United States Patent 7,655,785 (BIOINFORMATICALLY DETECTABLE GROUP OF NOVEL REGULATORY OLIGONUCLEOTIDES AND USES THEREOF) - sequence listing, part 17

SEQ ID NO: 666469 - RNA, 14 nt, Homo sapiens
ggccuuaaccauga

SEQ ID NO: 666470 - RNA, 15 nt, Homo sapiens
ggccuuaauggacau

SEQ ID NO: 666471 - RNA, 22 nt, Homo sapiens
ggccuuaauuuucaguauaauu

SEQ ID NO: 666472 - RNA, 13 nt, Homo sapiens
ggccuuagcagua

SEQ ID NO: 666473 - RNA, 22 nt, Homo sapiens
ggccuucaguuuauuuccacua

SEQ ID NO: 666474 - RNA, 17 nt, Homo sapiens
ggccuucccauggccau

SEQ ID NO: 666475 - RNA, 11 nt, Homo sapiens
ggccuugcccg

SEQ ID NO: 666476 - RNA, 12 nt, Homo sapiens
ggccuugcucug

SEQ ID NO: 666477 - RNA, 18 nt, Homo sapiens
ggccuugguaugugccag

SEQ ID NO: 666478 - RNA, 14 nt, Homo sapiens
ggccuuguggcacu

SEQ ID NO: 666479 - RNA, 16 nt, Homo sapiens
ggccuuuaagaaccuu

SEQ ID NO: 666480 - RNA, 15 nt, Homo sapiens
ggccuuugcucuuac

SEQ ID NO: 666481 - RNA, 20 nt, Homo sapiens
ggccuuuucugugccagaca

SEQ ID NO: 666482 - RNA, 22 nt, Homo sapiens
ggccuuuugcccguugagguag

SEQ ID NO: 666483 - RNA, 15 nt, Homo sapiens
ggccuuuuuugccag

SEQ ID NO: 666484 - RNA, 21 nt, Homo sapiens
ggcgaaucauuuguucaaagc

SEQ ID NO: 666485 - RNA, 21 nt, Homo sapiens
ggcgacaagagugagacucca

SEQ ID NO: 666486 - RNA, 20 nt, Homo sapiens
ggcgacagagcgagacucca

SEQ ID NO: 666487 - RNA, 21 nt, Homo sapiens
ggcgaccuccuuucaucacac

SEQ ID NO: 666488 - RNA, 17 nt, Homo sapiens
ggcgagccgcgggcgcu

SEQ ID NO: 666489 - RNA, 20 nt, Homo sapiens
ggcgaugugcaaguguaugc

SEQ ID NO: 666490 - RNA, 13 nt, Homo sapiens
ggcgcagugcuuc

SEQ ID NO: 666491 - RNA, 21 nt, Homo sapiens
ggcgcaguggcucaugccugu

SEQ ID NO: 666492 - RNA, 17 nt, Homo sapiens
ggcgccaucgccaagua

SEQ ID NO: 666493 - RNA, 15 nt, Homo sapiens
ggcgcccccgcccca

SEQ ID NO: 666494 - RNA, 17 nt, Homo sapiens
ggcgcccgggauccagc

SEQ ID NO: 666495 - RNA, 22 nt, Homo sapiens
ggcgcccuuggcuucugugaug

SEQ ID NO: 666496 - RNA, 18 nt, Homo sapiens
ggcgcugcuuugucaaaa

SEQ ID NO: 666497 - RNA, 22 nt, Homo sapiens
ggcgcuugcaccacuuccgucc

SEQ ID NO: 666498 - RNA, 14 nt, Homo sapiens
ggcggaucaucuaa

SEQ ID NO: 666499 - RNA, 14 nt, Homo sapiens
ggcggccugcagug

SEQ ID NO: 666500 - RNA, 16 nt, Homo sapiens
ggcgggcagggguucc

SEQ ID NO: 666501 - RNA, 15 nt, Homo sapiens
ggcggggacugcugg

SEQ ID NO: 666502 - RNA, 22 nt, Homo sapiens
ggcgggguauucccacucacca

SEQ ID NO: 666503 - RNA, 20 nt, Homo sapiens
ggcggguggaucacaagguc

SEQ ID NO: 666504 - RNA, 21 nt, Homo sapiens
ggcggugucaggucccagcga

SEQ ID NO: 666505 - RNA, 16 nt, Homo sapiens
ggcgucccuaccuccu

SEQ ID NO: 666506 - RNA, 18 nt, Homo sapiens
ggcguggaggaggaggga

SEQ ID NO: 666507 - RNA, 16 nt, Homo sapiens
ggcguggcccguggcu

SEQ ID NO: 666508 - RNA, 19 nt, Homo sapiens
ggcgugggggcacugacca

SEQ ID NO: 666509 - RNA, 14 nt, Homo sapiens
ggcgugggucucug

SEQ ID NO: 666510 - RNA, 22 nt, Homo sapiens
ggcguuacugcuugaccaaaga

SEQ ID NO: 666511 - RNA, 19 nt, Homo sapiens
ggcuaaaugaaguguguua

SEQ ID NO: 666512 - RNA, 23 nt, Homo sapiens
ggcuaagucaagaucaacauucc

SEQ ID NO: 666513 - RNA, 21 nt, Homo sapiens
ggcuaauaaacuuugugcuga

SEQ ID NO: 666514 - RNA, 21 nt, Homo sapiens
ggcuaauucccagagugugaa

SEQ ID NO: 666515 - RNA, 23 nt, Homo sapiens
ggcuaauuuaacaagaacuuuaa

SEQ ID NO: 666516 - RNA, 23 nt, Homo sapiens
ggcuacaaagcguuucuuuacuu

SEQ ID NO: 666517 - RNA, 17 nt, Homo sapiens
ggcuaccucaccugggc

SEQ ID NO: 666518 - RNA, 23 nt, Homo sapiens
ggcuacuaccuagggcacuuuaa

SEQ ID NO: 666519 - RNA, 18 nt, Homo sapiens
ggcuacucuugacuuaga

SEQ ID NO: 666520 - RNA, 19 nt, Homo sapiens
ggcuagagugcaauggcgc

SEQ ID NO: 666521 - RNA, 14 nt, Homo sapiens
ggcuagcuucugcu

SEQ ID NO: 666522 - RNA, 23 nt, Homo sapiens
ggcuagucuucccuuaccucaaa

SEQ ID NO: 666523 - RNA, 17 nt, Homo sapiens
ggcuagugaaguggccu

SEQ ID NO: 666524 - RNA, 13 nt, Homo sapiens
ucugcucccucug

SEQ ID NO: 666525 - RNA, 22 nt, Homo sapiens
ucugcuccuuagacaccugaau

SEQ ID NO: 666526 - RNA, 21 nt, Homo sapiens
ucugcucuagggaaucuggau

SEQ ID NO: 666527 - RNA, 23 nt, Homo sapiens
ucugcucuuucucugccagugac

SEQ ID NO: 666528 - RNA, 18 nt, Homo sapiens
ucugcugaaugcagggaa

SEQ ID NO: 666529 - RNA, 15 nt, Homo sapiens
ucugcugcaguuacc

SEQ ID NO: 666530 - RNA, 16 nt, Homo sapiens
ucugcugcucugaccu

SEQ ID NO: 666531 - RNA, 23 nt, Homo sapiens
ucugcuggggauggccacuguga

SEQ ID NO: 666532 - RNA, 16 nt, Homo sapiens
ucugcugggugugacc

SEQ ID NO: 666533 - RNA, 12 nt, Homo sapiens
ucugcugucuaa

SEQ ID NO: 666534 - RNA, 22 nt, Homo sapiens
ucugcuuacaauucccugcugu

SEQ ID NO: 666535 - RNA, 19 nt, Homo sapiens
ucugcuuagaaauaacaga

SEQ ID NO: 666536 - RNA, 17 nt, Homo sapiens
ucugcuuuucccauugc

SEQ ID NO: 666537 - RNA, 19 nt, Homo sapiens
ucugcuuuugaaaucugua

SEQ ID NO: 666538 - RNA, 23 nt, Homo sapiens
ucuggaaaaaaacaaaaacagaa

SEQ ID NO: 666539 - RNA, 19 nt, Homo sapiens
ucuggaaaacucaggauuc

SEQ ID NO: 666540 - RNA, 14 nt, Homo sapiens
ucuggaaaagcaaa

SEQ ID NO: 666541 - RNA, 13 nt, Homo sapiens
ggcucaugaccug

SEQ ID NO: 666542 - RNA, 23 nt, Homo sapiens
ggcuccacaccuccaaugcugcc

SEQ ID NO: 666543 - RNA, 13 nt, Homo sapiens
ggcuccacuggga

SEQ ID NO: 666544 - RNA, 14 nt, Homo sapiens
ggcuccagcaccuu

SEQ ID NO: 666545 - RNA, 17 nt, Homo sapiens
ggcuccauccguggcug

SEQ ID NO: 666546 - RNA, 14 nt, Homo sapiens
ggcuccuccuuaug

SEQ ID NO: 666547 - RNA, 19 nt, Homo sapiens
ggcuccuugcccucaagca

SEQ ID NO: 666548 - RNA, 21 nt, Homo sapiens
ggcuccuuggauguagucagu

SEQ ID NO: 666549 - RNA, 22 nt, Homo sapiens
ggcucgccaugccggggguuca

SEQ ID NO: 666550 - RNA, 19 nt, Homo sapiens
ggcucgucagccaccuggg

SEQ ID NO: 666551 - RNA, 19 nt, Homo sapiens
ggcucuaauguacaauaaa

SEQ ID NO: 666552 - RNA, 16 nt, Homo sapiens
ggcucucaacagggga

SEQ ID NO: 666553 - RNA, 20 nt, Homo sapiens
ggcucucagggaacagcagc

SEQ ID NO: 666554 - RNA, 12 nt, Homo sapiens
ggcucuccuagg

SEQ ID NO: 666555 - RNA, 15 nt, Homo sapiens
ggcucugcaggccac

SEQ ID NO: 666556 - RNA, 19 nt, Homo sapiens
ggcucugguaugaauucac

SEQ ID NO: 666557 - RNA, 21 nt, Homo sapiens
ggcucugugcagucacuggag

SEQ ID NO: 666558 - RNA, 16 nt, Homo sapiens
ggcucuugacuacuug

SEQ ID NO: 666559 - RNA, 18 nt, Homo sapiens
ggcucuuuccuugcucaa

SEQ ID NO: 666560 - RNA, 15 nt, Homo sapiens
ggcugaacucucccc

SEQ ID NO: 666561 - RNA, 21 nt, Homo sapiens
ggcugaagcgagcccucagga

SEQ ID NO: 666562 - RNA, 23 nt, Homo sapiens
ggcugacaccuaccaugcugcuu

SEQ ID NO: 666563 - RNA, 18 nt, Homo sapiens
ggcugaccuagaccaguu

SEQ ID NO: 666564 - RNA, 22 nt, Homo sapiens
ggcugacggugcagucugggug

SEQ ID NO: 666565 - RNA, 17 nt, Homo sapiens
ggcugagaacuggacag

SEQ ID NO: 666566 - RNA, 14 nt, Homo sapiens
ggcugagcuagccu

SEQ ID NO: 666567 - RNA, 15 nt, Homo sapiens
ggcugagcucuuauc

SEQ ID NO: 666568 - RNA, 22 nt, Homo sapiens
ggcugaggcagcagacuggugu

SEQ ID NO: 666569 - RNA, 13 nt, Homo sapiens
ggcugaugaucca

SEQ ID NO: 666570 - RNA, 15 nt, Homo sapiens
ggcugcacaacagcc

SEQ ID NO: 666571 - RNA, 16 nt, Homo sapiens
ggcugcacagcucaac

SEQ ID NO: 666572 - RNA, 17 nt, Homo sapiens
ggcugcacccacccagg

SEQ ID NO: 666573 - RNA, 16 nt, Homo sapiens
ggcugcagaugaucag

SEQ ID NO: 666574 - RNA, 20 nt, Homo sapiens
ggcugcagaugaucagggau

SEQ ID NO: 666575 - RNA, 19 nt, Homo sapiens
ggcugcccuugggugacac

SEQ ID NO: 666576 - RNA, 16 nt, Homo sapiens
ggcugcuaggccagag

SEQ ID NO: 666577 - RNA, 12 nt, Homo sapiens
ggcugcugagaa

SEQ ID NO: 666578 - RNA, 21 nt, Homo sapiens
ggcugcuggaaacacagucac

SEQ ID NO: 666579 - RNA, 17 nt, Homo sapiens
ggcugcuggccaugaau

SEQ ID NO: 666580 - RNA, 18 nt, Homo sapiens
ggcugcuggggccucaga

SEQ ID NO: 666581 - RNA, 16 nt, Homo sapiens
ggcuggaaucucauga

SEQ ID NO: 666582 - RNA, 22 nt, Homo sapiens
ggcuggacuggaggugggcaug

SEQ ID NO: 666583 - RNA, 16 nt, Homo sapiens
ggcuggagcugccucu

SEQ ID NO: 666584 - RNA, 20 nt, Homo sapiens
ggcuggaggacaguggcaca

SEQ ID NO: 666585 - RNA, 15 nt, Homo sapiens
ggcuggagguaggcu

SEQ ID NO: 666586 - RNA, 16 nt, Homo sapiens
ggcuggagugcaaugg

SEQ ID NO: 666587 - RNA, 19 nt, Homo sapiens
ggcuggagugcaauggugu

SEQ ID NO: 666588 - RNA, 16 nt, Homo sapiens
ggcuggagugcagugg

SEQ ID NO: 666589 - RNA, 20 nt, Homo sapiens
ggcuggagugcaguggcaug

SEQ ID NO: 666590 - RNA, 20 nt, Homo sapiens
ggcuggaguguaguggcgcg

SEQ ID NO: 666591 - RNA, 19 nt, Homo sapiens
ggcuggcaccauggugacu

SEQ ID NO: 666592 - RNA, 11 nt, Homo sapiens
ggcuggcacug

SEQ ID NO: 666593 - RNA, 22 nt, Homo sapiens
ggcugggaauggggacacggug

SEQ ID NO: 666594 - RNA, 18 nt, Homo sapiens
ggcugggagguugggagg

SEQ ID NO: 666595 - RNA, 11 nt, Homo sapiens
ggcugggcuag

SEQ ID NO: 666596 - RNA, 22 nt, Homo sapiens
ggcuggggacucuggcacagug

SEQ ID NO: 666597 - RNA, 17 nt, Homo sapiens
ggcugguaacaguucau

SEQ ID NO: 666598 - RNA, 13 nt, Homo sapiens
ggcuggucacucu

SEQ ID NO: 666599 - RNA, 14 nt, Homo sapiens
ggcuggucuugggg

SEQ ID NO: 666600 - RNA, 13 nt, Homo sapiens
ggcuggugacaga

SEQ ID NO: 666601 - RNA, 12 nt, Homo sapiens
ggcugguggcca

SEQ ID NO: 666602 - RNA, 13 nt, Homo sapiens
ggcugugacuccc

SEQ ID NO: 666603 - RNA, 17 nt, Homo sapiens
ggcuguuccagacucag

SEQ ID NO: 666604 - RNA, 18 nt, Homo sapiens
ggcuguucccuuugccuu

SEQ ID NO: 666605 - RNA, 16 nt, Homo sapiens
ggcuguugcucaggag

SEQ ID NO: 666606 - RNA, 19 nt, Homo sapiens
ggcuguuucuugucuguua

SEQ ID NO: 666607 - RNA, 19 nt, Homo sapiens
ggcuuaagugagcagaaca

SEQ ID NO: 666608 - RNA, 21 nt, Homo sapiens
ggcuuagacuucgacucagga

SEQ ID NO: 666609 - RNA, 18 nt, Homo sapiens
ggcuuaggaaagugauau

SEQ ID NO: 666610 - RNA, 16 nt, Homo sapiens
ggcuuauccacuuuga

SEQ ID NO: 666611 - RNA, 11 nt, Homo sapiens
ggcuucacagc

SEQ ID NO: 666612 - RNA, 19 nt, Homo sapiens
ggcuucacugcugugacuu

SEQ ID NO: 666613 - RNA, 11 nt, Homo sapiens
ggcuuccaucc

SEQ ID NO: 666614 - RNA, 14 nt, Homo sapiens
ggcuuccugcugag

SEQ ID NO: 666615 - RNA, 23 nt, Homo sapiens
ggcuucucucucuagcagcaccu

SEQ ID NO: 666616 - RNA, 14 nt, Homo sapiens
ggcuucucugucuc

SEQ ID NO: 666617 - RNA, 13 nt, Homo sapiens
ggcuucugugaug

SEQ ID NO: 666618 - RNA, 22 nt, Homo sapiens
ggcuucuuccuccuccaucacc

SEQ ID NO: 666619 - RNA, 16 nt, Homo sapiens
ggcuugacaugugcaa

SEQ ID NO: 666620 - RNA, 10 nt, Homo sapiens
ggcuugacuc

SEQ ID NO: 666621 - RNA, 14 nt, Homo sapiens
ggcuuggaccacuu

SEQ ID NO: 666622 - RNA, 16 nt, Homo sapiens
ggcuuggaguggccaa

SEQ ID NO: 666623 - RNA, 15 nt, Homo sapiens
ggcuuggcagccagu

SEQ ID NO: 666624 - RNA, 17 nt, Homo sapiens
ggcuuguccucaucucu

SEQ ID NO: 666625 - RNA, 16 nt, Homo sapiens
ggcuuguccugugcuu

SEQ ID NO: 666626 - RNA, 22 nt, Homo sapiens
ggcuuguuuuccaaagaaaagu

SEQ ID NO: 666627 - RNA, 15 nt, Homo sapiens
ggcuuuaaaagucau

SEQ ID NO: 666628 - RNA, 20 nt, Homo sapiens
ggcuuuaauagucaccuuca

SEQ ID NO: 666629 - RNA, 15 nt, Homo sapiens
ggcuuucacugcuga

SEQ ID NO: 666630 - RNA, 15 nt, Homo sapiens
ggcuuucagagccag

SEQ ID NO: 666631 - RNA, 19 nt, Homo sapiens
ggcuuuguaugacagugaa

SEQ ID NO: 666632 - RNA, 21 nt, Homo sapiens
ggcuuuguuuuuugugcuauu

SEQ ID NO: 666633 - RNA, 16 nt, Homo sapiens
ggcuuuucccuugcuu

SEQ ID NO: 666634 - RNA, 21 nt, Homo sapiens
gggaaaaguuagucaauccug

SEQ ID NO: 666635 - RNA, 16 nt, Homo sapiens
gggaaacacacaagca

SEQ ID NO: 666636 - RNA, 22 nt, Homo sapiens
gggaaacuuagaucaucaguca

SEQ ID NO: 666637 - RNA, 14 nt, Homo sapiens
gggaaagaaaggga

SEQ ID NO: 666638 - RNA, 21 nt, Homo sapiens
gggaaaggauauuuucuucca

SEQ ID NO: 666639 - RNA, 19 nt, Homo sapiens
gggaaaguaaauauuucag

SEQ ID NO: 666640 - RNA, 14 nt, Homo sapiens
gggaaauccauucc

SEQ ID NO: 666641 - RNA, 21 nt, Homo sapiens
gggaaccaugaagacaggaug

SEQ ID NO: 666642 - RNA, 16 nt, Homo sapiens
gggaacggacugguau

SEQ ID NO: 666643 - RNA, 14 nt, Homo sapiens
gggaagaagggaua

SEQ ID NO: 666644 - RNA, 13 nt, Homo sapiens
gggaagaccagcu

SEQ ID NO: 666645 - RNA, 14 nt, Homo sapiens
gggaagacuguggc

SEQ ID NO: 666646 - RNA, 22 nt, Homo sapiens
gggcuagucuucccuuaccuca

SEQ ID NO: 666647 - RNA, 17 nt, Homo sapiens
gggcuauagcacacagu

SEQ ID NO: 666648 - RNA, 17 nt, Homo sapiens
gggcuauauuucaguga

SEQ ID NO: 666649 - RNA, 22 nt, Homo sapiens
gggcucaccagcugggguccug

SEQ ID NO: 666650 - RNA, 12 nt, Homo sapiens
gggcucagcaaa

SEQ ID NO: 666651 - RNA, 15 nt, Homo sapiens
gggcuccagccaucu

SEQ ID NO: 666652 - RNA, 19 nt, Homo sapiens
gggcuccgggucacugcug

SEQ ID NO: 666653 - RNA, 22 nt, Homo sapiens
gggcuccugcauccucacugug

SEQ ID NO: 666654 - RNA, 16 nt, Homo sapiens
gggcucuacgucccag

SEQ ID NO: 666655 - RNA, 22 nt, Homo sapiens
gggcucuuccaacaaggaagaa

SEQ ID NO: 666656 - RNA, 23 nt, Homo sapiens
gggcucuucugagcagaaauggc

SEQ ID NO: 666657 - RNA, 22 nt, Homo sapiens
gggcugagcccuggcaggauga

SEQ ID NO: 666658 - RNA, 17 nt, Homo sapiens
gggcugcagagggagac

SEQ ID NO: 666659 - RNA, 23 nt, Homo sapiens
gggcuggaggcccaggcugggaa

SEQ ID NO: 666660 - RNA, 20 nt, Homo sapiens
gggcuggaggcugagcugca

SEQ ID NO: 666661 - RNA, 18 nt, Homo sapiens
gggcuguccacuagacca

SEQ ID NO: 666662 - RNA, 15 nt, Homo sapiens
gggcuuacacgugga

SEQ ID NO: 666663 - RNA, 15 nt, Homo sapiens
gggcuuaccagguga

SEQ ID NO: 666664 - RNA, 16 nt, Homo sapiens
gggcuuaccaggugag

SEQ ID NO: 666665 - RNA, 14 nt, Homo sapiens
ucuguuuugcauau

SEQ ID NO: 666666 - RNA, 16 nt, Homo sapiens
ucuguuuugccuucac

SEQ ID NO: 666667 - RNA, 20 nt, Homo sapiens
ucuguuuuuuaaaugaucau

SEQ ID NO: 666668 - RNA, 16 nt, Homo sapiens
ucuuaaaaaacauaua

SEQ ID NO: 666669 - RNA, 14 nt, Homo sapiens
ucuuaaaaacugug

SEQ ID NO: 666670 - RNA, 14 nt, Homo sapiens
ucuuaaaacaaauu

SEQ ID NO: 666671 - RNA, 19 nt, Homo sapiens
ucuuaaacacaaauuucau

SEQ ID NO: 666672 - RNA, 16 nt, Homo sapiens
ucuuaaagcauuucag

SEQ ID NO: 666673 - RNA, 20 nt, Homo sapiens
ucuuaaauauguauaugaca

SEQ ID NO: 666674 - RNA, 14 nt, Homo sapiens
ucuuaaauauuucc

SEQ ID NO: 666675 - RNA, 23 nt, Homo sapiens
ucuuaaauguagcaauggcacug

SEQ ID NO: 666676 - RNA, 22 nt, Homo sapiens
ucuuaaauuuucuuccuuugaa

SEQ ID NO: 666677 - RNA, 19 nt, Homo sapiens
ucuuaacauuuuguauaaa

SEQ ID NO: 666678 - RNA, 16 nt, Homo sapiens
ucuuaaccuauuuauu

SEQ ID NO: 666679 - RNA, 19 nt, Homo sapiens
ucuuaaccuuugcuaugua

SEQ ID NO: 666680 - RNA, 15 nt, Homo sapiens
ucuuaacucuuuaaa

SEQ ID NO: 666681 - RNA, 19 nt, Homo sapiens
ucuuaacuuugaaccauaa

SEQ ID NO: 666682 - RNA, 22 nt, Homo sapiens
ucuuaagauccacaaaugaagg

SEQ ID NO: 666683 - RNA, 16 nt, Homo sapiens
ucuuaaggaaauggug

SEQ ID NO: 666684 - RNA, 15 nt, Homo sapiens
ucuuaauaaucucau

SEQ ID NO: 666685 - RNA, 23 nt, Homo sapiens
ucuuaauauaaauucacuuucau

SEQ ID NO: 666686 - RNA, 17 nt, Homo sapiens
ucuuacaauugcacugc

SEQ ID NO: 666687 - RNA, 20 nt, Homo sapiens
ucuuacacaggcuucaucaa

SEQ ID NO: 666688 - RNA, 14 nt, Homo sapiens
ucuuacacuacauu

SEQ ID NO: 666689 - RNA, 16 nt, Homo sapiens
ucuuacaucuguaaag

SEQ ID NO: 666690 - RNA, 13 nt, Homo sapiens
ucuuacaugcauu

SEQ ID NO: 666691 - RNA, 16 nt, Homo sapiens
ucuuacaugcauuuga

SEQ ID NO: 666692 - RNA, 12 nt, Homo sapiens
ucuuaccagauc

SEQ ID NO: 666693 - RNA, 14 nt, Homo sapiens
ucuuacccaaagca

SEQ ID NO: 666694 - RNA, 19 nt, Homo sapiens
ucuuacccgaaagcaucac

SEQ ID NO: 666695 - RNA, 17 nt, Homo sapiens
ucuuaccuaaacugagc

SEQ ID NO: 666696 - RNA, 14 nt, Homo sapiens
ucuuaccugugcuu

SEQ ID NO: 666697 - RNA, 21 nt, Homo sapiens
ucuuacguucuuucacuucaa

SEQ ID NO: 666698 - RNA, 18 nt, Homo sapiens
ucuuacuccuggcuuuaa

SEQ ID NO: 666699 - RNA, 12 nt, Homo sapiens
ucuuacuguugc

SEQ ID NO: 666700 - RNA, 20 nt, Homo sapiens
ucuuagaagcacuacaccuu

SEQ ID NO: 666701 - RNA, 17 nt, Homo sapiens
ucuuagaagccauggga

SEQ ID NO: 666702 - RNA, 16 nt, Homo sapiens
ucuuagaaguggacca

SEQ ID NO: 666703 - RNA, 22 nt, Homo sapiens
ucuuagacuuugcaagcagaga

SEQ ID NO: 666704 - RNA, 21 nt, Homo sapiens
ucuuagauguauauauuuccu

SEQ ID NO: 666705 - RNA, 16 nt, Homo sapiens
ucuuagauucagggga

SEQ ID NO: 666706 - RNA, 15 nt, Homo sapiens
ucuuagauucuuaau

SEQ ID NO: 666707 - RNA, 17 nt, Homo sapiens
ucuuagccccagacucu

SEQ ID NO: 666708 - RNA, 17 nt, Homo sapiens
ucuuagcucuaccggga

SEQ ID NO: 666709 - RNA, 21 nt, Homo sapiens
ucuuagcucuuaauuguucau

SEQ ID NO: 666710 - RNA, 16 nt, Homo sapiens
ucuuagcuuacaggaa

SEQ ID NO: 666711 - RNA, 15 nt, Homo sapiens
ucuuaggagcaagaa

SEQ ID NO: 666712 - RNA, 21 nt, Homo sapiens
ucuuagugcaaaaaacauacu

SEQ ID NO: 666713 - RNA, 19 nt, Homo sapiens
ucuuagugcuucagaguuu

SEQ ID NO: 666714 - RNA, 21 nt, Homo sapiens
ucuuaguguuguggacacugc

SEQ ID NO: 666715 - RNA, 18 nt, Homo sapiens
ucuuaguugacaaccuag

SEQ ID NO: 666716 - RNA, 18 nt, Homo sapiens
ucuuauaauacucuguug

SEQ ID NO: 666717 - RNA, 21 nt, Homo sapiens
ucuuauccaacaucaacaucu

SEQ ID NO: 666718 - RNA, 18 nt, Homo sapiens
ucuuaucccagugaucac

SEQ ID NO: 666719 - RNA, 20 nt, Homo sapiens
ucuuaucccuugacaaaaau

SEQ ID NO: 666720 - RNA, 12 nt, Homo sapiens
ucuuaucuuucu

SEQ ID NO: 666721 - RNA, 23 nt, Homo sapiens
ucuuaucuuuuggcuucugcaga

SEQ ID NO: 666722 - RNA, 22 nt, Homo sapiens
ucuuaugauuacuaucauggca

SEQ ID NO: 666723 - RNA, 17 nt, Homo sapiens
ucuuaugcaaucuaugu

SEQ ID NO: 666724 - RNA, 16 nt, Homo sapiens
ucuuaugugugccuuu

SEQ ID NO: 666725 - RNA, 14 nt, Homo sapiens
ucuuauuaaucaua

SEQ ID NO: 666726 - RNA, 16 nt, Homo sapiens
ucuuauuuaacuuaac

SEQ ID NO: 666727 - RNA, 16 nt, Homo sapiens
ucuuauuuaaugaaag

SEQ ID NO: 666728 - RNA, 16 nt, Homo sapiens
ucuuauuuugcauucc

SEQ ID NO: 666729 - RNA, 22 nt, Homo sapiens
ucuucaaacugugaagcauuua

SEQ ID NO: 666730 - RNA, 20 nt, Homo sapiens
ucuucaaaucucagcaaagc

SEQ ID NO: 666731 - RNA, 15 nt, Homo sapiens
ucuucaacaugacau

SEQ ID NO: 666732 - RNA, 22 nt, Homo sapiens
ucuucaaccucauugacaagaa

SEQ ID NO: 666733 - RNA, 12 nt, Homo sapiens
ucuucaagagcu

SEQ ID NO: 666734 - RNA, 19 nt, Homo sapiens
ucuucaaugucaacagauc

SEQ ID NO: 666735 - RNA, 18 nt, Homo sapiens
ucuucaauuuggauauuu

SEQ ID NO: 666736 - RNA, 22 nt, Homo sapiens
ucuucacacgauugaccugucc

SEQ ID NO: 666737 - RNA, 18 nt, Homo sapiens
ucuucacaggcacuccug

SEQ ID NO: 666738 - RNA, 24 nt, Homo sapiens
ucuucaccauuuggcaaugccauc

SEQ ID NO: 666739 - RNA, 23 nt, Homo sapiens
ucuucacucuauacuuaaucuca

SEQ ID NO: 666740 - RNA, 15 nt, Homo sapiens
ucuucacucucugaa

SEQ ID NO: 666741 - RNA, 16 nt, Homo sapiens
ucuucacucucugaag

SEQ ID NO: 666742 - RNA, 16 nt, Homo sapiens
ucuucacucuuugaag

SEQ ID NO: 666743 - RNA, 20 nt, Homo sapiens
ucuucacugucugacuuuag

SEQ ID NO: 666744 - RNA, 18 nt, Homo sapiens
ucuucacuucuaaaugca

SEQ ID NO: 666745 - RNA, 21 nt, Homo sapiens
ucuucacuucuaaaugcauau

SEQ ID NO: 666746 - RNA, 22 nt, Homo sapiens
ucuucacuucuaaaugcauauc

SEQ ID NO: 666747 - RNA, 18 nt, Homo sapiens
ucuucagaacuugucagg

SEQ ID NO: 666748 - RNA, 17 nt, Homo sapiens
ucuucagcacauuccac

SEQ ID NO: 666749 - RNA, 16 nt, Homo sapiens
ucuucaggccucccuc

SEQ ID NO: 666750 - RNA, 13 nt, Homo sapiens
ucuucauucagug

SEQ ID NO: 666751 - RNA, 15 nt, Homo sapiens
ucuucauuucaggaa

SEQ ID NO: 666752 - RNA, 22 nt, Homo sapiens
ucuuccagugguuugagacacu

SEQ ID NO: 666753 - RNA, 14 nt, Homo sapiens
ucuucccaugacug

SEQ ID NO: 666754 - RNA, 15 nt, Homo sapiens
ucuucccccaccacc

SEQ ID NO: 666755 - RNA, 14 nt, Homo sapiens
ucuucccgugugua

SEQ ID NO: 666756 - RNA, 15 nt, Homo sapiens
ucuucccguguguau

SEQ ID NO: 666757 - RNA, 15 nt, Homo sapiens
ucuucccucucugca

SEQ ID NO: 666758 - RNA, 22 nt, Homo sapiens
ucuucccucucugcagacuucc

SEQ ID NO: 666759 - RNA, 23 nt, Homo sapiens
ucuucccugggcugccaccagcc

SEQ ID NO: 666760 - RNA, 23 nt, Homo sapiens
ucuucccuguaugauuccuugau

SEQ ID NO: 666761 - RNA, 17 nt, Homo sapiens
ucuucccuuccuccauu

SEQ ID NO: 666762 - RNA, 20 nt, Homo sapiens
ucuuccuacccuccuuccac

SEQ ID NO: 666763 - RNA, 19 nt, Homo sapiens
ucuuccuccucgcugccag

SEQ ID NO: 666764 - RNA, 23 nt, Homo sapiens
ucuuccuccucgcugccagauga

SEQ ID NO: 666765 - RNA, 23 nt, Homo sapiens
ucuuccugacauuugucagugau

SEQ ID NO: 666766 - RNA, 13 nt, Homo sapiens
ucuuccugcaaag

SEQ ID NO: 666767 - RNA, 12 nt, Homo sapiens
ggguuuugcucu

SEQ ID NO: 666768 - RNA, 23 nt, Homo sapiens
ggguuuuuguucuggaagccaua

SEQ ID NO: 666769 - RNA, 20 nt, Homo sapiens
gguaaaaaucuguaaauauc

SEQ ID NO: 666770 - RNA, 18 nt, Homo sapiens
gguaaaaguaccacacaa

SEQ ID NO: 666771 - RNA, 18 nt, Homo sapiens
gguaaaauggcaguuuga

SEQ ID NO: 666772 - RNA, 17 nt, Homo sapiens
gguaaauacugugaaau

SEQ ID NO: 666773 - RNA, 21 nt, Homo sapiens
gguaacauaacaacaacaguu

SEQ ID NO: 666774 - RNA, 19 nt, Homo sapiens
gguaacugcuuucuguucc

SEQ ID NO: 666775 - RNA, 17 nt, Homo sapiens
gguaagcaaaacuuucc

SEQ ID NO: 666776 - RNA, 19 nt, Homo sapiens
gguaauaaucaaauuuaag

SEQ ID NO: 666777 - RNA, 20 nt, Homo sapiens
gguaauauaaaguguaauag

SEQ ID NO: 666778 - RNA, 21 nt, Homo sapiens
gguaauauugacuuguauauu

SEQ ID NO: 666779 - RNA, 11 nt, Homo sapiens
gguaaucagca

SEQ ID NO: 666780 - RNA, 23 nt, Homo sapiens
gguaauguuggaugaugaaacau

SEQ ID NO: 666781 - RNA, 14 nt, Homo sapiens
gguaauuguugcua

SEQ ID NO: 666782 - RNA, 14 nt, Homo sapiens
gguacaauuguaaa

SEQ ID NO: 666783 - RNA, 13 nt, Homo sapiens
gguacagcagggu

SEQ ID NO: 666784 - RNA, 18 nt, Homo sapiens
gguacauaggcuucuauu

SEQ ID NO: 666785 - RNA, 18 nt, Homo sapiens
gguacauuuaucacugaa

SEQ ID NO: 666786 - RNA, 11 nt, Homo sapiens
gguacauuucu

SEQ ID NO: 666787 - RNA, 16 nt, Homo sapiens
gguacgaugacagugu

SEQ ID NO: 666788 - RNA, 17 nt, Homo sapiens
ucuucugugugaccaug

SEQ ID NO: 666789 - RNA, 14 nt, Homo sapiens
ucuucuucauugaa

SEQ ID NO: 666790 - RNA, 20 nt, Homo sapiens
ucuucuugugauugcugcca

SEQ ID NO: 666791 - RNA, 16 nt, Homo sapiens
ucuucuuuauugcacu

SEQ ID NO: 666792 - RNA, 22 nt, Homo sapiens
ucuucuuuuggcuuccaugaug

SEQ ID NO: 666793 - RNA, 12 nt, Homo sapiens
ucuugaaaaaga

SEQ ID NO: 666794 - RNA, 13 nt, Homo sapiens
ucuugaaagcugu

SEQ ID NO: 666795 - RNA, 20 nt, Homo sapiens
ucuugaaauuaagaaggcaa

SEQ ID NO: 666796 - RNA, 17 nt, Homo sapiens
ucuugaaccugugcuca

SEQ ID NO: 666797 - RNA, 23 nt, Homo sapiens
ucuugaagaauaaauucuaccuc

SEQ ID NO: 666798 - RNA, 17 nt, Homo sapiens
ucuugaauagacuucca

SEQ ID NO: 666799 - RNA, 20 nt, Homo sapiens
ucuugacauucaaggcauuu

SEQ ID NO: 666800 - RNA, 19 nt, Homo sapiens
ucuugacguuuacauauau

SEQ ID NO: 666801 - RNA, 19 nt, Homo sapiens
ucuugacuacagucaggaa

SEQ ID NO: 666802 - RNA, 22 nt, Homo sapiens
ucuugaguucuggaagggacuu

SEQ ID NO: 666803 - RNA, 20 nt, Homo sapiens
ucuugaucucaaagcacaau

SEQ ID NO: 666804 - RNA, 20 nt, Homo sapiens
ucuugaucuuugagcccauu

SEQ ID NO: 666805 - RNA, 15 nt, Homo sapiens
ucuugcaacucugua

SEQ ID NO: 666806 - RNA, 15 nt, Homo sapiens
ucuugcaacuuguua

SEQ ID NO: 666807 - RNA, 24 nt, Homo sapiens
ucuugcacagucacugcucuucag

SEQ ID NO: 666808 - RNA, 13 nt, Homo sapiens
ucuugcaccccaa

SEQ ID NO: 666809 - RNA, 17 nt, Homo sapiens
ucuugcacugaauauau

SEQ ID NO: 666810 - RNA, 20 nt, Homo sapiens
ucuugccccagugugguuug

SEQ ID NO: 666811 - RNA, 15 nt, Homo sapiens
ucuugccccuugucc

SEQ ID NO: 666812 - RNA, 20 nt, Homo sapiens
ucuugcccuaggauacccag

SEQ ID NO: 666813 - RNA, 17 nt, Homo sapiens
ucuugccucucucagga

SEQ ID NO: 666814 - RNA, 10 nt, Homo sapiens
ucuugccuug

SEQ ID NO: 666815 - RNA, 14 nt, Homo sapiens
ucuugcuaccagua

SEQ ID NO: 666816 - RNA, 17 nt, Homo sapiens
ucuugcucugcauuuau

SEQ ID NO: 666817 - RNA, 20 nt, Homo sapiens
ucuugcugccagcuaauaag

SEQ ID NO: 666818 - RNA, 18 nt, Homo sapiens
ucuugcuggcucugagaa

SEQ ID NO: 666819 - RNA, 18 nt, Homo sapiens
ucuugcuggucuagucac

SEQ ID NO: 666820 - RNA, 24 nt, Homo sapiens
ucuugcuguaacucagacauucca

SEQ ID NO: 666821 - RNA, 14 nt, Homo sapiens
ucuuggaccccuga

SEQ ID NO: 666822 - RNA, 16 nt, Homo sapiens
ucuuggccuaaaccuc

SEQ ID NO: 666823 - RNA, 17 nt, Homo sapiens
ucuuggccuaaaccuca

SEQ ID NO: 666824 - RNA, 19 nt, Homo sapiens
ucuugggaagaccagcuuu

SEQ ID NO: 666825 - RNA, 20 nt, Homo sapiens
ucuugggaauuuucuuccaa

SEQ ID NO: 666826 - RNA, 19 nt, Homo sapiens
ucuugggcugagugcagcc

SEQ ID NO: 666827 - RNA, 21 nt, Homo sapiens
ucuugggcuuugcuagccugu

SEQ ID NO: 666828 - RNA, 12 nt, Homo sapiens
ucuuggggacua

SEQ ID NO: 666829 - RNA, 20 nt, Homo sapiens
ucuuggggacuaacccaaug

SEQ ID NO: 666830 - RNA, 19 nt, Homo sapiens
ucuugggucccccacguga

SEQ ID NO: 666831 - RNA, 13 nt, Homo sapiens
ucuugggucuugg

SEQ ID NO: 666832 - RNA, 18 nt, Homo sapiens
ucuugguaaaacauuacu

SEQ ID NO: 666833 - RNA, 15 nt, Homo sapiens
ucuuggucacauaca

SEQ ID NO: 666834 - RNA, 21 nt, Homo sapiens
ucuuggugugauugcacagaa

SEQ ID NO: 666835 - RNA, 14 nt, Homo sapiens
ucuugguucuuauu

SEQ ID NO: 666836 - RNA, 14 nt, Homo sapiens
ucuugguuuccaaa

SEQ ID NO: 666837 - RNA, 17 nt, Homo sapiens
ucuuguauucaugaaaa

SEQ ID NO: 666838 - RNA, 17 nt, Homo sapiens
ucuugucccuuucccua

SEQ ID NO: 666839 - RNA, 15 nt, Homo sapiens
ucuugucuaauuuuc

SEQ ID NO: 666840 - RNA, 23 nt, Homo sapiens
ucuugugaaggggucaccccagc

SEQ ID NO: 666841 - RNA, 15 nt, Homo sapiens
ucuugugaguggaua

SEQ ID NO: 666842 - RNA, 15 nt, Homo sapiens
ucuuguuacugcuga

SEQ ID NO: 666843 - RNA, 17 nt, Homo sapiens
ucuuguuauguacaaac

SEQ ID NO: 666844 - RNA, 19 nt, Homo sapiens
ucuuguucugagauucaau

SEQ ID NO: 666845 - RNA, 17 nt, Homo sapiens
ucuuguugagugccagc

SEQ ID NO: 666846 - RNA, 13 nt, Homo sapiens
ucuuguugcaaaa

SEQ ID NO: 666847 - RNA, 18 nt, Homo sapiens
ucuuguugcugcaucucc

SEQ ID NO: 666848 - RNA, 18 nt, Homo sapiens
ucuuguuuacaauaaaga

SEQ ID NO: 666849 - RNA, 22 nt, Homo sapiens
ucuuguuucaauuccaccugca

SEQ ID NO: 666850 - RNA, 15 nt, Homo sapiens
ucuuguuucacucca

SEQ ID NO: 666851 - RNA, 18 nt, Homo sapiens
ucuuguuuuaagugccuu

SEQ ID NO: 666852 - RNA, 17 nt, Homo sapiens
ucuuuaaaauaaggaua

SEQ ID NO: 666853 - RNA, 21 nt, Homo sapiens
ucuuuaaaccacuaaaauaca

SEQ ID NO: 666854 - RNA, 18 nt, Homo sapiens
ucuuuaaaggcaucuaca

SEQ ID NO: 666855 - RNA, 20 nt, Homo sapiens
ucuuuaaaggcaucuacaca

SEQ ID NO: 666856 - RNA, 13 nt, Homo sapiens
ucuuuaacacagc

SEQ ID NO: 666857 - RNA, 17 nt, Homo sapiens
ucuuuaauaaauugcuu

SEQ ID NO: 666858 - RNA, 21 nt, Homo sapiens
ucuuuaauguuguccaggaaa

SEQ ID NO: 666859 - RNA, 23 nt, Homo sapiens
ucuuuaauuuauaucagguguau

SEQ ID NO: 666860 - RNA, 21 nt, Homo sapiens
ucuuuacaaaacuacaugaga

SEQ ID NO: 666861 - RNA, 13 nt, Homo sapiens
ucuuuacucaggc

SEQ ID NO: 666862 - RNA, 15 nt, Homo sapiens
ucuuuagaugccaaa

SEQ ID NO: 666863 - RNA, 16 nt, Homo sapiens
ucuuuagcaagauauu

SEQ ID NO: 666864 - RNA, 17 nt, Homo sapiens
ucuuuagcaugcuacag

SEQ ID NO: 666865 - RNA, 14 nt, Homo sapiens
ucuuuagugucuga

SEQ ID NO: 666866 - RNA, 13 nt, Homo sapiens
ucuuuauacagcu

SEQ ID NO: 666867 - RNA, 16 nt, Homo sapiens
ucuuuauacagcugua

SEQ ID NO: 666868 - RNA, 20 nt, Homo sapiens
ucuuuauaucugaaccaaga

SEQ ID NO: 666869 - RNA, 18 nt, Homo sapiens
ucuuuauguccauaagcu

SEQ ID NO: 666870 - RNA, 20 nt, Homo sapiens
ucuuuaugucuuuugaugaa

SEQ ID NO: 666871 - RNA, 21 nt, Homo sapiens
ucuuuauuuuuguuaauauua

SEQ ID NO: 666872 - RNA, 17 nt, Homo sapiens
ucuuucacuggaaugaa

SEQ ID NO: 666873 - RNA, 21 nt, Homo sapiens
ucuuucaggacucuaccucau

SEQ ID NO: 666874 - RNA, 16 nt, Homo sapiens
ucuuuccacucuggau

SEQ ID NO: 666875 - RNA, 13 nt, Homo sapiens
ucuuuccauuuac

SEQ ID NO: 666876 - RNA, 16 nt, Homo sapiens
ucuuuccugaaccaug

SEQ ID NO: 666877 - RNA, 23 nt, Homo sapiens
ucuuuccuguaaagaaacauuuc

SEQ ID NO: 666878 - RNA, 23 nt, Homo sapiens
ucuuucguuuguuuguuucaaua

SEQ ID NO: 666879 - RNA, 12 nt, Homo sapiens
ucuuucuaccuc

SEQ ID NO: 666880 - RNA, 21 nt, Homo sapiens
ucuuucuagaggugcuacaua

SEQ ID NO: 666881 - RNA, 21 nt, Homo sapiens
ucuuucucuccccaaccccca

SEQ ID NO: 666882 - RNA, 14 nt, Homo sapiens
ucuuucucuuacaa

SEQ ID NO: 666883 - RNA, 20 nt, Homo sapiens
ucuuucugauaaugcauuag

SEQ ID NO: 666884 - RNA, 12 nt, Homo sapiens
ucuuucuguccc

SEQ ID NO: 666885 - RNA, 17 nt, Homo sapiens
ucuuucuuuaccugaga

SEQ ID NO: 666886 - RNA, 22 nt, Homo sapiens
ucuuucuuuacuuaacauaucu

SEQ ID NO: 666887 - RNA, 22 nt, Homo sapiens
ucuuucuuugcaccaaagacau

SEQ ID NO: 666888 - RNA, 19 nt, Homo sapiens
ucuuugacaauuccuagau

SEQ ID NO: 666889 - RNA, 12 nt, Homo sapiens
gucaaaccaaga

SEQ ID NO: 666890 - RNA, 11 nt, Homo sapiens
gucaaacugua

SEQ ID NO: 666891 - RNA, 19 nt, Homo sapiens
gucaaaugaugugcaaaac

SEQ ID NO: 666892 - RNA, 16 nt, Homo sapiens
gucaacaaaccaagca

SEQ ID NO: 666893 - RNA, 16 nt, Homo sapiens
gucaaccagugaggcu

SEQ ID NO: 666894 - RNA, 20 nt, Homo sapiens
gucaacggagggaguggcac

SEQ ID NO: 666895 - RNA, 19 nt, Homo sapiens
gucaacucuggccaggaac

SEQ ID NO: 666896 - RNA, 12 nt, Homo sapiens
gucaacugagag

SEQ ID NO: 666897 - RNA, 19 nt, Homo sapiens
gucaacuuuugacuaagaa

SEQ ID NO: 666898 - RNA, 23 nt, Homo sapiens
gucaagaagaaaaagguuugcau

SEQ ID NO: 666899 - RNA, 19 nt, Homo sapiens
gucaagaucaacauuccag

SEQ ID NO: 666900 - RNA, 13 nt, Homo sapiens
gucaagcaccugc

SEQ ID NO: 666901 - RNA, 21 nt, Homo sapiens
gucaagcaccugcaugugcug

SEQ ID NO: 666902 - RNA, 20 nt, Homo sapiens
gucaagcuguugaagucuca

SEQ ID NO: 666903 - RNA, 15 nt, Homo sapiens
gucaauaaaaugaac

SEQ ID NO: 666904 - RNA, 21 nt, Homo sapiens
gucaauaaaaugaaccugauc

SEQ ID NO: 666905 - RNA, 14 nt, Homo sapiens
gucaauacugagcc

SEQ ID NO: 666906 - RNA, 21 nt, Homo sapiens
gucaauauuaaauacagacac

SEQ ID NO: 666907 - RNA, 18 nt, Homo sapiens
gucaauccccucauucag

SEQ ID NO: 666908 - RNA, 14 nt, Homo sapiens
gucaauccugucau

SEQ ID NO: 666909 - RNA, 15 nt, Homo sapiens
gucaauccugucaua

SEQ ID NO: 666910 - RNA, 17 nt, Homo sapiens
gucaauccugucauaua

SEQ ID NO: 666911 - RNA, 13 nt, Homo sapiens
gucaauggaagaa

SEQ ID NO: 666912 - RNA, 19 nt, Homo sapiens
gucaauggcuuguucauca

SEQ ID NO: 666913 - RNA, 18 nt, Homo sapiens
gucaauggggguguagua

SEQ ID NO: 666914 - RNA, 23 nt, Homo sapiens
gucaauucugauguuacugagau

SEQ ID NO: 666915 - RNA, 23 nt, Homo sapiens
gucaauuucaguguaugauauac

SEQ ID NO: 666916 - RNA, 22 nt, Homo sapiens
gucacaacaacaacaacaaaaa

SEQ ID NO: 666917 - RNA, 22 nt, Homo sapiens
ugacuuacaagugggaagcagu

SEQ ID NO: 666918 - RNA, 18 nt, Homo sapiens
ugacuucagcugccugaa

SEQ ID NO: 666919 - RNA, 16 nt, Homo sapiens
ugacuuccccacugcu

SEQ ID NO: 666920 - RNA, 16 nt, Homo sapiens
ugacuuccugccaugg

SEQ ID NO: 666921 - RNA, 19 nt, Homo sapiens
ugacuucuccaggucucac

SEQ ID NO: 666922 - RNA, 21 nt, Homo sapiens
ugacuucuuuacuaacacugg

SEQ ID NO: 666923 - RNA, 22 nt, Homo sapiens
ugacuucuuuacuaacacuggc

SEQ ID NO: 666924 - RNA, 13 nt, Homo sapiens
ugacuugagccac

SEQ ID NO: 666925 - RNA, 19 nt, Homo sapiens
ugacuuuaauuuauguaac

SEQ ID NO: 666926 - RNA, 17 nt, Homo sapiens
ugacuuuagaaagcuga

SEQ ID NO: 666927 - RNA, 17 nt, Homo sapiens
ugacuuuagguucacau

SEQ ID NO: 666928 - RNA, 21 nt, Homo sapiens
ugacuuuauauggaugauuca

SEQ ID NO: 666929 - RNA, 17 nt, Homo sapiens
ugacuuuauugcaucug

SEQ ID NO: 666930 - RNA, 15 nt, Homo sapiens
ugacuuucugauuac

SEQ ID NO: 666931 - RNA, 18 nt, Homo sapiens
ugacuuugccaaagugua

SEQ ID NO: 666932 - RNA, 17 nt, Homo sapiens
ugacuuugcuccucaca

SEQ ID NO: 666933 - RNA, 21 nt, Homo sapiens
ugacuuugggaaagagggacc

SEQ ID NO: 666934 - RNA, 22 nt, Homo sapiens
ugagaaaaacuguucuuuugca

SEQ ID NO: 666935 - RNA, 19 nt, Homo sapiens
ugagaaaacagggaauaca

SEQ ID NO: 666936 - RNA, 14 nt, Homo sapiens
ugagaaaacuguga

SEQ ID NO: 666937 - RNA, 17 nt, Homo sapiens
ugagaaaauaucuugcu

SEQ ID NO: 666938 - RNA, 23 nt, Homo sapiens
ugagaaaauaucuugcuuucaaa

SEQ ID NO: 666939 - RNA, 22 nt, Homo sapiens
ugagaaacauuauuagcacuuc

SEQ ID NO: 666940 - RNA, 22 nt, Homo sapiens
ugagaaacucuacauguaacua

SEQ ID NO: 666941 - RNA, 15 nt, Homo sapiens
ugagaaacugauuua

SEQ ID NO: 666942 - RNA, 17 nt, Homo sapiens
ugagaaagagcacuuaa

SEQ ID NO: 666943 - RNA, 22 nt, Homo sapiens
ugagaaagagcacuuaagagaa

SEQ ID NO: 666944 - RNA, 23 nt, Homo sapiens
ugagaaauaaaaagccugucauu

SEQ ID NO: 666945 - RNA, 20 nt, Homo sapiens
ugagaaauauggacacuuaa

SEQ ID NO: 666946 - RNA, 22 nt, Homo sapiens
ugagaaaugaauaagcuuucuc

SEQ ID NO: 666947 - RNA, 23 nt, Homo sapiens
ugagaaaugggacuuaacuccuu

SEQ ID NO: 666948 - RNA, 22 nt, Homo sapiens
ugagaacauuaacaaaagcaau

SEQ ID NO: 666949 - RNA, 12 nt, Homo sapiens
ugagaacauucc

SEQ ID NO: 666950 - RNA, 20 nt, Homo sapiens
ugagaacccccuaaccucua

SEQ ID NO: 666951 - RNA, 14 nt, Homo sapiens
ugagaaccgugaca

SEQ ID NO: 666952 - RNA, 17 nt, Homo sapiens
ugagaaccgugacauca

SEQ ID NO: 666953 - RNA, 19 nt, Homo sapiens
ugagaaccgugacaucagc

SEQ ID NO: 666954 - RNA, 20 nt, Homo sapiens
ugagaagauaaucauugcuu

SEQ ID NO: 666955 - RNA, 16 nt, Homo sapiens
ugagaaggaacuucca

SEQ ID NO: 666956 - RNA, 15 nt, Homo sapiens
ugagaaucaugcacu

SEQ ID NO: 666957 - RNA, 20 nt, Homo sapiens
ugagaauguggaauaccuaa

SEQ ID NO: 666958 - RNA, 17 nt, Homo sapiens
ugagaauguucaucucu

SEQ ID NO: 666959 - RNA, 18 nt, Homo sapiens
ugagacaacaaauggguc

SEQ ID NO: 666960 - RNA, 23 nt, Homo sapiens
ugagacaggagaccuggcacugg

SEQ ID NO: 666961 - RNA, 15 nt, Homo sapiens
ugagacaucuugccu

SEQ ID NO: 666962 - RNA, 18 nt, Homo sapiens
ugagaccaaggcuuucuc

SEQ ID NO: 666963 - RNA, 17 nt, Homo sapiens
ugagacggagucuugcu

SEQ ID NO: 666964 - RNA, 22 nt, Homo sapiens
ugagacuauaaagcaguagaca

SEQ ID NO: 666965 - RNA, 13 nt, Homo sapiens
ugagacuaugcaa

SEQ ID NO: 666966 - RNA, 16 nt, Homo sapiens
ugagacuccaccucaa

SEQ ID NO: 666967 - RNA, 21 nt, Homo sapiens
ugagacuccccaauaccuaau

SEQ ID NO: 666968 - RNA, 18 nt, Homo sapiens
ugagacuuucuaaaucaa

SEQ ID NO: 666969 - RNA, 13 nt, Homo sapiens
ugagagacuccau

SEQ ID NO: 666970 - RNA, 15 nt, Homo sapiens
ugagagagacaggca

SEQ ID NO: 666971 - RNA, 20 nt, Homo sapiens
ugagagcccuucaugcauuu

SEQ ID NO: 666972 - RNA, 16 nt, Homo sapiens
ugagagcgacacagac

SEQ ID NO: 666973 - RNA, 23 nt, Homo sapiens
ugagaggaugaauguaugugcac

SEQ ID NO: 666974 - RNA, 18 nt, Homo sapiens
ugagagggcaguguuucc

SEQ ID NO: 666975 - RNA, 13 nt, Homo sapiens
ugagagggugcua

SEQ ID NO: 666976 - RNA, 15 nt, Homo sapiens
ugagagugaaaccau

SEQ ID NO: 666977 - RNA, 19 nt, Homo sapiens
ugagagugagcaaccagcu

SEQ ID NO: 666978 - RNA, 14 nt, Homo sapiens
ugagagugcacugc

SEQ ID NO: 666979 - RNA, 15 nt, Homo sapiens
ugagaguuauaguga

SEQ ID NO: 666980 - RNA, 13 nt, Homo sapiens
ugagauaaaguca

SEQ ID NO: 666981 - RNA, 13 nt, Homo sapiens
ugagauaaaugca

SEQ ID NO: 666982 - RNA, 15 nt, Homo sapiens
ugagauaaaugcaca

SEQ ID NO: 666983 - RNA, 20 nt, Homo sapiens
ugagauaaaugcacauuuca

SEQ ID NO: 666984 - RNA, 13 nt, Homo sapiens
ugagauacuuugc

SEQ ID NO: 666985 - RNA, 21 nt, Homo sapiens
ugagauagaagaacugcaaag

SEQ ID NO: 666986 - RNA, 19 nt, Homo sapiens
ugagauccggcaacaucaa

SEQ ID NO: 666987 - RNA, 23 nt, Homo sapiens
ugagaucgugccguuacucucca

SEQ ID NO: 666988 - RNA, 17 nt, Homo sapiens
ugagaugauacauccaa

SEQ ID NO: 666989 - RNA, 16 nt, Homo sapiens
ugagaugcagcuggaa

SEQ ID NO: 666990 - RNA, 13 nt, Homo sapiens
ugagaugccuguu

SEQ ID NO: 666991 - RNA, 22 nt, Homo sapiens
ugagauggguguacaaacucau

SEQ ID NO: 666992 - RNA, 22 nt, Homo sapiens
ugagauguuguguggcaauggg

SEQ ID NO: 666993 - RNA, 18 nt, Homo sapiens
ugagauuggaaaagggca

SEQ ID NO: 666994 - RNA, 18 nt, Homo sapiens
ugagauuucuuaaauaau

SEQ ID NO: 666995 - RNA, 22 nt, Homo sapiens
ugagauuuugaaaaucuaccaa

SEQ ID NO: 666996 - RNA, 16 nt, Homo sapiens
ugagcaaauggugcug

SEQ ID NO: 666997 - RNA, 23 nt, Homo sapiens
ugagcaauggaguggcugccaug

SEQ ID NO: 666998 - RNA, 20 nt, Homo sapiens
ugagcaaugguaacugcacc

SEQ ID NO: 666999 - RNA, 13 nt, Homo sapiens
ugagcaaugucug

SEQ ID NO: 667000 - RNA, 23 nt, Homo sapiens
ugagcacaaaauuaugcaaauau

SEQ ID NO: 667001 - RNA, 18 nt, Homo sapiens
ugagcacagucaggggcu

SEQ ID NO: 667002 - RNA, 18 nt, Homo sapiens
ugagcacccccucauucc

SEQ ID NO: 667003 - RNA, 17 nt, Homo sapiens
ugagcaccgucauggcu

SEQ ID NO: 667004 - RNA, 12 nt, Homo sapiens
ugagcaccucca

SEQ ID NO: 667005 - RNA, 23 nt, Homo sapiens
ugagcacuuagcaggcaccgcca

SEQ ID NO: 667006 - RNA, 15 nt, Homo sapiens
ugagcagaagaucaa

SEQ ID NO: 667007 - RNA, 22 nt, Homo sapiens
ugagcagaagcuggaggcacaa

SEQ ID NO: 667008 - RNA, 15 nt, Homo sapiens
ugagcagaauacugg

SEQ ID NO: 667009 - RNA, 17 nt, Homo sapiens
ugagcagaauacugguc

SEQ ID NO: 667010 - RNA, 15 nt, Homo sapiens
guccacaacaauaug

SEQ ID NO: 667011 - RNA, 15 nt, Homo sapiens
guccacaaggggcuu

SEQ ID NO: 667012 - RNA, 14 nt, Homo sapiens
guccacaucugccu

SEQ ID NO: 667013 - RNA, 19 nt, Homo sapiens
guccacccaggcugcacug

SEQ ID NO: 667014 - RNA, 14 nt, Homo sapiens
guccacccuuccau

SEQ ID NO: 667015 - RNA, 17 nt, Homo sapiens
guccaccugugcugcug

SEQ ID NO: 667016 - RNA, 21 nt, Homo sapiens
guccacggucuguucuugaag

SEQ ID NO: 667017 - RNA, 17 nt, Homo sapiens
guccagauauuucacau

SEQ ID NO: 667018 - RNA, 13 nt, Homo sapiens
guccagcacugga

SEQ ID NO: 667019 - RNA, 16 nt, Homo sapiens
guccagcucguucucu

SEQ ID NO: 667020 - RNA, 17 nt, Homo sapiens
guccaggaacugccugg

SEQ ID NO: 667021 - RNA, 19 nt, Homo sapiens
guccaggagcuaaucugac

SEQ ID NO: 667022 - RNA, 14 nt, Homo sapiens
guccaggcacagga

SEQ ID NO: 667023 - RNA, 12 nt, Homo sapiens
guccaggccagu

SEQ ID NO: 667024 - RNA, 20 nt, Homo sapiens
guccaggcuggagugcaaug

SEQ ID NO: 667025 - RNA, 17 nt, Homo sapiens
guccagggcuagugacu

SEQ ID NO: 667026 - RNA, 18 nt, Homo sapiens
guccagggcuagugacuu

SEQ ID NO: 667027 - RNA, 23 nt, Homo sapiens
guccaggggucugucugcuuugg

SEQ ID NO: 667028 - RNA, 15 nt, Homo sapiens
guccagguccauuua

SEQ ID NO: 667029 - RNA, 15 nt, Homo sapiens
guccaguacugggag

SEQ ID NO: 667030 - RNA, 14 nt, Homo sapiens
guccaguauucuac

SEQ ID NO: 667031 - RNA, 22 nt, Homo sapiens
guccauacacuuuguugcaaga

SEQ ID NO: 667032 - RNA, 15 nt, Homo sapiens
guccaucugaccguu

SEQ ID NO: 667033 - RNA, 15 nt, Homo sapiens
guccaugaagcacug

SEQ ID NO: 667034 - RNA, 18 nt, Homo sapiens
guccaugaagcacugagc

SEQ ID NO: 667035 - RNA, 22 nt, Homo sapiens
guccaugccuuuaauguugccc

SEQ ID NO: 667036 - RNA, 21 nt, Homo sapiens
guccaugcugaugauuuugca

SEQ ID NO: 667037 - RNA, 14 nt, Homo sapiens
guccaugcuucuag

SEQ ID NO: 667038 - RNA, 19 nt, Homo sapiens
guccauguaauauucccau

SEQ ID NO: 667039 - RNA, 19 nt, Homo sapiens
guccaugugguucuucaaa

SEQ ID NO: 667040 - RNA, 16 nt, Homo sapiens
ugagcucuguaacuua

SEQ ID NO: 667041 - RNA, 14 nt, Homo sapiens
ugagcugagugcug

SEQ ID NO: 667042 - RNA, 19 nt, Homo sapiens
ugagcugccuguaacuuga

SEQ ID NO: 667043 - RNA, 22 nt, Homo sapiens
ugagcuggauggguacagcuua

SEQ ID NO: 667044 - RNA, 16 nt, Homo sapiens
ugagcuggcuugucca

SEQ ID NO: 667045 - RNA, 14 nt, Homo sapiens
ugagcuggggacuc

SEQ ID NO: 667046 - RNA, 19 nt, Homo sapiens
ugagcuguaaaaauguuac

SEQ ID NO: 667047 - RNA, 15 nt, Homo sapiens
ugagcuguugccuca

SEQ ID NO: 667048 - RNA, 16 nt, Homo sapiens
ugagcuguugccucag

SEQ ID NO: 667049 - RNA, 23 nt, Homo sapiens
ugagcuucaauauaagaagcaau

SEQ ID NO: 667050 - RNA, 20 nt, Homo sapiens
ugagcuucauauaccagcaa

SEQ ID NO: 667051 - RNA, 13 nt, Homo sapiens
ugagcuucuuuag

SEQ ID NO: 667052 - RNA, 16 nt, Homo sapiens
ugagcuucuuuagcua

SEQ ID NO: 667053 - RNA, 15 nt, Homo sapiens
ugagcuuugcugcua

SEQ ID NO: 667054 - RNA, 20 nt, Homo sapiens
ugaggaaaacuguagucucu

SEQ ID NO: 667055 - RNA, 15 nt, Homo sapiens
ugaggaaacaacagc

SEQ ID NO: 667056 - RNA, 20 nt, Homo sapiens
ugaggaaauugcacacagua

SEQ ID NO: 667057 - RNA, 15 nt, Homo sapiens
ugaggaacccuuaca

SEQ ID NO: 667058 - RNA, 17 nt, Homo sapiens
ugaggaaggacuugacu

SEQ ID NO: 667059 - RNA, 17 nt, Homo sapiens
ugaggaagucacuuuac

SEQ ID NO: 667060 - RNA, 23 nt, Homo sapiens
ugaggaccacuccuguacacuga

SEQ ID NO: 667061 - RNA, 15 nt, Homo sapiens
ugaggacugauuuca

SEQ ID NO: 667062 - RNA, 15 nt, Homo sapiens
ugaggagacagaaua

SEQ ID NO: 667063 - RNA, 18 nt, Homo sapiens
ugaggagcccugaggacc

SEQ ID NO: 667064 - RNA, 22 nt, Homo sapiens
ugaggaggcuugccccacccaa

SEQ ID NO: 667065 - RNA, 14 nt, Homo sapiens
ugaggauugcugau

SEQ ID NO: 667066 - RNA, 15 nt, Homo sapiens
ugaggauuuuguuga

SEQ ID NO: 667067 - RNA, 14 nt, Homo sapiens
ugaggcaauaaaaa

SEQ ID NO: 667068 - RNA, 13 nt, Homo sapiens
ugaggcaggugga

SEQ ID NO: 667069 - RNA, 20 nt, Homo sapiens
ugaggcauuuccagacuuga

SEQ ID NO: 667070 - RNA, 16 nt, Homo sapiens
ugaggcccauucuuca

SEQ ID NO: 667071 - RNA, 16 nt, Homo sapiens
ugaggcggguggauca

SEQ ID NO: 667072 - RNA, 21 nt, Homo sapiens
ugaggcggguggaucacuuga

SEQ ID NO: 667073 - RNA, 19 nt, Homo sapiens
ugaggcuauggaggguccu

SEQ ID NO: 667074 - RNA, 13 nt, Homo sapiens
ugaggcucuucac

SEQ ID NO: 667075 - RNA, 17 nt, Homo sapiens
ugaggcugacacagcca

SEQ ID NO: 667076 - RNA, 18 nt, Homo sapiens
ugaggcuggcacaggaca

SEQ ID NO: 667077 - RNA, 13 nt, Homo sapiens
ugaggcugucaca

SEQ ID NO: 667078 - RNA, 14 nt, Homo sapiens
ugaggcugucacag

SEQ ID NO: 667079 - RNA, 13 nt, Homo sapiens
ugaggcugucagu

SEQ ID NO: 667080 - RNA, 15 nt, Homo sapiens
ugagggaaaaugagu

SEQ ID NO: 667081 - RNA, 15 nt, Homo sapiens
ugagggaaagugcau

SEQ ID NO: 667082 - RNA, 18 nt, Homo sapiens
ugagggaaauugcuauuu

SEQ ID NO: 667083 - RNA, 16 nt, Homo sapiens
ugagggacaaugccaa

SEQ ID NO: 667084 - RNA, 20 nt, Homo sapiens
ugagggacuggaaccaggga

SEQ ID NO: 667085 - RNA, 20 nt, Homo sapiens
ugagggagggagccauggaa

SEQ ID NO: 667086 - RNA, 20 nt, Homo sapiens
ugagggcaagagggggaccu

SEQ ID NO: 667087 - RNA, 17 nt, Homo sapiens
ugagggcagacuggggc

SEQ ID NO: 667088 - RNA, 17 nt, Homo sapiens
ugagggcagcacuggga

SEQ ID NO: 667089 - RNA, 15 nt, Homo sapiens
ugagggcauggguaa

SEQ ID NO: 667090 - RNA, 20 nt, Homo sapiens
ugagggcaugugcggcugaa

SEQ ID NO: 667091 - RNA, 15 nt, Homo sapiens
ugagggccugcugga

SEQ ID NO: 667092 - RNA, 22 nt, Homo sapiens
ugagggcucuguuugugggacu

SEQ ID NO: 667093 - RNA, 21 nt, Homo sapiens
ugaggggaggaucuuacugaa

SEQ ID NO: 667094 - RNA, 18 nt, Homo sapiens
ugaggggcuaccaggaaa

SEQ ID NO: 667095 - RNA, 22 nt, Homo sapiens
ugaggggcuccuggaaaggcuc

SEQ ID NO: 667096 - RNA, 18 nt, Homo sapiens
ugaggggcugacuucaau

SEQ ID NO: 667097 - RNA, 12 nt, Homo sapiens
ugaggggucccc

SEQ ID NO: 667098 - RNA, 14 nt, Homo sapiens
ugaggggucucgga

SEQ ID NO: 667099 - RNA, 14 nt, Homo sapiens
ugagggucacagua

SEQ ID NO: 667100 - RNA, 18 nt, Homo sapiens
ugagggucuuugcaagaa

SEQ ID NO: 667101 - RNA, 21 nt, Homo sapiens
ugaggguguuucuuccugcac

SEQ ID NO: 667102 - RNA, 15 nt, Homo sapiens
ugaggguuaaugaaa

SEQ ID NO: 667103 - RNA, 16 nt, Homo sapiens
ugagguaaguggaauu

SEQ ID NO: 667104 - RNA, 20 nt, Homo sapiens
ugagguaauucuagccuuuu

SEQ ID NO: 667105 - RNA, 22 nt, Homo sapiens
ugagguacagcagaaaggagaa

SEQ ID NO: 667106 - RNA, 17 nt, Homo sapiens
ugagguaucuucuuuag

SEQ ID NO: 667107 - RNA, 12 nt, Homo sapiens
ugaggucaggga

SEQ ID NO: 667108 - RNA, 18 nt, Homo sapiens
ugaggucuuucuccucag

SEQ ID NO: 667109 - RNA, 22 nt, Homo sapiens
ugaggugccugcucaggugcua

SEQ ID NO: 667110 - RNA, 16 nt, Homo sapiens
ugaggugccuguccca

SEQ ID NO: 667111 - RNA, 19 nt, Homo sapiens
ugaggugguggaguggagu

SEQ ID NO: 667112 - RNA, 19 nt, Homo sapiens
ugaggugugaaagcccagg

SEQ ID NO: 667113 - RNA, 13 nt, Homo sapiens
ugagguuguggag

SEQ ID NO: 667114 - RNA, 18 nt, Homo sapiens
ugagguuuagaugugcaa

SEQ ID NO: 667115 - RNA, 18 nt, Homo sapiens
ugagguuugcuuguuacc

SEQ ID NO: 667116 - RNA, 13 nt, Homo sapiens
ugaguaaaaucua

SEQ ID NO: 667117 - RNA, 18 nt, Homo sapiens
ugaguaacaggugccuuc

SEQ ID NO: 667118 - RNA, 18 nt, Homo sapiens
ugaguaagcccucaggag

SEQ ID NO: 667119 - RNA, 17 nt, Homo sapiens
ugaguaauacaucaaag

SEQ ID NO: 667120 - RNA, 20 nt, Homo sapiens
ugaguagauccaguauuuga

SEQ ID NO: 667121 - RNA, 20 nt, Homo sapiens
ugaguagcuggauuacaggc

SEQ ID NO: 667122 - RNA, 13 nt, Homo sapiens
ugaguagggacuc

SEQ ID NO: 667123 - RNA, 16 nt, Homo sapiens
ugaguaguguggaauu

SEQ ID NO: 667124 - RNA, 19 nt, Homo sapiens
ugaguaucuguauguauau

SEQ ID NO: 667125 - RNA, 20 nt, Homo sapiens
ugaguauuccaugagcugcu

SEQ ID NO: 667126 - RNA, 15 nt, Homo sapiens
ugagucaaagacuua

SEQ ID NO: 667127 - RNA, 15 nt, Homo sapiens
ugagucagacuguca

SEQ ID NO: 667128 - RNA, 19 nt, Homo sapiens
ugagucagugccaugacug

SEQ ID NO: 667129 - RNA, 14 nt, Homo sapiens
ugagucaugauccu

SEQ ID NO: 667130 - RNA, 20 nt, Homo sapiens
ugagucaugaucucccugcc

SEQ ID NO: 667131 - RNA, 13 nt, Homo sapiens
ugaguccaaagaa

SEQ ID NO: 667132 - RNA, 18 nt, Homo sapiens
gaaacacagcaacaauga

SEQ ID NO: 667133 - RNA, 21 nt, Homo sapiens
gaaacacagcugaugaacugu

SEQ ID NO: 667134 - RNA, 13 nt, Homo sapiens
gaaacacaugcca

SEQ ID NO: 667135 - RNA, 18 nt, Homo sapiens
gaaacacccacucacuuu

SEQ ID NO: 667136 - RNA, 21 nt, Homo sapiens
gaaacaccuucucuggagcca

SEQ ID NO: 667137 - RNA, 23 nt, Homo sapiens
gaaacaccuucucuggagccaag

SEQ ID NO: 667138 - RNA, 12 nt, Homo sapiens
gaaacacuggac

SEQ ID NO: 667139 - RNA, 17 nt, Homo sapiens
gaaacagauaacaccaa

SEQ ID NO: 667140 - RNA, 16 nt, Homo sapiens
gaaacagucacuauca

SEQ ID NO: 667141 - RNA, 16 nt, Homo sapiens
gaaacaguuucuugcu

SEQ ID NO: 667142 - RNA, 14 nt, Homo sapiens
gaaacaugauguga

SEQ ID NO: 667143 - RNA, 16 nt, Homo sapiens
gaaacauuaugccuua

SEQ ID NO: 667144 - RNA, 21 nt, Homo sapiens
gaaacauuauuagcacuuccc

SEQ ID NO: 667145 - RNA, 17 nt, Homo sapiens
gaaacauuguaaauauu

SEQ ID NO: 667146 - RNA, 12 nt, Homo sapiens
gaaaccaaaaca

SEQ ID NO: 667147 - RNA, 16 nt, Homo sapiens
gaaaccaguucaugca

SEQ ID NO: 667148 - RNA, 15 nt, Homo sapiens
gaaaccauuuuccca

SEQ ID NO: 667149 - RNA, 13 nt, Homo sapiens
gaaacccaaccuu

SEQ ID NO: 667150 - RNA, 13 nt, Homo sapiens
gaaacccaagcuc

SEQ ID NO: 667151 - RNA, 20 nt, Homo sapiens
gaaaccccccagagcucuuu

SEQ ID NO: 667152 - RNA, 21 nt, Homo sapiens
gaaaccucacgacuggucacc

SEQ ID NO: 667153 - RNA, 20 nt, Homo sapiens
gaaaccuuauuguaccucuc

SEQ ID NO: 667154 - RNA, 23 nt, Homo sapiens
gaaaccuucagauuuguguuaua

SEQ ID NO: 667155 - RNA, 16 nt, Homo sapiens
gaaacgacucaaaaug

SEQ ID NO: 667156 - RNA, 18 nt, Homo sapiens
gaaacggaggccagagag

SEQ ID NO: 667157 - RNA, 17 nt, Homo sapiens
gaaacgggcuccuuccc

SEQ ID NO: 667158 - RNA, 14 nt, Homo sapiens
gaaacgucaugugu

SEQ ID NO: 667159 - RNA, 21 nt, Homo sapiens
gaaacgucuucuaaacuuccc

SEQ ID NO: 667160 - RNA, 15 nt, Homo sapiens
gaaacguuugcccca

SEQ ID NO: 667161 - RNA, 13 nt, Homo sapiens
gaaacuaacuugg

SEQ ID NO: 667162 - RNA, 22 nt, Homo sapiens
gaaacuacauuucuacuaugau

SEQ ID NO: 667163 - RNA, 15 nt, Homo sapiens
gaaacuauacauuua

SEQ ID NO: 667164 - RNA, 21 nt, Homo sapiens
gaaacucaacuucuuuccucu

SEQ ID NO: 667165 - RNA, 15 nt, Homo sapiens
gaaacucacacuccc

SEQ ID NO: 667166 - RNA, 23 nt, Homo sapiens
gaaacuccagaugccacaaugga

SEQ ID NO: 667167 - RNA, 16 nt, Homo sapiens
gaaacucuuucauucu

SEQ ID NO: 667168 - RNA, 23 nt, Homo sapiens
gaaacugcuucuagaaacucugg

SEQ ID NO: 667169 - RNA, 20 nt, Homo sapiens
gaaacuggaauaaguguuua

SEQ ID NO: 667170 - RNA, 12 nt, Homo sapiens
gaaacuguaaaa

SEQ ID NO: 667171 - RNA, 15 nt, Homo sapiens
gaaacuguacuacau

SEQ ID NO: 667172 - RNA, 13 nt, Homo sapiens
gaaacuguaugaa

SEQ ID NO: 667173 - RNA, 16 nt, Homo sapiens
gaaacuguucccaccu

SEQ ID NO: 667174 - RNA, 17 nt, Homo sapiens
gaaacuuauucgcaaua

SEQ ID NO: 667175 - RNA, 19 nt, Homo sapiens
gaaacuugaacuccaggau

SEQ ID NO: 667176 - RNA, 18 nt, Homo sapiens
gaaacuugugaaguggaa

SEQ ID NO: 667177 - RNA, 19 nt, Homo sapiens
gaaacuuuaaaagacugaa

SEQ ID NO: 667178 - RNA, 14 nt, Homo sapiens
gaaacuuucaaaag

SEQ ID NO: 667179 - RNA, 15 nt, Homo sapiens
gaaagaaaaggcaaa

SEQ ID NO: 667180 - RNA, 13 nt, Homo sapiens
gaaagaaccagag

SEQ ID NO: 667181 - RNA, 14 nt, Homo sapiens
gaaagaaguaggca

SEQ ID NO: 667182 - RNA, 23 nt, Homo sapiens
gaaagaaguccuuucucuuuauu

SEQ ID NO: 667183 - RNA, 23 nt, Homo sapiens
gaaagaaguguggggauuuucac

SEQ ID NO: 667184 - RNA, 18 nt, Homo sapiens
gaaagaaguuauuuucca

SEQ ID NO: 667185 - RNA, 13 nt, Homo sapiens
gaaagaauugagg

SEQ ID NO: 667186 - RNA, 12 nt, Homo sapiens
gaaagacaguga

SEQ ID NO: 667187 - RNA, 13 nt, Homo sapiens
gaaagaccaggcc

SEQ ID NO: 667188 - RNA, 23 nt, Homo sapiens
gaaagacgccuucaucugggaca

SEQ ID NO: 667189 - RNA, 18 nt, Homo sapiens
gaaagacucuuaaugcag

SEQ ID NO: 667190 - RNA, 22 nt, Homo sapiens
gaaagagcagucagaguccagu

SEQ ID NO: 667191 - RNA, 15 nt, Homo sapiens
gaaagaggaagcaaa

SEQ ID NO: 667192 - RNA, 23 nt, Homo sapiens
gaaagaucguuuaaaaacaaagg

SEQ ID NO: 667193 - RNA, 20 nt, Homo sapiens
gaaagaugacaaaagaaaau

SEQ ID NO: 667194 - RNA, 18 nt, Homo sapiens
gaaagaugggcaaaagac

SEQ ID NO: 667195 - RNA, 22 nt, Homo sapiens
gaaagcacuauuaauacucugc

SEQ ID NO: 667196 - RNA, 22 nt, Homo sapiens
gaaagcagcccaaguagguuau

SEQ ID NO: 667197 - RNA, 18 nt, Homo sapiens
gaaagcauaaagcucaaa

SEQ ID NO: 667198 - RNA, 18 nt, Homo sapiens
gaaagcauaacaaaaaga

SEQ ID NO: 667199 - RNA, 19 nt, Homo sapiens
gaaagcauaucccaccaac

SEQ ID NO: 667200 - RNA, 18 nt, Homo sapiens
gaaagcauaugcagccaa

SEQ ID NO: 667201 - RNA, 18 nt, Homo sapiens
gaaagcaucaccucaggc

SEQ ID NO: 667202 - RNA, 22 nt, Homo sapiens
gaaagccacacggagaggccac

SEQ ID NO: 667203 - RNA, 14 nt, Homo sapiens
gaaagccauugacc

SEQ ID NO: 667204 - RNA, 23 nt, Homo sapiens
gaaagccucucaguacagcacuc

SEQ ID NO: 667205 - RNA, 16 nt, Homo sapiens
uacagcaucauugcau

SEQ ID NO: 667206 - RNA, 19 nt, Homo sapiens
uacagcaugacguaguauu

SEQ ID NO: 667207 - RNA, 14 nt, Homo sapiens
uacagccaaagaua

SEQ ID NO: 667208 - RNA, 20 nt, Homo sapiens
uacagccagcagcacaguca

SEQ ID NO: 667209 - RNA, 13 nt, Homo sapiens
uacagcucucccc

SEQ ID NO: 667210 - RNA, 21 nt, Homo sapiens
uacagcucuuggcauuuuccu

SEQ ID NO: 667211 - RNA, 17 nt, Homo sapiens
uacaggaagaaagagcu

SEQ ID NO: 667212 - RNA, 17 nt, Homo sapiens
uacaggaagcaccccau

SEQ ID NO: 667213 - RNA, 19 nt, Homo sapiens
uacaggaagguagaaauau

SEQ ID NO: 667214 - RNA, 17 nt, Homo sapiens
uacaggaggcagacaau

SEQ ID NO: 667215 - RNA, 14 nt, Homo sapiens
uacaggcacgugcc

SEQ ID NO: 667216 - RNA, 20 nt, Homo sapiens
uacaggcaguuaggugcuga

SEQ ID NO: 667217 - RNA, 20 nt, Homo sapiens
uacaggcgugauccaccaca

SEQ ID NO: 667218 - RNA, 20 nt, Homo sapiens
uacaggggcccgccaccaca

SEQ ID NO: 667219 - RNA, 14 nt, Homo sapiens
uacagggggucccc

SEQ ID NO: 667220 - RNA, 15 nt, Homo sapiens
uacaggggugcugca

SEQ ID NO: 667221 - RNA, 18 nt, Homo sapiens
uacaggugaaggcucuca

SEQ ID NO: 667222 - RNA, 22 nt, Homo sapiens
uacaggugcgcgccaccgugcc

SEQ ID NO: 667223 - RNA, 15 nt, Homo sapiens
uacaggugucuagac

SEQ ID NO: 667224 - RNA, 21 nt, Homo sapiens
uacaggugugagccacagugc

SEQ ID NO: 667225 - RNA, 21 nt, Homo sapiens
uacaguaaaguauagaaauau

SEQ ID NO: 667226 - RNA, 22 nt, Homo sapiens
uacaguauuguggcugcacuug

SEQ ID NO: 667227 - RNA, 21 nt, Homo sapiens
uacaguauuuuucugugacca

SEQ ID NO: 667228 - RNA, 14 nt, Homo sapiens
uacagucaucugcc

SEQ ID NO: 667229 - RNA, 15 nt, Homo sapiens
uacagucugucauga

SEQ ID NO: 667230 - RNA, 16 nt, Homo sapiens
uacagugagccaagau

SEQ ID NO: 667231 - RNA, 17 nt, Homo sapiens
uacagugcagagccuuc

SEQ ID NO: 667232 - RNA, 12 nt, Homo sapiens
uacagugcaguu

SEQ ID NO: 667233 - RNA, 17 nt, Homo sapiens
uacagugccacugcaau

SEQ ID NO: 667234 - RNA, 13 nt, Homo sapiens
uacagugcuauuu

SEQ ID NO: 667235 - RNA, 12 nt, Homo sapiens
uacagugguuuu

SEQ ID NO: 667236 - RNA, 20 nt, Homo sapiens
uacaguucugggguacaugu

SEQ ID NO: 667237 - RNA, 14 nt, Homo sapiens
uacauaaagacugu

SEQ ID NO: 667238 - RNA, 16 nt, Homo sapiens
uacauaaagacugugc

SEQ ID NO: 667239 - RNA, 23 nt, Homo sapiens
uacauaacguucaguugggaugg

SEQ ID NO: 667240 - RNA, 22 nt, Homo sapiens
uacauaacugaaaaugugcuau

SEQ ID NO: 667241 - RNA, 14 nt, Homo sapiens
uacauaaggcugga

SEQ ID NO: 667242 - RNA, 23 nt, Homo sapiens
uacauaauaaaaaauuaugacaa

SEQ ID NO: 667243 - RNA, 14 nt, Homo sapiens
uacauaaucuguac

SEQ ID NO: 667244 - RNA, 15 nt, Homo sapiens
uacauaauguauugu

SEQ ID NO: 667245 - RNA, 15 nt, Homo sapiens
uacauacaccagcau

SEQ ID NO: 667246 - RNA, 20 nt, Homo sapiens
uacauacaggccauacuuua

SEQ ID NO: 667247 - RNA, 13 nt, Homo sapiens
uacauacauacau

SEQ ID NO: 667248 - RNA, 16 nt, Homo sapiens
uacauacauacauaca

SEQ ID NO: 667249 - RNA, 13 nt, Homo sapiens
uacauacauauau

SEQ ID NO: 667250 - RNA, 20 nt, Homo sapiens
uacauacuuuaucaaugugu

SEQ ID NO: 667251 - RNA, 20 nt, Homo sapiens
uacauaggcaucauuucaca

SEQ ID NO: 667252 - RNA, 20 nt, Homo sapiens
uacauaggcuucuauuaccu

SEQ ID NO: 667253 - RNA, 23 nt, Homo sapiens
uacauauauauauacacauacau

SEQ ID NO: 667254 - RNA, 18 nt, Homo sapiens
uacccuuuagacuguagc

SEQ ID NO: 667255 - RNA, 18 nt, Homo sapiens
uacccuuucauucagccu

SEQ ID NO: 667256 - RNA, 21 nt, Homo sapiens
uacccuuuggccccacuuuga

SEQ ID NO: 667257 - RNA, 22 nt, Homo sapiens
uacccuuuggccccacuuugaa

SEQ ID NO: 667258 - RNA, 18 nt, Homo sapiens
uacccuuuuucuccagcu

SEQ ID NO: 667259 - RNA, 22 nt, Homo sapiens
uaccgauguuaauuauuuugac

SEQ ID NO: 667260 - RNA, 13 nt, Homo sapiens
uaccggauucucu

SEQ ID NO: 667261 - RNA, 13 nt, Homo sapiens
uaccuaaacugag

SEQ ID NO: 667262 - RNA, 11 nt, Homo sapiens
uaccuaaagac

SEQ ID NO: 667263 - RNA, 14 nt, Homo sapiens
uaccuaaugucuca

SEQ ID NO: 667264 - RNA, 13 nt, Homo sapiens
uaccuacaucaga

SEQ ID NO: 667265 - RNA, 15 nt, Homo sapiens
uaccuacaucaguca

SEQ ID NO: 667266 - RNA, 17 nt, Homo sapiens
uaccuaccacagugucu

SEQ ID NO: 667267 - RNA, 23 nt, Homo sapiens
uaccuaggauauguuaaauguau

SEQ ID NO: 667268 - RNA, 20 nt, Homo sapiens
uaccuaggcaccaucauuua

SEQ ID NO: 667269 - RNA, 17 nt, Homo sapiens
uaccuauauugauuuaa

SEQ ID NO: 667270 - RNA, 16 nt, Homo sapiens
uaccuauuucugauga

SEQ ID NO: 667271 - RNA, 16 nt, Homo sapiens
uaccuccaacccugcc

SEQ ID NO: 667272 - RNA, 18 nt, Homo sapiens
uaccuccaacccugccgu

SEQ ID NO: 667273 - RNA, 18 nt, Homo sapiens
uaccuccugucuuuacaa

SEQ ID NO: 667274 - RNA, 23 nt, Homo sapiens
uaccucuaaguacauauguagau

SEQ ID NO: 667275 - RNA, 16 nt, Homo sapiens
uaccucucagccuuag

SEQ ID NO: 667276 - RNA, 21 nt, Homo sapiens
uaccugaaaacacugugcaca

SEQ ID NO: 667277 - RNA, 20 nt, Homo sapiens
uaccugaaauaaaauucauu

SEQ ID NO: 667278 - RNA, 14 nt, Homo sapiens
uaccugacacuccc

SEQ ID NO: 667279 - RNA, 13 nt, Homo sapiens
uaccugagcauuc

SEQ ID NO: 667280 - RNA, 16 nt, Homo sapiens
uaccugcugcugcuau

SEQ ID NO: 667281 - RNA, 11 nt, Homo sapiens
uaccugggaaa

SEQ ID NO: 667282 - RNA, 21 nt, Homo sapiens
uaccugggcauucuuguuuca

SEQ ID NO: 667283 - RNA, 18 nt, Homo sapiens
uaccuguacuaaaccacc

SEQ ID NO: 667284 - RNA, 21 nt, Homo sapiens
uaccuguacuaaaccaccuca

SEQ ID NO: 667285 - RNA, 23 nt, Homo sapiens
uaccuguuuuguggucagcugua

SEQ ID NO: 667286 - RNA, 16 nt, Homo sapiens
uaccuucaaacuuuag

SEQ ID NO: 667287 - RNA, 21 nt, Homo sapiens
uaccuucaggcagccagugug

SEQ ID NO: 667288 - RNA, 23 nt, Homo sapiens
uaccuucaggguuggauguaguu

SEQ ID NO: 667289 - RNA, 17 nt, Homo sapiens
uaccuucaugugauuca

SEQ ID NO: 667290 - RNA, 17 nt, Homo sapiens
uaccuugaacacugggg

SEQ ID NO: 667291 - RNA, 18 nt, Homo sapiens
uaccuuucuagccuuaga

SEQ ID NO: 667292 - RNA, 14 nt, Homo sapiens
uacgaaccaugccu

SEQ ID NO: 667293 - RNA, 12 nt, Homo sapiens
uacgauuucacu

SEQ ID NO: 667294 - RNA, 15 nt, Homo sapiens
uacgcuuugcucaaa

SEQ ID NO: 667295 - RNA, 22 nt, Homo sapiens
uacgcuuuuauuggaaauguga

SEQ ID NO: 667296 - RNA, 18 nt, Homo sapiens
uacggggaaaaugcauuu

SEQ ID NO: 667297 - RNA, 20 nt, Homo sapiens
uacgguaccuggcaauguuu

SEQ ID NO: 667298 - RNA, 15 nt, Homo sapiens
uacgguuaugaaggc

SEQ ID NO: 667299 - RNA, 13 nt, Homo sapiens
uacguaucugcuc

SEQ ID NO: 667300 - RNA, 22 nt, Homo sapiens
uacguauuuuuucuaaugugca

SEQ ID NO: 667301 - RNA, 23 nt, Homo sapiens
uacguauuuuuucuaaugugcau

SEQ ID NO: 667302 - RNA, 15 nt, Homo sapiens
uacgucaaagcagua

SEQ ID NO: 667303 - RNA, 22 nt, Homo sapiens
uacgucccagcggccucagggu

SEQ ID NO: 667304 - RNA, 14 nt, Homo sapiens
uacgugacaacaca

SEQ ID NO: 667305 - RNA, 21 nt, Homo sapiens
uacgugacagaauuguacaca

SEQ ID NO: 667306 - RNA, 20 nt, Homo sapiens
uacgugauccucucaccuca

SEQ ID NO: 667307 - RNA, 21 nt, Homo sapiens
uacgugauuuggcugcacuug

SEQ ID NO: 667308 - RNA, 21 nt, Homo sapiens
uacgugcauuuaaacucugcc

SEQ ID NO: 667309 - RNA, 19 nt, Homo sapiens
uacgugcgcucugccauuc

SEQ ID NO: 667310 - RNA, 14 nt, Homo sapiens
uacguugugcauuu

SEQ ID NO: 667311 - RNA, 19 nt, Homo sapiens
uacuaaaaaguauaaaaua

SEQ ID NO: 667312 - RNA, 15 nt, Homo sapiens
uacuaaaaauacaaa

SEQ ID NO: 667313 - RNA, 14 nt, Homo sapiens
uacuaaaccucaca

SEQ ID NO: 667314 - RNA, 17 nt, Homo sapiens
uacuaacaaauguaaaa

SEQ ID NO: 667315 - RNA, 12 nt, Homo sapiens
uacuaacacugg

SEQ ID NO: 667316 - RNA, 18 nt, Homo sapiens
uacuaacauuuucauuga

SEQ ID NO: 667317 - RNA, 24 nt, Homo sapiens
uacuaacauuuucauugaugagca

SEQ ID NO: 667318 - RNA, 17 nt, Homo sapiens
uacuaaggaaucuuucu

SEQ ID NO: 667319 - RNA, 23 nt, Homo sapiens
uacuaaggaguaaucuguguaca

SEQ ID NO: 667320 - RNA, 20 nt, Homo sapiens
uacuaauaugccuagcacaa

SEQ ID NO: 667321 - RNA, 18 nt, Homo sapiens
uacuaaugaugcuuuuau

SEQ ID NO: 667322 - RNA, 18 nt, Homo sapiens
uacuaaugccucuucauu

SEQ ID NO: 667323 - RNA, 14 nt, Homo sapiens
uacuacauuuccaa

SEQ ID NO: 667324 - RNA, 11 nt, Homo sapiens
uacuacuccuu

SEQ ID NO: 667325 - RNA, 17 nt, Homo sapiens
uacuauaaaagcuuucu

SEQ ID NO: 667326 - RNA, 16 nt, Homo sapiens
uacuauaguaccagua

SEQ ID NO: 667327 - RNA, 18 nt, Homo sapiens
uacuaugugccaguuccu

SEQ ID NO: 667328 - RNA, 14 nt, Homo sapiens
uacuauuaccauag

SEQ ID NO: 667329 - RNA, 14 nt, Homo sapiens
uacuauucacugau

SEQ ID NO: 667330 - RNA, 17 nt, Homo sapiens
gaacacccuugguggcu

SEQ ID NO: 667331 - RNA, 22 nt, Homo sapiens
gaacacuauaaaaacagcuccu

SEQ ID NO: 667332 - RNA, 13 nt, Homo sapiens
gaacacucaaagg

SEQ ID NO: 667333 - RNA, 15 nt, Homo sapiens
gaacacuguucuacc

SEQ ID NO: 667334 - RNA, 23 nt, Homo sapiens
gaacacuucgaguucccaggguu

SEQ ID NO: 667335 - RNA, 17 nt, Homo sapiens
gaacagaaggaugaaug

SEQ ID NO: 667336 - RNA, 19 nt, Homo sapiens
gaacagaaggaugaaugag

SEQ ID NO: 667337 - RNA, 21 nt, Homo sapiens
gaacagacaacagaagucaug

SEQ ID NO: 667338 - RNA, 20 nt, Homo sapiens
gaacagagggaacuuuggga

SEQ ID NO: 667339 - RNA, 21 nt, Homo sapiens
gaacagagggugaaagggaca

SEQ ID NO: 667340 - RNA, 15 nt, Homo sapiens
gaacagaucaggaau

SEQ ID NO: 667341 - RNA, 19 nt, Homo sapiens
gaacagaucaggaauucua

SEQ ID NO: 667342 - RNA, 15 nt, Homo sapiens
gaacagaugcugagc

SEQ ID NO: 667343 - RNA, 15 nt, Homo sapiens
gaacagcacugggga

SEQ ID NO: 667344 - RNA, 22 nt, Homo sapiens
gaacagcacuggggagucuuug

SEQ ID NO: 667345 - RNA, 20 nt, Homo sapiens
gaacagcagcagugccauag

SEQ ID NO: 667346 - RNA, 21 nt, Homo sapiens
gaacagcauuacccuccucuc

SEQ ID NO: 667347 - RNA, 13 nt, Homo sapiens
gaacagcugugag

SEQ ID NO: 667348 - RNA, 18 nt, Homo sapiens
gaacagcugugagccaug

SEQ ID NO: 667349 - RNA, 22 nt, Homo sapiens
gaacaggacugcaaaaauccuu

SEQ ID NO: 667350 - RNA, 15 nt, Homo sapiens
gaacaggucuugggg

SEQ ID NO: 667351 - RNA, 17 nt, Homo sapiens
gaacagguucucuuccu

SEQ ID NO: 667352 - RNA, 15 nt, Homo sapiens
gaacaguaacugcca

SEQ ID NO: 667353 - RNA, 16 nt, Homo sapiens
gaacaguaacugccau

SEQ ID NO: 667354 - RNA, 13 nt, Homo sapiens
gaacagugcccaa

SEQ ID NO: 667355 - RNA, 13 nt, Homo sapiens
gaacaguguuucc

SEQ ID NO: 667356 - RNA, 17 nt, Homo sapiens
gaacaguuuuggcauaa

SEQ ID NO: 667357 - RNA, 10 nt, Homo sapiens
gaacauaaaa

SEQ ID NO: 667358 - RNA, 22 nt, Homo sapiens
gaacauaaaaaauaaaguacca

SEQ ID NO: 667359 - RNA, 23 nt, Homo sapiens
gaacauaaaaaauaaaguaccac

SEQ ID NO: 667360 - RNA, 16 nt, Homo sapiens
gaacauaucauuugug

SEQ ID NO: 667361 - RNA, 15 nt, Homo sapiens
gaacaucccuacccu

SEQ ID NO: 667362 - RNA, 20 nt, Homo sapiens
gaacaugcagcaaggggaca

SEQ ID NO: 667363 - RNA, 19 nt, Homo sapiens
gaacaugccugccaaagac

SEQ ID NO: 667364 - RNA, 22 nt, Homo sapiens
gaacauuaacaaaagcaauugu

SEQ ID NO: 667365 - RNA, 19 nt, Homo sapiens
gaacauucacuuuuguuaa

SEQ ID NO: 667366 - RNA, 23 nt, Homo sapiens
gaacauuccuuagucucaagggc

SEQ ID NO: 667367 - RNA, 18 nt, Homo sapiens
gaacauugguucuuucau

SEQ ID NO: 667368 - RNA, 21 nt, Homo sapiens
gaaccaaggcagccuccagag

SEQ ID NO: 667369 - RNA, 12 nt, Homo sapiens
gaaccaauaaug

SEQ ID NO: 667370 - RNA, 17 nt, Homo sapiens
gaaccaaucccgugaaa

SEQ ID NO: 667371 - RNA, 20 nt, Homo sapiens
gaaccacggaggaugaugcc

SEQ ID NO: 667372 - RNA, 21 nt, Homo sapiens
gaaccacggaggaugaugcca

SEQ ID NO: 667373 - RNA, 21 nt, Homo sapiens
gaaccagagaggcucugagaa

SEQ ID NO: 667374 - RNA, 17 nt, Homo sapiens
gaaccagagcucagaga

SEQ ID NO: 667375 - RNA, 17 nt, Homo sapiens
uacugcuugaccaaaga

SEQ ID NO: 667376 - RNA, 19 nt, Homo sapiens
uacuggaaaaaaauacaaa

SEQ ID NO: 667377 - RNA, 14 nt, Homo sapiens
uacuggaaaccuaa

SEQ ID NO: 667378 - RNA, 14 nt, Homo sapiens
uacuggaaggcuuc

SEQ ID NO: 667379 - RNA, 20 nt, Homo sapiens
uacuggcaaggagaagagca

SEQ ID NO: 667380 - RNA, 18 nt, Homo sapiens
uacuggcacaaaaacaca

SEQ ID NO: 667381 - RNA, 16 nt, Homo sapiens
uacuggcuguggacca

SEQ ID NO: 667382 - RNA, 17 nt, Homo sapiens
uacugggacugugcuca

SEQ ID NO: 667383 - RNA, 17 nt, Homo sapiens
uacuggucccuuccuuu

SEQ ID NO: 667384 - RNA, 14 nt, Homo sapiens
uacuggugcaguca

SEQ ID NO: 667385 - RNA, 14 nt, Homo sapiens
uacugguugacuuu

SEQ ID NO: 667386 - RNA, 22 nt, Homo sapiens
uacuguaaagaauuuagcugua

SEQ ID NO: 667387 - RNA, 18 nt, Homo sapiens
uacuguaauagugugauu

SEQ ID NO: 667388 - RNA, 22 nt, Homo sapiens
uacuguacaugcuaugcugaag

SEQ ID NO: 667389 - RNA, 12 nt, Homo sapiens
uacuguacuuaa

SEQ ID NO: 667390 - RNA, 13 nt, Homo sapiens
uacuguacuuaau

SEQ ID NO: 667391 - RNA, 13 nt, Homo sapiens
uacuguagccuca

SEQ ID NO: 667392 - RNA, 12 nt, Homo sapiens
uacuguauauau

SEQ ID NO: 667393 - RNA, 17 nt, Homo sapiens
uacugucaguuguacuu

SEQ ID NO: 667394 - RNA, 17 nt, Homo sapiens
uacugucuguuaugauu

SEQ ID NO: 667395 - RNA, 21 nt, Homo sapiens
uacugucuuacuauuauagca

SEQ ID NO: 667396 - RNA, 17 nt, Homo sapiens
uacuguggucacuugua

SEQ ID NO: 667397 - RNA, 23 nt, Homo sapiens
uacuguggucugggcaccaccuc

SEQ ID NO: 667398 - RNA, 21 nt, Homo sapiens
uacuguguuucgcauuaagca

SEQ ID NO: 667399 - RNA, 20 nt, Homo sapiens
uacuguucuauacgagugac

SEQ ID NO: 667400 - RNA, 23 nt, Homo sapiens
uacuguuuugggccuccaugccc

SEQ ID NO: 667401 - RNA, 15 nt, Homo sapiens
uacuuaaaaugacaa

SEQ ID NO: 667402 - RNA, 21 nt, Homo sapiens
uacuuaaaaugacaaagccau

SEQ ID NO: 667403 - RNA, 15 nt, Homo sapiens
uacuuaaagcuucua

SEQ ID NO: 667404 - RNA, 18 nt, Homo sapiens
uacuuaacauuucauugu

SEQ ID NO: 667405 - RNA, 16 nt, Homo sapiens
uacuuaauguaauuca

SEQ ID NO: 667406 - RNA, 16 nt, Homo sapiens
uacuuacugaacugug

SEQ ID NO: 667407 - RNA, 13 nt, Homo sapiens
uacuuagugguau

SEQ ID NO: 667408 - RNA, 20 nt, Homo sapiens
uacuuauauguaaaguauua

SEQ ID NO: 667409 - RNA, 20 nt, Homo sapiens
uacuuaugaaaagaauuuga

SEQ ID NO: 667410 - RNA, 20 nt, Homo sapiens
uacuuaugaaaucucacaga

SEQ ID NO: 667411 - RNA, 15 nt, Homo sapiens
uacuuaugccauaga

SEQ ID NO: 667412 - RNA, 17 nt, Homo sapiens
uacuuauucuagauuac

SEQ ID NO: 667413 - RNA, 16 nt, Homo sapiens
uacuucaagaucugaa

SEQ ID NO: 667414 - RNA, 18 nt, Homo sapiens
uacuucaucauuuugaca

SEQ ID NO: 667415 - RNA, 15 nt, Homo sapiens
uacuuccuacuguag

SEQ ID NO: 667416 - RNA, 18 nt, Homo sapiens
uacuuccucauaccacau

SEQ ID NO: 667417 - RNA, 22 nt, Homo sapiens
uacuucuacauccaauguauga

SEQ ID NO: 667418 - RNA, 12 nt, Homo sapiens
uacuucucacca

SEQ ID NO: 667419 - RNA, 15 nt, Homo sapiens
uacuucucgugacac

SEQ ID NO: 667420 - RNA, 20 nt, Homo sapiens
uacuucucuuguuagguaau

SEQ ID NO: 667421 - RNA, 20 nt, Homo sapiens
uacuucuggaagucaucuca

SEQ ID NO: 667422 - RNA, 18 nt, Homo sapiens
uacuucuuauacauuuga

SEQ ID NO: 667423 - RNA, 16 nt, Homo sapiens
uacuucuugaauauaa

SEQ ID NO: 667424 - RNA, 17 nt, Homo sapiens
uacuucuuuagcauuuu

SEQ ID NO: 667425 - RNA, 16 nt, Homo sapiens
uacuugaaaaaguaaa

SEQ ID NO: 667426 - RNA, 14 nt, Homo sapiens
uacuugcacuguua

SEQ ID NO: 667427 - RNA, 16 nt, Homo sapiens
uacuugccaucaguga

SEQ ID NO: 667428 - RNA, 21 nt, Homo sapiens
uacuugcuuucaauugacaaa

SEQ ID NO: 667429 - RNA, 22 nt, Homo sapiens
uacuuggcugcuuccugugaca

SEQ ID NO: 667430 - RNA, 19 nt, Homo sapiens
uacuuguuugguuugguau

SEQ ID NO: 667431 - RNA, 14 nt, Homo sapiens
uacuuuacaaacca

SEQ ID NO: 667432 - RNA, 16 nt, Homo sapiens
uacuuuacaaaccauu

SEQ ID NO: 667433 - RNA, 14 nt, Homo sapiens
uacuuuacugccug

SEQ ID NO: 667434 - RNA, 17 nt, Homo sapiens
uacuuuaugaugcuaug

SEQ ID NO: 667435 - RNA, 14 nt, Homo sapiens
uacuuucacacuaa

SEQ ID NO: 667436 - RNA, 23 nt, Homo sapiens
uacuuucuguguugaagcacugu

SEQ ID NO: 667437 - RNA, 19 nt, Homo sapiens
uacuuugaguuagugccau

SEQ ID NO: 667438 - RNA, 18 nt, Homo sapiens
uacuuugauaucugauca

SEQ ID NO: 667439 - RNA, 18 nt, Homo sapiens
uacuuugccaacuugcca

SEQ ID NO: 667440 - RNA, 19 nt, Homo sapiens
uacuuuguccuaagagauu

SEQ ID NO: 667441 - RNA, 15 nt, Homo sapiens
uacuuuucacacugu

SEQ ID NO: 667442 - RNA, 16 nt, Homo sapiens
uacuuuucacacuguc

SEQ ID NO: 667443 - RNA, 15 nt, Homo sapiens
uacuuuucuguucau

SEQ ID NO: 667444 - RNA, 21 nt, Homo sapiens
uacuuuugcccuuugauuaaa

SEQ ID NO: 667445 - RNA, 22 nt, Homo sapiens
uacuuuuuccuggcucaucucu

SEQ ID NO: 667446 - RNA, 16 nt, Homo sapiens
uacuuuuuguauuuag

SEQ ID NO: 667447 - RNA, 19 nt, Homo sapiens
uacuuuuuuauagcuuaac

SEQ ID NO: 667448 - RNA, 16 nt, Homo sapiens
uagaaaaacaucccaa

SEQ ID NO: 667449 - RNA, 13 nt, Homo sapiens
uagaaaaaccacc

SEQ ID NO: 667450 - RNA, 13 nt, Homo sapiens
uagaaaaacuugg

SEQ ID NO: 667451 - RNA, 19 nt, Homo sapiens
uagaaaaaggacucugcuu

SEQ ID NO: 667452 - RNA, 22 nt, Homo sapiens
uagaaaacagcccccacuccag

SEQ ID NO: 667453 - RNA, 16 nt, Homo sapiens
uagaaaagaaagcaaa

SEQ ID NO: 667454 - RNA, 15 nt, Homo sapiens
uagaaaaugguccaa

SEQ ID NO: 667455 - RNA, 14 nt, Homo sapiens
gaagaaacuuugcc

SEQ ID NO: 667456 - RNA, 19 nt, Homo sapiens
gaagaaaucuuucucccuc

SEQ ID NO: 667457 - RNA, 19 nt, Homo sapiens
gaagaacaagaaauggaug

SEQ ID NO: 667458 - RNA, 22 nt, Homo sapiens
gaagaacagaauugcuccugca

SEQ ID NO: 667459 - RNA, 20 nt, Homo sapiens
gaagaacaguaacugccauc

SEQ ID NO: 667460 - RNA, 17 nt, Homo sapiens
gaagaaccaaauaccuc

SEQ ID NO: 667461 - RNA, 17 nt, Homo sapiens
gaagaacugacuaguga

SEQ ID NO: 667462 - RNA, 13 nt, Homo sapiens
gaagaacuugcau

SEQ ID NO: 667463 - RNA, 20 nt, Homo sapiens
gaagaacuuggcacacucuc

SEQ ID NO: 667464 - RNA, 22 nt, Homo sapiens
gaagaagagaaaauuugaaaau

SEQ ID NO: 667465 - RNA, 18 nt, Homo sapiens
gaagaagagaugacaaac

SEQ ID NO: 667466 - RNA, 14 nt, Homo sapiens
gaagaagagcaaag

SEQ ID NO: 667467 - RNA, 19 nt, Homo sapiens
gaagaagagcaaagggugg

SEQ ID NO: 667468 - RNA, 16 nt, Homo sapiens
gaagaagauagaucca

SEQ ID NO: 667469 - RNA, 12 nt, Homo sapiens
gaagaagcuaaa

SEQ ID NO: 667470 - RNA, 19 nt, Homo sapiens
gaagaagugggagcagcuu

SEQ ID NO: 667471 - RNA, 15 nt, Homo sapiens
gaagaaugcauucaa

SEQ ID NO: 667472 - RNA, 16 nt, Homo sapiens
gaagaauggcuuucaa

SEQ ID NO: 667473 - RNA, 17 nt, Homo sapiens
gaagaauuggccaucuu

SEQ ID NO: 667474 - RNA, 16 nt, Homo sapiens
gaagaauugucuugca

SEQ ID NO: 667475 - RNA, 15 nt, Homo sapiens
gaagacacugcaaag

SEQ ID NO: 667476 - RNA, 16 nt, Homo sapiens
gaagacaucaggaaac

SEQ ID NO: 667477 - RNA, 12 nt, Homo sapiens
gaagaccaaaaa

SEQ ID NO: 667478 - RNA, 20 nt, Homo sapiens
gaagaccaagacacagauca

SEQ ID NO: 667479 - RNA, 17 nt, Homo sapiens
gaagaccacacuuggug

SEQ ID NO: 667480 - RNA, 17 nt, Homo sapiens
gaagacccacgugcuag

SEQ ID NO: 667481 - RNA, 23 nt, Homo sapiens
gaagaccuucguauccccucuca

SEQ ID NO: 667482 - RNA, 21 nt, Homo sapiens
gaagacguggacuccucuugg

SEQ ID NO: 667483 - RNA, 19 nt, Homo sapiens
gaagacugcccuacuauag

SEQ ID NO: 667484 - RNA, 15 nt, Homo sapiens
gaagacugucaggaa

SEQ ID NO: 667485 - RNA, 17 nt, Homo sapiens
gaagacuucaaaauauu

SEQ ID NO: 667486 - RNA, 19 nt, Homo sapiens
gaagacuuuaaaccaccua

SEQ ID NO: 667487 - RNA, 14 nt, Homo sapiens
gaagagaagcugcu

SEQ ID NO: 667488 - RNA, 20 nt, Homo sapiens
gaagagaagcugcugaccaa

SEQ ID NO: 667489 - RNA, 17 nt, Homo sapiens
gaagagauccuucugua

SEQ ID NO: 667490 - RNA, 14 nt, Homo sapiens
gaagagcaggugac

SEQ ID NO: 667491 - RNA, 23 nt, Homo sapiens
gaagagccuugcggaagguucua

SEQ ID NO: 667492 - RNA, 14 nt, Homo sapiens
gaagagcuauggcc

SEQ ID NO: 667493 - RNA, 13 nt, Homo sapiens
gaagagcuugugu

SEQ ID NO: 667494 - RNA, 15 nt, Homo sapiens
gaagaggaggaggug

SEQ ID NO: 667495 - RNA, 15 nt, Homo sapiens
gaagaggcugcugag

SEQ ID NO: 667496 - RNA, 17 nt, Homo sapiens
gaagagggacagaugaa

SEQ ID NO: 667497 - RNA, 17 nt, Homo sapiens
gagauugugccacuuca

SEQ ID NO: 667498 - RNA, 20 nt, Homo sapiens
gagauugugccacuucacuc

SEQ ID NO: 667499 - RNA, 18 nt, Homo sapiens
gagauuucuuguugcuca

SEQ ID NO: 667500 - RNA, 19 nt, Homo sapiens
gagcaaaaucgaugcagug

SEQ ID NO: 667501 - RNA, 19 nt, Homo sapiens
gagcaaaucaucugcauuc

SEQ ID NO: 667502 - RNA, 17 nt, Homo sapiens
gagcaaaucgugccuug

SEQ ID NO: 667503 - RNA, 19 nt, Homo sapiens
gagcaagaagaaaaugugg

SEQ ID NO: 667504 - RNA, 13 nt, Homo sapiens
gagcaagacucca

SEQ ID NO: 667505 - RNA, 13 nt, Homo sapiens
gagcaagcauugg

SEQ ID NO: 667506 - RNA, 18 nt, Homo sapiens
gagcaaggguucccucaa

SEQ ID NO: 667507 - RNA, 11 nt, Homo sapiens
gagcacacugu

SEQ ID NO: 667508 - RNA, 16 nt, Homo sapiens
gagcacagcugcauua

SEQ ID NO: 667509 - RNA, 17 nt, Homo sapiens
gagcacaggagcugcca

SEQ ID NO: 667510 - RNA, 22 nt, Homo sapiens
gagcacaggagcugccauguca

SEQ ID NO: 667511 - RNA, 18 nt, Homo sapiens
gagcacccccucauuccc

SEQ ID NO: 667512 - RNA, 16 nt, Homo sapiens
gagcacccuacaggga

SEQ ID NO: 667513 - RNA, 15 nt, Homo sapiens
gagcaccuugcaguu

SEQ ID NO: 667514 - RNA, 20 nt, Homo sapiens
gagcaccuuugcacaggaug

SEQ ID NO: 667515 - RNA, 21 nt, Homo sapiens
gagcacguggagauagugcca

SEQ ID NO: 667516 - RNA, 13 nt, Homo sapiens
gagcacucucacc

SEQ ID NO: 667517 - RNA, 22 nt, Homo sapiens
gagcacuguccaguauucuacc

SEQ ID NO: 667518 - RNA, 18 nt, Homo sapiens
gagcacuugcguccugca

SEQ ID NO: 667519 - RNA, 17 nt, Homo sapiens
gagcagaagaucaagga

SEQ ID NO: 667520 - RNA, 17 nt, Homo sapiens
gagcagaugacugagaa

SEQ ID NO: 667521 - RNA, 22 nt, Homo sapiens
gagcagaugcaaugacucagga

SEQ ID NO: 667522 - RNA, 19 nt, Homo sapiens
gagcagccacaaccaaaaa

SEQ ID NO: 667523 - RNA, 18 nt, Homo sapiens
gagcagccucuggacagc

SEQ ID NO: 667524 - RNA, 12 nt, Homo sapiens
gagcagccugug

SEQ ID NO: 667525 - RNA, 17 nt, Homo sapiens
gagcagcuagcucuuug

SEQ ID NO: 667526 - RNA, 15 nt, Homo sapiens
gagcagcuucuggga

SEQ ID NO: 667527 - RNA, 22 nt, Homo sapiens
gagcagcuucugggaccauaag

SEQ ID NO: 667528 - RNA, 21 nt, Homo sapiens
gagcagcuuuaaacucaggga

SEQ ID NO: 667529 - RNA, 17 nt, Homo sapiens
gagcaggaagcauucag

SEQ ID NO: 667530 - RNA, 14 nt, Homo sapiens
gagcaggaggccaa

SEQ ID NO: 667531 - RNA, 15 nt, Homo sapiens
gagcaggagugcuca

SEQ ID NO: 667532 - RNA, 18 nt, Homo sapiens
gagcagggauuaaccucu

SEQ ID NO: 667533 - RNA, 17 nt, Homo sapiens
gagcaggggcaggguga

SEQ ID NO: 667534 - RNA, 13 nt, Homo sapiens
gagcaggguccug

SEQ ID NO: 667535 - RNA, 20 nt, Homo sapiens
gagcaguucugaaaaaugca

SEQ ID NO: 667536 - RNA, 20 nt, Homo sapiens
gagcauaacuguucucauuu

SEQ ID NO: 667537 - RNA, 17 nt, Homo sapiens
gagcauaaugcucccau

SEQ ID NO: 667538 - RNA, 15 nt, Homo sapiens
gagcauacaucuuaa

SEQ ID NO: 667539 - RNA, 22 nt, Homo sapiens
gagcauaucaaaaaguauuaaa

SEQ ID NO: 667540 - RNA, 14 nt, Homo sapiens
gagcaucaagccac

SEQ ID NO: 667541 - RNA, 22 nt, Homo sapiens
gagcaucccccaaaguucacaa

SEQ ID NO: 667542 - RNA, 15 nt, Homo sapiens
gagcaucugcaacaa

SEQ ID NO: 667543 - RNA, 21 nt, Homo sapiens
gagcaugcucaguuggugcug

SEQ ID NO: 667544 - RNA, 18 nt, Homo sapiens
gagcaugcuuaccuucug

SEQ ID NO: 667545 - RNA, 15 nt, Homo sapiens
gagcauuacgugagc

SEQ ID NO: 667546 - RNA, 19 nt, Homo sapiens
gagcauuacgugagccagg

SEQ ID NO: 667547 - RNA, 12 nt, Homo sapiens
gagcauuuccaa

SEQ ID NO: 667548 - RNA, 19 nt, Homo sapiens
gagcauuugaaaggugugc

SEQ ID NO: 667549 - RNA, 13 nt, Homo sapiens
gagccaaggguuc

SEQ ID NO: 667550 - RNA, 17 nt, Homo sapiens
gagccaccccuaaagag

SEQ ID NO: 667551 - RNA, 20 nt, Homo sapiens
gagccaccgugcccggccaa

SEQ ID NO: 667552 - RNA, 13 nt, Homo sapiens
gagccacugggcc

SEQ ID NO: 667553 - RNA, 15 nt, Homo sapiens
gagccagaaaugggc

SEQ ID NO: 667554 - RNA, 22 nt, Homo sapiens
gagccagcugcuuuuugugauu

SEQ ID NO: 667555 - RNA, 20 nt, Homo sapiens
gagccagcuuggggccacca

SEQ ID NO: 667556 - RNA, 13 nt, Homo sapiens
gagccaggguaga

SEQ ID NO: 667557 - RNA, 13 nt, Homo sapiens
gagccagucucac

SEQ ID NO: 667558 - RNA, 20 nt, Homo sapiens
gagccauugaacagcuguga

SEQ ID NO: 667559 - RNA, 15 nt, Homo sapiens
gagcccacugcaguu

SEQ ID NO: 667560 - RNA, 18 nt, Homo sapiens
gagcccagcuacauuccu

SEQ ID NO: 667561 - RNA, 20 nt, Homo sapiens
gagcccaggccguuccccuu

SEQ ID NO: 667562 - RNA, 12 nt, Homo sapiens
gagcccagugaa

SEQ ID NO: 667563 - RNA, 15 nt, Homo sapiens
gagcccauucccacc

SEQ ID NO: 667564 - RNA, 21 nt, Homo sapiens
gagccccaggggacaagggau

SEQ ID NO: 667565 - RNA, 18 nt, Homo sapiens
gagccccagggugcccag

SEQ ID NO: 667566 - RNA, 18 nt, Homo sapiens
gagcccccaacacaggca

SEQ ID NO: 667567 - RNA, 19 nt, Homo sapiens
gagcccccaacacaggcaa

SEQ ID NO: 667568 - RNA, 17 nt, Homo sapiens
gagcccccaccacaaac

SEQ ID NO: 667569 - RNA, 15 nt, Homo sapiens
gagcccccaccggaa

SEQ ID NO: 667570 - RNA, 17 nt, Homo sapiens
gagcccgcagcccagac

SEQ ID NO: 667571 - RNA, 20 nt, Homo sapiens
gagcccgcagggccaugcag

SEQ ID NO: 667572 - RNA, 16 nt, Homo sapiens
gagcccuggcaggaug

SEQ ID NO: 667573 - RNA, 16 nt, Homo sapiens
gagcccuggcucccac

SEQ ID NO: 667574 - RNA, 14 nt, Homo sapiens
gagcccuuaugaca

SEQ ID NO: 667575 - RNA, 17 nt, Homo sapiens
gagccgagaucaugcca

SEQ ID NO: 667576 - RNA, 19 nt, Homo sapiens
gagccgagaucaugccauu

SEQ ID NO: 667577 - RNA, 20 nt, Homo sapiens
gagccgagaucaugccauug

SEQ ID NO: 667578 - RNA, 19 nt, Homo sapiens
gagccgcaccuugucaugu

SEQ ID NO: 667579 - RNA, 16 nt, Homo sapiens
gagccggacaccaagc

SEQ ID NO: 667580 - RNA, 18 nt, Homo sapiens
gagccgugaacugugcau

SEQ ID NO: 667581 - RNA, 16 nt, Homo sapiens
gagccucaauuuccuc

SEQ ID NO: 667582 - RNA, 23 nt, Homo sapiens
gagccucccccucagaugaucuc

SEQ ID NO: 667583 - RNA, 16 nt, Homo sapiens
gagccuccucgucacc

SEQ ID NO: 667584 - RNA, 17 nt, Homo sapiens
gagccucgggacaucaa

SEQ ID NO: 667585 - RNA, 18 nt, Homo sapiens
gagccugagccacaaaaa

SEQ ID NO: 667586 - RNA, 19 nt, Homo sapiens
gagccugagguacagagaa

SEQ ID NO: 667587 - RNA, 14 nt, Homo sapiens
gagccugcagauga

SEQ ID NO: 667588 - RNA, 20 nt, Homo sapiens
gagccugcaggguggugcug

SEQ ID NO: 667589 - RNA, 15 nt, Homo sapiens
gagccugcauuuccu

SEQ ID NO: 667590 - RNA, 16 nt, Homo sapiens
gagggaaaucuguaaa

SEQ ID NO: 667591 - RNA, 21 nt, Homo sapiens
gagggaagaaugaacacuccc

SEQ ID NO: 667592 - RNA, 23 nt, Homo sapiens
gagggaagaaugaacacucccca

SEQ ID NO: 667593 - RNA, 12 nt, Homo sapiens
gagggaaggaug

SEQ ID NO: 667594 - RNA, 19 nt, Homo sapiens
gagggaagguucuucauga

SEQ ID NO: 667595 - RNA, 22 nt, Homo sapiens
gagggaaguggagguugcugua

SEQ ID NO: 667596 - RNA, 17 nt, Homo sapiens
gagggacacaugccccu

SEQ ID NO: 667597 - RNA, 18 nt, Homo sapiens
gagggaccucucccaggg

SEQ ID NO: 667598 - RNA, 20 nt, Homo sapiens
gagggaccugcaucuaagca

SEQ ID NO: 667599 - RNA, 15 nt, Homo sapiens
gagggagaagcauga

SEQ ID NO: 667600 - RNA, 21 nt, Homo sapiens
gagggagcgacacuugaaugu

SEQ ID NO: 667601 - RNA, 16 nt, Homo sapiens
gagggaggagaaugag

SEQ ID NO: 667602 - RNA, 17 nt, Homo sapiens
gagggaggcucaggucc

SEQ ID NO: 667603 - RNA, 17 nt, Homo sapiens
gagggaggucacuggaa

SEQ ID NO: 667604 - RNA, 14 nt, Homo sapiens
gagggauggugccc

SEQ ID NO: 667605 - RNA, 22 nt, Homo sapiens
gagggcacuuccuccacagucc

SEQ ID NO: 667606 - RNA, 11 nt, Homo sapiens
gagggcagcug

SEQ ID NO: 667607 - RNA, 17 nt, Homo sapiens
gagggcaggcacuccca

SEQ ID NO: 667608 - RNA, 17 nt, Homo sapiens
gagggccacaugggagg

SEQ ID NO: 667609 - RNA, 15 nt, Homo sapiens
gagggccagagcaag

SEQ ID NO: 667610 - RNA, 12 nt, Homo sapiens
gagggccaguga

SEQ ID NO: 667611 - RNA, 14 nt, Homo sapiens
gagggccagugaug

SEQ ID NO: 667612 - RNA, 16 nt, Homo sapiens
gagggcccagcccaga

SEQ ID NO: 667613 - RNA, 17 nt, Homo sapiens
gagggccccucugccca

SEQ ID NO: 667614 - RNA, 16 nt, Homo sapiens
gagggccccugcgugg

SEQ ID NO: 667615 - RNA, 19 nt, Homo sapiens
gagggccgugagggguccc

SEQ ID NO: 667616 - RNA, 15 nt, Homo sapiens
gagggcuguggugcc

SEQ ID NO: 667617 - RNA, 15 nt, Homo sapiens
gaggggaagggccag

SEQ ID NO: 667618 - RNA, 19 nt, Homo sapiens
gaggggagugugugcagcg

SEQ ID NO: 667619 - RNA, 11 nt, Homo sapiens
gaggggccagu

SEQ ID NO: 667620 - RNA, 17 nt, Homo sapiens
gagggggacuaaacuca

SEQ ID NO: 667621 - RNA, 18 nt, Homo sapiens
gagggggcuugaagccaa

SEQ ID NO: 667622 - RNA, 19 nt, Homo sapiens
gagggggucugggccagug

SEQ ID NO: 667623 - RNA, 19 nt, Homo sapiens
gagggguaagagaggaugu

SEQ ID NO: 667624 - RNA, 17 nt, Homo sapiens
gagggugagacacugca

SEQ ID NO: 667625 - RNA, 19 nt, Homo sapiens
gagggugcagcccucuugc

SEQ ID NO: 667626 - RNA, 19 nt, Homo sapiens
gaggguggaucacaccuca

SEQ ID NO: 667627 - RNA, 21 nt, Homo sapiens
gagggugggaaggaaacaacc

SEQ ID NO: 667628 - RNA, 21 nt, Homo sapiens
gaggguuccgccacuccaguu

SEQ ID NO: 667629 - RNA, 21 nt, Homo sapiens
gaggguuccucuuaggucaga

SEQ ID NO: 667630 - RNA, 23 nt, Homo sapiens
gaggguuggguucaucugagcaa

SEQ ID NO: 667631 - RNA, 18 nt, Homo sapiens
gagguagagguugcacug

SEQ ID NO: 667632 - RNA, 20 nt, Homo sapiens
gagguagguagauugcuuga

SEQ ID NO: 667633 - RNA, 21 nt, Homo sapiens
gagguauggcagaggugcaag

SEQ ID NO: 667634 - RNA, 20 nt, Homo sapiens
gaggucaaggcugcagugag

SEQ ID NO: 667635 - RNA, 17 nt, Homo sapiens
gaggucaggccccacuc

SEQ ID NO: 667636 - RNA, 23 nt, Homo sapiens
gaggucagggagugcuggcucac

SEQ ID NO: 667637 - RNA, 15 nt, Homo sapiens
gaggucauacaugca

SEQ ID NO: 667638 - RNA, 17 nt, Homo sapiens
gaggucaucacuuugac

SEQ ID NO: 667639 - RNA, 21 nt, Homo sapiens
gaggucuguacguuaccucuu

SEQ ID NO: 667640 - RNA, 17 nt, Homo sapiens
gaggugaaauucaguua

SEQ ID NO: 667641 - RNA, 22 nt, Homo sapiens
gaggugagggggguucuccuuu

SEQ ID NO: 667642 - RNA, 18 nt, Homo sapiens
gagguggagguugcagug

SEQ ID NO: 667643 - RNA, 19 nt, Homo sapiens
gaggugggagaggccucau

SEQ ID NO: 667644 - RNA, 20 nt, Homo sapiens
gaggugggaggauugcuuga

SEQ ID NO: 667645 - RNA, 15 nt, Homo sapiens
gaggugggauccucc

SEQ ID NO: 667646 - RNA, 20 nt, Homo sapiens
gaggugggauccucccucau

SEQ ID NO: 667647 - RNA, 21 nt, Homo sapiens
gaggugggcaugccacccuca

SEQ ID NO: 667648 - RNA, 15 nt, Homo sapiens
gagguguacagguac

SEQ ID NO: 667649 - RNA, 17 nt, Homo sapiens
gagguguggauaaggcu

SEQ ID NO: 667650 - RNA, 19 nt, Homo sapiens
gagguguuggcugcacgug

SEQ ID NO: 667651 - RNA, 16 nt, Homo sapiens
gagguuugcacuuccu

SEQ ID NO: 667652 - RNA, 17 nt, Homo sapiens
gagguuugccagcauuu

SEQ ID NO: 667653 - RNA, 22 nt, Homo sapiens
gagguuuuguauugagggccag

SEQ ID NO: 667654 - RNA, 14 nt, Homo sapiens
gaguaaaacuguau

SEQ ID NO: 667655 - RNA, 15 nt, Homo sapiens
gaguaaauacaggua

SEQ ID NO: 667656 - RNA, 19 nt, Homo sapiens
gaguaaauauauaugucaa

SEQ ID NO: 667657 - RNA, 17 nt, Homo sapiens
gaguaacaggugccuuc

SEQ ID NO: 667658 - RNA, 12 nt, Homo sapiens
gaguaacaucua

SEQ ID NO: 667659 - RNA, 15 nt, Homo sapiens
gaguaagcaguguua

SEQ ID NO: 667660 - RNA, 12 nt, Homo sapiens
gaguaagccagu

SEQ ID NO: 667661 - RNA, 23 nt, Homo sapiens
gaguaagcccucaggagccucug

SEQ ID NO: 667662 - RNA, 18 nt, Homo sapiens
gaguaaggcacacccaaa

SEQ ID NO: 667663 - RNA, 12 nt, Homo sapiens
gaguaccuggac

SEQ ID NO: 667664 - RNA, 21 nt, Homo sapiens
gaguagagaggcccgcccgcc

SEQ ID NO: 667665 - RNA, 17 nt, Homo sapiens
gaguagggacucagggc

SEQ ID NO: 667666 - RNA, 20 nt, Homo sapiens
gaguagggacucagggccau

SEQ ID NO: 667667 - RNA, 22 nt, Homo sapiens
gaguaucuuuaaaagugccuua

SEQ ID NO: 667668 - RNA, 17 nt, Homo sapiens
gaguauuagcuuaccca

SEQ ID NO: 667669 - RNA, 21 nt, Homo sapiens
gagucaauuaaacagcugguc

SEQ ID NO: 667670 - RNA, 17 nt, Homo sapiens
gagucacaguugacaaa

SEQ ID NO: 667671 - RNA, 12 nt, Homo sapiens
gagucacauccu

SEQ ID NO: 667672 - RNA, 16 nt, Homo sapiens
gagucagaucuuucuc

SEQ ID NO: 667673 - RNA, 21 nt, Homo sapiens
gagucaugauccuugcugaua

SEQ ID NO: 667674 - RNA, 16 nt, Homo sapiens
gaguccacugcuccau

SEQ ID NO: 667675 - RNA, 14 nt, Homo sapiens
gaguccacuuuguu

SEQ ID NO: 667676 - RNA, 16 nt, Homo sapiens
gaguccccuacucccu

SEQ ID NO: 667677 - RNA, 20 nt, Homo sapiens
gaguccugaagaucaagcca

SEQ ID NO: 667678 - RNA, 14 nt, Homo sapiens
gagucgcugugcca

SEQ ID NO: 667679 - RNA, 13 nt, Homo sapiens
gagucgggacuaa

SEQ ID NO: 667680 - RNA, 19 nt, Homo sapiens
gagucucacucuguugccu

SEQ ID NO: 667681 - RNA, 19 nt, Homo sapiens
gagucucagaaacuccccu

SEQ ID NO: 667682 - RNA, 15 nt, Homo sapiens
gagucugaacagcug

SEQ ID NO: 667683 - RNA, 18 nt, Homo sapiens
gagucugaacagcuguaa

SEQ ID NO: 667684 - RNA, 23 nt, Homo sapiens
gagucugccccacauguggccau

SEQ ID NO: 667685 - RNA, 23 nt, Homo sapiens
gagucuggggucuccuauacucu

SEQ ID NO: 667686 - RNA, 19 nt, Homo sapiens
gagucuguaaaaccagcau

SEQ ID NO: 667687 - RNA, 14 nt, Homo sapiens
gagucugugcucuu

SEQ ID NO: 667688 - RNA, 16 nt, Homo sapiens
gagucuguuucaggag

SEQ ID NO: 667689 - RNA, 18 nt, Homo sapiens
gagugaaaccaugacugu

SEQ ID NO: 667690 - RNA, 17 nt, Homo sapiens
gagugacccagcuacug

SEQ ID NO: 667691 - RNA, 13 nt, Homo sapiens
gagugacucaaga

SEQ ID NO: 667692 - RNA, 13 nt, Homo sapiens
gagugagccagug

SEQ ID NO: 667693 - RNA, 14 nt, Homo sapiens
gagugauccuccaa

SEQ ID NO: 667694 - RNA, 15 nt, Homo sapiens
gagugcaaguaucau

SEQ ID NO: 667695 - RNA, 19 nt, Homo sapiens
gagugcaauggugugaucu

SEQ ID NO: 667696 - RNA, 15 nt, Homo sapiens
gagugcagugagcua

SEQ ID NO: 667697 - RNA, 19 nt, Homo sapiens
gagugcaguggcgugaucu

SEQ ID NO: 667698 - RNA, 19 nt, Homo sapiens
gagugcaguggugcaauca

SEQ ID NO: 667699 - RNA, 19 nt, Homo sapiens
gagugcaguggugugaucu

SEQ ID NO: 667700 - RNA, 13 nt, Homo sapiens
gagugccaugcuu

SEQ ID NO: 667701 - RNA, 21 nt, Homo sapiens
gagugccguaacaacuguggu

SEQ ID NO: 667702 - RNA, 22 nt, Homo sapiens
gagugccguaacaacugugguc

SEQ ID NO: 667703 - RNA, 21 nt, Homo sapiens
gagugcgcagaucugugccug

SEQ ID NO: 667704 - RNA, 14 nt, Homo sapiens
gagugcucuugcua

SEQ ID NO: 667705 - RNA, 14 nt, Homo sapiens
gaguggaaggucua

SEQ ID NO: 667706 - RNA, 14 nt, Homo sapiens
gaguggaucuccaa

SEQ ID NO: 667707 - RNA, 13 nt, Homo sapiens
gagugggaccaac

SEQ ID NO: 667708 - RNA, 21 nt, Homo sapiens
gagugggguuuucuugaacau

SEQ ID NO: 667709 - RNA, 11 nt, Homo sapiens
gaguggugcca

SEQ ID NO: 667710 - RNA, 15 nt, Homo sapiens
gagugguuguugcca

SEQ ID NO: 667711 - RNA, 12 nt, Homo sapiens
gaguguagccua

SEQ ID NO: 667712 - RNA, 22 nt, Homo sapiens
gaguguaggugaaaugaaugaa

SEQ ID NO: 667713 - RNA, 14 nt, Homo sapiens
gaguguccggcuga

SEQ ID NO: 667714 - RNA, 16 nt, Homo sapiens
gaguguccucuucccu

SEQ ID NO: 667715 - RNA, 18 nt, Homo sapiens
gagugugacagggccagu

SEQ ID NO: 667716 - RNA, 14 nt, Homo sapiens
gagugugcucuccc

SEQ ID NO: 667717 - RNA, 14 nt, Homo sapiens
gagugugcugcuau

SEQ ID NO: 667718 - RNA, 16 nt, Homo sapiens
gaguguggauuguaua

SEQ ID NO: 667719 - RNA, 18 nt, Homo sapiens
gagugugguuaugaacuu

SEQ ID NO: 667720 - RNA, 21 nt, Homo sapiens
gagugugugacauuccagggg

SEQ ID NO: 667721 - RNA, 14 nt, Homo sapiens
gagugugugcaagu

SEQ ID NO: 667722 - RNA, 22 nt, Homo sapiens
gaguguucauuuuagugacugu

SEQ ID NO: 667723 - RNA, 22 nt, Homo sapiens
gaguguuccccuuccacugagg

SEQ ID NO: 667724 - RNA, 19 nt, Homo sapiens
gaguguuuuaaaacauuca

SEQ ID NO: 667725 - RNA, 13 nt, Homo sapiens
gaguuagugccau

SEQ ID NO: 667726 - RNA, 21 nt, Homo sapiens
gaguuaguggauuacugccau

SEQ ID NO: 667727 - RNA, 15 nt, Homo sapiens
gaguucaagccugug

SEQ ID NO: 667728 - RNA, 14 nt, Homo sapiens
gaguucagugcuca

SEQ ID NO: 667729 - RNA, 16 nt, Homo sapiens
gaguucccacccaagc

SEQ ID NO: 667730 - RNA, 13 nt, Homo sapiens
gaguuccggccug

SEQ ID NO: 667731 - RNA, 20 nt, Homo sapiens
gaguuccggccugggcacca

SEQ ID NO: 667732 - RNA, 17 nt, Homo sapiens
gaguuccuaacaggaug

SEQ ID NO: 667733 - RNA, 17 nt, Homo sapiens
gaguuccucugcaguuu

SEQ ID NO: 667734 - RNA, 15 nt, Homo sapiens
gaguucgagaccaac

SEQ ID NO: 667735 - RNA, 19 nt, Homo sapiens
gaguucugacuaaagguua

SEQ ID NO: 667736 - RNA, 19 nt, Homo sapiens
uagucuguaauacacucca

SEQ ID NO: 667737 - RNA, 21 nt, Homo sapiens
uagucuuauguaaaguauguu

SEQ ID NO: 667738 - RNA, 13 nt, Homo sapiens
uagucuuugccag

SEQ ID NO: 667739 - RNA, 19 nt, Homo sapiens
uagugaaauggccacuacu

SEQ ID NO: 667740 - RNA, 16 nt, Homo sapiens
uagugaagcuaauuaa

SEQ ID NO: 667741 - RNA, 15 nt, Homo sapiens
uagugaauggucucu

SEQ ID NO: 667742 - RNA, 20 nt, Homo sapiens
uagugaccaaauucagccua

SEQ ID NO: 667743 - RNA, 19 nt, Homo sapiens
uagugaccauuauucacag

SEQ ID NO: 667744 - RNA, 17 nt, Homo sapiens
uagugaccuguguuuca

SEQ ID NO: 667745 - RNA, 15 nt, Homo sapiens
uagugagggccucaa

SEQ ID NO: 667746 - RNA, 19 nt, Homo sapiens
uagugagggccucaagucc

SEQ ID NO: 667747 - RNA, 11 nt, Homo sapiens
uagugaguaua

SEQ ID NO: 667748 - RNA, 17 nt, Homo sapiens
uagugagucagcaccuu

SEQ ID NO: 667749 - RNA, 14 nt, Homo sapiens
uagugaucauuuaa

SEQ ID NO: 667750 - RNA, 19 nt, Homo sapiens
uagugaugagaauuguaug

SEQ ID NO: 667751 - RNA, 14 nt, Homo sapiens
uagugcaacuuaga

SEQ ID NO: 667752 - RNA, 14 nt, Homo sapiens
uagugcacuagcau

SEQ ID NO: 667753 - RNA, 21 nt, Homo sapiens
uagugcaugaauagauucucu

SEQ ID NO: 667754 - RNA, 12 nt, Homo sapiens
uagugccuugcc

SEQ ID NO: 667755 - RNA, 13 nt, Homo sapiens
uagugcuuuucag

SEQ ID NO: 667756 - RNA, 17 nt, Homo sapiens
uaguggaccacuuggaa

SEQ ID NO: 667757 - RNA, 21 nt, Homo sapiens
uaguggcugccucauauagca

SEQ ID NO: 667758 - RNA, 21 nt, Homo sapiens
uaguggcuguucaugcuccaa

SEQ ID NO: 667759 - RNA, 22 nt, Homo sapiens
uagugguauagaguacugcaga

SEQ ID NO: 667760 - RNA, 15 nt, Homo sapiens
uagugguaugucucu

SEQ ID NO: 667761 - RNA, 21 nt, Homo sapiens
uagugguuuaucagcaaaaaa

SEQ ID NO: 667762 - RNA, 13 nt, Homo sapiens
uaguguauucucu

SEQ ID NO: 667763 - RNA, 19 nt, Homo sapiens
uagugucaccaauuccacc

SEQ ID NO: 667764 - RNA, 18 nt, Homo sapiens
uaguguccaaauucucac

SEQ ID NO: 667765 - RNA, 18 nt, Homo sapiens
uagugucuauuaucacau

SEQ ID NO: 667766 - RNA, 18 nt, Homo sapiens
uaguguuaauaucuugaa

SEQ ID NO: 667767 - RNA, 19 nt, Homo sapiens
uaguuaaaaaaacaaacag

SEQ ID NO: 667768 - RNA, 14 nt, Homo sapiens
uaguuaagugugga

SEQ ID NO: 667769 - RNA, 19 nt, Homo sapiens
uaguuacaaaauacaaaag

SEQ ID NO: 667770 - RNA, 22 nt, Homo sapiens
uaguuacaaaguuauauucaca

SEQ ID NO: 667771 - RNA, 21 nt, Homo sapiens
uaguuaccacauuacucugcc

SEQ ID NO: 667772 - RNA, 16 nt, Homo sapiens
uaguuaccuacugagu

SEQ ID NO: 667773 - RNA, 18 nt, Homo sapiens
uaguuaccuuauaguuac

SEQ ID NO: 667774 - RNA, 15 nt, Homo sapiens
uaguuagcuauuucu

SEQ ID NO: 667775 - RNA, 17 nt, Homo sapiens
uaguuauauauggggau

SEQ ID NO: 667776 - RNA, 15 nt, Homo sapiens
uaguuaucaguauuu

SEQ ID NO: 667777 - RNA, 22 nt, Homo sapiens
uaguucaauauuuguuacuguu

SEQ ID NO: 667778 - RNA, 20 nt, Homo sapiens
uaguucacccccugagaucc

SEQ ID NO: 667779 - RNA, 16 nt, Homo sapiens
uaguucagccauugug

SEQ ID NO: 667780 - RNA, 18 nt, Homo sapiens
uaguucagccauugugga

SEQ ID NO: 667781 - RNA, 14 nt, Homo sapiens
uaguucagcugccc

SEQ ID NO: 667782 - RNA, 15 nt, Homo sapiens
uaguucauccaaucc

SEQ ID NO: 667783 - RNA, 13 nt, Homo sapiens
uaguuccaguuuc

SEQ ID NO: 667784 - RNA, 22 nt, Homo sapiens
uaguuccccaaauacaaaguua

SEQ ID NO: 667785 - RNA, 22 nt, Homo sapiens
uaguucccugaaaacccagaga

SEQ ID NO: 667786 - RNA, 19 nt, Homo sapiens
uaguucuacauuauucuuc

SEQ ID NO: 667787 - RNA, 13 nt, Homo sapiens
uaguucuaccuca

SEQ ID NO: 667788 - RNA, 16 nt, Homo sapiens
uaguucuaucaggaaa

SEQ ID NO: 667789 - RNA, 15 nt, Homo sapiens
uaguucuugugcaug

SEQ ID NO: 667790 - RNA, 19 nt, Homo sapiens
uaguucuugugcauguuua

SEQ ID NO: 667791 - RNA, 21 nt, Homo sapiens
uaguugaauguugcaauguga

SEQ ID NO: 667792 - RNA, 23 nt, Homo sapiens
uaguugaucuacaaaggccaugg

SEQ ID NO: 667793 - RNA, 19 nt, Homo sapiens
uaguuguucuagcagugaa

SEQ ID NO: 667794 - RNA, 15 nt, Homo sapiens
uaguuuaaaaugcag

SEQ ID NO: 667795 - RNA, 14 nt, Homo sapiens
uaguuucaaagucu

SEQ ID NO: 667796 - RNA, 13 nt, Homo sapiens
uaguuuccuuuag

SEQ ID NO: 667797 - RNA, 15 nt, Homo sapiens
uaguuugacucagua

SEQ ID NO: 667798 - RNA, 20 nt, Homo sapiens
uaguuuuauaaaacucaguu

SEQ ID NO: 667799 - RNA, 16 nt, Homo sapiens
uaguuuucaaaacaca

SEQ ID NO: 667800 - RNA, 17 nt, Homo sapiens
uaguuuuuacaaaacug

SEQ ID NO: 667801 - RNA, 14 nt, Homo sapiens
uaguuuuucacuuu

SEQ ID NO: 667802 - RNA, 19 nt, Homo sapiens
uauaaaaacagauucugau

SEQ ID NO: 667803 - RNA, 20 nt, Homo sapiens
uauaaaaacagcuccucuau

SEQ ID NO: 667804 - RNA, 19 nt, Homo sapiens
uauaaaaaugagugcuuaa

SEQ ID NO: 667805 - RNA, 21 nt, Homo sapiens
uauaaaaggauguuacaaguu

SEQ ID NO: 667806 - RNA, 23 nt, Homo sapiens
uauaaacuauaaccucuccuuca

SEQ ID NO: 667807 - RNA, 21 nt, Homo sapiens
uauaaagaagaacuugcaugg

SEQ ID NO: 667808 - RNA, 16 nt, Homo sapiens
uauaaagaccuauaaa

SEQ ID NO: 667809 - RNA, 14 nt, Homo sapiens
uauaaagauuuucu

SEQ ID NO: 667810 - RNA, 15 nt, Homo sapiens
uauaaagcacaucuc

SEQ ID NO: 667811 - RNA, 15 nt, Homo sapiens
uauaaagcacuauac

SEQ ID NO: 667812 - RNA, 16 nt, Homo sapiens
uauaaagcauuacucu

SEQ ID NO: 667813 - RNA, 20 nt, Homo sapiens
uauaaagccuguauucucaa

SEQ ID NO: 667814 - RNA, 19 nt, Homo sapiens
uauaaaggccagcgccaga

SEQ ID NO: 667815 - RNA, 22 nt, Homo sapiens
uauaaaguugguucacuucaaa

SEQ ID NO: 667816 - RNA, 14 nt, Homo sapiens
uauaaauaaacaca

SEQ ID NO: 667817 - RNA, 21 nt, Homo sapiens
uauaaauacacuuccugcuua

SEQ ID NO: 667818 - RNA, 17 nt, Homo sapiens
uauaaauacaugcacac

SEQ ID NO: 667819 - RNA, 12 nt, Homo sapiens
uauaaaucuuuc

SEQ ID NO: 667820 - RNA, 21 nt, Homo sapiens
uauaaaugaaucugguguugg

SEQ ID NO: 667821 - RNA, 15 nt, Homo sapiens
uauaaaugaauuugc

SEQ ID NO: 667822 - RNA, 22 nt, Homo sapiens
uauaaaugaauuugcauaccag

SEQ ID NO: 667823 - RNA, 20 nt, Homo sapiens
uauaaaugggaaaucagugu

SEQ ID NO: 667824 - RNA, 21 nt, Homo sapiens
uauaaaugugauugcagcuuu

SEQ ID NO: 667825 - RNA, 23 nt, Homo sapiens
uauaaauuuauuuacugcuaguc

SEQ ID NO: 667826 - RNA, 20 nt, Homo sapiens
uauaaauuuuauaacagaau

SEQ ID NO: 667827 - RNA, 22 nt, Homo sapiens
uauaaauuuuuugugaucagua

SEQ ID NO: 667828 - RNA, 14 nt, Homo sapiens
uauaacaacaauga

SEQ ID NO: 667829 - RNA, 21 nt, Homo sapiens
uauaacagaauuaaaguagau

SEQ ID NO: 667830 - RNA, 12 nt, Homo sapiens
uauaacaguguu

SEQ ID NO: 667831 - RNA, 22 nt, Homo sapiens
uauaaccacaaagcacaguuug

SEQ ID NO: 667832 - RNA, 12 nt, Homo sapiens
uauaaccccagc

SEQ ID NO: 667833 - RNA, 12 nt, Homo sapiens
uauaaccuuaau

SEQ ID NO: 667834 - RNA, 21 nt, Homo sapiens
uauaaccuuguucucugcuug

SEQ ID NO: 667835 - RNA, 23 nt, Homo sapiens
uauaacuacuccggagacagggu

SEQ ID NO: 667836 - RNA, 17 nt, Homo sapiens
uauaacuagacaucugc

SEQ ID NO: 667837 - RNA, 13 nt, Homo sapiens
gaugcugucugaa

SEQ ID NO: 667838 - RNA, 19 nt, Homo sapiens
gauggaaguaaagccucaa

SEQ ID NO: 667839 - RNA, 23 nt, Homo sapiens
gauggaauuuggaacaauagaau

SEQ ID NO: 667840 - RNA, 22 nt, Homo sapiens
gauggacaagauuaccccaccu

SEQ ID NO: 667841 - RNA, 20 nt, Homo sapiens
gauggacagacucacaaccu

SEQ ID NO: 667842 - RNA, 16 nt, Homo sapiens
gauggacuuggcuuca

SEQ ID NO: 667843 - RNA, 14 nt, Homo sapiens
gauggagaugucuc

SEQ ID NO: 667844 - RNA, 18 nt, Homo sapiens
gauggagccagcucugca

SEQ ID NO: 667845 - RNA, 22 nt, Homo sapiens
gauggagugugcagacagccau

SEQ ID NO: 667846 - RNA, 15 nt, Homo sapiens
gauggauaagcuugu

SEQ ID NO: 667847 - RNA, 18 nt, Homo sapiens
gauggauagucuguccaa

SEQ ID NO: 667848 - RNA, 13 nt, Homo sapiens
gauggauuaacau

SEQ ID NO: 667849 - RNA, 13 nt, Homo sapiens
gauggauuuccag

SEQ ID NO: 667850 - RNA, 18 nt, Homo sapiens
gauggcaccacugcacuc

SEQ ID NO: 667851 - RNA, 21 nt, Homo sapiens
gauggcagauucccacugccg

SEQ ID NO: 667852 - RNA, 16 nt, Homo sapiens
gauggcauccugugaa

SEQ ID NO: 667853 - RNA, 17 nt, Homo sapiens
gauggcauccugugaag

SEQ ID NO: 667854 - RNA, 21 nt, Homo sapiens
gauggcauccugugaaguccu

SEQ ID NO: 667855 - RNA, 20 nt, Homo sapiens
gauggcauuuggucucaggc

SEQ ID NO: 667856 - RNA, 21 nt, Homo sapiens
gauggcauuuuuugcaaguua

SEQ ID NO: 667857 - RNA, 24 nt, Homo sapiens
gauugagaaauguguagcugcaaa

SEQ ID NO: 667858 - RNA, 15 nt, Homo sapiens
gauugauuaccaagu

SEQ ID NO: 667859 - RNA, 11 nt, Homo sapiens
gauugcacaga

SEQ ID NO: 667860 - RNA, 20 nt, Homo sapiens
gauugcacguggccucuuga

SEQ ID NO: 667861 - RNA, 19 nt, Homo sapiens
gauuggcuauaacaugucu

SEQ ID NO: 667862 - RNA, 14 nt, Homo sapiens
gauuggcucaccca

SEQ ID NO: 667863 - RNA, 17 nt, Homo sapiens
gauuggcucacccaagc

SEQ ID NO: 667864 - RNA, 16 nt, Homo sapiens
gauuguauaacccaua

SEQ ID NO: 667865 - RNA, 19 nt, Homo sapiens
gauugucaccaugaucacu

SEQ ID NO: 667866 - RNA, 19 nt, Homo sapiens
gauugucauguaaggcuua

SEQ ID NO: 667867 - RNA, 20 nt, Homo sapiens
gauugugccacuucacucca

SEQ ID NO: 667868 - RNA, 19 nt, Homo sapiens
gauugugguacaaucucaa

SEQ ID NO: 667869 - RNA, 21 nt, Homo sapiens
gauuguguugaagaaggguua

SEQ ID NO: 667870 - RNA, 20 nt, Homo sapiens
gauuuaaaaaaagaacauaa

SEQ ID NO: 667871 - RNA, 17 nt, Homo sapiens
gauuuaaaaacuggaac

SEQ ID NO: 667872 - RNA, 16 nt, Homo sapiens
gauuuaaaaaugccaa

SEQ ID NO: 667873 - RNA, 17 nt, Homo sapiens
gauuuaaaguggcagcu

SEQ ID NO: 667874 - RNA, 15 nt, Homo sapiens
gauuuaauacaguuu

SEQ ID NO: 667875 - RNA, 22 nt, Homo sapiens
gauuuaauuuccaggguugcuu

SEQ ID NO: 667876 - RNA, 21 nt, Homo sapiens
gauuuagaaaaaaguuuacaa

SEQ ID NO: 667877 - RNA, 23 nt, Homo sapiens
gauuuagcccaugacguguuucu

SEQ ID NO: 667878 - RNA, 18 nt, Homo sapiens
gauuuaguuuuguaacuu

SEQ ID NO: 667879 - RNA, 22 nt, Homo sapiens
gauuuauaguaugugacuuuuc

SEQ ID NO: 667880 - RNA, 17 nt, Homo sapiens
gauuuaugacauuacaa

SEQ ID NO: 667881 - RNA, 19 nt, Homo sapiens
gauuuaugaucacuuggaa

SEQ ID NO: 667882 - RNA, 15 nt, Homo sapiens
gauuuauucugccaa

SEQ ID NO: 667883 - RNA, 17 nt, Homo sapiens
gauuuauucugccaaac

SEQ ID NO: 667884 - RNA, 15 nt, Homo sapiens
gauuucaggcagcag

SEQ ID NO: 667885 - RNA, 21 nt, Homo sapiens
gauuucauaguucagaauuua

SEQ ID NO: 667886 - RNA, 18 nt, Homo sapiens
gauuuccuggagugcccu

SEQ ID NO: 667887 - RNA, 13 nt, Homo sapiens
gauuuccuuucag

SEQ ID NO: 667888 - RNA, 19 nt, Homo sapiens
gauuucugguugauuugua

SEQ ID NO: 667889 - RNA, 16 nt, Homo sapiens
gauuucuuaguucaua

SEQ ID NO: 667890 - RNA, 21 nt, Homo sapiens
gauuugaaaauuguauaccaa

SEQ ID NO: 667891 - RNA, 22 nt, Homo sapiens
gauuugccagcacaggggcccc

SEQ ID NO: 667892 - RNA, 20 nt, Homo sapiens
gauuugccguaccaaucucu

SEQ ID NO: 667893 - RNA, 13 nt, Homo sapiens
gauuugcugugua

SEQ ID NO: 667894 - RNA, 16 nt, Homo sapiens
gauuugggugaacaaa

SEQ ID NO: 667895 - RNA, 20 nt, Homo sapiens
gauuugguacuuuugagugu

SEQ ID NO: 667896 - RNA, 18 nt, Homo sapiens
gauuugguggaugugaug

SEQ ID NO: 667897 - RNA, 15 nt, Homo sapiens
gauuuguacaggagu

SEQ ID NO: 667898 - RNA, 19 nt, Homo sapiens
gauuuuaaaaagucuucac

SEQ ID NO: 667899 - RNA, 19 nt, Homo sapiens
gauuuuaccaaagcaucaa

SEQ ID NO: 667900 - RNA, 13 nt, Homo sapiens
gauuuuacuuuaa

SEQ ID NO: 667901 - RNA, 16 nt, Homo sapiens
gauuuuaucugugaau

SEQ ID NO: 667902 - RNA, 19 nt, Homo sapiens
gauuuucuaagaaccaaaa

SEQ ID NO: 667903 - RNA, 15 nt, Homo sapiens
gauuuucuauuuaug

SEQ ID NO: 667904 - RNA, 22 nt, Homo sapiens
gauuuugaaauauaguaaacac

SEQ ID NO: 667905 - RNA, 12 nt, Homo sapiens
gauuuugcaauc

SEQ ID NO: 667906 - RNA, 17 nt, Homo sapiens
gauuuugcaaucugugu

SEQ ID NO: 667907 - RNA, 21 nt, Homo sapiens
gauuuugcugagaugaagcua

SEQ ID NO: 667908 - RNA, 16 nt, Homo sapiens
gauuuugcuguagaag

SEQ ID NO: 667909 - RNA, 21 nt, Homo sapiens
gauuuuuagccccaaaucucu

SEQ ID NO: 667910 - RNA, 23 nt, Homo sapiens
gauuuuucuaaccuugaaugcug

SEQ ID NO: 667911 - RNA, 17 nt, Homo sapiens
gauuuuuguauguuaug

SEQ ID NO: 667912 - RNA, 17 nt, Homo sapiens
gcaaaaaagguaacuaa

SEQ ID NO: 667913 - RNA, 13 nt, Homo sapiens
gcaaaaaguauug

SEQ ID NO: 667914 - RNA, 11 nt, Homo sapiens
gcaaaaaucuc

SEQ ID NO: 667915 - RNA, 15 nt, Homo sapiens
gcaaaacgacacugc

SEQ ID NO: 667916 - RNA, 17 nt, Homo sapiens
gcaaaacuccaucucaa

SEQ ID NO: 667917 - RNA, 14 nt, Homo sapiens
gcaaaacuuuggca

SEQ ID NO: 667918 - RNA, 19 nt, Homo sapiens
gcaaaagagucaacaguau

SEQ ID NO: 667919 - RNA, 12 nt, Homo sapiens
gcaaaagucauu

SEQ ID NO: 667920 - RNA, 17 nt, Homo sapiens
gcaaaagugcaagaugg

SEQ ID NO: 667921 - RNA, 23 nt, Homo sapiens
gcaaaauaaagaauaugccguuu

SEQ ID NO: 667922 - RNA, 15 nt, Homo sapiens
gcaaaauaaagugau

SEQ ID NO: 667923 - RNA, 16 nt, Homo sapiens
gcaaaauaguucugca

SEQ ID NO: 667924 - RNA, 17 nt, Homo sapiens
gcaaaauggaagcaaag

SEQ ID NO: 667925 - RNA, 22 nt, Homo sapiens
gcaaaauuugaugccaggacac

SEQ ID NO: 667926 - RNA, 14 nt, Homo sapiens
gcaaacagucauuu

SEQ ID NO: 667927 - RNA, 11 nt, Homo sapiens
gcaaacauaau

SEQ ID NO: 667928 - RNA, 18 nt, Homo sapiens
gcaaacucacugcucaag

SEQ ID NO: 667929 - RNA, 14 nt, Homo sapiens
gcaaagacugcagu

SEQ ID NO: 667930 - RNA, 21 nt, Homo sapiens
gcaaagauuuucaaacaaaau

SEQ ID NO: 667931 - RNA, 21 nt, Homo sapiens
gcaaagcaccagcuucuccag

SEQ ID NO: 667932 - RNA, 15 nt, Homo sapiens
gcaaagccaaaaccu

SEQ ID NO: 667933 - RNA, 21 nt, Homo sapiens
gcaaaggaagcauacuuguga

SEQ ID NO: 667934 - RNA, 15 nt, Homo sapiens
gcaaaggcagaggaa

SEQ ID NO: 667935 - RNA, 14 nt, Homo sapiens
gcaaagggaaauca

SEQ ID NO: 667936 - RNA, 18 nt, Homo sapiens
gcaaagggagcacugggu

SEQ ID NO: 667937 - RNA, 21 nt, Homo sapiens
gcaaaggggaggcaucagugu

SEQ ID NO: 667938 - RNA, 19 nt, Homo sapiens
gcaaaguccagguccauuu

SEQ ID NO: 667939 - RNA, 13 nt, Homo sapiens
gcaaagugcugua

SEQ ID NO: 667940 - RNA, 19 nt, Homo sapiens
gcaaaguucccuacuuccu

SEQ ID NO: 667941 - RNA, 22 nt, Homo sapiens
gcaaauaauggaaaaauaguaa

SEQ ID NO: 667942 - RNA, 15 nt, Homo sapiens
gcaaaucgugccuug

SEQ ID NO: 667943 - RNA, 19 nt, Homo sapiens
gcaaaucuaugagauuuug

SEQ ID NO: 667944 - RNA, 19 nt, Homo sapiens
gcaaaucugacaauauaca

SEQ ID NO: 667945 - RNA, 16 nt, Homo sapiens
gcaaaugacaaaaagc

SEQ ID NO: 667946 - RNA, 14 nt, Homo sapiens
gcaaaugaguauuu

SEQ ID NO: 667947 - RNA, 22 nt, Homo sapiens
gcaaaugaucagccuugcaaau

SEQ ID NO: 667948 - RNA, 15 nt, Homo sapiens
gcaaauggugcugaa

SEQ ID NO: 667949 - RNA, 16 nt, Homo sapiens
gcaaauguaacugugc

SEQ ID NO: 667950 - RNA, 23 nt, Homo sapiens
gcaaaugugcuggucacccuuca

SEQ ID NO: 667951 - RNA, 16 nt, Homo sapiens
gcaaauguuaugcaua

SEQ ID NO: 667952 - RNA, 16 nt, Homo sapiens
gcaaauuaguugguuu

SEQ ID NO: 667953 - RNA, 15 nt, Homo sapiens
gcaaauuguuucagu

SEQ ID NO: 667954 - RNA, 17 nt, Homo sapiens
gcaaauuuugcauuuag

SEQ ID NO: 667955 - RNA, 17 nt, Homo sapiens
gcaaauuuuguauuucu

SEQ ID NO: 667956 - RNA, 15 nt, Homo sapiens
gcaacaaaaagucau

SEQ ID NO: 667957 - RNA, 14 nt, Homo sapiens
gcaacaaacaauau

SEQ ID NO: 667958 - RNA, 21 nt, Homo sapiens
gcaacaagaccaccacuucga

SEQ ID NO: 667959 - RNA, 20 nt, Homo sapiens
gcaacaaugagcagaccaac

SEQ ID NO: 667960 - RNA, 17 nt, Homo sapiens
gcaacaauuuaugaauu

SEQ ID NO: 667961 - RNA, 18 nt, Homo sapiens
uauauguguauacauaca

SEQ ID NO: 667962 - RNA, 21 nt, Homo sapiens
uauauguguguggcgugugua

SEQ ID NO: 667963 - RNA, 18 nt, Homo sapiens
uauauguguuuuucacau

SEQ ID NO: 667964 - RNA, 19 nt, Homo sapiens
uauauguucagcagugugc

SEQ ID NO: 667965 - RNA, 16 nt, Homo sapiens
uauauuccagguuuaa

SEQ ID NO: 667966 - RNA, 15 nt, Homo sapiens
uauauucuuuccuca

SEQ ID NO: 667967 - RNA, 21 nt, Homo sapiens
uauauuguaagaaauacugua

SEQ ID NO: 667968 - RNA, 23 nt, Homo sapiens
uauauugugaacccuagcugugu

SEQ ID NO: 667969 - RNA, 20 nt, Homo sapiens
uauauuguguugacuuuaua

SEQ ID NO: 667970 - RNA, 19 nt, Homo sapiens
uauauuguuuucaguguac

SEQ ID NO: 667971 - RNA, 19 nt, Homo sapiens
uauauuugaaguggagcca

SEQ ID NO: 667972 - RNA, 14 nt, Homo sapiens
uauauuugcauuau

SEQ ID NO: 667973 - RNA, 11 nt, Homo sapiens
uauauuugcuu

SEQ ID NO: 667974 - RNA, 23 nt, Homo sapiens
uauauuuuaaaaauaaauucaaa

SEQ ID NO: 667975 - RNA, 16 nt, Homo sapiens
uauauuuuaaagacca

SEQ ID NO: 667976 - RNA, 16 nt, Homo sapiens
uauauuuuagccuuua

SEQ ID NO: 667977 - RNA, 18 nt, Homo sapiens
uauauuuuuauaagacua

SEQ ID NO: 667978 - RNA, 20 nt, Homo sapiens
gcaacucaaagaugauggaa

SEQ ID NO: 667979 - RNA, 17 nt, Homo sapiens
gcaacucacugauucuc

SEQ ID NO: 667980 - RNA, 21 nt, Homo sapiens
gcaacucacugauucucuaca

SEQ ID NO: 667981 - RNA, 15 nt, Homo sapiens
gcaacuccauuuacc

SEQ ID NO: 667982 - RNA, 17 nt, Homo sapiens
gcaacugaaugacuaau

SEQ ID NO: 667983 - RNA, 22 nt, Homo sapiens
gcaacugacuucauuugugcca

SEQ ID NO: 667984 - RNA, 16 nt, Homo sapiens
gcaacugcccuuccag

SEQ ID NO: 667985 - RNA, 17 nt, Homo sapiens
gcaacuggccagccaau

SEQ ID NO: 667986 - RNA, 20 nt, Homo sapiens
gcaacugucucucuucucag

SEQ ID NO: 667987 - RNA, 22 nt, Homo sapiens
gcaacuuaagcugggauaauca

SEQ ID NO: 667988 - RNA, 14 nt, Homo sapiens
gcaacuuaauacuc

SEQ ID NO: 667989 - RNA, 17 nt, Homo sapiens
gcaacuucuauccuuuc

SEQ ID NO: 667990 - RNA, 18 nt, Homo sapiens
gcaacuuguuaaauauau

SEQ ID NO: 667991 - RNA, 14 nt, Homo sapiens
gcaagaagccauuu

SEQ ID NO: 667992 - RNA, 16 nt, Homo sapiens
gcaagacauaaagccu

SEQ ID NO: 667993 - RNA, 17 nt, Homo sapiens
gcaagaccuaguccccu

SEQ ID NO: 667994 - RNA, 12 nt, Homo sapiens
gcaagagacugg

SEQ ID NO: 667995 - RNA, 18 nt, Homo sapiens
gcaagagggggaccugcc

SEQ ID NO: 667996 - RNA, 19 nt, Homo sapiens
gcaagagugauugcagcuu

SEQ ID NO: 667997 - RNA, 15 nt, Homo sapiens
gcaagccaagugccc

SEQ ID NO: 667998 - RNA, 14 nt, Homo sapiens
gcaagcccagggca

SEQ ID NO: 667999 - RNA, 16 nt, Homo sapiens
gcaagccugucuucag

SEQ ID NO: 668000 - RNA, 15 nt, Homo sapiens
gcaagcgcuguaaac

SEQ ID NO: 668001 - RNA, 17 nt, Homo sapiens
gcaagcguugugcagag

SEQ ID NO: 668002 - RNA, 15 nt, Homo sapiens
gcaagcuaguuccca

SEQ ID NO: 668003 - RNA, 15 nt, Homo sapiens
gcaagcucugccucc

SEQ ID NO: 668004 - RNA, 16 nt, Homo sapiens
gcaaggaaacuaugua

SEQ ID NO: 668005 - RNA, 22 nt, Homo sapiens
gcaaggacugcagggacugcca

SEQ ID NO: 668006 - RNA, 23 nt, Homo sapiens
gcaaggaucuuuuuucccucuua

SEQ ID NO: 668007 - RNA, 16 nt, Homo sapiens
gcaaggggaaaaucuc

SEQ ID NO: 668008 - RNA, 13 nt, Homo sapiens
gcaaggugacauu

SEQ ID NO: 668009 - RNA, 14 nt, Homo sapiens
gcaaguaaguuaua

SEQ ID NO: 668010 - RNA, 16 nt, Homo sapiens
gcaagucaugcugaau

SEQ ID NO: 668011 - RNA, 19 nt, Homo sapiens
gcaaguccggcggaauuca

SEQ ID NO: 668012 - RNA, 22 nt, Homo sapiens
gcaagucuggacaaauguauag

SEQ ID NO: 668013 - RNA, 22 nt, Homo sapiens
gcaagugauugaaaauaguaaa

SEQ ID NO: 668014 - RNA, 23 nt, Homo sapiens
gcaaguguaugcacgugugcaca

SEQ ID NO: 668015 - RNA, 17 nt, Homo sapiens
gcaagugucugugugca

SEQ ID NO: 668016 - RNA, 22 nt, Homo sapiens
gcaagugugcuggccucucuga

SEQ ID NO: 668017 - RNA, 15 nt, Homo sapiens
gcaagugugugcaug

SEQ ID NO: 668018 - RNA, 13 nt, Homo sapiens
gcaaguuacucug

SEQ ID NO: 668019 - RNA, 20 nt, Homo sapiens
gcaaguuagaacuagccaaa

SEQ ID NO: 668020 - RNA, 14 nt, Homo sapiens
gcaaguuuacuuuu

SEQ ID NO: 668021 - RNA, 18 nt, Homo sapiens
gcaaguuuccaucaucua

SEQ ID NO: 668022 - RNA, 20 nt, Homo sapiens
gcaaguuugacacaaacuca

SEQ ID NO: 668023 - RNA, 17 nt, Homo sapiens
gcaauaaacuccuacua

SEQ ID NO: 668024 - RNA, 18 nt, Homo sapiens
gcaauaaacuccuacuaa

SEQ ID NO: 668025 - RNA, 20 nt, Homo sapiens
gcaauaaauuuauauacuuu

SEQ ID NO: 668026 - RNA, 19 nt, Homo sapiens
gcaauaaccucaaagugac

SEQ ID NO: 668027 - RNA, 20 nt, Homo sapiens
gcaauaaccucaaagugacu

SEQ ID NO: 668028 - RNA, 22 nt, Homo sapiens
gcaauaacguuuaagccaaaac

SEQ ID NO: 668029 - RNA, 22 nt, Homo sapiens
gcaauaacuucuauguugguuu

SEQ ID NO: 668030 - RNA, 12 nt, Homo sapiens
gcaauacuguag

SEQ ID NO: 668031 - RNA, 18 nt, Homo sapiens
gcaauagauuacugaugu

SEQ ID NO: 668032 - RNA, 15 nt, Homo sapiens
gcaauaguguguucu

SEQ ID NO: 668033 - RNA, 16 nt, Homo sapiens
gcaauauaagcauaaa

SEQ ID NO: 668034 - RNA, 18 nt, Homo sapiens
gcaauaucuacguguuuu

SEQ ID NO: 668035 - RNA, 16 nt, Homo sapiens
gcaauauggaagcaac

SEQ ID NO: 668036 - RNA, 23 nt, Homo sapiens
gcaaucaaguccuacaagcuaaa

SEQ ID NO: 668037 - RNA, 16 nt, Homo sapiens
gcaaucacaacacugg

SEQ ID NO: 668038 - RNA, 23 nt, Homo sapiens
gcaaucuaaucugaacugaccuu

SEQ ID NO: 668039 - RNA, 16 nt, Homo sapiens
gcaaucuacuggaaau

SEQ ID NO: 668040 - RNA, 21 nt, Homo sapiens
gcaaucucauuacuggguaua

SEQ ID NO: 668041 - RNA, 22 nt, Homo sapiens
gcaaucuguguucgauggcuca

SEQ ID NO: 668042 - RNA, 23 nt, Homo sapiens
gcaaucuuugccuuuaucucuga

SEQ ID NO: 668043 - RNA, 20 nt, Homo sapiens
gcaaugacucaggacauccc

SEQ ID NO: 668044 - RNA, 14 nt, Homo sapiens
gcaaugauuacucu

SEQ ID NO: 668045 - RNA, 16 nt, Homo sapiens
gcaaugcccugugcau

SEQ ID NO: 668046 - RNA, 19 nt, Homo sapiens
gcaaugccuagacuuccca

SEQ ID NO: 668047 - RNA, 17 nt, Homo sapiens
gcaaugggcacugggau

SEQ ID NO: 668048 - RNA, 19 nt, Homo sapiens
gcaaugggcagcuauccag

SEQ ID NO: 668049 - RNA, 22 nt, Homo sapiens
gcaauggguuuauagacauuau

SEQ ID NO: 668050 - RNA, 20 nt, Homo sapiens
gcaaugguaacugcaccugg

SEQ ID NO: 668051 - RNA, 22 nt, Homo sapiens
gcaaugugggaucucagaccca

SEQ ID NO: 668052 - RNA, 17 nt, Homo sapiens
gcaauuacggggugacc

SEQ ID NO: 668053 - RNA, 22 nt, Homo sapiens
gcaauugcucuucuccacgucu

SEQ ID NO: 668054 - RNA, 23 nt, Homo sapiens
gcaauuuuaccuaguuugcacua

SEQ ID NO: 668055 - RNA, 13 nt, Homo sapiens
gcaauuuuuccau

SEQ ID NO: 668056 - RNA, 15 nt, Homo sapiens
gcacaaaacuacuuu

SEQ ID NO: 668057 - RNA, 18 nt, Homo sapiens
gcacaaaauuaugcaaau

SEQ ID NO: 668058 - RNA, 22 nt, Homo sapiens
gcacaaacugcagcugugagug

SEQ ID NO: 668059 - RNA, 23 nt, Homo sapiens
gcacaaccaugacgcacugcuca

SEQ ID NO: 668060 - RNA, 13 nt, Homo sapiens
gcacaagccagac

SEQ ID NO: 668061 - RNA, 15 nt, Homo sapiens
gcacaagccagaccc

SEQ ID NO: 668062 - RNA, 15 nt, Homo sapiens
gcacaaggccuugcc

SEQ ID NO: 668063 - RNA, 15 nt, Homo sapiens
gcacaauaugggcac

SEQ ID NO: 668064 - RNA, 19 nt, Homo sapiens
gcacacacacacaucucau

SEQ ID NO: 668065 - RNA, 19 nt, Homo sapiens
gcacacagcugagcacuua

SEQ ID NO: 668066 - RNA, 19 nt, Homo sapiens
gcacacccaugcacacuca

SEQ ID NO: 668067 - RNA, 17 nt, Homo sapiens
gcacacgaguuccagac

SEQ ID NO: 668068 - RNA, 23 nt, Homo sapiens
gcacacuuacaguauacauauau

SEQ ID NO: 668069 - RNA, 20 nt, Homo sapiens
gcacacuuaugggccaagcc

SEQ ID NO: 668070 - RNA, 17 nt, Homo sapiens
gcacacuuccaccauag

SEQ ID NO: 668071 - RNA, 11 nt, Homo sapiens
gcacacuuuac

SEQ ID NO: 668072 - RNA, 23 nt, Homo sapiens
gcacagaagacagcagcaagugu

SEQ ID NO: 668073 - RNA, 16 nt, Homo sapiens
gcacagaauuugucag

SEQ ID NO: 668074 - RNA, 16 nt, Homo sapiens
gcacagaguggcuugg

SEQ ID NO: 668075 - RNA, 16 nt, Homo sapiens
gcacagcagcaauugu

SEQ ID NO: 668076 - RNA, 20 nt, Homo sapiens
gcacagcguccuguccacac

SEQ ID NO: 668077 - RNA, 23 nt, Homo sapiens
gcacaggacaugcgguagccagc

SEQ ID NO: 668078 - RNA, 21 nt, Homo sapiens
gcacaggaguguccucuuccc

SEQ ID NO: 668079 - RNA, 19 nt, Homo sapiens
gcacaggccauggugcaca

SEQ ID NO: 668080 - RNA, 19 nt, Homo sapiens
gcacaggggcccauggacu

SEQ ID NO: 668081 - RNA, 22 nt, Homo sapiens
gcacaggguccccgagugccua

SEQ ID NO: 668082 - RNA, 17 nt, Homo sapiens
gcacaguaaaaauggaa

SEQ ID NO: 668083 - RNA, 13 nt, Homo sapiens
uaugacugauuac

SEQ ID NO: 668084 - RNA, 15 nt, Homo sapiens
uaugacugauuacuc

SEQ ID NO: 668085 - RNA, 19 nt, Homo sapiens
uaugacuggaguaaaccau

SEQ ID NO: 668086 - RNA, 21 nt, Homo sapiens
uaugagaguuuggaauuauug

SEQ ID NO: 668087 - RNA, 15 nt, Homo sapiens
uaugagauacuuugc

SEQ ID NO: 668088 - RNA, 18 nt, Homo sapiens
uaugagccaggcaucaua

SEQ ID NO: 668089 - RNA, 13 nt, Homo sapiens
uaugagcccagau

SEQ ID NO: 668090 - RNA, 20 nt, Homo sapiens
uaugaguaauacaucaaaga

SEQ ID NO: 668091 - RNA, 16 nt, Homo sapiens
uaugagucaaugugca

SEQ ID NO: 668092 - RNA, 21 nt, Homo sapiens
uaugagucggauacccuggag

SEQ ID NO: 668093 - RNA, 23 nt, Homo sapiens
uaugaguuuuugauagcuuuauu

SEQ ID NO: 668094 - RNA, 16 nt, Homo sapiens
uaugauaccaaagaca

SEQ ID NO: 668095 - RNA, 14 nt, Homo sapiens
uaugauacguguau

SEQ ID NO: 668096 - RNA, 19 nt, Homo sapiens
uaugaucuggcccuugcuu

SEQ ID NO: 668097 - RNA, 13 nt, Homo sapiens
uaugaucuuggcu

SEQ ID NO: 668098 - RNA, 14 nt, Homo sapiens
uaugaugagccaua

SEQ ID NO: 668099 - RNA, 18 nt, Homo sapiens
ucacugcuggcugccuua

SEQ ID NO: 668100 - RNA, 15 nt, Homo sapiens
ucacuggaaagggga

SEQ ID NO: 668101 - RNA, 22 nt, Homo sapiens
ucacuggaugucaaacaguaau

SEQ ID NO: 668102 - RNA, 18 nt, Homo sapiens
ucacuggcaugggagacc

SEQ ID NO: 668103 - RNA, 19 nt, Homo sapiens
ucacugguauuaacuuuau

SEQ ID NO: 668104 - RNA, 19 nt, Homo sapiens
ucacuguauauaaacauau

SEQ ID NO: 668105 - RNA, 12 nt, Homo sapiens
ucacugucaggg

SEQ ID NO: 668106 - RNA, 17 nt, Homo sapiens
ucacugucccucaaaug

SEQ ID NO: 668107 - RNA, 13 nt, Homo sapiens
ucacuguccucca

SEQ ID NO: 668108 - RNA, 17 nt, Homo sapiens
ucacugucuugccagau

SEQ ID NO: 668109 - RNA, 19 nt, Homo sapiens
ucacuguuguacacagucu

SEQ ID NO: 668110 - RNA, 16 nt, Homo sapiens
ucacuguuucucugcu

SEQ ID NO: 668111 - RNA, 17 nt, Homo sapiens
ucacuuaaacucagcua

SEQ ID NO: 668112 - RNA, 23 nt, Homo sapiens
ucacuuaauccauuuagcacuau

SEQ ID NO: 668113 - RNA, 20 nt, Homo sapiens
ucacuuauaccaaagggaaa

SEQ ID NO: 668114 - RNA, 14 nt, Homo sapiens
ucacuuauuucaua

SEQ ID NO: 668115 - RNA, 12 nt, Homo sapiens
ucacuucacccu

SEQ ID NO: 668116 - RNA, 13 nt, Homo sapiens
ucacuuccuacaa

SEQ ID NO: 668117 - RNA, 18 nt, Homo sapiens
ucacuucgggcuguguaa

SEQ ID NO: 668118 - RNA, 23 nt, Homo sapiens
ucacuugccaaaauccaaggcaa

SEQ ID NO: 668119 - RNA, 18 nt, Homo sapiens
ucacuugguccuaccuau

SEQ ID NO: 668120 - RNA, 15 nt, Homo sapiens
ucacuuguauugacu

SEQ ID NO: 668121 - RNA, 20 nt, Homo sapiens
ucacuugugcaguguugaca

SEQ ID NO: 668122 - RNA, 16 nt, Homo sapiens
ucacuuuaaagcccuu

SEQ ID NO: 668123 - RNA, 19 nt, Homo sapiens
ucacuuucucaguuuucau

SEQ ID NO: 668124 - RNA, 23 nt, Homo sapiens
ucagaaaaaggaaaccacaguga

SEQ ID NO: 668125 - RNA, 23 nt, Homo sapiens
ucagaaaacagagaaaggguaau

SEQ ID NO: 668126 - RNA, 14 nt, Homo sapiens
ucagaaaagcuauu

SEQ ID NO: 668127 - RNA, 20 nt, Homo sapiens
ucagaaacaggugcaucugg

SEQ ID NO: 668128 - RNA, 13 nt, Homo sapiens
ucagaaaccugca

SEQ ID NO: 668129 - RNA, 16 nt, Homo sapiens
ucagaaacgaaaucua

SEQ ID NO: 668130 - RNA, 12 nt, Homo sapiens
ucagaaaugcug

SEQ ID NO: 668131 - RNA, 23 nt, Homo sapiens
ucagaaauuuaauucauguuucu

SEQ ID NO: 668132 - RNA, 20 nt, Homo sapiens
ucagaaauuuucugaucuca

SEQ ID NO: 668133 - RNA, 14 nt, Homo sapiens
ucagaacacacaga

SEQ ID NO: 668134 - RNA, 16 nt, Homo sapiens
ucagaacacucaaagg

SEQ ID NO: 668135 - RNA, 21 nt, Homo sapiens
ucagaacagaugcugagccau

SEQ ID NO: 668136 - RNA, 18 nt, Homo sapiens
ucagaaccaaaagggagg

SEQ ID NO: 668137 - RNA, 15 nt, Homo sapiens
ucagaaccauccaua

SEQ ID NO: 668138 - RNA, 19 nt, Homo sapiens
ucagaaccucuuccccaga

SEQ ID NO: 668139 - RNA, 22 nt, Homo sapiens
ucagaacuauuuaaaauaaaga

SEQ ID NO: 668140 - RNA, 16 nt, Homo sapiens
ucagaacugugccaca

SEQ ID NO: 668141 - RNA, 22 nt, Homo sapiens
ucagaagaaagaaucuuuccau

SEQ ID NO: 668142 - RNA, 15 nt, Homo sapiens
ucagaagcucuucua

SEQ ID NO: 668143 - RNA, 12 nt, Homo sapiens
ucagaaggugac

SEQ ID NO: 668144 - RNA, 19 nt, Homo sapiens
ucagaaggugacaaguacu

SEQ ID NO: 668145 - RNA, 18 nt, Homo sapiens
ucagaaggugguuugaca

SEQ ID NO: 668146 - RNA, 20 nt, Homo sapiens
ucagaauaaauuauugcugu

SEQ ID NO: 668147 - RNA, 21 nt, Homo sapiens
ucagaauaaauugauccuuug

SEQ ID NO: 668148 - RNA, 17 nt, Homo sapiens
ucagaauacuugcacuc

SEQ ID NO: 668149 - RNA, 19 nt, Homo sapiens
ucagaaucccuuaacaguu

SEQ ID NO: 668150 - RNA, 22 nt, Homo sapiens
ucagaaucucucuacucagaug

SEQ ID NO: 668151 - RNA, 14 nt, Homo sapiens
ucagaauguguuau

SEQ ID NO: 668152 - RNA, 22 nt, Homo sapiens
ucagacaaaauggauacauaaa

SEQ ID NO: 668153 - RNA, 22 nt, Homo sapiens
ucagacaagaaugugcacucuc

SEQ ID NO: 668154 - RNA, 14 nt, Homo sapiens
ucagacaagcacua

SEQ ID NO: 668155 - RNA, 18 nt, Homo sapiens
ucagacacaugcuauguu

SEQ ID NO: 668156 - RNA, 17 nt, Homo sapiens
ucagacaccuguucaca

SEQ ID NO: 668157 - RNA, 15 nt, Homo sapiens
ucagacacuacauga

SEQ ID NO: 668158 - RNA, 17 nt, Homo sapiens
ucagacagagacuuuaa

SEQ ID NO: 668159 - RNA, 19 nt, Homo sapiens
ucagacaucuccagugugc

SEQ ID NO: 668160 - RNA, 20 nt, Homo sapiens
ucagacccuaccccaccacg

SEQ ID NO: 668161 - RNA, 20 nt, Homo sapiens
ucagaccugucuuccaagga

SEQ ID NO: 668162 - RNA, 21 nt, Homo sapiens
ucagacuccugugcaacuuuc

SEQ ID NO: 668163 - RNA, 20 nt, Homo sapiens
ucagacucuuggcuacagug

SEQ ID NO: 668164 - RNA, 21 nt, Homo sapiens
ucagacugaaacgccuugcac

SEQ ID NO: 668165 - RNA, 14 nt, Homo sapiens
ucagacuuaccagg

SEQ ID NO: 668166 - RNA, 13 nt, Homo sapiens
ucagacuugucaa

SEQ ID NO: 668167 - RNA, 12 nt, Homo sapiens
ucagacuuugcu

SEQ ID NO: 668168 - RNA, 17 nt, Homo sapiens
ucagagaaauacuuuca

SEQ ID NO: 668169 - RNA, 18 nt, Homo sapiens
ucagagacagauaccucc

SEQ ID NO: 668170 - RNA, 21 nt, Homo sapiens
ucagagagccuagaacauccc

SEQ ID NO: 668171 - RNA, 22 nt, Homo sapiens
ucagagagccuuuuucuaggcc

SEQ ID NO: 668172 - RNA, 20 nt, Homo sapiens
ucagagagcuaaauuacaau

SEQ ID NO: 668173 - RNA, 17 nt, Homo sapiens
ucagagagggugacaag

SEQ ID NO: 668174 - RNA, 15 nt, Homo sapiens
ucagagcacucccua

SEQ ID NO: 668175 - RNA, 10 nt, Homo sapiens
ucagagccag

SEQ ID NO: 668176 - RNA, 20 nt, Homo sapiens
ucagagccccuacagcauug

SEQ ID NO: 668177 - RNA, 12 nt, Homo sapiens
ucagagcuaaac

SEQ ID NO: 668178 - RNA, 20 nt, Homo sapiens
ucagagcuauguucccucca

SEQ ID NO: 668179 - RNA, 23 nt, Homo sapiens
ucagagcuccaguuugcauuugg

SEQ ID NO: 668180 - RNA, 19 nt, Homo sapiens
ucagagcugggaguagcau

SEQ ID NO: 668181 - RNA, 18 nt, Homo sapiens
ucagaggccugcugccag

SEQ ID NO: 668182 - RNA, 18 nt, Homo sapiens
ucagagggcguguuguuu

SEQ ID NO: 668183 - RNA, 23 nt, Homo sapiens
ucagagugacuacacacaguacg

SEQ ID NO: 668184 - RNA, 12 nt, Homo sapiens
ucagagugcaag

SEQ ID NO: 668185 - RNA, 13 nt, Homo sapiens
ucagagugcaagc

SEQ ID NO: 668186 - RNA, 23 nt, Homo sapiens
ucagagugggguggggagcaugu

SEQ ID NO: 668187 - RNA, 18 nt, Homo sapiens
ucagaguguggauuguau

SEQ ID NO: 668188 - RNA, 23 nt, Homo sapiens
ucagaguuugaaauaaaacuugg

SEQ ID NO: 668189 - RNA, 18 nt, Homo sapiens
ucagauaaacaacaaaua

SEQ ID NO: 668190 - RNA, 22 nt, Homo sapiens
ucagauaaucauuucuacuuca

SEQ ID NO: 668191 - RNA, 15 nt, Homo sapiens
ucagauacacaagga

SEQ ID NO: 668192 - RNA, 16 nt, Homo sapiens
ucagauagaaugacag

SEQ ID NO: 668193 - RNA, 20 nt, Homo sapiens
ucagauauuuuuucagaaau

SEQ ID NO: 668194 - RNA, 13 nt, Homo sapiens
ucagaucaugccc

SEQ ID NO: 668195 - RNA, 16 nt, Homo sapiens
ucagaucugaacacag

SEQ ID NO: 668196 - RNA, 21 nt, Homo sapiens
ucagaucuggggcagcacccu

SEQ ID NO: 668197 - RNA, 12 nt, Homo sapiens
ucagaugaacuc

SEQ ID NO: 668198 - RNA, 17 nt, Homo sapiens
ucagaugacaacaaaga

SEQ ID NO: 668199 - RNA, 23 nt, Homo sapiens
ucagaugaccccagaaacugaac

SEQ ID NO: 668200 - RNA, 23 nt, Homo sapiens
ucagaugcuugcggcaaaaggaa

SEQ ID NO: 668201 - RNA, 18 nt, Homo sapiens
ucagauggacaagauuac

SEQ ID NO: 668202 - RNA, 21 nt, Homo sapiens
ucagaugggaauugcacagua

SEQ ID NO: 668203 - RNA, 20 nt, Homo sapiens
ucagaugggucugauauuaa

SEQ ID NO: 668204 - RNA, 20 nt, Homo sapiens
ucagauuaagaguugccaaa

SEQ ID NO: 668205 - RNA, 16 nt, Homo sapiens
ucagauucuucucuua

SEQ ID NO: 668206 - RNA, 12 nt, Homo sapiens
ucagauugcuga

SEQ ID NO: 668207 - RNA, 15 nt, Homo sapiens
ucagauuucauguca

SEQ ID NO: 668208 - RNA, 23 nt, Homo sapiens
ucagauuuuaaaaagucuucacu

SEQ ID NO: 668209 - RNA, 21 nt, Homo sapiens
ucagauuuucuaagaaccaaa

SEQ ID NO: 668210 - RNA, 23 nt, Homo sapiens
ucagauuuuuuuuuccuguaaug

SEQ ID NO: 668211 - RNA, 21 nt, Homo sapiens
ucagcaaaaaucucccaguga

SEQ ID NO: 668212 - RNA, 21 nt, Homo sapiens
ucagcaaguuagaacuagcca

SEQ ID NO: 668213 - RNA, 17 nt, Homo sapiens
ucagcaauacucaucag

SEQ ID NO: 668214 - RNA, 18 nt, Homo sapiens
gccauuaugcaaauggag

SEQ ID NO: 668215 - RNA, 14 nt, Homo sapiens
gccauucacugccc

SEQ ID NO: 668216 - RNA, 15 nt, Homo sapiens
gccauucacugcccc

SEQ ID NO: 668217 - RNA, 13 nt, Homo sapiens
gccauugaacuca

SEQ ID NO: 668218 - RNA, 13 nt, Homo sapiens
gccauugaccacc

SEQ ID NO: 668219 - RNA, 18 nt, Homo sapiens
gccauugcauuccagccu

SEQ ID NO: 668220 - RNA, 14 nt, Homo sapiens
ucagcagacaagga

SEQ ID NO: 668221 - RNA, 20 nt, Homo sapiens
ucagcagaugcuguugugaa

SEQ ID NO: 668222 - RNA, 22 nt, Homo sapiens
ucagcagaugcuguugugaagc

SEQ ID NO: 668223 - RNA, 22 nt, Homo sapiens
ucagcagccgccuuaagcugau

SEQ ID NO: 668224 - RNA, 20 nt, Homo sapiens
ucagcagcgugcacaucugc

SEQ ID NO: 668225 - RNA, 22 nt, Homo sapiens
ucagcagcgugcacaucugcug

SEQ ID NO: 668226 - RNA, 18 nt, Homo sapiens
ucagcagggacuguaaac

SEQ ID NO: 668227 - RNA, 16 nt, Homo sapiens
ucagcaguccacaaag

SEQ ID NO: 668228 - RNA, 20 nt, Homo sapiens
ucagcaguucagcuccuucc

SEQ ID NO: 668229 - RNA, 22 nt, Homo sapiens
ucagcauccagguuuaugaaug

SEQ ID NO: 668230 - RNA, 17 nt, Homo sapiens
ucagcaugcauccuuug

SEQ ID NO: 668231 - RNA, 22 nt, Homo sapiens
ucagcaugcauccuuugcacug

SEQ ID NO: 668232 - RNA, 15 nt, Homo sapiens
ucagcauuauuccuc

SEQ ID NO: 668233 - RNA, 14 nt, Homo sapiens
ucagcauugucucg

SEQ ID NO: 668234 - RNA, 23 nt, Homo sapiens
ucagcauugucucguguacagcu

SEQ ID NO: 668235 - RNA, 18 nt, Homo sapiens
ucagccaacaugugacua

SEQ ID NO: 668236 - RNA, 20 nt, Homo sapiens
ucagccaauccgauugccuu

SEQ ID NO: 668237 - RNA, 19 nt, Homo sapiens
ucagccacuugccugugcu

SEQ ID NO: 668238 - RNA, 23 nt, Homo sapiens
ucagccagcccauggcccccaau

SEQ ID NO: 668239 - RNA, 21 nt, Homo sapiens
ucagccaggcugcuaaccugg

SEQ ID NO: 668240 - RNA, 15 nt, Homo sapiens
ucagccagucucaga

SEQ ID NO: 668241 - RNA, 19 nt, Homo sapiens
ucagccauaagaaagcacu

SEQ ID NO: 668242 - RNA, 20 nt, Homo sapiens
ucagccauccgcagacugcu

SEQ ID NO: 668243 - RNA, 20 nt, Homo sapiens
ucagccaucguccugggacu

SEQ ID NO: 668244 - RNA, 12 nt, Homo sapiens
ucagccaugagg

SEQ ID NO: 668245 - RNA, 22 nt, Homo sapiens
ucagcccagccccuccaaaggu

SEQ ID NO: 668246 - RNA, 15 nt, Homo sapiens
ucagcccaucucaac

SEQ ID NO: 668247 - RNA, 14 nt, Homo sapiens
ucagccccuaggag

SEQ ID NO: 668248 - RNA, 16 nt, Homo sapiens
ucagcccucaguuccu

SEQ ID NO: 668249 - RNA, 20 nt, Homo sapiens
ucagccuagccgaccucagc

SEQ ID NO: 668250 - RNA, 18 nt, Homo sapiens
ucagccucccgaguagcu

SEQ ID NO: 668251 - RNA, 20 nt, Homo sapiens
ucagccucugccagcgccaa

SEQ ID NO: 668252 - RNA, 20 nt, Homo sapiens
ucagccucuuaaagcugccu

SEQ ID NO: 668253 - RNA, 22 nt, Homo sapiens
ucagccuggggcucucugaccc

SEQ ID NO: 668254 - RNA, 17 nt, Homo sapiens
ucagccuuaagaaccau

SEQ ID NO: 668255 - RNA, 15 nt, Homo sapiens
ucagccuuagcucuc

SEQ ID NO: 668256 - RNA, 12 nt, Homo sapiens
ucagccuugcac

SEQ ID NO: 668257 - RNA, 14 nt, Homo sapiens
ucagccuuguccua

SEQ ID NO: 668258 - RNA, 21 nt, Homo sapiens
ucagcuacuucuccugcacuu

SEQ ID NO: 668259 - RNA, 23 nt, Homo sapiens
ucagcucaauuguuaaugugaug

SEQ ID NO: 668260 - RNA, 12 nt, Homo sapiens
ucagcucugagg

SEQ ID NO: 668261 - RNA, 23 nt, Homo sapiens
ucagcucuuggcuccacugggau

SEQ ID NO: 668262 - RNA, 14 nt, Homo sapiens
ucagcugcucccac

SEQ ID NO: 668263 - RNA, 19 nt, Homo sapiens
ucagcuguaguccucauaa

SEQ ID NO: 668264 - RNA, 23 nt, Homo sapiens
ucagcugucaccugcucacaggg

SEQ ID NO: 668265 - RNA, 11 nt, Homo sapiens
ucagcugugaa

SEQ ID NO: 668266 - RNA, 14 nt, Homo sapiens
ucagcuuaauucuc

SEQ ID NO: 668267 - RNA, 14 nt, Homo sapiens
ucagcuuggcugua

SEQ ID NO: 668268 - RNA, 23 nt, Homo sapiens
ucagcuuuuguuguuuauauaca

SEQ ID NO: 668269 - RNA, 14 nt, Homo sapiens
ucaggaaaacugac

SEQ ID NO: 668270 - RNA, 18 nt, Homo sapiens
ucaggaaaaucugugauu

SEQ ID NO: 668271 - RNA, 11 nt, Homo sapiens
ucaggaaaaug

SEQ ID NO: 668272 - RNA, 20 nt, Homo sapiens
ucaggaaacgagacuuucca

SEQ ID NO: 668273 - RNA, 16 nt, Homo sapiens
ucaggaaguccagcca

SEQ ID NO: 668274 - RNA, 15 nt, Homo sapiens
ucaggaauacauuug

SEQ ID NO: 668275 - RNA, 19 nt, Homo sapiens
ucaggaauacauuuggaaa

SEQ ID NO: 668276 - RNA, 18 nt, Homo sapiens
ucaggaaucagaaaucau

SEQ ID NO: 668277 - RNA, 16 nt, Homo sapiens
ucaggacacaucuauu

SEQ ID NO: 668278 - RNA, 20 nt, Homo sapiens
ucaggacagguggugcaaau

SEQ ID NO: 668279 - RNA, 22 nt, Homo sapiens
ucaggacauaggcacaggcaaa

SEQ ID NO: 668280 - RNA, 14 nt, Homo sapiens
ucaggaccaucaga

SEQ ID NO: 668281 - RNA, 19 nt, Homo sapiens
ucaggaggcccugguguca

SEQ ID NO: 668282 - RNA, 18 nt, Homo sapiens
ucaggaguucgagaccaa

SEQ ID NO: 668283 - RNA, 14 nt, Homo sapiens
ucaggauccaguga

SEQ ID NO: 668284 - RNA, 13 nt, Homo sapiens
ucaggaugagaug

SEQ ID NO: 668285 - RNA, 16 nt, Homo sapiens
ucaggaugcagcacug

SEQ ID NO: 668286 - RNA, 16 nt, Homo sapiens
ucaggauuucaccaga

SEQ ID NO: 668287 - RNA, 17 nt, Homo sapiens
ucaggcaaagugcugcu

SEQ ID NO: 668288 - RNA, 21 nt, Homo sapiens
ucaggcaaggggcauuucaca

SEQ ID NO: 668289 - RNA, 21 nt, Homo sapiens
ucaggcaauugauugugaauu

SEQ ID NO: 668290 - RNA, 21 nt, Homo sapiens
ucaggcagacaagagcugcug

SEQ ID NO: 668291 - RNA, 13 nt, Homo sapiens
ucaggcagcucaa

SEQ ID NO: 668292 - RNA, 13 nt, Homo sapiens
ucaggcagggugc

SEQ ID NO: 668293 - RNA, 19 nt, Homo sapiens
ucaggcagguuugccagug

SEQ ID NO: 668294 - RNA, 16 nt, Homo sapiens
ucaggccagggcucac

SEQ ID NO: 668295 - RNA, 18 nt, Homo sapiens
ucaggcccgcuaggucca

SEQ ID NO: 668296 - RNA, 22 nt, Homo sapiens
ucaggcccugaucuagugcagu

SEQ ID NO: 668297 - RNA, 23 nt, Homo sapiens
ucaggccugaacccguccauuca

SEQ ID NO: 668298 - RNA, 14 nt, Homo sapiens
ucaggcugcuggaa

SEQ ID NO: 668299 - RNA, 17 nt, Homo sapiens
ucagggauccaauauga

SEQ ID NO: 668300 - RNA, 20 nt, Homo sapiens
ucagggcaucggcagcugaa

SEQ ID NO: 668301 - RNA, 22 nt, Homo sapiens
ucagggccaggugcagaccuug

SEQ ID NO: 668302 - RNA, 15 nt, Homo sapiens
ucagggccaguccuc

SEQ ID NO: 668303 - RNA, 19 nt, Homo sapiens
ucagggccuggggccugag

SEQ ID NO: 668304 - RNA, 14 nt, Homo sapiens
ucaggggacucagc

SEQ ID NO: 668305 - RNA, 15 nt, Homo sapiens
ucaggggacuugaau

SEQ ID NO: 668306 - RNA, 22 nt, Homo sapiens
ucaggggcggggagggugacag

SEQ ID NO: 668307 - RNA, 15 nt, Homo sapiens
ucaggggcucugugu

SEQ ID NO: 668308 - RNA, 20 nt, Homo sapiens
ucagggggauaacuaccaga

SEQ ID NO: 668309 - RNA, 13 nt, Homo sapiens
ucaggggugcaca

SEQ ID NO: 668310 - RNA, 12 nt, Homo sapiens
ucagggucuaag

SEQ ID NO: 668311 - RNA, 13 nt, Homo sapiens
ucagguaauacaa

SEQ ID NO: 668312 - RNA, 17 nt, Homo sapiens
ucagguaauacaaacua

SEQ ID NO: 668313 - RNA, 15 nt, Homo sapiens
ucagguaccaaggaa

SEQ ID NO: 668314 - RNA, 14 nt, Homo sapiens
ucagguaguacugg

SEQ ID NO: 668315 - RNA, 16 nt, Homo sapiens
ucagguaguacuggga

SEQ ID NO: 668316 - RNA, 13 nt, Homo sapiens
ucaggugauccac

SEQ ID NO: 668317 - RNA, 15 nt, Homo sapiens
ucaggugccacugac

SEQ ID NO: 668318 - RNA, 20 nt, Homo sapiens
ucagguggccagccuggauc

SEQ ID NO: 668319 - RNA, 14 nt, Homo sapiens
ucaguaaacaauga

SEQ ID NO: 668320 - RNA, 19 nt, Homo sapiens
ucaguaaauagugucauau

SEQ ID NO: 668321 - RNA, 21 nt, Homo sapiens
ucaguaacauuucuguucuca

SEQ ID NO: 668322 - RNA, 15 nt, Homo sapiens
ucaguaagucucaua

SEQ ID NO: 668323 - RNA, 19 nt, Homo sapiens
ucaguaauaaaaccgguca

SEQ ID NO: 668324 - RNA, 17 nt, Homo sapiens
ucaguaaugcugcagga

SEQ ID NO: 668325 - RNA, 10 nt, Homo sapiens
ucaguacaac

SEQ ID NO: 668326 - RNA, 22 nt, Homo sapiens
ucaguacccacucuggagcauu

SEQ ID NO: 668327 - RNA, 21 nt, Homo sapiens
ucaguaccccugguaaaccaa

SEQ ID NO: 668328 - RNA, 22 nt, Homo sapiens
ucaguaccccugguaaaccaag

SEQ ID NO: 668329 - RNA, 22 nt, Homo sapiens
ucaguacugacuuucugauuac

SEQ ID NO: 668330 - RNA, 22 nt, Homo sapiens
ucaguagcaucuguaacagcau

SEQ ID NO: 668331 - RNA, 20 nt, Homo sapiens
ucaguagccccuaaucacau

SEQ ID NO: 668332 - RNA, 19 nt, Homo sapiens
ucaguauuagaugcacuua

SEQ ID NO: 668333 - RNA, 14 nt, Homo sapiens
ucaguauuuuccag

SEQ ID NO: 668334 - RNA, 19 nt, Homo sapiens
ucaguauuuuccagccuua

SEQ ID NO: 668335 - RNA, 20 nt, Homo sapiens
ucagucaacaacuuacacuu

SEQ ID NO: 668336 - RNA, 15 nt, Homo sapiens
ucagucaauagccau

SEQ ID NO: 668337 - RNA, 14 nt, Homo sapiens
gccccuccuugcaa

SEQ ID NO: 668338 - RNA, 17 nt, Homo sapiens
gccccucgcacacaggg

SEQ ID NO: 668339 - RNA, 18 nt, Homo sapiens
gccccucgcugcugcuac

SEQ ID NO: 668340 - RNA, 21 nt, Homo sapiens
gccccucgcugcugcuacuac

SEQ ID NO: 668341 - RNA, 21 nt, Homo sapiens
ucagucaucaaagcagaaguc

SEQ ID NO: 668342 - RNA, 16 nt, Homo sapiens
ucaguccaagucuucu

SEQ ID NO: 668343 - RNA, 20 nt, Homo sapiens
ucaguccacuucugcucugg

SEQ ID NO: 668344 - RNA, 13 nt, Homo sapiens
ucaguccuaagaa

SEQ ID NO: 668345 - RNA, 14 nt, Homo sapiens
ucaguccucuuuca

SEQ ID NO: 668346 - RNA, 15 nt, Homo sapiens
ucagucgcccggggc

SEQ ID NO: 668347 - RNA, 17 nt, Homo sapiens
ucagucgcuagcauuuc

SEQ ID NO: 668348 - RNA, 15 nt, Homo sapiens
ucagucuuugcucag

SEQ ID NO: 668349 - RNA, 20 nt, Homo sapiens
ucagucuuugcucagugucc

SEQ ID NO: 668350 - RNA, 17 nt, Homo sapiens
ucagugaaaaauaauua

SEQ ID NO: 668351 - RNA, 14 nt, Homo sapiens
ucagugaaagccag

SEQ ID NO: 668352 - RNA, 15 nt, Homo sapiens
ucagugaaagccaga

SEQ ID NO: 668353 - RNA, 20 nt, Homo sapiens
ucagugaagaugccagugaa

SEQ ID NO: 668354 - RNA, 17 nt, Homo sapiens
ucagugaaguacaccug

SEQ ID NO: 668355 - RNA, 23 nt, Homo sapiens
ucagugaguaauuuuggauuuug

SEQ ID NO: 668356 - RNA, 17 nt, Homo sapiens
ucagugauuacugucaa

SEQ ID NO: 668357 - RNA, 18 nt, Homo sapiens
ucagugcacuguauauag

SEQ ID NO: 668358 - RNA, 21 nt, Homo sapiens
ucagugccacuugacauuccu

SEQ ID NO: 668359 - RNA, 21 nt, Homo sapiens
ucagugcuucccgagugagca

SEQ ID NO: 668360 - RNA, 20 nt, Homo sapiens
ucagugggacucggugagcc

SEQ ID NO: 668361 - RNA, 12 nt, Homo sapiens
ucaguggugguc

SEQ ID NO: 668362 - RNA, 19 nt, Homo sapiens
ucagugguggucuucaaga

SEQ ID NO: 668363 - RNA, 16 nt, Homo sapiens
ucaguggugucuguga

SEQ ID NO: 668364 - RNA, 18 nt, Homo sapiens
ucaguggugucugugaag

SEQ ID NO: 668365 - RNA, 17 nt, Homo sapiens
ucagugguuagaagcau

SEQ ID NO: 668366 - RNA, 23 nt, Homo sapiens
ucagugguuagaagcaugucucu

SEQ ID NO: 668367 - RNA, 21 nt, Homo sapiens
ucaguguaugauauacuuuau

SEQ ID NO: 668368 - RNA, 16 nt, Homo sapiens
ucaguuaacuauugca

SEQ ID NO: 668369 - RNA, 17 nt, Homo sapiens
ucaguuaauucuuagau

SEQ ID NO: 668370 - RNA, 18 nt, Homo sapiens
ucaguuaauucuuagaua

SEQ ID NO: 668371 - RNA, 14 nt, Homo sapiens
ucaguuacuaagaa

SEQ ID NO: 668372 - RNA, 18 nt, Homo sapiens
ucaguuacucagcccugg

SEQ ID NO: 668373 - RNA, 13 nt, Homo sapiens
ucaguuacucuga

SEQ ID NO: 668374 - RNA, 20 nt, Homo sapiens
ucaguuauaaagucaaggac

SEQ ID NO: 668375 - RNA, 22 nt, Homo sapiens
ucaguuaugauuuuuuuuucau

SEQ ID NO: 668376 - RNA, 15 nt, Homo sapiens
ucaguuauuacaugu

SEQ ID NO: 668377 - RNA, 20 nt, Homo sapiens
ucaguucccaccaucugauu

SEQ ID NO: 668378 - RNA, 15 nt, Homo sapiens
ucaguucccuccugc

SEQ ID NO: 668379 - RNA, 21 nt, Homo sapiens
ucaguucguguuugauuccau

SEQ ID NO: 668380 - RNA, 16 nt, Homo sapiens
ucaguucuacacugau

SEQ ID NO: 668381 - RNA, 16 nt, Homo sapiens
ucaguucuacuuuuau

SEQ ID NO: 668382 - RNA, 20 nt, Homo sapiens
ucaguucuuagauucagggg

SEQ ID NO: 668383 - RNA, 13 nt, Homo sapiens
ucaguugacuuua

SEQ ID NO: 668384 - RNA, 21 nt, Homo sapiens
ucaguugccaaggaucccuga

SEQ ID NO: 668385 - RNA, 21 nt, Homo sapiens
ucaguugggagugguugcuau

SEQ ID NO: 668386 - RNA, 14 nt, Homo sapiens
ucaguuggugcugc

SEQ ID NO: 668387 - RNA, 15 nt, Homo sapiens
ucaguuggugcugcu

SEQ ID NO: 668388 - RNA, 19 nt, Homo sapiens
ucaguuuucauaguaucca

SEQ ID NO: 668389 - RNA, 20 nt, Homo sapiens
ucauaaaccaauguggcaag

SEQ ID NO: 668390 - RNA, 17 nt, Homo sapiens
ucauaacuauacuugau

SEQ ID NO: 668391 - RNA, 21 nt, Homo sapiens
ucauaacuuggccauguucuc

SEQ ID NO: 668392 - RNA, 15 nt, Homo sapiens
ucauaagacaaugga

SEQ ID NO: 668393 - RNA, 15 nt, Homo sapiens
ucauaaguaaaccua

SEQ ID NO: 668394 - RNA, 22 nt, Homo sapiens
ucauaauguuaacuaaauaacu

SEQ ID NO: 668395 - RNA, 14 nt, Homo sapiens
ucauaauucugaaa

SEQ ID NO: 668396 - RNA, 20 nt, Homo sapiens
ucauaauuuuaguaauuucc

SEQ ID NO: 668397 - RNA, 14 nt, Homo sapiens
ucauacaugcauac

SEQ ID NO: 668398 - RNA, 20 nt, Homo sapiens
ucauacaugcauacaaagag

SEQ ID NO: 668399 - RNA, 22 nt, Homo sapiens
ucauaccacuugaauuuauuga

SEQ ID NO: 668400 - RNA, 20 nt, Homo sapiens
ucauaccagcauacgcucac

SEQ ID NO: 668401 - RNA, 19 nt, Homo sapiens
ucauaccucagaauguaaa

SEQ ID NO: 668402 - RNA, 20 nt, Homo sapiens
ucauaccuuaugcuacacag

SEQ ID NO: 668403 - RNA, 23 nt, Homo sapiens
ucauacuuaacauuucauuguac

SEQ ID NO: 668404 - RNA, 18 nt, Homo sapiens
ucauagaaauucuuuaua

SEQ ID NO: 668405 - RNA, 18 nt, Homo sapiens
ucauagaagguguaggcu

SEQ ID NO: 668406 - RNA, 14 nt, Homo sapiens
ucauagcugagauu

SEQ ID NO: 668407 - RNA, 15 nt, Homo sapiens
ucauagcugagauuc

SEQ ID NO: 668408 - RNA, 15 nt, Homo sapiens
ucauaggaagacaca

SEQ ID NO: 668409 - RNA, 14 nt, Homo sapiens
ucauaggucccuga

SEQ ID NO: 668410 - RNA, 15 nt, Homo sapiens
ucauagugcugaaaa

SEQ ID NO: 668411 - RNA, 15 nt, Homo sapiens
ucauaguuuugcacu

SEQ ID NO: 668412 - RNA, 13 nt, Homo sapiens
ucauauaccagca

SEQ ID NO: 668413 - RNA, 23 nt, Homo sapiens
ucauauauuuuuaccaucugcug

SEQ ID NO: 668414 - RNA, 20 nt, Homo sapiens
ucauaugaaaaaaaugcauu

SEQ ID NO: 668415 - RNA, 14 nt, Homo sapiens
ucauauguguaaaa

SEQ ID NO: 668416 - RNA, 23 nt, Homo sapiens
ucauauugguauucacuaaucug

SEQ ID NO: 668417 - RNA, 17 nt, Homo sapiens
ucauauuguugcauugc

SEQ ID NO: 668418 - RNA, 20 nt, Homo sapiens
ucauauuuuaaacagaggau

SEQ ID NO: 668419 - RNA, 13 nt, Homo sapiens
ucauauuuugcca

SEQ ID NO: 668420 - RNA, 23 nt, Homo sapiens
ucaucaaagcagaagucuggcuu

SEQ ID NO: 668421 - RNA, 20 nt, Homo sapiens
ucaucacauuucuaugccaa

SEQ ID NO: 668422 - RNA, 14 nt, Homo sapiens
ucaucagagcagcu

SEQ ID NO: 668423 - RNA, 21 nt, Homo sapiens
ucaucagagccuuuccucaaa

SEQ ID NO: 668424 - RNA, 17 nt, Homo sapiens
ucaucagaugccugcuu

SEQ ID NO: 668425 - RNA, 22 nt, Homo sapiens
ucaucagcugugugcauuucag

SEQ ID NO: 668426 - RNA, 14 nt, Homo sapiens
ucaucaggaccaaa

SEQ ID NO: 668427 - RNA, 15 nt, Homo sapiens
ucaucaggugcauag

SEQ ID NO: 668428 - RNA, 16 nt, Homo sapiens
ucaucaugugugucca

SEQ ID NO: 668429 - RNA, 20 nt, Homo sapiens
ucaucauuggcuccauugcu

SEQ ID NO: 668430 - RNA, 16 nt, Homo sapiens
ucauccccccugcugc

SEQ ID NO: 668431 - RNA, 17 nt, Homo sapiens
ucauccccucguccugu

SEQ ID NO: 668432 - RNA, 20 nt, Homo sapiens
ucaucccguaucacaguguu

SEQ ID NO: 668433 - RNA, 15 nt, Homo sapiens
ucaucccuaugggau

SEQ ID NO: 668434 - RNA, 21 nt, Homo sapiens
ucaucccuggucgucuauccc

SEQ ID NO: 668435 - RNA, 17 nt, Homo sapiens
ucaucccuuaauuuaag

SEQ ID NO: 668436 - RNA, 14 nt, Homo sapiens
ucaucccuuucucc

SEQ ID NO: 668437 - RNA, 22 nt, Homo sapiens
ucauccuaaaaaguuccaugaa

SEQ ID NO: 668438 - RNA, 21 nt, Homo sapiens
ucauccugcuucucuuuuccu

SEQ ID NO: 668439 - RNA, 22 nt, Homo sapiens
ucauccuggcacgcccuacucc

SEQ ID NO: 668440 - RNA, 23 nt, Homo sapiens
ucauccuuaaaacaauucuguga

SEQ ID NO: 668441 - RNA, 19 nt, Homo sapiens
ucaucggcaggcgcaugag

SEQ ID NO: 668442 - RNA, 14 nt, Homo sapiens
ucaucggugccugg

SEQ ID NO: 668443 - RNA, 15 nt, Homo sapiens
ucaucgucaucauca

SEQ ID NO: 668444 - RNA, 15 nt, Homo sapiens
ucaucuaacugauga

SEQ ID NO: 668445 - RNA, 16 nt, Homo sapiens
ucaucuacccugcuga

SEQ ID NO: 668446 - RNA, 20 nt, Homo sapiens
ucaucuauagaaagcuauau

SEQ ID NO: 668447 - RNA, 14 nt, Homo sapiens
ucaucucauuccaa

SEQ ID NO: 668448 - RNA, 20 nt, Homo sapiens
ucaucuccaucauaugccug

SEQ ID NO: 668449 - RNA, 18 nt, Homo sapiens
ucaucucccaccuagcag

SEQ ID NO: 668450 - RNA, 21 nt, Homo sapiens
ucaucuccgggguggccacag

SEQ ID NO: 668451 - RNA, 13 nt, Homo sapiens
ucaucucuacuaa

SEQ ID NO: 668452 - RNA, 14 nt, Homo sapiens
ucaucucugcaggu

SEQ ID NO: 668453 - RNA, 16 nt, Homo sapiens
ucaucugaaaaucugg

SEQ ID NO: 668454 - RNA, 18 nt, Homo sapiens
ucaucugaccuucaccuu

SEQ ID NO: 668455 - RNA, 12 nt, Homo sapiens
ucaucugggaaa

SEQ ID NO: 668456 - RNA, 13 nt, Homo sapiens
ucaucugugcacu

SEQ ID NO: 668457 - RNA, 23 nt, Homo sapiens
ucaucuuagugccugagaguauu

SEQ ID NO: 668458 - RNA, 20 nt, Homo sapiens
ucaucuucacagauuguucu

SEQ ID NO: 668459 - RNA, 14 nt, Homo sapiens
ucaucuucacugca

SEQ ID NO: 668460 - RNA, 12 nt, Homo sapiens
gccgugccuugu

SEQ ID NO: 668461 - RNA, 15 nt, Homo sapiens
gccguuuaaaccacu

SEQ ID NO: 668462 - RNA, 19 nt, Homo sapiens
gccuaaaaaguaucauuac

SEQ ID NO: 668463 - RNA, 22 nt, Homo sapiens
cucaagugaucuucccacacca

SEQ ID NO: 668464 - RNA, 16 nt, Homo sapiens
cucaaguuaggaggau

SEQ ID NO: 668465 - RNA, 14 nt, Homo sapiens
cucaaguucuugga

SEQ ID NO: 668466 - RNA, 19 nt, Homo sapiens
cucaauaaauugcaacaua

SEQ ID NO: 668467 - RNA, 15 nt, Homo sapiens
cucaauauuccugaa

SEQ ID NO: 668468 - RNA, 17 nt, Homo sapiens
cucaaucacugcucccc

SEQ ID NO: 668469 - RNA, 19 nt, Homo sapiens
cucaaucgagugagacaga

SEQ ID NO: 668470 - RNA, 21 nt, Homo sapiens
cucaaucucagcuaacauucc

SEQ ID NO: 668471 - RNA, 18 nt, Homo sapiens
cucaaucucccuggggca

SEQ ID NO: 668472 - RNA, 14 nt, Homo sapiens
cucaaugcagucag

SEQ ID NO: 668473 - RNA, 12 nt, Homo sapiens
cucaauucacau

SEQ ID NO: 668474 - RNA, 14 nt, Homo sapiens
cucaauucacauag

SEQ ID NO: 668475 - RNA, 20 nt, Homo sapiens
cucaauucuuuguauaugca

SEQ ID NO: 668476 - RNA, 20 nt, Homo sapiens
cucaauuuugucuguacuca

SEQ ID NO: 668477 - RNA, 23 nt, Homo sapiens
cucaauuuugucuguacucaugu

SEQ ID NO: 668478 - RNA, 14 nt, Homo sapiens
cucacaaaaucacu

SEQ ID NO: 668479 - RNA, 22 nt, Homo sapiens
cucacaaaguccacuuuacuca

SEQ ID NO: 668480 - RNA, 13 nt, Homo sapiens
cucacaaccugaa

SEQ ID NO: 668481 - RNA, 15 nt, Homo sapiens
cucacaagaagacca

SEQ ID NO: 668482 - RNA, 16 nt, Homo sapiens
cucacaagcaauccau

SEQ ID NO: 668483 - RNA, 15 nt, Homo sapiens
cucacaagcaugaag

SEQ ID NO: 668484 - RNA, 18 nt, Homo sapiens
cucacaaggaaaaggcca

SEQ ID NO: 668485 - RNA, 15 nt, Homo sapiens
cucacacacacagcu

SEQ ID NO: 668486 - RNA, 20 nt, Homo sapiens
cucacacaucacauucccau

SEQ ID NO: 668487 - RNA, 14 nt, Homo sapiens
cucacaccaacagu

SEQ ID NO: 668488 - RNA, 13 nt, Homo sapiens
cucacaccacuaa

SEQ ID NO: 668489 - RNA, 19 nt, Homo sapiens
cucacaccuguaaucccag

SEQ ID NO: 668490 - RNA, 14 nt, Homo sapiens
cucacagaacugca

SEQ ID NO: 668491 - RNA, 12 nt, Homo sapiens
cucacagaccug

SEQ ID NO: 668492 - RNA, 20 nt, Homo sapiens
cucacagagugcauugugag

SEQ ID NO: 668493 - RNA, 19 nt, Homo sapiens
cucacagaguuuauaguua

SEQ ID NO: 668494 - RNA, 21 nt, Homo sapiens
cucacagccgcauuggugacu

SEQ ID NO: 668495 - RNA, 22 nt, Homo sapiens
cucacaguaccuaugacuuuuu

SEQ ID NO: 668496 - RNA, 13 nt, Homo sapiens
cucacagugacau

SEQ ID NO: 668497 - RNA, 19 nt, Homo sapiens
cucacauaagcccaguuca

SEQ ID NO: 668498 - RNA, 20 nt, Homo sapiens
cucacauaagcccaguucau

SEQ ID NO: 668499 - RNA, 15 nt, Homo sapiens
cucacauggucugcu

SEQ ID NO: 668500 - RNA, 14 nt, Homo sapiens
cucacccagccugg

SEQ ID NO: 668501 - RNA, 15 nt, Homo sapiens
cucacccaggcaauc

SEQ ID NO: 668502 - RNA, 19 nt, Homo sapiens
cucacccuccacaaagcaa

SEQ ID NO: 668503 - RNA, 12 nt, Homo sapiens
cucaccgucucg

SEQ ID NO: 668504 - RNA, 19 nt, Homo sapiens
cucaccucccgaagccacc

SEQ ID NO: 668505 - RNA, 17 nt, Homo sapiens
cucaccugcuggccccu

SEQ ID NO: 668506 - RNA, 23 nt, Homo sapiens
cucaccuguuacuugaaauacca

SEQ ID NO: 668507 - RNA, 15 nt, Homo sapiens
cucaccuugagccca

SEQ ID NO: 668508 - RNA, 15 nt, Homo sapiens
cucacgacuggucac

SEQ ID NO: 668509 - RNA, 13 nt, Homo sapiens
cucacgccuguaa

SEQ ID NO: 668510 - RNA, 14 nt, Homo sapiens
cucacgucucucuu

SEQ ID NO: 668511 - RNA, 15 nt, Homo sapiens
cucacuaugcugcuu

SEQ ID NO: 668512 - RNA, 17 nt, Homo sapiens
cucacucacucacucca

SEQ ID NO: 668513 - RNA, 15 nt, Homo sapiens
cucacucccaaggga

SEQ ID NO: 668514 - RNA, 13 nt, Homo sapiens
cucacuccuagga

SEQ ID NO: 668515 - RNA, 16 nt, Homo sapiens
cucacucuguugccca

SEQ ID NO: 668516 - RNA, 16 nt, Homo sapiens
cucacugcagugcuga

SEQ ID NO: 668517 - RNA, 23 nt, Homo sapiens
cucacugcugcaaauacuguaua

SEQ ID NO: 668518 - RNA, 21 nt, Homo sapiens
cucacuggaugaaauaacucc

SEQ ID NO: 668519 - RNA, 18 nt, Homo sapiens
cucacugggaagcuccca

SEQ ID NO: 668520 - RNA, 20 nt, Homo sapiens
cucacuuuggaaucagaauu

SEQ ID NO: 668521 - RNA, 17 nt, Homo sapiens
cucacuuuuauugauaa

SEQ ID NO: 668522 - RNA, 17 nt, Homo sapiens
cucagaaaagugacagu

SEQ ID NO: 668523 - RNA, 22 nt, Homo sapiens
cucagaaacugcgaggccaguu

SEQ ID NO: 668524 - RNA, 13 nt, Homo sapiens
cucagaaagggau

SEQ ID NO: 668525 - RNA, 21 nt, Homo sapiens
cucagaaauuuucugaucuca

SEQ ID NO: 668526 - RNA, 23 nt, Homo sapiens
cucagaacuuucuaguugcccuc

SEQ ID NO: 668527 - RNA, 19 nt, Homo sapiens
cucagaaggccccagagag

SEQ ID NO: 668528 - RNA, 14 nt, Homo sapiens
cucagaauaaaaga

SEQ ID NO: 668529 - RNA, 20 nt, Homo sapiens
cucagaauaaaagaugauuu

SEQ ID NO: 668530 - RNA, 23 nt, Homo sapiens
cucagaauaaaagaugauuucuc

SEQ ID NO: 668531 - RNA, 20 nt, Homo sapiens
cucagaauaaggcaggcauu

SEQ ID NO: 668532 - RNA, 20 nt, Homo sapiens
cucagaaugcacuugauuca

SEQ ID NO: 668533 - RNA, 20 nt, Homo sapiens
cucagaauugaucauuuucc

SEQ ID NO: 668534 - RNA, 14 nt, Homo sapiens
cucagacauuccaa

SEQ ID NO: 668535 - RNA, 17 nt, Homo sapiens
cucagaccacuugcauu

SEQ ID NO: 668536 - RNA, 16 nt, Homo sapiens
cucagaccagcucuuc

SEQ ID NO: 668537 - RNA, 19 nt, Homo sapiens
cucagagaaccagugcaga

SEQ ID NO: 668538 - RNA, 17 nt, Homo sapiens
cucagagaaucaaagau

SEQ ID NO: 668539 - RNA, 18 nt, Homo sapiens
cucagagaccagcacuca

SEQ ID NO: 668540 - RNA, 20 nt, Homo sapiens
cucagagaccugaagugugc

SEQ ID NO: 668541 - RNA, 16 nt, Homo sapiens
cucagagaguugucug

SEQ ID NO: 668542 - RNA, 13 nt, Homo sapiens
cucagagauauac

SEQ ID NO: 668543 - RNA, 14 nt, Homo sapiens
cucagagcauuuca

SEQ ID NO: 668544 - RNA, 20 nt, Homo sapiens
cucagaggacuggacgugcu

SEQ ID NO: 668545 - RNA, 14 nt, Homo sapiens
cucagaggccugcu

SEQ ID NO: 668546 - RNA, 19 nt, Homo sapiens
cucagaggcugagcccugu

SEQ ID NO: 668547 - RNA, 21 nt, Homo sapiens
cucagaguccacuguggcacu

SEQ ID NO: 668548 - RNA, 21 nt, Homo sapiens
cucagaguguggguccuucaa

SEQ ID NO: 668549 - RNA, 13 nt, Homo sapiens
cucagaugaucuc

SEQ ID NO: 668550 - RNA, 16 nt, Homo sapiens
cucagauuauuuuucc

SEQ ID NO: 668551 - RNA, 16 nt, Homo sapiens
cucagauuccaccuag

SEQ ID NO: 668552 - RNA, 13 nt, Homo sapiens
cucagcaaaagau

SEQ ID NO: 668553 - RNA, 14 nt, Homo sapiens
cucagcaaugauua

SEQ ID NO: 668554 - RNA, 21 nt, Homo sapiens
cucagcaauugucuacauuca

SEQ ID NO: 668555 - RNA, 22 nt, Homo sapiens
cucagcaauugucuacauucag

SEQ ID NO: 668556 - RNA, 11 nt, Homo sapiens
cucagcacugu

SEQ ID NO: 668557 - RNA, 23 nt, Homo sapiens
cucagcacuuuggacauggcuca

SEQ ID NO: 668558 - RNA, 23 nt, Homo sapiens
cucagcauagggucacuuugcca

SEQ ID NO: 668559 - RNA, 22 nt, Homo sapiens
cucagcauuugauuaacauuug

SEQ ID NO: 668560 - RNA, 18 nt, Homo sapiens
cucagccacagccugaca

SEQ ID NO: 668561 - RNA, 11 nt, Homo sapiens
cucagcccagg

SEQ ID NO: 668562 - RNA, 19 nt, Homo sapiens
cucagcccccaccucaggu

SEQ ID NO: 668563 - RNA, 14 nt, Homo sapiens
cucagccccuagga

SEQ ID NO: 668564 - RNA, 18 nt, Homo sapiens
cucagccccuaggaguau

SEQ ID NO: 668565 - RNA, 15 nt, Homo sapiens
cucagcccugacccu

SEQ ID NO: 668566 - RNA, 17 nt, Homo sapiens
cucagccuguugcggau

SEQ ID NO: 668567 - RNA, 16 nt, Homo sapiens
cucagcuaagcucacg

SEQ ID NO: 668568 - RNA, 22 nt, Homo sapiens
cuaucauuggccuccaaacaca

SEQ ID NO: 668569 - RNA, 22 nt, Homo sapiens
cuauccaaagaacuugauuugc

SEQ ID NO: 668570 - RNA, 18 nt, Homo sapiens
cuauccccaaacuccuuu

SEQ ID NO: 668571 - RNA, 15 nt, Homo sapiens
cuauccuauguuaaa

SEQ ID NO: 668572 - RNA, 12 nt, Homo sapiens
cuauccuuccag

SEQ ID NO: 668573 - RNA, 22 nt, Homo sapiens
cuaucgucaggaaaccaaauaa

SEQ ID NO: 668574 - RNA, 14 nt, Homo sapiens
cuaucuacuacaaa

SEQ ID NO: 668575 - RNA, 21 nt, Homo sapiens
cuaucuacuacaaacuucaaa

SEQ ID NO: 668576 - RNA, 19 nt, Homo sapiens
cuaucuauggcccugcaaa

SEQ ID NO: 668577 - RNA, 21 nt, Homo sapiens
cuaucuccagcggcccuguca

SEQ ID NO: 668578 - RNA, 15 nt, Homo sapiens
cuaucugcacucuaa

SEQ ID NO: 668579 - RNA, 16 nt, Homo sapiens
cuaucugcuuagcaac

SEQ ID NO: 668580 - RNA, 17 nt, Homo sapiens
cuaucuuuuaguuuuag

SEQ ID NO: 668581 - RNA, 22 nt, Homo sapiens
cuaugaaaaauguguuccauug

SEQ ID NO: 668582 - RNA, 16 nt, Homo sapiens
cuaugaaaaugagccc

SEQ ID NO: 668583 - RNA, 20 nt, Homo sapiens
cuaugaaaaugagcccuggc

SEQ ID NO: 668584 - RNA, 12 nt, Homo sapiens
cuaugaacacug

SEQ ID NO: 668585 - RNA, 24 nt, Homo sapiens
cuaugaacagaaacuacauuucua

SEQ ID NO: 668586 - RNA, 16 nt, Homo sapiens
cuaugaacuucucuca

SEQ ID NO: 668587 - RNA, 17 nt, Homo sapiens
cuaugaauuuucaagua

SEQ ID NO: 668588 - RNA, 21 nt, Homo sapiens
cuaugagaauugggauuacau

SEQ ID NO: 668589 - RNA, 17 nt, Homo sapiens
cuaugagcacauaggac

SEQ ID NO: 668590 - RNA, 14 nt, Homo sapiens
cuaugagccaggca

SEQ ID NO: 668591 - RNA, 19 nt, Homo sapiens
cuaugauauuuucugugcc

SEQ ID NO: 668592 - RNA, 15 nt, Homo sapiens
cuaugcagaggccug

SEQ ID NO: 668593 - RNA, 21 nt, Homo sapiens
cuaugcauaaaaaaaugaugc

SEQ ID NO: 668594 - RNA, 23 nt, Homo sapiens
cuaugcauuuucuucacagugca

SEQ ID NO: 668595 - RNA, 23 nt, Homo sapiens
cuaugcuggauaagaaauggugg

SEQ ID NO: 668596 - RNA, 18 nt, Homo sapiens
cuaugcuggcuuuucacc

SEQ ID NO: 668597 - RNA, 16 nt, Homo sapiens
cuauggaaucaauuca

SEQ ID NO: 668598 - RNA, 20 nt, Homo sapiens
cuauggaauguaaagugcaa

SEQ ID NO: 668599 - RNA, 22 nt, Homo sapiens
cuauggacagcuuuucccaaga

SEQ ID NO: 668600 - RNA, 10 nt, Homo sapiens
cuauggaugu

SEQ ID NO: 668601 - RNA, 19 nt, Homo sapiens
cuauggugagaugcagcug

SEQ ID NO: 668602 - RNA, 21 nt, Homo sapiens
cuaugguguguuguaucuuug

SEQ ID NO: 668603 - RNA, 18 nt, Homo sapiens
cuauguaaacaaaccaca

SEQ ID NO: 668604 - RNA, 14 nt, Homo sapiens
cuauguaacaugua

SEQ ID NO: 668605 - RNA, 13 nt, Homo sapiens
cuauguacuguaa

SEQ ID NO: 668606 - RNA, 18 nt, Homo sapiens
cuauguagcaauauauca

SEQ ID NO: 668607 - RNA, 13 nt, Homo sapiens
cuauguauauaaa

SEQ ID NO: 668608 - RNA, 22 nt, Homo sapiens
cuauguauggaauacaguguua

SEQ ID NO: 668609 - RNA, 17 nt, Homo sapiens
cuaugucaacaguauaa

SEQ ID NO: 668610 - RNA, 14 nt, Homo sapiens
cuaugucuuucacc

SEQ ID NO: 668611 - RNA, 12 nt, Homo sapiens
cuaugugcaaaa

SEQ ID NO: 668612 - RNA, 13 nt, Homo sapiens
cuaugugcaaaaa

SEQ ID NO: 668613 - RNA, 23 nt, Homo sapiens
cuaugugcaaaaaucaacucaaa

SEQ ID NO: 668614 - RNA, 20 nt, Homo sapiens
cuaugugggugggaccacag

SEQ ID NO: 668615 - RNA, 22 nt, Homo sapiens
cuauguguuaaacagaggugau

SEQ ID NO: 668616 - RNA, 22 nt, Homo sapiens
cuauguguuuuagacuuagacu

SEQ ID NO: 668617 - RNA, 11 nt, Homo sapiens
cuauguucccc

SEQ ID NO: 668618 - RNA, 21 nt, Homo sapiens
cuauguuuccccccuuuucag

SEQ ID NO: 668619 - RNA, 17 nt, Homo sapiens
cuauguuuggaguuuaa

SEQ ID NO: 668620 - RNA, 18 nt, Homo sapiens
cuauuaagaaaaucacau

SEQ ID NO: 668621 - RNA, 17 nt, Homo sapiens
cuauuaauacucugcag

SEQ ID NO: 668622 - RNA, 16 nt, Homo sapiens
cuauuacgugcaauac

SEQ ID NO: 668623 - RNA, 18 nt, Homo sapiens
cuauuaguccccacccaa

SEQ ID NO: 668624 - RNA, 13 nt, Homo sapiens
cuauuauccuucu

SEQ ID NO: 668625 - RNA, 23 nt, Homo sapiens
cuauucaauaugugaaagacaau

SEQ ID NO: 668626 - RNA, 16 nt, Homo sapiens
cuauucagacaagcaa

SEQ ID NO: 668627 - RNA, 15 nt, Homo sapiens
cuauucaguuuucag

SEQ ID NO: 668628 - RNA, 14 nt, Homo sapiens
cuauuccaaaaagg

SEQ ID NO: 668629 - RNA, 21 nt, Homo sapiens
cuauucccugucacuacacac

SEQ ID NO: 668630 - RNA, 23 nt, Homo sapiens
cuauucccugucacuacacacua

SEQ ID NO: 668631 - RNA, 21 nt, Homo sapiens
cuauuccuuaugggaucauuu

SEQ ID NO: 668632 - RNA, 13 nt, Homo sapiens
cuauucuauccau

SEQ ID NO: 668633 - RNA, 13 nt, Homo sapiens
cuauucucaccag

SEQ ID NO: 668634 - RNA, 16 nt, Homo sapiens
cuauucucugccuuuu

SEQ ID NO: 668635 - RNA, 15 nt, Homo sapiens
cuauucuggcaauaa

SEQ ID NO: 668636 - RNA, 15 nt, Homo sapiens
cuauucuuaagcacu

SEQ ID NO: 668637 - RNA, 14 nt, Homo sapiens
cuauucuugauuua

SEQ ID NO: 668638 - RNA, 18 nt, Homo sapiens
cuauugcugcucucucac

SEQ ID NO: 668639 - RNA, 14 nt, Homo sapiens
cuauugucuguaau

SEQ ID NO: 668640 - RNA, 22 nt, Homo sapiens
cuauuuaaaaaaaaagucagag

SEQ ID NO: 668641 - RNA, 19 nt, Homo sapiens
cuauuuaaaggcacuauua

SEQ ID NO: 668642 - RNA, 14 nt, Homo sapiens
cuauuuaagugaaa

SEQ ID NO: 668643 - RNA, 21 nt, Homo sapiens
cuauuuaagugaaaaaagcaa

SEQ ID NO: 668644 - RNA, 22 nt, Homo sapiens
cuauuuaagugaaaaaagcaaa

SEQ ID NO: 668645 - RNA, 21 nt, Homo sapiens
cuauuuagaaauggauuuauc

SEQ ID NO: 668646 - RNA, 22 nt, Homo sapiens
cuauuucaauaacagauggugc

SEQ ID NO: 668647 - RNA, 11 nt, Homo sapiens
cuauuuccauu

SEQ ID NO: 668648 - RNA, 22 nt, Homo sapiens
cuauuuccuucuccuccugucu

SEQ ID NO: 668649 - RNA, 18 nt, Homo sapiens
cuauuucuucuacugcua

SEQ ID NO: 668650 - RNA, 13 nt, Homo sapiens
cuauuugaagugu

SEQ ID NO: 668651 - RNA, 23 nt, Homo sapiens
cuauuuggggcuugcaugccaaa

SEQ ID NO: 668652 - RNA, 18 nt, Homo sapiens
cuauuuguuuacaugcag

SEQ ID NO: 668653 - RNA, 14 nt, Homo sapiens
cuauuuuacuuugu

SEQ ID NO: 668654 - RNA, 15 nt, Homo sapiens
cuauuuuauucccuu

SEQ ID NO: 668655 - RNA, 21 nt, Homo sapiens
cuauuuucaacauaacugaag

SEQ ID NO: 668656 - RNA, 22 nt, Homo sapiens
cuauuuucugcagaaauuugca

SEQ ID NO: 668657 - RNA, 17 nt, Homo sapiens
cuauuuucuuuuccauu

SEQ ID NO: 668658 - RNA, 21 nt, Homo sapiens
cuauuuuuguuaagcgugucu

SEQ ID NO: 668659 - RNA, 16 nt, Homo sapiens
cucaaaacacuuccag

SEQ ID NO: 668660 - RNA, 14 nt, Homo sapiens
cucaaaacuuucaa

SEQ ID NO: 668661 - RNA, 21 nt, Homo sapiens
cucaaaagcugggcagguugg

SEQ ID NO: 668662 - RNA, 14 nt, Homo sapiens
cucaaaauauguca

SEQ ID NO: 668663 - RNA, 19 nt, Homo sapiens
cucaaaaucuuuccaaaua

SEQ ID NO: 668664 - RNA, 21 nt, Homo sapiens
cucaaaauuuaacaguuaccu

SEQ ID NO: 668665 - RNA, 13 nt, Homo sapiens
cucaaacagucuu

SEQ ID NO: 668666 - RNA, 12 nt, Homo sapiens
cucaaaccacuu

SEQ ID NO: 668667 - RNA, 23 nt, Homo sapiens
cucaaaccgccggccacacuggu

SEQ ID NO: 668668 - RNA, 20 nt, Homo sapiens
cucaaacuccugaccucagg

SEQ ID NO: 668669 - RNA, 11 nt, Homo sapiens
cucaaacugcc

SEQ ID NO: 668670 - RNA, 18 nt, Homo sapiens
cucaaagucccuugagac

SEQ ID NO: 668671 - RNA, 13 nt, Homo sapiens
cucaaaucuccag

SEQ ID NO: 668672 - RNA, 18 nt, Homo sapiens
cucaaaugacccaaagac

SEQ ID NO: 668673 - RNA, 20 nt, Homo sapiens
cucaaaugacccaaagacca

SEQ ID NO: 668674 - RNA, 21 nt, Homo sapiens
cucaaaugacccaaagaccaa

SEQ ID NO: 668675 - RNA, 13 nt, Homo sapiens
cucaaaugcacau

SEQ ID NO: 668676 - RNA, 20 nt, Homo sapiens
gccauaguggaucacucacc

SEQ ID NO: 668677 - RNA, 16 nt, Homo sapiens
gccauauaaguuugaa

SEQ ID NO: 668678 - RNA, 22 nt, Homo sapiens
gccauaugaaugucaguaguuu

SEQ ID NO: 668679 - RNA, 14 nt, Homo sapiens
gccauauuaccccu

SEQ ID NO: 668680 - RNA, 18 nt, Homo sapiens
gccaucaaaaugcuuuuu

SEQ ID NO: 668681 - RNA, 17 nt, Homo sapiens
gccaucaccgcugggug

SEQ ID NO: 668682 - RNA, 14 nt, Homo sapiens
gccaucacuagaag

SEQ ID NO: 668683 - RNA, 22 nt, Homo sapiens
gccaucagggugggccacucuc

SEQ ID NO: 668684 - RNA, 12 nt, Homo sapiens
gccaucaugccu

SEQ ID NO: 668685 - RNA, 16 nt, Homo sapiens
gccaucaugccugacu

SEQ ID NO: 668686 - RNA, 18 nt, Homo sapiens
gccauccuaaaagccacc

SEQ ID NO: 668687 - RNA, 17 nt, Homo sapiens
gccaucuaauggcuuca

SEQ ID NO: 668688 - RNA, 20 nt, Homo sapiens
gccaucuggggucuaugccc

SEQ ID NO: 668689 - RNA, 19 nt, Homo sapiens
gccaucuguaaauauccca

SEQ ID NO: 668690 - RNA, 23 nt, Homo sapiens
gccaucuuuaucaugaagcacau

SEQ ID NO: 668691 - RNA, 20 nt, Homo sapiens
gccaugaucaugccacugca

SEQ ID NO: 668692 - RNA, 16 nt, Homo sapiens
gccaugauggccuuac

SEQ ID NO: 668693 - RNA, 14 nt, Homo sapiens
gccaugauguauau

SEQ ID NO: 668694 - RNA, 13 nt, Homo sapiens
gccaugccaggaa

SEQ ID NO: 668695 - RNA, 16 nt, Homo sapiens
gccaugcgaggggcca

SEQ ID NO: 668696 - RNA, 22 nt, Homo sapiens
gccauggcuuucauccuguguc

SEQ ID NO: 668697 - RNA, 19 nt, Homo sapiens
gccauggugacauugugga

SEQ ID NO: 668698 - RNA, 21 nt, Homo sapiens
gccaugguggagggcacuuca

SEQ ID NO: 668699 - RNA, 18 nt, Homo sapiens
gccauguaucaauauuca

SEQ ID NO: 668700 - RNA, 13 nt, Homo sapiens
gccauguccaaag

SEQ ID NO: 668701 - RNA, 14 nt, Homo sapiens
gccauguccaaaga

SEQ ID NO: 668702 - RNA, 17 nt, Homo sapiens
gccauguuauuuauagu

SEQ ID NO: 668703 - RNA, 23 nt, Homo sapiens
gccauuacuacuguacacggacc

SEQ ID NO: 668704 - RNA, 18 nt, Homo sapiens
gccauuauuuucugucag

SEQ ID NO: 668705 - RNA, 16 nt, Homo sapiens
gccauucaacucggaa

SEQ ID NO: 668706 - RNA, 13 nt, Homo sapiens
gccauucaugucc

SEQ ID NO: 668707 - RNA, 21 nt, Homo sapiens
gccauuccacagccccuuccu

SEQ ID NO: 668708 - RNA, 22 nt, Homo sapiens
gccauuccacagccccuuccuc

SEQ ID NO: 668709 - RNA, 22 nt, Homo sapiens
gccauuccacuccacucagguu

SEQ ID NO: 668710 - RNA, 21 nt, Homo sapiens
gccauuggguuuggggccaug

SEQ ID NO: 668711 - RNA, 22 nt, Homo sapiens
gccauuuaaguaucuugugcuu

SEQ ID NO: 668712 - RNA, 22 nt, Homo sapiens
gccauuuuggguuuugggucuu

SEQ ID NO: 668713 - RNA, 19 nt, Homo sapiens
gccauuuuguuguguguau

SEQ ID NO: 668714 - RNA, 13 nt, Homo sapiens
gcccaaacauaaa

SEQ ID NO: 668715 - RNA, 21 nt, Homo sapiens
gcccaaaugucaggguucugc

SEQ ID NO: 668716 - RNA, 17 nt, Homo sapiens
gcccaacccuaucccag

SEQ ID NO: 668717 - RNA, 15 nt, Homo sapiens
gcccaaccuauccug

SEQ ID NO: 668718 - RNA, 15 nt, Homo sapiens
gcccaacuaacaguc

SEQ ID NO: 668719 - RNA, 15 nt, Homo sapiens
gcccaagaacugcag

SEQ ID NO: 668720 - RNA, 15 nt, Homo sapiens
gcccaagaggacuga

SEQ ID NO: 668721 - RNA, 16 nt, Homo sapiens
gcccaagaggacugag

SEQ ID NO: 668722 - RNA, 22 nt, Homo sapiens
gcccaagcuucccuccaucccc

SEQ ID NO: 668723 - RNA, 23 nt, Homo sapiens
gcccaagugauccuuccaccuca

SEQ ID NO: 668724 - RNA, 14 nt, Homo sapiens
gcccaaguugcagu

SEQ ID NO: 668725 - RNA, 18 nt, Homo sapiens
gcccaauauaaaaggcaa

SEQ ID NO: 668726 - RNA, 13 nt, Homo sapiens
gcccacacccagg

SEQ ID NO: 668727 - RNA, 22 nt, Homo sapiens
gcccacagcaggggcuggccca

SEQ ID NO: 668728 - RNA, 17 nt, Homo sapiens
gcccaccaucaccaccg

SEQ ID NO: 668729 - RNA, 18 nt, Homo sapiens
gcccacccgaguaccucc

SEQ ID NO: 668730 - RNA, 17 nt, Homo sapiens
gcccaccguuauuugua

SEQ ID NO: 668731 - RNA, 14 nt, Homo sapiens
gcccacggggauca

SEQ ID NO: 668732 - RNA, 18 nt, Homo sapiens
gcccacuagagggcccau

SEQ ID NO: 668733 - RNA, 22 nt, Homo sapiens
gcccacuucaccguacuaacca

SEQ ID NO: 668734 - RNA, 16 nt, Homo sapiens
gcccagacaagauuuu

SEQ ID NO: 668735 - RNA, 21 nt, Homo sapiens
gcccagacaccaugugcaaua

SEQ ID NO: 668736 - RNA, 19 nt, Homo sapiens
gcccagaccacugucucca

SEQ ID NO: 668737 - RNA, 13 nt, Homo sapiens
gcccagacccacu

SEQ ID NO: 668738 - RNA, 23 nt, Homo sapiens
gcccagaccucugacacauuagc

SEQ ID NO: 668739 - RNA, 14 nt, Homo sapiens
gcccagacugauga

SEQ ID NO: 668740 - RNA, 21 nt, Homo sapiens
gcccagagcaggaagcauuca

SEQ ID NO: 668741 - RNA, 16 nt, Homo sapiens
gcccagagccucugcu

SEQ ID NO: 668742 - RNA, 20 nt, Homo sapiens
gcccagaggcggagggcagu

SEQ ID NO: 668743 - RNA, 18 nt, Homo sapiens
gcccagcaaucugcauuu

SEQ ID NO: 668744 - RNA, 20 nt, Homo sapiens
gcccagcagggccucaaagu

SEQ ID NO: 668745 - RNA, 13 nt, Homo sapiens
gcccagcccagcu

SEQ ID NO: 668746 - RNA, 16 nt, Homo sapiens
gcccagcccuccuuca

SEQ ID NO: 668747 - RNA, 19 nt, Homo sapiens
gcccagcgguucacacagg

SEQ ID NO: 668748 - RNA, 16 nt, Homo sapiens
gcccagcuaaagcaau

SEQ ID NO: 668749 - RNA, 15 nt, Homo sapiens
gcccagcugcaccug

SEQ ID NO: 668750 - RNA, 16 nt, Homo sapiens
gcccagcugcaccugc

SEQ ID NO: 668751 - RNA, 18 nt, Homo sapiens
gcccaggcaacaguacuu

SEQ ID NO: 668752 - RNA, 19 nt, Homo sapiens
gcccaggccucgggaccaa

SEQ ID NO: 668753 - RNA, 17 nt, Homo sapiens
gcccaggccugccuguu

SEQ ID NO: 668754 - RNA, 21 nt, Homo sapiens
gcccaggccugggaugcagug

SEQ ID NO: 668755 - RNA, 20 nt, Homo sapiens
gcccaggcuggaguacaaug

SEQ ID NO: 668756 - RNA, 19 nt, Homo sapiens
gcccaggcuggagugcaau

SEQ ID NO: 668757 - RNA, 20 nt, Homo sapiens
gcccaggcuggaguguagug

SEQ ID NO: 668758 - RNA, 17 nt, Homo sapiens
gcccaggcuggucuuga

SEQ ID NO: 668759 - RNA, 20 nt, Homo sapiens
gcccaggggcccacagggaa

SEQ ID NO: 668760 - RNA, 18 nt, Homo sapiens
gccccagggaucacuggc

SEQ ID NO: 668761 - RNA, 14 nt, Homo sapiens
gccccaguccaugc

SEQ ID NO: 668762 - RNA, 16 nt, Homo sapiens
gccccaguccaugcuu

SEQ ID NO: 668763 - RNA, 13 nt, Homo sapiens
gccccagugacag

SEQ ID NO: 668764 - RNA, 21 nt, Homo sapiens
gccccauccuccagcagggaa

SEQ ID NO: 668765 - RNA, 13 nt, Homo sapiens
gccccauguaucu

SEQ ID NO: 668766 - RNA, 14 nt, Homo sapiens
gcccccaccagcag

SEQ ID NO: 668767 - RNA, 17 nt, Homo sapiens
gcccccacuccagucca

SEQ ID NO: 668768 - RNA, 20 nt, Homo sapiens
gcccccagauacauggugau

SEQ ID NO: 668769 - RNA, 21 nt, Homo sapiens
gcccccagauagagcugggug

SEQ ID NO: 668770 - RNA, 13 nt, Homo sapiens
gcccccagcagag

SEQ ID NO: 668771 - RNA, 16 nt, Homo sapiens
gcccccagcccuggga

SEQ ID NO: 668772 - RNA, 15 nt, Homo sapiens
gcccccagccuuguu

SEQ ID NO: 668773 - RNA, 21 nt, Homo sapiens
gcccccaggcagccaccagug

SEQ ID NO: 668774 - RNA, 17 nt, Homo sapiens
gcccccaggcugcugga

SEQ ID NO: 668775 - RNA, 13 nt, Homo sapiens
gcccccaucaccu

SEQ ID NO: 668776 - RNA, 13 nt, Homo sapiens
gcccccauuucac

SEQ ID NO: 668777 - RNA, 22 nt, Homo sapiens
gccccccacaccuuuuccccaa

SEQ ID NO: 668778 - RNA, 21 nt, Homo sapiens
gccccccagggcuagugaagu

SEQ ID NO: 668779 - RNA, 13 nt, Homo sapiens
gccccccccaugu

SEQ ID NO: 668780 - RNA, 15 nt, Homo sapiens
gcccccgggccugca

SEQ ID NO: 668781 - RNA, 16 nt, Homo sapiens
gcccccuccucuccca

SEQ ID NO: 668782 - RNA, 13 nt, Homo sapiens
gcccccugcaucu

SEQ ID NO: 668783 - RNA, 21 nt, Homo sapiens
gccccgcaggguccaaaggcc

SEQ ID NO: 668784 - RNA, 16 nt, Homo sapiens
gccccgccugucacaa

SEQ ID NO: 668785 - RNA, 17 nt, Homo sapiens
gccccgcgaccaugugg

SEQ ID NO: 668786 - RNA, 17 nt, Homo sapiens
gccccggaccuaccucc

SEQ ID NO: 668787 - RNA, 20 nt, Homo sapiens
gccccggcaagccacaggaa

SEQ ID NO: 668788 - RNA, 17 nt, Homo sapiens
gccccggccuccucgga

SEQ ID NO: 668789 - RNA, 18 nt, Homo sapiens
gccccgggaugcaccggu

SEQ ID NO: 668790 - RNA, 17 nt, Homo sapiens
gccccgugggcugugcc

SEQ ID NO: 668791 - RNA, 23 nt, Homo sapiens
gccccguuucuugccccagugug

SEQ ID NO: 668792 - RNA, 22 nt, Homo sapiens
gccccuaaguuauuaccucucc

SEQ ID NO: 668793 - RNA, 16 nt, Homo sapiens
gccccucagggggcca

SEQ ID NO: 668794 - RNA, 18 nt, Homo sapiens
gccccuccuugcaaccag

SEQ ID NO: 668795 - RNA, 12 nt, Homo sapiens
gccccucuccca

SEQ ID NO: 668796 - RNA, 20 nt, Homo sapiens
gccccugaccccaugucucc

SEQ ID NO: 668797 - RNA, 20 nt, Homo sapiens
gccccuggggcuguauuuau

SEQ ID NO: 668798 - RNA, 18 nt, Homo sapiens
gccccuggucaagugcug

SEQ ID NO: 668799 - RNA, 17 nt, Homo sapiens
gccccuguccccagucc

SEQ ID NO: 668800 - RNA, 17 nt, Homo sapiens
gcccgagggauggugcc

SEQ ID NO: 668801 - RNA, 17 nt, Homo sapiens
gcccgcccucaccucug

SEQ ID NO: 668802 - RNA, 15 nt, Homo sapiens
gcccggaccuccauc

SEQ ID NO: 668803 - RNA, 21 nt, Homo sapiens
gcccgggguggggugcacucg

SEQ ID NO: 668804 - RNA, 20 nt, Homo sapiens
gcccgucauguuccucaaaa

SEQ ID NO: 668805 - RNA, 15 nt, Homo sapiens
gcccgugcacccugg

SEQ ID NO: 668806 - RNA, 18 nt, Homo sapiens
gcccgugcacccuggaag

SEQ ID NO: 668807 - RNA, 22 nt, Homo sapiens
gcccguggcuuggcaucugugu

SEQ ID NO: 668808 - RNA, 20 nt, Homo sapiens
gcccuaaaaauccagacucu

SEQ ID NO: 668809 - RNA, 16 nt, Homo sapiens
gcccuaaaagcacacu

SEQ ID NO: 668810 - RNA, 17 nt, Homo sapiens
gcccuaaccccuuccag

SEQ ID NO: 668811 - RNA, 17 nt, Homo sapiens
gcccuagagcacacugu

SEQ ID NO: 668812 - RNA, 17 nt, Homo sapiens
gcccuaggggagcaccg

SEQ ID NO: 668813 - RNA, 18 nt, Homo sapiens
gcccucacuaacaaagaa

SEQ ID NO: 668814 - RNA, 19 nt, Homo sapiens
gcccucaggaguuuuggga

SEQ ID NO: 668815 - RNA, 17 nt, Homo sapiens
gcccucaggccauuccc

SEQ ID NO: 668816 - RNA, 19 nt, Homo sapiens
gcccucaggggacuugaau

SEQ ID NO: 668817 - RNA, 19 nt, Homo sapiens
gcccuccaccuuguuccug

SEQ ID NO: 668818 - RNA, 16 nt, Homo sapiens
gcccuccaguguauga

SEQ ID NO: 668819 - RNA, 15 nt, Homo sapiens
gcccuccauccgugc

SEQ ID NO: 668820 - RNA, 19 nt, Homo sapiens
gcccucccagcccauugcu

SEQ ID NO: 668821 - RNA, 21 nt, Homo sapiens
gcccuccccacaaugccagac

SEQ ID NO: 668822 - RNA, 19 nt, Homo sapiens
gcccucccccagcaguuga

SEQ ID NO: 668823 - RNA, 18 nt, Homo sapiens
gcccucccccagcuccuu

SEQ ID NO: 668824 - RNA, 15 nt, Homo sapiens
gcccuccgaccucuc

SEQ ID NO: 668825 - RNA, 15 nt, Homo sapiens
gcccuccuucugggc

SEQ ID NO: 668826 - RNA, 20 nt, Homo sapiens
gcccucgacacucaccauga

SEQ ID NO: 668827 - RNA, 19 nt, Homo sapiens
gcccucuagggcagggugg

SEQ ID NO: 668828 - RNA, 14 nt, Homo sapiens
gcccucucaugcag

SEQ ID NO: 668829 - RNA, 22 nt, Homo sapiens
gcccucuccucccccuccuagg

SEQ ID NO: 668830 - RNA, 17 nt, Homo sapiens
gcccucucugaaccuca

SEQ ID NO: 668831 - RNA, 19 nt, Homo sapiens
gcccucugucuaccuggga

SEQ ID NO: 668832 - RNA, 18 nt, Homo sapiens
gcccugaacccacugcug

SEQ ID NO: 668833 - RNA, 15 nt, Homo sapiens
gcccugaaggugcca

SEQ ID NO: 668834 - RNA, 17 nt, Homo sapiens
gcccugaauuucuucuu

SEQ ID NO: 668835 - RNA, 17 nt, Homo sapiens
gcccugacuccuggacu

SEQ ID NO: 668836 - RNA, 19 nt, Homo sapiens
gcccugcagcccaccagac

SEQ ID NO: 668837 - RNA, 17 nt, Homo sapiens
gcccugccccaccccau

SEQ ID NO: 668838 - RNA, 14 nt, Homo sapiens
gcccugcccgggga

SEQ ID NO: 668839 - RNA, 19 nt, Homo sapiens
gcccugccugcugcaucuu

SEQ ID NO: 668840 - RNA, 16 nt, Homo sapiens
gcccugcgggugaaca

SEQ ID NO: 668841 - RNA, 17 nt, Homo sapiens
gcccugcucccaccagg

SEQ ID NO: 668842 - RNA, 12 nt, Homo sapiens
gcccugcugagu

SEQ ID NO: 668843 - RNA, 16 nt, Homo sapiens
gcccugcugugggaga

SEQ ID NO: 668844 - RNA, 16 nt, Homo sapiens
gcccuggaaggugcca

SEQ ID NO: 668845 - RNA, 19 nt, Homo sapiens
gcccuggcauguuccugcc

SEQ ID NO: 668846 - RNA, 14 nt, Homo sapiens
gcccuggccaggac

SEQ ID NO: 668847 - RNA, 19 nt, Homo sapiens
gcccugggaaccacuccca

SEQ ID NO: 668848 - RNA, 18 nt, Homo sapiens
ccaguguuguuuguaaau

SEQ ID NO: 668849 - RNA, 20 nt, Homo sapiens
ccaguguuuacaaggugaca

SEQ ID NO: 668850 - RNA, 19 nt, Homo sapiens
ccaguuacgacugaaguca

SEQ ID NO: 668851 - RNA, 23 nt, Homo sapiens
ccaguuaucuugaguugcagcuc

SEQ ID NO: 668852 - RNA, 13 nt, Homo sapiens
ccaguucaugcag

SEQ ID NO: 668853 - RNA, 19 nt, Homo sapiens
ccaguucauugcacuuuga

SEQ ID NO: 668854 - RNA, 14 nt, Homo sapiens
ccaguucuuuauaa

SEQ ID NO: 668855 - RNA, 23 nt, Homo sapiens
ccaguugguuaucugaauagugu

SEQ ID NO: 668856 - RNA, 20 nt, Homo sapiens
ccaguuguagcagguuucac

SEQ ID NO: 668857 - RNA, 23 nt, Homo sapiens
ccaguuucagagaaauacuuuca

SEQ ID NO: 668858 - RNA, 23 nt, Homo sapiens
ccaguuuggguaaaauacuuuua

SEQ ID NO: 668859 - RNA, 22 nt, Homo sapiens
ccaguuuguauuuagcugccaa

SEQ ID NO: 668860 - RNA, 17 nt, Homo sapiens
ccauaaaaaggaacaag

SEQ ID NO: 668861 - RNA, 22 nt, Homo sapiens
ccauaaaaauaaaucaguucau

SEQ ID NO: 668862 - RNA, 15 nt, Homo sapiens
ccauaagaaagcacu

SEQ ID NO: 668863 - RNA, 20 nt, Homo sapiens
ccauaaggcacuuaucccug

SEQ ID NO: 668864 - RNA, 23 nt, Homo sapiens
ccauaagucugauucucuuuaac

SEQ ID NO: 668865 - RNA, 16 nt, Homo sapiens
ccauaaucauguaaau

SEQ ID NO: 668866 - RNA, 13 nt, Homo sapiens
ccauaaugcauuc

SEQ ID NO: 668867 - RNA, 13 nt, Homo sapiens
ccauaauguuaca

SEQ ID NO: 668868 - RNA, 19 nt, Homo sapiens
ccauaauuaugaaaacuca

SEQ ID NO: 668869 - RNA, 20 nt, Homo sapiens
ccauacacacacaaaccauu

SEQ ID NO: 668870 - RNA, 18 nt, Homo sapiens
ccauacacacuguuguca

SEQ ID NO: 668871 - RNA, 14 nt, Homo sapiens
ccauacaccagcaa

SEQ ID NO: 668872 - RNA, 19 nt, Homo sapiens
ccauacaccagcaaugaag

SEQ ID NO: 668873 - RNA, 19 nt, Homo sapiens
ccauacucccuuucagggc

SEQ ID NO: 668874 - RNA, 12 nt, Homo sapiens
ccauacugagcc

SEQ ID NO: 668875 - RNA, 15 nt, Homo sapiens
ccauacuucucucag

SEQ ID NO: 668876 - RNA, 15 nt, Homo sapiens
ccauagagacuuugu

SEQ ID NO: 668877 - RNA, 21 nt, Homo sapiens
ccauagggacccauucuacac

SEQ ID NO: 668878 - RNA, 22 nt, Homo sapiens
ccauagggggcugcacgggaug

SEQ ID NO: 668879 - RNA, 16 nt, Homo sapiens
ccauagugaccaacau

SEQ ID NO: 668880 - RNA, 20 nt, Homo sapiens
ccauagugcacuagcauuuu

SEQ ID NO: 668881 - RNA, 13 nt, Homo sapiens
gccugagugaucc

SEQ ID NO: 668882 - RNA, 16 nt, Homo sapiens
gccugaugagacucca

SEQ ID NO: 668883 - RNA, 18 nt, Homo sapiens
gccugaugcucccucccc

SEQ ID NO: 668884 - RNA, 20 nt, Homo sapiens
gccugcaaaccuuccuggga

SEQ ID NO: 668885 - RNA, 22 nt, Homo sapiens
gccugcaaacucacugcucaag

SEQ ID NO: 668886 - RNA, 13 nt, Homo sapiens
gccugcacugaga

SEQ ID NO: 668887 - RNA, 12 nt, Homo sapiens
gccugcacugga

SEQ ID NO: 668888 - RNA, 15 nt, Homo sapiens
gccugcacugggaag

SEQ ID NO: 668889 - RNA, 20 nt, Homo sapiens
gccugcaguggugugaaaca

SEQ ID NO: 668890 - RNA, 22 nt, Homo sapiens
gccugcaugaaacauguucuca

SEQ ID NO: 668891 - RNA, 15 nt, Homo sapiens
gccugcauggagaag

SEQ ID NO: 668892 - RNA, 22 nt, Homo sapiens
gccugccagcuucugccuucaa

SEQ ID NO: 668893 - RNA, 11 nt, Homo sapiens
gccugccauuu

SEQ ID NO: 668894 - RNA, 23 nt, Homo sapiens
gccugcccuccccagagcacugg

SEQ ID NO: 668895 - RNA, 14 nt, Homo sapiens
gccugccuaugaaa

SEQ ID NO: 668896 - RNA, 23 nt, Homo sapiens
gccugccuguccccccgcacuuu

SEQ ID NO: 668897 - RNA, 13 nt, Homo sapiens
gccugccuugaag

SEQ ID NO: 668898 - RNA, 24 nt, Homo sapiens
gccugcgcagcuuggauggagacu

SEQ ID NO: 668899 - RNA, 14 nt, Homo sapiens
gccugcggaccaga

SEQ ID NO: 668900 - RNA, 19 nt, Homo sapiens
gccugcucccuagccagag

SEQ ID NO: 668901 - RNA, 23 nt, Homo sapiens
gccugcucccuagccagaggcuc

SEQ ID NO: 668902 - RNA, 15 nt, Homo sapiens
gccugcugcacuucc

SEQ ID NO: 668903 - RNA, 18 nt, Homo sapiens
gccugcuggccgacccac

SEQ ID NO: 668904 - RNA, 19 nt, Homo sapiens
gccugcuggcugcggcccc

SEQ ID NO: 668905 - RNA, 16 nt, Homo sapiens
gccugcuguguggacu

SEQ ID NO: 668906 - RNA, 23 nt, Homo sapiens
gccugcuuuggccuuuccuugua

SEQ ID NO: 668907 - RNA, 16 nt, Homo sapiens
gccuggaccuaugcag

SEQ ID NO: 668908 - RNA, 22 nt, Homo sapiens
gccuggacuguuuucucucggc

SEQ ID NO: 668909 - RNA, 24 nt, Homo sapiens
gccuggagacuuccuaugugugca

SEQ ID NO: 668910 - RNA, 15 nt, Homo sapiens
gccuggaggugggca

SEQ ID NO: 668911 - RNA, 21 nt, Homo sapiens
gccuggcaucugugugcgugg

SEQ ID NO: 668912 - RNA, 20 nt, Homo sapiens
gccuggccaacauggugaaa

SEQ ID NO: 668913 - RNA, 19 nt, Homo sapiens
gccuggccaagagaccagc

SEQ ID NO: 668914 - RNA, 14 nt, Homo sapiens
gccuggccaccagc

SEQ ID NO: 668915 - RNA, 20 nt, Homo sapiens
gccuggccaguauggugaaa

SEQ ID NO: 668916 - RNA, 22 nt, Homo sapiens
gccuggcccuccccacaaugcc

SEQ ID NO: 668917 - RNA, 21 nt, Homo sapiens
gccuggcuccccacgagucac

SEQ ID NO: 668918 - RNA, 15 nt, Homo sapiens
gccuggcuggcacag

SEQ ID NO: 668919 - RNA, 23 nt, Homo sapiens
gccuggcuucacucucccugacg

SEQ ID NO: 668920 - RNA, 15 nt, Homo sapiens
gccugggacccagcu

SEQ ID NO: 668921 - RNA, 17 nt, Homo sapiens
gccugggaccugaaccu

SEQ ID NO: 668922 - RNA, 17 nt, Homo sapiens
gccugggaucuggcaca

SEQ ID NO: 668923 - RNA, 16 nt, Homo sapiens
gccugggcaacaacag

SEQ ID NO: 668924 - RNA, 20 nt, Homo sapiens
gccugggcaacacggugaaa

SEQ ID NO: 668925 - RNA, 23 nt, Homo sapiens
gccugggcaacgagugaaacucc

SEQ ID NO: 668926 - RNA, 16 nt, Homo sapiens
gccuggggauucugag

SEQ ID NO: 668927 - RNA, 21 nt, Homo sapiens
gccuggggcccaaguugcagu

SEQ ID NO: 668928 - RNA, 17 nt, Homo sapiens
gccuggggucugacaau

SEQ ID NO: 668929 - RNA, 21 nt, Homo sapiens
gccugggugacagagugagug

SEQ ID NO: 668930 - RNA, 16 nt, Homo sapiens
gccugggugacauuug

SEQ ID NO: 668931 - RNA, 17 nt, Homo sapiens
gccugguacucaagccc

SEQ ID NO: 668932 - RNA, 14 nt, Homo sapiens
gccuggugcagugg

SEQ ID NO: 668933 - RNA, 13 nt, Homo sapiens
gccugguuugcaa

SEQ ID NO: 668934 - RNA, 21 nt, Homo sapiens
gccuguaaucccagcacuuug

SEQ ID NO: 668935 - RNA, 19 nt, Homo sapiens
gccuguaaucccagcuacu

SEQ ID NO: 668936 - RNA, 22 nt, Homo sapiens
gccuguaaucucagcacuuugg

SEQ ID NO: 668937 - RNA, 19 nt, Homo sapiens
gccuguacucccagcacuu

SEQ ID NO: 668938 - RNA, 20 nt, Homo sapiens
gccuguacucccagcacuuu

SEQ ID NO: 668939 - RNA, 17 nt, Homo sapiens
gccuguagcaauggcca

SEQ ID NO: 668940 - RNA, 19 nt, Homo sapiens
gccugucccauggacacuc

SEQ ID NO: 668941 - RNA, 21 nt, Homo sapiens
gccugucccauggacacucca

SEQ ID NO: 668942 - RNA, 14 nt, Homo sapiens
gccuguccccaugc

SEQ ID NO: 668943 - RNA, 17 nt, Homo sapiens
gccugucgcaugagaac

SEQ ID NO: 668944 - RNA, 20 nt, Homo sapiens
gccugucugccccagcccag

SEQ ID NO: 668945 - RNA, 15 nt, Homo sapiens
gccugucugugugca

SEQ ID NO: 668946 - RNA, 14 nt, Homo sapiens
gccugucuucagag

SEQ ID NO: 668947 - RNA, 17 nt, Homo sapiens
gccugugaagcagucag

SEQ ID NO: 668948 - RNA, 14 nt, Homo sapiens
gccugugacuuuca

SEQ ID NO: 668949 - RNA, 14 nt, Homo sapiens
gccugugcugugac

SEQ ID NO: 668950 - RNA, 20 nt, Homo sapiens
gccuguggaaugagugugca

SEQ ID NO: 668951 - RNA, 11 nt, Homo sapiens
gccuguggcau

SEQ ID NO: 668952 - RNA, 13 nt, Homo sapiens
gccuguggugaag

SEQ ID NO: 668953 - RNA, 18 nt, Homo sapiens
gccuguguccaucugacc

SEQ ID NO: 668954 - RNA, 13 nt, Homo sapiens
gccuguugccucg

SEQ ID NO: 668955 - RNA, 20 nt, Homo sapiens
gccuuaaacacacauugcag

SEQ ID NO: 668956 - RNA, 17 nt, Homo sapiens
gccuuaaacacucaccu

SEQ ID NO: 668957 - RNA, 14 nt, Homo sapiens
gccuuaagcaaauu

SEQ ID NO: 668958 - RNA, 14 nt, Homo sapiens
gccuuaagcagaac

SEQ ID NO: 668959 - RNA, 19 nt, Homo sapiens
gccuuaaguaauguuaauu

SEQ ID NO: 668960 - RNA, 21 nt, Homo sapiens
gccuuaaguggcagaauauaa

SEQ ID NO: 668961 - RNA, 18 nt, Homo sapiens
gccuuaaugacauucccc

SEQ ID NO: 668962 - RNA, 15 nt, Homo sapiens
gccuuaaugcuucau

SEQ ID NO: 668963 - RNA, 15 nt, Homo sapiens
gccuuacaucuggcu

SEQ ID NO: 668964 - RNA, 14 nt, Homo sapiens
gccuuagcaguaac

SEQ ID NO: 668965 - RNA, 16 nt, Homo sapiens
gccuuagugggccagg

SEQ ID NO: 668966 - RNA, 23 nt, Homo sapiens
gccuuauuucucauugccucuuc

SEQ ID NO: 668967 - RNA, 21 nt, Homo sapiens
gccuuauuuuuguaugccuuu

SEQ ID NO: 668968 - RNA, 19 nt, Homo sapiens
gccuucaguuuauuuccac

SEQ ID NO: 668969 - RNA, 14 nt, Homo sapiens
gccuucauaagccu

SEQ ID NO: 668970 - RNA, 14 nt, Homo sapiens
gccuucaucuucac

SEQ ID NO: 668971 - RNA, 21 nt, Homo sapiens
gccuucaucuucacugcaauu

SEQ ID NO: 668972 - RNA, 19 nt, Homo sapiens
gccuucauuugcaauucau

SEQ ID NO: 668973 - RNA, 16 nt, Homo sapiens
cccacuccagcgcuga

SEQ ID NO: 668974 - RNA, 13 nt, Homo sapiens
cccacuggccuca

SEQ ID NO: 668975 - RNA, 16 nt, Homo sapiens
cccacuguucuuguau

SEQ ID NO: 668976 - RNA, 16 nt, Homo sapiens
cccacuuaugcugcug

SEQ ID NO: 668977 - RNA, 11 nt, Homo sapiens
cccacuugaag

SEQ ID NO: 668978 - RNA, 19 nt, Homo sapiens
cccacuugucaaguucagc

SEQ ID NO: 668979 - RNA, 22 nt, Homo sapiens
cccagaaaaacuggcucugauu

SEQ ID NO: 668980 - RNA, 23 nt, Homo sapiens
cccagaaacaaaucucaaagugu

SEQ ID NO: 668981 - RNA, 14 nt, Homo sapiens
cccagaagguugug

SEQ ID NO: 668982 - RNA, 13 nt, Homo sapiens
cccagacaaccaa

SEQ ID NO: 668983 - RNA, 17 nt, Homo sapiens
cccagacaaccaaaaca

SEQ ID NO: 668984 - RNA, 19 nt, Homo sapiens
cccagacaaccaaaacaua

SEQ ID NO: 668985 - RNA, 18 nt, Homo sapiens
cccagacacagacuggca

SEQ ID NO: 668986 - RNA, 18 nt, Homo sapiens
cccagacuagauguagua

SEQ ID NO: 668987 - RNA, 19 nt, Homo sapiens
cccagacugaugagcacau

SEQ ID NO: 668988 - RNA, 12 nt, Homo sapiens
cccagagcacuu

SEQ ID NO: 668989 - RNA, 16 nt, Homo sapiens
cccagagcuacaggcc

SEQ ID NO: 668990 - RNA, 18 nt, Homo sapiens
cccagagcugugccagca

SEQ ID NO: 668991 - RNA, 16 nt, Homo sapiens
cccagaggaaguggau

SEQ ID NO: 668992 - RNA, 22 nt, Homo sapiens
cccagaggagccaccaguucuc

SEQ ID NO: 668993 - RNA, 21 nt, Homo sapiens
cccagaggaugucacaaagau

SEQ ID NO: 668994 - RNA, 21 nt, Homo sapiens
cccagagggaguagaauacgc

SEQ ID NO: 668995 - RNA, 21 nt, Homo sapiens
cccagauagcuggcugggugg

SEQ ID NO: 668996 - RNA, 17 nt, Homo sapiens
cccagaucaccaccuga

SEQ ID NO: 668997 - RNA, 18 nt, Homo sapiens
cccagaucaccaccugaa

SEQ ID NO: 668998 - RNA, 19 nt, Homo sapiens
cccagaucaccaccugaac

SEQ ID NO: 668999 - RNA, 23 nt, Homo sapiens
cccagaugcaagacacugugcca

SEQ ID NO: 669000 - RNA, 13 nt, Homo sapiens
cccagaugcucuc

SEQ ID NO: 669001 - RNA, 19 nt, Homo sapiens
cccagauuccccuguguca

SEQ ID NO: 669002 - RNA, 16 nt, Homo sapiens
gcuuuauacaguugaa

SEQ ID NO: 669003 - RNA, 23 nt, Homo sapiens
gcuuuaucuuuggagaaggcaag

SEQ ID NO: 669004 - RNA, 20 nt, Homo sapiens
gcuuucauaaacuucaggga

SEQ ID NO: 669005 - RNA, 16 nt, Homo sapiens
gcuuucauccuguguc

SEQ ID NO: 669006 - RNA, 20 nt, Homo sapiens
gcuuucauguaaacugugca

SEQ ID NO: 669007 - RNA, 21 nt, Homo sapiens
gcuuucauguaaacugugcac

SEQ ID NO: 669008 - RNA, 17 nt, Homo sapiens
gcuuuccagacuuugaa

SEQ ID NO: 669009 - RNA, 19 nt, Homo sapiens
gcuuuccguggcacugcau

SEQ ID NO: 669010 - RNA, 16 nt, Homo sapiens
gcuuucgguacuguaa

SEQ ID NO: 669011 - RNA, 23 nt, Homo sapiens
gcuuucuaugcuguuuguaguga

SEQ ID NO: 669012 - RNA, 20 nt, Homo sapiens
gcuuucucccucacccaagu

SEQ ID NO: 669013 - RNA, 18 nt, Homo sapiens
gcuuucuuaucccaguga

SEQ ID NO: 669014 - RNA, 14 nt, Homo sapiens
gcuuucuuucacaa

SEQ ID NO: 669015 - RNA, 15 nt, Homo sapiens
gcuuugaaaauucag

SEQ ID NO: 669016 - RNA, 18 nt, Homo sapiens
gcuuugaaacuugccugg

SEQ ID NO: 669017 - RNA, 17 nt, Homo sapiens
gcuuugaguuaacucac

SEQ ID NO: 669018 - RNA, 12 nt, Homo sapiens
gcuuugcaguga

SEQ ID NO: 669019 - RNA, 23 nt, Homo sapiens
gcuuugcccaccccucacucccc

SEQ ID NO: 669020 - RNA, 15 nt, Homo sapiens
gcuuugcucuauuaa

SEQ ID NO: 669021 - RNA, 16 nt, Homo sapiens
gcuuugcuuucugcuc

SEQ ID NO: 669022 - RNA, 17 nt, Homo sapiens
gcuuuggaaaggugccc

SEQ ID NO: 669023 - RNA, 18 nt, Homo sapiens
gcuuuggaggauuucacu

SEQ ID NO: 669024 - RNA, 15 nt, Homo sapiens
gcuuugguaaucucu

SEQ ID NO: 669025 - RNA, 14 nt, Homo sapiens
gcuuuggucuaucu

SEQ ID NO: 669026 - RNA, 16 nt, Homo sapiens
gcuuugguuaauacau

SEQ ID NO: 669027 - RNA, 21 nt, Homo sapiens
gcuuugguuccuucucugggu

SEQ ID NO: 669028 - RNA, 13 nt, Homo sapiens
gcuuuguaccaaa

SEQ ID NO: 669029 - RNA, 17 nt, Homo sapiens
gcuuuguccugaaggaa

SEQ ID NO: 669030 - RNA, 21 nt, Homo sapiens
gcuuuguuucuuucauaugaa

SEQ ID NO: 669031 - RNA, 19 nt, Homo sapiens
gcuuuuagaguugcaacuu

SEQ ID NO: 669032 - RNA, 21 nt, Homo sapiens
gcuuuuaugauauauauaugc

SEQ ID NO: 669033 - RNA, 21 nt, Homo sapiens
gcuuuuccuauuuguuuucau

SEQ ID NO: 669034 - RNA, 13 nt, Homo sapiens
gcuuuuccucacc

SEQ ID NO: 669035 - RNA, 13 nt, Homo sapiens
gcuuuucuguauu

SEQ ID NO: 669036 - RNA, 22 nt, Homo sapiens
gcuuuucuuuuuuaauuuccag

SEQ ID NO: 669037 - RNA, 20 nt, Homo sapiens
gcuuuugaaaaacaacugca

SEQ ID NO: 669038 - RNA, 14 nt, Homo sapiens
gcuuuugugcauua

SEQ ID NO: 669039 - RNA, 20 nt, Homo sapiens
gcuuuuucacagucacugau

SEQ ID NO: 669040 - RNA, 23 nt, Homo sapiens
gcuuuuucacagucacugaugua

SEQ ID NO: 669041 - RNA, 14 nt, Homo sapiens
gcuuuuuuacacaa

SEQ ID NO: 669042 - RNA, 13 nt, Homo sapiens
gcuuuuuucacau

SEQ ID NO: 669043 - RNA, 18 nt, Homo sapiens
ggaaaaaaaacacaaaac

SEQ ID NO: 669044 - RNA, 15 nt, Homo sapiens
ggaaaaaaaugaaug

SEQ ID NO: 669045 - RNA, 18 nt, Homo sapiens
ggaaaaacuugugcuaua

SEQ ID NO: 669046 - RNA, 21 nt, Homo sapiens
ggaaaaagaacccugcaaaug

SEQ ID NO: 669047 - RNA, 19 nt, Homo sapiens
ggaaaaagaaugaugcuau

SEQ ID NO: 669048 - RNA, 20 nt, Homo sapiens
ggaaaaagaaugaugcuaug

SEQ ID NO: 669049 - RNA, 19 nt, Homo sapiens
ggaaaacacagccucccug

SEQ ID NO: 669050 - RNA, 15 nt, Homo sapiens
ggaaaacaggacuua

SEQ ID NO: 669051 - RNA, 23 nt, Homo sapiens
ggaaaacaugcugcucuggugca

SEQ ID NO: 669052 - RNA, 21 nt, Homo sapiens
ggaaaacgggcagucugcucu

SEQ ID NO: 669053 - RNA, 22 nt, Homo sapiens
ggaaaacgguggaggccagggc

SEQ ID NO: 669054 - RNA, 20 nt, Homo sapiens
ggaaaagaaucccugcagcc

SEQ ID NO: 669055 - RNA, 16 nt, Homo sapiens
ggaaaagaggaguuuc

SEQ ID NO: 669056 - RNA, 12 nt, Homo sapiens
ggaaaagcaaaa

SEQ ID NO: 669057 - RNA, 15 nt, Homo sapiens
ggaaaagcagcucaa

SEQ ID NO: 669058 - RNA, 24 nt, Homo sapiens
ggaaaauaaacugacacuuauuaa

SEQ ID NO: 669059 - RNA, 18 nt, Homo sapiens
ggaaaaucacaucuccag

SEQ ID NO: 669060 - RNA, 13 nt, Homo sapiens
ggaaaaucucagc

SEQ ID NO: 669061 - RNA, 14 nt, Homo sapiens
ggaaaaugacucug

SEQ ID NO: 669062 - RNA, 16 nt, Homo sapiens
ggaaaauggccaugca

SEQ ID NO: 669063 - RNA, 17 nt, Homo sapiens
ggaaaaugugacccaga

SEQ ID NO: 669064 - RNA, 15 nt, Homo sapiens
ggaaaaugugcaaua

SEQ ID NO: 669065 - RNA, 18 nt, Homo sapiens
ggaaaauucucuuaauca

SEQ ID NO: 669066 - RNA, 14 nt, Homo sapiens
ggaaacaacagcuu

SEQ ID NO: 669067 - RNA, 22 nt, Homo sapiens
ggaaacacagucacuugggagc

SEQ ID NO: 669068 - RNA, 11 nt, Homo sapiens
ggaaacagcau

SEQ ID NO: 669069 - RNA, 11 nt, Homo sapiens
ggaaaccacaa

SEQ ID NO: 669070 - RNA, 15 nt, Homo sapiens
ggaaaccacacuucu

SEQ ID NO: 669071 - RNA, 14 nt, Homo sapiens
ggaaacgcacuuac

SEQ ID NO: 669072 - RNA, 19 nt, Homo sapiens
ggaaacuguacuacaucua

SEQ ID NO: 669073 - RNA, 20 nt, Homo sapiens
ggaaagacauccauaaagaa

SEQ ID NO: 669074 - RNA, 19 nt, Homo sapiens
ggaaagagcacccucgaga

SEQ ID NO: 669075 - RNA, 21 nt, Homo sapiens
ggaaagagcagucagagucca

SEQ ID NO: 669076 - RNA, 14 nt, Homo sapiens
ggaaagaugagcuu

SEQ ID NO: 669077 - RNA, 22 nt, Homo sapiens
ggaaagcagaacugaagccacu

SEQ ID NO: 669078 - RNA, 20 nt, Homo sapiens
ggaaagccauugaccaccca

SEQ ID NO: 669079 - RNA, 16 nt, Homo sapiens
ggaaagggagggaaua

SEQ ID NO: 669080 - RNA, 15 nt, Homo sapiens
ggaaaggggguccca

SEQ ID NO: 669081 - RNA, 22 nt, Homo sapiens
ggaaagggugcugcuucccucu

SEQ ID NO: 669082 - RNA, 21 nt, Homo sapiens
ggaaagucacccaaacacuuc

SEQ ID NO: 669083 - RNA, 23 nt, Homo sapiens
ggaaauaguaccuucaauacuua

SEQ ID NO: 669084 - RNA, 12 nt, Homo sapiens
ggaaaucaaaag

SEQ ID NO: 669085 - RNA, 19 nt, Homo sapiens
ggaaaucaaaagggccaaa

SEQ ID NO: 669086 - RNA, 13 nt, Homo sapiens
ggaaaucucuauu

SEQ ID NO: 669087 - RNA, 19 nt, Homo sapiens
ggaaauggcuugaagccaa

SEQ ID NO: 669088 - RNA, 21 nt, Homo sapiens
ggaaauguauuuugacacugg

SEQ ID NO: 669089 - RNA, 14 nt, Homo sapiens
ggaaauuagucuuu

SEQ ID NO: 669090 - RNA, 18 nt, Homo sapiens
ggaaauuuuucagacuuu

SEQ ID NO: 669091 - RNA, 14 nt, Homo sapiens
ggaacaaaucucuc

SEQ ID NO: 669092 - RNA, 18 nt, Homo sapiens
ggaacaauagaauaaucu

SEQ ID NO: 669093 - RNA, 14 nt, Homo sapiens
ggaacacggccaca

SEQ ID NO: 669094 - RNA, 18 nt, Homo sapiens
ggaacagacaacagaagu

SEQ ID NO: 669095 - RNA, 20 nt, Homo sapiens
ggaacauauagaaugcagag

SEQ ID NO: 669096 - RNA, 15 nt, Homo sapiens
ggaacaugcguguga

SEQ ID NO: 669097 - RNA, 20 nt, Homo sapiens
ggaaccacaccacaucuaag

SEQ ID NO: 669098 - RNA, 13 nt, Homo sapiens
ggaaccccuccug

SEQ ID NO: 669099 - RNA, 23 nt, Homo sapiens
ggaaccuugcuguccugaucugu

SEQ ID NO: 669100 - RNA, 14 nt, Homo sapiens
ggaacucuccuuug

SEQ ID NO: 669101 - RNA, 23 nt, Homo sapiens
ggaacucugcuugauuuuugccu

SEQ ID NO: 669102 - RNA, 13 nt, Homo sapiens
ggaacugcaauaa

SEQ ID NO: 669103 - RNA, 19 nt, Homo sapiens
ggaacugccugggccaugc

SEQ ID NO: 669104 - RNA, 23 nt, Homo sapiens
ggaacugccuuauuaaagcaaaa

SEQ ID NO: 669105 - RNA, 23 nt, Homo sapiens
ggaacugcguuaugaagagcuaa

SEQ ID NO: 669106 - RNA, 23 nt, Homo sapiens
ggaacugggccaacucaccugag

SEQ ID NO: 669107 - RNA, 15 nt, Homo sapiens
ccgaugguacuauuu

SEQ ID NO: 669108 - RNA, 14 nt, Homo sapiens
ccgcaaagacauca

SEQ ID NO: 669109 - RNA, 16 nt, Homo sapiens
ccgcaccuugucaugu

SEQ ID NO: 669110 - RNA, 23 nt, Homo sapiens
ccgcagaagcccugauguguccu

SEQ ID NO: 669111 - RNA, 20 nt, Homo sapiens
ccgcagggagggcuguggug

SEQ ID NO: 669112 - RNA, 16 nt, Homo sapiens
ccgcagggccaugcag

SEQ ID NO: 669113 - RNA, 13 nt, Homo sapiens
ccgcagggcgggg

SEQ ID NO: 669114 - RNA, 17 nt, Homo sapiens
ccgcaggugcugguccc

SEQ ID NO: 669115 - RNA, 22 nt, Homo sapiens
ccgcaucguggccuugaccucc

SEQ ID NO: 669116 - RNA, 17 nt, Homo sapiens
ccgcauuggugacucac

SEQ ID NO: 669117 - RNA, 14 nt, Homo sapiens
ccgccagaccucaa

SEQ ID NO: 669118 - RNA, 12 nt, Homo sapiens
ccgccauccacc

SEQ ID NO: 669119 - RNA, 14 nt, Homo sapiens
ccgcccacagccag

SEQ ID NO: 669120 - RNA, 17 nt, Homo sapiens
ccgcccuccacaccucu

SEQ ID NO: 669121 - RNA, 22 nt, Homo sapiens
ccgccugaaagccacaaugaga

SEQ ID NO: 669122 - RNA, 15 nt, Homo sapiens
ccgccugccugccac

SEQ ID NO: 669123 - RNA, 19 nt, Homo sapiens
ggaagaucagcacccuaag

SEQ ID NO: 669124 - RNA, 17 nt, Homo sapiens
ggaagcagcucaaggga

SEQ ID NO: 669125 - RNA, 14 nt, Homo sapiens
ggaagccaaagagu

SEQ ID NO: 669126 - RNA, 10 nt, Homo sapiens
ggaagccagg

SEQ ID NO: 669127 - RNA, 20 nt, Homo sapiens
ggaagccccugggcccagua

SEQ ID NO: 669128 - RNA, 19 nt, Homo sapiens
ggaagccugugccagcacc

SEQ ID NO: 669129 - RNA, 14 nt, Homo sapiens
ggaagcgagcuuug

SEQ ID NO: 669130 - RNA, 18 nt, Homo sapiens
ggaagcggcccuaaggga

SEQ ID NO: 669131 - RNA, 20 nt, Homo sapiens
ggaagcuaccagagcucuau

SEQ ID NO: 669132 - RNA, 16 nt, Homo sapiens
ggaagcuccacuguca

SEQ ID NO: 669133 - RNA, 19 nt, Homo sapiens
ggaagcucugaagucacau

SEQ ID NO: 669134 - RNA, 17 nt, Homo sapiens
ggaaggacauccauguu

SEQ ID NO: 669135 - RNA, 23 nt, Homo sapiens
ggaaggcuguacgacacgggugg

SEQ ID NO: 669136 - RNA, 13 nt, Homo sapiens
ggaagggaccugg

SEQ ID NO: 669137 - RNA, 22 nt, Homo sapiens
ggaaggugaccgcccagcucuc

SEQ ID NO: 669138 - RNA, 16 nt, Homo sapiens
ggaaggugacugugug

SEQ ID NO: 669139 - RNA, 17 nt, Homo sapiens
ggaaggugccuggccau

SEQ ID NO: 669140 - RNA, 15 nt, Homo sapiens
ggaagguuaucagug

SEQ ID NO: 669141 - RNA, 14 nt, Homo sapiens
ggaagguucucugu

SEQ ID NO: 669142 - RNA, 18 nt, Homo sapiens
ggaaguaaccauuugcac

SEQ ID NO: 669143 - RNA, 17 nt, Homo sapiens
ggaagucagcaugccuc

SEQ ID NO: 669144 - RNA, 23 nt, Homo sapiens
ggaagucaucucauuccacuguu

SEQ ID NO: 669145 - RNA, 17 nt, Homo sapiens
ggaagucuaaauauuca

SEQ ID NO: 669146 - RNA, 18 nt, Homo sapiens
ggaagugaaaacuuugua

SEQ ID NO: 669147 - RNA, 17 nt, Homo sapiens
ggaagugaggaagccag

SEQ ID NO: 669148 - RNA, 15 nt, Homo sapiens
ggaaguucaacuucc

SEQ ID NO: 669149 - RNA, 16 nt, Homo sapiens
ggaaguuuuccuacac

SEQ ID NO: 669150 - RNA, 13 nt, Homo sapiens
ggaauaaaauccu

SEQ ID NO: 669151 - RNA, 22 nt, Homo sapiens
ggaauaaaauccuaagacacaa

SEQ ID NO: 669152 - RNA, 22 nt, Homo sapiens
ggaauaaauugcuccuugacau

SEQ ID NO: 669153 - RNA, 16 nt, Homo sapiens
ggaauaacaacuuuca

SEQ ID NO: 669154 - RNA, 20 nt, Homo sapiens
ggaauaaccuuccauacauu

SEQ ID NO: 669155 - RNA, 16 nt, Homo sapiens
ggaauaacuuuuacac

SEQ ID NO: 669156 - RNA, 21 nt, Homo sapiens
ggaauacugugcauaagccau

SEQ ID NO: 669157 - RNA, 17 nt, Homo sapiens
ggaauauacgugcuugg

SEQ ID NO: 669158 - RNA, 13 nt, Homo sapiens
ggaauauuugaau

SEQ ID NO: 669159 - RNA, 20 nt, Homo sapiens
ggaauauuugcaagacauag

SEQ ID NO: 669160 - RNA, 21 nt, Homo sapiens
ggaaucacuguuuagaacaca

SEQ ID NO: 669161 - RNA, 12 nt, Homo sapiens
ggaaucagagag

SEQ ID NO: 669162 - RNA, 23 nt, Homo sapiens
ggaaucagugaagccaaagggac

SEQ ID NO: 669163 - RNA, 22 nt, Homo sapiens
ggaauccuggcagcccagagac

SEQ ID NO: 669164 - RNA, 16 nt, Homo sapiens
ggaaucgaaguguuua

SEQ ID NO: 669165 - RNA, 15 nt, Homo sapiens
ggaaucuucaccuca

SEQ ID NO: 669166 - RNA, 16 nt, Homo sapiens
ggaaugaaaacauuca

SEQ ID NO: 669167 - RNA, 20 nt, Homo sapiens
ggaaugaccagccuguccaa

SEQ ID NO: 669168 - RNA, 22 nt, Homo sapiens
ggaaugagucaaucagccuuua

SEQ ID NO: 669169 - RNA, 14 nt, Homo sapiens
ggaaugcaccuccc

SEQ ID NO: 669170 - RNA, 21 nt, Homo sapiens
ggaauggaaagcggaguuccu

SEQ ID NO: 669171 - RNA, 17 nt, Homo sapiens
ggaaugugcaacauucu

SEQ ID NO: 669172 - RNA, 21 nt, Homo sapiens
ggaauuacaaaacucagagaa

SEQ ID NO: 669173 - RNA, 17 nt, Homo sapiens
ggaauuauuguaccauu

SEQ ID NO: 669174 - RNA, 13 nt, Homo sapiens
ggaauugcucaga

SEQ ID NO: 669175 - RNA, 18 nt, Homo sapiens
ggaauuucuuaacuucuu

SEQ ID NO: 669176 - RNA, 23 nt, Homo sapiens
ggaauuuuccacuucuggcauca

SEQ ID NO: 669177 - RNA, 15 nt, Homo sapiens
ggaauuuucuuccaa

SEQ ID NO: 669178 - RNA, 14 nt, Homo sapiens
ggacaaaacuggag

SEQ ID NO: 669179 - RNA, 14 nt, Homo sapiens
ggacaaacagcuca

SEQ ID NO: 669180 - RNA, 17 nt, Homo sapiens
ggacaaacugccaguuu

SEQ ID NO: 669181 - RNA, 14 nt, Homo sapiens
ggacaaagccuuug

SEQ ID NO: 669182 - RNA, 13 nt, Homo sapiens
ggacaaccuggac

SEQ ID NO: 669183 - RNA, 23 nt, Homo sapiens
ggacaagacaggcagagaucuau

SEQ ID NO: 669184 - RNA, 14 nt, Homo sapiens
ggacaagaccccca

SEQ ID NO: 669185 - RNA, 17 nt, Homo sapiens
ggacaagauacauauga

SEQ ID NO: 669186 - RNA, 22 nt, Homo sapiens
ggacaagauuuccuacuuucuc

SEQ ID NO: 669187 - RNA, 12 nt, Homo sapiens
ggacaagggauu

SEQ ID NO: 669188 - RNA, 15 nt, Homo sapiens
ggacaauaugugcca

SEQ ID NO: 669189 - RNA, 22 nt, Homo sapiens
ggacaauaugugccaaucaaua

SEQ ID NO: 669190 - RNA, 18 nt, Homo sapiens
ggacaaucuuauguuucc

SEQ ID NO: 669191 - RNA, 14 nt, Homo sapiens
ggacacaacacaga

SEQ ID NO: 669192 - RNA, 23 nt, Homo sapiens
ggacacacacucaccaguggccu

SEQ ID NO: 669193 - RNA, 21 nt, Homo sapiens
ggacacgccgucuguccucac

SEQ ID NO: 669194 - RNA, 19 nt, Homo sapiens
ggacacgguguccaccauc

SEQ ID NO: 669195 - RNA, 17 nt, Homo sapiens
ggacacucgggcccaug

SEQ ID NO: 669196 - RNA, 9 nt, Homo sapiens
ggacacugc

SEQ ID NO: 669197 - RNA, 16 nt, Homo sapiens
ggacacugccaagagc

SEQ ID NO: 669198 - RNA, 19 nt, Homo sapiens
ggacacuguccaugaagca

SEQ ID NO: 669199 - RNA, 18 nt, Homo sapiens
ggacacuugcucaugccc

SEQ ID NO: 669200 - RNA, 17 nt, Homo sapiens
ggacagaauaauacaau

SEQ ID NO: 669201 - RNA, 16 nt, Homo sapiens
ggacagacaccgugga

SEQ ID NO: 669202 - RNA, 17 nt, Homo sapiens
ggacagcagaagccucc

SEQ ID NO: 669203 - RNA, 15 nt, Homo sapiens
ggacaggaugaccug

SEQ ID NO: 669204 - RNA, 20 nt, Homo sapiens
ggacaggcaaagacugcagu

SEQ ID NO: 669205 - RNA, 19 nt, Homo sapiens
ggacaggcuggugcuaaca

SEQ ID NO: 669206 - RNA, 19 nt, Homo sapiens
ggacagucaaggugauaua

SEQ ID NO: 669207 - RNA, 17 nt, Homo sapiens
ggacauaaugggguccu

SEQ ID NO: 669208 - RNA, 22 nt, Homo sapiens
ggacaucagcuggucaaacaaa

SEQ ID NO: 669209 - RNA, 12 nt, Homo sapiens
ggacaucucuag

SEQ ID NO: 669210 - RNA, 16 nt, Homo sapiens
ggacaugagauuuuau

SEQ ID NO: 669211 - RNA, 17 nt, Homo sapiens
ggacaugauacugaugc

SEQ ID NO: 669212 - RNA, 10 nt, Homo sapiens
ggacaugccc

SEQ ID NO: 669213 - RNA, 12 nt, Homo sapiens
ggacauggcuca

SEQ ID NO: 669214 - RNA, 17 nt, Homo sapiens
ggacauucacuauaaug

SEQ ID NO: 669215 - RNA, 18 nt, Homo sapiens
ggacauuuuuucagucau

SEQ ID NO: 669216 - RNA, 23 nt, Homo sapiens
ggaccaaagggggagucccucgu

SEQ ID NO: 669217 - RNA, 21 nt, Homo sapiens
ggaccaacccuguuuccugag

SEQ ID NO: 669218 - RNA, 14 nt, Homo sapiens
ggaccacaguaaca

SEQ ID NO: 669219 - RNA, 16 nt, Homo sapiens
ggaccaccaauggauu

SEQ ID NO: 669220 - RNA, 22 nt, Homo sapiens
ggaccaggacuauagcccaggu

SEQ ID NO: 669221 - RNA, 21 nt, Homo sapiens
ggaccagucccgucgugcagu

SEQ ID NO: 669222 - RNA, 19 nt, Homo sapiens
ggaccaucugcugcaguua

SEQ ID NO: 669223 - RNA, 16 nt, Homo sapiens
ggaccaugaaacauug

SEQ ID NO: 669224 - RNA, 13 nt, Homo sapiens
ggaccauguguca

SEQ ID NO: 669225 - RNA, 20 nt, Homo sapiens
ggaccaugugucacuugugc

SEQ ID NO: 669226 - RNA, 12 nt, Homo sapiens
ggaccauuccag

SEQ ID NO: 669227 - RNA, 12 nt, Homo sapiens
ggaccauuccug

SEQ ID NO: 669228 - RNA, 12 nt, Homo sapiens
ggacccaaaaca

SEQ ID NO: 669229 - RNA, 15 nt, Homo sapiens
ggaccccucagcucc

SEQ ID NO: 669230 - RNA, 14 nt, Homo sapiens
ggacccggauguga

SEQ ID NO: 669231 - RNA, 19 nt, Homo sapiens
ccuaaugagagugcacugc

SEQ ID NO: 669232 - RNA, 20 nt, Homo sapiens
ccuaaugcucaccuuuauca

SEQ ID NO: 669233 - RNA, 12 nt, Homo sapiens
ccuaauggcaaa

SEQ ID NO: 669234 - RNA, 21 nt, Homo sapiens
ccuaauuccacagcugcucaa

SEQ ID NO: 669235 - RNA, 20 nt, Homo sapiens
ccuaauucuuguagaugcau

SEQ ID NO: 669236 - RNA, 11 nt, Homo sapiens
ccuacaacuua

SEQ ID NO: 669237 - RNA, 14 nt, Homo sapiens
ccuacaagauuuag

SEQ ID NO: 669238 - RNA, 21 nt, Homo sapiens
ccuacaaggcuggcagugaca

SEQ ID NO: 669239 - RNA, 15 nt, Homo sapiens
ccuacagacuaagaa

SEQ ID NO: 669240 - RNA, 19 nt, Homo sapiens
ccuacagcacuacugggug

SEQ ID NO: 669241 - RNA, 21 nt, Homo sapiens
ccuacagggacacuaucacuc

SEQ ID NO: 669242 - RNA, 15 nt, Homo sapiens
ccuaccaacuuuacu

SEQ ID NO: 669243 - RNA, 15 nt, Homo sapiens
ccuaccacagugucu

SEQ ID NO: 669244 - RNA, 14 nt, Homo sapiens
ccuaccacuuuucu

SEQ ID NO: 669245 - RNA, 19 nt, Homo sapiens
ccucaggccaggugcagug

SEQ ID NO: 669246 - RNA, 17 nt, Homo sapiens
ccucagggauccucugc

SEQ ID NO: 669247 - RNA, 22 nt, Homo sapiens
ccucagggaucuugcauuccca

SEQ ID NO: 669248 - RNA, 11 nt, Homo sapiens
ccucagggugg

SEQ ID NO: 669249 - RNA, 20 nt, Homo sapiens
ccucaggugaaacuccagau

SEQ ID NO: 669250 - RNA, 19 nt, Homo sapiens
ccucagucaggcacuggcu

SEQ ID NO: 669251 - RNA, 17 nt, Homo sapiens
ccucagucucccagcua

SEQ ID NO: 669252 - RNA, 12 nt, Homo sapiens
ccucagugcauu

SEQ ID NO: 669253 - RNA, 23 nt, Homo sapiens
ccucagugccacuugacauuccu

SEQ ID NO: 669254 - RNA, 15 nt, Homo sapiens
ccucaguuuccucau

SEQ ID NO: 669255 - RNA, 17 nt, Homo sapiens
ccucaguuuuaucauuu

SEQ ID NO: 669256 - RNA, 13 nt, Homo sapiens
ccucaucaucaga

SEQ ID NO: 669257 - RNA, 19 nt, Homo sapiens
ccucauccaugcugugcug

SEQ ID NO: 669258 - RNA, 14 nt, Homo sapiens
ccucauccuuucag

SEQ ID NO: 669259 - RNA, 19 nt, Homo sapiens
ccucaucugcaaaauggga

SEQ ID NO: 669260 - RNA, 20 nt, Homo sapiens
ccucaucuuuuuuugguucu

SEQ ID NO: 669261 - RNA, 12 nt, Homo sapiens
ccucaugccaug

SEQ ID NO: 669262 - RNA, 16 nt, Homo sapiens
ccucauggagaccuca

SEQ ID NO: 669263 - RNA, 13 nt, Homo sapiens
ccucauuagcauu

SEQ ID NO: 669264 - RNA, 20 nt, Homo sapiens
ccucauuccccaaccacuuc

SEQ ID NO: 669265 - RNA, 20 nt, Homo sapiens
ccucauuguuggaguguaaa

SEQ ID NO: 669266 - RNA, 13 nt, Homo sapiens
ccuccaaccagga

SEQ ID NO: 669267 - RNA, 22 nt, Homo sapiens
ccuccaacgccccuguggccaa

SEQ ID NO: 669268 - RNA, 12 nt, Homo sapiens
ccuccacagaga

SEQ ID NO: 669269 - RNA, 18 nt, Homo sapiens
ccuccaccacaucugcca

SEQ ID NO: 669270 - RNA, 20 nt, Homo sapiens
ccuccacuccagcucugaga

SEQ ID NO: 669271 - RNA, 19 nt, Homo sapiens
ccuccacucuaguucuaga

SEQ ID NO: 669272 - RNA, 11 nt, Homo sapiens
ccuccagagac

SEQ ID NO: 669273 - RNA, 18 nt, Homo sapiens
ccuccagagaccccagga

SEQ ID NO: 669274 - RNA, 22 nt, Homo sapiens
ccuccagagaccccaggaacaa

SEQ ID NO: 669275 - RNA, 15 nt, Homo sapiens
ccuccagaggaugac

SEQ ID NO: 669276 - RNA, 23 nt, Homo sapiens
ccuccagcuguacuagugccauu

SEQ ID NO: 669277 - RNA, 22 nt, Homo sapiens
ccuccaggaaccacaccacauc

SEQ ID NO: 669278 - RNA, 22 nt, Homo sapiens
ccuccaggaugaguuacuugaa

SEQ ID NO: 669279 - RNA, 10 nt, Homo sapiens
ccuccagggc

SEQ ID NO: 669280 - RNA, 21 nt, Homo sapiens
ccuccaggggcuccuggguug

SEQ ID NO: 669281 - RNA, 14 nt, Homo sapiens
ccuccagugcaguc

SEQ ID NO: 669282 - RNA, 15 nt, Homo sapiens
ccuccaucaccugaa

SEQ ID NO: 669283 - RNA, 16 nt, Homo sapiens
ccuccaucagagccag

SEQ ID NO: 669284 - RNA, 15 nt, Homo sapiens
ccuccauucugacca

SEQ ID NO: 669285 - RNA, 20 nt, Homo sapiens
ccucccaaaguguugggauu

SEQ ID NO: 669286 - RNA, 17 nt, Homo sapiens
ccucccaacagcgcuuu

SEQ ID NO: 669287 - RNA, 14 nt, Homo sapiens
ccucccaagguccu

SEQ ID NO: 669288 - RNA, 12 nt, Homo sapiens
ccucccacaauu

SEQ ID NO: 669289 - RNA, 12 nt, Homo sapiens
ccucccacuccu

SEQ ID NO: 669290 - RNA, 22 nt, Homo sapiens
ccucccagcagcgguaccccag

SEQ ID NO: 669291 - RNA, 16 nt, Homo sapiens
ccucccagcugcacuu

SEQ ID NO: 669292 - RNA, 19 nt, Homo sapiens
ccucccauuucuguugcug

SEQ ID NO: 669293 - RNA, 11 nt, Homo sapiens
ccuccccaugc

SEQ ID NO: 669294 - RNA, 13 nt, Homo sapiens
ccuccccauugca

SEQ ID NO: 669295 - RNA, 15 nt, Homo sapiens
ccucccccagcuccu

SEQ ID NO: 669296 - RNA, 13 nt, Homo sapiens
ccucccgaaaaau

SEQ ID NO: 669297 - RNA, 21 nt, Homo sapiens
ccucccgaguagcuggcacua

SEQ ID NO: 669298 - RNA, 14 nt, Homo sapiens
ccucccgggcucaa

SEQ ID NO: 669299 - RNA, 22 nt, Homo sapiens
ccucccucucucuucugcucca

SEQ ID NO: 669300 - RNA, 15 nt, Homo sapiens
ccucccucugccagu

SEQ ID NO: 669301 - RNA, 18 nt, Homo sapiens
ccucccugccuccaggaa

SEQ ID NO: 669302 - RNA, 19 nt, Homo sapiens
ccucccugggccaccuccu

SEQ ID NO: 669303 - RNA, 21 nt, Homo sapiens
ccucccuguauaagacacuuu

SEQ ID NO: 669304 - RNA, 13 nt, Homo sapiens
ccucccuucacag

SEQ ID NO: 669305 - RNA, 13 nt, Homo sapiens
ccucccuugccac

SEQ ID NO: 669306 - RNA, 18 nt, Homo sapiens
ccucccuuguggcagcaa

SEQ ID NO: 669307 - RNA, 17 nt, Homo sapiens
ccuccgccucucagguu

SEQ ID NO: 669308 - RNA, 17 nt, Homo sapiens
ccuccgugauccaucca

SEQ ID NO: 669309 - RNA, 20 nt, Homo sapiens
ccuccuagagugcagggauu

SEQ ID NO: 669310 - RNA, 22 nt, Homo sapiens
ccuccuauggguugucaccaag

SEQ ID NO: 669311 - RNA, 13 nt, Homo sapiens
ccuccucaccucu

SEQ ID NO: 669312 - RNA, 19 nt, Homo sapiens
ccuccucagaggacaguuu

SEQ ID NO: 669313 - RNA, 16 nt, Homo sapiens
ccuccucaggcacaca

SEQ ID NO: 669314 - RNA, 17 nt, Homo sapiens
ccuccuccaccacagaa

SEQ ID NO: 669315 - RNA, 14 nt, Homo sapiens
ccuccuccagggaa

SEQ ID NO: 669316 - RNA, 21 nt, Homo sapiens
ccuccucuccuacuuugggac

SEQ ID NO: 669317 - RNA, 20 nt, Homo sapiens
ccuccucugccuacagccag

SEQ ID NO: 669318 - RNA, 18 nt, Homo sapiens
ccuccugaagccacagca

SEQ ID NO: 669319 - RNA, 13 nt, Homo sapiens
ccuccugcuccuc

SEQ ID NO: 669320 - RNA, 17 nt, Homo sapiens
ccuccugguccuggaca

SEQ ID NO: 669321 - RNA, 21 nt, Homo sapiens
ccuccugguugauacuuguuc

SEQ ID NO: 669322 - RNA, 20 nt, Homo sapiens
ccuccugucuaauuugcacc

SEQ ID NO: 669323 - RNA, 22 nt, Homo sapiens
ccuccugugacgugaggcccau

SEQ ID NO: 669324 - RNA, 13 nt, Homo sapiens
ccuccugugggga

SEQ ID NO: 669325 - RNA, 20 nt, Homo sapiens
ccucgaaaaccaucacauga

SEQ ID NO: 669326 - RNA, 20 nt, Homo sapiens
ccucgaauuuuaucugugga

SEQ ID NO: 669327 - RNA, 18 nt, Homo sapiens
ccucgacguuuacaagcc

SEQ ID NO: 669328 - RNA, 22 nt, Homo sapiens
ccucgacugcuuuaguggggaa

SEQ ID NO: 669329 - RNA, 15 nt, Homo sapiens
ccucgcaugacuguu

SEQ ID NO: 669330 - RNA, 15 nt, Homo sapiens
ccucgcccuccacaa

SEQ ID NO: 669331 - RNA, 14 nt, Homo sapiens
ccucggagcugcca

SEQ ID NO: 669332 - RNA, 13 nt, Homo sapiens
ccucgggacauca

SEQ ID NO: 669333 - RNA, 14 nt, Homo sapiens
ccucgggaccccac

SEQ ID NO: 669334 - RNA, 19 nt, Homo sapiens
ccucgggccccauccucau

SEQ ID NO: 669335 - RNA, 17 nt, Homo sapiens
ccucgguacucccauaa

SEQ ID NO: 669336 - RNA, 14 nt, Homo sapiens
ccucggucacucca

SEQ ID NO: 669337 - RNA, 15 nt, Homo sapiens
ccucgugucaucucc

SEQ ID NO: 669338 - RNA, 20 nt, Homo sapiens
ccucguugggccgcucugau

SEQ ID NO: 669339 - RNA, 21 nt, Homo sapiens
ccucguugggccgcucugauu

SEQ ID NO: 669340 - RNA, 19 nt, Homo sapiens
ccucuaacucacugccuag

SEQ ID NO: 669341 - RNA, 15 nt, Homo sapiens
ccucuaagacaaagu

SEQ ID NO: 669342 - RNA, 19 nt, Homo sapiens
ccucuaagacuuuguauau

SEQ ID NO: 669343 - RNA, 13 nt, Homo sapiens
ccucuaagccacu

SEQ ID NO: 669344 - RNA, 12 nt, Homo sapiens
ccucuacagguc

SEQ ID NO: 669345 - RNA, 11 nt, Homo sapiens
ccucuacugcu

SEQ ID NO: 669346 - RNA, 19 nt, Homo sapiens
ccucuacuuugauucugau

SEQ ID NO: 669347 - RNA, 20 nt, Homo sapiens
ccucuaguaagaugcacuga

SEQ ID NO: 669348 - RNA, 21 nt, Homo sapiens
ccucuaguaagaugcacugaa

SEQ ID NO: 669349 - RNA, 22 nt, Homo sapiens
ccucuaguaagaugcacugaaa

SEQ ID NO: 669350 - RNA, 20 nt, Homo sapiens
ccucuaguagcugaaaugca

SEQ ID NO: 669351 - RNA, 16 nt, Homo sapiens
ccucuaguaucacuuu

SEQ ID NO: 669352 - RNA, 17 nt, Homo sapiens
ccucuauauaccaaagc

SEQ ID NO: 669353 - RNA, 16 nt, Homo sapiens
ccucucaacauuacca

SEQ ID NO: 669354 - RNA, 16 nt, Homo sapiens
ccucucaauugucauu

SEQ ID NO: 669355 - RNA, 12 nt, Homo sapiens
ccucucaccaaa

SEQ ID NO: 669356 - RNA, 16 nt, Homo sapiens
ccucucagcauagccu

SEQ ID NO: 669357 - RNA, 16 nt, Homo sapiens
ccucucagguggguua

SEQ ID NO: 669358 - RNA, 19 nt, Homo sapiens
ggaggcggagguugcagua

SEQ ID NO: 669359 - RNA, 15 nt, Homo sapiens
ggaggcugacacaga

SEQ ID NO: 669360 - RNA, 13 nt, Homo sapiens
ggaggcugcagug

SEQ ID NO: 669361 - RNA, 16 nt, Homo sapiens
ggaggcugugugccug

SEQ ID NO: 669362 - RNA, 18 nt, Homo sapiens
ggaggcuuccccucacua

SEQ ID NO: 669363 - RNA, 21 nt, Homo sapiens
ggagggcccuccgaccacuuc

SEQ ID NO: 669364 - RNA, 22 nt, Homo sapiens
ggagggcgugacucacccaagc

SEQ ID NO: 669365 - RNA, 17 nt, Homo sapiens
ggagggcucagggcagu

SEQ ID NO: 669366 - RNA, 19 nt, Homo sapiens
ggagggcugguggccacga

SEQ ID NO: 669367 - RNA, 17 nt, Homo sapiens
ggauuuuaccaaagcau

SEQ ID NO: 669368 - RNA, 14 nt, Homo sapiens
ggauuuuucuuuaa

SEQ ID NO: 669369 - RNA, 18 nt, Homo sapiens
ggcaaaaacuuccaucac

SEQ ID NO: 669370 - RNA, 17 nt, Homo sapiens
ggcaaaaauaaugacau

SEQ ID NO: 669371 - RNA, 23 nt, Homo sapiens
ggcaaaacaaaauguaaugucag

SEQ ID NO: 669372 - RNA, 15 nt, Homo sapiens
ggcaaaacucaguag

SEQ ID NO: 669373 - RNA, 20 nt, Homo sapiens
ggcaaaacuuuggcacuggg

SEQ ID NO: 669374 - RNA, 12 nt, Homo sapiens
ggcaaaauaugg

SEQ ID NO: 669375 - RNA, 20 nt, Homo sapiens
ggcaaaaucgagagaagcug

SEQ ID NO: 669376 - RNA, 22 nt, Homo sapiens
ggcaaaaucuuguuaaugucau

SEQ ID NO: 669377 - RNA, 13 nt, Homo sapiens
ggcaaagguuuau

SEQ ID NO: 669378 - RNA, 15 nt, Homo sapiens
ggcaaaguccagcuc

SEQ ID NO: 669379 - RNA, 13 nt, Homo sapiens
ggcaaaguguuuu

SEQ ID NO: 669380 - RNA, 15 nt, Homo sapiens
ggcaaauggggugca

SEQ ID NO: 669381 - RNA, 23 nt, Homo sapiens
ggcaacacuuuagcuugggucca

SEQ ID NO: 669382 - RNA, 19 nt, Homo sapiens
ggcaacagagcaagacucc

SEQ ID NO: 669383 - RNA, 16 nt, Homo sapiens
ggcaacagauugaaaa

SEQ ID NO: 669384 - RNA, 17 nt, Homo sapiens
ggcaacauaccaagacc

SEQ ID NO: 669385 - RNA, 22 nt, Homo sapiens
ggcaaccuugucucuaugccag

SEQ ID NO: 669386 - RNA, 14 nt, Homo sapiens
ggcaacuguaugaa

SEQ ID NO: 669387 - RNA, 23 nt, Homo sapiens
ggcaagaggaauuacgugcucug

SEQ ID NO: 669388 - RNA, 19 nt, Homo sapiens
ggcaagcucuaucaccaag

SEQ ID NO: 669389 - RNA, 11 nt, Homo sapiens
ggcaagcugca

SEQ ID NO: 669390 - RNA, 21 nt, Homo sapiens
ggcaagcugugacuucuccag

SEQ ID NO: 669391 - RNA, 20 nt, Homo sapiens
ggcaaggagaagagcaaagu

SEQ ID NO: 669392 - RNA, 14 nt, Homo sapiens
ggcaaggaugucug

SEQ ID NO: 669393 - RNA, 15 nt, Homo sapiens
ggcaaggcauuccuc

SEQ ID NO: 669394 - RNA, 14 nt, Homo sapiens
ggcaagggguuucc

SEQ ID NO: 669395 - RNA, 12 nt, Homo sapiens
ggcaagugauau

SEQ ID NO: 669396 - RNA, 13 nt, Homo sapiens
ggcaagugauauc

SEQ ID NO: 669397 - RNA, 21 nt, Homo sapiens
ggcaauaaaagaaauguugcg

SEQ ID NO: 669398 - RNA, 14 nt, Homo sapiens
ggcaauaaacuccu

SEQ ID NO: 669399 - RNA, 23 nt, Homo sapiens
ggcaauaaauauuagaagccugc

SEQ ID NO: 669400 - RNA, 22 nt, Homo sapiens
ggcaauauaaggggaugaggaa

SEQ ID NO: 669401 - RNA, 19 nt, Homo sapiens
ggcaaucaugagcaaguga

SEQ ID NO: 669402 - RNA, 16 nt, Homo sapiens
ggcaauccaaguacau

SEQ ID NO: 669403 - RNA, 16 nt, Homo sapiens
ggcaaucccaccaaau

SEQ ID NO: 669404 - RNA, 19 nt, Homo sapiens
ggcaaucucagaugcaguu

SEQ ID NO: 669405 - RNA, 22 nt, Homo sapiens
ggcaaugcccugugcaugccau

SEQ ID NO: 669406 - RNA, 12 nt, Homo sapiens
ggcaauucagug

SEQ ID NO: 669407 - RNA, 22 nt, Homo sapiens
ggcacaaacugcagcugugagu

SEQ ID NO: 669408 - RNA, 14 nt, Homo sapiens
ggcacaagugucag

SEQ ID NO: 669409 - RNA, 21 nt, Homo sapiens
ggcacaauaugggcacuuuaa

SEQ ID NO: 669410 - RNA, 21 nt, Homo sapiens
ggcacaauuuuaauucaaaag

SEQ ID NO: 669411 - RNA, 20 nt, Homo sapiens
ggcacacaccaccaugcuca

SEQ ID NO: 669412 - RNA, 16 nt, Homo sapiens
ggcacaccagugcaag

SEQ ID NO: 669413 - RNA, 22 nt, Homo sapiens
ggcacagcugucugccaggcac

SEQ ID NO: 669414 - RNA, 17 nt, Homo sapiens
ggcacaggaugcugugu

SEQ ID NO: 669415 - RNA, 17 nt, Homo sapiens
ggcacaguccagaccca

SEQ ID NO: 669416 - RNA, 13 nt, Homo sapiens
ggcaccaacucca

SEQ ID NO: 669417 - RNA, 23 nt, Homo sapiens
ggcaccacucuccuuucacagag

SEQ ID NO: 669418 - RNA, 23 nt, Homo sapiens
ggcacccaccgucucggcccuga

SEQ ID NO: 669419 - RNA, 14 nt, Homo sapiens
ggcaccgggcucca

SEQ ID NO: 669420 - RNA, 13 nt, Homo sapiens
ggcaccuguggug

SEQ ID NO: 669421 - RNA, 16 nt, Homo sapiens
ggcacgccaacagccc

SEQ ID NO: 669422 - RNA, 13 nt, Homo sapiens
ggcacuauuuauu

SEQ ID NO: 669423 - RNA, 18 nt, Homo sapiens
ggcacucagggagcauuu

SEQ ID NO: 669424 - RNA, 20 nt, Homo sapiens
ggcacuccuggagauaugaa

SEQ ID NO: 669425 - RNA, 22 nt, Homo sapiens
ggcacugacugauagcuuacac

SEQ ID NO: 669426 - RNA, 15 nt, Homo sapiens
ggcacuucauugaga

SEQ ID NO: 669427 - RNA, 18 nt, Homo sapiens
ggcacuuuaagucaguga

SEQ ID NO: 669428 - RNA, 21 nt, Homo sapiens
ggcagaaacaaaaugacugua

SEQ ID NO: 669429 - RNA, 15 nt, Homo sapiens
ggcagaaccaaagcu

SEQ ID NO: 669430 - RNA, 20 nt, Homo sapiens
ggcagaacucuccuuggaua

SEQ ID NO: 669431 - RNA, 12 nt, Homo sapiens
ggcagagccaug

SEQ ID NO: 669432 - RNA, 21 nt, Homo sapiens
ggcagagccuuccacagugaa

SEQ ID NO: 669433 - RNA, 16 nt, Homo sapiens
ggcagagcucugggaa

SEQ ID NO: 669434 - RNA, 17 nt, Homo sapiens
ggcagagggagaaucca

SEQ ID NO: 669435 - RNA, 18 nt, Homo sapiens
ggcagauuaaaagcacaa

SEQ ID NO: 669436 - RNA, 14 nt, Homo sapiens
ggcagauugaaaag

SEQ ID NO: 669437 - RNA, 20 nt, Homo sapiens
ggcagauugaacaagagcuu

SEQ ID NO: 669438 - RNA, 17 nt, Homo sapiens
ggcagauuuucaugcaa

SEQ ID NO: 669439 - RNA, 16 nt, Homo sapiens
ggcagcacagcccagg

SEQ ID NO: 669440 - RNA, 21 nt, Homo sapiens
ggcagcagacugaccaucucc

SEQ ID NO: 669441 - RNA, 17 nt, Homo sapiens
ggcagcagagcauucag

SEQ ID NO: 669442 - RNA, 18 nt, Homo sapiens
ggcagcauagcaagacac

SEQ ID NO: 669443 - RNA, 14 nt, Homo sapiens
ggcagcaucuucac

SEQ ID NO: 669444 - RNA, 21 nt, Homo sapiens
ggcagcauggagcuauaacua

SEQ ID NO: 669445 - RNA, 17 nt, Homo sapiens
ggcagccaggacaucuc

SEQ ID NO: 669446 - RNA, 20 nt, Homo sapiens
ggcagccuggacauagagag

SEQ ID NO: 669447 - RNA, 22 nt, Homo sapiens
ggcagccuugggggggcugccu

SEQ ID NO: 669448 - RNA, 13 nt, Homo sapiens
ggcagccuuuacg

SEQ ID NO: 669449 - RNA, 13 nt, Homo sapiens
ggcagcucuccag

SEQ ID NO: 669450 - RNA, 12 nt, Homo sapiens
ggcagcugugau

SEQ ID NO: 669451 - RNA, 13 nt, Homo sapiens
ggcagcuugcccc

SEQ ID NO: 669452 - RNA, 18 nt, Homo sapiens
ggcaggaacaaacagggc

SEQ ID NO: 669453 - RNA, 18 nt, Homo sapiens
ggcaggacacacauggug

SEQ ID NO: 669454 - RNA, 17 nt, Homo sapiens
ggcaggacuccuggcag

SEQ ID NO: 669455 - RNA, 20 nt, Homo sapiens
ggcaggagaaucacuugaac

SEQ ID NO: 669456 - RNA, 20 nt, Homo sapiens
ggcaggagaauugcuugaac

SEQ ID NO: 669457 - RNA, 14 nt, Homo sapiens
ggcaggagagucac

SEQ ID NO: 669458 - RNA, 20 nt, Homo sapiens
ggcaggagagucacuugaac

SEQ ID NO: 669459 - RNA, 22 nt, Homo sapiens
ggcaggcggaucaugaggucag

SEQ ID NO: 669460 - RNA, 22 nt, Homo sapiens
ggcaggcucacugccaggccag

SEQ ID NO: 669461 - RNA, 21 nt, Homo sapiens
ggcagggaauggggacggugu

SEQ ID NO: 669462 - RNA, 15 nt, Homo sapiens
ggcagggagugauga

SEQ ID NO: 669463 - RNA, 16 nt, Homo sapiens
ggcagggaugauggca

SEQ ID NO: 669464 - RNA, 14 nt, Homo sapiens
ggcagggcccagug

SEQ ID NO: 669465 - RNA, 17 nt, Homo sapiens
ggcagggcccagugaca

SEQ ID NO: 669466 - RNA, 21 nt, Homo sapiens
ggcaggggaauuuucucucca

SEQ ID NO: 669467 - RNA, 21 nt, Homo sapiens
ggcaggggcuucuagcugacu

SEQ ID NO: 669468 - RNA, 21 nt, Homo sapiens
ggcaggggugcuuccuccuca

SEQ ID NO: 669469 - RNA, 17 nt, Homo sapiens
ggcagggugagaagcua

SEQ ID NO: 669470 - RNA, 14 nt, Homo sapiens
ggcagggugcagua

SEQ ID NO: 669471 - RNA, 16 nt, Homo sapiens
ggcaggugaaaagggu

SEQ ID NO: 669472 - RNA, 19 nt, Homo sapiens
ggcagguguguauuuacuu

SEQ ID NO: 669473 - RNA, 13 nt, Homo sapiens
ggcaguaccauuc

SEQ ID NO: 669474 - RNA, 16 nt, Homo sapiens
ggcaguagaacuccag

SEQ ID NO: 669475 - RNA, 22 nt, Homo sapiens
ggcagucugaacccuugugcuu

SEQ ID NO: 669476 - RNA, 15 nt, Homo sapiens
ggcagugagugccau

SEQ ID NO: 669477 - RNA, 20 nt, Homo sapiens
ggcaguguggcagugaccau

SEQ ID NO: 669478 - RNA, 15 nt, Homo sapiens
ggcaguucucacucc

SEQ ID NO: 669479 - RNA, 12 nt, Homo sapiens
ggcauacuuucu

SEQ ID NO: 669480 - RNA, 17 nt, Homo sapiens
ggcauagcucuggggug

SEQ ID NO: 669481 - RNA, 22 nt, Homo sapiens
ggcaucaguagcaucuguaaca

SEQ ID NO: 669482 - RNA, 12 nt, Homo sapiens
ggcaucauggaa

SEQ ID NO: 669483 - RNA, 15 nt, Homo sapiens
ccugacuuccucugc

SEQ ID NO: 669484 - RNA, 15 nt, Homo sapiens
ccugacuugagccac

SEQ ID NO: 669485 - RNA, 23 nt, Homo sapiens
ccugacuuggcuggggaggacca

SEQ ID NO: 669486 - RNA, 15 nt, Homo sapiens
ccugacuuuagaugu

SEQ ID NO: 669487 - RNA, 15 nt, Homo sapiens
ccugagagggaaccc

SEQ ID NO: 669488 - RNA, 13 nt, Homo sapiens
ccugagagucagc

SEQ ID NO: 669489 - RNA, 23 nt, Homo sapiens
ccuggcaucaguagcaucuguaa

SEQ ID NO: 669490 - RNA, 22 nt, Homo sapiens
ccuggccagacaagaagacugu

SEQ ID NO: 669491 - RNA, 15 nt, Homo sapiens
ccuggcccaaagcag

SEQ ID NO: 669492 - RNA, 15 nt, Homo sapiens
ccuggccggcaaccc

SEQ ID NO: 669493 - RNA, 20 nt, Homo sapiens
ccuggccgggucacccugug

SEQ ID NO: 669494 - RNA, 23 nt, Homo sapiens
ccuggccuuaaaaggggcccaag

SEQ ID NO: 669495 - RNA, 14 nt, Homo sapiens
ccuggcucaucucu

SEQ ID NO: 669496 - RNA, 14 nt, Homo sapiens
ccuggcuggcacag

SEQ ID NO: 669497 - RNA, 13 nt, Homo sapiens
ccugggaacauca

SEQ ID NO: 669498 - RNA, 14 nt, Homo sapiens
ccugggaccacaga

SEQ ID NO: 669499 - RNA, 17 nt, Homo sapiens
ccugggaccuccccuga

SEQ ID NO: 669500 - RNA, 14 nt, Homo sapiens
ccugggacuuccau

SEQ ID NO: 669501 - RNA, 23 nt, Homo sapiens
ccugggagaaagaccaugcauuu

SEQ ID NO: 669502 - RNA, 17 nt, Homo sapiens
ccugggagaccagggac

SEQ ID NO: 669503 - RNA, 18 nt, Homo sapiens
ccugggagccagggugag

SEQ ID NO: 669504 - RNA, 19 nt, Homo sapiens
ccugggaggcggagaguac

SEQ ID NO: 669505 - RNA, 23 nt, Homo sapiens
ccugggagguagagguugcacug

SEQ ID NO: 669506 - RNA, 15 nt, Homo sapiens
ccugggcagccguuu

SEQ ID NO: 669507 - RNA, 14 nt, Homo sapiens
ccugggcagcuccu

SEQ ID NO: 669508 - RNA, 14 nt, Homo sapiens
ccugggcagggcag

SEQ ID NO: 669509 - RNA, 16 nt, Homo sapiens
ccugggcaggugggag

SEQ ID NO: 669510 - RNA, 16 nt, Homo sapiens
ccugggccguggcaca

SEQ ID NO: 669511 - RNA, 17 nt, Homo sapiens
ccugggcggcacgggcu

SEQ ID NO: 669512 - RNA, 13 nt, Homo sapiens
ccugggcucugga

SEQ ID NO: 669513 - RNA, 16 nt, Homo sapiens
ccugggcugauggaag

SEQ ID NO: 669514 - RNA, 23 nt, Homo sapiens
ccugggcugucugucaccagcua

SEQ ID NO: 669515 - RNA, 16 nt, Homo sapiens
ccuggggcacagucca

SEQ ID NO: 669516 - RNA, 21 nt, Homo sapiens
ccugggggacccaucuuccac

SEQ ID NO: 669517 - RNA, 21 nt, Homo sapiens
ccugggggcagugacuggcag

SEQ ID NO: 669518 - RNA, 15 nt, Homo sapiens
ccuggggguggcagg

SEQ ID NO: 669519 - RNA, 17 nt, Homo sapiens
ccugggguaccaugugg

SEQ ID NO: 669520 - RNA, 21 nt, Homo sapiens
ccugggguguccuacagugac

SEQ ID NO: 669521 - RNA, 19 nt, Homo sapiens
ccuggguauccccugccuc

SEQ ID NO: 669522 - RNA, 22 nt, Homo sapiens
ccugggugacauuugggagaca

SEQ ID NO: 669523 - RNA, 16 nt, Homo sapiens
ccugggugacgguccu

SEQ ID NO: 669524 - RNA, 13 nt, Homo sapiens
ccugggugggugg

SEQ ID NO: 669525 - RNA, 15 nt, Homo sapiens
ccuggguguguguga

SEQ ID NO: 669526 - RNA, 16 nt, Homo sapiens
ccugggugugugugag

SEQ ID NO: 669527 - RNA, 21 nt, Homo sapiens
ccuggguuccgguuguugaua

SEQ ID NO: 669528 - RNA, 20 nt, Homo sapiens
ccuggguucugggacuuuua

SEQ ID NO: 669529 - RNA, 23 nt, Homo sapiens
ccuggguucuggggcaucagcca

SEQ ID NO: 669530 - RNA, 16 nt, Homo sapiens
ccugguacucaagccc

SEQ ID NO: 669531 - RNA, 20 nt, Homo sapiens
ccugguauuuucaaccauaa

SEQ ID NO: 669532 - RNA, 17 nt, Homo sapiens
ccuggucaacaugguga

SEQ ID NO: 669533 - RNA, 14 nt, Homo sapiens
ccugguccaugaug

SEQ ID NO: 669534 - RNA, 19 nt, Homo sapiens
ccuggucccuuggagacaa

SEQ ID NO: 669535 - RNA, 16 nt, Homo sapiens
ccugguccuucccuga

SEQ ID NO: 669536 - RNA, 15 nt, Homo sapiens
ccuggugcugcugcu

SEQ ID NO: 669537 - RNA, 22 nt, Homo sapiens
ccuggugggccuccucugucca

SEQ ID NO: 669538 - RNA, 15 nt, Homo sapiens
ccugguggugugugg

SEQ ID NO: 669539 - RNA, 14 nt, Homo sapiens
ccugguguguuucc

SEQ ID NO: 669540 - RNA, 12 nt, Homo sapiens
ccugguguuucu

SEQ ID NO: 669541 - RNA, 20 nt, Homo sapiens
ccugguugggaucacaccca

SEQ ID NO: 669542 - RNA, 17 nt, Homo sapiens
ccugguuguuguaguaa

SEQ ID NO: 669543 - RNA, 20 nt, Homo sapiens
ccugguuugacucaguucca

SEQ ID NO: 669544 - RNA, 16 nt, Homo sapiens
ccugguuugcaaagac

SEQ ID NO: 669545 - RNA, 15 nt, Homo sapiens
ccuguaaaacuuuau

SEQ ID NO: 669546 - RNA, 20 nt, Homo sapiens
ccuguaauaaagcucuuuaa

SEQ ID NO: 669547 - RNA, 18 nt, Homo sapiens
ccuguaauccuagcacuu

SEQ ID NO: 669548 - RNA, 19 nt, Homo sapiens
ccuguaauccuagcacuuu

SEQ ID NO: 669549 - RNA, 20 nt, Homo sapiens
ccuguaccccagcacuugug

SEQ ID NO: 669550 - RNA, 16 nt, Homo sapiens
ccuguaccugugcacg

SEQ ID NO: 669551 - RNA, 16 nt, Homo sapiens
ccuguacggacacugu

SEQ ID NO: 669552 - RNA, 17 nt, Homo sapiens
ccuguacuaaaccaccu

SEQ ID NO: 669553 - RNA, 17 nt, Homo sapiens
ccuguagcagccagucc

SEQ ID NO: 669554 - RNA, 23 nt, Homo sapiens
ccuguauucucaaacacaguuac

SEQ ID NO: 669555 - RNA, 14 nt, Homo sapiens
ccuguauugcuuua

SEQ ID NO: 669556 - RNA, 15 nt, Homo sapiens
ccugucaacauuugg

SEQ ID NO: 669557 - RNA, 20 nt, Homo sapiens
ccugucaagguuuguguuac

SEQ ID NO: 669558 - RNA, 19 nt, Homo sapiens
ccugucaauacuauggagu

SEQ ID NO: 669559 - RNA, 15 nt, Homo sapiens
ccugucacacacugg

SEQ ID NO: 669560 - RNA, 18 nt, Homo sapiens
ccugucaccaugacuucc

SEQ ID NO: 669561 - RNA, 16 nt, Homo sapiens
ccugucccauucuaga

SEQ ID NO: 669562 - RNA, 20 nt, Homo sapiens
ccuguccccaagacacuucc

SEQ ID NO: 669563 - RNA, 17 nt, Homo sapiens
ccuguccuaagcacuuu

SEQ ID NO: 669564 - RNA, 18 nt, Homo sapiens
ccuguccugccuccucau

SEQ ID NO: 669565 - RNA, 23 nt, Homo sapiens
ccugucgguggcugccuuugauc

SEQ ID NO: 669566 - RNA, 14 nt, Homo sapiens
ccugucuccagcug

SEQ ID NO: 669567 - RNA, 17 nt, Homo sapiens
ccugucuccagcugccu

SEQ ID NO: 669568 - RNA, 20 nt, Homo sapiens
ccugucugaaggacacuucc

SEQ ID NO: 669569 - RNA, 19 nt, Homo sapiens
ccugucuggcucaggguca

SEQ ID NO: 669570 - RNA, 18 nt, Homo sapiens
ccugucuguuacacugga

SEQ ID NO: 669571 - RNA, 21 nt, Homo sapiens
ccugucuuaauuuucuuucac

SEQ ID NO: 669572 - RNA, 20 nt, Homo sapiens
ccugucuuccaaggagacca

SEQ ID NO: 669573 - RNA, 16 nt, Homo sapiens
ccugucuugcugucau

SEQ ID NO: 669574 - RNA, 23 nt, Homo sapiens
ccugugaaauauucuuaggcaga

SEQ ID NO: 669575 - RNA, 20 nt, Homo sapiens
ccugugacccucucacuuac

SEQ ID NO: 669576 - RNA, 11 nt, Homo sapiens
ccugugacugu

SEQ ID NO: 669577 - RNA, 12 nt, Homo sapiens
ccugugacuguc

SEQ ID NO: 669578 - RNA, 13 nt, Homo sapiens
ccugugcaaaaaa

SEQ ID NO: 669579 - RNA, 18 nt, Homo sapiens
ccugugcaacuuucccaa

SEQ ID NO: 669580 - RNA, 11 nt, Homo sapiens
ccugugcagca

SEQ ID NO: 669581 - RNA, 15 nt, Homo sapiens
ccugugccaugccca

SEQ ID NO: 669582 - RNA, 19 nt, Homo sapiens
ccugugccuaacaccagcg

SEQ ID NO: 669583 - RNA, 20 nt, Homo sapiens
ccugugcucauuuugcaauu

SEQ ID NO: 669584 - RNA, 22 nt, Homo sapiens
ccugugcuucuauuucuuggaa

SEQ ID NO: 669585 - RNA, 18 nt, Homo sapiens
ccuguggccaacugcaaa

SEQ ID NO: 669586 - RNA, 15 nt, Homo sapiens
ccuguggccuugccc

SEQ ID NO: 669587 - RNA, 20 nt, Homo sapiens
ccuguggcggccuuccgggu

SEQ ID NO: 669588 - RNA, 14 nt, Homo sapiens
ccugugggaguaga

SEQ ID NO: 669589 - RNA, 21 nt, Homo sapiens
ccuguggggccugauggugcu

SEQ ID NO: 669590 - RNA, 22 nt, Homo sapiens
ccuguggguguucuuuccugcc

SEQ ID NO: 669591 - RNA, 17 nt, Homo sapiens
ccugugugccauuuuaa

SEQ ID NO: 669592 - RNA, 18 nt, Homo sapiens
ccuguguuaucugugguu

SEQ ID NO: 669593 - RNA, 14 nt, Homo sapiens
ccuguguucugggc

SEQ ID NO: 669594 - RNA, 17 nt, Homo sapiens
ccuguuaaauauacacu

SEQ ID NO: 669595 - RNA, 19 nt, Homo sapiens
ccuguucagagcacucauu

SEQ ID NO: 669596 - RNA, 22 nt, Homo sapiens
ccuguucaguacucuacaauuc

SEQ ID NO: 669597 - RNA, 19 nt, Homo sapiens
ccuguucuguguugcaaga

SEQ ID NO: 669598 - RNA, 21 nt, Homo sapiens
ccuguucuguguugcaagaua

SEQ ID NO: 669599 - RNA, 23 nt, Homo sapiens
ccuguucuuccuccagcugcacc

SEQ ID NO: 669600 - RNA, 16 nt, Homo sapiens
ccuguuucccacccag

SEQ ID NO: 669601 - RNA, 19 nt, Homo sapiens
ccuguuuccuccccaucag

SEQ ID NO: 669602 - RNA, 18 nt, Homo sapiens
ccuguuugucugaugugg

SEQ ID NO: 669603 - RNA, 19 nt, Homo sapiens
ccuguuuguugagugcacu

SEQ ID NO: 669604 - RNA, 23 nt, Homo sapiens
ccuguuuucuuaggcacugaggg

SEQ ID NO: 669605 - RNA, 16 nt, Homo sapiens
ccuuaaaaccaaagag

SEQ ID NO: 669606 - RNA, 15 nt, Homo sapiens
ccuuaaaccuaccuc

SEQ ID NO: 669607 - RNA, 17 nt, Homo sapiens
ccuuaacccaaggagca

SEQ ID NO: 669608 - RNA, 20 nt, Homo sapiens
ccuuaaccucucuaagccac

SEQ ID NO: 669609 - RNA, 14 nt, Homo sapiens
ccuuaacugcaucc

SEQ ID NO: 669610 - RNA, 17 nt, Homo sapiens
cgaaccuacaguuuuaa

SEQ ID NO: 669611 - RNA, 22 nt, Homo sapiens
cgaacuauuuucaaagacuuaa

SEQ ID NO: 669612 - RNA, 20 nt, Homo sapiens
cgaacuccugaccucaggug

SEQ ID NO: 669613 - RNA, 18 nt, Homo sapiens
cgaagaaugcuguucuga

SEQ ID NO: 669614 - RNA, 17 nt, Homo sapiens
cgaagggggucaaagga

SEQ ID NO: 669615 - RNA, 19 nt, Homo sapiens
cgaagucgccacguggccu

SEQ ID NO: 669616 - RNA, 17 nt, Homo sapiens
cgaagugcugagauuac

SEQ ID NO: 669617 - RNA, 16 nt, Homo sapiens
cgaaguggcucucagg

SEQ ID NO: 669618 - RNA, 16 nt, Homo sapiens
cgaaucacacagacag

SEQ ID NO: 669619 - RNA, 14 nt, Homo sapiens
cgaauggcagcaua

SEQ ID NO: 669620 - RNA, 12 nt, Homo sapiens
cgaaugucacug

SEQ ID NO: 669621 - RNA, 13 nt, Homo sapiens
cgaaugugucuuu

SEQ ID NO: 669622 - RNA, 13 nt, Homo sapiens
cgacaaagccaaa

SEQ ID NO: 669623 - RNA, 21 nt, Homo sapiens
cgacaaguaguucaugaguau

SEQ ID NO: 669624 - RNA, 20 nt, Homo sapiens
cgacaagugcugaacagugg

SEQ ID NO: 669625 - RNA, 23 nt, Homo sapiens
cgacagaggagcuuuucuggaau

SEQ ID NO: 669626 - RNA, 17 nt, Homo sapiens
cgacagugcauuugccu

SEQ ID NO: 669627 - RNA, 13 nt, Homo sapiens
cgaccaccaaagu

SEQ ID NO: 669628 - RNA, 12 nt, Homo sapiens
cgaccaggaaag

SEQ ID NO: 669629 - RNA, 16 nt, Homo sapiens
cgaccgccccaguucc

SEQ ID NO: 669630 - RNA, 22 nt, Homo sapiens
cgaccuaauugucuuuguucug

SEQ ID NO: 669631 - RNA, 21 nt, Homo sapiens
cgaccuuagcuuauugauccc

SEQ ID NO: 669632 - RNA, 17 nt, Homo sapiens
cgacuaauuucaaaaug

SEQ ID NO: 669633 - RNA, 22 nt, Homo sapiens
cgacuaauuucaaaaugcuuuu

SEQ ID NO: 669634 - RNA, 13 nt, Homo sapiens
cgacuccaucucu

SEQ ID NO: 669635 - RNA, 19 nt, Homo sapiens
cgacucccccaaccaagga

SEQ ID NO: 669636 - RNA, 14 nt, Homo sapiens
cgacugaaacugga

SEQ ID NO: 669637 - RNA, 13 nt, Homo sapiens
cgacugggcucaa

SEQ ID NO: 669638 - RNA, 20 nt, Homo sapiens
cgacuucaugacaagcauuu

SEQ ID NO: 669639 - RNA, 18 nt, Homo sapiens
cgacuuucugccuggagu

SEQ ID NO: 669640 - RNA, 22 nt, Homo sapiens
cgagaaggccgaggaauccuca

SEQ ID NO: 669641 - RNA, 13 nt, Homo sapiens
cgagaaggugcuu

SEQ ID NO: 669642 - RNA, 16 nt, Homo sapiens
cgagaaggugcuuccg

SEQ ID NO: 669643 - RNA, 14 nt, Homo sapiens
cgagacaccacaag

SEQ ID NO: 669644 - RNA, 17 nt, Homo sapiens
cgagaccaaccuagcca

SEQ ID NO: 669645 - RNA, 22 nt, Homo sapiens
cgagagaggcgcgucugcccca

SEQ ID NO: 669646 - RNA, 17 nt, Homo sapiens
cgagaggugggccaguc

SEQ ID NO: 669647 - RNA, 20 nt, Homo sapiens
cgagaucacgccacugcacu

SEQ ID NO: 669648 - RNA, 21 nt, Homo sapiens
cgagaucacgccacugcacuc

SEQ ID NO: 669649 - RNA, 18 nt, Homo sapiens
cgagaugugaguccuguu

SEQ ID NO: 669650 - RNA, 22 nt, Homo sapiens
cgagauguucgcucgugcagua

SEQ ID NO: 669651 - RNA, 14 nt, Homo sapiens
cgagauugcacugc

SEQ ID NO: 669652 - RNA, 18 nt, Homo sapiens
cgagcacauagagcuuuu

SEQ ID NO: 669653 - RNA, 19 nt, Homo sapiens
cgagcaccuccagccugaa

SEQ ID NO: 669654 - RNA, 17 nt, Homo sapiens
cgagcagaugaugccaa

SEQ ID NO: 669655 - RNA, 16 nt, Homo sapiens
cgagccaggcugacca

SEQ ID NO: 669656 - RNA, 14 nt, Homo sapiens
cgagccugcacugg

SEQ ID NO: 669657 - RNA, 22 nt, Homo sapiens
cgagcuaugaucgcgccacuac

SEQ ID NO: 669658 - RNA, 23 nt, Homo sapiens
cgaggaaaagaacaaacaaaacu

SEQ ID NO: 669659 - RNA, 23 nt, Homo sapiens
cgaggaaaggauuuuaccaaagc

SEQ ID NO: 669660 - RNA, 15 nt, Homo sapiens
cgaggcgaugccacg

SEQ ID NO: 669661 - RNA, 13 nt, Homo sapiens
cgagggagcugcu

SEQ ID NO: 669662 - RNA, 23 nt, Homo sapiens
cgagggcugauggaggaaaaagg

SEQ ID NO: 669663 - RNA, 14 nt, Homo sapiens
cgaggucagaggag

SEQ ID NO: 669664 - RNA, 22 nt, Homo sapiens
cgagucaauccccucauucagg

SEQ ID NO: 669665 - RNA, 14 nt, Homo sapiens
cgagucucuucucc

SEQ ID NO: 669666 - RNA, 14 nt, Homo sapiens
cgaguuaagaacau

SEQ ID NO: 669667 - RNA, 14 nt, Homo sapiens
cgaguuccagaccc

SEQ ID NO: 669668 - RNA, 17 nt, Homo sapiens
cgaguuguggaaagccu

SEQ ID NO: 669669 - RNA, 15 nt, Homo sapiens
cgauacaaaguguug

SEQ ID NO: 669670 - RNA, 15 nt, Homo sapiens
cgauaccgggacaca

SEQ ID NO: 669671 - RNA, 14 nt, Homo sapiens
cgauaucagaauuu

SEQ ID NO: 669672 - RNA, 13 nt, Homo sapiens
cgaucaaaaccug

SEQ ID NO: 669673 - RNA, 12 nt, Homo sapiens
cgaucaguggug

SEQ ID NO: 669674 - RNA, 23 nt, Homo sapiens
cgauccuccugucuaauuugcac

SEQ ID NO: 669675 - RNA, 23 nt, Homo sapiens
cgaucgauggaugggaugcacuc

SEQ ID NO: 669676 - RNA, 19 nt, Homo sapiens
cgaucucagcucaccucaa

SEQ ID NO: 669677 - RNA, 19 nt, Homo sapiens
cgauuaugcuuucuuuggc

SEQ ID NO: 669678 - RNA, 20 nt, Homo sapiens
cgauucaucuacccugcuga

SEQ ID NO: 669679 - RNA, 20 nt, Homo sapiens
cgauuccuuuauauuugcuc

SEQ ID NO: 669680 - RNA, 16 nt, Homo sapiens
cgauugaaagaaccag

SEQ ID NO: 669681 - RNA, 22 nt, Homo sapiens
cgauuucacaguguguuuguga

SEQ ID NO: 669682 - RNA, 15 nt, Homo sapiens
cgauuugggggcucg

SEQ ID NO: 669683 - RNA, 17 nt, Homo sapiens
cgauuuuguaucugcag

SEQ ID NO: 669684 - RNA, 13 nt, Homo sapiens
cgcaaaaccugca

SEQ ID NO: 669685 - RNA, 16 nt, Homo sapiens
cgcaaaccacacugga

SEQ ID NO: 669686 - RNA, 20 nt, Homo sapiens
cgcacaacaggaaacuggga

SEQ ID NO: 669687 - RNA, 20 nt, Homo sapiens
cgcacaaggcugaccaagag

SEQ ID NO: 669688 - RNA, 20 nt, Homo sapiens
cgcacaggcuggagugcagu

SEQ ID NO: 669689 - RNA, 14 nt, Homo sapiens
cgcacagugcaguu

SEQ ID NO: 669690 - RNA, 15 nt, Homo sapiens
cgcaccaagaucucc

SEQ ID NO: 669691 - RNA, 14 nt, Homo sapiens
cgcaccacugcacu

SEQ ID NO: 669692 - RNA, 14 nt, Homo sapiens
cgcaccauucuccu

SEQ ID NO: 669693 - RNA, 20 nt, Homo sapiens
cgcaccggagugucuggaau

SEQ ID NO: 669694 - RNA, 18 nt, Homo sapiens
cgcaccuaccaucaggga

SEQ ID NO: 669695 - RNA, 16 nt, Homo sapiens
cgcacgcucgcugcca

SEQ ID NO: 669696 - RNA, 12 nt, Homo sapiens
cgcagauguuac

SEQ ID NO: 669697 - RNA, 14 nt, Homo sapiens
cgcagccuccaguu

SEQ ID NO: 669698 - RNA, 17 nt, Homo sapiens
cgcaggagccauugcuc

SEQ ID NO: 669699 - RNA, 15 nt, Homo sapiens
cgcagggccaugcag

SEQ ID NO: 669700 - RNA, 17 nt, Homo sapiens
cgcaguguuuugcaagu

SEQ ID NO: 669701 - RNA, 15 nt, Homo sapiens
cgcaguuuggaguca

SEQ ID NO: 669702 - RNA, 16 nt, Homo sapiens
cgcaucaggccuggca

SEQ ID NO: 669703 - RNA, 23 nt, Homo sapiens
cgcaucguggccuugaccuccaa

SEQ ID NO: 669704 - RNA, 20 nt, Homo sapiens
cgcaugcccucaaucccagc

SEQ ID NO: 669705 - RNA, 23 nt, Homo sapiens
cgcaugucucccuccaguccucu

SEQ ID NO: 669706 - RNA, 19 nt, Homo sapiens
cgcaugugcagcuauuuaa

SEQ ID NO: 669707 - RNA, 22 nt, Homo sapiens
cgccacauagguaaaaacugga

SEQ ID NO: 669708 - RNA, 13 nt, Homo sapiens
cgccagaucugca

SEQ ID NO: 669709 - RNA, 15 nt, Homo sapiens
cgccagcucaguuuc

SEQ ID NO: 669710 - RNA, 14 nt, Homo sapiens
cgccaggacugugu

SEQ ID NO: 669711 - RNA, 18 nt, Homo sapiens
cgccaguugccucuugaa

SEQ ID NO: 669712 - RNA, 15 nt, Homo sapiens
cgcccaaggcccacg

SEQ ID NO: 669713 - RNA, 16 nt, Homo sapiens
cgcccaggcuggagug

SEQ ID NO: 669714 - RNA, 14 nt, Homo sapiens
cgccccaagguucc

SEQ ID NO: 669715 - RNA, 19 nt, Homo sapiens
cgccccccgccucucccca

SEQ ID NO: 669716 - RNA, 14 nt, Homo sapiens
cgcccccucccuau

SEQ ID NO: 669717 - RNA, 19 nt, Homo sapiens
cgcccucacugcaggcucc

SEQ ID NO: 669718 - RNA, 13 nt, Homo sapiens
cgcccuccacaaa

SEQ ID NO: 669719 - RNA, 17 nt, Homo sapiens
cgcccuccucccuguca

SEQ ID NO: 669720 - RNA, 20 nt, Homo sapiens
cgcccuuggcuucugugaug

SEQ ID NO: 669721 - RNA, 21 nt, Homo sapiens
cgcccuuggcuucugugauga

SEQ ID NO: 669722 - RNA, 15 nt, Homo sapiens
cgccgcugacugcca

SEQ ID NO: 669723 - RNA, 20 nt, Homo sapiens
cgccgucccaccagcuucac

SEQ ID NO: 669724 - RNA, 13 nt, Homo sapiens
cgccuaacugaau

SEQ ID NO: 669725 - RNA, 13 nt, Homo sapiens
cgccucucagguu

SEQ ID NO: 669726 - RNA, 16 nt, Homo sapiens
cgccugacaaccacug

SEQ ID NO: 669727 - RNA, 13 nt, Homo sapiens
cgccuuaaacucu

SEQ ID NO: 669728 - RNA, 14 nt, Homo sapiens
cgccuuacuggcaa

SEQ ID NO: 669729 - RNA, 15 nt, Homo sapiens
cgccuuccaaaaccu

SEQ ID NO: 669730 - RNA, 13 nt, Homo sapiens
cgccuucccucac

SEQ ID NO: 669731 - RNA, 12 nt, Homo sapiens
cgccuuccucuc

SEQ ID NO: 669732 - RNA, 13 nt, Homo sapiens
cgcgagacugaga

SEQ ID NO: 669733 - RNA, 20 nt, Homo sapiens
cuccaccgucuuucuuuuau

SEQ ID NO: 669734 - RNA, 23 nt, Homo sapiens
cuccaccuacaccccugugcucc

SEQ ID NO: 669735 - RNA, 16 nt, Homo sapiens
cuccaccuagacugua

SEQ ID NO: 669736 - RNA, 14 nt, Homo sapiens
cuccaccucuggug

SEQ ID NO: 669737 - RNA, 16 nt, Homo sapiens
cuccaccuuccaaagg

SEQ ID NO: 669738 - RNA, 18 nt, Homo sapiens
cuccaccuugcucuucuu

SEQ ID NO: 669739 - RNA, 21 nt, Homo sapiens
cuccaccuuguuacacauuau

SEQ ID NO: 669740 - RNA, 21 nt, Homo sapiens
cuccacgaagccuuaagccau

SEQ ID NO: 669741 - RNA, 19 nt, Homo sapiens
cuccacgguagcacuugac

SEQ ID NO: 669742 - RNA, 16 nt, Homo sapiens
cuccacuccaccucca

SEQ ID NO: 669743 - RNA, 13 nt, Homo sapiens
cuccacuccagau

SEQ ID NO: 669744 - RNA, 19 nt, Homo sapiens
cuccacuggccuccuggca

SEQ ID NO: 669745 - RNA, 22 nt, Homo sapiens
cuccacuggucugucuuuggau

SEQ ID NO: 669746 - RNA, 12 nt, Homo sapiens
cuccacugucac

SEQ ID NO: 669747 - RNA, 13 nt, Homo sapiens
cuccacugucaca

SEQ ID NO: 669748 - RNA, 16 nt, Homo sapiens
cuccagaaaaaugaaa

SEQ ID NO: 669749 - RNA, 19 nt, Homo sapiens
cuccagacauacaaacaua

SEQ ID NO: 669750 - RNA, 12 nt, Homo sapiens
cuccagaccacc

SEQ ID NO: 669751 - RNA, 16 nt, Homo sapiens
cuccagagaccccagg

SEQ ID NO: 669752 - RNA, 20 nt, Homo sapiens
cuccagagugugcagacuga

SEQ ID NO: 669753 - RNA, 17 nt, Homo sapiens
cuccagaguuguucucu

SEQ ID NO: 669754 - RNA, 13 nt, Homo sapiens
ggcugugccaacc

SEQ ID NO: 669755 - RNA, 18 nt, Homo sapiens
ggcugugggcaagccuaa

SEQ ID NO: 669756 - RNA, 17 nt, Homo sapiens
ggcuguguuaugaaaau

SEQ ID NO: 669757 - RNA, 11 nt, Homo sapiens
ggcuguguucg

SEQ ID NO: 669758 - RNA, 16 nt, Homo sapiens
ggcuguguuuccaucu

SEQ ID NO: 669759 - RNA, 15 nt, Homo sapiens
ggcuguugcucagga

SEQ ID NO: 669760 - RNA, 16 nt, Homo sapiens
ggcuuccagaaggcag

SEQ ID NO: 669761 - RNA, 19 nt, Homo sapiens
ggcuuccagagaguccucu

SEQ ID NO: 669762 - RNA, 19 nt, Homo sapiens
ggcuuccagguaucuccag

SEQ ID NO: 669763 - RNA, 20 nt, Homo sapiens
ggcuucccucuuucaucucc

SEQ ID NO: 669764 - RNA, 19 nt, Homo sapiens
ggcuuccucuagaagccaa

SEQ ID NO: 669765 - RNA, 15 nt, Homo sapiens
ggcuucuauuaccua

SEQ ID NO: 669766 - RNA, 15 nt, Homo sapiens
ggcuucucagccccu

SEQ ID NO: 669767 - RNA, 13 nt, Homo sapiens
ggcuugaagccaa

SEQ ID NO: 669768 - RNA, 14 nt, Homo sapiens
ggcuugaagccaaa

SEQ ID NO: 669769 - RNA, 14 nt, Homo sapiens
ggcuugcagugcgc

SEQ ID NO: 669770 - RNA, 12 nt, Homo sapiens
ggcuugggacau

SEQ ID NO: 669771 - RNA, 21 nt, Homo sapiens
ggcuuguaccacuuuugcaaa

SEQ ID NO: 669772 - RNA, 20 nt, Homo sapiens
ggcuuuaugcuaguuugacc

SEQ ID NO: 669773 - RNA, 18 nt, Homo sapiens
ggcuuucacaaaaggcau

SEQ ID NO: 669774 - RNA, 15 nt, Homo sapiens
ggcuuugggcccaag

SEQ ID NO: 669775 - RNA, 19 nt, Homo sapiens
ggcuuuuccaagcugccac

SEQ ID NO: 669776 - RNA, 20 nt, Homo sapiens
gggaaaaagaaugaugcuau

SEQ ID NO: 669777 - RNA, 13 nt, Homo sapiens
gggaaaaccagac

SEQ ID NO: 669778 - RNA, 14 nt, Homo sapiens
gggaaaagggucca

SEQ ID NO: 669779 - RNA, 21 nt, Homo sapiens
gggaaaccccccagagcucuu

SEQ ID NO: 669780 - RNA, 14 nt, Homo sapiens
gggaaacgggguga

SEQ ID NO: 669781 - RNA, 18 nt, Homo sapiens
gggaaaggaaucagagag

SEQ ID NO: 669782 - RNA, 15 nt, Homo sapiens
gggaaaggccagugu

SEQ ID NO: 669783 - RNA, 15 nt, Homo sapiens
gggaaauccauucca

SEQ ID NO: 669784 - RNA, 16 nt, Homo sapiens
gggaacacgugugcac

SEQ ID NO: 669785 - RNA, 12 nt, Homo sapiens
gggaacaugccc

SEQ ID NO: 669786 - RNA, 14 nt, Homo sapiens
gggaaccacuccca

SEQ ID NO: 669787 - RNA, 19 nt, Homo sapiens
gggaacugacgcuggagau

SEQ ID NO: 669788 - RNA, 16 nt, Homo sapiens
gggaacuggagucugu

SEQ ID NO: 669789 - RNA, 14 nt, Homo sapiens
gggaagaaacacuc

SEQ ID NO: 669790 - RNA, 21 nt, Homo sapiens
gggaagaccagcuuugcagug

SEQ ID NO: 669791 - RNA, 14 nt, Homo sapiens
gggaagagggcagu

SEQ ID NO: 669792 - RNA, 15 nt, Homo sapiens
gggaagaggggugca

SEQ ID NO: 669793 - RNA, 15 nt, Homo sapiens
gggaagagucuucca

SEQ ID NO: 669794 - RNA, 22 nt, Homo sapiens
gggaagccugugccagcaccuu

SEQ ID NO: 669795 - RNA, 22 nt, Homo sapiens
gggaagcgaugaauuuggagac

SEQ ID NO: 669796 - RNA, 22 nt, Homo sapiens
gggaaggggugcccccaggcuc

SEQ ID NO: 669797 - RNA, 21 nt, Homo sapiens
gggaaggguccaucucagaga

SEQ ID NO: 669798 - RNA, 18 nt, Homo sapiens
gggaaguaacauuugccu

SEQ ID NO: 669799 - RNA, 13 nt, Homo sapiens
gggaaguucaggc

SEQ ID NO: 669800 - RNA, 15 nt, Homo sapiens
gggaauacuggccau

SEQ ID NO: 669801 - RNA, 18 nt, Homo sapiens
gggaauagaggaaugugu

SEQ ID NO: 669802 - RNA, 22 nt, Homo sapiens
gggaauauugccaaugcuacag

SEQ ID NO: 669803 - RNA, 21 nt, Homo sapiens
gggaaucauuuuucacuguac

SEQ ID NO: 669804 - RNA, 22 nt, Homo sapiens
gggaauccaagccuccacagcg

SEQ ID NO: 669805 - RNA, 16 nt, Homo sapiens
gggaaugagcccagag

SEQ ID NO: 669806 - RNA, 22 nt, Homo sapiens
gggaauucauuuucaucacugg

SEQ ID NO: 669807 - RNA, 14 nt, Homo sapiens
gggacaagggauuu

SEQ ID NO: 669808 - RNA, 17 nt, Homo sapiens
gggacaauaaauuuugc

SEQ ID NO: 669809 - RNA, 23 nt, Homo sapiens
gggacacuucccugggccucaac

SEQ ID NO: 669810 - RNA, 15 nt, Homo sapiens
gggacagagccaugc

SEQ ID NO: 669811 - RNA, 16 nt, Homo sapiens
gggacagcaagugagc

SEQ ID NO: 669812 - RNA, 14 nt, Homo sapiens
gggacagcccacug

SEQ ID NO: 669813 - RNA, 21 nt, Homo sapiens
gggacaucaaaaacagcagaa

SEQ ID NO: 669814 - RNA, 16 nt, Homo sapiens
gggacaucucuuugaa

SEQ ID NO: 669815 - RNA, 20 nt, Homo sapiens
gggacauugggaaggggacc

SEQ ID NO: 669816 - RNA, 22 nt, Homo sapiens
gggaccccaggugggccuggca

SEQ ID NO: 669817 - RNA, 19 nt, Homo sapiens
gggacccccguggugggga

SEQ ID NO: 669818 - RNA, 19 nt, Homo sapiens
gggaccgaaagcaaagguu

SEQ ID NO: 669819 - RNA, 15 nt, Homo sapiens
gggaccgacuuucca

SEQ ID NO: 669820 - RNA, 20 nt, Homo sapiens
gggaccucccaggacaagca

SEQ ID NO: 669821 - RNA, 18 nt, Homo sapiens
gggacgcacagugcaguu

SEQ ID NO: 669822 - RNA, 15 nt, Homo sapiens
gggacuaggaccuga

SEQ ID NO: 669823 - RNA, 11 nt, Homo sapiens
gggacucuccu

SEQ ID NO: 669824 - RNA, 22 nt, Homo sapiens
gggacucugaccacagcccgcu

SEQ ID NO: 669825 - RNA, 13 nt, Homo sapiens
gggacucugagaa

SEQ ID NO: 669826 - RNA, 11 nt, Homo sapiens
gggacugcugg

SEQ ID NO: 669827 - RNA, 23 nt, Homo sapiens
gggacuuauguauuuaugaccuu

SEQ ID NO: 669828 - RNA, 14 nt, Homo sapiens
gggacuuccuugcu

SEQ ID NO: 669829 - RNA, 17 nt, Homo sapiens
gggacuuccuugcucuc

SEQ ID NO: 669830 - RNA, 15 nt, Homo sapiens
gggacuugggucuca

SEQ ID NO: 669831 - RNA, 13 nt, Homo sapiens
gggagaaaugacu

SEQ ID NO: 669832 - RNA, 14 nt, Homo sapiens
gggagaaaugccag

SEQ ID NO: 669833 - RNA, 19 nt, Homo sapiens
gggagaagaagucagagag

SEQ ID NO: 669834 - RNA, 22 nt, Homo sapiens
gggagaugcuucucuccuugcc

SEQ ID NO: 669835 - RNA, 21 nt, Homo sapiens
gggagauucaagggacccaug

SEQ ID NO: 669836 - RNA, 16 nt, Homo sapiens
gggagcaugcuuaccu

SEQ ID NO: 669837 - RNA, 14 nt, Homo sapiens
gggagcauguucau

SEQ ID NO: 669838 - RNA, 22 nt, Homo sapiens
gggagccagccuucuaacagcu

SEQ ID NO: 669839 - RNA, 20 nt, Homo sapiens
gggagccuaaggaagcgugg

SEQ ID NO: 669840 - RNA, 18 nt, Homo sapiens
gggagcgacacuugaaug

SEQ ID NO: 669841 - RNA, 23 nt, Homo sapiens
gggaggaaaaggccccugcaaug

SEQ ID NO: 669842 - RNA, 21 nt, Homo sapiens
gggaggaggccaccucuccaa

SEQ ID NO: 669843 - RNA, 23 nt, Homo sapiens
gggaggauugcuugaacccaaga

SEQ ID NO: 669844 - RNA, 23 nt, Homo sapiens
gggaggcaagugugggggguccu

SEQ ID NO: 669845 - RNA, 22 nt, Homo sapiens
gggaggcagagguugcagugaa

SEQ ID NO: 669846 - RNA, 13 nt, Homo sapiens
gggaggccacguc

SEQ ID NO: 669847 - RNA, 21 nt, Homo sapiens
gggaggcccugagacagggau

SEQ ID NO: 669848 - RNA, 17 nt, Homo sapiens
gggaggcugcacuggag

SEQ ID NO: 669849 - RNA, 17 nt, Homo sapiens
gggagggggaagcaaag

SEQ ID NO: 669850 - RNA, 23 nt, Homo sapiens
gggaggguggugggcccagacca

SEQ ID NO: 669851 - RNA, 20 nt, Homo sapiens
gggagguggagauugcagug

SEQ ID NO: 669852 - RNA, 20 nt, Homo sapiens
gggaggugggauuuagccag

SEQ ID NO: 669853 - RNA, 16 nt, Homo sapiens
gggaguccaggcacag

SEQ ID NO: 669854 - RNA, 19 nt, Homo sapiens
gggaguccuugcgucccau

SEQ ID NO: 669855 - RNA, 16 nt, Homo sapiens
gggagugggcgcagug

SEQ ID NO: 669856 - RNA, 13 nt, Homo sapiens
gggauagaaagga

SEQ ID NO: 669857 - RNA, 17 nt, Homo sapiens
gggauagaggaaaggga

SEQ ID NO: 669858 - RNA, 16 nt, Homo sapiens
gggauauggguccucu

SEQ ID NO: 669859 - RNA, 23 nt, Homo sapiens
gggaucagccuccgccauuccaa

SEQ ID NO: 669860 - RNA, 18 nt, Homo sapiens
gggauccagcucaucccc

SEQ ID NO: 669861 - RNA, 13 nt, Homo sapiens
gggaucuucccac

SEQ ID NO: 669862 - RNA, 23 nt, Homo sapiens
gggaucuuccuugggaugaucuu

SEQ ID NO: 669863 - RNA, 14 nt, Homo sapiens
gggaucuugaggga

SEQ ID NO: 669864 - RNA, 22 nt, Homo sapiens
gggaugcugccugagucaccca

SEQ ID NO: 669865 - RNA, 22 nt, Homo sapiens
gggauggaagcaggacagacac

SEQ ID NO: 669866 - RNA, 17 nt, Homo sapiens
gggaugggaacacuggu

SEQ ID NO: 669867 - RNA, 21 nt, Homo sapiens
gggaugggccccgccuuccug

SEQ ID NO: 669868 - RNA, 14 nt, Homo sapiens
gggauguugaacug

SEQ ID NO: 669869 - RNA, 13 nt, Homo sapiens
gggauuacaggca

SEQ ID NO: 669870 - RNA, 18 nt, Homo sapiens
gggauugaagcccuccaa

SEQ ID NO: 669871 - RNA, 17 nt, Homo sapiens
gggauuggggaagacug

SEQ ID NO: 669872 - RNA, 17 nt, Homo sapiens
gggauugucuuacuguu

SEQ ID NO: 669873 - RNA, 13 nt, Homo sapiens
gggcaaagaagaa

SEQ ID NO: 669874 - RNA, 14 nt, Homo sapiens
gggcaacaacagca

SEQ ID NO: 669875 - RNA, 22 nt, Homo sapiens
gggcaacacggugaaaccccau

SEQ ID NO: 669876 - RNA, 14 nt, Homo sapiens
gggcaacuguagaa

SEQ ID NO: 669877 - RNA, 16 nt, Homo sapiens
cuccagaguuguugaa

SEQ ID NO: 669878 - RNA, 20 nt, Homo sapiens
cuccagauguuuccagacuu

SEQ ID NO: 669879 - RNA, 19 nt, Homo sapiens
cuccagauuagagccugua

SEQ ID NO: 669880 - RNA, 15 nt, Homo sapiens
cuccagcaacugccc

SEQ ID NO: 669881 - RNA, 13 nt, Homo sapiens
cuccagcaccaua

SEQ ID NO: 669882 - RNA, 22 nt, Homo sapiens
cuccagccagcaaugaugucca

SEQ ID NO: 669883 - RNA, 17 nt, Homo sapiens
cuccagccccugacccc

SEQ ID NO: 669884 - RNA, 15 nt, Homo sapiens
cuccagcugauccag

SEQ ID NO: 669885 - RNA, 20 nt, Homo sapiens
cuccagcuugggcaacagag

SEQ ID NO: 669886 - RNA, 17 nt, Homo sapiens
cuccaggaaagagcagu

SEQ ID NO: 669887 - RNA, 17 nt, Homo sapiens
cuccaggaugaguuacu

SEQ ID NO: 669888 - RNA, 14 nt, Homo sapiens
cuccaggauuuccu

SEQ ID NO: 669889 - RNA, 17 nt, Homo sapiens
cuccagggaaaaugacu

SEQ ID NO: 669890 - RNA, 18 nt, Homo sapiens
cuccaggggggacaauau

SEQ ID NO: 669891 - RNA, 17 nt, Homo sapiens
cuccagguucacuuugg

SEQ ID NO: 669892 - RNA, 16 nt, Homo sapiens
cuccaguaacagccua

SEQ ID NO: 669893 - RNA, 13 nt, Homo sapiens
cuccaguagaaag

SEQ ID NO: 669894 - RNA, 13 nt, Homo sapiens
cuccagucuuccg

SEQ ID NO: 669895 - RNA, 13 nt, Homo sapiens
cuccagugcaguc

SEQ ID NO: 669896 - RNA, 13 nt, Homo sapiens
cuccagugccagc

SEQ ID NO: 669897 - RNA, 18 nt, Homo sapiens
cuccagugccagcaauga

SEQ ID NO: 669898 - RNA, 22 nt, Homo sapiens
cuccaguuuacccuucagguug

SEQ ID NO: 669899 - RNA, 15 nt, Homo sapiens
cuccaguuugcauuu

SEQ ID NO: 669900 - RNA, 22 nt, Homo sapiens
cuccauaucccuuccucucagg

SEQ ID NO: 669901 - RNA, 14 nt, Homo sapiens
cuccauaugcugua

SEQ ID NO: 669902 - RNA, 23 nt, Homo sapiens
cuccauauuggacauccccagaa

SEQ ID NO: 669903 - RNA, 15 nt, Homo sapiens
cuccaucccaacagc

SEQ ID NO: 669904 - RNA, 18 nt, Homo sapiens
cuccaucccaacagccau

SEQ ID NO: 669905 - RNA, 19 nt, Homo sapiens
cuccaucccaacagccaug

SEQ ID NO: 669906 - RNA, 17 nt, Homo sapiens
cuccaucguccauccuc

SEQ ID NO: 669907 - RNA, 13 nt, Homo sapiens
cuccaucucuuaa

SEQ ID NO: 669908 - RNA, 12 nt, Homo sapiens
cuccaugcugca

SEQ ID NO: 669909 - RNA, 21 nt, Homo sapiens
cuccaugcuggauacuggaca

SEQ ID NO: 669910 - RNA, 23 nt, Homo sapiens
cuccauggccaccccgugccacc

SEQ ID NO: 669911 - RNA, 19 nt, Homo sapiens
cuccauguagaagccacua

SEQ ID NO: 669912 - RNA, 19 nt, Homo sapiens
cuccauguuuuuggggaca

SEQ ID NO: 669913 - RNA, 15 nt, Homo sapiens
cuccauugugccuaa

SEQ ID NO: 669914 - RNA, 18 nt, Homo sapiens
cuccauuucuuucuucca

SEQ ID NO: 669915 - RNA, 21 nt, Homo sapiens
cuccauuugcaauugaccucu

SEQ ID NO: 669916 - RNA, 21 nt, Homo sapiens
cuccauuuuacagaagcauuu

SEQ ID NO: 669917 - RNA, 15 nt, Homo sapiens
cucccaaagcucaga

SEQ ID NO: 669918 - RNA, 12 nt, Homo sapiens
cucccaaagugc

SEQ ID NO: 669919 - RNA, 20 nt, Homo sapiens
cucccaaagugcuaggauua

SEQ ID NO: 669920 - RNA, 20 nt, Homo sapiens
cucccaaagugcugggauua

SEQ ID NO: 669921 - RNA, 20 nt, Homo sapiens
cucccaaaugagccaugaga

SEQ ID NO: 669922 - RNA, 18 nt, Homo sapiens
cucccaacucaagguucu

SEQ ID NO: 669923 - RNA, 14 nt, Homo sapiens
cucccaacucuugc

SEQ ID NO: 669924 - RNA, 15 nt, Homo sapiens
cucccaaggcucuga

SEQ ID NO: 669925 - RNA, 23 nt, Homo sapiens
cucccaagguccucucaguucuc

SEQ ID NO: 669926 - RNA, 14 nt, Homo sapiens
cucccaaucagcuu

SEQ ID NO: 669927 - RNA, 22 nt, Homo sapiens
cucccacaaugcugaugaaaac

SEQ ID NO: 669928 - RNA, 13 nt, Homo sapiens
cucccacauucug

SEQ ID NO: 669929 - RNA, 18 nt, Homo sapiens
cucccaccagagacuggg

SEQ ID NO: 669930 - RNA, 18 nt, Homo sapiens
cucccaccccacccccuu

SEQ ID NO: 669931 - RNA, 21 nt, Homo sapiens
cucccacugggguccagggag

SEQ ID NO: 669932 - RNA, 18 nt, Homo sapiens
cucccacuucacugcgaa

SEQ ID NO: 669933 - RNA, 13 nt, Homo sapiens
cucccacuuucug

SEQ ID NO: 669934 - RNA, 12 nt, Homo sapiens
cucccacuuugc

SEQ ID NO: 669935 - RNA, 16 nt, Homo sapiens
cucccagcugcacuuu

SEQ ID NO: 669936 - RNA, 15 nt, Homo sapiens
cucccagcugugcug

SEQ ID NO: 669937 - RNA, 23 nt, Homo sapiens
cucccaggcugcuggagugcagu

SEQ ID NO: 669938 - RNA, 20 nt, Homo sapiens
cucccaggcuggagugcagu

SEQ ID NO: 669939 - RNA, 19 nt, Homo sapiens
cucccagguucaagugauu

SEQ ID NO: 669940 - RNA, 16 nt, Homo sapiens
cucccaguccauuucc

SEQ ID NO: 669941 - RNA, 19 nt, Homo sapiens
cucccagugaacuccugcc

SEQ ID NO: 669942 - RNA, 11 nt, Homo sapiens
cucccauuuca

SEQ ID NO: 669943 - RNA, 16 nt, Homo sapiens
cucccauuucucucuu

SEQ ID NO: 669944 - RNA, 16 nt, Homo sapiens
cuccccacacuaaccu

SEQ ID NO: 669945 - RNA, 14 nt, Homo sapiens
cuccccacacucca

SEQ ID NO: 669946 - RNA, 14 nt, Homo sapiens
cuccccacccaaga

SEQ ID NO: 669947 - RNA, 13 nt, Homo sapiens
cuccccaccuuca

SEQ ID NO: 669948 - RNA, 16 nt, Homo sapiens
cuccccagagcacugg

SEQ ID NO: 669949 - RNA, 20 nt, Homo sapiens
cuccccagggaagacccuga

SEQ ID NO: 669950 - RNA, 21 nt, Homo sapiens
cuccccaguucauugcacuuu

SEQ ID NO: 669951 - RNA, 23 nt, Homo sapiens
cuccccaguucauugcacuuuga

SEQ ID NO: 669952 - RNA, 17 nt, Homo sapiens
cuccccaucaccauggg

SEQ ID NO: 669953 - RNA, 16 nt, Homo sapiens
cucccccagcacagau

SEQ ID NO: 669954 - RNA, 18 nt, Homo sapiens
cucccccuuucacacugg

SEQ ID NO: 669955 - RNA, 22 nt, Homo sapiens
cuccccgccaacccugccugcc

SEQ ID NO: 669956 - RNA, 18 nt, Homo sapiens
cuccccucagagugcaag

SEQ ID NO: 669957 - RNA, 11 nt, Homo sapiens
cuccccugaag

SEQ ID NO: 669958 - RNA, 16 nt, Homo sapiens
cuccccugaggcucag

SEQ ID NO: 669959 - RNA, 18 nt, Homo sapiens
cuccccugcccuggucca

SEQ ID NO: 669960 - RNA, 20 nt, Homo sapiens
cuccccuucccuggggagcc

SEQ ID NO: 669961 - RNA, 15 nt, Homo sapiens
cucccgaugcugcua

SEQ ID NO: 669962 - RNA, 16 nt, Homo sapiens
cucccgaugcugcuau

SEQ ID NO: 669963 - RNA, 22 nt, Homo sapiens
cucccgccgcggcuguugcuca

SEQ ID NO: 669964 - RNA, 15 nt, Homo sapiens
cucccguccauucca

SEQ ID NO: 669965 - RNA, 20 nt, Homo sapiens
cucccuaaggaaucugaaag

SEQ ID NO: 669966 - RNA, 12 nt, Homo sapiens
cucccuagccag

SEQ ID NO: 669967 - RNA, 14 nt, Homo sapiens
cucccuagccagag

SEQ ID NO: 669968 - RNA, 22 nt, Homo sapiens
cucccuagccagaggcucuaau

SEQ ID NO: 669969 - RNA, 21 nt, Homo sapiens
cucccuaggcugcccacucuc

SEQ ID NO: 669970 - RNA, 19 nt, Homo sapiens
cucccuaguagcugggauu

SEQ ID NO: 669971 - RNA, 13 nt, Homo sapiens
cucccucauucca

SEQ ID NO: 669972 - RNA, 15 nt, Homo sapiens
cucccuccaccagcc

SEQ ID NO: 669973 - RNA, 21 nt, Homo sapiens
cucccucccagcgcucuggga

SEQ ID NO: 669974 - RNA, 15 nt, Homo sapiens
cucccuccccagcuc

SEQ ID NO: 669975 - RNA, 18 nt, Homo sapiens
cucccucggaaugcuaag

SEQ ID NO: 669976 - RNA, 16 nt, Homo sapiens
cucccucucaguggag

SEQ ID NO: 669977 - RNA, 16 nt, Homo sapiens
cucccucugaccugca

SEQ ID NO: 669978 - RNA, 14 nt, Homo sapiens
cucccucugacucu

SEQ ID NO: 669979 - RNA, 18 nt, Homo sapiens
cucccugaagaccaaaau

SEQ ID NO: 669980 - RNA, 23 nt, Homo sapiens
cucccugaccuuagcguucugga

SEQ ID NO: 669981 - RNA, 16 nt, Homo sapiens
cucccugcaagaaauc

SEQ ID NO: 669982 - RNA, 12 nt, Homo sapiens
cucccugccacc

SEQ ID NO: 669983 - RNA, 23 nt, Homo sapiens
cucccugggucuggggacaggcc

SEQ ID NO: 669984 - RNA, 18 nt, Homo sapiens
cucccuguuuuaauucaa

SEQ ID NO: 669985 - RNA, 14 nt, Homo sapiens
cucccuuacccucc

SEQ ID NO: 669986 - RNA, 16 nt, Homo sapiens
cucccuugccacccaa

SEQ ID NO: 669987 - RNA, 11 nt, Homo sapiens
cucccuuuacc

SEQ ID NO: 669988 - RNA, 20 nt, Homo sapiens
cuccgagaggugggccaguc

SEQ ID NO: 669989 - RNA, 13 nt, Homo sapiens
cuccgccauucca

SEQ ID NO: 669990 - RNA, 15 nt, Homo sapiens
cuccgcgccuacccu

SEQ ID NO: 669991 - RNA, 18 nt, Homo sapiens
cuccgcgggagaccccuu

SEQ ID NO: 669992 - RNA, 24 nt, Homo sapiens
cuccggucccaaauguagcaggug

SEQ ID NO: 669993 - RNA, 16 nt, Homo sapiens
cuccgucucaaaagaa

SEQ ID NO: 669994 - RNA, 17 nt, Homo sapiens
cuccguggaacauucug

SEQ ID NO: 669995 - RNA, 18 nt, Homo sapiens
cuccguuuggcagugcaa

SEQ ID NO: 669996 - RNA, 18 nt, Homo sapiens
cuccuaaaguaacaucag

SEQ ID NO: 669997 - RNA, 14 nt, Homo sapiens
cuccuaacccuuau

SEQ ID NO: 669998 - RNA, 15 nt, Homo sapiens
cuccuaaugcuuuau

SEQ ID NO: 669999 - RNA, 13 nt, Homo sapiens
cuccuacccugau

SEQ ID NO: 670000 - RNA, 16 nt, Homo sapiens
cuccuacuaaaucccu

SEQ ID NO: 670001 - RNA, 18 nt, Homo sapiens
gggcaagagaugggacaa

SEQ ID NO: 670002 - RNA, 22 nt, Homo sapiens
gggcacacgccucccacugggg

SEQ ID NO: 670003 - RNA, 20 nt, Homo sapiens
gggcacuacauaauugcugu

SEQ ID NO: 670004 - RNA, 22 nt, Homo sapiens
gggcacucccuugguggcaaga

SEQ ID NO: 670005 - RNA, 15 nt, Homo sapiens
gggcacuggcccagg

SEQ ID NO: 670006 - RNA, 22 nt, Homo sapiens
gggcacuuuaagucagugacag

SEQ ID NO: 670007 - RNA, 14 nt, Homo sapiens
gggcagcacucccc

SEQ ID NO: 670008 - RNA, 17 nt, Homo sapiens
gggcagcagcaucccag

SEQ ID NO: 670009 - RNA, 16 nt, Homo sapiens
gggcagggacccgggg

SEQ ID NO: 670010 - RNA, 20 nt, Homo sapiens
gggcagggaggcaacacugc

SEQ ID NO: 670011 - RNA, 12 nt, Homo sapiens
gggcagggauga

SEQ ID NO: 670012 - RNA, 16 nt, Homo sapiens
gggcagggcccacgug

SEQ ID NO: 670013 - RNA, 17 nt, Homo sapiens
gggcagggccccugacc

SEQ ID NO: 670014 - RNA, 15 nt, Homo sapiens
gggcagggguuccca

SEQ ID NO: 670015 - RNA, 11 nt, Homo sapiens
gggcaggguga

SEQ ID NO: 670016 - RNA, 17 nt, Homo sapiens
gggcaguccuuacuccc

SEQ ID NO: 670017 - RNA, 15 nt, Homo sapiens
gggcaucagccagcu

SEQ ID NO: 670018 - RNA, 18 nt, Homo sapiens
gggcaucugccccucccc

SEQ ID NO: 670019 - RNA, 18 nt, Homo sapiens
gggcaugaagcugcauau

SEQ ID NO: 670020 - RNA, 12 nt, Homo sapiens
gggcaugccacc

SEQ ID NO: 670021 - RNA, 16 nt, Homo sapiens
gggcauguguaugugu

SEQ ID NO: 670022 - RNA, 14 nt, Homo sapiens
gggcauuguaguua

SEQ ID NO: 670023 - RNA, 16 nt, Homo sapiens
gggccaaaaccaaugc

SEQ ID NO: 670024 - RNA, 21 nt, Homo sapiens
gggccaaauucccaaccugcu

SEQ ID NO: 670025 - RNA, 14 nt, Homo sapiens
gggccacuggggac

SEQ ID NO: 670026 - RNA, 21 nt, Homo sapiens
gggccagcacuuccaugggaa

SEQ ID NO: 670027 - RNA, 22 nt, Homo sapiens
gggccagccccacccccagcca

SEQ ID NO: 670028 - RNA, 16 nt, Homo sapiens
gggccagggcccugca

SEQ ID NO: 670029 - RNA, 14 nt, Homo sapiens
gggccagggcucca

SEQ ID NO: 670030 - RNA, 15 nt, Homo sapiens
gggccagggguggga

SEQ ID NO: 670031 - RNA, 16 nt, Homo sapiens
gggccaugccaggcca

SEQ ID NO: 670032 - RNA, 12 nt, Homo sapiens
gggccaugccuc

SEQ ID NO: 670033 - RNA, 14 nt, Homo sapiens
gggccauguccaaa

SEQ ID NO: 670034 - RNA, 18 nt, Homo sapiens
gggccauucuccacagca

SEQ ID NO: 670035 - RNA, 21 nt, Homo sapiens
gggcccaaauucuuucagugg

SEQ ID NO: 670036 - RNA, 21 nt, Homo sapiens
gggcccacagggaacccugcu

SEQ ID NO: 670037 - RNA, 16 nt, Homo sapiens
gggcccacccauguca

SEQ ID NO: 670038 - RNA, 22 nt, Homo sapiens
gggccccacuggacaacacuga

SEQ ID NO: 670039 - RNA, 15 nt, Homo sapiens
gggccccaucuugau

SEQ ID NO: 670040 - RNA, 22 nt, Homo sapiens
gggcccccagccuggccagaca

SEQ ID NO: 670041 - RNA, 15 nt, Homo sapiens
gggcccccaucucau

SEQ ID NO: 670042 - RNA, 14 nt, Homo sapiens
gggccccucagagc

SEQ ID NO: 670043 - RNA, 17 nt, Homo sapiens
gggcccugccugcugca

SEQ ID NO: 670044 - RNA, 16 nt, Homo sapiens
gggcccugggccucag

SEQ ID NO: 670045 - RNA, 15 nt, Homo sapiens
gggccgaauccccuc

SEQ ID NO: 670046 - RNA, 18 nt, Homo sapiens
gggccgcucgaugccuuu

SEQ ID NO: 670047 - RNA, 14 nt, Homo sapiens
gggccggccagugg

SEQ ID NO: 670048 - RNA, 22 nt, Homo sapiens
gggccgugacagugacgccuuu

SEQ ID NO: 670049 - RNA, 17 nt, Homo sapiens
gggccucaaggacuuga

SEQ ID NO: 670050 - RNA, 18 nt, Homo sapiens
gggccucaggagcaggaa

SEQ ID NO: 670051 - RNA, 19 nt, Homo sapiens
gggccuccagggcccaggu

SEQ ID NO: 670052 - RNA, 13 nt, Homo sapiens
gggccuccaugcc

SEQ ID NO: 670053 - RNA, 16 nt, Homo sapiens
gggccucccaccagag

SEQ ID NO: 670054 - RNA, 15 nt, Homo sapiens
gggccugcccagaca

SEQ ID NO: 670055 - RNA, 16 nt, Homo sapiens
gggccugcccagacaa

SEQ ID NO: 670056 - RNA, 14 nt, Homo sapiens
gggccuggaccugc

SEQ ID NO: 670057 - RNA, 18 nt, Homo sapiens
gggccuggccaccucucu

SEQ ID NO: 670058 - RNA, 15 nt, Homo sapiens
gggccugucacugau

SEQ ID NO: 670059 - RNA, 20 nt, Homo sapiens
gggccuugcucugagcacag

SEQ ID NO: 670060 - RNA, 18 nt, Homo sapiens
gggccuuggaucgcuaag

SEQ ID NO: 670061 - RNA, 13 nt, Homo sapiens
gggcgaaggccau

SEQ ID NO: 670062 - RNA, 18 nt, Homo sapiens
gggcgaucgcggcggagc

SEQ ID NO: 670063 - RNA, 20 nt, Homo sapiens
gggcgcccucucugcuccuu

SEQ ID NO: 670064 - RNA, 12 nt, Homo sapiens
gggcgcgguggc

SEQ ID NO: 670065 - RNA, 20 nt, Homo sapiens
gggcggccagggacccaaag

SEQ ID NO: 670066 - RNA, 22 nt, Homo sapiens
gggcggggcguguagccagcca

SEQ ID NO: 670067 - RNA, 20 nt, Homo sapiens
gggcgguaccuugugcccag

SEQ ID NO: 670068 - RNA, 18 nt, Homo sapiens
gggcguggagagcccggc

SEQ ID NO: 670069 - RNA, 21 nt, Homo sapiens
gggcuaagguuuccagucaga

SEQ ID NO: 670070 - RNA, 12 nt, Homo sapiens
gggcuagggagg

SEQ ID NO: 670071 - RNA, 19 nt, Homo sapiens
gggcucaaggaaagggggu

SEQ ID NO: 670072 - RNA, 15 nt, Homo sapiens
gggcuccacgggcag

SEQ ID NO: 670073 - RNA, 15 nt, Homo sapiens
gggcuccauguagaa

SEQ ID NO: 670074 - RNA, 17 nt, Homo sapiens
gggcucccagcccgugc

SEQ ID NO: 670075 - RNA, 15 nt, Homo sapiens
gggcuccuugcucca

SEQ ID NO: 670076 - RNA, 14 nt, Homo sapiens
gggcucgugcccug

SEQ ID NO: 670077 - RNA, 15 nt, Homo sapiens
gggcucuaugccugc

SEQ ID NO: 670078 - RNA, 18 nt, Homo sapiens
gggcucugugaccaggaa

SEQ ID NO: 670079 - RNA, 18 nt, Homo sapiens
gggcugaaagaacaugga

SEQ ID NO: 670080 - RNA, 19 nt, Homo sapiens
gggcugaaagaacauggac

SEQ ID NO: 670081 - RNA, 17 nt, Homo sapiens
gggcugaccgugucucu

SEQ ID NO: 670082 - RNA, 22 nt, Homo sapiens
gggcugacuccugcucucugga

SEQ ID NO: 670083 - RNA, 16 nt, Homo sapiens
gggcugagcccuggca

SEQ ID NO: 670084 - RNA, 11 nt, Homo sapiens
gggcugagggu

SEQ ID NO: 670085 - RNA, 19 nt, Homo sapiens
gggcugaguggucugacac

SEQ ID NO: 670086 - RNA, 17 nt, Homo sapiens
gggcugcacauugccug

SEQ ID NO: 670087 - RNA, 13 nt, Homo sapiens
gggcugcauucuu

SEQ ID NO: 670088 - RNA, 14 nt, Homo sapiens
gggcugcccugcca

SEQ ID NO: 670089 - RNA, 15 nt, Homo sapiens
gggcuggaguccucu

SEQ ID NO: 670090 - RNA, 16 nt, Homo sapiens
gggcuggaguccucuc

SEQ ID NO: 670091 - RNA, 19 nt, Homo sapiens
gggcuggcucccagggugg

SEQ ID NO: 670092 - RNA, 11 nt, Homo sapiens
gggcuguagac

SEQ ID NO: 670093 - RNA, 11 nt, Homo sapiens
gggcugugauc

SEQ ID NO: 670094 - RNA, 22 nt, Homo sapiens
gggcuuaccaggugagaaguga

SEQ ID NO: 670095 - RNA, 19 nt, Homo sapiens
gggcuuaccuguacacuga

SEQ ID NO: 670096 - RNA, 18 nt, Homo sapiens
gggcuuggaccagaucua

SEQ ID NO: 670097 - RNA, 19 nt, Homo sapiens
gggcuuuuguucugagggg

SEQ ID NO: 670098 - RNA, 22 nt, Homo sapiens
ggggaaauaauaaagaugcucu

SEQ ID NO: 670099 - RNA, 12 nt, Homo sapiens
ggggacugcugg

SEQ ID NO: 670100 - RNA, 15 nt, Homo sapiens
ggucaggcgcagugg

SEQ ID NO: 670101 - RNA, 20 nt, Homo sapiens
ggucagggccagacuggaag

SEQ ID NO: 670102 - RNA, 19 nt, Homo sapiens
ggucaggggcucccuacau

SEQ ID NO: 670103 - RNA, 16 nt, Homo sapiens
ggucagucuuugcuca

SEQ ID NO: 670104 - RNA, 14 nt, Homo sapiens
ggucaguuacaaag

SEQ ID NO: 670105 - RNA, 15 nt, Homo sapiens
ggucauacaugcaua

SEQ ID NO: 670106 - RNA, 15 nt, Homo sapiens
ggucauccaaacuca

SEQ ID NO: 670107 - RNA, 24 nt, Homo sapiens
ggucaucugaccuucaccuuggau

SEQ ID NO: 670108 - RNA, 16 nt, Homo sapiens
ggucaugcacaugccu

SEQ ID NO: 670109 - RNA, 12 nt, Homo sapiens
ggucaugcccuc

SEQ ID NO: 670110 - RNA, 12 nt, Homo sapiens
ggucaugugcau

SEQ ID NO: 670111 - RNA, 18 nt, Homo sapiens
ggucaugugggucuucca

SEQ ID NO: 670112 - RNA, 13 nt, Homo sapiens
ggucaugugguac

SEQ ID NO: 670113 - RNA, 20 nt, Homo sapiens
ggucauuacaaaaaaacacg

SEQ ID NO: 670114 - RNA, 18 nt, Homo sapiens
ggucauuauuuuuuacaa

SEQ ID NO: 670115 - RNA, 14 nt, Homo sapiens
ggucauucuuuauu

SEQ ID NO: 670116 - RNA, 16 nt, Homo sapiens
ggucauuuccagacaa

SEQ ID NO: 670117 - RNA, 19 nt, Homo sapiens
ggucauuuuuauguuauua

SEQ ID NO: 670118 - RNA, 16 nt, Homo sapiens
gguccaaacccuucaa

SEQ ID NO: 670119 - RNA, 21 nt, Homo sapiens
gguccaaaggccagcggugac

SEQ ID NO: 670120 - RNA, 14 nt, Homo sapiens
gguccaccuccuga

SEQ ID NO: 670121 - RNA, 14 nt, Homo sapiens
gguccagugggaac

SEQ ID NO: 670122 - RNA, 16 nt, Homo sapiens
gguccaugcagggggc

SEQ ID NO: 670123 - RNA, 17 nt, Homo sapiens
gguccauucugcaccuc

SEQ ID NO: 670124 - RNA, 19 nt, Homo sapiens
ggucccaggcagagaauca

SEQ ID NO: 670125 - RNA, 14 nt, Homo sapiens
gguccccagcauug

SEQ ID NO: 670126 - RNA, 15 nt, Homo sapiens
gcauugaaagaauua

SEQ ID NO: 670127 - RNA, 13 nt, Homo sapiens
gcauugcucuuau

SEQ ID NO: 670128 - RNA, 10 nt, Homo sapiens
gcauugcuga

SEQ ID NO: 670129 - RNA, 18 nt, Homo sapiens
gcauuguaaaagcauuuu

SEQ ID NO: 670130 - RNA, 16 nt, Homo sapiens
gcauugucucucucga

SEQ ID NO: 670131 - RNA, 20 nt, Homo sapiens
gcauuuagacccugcauuua

SEQ ID NO: 670132 - RNA, 22 nt, Homo sapiens
gcauuucaauuagggaugcuca

SEQ ID NO: 670133 - RNA, 20 nt, Homo sapiens
gcauuucacgaacuguucac

SEQ ID NO: 670134 - RNA, 17 nt, Homo sapiens
gcauuugaguuugcaaa

SEQ ID NO: 670135 - RNA, 15 nt, Homo sapiens
gcauuugccacuuag

SEQ ID NO: 670136 - RNA, 16 nt, Homo sapiens
gcauuuggucaggggg

SEQ ID NO: 670137 - RNA, 21 nt, Homo sapiens
gcauuugucaaugacaguuuc

SEQ ID NO: 670138 - RNA, 19 nt, Homo sapiens
gcauuugugcccacucucc

SEQ ID NO: 670139 - RNA, 13 nt, Homo sapiens
gcauuuguucacu

SEQ ID NO: 670140 - RNA, 14 nt, Homo sapiens
gcauuuuacaggug

SEQ ID NO: 670141 - RNA, 21 nt, Homo sapiens
gcauuuuauaggcauaccucc

SEQ ID NO: 670142 - RNA, 12 nt, Homo sapiens
gcauuuuccucc

SEQ ID NO: 670143 - RNA, 19 nt, Homo sapiens
gcauuuuucuaaugggcua

SEQ ID NO: 670144 - RNA, 13 nt, Homo sapiens
gccaaaccaggac

SEQ ID NO: 670145 - RNA, 17 nt, Homo sapiens
gccaaacccaugaggca

SEQ ID NO: 670146 - RNA, 18 nt, Homo sapiens
gccaaacccuugucagug

SEQ ID NO: 670147 - RNA, 15 nt, Homo sapiens
gccaaagauaaucuc

SEQ ID NO: 670148 - RNA, 21 nt, Homo sapiens
gccaaagccccaugugccuug

SEQ ID NO: 670149 - RNA, 22 nt, Homo sapiens
gccaaagccccaugugccuugu

SEQ ID NO: 670150 - RNA, 16 nt, Homo sapiens
gccaaaggaaugucca

SEQ ID NO: 670151 - RNA, 17 nt, Homo sapiens
gccaaauaugcacuuuc

SEQ ID NO: 670152 - RNA, 15 nt, Homo sapiens
gccaacaacucugau

SEQ ID NO: 670153 - RNA, 17 nt, Homo sapiens
gccaacaccuucuuggc

SEQ ID NO: 670154 - RNA, 23 nt, Homo sapiens
gccaacagccccccccuugaauc

SEQ ID NO: 670155 - RNA, 15 nt, Homo sapiens
gccaaccacaauuca

SEQ ID NO: 670156 - RNA, 15 nt, Homo sapiens
gccaacuucucccac

SEQ ID NO: 670157 - RNA, 14 nt, Homo sapiens
gccaagaagcagug

SEQ ID NO: 670158 - RNA, 13 nt, Homo sapiens
gccaagaaguuua

SEQ ID NO: 670159 - RNA, 17 nt, Homo sapiens
gccaagaauacuugaag

SEQ ID NO: 670160 - RNA, 20 nt, Homo sapiens
gccaagacaaaucaacagaa

SEQ ID NO: 670161 - RNA, 19 nt, Homo sapiens
gccaagagccgacaaugcc

SEQ ID NO: 670162 - RNA, 20 nt, Homo sapiens
gccaagaucgccccacugca

SEQ ID NO: 670163 - RNA, 17 nt, Homo sapiens
gccaagccagucaagga

SEQ ID NO: 670164 - RNA, 22 nt, Homo sapiens
gccaagcuuccugugcccucac

SEQ ID NO: 670165 - RNA, 20 nt, Homo sapiens
gccaaggagggugagugcaa

SEQ ID NO: 670166 - RNA, 20 nt, Homo sapiens
gccaagggaaaggggugcuu

SEQ ID NO: 670167 - RNA, 19 nt, Homo sapiens
gccaagggccgacuaagag

SEQ ID NO: 670168 - RNA, 21 nt, Homo sapiens
gcagagccacagcugugcaug

SEQ ID NO: 670169 - RNA, 22 nt, Homo sapiens
gcagagccuacagaagggcagu

SEQ ID NO: 670170 - RNA, 21 nt, Homo sapiens
gcagagcgauggagcagucuc

SEQ ID NO: 670171 - RNA, 21 nt, Homo sapiens
gcagagcucccacaaugcuga

SEQ ID NO: 670172 - RNA, 20 nt, Homo sapiens
gcagagcuuguuuuguuuca

SEQ ID NO: 670173 - RNA, 13 nt, Homo sapiens
gcagaggacgcac

SEQ ID NO: 670174 - RNA, 13 nt, Homo sapiens
gcagaggcaccuc

SEQ ID NO: 670175 - RNA, 14 nt, Homo sapiens
gcagaggccagagg

SEQ ID NO: 670176 - RNA, 23 nt, Homo sapiens
gcagaggcuccgcggcaggagga

SEQ ID NO: 670177 - RNA, 11 nt, Homo sapiens
gcagaggucag

SEQ ID NO: 670178 - RNA, 18 nt, Homo sapiens
gcagaggucccucagcug

SEQ ID NO: 670179 - RNA, 14 nt, Homo sapiens
gcagaggucuccca

SEQ ID NO: 670180 - RNA, 15 nt, Homo sapiens
gcagagguugcagug

SEQ ID NO: 670181 - RNA, 16 nt, Homo sapiens
gcagagguugcaguga

SEQ ID NO: 670182 - RNA, 17 nt, Homo sapiens
gcagagugaaagaucaa

SEQ ID NO: 670183 - RNA, 15 nt, Homo sapiens
gcagaguuugccuuc

SEQ ID NO: 670184 - RNA, 21 nt, Homo sapiens
gcagauccccacuguccuacc

SEQ ID NO: 670185 - RNA, 17 nt, Homo sapiens
gcagaucugugccccau

SEQ ID NO: 670186 - RNA, 23 nt, Homo sapiens
gcagcaagguggccacaguguca

SEQ ID NO: 670187 - RNA, 18 nt, Homo sapiens
gcagcaagugugcuggcc

SEQ ID NO: 670188 - RNA, 12 nt, Homo sapiens
gcagcacucccc

SEQ ID NO: 670189 - RNA, 22 nt, Homo sapiens
gcagcacuccgcaucaccucac

SEQ ID NO: 670190 - RNA, 9 nt, Homo sapiens
gcagcacuu

SEQ ID NO: 670191 - RNA, 22 nt, Homo sapiens
gcagcacuuuaacccucucuuc

SEQ ID NO: 670192 - RNA, 21 nt, Homo sapiens
gcagcaucuucaaacauguac

SEQ ID NO: 670193 - RNA, 16 nt, Homo sapiens
gcagccaaccaagaug

SEQ ID NO: 670194 - RNA, 18 nt, Homo sapiens
gcagccaaguagccucuc

SEQ ID NO: 670195 - RNA, 19 nt, Homo sapiens
gcagccaccaguggaccua

SEQ ID NO: 670196 - RNA, 17 nt, Homo sapiens
gcagccacgucucaaca

SEQ ID NO: 670197 - RNA, 23 nt, Homo sapiens
gcagccagagcugugccugcuca

SEQ ID NO: 670198 - RNA, 14 nt, Homo sapiens
gcagccagcauuac

SEQ ID NO: 670199 - RNA, 21 nt, Homo sapiens
gcagcccaaucugccagacuu

SEQ ID NO: 670200 - RNA, 13 nt, Homo sapiens
gcagcccagagac

SEQ ID NO: 670201 - RNA, 16 nt, Homo sapiens
gcagccccucuaccuc

SEQ ID NO: 670202 - RNA, 20 nt, Homo sapiens
gcagcccggcgccaccaucc

SEQ ID NO: 670203 - RNA, 13 nt, Homo sapiens
gcagccucaaaac

SEQ ID NO: 670204 - RNA, 12 nt, Homo sapiens
gcagccuggcau

SEQ ID NO: 670205 - RNA, 21 nt, Homo sapiens
gcagccuuuacguucaucacc

SEQ ID NO: 670206 - RNA, 22 nt, Homo sapiens
gcagcgcccccaucugucuuca

SEQ ID NO: 670207 - RNA, 23 nt, Homo sapiens
gcagcgcccccaucugucuucag

SEQ ID NO: 670208 - RNA, 17 nt, Homo sapiens
gcagcgccuuucccaac

SEQ ID NO: 670209 - RNA, 16 nt, Homo sapiens
gcagcgguaccccagg

SEQ ID NO: 670210 - RNA, 15 nt, Homo sapiens
gcagcuaaaaaugca

SEQ ID NO: 670211 - RNA, 14 nt, Homo sapiens
gcagcuaagccaca

SEQ ID NO: 670212 - RNA, 19 nt, Homo sapiens
gcagcucacggaacuggag

SEQ ID NO: 670213 - RNA, 21 nt, Homo sapiens
gcagcucacggaacuggagaa

SEQ ID NO: 670214 - RNA, 18 nt, Homo sapiens
gcagcucaggcacacuuc

SEQ ID NO: 670215 - RNA, 17 nt, Homo sapiens
gcagcugagaccagggu

SEQ ID NO: 670216 - RNA, 12 nt, Homo sapiens
gcagcugugaug

SEQ ID NO: 670217 - RNA, 17 nt, Homo sapiens
gcagcuguuucucauga

SEQ ID NO: 670218 - RNA, 20 nt, Homo sapiens
gcagcuucaccagagcauuu

SEQ ID NO: 670219 - RNA, 15 nt, Homo sapiens
gcagcuucagugaca

SEQ ID NO: 670220 - RNA, 19 nt, Homo sapiens
gcagcuuuaaacucaggga

SEQ ID NO: 670221 - RNA, 21 nt, Homo sapiens
gcagcuuuaaacucagggaca

SEQ ID NO: 670222 - RNA, 13 nt, Homo sapiens
gcagcuuugcaaa

SEQ ID NO: 670223 - RNA, 13 nt, Homo sapiens
gcaggaaagccac

SEQ ID NO: 670224 - RNA, 12 nt, Homo sapiens
gcaggaccucag

SEQ ID NO: 670225 - RNA, 14 nt, Homo sapiens
gcaggacuugccac

SEQ ID NO: 670226 - RNA, 17 nt, Homo sapiens
gcaggagaauagccuga

SEQ ID NO: 670227 - RNA, 18 nt, Homo sapiens
gcaggagaauggugugaa

SEQ ID NO: 670228 - RNA, 17 nt, Homo sapiens
gcaggagacuggcguga

SEQ ID NO: 670229 - RNA, 22 nt, Homo sapiens
gcaggagcauguaugucugcag

SEQ ID NO: 670230 - RNA, 13 nt, Homo sapiens
gcaggagcuugug

SEQ ID NO: 670231 - RNA, 16 nt, Homo sapiens
gcaggaguauaugagc

SEQ ID NO: 670232 - RNA, 16 nt, Homo sapiens
gcaggaguggugcaga

SEQ ID NO: 670233 - RNA, 17 nt, Homo sapiens
gcaggaucccuacugcc

SEQ ID NO: 670234 - RNA, 22 nt, Homo sapiens
gcaggaucuggacgguccccuc

SEQ ID NO: 670235 - RNA, 18 nt, Homo sapiens
gcaggauguuggccacca

SEQ ID NO: 670236 - RNA, 14 nt, Homo sapiens
gcaggccacugggg

SEQ ID NO: 670237 - RNA, 15 nt, Homo sapiens
gcaggccagggcagu

SEQ ID NO: 670238 - RNA, 21 nt, Homo sapiens
gcaggcccuuugaagccucag

SEQ ID NO: 670239 - RNA, 23 nt, Homo sapiens
gcaggcuggcagcucuccaguca

SEQ ID NO: 670240 - RNA, 20 nt, Homo sapiens
gcagggaagaggggugcaga

SEQ ID NO: 670241 - RNA, 16 nt, Homo sapiens
gcagggacuccaugcu

SEQ ID NO: 670242 - RNA, 17 nt, Homo sapiens
gcagggccagggcaaug

SEQ ID NO: 670243 - RNA, 20 nt, Homo sapiens
gcagggcuauauuucaguga

SEQ ID NO: 670244 - RNA, 22 nt, Homo sapiens
gcaggggacaagggaggcagug

SEQ ID NO: 670245 - RNA, 16 nt, Homo sapiens
gcaggggccaggggug

SEQ ID NO: 670246 - RNA, 12 nt, Homo sapiens
gcaggggcugca

SEQ ID NO: 670247 - RNA, 15 nt, Homo sapiens
gcaggggcuggagau

SEQ ID NO: 670248 - RNA, 17 nt, Homo sapiens
gcaggggucucaugugg

SEQ ID NO: 670249 - RNA, 16 nt, Homo sapiens
gcagggguugcaguga

SEQ ID NO: 670250 - RNA, 15 nt, Homo sapiens
gcagggucuuuucau

SEQ ID NO: 670251 - RNA, 21 nt, Homo sapiens
gcagggugcaguaucaugccc

SEQ ID NO: 670252 - RNA, 18 nt, Homo sapiens
gcagguacuuccucaguc

SEQ ID NO: 670253 - RNA, 22 nt, Homo sapiens
gcaggugaccuucugggaaaug

SEQ ID NO: 670254 - RNA, 20 nt, Homo sapiens
gcaggugagaacccugugga

SEQ ID NO: 670255 - RNA, 19 nt, Homo sapiens
gcagguggugggacacugg

SEQ ID NO: 670256 - RNA, 21 nt, Homo sapiens
gcagguuccuuaucugucaca

SEQ ID NO: 670257 - RNA, 23 nt, Homo sapiens
gcagguuuguaaugcaaaaggcu

SEQ ID NO: 670258 - RNA, 22 nt, Homo sapiens
gcaguacauacgucugccaggg

SEQ ID NO: 670259 - RNA, 24 nt, Homo sapiens
gcaguagccuaacacacuccaaga

SEQ ID NO: 670260 - RNA, 13 nt, Homo sapiens
gcaguaguuuuca

SEQ ID NO: 670261 - RNA, 13 nt, Homo sapiens
gcaguauaagccu

SEQ ID NO: 670262 - RNA, 21 nt, Homo sapiens
gcaguaucaugcccugugcaa

SEQ ID NO: 670263 - RNA, 21 nt, Homo sapiens
gcaguaugugauggacugggg

SEQ ID NO: 670264 - RNA, 22 nt, Homo sapiens
gcagucagcccuuauggccaau

SEQ ID NO: 670265 - RNA, 16 nt, Homo sapiens
gcaguccacaaagcau

SEQ ID NO: 670266 - RNA, 17 nt, Homo sapiens
gcaguccauuuccuaau

SEQ ID NO: 670267 - RNA, 15 nt, Homo sapiens
gcagucccacacugu

SEQ ID NO: 670268 - RNA, 14 nt, Homo sapiens
gcaguccuccgggg

SEQ ID NO: 670269 - RNA, 20 nt, Homo sapiens
gcagucggugguaccugaga

SEQ ID NO: 670270 - RNA, 21 nt, Homo sapiens
gcagucggugguaccugagau

SEQ ID NO: 670271 - RNA, 23 nt, Homo sapiens
gcagucuugcaacagugccaugu

SEQ ID NO: 670272 - RNA, 19 nt, Homo sapiens
gcagugagcccagaucgca

SEQ ID NO: 670273 - RNA, 21 nt, Homo sapiens
gcagugagcugauaucaugcc

SEQ ID NO: 670274 - RNA, 21 nt, Homo sapiens
gcagugagcuguguucuugcc

SEQ ID NO: 670275 - RNA, 15 nt, Homo sapiens
gcagugauacaugua

SEQ ID NO: 670276 - RNA, 16 nt, Homo sapiens
gcagugauuagcacuu

SEQ ID NO: 670277 - RNA, 15 nt, Homo sapiens
gcagugcacauuuca

SEQ ID NO: 670278 - RNA, 23 nt, Homo sapiens
gcagugcaguauagaauaggcac

SEQ ID NO: 670279 - RNA, 12 nt, Homo sapiens
gcagugcccuuu

SEQ ID NO: 670280 - RNA, 14 nt, Homo sapiens
gcagugccuugcau

SEQ ID NO: 670281 - RNA, 12 nt, Homo sapiens
gcagugccuugu

SEQ ID NO: 670282 - RNA, 21 nt, Homo sapiens
gcagugccuugugcaauguga

SEQ ID NO: 670283 - RNA, 20 nt, Homo sapiens
gcagugggcccaagcaaggg

SEQ ID NO: 670284 - RNA, 21 nt, Homo sapiens
gcagugucuguaaaagagccu

SEQ ID NO: 670285 - RNA, 13 nt, Homo sapiens
gcagugucuguca

SEQ ID NO: 670286 - RNA, 17 nt, Homo sapiens
gcagugugaaaaguccu

SEQ ID NO: 670287 - RNA, 13 nt, Homo sapiens
gcaguuaauuuau

SEQ ID NO: 670288 - RNA, 18 nt, Homo sapiens
gcaguuagcucauuugag

SEQ ID NO: 670289 - RNA, 14 nt, Homo sapiens
gcaguuaggugcug

SEQ ID NO: 670290 - RNA, 19 nt, Homo sapiens
gcaguucagcuccuuccac

SEQ ID NO: 670291 - RNA, 19 nt, Homo sapiens
gcaguucccccaaccucag

SEQ ID NO: 670292 - RNA, 20 nt, Homo sapiens
gcaguucucgcagauguuac

SEQ ID NO: 670293 - RNA, 23 nt, Homo sapiens
gcaguucugaguguuuaauuuca

SEQ ID NO: 670294 - RNA, 18 nt, Homo sapiens
gcaguugaucagacugaa

SEQ ID NO: 670295 - RNA, 19 nt, Homo sapiens
gcaguuggacucucaggga

SEQ ID NO: 670296 - RNA, 19 nt, Homo sapiens
gcaguuggccaagcagaaa

SEQ ID NO: 670297 - RNA, 23 nt, Homo sapiens
gcaguuucauugugaucacugua

SEQ ID NO: 670298 - RNA, 19 nt, Homo sapiens
gcaguuucugacacuuguu

SEQ ID NO: 670299 - RNA, 18 nt, Homo sapiens
gcaguuugaagucaaaug

SEQ ID NO: 670300 - RNA, 19 nt, Homo sapiens
gcaguuuuagcagcacuuu

SEQ ID NO: 670301 - RNA, 15 nt, Homo sapiens
gcaguuuuucccaag

SEQ ID NO: 670302 - RNA, 15 nt, Homo sapiens
gcauaaaaaaaugau

SEQ ID NO: 670303 - RNA, 16 nt, Homo sapiens
gcauaaaaacauuuua

SEQ ID NO: 670304 - RNA, 20 nt, Homo sapiens
gcauaaagccaaauuuccag

SEQ ID NO: 670305 - RNA, 13 nt, Homo sapiens
gcauaaaugcauu

SEQ ID NO: 670306 - RNA, 16 nt, Homo sapiens
gcauaaauuacaguca

SEQ ID NO: 670307 - RNA, 20 nt, Homo sapiens
gcauaaauuacagucaucug

SEQ ID NO: 670308 - RNA, 16 nt, Homo sapiens
gcauaacuguucucau

SEQ ID NO: 670309 - RNA, 17 nt, Homo sapiens
gcauaagcuaucaccua

SEQ ID NO: 670310 - RNA, 20 nt, Homo sapiens
gcauaaguucuuaaugucaa

SEQ ID NO: 670311 - RNA, 21 nt, Homo sapiens
gcauaauguuucuggauuuca

SEQ ID NO: 670312 - RNA, 16 nt, Homo sapiens
gcauacuuucccucau

SEQ ID NO: 670313 - RNA, 20 nt, Homo sapiens
gcauacuuucccucauccau

SEQ ID NO: 670314 - RNA, 19 nt, Homo sapiens
gcauacuuugacaaggaaa

SEQ ID NO: 670315 - RNA, 16 nt, Homo sapiens
gcauagagguuuugua

SEQ ID NO: 670316 - RNA, 16 nt, Homo sapiens
gcauagauuugcagcu

SEQ ID NO: 670317 - RNA, 16 nt, Homo sapiens
gcauagcaagacacau

SEQ ID NO: 670318 - RNA, 23 nt, Homo sapiens
gcauaggaggggucuggacaugu

SEQ ID NO: 670319 - RNA, 16 nt, Homo sapiens
gcauaggucucuuugc

SEQ ID NO: 670320 - RNA, 21 nt, Homo sapiens
gcauaggucucuuugcuuucu

SEQ ID NO: 670321 - RNA, 13 nt, Homo sapiens
gcauaggugacag

SEQ ID NO: 670322 - RNA, 22 nt, Homo sapiens
gcauaguacuggcacaaaaaca

SEQ ID NO: 670323 - RNA, 14 nt, Homo sapiens
gcauagucuguucc

SEQ ID NO: 670324 - RNA, 23 nt, Homo sapiens
gcauauaacuuauauuguaagaa

SEQ ID NO: 670325 - RNA, 17 nt, Homo sapiens
gcauauagaaaacaaag

SEQ ID NO: 670326 - RNA, 23 nt, Homo sapiens
gcauaucccaccaaccuccagug

SEQ ID NO: 670327 - RNA, 15 nt, Homo sapiens
gcauaucugccuccc

SEQ ID NO: 670328 - RNA, 18 nt, Homo sapiens
gcauaugauagaugacaa

SEQ ID NO: 670329 - RNA, 20 nt, Homo sapiens
gcauaugcagccaaccaaga

SEQ ID NO: 670330 - RNA, 18 nt, Homo sapiens
gcauauuaagcacuuuaa

SEQ ID NO: 670331 - RNA, 23 nt, Homo sapiens
gcauauuuauccaaaauguguau

SEQ ID NO: 670332 - RNA, 17 nt, Homo sapiens
gcauauuuguuacuuua

SEQ ID NO: 670333 - RNA, 18 nt, Homo sapiens
gcaucaauacaaccagcc

SEQ ID NO: 670334 - RNA, 21 nt, Homo sapiens
gcacauauccaggcaccagga

SEQ ID NO: 670335 - RNA, 22 nt, Homo sapiens
gcacauauccaggcaccaggac

SEQ ID NO: 670336 - RNA, 23 nt, Homo sapiens
gcacauauccaggcaccaggacu

SEQ ID NO: 670337 - RNA, 22 nt, Homo sapiens
gcacauauggaauuuugcaaag

SEQ ID NO: 670338 - RNA, 12 nt, Homo sapiens
gcacaucaggag

SEQ ID NO: 670339 - RNA, 12 nt, Homo sapiens
gcacaugcagau

SEQ ID NO: 670340 - RNA, 13 nt, Homo sapiens
gcacauggugugg

SEQ ID NO: 670341 - RNA, 15 nt, Homo sapiens
gcacaugugugcgug

SEQ ID NO: 670342 - RNA, 11 nt, Homo sapiens
gcaccaaagac

SEQ ID NO: 670343 - RNA, 13 nt, Homo sapiens
gcaccaaauguca

SEQ ID NO: 670344 - RNA, 17 nt, Homo sapiens
gcaccaaaugucagaag

SEQ ID NO: 670345 - RNA, 12 nt, Homo sapiens
gcaccaacauca

SEQ ID NO: 670346 - RNA, 13 nt, Homo sapiens
gcaccaaccugca

SEQ ID NO: 670347 - RNA, 21 nt, Homo sapiens
gcaccaccaggagcagcagcc

SEQ ID NO: 670348 - RNA, 16 nt, Homo sapiens
gcaccacugcacucca

SEQ ID NO: 670349 - RNA, 15 nt, Homo sapiens
gcaccacuguguauu

SEQ ID NO: 670350 - RNA, 22 nt, Homo sapiens
gcaccagagagagauucuuccc

SEQ ID NO: 670351 - RNA, 19 nt, Homo sapiens
gcaccagagcaaccucuca

SEQ ID NO: 670352 - RNA, 23 nt, Homo sapiens
gcaccagagggauaaaaacaaua

SEQ ID NO: 670353 - RNA, 18 nt, Homo sapiens
gcaccagugugacaucua

SEQ ID NO: 670354 - RNA, 22 nt, Homo sapiens
gcaccaucauuuaaugugacag

SEQ ID NO: 670355 - RNA, 16 nt, Homo sapiens
gcaccaucuggaagga

SEQ ID NO: 670356 - RNA, 16 nt, Homo sapiens
gcaccaugcaaauguc

SEQ ID NO: 670357 - RNA, 17 nt, Homo sapiens
gcacccagcuccagggg

SEQ ID NO: 670358 - RNA, 20 nt, Homo sapiens
gcacccagcuuggcagaugu

SEQ ID NO: 670359 - RNA, 13 nt, Homo sapiens
gcaccccacugca

SEQ ID NO: 670360 - RNA, 13 nt, Homo sapiens
gcaccccaugcca

SEQ ID NO: 670361 - RNA, 15 nt, Homo sapiens
gcacccccuggagag

SEQ ID NO: 670362 - RNA, 13 nt, Homo sapiens
gcacccucaggga

SEQ ID NO: 670363 - RNA, 20 nt, Homo sapiens
gcacccugcgccuccagagg

SEQ ID NO: 670364 - RNA, 21 nt, Homo sapiens
gcacccugcgccuccagaggu

SEQ ID NO: 670365 - RNA, 14 nt, Homo sapiens
gcacccuggaaggg

SEQ ID NO: 670366 - RNA, 17 nt, Homo sapiens
gcacccuucuuuccucu

SEQ ID NO: 670367 - RNA, 14 nt, Homo sapiens
gcaccgucauggcu

SEQ ID NO: 670368 - RNA, 19 nt, Homo sapiens
gcaccuaccaucagggaca

SEQ ID NO: 670369 - RNA, 13 nt, Homo sapiens
gcaccuaccucac

SEQ ID NO: 670370 - RNA, 16 nt, Homo sapiens
gcaccuagcugugcaa

SEQ ID NO: 670371 - RNA, 16 nt, Homo sapiens
gcaccuccgcuugcca

SEQ ID NO: 670372 - RNA, 21 nt, Homo sapiens
gcaccucuagggccucuccag

SEQ ID NO: 670373 - RNA, 14 nt, Homo sapiens
gcaccucucaggau

SEQ ID NO: 670374 - RNA, 15 nt, Homo sapiens
gcaccucuguucauu

SEQ ID NO: 670375 - RNA, 16 nt, Homo sapiens
gcaccugacuuggcug

SEQ ID NO: 670376 - RNA, 22 nt, Homo sapiens
gcaccuggcuaguuucuaacau

SEQ ID NO: 670377 - RNA, 20 nt, Homo sapiens
gcaccugggacccugcacag

SEQ ID NO: 670378 - RNA, 16 nt, Homo sapiens
gcaccuguacucagga

SEQ ID NO: 670379 - RNA, 21 nt, Homo sapiens
gcaccuguagucccagcuacu

SEQ ID NO: 670380 - RNA, 18 nt, Homo sapiens
gcaccuuaccaacuuucu

SEQ ID NO: 670381 - RNA, 17 nt, Homo sapiens
gcaccuucuuucuggac

SEQ ID NO: 670382 - RNA, 13 nt, Homo sapiens
gagggcugcaguu

SEQ ID NO: 670383 - RNA, 20 nt, Homo sapiens
gagggcugcaguucuacuca

SEQ ID NO: 670384 - RNA, 22 nt, Homo sapiens
gagggcuuccucuagaagccaa

SEQ ID NO: 670385 - RNA, 19 nt, Homo sapiens
gaggggacucaaacagucu

SEQ ID NO: 670386 - RNA, 16 nt, Homo sapiens
gaggggagaguccagu

SEQ ID NO: 670387 - RNA, 14 nt, Homo sapiens
gaggggauucucua

SEQ ID NO: 670388 - RNA, 11 nt, Homo sapiens
gagggggaccu

SEQ ID NO: 670389 - RNA, 17 nt, Homo sapiens
gagggggccaggcggug

SEQ ID NO: 670390 - RNA, 14 nt, Homo sapiens
gagggggcgcugga

SEQ ID NO: 670391 - RNA, 19 nt, Homo sapiens
gagggggcuugaagccaaa

SEQ ID NO: 670392 - RNA, 17 nt, Homo sapiens
gaggggggcgggugacg

SEQ ID NO: 670393 - RNA, 21 nt, Homo sapiens
gaggggggggugggugagaga

SEQ ID NO: 670394 - RNA, 23 nt, Homo sapiens
gagggguguccgagaggcuggug

SEQ ID NO: 670395 - RNA, 18 nt, Homo sapiens
gagggucacgcuugccug

SEQ ID NO: 670396 - RNA, 12 nt, Homo sapiens
gagggugacaug

SEQ ID NO: 670397 - RNA, 21 nt, Homo sapiens
gagggugggaggcaaacacgc

SEQ ID NO: 670398 - RNA, 13 nt, Homo sapiens
gagguacucuccu

SEQ ID NO: 670399 - RNA, 13 nt, Homo sapiens
gaggucaccagcu

SEQ ID NO: 670400 - RNA, 19 nt, Homo sapiens
gaggucaccagcugcugug

SEQ ID NO: 670401 - RNA, 12 nt, Homo sapiens
gaggucacugga

SEQ ID NO: 670402 - RNA, 18 nt, Homo sapiens
gaggucagcauuugaucu

SEQ ID NO: 670403 - RNA, 23 nt, Homo sapiens
gaggucaggaguucgaaaccagc

SEQ ID NO: 670404 - RNA, 18 nt, Homo sapiens
gaggucaggaguucgaga

SEQ ID NO: 670405 - RNA, 19 nt, Homo sapiens
gagguccacaacacacaga

SEQ ID NO: 670406 - RNA, 18 nt, Homo sapiens
gaggucccucagcugcga

SEQ ID NO: 670407 - RNA, 11 nt, Homo sapiens
gaggucccuuc

SEQ ID NO: 670408 - RNA, 13 nt, Homo sapiens
gaggucccuucaa

SEQ ID NO: 670409 - RNA, 14 nt, Homo sapiens
gaggucuaaucuag

SEQ ID NO: 670410 - RNA, 13 nt, Homo sapiens
gaggugaaauuca

SEQ ID NO: 670411 - RNA, 16 nt, Homo sapiens
gaggugacacuguugg

SEQ ID NO: 670412 - RNA, 22 nt, Homo sapiens
gagguggauguuaugaacagcu

SEQ ID NO: 670413 - RNA, 18 nt, Homo sapiens
gagguggccccaccugag

SEQ ID NO: 670414 - RNA, 22 nt, Homo sapiens
gagguggcuucauguggcacuu

SEQ ID NO: 670415 - RNA, 15 nt, Homo sapiens
gaggugggaggugga

SEQ ID NO: 670416 - RNA, 20 nt, Homo sapiens
gaggugggguacauuucucu

SEQ ID NO: 670417 - RNA, 17 nt, Homo sapiens
gaggugggucuaccuca

SEQ ID NO: 670418 - RNA, 21 nt, Homo sapiens
gagguggguggaucaccugag

SEQ ID NO: 670419 - RNA, 16 nt, Homo sapiens
gagguuaaaaagaaaa

SEQ ID NO: 670420 - RNA, 15 nt, Homo sapiens
gagguuauaggucac

SEQ ID NO: 670421 - RNA, 23 nt, Homo sapiens
gagguuaucugucugcauuuuaa

SEQ ID NO: 670422 - RNA, 13 nt, Homo sapiens
gagguugaagcua

SEQ ID NO: 670423 - RNA, 14 nt, Homo sapiens
gagguugcagggag

SEQ ID NO: 670424 - RNA, 13 nt, Homo sapiens
gagguugcaguga

SEQ ID NO: 670425 - RNA, 14 nt, Homo sapiens
gagguuguggagaa

SEQ ID NO: 670426 - RNA, 21 nt, Homo sapiens
gagguuucugguauucacaga

SEQ ID NO: 670427 - RNA, 21 nt, Homo sapiens
gaguaaaacuguauaaacaaa

SEQ ID NO: 670428 - RNA, 18 nt, Homo sapiens
gaguaaauauauauguca

SEQ ID NO: 670429 - RNA, 13 nt, Homo sapiens
gaguaacaauaca

SEQ ID NO: 670430 - RNA, 22 nt, Homo sapiens
gaguaacuuucaaccuugccag

SEQ ID NO: 670431 - RNA, 16 nt, Homo sapiens
gaguaaggcacaccca

SEQ ID NO: 670432 - RNA, 18 nt, Homo sapiens
gaguaauacaucaaagag

SEQ ID NO: 670433 - RNA, 16 nt, Homo sapiens
gaguacagugagccaa

SEQ ID NO: 670434 - RNA, 22 nt, Homo sapiens
gaguaccuccagucacacuccc

SEQ ID NO: 670435 - RNA, 16 nt, Homo sapiens
gaguacucacuuuuca

SEQ ID NO: 670436 - RNA, 12 nt, Homo sapiens
gaguagcuggau

SEQ ID NO: 670437 - RNA, 14 nt, Homo sapiens
gaguagcugggauu

SEQ ID NO: 670438 - RNA, 18 nt, Homo sapiens
gaguaguauuaaaagcua

SEQ ID NO: 670439 - RNA, 14 nt, Homo sapiens
gaguauaauauuca

SEQ ID NO: 670440 - RNA, 12 nt, Homo sapiens
gaguauaccucc

SEQ ID NO: 670441 - RNA, 13 nt, Homo sapiens
gaguaucacuccc

SEQ ID NO: 670442 - RNA, 14 nt, Homo sapiens
gaguauccuaccca

SEQ ID NO: 670443 - RNA, 20 nt, Homo sapiens
gaguauuagcuuacccaaug

SEQ ID NO: 670444 - RNA, 14 nt, Homo sapiens
gagucacugauaca

SEQ ID NO: 670445 - RNA, 15 nt, Homo sapiens
caucauucaugacaa

SEQ ID NO: 670446 - RNA, 18 nt, Homo sapiens
caucauuccaaagcuaaa

SEQ ID NO: 670447 - RNA, 19 nt, Homo sapiens
caucauuggaaaugaaacu

SEQ ID NO: 670448 - RNA, 21 nt, Homo sapiens
caucauuuccugggagaaaga

SEQ ID NO: 670449 - RNA, 17 nt, Homo sapiens
caucauuuugcauucaa

SEQ ID NO: 670450 - RNA, 20 nt, Homo sapiens
caucauuuuugaugacuacc

SEQ ID NO: 670451 - RNA, 12 nt, Homo sapiens
cauccaaagcag

SEQ ID NO: 670452 - RNA, 20 nt, Homo sapiens
cauccaaaguucccuaugaa

SEQ ID NO: 670453 - RNA, 18 nt, Homo sapiens
cauccaaaucuagccaga

SEQ ID NO: 670454 - RNA, 22 nt, Homo sapiens
cauccacaggguuuugacacuu

SEQ ID NO: 670455 - RNA, 21 nt, Homo sapiens
cauccacuggguguaaacaca

SEQ ID NO: 670456 - RNA, 16 nt, Homo sapiens
cauccaggucuugacu

SEQ ID NO: 670457 - RNA, 15 nt, Homo sapiens
cauccauaaagaagc

SEQ ID NO: 670458 - RNA, 15 nt, Homo sapiens
cauccauaacugaac

SEQ ID NO: 670459 - RNA, 18 nt, Homo sapiens
caucccacgcuugcuuua

SEQ ID NO: 670460 - RNA, 17 nt, Homo sapiens
caucccacugacuguau

SEQ ID NO: 670461 - RNA, 22 nt, Homo sapiens
caucccaucucucccacuuccu

SEQ ID NO: 670462 - RNA, 16 nt, Homo sapiens
cauccccaacuccaug

SEQ ID NO: 670463 - RNA, 19 nt, Homo sapiens
caucccccaaaguucacaa

SEQ ID NO: 670464 - RNA, 21 nt, Homo sapiens
cauccccugaugcccagguca

SEQ ID NO: 670465 - RNA, 17 nt, Homo sapiens
cauccccuggacuggga

SEQ ID NO: 670466 - RNA, 19 nt, Homo sapiens
cauccccuuuguguagaaa

SEQ ID NO: 670467 - RNA, 17 nt, Homo sapiens
caucccgaagccaucac

SEQ ID NO: 670468 - RNA, 18 nt, Homo sapiens
caucccguaucacagugu

SEQ ID NO: 670469 - RNA, 15 nt, Homo sapiens
caucccuggaaggac

SEQ ID NO: 670470 - RNA, 14 nt, Homo sapiens
cauccgacugcccc

SEQ ID NO: 670471 - RNA, 17 nt, Homo sapiens
cuucuuuccuuuccauu

SEQ ID NO: 670472 - RNA, 17 nt, Homo sapiens
cuucuuuuggcuuccau

SEQ ID NO: 670473 - RNA, 16 nt, Homo sapiens
cuucuuuuucuggacu

SEQ ID NO: 670474 - RNA, 17 nt, Homo sapiens
cuucuuuuugcuucaaa

SEQ ID NO: 670475 - RNA, 18 nt, Homo sapiens
cuugaaaaaaaacagugg

SEQ ID NO: 670476 - RNA, 13 nt, Homo sapiens
cuugaaaagccuu

SEQ ID NO: 670477 - RNA, 23 nt, Homo sapiens
cuugaaaagcuaguguaccuccu

SEQ ID NO: 670478 - RNA, 22 nt, Homo sapiens
cuugaaaauaguaauaccugag

SEQ ID NO: 670479 - RNA, 13 nt, Homo sapiens
cuugaaaccaaag

SEQ ID NO: 670480 - RNA, 18 nt, Homo sapiens
cuugaaacguuugcccca

SEQ ID NO: 670481 - RNA, 12 nt, Homo sapiens
cuugaaauacca

SEQ ID NO: 670482 - RNA, 22 nt, Homo sapiens
cuugaaauaccagugaaccaaa

SEQ ID NO: 670483 - RNA, 12 nt, Homo sapiens
cuugaaaucuga

SEQ ID NO: 670484 - RNA, 13 nt, Homo sapiens
cuugaaaugaugg

SEQ ID NO: 670485 - RNA, 22 nt, Homo sapiens
cuugaaaugaugguaaguuaau

SEQ ID NO: 670486 - RNA, 14 nt, Homo sapiens
cuugaaaugcauua

SEQ ID NO: 670487 - RNA, 21 nt, Homo sapiens
cuugaaauucucaucagucca

SEQ ID NO: 670488 - RNA, 20 nt, Homo sapiens
cuugaacugaggcccuguga

SEQ ID NO: 670489 - RNA, 22 nt, Homo sapiens
cuugaagaaccucucacuucac

SEQ ID NO: 670490 - RNA, 15 nt, Homo sapiens
cuugaagaagggaga

SEQ ID NO: 670491 - RNA, 16 nt, Homo sapiens
cuugaagcaaaugugu

SEQ ID NO: 670492 - RNA, 21 nt, Homo sapiens
cuugaagcauuucaaagcccu

SEQ ID NO: 670493 - RNA, 17 nt, Homo sapiens
cuugaaggacuaauaga

SEQ ID NO: 670494 - RNA, 14 nt, Homo sapiens
cuugaauauuccug

SEQ ID NO: 670495 - RNA, 17 nt, Homo sapiens
cuugaaucaaagcaguu

SEQ ID NO: 670496 - RNA, 14 nt, Homo sapiens
cuugaaugcugcca

SEQ ID NO: 670497 - RNA, 15 nt, Homo sapiens
cuugaaugcugccag

SEQ ID NO: 670498 - RNA, 16 nt, Homo sapiens
cuugaauguggcuuga

SEQ ID NO: 670499 - RNA, 17 nt, Homo sapiens
cuugacaacagacugaa

SEQ ID NO: 670500 - RNA, 11 nt, Homo sapiens
cuugacagucu

SEQ ID NO: 670501 - RNA, 12 nt, Homo sapiens
cuugacauuuau

SEQ ID NO: 670502 - RNA, 18 nt, Homo sapiens
cuugaccaauacugaccc

SEQ ID NO: 670503 - RNA, 20 nt, Homo sapiens
cuugaccuaagggacuccca

SEQ ID NO: 670504 - RNA, 15 nt, Homo sapiens
cuugacucauggcag

SEQ ID NO: 670505 - RNA, 22 nt, Homo sapiens
cuugacuuagaccuauacugaa

SEQ ID NO: 670506 - RNA, 21 nt, Homo sapiens
cuugacuuuagucugcaaaau

SEQ ID NO: 670507 - RNA, 16 nt, Homo sapiens
cuugagaaagaucuaa

SEQ ID NO: 670508 - RNA, 19 nt, Homo sapiens
cuugagaccuggaaccaga

SEQ ID NO: 670509 - RNA, 21 nt, Homo sapiens
cuugagaggaugaauguaugu

SEQ ID NO: 670510 - RNA, 21 nt, Homo sapiens
cuugagcagaccgugauuugg

SEQ ID NO: 670511 - RNA, 20 nt, Homo sapiens
cuugagccacagucacugga

SEQ ID NO: 670512 - RNA, 20 nt, Homo sapiens
cuugagccaguaauuggucc

SEQ ID NO: 670513 - RNA, 12 nt, Homo sapiens
cuugagcccaaa

SEQ ID NO: 670514 - RNA, 15 nt, Homo sapiens
cuugagcuacaguag

SEQ ID NO: 670515 - RNA, 13 nt, Homo sapiens
cuugagcuugacc

SEQ ID NO: 670516 - RNA, 18 nt, Homo sapiens
cuugaggauguaaugcau

SEQ ID NO: 670517 - RNA, 15 nt, Homo sapiens
cuugaggauugugga

SEQ ID NO: 670518 - RNA, 14 nt, Homo sapiens
cuugaggccugugc

SEQ ID NO: 670519 - RNA, 23 nt, Homo sapiens
cuugagggcugcaguucuacuca

SEQ ID NO: 670520 - RNA, 21 nt, Homo sapiens
cuugaggggaagcuagucuuu

SEQ ID NO: 670521 - RNA, 17 nt, Homo sapiens
cuugagguggugccuuc

SEQ ID NO: 670522 - RNA, 18 nt, Homo sapiens
cuugaguaaaucuaaaga

SEQ ID NO: 670523 - RNA, 14 nt, Homo sapiens
cuugaguguguuac

SEQ ID NO: 670524 - RNA, 14 nt, Homo sapiens
cuugaguucccaga

SEQ ID NO: 670525 - RNA, 16 nt, Homo sapiens
cuugaguugccugaug

SEQ ID NO: 670526 - RNA, 15 nt, Homo sapiens
cuugauaauacuuga

SEQ ID NO: 670527 - RNA, 22 nt, Homo sapiens
cuugauaaugggaugaauggaa

SEQ ID NO: 670528 - RNA, 18 nt, Homo sapiens
cuugauacauguaauucu

SEQ ID NO: 670529 - RNA, 14 nt, Homo sapiens
cuugauaucauuca

SEQ ID NO: 670530 - RNA, 15 nt, Homo sapiens
cuugauaugaccugu

SEQ ID NO: 670531 - RNA, 21 nt, Homo sapiens
cuugauauguaaguacuucca

SEQ ID NO: 670532 - RNA, 22 nt, Homo sapiens
cuugauauguaaguacuuccac

SEQ ID NO: 670533 - RNA, 16 nt, Homo sapiens
cuugauauuuuccaaa

SEQ ID NO: 670534 - RNA, 17 nt, Homo sapiens
cuugauccacagaaaua

SEQ ID NO: 670535 - RNA, 13 nt, Homo sapiens
cuugaucuguaua

SEQ ID NO: 670536 - RNA, 18 nt, Homo sapiens
cuugaucuguauauacaa

SEQ ID NO: 670537 - RNA, 15 nt, Homo sapiens
cuugaugacauuuca

SEQ ID NO: 670538 - RNA, 19 nt, Homo sapiens
cuugaugacauuucacuga

SEQ ID NO: 670539 - RNA, 18 nt, Homo sapiens
cuugaugcuagaaaggaa

SEQ ID NO: 670540 - RNA, 15 nt, Homo sapiens
cuugaugggugcugc

SEQ ID NO: 670541 - RNA, 15 nt, Homo sapiens
cuugaugugccauuu

SEQ ID NO: 670542 - RNA, 20 nt, Homo sapiens
cuugauguuccaccugccac

SEQ ID NO: 670543 - RNA, 17 nt, Homo sapiens
cuugauucugcaguaaa

SEQ ID NO: 670544 - RNA, 14 nt, Homo sapiens
cuugauugucuccu

SEQ ID NO: 670545 - RNA, 16 nt, Homo sapiens
cuugauuuuuauaugu

SEQ ID NO: 670546 - RNA, 13 nt, Homo sapiens
cuugauuuuugcc

SEQ ID NO: 670547 - RNA, 16 nt, Homo sapiens
cuugcaaagcgacaga

SEQ ID NO: 670548 - RNA, 19 nt, Homo sapiens
cuugcaacacacagacaca

SEQ ID NO: 670549 - RNA, 13 nt, Homo sapiens
cuugcaagcaaau

SEQ ID NO: 670550 - RNA, 16 nt, Homo sapiens
cuugcaauguagucaa

SEQ ID NO: 670551 - RNA, 14 nt, Homo sapiens
cuugcacacuuccc

SEQ ID NO: 670552 - RNA, 13 nt, Homo sapiens
cuugcacagccaa

SEQ ID NO: 670553 - RNA, 17 nt, Homo sapiens
cuugcaccucagccucc

SEQ ID NO: 670554 - RNA, 20 nt, Homo sapiens
cuugcacgcccaugugugag

SEQ ID NO: 670555 - RNA, 12 nt, Homo sapiens
cuugcacugaau

SEQ ID NO: 670556 - RNA, 18 nt, Homo sapiens
cuugcagcugauguugga

SEQ ID NO: 670557 - RNA, 14 nt, Homo sapiens
cuugcagggccguu

SEQ ID NO: 670558 - RNA, 21 nt, Homo sapiens
cuugcagucucccagauguug

SEQ ID NO: 670559 - RNA, 16 nt, Homo sapiens
cuugcaguugcucuga

SEQ ID NO: 670560 - RNA, 17 nt, Homo sapiens
cuugcaguugcucugac

SEQ ID NO: 670561 - RNA, 19 nt, Homo sapiens
cuugcauacaccacugcaa

SEQ ID NO: 670562 - RNA, 17 nt, Homo sapiens
cuugcauaggcucuuaa

SEQ ID NO: 670563 - RNA, 18 nt, Homo sapiens
cuugcaucaagggcuuua

SEQ ID NO: 670564 - RNA, 20 nt, Homo sapiens
cuugccaagcagugcacauu

SEQ ID NO: 670565 - RNA, 13 nt, Homo sapiens
cuugccaggcucc

SEQ ID NO: 670566 - RNA, 18 nt, Homo sapiens
cuugccagggcagggucu

SEQ ID NO: 670567 - RNA, 19 nt, Homo sapiens
gacaaucaugaaauaugca

SEQ ID NO: 670568 - RNA, 22 nt, Homo sapiens
gacaauccccacauaccaucug

SEQ ID NO: 670569 - RNA, 16 nt, Homo sapiens
gacaaugaugaugaua

SEQ ID NO: 670570 - RNA, 23 nt, Homo sapiens
gacaauguugcauuuaugaugca

SEQ ID NO: 670571 - RNA, 18 nt, Homo sapiens
gacacagacaaagugaca

SEQ ID NO: 670572 - RNA, 14 nt, Homo sapiens
gacacagacuggca

SEQ ID NO: 670573 - RNA, 17 nt, Homo sapiens
gacacagacuggcaaua

SEQ ID NO: 670574 - RNA, 19 nt, Homo sapiens
gacacagaucccacuggaa

SEQ ID NO: 670575 - RNA, 13 nt, Homo sapiens
gacacagccuccc

SEQ ID NO: 670576 - RNA, 13 nt, Homo sapiens
gacacaggaaaaa

SEQ ID NO: 670577 - RNA, 17 nt, Homo sapiens
gacacaggucuuuccua

SEQ ID NO: 670578 - RNA, 13 nt, Homo sapiens
gacacaguaaaau

SEQ ID NO: 670579 - RNA, 20 nt, Homo sapiens
gacacaucuauugcagagac

SEQ ID NO: 670580 - RNA, 21 nt, Homo sapiens
gacacauuaaugauaaacuca

SEQ ID NO: 670581 - RNA, 23 nt, Homo sapiens
gacacauuagccuugaacaacca

SEQ ID NO: 670582 - RNA, 20 nt, Homo sapiens
gacacauucaggaguuaaau

SEQ ID NO: 670583 - RNA, 12 nt, Homo sapiens
gacacauuggac

SEQ ID NO: 670584 - RNA, 13 nt, Homo sapiens
gacaccaccaagg

SEQ ID NO: 670585 - RNA, 17 nt, Homo sapiens
gacacccugaucuucac

SEQ ID NO: 670586 - RNA, 20 nt, Homo sapiens
gacaccgucgaccaggaaag

SEQ ID NO: 670587 - RNA, 19 nt, Homo sapiens
gacaccucccccuacccau

SEQ ID NO: 670588 - RNA, 13 nt, Homo sapiens
gacaccuccuucu

SEQ ID NO: 670589 - RNA, 17 nt, Homo sapiens
gacaccuguacauucuu

SEQ ID NO: 670590 - RNA, 16 nt, Homo sapiens
gacacgaagccuuauu

SEQ ID NO: 670591 - RNA, 21 nt, Homo sapiens
gacacuacacccagcaauaga

SEQ ID NO: 670592 - RNA, 16 nt, Homo sapiens
gacacuauucauuuga

SEQ ID NO: 670593 - RNA, 20 nt, Homo sapiens
gacacuauuuaucugugcaa

SEQ ID NO: 670594 - RNA, 12 nt, Homo sapiens
gacacucagggc

SEQ ID NO: 670595 - RNA, 21 nt, Homo sapiens
gacacugaaaguuuuguaaaa

SEQ ID NO: 670596 - RNA, 20 nt, Homo sapiens
gacacugaggagauacugaa

SEQ ID NO: 670597 - RNA, 13 nt, Homo sapiens
gacacugcuuuaa

SEQ ID NO: 670598 - RNA, 20 nt, Homo sapiens
gacacuggugguucuacuga

SEQ ID NO: 670599 - RNA, 24 nt, Homo sapiens
gacacuggugguucuacugaccca

SEQ ID NO: 670600 - RNA, 20 nt, Homo sapiens
gacacuguggagacuuucug

SEQ ID NO: 670601 - RNA, 14 nt, Homo sapiens
gacacuguugcaaa

SEQ ID NO: 670602 - RNA, 15 nt, Homo sapiens
gacagaaagagacag

SEQ ID NO: 670603 - RNA, 18 nt, Homo sapiens
gacagaacaccuaugcaa

SEQ ID NO: 670604 - RNA, 17 nt, Homo sapiens
gacagaaggugccacuu

SEQ ID NO: 670605 - RNA, 23 nt, Homo sapiens
gacagaaggugccacuuuaccca

SEQ ID NO: 670606 - RNA, 23 nt, Homo sapiens
gacagaauaaugaauggacucaa

SEQ ID NO: 670607 - RNA, 11 nt, Homo sapiens
gacagacaccg

SEQ ID NO: 670608 - RNA, 17 nt, Homo sapiens
gacagacaggcucuuag

SEQ ID NO: 670609 - RNA, 22 nt, Homo sapiens
gacagaccacagagcugucacu

SEQ ID NO: 670610 - RNA, 15 nt, Homo sapiens
gacagacccucugcc

SEQ ID NO: 670611 - RNA, 22 nt, Homo sapiens
gacagagccaggagaagcucag

SEQ ID NO: 670612 - RNA, 22 nt, Homo sapiens
gacagaggacaauggcuuccau

SEQ ID NO: 670613 - RNA, 16 nt, Homo sapiens
gacagagggcucaccu

SEQ ID NO: 670614 - RNA, 22 nt, Homo sapiens
gacagagggcucaccucuugcc

SEQ ID NO: 670615 - RNA, 14 nt, Homo sapiens
gacagauaccucca

SEQ ID NO: 670616 - RNA, 23 nt, Homo sapiens
gacagauggacgcaggcccuguc

SEQ ID NO: 670617 - RNA, 21 nt, Homo sapiens
gacagauuccaggcgaugugc

SEQ ID NO: 670618 - RNA, 23 nt, Homo sapiens
gacagauuccaggcgaugugcaa

SEQ ID NO: 670619 - RNA, 20 nt, Homo sapiens
gacagccaggagcucuccau

SEQ ID NO: 670620 - RNA, 14 nt, Homo sapiens
gacagcccaucacc

SEQ ID NO: 670621 - RNA, 15 nt, Homo sapiens
gacagcccuccuuga

SEQ ID NO: 670622 - RNA, 15 nt, Homo sapiens
gacagccugcagcag

SEQ ID NO: 670623 - RNA, 18 nt, Homo sapiens
gacagcuuguggcuuuuu

SEQ ID NO: 670624 - RNA, 15 nt, Homo sapiens
gacagcuuugcugcu

SEQ ID NO: 670625 - RNA, 15 nt, Homo sapiens
gacaggaauacuuaa

SEQ ID NO: 670626 - RNA, 18 nt, Homo sapiens
gacaggcagccuggacau

SEQ ID NO: 670627 - RNA, 13 nt, Homo sapiens
gacaggcucuuag

SEQ ID NO: 670628 - RNA, 16 nt, Homo sapiens
gacagggaaaggucag

SEQ ID NO: 670629 - RNA, 21 nt, Homo sapiens
gacagggacaugcccugugug

SEQ ID NO: 670630 - RNA, 11 nt, Homo sapiens
gacagggccag

SEQ ID NO: 670631 - RNA, 17 nt, Homo sapiens
gacagggccagugcagu

SEQ ID NO: 670632 - RNA, 13 nt, Homo sapiens
gacaggucaguag

SEQ ID NO: 670633 - RNA, 15 nt, Homo sapiens
gacaguacacuguca

SEQ ID NO: 670634 - RNA, 14 nt, Homo sapiens
gacaguauugccac

SEQ ID NO: 670635 - RNA, 20 nt, Homo sapiens
gacagucauaaauacuguca

SEQ ID NO: 670636 - RNA, 20 nt, Homo sapiens
gacaguccaaaccacuccac

SEQ ID NO: 670637 - RNA, 18 nt, Homo sapiens
gacagucgagaagccagg

SEQ ID NO: 670638 - RNA, 21 nt, Homo sapiens
gacagucgcucagucuguuca

SEQ ID NO: 670639 - RNA, 18 nt, Homo sapiens
gacagucguucccagugu

SEQ ID NO: 670640 - RNA, 18 nt, Homo sapiens
gacagucuagcugccuca

SEQ ID NO: 670641 - RNA, 15 nt, Homo sapiens
gacagucucccugau

SEQ ID NO: 670642 - RNA, 20 nt, Homo sapiens
gacagucuggccacugucaa

SEQ ID NO: 670643 - RNA, 16 nt, Homo sapiens
gacagucuguuaugca

SEQ ID NO: 670644 - RNA, 21 nt, Homo sapiens
gacagugaagcagcacuguga

SEQ ID NO: 670645 - RNA, 14 nt, Homo sapiens
gacagugcauuugc

SEQ ID NO: 670646 - RNA, 16 nt, Homo sapiens
gacagugcauuugccu

SEQ ID NO: 670647 - RNA, 15 nt, Homo sapiens
gacagugccucuucc

SEQ ID NO: 670648 - RNA, 16 nt, Homo sapiens
gacaguuaaguauuuu

SEQ ID NO: 670649 - RNA, 18 nt, Homo sapiens
gacaguuuacuuugccaa

SEQ ID NO: 670650 - RNA, 22 nt, Homo sapiens
gacaguuuguggcaucuugcca

SEQ ID NO: 670651 - RNA, 18 nt, Homo sapiens
gacaguuuucaccaucuc

SEQ ID NO: 670652 - RNA, 17 nt, Homo sapiens
gacauacauauuaucuc

SEQ ID NO: 670653 - RNA, 18 nt, Homo sapiens
gacauacauauuaucuca

SEQ ID NO: 670654 - RNA, 19 nt, Homo sapiens
gacauacauauuaucucau

SEQ ID NO: 670655 - RNA, 17 nt, Homo sapiens
gacauacuuaaugcaua

SEQ ID NO: 670656 - RNA, 16 nt, Homo sapiens
gacauagaagagccaa

SEQ ID NO: 670657 - RNA, 21 nt, Homo sapiens
gacauagccaacugcuguuca

SEQ ID NO: 670658 - RNA, 15 nt, Homo sapiens
gacauauacuaagau

SEQ ID NO: 670659 - RNA, 22 nt, Homo sapiens
gacauauacuaagauguucacu

SEQ ID NO: 670660 - RNA, 14 nt, Homo sapiens
gacaucaaaaugag

SEQ ID NO: 670661 - RNA, 22 nt, Homo sapiens
gacaucaacauggcaauugcac

SEQ ID NO: 670662 - RNA, 18 nt, Homo sapiens
gacauccagcgugacgga

SEQ ID NO: 670663 - RNA, 11 nt, Homo sapiens
gacaucugccu

SEQ ID NO: 670664 - RNA, 12 nt, Homo sapiens
gacaugaacuac

SEQ ID NO: 670665 - RNA, 16 nt, Homo sapiens
gacaugagaaagggag

SEQ ID NO: 670666 - RNA, 16 nt, Homo sapiens
gacaugagccacugca

SEQ ID NO: 670667 - RNA, 24 nt, Homo sapiens
gacaugaucgcuuucuacacugua

SEQ ID NO: 670668 - RNA, 18 nt, Homo sapiens
gacaugauuuccuugaau

SEQ ID NO: 670669 - RNA, 20 nt, Homo sapiens
gacaugcuaaccucucugaa

SEQ ID NO: 670670 - RNA, 12 nt, Homo sapiens
gacauggcucac

SEQ ID NO: 670671 - RNA, 15 nt, Homo sapiens
gacaugugacauuua

SEQ ID NO: 670672 - RNA, 21 nt, Homo sapiens
gacaugugguuacuaguacag

SEQ ID NO: 670673 - RNA, 13 nt, Homo sapiens
gacauuaacucau

SEQ ID NO: 670674 - RNA, 20 nt, Homo sapiens
gacauuacaauccugcauug

SEQ ID NO: 670675 - RNA, 16 nt, Homo sapiens
gacauuacuuguuuua

SEQ ID NO: 670676 - RNA, 16 nt, Homo sapiens
gacauuccuucuccca

SEQ ID NO: 670677 - RNA, 17 nt, Homo sapiens
gacauucuaugcuuaca

SEQ ID NO: 670678 - RNA, 17 nt, Homo sapiens
gacauucuuagcuguaa

SEQ ID NO: 670679 - RNA, 15 nt, Homo sapiens
gacauugaaagugaa

SEQ ID NO: 670680 - RNA, 16 nt, Homo sapiens
gacauuggacuuccuc

SEQ ID NO: 670681 - RNA, 17 nt, Homo sapiens
gacauuguggacuguau

SEQ ID NO: 670682 - RNA, 22 nt, Homo sapiens
gacauuuauccaagaccugaaa

SEQ ID NO: 670683 - RNA, 18 nt, Homo sapiens
gacauuuuuucagucaua

SEQ ID NO: 670684 - RNA, 21 nt, Homo sapiens
gaccaaaaaggggacaaagga

SEQ ID NO: 670685 - RNA, 23 nt, Homo sapiens
gaccaaccugggcaacauaguga

SEQ ID NO: 670686 - RNA, 13 nt, Homo sapiens
gaccaagagcaau

SEQ ID NO: 670687 - RNA, 20 nt, Homo sapiens
gaccaagagcaauugcagca

SEQ ID NO: 670688 - RNA, 14 nt, Homo sapiens
gaccaauaccuccu

SEQ ID NO: 670689 - RNA, 15 nt, Homo sapiens
gacucuaguccuugg

SEQ ID NO: 670690 - RNA, 12 nt, Homo sapiens
gacucucaggga

SEQ ID NO: 670691 - RNA, 23 nt, Homo sapiens
gacucugaaaaacauuccaggaa

SEQ ID NO: 670692 - RNA, 16 nt, Homo sapiens
gacucugcuucagucc

SEQ ID NO: 670693 - RNA, 21 nt, Homo sapiens
gacucuggaaguuuucuagca

SEQ ID NO: 670694 - RNA, 14 nt, Homo sapiens
gacucugguguucu

SEQ ID NO: 670695 - RNA, 13 nt, Homo sapiens
gacucuucagucu

SEQ ID NO: 670696 - RNA, 18 nt, Homo sapiens
gacugaaacgccuugcac

SEQ ID NO: 670697 - RNA, 14 nt, Homo sapiens
gacugaaacuggaa

SEQ ID NO: 670698 - RNA, 19 nt, Homo sapiens
gacugaaggggcacaccac

SEQ ID NO: 670699 - RNA, 17 nt, Homo sapiens
gacugaauuaaugagaa

SEQ ID NO: 670700 - RNA, 18 nt, Homo sapiens
gacugaauucugccuugg

SEQ ID NO: 670701 - RNA, 11 nt, Homo sapiens
gacugacauuu

SEQ ID NO: 670702 - RNA, 22 nt, Homo sapiens
gacugacauuuuuuccuaagga

SEQ ID NO: 670703 - RNA, 17 nt, Homo sapiens
gacugacccccaucuga

SEQ ID NO: 670704 - RNA, 23 nt, Homo sapiens
gacugacugggcgugguggcuca

SEQ ID NO: 670705 - RNA, 13 nt, Homo sapiens
gacugaggugccu

SEQ ID NO: 670706 - RNA, 12 nt, Homo sapiens
gacugaugccag

SEQ ID NO: 670707 - RNA, 23 nt, Homo sapiens
gacugauggcgauucccucucac

SEQ ID NO: 670708 - RNA, 18 nt, Homo sapiens
gacugaugggacaucaaa

SEQ ID NO: 670709 - RNA, 14 nt, Homo sapiens
gacugauguguaua

SEQ ID NO: 670710 - RNA, 18 nt, Homo sapiens
gacugauugauuauucaa

SEQ ID NO: 670711 - RNA, 17 nt, Homo sapiens
gacugcacaggugacaa

SEQ ID NO: 670712 - RNA, 16 nt, Homo sapiens
gacugcagacauucuc

SEQ ID NO: 670713 - RNA, 14 nt, Homo sapiens
gacugccacauaau

SEQ ID NO: 670714 - RNA, 21 nt, Homo sapiens
gacugccaugcuagacaagcu

SEQ ID NO: 670715 - RNA, 18 nt, Homo sapiens
gacugcccagccacucca

SEQ ID NO: 670716 - RNA, 11 nt, Homo sapiens
gacugcugcuc

SEQ ID NO: 670717 - RNA, 22 nt, Homo sapiens
gacugcuggcaugcagugcccu

SEQ ID NO: 670718 - RNA, 16 nt, Homo sapiens
gacuggacgugcucag

SEQ ID NO: 670719 - RNA, 19 nt, Homo sapiens
gacuggacgugcucagaca

SEQ ID NO: 670720 - RNA, 17 nt, Homo sapiens
gacuggauguaccacca

SEQ ID NO: 670721 - RNA, 20 nt, Homo sapiens
gacuggcaauaaacuccuac

SEQ ID NO: 670722 - RNA, 19 nt, Homo sapiens
gacuggccucaaagcaagc

SEQ ID NO: 670723 - RNA, 16 nt, Homo sapiens
gacugggcaacacugc

SEQ ID NO: 670724 - RNA, 17 nt, Homo sapiens
gacuggggagggcugca

SEQ ID NO: 670725 - RNA, 16 nt, Homo sapiens
gacuggggauggcgca

SEQ ID NO: 670726 - RNA, 21 nt, Homo sapiens
gacugggugagacccaaagcg

SEQ ID NO: 670727 - RNA, 20 nt, Homo sapiens
gacuggguuuugugauugcc

SEQ ID NO: 670728 - RNA, 17 nt, Homo sapiens
gacugguuagugaugca

SEQ ID NO: 670729 - RNA, 20 nt, Homo sapiens
gacugguuagugaugcaguu

SEQ ID NO: 670730 - RNA, 13 nt, Homo sapiens
gacuguagaagaa

SEQ ID NO: 670731 - RNA, 14 nt, Homo sapiens
gacugucaguucuc

SEQ ID NO: 670732 - RNA, 13 nt, Homo sapiens
gacugugaccacc

SEQ ID NO: 670733 - RNA, 17 nt, Homo sapiens
gacugugcucacuaccu

SEQ ID NO: 670734 - RNA, 14 nt, Homo sapiens
gacugugcugagaa

SEQ ID NO: 670735 - RNA, 16 nt, Homo sapiens
gacuguggccuguuaa

SEQ ID NO: 670736 - RNA, 16 nt, Homo sapiens
gacuguucaagcaaaa

SEQ ID NO: 670737 - RNA, 18 nt, Homo sapiens
gacuguucuuuuacaaga

SEQ ID NO: 670738 - RNA, 13 nt, Homo sapiens
gacuguugcucaa

SEQ ID NO: 670739 - RNA, 14 nt, Homo sapiens
gacuguugcucaaa

SEQ ID NO: 670740 - RNA, 16 nt, Homo sapiens
gacuguuuggcuuaua

SEQ ID NO: 670741 - RNA, 21 nt, Homo sapiens
gacuguuuucaauaacaaagc

SEQ ID NO: 670742 - RNA, 16 nt, Homo sapiens
gacuguuuuuuuugca

SEQ ID NO: 670743 - RNA, 15 nt, Homo sapiens
gacuuaccuguucag

SEQ ID NO: 670744 - RNA, 16 nt, Homo sapiens
gacuuagagcugggaa

SEQ ID NO: 670745 - RNA, 17 nt, Homo sapiens
gacuuauuaggacuuug

SEQ ID NO: 670746 - RNA, 19 nt, Homo sapiens
gacuuauuaggacuuugaa

SEQ ID NO: 670747 - RNA, 21 nt, Homo sapiens
gacuuauuaugcauaaagcca

SEQ ID NO: 670748 - RNA, 14 nt, Homo sapiens
gacuucaaugauag

SEQ ID NO: 670749 - RNA, 13 nt, Homo sapiens
gacuucacacugc

SEQ ID NO: 670750 - RNA, 22 nt, Homo sapiens
gacuucaugacaagcauuuugu

SEQ ID NO: 670751 - RNA, 19 nt, Homo sapiens
gacuucccaacagccuuag

SEQ ID NO: 670752 - RNA, 15 nt, Homo sapiens
gacuucccacuguuc

SEQ ID NO: 670753 - RNA, 19 nt, Homo sapiens
gacuuccuaugugugcauu

SEQ ID NO: 670754 - RNA, 19 nt, Homo sapiens
gacuuccucagagcgagaa

SEQ ID NO: 670755 - RNA, 20 nt, Homo sapiens
gacuuccucugccacucccu

SEQ ID NO: 670756 - RNA, 16 nt, Homo sapiens
gacuuccuggggcccc

SEQ ID NO: 670757 - RNA, 10 nt, Homo sapiens
gacuuccuug

SEQ ID NO: 670758 - RNA, 16 nt, Homo sapiens
gacuucuaccugcccu

SEQ ID NO: 670759 - RNA, 13 nt, Homo sapiens
gacuucugcugaa

SEQ ID NO: 670760 - RNA, 16 nt, Homo sapiens
gacuucuggcagggaa

SEQ ID NO: 670761 - RNA, 21 nt, Homo sapiens
gacuucuuuacuaacacuggc

SEQ ID NO: 670762 - RNA, 14 nt, Homo sapiens
gagagcaggacagg

SEQ ID NO: 670763 - RNA, 16 nt, Homo sapiens
gagagccaccaagagg

SEQ ID NO: 670764 - RNA, 18 nt, Homo sapiens
gagagccagcccacagau

SEQ ID NO: 670765 - RNA, 17 nt, Homo sapiens
gagagccuggugcugcu

SEQ ID NO: 670766 - RNA, 15 nt, Homo sapiens
gagagccuugguuca

SEQ ID NO: 670767 - RNA, 19 nt, Homo sapiens
gagagcgcuuuugucugca

SEQ ID NO: 670768 - RNA, 18 nt, Homo sapiens
gagagcuagagggacaaa

SEQ ID NO: 670769 - RNA, 15 nt, Homo sapiens
gagagcuguauuaag

SEQ ID NO: 670770 - RNA, 18 nt, Homo sapiens
gagagcuugcugugacua

SEQ ID NO: 670771 - RNA, 18 nt, Homo sapiens
gagagcuuuucacuguga

SEQ ID NO: 670772 - RNA, 23 nt, Homo sapiens
gagaggaaaaguaaggugcaguu

SEQ ID NO: 670773 - RNA, 15 nt, Homo sapiens
gagaggauacauuua

SEQ ID NO: 670774 - RNA, 13 nt, Homo sapiens
gagaggccucauc

SEQ ID NO: 670775 - RNA, 18 nt, Homo sapiens
gagagggaagagugcauu

SEQ ID NO: 670776 - RNA, 16 nt, Homo sapiens
gagagggcaaagggau

SEQ ID NO: 670777 - RNA, 13 nt, Homo sapiens
gagaggggggcca

SEQ ID NO: 670778 - RNA, 14 nt, Homo sapiens
gagagggugacaag

SEQ ID NO: 670779 - RNA, 11 nt, Homo sapiens
gagaguaccau

SEQ ID NO: 670780 - RNA, 17 nt, Homo sapiens
gagagugagcaaccagc

SEQ ID NO: 670781 - RNA, 13 nt, Homo sapiens
gagagugcacugc

SEQ ID NO: 670782 - RNA, 22 nt, Homo sapiens
gagaguggcaggugggcugccu

SEQ ID NO: 670783 - RNA, 14 nt, Homo sapiens
gagagugugcucuc

SEQ ID NO: 670784 - RNA, 17 nt, Homo sapiens
gagagugugcucucccc

SEQ ID NO: 670785 - RNA, 13 nt, Homo sapiens
gagaguuugccug

SEQ ID NO: 670786 - RNA, 16 nt, Homo sapiens
gagauaaaccaauaaa

SEQ ID NO: 670787 - RNA, 20 nt, Homo sapiens
gagauaaauuuaaagucuaa

SEQ ID NO: 670788 - RNA, 21 nt, Homo sapiens
gagauaacagccucuugcccg

SEQ ID NO: 670789 - RNA, 18 nt, Homo sapiens
gagauaagaucuauagcc

SEQ ID NO: 670790 - RNA, 19 nt, Homo sapiens
gagauacugaacauuuugc

SEQ ID NO: 670791 - RNA, 13 nt, Homo sapiens
gagauacuuugca

SEQ ID NO: 670792 - RNA, 23 nt, Homo sapiens
gagauagaagaacugcaaaggua

SEQ ID NO: 670793 - RNA, 19 nt, Homo sapiens
gagauagcauugugaacug

SEQ ID NO: 670794 - RNA, 21 nt, Homo sapiens
gagauaggccugugggccaga

SEQ ID NO: 670795 - RNA, 17 nt, Homo sapiens
gagauaggggcagauag

SEQ ID NO: 670796 - RNA, 12 nt, Homo sapiens
gagauaguucua

SEQ ID NO: 670797 - RNA, 15 nt, Homo sapiens
gagauauacauugug

SEQ ID NO: 670798 - RNA, 16 nt, Homo sapiens
gagaucgagaccaucc

SEQ ID NO: 670799 - RNA, 20 nt, Homo sapiens
gagaucgcgccacugcacuc

SEQ ID NO: 670800 - RNA, 20 nt, Homo sapiens
gagaucgcgccauugcacuc

SEQ ID NO: 670801 - RNA, 20 nt, Homo sapiens
gagaucgugcuacugcacuc

SEQ ID NO: 670802 - RNA, 21 nt, Homo sapiens
gagaucgugcuacugcacucc

SEQ ID NO: 670803 - RNA, 20 nt, Homo sapiens
gagaucguuguuuacagugu

SEQ ID NO: 670804 - RNA, 20 nt, Homo sapiens
gagaucugcaggcugccucu

SEQ ID NO: 670805 - RNA, 14 nt, Homo sapiens
gagaucuugaucca

SEQ ID NO: 670806 - RNA, 21 nt, Homo sapiens
gagaucuuucuuuccaaaaca

SEQ ID NO: 670807 - RNA, 18 nt, Homo sapiens
gagaugacccaaucugcc

SEQ ID NO: 670808 - RNA, 14 nt, Homo sapiens
gagaugagaagcca

SEQ ID NO: 670809 - RNA, 18 nt, Homo sapiens
gagaugagggaugggccu

SEQ ID NO: 670810 - RNA, 16 nt, Homo sapiens
gagaugaguugcaguu

SEQ ID NO: 670811 - RNA, 13 nt, Homo sapiens
gagaugcagcuac

SEQ ID NO: 670812 - RNA, 18 nt, Homo sapiens
gagaugccacuucucacu

SEQ ID NO: 670813 - RNA, 17 nt, Homo sapiens
gagaugcggccaagaua

SEQ ID NO: 670814 - RNA, 21 nt, Homo sapiens
gagaugcuucucuccuugccc

SEQ ID NO: 670815 - RNA, 22 nt, Homo sapiens
gagaugggaaagcggcgccaca

SEQ ID NO: 670816 - RNA, 16 nt, Homo sapiens
ccacccaauuggccca

SEQ ID NO: 670817 - RNA, 15 nt, Homo sapiens
ccacccacaaucaca

SEQ ID NO: 670818 - RNA, 20 nt, Homo sapiens
ccacccacaaucacaagaag

SEQ ID NO: 670819 - RNA, 16 nt, Homo sapiens
ccacccauggggagga

SEQ ID NO: 670820 - RNA, 13 nt, Homo sapiens
ccaccccagcuca

SEQ ID NO: 670821 - RNA, 19 nt, Homo sapiens
ccaccccccacucagugcc

SEQ ID NO: 670822 - RNA, 14 nt, Homo sapiens
ccacccccuguucc

SEQ ID NO: 670823 - RNA, 17 nt, Homo sapiens
ccacccgcccacagcca

SEQ ID NO: 670824 - RNA, 20 nt, Homo sapiens
ccacccguaggcagccucuc

SEQ ID NO: 670825 - RNA, 13 nt, Homo sapiens
ccacccuaguccc

SEQ ID NO: 670826 - RNA, 21 nt, Homo sapiens
ccacccucugggaguccccau

SEQ ID NO: 670827 - RNA, 13 nt, Homo sapiens
ccacccugcauuu

SEQ ID NO: 670828 - RNA, 13 nt, Homo sapiens
ccacccugcucau

SEQ ID NO: 670829 - RNA, 21 nt, Homo sapiens
ccaccgauggagcccccagau

SEQ ID NO: 670830 - RNA, 14 nt, Homo sapiens
ccaccgcagcuacu

SEQ ID NO: 670831 - RNA, 13 nt, Homo sapiens
ccaccuaauauca

SEQ ID NO: 670832 - RNA, 22 nt, Homo sapiens
ccaccuagagcuagaugugucu

SEQ ID NO: 670833 - RNA, 24 nt, Homo sapiens
ccaccuagagguagguaggaucau

SEQ ID NO: 670834 - RNA, 17 nt, Homo sapiens
ccaccuauaccaauauu

SEQ ID NO: 670835 - RNA, 20 nt, Homo sapiens
ccaccuaugccuguggugaa

SEQ ID NO: 670836 - RNA, 16 nt, Homo sapiens
ccaccucccucugcca

SEQ ID NO: 670837 - RNA, 20 nt, Homo sapiens
ccaccucggcacacacugug

SEQ ID NO: 670838 - RNA, 21 nt, Homo sapiens
ccaccucggcacacacugugc

SEQ ID NO: 670839 - RNA, 22 nt, Homo sapiens
ccaccucggcacacacugugcc

SEQ ID NO: 670840 - RNA, 16 nt, Homo sapiens
ccaccugaaagccugu

SEQ ID NO: 670841 - RNA, 16 nt, Homo sapiens
ccaccugacacaccag

SEQ ID NO: 670842 - RNA, 21 nt, Homo sapiens
ccaccugacauguccuucuga

SEQ ID NO: 670843 - RNA, 12 nt, Homo sapiens
ccaccugccauu

SEQ ID NO: 670844 - RNA, 15 nt, Homo sapiens
ccaccugcccaucac

SEQ ID NO: 670845 - RNA, 22 nt, Homo sapiens
ccaccugccugcaucugugaaa

SEQ ID NO: 670846 - RNA, 19 nt, Homo sapiens
ccaccugcuggagugaagg

SEQ ID NO: 670847 - RNA, 18 nt, Homo sapiens
ccaccuguagcugaagca

SEQ ID NO: 670848 - RNA, 13 nt, Homo sapiens
ccaccugucucag

SEQ ID NO: 670849 - RNA, 17 nt, Homo sapiens
ccaccugugcugcugca

SEQ ID NO: 670850 - RNA, 19 nt, Homo sapiens
ccaccuuggucccucucag

SEQ ID NO: 670851 - RNA, 20 nt, Homo sapiens
ccaccuuugggaucagccuc

SEQ ID NO: 670852 - RNA, 17 nt, Homo sapiens
ccacgauucucccaaag

SEQ ID NO: 670853 - RNA, 21 nt, Homo sapiens
ccacgcagaggacgcacgcuc

SEQ ID NO: 670854 - RNA, 20 nt, Homo sapiens
ccacgcauacacacaugccc

SEQ ID NO: 670855 - RNA, 18 nt, Homo sapiens
ccacgccucuugaccagg

SEQ ID NO: 670856 - RNA, 13 nt, Homo sapiens
ccacgcugaccau

SEQ ID NO: 670857 - RNA, 21 nt, Homo sapiens
ccacgcugauaauaugcaaau

SEQ ID NO: 670858 - RNA, 18 nt, Homo sapiens
ccacggacgccaccugcg

SEQ ID NO: 670859 - RNA, 17 nt, Homo sapiens
ccacgggggcaguguga

SEQ ID NO: 670860 - RNA, 20 nt, Homo sapiens
ccacguaugugaaacacaca

SEQ ID NO: 670861 - RNA, 16 nt, Homo sapiens
ccacgucaacagaauu

SEQ ID NO: 670862 - RNA, 14 nt, Homo sapiens
ccacguucagggag

SEQ ID NO: 670863 - RNA, 12 nt, Homo sapiens
ccacuaaacuac

SEQ ID NO: 670864 - RNA, 22 nt, Homo sapiens
ccacuaauuguguacauaugua

SEQ ID NO: 670865 - RNA, 14 nt, Homo sapiens
ccacuacacuccag

SEQ ID NO: 670866 - RNA, 19 nt, Homo sapiens
ccacuaccguaaaugucca

SEQ ID NO: 670867 - RNA, 12 nt, Homo sapiens
ccacuacugcag

SEQ ID NO: 670868 - RNA, 12 nt, Homo sapiens
ccacuacuguag

SEQ ID NO: 670869 - RNA, 20 nt, Homo sapiens
ccacuagaagcaacuaggaa

SEQ ID NO: 670870 - RNA, 16 nt, Homo sapiens
ccacuaggacucugag

SEQ ID NO: 670871 - RNA, 15 nt, Homo sapiens
ccacuagguggugcu

SEQ ID NO: 670872 - RNA, 22 nt, Homo sapiens
ccacucacaaccccugcuccag

SEQ ID NO: 670873 - RNA, 16 nt, Homo sapiens
ccacucacuuugcaau

SEQ ID NO: 670874 - RNA, 18 nt, Homo sapiens
ccacucaggauugggaau

SEQ ID NO: 670875 - RNA, 20 nt, Homo sapiens
ccacucagguucuucagggc

SEQ ID NO: 670876 - RNA, 15 nt, Homo sapiens
ccacuccacccuguu

SEQ ID NO: 670877 - RNA, 22 nt, Homo sapiens
ccacuccagcccgcagcacauu

SEQ ID NO: 670878 - RNA, 15 nt, Homo sapiens
ccacuccagcuccuu

SEQ ID NO: 670879 - RNA, 16 nt, Homo sapiens
ccacuccagcucugag

SEQ ID NO: 670880 - RNA, 12 nt, Homo sapiens
ccacuccagugc

SEQ ID NO: 670881 - RNA, 23 nt, Homo sapiens
ccacuccucucccuugagggaua

SEQ ID NO: 670882 - RNA, 16 nt, Homo sapiens
ccacuccucugacuca

SEQ ID NO: 670883 - RNA, 19 nt, Homo sapiens
ccacucggggcaggccagc

SEQ ID NO: 670884 - RNA, 17 nt, Homo sapiens
gagccagccuugcagua

SEQ ID NO: 670885 - RNA, 23 nt, Homo sapiens
gagccagcucucucuacccggcc

SEQ ID NO: 670886 - RNA, 15 nt, Homo sapiens
gagccaguggugcua

SEQ ID NO: 670887 - RNA, 18 nt, Homo sapiens
gagccauauaaguuugaa

SEQ ID NO: 670888 - RNA, 19 nt, Homo sapiens
gagccauauuaauugccug

SEQ ID NO: 670889 - RNA, 15 nt, Homo sapiens
gagccaugcugggaa

SEQ ID NO: 670890 - RNA, 18 nt, Homo sapiens
gagcccagagaagcugga

SEQ ID NO: 670891 - RNA, 16 nt, Homo sapiens
gagcccauacucagcc

SEQ ID NO: 670892 - RNA, 17 nt, Homo sapiens
gagcccauccagucucc

SEQ ID NO: 670893 - RNA, 21 nt, Homo sapiens
gagcccauuucaauucucaaa

SEQ ID NO: 670894 - RNA, 16 nt, Homo sapiens
gagccccagcuacccu

SEQ ID NO: 670895 - RNA, 15 nt, Homo sapiens
gagcccccaccacaa

SEQ ID NO: 670896 - RNA, 14 nt, Homo sapiens
gagcccccuugaca

SEQ ID NO: 670897 - RNA, 22 nt, Homo sapiens
gagccccuccucccccggcugg

SEQ ID NO: 670898 - RNA, 19 nt, Homo sapiens
gagcccuaagcauugacuu

SEQ ID NO: 670899 - RNA, 22 nt, Homo sapiens
gagcccuaagcauugacuucuc

SEQ ID NO: 670900 - RNA, 19 nt, Homo sapiens
gagcccuucucuuugacuu

SEQ ID NO: 670901 - RNA, 21 nt, Homo sapiens
gagccgagauugcaccacugc

SEQ ID NO: 670902 - RNA, 19 nt, Homo sapiens
gagccgccugcuucuucuc

SEQ ID NO: 670903 - RNA, 12 nt, Homo sapiens
gagccgcuguga

SEQ ID NO: 670904 - RNA, 15 nt, Homo sapiens
gagccggagcucaug

SEQ ID NO: 670905 - RNA, 20 nt, Homo sapiens
gagccgugaacugugcauag

SEQ ID NO: 670906 - RNA, 20 nt, Homo sapiens
gagccuaccuucaccaccua

SEQ ID NO: 670907 - RNA, 22 nt, Homo sapiens
gagccuaccuucaccaccuaua

SEQ ID NO: 670908 - RNA, 17 nt, Homo sapiens
gagccucacagcaguga

SEQ ID NO: 670909 - RNA, 23 nt, Homo sapiens
gagccuccaugccuggcccaggu

SEQ ID NO: 670910 - RNA, 19 nt, Homo sapiens
gagccuccugggaacacau

SEQ ID NO: 670911 - RNA, 21 nt, Homo sapiens
gagccucgccccuccaguguu

SEQ ID NO: 670912 - RNA, 14 nt, Homo sapiens
gagccucgggacau

SEQ ID NO: 670913 - RNA, 12 nt, Homo sapiens
gagccucuuagu

SEQ ID NO: 670914 - RNA, 16 nt, Homo sapiens
gagccugcauucugca

SEQ ID NO: 670915 - RNA, 15 nt, Homo sapiens
gagccuggaacugca

SEQ ID NO: 670916 - RNA, 17 nt, Homo sapiens
gagccuggaacugcauc

SEQ ID NO: 670917 - RNA, 16 nt, Homo sapiens
gagccuggcaagaaug

SEQ ID NO: 670918 - RNA, 13 nt, Homo sapiens
gagccugguccca

SEQ ID NO: 670919 - RNA, 23 nt, Homo sapiens
gagccuguaaacuuuaucacuua

SEQ ID NO: 670920 - RNA, 18 nt, Homo sapiens
gagccuguguuagugucu

SEQ ID NO: 670921 - RNA, 18 nt, Homo sapiens
gagccuugcugggccagg

SEQ ID NO: 670922 - RNA, 22 nt, Homo sapiens
gagccuuuccucaaaacuggag

SEQ ID NO: 670923 - RNA, 12 nt, Homo sapiens
gagcgaggucag

SEQ ID NO: 670924 - RNA, 21 nt, Homo sapiens
gagcgccggauuugcucccac

SEQ ID NO: 670925 - RNA, 16 nt, Homo sapiens
gagcgucacggccaag

SEQ ID NO: 670926 - RNA, 14 nt, Homo sapiens
gagcgucaggguug

SEQ ID NO: 670927 - RNA, 12 nt, Homo sapiens
gagcguuugcac

SEQ ID NO: 670928 - RNA, 12 nt, Homo sapiens
gagcuaagucac

SEQ ID NO: 670929 - RNA, 17 nt, Homo sapiens
gagcuagaaacucagga

SEQ ID NO: 670930 - RNA, 21 nt, Homo sapiens
gagcucacaugggacugggau

SEQ ID NO: 670931 - RNA, 22 nt, Homo sapiens
gagcucccaccucccuucccac

SEQ ID NO: 670932 - RNA, 19 nt, Homo sapiens
gagcuccccagaucuccca

SEQ ID NO: 670933 - RNA, 16 nt, Homo sapiens
gagcuccugggacccu

SEQ ID NO: 670934 - RNA, 17 nt, Homo sapiens
gagcucuagcaagggag

SEQ ID NO: 670935 - RNA, 16 nt, Homo sapiens
gagcugagcacuuuug

SEQ ID NO: 670936 - RNA, 14 nt, Homo sapiens
gagcugagccucuc

SEQ ID NO: 670937 - RNA, 22 nt, Homo sapiens
gagcugagguuuagaugugcaa

SEQ ID NO: 670938 - RNA, 21 nt, Homo sapiens
gagcugaugccccuucucccc

SEQ ID NO: 670939 - RNA, 18 nt, Homo sapiens
gagcugcacaaagucagc

SEQ ID NO: 670940 - RNA, 22 nt, Homo sapiens
gagcugcacugaucacccaaug

SEQ ID NO: 670941 - RNA, 19 nt, Homo sapiens
gagcugcagaaugacucca

SEQ ID NO: 670942 - RNA, 14 nt, Homo sapiens
gagcugcagggugg

SEQ ID NO: 670943 - RNA, 15 nt, Homo sapiens
gagcugcagguuccu

SEQ ID NO: 670944 - RNA, 20 nt, Homo sapiens
gagcugccucuucucuugac

SEQ ID NO: 670945 - RNA, 16 nt, Homo sapiens
gagcugcucaccggag

SEQ ID NO: 670946 - RNA, 17 nt, Homo sapiens
gagcuggggggcgugga

SEQ ID NO: 670947 - RNA, 22 nt, Homo sapiens
gagcugguuccucucucccacc

SEQ ID NO: 670948 - RNA, 20 nt, Homo sapiens
gagcuguaucuugauguuua

SEQ ID NO: 670949 - RNA, 16 nt, Homo sapiens
gagcugucugaacuca

SEQ ID NO: 670950 - RNA, 18 nt, Homo sapiens
gagcuguucgcuccuccc

SEQ ID NO: 670951 - RNA, 19 nt, Homo sapiens
gagcuuaaacagaagcagc

SEQ ID NO: 670952 - RNA, 15 nt, Homo sapiens
gagcuuaaucuuuga

SEQ ID NO: 670953 - RNA, 13 nt, Homo sapiens
gagcuuagcauau

SEQ ID NO: 670954 - RNA, 21 nt, Homo sapiens
gagcuuccccaagcacggugu

SEQ ID NO: 670955 - RNA, 21 nt, Homo sapiens
gagcuucccugacucauucug

SEQ ID NO: 670956 - RNA, 12 nt, Homo sapiens
gagcuucugggg

SEQ ID NO: 670957 - RNA, 19 nt, Homo sapiens
gagcuugacaccuggugcu

SEQ ID NO: 670958 - RNA, 15 nt, Homo sapiens
gagcuugaucuguga

SEQ ID NO: 670959 - RNA, 19 nt, Homo sapiens
gagcuuguggaguugauga

SEQ ID NO: 670960 - RNA, 16 nt, Homo sapiens
gagcuuucaucauuca

SEQ ID NO: 670961 - RNA, 22 nt, Homo sapiens
gagcuuugguaaucucugugaa

SEQ ID NO: 670962 - RNA, 17 nt, Homo sapiens
gagcuuugucacuugcc

SEQ ID NO: 670963 - RNA, 22 nt, Homo sapiens
gagcuuugugcuugucauucca

SEQ ID NO: 670964 - RNA, 20 nt, Homo sapiens
gagcuuuuuaauagcacuaa

SEQ ID NO: 670965 - RNA, 22 nt, Homo sapiens
gaggaaaaggccccugcaaugu

SEQ ID NO: 670966 - RNA, 15 nt, Homo sapiens
gaggaaacucaccug

SEQ ID NO: 670967 - RNA, 17 nt, Homo sapiens
gaggaaagagaguuugu

SEQ ID NO: 670968 - RNA, 13 nt, Homo sapiens
gaggaacaagcau

SEQ ID NO: 670969 - RNA, 13 nt, Homo sapiens
gaggaacacugca

SEQ ID NO: 670970 - RNA, 16 nt, Homo sapiens
gaggaagccuauuuga

SEQ ID NO: 670971 - RNA, 23 nt, Homo sapiens
gaggaagggcaaaaccacuagaa

SEQ ID NO: 670972 - RNA, 20 nt, Homo sapiens
gaggaaugcuggacuggagg

SEQ ID NO: 670973 - RNA, 23 nt, Homo sapiens
gaggaauuucuugauuaauguug

SEQ ID NO: 670974 - RNA, 20 nt, Homo sapiens
gaggacacaggcagcuucca

SEQ ID NO: 670975 - RNA, 18 nt, Homo sapiens
gaggacagcucuggggua

SEQ ID NO: 670976 - RNA, 17 nt, Homo sapiens
gaggacaggaaaggccc

SEQ ID NO: 670977 - RNA, 19 nt, Homo sapiens
gaggacauaaugggguccu

SEQ ID NO: 670978 - RNA, 21 nt, Homo sapiens
gaggacauugaaagugaaaua

SEQ ID NO: 670979 - RNA, 20 nt, Homo sapiens
gaggacuuaguuugugaugu

SEQ ID NO: 670980 - RNA, 13 nt, Homo sapiens
gaggacuuuggua

SEQ ID NO: 670981 - RNA, 15 nt, Homo sapiens
gaggagaacaaaaug

SEQ ID NO: 670982 - RNA, 15 nt, Homo sapiens
gaggagaagcaaugg

SEQ ID NO: 670983 - RNA, 14 nt, Homo sapiens
gaggagaccuuuga

SEQ ID NO: 670984 - RNA, 19 nt, Homo sapiens
gaggagcaacagcuggaag

SEQ ID NO: 670985 - RNA, 21 nt, Homo sapiens
gaggagcagccucgaggcugg

SEQ ID NO: 670986 - RNA, 16 nt, Homo sapiens
gaggagccaccaguuc

SEQ ID NO: 670987 - RNA, 20 nt, Homo sapiens
gaggagccggugcucuggaa

SEQ ID NO: 670988 - RNA, 15 nt, Homo sapiens
gaggaggaagucaug

SEQ ID NO: 670989 - RNA, 14 nt, Homo sapiens
gaggaggggaccaa

SEQ ID NO: 670990 - RNA, 17 nt, Homo sapiens
gaggagguucacugagc

SEQ ID NO: 670991 - RNA, 15 nt, Homo sapiens
gaggaguaaaauuca

SEQ ID NO: 670992 - RNA, 15 nt, Homo sapiens
gaggaguaccgccag

SEQ ID NO: 670993 - RNA, 17 nt, Homo sapiens
gaggaucuccuguccau

SEQ ID NO: 670994 - RNA, 16 nt, Homo sapiens
gaggaugaugccaguu

SEQ ID NO: 670995 - RNA, 18 nt, Homo sapiens
gaggaugggucagagcua

SEQ ID NO: 670996 - RNA, 16 nt, Homo sapiens
gaggauucugugccuc

SEQ ID NO: 670997 - RNA, 19 nt, Homo sapiens
gaggauugcuugagcucag

SEQ ID NO: 670998 - RNA, 15 nt, Homo sapiens
gaggcaagaaaagga

SEQ ID NO: 670999 - RNA, 14 nt, Homo sapiens
gaggcaaugggagc

SEQ ID NO: 671000 - RNA, 19 nt, Homo sapiens
gaggcacaacgcaccagac

SEQ ID NO: 671001 - RNA, 19 nt, Homo sapiens
gaggcagagguuacagguu

SEQ ID NO: 671002 - RNA, 23 nt, Homo sapiens
gaggcagcaccaccacacaguca

SEQ ID NO: 671003 - RNA, 22 nt, Homo sapiens
gaggcaggagaaucgcuugaac

SEQ ID NO: 671004 - RNA, 20 nt, Homo sapiens
gaggcaggagaauugcuuga

SEQ ID NO: 671005 - RNA, 22 nt, Homo sapiens
auuaaaacauauuucauuuuaa

SEQ ID NO: 671006 - RNA, 13 nt, Homo sapiens
auuaaaaccugau

SEQ ID NO: 671007 - RNA, 14 nt, Homo sapiens
auuaaaaccugaua

SEQ ID NO: 671008 - RNA, 19 nt, Homo sapiens
auuaaaacucauaauuauu

SEQ ID NO: 671009 - RNA, 13 nt, Homo sapiens
auuaaaagaaucc

SEQ ID NO: 671010 - RNA, 14 nt, Homo sapiens
auuaaaauacuuag

SEQ ID NO: 671011 - RNA, 13 nt, Homo sapiens
auuaaaauagcau

SEQ ID NO: 671012 - RNA, 16 nt, Homo sapiens
auuaaaaucuggaaau

SEQ ID NO: 671013 - RNA, 13 nt, Homo sapiens
auuaaaauuccaa

SEQ ID NO: 671014 - RNA, 12 nt, Homo sapiens
auuaaacaaaua

SEQ ID NO: 671015 - RNA, 22 nt, Homo sapiens
auuaaacguguaaauugcacag

SEQ ID NO: 671016 - RNA, 19 nt, Homo sapiens
auuaaagcucuucauuucu

SEQ ID NO: 671017 - RNA, 12 nt, Homo sapiens
auuaaagugaua

SEQ ID NO: 671018 - RNA, 22 nt, Homo sapiens
auuaaauaaagguacacaugga

SEQ ID NO: 671019 - RNA, 15 nt, Homo sapiens
auuaaauauauacug

SEQ ID NO: 671020 - RNA, 18 nt, Homo sapiens
auuaaauggaucacugau

SEQ ID NO: 671021 - RNA, 15 nt, Homo sapiens
auuaaauuuaacucu

SEQ ID NO: 671022 - RNA, 13 nt, Homo sapiens
auuaacaaacauc

SEQ ID NO: 671023 - RNA, 15 nt, Homo sapiens
auuaacaaagugcca

SEQ ID NO: 671024 - RNA, 19 nt, Homo sapiens
auuaacaaaugugcugcuu

SEQ ID NO: 671025 - RNA, 17 nt, Homo sapiens
auuaacauaauauaugu

SEQ ID NO: 671026 - RNA, 14 nt, Homo sapiens
auuaacaucaucuu

SEQ ID NO: 671027 - RNA, 16 nt, Homo sapiens
auuaaccacuucagcu

SEQ ID NO: 671028 - RNA, 22 nt, Homo sapiens
auuaaccucugcacuacugaca

SEQ ID NO: 671029 - RNA, 17 nt, Homo sapiens
auuaacgggcauguauu

SEQ ID NO: 671030 - RNA, 16 nt, Homo sapiens
auuaacuuacuuccaa

SEQ ID NO: 671031 - RNA, 23 nt, Homo sapiens
auuaacuuuaauguuuuuugcca

SEQ ID NO: 671032 - RNA, 15 nt, Homo sapiens
auuaagaagcaauaa

SEQ ID NO: 671033 - RNA, 14 nt, Homo sapiens
auuaagaaugccag

SEQ ID NO: 671034 - RNA, 20 nt, Homo sapiens
auuaagaauugguugccaua

SEQ ID NO: 671035 - RNA, 15 nt, Homo sapiens
auuaagacaguguac

SEQ ID NO: 671036 - RNA, 14 nt, Homo sapiens
auuaagcacuuuaa

SEQ ID NO: 671037 - RNA, 21 nt, Homo sapiens
auuaagcccaauuaauuccug

SEQ ID NO: 671038 - RNA, 21 nt, Homo sapiens
auuaaggguaggauguugcuu

SEQ ID NO: 671039 - RNA, 17 nt, Homo sapiens
auuaagguaacuacugc

SEQ ID NO: 671040 - RNA, 17 nt, Homo sapiens
auuaaguccuacuuuac

SEQ ID NO: 671041 - RNA, 14 nt, Homo sapiens
auuaaguggcuuuu

SEQ ID NO: 671042 - RNA, 23 nt, Homo sapiens
auuaaguggcuuuuuaacaugaa

SEQ ID NO: 671043 - RNA, 18 nt, Homo sapiens
auuaagugguuacuuugu

SEQ ID NO: 671044 - RNA, 20 nt, Homo sapiens
auuaauaaagauggcacuuu

SEQ ID NO: 671045 - RNA, 14 nt, Homo sapiens
auuaauaaagcauu

SEQ ID NO: 671046 - RNA, 23 nt, Homo sapiens
auuaauaacgucuuuuuauaucu

SEQ ID NO: 671047 - RNA, 13 nt, Homo sapiens
auuaauaccaaag

SEQ ID NO: 671048 - RNA, 13 nt, Homo sapiens
auuaauagcuuuu

SEQ ID NO: 671049 - RNA, 17 nt, Homo sapiens
auuaauagcuuuugauu

SEQ ID NO: 671050 - RNA, 18 nt, Homo sapiens
auuaauaguucaguguau

SEQ ID NO: 671051 - RNA, 14 nt, Homo sapiens
auuaaucaaaggca

SEQ ID NO: 671052 - RNA, 12 nt, Homo sapiens
auuaaugaacau

SEQ ID NO: 671053 - RNA, 22 nt, Homo sapiens
auuaaugacaaaggcacugagg

SEQ ID NO: 671054 - RNA, 18 nt, Homo sapiens
auuaaugagaauuccuua

SEQ ID NO: 671055 - RNA, 17 nt, Homo sapiens
auuaaugcauuuugcug

SEQ ID NO: 671056 - RNA, 23 nt, Homo sapiens
auuaaugcuauacuggaaaugua

SEQ ID NO: 671057 - RNA, 20 nt, Homo sapiens
auuaauguguuaagugcagg

SEQ ID NO: 671058 - RNA, 13 nt, Homo sapiens
auuaauguuaaca

SEQ ID NO: 671059 - RNA, 13 nt, Homo sapiens
auuaauguuaauu

SEQ ID NO: 671060 - RNA, 21 nt, Homo sapiens
auuaauguuuauuuagcucug

SEQ ID NO: 671061 - RNA, 19 nt, Homo sapiens
auuaauguuucuucuccaa

SEQ ID NO: 671062 - RNA, 12 nt, Homo sapiens
auuaauucaccu

SEQ ID NO: 671063 - RNA, 19 nt, Homo sapiens
auuaauuccaacuguacuu

SEQ ID NO: 671064 - RNA, 15 nt, Homo sapiens
auuaauucuucaccu

SEQ ID NO: 671065 - RNA, 17 nt, Homo sapiens
auuaauugccuguuaaa

SEQ ID NO: 671066 - RNA, 17 nt, Homo sapiens
auuaauugucauuauuu

SEQ ID NO: 671067 - RNA, 19 nt, Homo sapiens
auuaauugugugucacaag

SEQ ID NO: 671068 - RNA, 18 nt, Homo sapiens
auuaauuuaccaccaaua

SEQ ID NO: 671069 - RNA, 23 nt, Homo sapiens
auuaauuuucuugguucuuucag

SEQ ID NO: 671070 - RNA, 20 nt, Homo sapiens
auuaauuuugauauaaucuu

SEQ ID NO: 671071 - RNA, 13 nt, Homo sapiens
auuacaaaugcaa

SEQ ID NO: 671072 - RNA, 13 nt, Homo sapiens
auuacaagcccug

SEQ ID NO: 671073 - RNA, 17 nt, Homo sapiens
auuacaagccuacauga

SEQ ID NO: 671074 - RNA, 21 nt, Homo sapiens
auuacaaggcuuuaucucagg

SEQ ID NO: 671075 - RNA, 13 nt, Homo sapiens
auuacaaguggcu

SEQ ID NO: 671076 - RNA, 19 nt, Homo sapiens
auuacaauccugcauuguu

SEQ ID NO: 671077 - RNA, 14 nt, Homo sapiens
auuacaauguaucu

SEQ ID NO: 671078 - RNA, 23 nt, Homo sapiens
ccccucauccgauuccccuguag

SEQ ID NO: 671079 - RNA, 13 nt, Homo sapiens
ccccucaucucau

SEQ ID NO: 671080 - RNA, 17 nt, Homo sapiens
ccccuccacuggggaau

SEQ ID NO: 671081 - RNA, 12 nt, Homo sapiens
ccccuccacugu

SEQ ID NO: 671082 - RNA, 18 nt, Homo sapiens
ccccucgugcgcaucuca

SEQ ID NO: 671083 - RNA, 13 nt, Homo sapiens
ccccucucaccaa

SEQ ID NO: 671084 - RNA, 13 nt, Homo sapiens
ccccucugccuuu

SEQ ID NO: 671085 - RNA, 12 nt, Homo sapiens
ccccucuggaau

SEQ ID NO: 671086 - RNA, 15 nt, Homo sapiens
ccccugaacugcugu

SEQ ID NO: 671087 - RNA, 18 nt, Homo sapiens
ccccugagcuugcagaga

SEQ ID NO: 671088 - RNA, 14 nt, Homo sapiens
ccccugcaaaaaga

SEQ ID NO: 671089 - RNA, 14 nt, Homo sapiens
ccccugcuccagaa

SEQ ID NO: 671090 - RNA, 15 nt, Homo sapiens
ccccuggaccgcuuu

SEQ ID NO: 671091 - RNA, 22 nt, Homo sapiens
ccccuggacuauggugcuguau

SEQ ID NO: 671092 - RNA, 23 nt, Homo sapiens
ccccugggcaagagaugggacaa

SEQ ID NO: 671093 - RNA, 19 nt, Homo sapiens
ccccugggcccuugugcuc

SEQ ID NO: 671094 - RNA, 20 nt, Homo sapiens
ccccuguagacuagugccgu

SEQ ID NO: 671095 - RNA, 16 nt, Homo sapiens
ccccuguagcagucac

SEQ ID NO: 671096 - RNA, 22 nt, Homo sapiens
ccccuuaaggguugaaggcagu

SEQ ID NO: 671097 - RNA, 22 nt, Homo sapiens
ccccuuaggucgcgcucuugca

SEQ ID NO: 671098 - RNA, 22 nt, Homo sapiens
ccccuuauccaggacucuguca

SEQ ID NO: 671099 - RNA, 23 nt, Homo sapiens
ccccuuauccaggacucugucaa

SEQ ID NO: 671100 - RNA, 17 nt, Homo sapiens
ccccuuauccuucuccc

SEQ ID NO: 671101 - RNA, 22 nt, Homo sapiens
ccccuuccagaucacugccaca

SEQ ID NO: 671102 - RNA, 18 nt, Homo sapiens
ccccuugccagacaugug

SEQ ID NO: 671103 - RNA, 17 nt, Homo sapiens
ccccuugucugcacugu

SEQ ID NO: 671104 - RNA, 16 nt, Homo sapiens
ccccuuucacacugga

SEQ ID NO: 671105 - RNA, 14 nt, Homo sapiens
cccgaagggagcau

SEQ ID NO: 671106 - RNA, 16 nt, Homo sapiens
cccgaaguccugucac

SEQ ID NO: 671107 - RNA, 23 nt, Homo sapiens
cccgaaguccugucacugagcac

SEQ ID NO: 671108 - RNA, 13 nt, Homo sapiens
cccgaaugcauuu

SEQ ID NO: 671109 - RNA, 15 nt, Homo sapiens
cccgaaugccuguca

SEQ ID NO: 671110 - RNA, 17 nt, Homo sapiens
cccgaauuuagucacac

SEQ ID NO: 671111 - RNA, 22 nt, Homo sapiens
cccgagaguggguguuggacag

SEQ ID NO: 671112 - RNA, 12 nt, Homo sapiens
cccgaguagcau

SEQ ID NO: 671113 - RNA, 15 nt, Homo sapiens
cccgagugagcaugg

SEQ ID NO: 671114 - RNA, 20 nt, Homo sapiens
cccgauccccgacaguggcu

SEQ ID NO: 671115 - RNA, 17 nt, Homo sapiens
cccgcagggccaugcag

SEQ ID NO: 671116 - RNA, 22 nt, Homo sapiens
cccgccuccacucuaguucuag

SEQ ID NO: 671117 - RNA, 22 nt, Homo sapiens
cccgccucuucuucuucagaag

SEQ ID NO: 671118 - RNA, 23 nt, Homo sapiens
cccgcuauuaucagaucaugccc

SEQ ID NO: 671119 - RNA, 22 nt, Homo sapiens
cccgcugccucuuggcuucuca

SEQ ID NO: 671120 - RNA, 23 nt, Homo sapiens
cccgcugggauuucuucgcugcu

SEQ ID NO: 671121 - RNA, 20 nt, Homo sapiens
cccgcuuuuccuuucugcca

SEQ ID NO: 671122 - RNA, 21 nt, Homo sapiens
cccggacucaccaacuugcca

SEQ ID NO: 671123 - RNA, 19 nt, Homo sapiens
cccggaugugaauggcaug

SEQ ID NO: 671124 - RNA, 17 nt, Homo sapiens
cccggcgccgggcacca

SEQ ID NO: 671125 - RNA, 20 nt, Homo sapiens
cccggggcauggacagggcc

SEQ ID NO: 671126 - RNA, 17 nt, Homo sapiens
cccggggcuccacugaa

SEQ ID NO: 671127 - RNA, 12 nt, Homo sapiens
auauugcuaaaa

SEQ ID NO: 671128 - RNA, 16 nt, Homo sapiens
auauugcuucuucucc

SEQ ID NO: 671129 - RNA, 23 nt, Homo sapiens
auauugguauuugcaccaacaua

SEQ ID NO: 671130 - RNA, 17 nt, Homo sapiens
auauuguaaauacugga

SEQ ID NO: 671131 - RNA, 19 nt, Homo sapiens
auauuguagcucaauacaa

SEQ ID NO: 671132 - RNA, 17 nt, Homo sapiens
auauuguauaggggcaa

SEQ ID NO: 671133 - RNA, 15 nt, Homo sapiens
auauugucagucuuu

SEQ ID NO: 671134 - RNA, 21 nt, Homo sapiens
auauuguggguaacgugagaa

SEQ ID NO: 671135 - RNA, 16 nt, Homo sapiens
auauugugucauagaa

SEQ ID NO: 671136 - RNA, 17 nt, Homo sapiens
auauuuaagcaacaucu

SEQ ID NO: 671137 - RNA, 14 nt, Homo sapiens
auauuuacucauag

SEQ ID NO: 671138 - RNA, 14 nt, Homo sapiens
auauuuacuguuag

SEQ ID NO: 671139 - RNA, 16 nt, Homo sapiens
auauuuaucauauccu

SEQ ID NO: 671140 - RNA, 21 nt, Homo sapiens
auauuuaugagaaaguucuca

SEQ ID NO: 671141 - RNA, 21 nt, Homo sapiens
auauuuauucauuauuuguca

SEQ ID NO: 671142 - RNA, 15 nt, Homo sapiens
auauuuauuuccugc

SEQ ID NO: 671143 - RNA, 18 nt, Homo sapiens
auauuuauuuuuugccau

SEQ ID NO: 671144 - RNA, 15 nt, Homo sapiens
auauuucaagcuaua

SEQ ID NO: 671145 - RNA, 14 nt, Homo sapiens
auauuucaauguua

SEQ ID NO: 671146 - RNA, 18 nt, Homo sapiens
auauuucaggcauacuga

SEQ ID NO: 671147 - RNA, 20 nt, Homo sapiens
auauuucaggcauacugaca

SEQ ID NO: 671148 - RNA, 13 nt, Homo sapiens
auauuucagugac

SEQ ID NO: 671149 - RNA, 14 nt, Homo sapiens
auauuucccauuug

SEQ ID NO: 671150 - RNA, 18 nt, Homo sapiens
auauuucuaccugaguga

SEQ ID NO: 671151 - RNA, 17 nt, Homo sapiens
auauuucugauacugcu

SEQ ID NO: 671152 - RNA, 17 nt, Homo sapiens
auauuucuugcuuucaa

SEQ ID NO: 671153 - RNA, 18 nt, Homo sapiens
auauuugaagcaucacau

SEQ ID NO: 671154 - RNA, 19 nt, Homo sapiens
auauuugagagacauuugu

SEQ ID NO: 671155 - RNA, 13 nt, Homo sapiens
auauuuguauaca

SEQ ID NO: 671156 - RNA, 22 nt, Homo sapiens
auauuugucaugacagugcuug

SEQ ID NO: 671157 - RNA, 16 nt, Homo sapiens
auauuuuacauacacu

SEQ ID NO: 671158 - RNA, 14 nt, Homo sapiens
auauuuuagcauuu

SEQ ID NO: 671159 - RNA, 16 nt, Homo sapiens
auauuuuauuacuguu

SEQ ID NO: 671160 - RNA, 19 nt, Homo sapiens
auauuuugcuuugugauuu

SEQ ID NO: 671161 - RNA, 17 nt, Homo sapiens
auauuuuuaaacaaaga

SEQ ID NO: 671162 - RNA, 16 nt, Homo sapiens
auauuuuuagccuaaa

SEQ ID NO: 671163 - RNA, 19 nt, Homo sapiens
auauuuuuaugugcaauaa

SEQ ID NO: 671164 - RNA, 17 nt, Homo sapiens
auauuuuuccacuuaaa

SEQ ID NO: 671165 - RNA, 17 nt, Homo sapiens
auauuuuugugcacauu

SEQ ID NO: 671166 - RNA, 12 nt, Homo sapiens
aucaaaaagccu

SEQ ID NO: 671167 - RNA, 22 nt, Homo sapiens
aucaaaacuuggacccuuggaa

SEQ ID NO: 671168 - RNA, 18 nt, Homo sapiens
aucaaaagcuuauucauc

SEQ ID NO: 671169 - RNA, 15 nt, Homo sapiens
aucaaaauccaaaau

SEQ ID NO: 671170 - RNA, 12 nt, Homo sapiens
aucaaacauaau

SEQ ID NO: 671171 - RNA, 21 nt, Homo sapiens
aucaaacuagcugucacuuuu

SEQ ID NO: 671172 - RNA, 15 nt, Homo sapiens
aucaaagaacaaaca

SEQ ID NO: 671173 - RNA, 16 nt, Homo sapiens
ccauuauuuucuguca

SEQ ID NO: 671174 - RNA, 19 nt, Homo sapiens
ccauucaaaugacgccuga

SEQ ID NO: 671175 - RNA, 13 nt, Homo sapiens
ccauucacaccag

SEQ ID NO: 671176 - RNA, 15 nt, Homo sapiens
ccauucagagacugu

SEQ ID NO: 671177 - RNA, 22 nt, Homo sapiens
ccauuccaggaaaacugggaca

SEQ ID NO: 671178 - RNA, 21 nt, Homo sapiens
ccauuccauaauuuguaguau

SEQ ID NO: 671179 - RNA, 16 nt, Homo sapiens
ccauucccccaugugg

SEQ ID NO: 671180 - RNA, 15 nt, Homo sapiens
ccauucccuagucau

SEQ ID NO: 671181 - RNA, 18 nt, Homo sapiens
ccauuccucagcuucuuc

SEQ ID NO: 671182 - RNA, 10 nt, Homo sapiens
ccauuccucu

SEQ ID NO: 671183 - RNA, 19 nt, Homo sapiens
ccauucugccgcccccucc

SEQ ID NO: 671184 - RNA, 14 nt, Homo sapiens
ccauucugccucuc

SEQ ID NO: 671185 - RNA, 19 nt, Homo sapiens
ccauucuucacucuuugaa

SEQ ID NO: 671186 - RNA, 12 nt, Homo sapiens
ccauugaacuca

SEQ ID NO: 671187 - RNA, 19 nt, Homo sapiens
ccauugaccucagcugcac

SEQ ID NO: 671188 - RNA, 13 nt, Homo sapiens
ccauugagacuau

SEQ ID NO: 671189 - RNA, 18 nt, Homo sapiens
ccauugggacaugaaguu

SEQ ID NO: 671190 - RNA, 16 nt, Homo sapiens
ccauugugaaccaaug

SEQ ID NO: 671191 - RNA, 17 nt, Homo sapiens
ccauugugaaccaaugc

SEQ ID NO: 671192 - RNA, 16 nt, Homo sapiens
ccauuguggaagacag

SEQ ID NO: 671193 - RNA, 20 nt, Homo sapiens
ccauuguggaagacagugug

SEQ ID NO: 671194 - RNA, 12 nt, Homo sapiens
ccauuguucacc

SEQ ID NO: 671195 - RNA, 16 nt, Homo sapiens
ccauuguuugaaacaa

SEQ ID NO: 671196 - RNA, 20 nt, Homo sapiens
ccauuguuugaaacaaagaa

SEQ ID NO: 671197 - RNA, 13 nt, Homo sapiens
ccauuuacagucu

SEQ ID NO: 671198 - RNA, 22 nt, Homo sapiens
ccauuuaguuuuuggauauauu

SEQ ID NO: 671199 - RNA, 21 nt, Homo sapiens
ccauuuauaauguuaguagaa

SEQ ID NO: 671200 - RNA, 22 nt, Homo sapiens
ccauuuauaauguuaguagaaa

SEQ ID NO: 671201 - RNA, 22 nt, Homo sapiens
ccauuucacucucaaacuucac

SEQ ID NO: 671202 - RNA, 22 nt, Homo sapiens
ccauuuccaaauguggccucca

SEQ ID NO: 671203 - RNA, 17 nt, Homo sapiens
ccauuucugagaucaaa

SEQ ID NO: 671204 - RNA, 12 nt, Homo sapiens
ccauuucuugaa

SEQ ID NO: 671205 - RNA, 12 nt, Homo sapiens
ccauuugaagca

SEQ ID NO: 671206 - RNA, 17 nt, Homo sapiens
ccauuugaagcagugau

SEQ ID NO: 671207 - RNA, 13 nt, Homo sapiens
ccauuuguaauaa

SEQ ID NO: 671208 - RNA, 15 nt, Homo sapiens
ccauuugugccagag

SEQ ID NO: 671209 - RNA, 21 nt, Homo sapiens
ccauuuguuggggcaguggua

SEQ ID NO: 671210 - RNA, 20 nt, Homo sapiens
ccauuuuacagaagcauuuu

SEQ ID NO: 671211 - RNA, 15 nt, Homo sapiens
ccauuuuacauuucu

SEQ ID NO: 671212 - RNA, 22 nt, Homo sapiens
ccauuuuauuuuuugggccauu

SEQ ID NO: 671213 - RNA, 23 nt, Homo sapiens
ccauuuucuuauugcgcugcuac

SEQ ID NO: 671214 - RNA, 14 nt, Homo sapiens
ccauuuugcaaaau

SEQ ID NO: 671215 - RNA, 19 nt, Homo sapiens
ccauuuuggaaguuuucag

SEQ ID NO: 671216 - RNA, 23 nt, Homo sapiens
ccauuuuguggauuguguccuau

SEQ ID NO: 671217 - RNA, 18 nt, Homo sapiens
ccauuuuguuaaaaucua

SEQ ID NO: 671218 - RNA, 18 nt, Homo sapiens
ccauuuuucuagacuguc

SEQ ID NO: 671219 - RNA, 15 nt, Homo sapiens
ccauuuuuugaacca

SEQ ID NO: 671220 - RNA, 18 nt, Homo sapiens
cccaaaacucaagcaaga

SEQ ID NO: 671221 - RNA, 22 nt, Homo sapiens
cccaaaacugauacccuuugaa

SEQ ID NO: 671222 - RNA, 20 nt, Homo sapiens
cccaaaauacagcuaugaag

SEQ ID NO: 671223 - RNA, 12 nt, Homo sapiens
cccaaacauguu

SEQ ID NO: 671224 - RNA, 21 nt, Homo sapiens
cccaaacuugcuuuaugccuu

SEQ ID NO: 671225 - RNA, 23 nt, Homo sapiens
cccaaagcacaugcuuagcuuau

SEQ ID NO: 671226 - RNA, 20 nt, Homo sapiens
cccaaagcucagacuugcca

SEQ ID NO: 671227 - RNA, 15 nt, Homo sapiens
cccaaaggcauccau

SEQ ID NO: 671228 - RNA, 13 nt, Homo sapiens
cccaaagugcuga

SEQ ID NO: 671229 - RNA, 16 nt, Homo sapiens
cccaaaguuguuguaa

SEQ ID NO: 671230 - RNA, 17 nt, Homo sapiens
cccaaauggcagggaua

SEQ ID NO: 671231 - RNA, 16 nt, Homo sapiens
cccaaauggcugcuuu

SEQ ID NO: 671232 - RNA, 17 nt, Homo sapiens
cccaaauggcugcuuug

SEQ ID NO: 671233 - RNA, 13 nt, Homo sapiens
cccaaauguauug

SEQ ID NO: 671234 - RNA, 12 nt, Homo sapiens
cccaaauguccc

SEQ ID NO: 671235 - RNA, 18 nt, Homo sapiens
cccaaauucuuucagugg

SEQ ID NO: 671236 - RNA, 12 nt, Homo sapiens
cccaacacaggc

SEQ ID NO: 671237 - RNA, 14 nt, Homo sapiens
cccaacacaggcaa

SEQ ID NO: 671238 - RNA, 15 nt, Homo sapiens
cccaacacuuugaga

SEQ ID NO: 671239 - RNA, 13 nt, Homo sapiens
cccaacccuggcu

SEQ ID NO: 671240 - RNA, 20 nt, Homo sapiens
cccaaccugacuuccucugc

SEQ ID NO: 671241 - RNA, 22 nt, Homo sapiens
cccaacuccccuccgucuguga

SEQ ID NO: 671242 - RNA, 15 nt, Homo sapiens
cccaacucuugcaca

SEQ ID NO: 671243 - RNA, 16 nt, Homo sapiens
cccaacucuugcacag

SEQ ID NO: 671244 - RNA, 19 nt, Homo sapiens
cccaacuucauacuggcag

SEQ ID NO: 671245 - RNA, 16 nt, Homo sapiens
cccaacuuggcagcuu

SEQ ID NO: 671246 - RNA, 23 nt, Homo sapiens
cccaagagcauaacuguucucau

SEQ ID NO: 671247 - RNA, 13 nt, Homo sapiens
cccaagaugaauu

SEQ ID NO: 671248 - RNA, 21 nt, Homo sapiens
cccaagccugggcuugagcug

SEQ ID NO: 671249 - RNA, 13 nt, Homo sapiens
cccaagcgucauc

SEQ ID NO: 671250 - RNA, 21 nt, Homo sapiens
auguggaagaacuuaggcauc

SEQ ID NO: 671251 - RNA, 22 nt, Homo sapiens
auguggaccuuagaauacaguu

SEQ ID NO: 671252 - RNA, 21 nt, Homo sapiens
auguggacuggugcaaguuga

SEQ ID NO: 671253 - RNA, 19 nt, Homo sapiens
auguggagcuacugaugaa

SEQ ID NO: 671254 - RNA, 15 nt, Homo sapiens
auguggaucugggga

SEQ ID NO: 671255 - RNA, 18 nt, Homo sapiens
auguggccgaggacuuug

SEQ ID NO: 671256 - RNA, 20 nt, Homo sapiens
auguggcuacugacauaucu

SEQ ID NO: 671257 - RNA, 18 nt, Homo sapiens
auguggcucagugccuuc

SEQ ID NO: 671258 - RNA, 20 nt, Homo sapiens
augugggagcugaaccacag

SEQ ID NO: 671259 - RNA, 13 nt, Homo sapiens
augugggaucuca

SEQ ID NO: 671260 - RNA, 15 nt, Homo sapiens
augugggugagccag

SEQ ID NO: 671261 - RNA, 19 nt, Homo sapiens
augugggugggaccacaga

SEQ ID NO: 671262 - RNA, 14 nt, Homo sapiens
augugguacuugag

SEQ ID NO: 671263 - RNA, 15 nt, Homo sapiens
augugguaggugaua

SEQ ID NO: 671264 - RNA, 15 nt, Homo sapiens
auguggucaauggaa

SEQ ID NO: 671265 - RNA, 13 nt, Homo sapiens
auguguaaagauu

SEQ ID NO: 671266 - RNA, 16 nt, Homo sapiens
auguguaaagauuuau

SEQ ID NO: 671267 - RNA, 12 nt, Homo sapiens
auguguacaagu

SEQ ID NO: 671268 - RNA, 15 nt, Homo sapiens
auguguacgugcaug

SEQ ID NO: 671269 - RNA, 18 nt, Homo sapiens
auguguaugcaaguacaa

SEQ ID NO: 671270 - RNA, 14 nt, Homo sapiens
auguguaugcagaa

SEQ ID NO: 671271 - RNA, 19 nt, Homo sapiens
auguguauguacguuugua

SEQ ID NO: 671272 - RNA, 17 nt, Homo sapiens
augugucagaauaggaa

SEQ ID NO: 671273 - RNA, 12 nt, Homo sapiens
augugucagcca

SEQ ID NO: 671274 - RNA, 22 nt, Homo sapiens
augugucaggugacccugauga

SEQ ID NO: 671275 - RNA, 17 nt, Homo sapiens
augugucaucaggagaa

SEQ ID NO: 671276 - RNA, 20 nt, Homo sapiens
augugucccagccacagugu

SEQ ID NO: 671277 - RNA, 18 nt, Homo sapiens
augugucccuuccaagcu

SEQ ID NO: 671278 - RNA, 15 nt, Homo sapiens
auguguccucaggga

SEQ ID NO: 671279 - RNA, 19 nt, Homo sapiens
augugucugggagagccug

SEQ ID NO: 671280 - RNA, 13 nt, Homo sapiens
augugucuuacca

SEQ ID NO: 671281 - RNA, 22 nt, Homo sapiens
augugucuuaccagaucuaaua

SEQ ID NO: 671282 - RNA, 14 nt, Homo sapiens
augugugaggagcu

SEQ ID NO: 671283 - RNA, 15 nt, Homo sapiens
augugugaggagcug

SEQ ID NO: 671284 - RNA, 19 nt, Homo sapiens
augugugaguguaauucca

SEQ ID NO: 671285 - RNA, 18 nt, Homo sapiens
augugugagugugugcaa

SEQ ID NO: 671286 - RNA, 23 nt, Homo sapiens
auguguggaaguuauuaacuuua

SEQ ID NO: 671287 - RNA, 14 nt, Homo sapiens
auguguggacucaa

SEQ ID NO: 671288 - RNA, 20 nt, Homo sapiens
augugugguggccucagcug

SEQ ID NO: 671289 - RNA, 20 nt, Homo sapiens
augugugguuuuugcaaaug

SEQ ID NO: 671290 - RNA, 16 nt, Homo sapiens
augugugugcaagugu

SEQ ID NO: 671291 - RNA, 13 nt, Homo sapiens
augugugugcuca

SEQ ID NO: 671292 - RNA, 17 nt, Homo sapiens
auguguuaaaauacuca

SEQ ID NO: 671293 - RNA, 22 nt, Homo sapiens
auguguuaggggccuggcccaa

SEQ ID NO: 671294 - RNA, 15 nt, Homo sapiens
auguguucaaugaaa

SEQ ID NO: 671295 - RNA, 21 nt, Homo sapiens
auguguuccauugccauagcu

SEQ ID NO: 671296 - RNA, 17 nt, Homo sapiens
auguguugcagcuuuau

SEQ ID NO: 671297 - RNA, 14 nt, Homo sapiens
auguguugugauag

SEQ ID NO: 671298 - RNA, 18 nt, Homo sapiens
auguguuucaaaaccaug

SEQ ID NO: 671299 - RNA, 17 nt, Homo sapiens
auguuaacuaaauaacu

SEQ ID NO: 671300 - RNA, 19 nt, Homo sapiens
auguuaagacuugacagug

SEQ ID NO: 671301 - RNA, 13 nt, Homo sapiens
auguuaagugcca

SEQ ID NO: 671302 - RNA, 18 nt, Homo sapiens
auguuaauguuauaucau

SEQ ID NO: 671303 - RNA, 22 nt, Homo sapiens
auguuaauugggcaggugaaaa

SEQ ID NO: 671304 - RNA, 13 nt, Homo sapiens
auguuacaagcua

SEQ ID NO: 671305 - RNA, 13 nt, Homo sapiens
auguuacugagau

SEQ ID NO: 671306 - RNA, 17 nt, Homo sapiens
auguuagaaagugcuga

SEQ ID NO: 671307 - RNA, 18 nt, Homo sapiens
auguuagcagacccagcu

SEQ ID NO: 671308 - RNA, 19 nt, Homo sapiens
auguuaggaaaauuucaca

SEQ ID NO: 671309 - RNA, 19 nt, Homo sapiens
auguuagggugcucuggaa

SEQ ID NO: 671310 - RNA, 14 nt, Homo sapiens
auguuauaucauau

SEQ ID NO: 671311 - RNA, 22 nt, Homo sapiens
auguuauuuuguguacaaguug

SEQ ID NO: 671312 - RNA, 14 nt, Homo sapiens
auguucaacuggag

SEQ ID NO: 671313 - RNA, 15 nt, Homo sapiens
auguucacugugagu

SEQ ID NO: 671314 - RNA, 15 nt, Homo sapiens
auguucacuguggca

SEQ ID NO: 671315 - RNA, 22 nt, Homo sapiens
auguucacuuauugacuauuau

SEQ ID NO: 671316 - RNA, 14 nt, Homo sapiens
auguucagcacugu

SEQ ID NO: 671317 - RNA, 14 nt, Homo sapiens
auguucauuuguac

SEQ ID NO: 671318 - RNA, 18 nt, Homo sapiens
auguuccagacauucucg

SEQ ID NO: 671319 - RNA, 13 nt, Homo sapiens
agcacccauucca

SEQ ID NO: 671320 - RNA, 14 nt, Homo sapiens
agcacccauuccaa

SEQ ID NO: 671321 - RNA, 19 nt, Homo sapiens
agcacccccagccugccuu

SEQ ID NO: 671322 - RNA, 16 nt, Homo sapiens
agcaccccucucugca

SEQ ID NO: 671323 - RNA, 22 nt, Homo sapiens
agcacccucuggauucugaauc

SEQ ID NO: 671324 - RNA, 17 nt, Homo sapiens
agcacccugggugccau

SEQ ID NO: 671325 - RNA, 12 nt, Homo sapiens
agcaccgugcca

SEQ ID NO: 671326 - RNA, 17 nt, Homo sapiens
agcaccguucugugcac

SEQ ID NO: 671327 - RNA, 17 nt, Homo sapiens
agcaccuuucucugaga

SEQ ID NO: 671328 - RNA, 21 nt, Homo sapiens
agcaccuuugagccuuggccc

SEQ ID NO: 671329 - RNA, 14 nt, Homo sapiens
agcacggacuguca

SEQ ID NO: 671330 - RNA, 15 nt, Homo sapiens
agcacgugucucaga

SEQ ID NO: 671331 - RNA, 15 nt, Homo sapiens
agcacuaaagcagug

SEQ ID NO: 671332 - RNA, 13 nt, Homo sapiens
agcacuaaccaau

SEQ ID NO: 671333 - RNA, 19 nt, Homo sapiens
agcacuaaccaaugccuuu

SEQ ID NO: 671334 - RNA, 17 nt, Homo sapiens
agcacuacaccuugccu

SEQ ID NO: 671335 - RNA, 22 nt, Homo sapiens
agcacuacugggugucauuuca

SEQ ID NO: 671336 - RNA, 13 nt, Homo sapiens
agcacuagaauau

SEQ ID NO: 671337 - RNA, 17 nt, Homo sapiens
agcacucccuaauuuau

SEQ ID NO: 671338 - RNA, 17 nt, Homo sapiens
agcacucucaccccaag

SEQ ID NO: 671339 - RNA, 12 nt, Homo sapiens
agcacucugaaa

SEQ ID NO: 671340 - RNA, 13 nt, Homo sapiens
agcacugacaaua

SEQ ID NO: 671341 - RNA, 11 nt, Homo sapiens
agcacugagca

SEQ ID NO: 671342 - RNA, 21 nt, Homo sapiens
agcacugaggguggcacucaa

SEQ ID NO: 671343 - RNA, 19 nt, Homo sapiens
agcacugggaaccuagcua

SEQ ID NO: 671344 - RNA, 19 nt, Homo sapiens
agcacugggugaccagcug

SEQ ID NO: 671345 - RNA, 18 nt, Homo sapiens
agcacugucccuugccuc

SEQ ID NO: 671346 - RNA, 18 nt, Homo sapiens
agcacuguugauguaucu

SEQ ID NO: 671347 - RNA, 21 nt, Homo sapiens
agcacuguuuauacacugugu

SEQ ID NO: 671348 - RNA, 22 nt, Homo sapiens
agcacuguuuauacacugugua

SEQ ID NO: 671349 - RNA, 22 nt, Homo sapiens
agcacuuacagcucuggccaca

SEQ ID NO: 671350 - RNA, 14 nt, Homo sapiens
agcacuuccauggg

SEQ ID NO: 671351 - RNA, 12 nt, Homo sapiens
agcacuucccac

SEQ ID NO: 671352 - RNA, 20 nt, Homo sapiens
agcacuugagaaccagucuc

SEQ ID NO: 671353 - RNA, 12 nt, Homo sapiens
agcacuugucca

SEQ ID NO: 671354 - RNA, 17 nt, Homo sapiens
agcacuuugcacuuaau

SEQ ID NO: 671355 - RNA, 15 nt, Homo sapiens
agcacuuuggacaug

SEQ ID NO: 671356 - RNA, 17 nt, Homo sapiens
agcagaaacagcauauu

SEQ ID NO: 671357 - RNA, 13 nt, Homo sapiens
agcagaaaugccu

SEQ ID NO: 671358 - RNA, 20 nt, Homo sapiens
agcagaauucauucauacuu

SEQ ID NO: 671359 - RNA, 15 nt, Homo sapiens
agcagaccgugauuu

SEQ ID NO: 671360 - RNA, 15 nt, Homo sapiens
agcagaccuacagca

SEQ ID NO: 671361 - RNA, 22 nt, Homo sapiens
agcagaccuaccugcaguggga

SEQ ID NO: 671362 - RNA, 17 nt, Homo sapiens
agcagagaaaauuguga

SEQ ID NO: 671363 - RNA, 17 nt, Homo sapiens
agcagagacaugacuca

SEQ ID NO: 671364 - RNA, 20 nt, Homo sapiens
agcagagacgggguuucacc

SEQ ID NO: 671365 - RNA, 14 nt, Homo sapiens
agcagagccuggag

SEQ ID NO: 671366 - RNA, 15 nt, Homo sapiens
agcagaggucuucag

SEQ ID NO: 671367 - RNA, 21 nt, Homo sapiens
agcagaguguucccugacucc

SEQ ID NO: 671368 - RNA, 13 nt, Homo sapiens
agcagauuuaaca

SEQ ID NO: 671369 - RNA, 23 nt, Homo sapiens
agcagcacuguucuguccucaag

SEQ ID NO: 671370 - RNA, 14 nt, Homo sapiens
agcagcagugccau

SEQ ID NO: 671371 - RNA, 13 nt, Homo sapiens
agcagccacgagg

SEQ ID NO: 671372 - RNA, 15 nt, Homo sapiens
agcagccagucucag

SEQ ID NO: 671373 - RNA, 14 nt, Homo sapiens
agcagcccugucac

SEQ ID NO: 671374 - RNA, 23 nt, Homo sapiens
agcagccucuggacagccaguga

SEQ ID NO: 671375 - RNA, 23 nt, Homo sapiens
agcagccuuucucucuuuauaca

SEQ ID NO: 671376 - RNA, 21 nt, Homo sapiens
agcagcgccccucccaagagg

SEQ ID NO: 671377 - RNA, 19 nt, Homo sapiens
agcagcuauuuuaagccau

SEQ ID NO: 671378 - RNA, 23 nt, Homo sapiens
agcagcucuccccaggcauuugc

SEQ ID NO: 671379 - RNA, 13 nt, Homo sapiens
agcagcucuguga

SEQ ID NO: 671380 - RNA, 16 nt, Homo sapiens
agcagcuuucagcucu

SEQ ID NO: 671381 - RNA, 18 nt, Homo sapiens
agcaggaaccccaggaga

SEQ ID NO: 671382 - RNA, 20 nt, Homo sapiens
agcaggaaggccccucugug

SEQ ID NO: 671383 - RNA, 14 nt, Homo sapiens
agcaggacagacac

SEQ ID NO: 671384 - RNA, 13 nt, Homo sapiens
agcaggacuccag

SEQ ID NO: 671385 - RNA, 18 nt, Homo sapiens
agcaggacuccaucucuu

SEQ ID NO: 671386 - RNA, 21 nt, Homo sapiens
agcaggacucugcccagacca

SEQ ID NO: 671387 - RNA, 17 nt, Homo sapiens
agcaggagugcucaaua

SEQ ID NO: 671388 - RNA, 21 nt, Homo sapiens
agcaggcagcgccaagugcgu

SEQ ID NO: 671389 - RNA, 16 nt, Homo sapiens
agcaggccacuaguga

SEQ ID NO: 671390 - RNA, 20 nt, Homo sapiens
agcaggccacuagugacagu

SEQ ID NO: 671391 - RNA, 13 nt, Homo sapiens
agcaggccaggga

SEQ ID NO: 671392 - RNA, 21 nt, Homo sapiens
agcaggcggugggcacccacc

SEQ ID NO: 671393 - RNA, 16 nt, Homo sapiens
agcaggggcauugcug

SEQ ID NO: 671394 - RNA, 13 nt, Homo sapiens
agcaggggccaga

SEQ ID NO: 671395 - RNA, 16 nt, Homo sapiens
agcaggggcuccagca

SEQ ID NO: 671396 - RNA, 19 nt, Homo sapiens
agcaggggggcugugccaa

SEQ ID NO: 671397 - RNA, 22 nt, Homo sapiens
agcaggugcugacuucaucucc

SEQ ID NO: 671398 - RNA, 16 nt, Homo sapiens
agcaggugcugggcug

SEQ ID NO: 671399 - RNA, 19 nt, Homo sapiens
agcaggugguccugagacc

SEQ ID NO: 671400 - RNA, 16 nt, Homo sapiens
agcagguuaagaauuu

SEQ ID NO: 671401 - RNA, 13 nt, Homo sapiens
agcaguaagcuau

SEQ ID NO: 671402 - RNA, 19 nt, Homo sapiens
agcaguaccccccuaccac

SEQ ID NO: 671403 - RNA, 16 nt, Homo sapiens
agcaguagcaaacuuu

SEQ ID NO: 671404 - RNA, 15 nt, Homo sapiens
agcagucaauacaaa

SEQ ID NO: 671405 - RNA, 14 nt, Homo sapiens
agcagucaggcgcu

SEQ ID NO: 671406 - RNA, 21 nt, Homo sapiens
agcagucccaguauucucaga

SEQ ID NO: 671407 - RNA, 22 nt, Homo sapiens
agcagucuccugcccucucccc

SEQ ID NO: 671408 - RNA, 13 nt, Homo sapiens
agcagucuugcuc

SEQ ID NO: 671409 - RNA, 23 nt, Homo sapiens
agcagucuuucuauccuguucuu

SEQ ID NO: 671410 - RNA, 21 nt, Homo sapiens
agcagugaaauaugauaauaa

SEQ ID NO: 671411 - RNA, 12 nt, Homo sapiens
agcagugccaua

SEQ ID NO: 671412 - RNA, 15 nt, Homo sapiens
agcagugucuuccau

SEQ ID NO: 671413 - RNA, 22 nt, Homo sapiens
agcagugucuuccauaauguau

SEQ ID NO: 671414 - RNA, 20 nt, Homo sapiens
agcaguuaguuccuucauga

SEQ ID NO: 671415 - RNA, 18 nt, Homo sapiens
agcaguuauggugaugac

SEQ ID NO: 671416 - RNA, 20 nt, Homo sapiens
agcaguugaucagacugaaa

SEQ ID NO: 671417 - RNA, 22 nt, Homo sapiens
agcaguuugcuuuguaugcacu

SEQ ID NO: 671418 - RNA, 19 nt, Homo sapiens
agcauaaauaaaacugaau

SEQ ID NO: 671419 - RNA, 13 nt, Homo sapiens
agcauaacaugga

SEQ ID NO: 671420 - RNA, 14 nt, Homo sapiens
agcauaacauggag

SEQ ID NO: 671421 - RNA, 13 nt, Homo sapiens
agcauaaugcucc

SEQ ID NO: 671422 - RNA, 14 nt, Homo sapiens
agcauacaacugga

SEQ ID NO: 671423 - RNA, 13 nt, Homo sapiens
agcauacaacuuu

SEQ ID NO: 671424 - RNA, 21 nt, Homo sapiens
agcauagccugccugaucccu

SEQ ID NO: 671425 - RNA, 22 nt, Homo sapiens
agcauaggaggggucuggacau

SEQ ID NO: 671426 - RNA, 18 nt, Homo sapiens
agcauagggucacuuugc

SEQ ID NO: 671427 - RNA, 18 nt, Homo sapiens
agcauaguacuggcacaa

SEQ ID NO: 671428 - RNA, 13 nt, Homo sapiens
agcauauacuggu

SEQ ID NO: 671429 - RNA, 12 nt, Homo sapiens
agcauaugcagc

SEQ ID NO: 671430 - RNA, 19 nt, Homo sapiens
agcauauuuuaaugcaguu

SEQ ID NO: 671431 - RNA, 13 nt, Homo sapiens
agcaucaagccac

SEQ ID NO: 671432 - RNA, 17 nt, Homo sapiens
agcaucaccucaggcca

SEQ ID NO: 671433 - RNA, 19 nt, Homo sapiens
agcaucagagaguguacau

SEQ ID NO: 671434 - RNA, 23 nt, Homo sapiens
agcaucagagguuugcuuccuca

SEQ ID NO: 671435 - RNA, 16 nt, Homo sapiens
agcauccacuggaaaa

SEQ ID NO: 671436 - RNA, 15 nt, Homo sapiens
agcauccccagccac

SEQ ID NO: 671437 - RNA, 16 nt, Homo sapiens
agccagugagggcagu

SEQ ID NO: 671438 - RNA, 12 nt, Homo sapiens
agccaguggcac

SEQ ID NO: 671439 - RNA, 14 nt, Homo sapiens
agccagugggagau

SEQ ID NO: 671440 - RNA, 14 nt, Homo sapiens
agccaguggugcua

SEQ ID NO: 671441 - RNA, 23 nt, Homo sapiens
agccagugugacacugcuuuaaa

SEQ ID NO: 671442 - RNA, 16 nt, Homo sapiens
agccaguguugcuuaa

SEQ ID NO: 671443 - RNA, 19 nt, Homo sapiens
agccauaagaaagcacuau

SEQ ID NO: 671444 - RNA, 21 nt, Homo sapiens
agccauaagaaagcacuauua

SEQ ID NO: 671445 - RNA, 18 nt, Homo sapiens
agccauaggcccaggaua

SEQ ID NO: 671446 - RNA, 23 nt, Homo sapiens
agccauaggugcaguuugcuucu

SEQ ID NO: 671447 - RNA, 11 nt, Homo sapiens
agccauaugca

SEQ ID NO: 671448 - RNA, 13 nt, Homo sapiens
agccauaugcaau

SEQ ID NO: 671449 - RNA, 18 nt, Homo sapiens
agccauauucacaccuca

SEQ ID NO: 671450 - RNA, 19 nt, Homo sapiens
agccauauuugauaguaua

SEQ ID NO: 671451 - RNA, 16 nt, Homo sapiens
agccaucaagagacug

SEQ ID NO: 671452 - RNA, 13 nt, Homo sapiens
agccaucagacaa

SEQ ID NO: 671453 - RNA, 23 nt, Homo sapiens
agccaucccuuuuuuuacauuuc

SEQ ID NO: 671454 - RNA, 15 nt, Homo sapiens
agccaucuaaugcuu

SEQ ID NO: 671455 - RNA, 23 nt, Homo sapiens
agccaugacaagaacaaagccac

SEQ ID NO: 671456 - RNA, 17 nt, Homo sapiens
agccaugcaaugccaaa

SEQ ID NO: 671457 - RNA, 20 nt, Homo sapiens
agccauggacucuacacugu

SEQ ID NO: 671458 - RNA, 15 nt, Homo sapiens
agccauggcccuccc

SEQ ID NO: 671459 - RNA, 23 nt, Homo sapiens
agccauggcugggcgugcuagag

SEQ ID NO: 671460 - RNA, 16 nt, Homo sapiens
agccaugggucugugc

SEQ ID NO: 671461 - RNA, 21 nt, Homo sapiens
agccauguaucaauauucacu

SEQ ID NO: 671462 - RNA, 18 nt, Homo sapiens
agccauuauuaugauguu

SEQ ID NO: 671463 - RNA, 23 nt, Homo sapiens
agccauuguggaagacagugugg

SEQ ID NO: 671464 - RNA, 15 nt, Homo sapiens
agccauuugccauca

SEQ ID NO: 671465 - RNA, 19 nt, Homo sapiens
agccauuuuucaaagcaau

SEQ ID NO: 671466 - RNA, 14 nt, Homo sapiens
agcccaaagccaag

SEQ ID NO: 671467 - RNA, 20 nt, Homo sapiens
agcccaacagacaccaucuu

SEQ ID NO: 671468 - RNA, 16 nt, Homo sapiens
agcccaagaggacuga

SEQ ID NO: 671469 - RNA, 14 nt, Homo sapiens
agcccaagccuugu

SEQ ID NO: 671470 - RNA, 16 nt, Homo sapiens
agcccaaggucaggga

SEQ ID NO: 671471 - RNA, 16 nt, Homo sapiens
agcccaagguuaaaaa

SEQ ID NO: 671472 - RNA, 13 nt, Homo sapiens
agcccaaucugcc

SEQ ID NO: 671473 - RNA, 14 nt, Homo sapiens
agcccaaucugcca

SEQ ID NO: 671474 - RNA, 14 nt, Homo sapiens
agcccacacuugag

SEQ ID NO: 671475 - RNA, 16 nt, Homo sapiens
agcccacuguuaauau

SEQ ID NO: 671476 - RNA, 16 nt, Homo sapiens
agcccagacgcagcug

SEQ ID NO: 671477 - RNA, 20 nt, Homo sapiens
agcccagaucgcaccacugc

SEQ ID NO: 671478 - RNA, 16 nt, Homo sapiens
agcccagcaucacuga

SEQ ID NO: 671479 - RNA, 18 nt, Homo sapiens
agcccagcuugccaaugg

SEQ ID NO: 671480 - RNA, 23 nt, Homo sapiens
agcccaguaacugcaccaacgag

SEQ ID NO: 671481 - RNA, 16 nt, Homo sapiens
agcccagugcacugaa

SEQ ID NO: 671482 - RNA, 20 nt, Homo sapiens
agcccagugggcugcacgcu

SEQ ID NO: 671483 - RNA, 14 nt, Homo sapiens
agcccauagcuauu

SEQ ID NO: 671484 - RNA, 19 nt, Homo sapiens
agcccauccugaccagcug

SEQ ID NO: 671485 - RNA, 12 nt, Homo sapiens
agcccaucucaa

SEQ ID NO: 671486 - RNA, 21 nt, Homo sapiens
agcccaugacguguuucuuga

SEQ ID NO: 671487 - RNA, 22 nt, Homo sapiens
agcccauggugagcucugggaa

SEQ ID NO: 671488 - RNA, 15 nt, Homo sapiens
agccccaaaucucuc

SEQ ID NO: 671489 - RNA, 13 nt, Homo sapiens
agccccacccugg

SEQ ID NO: 671490 - RNA, 16 nt, Homo sapiens
agccccagacaacagc

SEQ ID NO: 671491 - RNA, 17 nt, Homo sapiens
agccccagacucuucau

SEQ ID NO: 671492 - RNA, 19 nt, Homo sapiens
agccccaggccucuguguc

SEQ ID NO: 671493 - RNA, 15 nt, Homo sapiens
agccccagucuuccu

SEQ ID NO: 671494 - RNA, 20 nt, Homo sapiens
agcccccaccggaacugggc

SEQ ID NO: 671495 - RNA, 15 nt, Homo sapiens
agcccccacuccagu

SEQ ID NO: 671496 - RNA, 24 nt, Homo sapiens
agcccccuggaugggcauugggcu

SEQ ID NO: 671497 - RNA, 13 nt, Homo sapiens
agccccgacucca

SEQ ID NO: 671498 - RNA, 23 nt, Homo sapiens
agccccgccccagcccucaguca

SEQ ID NO: 671499 - RNA, 16 nt, Homo sapiens
agccccggcaagccac

SEQ ID NO: 671500 - RNA, 12 nt, Homo sapiens
agccccuagugc

SEQ ID NO: 671501 - RNA, 13 nt, Homo sapiens
agccccucuaccu

SEQ ID NO: 671502 - RNA, 15 nt, Homo sapiens
agccccucuucccuu

SEQ ID NO: 671503 - RNA, 15 nt, Homo sapiens
agccccugguccuga

SEQ ID NO: 671504 - RNA, 18 nt, Homo sapiens
agccccuuauuugcacuu

SEQ ID NO: 671505 - RNA, 20 nt, Homo sapiens
agccccuuauuugcacuuca

SEQ ID NO: 671506 - RNA, 17 nt, Homo sapiens
agccccuucugcucagc

SEQ ID NO: 671507 - RNA, 20 nt, Homo sapiens
agcccgacagugccaucccc

SEQ ID NO: 671508 - RNA, 18 nt, Homo sapiens
agcccgccuccagcacca

SEQ ID NO: 671509 - RNA, 13 nt, Homo sapiens
agcccgucucagu

SEQ ID NO: 671510 - RNA, 20 nt, Homo sapiens
agcccgucuucucucucugc

SEQ ID NO: 671511 - RNA, 16 nt, Homo sapiens
agcccgugcacccugg

SEQ ID NO: 671512 - RNA, 20 nt, Homo sapiens
agcccguuagccccagggau

SEQ ID NO: 671513 - RNA, 18 nt, Homo sapiens
agcccuaaccccuuccag

SEQ ID NO: 671514 - RNA, 13 nt, Homo sapiens
agcccuaaucuca

SEQ ID NO: 671515 - RNA, 19 nt, Homo sapiens
agcccuccucugcacuccc

SEQ ID NO: 671516 - RNA, 20 nt, Homo sapiens
agcccucuagggcagggugg

SEQ ID NO: 671517 - RNA, 17 nt, Homo sapiens
agcccucugucuaccug

SEQ ID NO: 671518 - RNA, 17 nt, Homo sapiens
agcccugaacauuucau

SEQ ID NO: 671519 - RNA, 13 nt, Homo sapiens
agcccugacuggu

SEQ ID NO: 671520 - RNA, 21 nt, Homo sapiens
agcccugggaaccacucccac

SEQ ID NO: 671521 - RNA, 21 nt, Homo sapiens
agcccugggccccaccaccua

SEQ ID NO: 671522 - RNA, 20 nt, Homo sapiens
agcccugggguuugaagcug

SEQ ID NO: 671523 - RNA, 16 nt, Homo sapiens
agcccuguguguguca

SEQ ID NO: 671524 - RNA, 17 nt, Homo sapiens
agcccuguuggcagcuc

SEQ ID NO: 671525 - RNA, 20 nt, Homo sapiens
agcccuucaugcauuugcac

SEQ ID NO: 671526 - RNA, 19 nt, Homo sapiens
agcccuucccuagcacacu

SEQ ID NO: 671527 - RNA, 16 nt, Homo sapiens
agcccuucucugcucc

SEQ ID NO: 671528 - RNA, 18 nt, Homo sapiens
agcccuugaagauaucuu

SEQ ID NO: 671529 - RNA, 19 nt, Homo sapiens
agcccuugagucugucaca

SEQ ID NO: 671530 - RNA, 15 nt, Homo sapiens
agcccuugggcaguu

SEQ ID NO: 671531 - RNA, 14 nt, Homo sapiens
agcccuuuacuuga

SEQ ID NO: 671532 - RNA, 16 nt, Homo sapiens
agcccuuuuuguacug

SEQ ID NO: 671533 - RNA, 20 nt, Homo sapiens
agcccuuuuuguacugauau

SEQ ID NO: 671534 - RNA, 21 nt, Homo sapiens
agcccuuuuuguacugauaua

SEQ ID NO: 671535 - RNA, 19 nt, Homo sapiens
agccgaagggcaauaucua

SEQ ID NO: 671536 - RNA, 12 nt, Homo sapiens
agccgaccucag

SEQ ID NO: 671537 - RNA, 19 nt, Homo sapiens
agccgagaucaugccauug

SEQ ID NO: 671538 - RNA, 17 nt, Homo sapiens
agccgagaucgcgccac

SEQ ID NO: 671539 - RNA, 23 nt, Homo sapiens
agccgagaucgcgccacugcacu

SEQ ID NO: 671540 - RNA, 20 nt, Homo sapiens
agccgagaucgcgccacugu

SEQ ID NO: 671541 - RNA, 17 nt, Homo sapiens
agccgauaucagaauuu

SEQ ID NO: 671542 - RNA, 20 nt, Homo sapiens
agccgauggaaaauaccuaa

SEQ ID NO: 671543 - RNA, 15 nt, Homo sapiens
agccgauucucugcc

SEQ ID NO: 671544 - RNA, 22 nt, Homo sapiens
agccgcagagacccucucagcc

SEQ ID NO: 671545 - RNA, 18 nt, Homo sapiens
agccgcauuggugacuca

SEQ ID NO: 671546 - RNA, 18 nt, Homo sapiens
agccgccaguacuuguca

SEQ ID NO: 671547 - RNA, 12 nt, Homo sapiens
agccgcugugag

SEQ ID NO: 671548 - RNA, 20 nt, Homo sapiens
agccgggcugggaaugggga

SEQ ID NO: 671549 - RNA, 20 nt, Homo sapiens
agccggugccuggguggcca

SEQ ID NO: 671550 - RNA, 13 nt, Homo sapiens
agccgugaacugu

SEQ ID NO: 671551 - RNA, 17 nt, Homo sapiens
agccgugaugcucaggc

SEQ ID NO: 671552 - RNA, 17 nt, Homo sapiens
agccguugaaucuggga

SEQ ID NO: 671553 - RNA, 18 nt, Homo sapiens
agccguugaaucugggag

SEQ ID NO: 671554 - RNA, 18 nt, Homo sapiens
agccuaaaugauggugcu

SEQ ID NO: 671555 - RNA, 21 nt, Homo sapiens
agccuaacacacuccaagaua

SEQ ID NO: 671556 - RNA, 21 nt, Homo sapiens
agccuaagaauaugaucaggu

SEQ ID NO: 671557 - RNA, 21 nt, Homo sapiens
agccuacagaagggcagugac

SEQ ID NO: 671558 - RNA, 17 nt, Homo sapiens
agccuacccuauucuau

SEQ ID NO: 671559 - RNA, 17 nt, Homo sapiens
agccuaccguauuucag

SEQ ID NO: 671560 - RNA, 16 nt, Homo sapiens
agccuacgcugaagau

SEQ ID NO: 671561 - RNA, 19 nt, Homo sapiens
agccuagcacagcagcuua

SEQ ID NO: 671562 - RNA, 19 nt, Homo sapiens
agccuagcccuucucucau

SEQ ID NO: 671563 - RNA, 18 nt, Homo sapiens
agccuagcggagcccagc

SEQ ID NO: 671564 - RNA, 16 nt, Homo sapiens
agccuaggaccacuca

SEQ ID NO: 671565 - RNA, 21 nt, Homo sapiens
agccuaggggucagggaccaa

SEQ ID NO: 671566 - RNA, 19 nt, Homo sapiens
agccuagguguugucagca

SEQ ID NO: 671567 - RNA, 21 nt, Homo sapiens
agccuauaucaaacaugcaca

SEQ ID NO: 671568 - RNA, 21 nt, Homo sapiens
agccuauguaugccauggagg

SEQ ID NO: 671569 - RNA, 15 nt, Homo sapiens
agccucaauuuccuc

SEQ ID NO: 671570 - RNA, 17 nt, Homo sapiens
agccucagaugauuucc

SEQ ID NO: 671571 - RNA, 23 nt, Homo sapiens
agccucaucaucagagccuuucc

SEQ ID NO: 671572 - RNA, 22 nt, Homo sapiens
agccuccacagcgagggcagcu

SEQ ID NO: 671573 - RNA, 16 nt, Homo sapiens
agccuccagguuuccu

SEQ ID NO: 671574 - RNA, 17 nt, Homo sapiens
agccucccaaguagcug

SEQ ID NO: 671575 - RNA, 14 nt, Homo sapiens
agccucccagugug

SEQ ID NO: 671576 - RNA, 16 nt, Homo sapiens
agccucccgaaugaag

SEQ ID NO: 671577 - RNA, 17 nt, Homo sapiens
agccucccucugaccug

SEQ ID NO: 671578 - RNA, 18 nt, Homo sapiens
agccucccuguaacucca

SEQ ID NO: 671579 - RNA, 18 nt, Homo sapiens
agccucccuucugccuug

SEQ ID NO: 671580 - RNA, 15 nt, Homo sapiens
agccuccgucaucca

SEQ ID NO: 671581 - RNA, 21 nt, Homo sapiens
agccuccugagggcuccaugc

SEQ ID NO: 671582 - RNA, 17 nt, Homo sapiens
agccuccuucagcagcu

SEQ ID NO: 671583 - RNA, 17 nt, Homo sapiens
agccucucaaguaauau

SEQ ID NO: 671584 - RNA, 16 nt, Homo sapiens
agccucucaccuggac

SEQ ID NO: 671585 - RNA, 13 nt, Homo sapiens
agccucucuggcu

SEQ ID NO: 671586 - RNA, 22 nt, Homo sapiens
agccucuggcaaguagcuuucu

SEQ ID NO: 671587 - RNA, 16 nt, Homo sapiens
agccucuggcauuaga

SEQ ID NO: 671588 - RNA, 18 nt, Homo sapiens
agccucuucucugaugac

SEQ ID NO: 671589 - RNA, 22 nt, Homo sapiens
agccucuugacgcuggaagugu

SEQ ID NO: 671590 - RNA, 13 nt, Homo sapiens
agccucuugcccg

SEQ ID NO: 671591 - RNA, 18 nt, Homo sapiens
agccugaaaaggacuucu

SEQ ID NO: 671592 - RNA, 16 nt, Homo sapiens
agccugacucuucccu

SEQ ID NO: 671593 - RNA, 21 nt, Homo sapiens
agccugagcagagacaugacu

SEQ ID NO: 671594 - RNA, 18 nt, Homo sapiens
agccugagucaccugcag

SEQ ID NO: 671595 - RNA, 14 nt, Homo sapiens
agccugauccagcc

SEQ ID NO: 671596 - RNA, 13 nt, Homo sapiens
agccugcaccgcc

SEQ ID NO: 671597 - RNA, 23 nt, Homo sapiens
agccugccaagagguacuguaau

SEQ ID NO: 671598 - RNA, 21 nt, Homo sapiens
agccugcucauguaccucuga

SEQ ID NO: 671599 - RNA, 17 nt, Homo sapiens
agccugcuccagcuguu

SEQ ID NO: 671600 - RNA, 17 nt, Homo sapiens
agccugcuuguugggaa

SEQ ID NO: 671601 - RNA, 15 nt, Homo sapiens
agccuggaagccauc

SEQ ID NO: 671602 - RNA, 20 nt, Homo sapiens
agccuggaagccauccugcc

SEQ ID NO: 671603 - RNA, 14 nt, Homo sapiens
agccuggacccugu

SEQ ID NO: 671604 - RNA, 21 nt, Homo sapiens
agccuggcaaggcauuccuca

SEQ ID NO: 671605 - RNA, 14 nt, Homo sapiens
agccuggcaucugu

SEQ ID NO: 671606 - RNA, 16 nt, Homo sapiens
agccuggcaucugugc

SEQ ID NO: 671607 - RNA, 19 nt, Homo sapiens
agccuggccccugugcacc

SEQ ID NO: 671608 - RNA, 21 nt, Homo sapiens
agccuggcugcccaucaugug

SEQ ID NO: 671609 - RNA, 15 nt, Homo sapiens
agccuggcuggcaca

SEQ ID NO: 671610 - RNA, 18 nt, Homo sapiens
agccugggcaacauacca

SEQ ID NO: 671611 - RNA, 18 nt, Homo sapiens
agccugggcagcauagca

SEQ ID NO: 671612 - RNA, 21 nt, Homo sapiens
agccugggcagcauagcaaga

SEQ ID NO: 671613 - RNA, 19 nt, Homo sapiens
agccugggcucacugugcu

SEQ ID NO: 671614 - RNA, 22 nt, Homo sapiens
agccugggguguccuacaguga

SEQ ID NO: 671615 - RNA, 12 nt, Homo sapiens
agccuggugggc

SEQ ID NO: 671616 - RNA, 12 nt, Homo sapiens
agccuguaccuu

SEQ ID NO: 671617 - RNA, 23 nt, Homo sapiens
agccugucccauggacacuccag

SEQ ID NO: 671618 - RNA, 15 nt, Homo sapiens
agccuguccccagac

SEQ ID NO: 671619 - RNA, 14 nt, Homo sapiens
agccugucccugaa

SEQ ID NO: 671620 - RNA, 20 nt, Homo sapiens
agccuguccucaccgucucg

SEQ ID NO: 671621 - RNA, 13 nt, Homo sapiens
agccugugcaaaa

SEQ ID NO: 671622 - RNA, 22 nt, Homo sapiens
agccuguggcuggcuggaaaaa

SEQ ID NO: 671623 - RNA, 15 nt, Homo sapiens
agccuguugcugaag

SEQ ID NO: 671624 - RNA, 22 nt, Homo sapiens
agccuguuggacccgcucugga

SEQ ID NO: 671625 - RNA, 17 nt, Homo sapiens
agccuuaaaaugcauug

SEQ ID NO: 671626 - RNA, 19 nt, Homo sapiens
agccuuaaaaugcauugaa

SEQ ID NO: 671627 - RNA, 19 nt, Homo sapiens
agccuuaauagacuucucu

SEQ ID NO: 671628 - RNA, 17 nt, Homo sapiens
agccuuaauuugcacag

SEQ ID NO: 671629 - RNA, 20 nt, Homo sapiens
agccuuaauuugcacagugu

SEQ ID NO: 671630 - RNA, 13 nt, Homo sapiens
agccuuagacaaa

SEQ ID NO: 671631 - RNA, 22 nt, Homo sapiens
agccuuaggaaggccuucagga

SEQ ID NO: 671632 - RNA, 14 nt, Homo sapiens
agccuuauccucug

SEQ ID NO: 671633 - RNA, 14 nt, Homo sapiens
agccuuaugugagc

SEQ ID NO: 671634 - RNA, 21 nt, Homo sapiens
agccuuauuucuagaagcaca

SEQ ID NO: 671635 - RNA, 22 nt, Homo sapiens
agccuuauuuuuguaugccuuu

SEQ ID NO: 671636 - RNA, 23 nt, Homo sapiens
agccuucaaauuauaaaccaagg

SEQ ID NO: 671637 - RNA, 16 nt, Homo sapiens
agccuucacacagaua

SEQ ID NO: 671638 - RNA, 17 nt, Homo sapiens
agccuucauuugcaauu

SEQ ID NO: 671639 - RNA, 18 nt, Homo sapiens
agccuugauaauacuuga

SEQ ID NO: 671640 - RNA, 19 nt, Homo sapiens
agccuugauaauacuugac

SEQ ID NO: 671641 - RNA, 18 nt, Homo sapiens
agccuugcaucaagggcu

SEQ ID NO: 671642 - RNA, 23 nt, Homo sapiens
agccuugcauguacuugaaggau

SEQ ID NO: 671643 - RNA, 12 nt, Homo sapiens
agccuugcuugu

SEQ ID NO: 671644 - RNA, 17 nt, Homo sapiens
agccuugggaacaugcg

SEQ ID NO: 671645 - RNA, 21 nt, Homo sapiens
agccuugggguuggacaucuc

SEQ ID NO: 671646 - RNA, 15 nt, Homo sapiens
agccuuguaaauaac

SEQ ID NO: 671647 - RNA, 16 nt, Homo sapiens
agccuuuccaaugaag

SEQ ID NO: 671648 - RNA, 12 nt, Homo sapiens
agcgaacaaaug

SEQ ID NO: 671649 - RNA, 16 nt, Homo sapiens
agcgaacguauuucuc

SEQ ID NO: 671650 - RNA, 22 nt, Homo sapiens
agcgaccgcccccuccucuagc

SEQ ID NO: 671651 - RNA, 18 nt, Homo sapiens
agcgagaagaugcucugg

SEQ ID NO: 671652 - RNA, 19 nt, Homo sapiens
agcgagcagucagcauucu

SEQ ID NO: 671653 - RNA, 16 nt, Homo sapiens
agcgagcuaugaucgc

SEQ ID NO: 671654 - RNA, 21 nt, Homo sapiens
agcgccaaaacaagccaaaga

SEQ ID NO: 671655 - RNA, 22 nt, Homo sapiens
agcgccuccaacccuagcaaaa

SEQ ID NO: 671656 - RNA, 15 nt, Homo sapiens
agcgcuagugccuug

SEQ ID NO: 671657 - RNA, 20 nt, Homo sapiens
agcgcuucugcaccaacuca

SEQ ID NO: 671658 - RNA, 21 nt, Homo sapiens
agcgcuucugcaccaacucac

SEQ ID NO: 671659 - RNA, 14 nt, Homo sapiens
agcgcuuucuggaa

SEQ ID NO: 671660 - RNA, 22 nt, Homo sapiens
agcggccccccgcacagccacc

SEQ ID NO: 671661 - RNA, 22 nt, Homo sapiens
agcggcccuaagggagugucua

SEQ ID NO: 671662 - RNA, 22 nt, Homo sapiens
agcggcccugucauccagcuca

SEQ ID NO: 671663 - RNA, 17 nt, Homo sapiens
agcggggaucugaugaa

SEQ ID NO: 671664 - RNA, 14 nt, Homo sapiens
agcgguaccccagg

SEQ ID NO: 671665 - RNA, 22 nt, Homo sapiens
agcgguggaggaaggcucuguc

SEQ ID NO: 671666 - RNA, 12 nt, Homo sapiens
agcgucaaggug

SEQ ID NO: 671667 - RNA, 22 nt, Homo sapiens
agcgucacucuaccuaaugucu

SEQ ID NO: 671668 - RNA, 18 nt, Homo sapiens
agcgucaggccuaccuca

SEQ ID NO: 671669 - RNA, 15 nt, Homo sapiens
agcgucaguuucacu

SEQ ID NO: 671670 - RNA, 20 nt, Homo sapiens
agcgugggacccuucagcca

SEQ ID NO: 671671 - RNA, 13 nt, Homo sapiens
agcguuaugugca

SEQ ID NO: 671672 - RNA, 18 nt, Homo sapiens
agcguuugcugugccagg

SEQ ID NO: 671673 - RNA, 15 nt, Homo sapiens
agcuaaagaggcuga

SEQ ID NO: 671674 - RNA, 15 nt, Homo sapiens
aguaacauuaacuca

SEQ ID NO: 671675 - RNA, 12 nt, Homo sapiens
aguaacauuugc

SEQ ID NO: 671676 - RNA, 21 nt, Homo sapiens
aguaaccauggggaagaaauc

SEQ ID NO: 671677 - RNA, 13 nt, Homo sapiens
aguaaccuaguga

SEQ ID NO: 671678 - RNA, 15 nt, Homo sapiens
aguaagaagacauga

SEQ ID NO: 671679 - RNA, 18 nt, Homo sapiens
aguaagagcuggugucug

SEQ ID NO: 671680 - RNA, 14 nt, Homo sapiens
aguaagaugcacug

SEQ ID NO: 671681 - RNA, 20 nt, Homo sapiens
aguaagcaguguuacuugca

SEQ ID NO: 671682 - RNA, 16 nt, Homo sapiens
aguaagcugcucuauu

SEQ ID NO: 671683 - RNA, 14 nt, Homo sapiens
aguaaggugcaguu

SEQ ID NO: 671684 - RNA, 14 nt, Homo sapiens
aguaaguguacaau

SEQ ID NO: 671685 - RNA, 17 nt, Homo sapiens
aguaauaugcacacauu

SEQ ID NO: 671686 - RNA, 18 nt, Homo sapiens
aguaauauuauuacuuua

SEQ ID NO: 671687 - RNA, 22 nt, Homo sapiens
aguaauauuauuacuuuaugaa

SEQ ID NO: 671688 - RNA, 17 nt, Homo sapiens
aguaaucaauacagaca

SEQ ID NO: 671689 - RNA, 19 nt, Homo sapiens
aguaaucccauuucccaaa

SEQ ID NO: 671690 - RNA, 23 nt, Homo sapiens
agcaucuaucucaucuaucucaa

SEQ ID NO: 671691 - RNA, 12 nt, Homo sapiens
agcaucucagga

SEQ ID NO: 671692 - RNA, 17 nt, Homo sapiens
agcaucucccagcaaga

SEQ ID NO: 671693 - RNA, 14 nt, Homo sapiens
agcaucucugagca

SEQ ID NO: 671694 - RNA, 14 nt, Homo sapiens
agcaucugacucac

SEQ ID NO: 671695 - RNA, 12 nt, Homo sapiens
agcaucugcaac

SEQ ID NO: 671696 - RNA, 21 nt, Homo sapiens
agcaucuggucuuguuuccag

SEQ ID NO: 671697 - RNA, 19 nt, Homo sapiens
agcaucuucccaaaaccau

SEQ ID NO: 671698 - RNA, 19 nt, Homo sapiens
agcaucuugccagccucag

SEQ ID NO: 671699 - RNA, 17 nt, Homo sapiens
agcaugaauaaaacacu

SEQ ID NO: 671700 - RNA, 21 nt, Homo sapiens
agcaugauacaaauuccacag

SEQ ID NO: 671701 - RNA, 16 nt, Homo sapiens
agcaugauauuuacug

SEQ ID NO: 671702 - RNA, 19 nt, Homo sapiens
agcaugcaauaaugugcaa

SEQ ID NO: 671703 - RNA, 13 nt, Homo sapiens
agcaugcuacagu

SEQ ID NO: 671704 - RNA, 22 nt, Homo sapiens
agcaugcucaguuggugcugcu

SEQ ID NO: 671705 - RNA, 17 nt, Homo sapiens
agcaugcugcuuugcca

SEQ ID NO: 671706 - RNA, 14 nt, Homo sapiens
agcaugcuuaccuu

SEQ ID NO: 671707 - RNA, 22 nt, Homo sapiens
agcaugcuuugcugcuaugaaa

SEQ ID NO: 671708 - RNA, 17 nt, Homo sapiens
agcauggagagccucuu

SEQ ID NO: 671709 - RNA, 11 nt, Homo sapiens
agcauggagcu

SEQ ID NO: 671710 - RNA, 17 nt, Homo sapiens
agcauggccccagucca

SEQ ID NO: 671711 - RNA, 13 nt, Homo sapiens
agcauguacucug

SEQ ID NO: 671712 - RNA, 15 nt, Homo sapiens
agcauguagccaguu

SEQ ID NO: 671713 - RNA, 20 nt, Homo sapiens
agcaugucucaauaguaaaa

SEQ ID NO: 671714 - RNA, 20 nt, Homo sapiens
agcaugugccuuaaugcuuc

SEQ ID NO: 671715 - RNA, 14 nt, Homo sapiens
agcauguucuugga

SEQ ID NO: 671716 - RNA, 12 nt, Homo sapiens
agcauguuucau

SEQ ID NO: 671717 - RNA, 22 nt, Homo sapiens
agcauuacgugagccagguaau

SEQ ID NO: 671718 - RNA, 22 nt, Homo sapiens
agcauuagcuggcgcauauuaa

SEQ ID NO: 671719 - RNA, 16 nt, Homo sapiens
agcauuccuauugaca

SEQ ID NO: 671720 - RNA, 23 nt, Homo sapiens
agcauucuggaggggagagcuuu

SEQ ID NO: 671721 - RNA, 20 nt, Homo sapiens
agcauucuugucacaauaaa

SEQ ID NO: 671722 - RNA, 14 nt, Homo sapiens
agcauugagcauaa

SEQ ID NO: 671723 - RNA, 14 nt, Homo sapiens
agcauugcuuucgu

SEQ ID NO: 671724 - RNA, 22 nt, Homo sapiens
agcauugucucguguacagcuc

SEQ ID NO: 671725 - RNA, 17 nt, Homo sapiens
agcauuuagacccugca

SEQ ID NO: 671726 - RNA, 17 nt, Homo sapiens
agcauuuagucuugcca

SEQ ID NO: 671727 - RNA, 20 nt, Homo sapiens
agcauuuccaacaccacaga

SEQ ID NO: 671728 - RNA, 21 nt, Homo sapiens
agcauuuccagccuaucuaau

SEQ ID NO: 671729 - RNA, 22 nt, Homo sapiens
agcauuugacccuugcugugaa

SEQ ID NO: 671730 - RNA, 13 nt, Homo sapiens
agcauuugcaaca

SEQ ID NO: 671731 - RNA, 12 nt, Homo sapiens
agcauuugcacc

SEQ ID NO: 671732 - RNA, 13 nt, Homo sapiens
agcauuugccacu

SEQ ID NO: 671733 - RNA, 16 nt, Homo sapiens
agcauuugccacuuag

SEQ ID NO: 671734 - RNA, 23 nt, Homo sapiens
agcauuugggcagacccugagca

SEQ ID NO: 671735 - RNA, 23 nt, Homo sapiens
agcauuugguagaaggacugaac

SEQ ID NO: 671736 - RNA, 21 nt, Homo sapiens
agcauuuggugccuauuugaa

SEQ ID NO: 671737 - RNA, 18 nt, Homo sapiens
agcauuuuucaaaugauc

SEQ ID NO: 671738 - RNA, 14 nt, Homo sapiens
agccaaaaagugga

SEQ ID NO: 671739 - RNA, 23 nt, Homo sapiens
agccaaaggauaaguguccccua

SEQ ID NO: 671740 - RNA, 15 nt, Homo sapiens
agccaaaggggagcc

SEQ ID NO: 671741 - RNA, 13 nt, Homo sapiens
agccaaauguaau

SEQ ID NO: 671742 - RNA, 22 nt, Homo sapiens
agccaaauucauccucuuacca

SEQ ID NO: 671743 - RNA, 14 nt, Homo sapiens
agccaaauuuccag

SEQ ID NO: 671744 - RNA, 16 nt, Homo sapiens
agccaacauggugaaa

SEQ ID NO: 671745 - RNA, 16 nt, Homo sapiens
agccaaccaagaugca

SEQ ID NO: 671746 - RNA, 16 nt, Homo sapiens
agccaagaacgcaggg

SEQ ID NO: 671747 - RNA, 12 nt, Homo sapiens
agccaagaccca

SEQ ID NO: 671748 - RNA, 23 nt, Homo sapiens
agccaaggaggugaggagcagag

SEQ ID NO: 671749 - RNA, 20 nt, Homo sapiens
agccaaggagucacugagac

SEQ ID NO: 671750 - RNA, 16 nt, Homo sapiens
agccaagggcugagug

SEQ ID NO: 671751 - RNA, 12 nt, Homo sapiens
agccaagguuca

SEQ ID NO: 671752 - RNA, 17 nt, Homo sapiens
agccaagucagcuuugc

SEQ ID NO: 671753 - RNA, 23 nt, Homo sapiens
agccaagucagcuuugccuucca

SEQ ID NO: 671754 - RNA, 20 nt, Homo sapiens
agccaagugcccucucugaa

SEQ ID NO: 671755 - RNA, 18 nt, Homo sapiens
agccaaguuuauauacaa

SEQ ID NO: 671756 - RNA, 16 nt, Homo sapiens
agccaaugucuccucc

SEQ ID NO: 671757 - RNA, 15 nt, Homo sapiens
agccacaaccaaaaa

SEQ ID NO: 671758 - RNA, 12 nt, Homo sapiens
agccacacucug

SEQ ID NO: 671759 - RNA, 22 nt, Homo sapiens
agccacacucugggcuccagag

SEQ ID NO: 671760 - RNA, 13 nt, Homo sapiens
agccacacugugg

SEQ ID NO: 671761 - RNA, 15 nt, Homo sapiens
agccacagaagccag

SEQ ID NO: 671762 - RNA, 14 nt, Homo sapiens
agccacagccugac

SEQ ID NO: 671763 - RNA, 22 nt, Homo sapiens
agccacagcugugcaugcucag

SEQ ID NO: 671764 - RNA, 15 nt, Homo sapiens
agccacaggacccca

SEQ ID NO: 671765 - RNA, 18 nt, Homo sapiens
agccacauugagacuuuc

SEQ ID NO: 671766 - RNA, 16 nt, Homo sapiens
agccaccaguucucau

SEQ ID NO: 671767 - RNA, 18 nt, Homo sapiens
agccaccaugcuugccug

SEQ ID NO: 671768 - RNA, 16 nt, Homo sapiens
agccaccccaugagcu

SEQ ID NO: 671769 - RNA, 18 nt, Homo sapiens
agccaccgugcccggcca

SEQ ID NO: 671770 - RNA, 14 nt, Homo sapiens
agccaccugggaac

SEQ ID NO: 671771 - RNA, 15 nt, Homo sapiens
agccacgcagugccu

SEQ ID NO: 671772 - RNA, 18 nt, Homo sapiens
agccacgcagugccugga

SEQ ID NO: 671773 - RNA, 15 nt, Homo sapiens
agccacuaaaacaca

SEQ ID NO: 671774 - RNA, 20 nt, Homo sapiens
agccacucagucucuuccac

SEQ ID NO: 671775 - RNA, 13 nt, Homo sapiens
agccacucuucca

SEQ ID NO: 671776 - RNA, 19 nt, Homo sapiens
agccacugcaccugaccug

SEQ ID NO: 671777 - RNA, 20 nt, Homo sapiens
agccacugcggaguccaggc

SEQ ID NO: 671778 - RNA, 11 nt, Homo sapiens
agccacugggc

SEQ ID NO: 671779 - RNA, 14 nt, Homo sapiens
agccacugugaugc

SEQ ID NO: 671780 - RNA, 22 nt, Homo sapiens
agccacugugucuggccagaaa

SEQ ID NO: 671781 - RNA, 23 nt, Homo sapiens
agccacugugucuuaugaggaau

SEQ ID NO: 671782 - RNA, 23 nt, Homo sapiens
agccagaaaaacguguugccuug

SEQ ID NO: 671783 - RNA, 15 nt, Homo sapiens
agccagaaagcacua

SEQ ID NO: 671784 - RNA, 12 nt, Homo sapiens
agccagacacuc

SEQ ID NO: 671785 - RNA, 11 nt, Homo sapiens
agccagacucu

SEQ ID NO: 671786 - RNA, 19 nt, Homo sapiens
agccagacuggacaggcaa

SEQ ID NO: 671787 - RNA, 22 nt, Homo sapiens
agccagagagugagagacauua

SEQ ID NO: 671788 - RNA, 14 nt, Homo sapiens
agccagaggcaucu

SEQ ID NO: 671789 - RNA, 15 nt, Homo sapiens
agccagaggcucuaa

SEQ ID NO: 671790 - RNA, 16 nt, Homo sapiens
agccagaggcucuaau

SEQ ID NO: 671791 - RNA, 18 nt, Homo sapiens
agccagaggcucuaaugu

SEQ ID NO: 671792 - RNA, 23 nt, Homo sapiens
agccagaggcucuaauguacaau

SEQ ID NO: 671793 - RNA, 12 nt, Homo sapiens
agccagcaagag

SEQ ID NO: 671794 - RNA, 18 nt, Homo sapiens
agccagcagccagcucuc

SEQ ID NO: 671795 - RNA, 21 nt, Homo sapiens
agccagccaucaaauagugaa

SEQ ID NO: 671796 - RNA, 21 nt, Homo sapiens
agccagcccccuccagcucau

SEQ ID NO: 671797 - RNA, 20 nt, Homo sapiens
agccagcccuggcccacccc

SEQ ID NO: 671798 - RNA, 14 nt, Homo sapiens
agccagccugggac

SEQ ID NO: 671799 - RNA, 15 nt, Homo sapiens
agccagcugugcacu

SEQ ID NO: 671800 - RNA, 18 nt, Homo sapiens
agccagcugugcacuuuc

SEQ ID NO: 671801 - RNA, 18 nt, Homo sapiens
agccaggaggccugcuag

SEQ ID NO: 671802 - RNA, 18 nt, Homo sapiens
agccaggcaugguggcac

SEQ ID NO: 671803 - RNA, 16 nt, Homo sapiens
agccaggccugaccuc

SEQ ID NO: 671804 - RNA, 23 nt, Homo sapiens
agccaggccugggggcagccucu

SEQ ID NO: 671805 - RNA, 17 nt, Homo sapiens
agccaggcuaugguugc

SEQ ID NO: 671806 - RNA, 22 nt, Homo sapiens
agccagggugagagucuggguc

SEQ ID NO: 671807 - RNA, 10 nt, Homo sapiens
agucaaucca

SEQ ID NO: 671808 - RNA, 15 nt, Homo sapiens
agucaauccugucau

SEQ ID NO: 671809 - RNA, 16 nt, Homo sapiens
agucaauguguucuua

SEQ ID NO: 671810 - RNA, 13 nt, Homo sapiens
agucaauuucuac

SEQ ID NO: 671811 - RNA, 15 nt, Homo sapiens
agucaauuucuacuu

SEQ ID NO: 671812 - RNA, 13 nt, Homo sapiens
agucacagccacc

SEQ ID NO: 671813 - RNA, 15 nt, Homo sapiens
agucacaguucaaaa

SEQ ID NO: 671814 - RNA, 17 nt, Homo sapiens
agucacaucucuuccuc

SEQ ID NO: 671815 - RNA, 12 nt, Homo sapiens
agucaccaaaua

SEQ ID NO: 671816 - RNA, 19 nt, Homo sapiens
agucaccacccagcccuuc

SEQ ID NO: 671817 - RNA, 18 nt, Homo sapiens
agucaccauacacacugu

SEQ ID NO: 671818 - RNA, 17 nt, Homo sapiens
agucacccaaacacuuc

SEQ ID NO: 671819 - RNA, 18 nt, Homo sapiens
agucacccagagcacagg

SEQ ID NO: 671820 - RNA, 17 nt, Homo sapiens
agucacccuucugggca

SEQ ID NO: 671821 - RNA, 14 nt, Homo sapiens
agucaccgggauga

SEQ ID NO: 671822 - RNA, 23 nt, Homo sapiens
agucaccuccuccacucacucca

SEQ ID NO: 671823 - RNA, 16 nt, Homo sapiens
agucacgcaugcagug

SEQ ID NO: 671824 - RNA, 13 nt, Homo sapiens
auugccuuuccag

SEQ ID NO: 671825 - RNA, 15 nt, Homo sapiens
auugcgaaugugcag

SEQ ID NO: 671826 - RNA, 16 nt, Homo sapiens
auugcgcucucaagac

SEQ ID NO: 671827 - RNA, 22 nt, Homo sapiens
auugcuaaaaaauaaauaaaag

SEQ ID NO: 671828 - RNA, 14 nt, Homo sapiens
auugcuagccagca

SEQ ID NO: 671829 - RNA, 20 nt, Homo sapiens
auugcuagccagcauuccau

SEQ ID NO: 671830 - RNA, 19 nt, Homo sapiens
auugcuauuuauuuuuaca

SEQ ID NO: 671831 - RNA, 22 nt, Homo sapiens
auugcucccuaccagcugaaca

SEQ ID NO: 671832 - RNA, 16 nt, Homo sapiens
auugcucuaugucugc

SEQ ID NO: 671833 - RNA, 22 nt, Homo sapiens
auugcugugucuccucucagag

SEQ ID NO: 671834 - RNA, 20 nt, Homo sapiens
auugcuuacaagccuaagaa

SEQ ID NO: 671835 - RNA, 14 nt, Homo sapiens
auugcuugagccca

SEQ ID NO: 671836 - RNA, 15 nt, Homo sapiens
auugcuuuuaugaua

SEQ ID NO: 671837 - RNA, 20 nt, Homo sapiens
auuggaagaagcacugaugg

SEQ ID NO: 671838 - RNA, 16 nt, Homo sapiens
auuggaagcugucaua

SEQ ID NO: 671839 - RNA, 14 nt, Homo sapiens
auuggaagugcagu

SEQ ID NO: 671840 - RNA, 16 nt, Homo sapiens
auuggaaucugauaua

SEQ ID NO: 671841 - RNA, 18 nt, Homo sapiens
auuggaauuaaccuggug

SEQ ID NO: 671842 - RNA, 19 nt, Homo sapiens
auuggaauucuacuggaaa

SEQ ID NO: 671843 - RNA, 20 nt, Homo sapiens
auuggaccuguucaaaaagg

SEQ ID NO: 671844 - RNA, 17 nt, Homo sapiens
auuggagaagauuuaug

SEQ ID NO: 671845 - RNA, 19 nt, Homo sapiens
auuggagaguaaaaacuga

SEQ ID NO: 671846 - RNA, 17 nt, Homo sapiens
auuggagcaagcuugcc

SEQ ID NO: 671847 - RNA, 18 nt, Homo sapiens
auuggagggaagacaggu

SEQ ID NO: 671848 - RNA, 22 nt, Homo sapiens
auuggcaccccuuucuaguuca

SEQ ID NO: 671849 - RNA, 15 nt, Homo sapiens
auuggcagcucaaag

SEQ ID NO: 671850 - RNA, 13 nt, Homo sapiens
auuggccagugag

SEQ ID NO: 671851 - RNA, 17 nt, Homo sapiens
auuggccuccaaacaca

SEQ ID NO: 671852 - RNA, 21 nt, Homo sapiens
auuggcuaauaaauguugcca

SEQ ID NO: 671853 - RNA, 17 nt, Homo sapiens
auuggcuugaauuccau

SEQ ID NO: 671854 - RNA, 23 nt, Homo sapiens
auugggaaaugaaaaaaaaaugg

SEQ ID NO: 671855 - RNA, 21 nt, Homo sapiens
auugggacgcacagugcaguu

SEQ ID NO: 671856 - RNA, 15 nt, Homo sapiens
auugggaguccaggc

SEQ ID NO: 671857 - RNA, 22 nt, Homo sapiens
auugggcacagccuagggucuu

SEQ ID NO: 671858 - RNA, 13 nt, Homo sapiens
auugggcaugcca

SEQ ID NO: 671859 - RNA, 15 nt, Homo sapiens
auugggcgauuuggg

SEQ ID NO: 671860 - RNA, 18 nt, Homo sapiens
auugggcugacaccuacc

SEQ ID NO: 671861 - RNA, 20 nt, Homo sapiens
auugggcuugugauuuccau

SEQ ID NO: 671862 - RNA, 19 nt, Homo sapiens
auuggguacccaguuaaau

SEQ ID NO: 671863 - RNA, 21 nt, Homo sapiens
auuggguagaaagauggggca

SEQ ID NO: 671864 - RNA, 14 nt, Homo sapiens
auuggucauuguga

SEQ ID NO: 671865 - RNA, 22 nt, Homo sapiens
auugguuuuccaaucauuugac

SEQ ID NO: 671866 - RNA, 17 nt, Homo sapiens
auuguaaaacauucaca

SEQ ID NO: 671867 - RNA, 15 nt, Homo sapiens
auuguaaauacugga

SEQ ID NO: 671868 - RNA, 16 nt, Homo sapiens
auuguacacgcugaug

SEQ ID NO: 671869 - RNA, 20 nt, Homo sapiens
auuguacauauuuguggaau

SEQ ID NO: 671870 - RNA, 12 nt, Homo sapiens
auuguacuuaaa

SEQ ID NO: 671871 - RNA, 16 nt, Homo sapiens
auuguagaaacacagu

SEQ ID NO: 671872 - RNA, 13 nt, Homo sapiens
auuguagcacauu

SEQ ID NO: 671873 - RNA, 17 nt, Homo sapiens
auuguauaaaugcaaua

SEQ ID NO: 671874 - RNA, 15 nt, Homo sapiens
auuguaugucaagau

SEQ ID NO: 671875 - RNA, 17 nt, Homo sapiens
auuguauuaauaccaaa

SEQ ID NO: 671876 - RNA, 19 nt, Homo sapiens
auuguauuaauaccaaagu

SEQ ID NO: 671877 - RNA, 15 nt, Homo sapiens
auuguauuacagaug

SEQ ID NO: 671878 - RNA, 14 nt, Homo sapiens
auugucaccaugau

SEQ ID NO: 671879 - RNA, 13 nt, Homo sapiens
auugucagaaaag

SEQ ID NO: 671880 - RNA, 15 nt, Homo sapiens
auugucauaaccaac

SEQ ID NO: 671881 - RNA, 22 nt, Homo sapiens
auugucauaggauuaagcaguu

SEQ ID NO: 671882 - RNA, 15 nt, Homo sapiens
auugucauugauaca

SEQ ID NO: 671883 - RNA, 20 nt, Homo sapiens
auugucccuguguuguccca

SEQ ID NO: 671884 - RNA, 21 nt, Homo sapiens
auugucccuguguugucccau

SEQ ID NO: 671885 - RNA, 17 nt, Homo sapiens
auugucgcucagcaaua

SEQ ID NO: 671886 - RNA, 21 nt, Homo sapiens
auugucuaaucuguagaagcu

SEQ ID NO: 671887 - RNA, 16 nt, Homo sapiens
auugucuacucugaag

SEQ ID NO: 671888 - RNA, 20 nt, Homo sapiens
auugucuccuugguuauauu

SEQ ID NO: 671889 - RNA, 23 nt, Homo sapiens
auugucucguguacagcucccuu

SEQ ID NO: 671890 - RNA, 14 nt, Homo sapiens
auugucuuacuguu

SEQ ID NO: 671891 - RNA, 18 nt, Homo sapiens
auugucuuacuguugcau

SEQ ID NO: 671892 - RNA, 18 nt, Homo sapiens
auuuaauuuguaugcuaa

SEQ ID NO: 671893 - RNA, 19 nt, Homo sapiens
auuuaauuuuuuacuuuca

SEQ ID NO: 671894 - RNA, 19 nt, Homo sapiens
auuuacaaaauuacacagu

SEQ ID NO: 671895 - RNA, 13 nt, Homo sapiens
auuuacaaauguu

SEQ ID NO: 671896 - RNA, 15 nt, Homo sapiens
auuuacaaggaguua

SEQ ID NO: 671897 - RNA, 22 nt, Homo sapiens
auuuacaggaacuucaucauaa

SEQ ID NO: 671898 - RNA, 12 nt, Homo sapiens
auuuacauuaau

SEQ ID NO: 671899 - RNA, 14 nt, Homo sapiens
auuuacgcuuugau

SEQ ID NO: 671900 - RNA, 11 nt, Homo sapiens
auuuacuacag

SEQ ID NO: 671901 - RNA, 24 nt, Homo sapiens
auuuacuguuuuuuucuguagcac

SEQ ID NO: 671902 - RNA, 11 nt, Homo sapiens
auuuacuuaac

SEQ ID NO: 671903 - RNA, 19 nt, Homo sapiens
auuuagaaaaacaucccaa

SEQ ID NO: 671904 - RNA, 16 nt, Homo sapiens
auuuagaaaaagucaa

SEQ ID NO: 671905 - RNA, 22 nt, Homo sapiens
auuuagaaaauagagcuuuuaa

SEQ ID NO: 671906 - RNA, 12 nt, Homo sapiens
auuuagaacuuu

SEQ ID NO: 671907 - RNA, 19 nt, Homo sapiens
auuuagaagccaacuauga

SEQ ID NO: 671908 - RNA, 12 nt, Homo sapiens
auuuagaauuaa

SEQ ID NO: 671909 - RNA, 21 nt, Homo sapiens
auuuagaccccauacaaguuu

SEQ ID NO: 671910 - RNA, 14 nt, Homo sapiens
auuuagagucaauu

SEQ ID NO: 671911 - RNA, 18 nt, Homo sapiens
auuuagagucaauuugcu

SEQ ID NO: 671912 - RNA, 20 nt, Homo sapiens
auuuagccaggaaaggggug

SEQ ID NO: 671913 - RNA, 14 nt, Homo sapiens
auuuagcucugaag

SEQ ID NO: 671914 - RNA, 22 nt, Homo sapiens
auuuaggaaaugggcagugaag

SEQ ID NO: 671915 - RNA, 15 nt, Homo sapiens
auuuaggaguauuau

SEQ ID NO: 671916 - RNA, 23 nt, Homo sapiens
auuuaggauaaccuugugccuug

SEQ ID NO: 671917 - RNA, 12 nt, Homo sapiens
auuuaggggcaa

SEQ ID NO: 671918 - RNA, 18 nt, Homo sapiens
auuuaguaacaguuguga

SEQ ID NO: 671919 - RNA, 21 nt, Homo sapiens
auuuaguaauaguccaauauu

SEQ ID NO: 671920 - RNA, 21 nt, Homo sapiens
auuuaguagaaaggucaucca

SEQ ID NO: 671921 - RNA, 22 nt, Homo sapiens
auuuagugaucaaauugugcag

SEQ ID NO: 671922 - RNA, 13 nt, Homo sapiens
auuuaguuucaua

SEQ ID NO: 671923 - RNA, 21 nt, Homo sapiens
auuuaguuuguagcucauuaa

SEQ ID NO: 671924 - RNA, 13 nt, Homo sapiens
auuuauaacucau

SEQ ID NO: 671925 - RNA, 14 nt, Homo sapiens
auuuauaagcauuu

SEQ ID NO: 671926 - RNA, 19 nt, Homo sapiens
auuuauaccucaguuugca

SEQ ID NO: 671927 - RNA, 13 nt, Homo sapiens
auuuauacuguau

SEQ ID NO: 671928 - RNA, 14 nt, Homo sapiens
auuuauagcaagau

SEQ ID NO: 671929 - RNA, 17 nt, Homo sapiens
auuuauauaagucuguu

SEQ ID NO: 671930 - RNA, 12 nt, Homo sapiens
auuuauauaugu

SEQ ID NO: 671931 - RNA, 23 nt, Homo sapiens
auuuauaucgcuggccagcauua

SEQ ID NO: 671932 - RNA, 22 nt, Homo sapiens
auuuauaucuaauuauuuccac

SEQ ID NO: 671933 - RNA, 18 nt, Homo sapiens
auuuauaugaauuuccac

SEQ ID NO: 671934 - RNA, 15 nt, Homo sapiens
auuuauauuccacuu

SEQ ID NO: 671935 - RNA, 14 nt, Homo sapiens
auuuauauuccuuu

SEQ ID NO: 671936 - RNA, 12 nt, Homo sapiens
auuuaucaagga

SEQ ID NO: 671937 - RNA, 13 nt, Homo sapiens
auuuaucacugaa

SEQ ID NO: 671938 - RNA, 18 nt, Homo sapiens
auuuaucuuuaguuuguu

SEQ ID NO: 671939 - RNA, 13 nt, Homo sapiens
auuuaucuuucaa

SEQ ID NO: 671940 - RNA, 12 nt, Homo sapiens
auuuaugaaggc

SEQ ID NO: 671941 - RNA, 22 nt, Homo sapiens
auuuaugaugcacuuauucaau

SEQ ID NO: 671942 - RNA, 15 nt, Homo sapiens
auuuaugaugcaguu

SEQ ID NO: 671943 - RNA, 23 nt, Homo sapiens
auuuaugcugcucauccaaaguu

SEQ ID NO: 671944 - RNA, 19 nt, Homo sapiens
auuuauggauuuaugacau

SEQ ID NO: 671945 - RNA, 19 nt, Homo sapiens
auuuauggccgggcagggu

SEQ ID NO: 671946 - RNA, 19 nt, Homo sapiens
auuuauggucaacacuuaa

SEQ ID NO: 671947 - RNA, 21 nt, Homo sapiens
auuuaugucccugacuguaaa

SEQ ID NO: 671948 - RNA, 22 nt, Homo sapiens
auuuauguggcuuguuuauccu

SEQ ID NO: 671949 - RNA, 17 nt, Homo sapiens
auuuauuaacuaaucaa

SEQ ID NO: 671950 - RNA, 19 nt, Homo sapiens
auuuauucacauauaucaa

SEQ ID NO: 671951 - RNA, 20 nt, Homo sapiens
auuuauucuuggugaagaug

SEQ ID NO: 671952 - RNA, 14 nt, Homo sapiens
auuuauuguauuag

SEQ ID NO: 671953 - RNA, 16 nt, Homo sapiens
auuuauuucauccagu

SEQ ID NO: 671954 - RNA, 21 nt, Homo sapiens
auuuauuuuuauguucuuggc

SEQ ID NO: 671955 - RNA, 16 nt, Homo sapiens
auuuauuuuuugccau

SEQ ID NO: 671956 - RNA, 23 nt, Homo sapiens
auuucaaaacucauuuccuaugu

SEQ ID NO: 671957 - RNA, 13 nt, Homo sapiens
auuucaagaccuc

SEQ ID NO: 671958 - RNA, 16 nt, Homo sapiens
auuucaccaccaaaug

SEQ ID NO: 671959 - RNA, 15 nt, Homo sapiens
agucuguuucaggag

SEQ ID NO: 671960 - RNA, 18 nt, Homo sapiens
agucuuaaagcauuucag

SEQ ID NO: 671961 - RNA, 19 nt, Homo sapiens
agucuuacucugucuccca

SEQ ID NO: 671962 - RNA, 21 nt, Homo sapiens
agucuuagcuccuguguuaca

SEQ ID NO: 671963 - RNA, 17 nt, Homo sapiens
agucuuauuuccucaac

SEQ ID NO: 671964 - RNA, 13 nt, Homo sapiens
agucuucccugau

SEQ ID NO: 671965 - RNA, 19 nt, Homo sapiens
agucuucucauagcauuaa

SEQ ID NO: 671966 - RNA, 21 nt, Homo sapiens
agucuucucauagcauuaacu

SEQ ID NO: 671967 - RNA, 14 nt, Homo sapiens
agucuucuccucca

SEQ ID NO: 671968 - RNA, 17 nt, Homo sapiens
agucuugaaacaagcaa

SEQ ID NO: 671969 - RNA, 18 nt, Homo sapiens
agucuugaauaguacauu

SEQ ID NO: 671970 - RNA, 19 nt, Homo sapiens
agucuugaugacauuucac

SEQ ID NO: 671971 - RNA, 19 nt, Homo sapiens
agucuugcucugucuccca

SEQ ID NO: 671972 - RNA, 13 nt, Homo sapiens
agucuuguagcua

SEQ ID NO: 671973 - RNA, 16 nt, Homo sapiens
agucuuguauuaaguu

SEQ ID NO: 671974 - RNA, 16 nt, Homo sapiens
agucuuuucauugcua

SEQ ID NO: 671975 - RNA, 15 nt, Homo sapiens
agucuuuugcauguc

SEQ ID NO: 671976 - RNA, 13 nt, Homo sapiens
auuccuaucucau

SEQ ID NO: 671977 - RNA, 22 nt, Homo sapiens
auuccucaaaaaauugcacaua

SEQ ID NO: 671978 - RNA, 12 nt, Homo sapiens
auuccucuacug

SEQ ID NO: 671979 - RNA, 22 nt, Homo sapiens
auuccucuugccucucucagga

SEQ ID NO: 671980 - RNA, 16 nt, Homo sapiens
auuccugaagccagau

SEQ ID NO: 671981 - RNA, 20 nt, Homo sapiens
auuccugauaauaauugauc

SEQ ID NO: 671982 - RNA, 16 nt, Homo sapiens
auuccugaucuuccca

SEQ ID NO: 671983 - RNA, 15 nt, Homo sapiens
auuccugaugaccaa

SEQ ID NO: 671984 - RNA, 18 nt, Homo sapiens
auuccugcgcauggugca

SEQ ID NO: 671985 - RNA, 22 nt, Homo sapiens
auuccugcuggccccuucuggg

SEQ ID NO: 671986 - RNA, 16 nt, Homo sapiens
auuccuggcucuaccc

SEQ ID NO: 671987 - RNA, 22 nt, Homo sapiens
auuccugggguaaaguaucacu

SEQ ID NO: 671988 - RNA, 18 nt, Homo sapiens
auuccugguuugacucag

SEQ ID NO: 671989 - RNA, 15 nt, Homo sapiens
auuccuguagcaucu

SEQ ID NO: 671990 - RNA, 19 nt, Homo sapiens
auuccuguuagccaggugg

SEQ ID NO: 671991 - RNA, 16 nt, Homo sapiens
auuccuguugauggga

SEQ ID NO: 671992 - RNA, 20 nt, Homo sapiens
auuccuguuugucuacauau

SEQ ID NO: 671993 - RNA, 16 nt, Homo sapiens
auuccuuagauaccuu

SEQ ID NO: 671994 - RNA, 18 nt, Homo sapiens
auuccuuaggaggacuuu

SEQ ID NO: 671995 - RNA, 15 nt, Homo sapiens
auuccuuagucucaa

SEQ ID NO: 671996 - RNA, 17 nt, Homo sapiens
auucgcugugucagcau

SEQ ID NO: 671997 - RNA, 14 nt, Homo sapiens
auucggacggccaa

SEQ ID NO: 671998 - RNA, 14 nt, Homo sapiens
auucggugugcugc

SEQ ID NO: 671999 - RNA, 18 nt, Homo sapiens
auucggugugcugccaac

SEQ ID NO: 672000 - RNA, 13 nt, Homo sapiens
auucuaaaccaaa

SEQ ID NO: 672001 - RNA, 20 nt, Homo sapiens
auucuaaauccgacuugaau

SEQ ID NO: 672002 - RNA, 18 nt, Homo sapiens
auucuaacccaagacaug

SEQ ID NO: 672003 - RNA, 23 nt, Homo sapiens
auucuaacccaagacaugacauu

SEQ ID NO: 672004 - RNA, 22 nt, Homo sapiens
auucuaacccagguauccaaaa

SEQ ID NO: 672005 - RNA, 20 nt, Homo sapiens
auucuaaugucuucauuuca

SEQ ID NO: 672006 - RNA, 14 nt, Homo sapiens
auucuaauuugcau

SEQ ID NO: 672007 - RNA, 18 nt, Homo sapiens
auucuacuagcaggcaau

SEQ ID NO: 672008 - RNA, 17 nt, Homo sapiens
auucuaguggcuguuca

SEQ ID NO: 672009 - RNA, 14 nt, Homo sapiens
auucuauagccaua

SEQ ID NO: 672010 - RNA, 16 nt, Homo sapiens
auucuauccaucuccu

SEQ ID NO: 672011 - RNA, 18 nt, Homo sapiens
auucuauuacgugcaaua

SEQ ID NO: 672012 - RNA, 22 nt, Homo sapiens
auucuauugggauauccuuuca

SEQ ID NO: 672013 - RNA, 15 nt, Homo sapiens
auucucacaaggaaa

SEQ ID NO: 672014 - RNA, 12 nt, Homo sapiens
auucucaccagg

SEQ ID NO: 672015 - RNA, 19 nt, Homo sapiens
auucucaugggaaggggag

SEQ ID NO: 672016 - RNA, 19 nt, Homo sapiens
auucucauuuguucucaca

SEQ ID NO: 672017 - RNA, 18 nt, Homo sapiens
auucucccaaaguaccuu

SEQ ID NO: 672018 - RNA, 15 nt, Homo sapiens
auucuccugccucag

SEQ ID NO: 672019 - RNA, 17 nt, Homo sapiens
auucucgcuucccugaa

SEQ ID NO: 672020 - RNA, 16 nt, Homo sapiens
auucucggcucagguu

SEQ ID NO: 672021 - RNA, 22 nt, Homo sapiens
auucucguauccaacccaagga

SEQ ID NO: 672022 - RNA, 21 nt, Homo sapiens
auucucucacaguguacucua

SEQ ID NO: 672023 - RNA, 19 nt, Homo sapiens
auucucucaucuaacugau

SEQ ID NO: 672024 - RNA, 18 nt, Homo sapiens
auucucugagcugugcag

SEQ ID NO: 672025 - RNA, 12 nt, Homo sapiens
auugacacugaa

SEQ ID NO: 672026 - RNA, 14 nt, Homo sapiens
auugacaguggugg

SEQ ID NO: 672027 - RNA, 24 nt, Homo sapiens
auugacaugugccagggcaaugau

SEQ ID NO: 672028 - RNA, 12 nt, Homo sapiens
auugacauuugu

SEQ ID NO: 672029 - RNA, 15 nt, Homo sapiens
auugaccuacuuugg

SEQ ID NO: 672030 - RNA, 23 nt, Homo sapiens
auugaccucagcugcacauuccu

SEQ ID NO: 672031 - RNA, 23 nt, Homo sapiens
auugaccuguccucuuugugaua

SEQ ID NO: 672032 - RNA, 14 nt, Homo sapiens
auugacgacuucac

SEQ ID NO: 672033 - RNA, 18 nt, Homo sapiens
auugacgcauauuuaacu

SEQ ID NO: 672034 - RNA, 20 nt, Homo sapiens
auugagaaaaauauauacua

SEQ ID NO: 672035 - RNA, 15 nt, Homo sapiens
auugagaacugcaua

SEQ ID NO: 672036 - RNA, 14 nt, Homo sapiens
auugagaagcacaa

SEQ ID NO: 672037 - RNA, 14 nt, Homo sapiens
auugagacuauuua

SEQ ID NO: 672038 - RNA, 20 nt, Homo sapiens
auugagauaaugauacuuaa

SEQ ID NO: 672039 - RNA, 19 nt, Homo sapiens
auugagauacuaucauuaa

SEQ ID NO: 672040 - RNA, 15 nt, Homo sapiens
auugagcaguuagcu

SEQ ID NO: 672041 - RNA, 13 nt, Homo sapiens
auugagcauuuga

SEQ ID NO: 672042 - RNA, 18 nt, Homo sapiens
auugaggagcugcacuga

SEQ ID NO: 672043 - RNA, 15 nt, Homo sapiens
auugagggccaguga

SEQ ID NO: 672044 - RNA, 16 nt, Homo sapiens
auugagggccagugau

SEQ ID NO: 672045 - RNA, 22 nt, Homo sapiens
auugaguggcugcccugcagaa

SEQ ID NO: 672046 - RNA, 20 nt, Homo sapiens
auugaguucgaggacuacaa

SEQ ID NO: 672047 - RNA, 16 nt, Homo sapiens
auugaguuuucagugg

SEQ ID NO: 672048 - RNA, 19 nt, Homo sapiens
auugauagaacuacuuuga

SEQ ID NO: 672049 - RNA, 23 nt, Homo sapiens
auugauauacacggaugacuuaa

SEQ ID NO: 672050 - RNA, 17 nt, Homo sapiens
auugauaugcuuauaca

SEQ ID NO: 672051 - RNA, 12 nt, Homo sapiens
auugauauucaa

SEQ ID NO: 672052 - RNA, 16 nt, Homo sapiens
auugauauugaaggaa

SEQ ID NO: 672053 - RNA, 12 nt, Homo sapiens
auugauguugcu

SEQ ID NO: 672054 - RNA, 20 nt, Homo sapiens
auugauguuuuacgugcaaa

SEQ ID NO: 672055 - RNA, 14 nt, Homo sapiens
auugauuauucuga

SEQ ID NO: 672056 - RNA, 14 nt, Homo sapiens
auugauugauguac

SEQ ID NO: 672057 - RNA, 17 nt, Homo sapiens
auugauuuuaaccaaug

SEQ ID NO: 672058 - RNA, 15 nt, Homo sapiens
auugcaaaagggaac

SEQ ID NO: 672059 - RNA, 14 nt, Homo sapiens
auugcaaaauuugg

SEQ ID NO: 672060 - RNA, 22 nt, Homo sapiens
auugcaaauaaaccacuuucua

SEQ ID NO: 672061 - RNA, 17 nt, Homo sapiens
auugcaauacauuucaa

SEQ ID NO: 672062 - RNA, 16 nt, Homo sapiens
auugcacagagcacac

SEQ ID NO: 672063 - RNA, 21 nt, Homo sapiens
auugcacgggagaauauacaa

SEQ ID NO: 672064 - RNA, 17 nt, Homo sapiens
auugcaucccaaaccac

SEQ ID NO: 672065 - RNA, 13 nt, Homo sapiens
auugcaugacaaa

SEQ ID NO: 672066 - RNA, 23 nt, Homo sapiens
auugcaugcagugccggcugcca

SEQ ID NO: 672067 - RNA, 16 nt, Homo sapiens
auugcauuucugcucu

SEQ ID NO: 672068 - RNA, 17 nt, Homo sapiens
auugccaaccaguuuga

SEQ ID NO: 672069 - RNA, 18 nt, Homo sapiens
auugccacaaguccagcu

SEQ ID NO: 672070 - RNA, 15 nt, Homo sapiens
auugccacagcugua

SEQ ID NO: 672071 - RNA, 23 nt, Homo sapiens
auugccauagcugacuacaaauu

SEQ ID NO: 672072 - RNA, 17 nt, Homo sapiens
auugcccgaaaccagag

SEQ ID NO: 672073 - RNA, 16 nt, Homo sapiens
auugccuacaauaaaa

SEQ ID NO: 672074 - RNA, 16 nt, Homo sapiens
auugccuagcucuuuu

SEQ ID NO: 672075 - RNA, 17 nt, Homo sapiens
auugccuauaauacuug

SEQ ID NO: 672076 - RNA, 22 nt, Homo sapiens
auugccuguuaaauauacacua

SEQ ID NO: 672077 - RNA, 18 nt, Homo sapiens
auugccuuccucgugcag

SEQ ID NO: 672078 - RNA, 15 nt, Homo sapiens
cuccacgccauuucc

SEQ ID NO: 672079 - RNA, 15 nt, Homo sapiens
cuccacucaccacaa

SEQ ID NO: 672080 - RNA, 15 nt, Homo sapiens
cuccacucacuccag

SEQ ID NO: 672081 - RNA, 18 nt, Homo sapiens
cuccacucagguucuuca

SEQ ID NO: 672082 - RNA, 21 nt, Homo sapiens
cuccacucugauucaccucuu

SEQ ID NO: 672083 - RNA, 14 nt, Homo sapiens
cucggccuucacaa

SEQ ID NO: 672084 - RNA, 20 nt, Homo sapiens
cucgggaaacacacaagcaa

SEQ ID NO: 672085 - RNA, 17 nt, Homo sapiens
cucgggauuaguacaca

SEQ ID NO: 672086 - RNA, 12 nt, Homo sapiens
cucggggacaaa

SEQ ID NO: 672087 - RNA, 20 nt, Homo sapiens
cucgguggcugcacagaagg

SEQ ID NO: 672088 - RNA, 21 nt, Homo sapiens
cucgugcccaucaagugcagu

SEQ ID NO: 672089 - RNA, 19 nt, Homo sapiens
cucgugguaggacuguaga

SEQ ID NO: 672090 - RNA, 23 nt, Homo sapiens
ccugaucucugaccucugcugag

SEQ ID NO: 672091 - RNA, 17 nt, Homo sapiens
ccugaugaaaaauaugu

SEQ ID NO: 672092 - RNA, 15 nt, Homo sapiens
ccugauggugcugcu

SEQ ID NO: 672093 - RNA, 17 nt, Homo sapiens
ccugauucauacuccuu

SEQ ID NO: 672094 - RNA, 19 nt, Homo sapiens
ccugauuccuuuaaaugaa

SEQ ID NO: 672095 - RNA, 22 nt, Homo sapiens
ccugauuccuuuaaaugaauau

SEQ ID NO: 672096 - RNA, 20 nt, Homo sapiens
ccugauugaucacacagugu

SEQ ID NO: 672097 - RNA, 21 nt, Homo sapiens
ccugauugaucacacaguguu

SEQ ID NO: 672098 - RNA, 19 nt, Homo sapiens
ccugauuuaauaugcaaag

SEQ ID NO: 672099 - RNA, 18 nt, Homo sapiens
ccuuacuugcacuguuac

SEQ ID NO: 672100 - RNA, 21 nt, Homo sapiens
ccuuagaaauguaaacugcca

SEQ ID NO: 672101 - RNA, 22 nt, Homo sapiens
ccuuagauguucuaagucuuuc

SEQ ID NO: 672102 - RNA, 23 nt, Homo sapiens
ccuuagauguucuaagucuuucc

SEQ ID NO: 672103 - RNA, 16 nt, Homo sapiens
ccuuagauuagcucug

SEQ ID NO: 672104 - RNA, 18 nt, Homo sapiens
ccuuagcccugucugcua

SEQ ID NO: 672105 - RNA, 18 nt, Homo sapiens
ccuuagcuaaaugcaauu

SEQ ID NO: 672106 - RNA, 11 nt, Homo sapiens
ccagcucugac

SEQ ID NO: 672107 - RNA, 15 nt, Homo sapiens
ccagcucugcccaag

SEQ ID NO: 672108 - RNA, 22 nt, Homo sapiens
ccagcugcagggcacggggacc

SEQ ID NO: 672109 - RNA, 13 nt, Homo sapiens
ccagcugcugucu

SEQ ID NO: 672110 - RNA, 20 nt, Homo sapiens
ccagcugcuuuuugugauuu

SEQ ID NO: 672111 - RNA, 16 nt, Homo sapiens
ccagcugggguccugu

SEQ ID NO: 672112 - RNA, 17 nt, Homo sapiens
ccagcugggucaggcag

SEQ ID NO: 672113 - RNA, 23 nt, Homo sapiens
ccagcugggucaggcagggugca

SEQ ID NO: 672114 - RNA, 19 nt, Homo sapiens
ccagcuguacuagugccau

SEQ ID NO: 672115 - RNA, 16 nt, Homo sapiens
ccagcuguagccaugg

SEQ ID NO: 672116 - RNA, 15 nt, Homo sapiens
ccagcugugcacuuu

SEQ ID NO: 672117 - RNA, 16 nt, Homo sapiens
ccagcugugcacuuuc

SEQ ID NO: 672118 - RNA, 19 nt, Homo sapiens
ccagcugugcacuuucuuc

SEQ ID NO: 672119 - RNA, 16 nt, Homo sapiens
ccagcuuagaguucuu

SEQ ID NO: 672120 - RNA, 19 nt, Homo sapiens
ccagcuuagcaacugcugg

SEQ ID NO: 672121 - RNA, 14 nt, Homo sapiens
ccagcuuaucucag

SEQ ID NO: 672122 - RNA, 11 nt, Homo sapiens
ccagcuuuaag

SEQ ID NO: 672123 - RNA, 15 nt, Homo sapiens
ccaggaaaacuggga

SEQ ID NO: 672124 - RNA, 15 nt, Homo sapiens
ccaggaaagagcagu

SEQ ID NO: 672125 - RNA, 20 nt, Homo sapiens
ccaggaaagguuuuccuuau

SEQ ID NO: 672126 - RNA, 19 nt, Homo sapiens
ccaggaacaauaaaauguc

SEQ ID NO: 672127 - RNA, 21 nt, Homo sapiens
ccaggaacagcaaaugcaaaa

SEQ ID NO: 672128 - RNA, 21 nt, Homo sapiens
ccaggaacccuccuccuguca

SEQ ID NO: 672129 - RNA, 13 nt, Homo sapiens
ccaggaacugccu

SEQ ID NO: 672130 - RNA, 13 nt, Homo sapiens
ccaggaaugccuc

SEQ ID NO: 672131 - RNA, 12 nt, Homo sapiens
ccaggaauuuga

SEQ ID NO: 672132 - RNA, 13 nt, Homo sapiens
ccaggacaucucu

SEQ ID NO: 672133 - RNA, 22 nt, Homo sapiens
ccaggacggggcacaaguguca

SEQ ID NO: 672134 - RNA, 18 nt, Homo sapiens
ccaggagaagcucagcug

SEQ ID NO: 672135 - RNA, 13 nt, Homo sapiens
ccaggagacaguu

SEQ ID NO: 672136 - RNA, 21 nt, Homo sapiens
ccaggagauggaaguugcagu

SEQ ID NO: 672137 - RNA, 17 nt, Homo sapiens
ccaggagcaacagccua

SEQ ID NO: 672138 - RNA, 15 nt, Homo sapiens
ccaggagcccggcuu

SEQ ID NO: 672139 - RNA, 17 nt, Homo sapiens
ccaggagcugauggcag

SEQ ID NO: 672140 - RNA, 22 nt, Homo sapiens
ccaggaggcccugguccuggcc

SEQ ID NO: 672141 - RNA, 22 nt, Homo sapiens
ccaggaguucgaggcugcaguc

SEQ ID NO: 672142 - RNA, 17 nt, Homo sapiens
ccaggaguuugagacca

SEQ ID NO: 672143 - RNA, 15 nt, Homo sapiens
ccaggauagugggca

SEQ ID NO: 672144 - RNA, 19 nt, Homo sapiens
ccaggaugaguuacuugaa

SEQ ID NO: 672145 - RNA, 23 nt, Homo sapiens
ccaggaugcuaaagaugaugaug

SEQ ID NO: 672146 - RNA, 20 nt, Homo sapiens
ccaggauggucucgaucucu

SEQ ID NO: 672147 - RNA, 13 nt, Homo sapiens
ccaggcaccacca

SEQ ID NO: 672148 - RNA, 16 nt, Homo sapiens
ccaggcacugccugga

SEQ ID NO: 672149 - RNA, 18 nt, Homo sapiens
ccaggcagaauggcugca

SEQ ID NO: 672150 - RNA, 14 nt, Homo sapiens
ccaggcagauccca

SEQ ID NO: 672151 - RNA, 18 nt, Homo sapiens
ccaggcagauccucugga

SEQ ID NO: 672152 - RNA, 19 nt, Homo sapiens
ccaggcagcugagaccagg

SEQ ID NO: 672153 - RNA, 17 nt, Homo sapiens
ccaggcaggugccugga

SEQ ID NO: 672154 - RNA, 16 nt, Homo sapiens
ccaggcagucgggggc

SEQ ID NO: 672155 - RNA, 12 nt, Homo sapiens
ccaggcauuugc

SEQ ID NO: 672156 - RNA, 12 nt, Homo sapiens
ccaggccagugg

SEQ ID NO: 672157 - RNA, 22 nt, Homo sapiens
ccaggcccggggcuggcggcua

SEQ ID NO: 672158 - RNA, 18 nt, Homo sapiens
ccaggcccuacaaugcuc

SEQ ID NO: 672159 - RNA, 18 nt, Homo sapiens
ccaggccgggguggagca

SEQ ID NO: 672160 - RNA, 19 nt, Homo sapiens
ccaggccugggaugcagug

SEQ ID NO: 672161 - RNA, 18 nt, Homo sapiens
ccaggcgaugugcaagug

SEQ ID NO: 672162 - RNA, 14 nt, Homo sapiens
ccaggcuacaaucu

SEQ ID NO: 672163 - RNA, 23 nt, Homo sapiens
ccaggcuacaaucuucauuuaau

SEQ ID NO: 672164 - RNA, 17 nt, Homo sapiens
ccaggcuagagugcaau

SEQ ID NO: 672165 - RNA, 20 nt, Homo sapiens
ccaggcuagagugcaauggu

SEQ ID NO: 672166 - RNA, 20 nt, Homo sapiens
ccaggcucuccgggccuuuc

SEQ ID NO: 672167 - RNA, 16 nt, Homo sapiens
ccaggcugagugcaua

SEQ ID NO: 672168 - RNA, 20 nt, Homo sapiens
ccaggcugccucggacucca

SEQ ID NO: 672169 - RNA, 22 nt, Homo sapiens
ccaggcugccuggucacugccc

SEQ ID NO: 672170 - RNA, 14 nt, Homo sapiens
ccaggcugccugug

SEQ ID NO: 672171 - RNA, 18 nt, Homo sapiens
ccaggcugccugugugca

SEQ ID NO: 672172 - RNA, 21 nt, Homo sapiens
ccaggcugcuagaggugcuca

SEQ ID NO: 672173 - RNA, 18 nt, Homo sapiens
ccaggcugcuggagugca

SEQ ID NO: 672174 - RNA, 23 nt, Homo sapiens
ccaggcugcuggagugcaguggc

SEQ ID NO: 672175 - RNA, 20 nt, Homo sapiens
ccaggcuggaaugcaguggu

SEQ ID NO: 672176 - RNA, 17 nt, Homo sapiens
ccaggcuggacugcaau

SEQ ID NO: 672177 - RNA, 16 nt, Homo sapiens
ccaggcuggagugcaa

SEQ ID NO: 672178 - RNA, 20 nt, Homo sapiens
ccaggcuggagugcaaugac

SEQ ID NO: 672179 - RNA, 20 nt, Homo sapiens
ccaggcuggagugcaauggu

SEQ ID NO: 672180 - RNA, 17 nt, Homo sapiens
ccaggcuggagugcagu

SEQ ID NO: 672181 - RNA, 20 nt, Homo sapiens
ccaggcuggagugcaguggu

SEQ ID NO: 672182 - RNA, 15 nt, Homo sapiens
ccaggcugggaacuc

SEQ ID NO: 672183 - RNA, 13 nt, Homo sapiens
ccaggcugucacc

SEQ ID NO: 672184 - RNA, 15 nt, Homo sapiens
ccaggcugugcagcg

SEQ ID NO: 672185 - RNA, 21 nt, Homo sapiens
ccaggcuucacccugaauggu

SEQ ID NO: 672186 - RNA, 14 nt, Homo sapiens
ccaggcuuuguaca

SEQ ID NO: 672187 - RNA, 14 nt, Homo sapiens
ccagggacccaaag

SEQ ID NO: 672188 - RNA, 15 nt, Homo sapiens
ccagggacccaaagc

SEQ ID NO: 672189 - RNA, 15 nt, Homo sapiens
ccagggagcaagaca

SEQ ID NO: 672190 - RNA, 16 nt, Homo sapiens
ccagggaggagucagu

SEQ ID NO: 672191 - RNA, 22 nt, Homo sapiens
ccagggaggggggaugcugcuu

SEQ ID NO: 672192 - RNA, 18 nt, Homo sapiens
ccagggagugagcagcua

SEQ ID NO: 672193 - RNA, 23 nt, Homo sapiens
ccagggauggccccuagccacag

SEQ ID NO: 672194 - RNA, 23 nt, Homo sapiens
ccagggaugggggaugggccagg

SEQ ID NO: 672195 - RNA, 19 nt, Homo sapiens
ccagggcaaugccaucagc

SEQ ID NO: 672196 - RNA, 20 nt, Homo sapiens
ccagggcagggucugggcug

SEQ ID NO: 672197 - RNA, 12 nt, Homo sapiens
ccagggccagug

SEQ ID NO: 672198 - RNA, 20 nt, Homo sapiens
ccagggcccucccagcccau

SEQ ID NO: 672199 - RNA, 13 nt, Homo sapiens
ccagggccgugag

SEQ ID NO: 672200 - RNA, 17 nt, Homo sapiens
ccagggcucugccccag

SEQ ID NO: 672201 - RNA, 21 nt, Homo sapiens
ccagggcugccccuaaucucu

SEQ ID NO: 672202 - RNA, 16 nt, Homo sapiens
ccagggcugcccugag

SEQ ID NO: 672203 - RNA, 19 nt, Homo sapiens
ccagggcuuccccaucagc

SEQ ID NO: 672204 - RNA, 18 nt, Homo sapiens
ccaggggaaccugccaug

SEQ ID NO: 672205 - RNA, 17 nt, Homo sapiens
ccaggggccggccagug

SEQ ID NO: 672206 - RNA, 18 nt, Homo sapiens
ccaggggggacaauaugu

SEQ ID NO: 672207 - RNA, 18 nt, Homo sapiens
ccugggaggaaauuugaa

SEQ ID NO: 672208 - RNA, 15 nt, Homo sapiens
ccugggauccagugu

SEQ ID NO: 672209 - RNA, 22 nt, Homo sapiens
ccugggaugaggggugcugggu

SEQ ID NO: 672210 - RNA, 15 nt, Homo sapiens
ccugggaugggcucc

SEQ ID NO: 672211 - RNA, 14 nt, Homo sapiens
ccugggcaaagccu

SEQ ID NO: 672212 - RNA, 15 nt, Homo sapiens
ccugggcaaugugau

SEQ ID NO: 672213 - RNA, 16 nt, Homo sapiens
ccugggcagugcuccu

SEQ ID NO: 672214 - RNA, 18 nt, Homo sapiens
ccugggccccaccaccua

SEQ ID NO: 672215 - RNA, 16 nt, Homo sapiens
ccugggcccuuccuau

SEQ ID NO: 672216 - RNA, 17 nt, Homo sapiens
ccugggccguggcacag

SEQ ID NO: 672217 - RNA, 14 nt, Homo sapiens
ccugggcugugcua

SEQ ID NO: 672218 - RNA, 23 nt, Homo sapiens
ccugggcuuggccugcugugauu

SEQ ID NO: 672219 - RNA, 19 nt, Homo sapiens
ccuggggagucugggcaca

SEQ ID NO: 672220 - RNA, 21 nt, Homo sapiens
ccuggggcacuuucauccuca

SEQ ID NO: 672221 - RNA, 20 nt, Homo sapiens
ccuggggcccaaguugcagu

SEQ ID NO: 672222 - RNA, 16 nt, Homo sapiens
ccugggggugccagga

SEQ ID NO: 672223 - RNA, 17 nt, Homo sapiens
ccuggggugaauacuua

SEQ ID NO: 672224 - RNA, 19 nt, Homo sapiens
ccuggggugggacagggag

SEQ ID NO: 672225 - RNA, 18 nt, Homo sapiens
ccugggucucugggcaca

SEQ ID NO: 672226 - RNA, 19 nt, Homo sapiens
ccuggguuggagggaacca

SEQ ID NO: 672227 - RNA, 16 nt, Homo sapiens
ccuggguuuucuuaac

SEQ ID NO: 672228 - RNA, 22 nt, Homo sapiens
ccugguaaaagggauacacagg

SEQ ID NO: 672229 - RNA, 22 nt, Homo sapiens
ccuggucagugguggucuucaa

SEQ ID NO: 672230 - RNA, 16 nt, Homo sapiens
ccugguccacugggaa

SEQ ID NO: 672231 - RNA, 21 nt, Homo sapiens
ccugguccgugcacuggagaa

SEQ ID NO: 672232 - RNA, 16 nt, Homo sapiens
ccuggucgucuauccc

SEQ ID NO: 672233 - RNA, 21 nt, Homo sapiens
ccugguuaaauuugaauuuca

SEQ ID NO: 672234 - RNA, 18 nt, Homo sapiens
ccugguuccacucuggag

SEQ ID NO: 672235 - RNA, 18 nt, Homo sapiens
ccuguaaagaaacauuuc

SEQ ID NO: 672236 - RNA, 16 nt, Homo sapiens
ccuguaaagucuaauc

SEQ ID NO: 672237 - RNA, 12 nt, Homo sapiens
ccuguaacacaa

SEQ ID NO: 672238 - RNA, 13 nt, Homo sapiens
ccuguaacacaag

SEQ ID NO: 672239 - RNA, 19 nt, Homo sapiens
ccuguaacuacaaugaugg

SEQ ID NO: 672240 - RNA, 18 nt, Homo sapiens
ccuguaacucacauucuc

SEQ ID NO: 672241 - RNA, 20 nt, Homo sapiens
ccuguaaucccaacacuuug

SEQ ID NO: 672242 - RNA, 17 nt, Homo sapiens
ccuguaaucucagcacu

SEQ ID NO: 672243 - RNA, 18 nt, Homo sapiens
ccuguaaucucagcacuu

SEQ ID NO: 672244 - RNA, 12 nt, Homo sapiens
ccuguacauucu

SEQ ID NO: 672245 - RNA, 12 nt, Homo sapiens
ccuguacccagc

SEQ ID NO: 672246 - RNA, 18 nt, Homo sapiens
ccuguacucccagcacuu

SEQ ID NO: 672247 - RNA, 17 nt, Homo sapiens
ccuguagcagucacuga

SEQ ID NO: 672248 - RNA, 17 nt, Homo sapiens
ccuguagguucuugaua

SEQ ID NO: 672249 - RNA, 13 nt, Homo sapiens
ccuguaguacaag

SEQ ID NO: 672250 - RNA, 15 nt, Homo sapiens
ccuguagucccagcu

SEQ ID NO: 672251 - RNA, 18 nt, Homo sapiens
ccuguaguugacaauucu

SEQ ID NO: 672252 - RNA, 23 nt, Homo sapiens
ccuguauaaguggaggcacuuua

SEQ ID NO: 672253 - RNA, 18 nt, Homo sapiens
ccuguauucuacagcaga

SEQ ID NO: 672254 - RNA, 20 nt, Homo sapiens
ccuguauucuucaaccagug

SEQ ID NO: 672255 - RNA, 20 nt, Homo sapiens
ccugucaaguuaacaaggaa

SEQ ID NO: 672256 - RNA, 14 nt, Homo sapiens
ccugucaccaucaa

SEQ ID NO: 672257 - RNA, 16 nt, Homo sapiens
ccugucauuguauuca

SEQ ID NO: 672258 - RNA, 16 nt, Homo sapiens
ccuguccacacccagc

SEQ ID NO: 672259 - RNA, 23 nt, Homo sapiens
ccuguccaucagccaggacaguc

SEQ ID NO: 672260 - RNA, 23 nt, Homo sapiens
ccugucccagagguuaucugccu

SEQ ID NO: 672261 - RNA, 13 nt, Homo sapiens
ccugucccaugca

SEQ ID NO: 672262 - RNA, 13 nt, Homo sapiens
ccugucccaugga

SEQ ID NO: 672263 - RNA, 16 nt, Homo sapiens
ccuguccuaagcacuu

SEQ ID NO: 672264 - RNA, 19 nt, Homo sapiens
ccuguccuaagcacuuuau

SEQ ID NO: 672265 - RNA, 17 nt, Homo sapiens
ccuguccuccaacacca

SEQ ID NO: 672266 - RNA, 23 nt, Homo sapiens
ccuguccuccaacaccaagcaca

SEQ ID NO: 672267 - RNA, 19 nt, Homo sapiens
ccuguccucccgagcuccu

SEQ ID NO: 672268 - RNA, 14 nt, Homo sapiens
ccuguccuccugga

SEQ ID NO: 672269 - RNA, 16 nt, Homo sapiens
ccuguccuugcccuuu

SEQ ID NO: 672270 - RNA, 17 nt, Homo sapiens
ccugucgauuagacugg

SEQ ID NO: 672271 - RNA, 14 nt, Homo sapiens
ccugucuccagggc

SEQ ID NO: 672272 - RNA, 13 nt, Homo sapiens
ccugucuccuuau

SEQ ID NO: 672273 - RNA, 20 nt, Homo sapiens
ccugucucuuuccacuuugu

SEQ ID NO: 672274 - RNA, 22 nt, Homo sapiens
ccugucugccagccagcagcca

SEQ ID NO: 672275 - RNA, 21 nt, Homo sapiens
ccugucugcuaggcgcugggg

SEQ ID NO: 672276 - RNA, 17 nt, Homo sapiens
ccugucuuaugguccag

SEQ ID NO: 672277 - RNA, 21 nt, Homo sapiens
ccugucuucugggcacagugg

SEQ ID NO: 672278 - RNA, 21 nt, Homo sapiens
ccugucuuggggccacuuuca

SEQ ID NO: 672279 - RNA, 12 nt, Homo sapiens
ccugugacaugg

SEQ ID NO: 672280 - RNA, 14 nt, Homo sapiens
ccugugaccagcac

SEQ ID NO: 672281 - RNA, 22 nt, Homo sapiens
ccugugccaaccugaugccccu

SEQ ID NO: 672282 - RNA, 19 nt, Homo sapiens
ccugugcccuagaugcacg

SEQ ID NO: 672283 - RNA, 21 nt, Homo sapiens
ccugugcccucaccaccacac

SEQ ID NO: 672284 - RNA, 16 nt, Homo sapiens
ccugugccuaacacca

SEQ ID NO: 672285 - RNA, 21 nt, Homo sapiens
ccugugcuggaccagcuggcc

SEQ ID NO: 672286 - RNA, 21 nt, Homo sapiens
ccuguggggucugaugugucc

SEQ ID NO: 672287 - RNA, 13 nt, Homo sapiens
ccuguggugaccc

SEQ ID NO: 672288 - RNA, 23 nt, Homo sapiens
ccuguggugaugugccuguaauc

SEQ ID NO: 672289 - RNA, 21 nt, Homo sapiens
ccugugguggucuguguaaug

SEQ ID NO: 672290 - RNA, 15 nt, Homo sapiens
ccugugucaucccau

SEQ ID NO: 672291 - RNA, 21 nt, Homo sapiens
ccuguguccaccugugggugu

SEQ ID NO: 672292 - RNA, 19 nt, Homo sapiens
ccugugucugucacaggcu

SEQ ID NO: 672293 - RNA, 19 nt, Homo sapiens
ccuguguggucuccaugcu

SEQ ID NO: 672294 - RNA, 23 nt, Homo sapiens
ccuguuaccuacuuugacuuuuu

SEQ ID NO: 672295 - RNA, 16 nt, Homo sapiens
ccuguuagcauugcca

SEQ ID NO: 672296 - RNA, 14 nt, Homo sapiens
ccuguucaaaaagg

SEQ ID NO: 672297 - RNA, 14 nt, Homo sapiens
ccuguucacucuac

SEQ ID NO: 672298 - RNA, 16 nt, Homo sapiens
ccuguucagcuacucc

SEQ ID NO: 672299 - RNA, 11 nt, Homo sapiens
ccuguucucuc

SEQ ID NO: 672300 - RNA, 21 nt, Homo sapiens
ccuguucuguuuugccugaag

SEQ ID NO: 672301 - RNA, 13 nt, Homo sapiens
ccuguucuuuuaa

SEQ ID NO: 672302 - RNA, 22 nt, Homo sapiens
ccuguuuucgcaccuaccauca

SEQ ID NO: 672303 - RNA, 21 nt, Homo sapiens
ccuguuuuuagagcuuccaaa

SEQ ID NO: 672304 - RNA, 16 nt, Homo sapiens
ccuuaaaaaugcacac

SEQ ID NO: 672305 - RNA, 15 nt, Homo sapiens
ccuuaaaaugcauug

SEQ ID NO: 672306 - RNA, 17 nt, Homo sapiens
ccuuaaaaugcauugaa

SEQ ID NO: 672307 - RNA, 13 nt, Homo sapiens
ccuuaaacucagg

SEQ ID NO: 672308 - RNA, 23 nt, Homo sapiens
ccuuaaacucagggagcauuuau

SEQ ID NO: 672309 - RNA, 18 nt, Homo sapiens
ccuuaaagaaaauugcau

SEQ ID NO: 672310 - RNA, 21 nt, Homo sapiens
ccuuaaagaaaauugcaugaa

SEQ ID NO: 672311 - RNA, 22 nt, Homo sapiens
ccuuaaagaaaauugcaugaaa

SEQ ID NO: 672312 - RNA, 18 nt, Homo sapiens
ccuuaaagggaauucgau

SEQ ID NO: 672313 - RNA, 12 nt, Homo sapiens
ccuuaaauaugu

SEQ ID NO: 672314 - RNA, 20 nt, Homo sapiens
ccuuaacucaucuguuaucc

SEQ ID NO: 672315 - RNA, 17 nt, Homo sapiens
ccuuaagacacugugag

SEQ ID NO: 672316 - RNA, 21 nt, Homo sapiens
ccuuaagcaaauuuuguauua

SEQ ID NO: 672317 - RNA, 21 nt, Homo sapiens
ccuuaauaaaaauauauauua

SEQ ID NO: 672318 - RNA, 13 nt, Homo sapiens
ccuuaauauugag

SEQ ID NO: 672319 - RNA, 18 nt, Homo sapiens
ccuuaauuauuaacaaag

SEQ ID NO: 672320 - RNA, 16 nt, Homo sapiens
ccuuaauugaugcaaa

SEQ ID NO: 672321 - RNA, 21 nt, Homo sapiens
ccuuacaacgccgagugcacu

SEQ ID NO: 672322 - RNA, 14 nt, Homo sapiens
ccuuacaguaggag

SEQ ID NO: 672323 - RNA, 14 nt, Homo sapiens
ccuuaccucuggaa

SEQ ID NO: 672324 - RNA, 11 nt, Homo sapiens
ccuuaccugaa

SEQ ID NO: 672325 - RNA, 16 nt, Homo sapiens
ccuuacuccagagggc

SEQ ID NO: 672326 - RNA, 11 nt, Homo sapiens
ccuuacucuga

SEQ ID NO: 672327 - RNA, 14 nt, Homo sapiens
ccuuacuguuuaca

SEQ ID NO: 672328 - RNA, 19 nt, Homo sapiens
ccuuacuucucuugccuua

SEQ ID NO: 672329 - RNA, 14 nt, Homo sapiens
ccuuacuugcacug

SEQ ID NO: 672330 - RNA, 21 nt, Homo sapiens
ccagaccuuaagacacuguga

SEQ ID NO: 672331 - RNA, 14 nt, Homo sapiens
ccagacggucagga

SEQ ID NO: 672332 - RNA, 14 nt, Homo sapiens
ccagacggugugca

SEQ ID NO: 672333 - RNA, 22 nt, Homo sapiens
ccagacuaaaggauccagagag

SEQ ID NO: 672334 - RNA, 17 nt, Homo sapiens
ccagacucacuugccau

SEQ ID NO: 672335 - RNA, 15 nt, Homo sapiens
ccagacucagcucca

SEQ ID NO: 672336 - RNA, 17 nt, Homo sapiens
ccagacucuugccuguu

SEQ ID NO: 672337 - RNA, 17 nt, Homo sapiens
ccagacuggaagacacu

SEQ ID NO: 672338 - RNA, 11 nt, Homo sapiens
ccagacugugg

SEQ ID NO: 672339 - RNA, 12 nt, Homo sapiens
ccagacuugaau

SEQ ID NO: 672340 - RNA, 16 nt, Homo sapiens
ccagacuuggccucca

SEQ ID NO: 672341 - RNA, 13 nt, Homo sapiens
ccagagaccccag

SEQ ID NO: 672342 - RNA, 16 nt, Homo sapiens
ccagagagaacaacag

SEQ ID NO: 672343 - RNA, 13 nt, Homo sapiens
ccagagagagcuc

SEQ ID NO: 672344 - RNA, 14 nt, Homo sapiens
ccagagagcagcuu

SEQ ID NO: 672345 - RNA, 20 nt, Homo sapiens
ccagagagccuggugcugcu

SEQ ID NO: 672346 - RNA, 14 nt, Homo sapiens
ccagagcaaaauaa

SEQ ID NO: 672347 - RNA, 21 nt, Homo sapiens
ccagagcauuuccaacaccac

SEQ ID NO: 672348 - RNA, 17 nt, Homo sapiens
ccagagccagaaagggu

SEQ ID NO: 672349 - RNA, 20 nt, Homo sapiens
ccagagccagaaagggugcc

SEQ ID NO: 672350 - RNA, 15 nt, Homo sapiens
ccagagccauggacu

SEQ ID NO: 672351 - RNA, 19 nt, Homo sapiens
ccagagcccuucacugcca

SEQ ID NO: 672352 - RNA, 20 nt, Homo sapiens
ccagagcccuucacugccau

SEQ ID NO: 672353 - RNA, 16 nt, Homo sapiens
ccagagcuacugacua

SEQ ID NO: 672354 - RNA, 17 nt, Homo sapiens
ccagagcugugccugcu

SEQ ID NO: 672355 - RNA, 23 nt, Homo sapiens
ccagagcuugugcuccucuugau

SEQ ID NO: 672356 - RNA, 16 nt, Homo sapiens
ccagaggaacugucca

SEQ ID NO: 672357 - RNA, 19 nt, Homo sapiens
ccagaggaaguuauggcag

SEQ ID NO: 672358 - RNA, 21 nt, Homo sapiens
ccagaggagccaccaguucuc

SEQ ID NO: 672359 - RNA, 18 nt, Homo sapiens
ccagaggaugucacaaag

SEQ ID NO: 672360 - RNA, 20 nt, Homo sapiens
ccagaggauugcugccccau

SEQ ID NO: 672361 - RNA, 19 nt, Homo sapiens
ccagaggccccaggucacc

SEQ ID NO: 672362 - RNA, 19 nt, Homo sapiens
ccagaggcuauuauuuuca

SEQ ID NO: 672363 - RNA, 18 nt, Homo sapiens
ccagaggcucagcacuuu

SEQ ID NO: 672364 - RNA, 21 nt, Homo sapiens
ccagaggcucuaauguacaau

SEQ ID NO: 672365 - RNA, 22 nt, Homo sapiens
ccagaggcucuaauguacaaua

SEQ ID NO: 672366 - RNA, 20 nt, Homo sapiens
ccagaggguagggcacaaag

SEQ ID NO: 672367 - RNA, 14 nt, Homo sapiens
ccagaggugcuucu

SEQ ID NO: 672368 - RNA, 19 nt, Homo sapiens
ccagagguggauguuauga

SEQ ID NO: 672369 - RNA, 22 nt, Homo sapiens
ccagaggugucgggacaugguu

SEQ ID NO: 672370 - RNA, 12 nt, Homo sapiens
ccagaguaguuu

SEQ ID NO: 672371 - RNA, 23 nt, Homo sapiens
ccagaguccuuuccaaggcuucu

SEQ ID NO: 672372 - RNA, 13 nt, Homo sapiens
ccagagugcugcc

SEQ ID NO: 672373 - RNA, 15 nt, Homo sapiens
ccagagugcugccag

SEQ ID NO: 672374 - RNA, 20 nt, Homo sapiens
ccagaguggccuggccagga

SEQ ID NO: 672375 - RNA, 19 nt, Homo sapiens
ccagagugugcagacugau

SEQ ID NO: 672376 - RNA, 20 nt, Homo sapiens
ccagaguugcugggagcuga

SEQ ID NO: 672377 - RNA, 17 nt, Homo sapiens
ccagaguuuacauucua

SEQ ID NO: 672378 - RNA, 22 nt, Homo sapiens
ccagauacauggugaugguuag

SEQ ID NO: 672379 - RNA, 20 nt, Homo sapiens
ccagauagguggugccagug

SEQ ID NO: 672380 - RNA, 14 nt, Homo sapiens
ccagaucacugcca

SEQ ID NO: 672381 - RNA, 15 nt, Homo sapiens
ccagauccagacugu

SEQ ID NO: 672382 - RNA, 17 nt, Homo sapiens
ccagaucugucuccaag

SEQ ID NO: 672383 - RNA, 21 nt, Homo sapiens
ccagaugcccagaggcuccau

SEQ ID NO: 672384 - RNA, 14 nt, Homo sapiens
ccagauguuaugcu

SEQ ID NO: 672385 - RNA, 21 nt, Homo sapiens
ccagauuggcaccccuuucua

SEQ ID NO: 672386 - RNA, 20 nt, Homo sapiens
ccagauuuaaaaaaagaaca

SEQ ID NO: 672387 - RNA, 12 nt, Homo sapiens
ccagauuuacac

SEQ ID NO: 672388 - RNA, 11 nt, Homo sapiens
ccagcaaaaac

SEQ ID NO: 672389 - RNA, 23 nt, Homo sapiens
ccagcaaaauggaagcaaagaca

SEQ ID NO: 672390 - RNA, 15 nt, Homo sapiens
ccagcaacugaauaa

SEQ ID NO: 672391 - RNA, 13 nt, Homo sapiens
ccagcaaggcagg

SEQ ID NO: 672392 - RNA, 13 nt, Homo sapiens
ccagcaauuccau

SEQ ID NO: 672393 - RNA, 12 nt, Homo sapiens
ccagcacaccaa

SEQ ID NO: 672394 - RNA, 17 nt, Homo sapiens
ccagcacauagcuugcc

SEQ ID NO: 672395 - RNA, 15 nt, Homo sapiens
ccagcacaugugcug

SEQ ID NO: 672396 - RNA, 22 nt, Homo sapiens
ccagcaccuauugaauuaccau

SEQ ID NO: 672397 - RNA, 22 nt, Homo sapiens
ccagcacuaacguaaauacaca

SEQ ID NO: 672398 - RNA, 15 nt, Homo sapiens
ccagcacuaugcuuu

SEQ ID NO: 672399 - RNA, 11 nt, Homo sapiens
ccagcacucug

SEQ ID NO: 672400 - RNA, 13 nt, Homo sapiens
ccagcacucugaa

SEQ ID NO: 672401 - RNA, 12 nt, Homo sapiens
ccagcacuucca

SEQ ID NO: 672402 - RNA, 22 nt, Homo sapiens
ccagcacuuuagaucacuugag

SEQ ID NO: 672403 - RNA, 20 nt, Homo sapiens
ccagcacuuugggaggccaa

SEQ ID NO: 672404 - RNA, 19 nt, Homo sapiens
ccagcaggguagcuauuac

SEQ ID NO: 672405 - RNA, 19 nt, Homo sapiens
ccagcagugucacucugua

SEQ ID NO: 672406 - RNA, 18 nt, Homo sapiens
ccagcaugcagguggugg

SEQ ID NO: 672407 - RNA, 23 nt, Homo sapiens
ccagcauugugauauauucugua

SEQ ID NO: 672408 - RNA, 19 nt, Homo sapiens
ccagccacauugagacuuu

SEQ ID NO: 672409 - RNA, 21 nt, Homo sapiens
ccagccacggagggaggcacc

SEQ ID NO: 672410 - RNA, 21 nt, Homo sapiens
ccagccagaggcaucugaggg

SEQ ID NO: 672411 - RNA, 20 nt, Homo sapiens
ccagccaucaaaaugcuuuu

SEQ ID NO: 672412 - RNA, 22 nt, Homo sapiens
ccagccaucaaauagugaaugg

SEQ ID NO: 672413 - RNA, 12 nt, Homo sapiens
ccagccaugcau

SEQ ID NO: 672414 - RNA, 17 nt, Homo sapiens
ccagcccauggcuuuag

SEQ ID NO: 672415 - RNA, 13 nt, Homo sapiens
ccagcccauugcu

SEQ ID NO: 672416 - RNA, 15 nt, Homo sapiens
ccagcccauugcugc

SEQ ID NO: 672417 - RNA, 21 nt, Homo sapiens
ccagccccacugccagcagca

SEQ ID NO: 672418 - RNA, 15 nt, Homo sapiens
ccagccccuuugcca

SEQ ID NO: 672419 - RNA, 16 nt, Homo sapiens
ccagcccuacuccugc

SEQ ID NO: 672420 - RNA, 21 nt, Homo sapiens
ccagcccugucaugugccuug

SEQ ID NO: 672421 - RNA, 17 nt, Homo sapiens
ccagccgaaaagcuuuu

SEQ ID NO: 672422 - RNA, 13 nt, Homo sapiens
ccagccuaggugg

SEQ ID NO: 672423 - RNA, 20 nt, Homo sapiens
ccagccucaggcuugaggga

SEQ ID NO: 672424 - RNA, 14 nt, Homo sapiens
ccagccuccaugcu

SEQ ID NO: 672425 - RNA, 19 nt, Homo sapiens
ccagccuccccgugccaaa

SEQ ID NO: 672426 - RNA, 13 nt, Homo sapiens
ccagccuccugcu

SEQ ID NO: 672427 - RNA, 15 nt, Homo sapiens
ccagccuccugcuaa

SEQ ID NO: 672428 - RNA, 16 nt, Homo sapiens
ccagccugccuggcag

SEQ ID NO: 672429 - RNA, 20 nt, Homo sapiens
ccagccugcucccuagccag

SEQ ID NO: 672430 - RNA, 23 nt, Homo sapiens
caguccuggguuguuuccaggag

SEQ ID NO: 672431 - RNA, 14 nt, Homo sapiens
caguccuguuugca

SEQ ID NO: 672432 - RNA, 20 nt, Homo sapiens
cagucgaugcguucacucca

SEQ ID NO: 672433 - RNA, 17 nt, Homo sapiens
cagucggccccaucucu

SEQ ID NO: 672434 - RNA, 19 nt, Homo sapiens
cagucucacucuguugccc

SEQ ID NO: 672435 - RNA, 13 nt, Homo sapiens
cagucucacuuug

SEQ ID NO: 672436 - RNA, 17 nt, Homo sapiens
cagucucaucuccugac

SEQ ID NO: 672437 - RNA, 19 nt, Homo sapiens
cagucucccagauguugca

SEQ ID NO: 672438 - RNA, 15 nt, Homo sapiens
cagucuccccacucc

SEQ ID NO: 672439 - RNA, 23 nt, Homo sapiens
cagucuccucacucugucccugu

SEQ ID NO: 672440 - RNA, 18 nt, Homo sapiens
cagucuccuccccuacuc

SEQ ID NO: 672441 - RNA, 22 nt, Homo sapiens
cagucucugucguggagccauu

SEQ ID NO: 672442 - RNA, 20 nt, Homo sapiens
cagucugacccuuacagccu

SEQ ID NO: 672443 - RNA, 18 nt, Homo sapiens
cagucuggccacugucaa

SEQ ID NO: 672444 - RNA, 11 nt, Homo sapiens
cagucugugaa

SEQ ID NO: 672445 - RNA, 22 nt, Homo sapiens
cagucuuccauuugcaagggaa

SEQ ID NO: 672446 - RNA, 17 nt, Homo sapiens
cagucuuccuugucucu

SEQ ID NO: 672447 - RNA, 16 nt, Homo sapiens
cagucuucuaauuccu

SEQ ID NO: 672448 - RNA, 15 nt, Homo sapiens
cagugaaauaugaua

SEQ ID NO: 672449 - RNA, 13 nt, Homo sapiens
cagugaacacuca

SEQ ID NO: 672450 - RNA, 14 nt, Homo sapiens
cagugaaccaaaga

SEQ ID NO: 672451 - RNA, 17 nt, Homo sapiens
cagugaagaugccagug

SEQ ID NO: 672452 - RNA, 17 nt, Homo sapiens
cagugaagcagcacugu

SEQ ID NO: 672453 - RNA, 11 nt, Homo sapiens
cagugaaggcu

SEQ ID NO: 672454 - RNA, 23 nt, Homo sapiens
cagugaaggcuaagaaccuggug

SEQ ID NO: 672455 - RNA, 23 nt, Homo sapiens
cagugacaaacauauccuuucaa

SEQ ID NO: 672456 - RNA, 23 nt, Homo sapiens
cagugacagaacuaagaugauca

SEQ ID NO: 672457 - RNA, 12 nt, Homo sapiens
cagugacaguau

SEQ ID NO: 672458 - RNA, 15 nt, Homo sapiens
cagugaccacaccaa

SEQ ID NO: 672459 - RNA, 16 nt, Homo sapiens
cagugaccagucacug

SEQ ID NO: 672460 - RNA, 17 nt, Homo sapiens
cagugacgugcaccugu

SEQ ID NO: 672461 - RNA, 18 nt, Homo sapiens
cagugacugaauucugcc

SEQ ID NO: 672462 - RNA, 21 nt, Homo sapiens
cagugacuguacaguuaucau

SEQ ID NO: 672463 - RNA, 18 nt, Homo sapiens
cagugagacacaguaauu

SEQ ID NO: 672464 - RNA, 14 nt, Homo sapiens
cagugagacugugg

SEQ ID NO: 672465 - RNA, 22 nt, Homo sapiens
cagugagccgagaucacaccac

SEQ ID NO: 672466 - RNA, 21 nt, Homo sapiens
cagugagccgagaucaugcca

SEQ ID NO: 672467 - RNA, 12 nt, Homo sapiens
cagugagcucuu

SEQ ID NO: 672468 - RNA, 20 nt, Homo sapiens
cagugagcugauaucaugcc

SEQ ID NO: 672469 - RNA, 20 nt, Homo sapiens
cagugagcuguguucuugcc

SEQ ID NO: 672470 - RNA, 18 nt, Homo sapiens
cagugaggcugcacccac

SEQ ID NO: 672471 - RNA, 19 nt, Homo sapiens
cagugagguucuuggguuu

SEQ ID NO: 672472 - RNA, 20 nt, Homo sapiens
cagugagucacauccuggga

SEQ ID NO: 672473 - RNA, 13 nt, Homo sapiens
cagugauacucac

SEQ ID NO: 672474 - RNA, 23 nt, Homo sapiens
cagugauauaugccuauaauaua

SEQ ID NO: 672475 - RNA, 22 nt, Homo sapiens
cagugaucucagggcagacagc

SEQ ID NO: 672476 - RNA, 15 nt, Homo sapiens
cagugcaaaccacuu

SEQ ID NO: 672477 - RNA, 17 nt, Homo sapiens
cagugcaacagcacugg

SEQ ID NO: 672478 - RNA, 18 nt, Homo sapiens
cagugcaccuacugcuua

SEQ ID NO: 672479 - RNA, 10 nt, Homo sapiens
cagugcaguc

SEQ ID NO: 672480 - RNA, 22 nt, Homo sapiens
cagugcaguuucuuuucacauu

SEQ ID NO: 672481 - RNA, 17 nt, Homo sapiens
cagugcauuauguacac

SEQ ID NO: 672482 - RNA, 15 nt, Homo sapiens
cagugcauuugccuu

SEQ ID NO: 672483 - RNA, 10 nt, Homo sapiens
cagugccauu

SEQ ID NO: 672484 - RNA, 13 nt, Homo sapiens
cagugccauucca

SEQ ID NO: 672485 - RNA, 22 nt, Homo sapiens
cagugcccaaaagggcacccac

SEQ ID NO: 672486 - RNA, 21 nt, Homo sapiens
cagugcccaccaacaucccau

SEQ ID NO: 672487 - RNA, 13 nt, Homo sapiens
cagugcccuaggc

SEQ ID NO: 672488 - RNA, 17 nt, Homo sapiens
cagugccgcuccugcuu

SEQ ID NO: 672489 - RNA, 15 nt, Homo sapiens
cagugccuauugaua

SEQ ID NO: 672490 - RNA, 19 nt, Homo sapiens
cagugccuuaaacucuguu

SEQ ID NO: 672491 - RNA, 17 nt, Homo sapiens
cagugcgugaagaccaa

SEQ ID NO: 672492 - RNA, 18 nt, Homo sapiens
cagugcgugaagaccaac

SEQ ID NO: 672493 - RNA, 12 nt, Homo sapiens
cagugcucccuc

SEQ ID NO: 672494 - RNA, 21 nt, Homo sapiens
cagugcuguggccugggcaag

SEQ ID NO: 672495 - RNA, 16 nt, Homo sapiens
cagugcugugucauuc

SEQ ID NO: 672496 - RNA, 20 nt, Homo sapiens
cagugcugugucauuccaaa

SEQ ID NO: 672497 - RNA, 11 nt, Homo sapiens
cagugcuuccc

SEQ ID NO: 672498 - RNA, 21 nt, Homo sapiens
cagugcuucccgagugagcau

SEQ ID NO: 672499 - RNA, 18 nt, Homo sapiens
cagugcuucuuacuauua

SEQ ID NO: 672500 - RNA, 13 nt, Homo sapiens
cagugcuuuucac

SEQ ID NO: 672501 - RNA, 13 nt, Homo sapiens
caguggacccugg

SEQ ID NO: 672502 - RNA, 14 nt, Homo sapiens
caguggaucuucag

SEQ ID NO: 672503 - RNA, 23 nt, Homo sapiens
caguggaucuucagaacugcccu

SEQ ID NO: 672504 - RNA, 13 nt, Homo sapiens
caguggaugcugc

SEQ ID NO: 672505 - RNA, 20 nt, Homo sapiens
caguggauucccacagcaca

SEQ ID NO: 672506 - RNA, 18 nt, Homo sapiens
caguggauugauuauaaa

SEQ ID NO: 672507 - RNA, 12 nt, Homo sapiens
caguggcacaau

SEQ ID NO: 672508 - RNA, 14 nt, Homo sapiens
caguggcacaauca

SEQ ID NO: 672509 - RNA, 15 nt, Homo sapiens
caguggcacugaagu

SEQ ID NO: 672510 - RNA, 17 nt, Homo sapiens
caguggcagacaaacag

SEQ ID NO: 672511 - RNA, 18 nt, Homo sapiens
caguggcagacaaacaga

SEQ ID NO: 672512 - RNA, 20 nt, Homo sapiens
caguggccacguucagggag

SEQ ID NO: 672513 - RNA, 23 nt, Homo sapiens
caguggccuacaaaucaguaauu

SEQ ID NO: 672514 - RNA, 21 nt, Homo sapiens
caguggcuggugcccaugaag

SEQ ID NO: 672515 - RNA, 16 nt, Homo sapiens
caguggcugugccacc

SEQ ID NO: 672516 - RNA, 15 nt, Homo sapiens
caguggcuuuugccc

SEQ ID NO: 672517 - RNA, 17 nt, Homo sapiens
cagugggaaaggccacc

SEQ ID NO: 672518 - RNA, 18 nt, Homo sapiens
cagugggaacugugcaaa

SEQ ID NO: 672519 - RNA, 19 nt, Homo sapiens
cagugggccugguagcaca

SEQ ID NO: 672520 - RNA, 21 nt, Homo sapiens
cagugggugccccccuugcca

SEQ ID NO: 672521 - RNA, 23 nt, Homo sapiens
cagugguauccugugacauguaa

SEQ ID NO: 672522 - RNA, 19 nt, Homo sapiens
caguggucccagaaccuau

SEQ ID NO: 672523 - RNA, 20 nt, Homo sapiens
caguggugaagaaaacuccu

SEQ ID NO: 672524 - RNA, 18 nt, Homo sapiens
caguggugcaaacacagc

SEQ ID NO: 672525 - RNA, 21 nt, Homo sapiens
caguggugcaaucacagcuca

SEQ ID NO: 672526 - RNA, 21 nt, Homo sapiens
cagugguuacucaagcucaaa

SEQ ID NO: 672527 - RNA, 21 nt, Homo sapiens
caguguauguacuaagcagua

SEQ ID NO: 672528 - RNA, 17 nt, Homo sapiens
cagugucacucuguagu

SEQ ID NO: 672529 - RNA, 13 nt, Homo sapiens
cagugucugucag

SEQ ID NO: 672530 - RNA, 20 nt, Homo sapiens
cagugugcaagggcagugaa

SEQ ID NO: 672531 - RNA, 19 nt, Homo sapiens
cagugugcccaggauugaa

SEQ ID NO: 672532 - RNA, 15 nt, Homo sapiens
caguguggcagugac

SEQ ID NO: 672533 - RNA, 19 nt, Homo sapiens
caguguggcugaggccacc

SEQ ID NO: 672534 - RNA, 19 nt, Homo sapiens
caguguguguuuaacauuc

SEQ ID NO: 672535 - RNA, 14 nt, Homo sapiens
caguguuaagguaa

SEQ ID NO: 672536 - RNA, 18 nt, Homo sapiens
caguguuccccaucuggg

SEQ ID NO: 672537 - RNA, 20 nt, Homo sapiens
caguguuuauccuuucauau

SEQ ID NO: 672538 - RNA, 19 nt, Homo sapiens
caguguuugcaaugguguu

SEQ ID NO: 672539 - RNA, 14 nt, Homo sapiens
caguguuuggugua

SEQ ID NO: 672540 - RNA, 14 nt, Homo sapiens
caguuaacucuccc

SEQ ID NO: 672541 - RNA, 18 nt, Homo sapiens
caguuaauucaaugugaa

SEQ ID NO: 672542 - RNA, 14 nt, Homo sapiens
caguuacacaggaa

SEQ ID NO: 672543 - RNA, 21 nt, Homo sapiens
caguuagagcugagcacuuuu

SEQ ID NO: 672544 - RNA, 17 nt, Homo sapiens
caguuagcucauuugag

SEQ ID NO: 672545 - RNA, 20 nt, Homo sapiens
caguuaggguuuugcaauaa

SEQ ID NO: 672546 - RNA, 14 nt, Homo sapiens
caguuaggugcuga

SEQ ID NO: 672547 - RNA, 17 nt, Homo sapiens
caguuaguauagcuuua

SEQ ID NO: 672548 - RNA, 14 nt, Homo sapiens
caguuauaaaguca

SEQ ID NO: 672549 - RNA, 19 nt, Homo sapiens
caguuaucauuaucaucau

SEQ ID NO: 672550 - RNA, 12 nt, Homo sapiens
caguucaagcua

SEQ ID NO: 672551 - RNA, 17 nt, Homo sapiens
caguucaccugcacuua

SEQ ID NO: 672552 - RNA, 14 nt, Homo sapiens
caguucagcuccuu

SEQ ID NO: 672553 - RNA, 22 nt, Homo sapiens
cuguaauuguuguuuguaugua

SEQ ID NO: 672554 - RNA, 23 nt, Homo sapiens
cuguacaaaguagaagucuuaga

SEQ ID NO: 672555 - RNA, 23 nt, Homo sapiens
cuguacaaugacuuuauugcauc

SEQ ID NO: 672556 - RNA, 12 nt, Homo sapiens
cuguacacccca

SEQ ID NO: 672557 - RNA, 20 nt, Homo sapiens
cuguacaggaaggugccugg

SEQ ID NO: 672558 - RNA, 16 nt, Homo sapiens
cuguacauaaauucca

SEQ ID NO: 672559 - RNA, 19 nt, Homo sapiens
cuguacauacucaguaaaa

SEQ ID NO: 672560 - RNA, 17 nt, Homo sapiens
cuguacauguucuuguc

SEQ ID NO: 672561 - RNA, 18 nt, Homo sapiens
cuguacauguucuuguca

SEQ ID NO: 672562 - RNA, 18 nt, Homo sapiens
cuguacauuauaaaccuu

SEQ ID NO: 672563 - RNA, 12 nt, Homo sapiens
cuguaccaguua

SEQ ID NO: 672564 - RNA, 17 nt, Homo sapiens
cuguaccgacuuugaua

SEQ ID NO: 672565 - RNA, 18 nt, Homo sapiens
cuguaccuagaauagucu

SEQ ID NO: 672566 - RNA, 16 nt, Homo sapiens
cuguaccugugcacgu

SEQ ID NO: 672567 - RNA, 23 nt, Homo sapiens
cuguaccuugcuguggggcuaca

SEQ ID NO: 672568 - RNA, 15 nt, Homo sapiens
cuguacuaaggagca

SEQ ID NO: 672569 - RNA, 19 nt, Homo sapiens
cuguacuaaggagcaugau

SEQ ID NO: 672570 - RNA, 13 nt, Homo sapiens
cuguacucaggag

SEQ ID NO: 672571 - RNA, 16 nt, Homo sapiens
cuguacuucaguaugu

SEQ ID NO: 672572 - RNA, 15 nt, Homo sapiens
cuguacuuuuuccag

SEQ ID NO: 672573 - RNA, 14 nt, Homo sapiens
cuguagaaaugaug

SEQ ID NO: 672574 - RNA, 23 nt, Homo sapiens
cuguagaaaugaugauguggaag

SEQ ID NO: 672575 - RNA, 16 nt, Homo sapiens
cuguagaaauguaucc

SEQ ID NO: 672576 - RNA, 23 nt, Homo sapiens
cuguagaaggaaauauaccuuaa

SEQ ID NO: 672577 - RNA, 15 nt, Homo sapiens
cuguagaguugcuga

SEQ ID NO: 672578 - RNA, 17 nt, Homo sapiens
cuguagaugacuacuug

SEQ ID NO: 672579 - RNA, 17 nt, Homo sapiens
cuguagccucagaugau

SEQ ID NO: 672580 - RNA, 12 nt, Homo sapiens
cuguagcuuuaa

SEQ ID NO: 672581 - RNA, 19 nt, Homo sapiens
cuguaggcacacuuugcac

SEQ ID NO: 672582 - RNA, 19 nt, Homo sapiens
cuguagggcacccaaaacu

SEQ ID NO: 672583 - RNA, 18 nt, Homo sapiens
cuguagucccagcuacuu

SEQ ID NO: 672584 - RNA, 16 nt, Homo sapiens
cuguaguuuugagugu

SEQ ID NO: 672585 - RNA, 21 nt, Homo sapiens
cuguauaauacuuuguauaca

SEQ ID NO: 672586 - RNA, 13 nt, Homo sapiens
cuguauacauuac

SEQ ID NO: 672587 - RNA, 14 nt, Homo sapiens
cuguauacauuaca

SEQ ID NO: 672588 - RNA, 23 nt, Homo sapiens
cuguauaguuaggauagcauuuu

SEQ ID NO: 672589 - RNA, 16 nt, Homo sapiens
cuguauauacaauaac

SEQ ID NO: 672590 - RNA, 13 nt, Homo sapiens
cuguauauguugu

SEQ ID NO: 672591 - RNA, 16 nt, Homo sapiens
cuguauauuuguauga

SEQ ID NO: 672592 - RNA, 19 nt, Homo sapiens
cuguauauuugucaugaca

SEQ ID NO: 672593 - RNA, 17 nt, Homo sapiens
cuguaugucucguggua

SEQ ID NO: 672594 - RNA, 17 nt, Homo sapiens
cuguaugugagcuguaa

SEQ ID NO: 672595 - RNA, 15 nt, Homo sapiens
cuguaugugccaaag

SEQ ID NO: 672596 - RNA, 23 nt, Homo sapiens
cuguauuauaauaagcaaaaaga

SEQ ID NO: 672597 - RNA, 21 nt, Homo sapiens
cuguauuccgauacaaagugu

SEQ ID NO: 672598 - RNA, 14 nt, Homo sapiens
cuguauugagcaag

SEQ ID NO: 672599 - RNA, 22 nt, Homo sapiens
cuguauugucugaacuugcauu

SEQ ID NO: 672600 - RNA, 18 nt, Homo sapiens
cuguauuuaacaaaaagu

SEQ ID NO: 672601 - RNA, 15 nt, Homo sapiens
cuguauuuauuuuag

SEQ ID NO: 672602 - RNA, 17 nt, Homo sapiens
cuguauuucacucuuuc

SEQ ID NO: 672603 - RNA, 19 nt, Homo sapiens
cuguauuucgaaugagucu

SEQ ID NO: 672604 - RNA, 20 nt, Homo sapiens
cuguauuuuauuggacaggu

SEQ ID NO: 672605 - RNA, 18 nt, Homo sapiens
cugucaaaacacugugga

SEQ ID NO: 672606 - RNA, 12 nt, Homo sapiens
cugucaagaaga

SEQ ID NO: 672607 - RNA, 23 nt, Homo sapiens
cugucaagcaccugcaugugcug

SEQ ID NO: 672608 - RNA, 21 nt, Homo sapiens
cugucaagcuuacuacaguga

SEQ ID NO: 672609 - RNA, 17 nt, Homo sapiens
cugucaaggcugcuuag

SEQ ID NO: 672610 - RNA, 19 nt, Homo sapiens
cugucaaucacagucucag

SEQ ID NO: 672611 - RNA, 22 nt, Homo sapiens
cugucacaaccaagaauguuau

SEQ ID NO: 672612 - RNA, 15 nt, Homo sapiens
cugucacacacugga

SEQ ID NO: 672613 - RNA, 16 nt, Homo sapiens
cugucacacacuggac

SEQ ID NO: 672614 - RNA, 22 nt, Homo sapiens
cugucacacacuggaccccacu

SEQ ID NO: 672615 - RNA, 23 nt, Homo sapiens
cugucacagaguagaaacucaaa

SEQ ID NO: 672616 - RNA, 18 nt, Homo sapiens
cugucacaggcuggguca

SEQ ID NO: 672617 - RNA, 21 nt, Homo sapiens
cugucacccuccaccgagcca

SEQ ID NO: 672618 - RNA, 23 nt, Homo sapiens
cugucacugaugguggcucuggu

SEQ ID NO: 672619 - RNA, 21 nt, Homo sapiens
cugucacuugaccaauacuga

SEQ ID NO: 672620 - RNA, 23 nt, Homo sapiens
cugucagaaaaagcuagcacuaa

SEQ ID NO: 672621 - RNA, 16 nt, Homo sapiens
cugucagaggcuaaga

SEQ ID NO: 672622 - RNA, 13 nt, Homo sapiens
cugucagcugcaa

SEQ ID NO: 672623 - RNA, 23 nt, Homo sapiens
cugucaguucuaaccuccuaagc

SEQ ID NO: 672624 - RNA, 22 nt, Homo sapiens
cugucaguuguacuucugcucc

SEQ ID NO: 672625 - RNA, 15 nt, Homo sapiens
cugucaucagccugu

SEQ ID NO: 672626 - RNA, 20 nt, Homo sapiens
cugucaugcuucaucauucc

SEQ ID NO: 672627 - RNA, 15 nt, Homo sapiens
cugucauuacgucaa

SEQ ID NO: 672628 - RNA, 20 nt, Homo sapiens
cugucauuaguauuucacaa

SEQ ID NO: 672629 - RNA, 22 nt, Homo sapiens
cugucauucgcucccacauucu

SEQ ID NO: 672630 - RNA, 17 nt, Homo sapiens
cuguccaccaagaucaa

SEQ ID NO: 672631 - RNA, 23 nt, Homo sapiens
cuguccacgcaauggaacauuau

SEQ ID NO: 672632 - RNA, 19 nt, Homo sapiens
cuguccaggacaugauacu

SEQ ID NO: 672633 - RNA, 21 nt, Homo sapiens
cuguccaggccacuguggcca

SEQ ID NO: 672634 - RNA, 22 nt, Homo sapiens
cuguccaugaagcacugagcag

SEQ ID NO: 672635 - RNA, 14 nt, Homo sapiens
cugucccaccaacu

SEQ ID NO: 672636 - RNA, 14 nt, Homo sapiens
cugucccacccaca

SEQ ID NO: 672637 - RNA, 17 nt, Homo sapiens
cugucccauucuagauc

SEQ ID NO: 672638 - RNA, 21 nt, Homo sapiens
cuguccccaaaccuauggaag

SEQ ID NO: 672639 - RNA, 23 nt, Homo sapiens
cuguccccagaccaacccuggga

SEQ ID NO: 672640 - RNA, 18 nt, Homo sapiens
cugucccccacucucuca

SEQ ID NO: 672641 - RNA, 23 nt, Homo sapiens
cuguccccgccgggcagugucac

SEQ ID NO: 672642 - RNA, 23 nt, Homo sapiens
cugucccucaaaugacccaaaga

SEQ ID NO: 672643 - RNA, 15 nt, Homo sapiens
cugucccugccaaug

SEQ ID NO: 672644 - RNA, 19 nt, Homo sapiens
cuguccuaaggaaccuucc

SEQ ID NO: 672645 - RNA, 12 nt, Homo sapiens
cuguccuagugg

SEQ ID NO: 672646 - RNA, 20 nt, Homo sapiens
cuguccucucccaacucaag

SEQ ID NO: 672647 - RNA, 22 nt, Homo sapiens
cuguccugcagcaaacacucca

SEQ ID NO: 672648 - RNA, 14 nt, Homo sapiens
cuguccugcagucc

SEQ ID NO: 672649 - RNA, 14 nt, Homo sapiens
cuguccuggaggca

SEQ ID NO: 672650 - RNA, 15 nt, Homo sapiens
cuguccuggcuacua

SEQ ID NO: 672651 - RNA, 12 nt, Homo sapiens
cuguccuugccc

SEQ ID NO: 672652 - RNA, 17 nt, Homo sapiens
cugucgauaaucagaga

SEQ ID NO: 672653 - RNA, 22 nt, Homo sapiens
cugucgcaugagaacauuaaca

SEQ ID NO: 672654 - RNA, 16 nt, Homo sapiens
cugucuaaagccuuaa

SEQ ID NO: 672655 - RNA, 23 nt, Homo sapiens
cugucuagggcgaagacccuuau

SEQ ID NO: 672656 - RNA, 17 nt, Homo sapiens
cugucuauaagagaauu

SEQ ID NO: 672657 - RNA, 20 nt, Homo sapiens
cugucuauuuaagugcaauu

SEQ ID NO: 672658 - RNA, 23 nt, Homo sapiens
cugucucagagauauacuggccc

SEQ ID NO: 672659 - RNA, 17 nt, Homo sapiens
gccucagugccacuuga

SEQ ID NO: 672660 - RNA, 22 nt, Homo sapiens
gccucaguuuuccuucuguuaa

SEQ ID NO: 672661 - RNA, 13 nt, Homo sapiens
gccucauacacau

SEQ ID NO: 672662 - RNA, 11 nt, Homo sapiens
gccucaucucu

SEQ ID NO: 672663 - RNA, 16 nt, Homo sapiens
gccuccaaaauauuaa

SEQ ID NO: 672664 - RNA, 19 nt, Homo sapiens
gccuccaacccuagcaaaa

SEQ ID NO: 672665 - RNA, 16 nt, Homo sapiens
gccuccaauuggugcu

SEQ ID NO: 672666 - RNA, 21 nt, Homo sapiens
gccuccacagcgagggcagcu

SEQ ID NO: 672667 - RNA, 16 nt, Homo sapiens
gccuccaccaccacug

SEQ ID NO: 672668 - RNA, 18 nt, Homo sapiens
gccuccaccgcugccuaa

SEQ ID NO: 672669 - RNA, 10 nt, Homo sapiens
gccuccacuc

SEQ ID NO: 672670 - RNA, 20 nt, Homo sapiens
gccuccagagaccccaggaa

SEQ ID NO: 672671 - RNA, 19 nt, Homo sapiens
gccuccaggggcagggccu

SEQ ID NO: 672672 - RNA, 16 nt, Homo sapiens
gccuccagucauggua

SEQ ID NO: 672673 - RNA, 17 nt, Homo sapiens
gccucccaaagugcugg

SEQ ID NO: 672674 - RNA, 13 nt, Homo sapiens
gccucccacaaga

SEQ ID NO: 672675 - RNA, 14 nt, Homo sapiens
gccucccaccagag

SEQ ID NO: 672676 - RNA, 18 nt, Homo sapiens
gccucccacuggggucca

SEQ ID NO: 672677 - RNA, 16 nt, Homo sapiens
gccuccccaacccugc

SEQ ID NO: 672678 - RNA, 17 nt, Homo sapiens
gccuccccaugggcaca

SEQ ID NO: 672679 - RNA, 17 nt, Homo sapiens
gccuccccgugccaaaa

SEQ ID NO: 672680 - RNA, 18 nt, Homo sapiens
gccuccccgugccaaaaa

SEQ ID NO: 672681 - RNA, 21 nt, Homo sapiens
gccuccccucuccuuccugug

SEQ ID NO: 672682 - RNA, 21 nt, Homo sapiens
gccucccggguucaagcaauu

SEQ ID NO: 672683 - RNA, 19 nt, Homo sapiens
gccucccuguucacgguga

SEQ ID NO: 672684 - RNA, 17 nt, Homo sapiens
gccucccuuucugggag

SEQ ID NO: 672685 - RNA, 14 nt, Homo sapiens
gccuccgucaucca

SEQ ID NO: 672686 - RNA, 17 nt, Homo sapiens
gccuccucagugaaggu

SEQ ID NO: 672687 - RNA, 19 nt, Homo sapiens
gccuccucccacaagcacc

SEQ ID NO: 672688 - RNA, 21 nt, Homo sapiens
gccuccucuguccagggcccu

SEQ ID NO: 672689 - RNA, 17 nt, Homo sapiens
gccuccugcugccacaa

SEQ ID NO: 672690 - RNA, 23 nt, Homo sapiens
gccuccugggaacacaucuggcu

SEQ ID NO: 672691 - RNA, 22 nt, Homo sapiens
gccuccuuuuuaauacauuaag

SEQ ID NO: 672692 - RNA, 23 nt, Homo sapiens
gccucgagggccgccugccuuag

SEQ ID NO: 672693 - RNA, 13 nt, Homo sapiens
gccucgcacuugc

SEQ ID NO: 672694 - RNA, 19 nt, Homo sapiens
gccucgcauccuaugcuua

SEQ ID NO: 672695 - RNA, 18 nt, Homo sapiens
gccucgggaccucaggug

SEQ ID NO: 672696 - RNA, 17 nt, Homo sapiens
gccucgguggcccugac

SEQ ID NO: 672697 - RNA, 12 nt, Homo sapiens
gccucuccccaa

SEQ ID NO: 672698 - RNA, 19 nt, Homo sapiens
gccucuccccaaacauuaa

SEQ ID NO: 672699 - RNA, 14 nt, Homo sapiens
gccucucucaggag

SEQ ID NO: 672700 - RNA, 13 nt, Homo sapiens
gccucucuugccc

SEQ ID NO: 672701 - RNA, 20 nt, Homo sapiens
gccucugcuccccugugaac

SEQ ID NO: 672702 - RNA, 21 nt, Homo sapiens
gccucuggaaaacucaggauu

SEQ ID NO: 672703 - RNA, 19 nt, Homo sapiens
gccucugggcagccugcuu

SEQ ID NO: 672704 - RNA, 22 nt, Homo sapiens
gccucugguucugacacuuucu

SEQ ID NO: 672705 - RNA, 10 nt, Homo sapiens
gccucugugc

SEQ ID NO: 672706 - RNA, 19 nt, Homo sapiens
gccucuuccucccucauuc

SEQ ID NO: 672707 - RNA, 17 nt, Homo sapiens
gccucuucucugaugac

SEQ ID NO: 672708 - RNA, 13 nt, Homo sapiens
gccucuuggcagu

SEQ ID NO: 672709 - RNA, 17 nt, Homo sapiens
gccugaagaacaguaac

SEQ ID NO: 672710 - RNA, 16 nt, Homo sapiens
gccugacaaccacugg

SEQ ID NO: 672711 - RNA, 16 nt, Homo sapiens
gccugaccuuccuucc

SEQ ID NO: 672712 - RNA, 18 nt, Homo sapiens
gccugagaugcaggugau

SEQ ID NO: 672713 - RNA, 18 nt, Homo sapiens
gccugagcgaguguccag

SEQ ID NO: 672714 - RNA, 17 nt, Homo sapiens
gccugagcuggggccac

SEQ ID NO: 672715 - RNA, 15 nt, Homo sapiens
gccugagggcaguac

SEQ ID NO: 672716 - RNA, 13 nt, Homo sapiens
gccugagucaccu

SEQ ID NO: 672717 - RNA, 14 nt, Homo sapiens
gccugagugaucca

SEQ ID NO: 672718 - RNA, 21 nt, Homo sapiens
gccugauggugcugcucaggc

SEQ ID NO: 672719 - RNA, 21 nt, Homo sapiens
ggaggugggcaugccacccuc

SEQ ID NO: 672720 - RNA, 19 nt, Homo sapiens
ggaggugggguacauuucu

SEQ ID NO: 672721 - RNA, 15 nt, Homo sapiens
ggagguugaagccaa

SEQ ID NO: 672722 - RNA, 16 nt, Homo sapiens
ggagguugguuccuug

SEQ ID NO: 672723 - RNA, 17 nt, Homo sapiens
ggaguaccauguggcaa

SEQ ID NO: 672724 - RNA, 20 nt, Homo sapiens
ggagucaccuucccuugcca

SEQ ID NO: 672725 - RNA, 22 nt, Homo sapiens
ggagucaccuucccuugccacu

SEQ ID NO: 672726 - RNA, 11 nt, Homo sapiens
ggaguccaggc

SEQ ID NO: 672727 - RNA, 14 nt, Homo sapiens
ggagucucugccac

SEQ ID NO: 672728 - RNA, 18 nt, Homo sapiens
ggagugagaucauuuucu

SEQ ID NO: 672729 - RNA, 15 nt, Homo sapiens
ggagugcagugccac

SEQ ID NO: 672730 - RNA, 16 nt, Homo sapiens
ggagugcaguggcaca

SEQ ID NO: 672731 - RNA, 22 nt, Homo sapiens
ggagugcucaccgccucacuca

SEQ ID NO: 672732 - RNA, 16 nt, Homo sapiens
ggagugggcgcagugg

SEQ ID NO: 672733 - RNA, 15 nt, Homo sapiens
ggagugguuccugug

SEQ ID NO: 672734 - RNA, 14 nt, Homo sapiens
ggagugguugcuau

SEQ ID NO: 672735 - RNA, 18 nt, Homo sapiens
ggaguguaaaauguauau

SEQ ID NO: 672736 - RNA, 18 nt, Homo sapiens
ggagugucggauccugug

SEQ ID NO: 672737 - RNA, 18 nt, Homo sapiens
ggaguguggccacguggg

SEQ ID NO: 672738 - RNA, 21 nt, Homo sapiens
ggaguguucagggccagcccu

SEQ ID NO: 672739 - RNA, 16 nt, Homo sapiens
ggaguucagauguuuu

SEQ ID NO: 672740 - RNA, 17 nt, Homo sapiens
ggaguucauaguuggaa

SEQ ID NO: 672741 - RNA, 14 nt, Homo sapiens
ggaguugaaacugc

SEQ ID NO: 672742 - RNA, 21 nt, Homo sapiens
ggaguuggaauguuguaguua

SEQ ID NO: 672743 - RNA, 21 nt, Homo sapiens
ggaguuuuauuuuuaagaaaa

SEQ ID NO: 672744 - RNA, 12 nt, Homo sapiens
ggauaaaagccc

SEQ ID NO: 672745 - RNA, 19 nt, Homo sapiens
ggauaaaucauaaagucag

SEQ ID NO: 672746 - RNA, 19 nt, Homo sapiens
ggauaacuuagguggcaag

SEQ ID NO: 672747 - RNA, 17 nt, Homo sapiens
ggauaauaggaauucaa

SEQ ID NO: 672748 - RNA, 16 nt, Homo sapiens
ggauaauuccuuggug

SEQ ID NO: 672749 - RNA, 20 nt, Homo sapiens
ggauacugcccggggcagcu

SEQ ID NO: 672750 - RNA, 14 nt, Homo sapiens
ggauagacacugga

SEQ ID NO: 672751 - RNA, 23 nt, Homo sapiens
ggauagugggcaccccacugcaa

SEQ ID NO: 672752 - RNA, 19 nt, Homo sapiens
ggauauaaaaauaauguca

SEQ ID NO: 672753 - RNA, 16 nt, Homo sapiens
ggauauaggucaguga

SEQ ID NO: 672754 - RNA, 22 nt, Homo sapiens
ggauauaggucagugaggccca

SEQ ID NO: 672755 - RNA, 20 nt, Homo sapiens
ggauaucaauuaauuugaaa

SEQ ID NO: 672756 - RNA, 21 nt, Homo sapiens
ggauauccuuaucagagcuaa

SEQ ID NO: 672757 - RNA, 16 nt, Homo sapiens
ggauauuaaauguugc

SEQ ID NO: 672758 - RNA, 17 nt, Homo sapiens
ggauauugucagucuuu

SEQ ID NO: 672759 - RNA, 13 nt, Homo sapiens
ggauauuuacuac

SEQ ID NO: 672760 - RNA, 16 nt, Homo sapiens
ggaucacaaggucacu

SEQ ID NO: 672761 - RNA, 12 nt, Homo sapiens
ggaucacagaca

SEQ ID NO: 672762 - RNA, 22 nt, Homo sapiens
ggaucaguuaacuauugcauuu

SEQ ID NO: 672763 - RNA, 21 nt, Homo sapiens
ggauccaauaugacucagaga

SEQ ID NO: 672764 - RNA, 16 nt, Homo sapiens
ggauccagagagcagc

SEQ ID NO: 672765 - RNA, 17 nt, Homo sapiens
ggauccagagcaauuuc

SEQ ID NO: 672766 - RNA, 19 nt, Homo sapiens
ggaucccacucuucuugca

SEQ ID NO: 672767 - RNA, 16 nt, Homo sapiens
ggcagccacccaagcc

SEQ ID NO: 672768 - RNA, 14 nt, Homo sapiens
ggcagccaucaaag

SEQ ID NO: 672769 - RNA, 17 nt, Homo sapiens
ggcagccccccccucaa

SEQ ID NO: 672770 - RNA, 15 nt, Homo sapiens
ggcagcuauccagug

SEQ ID NO: 672771 - RNA, 16 nt, Homo sapiens
ggcagcuauccaguga

SEQ ID NO: 672772 - RNA, 13 nt, Homo sapiens
ggcagcugugaug

SEQ ID NO: 672773 - RNA, 19 nt, Homo sapiens
ggcagcuucuguuggcaga

SEQ ID NO: 672774 - RNA, 16 nt, Homo sapiens
ggcagcuuugcaaaau

SEQ ID NO: 672775 - RNA, 16 nt, Homo sapiens
ggcaggaacuugcaca

SEQ ID NO: 672776 - RNA, 20 nt, Homo sapiens
ggcaggaaggggaaacacag

SEQ ID NO: 672777 - RNA, 22 nt, Homo sapiens
ggcaggaaucuauccauugaac

SEQ ID NO: 672778 - RNA, 17 nt, Homo sapiens
ggcaggacccugcugac

SEQ ID NO: 672779 - RNA, 17 nt, Homo sapiens
ggcaggaccugccuagc

SEQ ID NO: 672780 - RNA, 17 nt, Homo sapiens
ggcaggaccuguggcca

SEQ ID NO: 672781 - RNA, 13 nt, Homo sapiens
ggcaggagaagaa

SEQ ID NO: 672782 - RNA, 20 nt, Homo sapiens
ggcaggagaaucucuugaac

SEQ ID NO: 672783 - RNA, 21 nt, Homo sapiens
ggcaggaggggugaguccccu

SEQ ID NO: 672784 - RNA, 22 nt, Homo sapiens
ggcaggaguauaugagcauccu

SEQ ID NO: 672785 - RNA, 17 nt, Homo sapiens
ggcaggcgguccccauc

SEQ ID NO: 672786 - RNA, 16 nt, Homo sapiens
ggcaggcuccaggccu

SEQ ID NO: 672787 - RNA, 20 nt, Homo sapiens
ggcaggcugggccaugucca

SEQ ID NO: 672788 - RNA, 21 nt, Homo sapiens
ggcaggcuuagagucaggcau

SEQ ID NO: 672789 - RNA, 13 nt, Homo sapiens
ggcagggugcagu

SEQ ID NO: 672790 - RNA, 22 nt, Homo sapiens
ggcagguaggucggcacuugga

SEQ ID NO: 672791 - RNA, 24 nt, Homo sapiens
ggcaggugaaaaggguacagaugu

SEQ ID NO: 672792 - RNA, 17 nt, Homo sapiens
ggcaggugaauaugugg

SEQ ID NO: 672793 - RNA, 16 nt, Homo sapiens
ggcaggugucauauga

SEQ ID NO: 672794 - RNA, 14 nt, Homo sapiens
ggcaguaccauuca

SEQ ID NO: 672795 - RNA, 19 nt, Homo sapiens
ggcaguauuuuguguccuc

SEQ ID NO: 672796 - RNA, 20 nt, Homo sapiens
ggcagucaugcugggucucc

SEQ ID NO: 672797 - RNA, 20 nt, Homo sapiens
ggcagucugaacccuugugc

SEQ ID NO: 672798 - RNA, 13 nt, Homo sapiens
ggcagucugcucu

SEQ ID NO: 672799 - RNA, 16 nt, Homo sapiens
ggcagucugcucugcu

SEQ ID NO: 672800 - RNA, 22 nt, Homo sapiens
ggcagugagugccaugcuuuuu

SEQ ID NO: 672801 - RNA, 14 nt, Homo sapiens
ggcagugcauguga

SEQ ID NO: 672802 - RNA, 12 nt, Homo sapiens
ggcagugccaca

SEQ ID NO: 672803 - RNA, 22 nt, Homo sapiens
ggcaguggacucagaaagccaa

SEQ ID NO: 672804 - RNA, 22 nt, Homo sapiens
ggcaguggccacguucagggag

SEQ ID NO: 672805 - RNA, 14 nt, Homo sapiens
ggcagugggaccca

SEQ ID NO: 672806 - RNA, 19 nt, Homo sapiens
ggcaguguggcagugacca

SEQ ID NO: 672807 - RNA, 16 nt, Homo sapiens
ggcaguugaacagagg

SEQ ID NO: 672808 - RNA, 19 nt, Homo sapiens
ggcaguuuuagcagcacuu

SEQ ID NO: 672809 - RNA, 16 nt, Homo sapiens
ggcauaggccugggug

SEQ ID NO: 672810 - RNA, 24 nt, Homo sapiens
ggcauaggcugacuuuugcagaug

SEQ ID NO: 672811 - RNA, 22 nt, Homo sapiens
ggcauaggucucuuugcuuucu

SEQ ID NO: 672812 - RNA, 17 nt, Homo sapiens
ggcauauccaccaccuc

SEQ ID NO: 672813 - RNA, 22 nt, Homo sapiens
ggcaucaaaaaagauagaucua

SEQ ID NO: 672814 - RNA, 13 nt, Homo sapiens
ggcaucaaacagg

SEQ ID NO: 672815 - RNA, 22 nt, Homo sapiens
ggcaucacacuuauauuuuaug

SEQ ID NO: 672816 - RNA, 17 nt, Homo sapiens
ggcauccaaggcaaaca

SEQ ID NO: 672817 - RNA, 22 nt, Homo sapiens
ggcauccacccagugcugccau

SEQ ID NO: 672818 - RNA, 14 nt, Homo sapiens
ggcaucuauuuccu

SEQ ID NO: 672819 - RNA, 21 nt, Homo sapiens
ggcaucuccugugcaugggug

SEQ ID NO: 672820 - RNA, 12 nt, Homo sapiens
ggcaucugugug

SEQ ID NO: 672821 - RNA, 21 nt, Homo sapiens
ggcaucuuuucuagagacaca

SEQ ID NO: 672822 - RNA, 21 nt, Homo sapiens
ggcaugagcuacuaugcccaa

SEQ ID NO: 672823 - RNA, 19 nt, Homo sapiens
ggcaugccaaauguuccau

SEQ ID NO: 672824 - RNA, 19 nt, Homo sapiens
ggcaugccuuucuguaacc

SEQ ID NO: 672825 - RNA, 16 nt, Homo sapiens
ggcauggguccagggc

SEQ ID NO: 672826 - RNA, 15 nt, Homo sapiens
ggcaugucugguuca

SEQ ID NO: 672827 - RNA, 14 nt, Homo sapiens
ggcaugugcuguga

SEQ ID NO: 672828 - RNA, 13 nt, Homo sapiens
ggcaugugugccu

SEQ ID NO: 672829 - RNA, 14 nt, Homo sapiens
ggcauucucugaag

SEQ ID NO: 672830 - RNA, 22 nt, Homo sapiens
ggcauuucauuaugcuuugaac

SEQ ID NO: 672831 - RNA, 13 nt, Homo sapiens
ggcauuugcaaua

SEQ ID NO: 672832 - RNA, 11 nt, Homo sapiens
ggcauuugccu

SEQ ID NO: 672833 - RNA, 12 nt, Homo sapiens
ggcauuuggacc

SEQ ID NO: 672834 - RNA, 22 nt, Homo sapiens
ggcauuugucagggauuuagcc

SEQ ID NO: 672835 - RNA, 18 nt, Homo sapiens
ggcauuuuuauacucaga

SEQ ID NO: 672836 - RNA, 17 nt, Homo sapiens
ggccaaaacagauuuua

SEQ ID NO: 672837 - RNA, 12 nt, Homo sapiens
ggccaaauaugc

SEQ ID NO: 672838 - RNA, 14 nt, Homo sapiens
ggccaacagcaccu

SEQ ID NO: 672839 - RNA, 18 nt, Homo sapiens
ggccaagcaccuagccuc

SEQ ID NO: 672840 - RNA, 22 nt, Homo sapiens
ggccaagcccagcuuaauggcu

SEQ ID NO: 672841 - RNA, 19 nt, Homo sapiens
ggccaagguguccaggguc

SEQ ID NO: 672842 - RNA, 16 nt, Homo sapiens
gccaccccaacccaau

SEQ ID NO: 672843 - RNA, 16 nt, Homo sapiens
gccaccgcccagagac

SEQ ID NO: 672844 - RNA, 15 nt, Homo sapiens
gccaccgggcagccu

SEQ ID NO: 672845 - RNA, 20 nt, Homo sapiens
gccaccggggcaagagggaa

SEQ ID NO: 672846 - RNA, 22 nt, Homo sapiens
gccaccgugcccggccaaguaa

SEQ ID NO: 672847 - RNA, 20 nt, Homo sapiens
gccaccuccagacaccagug

SEQ ID NO: 672848 - RNA, 19 nt, Homo sapiens
gccaccucccucugccagu

SEQ ID NO: 672849 - RNA, 17 nt, Homo sapiens
gccaccuugccacccau

SEQ ID NO: 672850 - RNA, 16 nt, Homo sapiens
gccacgaggugcaaca

SEQ ID NO: 672851 - RNA, 20 nt, Homo sapiens
gccacgcacuuccucucucg

SEQ ID NO: 672852 - RNA, 14 nt, Homo sapiens
gccacgugggcaaa

SEQ ID NO: 672853 - RNA, 14 nt, Homo sapiens
gccacuaaaacaca

SEQ ID NO: 672854 - RNA, 18 nt, Homo sapiens
gccacuacaacagaauuu

SEQ ID NO: 672855 - RNA, 20 nt, Homo sapiens
gccacuccagaccccuggcu

SEQ ID NO: 672856 - RNA, 15 nt, Homo sapiens
gccacugagcagucu

SEQ ID NO: 672857 - RNA, 18 nt, Homo sapiens
gccacugcaccugaccug

SEQ ID NO: 672858 - RNA, 22 nt, Homo sapiens
gccacugccccccgaggcugcu

SEQ ID NO: 672859 - RNA, 18 nt, Homo sapiens
gccacugccucucccucu

SEQ ID NO: 672860 - RNA, 10 nt, Homo sapiens
gccacugggc

SEQ ID NO: 672861 - RNA, 11 nt, Homo sapiens
gccacugggcc

SEQ ID NO: 672862 - RNA, 17 nt, Homo sapiens
gccacuguguacugugg

SEQ ID NO: 672863 - RNA, 17 nt, Homo sapiens
gccacugugucuggcca

SEQ ID NO: 672864 - RNA, 15 nt, Homo sapiens
gccacuuaguauuuu

SEQ ID NO: 672865 - RNA, 15 nt, Homo sapiens
gccacuucaccaagg

SEQ ID NO: 672866 - RNA, 23 nt, Homo sapiens
gccacuugacauuccuugucacc

SEQ ID NO: 672867 - RNA, 16 nt, Homo sapiens
gccacuugucaaagaa

SEQ ID NO: 672868 - RNA, 23 nt, Homo sapiens
gccagaacguggcucugcuggcc

SEQ ID NO: 672869 - RNA, 16 nt, Homo sapiens
gccagaagggggccau

SEQ ID NO: 672870 - RNA, 17 nt, Homo sapiens
gccagaagggggccaug

SEQ ID NO: 672871 - RNA, 15 nt, Homo sapiens
gccagaaggugcagg

SEQ ID NO: 672872 - RNA, 13 nt, Homo sapiens
gccagaccaugga

SEQ ID NO: 672873 - RNA, 20 nt, Homo sapiens
gccagaccauggacacuaca

SEQ ID NO: 672874 - RNA, 17 nt, Homo sapiens
gccagacccagagcccu

SEQ ID NO: 672875 - RNA, 18 nt, Homo sapiens
gccagacucuagguuaua

SEQ ID NO: 672876 - RNA, 20 nt, Homo sapiens
gccagacuuaaaaaaaccau

SEQ ID NO: 672877 - RNA, 22 nt, Homo sapiens
gccagagcccuucacugccaug

SEQ ID NO: 672878 - RNA, 19 nt, Homo sapiens
gccagaggcagccucugca

SEQ ID NO: 672879 - RNA, 15 nt, Homo sapiens
gccagaggcucuaau

SEQ ID NO: 672880 - RNA, 13 nt, Homo sapiens
gccagagggcagu

SEQ ID NO: 672881 - RNA, 17 nt, Homo sapiens
gccagauggacuccagc

SEQ ID NO: 672882 - RNA, 19 nt, Homo sapiens
gccagaugugaaaacaucu

SEQ ID NO: 672883 - RNA, 20 nt, Homo sapiens
gccagcaagagggaacaaaa

SEQ ID NO: 672884 - RNA, 21 nt, Homo sapiens
gccagcaaugacaucucaggg

SEQ ID NO: 672885 - RNA, 17 nt, Homo sapiens
gccagcaaugaugucca

SEQ ID NO: 672886 - RNA, 21 nt, Homo sapiens
gccagcaggagcucugacuaa

SEQ ID NO: 672887 - RNA, 15 nt, Homo sapiens
gccagccaugcauug

SEQ ID NO: 672888 - RNA, 15 nt, Homo sapiens
gccagccccaagcug

SEQ ID NO: 672889 - RNA, 22 nt, Homo sapiens
gccagcccuccuugacccagaa

SEQ ID NO: 672890 - RNA, 17 nt, Homo sapiens
gccagccgugaugcuca

SEQ ID NO: 672891 - RNA, 14 nt, Homo sapiens
gccagccucagaag

SEQ ID NO: 672892 - RNA, 23 nt, Homo sapiens
gccagccucagaaggccccagag

SEQ ID NO: 672893 - RNA, 19 nt, Homo sapiens
gccagccuccuugcugacc

SEQ ID NO: 672894 - RNA, 21 nt, Homo sapiens
gccagcucuaaacaagucccu

SEQ ID NO: 672895 - RNA, 13 nt, Homo sapiens
gccagcugcaggg

SEQ ID NO: 672896 - RNA, 20 nt, Homo sapiens
gccagcugggagcacuggug

SEQ ID NO: 672897 - RNA, 22 nt, Homo sapiens
gccagcuuggggccaccaaagc

SEQ ID NO: 672898 - RNA, 19 nt, Homo sapiens
gccaggacagcagcacucc

SEQ ID NO: 672899 - RNA, 21 nt, Homo sapiens
gccaggacaugcagcccagaa

SEQ ID NO: 672900 - RNA, 15 nt, Homo sapiens
gccaggagcaggcac

SEQ ID NO: 672901 - RNA, 11 nt, Homo sapiens
gccaggagcuc

SEQ ID NO: 672902 - RNA, 15 nt, Homo sapiens
gccaggcagauccca

SEQ ID NO: 672903 - RNA, 20 nt, Homo sapiens
gccaggcaggugccuggaca

SEQ ID NO: 672904 - RNA, 23 nt, Homo sapiens
guauguuucuucuuucuuuuaag

SEQ ID NO: 672905 - RNA, 15 nt, Homo sapiens
guauguuuguuucau

SEQ ID NO: 672906 - RNA, 20 nt, Homo sapiens
guauuaaaaaaaacaaaaag

SEQ ID NO: 672907 - RNA, 14 nt, Homo sapiens
guauuaaaagcuaa

SEQ ID NO: 672908 - RNA, 12 nt, Homo sapiens
guauuaaacuug

SEQ ID NO: 672909 - RNA, 17 nt, Homo sapiens
guauuaagugugcuuau

SEQ ID NO: 672910 - RNA, 14 nt, Homo sapiens
guauuaauaccaaa

SEQ ID NO: 672911 - RNA, 21 nt, Homo sapiens
guauuaccuccccuacucccu

SEQ ID NO: 672912 - RNA, 19 nt, Homo sapiens
guauuaggugucauuucca

SEQ ID NO: 672913 - RNA, 20 nt, Homo sapiens
guauuaggugucauuuccau

SEQ ID NO: 672914 - RNA, 20 nt, Homo sapiens
guauuauaauaagcaaaaag

SEQ ID NO: 672915 - RNA, 18 nt, Homo sapiens
guauuauauaaacuuaac

SEQ ID NO: 672916 - RNA, 17 nt, Homo sapiens
guauuauauaauucaag

SEQ ID NO: 672917 - RNA, 16 nt, Homo sapiens
guauuaugcuggaauu

SEQ ID NO: 672918 - RNA, 12 nt, Homo sapiens
guauuauucaaa

SEQ ID NO: 672919 - RNA, 12 nt, Homo sapiens
guauuccauuuu

SEQ ID NO: 672920 - RNA, 16 nt, Homo sapiens
guauucccacaccagg

SEQ ID NO: 672921 - RNA, 18 nt, Homo sapiens
guauuccuuuuguguaca

SEQ ID NO: 672922 - RNA, 20 nt, Homo sapiens
guauucuacagcagauacuu

SEQ ID NO: 672923 - RNA, 22 nt, Homo sapiens
guauucuugagggacaaugcca

SEQ ID NO: 672924 - RNA, 16 nt, Homo sapiens
guauucuuuaccucag

SEQ ID NO: 672925 - RNA, 21 nt, Homo sapiens
guauucuuuacuaaagauauc

SEQ ID NO: 672926 - RNA, 14 nt, Homo sapiens
guauugagggccag

SEQ ID NO: 672927 - RNA, 22 nt, Homo sapiens
guauugcaccuuugaaaugcac

SEQ ID NO: 672928 - RNA, 15 nt, Homo sapiens
guauuuaacaaaaag

SEQ ID NO: 672929 - RNA, 20 nt, Homo sapiens
guauuuaacuacaucugccu

SEQ ID NO: 672930 - RNA, 17 nt, Homo sapiens
guauuuaccacagcagc

SEQ ID NO: 672931 - RNA, 17 nt, Homo sapiens
guauuucaagucucuca

SEQ ID NO: 672932 - RNA, 15 nt, Homo sapiens
guauuuccuuccacu

SEQ ID NO: 672933 - RNA, 23 nt, Homo sapiens
guauuucuaauuccacaggucau

SEQ ID NO: 672934 - RNA, 15 nt, Homo sapiens
guauuugaacacuug

SEQ ID NO: 672935 - RNA, 21 nt, Homo sapiens
guauuugcagaauacauucaa

SEQ ID NO: 672936 - RNA, 12 nt, Homo sapiens
guauuuuugcca

SEQ ID NO: 672937 - RNA, 21 nt, Homo sapiens
guauuuuuuccuuaagagcua

SEQ ID NO: 672938 - RNA, 19 nt, Homo sapiens
guauuuuuucuaaugugca

SEQ ID NO: 672939 - RNA, 14 nt, Homo sapiens
gucaaaacuacuga

SEQ ID NO: 672940 - RNA, 19 nt, Homo sapiens
gucaaaaggaagucucuag

SEQ ID NO: 672941 - RNA, 16 nt, Homo sapiens
gucaaaaggacauuua

SEQ ID NO: 672942 - RNA, 19 nt, Homo sapiens
gucaaaauuugcugccaaa

SEQ ID NO: 672943 - RNA, 16 nt, Homo sapiens
gucaaagcaaguuuca

SEQ ID NO: 672944 - RNA, 12 nt, Homo sapiens
gucaaagcagua

SEQ ID NO: 672945 - RNA, 18 nt, Homo sapiens
gucaaagugguacaggaa

SEQ ID NO: 672946 - RNA, 13 nt, Homo sapiens
gucaacaugcauu

SEQ ID NO: 672947 - RNA, 12 nt, Homo sapiens
gucaacauugug

SEQ ID NO: 672948 - RNA, 19 nt, Homo sapiens
gucaaccugccugacauuu

SEQ ID NO: 672949 - RNA, 14 nt, Homo sapiens
gucaacuaugauau

SEQ ID NO: 672950 - RNA, 23 nt, Homo sapiens
gucaacuucuggcuccucaaaca

SEQ ID NO: 672951 - RNA, 15 nt, Homo sapiens
gucaacuuucuuagc

SEQ ID NO: 672952 - RNA, 18 nt, Homo sapiens
gucaagaaacagccagca

SEQ ID NO: 672953 - RNA, 17 nt, Homo sapiens
gucaagaucaacauucc

SEQ ID NO: 672954 - RNA, 16 nt, Homo sapiens
gucaagcugcucugag

SEQ ID NO: 672955 - RNA, 13 nt, Homo sapiens
gucaagcugcuga

SEQ ID NO: 672956 - RNA, 22 nt, Homo sapiens
gucaagcuguugaagucucagg

SEQ ID NO: 672957 - RNA, 15 nt, Homo sapiens
gucaaggaaccucaa

SEQ ID NO: 672958 - RNA, 23 nt, Homo sapiens
gucaaggcagggaaggggccaug

SEQ ID NO: 672959 - RNA, 20 nt, Homo sapiens
gucaaggcaguagaacucca

SEQ ID NO: 672960 - RNA, 19 nt, Homo sapiens
gucaaguaagaacugcucu

SEQ ID NO: 672961 - RNA, 18 nt, Homo sapiens
gucaauaaacaacagcug

SEQ ID NO: 672962 - RNA, 17 nt, Homo sapiens
gucaauacugagccauu

SEQ ID NO: 672963 - RNA, 16 nt, Homo sapiens
gucaaucacagucuca

SEQ ID NO: 672964 - RNA, 13 nt, Homo sapiens
gucaauccuguca

SEQ ID NO: 672965 - RNA, 15 nt, Homo sapiens
gucaaugaccauuca

SEQ ID NO: 672966 - RNA, 17 nt, Homo sapiens
gucaauggcuuguucau

SEQ ID NO: 672967 - RNA, 20 nt, Homo sapiens
gucaaugucauuacauagaa

SEQ ID NO: 672968 - RNA, 12 nt, Homo sapiens
gucaaugugcag

SEQ ID NO: 672969 - RNA, 19 nt, Homo sapiens
gucacaauacaguaaguaa

SEQ ID NO: 672970 - RNA, 18 nt, Homo sapiens
gucacaauuaugugcaaa

SEQ ID NO: 672971 - RNA, 19 nt, Homo sapiens
gucacacucuacacggacu

SEQ ID NO: 672972 - RNA, 18 nt, Homo sapiens
gucacauagagugaucuu

SEQ ID NO: 672973 - RNA, 16 nt, Homo sapiens
gucacaucagcaauuu

SEQ ID NO: 672974 - RNA, 18 nt, Homo sapiens
gucacaucagcaauuuca

SEQ ID NO: 672975 - RNA, 19 nt, Homo sapiens
gucacaucucugccuggaa

SEQ ID NO: 672976 - RNA, 18 nt, Homo sapiens
gucacauuguaacugaac

SEQ ID NO: 672977 - RNA, 17 nt, Homo sapiens
gucaccacccagcccuu

SEQ ID NO: 672978 - RNA, 18 nt, Homo sapiens
gucaccagcuaucuguca

SEQ ID NO: 672979 - RNA, 12 nt, Homo sapiens
gucaccaugacu

SEQ ID NO: 672980 - RNA, 15 nt, Homo sapiens
gucacccaaacacuu

SEQ ID NO: 672981 - RNA, 16 nt, Homo sapiens
gucacccaaacacuuc

SEQ ID NO: 672982 - RNA, 22 nt, Homo sapiens
gucacccaggcuggagugcggu

SEQ ID NO: 672983 - RNA, 17 nt, Homo sapiens
gucaccuacgugccacu

SEQ ID NO: 672984 - RNA, 18 nt, Homo sapiens
gucaccucagcugauauu

SEQ ID NO: 672985 - RNA, 21 nt, Homo sapiens
gucacgcacaagggcacguga

SEQ ID NO: 672986 - RNA, 16 nt, Homo sapiens
gucacggccaagugua

SEQ ID NO: 672987 - RNA, 14 nt, Homo sapiens
gucacggguaaaaa

SEQ ID NO: 672988 - RNA, 19 nt, Homo sapiens
gucacguuaccauuuacau

SEQ ID NO: 672989 - RNA, 12 nt, Homo sapiens
gucacuaagacu

SEQ ID NO: 672990 - RNA, 14 nt, Homo sapiens
gucaguaauuuaua

SEQ ID NO: 672991 - RNA, 15 nt, Homo sapiens
gucagucacagccac

SEQ ID NO: 672992 - RNA, 17 nt, Homo sapiens
gucagucugcuuagaaa

SEQ ID NO: 672993 - RNA, 20 nt, Homo sapiens
gucagugccaugacugagaa

SEQ ID NO: 672994 - RNA, 18 nt, Homo sapiens
gucaguuucacucccucu

SEQ ID NO: 672995 - RNA, 12 nt, Homo sapiens
gucaguuuucau

SEQ ID NO: 672996 - RNA, 22 nt, Homo sapiens
gucauaaaaugcauacuguuga

SEQ ID NO: 672997 - RNA, 13 nt, Homo sapiens
gucauacauaccu

SEQ ID NO: 672998 - RNA, 15 nt, Homo sapiens
gucauagggauuguc

SEQ ID NO: 672999 - RNA, 18 nt, Homo sapiens
gucauaggggacugagga

SEQ ID NO: 673000 - RNA, 21 nt, Homo sapiens
gucauauauuuuuugcuacuu

SEQ ID NO: 673001 - RNA, 22 nt, Homo sapiens
gucaucaaccgaugguccucac

SEQ ID NO: 673002 - RNA, 12 nt, Homo sapiens
gucaucacccag

SEQ ID NO: 673003 - RNA, 14 nt, Homo sapiens
gucaucugugcacu

SEQ ID NO: 673004 - RNA, 18 nt, Homo sapiens
gucaucuuaaauuucaaa

SEQ ID NO: 673005 - RNA, 16 nt, Homo sapiens
gucaugaccuccaggg

SEQ ID NO: 673006 - RNA, 18 nt, Homo sapiens
gucaugaccuccagggag

SEQ ID NO: 673007 - RNA, 13 nt, Homo sapiens
gucaugcacugag

SEQ ID NO: 673008 - RNA, 15 nt, Homo sapiens
gucaugccacugcac

SEQ ID NO: 673009 - RNA, 16 nt, Homo sapiens
gucaugcuuuugcuau

SEQ ID NO: 673010 - RNA, 19 nt, Homo sapiens
gucauggaauggcaggugu

SEQ ID NO: 673011 - RNA, 24 nt, Homo sapiens
gucauggcaccaaagccaccagac

SEQ ID NO: 673012 - RNA, 21 nt, Homo sapiens
gucaugucucugguggugcug

SEQ ID NO: 673013 - RNA, 21 nt, Homo sapiens
gucauguggaaacuauuuaaa

SEQ ID NO: 673014 - RNA, 19 nt, Homo sapiens
gucauuauccuugcuauga

SEQ ID NO: 673015 - RNA, 20 nt, Homo sapiens
gucauuccaaauaugagaug

SEQ ID NO: 673016 - RNA, 14 nt, Homo sapiens
gucauuguauucag

SEQ ID NO: 673017 - RNA, 17 nt, Homo sapiens
gucauuuccuaugcaaa

SEQ ID NO: 673018 - RNA, 14 nt, Homo sapiens
gucauuuccucuag

SEQ ID NO: 673019 - RNA, 14 nt, Homo sapiens
gucauuugaaugag

SEQ ID NO: 673020 - RNA, 22 nt, Homo sapiens
gucauuugaaugagaccuggaa

SEQ ID NO: 673021 - RNA, 17 nt, Homo sapiens
gucauuuuuaacagcau

SEQ ID NO: 673022 - RNA, 13 nt, Homo sapiens
guccaaaugcaau

SEQ ID NO: 673023 - RNA, 20 nt, Homo sapiens
guccaaccagaaacaccccu

SEQ ID NO: 673024 - RNA, 16 nt, Homo sapiens
guccaaccagacuuug

SEQ ID NO: 673025 - RNA, 17 nt, Homo sapiens
guccaagagacauggaa

SEQ ID NO: 673026 - RNA, 21 nt, Homo sapiens
guccaagccccccacaccuuu

SEQ ID NO: 673027 - RNA, 13 nt, Homo sapiens
guccaagggccau

SEQ ID NO: 673028 - RNA, 18 nt, Homo sapiens
guccaaguggcugugaca

SEQ ID NO: 673029 - RNA, 19 nt, Homo sapiens
guccaagugugugugcgug

SEQ ID NO: 673030 - RNA, 21 nt, Homo sapiens
guccaagugugugugcgugug

SEQ ID NO: 673031 - RNA, 16 nt, Homo sapiens
guccaccccagugugc

SEQ ID NO: 673032 - RNA, 23 nt, Homo sapiens
guccacgcaauggaacauuauua

SEQ ID NO: 673033 - RNA, 16 nt, Homo sapiens
guccacuuuacucaaa

SEQ ID NO: 673034 - RNA, 15 nt, Homo sapiens
guccagaauucacuu

SEQ ID NO: 673035 - RNA, 20 nt, Homo sapiens
guccagagcuggaucucuca

SEQ ID NO: 673036 - RNA, 18 nt, Homo sapiens
guccagauuuacacuggg

SEQ ID NO: 673037 - RNA, 14 nt, Homo sapiens
guccagcacuggaa

SEQ ID NO: 673038 - RNA, 22 nt, Homo sapiens
guccagccacuugacuggcaca

SEQ ID NO: 673039 - RNA, 16 nt, Homo sapiens
guccagcucagucuca

SEQ ID NO: 673040 - RNA, 18 nt, Homo sapiens
guccagcucagucucagc

SEQ ID NO: 673041 - RNA, 11 nt, Homo sapiens
guccaggaaac

SEQ ID NO: 673042 - RNA, 22 nt, Homo sapiens
guccaggccucucucugcucca

SEQ ID NO: 673043 - RNA, 17 nt, Homo sapiens
guccaggguugaucaca

SEQ ID NO: 673044 - RNA, 19 nt, Homo sapiens
guccaugaagcacugagca

SEQ ID NO: 673045 - RNA, 15 nt, Homo sapiens
guccaugcugaugau

SEQ ID NO: 673046 - RNA, 14 nt, Homo sapiens
guccauuuugcccu

SEQ ID NO: 673047 - RNA, 16 nt, Homo sapiens
gucccaaaugucauca

SEQ ID NO: 673048 - RNA, 15 nt, Homo sapiens
gucccaacccagaca

SEQ ID NO: 673049 - RNA, 14 nt, Homo sapiens
gucccacacuggug

SEQ ID NO: 673050 - RNA, 13 nt, Homo sapiens
gucccacacugug

SEQ ID NO: 673051 - RNA, 13 nt, Homo sapiens
gucccaccaacuc

SEQ ID NO: 673052 - RNA, 17 nt, Homo sapiens
gucccacuaucugggug

SEQ ID NO: 673053 - RNA, 21 nt, Homo sapiens
gucccagaaauaaacugagaa

SEQ ID NO: 673054 - RNA, 11 nt, Homo sapiens
gucccagagag

SEQ ID NO: 673055 - RNA, 17 nt, Homo sapiens
gucccagagcagaggaa

SEQ ID NO: 673056 - RNA, 20 nt, Homo sapiens
gucccagagguuaucugccu

SEQ ID NO: 673057 - RNA, 15 nt, Homo sapiens
gucccagcggcacca

SEQ ID NO: 673058 - RNA, 16 nt, Homo sapiens
gucccaggagcaggac

SEQ ID NO: 673059 - RNA, 19 nt, Homo sapiens
gucccaucaauucuuagaa

SEQ ID NO: 673060 - RNA, 22 nt, Homo sapiens
gucccaucaauucuuagaauau

SEQ ID NO: 673061 - RNA, 14 nt, Homo sapiens
gucccaucuucacu

SEQ ID NO: 673062 - RNA, 17 nt, Homo sapiens
gucccauggacacucca

SEQ ID NO: 673063 - RNA, 20 nt, Homo sapiens
gucccauuuuucucuugcca

SEQ ID NO: 673064 - RNA, 22 nt, Homo sapiens
guccccacagcuucucuacaga

SEQ ID NO: 673065 - RNA, 14 nt, Homo sapiens
guccccaccuaagc

SEQ ID NO: 673066 - RNA, 14 nt, Homo sapiens
guccccaccuggga

SEQ ID NO: 673067 - RNA, 17 nt, Homo sapiens
guccccacgaacuggcc

SEQ ID NO: 673068 - RNA, 21 nt, Homo sapiens
guccccccucaagaguacaga

SEQ ID NO: 673069 - RNA, 16 nt, Homo sapiens
guccccuccacuguca

SEQ ID NO: 673070 - RNA, 20 nt, Homo sapiens
guccccuuccuguucuuccu

SEQ ID NO: 673071 - RNA, 20 nt, Homo sapiens
gucccggggccagcacuucc

SEQ ID NO: 673072 - RNA, 13 nt, Homo sapiens
gucccgguuuguc

SEQ ID NO: 673073 - RNA, 16 nt, Homo sapiens
gucccgugcauggguu

SEQ ID NO: 673074 - RNA, 12 nt, Homo sapiens
gucccuaccugc

SEQ ID NO: 673075 - RNA, 18 nt, Homo sapiens
gucccucacguuucuucc

SEQ ID NO: 673076 - RNA, 19 nt, Homo sapiens
gucccucacguuucuuccc

SEQ ID NO: 673077 - RNA, 23 nt, Homo sapiens
gucugcccugcccauacugagcc

SEQ ID NO: 673078 - RNA, 20 nt, Homo sapiens
gucugcucggccgucuucac

SEQ ID NO: 673079 - RNA, 16 nt, Homo sapiens
gucugcuuaaagcuuc

SEQ ID NO: 673080 - RNA, 18 nt, Homo sapiens
gucugcuuagaguuuacu

SEQ ID NO: 673081 - RNA, 24 nt, Homo sapiens
gucuggaucccgagguauggcaga

SEQ ID NO: 673082 - RNA, 15 nt, Homo sapiens
gucuggcccaccagg

SEQ ID NO: 673083 - RNA, 19 nt, Homo sapiens
gucuggcugaggauuucaa

SEQ ID NO: 673084 - RNA, 20 nt, Homo sapiens
gucugggagaaauugacaga

SEQ ID NO: 673085 - RNA, 18 nt, Homo sapiens
gucugggagucacacagu

SEQ ID NO: 673086 - RNA, 12 nt, Homo sapiens
gucugggccagu

SEQ ID NO: 673087 - RNA, 16 nt, Homo sapiens
gucugguuaguuaaaa

SEQ ID NO: 673088 - RNA, 22 nt, Homo sapiens
gucuguaaaaccagcauacagu

SEQ ID NO: 673089 - RNA, 19 nt, Homo sapiens
gucuguaaauacuggugca

SEQ ID NO: 673090 - RNA, 21 nt, Homo sapiens
gucugucaugaacauguuccu

SEQ ID NO: 673091 - RNA, 15 nt, Homo sapiens
gucugucuacugugg

SEQ ID NO: 673092 - RNA, 13 nt, Homo sapiens
gucugucuugaga

SEQ ID NO: 673093 - RNA, 16 nt, Homo sapiens
gucuguggcacauucu

SEQ ID NO: 673094 - RNA, 16 nt, Homo sapiens
gucugugugcaagugu

SEQ ID NO: 673095 - RNA, 15 nt, Homo sapiens
gucugugugguggag

SEQ ID NO: 673096 - RNA, 12 nt, Homo sapiens
gucuguguuauu

SEQ ID NO: 673097 - RNA, 16 nt, Homo sapiens
gucuguuacacuggag

SEQ ID NO: 673098 - RNA, 17 nt, Homo sapiens
gucuguugaacagcuau

SEQ ID NO: 673099 - RNA, 14 nt, Homo sapiens
gucuguugcuugua

SEQ ID NO: 673100 - RNA, 21 nt, Homo sapiens
gucuuaaacuaaaugugcaau

SEQ ID NO: 673101 - RNA, 20 nt, Homo sapiens
gucuuaagccuuuugcucac

SEQ ID NO: 673102 - RNA, 14 nt, Homo sapiens
gucuuaaugcaaau

SEQ ID NO: 673103 - RNA, 16 nt, Homo sapiens
gucuuacuguugcaua

SEQ ID NO: 673104 - RNA, 16 nt, Homo sapiens
gucuuagugcaaaaaa

SEQ ID NO: 673105 - RNA, 13 nt, Homo sapiens
gucuucaaucucu

SEQ ID NO: 673106 - RNA, 22 nt, Homo sapiens
gucuucagaguccgccaguguu

SEQ ID NO: 673107 - RNA, 17 nt, Homo sapiens
gucuucagcacauucca

SEQ ID NO: 673108 - RNA, 18 nt, Homo sapiens
gucuucauuucauuguau

SEQ ID NO: 673109 - RNA, 14 nt, Homo sapiens
gucuuccacuguac

SEQ ID NO: 673110 - RNA, 14 nt, Homo sapiens
gucuuccacuuugc

SEQ ID NO: 673111 - RNA, 14 nt, Homo sapiens
uaaagaaguuugaa

SEQ ID NO: 673112 - RNA, 13 nt, Homo sapiens
uaaagaauuacuu

SEQ ID NO: 673113 - RNA, 20 nt, Homo sapiens
uaaagacagagugaauuuca

SEQ ID NO: 673114 - RNA, 14 nt, Homo sapiens
uaaagacucaaggu

SEQ ID NO: 673115 - RNA, 20 nt, Homo sapiens
uaaagacugguuuucugcca

SEQ ID NO: 673116 - RNA, 22 nt, Homo sapiens
uaaagacuuguauagcaugaaa

SEQ ID NO: 673117 - RNA, 23 nt, Homo sapiens
uaaagagagagagagagaauucc

SEQ ID NO: 673118 - RNA, 18 nt, Homo sapiens
uaaagauaauugcuauuu

SEQ ID NO: 673119 - RNA, 20 nt, Homo sapiens
uaaagauacuaaaccagcau

SEQ ID NO: 673120 - RNA, 17 nt, Homo sapiens
uaaagaugaucuacuca

SEQ ID NO: 673121 - RNA, 15 nt, Homo sapiens
uaaagauggcacuuu

SEQ ID NO: 673122 - RNA, 11 nt, Homo sapiens
uaaagauguga

SEQ ID NO: 673123 - RNA, 12 nt, Homo sapiens
uaaagauuuaua

SEQ ID NO: 673124 - RNA, 19 nt, Homo sapiens
uaaagauuucuaguaggca

SEQ ID NO: 673125 - RNA, 22 nt, Homo sapiens
uaaagauuuuuuaauaauuuag

SEQ ID NO: 673126 - RNA, 19 nt, Homo sapiens
uaaagcaaaauaguauugc

SEQ ID NO: 673127 - RNA, 18 nt, Homo sapiens
uaaagcaauaugcauuua

SEQ ID NO: 673128 - RNA, 17 nt, Homo sapiens
uaaagcaaugugguagu

SEQ ID NO: 673129 - RNA, 14 nt, Homo sapiens
uaaagcacaugccu

SEQ ID NO: 673130 - RNA, 17 nt, Homo sapiens
uaaagcacaugccuucu

SEQ ID NO: 673131 - RNA, 21 nt, Homo sapiens
uaaagcagagcuaguaaugcu

SEQ ID NO: 673132 - RNA, 20 nt, Homo sapiens
uaaagcagaggcaacacugg

SEQ ID NO: 673133 - RNA, 20 nt, Homo sapiens
uaaagcaucauuaaugcaca

SEQ ID NO: 673134 - RNA, 21 nt, Homo sapiens
uaaagccaacacccugucuaa

SEQ ID NO: 673135 - RNA, 16 nt, Homo sapiens
uaaagccaagcacuuu

SEQ ID NO: 673136 - RNA, 23 nt, Homo sapiens
uaaagcccuuuauuuauaauaca

SEQ ID NO: 673137 - RNA, 17 nt, Homo sapiens
uaaagcuacaaucuguu

SEQ ID NO: 673138 - RNA, 19 nt, Homo sapiens
uaaagcuauguuacaugga

SEQ ID NO: 673139 - RNA, 21 nt, Homo sapiens
uaaagcuggaacauuugauau

SEQ ID NO: 673140 - RNA, 16 nt, Homo sapiens
uaaagcuugauuugau

SEQ ID NO: 673141 - RNA, 21 nt, Homo sapiens
uaaagcuuuaucuuuguguaa

SEQ ID NO: 673142 - RNA, 18 nt, Homo sapiens
uaaagcuuucaacaugua

SEQ ID NO: 673143 - RNA, 23 nt, Homo sapiens
uaaagcuuuuauucguccuuuga

SEQ ID NO: 673144 - RNA, 15 nt, Homo sapiens
uaaaggaaaaucaca

SEQ ID NO: 673145 - RNA, 20 nt, Homo sapiens
uaaaggcagcugccucugcu

SEQ ID NO: 673146 - RNA, 15 nt, Homo sapiens
uaaaggcaguuuucu

SEQ ID NO: 673147 - RNA, 13 nt, Homo sapiens
uaaaggcaucuac

SEQ ID NO: 673148 - RNA, 14 nt, Homo sapiens
uaaaggccuggaac

SEQ ID NO: 673149 - RNA, 15 nt, Homo sapiens
uaaaggcuacaggcu

SEQ ID NO: 673150 - RNA, 18 nt, Homo sapiens
uaaaggcucgauuuugua

SEQ ID NO: 673151 - RNA, 18 nt, Homo sapiens
uaaagggagaaaugccag

SEQ ID NO: 673152 - RNA, 17 nt, Homo sapiens
uaaagggucuuaugaaa

SEQ ID NO: 673153 - RNA, 24 nt, Homo sapiens
uaaagguacgauuauacuugagau

SEQ ID NO: 673154 - RNA, 15 nt, Homo sapiens
uaaagguuuucucua

SEQ ID NO: 673155 - RNA, 14 nt, Homo sapiens
uaaaguaccacaca

SEQ ID NO: 673156 - RNA, 13 nt, Homo sapiens
uaaaguaccauua

SEQ ID NO: 673157 - RNA, 12 nt, Homo sapiens
uaaaguagcuuu

SEQ ID NO: 673158 - RNA, 12 nt, Homo sapiens
uaaaguauguga

SEQ ID NO: 673159 - RNA, 19 nt, Homo sapiens
uaaaguauguuauugcaua

SEQ ID NO: 673160 - RNA, 20 nt, Homo sapiens
uaaaguauguuauugcauaa

SEQ ID NO: 673161 - RNA, 21 nt, Homo sapiens
uaaaguauguuuuuacauuau

SEQ ID NO: 673162 - RNA, 12 nt, Homo sapiens
uaaaguauucca

SEQ ID NO: 673163 - RNA, 14 nt, Homo sapiens
uaaaguauucucca

SEQ ID NO: 673164 - RNA, 15 nt, Homo sapiens
uaaagucaaaugcca

SEQ ID NO: 673165 - RNA, 20 nt, Homo sapiens
uaaaguccaaagucagaucu

SEQ ID NO: 673166 - RNA, 13 nt, Homo sapiens
uaaagucugaauc

SEQ ID NO: 673167 - RNA, 17 nt, Homo sapiens
uaaagucuguugauuaa

SEQ ID NO: 673168 - RNA, 14 nt, Homo sapiens
uaaagugccaguau

SEQ ID NO: 673169 - RNA, 20 nt, Homo sapiens
uaaagugcugcagccaaaga

SEQ ID NO: 673170 - RNA, 14 nt, Homo sapiens
uaaagugcuugcuu

SEQ ID NO: 673171 - RNA, 11 nt, Homo sapiens
uaaaguggcag

SEQ ID NO: 673172 - RNA, 15 nt, Homo sapiens
uaaaguguuugccuc

SEQ ID NO: 673173 - RNA, 13 nt, Homo sapiens
uaaaguucaauuu

SEQ ID NO: 673174 - RNA, 23 nt, Homo sapiens
uaaaguucaauuucaacauguau

SEQ ID NO: 673175 - RNA, 14 nt, Homo sapiens
uaaaguuggaauuu

SEQ ID NO: 673176 - RNA, 15 nt, Homo sapiens
uaaaguugguauuaa

SEQ ID NO: 673177 - RNA, 15 nt, Homo sapiens
uaaauaaaacugaau

SEQ ID NO: 673178 - RNA, 23 nt, Homo sapiens
uaaauaaacacauagauucaccu

SEQ ID NO: 673179 - RNA, 15 nt, Homo sapiens
uaaauaaacaugacc

SEQ ID NO: 673180 - RNA, 16 nt, Homo sapiens
uaaauaaaccacugug

SEQ ID NO: 673181 - RNA, 18 nt, Homo sapiens
uaaauaaaccacugugcg

SEQ ID NO: 673182 - RNA, 15 nt, Homo sapiens
uaaauaaagucuuac

SEQ ID NO: 673183 - RNA, 20 nt, Homo sapiens
uaaauaaagucuuacugugc

SEQ ID NO: 673184 - RNA, 18 nt, Homo sapiens
uaaauaaaguuacuugaa

SEQ ID NO: 673185 - RNA, 15 nt, Homo sapiens
uaaauaaaucauuaa

SEQ ID NO: 673186 - RNA, 16 nt, Homo sapiens
uaaauaaauguaaaua

SEQ ID NO: 673187 - RNA, 21 nt, Homo sapiens
uaaauaaauguaucuuauuca

SEQ ID NO: 673188 - RNA, 15 nt, Homo sapiens
uaaauaauucuuccu

SEQ ID NO: 673189 - RNA, 21 nt, Homo sapiens
uaaauaauuuauggauuuaug

SEQ ID NO: 673190 - RNA, 16 nt, Homo sapiens
uaaauaauuugcacug

SEQ ID NO: 673191 - RNA, 13 nt, Homo sapiens
uaaauacaaaagg

SEQ ID NO: 673192 - RNA, 11 nt, Homo sapiens
uaaauacaggu

SEQ ID NO: 673193 - RNA, 13 nt, Homo sapiens
uaaauacauaugg

SEQ ID NO: 673194 - RNA, 12 nt, Homo sapiens
uaaauaccucuu

SEQ ID NO: 673195 - RNA, 16 nt, Homo sapiens
uaaauacugcuugacc

SEQ ID NO: 673196 - RNA, 13 nt, Homo sapiens
uaaauacuggugc

SEQ ID NO: 673197 - RNA, 20 nt, Homo sapiens
uaaauacuguaaaugcauug

SEQ ID NO: 673198 - RNA, 22 nt, Homo sapiens
uaaauacuguaaaugcauugga

SEQ ID NO: 673199 - RNA, 17 nt, Homo sapiens
uaaauagaacaaccugc

SEQ ID NO: 673200 - RNA, 19 nt, Homo sapiens
uaaauagaacuaucugcau

SEQ ID NO: 673201 - RNA, 17 nt, Homo sapiens
uaaauagaagaguuuaa

SEQ ID NO: 673202 - RNA, 23 nt, Homo sapiens
uaaauagcuauauccauguacug

SEQ ID NO: 673203 - RNA, 13 nt, Homo sapiens
uaaauaggagcuu

SEQ ID NO: 673204 - RNA, 19 nt, Homo sapiens
uaaauaggcuggcaagaua

SEQ ID NO: 673205 - RNA, 16 nt, Homo sapiens
uaaauauacuaugaaa

SEQ ID NO: 673206 - RNA, 15 nt, Homo sapiens
uaaauauauauguca

SEQ ID NO: 673207 - RNA, 19 nt, Homo sapiens
uaaauaucaacccacuuaa

SEQ ID NO: 673208 - RNA, 19 nt, Homo sapiens
uaaauauccacaguacuca

SEQ ID NO: 673209 - RNA, 15 nt, Homo sapiens
uaaauaucugucaua

SEQ ID NO: 673210 - RNA, 23 nt, Homo sapiens
uaaauaucuuuuuccuucuacuc

SEQ ID NO: 673211 - RNA, 13 nt, Homo sapiens
uaaauauucauau

SEQ ID NO: 673212 - RNA, 13 nt, Homo sapiens
uaaauauuucaca

SEQ ID NO: 673213 - RNA, 16 nt, Homo sapiens
uaaauauuucaggcau

SEQ ID NO: 673214 - RNA, 17 nt, Homo sapiens
uaaauauuucaggcaua

SEQ ID NO: 673215 - RNA, 13 nt, Homo sapiens
uaaaucaaaccag

SEQ ID NO: 673216 - RNA, 15 nt, Homo sapiens
uaaaucaagagcuua

SEQ ID NO: 673217 - RNA, 12 nt, Homo sapiens
uaaaucaagucc

SEQ ID NO: 673218 - RNA, 20 nt, Homo sapiens
uaaaucaggacagguggugc

SEQ ID NO: 673219 - RNA, 13 nt, Homo sapiens
uaaaucauaaagu

SEQ ID NO: 673220 - RNA, 14 nt, Homo sapiens
uaaaucaugaugcu

SEQ ID NO: 673221 - RNA, 12 nt, Homo sapiens
uaaauccaauau

SEQ ID NO: 673222 - RNA, 21 nt, Homo sapiens
uaaauccauccauccaaaggc

SEQ ID NO: 673223 - RNA, 20 nt, Homo sapiens
uaaauccuugggagucauua

SEQ ID NO: 673224 - RNA, 14 nt, Homo sapiens
uaaaucuccagugg

SEQ ID NO: 673225 - RNA, 22 nt, Homo sapiens
uaaaucugaguauauauuuaca

SEQ ID NO: 673226 - RNA, 20 nt, Homo sapiens
uaaaucuggcagagccucag

SEQ ID NO: 673227 - RNA, 13 nt, Homo sapiens
uaaaucugugaug

SEQ ID NO: 673228 - RNA, 14 nt, Homo sapiens
uaaaucugugauga

SEQ ID NO: 673229 - RNA, 11 nt, Homo sapiens
uaaaugaacua

SEQ ID NO: 673230 - RNA, 19 nt, Homo sapiens
uaaaugacaaauguauuaa

SEQ ID NO: 673231 - RNA, 16 nt, Homo sapiens
uaaaugacacuacuug

SEQ ID NO: 673232 - RNA, 17 nt, Homo sapiens
uaaaugacuuuucuuaa

SEQ ID NO: 673233 - RNA, 16 nt, Homo sapiens
uaaaugauguguuggu

SEQ ID NO: 673234 - RNA, 22 nt, Homo sapiens
uaaaugauuaaaaaaucagaga

SEQ ID NO: 673235 - RNA, 14 nt, Homo sapiens
uagucgguucugua

SEQ ID NO: 673236 - RNA, 12 nt, Homo sapiens
uagucucaguga

SEQ ID NO: 673237 - RNA, 16 nt, Homo sapiens
uagucuguacuucauc

SEQ ID NO: 673238 - RNA, 19 nt, Homo sapiens
uagucuuaacuggucuccu

SEQ ID NO: 673239 - RNA, 22 nt, Homo sapiens
uagucuuggaagcuguuuggaa

SEQ ID NO: 673240 - RNA, 21 nt, Homo sapiens
uagugaaaaaugucacuauau

SEQ ID NO: 673241 - RNA, 21 nt, Homo sapiens
uagugacuugugucccaugau

SEQ ID NO: 673242 - RNA, 15 nt, Homo sapiens
uagugcaaaacugug

SEQ ID NO: 673243 - RNA, 19 nt, Homo sapiens
uagugcaacaucucugaau

SEQ ID NO: 673244 - RNA, 14 nt, Homo sapiens
uagugcaauuccaa

SEQ ID NO: 673245 - RNA, 20 nt, Homo sapiens
uagugcacccagugacugac

SEQ ID NO: 673246 - RNA, 12 nt, Homo sapiens
uagugcagccaa

SEQ ID NO: 673247 - RNA, 14 nt, Homo sapiens
uagugcaucagaug

SEQ ID NO: 673248 - RNA, 19 nt, Homo sapiens
uagugccauuggaauaaua

SEQ ID NO: 673249 - RNA, 10 nt, Homo sapiens
uagugccuuc

SEQ ID NO: 673250 - RNA, 13 nt, Homo sapiens
uagugccuuccac

SEQ ID NO: 673251 - RNA, 14 nt, Homo sapiens
uagugcuggucaga

SEQ ID NO: 673252 - RNA, 16 nt, Homo sapiens
uagugcuucagaguuu

SEQ ID NO: 673253 - RNA, 18 nt, Homo sapiens
uaguggacauggucacag

SEQ ID NO: 673254 - RNA, 13 nt, Homo sapiens
uaguggagccagg

SEQ ID NO: 673255 - RNA, 17 nt, Homo sapiens
uaguggauuaaugcauu

SEQ ID NO: 673256 - RNA, 21 nt, Homo sapiens
uaguggggagacuucuuggcu

SEQ ID NO: 673257 - RNA, 23 nt, Homo sapiens
uagugguaucugacauauacuca

SEQ ID NO: 673258 - RNA, 20 nt, Homo sapiens
uaguguaccuccucucagug

SEQ ID NO: 673259 - RNA, 20 nt, Homo sapiens
uaguguauaaaaaccaugcu

SEQ ID NO: 673260 - RNA, 18 nt, Homo sapiens
uaguguauccauaaugca

SEQ ID NO: 673261 - RNA, 20 nt, Homo sapiens
uagugucauccucacaguga

SEQ ID NO: 673262 - RNA, 17 nt, Homo sapiens
uagugucucauguggaa

SEQ ID NO: 673263 - RNA, 12 nt, Homo sapiens
uagugugaauua

SEQ ID NO: 673264 - RNA, 18 nt, Homo sapiens
uaguguguguguguauau

SEQ ID NO: 673265 - RNA, 19 nt, Homo sapiens
uaguguucacaaacuguga

SEQ ID NO: 673266 - RNA, 20 nt, Homo sapiens
uaguguucacaaacugugaa

SEQ ID NO: 673267 - RNA, 19 nt, Homo sapiens
uaguguuggaaaaugugca

SEQ ID NO: 673268 - RNA, 21 nt, Homo sapiens
uaguguuggaaaaugugcaau

SEQ ID NO: 673269 - RNA, 23 nt, Homo sapiens
uaguguuggaaaaugugcaauau

SEQ ID NO: 673270 - RNA, 19 nt, Homo sapiens
uaguuaaaaaaaaauuccc

SEQ ID NO: 673271 - RNA, 16 nt, Homo sapiens
uaguuaaagaaaggaa

SEQ ID NO: 673272 - RNA, 13 nt, Homo sapiens
uaguuaaaguaau

SEQ ID NO: 673273 - RNA, 12 nt, Homo sapiens
uaguuacugugg

SEQ ID NO: 673274 - RNA, 13 nt, Homo sapiens
uaguuacuguggu

SEQ ID NO: 673275 - RNA, 18 nt, Homo sapiens
uaguuagauucacuuuga

SEQ ID NO: 673276 - RNA, 17 nt, Homo sapiens
uaguucaauacagugaa

SEQ ID NO: 673277 - RNA, 14 nt, Homo sapiens
uaguucaauagucu

SEQ ID NO: 673278 - RNA, 20 nt, Homo sapiens
uaguucccuuugccaacaga

SEQ ID NO: 673279 - RNA, 11 nt, Homo sapiens
uaguucuagau

SEQ ID NO: 673280 - RNA, 16 nt, Homo sapiens
uaguucuguguugacc

SEQ ID NO: 673281 - RNA, 14 nt, Homo sapiens
uaguugcaguauug

SEQ ID NO: 673282 - RNA, 19 nt, Homo sapiens
uaguugcccucuaccugac

SEQ ID NO: 673283 - RNA, 12 nt, Homo sapiens
uaguugccuuaa

SEQ ID NO: 673284 - RNA, 22 nt, Homo sapiens
uaguugcuucuuuccuuuccau

SEQ ID NO: 673285 - RNA, 20 nt, Homo sapiens
uaguuuaccucauccaugca

SEQ ID NO: 673286 - RNA, 22 nt, Homo sapiens
uaguuuaccucauccaugcacu

SEQ ID NO: 673287 - RNA, 15 nt, Homo sapiens
uaguuuaggcuggaa

SEQ ID NO: 673288 - RNA, 16 nt, Homo sapiens
uaguuucagacuugga

SEQ ID NO: 673289 - RNA, 18 nt, Homo sapiens
uaguuucuugaggccaaa

SEQ ID NO: 673290 - RNA, 13 nt, Homo sapiens
uaguuugcacuau

SEQ ID NO: 673291 - RNA, 13 nt, Homo sapiens
uaguuugugcugu

SEQ ID NO: 673292 - RNA, 21 nt, Homo sapiens
uaguuuucuccuuuuacuuca

SEQ ID NO: 673293 - RNA, 23 nt, Homo sapiens
uaguuuugauccuaaaucugccu

SEQ ID NO: 673294 - RNA, 22 nt, Homo sapiens
uaguuuuuugcuucucuuuccc

SEQ ID NO: 673295 - RNA, 14 nt, Homo sapiens
uauaaaaaguggag

SEQ ID NO: 673296 - RNA, 18 nt, Homo sapiens
uauaaaaaugagugcuua

SEQ ID NO: 673297 - RNA, 13 nt, Homo sapiens
uauaaaacaguca

SEQ ID NO: 673298 - RNA, 14 nt, Homo sapiens
uauaaaacagucau

SEQ ID NO: 673299 - RNA, 21 nt, Homo sapiens
uauaaaagaauaaaauugcac

SEQ ID NO: 673300 - RNA, 16 nt, Homo sapiens
uauaaaagacugacca

SEQ ID NO: 673301 - RNA, 19 nt, Homo sapiens
uauaaaaucuuagaaagaa

SEQ ID NO: 673302 - RNA, 20 nt, Homo sapiens
uauaaacaggagacagguca

SEQ ID NO: 673303 - RNA, 19 nt, Homo sapiens
uauaaaccuaaaaaagaua

SEQ ID NO: 673304 - RNA, 12 nt, Homo sapiens
uauaaaccugga

SEQ ID NO: 673305 - RNA, 15 nt, Homo sapiens
uauaaagauacuaaa

SEQ ID NO: 673306 - RNA, 16 nt, Homo sapiens
uauaaagauuguacuu

SEQ ID NO: 673307 - RNA, 21 nt, Homo sapiens
uauaaauacagcauacuucaa

SEQ ID NO: 673308 - RNA, 22 nt, Homo sapiens
uauaaauacagcauacuucaaa

SEQ ID NO: 673309 - RNA, 19 nt, Homo sapiens
uauaaauacguauuacaaa

SEQ ID NO: 673310 - RNA, 16 nt, Homo sapiens
uauaaaucaaugucac

SEQ ID NO: 673311 - RNA, 14 nt, Homo sapiens
uauaaaugagcaaa

SEQ ID NO: 673312 - RNA, 18 nt, Homo sapiens
uauaaaugagcaaauauc

SEQ ID NO: 673313 - RNA, 21 nt, Homo sapiens
uauaaaugcggauacagguua

SEQ ID NO: 673314 - RNA, 14 nt, Homo sapiens
uauaaauguaaaaa

SEQ ID NO: 673315 - RNA, 17 nt, Homo sapiens
uauaaauguaccagaga

SEQ ID NO: 673316 - RNA, 13 nt, Homo sapiens
uauaaaugugauu

SEQ ID NO: 673317 - RNA, 14 nt, Homo sapiens
uauaaauuauaucc

SEQ ID NO: 673318 - RNA, 21 nt, Homo sapiens
uauaaauuuuauaacagaauu

SEQ ID NO: 673319 - RNA, 23 nt, Homo sapiens
uauaaauuuucccaaaacugaua

SEQ ID NO: 673320 - RNA, 20 nt, Homo sapiens
uauaacaauucaguaacaaa

SEQ ID NO: 673321 - RNA, 11 nt, Homo sapiens
uauaacagugu

SEQ ID NO: 673322 - RNA, 15 nt, Homo sapiens
uauaacaguuauauu

SEQ ID NO: 673323 - RNA, 22 nt, Homo sapiens
uauaacaugucuuucagcauua

SEQ ID NO: 673324 - RNA, 20 nt, Homo sapiens
uauaaccaagugugcucuuu

SEQ ID NO: 673325 - RNA, 17 nt, Homo sapiens
uauaaccauuacauguu

SEQ ID NO: 673326 - RNA, 13 nt, Homo sapiens
uauaacccagaaa

SEQ ID NO: 673327 - RNA, 13 nt, Homo sapiens
uauaaccuggcaa

SEQ ID NO: 673328 - RNA, 14 nt, Homo sapiens
uauaacuaacaugu

SEQ ID NO: 673329 - RNA, 18 nt, Homo sapiens
uauaacucugcacuacuc

SEQ ID NO: 673330 - RNA, 16 nt, Homo sapiens
uauaagaaagaucaaa

SEQ ID NO: 673331 - RNA, 11 nt, Homo sapiens
uauaagacauu

SEQ ID NO: 673332 - RNA, 13 nt, Homo sapiens
uauaagacuacua

SEQ ID NO: 673333 - RNA, 16 nt, Homo sapiens
uauaagagagaguuaa

SEQ ID NO: 673334 - RNA, 13 nt, Homo sapiens
uauaagaugacaa

SEQ ID NO: 673335 - RNA, 14 nt, Homo sapiens
uauaagauuccaaa

SEQ ID NO: 673336 - RNA, 17 nt, Homo sapiens
uauaagcagaagcacau

SEQ ID NO: 673337 - RNA, 20 nt, Homo sapiens
uauaagcagauuuaacaauu

SEQ ID NO: 673338 - RNA, 16 nt, Homo sapiens
uauaagcaucugccau

SEQ ID NO: 673339 - RNA, 23 nt, Homo sapiens
uauaagugaagugauacuaucca

SEQ ID NO: 673340 - RNA, 17 nt, Homo sapiens
uauaaguguuugucaua

SEQ ID NO: 673341 - RNA, 19 nt, Homo sapiens
uauaaguuguaccaaaaca

SEQ ID NO: 673342 - RNA, 14 nt, Homo sapiens
uauaauaacugaac

SEQ ID NO: 673343 - RNA, 20 nt, Homo sapiens
uauaauacaguuuucuauuc

SEQ ID NO: 673344 - RNA, 13 nt, Homo sapiens
uauaauacuguau

SEQ ID NO: 673345 - RNA, 14 nt, Homo sapiens
uauaauauuuacug

SEQ ID NO: 673346 - RNA, 21 nt, Homo sapiens
uauaaucaucaaguaauacaa

SEQ ID NO: 673347 - RNA, 16 nt, Homo sapiens
uauaaucuaauuacau

SEQ ID NO: 673348 - RNA, 16 nt, Homo sapiens
uauaaucucuucuuau

SEQ ID NO: 673349 - RNA, 22 nt, Homo sapiens
uauaaucuuccauacuucuuca

SEQ ID NO: 673350 - RNA, 20 nt, Homo sapiens
uauaaucuuucaaaccagcu

SEQ ID NO: 673351 - RNA, 16 nt, Homo sapiens
uauaaugcuugcaccu

SEQ ID NO: 673352 - RNA, 12 nt, Homo sapiens
uauaauguauuu

SEQ ID NO: 673353 - RNA, 15 nt, Homo sapiens
uauaauguugccagc

SEQ ID NO: 673354 - RNA, 15 nt, Homo sapiens
uaucaauaucuaaua

SEQ ID NO: 673355 - RNA, 23 nt, Homo sapiens
ucagguuugggguucguggaaag

SEQ ID NO: 673356 - RNA, 18 nt, Homo sapiens
ucaguaaacaaugaauag

SEQ ID NO: 673357 - RNA, 20 nt, Homo sapiens
ucaguaaagaacguggucag

SEQ ID NO: 673358 - RNA, 18 nt, Homo sapiens
ucaguaaauaacuggaaa

SEQ ID NO: 673359 - RNA, 18 nt, Homo sapiens
ucaguaaauaccuugaaa

SEQ ID NO: 673360 - RNA, 24 nt, Homo sapiens
ucaguaaauuguuuuuacugauga

SEQ ID NO: 673361 - RNA, 14 nt, Homo sapiens
ucaguaagucucau

SEQ ID NO: 673362 - RNA, 15 nt, Homo sapiens
ucaguaauaacucua

SEQ ID NO: 673363 - RNA, 22 nt, Homo sapiens
uaaauguguuuccguucacaua

SEQ ID NO: 673364 - RNA, 15 nt, Homo sapiens
uaaauguuaccucua

SEQ ID NO: 673365 - RNA, 19 nt, Homo sapiens
uaaauguucauugcacauc

SEQ ID NO: 673366 - RNA, 17 nt, Homo sapiens
uaaauguuuuacucaga

SEQ ID NO: 673367 - RNA, 13 nt, Homo sapiens
uaaauuaagcaug

SEQ ID NO: 673368 - RNA, 13 nt, Homo sapiens
uaaauuaccuugc

SEQ ID NO: 673369 - RNA, 19 nt, Homo sapiens
uaaauuacuuuuucauucu

SEQ ID NO: 673370 - RNA, 14 nt, Homo sapiens
uaaauuauugcugu

SEQ ID NO: 673371 - RNA, 16 nt, Homo sapiens
uaaauuauuuacugca

SEQ ID NO: 673372 - RNA, 22 nt, Homo sapiens
uaaauuauuuuaaaaacuaaaa

SEQ ID NO: 673373 - RNA, 21 nt, Homo sapiens
uaaauucacagcgcuaugcaa

SEQ ID NO: 673374 - RNA, 12 nt, Homo sapiens
uaaauucaucag

SEQ ID NO: 673375 - RNA, 14 nt, Homo sapiens
uaaauucaucuaga

SEQ ID NO: 673376 - RNA, 16 nt, Homo sapiens
uaaauuccacagauua

SEQ ID NO: 673377 - RNA, 20 nt, Homo sapiens
uaaauuccacagauuaucaa

SEQ ID NO: 673378 - RNA, 18 nt, Homo sapiens
uaaauuccagaggacucu

SEQ ID NO: 673379 - RNA, 20 nt, Homo sapiens
uaaauucccaacuucucuug

SEQ ID NO: 673380 - RNA, 18 nt, Homo sapiens
uaaauucccuggggaaaa

SEQ ID NO: 673381 - RNA, 17 nt, Homo sapiens
uaaauucuaagccauau

SEQ ID NO: 673382 - RNA, 23 nt, Homo sapiens
uaaauucuauaggaacauaugaa

SEQ ID NO: 673383 - RNA, 22 nt, Homo sapiens
uaaauucugggugaaacccuuu

SEQ ID NO: 673384 - RNA, 18 nt, Homo sapiens
uaaauugcugcgugacau

SEQ ID NO: 673385 - RNA, 22 nt, Homo sapiens
uaaauugguauuaacuaugauc

SEQ ID NO: 673386 - RNA, 20 nt, Homo sapiens
uaaauuguuucauaucuggu

SEQ ID NO: 673387 - RNA, 16 nt, Homo sapiens
uaaauuugaaucugag

SEQ ID NO: 673388 - RNA, 14 nt, Homo sapiens
uaaauuugcuagca

SEQ ID NO: 673389 - RNA, 17 nt, Homo sapiens
uaaauuugguucuaggc

SEQ ID NO: 673390 - RNA, 23 nt, Homo sapiens
uaaauuuguuauuguguauuaug

SEQ ID NO: 673391 - RNA, 17 nt, Homo sapiens
uaaauuuuacccuuuag

SEQ ID NO: 673392 - RNA, 21 nt, Homo sapiens
uaaauuuuauaugcacaguaa

SEQ ID NO: 673393 - RNA, 17 nt, Homo sapiens
uaaauuuuucauagaag

SEQ ID NO: 673394 - RNA, 17 nt, Homo sapiens
uaaauuuuuuguugaca

SEQ ID NO: 673395 - RNA, 22 nt, Homo sapiens
uaaauuuuuuugauaauagaga

SEQ ID NO: 673396 - RNA, 18 nt, Homo sapiens
uaacaaaacaagugcaag

SEQ ID NO: 673397 - RNA, 19 nt, Homo sapiens
uaacaaaacaagugcaaga

SEQ ID NO: 673398 - RNA, 16 nt, Homo sapiens
uaacaaaagcaauugu

SEQ ID NO: 673399 - RNA, 13 nt, Homo sapiens
uaacaaacaucac

SEQ ID NO: 673400 - RNA, 22 nt, Homo sapiens
uaacaaacaucacucugcugcu

SEQ ID NO: 673401 - RNA, 15 nt, Homo sapiens
uaacaaagaacaagc

SEQ ID NO: 673402 - RNA, 19 nt, Homo sapiens
uaacaaagcacauaacugg

SEQ ID NO: 673403 - RNA, 17 nt, Homo sapiens
uaacaagaccucagugc

SEQ ID NO: 673404 - RNA, 20 nt, Homo sapiens
uaacaagaguuuuaacacuu

SEQ ID NO: 673405 - RNA, 17 nt, Homo sapiens
uaacaaucacaaaggaa

SEQ ID NO: 673406 - RNA, 13 nt, Homo sapiens
uaacaauugugua

SEQ ID NO: 673407 - RNA, 18 nt, Homo sapiens
uaacacaagccacagaag

SEQ ID NO: 673408 - RNA, 23 nt, Homo sapiens
uaacacauuaucgggagcagugu

SEQ ID NO: 673409 - RNA, 12 nt, Homo sapiens
uaacacauucuu

SEQ ID NO: 673410 - RNA, 20 nt, Homo sapiens
uaacaccaucgaucaugaug

SEQ ID NO: 673411 - RNA, 14 nt, Homo sapiens
uaacaccaugauua

SEQ ID NO: 673412 - RNA, 18 nt, Homo sapiens
uaacacuguuggcacuua

SEQ ID NO: 673413 - RNA, 22 nt, Homo sapiens
uaacagaaagccugggugacau

SEQ ID NO: 673414 - RNA, 23 nt, Homo sapiens
uaacagaaagccugggugacauu

SEQ ID NO: 673415 - RNA, 14 nt, Homo sapiens
uaacagaaauguac

SEQ ID NO: 673416 - RNA, 16 nt, Homo sapiens
uaacagaaauuguaua

SEQ ID NO: 673417 - RNA, 15 nt, Homo sapiens
uaacagaacagucac

SEQ ID NO: 673418 - RNA, 15 nt, Homo sapiens
uaacagaccacugua

SEQ ID NO: 673419 - RNA, 23 nt, Homo sapiens
uaacagaccacuguauguuuacu

SEQ ID NO: 673420 - RNA, 17 nt, Homo sapiens
uaacagauccuuucaaa

SEQ ID NO: 673421 - RNA, 18 nt, Homo sapiens
uaacagaugggcuggaag

SEQ ID NO: 673422 - RNA, 15 nt, Homo sapiens
uaacagccucuugcc

SEQ ID NO: 673423 - RNA, 18 nt, Homo sapiens
uaacaggauauuuaauga

SEQ ID NO: 673424 - RNA, 14 nt, Homo sapiens
uaacaggcauuugu

SEQ ID NO: 673425 - RNA, 23 nt, Homo sapiens
uaacagggucucuagugcuguga

SEQ ID NO: 673426 - RNA, 22 nt, Homo sapiens
uaacagucaaauaucauuuacu

SEQ ID NO: 673427 - RNA, 15 nt, Homo sapiens
uaacagucauuuaaa

SEQ ID NO: 673428 - RNA, 12 nt, Homo sapiens
uaacaguugugu

SEQ ID NO: 673429 - RNA, 16 nt, Homo sapiens
uaacaguugugucaua

SEQ ID NO: 673430 - RNA, 17 nt, Homo sapiens
uaacaguuuuccaugaa

SEQ ID NO: 673431 - RNA, 13 nt, Homo sapiens
uaacauaacaaca

SEQ ID NO: 673432 - RNA, 15 nt, Homo sapiens
uaacauaacacuaaa

SEQ ID NO: 673433 - RNA, 21 nt, Homo sapiens
uaacauauuaugaaaguagua

SEQ ID NO: 673434 - RNA, 15 nt, Homo sapiens
uaacaucacugucuu

SEQ ID NO: 673435 - RNA, 16 nt, Homo sapiens
uaacaugaacucuuga

SEQ ID NO: 673436 - RNA, 15 nt, Homo sapiens
uaacaugcaaagauc

SEQ ID NO: 673437 - RNA, 13 nt, Homo sapiens
uaacauguuauca

SEQ ID NO: 673438 - RNA, 22 nt, Homo sapiens
uaacauuaucuaguucauugaa

SEQ ID NO: 673439 - RNA, 14 nt, Homo sapiens
uaacauucaguucc

SEQ ID NO: 673440 - RNA, 15 nt, Homo sapiens
uaacauucccacugc

SEQ ID NO: 673441 - RNA, 14 nt, Homo sapiens
uaacauugcacuuu

SEQ ID NO: 673442 - RNA, 21 nt, Homo sapiens
uaacauuuaaauuccacagau

SEQ ID NO: 673443 - RNA, 11 nt, Homo sapiens
uaacauuugcc

SEQ ID NO: 673444 - RNA, 20 nt, Homo sapiens
uaacauuuuauacaauuucc

SEQ ID NO: 673445 - RNA, 20 nt, Homo sapiens
uaaccaagagauaacuguaa

SEQ ID NO: 673446 - RNA, 18 nt, Homo sapiens
uaaccaaggaggggccag

SEQ ID NO: 673447 - RNA, 17 nt, Homo sapiens
uaaccacuuaaggaccu

SEQ ID NO: 673448 - RNA, 22 nt, Homo sapiens
uaaccagauggaacacuggaac

SEQ ID NO: 673449 - RNA, 18 nt, Homo sapiens
uaaccagcagaaaugccu

SEQ ID NO: 673450 - RNA, 19 nt, Homo sapiens
uaaccauccccaacuccau

SEQ ID NO: 673451 - RNA, 18 nt, Homo sapiens
uaacccaagacaugacau

SEQ ID NO: 673452 - RNA, 14 nt, Homo sapiens
uaacccaaugccug

SEQ ID NO: 673453 - RNA, 21 nt, Homo sapiens
uaacccccaguucaagacuua

SEQ ID NO: 673454 - RNA, 15 nt, Homo sapiens
uaacccccugcccac

SEQ ID NO: 673455 - RNA, 23 nt, Homo sapiens
uaaccccuuccagaucacugcca

SEQ ID NO: 673456 - RNA, 18 nt, Homo sapiens
uaacccgauuauugugua

SEQ ID NO: 673457 - RNA, 21 nt, Homo sapiens
uaacccucacaagcaugaagu

SEQ ID NO: 673458 - RNA, 13 nt, Homo sapiens
uaacccucucuug

SEQ ID NO: 673459 - RNA, 16 nt, Homo sapiens
uaaccgcacaugcaca

SEQ ID NO: 673460 - RNA, 16 nt, Homo sapiens
uaaccuagaaguauuu

SEQ ID NO: 673461 - RNA, 21 nt, Homo sapiens
uaaccucucugaacugcaaca

SEQ ID NO: 673462 - RNA, 14 nt, Homo sapiens
uaaccucugcacua

SEQ ID NO: 673463 - RNA, 22 nt, Homo sapiens
uaaccugcaaaaucuguucuaa

SEQ ID NO: 673464 - RNA, 17 nt, Homo sapiens
uaaccuggaccuggaac

SEQ ID NO: 673465 - RNA, 12 nt, Homo sapiens
uaaccuggugcu

SEQ ID NO: 673466 - RNA, 23 nt, Homo sapiens
ugcaggaagugucuagaggaaua

SEQ ID NO: 673467 - RNA, 19 nt, Homo sapiens
ugcaggaccucgugccacc

SEQ ID NO: 673468 - RNA, 20 nt, Homo sapiens
ugcaggccaggccagcugcc

SEQ ID NO: 673469 - RNA, 22 nt, Homo sapiens
ugcaggcccuuugaagccucag

SEQ ID NO: 673470 - RNA, 16 nt, Homo sapiens
ugcaggcgauggggca

SEQ ID NO: 673471 - RNA, 22 nt, Homo sapiens
ugcagggaagccccacuugaag

SEQ ID NO: 673472 - RNA, 13 nt, Homo sapiens
ugcagggacucca

SEQ ID NO: 673473 - RNA, 17 nt, Homo sapiens
ugcagggauauugccuu

SEQ ID NO: 673474 - RNA, 19 nt, Homo sapiens
ugcagggcacagaugacca

SEQ ID NO: 673475 - RNA, 15 nt, Homo sapiens
ugcaggggccagggg

SEQ ID NO: 673476 - RNA, 21 nt, Homo sapiens
ugcaggggugacggcccucau

SEQ ID NO: 673477 - RNA, 17 nt, Homo sapiens
ugcagguacuuccucag

SEQ ID NO: 673478 - RNA, 17 nt, Homo sapiens
ugcagguucauggauua

SEQ ID NO: 673479 - RNA, 21 nt, Homo sapiens
ugcagguuuguaaugcaaaag

SEQ ID NO: 673480 - RNA, 22 nt, Homo sapiens
ugcaguaagccaaggucaugcc

SEQ ID NO: 673481 - RNA, 19 nt, Homo sapiens
ugcaguacaggacauauau

SEQ ID NO: 673482 - RNA, 21 nt, Homo sapiens
ugcaguacuuaauguuuguaa

SEQ ID NO: 673483 - RNA, 12 nt, Homo sapiens
ugcaguagggga

SEQ ID NO: 673484 - RNA, 15 nt, Homo sapiens
ugcagucacauugau

SEQ ID NO: 673485 - RNA, 12 nt, Homo sapiens
ugcagucacugg

SEQ ID NO: 673486 - RNA, 16 nt, Homo sapiens
ugcagucacugugauu

SEQ ID NO: 673487 - RNA, 15 nt, Homo sapiens
ugcagucaucuacuu

SEQ ID NO: 673488 - RNA, 16 nt, Homo sapiens
ugcagucucccagaug

SEQ ID NO: 673489 - RNA, 16 nt, Homo sapiens
ugcagugagcccagau

SEQ ID NO: 673490 - RNA, 15 nt, Homo sapiens
ugcagugagcugugu

SEQ ID NO: 673491 - RNA, 14 nt, Homo sapiens
ugcagugaugcaau

SEQ ID NO: 673492 - RNA, 15 nt, Homo sapiens
ugcagugcucauuca

SEQ ID NO: 673493 - RNA, 13 nt, Homo sapiens
ugcagugcuucca

SEQ ID NO: 673494 - RNA, 21 nt, Homo sapiens
ugcaguggcgugaucuuggcu

SEQ ID NO: 673495 - RNA, 19 nt, Homo sapiens
ugcaguggcuccgaucucu

SEQ ID NO: 673496 - RNA, 19 nt, Homo sapiens
ugcaguggcugugccacca

SEQ ID NO: 673497 - RNA, 21 nt, Homo sapiens
ugcaguguucuacaccuugcu

SEQ ID NO: 673498 - RNA, 20 nt, Homo sapiens
ugcaguuccccgagaacuuu

SEQ ID NO: 673499 - RNA, 14 nt, Homo sapiens
ugcaguucuacuca

SEQ ID NO: 673500 - RNA, 19 nt, Homo sapiens
ugcaguuucaaguaccaaa

SEQ ID NO: 673501 - RNA, 20 nt, Homo sapiens
ugcaguuucuuuucacauua

SEQ ID NO: 673502 - RNA, 21 nt, Homo sapiens
ugcauaaacuguuguaugccu

SEQ ID NO: 673503 - RNA, 17 nt, Homo sapiens
ugcauaacgucugccuu

SEQ ID NO: 673504 - RNA, 22 nt, Homo sapiens
ugcauaagugaaaaucuuacaa

SEQ ID NO: 673505 - RNA, 20 nt, Homo sapiens
ugcauaaguucuuaauguca

SEQ ID NO: 673506 - RNA, 20 nt, Homo sapiens
ugcauaauacuauucuuuaa

SEQ ID NO: 673507 - RNA, 20 nt, Homo sapiens
ugcauaauucuugaugguaa

SEQ ID NO: 673508 - RNA, 20 nt, Homo sapiens
ugcauacuuucccucaucca

SEQ ID NO: 673509 - RNA, 13 nt, Homo sapiens
ugcauagcucuau

SEQ ID NO: 673510 - RNA, 15 nt, Homo sapiens
ugcauagcuuucaca

SEQ ID NO: 673511 - RNA, 12 nt, Homo sapiens
ugcauaucauua

SEQ ID NO: 673512 - RNA, 13 nt, Homo sapiens
ugcauaucugccu

SEQ ID NO: 673513 - RNA, 22 nt, Homo sapiens
ugcauauuauaaaggauaaaga

SEQ ID NO: 673514 - RNA, 19 nt, Homo sapiens
ugcauauuuguuacuuuac

SEQ ID NO: 673515 - RNA, 21 nt, Homo sapiens
ugcaucaagggcuuuaucaaa

SEQ ID NO: 673516 - RNA, 22 nt, Homo sapiens
ugcaucacguaccccacugggc

SEQ ID NO: 673517 - RNA, 22 nt, Homo sapiens
ugcaucacuuaacggaccaaag

SEQ ID NO: 673518 - RNA, 15 nt, Homo sapiens
ugcauccaauuuauu

SEQ ID NO: 673519 - RNA, 19 nt, Homo sapiens
ugcauccagccuccugcua

SEQ ID NO: 673520 - RNA, 21 nt, Homo sapiens
ugcauccauuugaacacauua

SEQ ID NO: 673521 - RNA, 20 nt, Homo sapiens
ugcaucccugaaacaucuca

SEQ ID NO: 673522 - RNA, 14 nt, Homo sapiens
ugcaucuacuugcc

SEQ ID NO: 673523 - RNA, 17 nt, Homo sapiens
ugcaucucaaaauuauu

SEQ ID NO: 673524 - RNA, 22 nt, Homo sapiens
ugcaucuccccucagauuccac

SEQ ID NO: 673525 - RNA, 15 nt, Homo sapiens
ugcaucugaccagca

SEQ ID NO: 673526 - RNA, 15 nt, Homo sapiens
ugcaucugucagcca

SEQ ID NO: 673527 - RNA, 13 nt, Homo sapiens
ugcaugaaacaug

SEQ ID NO: 673528 - RNA, 20 nt, Homo sapiens
ugcaugaaacauguucucaa

SEQ ID NO: 673529 - RNA, 21 nt, Homo sapiens
ugcaugacaaacacacaucca

SEQ ID NO: 673530 - RNA, 19 nt, Homo sapiens
ugcaugccaggcugggcac

SEQ ID NO: 673531 - RNA, 11 nt, Homo sapiens
ugcauggauuu

SEQ ID NO: 673532 - RNA, 22 nt, Homo sapiens
ugcauggcagggccucaucuca

SEQ ID NO: 673533 - RNA, 15 nt, Homo sapiens
ugcauguaagccaag

SEQ ID NO: 673534 - RNA, 24 nt, Homo sapiens
ugcauguagucacuuuauaaguca

SEQ ID NO: 673535 - RNA, 14 nt, Homo sapiens
ugcaugucuacuca

SEQ ID NO: 673536 - RNA, 12 nt, Homo sapiens
ugcaugugaaga

SEQ ID NO: 673537 - RNA, 15 nt, Homo sapiens
ugcauguggcuuuuu

SEQ ID NO: 673538 - RNA, 16 nt, Homo sapiens
ugcaugugugugcuca

SEQ ID NO: 673539 - RNA, 17 nt, Homo sapiens
ugcaugugugugcucag

SEQ ID NO: 673540 - RNA, 14 nt, Homo sapiens
uggccacagacuga

SEQ ID NO: 673541 - RNA, 21 nt, Homo sapiens
uggccacccgcccacagccag

SEQ ID NO: 673542 - RNA, 21 nt, Homo sapiens
uggccacgagguuaaagaagc

SEQ ID NO: 673543 - RNA, 16 nt, Homo sapiens
uggccacuucauucca

SEQ ID NO: 673544 - RNA, 22 nt, Homo sapiens
uggccagaagggggccaugagg

SEQ ID NO: 673545 - RNA, 14 nt, Homo sapiens
uggccagacaagaa

SEQ ID NO: 673546 - RNA, 15 nt, Homo sapiens
uggccagcacucuga

SEQ ID NO: 673547 - RNA, 16 nt, Homo sapiens
uggccagccagugcca

SEQ ID NO: 673548 - RNA, 18 nt, Homo sapiens
uggccagccagugccauu

SEQ ID NO: 673549 - RNA, 12 nt, Homo sapiens
uggccagccaua

SEQ ID NO: 673550 - RNA, 22 nt, Homo sapiens
uggccaggagguuggugacuga

SEQ ID NO: 673551 - RNA, 21 nt, Homo sapiens
uggccaggccucuuggcaguc

SEQ ID NO: 673552 - RNA, 18 nt, Homo sapiens
uggccagugugaucccaa

SEQ ID NO: 673553 - RNA, 11 nt, Homo sapiens
uggccaugaau

SEQ ID NO: 673554 - RNA, 13 nt, Homo sapiens
uggccauguucuc

SEQ ID NO: 673555 - RNA, 22 nt, Homo sapiens
uggcccaaucucugccauauca

SEQ ID NO: 673556 - RNA, 15 nt, Homo sapiens
uggcccagcuuuuag

SEQ ID NO: 673557 - RNA, 23 nt, Homo sapiens
uggcccagcuuuuagaaaaugca

SEQ ID NO: 673558 - RNA, 19 nt, Homo sapiens
uggcccagggaagccaaaa

SEQ ID NO: 673559 - RNA, 16 nt, Homo sapiens
uggcccauaaugugaa

SEQ ID NO: 673560 - RNA, 14 nt, Homo sapiens
uggcccauucuuga

SEQ ID NO: 673561 - RNA, 16 nt, Homo sapiens
uggccccacuuugaag

SEQ ID NO: 673562 - RNA, 14 nt, Homo sapiens
uggccccaugucuc

SEQ ID NO: 673563 - RNA, 23 nt, Homo sapiens
uggcccccgagcugggggccaug

SEQ ID NO: 673564 - RNA, 20 nt, Homo sapiens
uggcccccucauucagagac

SEQ ID NO: 673565 - RNA, 17 nt, Homo sapiens
uggccccuccuugcaac

SEQ ID NO: 673566 - RNA, 23 nt, Homo sapiens
uggcccucccucccuagcccuuc

SEQ ID NO: 673567 - RNA, 22 nt, Homo sapiens
uggcccuuucaacaaugucuuu

SEQ ID NO: 673568 - RNA, 22 nt, Homo sapiens
uggccgcuccucccucagaaaa

SEQ ID NO: 673569 - RNA, 14 nt, Homo sapiens
uggccggcuggaaa

SEQ ID NO: 673570 - RNA, 20 nt, Homo sapiens
uggccgggucccugagcucc

SEQ ID NO: 673571 - RNA, 19 nt, Homo sapiens
uggccuaaaaaugcaacuu

SEQ ID NO: 673572 - RNA, 13 nt, Homo sapiens
uggccuacaguca

SEQ ID NO: 673573 - RNA, 16 nt, Homo sapiens
uggccuagagcacucu

SEQ ID NO: 673574 - RNA, 20 nt, Homo sapiens
uggccucagcugaaugccuc

SEQ ID NO: 673575 - RNA, 14 nt, Homo sapiens
uggccuccaugugg

SEQ ID NO: 673576 - RNA, 15 nt, Homo sapiens
uggccucccacagac

SEQ ID NO: 673577 - RNA, 20 nt, Homo sapiens
uggccucccugcugugccau

SEQ ID NO: 673578 - RNA, 16 nt, Homo sapiens
uggccuccguccuguc

SEQ ID NO: 673579 - RNA, 15 nt, Homo sapiens
uggccuccuaugccu

SEQ ID NO: 673580 - RNA, 12 nt, Homo sapiens
uggccucugaua

SEQ ID NO: 673581 - RNA, 14 nt, Homo sapiens
uggccucugauaca

SEQ ID NO: 673582 - RNA, 23 nt, Homo sapiens
uggccucugcaaaggaaauacca

SEQ ID NO: 673583 - RNA, 16 nt, Homo sapiens
uggccucuggcucuca

SEQ ID NO: 673584 - RNA, 14 nt, Homo sapiens
uggccucugugauu

SEQ ID NO: 673585 - RNA, 16 nt, Homo sapiens
uggccugcgcuagcuu

SEQ ID NO: 673586 - RNA, 15 nt, Homo sapiens
uggccugcugggaac

SEQ ID NO: 673587 - RNA, 19 nt, Homo sapiens
uggccugcugugauuccac

SEQ ID NO: 673588 - RNA, 22 nt, Homo sapiens
uggccuggcaguugaacagagg

SEQ ID NO: 673589 - RNA, 15 nt, Homo sapiens
uggccuggcaucugu

SEQ ID NO: 673590 - RNA, 21 nt, Homo sapiens
uggccuggggaagcugugaaa

SEQ ID NO: 673591 - RNA, 14 nt, Homo sapiens
uggccuucugggaa

SEQ ID NO: 673592 - RNA, 15 nt, Homo sapiens
uggccuucugggaac

SEQ ID NO: 673593 - RNA, 18 nt, Homo sapiens
uggccuugaaaccaccuu

SEQ ID NO: 673594 - RNA, 14 nt, Homo sapiens
uggccuuucacuuu

SEQ ID NO: 673595 - RNA, 21 nt, Homo sapiens
uggcgaggccucucucaggag

SEQ ID NO: 673596 - RNA, 16 nt, Homo sapiens
uggcgcaucauaugca

SEQ ID NO: 673597 - RNA, 19 nt, Homo sapiens
uggcgcuuagagaggacaa

SEQ ID NO: 673598 - RNA, 21 nt, Homo sapiens
ucaucuauuuuuggcagucug

SEQ ID NO: 673599 - RNA, 20 nt, Homo sapiens
ucaucucauuccaacuuccc

SEQ ID NO: 673600 - RNA, 19 nt, Homo sapiens
ucaucuccuuuauugcagu

SEQ ID NO: 673601 - RNA, 17 nt, Homo sapiens
ucaucuccuuuugcgcu

SEQ ID NO: 673602 - RNA, 19 nt, Homo sapiens
ucaucugggacaaaacugg

SEQ ID NO: 673603 - RNA, 23 nt, Homo sapiens
ucaucuguagauacuagcuaucu

SEQ ID NO: 673604 - RNA, 17 nt, Homo sapiens
ucaucuguggagcugcc

SEQ ID NO: 673605 - RNA, 18 nt, Homo sapiens
ucaucuguggagcugcca

SEQ ID NO: 673606 - RNA, 20 nt, Homo sapiens
ucaucuguggagcugccaca

SEQ ID NO: 673607 - RNA, 21 nt, Homo sapiens
ucaucuuccuguguccugaaa

SEQ ID NO: 673608 - RNA, 17 nt, Homo sapiens
ucaucuugaaguuuuuc

SEQ ID NO: 673609 - RNA, 12 nt, Homo sapiens
ucaucuugccac

SEQ ID NO: 673610 - RNA, 16 nt, Homo sapiens
ucaucuuguucuuccc

SEQ ID NO: 673611 - RNA, 23 nt, Homo sapiens
ucaugaaaaccugaagaguucac

SEQ ID NO: 673612 - RNA, 14 nt, Homo sapiens
ucaugaaacugucc

SEQ ID NO: 673613 - RNA, 21 nt, Homo sapiens
ucaugaaacuguccaccaaga

SEQ ID NO: 673614 - RNA, 13 nt, Homo sapiens
ucaugaaaguggg

SEQ ID NO: 673615 - RNA, 10 nt, Homo sapiens
ucaugaaauu

SEQ ID NO: 673616 - RNA, 13 nt, Homo sapiens
ucaugaacagcuc

SEQ ID NO: 673617 - RNA, 21 nt, Homo sapiens
ucaugaagaauguuucuggaa

SEQ ID NO: 673618 - RNA, 19 nt, Homo sapiens
ucaugaauuuauugcacau

SEQ ID NO: 673619 - RNA, 12 nt, Homo sapiens
ucaugacacugu

SEQ ID NO: 673620 - RNA, 13 nt, Homo sapiens
ucaugacauauga

SEQ ID NO: 673621 - RNA, 17 nt, Homo sapiens
ucaugauagacuuguua

SEQ ID NO: 673622 - RNA, 13 nt, Homo sapiens
ucaugauccuugc

SEQ ID NO: 673623 - RNA, 22 nt, Homo sapiens
ucaugaugcuagccagcaaaga

SEQ ID NO: 673624 - RNA, 15 nt, Homo sapiens
ucaugauuggcuuaa

SEQ ID NO: 673625 - RNA, 16 nt, Homo sapiens
ucaugauuucauuuca

SEQ ID NO: 673626 - RNA, 23 nt, Homo sapiens
ucaugcagagggugggguacugg

SEQ ID NO: 673627 - RNA, 13 nt, Homo sapiens
ucaugcauuugca

SEQ ID NO: 673628 - RNA, 15 nt, Homo sapiens
ucaugccacugcacu

SEQ ID NO: 673629 - RNA, 18 nt, Homo sapiens
ucaugccacugcacucua

SEQ ID NO: 673630 - RNA, 15 nt, Homo sapiens
ucaugcucauguaua

SEQ ID NO: 673631 - RNA, 18 nt, Homo sapiens
ucaugcuccaagacuuua

SEQ ID NO: 673632 - RNA, 23 nt, Homo sapiens
ucaugcuguugcugcuacugucu

SEQ ID NO: 673633 - RNA, 18 nt, Homo sapiens
ucaugcuugacauaccua

SEQ ID NO: 673634 - RNA, 16 nt, Homo sapiens
ucaugcuuuguaccaa

SEQ ID NO: 673635 - RNA, 18 nt, Homo sapiens
ucaugcuuuugcuugcaa

SEQ ID NO: 673636 - RNA, 15 nt, Homo sapiens
ucauggacacuuuga

SEQ ID NO: 673637 - RNA, 16 nt, Homo sapiens
ucauggacacuuugaa

SEQ ID NO: 673638 - RNA, 13 nt, Homo sapiens
ucauggagaccuc

SEQ ID NO: 673639 - RNA, 15 nt, Homo sapiens
ucauggagaccucau

SEQ ID NO: 673640 - RNA, 18 nt, Homo sapiens
ucauggauaaauugcaca

SEQ ID NO: 673641 - RNA, 15 nt, Homo sapiens
ucauggccaccucca

SEQ ID NO: 673642 - RNA, 22 nt, Homo sapiens
ucauggccugagaugcagguga

SEQ ID NO: 673643 - RNA, 23 nt, Homo sapiens
ucauggguccagccuaaaaacca

SEQ ID NO: 673644 - RNA, 19 nt, Homo sapiens
ucaugguacauuuaucacu

SEQ ID NO: 673645 - RNA, 17 nt, Homo sapiens
ucaugguagagaaucuc

SEQ ID NO: 673646 - RNA, 23 nt, Homo sapiens
ucauggugguggacaccuguaau

SEQ ID NO: 673647 - RNA, 19 nt, Homo sapiens
ucauguaaggcuuaacaca

SEQ ID NO: 673648 - RNA, 21 nt, Homo sapiens
ucauguaauuugcauuacucu

SEQ ID NO: 673649 - RNA, 15 nt, Homo sapiens
ucauguacagcauua

SEQ ID NO: 673650 - RNA, 13 nt, Homo sapiens
ucauguacuuccu

SEQ ID NO: 673651 - RNA, 20 nt, Homo sapiens
ucauguagaacucagcaguu

SEQ ID NO: 673652 - RNA, 14 nt, Homo sapiens
ucauguauauaccu

SEQ ID NO: 673653 - RNA, 22 nt, Homo sapiens
ucauguauauguguucauuaaa

SEQ ID NO: 673654 - RNA, 14 nt, Homo sapiens
ucaugugaugucau

SEQ ID NO: 673655 - RNA, 15 nt, Homo sapiens
ucaugugguacuuga

SEQ ID NO: 673656 - RNA, 17 nt, Homo sapiens
ucaugugugcaugugag

SEQ ID NO: 673657 - RNA, 18 nt, Homo sapiens
ucauguguugcagcuuua

SEQ ID NO: 673658 - RNA, 11 nt, Homo sapiens
ucauguuauau

SEQ ID NO: 673659 - RNA, 18 nt, Homo sapiens
ucauguuauuaaacguau

SEQ ID NO: 673660 - RNA, 14 nt, Homo sapiens
ucauguuccucaaa

SEQ ID NO: 673661 - RNA, 17 nt, Homo sapiens
ucauguuccuggcguga

SEQ ID NO: 673662 - RNA, 18 nt, Homo sapiens
ucauguugaucauguacu

SEQ ID NO: 673663 - RNA, 16 nt, Homo sapiens
ucauguugaugacucg

SEQ ID NO: 673664 - RNA, 20 nt, Homo sapiens
ucauuacaaaaaaacacgug

SEQ ID NO: 673665 - RNA, 13 nt, Homo sapiens
ucauuacauauag

SEQ ID NO: 673666 - RNA, 21 nt, Homo sapiens
ucauuacccuucccugcacua

SEQ ID NO: 673667 - RNA, 21 nt, Homo sapiens
ucauuagcuuugggugccuuu

SEQ ID NO: 673668 - RNA, 14 nt, Homo sapiens
ucauuagugacuuc

SEQ ID NO: 673669 - RNA, 13 nt, Homo sapiens
ucauuauguuucc

SEQ ID NO: 673670 - RNA, 17 nt, Homo sapiens
ucauuauuggaauuaac

SEQ ID NO: 673671 - RNA, 19 nt, Homo sapiens
ucauuauuuugugguucua

SEQ ID NO: 673672 - RNA, 22 nt, Homo sapiens
ucauucaauauugacauuugua

SEQ ID NO: 673673 - RNA, 13 nt, Homo sapiens
ucauucauauuac

SEQ ID NO: 673674 - RNA, 15 nt, Homo sapiens
ucauucaucacucca

SEQ ID NO: 673675 - RNA, 18 nt, Homo sapiens
ucauucauucaaguaaua

SEQ ID NO: 673676 - RNA, 22 nt, Homo sapiens
ucauuccaaucuauugcuucac

SEQ ID NO: 673677 - RNA, 16 nt, Homo sapiens
ucauuccaccuuccca

SEQ ID NO: 673678 - RNA, 15 nt, Homo sapiens
ucauuccauugccua

SEQ ID NO: 673679 - RNA, 21 nt, Homo sapiens
ucauuccuuagauaccuugaa

SEQ ID NO: 673680 - RNA, 15 nt, Homo sapiens
ucauuccuucacuca

SEQ ID NO: 673681 - RNA, 20 nt, Homo sapiens
ucauucuacugaacagucca

SEQ ID NO: 673682 - RNA, 21 nt, Homo sapiens
ucauucucagugggacucuga

SEQ ID NO: 673683 - RNA, 21 nt, Homo sapiens
ucauucucugucucauccauc

SEQ ID NO: 673684 - RNA, 16 nt, Homo sapiens
ucauucugcauugcua

SEQ ID NO: 673685 - RNA, 19 nt, Homo sapiens
ucauucugccugcuccauc

SEQ ID NO: 673686 - RNA, 11 nt, Homo sapiens
ucauucuugcc

SEQ ID NO: 673687 - RNA, 18 nt, Homo sapiens
ucauugacaagaacugaa

SEQ ID NO: 673688 - RNA, 18 nt, Homo sapiens
ucauugagggaccaaaaa

SEQ ID NO: 673689 - RNA, 14 nt, Homo sapiens
ucauugcacuuuga

SEQ ID NO: 673690 - RNA, 15 nt, Homo sapiens
ucauugccacacuug

SEQ ID NO: 673691 - RNA, 22 nt, Homo sapiens
ucauugcccgaaaccagagccu

SEQ ID NO: 673692 - RNA, 21 nt, Homo sapiens
ucauugcuaaacugaugacuu

SEQ ID NO: 673693 - RNA, 11 nt, Homo sapiens
ucauugcugag

SEQ ID NO: 673694 - RNA, 18 nt, Homo sapiens
ucauugcugucuugcccc

SEQ ID NO: 673695 - RNA, 22 nt, Homo sapiens
ucauuggaccuguucaaaaagg

SEQ ID NO: 673696 - RNA, 22 nt, Homo sapiens
ucauuguaaacaaacucuugaa

SEQ ID NO: 673697 - RNA, 17 nt, Homo sapiens
ucauuguacaaguauua

SEQ ID NO: 673698 - RNA, 16 nt, Homo sapiens
ucauuguaugugguca

SEQ ID NO: 673699 - RNA, 22 nt, Homo sapiens
ucauugucccugaaugcuccau

SEQ ID NO: 673700 - RNA, 12 nt, Homo sapiens
ucauugucuuau

SEQ ID NO: 673701 - RNA, 23 nt, Homo sapiens
ucauuguuggaguguaaaccaaa

SEQ ID NO: 673702 - RNA, 23 nt, Homo sapiens
ucauuuaaaaagcucacugcuga

SEQ ID NO: 673703 - RNA, 19 nt, Homo sapiens
ucauuuaaaacaggcaaag

SEQ ID NO: 673704 - RNA, 14 nt, Homo sapiens
ucauuuaagggaaa

SEQ ID NO: 673705 - RNA, 14 nt, Homo sapiens
ucauuuagaacuug

SEQ ID NO: 673706 - RNA, 16 nt, Homo sapiens
ucauuuaggaguauua

SEQ ID NO: 673707 - RNA, 17 nt, Homo sapiens
ucauuuagucaugugac

SEQ ID NO: 673708 - RNA, 21 nt, Homo sapiens
ucauuuauagaugucaggaaa

SEQ ID NO: 673709 - RNA, 21 nt, Homo sapiens
ucauuuauuauuucaauguga

SEQ ID NO: 673710 - RNA, 16 nt, Homo sapiens
ucauuucacacaguga

SEQ ID NO: 673711 - RNA, 17 nt, Homo sapiens
ucauuucacccaaguau

SEQ ID NO: 673712 - RNA, 20 nt, Homo sapiens
ucauuucagcucuugcuuca

SEQ ID NO: 673713 - RNA, 14 nt, Homo sapiens
ucauuucauguaua

SEQ ID NO: 673714 - RNA, 17 nt, Homo sapiens
ucauuucauguauaguu

SEQ ID NO: 673715 - RNA, 12 nt, Homo sapiens
ucauuucauucc

SEQ ID NO: 673716 - RNA, 23 nt, Homo sapiens
ucauuucauuguaugauguguug

SEQ ID NO: 673717 - RNA, 17 nt, Homo sapiens
ucauuuccaaacuugaa

SEQ ID NO: 673718 - RNA, 15 nt, Homo sapiens
ucauuucuacuguga

SEQ ID NO: 673719 - RNA, 18 nt, Homo sapiens
ucauuucucagcuguccu

SEQ ID NO: 673720 - RNA, 23 nt, Homo sapiens
ucauuucuuaugaaucuuuccag

SEQ ID NO: 673721 - RNA, 15 nt, Homo sapiens
uggaaugaauacagc

SEQ ID NO: 673722 - RNA, 15 nt, Homo sapiens
uggaaugcuggguau

SEQ ID NO: 673723 - RNA, 14 nt, Homo sapiens
uggaauguuggaua

SEQ ID NO: 673724 - RNA, 15 nt, Homo sapiens
uggaauuacaaccau

SEQ ID NO: 673725 - RNA, 15 nt, Homo sapiens
uggaauucuacugga

SEQ ID NO: 673726 - RNA, 21 nt, Homo sapiens
uggaauucucuguaagccuag

SEQ ID NO: 673727 - RNA, 18 nt, Homo sapiens
uggaauucuucacuugcu

SEQ ID NO: 673728 - RNA, 15 nt, Homo sapiens
uggaauugacucaaa

SEQ ID NO: 673729 - RNA, 14 nt, Homo sapiens
uggaauugcucaag

SEQ ID NO: 673730 - RNA, 20 nt, Homo sapiens
uggaauuugccugcugggau

SEQ ID NO: 673731 - RNA, 20 nt, Homo sapiens
uggaauuuuucuguacuuca

SEQ ID NO: 673732 - RNA, 20 nt, Homo sapiens
uggacacagaucccacugga

SEQ ID NO: 673733 - RNA, 21 nt, Homo sapiens
uggacacuacacccagcaaua

SEQ ID NO: 673734 - RNA, 16 nt, Homo sapiens
uggacacuugguuaga

SEQ ID NO: 673735 - RNA, 15 nt, Homo sapiens
uggacagacacuguu

SEQ ID NO: 673736 - RNA, 20 nt, Homo sapiens
uggacagacacuguugcaaa

SEQ ID NO: 673737 - RNA, 16 nt, Homo sapiens
uggacagccugaguca

SEQ ID NO: 673738 - RNA, 14 nt, Homo sapiens
uggacagcugcuug

SEQ ID NO: 673739 - RNA, 15 nt, Homo sapiens
uggacaggaaagggc

SEQ ID NO: 673740 - RNA, 22 nt, Homo sapiens
uggacaggcgccuggugugagg

SEQ ID NO: 673741 - RNA, 16 nt, Homo sapiens
uggacaggcucugcuu

SEQ ID NO: 673742 - RNA, 17 nt, Homo sapiens
uggacagucuggccacu

SEQ ID NO: 673743 - RNA, 21 nt, Homo sapiens
uggacauccuguauaagcacu

SEQ ID NO: 673744 - RNA, 11 nt, Homo sapiens
uggacaugacg

SEQ ID NO: 673745 - RNA, 14 nt, Homo sapiens
uggacauggcucac

SEQ ID NO: 673746 - RNA, 22 nt, Homo sapiens
uggaccaauagggcugagcucu

SEQ ID NO: 673747 - RNA, 13 nt, Homo sapiens
uggaccagccugu

SEQ ID NO: 673748 - RNA, 22 nt, Homo sapiens
uggaccaggaagcccugaaucc

SEQ ID NO: 673749 - RNA, 21 nt, Homo sapiens
uggaccaggaggauugccuuu

SEQ ID NO: 673750 - RNA, 20 nt, Homo sapiens
uggaccauuccugucccuuu

SEQ ID NO: 673751 - RNA, 14 nt, Homo sapiens
uggaccccacuggc

SEQ ID NO: 673752 - RNA, 14 nt, Homo sapiens
uggaccccaucugu

SEQ ID NO: 673753 - RNA, 18 nt, Homo sapiens
uggaccccaucugugaau

SEQ ID NO: 673754 - RNA, 14 nt, Homo sapiens
uggacccccuggaa

SEQ ID NO: 673755 - RNA, 20 nt, Homo sapiens
uggacccuggaccauuccag

SEQ ID NO: 673756 - RNA, 19 nt, Homo sapiens
uggaccuaggguggccuga

SEQ ID NO: 673757 - RNA, 17 nt, Homo sapiens
uggaccugcaccaaagc

SEQ ID NO: 673758 - RNA, 23 nt, Homo sapiens
uggaccugccccggaccuaccuc

SEQ ID NO: 673759 - RNA, 15 nt, Homo sapiens
uggacgugcucagac

SEQ ID NO: 673760 - RNA, 15 nt, Homo sapiens
uggacuaugauuauc

SEQ ID NO: 673761 - RNA, 18 nt, Homo sapiens
uggacucagcugccagca

SEQ ID NO: 673762 - RNA, 14 nt, Homo sapiens
uggacucucaggga

SEQ ID NO: 673763 - RNA, 15 nt, Homo sapiens
uggacugcucaggaa

SEQ ID NO: 673764 - RNA, 12 nt, Homo sapiens
uggacuggccau

SEQ ID NO: 673765 - RNA, 11 nt, Homo sapiens
uggacugggag

SEQ ID NO: 673766 - RNA, 21 nt, Homo sapiens
uggacuguuccaggcccucca

SEQ ID NO: 673767 - RNA, 19 nt, Homo sapiens
uggacuuccacugccaucc

SEQ ID NO: 673768 - RNA, 17 nt, Homo sapiens
uggacuuggucaccagc

SEQ ID NO: 673769 - RNA, 18 nt, Homo sapiens
uggacuuuccacccccuc

SEQ ID NO: 673770 - RNA, 17 nt, Homo sapiens
uggacuuuccuguuguc

SEQ ID NO: 673771 - RNA, 13 nt, Homo sapiens
uggagaaagcuca

SEQ ID NO: 673772 - RNA, 21 nt, Homo sapiens
uggagaaagggcagaggaaga

SEQ ID NO: 673773 - RNA, 17 nt, Homo sapiens
uggagaacagcaugaca

SEQ ID NO: 673774 - RNA, 21 nt, Homo sapiens
uggagaagucuuagacuugaa

SEQ ID NO: 673775 - RNA, 20 nt, Homo sapiens
uggagacaaggugcuaacau

SEQ ID NO: 673776 - RNA, 16 nt, Homo sapiens
uggagacacugaguca

SEQ ID NO: 673777 - RNA, 16 nt, Homo sapiens
ugggccacuguagggg

SEQ ID NO: 673778 - RNA, 21 nt, Homo sapiens
ugggccagccccagcaccuca

SEQ ID NO: 673779 - RNA, 15 nt, Homo sapiens
ugggcccaagaacug

SEQ ID NO: 673780 - RNA, 21 nt, Homo sapiens
ugggcccaagaacugcagaua

SEQ ID NO: 673781 - RNA, 14 nt, Homo sapiens
ugggcccagaucug

SEQ ID NO: 673782 - RNA, 16 nt, Homo sapiens
ugggcccuuugagugc

SEQ ID NO: 673783 - RNA, 15 nt, Homo sapiens
ugggccuccagagac

SEQ ID NO: 673784 - RNA, 14 nt, Homo sapiens
ugggccucucuggg

SEQ ID NO: 673785 - RNA, 20 nt, Homo sapiens
ugggccucugggcugcugua

SEQ ID NO: 673786 - RNA, 23 nt, Homo sapiens
ugggccucugguucugacacuuu

SEQ ID NO: 673787 - RNA, 23 nt, Homo sapiens
ugggcuccccucuuccucuugac

SEQ ID NO: 673788 - RNA, 18 nt, Homo sapiens
ugggcuccuccagggugu

SEQ ID NO: 673789 - RNA, 13 nt, Homo sapiens
ugggcucgcacug

SEQ ID NO: 673790 - RNA, 14 nt, Homo sapiens
ugggcucuccuagg

SEQ ID NO: 673791 - RNA, 13 nt, Homo sapiens
ugggcucuuccaa

SEQ ID NO: 673792 - RNA, 12 nt, Homo sapiens
ugggcugcugca

SEQ ID NO: 673793 - RNA, 21 nt, Homo sapiens
ugggcuggauugugcuuuggu

SEQ ID NO: 673794 - RNA, 16 nt, Homo sapiens
ugggcugggaaaaacu

SEQ ID NO: 673795 - RNA, 16 nt, Homo sapiens
ugggcugggcagccuu

SEQ ID NO: 673796 - RNA, 18 nt, Homo sapiens
ugggcuggggccucagac

SEQ ID NO: 673797 - RNA, 12 nt, Homo sapiens
ugggcugugcua

SEQ ID NO: 673798 - RNA, 16 nt, Homo sapiens
ugggcuguggggcccu

SEQ ID NO: 673799 - RNA, 15 nt, Homo sapiens
ugggcuucaguaagu

SEQ ID NO: 673800 - RNA, 23 nt, Homo sapiens
ugggcuucaguaaguccccggcg

SEQ ID NO: 673801 - RNA, 12 nt, Homo sapiens
ugggcuuccuga

SEQ ID NO: 673802 - RNA, 16 nt, Homo sapiens
ugggcuugaaacauua

SEQ ID NO: 673803 - RNA, 18 nt, Homo sapiens
ugggcuugagcugcagaa

SEQ ID NO: 673804 - RNA, 15 nt, Homo sapiens
uggggaaaacuugca

SEQ ID NO: 673805 - RNA, 16 nt, Homo sapiens
uggggaaaacuugcag

SEQ ID NO: 673806 - RNA, 19 nt, Homo sapiens
uggggaacaggucuugggg

SEQ ID NO: 673807 - RNA, 16 nt, Homo sapiens
uggggaagcugugaaa

SEQ ID NO: 673808 - RNA, 20 nt, Homo sapiens
uggggaaguguuccagauag

SEQ ID NO: 673809 - RNA, 15 nt, Homo sapiens
uggggaauauacgug

SEQ ID NO: 673810 - RNA, 14 nt, Homo sapiens
uggggaauuacuuu

SEQ ID NO: 673811 - RNA, 15 nt, Homo sapiens
uggggacacagauca

SEQ ID NO: 673812 - RNA, 20 nt, Homo sapiens
uggggacccaggcuccgccc

SEQ ID NO: 673813 - RNA, 13 nt, Homo sapiens
uggggacggugua

SEQ ID NO: 673814 - RNA, 19 nt, Homo sapiens
uggggacuggggaagggga

SEQ ID NO: 673815 - RNA, 12 nt, Homo sapiens
uggggaggacca

SEQ ID NO: 673816 - RNA, 20 nt, Homo sapiens
uggggaggccuauuccugcu

SEQ ID NO: 673817 - RNA, 15 nt, Homo sapiens
uggggauaaagacag

SEQ ID NO: 673818 - RNA, 16 nt, Homo sapiens
uggggauaugauuuaa

SEQ ID NO: 673819 - RNA, 17 nt, Homo sapiens
uggggaugguccacugu

SEQ ID NO: 673820 - RNA, 19 nt, Homo sapiens
uggggaugguccacuguca

SEQ ID NO: 673821 - RNA, 20 nt, Homo sapiens
uggggauugcccauccaucu

SEQ ID NO: 673822 - RNA, 19 nt, Homo sapiens
uggggcacugggcgucuga

SEQ ID NO: 673823 - RNA, 20 nt, Homo sapiens
uggggcagaaacacucaagu

SEQ ID NO: 673824 - RNA, 24 nt, Homo sapiens
uggggcaggcugggccauguccaa

SEQ ID NO: 673825 - RNA, 16 nt, Homo sapiens
uggggcaggucacuuu

SEQ ID NO: 673826 - RNA, 22 nt, Homo sapiens
uggggcaggucacuuuaccucu

SEQ ID NO: 673827 - RNA, 19 nt, Homo sapiens
uggggcagucucugcccaa

SEQ ID NO: 673828 - RNA, 21 nt, Homo sapiens
uggggcaguuccccuucuuac

SEQ ID NO: 673829 - RNA, 18 nt, Homo sapiens
uggggcauauucaucuac

SEQ ID NO: 673830 - RNA, 14 nt, Homo sapiens
uggggccaugccuc

SEQ ID NO: 673831 - RNA, 19 nt, Homo sapiens
uggggcccaaguugcagug

SEQ ID NO: 673832 - RNA, 17 nt, Homo sapiens
uggggcccagacaccag

SEQ ID NO: 673833 - RNA, 21 nt, Homo sapiens
uggggcccgcugcgugccauc

SEQ ID NO: 673834 - RNA, 16 nt, Homo sapiens
uggggccuguggaaug

SEQ ID NO: 673835 - RNA, 20 nt, Homo sapiens
uggggcucaagcaguucucc

SEQ ID NO: 673836 - RNA, 21 nt, Homo sapiens
uggggcuuacagaaaugacug

SEQ ID NO: 673837 - RNA, 19 nt, Homo sapiens
uggggcuuguccugugcuu

SEQ ID NO: 673838 - RNA, 20 nt, Homo sapiens
ugggggaaaaguuagucaau

SEQ ID NO: 673839 - RNA, 15 nt, Homo sapiens
ugggggaagacuuua

SEQ ID NO: 673840 - RNA, 22 nt, Homo sapiens
ugggggaagacuuuaaaccacc

SEQ ID NO: 673841 - RNA, 24 nt, Homo sapiens
uuaaaacuaaaaaggaccagagaa

SEQ ID NO: 673842 - RNA, 16 nt, Homo sapiens
uuaaaacucuggugau

SEQ ID NO: 673843 - RNA, 17 nt, Homo sapiens
uuaaaacucuggugaua

SEQ ID NO: 673844 - RNA, 15 nt, Homo sapiens
uuaaaacuucaguuu

SEQ ID NO: 673845 - RNA, 20 nt, Homo sapiens
uuaaaagaaauauacaguuu

SEQ ID NO: 673846 - RNA, 22 nt, Homo sapiens
uuaaaagacaagacuucaguau

SEQ ID NO: 673847 - RNA, 11 nt, Homo sapiens
uuaaaaggggg

SEQ ID NO: 673848 - RNA, 21 nt, Homo sapiens
uuaaaagggucguuaccagag

SEQ ID NO: 673849 - RNA, 21 nt, Homo sapiens
uuaaaauaaaacaagccuuaa

SEQ ID NO: 673850 - RNA, 22 nt, Homo sapiens
uuaaaauauauguucugcaaga

SEQ ID NO: 673851 - RNA, 11 nt, Homo sapiens
uuaaaaucaca

SEQ ID NO: 673852 - RNA, 15 nt, Homo sapiens
uuaaaaucagcuauu

SEQ ID NO: 673853 - RNA, 13 nt, Homo sapiens
uuaaaaucuguca

SEQ ID NO: 673854 - RNA, 16 nt, Homo sapiens
uuaaaaucugugaaga

SEQ ID NO: 673855 - RNA, 19 nt, Homo sapiens
uuaaaaugagagucacuug

SEQ ID NO: 673856 - RNA, 13 nt, Homo sapiens
uuaaaaugccaau

SEQ ID NO: 673857 - RNA, 11 nt, Homo sapiens
uuaaaauggaa

SEQ ID NO: 673858 - RNA, 15 nt, Homo sapiens
uuaaaauucaauuag

SEQ ID NO: 673859 - RNA, 20 nt, Homo sapiens
uuaaaauugcuauguuacua

SEQ ID NO: 673860 - RNA, 21 nt, Homo sapiens
uuaaacaaaauuucacaguuc

SEQ ID NO: 673861 - RNA, 17 nt, Homo sapiens
uuaaacaaucuuucaug

SEQ ID NO: 673862 - RNA, 19 nt, Homo sapiens
uuaaacacacauugcagcu

SEQ ID NO: 673863 - RNA, 23 nt, Homo sapiens
uuaaacacacauugcagcuucaa

SEQ ID NO: 673864 - RNA, 14 nt, Homo sapiens
uuaaacaccuccuc

SEQ ID NO: 673865 - RNA, 18 nt, Homo sapiens
uuaaacauaaagaauuca

SEQ ID NO: 673866 - RNA, 16 nt, Homo sapiens
uuaaacauuacuguuu

SEQ ID NO: 673867 - RNA, 13 nt, Homo sapiens
uuaaacauuucaa

SEQ ID NO: 673868 - RNA, 15 nt, Homo sapiens
uuaaacccauacaau

SEQ ID NO: 673869 - RNA, 15 nt, Homo sapiens
uuaaacccuuaccaa

SEQ ID NO: 673870 - RNA, 17 nt, Homo sapiens
uuaaaccuuuaaugaga

SEQ ID NO: 673871 - RNA, 14 nt, Homo sapiens
uuaaaccuuucaua

SEQ ID NO: 673872 - RNA, 18 nt, Homo sapiens
uuaaacguaugcauguga

SEQ ID NO: 673873 - RNA, 12 nt, Homo sapiens
uuaaacuaaaga

SEQ ID NO: 673874 - RNA, 19 nt, Homo sapiens
uuaaacucaagacaaugca

SEQ ID NO: 673875 - RNA, 13 nt, Homo sapiens
uuaaacucaggga

SEQ ID NO: 673876 - RNA, 21 nt, Homo sapiens
uuaaacucagggacagagcca

SEQ ID NO: 673877 - RNA, 12 nt, Homo sapiens
uuaaacugauua

SEQ ID NO: 673878 - RNA, 14 nt, Homo sapiens
uuaaacugauucau

SEQ ID NO: 673879 - RNA, 12 nt, Homo sapiens
uuaaacugugua

SEQ ID NO: 673880 - RNA, 15 nt, Homo sapiens
uuaaacuguguaaaa

SEQ ID NO: 673881 - RNA, 20 nt, Homo sapiens
uuaaacuguguggacuguga

SEQ ID NO: 673882 - RNA, 19 nt, Homo sapiens
uuaaacuugacccaggugg

SEQ ID NO: 673883 - RNA, 18 nt, Homo sapiens
uuaaacuugcaucacuua

SEQ ID NO: 673884 - RNA, 23 nt, Homo sapiens
uuaaacuuucaauugucacuuuu

SEQ ID NO: 673885 - RNA, 20 nt, Homo sapiens
uuaaagaaaaaaaaagucag

SEQ ID NO: 673886 - RNA, 15 nt, Homo sapiens
uuaaagaaacuuggc

SEQ ID NO: 673887 - RNA, 13 nt, Homo sapiens
uuaaagaaaugaa

SEQ ID NO: 673888 - RNA, 17 nt, Homo sapiens
uuaaagaagcugcaugu

SEQ ID NO: 673889 - RNA, 21 nt, Homo sapiens
uuaaagacaggagacaaaaga

SEQ ID NO: 673890 - RNA, 18 nt, Homo sapiens
uuaaagacucaagguggu

SEQ ID NO: 673891 - RNA, 17 nt, Homo sapiens
uuaaagagggacaggcu

SEQ ID NO: 673892 - RNA, 18 nt, Homo sapiens
uuaaagaugugaagacca

SEQ ID NO: 673893 - RNA, 21 nt, Homo sapiens
uuaaagcaaacuaugauuuau

SEQ ID NO: 673894 - RNA, 18 nt, Homo sapiens
uuaaagcauuacaguauu

SEQ ID NO: 673895 - RNA, 12 nt, Homo sapiens
uuaaagcuaaac

SEQ ID NO: 673896 - RNA, 14 nt, Homo sapiens
uuaaagcuguacac

SEQ ID NO: 673897 - RNA, 17 nt, Homo sapiens
uuaaagcuuaaacugaa

SEQ ID NO: 673898 - RNA, 18 nt, Homo sapiens
uuaaagcuuaaacugaau

SEQ ID NO: 673899 - RNA, 18 nt, Homo sapiens
uuaaagcuuucaacaugu

SEQ ID NO: 673900 - RNA, 16 nt, Homo sapiens
uuaaaggaaaaucaca

SEQ ID NO: 673901 - RNA, 18 nt, Homo sapiens
uuaaagggaaaacccuca

SEQ ID NO: 673902 - RNA, 17 nt, Homo sapiens
uuaaaggggguauguga

SEQ ID NO: 673903 - RNA, 19 nt, Homo sapiens
uuaaaggguguacuuauau

SEQ ID NO: 673904 - RNA, 15 nt, Homo sapiens
uuaaagguucacagg

SEQ ID NO: 673905 - RNA, 13 nt, Homo sapiens
uuaaaguaccugu

SEQ ID NO: 673906 - RNA, 12 nt, Homo sapiens
uuaaaguauaaa

SEQ ID NO: 673907 - RNA, 15 nt, Homo sapiens
uuaaaguauguccuu

SEQ ID NO: 673908 - RNA, 11 nt, Homo sapiens
uuaaagugaua

SEQ ID NO: 673909 - RNA, 13 nt, Homo sapiens
uuaaaguucucaa

SEQ ID NO: 673910 - RNA, 18 nt, Homo sapiens
uuaaaguuuuauaugcau

SEQ ID NO: 673911 - RNA, 19 nt, Homo sapiens
uuaaauaaaucauuaauac

SEQ ID NO: 673912 - RNA, 15 nt, Homo sapiens
uuaaauaacagggac

SEQ ID NO: 673913 - RNA, 13 nt, Homo sapiens
uuaaauaagcagu

SEQ ID NO: 673914 - RNA, 16 nt, Homo sapiens
uuaaauaauagacaua

SEQ ID NO: 673915 - RNA, 13 nt, Homo sapiens
uuaaauaaucucu

SEQ ID NO: 673916 - RNA, 19 nt, Homo sapiens
uuaaauaaugcuucagaua

SEQ ID NO: 673917 - RNA, 17 nt, Homo sapiens
uuaaauaauuucuacuc

SEQ ID NO: 673918 - RNA, 14 nt, Homo sapiens
uuaaauacaaaagg

SEQ ID NO: 673919 - RNA, 12 nt, Homo sapiens
uuaaauagugug

SEQ ID NO: 673920 - RNA, 14 nt, Homo sapiens
uuaaaucaaaaggg

SEQ ID NO: 673921 - RNA, 13 nt, Homo sapiens
uuaaaucuugaua

SEQ ID NO: 673922 - RNA, 20 nt, Homo sapiens
uuaaaugcaauaauuuuacu

SEQ ID NO: 673923 - RNA, 16 nt, Homo sapiens
uuaaaugccuuguaua

SEQ ID NO: 673924 - RNA, 15 nt, Homo sapiens
uuaaaugcucucuca

SEQ ID NO: 673925 - RNA, 18 nt, Homo sapiens
uuaaauguccguguaaaa

SEQ ID NO: 673926 - RNA, 14 nt, Homo sapiens
uuaaauuacaauuu

SEQ ID NO: 673927 - RNA, 21 nt, Homo sapiens
uuaaauuauuuuuucuaugaa

SEQ ID NO: 673928 - RNA, 21 nt, Homo sapiens
uuaaauuucuccaguggauuc

SEQ ID NO: 673929 - RNA, 19 nt, Homo sapiens
uuaaauuuugaaaacugug

SEQ ID NO: 673930 - RNA, 16 nt, Homo sapiens
uuaaauuuuuuuuaca

SEQ ID NO: 673931 - RNA, 19 nt, Homo sapiens
uuaacaaaaugagcaguaa

SEQ ID NO: 673932 - RNA, 12 nt, Homo sapiens
uuaacacagccu

SEQ ID NO: 673933 - RNA, 19 nt, Homo sapiens
uuaacaccuucauccagau

SEQ ID NO: 673934 - RNA, 15 nt, Homo sapiens
uuaacacucaugaag

SEQ ID NO: 673935 - RNA, 12 nt, Homo sapiens
uuaacacuuaaa

SEQ ID NO: 673936 - RNA, 17 nt, Homo sapiens
uuaacagaucuuuacuc

SEQ ID NO: 673937 - RNA, 21 nt, Homo sapiens
uuaacagaugcaaugugcuac

SEQ ID NO: 673938 - RNA, 13 nt, Homo sapiens
uuaacaggauauu

SEQ ID NO: 673939 - RNA, 19 nt, Homo sapiens
uuaacaguuguauuuaaca

SEQ ID NO: 673940 - RNA, 18 nt, Homo sapiens
uuaacauggacaugaucu

SEQ ID NO: 673941 - RNA, 15 nt, Homo sapiens
uuaacauguguuaaa

SEQ ID NO: 673942 - RNA, 12 nt, Homo sapiens
uuaacauucaca

SEQ ID NO: 673943 - RNA, 17 nt, Homo sapiens
uuaacauuuaucuuuag

SEQ ID NO: 673944 - RNA, 22 nt, Homo sapiens
uuaaccaguucugucuucagcu

SEQ ID NO: 673945 - RNA, 18 nt, Homo sapiens
uuaacccugucugagaug

SEQ ID NO: 673946 - RNA, 21 nt, Homo sapiens
uuaaccugaaccuugagcaaa

SEQ ID NO: 673947 - RNA, 15 nt, Homo sapiens
uuaaccuuaaauaca

SEQ ID NO: 673948 - RNA, 13 nt, Homo sapiens
uuaaccuuaucag

SEQ ID NO: 673949 - RNA, 13 nt, Homo sapiens
uuaacgacaauuu

SEQ ID NO: 673950 - RNA, 17 nt, Homo sapiens
uuaacggugcuaaaaau

SEQ ID NO: 673951 - RNA, 13 nt, Homo sapiens
uuaacguggcuug

SEQ ID NO: 673952 - RNA, 14 nt, Homo sapiens
uuaacuacugaaua

SEQ ID NO: 673953 - RNA, 19 nt, Homo sapiens
uuaacucaccucucaaggu

SEQ ID NO: 673954 - RNA, 18 nt, Homo sapiens
uuaacucccuccaccagc

SEQ ID NO: 673955 - RNA, 19 nt, Homo sapiens
uuaacucccuccaccagcc

SEQ ID NO: 673956 - RNA, 20 nt, Homo sapiens
uuaacugcauaauagccuaa

SEQ ID NO: 673957 - RNA, 21 nt, Homo sapiens
uuaacugguauauacauauau

SEQ ID NO: 673958 - RNA, 15 nt, Homo sapiens
uuaacuuaacauucu

SEQ ID NO: 673959 - RNA, 21 nt, Homo sapiens
uuaacuugaggguguagaggu

SEQ ID NO: 673960 - RNA, 22 nt, Homo sapiens
uuaacuuuaccaugcucaauga

SEQ ID NO: 673961 - RNA, 14 nt, Homo sapiens
uuaagaaaaauuca

SEQ ID NO: 673962 - RNA, 13 nt, Homo sapiens
uuaagaaaauaca

SEQ ID NO: 673963 - RNA, 22 nt, Homo sapiens
uuaagaaacacaggguuuugua

SEQ ID NO: 673964 - RNA, 23 nt, Homo sapiens
uuaagaaagagaaugaacugugg

SEQ ID NO: 673965 - RNA, 19 nt, Homo sapiens
uuaagaacaaacucugaaa

SEQ ID NO: 673966 - RNA, 21 nt, Homo sapiens
uuaagaacaucaaaacuaacc

SEQ ID NO: 673967 - RNA, 22 nt, Homo sapiens
uuaagaagcauuugggaaagaa

SEQ ID NO: 673968 - RNA, 22 nt, Homo sapiens
uuaagaaugucgauuaaaauca

SEQ ID NO: 673969 - RNA, 15 nt, Homo sapiens
uuaagacagcauuga

SEQ ID NO: 673970 - RNA, 15 nt, Homo sapiens
uuaagacaugcacua

SEQ ID NO: 673971 - RNA, 18 nt, Homo sapiens
uuaagacuguaaugugua

SEQ ID NO: 673972 - RNA, 16 nt, Homo sapiens
uuaagagaucccuuaa

SEQ ID NO: 673973 - RNA, 21 nt, Homo sapiens
uuaagagcuugaucugugauu

SEQ ID NO: 673974 - RNA, 17 nt, Homo sapiens
uuaagauacaaauuaau

SEQ ID NO: 673975 - RNA, 16 nt, Homo sapiens
uuaagauagaacacaa

SEQ ID NO: 673976 - RNA, 22 nt, Homo sapiens
uuaagauuuggucacacucuca

SEQ ID NO: 673977 - RNA, 18 nt, Homo sapiens
uuaagcacacuaaaccaa

SEQ ID NO: 673978 - RNA, 14 nt, Homo sapiens
uuaagcacugugga

SEQ ID NO: 673979 - RNA, 14 nt, Homo sapiens
uuaagcagaacaaa

SEQ ID NO: 673980 - RNA, 12 nt, Homo sapiens
uuaagcauuugu

SEQ ID NO: 673981 - RNA, 20 nt, Homo sapiens
uuaagccaucucagauucug

SEQ ID NO: 673982 - RNA, 19 nt, Homo sapiens
uuaagccuaaaugccuuag

SEQ ID NO: 673983 - RNA, 16 nt, Homo sapiens
uuaagcgugucuguau

SEQ ID NO: 673984 - RNA, 15 nt, Homo sapiens
uuaagcguuguagua

SEQ ID NO: 673985 - RNA, 22 nt, Homo sapiens
uuaagcugggauaaucacauua

SEQ ID NO: 673986 - RNA, 23 nt, Homo sapiens
uuaagcugggauaaucacauuau

SEQ ID NO: 673987 - RNA, 17 nt, Homo sapiens
uuaagcuuaugucagac

SEQ ID NO: 673988 - RNA, 23 nt, Homo sapiens
uuaaggaaucaaaucuuacaaaa

SEQ ID NO: 673989 - RNA, 23 nt, Homo sapiens
uuaaggauaaaucauaaagucag

SEQ ID NO: 673990 - RNA, 16 nt, Homo sapiens
uuaaggcaacauuccu

SEQ ID NO: 673991 - RNA, 23 nt, Homo sapiens
uuaagggaacugaaucacuuaaa

SEQ ID NO: 673992 - RNA, 16 nt, Homo sapiens
uuaagggaaggaacuc

SEQ ID NO: 673993 - RNA, 21 nt, Homo sapiens
uuaagggcauuuuuauacuca

SEQ ID NO: 673994 - RNA, 22 nt, Homo sapiens
uuaagguacuaauuaacuuaaa

SEQ ID NO: 673995 - RNA, 17 nt, Homo sapiens
uuaagguauugugcauc

SEQ ID NO: 673996 - RNA, 19 nt, Homo sapiens
uuaaggucuccaaaccaga

SEQ ID NO: 673997 - RNA, 13 nt, Homo sapiens
uuaaguaaauaca

SEQ ID NO: 673998 - RNA, 17 nt, Homo sapiens
uuaaguaaauacaguag

SEQ ID NO: 673999 - RNA, 16 nt, Homo sapiens
uuaaguaggaaucuga

SEQ ID NO: 674000 - RNA, 22 nt, Homo sapiens
uuaaguauguuauuuucuguug

SEQ ID NO: 674001 - RNA, 16 nt, Homo sapiens
uuaagugaauacauua

SEQ ID NO: 674002 - RNA, 16 nt, Homo sapiens
uuaagugacuauagaa

SEQ ID NO: 674003 - RNA, 16 nt, Homo sapiens
uuaagugcaauuaaca

SEQ ID NO: 674004 - RNA, 20 nt, Homo sapiens
uuaagugccauuacuacugu

SEQ ID NO: 674005 - RNA, 22 nt, Homo sapiens
uuaaguggggugggaaggggag

SEQ ID NO: 674006 - RNA, 23 nt, Homo sapiens
uuaaguguuuagaaaucauagaa

SEQ ID NO: 674007 - RNA, 15 nt, Homo sapiens
uuaaguuuaucuuuc

SEQ ID NO: 674008 - RNA, 17 nt, Homo sapiens
uuaaguuucucuucacc

SEQ ID NO: 674009 - RNA, 16 nt, Homo sapiens
uuaauaaagacagggu

SEQ ID NO: 674010 - RNA, 14 nt, Homo sapiens
uuaauaaagcauuc

SEQ ID NO: 674011 - RNA, 22 nt, Homo sapiens
uuaauaaagcauucuuuaacag

SEQ ID NO: 674012 - RNA, 13 nt, Homo sapiens
uuaauaacagcuc

SEQ ID NO: 674013 - RNA, 19 nt, Homo sapiens
uuaauaagcuacuagcaaa

SEQ ID NO: 674014 - RNA, 15 nt, Homo sapiens
uuaauaaucucaugc

SEQ ID NO: 674015 - RNA, 14 nt, Homo sapiens
uuaauaaucuuggc

SEQ ID NO: 674016 - RNA, 20 nt, Homo sapiens
uuaauacagggcauuuuggu

SEQ ID NO: 674017 - RNA, 18 nt, Homo sapiens
uuaauacaugcaacagaa

SEQ ID NO: 674018 - RNA, 17 nt, Homo sapiens
uuacgcccaucucagga

SEQ ID NO: 674019 - RNA, 16 nt, Homo sapiens
uuacgcucaucaccua

SEQ ID NO: 674020 - RNA, 17 nt, Homo sapiens
uuacggauuuauuauau

SEQ ID NO: 674021 - RNA, 20 nt, Homo sapiens
uuacgguccaugccuuuaau

SEQ ID NO: 674022 - RNA, 13 nt, Homo sapiens
uuacgugagccag

SEQ ID NO: 674023 - RNA, 12 nt, Homo sapiens
uuacgugcaaua

SEQ ID NO: 674024 - RNA, 13 nt, Homo sapiens
uuacuaaacauuu

SEQ ID NO: 674025 - RNA, 22 nt, Homo sapiens
uuacuaaagguuuuaaccgcac

SEQ ID NO: 674026 - RNA, 21 nt, Homo sapiens
uuacuaacuaaauaccauuca

SEQ ID NO: 674027 - RNA, 19 nt, Homo sapiens
uuacuacagcuucagugau

SEQ ID NO: 674028 - RNA, 12 nt, Homo sapiens
uuacuacuccuu

SEQ ID NO: 674029 - RNA, 12 nt, Homo sapiens
uuacuacugugg

SEQ ID NO: 674030 - RNA, 19 nt, Homo sapiens
uuacuaguagccaaaagga

SEQ ID NO: 674031 - RNA, 16 nt, Homo sapiens
uuacuauaauuugacu

SEQ ID NO: 674032 - RNA, 22 nt, Homo sapiens
uuacuauagcauagauugucaa

SEQ ID NO: 674033 - RNA, 16 nt, Homo sapiens
uuacuaucauucucag

SEQ ID NO: 674034 - RNA, 19 nt, Homo sapiens
uuacuaugacugcucccca

SEQ ID NO: 674035 - RNA, 22 nt, Homo sapiens
uuacuauuauagcaacuuuaag

SEQ ID NO: 674036 - RNA, 17 nt, Homo sapiens
uuacucagagcagauga

SEQ ID NO: 674037 - RNA, 21 nt, Homo sapiens
uuacucagaggagcugcaaau

SEQ ID NO: 674038 - RNA, 14 nt, Homo sapiens
uuacucagguuuga

SEQ ID NO: 674039 - RNA, 16 nt, Homo sapiens
uuacuccccuaagucu

SEQ ID NO: 674040 - RNA, 23 nt, Homo sapiens
uuacucuauacauucaacagaga

SEQ ID NO: 674041 - RNA, 16 nt, Homo sapiens
uuacucuguuaccaca

SEQ ID NO: 674042 - RNA, 13 nt, Homo sapiens
uuacucuugagaa

SEQ ID NO: 674043 - RNA, 18 nt, Homo sapiens
uuacucuuuccuauuuca

SEQ ID NO: 674044 - RNA, 14 nt, Homo sapiens
uuacugaacugugu

SEQ ID NO: 674045 - RNA, 15 nt, Homo sapiens
uuacugaaucuucaa

SEQ ID NO: 674046 - RNA, 20 nt, Homo sapiens
uuacugagcuucucugugaa

SEQ ID NO: 674047 - RNA, 21 nt, Homo sapiens
uuacugaggaaauauuuccau

SEQ ID NO: 674048 - RNA, 13 nt, Homo sapiens
uuacugauauuau

SEQ ID NO: 674049 - RNA, 14 nt, Homo sapiens
uuacugaugugaua

SEQ ID NO: 674050 - RNA, 23 nt, Homo sapiens
uuacuggugcagaugguugacau

SEQ ID NO: 674051 - RNA, 20 nt, Homo sapiens
uuacuguacccucgcaugac

SEQ ID NO: 674052 - RNA, 15 nt, Homo sapiens
uuacuguagccucag

SEQ ID NO: 674053 - RNA, 23 nt, Homo sapiens
uuacugugauauuuuaaauaucc

SEQ ID NO: 674054 - RNA, 13 nt, Homo sapiens
uuacugugauuca

SEQ ID NO: 674055 - RNA, 19 nt, Homo sapiens
uuacuguuuugggccucca

SEQ ID NO: 674056 - RNA, 22 nt, Homo sapiens
uuacuucaaugggcucuuccaa

SEQ ID NO: 674057 - RNA, 19 nt, Homo sapiens
uuacuucauauuguugcau

SEQ ID NO: 674058 - RNA, 23 nt, Homo sapiens
uuacuuuucuguuuaguuuuaca

SEQ ID NO: 674059 - RNA, 14 nt, Homo sapiens
uuacuuuuucauuc

SEQ ID NO: 674060 - RNA, 19 nt, Homo sapiens
uuacuuuuuccuggcucau

SEQ ID NO: 674061 - RNA, 17 nt, Homo sapiens
uuacuuuuucuuguauu

SEQ ID NO: 674062 - RNA, 17 nt, Homo sapiens
uuacuuuuuugguacua

SEQ ID NO: 674063 - RNA, 23 nt, Homo sapiens
uuacuuuuuuucugugacauuua

SEQ ID NO: 674064 - RNA, 17 nt, Homo sapiens
uuagaaaaaaacaugaa

SEQ ID NO: 674065 - RNA, 20 nt, Homo sapiens
uuagaaaaacaucccaagaa

SEQ ID NO: 674066 - RNA, 21 nt, Homo sapiens
uuagaaaaauccuacaaggcu

SEQ ID NO: 674067 - RNA, 13 nt, Homo sapiens
uuagaaaacuaga

SEQ ID NO: 674068 - RNA, 13 nt, Homo sapiens
uuagaaaauauuc

SEQ ID NO: 674069 - RNA, 14 nt, Homo sapiens
uuagaaaaugcagu

SEQ ID NO: 674070 - RNA, 23 nt, Homo sapiens
uuagaaauaaaccuuaauauuuc

SEQ ID NO: 674071 - RNA, 23 nt, Homo sapiens
uuagaaauauucuacuucucugu

SEQ ID NO: 674072 - RNA, 14 nt, Homo sapiens
uuagaaaucauaga

SEQ ID NO: 674073 - RNA, 20 nt, Homo sapiens
uuagaaauguaaacugccau

SEQ ID NO: 674074 - RNA, 15 nt, Homo sapiens
uuagaaauugcauuu

SEQ ID NO: 674075 - RNA, 13 nt, Homo sapiens
uuagaacagucca

SEQ ID NO: 674076 - RNA, 15 nt, Homo sapiens
uuagaacugccaaag

SEQ ID NO: 674077 - RNA, 12 nt, Homo sapiens
uuagaacuugca

SEQ ID NO: 674078 - RNA, 17 nt, Homo sapiens
uuagaagaaaaaaccac

SEQ ID NO: 674079 - RNA, 14 nt, Homo sapiens
uuagaagacaauuu

SEQ ID NO: 674080 - RNA, 12 nt, Homo sapiens
uuagaagacauu

SEQ ID NO: 674081 - RNA, 19 nt, Homo sapiens
uuagaaguaguauguuauu

SEQ ID NO: 674082 - RNA, 12 nt, Homo sapiens
uuagaauaucua

SEQ ID NO: 674083 - RNA, 15 nt, Homo sapiens
uuagaaugcaucuca

SEQ ID NO: 674084 - RNA, 13 nt, Homo sapiens
uuagacauaacaa

SEQ ID NO: 674085 - RNA, 18 nt, Homo sapiens
uuagacauaacaaaacac

SEQ ID NO: 674086 - RNA, 19 nt, Homo sapiens
uuagacaucuuugcuuaug

SEQ ID NO: 674087 - RNA, 22 nt, Homo sapiens
uuagacaugacugaugacauau

SEQ ID NO: 674088 - RNA, 17 nt, Homo sapiens
uuagaccuguguuacua

SEQ ID NO: 674089 - RNA, 21 nt, Homo sapiens
uugcaaagguuaaaacaaaaa

SEQ ID NO: 674090 - RNA, 17 nt, Homo sapiens
uugcaaauaaaauacua

SEQ ID NO: 674091 - RNA, 11 nt, Homo sapiens
uugcaaccagg

SEQ ID NO: 674092 - RNA, 23 nt, Homo sapiens
uugcaaccaggcagcugagacca

SEQ ID NO: 674093 - RNA, 19 nt, Homo sapiens
uugcaacucacugauucuc

SEQ ID NO: 674094 - RNA, 15 nt, Homo sapiens
uugcaagaaucauua

SEQ ID NO: 674095 - RNA, 22 nt, Homo sapiens
uugcaagacaaaguugaaugua

SEQ ID NO: 674096 - RNA, 12 nt, Homo sapiens
uugcaagccaua

SEQ ID NO: 674097 - RNA, 16 nt, Homo sapiens
uugcacacagauguga

SEQ ID NO: 674098 - RNA, 15 nt, Homo sapiens
uugcacacagguguu

SEQ ID NO: 674099 - RNA, 19 nt, Homo sapiens
uugcacagugugugacuua

SEQ ID NO: 674100 - RNA, 13 nt, Homo sapiens
uugcacauaguag

SEQ ID NO: 674101 - RNA, 14 nt, Homo sapiens
uugcacaugugacc

SEQ ID NO: 674102 - RNA, 14 nt, Homo sapiens
uugcaccacugcac

SEQ ID NO: 674103 - RNA, 15 nt, Homo sapiens
uugcaccauugcacu

SEQ ID NO: 674104 - RNA, 16 nt, Homo sapiens
uugcacgcccaugugu

SEQ ID NO: 674105 - RNA, 18 nt, Homo sapiens
uugcacugaggauauuca

SEQ ID NO: 674106 - RNA, 11 nt, Homo sapiens
uugcacuuugu

SEQ ID NO: 674107 - RNA, 16 nt, Homo sapiens
uugcagaggagcccag

SEQ ID NO: 674108 - RNA, 18 nt, Homo sapiens
uugcagaguccugcacag

SEQ ID NO: 674109 - RNA, 18 nt, Homo sapiens
uugcagccagggccagug

SEQ ID NO: 674110 - RNA, 20 nt, Homo sapiens
uugcagcuuauauucaucca

SEQ ID NO: 674111 - RNA, 18 nt, Homo sapiens
uugcaggaccucagguga

SEQ ID NO: 674112 - RNA, 23 nt, Homo sapiens
uugcaggggauugaagcccucca

SEQ ID NO: 674113 - RNA, 13 nt, Homo sapiens
uugcagggguccc

SEQ ID NO: 674114 - RNA, 16 nt, Homo sapiens
uugcaggguccucuuc

SEQ ID NO: 674115 - RNA, 23 nt, Homo sapiens
uugcagucucccagauguugcau

SEQ ID NO: 674116 - RNA, 15 nt, Homo sapiens
uugcaguugcucuga

SEQ ID NO: 674117 - RNA, 20 nt, Homo sapiens
uugcauaguaccaaucauuu

SEQ ID NO: 674118 - RNA, 22 nt, Homo sapiens
uugcaucccugaaacaucucaa

SEQ ID NO: 674119 - RNA, 20 nt, Homo sapiens
uugcaucucuaauagagauu

SEQ ID NO: 674120 - RNA, 19 nt, Homo sapiens
uugcaucuggguagcugua

SEQ ID NO: 674121 - RNA, 20 nt, Homo sapiens
uugcaucuggguagcuguaa

SEQ ID NO: 674122 - RNA, 18 nt, Homo sapiens
uugcaugaccacauagaa

SEQ ID NO: 674123 - RNA, 18 nt, Homo sapiens
uugcauggaaaucagcca

SEQ ID NO: 674124 - RNA, 24 nt, Homo sapiens
uugcaugggcuaaugaagaucaua

SEQ ID NO: 674125 - RNA, 16 nt, Homo sapiens
uugcauguaugacuua

SEQ ID NO: 674126 - RNA, 16 nt, Homo sapiens
uugcauuuucacaaau

SEQ ID NO: 674127 - RNA, 23 nt, Homo sapiens
uugcauuuuugcaggagcaguau

SEQ ID NO: 674128 - RNA, 22 nt, Homo sapiens
uugccaacauggugaaacucca

SEQ ID NO: 674129 - RNA, 17 nt, Homo sapiens
uugccacacccagguga

SEQ ID NO: 674130 - RNA, 18 nt, Homo sapiens
uugccacggaaacauaca

SEQ ID NO: 674131 - RNA, 16 nt, Homo sapiens
uugccacuacccccuc

SEQ ID NO: 674132 - RNA, 23 nt, Homo sapiens
uugccacuuagaauagcauuugc

SEQ ID NO: 674133 - RNA, 14 nt, Homo sapiens
uugccagaaccaaa

SEQ ID NO: 674134 - RNA, 16 nt, Homo sapiens
uugccagcugcugcug

SEQ ID NO: 674135 - RNA, 19 nt, Homo sapiens
uugccaucggaacugccuu

SEQ ID NO: 674136 - RNA, 21 nt, Homo sapiens
uugccauuucucugcuuaccc

SEQ ID NO: 674137 - RNA, 18 nt, Homo sapiens
uugcccagacuacagggc

SEQ ID NO: 674138 - RNA, 15 nt, Homo sapiens
uugcccagcacuguc

SEQ ID NO: 674139 - RNA, 21 nt, Homo sapiens
uugcccaggcuagagugcaau

SEQ ID NO: 674140 - RNA, 20 nt, Homo sapiens
uugcccaggcuggagugcaa

SEQ ID NO: 674141 - RNA, 21 nt, Homo sapiens
uugcccaggcuggagugcagu

SEQ ID NO: 674142 - RNA, 19 nt, Homo sapiens
uugcccccgacggcuguga

SEQ ID NO: 674143 - RNA, 20 nt, Homo sapiens
uugcccgaaacuaagccagg

SEQ ID NO: 674144 - RNA, 17 nt, Homo sapiens
uugccgcgucgcccucc

SEQ ID NO: 674145 - RNA, 13 nt, Homo sapiens
uugccguaccaau

SEQ ID NO: 674146 - RNA, 21 nt, Homo sapiens
uugccgucucaucuucucuca

SEQ ID NO: 674147 - RNA, 19 nt, Homo sapiens
uugccuauaauacuugcaa

SEQ ID NO: 674148 - RNA, 13 nt, Homo sapiens
uugccucaagacu

SEQ ID NO: 674149 - RNA, 19 nt, Homo sapiens
uugccucaaugccaguaac

SEQ ID NO: 674150 - RNA, 14 nt, Homo sapiens
uugccucaccuaau

SEQ ID NO: 674151 - RNA, 23 nt, Homo sapiens
uugccucccgggcucaagcgauu

SEQ ID NO: 674152 - RNA, 15 nt, Homo sapiens
uugccucuacuuuga

SEQ ID NO: 674153 - RNA, 14 nt, Homo sapiens
uugccugcaaaaau

SEQ ID NO: 674154 - RNA, 20 nt, Homo sapiens
uugccugcaugaaacauguu

SEQ ID NO: 674155 - RNA, 20 nt, Homo sapiens
uugccugggaaacauagcag

SEQ ID NO: 674156 - RNA, 19 nt, Homo sapiens
uugccuggggucugagcau

SEQ ID NO: 674157 - RNA, 13 nt, Homo sapiens
uugccuuuuacuu

SEQ ID NO: 674158 - RNA, 15 nt, Homo sapiens
uugcggaaugcauug

SEQ ID NO: 674159 - RNA, 19 nt, Homo sapiens
uugcguuuguauauccaaa

SEQ ID NO: 674160 - RNA, 15 nt, Homo sapiens
uugcuaaaauauuau

SEQ ID NO: 674161 - RNA, 22 nt, Homo sapiens
uugcuaagaagcgagcacugac

SEQ ID NO: 674162 - RNA, 20 nt, Homo sapiens
uugcuaaguguaugauguca

SEQ ID NO: 674163 - RNA, 22 nt, Homo sapiens
uugcuaauacccaguuacuuau

SEQ ID NO: 674164 - RNA, 18 nt, Homo sapiens
uugcuaauuugccacagg

SEQ ID NO: 674165 - RNA, 12 nt, Homo sapiens
uugcuacauucu

SEQ ID NO: 674166 - RNA, 16 nt, Homo sapiens
uugcuauguugcccaa

SEQ ID NO: 674167 - RNA, 19 nt, Homo sapiens
uugcucauaacagguauca

SEQ ID NO: 674168 - RNA, 20 nt, Homo sapiens
uugcuccagauucugaugca

SEQ ID NO: 674169 - RNA, 13 nt, Homo sapiens
uugcucccugcaa

SEQ ID NO: 674170 - RNA, 15 nt, Homo sapiens
uugcucccugcaaga

SEQ ID NO: 674171 - RNA, 16 nt, Homo sapiens
uugcuccgccuggccu

SEQ ID NO: 674172 - RNA, 23 nt, Homo sapiens
uugcucgcccagacaccaugugc

SEQ ID NO: 674173 - RNA, 19 nt, Homo sapiens
uugcucuacaaugacacac

SEQ ID NO: 674174 - RNA, 16 nt, Homo sapiens
uugaaucaaagugauu

SEQ ID NO: 674175 - RNA, 19 nt, Homo sapiens
uugaaucccuuaaacucag

SEQ ID NO: 674176 - RNA, 18 nt, Homo sapiens
uugaaucuacaacucuga

SEQ ID NO: 674177 - RNA, 22 nt, Homo sapiens
uugaaugaaaaauuuaagcauu

SEQ ID NO: 674178 - RNA, 11 nt, Homo sapiens
uugaaugauga

SEQ ID NO: 674179 - RNA, 15 nt, Homo sapiens
uugaaugcagggaca

SEQ ID NO: 674180 - RNA, 22 nt, Homo sapiens
uugaauggaaaacacauggugu

SEQ ID NO: 674181 - RNA, 12 nt, Homo sapiens
uugaaugucaca

SEQ ID NO: 674182 - RNA, 22 nt, Homo sapiens
uugaauuaauaucccuacaugu

SEQ ID NO: 674183 - RNA, 20 nt, Homo sapiens
uugaauuaauccacacauca

SEQ ID NO: 674184 - RNA, 15 nt, Homo sapiens
uugaauuucagaaaa

SEQ ID NO: 674185 - RNA, 15 nt, Homo sapiens
uugacaaaacccacu

SEQ ID NO: 674186 - RNA, 15 nt, Homo sapiens
uugacaacagacuga

SEQ ID NO: 674187 - RNA, 20 nt, Homo sapiens
uugacacuauucacuaaaau

SEQ ID NO: 674188 - RNA, 11 nt, Homo sapiens
uugacacugaa

SEQ ID NO: 674189 - RNA, 12 nt, Homo sapiens
uugacacugaac

SEQ ID NO: 674190 - RNA, 18 nt, Homo sapiens
uugacagcaaaauguuga

SEQ ID NO: 674191 - RNA, 13 nt, Homo sapiens
uugacagcaugaa

SEQ ID NO: 674192 - RNA, 18 nt, Homo sapiens
uugacaguugcagaauug

SEQ ID NO: 674193 - RNA, 14 nt, Homo sapiens
uugacauaaccaac

SEQ ID NO: 674194 - RNA, 16 nt, Homo sapiens
uugacauacauucccu

SEQ ID NO: 674195 - RNA, 14 nt, Homo sapiens
uugacaucagcauu

SEQ ID NO: 674196 - RNA, 22 nt, Homo sapiens
uugacaucauucaugacaacau

SEQ ID NO: 674197 - RNA, 11 nt, Homo sapiens
uugacaucucu

SEQ ID NO: 674198 - RNA, 20 nt, Homo sapiens
uugacauuagucucagugaa

SEQ ID NO: 674199 - RNA, 17 nt, Homo sapiens
uugaccaagaacugcau

SEQ ID NO: 674200 - RNA, 11 nt, Homo sapiens
uugaccacaga

SEQ ID NO: 674201 - RNA, 18 nt, Homo sapiens
uugaccucaaccugugau

SEQ ID NO: 674202 - RNA, 15 nt, Homo sapiens
uugaccucauuucaa

SEQ ID NO: 674203 - RNA, 17 nt, Homo sapiens
uugaccuccuugacuca

SEQ ID NO: 674204 - RNA, 15 nt, Homo sapiens
uugaccucugugacc

SEQ ID NO: 674205 - RNA, 21 nt, Homo sapiens
uugacgacagugcauuugccu

SEQ ID NO: 674206 - RNA, 21 nt, Homo sapiens
uugacguauauauaaacagaa

SEQ ID NO: 674207 - RNA, 20 nt, Homo sapiens
uugacuauuauagaauggaa

SEQ ID NO: 674208 - RNA, 14 nt, Homo sapiens
uugacucaccugaa

SEQ ID NO: 674209 - RNA, 17 nt, Homo sapiens
uugacucucacacugaa

SEQ ID NO: 674210 - RNA, 15 nt, Homo sapiens
uugacuguacagaga

SEQ ID NO: 674211 - RNA, 21 nt, Homo sapiens
uugacuuacauagaugauaaa

SEQ ID NO: 674212 - RNA, 15 nt, Homo sapiens
uugacuuaccaugga

SEQ ID NO: 674213 - RNA, 13 nt, Homo sapiens
uugagaaaauaua

SEQ ID NO: 674214 - RNA, 20 nt, Homo sapiens
uugagaaccagucuccucac

SEQ ID NO: 674215 - RNA, 13 nt, Homo sapiens
uugagaacugaca

SEQ ID NO: 674216 - RNA, 14 nt, Homo sapiens
uugagaacugacaa

SEQ ID NO: 674217 - RNA, 22 nt, Homo sapiens
uugagaagccuucagcuccagg

SEQ ID NO: 674218 - RNA, 15 nt, Homo sapiens
uugagacauuuacau

SEQ ID NO: 674219 - RNA, 20 nt, Homo sapiens
uugagaccuaaucucuguaa

SEQ ID NO: 674220 - RNA, 19 nt, Homo sapiens
uugagaccuggaaccagag

SEQ ID NO: 674221 - RNA, 18 nt, Homo sapiens
uugagacuauaaagcagu

SEQ ID NO: 674222 - RNA, 16 nt, Homo sapiens
uugagacuuccaaagg

SEQ ID NO: 674223 - RNA, 16 nt, Homo sapiens
uugagagcaacgucac

SEQ ID NO: 674224 - RNA, 14 nt, Homo sapiens
uugagagcuuucug

SEQ ID NO: 674225 - RNA, 23 nt, Homo sapiens
uugagaguauauuauguauuuau

SEQ ID NO: 674226 - RNA, 23 nt, Homo sapiens
uugagauaaagucaaaugccaaa

SEQ ID NO: 674227 - RNA, 17 nt, Homo sapiens
uugagauacuaucauua

SEQ ID NO: 674228 - RNA, 18 nt, Homo sapiens
uugagauguaugaaggcu

SEQ ID NO: 674229 - RNA, 20 nt, Homo sapiens
uugagauguuguguggcaau

SEQ ID NO: 674230 - RNA, 21 nt, Homo sapiens
uugagauuauucuuuguuucc

SEQ ID NO: 674231 - RNA, 19 nt, Homo sapiens
uugagcacacuuuacacaa

SEQ ID NO: 674232 - RNA, 16 nt, Homo sapiens
uugagccaguggugcu

SEQ ID NO: 674233 - RNA, 18 nt, Homo sapiens
uugagccuggcuguccaa

SEQ ID NO: 674234 - RNA, 22 nt, Homo sapiens
uugagcgugaaucuguaucuug

SEQ ID NO: 674235 - RNA, 14 nt, Homo sapiens
uugagcguuugcac

SEQ ID NO: 674236 - RNA, 14 nt, Homo sapiens
uugagcuacuucaa

SEQ ID NO: 674237 - RNA, 18 nt, Homo sapiens
uugagcugcugacugcca

SEQ ID NO: 674238 - RNA, 14 nt, Homo sapiens
uugaggaauuauca

SEQ ID NO: 674239 - RNA, 18 nt, Homo sapiens
uugaggagcugcacugau

SEQ ID NO: 674240 - RNA, 20 nt, Homo sapiens
uugaggauuguggaaaacca

SEQ ID NO: 674241 - RNA, 13 nt, Homo sapiens
uugaggccaaaca

SEQ ID NO: 674242 - RNA, 11 nt, Homo sapiens
uugagggauaa

SEQ ID NO: 674243 - RNA, 16 nt, Homo sapiens
uugagggaugcuggaa

SEQ ID NO: 674244 - RNA, 22 nt, Homo sapiens
uugagguaauaaugacacuccu

SEQ ID NO: 674245 - RNA, 21 nt, Homo sapiens
uugagguggugccuucucaca

SEQ ID NO: 674246 - RNA, 11 nt, Homo sapiens
uugaguaccaa

SEQ ID NO: 674247 - RNA, 19 nt, Homo sapiens
uugaguagaguugaucaaa

SEQ ID NO: 674248 - RNA, 13 nt, Homo sapiens
uugaguagaucca

SEQ ID NO: 674249 - RNA, 16 nt, Homo sapiens
uugagucaccaugcca

SEQ ID NO: 674250 - RNA, 19 nt, Homo sapiens
uugagucagaaaacagaga

SEQ ID NO: 674251 - RNA, 16 nt, Homo sapiens
uugagugcacuaaaca

SEQ ID NO: 674252 - RNA, 15 nt, Homo sapiens
uugagugcacugacu

SEQ ID NO: 674253 - RNA, 19 nt, Homo sapiens
uugagugcacugacuguga

SEQ ID NO: 674254 - RNA, 23 nt, Homo sapiens
uugauaagcuauugucuguaaua

SEQ ID NO: 674255 - RNA, 21 nt, Homo sapiens
uugauaauauuagugauucug

SEQ ID NO: 674256 - RNA, 14 nt, Homo sapiens
uugauaaucuucag

SEQ ID NO: 674257 - RNA, 17 nt, Homo sapiens
uugauacaaaguacaga

SEQ ID NO: 674258 - RNA, 13 nt, Homo sapiens
uugcucuccuaga

SEQ ID NO: 674259 - RNA, 17 nt, Homo sapiens
uugcucuuuucaaugug

SEQ ID NO: 674260 - RNA, 17 nt, Homo sapiens
uugcugaaaaugguauu

SEQ ID NO: 674261 - RNA, 20 nt, Homo sapiens
uugcugaagugguugcauuc

SEQ ID NO: 674262 - RNA, 18 nt, Homo sapiens
uugcugacaggugaugcu

SEQ ID NO: 674263 - RNA, 22 nt, Homo sapiens
uugcugaccauuuuggauguca

SEQ ID NO: 674264 - RNA, 14 nt, Homo sapiens
uugcugaugcuccu

SEQ ID NO: 674265 - RNA, 18 nt, Homo sapiens
uugcugauggcuugacau

SEQ ID NO: 674266 - RNA, 20 nt, Homo sapiens
uugcugauggguaguaccug

SEQ ID NO: 674267 - RNA, 13 nt, Homo sapiens
uugcugcaucucc

SEQ ID NO: 674268 - RNA, 21 nt, Homo sapiens
uugcugcaucuccccucagau

SEQ ID NO: 674269 - RNA, 12 nt, Homo sapiens
uugcugccacaa

SEQ ID NO: 674270 - RNA, 14 nt, Homo sapiens
uugcugcuugugau

SEQ ID NO: 674271 - RNA, 14 nt, Homo sapiens
uugcugcuuuccag

SEQ ID NO: 674272 - RNA, 22 nt, Homo sapiens
uugcuggaggggcuguccuccu

SEQ ID NO: 674273 - RNA, 16 nt, Homo sapiens
uugcuggcucugagaa

SEQ ID NO: 674274 - RNA, 18 nt, Homo sapiens
uugcugguagcacuugcu

SEQ ID NO: 674275 - RNA, 16 nt, Homo sapiens
uugcuggucuagucac

SEQ ID NO: 674276 - RNA, 16 nt, Homo sapiens
uugcuggugcaaagau

SEQ ID NO: 674277 - RNA, 22 nt, Homo sapiens
uugcuguaacucagacauucca

SEQ ID NO: 674278 - RNA, 11 nt, Homo sapiens
uugcuguagaa

SEQ ID NO: 674279 - RNA, 21 nt, Homo sapiens
uugcugucauaagaaugaaua

SEQ ID NO: 674280 - RNA, 13 nt, Homo sapiens
uugcuguguaaaa

SEQ ID NO: 674281 - RNA, 16 nt, Homo sapiens
uugcuguucugcugaa

SEQ ID NO: 674282 - RNA, 15 nt, Homo sapiens
uugcuguuugcaauu

SEQ ID NO: 674283 - RNA, 14 nt, Homo sapiens
uugcuuaaaucagu

SEQ ID NO: 674284 - RNA, 17 nt, Homo sapiens
uugcuuauguaaucuca

SEQ ID NO: 674285 - RNA, 21 nt, Homo sapiens
uugcuucuagagcuuagcaua

SEQ ID NO: 674286 - RNA, 15 nt, Homo sapiens
uugcuucuugccauc

SEQ ID NO: 674287 - RNA, 13 nt, Homo sapiens
uugcuugcaaugu

SEQ ID NO: 674288 - RNA, 19 nt, Homo sapiens
uugcuuggaagccagguac

SEQ ID NO: 674289 - RNA, 23 nt, Homo sapiens
uugcuuggugcacagauugcuga

SEQ ID NO: 674290 - RNA, 17 nt, Homo sapiens
uugcuugucuugauuaa

SEQ ID NO: 674291 - RNA, 18 nt, Homo sapiens
uugcuugugccacacccu

SEQ ID NO: 674292 - RNA, 12 nt, Homo sapiens
uugcuuuacucu

SEQ ID NO: 674293 - RNA, 10 nt, Homo sapiens
uugcuuuaug

SEQ ID NO: 674294 - RNA, 17 nt, Homo sapiens
uugggaagggcagggaa

SEQ ID NO: 674295 - RNA, 16 nt, Homo sapiens
uugggacccaaaacac

SEQ ID NO: 674296 - RNA, 12 nt, Homo sapiens
uugggaccucag

SEQ ID NO: 674297 - RNA, 20 nt, Homo sapiens
uugggacgcacagugcaguu

SEQ ID NO: 674298 - RNA, 23 nt, Homo sapiens
uugggagacauggaccagcaucu

SEQ ID NO: 674299 - RNA, 16 nt, Homo sapiens
uugggagacaugugac

SEQ ID NO: 674300 - RNA, 17 nt, Homo sapiens
uugggagacaugugaca

SEQ ID NO: 674301 - RNA, 20 nt, Homo sapiens
uugggagagcccugcuccca

SEQ ID NO: 674302 - RNA, 21 nt, Homo sapiens
uugggagcaccgccugugaaa

SEQ ID NO: 674303 - RNA, 14 nt, Homo sapiens
uugggaggccaagg

SEQ ID NO: 674304 - RNA, 20 nt, Homo sapiens
uugggauugagucugugcca

SEQ ID NO: 674305 - RNA, 12 nt, Homo sapiens
uugggcauguga

SEQ ID NO: 674306 - RNA, 17 nt, Homo sapiens
uugggccagcuuuucaa

SEQ ID NO: 674307 - RNA, 15 nt, Homo sapiens
uugggcccuuugagu

SEQ ID NO: 674308 - RNA, 20 nt, Homo sapiens
uugggccucccuggcacuga

SEQ ID NO: 674309 - RNA, 15 nt, Homo sapiens
uugggccucuuguac

SEQ ID NO: 674310 - RNA, 17 nt, Homo sapiens
uuggggauucaaaaaca

SEQ ID NO: 674311 - RNA, 17 nt, Homo sapiens
uugggggaaaaaaaaga

SEQ ID NO: 674312 - RNA, 23 nt, Homo sapiens
uugggggcucggggaggcagaga

SEQ ID NO: 674313 - RNA, 19 nt, Homo sapiens
uugggguauaggucucauc

SEQ ID NO: 674314 - RNA, 13 nt, Homo sapiens
uuggggucaggaa

SEQ ID NO: 674315 - RNA, 13 nt, Homo sapiens
uugggucuugggg

SEQ ID NO: 674316 - RNA, 12 nt, Homo sapiens
uugggugccuuu

SEQ ID NO: 674317 - RNA, 18 nt, Homo sapiens
uugguaaaaaugcugcuc

SEQ ID NO: 674318 - RNA, 24 nt, Homo sapiens
uugguaccccuaaaaagauugcca

SEQ ID NO: 674319 - RNA, 16 nt, Homo sapiens
uugguaccuauuugac

SEQ ID NO: 674320 - RNA, 16 nt, Homo sapiens
uugguacuauggugug

SEQ ID NO: 674321 - RNA, 19 nt, Homo sapiens
uugguacuuauuacugcua

SEQ ID NO: 674322 - RNA, 21 nt, Homo sapiens
uugguacuuauuacugcuaag

SEQ ID NO: 674323 - RNA, 14 nt, Homo sapiens
uugguacuuuuaug

SEQ ID NO: 674324 - RNA, 15 nt, Homo sapiens
uugguagacuuggac

SEQ ID NO: 674325 - RNA, 14 nt, Homo sapiens
uuggucacauauca

SEQ ID NO: 674326 - RNA, 20 nt, Homo sapiens
uuggucaugugggucuucca

SEQ ID NO: 674327 - RNA, 19 nt, Homo sapiens
uuggucaugugguacuuga

SEQ ID NO: 674328 - RNA, 18 nt, Homo sapiens
uuggucccucucagauac

SEQ ID NO: 674329 - RNA, 12 nt, Homo sapiens
aaaaaaacugaa

SEQ ID NO: 674330 - RNA, 12 nt, Homo sapiens
aaaaaaccacaa

SEQ ID NO: 674331 - RNA, 18 nt, Homo sapiens
aaaaaaccuucagugaaa

SEQ ID NO: 674332 - RNA, 13 nt, Homo sapiens
aaaaaacuacuuc

SEQ ID NO: 674333 - RNA, 14 nt, Homo sapiens
aaaaaacucuugau

SEQ ID NO: 674334 - RNA, 20 nt, Homo sapiens
aaaaaaguaaguaccacuca

SEQ ID NO: 674335 - RNA, 12 nt, Homo sapiens
aaaaaagucaga

SEQ ID NO: 674336 - RNA, 19 nt, Homo sapiens
caguccuauuuuucaaugg

SEQ ID NO: 674337 - RNA, 14 nt, Homo sapiens
caguccucaucucc

SEQ ID NO: 674338 - RNA, 18 nt, Homo sapiens
augucuagccacugauca

SEQ ID NO: 674339 - RNA, 16 nt, Homo sapiens
augucuauaacuccuu

SEQ ID NO: 674340 - RNA, 22 nt, Homo sapiens
augucuauaaucccagcacuuu

SEQ ID NO: 674341 - RNA, 16 nt, Homo sapiens
augucuauucagcuuc

SEQ ID NO: 674342 - RNA, 21 nt, Homo sapiens
augucucuaagccaacuuuaa

SEQ ID NO: 674343 - RNA, 23 nt, Homo sapiens
augucucucuugagcuacaguag

SEQ ID NO: 674344 - RNA, 11 nt, Homo sapiens
augucuguccu

SEQ ID NO: 674345 - RNA, 23 nt, Homo sapiens
augucugugggcaggaagugaag

SEQ ID NO: 674346 - RNA, 20 nt, Homo sapiens
augucuuaaauaaaacuauu

SEQ ID NO: 674347 - RNA, 17 nt, Homo sapiens
augucuuaaugcaaauu

SEQ ID NO: 674348 - RNA, 22 nt, Homo sapiens
augugaaaacccaucucuacaa

SEQ ID NO: 674349 - RNA, 15 nt, Homo sapiens
augugaaacaucuuc

SEQ ID NO: 674350 - RNA, 22 nt, Homo sapiens
augugaauaaauucuauaggaa

SEQ ID NO: 674351 - RNA, 20 nt, Homo sapiens
augugaauuauugacacuga

SEQ ID NO: 674352 - RNA, 21 nt, Homo sapiens
augugaauuauugacacugaa

SEQ ID NO: 674353 - RNA, 17 nt, Homo sapiens
augugacaugcccaagg

SEQ ID NO: 674354 - RNA, 16 nt, Homo sapiens
augugacauuccauga

SEQ ID NO: 674355 - RNA, 13 nt, Homo sapiens
augugacccucca

SEQ ID NO: 674356 - RNA, 19 nt, Homo sapiens
augugacugugacuuucaa

SEQ ID NO: 674357 - RNA, 15 nt, Homo sapiens
augugacuugcaaua

SEQ ID NO: 674358 - RNA, 22 nt, Homo sapiens
augugacuugcgcuuaauccaa

SEQ ID NO: 674359 - RNA, 18 nt, Homo sapiens
augugagauuacuuuguc

SEQ ID NO: 674360 - RNA, 17 nt, Homo sapiens
augugagcuguaaaaau

SEQ ID NO: 674361 - RNA, 21 nt, Homo sapiens
augugagugccuuuugcagaa

SEQ ID NO: 674362 - RNA, 17 nt, Homo sapiens
augugaguuuccugcua

SEQ ID NO: 674363 - RNA, 22 nt, Homo sapiens
augugauaacgagguuccagua

SEQ ID NO: 674364 - RNA, 13 nt, Homo sapiens
augugauacaaau

SEQ ID NO: 674365 - RNA, 17 nt, Homo sapiens
augugauggacacucca

SEQ ID NO: 674366 - RNA, 13 nt, Homo sapiens
augugauggacug

SEQ ID NO: 674367 - RNA, 20 nt, Homo sapiens
augugauggauggcacaaug

SEQ ID NO: 674368 - RNA, 22 nt, Homo sapiens
augugauggauggcacaaugaa

SEQ ID NO: 674369 - RNA, 14 nt, Homo sapiens
augugauugcagcu

SEQ ID NO: 674370 - RNA, 18 nt, Homo sapiens
augugcaaccacugcuuc

SEQ ID NO: 674371 - RNA, 11 nt, Homo sapiens
augugcaauau

SEQ ID NO: 674372 - RNA, 17 nt, Homo sapiens
augugcagauaucacag

SEQ ID NO: 674373 - RNA, 19 nt, Homo sapiens
augugcagguuuugaaaau

SEQ ID NO: 674374 - RNA, 13 nt, Homo sapiens
augugccaaagcu

SEQ ID NO: 674375 - RNA, 13 nt, Homo sapiens
augugccuuuagu

SEQ ID NO: 674376 - RNA, 22 nt, Homo sapiens
augugcuauuggcccagcuuuu

SEQ ID NO: 674377 - RNA, 17 nt, Homo sapiens
augugcuggacacuguc

SEQ ID NO: 674378 - RNA, 16 nt, Homo sapiens
augugcuuuagcauaa

SEQ ID NO: 674379 - RNA, 14 nt, Homo sapiens
auguggacgugcac

SEQ ID NO: 674380 - RNA, 19 nt, Homo sapiens
auguggagcucagcaacaa

SEQ ID NO: 674381 - RNA, 21 nt, Homo sapiens
auguggagcucagcaacaagg

SEQ ID NO: 674382 - RNA, 12 nt, Homo sapiens
auguggauauca

SEQ ID NO: 674383 - RNA, 22 nt, Homo sapiens
auguggcaaggaaaaacagguc

SEQ ID NO: 674384 - RNA, 17 nt, Homo sapiens
auguggccuuuaucuca

SEQ ID NO: 674385 - RNA, 20 nt, Homo sapiens
auguggcuggaagauccugc

SEQ ID NO: 674386 - RNA, 18 nt, Homo sapiens
augugggagggagcagac

SEQ ID NO: 674387 - RNA, 22 nt, Homo sapiens
augugggguccccaucauccca

SEQ ID NO: 674388 - RNA, 23 nt, Homo sapiens
augugggguugcugaagaugccu

SEQ ID NO: 674389 - RNA, 21 nt, Homo sapiens
augugggugucagucagggac

SEQ ID NO: 674390 - RNA, 15 nt, Homo sapiens
augugguagccucac

SEQ ID NO: 674391 - RNA, 13 nt, Homo sapiens
auguggucaugga

SEQ ID NO: 674392 - RNA, 12 nt, Homo sapiens
auguggucucag

SEQ ID NO: 674393 - RNA, 20 nt, Homo sapiens
augugguguauauccuucca

SEQ ID NO: 674394 - RNA, 18 nt, Homo sapiens
augugguucagugccuuc

SEQ ID NO: 674395 - RNA, 20 nt, Homo sapiens
auguguagggaaaguuaaaa

SEQ ID NO: 674396 - RNA, 12 nt, Homo sapiens
auguguauauau

SEQ ID NO: 674397 - RNA, 16 nt, Homo sapiens
augugucaacugagag

SEQ ID NO: 674398 - RNA, 16 nt, Homo sapiens
auguguccaagacaca

SEQ ID NO: 674399 - RNA, 17 nt, Homo sapiens
augugucccagccacag

SEQ ID NO: 674400 - RNA, 22 nt, Homo sapiens
auguguccccucacucugucag

SEQ ID NO: 674401 - RNA, 17 nt, Homo sapiens
augugucuuaccagauc

SEQ ID NO: 674402 - RNA, 12 nt, Homo sapiens
augugucuucaa

SEQ ID NO: 674403 - RNA, 19 nt, Homo sapiens
augugugaaaaagaugcca

SEQ ID NO: 674404 - RNA, 16 nt, Homo sapiens
augugugaugcaaaug

SEQ ID NO: 674405 - RNA, 12 nt, Homo sapiens
augugugcaaaa

SEQ ID NO: 674406 - RNA, 16 nt, Homo sapiens
auguguuaagugcagg

SEQ ID NO: 674407 - RNA, 17 nt, Homo sapiens
auguguuauuacuuccu

SEQ ID NO: 674408 - RNA, 22 nt, Homo sapiens
acuggaucuucuaucauuccaa

SEQ ID NO: 674409 - RNA, 16 nt, Homo sapiens
acuggauucauucuca

SEQ ID NO: 674410 - RNA, 17 nt, Homo sapiens
acuggauucauucucau

SEQ ID NO: 674411 - RNA, 19 nt, Homo sapiens
acuggauuuuugcucugcc

SEQ ID NO: 674412 - RNA, 22 nt, Homo sapiens
acuggcaaagcagaaugugaua

SEQ ID NO: 674413 - RNA, 15 nt, Homo sapiens
acuggcaauaaacuc

SEQ ID NO: 674414 - RNA, 17 nt, Homo sapiens
acuggcaauaaacuccu

SEQ ID NO: 674415 - RNA, 19 nt, Homo sapiens
acuggcaauaaacuccuac

SEQ ID NO: 674416 - RNA, 21 nt, Homo sapiens
acuggcaauaaacuccuacua

SEQ ID NO: 674417 - RNA, 18 nt, Homo sapiens
acuggcaguaaccuagug

SEQ ID NO: 674418 - RNA, 23 nt, Homo sapiens
acuggccagagagggcccagcug

SEQ ID NO: 674419 - RNA, 15 nt, Homo sapiens
acuggccgagcugcu

SEQ ID NO: 674420 - RNA, 20 nt, Homo sapiens
acuggccucugugauuacau

SEQ ID NO: 674421 - RNA, 21 nt, Homo sapiens
acuggcuggccagucuggguc

SEQ ID NO: 674422 - RNA, 23 nt, Homo sapiens
acuggcugggaguccuuaccucg

SEQ ID NO: 674423 - RNA, 19 nt, Homo sapiens
acuggcuucucuugaguca

SEQ ID NO: 674424 - RNA, 21 nt, Homo sapiens
acugggaccgugcgagcugcc

SEQ ID NO: 674425 - RNA, 20 nt, Homo sapiens
acugggagaaaugacuuuga

SEQ ID NO: 674426 - RNA, 18 nt, Homo sapiens
acugggaggcagggcucu

SEQ ID NO: 674427 - RNA, 22 nt, Homo sapiens
acugggaugagccgcugugagc

SEQ ID NO: 674428 - RNA, 21 nt, Homo sapiens
acugggaugccugucuugagu

SEQ ID NO: 674429 - RNA, 18 nt, Homo sapiens
acugggcgugguggcuca

SEQ ID NO: 674430 - RNA, 14 nt, Homo sapiens
acugggcucaagag

SEQ ID NO: 674431 - RNA, 20 nt, Homo sapiens
acugggcuccggaggacuca

SEQ ID NO: 674432 - RNA, 20 nt, Homo sapiens
acuggggagucuuuguggau

SEQ ID NO: 674433 - RNA, 23 nt, Homo sapiens
acuggguguugaucuuacaagau

SEQ ID NO: 674434 - RNA, 21 nt, Homo sapiens
acuggguuuggaccccagcug

SEQ ID NO: 674435 - RNA, 21 nt, Homo sapiens
acugguaaaaagauccaggga

SEQ ID NO: 674436 - RNA, 13 nt, Homo sapiens
acugguaaagccu

SEQ ID NO: 674437 - RNA, 19 nt, Homo sapiens
acugguagaaaggcaguuc

SEQ ID NO: 674438 - RNA, 17 nt, Homo sapiens
acugguagguugggaca

SEQ ID NO: 674439 - RNA, 16 nt, Homo sapiens
acugguauuaacuuua

SEQ ID NO: 674440 - RNA, 16 nt, Homo sapiens
acugguccagcucuga

SEQ ID NO: 674441 - RNA, 18 nt, Homo sapiens
acugguccagcucugaca

SEQ ID NO: 674442 - RNA, 17 nt, Homo sapiens
acuggugcacuuuguaa

SEQ ID NO: 674443 - RNA, 22 nt, Homo sapiens
acuggugguucuacugacccaa

SEQ ID NO: 674444 - RNA, 23 nt, Homo sapiens
acugguucauauuggacugauaa

SEQ ID NO: 674445 - RNA, 16 nt, Homo sapiens
acugguuguucuguua

SEQ ID NO: 674446 - RNA, 17 nt, Homo sapiens
acugguuguugccaaac

SEQ ID NO: 674447 - RNA, 16 nt, Homo sapiens
acugguuuacacuuua

SEQ ID NO: 674448 - RNA, 23 nt, Homo sapiens
acuguaaacucuaucagcauugu

SEQ ID NO: 674449 - RNA, 13 nt, Homo sapiens
acuguaaagacaa

SEQ ID NO: 674450 - RNA, 16 nt, Homo sapiens
acuguaacacuuuaca

SEQ ID NO: 674451 - RNA, 20 nt, Homo sapiens
acuguaaugagucagugaag

SEQ ID NO: 674452 - RNA, 14 nt, Homo sapiens
acuguacauuguga

SEQ ID NO: 674453 - RNA, 17 nt, Homo sapiens
acuguacauugugagcu

SEQ ID NO: 674454 - RNA, 17 nt, Homo sapiens
acuguaccgacuuugau

SEQ ID NO: 674455 - RNA, 12 nt, Homo sapiens
acuguacuggcc

SEQ ID NO: 674456 - RNA, 23 nt, Homo sapiens
acuguagaaaugaugauguggaa

SEQ ID NO: 674457 - RNA, 16 nt, Homo sapiens
acuguagcugaugaaa

SEQ ID NO: 674458 - RNA, 17 nt, Homo sapiens
acuguaggaacaagcau

SEQ ID NO: 674459 - RNA, 20 nt, Homo sapiens
auuacuauugcaaaagggaa

SEQ ID NO: 674460 - RNA, 23 nt, Homo sapiens
auuacugaguuuuuuauuccagu

SEQ ID NO: 674461 - RNA, 15 nt, Homo sapiens
auuacugaugugaua

SEQ ID NO: 674462 - RNA, 13 nt, Homo sapiens
auuacugccuuac

SEQ ID NO: 674463 - RNA, 21 nt, Homo sapiens
auuacugcuaaguauuuccca

SEQ ID NO: 674464 - RNA, 20 nt, Homo sapiens
auuacuggaaggcuuccacu

SEQ ID NO: 674465 - RNA, 15 nt, Homo sapiens
auuacuggaucucuu

SEQ ID NO: 674466 - RNA, 15 nt, Homo sapiens
auuacugguccaaaa

SEQ ID NO: 674467 - RNA, 16 nt, Homo sapiens
auuacugguccaaaag

SEQ ID NO: 674468 - RNA, 13 nt, Homo sapiens
auuacugucuuua

SEQ ID NO: 674469 - RNA, 13 nt, Homo sapiens
auuacugugaauu

SEQ ID NO: 674470 - RNA, 20 nt, Homo sapiens
auuacuguugcauuuacuuu

SEQ ID NO: 674471 - RNA, 16 nt, Homo sapiens
auuacuugugcacuua

SEQ ID NO: 674472 - RNA, 20 nt, Homo sapiens
auuacuuuucuuacucugaa

SEQ ID NO: 674473 - RNA, 23 nt, Homo sapiens
auuacuuuugauccugggggacc

SEQ ID NO: 674474 - RNA, 15 nt, Homo sapiens
auuagaagucuuuca

SEQ ID NO: 674475 - RNA, 14 nt, Homo sapiens
auuagaaugcaugu

SEQ ID NO: 674476 - RNA, 18 nt, Homo sapiens
auuagagagcaucugcaa

SEQ ID NO: 674477 - RNA, 18 nt, Homo sapiens
auuagaucaauuacuuau

SEQ ID NO: 674478 - RNA, 16 nt, Homo sapiens
auuagaugaacucaac

SEQ ID NO: 674479 - RNA, 19 nt, Homo sapiens
auuagccuugaacaaccag

SEQ ID NO: 674480 - RNA, 13 nt, Homo sapiens
auuagcucacuga

SEQ ID NO: 674481 - RNA, 10 nt, Homo sapiens
auuagcugug

SEQ ID NO: 674482 - RNA, 16 nt, Homo sapiens
auuaggcaaaguacaa

SEQ ID NO: 674483 - RNA, 15 nt, Homo sapiens
auuaguaacugcaca

SEQ ID NO: 674484 - RNA, 14 nt, Homo sapiens
auuagugacuucaa

SEQ ID NO: 674485 - RNA, 22 nt, Homo sapiens
auuaguuuaccucauccaugca

SEQ ID NO: 674486 - RNA, 24 nt, Homo sapiens
auuaguuuaccucauccaugcacu

SEQ ID NO: 674487 - RNA, 16 nt, Homo sapiens
auuauaaaauggacac

SEQ ID NO: 674488 - RNA, 22 nt, Homo sapiens
auuauaaauaaauagauguguc

SEQ ID NO: 674489 - RNA, 14 nt, Homo sapiens
auuauaagcauaca

SEQ ID NO: 674490 - RNA, 20 nt, Homo sapiens
auuauacaggaaagcaauau

SEQ ID NO: 674491 - RNA, 13 nt, Homo sapiens
auuauacauuuga

SEQ ID NO: 674492 - RNA, 24 nt, Homo sapiens
auuauacgcuggcaacacagaggc

SEQ ID NO: 674493 - RNA, 20 nt, Homo sapiens
auuauagaaacaauacuguu

SEQ ID NO: 674494 - RNA, 21 nt, Homo sapiens
auuauagaaacaauacuguuc

SEQ ID NO: 674495 - RNA, 16 nt, Homo sapiens
auuauagccacauccc

SEQ ID NO: 674496 - RNA, 23 nt, Homo sapiens
auuauauaaagggugacuuacau

SEQ ID NO: 674497 - RNA, 16 nt, Homo sapiens
auuauauuagucuguu

SEQ ID NO: 674498 - RNA, 20 nt, Homo sapiens
auuauauugucgaauuccua

SEQ ID NO: 674499 - RNA, 13 nt, Homo sapiens
auuaucaacagca

SEQ ID NO: 674500 - RNA, 16 nt, Homo sapiens
auuaucaacagcauuu

SEQ ID NO: 674501 - RNA, 16 nt, Homo sapiens
auuaucacaugauuau

SEQ ID NO: 674502 - RNA, 12 nt, Homo sapiens
auuaucauccca

SEQ ID NO: 674503 - RNA, 14 nt, Homo sapiens
auuauccuugcuau

SEQ ID NO: 674504 - RNA, 16 nt, Homo sapiens
auuaucuauuaucuca

SEQ ID NO: 674505 - RNA, 22 nt, Homo sapiens
auuaucugugucaaaagccaga

SEQ ID NO: 674506 - RNA, 19 nt, Homo sapiens
auuaucuugauacauucaa

SEQ ID NO: 674507 - RNA, 20 nt, Homo sapiens
auuaucuuuaauaaaauguu

SEQ ID NO: 674508 - RNA, 11 nt, Homo sapiens
auuaugacaau

SEQ ID NO: 674509 - RNA, 15 nt, Homo sapiens
auuaugccacuuccu

SEQ ID NO: 674510 - RNA, 14 nt, Homo sapiens
auuaugcucuuaau

SEQ ID NO: 674511 - RNA, 20 nt, Homo sapiens
auuauggcaagugauaucac

SEQ ID NO: 674512 - RNA, 20 nt, Homo sapiens
auuaugggcgugaaccacca

SEQ ID NO: 674513 - RNA, 15 nt, Homo sapiens
auuauguauguuuac

SEQ ID NO: 674514 - RNA, 22 nt, Homo sapiens
auuaugugaaaugcuuaugcuu

SEQ ID NO: 674515 - RNA, 22 nt, Homo sapiens
auuauguuuugcauguaugacu

SEQ ID NO: 674516 - RNA, 14 nt, Homo sapiens
auuauuaacaaagu

SEQ ID NO: 674517 - RNA, 16 nt, Homo sapiens
auuauuaacauaccua

SEQ ID NO: 674518 - RNA, 13 nt, Homo sapiens
auuauuaauugca

SEQ ID NO: 674519 - RNA, 14 nt, Homo sapiens
auuauucaaaaaca

SEQ ID NO: 674520 - RNA, 18 nt, Homo sapiens
auuauucaagugccucuu

SEQ ID NO: 674521 - RNA, 14 nt, Homo sapiens
auuauuccaaaguu

SEQ ID NO: 674522 - RNA, 15 nt, Homo sapiens
auuauuccuccagga

SEQ ID NO: 674523 - RNA, 20 nt, Homo sapiens
auuauucuuguaguuuaccu

SEQ ID NO: 674524 - RNA, 17 nt, Homo sapiens
auuauucuuuguuuccu

SEQ ID NO: 674525 - RNA, 19 nt, Homo sapiens
auuauugaaauuguacaua

SEQ ID NO: 674526 - RNA, 19 nt, Homo sapiens
auuauugacacugaacuua

SEQ ID NO: 674527 - RNA, 18 nt, Homo sapiens
auuauuguagacaugccc

SEQ ID NO: 674528 - RNA, 22 nt, Homo sapiens
auuauuguuccccuaaguggau

SEQ ID NO: 674529 - RNA, 15 nt, Homo sapiens
auuauuuaauuugua

SEQ ID NO: 674530 - RNA, 14 nt, Homo sapiens
auuauuuaucacau

SEQ ID NO: 674531 - RNA, 21 nt, Homo sapiens
auuauuuaucagcccuauucu

SEQ ID NO: 674532 - RNA, 14 nt, Homo sapiens
auuauuuccacuug

SEQ ID NO: 674533 - RNA, 20 nt, Homo sapiens
acuucagugggacucgguga

SEQ ID NO: 674534 - RNA, 12 nt, Homo sapiens
acuucagugugu

SEQ ID NO: 674535 - RNA, 15 nt, Homo sapiens
acuucaguugaucuu

SEQ ID NO: 674536 - RNA, 23 nt, Homo sapiens
acuucaguuuuauuuuugccaag

SEQ ID NO: 674537 - RNA, 18 nt, Homo sapiens
acuucauauugcugagag

SEQ ID NO: 674538 - RNA, 17 nt, Homo sapiens
acuucauauuguugcau

SEQ ID NO: 674539 - RNA, 22 nt, Homo sapiens
acuucaucaguguggcuucuau

SEQ ID NO: 674540 - RNA, 14 nt, Homo sapiens
acuucauggaucag

SEQ ID NO: 674541 - RNA, 22 nt, Homo sapiens
acuucauggucccaaaauguca

SEQ ID NO: 674542 - RNA, 12 nt, Homo sapiens
acuucauucucg

SEQ ID NO: 674543 - RNA, 18 nt, Homo sapiens
acuucauuugaugcuaaa

SEQ ID NO: 674544 - RNA, 19 nt, Homo sapiens
acuucauuugaugcuaaau

SEQ ID NO: 674545 - RNA, 19 nt, Homo sapiens
acuuccaagacaagauacc

SEQ ID NO: 674546 - RNA, 16 nt, Homo sapiens
acuuccacucgaugau

SEQ ID NO: 674547 - RNA, 16 nt, Homo sapiens
acuuccacugccaucc

SEQ ID NO: 674548 - RNA, 14 nt, Homo sapiens
acuuccauuugcuu

SEQ ID NO: 674549 - RNA, 22 nt, Homo sapiens
acuucccaaguguaagacucug

SEQ ID NO: 674550 - RNA, 20 nt, Homo sapiens
acuucccaucuccagggaag

SEQ ID NO: 674551 - RNA, 16 nt, Homo sapiens
acuuccccuucuugcc

SEQ ID NO: 674552 - RNA, 20 nt, Homo sapiens
acuuccccuucuugccauua

SEQ ID NO: 674553 - RNA, 22 nt, Homo sapiens
acuucccgucccauauccugcc

SEQ ID NO: 674554 - RNA, 16 nt, Homo sapiens
acuucccuacauggag

SEQ ID NO: 674555 - RNA, 11 nt, Homo sapiens
acuucccugaa

SEQ ID NO: 674556 - RNA, 18 nt, Homo sapiens
acuuccuacguauccugc

SEQ ID NO: 674557 - RNA, 15 nt, Homo sapiens
acuuccuccuaccug

SEQ ID NO: 674558 - RNA, 15 nt, Homo sapiens
acuuccucugccaug

SEQ ID NO: 674559 - RNA, 21 nt, Homo sapiens
acuuccucuucuucauugcag

SEQ ID NO: 674560 - RNA, 13 nt, Homo sapiens
acuuccugcagug

SEQ ID NO: 674561 - RNA, 16 nt, Homo sapiens
acuuccugccauggau

SEQ ID NO: 674562 - RNA, 20 nt, Homo sapiens
acuuccugccauggaucucu

SEQ ID NO: 674563 - RNA, 18 nt, Homo sapiens
acuuccuucaaucuucau

SEQ ID NO: 674564 - RNA, 13 nt, Homo sapiens
acuuccuugcucu

SEQ ID NO: 674565 - RNA, 16 nt, Homo sapiens
acuuccuugcucuccc

SEQ ID NO: 674566 - RNA, 19 nt, Homo sapiens
acuuccuuggaaacagagc

SEQ ID NO: 674567 - RNA, 14 nt, Homo sapiens
acuucgaaaccugg

SEQ ID NO: 674568 - RNA, 16 nt, Homo sapiens
acuucgaaaccuggga

SEQ ID NO: 674569 - RNA, 14 nt, Homo sapiens
acuucgagcacugu

SEQ ID NO: 674570 - RNA, 21 nt, Homo sapiens
acuucuaauuuauauuaucca

SEQ ID NO: 674571 - RNA, 21 nt, Homo sapiens
acuucuacauccaauguauga

SEQ ID NO: 674572 - RNA, 15 nt, Homo sapiens
acuucuaccaggacg

SEQ ID NO: 674573 - RNA, 21 nt, Homo sapiens
acuucuagcugucugugaaua

SEQ ID NO: 674574 - RNA, 11 nt, Homo sapiens
acuucuaguuu

SEQ ID NO: 674575 - RNA, 18 nt, Homo sapiens
acuucucacucaccacua

SEQ ID NO: 674576 - RNA, 21 nt, Homo sapiens
acuucuccccuccucuugccu

SEQ ID NO: 674577 - RNA, 18 nt, Homo sapiens
acuucucugugugcacac

SEQ ID NO: 674578 - RNA, 23 nt, Homo sapiens
acuucucuugccuuaaauauauc

SEQ ID NO: 674579 - RNA, 15 nt, Homo sapiens
acuucugaagacuga

SEQ ID NO: 674580 - RNA, 14 nt, Homo sapiens
acuucugacuuacu

SEQ ID NO: 674581 - RNA, 16 nt, Homo sapiens
acuucuggcucacagg

SEQ ID NO: 674582 - RNA, 21 nt, Homo sapiens
acuucuguaauuuaaaagcuc

SEQ ID NO: 674583 - RNA, 13 nt, Homo sapiens
acuucugugccac

SEQ ID NO: 674584 - RNA, 24 nt, Homo sapiens
acuucuuaccccagccuacccuuc

SEQ ID NO: 674585 - RNA, 17 nt, Homo sapiens
acuucuuauacauuuga

SEQ ID NO: 674586 - RNA, 18 nt, Homo sapiens
acuucuuauacauuugau

SEQ ID NO: 674587 - RNA, 23 nt, Homo sapiens
acuucuuauggaauugauuugca

SEQ ID NO: 674588 - RNA, 23 nt, Homo sapiens
acuucuucuguaauauuuacaau

SEQ ID NO: 674589 - RNA, 13 nt, Homo sapiens
acuucuugaauau

SEQ ID NO: 674590 - RNA, 20 nt, Homo sapiens
acuucuugcuggucuaguca

SEQ ID NO: 674591 - RNA, 19 nt, Homo sapiens
acuucuugguacccaguca

SEQ ID NO: 674592 - RNA, 22 nt, Homo sapiens
acuugaaacagauucaggccag

SEQ ID NO: 674593 - RNA, 22 nt, Homo sapiens
acuugaaaccugggcauggugg

SEQ ID NO: 674594 - RNA, 23 nt, Homo sapiens
acuugaaaguuuuccaguauuga

SEQ ID NO: 674595 - RNA, 23 nt, Homo sapiens
acuugaaauaccagugaaccaaa

SEQ ID NO: 674596 - RNA, 17 nt, Homo sapiens
acuugaaauucucauca

SEQ ID NO: 674597 - RNA, 20 nt, Homo sapiens
acuugagaaaauaucuugcu

SEQ ID NO: 674598 - RNA, 20 nt, Homo sapiens
acuugagaagucuaauucac

SEQ ID NO: 674599 - RNA, 20 nt, Homo sapiens
acuugagaggaugaauguau

SEQ ID NO: 674600 - RNA, 23 nt, Homo sapiens
acuugagaguggaaccuccuaua

SEQ ID NO: 674601 - RNA, 15 nt, Homo sapiens
acuugaggucaggag

SEQ ID NO: 674602 - RNA, 14 nt, Homo sapiens
acuugauugucucc

SEQ ID NO: 674603 - RNA, 16 nt, Homo sapiens
acuugauuuaaucacc

SEQ ID NO: 674604 - RNA, 21 nt, Homo sapiens
acuugcacaaaaucacacagc

SEQ ID NO: 674605 - RNA, 19 nt, Homo sapiens
acuugcagucuuguagcua

SEQ ID NO: 674606 - RNA, 15 nt, Homo sapiens
acuugcaucacuuaa

SEQ ID NO: 674607 - RNA, 19 nt, Homo sapiens
acuugcccugaccaugcau

SEQ ID NO: 674608 - RNA, 16 nt, Homo sapiens
acuugccugugcuaca

SEQ ID NO: 674609 - RNA, 19 nt, Homo sapiens
auuccuauauccugugacu

SEQ ID NO: 674610 - RNA, 12 nt, Homo sapiens
auuccuaucuca

SEQ ID NO: 674611 - RNA, 14 nt, Homo sapiens
auuccucaucacca

SEQ ID NO: 674612 - RNA, 22 nt, Homo sapiens
auuccugaccuccgccauccac

SEQ ID NO: 674613 - RNA, 22 nt, Homo sapiens
auuccugcccaaacagcuguau

SEQ ID NO: 674614 - RNA, 21 nt, Homo sapiens
auuccuguacaauuucauccc

SEQ ID NO: 674615 - RNA, 16 nt, Homo sapiens
auuccuguuacuuuac

SEQ ID NO: 674616 - RNA, 18 nt, Homo sapiens
auuccuguuacuuuacag

SEQ ID NO: 674617 - RNA, 18 nt, Homo sapiens
auuccuguuugucuacau

SEQ ID NO: 674618 - RNA, 22 nt, Homo sapiens
auuccuuacuugcacuguuacu

SEQ ID NO: 674619 - RNA, 19 nt, Homo sapiens
auuccuuagacucuuuucc

SEQ ID NO: 674620 - RNA, 20 nt, Homo sapiens
auuccuuagcuuagaccuca

SEQ ID NO: 674621 - RNA, 13 nt, Homo sapiens
auuccuucacuca

SEQ ID NO: 674622 - RNA, 21 nt, Homo sapiens
auuccuucuaagauaaaaaua

SEQ ID NO: 674623 - RNA, 23 nt, Homo sapiens
auuccuucucccaucucuuccuu

SEQ ID NO: 674624 - RNA, 22 nt, Homo sapiens
auuccuucuggccucugcugaa

SEQ ID NO: 674625 - RNA, 12 nt, Homo sapiens
auuccuugcaca

SEQ ID NO: 674626 - RNA, 14 nt, Homo sapiens
auuccuugcacaua

SEQ ID NO: 674627 - RNA, 12 nt, Homo sapiens
auuccuuuauga

SEQ ID NO: 674628 - RNA, 22 nt, Homo sapiens
auuccuuuauuuugcugcuuga

SEQ ID NO: 674629 - RNA, 17 nt, Homo sapiens
auuccuuuccaguucau

SEQ ID NO: 674630 - RNA, 22 nt, Homo sapiens
auuccuuuggaaaaccaaacua

SEQ ID NO: 674631 - RNA, 16 nt, Homo sapiens
auucgaaugacacugu

SEQ ID NO: 674632 - RNA, 23 nt, Homo sapiens
auucgaaugacgguaaguguucu

SEQ ID NO: 674633 - RNA, 21 nt, Homo sapiens
auucgaccuauaagaagccuu

SEQ ID NO: 674634 - RNA, 19 nt, Homo sapiens
auucgcuacuaugauuuaa

SEQ ID NO: 674635 - RNA, 22 nt, Homo sapiens
auucguacauaauaaguuucau

SEQ ID NO: 674636 - RNA, 20 nt, Homo sapiens
auucgugcauuuuuggauca

SEQ ID NO: 674637 - RNA, 22 nt, Homo sapiens
auucuaaauaaauuucccaguu

SEQ ID NO: 674638 - RNA, 12 nt, Homo sapiens
auucuaagccag

SEQ ID NO: 674639 - RNA, 13 nt, Homo sapiens
auucuaagugaaa

SEQ ID NO: 674640 - RNA, 19 nt, Homo sapiens
auucuaaguuagacucuuc

SEQ ID NO: 674641 - RNA, 16 nt, Homo sapiens
auucuacacagagcag

SEQ ID NO: 674642 - RNA, 20 nt, Homo sapiens
auucuaccgugguacacagu

SEQ ID NO: 674643 - RNA, 19 nt, Homo sapiens
auucuagcugagaagcaau

SEQ ID NO: 674644 - RNA, 14 nt, Homo sapiens
auucuaguacauaa

SEQ ID NO: 674645 - RNA, 15 nt, Homo sapiens
auucuauccaucucc

SEQ ID NO: 674646 - RNA, 19 nt, Homo sapiens
auucuauuuauauguacau

SEQ ID NO: 674647 - RNA, 19 nt, Homo sapiens
auucuauuuuuguccuugc

SEQ ID NO: 674648 - RNA, 12 nt, Homo sapiens
auucucaaagau

SEQ ID NO: 674649 - RNA, 15 nt, Homo sapiens
auucucaaccuacca

SEQ ID NO: 674650 - RNA, 13 nt, Homo sapiens
auucucaccagga

SEQ ID NO: 674651 - RNA, 21 nt, Homo sapiens
auucucacuccaccacccaaa

SEQ ID NO: 674652 - RNA, 19 nt, Homo sapiens
auucucaguguagggcaga

SEQ ID NO: 674653 - RNA, 22 nt, Homo sapiens
auucucaguguagggcagagag

SEQ ID NO: 674654 - RNA, 12 nt, Homo sapiens
agauugcacugc

SEQ ID NO: 674655 - RNA, 21 nt, Homo sapiens
agauugcuagaaaagacauaa

SEQ ID NO: 674656 - RNA, 20 nt, Homo sapiens
agauuggcaccccuuucuag

SEQ ID NO: 674657 - RNA, 20 nt, Homo sapiens
agauuggggguuggaccaga

SEQ ID NO: 674658 - RNA, 16 nt, Homo sapiens
agauuggguuuugcuu

SEQ ID NO: 674659 - RNA, 17 nt, Homo sapiens
agauugugaauauuucc

SEQ ID NO: 674660 - RNA, 22 nt, Homo sapiens
agauugugccacuucacuccag

SEQ ID NO: 674661 - RNA, 16 nt, Homo sapiens
agauuguuaaaauaac

SEQ ID NO: 674662 - RNA, 20 nt, Homo sapiens
agauuguuaggagugguucu

SEQ ID NO: 674663 - RNA, 18 nt, Homo sapiens
agauuuaaaaaaagaaca

SEQ ID NO: 674664 - RNA, 21 nt, Homo sapiens
agauuuaaaaaaagaacauaa

SEQ ID NO: 674665 - RNA, 21 nt, Homo sapiens
agauuuaaaguggcagcuuca

SEQ ID NO: 674666 - RNA, 17 nt, Homo sapiens
agauuuaacaauuccaa

SEQ ID NO: 674667 - RNA, 21 nt, Homo sapiens
agauuuaagugaauacauuaa

SEQ ID NO: 674668 - RNA, 17 nt, Homo sapiens
agauuuaggagcagaaa

SEQ ID NO: 674669 - RNA, 17 nt, Homo sapiens
agauuuaugaugcacuu

SEQ ID NO: 674670 - RNA, 14 nt, Homo sapiens
agauuucagaucau

SEQ ID NO: 674671 - RNA, 14 nt, Homo sapiens
agauuuccuacuuu

SEQ ID NO: 674672 - RNA, 13 nt, Homo sapiens
agauuucuucucu

SEQ ID NO: 674673 - RNA, 19 nt, Homo sapiens
agauuuggaauaggaauaa

SEQ ID NO: 674674 - RNA, 19 nt, Homo sapiens
agauuuggaggcuaccuca

SEQ ID NO: 674675 - RNA, 15 nt, Homo sapiens
agauuuggaugcacu

SEQ ID NO: 674676 - RNA, 17 nt, Homo sapiens
agauuugggugaacaaa

SEQ ID NO: 674677 - RNA, 16 nt, Homo sapiens
agauuuguuacuguau

SEQ ID NO: 674678 - RNA, 18 nt, Homo sapiens
agauuuguugacagcaaa

SEQ ID NO: 674679 - RNA, 23 nt, Homo sapiens
agauuuguuuuuaaacuguacag

SEQ ID NO: 674680 - RNA, 17 nt, Homo sapiens
agauuuuaagggggaaa

SEQ ID NO: 674681 - RNA, 15 nt, Homo sapiens
agauuuuaccuaucc

SEQ ID NO: 674682 - RNA, 17 nt, Homo sapiens
agauuuuagacuuaccu

SEQ ID NO: 674683 - RNA, 19 nt, Homo sapiens
agauuuuaucugggggaaa

SEQ ID NO: 674684 - RNA, 16 nt, Homo sapiens
agauuuuaugcugcug

SEQ ID NO: 674685 - RNA, 13 nt, Homo sapiens
agauuuuccauug

SEQ ID NO: 674686 - RNA, 19 nt, Homo sapiens
agauuuucugguucuacuu

SEQ ID NO: 674687 - RNA, 18 nt, Homo sapiens
agauuuugcaaucugugu

SEQ ID NO: 674688 - RNA, 20 nt, Homo sapiens
agauuuugcaaucuguguuc

SEQ ID NO: 674689 - RNA, 17 nt, Homo sapiens
agauuuuguugaccuca

SEQ ID NO: 674690 - RNA, 19 nt, Homo sapiens
agauuuuuaagaacuucau

SEQ ID NO: 674691 - RNA, 17 nt, Homo sapiens
agauuuuugauaucuca

SEQ ID NO: 674692 - RNA, 18 nt, Homo sapiens
agauuuuugauaucucaa

SEQ ID NO: 674693 - RNA, 23 nt, Homo sapiens
agauuuuuguuuuccacugugcu

SEQ ID NO: 674694 - RNA, 15 nt, Homo sapiens
agcaaaaaaauuauu

SEQ ID NO: 674695 - RNA, 16 nt, Homo sapiens
agcaaaaacauguaug

SEQ ID NO: 674696 - RNA, 20 nt, Homo sapiens
agcaaaaacucuugugguac

SEQ ID NO: 674697 - RNA, 14 nt, Homo sapiens
agcaaaaacugugg

SEQ ID NO: 674698 - RNA, 17 nt, Homo sapiens
agcaaaacgcauggagu

SEQ ID NO: 674699 - RNA, 17 nt, Homo sapiens
agcaaaagaaacuauca

SEQ ID NO: 674700 - RNA, 12 nt, Homo sapiens
agcaaaagccuc

SEQ ID NO: 674701 - RNA, 17 nt, Homo sapiens
agcaaaagucagucuua

SEQ ID NO: 674702 - RNA, 13 nt, Homo sapiens
agcaaaauaguau

SEQ ID NO: 674703 - RNA, 15 nt, Homo sapiens
agcaaacaauggugu

SEQ ID NO: 674704 - RNA, 21 nt, Homo sapiens
agcaaacgucuauuuuguaua

SEQ ID NO: 674705 - RNA, 13 nt, Homo sapiens
agcaaacuaagcc

SEQ ID NO: 674706 - RNA, 17 nt, Homo sapiens
agcaaacucugcugucu

SEQ ID NO: 674707 - RNA, 13 nt, Homo sapiens
agcaaacuuggaa

SEQ ID NO: 674708 - RNA, 14 nt, Homo sapiens
agcaaagagugggc

SEQ ID NO: 674709 - RNA, 12 nt, Homo sapiens
agcaaaggcagu

SEQ ID NO: 674710 - RNA, 19 nt, Homo sapiens
agcaaaguuaaggcuugau

SEQ ID NO: 674711 - RNA, 19 nt, Homo sapiens
agcaaauaggcaaaagaca

SEQ ID NO: 674712 - RNA, 20 nt, Homo sapiens
agcaaauaucauacuguuca

SEQ ID NO: 674713 - RNA, 16 nt, Homo sapiens
agcaaaucccauuucu

SEQ ID NO: 674714 - RNA, 12 nt, Homo sapiens
agcaaaucugcc

SEQ ID NO: 674715 - RNA, 21 nt, Homo sapiens
agcaaauggccucaugucaaa

SEQ ID NO: 674716 - RNA, 19 nt, Homo sapiens
agcaaauuagaaacaccau

SEQ ID NO: 674717 - RNA, 24 nt, Homo sapiens
agcaacagauggauagucugucca

SEQ ID NO: 674718 - RNA, 23 nt, Homo sapiens
agcaacagccuaaucccgugccc

SEQ ID NO: 674719 - RNA, 20 nt, Homo sapiens
agcaacauucauagucuuug

SEQ ID NO: 674720 - RNA, 12 nt, Homo sapiens
agcaacauuugu

SEQ ID NO: 674721 - RNA, 15 nt, Homo sapiens
agcaaccaugaacuc

SEQ ID NO: 674722 - RNA, 17 nt, Homo sapiens
agcaacccuaacaguaa

SEQ ID NO: 674723 - RNA, 14 nt, Homo sapiens
agcaaccucuguau

SEQ ID NO: 674724 - RNA, 14 nt, Homo sapiens
agcaacucagagaa

SEQ ID NO: 674725 - RNA, 16 nt, Homo sapiens
agcaacucuugauuau

SEQ ID NO: 674726 - RNA, 13 nt, Homo sapiens
agcaacugugcaa

SEQ ID NO: 674727 - RNA, 24 nt, Homo sapiens
agcaacuucaaguauaacaacuuu

SEQ ID NO: 674728 - RNA, 23 nt, Homo sapiens
agcaagacaaauuagccauuuca

SEQ ID NO: 674729 - RNA, 14 nt, Homo sapiens
agcaagacacaucc

SEQ ID NO: 674730 - RNA, 20 nt, Homo sapiens
agcaagacccuaaacaucca

SEQ ID NO: 674731 - RNA, 23 nt, Homo sapiens
agcaagacugaagauggcuuuuc

SEQ ID NO: 674732 - RNA, 18 nt, Homo sapiens
agcaagcucuucacugaa

SEQ ID NO: 674733 - RNA, 15 nt, Homo sapiens
agcaaggauggagcu

SEQ ID NO: 674734 - RNA, 19 nt, Homo sapiens
agcaaggcuuugguuucca

SEQ ID NO: 674735 - RNA, 19 nt, Homo sapiens
agcaagggcacaaacugca

SEQ ID NO: 674736 - RNA, 15 nt, Homo sapiens
agcaaggugcucuug

SEQ ID NO: 674737 - RNA, 21 nt, Homo sapiens
agcaagugcuggagucgggac

SEQ ID NO: 674738 - RNA, 13 nt, Homo sapiens
agcaaguguucac

SEQ ID NO: 674739 - RNA, 15 nt, Homo sapiens
agcaaguguucacaa

SEQ ID NO: 674740 - RNA, 18 nt, Homo sapiens
agcaaguuacagugaugc

SEQ ID NO: 674741 - RNA, 16 nt, Homo sapiens
agcaaguuugacacaa

SEQ ID NO: 674742 - RNA, 14 nt, Homo sapiens
agcaauaacauaca

SEQ ID NO: 674743 - RNA, 17 nt, Homo sapiens
agcaauagggugcaguu

SEQ ID NO: 674744 - RNA, 12 nt, Homo sapiens
agcaauauguca

SEQ ID NO: 674745 - RNA, 14 nt, Homo sapiens
agcaaucauuuuau

SEQ ID NO: 674746 - RNA, 20 nt, Homo sapiens
agcaaugaagggaagugcau

SEQ ID NO: 674747 - RNA, 14 nt, Homo sapiens
caacuuugugcuuu

SEQ ID NO: 674748 - RNA, 16 nt, Homo sapiens
caagaaaaaaagggag

SEQ ID NO: 674749 - RNA, 16 nt, Homo sapiens
caagaaaaucacauca

SEQ ID NO: 674750 - RNA, 21 nt, Homo sapiens
caagaaagauccacccucaaa

SEQ ID NO: 674751 - RNA, 21 nt, Homo sapiens
caagaaaggccugaauggagg

SEQ ID NO: 674752 - RNA, 15 nt, Homo sapiens
caagaaaucagccau

SEQ ID NO: 674753 - RNA, 16 nt, Homo sapiens
caagaaaucagccaua

SEQ ID NO: 674754 - RNA, 15 nt, Homo sapiens
caagaaaucugacaa

SEQ ID NO: 674755 - RNA, 16 nt, Homo sapiens
caagaacaaacacugc

SEQ ID NO: 674756 - RNA, 17 nt, Homo sapiens
caagaacauucuaccaa

SEQ ID NO: 674757 - RNA, 13 nt, Homo sapiens
caagaaccucucc

SEQ ID NO: 674758 - RNA, 21 nt, Homo sapiens
caagaaccuggaaaaauucca

SEQ ID NO: 674759 - RNA, 13 nt, Homo sapiens
caagaacuauaua

SEQ ID NO: 674760 - RNA, 22 nt, Homo sapiens
caagaagcgccgacucccugag

SEQ ID NO: 674761 - RNA, 19 nt, Homo sapiens
caagaagcguuaugugcag

SEQ ID NO: 674762 - RNA, 20 nt, Homo sapiens
caagaagcguuaugugcagu

SEQ ID NO: 674763 - RNA, 17 nt, Homo sapiens
caagaaggaauugacuu

SEQ ID NO: 674764 - RNA, 17 nt, Homo sapiens
caagaagggacugagag

SEQ ID NO: 674765 - RNA, 20 nt, Homo sapiens
caagaagggaguuccaguca

SEQ ID NO: 674766 - RNA, 20 nt, Homo sapiens
caagaaguagcagugucugu

SEQ ID NO: 674767 - RNA, 21 nt, Homo sapiens
caagaaucuagaagaugugua

SEQ ID NO: 674768 - RNA, 20 nt, Homo sapiens
caagaaucucccagucuggu

SEQ ID NO: 674769 - RNA, 16 nt, Homo sapiens
caagaauguaacucca

SEQ ID NO: 674770 - RNA, 20 nt, Homo sapiens
caagaauuagaagucuuuca

SEQ ID NO: 674771 - RNA, 18 nt, Homo sapiens
caagacacaucccuacaa

SEQ ID NO: 674772 - RNA, 13 nt, Homo sapiens
caagacagugaag

SEQ ID NO: 674773 - RNA, 18 nt, Homo sapiens
caagacccccagcacuug

SEQ ID NO: 674774 - RNA, 16 nt, Homo sapiens
caagaccuucucccca

SEQ ID NO: 674775 - RNA, 22 nt, Homo sapiens
caagacuacuggacuucuauca

SEQ ID NO: 674776 - RNA, 20 nt, Homo sapiens
agcaccgugucaagcugcuc

SEQ ID NO: 674777 - RNA, 18 nt, Homo sapiens
agcaccguucugugcaca

SEQ ID NO: 674778 - RNA, 21 nt, Homo sapiens
agcaccuccgccagauccugc

SEQ ID NO: 674779 - RNA, 14 nt, Homo sapiens
agcaccugcucaac

SEQ ID NO: 674780 - RNA, 20 nt, Homo sapiens
agcaccuuugagccuuggcc

SEQ ID NO: 674781 - RNA, 20 nt, Homo sapiens
agcacggacugucaguucuc

SEQ ID NO: 674782 - RNA, 21 nt, Homo sapiens
agcacggacugucaguucucu

SEQ ID NO: 674783 - RNA, 13 nt, Homo sapiens
agcacgugucuca

SEQ ID NO: 674784 - RNA, 17 nt, Homo sapiens
agcacuacauaaacuga

SEQ ID NO: 674785 - RNA, 18 nt, Homo sapiens
agcacuacauaaacugac

SEQ ID NO: 674786 - RNA, 20 nt, Homo sapiens
agcacuagaauauuuaaaac

SEQ ID NO: 674787 - RNA, 22 nt, Homo sapiens
agcacuauuuaaaauaagcaca

SEQ ID NO: 674788 - RNA, 19 nt, Homo sapiens
agcacucagccucauucag

SEQ ID NO: 674789 - RNA, 23 nt, Homo sapiens
agcacuccuguaacugucucaga

SEQ ID NO: 674790 - RNA, 17 nt, Homo sapiens
agcacugggugaccagc

SEQ ID NO: 674791 - RNA, 15 nt, Homo sapiens
agcacuguccaguau

SEQ ID NO: 674792 - RNA, 17 nt, Homo sapiens
agcacugucucaguuuc

SEQ ID NO: 674793 - RNA, 15 nt, Homo sapiens
agcacuguucugucc

SEQ ID NO: 674794 - RNA, 20 nt, Homo sapiens
agcacuuagcaggcaccgcc

SEQ ID NO: 674795 - RNA, 22 nt, Homo sapiens
agcacuugcaaccgucuguuau

SEQ ID NO: 674796 - RNA, 19 nt, Homo sapiens
agcacuuuagaucacuuga

SEQ ID NO: 674797 - RNA, 13 nt, Homo sapiens
agcacuuugcaac

SEQ ID NO: 674798 - RNA, 18 nt, Homo sapiens
agcacuuugggaggccaa

SEQ ID NO: 674799 - RNA, 18 nt, Homo sapiens
agcagaaaagaugaauuu

SEQ ID NO: 674800 - RNA, 14 nt, Homo sapiens
agcagaacacugca

SEQ ID NO: 674801 - RNA, 20 nt, Homo sapiens
agcagaacacugcagucaga

SEQ ID NO: 674802 - RNA, 20 nt, Homo sapiens
agcagaacagaucuuuuacu

SEQ ID NO: 674803 - RNA, 15 nt, Homo sapiens
agcagaacuucugaa

SEQ ID NO: 674804 - RNA, 17 nt, Homo sapiens
agcagaacuucugaaac

SEQ ID NO: 674805 - RNA, 15 nt, Homo sapiens
agcagaagcacauau

SEQ ID NO: 674806 - RNA, 19 nt, Homo sapiens
agcagaagcuggaggcaca

SEQ ID NO: 674807 - RNA, 14 nt, Homo sapiens
agcagaauacuggu

SEQ ID NO: 674808 - RNA, 20 nt, Homo sapiens
agcagaauguuguacuugaa

SEQ ID NO: 674809 - RNA, 22 nt, Homo sapiens
agcagacacagguguagaccag

SEQ ID NO: 674810 - RNA, 16 nt, Homo sapiens
agcagaccucguuucu

SEQ ID NO: 674811 - RNA, 15 nt, Homo sapiens
agcagacuccagccc

SEQ ID NO: 674812 - RNA, 18 nt, Homo sapiens
agcagagagggauggguu

SEQ ID NO: 674813 - RNA, 15 nt, Homo sapiens
agcagagaucugcag

SEQ ID NO: 674814 - RNA, 13 nt, Homo sapiens
agcagagcauuca

SEQ ID NO: 674815 - RNA, 23 nt, Homo sapiens
agcagagccuacagaagggcagu

SEQ ID NO: 674816 - RNA, 21 nt, Homo sapiens
agcagaggaaggcuacuugag

SEQ ID NO: 674817 - RNA, 14 nt, Homo sapiens
agcagauacuuugu

SEQ ID NO: 674818 - RNA, 13 nt, Homo sapiens
agcagaugaugcc

SEQ ID NO: 674819 - RNA, 13 nt, Homo sapiens
agcagauggagua

SEQ ID NO: 674820 - RNA, 16 nt, Homo sapiens
agcagauuguguaaca

SEQ ID NO: 674821 - RNA, 19 nt, Homo sapiens
agcagcacaauucuguccc

SEQ ID NO: 674822 - RNA, 23 nt, Homo sapiens
agcagcacagucacccauggaac

SEQ ID NO: 674823 - RNA, 14 nt, Homo sapiens
agcagcacugugag

SEQ ID NO: 674824 - RNA, 13 nt, Homo sapiens
agcagcacuuuug

SEQ ID NO: 674825 - RNA, 14 nt, Homo sapiens
agcagcaucuuuaa

SEQ ID NO: 674826 - RNA, 16 nt, Homo sapiens
agcagccacaaccaaa

SEQ ID NO: 674827 - RNA, 17 nt, Homo sapiens
agcagccacacuuccuu

SEQ ID NO: 674828 - RNA, 23 nt, Homo sapiens
agcagccaccagggaguggccau

SEQ ID NO: 674829 - RNA, 16 nt, Homo sapiens
agcagccagucucaga

SEQ ID NO: 674830 - RNA, 21 nt, Homo sapiens
agcagcccuaaggaucucuca

SEQ ID NO: 674831 - RNA, 20 nt, Homo sapiens
agcagcccuggcauguuccu

SEQ ID NO: 674832 - RNA, 15 nt, Homo sapiens
agcagcccugucacg

SEQ ID NO: 674833 - RNA, 18 nt, Homo sapiens
agcagccgccagcuggga

SEQ ID NO: 674834 - RNA, 22 nt, Homo sapiens
agcagccuguacuagcuuuuga

SEQ ID NO: 674835 - RNA, 18 nt, Homo sapiens
agcagcggauugcucugg

SEQ ID NO: 674836 - RNA, 13 nt, Homo sapiens
agcagcugccaga

SEQ ID NO: 674837 - RNA, 18 nt, Homo sapiens
agcagcugcuuugcucua

SEQ ID NO: 674838 - RNA, 23 nt, Homo sapiens
agcagcugguggaagaccuggac

SEQ ID NO: 674839 - RNA, 14 nt, Homo sapiens
agcagcuuuaaaca

SEQ ID NO: 674840 - RNA, 15 nt, Homo sapiens
agcaggaaaccugug

SEQ ID NO: 674841 - RNA, 16 nt, Homo sapiens
agcaggaaugcucuga

SEQ ID NO: 674842 - RNA, 17 nt, Homo sapiens
agcaggacuaggcaugu

SEQ ID NO: 674843 - RNA, 17 nt, Homo sapiens
agcaggaggaguggaag

SEQ ID NO: 674844 - RNA, 23 nt, Homo sapiens
agcaggcagcgccaagugcgugc

SEQ ID NO: 674845 - RNA, 18 nt, Homo sapiens
agcaggcauugcuuugcc

SEQ ID NO: 674846 - RNA, 12 nt, Homo sapiens
agcaggcucaga

SEQ ID NO: 674847 - RNA, 18 nt, Homo sapiens
agcaggggaguaugcaaa

SEQ ID NO: 674848 - RNA, 20 nt, Homo sapiens
agcaggggaguaugcaaaag

SEQ ID NO: 674849 - RNA, 14 nt, Homo sapiens
agcaggucaccuag

SEQ ID NO: 674850 - RNA, 12 nt, Homo sapiens
agcaggugaccu

SEQ ID NO: 674851 - RNA, 19 nt, Homo sapiens
agcagguggcaucucuaau

SEQ ID NO: 674852 - RNA, 17 nt, Homo sapiens
agcaguaaauuugcuag

SEQ ID NO: 674853 - RNA, 19 nt, Homo sapiens
agcaguaaauuugcuagca

SEQ ID NO: 674854 - RNA, 19 nt, Homo sapiens
agcaguaagcuaucuucaa

SEQ ID NO: 674855 - RNA, 19 nt, Homo sapiens
agcaguauuaacuucacag

SEQ ID NO: 674856 - RNA, 10 nt, Homo sapiens
agcagucaau

SEQ ID NO: 674857 - RNA, 16 nt, Homo sapiens
agcagucaauacaaau

SEQ ID NO: 674858 - RNA, 17 nt, Homo sapiens
agcagucagaguccagu

SEQ ID NO: 674859 - RNA, 17 nt, Homo sapiens
agcagucccaguauucu

SEQ ID NO: 674860 - RNA, 15 nt, Homo sapiens
agcagucgugccugu

SEQ ID NO: 674861 - RNA, 18 nt, Homo sapiens
agcagucuaaucuaguga

SEQ ID NO: 674862 - RNA, 15 nt, Homo sapiens
agcagugaaguauaa

SEQ ID NO: 674863 - RNA, 20 nt, Homo sapiens
agcagugaaugauucagugu

SEQ ID NO: 674864 - RNA, 15 nt, Homo sapiens
agcagugaucucagg

SEQ ID NO: 674865 - RNA, 13 nt, Homo sapiens
agcagugaugaaa

SEQ ID NO: 674866 - RNA, 13 nt, Homo sapiens
agcagugccagcu

SEQ ID NO: 674867 - RNA, 13 nt, Homo sapiens
agcagugccuugu

SEQ ID NO: 674868 - RNA, 16 nt, Homo sapiens
agcaguggcuggugcc

SEQ ID NO: 674869 - RNA, 17 nt, Homo sapiens
agcaguggcuggugccc

SEQ ID NO: 674870 - RNA, 14 nt, Homo sapiens
caaggcagugcaug

SEQ ID NO: 674871 - RNA, 15 nt, Homo sapiens
caaggccuccaggga

SEQ ID NO: 674872 - RNA, 17 nt, Homo sapiens
caaggccugguguuucu

SEQ ID NO: 674873 - RNA, 14 nt, Homo sapiens
caaggccuugccug

SEQ ID NO: 674874 - RNA, 13 nt, Homo sapiens
caaggccuugcuc

SEQ ID NO: 674875 - RNA, 18 nt, Homo sapiens
caaggccuugguggagca

SEQ ID NO: 674876 - RNA, 15 nt, Homo sapiens
caaggcuacaguaac

SEQ ID NO: 674877 - RNA, 16 nt, Homo sapiens
caaggcugacuucucu

SEQ ID NO: 674878 - RNA, 16 nt, Homo sapiens
caaggcuggcagugac

SEQ ID NO: 674879 - RNA, 19 nt, Homo sapiens
caaggcugggggaagaagc

SEQ ID NO: 674880 - RNA, 18 nt, Homo sapiens
caaggcuggguaauguga

SEQ ID NO: 674881 - RNA, 19 nt, Homo sapiens
caaggcuuuauauuuuuaa

SEQ ID NO: 674882 - RNA, 15 nt, Homo sapiens
caaggcuuuaucuca

SEQ ID NO: 674883 - RNA, 18 nt, Homo sapiens
caaggcuuugguuuccaa

SEQ ID NO: 674884 - RNA, 21 nt, Homo sapiens
caaggcuuugguuuccaaguc

SEQ ID NO: 674885 - RNA, 18 nt, Homo sapiens
caagggaauauugccaau

SEQ ID NO: 674886 - RNA, 13 nt, Homo sapiens
caagggacaguga

SEQ ID NO: 674887 - RNA, 15 nt, Homo sapiens
caagggacccaugag

SEQ ID NO: 674888 - RNA, 14 nt, Homo sapiens
caagggaugucuca

SEQ ID NO: 674889 - RNA, 18 nt, Homo sapiens
caagggcacgugaaguca

SEQ ID NO: 674890 - RNA, 18 nt, Homo sapiens
caagggcaggaccaaugg

SEQ ID NO: 674891 - RNA, 16 nt, Homo sapiens
caagggcaggucuuca

SEQ ID NO: 674892 - RNA, 19 nt, Homo sapiens
caagggcccuucucuacug

SEQ ID NO: 674893 - RNA, 20 nt, Homo sapiens
caaggggcuggaaucucaug

SEQ ID NO: 674894 - RNA, 17 nt, Homo sapiens
caagggggugacuggaa

SEQ ID NO: 674895 - RNA, 20 nt, Homo sapiens
caaggggugggccugugaau

SEQ ID NO: 674896 - RNA, 16 nt, Homo sapiens
caaggguggccuugaa

SEQ ID NO: 674897 - RNA, 14 nt, Homo sapiens
caaggucaagagau

SEQ ID NO: 674898 - RNA, 15 nt, Homo sapiens
caauauuuugccuuu

SEQ ID NO: 674899 - RNA, 20 nt, Homo sapiens
caaucaacuuuacuguaaua

SEQ ID NO: 674900 - RNA, 18 nt, Homo sapiens
caaucaauggugcaaaaa

SEQ ID NO: 674901 - RNA, 19 nt, Homo sapiens
caaucaauggugcaaaaaa

SEQ ID NO: 674902 - RNA, 21 nt, Homo sapiens
caaucagaugacaacaaagau

SEQ ID NO: 674903 - RNA, 21 nt, Homo sapiens
caaucaggguuuuuagauuaa

SEQ ID NO: 674904 - RNA, 17 nt, Homo sapiens
caaucagugcagugaua

SEQ ID NO: 674905 - RNA, 21 nt, Homo sapiens
caaucaucaacuaccauucua

SEQ ID NO: 674906 - RNA, 19 nt, Homo sapiens
caaucaucaucauucucau

SEQ ID NO: 674907 - RNA, 15 nt, Homo sapiens
caauccaaguacaug

SEQ ID NO: 674908 - RNA, 20 nt, Homo sapiens
caauccagaggaacaagcau

SEQ ID NO: 674909 - RNA, 20 nt, Homo sapiens
caauccauccugcucaggaa

SEQ ID NO: 674910 - RNA, 20 nt, Homo sapiens
caaucccaacguuuuacaua

SEQ ID NO: 674911 - RNA, 15 nt, Homo sapiens
caauccccagacuca

SEQ ID NO: 674912 - RNA, 17 nt, Homo sapiens
caaucccucuccacucu

SEQ ID NO: 674913 - RNA, 15 nt, Homo sapiens
caauccuccuaccuc

SEQ ID NO: 674914 - RNA, 17 nt, Homo sapiens
caauccugucauauaau

SEQ ID NO: 674915 - RNA, 18 nt, Homo sapiens
caauccugucauauaaua

SEQ ID NO: 674916 - RNA, 15 nt, Homo sapiens
caauccuuaguccua

SEQ ID NO: 674917 - RNA, 14 nt, Homo sapiens
caaucgagauuugg

SEQ ID NO: 674918 - RNA, 17 nt, Homo sapiens
caaucggguccagagac

SEQ ID NO: 674919 - RNA, 15 nt, Homo sapiens
caaucuauguuugca

SEQ ID NO: 674920 - RNA, 18 nt, Homo sapiens
caaucuccccuugcacua

SEQ ID NO: 674921 - RNA, 22 nt, Homo sapiens
caaucucccuggggcacuuuca

SEQ ID NO: 674922 - RNA, 13 nt, Homo sapiens
caaucuguucaau

SEQ ID NO: 674923 - RNA, 15 nt, Homo sapiens
caaucuuauguuucc

SEQ ID NO: 674924 - RNA, 15 nt, Homo sapiens
caaucuucauuuaau

SEQ ID NO: 674925 - RNA, 11 nt, Homo sapiens
caaucuugccc

SEQ ID NO: 674926 - RNA, 15 nt, Homo sapiens
caaucuuucaugucu

SEQ ID NO: 674927 - RNA, 20 nt, Homo sapiens
caaucuuucaugucuuguca

SEQ ID NO: 674928 - RNA, 23 nt, Homo sapiens
caaucuuucaugucuugucauac

SEQ ID NO: 674929 - RNA, 20 nt, Homo sapiens
caaucuuugccuuuaucucu

SEQ ID NO: 674930 - RNA, 21 nt, Homo sapiens
caaugaaaaauguaauuuaga

SEQ ID NO: 674931 - RNA, 14 nt, Homo sapiens
caaugaaauacuga

SEQ ID NO: 674932 - RNA, 17 nt, Homo sapiens
caaugaacccccaugau

SEQ ID NO: 674933 - RNA, 16 nt, Homo sapiens
caaugaagaaguuucu

SEQ ID NO: 674934 - RNA, 17 nt, Homo sapiens
caaugaagaauuaugua

SEQ ID NO: 674935 - RNA, 18 nt, Homo sapiens
caaugaccacauccugaa

SEQ ID NO: 674936 - RNA, 19 nt, Homo sapiens
caaugacuuaaccauauaa

SEQ ID NO: 674937 - RNA, 16 nt, Homo sapiens
caaugacuuacuguac

SEQ ID NO: 674938 - RNA, 18 nt, Homo sapiens
caaugagauugaauuuca

SEQ ID NO: 674939 - RNA, 15 nt, Homo sapiens
caaugagcucuucca

SEQ ID NO: 674940 - RNA, 13 nt, Homo sapiens
caaugauaugcaa

SEQ ID NO: 674941 - RNA, 20 nt, Homo sapiens
caaugauaugcaagugcaaa

SEQ ID NO: 674942 - RNA, 22 nt, Homo sapiens
caaugauaugcaagugcaaaag

SEQ ID NO: 674943 - RNA, 18 nt, Homo sapiens
caaugauuuuuugcaaaa

SEQ ID NO: 674944 - RNA, 15 nt, Homo sapiens
caaugcaaccaacua

SEQ ID NO: 674945 - RNA, 20 nt, Homo sapiens
caaugcaccuaaagaaaaac

SEQ ID NO: 674946 - RNA, 20 nt, Homo sapiens
caaugcaccuagcugugcaa

SEQ ID NO: 674947 - RNA, 23 nt, Homo sapiens
caaugccaaaaaaagacagggcu

SEQ ID NO: 674948 - RNA, 15 nt, Homo sapiens
caaugccuauaaaau

SEQ ID NO: 674949 - RNA, 13 nt, Homo sapiens
caaugccugugaa

SEQ ID NO: 674950 - RNA, 22 nt, Homo sapiens
caaugccuugacaacagacuga

SEQ ID NO: 674951 - RNA, 23 nt, Homo sapiens
caaugccuuuuugauuacagugu

SEQ ID NO: 674952 - RNA, 16 nt, Homo sapiens
caaugcuccaucccaa

SEQ ID NO: 674953 - RNA, 18 nt, Homo sapiens
caaugcuggccuguggug

SEQ ID NO: 674954 - RNA, 19 nt, Homo sapiens
caaugcuuaaacuaaauaa

SEQ ID NO: 674955 - RNA, 19 nt, Homo sapiens
caauggaguggcugccaug

SEQ ID NO: 674956 - RNA, 21 nt, Homo sapiens
caauggaguggcugccaugga

SEQ ID NO: 674957 - RNA, 22 nt, Homo sapiens
caauggauauuuguacuguuua

SEQ ID NO: 674958 - RNA, 18 nt, Homo sapiens
caauggcccgacauuucu

SEQ ID NO: 674959 - RNA, 22 nt, Homo sapiens
caaugggacucugagaacuccu

SEQ ID NO: 674960 - RNA, 16 nt, Homo sapiens
caaugggcacugggau

SEQ ID NO: 674961 - RNA, 17 nt, Homo sapiens
caaugggccuccagaga

SEQ ID NO: 674962 - RNA, 19 nt, Homo sapiens
caaugggcucaaacuucua

SEQ ID NO: 674963 - RNA, 17 nt, Homo sapiens
caaugguacucuaauca

SEQ ID NO: 674964 - RNA, 19 nt, Homo sapiens
caauguacaauuaugucuc

SEQ ID NO: 674965 - RNA, 20 nt, Homo sapiens
caauguacaggaaguaguuc

SEQ ID NO: 674966 - RNA, 22 nt, Homo sapiens
caauguacaguugaaauaacug

SEQ ID NO: 674967 - RNA, 13 nt, Homo sapiens
caauguaucuuua

SEQ ID NO: 674968 - RNA, 19 nt, Homo sapiens
caaugucaggaacagaagg

SEQ ID NO: 674969 - RNA, 17 nt, Homo sapiens
caaugugaacuuuauua

SEQ ID NO: 674970 - RNA, 19 nt, Homo sapiens
caauguggacgugcacuga

SEQ ID NO: 674971 - RNA, 13 nt, Homo sapiens
caauguguacaag

SEQ ID NO: 674972 - RNA, 14 nt, Homo sapiens
caauguuagccaca

SEQ ID NO: 674973 - RNA, 19 nt, Homo sapiens
caauguuaucaaccaacug

SEQ ID NO: 674974 - RNA, 15 nt, Homo sapiens
caauguucaucccau

SEQ ID NO: 674975 - RNA, 21 nt, Homo sapiens
caauguugcauuuaugaugca

SEQ ID NO: 674976 - RNA, 21 nt, Homo sapiens
caauguugguuucacugagag

SEQ ID NO: 674977 - RNA, 15 nt, Homo sapiens
caauguuuaugcaag

SEQ ID NO: 674978 - RNA, 18 nt, Homo sapiens
caauuaaaaugacaagca

SEQ ID NO: 674979 - RNA, 17 nt, Homo sapiens
caauuaaagguccugcc

SEQ ID NO: 674980 - RNA, 18 nt, Homo sapiens
caauuacagggugacuca

SEQ ID NO: 674981 - RNA, 18 nt, Homo sapiens
caauuacucagguuugag

SEQ ID NO: 674982 - RNA, 21 nt, Homo sapiens
caauuagcaauugacugucac

SEQ ID NO: 674983 - RNA, 16 nt, Homo sapiens
caauuauuacauuuau

SEQ ID NO: 674984 - RNA, 18 nt, Homo sapiens
caauuauuacauuuauac

SEQ ID NO: 674985 - RNA, 14 nt, Homo sapiens
caauucaguucuag

SEQ ID NO: 674986 - RNA, 13 nt, Homo sapiens
caauucauucacc

SEQ ID NO: 674987 - RNA, 14 nt, Homo sapiens
caauuccgcauuua

SEQ ID NO: 674988 - RNA, 17 nt, Homo sapiens
caauuccucugaacaaa

SEQ ID NO: 674989 - RNA, 13 nt, Homo sapiens
caauuccucuggg

SEQ ID NO: 674990 - RNA, 15 nt, Homo sapiens
caauuccucugggaa

SEQ ID NO: 674991 - RNA, 14 nt, Homo sapiens
caauuccugugauu

SEQ ID NO: 674992 - RNA, 21 nt, Homo sapiens
caauucgaaaacaaccguccu

SEQ ID NO: 674993 - RNA, 20 nt, Homo sapiens
caauucuaaauccgacuuga

SEQ ID NO: 674994 - RNA, 16 nt, Homo sapiens
agcagugguauuaaua

SEQ ID NO: 674995 - RNA, 11 nt, Homo sapiens
agcaguguccu

SEQ ID NO: 674996 - RNA, 16 nt, Homo sapiens
agcagugucuuccaua

SEQ ID NO: 674997 - RNA, 18 nt, Homo sapiens
agcaguuagcucauuuga

SEQ ID NO: 674998 - RNA, 21 nt, Homo sapiens
agcaguucucccaccagccuc

SEQ ID NO: 674999 - RNA, 19 nt, Homo sapiens
agcaguuguuauuuaguga

SEQ ID NO: 675000 - RNA, 13 nt, Homo sapiens
agcauaacuguag

SEQ ID NO: 675001 - RNA, 18 nt, Homo sapiens
agcauaaguuucugggac

SEQ ID NO: 675002 - RNA, 15 nt, Homo sapiens
agcauacaacuggac

SEQ ID NO: 675003 - RNA, 21 nt, Homo sapiens
agcauaccaguacucaguaua

SEQ ID NO: 675004 - RNA, 16 nt, Homo sapiens
agcauacguacacauu

SEQ ID NO: 675005 - RNA, 21 nt, Homo sapiens
agcauacguacacauuuuauu

SEQ ID NO: 675006 - RNA, 18 nt, Homo sapiens
agcauagauuugcagcuc

SEQ ID NO: 675007 - RNA, 13 nt, Homo sapiens
agcauauacugaa

SEQ ID NO: 675008 - RNA, 17 nt, Homo sapiens
agcauauacugaagucu

SEQ ID NO: 675009 - RNA, 14 nt, Homo sapiens
agcauauuuugcug

SEQ ID NO: 675010 - RNA, 13 nt, Homo sapiens
agcaucaauacaa

SEQ ID NO: 675011 - RNA, 19 nt, Homo sapiens
agcaucaauacaaccagcc

SEQ ID NO: 675012 - RNA, 24 nt, Homo sapiens
agcaucaaucuuguuacugcugau

SEQ ID NO: 675013 - RNA, 19 nt, Homo sapiens
agcaucauuaaugcacauc

SEQ ID NO: 675014 - RNA, 20 nt, Homo sapiens
agcaucauuaaugcacaucu

SEQ ID NO: 675015 - RNA, 15 nt, Homo sapiens
agcaucccucagccu

SEQ ID NO: 675016 - RNA, 20 nt, Homo sapiens
agcauccucucucacaugga

SEQ ID NO: 675017 - RNA, 22 nt, Homo sapiens
agcauccugauuaaaugucuga

SEQ ID NO: 675018 - RNA, 14 nt, Homo sapiens
agcaucgggagcac

SEQ ID NO: 675019 - RNA, 22 nt, Homo sapiens
agccaggguggucuugaucucc

SEQ ID NO: 675020 - RNA, 20 nt, Homo sapiens
agccaguacagagaaauucu

SEQ ID NO: 675021 - RNA, 21 nt, Homo sapiens
agccagucucagagaccagca

SEQ ID NO: 675022 - RNA, 16 nt, Homo sapiens
agccagugccauucca

SEQ ID NO: 675023 - RNA, 22 nt, Homo sapiens
agccagugccauuccacuccac

SEQ ID NO: 675024 - RNA, 17 nt, Homo sapiens
agccaguggugauguaa

SEQ ID NO: 675025 - RNA, 18 nt, Homo sapiens
agccaguuaaaauguguu

SEQ ID NO: 675026 - RNA, 23 nt, Homo sapiens
agccaguuggcuucuaagccaaa

SEQ ID NO: 675027 - RNA, 22 nt, Homo sapiens
agccaguuuggguaaaauacuu

SEQ ID NO: 675028 - RNA, 15 nt, Homo sapiens
agccauaacuugaaa

SEQ ID NO: 675029 - RNA, 20 nt, Homo sapiens
agccauaagaaagcacuauu

SEQ ID NO: 675030 - RNA, 22 nt, Homo sapiens
agccauaagaaagcacuauuaa

SEQ ID NO: 675031 - RNA, 21 nt, Homo sapiens
agccauauaaguuugaaggaa

SEQ ID NO: 675032 - RNA, 14 nt, Homo sapiens
agccauaugcaaua

SEQ ID NO: 675033 - RNA, 11 nt, Homo sapiens
agccauccagg

SEQ ID NO: 675034 - RNA, 20 nt, Homo sapiens
agccaucccuuuuuuuacau

SEQ ID NO: 675035 - RNA, 14 nt, Homo sapiens
agccaugccagcug

SEQ ID NO: 675036 - RNA, 19 nt, Homo sapiens
agccauggaaaaacuuccu

SEQ ID NO: 675037 - RNA, 17 nt, Homo sapiens
agccauggaacccugcc

SEQ ID NO: 675038 - RNA, 16 nt, Homo sapiens
agccaugggaaccuca

SEQ ID NO: 675039 - RNA, 18 nt, Homo sapiens
agccauguauuucaggga

SEQ ID NO: 675040 - RNA, 21 nt, Homo sapiens
agccauguccugcugcuucug

SEQ ID NO: 675041 - RNA, 23 nt, Homo sapiens
agccauguguuggggagacauca

SEQ ID NO: 675042 - RNA, 18 nt, Homo sapiens
agccauucuuuuaaauau

SEQ ID NO: 675043 - RNA, 14 nt, Homo sapiens
agccauugcauuua

SEQ ID NO: 675044 - RNA, 22 nt, Homo sapiens
agccauuucacucucaaacuuc

SEQ ID NO: 675045 - RNA, 19 nt, Homo sapiens
agccauuugcugcauuucu

SEQ ID NO: 675046 - RNA, 22 nt, Homo sapiens
agccauuuguuggggcaguggu

SEQ ID NO: 675047 - RNA, 19 nt, Homo sapiens
agccauuuuuaaugaucuc

SEQ ID NO: 675048 - RNA, 20 nt, Homo sapiens
agccauuuuucaaagcaauu

SEQ ID NO: 675049 - RNA, 15 nt, Homo sapiens
agcccaaaacccagg

SEQ ID NO: 675050 - RNA, 23 nt, Homo sapiens
agcccaagagauuguugcuuugu

SEQ ID NO: 675051 - RNA, 14 nt, Homo sapiens
agcccaaguucaug

SEQ ID NO: 675052 - RNA, 15 nt, Homo sapiens
agcccacacuugaga

SEQ ID NO: 675053 - RNA, 13 nt, Homo sapiens
agcccaccccuca

SEQ ID NO: 675054 - RNA, 16 nt, Homo sapiens
agcccaccuucuugcu

SEQ ID NO: 675055 - RNA, 20 nt, Homo sapiens
agcccacuguuaauauucua

SEQ ID NO: 675056 - RNA, 15 nt, Homo sapiens
agcccagaaccacag

SEQ ID NO: 675057 - RNA, 19 nt, Homo sapiens
agcccagaccucugacaca

SEQ ID NO: 675058 - RNA, 14 nt, Homo sapiens
agcccagagccacc

SEQ ID NO: 675059 - RNA, 21 nt, Homo sapiens
agcccagaucaccaccugaac

SEQ ID NO: 675060 - RNA, 15 nt, Homo sapiens
agcccagauggaaag

SEQ ID NO: 675061 - RNA, 19 nt, Homo sapiens
agcccagcaaaugaucagc

SEQ ID NO: 675062 - RNA, 19 nt, Homo sapiens
agcccagcucuugcucucu

SEQ ID NO: 675063 - RNA, 22 nt, Homo sapiens
agcccagcuuggcccuuuccuu

SEQ ID NO: 675064 - RNA, 19 nt, Homo sapiens
agcccaggauacuggcaca

SEQ ID NO: 675065 - RNA, 20 nt, Homo sapiens
agcccaggggccggccagug

SEQ ID NO: 675066 - RNA, 15 nt, Homo sapiens
agcccagugcugcug

SEQ ID NO: 675067 - RNA, 16 nt, Homo sapiens
agcccagugggcugca

SEQ ID NO: 675068 - RNA, 15 nt, Homo sapiens
agcccauaaggccag

SEQ ID NO: 675069 - RNA, 18 nt, Homo sapiens
agcccauccagucuccca

SEQ ID NO: 675070 - RNA, 24 nt, Homo sapiens
agcccauggcccccaauaaaggca

SEQ ID NO: 675071 - RNA, 12 nt, Homo sapiens
agcccaugggua

SEQ ID NO: 675072 - RNA, 20 nt, Homo sapiens
agcccauuucuccauacgca

SEQ ID NO: 675073 - RNA, 14 nt, Homo sapiens
agccccacugccag

SEQ ID NO: 675074 - RNA, 17 nt, Homo sapiens
agccccagacaacagcc

SEQ ID NO: 675075 - RNA, 12 nt, Homo sapiens
agccccagcuga

SEQ ID NO: 675076 - RNA, 17 nt, Homo sapiens
agccccauccuguguua

SEQ ID NO: 675077 - RNA, 20 nt, Homo sapiens
agcccccaccccgagucaca

SEQ ID NO: 675078 - RNA, 16 nt, Homo sapiens
agcccccccacccacc

SEQ ID NO: 675079 - RNA, 20 nt, Homo sapiens
agcccccccccggagcugcg

SEQ ID NO: 675080 - RNA, 16 nt, Homo sapiens
agcccccgccccagag

SEQ ID NO: 675081 - RNA, 16 nt, Homo sapiens
agcccccgcuguaaug

SEQ ID NO: 675082 - RNA, 13 nt, Homo sapiens
agccccgacuucc

SEQ ID NO: 675083 - RNA, 23 nt, Homo sapiens
agccccuccaaaggucugauguc

SEQ ID NO: 675084 - RNA, 19 nt, Homo sapiens
agccccucuggacacagcc

SEQ ID NO: 675085 - RNA, 16 nt, Homo sapiens
agccccugcuccagaa

SEQ ID NO: 675086 - RNA, 22 nt, Homo sapiens
agccccugggcccaguaccuag

SEQ ID NO: 675087 - RNA, 17 nt, Homo sapiens
agccccugggguggcca

SEQ ID NO: 675088 - RNA, 16 nt, Homo sapiens
agccccuuauuugcac

SEQ ID NO: 675089 - RNA, 21 nt, Homo sapiens
agccccuuauuugcacuucac

SEQ ID NO: 675090 - RNA, 18 nt, Homo sapiens
agccccuuccucugccag

SEQ ID NO: 675091 - RNA, 20 nt, Homo sapiens
agcccgcaggaucaggugac

SEQ ID NO: 675092 - RNA, 14 nt, Homo sapiens
agcccgcccacugg

SEQ ID NO: 675093 - RNA, 19 nt, Homo sapiens
agcccgccugccgugcaug

SEQ ID NO: 675094 - RNA, 22 nt, Homo sapiens
agcccgguaagagcaaaagaau

SEQ ID NO: 675095 - RNA, 16 nt, Homo sapiens
agcccgucuuggcuua

SEQ ID NO: 675096 - RNA, 13 nt, Homo sapiens
agcccucagcaau

SEQ ID NO: 675097 - RNA, 22 nt, Homo sapiens
agcccucagcaaugugccuucu

SEQ ID NO: 675098 - RNA, 19 nt, Homo sapiens
agcccuccaaaagcacuua

SEQ ID NO: 675099 - RNA, 16 nt, Homo sapiens
agcccucccacuuugc

SEQ ID NO: 675100 - RNA, 19 nt, Homo sapiens
agcccucccccagcaguug

SEQ ID NO: 675101 - RNA, 20 nt, Homo sapiens
agcccucgaaccaaggcagc

SEQ ID NO: 675102 - RNA, 14 nt, Homo sapiens
agcccugacccugu

SEQ ID NO: 675103 - RNA, 17 nt, Homo sapiens
agcccugcagagcacaa

SEQ ID NO: 675104 - RNA, 19 nt, Homo sapiens
agcccugcagcccaccaga

SEQ ID NO: 675105 - RNA, 12 nt, Homo sapiens
agcccugccagg

SEQ ID NO: 675106 - RNA, 18 nt, Homo sapiens
agcccugccccacaccuc

SEQ ID NO: 675107 - RNA, 21 nt, Homo sapiens
agcccuggcucccaccuguuu

SEQ ID NO: 675108 - RNA, 23 nt, Homo sapiens
agcccugggggauuccugagcug

SEQ ID NO: 675109 - RNA, 19 nt, Homo sapiens
agcccuggguuuaauguca

SEQ ID NO: 675110 - RNA, 20 nt, Homo sapiens
agcccuguacccaccccagc

SEQ ID NO: 675111 - RNA, 15 nt, Homo sapiens
agcccugucugcuag

SEQ ID NO: 675112 - RNA, 20 nt, Homo sapiens
agcccugucuguuugccaca

SEQ ID NO: 675113 - RNA, 22 nt, Homo sapiens
agcccuguggccgccaccugag

SEQ ID NO: 675114 - RNA, 18 nt, Homo sapiens
agcccugugucugucaca

SEQ ID NO: 675115 - RNA, 13 nt, Homo sapiens
agcccuguuggca

SEQ ID NO: 675116 - RNA, 19 nt, Homo sapiens
agcccuucugucugucagg

SEQ ID NO: 675117 - RNA, 15 nt, Homo sapiens
cacacuuugcacuga

SEQ ID NO: 675118 - RNA, 22 nt, Homo sapiens
cacagaaaaggcugcugugaac

SEQ ID NO: 675119 - RNA, 20 nt, Homo sapiens
cacagaaaucacagucaaug

SEQ ID NO: 675120 - RNA, 14 nt, Homo sapiens
cacagaaaugcugc

SEQ ID NO: 675121 - RNA, 19 nt, Homo sapiens
cacagacacuacauaucua

SEQ ID NO: 675122 - RNA, 14 nt, Homo sapiens
cacagacauacaau

SEQ ID NO: 675123 - RNA, 19 nt, Homo sapiens
cacagaccugcucuggaca

SEQ ID NO: 675124 - RNA, 20 nt, Homo sapiens
cacagacgccuuacuggcaa

SEQ ID NO: 675125 - RNA, 14 nt, Homo sapiens
cacagacgggcaca

SEQ ID NO: 675126 - RNA, 11 nt, Homo sapiens
cacagacuccg

SEQ ID NO: 675127 - RNA, 16 nt, Homo sapiens
cacagacuggcaauaa

SEQ ID NO: 675128 - RNA, 20 nt, Homo sapiens
cacagacuggcaauaaacuc

SEQ ID NO: 675129 - RNA, 21 nt, Homo sapiens
cacagacuggcaauaaacucc

SEQ ID NO: 675130 - RNA, 22 nt, Homo sapiens
cacagacuggcaauaaacuccu

SEQ ID NO: 675131 - RNA, 23 nt, Homo sapiens
cacagacuggcaauaaacuccua

SEQ ID NO: 675132 - RNA, 22 nt, Homo sapiens
cacagagaagaccuucuaguga

SEQ ID NO: 675133 - RNA, 20 nt, Homo sapiens
cacagagaagcggauuucca

SEQ ID NO: 675134 - RNA, 18 nt, Homo sapiens
cacagagcugaguccucu

SEQ ID NO: 675135 - RNA, 13 nt, Homo sapiens
cacagaggcugcc

SEQ ID NO: 675136 - RNA, 21 nt, Homo sapiens
cacagagguccggguuuagua

SEQ ID NO: 675137 - RNA, 14 nt, Homo sapiens
cacagagugcugga

SEQ ID NO: 675138 - RNA, 14 nt, Homo sapiens
cacagaguuguuac

SEQ ID NO: 675139 - RNA, 20 nt, Homo sapiens
cacagaucugcuugaucaau

SEQ ID NO: 675140 - RNA, 15 nt, Homo sapiens
cagcuguagccaugg

SEQ ID NO: 675141 - RNA, 21 nt, Homo sapiens
cagcugucaagggcagaauga

SEQ ID NO: 675142 - RNA, 15 nt, Homo sapiens
cagcugucaccugcu

SEQ ID NO: 675143 - RNA, 15 nt, Homo sapiens
cagcugugagccaug

SEQ ID NO: 675144 - RNA, 15 nt, Homo sapiens
cagcugugcacuuuc

SEQ ID NO: 675145 - RNA, 20 nt, Homo sapiens
cagcuguggcagaguuacag

SEQ ID NO: 675146 - RNA, 22 nt, Homo sapiens
cagcuguggcuucuaggugccc

SEQ ID NO: 675147 - RNA, 17 nt, Homo sapiens
cagcugugguacaaaug

SEQ ID NO: 675148 - RNA, 18 nt, Homo sapiens
cagcuguuuuguugacau

SEQ ID NO: 675149 - RNA, 15 nt, Homo sapiens
cagcuuagauuucau

SEQ ID NO: 675150 - RNA, 19 nt, Homo sapiens
cagcuucaacuuuucucuu

SEQ ID NO: 675151 - RNA, 23 nt, Homo sapiens
cagcuucuggggguagaucucaa

SEQ ID NO: 675152 - RNA, 19 nt, Homo sapiens
cagcuucuugcacuccuuc

SEQ ID NO: 675153 - RNA, 16 nt, Homo sapiens
cagcuuggcccaggga

SEQ ID NO: 675154 - RNA, 20 nt, Homo sapiens
cagcuuggggccaccaaagc

SEQ ID NO: 675155 - RNA, 13 nt, Homo sapiens
cagcuuucuggga

SEQ ID NO: 675156 - RNA, 23 nt, Homo sapiens
cagcuuuguuuguugucagcuga

SEQ ID NO: 675157 - RNA, 21 nt, Homo sapiens
cagcuuuuagaaaaugcaguc

SEQ ID NO: 675158 - RNA, 11 nt, Homo sapiens
cagcuuuucaa

SEQ ID NO: 675159 - RNA, 21 nt, Homo sapiens
cagcuuuucccaagaugucaa

SEQ ID NO: 675160 - RNA, 13 nt, Homo sapiens
cagcuuuuccuca

SEQ ID NO: 675161 - RNA, 13 nt, Homo sapiens
caggaaaaaccaa

SEQ ID NO: 675162 - RNA, 16 nt, Homo sapiens
caggaaaaaccaacag

SEQ ID NO: 675163 - RNA, 17 nt, Homo sapiens
caggaaaacaaaucacu

SEQ ID NO: 675164 - RNA, 17 nt, Homo sapiens
caggaaaacugggacau

SEQ ID NO: 675165 - RNA, 15 nt, Homo sapiens
caggaaaaucugcac

SEQ ID NO: 675166 - RNA, 14 nt, Homo sapiens
caggaaaaugccag

SEQ ID NO: 675167 - RNA, 19 nt, Homo sapiens
caggaaaauguauugauuc

SEQ ID NO: 675168 - RNA, 23 nt, Homo sapiens
caggaaaauuguuugaacccagg

SEQ ID NO: 675169 - RNA, 14 nt, Homo sapiens
caggaaaccaaaua

SEQ ID NO: 675170 - RNA, 15 nt, Homo sapiens
caggaaacugggaau

SEQ ID NO: 675171 - RNA, 15 nt, Homo sapiens
caggaaaggccccaa

SEQ ID NO: 675172 - RNA, 21 nt, Homo sapiens
caggaaagggcaaaguagggc

SEQ ID NO: 675173 - RNA, 19 nt, Homo sapiens
caggaaauaaauuguaaaa

SEQ ID NO: 675174 - RNA, 14 nt, Homo sapiens
caggaaauagucac

SEQ ID NO: 675175 - RNA, 23 nt, Homo sapiens
caggaaauauauaugugugugua

SEQ ID NO: 675176 - RNA, 21 nt, Homo sapiens
caggaacaauaaaaugucuuc

SEQ ID NO: 675177 - RNA, 22 nt, Homo sapiens
caggaaccuccuccacaccagc

SEQ ID NO: 675178 - RNA, 15 nt, Homo sapiens
caggaacucccagca

SEQ ID NO: 675179 - RNA, 15 nt, Homo sapiens
caggaacuugcacaa

SEQ ID NO: 675180 - RNA, 14 nt, Homo sapiens
caggaagacugaca

SEQ ID NO: 675181 - RNA, 16 nt, Homo sapiens
caggaagaugaaagag

SEQ ID NO: 675182 - RNA, 15 nt, Homo sapiens
caggaagccagagcc

SEQ ID NO: 675183 - RNA, 19 nt, Homo sapiens
caggaaggacugucccaga

SEQ ID NO: 675184 - RNA, 19 nt, Homo sapiens
caggaaggggaaacacagc

SEQ ID NO: 675185 - RNA, 23 nt, Homo sapiens
caggaaggugccuggccauguca

SEQ ID NO: 675186 - RNA, 14 nt, Homo sapiens
caggaauacugaac

SEQ ID NO: 675187 - RNA, 17 nt, Homo sapiens
caggaauacuuggaccu

SEQ ID NO: 675188 - RNA, 22 nt, Homo sapiens
caggaauagaauggagggagcu

SEQ ID NO: 675189 - RNA, 15 nt, Homo sapiens
caggaauauuuucca

SEQ ID NO: 675190 - RNA, 13 nt, Homo sapiens
caggaaugaguca

SEQ ID NO: 675191 - RNA, 16 nt, Homo sapiens
caggaauguguggccu

SEQ ID NO: 675192 - RNA, 23 nt, Homo sapiens
caggaauuaugucguaagucacu

SEQ ID NO: 675193 - RNA, 21 nt, Homo sapiens
caggaauuccucuuuugcuua

SEQ ID NO: 675194 - RNA, 22 nt, Homo sapiens
caggacacagggaaaucagggu

SEQ ID NO: 675195 - RNA, 23 nt, Homo sapiens
caggacacuaaugggaagaccaa

SEQ ID NO: 675196 - RNA, 13 nt, Homo sapiens
caggacauaggca

SEQ ID NO: 675197 - RNA, 10 nt, Homo sapiens
caggacaucu

SEQ ID NO: 675198 - RNA, 18 nt, Homo sapiens
caggacauuaaggaccaa

SEQ ID NO: 675199 - RNA, 15 nt, Homo sapiens
caggaccaagccaca

SEQ ID NO: 675200 - RNA, 15 nt, Homo sapiens
caggaccaguuugau

SEQ ID NO: 675201 - RNA, 18 nt, Homo sapiens
caggaccccuguccagga

SEQ ID NO: 675202 - RNA, 15 nt, Homo sapiens
caggacccgccugcu

SEQ ID NO: 675203 - RNA, 15 nt, Homo sapiens
caggaccuugggcac

SEQ ID NO: 675204 - RNA, 20 nt, Homo sapiens
caggaccuuuuggucuucag

SEQ ID NO: 675205 - RNA, 21 nt, Homo sapiens
caggaccuuuuggucuucagc

SEQ ID NO: 675206 - RNA, 13 nt, Homo sapiens
caggacggggcac

SEQ ID NO: 675207 - RNA, 17 nt, Homo sapiens
caggacuaggcauguca

SEQ ID NO: 675208 - RNA, 17 nt, Homo sapiens
caggacucacccuccac

SEQ ID NO: 675209 - RNA, 18 nt, Homo sapiens
caggacucuggcacuucc

SEQ ID NO: 675210 - RNA, 23 nt, Homo sapiens
caggacugagcccucucacucca

SEQ ID NO: 675211 - RNA, 18 nt, Homo sapiens
caggacugugccugaaca

SEQ ID NO: 675212 - RNA, 19 nt, Homo sapiens
caggacuucucuuuaguca

SEQ ID NO: 675213 - RNA, 20 nt, Homo sapiens
caggacuugcuaaagcacuu

SEQ ID NO: 675214 - RNA, 19 nt, Homo sapiens
caggacuuguuuacaaaga

SEQ ID NO: 675215 - RNA, 16 nt, Homo sapiens
caggagaagaacaaga

SEQ ID NO: 675216 - RNA, 14 nt, Homo sapiens
caggagaagggaua

SEQ ID NO: 675217 - RNA, 13 nt, Homo sapiens
caggagaaucacu

SEQ ID NO: 675218 - RNA, 18 nt, Homo sapiens
caggagaaucacuugaac

SEQ ID NO: 675219 - RNA, 13 nt, Homo sapiens
caggagaaucgcu

SEQ ID NO: 675220 - RNA, 17 nt, Homo sapiens
caggagaccuggcacug

SEQ ID NO: 675221 - RNA, 15 nt, Homo sapiens
caggagagugugcaa

SEQ ID NO: 675222 - RNA, 17 nt, Homo sapiens
caggagaugauucuguu

SEQ ID NO: 675223 - RNA, 18 nt, Homo sapiens
caggagcccacagugccu

SEQ ID NO: 675224 - RNA, 19 nt, Homo sapiens
caggagcgccucguucucu

SEQ ID NO: 675225 - RNA, 14 nt, Homo sapiens
caggagcucuccau

SEQ ID NO: 675226 - RNA, 11 nt, Homo sapiens
caggagcucuu

SEQ ID NO: 675227 - RNA, 23 nt, Homo sapiens
caggagcuugggcagugccccag

SEQ ID NO: 675228 - RNA, 18 nt, Homo sapiens
caggaggaauacugaaca

SEQ ID NO: 675229 - RNA, 23 nt, Homo sapiens
caggaggaggcugcccugagggg

SEQ ID NO: 675230 - RNA, 18 nt, Homo sapiens
caggaggcagacaaugac

SEQ ID NO: 675231 - RNA, 17 nt, Homo sapiens
caggaggccaauaaaaa

SEQ ID NO: 675232 - RNA, 21 nt, Homo sapiens
caggaggcccugguccuggcc

SEQ ID NO: 675233 - RNA, 18 nt, Homo sapiens
caggaggcuuggaaagca

SEQ ID NO: 675234 - RNA, 23 nt, Homo sapiens
caggagggcccggagaaacugag

SEQ ID NO: 675235 - RNA, 16 nt, Homo sapiens
caggagggcccuaccu

SEQ ID NO: 675236 - RNA, 20 nt, Homo sapiens
caggagggugacgcccagcu

SEQ ID NO: 675237 - RNA, 23 nt, Homo sapiens
caggagguggaggcugcagugag

SEQ ID NO: 675238 - RNA, 18 nt, Homo sapiens
caggagguuggugacuga

SEQ ID NO: 675239 - RNA, 19 nt, Homo sapiens
caggagguuguggaugcuc

SEQ ID NO: 675240 - RNA, 20 nt, Homo sapiens
caggagguuuuuuugucaac

SEQ ID NO: 675241 - RNA, 23 nt, Homo sapiens
caggaguguuaagcguucaguga

SEQ ID NO: 675242 - RNA, 12 nt, Homo sapiens
caggaguucaag

SEQ ID NO: 675243 - RNA, 20 nt, Homo sapiens
caggaguucgagaccagccu

SEQ ID NO: 675244 - RNA, 22 nt, Homo sapiens
caggauacuggcacagagguag

SEQ ID NO: 675245 - RNA, 16 nt, Homo sapiens
caggauccagugacau

SEQ ID NO: 675246 - RNA, 23 nt, Homo sapiens
caggaucugaguuauuuugcuaa

SEQ ID NO: 675247 - RNA, 15 nt, Homo sapiens
caggaucuguacaau

SEQ ID NO: 675248 - RNA, 13 nt, Homo sapiens
caggaugagggaa

SEQ ID NO: 675249 - RNA, 13 nt, Homo sapiens
caggaugcacauu

SEQ ID NO: 675250 - RNA, 12 nt, Homo sapiens
caggauggucau

SEQ ID NO: 675251 - RNA, 19 nt, Homo sapiens
caggauggucucgaucucu

SEQ ID NO: 675252 - RNA, 19 nt, Homo sapiens
caggauucaggaguuuuaa

SEQ ID NO: 675253 - RNA, 15 nt, Homo sapiens
caggcaaaauugaua

SEQ ID NO: 675254 - RNA, 15 nt, Homo sapiens
caggcaaugcuguac

SEQ ID NO: 675255 - RNA, 15 nt, Homo sapiens
caggcacacacagcc

SEQ ID NO: 675256 - RNA, 18 nt, Homo sapiens
caggcacacagcuacucu

SEQ ID NO: 675257 - RNA, 12 nt, Homo sapiens
caggcaccucac

SEQ ID NO: 675258 - RNA, 14 nt, Homo sapiens
caggcacgugccac

SEQ ID NO: 675259 - RNA, 23 nt, Homo sapiens
caggcacugccaggcuugcaguc

SEQ ID NO: 675260 - RNA, 15 nt, Homo sapiens
caggcacugccugga

SEQ ID NO: 675261 - RNA, 15 nt, Homo sapiens
caggcacugcugccc

SEQ ID NO: 675262 - RNA, 18 nt, Homo sapiens
auauuuaauucaccucag

SEQ ID NO: 675263 - RNA, 12 nt, Homo sapiens
auauuuacuacu

SEQ ID NO: 675264 - RNA, 15 nt, Homo sapiens
auauuuacuguuaga

SEQ ID NO: 675265 - RNA, 21 nt, Homo sapiens
auauuuagaaaaacaucccaa

SEQ ID NO: 675266 - RNA, 15 nt, Homo sapiens
auauuuauacuguau

SEQ ID NO: 675267 - RNA, 13 nt, Homo sapiens
auauuuaucugau

SEQ ID NO: 675268 - RNA, 15 nt, Homo sapiens
auauuucagugacag

SEQ ID NO: 675269 - RNA, 18 nt, Homo sapiens
auauuucauuuagcuuuu

SEQ ID NO: 675270 - RNA, 22 nt, Homo sapiens
auauuuccaucagcccaucuca

SEQ ID NO: 675271 - RNA, 17 nt, Homo sapiens
auauuuccuaaggcaug

SEQ ID NO: 675272 - RNA, 15 nt, Homo sapiens
auauuucuaacuaua

SEQ ID NO: 675273 - RNA, 14 nt, Homo sapiens
auauuucugauacu

SEQ ID NO: 675274 - RNA, 17 nt, Homo sapiens
auauuucuguguacaca

SEQ ID NO: 675275 - RNA, 20 nt, Homo sapiens
auauuucuuaucaccacagu

SEQ ID NO: 675276 - RNA, 15 nt, Homo sapiens
auauuugacuugcau

SEQ ID NO: 675277 - RNA, 14 nt, Homo sapiens
auauuugcugcaaa

SEQ ID NO: 675278 - RNA, 17 nt, Homo sapiens
auauuuggaaugaagga

SEQ ID NO: 675279 - RNA, 14 nt, Homo sapiens
auauuuguauacac

SEQ ID NO: 675280 - RNA, 13 nt, Homo sapiens
auauuuuacauac

SEQ ID NO: 675281 - RNA, 15 nt, Homo sapiens
auauuuuacugaucu

SEQ ID NO: 675282 - RNA, 21 nt, Homo sapiens
auauuuuacugaucucuuuaa

SEQ ID NO: 675283 - RNA, 16 nt, Homo sapiens
auauuuuagccuuaaa

SEQ ID NO: 675284 - RNA, 16 nt, Homo sapiens
auauuuucacauaugu

SEQ ID NO: 675285 - RNA, 15 nt, Homo sapiens
auauuuucaccauuu

SEQ ID NO: 675286 - RNA, 16 nt, Homo sapiens
auauuuugcauaguac

SEQ ID NO: 675287 - RNA, 12 nt, Homo sapiens
auauuuugccac

SEQ ID NO: 675288 - RNA, 15 nt, Homo sapiens
auauuuuguuuacaa

SEQ ID NO: 675289 - RNA, 16 nt, Homo sapiens
auauuuuucuaaagaa

SEQ ID NO: 675290 - RNA, 15 nt, Homo sapiens
auauuuuugugcaca

SEQ ID NO: 675291 - RNA, 14 nt, Homo sapiens
aucaaaaaguaauu

SEQ ID NO: 675292 - RNA, 20 nt, Homo sapiens
aucaaaagggagagaacaaa

SEQ ID NO: 675293 - RNA, 18 nt, Homo sapiens
aucaaaagggccaaagaa

SEQ ID NO: 675294 - RNA, 21 nt, Homo sapiens
aucaaaauaaaaagugacaca

SEQ ID NO: 675295 - RNA, 14 nt, Homo sapiens
aucaaaauccaaaa

SEQ ID NO: 675296 - RNA, 15 nt, Homo sapiens
aucaaacaugcacac

SEQ ID NO: 675297 - RNA, 13 nt, Homo sapiens
aucaaacccacga

SEQ ID NO: 675298 - RNA, 20 nt, Homo sapiens
aucaaacccacgauuuucuc

SEQ ID NO: 675299 - RNA, 17 nt, Homo sapiens
aucaaacuagugcauga

SEQ ID NO: 675300 - RNA, 19 nt, Homo sapiens
aucaaacucaaugcuuuau

SEQ ID NO: 675301 - RNA, 23 nt, Homo sapiens
aucaaagugugauauacaaagug

SEQ ID NO: 675302 - RNA, 23 nt, Homo sapiens
aucaaaucugcuuuuuaaagaau

SEQ ID NO: 675303 - RNA, 22 nt, Homo sapiens
aucaaaugugacauuauaugca

SEQ ID NO: 675304 - RNA, 20 nt, Homo sapiens
aucaacaaaucuucacugag

SEQ ID NO: 675305 - RNA, 14 nt, Homo sapiens
aucaacaacacagc

SEQ ID NO: 675306 - RNA, 18 nt, Homo sapiens
aucaacagaucaacaaua

SEQ ID NO: 675307 - RNA, 13 nt, Homo sapiens
aucaacagcauuu

SEQ ID NO: 675308 - RNA, 22 nt, Homo sapiens
aucaacauggcaauugcacuca

SEQ ID NO: 675309 - RNA, 15 nt, Homo sapiens
aucaacuaaugauuu

SEQ ID NO: 675310 - RNA, 18 nt, Homo sapiens
aucaacucucacuccuga

SEQ ID NO: 675311 - RNA, 22 nt, Homo sapiens
aucaacuuauuuuucaccaggu

SEQ ID NO: 675312 - RNA, 24 nt, Homo sapiens
aucaacuuuagcuaguaucuucaa

SEQ ID NO: 675313 - RNA, 22 nt, Homo sapiens
aucaagaaaugucucugcuccu

SEQ ID NO: 675314 - RNA, 17 nt, Homo sapiens
acccaaugccugugaag

SEQ ID NO: 675315 - RNA, 15 nt, Homo sapiens
acccaaugucuccca

SEQ ID NO: 675316 - RNA, 16 nt, Homo sapiens
acccaaugucucccac

SEQ ID NO: 675317 - RNA, 22 nt, Homo sapiens
acccaauuaaguccuacuuuac

SEQ ID NO: 675318 - RNA, 22 nt, Homo sapiens
acccaauucaaaacauugugcc

SEQ ID NO: 675319 - RNA, 20 nt, Homo sapiens
acccacaaauaaaugacaag

SEQ ID NO: 675320 - RNA, 21 nt, Homo sapiens
acccacaagagcaucaggcuc

SEQ ID NO: 675321 - RNA, 15 nt, Homo sapiens
acccacaauaaacuc

SEQ ID NO: 675322 - RNA, 22 nt, Homo sapiens
acccacagacugguuuugcaac

SEQ ID NO: 675323 - RNA, 12 nt, Homo sapiens
acccacagaugu

SEQ ID NO: 675324 - RNA, 13 nt, Homo sapiens
acccacagcugca

SEQ ID NO: 675325 - RNA, 14 nt, Homo sapiens
acccacagcugcag

SEQ ID NO: 675326 - RNA, 15 nt, Homo sapiens
acccacaucuaaugu

SEQ ID NO: 675327 - RNA, 17 nt, Homo sapiens
acccacaucuaaugucu

SEQ ID NO: 675328 - RNA, 14 nt, Homo sapiens
acccacaugcucca

SEQ ID NO: 675329 - RNA, 22 nt, Homo sapiens
acccaccauggaccagcccauu

SEQ ID NO: 675330 - RNA, 11 nt, Homo sapiens
acccaccauug

SEQ ID NO: 675331 - RNA, 14 nt, Homo sapiens
acccaccccagugc

SEQ ID NO: 675332 - RNA, 18 nt, Homo sapiens
acccaccuucaagcagcu

SEQ ID NO: 675333 - RNA, 22 nt, Homo sapiens
acccacugaaaugaccaagaca

SEQ ID NO: 675334 - RNA, 14 nt, Homo sapiens
acccacugacccac

SEQ ID NO: 675335 - RNA, 21 nt, Homo sapiens
acccacuucuaaauagcaauu

SEQ ID NO: 675336 - RNA, 21 nt, Homo sapiens
acccagagaguccugugcuga

SEQ ID NO: 675337 - RNA, 24 nt, Homo sapiens
acccagagaguccugugcugaaug

SEQ ID NO: 675338 - RNA, 17 nt, Homo sapiens
acccagaggcagcagag

SEQ ID NO: 675339 - RNA, 16 nt, Homo sapiens
acccagaggcccugaa

SEQ ID NO: 675340 - RNA, 20 nt, Homo sapiens
acccagaucaggaaccaggg

SEQ ID NO: 675341 - RNA, 20 nt, Homo sapiens
acccagaugccaaccagaca

SEQ ID NO: 675342 - RNA, 15 nt, Homo sapiens
acccagcaucuccca

SEQ ID NO: 675343 - RNA, 19 nt, Homo sapiens
acccagccaugcugugaua

SEQ ID NO: 675344 - RNA, 18 nt, Homo sapiens
acccagcccagcuugcca

SEQ ID NO: 675345 - RNA, 20 nt, Homo sapiens
acccaggacuuccauuugcu

SEQ ID NO: 675346 - RNA, 17 nt, Homo sapiens
acccaggaguguggcca

SEQ ID NO: 675347 - RNA, 19 nt, Homo sapiens
acccaggcccgcaccgcug

SEQ ID NO: 675348 - RNA, 21 nt, Homo sapiens
acccagggccugacuugagcc

SEQ ID NO: 675349 - RNA, 15 nt, Homo sapiens
acccaggugauuucc

SEQ ID NO: 675350 - RNA, 12 nt, Homo sapiens
acccagucccac

SEQ ID NO: 675351 - RNA, 16 nt, Homo sapiens
acccagucccacacug

SEQ ID NO: 675352 - RNA, 13 nt, Homo sapiens
acccagucucaga

SEQ ID NO: 675353 - RNA, 14 nt, Homo sapiens
acccaguguagcau

SEQ ID NO: 675354 - RNA, 17 nt, Homo sapiens
acccaguuagcucucaa

SEQ ID NO: 675355 - RNA, 20 nt, Homo sapiens
acccaguuggugacugggaa

SEQ ID NO: 675356 - RNA, 20 nt, Homo sapiens
acccauaaguuuaacuguau

SEQ ID NO: 675357 - RNA, 19 nt, Homo sapiens
acccaucuaguacuugaaa

SEQ ID NO: 675358 - RNA, 15 nt, Homo sapiens
acccaucucaacagg

SEQ ID NO: 675359 - RNA, 13 nt, Homo sapiens
acccaucuuccac

SEQ ID NO: 675360 - RNA, 22 nt, Homo sapiens
acccaucuuuaauuuauaucag

SEQ ID NO: 675361 - RNA, 17 nt, Homo sapiens
acccaugaaucaaagac

SEQ ID NO: 675362 - RNA, 12 nt, Homo sapiens
acccaugccaga

SEQ ID NO: 675363 - RNA, 15 nt, Homo sapiens
acccaugccagagag

SEQ ID NO: 675364 - RNA, 16 nt, Homo sapiens
acccauuaucuggaau

SEQ ID NO: 675365 - RNA, 20 nt, Homo sapiens
acccauucguggugaucaau

SEQ ID NO: 675366 - RNA, 15 nt, Homo sapiens
accccaaaccuggca

SEQ ID NO: 675367 - RNA, 15 nt, Homo sapiens
accccaaagcuuucc

SEQ ID NO: 675368 - RNA, 14 nt, Homo sapiens
accccaagcugccu

SEQ ID NO: 675369 - RNA, 23 nt, Homo sapiens
accccaaucccugccacugggcu

SEQ ID NO: 675370 - RNA, 16 nt, Homo sapiens
accccacacccagggc

SEQ ID NO: 675371 - RNA, 18 nt, Homo sapiens
accccacagacacuuaca

SEQ ID NO: 675372 - RNA, 20 nt, Homo sapiens
accccacgugcgacagagag

SEQ ID NO: 675373 - RNA, 18 nt, Homo sapiens
accccagcaugagugcug

SEQ ID NO: 675374 - RNA, 17 nt, Homo sapiens
accccagcucccuagga

SEQ ID NO: 675375 - RNA, 11 nt, Homo sapiens
accccagcugg

SEQ ID NO: 675376 - RNA, 15 nt, Homo sapiens
accccaggucagggg

SEQ ID NO: 675377 - RNA, 22 nt, Homo sapiens
accccaguaccgacuaagcaaa

SEQ ID NO: 675378 - RNA, 20 nt, Homo sapiens
accccagugggaacugugca

SEQ ID NO: 675379 - RNA, 15 nt, Homo sapiens
accccaucucuacua

SEQ ID NO: 675380 - RNA, 16 nt, Homo sapiens
accccaucucuacuga

SEQ ID NO: 675381 - RNA, 17 nt, Homo sapiens
accccaucuuuacuaaa

SEQ ID NO: 675382 - RNA, 21 nt, Homo sapiens
acccccaaacacaaaacauuc

SEQ ID NO: 675383 - RNA, 17 nt, Homo sapiens
acccccaccaugcagcc

SEQ ID NO: 675384 - RNA, 18 nt, Homo sapiens
agcagagcagcucugcua

SEQ ID NO: 675385 - RNA, 13 nt, Homo sapiens
agcagagcaggca

SEQ ID NO: 675386 - RNA, 15 nt, Homo sapiens
agcagaggucuccca

SEQ ID NO: 675387 - RNA, 15 nt, Homo sapiens
agcagauacugucuu

SEQ ID NO: 675388 - RNA, 14 nt, Homo sapiens
agcagauacuugag

SEQ ID NO: 675389 - RNA, 14 nt, Homo sapiens
agcagaugacaaaa

SEQ ID NO: 675390 - RNA, 16 nt, Homo sapiens
agcagaugccagugaa

SEQ ID NO: 675391 - RNA, 17 nt, Homo sapiens
agcagaugccagugaag

SEQ ID NO: 675392 - RNA, 21 nt, Homo sapiens
agcagauggacagcgaugagg

SEQ ID NO: 675393 - RNA, 15 nt, Homo sapiens
agcagaugguuucca

SEQ ID NO: 675394 - RNA, 13 nt, Homo sapiens
agcagauuccaca

SEQ ID NO: 675395 - RNA, 20 nt, Homo sapiens
agcagcaccaaccacagcau

SEQ ID NO: 675396 - RNA, 21 nt, Homo sapiens
agcagcaccguucugugcaca

SEQ ID NO: 675397 - RNA, 13 nt, Homo sapiens
agcagcacuguga

SEQ ID NO: 675398 - RNA, 11 nt, Homo sapiens
agcagcacuuu

SEQ ID NO: 675399 - RNA, 13 nt, Homo sapiens
agcagcagcacca

SEQ ID NO: 675400 - RNA, 13 nt, Homo sapiens
agcagccaggagg

SEQ ID NO: 675401 - RNA, 14 nt, Homo sapiens
agcagccagucuca

SEQ ID NO: 675402 - RNA, 15 nt, Homo sapiens
agcagcccagcacau

SEQ ID NO: 675403 - RNA, 14 nt, Homo sapiens
agcagccucgcaca

SEQ ID NO: 675404 - RNA, 18 nt, Homo sapiens
agcagcggggcagugugg

SEQ ID NO: 675405 - RNA, 17 nt, Homo sapiens
agcagcugaaaauuuau

SEQ ID NO: 675406 - RNA, 15 nt, Homo sapiens
agcagcugguggaag

SEQ ID NO: 675407 - RNA, 15 nt, Homo sapiens
agcagcuucugggac

SEQ ID NO: 675408 - RNA, 21 nt, Homo sapiens
agcagcuucugggaccauaag

SEQ ID NO: 675409 - RNA, 21 nt, Homo sapiens
agcagcuuuaaacaaauucau

SEQ ID NO: 675410 - RNA, 23 nt, Homo sapiens
agcaggaauauaugugugccuau

SEQ ID NO: 675411 - RNA, 15 nt, Homo sapiens
agcaggacugcacag

SEQ ID NO: 675412 - RNA, 18 nt, Homo sapiens
agcaggagguuaucugug

SEQ ID NO: 675413 - RNA, 14 nt, Homo sapiens
agcaggcaauuuca

SEQ ID NO: 675414 - RNA, 19 nt, Homo sapiens
agcaggcagcgccaagugc

SEQ ID NO: 675415 - RNA, 12 nt, Homo sapiens
agcaggccacug

SEQ ID NO: 675416 - RNA, 15 nt, Homo sapiens
agcaggccacugggg

SEQ ID NO: 675417 - RNA, 23 nt, Homo sapiens
agcaggcccagcaugcagguggu

SEQ ID NO: 675418 - RNA, 20 nt, Homo sapiens
agcaggcuccuggcugugcc

SEQ ID NO: 675419 - RNA, 13 nt, Homo sapiens
agcagggacaaga

SEQ ID NO: 675420 - RNA, 13 nt, Homo sapiens
agcagggacaccc

SEQ ID NO: 675421 - RNA, 18 nt, Homo sapiens
agcagggauuaaccucug

SEQ ID NO: 675422 - RNA, 21 nt, Homo sapiens
agcagggcuauauuucaguga

SEQ ID NO: 675423 - RNA, 19 nt, Homo sapiens
agcagggggagugcugguc

SEQ ID NO: 675424 - RNA, 17 nt, Homo sapiens
agcaggggggcugugcc

SEQ ID NO: 675425 - RNA, 16 nt, Homo sapiens
agcaggguacccuuug

SEQ ID NO: 675426 - RNA, 22 nt, Homo sapiens
agcaggguagcuauuacugucc

SEQ ID NO: 675427 - RNA, 15 nt, Homo sapiens
agcagggucuggaag

SEQ ID NO: 675428 - RNA, 22 nt, Homo sapiens
agcagggucuuuucaucuggga

SEQ ID NO: 675429 - RNA, 20 nt, Homo sapiens
agcaggguggggucugggag

SEQ ID NO: 675430 - RNA, 21 nt, Homo sapiens
agcaggugcuacaacauguga

SEQ ID NO: 675431 - RNA, 17 nt, Homo sapiens
agcaggugcugacuuca

SEQ ID NO: 675432 - RNA, 12 nt, Homo sapiens
agcaggugcugu

SEQ ID NO: 675433 - RNA, 20 nt, Homo sapiens
agagcaagacuccaucucaa

SEQ ID NO: 675434 - RNA, 13 nt, Homo sapiens
agagcaauuguaa

SEQ ID NO: 675435 - RNA, 15 nt, Homo sapiens
agagcagcuagcucu

SEQ ID NO: 675436 - RNA, 16 nt, Homo sapiens
agagcagcuagcucuu

SEQ ID NO: 675437 - RNA, 16 nt, Homo sapiens
agagcaggcaggggca

SEQ ID NO: 675438 - RNA, 13 nt, Homo sapiens
agagcagggauua

SEQ ID NO: 675439 - RNA, 20 nt, Homo sapiens
agagcaggggagcuugggac

SEQ ID NO: 675440 - RNA, 17 nt, Homo sapiens
agagcagucacaacaga

SEQ ID NO: 675441 - RNA, 15 nt, Homo sapiens
agagcaucugcaaca

SEQ ID NO: 675442 - RNA, 21 nt, Homo sapiens
agagcauggaaaaauacugcc

SEQ ID NO: 675443 - RNA, 14 nt, Homo sapiens
agagccaagcugca

SEQ ID NO: 675444 - RNA, 17 nt, Homo sapiens
agagccacagcugugca

SEQ ID NO: 675445 - RNA, 17 nt, Homo sapiens
agagccaccccaugagc

SEQ ID NO: 675446 - RNA, 20 nt, Homo sapiens
agagccagccggcuaugaaa

SEQ ID NO: 675447 - RNA, 14 nt, Homo sapiens
agagccagcucucu

SEQ ID NO: 675448 - RNA, 17 nt, Homo sapiens
agagccaggcuguugga

SEQ ID NO: 675449 - RNA, 19 nt, Homo sapiens
agagccagggcuguccuua

SEQ ID NO: 675450 - RNA, 13 nt, Homo sapiens
agagccagugaag

SEQ ID NO: 675451 - RNA, 22 nt, Homo sapiens
agagccauggacucuacacugu

SEQ ID NO: 675452 - RNA, 21 nt, Homo sapiens
agagccauuagagcacagcuu

SEQ ID NO: 675453 - RNA, 23 nt, Homo sapiens
agagcccccaccuugaucccaau

SEQ ID NO: 675454 - RNA, 15 nt, Homo sapiens
agagcccccuugaca

SEQ ID NO: 675455 - RNA, 20 nt, Homo sapiens
agagcccggcgccccugcca

SEQ ID NO: 675456 - RNA, 21 nt, Homo sapiens
agagcccggcgccccugccac

SEQ ID NO: 675457 - RNA, 20 nt, Homo sapiens
agagcccugcucccagacau

SEQ ID NO: 675458 - RNA, 20 nt, Homo sapiens
agagcccuucacugccauga

SEQ ID NO: 675459 - RNA, 22 nt, Homo sapiens
agagcccuucaugcauuugcac

SEQ ID NO: 675460 - RNA, 23 nt, Homo sapiens
agagcccuucaugcauuugcacu

SEQ ID NO: 675461 - RNA, 17 nt, Homo sapiens
agagccuggugcugcug

SEQ ID NO: 675462 - RNA, 13 nt, Homo sapiens
agagccuguaaac

SEQ ID NO: 675463 - RNA, 20 nt, Homo sapiens
agagccuucacugguucugc

SEQ ID NO: 675464 - RNA, 21 nt, Homo sapiens
agagccuucacugguucugca

SEQ ID NO: 675465 - RNA, 20 nt, Homo sapiens
agagccuucagaaugcuccu

SEQ ID NO: 675466 - RNA, 13 nt, Homo sapiens
agagccuuuccaa

SEQ ID NO: 675467 - RNA, 19 nt, Homo sapiens
agagcgagacuccgucuca

SEQ ID NO: 675468 - RNA, 20 nt, Homo sapiens
agagcgagacuccgucucaa

SEQ ID NO: 675469 - RNA, 15 nt, Homo sapiens
agagcgagaguccau

SEQ ID NO: 675470 - RNA, 20 nt, Homo sapiens
agagcgagauuccgucucaa

SEQ ID NO: 675471 - RNA, 18 nt, Homo sapiens
agagcgaggaaaggauuu

SEQ ID NO: 675472 - RNA, 16 nt, Homo sapiens
agagcgauaauacacu

SEQ ID NO: 675473 - RNA, 22 nt, Homo sapiens
agagcgugcuuucaaguguccu

SEQ ID NO: 675474 - RNA, 14 nt, Homo sapiens
agagcuauguuccc

SEQ ID NO: 675475 - RNA, 15 nt, Homo sapiens
agagcugagcacuuu

SEQ ID NO: 675476 - RNA, 19 nt, Homo sapiens
agagcugcacagcaaaaga

SEQ ID NO: 675477 - RNA, 18 nt, Homo sapiens
agagcuggcacccuguca

SEQ ID NO: 675478 - RNA, 23 nt, Homo sapiens
agagcuguuuggauacagcugcu

SEQ ID NO: 675479 - RNA, 20 nt, Homo sapiens
agagcuuaggauucuaaucu

SEQ ID NO: 675480 - RNA, 16 nt, Homo sapiens
agagcuucucccaaac

SEQ ID NO: 675481 - RNA, 15 nt, Homo sapiens
agagcuuuaucccua

SEQ ID NO: 675482 - RNA, 15 nt, Homo sapiens
agagcuuucaaguac

SEQ ID NO: 675483 - RNA, 17 nt, Homo sapiens
agagcuuugugcuuguc

SEQ ID NO: 675484 - RNA, 23 nt, Homo sapiens
agagcuuugugcuugucauucca

SEQ ID NO: 675485 - RNA, 20 nt, Homo sapiens
agaggaaaagaaagaaguua

SEQ ID NO: 675486 - RNA, 13 nt, Homo sapiens
agaggaacaagca

SEQ ID NO: 675487 - RNA, 18 nt, Homo sapiens
agagugaaaccaugacug

SEQ ID NO: 675488 - RNA, 20 nt, Homo sapiens
agagugagacuccaccucaa

SEQ ID NO: 675489 - RNA, 20 nt, Homo sapiens
agagugagagacaucaucaa

SEQ ID NO: 675490 - RNA, 20 nt, Homo sapiens
agagugagagacauuaacuc

SEQ ID NO: 675491 - RNA, 20 nt, Homo sapiens
agagugagcaagggggccca

SEQ ID NO: 675492 - RNA, 20 nt, Homo sapiens
agagugauaggacauucuau

SEQ ID NO: 675493 - RNA, 12 nt, Homo sapiens
agagugcaaugg

SEQ ID NO: 675494 - RNA, 14 nt, Homo sapiens
agagugcuugggau

SEQ ID NO: 675495 - RNA, 17 nt, Homo sapiens
agaguggagagugacau

SEQ ID NO: 675496 - RNA, 16 nt, Homo sapiens
agaguggagucugagu

SEQ ID NO: 675497 - RNA, 22 nt, Homo sapiens
agaguggccuagagcacucuca

SEQ ID NO: 675498 - RNA, 21 nt, Homo sapiens
agaguggccuggccaggagcu

SEQ ID NO: 675499 - RNA, 19 nt, Homo sapiens
agaguggggaugacaugca

SEQ ID NO: 675500 - RNA, 16 nt, Homo sapiens
agaguggguacuagaa

SEQ ID NO: 675501 - RNA, 16 nt, Homo sapiens
agaguggguuucacaa

SEQ ID NO: 675502 - RNA, 11 nt, Homo sapiens
agaguggugcu

SEQ ID NO: 675503 - RNA, 11 nt, Homo sapiens
agagugguggg

SEQ ID NO: 675504 - RNA, 20 nt, Homo sapiens
agagugucucagggugcaga

SEQ ID NO: 675505 - RNA, 13 nt, Homo sapiens
agagugucuuucc

SEQ ID NO: 675506 - RNA, 17 nt, Homo sapiens
agagugugaaacuuccu

SEQ ID NO: 675507 - RNA, 16 nt, Homo sapiens
agaguguggauuguau

SEQ ID NO: 675508 - RNA, 15 nt, Homo sapiens
agagugugguuauga

SEQ ID NO: 675509 - RNA, 22 nt, Homo sapiens
agaguguuuggggguuccguga

SEQ ID NO: 675510 - RNA, 15 nt, Homo sapiens
agaguuaaaucucaa

SEQ ID NO: 675511 - RNA, 22 nt, Homo sapiens
agaguucacccugugcccuccg

SEQ ID NO: 675512 - RNA, 19 nt, Homo sapiens
agaguuggacuucuagacu

SEQ ID NO: 675513 - RNA, 17 nt, Homo sapiens
agaguuggggaaggcaa

SEQ ID NO: 675514 - RNA, 21 nt, Homo sapiens
agaguuucaaaagcaaaacau

SEQ ID NO: 675515 - RNA, 21 nt, Homo sapiens
agaguuucuccuuuugaccaa

SEQ ID NO: 675516 - RNA, 18 nt, Homo sapiens
agaguuuguguguugucu

SEQ ID NO: 675517 - RNA, 14 nt, Homo sapiens
agaguuuuaucaac

SEQ ID NO: 675518 - RNA, 21 nt, Homo sapiens
agaguuuuuauuuuguuacaa

SEQ ID NO: 675519 - RNA, 17 nt, Homo sapiens
agauaaaagauguacuu

SEQ ID NO: 675520 - RNA, 17 nt, Homo sapiens
agauaaacaacaaauaa

SEQ ID NO: 675521 - RNA, 14 nt, Homo sapiens
agauaaaccaauaa

SEQ ID NO: 675522 - RNA, 16 nt, Homo sapiens
agauaaaccaguugaa

SEQ ID NO: 675523 - RNA, 16 nt, Homo sapiens
agauaaauagaacuau

SEQ ID NO: 675524 - RNA, 13 nt, Homo sapiens
agauaaaugcaca

SEQ ID NO: 675525 - RNA, 19 nt, Homo sapiens
agauaacagccucuugccc

SEQ ID NO: 675526 - RNA, 13 nt, Homo sapiens
agauaacugagaa

SEQ ID NO: 675527 - RNA, 21 nt, Homo sapiens
agauaacuugagcaccgucau

SEQ ID NO: 675528 - RNA, 17 nt, Homo sapiens
agauaaggcaagccagu

SEQ ID NO: 675529 - RNA, 22 nt, Homo sapiens
agauaaguuugcaguuggcuaa

SEQ ID NO: 675530 - RNA, 15 nt, Homo sapiens
agauaauacaccacu

SEQ ID NO: 675531 - RNA, 13 nt, Homo sapiens
agauaauuggcaa

SEQ ID NO: 675532 - RNA, 14 nt, Homo sapiens
agauaauuggcaac

SEQ ID NO: 675533 - RNA, 17 nt, Homo sapiens
agauaauuuauuauaca

SEQ ID NO: 675534 - RNA, 12 nt, Homo sapiens
agauacaaacug

SEQ ID NO: 675535 - RNA, 13 nt, Homo sapiens
agauacaaacugc

SEQ ID NO: 675536 - RNA, 14 nt, Homo sapiens
agauacaucacugc

SEQ ID NO: 675537 - RNA, 12 nt, Homo sapiens
agauacauuucc

SEQ ID NO: 675538 - RNA, 20 nt, Homo sapiens
agauacauuuuuagaaauca

SEQ ID NO: 675539 - RNA, 14 nt, Homo sapiens
agauggcacuuuga

SEQ ID NO: 675540 - RNA, 20 nt, Homo sapiens
agauggcauaaccugucuca

SEQ ID NO: 675541 - RNA, 12 nt, Homo sapiens
agauggcccaag

SEQ ID NO: 675542 - RNA, 22 nt, Homo sapiens
agauggcugugccucugccugu

SEQ ID NO: 675543 - RNA, 18 nt, Homo sapiens
agaugggaugcuugccua

SEQ ID NO: 675544 - RNA, 23 nt, Homo sapiens
agauggggcgggggugugucugu

SEQ ID NO: 675545 - RNA, 17 nt, Homo sapiens
agaugggggaacuguga

SEQ ID NO: 675546 - RNA, 22 nt, Homo sapiens
agauggguauuaaacuugucag

SEQ ID NO: 675547 - RNA, 12 nt, Homo sapiens
agauggugaccc

SEQ ID NO: 675548 - RNA, 17 nt, Homo sapiens
agauguaacccaccuug

SEQ ID NO: 675549 - RNA, 21 nt, Homo sapiens
agauguacaaaacaguuugaa

SEQ ID NO: 675550 - RNA, 13 nt, Homo sapiens
agauguacugcaa

SEQ ID NO: 675551 - RNA, 14 nt, Homo sapiens
agauguacugcaaa

SEQ ID NO: 675552 - RNA, 23 nt, Homo sapiens
agaugucgcccuacucaccugag

SEQ ID NO: 675553 - RNA, 20 nt, Homo sapiens
agaugugagccaccgugccu

SEQ ID NO: 675554 - RNA, 19 nt, Homo sapiens
agauguggcuacugacaua

SEQ ID NO: 675555 - RNA, 16 nt, Homo sapiens
agaugugucuauggcu

SEQ ID NO: 675556 - RNA, 14 nt, Homo sapiens
agaugugucuuacc

SEQ ID NO: 675557 - RNA, 17 nt, Homo sapiens
agauguucacuguggca

SEQ ID NO: 675558 - RNA, 11 nt, Homo sapiens
agauguuccuc

SEQ ID NO: 675559 - RNA, 16 nt, Homo sapiens
agauguugucuuggcu

SEQ ID NO: 675560 - RNA, 19 nt, Homo sapiens
agauguuucaacugugcuc

SEQ ID NO: 675561 - RNA, 19 nt, Homo sapiens
agauguuugaggcuuucag

SEQ ID NO: 675562 - RNA, 19 nt, Homo sapiens
agauuacuuuucuuacucu

SEQ ID NO: 675563 - RNA, 20 nt, Homo sapiens
agauuagaagacaacaggca

SEQ ID NO: 675564 - RNA, 15 nt, Homo sapiens
agauuagcucuggac

SEQ ID NO: 675565 - RNA, 17 nt, Homo sapiens
agauuagguagacuuug

SEQ ID NO: 675566 - RNA, 17 nt, Homo sapiens
agauuaguaaauaugug

SEQ ID NO: 675567 - RNA, 22 nt, Homo sapiens
agauucagacuuggacuaugau

SEQ ID NO: 675568 - RNA, 22 nt, Homo sapiens
agauucauaggcagcaucucag

SEQ ID NO: 675569 - RNA, 22 nt, Homo sapiens
agauuccaggcgaugugcaagu

SEQ ID NO: 675570 - RNA, 18 nt, Homo sapiens
agauucccacccaauuca

SEQ ID NO: 675571 - RNA, 18 nt, Homo sapiens
agauucccagaccuuaag

SEQ ID NO: 675572 - RNA, 16 nt, Homo sapiens
agauucuaaagcucaa

SEQ ID NO: 675573 - RNA, 16 nt, Homo sapiens
agauucuccugugcua

SEQ ID NO: 675574 - RNA, 17 nt, Homo sapiens
agauucuucagcuugau

SEQ ID NO: 675575 - RNA, 14 nt, Homo sapiens
agauucuuccccaa

SEQ ID NO: 675576 - RNA, 16 nt, Homo sapiens
agauugagcucucugc

SEQ ID NO: 675577 - RNA, 13 nt, Homo sapiens
agauugauacuuu

SEQ ID NO: 675578 - RNA, 14 nt, Homo sapiens
agauugcacuauug

SEQ ID NO: 675579 - RNA, 24 nt, Homo sapiens
agauugcuagaaaagacauaauca

SEQ ID NO: 675580 - RNA, 21 nt, Homo sapiens
agauugcugaaaaaguagauu

SEQ ID NO: 675581 - RNA, 14 nt, Homo sapiens
agauugcuuucuuc

SEQ ID NO: 675582 - RNA, 18 nt, Homo sapiens
agauuggcauggcuuuau

SEQ ID NO: 675583 - RNA, 17 nt, Homo sapiens
agauuggccagcaaaaa

SEQ ID NO: 675584 - RNA, 19 nt, Homo sapiens
agauuggccagcaaaaacu

SEQ ID NO: 675585 - RNA, 12 nt, Homo sapiens
agauuguguucc

SEQ ID NO: 675586 - RNA, 19 nt, Homo sapiens
agauuguguuuguucauaa

SEQ ID NO: 675587 - RNA, 16 nt, Homo sapiens
agauuuaaagcacaug

SEQ ID NO: 675588 - RNA, 17 nt, Homo sapiens
agauuuaaagcacaugc

SEQ ID NO: 675589 - RNA, 15 nt, Homo sapiens
agauuuaaauccuuu

SEQ ID NO: 675590 - RNA, 13 nt, Homo sapiens
agauuuacccauc

SEQ ID NO: 675591 - RNA, 14 nt, Homo sapiens
agauuucaguagaa

SEQ ID NO: 675592 - RNA, 16 nt, Homo sapiens
agauuucaugccuggu

SEQ ID NO: 675593 - RNA, 15 nt, Homo sapiens
agauuuccuuucaga

SEQ ID NO: 675594 - RNA, 23 nt, Homo sapiens
agauuucggaggccauccugcca

SEQ ID NO: 675595 - RNA, 20 nt, Homo sapiens
agauuuggaggcuaccucac

SEQ ID NO: 675596 - RNA, 18 nt, Homo sapiens
agauuuggaugcacucau

SEQ ID NO: 675597 - RNA, 22 nt, Homo sapiens
agauuuggaugcacucauuuaa

SEQ ID NO: 675598 - RNA, 17 nt, Homo sapiens
agauuuggcuugacaaa

SEQ ID NO: 675599 - RNA, 12 nt, Homo sapiens
agauuugucaca

SEQ ID NO: 675600 - RNA, 22 nt, Homo sapiens
agauuuuacagagcgcaccuca

SEQ ID NO: 675601 - RNA, 14 nt, Homo sapiens
agauuuuaccuauc

SEQ ID NO: 675602 - RNA, 17 nt, Homo sapiens
agauuuucaugcaaaag

SEQ ID NO: 675603 - RNA, 16 nt, Homo sapiens
agauuuucuuuugccu

SEQ ID NO: 675604 - RNA, 21 nt, Homo sapiens
agcaaaaacauguaugugcau

SEQ ID NO: 675605 - RNA, 10 nt, Homo sapiens
agcaaaaacu

SEQ ID NO: 675606 - RNA, 16 nt, Homo sapiens
agcaaaaagcaaaauc

SEQ ID NO: 675607 - RNA, 16 nt, Homo sapiens
agcaaaagaccaaauc

SEQ ID NO: 675608 - RNA, 21 nt, Homo sapiens
agcaaaaggcagcucaccccu

SEQ ID NO: 675609 - RNA, 22 nt, Homo sapiens
agcaaaaguagccaucauuccu

SEQ ID NO: 675610 - RNA, 18 nt, Homo sapiens
agcaaaaucaacaugacu

SEQ ID NO: 675611 - RNA, 18 nt, Homo sapiens
agcaaacacuuacagaau

SEQ ID NO: 675612 - RNA, 19 nt, Homo sapiens
agcaaaccgcccugcagca

SEQ ID NO: 675613 - RNA, 18 nt, Homo sapiens
agcaaaggagacaaagca

SEQ ID NO: 675614 - RNA, 17 nt, Homo sapiens
agcaaaggcccaugccc

SEQ ID NO: 675615 - RNA, 18 nt, Homo sapiens
agcaaagggagcacuggg

SEQ ID NO: 675616 - RNA, 15 nt, Homo sapiens
agcaaaguaguacuu

SEQ ID NO: 675617 - RNA, 19 nt, Homo sapiens
agcaaauaaauacguguca

SEQ ID NO: 675618 - RNA, 18 nt, Homo sapiens
agcaaauaccuaugucaa

SEQ ID NO: 675619 - RNA, 17 nt, Homo sapiens
agcaaauagaucaugca

SEQ ID NO: 675620 - RNA, 23 nt, Homo sapiens
agcaaaugcuacauauaugcaau

SEQ ID NO: 675621 - RNA, 16 nt, Homo sapiens
agcaaaugggggaaaa

SEQ ID NO: 675622 - RNA, 21 nt, Homo sapiens
agcaaauguuuaaaauccaaa

SEQ ID NO: 675623 - RNA, 11 nt, Homo sapiens
agcaacaaaga

SEQ ID NO: 675624 - RNA, 16 nt, Homo sapiens
agcaacaagacugcca

SEQ ID NO: 675625 - RNA, 21 nt, Homo sapiens
agcaacacucuauauuuagau

SEQ ID NO: 675626 - RNA, 17 nt, Homo sapiens
agcaacauaucucugcc

SEQ ID NO: 675627 - RNA, 17 nt, Homo sapiens
agcaaccuccacauguu

SEQ ID NO: 675628 - RNA, 19 nt, Homo sapiens
agcaaccuccacauguuca

SEQ ID NO: 675629 - RNA, 21 nt, Homo sapiens
agcaacucugagaucuaagga

SEQ ID NO: 675630 - RNA, 14 nt, Homo sapiens
agcaacugucuuau

SEQ ID NO: 675631 - RNA, 18 nt, Homo sapiens
agcaacuguuaugaaaua

SEQ ID NO: 675632 - RNA, 16 nt, Homo sapiens
agcaacuucauuugac

SEQ ID NO: 675633 - RNA, 17 nt, Homo sapiens
agcaagaagcuguuacc

SEQ ID NO: 675634 - RNA, 13 nt, Homo sapiens
agcaagaugcaaa

SEQ ID NO: 675635 - RNA, 22 nt, Homo sapiens
agcaagccaucauccuccauug

SEQ ID NO: 675636 - RNA, 21 nt, Homo sapiens
agcaagcgcuguaaacccuga

SEQ ID NO: 675637 - RNA, 21 nt, Homo sapiens
agcaaggcuggguaaugugaa

SEQ ID NO: 675638 - RNA, 19 nt, Homo sapiens
agcaaggguuggaggcaau

SEQ ID NO: 675639 - RNA, 20 nt, Homo sapiens
agcaaggguuggaggcaaug

SEQ ID NO: 675640 - RNA, 20 nt, Homo sapiens
agcaagucuuagacaucaua

SEQ ID NO: 675641 - RNA, 21 nt, Homo sapiens
agcaagugaauuuuucucuaa

SEQ ID NO: 675642 - RNA, 14 nt, Homo sapiens
agcaagugcacaug

SEQ ID NO: 675643 - RNA, 22 nt, Homo sapiens
agcaaguguucacaacagugaa

SEQ ID NO: 675644 - RNA, 19 nt, Homo sapiens
agcaaguuucaucagucaa

SEQ ID NO: 675645 - RNA, 21 nt, Homo sapiens
agcaauaacauacaugagaua

SEQ ID NO: 675646 - RNA, 15 nt, Homo sapiens
agcaauaacauuccc

SEQ ID NO: 675647 - RNA, 14 nt, Homo sapiens
agcaauaacuucua

SEQ ID NO: 675648 - RNA, 18 nt, Homo sapiens
agcaauaccagcaauuca

SEQ ID NO: 675649 - RNA, 13 nt, Homo sapiens
agcaauaccaguu

SEQ ID NO: 675650 - RNA, 9 nt, Homo sapiens
agcaauacu

SEQ ID NO: 675651 - RNA, 19 nt, Homo sapiens
agcaaucaagguuauaauu

SEQ ID NO: 675652 - RNA, 20 nt, Homo sapiens
agcaaucauuuuaugcuguu

SEQ ID NO: 675653 - RNA, 16 nt, Homo sapiens
agcaauccaugaucua

SEQ ID NO: 675654 - RNA, 15 nt, Homo sapiens
agcaauccuccugcc

SEQ ID NO: 675655 - RNA, 22 nt, Homo sapiens
agcaaugaaggagauagauuug

SEQ ID NO: 675656 - RNA, 14 nt, Homo sapiens
agcaaugauuacuc

SEQ ID NO: 675657 - RNA, 14 nt, Homo sapiens
agcaaugccauuuc

SEQ ID NO: 675658 - RNA, 16 nt, Homo sapiens
agcaaugggucuuagc

SEQ ID NO: 675659 - RNA, 20 nt, Homo sapiens
agcaauuagauuaguauuuu

SEQ ID NO: 675660 - RNA, 16 nt, Homo sapiens
agcaauuagugauaua

SEQ ID NO: 675661 - RNA, 19 nt, Homo sapiens
acuaaugccauaggugaga

SEQ ID NO: 675662 - RNA, 12 nt, Homo sapiens
acuaaugcuuua

SEQ ID NO: 675663 - RNA, 15 nt, Homo sapiens
acuaauguacuguac

SEQ ID NO: 675664 - RNA, 19 nt, Homo sapiens
acuaauguacuguacauaa

SEQ ID NO: 675665 - RNA, 23 nt, Homo sapiens
acuaauguuggacagacacuguu

SEQ ID NO: 675666 - RNA, 23 nt, Homo sapiens
acuaauuaggcaaggcuauguga

SEQ ID NO: 675667 - RNA, 20 nt, Homo sapiens
acuaauuuaguaauagccug

SEQ ID NO: 675668 - RNA, 18 nt, Homo sapiens
acuaauuuuugcuuaaca

SEQ ID NO: 675669 - RNA, 18 nt, Homo sapiens
acuacaaacaaaagcagc

SEQ ID NO: 675670 - RNA, 17 nt, Homo sapiens
acuacaacgaacacaag

SEQ ID NO: 675671 - RNA, 14 nt, Homo sapiens
acuacaagucagcu

SEQ ID NO: 675672 - RNA, 14 nt, Homo sapiens
acuacacacuaaaa

SEQ ID NO: 675673 - RNA, 21 nt, Homo sapiens
acuacacacuguguacugcag

SEQ ID NO: 675674 - RNA, 15 nt, Homo sapiens
acuacagacauuaaa

SEQ ID NO: 675675 - RNA, 22 nt, Homo sapiens
acuacagcaugacguaguauua

SEQ ID NO: 675676 - RNA, 14 nt, Homo sapiens
acuacagcucuuaa

SEQ ID NO: 675677 - RNA, 14 nt, Homo sapiens
acuacagggagaaa

SEQ ID NO: 675678 - RNA, 12 nt, Homo sapiens
acuacaggugug

SEQ ID NO: 675679 - RNA, 13 nt, Homo sapiens
acuacaucugccu

SEQ ID NO: 675680 - RNA, 21 nt, Homo sapiens
acuacaugugacuggcaguau

SEQ ID NO: 675681 - RNA, 22 nt, Homo sapiens
acuacauuuuauuuuuguaucu

SEQ ID NO: 675682 - RNA, 16 nt, Homo sapiens
acuaccaagcagcuca

SEQ ID NO: 675683 - RNA, 18 nt, Homo sapiens
acuaccauucuauuccau

SEQ ID NO: 675684 - RNA, 21 nt, Homo sapiens
acuacuaaagugccuacccca

SEQ ID NO: 675685 - RNA, 22 nt, Homo sapiens
acuacuaaagugccuaccccag

SEQ ID NO: 675686 - RNA, 13 nt, Homo sapiens
acuacuacucugc

SEQ ID NO: 675687 - RNA, 23 nt, Homo sapiens
acuacuaguuaggauauugauuu

SEQ ID NO: 675688 - RNA, 23 nt, Homo sapiens
acuacuccuguaauuccuaccuc

SEQ ID NO: 675689 - RNA, 15 nt, Homo sapiens
acuacucugugccag

SEQ ID NO: 675690 - RNA, 22 nt, Homo sapiens
acuacugauuuuaaaaugaaua

SEQ ID NO: 675691 - RNA, 16 nt, Homo sapiens
acuacuggacuucuau

SEQ ID NO: 675692 - RNA, 15 nt, Homo sapiens
acuacuggcaauuug

SEQ ID NO: 675693 - RNA, 17 nt, Homo sapiens
acuacuuaaacaguauu

SEQ ID NO: 675694 - RNA, 15 nt, Homo sapiens
acuacuuaauuacuu

SEQ ID NO: 675695 - RNA, 19 nt, Homo sapiens
acuacuuuguaucaaucca

SEQ ID NO: 675696 - RNA, 17 nt, Homo sapiens
acuacuuuuggugcuua

SEQ ID NO: 675697 - RNA, 20 nt, Homo sapiens
acuagaaagaaggacccaga

SEQ ID NO: 675698 - RNA, 15 nt, Homo sapiens
acuagaacucuccau

SEQ ID NO: 675699 - RNA, 18 nt, Homo sapiens
acuagacaucugcuguua

SEQ ID NO: 675700 - RNA, 19 nt, Homo sapiens
acuagagucugaacagcug

SEQ ID NO: 675701 - RNA, 13 nt, Homo sapiens
acuagauguuaag

SEQ ID NO: 675702 - RNA, 15 nt, Homo sapiens
acuagcucuguauua

SEQ ID NO: 675703 - RNA, 19 nt, Homo sapiens
acuaggaaaaucaugugcu

SEQ ID NO: 675704 - RNA, 23 nt, Homo sapiens
acuaggcacuguggcucugcaug

SEQ ID NO: 675705 - RNA, 17 nt, Homo sapiens
acuaggcauacacugua

SEQ ID NO: 675706 - RNA, 20 nt, Homo sapiens
acuaggcccccacuugccuc

SEQ ID NO: 675707 - RNA, 15 nt, Homo sapiens
acuagggaagcucag

SEQ ID NO: 675708 - RNA, 17 nt, Homo sapiens
acuagggcuagucuucc

SEQ ID NO: 675709 - RNA, 14 nt, Homo sapiens
acuaguaaagcaaa

SEQ ID NO: 675710 - RNA, 12 nt, Homo sapiens
acuaguaacaug

SEQ ID NO: 675711 - RNA, 16 nt, Homo sapiens
acuagucuguguaacu

SEQ ID NO: 675712 - RNA, 12 nt, Homo sapiens
acuaguuuauuu

SEQ ID NO: 675713 - RNA, 16 nt, Homo sapiens
acuaguuuucaaucau

SEQ ID NO: 675714 - RNA, 23 nt, Homo sapiens
acuaguuuuuccuaucauguuaa

SEQ ID NO: 675715 - RNA, 22 nt, Homo sapiens
acuauaaaaaagaaagaauuaa

SEQ ID NO: 675716 - RNA, 21 nt, Homo sapiens
acuauaaagcaguagacaauc

SEQ ID NO: 675717 - RNA, 22 nt, Homo sapiens
acuauaaauaauauucuauuca

SEQ ID NO: 675718 - RNA, 18 nt, Homo sapiens
acuauaaguaauucucaa

SEQ ID NO: 675719 - RNA, 15 nt, Homo sapiens
acuauagguccagaa

SEQ ID NO: 675720 - RNA, 16 nt, Homo sapiens
acuauaucacaaucuc

SEQ ID NO: 675721 - RNA, 13 nt, Homo sapiens
acuauaugaucag

SEQ ID NO: 675722 - RNA, 23 nt, Homo sapiens
acuaucaagagaguaaacagaca

SEQ ID NO: 675723 - RNA, 16 nt, Homo sapiens
acuauccaguuacugc

SEQ ID NO: 675724 - RNA, 15 nt, Homo sapiens
acuauccucacuccc

SEQ ID NO: 675725 - RNA, 16 nt, Homo sapiens
acuaucugauuuccua

SEQ ID NO: 675726 - RNA, 23 nt, Homo sapiens
acuaucugugcguagaaguucua

SEQ ID NO: 675727 - RNA, 19 nt, Homo sapiens
acuaugaagcuaccucaaa

SEQ ID NO: 675728 - RNA, 21 nt, Homo sapiens
acuaugacuggaguaaaccau

SEQ ID NO: 675729 - RNA, 16 nt, Homo sapiens
acuaugaucacaguga

SEQ ID NO: 675730 - RNA, 15 nt, Homo sapiens
acuaugauuuaccua

SEQ ID NO: 675731 - RNA, 12 nt, Homo sapiens
acuaugcugcuu

SEQ ID NO: 675732 - RNA, 14 nt, Homo sapiens
acuauggaaaauca

SEQ ID NO: 675733 - RNA, 21 nt, Homo sapiens
acuauggagugcaccaaagag

SEQ ID NO: 675734 - RNA, 18 nt, Homo sapiens
acuauggauguguucucu

SEQ ID NO: 675735 - RNA, 22 nt, Homo sapiens
acuaugguguguuguaucuuug

SEQ ID NO: 675736 - RNA, 17 nt, Homo sapiens
acuaugguucccaauaa

SEQ ID NO: 675737 - RNA, 14 nt, Homo sapiens
acuauguguucaau

SEQ ID NO: 675738 - RNA, 21 nt, Homo sapiens
acuauguucuaggucagucua

SEQ ID NO: 675739 - RNA, 14 nt, Homo sapiens
acuauuaaagcaca

SEQ ID NO: 675740 - RNA, 14 nt, Homo sapiens
aagcuacaguuuug

SEQ ID NO: 675741 - RNA, 22 nt, Homo sapiens
aagcuaccccucaaacugcaca

SEQ ID NO: 675742 - RNA, 20 nt, Homo sapiens
aagcuagauaugccuuaaaa

SEQ ID NO: 675743 - RNA, 21 nt, Homo sapiens
aagcuaggguggcccuugcag

SEQ ID NO: 675744 - RNA, 17 nt, Homo sapiens
aagcuaggguuuggcaa

SEQ ID NO: 675745 - RNA, 21 nt, Homo sapiens
aagcuaguuaaugucagugac

SEQ ID NO: 675746 - RNA, 22 nt, Homo sapiens
aagcuaucagcaauacucauca

SEQ ID NO: 675747 - RNA, 18 nt, Homo sapiens
aagcuauguaucgcuccu

SEQ ID NO: 675748 - RNA, 22 nt, Homo sapiens
aagcuauuauaaaacuugaauu

SEQ ID NO: 675749 - RNA, 17 nt, Homo sapiens
aagcucaauucaaguga

SEQ ID NO: 675750 - RNA, 15 nt, Homo sapiens
aagcucagaauccaa

SEQ ID NO: 675751 - RNA, 15 nt, Homo sapiens
aagcucagacuugcc

SEQ ID NO: 675752 - RNA, 21 nt, Homo sapiens
aagcucccagcuccuuucaug

SEQ ID NO: 675753 - RNA, 19 nt, Homo sapiens
aagcucccuugaagcaaga

SEQ ID NO: 675754 - RNA, 23 nt, Homo sapiens
aagcuccggauggaggccagcua

SEQ ID NO: 675755 - RNA, 15 nt, Homo sapiens
aagcuccucgugaua

SEQ ID NO: 675756 - RNA, 22 nt, Homo sapiens
aagcuccuguccucccaucccc

SEQ ID NO: 675757 - RNA, 15 nt, Homo sapiens
aagcucgagugaauu

SEQ ID NO: 675758 - RNA, 14 nt, Homo sapiens
aagcucugaaguca

SEQ ID NO: 675759 - RNA, 22 nt, Homo sapiens
aagcucuucuucccagcacuau

SEQ ID NO: 675760 - RNA, 19 nt, Homo sapiens
aagcucuuuaugacuguuu

SEQ ID NO: 675761 - RNA, 14 nt, Homo sapiens
aagcugaagugcau

SEQ ID NO: 675762 - RNA, 14 nt, Homo sapiens
aagcugacauugcc

SEQ ID NO: 675763 - RNA, 17 nt, Homo sapiens
aagcugacauugccaaa

SEQ ID NO: 675764 - RNA, 16 nt, Homo sapiens
aagcugacucaaaaau

SEQ ID NO: 675765 - RNA, 16 nt, Homo sapiens
aagcugacuuggcacu

SEQ ID NO: 675766 - RNA, 19 nt, Homo sapiens
aagcugcacaugugccaca

SEQ ID NO: 675767 - RNA, 15 nt, Homo sapiens
aagcugccugugcca

SEQ ID NO: 675768 - RNA, 19 nt, Homo sapiens
aagcugccugugccaugcc

SEQ ID NO: 675769 - RNA, 20 nt, Homo sapiens
aagcuggaacugaaguccaa

SEQ ID NO: 675770 - RNA, 13 nt, Homo sapiens
aagcuggaggcac

SEQ ID NO: 675771 - RNA, 16 nt, Homo sapiens
aagcuggcuuuuccca

SEQ ID NO: 675772 - RNA, 22 nt, Homo sapiens
aagcugggcugucucucuccau

SEQ ID NO: 675773 - RNA, 14 nt, Homo sapiens
aagcuggugaaagc

SEQ ID NO: 675774 - RNA, 21 nt, Homo sapiens
aagcugucccucacuguugaa

SEQ ID NO: 675775 - RNA, 14 nt, Homo sapiens
aagcugucuuagag

SEQ ID NO: 675776 - RNA, 15 nt, Homo sapiens
aagcuguuauuugca

SEQ ID NO: 675777 - RNA, 14 nt, Homo sapiens
aagcuguugcuauu

SEQ ID NO: 675778 - RNA, 19 nt, Homo sapiens
aagcuguuuccauagggug

SEQ ID NO: 675779 - RNA, 15 nt, Homo sapiens
aagcuuaaauugcuu

SEQ ID NO: 675780 - RNA, 18 nt, Homo sapiens
aagcuuaacacuugaccu

SEQ ID NO: 675781 - RNA, 14 nt, Homo sapiens
aagcuuaaugauuc

SEQ ID NO: 675782 - RNA, 18 nt, Homo sapiens
aagcuucccuccaucccc

SEQ ID NO: 675783 - RNA, 17 nt, Homo sapiens
aagcuuccgccgucuca

SEQ ID NO: 675784 - RNA, 20 nt, Homo sapiens
aagcuuggggaacccaugag

SEQ ID NO: 675785 - RNA, 16 nt, Homo sapiens
aagcuugucugaucgu

SEQ ID NO: 675786 - RNA, 17 nt, Homo sapiens
aagcuuuauauaccucu

SEQ ID NO: 675787 - RNA, 17 nt, Homo sapiens
aagcuuuaucuuugugu

SEQ ID NO: 675788 - RNA, 22 nt, Homo sapiens
aagcuuucauguaaacugugca

SEQ ID NO: 675789 - RNA, 22 nt, Homo sapiens
aagcuuucauuugccgggacac

SEQ ID NO: 675790 - RNA, 19 nt, Homo sapiens
aagcuuugaggcucuguca

SEQ ID NO: 675791 - RNA, 11 nt, Homo sapiens
aagcuuuguga

SEQ ID NO: 675792 - RNA, 23 nt, Homo sapiens
aagcuuuucuuuuuuaauuucca

SEQ ID NO: 675793 - RNA, 19 nt, Homo sapiens
aagcuuuuuacucaaagag

SEQ ID NO: 675794 - RNA, 21 nt, Homo sapiens
aagcuuuuuauuccuccugcu

SEQ ID NO: 675795 - RNA, 17 nt, Homo sapiens
aaggaaaaaaaacacaa

SEQ ID NO: 675796 - RNA, 20 nt, Homo sapiens
aaggaaaaaaaacacaaaac

SEQ ID NO: 675797 - RNA, 17 nt, Homo sapiens
aaggaaaaaauccucac

SEQ ID NO: 675798 - RNA, 20 nt, Homo sapiens
aaggaaaagacugaaucuac

SEQ ID NO: 675799 - RNA, 14 nt, Homo sapiens
aaggaaaaugacuc

SEQ ID NO: 675800 - RNA, 23 nt, Homo sapiens
aaggaaaaugugcacacauauac

SEQ ID NO: 675801 - RNA, 15 nt, Homo sapiens
aaggaaaauugcacu

SEQ ID NO: 675802 - RNA, 16 nt, Homo sapiens
aaggaaaauugcacua

SEQ ID NO: 675803 - RNA, 14 nt, Homo sapiens
aaggaaacuccuga

SEQ ID NO: 675804 - RNA, 18 nt, Homo sapiens
aaggaaaggcucauuuaa

SEQ ID NO: 675805 - RNA, 19 nt, Homo sapiens
aaggaaauaacauugcacu

SEQ ID NO: 675806 - RNA, 16 nt, Homo sapiens
aaggaaauaugaucca

SEQ ID NO: 675807 - RNA, 13 nt, Homo sapiens
aaggaaaugaugg

SEQ ID NO: 675808 - RNA, 23 nt, Homo sapiens
aaggaacagagugagagacauca

SEQ ID NO: 675809 - RNA, 22 nt, Homo sapiens
aaggaacccucaggccacccuc

SEQ ID NO: 675810 - RNA, 22 nt, Homo sapiens
aaggaacucuggcuuccaggua

SEQ ID NO: 675811 - RNA, 14 nt, Homo sapiens
aaggaacugcaaua

SEQ ID NO: 675812 - RNA, 12 nt, Homo sapiens
aaggaacuucca

SEQ ID NO: 675813 - RNA, 23 nt, Homo sapiens
aaggaagaaaagcugccauuucc

SEQ ID NO: 675814 - RNA, 16 nt, Homo sapiens
aaggaagcuccacugu

SEQ ID NO: 675815 - RNA, 19 nt, Homo sapiens
aaggaagcuccacugucac

SEQ ID NO: 675816 - RNA, 12 nt, Homo sapiens
aaggaaggcagu

SEQ ID NO: 675817 - RNA, 14 nt, Homo sapiens
aaggaaggcauuug

SEQ ID NO: 675818 - RNA, 18 nt, Homo sapiens
aaggaaguguguuugccu

SEQ ID NO: 675819 - RNA, 19 nt, Homo sapiens
aaggaauuaucaauuacaa

SEQ ID NO: 675820 - RNA, 14 nt, Homo sapiens
aaggacacagugau

SEQ ID NO: 675821 - RNA, 15 nt, Homo sapiens
aaggacaucagcaaa

SEQ ID NO: 675822 - RNA, 21 nt, Homo sapiens
aaggacauuuaaaauucaauu

SEQ ID NO: 675823 - RNA, 13 nt, Homo sapiens
aaggaccagguua

SEQ ID NO: 675824 - RNA, 19 nt, Homo sapiens
aaggacccaauccccagac

SEQ ID NO: 675825 - RNA, 15 nt, Homo sapiens
aaggaccuuggaaga

SEQ ID NO: 675826 - RNA, 14 nt, Homo sapiens
aaggacgugggcag

SEQ ID NO: 675827 - RNA, 17 nt, Homo sapiens
aaggacuaggucuuccc

SEQ ID NO: 675828 - RNA, 19 nt, Homo sapiens
aaggacuuagugcaucaga

SEQ ID NO: 675829 - RNA, 16 nt, Homo sapiens
aaggacuuuaaggaag

SEQ ID NO: 675830 - RNA, 22 nt, Homo sapiens
aaggagaaaugauaagugacaa

SEQ ID NO: 675831 - RNA, 18 nt, Homo sapiens
aaggagaacuauccaaaa

SEQ ID NO: 675832 - RNA, 16 nt, Homo sapiens
aaggagagggacugga

SEQ ID NO: 675833 - RNA, 17 nt, Homo sapiens
aaggagcacaagccaca

SEQ ID NO: 675834 - RNA, 21 nt, Homo sapiens
aaggagcagagagguggccac

SEQ ID NO: 675835 - RNA, 21 nt, Homo sapiens
aaggagccaaacauccuacaa

SEQ ID NO: 675836 - RNA, 19 nt, Homo sapiens
aaggagcuacugacauucc

SEQ ID NO: 675837 - RNA, 15 nt, Homo sapiens
aaggagcuuucucaa

SEQ ID NO: 675838 - RNA, 22 nt, Homo sapiens
aaggaggacgguuaacuuguau

SEQ ID NO: 675839 - RNA, 21 nt, Homo sapiens
aaggaggcuuaggacuuucca

SEQ ID NO: 675840 - RNA, 20 nt, Homo sapiens
aaggaggggaaacaaugaaa

SEQ ID NO: 675841 - RNA, 16 nt, Homo sapiens
aaggaggggagccuuu

SEQ ID NO: 675842 - RNA, 18 nt, Homo sapiens
aaggagggugagugcaag

SEQ ID NO: 675843 - RNA, 16 nt, Homo sapiens
aaggaguaaucugugu

SEQ ID NO: 675844 - RNA, 20 nt, Homo sapiens
aaggaguaaucuguguacaa

SEQ ID NO: 675845 - RNA, 16 nt, Homo sapiens
aaggaguacaaugccc

SEQ ID NO: 675846 - RNA, 21 nt, Homo sapiens
aaggagucccugguucauuga

SEQ ID NO: 675847 - RNA, 15 nt, Homo sapiens
aaggagucugcacau

SEQ ID NO: 675848 - RNA, 13 nt, Homo sapiens
aaggaguguauga

SEQ ID NO: 675849 - RNA, 17 nt, Homo sapiens
aaggaguuuuuuuguca

SEQ ID NO: 675850 - RNA, 17 nt, Homo sapiens
aaggauaaugaaauaau

SEQ ID NO: 675851 - RNA, 23 nt, Homo sapiens
aaggaugcugucaagcaccugca

SEQ ID NO: 675852 - RNA, 15 nt, Homo sapiens
aaggauggaugcaga

SEQ ID NO: 675853 - RNA, 19 nt, Homo sapiens
aaggaugggccaucugggg

SEQ ID NO: 675854 - RNA, 12 nt, Homo sapiens
aaggauguugcc

SEQ ID NO: 675855 - RNA, 14 nt, Homo sapiens
aaggauugugauau

SEQ ID NO: 675856 - RNA, 19 nt, Homo sapiens
aaggauuuuaccaaagcau

SEQ ID NO: 675857 - RNA, 22 nt, Homo sapiens
aaggauuuuaccaaagcaucaa

SEQ ID NO: 675858 - RNA, 21 nt, Homo sapiens
aaggauuuucauguugaugac

SEQ ID NO: 675859 - RNA, 21 nt, Homo sapiens
aaggauuuuggaacucuggag

SEQ ID NO: 675860 - RNA, 15 nt, Homo sapiens
aaggcaaauguuuau

SEQ ID NO: 675861 - RNA, 13 nt, Homo sapiens
aaacauauacaaa

SEQ ID NO: 675862 - RNA, 15 nt, Homo sapiens
aaacauaucauggua

SEQ ID NO: 675863 - RNA, 22 nt, Homo sapiens
aaacauauccuuucaagacaga

SEQ ID NO: 675864 - RNA, 21 nt, Homo sapiens
aaacauauuuuuauacuuuau

SEQ ID NO: 675865 - RNA, 19 nt, Homo sapiens
aaacaucacaccugcccua

SEQ ID NO: 675866 - RNA, 21 nt, Homo sapiens
aaacaucacaccugcccuaaa

SEQ ID NO: 675867 - RNA, 15 nt, Homo sapiens
aaacaucacauucca

SEQ ID NO: 675868 - RNA, 22 nt, Homo sapiens
aaacaucaguuacucugaaggg

SEQ ID NO: 675869 - RNA, 13 nt, Homo sapiens
aaacaucccaaga

SEQ ID NO: 675870 - RNA, 21 nt, Homo sapiens
aaacaucuaauaaguauauaa

SEQ ID NO: 675871 - RNA, 19 nt, Homo sapiens
aaacaugaacccaaaaaga

SEQ ID NO: 675872 - RNA, 16 nt, Homo sapiens
aaacaugauuguuuac

SEQ ID NO: 675873 - RNA, 17 nt, Homo sapiens
aaacaugcuaaauaguu

SEQ ID NO: 675874 - RNA, 21 nt, Homo sapiens
aaacauguuuaaauagccuaa

SEQ ID NO: 675875 - RNA, 21 nt, Homo sapiens
aaacauuaaaauauaaucucu

SEQ ID NO: 675876 - RNA, 15 nt, Homo sapiens
aaacauuaaugcaau

SEQ ID NO: 675877 - RNA, 15 nt, Homo sapiens
aaacauuacuuauuu

SEQ ID NO: 675878 - RNA, 14 nt, Homo sapiens
aaacauuauuccaa

SEQ ID NO: 675879 - RNA, 10 nt, Homo sapiens
aaacauucau

SEQ ID NO: 675880 - RNA, 20 nt, Homo sapiens
aaacauucauguaacucucc

SEQ ID NO: 675881 - RNA, 21 nt, Homo sapiens
aaacauucauuuuuaccuugu

SEQ ID NO: 675882 - RNA, 15 nt, Homo sapiens
aaacauuccaggaaa

SEQ ID NO: 675883 - RNA, 20 nt, Homo sapiens
aaacauuccccuccccacuc

SEQ ID NO: 675884 - RNA, 16 nt, Homo sapiens
aaacauuuaacauaau

SEQ ID NO: 675885 - RNA, 14 nt, Homo sapiens
aaacauuucuggac

SEQ ID NO: 675886 - RNA, 19 nt, Homo sapiens
aaacauuuuauacuguaca

SEQ ID NO: 675887 - RNA, 17 nt, Homo sapiens
aaacauuuuaucauuaa

SEQ ID NO: 675888 - RNA, 11 nt, Homo sapiens
aaaccaaagau

SEQ ID NO: 675889 - RNA, 11 nt, Homo sapiens
aaaccaaagcc

SEQ ID NO: 675890 - RNA, 12 nt, Homo sapiens
aaaccaacaaaa

SEQ ID NO: 675891 - RNA, 15 nt, Homo sapiens
aaaccaacaaaaaga

SEQ ID NO: 675892 - RNA, 21 nt, Homo sapiens
aaaccaaccgcacaugcagau

SEQ ID NO: 675893 - RNA, 19 nt, Homo sapiens
aaaccaagcaucaggggga

SEQ ID NO: 675894 - RNA, 19 nt, Homo sapiens
aaaccaaugagcuguaucu

SEQ ID NO: 675895 - RNA, 14 nt, Homo sapiens
aaaccacaaaaaua

SEQ ID NO: 675896 - RNA, 23 nt, Homo sapiens
aaaccacaugggcugggggccag

SEQ ID NO: 675897 - RNA, 16 nt, Homo sapiens
aaaccacuagaacucu

SEQ ID NO: 675898 - RNA, 21 nt, Homo sapiens
aaaccacuagaacucuccauc

SEQ ID NO: 675899 - RNA, 18 nt, Homo sapiens
aaaccacugcuaugccau

SEQ ID NO: 675900 - RNA, 11 nt, Homo sapiens
aaaccacuucu

SEQ ID NO: 675901 - RNA, 12 nt, Homo sapiens
aaaccacuugcc

SEQ ID NO: 675902 - RNA, 17 nt, Homo sapiens
aaaccagaaaagcaaua

SEQ ID NO: 675903 - RNA, 17 nt, Homo sapiens
aaaccagaaaggugauu

SEQ ID NO: 675904 - RNA, 16 nt, Homo sapiens
aaaccagccaucccau

SEQ ID NO: 675905 - RNA, 15 nt, Homo sapiens
aaaccagccuggcca

SEQ ID NO: 675906 - RNA, 21 nt, Homo sapiens
aaaccagcuuuaggucccaau

SEQ ID NO: 675907 - RNA, 16 nt, Homo sapiens
aaaccaggugcaauua

SEQ ID NO: 675908 - RNA, 15 nt, Homo sapiens
aaaccaucacaugac

SEQ ID NO: 675909 - RNA, 14 nt, Homo sapiens
aaaccauccaguga

SEQ ID NO: 675910 - RNA, 12 nt, Homo sapiens
aaaccaugacug

SEQ ID NO: 675911 - RNA, 13 nt, Homo sapiens
aaaccaugacugu

SEQ ID NO: 675912 - RNA, 16 nt, Homo sapiens
aaacccaaaacaguaa

SEQ ID NO: 675913 - RNA, 21 nt, Homo sapiens
aaacccaaucagaugccucag

SEQ ID NO: 675914 - RNA, 12 nt, Homo sapiens
aaacccagacaa

SEQ ID NO: 675915 - RNA, 19 nt, Homo sapiens
aaaccccaucucuacuaaa

SEQ ID NO: 675916 - RNA, 20 nt, Homo sapiens
aaaccccaucucuacuaaaa

SEQ ID NO: 675917 - RNA, 19 nt, Homo sapiens
aaaccccaucuuuacuaaa

SEQ ID NO: 675918 - RNA, 18 nt, Homo sapiens
aaacccccacuccagcuc

SEQ ID NO: 675919 - RNA, 13 nt, Homo sapiens
aaaccccgucucu

SEQ ID NO: 675920 - RNA, 17 nt, Homo sapiens
aaacccgcccucagggg

SEQ ID NO: 675921 - RNA, 23 nt, Homo sapiens
aaacccuuuagugcuuugugaua

SEQ ID NO: 675922 - RNA, 15 nt, Homo sapiens
aaaccgagugcaaug

SEQ ID NO: 675923 - RNA, 13 nt, Homo sapiens
aaaccucacaggg

SEQ ID NO: 675924 - RNA, 13 nt, Homo sapiens
aaaccucaucucu

SEQ ID NO: 675925 - RNA, 14 nt, Homo sapiens
aaaccucuccucau

SEQ ID NO: 675926 - RNA, 22 nt, Homo sapiens
aaaccugauguuaaaauuccau

SEQ ID NO: 675927 - RNA, 15 nt, Homo sapiens
aaaccugauuuacua

SEQ ID NO: 675928 - RNA, 19 nt, Homo sapiens
aaaccuuauggaaaagggg

SEQ ID NO: 675929 - RNA, 18 nt, Homo sapiens
aaaccuuauuuuuuccca

SEQ ID NO: 675930 - RNA, 22 nt, Homo sapiens
aaaccuucaucugaaacccaca

SEQ ID NO: 675931 - RNA, 15 nt, Homo sapiens
aaaccuuguucuauu

SEQ ID NO: 675932 - RNA, 17 nt, Homo sapiens
aaaccuuuaaucugcac

SEQ ID NO: 675933 - RNA, 18 nt, Homo sapiens
aaaccuuuacaguuagca

SEQ ID NO: 675934 - RNA, 13 nt, Homo sapiens
aaaccuuugcaaa

SEQ ID NO: 675935 - RNA, 13 nt, Homo sapiens
aaacgagacuuuc

SEQ ID NO: 675936 - RNA, 22 nt, Homo sapiens
aaacgauucugagccauucaca

SEQ ID NO: 675937 - RNA, 14 nt, Homo sapiens
aaacgcaugugcag

SEQ ID NO: 675938 - RNA, 18 nt, Homo sapiens
aaacgccaguguguuuaa

SEQ ID NO: 675939 - RNA, 17 nt, Homo sapiens
aaacggaggccagagag

SEQ ID NO: 675940 - RNA, 22 nt, Homo sapiens
aaacgggcucgggucugggcag

SEQ ID NO: 675941 - RNA, 20 nt, Homo sapiens
aaacggucacgagacccaga

SEQ ID NO: 675942 - RNA, 17 nt, Homo sapiens
aaacgguggaggccagg

SEQ ID NO: 675943 - RNA, 13 nt, Homo sapiens
aaacgguucaguu

SEQ ID NO: 675944 - RNA, 19 nt, Homo sapiens
aaacgucuucuaaacuucc

SEQ ID NO: 675945 - RNA, 20 nt, Homo sapiens
aaacgucuucuaaacuuccc

SEQ ID NO: 675946 - RNA, 15 nt, Homo sapiens
aaacguguaaauugc

SEQ ID NO: 675947 - RNA, 17 nt, Homo sapiens
aaacuaaacucuuacca

SEQ ID NO: 675948 - RNA, 18 nt, Homo sapiens
aaacuaaccagcauuccc

SEQ ID NO: 675949 - RNA, 16 nt, Homo sapiens
aaacuaaccaucugaa

SEQ ID NO: 675950 - RNA, 14 nt, Homo sapiens
aaacuaagcacaaa

SEQ ID NO: 675951 - RNA, 18 nt, Homo sapiens
aaacuaagcccccgcugu

SEQ ID NO: 675952 - RNA, 18 nt, Homo sapiens
aaacuaauguacuguaca

SEQ ID NO: 675953 - RNA, 14 nt, Homo sapiens
aaacuaauuucaua

SEQ ID NO: 675954 - RNA, 18 nt, Homo sapiens
aaacuaauuuuaacaaac

SEQ ID NO: 675955 - RNA, 16 nt, Homo sapiens
aaacuacauuuugcaa

SEQ ID NO: 675956 - RNA, 17 nt, Homo sapiens
aaacuacccuccagagu

SEQ ID NO: 675957 - RNA, 15 nt, Homo sapiens
aaacuaguggcaaua

SEQ ID NO: 675958 - RNA, 21 nt, Homo sapiens
aaacuauacacuuaaugauac

SEQ ID NO: 675959 - RNA, 13 nt, Homo sapiens
aaacuauauucuc

SEQ ID NO: 675960 - RNA, 14 nt, Homo sapiens
aaacuauauucuca

SEQ ID NO: 675961 - RNA, 18 nt, Homo sapiens
aaacuauguaacauguag

SEQ ID NO: 675962 - RNA, 16 nt, Homo sapiens
aaacuauguguucaau

SEQ ID NO: 675963 - RNA, 18 nt, Homo sapiens
aaacuauucaugaauauu

SEQ ID NO: 675964 - RNA, 16 nt, Homo sapiens
acacgcugguggugcu

SEQ ID NO: 675965 - RNA, 20 nt, Homo sapiens
acacggaggucucuguaaaa

SEQ ID NO: 675966 - RNA, 21 nt, Homo sapiens
acacggaugacuuaacugcau

SEQ ID NO: 675967 - RNA, 13 nt, Homo sapiens
acacggcacauuu

SEQ ID NO: 675968 - RNA, 20 nt, Homo sapiens
acacggugaaaccccgucuc

SEQ ID NO: 675969 - RNA, 16 nt, Homo sapiens
acacguggguauuuaa

SEQ ID NO: 675970 - RNA, 13 nt, Homo sapiens
acacuaaaacuuu

SEQ ID NO: 675971 - RNA, 24 nt, Homo sapiens
acacuaaaacuuuccugacuuaca

SEQ ID NO: 675972 - RNA, 15 nt, Homo sapiens
acacuaacauauaau

SEQ ID NO: 675973 - RNA, 18 nt, Homo sapiens
acacuaacauauaauguu

SEQ ID NO: 675974 - RNA, 20 nt, Homo sapiens
acacuaaccuggguucccuu

SEQ ID NO: 675975 - RNA, 22 nt, Homo sapiens
acacuaagcgaauguguacaaa

SEQ ID NO: 675976 - RNA, 21 nt, Homo sapiens
acacuacacagcacaccagcc

SEQ ID NO: 675977 - RNA, 12 nt, Homo sapiens
acacuaccacau

SEQ ID NO: 675978 - RNA, 12 nt, Homo sapiens
acacuaugccug

SEQ ID NO: 675979 - RNA, 15 nt, Homo sapiens
acacuauuuccaaaa

SEQ ID NO: 675980 - RNA, 23 nt, Homo sapiens
acacucacagcaaggauggagcu

SEQ ID NO: 675981 - RNA, 14 nt, Homo sapiens
acacucaccaugaa

SEQ ID NO: 675982 - RNA, 12 nt, Homo sapiens
acacucaucccu

SEQ ID NO: 675983 - RNA, 15 nt, Homo sapiens
acacucaucccuggu

SEQ ID NO: 675984 - RNA, 15 nt, Homo sapiens
acacuccacuugaag

SEQ ID NO: 675985 - RNA, 21 nt, Homo sapiens
acacuccagugccagcaauga

SEQ ID NO: 675986 - RNA, 23 nt, Homo sapiens
acacuccagugccagcaaugaca

SEQ ID NO: 675987 - RNA, 19 nt, Homo sapiens
acacuccugggcucugaac

SEQ ID NO: 675988 - RNA, 16 nt, Homo sapiens
acacucuauaagauuc

SEQ ID NO: 675989 - RNA, 22 nt, Homo sapiens
acacugaaaaaauacuaccuau

SEQ ID NO: 675990 - RNA, 14 nt, Homo sapiens
acacugaacuuaau

SEQ ID NO: 675991 - RNA, 17 nt, Homo sapiens
acacugaaguuaacaga

SEQ ID NO: 675992 - RNA, 19 nt, Homo sapiens
acacugaauugaaucuaca

SEQ ID NO: 675993 - RNA, 20 nt, Homo sapiens
acacugacaaagucaucccc

SEQ ID NO: 675994 - RNA, 14 nt, Homo sapiens
acacugacuugaga

SEQ ID NO: 675995 - RNA, 20 nt, Homo sapiens
acacugagauauucagccca

SEQ ID NO: 675996 - RNA, 18 nt, Homo sapiens
acacugagcuucugagac

SEQ ID NO: 675997 - RNA, 13 nt, Homo sapiens
acacugagucaga

SEQ ID NO: 675998 - RNA, 21 nt, Homo sapiens
acacugaguucuaucaguuau

SEQ ID NO: 675999 - RNA, 18 nt, Homo sapiens
acacugauacacuugaag

SEQ ID NO: 676000 - RNA, 16 nt, Homo sapiens
acacugaugcuuagau

SEQ ID NO: 676001 - RNA, 16 nt, Homo sapiens
acacugcagagacuaa

SEQ ID NO: 676002 - RNA, 13 nt, Homo sapiens
acacugcaguuuc

SEQ ID NO: 676003 - RNA, 18 nt, Homo sapiens
acacugcaguuuccugga

SEQ ID NO: 676004 - RNA, 19 nt, Homo sapiens
acacugcauguuugugauu

SEQ ID NO: 676005 - RNA, 16 nt, Homo sapiens
acacugccucugaguu

SEQ ID NO: 676006 - RNA, 17 nt, Homo sapiens
acacugccuuagccucu

SEQ ID NO: 676007 - RNA, 19 nt, Homo sapiens
acacugcgcaucaccuacc

SEQ ID NO: 676008 - RNA, 18 nt, Homo sapiens
acacugcugcuccagugc

SEQ ID NO: 676009 - RNA, 19 nt, Homo sapiens
acacugcugcuccagugca

SEQ ID NO: 676010 - RNA, 20 nt, Homo sapiens
acacugcugcuccagugcag

SEQ ID NO: 676011 - RNA, 15 nt, Homo sapiens
acacuggaacauucc

SEQ ID NO: 676012 - RNA, 20 nt, Homo sapiens
acacugggagaggugccagc

SEQ ID NO: 676013 - RNA, 19 nt, Homo sapiens
acacugggugcgucuccag

SEQ ID NO: 676014 - RNA, 14 nt, Homo sapiens
acacuggucacagg

SEQ ID NO: 676015 - RNA, 22 nt, Homo sapiens
acacugucagcagggacuguaa

SEQ ID NO: 676016 - RNA, 12 nt, Homo sapiens
acacuguccaug

SEQ ID NO: 676017 - RNA, 23 nt, Homo sapiens
acacuguccaugaagcacugagc

SEQ ID NO: 676018 - RNA, 14 nt, Homo sapiens
acacugucuucccg

SEQ ID NO: 676019 - RNA, 21 nt, Homo sapiens
acacugugauuuaucuuucaa

SEQ ID NO: 676020 - RNA, 13 nt, Homo sapiens
acacugugucauu

SEQ ID NO: 676021 - RNA, 23 nt, Homo sapiens
acacuguguccuggugcucucug

SEQ ID NO: 676022 - RNA, 18 nt, Homo sapiens
acacuguuacuuucguac

SEQ ID NO: 676023 - RNA, 23 nt, Homo sapiens
acacuguuggggaccuuccugau

SEQ ID NO: 676024 - RNA, 17 nt, Homo sapiens
acacuguugucaaaaag

SEQ ID NO: 676025 - RNA, 18 nt, Homo sapiens
acacuguugucaaaaagu

SEQ ID NO: 676026 - RNA, 23 nt, Homo sapiens
acacuguugucaaaaaguuccau

SEQ ID NO: 676027 - RNA, 20 nt, Homo sapiens
acacuuaaauuucuuggcaa

SEQ ID NO: 676028 - RNA, 18 nt, Homo sapiens
acacuuacugcaaaggcu

SEQ ID NO: 676029 - RNA, 15 nt, Homo sapiens
acacuucagaucuga

SEQ ID NO: 676030 - RNA, 18 nt, Homo sapiens
acacuuccaccauagcuu

SEQ ID NO: 676031 - RNA, 18 nt, Homo sapiens
acacuugguguacugggu

SEQ ID NO: 676032 - RNA, 14 nt, Homo sapiens
acacuugugccagc

SEQ ID NO: 676033 - RNA, 23 nt, Homo sapiens
acacuugugugugggcugugagu

SEQ ID NO: 676034 - RNA, 18 nt, Homo sapiens
acacuuguuguccaguug

SEQ ID NO: 676035 - RNA, 21 nt, Homo sapiens
acacuuuagguagaugaacua

SEQ ID NO: 676036 - RNA, 15 nt, Homo sapiens
acacuuucucuucaa

SEQ ID NO: 676037 - RNA, 15 nt, Homo sapiens
acacuuugagcauuu

SEQ ID NO: 676038 - RNA, 20 nt, Homo sapiens
acacuuuuggaaccaugccu

SEQ ID NO: 676039 - RNA, 23 nt, Homo sapiens
acagaaaagacucugaccagaga

SEQ ID NO: 676040 - RNA, 21 nt, Homo sapiens
acagaaaaggcugcugugaac

SEQ ID NO: 676041 - RNA, 16 nt, Homo sapiens
acagaaaaguccacau

SEQ ID NO: 676042 - RNA, 20 nt, Homo sapiens
acagaaaccagaaaagcaau

SEQ ID NO: 676043 - RNA, 12 nt, Homo sapiens
acagaaacccag

SEQ ID NO: 676044 - RNA, 13 nt, Homo sapiens
acagaaacuggau

SEQ ID NO: 676045 - RNA, 20 nt, Homo sapiens
acagaaagagacuccgucuc

SEQ ID NO: 676046 - RNA, 21 nt, Homo sapiens
acagaaagccugggugacauu

SEQ ID NO: 676047 - RNA, 22 nt, Homo sapiens
acagaaagcuagauaugccuua

SEQ ID NO: 676048 - RNA, 20 nt, Homo sapiens
acagaaaucguagacaagca

SEQ ID NO: 676049 - RNA, 13 nt, Homo sapiens
acagaaauuaucu

SEQ ID NO: 676050 - RNA, 15 nt, Homo sapiens
acagaaauucugcaa

SEQ ID NO: 676051 - RNA, 16 nt, Homo sapiens
acagaacaccuaugca

SEQ ID NO: 676052 - RNA, 23 nt, Homo sapiens
acagaacagggucauguuugcag

SEQ ID NO: 676053 - RNA, 19 nt, Homo sapiens
acagaaccaaaucguggca

SEQ ID NO: 676054 - RNA, 13 nt, Homo sapiens
acagaacuaugga

SEQ ID NO: 676055 - RNA, 18 nt, Homo sapiens
acagaacucgaugcacug

SEQ ID NO: 676056 - RNA, 15 nt, Homo sapiens
acagaacugcaguca

SEQ ID NO: 676057 - RNA, 13 nt, Homo sapiens
acagaacuucaga

SEQ ID NO: 676058 - RNA, 12 nt, Homo sapiens
acagaacuugaa

SEQ ID NO: 676059 - RNA, 23 nt, Homo sapiens
acagaagacccgcucuccaucuu

SEQ ID NO: 676060 - RNA, 22 nt, Homo sapiens
acagcuauuauaucagcuuuuc

SEQ ID NO: 676061 - RNA, 17 nt, Homo sapiens
acagcucaccacugugc

SEQ ID NO: 676062 - RNA, 18 nt, Homo sapiens
acagcucacugcagccuc

SEQ ID NO: 676063 - RNA, 19 nt, Homo sapiens
acagcucacugcagccuca

SEQ ID NO: 676064 - RNA, 15 nt, Homo sapiens
acagcucccuaggua

SEQ ID NO: 676065 - RNA, 23 nt, Homo sapiens
acagcucgggcccucugugagau

SEQ ID NO: 676066 - RNA, 20 nt, Homo sapiens
acagcucuagacacugccac

SEQ ID NO: 676067 - RNA, 15 nt, Homo sapiens
acagcucuggcuuug

SEQ ID NO: 676068 - RNA, 16 nt, Homo sapiens
acagcugauacuucau

SEQ ID NO: 676069 - RNA, 15 nt, Homo sapiens
acagcugguucgugg

SEQ ID NO: 676070 - RNA, 22 nt, Homo sapiens
acagcuguaaucccagcacuuu

SEQ ID NO: 676071 - RNA, 11 nt, Homo sapiens
acagcugucug

SEQ ID NO: 676072 - RNA, 16 nt, Homo sapiens
acagcugugagccaug

SEQ ID NO: 676073 - RNA, 22 nt, Homo sapiens
acagcugugagccaugccuccc

SEQ ID NO: 676074 - RNA, 18 nt, Homo sapiens
acagcugugcaugcucag

SEQ ID NO: 676075 - RNA, 16 nt, Homo sapiens
acagcuuauuauccaa

SEQ ID NO: 676076 - RNA, 13 nt, Homo sapiens
acagcuuccucac

SEQ ID NO: 676077 - RNA, 16 nt, Homo sapiens
acagcuugcugucacu

SEQ ID NO: 676078 - RNA, 18 nt, Homo sapiens
acagcuuugcaccccuuu

SEQ ID NO: 676079 - RNA, 20 nt, Homo sapiens
acagcuuugcugcugaaggc

SEQ ID NO: 676080 - RNA, 22 nt, Homo sapiens
acaggaaaaaugaaaauguuac

SEQ ID NO: 676081 - RNA, 15 nt, Homo sapiens
acaggaaaccacuua

SEQ ID NO: 676082 - RNA, 13 nt, Homo sapiens
acaggaaauugac

SEQ ID NO: 676083 - RNA, 16 nt, Homo sapiens
acaggaaauugacuua

SEQ ID NO: 676084 - RNA, 23 nt, Homo sapiens
acaggaagguagaaauaucugaa

SEQ ID NO: 676085 - RNA, 19 nt, Homo sapiens
acaggaauagaauggaggg

SEQ ID NO: 676086 - RNA, 16 nt, Homo sapiens
acaggacuguaaagau

SEQ ID NO: 676087 - RNA, 21 nt, Homo sapiens
acacaaauucagucucugaau

SEQ ID NO: 676088 - RNA, 15 nt, Homo sapiens
acacaaauuuucaag

SEQ ID NO: 676089 - RNA, 12 nt, Homo sapiens
acacaacacaga

SEQ ID NO: 676090 - RNA, 15 nt, Homo sapiens
acacaacuuugcaaa

SEQ ID NO: 676091 - RNA, 13 nt, Homo sapiens
acacaagaaucua

SEQ ID NO: 676092 - RNA, 19 nt, Homo sapiens
acacaagcaaccaauggaa

SEQ ID NO: 676093 - RNA, 15 nt, Homo sapiens
acacaaucacuccau

SEQ ID NO: 676094 - RNA, 17 nt, Homo sapiens
acacaauuaauucaucc

SEQ ID NO: 676095 - RNA, 21 nt, Homo sapiens
acacacaaaccuacugcccac

SEQ ID NO: 676096 - RNA, 13 nt, Homo sapiens
acacacacaccaa

SEQ ID NO: 676097 - RNA, 16 nt, Homo sapiens
acacacaccuagccag

SEQ ID NO: 676098 - RNA, 16 nt, Homo sapiens
acacacacgaugcauu

SEQ ID NO: 676099 - RNA, 12 nt, Homo sapiens
acacacaguacg

SEQ ID NO: 676100 - RNA, 12 nt, Homo sapiens
acacacauacag

SEQ ID NO: 676101 - RNA, 13 nt, Homo sapiens
acacacauccagc

SEQ ID NO: 676102 - RNA, 21 nt, Homo sapiens
acacaccaccaugcucaacua

SEQ ID NO: 676103 - RNA, 21 nt, Homo sapiens
acacaccccuccggacaucca

SEQ ID NO: 676104 - RNA, 16 nt, Homo sapiens
acacacgaugcauuua

SEQ ID NO: 676105 - RNA, 13 nt, Homo sapiens
acacacgcuuucu

SEQ ID NO: 676106 - RNA, 13 nt, Homo sapiens
acacacuauggca

SEQ ID NO: 676107 - RNA, 18 nt, Homo sapiens
acacacuucggcucucug

SEQ ID NO: 676108 - RNA, 21 nt, Homo sapiens
acacacuucggcucucuggac

SEQ ID NO: 676109 - RNA, 19 nt, Homo sapiens
acacagacaguuucugaca

SEQ ID NO: 676110 - RNA, 15 nt, Homo sapiens
acacagacuggcaau

SEQ ID NO: 676111 - RNA, 16 nt, Homo sapiens
acacagacuggcaaua

SEQ ID NO: 676112 - RNA, 19 nt, Homo sapiens
acacagagcaggacugcac

SEQ ID NO: 676113 - RNA, 18 nt, Homo sapiens
acacagauuugagcucag

SEQ ID NO: 676114 - RNA, 16 nt, Homo sapiens
acacagcaacaaugac

SEQ ID NO: 676115 - RNA, 20 nt, Homo sapiens
acacagcaagacuccgucuc

SEQ ID NO: 676116 - RNA, 15 nt, Homo sapiens
acacagcagcaguua

SEQ ID NO: 676117 - RNA, 19 nt, Homo sapiens
acacagcaggacuccaucu

SEQ ID NO: 676118 - RNA, 17 nt, Homo sapiens
acacagccaagccaguc

SEQ ID NO: 676119 - RNA, 16 nt, Homo sapiens
acacagccuagcacag

SEQ ID NO: 676120 - RNA, 16 nt, Homo sapiens
acacagccuauaucaa

SEQ ID NO: 676121 - RNA, 21 nt, Homo sapiens
acacagcgcgguuuuuuccac

SEQ ID NO: 676122 - RNA, 22 nt, Homo sapiens
acacagcuauuagaacuaauaa

SEQ ID NO: 676123 - RNA, 14 nt, Homo sapiens
acacaggcaaaauc

SEQ ID NO: 676124 - RNA, 17 nt, Homo sapiens
acacaggcuucaucaag

SEQ ID NO: 676125 - RNA, 15 nt, Homo sapiens
acacagggcucuuug

SEQ ID NO: 676126 - RNA, 14 nt, Homo sapiens
acacagggcugcug

SEQ ID NO: 676127 - RNA, 19 nt, Homo sapiens
acacagucuuggcucacug

SEQ ID NO: 676128 - RNA, 15 nt, Homo sapiens
acacagugacuuccu

SEQ ID NO: 676129 - RNA, 22 nt, Homo sapiens
acacaguggauggacggacaag

SEQ ID NO: 676130 - RNA, 23 nt, Homo sapiens
acacaguguuggagguuaaggca

SEQ ID NO: 676131 - RNA, 15 nt, Homo sapiens
acacaguucugggca

SEQ ID NO: 676132 - RNA, 22 nt, Homo sapiens
acacaguuggauuuauucugcc

SEQ ID NO: 676133 - RNA, 19 nt, Homo sapiens
acacauaaaccaaaaccaa

SEQ ID NO: 676134 - RNA, 13 nt, Homo sapiens
acacauaagcaua

SEQ ID NO: 676135 - RNA, 23 nt, Homo sapiens
acacauaauuucuuaauuuucac

SEQ ID NO: 676136 - RNA, 14 nt, Homo sapiens
acacauaccuucau

SEQ ID NO: 676137 - RNA, 14 nt, Homo sapiens
acacauagauucac

SEQ ID NO: 676138 - RNA, 18 nt, Homo sapiens
acacauauacauguagga

SEQ ID NO: 676139 - RNA, 16 nt, Homo sapiens
acacaucuauucucaa

SEQ ID NO: 676140 - RNA, 23 nt, Homo sapiens
acacaucucccuuuuccaugacu

SEQ ID NO: 676141 - RNA, 14 nt, Homo sapiens
acacaucuuaccuc

SEQ ID NO: 676142 - RNA, 16 nt, Homo sapiens
acacaugcccaugaug

SEQ ID NO: 676143 - RNA, 23 nt, Homo sapiens
acacauggugugaguccaaagaa

SEQ ID NO: 676144 - RNA, 15 nt, Homo sapiens
acacaugugcaguca

SEQ ID NO: 676145 - RNA, 12 nt, Homo sapiens
acacaugugcug

SEQ ID NO: 676146 - RNA, 20 nt, Homo sapiens
acacauucuuaacacauguc

SEQ ID NO: 676147 - RNA, 19 nt, Homo sapiens
acacauugacuccuuucca

SEQ ID NO: 676148 - RNA, 19 nt, Homo sapiens
acacauugaguuggaauca

SEQ ID NO: 676149 - RNA, 20 nt, Homo sapiens
acacauugcauuuugauaaa

SEQ ID NO: 676150 - RNA, 16 nt, Homo sapiens
acacauuguacauggu

SEQ ID NO: 676151 - RNA, 16 nt, Homo sapiens
acacauuuacccuuug

SEQ ID NO: 676152 - RNA, 21 nt, Homo sapiens
acacauuuuuauaaaaaugag

SEQ ID NO: 676153 - RNA, 18 nt, Homo sapiens
acacauuuuucuuaggga

SEQ ID NO: 676154 - RNA, 20 nt, Homo sapiens
acacauuuuuuaaaugcacc

SEQ ID NO: 676155 - RNA, 15 nt, Homo sapiens
acaccaaaacaugcc

SEQ ID NO: 676156 - RNA, 19 nt, Homo sapiens
acaccaaugcccaacugcc

SEQ ID NO: 676157 - RNA, 16 nt, Homo sapiens
acaccacagguucuca

SEQ ID NO: 676158 - RNA, 18 nt, Homo sapiens
acaccacagguucucacu

SEQ ID NO: 676159 - RNA, 15 nt, Homo sapiens
acaccaccaugcuca

SEQ ID NO: 676160 - RNA, 20 nt, Homo sapiens
acaccaccaugcucaacuaa

SEQ ID NO: 676161 - RNA, 17 nt, Homo sapiens
acaccacuguacuccag

SEQ ID NO: 676162 - RNA, 20 nt, Homo sapiens
acaccaggcugugggccuca

SEQ ID NO: 676163 - RNA, 22 nt, Homo sapiens
acaccaugagccuccucgucac

SEQ ID NO: 676164 - RNA, 19 nt, Homo sapiens
acaccauuauaaaaacacu

SEQ ID NO: 676165 - RNA, 19 nt, Homo sapiens
acaccauucuccugccuca

SEQ ID NO: 676166 - RNA, 13 nt, Homo sapiens
acacccaacacuu

SEQ ID NO: 676167 - RNA, 23 nt, Homo sapiens
acacccaagaagaaaugcuuucc

SEQ ID NO: 676168 - RNA, 20 nt, Homo sapiens
acacccacccaauuggccca

SEQ ID NO: 676169 - RNA, 19 nt, Homo sapiens
acacccagagggaguagaa

SEQ ID NO: 676170 - RNA, 13 nt, Homo sapiens
acacccagcaaua

SEQ ID NO: 676171 - RNA, 20 nt, Homo sapiens
acacccagcucagcauuucc

SEQ ID NO: 676172 - RNA, 13 nt, Homo sapiens
acacccaggugau

SEQ ID NO: 676173 - RNA, 11 nt, Homo sapiens
acaccccagac

SEQ ID NO: 676174 - RNA, 21 nt, Homo sapiens
acacccgaaguccugucacug

SEQ ID NO: 676175 - RNA, 17 nt, Homo sapiens
acacccgacuccucaaa

SEQ ID NO: 676176 - RNA, 23 nt, Homo sapiens
acacccugaagaaauccugggaa

SEQ ID NO: 676177 - RNA, 14 nt, Homo sapiens
acacccugcuucuc

SEQ ID NO: 676178 - RNA, 21 nt, Homo sapiens
acacccugcuucucccgggga

SEQ ID NO: 676179 - RNA, 22 nt, Homo sapiens
acacccuggccugaacugagga

SEQ ID NO: 676180 - RNA, 13 nt, Homo sapiens
acacccuguacug

SEQ ID NO: 676181 - RNA, 15 nt, Homo sapiens
acacccuuucaucuc

SEQ ID NO: 676182 - RNA, 19 nt, Homo sapiens
acaccguacaucugcaaua

SEQ ID NO: 676183 - RNA, 20 nt, Homo sapiens
acaccguacaucugcaauau

SEQ ID NO: 676184 - RNA, 14 nt, Homo sapiens
acaacagaagucau

SEQ ID NO: 676185 - RNA, 21 nt, Homo sapiens
acaacagccucuacaccaacg

SEQ ID NO: 676186 - RNA, 23 nt, Homo sapiens
acaacaggcauagcaaaugacau

SEQ ID NO: 676187 - RNA, 22 nt, Homo sapiens
acaacauaaggagaauguaucu

SEQ ID NO: 676188 - RNA, 20 nt, Homo sapiens
acaacauguaccuguauuaa

SEQ ID NO: 676189 - RNA, 10 nt, Homo sapiens
acaacauguu

SEQ ID NO: 676190 - RNA, 11 nt, Homo sapiens
acaacauuaag

SEQ ID NO: 676191 - RNA, 14 nt, Homo sapiens
acaacauuugcaga

SEQ ID NO: 676192 - RNA, 16 nt, Homo sapiens
acaaccaaaaaauucu

SEQ ID NO: 676193 - RNA, 20 nt, Homo sapiens
acaaccaaaaaauucuacaa

SEQ ID NO: 676194 - RNA, 22 nt, Homo sapiens
acaaccaacggccgacugccug

SEQ ID NO: 676195 - RNA, 24 nt, Homo sapiens
acaacccaaaugucuaccaacuga

SEQ ID NO: 676196 - RNA, 22 nt, Homo sapiens
acaacccagaauggucauuuca

SEQ ID NO: 676197 - RNA, 15 nt, Homo sapiens
acaaccggucccuuc

SEQ ID NO: 676198 - RNA, 18 nt, Homo sapiens
acaaccggucccuuccau

SEQ ID NO: 676199 - RNA, 16 nt, Homo sapiens
acaaccugaaucuuuu

SEQ ID NO: 676200 - RNA, 18 nt, Homo sapiens
acaacgccgagugcacug

SEQ ID NO: 676201 - RNA, 17 nt, Homo sapiens
acaacgccugucacaga

SEQ ID NO: 676202 - RNA, 15 nt, Homo sapiens
acaacuaccuccuca

SEQ ID NO: 676203 - RNA, 12 nt, Homo sapiens
acaacuaccuga

SEQ ID NO: 676204 - RNA, 16 nt, Homo sapiens
acaacucaaugaaaau

SEQ ID NO: 676205 - RNA, 14 nt, Homo sapiens
acaacucuagucag

SEQ ID NO: 676206 - RNA, 13 nt, Homo sapiens
acaacucugaaag

SEQ ID NO: 676207 - RNA, 20 nt, Homo sapiens
acaacucuuacacaaauacu

SEQ ID NO: 676208 - RNA, 15 nt, Homo sapiens
acaacugccagcucu

SEQ ID NO: 676209 - RNA, 20 nt, Homo sapiens
acaacugccagcucucugau

SEQ ID NO: 676210 - RNA, 13 nt, Homo sapiens
acaacuuagcuca

SEQ ID NO: 676211 - RNA, 21 nt, Homo sapiens
acaacuuucacuauaauguga

SEQ ID NO: 676212 - RNA, 21 nt, Homo sapiens
acaacuuugaaacuggaauaa

SEQ ID NO: 676213 - RNA, 17 nt, Homo sapiens
acaagaaaaucaaauau

SEQ ID NO: 676214 - RNA, 21 nt, Homo sapiens
acaagaaaauguauccaagga

SEQ ID NO: 676215 - RNA, 16 nt, Homo sapiens
acaagaaacauuucag

SEQ ID NO: 676216 - RNA, 15 nt, Homo sapiens
acaagaaaucugaca

SEQ ID NO: 676217 - RNA, 13 nt, Homo sapiens
acaagaacaauga

SEQ ID NO: 676218 - RNA, 19 nt, Homo sapiens
acaagaagaccagacugug

SEQ ID NO: 676219 - RNA, 12 nt, Homo sapiens
acaagaagccac

SEQ ID NO: 676220 - RNA, 18 nt, Homo sapiens
acaagaagggacugagag

SEQ ID NO: 676221 - RNA, 16 nt, Homo sapiens
acaagaaucaccucaa

SEQ ID NO: 676222 - RNA, 18 nt, Homo sapiens
acaagaaugcauucccug

SEQ ID NO: 676223 - RNA, 19 nt, Homo sapiens
acaagaaugugcacucucu

SEQ ID NO: 676224 - RNA, 17 nt, Homo sapiens
acaagaccccgucucaa

SEQ ID NO: 676225 - RNA, 15 nt, Homo sapiens
acaagaccucagugc

SEQ ID NO: 676226 - RNA, 16 nt, Homo sapiens
acaagagcaucaggcu

SEQ ID NO: 676227 - RNA, 22 nt, Homo sapiens
acaagagcuuugguaaucucug

SEQ ID NO: 676228 - RNA, 18 nt, Homo sapiens
acaagauccuuaaugcag

SEQ ID NO: 676229 - RNA, 19 nt, Homo sapiens
acaagauccuuaaugcaga

SEQ ID NO: 676230 - RNA, 20 nt, Homo sapiens
acaagauuaccccaccuugc

SEQ ID NO: 676231 - RNA, 15 nt, Homo sapiens
acaagauuaucuuau

SEQ ID NO: 676232 - RNA, 12 nt, Homo sapiens
acaagauugaaa

SEQ ID NO: 676233 - RNA, 14 nt, Homo sapiens
acaagauugcuuaa

SEQ ID NO: 676234 - RNA, 20 nt, Homo sapiens
acaagauuugcugcauuucc

SEQ ID NO: 676235 - RNA, 14 nt, Homo sapiens
acaagcaauaacuc

SEQ ID NO: 676236 - RNA, 14 nt, Homo sapiens
acaagcauauuuga

SEQ ID NO: 676237 - RNA, 13 nt, Homo sapiens
acaagccaagaaa

SEQ ID NO: 676238 - RNA, 20 nt, Homo sapiens
acaagccacaagucuuccag

SEQ ID NO: 676239 - RNA, 14 nt, Homo sapiens
acaagccauagugg

SEQ ID NO: 676240 - RNA, 22 nt, Homo sapiens
acaagcucugcgccaaucacag

SEQ ID NO: 676241 - RNA, 21 nt, Homo sapiens
acaagcugacuuggcacuuaa

SEQ ID NO: 676242 - RNA, 23 nt, Homo sapiens
acaaggaauuucccuguguggau

SEQ ID NO: 676243 - RNA, 16 nt, Homo sapiens
acaaggaugacaagaa

SEQ ID NO: 676244 - RNA, 20 nt, Homo sapiens
acaaggcacaccagugcaag

SEQ ID NO: 676245 - RNA, 23 nt, Homo sapiens
acaaggcauucaaguguacagug

SEQ ID NO: 676246 - RNA, 15 nt, Homo sapiens
acaaggcugaccaag

SEQ ID NO: 676247 - RNA, 18 nt, Homo sapiens
acaaggcuuuaucucagg

SEQ ID NO: 676248 - RNA, 19 nt, Homo sapiens
acaaggcuuuaucucaggg

SEQ ID NO: 676249 - RNA, 22 nt, Homo sapiens
acaagggacuagugagucagca

SEQ ID NO: 676250 - RNA, 20 nt, Homo sapiens
acaaggguccguggaccagg

SEQ ID NO: 676251 - RNA, 20 nt, Homo sapiens
acaagguggugcuucugcca

SEQ ID NO: 676252 - RNA, 22 nt, Homo sapiens
acaaggugucuuuuccacuccu

SEQ ID NO: 676253 - RNA, 19 nt, Homo sapiens
acaagguuggcaccccagc

SEQ ID NO: 676254 - RNA, 18 nt, Homo sapiens
acaaguauguugagaguu

SEQ ID NO: 676255 - RNA, 15 nt, Homo sapiens
acaaguccuugaccu

SEQ ID NO: 676256 - RNA, 17 nt, Homo sapiens
acaagugagacaaaaag

SEQ ID NO: 676257 - RNA, 15 nt, Homo sapiens
acaagugggugaaug

SEQ ID NO: 676258 - RNA, 19 nt, Homo sapiens
acaaguuagaaaacauaau

SEQ ID NO: 676259 - RNA, 22 nt, Homo sapiens
acaaguucaauaaaaaucugcu

SEQ ID NO: 676260 - RNA, 15 nt, Homo sapiens
acaauaaaacacuuu

SEQ ID NO: 676261 - RNA, 15 nt, Homo sapiens
acaauaaaacauuaa

SEQ ID NO: 676262 - RNA, 14 nt, Homo sapiens
acaauaaaaccugg

SEQ ID NO: 676263 - RNA, 13 nt, Homo sapiens
acaauaaagcaau

SEQ ID NO: 676264 - RNA, 17 nt, Homo sapiens
acaauaaagcaaugugg

SEQ ID NO: 676265 - RNA, 18 nt, Homo sapiens
acaauaaauggccagugc

SEQ ID NO: 676266 - RNA, 17 nt, Homo sapiens
acaauacaugcugcuaa

SEQ ID NO: 676267 - RNA, 21 nt, Homo sapiens
acaauaggugcuuauucucaa

SEQ ID NO: 676268 - RNA, 23 nt, Homo sapiens
acaauauaaacugaaaaauguca

SEQ ID NO: 676269 - RNA, 20 nt, Homo sapiens
acaauauauuuaguuguaaa

SEQ ID NO: 676270 - RNA, 15 nt, Homo sapiens
acaaucagcagucua

SEQ ID NO: 676271 - RNA, 14 nt, Homo sapiens
acaaucagcuccuu

SEQ ID NO: 676272 - RNA, 19 nt, Homo sapiens
acaaucaugaaauaugcau

SEQ ID NO: 676273 - RNA, 24 nt, Homo sapiens
acaauccaucucucaaguagugua

SEQ ID NO: 676274 - RNA, 21 nt, Homo sapiens
acaauccccacauaccaucug

SEQ ID NO: 676275 - RNA, 19 nt, Homo sapiens
acaaucuaagggucucuca

SEQ ID NO: 676276 - RNA, 20 nt, Homo sapiens
acaaucuaagggucucucau

SEQ ID NO: 676277 - RNA, 12 nt, Homo sapiens
acaaucugggac

SEQ ID NO: 676278 - RNA, 21 nt, Homo sapiens
acaaucuuaagagcuugaucu

SEQ ID NO: 676279 - RNA, 18 nt, Homo sapiens
acaaugaaauacuccagc

SEQ ID NO: 676280 - RNA, 21 nt, Homo sapiens
acaaugaacccccaugaugua

SEQ ID NO: 676281 - RNA, 17 nt, Homo sapiens
acaaugacauccagaaa

SEQ ID NO: 676282 - RNA, 18 nt, Homo sapiens
acaaugaugccgaacauu

SEQ ID NO: 676283 - RNA, 17 nt, Homo sapiens
acaaugcaaccaacuau

SEQ ID NO: 676284 - RNA, 23 nt, Homo sapiens
acaaugcaguacaggacauauau

SEQ ID NO: 676285 - RNA, 17 nt, Homo sapiens
acaaugcaugugcuguc

SEQ ID NO: 676286 - RNA, 11 nt, Homo sapiens
acaaugcauuu

SEQ ID NO: 676287 - RNA, 9 nt, Homo sapiens
acaaugcca

SEQ ID NO: 676288 - RNA, 22 nt, Homo sapiens
acaauggcccgacauuucuuca

SEQ ID NO: 676289 - RNA, 15 nt, Homo sapiens
acaauguauaagcua

SEQ ID NO: 676290 - RNA, 22 nt, Homo sapiens
acaauguuaucaaccaacugca

SEQ ID NO: 676291 - RNA, 23 nt, Homo sapiens
acaauguugcauuuaugaugcag

SEQ ID NO: 676292 - RNA, 17 nt, Homo sapiens
acaauuaugaacaucca

SEQ ID NO: 676293 - RNA, 21 nt, Homo sapiens
acaauuauuuuuacaguucuc

SEQ ID NO: 676294 - RNA, 14 nt, Homo sapiens
acaauucauugugu

SEQ ID NO: 676295 - RNA, 15 nt, Homo sapiens
acaauucuucuguca

SEQ ID NO: 676296 - RNA, 16 nt, Homo sapiens
acaauugcaacagaag

SEQ ID NO: 676297 - RNA, 21 nt, Homo sapiens
acaauugcuuuaacagucaaa

SEQ ID NO: 676298 - RNA, 18 nt, Homo sapiens
acaauuguaauugacagg

SEQ ID NO: 676299 - RNA, 19 nt, Homo sapiens
acaauugucuuaaaaccag

SEQ ID NO: 676300 - RNA, 21 nt, Homo sapiens
acaauugucuuaaaaccagag

SEQ ID NO: 676301 - RNA, 20 nt, Homo sapiens
acaauuuccaaaacugucca

SEQ ID NO: 676302 - RNA, 14 nt, Homo sapiens
acaauuuuuauuuc

SEQ ID NO: 676303 - RNA, 20 nt, Homo sapiens
acacaaacgggcucagcaaa

SEQ ID NO: 676304 - RNA, 16 nt, Homo sapiens
acacaaagacuccuug

SEQ ID NO: 676305 - RNA, 19 nt, Homo sapiens
acacaaaguguauacaugu

SEQ ID NO: 676306 - RNA, 20 nt, Homo sapiens
aaguuaccuacaagaacaau

SEQ ID NO: 676307 - RNA, 13 nt, Homo sapiens
aaguuacuacuga

SEQ ID NO: 676308 - RNA, 17 nt, Homo sapiens
aaguuagaaaacauaau

SEQ ID NO: 676309 - RNA, 14 nt, Homo sapiens
aaguuaucaucuca

SEQ ID NO: 676310 - RNA, 22 nt, Homo sapiens
aaguuauguucuucuucauuga

SEQ ID NO: 676311 - RNA, 17 nt, Homo sapiens
aaguuauuaacuuuaau

SEQ ID NO: 676312 - RNA, 16 nt, Homo sapiens
aaguuauuuacuuuua

SEQ ID NO: 676313 - RNA, 17 nt, Homo sapiens
aaguuauuucaugcgca

SEQ ID NO: 676314 - RNA, 23 nt, Homo sapiens
aaguuccaugaauucuugauuuc

SEQ ID NO: 676315 - RNA, 17 nt, Homo sapiens
aaguuccuauaccuuac

SEQ ID NO: 676316 - RNA, 15 nt, Homo sapiens
aaguuccucuagugc

SEQ ID NO: 676317 - RNA, 20 nt, Homo sapiens
aaguucuuggugguggauga

SEQ ID NO: 676318 - RNA, 21 nt, Homo sapiens
aaguugaggagguuucugcau

SEQ ID NO: 676319 - RNA, 12 nt, Homo sapiens
aaguugcagcug

SEQ ID NO: 676320 - RNA, 22 nt, Homo sapiens
aaguugcauuccuuugucuuca

SEQ ID NO: 676321 - RNA, 20 nt, Homo sapiens
aaguugcugaugaacucuua

SEQ ID NO: 676322 - RNA, 22 nt, Homo sapiens
aaguugcugggauuacaggugu

SEQ ID NO: 676323 - RNA, 13 nt, Homo sapiens
aaguugugcuuga

SEQ ID NO: 676324 - RNA, 22 nt, Homo sapiens
aaguuguugacugugauuagau

SEQ ID NO: 676325 - RNA, 20 nt, Homo sapiens
aaguuguuuaccucuuuguc

SEQ ID NO: 676326 - RNA, 16 nt, Homo sapiens
aaguuuaauugacuua

SEQ ID NO: 676327 - RNA, 17 nt, Homo sapiens
aaguuuauaaaagugaa

SEQ ID NO: 676328 - RNA, 16 nt, Homo sapiens
aaguuuauaugcuucu

SEQ ID NO: 676329 - RNA, 15 nt, Homo sapiens
aaguuucauacucaa

SEQ ID NO: 676330 - RNA, 22 nt, Homo sapiens
aaguuucaucagucaaugagga

SEQ ID NO: 676331 - RNA, 16 nt, Homo sapiens
aaguuucugucuuccu

SEQ ID NO: 676332 - RNA, 17 nt, Homo sapiens
aaguuucuguugaauua

SEQ ID NO: 676333 - RNA, 19 nt, Homo sapiens
aaguuugaccagugcaguu

SEQ ID NO: 676334 - RNA, 13 nt, Homo sapiens
aaguuugagauca

SEQ ID NO: 676335 - RNA, 19 nt, Homo sapiens
aaguuuuaaauaaaccuau

SEQ ID NO: 676336 - RNA, 18 nt, Homo sapiens
aaguuuuccaguauugaa

SEQ ID NO: 676337 - RNA, 16 nt, Homo sapiens
aaguuuucuaaacuca

SEQ ID NO: 676338 - RNA, 21 nt, Homo sapiens
aaguuuuguaaaagaaaucau

SEQ ID NO: 676339 - RNA, 23 nt, Homo sapiens
aaguuuuuauggcuuuugugcau

SEQ ID NO: 676340 - RNA, 20 nt, Homo sapiens
aaguuuuuuauuaugcauua

SEQ ID NO: 676341 - RNA, 20 nt, Homo sapiens
aauaaaaaaaaaaggaugaa

SEQ ID NO: 676342 - RNA, 15 nt, Homo sapiens
aauaaaaaacaagaa

SEQ ID NO: 676343 - RNA, 20 nt, Homo sapiens
aauaaaaagucacaaugagu

SEQ ID NO: 676344 - RNA, 16 nt, Homo sapiens
aauaaaaaucauucua

SEQ ID NO: 676345 - RNA, 18 nt, Homo sapiens
aauaaaaauguucuuaca

SEQ ID NO: 676346 - RNA, 21 nt, Homo sapiens
aauaaaacccacaagugucua

SEQ ID NO: 676347 - RNA, 24 nt, Homo sapiens
aauaaaacuauuuaaaauuggcac

SEQ ID NO: 676348 - RNA, 14 nt, Homo sapiens
aauaaaacugcaca

SEQ ID NO: 676349 - RNA, 15 nt, Homo sapiens
aauaaaagaacaugc

SEQ ID NO: 676350 - RNA, 22 nt, Homo sapiens
aauaaaagaauaguugccaagg

SEQ ID NO: 676351 - RNA, 16 nt, Homo sapiens
aauaaaagaucuugaa

SEQ ID NO: 676352 - RNA, 19 nt, Homo sapiens
aauaaaagaugauuucuca

SEQ ID NO: 676353 - RNA, 16 nt, Homo sapiens
aauaaaaucauguagu

SEQ ID NO: 676354 - RNA, 20 nt, Homo sapiens
aauaaaaugucuucucccac

SEQ ID NO: 676355 - RNA, 14 nt, Homo sapiens
aauaaaauguuccg

SEQ ID NO: 676356 - RNA, 19 nt, Homo sapiens
aauaaaauuucuaagagag

SEQ ID NO: 676357 - RNA, 13 nt, Homo sapiens
aauaaacaugacc

SEQ ID NO: 676358 - RNA, 12 nt, Homo sapiens
aauaaacauuaa

SEQ ID NO: 676359 - RNA, 20 nt, Homo sapiens
aauaaaccaucaucuugcca

SEQ ID NO: 676360 - RNA, 15 nt, Homo sapiens
aauaaacccuuccug

SEQ ID NO: 676361 - RNA, 23 nt, Homo sapiens
aauaaacgaggaaaagguccuug

SEQ ID NO: 676362 - RNA, 18 nt, Homo sapiens
aauaaacugaaaauggac

SEQ ID NO: 676363 - RNA, 17 nt, Homo sapiens
aauaaagaaauugcaau

SEQ ID NO: 676364 - RNA, 22 nt, Homo sapiens
aauaaagaccuauguacuuaau

SEQ ID NO: 676365 - RNA, 22 nt, Homo sapiens
aauaaagcuuucagguguuaca

SEQ ID NO: 676366 - RNA, 12 nt, Homo sapiens
aauaaagcuuuu

SEQ ID NO: 676367 - RNA, 15 nt, Homo sapiens
aauaaaggcauuuca

SEQ ID NO: 676368 - RNA, 13 nt, Homo sapiens
aauaaaguaccac

SEQ ID NO: 676369 - RNA, 15 nt, Homo sapiens
aauaaaguaccacac

SEQ ID NO: 676370 - RNA, 13 nt, Homo sapiens
aauaaagugaucu

SEQ ID NO: 676371 - RNA, 14 nt, Homo sapiens
aauaaauacacaau

SEQ ID NO: 676372 - RNA, 12 nt, Homo sapiens
aauaaaucaauu

SEQ ID NO: 676373 - RNA, 17 nt, Homo sapiens
aauaaaucacuugcucu

SEQ ID NO: 676374 - RNA, 23 nt, Homo sapiens
aauaaaugagagggaaucgacug

SEQ ID NO: 676375 - RNA, 12 nt, Homo sapiens
aauaaaugauua

SEQ ID NO: 676376 - RNA, 12 nt, Homo sapiens
aauaaaugccac

SEQ ID NO: 676377 - RNA, 15 nt, Homo sapiens
aauaaaugccuucca

SEQ ID NO: 676378 - RNA, 20 nt, Homo sapiens
aauaaaugguuucucauuaa

SEQ ID NO: 676379 - RNA, 15 nt, Homo sapiens
aauaaaugucuugcc

SEQ ID NO: 676380 - RNA, 14 nt, Homo sapiens
aauaaaugugcuua

SEQ ID NO: 676381 - RNA, 13 nt, Homo sapiens
aauaaauguugcc

SEQ ID NO: 676382 - RNA, 18 nt, Homo sapiens
aauaaauguuuuauuucu

SEQ ID NO: 676383 - RNA, 22 nt, Homo sapiens
aauaaauguuuuuuaaaucuga

SEQ ID NO: 676384 - RNA, 16 nt, Homo sapiens
aauaaauugcucaaau

SEQ ID NO: 676385 - RNA, 13 nt, Homo sapiens
aauaaauuguaaa

SEQ ID NO: 676386 - RNA, 13 nt, Homo sapiens
aauaaauugugaa

SEQ ID NO: 676387 - RNA, 21 nt, Homo sapiens
aauaaauuuuagugugccuuc

SEQ ID NO: 676388 - RNA, 13 nt, Homo sapiens
aauaacauguaau

SEQ ID NO: 676389 - RNA, 14 nt, Homo sapiens
aauaacauugcacu

SEQ ID NO: 676390 - RNA, 19 nt, Homo sapiens
aauaacauuuaaauuccac

SEQ ID NO: 676391 - RNA, 14 nt, Homo sapiens
aauaaccacuuaaa

SEQ ID NO: 676392 - RNA, 19 nt, Homo sapiens
aauaaccguaaagguuuau

SEQ ID NO: 676393 - RNA, 16 nt, Homo sapiens
aauaaccugccagucc

SEQ ID NO: 676394 - RNA, 20 nt, Homo sapiens
aauaacuuuucaccaaugag

SEQ ID NO: 676395 - RNA, 16 nt, Homo sapiens
aauaagaaacaugaug

SEQ ID NO: 676396 - RNA, 19 nt, Homo sapiens
aauaagaacagaucaggaa

SEQ ID NO: 676397 - RNA, 21 nt, Homo sapiens
aauaagaauucagacaucuga

SEQ ID NO: 676398 - RNA, 17 nt, Homo sapiens
aauaagagauccuuuag

SEQ ID NO: 676399 - RNA, 19 nt, Homo sapiens
aauaagauauauaugugcu

SEQ ID NO: 676400 - RNA, 16 nt, Homo sapiens
aauaagcaaaaugcca

SEQ ID NO: 676401 - RNA, 13 nt, Homo sapiens
aauaagccuucaa

SEQ ID NO: 676402 - RNA, 21 nt, Homo sapiens
aauaagcuaaacgcaauguca

SEQ ID NO: 676403 - RNA, 14 nt, Homo sapiens
aauaauaaaaugca

SEQ ID NO: 676404 - RNA, 15 nt, Homo sapiens
aauaauaaauccuca

SEQ ID NO: 676405 - RNA, 15 nt, Homo sapiens
aauaauaaauuugau

SEQ ID NO: 676406 - RNA, 16 nt, Homo sapiens
aauaauagaauugcuc

SEQ ID NO: 676407 - RNA, 20 nt, Homo sapiens
aauaauagacucgcuaguca

SEQ ID NO: 676408 - RNA, 15 nt, Homo sapiens
aauaauagcaauuca

SEQ ID NO: 676409 - RNA, 20 nt, Homo sapiens
aauaauagggaaaauaccua

SEQ ID NO: 676410 - RNA, 18 nt, Homo sapiens
aauaauaucccacuggga

SEQ ID NO: 676411 - RNA, 14 nt, Homo sapiens
aauaauaugaagca

SEQ ID NO: 676412 - RNA, 15 nt, Homo sapiens
aauaauaugaugcca

SEQ ID NO: 676413 - RNA, 20 nt, Homo sapiens
aauaaucaacugaauugcaa

SEQ ID NO: 676414 - RNA, 22 nt, Homo sapiens
aauaaucauucuuuccccucag

SEQ ID NO: 676415 - RNA, 16 nt, Homo sapiens
aauaaugaauacauuu

SEQ ID NO: 676416 - RNA, 21 nt, Homo sapiens
aauaaugaguuagaacuauua

SEQ ID NO: 676417 - RNA, 19 nt, Homo sapiens
aauaauggaaaaugccaug

SEQ ID NO: 676418 - RNA, 18 nt, Homo sapiens
aauaauggaaacauuaca

SEQ ID NO: 676419 - RNA, 20 nt, Homo sapiens
aauaauggcaucaauauaca

SEQ ID NO: 676420 - RNA, 14 nt, Homo sapiens
aaggcagcugccuc

SEQ ID NO: 676421 - RNA, 13 nt, Homo sapiens
aaggcagugcaug

SEQ ID NO: 676422 - RNA, 22 nt, Homo sapiens
aaggcauguggccuuuaucuca

SEQ ID NO: 676423 - RNA, 15 nt, Homo sapiens
aaggccacaugucac

SEQ ID NO: 676424 - RNA, 20 nt, Homo sapiens
aaggccacggccuugugucu

SEQ ID NO: 676425 - RNA, 19 nt, Homo sapiens
aaggccccagaugauccca

SEQ ID NO: 676426 - RNA, 14 nt, Homo sapiens
aaggcccuuuucag

SEQ ID NO: 676427 - RNA, 13 nt, Homo sapiens
aaggccucugugg

SEQ ID NO: 676428 - RNA, 22 nt, Homo sapiens
aaggccucuuguugagugccag

SEQ ID NO: 676429 - RNA, 17 nt, Homo sapiens
aaggccugcccucccau

SEQ ID NO: 676430 - RNA, 19 nt, Homo sapiens
aaggccuuuccuacaugcc

SEQ ID NO: 676431 - RNA, 16 nt, Homo sapiens
aaggcgccugccuugg

SEQ ID NO: 676432 - RNA, 19 nt, Homo sapiens
aaggcggguggaucacuug

SEQ ID NO: 676433 - RNA, 22 nt, Homo sapiens
aaggcgguacuaguucagacac

SEQ ID NO: 676434 - RNA, 23 nt, Homo sapiens
aaggcuaaaaagcaacaggccau

SEQ ID NO: 676435 - RNA, 14 nt, Homo sapiens
aaggcuacuugagc

SEQ ID NO: 676436 - RNA, 13 nt, Homo sapiens
aaggcucagucuc

SEQ ID NO: 676437 - RNA, 16 nt, Homo sapiens
aaggcuccuccuugcc

SEQ ID NO: 676438 - RNA, 22 nt, Homo sapiens
aaggcugacagacucacuggga

SEQ ID NO: 676439 - RNA, 14 nt, Homo sapiens
aaggcugagcucuu

SEQ ID NO: 676440 - RNA, 17 nt, Homo sapiens
aaggcugauuacugaaa

SEQ ID NO: 676441 - RNA, 16 nt, Homo sapiens
aaggcugcaagguuua

SEQ ID NO: 676442 - RNA, 15 nt, Homo sapiens
aaggcugcugugaac

SEQ ID NO: 676443 - RNA, 18 nt, Homo sapiens
aaggcuggcagugacaga

SEQ ID NO: 676444 - RNA, 20 nt, Homo sapiens
aaggcuuuaauaaaggccac

SEQ ID NO: 676445 - RNA, 18 nt, Homo sapiens
aaggcuuugccaugggcc

SEQ ID NO: 676446 - RNA, 20 nt, Homo sapiens
aaggcuuugguuuccaaguc

SEQ ID NO: 676447 - RNA, 15 nt, Homo sapiens
aagggaaagucagcu

SEQ ID NO: 676448 - RNA, 22 nt, Homo sapiens
aagggaaucauuuuucacugua

SEQ ID NO: 676449 - RNA, 14 nt, Homo sapiens
aagggaauugcuca

SEQ ID NO: 676450 - RNA, 20 nt, Homo sapiens
aagggacaagacaaaaccaa

SEQ ID NO: 676451 - RNA, 21 nt, Homo sapiens
aagggagaagggugguaaaua

SEQ ID NO: 676452 - RNA, 15 nt, Homo sapiens
aagggauaguccaaa

SEQ ID NO: 676453 - RNA, 23 nt, Homo sapiens
aagggauugcuuugcauuacugu

SEQ ID NO: 676454 - RNA, 23 nt, Homo sapiens
aagggauuugaggugaggguugg

SEQ ID NO: 676455 - RNA, 19 nt, Homo sapiens
aagggcaacagaucaguaa

SEQ ID NO: 676456 - RNA, 12 nt, Homo sapiens
aagggcauuucc

SEQ ID NO: 676457 - RNA, 14 nt, Homo sapiens
aagggccacuggga

SEQ ID NO: 676458 - RNA, 15 nt, Homo sapiens
aagggccacugggac

SEQ ID NO: 676459 - RNA, 22 nt, Homo sapiens
aagggcccagauucuaccacac

SEQ ID NO: 676460 - RNA, 17 nt, Homo sapiens
aagggccugcccagaca

SEQ ID NO: 676461 - RNA, 21 nt, Homo sapiens
aaggggacaccuguacauucu

SEQ ID NO: 676462 - RNA, 16 nt, Homo sapiens
aaggggaggacacugg

SEQ ID NO: 676463 - RNA, 20 nt, Homo sapiens
aaggggcucuucaucugccu

SEQ ID NO: 676464 - RNA, 17 nt, Homo sapiens
aagggggguugcagugg

SEQ ID NO: 676465 - RNA, 12 nt, Homo sapiens
aaggggucugua

SEQ ID NO: 676466 - RNA, 19 nt, Homo sapiens
aagggguuggggugacagu

SEQ ID NO: 676467 - RNA, 21 nt, Homo sapiens
aaggguacagauuagguuugu

SEQ ID NO: 676468 - RNA, 23 nt, Homo sapiens
aaggguaccuugaacacuggggg

SEQ ID NO: 676469 - RNA, 21 nt, Homo sapiens
aagggugcccuuugggguccc

SEQ ID NO: 676470 - RNA, 13 nt, Homo sapiens
aaggguucuuucc

SEQ ID NO: 676471 - RNA, 16 nt, Homo sapiens
aagguaagaucauuua

SEQ ID NO: 676472 - RNA, 17 nt, Homo sapiens
aagguagagucuuacaa

SEQ ID NO: 676473 - RNA, 22 nt, Homo sapiens
aagguagccaucccaugaacac

SEQ ID NO: 676474 - RNA, 12 nt, Homo sapiens
aagguaugcaau

SEQ ID NO: 676475 - RNA, 16 nt, Homo sapiens
aagguaugcaaucaaa

SEQ ID NO: 676476 - RNA, 13 nt, Homo sapiens
aagguauguguca

SEQ ID NO: 676477 - RNA, 18 nt, Homo sapiens
aagguaugugucagccau

SEQ ID NO: 676478 - RNA, 15 nt, Homo sapiens
aagguauuucuccag

SEQ ID NO: 676479 - RNA, 15 nt, Homo sapiens
aaggucacucuuggu

SEQ ID NO: 676480 - RNA, 23 nt, Homo sapiens
aagguccaacaagaaugcauucc

SEQ ID NO: 676481 - RNA, 15 nt, Homo sapiens
aagguccaggcuugc

SEQ ID NO: 676482 - RNA, 19 nt, Homo sapiens
aaggucuccaaaccagacg

SEQ ID NO: 676483 - RNA, 23 nt, Homo sapiens
aaggucugaaauccagcaucuau

SEQ ID NO: 676484 - RNA, 17 nt, Homo sapiens
aaggucugcacuccuuu

SEQ ID NO: 676485 - RNA, 16 nt, Homo sapiens
aaggugaaagugcagu

SEQ ID NO: 676486 - RNA, 16 nt, Homo sapiens
aaggugaagagaccaa

SEQ ID NO: 676487 - RNA, 15 nt, Homo sapiens
aaggugaccuugcaa

SEQ ID NO: 676488 - RNA, 11 nt, Homo sapiens
aaggugauaua

SEQ ID NO: 676489 - RNA, 14 nt, Homo sapiens
aaggugccacuuua

SEQ ID NO: 676490 - RNA, 12 nt, Homo sapiens
aaggugccucau

SEQ ID NO: 676491 - RNA, 19 nt, Homo sapiens
aagguggaacaagcacaga

SEQ ID NO: 676492 - RNA, 21 nt, Homo sapiens
aaggugggaaggaugguccag

SEQ ID NO: 676493 - RNA, 20 nt, Homo sapiens
aaggugggcagaucacugga

SEQ ID NO: 676494 - RNA, 21 nt, Homo sapiens
aaggugguuacuuggaccaga

SEQ ID NO: 676495 - RNA, 15 nt, Homo sapiens
aaggugucuuuauga

SEQ ID NO: 676496 - RNA, 16 nt, Homo sapiens
aagguguguccuugaa

SEQ ID NO: 676497 - RNA, 19 nt, Homo sapiens
aagguguuuuccugaagaa

SEQ ID NO: 676498 - RNA, 20 nt, Homo sapiens
aagguuaugaaacauaucau

SEQ ID NO: 676499 - RNA, 12 nt, Homo sapiens
aagguucacagg

SEQ ID NO: 676500 - RNA, 14 nt, Homo sapiens
aagguucagcugaa

SEQ ID NO: 676501 - RNA, 17 nt, Homo sapiens
aagguuccaacuguaua

SEQ ID NO: 676502 - RNA, 22 nt, Homo sapiens
aagguucucagguguugccaaa

SEQ ID NO: 676503 - RNA, 15 nt, Homo sapiens
aagguucugcccuua

SEQ ID NO: 676504 - RNA, 23 nt, Homo sapiens
aagguugaaaagacaauagccca

SEQ ID NO: 676505 - RNA, 22 nt, Homo sapiens
aagguugcugaggcucugaccc

SEQ ID NO: 676506 - RNA, 19 nt, Homo sapiens
aagguuggugaauuucaca

SEQ ID NO: 676507 - RNA, 20 nt, Homo sapiens
aagguuucauguucacugug

SEQ ID NO: 676508 - RNA, 20 nt, Homo sapiens
aagguuuuagacccauagca

SEQ ID NO: 676509 - RNA, 13 nt, Homo sapiens
aagguuuuauuca

SEQ ID NO: 676510 - RNA, 22 nt, Homo sapiens
aagguuuucucuaacuucucaa

SEQ ID NO: 676511 - RNA, 22 nt, Homo sapiens
aagguuuuguugcuagcccuuc

SEQ ID NO: 676512 - RNA, 21 nt, Homo sapiens
aagguuuuugucuaugaauau

SEQ ID NO: 676513 - RNA, 23 nt, Homo sapiens
aaguaaaaacacuaccucuuuug

SEQ ID NO: 676514 - RNA, 23 nt, Homo sapiens
aaguaaaacaugcugaaaacuac

SEQ ID NO: 676515 - RNA, 20 nt, Homo sapiens
aaguaaaacuugcugccuga

SEQ ID NO: 676516 - RNA, 13 nt, Homo sapiens
aaguaaaagcaag

SEQ ID NO: 676517 - RNA, 16 nt, Homo sapiens
aaguaaaagucuaccu

SEQ ID NO: 676518 - RNA, 15 nt, Homo sapiens
aaguaaauauuucag

SEQ ID NO: 676519 - RNA, 14 nt, Homo sapiens
aaguaaauugccug

SEQ ID NO: 676520 - RNA, 21 nt, Homo sapiens
aaguaacacaguggacuuccu

SEQ ID NO: 676521 - RNA, 16 nt, Homo sapiens
aaguaacaucagccau

SEQ ID NO: 676522 - RNA, 21 nt, Homo sapiens
aaguaacaugcauacuuuauu

SEQ ID NO: 676523 - RNA, 16 nt, Homo sapiens
aaguaaccauuugcac

SEQ ID NO: 676524 - RNA, 18 nt, Homo sapiens
aaguaacuuaaggaccuu

SEQ ID NO: 676525 - RNA, 13 nt, Homo sapiens
aaguaagcccuug

SEQ ID NO: 676526 - RNA, 13 nt, Homo sapiens
aaguaagucuuuu

SEQ ID NO: 676527 - RNA, 18 nt, Homo sapiens
aaguaaguuaauaaugua

SEQ ID NO: 676528 - RNA, 13 nt, Homo sapiens
aaguaaugauuaa

SEQ ID NO: 676529 - RNA, 20 nt, Homo sapiens
aaguaauuccucucacuaaa

SEQ ID NO: 676530 - RNA, 16 nt, Homo sapiens
aaguaauucucaagaa

SEQ ID NO: 676531 - RNA, 19 nt, Homo sapiens
aaguacaaacuucuccuau

SEQ ID NO: 676532 - RNA, 22 nt, Homo sapiens
aaguacaagagcuuaacagugu

SEQ ID NO: 676533 - RNA, 18 nt, Homo sapiens
aaguacauaaaguacaua

SEQ ID NO: 676534 - RNA, 13 nt, Homo sapiens
aaguacauguauu

SEQ ID NO: 676535 - RNA, 20 nt, Homo sapiens
aaguaccacacauauugcac

SEQ ID NO: 676536 - RNA, 13 nt, Homo sapiens
cuagaugcaaaua

SEQ ID NO: 676537 - RNA, 15 nt, Homo sapiens
cuagaugugucuuac

SEQ ID NO: 676538 - RNA, 11 nt, Homo sapiens
cuagauuacag

SEQ ID NO: 676539 - RNA, 20 nt, Homo sapiens
cuagauuaccaugaagaaca

SEQ ID NO: 676540 - RNA, 17 nt, Homo sapiens
cuagauuuaacucaguu

SEQ ID NO: 676541 - RNA, 16 nt, Homo sapiens
cuagauuuucuacuuu

SEQ ID NO: 676542 - RNA, 19 nt, Homo sapiens
cuagauuuucuacuuuauu

SEQ ID NO: 676543 - RNA, 13 nt, Homo sapiens
cuagauuuugcug

SEQ ID NO: 676544 - RNA, 23 nt, Homo sapiens
cuagcaaauggcagaaccaaagc

SEQ ID NO: 676545 - RNA, 15 nt, Homo sapiens
cuuuuaaacuggaaa

SEQ ID NO: 676546 - RNA, 23 nt, Homo sapiens
cuuuuaaagaaaaauaugauacu

SEQ ID NO: 676547 - RNA, 16 nt, Homo sapiens
cuuuuaagcagucuca

SEQ ID NO: 676548 - RNA, 22 nt, Homo sapiens
cuuuuaauguauuuguuugcaa

SEQ ID NO: 676549 - RNA, 22 nt, Homo sapiens
cuuuuaaugucauuuguuaaaa

SEQ ID NO: 676550 - RNA, 20 nt, Homo sapiens
cuuuuaaugugaggaacuca

SEQ ID NO: 676551 - RNA, 13 nt, Homo sapiens
cuuuuaauucaaa

SEQ ID NO: 676552 - RNA, 23 nt, Homo sapiens
cuuuuacaaaaaaguaaccugaa

SEQ ID NO: 676553 - RNA, 17 nt, Homo sapiens
cuuuuacagcucuuggc

SEQ ID NO: 676554 - RNA, 17 nt, Homo sapiens
cuuuuacucugccuaca

SEQ ID NO: 676555 - RNA, 22 nt, Homo sapiens
cuuuuagaaaaugcagucauuu

SEQ ID NO: 676556 - RNA, 19 nt, Homo sapiens
cuuuuauaaugauucauaa

SEQ ID NO: 676557 - RNA, 23 nt, Homo sapiens
cuuuuauaggugagaaaaaaaca

SEQ ID NO: 676558 - RNA, 13 nt, Homo sapiens
cuuuuauauucua

SEQ ID NO: 676559 - RNA, 21 nt, Homo sapiens
cuuuuaugauauauauaugcu

SEQ ID NO: 676560 - RNA, 19 nt, Homo sapiens
cuuuuauuaaugcacuuuc

SEQ ID NO: 676561 - RNA, 13 nt, Homo sapiens
cuuuucaaaagaa

SEQ ID NO: 676562 - RNA, 14 nt, Homo sapiens
cuuuucaagcugcu

SEQ ID NO: 676563 - RNA, 15 nt, Homo sapiens
cuuuucaaguuuccc

SEQ ID NO: 676564 - RNA, 17 nt, Homo sapiens
cuuuucaaguuucccca

SEQ ID NO: 676565 - RNA, 14 nt, Homo sapiens
cuuuucaaugugug

SEQ ID NO: 676566 - RNA, 19 nt, Homo sapiens
cuuuucaauguuagccaca

SEQ ID NO: 676567 - RNA, 13 nt, Homo sapiens
cuuuucacacugu

SEQ ID NO: 676568 - RNA, 14 nt, Homo sapiens
cuuuucaccaauga

SEQ ID NO: 676569 - RNA, 18 nt, Homo sapiens
cuuuucagaagcaagcca

SEQ ID NO: 676570 - RNA, 20 nt, Homo sapiens
cuuuucagaagcaagccaga

SEQ ID NO: 676571 - RNA, 23 nt, Homo sapiens
cuuuucagcgauguaugcagcua

SEQ ID NO: 676572 - RNA, 15 nt, Homo sapiens
cuuuucagcugaggu

SEQ ID NO: 676573 - RNA, 22 nt, Homo sapiens
cuuuucaggguuuucugaggga

SEQ ID NO: 676574 - RNA, 18 nt, Homo sapiens
cuuuucauagugcucaga

SEQ ID NO: 676575 - RNA, 15 nt, Homo sapiens
cuuuucaugauuuua

SEQ ID NO: 676576 - RNA, 12 nt, Homo sapiens
cuuuucauuuaa

SEQ ID NO: 676577 - RNA, 16 nt, Homo sapiens
cuuuucauuuggaaug

SEQ ID NO: 676578 - RNA, 15 nt, Homo sapiens
cuuuuccacuuuaaa

SEQ ID NO: 676579 - RNA, 12 nt, Homo sapiens
cauuauuccucc

SEQ ID NO: 676580 - RNA, 19 nt, Homo sapiens
cauuauuuguaauagccaa

SEQ ID NO: 676581 - RNA, 22 nt, Homo sapiens
cauuauuuucugucagaugaga

SEQ ID NO: 676582 - RNA, 17 nt, Homo sapiens
cauuauuuugaauguga

SEQ ID NO: 676583 - RNA, 18 nt, Homo sapiens
cauucaauguuuaugcaa

SEQ ID NO: 676584 - RNA, 22 nt, Homo sapiens
cauucaauguuuaugcaaggaa

SEQ ID NO: 676585 - RNA, 14 nt, Homo sapiens
cauucacagcccag

SEQ ID NO: 676586 - RNA, 20 nt, Homo sapiens
cauucacagcccagaaccac

SEQ ID NO: 676587 - RNA, 21 nt, Homo sapiens
cauucacauuugauguacaug

SEQ ID NO: 676588 - RNA, 18 nt, Homo sapiens
cauucaccuuagugcaac

SEQ ID NO: 676589 - RNA, 16 nt, Homo sapiens
cauucagagacugccc

SEQ ID NO: 676590 - RNA, 17 nt, Homo sapiens
cauucagagagcagcuu

SEQ ID NO: 676591 - RNA, 18 nt, Homo sapiens
cauucaggcagcacugac

SEQ ID NO: 676592 - RNA, 13 nt, Homo sapiens
cauucaguauuaa

SEQ ID NO: 676593 - RNA, 19 nt, Homo sapiens
cauucaguuguuuugcaua

SEQ ID NO: 676594 - RNA, 18 nt, Homo sapiens
cauucaucacuccaaaaa

SEQ ID NO: 676595 - RNA, 11 nt, Homo sapiens
cauucaucuug

SEQ ID NO: 676596 - RNA, 17 nt, Homo sapiens
cauucaugugggcauuu

SEQ ID NO: 676597 - RNA, 19 nt, Homo sapiens
cauucaugugggcauuucu

SEQ ID NO: 676598 - RNA, 17 nt, Homo sapiens
cauuccaacuucaauuu

SEQ ID NO: 676599 - RNA, 12 nt, Homo sapiens
cauuccaggaaa

SEQ ID NO: 676600 - RNA, 13 nt, Homo sapiens
cauuccaggaaac

SEQ ID NO: 676601 - RNA, 22 nt, Homo sapiens
cauuccaggaccagaagcauuu

SEQ ID NO: 676602 - RNA, 19 nt, Homo sapiens
cauuccauugccuagcucu

SEQ ID NO: 676603 - RNA, 15 nt, Homo sapiens
cauucccagugguca

SEQ ID NO: 676604 - RNA, 21 nt, Homo sapiens
cauucccguggaacguuuuuc

SEQ ID NO: 676605 - RNA, 16 nt, Homo sapiens
cauucccucuccugcc

SEQ ID NO: 676606 - RNA, 11 nt, Homo sapiens
cauucccugag

SEQ ID NO: 676607 - RNA, 17 nt, Homo sapiens
cauuccuuacuugcacu

SEQ ID NO: 676608 - RNA, 21 nt, Homo sapiens
cauuccuuacuugcacuguua

SEQ ID NO: 676609 - RNA, 16 nt, Homo sapiens
cauuccuuugucuuca

SEQ ID NO: 676610 - RNA, 20 nt, Homo sapiens
cauuccuuuuucuucacuua

SEQ ID NO: 676611 - RNA, 16 nt, Homo sapiens
cauucgcuacuaugau

SEQ ID NO: 676612 - RNA, 13 nt, Homo sapiens
cauucgucaucac

SEQ ID NO: 676613 - RNA, 17 nt, Homo sapiens
cauucuagauuacuuuu

SEQ ID NO: 676614 - RNA, 15 nt, Homo sapiens
cauucuauuuuagaa

SEQ ID NO: 676615 - RNA, 16 nt, Homo sapiens
cauucucaaagccucu

SEQ ID NO: 676616 - RNA, 17 nt, Homo sapiens
cauucucaauacuugaa

SEQ ID NO: 676617 - RNA, 20 nt, Homo sapiens
cauucuccucaugcuuagaa

SEQ ID NO: 676618 - RNA, 11 nt, Homo sapiens
cauucucucau

SEQ ID NO: 676619 - RNA, 15 nt, Homo sapiens
cauucucuuguuauu

SEQ ID NO: 676620 - RNA, 14 nt, Homo sapiens
cauucugaaucaga

SEQ ID NO: 676621 - RNA, 11 nt, Homo sapiens
cauucugacca

SEQ ID NO: 676622 - RNA, 15 nt, Homo sapiens
cauucugcaccucuu

SEQ ID NO: 676623 - RNA, 21 nt, Homo sapiens
cauucugcaccucuuggcucg

SEQ ID NO: 676624 - RNA, 18 nt, Homo sapiens
cauucugcauugcuagau

SEQ ID NO: 676625 - RNA, 23 nt, Homo sapiens
cauucugccgcccccuccugaac

SEQ ID NO: 676626 - RNA, 14 nt, Homo sapiens
cauucugcuacuuc

SEQ ID NO: 676627 - RNA, 21 nt, Homo sapiens
cauucuguuuaucaagccaua

SEQ ID NO: 676628 - RNA, 19 nt, Homo sapiens
cauucuuaaauauuuccau

SEQ ID NO: 676629 - RNA, 16 nt, Homo sapiens
cauucuuaacaaacuc

SEQ ID NO: 676630 - RNA, 23 nt, Homo sapiens
cauucuuauuaauucuucaccug

SEQ ID NO: 676631 - RNA, 20 nt, Homo sapiens
cauucuucagacaucaguca

SEQ ID NO: 676632 - RNA, 11 nt, Homo sapiens
cauucuucagu

SEQ ID NO: 676633 - RNA, 11 nt, Homo sapiens
cauucuucccg

SEQ ID NO: 676634 - RNA, 17 nt, Homo sapiens
cauucuuguucagauua

SEQ ID NO: 676635 - RNA, 23 nt, Homo sapiens
cauucuuguuuuaagugccuuua

SEQ ID NO: 676636 - RNA, 12 nt, Homo sapiens
cauucuuuuaua

SEQ ID NO: 676637 - RNA, 12 nt, Homo sapiens
cauucuuuugca

SEQ ID NO: 676638 - RNA, 19 nt, Homo sapiens
cauucuuuuucuguugaaa

SEQ ID NO: 676639 - RNA, 15 nt, Homo sapiens
cauugaaagugaaau

SEQ ID NO: 676640 - RNA, 21 nt, Homo sapiens
cauugaaaucagcaugacaaa

SEQ ID NO: 676641 - RNA, 18 nt, Homo sapiens
cauugaaguaaugaauuu

SEQ ID NO: 676642 - RNA, 23 nt, Homo sapiens
cauugaccgcgacuaauuucaaa

SEQ ID NO: 676643 - RNA, 14 nt, Homo sapiens
cauugagcauuuga

SEQ ID NO: 676644 - RNA, 22 nt, Homo sapiens
cauugaucauuuuuauaugaaa

SEQ ID NO: 676645 - RNA, 18 nt, Homo sapiens
cauugaucuuuugcuaau

SEQ ID NO: 676646 - RNA, 22 nt, Homo sapiens
cauugaucuuuugcuaaugcaa

SEQ ID NO: 676647 - RNA, 20 nt, Homo sapiens
cauugauguaaggacuguaa

SEQ ID NO: 676648 - RNA, 21 nt, Homo sapiens
cauugauguaauuuaaaacuu

SEQ ID NO: 676649 - RNA, 18 nt, Homo sapiens
cauugauuugcucuuacu

SEQ ID NO: 676650 - RNA, 19 nt, Homo sapiens
cauugauuugcucuuacua

SEQ ID NO: 676651 - RNA, 22 nt, Homo sapiens
cauugcaagcuucuuuuaguug

SEQ ID NO: 676652 - RNA, 11 nt, Homo sapiens
cauugcacaug

SEQ ID NO: 676653 - RNA, 16 nt, Homo sapiens
cauugcacuccagcug

SEQ ID NO: 676654 - RNA, 18 nt, Homo sapiens
cauugcacucuagccugg

SEQ ID NO: 676655 - RNA, 22 nt, Homo sapiens
cauugcacuuuauaaacacugu

SEQ ID NO: 676656 - RNA, 18 nt, Homo sapiens
cauugccaauuagacaaa

SEQ ID NO: 676657 - RNA, 15 nt, Homo sapiens
cauugccaugaauuu

SEQ ID NO: 676658 - RNA, 20 nt, Homo sapiens
cauugcgucggaaagccaag

SEQ ID NO: 676659 - RNA, 17 nt, Homo sapiens
cauugcuaaacugauga

SEQ ID NO: 676660 - RNA, 20 nt, Homo sapiens
cauugcuguaccacaucugc

SEQ ID NO: 676661 - RNA, 19 nt, Homo sapiens
cauugcugucuugccccag

SEQ ID NO: 676662 - RNA, 15 nt, Homo sapiens
cauugcuuaugacau

SEQ ID NO: 676663 - RNA, 17 nt, Homo sapiens
cauugcuugugccacac

SEQ ID NO: 676664 - RNA, 12 nt, Homo sapiens
cauugcuuugcc

SEQ ID NO: 676665 - RNA, 20 nt, Homo sapiens
cauuggaauucuacuggaaa

SEQ ID NO: 676666 - RNA, 19 nt, Homo sapiens
cauuggaccuguucaaaaa

SEQ ID NO: 676667 - RNA, 20 nt, Homo sapiens
gaaaacauagcaucucagga

SEQ ID NO: 676668 - RNA, 15 nt, Homo sapiens
gaaaacaucucauca

SEQ ID NO: 676669 - RNA, 14 nt, Homo sapiens
gaaaacaucuggaa

SEQ ID NO: 676670 - RNA, 12 nt, Homo sapiens
gaaaacauugca

SEQ ID NO: 676671 - RNA, 15 nt, Homo sapiens
gaaaacauugcuuug

SEQ ID NO: 676672 - RNA, 18 nt, Homo sapiens
gaaaacuagcauuacauu

SEQ ID NO: 676673 - RNA, 19 nt, Homo sapiens
gaaaacuagcauuacauua

SEQ ID NO: 676674 - RNA, 16 nt, Homo sapiens
gaaaacucaaccagag

SEQ ID NO: 676675 - RNA, 16 nt, Homo sapiens
gaaaacucccaauaca

SEQ ID NO: 676676 - RNA, 20 nt, Homo sapiens
gaaaacucccaauacaaaga

SEQ ID NO: 676677 - RNA, 19 nt, Homo sapiens
gaaaacuuagagagguaca

SEQ ID NO: 676678 - RNA, 21 nt, Homo sapiens
gaaaacuuugaggaacauuca

SEQ ID NO: 676679 - RNA, 15 nt, Homo sapiens
gaaaagaaaccagag

SEQ ID NO: 676680 - RNA, 23 nt, Homo sapiens
gaaaagaaagaaguuauuuucca

SEQ ID NO: 676681 - RNA, 20 nt, Homo sapiens
gaaaagaaauugcaugcagu

SEQ ID NO: 676682 - RNA, 14 nt, Homo sapiens
gaaaagaagacucu

SEQ ID NO: 676683 - RNA, 16 nt, Homo sapiens
gaaaagaagacucuga

SEQ ID NO: 676684 - RNA, 23 nt, Homo sapiens
gaaaagaagacucugaccuguac

SEQ ID NO: 676685 - RNA, 19 nt, Homo sapiens
gaaaagaccaguccaugag

SEQ ID NO: 676686 - RNA, 22 nt, Homo sapiens
gaaaagaccuacagacuaagaa

SEQ ID NO: 676687 - RNA, 23 nt, Homo sapiens
gaaaagauucccacccaauucaa

SEQ ID NO: 676688 - RNA, 13 nt, Homo sapiens
gaaaagcauguua

SEQ ID NO: 676689 - RNA, 13 nt, Homo sapiens
gaaaagccagcuu

SEQ ID NO: 676690 - RNA, 17 nt, Homo sapiens
gaaaagcccccaguuaa

SEQ ID NO: 676691 - RNA, 23 nt, Homo sapiens
gaaaagcugaugaggcuggugac

SEQ ID NO: 676692 - RNA, 18 nt, Homo sapiens
gaaaagcugccauuuccc

SEQ ID NO: 676693 - RNA, 13 nt, Homo sapiens
gaaaagcuuuccu

SEQ ID NO: 676694 - RNA, 18 nt, Homo sapiens
gaaaaggacuucuggcua

SEQ ID NO: 676695 - RNA, 16 nt, Homo sapiens
gaaaagggcugacauu

SEQ ID NO: 676696 - RNA, 17 nt, Homo sapiens
gaaaagguccuugccuc

SEQ ID NO: 676697 - RNA, 23 nt, Homo sapiens
gaaaagguuguuguuaaugaaua

SEQ ID NO: 676698 - RNA, 19 nt, Homo sapiens
gaaaaguaaguuuuguuaa

SEQ ID NO: 676699 - RNA, 18 nt, Homo sapiens
gaaaaguccacauaaccc

SEQ ID NO: 676700 - RNA, 13 nt, Homo sapiens
gaaaagugaaucu

SEQ ID NO: 676701 - RNA, 19 nt, Homo sapiens
gaaaaguguccuucuugcu

SEQ ID NO: 676702 - RNA, 13 nt, Homo sapiens
cauuuaccaaauu

SEQ ID NO: 676703 - RNA, 12 nt, Homo sapiens
cauuuacuuaac

SEQ ID NO: 676704 - RNA, 22 nt, Homo sapiens
cauuuagaaaauagagcuuuua

SEQ ID NO: 676705 - RNA, 13 nt, Homo sapiens
cauuuagaacuug

SEQ ID NO: 676706 - RNA, 18 nt, Homo sapiens
cauuuagaacuugcagcu

SEQ ID NO: 676707 - RNA, 16 nt, Homo sapiens
cauuuaggaguauuau

SEQ ID NO: 676708 - RNA, 16 nt, Homo sapiens
cauuuagucaugugac

SEQ ID NO: 676709 - RNA, 17 nt, Homo sapiens
cauuuagucaugugacc

SEQ ID NO: 676710 - RNA, 22 nt, Homo sapiens
cauuuauaaccccagccugacc

SEQ ID NO: 676711 - RNA, 13 nt, Homo sapiens
cauuuauagcaua

SEQ ID NO: 676712 - RNA, 15 nt, Homo sapiens
cauuuauauauugaa

SEQ ID NO: 676713 - RNA, 15 nt, Homo sapiens
cauuuauuauuucaa

SEQ ID NO: 676714 - RNA, 20 nt, Homo sapiens
cauuuauucaaaguuaaaag

SEQ ID NO: 676715 - RNA, 22 nt, Homo sapiens
cauuucaaaauuaauagcuuuu

SEQ ID NO: 676716 - RNA, 13 nt, Homo sapiens
cauuucaaugugu

SEQ ID NO: 676717 - RNA, 23 nt, Homo sapiens
cauuucaauuagggaugcucaaa

SEQ ID NO: 676718 - RNA, 15 nt, Homo sapiens
cauuucacgaacugu

SEQ ID NO: 676719 - RNA, 18 nt, Homo sapiens
cauuucacgaacuguuca

SEQ ID NO: 676720 - RNA, 21 nt, Homo sapiens
cauuucacuauguuacaugua

SEQ ID NO: 676721 - RNA, 18 nt, Homo sapiens
cauuucacugaugcuucu

SEQ ID NO: 676722 - RNA, 23 nt, Homo sapiens
cauuucagagaggccuuuuggaa

SEQ ID NO: 676723 - RNA, 19 nt, Homo sapiens
cauuucaggacauuuggaa

SEQ ID NO: 676724 - RNA, 16 nt, Homo sapiens
cauuucaggugugaga

SEQ ID NO: 676725 - RNA, 21 nt, Homo sapiens
cauuucaggugugagauguaa

SEQ ID NO: 676726 - RNA, 21 nt, Homo sapiens
cauuucaucguggcuguuucu

SEQ ID NO: 676727 - RNA, 20 nt, Homo sapiens
cauuucaucuggguggucug

SEQ ID NO: 676728 - RNA, 20 nt, Homo sapiens
cauuucauuaagguuccagu

SEQ ID NO: 676729 - RNA, 12 nt, Homo sapiens
cauuuccagagc

SEQ ID NO: 676730 - RNA, 15 nt, Homo sapiens
cauuuccaugcauaa

SEQ ID NO: 676731 - RNA, 17 nt, Homo sapiens
cauuuccaugcauaaau

SEQ ID NO: 676732 - RNA, 14 nt, Homo sapiens
cauuucccacaucu

SEQ ID NO: 676733 - RNA, 20 nt, Homo sapiens
cauuuccucuguucuuuuca

SEQ ID NO: 676734 - RNA, 14 nt, Homo sapiens
cauuuccuguguuu

SEQ ID NO: 676735 - RNA, 18 nt, Homo sapiens
cauuucuacugugacuga

SEQ ID NO: 676736 - RNA, 22 nt, Homo sapiens
cauuucuacuuuuugcaccuua

SEQ ID NO: 676737 - RNA, 16 nt, Homo sapiens
cauuucuauagccaaa

SEQ ID NO: 676738 - RNA, 21 nt, Homo sapiens
cauuucuauuuauuuacugag

SEQ ID NO: 676739 - RNA, 17 nt, Homo sapiens
cauuucugaugucucca

SEQ ID NO: 676740 - RNA, 13 nt, Homo sapiens
cauuucugccaug

SEQ ID NO: 676741 - RNA, 22 nt, Homo sapiens
cauuucuggaaagugcaauuau

SEQ ID NO: 676742 - RNA, 20 nt, Homo sapiens
cauuucuggacaguaccuga

SEQ ID NO: 676743 - RNA, 17 nt, Homo sapiens
cauuucuggacaugacg

SEQ ID NO: 676744 - RNA, 15 nt, Homo sapiens
cauuucugucuccag

SEQ ID NO: 676745 - RNA, 17 nt, Homo sapiens
cauuugaaccagugauc

SEQ ID NO: 676746 - RNA, 20 nt, Homo sapiens
cauuugaagaggagaacaaa

SEQ ID NO: 676747 - RNA, 23 nt, Homo sapiens
cauuugagaaguggcuugacaau

SEQ ID NO: 676748 - RNA, 18 nt, Homo sapiens
cauuugagauaaagucaa

SEQ ID NO: 676749 - RNA, 16 nt, Homo sapiens
cauuugcaccuaccuc

SEQ ID NO: 676750 - RNA, 14 nt, Homo sapiens
cauuugcagagucc

SEQ ID NO: 676751 - RNA, 14 nt, Homo sapiens
cauuugccaaguga

SEQ ID NO: 676752 - RNA, 19 nt, Homo sapiens
cauuugcgaaugguuccau

SEQ ID NO: 676753 - RNA, 16 nt, Homo sapiens
cauuugcuaguucugc

SEQ ID NO: 676754 - RNA, 19 nt, Homo sapiens
cauuugcucuuucaucucu

SEQ ID NO: 676755 - RNA, 23 nt, Homo sapiens
cauuugcugaauagcuacuauau

SEQ ID NO: 676756 - RNA, 21 nt, Homo sapiens
cauuuggaccaauagcccaca

SEQ ID NO: 676757 - RNA, 16 nt, Homo sapiens
cauuuggcaaugccau

SEQ ID NO: 676758 - RNA, 20 nt, Homo sapiens
cauuugggagacaugugaca

SEQ ID NO: 676759 - RNA, 20 nt, Homo sapiens
cauuugggugaacuguggac

SEQ ID NO: 676760 - RNA, 15 nt, Homo sapiens
cauuuggugacugug

SEQ ID NO: 676761 - RNA, 21 nt, Homo sapiens
cauuuggugguacuuuauucu

SEQ ID NO: 676762 - RNA, 19 nt, Homo sapiens
cauuugguguggauuuucu

SEQ ID NO: 676763 - RNA, 21 nt, Homo sapiens
cauuuguaugucaaagcuuug

SEQ ID NO: 676764 - RNA, 12 nt, Homo sapiens
cauuugucacag

SEQ ID NO: 676765 - RNA, 21 nt, Homo sapiens
cauuugucaguauuuuugccg

SEQ ID NO: 676766 - RNA, 23 nt, Homo sapiens
cauuugugggucuguguggcagg

SEQ ID NO: 676767 - RNA, 18 nt, Homo sapiens
cauuugugugugugcaag

SEQ ID NO: 676768 - RNA, 23 nt, Homo sapiens
cauuugugugugugcaagugugu

SEQ ID NO: 676769 - RNA, 16 nt, Homo sapiens
cauuuguuaaaauaca

SEQ ID NO: 676770 - RNA, 12 nt, Homo sapiens
cauuuguucuca

SEQ ID NO: 676771 - RNA, 23 nt, Homo sapiens
cauuuguuuaaauucacaucuca

SEQ ID NO: 676772 - RNA, 13 nt, Homo sapiens
cauuuuaaaaaca

SEQ ID NO: 676773 - RNA, 19 nt, Homo sapiens
cauuuuacucuuaugauca

SEQ ID NO: 676774 - RNA, 21 nt, Homo sapiens
cauuuuacucuuaugaucaau

SEQ ID NO: 676775 - RNA, 18 nt, Homo sapiens
cauuuuagaaacuacaaa

SEQ ID NO: 676776 - RNA, 16 nt, Homo sapiens
cauuuuagaacagagg

SEQ ID NO: 676777 - RNA, 17 nt, Homo sapiens
cauuuuaugucauuaaa

SEQ ID NO: 676778 - RNA, 17 nt, Homo sapiens
cauuuuauguuaaggga

SEQ ID NO: 676779 - RNA, 17 nt, Homo sapiens
cauuuuauuaagcuuuu

SEQ ID NO: 676780 - RNA, 22 nt, Homo sapiens
cauuuuauuuuuucuugcaaau

SEQ ID NO: 676781 - RNA, 21 nt, Homo sapiens
cauuuucagaccaugaaugaa

SEQ ID NO: 676782 - RNA, 20 nt, Homo sapiens
cauuuucccccacuacugca

SEQ ID NO: 676783 - RNA, 17 nt, Homo sapiens
cauuuucuucacagugc

SEQ ID NO: 676784 - RNA, 14 nt, Homo sapiens
cauuuucuucagaa

SEQ ID NO: 676785 - RNA, 13 nt, Homo sapiens
cauuuucuucucu

SEQ ID NO: 676786 - RNA, 17 nt, Homo sapiens
cauuuugacagcaucuu

SEQ ID NO: 676787 - RNA, 13 nt, Homo sapiens
cauuuugcaaaau

SEQ ID NO: 676788 - RNA, 16 nt, Homo sapiens
gaaauggccacuacuu

SEQ ID NO: 676789 - RNA, 15 nt, Homo sapiens
gaaaugguacugccc

SEQ ID NO: 676790 - RNA, 15 nt, Homo sapiens
gaaaugguacuucau

SEQ ID NO: 676791 - RNA, 16 nt, Homo sapiens
gaaauguaaacugcca

SEQ ID NO: 676792 - RNA, 18 nt, Homo sapiens
gaaauguaauacuggaau

SEQ ID NO: 676793 - RNA, 19 nt, Homo sapiens
gaaauguaccggcuuccau

SEQ ID NO: 676794 - RNA, 14 nt, Homo sapiens
gaaauguaugugcu

SEQ ID NO: 676795 - RNA, 19 nt, Homo sapiens
gaaaugugcaaccacugcu

SEQ ID NO: 676796 - RNA, 22 nt, Homo sapiens
gaaaugugguagccucacuuuu

SEQ ID NO: 676797 - RNA, 13 nt, Homo sapiens
gaaauguuagguu

SEQ ID NO: 676798 - RNA, 21 nt, Homo sapiens
gaaauguucucaugaacuacc

SEQ ID NO: 676799 - RNA, 14 nt, Homo sapiens
gaaauuaauuugug

SEQ ID NO: 676800 - RNA, 17 nt, Homo sapiens
gaaauuaauuugugaau

SEQ ID NO: 676801 - RNA, 13 nt, Homo sapiens
gaaauuacugugu

SEQ ID NO: 676802 - RNA, 21 nt, Homo sapiens
gaaauuagguugaaacauauc

SEQ ID NO: 676803 - RNA, 13 nt, Homo sapiens
gaaauuccaggaa

SEQ ID NO: 676804 - RNA, 20 nt, Homo sapiens
gaaauuccauacuucucuca

SEQ ID NO: 676805 - RNA, 19 nt, Homo sapiens
gaaauucucaucaguccau

SEQ ID NO: 676806 - RNA, 14 nt, Homo sapiens
gaaauucugaugag

SEQ ID NO: 676807 - RNA, 14 nt, Homo sapiens
gaaauucuuuccca

SEQ ID NO: 676808 - RNA, 18 nt, Homo sapiens
gaaauugaagugucuucu

SEQ ID NO: 676809 - RNA, 16 nt, Homo sapiens
gaaauugacagaucaa

SEQ ID NO: 676810 - RNA, 15 nt, Homo sapiens
gaaauugaccauaca

SEQ ID NO: 676811 - RNA, 15 nt, Homo sapiens
gaaauuguaucucag

SEQ ID NO: 676812 - RNA, 18 nt, Homo sapiens
gaaauuuugccugccauu

SEQ ID NO: 676813 - RNA, 19 nt, Homo sapiens
gaaauuuugccugccauuu

SEQ ID NO: 676814 - RNA, 19 nt, Homo sapiens
gaaauuuuggugaaugugg

SEQ ID NO: 676815 - RNA, 21 nt, Homo sapiens
gaaauuuuguaagaaggcaau

SEQ ID NO: 676816 - RNA, 22 nt, Homo sapiens
gaaauuuuuguguaaaauaagg

SEQ ID NO: 676817 - RNA, 21 nt, Homo sapiens
gaacaaaaagaaaucuugucu

SEQ ID NO: 676818 - RNA, 16 nt, Homo sapiens
gaacaaaaauguuucc

SEQ ID NO: 676819 - RNA, 14 nt, Homo sapiens
gaacaaacaaugaa

SEQ ID NO: 676820 - RNA, 15 nt, Homo sapiens
gaacaaacacugcag

SEQ ID NO: 676821 - RNA, 22 nt, Homo sapiens
gaacaaacuaugaucacaguga

SEQ ID NO: 676822 - RNA, 21 nt, Homo sapiens
gaacaaagugcuagacuuucu

SEQ ID NO: 676823 - RNA, 11 nt, Homo sapiens
gaacaaaucag

SEQ ID NO: 676824 - RNA, 12 nt, Homo sapiens
gaacaaaucagc

SEQ ID NO: 676825 - RNA, 22 nt, Homo sapiens
gaacaacuaggcuucagcauau

SEQ ID NO: 676826 - RNA, 18 nt, Homo sapiens
gaacaacuccaaaaccca

SEQ ID NO: 676827 - RNA, 20 nt, Homo sapiens
gaacaacuuguagcagcuau

SEQ ID NO: 676828 - RNA, 19 nt, Homo sapiens
gaacaaguuguuucauuga

SEQ ID NO: 676829 - RNA, 18 nt, Homo sapiens
gaacaauaaaaugucuuc

SEQ ID NO: 676830 - RNA, 14 nt, Homo sapiens
gaacaaugcuauaa

SEQ ID NO: 676831 - RNA, 19 nt, Homo sapiens
gaacaaugggaggcuguga

SEQ ID NO: 676832 - RNA, 17 nt, Homo sapiens
gaacacaaaugaaaaug

SEQ ID NO: 676833 - RNA, 18 nt, Homo sapiens
gaacacagcaugugccaa

SEQ ID NO: 676834 - RNA, 18 nt, Homo sapiens
gaacacagugucuguuca

SEQ ID NO: 676835 - RNA, 19 nt, Homo sapiens
gaacacaugugcagucacu

SEQ ID NO: 676836 - RNA, 19 nt, Homo sapiens
gaacacuaacucaccagcc

SEQ ID NO: 676837 - RNA, 12 nt, Homo sapiens
gaacacugcacu

SEQ ID NO: 676838 - RNA, 21 nt, Homo sapiens
gaacacuggcaacaacaaagc

SEQ ID NO: 676839 - RNA, 12 nt, Homo sapiens
gaacacuggggg

SEQ ID NO: 676840 - RNA, 20 nt, Homo sapiens
gaacacugggggaggggaca

SEQ ID NO: 676841 - RNA, 24 nt, Homo sapiens
gaacacuuauguuauacaauacag

SEQ ID NO: 676842 - RNA, 13 nt, Homo sapiens
gaacagaaggaug

SEQ ID NO: 676843 - RNA, 23 nt, Homo sapiens
gaacagaauguuuuacugugaaa

SEQ ID NO: 676844 - RNA, 22 nt, Homo sapiens
gaacagcgggagaccugugcua

SEQ ID NO: 676845 - RNA, 23 nt, Homo sapiens
gaacagcgggagaccugugcuag

SEQ ID NO: 676846 - RNA, 17 nt, Homo sapiens
gaacagcuguaaucuau

SEQ ID NO: 676847 - RNA, 19 nt, Homo sapiens
gaacagcugugucugccaa

SEQ ID NO: 676848 - RNA, 13 nt, Homo sapiens
gaacaggcugugu

SEQ ID NO: 676849 - RNA, 14 nt, Homo sapiens
gaacaggugguggu

SEQ ID NO: 676850 - RNA, 17 nt, Homo sapiens
gaacaguaugaauuuga

SEQ ID NO: 676851 - RNA, 12 nt, Homo sapiens
gaacagugccca

SEQ ID NO: 676852 - RNA, 17 nt, Homo sapiens
gaacaguuucaucagga

SEQ ID NO: 676853 - RNA, 15 nt, Homo sapiens
gaacauaaagcaaau

SEQ ID NO: 676854 - RNA, 19 nt, Homo sapiens
gaacauaaguaaucacuaa

SEQ ID NO: 676855 - RNA, 13 nt, Homo sapiens
gaacauacacugu

SEQ ID NO: 676856 - RNA, 16 nt, Homo sapiens
gaacauacacugugaa

SEQ ID NO: 676857 - RNA, 20 nt, Homo sapiens
gaacauacacugugaacuca

SEQ ID NO: 676858 - RNA, 16 nt, Homo sapiens
gaacauagaacucugg

SEQ ID NO: 676859 - RNA, 20 nt, Homo sapiens
gaacauauggaaaguauuag

SEQ ID NO: 676860 - RNA, 19 nt, Homo sapiens
gaacaucauaacccaugaa

SEQ ID NO: 676861 - RNA, 17 nt, Homo sapiens
gaacauccaaccuuccc

SEQ ID NO: 676862 - RNA, 21 nt, Homo sapiens
gaacaucuaaaagaugaaguu

SEQ ID NO: 676863 - RNA, 20 nt, Homo sapiens
gaacaucucugcuuucacuc

SEQ ID NO: 676864 - RNA, 21 nt, Homo sapiens
gaacaugauuuuacaaguaua

SEQ ID NO: 676865 - RNA, 16 nt, Homo sapiens
gaacaugcacauuuau

SEQ ID NO: 676866 - RNA, 20 nt, Homo sapiens
gaacaugcccccugcagaca

SEQ ID NO: 676867 - RNA, 17 nt, Homo sapiens
gaacauuaaauagcaaa

SEQ ID NO: 676868 - RNA, 19 nt, Homo sapiens
gaacauuuuaauucauccc

SEQ ID NO: 676869 - RNA, 19 nt, Homo sapiens
gaaccaaaagaauuugcac

SEQ ID NO: 676870 - RNA, 18 nt, Homo sapiens
gaaccaaaagagaucaca

SEQ ID NO: 676871 - RNA, 10 nt, Homo sapiens
gaaccaaaga

SEQ ID NO: 676872 - RNA, 20 nt, Homo sapiens
gaaccaaaucuggaagccaa

SEQ ID NO: 676873 - RNA, 13 nt, Homo sapiens
gaaccaacaucuu

SEQ ID NO: 676874 - RNA, 14 nt, Homo sapiens
gaaccaauaaugua

SEQ ID NO: 676875 - RNA, 21 nt, Homo sapiens
gaaccacaccacaucuaagcc

SEQ ID NO: 676876 - RNA, 12 nt, Homo sapiens
gaaccacuccca

SEQ ID NO: 676877 - RNA, 21 nt, Homo sapiens
gaaccacucccaccacaggca

SEQ ID NO: 676878 - RNA, 21 nt, Homo sapiens
gaaccacucuaucaaguauua

SEQ ID NO: 676879 - RNA, 21 nt, Homo sapiens
gaaccagagccauggacucua

SEQ ID NO: 676880 - RNA, 21 nt, Homo sapiens
gaaccagcuucugauaaacac

SEQ ID NO: 676881 - RNA, 15 nt, Homo sapiens
gaaccaggaggacaa

SEQ ID NO: 676882 - RNA, 17 nt, Homo sapiens
gaaccagggcucuucuc

SEQ ID NO: 676883 - RNA, 17 nt, Homo sapiens
gaaccaguuaagagaca

SEQ ID NO: 676884 - RNA, 16 nt, Homo sapiens
gaaccauuuacaugca

SEQ ID NO: 676885 - RNA, 19 nt, Homo sapiens
gaaccauuugggauggaga

SEQ ID NO: 676886 - RNA, 22 nt, Homo sapiens
gaacccaagcuuagaacuuuaa

SEQ ID NO: 676887 - RNA, 19 nt, Homo sapiens
gaacccaucgguaggcaaa

SEQ ID NO: 676888 - RNA, 18 nt, Homo sapiens
gaacccgaggcugagaau

SEQ ID NO: 676889 - RNA, 23 nt, Homo sapiens
gaacccgggagguggagauugca

SEQ ID NO: 676890 - RNA, 12 nt, Homo sapiens
gaacccucaggc

SEQ ID NO: 676891 - RNA, 17 nt, Homo sapiens
gaacccuccuccuguca

SEQ ID NO: 676892 - RNA, 21 nt, Homo sapiens
gaacccugcuugcacuuugua

SEQ ID NO: 676893 - RNA, 22 nt, Homo sapiens
gaacccuuggagccaauggaga

SEQ ID NO: 676894 - RNA, 17 nt, Homo sapiens
gaacccuuugggagcaa

SEQ ID NO: 676895 - RNA, 21 nt, Homo sapiens
gaaccgagcaauuuucugcua

SEQ ID NO: 676896 - RNA, 23 nt, Homo sapiens
gaaccgugguaugucugccaugu

SEQ ID NO: 676897 - RNA, 12 nt, Homo sapiens
gaaccucuccau

SEQ ID NO: 676898 - RNA, 18 nt, Homo sapiens
gaaccucucguaguccau

SEQ ID NO: 676899 - RNA, 18 nt, Homo sapiens
gaaccugcccugcuccca

SEQ ID NO: 676900 - RNA, 21 nt, Homo sapiens
gaaccugcccugcucccacag

SEQ ID NO: 676901 - RNA, 13 nt, Homo sapiens
gaaccuggagcca

SEQ ID NO: 676902 - RNA, 22 nt, Homo sapiens
gaaccuggauccagcacuggug

SEQ ID NO: 676903 - RNA, 16 nt, Homo sapiens
gaaccuguccuaagga

SEQ ID NO: 676904 - RNA, 20 nt, Homo sapiens
gaaccugugcucauuuugca

SEQ ID NO: 676905 - RNA, 19 nt, Homo sapiens
gaacgcgacuuccacaaac

SEQ ID NO: 676906 - RNA, 16 nt, Homo sapiens
gaacgcuaucugggaa

SEQ ID NO: 676907 - RNA, 20 nt, Homo sapiens
gaacgcuuguaauuggaaua

SEQ ID NO: 676908 - RNA, 13 nt, Homo sapiens
gaacggaaugugu

SEQ ID NO: 676909 - RNA, 17 nt, Homo sapiens
gaguuauauguucacug

SEQ ID NO: 676910 - RNA, 19 nt, Homo sapiens
gaguuaucacuucauuuau

SEQ ID NO: 676911 - RNA, 21 nt, Homo sapiens
gaguuauuuuuauuuauuuaa

SEQ ID NO: 676912 - RNA, 14 nt, Homo sapiens
gaguucaagaccag

SEQ ID NO: 676913 - RNA, 12 nt, Homo sapiens
gaguuccagacc

SEQ ID NO: 676914 - RNA, 16 nt, Homo sapiens
gaguuccuucugcucc

SEQ ID NO: 676915 - RNA, 19 nt, Homo sapiens
gaguucgaggcugcaguca

SEQ ID NO: 676916 - RNA, 21 nt, Homo sapiens
gaguugcagccagggccagug

SEQ ID NO: 676917 - RNA, 22 nt, Homo sapiens
gaguugcagccagggccagugg

SEQ ID NO: 676918 - RNA, 14 nt, Homo sapiens
gaguuggggcugcc

SEQ ID NO: 676919 - RNA, 15 nt, Homo sapiens
gaguugguuacuuca

SEQ ID NO: 676920 - RNA, 14 nt, Homo sapiens
gaguugugaugaau

SEQ ID NO: 676921 - RNA, 23 nt, Homo sapiens
gaguuguucaaauguuccuuuua

SEQ ID NO: 676922 - RNA, 20 nt, Homo sapiens
gaguuguuucugacccacug

SEQ ID NO: 676923 - RNA, 22 nt, Homo sapiens
gaguuuagcccugaacauuuca

SEQ ID NO: 676924 - RNA, 15 nt, Homo sapiens
gaguuuagggaacaa

SEQ ID NO: 676925 - RNA, 14 nt, Homo sapiens
gaguuuagugugau

SEQ ID NO: 676926 - RNA, 21 nt, Homo sapiens
gaguuuagugugauaaaggca

SEQ ID NO: 676927 - RNA, 17 nt, Homo sapiens
gaguuuccacuauccca

SEQ ID NO: 676928 - RNA, 14 nt, Homo sapiens
gaguuucgagguag

SEQ ID NO: 676929 - RNA, 11 nt, Homo sapiens
gaguuugccac

SEQ ID NO: 676930 - RNA, 15 nt, Homo sapiens
gaguuuguauuauua

SEQ ID NO: 676931 - RNA, 12 nt, Homo sapiens
gaguuuguuacc

SEQ ID NO: 676932 - RNA, 17 nt, Homo sapiens
gaguuuuggcagccaga

SEQ ID NO: 676933 - RNA, 14 nt, Homo sapiens
gaguuuuuguauaa

SEQ ID NO: 676934 - RNA, 13 nt, Homo sapiens
gauaaaagcagua

SEQ ID NO: 676935 - RNA, 18 nt, Homo sapiens
gauaaacaguuucuuugu

SEQ ID NO: 676936 - RNA, 14 nt, Homo sapiens
gauaaaccaguuga

SEQ ID NO: 676937 - RNA, 18 nt, Homo sapiens
gauaaacucagaucugau

SEQ ID NO: 676938 - RNA, 12 nt, Homo sapiens
gauaaagcaccc

SEQ ID NO: 676939 - RNA, 22 nt, Homo sapiens
gauaaagggaaccacuuucuua

SEQ ID NO: 676940 - RNA, 20 nt, Homo sapiens
gauaaauauuugacuugcau

SEQ ID NO: 676941 - RNA, 15 nt, Homo sapiens
gauaaaucagugccu

SEQ ID NO: 676942 - RNA, 19 nt, Homo sapiens
gauaaaucauuucaguauc

SEQ ID NO: 676943 - RNA, 17 nt, Homo sapiens
gauaaaugacacaauga

SEQ ID NO: 676944 - RNA, 21 nt, Homo sapiens
gauaaauugcugcgugacaua

SEQ ID NO: 676945 - RNA, 19 nt, Homo sapiens
gauaaauuuaaagucuaag

SEQ ID NO: 676946 - RNA, 16 nt, Homo sapiens
gauaaauuuguugaau

SEQ ID NO: 676947 - RNA, 14 nt, Homo sapiens
gauaacagccucuu

SEQ ID NO: 676948 - RNA, 18 nt, Homo sapiens
gauaacagccucuugccc

SEQ ID NO: 676949 - RNA, 15 nt, Homo sapiens
gauaacugagaauuu

SEQ ID NO: 676950 - RNA, 14 nt, Homo sapiens
gauaacugcaauuu

SEQ ID NO: 676951 - RNA, 17 nt, Homo sapiens
gauaacuugagcaccgu

SEQ ID NO: 676952 - RNA, 12 nt, Homo sapiens
gauaacuuugac

SEQ ID NO: 676953 - RNA, 15 nt, Homo sapiens
gauaagagaauaccu

SEQ ID NO: 676954 - RNA, 16 nt, Homo sapiens
gauaagagaauaccuu

SEQ ID NO: 676955 - RNA, 19 nt, Homo sapiens
gauaagccacucugucccu

SEQ ID NO: 676956 - RNA, 18 nt, Homo sapiens
gauaagcuaacaccagac

SEQ ID NO: 676957 - RNA, 20 nt, Homo sapiens
gauaaguaaguuugauuuca

SEQ ID NO: 676958 - RNA, 18 nt, Homo sapiens
gauaaguggggacuagug

SEQ ID NO: 676959 - RNA, 19 nt, Homo sapiens
gauaaguggggacuagugu

SEQ ID NO: 676960 - RNA, 20 nt, Homo sapiens
gauaauagagggcuggaauu

SEQ ID NO: 676961 - RNA, 21 nt, Homo sapiens
gauaaucucuuuaaauggcuu

SEQ ID NO: 676962 - RNA, 15 nt, Homo sapiens
gauaaucuucaggug

SEQ ID NO: 676963 - RNA, 16 nt, Homo sapiens
gauaaugaaauaauca

SEQ ID NO: 676964 - RNA, 12 nt, Homo sapiens
gauaaugggaga

SEQ ID NO: 676965 - RNA, 18 nt, Homo sapiens
gauaauuguuucauucau

SEQ ID NO: 676966 - RNA, 19 nt, Homo sapiens
gauaauuguuucauucauc

SEQ ID NO: 676967 - RNA, 12 nt, Homo sapiens
gauacaaacugc

SEQ ID NO: 676968 - RNA, 12 nt, Homo sapiens
gauacacagaua

SEQ ID NO: 676969 - RNA, 18 nt, Homo sapiens
gauccuuccucccaccuc

SEQ ID NO: 676970 - RNA, 20 nt, Homo sapiens
gaucgcaccacugcacucca

SEQ ID NO: 676971 - RNA, 20 nt, Homo sapiens
gaucgcgccacugcacucca

SEQ ID NO: 676972 - RNA, 15 nt, Homo sapiens
gaucguaaaaaaaua

SEQ ID NO: 676973 - RNA, 18 nt, Homo sapiens
gaucguucucugccucac

SEQ ID NO: 676974 - RNA, 14 nt, Homo sapiens
gaucuaacuauguu

SEQ ID NO: 676975 - RNA, 21 nt, Homo sapiens
gaucuaaggaugucacagggc

SEQ ID NO: 676976 - RNA, 20 nt, Homo sapiens
gaucuaauauugacugccuc

SEQ ID NO: 676977 - RNA, 17 nt, Homo sapiens
gaucuauguacuguaau

SEQ ID NO: 676978 - RNA, 21 nt, Homo sapiens
gaucucaauuugcaguauuca

SEQ ID NO: 676979 - RNA, 20 nt, Homo sapiens
gaucucagcagugaaguaua

SEQ ID NO: 676980 - RNA, 22 nt, Homo sapiens
gaucucagcucaccucaaccuc

SEQ ID NO: 676981 - RNA, 17 nt, Homo sapiens
gaucuccaacagccagu

SEQ ID NO: 676982 - RNA, 14 nt, Homo sapiens
gaucuccacuguug

SEQ ID NO: 676983 - RNA, 15 nt, Homo sapiens
gaucucccacugcgg

SEQ ID NO: 676984 - RNA, 21 nt, Homo sapiens
gaucucuucuuuuggcuucca

SEQ ID NO: 676985 - RNA, 14 nt, Homo sapiens
gaucugaaaucauu

SEQ ID NO: 676986 - RNA, 14 nt, Homo sapiens
gaucugaacacagu

SEQ ID NO: 676987 - RNA, 20 nt, Homo sapiens
gaucugauaaggaucuagga

SEQ ID NO: 676988 - RNA, 23 nt, Homo sapiens
gaucugauaaggaucuaggagaa

SEQ ID NO: 676989 - RNA, 20 nt, Homo sapiens
gaucugaugaaaaggucaga

SEQ ID NO: 676990 - RNA, 16 nt, Homo sapiens
gaucugcacauuucau

SEQ ID NO: 676991 - RNA, 22 nt, Homo sapiens
gaucuguagaagucugucuuuc

SEQ ID NO: 676992 - RNA, 19 nt, Homo sapiens
gaucuguuuugaaggcaaa

SEQ ID NO: 676993 - RNA, 12 nt, Homo sapiens
gaucuucagagc

SEQ ID NO: 676994 - RNA, 9 nt, Homo sapiens
gaucuugaa

SEQ ID NO: 676995 - RNA, 13 nt, Homo sapiens
gaucuugagggac

SEQ ID NO: 676996 - RNA, 20 nt, Homo sapiens
gaucuugcauucccaguggu

SEQ ID NO: 676997 - RNA, 14 nt, Homo sapiens
gaucuugguucacu

SEQ ID NO: 676998 - RNA, 22 nt, Homo sapiens
gaucuuucucaaucuugaacuc

SEQ ID NO: 676999 - RNA, 18 nt, Homo sapiens
gaucuuuguauauuacau

SEQ ID NO: 677000 - RNA, 20 nt, Homo sapiens
gaucuuuguuuaaaugccaa

SEQ ID NO: 677001 - RNA, 18 nt, Homo sapiens
gaucuuuugcuaaugcaa

SEQ ID NO: 677002 - RNA, 18 nt, Homo sapiens
gaugaaaaugaaucuuca

SEQ ID NO: 677003 - RNA, 16 nt, Homo sapiens
gaugaaauaacuccuu

SEQ ID NO: 677004 - RNA, 23 nt, Homo sapiens
gaugaaauaacuccuucuuguag

SEQ ID NO: 677005 - RNA, 16 nt, Homo sapiens
gaugaaccugacaaaa

SEQ ID NO: 677006 - RNA, 19 nt, Homo sapiens
gaugaaccugacaaaaaca

SEQ ID NO: 677007 - RNA, 15 nt, Homo sapiens
gaugaauuauccugu

SEQ ID NO: 677008 - RNA, 11 nt, Homo sapiens
gaugaauuauu

SEQ ID NO: 677009 - RNA, 19 nt, Homo sapiens
gaugaauuccuauggcucu

SEQ ID NO: 677010 - RNA, 13 nt, Homo sapiens
gaugacaaccucc

SEQ ID NO: 677011 - RNA, 12 nt, Homo sapiens
gaugacauuucg

SEQ ID NO: 677012 - RNA, 23 nt, Homo sapiens
gaugaccacauaagaaggcaauu

SEQ ID NO: 677013 - RNA, 15 nt, Homo sapiens
gaugacguccucuca

SEQ ID NO: 677014 - RNA, 16 nt, Homo sapiens
gaugacguccucucaa

SEQ ID NO: 677015 - RNA, 22 nt, Homo sapiens
gaugacuaccucagaacauaaa

SEQ ID NO: 677016 - RNA, 11 nt, Homo sapiens
gaugacuguga

SEQ ID NO: 677017 - RNA, 14 nt, Homo sapiens
gaugacuucaguga

SEQ ID NO: 677018 - RNA, 16 nt, Homo sapiens
gaugagccgcugugag

SEQ ID NO: 677019 - RNA, 15 nt, Homo sapiens
gaugaggugcucaau

SEQ ID NO: 677020 - RNA, 21 nt, Homo sapiens
gaugaggugguggaguggagu

SEQ ID NO: 677021 - RNA, 18 nt, Homo sapiens
gaugaguaaaacuggugg

SEQ ID NO: 677022 - RNA, 15 nt, Homo sapiens
gaugagucagugcca

SEQ ID NO: 677023 - RNA, 21 nt, Homo sapiens
gaugagucagugccaugacug

SEQ ID NO: 677024 - RNA, 13 nt, Homo sapiens
gaugauaaaacac

SEQ ID NO: 677025 - RNA, 13 nt, Homo sapiens
gaugaucaucucc

SEQ ID NO: 677026 - RNA, 21 nt, Homo sapiens
gaugaucuggauccaccaaga

SEQ ID NO: 677027 - RNA, 14 nt, Homo sapiens
gaugaugaugacuc

SEQ ID NO: 677028 - RNA, 18 nt, Homo sapiens
gaugauggccauuucuaa

SEQ ID NO: 677029 - RNA, 22 nt, Homo sapiens
gaugauggggugggagacuuuc

SEQ ID NO: 677030 - RNA, 17 nt, Homo sapiens
gaugauucuaugucuca

SEQ ID NO: 677031 - RNA, 21 nt, Homo sapiens
gaugauucuggauucuaaaca

SEQ ID NO: 677032 - RNA, 13 nt, Homo sapiens
gaugauuguucaa

SEQ ID NO: 677033 - RNA, 15 nt, Homo sapiens
gaugcaauacaagau

SEQ ID NO: 677034 - RNA, 11 nt, Homo sapiens
gaugcacucuc

SEQ ID NO: 677035 - RNA, 17 nt, Homo sapiens
gaugcacuucaaauuca

SEQ ID NO: 677036 - RNA, 19 nt, Homo sapiens
gaugcagcaccucucagga

SEQ ID NO: 677037 - RNA, 16 nt, Homo sapiens
gaugcagcucuuggga

SEQ ID NO: 677038 - RNA, 13 nt, Homo sapiens
gaugcauucgaga

SEQ ID NO: 677039 - RNA, 17 nt, Homo sapiens
gaugccaaaaugacuuu

SEQ ID NO: 677040 - RNA, 18 nt, Homo sapiens
gaugccagagggccagca

SEQ ID NO: 677041 - RNA, 12 nt, Homo sapiens
gaugcccagaag

SEQ ID NO: 677042 - RNA, 23 nt, Homo sapiens
gaugccgagguaaaaguucuuuu

SEQ ID NO: 677043 - RNA, 22 nt, Homo sapiens
gaugccuguuaauuuauaaugu

SEQ ID NO: 677044 - RNA, 20 nt, Homo sapiens
gaugcgaaccacccaaaaca

SEQ ID NO: 677045 - RNA, 20 nt, Homo sapiens
gaugcgggacugcuggcaug

SEQ ID NO: 677046 - RNA, 23 nt, Homo sapiens
gaugcuacgcuccagcugaucca

SEQ ID NO: 677047 - RNA, 22 nt, Homo sapiens
gaugcugaggguguuucuuccu

SEQ ID NO: 677048 - RNA, 16 nt, Homo sapiens
gaugcugccugaguca

SEQ ID NO: 677049 - RNA, 11 nt, Homo sapiens
gaugcugcuau

SEQ ID NO: 677050 - RNA, 17 nt, Homo sapiens
gaugcugugagcauuaa

SEQ ID NO: 677051 - RNA, 14 nt, Homo sapiens
gaugcugugcuaug

SEQ ID NO: 677052 - RNA, 17 nt, Homo sapiens
gaugcuguuaaccaaag

SEQ ID NO: 677053 - RNA, 21 nt, Homo sapiens
gaugcuucuauaauuuugccu

SEQ ID NO: 677054 - RNA, 20 nt, Homo sapiens
gauggaacacggccacauca

SEQ ID NO: 677055 - RNA, 13 nt, Homo sapiens
gauggacaacuca

SEQ ID NO: 677056 - RNA, 21 nt, Homo sapiens
gauggaccuccuucgcuggaa

SEQ ID NO: 677057 - RNA, 13 nt, Homo sapiens
gauggacucagga

SEQ ID NO: 677058 - RNA, 14 nt, Homo sapiens
gauggacucugaaa

SEQ ID NO: 677059 - RNA, 19 nt, Homo sapiens
gauggagauauuuacauga

SEQ ID NO: 677060 - RNA, 9 nt, Homo sapiens
gauggagcu

SEQ ID NO: 677061 - RNA, 17 nt, Homo sapiens
gauggaggggugguccu

SEQ ID NO: 677062 - RNA, 16 nt, Homo sapiens
gauggauagucugucc

SEQ ID NO: 677063 - RNA, 22 nt, Homo sapiens
gauggaugaaucucccacucca

SEQ ID NO: 677064 - RNA, 18 nt, Homo sapiens
gauggaugggaugcacuc

SEQ ID NO: 677065 - RNA, 20 nt, Homo sapiens
gauggauuaaacucaguggu

SEQ ID NO: 677066 - RNA, 16 nt, Homo sapiens
gauggcaccacugcac

SEQ ID NO: 677067 - RNA, 18 nt, Homo sapiens
gauggcaggccugaccca

SEQ ID NO: 677068 - RNA, 23 nt, Homo sapiens
gauggcauaggccuuagcaguaa

SEQ ID NO: 677069 - RNA, 14 nt, Homo sapiens
gauggccacuguga

SEQ ID NO: 677070 - RNA, 10 nt, Homo sapiens
gauggcccaa

SEQ ID NO: 677071 - RNA, 18 nt, Homo sapiens
gauggcgaccaccaaagu

SEQ ID NO: 677072 - RNA, 13 nt, Homo sapiens
gaugggacaccca

SEQ ID NO: 677073 - RNA, 19 nt, Homo sapiens
gaugggauggguuccagag

SEQ ID NO: 677074 - RNA, 22 nt, Homo sapiens
gaugggguuucaccaucuuggc

SEQ ID NO: 677075 - RNA, 21 nt, Homo sapiens
gauggguggggagcaaaucau

SEQ ID NO: 677076 - RNA, 20 nt, Homo sapiens
gaugguucauaucaugaaga

SEQ ID NO: 677077 - RNA, 20 nt, Homo sapiens
gauguagauuacugaaaaau

SEQ ID NO: 677078 - RNA, 14 nt, Homo sapiens
gauguagugccucu

SEQ ID NO: 677079 - RNA, 22 nt, Homo sapiens
gaugucaaaacaagacuccuca

SEQ ID NO: 677080 - RNA, 22 nt, Homo sapiens
gaugucaggaaacauucaguga

SEQ ID NO: 677081 - RNA, 15 nt, Homo sapiens
gaugucauagccaaa

SEQ ID NO: 677082 - RNA, 20 nt, Homo sapiens
gauguccagaagaauauuca

SEQ ID NO: 677083 - RNA, 19 nt, Homo sapiens
gaugucccuugaugcacag

SEQ ID NO: 677084 - RNA, 14 nt, Homo sapiens
gaugucuucuagcu

SEQ ID NO: 677085 - RNA, 22 nt, Homo sapiens
gaugugaaaacaucucaauaac

SEQ ID NO: 677086 - RNA, 21 nt, Homo sapiens
gaugugaauugccugcagaga

SEQ ID NO: 677087 - RNA, 13 nt, Homo sapiens
gaugugauacaaa

SEQ ID NO: 677088 - RNA, 16 nt, Homo sapiens
gaugugaucacugaga

SEQ ID NO: 677089 - RNA, 16 nt, Homo sapiens
gaugugcaaguguaug

SEQ ID NO: 677090 - RNA, 23 nt, Homo sapiens
gaugugcauuucaccugugacaa

SEQ ID NO: 677091 - RNA, 22 nt, Homo sapiens
ccagcaaugacaucucaggggc

SEQ ID NO: 677092 - RNA, 14 nt, Homo sapiens
ccagcacacagggc

SEQ ID NO: 677093 - RNA, 13 nt, Homo sapiens
ccagcacauggcc

SEQ ID NO: 677094 - RNA, 12 nt, Homo sapiens
ccagcacccucu

SEQ ID NO: 677095 - RNA, 16 nt, Homo sapiens
ccagcaccucaugcag

SEQ ID NO: 677096 - RNA, 16 nt, Homo sapiens
ccagcacucagccuca

SEQ ID NO: 677097 - RNA, 18 nt, Homo sapiens
ccagcacucugaaacuga

SEQ ID NO: 677098 - RNA, 14 nt, Homo sapiens
ccagcacuggugaa

SEQ ID NO: 677099 - RNA, 10 nt, Homo sapiens
ccagcacuuc

SEQ ID NO: 677100 - RNA, 19 nt, Homo sapiens
ccagcagaagcaggguacc

SEQ ID NO: 677101 - RNA, 23 nt, Homo sapiens
ccagcagagggcgccaccaccac

SEQ ID NO: 677102 - RNA, 17 nt, Homo sapiens
ccagcagcccaagcuua

SEQ ID NO: 677103 - RNA, 16 nt, Homo sapiens
ccagcagcugauucca

SEQ ID NO: 677104 - RNA, 19 nt, Homo sapiens
ccagcagggaaaaugcagc

SEQ ID NO: 677105 - RNA, 19 nt, Homo sapiens
ccagcagugccuugugcaa

SEQ ID NO: 677106 - RNA, 16 nt, Homo sapiens
ccagcagugguauuaa

SEQ ID NO: 677107 - RNA, 13 nt, Homo sapiens
ccagcaucuccca

SEQ ID NO: 677108 - RNA, 12 nt, Homo sapiens
ccagcaucugga

SEQ ID NO: 677109 - RNA, 14 nt, Homo sapiens
ccagcaucuggaag

SEQ ID NO: 677110 - RNA, 18 nt, Homo sapiens
ccagcauucagcacacac

SEQ ID NO: 677111 - RNA, 13 nt, Homo sapiens
ccagccaacgaga

SEQ ID NO: 677112 - RNA, 14 nt, Homo sapiens
ccagccaagcuuua

SEQ ID NO: 677113 - RNA, 22 nt, Homo sapiens
ccagccaccccgggcucucugc

SEQ ID NO: 677114 - RNA, 13 nt, Homo sapiens
ccagccaggcuau

SEQ ID NO: 677115 - RNA, 17 nt, Homo sapiens
ccagcccaaaggggaca

SEQ ID NO: 677116 - RNA, 10 nt, Homo sapiens
ccagcccaga

SEQ ID NO: 677117 - RNA, 20 nt, Homo sapiens
ccagcccagacccccagugu

SEQ ID NO: 677118 - RNA, 15 nt, Homo sapiens
ccagcccagagccac

SEQ ID NO: 677119 - RNA, 15 nt, Homo sapiens
ccagcccagcacugg

SEQ ID NO: 677120 - RNA, 23 nt, Homo sapiens
ccagcccauugcugccaaggugg

SEQ ID NO: 677121 - RNA, 15 nt, Homo sapiens
ccagccccacugcca

SEQ ID NO: 677122 - RNA, 16 nt, Homo sapiens
ccagccccacugccag

SEQ ID NO: 677123 - RNA, 14 nt, Homo sapiens
ccagccccuuugcc

SEQ ID NO: 677124 - RNA, 20 nt, Homo sapiens
ccagccguauuuuacaugaa

SEQ ID NO: 677125 - RNA, 13 nt, Homo sapiens
ccagccuggaucu

SEQ ID NO: 677126 - RNA, 19 nt, Homo sapiens
ccagccuggccaacauggc

SEQ ID NO: 677127 - RNA, 21 nt, Homo sapiens
ccagccugggacucccaguga

SEQ ID NO: 677128 - RNA, 20 nt, Homo sapiens
ccagccugggcaacagagca

SEQ ID NO: 677129 - RNA, 20 nt, Homo sapiens
ccagccugggcaacauacca

SEQ ID NO: 677130 - RNA, 20 nt, Homo sapiens
ccagccugguuugcaaagac

SEQ ID NO: 677131 - RNA, 17 nt, Homo sapiens
ccagccuuccucugcag

SEQ ID NO: 677132 - RNA, 19 nt, Homo sapiens
ccagcgaccucucugccuc

SEQ ID NO: 677133 - RNA, 18 nt, Homo sapiens
ccagcgagagaaagaguu

SEQ ID NO: 677134 - RNA, 16 nt, Homo sapiens
ccagcgagcucucaaa

SEQ ID NO: 677135 - RNA, 14 nt, Homo sapiens
ccagcuacauuccu

SEQ ID NO: 677136 - RNA, 15 nt, Homo sapiens
ccagcuacucaggag

SEQ ID NO: 677137 - RNA, 15 nt, Homo sapiens
ccagcuacucgggag

SEQ ID NO: 677138 - RNA, 17 nt, Homo sapiens
ccagcuagugccaaaua

SEQ ID NO: 677139 - RNA, 13 nt, Homo sapiens
ccagcuaucuuuc

SEQ ID NO: 677140 - RNA, 15 nt, Homo sapiens
ccagcucagucccau

SEQ ID NO: 677141 - RNA, 14 nt, Homo sapiens
ccagcucagucuca

SEQ ID NO: 677142 - RNA, 13 nt, Homo sapiens
ccagcucaucucc

SEQ ID NO: 677143 - RNA, 23 nt, Homo sapiens
ccagcuccuuggcugcagccauc

SEQ ID NO: 677144 - RNA, 18 nt, Homo sapiens
ccagcucugacaucccuu

SEQ ID NO: 677145 - RNA, 19 nt, Homo sapiens
ccagcucuggcuuccugcu

SEQ ID NO: 677146 - RNA, 22 nt, Homo sapiens
ccagcucuucuccccaggugug

SEQ ID NO: 677147 - RNA, 13 nt, Homo sapiens
ccagcugacuguu

SEQ ID NO: 677148 - RNA, 16 nt, Homo sapiens
ccagcugcaccugcca

SEQ ID NO: 677149 - RNA, 18 nt, Homo sapiens
ccagcugcaccugccagc

SEQ ID NO: 677150 - RNA, 20 nt, Homo sapiens
ccagcugccuuggacugugu

SEQ ID NO: 677151 - RNA, 13 nt, Homo sapiens
ccagcugcuccca

SEQ ID NO: 677152 - RNA, 13 nt, Homo sapiens
ccagcuggcagac

SEQ ID NO: 677153 - RNA, 18 nt, Homo sapiens
ccagcugggaagcccuuu

SEQ ID NO: 677154 - RNA, 21 nt, Homo sapiens
ccagcugggaccuaaugcugg

SEQ ID NO: 677155 - RNA, 18 nt, Homo sapiens
ccagcuggggcgugggga

SEQ ID NO: 677156 - RNA, 20 nt, Homo sapiens
ccagcuuaaaggcaguauuu

SEQ ID NO: 677157 - RNA, 18 nt, Homo sapiens
ccagcuucugguacucuc

SEQ ID NO: 677158 - RNA, 17 nt, Homo sapiens
ccagcuugggcccagcu

SEQ ID NO: 677159 - RNA, 17 nt, Homo sapiens
ccagcuugggccugucu

SEQ ID NO: 677160 - RNA, 19 nt, Homo sapiens
gauugaggagcugcacuga

SEQ ID NO: 677161 - RNA, 12 nt, Homo sapiens
gauugauuagau

SEQ ID NO: 677162 - RNA, 17 nt, Homo sapiens
gauugcacagagcugga

SEQ ID NO: 677163 - RNA, 23 nt, Homo sapiens
gauugcagcuuuauguucauuug

SEQ ID NO: 677164 - RNA, 15 nt, Homo sapiens
gauugccacagcuca

SEQ ID NO: 677165 - RNA, 20 nt, Homo sapiens
gauugcugaaaaaguagauu

SEQ ID NO: 677166 - RNA, 16 nt, Homo sapiens
gauugcugaaacugug

SEQ ID NO: 677167 - RNA, 13 nt, Homo sapiens
gauugcugcaaac

SEQ ID NO: 677168 - RNA, 19 nt, Homo sapiens
gauugguguucguuuccau

SEQ ID NO: 677169 - RNA, 18 nt, Homo sapiens
gauuguauaaaugcaaua

SEQ ID NO: 677170 - RNA, 13 nt, Homo sapiens
gauuguauugcaa

SEQ ID NO: 677171 - RNA, 17 nt, Homo sapiens
gauuguucaucaugaca

SEQ ID NO: 677172 - RNA, 18 nt, Homo sapiens
gauuguuguguagucaag

SEQ ID NO: 677173 - RNA, 15 nt, Homo sapiens
gauuguuguuugcca

SEQ ID NO: 677174 - RNA, 18 nt, Homo sapiens
gauuguuuccucuuccaa

SEQ ID NO: 677175 - RNA, 14 nt, Homo sapiens
gauuguuuugccac

SEQ ID NO: 677176 - RNA, 14 nt, Homo sapiens
gauuuaauaugcaa

SEQ ID NO: 677177 - RNA, 16 nt, Homo sapiens
gauuuaaucugccaag

SEQ ID NO: 677178 - RNA, 15 nt, Homo sapiens
gauuuaauguugauu

SEQ ID NO: 677179 - RNA, 15 nt, Homo sapiens
gauuuaccagcuuaa

SEQ ID NO: 677180 - RNA, 14 nt, Homo sapiens
gauuuacucauuau

SEQ ID NO: 677181 - RNA, 22 nt, Homo sapiens
gauuuagaaaaaaacaugaauu

SEQ ID NO: 677182 - RNA, 16 nt, Homo sapiens
gauuuaugaugcacuu

SEQ ID NO: 677183 - RNA, 21 nt, Homo sapiens
gauuucagaucauauuucaca

SEQ ID NO: 677184 - RNA, 22 nt, Homo sapiens
gauuucaggauacucugucaga

SEQ ID NO: 677185 - RNA, 14 nt, Homo sapiens
gauuucaugccugg

SEQ ID NO: 677186 - RNA, 13 nt, Homo sapiens
gauuuccuugaau

SEQ ID NO: 677187 - RNA, 15 nt, Homo sapiens
gauuucggaggccau

SEQ ID NO: 677188 - RNA, 17 nt, Homo sapiens
gauuucugguuguuaug

SEQ ID NO: 677189 - RNA, 15 nt, Homo sapiens
gauuucuguuuagau

SEQ ID NO: 677190 - RNA, 23 nt, Homo sapiens
gauuucuuucuuugcaccaaaga

SEQ ID NO: 677191 - RNA, 16 nt, Homo sapiens
gauuugggaaccaagc

SEQ ID NO: 677192 - RNA, 17 nt, Homo sapiens
gauuugggaaccaagcu

SEQ ID NO: 677193 - RNA, 20 nt, Homo sapiens
gauuuggggcagagggacag

SEQ ID NO: 677194 - RNA, 13 nt, Homo sapiens
gauuuggugacca

SEQ ID NO: 677195 - RNA, 16 nt, Homo sapiens
gauuuguagcacugag

SEQ ID NO: 677196 - RNA, 15 nt, Homo sapiens
gauuuguauguuaaa

SEQ ID NO: 677197 - RNA, 22 nt, Homo sapiens
gauuugucccuaugcauaucag

SEQ ID NO: 677198 - RNA, 14 nt, Homo sapiens
gauuugucugucaa

SEQ ID NO: 677199 - RNA, 21 nt, Homo sapiens
gauuuguuuguuuucuugucu

SEQ ID NO: 677200 - RNA, 20 nt, Homo sapiens
gauuuuaaaaagucuucacu

SEQ ID NO: 677201 - RNA, 19 nt, Homo sapiens
gauuuuaaguaacauaacu

SEQ ID NO: 677202 - RNA, 14 nt, Homo sapiens
gauuuuaccaaagc

SEQ ID NO: 677203 - RNA, 14 nt, Homo sapiens
gauuuuaugcugcu

SEQ ID NO: 677204 - RNA, 16 nt, Homo sapiens
gauuuucauguugaug

SEQ ID NO: 677205 - RNA, 18 nt, Homo sapiens
gauuuuguaauucuuaug

SEQ ID NO: 677206 - RNA, 20 nt, Homo sapiens
gauuuugucugcccaaucca

SEQ ID NO: 677207 - RNA, 19 nt, Homo sapiens
gauuuuugacucuggcaaa

SEQ ID NO: 677208 - RNA, 22 nt, Homo sapiens
gauuuuuugcauuccugacaaa

SEQ ID NO: 677209 - RNA, 16 nt, Homo sapiens
gauuuuuuuaaaguag

SEQ ID NO: 677210 - RNA, 18 nt, Homo sapiens
gauuuuuuuaaaguaguu

SEQ ID NO: 677211 - RNA, 22 nt, Homo sapiens
gauuuuuuuuaauuaccaugcu

SEQ ID NO: 677212 - RNA, 22 nt, Homo sapiens
gauuuuuuuuucauacacuuau

SEQ ID NO: 677213 - RNA, 20 nt, Homo sapiens
gcaaaaaaauuaaauuauuu

SEQ ID NO: 677214 - RNA, 12 nt, Homo sapiens
cccagauuuccu

SEQ ID NO: 677215 - RNA, 11 nt, Homo sapiens
cccagcacuug

SEQ ID NO: 677216 - RNA, 13 nt, Homo sapiens
cccagcacuuuga

SEQ ID NO: 677217 - RNA, 21 nt, Homo sapiens
cccagcaggugcugacuucau

SEQ ID NO: 677218 - RNA, 18 nt, Homo sapiens
cccagcagguuaccugga

SEQ ID NO: 677219 - RNA, 19 nt, Homo sapiens
cccagcaucccuggagcag

SEQ ID NO: 677220 - RNA, 16 nt, Homo sapiens
cccagcauuccagcuc

SEQ ID NO: 677221 - RNA, 20 nt, Homo sapiens
cccagccaaacccugucuga

SEQ ID NO: 677222 - RNA, 14 nt, Homo sapiens
cccagccaccgaag

SEQ ID NO: 677223 - RNA, 19 nt, Homo sapiens
cccagccaugcaaugccaa

SEQ ID NO: 677224 - RNA, 15 nt, Homo sapiens
cccagcccaaagggg

SEQ ID NO: 677225 - RNA, 16 nt, Homo sapiens
cccagcccaaugccaa

SEQ ID NO: 677226 - RNA, 23 nt, Homo sapiens
cccagcccagggcuccugcacuu

SEQ ID NO: 677227 - RNA, 19 nt, Homo sapiens
cccagccccuuuucucugc

SEQ ID NO: 677228 - RNA, 23 nt, Homo sapiens
cccagcccugggaaccacuccca

SEQ ID NO: 677229 - RNA, 20 nt, Homo sapiens
cccagcccuuagcacagaga

SEQ ID NO: 677230 - RNA, 18 nt, Homo sapiens
cccagccgaaaagcuuuu

SEQ ID NO: 677231 - RNA, 13 nt, Homo sapiens
cccagccuaguca

SEQ ID NO: 677232 - RNA, 15 nt, Homo sapiens
cccagcgagccacag

SEQ ID NO: 677233 - RNA, 15 nt, Homo sapiens
cccagcgagcucuca

SEQ ID NO: 677234 - RNA, 19 nt, Homo sapiens
cccagcgucugcaggguga

SEQ ID NO: 677235 - RNA, 19 nt, Homo sapiens
cccagcuaacuaaugccau

SEQ ID NO: 677236 - RNA, 21 nt, Homo sapiens
cccagcuaauugagaccacag

SEQ ID NO: 677237 - RNA, 12 nt, Homo sapiens
cccagcuacucg

SEQ ID NO: 677238 - RNA, 21 nt, Homo sapiens
cccagcuaucuauauggaauu

SEQ ID NO: 677239 - RNA, 13 nt, Homo sapiens
cccagcugcacuu

SEQ ID NO: 677240 - RNA, 22 nt, Homo sapiens
cccagcuguugggaacagcaug

SEQ ID NO: 677241 - RNA, 17 nt, Homo sapiens
cccagcuuagaguucuu

SEQ ID NO: 677242 - RNA, 14 nt, Homo sapiens
cccaggaacaauaa

SEQ ID NO: 677243 - RNA, 17 nt, Homo sapiens
cccaggaauaguggaca

SEQ ID NO: 677244 - RNA, 16 nt, Homo sapiens
cccaggacggggcaca

SEQ ID NO: 677245 - RNA, 14 nt, Homo sapiens
cccaggagacagac

SEQ ID NO: 677246 - RNA, 21 nt, Homo sapiens
cccaggaggcggagguugcag

SEQ ID NO: 677247 - RNA, 17 nt, Homo sapiens
cccaggauacuggcaca

SEQ ID NO: 677248 - RNA, 14 nt, Homo sapiens
cccaggcacugggc

SEQ ID NO: 677249 - RNA, 13 nt, Homo sapiens
cccaggcacuguu

SEQ ID NO: 677250 - RNA, 19 nt, Homo sapiens
cccaggccccagacagggu

SEQ ID NO: 677251 - RNA, 19 nt, Homo sapiens
cccaggccccaggcaucuu

SEQ ID NO: 677252 - RNA, 21 nt, Homo sapiens
cccaggccccaggcaucuuuc

SEQ ID NO: 677253 - RNA, 23 nt, Homo sapiens
cccaggccuaucuggaagccacc

SEQ ID NO: 677254 - RNA, 18 nt, Homo sapiens
cccaggcuagagugcaau

SEQ ID NO: 677255 - RNA, 20 nt, Homo sapiens
cccaggcuagagugcaaugg

SEQ ID NO: 677256 - RNA, 22 nt, Homo sapiens
cccaggcugcuggagugcagug

SEQ ID NO: 677257 - RNA, 19 nt, Homo sapiens
cccaggcuggaaugcagug

SEQ ID NO: 677258 - RNA, 18 nt, Homo sapiens
cccaggcuggaguacaau

SEQ ID NO: 677259 - RNA, 14 nt, Homo sapiens
cccaggcuggagug

SEQ ID NO: 677260 - RNA, 18 nt, Homo sapiens
cccaggcuggagugcagu

SEQ ID NO: 677261 - RNA, 23 nt, Homo sapiens
cccaggcuggagugcaguagcac

SEQ ID NO: 677262 - RNA, 22 nt, Homo sapiens
cccaggcuucacccugaauggu

SEQ ID NO: 677263 - RNA, 17 nt, Homo sapiens
cccagggaagccaaaag

SEQ ID NO: 677264 - RNA, 16 nt, Homo sapiens
cccagggagaggccau

SEQ ID NO: 677265 - RNA, 13 nt, Homo sapiens
cccagggcuaccc

SEQ ID NO: 677266 - RNA, 18 nt, Homo sapiens
cccaggggccggccagug

SEQ ID NO: 677267 - RNA, 23 nt, Homo sapiens
cccagggucgucuuuguguaugg

SEQ ID NO: 677268 - RNA, 14 nt, Homo sapiens
cccagguaccagcu

SEQ ID NO: 677269 - RNA, 18 nt, Homo sapiens
cccaggucagcuguuacu

SEQ ID NO: 677270 - RNA, 22 nt, Homo sapiens
cccaggucucucaacuucauca

SEQ ID NO: 677271 - RNA, 18 nt, Homo sapiens
cccaggugauuuccucua

SEQ ID NO: 677272 - RNA, 20 nt, Homo sapiens
cccagguggaaggcagacag

SEQ ID NO: 677273 - RNA, 15 nt, Homo sapiens
cccagucacuccucu

SEQ ID NO: 677274 - RNA, 14 nt, Homo sapiens
cccaguccaagacc

SEQ ID NO: 677275 - RNA, 14 nt, Homo sapiens
cccaguccaugcuu

SEQ ID NO: 677276 - RNA, 13 nt, Homo sapiens
cccagucccacac

SEQ ID NO: 677277 - RNA, 18 nt, Homo sapiens
cccagucccacacugugg

SEQ ID NO: 677278 - RNA, 19 nt, Homo sapiens
cccagucccagacaauucc

SEQ ID NO: 677279 - RNA, 11 nt, Homo sapiens
cccagucccau

SEQ ID NO: 677280 - RNA, 15 nt, Homo sapiens
cccaguccuccagac

SEQ ID NO: 677281 - RNA, 23 nt, Homo sapiens
cccaguccucucccaaguccaca

SEQ ID NO: 677282 - RNA, 18 nt, Homo sapiens
cccagucuccagggaccc

SEQ ID NO: 677283 - RNA, 12 nt, Homo sapiens
cccagugcugcu

SEQ ID NO: 677284 - RNA, 16 nt, Homo sapiens
cccaguuacucaggag

SEQ ID NO: 677285 - RNA, 16 nt, Homo sapiens
cccaguuagcucucaa

SEQ ID NO: 677286 - RNA, 22 nt, Homo sapiens
cccaguucugaauaacuugaag

SEQ ID NO: 677287 - RNA, 18 nt, Homo sapiens
cccaguuuaauauuccaa

SEQ ID NO: 677288 - RNA, 12 nt, Homo sapiens
cccauaaggcca

SEQ ID NO: 677289 - RNA, 22 nt, Homo sapiens
cccauaauaacccugccagugc

SEQ ID NO: 677290 - RNA, 19 nt, Homo sapiens
cccauaauuauuauuucca

SEQ ID NO: 677291 - RNA, 21 nt, Homo sapiens
cccauacaauguauguacaau

SEQ ID NO: 677292 - RNA, 12 nt, Homo sapiens
cccauagcuauu

SEQ ID NO: 677293 - RNA, 14 nt, Homo sapiens
cccauagcuuccau

SEQ ID NO: 677294 - RNA, 20 nt, Homo sapiens
cccaucaauucuuagaauau

SEQ ID NO: 677295 - RNA, 15 nt, Homo sapiens
cccauccccuagugc

SEQ ID NO: 677296 - RNA, 16 nt, Homo sapiens
cccaucccucauacca

SEQ ID NO: 677297 - RNA, 21 nt, Homo sapiens
cccauccuucuccaccaaaga

SEQ ID NO: 677298 - RNA, 20 nt, Homo sapiens
cccaucgucucggccuucac

SEQ ID NO: 677299 - RNA, 13 nt, Homo sapiens
cccaucucuacaa

SEQ ID NO: 677300 - RNA, 20 nt, Homo sapiens
cccaucuuccaccucaccuc

SEQ ID NO: 677301 - RNA, 19 nt, Homo sapiens
cccaugaccccaaagccaa

SEQ ID NO: 677302 - RNA, 18 nt, Homo sapiens
cccaugagguacagcaga

SEQ ID NO: 677303 - RNA, 20 nt, Homo sapiens
cccaugcccuggauccauca

SEQ ID NO: 677304 - RNA, 21 nt, Homo sapiens
cccaugccuggucccaagaca

SEQ ID NO: 677305 - RNA, 17 nt, Homo sapiens
cccaugggaucuugagg

SEQ ID NO: 677306 - RNA, 22 nt, Homo sapiens
cccaugggaucuugagggacca

SEQ ID NO: 677307 - RNA, 14 nt, Homo sapiens
cccaugucaccuca

SEQ ID NO: 677308 - RNA, 20 nt, Homo sapiens
gccuuccagcugcugucuuc

SEQ ID NO: 677309 - RNA, 20 nt, Homo sapiens
gccuuccauaauuaugacag

SEQ ID NO: 677310 - RNA, 14 nt, Homo sapiens
gccuucccaaaaca

SEQ ID NO: 677311 - RNA, 14 nt, Homo sapiens
gccuuccucugcag

SEQ ID NO: 677312 - RNA, 17 nt, Homo sapiens
gccuuccugcccuacag

SEQ ID NO: 677313 - RNA, 18 nt, Homo sapiens
gccuucuaguuaccacau

SEQ ID NO: 677314 - RNA, 12 nt, Homo sapiens
gccuucucacca

SEQ ID NO: 677315 - RNA, 15 nt, Homo sapiens
gccuucugcccuccc

SEQ ID NO: 677316 - RNA, 13 nt, Homo sapiens
gccuucuggagcu

SEQ ID NO: 677317 - RNA, 18 nt, Homo sapiens
gccuucuuauugcuuuua

SEQ ID NO: 677318 - RNA, 15 nt, Homo sapiens
gccuucuuccaggau

SEQ ID NO: 677319 - RNA, 15 nt, Homo sapiens
gccuugauaauacuu

SEQ ID NO: 677320 - RNA, 14 nt, Homo sapiens
gccuugaucaguga

SEQ ID NO: 677321 - RNA, 18 nt, Homo sapiens
gccuugcacggcugcucg

SEQ ID NO: 677322 - RNA, 17 nt, Homo sapiens
gccuugcagaacugcca

SEQ ID NO: 677323 - RNA, 17 nt, Homo sapiens
gccuugcauguacuuga

SEQ ID NO: 677324 - RNA, 19 nt, Homo sapiens
gccuugcauguacuugaag

SEQ ID NO: 677325 - RNA, 15 nt, Homo sapiens
gccuuggcuucaggg

SEQ ID NO: 677326 - RNA, 16 nt, Homo sapiens
gccuugguaugugcca

SEQ ID NO: 677327 - RNA, 14 nt, Homo sapiens
gccuuguagcuguu

SEQ ID NO: 677328 - RNA, 15 nt, Homo sapiens
gccuugucauuuuau

SEQ ID NO: 677329 - RNA, 16 nt, Homo sapiens
gccuugucugggugca

SEQ ID NO: 677330 - RNA, 14 nt, Homo sapiens
gccuugugugucag

SEQ ID NO: 677331 - RNA, 19 nt, Homo sapiens
gccuuguuucaccuuccau

SEQ ID NO: 677332 - RNA, 18 nt, Homo sapiens
gccuuuaaaucugugaug

SEQ ID NO: 677333 - RNA, 16 nt, Homo sapiens
gccuuuagaaauuaua

SEQ ID NO: 677334 - RNA, 12 nt, Homo sapiens
gccuuuaucuca

SEQ ID NO: 677335 - RNA, 15 nt, Homo sapiens
gccuuuaucucugag

SEQ ID NO: 677336 - RNA, 14 nt, Homo sapiens
ccccacacagggca

SEQ ID NO: 677337 - RNA, 23 nt, Homo sapiens
ccccacagaaccuucaacccagu

SEQ ID NO: 677338 - RNA, 22 nt, Homo sapiens
ccccacagcuucucuacagacu

SEQ ID NO: 677339 - RNA, 12 nt, Homo sapiens
ccccaccacaaa

SEQ ID NO: 677340 - RNA, 17 nt, Homo sapiens
ccccacccaccccacag

SEQ ID NO: 677341 - RNA, 17 nt, Homo sapiens
ccccacccccugggcag

SEQ ID NO: 677342 - RNA, 15 nt, Homo sapiens
ccccacccuccucca

SEQ ID NO: 677343 - RNA, 22 nt, Homo sapiens
ccccaccugccauuugcacccu

SEQ ID NO: 677344 - RNA, 21 nt, Homo sapiens
ccccaccugggacccuugaga

SEQ ID NO: 677345 - RNA, 23 nt, Homo sapiens
ccccacguugccucuacuuuauc

SEQ ID NO: 677346 - RNA, 17 nt, Homo sapiens
ccccacucagugccucc

SEQ ID NO: 677347 - RNA, 13 nt, Homo sapiens
ccccacuccagcc

SEQ ID NO: 677348 - RNA, 16 nt, Homo sapiens
ccccacuccagcuccu

SEQ ID NO: 677349 - RNA, 19 nt, Homo sapiens
ccccacuggacaacacuga

SEQ ID NO: 677350 - RNA, 11 nt, Homo sapiens
ccccacuuuga

SEQ ID NO: 677351 - RNA, 19 nt, Homo sapiens
ccccagaacauacacugug

SEQ ID NO: 677352 - RNA, 13 nt, Homo sapiens
ccccagacacugg

SEQ ID NO: 677353 - RNA, 21 nt, Homo sapiens
ccccagacucuucauucagug

SEQ ID NO: 677354 - RNA, 10 nt, Homo sapiens
ccccagagac

SEQ ID NO: 677355 - RNA, 14 nt, Homo sapiens
ccccagagcuguuu

SEQ ID NO: 677356 - RNA, 20 nt, Homo sapiens
ccccagaggcucagcacuuu

SEQ ID NO: 677357 - RNA, 15 nt, Homo sapiens
ccccagaucugcucc

SEQ ID NO: 677358 - RNA, 20 nt, Homo sapiens
ccccagauuuaaaaaaagaa

SEQ ID NO: 677359 - RNA, 22 nt, Homo sapiens
ccccagcacacgaguuccagac

SEQ ID NO: 677360 - RNA, 14 nt, Homo sapiens
ccccagccugcucc

SEQ ID NO: 677361 - RNA, 21 nt, Homo sapiens
ccccagccugcucccuagcca

SEQ ID NO: 677362 - RNA, 22 nt, Homo sapiens
ccccagccugcucccuagccag

SEQ ID NO: 677363 - RNA, 15 nt, Homo sapiens
ccccaggcauugcca

SEQ ID NO: 677364 - RNA, 23 nt, Homo sapiens
ccccaggcccaccaucaccaccg

SEQ ID NO: 677365 - RNA, 22 nt, Homo sapiens
ccccaggcccagugggguggcc

SEQ ID NO: 677366 - RNA, 14 nt, Homo sapiens
ccccaggcccuaca

SEQ ID NO: 677367 - RNA, 16 nt, Homo sapiens
ccccaggccuguccac

SEQ ID NO: 677368 - RNA, 21 nt, Homo sapiens
ccccagggggcaacugacauu

SEQ ID NO: 677369 - RNA, 17 nt, Homo sapiens
ccccaggggucccagcc

SEQ ID NO: 677370 - RNA, 14 nt, Homo sapiens
ccccaguccaugcu

SEQ ID NO: 677371 - RNA, 20 nt, Homo sapiens
ccccagugggaacugugcaa

SEQ ID NO: 677372 - RNA, 21 nt, Homo sapiens
ccccagugguauccugugaca

SEQ ID NO: 677373 - RNA, 15 nt, Homo sapiens
ccccaguucuacuga

SEQ ID NO: 677374 - RNA, 18 nt, Homo sapiens
ccccaguucuacugaccu

SEQ ID NO: 677375 - RNA, 18 nt, Homo sapiens
ccccaucauguggcccaa

SEQ ID NO: 677376 - RNA, 18 nt, Homo sapiens
ccccaucauuacugguaa

SEQ ID NO: 677377 - RNA, 17 nt, Homo sapiens
ccccauccccaccacug

SEQ ID NO: 677378 - RNA, 17 nt, Homo sapiens
ccccauccccaccagcu

SEQ ID NO: 677379 - RNA, 14 nt, Homo sapiens
ccccauccuguguu

SEQ ID NO: 677380 - RNA, 14 nt, Homo sapiens
ccccaucugguccu

SEQ ID NO: 677381 - RNA, 15 nt, Homo sapiens
ccccaucuuuacaaa

SEQ ID NO: 677382 - RNA, 17 nt, Homo sapiens
ccccaugggcacagugg

SEQ ID NO: 677383 - RNA, 18 nt, Homo sapiens
ccccaugugccuugucca

SEQ ID NO: 677384 - RNA, 16 nt, Homo sapiens
ccccauuuuacagagg

SEQ ID NO: 677385 - RNA, 21 nt, Homo sapiens
cccccaaugcccggccaggcu

SEQ ID NO: 677386 - RNA, 15 nt, Homo sapiens
cccccacucagugcc

SEQ ID NO: 677387 - RNA, 21 nt, Homo sapiens
cccccacugcuaaggcugcug

SEQ ID NO: 677388 - RNA, 20 nt, Homo sapiens
cccccagccucagcccaacu

SEQ ID NO: 677389 - RNA, 15 nt, Homo sapiens
cccccagugugcaag

SEQ ID NO: 677390 - RNA, 12 nt, Homo sapiens
cccccauuucac

SEQ ID NO: 677391 - RNA, 19 nt, Homo sapiens
cccccguguggacacagau

SEQ ID NO: 677392 - RNA, 21 nt, Homo sapiens
cccccucccaacagcgcuuua

SEQ ID NO: 677393 - RNA, 14 nt, Homo sapiens
cccccucgccagcu

SEQ ID NO: 677394 - RNA, 21 nt, Homo sapiens
cccccugucccauucuagauc

SEQ ID NO: 677395 - RNA, 15 nt, Homo sapiens
ccccgaaugucacug

SEQ ID NO: 677396 - RNA, 17 nt, Homo sapiens
ccccgagaccucacuuu

SEQ ID NO: 677397 - RNA, 22 nt, Homo sapiens
ccccgagcugggggccaugagc

SEQ ID NO: 677398 - RNA, 13 nt, Homo sapiens
ccccgcaaagaca

SEQ ID NO: 677399 - RNA, 22 nt, Homo sapiens
ccccgcgcucgcccagcaggag

SEQ ID NO: 677400 - RNA, 23 nt, Homo sapiens
ccccgcucccaccuagugcccca

SEQ ID NO: 677401 - RNA, 13 nt, Homo sapiens
ccccuaaaccaaa

SEQ ID NO: 677402 - RNA, 14 nt, Homo sapiens
ccccuaaaccaaaa

SEQ ID NO: 677403 - RNA, 13 nt, Homo sapiens
ccccuacaugaaa

SEQ ID NO: 677404 - RNA, 13 nt, Homo sapiens
ccccuacucccuc

SEQ ID NO: 677405 - RNA, 16 nt, Homo sapiens
ccccuacugcugugaa

SEQ ID NO: 677406 - RNA, 20 nt, Homo sapiens
ccccuaugugacagcucuau

SEQ ID NO: 677407 - RNA, 22 nt, Homo sapiens
ccccucaauccuaucacagucu

SEQ ID NO: 677408 - RNA, 21 nt, Homo sapiens
ccccuccucccccggcugggc

SEQ ID NO: 677409 - RNA, 15 nt, Homo sapiens
ccccuccugcugggc

SEQ ID NO: 677410 - RNA, 15 nt, Homo sapiens
ccccuccuugcaacc

SEQ ID NO: 677411 - RNA, 17 nt, Homo sapiens
ccccucgugucagcuca

SEQ ID NO: 677412 - RNA, 16 nt, Homo sapiens
ccccucguuagccuuc

SEQ ID NO: 677413 - RNA, 23 nt, Homo sapiens
ccccucguuagccuuccucugau

SEQ ID NO: 677414 - RNA, 13 nt, Homo sapiens
ccccucuccuccg

SEQ ID NO: 677415 - RNA, 19 nt, Homo sapiens
ccccucucucacacaucac

SEQ ID NO: 677416 - RNA, 15 nt, Homo sapiens
ccccucucugcucca

SEQ ID NO: 677417 - RNA, 17 nt, Homo sapiens
ccccucuggauucccuu

SEQ ID NO: 677418 - RNA, 17 nt, Homo sapiens
ccccucugucuugugaa

SEQ ID NO: 677419 - RNA, 21 nt, Homo sapiens
ccccucuuugcacagcaugag

SEQ ID NO: 677420 - RNA, 18 nt, Homo sapiens
ccccugaccucacuguga

SEQ ID NO: 677421 - RNA, 24 nt, Homo sapiens
ccccugacgugcagccacacacag

SEQ ID NO: 677422 - RNA, 19 nt, Homo sapiens
ccccugagaguuuccucag

SEQ ID NO: 677423 - RNA, 19 nt, Homo sapiens
ccccugcaauguggugaca

SEQ ID NO: 677424 - RNA, 14 nt, Homo sapiens
ccccugccagugaa

SEQ ID NO: 677425 - RNA, 11 nt, Homo sapiens
ccccugccauu

SEQ ID NO: 677426 - RNA, 17 nt, Homo sapiens
ccccugcgggcgcgggc

SEQ ID NO: 677427 - RNA, 21 nt, Homo sapiens
ccccugcucaguaaagcacuu

SEQ ID NO: 677428 - RNA, 20 nt, Homo sapiens
ccccuggcccagcggccccu

SEQ ID NO: 677429 - RNA, 14 nt, Homo sapiens
ccccuggcuuuuca

SEQ ID NO: 677430 - RNA, 16 nt, Homo sapiens
ccccuguacauuugug

SEQ ID NO: 677431 - RNA, 14 nt, Homo sapiens
ccccuguaccuuuu

SEQ ID NO: 677432 - RNA, 17 nt, Homo sapiens
ccccugucccauucuag

SEQ ID NO: 677433 - RNA, 22 nt, Homo sapiens
ccccugucucggggcuugcccc

SEQ ID NO: 677434 - RNA, 15 nt, Homo sapiens
ccccuguuugcauga

SEQ ID NO: 677435 - RNA, 21 nt, Homo sapiens
ccccuucccgggcugcacuuu

SEQ ID NO: 677436 - RNA, 23 nt, Homo sapiens
gcugaguuuauuaguacaugggc

SEQ ID NO: 677437 - RNA, 21 nt, Homo sapiens
gcugaugaacucuuaaucaaa

SEQ ID NO: 677438 - RNA, 18 nt, Homo sapiens
gcugaugauuuugcaaaa

SEQ ID NO: 677439 - RNA, 21 nt, Homo sapiens
gcugauggaccaggaagcccu

SEQ ID NO: 677440 - RNA, 13 nt, Homo sapiens
gcugauggcagcu

SEQ ID NO: 677441 - RNA, 16 nt, Homo sapiens
gcugauucaaaccaaa

SEQ ID NO: 677442 - RNA, 17 nt, Homo sapiens
gcugauuccagaacaaa

SEQ ID NO: 677443 - RNA, 22 nt, Homo sapiens
gcugcaaaauuaaaucuagaca

SEQ ID NO: 677444 - RNA, 15 nt, Homo sapiens
gcugcacauugccug

SEQ ID NO: 677445 - RNA, 19 nt, Homo sapiens
gcugcaccacuuccagggu

SEQ ID NO: 677446 - RNA, 16 nt, Homo sapiens
gcugcaccugccugcc

SEQ ID NO: 677447 - RNA, 21 nt, Homo sapiens
gcugcacucuugaacugggcg

SEQ ID NO: 677448 - RNA, 20 nt, Homo sapiens
gcugcagcugggccccaugc

SEQ ID NO: 677449 - RNA, 21 nt, Homo sapiens
gcugcagggacagcccugaca

SEQ ID NO: 677450 - RNA, 15 nt, Homo sapiens
gcugcagguggcaga

SEQ ID NO: 677451 - RNA, 21 nt, Homo sapiens
gcugcagguuuguaaugcaaa

SEQ ID NO: 677452 - RNA, 16 nt, Homo sapiens
gcugcagucccuggaa

SEQ ID NO: 677453 - RNA, 16 nt, Homo sapiens
gcugcauacuggccga

SEQ ID NO: 677454 - RNA, 11 nt, Homo sapiens
gcugcaucucc

SEQ ID NO: 677455 - RNA, 10 nt, Homo sapiens
gcugccaaau

SEQ ID NO: 677456 - RNA, 23 nt, Homo sapiens
gcugccaaccauaccuuccuucc

SEQ ID NO: 677457 - RNA, 16 nt, Homo sapiens
gcugccaagcacucga

SEQ ID NO: 677458 - RNA, 15 nt, Homo sapiens
uauuguuguugccaa

SEQ ID NO: 677459 - RNA, 23 nt, Homo sapiens
uauuuaaacaugguuacaaucau

SEQ ID NO: 677460 - RNA, 15 nt, Homo sapiens
uauuuaaacucgcuc

SEQ ID NO: 677461 - RNA, 20 nt, Homo sapiens
uauuuaaagaaaauaaacac

SEQ ID NO: 677462 - RNA, 18 nt, Homo sapiens
uauuuaaagccuccucau

SEQ ID NO: 677463 - RNA, 14 nt, Homo sapiens
uauuuaaagcuuuc

SEQ ID NO: 677464 - RNA, 16 nt, Homo sapiens
uauuuaaagcuuucaa

SEQ ID NO: 677465 - RNA, 23 nt, Homo sapiens
uauuuaaaggaaaaucacaucuc

SEQ ID NO: 677466 - RNA, 15 nt, Homo sapiens
uauuuaacaaaaagu

SEQ ID NO: 677467 - RNA, 16 nt, Homo sapiens
uauuuaagcaacaucu

SEQ ID NO: 677468 - RNA, 21 nt, Homo sapiens
uauuuaaggaaucaaaucuua

SEQ ID NO: 677469 - RNA, 17 nt, Homo sapiens
uauuuaaguauauagua

SEQ ID NO: 677470 - RNA, 14 nt, Homo sapiens
uauuuaagugcaau

SEQ ID NO: 677471 - RNA, 16 nt, Homo sapiens
uauuuaauaugucaaa

SEQ ID NO: 677472 - RNA, 22 nt, Homo sapiens
uauuuaaucaaacaguaaucua

SEQ ID NO: 677473 - RNA, 23 nt, Homo sapiens
uauuuacaaauguuuugcucaau

SEQ ID NO: 677474 - RNA, 22 nt, Homo sapiens
uauuuacagaaaagacucugac

SEQ ID NO: 677475 - RNA, 18 nt, Homo sapiens
uauuuacauacaggccau

SEQ ID NO: 677476 - RNA, 17 nt, Homo sapiens
uauuuaccagaccacaa

SEQ ID NO: 677477 - RNA, 12 nt, Homo sapiens
uauuuacuguua

SEQ ID NO: 677478 - RNA, 19 nt, Homo sapiens
uauuuacuuuuaccacuau

SEQ ID NO: 677479 - RNA, 18 nt, Homo sapiens
uauuuagauauaacacua

SEQ ID NO: 677480 - RNA, 13 nt, Homo sapiens
uauuuauaaacua

SEQ ID NO: 677481 - RNA, 21 nt, Homo sapiens
uauuuauaauuccuauauccu

SEQ ID NO: 677482 - RNA, 12 nt, Homo sapiens
uauuuauacucu

SEQ ID NO: 677483 - RNA, 13 nt, Homo sapiens
uauuuauacugua

SEQ ID NO: 677484 - RNA, 19 nt, Homo sapiens
uauuuaucagugacagagu

SEQ ID NO: 677485 - RNA, 21 nt, Homo sapiens
uauuuaugaccuuauaguguu

SEQ ID NO: 677486 - RNA, 18 nt, Homo sapiens
uauuuauguuugcacuug

SEQ ID NO: 677487 - RNA, 23 nt, Homo sapiens
uauuuauuacuuccucauaccac

SEQ ID NO: 677488 - RNA, 23 nt, Homo sapiens
uauuuauugcuguguaacacugu

SEQ ID NO: 677489 - RNA, 21 nt, Homo sapiens
uauuucaaaacacaucuuucc

SEQ ID NO: 677490 - RNA, 20 nt, Homo sapiens
uauuucaaaauauacauuca

SEQ ID NO: 677491 - RNA, 23 nt, Homo sapiens
uauuucaaauuguuuucagugaa

SEQ ID NO: 677492 - RNA, 18 nt, Homo sapiens
uauuucaagucucucacc

SEQ ID NO: 677493 - RNA, 16 nt, Homo sapiens
uauuucagccaugaua

SEQ ID NO: 677494 - RNA, 21 nt, Homo sapiens
uauuucagggaccucaggggc

SEQ ID NO: 677495 - RNA, 14 nt, Homo sapiens
uauuuccaaaagca

SEQ ID NO: 677496 - RNA, 13 nt, Homo sapiens
uauuuccacuugc

SEQ ID NO: 677497 - RNA, 22 nt, Homo sapiens
uauuuccguuuuccacuugugg

SEQ ID NO: 677498 - RNA, 21 nt, Homo sapiens
uauuuccucugugcaaaggga

SEQ ID NO: 677499 - RNA, 22 nt, Homo sapiens
uauuuccucugugcaaagggaa

SEQ ID NO: 677500 - RNA, 17 nt, Homo sapiens
uauuuccuucuccuccu

SEQ ID NO: 677501 - RNA, 20 nt, Homo sapiens
uauuuccuuuaugugaauuu

SEQ ID NO: 677502 - RNA, 21 nt, Homo sapiens
uauuucuaagaaauagagcca

SEQ ID NO: 677503 - RNA, 16 nt, Homo sapiens
uauuucuacugucaaa

SEQ ID NO: 677504 - RNA, 23 nt, Homo sapiens
uauuucuauguaaauuauuguaa

SEQ ID NO: 677505 - RNA, 19 nt, Homo sapiens
uauuucuauguguaugcaa

SEQ ID NO: 677506 - RNA, 17 nt, Homo sapiens
uauuucucaacaaagca

SEQ ID NO: 677507 - RNA, 21 nt, Homo sapiens
uauuucucaacaaagcacagu

SEQ ID NO: 677508 - RNA, 16 nt, Homo sapiens
uauuucuuuucaggga

SEQ ID NO: 677509 - RNA, 21 nt, Homo sapiens
uauuugaaaauuuuacuucca

SEQ ID NO: 677510 - RNA, 17 nt, Homo sapiens
uauuugaacacuuggug

SEQ ID NO: 677511 - RNA, 21 nt, Homo sapiens
uauuugaacuuauuuacacau

SEQ ID NO: 677512 - RNA, 18 nt, Homo sapiens
uauuugacuuaccaugga

SEQ ID NO: 677513 - RNA, 20 nt, Homo sapiens
uauuugcagaauacauucaa

SEQ ID NO: 677514 - RNA, 15 nt, Homo sapiens
uauuugcaguaugaa

SEQ ID NO: 677515 - RNA, 16 nt, Homo sapiens
uauuugcuaagcauau

SEQ ID NO: 677516 - RNA, 14 nt, Homo sapiens
uauuugcuauucaa

SEQ ID NO: 677517 - RNA, 20 nt, Homo sapiens
uauuugcugccagacacuga

SEQ ID NO: 677518 - RNA, 19 nt, Homo sapiens
uauuugcuuaaaauuguga

SEQ ID NO: 677519 - RNA, 21 nt, Homo sapiens
uauuugggagggaaaagggaa

SEQ ID NO: 677520 - RNA, 22 nt, Homo sapiens
uauuugggauauguauggguag

SEQ ID NO: 677521 - RNA, 14 nt, Homo sapiens
uauuuggguacaug

SEQ ID NO: 677522 - RNA, 13 nt, Homo sapiens
uauuuguauuaau

SEQ ID NO: 677523 - RNA, 21 nt, Homo sapiens
uauuuguauuaauaaagcauu

SEQ ID NO: 677524 - RNA, 16 nt, Homo sapiens
uauuuguggggugaga

SEQ ID NO: 677525 - RNA, 20 nt, Homo sapiens
uauuuguuuggugaauuugu

SEQ ID NO: 677526 - RNA, 21 nt, Homo sapiens
uauuuuaaaaauaaauucaaa

SEQ ID NO: 677527 - RNA, 17 nt, Homo sapiens
uauuuuaagaauuucac

SEQ ID NO: 677528 - RNA, 19 nt, Homo sapiens
uauuuuaagaauuucacaa

SEQ ID NO: 677529 - RNA, 19 nt, Homo sapiens
uauuuuaagagaaaacugc

SEQ ID NO: 677530 - RNA, 18 nt, Homo sapiens
uauuuuaaguaucagagg

SEQ ID NO: 677531 - RNA, 23 nt, Homo sapiens
uauuuuaauguauauuugcugca

SEQ ID NO: 677532 - RNA, 17 nt, Homo sapiens
uauuuuaugaacauugu

SEQ ID NO: 677533 - RNA, 19 nt, Homo sapiens
uauuuuauucccuuucaca

SEQ ID NO: 677534 - RNA, 21 nt, Homo sapiens
uauuuucagccuacaguuaug

SEQ ID NO: 677535 - RNA, 15 nt, Homo sapiens
uauuuucagcucaau

SEQ ID NO: 677536 - RNA, 21 nt, Homo sapiens
uauuuucccccuuuucugcau

SEQ ID NO: 677537 - RNA, 15 nt, Homo sapiens
uauuuucuauuuucc

SEQ ID NO: 677538 - RNA, 16 nt, Homo sapiens
uauuuucuauuuuccc

SEQ ID NO: 677539 - RNA, 20 nt, Homo sapiens
uauuuucuucuccagugguc

SEQ ID NO: 677540 - RNA, 19 nt, Homo sapiens
uauuuucuuuucuuucaac

SEQ ID NO: 677541 - RNA, 18 nt, Homo sapiens
uauuuugcauaguaccaa

SEQ ID NO: 677542 - RNA, 13 nt, Homo sapiens
uauuuugguucuu

SEQ ID NO: 677543 - RNA, 22 nt, Homo sapiens
uauuuugguugcaguuuccaau

SEQ ID NO: 677544 - RNA, 16 nt, Homo sapiens
uauuuuguugccuuca

SEQ ID NO: 677545 - RNA, 22 nt, Homo sapiens
uauuuuguugccuucaucuuca

SEQ ID NO: 677546 - RNA, 23 nt, Homo sapiens
uauuuuuaaccugccaacauacu

SEQ ID NO: 677547 - RNA, 23 nt, Homo sapiens
uauuuuucaaagauguguugcua

SEQ ID NO: 677548 - RNA, 16 nt, Homo sapiens
uauuuuugaagacuau

SEQ ID NO: 677549 - RNA, 12 nt, Homo sapiens
uauuuuugccaa

SEQ ID NO: 677550 - RNA, 23 nt, Homo sapiens
uauuuuugcccugaguccaagag

SEQ ID NO: 677551 - RNA, 20 nt, Homo sapiens
uauuuuuuaaaacacuaaaa

SEQ ID NO: 677552 - RNA, 20 nt, Homo sapiens
uauuuuuucuugcaaauacc

SEQ ID NO: 677553 - RNA, 12 nt, Homo sapiens
uauuuuuugcaa

SEQ ID NO: 677554 - RNA, 14 nt, Homo sapiens
uauuuuuugcaagu

SEQ ID NO: 677555 - RNA, 22 nt, Homo sapiens
ucaaaaaaaaaaaaaaaagccu

SEQ ID NO: 677556 - RNA, 23 nt, Homo sapiens
ucaaaaaaaaaaaaaagaaucca

SEQ ID NO: 677557 - RNA, 16 nt, Homo sapiens
ucaaaaaaccuuuaca

SEQ ID NO: 677558 - RNA, 15 nt, Homo sapiens
ucaaaaacauucuua

SEQ ID NO: 677559 - RNA, 14 nt, Homo sapiens
ucaaaaagaacaac

SEQ ID NO: 677560 - RNA, 18 nt, Homo sapiens
ucaaaaagggaaugcauu

SEQ ID NO: 677561 - RNA, 13 nt, Homo sapiens
ucaaaaaguucca

SEQ ID NO: 677562 - RNA, 20 nt, Homo sapiens
ucaaaacagagggcugcauu

SEQ ID NO: 677563 - RNA, 18 nt, Homo sapiens
ucaaaacauugugccaug

SEQ ID NO: 677564 - RNA, 20 nt, Homo sapiens
ucaaaacgacucuaaacaca

SEQ ID NO: 677565 - RNA, 12 nt, Homo sapiens
gcagagccuguc

SEQ ID NO: 677566 - RNA, 21 nt, Homo sapiens
gcagagcugagggcccugugg

SEQ ID NO: 677567 - RNA, 17 nt, Homo sapiens
gcagaggacgcacgcuc

SEQ ID NO: 677568 - RNA, 14 nt, Homo sapiens
gcagaggagccaug

SEQ ID NO: 677569 - RNA, 16 nt, Homo sapiens
gcagaggcaacacugg

SEQ ID NO: 677570 - RNA, 20 nt, Homo sapiens
gcagagguaaaagugugagc

SEQ ID NO: 677571 - RNA, 20 nt, Homo sapiens
gcagagguccacaacacaca

SEQ ID NO: 677572 - RNA, 17 nt, Homo sapiens
gcagaggugagaacuca

SEQ ID NO: 677573 - RNA, 13 nt, Homo sapiens
gcagagguugcag

SEQ ID NO: 677574 - RNA, 21 nt, Homo sapiens
gcagaguccuuauucuucuca

SEQ ID NO: 677575 - RNA, 22 nt, Homo sapiens
gcagagucugccccacaugugg

SEQ ID NO: 677576 - RNA, 17 nt, Homo sapiens
gcagaguuacaguucug

SEQ ID NO: 677577 - RNA, 14 nt, Homo sapiens
gcagaguucuccug

SEQ ID NO: 677578 - RNA, 15 nt, Homo sapiens
ucaaggaguacaaug

SEQ ID NO: 677579 - RNA, 20 nt, Homo sapiens
ucaaggcaguagaacuccag

SEQ ID NO: 677580 - RNA, 13 nt, Homo sapiens
ucaaggccuucag

SEQ ID NO: 677581 - RNA, 14 nt, Homo sapiens
ucaaggccuuccaa

SEQ ID NO: 677582 - RNA, 19 nt, Homo sapiens
ucaaggcuuccacugcaaa

SEQ ID NO: 677583 - RNA, 21 nt, Homo sapiens
ucaagggaacuugagcgugaa

SEQ ID NO: 677584 - RNA, 20 nt, Homo sapiens
ucaaggggcuggaaucucau

SEQ ID NO: 677585 - RNA, 21 nt, Homo sapiens
ucaaggucagcaugaggacag

SEQ ID NO: 677586 - RNA, 22 nt, Homo sapiens
ucaaggugaaauaaacagucua

SEQ ID NO: 677587 - RNA, 13 nt, Homo sapiens
ucaaguaauccac

SEQ ID NO: 677588 - RNA, 16 nt, Homo sapiens
ucaaguacaccagcca

SEQ ID NO: 677589 - RNA, 14 nt, Homo sapiens
ucaaguaccaaaac

SEQ ID NO: 677590 - RNA, 15 nt, Homo sapiens
ucaaguccaucugac

SEQ ID NO: 677591 - RNA, 18 nt, Homo sapiens
ucaagucuaaaccaagau

SEQ ID NO: 677592 - RNA, 12 nt, Homo sapiens
ucaagugcaguc

SEQ ID NO: 677593 - RNA, 12 nt, Homo sapiens
ucaaguggcaug

SEQ ID NO: 677594 - RNA, 18 nt, Homo sapiens
ucaagugucuuccaucau

SEQ ID NO: 677595 - RNA, 17 nt, Homo sapiens
ucaaguuaacaaggaau

SEQ ID NO: 677596 - RNA, 18 nt, Homo sapiens
ucaaguuaugaaauacuu

SEQ ID NO: 677597 - RNA, 16 nt, Homo sapiens
ucaaguugugcuuguu

SEQ ID NO: 677598 - RNA, 19 nt, Homo sapiens
ucaaguuguugacugugau

SEQ ID NO: 677599 - RNA, 21 nt, Homo sapiens
ucaaguuuuggguauguuuaa

SEQ ID NO: 677600 - RNA, 17 nt, Homo sapiens
ucaauaaaaaucugcuc

SEQ ID NO: 677601 - RNA, 21 nt, Homo sapiens
ucaauaaaaugaaccugauca

SEQ ID NO: 677602 - RNA, 19 nt, Homo sapiens
ucaauaaagauuucaagau

SEQ ID NO: 677603 - RNA, 16 nt, Homo sapiens
ucaauaaaguacaaga

SEQ ID NO: 677604 - RNA, 19 nt, Homo sapiens
ucaauacaaccagcccaac

SEQ ID NO: 677605 - RNA, 19 nt, Homo sapiens
ucaauaccgcucaguauuu

SEQ ID NO: 677606 - RNA, 12 nt, Homo sapiens
ucaauagcuguc

SEQ ID NO: 677607 - RNA, 18 nt, Homo sapiens
ucaauaugcaagcagcuu

SEQ ID NO: 677608 - RNA, 16 nt, Homo sapiens
ucaaucaaguuuacau

SEQ ID NO: 677609 - RNA, 20 nt, Homo sapiens
ucaaucaauggugcaaaaaa

SEQ ID NO: 677610 - RNA, 18 nt, Homo sapiens
ucaaucagugcagugaua

SEQ ID NO: 677611 - RNA, 18 nt, Homo sapiens
ucaauccaggcuacaauc

SEQ ID NO: 677612 - RNA, 15 nt, Homo sapiens
ucaauccucuaagcu

SEQ ID NO: 677613 - RNA, 12 nt, Homo sapiens
ucaauccuguca

SEQ ID NO: 677614 - RNA, 18 nt, Homo sapiens
ucaauccugucauauaau

SEQ ID NO: 677615 - RNA, 23 nt, Homo sapiens
ucaaugaaaaaaaguacauguau

SEQ ID NO: 677616 - RNA, 23 nt, Homo sapiens
ucaaugcaagagugauugcagcu

SEQ ID NO: 677617 - RNA, 15 nt, Homo sapiens
ucaaugccaacuuuu

SEQ ID NO: 677618 - RNA, 20 nt, Homo sapiens
ucaaugccucacgagauuug

SEQ ID NO: 677619 - RNA, 16 nt, Homo sapiens
ucaauggcuuguucau

SEQ ID NO: 677620 - RNA, 18 nt, Homo sapiens
ucaaugggcucuuccaac

SEQ ID NO: 677621 - RNA, 15 nt, Homo sapiens
ucaaugguacucuaa

SEQ ID NO: 677622 - RNA, 15 nt, Homo sapiens
ucaaugucacuuaaa

SEQ ID NO: 677623 - RNA, 13 nt, Homo sapiens
ucaaugucuuccc

SEQ ID NO: 677624 - RNA, 14 nt, Homo sapiens
ucaauguguacaag

SEQ ID NO: 677625 - RNA, 13 nt, Homo sapiens
ucaauuacaaagc

SEQ ID NO: 677626 - RNA, 20 nt, Homo sapiens
ucaauuauacuaaaccucac

SEQ ID NO: 677627 - RNA, 20 nt, Homo sapiens
ucaauucuuagaauaucuaa

SEQ ID NO: 677628 - RNA, 18 nt, Homo sapiens
ucaauuguuaauuguaau

SEQ ID NO: 677629 - RNA, 12 nt, Homo sapiens
ucaauuuacuua

SEQ ID NO: 677630 - RNA, 15 nt, Homo sapiens
ucaauuucaacaugg

SEQ ID NO: 677631 - RNA, 15 nt, Homo sapiens
ucaauuucaguguau

SEQ ID NO: 677632 - RNA, 17 nt, Homo sapiens
ucaauuucccugacucc

SEQ ID NO: 677633 - RNA, 15 nt, Homo sapiens
ucaauuuccugaugc

SEQ ID NO: 677634 - RNA, 14 nt, Homo sapiens
ucaauuucucugag

SEQ ID NO: 677635 - RNA, 17 nt, Homo sapiens
ucaauuucucugaggac

SEQ ID NO: 677636 - RNA, 22 nt, Homo sapiens
ucaauuucuggaaaacugccuu

SEQ ID NO: 677637 - RNA, 13 nt, Homo sapiens
ucaauuugcugaa

SEQ ID NO: 677638 - RNA, 17 nt, Homo sapiens
ucaauuuggacuggugu

SEQ ID NO: 677639 - RNA, 22 nt, Homo sapiens
ucaauuuuaucccucaccugua

SEQ ID NO: 677640 - RNA, 19 nt, Homo sapiens
ucacaaaaaggcauaugca

SEQ ID NO: 677641 - RNA, 20 nt, Homo sapiens
ucacaaaaaggcauaugcaa

SEQ ID NO: 677642 - RNA, 18 nt, Homo sapiens
ucacaaaaucacuuuaag

SEQ ID NO: 677643 - RNA, 16 nt, Homo sapiens
ucacaaaccaugcaaa

SEQ ID NO: 677644 - RNA, 19 nt, Homo sapiens
ucacaaacuuuuauacucu

SEQ ID NO: 677645 - RNA, 16 nt, Homo sapiens
ucacaaaguccacuuu

SEQ ID NO: 677646 - RNA, 10 nt, Homo sapiens
ucacaaagug

SEQ ID NO: 677647 - RNA, 16 nt, Homo sapiens
ucacaaauaaaagcca

SEQ ID NO: 677648 - RNA, 17 nt, Homo sapiens
ucacaaauaaaagccaa

SEQ ID NO: 677649 - RNA, 13 nt, Homo sapiens
ucacaaauggaau

SEQ ID NO: 677650 - RNA, 13 nt, Homo sapiens
ucacaaaugggau

SEQ ID NO: 677651 - RNA, 19 nt, Homo sapiens
ucacaaaugucauugucua

SEQ ID NO: 677652 - RNA, 16 nt, Homo sapiens
ucacaaauugaucaag

SEQ ID NO: 677653 - RNA, 18 nt, Homo sapiens
ucacaaccaccuaaucag

SEQ ID NO: 677654 - RNA, 19 nt, Homo sapiens
ucacaaccguacaguuucu

SEQ ID NO: 677655 - RNA, 17 nt, Homo sapiens
ucacaaccucucugauc

SEQ ID NO: 677656 - RNA, 19 nt, Homo sapiens
ucacaaccucucugaucuu

SEQ ID NO: 677657 - RNA, 15 nt, Homo sapiens
ucacaagaagaccag

SEQ ID NO: 677658 - RNA, 18 nt, Homo sapiens
ucacaagaaguagcuuca

SEQ ID NO: 677659 - RNA, 14 nt, Homo sapiens
ucacaagaauuuaa

SEQ ID NO: 677660 - RNA, 20 nt, Homo sapiens
ucacaagaauuuaaaacgca

SEQ ID NO: 677661 - RNA, 13 nt, Homo sapiens
ucacaagcaugaa

SEQ ID NO: 677662 - RNA, 19 nt, Homo sapiens
ucacaagcaugaagugcug

SEQ ID NO: 677663 - RNA, 22 nt, Homo sapiens
ucacaaggcacaccagugcaag

SEQ ID NO: 677664 - RNA, 15 nt, Homo sapiens
ucacaauacaguaag

SEQ ID NO: 677665 - RNA, 19 nt, Homo sapiens
ucacaauacaguaaguaaa

SEQ ID NO: 677666 - RNA, 19 nt, Homo sapiens
ucacaaugaguuugggcau

SEQ ID NO: 677667 - RNA, 18 nt, Homo sapiens
ucacaauggaaaaccugg

SEQ ID NO: 677668 - RNA, 17 nt, Homo sapiens
ucacaauuaugugcaaa

SEQ ID NO: 677669 - RNA, 23 nt, Homo sapiens
ucacacaaccaugacgcacugcu

SEQ ID NO: 677670 - RNA, 21 nt, Homo sapiens
ucacacacuggaccccacugg

SEQ ID NO: 677671 - RNA, 19 nt, Homo sapiens
ucacacacuuucucuucaa

SEQ ID NO: 677672 - RNA, 21 nt, Homo sapiens
ucacacauauucuuaaugaca

SEQ ID NO: 677673 - RNA, 17 nt, Homo sapiens
ucacacauuacaaaguu

SEQ ID NO: 677674 - RNA, 22 nt, Homo sapiens
ucacaccauuuuguuuagacaa

SEQ ID NO: 677675 - RNA, 20 nt, Homo sapiens
ucacaccugacucugaaauc

SEQ ID NO: 677676 - RNA, 24 nt, Homo sapiens
ucacacugguuuggucaguuacaa

SEQ ID NO: 677677 - RNA, 16 nt, Homo sapiens
ucacagaauagcacaa

SEQ ID NO: 677678 - RNA, 12 nt, Homo sapiens
ucacagacauac

SEQ ID NO: 677679 - RNA, 18 nt, Homo sapiens
ucacagagugcauuguga

SEQ ID NO: 677680 - RNA, 15 nt, Homo sapiens
ucacagauuguucua

SEQ ID NO: 677681 - RNA, 20 nt, Homo sapiens
ucacagccaccccugagauc

SEQ ID NO: 677682 - RNA, 14 nt, Homo sapiens
ucacagcugcagcu

SEQ ID NO: 677683 - RNA, 16 nt, Homo sapiens
ucacagcugcuuucug

SEQ ID NO: 677684 - RNA, 16 nt, Homo sapiens
ucacagcuggacccug

SEQ ID NO: 677685 - RNA, 20 nt, Homo sapiens
ucacagggccccagaaggca

SEQ ID NO: 677686 - RNA, 19 nt, Homo sapiens
ucacaguaccuaugacuuu

SEQ ID NO: 677687 - RNA, 22 nt, Homo sapiens
ucacaguccuguccucuggauc

SEQ ID NO: 677688 - RNA, 18 nt, Homo sapiens
ucacagucucaguucucu

SEQ ID NO: 677689 - RNA, 19 nt, Homo sapiens
ucacagucucaguucucuu

SEQ ID NO: 677690 - RNA, 18 nt, Homo sapiens
ucacaguugacaaaaagc

SEQ ID NO: 677691 - RNA, 17 nt, Homo sapiens
gcauggucccugccuua

SEQ ID NO: 677692 - RNA, 16 nt, Homo sapiens
gcauggugcagugccg

SEQ ID NO: 677693 - RNA, 13 nt, Homo sapiens
gcauggugcaguu

SEQ ID NO: 677694 - RNA, 23 nt, Homo sapiens
gcauguccucauccuuuccugcc

SEQ ID NO: 677695 - RNA, 22 nt, Homo sapiens
gcaugucuacucagcauuugau

SEQ ID NO: 677696 - RNA, 18 nt, Homo sapiens
gcaugucucccuccaguc

SEQ ID NO: 677697 - RNA, 15 nt, Homo sapiens
gcaugucucugcuuc

SEQ ID NO: 677698 - RNA, 17 nt, Homo sapiens
gcaugucugcaccuccg

SEQ ID NO: 677699 - RNA, 20 nt, Homo sapiens
gcaugucuuaaaugcucaua

SEQ ID NO: 677700 - RNA, 21 nt, Homo sapiens
guaaagaaauauauaugauau

SEQ ID NO: 677701 - RNA, 15 nt, Homo sapiens
guaaagaaguuugau

SEQ ID NO: 677702 - RNA, 15 nt, Homo sapiens
guaaagacagaguga

SEQ ID NO: 677703 - RNA, 12 nt, Homo sapiens
guaaagacugua

SEQ ID NO: 677704 - RNA, 13 nt, Homo sapiens
guaaagauuuguu

SEQ ID NO: 677705 - RNA, 15 nt, Homo sapiens
guaaaggauauuaaa

SEQ ID NO: 677706 - RNA, 22 nt, Homo sapiens
guaaagguuuuuggaauuaugu

SEQ ID NO: 677707 - RNA, 14 nt, Homo sapiens
guaaagugauuaaa

SEQ ID NO: 677708 - RNA, 16 nt, Homo sapiens
guaaauaccugucaau

SEQ ID NO: 677709 - RNA, 16 nt, Homo sapiens
guaaauacuugcaguu

SEQ ID NO: 677710 - RNA, 15 nt, Homo sapiens
guaaauauucuuguc

SEQ ID NO: 677711 - RNA, 23 nt, Homo sapiens
guaaauccuuuuggaacauauag

SEQ ID NO: 677712 - RNA, 11 nt, Homo sapiens
guaaaugcucg

SEQ ID NO: 677713 - RNA, 23 nt, Homo sapiens
guaaaugcuuuuaaaugcucucu

SEQ ID NO: 677714 - RNA, 18 nt, Homo sapiens
guaaaugggggugcauuu

SEQ ID NO: 677715 - RNA, 21 nt, Homo sapiens
guaaaugggggugcauuugag

SEQ ID NO: 677716 - RNA, 23 nt, Homo sapiens
guaaauuaaauuaguucagccau

SEQ ID NO: 677717 - RNA, 19 nt, Homo sapiens
guaaauuauauuugugcua

SEQ ID NO: 677718 - RNA, 20 nt, Homo sapiens
guaaauugaaucaguauaaa

SEQ ID NO: 677719 - RNA, 19 nt, Homo sapiens
guaacaagaaaacauaaga

SEQ ID NO: 677720 - RNA, 14 nt, Homo sapiens
guaacaagccagau

SEQ ID NO: 677721 - RNA, 20 nt, Homo sapiens
guaacaaggugucuuuucca

SEQ ID NO: 677722 - RNA, 18 nt, Homo sapiens
guaacacaagccacagaa

SEQ ID NO: 677723 - RNA, 22 nt, Homo sapiens
guaacagauuuuguuggcauag

SEQ ID NO: 677724 - RNA, 15 nt, Homo sapiens
ugaaauuuacaaauc

SEQ ID NO: 677725 - RNA, 15 nt, Homo sapiens
ugaaauuuggcaaag

SEQ ID NO: 677726 - RNA, 21 nt, Homo sapiens
ugaaauuuguuauacuucaaa

SEQ ID NO: 677727 - RNA, 15 nt, Homo sapiens
ugaaauuuucaggua

SEQ ID NO: 677728 - RNA, 20 nt, Homo sapiens
ugaacaaaaaaaacaaaaag

SEQ ID NO: 677729 - RNA, 21 nt, Homo sapiens
ugaacaaagugaggagaauga

SEQ ID NO: 677730 - RNA, 18 nt, Homo sapiens
ugaacaacuguugggaua

SEQ ID NO: 677731 - RNA, 18 nt, Homo sapiens
ugaacaaucaaagcacuu

SEQ ID NO: 677732 - RNA, 20 nt, Homo sapiens
ugaacaaucaaagcacuugg

SEQ ID NO: 677733 - RNA, 20 nt, Homo sapiens
ugaacaauuaugaacaucca

SEQ ID NO: 677734 - RNA, 18 nt, Homo sapiens
ugaacaauucggugguaa

SEQ ID NO: 677735 - RNA, 13 nt, Homo sapiens
ugaacacaguguc

SEQ ID NO: 677736 - RNA, 19 nt, Homo sapiens
ugaacacuagucuguguaa

SEQ ID NO: 677737 - RNA, 12 nt, Homo sapiens
ugaacacugggg

SEQ ID NO: 677738 - RNA, 16 nt, Homo sapiens
ugaacagccaaaugca

SEQ ID NO: 677739 - RNA, 17 nt, Homo sapiens
ugaacaucauggacuga

SEQ ID NO: 677740 - RNA, 14 nt, Homo sapiens
ugaacaucccuuau

SEQ ID NO: 677741 - RNA, 21 nt, Homo sapiens
ugaacaucccuuuuucaauga

SEQ ID NO: 677742 - RNA, 11 nt, Homo sapiens
ugaacauucca

SEQ ID NO: 677743 - RNA, 15 nt, Homo sapiens
ugaacauuguacugu

SEQ ID NO: 677744 - RNA, 12 nt, Homo sapiens
ugaacauuucau

SEQ ID NO: 677745 - RNA, 23 nt, Homo sapiens
ugaacauuuugcaaaacuuauca

SEQ ID NO: 677746 - RNA, 13 nt, Homo sapiens
ugaaccaaagaga

SEQ ID NO: 677747 - RNA, 19 nt, Homo sapiens
ugaaccaaugcaagacgcc

SEQ ID NO: 677748 - RNA, 21 nt, Homo sapiens
ugaaccaaugcuuucucaugu

SEQ ID NO: 677749 - RNA, 20 nt, Homo sapiens
ugaaccagugauccaugucc

SEQ ID NO: 677750 - RNA, 14 nt, Homo sapiens
ugaaccauggugaa

SEQ ID NO: 677751 - RNA, 12 nt, Homo sapiens
ugaacccacugc

SEQ ID NO: 677752 - RNA, 18 nt, Homo sapiens
ugaacccgaggcugagaa

SEQ ID NO: 677753 - RNA, 22 nt, Homo sapiens
ugaacccgaggcugagaaucag

SEQ ID NO: 677754 - RNA, 15 nt, Homo sapiens
ugaacccucuugcca

SEQ ID NO: 677755 - RNA, 15 nt, Homo sapiens
ugaaccuauaagcag

SEQ ID NO: 677756 - RNA, 13 nt, Homo sapiens
ugaaccuguauaa

SEQ ID NO: 677757 - RNA, 19 nt, Homo sapiens
ugaacgcagaagaaagggu

SEQ ID NO: 677758 - RNA, 19 nt, Homo sapiens
ugaacgcuuaagucaucau

SEQ ID NO: 677759 - RNA, 21 nt, Homo sapiens
ugaacgucauugcgauuuauc

SEQ ID NO: 677760 - RNA, 22 nt, Homo sapiens
ugaacguccuuccuugacuguc

SEQ ID NO: 677761 - RNA, 15 nt, Homo sapiens
ugaacuaacugacag

SEQ ID NO: 677762 - RNA, 20 nt, Homo sapiens
ugaacuacuaaaguuuuaca

SEQ ID NO: 677763 - RNA, 22 nt, Homo sapiens
ugaacuagauugcaugcuuccu

SEQ ID NO: 677764 - RNA, 17 nt, Homo sapiens
ugaacuaggcugagcaa

SEQ ID NO: 677765 - RNA, 13 nt, Homo sapiens
ugaacuauaucag

SEQ ID NO: 677766 - RNA, 18 nt, Homo sapiens
ugaacuaugaacacuguc

SEQ ID NO: 677767 - RNA, 16 nt, Homo sapiens
ugaacucacccuggga

SEQ ID NO: 677768 - RNA, 17 nt, Homo sapiens
ugaacucagaccacuug

SEQ ID NO: 677769 - RNA, 22 nt, Homo sapiens
ugaacucagaccacuugcauua

SEQ ID NO: 677770 - RNA, 14 nt, Homo sapiens
ugaacucagcuauu

SEQ ID NO: 677771 - RNA, 22 nt, Homo sapiens
ugaacucccgccacauuuuagc

SEQ ID NO: 677772 - RNA, 13 nt, Homo sapiens
ugaacuccugcca

SEQ ID NO: 677773 - RNA, 20 nt, Homo sapiens
ugaacucucugccuguaaau

SEQ ID NO: 677774 - RNA, 15 nt, Homo sapiens
ugaacucuguaaaac

SEQ ID NO: 677775 - RNA, 12 nt, Homo sapiens
ugaacucuuaga

SEQ ID NO: 677776 - RNA, 16 nt, Homo sapiens
ugaacucuuaggcaca

SEQ ID NO: 677777 - RNA, 17 nt, Homo sapiens
ugaacugcaacacugga

SEQ ID NO: 677778 - RNA, 14 nt, Homo sapiens
ugaacugugcauag

SEQ ID NO: 677779 - RNA, 17 nt, Homo sapiens
ugaacuguggugccaca

SEQ ID NO: 677780 - RNA, 22 nt, Homo sapiens
ugaacuguggugccacaugacc

SEQ ID NO: 677781 - RNA, 13 nt, Homo sapiens
ugaacugugugua

SEQ ID NO: 677782 - RNA, 22 nt, Homo sapiens
ugaacuguuagguucugaugac

SEQ ID NO: 677783 - RNA, 13 nt, Homo sapiens
ugaacuugccuua

SEQ ID NO: 677784 - RNA, 17 nt, Homo sapiens
ugaacuuucacauagca

SEQ ID NO: 677785 - RNA, 18 nt, Homo sapiens
ugaacuuucacauagcac

SEQ ID NO: 677786 - RNA, 21 nt, Homo sapiens
ugaacuuuuuaagaugaggca

SEQ ID NO: 677787 - RNA, 17 nt, Homo sapiens
ugaagaaagccagacaa

SEQ ID NO: 677788 - RNA, 22 nt, Homo sapiens
ugaagaacacagcaugugccaa

SEQ ID NO: 677789 - RNA, 18 nt, Homo sapiens
ugaagaacaguaacugcc

SEQ ID NO: 677790 - RNA, 14 nt, Homo sapiens
ugaagaacugcacu

SEQ ID NO: 677791 - RNA, 21 nt, Homo sapiens
ugaagaacuuggcacacucuc

SEQ ID NO: 677792 - RNA, 14 nt, Homo sapiens
ugaagaauuauuca

SEQ ID NO: 677793 - RNA, 22 nt, Homo sapiens
ugaagaauuauucagugaauuu

SEQ ID NO: 677794 - RNA, 13 nt, Homo sapiens
ugaagacaggaug

SEQ ID NO: 677795 - RNA, 13 nt, Homo sapiens
ugaagaccaaaga

SEQ ID NO: 677796 - RNA, 15 nt, Homo sapiens
ugaagaccacaucca

SEQ ID NO: 677797 - RNA, 22 nt, Homo sapiens
ugaagacccaggagagacagag

SEQ ID NO: 677798 - RNA, 18 nt, Homo sapiens
ugaagacucacuucucag

SEQ ID NO: 677799 - RNA, 12 nt, Homo sapiens
ugaagacugggu

SEQ ID NO: 677800 - RNA, 14 nt, Homo sapiens
ugaagagaacugca

SEQ ID NO: 677801 - RNA, 18 nt, Homo sapiens
ugaagagaccaagacucu

SEQ ID NO: 677802 - RNA, 12 nt, Homo sapiens
ugaagagcuaau

SEQ ID NO: 677803 - RNA, 17 nt, Homo sapiens
ugaagagcuaauuuacu

SEQ ID NO: 677804 - RNA, 17 nt, Homo sapiens
ugaagagcugucuuccc

SEQ ID NO: 677805 - RNA, 19 nt, Homo sapiens
ugaagagcuugcuuugauu

SEQ ID NO: 677806 - RNA, 22 nt, Homo sapiens
ugaagaggaagggcaaaaccac

SEQ ID NO: 677807 - RNA, 17 nt, Homo sapiens
ugaagaggccuaaguca

SEQ ID NO: 677808 - RNA, 17 nt, Homo sapiens
ugaagagguugaagcua

SEQ ID NO: 677809 - RNA, 15 nt, Homo sapiens
ugaagaguaaaggaa

SEQ ID NO: 677810 - RNA, 19 nt, Homo sapiens
ugaagagugagagggcaug

SEQ ID NO: 677811 - RNA, 20 nt, Homo sapiens
ugaagaguuuacugaagcaa

SEQ ID NO: 677812 - RNA, 21 nt, Homo sapiens
ugaagauauucuacuaugcau

SEQ ID NO: 677813 - RNA, 16 nt, Homo sapiens
ugaagaucaagccagu

SEQ ID NO: 677814 - RNA, 13 nt, Homo sapiens
ugaagaucugaga

SEQ ID NO: 677815 - RNA, 21 nt, Homo sapiens
ugaagaugaaauauauauugu

SEQ ID NO: 677816 - RNA, 22 nt, Homo sapiens
ugaagauguggaucccuuuaga

SEQ ID NO: 677817 - RNA, 14 nt, Homo sapiens
ugaagauuauuuca

SEQ ID NO: 677818 - RNA, 11 nt, Homo sapiens
ugaagcaagag

SEQ ID NO: 677819 - RNA, 10 nt, Homo sapiens
ugaagcacaa

SEQ ID NO: 677820 - RNA, 19 nt, Homo sapiens
ugaagcacugagcagaagc

SEQ ID NO: 677821 - RNA, 18 nt, Homo sapiens
ugaagcagucagcccuua

SEQ ID NO: 677822 - RNA, 19 nt, Homo sapiens
guauaaguggaggcacuuu

SEQ ID NO: 677823 - RNA, 22 nt, Homo sapiens
guauaauagagauaaguccauu

SEQ ID NO: 677824 - RNA, 20 nt, Homo sapiens
guauaauugaccuacuuugg

SEQ ID NO: 677825 - RNA, 14 nt, Homo sapiens
guauaauuguguug

SEQ ID NO: 677826 - RNA, 22 nt, Homo sapiens
guauaauuugaggugaaauuca

SEQ ID NO: 677827 - RNA, 13 nt, Homo sapiens
guauacaugugug

SEQ ID NO: 677828 - RNA, 17 nt, Homo sapiens
guauacccucuguuucc

SEQ ID NO: 677829 - RNA, 16 nt, Homo sapiens
guauacuauaguacca

SEQ ID NO: 677830 - RNA, 19 nt, Homo sapiens
guauacugugugggauacu

SEQ ID NO: 677831 - RNA, 22 nt, Homo sapiens
guauacuuuaguagacauuuau

SEQ ID NO: 677832 - RNA, 21 nt, Homo sapiens
guauacuuuuagcuuguaguu

SEQ ID NO: 677833 - RNA, 15 nt, Homo sapiens
guauagaccaaagca

SEQ ID NO: 677834 - RNA, 23 nt, Homo sapiens
guauaguagaaagacaucugccu

SEQ ID NO: 677835 - RNA, 13 nt, Homo sapiens
guauagugucuau

SEQ ID NO: 677836 - RNA, 12 nt, Homo sapiens
guauauaaucca

SEQ ID NO: 677837 - RNA, 14 nt, Homo sapiens
guauauacccaaag

SEQ ID NO: 677838 - RNA, 17 nt, Homo sapiens
guauauaguaugaaugc

SEQ ID NO: 677839 - RNA, 14 nt, Homo sapiens
guauauauaauacu

SEQ ID NO: 677840 - RNA, 18 nt, Homo sapiens
guauauauguauaugugc

SEQ ID NO: 677841 - RNA, 19 nt, Homo sapiens
guauauauguguaugcaca

SEQ ID NO: 677842 - RNA, 23 nt, Homo sapiens
guauaucaugaaacacuucucau

SEQ ID NO: 677843 - RNA, 20 nt, Homo sapiens
guauaugauucucugugguu

SEQ ID NO: 677844 - RNA, 22 nt, Homo sapiens
guauauguagauguaugcacac

SEQ ID NO: 677845 - RNA, 12 nt, Homo sapiens
guauauguauaa

SEQ ID NO: 677846 - RNA, 23 nt, Homo sapiens
guauauguucagcagugugccca

SEQ ID NO: 677847 - RNA, 14 nt, Homo sapiens
guauauugucagau

SEQ ID NO: 677848 - RNA, 22 nt, Homo sapiens
guauauuuuaaaaauaaauuca

SEQ ID NO: 677849 - RNA, 21 nt, Homo sapiens
ugacagaucaagcugugagac

SEQ ID NO: 677850 - RNA, 22 nt, Homo sapiens
ugacagaucauaggaaguggcu

SEQ ID NO: 677851 - RNA, 18 nt, Homo sapiens
ugacagcccgcaggauca

SEQ ID NO: 677852 - RNA, 16 nt, Homo sapiens
ugacagccugcagcag

SEQ ID NO: 677853 - RNA, 16 nt, Homo sapiens
ugacagccuugcccac

SEQ ID NO: 677854 - RNA, 15 nt, Homo sapiens
ugacagcucuucaca

SEQ ID NO: 677855 - RNA, 19 nt, Homo sapiens
ugacagcuuugcugcugaa

SEQ ID NO: 677856 - RNA, 18 nt, Homo sapiens
ugacaggcccaguggaac

SEQ ID NO: 677857 - RNA, 15 nt, Homo sapiens
ugacagggccagugc

SEQ ID NO: 677858 - RNA, 17 nt, Homo sapiens
ugacaguaaaucucaca

SEQ ID NO: 677859 - RNA, 20 nt, Homo sapiens
ugacaguaaaucucacaaau

SEQ ID NO: 677860 - RNA, 22 nt, Homo sapiens
ugacagucauaaauacugucaa

SEQ ID NO: 677861 - RNA, 17 nt, Homo sapiens
ugacaguccacaggggc

SEQ ID NO: 677862 - RNA, 22 nt, Homo sapiens
ugacaguuaauaaaccuuugca

SEQ ID NO: 677863 - RNA, 17 nt, Homo sapiens
ugacaguugcagcccuu

SEQ ID NO: 677864 - RNA, 16 nt, Homo sapiens
ugacaguuuguggcau

SEQ ID NO: 677865 - RNA, 18 nt, Homo sapiens
ugacauaaccaacauuaa

SEQ ID NO: 677866 - RNA, 14 nt, Homo sapiens
ugacauagccucau

SEQ ID NO: 677867 - RNA, 18 nt, Homo sapiens
ugacauauauauguauau

SEQ ID NO: 677868 - RNA, 18 nt, Homo sapiens
ugacauauucaagugaua

SEQ ID NO: 677869 - RNA, 13 nt, Homo sapiens
ugacauauuuaau

SEQ ID NO: 677870 - RNA, 17 nt, Homo sapiens
ugacaucaaaaugaguc

SEQ ID NO: 677871 - RNA, 16 nt, Homo sapiens
ugacaucaguggcaug

SEQ ID NO: 677872 - RNA, 13 nt, Homo sapiens
ugacauccagaaa

SEQ ID NO: 677873 - RNA, 19 nt, Homo sapiens
ugacaucccuuccuggaaa

SEQ ID NO: 677874 - RNA, 19 nt, Homo sapiens
ugacaucucaggggccaga

SEQ ID NO: 677875 - RNA, 16 nt, Homo sapiens
ugacaugauauacaau

SEQ ID NO: 677876 - RNA, 22 nt, Homo sapiens
ugacaugcagauucagugcaau

SEQ ID NO: 677877 - RNA, 21 nt, Homo sapiens
ugacaugugcuggacacuguc

SEQ ID NO: 677878 - RNA, 17 nt, Homo sapiens
ugacauuaaaugcaaua

SEQ ID NO: 677879 - RNA, 13 nt, Homo sapiens
ugacauuacaauc

SEQ ID NO: 677880 - RNA, 18 nt, Homo sapiens
ugacauuagcauuguggu

SEQ ID NO: 677881 - RNA, 14 nt, Homo sapiens
ugacauuauaugca

SEQ ID NO: 677882 - RNA, 14 nt, Homo sapiens
ugacauuccuucuc

SEQ ID NO: 677883 - RNA, 22 nt, Homo sapiens
ugacauucugauucgaaugaca

SEQ ID NO: 677884 - RNA, 17 nt, Homo sapiens
ugacauucuuagcugua

SEQ ID NO: 677885 - RNA, 19 nt, Homo sapiens
ugacauugauuugcucuua

SEQ ID NO: 677886 - RNA, 15 nt, Homo sapiens
ugacauugccaaaaa

SEQ ID NO: 677887 - RNA, 22 nt, Homo sapiens
ugacauuuauauuuguguauuu

SEQ ID NO: 677888 - RNA, 18 nt, Homo sapiens
ugacauuucacugaugcu

SEQ ID NO: 677889 - RNA, 15 nt, Homo sapiens
ugacauuugguggua

SEQ ID NO: 677890 - RNA, 22 nt, Homo sapiens
ugaccaaaaucaggaaccacag

SEQ ID NO: 677891 - RNA, 12 nt, Homo sapiens
ugaccaaauggc

SEQ ID NO: 677892 - RNA, 13 nt, Homo sapiens
ugaccaacugugu

SEQ ID NO: 677893 - RNA, 15 nt, Homo sapiens
ugaccaagaacugca

SEQ ID NO: 677894 - RNA, 22 nt, Homo sapiens
ugaccaagacagguucagguag

SEQ ID NO: 677895 - RNA, 18 nt, Homo sapiens
ugaccaagacugagccag

SEQ ID NO: 677896 - RNA, 22 nt, Homo sapiens
ugaccaauauuauacuaagaaa

SEQ ID NO: 677897 - RNA, 18 nt, Homo sapiens
ugaccacauaagaaggca

SEQ ID NO: 677898 - RNA, 16 nt, Homo sapiens
ugaccagcaaauacuc

SEQ ID NO: 677899 - RNA, 16 nt, Homo sapiens
ugaccagcaacuuguc

SEQ ID NO: 677900 - RNA, 17 nt, Homo sapiens
ugaccaggcgcccggga

SEQ ID NO: 677901 - RNA, 13 nt, Homo sapiens
ugaccagugcagu

SEQ ID NO: 677902 - RNA, 13 nt, Homo sapiens
ugaccauaugacc

SEQ ID NO: 677903 - RNA, 14 nt, Homo sapiens
ugaccauucugccu

SEQ ID NO: 677904 - RNA, 16 nt, Homo sapiens
ugaccauuucaggggu

SEQ ID NO: 677905 - RNA, 18 nt, Homo sapiens
ugacccaagagaacucac

SEQ ID NO: 677906 - RNA, 15 nt, Homo sapiens
ugacccagccugaaa

SEQ ID NO: 677907 - RNA, 18 nt, Homo sapiens
ugacccccaucugagcug

SEQ ID NO: 677908 - RNA, 16 nt, Homo sapiens
ugaccccugaccucac

SEQ ID NO: 677909 - RNA, 18 nt, Homo sapiens
ugacccuucuccaaaggc

SEQ ID NO: 677910 - RNA, 15 nt, Homo sapiens
ugacccuuguggcac

SEQ ID NO: 677911 - RNA, 23 nt, Homo sapiens
ugacccuugugucucauauaccc

SEQ ID NO: 677912 - RNA, 23 nt, Homo sapiens
ugaccgaccccuccccagugccu

SEQ ID NO: 677913 - RNA, 19 nt, Homo sapiens
ugaccggcagaauguucug

SEQ ID NO: 677914 - RNA, 22 nt, Homo sapiens
ugaccuaccucaaagggcaguu

SEQ ID NO: 677915 - RNA, 19 nt, Homo sapiens
ugaccuaguagaguguaau

SEQ ID NO: 677916 - RNA, 23 nt, Homo sapiens
ugaccucacuuuaggcagcugua

SEQ ID NO: 677917 - RNA, 12 nt, Homo sapiens
ugaccucagcug

SEQ ID NO: 677918 - RNA, 14 nt, Homo sapiens
ugaccucaggugau

SEQ ID NO: 677919 - RNA, 17 nt, Homo sapiens
ugaccucaggugaucca

SEQ ID NO: 677920 - RNA, 14 nt, Homo sapiens
ugaccucccaguga

SEQ ID NO: 677921 - RNA, 20 nt, Homo sapiens
ugaccucgcccuccacaaau

SEQ ID NO: 677922 - RNA, 16 nt, Homo sapiens
ugaccucugccccaga

SEQ ID NO: 677923 - RNA, 18 nt, Homo sapiens
ugaccuggaaucagugaa

SEQ ID NO: 677924 - RNA, 19 nt, Homo sapiens
ugaccugucuauaagagaa

SEQ ID NO: 677925 - RNA, 17 nt, Homo sapiens
ugaccuuaaaugcaacc

SEQ ID NO: 677926 - RNA, 18 nt, Homo sapiens
ugaccuucccacacaauc

SEQ ID NO: 677927 - RNA, 20 nt, Homo sapiens
ugaccuuccuucaagaggac

SEQ ID NO: 677928 - RNA, 18 nt, Homo sapiens
ugaccuugggguacaauu

SEQ ID NO: 677929 - RNA, 16 nt, Homo sapiens
ugaccuuuagguauua

SEQ ID NO: 677930 - RNA, 15 nt, Homo sapiens
ugaccuuuguccuua

SEQ ID NO: 677931 - RNA, 14 nt, Homo sapiens
ugaccuuugucuca

SEQ ID NO: 677932 - RNA, 14 nt, Homo sapiens
ugacgacagugcau

SEQ ID NO: 677933 - RNA, 16 nt, Homo sapiens
ugacgcaccacugcca

SEQ ID NO: 677934 - RNA, 16 nt, Homo sapiens
ugacgcacugcucaag

SEQ ID NO: 677935 - RNA, 19 nt, Homo sapiens
ugacgcauucucguaucca

SEQ ID NO: 677936 - RNA, 19 nt, Homo sapiens
ugacggcaccaucuggaag

SEQ ID NO: 677937 - RNA, 21 nt, Homo sapiens
ugacggcccucaucuaugagg

SEQ ID NO: 677938 - RNA, 16 nt, Homo sapiens
ugacggcuggggaccc

SEQ ID NO: 677939 - RNA, 17 nt, Homo sapiens
ugacgguguccaugccu

SEQ ID NO: 677940 - RNA, 18 nt, Homo sapiens
ugacguauauauaaacag

SEQ ID NO: 677941 - RNA, 12 nt, Homo sapiens
ugacuaaacaac

SEQ ID NO: 677942 - RNA, 20 nt, Homo sapiens
ugacuaaacaacuaccuccu

SEQ ID NO: 677943 - RNA, 22 nt, Homo sapiens
ugacuaaucagaugauggccau

SEQ ID NO: 677944 - RNA, 19 nt, Homo sapiens
gugauauuuuuaugugcag

SEQ ID NO: 677945 - RNA, 22 nt, Homo sapiens
gugaucagaccauaauguuaca

SEQ ID NO: 677946 - RNA, 12 nt, Homo sapiens
gugaucucaggg

SEQ ID NO: 677947 - RNA, 19 nt, Homo sapiens
gugaucuucccacaccagc

SEQ ID NO: 677948 - RNA, 12 nt, Homo sapiens
gugaugaugcug

SEQ ID NO: 677949 - RNA, 13 nt, Homo sapiens
gugaugaugcugu

SEQ ID NO: 677950 - RNA, 17 nt, Homo sapiens
gugaugaugcugugaca

SEQ ID NO: 677951 - RNA, 16 nt, Homo sapiens
gugaugauguuuugau

SEQ ID NO: 677952 - RNA, 23 nt, Homo sapiens
gugaugcaguuaguauagcuuua

SEQ ID NO: 677953 - RNA, 16 nt, Homo sapiens
gugauggacacuccag

SEQ ID NO: 677954 - RNA, 23 nt, Homo sapiens
gugauggagaugcagucacuuau

SEQ ID NO: 677955 - RNA, 13 nt, Homo sapiens
gugauggcuaugc

SEQ ID NO: 677956 - RNA, 20 nt, Homo sapiens
gugauggcuaugccuugcac

SEQ ID NO: 677957 - RNA, 21 nt, Homo sapiens
gugauguugaaauaugcauac

SEQ ID NO: 677958 - RNA, 14 nt, Homo sapiens
gugauguuugcucu

SEQ ID NO: 677959 - RNA, 16 nt, Homo sapiens
gugauuaacaucuaca

SEQ ID NO: 677960 - RNA, 22 nt, Homo sapiens
gugauuauuuuuuauacuguau

SEQ ID NO: 677961 - RNA, 14 nt, Homo sapiens
gugauucaccucuu

SEQ ID NO: 677962 - RNA, 23 nt, Homo sapiens
gugauucuaaggcaggaauuuga

SEQ ID NO: 677963 - RNA, 23 nt, Homo sapiens
gugauucucuugacguuuacaua

SEQ ID NO: 677964 - RNA, 14 nt, Homo sapiens
gugauugcugccau

SEQ ID NO: 677965 - RNA, 13 nt, Homo sapiens
gugauuucagaga

SEQ ID NO: 677966 - RNA, 19 nt, Homo sapiens
gugauuucagagagggcag

SEQ ID NO: 677967 - RNA, 15 nt, Homo sapiens
gugauuuccagugag

SEQ ID NO: 677968 - RNA, 19 nt, Homo sapiens
gugcaaaaaaaaacuuaaa

SEQ ID NO: 677969 - RNA, 22 nt, Homo sapiens
gugcaagaccgagauugaggga

SEQ ID NO: 677970 - RNA, 20 nt, Homo sapiens
gugcaagaugaaugcagauu

SEQ ID NO: 677971 - RNA, 15 nt, Homo sapiens
gugcaaguguguaug

SEQ ID NO: 677972 - RNA, 13 nt, Homo sapiens
gugcaauauguga

SEQ ID NO: 677973 - RNA, 19 nt, Homo sapiens
gugcaauggcgcgaucuca

SEQ ID NO: 677974 - RNA, 17 nt, Homo sapiens
gugcacacguguguaug

SEQ ID NO: 677975 - RNA, 14 nt, Homo sapiens
gugcacaguggcuu

SEQ ID NO: 677976 - RNA, 19 nt, Homo sapiens
gugcacccucuaucccaau

SEQ ID NO: 677977 - RNA, 17 nt, Homo sapiens
gugcaccgaguggccau

SEQ ID NO: 677978 - RNA, 14 nt, Homo sapiens
gugcacucacuccu

SEQ ID NO: 677979 - RNA, 17 nt, Homo sapiens
gugcacucucugcuuag

SEQ ID NO: 677980 - RNA, 14 nt, Homo sapiens
gugcacucugcuaa

SEQ ID NO: 677981 - RNA, 21 nt, Homo sapiens
gugcacugacagccuugccca

SEQ ID NO: 677982 - RNA, 16 nt, Homo sapiens
gugcacugacugugaa

SEQ ID NO: 677983 - RNA, 22 nt, Homo sapiens
gugcacuuuaagaggugggagc

SEQ ID NO: 677984 - RNA, 14 nt, Homo sapiens
gugcagaaggcaau

SEQ ID NO: 677985 - RNA, 17 nt, Homo sapiens
gugcagaccuuggggga

SEQ ID NO: 677986 - RNA, 12 nt, Homo sapiens
gugcagacucaa

SEQ ID NO: 677987 - RNA, 19 nt, Homo sapiens
gugcagacugaugggacau

SEQ ID NO: 677988 - RNA, 18 nt, Homo sapiens
gugcagauaucacagagg

SEQ ID NO: 677989 - RNA, 21 nt, Homo sapiens
gugcagccaaguagccucucc

SEQ ID NO: 677990 - RNA, 17 nt, Homo sapiens
gugcagcgggugcugcu

SEQ ID NO: 677991 - RNA, 22 nt, Homo sapiens
gugcagcuccucagcggcucca

SEQ ID NO: 677992 - RNA, 14 nt, Homo sapiens
gugcagcugucaca

SEQ ID NO: 677993 - RNA, 16 nt, Homo sapiens
gugcagggacaaagag

SEQ ID NO: 677994 - RNA, 22 nt, Homo sapiens
gugcagggaggaaaagugcaag

SEQ ID NO: 677995 - RNA, 16 nt, Homo sapiens
gugcaguagccguuug

SEQ ID NO: 677996 - RNA, 19 nt, Homo sapiens
gugcagugccaccaucaua

SEQ ID NO: 677997 - RNA, 13 nt, Homo sapiens
uggaagaccccac

SEQ ID NO: 677998 - RNA, 16 nt, Homo sapiens
uggaagagcacaagag

SEQ ID NO: 677999 - RNA, 20 nt, Homo sapiens
uggaagaguguuucuuccac

SEQ ID NO: 678000 - RNA, 12 nt, Homo sapiens
uggaagauuugu

SEQ ID NO: 678001 - RNA, 15 nt, Homo sapiens
uggaagcacagagug

SEQ ID NO: 678002 - RNA, 16 nt, Homo sapiens
uggaagcccuccuucc

SEQ ID NO: 678003 - RNA, 13 nt, Homo sapiens
uggaagccuauaa

SEQ ID NO: 678004 - RNA, 11 nt, Homo sapiens
uggaagccugc

SEQ ID NO: 678005 - RNA, 18 nt, Homo sapiens
uggaagcuguguccuugc

SEQ ID NO: 678006 - RNA, 12 nt, Homo sapiens
uggaagcuguuc

SEQ ID NO: 678007 - RNA, 18 nt, Homo sapiens
uggaaggcuucuccgccc

SEQ ID NO: 678008 - RNA, 17 nt, Homo sapiens
uggaagggaccaagcga

SEQ ID NO: 678009 - RNA, 14 nt, Homo sapiens
uggaaguaaagccu

SEQ ID NO: 678010 - RNA, 15 nt, Homo sapiens
uggaagugcuugaua

SEQ ID NO: 678011 - RNA, 23 nt, Homo sapiens
uggaaguuaaagggcauuuccaa

SEQ ID NO: 678012 - RNA, 20 nt, Homo sapiens
uggaaguuauuaacuuuaau

SEQ ID NO: 678013 - RNA, 15 nt, Homo sapiens
uggaaguugcaguga

SEQ ID NO: 678014 - RNA, 16 nt, Homo sapiens
uggaaguuguugcuau

SEQ ID NO: 678015 - RNA, 15 nt, Homo sapiens
uggaauaaaacuguc

SEQ ID NO: 678016 - RNA, 17 nt, Homo sapiens
uggaauaaaacugucuc

SEQ ID NO: 678017 - RNA, 13 nt, Homo sapiens
uggaauaaaguca

SEQ ID NO: 678018 - RNA, 17 nt, Homo sapiens
uggaauaacuaucucac

SEQ ID NO: 678019 - RNA, 15 nt, Homo sapiens
uggaauaacucugug

SEQ ID NO: 678020 - RNA, 12 nt, Homo sapiens
uggaauaaggca

SEQ ID NO: 678021 - RNA, 20 nt, Homo sapiens
uggaauauaucaguaccucu

SEQ ID NO: 678022 - RNA, 21 nt, Homo sapiens
uggaaucacaaaccaagccau

SEQ ID NO: 678023 - RNA, 22 nt, Homo sapiens
uggaaucacaaaccaagccaug

SEQ ID NO: 678024 - RNA, 23 nt, Homo sapiens
uggaaucagugaagccaaaggga

SEQ ID NO: 678025 - RNA, 15 nt, Homo sapiens
uggaauccaaccucc

SEQ ID NO: 678026 - RNA, 16 nt, Homo sapiens
uggaaucuaagcuguu

SEQ ID NO: 678027 - RNA, 17 nt, Homo sapiens
uggaaucuacaagccaa

SEQ ID NO: 678028 - RNA, 15 nt, Homo sapiens
uggaaucuagccgau

SEQ ID NO: 678029 - RNA, 19 nt, Homo sapiens
uggaaucuucucuuugaca

SEQ ID NO: 678030 - RNA, 19 nt, Homo sapiens
uggaaugaagaccaugccu

SEQ ID NO: 678031 - RNA, 20 nt, Homo sapiens
uggaaugaagaccaugccua

SEQ ID NO: 678032 - RNA, 13 nt, Homo sapiens
uggaauguaauca

SEQ ID NO: 678033 - RNA, 15 nt, Homo sapiens
uggaauuacugccuu

SEQ ID NO: 678034 - RNA, 19 nt, Homo sapiens
uggaauuaugucugcugaa

SEQ ID NO: 678035 - RNA, 17 nt, Homo sapiens
uggaauucccuccugag

SEQ ID NO: 678036 - RNA, 20 nt, Homo sapiens
uggaauucuaacaagucaua

SEQ ID NO: 678037 - RNA, 14 nt, Homo sapiens
uggaauucuacugg

SEQ ID NO: 678038 - RNA, 17 nt, Homo sapiens
uggaauucuacuggaaa

SEQ ID NO: 678039 - RNA, 13 nt, Homo sapiens
uggaauugcucaa

SEQ ID NO: 678040 - RNA, 23 nt, Homo sapiens
uggaauuuucucacgcaggagcc

SEQ ID NO: 678041 - RNA, 15 nt, Homo sapiens
uggaauuuugcaaag

SEQ ID NO: 678042 - RNA, 22 nt, Homo sapiens
uggacaaaauuaauacauucua

SEQ ID NO: 678043 - RNA, 13 nt, Homo sapiens
uggacaacacuga

SEQ ID NO: 678044 - RNA, 20 nt, Homo sapiens
uggacaaggagugugaccac

SEQ ID NO: 678045 - RNA, 17 nt, Homo sapiens
uggacacaacaccaaaa

SEQ ID NO: 678046 - RNA, 13 nt, Homo sapiens
uggacacagaucc

SEQ ID NO: 678047 - RNA, 22 nt, Homo sapiens
uggacacccccagcugacuguu

SEQ ID NO: 678048 - RNA, 15 nt, Homo sapiens
uggacacucuauaug

SEQ ID NO: 678049 - RNA, 13 nt, Homo sapiens
uggacacugagag

SEQ ID NO: 678050 - RNA, 10 nt, Homo sapiens
uggacacugu

SEQ ID NO: 678051 - RNA, 24 nt, Homo sapiens
uggacacuguccaugaagcacuga

SEQ ID NO: 678052 - RNA, 23 nt, Homo sapiens
uggacacuuugaaauguguuucu

SEQ ID NO: 678053 - RNA, 13 nt, Homo sapiens
uggacagacacug

SEQ ID NO: 678054 - RNA, 18 nt, Homo sapiens
uggacagacacuguugca

SEQ ID NO: 678055 - RNA, 12 nt, Homo sapiens
uggacagccagu

SEQ ID NO: 678056 - RNA, 15 nt, Homo sapiens
uggacagccagugac

SEQ ID NO: 678057 - RNA, 16 nt, Homo sapiens
uggacagcuuugcucc

SEQ ID NO: 678058 - RNA, 22 nt, Homo sapiens
uggacaggaggcccccaucuau

SEQ ID NO: 678059 - RNA, 15 nt, Homo sapiens
uggacauaagacaga

SEQ ID NO: 678060 - RNA, 13 nt, Homo sapiens
uggacaugauuua

SEQ ID NO: 678061 - RNA, 15 nt, Homo sapiens
uggaccacugcauga

SEQ ID NO: 678062 - RNA, 21 nt, Homo sapiens
uggaccacuuacagugugaua

SEQ ID NO: 678063 - RNA, 19 nt, Homo sapiens
uggaccagcccauuggccg

SEQ ID NO: 678064 - RNA, 22 nt, Homo sapiens
uggaccagucccgucgugcagu

SEQ ID NO: 678065 - RNA, 13 nt, Homo sapiens
uggaccauuccag

SEQ ID NO: 678066 - RNA, 22 nt, Homo sapiens
uggacccaaaaaaucaucucac

SEQ ID NO: 678067 - RNA, 23 nt, Homo sapiens
guguaaauugcacagagcacacu

SEQ ID NO: 678068 - RNA, 14 nt, Homo sapiens
guguaacaggucuc

SEQ ID NO: 678069 - RNA, 23 nt, Homo sapiens
guguaagguuuugguuauggagu

SEQ ID NO: 678070 - RNA, 14 nt, Homo sapiens
guguaauaugcaca

SEQ ID NO: 678071 - RNA, 19 nt, Homo sapiens
guguaauggaaaccaagga

SEQ ID NO: 678072 - RNA, 17 nt, Homo sapiens
guguaauuuuguucuag

SEQ ID NO: 678073 - RNA, 14 nt, Homo sapiens
guguacagugaauu

SEQ ID NO: 678074 - RNA, 15 nt, Homo sapiens
guguaccuccucuca

SEQ ID NO: 678075 - RNA, 12 nt, Homo sapiens
guguacugugga

SEQ ID NO: 678076 - RNA, 19 nt, Homo sapiens
guguagaggguguuugcag

SEQ ID NO: 678077 - RNA, 15 nt, Homo sapiens
guguagcuuugcucu

SEQ ID NO: 678078 - RNA, 12 nt, Homo sapiens
guguaggggcca

SEQ ID NO: 678079 - RNA, 19 nt, Homo sapiens
guguauauaaauacaugca

SEQ ID NO: 678080 - RNA, 23 nt, Homo sapiens
guguauauaguaugaaugcagug

SEQ ID NO: 678081 - RNA, 19 nt, Homo sapiens
guguaugcacgugugcaca

SEQ ID NO: 678082 - RNA, 13 nt, Homo sapiens
guguaugcugaug

SEQ ID NO: 678083 - RNA, 22 nt, Homo sapiens
guguaugugcgugugugcaagu

SEQ ID NO: 678084 - RNA, 22 nt, Homo sapiens
guguauuuauuuuacagcucau

SEQ ID NO: 678085 - RNA, 14 nt, Homo sapiens
guguauuugcuaau

SEQ ID NO: 678086 - RNA, 22 nt, Homo sapiens
guguauuuucgauauuucagga

SEQ ID NO: 678087 - RNA, 14 nt, Homo sapiens
gugucaaaacuggu

SEQ ID NO: 678088 - RNA, 19 nt, Homo sapiens
gugucaccuacgugccacu

SEQ ID NO: 678089 - RNA, 12 nt, Homo sapiens
gugucacuggcu

SEQ ID NO: 678090 - RNA, 19 nt, Homo sapiens
gugucaguucaacuuucag

SEQ ID NO: 678091 - RNA, 17 nt, Homo sapiens
guguccaggcuggucug

SEQ ID NO: 678092 - RNA, 17 nt, Homo sapiens
guguccccuccacuguc

SEQ ID NO: 678093 - RNA, 21 nt, Homo sapiens
gugucuagacugccagggaga

SEQ ID NO: 678094 - RNA, 14 nt, Homo sapiens
gugucuagagucau

SEQ ID NO: 678095 - RNA, 22 nt, Homo sapiens
gugucugcuuuaaagggccugc

SEQ ID NO: 678096 - RNA, 12 nt, Homo sapiens
gugucugucagc

SEQ ID NO: 678097 - RNA, 15 nt, Homo sapiens
gugucuuaauuauua

SEQ ID NO: 678098 - RNA, 20 nt, Homo sapiens
gugucuuccacuuugcauau

SEQ ID NO: 678099 - RNA, 16 nt, Homo sapiens
gugucuuuggugggga

SEQ ID NO: 678100 - RNA, 13 nt, Homo sapiens
gugucuuuugaca

SEQ ID NO: 678101 - RNA, 14 nt, Homo sapiens
gugugaaaucucag

SEQ ID NO: 678102 - RNA, 21 nt, Homo sapiens
gugugaacucaccaaacacaa

SEQ ID NO: 678103 - RNA, 15 nt, Homo sapiens
gugugaaugugggca

SEQ ID NO: 678104 - RNA, 16 nt, Homo sapiens
gugugaccauguucau

SEQ ID NO: 678105 - RNA, 15 nt, Homo sapiens
gugugagauccucuu

SEQ ID NO: 678106 - RNA, 9 nt, Homo sapiens
gugugagug

SEQ ID NO: 678107 - RNA, 20 nt, Homo sapiens
gugugaugcaaaugcucaaa

SEQ ID NO: 678108 - RNA, 22 nt, Homo sapiens
gugugaugcaccugcagggugu

SEQ ID NO: 678109 - RNA, 22 nt, Homo sapiens
gugugauuugaauucugugaua

SEQ ID NO: 678110 - RNA, 21 nt, Homo sapiens
gugugcaacagacaagugacu

SEQ ID NO: 678111 - RNA, 12 nt, Homo sapiens
gugugcacagaa

SEQ ID NO: 678112 - RNA, 16 nt, Homo sapiens
gugugcagacugaugg

SEQ ID NO: 678113 - RNA, 17 nt, Homo sapiens
gugugcauagcguccug

SEQ ID NO: 678114 - RNA, 14 nt, Homo sapiens
gugugccauuuuaa

SEQ ID NO: 678115 - RNA, 20 nt, Homo sapiens
gugugccguugcuccggccu

SEQ ID NO: 678116 - RNA, 10 nt, Homo sapiens
gugugccuuc

SEQ ID NO: 678117 - RNA, 12 nt, Homo sapiens
gugugcgugcaa

SEQ ID NO: 678118 - RNA, 11 nt, Homo sapiens
gugugcucucu

SEQ ID NO: 678119 - RNA, 18 nt, Homo sapiens
gugugcuuccugcuguau

SEQ ID NO: 678120 - RNA, 15 nt, Homo sapiens
gugugcuucugcuca

SEQ ID NO: 678121 - RNA, 13 nt, Homo sapiens
guguggacugugc

SEQ ID NO: 678122 - RNA, 14 nt, Homo sapiens
guguggagcacgug

SEQ ID NO: 678123 - RNA, 14 nt, Homo sapiens
guguggagcuguau

SEQ ID NO: 678124 - RNA, 16 nt, Homo sapiens
uggcauagccccggcc

SEQ ID NO: 678125 - RNA, 15 nt, Homo sapiens
uggcaucacagggca

SEQ ID NO: 678126 - RNA, 20 nt, Homo sapiens
uggcaucacgucagugcuca

SEQ ID NO: 678127 - RNA, 22 nt, Homo sapiens
uggcaucacgucagugcucaga

SEQ ID NO: 678128 - RNA, 21 nt, Homo sapiens
uggcauccaagacucuuuaug

SEQ ID NO: 678129 - RNA, 13 nt, Homo sapiens
uggcaucugugug

SEQ ID NO: 678130 - RNA, 21 nt, Homo sapiens
uggcaugauggacaaaggccu

SEQ ID NO: 678131 - RNA, 16 nt, Homo sapiens
uggcaugggacagggg

SEQ ID NO: 678132 - RNA, 17 nt, Homo sapiens
uggcauggugcagggag

SEQ ID NO: 678133 - RNA, 17 nt, Homo sapiens
uggcauuacaauugcag

SEQ ID NO: 678134 - RNA, 20 nt, Homo sapiens
uggcauugucuguaaugaca

SEQ ID NO: 678135 - RNA, 16 nt, Homo sapiens
uggccaacaugaugaa

SEQ ID NO: 678136 - RNA, 12 nt, Homo sapiens
uggccaagcaga

SEQ ID NO: 678137 - RNA, 17 nt, Homo sapiens
uggccaaggagcugcua

SEQ ID NO: 678138 - RNA, 18 nt, Homo sapiens
uggccaaggagcugcuau

SEQ ID NO: 678139 - RNA, 16 nt, Homo sapiens
uggccacagugucacu

SEQ ID NO: 678140 - RNA, 17 nt, Homo sapiens
uggccaccccagagugg

SEQ ID NO: 678141 - RNA, 22 nt, Homo sapiens
uggccacgugggcaaacaggca

SEQ ID NO: 678142 - RNA, 15 nt, Homo sapiens
uggccacugucccug

SEQ ID NO: 678143 - RNA, 19 nt, Homo sapiens
uggccagaagggggccaug

SEQ ID NO: 678144 - RNA, 19 nt, Homo sapiens
uggccagacuggucuugaa

SEQ ID NO: 678145 - RNA, 23 nt, Homo sapiens
uggccagagagccuggugcugcu

SEQ ID NO: 678146 - RNA, 19 nt, Homo sapiens
uggccagcccggcugguuu

SEQ ID NO: 678147 - RNA, 22 nt, Homo sapiens
uggccagccuggaucuccucaa

SEQ ID NO: 678148 - RNA, 19 nt, Homo sapiens
uggccaggacccugaccuc

SEQ ID NO: 678149 - RNA, 16 nt, Homo sapiens
uggccaggcacugccu

SEQ ID NO: 678150 - RNA, 18 nt, Homo sapiens
uggccaggcuggucucaa

SEQ ID NO: 678151 - RNA, 22 nt, Homo sapiens
uggccaguuuucugguaggaag

SEQ ID NO: 678152 - RNA, 22 nt, Homo sapiens
uggccaucucccuccccagaaa

SEQ ID NO: 678153 - RNA, 13 nt, Homo sapiens
uggccaugcccuc

SEQ ID NO: 678154 - RNA, 18 nt, Homo sapiens
uggccauggugacauugu

SEQ ID NO: 678155 - RNA, 22 nt, Homo sapiens
uggcccaagucucuuccuccua

SEQ ID NO: 678156 - RNA, 13 nt, Homo sapiens
uggcccacacuga

SEQ ID NO: 678157 - RNA, 13 nt, Homo sapiens
uggcccacugcau

SEQ ID NO: 678158 - RNA, 23 nt, Homo sapiens
uggcccagcaggcaggcacugug

SEQ ID NO: 678159 - RNA, 15 nt, Homo sapiens
uggcccauaauguga

SEQ ID NO: 678160 - RNA, 12 nt, Homo sapiens
uggcccaucaac

SEQ ID NO: 678161 - RNA, 14 nt, Homo sapiens
uggccccacuuuga

SEQ ID NO: 678162 - RNA, 18 nt, Homo sapiens
uggcccccuuucccgggc

SEQ ID NO: 678163 - RNA, 19 nt, Homo sapiens
uggccccucacauccucuc

SEQ ID NO: 678164 - RNA, 20 nt, Homo sapiens
uggccccuccuugcaaccag

SEQ ID NO: 678165 - RNA, 15 nt, Homo sapiens
uggccccuucacuuc

SEQ ID NO: 678166 - RNA, 22 nt, Homo sapiens
uggccccuucuggggguggugg

SEQ ID NO: 678167 - RNA, 18 nt, Homo sapiens
uggcccgcaauacuguag

SEQ ID NO: 678168 - RNA, 17 nt, Homo sapiens
uggcccgccccucgcug

SEQ ID NO: 678169 - RNA, 17 nt, Homo sapiens
uggcccuugcuuaccuc

SEQ ID NO: 678170 - RNA, 22 nt, Homo sapiens
uggcccuuuccuuccagauccu

SEQ ID NO: 678171 - RNA, 23 nt, Homo sapiens
uggccgaggacuuugauugcaca

SEQ ID NO: 678172 - RNA, 23 nt, Homo sapiens
uggccgccacccccaucuuccac

SEQ ID NO: 678173 - RNA, 14 nt, Homo sapiens
uggccgggcagggu

SEQ ID NO: 678174 - RNA, 21 nt, Homo sapiens
uggccuacagucaucugccac

SEQ ID NO: 678175 - RNA, 16 nt, Homo sapiens
uggccuauccgcugcc

SEQ ID NO: 678176 - RNA, 17 nt, Homo sapiens
uggccucaagugagcca

SEQ ID NO: 678177 - RNA, 23 nt, Homo sapiens
uggccucacccaccccugcacag

SEQ ID NO: 678178 - RNA, 19 nt, Homo sapiens
uggccucacuugauucauc

SEQ ID NO: 678179 - RNA, 15 nt, Homo sapiens
uggccucaugucaaa

SEQ ID NO: 678180 - RNA, 13 nt, Homo sapiens
uggccuccaaaau

SEQ ID NO: 678181 - RNA, 18 nt, Homo sapiens
uggccucccaaucuugcc

SEQ ID NO: 678182 - RNA, 22 nt, Homo sapiens
uggccuccuuccccguacuuug

SEQ ID NO: 678183 - RNA, 16 nt, Homo sapiens
uggccucgcuguucuc

SEQ ID NO: 678184 - RNA, 17 nt, Homo sapiens
uggccucuggcucucau

SEQ ID NO: 678185 - RNA, 22 nt, Homo sapiens
uggccugaagaguccucugaau

SEQ ID NO: 678186 - RNA, 14 nt, Homo sapiens
uggccugcacuggu

SEQ ID NO: 678187 - RNA, 21 nt, Homo sapiens
uggccugcugugauuccacua

SEQ ID NO: 678188 - RNA, 20 nt, Homo sapiens
uggccuggacaguaucccac

SEQ ID NO: 678189 - RNA, 21 nt, Homo sapiens
uaaucagaaaaguaauuuugu

SEQ ID NO: 678190 - RNA, 22 nt, Homo sapiens
uaaucagaaggagugugcuuua

SEQ ID NO: 678191 - RNA, 21 nt, Homo sapiens
uaaucagacaaaguaauuccu

SEQ ID NO: 678192 - RNA, 12 nt, Homo sapiens
uaaucagcaaaa

SEQ ID NO: 678193 - RNA, 20 nt, Homo sapiens
uaaucagcaauaaaaauccu

SEQ ID NO: 678194 - RNA, 12 nt, Homo sapiens
uaaucauacaaa

SEQ ID NO: 678195 - RNA, 23 nt, Homo sapiens
uaaucauaucuuuuaauugugua

SEQ ID NO: 678196 - RNA, 20 nt, Homo sapiens
uaaucauguaaaugcucauu

SEQ ID NO: 678197 - RNA, 23 nt, Homo sapiens
uaaucauuuguuuacauuugaug

SEQ ID NO: 678198 - RNA, 18 nt, Homo sapiens
uaaucauuuuaaauucca

SEQ ID NO: 678199 - RNA, 20 nt, Homo sapiens
uaauccaauauuuugccuuu

SEQ ID NO: 678200 - RNA, 15 nt, Homo sapiens
uaauccaguguuacu

SEQ ID NO: 678201 - RNA, 19 nt, Homo sapiens
uaaucccaacacuuugaga

SEQ ID NO: 678202 - RNA, 17 nt, Homo sapiens
uaaucccagcacuuuga

SEQ ID NO: 678203 - RNA, 13 nt, Homo sapiens
uaaucccauuucc

SEQ ID NO: 678204 - RNA, 15 nt, Homo sapiens
uaaucguaagccaug

SEQ ID NO: 678205 - RNA, 13 nt, Homo sapiens
uaaucuacuguaa

SEQ ID NO: 678206 - RNA, 21 nt, Homo sapiens
uaaucuagguguggcugugaa

SEQ ID NO: 678207 - RNA, 14 nt, Homo sapiens
uaaucuaguuuaca

SEQ ID NO: 678208 - RNA, 15 nt, Homo sapiens
uaaucucagcacuuu

SEQ ID NO: 678209 - RNA, 22 nt, Homo sapiens
uaaucuccucagacaguaacca

SEQ ID NO: 678210 - RNA, 16 nt, Homo sapiens
uaaucucucugcagcu

SEQ ID NO: 678211 - RNA, 15 nt, Homo sapiens
uaaucugagcagucu

SEQ ID NO: 678212 - RNA, 15 nt, Homo sapiens
uaaucugcaugaagg

SEQ ID NO: 678213 - RNA, 14 nt, Homo sapiens
uaaucugcugccau

SEQ ID NO: 678214 - RNA, 18 nt, Homo sapiens
uaaucuggaauaugcaac

SEQ ID NO: 678215 - RNA, 20 nt, Homo sapiens
uaaucugucaaaacacugug

SEQ ID NO: 678216 - RNA, 14 nt, Homo sapiens
uaaucuucauuucu

SEQ ID NO: 678217 - RNA, 18 nt, Homo sapiens
uaaucuucugccuucuca

SEQ ID NO: 678218 - RNA, 14 nt, Homo sapiens
uaaucuuucauugg

SEQ ID NO: 678219 - RNA, 18 nt, Homo sapiens
uaaugaaaaacuauguca

SEQ ID NO: 678220 - RNA, 18 nt, Homo sapiens
uaaugaacagaacauaga

SEQ ID NO: 678221 - RNA, 22 nt, Homo sapiens
uaaugaauuauaacaguuauau

SEQ ID NO: 678222 - RNA, 18 nt, Homo sapiens
uaaugaauuuuuaugaua

SEQ ID NO: 678223 - RNA, 19 nt, Homo sapiens
uaaugacauuucacugaug

SEQ ID NO: 678224 - RNA, 19 nt, Homo sapiens
uaaugagaauuccuuagca

SEQ ID NO: 678225 - RNA, 11 nt, Homo sapiens
uaaugagggac

SEQ ID NO: 678226 - RNA, 20 nt, Homo sapiens
uaaugaugcugucugaacag

SEQ ID NO: 678227 - RNA, 14 nt, Homo sapiens
uaaugccucuucau

SEQ ID NO: 678228 - RNA, 18 nt, Homo sapiens
uaaugcucaacaauuuau

SEQ ID NO: 678229 - RNA, 22 nt, Homo sapiens
uaaugcuguucuuuaguagcaa

SEQ ID NO: 678230 - RNA, 14 nt, Homo sapiens
uaaugcuucauuca

SEQ ID NO: 678231 - RNA, 12 nt, Homo sapiens
uaaugcuuuuau

SEQ ID NO: 678232 - RNA, 16 nt, Homo sapiens
uaauggaacuuagcca

SEQ ID NO: 678233 - RNA, 17 nt, Homo sapiens
uaauggcaauaggacau

SEQ ID NO: 678234 - RNA, 20 nt, Homo sapiens
uaauggcagcuagugccuuu

SEQ ID NO: 678235 - RNA, 16 nt, Homo sapiens
uaauggccggcuggaa

SEQ ID NO: 678236 - RNA, 17 nt, Homo sapiens
uaauggccggcuggaaa

SEQ ID NO: 678237 - RNA, 16 nt, Homo sapiens
uaaugggaagaccaaa

SEQ ID NO: 678238 - RNA, 15 nt, Homo sapiens
uaauggggaggacaa

SEQ ID NO: 678239 - RNA, 21 nt, Homo sapiens
uaaugguaaaauaaaaugccu

SEQ ID NO: 678240 - RNA, 16 nt, Homo sapiens
uaaugguagucagauu

SEQ ID NO: 678241 - RNA, 17 nt, Homo sapiens
uaauguaauaauagaaa

SEQ ID NO: 678242 - RNA, 20 nt, Homo sapiens
uaauguacaauaaagcaaug

SEQ ID NO: 678243 - RNA, 20 nt, Homo sapiens
uaauguacagaagagcaaaa

SEQ ID NO: 678244 - RNA, 17 nt, Homo sapiens
uaauguaggacuguaua

SEQ ID NO: 678245 - RNA, 21 nt, Homo sapiens
uaauguaggacuguauaggua

SEQ ID NO: 678246 - RNA, 17 nt, Homo sapiens
uaauguauaccagccua

SEQ ID NO: 678247 - RNA, 20 nt, Homo sapiens
uaaugucacaauuaugugca

SEQ ID NO: 678248 - RNA, 14 nt, Homo sapiens
uaaugucaccaccu

SEQ ID NO: 678249 - RNA, 17 nt, Homo sapiens
uaaugucauggccuuga

SEQ ID NO: 678250 - RNA, 16 nt, Homo sapiens
uaaugucauuuaauaa

SEQ ID NO: 678251 - RNA, 17 nt, Homo sapiens
uaauguccccacucccg

SEQ ID NO: 678252 - RNA, 22 nt, Homo sapiens
uaaugucuucacucuauacuua

SEQ ID NO: 678253 - RNA, 19 nt, Homo sapiens
uaaugugugguggccucag

SEQ ID NO: 678254 - RNA, 18 nt, Homo sapiens
uaauguguuaagugcagg

SEQ ID NO: 678255 - RNA, 20 nt, Homo sapiens
uaauguuaauucagcacuga

SEQ ID NO: 678256 - RNA, 13 nt, Homo sapiens
uaauguugcuuag

SEQ ID NO: 678257 - RNA, 12 nt, Homo sapiens
uaauguugcuuu

SEQ ID NO: 678258 - RNA, 18 nt, Homo sapiens
uaauguuuaauauugaga

SEQ ID NO: 678259 - RNA, 15 nt, Homo sapiens
uaauguuuugcuuaa

SEQ ID NO: 678260 - RNA, 23 nt, Homo sapiens
uaauguuuuuugccacagcuuuu

SEQ ID NO: 678261 - RNA, 18 nt, Homo sapiens
uaauuaaagaugccauag

SEQ ID NO: 678262 - RNA, 23 nt, Homo sapiens
uaauuaauaaagaaaaagaagua

SEQ ID NO: 678263 - RNA, 15 nt, Homo sapiens
uaauuaauugucauu

SEQ ID NO: 678264 - RNA, 13 nt, Homo sapiens
uaauuacaccaua

SEQ ID NO: 678265 - RNA, 16 nt, Homo sapiens
uaauuaccaaccuguu

SEQ ID NO: 678266 - RNA, 17 nt, Homo sapiens
uguuuauacacugugua

SEQ ID NO: 678267 - RNA, 16 nt, Homo sapiens
uguuuaucgaaguaua

SEQ ID NO: 678268 - RNA, 18 nt, Homo sapiens
uguuuaugcacacagaga

SEQ ID NO: 678269 - RNA, 23 nt, Homo sapiens
uguuuaugccacagaauuugcua

SEQ ID NO: 678270 - RNA, 18 nt, Homo sapiens
uguuucaaaaaaucugac

SEQ ID NO: 678271 - RNA, 14 nt, Homo sapiens
uguuucaccuucca

SEQ ID NO: 678272 - RNA, 15 nt, Homo sapiens
uguuucaccuuccau

SEQ ID NO: 678273 - RNA, 17 nt, Homo sapiens
uguuucaggaggcugga

SEQ ID NO: 678274 - RNA, 17 nt, Homo sapiens
uguuucaguucagauaa

SEQ ID NO: 678275 - RNA, 19 nt, Homo sapiens
uguuuccaauuauccuuuu

SEQ ID NO: 678276 - RNA, 12 nt, Homo sapiens
uguuuccaggag

SEQ ID NO: 678277 - RNA, 23 nt, Homo sapiens
uguuucccggggaggaaacacuu

SEQ ID NO: 678278 - RNA, 22 nt, Homo sapiens
uguuuccuccccaucagccucc

SEQ ID NO: 678279 - RNA, 23 nt, Homo sapiens
uguuuccugaaauauaaacugua

SEQ ID NO: 678280 - RNA, 19 nt, Homo sapiens
uguuucgaguaaacuugaa

SEQ ID NO: 678281 - RNA, 20 nt, Homo sapiens
uguuucguguauaugccuca

SEQ ID NO: 678282 - RNA, 18 nt, Homo sapiens
uguuucuaaaacuauggu

SEQ ID NO: 678283 - RNA, 19 nt, Homo sapiens
uguuucuaaaacuaugguu

SEQ ID NO: 678284 - RNA, 22 nt, Homo sapiens
uguuucuacagaaauaacagcu

SEQ ID NO: 678285 - RNA, 14 nt, Homo sapiens
uguuucuguuccaa

SEQ ID NO: 678286 - RNA, 12 nt, Homo sapiens
uguuucuuccaa

SEQ ID NO: 678287 - RNA, 20 nt, Homo sapiens
uguuucuugccugaacuccu

SEQ ID NO: 678288 - RNA, 16 nt, Homo sapiens
uguuucuuucauauga

SEQ ID NO: 678289 - RNA, 19 nt, Homo sapiens
uguuucuuuuguauguaaa

SEQ ID NO: 678290 - RNA, 22 nt, Homo sapiens
uguuugaggcaaauuaacugua

SEQ ID NO: 678291 - RNA, 13 nt, Homo sapiens
uguuugaguuaaa

SEQ ID NO: 678292 - RNA, 16 nt, Homo sapiens
uguuugauuccauucc

SEQ ID NO: 678293 - RNA, 20 nt, Homo sapiens
uguuuggauacaucugcugu

SEQ ID NO: 678294 - RNA, 23 nt, Homo sapiens
uguuugucauagggcaguuggaa

SEQ ID NO: 678295 - RNA, 12 nt, Homo sapiens
uguuugugauug

SEQ ID NO: 678296 - RNA, 16 nt, Homo sapiens
uguuuguggaacaaaa

SEQ ID NO: 678297 - RNA, 16 nt, Homo sapiens
uguuuguuucauauau

SEQ ID NO: 678298 - RNA, 17 nt, Homo sapiens
uguuuguuuuugcuugu

SEQ ID NO: 678299 - RNA, 19 nt, Homo sapiens
uguuuuaaaaaaacugaag

SEQ ID NO: 678300 - RNA, 14 nt, Homo sapiens
uguuuuacauucca

SEQ ID NO: 678301 - RNA, 14 nt, Homo sapiens
uguuuuaccagcuc

SEQ ID NO: 678302 - RNA, 18 nt, Homo sapiens
uguuuuauugacaucucu

SEQ ID NO: 678303 - RNA, 14 nt, Homo sapiens
uguuuuauugggga

SEQ ID NO: 678304 - RNA, 22 nt, Homo sapiens
uguuuuccaaagaaaaguauug

SEQ ID NO: 678305 - RNA, 16 nt, Homo sapiens
uguuuuccccacauuc

SEQ ID NO: 678306 - RNA, 21 nt, Homo sapiens
uguuuucucuggaaugguaca

SEQ ID NO: 678307 - RNA, 18 nt, Homo sapiens
uguuuucuucaacaugcu

SEQ ID NO: 678308 - RNA, 19 nt, Homo sapiens
uguuuugaccccuuacaca

SEQ ID NO: 678309 - RNA, 22 nt, Homo sapiens
uguuuugcauaacgucugccuu

SEQ ID NO: 678310 - RNA, 19 nt, Homo sapiens
uguuuuuaauaaagacagg

SEQ ID NO: 678311 - RNA, 23 nt, Homo sapiens
uguuuuuacccugccccugccuu

SEQ ID NO: 678312 - RNA, 12 nt, Homo sapiens
uguuuuugccaa

SEQ ID NO: 678313 - RNA, 14 nt, Homo sapiens
uguuuuugccaaag

SEQ ID NO: 678314 - RNA, 20 nt, Homo sapiens
uguuuuuguucaaagccagc

SEQ ID NO: 678315 - RNA, 23 nt, Homo sapiens
uguuuuuugccacagcuuuugca

SEQ ID NO: 678316 - RNA, 16 nt, Homo sapiens
uguuuuuuuucagcca

SEQ ID NO: 678317 - RNA, 19 nt, Homo sapiens
uguuuuuuuuuuauuccag

SEQ ID NO: 678318 - RNA, 22 nt, Homo sapiens
uuaaaaaaaaaggcauauugcu

SEQ ID NO: 678319 - RNA, 14 nt, Homo sapiens
uuaaaaaaagaaca

SEQ ID NO: 678320 - RNA, 17 nt, Homo sapiens
uuaaaaaaauuacugug

SEQ ID NO: 678321 - RNA, 19 nt, Homo sapiens
uuaaaaaaauuacugugaa

SEQ ID NO: 678322 - RNA, 15 nt, Homo sapiens
uuaaaaaaauuccau

SEQ ID NO: 678323 - RNA, 15 nt, Homo sapiens
uuaaaaaauaccauu

SEQ ID NO: 678324 - RNA, 18 nt, Homo sapiens
uuaaaaacaacgaaagaa

SEQ ID NO: 678325 - RNA, 14 nt, Homo sapiens
uuaaaaacaugaau

SEQ ID NO: 678326 - RNA, 12 nt, Homo sapiens
uuaaaaacuaaa

SEQ ID NO: 678327 - RNA, 19 nt, Homo sapiens
uuaaaaagauguauguucc

SEQ ID NO: 678328 - RNA, 17 nt, Homo sapiens
uuaaaaauagcaguauu

SEQ ID NO: 678329 - RNA, 23 nt, Homo sapiens
uuaaaacaaaggaacuaacuuac

SEQ ID NO: 678330 - RNA, 18 nt, Homo sapiens
uuaaaacaauucugugac

SEQ ID NO: 678331 - RNA, 21 nt, Homo sapiens
uuaaaacagaaaggugcagga

SEQ ID NO: 678332 - RNA, 13 nt, Homo sapiens
uuaaaacagaagc

SEQ ID NO: 678333 - RNA, 15 nt, Homo sapiens
uuaaaaccaaaagaa

SEQ ID NO: 678334 - RNA, 11 nt, Homo sapiens
uuaaaacucau

SEQ ID NO: 678335 - RNA, 19 nt, Homo sapiens
uuaaaagacugcagcugcu

SEQ ID NO: 678336 - RNA, 17 nt, Homo sapiens
uuaaaagagaagcauca

SEQ ID NO: 678337 - RNA, 16 nt, Homo sapiens
uuaaaagcacacuccc

SEQ ID NO: 678338 - RNA, 13 nt, Homo sapiens
uuaaaagcaugaa

SEQ ID NO: 678339 - RNA, 16 nt, Homo sapiens
uuaaaaggaaacugua

SEQ ID NO: 678340 - RNA, 19 nt, Homo sapiens
uuaaaaggaaagucaagaa

SEQ ID NO: 678341 - RNA, 22 nt, Homo sapiens
uuaaaagguuaaauauugucau

SEQ ID NO: 678342 - RNA, 16 nt, Homo sapiens
uuaaaaguuaagcaaa

SEQ ID NO: 678343 - RNA, 21 nt, Homo sapiens
uuaaaauaaaaaagcaaaaac

SEQ ID NO: 678344 - RNA, 16 nt, Homo sapiens
uuaaaauaacuuguau

SEQ ID NO: 678345 - RNA, 16 nt, Homo sapiens
uuaaaauaaugaacac

SEQ ID NO: 678346 - RNA, 17 nt, Homo sapiens
uuaaaauaaugaauaca

SEQ ID NO: 678347 - RNA, 14 nt, Homo sapiens
uuaaaauaccuaga

SEQ ID NO: 678348 - RNA, 14 nt, Homo sapiens
uuaaaauaggauua

SEQ ID NO: 678349 - RNA, 14 nt, Homo sapiens
uuaaaauauauagu

SEQ ID NO: 678350 - RNA, 19 nt, Homo sapiens
uuaaaauauauguauuuaa

SEQ ID NO: 678351 - RNA, 17 nt, Homo sapiens
uuaaaauauccugugua

SEQ ID NO: 678352 - RNA, 18 nt, Homo sapiens
uuaaaauauguaugucua

SEQ ID NO: 678353 - RNA, 15 nt, Homo sapiens
uuaaaauauuuuaga

SEQ ID NO: 678354 - RNA, 16 nt, Homo sapiens
uuaaaauccaaaugag

SEQ ID NO: 678355 - RNA, 18 nt, Homo sapiens
uuaaaaucugucacguag

SEQ ID NO: 678356 - RNA, 18 nt, Homo sapiens
uuaaaaugacaagcacua

SEQ ID NO: 678357 - RNA, 14 nt, Homo sapiens
uuaaaaugagaucg

SEQ ID NO: 678358 - RNA, 12 nt, Homo sapiens
uuaaaaugauug

SEQ ID NO: 678359 - RNA, 13 nt, Homo sapiens
uuaaaaugguuau

SEQ ID NO: 678360 - RNA, 13 nt, Homo sapiens
uuaaaauuauuca

SEQ ID NO: 678361 - RNA, 23 nt, Homo sapiens
uuaaaauuuuucuuaagacagag

SEQ ID NO: 678362 - RNA, 17 nt, Homo sapiens
uuaaacaaauaauuuag

SEQ ID NO: 678363 - RNA, 15 nt, Homo sapiens
uuaaacagugcuuug

SEQ ID NO: 678364 - RNA, 22 nt, Homo sapiens
uuaaacauuaauagcagccuuu

SEQ ID NO: 678365 - RNA, 24 nt, Homo sapiens
uuaaacauuugagagcuaacuaua

SEQ ID NO: 678366 - RNA, 22 nt, Homo sapiens
uuaaacccaagugcugcacaaa

SEQ ID NO: 678367 - RNA, 18 nt, Homo sapiens
uuaaacccacagccaaac

SEQ ID NO: 678368 - RNA, 18 nt, Homo sapiens
uuaaacccuuuggugcua

SEQ ID NO: 678369 - RNA, 14 nt, Homo sapiens
uuaaacguguaaau

SEQ ID NO: 678370 - RNA, 21 nt, Homo sapiens
uuaaacuaagaucuguuaaaa

SEQ ID NO: 678371 - RNA, 18 nt, Homo sapiens
uuaaacuauaagcaagaa

SEQ ID NO: 678372 - RNA, 16 nt, Homo sapiens
uuaaacucagggacag

SEQ ID NO: 678373 - RNA, 23 nt, Homo sapiens
uuaaacucugaagccacaaagac

SEQ ID NO: 678374 - RNA, 18 nt, Homo sapiens
uuaaacuguuagcacugu

SEQ ID NO: 678375 - RNA, 23 nt, Homo sapiens
uuaaacuuaagggaaaaguucuc

SEQ ID NO: 678376 - RNA, 18 nt, Homo sapiens
uuaaacuuaccugggcau

SEQ ID NO: 678377 - RNA, 14 nt, Homo sapiens
uuaaacuuacuuag

SEQ ID NO: 678378 - RNA, 22 nt, Homo sapiens
uuaaacuugaaauauauaauau

SEQ ID NO: 678379 - RNA, 16 nt, Homo sapiens
uuaaacuuuuaauuca

SEQ ID NO: 678380 - RNA, 12 nt, Homo sapiens
uuaaagaaagaa

SEQ ID NO: 678381 - RNA, 13 nt, Homo sapiens
uuaaagaaagugu

SEQ ID NO: 678382 - RNA, 11 nt, Homo sapiens
uuaaagacaug

SEQ ID NO: 678383 - RNA, 17 nt, Homo sapiens
uuaaagacccaacuugc

SEQ ID NO: 678384 - RNA, 14 nt, Homo sapiens
uuaaagacguaaaa

SEQ ID NO: 678385 - RNA, 18 nt, Homo sapiens
uuaaagacguucccuuuu

SEQ ID NO: 678386 - RNA, 15 nt, Homo sapiens
uuaaagaggcugugu

SEQ ID NO: 678387 - RNA, 11 nt, Homo sapiens
uuaaagcaaaa

SEQ ID NO: 678388 - RNA, 16 nt, Homo sapiens
uuaaagcauaugcuau

SEQ ID NO: 678389 - RNA, 12 nt, Homo sapiens
uaauuaccaugc

SEQ ID NO: 678390 - RNA, 12 nt, Homo sapiens
uaauuacuguac

SEQ ID NO: 678391 - RNA, 20 nt, Homo sapiens
uaauuacuuauuguauuuau

SEQ ID NO: 678392 - RNA, 22 nt, Homo sapiens
uaauuagcauggccccagucca

SEQ ID NO: 678393 - RNA, 23 nt, Homo sapiens
uaauuaguuuauauuacucucau

SEQ ID NO: 678394 - RNA, 17 nt, Homo sapiens
uaauuauaaauaucauu

SEQ ID NO: 678395 - RNA, 14 nt, Homo sapiens
uaauuauauuucua

SEQ ID NO: 678396 - RNA, 21 nt, Homo sapiens
uaauuaucggaagcagugccu

SEQ ID NO: 678397 - RNA, 19 nt, Homo sapiens
uaauuauuuauauuuccug

SEQ ID NO: 678398 - RNA, 16 nt, Homo sapiens
uaauucaaaagaucaa

SEQ ID NO: 678399 - RNA, 23 nt, Homo sapiens
uaauucaagccucuaaacagaca

SEQ ID NO: 678400 - RNA, 21 nt, Homo sapiens
uaauucacagaauagcacaaa

SEQ ID NO: 678401 - RNA, 19 nt, Homo sapiens
uaauucagcacugauuuca

SEQ ID NO: 678402 - RNA, 20 nt, Homo sapiens
uaauucauaaaucacaaaua

SEQ ID NO: 678403 - RNA, 19 nt, Homo sapiens
uaauucauaaucacucuaa

SEQ ID NO: 678404 - RNA, 20 nt, Homo sapiens
uaauuccacagcugcucaau

SEQ ID NO: 678405 - RNA, 20 nt, Homo sapiens
uaauucccugcuaaaugcca

SEQ ID NO: 678406 - RNA, 22 nt, Homo sapiens
uaauuccgaaacaaaacuguga

SEQ ID NO: 678407 - RNA, 17 nt, Homo sapiens
uaauuccuacagcacua

SEQ ID NO: 678408 - RNA, 16 nt, Homo sapiens
uaauucggauuugcca

SEQ ID NO: 678409 - RNA, 13 nt, Homo sapiens
uaauucucuaggg

SEQ ID NO: 678410 - RNA, 22 nt, Homo sapiens
uaauucuuagauacacuaaaaa

SEQ ID NO: 678411 - RNA, 15 nt, Homo sapiens
uaauugaacuaacaa

SEQ ID NO: 678412 - RNA, 16 nt, Homo sapiens
uaauugaagaacugca

SEQ ID NO: 678413 - RNA, 21 nt, Homo sapiens
uaauugauuauucugauucca

SEQ ID NO: 678414 - RNA, 14 nt, Homo sapiens
uaauugcaugacaa

SEQ ID NO: 678415 - RNA, 15 nt, Homo sapiens
uaauugcaugacaaa

SEQ ID NO: 678416 - RNA, 19 nt, Homo sapiens
uaauugccuaaaucuccag

SEQ ID NO: 678417 - RNA, 20 nt, Homo sapiens
uaauugcuuuuucacaguca

SEQ ID NO: 678418 - RNA, 20 nt, Homo sapiens
uaauuggaauuguugaagcu

SEQ ID NO: 678419 - RNA, 18 nt, Homo sapiens
uaauugguuuuaugcauu

SEQ ID NO: 678420 - RNA, 23 nt, Homo sapiens
uaauugugaauaaaaauugauga

SEQ ID NO: 678421 - RNA, 21 nt, Homo sapiens
uaauugugugacuuuuucaga

SEQ ID NO: 678422 - RNA, 13 nt, Homo sapiens
uaauuguguguca

SEQ ID NO: 678423 - RNA, 20 nt, Homo sapiens
uaauuguuuaaaaaccgaau

SEQ ID NO: 678424 - RNA, 19 nt, Homo sapiens
uaauuuaaaaagugcuaua

SEQ ID NO: 678425 - RNA, 17 nt, Homo sapiens
uaauuuaaacaccuccu

SEQ ID NO: 678426 - RNA, 15 nt, Homo sapiens
uaauuuaauguauua

SEQ ID NO: 678427 - RNA, 13 nt, Homo sapiens
uaauuuacauuaa

SEQ ID NO: 678428 - RNA, 20 nt, Homo sapiens
uaauuuagaccccauacaag

SEQ ID NO: 678429 - RNA, 19 nt, Homo sapiens
uaauuuaguuccacaaaug

SEQ ID NO: 678430 - RNA, 15 nt, Homo sapiens
uaauuuaguuucaua

SEQ ID NO: 678431 - RNA, 21 nt, Homo sapiens
uaauuuauuauuaacauaccu

SEQ ID NO: 678432 - RNA, 16 nt, Homo sapiens
uaauuuauuucaucca

SEQ ID NO: 678433 - RNA, 15 nt, Homo sapiens
ugcacuuguuauauu

SEQ ID NO: 678434 - RNA, 21 nt, Homo sapiens
ugcacuuuagauauacauauc

SEQ ID NO: 678435 - RNA, 11 nt, Homo sapiens
ugcacuuuuaa

SEQ ID NO: 678436 - RNA, 18 nt, Homo sapiens
ugcacuuuuaaaccucuc

SEQ ID NO: 678437 - RNA, 21 nt, Homo sapiens
ugcagaaaauucugugccuug

SEQ ID NO: 678438 - RNA, 17 nt, Homo sapiens
ugcagaaacaguucacc

SEQ ID NO: 678439 - RNA, 14 nt, Homo sapiens
ugcagaaacuacug

SEQ ID NO: 678440 - RNA, 16 nt, Homo sapiens
ugcagaaacuacugac

SEQ ID NO: 678441 - RNA, 18 nt, Homo sapiens
ugcagaaauauuugugac

SEQ ID NO: 678442 - RNA, 20 nt, Homo sapiens
ugcagaacaaacaaggcauu

SEQ ID NO: 678443 - RNA, 15 nt, Homo sapiens
ugcagaacugccauu

SEQ ID NO: 678444 - RNA, 21 nt, Homo sapiens
ugcagaauacaguaagcugcu

SEQ ID NO: 678445 - RNA, 21 nt, Homo sapiens
ugcagaaugacuccaccuucu

SEQ ID NO: 678446 - RNA, 18 nt, Homo sapiens
ugcagaaugggagaaaau

SEQ ID NO: 678447 - RNA, 19 nt, Homo sapiens
ugcagacagaccucaaggg

SEQ ID NO: 678448 - RNA, 19 nt, Homo sapiens
ugcagaccucacugucagg

SEQ ID NO: 678449 - RNA, 17 nt, Homo sapiens
ugcagaccugguuccca

SEQ ID NO: 678450 - RNA, 15 nt, Homo sapiens
ugcagaccugucacc

SEQ ID NO: 678451 - RNA, 12 nt, Homo sapiens
ugcagacgggaa

SEQ ID NO: 678452 - RNA, 13 nt, Homo sapiens
ugcagagccacag

SEQ ID NO: 678453 - RNA, 21 nt, Homo sapiens
ugcagagccacagcugugcau

SEQ ID NO: 678454 - RNA, 16 nt, Homo sapiens
ugcagagcuuuggcca

SEQ ID NO: 678455 - RNA, 14 nt, Homo sapiens
ugcagaggagccca

SEQ ID NO: 678456 - RNA, 19 nt, Homo sapiens
ugcagaggccugggggacc

SEQ ID NO: 678457 - RNA, 16 nt, Homo sapiens
ugcagagggacagaug

SEQ ID NO: 678458 - RNA, 17 nt, Homo sapiens
ugcagauagcccaggag

SEQ ID NO: 678459 - RNA, 22 nt, Homo sapiens
ugcagauagcccaggagcaaca

SEQ ID NO: 678460 - RNA, 21 nt, Homo sapiens
ugcagcaaacacuccacccuc

SEQ ID NO: 678461 - RNA, 11 nt, Homo sapiens
ugcagcaauau

SEQ ID NO: 678462 - RNA, 14 nt, Homo sapiens
ugcagcaccuccag

SEQ ID NO: 678463 - RNA, 13 nt, Homo sapiens
ugcagccagcuca

SEQ ID NO: 678464 - RNA, 20 nt, Homo sapiens
ugcagccaggagaaggucag

SEQ ID NO: 678465 - RNA, 15 nt, Homo sapiens
ugcagcccaugccca

SEQ ID NO: 678466 - RNA, 21 nt, Homo sapiens
ugcagcccuugugaugugauu

SEQ ID NO: 678467 - RNA, 16 nt, Homo sapiens
ugcagccucaaccucc

SEQ ID NO: 678468 - RNA, 17 nt, Homo sapiens
ugcagccuuugccuccc

SEQ ID NO: 678469 - RNA, 20 nt, Homo sapiens
ugcagcucuucaacaugaca

SEQ ID NO: 678470 - RNA, 23 nt, Homo sapiens
ugcagcugggccccaugcucugc

SEQ ID NO: 678471 - RNA, 20 nt, Homo sapiens
ugcagcuuaaaacaagcaaa

SEQ ID NO: 678472 - RNA, 15 nt, Homo sapiens
ugcagcuuauauuca

SEQ ID NO: 678473 - RNA, 19 nt, Homo sapiens
ugcagcuuauauucaucca

SEQ ID NO: 678474 - RNA, 17 nt, Homo sapiens
ugcagcuucgaggacag

SEQ ID NO: 678475 - RNA, 20 nt, Homo sapiens
ugcagcuucgaggacaggaa

SEQ ID NO: 678476 - RNA, 16 nt, Homo sapiens
ugcagcuuuauguuca

SEQ ID NO: 678477 - RNA, 23 nt, Homo sapiens
ugcaggaaaagcaaaauugcaau

SEQ ID NO: 678478 - RNA, 19 nt, Homo sapiens
ugcaggacccuguccugca

SEQ ID NO: 678479 - RNA, 22 nt, Homo sapiens
ugcaggacuugagaagaccuca

SEQ ID NO: 678480 - RNA, 17 nt, Homo sapiens
ugcaggagagacaguga

SEQ ID NO: 678481 - RNA, 14 nt, Homo sapiens
ugcaggagugacuc

SEQ ID NO: 678482 - RNA, 21 nt, Homo sapiens
ugcaggcugcagucccuggaa

SEQ ID NO: 678483 - RNA, 16 nt, Homo sapiens
ugcaggcuuuuccucc

SEQ ID NO: 678484 - RNA, 17 nt, Homo sapiens
ugcagggacuccaugcu

SEQ ID NO: 678485 - RNA, 14 nt, Homo sapiens
ugcagggacugcca

SEQ ID NO: 678486 - RNA, 15 nt, Homo sapiens
uggcucucuccagga

SEQ ID NO: 678487 - RNA, 15 nt, Homo sapiens
uggcucugaugcuga

SEQ ID NO: 678488 - RNA, 23 nt, Homo sapiens
uggcucugccccucagggggcca

SEQ ID NO: 678489 - RNA, 12 nt, Homo sapiens
uggcucugggcc

SEQ ID NO: 678490 - RNA, 21 nt, Homo sapiens
uggcugaaagguuaauucucu

SEQ ID NO: 678491 - RNA, 20 nt, Homo sapiens
uggcugaacgcguguguaca

SEQ ID NO: 678492 - RNA, 17 nt, Homo sapiens
uggcugaccccaaagag

SEQ ID NO: 678493 - RNA, 17 nt, Homo sapiens
uggcugacuggcaguaa

SEQ ID NO: 678494 - RNA, 16 nt, Homo sapiens
uggcugaggauuucaa

SEQ ID NO: 678495 - RNA, 15 nt, Homo sapiens
uggcugaugaugucu

SEQ ID NO: 678496 - RNA, 14 nt, Homo sapiens
uggcugccuuagaa

SEQ ID NO: 678497 - RNA, 15 nt, Homo sapiens
uggcugccuuuggaa

SEQ ID NO: 678498 - RNA, 16 nt, Homo sapiens
uggcugcuuugacaag

SEQ ID NO: 678499 - RNA, 16 nt, Homo sapiens
uggcuggcuuguuuga

SEQ ID NO: 678500 - RNA, 19 nt, Homo sapiens
uggcugggcuacaauuugu

SEQ ID NO: 678501 - RNA, 16 nt, Homo sapiens
uggcugggucuucaag

SEQ ID NO: 678502 - RNA, 19 nt, Homo sapiens
uggcugguaacaguucaug

SEQ ID NO: 678503 - RNA, 15 nt, Homo sapiens
uggcuggucuucacu

SEQ ID NO: 678504 - RNA, 12 nt, Homo sapiens
uggcugugaaag

SEQ ID NO: 678505 - RNA, 11 nt, Homo sapiens
uggcugugagg

SEQ ID NO: 678506 - RNA, 22 nt, Homo sapiens
uggcuguggaccacccuagcac

SEQ ID NO: 678507 - RNA, 16 nt, Homo sapiens
uggcuguguugcccug

SEQ ID NO: 678508 - RNA, 23 nt, Homo sapiens
uggcuuaccugaccucuugcugu

SEQ ID NO: 678509 - RNA, 20 nt, Homo sapiens
uggcuucagcccccaccagg

SEQ ID NO: 678510 - RNA, 13 nt, Homo sapiens
uggcuucauuuua

SEQ ID NO: 678511 - RNA, 16 nt, Homo sapiens
uggcuuccugcugagu

SEQ ID NO: 678512 - RNA, 14 nt, Homo sapiens
uggcuugacucagg

SEQ ID NO: 678513 - RNA, 21 nt, Homo sapiens
uggcuuguucaucauccagau

SEQ ID NO: 678514 - RNA, 21 nt, Homo sapiens
uggcuuuccaggagacauaua

SEQ ID NO: 678515 - RNA, 22 nt, Homo sapiens
uggcuuugccuuggcuuugcca

SEQ ID NO: 678516 - RNA, 22 nt, Homo sapiens
uggcuuuguuuuuugugcuauu

SEQ ID NO: 678517 - RNA, 17 nt, Homo sapiens
uggcuuuucaccccaga

SEQ ID NO: 678518 - RNA, 19 nt, Homo sapiens
uggcuuuuccuugaaucca

SEQ ID NO: 678519 - RNA, 14 nt, Homo sapiens
uggcuuuugugcau

SEQ ID NO: 678520 - RNA, 16 nt, Homo sapiens
uggcuuuugugcauua

SEQ ID NO: 678521 - RNA, 14 nt, Homo sapiens
ugggaaaaccagac

SEQ ID NO: 678522 - RNA, 21 nt, Homo sapiens
ugggaaauauuuagcaaauaa

SEQ ID NO: 678523 - RNA, 18 nt, Homo sapiens
ugggaaaucaguguuuua

SEQ ID NO: 678524 - RNA, 17 nt, Homo sapiens
ugggaacacaucuggcu

SEQ ID NO: 678525 - RNA, 22 nt, Homo sapiens
ugggaacaguaaagaaagcaga

SEQ ID NO: 678526 - RNA, 15 nt, Homo sapiens
ugggaaccacuccca

SEQ ID NO: 678527 - RNA, 15 nt, Homo sapiens
ugggaacuccacucu

SEQ ID NO: 678528 - RNA, 18 nt, Homo sapiens
ugggaacugaaucaggaa

SEQ ID NO: 678529 - RNA, 19 nt, Homo sapiens
ugggaagaaagaaugcaag

SEQ ID NO: 678530 - RNA, 16 nt, Homo sapiens
ugggaagccugugcca

SEQ ID NO: 678531 - RNA, 22 nt, Homo sapiens
ugggaaggcuugggauuugcug

SEQ ID NO: 678532 - RNA, 16 nt, Homo sapiens
ugggaagggcagggaa

SEQ ID NO: 678533 - RNA, 22 nt, Homo sapiens
ugggaauaauagacacugggga

SEQ ID NO: 678534 - RNA, 23 nt, Homo sapiens
ugggaauacaggggugaaagggg

SEQ ID NO: 678535 - RNA, 15 nt, Homo sapiens
ugggaaugucucuuu

SEQ ID NO: 678536 - RNA, 18 nt, Homo sapiens
ugggacacccaacacuuu

SEQ ID NO: 678537 - RNA, 17 nt, Homo sapiens
ugggacacccacagcug

SEQ ID NO: 678538 - RNA, 15 nt, Homo sapiens
ugggaccaucacuga

SEQ ID NO: 678539 - RNA, 20 nt, Homo sapiens
ugggacccaaaacacaggaa

SEQ ID NO: 678540 - RNA, 16 nt, Homo sapiens
ugggaccgugcgagcu

SEQ ID NO: 678541 - RNA, 19 nt, Homo sapiens
ugggaccuguguucuugcu

SEQ ID NO: 678542 - RNA, 19 nt, Homo sapiens
ugggacgcacagugcaguu

SEQ ID NO: 678543 - RNA, 12 nt, Homo sapiens
ugggacuuuuaa

SEQ ID NO: 678544 - RNA, 14 nt, Homo sapiens
ugggagaaggcagu

SEQ ID NO: 678545 - RNA, 15 nt, Homo sapiens
ugggagaaggcagug

SEQ ID NO: 678546 - RNA, 18 nt, Homo sapiens
ugggagacacagcaagac

SEQ ID NO: 678547 - RNA, 13 nt, Homo sapiens
ugggagacagugg

SEQ ID NO: 678548 - RNA, 18 nt, Homo sapiens
ugggagacaugugacauu

SEQ ID NO: 678549 - RNA, 15 nt, Homo sapiens
ugggagagggagacc

SEQ ID NO: 678550 - RNA, 14 nt, Homo sapiens
ugggagagucucac

SEQ ID NO: 678551 - RNA, 20 nt, Homo sapiens
ugggagagucucacuuugga

SEQ ID NO: 678552 - RNA, 19 nt, Homo sapiens
ugggagaucuucacucugg

SEQ ID NO: 678553 - RNA, 19 nt, Homo sapiens
ugggagauguuagacucau

SEQ ID NO: 678554 - RNA, 23 nt, Homo sapiens
ugggagcugaaccacagaaauca

SEQ ID NO: 678555 - RNA, 20 nt, Homo sapiens
ugauuugucccagccugggg

SEQ ID NO: 678556 - RNA, 17 nt, Homo sapiens
ugauuugugcugagauc

SEQ ID NO: 678557 - RNA, 21 nt, Homo sapiens
ugauuuuaaccaauguagcac

SEQ ID NO: 678558 - RNA, 16 nt, Homo sapiens
ugauuuugcuuuccaa

SEQ ID NO: 678559 - RNA, 14 nt, Homo sapiens
ugauuuugugauau

SEQ ID NO: 678560 - RNA, 19 nt, Homo sapiens
ugcaaaaaugaaauccagu

SEQ ID NO: 678561 - RNA, 16 nt, Homo sapiens
ugcaaaacacuaaaga

SEQ ID NO: 678562 - RNA, 16 nt, Homo sapiens
ugcaaaaggacucuca

SEQ ID NO: 678563 - RNA, 20 nt, Homo sapiens
ugcaaaaguucugacuugac

SEQ ID NO: 678564 - RNA, 22 nt, Homo sapiens
ugcaaaaugucuuaaugcaaau

SEQ ID NO: 678565 - RNA, 18 nt, Homo sapiens
ugcaaaccauagcacagg

SEQ ID NO: 678566 - RNA, 22 nt, Homo sapiens
ugcaaacccgaaaauaaaagac

SEQ ID NO: 678567 - RNA, 23 nt, Homo sapiens
ugcaaaccuuccugggaggacag

SEQ ID NO: 678568 - RNA, 12 nt, Homo sapiens
ugcaaacuaugc

SEQ ID NO: 678569 - RNA, 15 nt, Homo sapiens
ugcaaacugcuuuau

SEQ ID NO: 678570 - RNA, 20 nt, Homo sapiens
ugcaaagacugaguguucaa

SEQ ID NO: 678571 - RNA, 16 nt, Homo sapiens
ugcaaagcgacagauu

SEQ ID NO: 678572 - RNA, 19 nt, Homo sapiens
ugcaaagcuuuggcugaga

SEQ ID NO: 678573 - RNA, 22 nt, Homo sapiens
ugcaaaguacauguauuuuuaa

SEQ ID NO: 678574 - RNA, 14 nt, Homo sapiens
ugcaaauaaucaca

SEQ ID NO: 678575 - RNA, 15 nt, Homo sapiens
ugcaaauaaucacag

SEQ ID NO: 678576 - RNA, 17 nt, Homo sapiens
ugcaaauaaucacagau

SEQ ID NO: 678577 - RNA, 10 nt, Homo sapiens
ugcaaaucag

SEQ ID NO: 678578 - RNA, 19 nt, Homo sapiens
ugcaaauggcuacuaagca

SEQ ID NO: 678579 - RNA, 17 nt, Homo sapiens
ugcaaauugccugcaaa

SEQ ID NO: 678580 - RNA, 13 nt, Homo sapiens
ugcaacaaaaagu

SEQ ID NO: 678581 - RNA, 18 nt, Homo sapiens
ugcaacaaaaagucauuu

SEQ ID NO: 678582 - RNA, 15 nt, Homo sapiens
ugcaacagaagcaaa

SEQ ID NO: 678583 - RNA, 14 nt, Homo sapiens
ugcaacagcacugg

SEQ ID NO: 678584 - RNA, 16 nt, Homo sapiens
ugcaacagcacuggcu

SEQ ID NO: 678585 - RNA, 12 nt, Homo sapiens
ugcaacagcuac

SEQ ID NO: 678586 - RNA, 14 nt, Homo sapiens
ugcaacagugccau

SEQ ID NO: 678587 - RNA, 11 nt, Homo sapiens
ugcaacauucu

SEQ ID NO: 678588 - RNA, 16 nt, Homo sapiens
ugcaaccaacuaucca

SEQ ID NO: 678589 - RNA, 17 nt, Homo sapiens
ugcaacuaauucaauaa

SEQ ID NO: 678590 - RNA, 18 nt, Homo sapiens
ugcaacuauuuccaccuc

SEQ ID NO: 678591 - RNA, 15 nt, Homo sapiens
ugcaacugaaugacu

SEQ ID NO: 678592 - RNA, 22 nt, Homo sapiens
ugcaacugaaugacuaaucaga

SEQ ID NO: 678593 - RNA, 16 nt, Homo sapiens
ugcaacuuaaguauau

SEQ ID NO: 678594 - RNA, 16 nt, Homo sapiens
ugcaacuucaugucaa

SEQ ID NO: 678595 - RNA, 14 nt, Homo sapiens
ugcaacuucugccu

SEQ ID NO: 678596 - RNA, 19 nt, Homo sapiens
ugcaagaauuaaaacugag

SEQ ID NO: 678597 - RNA, 17 nt, Homo sapiens
ugcaagaguggacugaa

SEQ ID NO: 678598 - RNA, 18 nt, Homo sapiens
ugcaagaguggacugaau

SEQ ID NO: 678599 - RNA, 22 nt, Homo sapiens
ugcaagccccucuuucuguccc

SEQ ID NO: 678600 - RNA, 21 nt, Homo sapiens
ugcaagccugucugagacuca

SEQ ID NO: 678601 - RNA, 22 nt, Homo sapiens
ugcaagcgaaauuaaaucugaa

SEQ ID NO: 678602 - RNA, 18 nt, Homo sapiens
ugcaagcgacgacagaug

SEQ ID NO: 678603 - RNA, 15 nt, Homo sapiens
ugcaaggcaaauguu

SEQ ID NO: 678604 - RNA, 19 nt, Homo sapiens
ugcaaggccugguguuucu

SEQ ID NO: 678605 - RNA, 19 nt, Homo sapiens
ugcaaggcuaagaaguacu

SEQ ID NO: 678606 - RNA, 19 nt, Homo sapiens
ugcaaggugaaacgacuca

SEQ ID NO: 678607 - RNA, 17 nt, Homo sapiens
ugcaaguacaaguauau

SEQ ID NO: 678608 - RNA, 12 nt, Homo sapiens
ugcaagucaaaa

SEQ ID NO: 678609 - RNA, 18 nt, Homo sapiens
ugcaagugucugugugca

SEQ ID NO: 678610 - RNA, 19 nt, Homo sapiens
ugcaagugucugugugcaa

SEQ ID NO: 678611 - RNA, 14 nt, Homo sapiens
ugcaagugugugca

SEQ ID NO: 678612 - RNA, 16 nt, Homo sapiens
ugcaagugugugcaug

SEQ ID NO: 678613 - RNA, 23 nt, Homo sapiens
ugcaaguguuucuucuggcuuag

SEQ ID NO: 678614 - RNA, 15 nt, Homo sapiens
ugcaauaaugugcaa

SEQ ID NO: 678615 - RNA, 14 nt, Homo sapiens
ugcaauauuuacau

SEQ ID NO: 678616 - RNA, 20 nt, Homo sapiens
ugcaauccagccugggcaac

SEQ ID NO: 678617 - RNA, 16 nt, Homo sapiens
ugcaaucuguguucga

SEQ ID NO: 678618 - RNA, 15 nt, Homo sapiens
ugcaaucuucuacuu

SEQ ID NO: 678619 - RNA, 19 nt, Homo sapiens
ugcaaucuucuacuuuaag

SEQ ID NO: 678620 - RNA, 16 nt, Homo sapiens
ugcaaugacacagucu

SEQ ID NO: 678621 - RNA, 18 nt, Homo sapiens
ugcaaugacacagucuug

SEQ ID NO: 678622 - RNA, 18 nt, Homo sapiens
ugcaaugggcacugggau

SEQ ID NO: 678623 - RNA, 15 nt, Homo sapiens
ugcaauguaagcaua

SEQ ID NO: 678624 - RNA, 16 nt, Homo sapiens
ugcaauuaaagugaua

SEQ ID NO: 678625 - RNA, 23 nt, Homo sapiens
ugcacaagaauggaucacaagau

SEQ ID NO: 678626 - RNA, 12 nt, Homo sapiens
ugcacacaguga

SEQ ID NO: 678627 - RNA, 15 nt, Homo sapiens
ugcacacauuaggca

SEQ ID NO: 678628 - RNA, 21 nt, Homo sapiens
ugcacacucacuuguaagaaa

SEQ ID NO: 678629 - RNA, 12 nt, Homo sapiens
ugcacacuucca

SEQ ID NO: 678630 - RNA, 13 nt, Homo sapiens
ugcacacuuugcc

SEQ ID NO: 678631 - RNA, 15 nt, Homo sapiens
ugcacagagcuggag

SEQ ID NO: 678632 - RNA, 15 nt, Homo sapiens
ugcacagauugcuga

SEQ ID NO: 678633 - RNA, 22 nt, Homo sapiens
ugcacagcaggaccugugcuuu

SEQ ID NO: 678634 - RNA, 19 nt, Homo sapiens
ugcacagccaacgagacac

SEQ ID NO: 678635 - RNA, 13 nt, Homo sapiens
ugcacagcugcuu

SEQ ID NO: 678636 - RNA, 14 nt, Homo sapiens
ugcacagcugcuug

SEQ ID NO: 678637 - RNA, 16 nt, Homo sapiens
ugcacaggaugcuggc

SEQ ID NO: 678638 - RNA, 17 nt, Homo sapiens
ugcacagggauucucac

SEQ ID NO: 678639 - RNA, 16 nt, Homo sapiens
ugcacaguaaaaaugg

SEQ ID NO: 678640 - RNA, 23 nt, Homo sapiens
ugcacauaguagguacccaauuc

SEQ ID NO: 678641 - RNA, 20 nt, Homo sapiens
ugcacaugaacauaugucca

SEQ ID NO: 678642 - RNA, 11 nt, Homo sapiens
ugcacaugugc

SEQ ID NO: 678643 - RNA, 11 nt, Homo sapiens
ugcacauugua

SEQ ID NO: 678644 - RNA, 17 nt, Homo sapiens
ugcaccaaacugccuca

SEQ ID NO: 678645 - RNA, 18 nt, Homo sapiens
ugcaccaaagacaucagu

SEQ ID NO: 678646 - RNA, 12 nt, Homo sapiens
ugcaccaaagag

SEQ ID NO: 678647 - RNA, 21 nt, Homo sapiens
ugcaccaacgagcuguacaug

SEQ ID NO: 678648 - RNA, 17 nt, Homo sapiens
ugcaccaccaagccaag

SEQ ID NO: 678649 - RNA, 14 nt, Homo sapiens
ugcaccaccaugcc

SEQ ID NO: 678650 - RNA, 15 nt, Homo sapiens
ugcaccaccaugccc

SEQ ID NO: 678651 - RNA, 17 nt, Homo sapiens
ugcaccagugugacauc

SEQ ID NO: 678652 - RNA, 17 nt, Homo sapiens
ugcaccauugcacucua

SEQ ID NO: 678653 - RNA, 17 nt, Homo sapiens
ugcaccccagcauucca

SEQ ID NO: 678654 - RNA, 13 nt, Homo sapiens
ugcacccuggaag

SEQ ID NO: 678655 - RNA, 14 nt, Homo sapiens
ugcacccuggaagg

SEQ ID NO: 678656 - RNA, 21 nt, Homo sapiens
ugcaccuacccacaugcacuc

SEQ ID NO: 678657 - RNA, 19 nt, Homo sapiens
ugcaccuacugcuuacugu

SEQ ID NO: 678658 - RNA, 19 nt, Homo sapiens
ugcaccuccgcuugccaga

SEQ ID NO: 678659 - RNA, 22 nt, Homo sapiens
ugcaccugggagaaagacuuug

SEQ ID NO: 678660 - RNA, 21 nt, Homo sapiens
ugcaccuguccccacccucca

SEQ ID NO: 678661 - RNA, 19 nt, Homo sapiens
ugcacgggagaauauacaa

SEQ ID NO: 678662 - RNA, 16 nt, Homo sapiens
ugcacguggggcccac

SEQ ID NO: 678663 - RNA, 23 nt, Homo sapiens
ugcacuaaaucagagacaaaaua

SEQ ID NO: 678664 - RNA, 14 nt, Homo sapiens
ugcacuaacagagu

SEQ ID NO: 678665 - RNA, 18 nt, Homo sapiens
ugcacuagccugugauua

SEQ ID NO: 678666 - RNA, 10 nt, Homo sapiens
ugcacuauug

SEQ ID NO: 678667 - RNA, 14 nt, Homo sapiens
ugcacuccagccug

SEQ ID NO: 678668 - RNA, 10 nt, Homo sapiens
ugcacuccau

SEQ ID NO: 678669 - RNA, 16 nt, Homo sapiens
ugcacucuaaacugca

SEQ ID NO: 678670 - RNA, 20 nt, Homo sapiens
ugcacucuagccugggugac

SEQ ID NO: 678671 - RNA, 20 nt, Homo sapiens
ugcacugacagccuugccca

SEQ ID NO: 678672 - RNA, 16 nt, Homo sapiens
ugcacugacugugaaa

SEQ ID NO: 678673 - RNA, 16 nt, Homo sapiens
ugcacugaucacccaa

SEQ ID NO: 678674 - RNA, 19 nt, Homo sapiens
ugcacuguucaaaccucug

SEQ ID NO: 678675 - RNA, 21 nt, Homo sapiens
ugcacuguucccccugugcag

SEQ ID NO: 678676 - RNA, 14 nt, Homo sapiens
ugcacuuacuugcu

SEQ ID NO: 678677 - RNA, 21 nt, Homo sapiens
ugcacuugcacgcccaugugu

SEQ ID NO: 678678 - RNA, 20 nt, Homo sapiens
ugcacuuguggcaacagaua

SEQ ID NO: 678679 - RNA, 15 nt, Homo sapiens
ugauagacuuguuag

SEQ ID NO: 678680 - RNA, 13 nt, Homo sapiens
ugauagcacuuuc

SEQ ID NO: 678681 - RNA, 23 nt, Homo sapiens
ugauagcacuuucuacaauguga

SEQ ID NO: 678682 - RNA, 13 nt, Homo sapiens
ugauagcuuuauu

SEQ ID NO: 678683 - RNA, 22 nt, Homo sapiens
ugauagggaaggcuacuaccua

SEQ ID NO: 678684 - RNA, 21 nt, Homo sapiens
ugauaguccaauuuuuacuca

SEQ ID NO: 678685 - RNA, 16 nt, Homo sapiens
ugauaguucaguccca

SEQ ID NO: 678686 - RNA, 13 nt, Homo sapiens
ugauauacauugu

SEQ ID NO: 678687 - RNA, 15 nt, Homo sapiens
ugauauacuaugacu

SEQ ID NO: 678688 - RNA, 15 nt, Homo sapiens
ugauauagccagaaa

SEQ ID NO: 678689 - RNA, 23 nt, Homo sapiens
ugauauauuagggacacuuucac

SEQ ID NO: 678690 - RNA, 18 nt, Homo sapiens
ugauaucccccagccuca

SEQ ID NO: 678691 - RNA, 15 nt, Homo sapiens
ugauaucugaucaaa

SEQ ID NO: 678692 - RNA, 18 nt, Homo sapiens
ugauaugcacuauauuca

SEQ ID NO: 678693 - RNA, 12 nt, Homo sapiens
ugauaugcauau

SEQ ID NO: 678694 - RNA, 18 nt, Homo sapiens
ugauauguaaacauaauu

SEQ ID NO: 678695 - RNA, 16 nt, Homo sapiens
ugauauguaaguacuu

SEQ ID NO: 678696 - RNA, 19 nt, Homo sapiens
ugauauguucaacuggaga

SEQ ID NO: 678697 - RNA, 13 nt, Homo sapiens
ugauauugcagcu

SEQ ID NO: 678698 - RNA, 15 nt, Homo sapiens
ugauauugcagcuua

SEQ ID NO: 678699 - RNA, 16 nt, Homo sapiens
ugauauuuuaugcaaa

SEQ ID NO: 678700 - RNA, 17 nt, Homo sapiens
ugauauuuuuacuugca

SEQ ID NO: 678701 - RNA, 12 nt, Homo sapiens
ugaucaacuguu

SEQ ID NO: 678702 - RNA, 11 nt, Homo sapiens
ugaucaaguca

SEQ ID NO: 678703 - RNA, 17 nt, Homo sapiens
ugaucaauaaaauguga

SEQ ID NO: 678704 - RNA, 15 nt, Homo sapiens
ugaucacacaguguu

SEQ ID NO: 678705 - RNA, 22 nt, Homo sapiens
ugaucacaucuaaagcuuuauc

SEQ ID NO: 678706 - RNA, 20 nt, Homo sapiens
ugaucacauucuuuccaaaa

SEQ ID NO: 678707 - RNA, 17 nt, Homo sapiens
ugaucaccaagcaggaa

SEQ ID NO: 678708 - RNA, 15 nt, Homo sapiens
ugaucacugagccau

SEQ ID NO: 678709 - RNA, 13 nt, Homo sapiens
ugaucacuguaaa

SEQ ID NO: 678710 - RNA, 20 nt, Homo sapiens
ugaucagacagcuugaauca

SEQ ID NO: 678711 - RNA, 20 nt, Homo sapiens
ugaucagcgccgcaccagcc

SEQ ID NO: 678712 - RNA, 18 nt, Homo sapiens
ugaucaguccaacugaac

SEQ ID NO: 678713 - RNA, 12 nt, Homo sapiens
ugaucagugaca

SEQ ID NO: 678714 - RNA, 17 nt, Homo sapiens
ugaucauuacauggcug

SEQ ID NO: 678715 - RNA, 16 nt, Homo sapiens
ugaucauuucugccau

SEQ ID NO: 678716 - RNA, 19 nt, Homo sapiens
ugauccaccccgccuuggc

SEQ ID NO: 678717 - RNA, 16 nt, Homo sapiens
ugauccacuucucuca

SEQ ID NO: 678718 - RNA, 16 nt, Homo sapiens
ugauccgcccaccuca

SEQ ID NO: 678719 - RNA, 17 nt, Homo sapiens
ugauccggggguccagg

SEQ ID NO: 678720 - RNA, 19 nt, Homo sapiens
ugauccuaguaauugccua

SEQ ID NO: 678721 - RNA, 15 nt, Homo sapiens
ugauccuugcugaua

SEQ ID NO: 678722 - RNA, 17 nt, Homo sapiens
ugauccuugcugauaaa

SEQ ID NO: 678723 - RNA, 17 nt, Homo sapiens
ugaucgugcagcugcug

SEQ ID NO: 678724 - RNA, 16 nt, Homo sapiens
ugaucucaaagcacaa

SEQ ID NO: 678725 - RNA, 13 nt, Homo sapiens
ugaucucagggca

SEQ ID NO: 678726 - RNA, 20 nt, Homo sapiens
ugaucucccaagcuaucuaa

SEQ ID NO: 678727 - RNA, 18 nt, Homo sapiens
ugaucucuuagaagccau

SEQ ID NO: 678728 - RNA, 16 nt, Homo sapiens
ugaucuggacagaaca

SEQ ID NO: 678729 - RNA, 12 nt, Homo sapiens
ugaucugggcau

SEQ ID NO: 678730 - RNA, 17 nt, Homo sapiens
ugaucugucuguggcaa

SEQ ID NO: 678731 - RNA, 11 nt, Homo sapiens
ugaucuugccu

SEQ ID NO: 678732 - RNA, 20 nt, Homo sapiens
ugaucuuuguuuaaaugcca

SEQ ID NO: 678733 - RNA, 12 nt, Homo sapiens
ugaugaaugaga

SEQ ID NO: 678734 - RNA, 14 nt, Homo sapiens
ugaugacauuucac

SEQ ID NO: 678735 - RNA, 15 nt, Homo sapiens
ugaugacccucugac

SEQ ID NO: 678736 - RNA, 23 nt, Homo sapiens
ugaugacuuagcgucaagacauu

SEQ ID NO: 678737 - RNA, 19 nt, Homo sapiens
ugaugacuugccauuaaaa

SEQ ID NO: 678738 - RNA, 14 nt, Homo sapiens
ugaugagcacgguu

SEQ ID NO: 678739 - RNA, 13 nt, Homo sapiens
ugaugauacuucc

SEQ ID NO: 678740 - RNA, 17 nt, Homo sapiens
ugaugaugcaguuuuca

SEQ ID NO: 678741 - RNA, 16 nt, Homo sapiens
ugaugccaggugcaau

SEQ ID NO: 678742 - RNA, 22 nt, Homo sapiens
ugaugcccucuucuccuugccu

SEQ ID NO: 678743 - RNA, 17 nt, Homo sapiens
ugaugccguuucuuuca

SEQ ID NO: 678744 - RNA, 14 nt, Homo sapiens
ugaugcugggaccc

SEQ ID NO: 678745 - RNA, 19 nt, Homo sapiens
ugaugcuuagauguuccag

SEQ ID NO: 678746 - RNA, 19 nt, Homo sapiens
ugauggaacagaauagaga

SEQ ID NO: 678747 - RNA, 14 nt, Homo sapiens
ugauggacacucca

SEQ ID NO: 678748 - RNA, 18 nt, Homo sapiens
ugauggauuaacauauag

SEQ ID NO: 678749 - RNA, 15 nt, Homo sapiens
ugauggcgauucccu

SEQ ID NO: 678750 - RNA, 17 nt, Homo sapiens
ugauggcuugacaugug

SEQ ID NO: 678751 - RNA, 15 nt, Homo sapiens
ugauggggccugggu

SEQ ID NO: 678752 - RNA, 21 nt, Homo sapiens
ugauggucucaagcuaugauc

SEQ ID NO: 678753 - RNA, 19 nt, Homo sapiens
ugauguaguaacacagauu

SEQ ID NO: 678754 - RNA, 22 nt, Homo sapiens
ugaugucaugaaacuguacaua

SEQ ID NO: 678755 - RNA, 19 nt, Homo sapiens
ugauguccuuggacuccau

SEQ ID NO: 678756 - RNA, 22 nt, Homo sapiens
ugaugugcaaaaccuuuuacug

SEQ ID NO: 678757 - RNA, 15 nt, Homo sapiens
ugauguuaaccaaug

SEQ ID NO: 678758 - RNA, 17 nt, Homo sapiens
ugauguuaaccaaugua

SEQ ID NO: 678759 - RNA, 13 nt, Homo sapiens
ugauguuacuagc

SEQ ID NO: 678760 - RNA, 15 nt, Homo sapiens
ugauguuacugagau

SEQ ID NO: 678761 - RNA, 12 nt, Homo sapiens
ugauguuucaua

SEQ ID NO: 678762 - RNA, 20 nt, Homo sapiens
ugauguuuguggccucagaa

SEQ ID NO: 678763 - RNA, 20 nt, Homo sapiens
ugauuaaaauguuugagcac

SEQ ID NO: 678764 - RNA, 15 nt, Homo sapiens
ugauuaaauucuugc

SEQ ID NO: 678765 - RNA, 17 nt, Homo sapiens
ugauuacaaggcuuuau

SEQ ID NO: 678766 - RNA, 23 nt, Homo sapiens
ugauuacauggauacuucuaaaa

SEQ ID NO: 678767 - RNA, 14 nt, Homo sapiens
ugauuacuaaggaa

SEQ ID NO: 678768 - RNA, 24 nt, Homo sapiens
ugauuagaaauuaccuguggauau

SEQ ID NO: 678769 - RNA, 20 nt, Homo sapiens
ugauuagacagaacaccuau

SEQ ID NO: 678770 - RNA, 23 nt, Homo sapiens
ugauuauauggguauauauucau

SEQ ID NO: 678771 - RNA, 21 nt, Homo sapiens
ugauuauccauauugagucaa

SEQ ID NO: 678772 - RNA, 18 nt, Homo sapiens
ugauuauggagccuuaga

SEQ ID NO: 678773 - RNA, 15 nt, Homo sapiens
ugauuauuacuucug

SEQ ID NO: 678774 - RNA, 20 nt, Homo sapiens
ugauuauuuuuuauacugua

SEQ ID NO: 678775 - RNA, 16 nt, Homo sapiens
ugauucaacacuuaag

SEQ ID NO: 678776 - RNA, 15 nt, Homo sapiens
ugauucaacagggaa

SEQ ID NO: 678777 - RNA, 21 nt, Homo sapiens
ugauucaaccugauacauuua

SEQ ID NO: 678778 - RNA, 13 nt, Homo sapiens
ugauucaagccau

SEQ ID NO: 678779 - RNA, 18 nt, Homo sapiens
ugauucacucaagaguuc

SEQ ID NO: 678780 - RNA, 17 nt, Homo sapiens
ugauucacugccuuccu

SEQ ID NO: 678781 - RNA, 23 nt, Homo sapiens
ugauucaguucccuccuucuuac

SEQ ID NO: 678782 - RNA, 15 nt, Homo sapiens
ugauuccucuuggca

SEQ ID NO: 678783 - RNA, 12 nt, Homo sapiens
ugauucuauguc

SEQ ID NO: 678784 - RNA, 14 nt, Homo sapiens
ugauugcagcuuua

SEQ ID NO: 678785 - RNA, 19 nt, Homo sapiens
ugauuggacauuuucuuca

SEQ ID NO: 678786 - RNA, 14 nt, Homo sapiens
ugauugucaccaug

SEQ ID NO: 678787 - RNA, 16 nt, Homo sapiens
ugauuuaagacuauga

SEQ ID NO: 678788 - RNA, 13 nt, Homo sapiens
ugauuuaaucacc

SEQ ID NO: 678789 - RNA, 14 nt, Homo sapiens
ugauuuacauucaa

SEQ ID NO: 678790 - RNA, 18 nt, Homo sapiens
ugauuuaccuauacauua

SEQ ID NO: 678791 - RNA, 16 nt, Homo sapiens
ugauuuagugaucaaa

SEQ ID NO: 678792 - RNA, 22 nt, Homo sapiens
ugauuucagcaccuacagugua

SEQ ID NO: 678793 - RNA, 13 nt, Homo sapiens
ugauuucaggaua

SEQ ID NO: 678794 - RNA, 12 nt, Homo sapiens
ugauuuccucua

SEQ ID NO: 678795 - RNA, 20 nt, Homo sapiens
ugauuucucuacuugucaua

SEQ ID NO: 678796 - RNA, 18 nt, Homo sapiens
ugauuucugacucuauca

SEQ ID NO: 678797 - RNA, 14 nt, Homo sapiens
ugauuucugcccuu

SEQ ID NO: 678798 - RNA, 22 nt, Homo sapiens
ugauuucuuauuauuauauguu

SEQ ID NO: 678799 - RNA, 15 nt, Homo sapiens
ugauuugaaaaguau

SEQ ID NO: 678800 - RNA, 18 nt, Homo sapiens
ugauuugcucuuugacaa

SEQ ID NO: 678801 - RNA, 15 nt, Homo sapiens
ugauuuguagcacug

SEQ ID NO: 678802 - RNA, 18 nt, Homo sapiens
ugauuuguagcacugagg

SEQ ID NO: 678803 - RNA, 23 nt, Homo sapiens
ugaggaaguggcugucccugugg

SEQ ID NO: 678804 - RNA, 15 nt, Homo sapiens
ugaggaauccaaaag

SEQ ID NO: 678805 - RNA, 20 nt, Homo sapiens
ugaggaauucuucuguucuc

SEQ ID NO: 678806 - RNA, 15 nt, Homo sapiens
ugaggacagcugucc

SEQ ID NO: 678807 - RNA, 15 nt, Homo sapiens
ugaggacauguggaa

SEQ ID NO: 678808 - RNA, 18 nt, Homo sapiens
ugaggacgcuggggaaua

SEQ ID NO: 678809 - RNA, 18 nt, Homo sapiens
ugaggagacaucuacaca

SEQ ID NO: 678810 - RNA, 20 nt, Homo sapiens
ugaggagagcacccuaggca

SEQ ID NO: 678811 - RNA, 21 nt, Homo sapiens
ugaggagaggaguuuucucca

SEQ ID NO: 678812 - RNA, 17 nt, Homo sapiens
ugaggagcccuaagcau

SEQ ID NO: 678813 - RNA, 20 nt, Homo sapiens
ugaggagcuguuacugaaua

SEQ ID NO: 678814 - RNA, 13 nt, Homo sapiens
ugaggaggacaaa

SEQ ID NO: 678815 - RNA, 15 nt, Homo sapiens
ugaggaggaggacac

SEQ ID NO: 678816 - RNA, 19 nt, Homo sapiens
ugaggaggaggacacagca

SEQ ID NO: 678817 - RNA, 15 nt, Homo sapiens
ugaggauaaugggaa

SEQ ID NO: 678818 - RNA, 21 nt, Homo sapiens
ugaggauauaaugugugcuuu

SEQ ID NO: 678819 - RNA, 17 nt, Homo sapiens
ugaggauguguuuugca

SEQ ID NO: 678820 - RNA, 20 nt, Homo sapiens
ugaggcaggagaagaacaag

SEQ ID NO: 678821 - RNA, 19 nt, Homo sapiens
ugaggcauuuccagacuug

SEQ ID NO: 678822 - RNA, 23 nt, Homo sapiens
ugaggccacugcugcuucuccau

SEQ ID NO: 678823 - RNA, 21 nt, Homo sapiens
ugaggcccauucuucacucuu

SEQ ID NO: 678824 - RNA, 20 nt, Homo sapiens
ugaggcccugcccaaugaga

SEQ ID NO: 678825 - RNA, 19 nt, Homo sapiens
ugaggccuccagcuucagg

SEQ ID NO: 678826 - RNA, 14 nt, Homo sapiens
ugaggccugugcuc

SEQ ID NO: 678827 - RNA, 17 nt, Homo sapiens
ugaggccuuguguguca

SEQ ID NO: 678828 - RNA, 14 nt, Homo sapiens
ugaggcucucuagu

SEQ ID NO: 678829 - RNA, 14 nt, Homo sapiens
ugaggcugcaccca

SEQ ID NO: 678830 - RNA, 14 nt, Homo sapiens
ugaggcugcagcga

SEQ ID NO: 678831 - RNA, 15 nt, Homo sapiens
ugaggcuuccaggcu

SEQ ID NO: 678832 - RNA, 17 nt, Homo sapiens
ugaggcuucuccuucuc

SEQ ID NO: 678833 - RNA, 17 nt, Homo sapiens
ugagggaccaagcugcu

SEQ ID NO: 678834 - RNA, 19 nt, Homo sapiens
ugagggagccuggccccau

SEQ ID NO: 678835 - RNA, 20 nt, Homo sapiens
ugagggagggccaagcccag

SEQ ID NO: 678836 - RNA, 21 nt, Homo sapiens
ugagggaggggagcuaugcua

SEQ ID NO: 678837 - RNA, 16 nt, Homo sapiens
ugagggcccagagcag

SEQ ID NO: 678838 - RNA, 18 nt, Homo sapiens
ugagggcucacucagcca

SEQ ID NO: 678839 - RNA, 20 nt, Homo sapiens
ugagggcuggggguggacuu

SEQ ID NO: 678840 - RNA, 22 nt, Homo sapiens
ugaggggguaauaaaccuccuu

SEQ ID NO: 678841 - RNA, 13 nt, Homo sapiens
ugaggggugcugg

SEQ ID NO: 678842 - RNA, 15 nt, Homo sapiens
ugagggguugaggga

SEQ ID NO: 678843 - RNA, 20 nt, Homo sapiens
ugaggguaucugacaaugcu

SEQ ID NO: 678844 - RNA, 14 nt, Homo sapiens
ugaggguuagcaag

SEQ ID NO: 678845 - RNA, 21 nt, Homo sapiens
ugagguaaauuaaauucccac

SEQ ID NO: 678846 - RNA, 22 nt, Homo sapiens
ugagguaauucuagccuuuuaa

SEQ ID NO: 678847 - RNA, 14 nt, Homo sapiens
ugagguacagcaga

SEQ ID NO: 678848 - RNA, 21 nt, Homo sapiens
ugagguaccaguuguauuuaa

SEQ ID NO: 678849 - RNA, 22 nt, Homo sapiens
ugagguccaggguugcuaggaa

SEQ ID NO: 678850 - RNA, 12 nt, Homo sapiens
ugaggugcucaa

SEQ ID NO: 678851 - RNA, 17 nt, Homo sapiens
ugaggugggcuggggcu

SEQ ID NO: 678852 - RNA, 23 nt, Homo sapiens
ugaggugggucuaccucaucucu

SEQ ID NO: 678853 - RNA, 15 nt, Homo sapiens
ugagguggugccuuc

SEQ ID NO: 678854 - RNA, 19 nt, Homo sapiens
ugagguggugccuucucac

SEQ ID NO: 678855 - RNA, 23 nt, Homo sapiens
ugagguuguggagaaaaagauau

SEQ ID NO: 678856 - RNA, 16 nt, Homo sapiens
ugaguaaaaugaagga

SEQ ID NO: 678857 - RNA, 23 nt, Homo sapiens
ugaguaaacugaggcccaaagca

SEQ ID NO: 678858 - RNA, 15 nt, Homo sapiens
ugaguaacauuugcu

SEQ ID NO: 678859 - RNA, 17 nt, Homo sapiens
ugaguaaucauacucaa

SEQ ID NO: 678860 - RNA, 19 nt, Homo sapiens
ugaguaaugguguagaaca

SEQ ID NO: 678861 - RNA, 19 nt, Homo sapiens
ugaguaaugguuacuaggc

SEQ ID NO: 678862 - RNA, 19 nt, Homo sapiens
ugaguacuggaauaaacag

SEQ ID NO: 678863 - RNA, 17 nt, Homo sapiens
ugaguagaguugaucaa

SEQ ID NO: 678864 - RNA, 22 nt, Homo sapiens
ugaguagcuggauuacaggcau

SEQ ID NO: 678865 - RNA, 18 nt, Homo sapiens
ugaguaucuuaaguacug

SEQ ID NO: 678866 - RNA, 18 nt, Homo sapiens
ugaguauuccaugagcug

SEQ ID NO: 678867 - RNA, 18 nt, Homo sapiens
ugaguauuggaagacuug

SEQ ID NO: 678868 - RNA, 13 nt, Homo sapiens
ugaguauuuagga

SEQ ID NO: 678869 - RNA, 15 nt, Homo sapiens
ugagucaaugugcag

SEQ ID NO: 678870 - RNA, 17 nt, Homo sapiens
ugagucaaugugcagug

SEQ ID NO: 678871 - RNA, 22 nt, Homo sapiens
ugagucagacacgauugagaac

SEQ ID NO: 678872 - RNA, 16 nt, Homo sapiens
ugagucagacugucag

SEQ ID NO: 678873 - RNA, 14 nt, Homo sapiens
ugagucagugccau

SEQ ID NO: 678874 - RNA, 20 nt, Homo sapiens
ugagucagugccaugacuga

SEQ ID NO: 678875 - RNA, 17 nt, Homo sapiens
ugagucagugcucucag

SEQ ID NO: 678876 - RNA, 23 nt, Homo sapiens
ugagucauuuaaauguguacaau

SEQ ID NO: 678877 - RNA, 18 nt, Homo sapiens
ugaguccaucuaacauca

SEQ ID NO: 678878 - RNA, 22 nt, Homo sapiens
ugaguccuguugaagacuuccu

SEQ ID NO: 678879 - RNA, 17 nt, Homo sapiens
ugagugaaccuguauaa

SEQ ID NO: 678880 - RNA, 16 nt, Homo sapiens
ugagugcacuaaacaa

SEQ ID NO: 678881 - RNA, 13 nt, Homo sapiens
ugagugcacugac

SEQ ID NO: 678882 - RNA, 23 nt, Homo sapiens
ugagugcagccaaaggggagcca

SEQ ID NO: 678883 - RNA, 19 nt, Homo sapiens
ugagugcccaacccuaucc

SEQ ID NO: 678884 - RNA, 18 nt, Homo sapiens
ugaguggaucuccaagga

SEQ ID NO: 678885 - RNA, 22 nt, Homo sapiens
ugagugggagaaggcagugauu

SEQ ID NO: 678886 - RNA, 14 nt, Homo sapiens
ugaguggucuucaa

SEQ ID NO: 678887 - RNA, 19 nt, Homo sapiens
ugagugugugugcauggaa

SEQ ID NO: 678888 - RNA, 21 nt, Homo sapiens
ugaguuaacucacugagggua

SEQ ID NO: 678889 - RNA, 16 nt, Homo sapiens
ugaguuacagccuguu

SEQ ID NO: 678890 - RNA, 12 nt, Homo sapiens
ugaguuacuuag

SEQ ID NO: 678891 - RNA, 12 nt, Homo sapiens
ugaguuacuuga

SEQ ID NO: 678892 - RNA, 21 nt, Homo sapiens
ugaguugccaagacaaaucaa

SEQ ID NO: 678893 - RNA, 19 nt, Homo sapiens
ugaguugcuuuucagcuga

SEQ ID NO: 678894 - RNA, 15 nt, Homo sapiens
ugaguuguguuccac

SEQ ID NO: 678895 - RNA, 16 nt, Homo sapiens
ugaguuuauauucuga

SEQ ID NO: 678896 - RNA, 19 nt, Homo sapiens
ugaguuucuggcucuugag

SEQ ID NO: 678897 - RNA, 23 nt, Homo sapiens
ugaguuucuguucucccugggaa

SEQ ID NO: 678898 - RNA, 22 nt, Homo sapiens
ugaguuucuuaacccuuuccag

SEQ ID NO: 678899 - RNA, 18 nt, Homo sapiens
ugaguuugcuguuugcaa

SEQ ID NO: 678900 - RNA, 20 nt, Homo sapiens
ugaguuuuuccucccaguga

SEQ ID NO: 678901 - RNA, 22 nt, Homo sapiens
ugauaaaaacccaaaauacagc

SEQ ID NO: 678902 - RNA, 15 nt, Homo sapiens
ugauaaaauacuaaa

SEQ ID NO: 678903 - RNA, 21 nt, Homo sapiens
ugauaacucugagcaguuuca

SEQ ID NO: 678904 - RNA, 23 nt, Homo sapiens
ugauaauaaauuagguaagauaa

SEQ ID NO: 678905 - RNA, 16 nt, Homo sapiens
ugauaauaauugauca

SEQ ID NO: 678906 - RNA, 15 nt, Homo sapiens
ugauaauagcacuaa

SEQ ID NO: 678907 - RNA, 20 nt, Homo sapiens
ugauaauagcacuaaugcuu

SEQ ID NO: 678908 - RNA, 19 nt, Homo sapiens
ugauacaagaaagcaaugc

SEQ ID NO: 678909 - RNA, 21 nt, Homo sapiens
ugauacacagaauauaaucuu

SEQ ID NO: 678910 - RNA, 14 nt, Homo sapiens
ugauacacuaugaa

SEQ ID NO: 678911 - RNA, 16 nt, Homo sapiens
ugauacaguacuuuga

SEQ ID NO: 678912 - RNA, 18 nt, Homo sapiens
ugauacaugcauugcucu

SEQ ID NO: 678913 - RNA, 16 nt, Homo sapiens
ugauaccacgaggaaa

SEQ ID NO: 678914 - RNA, 12 nt, Homo sapiens
ugauaccacugc

SEQ ID NO: 678915 - RNA, 14 nt, Homo sapiens
ugauaccacugcac

SEQ ID NO: 678916 - RNA, 14 nt, Homo sapiens
ugauacccugaauu

SEQ ID NO: 678917 - RNA, 12 nt, Homo sapiens
ugauacguguau

SEQ ID NO: 678918 - RNA, 12 nt, Homo sapiens
ugauacugcuga

SEQ ID NO: 678919 - RNA, 21 nt, Homo sapiens
ugauacuuacugaacugugug

SEQ ID NO: 678920 - RNA, 12 nt, Homo sapiens
ugauacuuugac

SEQ ID NO: 678921 - RNA, 17 nt, Homo sapiens
ugauacuuugacagugu

SEQ ID NO: 678922 - RNA, 20 nt, Homo sapiens
ugauagaaccauugcaauau

SEQ ID NO: 678923 - RNA, 17 nt, Homo sapiens
ugauagaacuacuuuga

SEQ ID NO: 678924 - RNA, 13 nt, Homo sapiens
ugauagaauacaa

SEQ ID NO: 678925 - RNA, 22 nt, Homo sapiens
ugagagcaauauuuaaauucuc

SEQ ID NO: 678926 - RNA, 20 nt, Homo sapiens
ugagagcaauuguaacgguu

SEQ ID NO: 678927 - RNA, 15 nt, Homo sapiens
ugagagcccagucau

SEQ ID NO: 678928 - RNA, 19 nt, Homo sapiens
ugagagcugcucuggaaaa

SEQ ID NO: 678929 - RNA, 21 nt, Homo sapiens
ugagagggaaaagauugacug

SEQ ID NO: 678930 - RNA, 16 nt, Homo sapiens
ugagagggcccagaag

SEQ ID NO: 678931 - RNA, 17 nt, Homo sapiens
ugagaggguuugaguca

SEQ ID NO: 678932 - RNA, 18 nt, Homo sapiens
ugagaggguuugagucaa

SEQ ID NO: 678933 - RNA, 19 nt, Homo sapiens
ugagaggugacacuguugg

SEQ ID NO: 678934 - RNA, 20 nt, Homo sapiens
ugagaguacucacuuuucac

SEQ ID NO: 678935 - RNA, 12 nt, Homo sapiens
ugagaguauuua

SEQ ID NO: 678936 - RNA, 13 nt, Homo sapiens
ugagagucacuug

SEQ ID NO: 678937 - RNA, 14 nt, Homo sapiens
ugagauacauuccc

SEQ ID NO: 678938 - RNA, 23 nt, Homo sapiens
ugagauaccacaaacccugcuga

SEQ ID NO: 678939 - RNA, 19 nt, Homo sapiens
ugagauagcauugugaacu

SEQ ID NO: 678940 - RNA, 14 nt, Homo sapiens
ugagaucccgacaa

SEQ ID NO: 678941 - RNA, 23 nt, Homo sapiens
ugagaucuaaggaugucacaggg

SEQ ID NO: 678942 - RNA, 22 nt, Homo sapiens
ugagaugauacauccaaagcag

SEQ ID NO: 678943 - RNA, 17 nt, Homo sapiens
ugagaugcguuguuaca

SEQ ID NO: 678944 - RNA, 18 nt, Homo sapiens
ugagauuaagaaugccag

SEQ ID NO: 678945 - RNA, 14 nt, Homo sapiens
ugagauugugaagu

SEQ ID NO: 678946 - RNA, 22 nt, Homo sapiens
ugagcaaggagcacaagccaca

SEQ ID NO: 678947 - RNA, 18 nt, Homo sapiens
ugagcaagggggcccaaa

SEQ ID NO: 678948 - RNA, 15 nt, Homo sapiens
ugagcaauaugccuc

SEQ ID NO: 678949 - RNA, 18 nt, Homo sapiens
ugagcaauaugucaguca

SEQ ID NO: 678950 - RNA, 18 nt, Homo sapiens
ugagcacaucucucugcc

SEQ ID NO: 678951 - RNA, 23 nt, Homo sapiens
ugagcacuguuuauacacugugu

SEQ ID NO: 678952 - RNA, 16 nt, Homo sapiens
ugagcagaagcuggag

SEQ ID NO: 678953 - RNA, 22 nt, Homo sapiens
ugagcagaauacuggucucagg

SEQ ID NO: 678954 - RNA, 18 nt, Homo sapiens
ugagcagagauguacugc

SEQ ID NO: 678955 - RNA, 22 nt, Homo sapiens
ugagcagccucuggacagccag

SEQ ID NO: 678956 - RNA, 19 nt, Homo sapiens
ugagcagggagaagccaga

SEQ ID NO: 678957 - RNA, 18 nt, Homo sapiens
ugagcaguggacacguga

SEQ ID NO: 678958 - RNA, 14 nt, Homo sapiens
ugagcauaaaucaa

SEQ ID NO: 678959 - RNA, 23 nt, Homo sapiens
ugagcauaucugguauaugucau

SEQ ID NO: 678960 - RNA, 23 nt, Homo sapiens
ugagcauccucucucacauggaa

SEQ ID NO: 678961 - RNA, 15 nt, Homo sapiens
ugagcauuugcaccu

SEQ ID NO: 678962 - RNA, 19 nt, Homo sapiens
ugagccaaaaugacuuuga

SEQ ID NO: 678963 - RNA, 21 nt, Homo sapiens
ugagccacucagucucuucca

SEQ ID NO: 678964 - RNA, 14 nt, Homo sapiens
ugagccaugagaug

SEQ ID NO: 678965 - RNA, 23 nt, Homo sapiens
ugagccccuggucuucucuacag

SEQ ID NO: 678966 - RNA, 18 nt, Homo sapiens
ugagccgagaucaugcca

SEQ ID NO: 678967 - RNA, 14 nt, Homo sapiens
ugagccgcugugag

SEQ ID NO: 678968 - RNA, 21 nt, Homo sapiens
ugagccuaugauauuccccau

SEQ ID NO: 678969 - RNA, 21 nt, Homo sapiens
ugagccucacagcagugagac

SEQ ID NO: 678970 - RNA, 21 nt, Homo sapiens
ugagccugccaaagugccugg

SEQ ID NO: 678971 - RNA, 23 nt, Homo sapiens
ugagccuggcuggagagcugcua

SEQ ID NO: 678972 - RNA, 15 nt, Homo sapiens
ugagcggcacccugg

SEQ ID NO: 678973 - RNA, 20 nt, Homo sapiens
ugagcgucacggccaagugu

SEQ ID NO: 678974 - RNA, 21 nt, Homo sapiens
ugagcgucacugcccaccaaa

SEQ ID NO: 678975 - RNA, 23 nt, Homo sapiens
ugagcgugaaucuguaucuugcc

SEQ ID NO: 678976 - RNA, 13 nt, Homo sapiens
ugagcguuugcac

SEQ ID NO: 678977 - RNA, 13 nt, Homo sapiens
ugagcuacuucaa

SEQ ID NO: 678978 - RNA, 23 nt, Homo sapiens
ugagcuagagauaaaacagaauc

SEQ ID NO: 678979 - RNA, 21 nt, Homo sapiens
ugagcuaucuccuaacuuugg

SEQ ID NO: 678980 - RNA, 21 nt, Homo sapiens
ugagcucccaccucccuuccc

SEQ ID NO: 678981 - RNA, 21 nt, Homo sapiens
ugagcucgguggcucaugccu

SEQ ID NO: 678982 - RNA, 15 nt, Homo sapiens
ugagcugacaucuca

SEQ ID NO: 678983 - RNA, 20 nt, Homo sapiens
ugagcugcucauuacaguuc

SEQ ID NO: 678984 - RNA, 18 nt, Homo sapiens
ugagcuggaaggggccac

SEQ ID NO: 678985 - RNA, 21 nt, Homo sapiens
ugagcuggccucucuagcaca

SEQ ID NO: 678986 - RNA, 14 nt, Homo sapiens
ugagcuggggaccu

SEQ ID NO: 678987 - RNA, 16 nt, Homo sapiens
ugagcugggggaagaa

SEQ ID NO: 678988 - RNA, 12 nt, Homo sapiens
ugagcugugcag

SEQ ID NO: 678989 - RNA, 19 nt, Homo sapiens
ugagcuuagugaaauuacu

SEQ ID NO: 678990 - RNA, 18 nt, Homo sapiens
ugagcuuccccaagcacg

SEQ ID NO: 678991 - RNA, 15 nt, Homo sapiens
ugagcuugacaccug

SEQ ID NO: 678992 - RNA, 18 nt, Homo sapiens
ugagcuugauuaaaucaa

SEQ ID NO: 678993 - RNA, 23 nt, Homo sapiens
ugagcuuuccauguugcugccaa

SEQ ID NO: 678994 - RNA, 21 nt, Homo sapiens
ugaggaaaagcggacaucagc

SEQ ID NO: 678995 - RNA, 13 nt, Homo sapiens
ugaggaacauuca

SEQ ID NO: 678996 - RNA, 14 nt, Homo sapiens
uauccugugcuuga

SEQ ID NO: 678997 - RNA, 12 nt, Homo sapiens
uauccuguuguu

SEQ ID NO: 678998 - RNA, 19 nt, Homo sapiens
uauccuucuagaucauaca

SEQ ID NO: 678999 - RNA, 21 nt, Homo sapiens
uauccuuucauuaggcaaagu

SEQ ID NO: 679000 - RNA, 15 nt, Homo sapiens
uaucgcuccuauuga

SEQ ID NO: 679001 - RNA, 18 nt, Homo sapiens
uaucgcuccuauugaaag

SEQ ID NO: 679002 - RNA, 21 nt, Homo sapiens
uaucgggagcagugucuucca

SEQ ID NO: 679003 - RNA, 21 nt, Homo sapiens
uaucuaaaugaaugagccaaa

SEQ ID NO: 679004 - RNA, 20 nt, Homo sapiens
uaucuaauauauaugaauaa

SEQ ID NO: 679005 - RNA, 12 nt, Homo sapiens
uaucuaccccag

SEQ ID NO: 679006 - RNA, 12 nt, Homo sapiens
uaucuacuacaa

SEQ ID NO: 679007 - RNA, 12 nt, Homo sapiens
uaucuacugugg

SEQ ID NO: 679008 - RNA, 15 nt, Homo sapiens
uaucuacuucuacau

SEQ ID NO: 679009 - RNA, 16 nt, Homo sapiens
uaucuagauacuguau

SEQ ID NO: 679010 - RNA, 19 nt, Homo sapiens
uaucuagcaaucacaacac

SEQ ID NO: 679011 - RNA, 15 nt, Homo sapiens
uaucuauagcugcua

SEQ ID NO: 679012 - RNA, 12 nt, Homo sapiens
uaucuaugcaaa

SEQ ID NO: 679013 - RNA, 20 nt, Homo sapiens
uaucucauacugucugggau

SEQ ID NO: 679014 - RNA, 17 nt, Homo sapiens
uaucuccagauggaaug

SEQ ID NO: 679015 - RNA, 23 nt, Homo sapiens
uaucugagggaggaggccaccuc

SEQ ID NO: 679016 - RNA, 17 nt, Homo sapiens
uaucugauuguugucag

SEQ ID NO: 679017 - RNA, 20 nt, Homo sapiens
uaucugcacucuaaacugca

SEQ ID NO: 679018 - RNA, 19 nt, Homo sapiens
uaucugcaugugucaugaa

SEQ ID NO: 679019 - RNA, 17 nt, Homo sapiens
uaucugccaaauugaga

SEQ ID NO: 679020 - RNA, 14 nt, Homo sapiens
uaucugccauguga

SEQ ID NO: 679021 - RNA, 15 nt, Homo sapiens
uaucuggacaagcca

SEQ ID NO: 679022 - RNA, 20 nt, Homo sapiens
uaucuggcacuguuaauaca

SEQ ID NO: 679023 - RNA, 23 nt, Homo sapiens
uaucuggcccucgacacucacca

SEQ ID NO: 679024 - RNA, 16 nt, Homo sapiens
uaucuggccugagaca

SEQ ID NO: 679025 - RNA, 18 nt, Homo sapiens
uaucuggucaaccuccug

SEQ ID NO: 679026 - RNA, 22 nt, Homo sapiens
uaucuguagugagauagcauug

SEQ ID NO: 679027 - RNA, 22 nt, Homo sapiens
uaucugugaaaugcuggcauuu

SEQ ID NO: 679028 - RNA, 20 nt, Homo sapiens
uaucugugugugauuugcua

SEQ ID NO: 679029 - RNA, 21 nt, Homo sapiens
uaucuguugccuuauuucuca

SEQ ID NO: 679030 - RNA, 15 nt, Homo sapiens
uaucuuagcuggaua

SEQ ID NO: 679031 - RNA, 18 nt, Homo sapiens
uaucuuaucccuugacaa

SEQ ID NO: 679032 - RNA, 13 nt, Homo sapiens
uaucuuaugccac

SEQ ID NO: 679033 - RNA, 18 nt, Homo sapiens
uaucuuaugcuauuauuc

SEQ ID NO: 679034 - RNA, 17 nt, Homo sapiens
uaucuucaaacuuucac

SEQ ID NO: 679035 - RNA, 14 nt, Homo sapiens
uaucuucuacugua

SEQ ID NO: 679036 - RNA, 15 nt, Homo sapiens
uaucuucuuagcuca

SEQ ID NO: 679037 - RNA, 16 nt, Homo sapiens
uaucuugauaaacuag

SEQ ID NO: 679038 - RNA, 12 nt, Homo sapiens
uaucuugcucca

SEQ ID NO: 679039 - RNA, 14 nt, Homo sapiens
uaucuugcuucauu

SEQ ID NO: 679040 - RNA, 18 nt, Homo sapiens
uaucuugcuucauucuga

SEQ ID NO: 679041 - RNA, 22 nt, Homo sapiens
uaucuugcuuuuuuucaccaau

SEQ ID NO: 679042 - RNA, 19 nt, Homo sapiens
uaucuugggauaguuccca

SEQ ID NO: 679043 - RNA, 17 nt, Homo sapiens
uaucuuguuuuuccacu

SEQ ID NO: 679044 - RNA, 20 nt, Homo sapiens
uaucuuuauuaaucacuauu

SEQ ID NO: 679045 - RNA, 17 nt, Homo sapiens
uaucuuucuaaaacugc

SEQ ID NO: 679046 - RNA, 20 nt, Homo sapiens
uaucuuuugaauucuugaua

SEQ ID NO: 679047 - RNA, 24 nt, Homo sapiens
uaugaaaaauguaaauacucauga

SEQ ID NO: 679048 - RNA, 13 nt, Homo sapiens
uaugaaaacucau

SEQ ID NO: 679049 - RNA, 21 nt, Homo sapiens
uaugaaaaucuccaucucaaa

SEQ ID NO: 679050 - RNA, 18 nt, Homo sapiens
uaugaaacugcacauugg

SEQ ID NO: 679051 - RNA, 17 nt, Homo sapiens
uaugaaauuauaaucug

SEQ ID NO: 679052 - RNA, 14 nt, Homo sapiens
uaugaacuacaaag

SEQ ID NO: 679053 - RNA, 22 nt, Homo sapiens
uaugaauauuuauaacagcauu

SEQ ID NO: 679054 - RNA, 13 nt, Homo sapiens
uaugaaugcagug

SEQ ID NO: 679055 - RNA, 16 nt, Homo sapiens
uaugaauuaagcugua

SEQ ID NO: 679056 - RNA, 19 nt, Homo sapiens
uaugaauuacccuuucauu

SEQ ID NO: 679057 - RNA, 13 nt, Homo sapiens
uaugaauuuccac

SEQ ID NO: 679058 - RNA, 20 nt, Homo sapiens
uaugacaauguugcauuuau

SEQ ID NO: 679059 - RNA, 16 nt, Homo sapiens
uaugacaucacuugua

SEQ ID NO: 679060 - RNA, 15 nt, Homo sapiens
uaugacaucagcaau

SEQ ID NO: 679061 - RNA, 21 nt, Homo sapiens
uaugacaugaucgcuuucuac

SEQ ID NO: 679062 - RNA, 16 nt, Homo sapiens
uaugaccagaagccuu

SEQ ID NO: 679063 - RNA, 14 nt, Homo sapiens
uaugaccuaaguca

SEQ ID NO: 679064 - RNA, 21 nt, Homo sapiens
uaugacuguuuuuguaguggu

SEQ ID NO: 679065 - RNA, 22 nt, Homo sapiens
uaugacuguuuuuguaguggua

SEQ ID NO: 679066 - RNA, 22 nt, Homo sapiens
uaugacuuuccucagaacauga

SEQ ID NO: 679067 - RNA, 13 nt, Homo sapiens
uaugagaaacugg

SEQ ID NO: 679068 - RNA, 17 nt, Homo sapiens
uaugagaauauaccuua

SEQ ID NO: 679069 - RNA, 18 nt, Homo sapiens
uaugagaauauaccuuau

SEQ ID NO: 679070 - RNA, 22 nt, Homo sapiens
uaugagccaggcaucauacuaa

SEQ ID NO: 679071 - RNA, 22 nt, Homo sapiens
uaugaggcauuuguuugaacug

SEQ ID NO: 679072 - RNA, 14 nt, Homo sapiens
uaugaggcuauuaa

SEQ ID NO: 679073 - RNA, 17 nt, Homo sapiens
uaugagucaaugugcag

SEQ ID NO: 679074 - RNA, 21 nt, Homo sapiens
uaugaguuuuugauagcuuua

SEQ ID NO: 679075 - RNA, 15 nt, Homo sapiens
uaugauauugcagcu

SEQ ID NO: 679076 - RNA, 18 nt, Homo sapiens
uaugaucaauaaaggaca

SEQ ID NO: 679077 - RNA, 13 nt, Homo sapiens
uaugaucagaaga

SEQ ID NO: 679078 - RNA, 12 nt, Homo sapiens
uaugaucuuggc

SEQ ID NO: 679079 - RNA, 19 nt, Homo sapiens
uaugaucuuucuuuuccca

SEQ ID NO: 679080 - RNA, 12 nt, Homo sapiens
uaugaugcaguu

SEQ ID NO: 679081 - RNA, 20 nt, Homo sapiens
uaugaugcuaugguuugcca

SEQ ID NO: 679082 - RNA, 17 nt, Homo sapiens
uaugauguauauuuaau

SEQ ID NO: 679083 - RNA, 17 nt, Homo sapiens
uaugauucugcuuuuac

SEQ ID NO: 679084 - RNA, 16 nt, Homo sapiens
uaugauugcauuguau

SEQ ID NO: 679085 - RNA, 20 nt, Homo sapiens
uaugauuguaguuucuguaa

SEQ ID NO: 679086 - RNA, 10 nt, Homo sapiens
uaugcaaaag

SEQ ID NO: 679087 - RNA, 23 nt, Homo sapiens
uaugcaaaagucagcgugacaau

SEQ ID NO: 679088 - RNA, 21 nt, Homo sapiens
uaugcaaaccucaucuuucuc

SEQ ID NO: 679089 - RNA, 18 nt, Homo sapiens
uaugcaacucaucuucac

SEQ ID NO: 679090 - RNA, 13 nt, Homo sapiens
uaugcaaucugag

SEQ ID NO: 679091 - RNA, 16 nt, Homo sapiens
uaugcaauuagguuuu

SEQ ID NO: 679092 - RNA, 23 nt, Homo sapiens
uaugcaccaggucucaagguucu

SEQ ID NO: 679093 - RNA, 17 nt, Homo sapiens
uaugcacuucaaauaau

SEQ ID NO: 679094 - RNA, 18 nt, Homo sapiens
uaugcagaauggcauuug

SEQ ID NO: 679095 - RNA, 17 nt, Homo sapiens
uaugcagggagcacugu

SEQ ID NO: 679096 - RNA, 21 nt, Homo sapiens
uaugcagggagcacuguucac

SEQ ID NO: 679097 - RNA, 14 nt, Homo sapiens
uaugcaguaugcuu

SEQ ID NO: 679098 - RNA, 13 nt, Homo sapiens
uaugcauacuaau

SEQ ID NO: 679099 - RNA, 12 nt, Homo sapiens
uaugcauaucag

SEQ ID NO: 679100 - RNA, 23 nt, Homo sapiens
uaugcaucagauaacaacuguga

SEQ ID NO: 679101 - RNA, 15 nt, Homo sapiens
uaugcauuauaucaa

SEQ ID NO: 679102 - RNA, 17 nt, Homo sapiens
uaugcauucacauuuag

SEQ ID NO: 679103 - RNA, 18 nt, Homo sapiens
uaugcauuugcauuugcu

SEQ ID NO: 679104 - RNA, 21 nt, Homo sapiens
uaugccauggaggcacuaaca

SEQ ID NO: 679105 - RNA, 23 nt, Homo sapiens
uaugcccggaccuccaucagagc

SEQ ID NO: 679106 - RNA, 20 nt, Homo sapiens
uaugcccugcccuuccucag

SEQ ID NO: 679107 - RNA, 15 nt, Homo sapiens
uaugccucauacaca

SEQ ID NO: 679108 - RNA, 22 nt, Homo sapiens
uaugcgcuuaaauuaagauuau

SEQ ID NO: 679109 - RNA, 21 nt, Homo sapiens
uaugcggaggaaagcaagugu

SEQ ID NO: 679110 - RNA, 16 nt, Homo sapiens
uaugcuauuacauaca

SEQ ID NO: 679111 - RNA, 14 nt, Homo sapiens
uaugcuccugcuga

SEQ ID NO: 679112 - RNA, 15 nt, Homo sapiens
uaugcucugugacaa

SEQ ID NO: 679113 - RNA, 16 nt, Homo sapiens
uaugcucugugacaag

SEQ ID NO: 679114 - RNA, 21 nt, Homo sapiens
uaugcugaacgcagaagaaag

SEQ ID NO: 679115 - RNA, 20 nt, Homo sapiens
uaugcugacagcucuucaca

SEQ ID NO: 679116 - RNA, 18 nt, Homo sapiens
uaugcuguauccacaaau

SEQ ID NO: 679117 - RNA, 15 nt, Homo sapiens
uauggaaaugugaga

SEQ ID NO: 679118 - RNA, 12 nt, Homo sapiens
ucucauaggaga

SEQ ID NO: 679119 - RNA, 21 nt, Homo sapiens
ucucauagguugagcaauuuc

SEQ ID NO: 679120 - RNA, 12 nt, Homo sapiens
ucucaucacuca

SEQ ID NO: 679121 - RNA, 23 nt, Homo sapiens
ucucaucaguguccucuugcuca

SEQ ID NO: 679122 - RNA, 22 nt, Homo sapiens
ucucaucucuucagguucucau

SEQ ID NO: 679123 - RNA, 19 nt, Homo sapiens
ucucaucuuacauuucuca

SEQ ID NO: 679124 - RNA, 20 nt, Homo sapiens
ucucaugaacuaccccacaa

SEQ ID NO: 679125 - RNA, 17 nt, Homo sapiens
ucucaugauaccaccuu

SEQ ID NO: 679126 - RNA, 23 nt, Homo sapiens
ucucaugauccaacuaaugccuu

SEQ ID NO: 679127 - RNA, 19 nt, Homo sapiens
ucucaugggaaggggagga

SEQ ID NO: 679128 - RNA, 19 nt, Homo sapiens
ucucauggguggcacucag

SEQ ID NO: 679129 - RNA, 13 nt, Homo sapiens
ucucauguaucuu

SEQ ID NO: 679130 - RNA, 18 nt, Homo sapiens
ucucauuuaaaaugagau

SEQ ID NO: 679131 - RNA, 17 nt, Homo sapiens
ucucauuuccaaaccau

SEQ ID NO: 679132 - RNA, 17 nt, Homo sapiens
ucucauuuggucugcca

SEQ ID NO: 679133 - RNA, 21 nt, Homo sapiens
ucucauuuggucugccagaau

SEQ ID NO: 679134 - RNA, 21 nt, Homo sapiens
ucucauuuuuaucccauugag

SEQ ID NO: 679135 - RNA, 21 nt, Homo sapiens
ucuccaaacagucaccauaca

SEQ ID NO: 679136 - RNA, 15 nt, Homo sapiens
ucuccaaagagaauu

SEQ ID NO: 679137 - RNA, 14 nt, Homo sapiens
ucuccaaaugagau

SEQ ID NO: 679138 - RNA, 14 nt, Homo sapiens
ucuccaaccacugu

SEQ ID NO: 679139 - RNA, 17 nt, Homo sapiens
ucuccaaggaugggaau

SEQ ID NO: 679140 - RNA, 22 nt, Homo sapiens
ucuccaccgucacccaacauca

SEQ ID NO: 679141 - RNA, 20 nt, Homo sapiens
ucuccagcaauaauguuuuc

SEQ ID NO: 679142 - RNA, 19 nt, Homo sapiens
ucuccagcggcccugucau

SEQ ID NO: 679143 - RNA, 13 nt, Homo sapiens
ucuccaggucuca

SEQ ID NO: 679144 - RNA, 14 nt, Homo sapiens
ucuccaguggauuc

SEQ ID NO: 679145 - RNA, 18 nt, Homo sapiens
ucuccaguugggacucag

SEQ ID NO: 679146 - RNA, 18 nt, Homo sapiens
ucuccaguuugcaccugu

SEQ ID NO: 679147 - RNA, 19 nt, Homo sapiens
ucuccaucccucuaaugag

SEQ ID NO: 679148 - RNA, 22 nt, Homo sapiens
ucuccaugaauuaguucuccua

SEQ ID NO: 679149 - RNA, 13 nt, Homo sapiens
ucuccaugcucac

SEQ ID NO: 679150 - RNA, 20 nt, Homo sapiens
ucuccaugcuggauacugga

SEQ ID NO: 679151 - RNA, 16 nt, Homo sapiens
ucuccauugugugauc

SEQ ID NO: 679152 - RNA, 10 nt, Homo sapiens
ucucccaaag

SEQ ID NO: 679153 - RNA, 23 nt, Homo sapiens
ucucccaacaugggagggaucag

SEQ ID NO: 679154 - RNA, 16 nt, Homo sapiens
ucucccaccaccucac

SEQ ID NO: 679155 - RNA, 21 nt, Homo sapiens
ucucccacuaaaacugcauuu

SEQ ID NO: 679156 - RNA, 11 nt, Homo sapiens
ucucccacugc

SEQ ID NO: 679157 - RNA, 19 nt, Homo sapiens
ucucccacuuccuccuacc

SEQ ID NO: 679158 - RNA, 19 nt, Homo sapiens
ucucccagaccgccaguga

SEQ ID NO: 679159 - RNA, 19 nt, Homo sapiens
ucucccaggcuggagugca

SEQ ID NO: 679160 - RNA, 18 nt, Homo sapiens
ucucccagggaugcucuu

SEQ ID NO: 679161 - RNA, 13 nt, Homo sapiens
ucucccaguccau

SEQ ID NO: 679162 - RNA, 22 nt, Homo sapiens
ucucccaguccauuuccaaaug

SEQ ID NO: 679163 - RNA, 19 nt, Homo sapiens
ucucccauccagugucuca

SEQ ID NO: 679164 - RNA, 13 nt, Homo sapiens
ucucccaucucuu

SEQ ID NO: 679165 - RNA, 17 nt, Homo sapiens
ucuccccaggcauuugc

SEQ ID NO: 679166 - RNA, 21 nt, Homo sapiens
ucuccccggcaggccugagaa

SEQ ID NO: 679167 - RNA, 18 nt, Homo sapiens
ucuccccuccucuugccu

SEQ ID NO: 679168 - RNA, 15 nt, Homo sapiens
ucucccuagugccuu

SEQ ID NO: 679169 - RNA, 18 nt, Homo sapiens
ucucccuagugccuucca

SEQ ID NO: 679170 - RNA, 22 nt, Homo sapiens
ucucccucccuuggggccuaug

SEQ ID NO: 679171 - RNA, 13 nt, Homo sapiens
ucucccucggggg

SEQ ID NO: 679172 - RNA, 13 nt, Homo sapiens
ucucccugacccu

SEQ ID NO: 679173 - RNA, 22 nt, Homo sapiens
ucucccuguacaguguuaccau

SEQ ID NO: 679174 - RNA, 20 nt, Homo sapiens
ucucccugucacacacugga

SEQ ID NO: 679175 - RNA, 16 nt, Homo sapiens
ucucccuuguccugcu

SEQ ID NO: 679176 - RNA, 23 nt, Homo sapiens
ucucccuuuccauggcaaauggg

SEQ ID NO: 679177 - RNA, 21 nt, Homo sapiens
ucucccuuugaagaaacuaua

SEQ ID NO: 679178 - RNA, 18 nt, Homo sapiens
ucuccuaaugcuuuaucc

SEQ ID NO: 679179 - RNA, 12 nt, Homo sapiens
ucuccuacuuag

SEQ ID NO: 679180 - RNA, 18 nt, Homo sapiens
ucuccuaggaucccccca

SEQ ID NO: 679181 - RNA, 18 nt, Homo sapiens
ucuccuauaaucugucaa

SEQ ID NO: 679182 - RNA, 14 nt, Homo sapiens
ucuccuaucuugau

SEQ ID NO: 679183 - RNA, 14 nt, Homo sapiens
ucuccucauccauu

SEQ ID NO: 679184 - RNA, 20 nt, Homo sapiens
ucuccucgagcccuccccca

SEQ ID NO: 679185 - RNA, 20 nt, Homo sapiens
ucuccucuucauggcaucuu

SEQ ID NO: 679186 - RNA, 13 nt, Homo sapiens
ucuccugccugcc

SEQ ID NO: 679187 - RNA, 13 nt, Homo sapiens
ucuccugcugauu

SEQ ID NO: 679188 - RNA, 17 nt, Homo sapiens
ucuccuggacucagggu

SEQ ID NO: 679189 - RNA, 12 nt, Homo sapiens
ucuccugugaau

SEQ ID NO: 679190 - RNA, 13 nt, Homo sapiens
ucuccugugugcu

SEQ ID NO: 679191 - RNA, 16 nt, Homo sapiens
ucuccuucccauuucu

SEQ ID NO: 679192 - RNA, 18 nt, Homo sapiens
ucuccuuggccacagacu

SEQ ID NO: 679193 - RNA, 16 nt, Homo sapiens
ucuccuuggcugucug

SEQ ID NO: 679194 - RNA, 14 nt, Homo sapiens
ucuccuuugcugag

SEQ ID NO: 679195 - RNA, 13 nt, Homo sapiens
ucuccuuuggcca

SEQ ID NO: 679196 - RNA, 23 nt, Homo sapiens
ucuccuuuugcgcuuauuuggaa

SEQ ID NO: 679197 - RNA, 21 nt, Homo sapiens
ucucgaaaaaagagacaacuc

SEQ ID NO: 679198 - RNA, 12 nt, Homo sapiens
ucucgcaaaaac

SEQ ID NO: 679199 - RNA, 16 nt, Homo sapiens
ucucgcagauguuacc

SEQ ID NO: 679200 - RNA, 16 nt, Homo sapiens
ucucgcgcgacugaga

SEQ ID NO: 679201 - RNA, 22 nt, Homo sapiens
ucucgcucccuuucagguuuac

SEQ ID NO: 679202 - RNA, 20 nt, Homo sapiens
ucucggcucacugcaaccuc

SEQ ID NO: 679203 - RNA, 16 nt, Homo sapiens
ucucgggugcauuuga

SEQ ID NO: 679204 - RNA, 18 nt, Homo sapiens
ucucguaacugguuucau

SEQ ID NO: 679205 - RNA, 16 nt, Homo sapiens
ucucguaguccaucac

SEQ ID NO: 679206 - RNA, 21 nt, Homo sapiens
ucucguuccagaaauuguggg

SEQ ID NO: 679207 - RNA, 15 nt, Homo sapiens
ucucguucuccuucc

SEQ ID NO: 679208 - RNA, 19 nt, Homo sapiens
ucucuaaagcaucugcucu

SEQ ID NO: 679209 - RNA, 20 nt, Homo sapiens
ucucuaacauaugauacuga

SEQ ID NO: 679210 - RNA, 20 nt, Homo sapiens
ucucuaaccauucaaaugac

SEQ ID NO: 679211 - RNA, 16 nt, Homo sapiens
ucucuaacucagaaac

SEQ ID NO: 679212 - RNA, 22 nt, Homo sapiens
ucucuaauuggaagaaauuccu

SEQ ID NO: 679213 - RNA, 16 nt, Homo sapiens
ucucuacagacuccaa

SEQ ID NO: 679214 - RNA, 18 nt, Homo sapiens
ucucuacagacuccaaaa

SEQ ID NO: 679215 - RNA, 15 nt, Homo sapiens
ucucuaccagucuau

SEQ ID NO: 679216 - RNA, 19 nt, Homo sapiens
ucucuacccauccccugau

SEQ ID NO: 679217 - RNA, 21 nt, Homo sapiens
ucucuacuaaaaacacaaaag

SEQ ID NO: 679218 - RNA, 16 nt, Homo sapiens
ucucuacugaauguca

SEQ ID NO: 679219 - RNA, 17 nt, Homo sapiens
ucucuaggaaauauacu

SEQ ID NO: 679220 - RNA, 16 nt, Homo sapiens
ucucuaggccucucca

SEQ ID NO: 679221 - RNA, 21 nt, Homo sapiens
ucucuaggccuucaggacucu

SEQ ID NO: 679222 - RNA, 23 nt, Homo sapiens
ucucuaugccagcucagucccau

SEQ ID NO: 679223 - RNA, 15 nt, Homo sapiens
ucucuauugcugcuc

SEQ ID NO: 679224 - RNA, 15 nt, Homo sapiens
ucucucacugcauuu

SEQ ID NO: 679225 - RNA, 21 nt, Homo sapiens
ucucuccacgguagcacuuga

SEQ ID NO: 679226 - RNA, 16 nt, Homo sapiens
ucucucccagguccca

SEQ ID NO: 679227 - RNA, 13 nt, Homo sapiens
ucucuccucagga

SEQ ID NO: 679228 - RNA, 16 nt, Homo sapiens
ucucuccuuggccaca

SEQ ID NO: 679229 - RNA, 10 nt, Homo sapiens
ucucucucag

SEQ ID NO: 679230 - RNA, 10 nt, Homo sapiens
ucucucugcu

SEQ ID NO: 679231 - RNA, 13 nt, Homo sapiens
ucucucuuuauac

SEQ ID NO: 679232 - RNA, 17 nt, Homo sapiens
ucucugaagcauguuuc

SEQ ID NO: 679233 - RNA, 19 nt, Homo sapiens
ucucugaagcauguuucau

SEQ ID NO: 679234 - RNA, 16 nt, Homo sapiens
ucucugaagcgacucu

SEQ ID NO: 679235 - RNA, 19 nt, Homo sapiens
ucucugaagcgacucuccu

SEQ ID NO: 679236 - RNA, 22 nt, Homo sapiens
ucucugaauuuucagagacuuu

SEQ ID NO: 679237 - RNA, 18 nt, Homo sapiens
ucucugaccucugcugag

SEQ ID NO: 679238 - RNA, 18 nt, Homo sapiens
ucucugacgcuugugaca

SEQ ID NO: 679239 - RNA, 21 nt, Homo sapiens
ucucugagcacccaagccagg

SEQ ID NO: 679240 - RNA, 15 nt, Homo sapiens
uggcuauaaauauau

SEQ ID NO: 679241 - RNA, 18 nt, Homo sapiens
uggcuauaacagugucuu

SEQ ID NO: 679242 - RNA, 15 nt, Homo sapiens
uggcucacaccugua

SEQ ID NO: 679243 - RNA, 16 nt, Homo sapiens
uggcucacgccuguaa

SEQ ID NO: 679244 - RNA, 23 nt, Homo sapiens
uggcucacugcaagcucugccuc

SEQ ID NO: 679245 - RNA, 18 nt, Homo sapiens
uggcucagagggggacug

SEQ ID NO: 679246 - RNA, 20 nt, Homo sapiens
uggcucagugccaccuaugc

SEQ ID NO: 679247 - RNA, 12 nt, Homo sapiens
uggcucaucucu

SEQ ID NO: 679248 - RNA, 13 nt, Homo sapiens
uggcucaucucuu

SEQ ID NO: 679249 - RNA, 12 nt, Homo sapiens
uggcucaugccu

SEQ ID NO: 679250 - RNA, 19 nt, Homo sapiens
uggcuccgaucucugcuca

SEQ ID NO: 679251 - RNA, 15 nt, Homo sapiens
uggcuccuucacuga

SEQ ID NO: 679252 - RNA, 16 nt, Homo sapiens
uggcuccuugcccuca

SEQ ID NO: 679253 - RNA, 15 nt, Homo sapiens
uggcucucagaaggu

SEQ ID NO: 679254 - RNA, 19 nt, Homo sapiens
uggcucugagauacuaaua

SEQ ID NO: 679255 - RNA, 13 nt, Homo sapiens
uggcucugggaau

SEQ ID NO: 679256 - RNA, 20 nt, Homo sapiens
uggcucuugaggcauuucca

SEQ ID NO: 679257 - RNA, 22 nt, Homo sapiens
uggcucuugaggcauuuccaga

SEQ ID NO: 679258 - RNA, 15 nt, Homo sapiens
uggcugaacuacaag

SEQ ID NO: 679259 - RNA, 15 nt, Homo sapiens
uggcugaccccaaag

SEQ ID NO: 679260 - RNA, 21 nt, Homo sapiens
uggcugaccugggcccacaga

SEQ ID NO: 679261 - RNA, 13 nt, Homo sapiens
uggcugacugggg

SEQ ID NO: 679262 - RNA, 17 nt, Homo sapiens
uggcugagguuccucug

SEQ ID NO: 679263 - RNA, 11 nt, Homo sapiens
uggcugaugau

SEQ ID NO: 679264 - RNA, 16 nt, Homo sapiens
uggcugcccugcagaa

SEQ ID NO: 679265 - RNA, 12 nt, Homo sapiens
uggcugccuuug

SEQ ID NO: 679266 - RNA, 21 nt, Homo sapiens
uggcugccuuugaucacagga

SEQ ID NO: 679267 - RNA, 17 nt, Homo sapiens
uggcugcguacuccacu

SEQ ID NO: 679268 - RNA, 17 nt, Homo sapiens
uggcugcuuuguucaau

SEQ ID NO: 679269 - RNA, 17 nt, Homo sapiens
uggcuggaaggggucca

SEQ ID NO: 679270 - RNA, 15 nt, Homo sapiens
uggcuggacuguaga

SEQ ID NO: 679271 - RNA, 17 nt, Homo sapiens
uggcuggaucagggaau

SEQ ID NO: 679272 - RNA, 15 nt, Homo sapiens
uggcuguacugcuca

SEQ ID NO: 679273 - RNA, 13 nt, Homo sapiens
uggcugucccugu

SEQ ID NO: 679274 - RNA, 18 nt, Homo sapiens
uggcugugccugcuucug

SEQ ID NO: 679275 - RNA, 16 nt, Homo sapiens
uggcuguuucuguaua

SEQ ID NO: 679276 - RNA, 21 nt, Homo sapiens
uggcuuaauguuuauuccuga

SEQ ID NO: 679277 - RNA, 19 nt, Homo sapiens
uggcuuauaaacacauuga

SEQ ID NO: 679278 - RNA, 24 nt, Homo sapiens
uggcuuauuucuaugacaaauuca

SEQ ID NO: 679279 - RNA, 19 nt, Homo sapiens
uggcuucccuaaacugcag

SEQ ID NO: 679280 - RNA, 19 nt, Homo sapiens
uggcuucuaugagcccaga

SEQ ID NO: 679281 - RNA, 14 nt, Homo sapiens
uggcuugacuggau

SEQ ID NO: 679282 - RNA, 13 nt, Homo sapiens
uggcuugaugucc

SEQ ID NO: 679283 - RNA, 15 nt, Homo sapiens
uggcuuggcaucugu

SEQ ID NO: 679284 - RNA, 22 nt, Homo sapiens
uggcuuuccaggagacauauau

SEQ ID NO: 679285 - RNA, 14 nt, Homo sapiens
uggcuuucccagga

SEQ ID NO: 679286 - RNA, 21 nt, Homo sapiens
ugggaaaaaaguuuugaugaa

SEQ ID NO: 679287 - RNA, 16 nt, Homo sapiens
ugggaaaacacugcca

SEQ ID NO: 679288 - RNA, 20 nt, Homo sapiens
ugggaaaagcccacaggccu

SEQ ID NO: 679289 - RNA, 19 nt, Homo sapiens
ugggaaaauccacuaugac

SEQ ID NO: 679290 - RNA, 19 nt, Homo sapiens
ugggaaaccaguucaugca

SEQ ID NO: 679291 - RNA, 16 nt, Homo sapiens
ugggaaauaugaaugc

SEQ ID NO: 679292 - RNA, 19 nt, Homo sapiens
ugggaaaugagaacauucc

SEQ ID NO: 679293 - RNA, 20 nt, Homo sapiens
ugggaacacaucuggcugca

SEQ ID NO: 679294 - RNA, 19 nt, Homo sapiens
ugggaacaugcgugugacc

SEQ ID NO: 679295 - RNA, 14 nt, Homo sapiens
ugggaacugugcaa

SEQ ID NO: 679296 - RNA, 21 nt, Homo sapiens
ugggaagaccagcuuugcagu

SEQ ID NO: 679297 - RNA, 20 nt, Homo sapiens
ugggaagagaagagggccca

SEQ ID NO: 679298 - RNA, 16 nt, Homo sapiens
ugggaaggaaggcagu

SEQ ID NO: 679299 - RNA, 13 nt, Homo sapiens
ugggaagggauaa

SEQ ID NO: 679300 - RNA, 16 nt, Homo sapiens
ugggaagugaagucau

SEQ ID NO: 679301 - RNA, 22 nt, Homo sapiens
ugggaauagggagacaggguag

SEQ ID NO: 679302 - RNA, 13 nt, Homo sapiens
ugggaaugcaaua

SEQ ID NO: 679303 - RNA, 13 nt, Homo sapiens
ugggaaugcacuu

SEQ ID NO: 679304 - RNA, 23 nt, Homo sapiens
ugggaauggggacacggugucca

SEQ ID NO: 679305 - RNA, 20 nt, Homo sapiens
ugggaauguauuauucugca

SEQ ID NO: 679306 - RNA, 23 nt, Homo sapiens
ugggaaugucucuuuggcgaccu

SEQ ID NO: 679307 - RNA, 14 nt, Homo sapiens
ugggaauugcacag

SEQ ID NO: 679308 - RNA, 17 nt, Homo sapiens
ugggaauuuucuuccaa

SEQ ID NO: 679309 - RNA, 21 nt, Homo sapiens
ugggacagacggaaaugaaau

SEQ ID NO: 679310 - RNA, 16 nt, Homo sapiens
ugggacagcaugacug

SEQ ID NO: 679311 - RNA, 12 nt, Homo sapiens
ugggacagggag

SEQ ID NO: 679312 - RNA, 22 nt, Homo sapiens
ugggaccaacuuccuguugaug

SEQ ID NO: 679313 - RNA, 13 nt, Homo sapiens
ugggaccacagag

SEQ ID NO: 679314 - RNA, 18 nt, Homo sapiens
ugggaccaucacugagag

SEQ ID NO: 679315 - RNA, 22 nt, Homo sapiens
ugggacccuucagccacuacaa

SEQ ID NO: 679316 - RNA, 14 nt, Homo sapiens
ugggacccuugaga

SEQ ID NO: 679317 - RNA, 23 nt, Homo sapiens
ugggaccucaguuuuaucauuuu

SEQ ID NO: 679318 - RNA, 18 nt, Homo sapiens
ugggacgcacagugcagu

SEQ ID NO: 679319 - RNA, 18 nt, Homo sapiens
ugggacgggaugguucug

SEQ ID NO: 679320 - RNA, 14 nt, Homo sapiens
ugggacugcuaaau

SEQ ID NO: 679321 - RNA, 15 nt, Homo sapiens
ugggacuuccuugcu

SEQ ID NO: 679322 - RNA, 21 nt, Homo sapiens
ugggagaaauugacagaucaa

SEQ ID NO: 679323 - RNA, 15 nt, Homo sapiens
ugggagagccuggca

SEQ ID NO: 679324 - RNA, 17 nt, Homo sapiens
ugggagauguucuuccu

SEQ ID NO: 679325 - RNA, 14 nt, Homo sapiens
ugggagcacaggca

SEQ ID NO: 679326 - RNA, 15 nt, Homo sapiens
ugggagcaccgccug

SEQ ID NO: 679327 - RNA, 16 nt, Homo sapiens
ugggagcagagaaaau

SEQ ID NO: 679328 - RNA, 18 nt, Homo sapiens
ugggagccagaauucacu

SEQ ID NO: 679329 - RNA, 20 nt, Homo sapiens
ugggagcccccaccacaaac

SEQ ID NO: 679330 - RNA, 21 nt, Homo sapiens
ugggagcgggggggacagugc

SEQ ID NO: 679331 - RNA, 20 nt, Homo sapiens
ugggaggcagagguugcagu

SEQ ID NO: 679332 - RNA, 21 nt, Homo sapiens
ugggaggcagagguugcagug

SEQ ID NO: 679333 - RNA, 21 nt, Homo sapiens
ugggaggcccugagacaggga

SEQ ID NO: 679334 - RNA, 18 nt, Homo sapiens
ugggaggcugugauuugc

SEQ ID NO: 679335 - RNA, 15 nt, Homo sapiens
ugggaggucuugcua

SEQ ID NO: 679336 - RNA, 16 nt, Homo sapiens
ugggaguagcauggac

SEQ ID NO: 679337 - RNA, 15 nt, Homo sapiens
ugggagucacacagu

SEQ ID NO: 679338 - RNA, 19 nt, Homo sapiens
ugggagucaggccugggca

SEQ ID NO: 679339 - RNA, 17 nt, Homo sapiens
ugggaguccaggcacag

SEQ ID NO: 679340 - RNA, 19 nt, Homo sapiens
ugggagugugucugcugag

SEQ ID NO: 679341 - RNA, 18 nt, Homo sapiens
ugggaguucuaacaaaac

SEQ ID NO: 679342 - RNA, 19 nt, Homo sapiens
ugggaguuuagugugauaa

SEQ ID NO: 679343 - RNA, 17 nt, Homo sapiens
ugggauaaggaaacacu

SEQ ID NO: 679344 - RNA, 14 nt, Homo sapiens
ugggauaaucacau

SEQ ID NO: 679345 - RNA, 21 nt, Homo sapiens
ugggauagagaauguuccaga

SEQ ID NO: 679346 - RNA, 14 nt, Homo sapiens
ugggauauucccaa

SEQ ID NO: 679347 - RNA, 15 nt, Homo sapiens
ugggaucaaauaacu

SEQ ID NO: 679348 - RNA, 18 nt, Homo sapiens
ugggaucagcuucuugca

SEQ ID NO: 679349 - RNA, 13 nt, Homo sapiens
ugggaucauuuga

SEQ ID NO: 679350 - RNA, 17 nt, Homo sapiens
ugggaucgugcauuuga

SEQ ID NO: 679351 - RNA, 21 nt, Homo sapiens
ugggaugagagggcccagaag

SEQ ID NO: 679352 - RNA, 12 nt, Homo sapiens
ugggaugcacuc

SEQ ID NO: 679353 - RNA, 17 nt, Homo sapiens
ugggaugccucaccaca

SEQ ID NO: 679354 - RNA, 14 nt, Homo sapiens
ugggaugggcuccc

SEQ ID NO: 679355 - RNA, 15 nt, Homo sapiens
ugggaugggcuccca

SEQ ID NO: 679356 - RNA, 21 nt, Homo sapiens
ugggauguguagccuucuccc

SEQ ID NO: 679357 - RNA, 15 nt, Homo sapiens
ugggauguucagcac

SEQ ID NO: 679358 - RNA, 14 nt, Homo sapiens
ugggauuacaggug

SEQ ID NO: 679359 - RNA, 14 nt, Homo sapiens
ugggauugcacaga

SEQ ID NO: 679360 - RNA, 19 nt, Homo sapiens
ugggauuuaaagccuuuag

SEQ ID NO: 679361 - RNA, 16 nt, Homo sapiens
ugggauuuaauuucca

SEQ ID NO: 679362 - RNA, 15 nt, Homo sapiens
uggguccaccaugca

SEQ ID NO: 679363 - RNA, 22 nt, Homo sapiens
ugggucccuccucucaccucuc

SEQ ID NO: 679364 - RNA, 20 nt, Homo sapiens
ugggucucauuuagaacuug

SEQ ID NO: 679365 - RNA, 21 nt, Homo sapiens
ugggucuucccuguaugauuc

SEQ ID NO: 679366 - RNA, 14 nt, Homo sapiens
ugggugaagacaga

SEQ ID NO: 679367 - RNA, 17 nt, Homo sapiens
ugggugaugcuuuugcu

SEQ ID NO: 679368 - RNA, 14 nt, Homo sapiens
ugggugcucagaau

SEQ ID NO: 679369 - RNA, 10 nt, Homo sapiens
ugggugcugc

SEQ ID NO: 679370 - RNA, 14 nt, Homo sapiens
ugggugggccugac

SEQ ID NO: 679371 - RNA, 21 nt, Homo sapiens
uggguggggcugcuccuccag

SEQ ID NO: 679372 - RNA, 16 nt, Homo sapiens
ugggugggugggauga

SEQ ID NO: 679373 - RNA, 16 nt, Homo sapiens
uggguguacaaacuca

SEQ ID NO: 679374 - RNA, 23 nt, Homo sapiens
ugggugucucccucgggggcucu

SEQ ID NO: 679375 - RNA, 14 nt, Homo sapiens
ugggugugggacac

SEQ ID NO: 679376 - RNA, 14 nt, Homo sapiens
uggguuaaguauua

SEQ ID NO: 679377 - RNA, 15 nt, Homo sapiens
uggguuaaguauuau

SEQ ID NO: 679378 - RNA, 22 nt, Homo sapiens
uggguugaacuauaacuguugg

SEQ ID NO: 679379 - RNA, 16 nt, Homo sapiens
ugguaaauacugugaa

SEQ ID NO: 679380 - RNA, 16 nt, Homo sapiens
ugguaaauuaguauuu

SEQ ID NO: 679381 - RNA, 23 nt, Homo sapiens
ugguaacacaaauuuucaccugc

SEQ ID NO: 679382 - RNA, 19 nt, Homo sapiens
ugguaacugcuuucuguuc

SEQ ID NO: 679383 - RNA, 18 nt, Homo sapiens
ugguaagaugacucugag

SEQ ID NO: 679384 - RNA, 20 nt, Homo sapiens
ugguaaucauaugugucuuu

SEQ ID NO: 679385 - RNA, 14 nt, Homo sapiens
ugguacagcacugu

SEQ ID NO: 679386 - RNA, 23 nt, Homo sapiens
ugguacauacacaccagggaaua

SEQ ID NO: 679387 - RNA, 18 nt, Homo sapiens
ugguacuaccccagccau

SEQ ID NO: 679388 - RNA, 21 nt, Homo sapiens
ugguacugacuuugcuugcuu

SEQ ID NO: 679389 - RNA, 12 nt, Homo sapiens
ugguacugcugu

SEQ ID NO: 679390 - RNA, 18 nt, Homo sapiens
ugguacuuuauucuugcu

SEQ ID NO: 679391 - RNA, 18 nt, Homo sapiens
ugguacuuuuaugaugua

SEQ ID NO: 679392 - RNA, 23 nt, Homo sapiens
ugguagaaauacccaacgcacaa

SEQ ID NO: 679393 - RNA, 14 nt, Homo sapiens
ugguagagcaauaa

SEQ ID NO: 679394 - RNA, 17 nt, Homo sapiens
ugguagaucuucaauuu

SEQ ID NO: 679395 - RNA, 17 nt, Homo sapiens
ugguagccucacuuuua

SEQ ID NO: 679396 - RNA, 19 nt, Homo sapiens
ugguagcgggcgccuguag

SEQ ID NO: 679397 - RNA, 13 nt, Homo sapiens
ugguagcucacac

SEQ ID NO: 679398 - RNA, 21 nt, Homo sapiens
ugguagucacuaacauauaua

SEQ ID NO: 679399 - RNA, 15 nt, Homo sapiens
ugguauacuuuugcu

SEQ ID NO: 679400 - RNA, 19 nt, Homo sapiens
ugguauaggaauguagaag

SEQ ID NO: 679401 - RNA, 24 nt, Homo sapiens
ugguauccuacugagcauuugcac

SEQ ID NO: 679402 - RNA, 19 nt, Homo sapiens
ugguauccugugacaugua

SEQ ID NO: 679403 - RNA, 17 nt, Homo sapiens
ugguaucuacuucuaca

SEQ ID NO: 679404 - RNA, 15 nt, Homo sapiens
ugguaucucagaaag

SEQ ID NO: 679405 - RNA, 18 nt, Homo sapiens
ugguaugguuguauacac

SEQ ID NO: 679406 - RNA, 19 nt, Homo sapiens
ugguauguaauggaacuua

SEQ ID NO: 679407 - RNA, 19 nt, Homo sapiens
ugguauguaauuuaugcaa

SEQ ID NO: 679408 - RNA, 17 nt, Homo sapiens
ugguaugucucuuuaag

SEQ ID NO: 679409 - RNA, 21 nt, Homo sapiens
ugguauuuuuauagccauaaa

SEQ ID NO: 679410 - RNA, 22 nt, Homo sapiens
uggucaaacaaacucucugaac

SEQ ID NO: 679411 - RNA, 21 nt, Homo sapiens
uggucacacaccagcacuuua

SEQ ID NO: 679412 - RNA, 18 nt, Homo sapiens
uggucacuggucagggca

SEQ ID NO: 679413 - RNA, 16 nt, Homo sapiens
uggucagcuugcucag

SEQ ID NO: 679414 - RNA, 15 nt, Homo sapiens
uggucaggagccucu

SEQ ID NO: 679415 - RNA, 23 nt, Homo sapiens
uggucaguaaauaacaggcauuu

SEQ ID NO: 679416 - RNA, 19 nt, Homo sapiens
uggucauaaaauagaauaa

SEQ ID NO: 679417 - RNA, 21 nt, Homo sapiens
uggucauuggccgacaucaca

SEQ ID NO: 679418 - RNA, 15 nt, Homo sapiens
uggucauugugaaua

SEQ ID NO: 679419 - RNA, 15 nt, Homo sapiens
ugguccaccuccuga

SEQ ID NO: 679420 - RNA, 14 nt, Homo sapiens
ugguccccacugcu

SEQ ID NO: 679421 - RNA, 18 nt, Homo sapiens
ugguccccuguggugaug

SEQ ID NO: 679422 - RNA, 20 nt, Homo sapiens
uggucccggggccagcacuu

SEQ ID NO: 679423 - RNA, 18 nt, Homo sapiens
ugguccgaagucuuccau

SEQ ID NO: 679424 - RNA, 18 nt, Homo sapiens
ugguccuaagcaccugcc

SEQ ID NO: 679425 - RNA, 17 nt, Homo sapiens
ugguccuagguccucug

SEQ ID NO: 679426 - RNA, 14 nt, Homo sapiens
ugguccucuuacca

SEQ ID NO: 679427 - RNA, 20 nt, Homo sapiens
ugguccugacucaacauguu

SEQ ID NO: 679428 - RNA, 16 nt, Homo sapiens
uggucucuauacuaca

SEQ ID NO: 679429 - RNA, 22 nt, Homo sapiens
uggucugucaaugagagcauaa

SEQ ID NO: 679430 - RNA, 22 nt, Homo sapiens
uggucuguggagauggacucag

SEQ ID NO: 679431 - RNA, 18 nt, Homo sapiens
uggucuguuugcauuuga

SEQ ID NO: 679432 - RNA, 21 nt, Homo sapiens
uggucuuccucgauaaaggga

SEQ ID NO: 679433 - RNA, 18 nt, Homo sapiens
uggucuugagccaguaau

SEQ ID NO: 679434 - RNA, 17 nt, Homo sapiens
uggucuugaucuccuga

SEQ ID NO: 679435 - RNA, 20 nt, Homo sapiens
uggucuuguggaauugggag

SEQ ID NO: 679436 - RNA, 21 nt, Homo sapiens
uggucuuucugaauugcacau

SEQ ID NO: 679437 - RNA, 14 nt, Homo sapiens
uggucuuugcugcu

SEQ ID NO: 679438 - RNA, 20 nt, Homo sapiens
uggugaaaccccgucucuac

SEQ ID NO: 679439 - RNA, 19 nt, Homo sapiens
uggugaaaccucaucucua

SEQ ID NO: 679440 - RNA, 15 nt, Homo sapiens
uggugaauccuccag

SEQ ID NO: 679441 - RNA, 14 nt, Homo sapiens
uggugaauuucaca

SEQ ID NO: 679442 - RNA, 14 nt, Homo sapiens
uggugacugggaaa

SEQ ID NO: 679443 - RNA, 19 nt, Homo sapiens
uggugagccgagauugcac

SEQ ID NO: 679444 - RNA, 14 nt, Homo sapiens
uggugaggcaauaa

SEQ ID NO: 679445 - RNA, 14 nt, Homo sapiens
uggugauauccucu

SEQ ID NO: 679446 - RNA, 16 nt, Homo sapiens
uggugaucagugcaau

SEQ ID NO: 679447 - RNA, 20 nt, Homo sapiens
uggugaugguuuccacagga

SEQ ID NO: 679448 - RNA, 13 nt, Homo sapiens
uggugcaaucaca

SEQ ID NO: 679449 - RNA, 16 nt, Homo sapiens
uggugccccacagcua

SEQ ID NO: 679450 - RNA, 20 nt, Homo sapiens
uggugcgcccugucucugug

SEQ ID NO: 679451 - RNA, 19 nt, Homo sapiens
uggugcugcuuucuuguug

SEQ ID NO: 679452 - RNA, 13 nt, Homo sapiens
uggugcuggauau

SEQ ID NO: 679453 - RNA, 20 nt, Homo sapiens
uggugcuguggccaggguga

SEQ ID NO: 679454 - RNA, 12 nt, Homo sapiens
uggugcuuccca

SEQ ID NO: 679455 - RNA, 21 nt, Homo sapiens
ugguggaacccccaucucuac

SEQ ID NO: 679456 - RNA, 21 nt, Homo sapiens
ugguggacgcuggccugggau

SEQ ID NO: 679457 - RNA, 13 nt, Homo sapiens
ugguggagccagg

SEQ ID NO: 679458 - RNA, 15 nt, Homo sapiens
ugguggagggccaca

SEQ ID NO: 679459 - RNA, 15 nt, Homo sapiens
ugguggaucugucca

SEQ ID NO: 679460 - RNA, 21 nt, Homo sapiens
ugguggcaaagguuuauucca

SEQ ID NO: 679461 - RNA, 13 nt, Homo sapiens
ugguggcacugag

SEQ ID NO: 679462 - RNA, 19 nt, Homo sapiens
ugguggcagauuuuacaaa

SEQ ID NO: 679463 - RNA, 17 nt, Homo sapiens
ugguggcauuguuuaca

SEQ ID NO: 679464 - RNA, 16 nt, Homo sapiens
ugguggccaccgccag

SEQ ID NO: 679465 - RNA, 14 nt, Homo sapiens
ugguggccugggau

SEQ ID NO: 679466 - RNA, 15 nt, Homo sapiens
uggugggcaaaaaca

SEQ ID NO: 679467 - RNA, 20 nt, Homo sapiens
uggugggccucggguccagc

SEQ ID NO: 679468 - RNA, 18 nt, Homo sapiens
uggugggucugagcugga

SEQ ID NO: 679469 - RNA, 14 nt, Homo sapiens
ugguggucagggag

SEQ ID NO: 679470 - RNA, 14 nt, Homo sapiens
ugguggugaugucc

SEQ ID NO: 679471 - RNA, 14 nt, Homo sapiens
ugguguaauaugaa

SEQ ID NO: 679472 - RNA, 15 nt, Homo sapiens
ugguguauguaugag

SEQ ID NO: 679473 - RNA, 13 nt, Homo sapiens
ugguguauuguca

SEQ ID NO: 679474 - RNA, 12 nt, Homo sapiens
ugguguauuuga

SEQ ID NO: 679475 - RNA, 23 nt, Homo sapiens
uggugugaucucggcucacugca

SEQ ID NO: 679476 - RNA, 15 nt, Homo sapiens
uggugugauugcaca

SEQ ID NO: 679477 - RNA, 17 nt, Homo sapiens
uggugugauugcacaga

SEQ ID NO: 679478 - RNA, 13 nt, Homo sapiens
uggugugccucag

SEQ ID NO: 679479 - RNA, 17 nt, Homo sapiens
ugguguggccagcacuc

SEQ ID NO: 679480 - RNA, 12 nt, Homo sapiens
ugguuaaaguau

SEQ ID NO: 679481 - RNA, 12 nt, Homo sapiens
ugguuaaaucau

SEQ ID NO: 679482 - RNA, 18 nt, Homo sapiens
ugguuaauaaaacugcac

SEQ ID NO: 679483 - RNA, 19 nt, Homo sapiens
ugguuaauaaaacugcaca

SEQ ID NO: 679484 - RNA, 22 nt, Homo sapiens
uguauuuucagcucaauuguua

SEQ ID NO: 679485 - RNA, 22 nt, Homo sapiens
uguauuuuccuaaugugaucau

SEQ ID NO: 679486 - RNA, 15 nt, Homo sapiens
uguauuuugugccac

SEQ ID NO: 679487 - RNA, 20 nt, Homo sapiens
uguauuuuuaauauaugcau

SEQ ID NO: 679488 - RNA, 18 nt, Homo sapiens
uguauuuuucaaggcauu

SEQ ID NO: 679489 - RNA, 15 nt, Homo sapiens
ugucaaaagccagau

SEQ ID NO: 679490 - RNA, 24 nt, Homo sapiens
ugucaaaauuguuuaccauagaaa

SEQ ID NO: 679491 - RNA, 13 nt, Homo sapiens
ugucaaagcuuug

SEQ ID NO: 679492 - RNA, 22 nt, Homo sapiens
ugucaagaagcguuaugugcag

SEQ ID NO: 679493 - RNA, 20 nt, Homo sapiens
ugucaagaauagcauuguaa

SEQ ID NO: 679494 - RNA, 14 nt, Homo sapiens
ugucaagagucgcu

SEQ ID NO: 679495 - RNA, 19 nt, Homo sapiens
ugucaagaugucacuuucu

SEQ ID NO: 679496 - RNA, 23 nt, Homo sapiens
ugucaagcugcugaaacuguaau

SEQ ID NO: 679497 - RNA, 16 nt, Homo sapiens
ugucaaugacaguuuc

SEQ ID NO: 679498 - RNA, 18 nt, Homo sapiens
ugucacaaagggacuuug

SEQ ID NO: 679499 - RNA, 12 nt, Homo sapiens
ugucacacaaaa

SEQ ID NO: 679500 - RNA, 22 nt, Homo sapiens
ugucacaucagcaauuucagaa

SEQ ID NO: 679501 - RNA, 15 nt, Homo sapiens
ugucaccaugaucac

SEQ ID NO: 679502 - RNA, 15 nt, Homo sapiens
ugucacccauuggug

SEQ ID NO: 679503 - RNA, 19 nt, Homo sapiens
ugucacccuccaccgagcc

SEQ ID NO: 679504 - RNA, 18 nt, Homo sapiens
ugucacccugcagagcua

SEQ ID NO: 679505 - RNA, 22 nt, Homo sapiens
ugucacccuuguccuugagugc

SEQ ID NO: 679506 - RNA, 22 nt, Homo sapiens
ugucaccuacgugccacuccug

SEQ ID NO: 679507 - RNA, 19 nt, Homo sapiens
ugucaccucagcugauauu

SEQ ID NO: 679508 - RNA, 18 nt, Homo sapiens
ugucaccuggcacauuca

SEQ ID NO: 679509 - RNA, 16 nt, Homo sapiens
ugucacguggcuucau

SEQ ID NO: 679510 - RNA, 13 nt, Homo sapiens
ugucacuacacac

SEQ ID NO: 679511 - RNA, 22 nt, Homo sapiens
ugucacuacucacagucucuuu

SEQ ID NO: 679512 - RNA, 19 nt, Homo sapiens
ugucacugaugaacuagug

SEQ ID NO: 679513 - RNA, 15 nt, Homo sapiens
ugucagaaacaauga

SEQ ID NO: 679514 - RNA, 21 nt, Homo sapiens
ugucagaaaccaguuauguga

SEQ ID NO: 679515 - RNA, 20 nt, Homo sapiens
ugucagacuuugcugcauuu

SEQ ID NO: 679516 - RNA, 13 nt, Homo sapiens
ugucagagcccag

SEQ ID NO: 679517 - RNA, 17 nt, Homo sapiens
ugucagccccucuuccc

SEQ ID NO: 679518 - RNA, 16 nt, Homo sapiens
ugucagcuuccaaaca

SEQ ID NO: 679519 - RNA, 20 nt, Homo sapiens
ugucagggguuucuucaaga

SEQ ID NO: 679520 - RNA, 15 nt, Homo sapiens
ugucaguaaaacucu

SEQ ID NO: 679521 - RNA, 18 nt, Homo sapiens
ugucaguucuaaccuccu

SEQ ID NO: 679522 - RNA, 11 nt, Homo sapiens
ugucaguucuc

SEQ ID NO: 679523 - RNA, 20 nt, Homo sapiens
ugucauagccaaagccaggc

SEQ ID NO: 679524 - RNA, 23 nt, Homo sapiens
ugucauaggauuaagcaguuuaa

SEQ ID NO: 679525 - RNA, 20 nt, Homo sapiens
ugucauauaguaaacacuca

SEQ ID NO: 679526 - RNA, 14 nt, Homo sapiens
ugucauauguagcc

SEQ ID NO: 679527 - RNA, 15 nt, Homo sapiens
ugucauccucacagu

SEQ ID NO: 679528 - RNA, 21 nt, Homo sapiens
ugucaucugcuccuguucaca

SEQ ID NO: 679529 - RNA, 12 nt, Homo sapiens
ugucaugaagaa

SEQ ID NO: 679530 - RNA, 15 nt, Homo sapiens
ugucauucgcuccca

SEQ ID NO: 679531 - RNA, 15 nt, Homo sapiens
ugucauuuccucuag

SEQ ID NO: 679532 - RNA, 18 nt, Homo sapiens
ugucauuuuuaacagcau

SEQ ID NO: 679533 - RNA, 14 nt, Homo sapiens
uguccaaacuaauu

SEQ ID NO: 679534 - RNA, 11 nt, Homo sapiens
uguccaaagag

SEQ ID NO: 679535 - RNA, 23 nt, Homo sapiens
uguccaaauggacauaagacaga

SEQ ID NO: 679536 - RNA, 15 nt, Homo sapiens
uguccaaguccaacc

SEQ ID NO: 679537 - RNA, 14 nt, Homo sapiens
uguccaagugccac

SEQ ID NO: 679538 - RNA, 19 nt, Homo sapiens
uguccacauucuacuucag

SEQ ID NO: 679539 - RNA, 22 nt, Homo sapiens
uguccacguaucuuugggucuu

SEQ ID NO: 679540 - RNA, 20 nt, Homo sapiens
uguccagaggcugcaaggau

SEQ ID NO: 679541 - RNA, 16 nt, Homo sapiens
uguccagcagcugcca

SEQ ID NO: 679542 - RNA, 16 nt, Homo sapiens
uguccaggaacugccu

SEQ ID NO: 679543 - RNA, 22 nt, Homo sapiens
uguccaggagaaaccucacaaa

SEQ ID NO: 679544 - RNA, 19 nt, Homo sapiens
uguccaggcuggagugcaa

SEQ ID NO: 679545 - RNA, 20 nt, Homo sapiens
uguccaggcuggagugcaau

SEQ ID NO: 679546 - RNA, 14 nt, Homo sapiens
uguccauccauaua

SEQ ID NO: 679547 - RNA, 19 nt, Homo sapiens
uguccaugaagcacugagc

SEQ ID NO: 679548 - RNA, 15 nt, Homo sapiens
uguccaugccuucca

SEQ ID NO: 679549 - RNA, 16 nt, Homo sapiens
uguccaugccuuccau

SEQ ID NO: 679550 - RNA, 18 nt, Homo sapiens
uguccaugugugugcaag

SEQ ID NO: 679551 - RNA, 21 nt, Homo sapiens
uguccaugugugugcaagugu

SEQ ID NO: 679552 - RNA, 23 nt, Homo sapiens
ugucccacuaucugggugcauga

SEQ ID NO: 679553 - RNA, 12 nt, Homo sapiens
ugucccagagag

SEQ ID NO: 679554 - RNA, 20 nt, Homo sapiens
ugucccagcgauggugccug

SEQ ID NO: 679555 - RNA, 16 nt, Homo sapiens
ugucccaguaaagcca

SEQ ID NO: 679556 - RNA, 14 nt, Homo sapiens
ugucccaucugccc

SEQ ID NO: 679557 - RNA, 15 nt, Homo sapiens
ugucccauucuagau

SEQ ID NO: 679558 - RNA, 17 nt, Homo sapiens
ugucccccaacuugaga

SEQ ID NO: 679559 - RNA, 15 nt, Homo sapiens
ugucccccuacccac

SEQ ID NO: 679560 - RNA, 15 nt, Homo sapiens
ugucccccucucgcc

SEQ ID NO: 679561 - RNA, 18 nt, Homo sapiens
uguccccguguugcauga

SEQ ID NO: 679562 - RNA, 18 nt, Homo sapiens
uguccccuccacugucac

SEQ ID NO: 679563 - RNA, 19 nt, Homo sapiens
uguccccuccacugucaca

SEQ ID NO: 679564 - RNA, 19 nt, Homo sapiens
uguccccugacagggccag

SEQ ID NO: 679565 - RNA, 15 nt, Homo sapiens
ugucccgccuugugg

SEQ ID NO: 679566 - RNA, 20 nt, Homo sapiens
ugucccggggcuccacugaa

SEQ ID NO: 679567 - RNA, 13 nt, Homo sapiens
ugucccgugcaug

SEQ ID NO: 679568 - RNA, 14 nt, Homo sapiens
ugucccguggcauu

SEQ ID NO: 679569 - RNA, 15 nt, Homo sapiens
ugucccucugccuuu

SEQ ID NO: 679570 - RNA, 16 nt, Homo sapiens
ugucccugaaaccuag

SEQ ID NO: 679571 - RNA, 15 nt, Homo sapiens
ugucccugacuguaa

SEQ ID NO: 679572 - RNA, 15 nt, Homo sapiens
ugucccugcacugug

SEQ ID NO: 679573 - RNA, 18 nt, Homo sapiens
ugucccugccaaugcucc

SEQ ID NO: 679574 - RNA, 14 nt, Homo sapiens
ugucccuguccuuc

SEQ ID NO: 679575 - RNA, 22 nt, Homo sapiens
ugucccuugccucaaugccagu

SEQ ID NO: 679576 - RNA, 19 nt, Homo sapiens
uguccuagaaguucuuuga

SEQ ID NO: 679577 - RNA, 15 nt, Homo sapiens
uguccuaugcgcuca

SEQ ID NO: 679578 - RNA, 13 nt, Homo sapiens
uguccucagcauu

SEQ ID NO: 679579 - RNA, 15 nt, Homo sapiens
uguccucccacagac

SEQ ID NO: 679580 - RNA, 14 nt, Homo sapiens
uguccuccuuggcg

SEQ ID NO: 679581 - RNA, 16 nt, Homo sapiens
uguccucucugugucc

SEQ ID NO: 679582 - RNA, 15 nt, Homo sapiens
uguccucucuuuaug

SEQ ID NO: 679583 - RNA, 23 nt, Homo sapiens
uguccugaaacaugaacccaaaa

SEQ ID NO: 679584 - RNA, 14 nt, Homo sapiens
uguccugaccaccc

SEQ ID NO: 679585 - RNA, 16 nt, Homo sapiens
uguccugaucugugau

SEQ ID NO: 679586 - RNA, 17 nt, Homo sapiens
uguccugaucugugaua

SEQ ID NO: 679587 - RNA, 20 nt, Homo sapiens
uguccugaugcuuuugucua

SEQ ID NO: 679588 - RNA, 23 nt, Homo sapiens
uguccugcccacccuaccagcuc

SEQ ID NO: 679589 - RNA, 15 nt, Homo sapiens
uguccuggcauuugu

SEQ ID NO: 679590 - RNA, 22 nt, Homo sapiens
uguccugggccugccccugugu

SEQ ID NO: 679591 - RNA, 21 nt, Homo sapiens
uguccuggggaauacuggcca

SEQ ID NO: 679592 - RNA, 22 nt, Homo sapiens
uguccuggugcucucugccacu

SEQ ID NO: 679593 - RNA, 12 nt, Homo sapiens
uguccugugcuu

SEQ ID NO: 679594 - RNA, 19 nt, Homo sapiens
uguccuuaauugaugcaaa

SEQ ID NO: 679595 - RNA, 21 nt, Homo sapiens
uguccuuuaaucacugcauuu

SEQ ID NO: 679596 - RNA, 15 nt, Homo sapiens
uguccuuuaugaucc

SEQ ID NO: 679597 - RNA, 14 nt, Homo sapiens
uguccuuucuugca

SEQ ID NO: 679598 - RNA, 18 nt, Homo sapiens
uguccuuuuucacuuuga

SEQ ID NO: 679599 - RNA, 13 nt, Homo sapiens
ugucgccaccacu

SEQ ID NO: 679600 - RNA, 16 nt, Homo sapiens
ugucgccaccacuucc

SEQ ID NO: 679601 - RNA, 17 nt, Homo sapiens
ugucuaaaaugucagug

SEQ ID NO: 679602 - RNA, 17 nt, Homo sapiens
ugucuaauaaaauauaa

SEQ ID NO: 679603 - RNA, 16 nt, Homo sapiens
ugucuaauaaagagau

SEQ ID NO: 679604 - RNA, 22 nt, Homo sapiens
ugucuaauuaaaacacuuucaa

SEQ ID NO: 679605 - RNA, 23 nt, Homo sapiens
ugucuacaccaaugcccaacugc

SEQ ID NO: 679606 - RNA, 21 nt, Homo sapiens
uugcuuuccugcaucucugug

SEQ ID NO: 679607 - RNA, 19 nt, Homo sapiens
uugcuuugauuuacagcaa

SEQ ID NO: 679608 - RNA, 15 nt, Homo sapiens
uugcuuugccagagc

SEQ ID NO: 679609 - RNA, 18 nt, Homo sapiens
uugcuuuucacauccauu

SEQ ID NO: 679610 - RNA, 22 nt, Homo sapiens
uugcuuuugaaaaacaacugca

SEQ ID NO: 679611 - RNA, 16 nt, Homo sapiens
uugcuuuuuuuccaau

SEQ ID NO: 679612 - RNA, 20 nt, Homo sapiens
uuggaaaacacuuucauccg

SEQ ID NO: 679613 - RNA, 21 nt, Homo sapiens
uuggaaagaaauuaaagaagg

SEQ ID NO: 679614 - RNA, 17 nt, Homo sapiens
uuggaaagagucuccag

SEQ ID NO: 679615 - RNA, 21 nt, Homo sapiens
uuggaaauagaaagaagccau

SEQ ID NO: 679616 - RNA, 21 nt, Homo sapiens
uuggaacaacugauacuucac

SEQ ID NO: 679617 - RNA, 21 nt, Homo sapiens
uuggaacauacuguucacuca

SEQ ID NO: 679618 - RNA, 21 nt, Homo sapiens
uuggaacuauacccgggacca

SEQ ID NO: 679619 - RNA, 14 nt, Homo sapiens
uuggaagauggcau

SEQ ID NO: 679620 - RNA, 15 nt, Homo sapiens
uuggaagugauuuca

SEQ ID NO: 679621 - RNA, 16 nt, Homo sapiens
uuggaauaaaacuguc

SEQ ID NO: 679622 - RNA, 19 nt, Homo sapiens
uuggaauaaagucaaccuu

SEQ ID NO: 679623 - RNA, 19 nt, Homo sapiens
uuggaauauuuuauccugu

SEQ ID NO: 679624 - RNA, 17 nt, Homo sapiens
uuggaaugagucuccuu

SEQ ID NO: 679625 - RNA, 19 nt, Homo sapiens
uuggaauggaacuacugua

SEQ ID NO: 679626 - RNA, 23 nt, Homo sapiens
uuggaauuaugucugcugaauaa

SEQ ID NO: 679627 - RNA, 12 nt, Homo sapiens
uuggaauucacc

SEQ ID NO: 679628 - RNA, 13 nt, Homo sapiens
uuggaauuuguaa

SEQ ID NO: 679629 - RNA, 22 nt, Homo sapiens
uuggacaaaccgagugcaauga

SEQ ID NO: 679630 - RNA, 17 nt, Homo sapiens
uuggacagacacuguug

SEQ ID NO: 679631 - RNA, 14 nt, Homo sapiens
uuggacagauuuca

SEQ ID NO: 679632 - RNA, 13 nt, Homo sapiens
uuggacagcugcu

SEQ ID NO: 679633 - RNA, 16 nt, Homo sapiens
uuggacauccccagaa

SEQ ID NO: 679634 - RNA, 18 nt, Homo sapiens
uuggacccaaaaaaucau

SEQ ID NO: 679635 - RNA, 19 nt, Homo sapiens
uuggaccuguucaaaaagg

SEQ ID NO: 679636 - RNA, 22 nt, Homo sapiens
uuggagagcagcuggcucucca

SEQ ID NO: 679637 - RNA, 21 nt, Homo sapiens
uuggagaguuugccuguucua

SEQ ID NO: 679638 - RNA, 12 nt, Homo sapiens
uuggagcaaacc

SEQ ID NO: 679639 - RNA, 15 nt, Homo sapiens
uuggagcaaaccauu

SEQ ID NO: 679640 - RNA, 12 nt, Homo sapiens
uuggagcaagag

SEQ ID NO: 679641 - RNA, 12 nt, Homo sapiens
uuggagcacucu

SEQ ID NO: 679642 - RNA, 15 nt, Homo sapiens
uuggagcauuuucaa

SEQ ID NO: 679643 - RNA, 15 nt, Homo sapiens
uuggagcucuaucca

SEQ ID NO: 679644 - RNA, 20 nt, Homo sapiens
uuggaggagcaaaguuaaaa

SEQ ID NO: 679645 - RNA, 12 nt, Homo sapiens
uuggaggcaauc

SEQ ID NO: 679646 - RNA, 20 nt, Homo sapiens
uuggagggguauuuuugccc

SEQ ID NO: 679647 - RNA, 15 nt, Homo sapiens
uuggagucuguucua

SEQ ID NO: 679648 - RNA, 13 nt, Homo sapiens
uuggagugcacug

SEQ ID NO: 679649 - RNA, 18 nt, Homo sapiens
uuggauaaguuucuauuc

SEQ ID NO: 679650 - RNA, 19 nt, Homo sapiens
uuggauacauacaccagca

SEQ ID NO: 679651 - RNA, 14 nt, Homo sapiens
uuggaucaggacag

SEQ ID NO: 679652 - RNA, 16 nt, Homo sapiens
uuggaugcacuuuaua

SEQ ID NO: 679653 - RNA, 19 nt, Homo sapiens
uuggaugcggccauucaag

SEQ ID NO: 679654 - RNA, 14 nt, Homo sapiens
uuggauuauuucaa

SEQ ID NO: 679655 - RNA, 15 nt, Homo sapiens
uuggauucuuuccau

SEQ ID NO: 679656 - RNA, 19 nt, Homo sapiens
uuggauuuauaaaugcuau

SEQ ID NO: 679657 - RNA, 15 nt, Homo sapiens
uuggcaaacuuugua

SEQ ID NO: 679658 - RNA, 13 nt, Homo sapiens
uuggcaaugccau

SEQ ID NO: 679659 - RNA, 23 nt, Homo sapiens
uuggcaccccuuucuaguucaau

SEQ ID NO: 679660 - RNA, 16 nt, Homo sapiens
uuggcacuccuggaca

SEQ ID NO: 679661 - RNA, 18 nt, Homo sapiens
uuggcaggcuggccaguc

SEQ ID NO: 679662 - RNA, 17 nt, Homo sapiens
uuggcauaauagucaau

SEQ ID NO: 679663 - RNA, 15 nt, Homo sapiens
uuggcauggcuuuau

SEQ ID NO: 679664 - RNA, 12 nt, Homo sapiens
uuggccacagac

SEQ ID NO: 679665 - RNA, 13 nt, Homo sapiens
uuggccacugucu

SEQ ID NO: 679666 - RNA, 23 nt, Homo sapiens
uuggccagaagggggccaugagg

SEQ ID NO: 679667 - RNA, 23 nt, Homo sapiens
uuggccagcaaaaacugugggaa

SEQ ID NO: 679668 - RNA, 22 nt, Homo sapiens
uuggccaguagcuaaagugcaa

SEQ ID NO: 679669 - RNA, 12 nt, Homo sapiens
uuggccagugag

SEQ ID NO: 679670 - RNA, 14 nt, Homo sapiens
uuggcccacacuga

SEQ ID NO: 679671 - RNA, 14 nt, Homo sapiens
uuggccggcugugc

SEQ ID NO: 679672 - RNA, 19 nt, Homo sapiens
uuggccucccaaagugcua

SEQ ID NO: 679673 - RNA, 20 nt, Homo sapiens
uuggcgcaccaagaucucca

SEQ ID NO: 679674 - RNA, 14 nt, Homo sapiens
uuggcucucugaga

SEQ ID NO: 679675 - RNA, 18 nt, Homo sapiens
uuggcugauguugcagcc

SEQ ID NO: 679676 - RNA, 14 nt, Homo sapiens
uuggcugcacuuga

SEQ ID NO: 679677 - RNA, 15 nt, Homo sapiens
uuggcuggacuguag

SEQ ID NO: 679678 - RNA, 19 nt, Homo sapiens
uuggcuguggggaccccag

SEQ ID NO: 679679 - RNA, 13 nt, Homo sapiens
uuggcuucagggg

SEQ ID NO: 679680 - RNA, 22 nt, Homo sapiens
uuggcuucucaauagaguguug

SEQ ID NO: 679681 - RNA, 24 nt, Homo sapiens
uuggcuucugugaugagcugaucu

SEQ ID NO: 679682 - RNA, 18 nt, Homo sapiens
uuggcuuguuuggagcau

SEQ ID NO: 679683 - RNA, 12 nt, Homo sapiens
uuggcuuuucau

SEQ ID NO: 679684 - RNA, 21 nt, Homo sapiens
uugggaaaagcccacaggccu

SEQ ID NO: 679685 - RNA, 17 nt, Homo sapiens
uugggaacaggcugugu

SEQ ID NO: 679686 - RNA, 17 nt, Homo sapiens
uugggaaggaaggcagu

SEQ ID NO: 679687 - RNA, 19 nt, Homo sapiens
uugggacgcacagugcagu

SEQ ID NO: 679688 - RNA, 13 nt, Homo sapiens
uugggagcacugg

SEQ ID NO: 679689 - RNA, 12 nt, Homo sapiens
uugggagcugcu

SEQ ID NO: 679690 - RNA, 23 nt, Homo sapiens
uugggauauccuuucacucugca

SEQ ID NO: 679691 - RNA, 13 nt, Homo sapiens
uugggaugggcag

SEQ ID NO: 679692 - RNA, 11 nt, Homo sapiens
uugggcaguuc

SEQ ID NO: 679693 - RNA, 23 nt, Homo sapiens
uugggccagccccagcaccucau

SEQ ID NO: 679694 - RNA, 18 nt, Homo sapiens
uugggcuauuuggacuca

SEQ ID NO: 679695 - RNA, 10 nt, Homo sapiens
uugggcuccu

SEQ ID NO: 679696 - RNA, 23 nt, Homo sapiens
uugggcuuaguauuucucaggaa

SEQ ID NO: 679697 - RNA, 21 nt, Homo sapiens
uuggggaaaauggccaugcag

SEQ ID NO: 679698 - RNA, 16 nt, Homo sapiens
uuggggccaccaaagc

SEQ ID NO: 679699 - RNA, 11 nt, Homo sapiens
uugggggaaaa

SEQ ID NO: 679700 - RNA, 13 nt, Homo sapiens
uuggggggccacc

SEQ ID NO: 679701 - RNA, 19 nt, Homo sapiens
uuggguccaccaugcagaa

SEQ ID NO: 679702 - RNA, 15 nt, Homo sapiens
uuggguguagauuuc

SEQ ID NO: 679703 - RNA, 14 nt, Homo sapiens
uuggguucacagaa

SEQ ID NO: 679704 - RNA, 22 nt, Homo sapiens
uuggguucacagaagcacagca

SEQ ID NO: 679705 - RNA, 23 nt, Homo sapiens
uuggguugaucucuuagaagcca

SEQ ID NO: 679706 - RNA, 20 nt, Homo sapiens
uugguaaaacucacugugau

SEQ ID NO: 679707 - RNA, 13 nt, Homo sapiens
uugguaagagaca

SEQ ID NO: 679708 - RNA, 20 nt, Homo sapiens
uugguaagaugacucugaga

SEQ ID NO: 679709 - RNA, 22 nt, Homo sapiens
uugguaauugguuuuaugcauu

SEQ ID NO: 679710 - RNA, 21 nt, Homo sapiens
uugguaccuuucuagccuuag

SEQ ID NO: 679711 - RNA, 23 nt, Homo sapiens
uugguagggugaguguuuccacu

SEQ ID NO: 679712 - RNA, 20 nt, Homo sapiens
uugguaguggaauagugaau

SEQ ID NO: 679713 - RNA, 21 nt, Homo sapiens
uugguauuaauuugacugugc

SEQ ID NO: 679714 - RNA, 13 nt, Homo sapiens
uuggucaguuaca

SEQ ID NO: 679715 - RNA, 23 nt, Homo sapiens
uugguccuaagcaccugccucag

SEQ ID NO: 679716 - RNA, 21 nt, Homo sapiens
uugguccuaccuauuauccuu

SEQ ID NO: 679717 - RNA, 23 nt, Homo sapiens
uuggucucugcccugccuacuuu

SEQ ID NO: 679718 - RNA, 14 nt, Homo sapiens
uuggugaauuucac

SEQ ID NO: 679719 - RNA, 19 nt, Homo sapiens
uuggugacaccucaccuca

SEQ ID NO: 679720 - RNA, 14 nt, Homo sapiens
uuggugauggggcu

SEQ ID NO: 679721 - RNA, 13 nt, Homo sapiens
uuggugcucuugc

SEQ ID NO: 679722 - RNA, 13 nt, Homo sapiens
uugguggauguga

SEQ ID NO: 679723 - RNA, 11 nt, Homo sapiens
uugguggcaug

SEQ ID NO: 679724 - RNA, 22 nt, Homo sapiens
uugguguauguaugaguaucug

SEQ ID NO: 679725 - RNA, 19 nt, Homo sapiens
uugguuagacgccuuccag

SEQ ID NO: 679726 - RNA, 16 nt, Homo sapiens
uugguugcaguuucca

SEQ ID NO: 679727 - RNA, 17 nt, Homo sapiens
uugguuggauaagcuau

SEQ ID NO: 679728 - RNA, 20 nt, Homo sapiens
uuguuccuggggaauucacu

SEQ ID NO: 679729 - RNA, 20 nt, Homo sapiens
uuguuccuggggcuggaaug

SEQ ID NO: 679730 - RNA, 15 nt, Homo sapiens
uuguucuaguuuuca

SEQ ID NO: 679731 - RNA, 12 nt, Homo sapiens
uuguucucagaa

SEQ ID NO: 679732 - RNA, 12 nt, Homo sapiens
uuguucugagau

SEQ ID NO: 679733 - RNA, 17 nt, Homo sapiens
uuguucugaguaagugu

SEQ ID NO: 679734 - RNA, 14 nt, Homo sapiens
uuguucuucaggag

SEQ ID NO: 679735 - RNA, 21 nt, Homo sapiens
uuguucuuuaaagucaggucc

SEQ ID NO: 679736 - RNA, 15 nt, Homo sapiens
uuguugagugccagc

SEQ ID NO: 679737 - RNA, 19 nt, Homo sapiens
uuguugcaagaugugaauu

SEQ ID NO: 679738 - RNA, 11 nt, Homo sapiens
uuguugccaug

SEQ ID NO: 679739 - RNA, 20 nt, Homo sapiens
uuguugccuucaucuucacu

SEQ ID NO: 679740 - RNA, 20 nt, Homo sapiens
uuguuguaaccugcugugau

SEQ ID NO: 679741 - RNA, 16 nt, Homo sapiens
uuguuguccuugcccc

SEQ ID NO: 679742 - RNA, 13 nt, Homo sapiens
uuguugugugugc

SEQ ID NO: 679743 - RNA, 13 nt, Homo sapiens
uuguuguugccaa

SEQ ID NO: 679744 - RNA, 19 nt, Homo sapiens
uuguuuaaaucaagagcuu

SEQ ID NO: 679745 - RNA, 22 nt, Homo sapiens
uuguuuaauuuuuauuucuucc

SEQ ID NO: 679746 - RNA, 18 nt, Homo sapiens
uuguuuacagucauugga

SEQ ID NO: 679747 - RNA, 21 nt, Homo sapiens
uuguuucaaaugaaacuuuaa

SEQ ID NO: 679748 - RNA, 20 nt, Homo sapiens
uuguuucaccuuccauguca

SEQ ID NO: 679749 - RNA, 15 nt, Homo sapiens
uuguuucuuuucaca

SEQ ID NO: 679750 - RNA, 18 nt, Homo sapiens
uuguuugaauuccuccuc

SEQ ID NO: 679751 - RNA, 13 nt, Homo sapiens
uuguuuguuucuu

SEQ ID NO: 679752 - RNA, 21 nt, Homo sapiens
uuguuuuaaaauuaaagcuaa

SEQ ID NO: 679753 - RNA, 19 nt, Homo sapiens
uuguuuuacccuauacauc

SEQ ID NO: 679754 - RNA, 12 nt, Homo sapiens
uuguuuugugaa

SEQ ID NO: 679755 - RNA, 13 nt, Homo sapiens
uuguuuuuugcca

SEQ ID NO: 679756 - RNA, 22 nt, Homo sapiens
uuuaaaaaaaaagucagagaca

SEQ ID NO: 679757 - RNA, 18 nt, Homo sapiens
uuuaaaaaaaacaauucc

SEQ ID NO: 679758 - RNA, 16 nt, Homo sapiens
uuuaaaaaaacugaag

SEQ ID NO: 679759 - RNA, 19 nt, Homo sapiens
uuuaaaaaaagagcuaaga

SEQ ID NO: 679760 - RNA, 16 nt, Homo sapiens
uuuaaaaaagcuuaaa

SEQ ID NO: 679761 - RNA, 14 nt, Homo sapiens
uuuaaaaaauacca

SEQ ID NO: 679762 - RNA, 15 nt, Homo sapiens
uuuaaaaaauucucu

SEQ ID NO: 679763 - RNA, 13 nt, Homo sapiens
uuuaaaaaccgaa

SEQ ID NO: 679764 - RNA, 13 nt, Homo sapiens
uuuaaaaacucac

SEQ ID NO: 679765 - RNA, 13 nt, Homo sapiens
uuuaaaaagaaga

SEQ ID NO: 679766 - RNA, 13 nt, Homo sapiens
uuuaaaaagcuag

SEQ ID NO: 679767 - RNA, 14 nt, Homo sapiens
uuuaaaaagucaau

SEQ ID NO: 679768 - RNA, 17 nt, Homo sapiens
uuuaaaaauaaauucaa

SEQ ID NO: 679769 - RNA, 19 nt, Homo sapiens
uuuaaaaauacaacacuga

SEQ ID NO: 679770 - RNA, 12 nt, Homo sapiens
uuuaaaacacaa

SEQ ID NO: 679771 - RNA, 13 nt, Homo sapiens
uuuaaaacaucau

SEQ ID NO: 679772 - RNA, 14 nt, Homo sapiens
uuuaaaacauucac

SEQ ID NO: 679773 - RNA, 14 nt, Homo sapiens
uuuaaaagauaaaa

SEQ ID NO: 679774 - RNA, 13 nt, Homo sapiens
uuuaaaagucauu

SEQ ID NO: 679775 - RNA, 17 nt, Homo sapiens
uuuaaaaguuucaaugu

SEQ ID NO: 679776 - RNA, 20 nt, Homo sapiens
uuuaaaauaaaaaagcaaaa

SEQ ID NO: 679777 - RNA, 22 nt, Homo sapiens
uuuaaaauaaaaaagcaaaaac

SEQ ID NO: 679778 - RNA, 20 nt, Homo sapiens
uuuaaaauaaauuccuacaa

SEQ ID NO: 679779 - RNA, 17 nt, Homo sapiens
uuuaaaauaagcuuucu

SEQ ID NO: 679780 - RNA, 14 nt, Homo sapiens
uuuaaaaugaauaa

SEQ ID NO: 679781 - RNA, 22 nt, Homo sapiens
uuuaaaaugcucaauuucagca

SEQ ID NO: 679782 - RNA, 16 nt, Homo sapiens
uuuaaacacaugccuu

SEQ ID NO: 679783 - RNA, 18 nt, Homo sapiens
uuuaaacacaugccuuaa

SEQ ID NO: 679784 - RNA, 15 nt, Homo sapiens
uuuaaaccacuaaaa

SEQ ID NO: 679785 - RNA, 17 nt, Homo sapiens
uuuaaaccccgagauag

SEQ ID NO: 679786 - RNA, 21 nt, Homo sapiens
uuuaaaccuugugcuacuuag

SEQ ID NO: 679787 - RNA, 11 nt, Homo sapiens
uuuaaagacag

SEQ ID NO: 679788 - RNA, 12 nt, Homo sapiens
uuuaaagacaga

SEQ ID NO: 679789 - RNA, 13 nt, Homo sapiens
uuuaaagacaugu

SEQ ID NO: 679790 - RNA, 19 nt, Homo sapiens
uuuaaagauaagucuacau

SEQ ID NO: 679791 - RNA, 22 nt, Homo sapiens
uuuaaagcauauuggugcuaga

SEQ ID NO: 679792 - RNA, 18 nt, Homo sapiens
uuuaaagccacauuucau

SEQ ID NO: 679793 - RNA, 16 nt, Homo sapiens
uuuaaagcucaugcau

SEQ ID NO: 679794 - RNA, 10 nt, Homo sapiens
uuuaaagggu

SEQ ID NO: 679795 - RNA, 14 nt, Homo sapiens
uuuaaaguaugcau

SEQ ID NO: 679796 - RNA, 20 nt, Homo sapiens
uuuaaaguauguuauugcau

SEQ ID NO: 679797 - RNA, 17 nt, Homo sapiens
uuuaaaguauucuccau

SEQ ID NO: 679798 - RNA, 14 nt, Homo sapiens
uuuaaaguggcaau

SEQ ID NO: 679799 - RNA, 18 nt, Homo sapiens
uuuaaauaaaagcacaag

SEQ ID NO: 679800 - RNA, 20 nt, Homo sapiens
uuuaaauagggcauaccauu

SEQ ID NO: 679801 - RNA, 14 nt, Homo sapiens
uuuaaaucaaggaa

SEQ ID NO: 679802 - RNA, 15 nt, Homo sapiens
uuuaaaucugugaug

SEQ ID NO: 679803 - RNA, 17 nt, Homo sapiens
uuuaaaugucugcaugc

SEQ ID NO: 679804 - RNA, 13 nt, Homo sapiens
uuuaaauuccaca

SEQ ID NO: 679805 - RNA, 15 nt, Homo sapiens
uuuaaauucuagugu

SEQ ID NO: 679806 - RNA, 12 nt, Homo sapiens
uuuaaauucucu

SEQ ID NO: 679807 - RNA, 19 nt, Homo sapiens
uuuaacaaaucuaaucucu

SEQ ID NO: 679808 - RNA, 18 nt, Homo sapiens
uuuaacaccccacaggca

SEQ ID NO: 679809 - RNA, 17 nt, Homo sapiens
uuuaacagaaacuuuca

SEQ ID NO: 679810 - RNA, 13 nt, Homo sapiens
uuuaacagccucu

SEQ ID NO: 679811 - RNA, 14 nt, Homo sapiens
uuuaacagcugaau

SEQ ID NO: 679812 - RNA, 17 nt, Homo sapiens
uuuaaccaaucagauga

SEQ ID NO: 679813 - RNA, 14 nt, Homo sapiens
uuuaaccuaugaua

SEQ ID NO: 679814 - RNA, 17 nt, Homo sapiens
uuuaaccucuagaguca

SEQ ID NO: 679815 - RNA, 20 nt, Homo sapiens
uuuaaccucuagagucacug

SEQ ID NO: 679816 - RNA, 15 nt, Homo sapiens
uuuaacguuucucau

SEQ ID NO: 679817 - RNA, 14 nt, Homo sapiens
uuuaacuacccuga

SEQ ID NO: 679818 - RNA, 13 nt, Homo sapiens
uuuaacucaggag

SEQ ID NO: 679819 - RNA, 18 nt, Homo sapiens
uuuaacugugaaccugga

SEQ ID NO: 679820 - RNA, 17 nt, Homo sapiens
uuuaacuuuaccaugcu

SEQ ID NO: 679821 - RNA, 18 nt, Homo sapiens
uuuaagaauaucuguaau

SEQ ID NO: 679822 - RNA, 15 nt, Homo sapiens
uuuaagaauuucaca

SEQ ID NO: 679823 - RNA, 14 nt, Homo sapiens
uuuaagacugauaa

SEQ ID NO: 679824 - RNA, 23 nt, Homo sapiens
uuuaagauccgcaauguggagca

SEQ ID NO: 679825 - RNA, 15 nt, Homo sapiens
uuuaagcaacacaga

SEQ ID NO: 679826 - RNA, 14 nt, Homo sapiens
uuuaagcagucuca

SEQ ID NO: 679827 - RNA, 15 nt, Homo sapiens
uuuaagcagucucac

SEQ ID NO: 679828 - RNA, 13 nt, Homo sapiens
uuuaagcaucaaa

SEQ ID NO: 679829 - RNA, 15 nt, Homo sapiens
uuuaagccaggagca

SEQ ID NO: 679830 - RNA, 15 nt, Homo sapiens
uuuaaggauguugcc

SEQ ID NO: 679831 - RNA, 13 nt, Homo sapiens
uuuaaguaacuua

SEQ ID NO: 679832 - RNA, 15 nt, Homo sapiens
uuuaaguauauagua

SEQ ID NO: 679833 - RNA, 20 nt, Homo sapiens
uuuaaguauggaauauucau

SEQ ID NO: 679834 - RNA, 21 nt, Homo sapiens
uuuaagugaaaaaagcaaaua

SEQ ID NO: 679835 - RNA, 13 nt, Homo sapiens
uuuaagugaagga

SEQ ID NO: 679836 - RNA, 15 nt, Homo sapiens
uuuaagugacauaau

SEQ ID NO: 679837 - RNA, 16 nt, Homo sapiens
uuuaagugcuucacau

SEQ ID NO: 679838 - RNA, 19 nt, Homo sapiens
uuuaauaaaaaucauggaa

SEQ ID NO: 679839 - RNA, 19 nt, Homo sapiens
uuuaauaaaacugcgagga

SEQ ID NO: 679840 - RNA, 19 nt, Homo sapiens
uuuaauaacauacuccuuu

SEQ ID NO: 679841 - RNA, 15 nt, Homo sapiens
uuuaauaacauauua

SEQ ID NO: 679842 - RNA, 19 nt, Homo sapiens
uuuaauacaggguagauaa

SEQ ID NO: 679843 - RNA, 19 nt, Homo sapiens
uuuaauacagugagcucua

SEQ ID NO: 679844 - RNA, 20 nt, Homo sapiens
uuuaauaucuggcacuguua

SEQ ID NO: 679845 - RNA, 13 nt, Homo sapiens
uuuaauaugucaa

SEQ ID NO: 679846 - RNA, 20 nt, Homo sapiens
uuuaaucagcaauauugccu

SEQ ID NO: 679847 - RNA, 13 nt, Homo sapiens
uuuaaucagugaa

SEQ ID NO: 679848 - RNA, 15 nt, Homo sapiens
uuuaauccuaccuca

SEQ ID NO: 679849 - RNA, 19 nt, Homo sapiens
uuuaaugccgauauacucu

SEQ ID NO: 679850 - RNA, 23 nt, Homo sapiens
uuuaauggcaauaggacauugug

SEQ ID NO: 679851 - RNA, 17 nt, Homo sapiens
uuuaauggcaugucaga

SEQ ID NO: 679852 - RNA, 20 nt, Homo sapiens
uuuauuuuucauauugugcc

SEQ ID NO: 679853 - RNA, 20 nt, Homo sapiens
uuuauuuuucucucagugca

SEQ ID NO: 679854 - RNA, 14 nt, Homo sapiens
uuuauuuuugacug

SEQ ID NO: 679855 - RNA, 22 nt, Homo sapiens
uuuauuuuuuuaaaacacaaau

SEQ ID NO: 679856 - RNA, 22 nt, Homo sapiens
uuucaaaaaaucugaccaaaac

SEQ ID NO: 679857 - RNA, 23 nt, Homo sapiens
uuucaaaagcggggcuucaucug

SEQ ID NO: 679858 - RNA, 14 nt, Homo sapiens
uuucaaacauauau

SEQ ID NO: 679859 - RNA, 21 nt, Homo sapiens
uuucaaaccagcuucaugugg

SEQ ID NO: 679860 - RNA, 23 nt, Homo sapiens
uuucaaagaaggaauucuaggca

SEQ ID NO: 679861 - RNA, 15 nt, Homo sapiens
uuucaaaugugcugu

SEQ ID NO: 679862 - RNA, 17 nt, Homo sapiens
uuucaaauuauaugcua

SEQ ID NO: 679863 - RNA, 16 nt, Homo sapiens
uuucaaauugagagaa

SEQ ID NO: 679864 - RNA, 22 nt, Homo sapiens
uuucaacaagugcuaccuuuga

SEQ ID NO: 679865 - RNA, 12 nt, Homo sapiens
uuucaaccauaa

SEQ ID NO: 679866 - RNA, 15 nt, Homo sapiens
uuucaacgucuugcu

SEQ ID NO: 679867 - RNA, 20 nt, Homo sapiens
uuucaagaaaauagcuauaa

SEQ ID NO: 679868 - RNA, 18 nt, Homo sapiens
uuucaagcauuaagaaca

SEQ ID NO: 679869 - RNA, 16 nt, Homo sapiens
uuucaaggaaagugaa

SEQ ID NO: 679870 - RNA, 17 nt, Homo sapiens
uuucaaggcauuugucu

SEQ ID NO: 679871 - RNA, 12 nt, Homo sapiens
uuucaaggccuu

SEQ ID NO: 679872 - RNA, 21 nt, Homo sapiens
uuucaaguuuccccagcuuca

SEQ ID NO: 679873 - RNA, 15 nt, Homo sapiens
uuucaaucaacuuua

SEQ ID NO: 679874 - RNA, 23 nt, Homo sapiens
uuucaaugaugggcgagcgugca

SEQ ID NO: 679875 - RNA, 18 nt, Homo sapiens
uuucaauguccagugagu

SEQ ID NO: 679876 - RNA, 13 nt, Homo sapiens
uuucaauuacaaa

SEQ ID NO: 679877 - RNA, 16 nt, Homo sapiens
uuucacaauaccucau

SEQ ID NO: 679878 - RNA, 13 nt, Homo sapiens
uuucacacacaca

SEQ ID NO: 679879 - RNA, 15 nt, Homo sapiens
uuucacacagugaaa

SEQ ID NO: 679880 - RNA, 21 nt, Homo sapiens
uuucacagagugugcugcuau

SEQ ID NO: 679881 - RNA, 15 nt, Homo sapiens
uuucacauugaucau

SEQ ID NO: 679882 - RNA, 21 nt, Homo sapiens
uuucacauuguuugcugcuau

SEQ ID NO: 679883 - RNA, 21 nt, Homo sapiens
uuucaccccaucccuccuuaa

SEQ ID NO: 679884 - RNA, 21 nt, Homo sapiens
uuucaccgggcaauccaagua

SEQ ID NO: 679885 - RNA, 15 nt, Homo sapiens
uuucacucugucauc

SEQ ID NO: 679886 - RNA, 14 nt, Homo sapiens
uuucacugcugcuc

SEQ ID NO: 679887 - RNA, 22 nt, Homo sapiens
uuucacuuugggauauggucuu

SEQ ID NO: 679888 - RNA, 23 nt, Homo sapiens
uuucagagugacuacacacagua

SEQ ID NO: 679889 - RNA, 14 nt, Homo sapiens
uuucagccacuucu

SEQ ID NO: 679890 - RNA, 18 nt, Homo sapiens
uuucaggaagacugacag

SEQ ID NO: 679891 - RNA, 21 nt, Homo sapiens
uuucaggaggaauacugaaca

SEQ ID NO: 679892 - RNA, 12 nt, Homo sapiens
uuucagggcugg

SEQ ID NO: 679893 - RNA, 16 nt, Homo sapiens
uuucaguaagucucau

SEQ ID NO: 679894 - RNA, 18 nt, Homo sapiens
uuucaguaucaucuccau

SEQ ID NO: 679895 - RNA, 18 nt, Homo sapiens
uuucagugugagucagaa

SEQ ID NO: 679896 - RNA, 19 nt, Homo sapiens
uuucauaaacuucagggau

SEQ ID NO: 679897 - RNA, 20 nt, Homo sapiens
uuucauaaacuucagggauc

SEQ ID NO: 679898 - RNA, 13 nt, Homo sapiens
uuucauacaacag

SEQ ID NO: 679899 - RNA, 13 nt, Homo sapiens
uuucauacacuua

SEQ ID NO: 679900 - RNA, 16 nt, Homo sapiens
uuucauagugaccugu

SEQ ID NO: 679901 - RNA, 22 nt, Homo sapiens
uuucauagugaccuguguuuca

SEQ ID NO: 679902 - RNA, 17 nt, Homo sapiens
uuucauauguugcucag

SEQ ID NO: 679903 - RNA, 21 nt, Homo sapiens
uuucaucacacuggguggugg

SEQ ID NO: 679904 - RNA, 17 nt, Homo sapiens
uuucaucauaacauaaa

SEQ ID NO: 679905 - RNA, 19 nt, Homo sapiens
uuucauccacuagugcaaa

SEQ ID NO: 679906 - RNA, 16 nt, Homo sapiens
uuucaucucuauuuag

SEQ ID NO: 679907 - RNA, 21 nt, Homo sapiens
uuucaucuguuguucuguggu

SEQ ID NO: 679908 - RNA, 16 nt, Homo sapiens
uuucaucuuuguggau

SEQ ID NO: 679909 - RNA, 21 nt, Homo sapiens
uuucaugauaaugaacagaac

SEQ ID NO: 679910 - RNA, 13 nt, Homo sapiens
uuucaugcaaaag

SEQ ID NO: 679911 - RNA, 16 nt, Homo sapiens
uuucauggacacuuug

SEQ ID NO: 679912 - RNA, 17 nt, Homo sapiens
uuucauguaaauuuugu

SEQ ID NO: 679913 - RNA, 17 nt, Homo sapiens
uuucaugucuugucaua

SEQ ID NO: 679914 - RNA, 22 nt, Homo sapiens
uuucauguggcuguagauccca

SEQ ID NO: 679915 - RNA, 14 nt, Homo sapiens
uuucauuaggcaaa

SEQ ID NO: 679916 - RNA, 22 nt, Homo sapiens
uuucauuccuaacacagcaugu

SEQ ID NO: 679917 - RNA, 12 nt, Homo sapiens
uuucauugcugg

SEQ ID NO: 679918 - RNA, 18 nt, Homo sapiens
uuucauuguguucucuau

SEQ ID NO: 679919 - RNA, 17 nt, Homo sapiens
uuucauuuaucuauaau

SEQ ID NO: 679920 - RNA, 16 nt, Homo sapiens
uuucauuuuuaggaau

SEQ ID NO: 679921 - RNA, 15 nt, Homo sapiens
uuuccaaacauccaa

SEQ ID NO: 679922 - RNA, 13 nt, Homo sapiens
uuuccaaaccauc

SEQ ID NO: 679923 - RNA, 14 nt, Homo sapiens
uuuccaaagagccg

SEQ ID NO: 679924 - RNA, 13 nt, Homo sapiens
uuuccaaugaagg

SEQ ID NO: 679925 - RNA, 17 nt, Homo sapiens
uuuccaauuauuugacu

SEQ ID NO: 679926 - RNA, 18 nt, Homo sapiens
uuuccaauuauuugacuu

SEQ ID NO: 679927 - RNA, 16 nt, Homo sapiens
uuuccaauugaacuuu

SEQ ID NO: 679928 - RNA, 15 nt, Homo sapiens
uuuccacuccauugu

SEQ ID NO: 679929 - RNA, 20 nt, Homo sapiens
uuuccacugugcuauuacaa

SEQ ID NO: 679930 - RNA, 12 nt, Homo sapiens
uuuccagggaua

SEQ ID NO: 679931 - RNA, 22 nt, Homo sapiens
uuuccaguggaucauaagacaa

SEQ ID NO: 679932 - RNA, 21 nt, Homo sapiens
uuuccauaaagguaacaaagg

SEQ ID NO: 679933 - RNA, 18 nt, Homo sapiens
uuuccauauggauuuucu

SEQ ID NO: 679934 - RNA, 16 nt, Homo sapiens
uuuccauccaguuccu

SEQ ID NO: 679935 - RNA, 14 nt, Homo sapiens
uuuccauuccauaa

SEQ ID NO: 679936 - RNA, 23 nt, Homo sapiens
uuuccauugcuuauucuugagca

SEQ ID NO: 679937 - RNA, 18 nt, Homo sapiens
uuuccauuguagcucuuu

SEQ ID NO: 679938 - RNA, 13 nt, Homo sapiens
uuuccauuuacua

SEQ ID NO: 679939 - RNA, 12 nt, Homo sapiens
uuucccaccacc

SEQ ID NO: 679940 - RNA, 17 nt, Homo sapiens
uuucccacgaggaaucu

SEQ ID NO: 679941 - RNA, 19 nt, Homo sapiens
uuucccaucagacugucaa

SEQ ID NO: 679942 - RNA, 12 nt, Homo sapiens
uuucccauuuca

SEQ ID NO: 679943 - RNA, 17 nt, Homo sapiens
uuuccccaaccacagag

SEQ ID NO: 679944 - RNA, 23 nt, Homo sapiens
uuucccccuccucagauggggca

SEQ ID NO: 679945 - RNA, 21 nt, Homo sapiens
uuucccuaaguuuacuucucu

SEQ ID NO: 679946 - RNA, 13 nt, Homo sapiens
uuucccuuccagu

SEQ ID NO: 679947 - RNA, 18 nt, Homo sapiens
uuuccguaaaaaugauuu

SEQ ID NO: 679948 - RNA, 11 nt, Homo sapiens
uuuccuaggau

SEQ ID NO: 679949 - RNA, 12 nt, Homo sapiens
uuuccucaaaac

SEQ ID NO: 679950 - RNA, 14 nt, Homo sapiens
uuuccucaagcaau

SEQ ID NO: 679951 - RNA, 22 nt, Homo sapiens
uuuccucagugcauuugugcua

SEQ ID NO: 679952 - RNA, 16 nt, Homo sapiens
uuuccucaucugcaaa

SEQ ID NO: 679953 - RNA, 13 nt, Homo sapiens
uuuccuccccacc

SEQ ID NO: 679954 - RNA, 12 nt, Homo sapiens
uuuccuccugag

SEQ ID NO: 679955 - RNA, 20 nt, Homo sapiens
uuuccucgccuaggccugug

SEQ ID NO: 679956 - RNA, 13 nt, Homo sapiens
uuuccucuaauga

SEQ ID NO: 679957 - RNA, 18 nt, Homo sapiens
uuuccucuaguaucacuu

SEQ ID NO: 679958 - RNA, 14 nt, Homo sapiens
uuuccucuauugau

SEQ ID NO: 679959 - RNA, 14 nt, Homo sapiens
uuuccucuguucac

SEQ ID NO: 679960 - RNA, 12 nt, Homo sapiens
uuuccugauaca

SEQ ID NO: 679961 - RNA, 17 nt, Homo sapiens
uuuccugauacauuaaa

SEQ ID NO: 679962 - RNA, 20 nt, Homo sapiens
uuuccugaucuagcacuccu

SEQ ID NO: 679963 - RNA, 12 nt, Homo sapiens
uuuccugccucc

SEQ ID NO: 679964 - RNA, 15 nt, Homo sapiens
uuuccugcggcauca

SEQ ID NO: 679965 - RNA, 17 nt, Homo sapiens
uuuccuguauugcuuua

SEQ ID NO: 679966 - RNA, 19 nt, Homo sapiens
uuuccuuaacgcuagagau

SEQ ID NO: 679967 - RNA, 15 nt, Homo sapiens
uuuccuuagugccag

SEQ ID NO: 679968 - RNA, 19 nt, Homo sapiens
uuuccuuaguuuucuagua

SEQ ID NO: 679969 - RNA, 12 nt, Homo sapiens
uuuccuuccaga

SEQ ID NO: 679970 - RNA, 19 nt, Homo sapiens
uuuccuuuauccacuuuuc

SEQ ID NO: 679971 - RNA, 15 nt, Homo sapiens
uuuccuuucugccac

SEQ ID NO: 679972 - RNA, 16 nt, Homo sapiens
uuuccuuuuuugucua

SEQ ID NO: 679973 - RNA, 17 nt, Homo sapiens
uuucgugcacucugcua

SEQ ID NO: 679974 - RNA, 21 nt, Homo sapiens
uuucuaaauaaggaauuuccu

SEQ ID NO: 679975 - RNA, 18 nt, Homo sapiens
aaaagauaaccugcagaa

SEQ ID NO: 679976 - RNA, 22 nt, Homo sapiens
aaaagaucuugaauagucucau

SEQ ID NO: 679977 - RNA, 12 nt, Homo sapiens
aaaagaugaagu

SEQ ID NO: 679978 - RNA, 17 nt, Homo sapiens
aaaagaugauuucucaa

SEQ ID NO: 679979 - RNA, 15 nt, Homo sapiens
aaaagaugugcagau

SEQ ID NO: 679980 - RNA, 13 nt, Homo sapiens
aaaagauugccaa

SEQ ID NO: 679981 - RNA, 22 nt, Homo sapiens
aaaagcaagacuguugcucaaa

SEQ ID NO: 679982 - RNA, 15 nt, Homo sapiens
aaaagcaagggcaaa

SEQ ID NO: 679983 - RNA, 11 nt, Homo sapiens
aaaagcacaug

SEQ ID NO: 679984 - RNA, 13 nt, Homo sapiens
aaaagcaccugcc

SEQ ID NO: 679985 - RNA, 11 nt, Homo sapiens
aaaagcagcuc

SEQ ID NO: 679986 - RNA, 18 nt, Homo sapiens
aaaagccauaacuugaaa

SEQ ID NO: 679987 - RNA, 14 nt, Homo sapiens
aaaagccuaccuaa

SEQ ID NO: 679988 - RNA, 23 nt, Homo sapiens
aaaagcgcucccccgucgugcuu

SEQ ID NO: 679989 - RNA, 16 nt, Homo sapiens
aaaagcuacaguuuug

SEQ ID NO: 679990 - RNA, 18 nt, Homo sapiens
aaaagcuagauacuggaa

SEQ ID NO: 679991 - RNA, 18 nt, Homo sapiens
aaaagcugggaaccagca

SEQ ID NO: 679992 - RNA, 20 nt, Homo sapiens
aaaagcuuauucaucuguuu

SEQ ID NO: 679993 - RNA, 21 nt, Homo sapiens
aaaaggaaaccaaguggucag

SEQ ID NO: 679994 - RNA, 21 nt, Homo sapiens
aaaaggaaacuguacuacauc

SEQ ID NO: 679995 - RNA, 22 nt, Homo sapiens
aaaaggaacucuagaagaccaa

SEQ ID NO: 679996 - RNA, 22 nt, Homo sapiens
aaaaggacucugcuucagucca

SEQ ID NO: 679997 - RNA, 16 nt, Homo sapiens
aaaaggauaugcagua

SEQ ID NO: 679998 - RNA, 22 nt, Homo sapiens
aaaaggauguuacaaguuugcu

SEQ ID NO: 679999 - RNA, 15 nt, Homo sapiens
aaaaggcauauugcu

SEQ ID NO: 680000 - RNA, 16 nt, Homo sapiens
aaaaggcccuuuucag

SEQ ID NO: 680001 - RNA, 19 nt, Homo sapiens
aaaaggcuaagaauagugg

SEQ ID NO: 680002 - RNA, 19 nt, Homo sapiens
aaaaggcugauuacugaaa

SEQ ID NO: 680003 - RNA, 20 nt, Homo sapiens
aaaaggcugauuacugaaau

SEQ ID NO: 680004 - RNA, 16 nt, Homo sapiens
aaaaggcuucacuuuu

SEQ ID NO: 680005 - RNA, 16 nt, Homo sapiens
aaaagggaacugaaca

SEQ ID NO: 680006 - RNA, 20 nt, Homo sapiens
aaaaggguacagaugugcug

SEQ ID NO: 680007 - RNA, 19 nt, Homo sapiens
aaaaggguguugcuaagcu

SEQ ID NO: 680008 - RNA, 21 nt, Homo sapiens
aaaagguaccccgauggccaa

SEQ ID NO: 680009 - RNA, 17 nt, Homo sapiens
aaaaggucagacugaaa

SEQ ID NO: 680010 - RNA, 16 nt, Homo sapiens
aaaaggugauugucac

SEQ ID NO: 680011 - RNA, 19 nt, Homo sapiens
aaaagguuuucuucauuca

SEQ ID NO: 680012 - RNA, 18 nt, Homo sapiens
aaaaguaaauucauguaa

SEQ ID NO: 680013 - RNA, 17 nt, Homo sapiens
aaaaguaaggugcaguu

SEQ ID NO: 680014 - RNA, 18 nt, Homo sapiens
aaaaguaaguaccacuca

SEQ ID NO: 680015 - RNA, 22 nt, Homo sapiens
aaaaguaaguaccacucaggcc

SEQ ID NO: 680016 - RNA, 22 nt, Homo sapiens
aaaaguaaugaagaaaauugag

SEQ ID NO: 680017 - RNA, 14 nt, Homo sapiens
aaaaguaaugacuu

SEQ ID NO: 680018 - RNA, 18 nt, Homo sapiens
aaaaguagucauggauaa

SEQ ID NO: 680019 - RNA, 15 nt, Homo sapiens
aaaaguauaugugag

SEQ ID NO: 680020 - RNA, 18 nt, Homo sapiens
aaaaguauccugcuucug

SEQ ID NO: 680021 - RNA, 21 nt, Homo sapiens
aaaagucagagacagauaccu

SEQ ID NO: 680022 - RNA, 13 nt, Homo sapiens
aaaagucagucuu

SEQ ID NO: 680023 - RNA, 14 nt, Homo sapiens
aaaagucagucuua

SEQ ID NO: 680024 - RNA, 20 nt, Homo sapiens
aaaagucccucccugccuga

SEQ ID NO: 680025 - RNA, 13 nt, Homo sapiens
aaaagucuucacu

SEQ ID NO: 680026 - RNA, 16 nt, Homo sapiens
aaaagugaaccaucuc

SEQ ID NO: 680027 - RNA, 14 nt, Homo sapiens
aaaaguggcauuuc

SEQ ID NO: 680028 - RNA, 12 nt, Homo sapiens
aaaagugggcca

SEQ ID NO: 680029 - RNA, 13 nt, Homo sapiens
aaaagugggccag

SEQ ID NO: 680030 - RNA, 17 nt, Homo sapiens
aaaagugggcugugacu

SEQ ID NO: 680031 - RNA, 16 nt, Homo sapiens
aaaagugugagcagug

SEQ ID NO: 680032 - RNA, 15 nt, Homo sapiens
aaaaguuacauguuu

SEQ ID NO: 680033 - RNA, 19 nt, Homo sapiens
aaaaguuacauguuugcac

SEQ ID NO: 680034 - RNA, 19 nt, Homo sapiens
aaaaguuacuaccugucaa

SEQ ID NO: 680035 - RNA, 20 nt, Homo sapiens
aaaaguuagucaauccuguc

SEQ ID NO: 680036 - RNA, 23 nt, Homo sapiens
aaaaguuagucaauccugucaua

SEQ ID NO: 680037 - RNA, 22 nt, Homo sapiens
aaaaguucaaccucuuacaaua

SEQ ID NO: 680038 - RNA, 19 nt, Homo sapiens
aaaaguucuuuuugcucua

SEQ ID NO: 680039 - RNA, 17 nt, Homo sapiens
aaaaguuuaaagacacu

SEQ ID NO: 680040 - RNA, 21 nt, Homo sapiens
aaaaguuuauaaaagugaaua

SEQ ID NO: 680041 - RNA, 14 nt, Homo sapiens
aaaaguuucacagg

SEQ ID NO: 680042 - RNA, 22 nt, Homo sapiens
aaaaguuuggccgggugcggug

SEQ ID NO: 680043 - RNA, 15 nt, Homo sapiens
aaaauaaaacacauu

SEQ ID NO: 680044 - RNA, 17 nt, Homo sapiens
aaaauaaaacugucacu

SEQ ID NO: 680045 - RNA, 19 nt, Homo sapiens
aaaauaaacaccauuauuc

SEQ ID NO: 680046 - RNA, 18 nt, Homo sapiens
aaaauaaacuucuuaaca

SEQ ID NO: 680047 - RNA, 18 nt, Homo sapiens
aaaauaaaguaccacaca

SEQ ID NO: 680048 - RNA, 22 nt, Homo sapiens
aaaauaaaguaccacacauauu

SEQ ID NO: 680049 - RNA, 19 nt, Homo sapiens
aaaauaaauaggagcuuaa

SEQ ID NO: 680050 - RNA, 22 nt, Homo sapiens
aaaauaaauauaucuaccccag

SEQ ID NO: 680051 - RNA, 22 nt, Homo sapiens
aaacauguuuaaauagccuaaa

SEQ ID NO: 680052 - RNA, 22 nt, Homo sapiens
aaacauuaaaauauaaucucua

SEQ ID NO: 680053 - RNA, 19 nt, Homo sapiens
aaacauuacuguuuuccau

SEQ ID NO: 680054 - RNA, 17 nt, Homo sapiens
aaacauucaaagagaca

SEQ ID NO: 680055 - RNA, 23 nt, Homo sapiens
aaacauucacacagggcucuuug

SEQ ID NO: 680056 - RNA, 13 nt, Homo sapiens
aaacauucaguga

SEQ ID NO: 680057 - RNA, 18 nt, Homo sapiens
aaacauuccccuccccac

SEQ ID NO: 680058 - RNA, 18 nt, Homo sapiens
aaacauucugauuuggaa

SEQ ID NO: 680059 - RNA, 23 nt, Homo sapiens
aaacauugauuauaagcauguau

SEQ ID NO: 680060 - RNA, 23 nt, Homo sapiens
aaacauugcaauaaauggcuuga

SEQ ID NO: 680061 - RNA, 20 nt, Homo sapiens
aaacauuggauuuuuccuua

SEQ ID NO: 680062 - RNA, 15 nt, Homo sapiens
aaacauugugccaug

SEQ ID NO: 680063 - RNA, 19 nt, Homo sapiens
aaacauugugccaugucaa

SEQ ID NO: 680064 - RNA, 18 nt, Homo sapiens
aaacauuucuaaaccaga

SEQ ID NO: 680065 - RNA, 15 nt, Homo sapiens
aaacauuugccaagu

SEQ ID NO: 680066 - RNA, 12 nt, Homo sapiens
aaaccaaaaaga

SEQ ID NO: 680067 - RNA, 18 nt, Homo sapiens
aaaccaaaguaaccuuuu

SEQ ID NO: 680068 - RNA, 11 nt, Homo sapiens
aaaccaaauac

SEQ ID NO: 680069 - RNA, 19 nt, Homo sapiens
aaaccaagccguggcuucc

SEQ ID NO: 680070 - RNA, 18 nt, Homo sapiens
aaaccaaguuuuacuaaa

SEQ ID NO: 680071 - RNA, 17 nt, Homo sapiens
aaaccaccccauuaaaa

SEQ ID NO: 680072 - RNA, 23 nt, Homo sapiens
aaaccacgccucuugaccaggcu

SEQ ID NO: 680073 - RNA, 21 nt, Homo sapiens
aaaccacuucuccaugcugca

SEQ ID NO: 680074 - RNA, 13 nt, Homo sapiens
aaaccacuugccu

SEQ ID NO: 680075 - RNA, 17 nt, Homo sapiens
aaaccagaacaguauga

SEQ ID NO: 680076 - RNA, 11 nt, Homo sapiens
aaaccagcucg

SEQ ID NO: 680077 - RNA, 13 nt, Homo sapiens
aaaccaguaucgu

SEQ ID NO: 680078 - RNA, 18 nt, Homo sapiens
aaaccaucaaaaauauuc

SEQ ID NO: 680079 - RNA, 20 nt, Homo sapiens
aaaccaucaaaaauauucca

SEQ ID NO: 680080 - RNA, 11 nt, Homo sapiens
aaaccaucaca

SEQ ID NO: 680081 - RNA, 12 nt, Homo sapiens
aaaccaucagcu

SEQ ID NO: 680082 - RNA, 12 nt, Homo sapiens
aaaccaugacaa

SEQ ID NO: 680083 - RNA, 11 nt, Homo sapiens
aaaccaugacu

SEQ ID NO: 680084 - RNA, 15 nt, Homo sapiens
aaaccaugagaauuu

SEQ ID NO: 680085 - RNA, 18 nt, Homo sapiens
aaaccaugagaauuugca

SEQ ID NO: 680086 - RNA, 12 nt, Homo sapiens
aaaccauucuag

SEQ ID NO: 680087 - RNA, 23 nt, Homo sapiens
aaacccacgauuuucuccagcuc

SEQ ID NO: 680088 - RNA, 18 nt, Homo sapiens
aaacccagacaaccaaaa

SEQ ID NO: 680089 - RNA, 19 nt, Homo sapiens
aaacccagacaaccaaaac

SEQ ID NO: 680090 - RNA, 17 nt, Homo sapiens
aaacccagucucagaca

SEQ ID NO: 680091 - RNA, 14 nt, Homo sapiens
aaacccagucuccu

SEQ ID NO: 680092 - RNA, 20 nt, Homo sapiens
aaacccagucuccucuccau

SEQ ID NO: 680093 - RNA, 24 nt, Homo sapiens
aaacccauacaauguauguacaau

SEQ ID NO: 680094 - RNA, 17 nt, Homo sapiens
aaacccccacuccagcu

SEQ ID NO: 680095 - RNA, 21 nt, Homo sapiens
aaaccccccagagcucuuuac

SEQ ID NO: 680096 - RNA, 22 nt, Homo sapiens
aaacccuauacaaguuguucua

SEQ ID NO: 680097 - RNA, 15 nt, Homo sapiens
aaacccuaucuguga

SEQ ID NO: 680098 - RNA, 16 nt, Homo sapiens
aaacccucagcacugu

SEQ ID NO: 680099 - RNA, 20 nt, Homo sapiens
aaacccucagcacuguuaca

SEQ ID NO: 680100 - RNA, 13 nt, Homo sapiens
aaacccucuguca

SEQ ID NO: 680101 - RNA, 15 nt, Homo sapiens
aaacccugcugaaca

SEQ ID NO: 680102 - RNA, 16 nt, Homo sapiens
aaaccuaucucaggga

SEQ ID NO: 680103 - RNA, 14 nt, Homo sapiens
aaaccucaagccag

SEQ ID NO: 680104 - RNA, 14 nt, Homo sapiens
aaaccuccugcugu

SEQ ID NO: 680105 - RNA, 22 nt, Homo sapiens
aaaccucugccgcccuccacac

SEQ ID NO: 680106 - RNA, 16 nt, Homo sapiens
aaaccugaccccugcu

SEQ ID NO: 680107 - RNA, 21 nt, Homo sapiens
aaaccugaccccugcucagua

SEQ ID NO: 680108 - RNA, 16 nt, Homo sapiens
aaaccugcccaugugu

SEQ ID NO: 680109 - RNA, 22 nt, Homo sapiens
aaaccuggaaucuacaagccaa

SEQ ID NO: 680110 - RNA, 22 nt, Homo sapiens
aaaccuggcaagucaccugcag

SEQ ID NO: 680111 - RNA, 22 nt, Homo sapiens
aaaccugggcaugguggcucac

SEQ ID NO: 680112 - RNA, 16 nt, Homo sapiens
aaaccuguacauaugu

SEQ ID NO: 680113 - RNA, 14 nt, Homo sapiens
aaaccugugugcca

SEQ ID NO: 680114 - RNA, 18 nt, Homo sapiens
aaaccuuaagugcugcag

SEQ ID NO: 680115 - RNA, 21 nt, Homo sapiens
aaaccuuagauaucugguucu

SEQ ID NO: 680116 - RNA, 18 nt, Homo sapiens
aaaccuucagaagcuauu

SEQ ID NO: 680117 - RNA, 20 nt, Homo sapiens
aaaccuucagaagcuauuuu

SEQ ID NO: 680118 - RNA, 17 nt, Homo sapiens
aaaccuuccucuuccag

SEQ ID NO: 680119 - RNA, 18 nt, Homo sapiens
aaaccuuggccucugcua

SEQ ID NO: 680120 - RNA, 19 nt, Homo sapiens
aaaccuuucaaauuucaca

SEQ ID NO: 680121 - RNA, 14 nt, Homo sapiens
aaaccuuucauaau

SEQ ID NO: 680122 - RNA, 16 nt, Homo sapiens
aaacgcuuauugugua

SEQ ID NO: 680123 - RNA, 15 nt, Homo sapiens
aaacggauaccaagu

SEQ ID NO: 680124 - RNA, 15 nt, Homo sapiens
aaacggaugaguuau

SEQ ID NO: 680125 - RNA, 16 nt, Homo sapiens
aaacgggaacaugccc

SEQ ID NO: 680126 - RNA, 16 nt, Homo sapiens
aaacgugacagggaaa

SEQ ID NO: 680127 - RNA, 17 nt, Homo sapiens
aaacguguaaauugcac

SEQ ID NO: 680128 - RNA, 11 nt, Homo sapiens
aaaacuacuga

SEQ ID NO: 680129 - RNA, 18 nt, Homo sapiens
aaaacuacugacagggag

SEQ ID NO: 680130 - RNA, 11 nt, Homo sapiens
aaaacuacuuc

SEQ ID NO: 680131 - RNA, 15 nt, Homo sapiens
aaaacuauauucuca

SEQ ID NO: 680132 - RNA, 21 nt, Homo sapiens
aaaacuauguguucaaugaaa

SEQ ID NO: 680133 - RNA, 16 nt, Homo sapiens
aaaacuauuauaugua

SEQ ID NO: 680134 - RNA, 20 nt, Homo sapiens
aaaacuauuugcagaugaca

SEQ ID NO: 680135 - RNA, 14 nt, Homo sapiens
aaaacucaaccaga

SEQ ID NO: 680136 - RNA, 19 nt, Homo sapiens
aaaacucauaauuauuuug

SEQ ID NO: 680137 - RNA, 14 nt, Homo sapiens
aaaacuccaucuca

SEQ ID NO: 680138 - RNA, 23 nt, Homo sapiens
aaaacucccaauggauaaaucag

SEQ ID NO: 680139 - RNA, 18 nt, Homo sapiens
aaaacuccugggcuuaag

SEQ ID NO: 680140 - RNA, 18 nt, Homo sapiens
aaaacucuucagugcaaa

SEQ ID NO: 680141 - RNA, 21 nt, Homo sapiens
aaaacucuucagugcaaauug

SEQ ID NO: 680142 - RNA, 19 nt, Homo sapiens
aaaacugaaaaucuaauau

SEQ ID NO: 680143 - RNA, 23 nt, Homo sapiens
aaaacugaaagugaaaguccaga

SEQ ID NO: 680144 - RNA, 16 nt, Homo sapiens
aaaacugacauagaga

SEQ ID NO: 680145 - RNA, 19 nt, Homo sapiens
aaaacugauugaaugauau

SEQ ID NO: 680146 - RNA, 18 nt, Homo sapiens
aaaacugcacagugcugu

SEQ ID NO: 680147 - RNA, 21 nt, Homo sapiens
aaaacugcuuacuuaugccau

SEQ ID NO: 680148 - RNA, 17 nt, Homo sapiens
aaaacuggcaucugaca

SEQ ID NO: 680149 - RNA, 13 nt, Homo sapiens
aaaacuggcucug

SEQ ID NO: 680150 - RNA, 17 nt, Homo sapiens
aaaacuguguugccaca

SEQ ID NO: 680151 - RNA, 21 nt, Homo sapiens
aaaacuguuuguuaucucuug

SEQ ID NO: 680152 - RNA, 15 nt, Homo sapiens
aaaacuuaaagcaaa

SEQ ID NO: 680153 - RNA, 21 nt, Homo sapiens
aaaacuuaauaaaaauuauua

SEQ ID NO: 680154 - RNA, 16 nt, Homo sapiens
aaaacuuagugacaaa

SEQ ID NO: 680155 - RNA, 17 nt, Homo sapiens
aaaacuucaagacauca

SEQ ID NO: 680156 - RNA, 16 nt, Homo sapiens
aaaacuucaguaagua

SEQ ID NO: 680157 - RNA, 21 nt, Homo sapiens
aaaacuucauucuaaaccaaa

SEQ ID NO: 680158 - RNA, 19 nt, Homo sapiens
aaaacuuguacaccaaugu

SEQ ID NO: 680159 - RNA, 11 nt, Homo sapiens
aaaacuuguag

SEQ ID NO: 680160 - RNA, 17 nt, Homo sapiens
aaaacuugugcuauaaa

SEQ ID NO: 680161 - RNA, 23 nt, Homo sapiens
aaaacuuuucuaauacucuaccc

SEQ ID NO: 680162 - RNA, 22 nt, Homo sapiens
aaaagaaauuuugccugccauu

SEQ ID NO: 680163 - RNA, 15 nt, Homo sapiens
aaaagaagacucuga

SEQ ID NO: 680164 - RNA, 16 nt, Homo sapiens
aaaagaagacucugac

SEQ ID NO: 680165 - RNA, 16 nt, Homo sapiens
aaaagaauauuuagaa

SEQ ID NO: 680166 - RNA, 11 nt, Homo sapiens
aaaagacauaa

SEQ ID NO: 680167 - RNA, 23 nt, Homo sapiens
aaaagacauguuggaaauguagu

SEQ ID NO: 680168 - RNA, 17 nt, Homo sapiens
aaaagaccaagggccag

SEQ ID NO: 680169 - RNA, 21 nt, Homo sapiens
aaaagaccuacagacuaagaa

SEQ ID NO: 680170 - RNA, 13 nt, Homo sapiens
aaaagaccuauga

SEQ ID NO: 680171 - RNA, 20 nt, Homo sapiens
aaaagacguucauuauguau

SEQ ID NO: 680172 - RNA, 12 nt, Homo sapiens
aaaagacugaau

SEQ ID NO: 680173 - RNA, 13 nt, Homo sapiens
aaaagacugacca

SEQ ID NO: 680174 - RNA, 13 nt, Homo sapiens
aaaagagcuuuau

SEQ ID NO: 680175 - RNA, 15 nt, Homo sapiens
uuugcucuuacuaca

SEQ ID NO: 680176 - RNA, 23 nt, Homo sapiens
uuugcuguuaaaauaagaacaaa

SEQ ID NO: 680177 - RNA, 17 nt, Homo sapiens
uuugcuuaaaauuguga

SEQ ID NO: 680178 - RNA, 14 nt, Homo sapiens
uuugcuuagcucaa

SEQ ID NO: 680179 - RNA, 17 nt, Homo sapiens
uuugcuucuugccauca

SEQ ID NO: 680180 - RNA, 16 nt, Homo sapiens
uuugcuugcaauguag

SEQ ID NO: 680181 - RNA, 15 nt, Homo sapiens
uuugcuuucugcuca

SEQ ID NO: 680182 - RNA, 22 nt, Homo sapiens
uuuggaacauuucuuucuugcu

SEQ ID NO: 680183 - RNA, 14 nt, Homo sapiens
uuuggaauuauguc

SEQ ID NO: 680184 - RNA, 17 nt, Homo sapiens
uuuggacuguaacugac

SEQ ID NO: 680185 - RNA, 16 nt, Homo sapiens
uuuggaggaagauaca

SEQ ID NO: 680186 - RNA, 14 nt, Homo sapiens
uuuggaggugcugc

SEQ ID NO: 680187 - RNA, 19 nt, Homo sapiens
uuuggaguccccucaccuc

SEQ ID NO: 680188 - RNA, 16 nt, Homo sapiens
uuuggauguuuccacg

SEQ ID NO: 680189 - RNA, 23 nt, Homo sapiens
uuuggauuccuaaauauuuucaa

SEQ ID NO: 680190 - RNA, 18 nt, Homo sapiens
uuuggcaguucaaaagac

SEQ ID NO: 680191 - RNA, 17 nt, Homo sapiens
uuuggccccacuuugaa

SEQ ID NO: 680192 - RNA, 13 nt, Homo sapiens
uuuggccucaaaa

SEQ ID NO: 680193 - RNA, 15 nt, Homo sapiens
uuuggcgaaucucaa

SEQ ID NO: 680194 - RNA, 23 nt, Homo sapiens
uuuggcgaccuccuuucaucaca

SEQ ID NO: 680195 - RNA, 18 nt, Homo sapiens
uuuggcuuuaugugcaaa

SEQ ID NO: 680196 - RNA, 21 nt, Homo sapiens
uuugggagcacggacugucag

SEQ ID NO: 680197 - RNA, 19 nt, Homo sapiens
uuugggagggaaaagggaa

SEQ ID NO: 680198 - RNA, 23 nt, Homo sapiens
uuuggggaagugaggaagccagg

SEQ ID NO: 680199 - RNA, 15 nt, Homo sapiens
uuuggggagcagaga

SEQ ID NO: 680200 - RNA, 18 nt, Homo sapiens
uuugggguaauacuucca

SEQ ID NO: 680201 - RNA, 15 nt, Homo sapiens
uuuggguaacuucaa

SEQ ID NO: 680202 - RNA, 17 nt, Homo sapiens
uuuggguuuugggucuu

SEQ ID NO: 680203 - RNA, 14 nt, Homo sapiens
uuuggucacacucu

SEQ ID NO: 680204 - RNA, 15 nt, Homo sapiens
uuuggucacauauca

SEQ ID NO: 680205 - RNA, 21 nt, Homo sapiens
uuuggucaugugguacuugag

SEQ ID NO: 680206 - RNA, 17 nt, Homo sapiens
uuugguuaccaauuuaa

SEQ ID NO: 680207 - RNA, 11 nt, Homo sapiens
uuugguuuugc

SEQ ID NO: 680208 - RNA, 19 nt, Homo sapiens
uuuguaaaagcuugaugaa

SEQ ID NO: 680209 - RNA, 10 nt, Homo sapiens
uuuguaaaau

SEQ ID NO: 680210 - RNA, 23 nt, Homo sapiens
uuuguaaacuucugaagacugag

SEQ ID NO: 680211 - RNA, 17 nt, Homo sapiens
uuuguaagacuuacaaa

SEQ ID NO: 680212 - RNA, 23 nt, Homo sapiens
uuuguaauaaaaugguacauuuc

SEQ ID NO: 680213 - RNA, 15 nt, Homo sapiens
uuuguaaugcugcac

SEQ ID NO: 680214 - RNA, 16 nt, Homo sapiens
uuuguaaugcugcaca

SEQ ID NO: 680215 - RNA, 14 nt, Homo sapiens
uuuguaauugcuua

SEQ ID NO: 680216 - RNA, 16 nt, Homo sapiens
uuuguacauacuguau

SEQ ID NO: 680217 - RNA, 20 nt, Homo sapiens
uuuguaccucuaaguacaua

SEQ ID NO: 680218 - RNA, 14 nt, Homo sapiens
uuuguacugauaua

SEQ ID NO: 680219 - RNA, 14 nt, Homo sapiens
uuuguagcacugag

SEQ ID NO: 680220 - RNA, 19 nt, Homo sapiens
uuuguagccuuccuccaca

SEQ ID NO: 680221 - RNA, 22 nt, Homo sapiens
uuuguauauaggcuucucacgg

SEQ ID NO: 680222 - RNA, 15 nt, Homo sapiens
uuuguaugcuaaaug

SEQ ID NO: 680223 - RNA, 22 nt, Homo sapiens
uuuguauucucuuccucaucca

SEQ ID NO: 680224 - RNA, 22 nt, Homo sapiens
uuugucacaaauaaacauaaua

SEQ ID NO: 680225 - RNA, 19 nt, Homo sapiens
uuugucacuaaacucucau

SEQ ID NO: 680226 - RNA, 12 nt, Homo sapiens
uuugucagaaac

SEQ ID NO: 680227 - RNA, 13 nt, Homo sapiens
uuugucauaccuu

SEQ ID NO: 680228 - RNA, 19 nt, Homo sapiens
uuugucccagccuggggcu

SEQ ID NO: 680229 - RNA, 17 nt, Homo sapiens
uuuguccccacuuacag

SEQ ID NO: 680230 - RNA, 15 nt, Homo sapiens
uuuguccucucugug

SEQ ID NO: 680231 - RNA, 20 nt, Homo sapiens
uuuguccuggucaugcacau

SEQ ID NO: 680232 - RNA, 22 nt, Homo sapiens
uuugucucuuagaaauacuugu

SEQ ID NO: 680233 - RNA, 22 nt, Homo sapiens
uuugucuguacucaugucauuc

SEQ ID NO: 680234 - RNA, 17 nt, Homo sapiens
uuugucuuggauauaua

SEQ ID NO: 680235 - RNA, 19 nt, Homo sapiens
uuugugcuugucauuccag

SEQ ID NO: 680236 - RNA, 23 nt, Homo sapiens
uuuguggcauaaauuacagucau

SEQ ID NO: 680237 - RNA, 11 nt, Homo sapiens
uuuguggcauc

SEQ ID NO: 680238 - RNA, 13 nt, Homo sapiens
uuuguggccucag

SEQ ID NO: 680239 - RNA, 14 nt, Homo sapiens
uuugugugugugca

SEQ ID NO: 680240 - RNA, 16 nt, Homo sapiens
uuugugugugugcaag

SEQ ID NO: 680241 - RNA, 19 nt, Homo sapiens
uuugugugugugcaagugu

SEQ ID NO: 680242 - RNA, 12 nt, Homo sapiens
uuuguuacugau

SEQ ID NO: 680243 - RNA, 14 nt, Homo sapiens
uuuguuagcaaaga

SEQ ID NO: 680244 - RNA, 22 nt, Homo sapiens
uuuguuaguaugaggcauuugu

SEQ ID NO: 680245 - RNA, 12 nt, Homo sapiens
uuuguucacuua

SEQ ID NO: 680246 - RNA, 15 nt, Homo sapiens
uuuguuccaggcuca

SEQ ID NO: 680247 - RNA, 21 nt, Homo sapiens
uuuguucuccggguguggccu

SEQ ID NO: 680248 - RNA, 15 nt, Homo sapiens
uuuguugcagccaaa

SEQ ID NO: 680249 - RNA, 12 nt, Homo sapiens
uuuguugcccag

SEQ ID NO: 680250 - RNA, 10 nt, Homo sapiens
uuuguuguuu

SEQ ID NO: 680251 - RNA, 13 nt, Homo sapiens
uuuguuuaguacu

SEQ ID NO: 680252 - RNA, 16 nt, Homo sapiens
uuuguuucauauauac

SEQ ID NO: 680253 - RNA, 21 nt, Homo sapiens
uuuguuuuaauaaacaguaua

SEQ ID NO: 680254 - RNA, 21 nt, Homo sapiens
uuuguuuucccuggcuaacag

SEQ ID NO: 680255 - RNA, 21 nt, Homo sapiens
uuuuaaaaaaaucccauuuaa

SEQ ID NO: 680256 - RNA, 22 nt, Homo sapiens
uuuuaaaaagcaaaucuuucug

SEQ ID NO: 680257 - RNA, 14 nt, Homo sapiens
uuuuaaaacauuca

SEQ ID NO: 680258 - RNA, 21 nt, Homo sapiens
uuuuaaaaguuucaaugugau

SEQ ID NO: 680259 - RNA, 14 nt, Homo sapiens
uuuuaaacauaucc

SEQ ID NO: 680260 - RNA, 20 nt, Homo sapiens
uuuuaaaguaaacuugugua

SEQ ID NO: 680261 - RNA, 19 nt, Homo sapiens
uuuuaaauaaaagcacaag

SEQ ID NO: 680262 - RNA, 18 nt, Homo sapiens
uuuuaaaugaaaguauug

SEQ ID NO: 680263 - RNA, 22 nt, Homo sapiens
uuuuaaauuaaugaacauaugu

SEQ ID NO: 680264 - RNA, 17 nt, Homo sapiens
uuuuaacaaaucuaaaa

SEQ ID NO: 680265 - RNA, 19 nt, Homo sapiens
uuuuaacaacugugcuuuu

SEQ ID NO: 680266 - RNA, 14 nt, Homo sapiens
uuuuaacaugucaa

SEQ ID NO: 680267 - RNA, 16 nt, Homo sapiens
uuuuguacugaaucuc

SEQ ID NO: 680268 - RNA, 13 nt, Homo sapiens
uuuuguagccuuc

SEQ ID NO: 680269 - RNA, 21 nt, Homo sapiens
uuuuguaugaaauauauguga

SEQ ID NO: 680270 - RNA, 23 nt, Homo sapiens
uuuuguauugagggccagugaug

SEQ ID NO: 680271 - RNA, 23 nt, Homo sapiens
uuuugucgauuaguaaaagugcu

SEQ ID NO: 680272 - RNA, 13 nt, Homo sapiens
uuuugucuaugaa

SEQ ID NO: 680273 - RNA, 13 nt, Homo sapiens
uuuuguguguaua

SEQ ID NO: 680274 - RNA, 21 nt, Homo sapiens
uuuuguuacaaaaagacaaaa

SEQ ID NO: 680275 - RNA, 14 nt, Homo sapiens
uuuuguugccuuca

SEQ ID NO: 680276 - RNA, 17 nt, Homo sapiens
uuuuguuggcauagcuc

SEQ ID NO: 680277 - RNA, 18 nt, Homo sapiens
uuuuguuuugaagcuguu

SEQ ID NO: 680278 - RNA, 18 nt, Homo sapiens
uuuuuaaaaaacugcuga

SEQ ID NO: 680279 - RNA, 15 nt, Homo sapiens
uuuuuaaaaagcaac

SEQ ID NO: 680280 - RNA, 21 nt, Homo sapiens
uuuuuaaagucuaaacuguua

SEQ ID NO: 680281 - RNA, 17 nt, Homo sapiens
uuuuuaacugcauaaua

SEQ ID NO: 680282 - RNA, 15 nt, Homo sapiens
uuuuuaauagcacua

SEQ ID NO: 680283 - RNA, 20 nt, Homo sapiens
uuuuuaauagcuauggaauc

SEQ ID NO: 680284 - RNA, 21 nt, Homo sapiens
uuuuuaauucaguacaaccca

SEQ ID NO: 680285 - RNA, 12 nt, Homo sapiens
uuuuuacauuga

SEQ ID NO: 680286 - RNA, 17 nt, Homo sapiens
uuuuuacuccaguggug

SEQ ID NO: 680287 - RNA, 12 nt, Homo sapiens
uuuuuagcuuua

SEQ ID NO: 680288 - RNA, 19 nt, Homo sapiens
uuuuuaguagagauggggu

SEQ ID NO: 680289 - RNA, 14 nt, Homo sapiens
uuuuuauaaauauc

SEQ ID NO: 680290 - RNA, 13 nt, Homo sapiens
uuuuuauaauauc

SEQ ID NO: 680291 - RNA, 19 nt, Homo sapiens
uuuuuauaccagcuuaaua

SEQ ID NO: 680292 - RNA, 20 nt, Homo sapiens
uuuuuauaucaugcaaaaua

SEQ ID NO: 680293 - RNA, 21 nt, Homo sapiens
uuuuuaugaagugcgugaaug

SEQ ID NO: 680294 - RNA, 16 nt, Homo sapiens
uuuuuaugugcaauaa

SEQ ID NO: 680295 - RNA, 18 nt, Homo sapiens
uuuuuauuaugcauuaua

SEQ ID NO: 680296 - RNA, 14 nt, Homo sapiens
uuuuuauuugcuca

SEQ ID NO: 680297 - RNA, 13 nt, Homo sapiens
uuuuucagcuccu

SEQ ID NO: 680298 - RNA, 16 nt, Homo sapiens
uuuuucccccaugaaa

SEQ ID NO: 680299 - RNA, 16 nt, Homo sapiens
uuuuuccucuuuacuu

SEQ ID NO: 680300 - RNA, 19 nt, Homo sapiens
uuuuuccuuuucaucuguu

SEQ ID NO: 680301 - RNA, 15 nt, Homo sapiens
aaaggugccaucuca

SEQ ID NO: 680302 - RNA, 16 nt, Homo sapiens
aaaggugugcugguca

SEQ ID NO: 680303 - RNA, 21 nt, Homo sapiens
aaagguuaauuucugucaaau

SEQ ID NO: 680304 - RNA, 13 nt, Homo sapiens
aaagguucacagg

SEQ ID NO: 680305 - RNA, 16 nt, Homo sapiens
aaagguucuaucugcu

SEQ ID NO: 680306 - RNA, 16 nt, Homo sapiens
aaagguugagauguaa

SEQ ID NO: 680307 - RNA, 14 nt, Homo sapiens
aaagguugccugaa

SEQ ID NO: 680308 - RNA, 18 nt, Homo sapiens
aaagguuucauguucacu

SEQ ID NO: 680309 - RNA, 21 nt, Homo sapiens
aaagguuucauguucacugug

SEQ ID NO: 680310 - RNA, 22 nt, Homo sapiens
aaagguuuuaaccgcacaugca

SEQ ID NO: 680311 - RNA, 14 nt, Homo sapiens
aaagguuuuccuua

SEQ ID NO: 680312 - RNA, 19 nt, Homo sapiens
aaagguuuucuucauucau

SEQ ID NO: 680313 - RNA, 21 nt, Homo sapiens
aaaguaaaggccucaucuccu

SEQ ID NO: 680314 - RNA, 13 nt, Homo sapiens
aaaguaaggugca

SEQ ID NO: 680315 - RNA, 23 nt, Homo sapiens
aaaguaaggugcuuggaguuuac

SEQ ID NO: 680316 - RNA, 20 nt, Homo sapiens
aaaguaaguuaauaauguau

SEQ ID NO: 680317 - RNA, 17 nt, Homo sapiens
aaaguaauaaugugcaa

SEQ ID NO: 680318 - RNA, 18 nt, Homo sapiens
aaaguaauauaaugaugc

SEQ ID NO: 680319 - RNA, 14 nt, Homo sapiens
aaaguaaugaugaa

SEQ ID NO: 680320 - RNA, 13 nt, Homo sapiens
aaaguaaugccac

SEQ ID NO: 680321 - RNA, 19 nt, Homo sapiens
aaaguacacuaaguuugca

SEQ ID NO: 680322 - RNA, 13 nt, Homo sapiens
aaaguagccacgu

SEQ ID NO: 680323 - RNA, 17 nt, Homo sapiens
aaaguagggaccucaga

SEQ ID NO: 680324 - RNA, 16 nt, Homo sapiens
aaaguaguccugugaa

SEQ ID NO: 680325 - RNA, 21 nt, Homo sapiens
aaaguauaaccauaugauacu

SEQ ID NO: 680326 - RNA, 13 nt, Homo sapiens
aaaguauuauuca

SEQ ID NO: 680327 - RNA, 17 nt, Homo sapiens
aaaguauuccaccuuaa

SEQ ID NO: 680328 - RNA, 12 nt, Homo sapiens
aaaguauucuca

SEQ ID NO: 680329 - RNA, 16 nt, Homo sapiens
aaaguauucucaaaga

SEQ ID NO: 680330 - RNA, 22 nt, Homo sapiens
aaaguauuggcauucaaaaaga

SEQ ID NO: 680331 - RNA, 15 nt, Homo sapiens
aaagucaaaugccaa

SEQ ID NO: 680332 - RNA, 13 nt, Homo sapiens
aaagucacccaaa

SEQ ID NO: 680333 - RNA, 16 nt, Homo sapiens
aaagucacccaaacac

SEQ ID NO: 680334 - RNA, 21 nt, Homo sapiens
aaagucacggcugcgcacugu

SEQ ID NO: 680335 - RNA, 22 nt, Homo sapiens
aaagucagagacagauaccucc

SEQ ID NO: 680336 - RNA, 12 nt, Homo sapiens
aaagucagucuu

SEQ ID NO: 680337 - RNA, 19 nt, Homo sapiens
aaaguccaauuccaaagcc

SEQ ID NO: 680338 - RNA, 22 nt, Homo sapiens
aaaguccaauuccaaagccaga

SEQ ID NO: 680339 - RNA, 17 nt, Homo sapiens
aaaguccauaccuuaua

SEQ ID NO: 680340 - RNA, 15 nt, Homo sapiens
aaagucugucagguu

SEQ ID NO: 680341 - RNA, 23 nt, Homo sapiens
aaagugaaccaucucagaccuuu

SEQ ID NO: 680342 - RNA, 14 nt, Homo sapiens
aaagugacacagca

SEQ ID NO: 680343 - RNA, 14 nt, Homo sapiens
aaagugacuauuca

SEQ ID NO: 680344 - RNA, 23 nt, Homo sapiens
aaagugacucacuuaucccaaga

SEQ ID NO: 680345 - RNA, 20 nt, Homo sapiens
aaagugagaaaaugccucaa

SEQ ID NO: 680346 - RNA, 13 nt, Homo sapiens
aaagugaugacau

SEQ ID NO: 680347 - RNA, 17 nt, Homo sapiens
aaagugauuaguacuau

SEQ ID NO: 680348 - RNA, 13 nt, Homo sapiens
aaagugcaaucau

SEQ ID NO: 680349 - RNA, 19 nt, Homo sapiens
aaagugcuaguauuauggg

SEQ ID NO: 680350 - RNA, 20 nt, Homo sapiens
aaagugcugcuggaaguaga

SEQ ID NO: 680351 - RNA, 22 nt, Homo sapiens
aaagugcugggauuacaggcgu

SEQ ID NO: 680352 - RNA, 23 nt, Homo sapiens
aaagugcuucauucuuugcagga

SEQ ID NO: 680353 - RNA, 15 nt, Homo sapiens
aaagugcuugcuuuu

SEQ ID NO: 680354 - RNA, 16 nt, Homo sapiens
aaaguggacaaggagu

SEQ ID NO: 680355 - RNA, 14 nt, Homo sapiens
aaagugggcuugau

SEQ ID NO: 680356 - RNA, 12 nt, Homo sapiens
aaagugucucaa

SEQ ID NO: 680357 - RNA, 13 nt, Homo sapiens
aaagugugugauu

SEQ ID NO: 680358 - RNA, 16 nt, Homo sapiens
aaaguguucauuguuu

SEQ ID NO: 680359 - RNA, 17 nt, Homo sapiens
aaaguguugaccacaga

SEQ ID NO: 680360 - RNA, 14 nt, Homo sapiens
aaaguguuuucaca

SEQ ID NO: 680361 - RNA, 15 nt, Homo sapiens
aaaguuaaaagcaaa

SEQ ID NO: 680362 - RNA, 15 nt, Homo sapiens
aaaguuaaacauuga

SEQ ID NO: 680363 - RNA, 14 nt, Homo sapiens
aaaguuacuacuga

SEQ ID NO: 680364 - RNA, 15 nt, Homo sapiens
aaaguuacuacugau

SEQ ID NO: 680365 - RNA, 20 nt, Homo sapiens
aaaguuacugauucacugca

SEQ ID NO: 680366 - RNA, 21 nt, Homo sapiens
aaaguuacugauucacugcau

SEQ ID NO: 680367 - RNA, 23 nt, Homo sapiens
aaaguuagucaauccugucauau

SEQ ID NO: 680368 - RNA, 21 nt, Homo sapiens
aaaguuauauuucagauguaa

SEQ ID NO: 680369 - RNA, 23 nt, Homo sapiens
aaaguuaugguacuauguuagcc

SEQ ID NO: 680370 - RNA, 19 nt, Homo sapiens
aaaguuauuucauaccauu

SEQ ID NO: 680371 - RNA, 19 nt, Homo sapiens
aaaguuccagaaacuuuaa

SEQ ID NO: 680372 - RNA, 17 nt, Homo sapiens
aaccuuuggaagucaug

SEQ ID NO: 680373 - RNA, 21 nt, Homo sapiens
aacgaauggucuuugcuccag

SEQ ID NO: 680374 - RNA, 15 nt, Homo sapiens
aacgacaaagccaaa

SEQ ID NO: 680375 - RNA, 23 nt, Homo sapiens
aacgacaaagccaaacucugcca

SEQ ID NO: 680376 - RNA, 19 nt, Homo sapiens
aacgacuacccagaagugu

SEQ ID NO: 680377 - RNA, 18 nt, Homo sapiens
aacgacucaaaaugacag

SEQ ID NO: 680378 - RNA, 23 nt, Homo sapiens
aacgagauaccaucucacaccag

SEQ ID NO: 680379 - RNA, 15 nt, Homo sapiens
aacgauauguagcag

SEQ ID NO: 680380 - RNA, 15 nt, Homo sapiens
aacgcacaacaggaa

SEQ ID NO: 680381 - RNA, 19 nt, Homo sapiens
aacgcaccagacacucaca

SEQ ID NO: 680382 - RNA, 19 nt, Homo sapiens
aacgcccuuuccuccucag

SEQ ID NO: 680383 - RNA, 13 nt, Homo sapiens
aacgccgagugca

SEQ ID NO: 680384 - RNA, 16 nt, Homo sapiens
aacgccgagugcacug

SEQ ID NO: 680385 - RNA, 17 nt, Homo sapiens
aacgccgagugcacugc

SEQ ID NO: 680386 - RNA, 17 nt, Homo sapiens
aacgccgcugacugcca

SEQ ID NO: 680387 - RNA, 18 nt, Homo sapiens
aacgcuaacaauuucuca

SEQ ID NO: 680388 - RNA, 23 nt, Homo sapiens
aacgcuacggggaaaaugcauuu

SEQ ID NO: 680389 - RNA, 21 nt, Homo sapiens
aacggaauaauaaaaagcauu

SEQ ID NO: 680390 - RNA, 14 nt, Homo sapiens
aacggacacugaaa

SEQ ID NO: 680391 - RNA, 16 nt, Homo sapiens
aacggagagugcuugg

SEQ ID NO: 680392 - RNA, 19 nt, Homo sapiens
aacggcuuggcagccaguc

SEQ ID NO: 680393 - RNA, 22 nt, Homo sapiens
aacgggcugcccucagcucaca

SEQ ID NO: 680394 - RNA, 20 nt, Homo sapiens
aacggguagcagcagaugua

SEQ ID NO: 680395 - RNA, 14 nt, Homo sapiens
aacguaaauacaca

SEQ ID NO: 680396 - RNA, 21 nt, Homo sapiens
aacguagcuucuaccaugaac

SEQ ID NO: 680397 - RNA, 15 nt, Homo sapiens
aacguccacaugaaa

SEQ ID NO: 680398 - RNA, 23 nt, Homo sapiens
aacguccagcucguucucugggc

SEQ ID NO: 680399 - RNA, 15 nt, Homo sapiens
aacgucuauguguac

SEQ ID NO: 680400 - RNA, 13 nt, Homo sapiens
aacgucuccuagc

SEQ ID NO: 680401 - RNA, 13 nt, Homo sapiens
aacgucucuucaa

SEQ ID NO: 680402 - RNA, 14 nt, Homo sapiens
aacgugacagggaa

SEQ ID NO: 680403 - RNA, 22 nt, Homo sapiens
aacgugggaguucagcugcuuc

SEQ ID NO: 680404 - RNA, 17 nt, Homo sapiens
aacguuuugaacuaaua

SEQ ID NO: 680405 - RNA, 22 nt, Homo sapiens
aacuaaagccaaggguauccaa

SEQ ID NO: 680406 - RNA, 14 nt, Homo sapiens
aacuaaauaaagcu

SEQ ID NO: 680407 - RNA, 22 nt, Homo sapiens
aacuaacccuuaaaaaugcaca

SEQ ID NO: 680408 - RNA, 19 nt, Homo sapiens
aacuaagaaaaaaagcaca

SEQ ID NO: 680409 - RNA, 13 nt, Homo sapiens
aacuaagcacaaa

SEQ ID NO: 680410 - RNA, 17 nt, Homo sapiens
aacuaauaaaagcauaa

SEQ ID NO: 680411 - RNA, 20 nt, Homo sapiens
aacuaaucuaauuacugaag

SEQ ID NO: 680412 - RNA, 16 nt, Homo sapiens
aacuaaugaguaugaa

SEQ ID NO: 680413 - RNA, 18 nt, Homo sapiens
aacuacaacgaacacaag

SEQ ID NO: 680414 - RNA, 19 nt, Homo sapiens
aacuacaacgaacacaaga

SEQ ID NO: 680415 - RNA, 20 nt, Homo sapiens
aacuacaacgaacacaagaa

SEQ ID NO: 680416 - RNA, 17 nt, Homo sapiens
aacuacagaaguggaag

SEQ ID NO: 680417 - RNA, 21 nt, Homo sapiens
aacuacagaguuuaugauuua

SEQ ID NO: 680418 - RNA, 12 nt, Homo sapiens
aacuacaucuug

SEQ ID NO: 680419 - RNA, 22 nt, Homo sapiens
aacuacauuaccuguucuugcc

SEQ ID NO: 680420 - RNA, 16 nt, Homo sapiens
aacuacauuuugcaac

SEQ ID NO: 680421 - RNA, 18 nt, Homo sapiens
aacuacgggcugcucuac

SEQ ID NO: 680422 - RNA, 14 nt, Homo sapiens
aacuacugccuuua

SEQ ID NO: 680423 - RNA, 23 nt, Homo sapiens
aacuacugcuaauguugaucagc

SEQ ID NO: 680424 - RNA, 22 nt, Homo sapiens
aacuacuuuuuggucaugaaau

SEQ ID NO: 680425 - RNA, 16 nt, Homo sapiens
aacuagaaaucugcca

SEQ ID NO: 680426 - RNA, 21 nt, Homo sapiens
aacuagaaggcuucucuccac

SEQ ID NO: 680427 - RNA, 21 nt, Homo sapiens
aacuagacaucugcuguuauc

SEQ ID NO: 680428 - RNA, 16 nt, Homo sapiens
aacuagagcacagaag

SEQ ID NO: 680429 - RNA, 18 nt, Homo sapiens
aacuagccaaaccaggac

SEQ ID NO: 680430 - RNA, 13 nt, Homo sapiens
aacuagcuuuugc

SEQ ID NO: 680431 - RNA, 21 nt, Homo sapiens
aacuaggaaaaucacuugcca

SEQ ID NO: 680432 - RNA, 19 nt, Homo sapiens
aacuagggaagauaauauu

SEQ ID NO: 680433 - RNA, 14 nt, Homo sapiens
aagaauaagacaua

SEQ ID NO: 680434 - RNA, 16 nt, Homo sapiens
aagaauaagacauaaa

SEQ ID NO: 680435 - RNA, 13 nt, Homo sapiens
aagaauaugaagu

SEQ ID NO: 680436 - RNA, 23 nt, Homo sapiens
aagaauaugaaguucuaucuagu

SEQ ID NO: 680437 - RNA, 17 nt, Homo sapiens
aagaaucuagaaaauca

SEQ ID NO: 680438 - RNA, 16 nt, Homo sapiens
aagaaucuauaguuca

SEQ ID NO: 680439 - RNA, 19 nt, Homo sapiens
aagaaucuuagauaacuuc

SEQ ID NO: 680440 - RNA, 22 nt, Homo sapiens
aagaaugaucagcaucugugau

SEQ ID NO: 680441 - RNA, 14 nt, Homo sapiens
aagaaugaugcuau

SEQ ID NO: 680442 - RNA, 16 nt, Homo sapiens
aagaaugcaauaucau

SEQ ID NO: 680443 - RNA, 14 nt, Homo sapiens
aagaaugcauucaa

SEQ ID NO: 680444 - RNA, 12 nt, Homo sapiens
aagaaugcucuu

SEQ ID NO: 680445 - RNA, 15 nt, Homo sapiens
aagaauguagucaga

SEQ ID NO: 680446 - RNA, 18 nt, Homo sapiens
aagaauguguuuaaacuu

SEQ ID NO: 680447 - RNA, 14 nt, Homo sapiens
aagaauuacaguac

SEQ ID NO: 680448 - RNA, 15 nt, Homo sapiens
aagaauuacuugugu

SEQ ID NO: 680449 - RNA, 21 nt, Homo sapiens
aagaauuauuuuauacacaga

SEQ ID NO: 680450 - RNA, 20 nt, Homo sapiens
aagaauuccugaagccagau

SEQ ID NO: 680451 - RNA, 22 nt, Homo sapiens
aagaauuggggauucucuauug

SEQ ID NO: 680452 - RNA, 15 nt, Homo sapiens
aagaauugucuugca

SEQ ID NO: 680453 - RNA, 22 nt, Homo sapiens
aagaauuuaaaacgcaugugca

SEQ ID NO: 680454 - RNA, 17 nt, Homo sapiens
aagaauuucacaagcua

SEQ ID NO: 680455 - RNA, 20 nt, Homo sapiens
aagaauuugcauacuuaccu

SEQ ID NO: 680456 - RNA, 16 nt, Homo sapiens
aagaauuuuaccauuc

SEQ ID NO: 680457 - RNA, 13 nt, Homo sapiens
aagaauuuugcuu

SEQ ID NO: 680458 - RNA, 22 nt, Homo sapiens
aagacaaagcaaauaaaugccu

SEQ ID NO: 680459 - RNA, 13 nt, Homo sapiens
aagacaaaugaca

SEQ ID NO: 680460 - RNA, 14 nt, Homo sapiens
aagacaacauuucu

SEQ ID NO: 680461 - RNA, 16 nt, Homo sapiens
aagacaacauuucuca

SEQ ID NO: 680462 - RNA, 13 nt, Homo sapiens
aagacaaugcacc

SEQ ID NO: 680463 - RNA, 21 nt, Homo sapiens
aagacaauuugauacauaaua

SEQ ID NO: 680464 - RNA, 15 nt, Homo sapiens
aagacacaaaugcau

SEQ ID NO: 680465 - RNA, 13 nt, Homo sapiens
aagacacauugac

SEQ ID NO: 680466 - RNA, 22 nt, Homo sapiens
aagacaccaaauugaacucacu

SEQ ID NO: 680467 - RNA, 23 nt, Homo sapiens
aagacagacaucuguggaaugau

SEQ ID NO: 680468 - RNA, 15 nt, Homo sapiens
aagacagagauacca

SEQ ID NO: 680469 - RNA, 15 nt, Homo sapiens
aagacagagugaauu

SEQ ID NO: 680470 - RNA, 15 nt, Homo sapiens
aagacagcauugauc

SEQ ID NO: 680471 - RNA, 22 nt, Homo sapiens
aagacaggcaaauguacuucuc

SEQ ID NO: 680472 - RNA, 19 nt, Homo sapiens
aagacagggaagagcagaa

SEQ ID NO: 680473 - RNA, 20 nt, Homo sapiens
aagacagucgagaagccagg

SEQ ID NO: 680474 - RNA, 20 nt, Homo sapiens
aagacauaaauuacuuuuuc

SEQ ID NO: 680475 - RNA, 16 nt, Homo sapiens
aagacauccugagcag

SEQ ID NO: 680476 - RNA, 15 nt, Homo sapiens
aagacaugacauucu

SEQ ID NO: 680477 - RNA, 20 nt, Homo sapiens
aagacaugauuuccuugaau

SEQ ID NO: 680478 - RNA, 15 nt, Homo sapiens
aagaccaaaaugaca

SEQ ID NO: 680479 - RNA, 18 nt, Homo sapiens
aagaccaaaauuacuaau

SEQ ID NO: 680480 - RNA, 12 nt, Homo sapiens
aagaccaagaca

SEQ ID NO: 680481 - RNA, 22 nt, Homo sapiens
aagaccaauauucaaaugcgua

SEQ ID NO: 680482 - RNA, 11 nt, Homo sapiens
aagaccagcuu

SEQ ID NO: 680483 - RNA, 22 nt, Homo sapiens
aagaccauaacagccaacaggu

SEQ ID NO: 680484 - RNA, 18 nt, Homo sapiens
aagaccaugccuaggaac

SEQ ID NO: 680485 - RNA, 14 nt, Homo sapiens
aagacccaacuugc

SEQ ID NO: 680486 - RNA, 14 nt, Homo sapiens
aagacccugucuca

SEQ ID NO: 680487 - RNA, 19 nt, Homo sapiens
aagaccugagaauguaucc

SEQ ID NO: 680488 - RNA, 14 nt, Homo sapiens
aagacgccaaaaac

SEQ ID NO: 680489 - RNA, 23 nt, Homo sapiens
aagacgugauuuugcuguagaag

SEQ ID NO: 680490 - RNA, 15 nt, Homo sapiens
aagacuacuauacaa

SEQ ID NO: 680491 - RNA, 21 nt, Homo sapiens
aagacuacuggacuucuauca

SEQ ID NO: 680492 - RNA, 14 nt, Homo sapiens
aagacuccaucuca

SEQ ID NO: 680493 - RNA, 15 nt, Homo sapiens
aagacuccaucucaa

SEQ ID NO: 680494 - RNA, 21 nt, Homo sapiens
aagacuccucugggccugggg

SEQ ID NO: 680495 - RNA, 21 nt, Homo sapiens
aagacucgggauuaguacaca

SEQ ID NO: 680496 - RNA, 22 nt, Homo sapiens
aagacucuacccauauuacaga

SEQ ID NO: 680497 - RNA, 11 nt, Homo sapiens
aagacucugag

SEQ ID NO: 680498 - RNA, 12 nt, Homo sapiens
aagacucugagc

SEQ ID NO: 680499 - RNA, 17 nt, Homo sapiens
aagacucugagccaagg

SEQ ID NO: 680500 - RNA, 22 nt, Homo sapiens
aagacugaauguuuuauuuauc

SEQ ID NO: 680501 - RNA, 21 nt, Homo sapiens
aagacugaguacguugugcau

SEQ ID NO: 680502 - RNA, 21 nt, Homo sapiens
aagacugggcuagggagaaug

SEQ ID NO: 680503 - RNA, 17 nt, Homo sapiens
aagacugugcugagaag

SEQ ID NO: 680504 - RNA, 22 nt, Homo sapiens
aagacuguggcugcuagcacuu

SEQ ID NO: 680505 - RNA, 23 nt, Homo sapiens
aagacuuaagcccagugcacuga

SEQ ID NO: 680506 - RNA, 21 nt, Homo sapiens
aagacuuggguugaucucuua

SEQ ID NO: 680507 - RNA, 16 nt, Homo sapiens
aagacuuuauguaguu

SEQ ID NO: 680508 - RNA, 23 nt, Homo sapiens
aagacuuugauccaggugccaag

SEQ ID NO: 680509 - RNA, 16 nt, Homo sapiens
aagacuuuguccccac

SEQ ID NO: 680510 - RNA, 15 nt, Homo sapiens
aagagaaaagcccaa

SEQ ID NO: 680511 - RNA, 14 nt, Homo sapiens
aagagaaacuucaa

SEQ ID NO: 680512 - RNA, 16 nt, Homo sapiens
aagagaaccauaucaa

SEQ ID NO: 680513 - RNA, 16 nt, Homo sapiens
aagagaaccgagcaaa

SEQ ID NO: 680514 - RNA, 15 nt, Homo sapiens
aagagaacuaaagcu

SEQ ID NO: 680515 - RNA, 23 nt, Homo sapiens
aagagaagauggccaugcccucc

SEQ ID NO: 680516 - RNA, 13 nt, Homo sapiens
aagagaagcauca

SEQ ID NO: 680517 - RNA, 22 nt, Homo sapiens
aagagaauauuagcuuuacugu

SEQ ID NO: 680518 - RNA, 21 nt, Homo sapiens
aagagaaugaaauugcugaaa

SEQ ID NO: 680519 - RNA, 13 nt, Homo sapiens
aagagacacucca

SEQ ID NO: 680520 - RNA, 18 nt, Homo sapiens
aagagaccaagacucuga

SEQ ID NO: 680521 - RNA, 18 nt, Homo sapiens
aagagaccacccauauca

SEQ ID NO: 680522 - RNA, 20 nt, Homo sapiens
aagagaccacccauaucaug

SEQ ID NO: 680523 - RNA, 12 nt, Homo sapiens
aagagacugauc

SEQ ID NO: 680524 - RNA, 14 nt, Homo sapiens
aagagacugggaag

SEQ ID NO: 680525 - RNA, 23 nt, Homo sapiens
aagagaucacaauacucaaaaga

SEQ ID NO: 680526 - RNA, 16 nt, Homo sapiens
aagagaucacccacuc

SEQ ID NO: 680527 - RNA, 19 nt, Homo sapiens
aagagaucuuucuuuccaa

SEQ ID NO: 680528 - RNA, 18 nt, Homo sapiens
aagagauuguuguuugcc

SEQ ID NO: 680529 - RNA, 21 nt, Homo sapiens
aagagauuucccuucauuuaa

SEQ ID NO: 680530 - RNA, 15 nt, Homo sapiens
aagagccuccuucag

SEQ ID NO: 680531 - RNA, 20 nt, Homo sapiens
aagagccuucacugguucug

SEQ ID NO: 680532 - RNA, 19 nt, Homo sapiens
aagagcgaaacuccaucuc

SEQ ID NO: 680533 - RNA, 21 nt, Homo sapiens
aagagcgcuccucugccuugg

SEQ ID NO: 680534 - RNA, 18 nt, Homo sapiens
aagagcguagacaggugu

SEQ ID NO: 680535 - RNA, 13 nt, Homo sapiens
aagagcuaauaaa

SEQ ID NO: 680536 - RNA, 19 nt, Homo sapiens
aagagcuggcaaagguggc

SEQ ID NO: 680537 - RNA, 16 nt, Homo sapiens
aagagcuuaacagugu

SEQ ID NO: 680538 - RNA, 16 nt, Homo sapiens
aagagcuuuaucccua

SEQ ID NO: 680539 - RNA, 18 nt, Homo sapiens
aagagcuuuccuucucca

SEQ ID NO: 680540 - RNA, 14 nt, Homo sapiens
aagaggaaagggag

SEQ ID NO: 680541 - RNA, 14 nt, Homo sapiens
aagaggaacagcac

SEQ ID NO: 680542 - RNA, 12 nt, Homo sapiens
aagaggacacaa

SEQ ID NO: 680543 - RNA, 13 nt, Homo sapiens
aagaggagcugcu

SEQ ID NO: 680544 - RNA, 20 nt, Homo sapiens
aagaggaucuccuguccauc

SEQ ID NO: 680545 - RNA, 21 nt, Homo sapiens
aagaggccaaaggaaugucca

SEQ ID NO: 680546 - RNA, 17 nt, Homo sapiens
aagagggaacuuagcag

SEQ ID NO: 680547 - RNA, 17 nt, Homo sapiens
aagagggggaccugcca

SEQ ID NO: 680548 - RNA, 20 nt, Homo sapiens
aagagggugauugcuggggc

SEQ ID NO: 680549 - RNA, 22 nt, Homo sapiens
aagaguauuuuuaacacuuaaa

SEQ ID NO: 680550 - RNA, 23 nt, Homo sapiens
aagaguauuuuuaacacuuaaau

SEQ ID NO: 680551 - RNA, 18 nt, Homo sapiens
aagagucauauugcccag

SEQ ID NO: 680552 - RNA, 19 nt, Homo sapiens
aagaguccagguaaauggu

SEQ ID NO: 680553 - RNA, 18 nt, Homo sapiens
aagaguccucugaaugaa

SEQ ID NO: 680554 - RNA, 21 nt, Homo sapiens
aagagugagacuccaccucaa

SEQ ID NO: 680555 - RNA, 18 nt, Homo sapiens
aagagugauugcagcuuu

SEQ ID NO: 680556 - RNA, 15 nt, Homo sapiens
aagaguggacugaau

SEQ ID NO: 680557 - RNA, 21 nt, Homo sapiens
aagagugggggagagcaggcu

SEQ ID NO: 680558 - RNA, 14 nt, Homo sapiens
aagaguuacuuaau

SEQ ID NO: 680559 - RNA, 19 nt, Homo sapiens
aagaguuucacaaauccuu

SEQ ID NO: 680560 - RNA, 19 nt, Homo sapiens
aagaguuucuccuuuugac

SEQ ID NO: 680561 - RNA, 14 nt, Homo sapiens
aagaguuuguuacc

SEQ ID NO: 680562 - RNA, 16 nt, Homo sapiens
aagauaaacacaaaau

SEQ ID NO: 680563 - RNA, 19 nt, Homo sapiens
aagauaaagacuguggaaa

SEQ ID NO: 680564 - RNA, 19 nt, Homo sapiens
aagauaaaugugcugaaug

SEQ ID NO: 680565 - RNA, 15 nt, Homo sapiens
aagauaacugagaau

SEQ ID NO: 680566 - RNA, 20 nt, Homo sapiens
aagauaauuuguugggccau

SEQ ID NO: 680567 - RNA, 12 nt, Homo sapiens
aagauacagugu

SEQ ID NO: 680568 - RNA, 18 nt, Homo sapiens
aagauaccggugcuucug

SEQ ID NO: 680569 - RNA, 13 nt, Homo sapiens
aagauacuccaua

SEQ ID NO: 680570 - RNA, 16 nt, Homo sapiens
aagauauaacauucag

SEQ ID NO: 680571 - RNA, 19 nt, Homo sapiens
aagauauauuucacuuuug

SEQ ID NO: 680572 - RNA, 18 nt, Homo sapiens
aagauaucuugaaaugaa

SEQ ID NO: 680573 - RNA, 20 nt, Homo sapiens
aagauauuugaauauguauc

SEQ ID NO: 680574 - RNA, 14 nt, Homo sapiens
aagaucaacauucc

SEQ ID NO: 680575 - RNA, 19 nt, Homo sapiens
aagaucaacgccucacuga

SEQ ID NO: 680576 - RNA, 15 nt, Homo sapiens
aagaucaagccaguu

SEQ ID NO: 680577 - RNA, 22 nt, Homo sapiens
aagaucaaggaguacaaugccc

SEQ ID NO: 680578 - RNA, 20 nt, Homo sapiens
aagauccaagaggcccugca

SEQ ID NO: 680579 - RNA, 13 nt, Homo sapiens
aagauccacccuc

SEQ ID NO: 680580 - RNA, 15 nt, Homo sapiens
aagauccacccucaa

SEQ ID NO: 680581 - RNA, 22 nt, Homo sapiens
aagauccccucuccugcccaag

SEQ ID NO: 680582 - RNA, 19 nt, Homo sapiens
aagauccuccugaccucaa

SEQ ID NO: 680583 - RNA, 17 nt, Homo sapiens
aagauccuucgggugcu

SEQ ID NO: 680584 - RNA, 14 nt, Homo sapiens
aagaucgcaccauu

SEQ ID NO: 680585 - RNA, 18 nt, Homo sapiens
aagaucucgguuugccaa

SEQ ID NO: 680586 - RNA, 23 nt, Homo sapiens
aagaucucuugcuagauuuugcu

SEQ ID NO: 680587 - RNA, 19 nt, Homo sapiens
aagaucuugaauagucuca

SEQ ID NO: 680588 - RNA, 17 nt, Homo sapiens
aagaugaagacaacagc

SEQ ID NO: 680589 - RNA, 21 nt, Homo sapiens
aagaugaagcugagcuuuuga

SEQ ID NO: 680590 - RNA, 14 nt, Homo sapiens
aagaugaaguuuua

SEQ ID NO: 680591 - RNA, 20 nt, Homo sapiens
aagaugagcuuugucuacuu

SEQ ID NO: 680592 - RNA, 14 nt, Homo sapiens
aagaugauugacuc

SEQ ID NO: 680593 - RNA, 19 nt, Homo sapiens
aagaugccuuaauccauuc

SEQ ID NO: 680594 - RNA, 20 nt, Homo sapiens
aagaugcuucucacugccau

SEQ ID NO: 680595 - RNA, 21 nt, Homo sapiens
aagauggcauaaccugucuca

SEQ ID NO: 680596 - RNA, 19 nt, Homo sapiens
aagauggcauccugugaag

SEQ ID NO: 680597 - RNA, 15 nt, Homo sapiens
aagauggccaugccc

SEQ ID NO: 680598 - RNA, 20 nt, Homo sapiens
aagauggccuuugcuuauga

SEQ ID NO: 680599 - RNA, 20 nt, Homo sapiens
aagauggcgaccaccaaagu

SEQ ID NO: 680600 - RNA, 21 nt, Homo sapiens
aagauggcugugccucugccu

SEQ ID NO: 680601 - RNA, 12 nt, Homo sapiens
aagaugucuccu

SEQ ID NO: 680602 - RNA, 15 nt, Homo sapiens
aagaugugucuucaa

SEQ ID NO: 680603 - RNA, 20 nt, Homo sapiens
aagauguuaguaguuucuca

SEQ ID NO: 680604 - RNA, 16 nt, Homo sapiens
aagauguuguuuuagg

SEQ ID NO: 680605 - RNA, 16 nt, Homo sapiens
aagauuagaagcugaa

SEQ ID NO: 680606 - RNA, 20 nt, Homo sapiens
aagauuauagaaguagcaaa

SEQ ID NO: 680607 - RNA, 20 nt, Homo sapiens
aagauuauuuacugacauau

SEQ ID NO: 680608 - RNA, 19 nt, Homo sapiens
aagauucacaccugacucu

SEQ ID NO: 680609 - RNA, 20 nt, Homo sapiens
aagauuccaaaaagcacaua

SEQ ID NO: 680610 - RNA, 13 nt, Homo sapiens
aaggagauuuaca

SEQ ID NO: 680611 - RNA, 23 nt, Homo sapiens
aaggagcaaaacgccucuuuucc

SEQ ID NO: 680612 - RNA, 20 nt, Homo sapiens
aaggagcaucagccagugaa

SEQ ID NO: 680613 - RNA, 16 nt, Homo sapiens
aaggagccccauuccu

SEQ ID NO: 680614 - RNA, 23 nt, Homo sapiens
aaggagcucacuguggugucugu

SEQ ID NO: 680615 - RNA, 15 nt, Homo sapiens
aaggagcugauacuu

SEQ ID NO: 680616 - RNA, 21 nt, Homo sapiens
aaggaggacgguuaacuugua

SEQ ID NO: 680617 - RNA, 18 nt, Homo sapiens
aaggaguaaucuguguac

SEQ ID NO: 680618 - RNA, 22 nt, Homo sapiens
aaggaguauaguaaaugccuca

SEQ ID NO: 680619 - RNA, 16 nt, Homo sapiens
aaggagucacugagac

SEQ ID NO: 680620 - RNA, 17 nt, Homo sapiens
aaggagucccugguuca

SEQ ID NO: 680621 - RNA, 18 nt, Homo sapiens
aaggagugcccgccuuga

SEQ ID NO: 680622 - RNA, 23 nt, Homo sapiens
aaggauacuguaacacuuuacaa

SEQ ID NO: 680623 - RNA, 14 nt, Homo sapiens
aaggauacuuuaca

SEQ ID NO: 680624 - RNA, 14 nt, Homo sapiens
aaggauagaagcug

SEQ ID NO: 680625 - RNA, 14 nt, Homo sapiens
aaggauagacauac

SEQ ID NO: 680626 - RNA, 19 nt, Homo sapiens
aaggauagcaccgcuuuug

SEQ ID NO: 680627 - RNA, 23 nt, Homo sapiens
aaggauauguggagaaucaucaa

SEQ ID NO: 680628 - RNA, 15 nt, Homo sapiens
aaggauauuuacaga

SEQ ID NO: 680629 - RNA, 18 nt, Homo sapiens
aaggauauuuacuacuuu

SEQ ID NO: 680630 - RNA, 17 nt, Homo sapiens
aaggauccucuccacuc

SEQ ID NO: 680631 - RNA, 20 nt, Homo sapiens
aaggaucucuauaacagauc

SEQ ID NO: 680632 - RNA, 22 nt, Homo sapiens
aaggaucuugccugcaugaaac

SEQ ID NO: 680633 - RNA, 21 nt, Homo sapiens
aaggauuauuacuaauucuau

SEQ ID NO: 680634 - RNA, 19 nt, Homo sapiens
aaggauugggagcauggga

SEQ ID NO: 680635 - RNA, 23 nt, Homo sapiens
aaggcaaaaaacucuuaaucugu

SEQ ID NO: 680636 - RNA, 12 nt, Homo sapiens
aaggcaaaaaga

SEQ ID NO: 680637 - RNA, 13 nt, Homo sapiens
aaggcaaaaagca

SEQ ID NO: 680638 - RNA, 16 nt, Homo sapiens
aaggcaaauauaagcu

SEQ ID NO: 680639 - RNA, 17 nt, Homo sapiens
aaggcaauccuaagcaa

SEQ ID NO: 680640 - RNA, 23 nt, Homo sapiens
aaggcaauuccugauggaaaaug

SEQ ID NO: 680641 - RNA, 14 nt, Homo sapiens
aaggcacacuguua

SEQ ID NO: 680642 - RNA, 12 nt, Homo sapiens
aaggcacaugcc

SEQ ID NO: 680643 - RNA, 22 nt, Homo sapiens
aaggcagaggaauuuggcugcu

SEQ ID NO: 680644 - RNA, 19 nt, Homo sapiens
aaggcagcugccucugcuc

SEQ ID NO: 680645 - RNA, 20 nt, Homo sapiens
aaggcaggaggaucacuuga

SEQ ID NO: 680646 - RNA, 22 nt, Homo sapiens
aaggcagucccgggagaaaaga

SEQ ID NO: 680647 - RNA, 14 nt, Homo sapiens
aaggcauaugcaca

SEQ ID NO: 680648 - RNA, 18 nt, Homo sapiens
aaggcauguggccuuuau

SEQ ID NO: 680649 - RNA, 17 nt, Homo sapiens
aaggcauuuauugccau

SEQ ID NO: 680650 - RNA, 18 nt, Homo sapiens
aaggcauuuauugccaua

SEQ ID NO: 680651 - RNA, 15 nt, Homo sapiens
aaggcauuucuauca

SEQ ID NO: 680652 - RNA, 17 nt, Homo sapiens
aaggcauuuuauaugaa

SEQ ID NO: 680653 - RNA, 21 nt, Homo sapiens
aaggccaagaaucaagcuaga

SEQ ID NO: 680654 - RNA, 19 nt, Homo sapiens
aaggccacaugucaccgug

SEQ ID NO: 680655 - RNA, 22 nt, Homo sapiens
aaggccagcgccagaacccaga

SEQ ID NO: 680656 - RNA, 18 nt, Homo sapiens
aaggcccauaucugugaa

SEQ ID NO: 680657 - RNA, 17 nt, Homo sapiens
aaggcccugcugaguca

SEQ ID NO: 680658 - RNA, 15 nt, Homo sapiens
aaggccuacuauaca

SEQ ID NO: 680659 - RNA, 21 nt, Homo sapiens
aaggccuccccaauccaggcc

SEQ ID NO: 680660 - RNA, 21 nt, Homo sapiens
aaggccugacuucugcuggca

SEQ ID NO: 680661 - RNA, 20 nt, Homo sapiens
aaggccuggcgucggccaga

SEQ ID NO: 680662 - RNA, 12 nt, Homo sapiens
aaggccuuccaa

SEQ ID NO: 680663 - RNA, 18 nt, Homo sapiens
aaggcggcuacaugccuc

SEQ ID NO: 680664 - RNA, 16 nt, Homo sapiens
aaggcucacaccucau

SEQ ID NO: 680665 - RNA, 22 nt, Homo sapiens
aaggcucccggaauuccgucac

SEQ ID NO: 680666 - RNA, 22 nt, Homo sapiens
aaggcucugaaauaaaaugcca

SEQ ID NO: 680667 - RNA, 15 nt, Homo sapiens
aaggcugacuucucu

SEQ ID NO: 680668 - RNA, 22 nt, Homo sapiens
aaggcugaugucuuaacuguca

SEQ ID NO: 680669 - RNA, 23 nt, Homo sapiens
aaggcugaugucuuaacugucac

SEQ ID NO: 680670 - RNA, 18 nt, Homo sapiens
aaggcugauuacugaaau

SEQ ID NO: 680671 - RNA, 19 nt, Homo sapiens
aaggcugcccacuggagac

SEQ ID NO: 680672 - RNA, 13 nt, Homo sapiens
aaggcugugagcc

SEQ ID NO: 680673 - RNA, 13 nt, Homo sapiens
aaggcuguugcau

SEQ ID NO: 680674 - RNA, 20 nt, Homo sapiens
aaggcuucucuccacagugu

SEQ ID NO: 680675 - RNA, 17 nt, Homo sapiens
aaggcuuuaucucaggg

SEQ ID NO: 680676 - RNA, 15 nt, Homo sapiens
aagggaaaacccuca

SEQ ID NO: 680677 - RNA, 13 nt, Homo sapiens
aagggaaacuauu

SEQ ID NO: 680678 - RNA, 22 nt, Homo sapiens
aagggaacuugagcgugaaucu

SEQ ID NO: 680679 - RNA, 20 nt, Homo sapiens
aagggaauucggugugcacc

SEQ ID NO: 680680 - RNA, 15 nt, Homo sapiens
aagggaauugcucag

SEQ ID NO: 680681 - RNA, 16 nt, Homo sapiens
aagggacaaguauuaa

SEQ ID NO: 680682 - RNA, 18 nt, Homo sapiens
aagggaccaagcgaccaa

SEQ ID NO: 680683 - RNA, 13 nt, Homo sapiens
aagggaccugcuc

SEQ ID NO: 680684 - RNA, 12 nt, Homo sapiens
aagggacuccca

SEQ ID NO: 680685 - RNA, 13 nt, Homo sapiens
aagggacugagag

SEQ ID NO: 680686 - RNA, 19 nt, Homo sapiens
aagggagcgcucucuugau

SEQ ID NO: 680687 - RNA, 20 nt, Homo sapiens
aagggaguggccucauuuca

SEQ ID NO: 680688 - RNA, 21 nt, Homo sapiens
aagggauaauagacacaucaa

SEQ ID NO: 680689 - RNA, 16 nt, Homo sapiens
aagggauaguccaaag

SEQ ID NO: 680690 - RNA, 18 nt, Homo sapiens
aagggauccguacauuca

SEQ ID NO: 680691 - RNA, 18 nt, Homo sapiens
aagggaugucucacaucc

SEQ ID NO: 680692 - RNA, 20 nt, Homo sapiens
aagggauuguuguguaguca

SEQ ID NO: 680693 - RNA, 21 nt, Homo sapiens
aagggcacgugaagucauuga

SEQ ID NO: 680694 - RNA, 14 nt, Homo sapiens
aagggcagcuguga

SEQ ID NO: 680695 - RNA, 15 nt, Homo sapiens
aagggcagcugugau

SEQ ID NO: 680696 - RNA, 13 nt, Homo sapiens
aagggccaaagaa

SEQ ID NO: 680697 - RNA, 9 nt, Homo sapiens
aagggccag

SEQ ID NO: 680698 - RNA, 16 nt, Homo sapiens
aagggcuugaggugaa

SEQ ID NO: 680699 - RNA, 16 nt, Homo sapiens
aaggggauauuuacug

SEQ ID NO: 680700 - RNA, 23 nt, Homo sapiens
aaggggauuuuuaugucuggggc

SEQ ID NO: 680701 - RNA, 23 nt, Homo sapiens
aaggggccucaccgagugggggc

SEQ ID NO: 680702 - RNA, 15 nt, Homo sapiens
aaggggcucuucauc

SEQ ID NO: 680703 - RNA, 12 nt, Homo sapiens
aagggggugaca

SEQ ID NO: 680704 - RNA, 23 nt, Homo sapiens
aagggggugcaaagacucugagc

SEQ ID NO: 680705 - RNA, 17 nt, Homo sapiens
aagggguuggggugaca

SEQ ID NO: 680706 - RNA, 18 nt, Homo sapiens
aaggguacagaugugcug

SEQ ID NO: 680707 - RNA, 21 nt, Homo sapiens
aaggguaggcacgaagcaauu

SEQ ID NO: 680708 - RNA, 19 nt, Homo sapiens
aaggguccguggaccagga

SEQ ID NO: 680709 - RNA, 14 nt, Homo sapiens
aagggucuugacuc

SEQ ID NO: 680710 - RNA, 22 nt, Homo sapiens
aagggugaggcugacacagcca

SEQ ID NO: 680711 - RNA, 13 nt, Homo sapiens
aaggguggaaauc

SEQ ID NO: 680712 - RNA, 21 nt, Homo sapiens
aaggguuauagacugccaugc

SEQ ID NO: 680713 - RNA, 21 nt, Homo sapiens
aaggguucugcccugccugag

SEQ ID NO: 680714 - RNA, 14 nt, Homo sapiens
aaggguugugagcc

SEQ ID NO: 680715 - RNA, 16 nt, Homo sapiens
aaggguuucucuauua

SEQ ID NO: 680716 - RNA, 16 nt, Homo sapiens
aagguacugaagcuuu

SEQ ID NO: 680717 - RNA, 15 nt, Homo sapiens
aagguacuuaaagcu

SEQ ID NO: 680718 - RNA, 15 nt, Homo sapiens
aagguagacuacuuu

SEQ ID NO: 680719 - RNA, 22 nt, Homo sapiens
aagguagagucuuacaaucaaa

SEQ ID NO: 680720 - RNA, 17 nt, Homo sapiens
aagguagccaucccaug

SEQ ID NO: 680721 - RNA, 19 nt, Homo sapiens
aagguaucaguuauaugau

SEQ ID NO: 680722 - RNA, 13 nt, Homo sapiens
aagguaugguggg

SEQ ID NO: 680723 - RNA, 19 nt, Homo sapiens
aaggucaauuucaguguau

SEQ ID NO: 680724 - RNA, 18 nt, Homo sapiens
aaggucacauugugccuu

SEQ ID NO: 680725 - RNA, 21 nt, Homo sapiens
aaggucaugccacugcacucu

SEQ ID NO: 680726 - RNA, 12 nt, Homo sapiens
aagguccacucc

SEQ ID NO: 680727 - RNA, 16 nt, Homo sapiens
aaggucccuuguuucc

SEQ ID NO: 680728 - RNA, 17 nt, Homo sapiens
aaggucgagacauuccu

SEQ ID NO: 680729 - RNA, 15 nt, Homo sapiens
aaggucucugaacuc

SEQ ID NO: 680730 - RNA, 20 nt, Homo sapiens
aaugcauuccagaacaaauu

SEQ ID NO: 680731 - RNA, 16 nt, Homo sapiens
aaugcauugcuaaaau

SEQ ID NO: 680732 - RNA, 14 nt, Homo sapiens
aaugcauugucaau

SEQ ID NO: 680733 - RNA, 15 nt, Homo sapiens
aaugcauugucaaua

SEQ ID NO: 680734 - RNA, 12 nt, Homo sapiens
aaugccaaaaaa

SEQ ID NO: 680735 - RNA, 18 nt, Homo sapiens
aaugccaaacacuagcuc

SEQ ID NO: 680736 - RNA, 21 nt, Homo sapiens
aaugccaagggggugacugga

SEQ ID NO: 680737 - RNA, 20 nt, Homo sapiens
aaugccaaucuucaguauuu

SEQ ID NO: 680738 - RNA, 17 nt, Homo sapiens
aaugccacaaaacugac

SEQ ID NO: 680739 - RNA, 15 nt, Homo sapiens
aaugccagaaacagu

SEQ ID NO: 680740 - RNA, 21 nt, Homo sapiens
aaugcccucaggggacuugaa

SEQ ID NO: 680741 - RNA, 16 nt, Homo sapiens
aaugcccuucacuguc

SEQ ID NO: 680742 - RNA, 21 nt, Homo sapiens
aaugccuaaauauaauuaucc

SEQ ID NO: 680743 - RNA, 14 nt, Homo sapiens
aaugccuacugagu

SEQ ID NO: 680744 - RNA, 15 nt, Homo sapiens
aaugccuacugagua

SEQ ID NO: 680745 - RNA, 18 nt, Homo sapiens
aaugccuauaaaaugccc

SEQ ID NO: 680746 - RNA, 22 nt, Homo sapiens
aaugccuggaggguaacugggg

SEQ ID NO: 680747 - RNA, 18 nt, Homo sapiens
aaugccugugaagcaguc

SEQ ID NO: 680748 - RNA, 13 nt, Homo sapiens
aaugcuacugucu

SEQ ID NO: 680749 - RNA, 19 nt, Homo sapiens
aaugcuacugucucacuga

SEQ ID NO: 680750 - RNA, 23 nt, Homo sapiens
aaugcuagacagaaaccaagcca

SEQ ID NO: 680751 - RNA, 15 nt, Homo sapiens
aaugcucaaaaccuc

SEQ ID NO: 680752 - RNA, 10 nt, Homo sapiens
aaugcucacc

SEQ ID NO: 680753 - RNA, 15 nt, Homo sapiens
aaugcucaccuuuau

SEQ ID NO: 680754 - RNA, 22 nt, Homo sapiens
aaugcuccauuaauccagggaa

SEQ ID NO: 680755 - RNA, 12 nt, Homo sapiens
aaugcuccccac

SEQ ID NO: 680756 - RNA, 17 nt, Homo sapiens
aaugcugaacauugcau

SEQ ID NO: 680757 - RNA, 12 nt, Homo sapiens
aaugcugagaag

SEQ ID NO: 680758 - RNA, 18 nt, Homo sapiens
aaugcugggacucagccu

SEQ ID NO: 680759 - RNA, 13 nt, Homo sapiens
aaugcuucaauca

SEQ ID NO: 680760 - RNA, 17 nt, Homo sapiens
aaugcuucauuauucaa

SEQ ID NO: 680761 - RNA, 18 nt, Homo sapiens
aaugcuuuggacuuuuga

SEQ ID NO: 680762 - RNA, 17 nt, Homo sapiens
aauggaaaguaacucau

SEQ ID NO: 680763 - RNA, 14 nt, Homo sapiens
aauggaagcaaaga

SEQ ID NO: 680764 - RNA, 13 nt, Homo sapiens
aauggaaguccau

SEQ ID NO: 680765 - RNA, 15 nt, Homo sapiens
aauggaauacugaaa

SEQ ID NO: 680766 - RNA, 17 nt, Homo sapiens
aauggaggccauugugu

SEQ ID NO: 680767 - RNA, 19 nt, Homo sapiens
aauggaggggcagagccag

SEQ ID NO: 680768 - RNA, 15 nt, Homo sapiens
aauggagucauuuga

SEQ ID NO: 680769 - RNA, 12 nt, Homo sapiens
aauggaucacaa

SEQ ID NO: 680770 - RNA, 20 nt, Homo sapiens
aauggaucacugauauuuua

SEQ ID NO: 680771 - RNA, 21 nt, Homo sapiens
aauggauuugaugcuguuuga

SEQ ID NO: 680772 - RNA, 19 nt, Homo sapiens
aauggcaccucugcccuuc

SEQ ID NO: 680773 - RNA, 19 nt, Homo sapiens
aauggcagcaggaucugga

SEQ ID NO: 680774 - RNA, 18 nt, Homo sapiens
aauggcagcauacacaga

SEQ ID NO: 680775 - RNA, 20 nt, Homo sapiens
aauggcaggugucauaugac

SEQ ID NO: 680776 - RNA, 18 nt, Homo sapiens
aauggcaguuugaaguca

SEQ ID NO: 680777 - RNA, 18 nt, Homo sapiens
aauggcccaguccucucc

SEQ ID NO: 680778 - RNA, 16 nt, Homo sapiens
aauggccggcuggaaa

SEQ ID NO: 680779 - RNA, 20 nt, Homo sapiens
aauggcgcgaucucagcuca

SEQ ID NO: 680780 - RNA, 17 nt, Homo sapiens
aauggcuaacugaugaa

SEQ ID NO: 680781 - RNA, 12 nt, Homo sapiens
aauggcuauuaa

SEQ ID NO: 680782 - RNA, 15 nt, Homo sapiens
aaugggaaaucagug

SEQ ID NO: 680783 - RNA, 17 nt, Homo sapiens
aaugggaagaccaaaau

SEQ ID NO: 680784 - RNA, 11 nt, Homo sapiens
aaugggagaaa

SEQ ID NO: 680785 - RNA, 21 nt, Homo sapiens
aauggguuuuguguacuguaa

SEQ ID NO: 680786 - RNA, 16 nt, Homo sapiens
aaugguaauuguugcu

SEQ ID NO: 680787 - RNA, 16 nt, Homo sapiens
aaugguacucuaauca

SEQ ID NO: 680788 - RNA, 20 nt, Homo sapiens
aauggucaguauuaucuaaa

SEQ ID NO: 680789 - RNA, 12 nt, Homo sapiens
aauggucaucca

SEQ ID NO: 680790 - RNA, 15 nt, Homo sapiens
aauggucauccaaac

SEQ ID NO: 680791 - RNA, 16 nt, Homo sapiens
aauggucauuuccaga

SEQ ID NO: 680792 - RNA, 18 nt, Homo sapiens
aauggugauauccucuca

SEQ ID NO: 680793 - RNA, 20 nt, Homo sapiens
aauggugauuuaaaaacuug

SEQ ID NO: 680794 - RNA, 12 nt, Homo sapiens
aauggugcaaaa

SEQ ID NO: 680795 - RNA, 19 nt, Homo sapiens
aaugguggaguguagccuc

SEQ ID NO: 680796 - RNA, 17 nt, Homo sapiens
aauggugguggaagggu

SEQ ID NO: 680797 - RNA, 18 nt, Homo sapiens
aaugguguuguaugccuu

SEQ ID NO: 680798 - RNA, 23 nt, Homo sapiens
aaugguuaaauuuuacaugacag

SEQ ID NO: 680799 - RNA, 16 nt, Homo sapiens
aaugguuccauucucu

SEQ ID NO: 680800 - RNA, 17 nt, Homo sapiens
aaugguugaugauacuu

SEQ ID NO: 680801 - RNA, 18 nt, Homo sapiens
aaugguugggacaauggc

SEQ ID NO: 680802 - RNA, 15 nt, Homo sapiens
aaugguuuugaauag

SEQ ID NO: 680803 - RNA, 21 nt, Homo sapiens
aaugguuuugaauagaucuuu

SEQ ID NO: 680804 - RNA, 15 nt, Homo sapiens
aauguaaacugccau

SEQ ID NO: 680805 - RNA, 20 nt, Homo sapiens
aauguaaaguaagacaucuc

SEQ ID NO: 680806 - RNA, 15 nt, Homo sapiens
aauguaacugugcca

SEQ ID NO: 680807 - RNA, 17 nt, Homo sapiens
aauguaacugugccagu

SEQ ID NO: 680808 - RNA, 10 nt, Homo sapiens
aauguacaaa

SEQ ID NO: 680809 - RNA, 16 nt, Homo sapiens
aauguacaacugcacc

SEQ ID NO: 680810 - RNA, 16 nt, Homo sapiens
aauguacaauaaagca

SEQ ID NO: 680811 - RNA, 18 nt, Homo sapiens
aauguacaauaaagcaau

SEQ ID NO: 680812 - RNA, 19 nt, Homo sapiens
aauguacaauaaagcaaug

SEQ ID NO: 680813 - RNA, 20 nt, Homo sapiens
aauguacaauaaagcaaugu

SEQ ID NO: 680814 - RNA, 22 nt, Homo sapiens
uuguugaccucaacaauggcaa

SEQ ID NO: 680815 - RNA, 13 nt, Homo sapiens
uuguugacuguga

SEQ ID NO: 680816 - RNA, 15 nt, Homo sapiens
uuguugagaguguga

SEQ ID NO: 680817 - RNA, 21 nt, Homo sapiens
uuguugagugcacugacugug

SEQ ID NO: 680818 - RNA, 22 nt, Homo sapiens
uuguugcaggcuguaaggcaug

SEQ ID NO: 680819 - RNA, 20 nt, Homo sapiens
uuguugcuuaucuuuuccaa

SEQ ID NO: 680820 - RNA, 15 nt, Homo sapiens
uuguuggaugaaauu

SEQ ID NO: 680821 - RNA, 14 nt, Homo sapiens
uuguuggucagagg

SEQ ID NO: 680822 - RNA, 13 nt, Homo sapiens
uuguugugcuauu

SEQ ID NO: 680823 - RNA, 13 nt, Homo sapiens
uuguuguuauuaa

SEQ ID NO: 680824 - RNA, 18 nt, Homo sapiens
uuguuuaaacaaucuuuc

SEQ ID NO: 680825 - RNA, 13 nt, Homo sapiens
uuguuuacauaag

SEQ ID NO: 680826 - RNA, 22 nt, Homo sapiens
uuguuuaccucuuugucccaga

SEQ ID NO: 680827 - RNA, 19 nt, Homo sapiens
uuguuucaaccaagucaug

SEQ ID NO: 680828 - RNA, 13 nt, Homo sapiens
uuguuucacucca

SEQ ID NO: 680829 - RNA, 18 nt, Homo sapiens
uuccuuaauccagcugau

SEQ ID NO: 680830 - RNA, 17 nt, Homo sapiens
uuccuuacuugcacugu

SEQ ID NO: 680831 - RNA, 22 nt, Homo sapiens
uuccuuagcuuagaccucagcc

SEQ ID NO: 680832 - RNA, 13 nt, Homo sapiens
uuccuuagucuca

SEQ ID NO: 680833 - RNA, 15 nt, Homo sapiens
uuccuuagucucaag

SEQ ID NO: 680834 - RNA, 12 nt, Homo sapiens
uuccuucaaugu

SEQ ID NO: 680835 - RNA, 18 nt, Homo sapiens
uuccuucaaugugcauaa

SEQ ID NO: 680836 - RNA, 20 nt, Homo sapiens
uuccuucagacagauuccag

SEQ ID NO: 680837 - RNA, 21 nt, Homo sapiens
uuccuucaugaucaucacaau

SEQ ID NO: 680838 - RNA, 22 nt, Homo sapiens
uuccuuccaaggucacucuugg

SEQ ID NO: 680839 - RNA, 17 nt, Homo sapiens
uuccuuccacaguuauc

SEQ ID NO: 680840 - RNA, 19 nt, Homo sapiens
uuccuugacuucuuugaga

SEQ ID NO: 680841 - RNA, 11 nt, Homo sapiens
uuccuugagaa

SEQ ID NO: 680842 - RNA, 17 nt, Homo sapiens
uuccuugaucuguauau

SEQ ID NO: 680843 - RNA, 20 nt, Homo sapiens
uuccuugcaggagugacuca

SEQ ID NO: 680844 - RNA, 24 nt, Homo sapiens
uuccuuuauagagugucucagggu

SEQ ID NO: 680845 - RNA, 22 nt, Homo sapiens
uuccuuuauuuugcugcuugau

SEQ ID NO: 680846 - RNA, 14 nt, Homo sapiens
uuccuuucuugucu

SEQ ID NO: 680847 - RNA, 11 nt, Homo sapiens
uuccuuugaac

SEQ ID NO: 680848 - RNA, 18 nt, Homo sapiens
uuccuuuguguguacuca

SEQ ID NO: 680849 - RNA, 21 nt, Homo sapiens
uuccuuuuaaaacacuuccau

SEQ ID NO: 680850 - RNA, 19 nt, Homo sapiens
uuccuuuuggaacauuucu

SEQ ID NO: 680851 - RNA, 14 nt, Homo sapiens
uuccuuuuguaaaa

SEQ ID NO: 680852 - RNA, 19 nt, Homo sapiens
uuccuuuuugacacugaaa

SEQ ID NO: 680853 - RNA, 13 nt, Homo sapiens
uucgaaaggccuu

SEQ ID NO: 680854 - RNA, 15 nt, Homo sapiens
uucgaagccuugccu

SEQ ID NO: 680855 - RNA, 15 nt, Homo sapiens
uucgaaugacacugu

SEQ ID NO: 680856 - RNA, 16 nt, Homo sapiens
uucgacugguccagcu

SEQ ID NO: 680857 - RNA, 20 nt, Homo sapiens
uucgagaccagccuggccaa

SEQ ID NO: 680858 - RNA, 15 nt, Homo sapiens
uucgagguggaucac

SEQ ID NO: 680859 - RNA, 16 nt, Homo sapiens
uucgauauuucaggaa

SEQ ID NO: 680860 - RNA, 21 nt, Homo sapiens
uucgcaccuaccaucagggac

SEQ ID NO: 680861 - RNA, 17 nt, Homo sapiens
uucgcacucaaugccaa

SEQ ID NO: 680862 - RNA, 13 nt, Homo sapiens
uucgcagcacaga

SEQ ID NO: 680863 - RNA, 19 nt, Homo sapiens
uucgcauggcagccaucaa

SEQ ID NO: 680864 - RNA, 17 nt, Homo sapiens
uucgcauuaagcacaca

SEQ ID NO: 680865 - RNA, 19 nt, Homo sapiens
uucgcuuaguaacuaguga

SEQ ID NO: 680866 - RNA, 23 nt, Homo sapiens
uucggcuccgggcaaauggcuga

SEQ ID NO: 680867 - RNA, 17 nt, Homo sapiens
uucgggauucuuugaca

SEQ ID NO: 680868 - RNA, 14 nt, Homo sapiens
uucgguuccagaca

SEQ ID NO: 680869 - RNA, 21 nt, Homo sapiens
uucgucggaggcaucauggaa

SEQ ID NO: 680870 - RNA, 14 nt, Homo sapiens
uucgugaugggcag

SEQ ID NO: 680871 - RNA, 16 nt, Homo sapiens
uucguuacaucuugua

SEQ ID NO: 680872 - RNA, 13 nt, Homo sapiens
uucuaaaacugcc

SEQ ID NO: 680873 - RNA, 23 nt, Homo sapiens
uucuaaagauggaaaaaccaccc

SEQ ID NO: 680874 - RNA, 23 nt, Homo sapiens
uucuaaauaaggaauuuccuccc

SEQ ID NO: 680875 - RNA, 23 nt, Homo sapiens
uucuaaaugaauguuuacacucu

SEQ ID NO: 680876 - RNA, 13 nt, Homo sapiens
uucuaacccugac

SEQ ID NO: 680877 - RNA, 16 nt, Homo sapiens
uucuaacgccagcaca

SEQ ID NO: 680878 - RNA, 20 nt, Homo sapiens
uucuaagagguagauaccag

SEQ ID NO: 680879 - RNA, 21 nt, Homo sapiens
uucuaaguggaaaaaguauua

SEQ ID NO: 680880 - RNA, 16 nt, Homo sapiens
uucuaaguuagacucu

SEQ ID NO: 680881 - RNA, 20 nt, Homo sapiens
uucuaauaaauauacuauga

SEQ ID NO: 680882 - RNA, 16 nt, Homo sapiens
uucuaaugugcauuaa

SEQ ID NO: 680883 - RNA, 15 nt, Homo sapiens
uucuaauuaaccuua

SEQ ID NO: 680884 - RNA, 17 nt, Homo sapiens
uucuaauuuuuaagcaa

SEQ ID NO: 680885 - RNA, 21 nt, Homo sapiens
uucuaauuuuucagcuccuuc

SEQ ID NO: 680886 - RNA, 23 nt, Homo sapiens
uucuacacagagcaggacugcac

SEQ ID NO: 680887 - RNA, 13 nt, Homo sapiens
uucuacacaguaa

SEQ ID NO: 680888 - RNA, 22 nt, Homo sapiens
uucuacacaguaaaaacuugua

SEQ ID NO: 680889 - RNA, 17 nt, Homo sapiens
uucuacaucauuaacca

SEQ ID NO: 680890 - RNA, 14 nt, Homo sapiens
uucuacaugacugg

SEQ ID NO: 680891 - RNA, 18 nt, Homo sapiens
uucuacugacccaacugg

SEQ ID NO: 680892 - RNA, 19 nt, Homo sapiens
uucuacugucaaaugaugu

SEQ ID NO: 680893 - RNA, 21 nt, Homo sapiens
uucuacuucaaaaacauuuca

SEQ ID NO: 680894 - RNA, 15 nt, Homo sapiens
uucuagaaacaaaca

SEQ ID NO: 680895 - RNA, 18 nt, Homo sapiens
uucuagaacaccugccuu

SEQ ID NO: 680896 - RNA, 21 nt, Homo sapiens
uucuagaacaguaaaagccuu

SEQ ID NO: 680897 - RNA, 20 nt, Homo sapiens
uucuagacaguauugccacc

SEQ ID NO: 680898 - RNA, 16 nt, Homo sapiens
uucuagauuaccauga

SEQ ID NO: 680899 - RNA, 12 nt, Homo sapiens
uucuagccuuuu

SEQ ID NO: 680900 - RNA, 18 nt, Homo sapiens
uucuagcuuaucuacuuc

SEQ ID NO: 680901 - RNA, 15 nt, Homo sapiens
uucuaggcaucccag

SEQ ID NO: 680902 - RNA, 19 nt, Homo sapiens
uucuaggccaaaaauggug

SEQ ID NO: 680903 - RNA, 14 nt, Homo sapiens
uucuagucacuucc

SEQ ID NO: 680904 - RNA, 16 nt, Homo sapiens
uucuagucuuggccag

SEQ ID NO: 680905 - RNA, 14 nt, Homo sapiens
uucuagugcugcug

SEQ ID NO: 680906 - RNA, 20 nt, Homo sapiens
uucuagugcuuuucagugau

SEQ ID NO: 680907 - RNA, 21 nt, Homo sapiens
uucuagugcuuuucagugaua

SEQ ID NO: 680908 - RNA, 12 nt, Homo sapiens
uucuauaacaua

SEQ ID NO: 680909 - RNA, 15 nt, Homo sapiens
uucuauaaggccaua

SEQ ID NO: 680910 - RNA, 21 nt, Homo sapiens
uucuauauauauauaaauaua

SEQ ID NO: 680911 - RNA, 21 nt, Homo sapiens
uucuauaugaauuuaaauaua

SEQ ID NO: 680912 - RNA, 15 nt, Homo sapiens
uucuauauuuucaca

SEQ ID NO: 680913 - RNA, 13 nt, Homo sapiens
uucuaugagccca

SEQ ID NO: 680914 - RNA, 13 nt, Homo sapiens
uucuaugcauaaa

SEQ ID NO: 680915 - RNA, 16 nt, Homo sapiens
uucuauguccauucuc

SEQ ID NO: 680916 - RNA, 14 nt, Homo sapiens
uucuauuaacuuua

SEQ ID NO: 680917 - RNA, 15 nt, Homo sapiens
uucuauuauggaaaa

SEQ ID NO: 680918 - RNA, 18 nt, Homo sapiens
uucuauucuagccugcau

SEQ ID NO: 680919 - RNA, 15 nt, Homo sapiens
uucuauugcugagaa

SEQ ID NO: 680920 - RNA, 19 nt, Homo sapiens
uucuauuuaacaacugggu

SEQ ID NO: 680921 - RNA, 12 nt, Homo sapiens
uucuauuuacaa

SEQ ID NO: 680922 - RNA, 18 nt, Homo sapiens
uucuauuucacuaaucau

SEQ ID NO: 680923 - RNA, 21 nt, Homo sapiens
uucuauuuuauaaaacaaaua

SEQ ID NO: 680924 - RNA, 12 nt, Homo sapiens
uucuauuuuccc

SEQ ID NO: 680925 - RNA, 14 nt, Homo sapiens
uucucaaaauuccu

SEQ ID NO: 680926 - RNA, 21 nt, Homo sapiens
uucucaaaguuaauucaccua

SEQ ID NO: 680927 - RNA, 14 nt, Homo sapiens
uucucaagucccuu

SEQ ID NO: 680928 - RNA, 20 nt, Homo sapiens
uucucaaucagugcagugau

SEQ ID NO: 680929 - RNA, 19 nt, Homo sapiens
uucucacaaaaaggcaaau

SEQ ID NO: 680930 - RNA, 15 nt, Homo sapiens
uucucaccacagagc

SEQ ID NO: 680931 - RNA, 16 nt, Homo sapiens
uucucaccauuugagu

SEQ ID NO: 680932 - RNA, 16 nt, Homo sapiens
uucucacccaggcaau

SEQ ID NO: 680933 - RNA, 18 nt, Homo sapiens
uucucacccuacucugga

SEQ ID NO: 680934 - RNA, 16 nt, Homo sapiens
uucucacuccaccacc

SEQ ID NO: 680935 - RNA, 22 nt, Homo sapiens
uucucagaccugcgcacuccau

SEQ ID NO: 680936 - RNA, 22 nt, Homo sapiens
uucucagauguugaaacuuuga

SEQ ID NO: 680937 - RNA, 16 nt, Homo sapiens
uucucagcucuuccau

SEQ ID NO: 680938 - RNA, 19 nt, Homo sapiens
uucucagguguugccaaau

SEQ ID NO: 680939 - RNA, 20 nt, Homo sapiens
uucucaguguagggcagaga

SEQ ID NO: 680940 - RNA, 23 nt, Homo sapiens
uucucauaauuccuacagcacua

SEQ ID NO: 680941 - RNA, 13 nt, Homo sapiens
uucucaucacuca

SEQ ID NO: 680942 - RNA, 17 nt, Homo sapiens
uucucaugggguggggu

SEQ ID NO: 680943 - RNA, 20 nt, Homo sapiens
uucucauuucuguagccuga

SEQ ID NO: 680944 - RNA, 17 nt, Homo sapiens
uucucauuuguucucac

SEQ ID NO: 680945 - RNA, 18 nt, Homo sapiens
uucucauuuuauugcuag

SEQ ID NO: 680946 - RNA, 13 nt, Homo sapiens
uucuccuacuuag

SEQ ID NO: 680947 - RNA, 20 nt, Homo sapiens
uucuccugccugugcuguga

SEQ ID NO: 680948 - RNA, 14 nt, Homo sapiens
uucuccugugaaug

SEQ ID NO: 680949 - RNA, 17 nt, Homo sapiens
uucuccugugugauuga

SEQ ID NO: 680950 - RNA, 23 nt, Homo sapiens
uuuaccauaagggacugugccag

SEQ ID NO: 680951 - RNA, 14 nt, Homo sapiens
uuuaccaucugcau

SEQ ID NO: 680952 - RNA, 23 nt, Homo sapiens
uuuacccauuaaauuaagacuug

SEQ ID NO: 680953 - RNA, 18 nt, Homo sapiens
uuuaccucauccaugcac

SEQ ID NO: 680954 - RNA, 17 nt, Homo sapiens
uuuaccugagaccaguu

SEQ ID NO: 680955 - RNA, 17 nt, Homo sapiens
uuuaccuuuaucuuuca

SEQ ID NO: 680956 - RNA, 22 nt, Homo sapiens
uuuaccuuucagugcaguuucu

SEQ ID NO: 680957 - RNA, 21 nt, Homo sapiens
uuuacgaucuguuuccaaauc

SEQ ID NO: 680958 - RNA, 16 nt, Homo sapiens
uuuacgguccaugccu

SEQ ID NO: 680959 - RNA, 13 nt, Homo sapiens
uuuacgugcaaac

SEQ ID NO: 680960 - RNA, 13 nt, Homo sapiens
uuuacuauuuuag

SEQ ID NO: 680961 - RNA, 22 nt, Homo sapiens
uuuacucagaggagcugcaaau

SEQ ID NO: 680962 - RNA, 18 nt, Homo sapiens
uuuacugcuugcuuucca

SEQ ID NO: 680963 - RNA, 19 nt, Homo sapiens
uuuacuguuucucaagugu

SEQ ID NO: 680964 - RNA, 19 nt, Homo sapiens
uuuacuuaucuuaugccac

SEQ ID NO: 680965 - RNA, 16 nt, Homo sapiens
uuuacuuuaaaaagua

SEQ ID NO: 680966 - RNA, 16 nt, Homo sapiens
uuuacuuuguacuugu

SEQ ID NO: 680967 - RNA, 16 nt, Homo sapiens
uuuacuuuuaccacua

SEQ ID NO: 680968 - RNA, 14 nt, Homo sapiens
uuuagaaacuacaa

SEQ ID NO: 680969 - RNA, 18 nt, Homo sapiens
uuuagaaaucacaacaaa

SEQ ID NO: 680970 - RNA, 23 nt, Homo sapiens
uuuagaaaucacaacaaacugaa

SEQ ID NO: 680971 - RNA, 20 nt, Homo sapiens
uuuagaacagagggaccaaa

SEQ ID NO: 680972 - RNA, 22 nt, Homo sapiens
uuuagaacuuuaccuauggaag

SEQ ID NO: 680973 - RNA, 16 nt, Homo sapiens
uuuagaccccauacaa

SEQ ID NO: 680974 - RNA, 18 nt, Homo sapiens
uuuagagauuauaacaaa

SEQ ID NO: 680975 - RNA, 20 nt, Homo sapiens
uuuagagccaaauucauccu

SEQ ID NO: 680976 - RNA, 17 nt, Homo sapiens
uuuagagcguuugguua

SEQ ID NO: 680977 - RNA, 21 nt, Homo sapiens
uuuagaggauuuuggcuuaaa

SEQ ID NO: 680978 - RNA, 21 nt, Homo sapiens
uuuagaucaaauauauuucaa

SEQ ID NO: 680979 - RNA, 22 nt, Homo sapiens
uuuagauccuaagucucuuaca

SEQ ID NO: 680980 - RNA, 18 nt, Homo sapiens
uuuagauuaaacaaacaa

SEQ ID NO: 680981 - RNA, 19 nt, Homo sapiens
uuuagauuaaacaaacaaa

SEQ ID NO: 680982 - RNA, 18 nt, Homo sapiens
uuuagcagaggagccaug

SEQ ID NO: 680983 - RNA, 15 nt, Homo sapiens
uuuagcagcugaaaa

SEQ ID NO: 680984 - RNA, 19 nt, Homo sapiens
uuuagcgugcucacugacc

SEQ ID NO: 680985 - RNA, 16 nt, Homo sapiens
uuuagcuauuacugga

SEQ ID NO: 680986 - RNA, 19 nt, Homo sapiens
uuuaggaaaagugaaucuu

SEQ ID NO: 680987 - RNA, 14 nt, Homo sapiens
uuuaggaguacuga

SEQ ID NO: 680988 - RNA, 23 nt, Homo sapiens
uuuaggauaaccuugugccuugg

SEQ ID NO: 680989 - RNA, 13 nt, Homo sapiens
uuuaggcacuguu

SEQ ID NO: 680990 - RNA, 14 nt, Homo sapiens
uuuaguaaauguua

SEQ ID NO: 680991 - RNA, 15 nt, Homo sapiens
uuuagucaugugacc

SEQ ID NO: 680992 - RNA, 15 nt, Homo sapiens
uuuagugugccuucc

SEQ ID NO: 680993 - RNA, 16 nt, Homo sapiens
uuuagugugccuucca

SEQ ID NO: 680994 - RNA, 19 nt, Homo sapiens
uuuaguucaauacagugaa

SEQ ID NO: 680995 - RNA, 13 nt, Homo sapiens
uuuaguuucauga

SEQ ID NO: 680996 - RNA, 20 nt, Homo sapiens
uuuaguuuuagcagcugaaa

SEQ ID NO: 680997 - RNA, 22 nt, Homo sapiens
uuuauaaaaaugagugcuuaaa

SEQ ID NO: 680998 - RNA, 23 nt, Homo sapiens
uuuauaaaagaauaaaauugcac

SEQ ID NO: 680999 - RNA, 19 nt, Homo sapiens
uuuauaaagauacuaaacc

SEQ ID NO: 681000 - RNA, 15 nt, Homo sapiens
uuuauaaaggccaaa

SEQ ID NO: 681001 - RNA, 21 nt, Homo sapiens
uuuauaacuauuauauuauca

SEQ ID NO: 681002 - RNA, 16 nt, Homo sapiens
uuuauaagcuacaugu

SEQ ID NO: 681003 - RNA, 18 nt, Homo sapiens
uuuauaaggcugauguca

SEQ ID NO: 681004 - RNA, 14 nt, Homo sapiens
uuuauaaugauuca

SEQ ID NO: 681005 - RNA, 13 nt, Homo sapiens
uuuauacuguaug

SEQ ID NO: 681006 - RNA, 15 nt, Homo sapiens
uuuauacuguuuacu

SEQ ID NO: 681007 - RNA, 19 nt, Homo sapiens
uuuauagagugucucaggg

SEQ ID NO: 681008 - RNA, 17 nt, Homo sapiens
uuuauagaugucaggaa

SEQ ID NO: 681009 - RNA, 19 nt, Homo sapiens
uuuauaggacgaaugccaa

SEQ ID NO: 681010 - RNA, 17 nt, Homo sapiens
uuuauaggcauaccucc

SEQ ID NO: 681011 - RNA, 21 nt, Homo sapiens
uuuauauaaaauccauccaaa

SEQ ID NO: 681012 - RNA, 13 nt, Homo sapiens
uuuauauauauga

SEQ ID NO: 681013 - RNA, 14 nt, Homo sapiens
uuuauaucaugcaa

SEQ ID NO: 681014 - RNA, 23 nt, Homo sapiens
uuuauaucccccuaaacuaccuu

SEQ ID NO: 681015 - RNA, 11 nt, Homo sapiens
uuuauaugauu

SEQ ID NO: 681016 - RNA, 23 nt, Homo sapiens
uuuaucccccgcaaagacaucaa

SEQ ID NO: 681017 - RNA, 16 nt, Homo sapiens
uuuauccucacauaaa

SEQ ID NO: 681018 - RNA, 21 nt, Homo sapiens
uuuaucucugaggcauggugu

SEQ ID NO: 681019 - RNA, 19 nt, Homo sapiens
uuuaucugugaauucagau

SEQ ID NO: 681020 - RNA, 14 nt, Homo sapiens
uuuaucugugcaaa

SEQ ID NO: 681021 - RNA, 18 nt, Homo sapiens
uuuaucuguuuccugaca

SEQ ID NO: 681022 - RNA, 17 nt, Homo sapiens
uuuaucuugucucuggg

SEQ ID NO: 681023 - RNA, 16 nt, Homo sapiens
uuuaugaugacugcuu

SEQ ID NO: 681024 - RNA, 14 nt, Homo sapiens
uuuaugaugcaguu

SEQ ID NO: 681025 - RNA, 23 nt, Homo sapiens
uuuaugaugcuaugguuugccau

SEQ ID NO: 681026 - RNA, 12 nt, Homo sapiens
uuuaugcauuga

SEQ ID NO: 681027 - RNA, 21 nt, Homo sapiens
uuuauggauuaaaaacugcuu

SEQ ID NO: 681028 - RNA, 21 nt, Homo sapiens
uuuaugguauuugagugugca

SEQ ID NO: 681029 - RNA, 23 nt, Homo sapiens
uuuauguaaaaccaacaaaaaga

SEQ ID NO: 681030 - RNA, 22 nt, Homo sapiens
uuuauguguuaugaacauccaa

SEQ ID NO: 681031 - RNA, 17 nt, Homo sapiens
uuuauuaaaauauuuca

SEQ ID NO: 681032 - RNA, 16 nt, Homo sapiens
uuuauuaccucugaua

SEQ ID NO: 681033 - RNA, 22 nt, Homo sapiens
uuuauuaguuaauauaucccag

SEQ ID NO: 681034 - RNA, 18 nt, Homo sapiens
uuuauucaagaaugccag

SEQ ID NO: 681035 - RNA, 13 nt, Homo sapiens
uuuauuccaaaau

SEQ ID NO: 681036 - RNA, 15 nt, Homo sapiens
uuuauugaaugcuua

SEQ ID NO: 681037 - RNA, 23 nt, Homo sapiens
uuuauugagcuguacaugcauau

SEQ ID NO: 681038 - RNA, 21 nt, Homo sapiens
uuuauugcaggauggugucuc

SEQ ID NO: 681039 - RNA, 15 nt, Homo sapiens
uuuauugcugaauga

SEQ ID NO: 681040 - RNA, 14 nt, Homo sapiens
uuuauugcuuguug

SEQ ID NO: 681041 - RNA, 18 nt, Homo sapiens
uuuauuuaagcaucaaau

SEQ ID NO: 681042 - RNA, 18 nt, Homo sapiens
uuuauuuccaauguuuca

SEQ ID NO: 681043 - RNA, 14 nt, Homo sapiens
uuuauuuccacuaa

SEQ ID NO: 681044 - RNA, 16 nt, Homo sapiens
uuuauuuccacuaaaa

SEQ ID NO: 681045 - RNA, 15 nt, Homo sapiens
uuucaaaacacaucu

SEQ ID NO: 681046 - RNA, 18 nt, Homo sapiens
uuucaaaagauggcuuau

SEQ ID NO: 681047 - RNA, 21 nt, Homo sapiens
uuucaaaagcggggcuucauc

SEQ ID NO: 681048 - RNA, 22 nt, Homo sapiens
uuucaaacaagaaacauuucag

SEQ ID NO: 681049 - RNA, 22 nt, Homo sapiens
uuucaaacugcugcauacuuug

SEQ ID NO: 681050 - RNA, 20 nt, Homo sapiens
uuucaaagaaaauagauuag

SEQ ID NO: 681051 - RNA, 13 nt, Homo sapiens
uuucaaagacuua

SEQ ID NO: 681052 - RNA, 21 nt, Homo sapiens
uuucaaagagguauauuugaa

SEQ ID NO: 681053 - RNA, 19 nt, Homo sapiens
uuucaaagauguguugcua

SEQ ID NO: 681054 - RNA, 15 nt, Homo sapiens
uucucgaacuccuga

SEQ ID NO: 681055 - RNA, 16 nt, Homo sapiens
uucucgugacaccacc

SEQ ID NO: 681056 - RNA, 22 nt, Homo sapiens
uucucuaaaauaacuaguacaa

SEQ ID NO: 681057 - RNA, 14 nt, Homo sapiens
uucucuaaauauga

SEQ ID NO: 681058 - RNA, 12 nt, Homo sapiens
uucucuaauaau

SEQ ID NO: 681059 - RNA, 15 nt, Homo sapiens
uucucuaaugcagcu

SEQ ID NO: 681060 - RNA, 19 nt, Homo sapiens
uucucuacagacuccaaaa

SEQ ID NO: 681061 - RNA, 21 nt, Homo sapiens
uucucuacagacuccaaaagg

SEQ ID NO: 681062 - RNA, 23 nt, Homo sapiens
uucucuacagaggugaaauucca

SEQ ID NO: 681063 - RNA, 12 nt, Homo sapiens
uucucuacugau

SEQ ID NO: 681064 - RNA, 17 nt, Homo sapiens
uucucuagggucugaua

SEQ ID NO: 681065 - RNA, 13 nt, Homo sapiens
uucucucacugug

SEQ ID NO: 681066 - RNA, 12 nt, Homo sapiens
uucucucagaaa

SEQ ID NO: 681067 - RNA, 15 nt, Homo sapiens
uucucucauuuccaa

SEQ ID NO: 681068 - RNA, 22 nt, Homo sapiens
uucucucuguucccuuccucac

SEQ ID NO: 681069 - RNA, 15 nt, Homo sapiens
uucucucuucuccac

SEQ ID NO: 681070 - RNA, 18 nt, Homo sapiens
uucucugccccguuucuu

SEQ ID NO: 681071 - RNA, 17 nt, Homo sapiens
uucucugccuguacuga

SEQ ID NO: 681072 - RNA, 17 nt, Homo sapiens
uucucugcuccaccaca

SEQ ID NO: 681073 - RNA, 21 nt, Homo sapiens
uucucuguaaguaauugccac

SEQ ID NO: 681074 - RNA, 21 nt, Homo sapiens
uucucuguauuccgauacaaa

SEQ ID NO: 681075 - RNA, 15 nt, Homo sapiens
uucucugugaccuga

SEQ ID NO: 681076 - RNA, 23 nt, Homo sapiens
uucucuguuguuugguucaggga

SEQ ID NO: 681077 - RNA, 15 nt, Homo sapiens
uucucuuacaaucug

SEQ ID NO: 681078 - RNA, 17 nt, Homo sapiens
uucucuucucucuucaa

SEQ ID NO: 681079 - RNA, 22 nt, Homo sapiens
uucucuugagaggguggaauau

SEQ ID NO: 681080 - RNA, 20 nt, Homo sapiens
uucucuugccauuuguagcu

SEQ ID NO: 681081 - RNA, 11 nt, Homo sapiens
uucucuuucac

SEQ ID NO: 681082 - RNA, 15 nt, Homo sapiens
uucucuuucccuuca

SEQ ID NO: 681083 - RNA, 18 nt, Homo sapiens
uucugaaaacacuugaug

SEQ ID NO: 681084 - RNA, 22 nt, Homo sapiens
uucugaaauaaacuucacugaa

SEQ ID NO: 681085 - RNA, 14 nt, Homo sapiens
uucugaaugcugcu

SEQ ID NO: 681086 - RNA, 18 nt, Homo sapiens
uucugacaucagcagaga

SEQ ID NO: 681087 - RNA, 15 nt, Homo sapiens
uucugacuuuuacag

SEQ ID NO: 681088 - RNA, 15 nt, Homo sapiens
uucugagaaggugag

SEQ ID NO: 681089 - RNA, 19 nt, Homo sapiens
uucugagagugaaaccaug

SEQ ID NO: 681090 - RNA, 11 nt, Homo sapiens
uucugagauca

SEQ ID NO: 681091 - RNA, 23 nt, Homo sapiens
uucugagauuuuugauaucucaa

SEQ ID NO: 681092 - RNA, 14 nt, Homo sapiens
uucugagccauuca

SEQ ID NO: 681093 - RNA, 20 nt, Homo sapiens
uucugaguaaguguguucau

SEQ ID NO: 681094 - RNA, 20 nt, Homo sapiens
uucugagugaguuuuacucu

SEQ ID NO: 681095 - RNA, 20 nt, Homo sapiens
uucugauaaaagauggccau

SEQ ID NO: 681096 - RNA, 17 nt, Homo sapiens
uucugauacguguauga

SEQ ID NO: 681097 - RNA, 18 nt, Homo sapiens
uucugaucucagagcauu

SEQ ID NO: 681098 - RNA, 22 nt, Homo sapiens
uucugcaacaucuuaagaucca

SEQ ID NO: 681099 - RNA, 23 nt, Homo sapiens
uucugcaacaucuuaagauccac

SEQ ID NO: 681100 - RNA, 13 nt, Homo sapiens
uucugcacacagc

SEQ ID NO: 681101 - RNA, 15 nt, Homo sapiens
uucugcaccaacuca

SEQ ID NO: 681102 - RNA, 18 nt, Homo sapiens
uucugcaccaacucaccu

SEQ ID NO: 681103 - RNA, 20 nt, Homo sapiens
uucugcagcaugaccuguga

SEQ ID NO: 681104 - RNA, 18 nt, Homo sapiens
uucugcaucaucuguaga

SEQ ID NO: 681105 - RNA, 15 nt, Homo sapiens
uucugcaucuugggg

SEQ ID NO: 681106 - RNA, 12 nt, Homo sapiens
uucugcauguac

SEQ ID NO: 681107 - RNA, 19 nt, Homo sapiens
uucugccaaugaccaaaca

SEQ ID NO: 681108 - RNA, 14 nt, Homo sapiens
uucugccacuccau

SEQ ID NO: 681109 - RNA, 20 nt, Homo sapiens
uucugccgcccccuccugaa

SEQ ID NO: 681110 - RNA, 14 nt, Homo sapiens
uucugccugugcag

SEQ ID NO: 681111 - RNA, 17 nt, Homo sapiens
uucugccuucucaggaa

SEQ ID NO: 681112 - RNA, 19 nt, Homo sapiens
uucugcuaccucacugggg

SEQ ID NO: 681113 - RNA, 13 nt, Homo sapiens
uucugcuccuuag

SEQ ID NO: 681114 - RNA, 13 nt, Homo sapiens
uucugcucuggaa

SEQ ID NO: 681115 - RNA, 13 nt, Homo sapiens
uucugcugaagga

SEQ ID NO: 681116 - RNA, 16 nt, Homo sapiens
uucugcugaccaaaug

SEQ ID NO: 681117 - RNA, 11 nt, Homo sapiens
uucugcugcuu

SEQ ID NO: 681118 - RNA, 15 nt, Homo sapiens
uucugcugucucucc

SEQ ID NO: 681119 - RNA, 19 nt, Homo sapiens
uucugcuguucuucacuuc

SEQ ID NO: 681120 - RNA, 18 nt, Homo sapiens
uucuggaaacuaccaggu

SEQ ID NO: 681121 - RNA, 16 nt, Homo sapiens
uucuggaaagugcaau

SEQ ID NO: 681122 - RNA, 23 nt, Homo sapiens
uucuggaagcugauuaaaacaca

SEQ ID NO: 681123 - RNA, 14 nt, Homo sapiens
uucuggaauguaau

SEQ ID NO: 681124 - RNA, 16 nt, Homo sapiens
uucuggacagacagau

SEQ ID NO: 681125 - RNA, 22 nt, Homo sapiens
uucuggacuacacccaagccug

SEQ ID NO: 681126 - RNA, 17 nt, Homo sapiens
uucuggagguuuccaaa

SEQ ID NO: 681127 - RNA, 17 nt, Homo sapiens
uucuggagugagcacuc

SEQ ID NO: 681128 - RNA, 23 nt, Homo sapiens
uucuggauugugguuccaugcag

SEQ ID NO: 681129 - RNA, 15 nt, Homo sapiens
uucuggccucugcug

SEQ ID NO: 681130 - RNA, 22 nt, Homo sapiens
uucugggaagggagaguucuuu

SEQ ID NO: 681131 - RNA, 16 nt, Homo sapiens
uucugggcacuaagaa

SEQ ID NO: 681132 - RNA, 17 nt, Homo sapiens
uucugggcuacugccac

SEQ ID NO: 681133 - RNA, 16 nt, Homo sapiens
uucugggggacagaga

SEQ ID NO: 681134 - RNA, 18 nt, Homo sapiens
uucuggguguugaccacu

SEQ ID NO: 681135 - RNA, 20 nt, Homo sapiens
uucuggugggguguguucca

SEQ ID NO: 681136 - RNA, 15 nt, Homo sapiens
uucugguuacugugg

SEQ ID NO: 681137 - RNA, 15 nt, Homo sapiens
uucugguucuacuuu

SEQ ID NO: 681138 - RNA, 15 nt, Homo sapiens
uucugguuucuucca

SEQ ID NO: 681139 - RNA, 15 nt, Homo sapiens
uucuguaaccaaaaa

SEQ ID NO: 681140 - RNA, 20 nt, Homo sapiens
uucuguaauauuuacaaugu

SEQ ID NO: 681141 - RNA, 22 nt, Homo sapiens
uucuguaccacacuagaauuca

SEQ ID NO: 681142 - RNA, 21 nt, Homo sapiens
uucugucaagcuuacuacagu

SEQ ID NO: 681143 - RNA, 10 nt, Homo sapiens
uucugucacc

SEQ ID NO: 681144 - RNA, 21 nt, Homo sapiens
uucugucagggguuucuucaa

SEQ ID NO: 681145 - RNA, 23 nt, Homo sapiens
uucuguccugagaagcauguaau

SEQ ID NO: 681146 - RNA, 21 nt, Homo sapiens
uucugucuacuaagugaugcu

SEQ ID NO: 681147 - RNA, 12 nt, Homo sapiens
uucugucuuccc

SEQ ID NO: 681148 - RNA, 13 nt, Homo sapiens
uucugucuuccua

SEQ ID NO: 681149 - RNA, 17 nt, Homo sapiens
uucugugcagagaugac

SEQ ID NO: 681150 - RNA, 15 nt, Homo sapiens
uucuguguaccacuu

SEQ ID NO: 681151 - RNA, 17 nt, Homo sapiens
uucuguucuuacaaaug

SEQ ID NO: 681152 - RNA, 15 nt, Homo sapiens
uucuguugccaguca

SEQ ID NO: 681153 - RNA, 17 nt, Homo sapiens
uucuguuggggaggggu

SEQ ID NO: 681154 - RNA, 20 nt, Homo sapiens
uucuguuuggcacuuguauu

SEQ ID NO: 681155 - RNA, 22 nt, Homo sapiens
uucuguuuuuaaugcuauuuga

SEQ ID NO: 681156 - RNA, 18 nt, Homo sapiens
uucuuaaaaaacauauau

SEQ ID NO: 681157 - RNA, 21 nt, Homo sapiens
uucuuaaaagaaaucuugcuu

SEQ ID NO: 681158 - RNA, 14 nt, Homo sapiens
uucuuaaacacaaa

SEQ ID NO: 681159 - RNA, 13 nt, Homo sapiens
uucuuaaccaucu

SEQ ID NO: 681160 - RNA, 15 nt, Homo sapiens
uucuuaacucuuuaa

SEQ ID NO: 681161 - RNA, 17 nt, Homo sapiens
uucuuaagggcacacac

SEQ ID NO: 681162 - RNA, 12 nt, Homo sapiens
uucuuacacugu

SEQ ID NO: 681163 - RNA, 15 nt, Homo sapiens
uucuuacucugaaac

SEQ ID NO: 681164 - RNA, 20 nt, Homo sapiens
uucuuagugcuucagaguuu

SEQ ID NO: 681165 - RNA, 20 nt, Homo sapiens
uucuuaguggaagacaauac

SEQ ID NO: 681166 - RNA, 14 nt, Homo sapiens
uucuuagugucacu

SEQ ID NO: 681167 - RNA, 14 nt, Homo sapiens
uucuuauaauauua

SEQ ID NO: 681168 - RNA, 22 nt, Homo sapiens
uucuuauagaguauugucuuua

SEQ ID NO: 681169 - RNA, 14 nt, Homo sapiens
uucuuauagauauu

SEQ ID NO: 681170 - RNA, 17 nt, Homo sapiens
uucuuauuaaucauaca

SEQ ID NO: 681171 - RNA, 23 nt, Homo sapiens
uucuuauugaccaauuccugaca

SEQ ID NO: 681172 - RNA, 17 nt, Homo sapiens
uucuuauuuugcauucc

SEQ ID NO: 681173 - RNA, 20 nt, Homo sapiens
uuguaaugauauagccagaa

SEQ ID NO: 681174 - RNA, 17 nt, Homo sapiens
uuguaauguaucaaaua

SEQ ID NO: 681175 - RNA, 16 nt, Homo sapiens
uuguaaugucaccacc

SEQ ID NO: 681176 - RNA, 17 nt, Homo sapiens
uuguaauugcaugacaa

SEQ ID NO: 681177 - RNA, 13 nt, Homo sapiens
uuguaauugcuua

SEQ ID NO: 681178 - RNA, 14 nt, Homo sapiens
uuguacaaguauua

SEQ ID NO: 681179 - RNA, 17 nt, Homo sapiens
uuguacaaugguuuauu

SEQ ID NO: 681180 - RNA, 15 nt, Homo sapiens
uuguacaggacugua

SEQ ID NO: 681181 - RNA, 19 nt, Homo sapiens
uuguacauauuuguggaau

SEQ ID NO: 681182 - RNA, 13 nt, Homo sapiens
uuguacauuucac

SEQ ID NO: 681183 - RNA, 14 nt, Homo sapiens
uuguacuaaucuga

SEQ ID NO: 681184 - RNA, 23 nt, Homo sapiens
uuguacuaucgucaggaaaccaa

SEQ ID NO: 681185 - RNA, 15 nt, Homo sapiens
uucaauuaccaagaa

SEQ ID NO: 681186 - RNA, 19 nt, Homo sapiens
uucaauuagggaugcucaa

SEQ ID NO: 681187 - RNA, 18 nt, Homo sapiens
uucccaaguaugccuuaa

SEQ ID NO: 681188 - RNA, 23 nt, Homo sapiens
uucccaaguaugccuuaagcaga

SEQ ID NO: 681189 - RNA, 15 nt, Homo sapiens
uucccaaguguaauu

SEQ ID NO: 681190 - RNA, 20 nt, Homo sapiens
uucccaauaaaagugacucu

SEQ ID NO: 681191 - RNA, 12 nt, Homo sapiens
uucccacacugu

SEQ ID NO: 681192 - RNA, 15 nt, Homo sapiens
uucccacauacauua

SEQ ID NO: 681193 - RNA, 18 nt, Homo sapiens
uucccaccagguucuccu

SEQ ID NO: 681194 - RNA, 13 nt, Homo sapiens
uucccacccaagc

SEQ ID NO: 681195 - RNA, 18 nt, Homo sapiens
uucccaccuacugcacuu

SEQ ID NO: 681196 - RNA, 18 nt, Homo sapiens
uucccacggccuuucuag

SEQ ID NO: 681197 - RNA, 15 nt, Homo sapiens
uucccacugccaggg

SEQ ID NO: 681198 - RNA, 20 nt, Homo sapiens
uucccagcagugggggucag

SEQ ID NO: 681199 - RNA, 17 nt, Homo sapiens
uucccagcccucauccc

SEQ ID NO: 681200 - RNA, 14 nt, Homo sapiens
uucccagcuaggaa

SEQ ID NO: 681201 - RNA, 12 nt, Homo sapiens
uucccagugugg

SEQ ID NO: 681202 - RNA, 23 nt, Homo sapiens
uucccaguuaaagauuauuguga

SEQ ID NO: 681203 - RNA, 23 nt, Homo sapiens
uucccaucacuggagcaccaggc

SEQ ID NO: 681204 - RNA, 14 nt, Homo sapiens
uucccaugccuguc

SEQ ID NO: 681205 - RNA, 15 nt, Homo sapiens
uucccauguugucaa

SEQ ID NO: 681206 - RNA, 14 nt, Homo sapiens
uucccauucuugca

SEQ ID NO: 681207 - RNA, 17 nt, Homo sapiens
uuccccaaaggcaucca

SEQ ID NO: 681208 - RNA, 15 nt, Homo sapiens
uuccccaacagggca

SEQ ID NO: 681209 - RNA, 12 nt, Homo sapiens
uuccccacugac

SEQ ID NO: 681210 - RNA, 17 nt, Homo sapiens
uuccccauaacucaaug

SEQ ID NO: 681211 - RNA, 14 nt, Homo sapiens
uucccccacaguuu

SEQ ID NO: 681212 - RNA, 17 nt, Homo sapiens
uucccccagcccugugg

SEQ ID NO: 681213 - RNA, 14 nt, Homo sapiens
uuccccguccccug

SEQ ID NO: 681214 - RNA, 17 nt, Homo sapiens
uuccccucagagcucuu

SEQ ID NO: 681215 - RNA, 19 nt, Homo sapiens
uuccccucugcggcuuuca

SEQ ID NO: 681216 - RNA, 17 nt, Homo sapiens
uuccccucuucugcuaa

SEQ ID NO: 681217 - RNA, 16 nt, Homo sapiens
uuccccucuugucucc

SEQ ID NO: 681218 - RNA, 17 nt, Homo sapiens
uuccccuucuugccauu

SEQ ID NO: 681219 - RNA, 17 nt, Homo sapiens
uuccccuuuguccugcg

SEQ ID NO: 681220 - RNA, 18 nt, Homo sapiens
uucccgagggagcugcug

SEQ ID NO: 681221 - RNA, 14 nt, Homo sapiens
uucccgaugaacaa

SEQ ID NO: 681222 - RNA, 18 nt, Homo sapiens
uucccguauugacaggaa

SEQ ID NO: 681223 - RNA, 23 nt, Homo sapiens
uucccuaaagaagauaaacacaa

SEQ ID NO: 681224 - RNA, 17 nt, Homo sapiens
uucccuacaguugaaaa

SEQ ID NO: 681225 - RNA, 22 nt, Homo sapiens
uucccuacaguugaaaaacagc

SEQ ID NO: 681226 - RNA, 19 nt, Homo sapiens
uucccuaccauucagugau

SEQ ID NO: 681227 - RNA, 14 nt, Homo sapiens
uucccucacaccgc

SEQ ID NO: 681228 - RNA, 16 nt, Homo sapiens
uucccucagauuucca

SEQ ID NO: 681229 - RNA, 16 nt, Homo sapiens
uucccucccaguuuuc

SEQ ID NO: 681230 - RNA, 17 nt, Homo sapiens
uucccuccugcccagga

SEQ ID NO: 681231 - RNA, 21 nt, Homo sapiens
uucccucucaugguaccugcu

SEQ ID NO: 681232 - RNA, 17 nt, Homo sapiens
uucccucucccagucca

SEQ ID NO: 681233 - RNA, 16 nt, Homo sapiens
uucccucuucccugac

SEQ ID NO: 681234 - RNA, 19 nt, Homo sapiens
uucccucuucccugaccuc

SEQ ID NO: 681235 - RNA, 18 nt, Homo sapiens
uucccugaccucccucua

SEQ ID NO: 681236 - RNA, 13 nt, Homo sapiens
uucccugagucac

SEQ ID NO: 681237 - RNA, 14 nt, Homo sapiens
uucccugauggccu

SEQ ID NO: 681238 - RNA, 23 nt, Homo sapiens
uucccugcagucuagcaccucua

SEQ ID NO: 681239 - RNA, 13 nt, Homo sapiens
uucccuggcauga

SEQ ID NO: 681240 - RNA, 20 nt, Homo sapiens
uucccugggcugccaccagc

SEQ ID NO: 681241 - RNA, 18 nt, Homo sapiens
uucccuguguagcucuca

SEQ ID NO: 681242 - RNA, 22 nt, Homo sapiens
uucccuguguauucuagugaau

SEQ ID NO: 681243 - RNA, 14 nt, Homo sapiens
uucccuuaacucca

SEQ ID NO: 681244 - RNA, 19 nt, Homo sapiens
uucccuuagccucucccac

SEQ ID NO: 681245 - RNA, 18 nt, Homo sapiens
uucccuucuuugcugcug

SEQ ID NO: 681246 - RNA, 18 nt, Homo sapiens
uucccuugccaucacacu

SEQ ID NO: 681247 - RNA, 22 nt, Homo sapiens
uucccuuguaaagacagaguga

SEQ ID NO: 681248 - RNA, 17 nt, Homo sapiens
uucccuuugagguugcu

SEQ ID NO: 681249 - RNA, 14 nt, Homo sapiens
uuccgaaucucuuu

SEQ ID NO: 681250 - RNA, 15 nt, Homo sapiens
uuccgauacaaagug

SEQ ID NO: 681251 - RNA, 14 nt, Homo sapiens
uuccggguucaagu

SEQ ID NO: 681252 - RNA, 16 nt, Homo sapiens
uuccgguuguugauau

SEQ ID NO: 681253 - RNA, 16 nt, Homo sapiens
uuccguggcacugcau

SEQ ID NO: 681254 - RNA, 13 nt, Homo sapiens
uuccuaaagccaa

SEQ ID NO: 681255 - RNA, 18 nt, Homo sapiens
uuccuaaagccaucaugc

SEQ ID NO: 681256 - RNA, 21 nt, Homo sapiens
uuccuaaagccaucaugccuu

SEQ ID NO: 681257 - RNA, 14 nt, Homo sapiens
uuccuaacugugau

SEQ ID NO: 681258 - RNA, 16 nt, Homo sapiens
uuccuaaugugaucau

SEQ ID NO: 681259 - RNA, 12 nt, Homo sapiens
uuccuagcugug

SEQ ID NO: 681260 - RNA, 11 nt, Homo sapiens
uuccuaucuca

SEQ ID NO: 681261 - RNA, 22 nt, Homo sapiens
uuccuauuguaaucgugugcca

SEQ ID NO: 681262 - RNA, 20 nt, Homo sapiens
uuccuauuuggggcuugcau

SEQ ID NO: 681263 - RNA, 17 nt, Homo sapiens
uuccucagauugcugaa

SEQ ID NO: 681264 - RNA, 18 nt, Homo sapiens
uuccucagcaccccuagc

SEQ ID NO: 681265 - RNA, 13 nt, Homo sapiens
uuccucagccucc

SEQ ID NO: 681266 - RNA, 20 nt, Homo sapiens
uuccucagggacagagacac

SEQ ID NO: 681267 - RNA, 14 nt, Homo sapiens
uuccucaucugggu

SEQ ID NO: 681268 - RNA, 14 nt, Homo sapiens
uuccucauguugcu

SEQ ID NO: 681269 - RNA, 23 nt, Homo sapiens
uuccucauuagcauuuugcuaaa

SEQ ID NO: 681270 - RNA, 14 nt, Homo sapiens
uuccucccagugag

SEQ ID NO: 681271 - RNA, 19 nt, Homo sapiens
uuccuccccucucaucccc

SEQ ID NO: 681272 - RNA, 17 nt, Homo sapiens
uuccucccucauggaag

SEQ ID NO: 681273 - RNA, 17 nt, Homo sapiens
uuccucccuucugcuac

SEQ ID NO: 681274 - RNA, 13 nt, Homo sapiens
uuccuccuaccug

SEQ ID NO: 681275 - RNA, 19 nt, Homo sapiens
uuccuccucugcugggacu

SEQ ID NO: 681276 - RNA, 20 nt, Homo sapiens
uuccuccugaagccucugcc

SEQ ID NO: 681277 - RNA, 14 nt, Homo sapiens
uuccuccuuauccu

SEQ ID NO: 681278 - RNA, 18 nt, Homo sapiens
uuccucuccacugcugga

SEQ ID NO: 681279 - RNA, 15 nt, Homo sapiens
uuccucucucccacc

SEQ ID NO: 681280 - RNA, 12 nt, Homo sapiens
uuccucucucua

SEQ ID NO: 681281 - RNA, 21 nt, Homo sapiens
uuccucucucuaccagucuau

SEQ ID NO: 681282 - RNA, 14 nt, Homo sapiens
uuccucugaacaaa

SEQ ID NO: 681283 - RNA, 22 nt, Homo sapiens
uuccucugccacucccugcugu

SEQ ID NO: 681284 - RNA, 19 nt, Homo sapiens
uuccucuguucuaucccac

SEQ ID NO: 681285 - RNA, 18 nt, Homo sapiens
uuccugaaaauugcaaua

SEQ ID NO: 681286 - RNA, 17 nt, Homo sapiens
uuccugaauacaagccu

SEQ ID NO: 681287 - RNA, 15 nt, Homo sapiens
uuccugacuuacaau

SEQ ID NO: 681288 - RNA, 22 nt, Homo sapiens
uuccugagggcuaauucuggga

SEQ ID NO: 681289 - RNA, 13 nt, Homo sapiens
uuccugauacauu

SEQ ID NO: 681290 - RNA, 22 nt, Homo sapiens
uuccugaugccccugacaucau

SEQ ID NO: 681291 - RNA, 17 nt, Homo sapiens
uuccugauuccuuuaaa

SEQ ID NO: 681292 - RNA, 14 nt, Homo sapiens
uuccugauuucaua

SEQ ID NO: 681293 - RNA, 14 nt, Homo sapiens
uuccugcccuugaa

SEQ ID NO: 681294 - RNA, 22 nt, Homo sapiens
uuccugcgcauggugcagugcc

SEQ ID NO: 681295 - RNA, 16 nt, Homo sapiens
uuccugcuccaugacu

SEQ ID NO: 681296 - RNA, 22 nt, Homo sapiens
uuccugcugcuggggccagcga

SEQ ID NO: 681297 - RNA, 13 nt, Homo sapiens
uuccuggacacac

SEQ ID NO: 681298 - RNA, 21 nt, Homo sapiens
uuccuggccugagagucagcu

SEQ ID NO: 681299 - RNA, 20 nt, Homo sapiens
uuccuggcuccaacacugcu

SEQ ID NO: 681300 - RNA, 15 nt, Homo sapiens
uuccuggcugaugau

SEQ ID NO: 681301 - RNA, 13 nt, Homo sapiens
uuccugggaacau

SEQ ID NO: 681302 - RNA, 23 nt, Homo sapiens
uuccugggcuggguaaaagcagc

SEQ ID NO: 681303 - RNA, 18 nt, Homo sapiens
uuccugggguaaaguauc

SEQ ID NO: 681304 - RNA, 14 nt, Homo sapiens
uuccugguuugacu

SEQ ID NO: 681305 - RNA, 11 nt, Homo sapiens
uuccugugauc

SEQ ID NO: 681306 - RNA, 22 nt, Homo sapiens
uuccuguggggggaaguccaug

SEQ ID NO: 681307 - RNA, 21 nt, Homo sapiens
uuccuguguggccugccuuca

SEQ ID NO: 681308 - RNA, 15 nt, Homo sapiens
uuccuguucaguaau

SEQ ID NO: 681309 - RNA, 23 nt, Homo sapiens
uuccuuaaagcauuugcaacagc

SEQ ID NO: 681310 - RNA, 21 nt, Homo sapiens
uuauaaaaaacucacaggugu

SEQ ID NO: 681311 - RNA, 22 nt, Homo sapiens
uuauaaaaauauaaauuguaca

SEQ ID NO: 681312 - RNA, 18 nt, Homo sapiens
uuauaaacaacaucaaaa

SEQ ID NO: 681313 - RNA, 14 nt, Homo sapiens
uuauaaaccuucag

SEQ ID NO: 681314 - RNA, 18 nt, Homo sapiens
uuauaaagucaaggacga

SEQ ID NO: 681315 - RNA, 16 nt, Homo sapiens
uuauaaauaucaugca

SEQ ID NO: 681316 - RNA, 14 nt, Homo sapiens
uuauaaaugagcaa

SEQ ID NO: 681317 - RNA, 13 nt, Homo sapiens
uuauaacaagugu

SEQ ID NO: 681318 - RNA, 17 nt, Homo sapiens
uuauaacguguucaaua

SEQ ID NO: 681319 - RNA, 23 nt, Homo sapiens
uuauaagagugccguaacaacug

SEQ ID NO: 681320 - RNA, 12 nt, Homo sapiens
uuauaagcuaca

SEQ ID NO: 681321 - RNA, 15 nt, Homo sapiens
uuauaauaacugaac

SEQ ID NO: 681322 - RNA, 22 nt, Homo sapiens
uuauaauaguaagccccuguga

SEQ ID NO: 681323 - RNA, 19 nt, Homo sapiens
uuauacaauaacccaguua

SEQ ID NO: 681324 - RNA, 14 nt, Homo sapiens
uuauacaccagcaa

SEQ ID NO: 681325 - RNA, 22 nt, Homo sapiens
uuauacaccagcaauuuagaca

SEQ ID NO: 681326 - RNA, 13 nt, Homo sapiens
uuauacacugugu

SEQ ID NO: 681327 - RNA, 23 nt, Homo sapiens
uuauacagauagaguuccauaua

SEQ ID NO: 681328 - RNA, 23 nt, Homo sapiens
uuauaccugcucuuguucuacug

SEQ ID NO: 681329 - RNA, 21 nt, Homo sapiens
uuauacuaaauaugugacuga

SEQ ID NO: 681330 - RNA, 22 nt, Homo sapiens
uuauacucaccugcguuuucau

SEQ ID NO: 681331 - RNA, 12 nt, Homo sapiens
uuauacuguaua

SEQ ID NO: 681332 - RNA, 19 nt, Homo sapiens
uuauacuuuauuaagcaac

SEQ ID NO: 681333 - RNA, 20 nt, Homo sapiens
uuauagaaguagcaaaaagu

SEQ ID NO: 681334 - RNA, 12 nt, Homo sapiens
uuauagcuauga

SEQ ID NO: 681335 - RNA, 11 nt, Homo sapiens
uuauagcucua

SEQ ID NO: 681336 - RNA, 15 nt, Homo sapiens
uuauaggcauaccuc

SEQ ID NO: 681337 - RNA, 17 nt, Homo sapiens
uuauaggcaugagccac

SEQ ID NO: 681338 - RNA, 24 nt, Homo sapiens
uuauagucaauggcuuguucauca

SEQ ID NO: 681339 - RNA, 13 nt, Homo sapiens
uuauagucuucca

SEQ ID NO: 681340 - RNA, 21 nt, Homo sapiens
uuauagugcccuccauuguaa

SEQ ID NO: 681341 - RNA, 19 nt, Homo sapiens
uuauauaaggcaguauuau

SEQ ID NO: 681342 - RNA, 18 nt, Homo sapiens
uuauauaaggcauuccac

SEQ ID NO: 681343 - RNA, 22 nt, Homo sapiens
uuauauaauaaaguauuccacc

SEQ ID NO: 681344 - RNA, 12 nt, Homo sapiens
uuauauaauuca

SEQ ID NO: 681345 - RNA, 15 nt, Homo sapiens
uuauauaugaaguug

SEQ ID NO: 681346 - RNA, 19 nt, Homo sapiens
uuauauauuuuucugagau

SEQ ID NO: 681347 - RNA, 20 nt, Homo sapiens
uuauauauuuuucugagauu

SEQ ID NO: 681348 - RNA, 14 nt, Homo sapiens
uuauaucagccuga

SEQ ID NO: 681349 - RNA, 13 nt, Homo sapiens
uuauaucaugcaa

SEQ ID NO: 681350 - RNA, 13 nt, Homo sapiens
uuauauggaugau

SEQ ID NO: 681351 - RNA, 15 nt, Homo sapiens
uuauauuaaaguaaa

SEQ ID NO: 681352 - RNA, 13 nt, Homo sapiens
uuauauucaucca

SEQ ID NO: 681353 - RNA, 14 nt, Homo sapiens
uuauauuuugcagu

SEQ ID NO: 681354 - RNA, 17 nt, Homo sapiens
uuaucaagugucuucca

SEQ ID NO: 681355 - RNA, 14 nt, Homo sapiens
uuaucaauucugau

SEQ ID NO: 681356 - RNA, 19 nt, Homo sapiens
uuaucacacuucugugaga

SEQ ID NO: 681357 - RNA, 18 nt, Homo sapiens
uuaucacuuaaacuugca

SEQ ID NO: 681358 - RNA, 17 nt, Homo sapiens
uuaucagaauucucaga

SEQ ID NO: 681359 - RNA, 14 nt, Homo sapiens
uuaucagcaaaaaa

SEQ ID NO: 681360 - RNA, 22 nt, Homo sapiens
uuaucaggaaauguuuucuuaa

SEQ ID NO: 681361 - RNA, 23 nt, Homo sapiens
uuaucaggaaauguuuucuuaag

SEQ ID NO: 681362 - RNA, 17 nt, Homo sapiens
uuaucaguaauuugacu

SEQ ID NO: 681363 - RNA, 13 nt, Homo sapiens
uuaucauauccuu

SEQ ID NO: 681364 - RNA, 12 nt, Homo sapiens
uuaucauaugcu

SEQ ID NO: 681365 - RNA, 20 nt, Homo sapiens
uuaucaucccaacagccaag

SEQ ID NO: 681366 - RNA, 21 nt, Homo sapiens
uuaucaucccaacagccaaga

SEQ ID NO: 681367 - RNA, 19 nt, Homo sapiens
uuaucaugcaaaugcugua

SEQ ID NO: 681368 - RNA, 20 nt, Homo sapiens
uuaucaugcguuuuauaucu

SEQ ID NO: 681369 - RNA, 20 nt, Homo sapiens
uuaucauggagaacagcaug

SEQ ID NO: 681370 - RNA, 23 nt, Homo sapiens
uuaucauucauucuuagcucuua

SEQ ID NO: 681371 - RNA, 17 nt, Homo sapiens
uuauccaaaaugcuugg

SEQ ID NO: 681372 - RNA, 15 nt, Homo sapiens
uuauccacaaaguac

SEQ ID NO: 681373 - RNA, 14 nt, Homo sapiens
uuauccagcaguau

SEQ ID NO: 681374 - RNA, 21 nt, Homo sapiens
uuaucccccgcaaagacauca

SEQ ID NO: 681375 - RNA, 16 nt, Homo sapiens
uuauccucugaucucc

SEQ ID NO: 681376 - RNA, 21 nt, Homo sapiens
uuaucgcccugagaagaucua

SEQ ID NO: 681377 - RNA, 13 nt, Homo sapiens
uuaucuagcuguc

SEQ ID NO: 681378 - RNA, 21 nt, Homo sapiens
uuaucuauagcuaaguacaca

SEQ ID NO: 681379 - RNA, 14 nt, Homo sapiens
uuaucuauaucuca

SEQ ID NO: 681380 - RNA, 23 nt, Homo sapiens
uuaucuauggaaaugugagaaau

SEQ ID NO: 681381 - RNA, 15 nt, Homo sapiens
uuaucucugaggcua

SEQ ID NO: 681382 - RNA, 21 nt, Homo sapiens
uuaucuggcccucgacacuca

SEQ ID NO: 681383 - RNA, 13 nt, Homo sapiens
uuaucugugcaaa

SEQ ID NO: 681384 - RNA, 15 nt, Homo sapiens
uuaucuugacauuca

SEQ ID NO: 681385 - RNA, 15 nt, Homo sapiens
uuaucuuggacugac

SEQ ID NO: 681386 - RNA, 13 nt, Homo sapiens
uuaucuuuaccaa

SEQ ID NO: 681387 - RNA, 15 nt, Homo sapiens
uuaucuuuauaugaa

SEQ ID NO: 681388 - RNA, 14 nt, Homo sapiens
uuaugaaaaagaag

SEQ ID NO: 681389 - RNA, 15 nt, Homo sapiens
uuaugaaaaagaaga

SEQ ID NO: 681390 - RNA, 16 nt, Homo sapiens
uuaugaaaaccauaug

SEQ ID NO: 681391 - RNA, 21 nt, Homo sapiens
uuaugaaaauauagacauucu

SEQ ID NO: 681392 - RNA, 23 nt, Homo sapiens
uuaugaaauaaagaaauugcaau

SEQ ID NO: 681393 - RNA, 13 nt, Homo sapiens
uuaugaacaucca

SEQ ID NO: 681394 - RNA, 15 nt, Homo sapiens
uuaugaagcagauuu

SEQ ID NO: 681395 - RNA, 11 nt, Homo sapiens
uuaugaaguua

SEQ ID NO: 681396 - RNA, 21 nt, Homo sapiens
uuaugaauauaaugaaugaga

SEQ ID NO: 681397 - RNA, 12 nt, Homo sapiens
uuaugaaugaca

SEQ ID NO: 681398 - RNA, 16 nt, Homo sapiens
uuaugaauugucuaaa

SEQ ID NO: 681399 - RNA, 15 nt, Homo sapiens
uuaugaggcuauuaa

SEQ ID NO: 681400 - RNA, 19 nt, Homo sapiens
uuaugauagugguaugaca

SEQ ID NO: 681401 - RNA, 16 nt, Homo sapiens
uuaugauauauuucag

SEQ ID NO: 681402 - RNA, 20 nt, Homo sapiens
uuaugaucuggcccuugcuu

SEQ ID NO: 681403 - RNA, 18 nt, Homo sapiens
uuaugauggucugcauua

SEQ ID NO: 681404 - RNA, 18 nt, Homo sapiens
uuaugauuucauuaucac

SEQ ID NO: 681405 - RNA, 13 nt, Homo sapiens
uuaugcaacauca

SEQ ID NO: 681406 - RNA, 21 nt, Homo sapiens
uuaugcagaauccaaaguaaa

SEQ ID NO: 681407 - RNA, 22 nt, Homo sapiens
uuaugcaguaaauuaucuuggg

SEQ ID NO: 681408 - RNA, 23 nt, Homo sapiens
uuaugccauagcaagauugcuua

SEQ ID NO: 681409 - RNA, 17 nt, Homo sapiens
uuaugccuucacuuuac

SEQ ID NO: 681410 - RNA, 17 nt, Homo sapiens
uuaugcgaaccuauguc

SEQ ID NO: 681411 - RNA, 18 nt, Homo sapiens
uuaugcuauuuggacaau

SEQ ID NO: 681412 - RNA, 22 nt, Homo sapiens
uuaugcuuuuagaguugcaacu

SEQ ID NO: 681413 - RNA, 23 nt, Homo sapiens
uuauggagcucacacuccagugg

SEQ ID NO: 681414 - RNA, 13 nt, Homo sapiens
uuauggcaaagau

SEQ ID NO: 681415 - RNA, 23 nt, Homo sapiens
uuauggcagaagggaauugcuca

SEQ ID NO: 681416 - RNA, 19 nt, Homo sapiens
uuauggcauuuuucuggga

SEQ ID NO: 681417 - RNA, 18 nt, Homo sapiens
uuauggcuuuugugcauu

SEQ ID NO: 681418 - RNA, 17 nt, Homo sapiens
uuauguaauagauacca

SEQ ID NO: 681419 - RNA, 14 nt, Homo sapiens
uuauguaaugcaaa

SEQ ID NO: 681420 - RNA, 10 nt, Homo sapiens
uuauguacug

SEQ ID NO: 681421 - RNA, 17 nt, Homo sapiens
uuaugucaccagaauau

SEQ ID NO: 681422 - RNA, 18 nt, Homo sapiens
uuaugucaucaguaaagu

SEQ ID NO: 681423 - RNA, 20 nt, Homo sapiens
uuaugucccugacuguaaau

SEQ ID NO: 681424 - RNA, 24 nt, Homo sapiens
uuaugucuggggcagaaacacuca

SEQ ID NO: 681425 - RNA, 16 nt, Homo sapiens
uuaugugacuugcaau

SEQ ID NO: 681426 - RNA, 17 nt, Homo sapiens
uuaugugacuugcaaua

SEQ ID NO: 681427 - RNA, 23 nt, Homo sapiens
uuauguggaaaacagaacaucau

SEQ ID NO: 681428 - RNA, 22 nt, Homo sapiens
ugugggcauggccgcuucuaga

SEQ ID NO: 681429 - RNA, 21 nt, Homo sapiens
ugugggccuucucaaaccgcc

SEQ ID NO: 681430 - RNA, 15 nt, Homo sapiens
ugugggcuccaugua

SEQ ID NO: 681431 - RNA, 14 nt, Homo sapiens
ugugggcuucagca

SEQ ID NO: 681432 - RNA, 20 nt, Homo sapiens
uguggggacacagcagugag

SEQ ID NO: 681433 - RNA, 20 nt, Homo sapiens
ugugggguccccaucauccc

SEQ ID NO: 681434 - RNA, 20 nt, Homo sapiens
ugugggucuguguggcagga

SEQ ID NO: 681435 - RNA, 13 nt, Homo sapiens
ugugggucuucca

SEQ ID NO: 681436 - RNA, 20 nt, Homo sapiens
uguggucaauccgaaguaug

SEQ ID NO: 681437 - RNA, 20 nt, Homo sapiens
uguggucacuuguaccauau

SEQ ID NO: 681438 - RNA, 21 nt, Homo sapiens
ugugguccgaagucuuccaua

SEQ ID NO: 681439 - RNA, 12 nt, Homo sapiens
uguggucucagg

SEQ ID NO: 681440 - RNA, 19 nt, Homo sapiens
uguggucugggcaccaccu

SEQ ID NO: 681441 - RNA, 16 nt, Homo sapiens
uguggugagaucaugc

SEQ ID NO: 681442 - RNA, 22 nt, Homo sapiens
uguggugagcagaaguggagcu

SEQ ID NO: 681443 - RNA, 12 nt, Homo sapiens
uguggugcuaca

SEQ ID NO: 681444 - RNA, 18 nt, Homo sapiens
ugugguggccucagcuga

SEQ ID NO: 681445 - RNA, 15 nt, Homo sapiens
ugugguuaccgagua

SEQ ID NO: 681446 - RNA, 21 nt, Homo sapiens
uguguaaauaauuugcacuga

SEQ ID NO: 681447 - RNA, 18 nt, Homo sapiens
uguguaauaagaaaguau

SEQ ID NO: 681448 - RNA, 13 nt, Homo sapiens
uguguaauaugca

SEQ ID NO: 681449 - RNA, 22 nt, Homo sapiens
uguguacaccugcggggccacc

SEQ ID NO: 681450 - RNA, 16 nt, Homo sapiens
uguguaccugugacua

SEQ ID NO: 681451 - RNA, 13 nt, Homo sapiens
uguguagauuuga

SEQ ID NO: 681452 - RNA, 21 nt, Homo sapiens
uguguagcucucacaugcaca

SEQ ID NO: 681453 - RNA, 22 nt, Homo sapiens
uguguagcucucacaugcacag

SEQ ID NO: 681454 - RNA, 22 nt, Homo sapiens
uguguauauaaauacaugcaca

SEQ ID NO: 681455 - RNA, 23 nt, Homo sapiens
uguguauauaguaugaaugcagu

SEQ ID NO: 681456 - RNA, 11 nt, Homo sapiens
uguguauauau

SEQ ID NO: 681457 - RNA, 14 nt, Homo sapiens
uguguauauguaga

SEQ ID NO: 681458 - RNA, 23 nt, Homo sapiens
uguguaucaguguuuaugugcua

SEQ ID NO: 681459 - RNA, 14 nt, Homo sapiens
uguguaugugcauu

SEQ ID NO: 681460 - RNA, 21 nt, Homo sapiens
uguguauuccacuuaggaaga

SEQ ID NO: 681461 - RNA, 17 nt, Homo sapiens
uguguauuuaacugccu

SEQ ID NO: 681462 - RNA, 20 nt, Homo sapiens
uguguauuuaagaaaagugu

SEQ ID NO: 681463 - RNA, 18 nt, Homo sapiens
uguguauuuccagugcaa

SEQ ID NO: 681464 - RNA, 19 nt, Homo sapiens
uguguauuuccagugcaau

SEQ ID NO: 681465 - RNA, 16 nt, Homo sapiens
ugugucaaaagccaga

SEQ ID NO: 681466 - RNA, 13 nt, Homo sapiens
ugugucauguaua

SEQ ID NO: 681467 - RNA, 13 nt, Homo sapiens
uguguccaugugu

SEQ ID NO: 681468 - RNA, 20 nt, Homo sapiens
uguguccaugugugugcaag

SEQ ID NO: 681469 - RNA, 18 nt, Homo sapiens
ugugucccccucugucca

SEQ ID NO: 681470 - RNA, 21 nt, Homo sapiens
uguguccccugaccuguccag

SEQ ID NO: 681471 - RNA, 18 nt, Homo sapiens
uguguccuugaacugagg

SEQ ID NO: 681472 - RNA, 15 nt, Homo sapiens
ugugucgcuuauguc

SEQ ID NO: 681473 - RNA, 18 nt, Homo sapiens
ugugucgcuuaugucuau

SEQ ID NO: 681474 - RNA, 19 nt, Homo sapiens
ugugucgcuuaugucuaua

SEQ ID NO: 681475 - RNA, 13 nt, Homo sapiens
ugugucugucagc

SEQ ID NO: 681476 - RNA, 14 nt, Homo sapiens
ugugucuucaauuu

SEQ ID NO: 681477 - RNA, 22 nt, Homo sapiens
ugugugaacguguauguaccua

SEQ ID NO: 681478 - RNA, 18 nt, Homo sapiens
ugugugaacuaacaugca

SEQ ID NO: 681479 - RNA, 18 nt, Homo sapiens
ugugugacauuccagggg

SEQ ID NO: 681480 - RNA, 17 nt, Homo sapiens
ugugugaccaacugugu

SEQ ID NO: 681481 - RNA, 17 nt, Homo sapiens
ugugugagaauaaacua

SEQ ID NO: 681482 - RNA, 21 nt, Homo sapiens
ugugugauuaaaugacacauu

SEQ ID NO: 681483 - RNA, 18 nt, Homo sapiens
ugugugauugacagcuuu

SEQ ID NO: 681484 - RNA, 17 nt, Homo sapiens
ugugugcaagugugugc

SEQ ID NO: 681485 - RNA, 19 nt, Homo sapiens
ugugugcacaugugugcgu

SEQ ID NO: 681486 - RNA, 12 nt, Homo sapiens
ugugugccacac

SEQ ID NO: 681487 - RNA, 13 nt, Homo sapiens
ugugugccacuca

SEQ ID NO: 681488 - RNA, 11 nt, Homo sapiens
ugugugccuuu

SEQ ID NO: 681489 - RNA, 14 nt, Homo sapiens
ugugugcuuuccca

SEQ ID NO: 681490 - RNA, 11 nt, Homo sapiens
ugugugguggg

SEQ ID NO: 681491 - RNA, 22 nt, Homo sapiens
uguguguauauaguaugaaugc

SEQ ID NO: 681492 - RNA, 12 nt, Homo sapiens
ugugugugauau

SEQ ID NO: 681493 - RNA, 14 nt, Homo sapiens
ugugugugugcaca

SEQ ID NO: 681494 - RNA, 15 nt, Homo sapiens
ugugugugugcacac

SEQ ID NO: 681495 - RNA, 16 nt, Homo sapiens
ugugugugugugcaca

SEQ ID NO: 681496 - RNA, 22 nt, Homo sapiens
uguguguuuaggccucauuucu

SEQ ID NO: 681497 - RNA, 15 nt, Homo sapiens
uguguguuugccaau

SEQ ID NO: 681498 - RNA, 21 nt, Homo sapiens
uguguuacugcuuugcaaaga

SEQ ID NO: 681499 - RNA, 22 nt, Homo sapiens
uguguuacugcuuugcaaagac

SEQ ID NO: 681500 - RNA, 21 nt, Homo sapiens
uguguuaugagaaauuaguca

SEQ ID NO: 681501 - RNA, 23 nt, Homo sapiens
uguguucacaaaggcagagaguc

SEQ ID NO: 681502 - RNA, 15 nt, Homo sapiens
uguguucaguacaau

SEQ ID NO: 681503 - RNA, 10 nt, Homo sapiens
uguguuccaa

SEQ ID NO: 681504 - RNA, 20 nt, Homo sapiens
uguguuccaacaaccauuuu

SEQ ID NO: 681505 - RNA, 16 nt, Homo sapiens
uguguugacugcugcu

SEQ ID NO: 681506 - RNA, 13 nt, Homo sapiens
uguguugccacag

SEQ ID NO: 681507 - RNA, 14 nt, Homo sapiens
uguguuggguugaa

SEQ ID NO: 681508 - RNA, 14 nt, Homo sapiens
uguguugucccauc

SEQ ID NO: 681509 - RNA, 22 nt, Homo sapiens
uguguugucuucagcagucaau

SEQ ID NO: 681510 - RNA, 20 nt, Homo sapiens
uguguuuuuaauaaagacag

SEQ ID NO: 681511 - RNA, 13 nt, Homo sapiens
uguuaaaaaccuu

SEQ ID NO: 681512 - RNA, 19 nt, Homo sapiens
uguuaaaauguacacugga

SEQ ID NO: 681513 - RNA, 18 nt, Homo sapiens
uguuaaagcaucagagau

SEQ ID NO: 681514 - RNA, 18 nt, Homo sapiens
uguuaacauggacaugau

SEQ ID NO: 681515 - RNA, 15 nt, Homo sapiens
uguuaacuguucaaa

SEQ ID NO: 681516 - RNA, 23 nt, Homo sapiens
uguuaagguccugaaaguaacuc

SEQ ID NO: 681517 - RNA, 15 nt, Homo sapiens
uguuaauagacuuaa

SEQ ID NO: 681518 - RNA, 14 nt, Homo sapiens
uguuaauaucuuga

SEQ ID NO: 681519 - RNA, 18 nt, Homo sapiens
uguuaauuauuuugacaa

SEQ ID NO: 681520 - RNA, 23 nt, Homo sapiens
uguuaauucacagaauagcacaa

SEQ ID NO: 681521 - RNA, 19 nt, Homo sapiens
uguuaauuuuuugguacaa

SEQ ID NO: 681522 - RNA, 18 nt, Homo sapiens
uguuaauuuuuuuuacua

SEQ ID NO: 681523 - RNA, 16 nt, Homo sapiens
uguuacagcuucgcug

SEQ ID NO: 681524 - RNA, 22 nt, Homo sapiens
uguuacauagguauauauaugc

SEQ ID NO: 681525 - RNA, 19 nt, Homo sapiens
uguuaccauacugucucug

SEQ ID NO: 681526 - RNA, 17 nt, Homo sapiens
uguuaccguucaccagu

SEQ ID NO: 681527 - RNA, 14 nt, Homo sapiens
uguuaccuguagau

SEQ ID NO: 681528 - RNA, 13 nt, Homo sapiens
uguuacugcaagu

SEQ ID NO: 681529 - RNA, 20 nt, Homo sapiens
uguuacuuuuucuuguauuc

SEQ ID NO: 681530 - RNA, 21 nt, Homo sapiens
uguuagaaaaauagcugugaa

SEQ ID NO: 681531 - RNA, 19 nt, Homo sapiens
uguuagauagaauuuccaa

SEQ ID NO: 681532 - RNA, 17 nt, Homo sapiens
uguuagauuccucuugc

SEQ ID NO: 681533 - RNA, 19 nt, Homo sapiens
uguuaggaguuaccuuaaa

SEQ ID NO: 681534 - RNA, 21 nt, Homo sapiens
uguuaguaaaggaaccauucc

SEQ ID NO: 681535 - RNA, 17 nt, Homo sapiens
uguuaguggaaaaugga

SEQ ID NO: 681536 - RNA, 19 nt, Homo sapiens
uguagaaugggaugugaua

SEQ ID NO: 681537 - RNA, 17 nt, Homo sapiens
uguagauaaacucagaa

SEQ ID NO: 681538 - RNA, 15 nt, Homo sapiens
uguagauacuagcua

SEQ ID NO: 681539 - RNA, 13 nt, Homo sapiens
uguagaugugcau

SEQ ID NO: 681540 - RNA, 15 nt, Homo sapiens
uguagauucagguaa

SEQ ID NO: 681541 - RNA, 21 nt, Homo sapiens
uguagauucagguaauacaaa

SEQ ID NO: 681542 - RNA, 12 nt, Homo sapiens
uguagcaaagau

SEQ ID NO: 681543 - RNA, 16 nt, Homo sapiens
uguagcaauggcacug

SEQ ID NO: 681544 - RNA, 14 nt, Homo sapiens
uguagcaauggcca

SEQ ID NO: 681545 - RNA, 22 nt, Homo sapiens
uguagcagcuauauauuucccc

SEQ ID NO: 681546 - RNA, 16 nt, Homo sapiens
uguagcauaacuguag

SEQ ID NO: 681547 - RNA, 20 nt, Homo sapiens
uguagcauuucuugauguug

SEQ ID NO: 681548 - RNA, 10 nt, Homo sapiens
uguagccaug

SEQ ID NO: 681549 - RNA, 16 nt, Homo sapiens
uguagcccauccuucc

SEQ ID NO: 681550 - RNA, 16 nt, Homo sapiens
uguagcucuuugccuc

SEQ ID NO: 681551 - RNA, 13 nt, Homo sapiens
uguagcugaugaa

SEQ ID NO: 681552 - RNA, 14 nt, Homo sapiens
uguagcugcuauau

SEQ ID NO: 681553 - RNA, 18 nt, Homo sapiens
uguagcuguuacugcaag

SEQ ID NO: 681554 - RNA, 19 nt, Homo sapiens
uguaggcagucauggcacc

SEQ ID NO: 681555 - RNA, 16 nt, Homo sapiens
uguaggguaaggugcc

SEQ ID NO: 681556 - RNA, 14 nt, Homo sapiens
ugucacugguggau

SEQ ID NO: 681557 - RNA, 19 nt, Homo sapiens
ugucacuugccacauggug

SEQ ID NO: 681558 - RNA, 22 nt, Homo sapiens
ugucagaaaccugcagggacuc

SEQ ID NO: 681559 - RNA, 14 nt, Homo sapiens
ugucagagcccagg

SEQ ID NO: 681560 - RNA, 19 nt, Homo sapiens
ugucagauagucuauguau

SEQ ID NO: 681561 - RNA, 17 nt, Homo sapiens
ugucagauguacauaga

SEQ ID NO: 681562 - RNA, 20 nt, Homo sapiens
ugucagcagggacuguaaac

SEQ ID NO: 681563 - RNA, 22 nt, Homo sapiens
ugucagccaccucccucugcca

SEQ ID NO: 681564 - RNA, 12 nt, Homo sapiens
ugucagccugac

SEQ ID NO: 681565 - RNA, 15 nt, Homo sapiens
ugucaggguccagga

SEQ ID NO: 681566 - RNA, 16 nt, Homo sapiens
ugucagucacagccac

SEQ ID NO: 681567 - RNA, 16 nt, Homo sapiens
ugucagucagggacaa

SEQ ID NO: 681568 - RNA, 16 nt, Homo sapiens
ugucagugacaguauu

SEQ ID NO: 681569 - RNA, 20 nt, Homo sapiens
ugucagugacuuugagcuga

SEQ ID NO: 681570 - RNA, 12 nt, Homo sapiens
ugucagugcagc

SEQ ID NO: 681571 - RNA, 15 nt, Homo sapiens
ugucauagagcugca

SEQ ID NO: 681572 - RNA, 22 nt, Homo sapiens
ugucauauaauaaaaaaauuag

SEQ ID NO: 681573 - RNA, 12 nt, Homo sapiens
ugucauaugcag

SEQ ID NO: 681574 - RNA, 13 nt, Homo sapiens
ugucauauggaau

SEQ ID NO: 681575 - RNA, 20 nt, Homo sapiens
ugucaucagccaccauccua

SEQ ID NO: 681576 - RNA, 17 nt, Homo sapiens
ugucaucagccugugua

SEQ ID NO: 681577 - RNA, 23 nt, Homo sapiens
ugucaugucucugguggugcugg

SEQ ID NO: 681578 - RNA, 14 nt, Homo sapiens
ugucaugugccuug

SEQ ID NO: 681579 - RNA, 19 nt, Homo sapiens
ugucauucaagccugugaa

SEQ ID NO: 681580 - RNA, 15 nt, Homo sapiens
ugucauuguaaacaa

SEQ ID NO: 681581 - RNA, 16 nt, Homo sapiens
ugucauuucauuccau

SEQ ID NO: 681582 - RNA, 19 nt, Homo sapiens
ugucauuucauuccauugc

SEQ ID NO: 681583 - RNA, 14 nt, Homo sapiens
uguccaaaacugcc

SEQ ID NO: 681584 - RNA, 18 nt, Homo sapiens
uguccaaaacugccucag

SEQ ID NO: 681585 - RNA, 17 nt, Homo sapiens
uguccaccugugcugcu

SEQ ID NO: 681586 - RNA, 18 nt, Homo sapiens
uguccaccugugcugcug

SEQ ID NO: 681587 - RNA, 15 nt, Homo sapiens
uguccagcacaccug

SEQ ID NO: 681588 - RNA, 23 nt, Homo sapiens
uguccaggagaaaccucacaaac

SEQ ID NO: 681589 - RNA, 17 nt, Homo sapiens
uguccaggcacugagau

SEQ ID NO: 681590 - RNA, 17 nt, Homo sapiens
uguccaggcucugggca

SEQ ID NO: 681591 - RNA, 18 nt, Homo sapiens
uguccauaagcuacgggu

SEQ ID NO: 681592 - RNA, 22 nt, Homo sapiens
uguccaucagccaggacaguca

SEQ ID NO: 681593 - RNA, 17 nt, Homo sapiens
uguccaugugugugcaa

SEQ ID NO: 681594 - RNA, 22 nt, Homo sapiens
uguccauuuacagcccucagca

SEQ ID NO: 681595 - RNA, 16 nt, Homo sapiens
uguccauuuauaucau

SEQ ID NO: 681596 - RNA, 19 nt, Homo sapiens
ugucccaccaacucugcac

SEQ ID NO: 681597 - RNA, 17 nt, Homo sapiens
ugucccacuaucugggu

SEQ ID NO: 681598 - RNA, 13 nt, Homo sapiens
ugucccagaguua

SEQ ID NO: 681599 - RNA, 16 nt, Homo sapiens
ugucccaggacucacc

SEQ ID NO: 681600 - RNA, 21 nt, Homo sapiens
ugucccaguaaagccaaugac

SEQ ID NO: 681601 - RNA, 15 nt, Homo sapiens
ugucccaucugcccu

SEQ ID NO: 681602 - RNA, 12 nt, Homo sapiens
ugucccaugcag

SEQ ID NO: 681603 - RNA, 21 nt, Homo sapiens
uguccccccuugaagcaauaa

SEQ ID NO: 681604 - RNA, 19 nt, Homo sapiens
uguccccgccuucccucac

SEQ ID NO: 681605 - RNA, 19 nt, Homo sapiens
uguccccuaaaccaaaaac

SEQ ID NO: 681606 - RNA, 15 nt, Homo sapiens
uguccccuccacugu

SEQ ID NO: 681607 - RNA, 16 nt, Homo sapiens
uguccccuccacuguc

SEQ ID NO: 681608 - RNA, 17 nt, Homo sapiens
uguccccuccacuguca

SEQ ID NO: 681609 - RNA, 23 nt, Homo sapiens
uguccccuccccucuguuuacau

SEQ ID NO: 681610 - RNA, 16 nt, Homo sapiens
uguccccugacagggc

SEQ ID NO: 681611 - RNA, 16 nt, Homo sapiens
ugucccucacuguuga

SEQ ID NO: 681612 - RNA, 13 nt, Homo sapiens
ugucccucugccc

SEQ ID NO: 681613 - RNA, 14 nt, Homo sapiens
ugucccucugcuac

SEQ ID NO: 681614 - RNA, 22 nt, Homo sapiens
ugucccugccccgccccccaga

SEQ ID NO: 681615 - RNA, 15 nt, Homo sapiens
ugucccuguagcuca

SEQ ID NO: 681616 - RNA, 18 nt, Homo sapiens
uguccggcccagugccac

SEQ ID NO: 681617 - RNA, 13 nt, Homo sapiens
uguccgugauaau

SEQ ID NO: 681618 - RNA, 13 nt, Homo sapiens
uguccuaaaugca

SEQ ID NO: 681619 - RNA, 14 nt, Homo sapiens
uguccuaagcacuu

SEQ ID NO: 681620 - RNA, 19 nt, Homo sapiens
uguccuaccaguugcccua

SEQ ID NO: 681621 - RNA, 13 nt, Homo sapiens
uguccuaugcgcu

SEQ ID NO: 681622 - RNA, 20 nt, Homo sapiens
uguccucagggcuacagcag

SEQ ID NO: 681623 - RNA, 13 nt, Homo sapiens
uguccuccaacac

SEQ ID NO: 681624 - RNA, 14 nt, Homo sapiens
uguccuccuggaag

SEQ ID NO: 681625 - RNA, 21 nt, Homo sapiens
uguccucucuuuaugcuugcu

SEQ ID NO: 681626 - RNA, 22 nt, Homo sapiens
uguccucuugccuuuuacuuaa

SEQ ID NO: 681627 - RNA, 15 nt, Homo sapiens
uguccucuugcucaa

SEQ ID NO: 681628 - RNA, 17 nt, Homo sapiens
uguccucuuugugauaa

SEQ ID NO: 681629 - RNA, 15 nt, Homo sapiens
uguccugaucuguga

SEQ ID NO: 681630 - RNA, 21 nt, Homo sapiens
uguccugaugcuuuugucuaa

SEQ ID NO: 681631 - RNA, 13 nt, Homo sapiens
uguccugggguau

SEQ ID NO: 681632 - RNA, 19 nt, Homo sapiens
uguccuguccuuucuugca

SEQ ID NO: 681633 - RNA, 14 nt, Homo sapiens
uguccuuccugacc

SEQ ID NO: 681634 - RNA, 20 nt, Homo sapiens
uguccuucuacagaaccuga

SEQ ID NO: 681635 - RNA, 22 nt, Homo sapiens
uguccuuguggucuuugcugcu

SEQ ID NO: 681636 - RNA, 12 nt, Homo sapiens
uguccuuuauga

SEQ ID NO: 681637 - RNA, 17 nt, Homo sapiens
ugucgauuuaugccuca

SEQ ID NO: 681638 - RNA, 15 nt, Homo sapiens
ugucggcggcuugau

SEQ ID NO: 681639 - RNA, 17 nt, Homo sapiens
ugucggcuuuuugccau

SEQ ID NO: 681640 - RNA, 16 nt, Homo sapiens
ugucgggaauuuuccc

SEQ ID NO: 681641 - RNA, 18 nt, Homo sapiens
ugucgggcccuucuugcu

SEQ ID NO: 681642 - RNA, 18 nt, Homo sapiens
ugucgguuaccucugcau

SEQ ID NO: 681643 - RNA, 18 nt, Homo sapiens
ugucgucuuagcaagaag

SEQ ID NO: 681644 - RNA, 22 nt, Homo sapiens
ugucguuuucacauaugacaau

SEQ ID NO: 681645 - RNA, 20 nt, Homo sapiens
ugucuaacuggggauauaau

SEQ ID NO: 681646 - RNA, 19 nt, Homo sapiens
ugucuaauagcccauaaag

SEQ ID NO: 681647 - RNA, 18 nt, Homo sapiens
ugucuacacacccugcau

SEQ ID NO: 681648 - RNA, 11 nt, Homo sapiens
ugucuaccugg

SEQ ID NO: 681649 - RNA, 16 nt, Homo sapiens
ugucuacuaagugaug

SEQ ID NO: 681650 - RNA, 12 nt, Homo sapiens
ugucuacugugg

SEQ ID NO: 681651 - RNA, 17 nt, Homo sapiens
ugucuagacugccaggg

SEQ ID NO: 681652 - RNA, 16 nt, Homo sapiens
ugucuauaauggaaac

SEQ ID NO: 681653 - RNA, 22 nt, Homo sapiens
ugucuauaucauaacuauacuu

SEQ ID NO: 681654 - RNA, 20 nt, Homo sapiens
ugucucaaaggagcuuucuc

SEQ ID NO: 681655 - RNA, 18 nt, Homo sapiens
ugucucagacugcaugua

SEQ ID NO: 681656 - RNA, 19 nt, Homo sapiens
ugucucauaguuguguuaa

SEQ ID NO: 681657 - RNA, 21 nt, Homo sapiens
ugucuccagggcccccaccga

SEQ ID NO: 681658 - RNA, 21 nt, Homo sapiens
ugucucggagggauuccccua

SEQ ID NO: 681659 - RNA, 20 nt, Homo sapiens
ugucucuaaaggaagaaaua

SEQ ID NO: 681660 - RNA, 13 nt, Homo sapiens
ugucucuaccuaa

SEQ ID NO: 681661 - RNA, 20 nt, Homo sapiens
ugucucugggccacuuggag

SEQ ID NO: 681662 - RNA, 16 nt, Homo sapiens
ugucucuucugagcua

SEQ ID NO: 681663 - RNA, 16 nt, Homo sapiens
ugucugacaaccucuu

SEQ ID NO: 681664 - RNA, 13 nt, Homo sapiens
ugucugccaaaca

SEQ ID NO: 681665 - RNA, 19 nt, Homo sapiens
ugucugccagccagcagcc

SEQ ID NO: 681666 - RNA, 16 nt, Homo sapiens
ugucugcuuucuccau

SEQ ID NO: 681667 - RNA, 19 nt, Homo sapiens
ugucuggagugacagacca

SEQ ID NO: 681668 - RNA, 15 nt, Homo sapiens
ugucuggccaggccu

SEQ ID NO: 681669 - RNA, 14 nt, Homo sapiens
ugucuggcuucuag

SEQ ID NO: 681670 - RNA, 19 nt, Homo sapiens
ugucuguaaugacaaauaa

SEQ ID NO: 681671 - RNA, 12 nt, Homo sapiens
ugucugugccau

SEQ ID NO: 681672 - RNA, 13 nt, Homo sapiens
ugucugugccaug

SEQ ID NO: 681673 - RNA, 16 nt, Homo sapiens
ugucuguggggugguu

SEQ ID NO: 681674 - RNA, 14 nt, Homo sapiens
ugucugugugauuu

SEQ ID NO: 681675 - RNA, 17 nt, Homo sapiens
ugucugugugcaagugu

SEQ ID NO: 681676 - RNA, 15 nt, Homo sapiens
ugucuuaacugucac

SEQ ID NO: 681677 - RNA, 17 nt, Homo sapiens
ugucuuagugcaaaaaa

SEQ ID NO: 681678 - RNA, 13 nt, Homo sapiens
ugucuucagagaa

SEQ ID NO: 681679 - RNA, 20 nt, Homo sapiens
ugucuucagcacccucauaa

SEQ ID NO: 681680 - RNA, 15 nt, Homo sapiens
aauuauugacacuga

SEQ ID NO: 681681 - RNA, 16 nt, Homo sapiens
aauuauuguaaacuuu

SEQ ID NO: 681682 - RNA, 19 nt, Homo sapiens
aauuauuguuauacacagc

SEQ ID NO: 681683 - RNA, 16 nt, Homo sapiens
aauuauuucugucaca

SEQ ID NO: 681684 - RNA, 13 nt, Homo sapiens
aauuauuugcuaa

SEQ ID NO: 681685 - RNA, 16 nt, Homo sapiens
aauuauuuugacaaau

SEQ ID NO: 681686 - RNA, 21 nt, Homo sapiens
aauuauuuuugagacugucag

SEQ ID NO: 681687 - RNA, 20 nt, Homo sapiens
aauucaaucagagcuccagu

SEQ ID NO: 681688 - RNA, 15 nt, Homo sapiens
aauucacacaaagac

SEQ ID NO: 681689 - RNA, 20 nt, Homo sapiens
aauucacaugaugcacuuca

SEQ ID NO: 681690 - RNA, 20 nt, Homo sapiens
aauucagaucaaaaugccuu

SEQ ID NO: 681691 - RNA, 14 nt, Homo sapiens
aauucagcaccagu

SEQ ID NO: 681692 - RNA, 13 nt, Homo sapiens
aauucagcacuga

SEQ ID NO: 681693 - RNA, 19 nt, Homo sapiens
aauucagcacugauuucac

SEQ ID NO: 681694 - RNA, 13 nt, Homo sapiens
aauucagcacuua

SEQ ID NO: 681695 - RNA, 22 nt, Homo sapiens
aauucaguaacaaagguuuaaa

SEQ ID NO: 681696 - RNA, 15 nt, Homo sapiens
aauucagucucugaa

SEQ ID NO: 681697 - RNA, 22 nt, Homo sapiens
aauucauugagcaguuagcuca

SEQ ID NO: 681698 - RNA, 16 nt, Homo sapiens
aauucauuugcuugca

SEQ ID NO: 681699 - RNA, 11 nt, Homo sapiens
aauucauuugu

SEQ ID NO: 681700 - RNA, 21 nt, Homo sapiens
aauucauuuucaucacuggga

SEQ ID NO: 681701 - RNA, 18 nt, Homo sapiens
aauuccaaacacauacag

SEQ ID NO: 681702 - RNA, 23 nt, Homo sapiens
aauuccagaggacucugcuuaaa

SEQ ID NO: 681703 - RNA, 18 nt, Homo sapiens
aauuccagcaaaagagcu

SEQ ID NO: 681704 - RNA, 18 nt, Homo sapiens
aauuccaucccaucaucu

SEQ ID NO: 681705 - RNA, 20 nt, Homo sapiens
aauucccccuuaaacuucca

SEQ ID NO: 681706 - RNA, 14 nt, Homo sapiens
aauucccugcuaaa

SEQ ID NO: 681707 - RNA, 20 nt, Homo sapiens
aauuccuacacucuugacua

SEQ ID NO: 681708 - RNA, 16 nt, Homo sapiens
aauuccuagucacaau

SEQ ID NO: 681709 - RNA, 13 nt, Homo sapiens
aauuccucuggga

SEQ ID NO: 681710 - RNA, 16 nt, Homo sapiens
aauuccucuuacugua

SEQ ID NO: 681711 - RNA, 23 nt, Homo sapiens
aauuccuuagcuuagaccucagc

SEQ ID NO: 681712 - RNA, 15 nt, Homo sapiens
aauuccuugcacaua

SEQ ID NO: 681713 - RNA, 15 nt, Homo sapiens
aauucggugugcacc

SEQ ID NO: 681714 - RNA, 22 nt, Homo sapiens
aauucuaccuccuuguguugca

SEQ ID NO: 681715 - RNA, 14 nt, Homo sapiens
aauucuacuggaaa

SEQ ID NO: 681716 - RNA, 13 nt, Homo sapiens
aauguacaauuau

SEQ ID NO: 681717 - RNA, 21 nt, Homo sapiens
aauguacaauuaugucucuug

SEQ ID NO: 681718 - RNA, 14 nt, Homo sapiens
aauguacacugauu

SEQ ID NO: 681719 - RNA, 16 nt, Homo sapiens
aauguacagacauauu

SEQ ID NO: 681720 - RNA, 19 nt, Homo sapiens
aauguacagaguaaccuau

SEQ ID NO: 681721 - RNA, 17 nt, Homo sapiens
aauguaccggcuuccau

SEQ ID NO: 681722 - RNA, 16 nt, Homo sapiens
aauguaccugauguac

SEQ ID NO: 681723 - RNA, 12 nt, Homo sapiens
aauguagacuuu

SEQ ID NO: 681724 - RNA, 20 nt, Homo sapiens
aauguagacuuuugcuuuau

SEQ ID NO: 681725 - RNA, 21 nt, Homo sapiens
aauguaucauuuuugugcaca

SEQ ID NO: 681726 - RNA, 14 nt, Homo sapiens
aauguaucugugaa

SEQ ID NO: 681727 - RNA, 21 nt, Homo sapiens
aauguaucugugugugauuug

SEQ ID NO: 681728 - RNA, 15 nt, Homo sapiens
aauguaugauuacau

SEQ ID NO: 681729 - RNA, 21 nt, Homo sapiens
aauguaugcauucacauuuag

SEQ ID NO: 681730 - RNA, 14 nt, Homo sapiens
aauguauguacaau

SEQ ID NO: 681731 - RNA, 14 nt, Homo sapiens
aauguaugugcucu

SEQ ID NO: 681732 - RNA, 11 nt, Homo sapiens
aauguauuuaa

SEQ ID NO: 681733 - RNA, 17 nt, Homo sapiens
aauguauuuguuugcaa

SEQ ID NO: 681734 - RNA, 21 nt, Homo sapiens
aaugucacaauuaugugcaaa

SEQ ID NO: 681735 - RNA, 14 nt, Homo sapiens
aaugucacuuaaag

SEQ ID NO: 681736 - RNA, 21 nt, Homo sapiens
aaugucaguuacaauaugaga

SEQ ID NO: 681737 - RNA, 14 nt, Homo sapiens
aaugucauagguaa

SEQ ID NO: 681738 - RNA, 14 nt, Homo sapiens
aaugucauggccuu

SEQ ID NO: 681739 - RNA, 19 nt, Homo sapiens
aaugucauuaaacaugaca

SEQ ID NO: 681740 - RNA, 15 nt, Homo sapiens
aaugucauugcuaaa

SEQ ID NO: 681741 - RNA, 16 nt, Homo sapiens
aauguccauuugcuga

SEQ ID NO: 681742 - RNA, 19 nt, Homo sapiens
aauguccccacgguacuua

SEQ ID NO: 681743 - RNA, 16 nt, Homo sapiens
aauguccccuuagguc

SEQ ID NO: 681744 - RNA, 20 nt, Homo sapiens
aauguccugaaacaugaacc

SEQ ID NO: 681745 - RNA, 22 nt, Homo sapiens
aaugucgauuaaaaucacucuc

SEQ ID NO: 681746 - RNA, 12 nt, Homo sapiens
aaugucuaucaa

SEQ ID NO: 681747 - RNA, 15 nt, Homo sapiens
aaugucucacuguuc

SEQ ID NO: 681748 - RNA, 14 nt, Homo sapiens
aaugucucauguca

SEQ ID NO: 681749 - RNA, 11 nt, Homo sapiens
aaugucuccca

SEQ ID NO: 681750 - RNA, 14 nt, Homo sapiens
aaugucucccacac

SEQ ID NO: 681751 - RNA, 16 nt, Homo sapiens
aaugucuguuaacuua

SEQ ID NO: 681752 - RNA, 17 nt, Homo sapiens
aaugucuuaaugcaaau

SEQ ID NO: 681753 - RNA, 16 nt, Homo sapiens
aaugucuucaugaccu

SEQ ID NO: 681754 - RNA, 14 nt, Homo sapiens
aaugucuucuccca

SEQ ID NO: 681755 - RNA, 23 nt, Homo sapiens
acaaaucuccucgacugcuuuag

SEQ ID NO: 681756 - RNA, 19 nt, Homo sapiens
acaaaugaauaaaugcaua

SEQ ID NO: 681757 - RNA, 14 nt, Homo sapiens
acaaaugacuguau

SEQ ID NO: 681758 - RNA, 13 nt, Homo sapiens
acaaaugcaguau

SEQ ID NO: 681759 - RNA, 16 nt, Homo sapiens
acaaaugcaguauaua

SEQ ID NO: 681760 - RNA, 18 nt, Homo sapiens
acaaaugggaaaaccaga

SEQ ID NO: 681761 - RNA, 21 nt, Homo sapiens
acaaaugugauaauauauugc

SEQ ID NO: 681762 - RNA, 13 nt, Homo sapiens
acaaauuccacag

SEQ ID NO: 681763 - RNA, 17 nt, Homo sapiens
acaaauuuggccuuaag

SEQ ID NO: 681764 - RNA, 24 nt, Homo sapiens
acaaauuuggccuuaagaacugug

SEQ ID NO: 681765 - RNA, 17 nt, Homo sapiens
acaacaaaaaccaaaaa

SEQ ID NO: 681766 - RNA, 14 nt, Homo sapiens
acaacaaaaagcuu

SEQ ID NO: 681767 - RNA, 13 nt, Homo sapiens
acaacaaagagaa

SEQ ID NO: 681768 - RNA, 16 nt, Homo sapiens
acaacaauccuucuau

SEQ ID NO: 681769 - RNA, 10 nt, Homo sapiens
acaacacuga

SEQ ID NO: 681770 - RNA, 13 nt, Homo sapiens
acaacacugggaa

SEQ ID NO: 681771 - RNA, 13 nt, Homo sapiens
acaacagauguac

SEQ ID NO: 681772 - RNA, 23 nt, Homo sapiens
acaacagcaaaacuccaucucaa

SEQ ID NO: 681773 - RNA, 13 nt, Homo sapiens
acaacagcaucuu

SEQ ID NO: 681774 - RNA, 13 nt, Homo sapiens
acaacagugcauu

SEQ ID NO: 681775 - RNA, 23 nt, Homo sapiens
acaacagugcuuuguaaauugug

SEQ ID NO: 681776 - RNA, 22 nt, Homo sapiens
acaacauaaucuaguuuacaga

SEQ ID NO: 681777 - RNA, 15 nt, Homo sapiens
acaacauaucucagg

SEQ ID NO: 681778 - RNA, 19 nt, Homo sapiens
acaaccaauuccaaguuuu

SEQ ID NO: 681779 - RNA, 20 nt, Homo sapiens
acaacccacaccgucuuccu

SEQ ID NO: 681780 - RNA, 15 nt, Homo sapiens
acaacgucucuucaa

SEQ ID NO: 681781 - RNA, 13 nt, Homo sapiens
acaacuaccuccu

SEQ ID NO: 681782 - RNA, 17 nt, Homo sapiens
acaacucggggacaaau

SEQ ID NO: 681783 - RNA, 17 nt, Homo sapiens
acaacucugaaagagaa

SEQ ID NO: 681784 - RNA, 19 nt, Homo sapiens
acaacuggacucauuauca

SEQ ID NO: 681785 - RNA, 22 nt, Homo sapiens
acaacuggacucauuaucacag

SEQ ID NO: 681786 - RNA, 18 nt, Homo sapiens
acaacuucaggagcucuu

SEQ ID NO: 681787 - RNA, 23 nt, Homo sapiens
acaacuuucuccuacucuuccuu

SEQ ID NO: 681788 - RNA, 12 nt, Homo sapiens
acaacuuugcaa

SEQ ID NO: 681789 - RNA, 14 nt, Homo sapiens
acaacuuugugcuu

SEQ ID NO: 681790 - RNA, 22 nt, Homo sapiens
acaagaaagucauuagacggua

SEQ ID NO: 681791 - RNA, 16 nt, Homo sapiens
acaagaacaaagccac

SEQ ID NO: 681792 - RNA, 14 nt, Homo sapiens
acaagaagacuguc

SEQ ID NO: 681793 - RNA, 15 nt, Homo sapiens
acaagaagcccagug

SEQ ID NO: 681794 - RNA, 18 nt, Homo sapiens
acaagaauguaacuccag

SEQ ID NO: 681795 - RNA, 16 nt, Homo sapiens
acaagaaugugcacuc

SEQ ID NO: 681796 - RNA, 22 nt, Homo sapiens
acaagacaggacccugggacca

SEQ ID NO: 681797 - RNA, 18 nt, Homo sapiens
acaagacccccagcacuu

SEQ ID NO: 681798 - RNA, 18 nt, Homo sapiens
acaagaccccgucucaaa

SEQ ID NO: 681799 - RNA, 19 nt, Homo sapiens
acaagacugccauauuaaa

SEQ ID NO: 681800 - RNA, 19 nt, Homo sapiens
acaagagaggcgucugcug

SEQ ID NO: 681801 - RNA, 16 nt, Homo sapiens
acaagagugaauuuga

SEQ ID NO: 681802 - RNA, 19 nt, Homo sapiens
acaagagugaauuugaccu

SEQ ID NO: 681803 - RNA, 21 nt, Homo sapiens
acaagagugagacuccaccuc

SEQ ID NO: 681804 - RNA, 22 nt, Homo sapiens
acaagagugagacuccaccuca

SEQ ID NO: 681805 - RNA, 20 nt, Homo sapiens
acaagauccuuaaugcagag

SEQ ID NO: 681806 - RNA, 14 nt, Homo sapiens
acaagaucuuucca

SEQ ID NO: 681807 - RNA, 21 nt, Homo sapiens
acaagaugcugcaaugugagu

SEQ ID NO: 681808 - RNA, 16 nt, Homo sapiens
acaagcaacaaaccuc

SEQ ID NO: 681809 - RNA, 19 nt, Homo sapiens
acaagcauaacauggagcu

SEQ ID NO: 681810 - RNA, 13 nt, Homo sapiens
acaagcaugaucu

SEQ ID NO: 681811 - RNA, 17 nt, Homo sapiens
acaagccaacuuguaaa

SEQ ID NO: 681812 - RNA, 19 nt, Homo sapiens
acaagccacaagucuucca

SEQ ID NO: 681813 - RNA, 23 nt, Homo sapiens
acaagccuccuguaccucagugg

SEQ ID NO: 681814 - RNA, 17 nt, Homo sapiens
acaagcuauucccucaa

SEQ ID NO: 681815 - RNA, 16 nt, Homo sapiens
acaagcugcacuguga

SEQ ID NO: 681816 - RNA, 16 nt, Homo sapiens
acaagcugccucugac

SEQ ID NO: 681817 - RNA, 17 nt, Homo sapiens
acaagcuggaagcacau

SEQ ID NO: 681818 - RNA, 15 nt, Homo sapiens
acaagcuuuaugugg

SEQ ID NO: 681819 - RNA, 13 nt, Homo sapiens
acaagcuuuccaa

SEQ ID NO: 681820 - RNA, 17 nt, Homo sapiens
acaaggaagccaaaguu

SEQ ID NO: 681821 - RNA, 17 nt, Homo sapiens
acaaggcuaacauccca

SEQ ID NO: 681822 - RNA, 17 nt, Homo sapiens
acaaggcuacgcugaca

SEQ ID NO: 681823 - RNA, 18 nt, Homo sapiens
acaaggcuggcagugaca

SEQ ID NO: 681824 - RNA, 23 nt, Homo sapiens
acaagggagaagagugucagaau

SEQ ID NO: 681825 - RNA, 17 nt, Homo sapiens
acaagggcaggucuuca

SEQ ID NO: 681826 - RNA, 23 nt, Homo sapiens
acaaggugagugugacuucccuu

SEQ ID NO: 681827 - RNA, 23 nt, Homo sapiens
acaaggugguaugguuguauaca

SEQ ID NO: 681828 - RNA, 19 nt, Homo sapiens
acaagguugguugcuaaga

SEQ ID NO: 681829 - RNA, 18 nt, Homo sapiens
acaaguaaaacuguggua

SEQ ID NO: 681830 - RNA, 21 nt, Homo sapiens
acaaguaccacucuuggucag

SEQ ID NO: 681831 - RNA, 22 nt, Homo sapiens
acaaguacugguugacuuucua

SEQ ID NO: 681832 - RNA, 19 nt, Homo sapiens
acaaguauauaauauguca

SEQ ID NO: 681833 - RNA, 22 nt, Homo sapiens
acaaguauauaauaugucaccu

SEQ ID NO: 681834 - RNA, 17 nt, Homo sapiens
acaagucgaugaacuau

SEQ ID NO: 681835 - RNA, 14 nt, Homo sapiens
acaagucuuccaga

SEQ ID NO: 681836 - RNA, 12 nt, Homo sapiens
acaagugguggu

SEQ ID NO: 681837 - RNA, 21 nt, Homo sapiens
acaaguugcgacggagagaaa

SEQ ID NO: 681838 - RNA, 16 nt, Homo sapiens
acaaguuggaauucac

SEQ ID NO: 681839 - RNA, 19 nt, Homo sapiens
acaaguuggaugcggccau

SEQ ID NO: 681840 - RNA, 15 nt, Homo sapiens
acaaguuucagacag

SEQ ID NO: 681841 - RNA, 14 nt, Homo sapiens
acaaguuugcuaaa

SEQ ID NO: 681842 - RNA, 18 nt, Homo sapiens
acaaguuuuaauccagaa

SEQ ID NO: 681843 - RNA, 15 nt, Homo sapiens
acaauaaaagagcuu

SEQ ID NO: 681844 - RNA, 22 nt, Homo sapiens
acaauaaacucgugacuugucc

SEQ ID NO: 681845 - RNA, 16 nt, Homo sapiens
acaauaaagcaaugug

SEQ ID NO: 681846 - RNA, 17 nt, Homo sapiens
acaccccucccugccac

SEQ ID NO: 681847 - RNA, 23 nt, Homo sapiens
acacccuauauuuugcauaguac

SEQ ID NO: 681848 - RNA, 18 nt, Homo sapiens
acacccuuucaucucaga

SEQ ID NO: 681849 - RNA, 16 nt, Homo sapiens
acaccgguucccugaa

SEQ ID NO: 681850 - RNA, 16 nt, Homo sapiens
acaccgucccucagug

SEQ ID NO: 681851 - RNA, 19 nt, Homo sapiens
acaccgucccucagugaua

SEQ ID NO: 681852 - RNA, 20 nt, Homo sapiens
acaccgugggucauuacaaa

SEQ ID NO: 681853 - RNA, 19 nt, Homo sapiens
acaccguguaaaccaaagc

SEQ ID NO: 681854 - RNA, 20 nt, Homo sapiens
acaccguguaaaccaaagcc

SEQ ID NO: 681855 - RNA, 12 nt, Homo sapiens
acaccuaccuga

SEQ ID NO: 681856 - RNA, 15 nt, Homo sapiens
acaccuacucuauca

SEQ ID NO: 681857 - RNA, 20 nt, Homo sapiens
acaccucaagguguucucug

SEQ ID NO: 681858 - RNA, 21 nt, Homo sapiens
acaccucagaggcuguucuug

SEQ ID NO: 681859 - RNA, 23 nt, Homo sapiens
acaccucaguucccuuggccuca

SEQ ID NO: 681860 - RNA, 20 nt, Homo sapiens
acaccucauagguaugauuu

SEQ ID NO: 681861 - RNA, 24 nt, Homo sapiens
acaccucccccuuucacacuggau

SEQ ID NO: 681862 - RNA, 14 nt, Homo sapiens
acaccuccucucac

SEQ ID NO: 681863 - RNA, 21 nt, Homo sapiens
acaccugagcgcuguggacug

SEQ ID NO: 681864 - RNA, 18 nt, Homo sapiens
acaccugaugaccuguua

SEQ ID NO: 681865 - RNA, 17 nt, Homo sapiens
acaccugccucugaccc

SEQ ID NO: 681866 - RNA, 18 nt, Homo sapiens
acaccugccuucuacccu

SEQ ID NO: 681867 - RNA, 14 nt, Homo sapiens
acaccugcugagaa

SEQ ID NO: 681868 - RNA, 16 nt, Homo sapiens
acaccuggaccauuug

SEQ ID NO: 681869 - RNA, 19 nt, Homo sapiens
acaccugggccgggcugua

SEQ ID NO: 681870 - RNA, 22 nt, Homo sapiens
acaccuggguggacacaaggca

SEQ ID NO: 681871 - RNA, 15 nt, Homo sapiens
acaccuguacauucu

SEQ ID NO: 681872 - RNA, 18 nt, Homo sapiens
acaccuguagucccagcu

SEQ ID NO: 681873 - RNA, 16 nt, Homo sapiens
acaccuuagguugaca

SEQ ID NO: 681874 - RNA, 14 nt, Homo sapiens
acaccuucuuggcu

SEQ ID NO: 681875 - RNA, 12 nt, Homo sapiens
acaccuuggccu

SEQ ID NO: 681876 - RNA, 23 nt, Homo sapiens
acacgaagggugaggcugacaca

SEQ ID NO: 681877 - RNA, 17 nt, Homo sapiens
acacgagcaaacccaga

SEQ ID NO: 681878 - RNA, 14 nt, Homo sapiens
acacgaugcauuua

SEQ ID NO: 681879 - RNA, 15 nt, Homo sapiens
accaauugugcugcc

SEQ ID NO: 681880 - RNA, 20 nt, Homo sapiens
accaauugugcugccauuug

SEQ ID NO: 681881 - RNA, 20 nt, Homo sapiens
accacaaaaauugacucaaa

SEQ ID NO: 681882 - RNA, 22 nt, Homo sapiens
accacaaaggacccaaucccca

SEQ ID NO: 681883 - RNA, 15 nt, Homo sapiens
accacaagcaaaauc

SEQ ID NO: 681884 - RNA, 11 nt, Homo sapiens
accacacaaag

SEQ ID NO: 681885 - RNA, 16 nt, Homo sapiens
accacacaggagaagc

SEQ ID NO: 681886 - RNA, 16 nt, Homo sapiens
accacacauauugcac

SEQ ID NO: 681887 - RNA, 21 nt, Homo sapiens
accacaccuggcccuugcaau

SEQ ID NO: 681888 - RNA, 13 nt, Homo sapiens
accacacugaguu

SEQ ID NO: 681889 - RNA, 14 nt, Homo sapiens
accacacuucuuga

SEQ ID NO: 681890 - RNA, 20 nt, Homo sapiens
accacagagcugucacuuuu

SEQ ID NO: 681891 - RNA, 15 nt, Homo sapiens
accacagcaacugac

SEQ ID NO: 681892 - RNA, 16 nt, Homo sapiens
accacagcacagccaa

SEQ ID NO: 681893 - RNA, 13 nt, Homo sapiens
accacagcugcag

SEQ ID NO: 681894 - RNA, 14 nt, Homo sapiens
accacaggcaugca

SEQ ID NO: 681895 - RNA, 11 nt, Homo sapiens
accacaggcuu

SEQ ID NO: 681896 - RNA, 17 nt, Homo sapiens
accacagguucaugcca

SEQ ID NO: 681897 - RNA, 18 nt, Homo sapiens
accacauagaacaugugu

SEQ ID NO: 681898 - RNA, 20 nt, Homo sapiens
accacauccugaaaagggug

SEQ ID NO: 681899 - RNA, 17 nt, Homo sapiens
accacauuuagaacuuu

SEQ ID NO: 681900 - RNA, 12 nt, Homo sapiens
accaccacaagc

SEQ ID NO: 681901 - RNA, 11 nt, Homo sapiens
accaccagggu

SEQ ID NO: 681902 - RNA, 15 nt, Homo sapiens
accaccaugcucaac

SEQ ID NO: 681903 - RNA, 14 nt, Homo sapiens
accaccccuaccac

SEQ ID NO: 681904 - RNA, 14 nt, Homo sapiens
accacccucaggug

SEQ ID NO: 681905 - RNA, 21 nt, Homo sapiens
accaccgcauaugcaugccag

SEQ ID NO: 681906 - RNA, 14 nt, Homo sapiens
accaccuaauauca

SEQ ID NO: 681907 - RNA, 15 nt, Homo sapiens
accaccuaauaucaa

SEQ ID NO: 681908 - RNA, 15 nt, Homo sapiens
accaccuaguucucc

SEQ ID NO: 681909 - RNA, 13 nt, Homo sapiens
accaccucaccag

SEQ ID NO: 681910 - RNA, 14 nt, Homo sapiens
accacgaggaaaag

SEQ ID NO: 681911 - RNA, 21 nt, Homo sapiens
accacggccacauuugguucu

SEQ ID NO: 681912 - RNA, 21 nt, Homo sapiens
accacggccaccacugcagcc

SEQ ID NO: 681913 - RNA, 18 nt, Homo sapiens
accacuacaugcagccca

SEQ ID NO: 681914 - RNA, 16 nt, Homo sapiens
accacuaccagccagc

SEQ ID NO: 681915 - RNA, 12 nt, Homo sapiens
accacucaggcc

SEQ ID NO: 681916 - RNA, 21 nt, Homo sapiens
accacucaggccaacaagcca

SEQ ID NO: 681917 - RNA, 15 nt, Homo sapiens
accacucaggccaca

SEQ ID NO: 681918 - RNA, 12 nt, Homo sapiens
accacuccacuc

SEQ ID NO: 681919 - RNA, 16 nt, Homo sapiens
accacucccaccacag

SEQ ID NO: 681920 - RNA, 21 nt, Homo sapiens
accacucuucuuuaagccaua

SEQ ID NO: 681921 - RNA, 17 nt, Homo sapiens
accacugaaaaaauaua

SEQ ID NO: 681922 - RNA, 17 nt, Homo sapiens
accacugcacuccaguc

SEQ ID NO: 681923 - RNA, 16 nt, Homo sapiens
accacugcacugucug

SEQ ID NO: 681924 - RNA, 17 nt, Homo sapiens
accacugcuaugccauu

SEQ ID NO: 681925 - RNA, 14 nt, Homo sapiens
accacugcugagga

SEQ ID NO: 681926 - RNA, 14 nt, Homo sapiens
accacugggugaga

SEQ ID NO: 681927 - RNA, 16 nt, Homo sapiens
accacuguguauuuaa

SEQ ID NO: 681928 - RNA, 12 nt, Homo sapiens
accacuuccagg

SEQ ID NO: 681929 - RNA, 21 nt, Homo sapiens
accacuugaauuuauugauau

SEQ ID NO: 681930 - RNA, 21 nt, Homo sapiens
accagaacaguaugaauuuga

SEQ ID NO: 681931 - RNA, 14 nt, Homo sapiens
accagaaccaguua

SEQ ID NO: 681932 - RNA, 15 nt, Homo sapiens
accagaagcauuuca

SEQ ID NO: 681933 - RNA, 20 nt, Homo sapiens
accagaagggcuucaaagau

SEQ ID NO: 681934 - RNA, 14 nt, Homo sapiens
accagaauucccuu

SEQ ID NO: 681935 - RNA, 16 nt, Homo sapiens
accagacacguacaaa

SEQ ID NO: 681936 - RNA, 22 nt, Homo sapiens
accagacagacgcauguggcaa

SEQ ID NO: 681937 - RNA, 18 nt, Homo sapiens
accagaccccaaaccagc

SEQ ID NO: 681938 - RNA, 15 nt, Homo sapiens
accagagacuuuagg

SEQ ID NO: 681939 - RNA, 19 nt, Homo sapiens
accagagauaauaugagaa

SEQ ID NO: 681940 - RNA, 17 nt, Homo sapiens
accagaggaaacuugca

SEQ ID NO: 681941 - RNA, 18 nt, Homo sapiens
accagaggacaaagccuu

SEQ ID NO: 681942 - RNA, 17 nt, Homo sapiens
accagagucaaauuuga

SEQ ID NO: 681943 - RNA, 20 nt, Homo sapiens
accagaugaaauaauguucu

SEQ ID NO: 681944 - RNA, 19 nt, Homo sapiens
accagauggaacacuggaa

SEQ ID NO: 681945 - RNA, 20 nt, Homo sapiens
accagaugucgcccuacuca

SEQ ID NO: 681946 - RNA, 14 nt, Homo sapiens
accagauugcucug

SEQ ID NO: 681947 - RNA, 15 nt, Homo sapiens
accagcaaacagcug

SEQ ID NO: 681948 - RNA, 15 nt, Homo sapiens
accagcaagucccag

SEQ ID NO: 681949 - RNA, 17 nt, Homo sapiens
accagcagcccaagggc

SEQ ID NO: 681950 - RNA, 14 nt, Homo sapiens
accagcagcgccuu

SEQ ID NO: 681951 - RNA, 18 nt, Homo sapiens
accagcaggagguucugg

SEQ ID NO: 681952 - RNA, 20 nt, Homo sapiens
accagccguauuuuacauga

SEQ ID NO: 681953 - RNA, 15 nt, Homo sapiens
accagccugggcaac

SEQ ID NO: 681954 - RNA, 18 nt, Homo sapiens
accagcggaaacaggugu

SEQ ID NO: 681955 - RNA, 19 nt, Homo sapiens
accagcggaaacaggugug

SEQ ID NO: 681956 - RNA, 14 nt, Homo sapiens
accagcugcucugc

SEQ ID NO: 681957 - RNA, 17 nt, Homo sapiens
accagcuucauguggcu

SEQ ID NO: 681958 - RNA, 23 nt, Homo sapiens
accagcuuuugcggagauuuuga

SEQ ID NO: 681959 - RNA, 22 nt, Homo sapiens
accaggaaggaagcuguugcuu

SEQ ID NO: 681960 - RNA, 23 nt, Homo sapiens
accaggagagagggcaaagggau

SEQ ID NO: 681961 - RNA, 16 nt, Homo sapiens
accaggagagcccugg

SEQ ID NO: 681962 - RNA, 22 nt, Homo sapiens
accaggcaccucuuccuugaug

SEQ ID NO: 681963 - RNA, 13 nt, Homo sapiens
accaggcacugcc

SEQ ID NO: 681964 - RNA, 16 nt, Homo sapiens
accaggccaagacuca

SEQ ID NO: 681965 - RNA, 16 nt, Homo sapiens
accaggccaaugucag

SEQ ID NO: 681966 - RNA, 19 nt, Homo sapiens
accaggcugugggccucaa

SEQ ID NO: 681967 - RNA, 19 nt, Homo sapiens
accagggacugcagcugca

SEQ ID NO: 681968 - RNA, 13 nt, Homo sapiens
accagggaugcug

SEQ ID NO: 681969 - RNA, 11 nt, Homo sapiens
accagggaugg

SEQ ID NO: 681970 - RNA, 16 nt, Homo sapiens
accagggcaacucuug

SEQ ID NO: 681971 - RNA, 19 nt, Homo sapiens
accaggggcccacccucug

SEQ ID NO: 681972 - RNA, 22 nt, Homo sapiens
accaggguccuuuugacacugc

SEQ ID NO: 681973 - RNA, 18 nt, Homo sapiens
accagggugguugggacg

SEQ ID NO: 681974 - RNA, 15 nt, Homo sapiens
accaguacugggaag

SEQ ID NO: 681975 - RNA, 15 nt, Homo sapiens
accaguauaagcauc

SEQ ID NO: 681976 - RNA, 13 nt, Homo sapiens
accaguaugacag

SEQ ID NO: 681977 - RNA, 14 nt, Homo sapiens
accagucacugucc

SEQ ID NO: 681978 - RNA, 20 nt, Homo sapiens
accaguccacaccacuguug

SEQ ID NO: 681979 - RNA, 20 nt, Homo sapiens
accagucuauuuccacugaa

SEQ ID NO: 681980 - RNA, 20 nt, Homo sapiens
accgggcugcaggugcugcu

SEQ ID NO: 681981 - RNA, 23 nt, Homo sapiens
accggggccuacuagagucugaa

SEQ ID NO: 681982 - RNA, 16 nt, Homo sapiens
accguacaucugcaau

SEQ ID NO: 681983 - RNA, 15 nt, Homo sapiens
accgugaccaggaac

SEQ ID NO: 681984 - RNA, 14 nt, Homo sapiens
accgugaccaucuu

SEQ ID NO: 681985 - RNA, 15 nt, Homo sapiens
accgugcgagcugcc

SEQ ID NO: 681986 - RNA, 23 nt, Homo sapiens
accguggagcuuaagccacugcc

SEQ ID NO: 681987 - RNA, 13 nt, Homo sapiens
accguucaccagu

SEQ ID NO: 681988 - RNA, 15 nt, Homo sapiens
accguucaccaguug

SEQ ID NO: 681989 - RNA, 15 nt, Homo sapiens
accguucugugcaca

SEQ ID NO: 681990 - RNA, 14 nt, Homo sapiens
accguuguuugcaa

SEQ ID NO: 681991 - RNA, 15 nt, Homo sapiens
accuaaaacaucuca

SEQ ID NO: 681992 - RNA, 22 nt, Homo sapiens
accuaaaagacagcagggacaa

SEQ ID NO: 681993 - RNA, 19 nt, Homo sapiens
accuaaaauaauugguucu

SEQ ID NO: 681994 - RNA, 20 nt, Homo sapiens
accuaaauggccucaugugg

SEQ ID NO: 681995 - RNA, 16 nt, Homo sapiens
accuaaauuugguucu

SEQ ID NO: 681996 - RNA, 14 nt, Homo sapiens
accuaacacauuaa

SEQ ID NO: 681997 - RNA, 19 nt, Homo sapiens
accuaaccacuuagcaugu

SEQ ID NO: 681998 - RNA, 15 nt, Homo sapiens
accuaagaaguacau

SEQ ID NO: 681999 - RNA, 11 nt, Homo sapiens
accuaauccaa

SEQ ID NO: 682000 - RNA, 21 nt, Homo sapiens
accuaauguuuaugagccaga

SEQ ID NO: 682001 - RNA, 23 nt, Homo sapiens
accuaauucuuguagaugcauua

SEQ ID NO: 682002 - RNA, 15 nt, Homo sapiens
accuacaagauuucc

SEQ ID NO: 682003 - RNA, 15 nt, Homo sapiens
accuacacacuguca

SEQ ID NO: 682004 - RNA, 14 nt, Homo sapiens
accuacaugucuuu

SEQ ID NO: 682005 - RNA, 15 nt, Homo sapiens
accuacauuaucuca

SEQ ID NO: 682006 - RNA, 18 nt, Homo sapiens
accuacccacaugcacuc

SEQ ID NO: 682007 - RNA, 19 nt, Homo sapiens
accuaccccugcacaagcc

SEQ ID NO: 682008 - RNA, 12 nt, Homo sapiens
accuacuccugg

SEQ ID NO: 682009 - RNA, 12 nt, Homo sapiens
accuacugcacu

SEQ ID NO: 682010 - RNA, 21 nt, Homo sapiens
accuacuuugacuuuuugcau

SEQ ID NO: 682011 - RNA, 18 nt, Homo sapiens
accuagaacacuaacuca

SEQ ID NO: 682012 - RNA, 19 nt, Homo sapiens
accuagaaguauuuuuguc

SEQ ID NO: 682013 - RNA, 16 nt, Homo sapiens
accuagcuacacugag

SEQ ID NO: 682014 - RNA, 20 nt, Homo sapiens
accuagcuuuauucuucaga

SEQ ID NO: 682015 - RNA, 18 nt, Homo sapiens
accuaggcaacaugguga

SEQ ID NO: 682016 - RNA, 21 nt, Homo sapiens
accuaggccucagcugcacug

SEQ ID NO: 682017 - RNA, 22 nt, Homo sapiens
accuagggcacuuuaagucagu

SEQ ID NO: 682018 - RNA, 18 nt, Homo sapiens
accuagggggacggggcu

SEQ ID NO: 682019 - RNA, 13 nt, Homo sapiens
accuauaaaucau

SEQ ID NO: 682020 - RNA, 18 nt, Homo sapiens
accuauaaucccagcacu

SEQ ID NO: 682021 - RNA, 15 nt, Homo sapiens
accuauacauuauau

SEQ ID NO: 682022 - RNA, 22 nt, Homo sapiens
accuauagaaauagaacacugc

SEQ ID NO: 682023 - RNA, 15 nt, Homo sapiens
accuauguacuuaau

SEQ ID NO: 682024 - RNA, 19 nt, Homo sapiens
accuauuucugaugauguc

SEQ ID NO: 682025 - RNA, 13 nt, Homo sapiens
accucaaaggcuc

SEQ ID NO: 682026 - RNA, 22 nt, Homo sapiens
accucaacauugcauggugcua

SEQ ID NO: 682027 - RNA, 22 nt, Homo sapiens
accucaagcaaccaugaacuca

SEQ ID NO: 682028 - RNA, 12 nt, Homo sapiens
accucaagccau

SEQ ID NO: 682029 - RNA, 19 nt, Homo sapiens
accucaagggacagggaau

SEQ ID NO: 682030 - RNA, 21 nt, Homo sapiens
accucaccugggcagggauga

SEQ ID NO: 682031 - RNA, 21 nt, Homo sapiens
accucacgcucuggacaugau

SEQ ID NO: 682032 - RNA, 13 nt, Homo sapiens
accucacugugac

SEQ ID NO: 682033 - RNA, 16 nt, Homo sapiens
accucagacacucuga

SEQ ID NO: 682034 - RNA, 21 nt, Homo sapiens
accucaggugauccaccugcc

SEQ ID NO: 682035 - RNA, 22 nt, Homo sapiens
accucagguugaaauaccaggg

SEQ ID NO: 682036 - RNA, 22 nt, Homo sapiens
accucagugguuagaagcaugu

SEQ ID NO: 682037 - RNA, 22 nt, Homo sapiens
accucaguuuuaucauuuucaa

SEQ ID NO: 682038 - RNA, 22 nt, Homo sapiens
accucauaucaguuugcuagca

SEQ ID NO: 682039 - RNA, 16 nt, Homo sapiens
accucaucucuacuaa

SEQ ID NO: 682040 - RNA, 15 nt, Homo sapiens
accucaucucugaaa

SEQ ID NO: 682041 - RNA, 20 nt, Homo sapiens
accucaugaggaccagggug

SEQ ID NO: 682042 - RNA, 13 nt, Homo sapiens
accucaugccaug

SEQ ID NO: 682043 - RNA, 13 nt, Homo sapiens
accucauucugaa

SEQ ID NO: 682044 - RNA, 20 nt, Homo sapiens
accuccaacaacgacacauu

SEQ ID NO: 682045 - RNA, 14 nt, Homo sapiens
accuccaacuggau

SEQ ID NO: 682046 - RNA, 15 nt, Homo sapiens
accuccacauguuca

SEQ ID NO: 682047 - RNA, 17 nt, Homo sapiens
accuccagacaccagug

SEQ ID NO: 682048 - RNA, 15 nt, Homo sapiens
accuccagggagcac

SEQ ID NO: 682049 - RNA, 17 nt, Homo sapiens
accuccccaagacuuua

SEQ ID NO: 682050 - RNA, 19 nt, Homo sapiens
accucccuucccaccuacu

SEQ ID NO: 682051 - RNA, 17 nt, Homo sapiens
accuccgccccugcccc

SEQ ID NO: 682052 - RNA, 22 nt, Homo sapiens
accuccgcgggcugacugggcc

SEQ ID NO: 682053 - RNA, 19 nt, Homo sapiens
accuccggcugccuagccc

SEQ ID NO: 682054 - RNA, 20 nt, Homo sapiens
accuccucccuaaugcucac

SEQ ID NO: 682055 - RNA, 21 nt, Homo sapiens
accuccucccucauucaucuu

SEQ ID NO: 682056 - RNA, 16 nt, Homo sapiens
accuccuccucuggac

SEQ ID NO: 682057 - RNA, 22 nt, Homo sapiens
accuccugucacucacugaggc

SEQ ID NO: 682058 - RNA, 22 nt, Homo sapiens
accuccugugacccgugaaugu

SEQ ID NO: 682059 - RNA, 22 nt, Homo sapiens
accuccuuagcccugucugcua

SEQ ID NO: 682060 - RNA, 12 nt, Homo sapiens
accuccuuccag

SEQ ID NO: 682061 - RNA, 22 nt, Homo sapiens
accucgcucgaugacugugaac

SEQ ID NO: 682062 - RNA, 17 nt, Homo sapiens
accucggcacacacugu

SEQ ID NO: 682063 - RNA, 21 nt, Homo sapiens
accucggccucccaaagugcu

SEQ ID NO: 682064 - RNA, 21 nt, Homo sapiens
accucggugggcccagugggg

SEQ ID NO: 682065 - RNA, 22 nt, Homo sapiens
accucgucaagagcaugcacau

SEQ ID NO: 682066 - RNA, 13 nt, Homo sapiens
accucguccuccc

SEQ ID NO: 682067 - RNA, 13 nt, Homo sapiens
accucgugaucca

SEQ ID NO: 682068 - RNA, 15 nt, Homo sapiens
accucuagagucacu

SEQ ID NO: 682069 - RNA, 17 nt, Homo sapiens
accucuauauaccaaag

SEQ ID NO: 682070 - RNA, 14 nt, Homo sapiens
accucucaauuucu

SEQ ID NO: 682071 - RNA, 16 nt, Homo sapiens
accucucccugacccu

SEQ ID NO: 682072 - RNA, 19 nt, Homo sapiens
accucucuaagccacagcu

SEQ ID NO: 682073 - RNA, 18 nt, Homo sapiens
accucugauagacuuugu

SEQ ID NO: 682074 - RNA, 15 nt, Homo sapiens
accucugccccagau

SEQ ID NO: 682075 - RNA, 23 nt, Homo sapiens
accucugccuuacaaaauacagg

SEQ ID NO: 682076 - RNA, 10 nt, Homo sapiens
accucuggaa

SEQ ID NO: 682077 - RNA, 15 nt, Homo sapiens
accucuggccaaaua

SEQ ID NO: 682078 - RNA, 17 nt, Homo sapiens
accucugggucaucucu

SEQ ID NO: 682079 - RNA, 19 nt, Homo sapiens
accucugggucaucucuca

SEQ ID NO: 682080 - RNA, 17 nt, Homo sapiens
accucugugaccaacug

SEQ ID NO: 682081 - RNA, 19 nt, Homo sapiens
accucuucaugagcuugaa

SEQ ID NO: 682082 - RNA, 11 nt, Homo sapiens
accucuuccac

SEQ ID NO: 682083 - RNA, 17 nt, Homo sapiens
accugaccccagugaau

SEQ ID NO: 682084 - RNA, 22 nt, Homo sapiens
accugacccuucucucacuucu

SEQ ID NO: 682085 - RNA, 14 nt, Homo sapiens
accugacuuccucu

SEQ ID NO: 682086 - RNA, 18 nt, Homo sapiens
accugagauggagcugcc

SEQ ID NO: 682087 - RNA, 13 nt, Homo sapiens
accugagcgcugu

SEQ ID NO: 682088 - RNA, 14 nt, Homo sapiens
accugaucauuaca

SEQ ID NO: 682089 - RNA, 20 nt, Homo sapiens
accugauggaaguaaagccu

SEQ ID NO: 682090 - RNA, 21 nt, Homo sapiens
accugauugaucacacagugu

SEQ ID NO: 682091 - RNA, 22 nt, Homo sapiens
accugauugaucacacaguguu

SEQ ID NO: 682092 - RNA, 15 nt, Homo sapiens
accugauuugaugau

SEQ ID NO: 682093 - RNA, 15 nt, Homo sapiens
accugcacaaccugg

SEQ ID NO: 682094 - RNA, 13 nt, Homo sapiens
accugcaggccaa

SEQ ID NO: 682095 - RNA, 19 nt, Homo sapiens
accugcagggacuccaugc

SEQ ID NO: 682096 - RNA, 18 nt, Homo sapiens
accugcaguuaacaggau

SEQ ID NO: 682097 - RNA, 18 nt, Homo sapiens
accugcaguuccugagua

SEQ ID NO: 682098 - RNA, 21 nt, Homo sapiens
accugccagucccagaucaca

SEQ ID NO: 682099 - RNA, 17 nt, Homo sapiens
accugcccaaggaugcu

SEQ ID NO: 682100 - RNA, 15 nt, Homo sapiens
accugccucugaccc

SEQ ID NO: 682101 - RNA, 13 nt, Homo sapiens
accugccuucuac

SEQ ID NO: 682102 - RNA, 15 nt, Homo sapiens
accugcggguccuca

SEQ ID NO: 682103 - RNA, 19 nt, Homo sapiens
accugcucaucauauucca

SEQ ID NO: 682104 - RNA, 14 nt, Homo sapiens
accugcugcaugaa

SEQ ID NO: 682105 - RNA, 15 nt, Homo sapiens
accugcugcugcuau

SEQ ID NO: 682106 - RNA, 17 nt, Homo sapiens
accugcuuagcugccuu

SEQ ID NO: 682107 - RNA, 15 nt, Homo sapiens
accugcuuaugcauu

SEQ ID NO: 682108 - RNA, 17 nt, Homo sapiens
accuggaaacagcuuua

SEQ ID NO: 682109 - RNA, 13 nt, Homo sapiens
accuggacccaga

SEQ ID NO: 682110 - RNA, 14 nt, Homo sapiens
accuggacugagcc

SEQ ID NO: 682111 - RNA, 23 nt, Homo sapiens
accuggagcaucauaauggacuc

SEQ ID NO: 682112 - RNA, 22 nt, Homo sapiens
accuggaugaucacuaauacua

SEQ ID NO: 682113 - RNA, 15 nt, Homo sapiens
accuggcacauucau

SEQ ID NO: 682114 - RNA, 22 nt, Homo sapiens
accuggcagggcucacacuccu

SEQ ID NO: 682115 - RNA, 23 nt, Homo sapiens
accuggccgggucacccugugac

SEQ ID NO: 682116 - RNA, 21 nt, Homo sapiens
accugggagggugggaccaau

SEQ ID NO: 682117 - RNA, 13 nt, Homo sapiens
accugggcaggga

SEQ ID NO: 682118 - RNA, 19 nt, Homo sapiens
accugggcagggaugaugg

SEQ ID NO: 682119 - RNA, 18 nt, Homo sapiens
accugggccccacuggac

SEQ ID NO: 682120 - RNA, 17 nt, Homo sapiens
accuggggacuccucaa

SEQ ID NO: 682121 - RNA, 23 nt, Homo sapiens
accuggggacuccucaaaccacu

SEQ ID NO: 682122 - RNA, 21 nt, Homo sapiens
accuggggcacaguccaggaa

SEQ ID NO: 682123 - RNA, 15 nt, Homo sapiens
accuggugcuuuuaa

SEQ ID NO: 682124 - RNA, 16 nt, Homo sapiens
accuguaaucauauaa

SEQ ID NO: 682125 - RNA, 15 nt, Homo sapiens
accuguaaucccagc

SEQ ID NO: 682126 - RNA, 21 nt, Homo sapiens
accuguaaucccagcacuuug

SEQ ID NO: 682127 - RNA, 22 nt, Homo sapiens
accuguaaucccagcuacucga

SEQ ID NO: 682128 - RNA, 20 nt, Homo sapiens
accuguacacugacuugaga

SEQ ID NO: 682129 - RNA, 22 nt, Homo sapiens
accuguacauucuuccaucauc

SEQ ID NO: 682130 - RNA, 21 nt, Homo sapiens
accuguaccuccaaaagugac

SEQ ID NO: 682131 - RNA, 13 nt, Homo sapiens
accuguagugaga

SEQ ID NO: 682132 - RNA, 16 nt, Homo sapiens
accuguaguuuuacau

SEQ ID NO: 682133 - RNA, 17 nt, Homo sapiens
accuguccccacccucc

SEQ ID NO: 682134 - RNA, 14 nt, Homo sapiens
accuguccucuuug

SEQ ID NO: 682135 - RNA, 18 nt, Homo sapiens
accugucuauaagagaau

SEQ ID NO: 682136 - RNA, 15 nt, Homo sapiens
accugucuccacugu

SEQ ID NO: 682137 - RNA, 17 nt, Homo sapiens
accugucuccacugugc

SEQ ID NO: 682138 - RNA, 16 nt, Homo sapiens
accugucucuaccuaa

SEQ ID NO: 682139 - RNA, 22 nt, Homo sapiens
accugucuucuggcucucucug

SEQ ID NO: 682140 - RNA, 22 nt, Homo sapiens
accugugacuaaacaacuaccu

SEQ ID NO: 682141 - RNA, 15 nt, Homo sapiens
accugugagcccagc

SEQ ID NO: 682142 - RNA, 15 nt, Homo sapiens
accugugcaccuacc

SEQ ID NO: 682143 - RNA, 17 nt, Homo sapiens
accugugcccucaccac

SEQ ID NO: 682144 - RNA, 13 nt, Homo sapiens
accugugcugcug

SEQ ID NO: 682145 - RNA, 13 nt, Homo sapiens
accugugcuuuga

SEQ ID NO: 682146 - RNA, 23 nt, Homo sapiens
accugugugagagaauuuaucac

SEQ ID NO: 682147 - RNA, 13 nt, Homo sapiens
accuguuacuuga

SEQ ID NO: 682148 - RNA, 20 nt, Homo sapiens
accuguuacuugaaauacca

SEQ ID NO: 682149 - RNA, 20 nt, Homo sapiens
accuguuccauuguugucaa

SEQ ID NO: 682150 - RNA, 24 nt, Homo sapiens
accuguucuuagaguguagcugua

SEQ ID NO: 682151 - RNA, 21 nt, Homo sapiens
accuguugauagcaagugaau

SEQ ID NO: 682152 - RNA, 15 nt, Homo sapiens
accuguuucccgggc

SEQ ID NO: 682153 - RNA, 19 nt, Homo sapiens
accuguuuuuaagcuguuu

SEQ ID NO: 682154 - RNA, 15 nt, Homo sapiens
accuuaaaguauaaa

SEQ ID NO: 682155 - RNA, 23 nt, Homo sapiens
accuuaaauacacugaauugaau

SEQ ID NO: 682156 - RNA, 17 nt, Homo sapiens
accuuaagaagucuaua

SEQ ID NO: 682157 - RNA, 17 nt, Homo sapiens
accuuaagagacacucc

SEQ ID NO: 682158 - RNA, 15 nt, Homo sapiens
accuuaaugacaaca

SEQ ID NO: 682159 - RNA, 17 nt, Homo sapiens
accuuacauguguaaag

SEQ ID NO: 682160 - RNA, 24 nt, Homo sapiens
accuuacugacacauugcugauau

SEQ ID NO: 682161 - RNA, 13 nt, Homo sapiens
accuuagaauaca

SEQ ID NO: 682162 - RNA, 23 nt, Homo sapiens
accuuagcuuauugaucccacau

SEQ ID NO: 682163 - RNA, 20 nt, Homo sapiens
accuuaguugcaugaccaca

SEQ ID NO: 682164 - RNA, 21 nt, Homo sapiens
accuuauaguguuaauaucuu

SEQ ID NO: 682165 - RNA, 17 nt, Homo sapiens
accuuauuuuuucccaa

SEQ ID NO: 682166 - RNA, 21 nt, Homo sapiens
accuucaagcgcuccagggcc

SEQ ID NO: 682167 - RNA, 13 nt, Homo sapiens
accuucaccuuug

SEQ ID NO: 682168 - RNA, 13 nt, Homo sapiens
accuucagaagcu

SEQ ID NO: 682169 - RNA, 21 nt, Homo sapiens
accuucagauuuguguuauaa

SEQ ID NO: 682170 - RNA, 19 nt, Homo sapiens
accuucaggcagccagugu

SEQ ID NO: 682171 - RNA, 22 nt, Homo sapiens
accuucaucugaaacccacaga

SEQ ID NO: 682172 - RNA, 15 nt, Homo sapiens
accuucauuuaauau

SEQ ID NO: 682173 - RNA, 19 nt, Homo sapiens
accuuccagcuccuguaac

SEQ ID NO: 682174 - RNA, 20 nt, Homo sapiens
accuuccauucacaccagcu

SEQ ID NO: 682175 - RNA, 15 nt, Homo sapiens
accuucccuugccac

SEQ ID NO: 682176 - RNA, 16 nt, Homo sapiens
accuucguccuuuuaa

SEQ ID NO: 682177 - RNA, 15 nt, Homo sapiens
accuucuaaaagcca

SEQ ID NO: 682178 - RNA, 17 nt, Homo sapiens
accuucuaccaccaggg

SEQ ID NO: 682179 - RNA, 16 nt, Homo sapiens
accuucuauguauuag

SEQ ID NO: 682180 - RNA, 17 nt, Homo sapiens
accuucuauuugcccag

SEQ ID NO: 682181 - RNA, 16 nt, Homo sapiens
accuugaacacugggg

SEQ ID NO: 682182 - RNA, 15 nt, Homo sapiens
accuugaaugcugcc

SEQ ID NO: 682183 - RNA, 19 nt, Homo sapiens
accuugagggugggccagc

SEQ ID NO: 682184 - RNA, 18 nt, Homo sapiens
accuugccacccauucuu

SEQ ID NO: 682185 - RNA, 20 nt, Homo sapiens
accuugccacccauucuucc

SEQ ID NO: 682186 - RNA, 12 nt, Homo sapiens
acuaucauucuc

SEQ ID NO: 682187 - RNA, 14 nt, Homo sapiens
acuaucauucucag

SEQ ID NO: 682188 - RNA, 24 nt, Homo sapiens
acuauccaaguguuauaccaacua

SEQ ID NO: 682189 - RNA, 20 nt, Homo sapiens
acuaucgucaggaaaccaaa

SEQ ID NO: 682190 - RNA, 14 nt, Homo sapiens
acuaucugcauuau

SEQ ID NO: 682191 - RNA, 20 nt, Homo sapiens
acuaucugcauuaucuaugc

SEQ ID NO: 682192 - RNA, 14 nt, Homo sapiens
acuaugacaucuaa

SEQ ID NO: 682193 - RNA, 23 nt, Homo sapiens
acuaugagccaggcaucauacua

SEQ ID NO: 682194 - RNA, 21 nt, Homo sapiens
acuaugauaaaguuguaaaua

SEQ ID NO: 682195 - RNA, 21 nt, Homo sapiens
acuaugauuuaccuauacauu

SEQ ID NO: 682196 - RNA, 17 nt, Homo sapiens
acuaugcaaaaguacaa

SEQ ID NO: 682197 - RNA, 11 nt, Homo sapiens
acuaugcacaa

SEQ ID NO: 682198 - RNA, 13 nt, Homo sapiens
acuauggugcugu

SEQ ID NO: 682199 - RNA, 17 nt, Homo sapiens
acuaugucugaacauag

SEQ ID NO: 682200 - RNA, 13 nt, Homo sapiens
acuaugugcaaaa

SEQ ID NO: 682201 - RNA, 18 nt, Homo sapiens
acuccuccugcuccucac

SEQ ID NO: 682202 - RNA, 14 nt, Homo sapiens
acuccucucuaggg

SEQ ID NO: 682203 - RNA, 14 nt, Homo sapiens
acuccucugucaua

SEQ ID NO: 682204 - RNA, 19 nt, Homo sapiens
acuccucuguccaggcacu

SEQ ID NO: 682205 - RNA, 14 nt, Homo sapiens
acuccucuuuacac

SEQ ID NO: 682206 - RNA, 17 nt, Homo sapiens
acuccugaccucaggug

SEQ ID NO: 682207 - RNA, 20 nt, Homo sapiens
acuccugaggacagcugucc

SEQ ID NO: 682208 - RNA, 16 nt, Homo sapiens
acuccugccaguugaa

SEQ ID NO: 682209 - RNA, 14 nt, Homo sapiens
acuccuggccucac

SEQ ID NO: 682210 - RNA, 19 nt, Homo sapiens
acuccugggcucaagcaau

SEQ ID NO: 682211 - RNA, 12 nt, Homo sapiens
acuccuguuacu

SEQ ID NO: 682212 - RNA, 15 nt, Homo sapiens
acuccuucuccccaa

SEQ ID NO: 682213 - RNA, 12 nt, Homo sapiens
agaaaagaccuu

SEQ ID NO: 682214 - RNA, 14 nt, Homo sapiens
agaaaagaccuuuu

SEQ ID NO: 682215 - RNA, 15 nt, Homo sapiens
agaaaagacucugac

SEQ ID NO: 682216 - RNA, 17 nt, Homo sapiens
agaaaagcaauacuguu

SEQ ID NO: 682217 - RNA, 18 nt, Homo sapiens
agaaaagcaugcauauca

SEQ ID NO: 682218 - RNA, 20 nt, Homo sapiens
agaaaaggcagcuaaaggaa

SEQ ID NO: 682219 - RNA, 19 nt, Homo sapiens
agaacccucaggucacaag

SEQ ID NO: 682220 - RNA, 18 nt, Homo sapiens
agaaccgagcaaagauca

SEQ ID NO: 682221 - RNA, 15 nt, Homo sapiens
agaaccuucaaccca

SEQ ID NO: 682222 - RNA, 17 nt, Homo sapiens
agaaccuucaacccagu

SEQ ID NO: 682223 - RNA, 16 nt, Homo sapiens
agaacguauuuagcca

SEQ ID NO: 682224 - RNA, 20 nt, Homo sapiens
agaacguggugaccuuucac

SEQ ID NO: 682225 - RNA, 23 nt, Homo sapiens
agaacguggugaccuuucacgaa

SEQ ID NO: 682226 - RNA, 15 nt, Homo sapiens
agaacuaaagcugga

SEQ ID NO: 682227 - RNA, 20 nt, Homo sapiens
agaacuaccaugagaugguu

SEQ ID NO: 682228 - RNA, 13 nt, Homo sapiens
agaacuacuucuu

SEQ ID NO: 682229 - RNA, 14 nt, Homo sapiens
agaacuacuuugaa

SEQ ID NO: 682230 - RNA, 17 nt, Homo sapiens
agaacucaacuguauaa

SEQ ID NO: 682231 - RNA, 15 nt, Homo sapiens
agaacucacaguacc

SEQ ID NO: 682232 - RNA, 15 nt, Homo sapiens
agaacucauucauag

SEQ ID NO: 682233 - RNA, 16 nt, Homo sapiens
agaacuccaauacuca

SEQ ID NO: 682234 - RNA, 23 nt, Homo sapiens
agaacucucugucuucucuccac

SEQ ID NO: 682235 - RNA, 18 nt, Homo sapiens
agaacucuugacuuccug

SEQ ID NO: 682236 - RNA, 15 nt, Homo sapiens
agaacugaaggcaua

SEQ ID NO: 682237 - RNA, 17 nt, Homo sapiens
agaacugacaaaggagc

SEQ ID NO: 682238 - RNA, 13 nt, Homo sapiens
agaacugagcucc

SEQ ID NO: 682239 - RNA, 22 nt, Homo sapiens
agaacugcagaccucacuguca

SEQ ID NO: 682240 - RNA, 16 nt, Homo sapiens
agaacugcagucagca

SEQ ID NO: 682241 - RNA, 11 nt, Homo sapiens
agaacugccau

SEQ ID NO: 682242 - RNA, 21 nt, Homo sapiens
agaacuuagccuuuaccugug

SEQ ID NO: 682243 - RNA, 15 nt, Homo sapiens
agaacuuauucucug

SEQ ID NO: 682244 - RNA, 14 nt, Homo sapiens
agaacuucaagaag

SEQ ID NO: 682245 - RNA, 20 nt, Homo sapiens
agaacuuccccucccuuccc

SEQ ID NO: 682246 - RNA, 18 nt, Homo sapiens
agaacuuggcacacucuc

SEQ ID NO: 682247 - RNA, 18 nt, Homo sapiens
agaacuuuucgacauauu

SEQ ID NO: 682248 - RNA, 21 nt, Homo sapiens
agaagaaguuugaccaucacc

SEQ ID NO: 682249 - RNA, 18 nt, Homo sapiens
agaagaauuggccaucuu

SEQ ID NO: 682250 - RNA, 15 nt, Homo sapiens
agaagacaaacuuug

SEQ ID NO: 682251 - RNA, 15 nt, Homo sapiens
agaagacaacauuaa

SEQ ID NO: 682252 - RNA, 13 nt, Homo sapiens
agaagaccagacu

SEQ ID NO: 682253 - RNA, 12 nt, Homo sapiens
agaagacugggc

SEQ ID NO: 682254 - RNA, 12 nt, Homo sapiens
agaagacuguca

SEQ ID NO: 682255 - RNA, 15 nt, Homo sapiens
agaagagaauuccuu

SEQ ID NO: 682256 - RNA, 14 nt, Homo sapiens
agaagagacaggag

SEQ ID NO: 682257 - RNA, 14 nt, Homo sapiens
agaagagacuggga

SEQ ID NO: 682258 - RNA, 20 nt, Homo sapiens
agaagagaugcacuauaugu

SEQ ID NO: 682259 - RNA, 12 nt, Homo sapiens
agaagagcaaaa

SEQ ID NO: 682260 - RNA, 22 nt, Homo sapiens
agaagagcagcuucggugugca

SEQ ID NO: 682261 - RNA, 16 nt, Homo sapiens
agaagaggaaagggag

SEQ ID NO: 682262 - RNA, 19 nt, Homo sapiens
agaagaggcuggugcugug

SEQ ID NO: 682263 - RNA, 13 nt, Homo sapiens
agaagagguguuu

SEQ ID NO: 682264 - RNA, 15 nt, Homo sapiens
agaagauaaugacuu

SEQ ID NO: 682265 - RNA, 18 nt, Homo sapiens
agaagauuuuaugcugcu

SEQ ID NO: 682266 - RNA, 13 nt, Homo sapiens
agaagcaagccag

SEQ ID NO: 682267 - RNA, 19 nt, Homo sapiens
agaagcaaugggucacuca

SEQ ID NO: 682268 - RNA, 21 nt, Homo sapiens
agaagcaaugggucuuagcuc

SEQ ID NO: 682269 - RNA, 20 nt, Homo sapiens
agaagcacccaggacuucca

SEQ ID NO: 682270 - RNA, 17 nt, Homo sapiens
agaagcagguucuugau

SEQ ID NO: 682271 - RNA, 14 nt, Homo sapiens
agaagcaguuggug

SEQ ID NO: 682272 - RNA, 13 nt, Homo sapiens
agaagcaugucuc

SEQ ID NO: 682273 - RNA, 12 nt, Homo sapiens
agaagcauuucu

SEQ ID NO: 682274 - RNA, 19 nt, Homo sapiens
agaagccaaacagcaagaa

SEQ ID NO: 682275 - RNA, 20 nt, Homo sapiens
agaagccacgcuguccucuc

SEQ ID NO: 682276 - RNA, 17 nt, Homo sapiens
agaagccaggugcaaaa

SEQ ID NO: 682277 - RNA, 15 nt, Homo sapiens
agaagcccauaucac

SEQ ID NO: 682278 - RNA, 23 nt, Homo sapiens
agaagcguuaugugcaguacuua

SEQ ID NO: 682279 - RNA, 22 nt, Homo sapiens
agaagcuaccccucaaacugca

SEQ ID NO: 682280 - RNA, 13 nt, Homo sapiens
agaagcucagcug

SEQ ID NO: 682281 - RNA, 13 nt, Homo sapiens
agaagcucuuacu

SEQ ID NO: 682282 - RNA, 17 nt, Homo sapiens
agaagcugaggccuaug

SEQ ID NO: 682283 - RNA, 21 nt, Homo sapiens
agaagcugcagugguauuaau

SEQ ID NO: 682284 - RNA, 12 nt, Homo sapiens
agaaggaaagca

SEQ ID NO: 682285 - RNA, 14 nt, Homo sapiens
agaaggaagggcag

SEQ ID NO: 682286 - RNA, 12 nt, Homo sapiens
agaaggaaugca

SEQ ID NO: 682287 - RNA, 17 nt, Homo sapiens
agaaggauguacauuuc

SEQ ID NO: 682288 - RNA, 14 nt, Homo sapiens
agaaggcaaaaaug

SEQ ID NO: 682289 - RNA, 22 nt, Homo sapiens
agaaggcagugauuagcacuug

SEQ ID NO: 682290 - RNA, 23 nt, Homo sapiens
agaaggcuauguaaacaaaccac

SEQ ID NO: 682291 - RNA, 16 nt, Homo sapiens
agaagggacugagaga

SEQ ID NO: 682292 - RNA, 20 nt, Homo sapiens
agaagggauaucuacugugg

SEQ ID NO: 682293 - RNA, 10 nt, Homo sapiens
agaagggaug

SEQ ID NO: 682294 - RNA, 18 nt, Homo sapiens
agaagggcugaguggucu

SEQ ID NO: 682295 - RNA, 18 nt, Homo sapiens
agaaggggaggacacugg

SEQ ID NO: 682296 - RNA, 22 nt, Homo sapiens
agaaggguuuuccacccuggaa

SEQ ID NO: 682297 - RNA, 18 nt, Homo sapiens
agaaggugguuacuugga

SEQ ID NO: 682298 - RNA, 22 nt, Homo sapiens
agaagguuugcaccccuccuau

SEQ ID NO: 682299 - RNA, 19 nt, Homo sapiens
agaaguacuuuaccugaaa

SEQ ID NO: 682300 - RNA, 18 nt, Homo sapiens
agaaguacuuuauugcaa

SEQ ID NO: 682301 - RNA, 19 nt, Homo sapiens
agaaguacuuuauugcaac

SEQ ID NO: 682302 - RNA, 17 nt, Homo sapiens
agaaguauuuuaauuca

SEQ ID NO: 682303 - RNA, 16 nt, Homo sapiens
agaagucacugaacaa

SEQ ID NO: 682304 - RNA, 15 nt, Homo sapiens
agaagucccucccau

SEQ ID NO: 682305 - RNA, 23 nt, Homo sapiens
agaagucugucugucugaugaug

SEQ ID NO: 682306 - RNA, 18 nt, Homo sapiens
agaagugagcaaggugcu

SEQ ID NO: 682307 - RNA, 19 nt, Homo sapiens
agaagugagcuuugcugcu

SEQ ID NO: 682308 - RNA, 20 nt, Homo sapiens
agaagugcagcugcugugcc

SEQ ID NO: 682309 - RNA, 22 nt, Homo sapiens
agaagugccuuuaauuugcuac

SEQ ID NO: 682310 - RNA, 22 nt, Homo sapiens
agaaguggcuacugacuacccu

SEQ ID NO: 682311 - RNA, 16 nt, Homo sapiens
agaagugucuaaaaac

SEQ ID NO: 682312 - RNA, 14 nt, Homo sapiens
agaaguuaauccac

SEQ ID NO: 682313 - RNA, 23 nt, Homo sapiens
agaaguucaguuuuuacugagga

SEQ ID NO: 682314 - RNA, 22 nt, Homo sapiens
agaaguucucaaaguuaauuca

SEQ ID NO: 682315 - RNA, 18 nt, Homo sapiens
agaaguuuuuuacuuugg

SEQ ID NO: 682316 - RNA, 18 nt, Homo sapiens
agaauaaaagaugauuuc

SEQ ID NO: 682317 - RNA, 16 nt, Homo sapiens
agaauaaagauuuaua

SEQ ID NO: 682318 - RNA, 23 nt, Homo sapiens
agaauaaaugguuucucauuaaa

SEQ ID NO: 682319 - RNA, 15 nt, Homo sapiens
agaauaaauucccaa

SEQ ID NO: 682320 - RNA, 17 nt, Homo sapiens
agaauaagaauuugcau

SEQ ID NO: 682321 - RNA, 13 nt, Homo sapiens
agaauaagccuuc

SEQ ID NO: 682322 - RNA, 17 nt, Homo sapiens
agaauaaggcaggcauu

SEQ ID NO: 682323 - RNA, 23 nt, Homo sapiens
agaauaaggcuuuuucuucccuu

SEQ ID NO: 682324 - RNA, 15 nt, Homo sapiens
agaauaauaugaagc

SEQ ID NO: 682325 - RNA, 18 nt, Homo sapiens
agaauacaguaagcugcu

SEQ ID NO: 682326 - RNA, 13 nt, Homo sapiens
agaauacauucaa

SEQ ID NO: 682327 - RNA, 21 nt, Homo sapiens
agaauacauugauacaaagua

SEQ ID NO: 682328 - RNA, 19 nt, Homo sapiens
agaauaccaccuaauccuu

SEQ ID NO: 682329 - RNA, 22 nt, Homo sapiens
agaauacuauuuccaaacucau

SEQ ID NO: 682330 - RNA, 17 nt, Homo sapiens
agaauacuggucucagg

SEQ ID NO: 682331 - RNA, 18 nt, Homo sapiens
agaauagaauacauugau

SEQ ID NO: 682332 - RNA, 17 nt, Homo sapiens
agaauagucucacuguc

SEQ ID NO: 682333 - RNA, 17 nt, Homo sapiens
agaauauaaaaaacuuu

SEQ ID NO: 682334 - RNA, 13 nt, Homo sapiens
agaauauaaucuu

SEQ ID NO: 682335 - RNA, 14 nt, Homo sapiens
agaauaucuaaaca

SEQ ID NO: 682336 - RNA, 14 nt, Homo sapiens
agaauaucugggau

SEQ ID NO: 682337 - RNA, 17 nt, Homo sapiens
agaauaugaaguucuau

SEQ ID NO: 682338 - RNA, 20 nt, Homo sapiens
agaauauuauuagucugcau

SEQ ID NO: 682339 - RNA, 19 nt, Homo sapiens
agaauauugucugccuuaa

SEQ ID NO: 682340 - RNA, 21 nt, Homo sapiens
agaauauuuuaagaauuucac

SEQ ID NO: 682341 - RNA, 20 nt, Homo sapiens
agaauauuuuagccacucaa

SEQ ID NO: 682342 - RNA, 12 nt, Homo sapiens
agaaucaccuca

SEQ ID NO: 682343 - RNA, 17 nt, Homo sapiens
agaaucacuugcacucc

SEQ ID NO: 682344 - RNA, 22 nt, Homo sapiens
agaaucaucuuuugaagcuuuc

SEQ ID NO: 682345 - RNA, 16 nt, Homo sapiens
agacaugaaugcacac

SEQ ID NO: 682346 - RNA, 22 nt, Homo sapiens
agagguguuuuuauaauaucca

SEQ ID NO: 682347 - RNA, 16 nt, Homo sapiens
agcuaaaugcaauuua

SEQ ID NO: 682348 - RNA, 15 nt, Homo sapiens
agcuaaaugcaggga

SEQ ID NO: 682349 - RNA, 22 nt, Homo sapiens
agcuaaauuuucugaaacugca

SEQ ID NO: 682350 - RNA, 21 nt, Homo sapiens
agcuaacagucccuauggaaa

SEQ ID NO: 682351 - RNA, 12 nt, Homo sapiens
agcuaaccauca

SEQ ID NO: 682352 - RNA, 20 nt, Homo sapiens
agcuaaccccaagcugccuc

SEQ ID NO: 682353 - RNA, 16 nt, Homo sapiens
agcuaagacauauuca

SEQ ID NO: 682354 - RNA, 22 nt, Homo sapiens
agcuaaugucacaauuaugugc

SEQ ID NO: 682355 - RNA, 17 nt, Homo sapiens
aggaaagaagcauuucu

SEQ ID NO: 682356 - RNA, 14 nt, Homo sapiens
aggaaagcccuccc

SEQ ID NO: 682357 - RNA, 15 nt, Homo sapiens
aggaaagcgccucca

SEQ ID NO: 682358 - RNA, 22 nt, Homo sapiens
aggaaaggauuuuaccaaagca

SEQ ID NO: 682359 - RNA, 23 nt, Homo sapiens
aggaaagggauaguccaaagacu

SEQ ID NO: 682360 - RNA, 13 nt, Homo sapiens
aggaaauaaagua

SEQ ID NO: 682361 - RNA, 20 nt, Homo sapiens
aggaaauauucuguaaucuu

SEQ ID NO: 682362 - RNA, 15 nt, Homo sapiens
aggaacaaagacagg

SEQ ID NO: 682363 - RNA, 12 nt, Homo sapiens
aggaacacugca

SEQ ID NO: 682364 - RNA, 16 nt, Homo sapiens
aggaacacugcacucu

SEQ ID NO: 682365 - RNA, 21 nt, Homo sapiens
aggaacagcaaaugcaaaaac

SEQ ID NO: 682366 - RNA, 12 nt, Homo sapiens
aggaacaggugg

SEQ ID NO: 682367 - RNA, 23 nt, Homo sapiens
aggaaccucucgccaugaucaga

SEQ ID NO: 682368 - RNA, 14 nt, Homo sapiens
aggaacuaagucag

SEQ ID NO: 682369 - RNA, 15 nt, Homo sapiens
aggaacuagaaagaa

SEQ ID NO: 682370 - RNA, 12 nt, Homo sapiens
aggaacucuggc

SEQ ID NO: 682371 - RNA, 22 nt, Homo sapiens
aggaacugcaauaauaucaaaa

SEQ ID NO: 682372 - RNA, 22 nt, Homo sapiens
aggaacugggccaacucaccug

SEQ ID NO: 682373 - RNA, 12 nt, Homo sapiens
aggaacuguaca

SEQ ID NO: 682374 - RNA, 20 nt, Homo sapiens
aggaacuuuccccagaucaa

SEQ ID NO: 682375 - RNA, 17 nt, Homo sapiens
aggaagaaaugucagau

SEQ ID NO: 682376 - RNA, 15 nt, Homo sapiens
aggaagacaauguga

SEQ ID NO: 682377 - RNA, 16 nt, Homo sapiens
aggaagagcaggacuc

SEQ ID NO: 682378 - RNA, 18 nt, Homo sapiens
aggaagauggagguuuac

SEQ ID NO: 682379 - RNA, 16 nt, Homo sapiens
aggaagauguaugcuu

SEQ ID NO: 682380 - RNA, 20 nt, Homo sapiens
aggaagccucccacgacugc

SEQ ID NO: 682381 - RNA, 15 nt, Homo sapiens
aggaagcucucuuaa

SEQ ID NO: 682382 - RNA, 21 nt, Homo sapiens
aggaaggaaagaaagaaggaa

SEQ ID NO: 682383 - RNA, 15 nt, Homo sapiens
aggaaggaacagcaa

SEQ ID NO: 682384 - RNA, 15 nt, Homo sapiens
aggaaggaaccagaa

SEQ ID NO: 682385 - RNA, 17 nt, Homo sapiens
aggaagggaucugagaa

SEQ ID NO: 682386 - RNA, 17 nt, Homo sapiens
aggaaggggaaacacag

SEQ ID NO: 682387 - RNA, 21 nt, Homo sapiens
aggaagguagaaauaucugaa

SEQ ID NO: 682388 - RNA, 22 nt, Homo sapiens
aggaagguggugcuuacauccu

SEQ ID NO: 682389 - RNA, 14 nt, Homo sapiens
aggaagguguuuca

SEQ ID NO: 682390 - RNA, 15 nt, Homo sapiens
aggaauacauugcaa

SEQ ID NO: 682391 - RNA, 15 nt, Homo sapiens
aggaauacauuuuau

SEQ ID NO: 682392 - RNA, 21 nt, Homo sapiens
aggaauacuucaccuuuccuc

SEQ ID NO: 682393 - RNA, 18 nt, Homo sapiens
aggaauauaagaaaagua

SEQ ID NO: 682394 - RNA, 22 nt, Homo sapiens
aggaauauauggcagaguugua

SEQ ID NO: 682395 - RNA, 18 nt, Homo sapiens
aggaauauaugugugccu

SEQ ID NO: 682396 - RNA, 13 nt, Homo sapiens
aggaauauuugca

SEQ ID NO: 682397 - RNA, 17 nt, Homo sapiens
aggaaucaaugacuuaa

SEQ ID NO: 682398 - RNA, 13 nt, Homo sapiens
aggaaucauguca

SEQ ID NO: 682399 - RNA, 17 nt, Homo sapiens
aggaauccauccugcaa

SEQ ID NO: 682400 - RNA, 18 nt, Homo sapiens
aggaauccccaacaugca

SEQ ID NO: 682401 - RNA, 19 nt, Homo sapiens
aggaauccuggauuuugcc

SEQ ID NO: 682402 - RNA, 21 nt, Homo sapiens
aggaauccuggcagcccagag

SEQ ID NO: 682403 - RNA, 23 nt, Homo sapiens
aggaauccuggcagcccagagac

SEQ ID NO: 682404 - RNA, 17 nt, Homo sapiens
aggaaucugaaaguaua

SEQ ID NO: 682405 - RNA, 14 nt, Homo sapiens
aggaauuacgugcu

SEQ ID NO: 682406 - RNA, 15 nt, Homo sapiens
aggaauucuuugcau

SEQ ID NO: 682407 - RNA, 17 nt, Homo sapiens
aggaauuucugcucugg

SEQ ID NO: 682408 - RNA, 22 nt, Homo sapiens
aggacaaaauaaaccguguauu

SEQ ID NO: 682409 - RNA, 21 nt, Homo sapiens
aggacaacagcaucuucccaa

SEQ ID NO: 682410 - RNA, 16 nt, Homo sapiens
aggacaagggcucaga

SEQ ID NO: 682411 - RNA, 13 nt, Homo sapiens
aggacacagugau

SEQ ID NO: 682412 - RNA, 14 nt, Homo sapiens
aggacacauggauu

SEQ ID NO: 682413 - RNA, 17 nt, Homo sapiens
aggacacgaacuggaag

SEQ ID NO: 682414 - RNA, 21 nt, Homo sapiens
aggacacuagaagauuuugaa

SEQ ID NO: 682415 - RNA, 17 nt, Homo sapiens
aggacagaauguguucu

SEQ ID NO: 682416 - RNA, 15 nt, Homo sapiens
aggacagccagcagc

SEQ ID NO: 682417 - RNA, 16 nt, Homo sapiens
aggacagccagcagca

SEQ ID NO: 682418 - RNA, 15 nt, Homo sapiens
aggacagucagcucu

SEQ ID NO: 682419 - RNA, 17 nt, Homo sapiens
aggacaguggaugcugc

SEQ ID NO: 682420 - RNA, 20 nt, Homo sapiens
aggacauccccccgccaaaa

SEQ ID NO: 682421 - RNA, 11 nt, Homo sapiens
aggacaucuua

SEQ ID NO: 682422 - RNA, 23 nt, Homo sapiens
aggacaugcgguagccagcacac

SEQ ID NO: 682423 - RNA, 22 nt, Homo sapiens
aggacauucuggaaaagcaaaa

SEQ ID NO: 682424 - RNA, 18 nt, Homo sapiens
aggacauuuuacugcagu

SEQ ID NO: 682425 - RNA, 14 nt, Homo sapiens
aggaccaagcaucu

SEQ ID NO: 682426 - RNA, 13 nt, Homo sapiens
aggaccaccaaug

SEQ ID NO: 682427 - RNA, 15 nt, Homo sapiens
aggaccacucagccc

SEQ ID NO: 682428 - RNA, 13 nt, Homo sapiens
aggaccagagcua

SEQ ID NO: 682429 - RNA, 17 nt, Homo sapiens
aggacccuaagaugaag

SEQ ID NO: 682430 - RNA, 15 nt, Homo sapiens
aggacccuccacuca

SEQ ID NO: 682431 - RNA, 19 nt, Homo sapiens
aggaccugagacucacacu

SEQ ID NO: 682432 - RNA, 16 nt, Homo sapiens
aggaccuggcugccau

SEQ ID NO: 682433 - RNA, 14 nt, Homo sapiens
aggaccuugcuuug

SEQ ID NO: 682434 - RNA, 22 nt, Homo sapiens
aggacgaauuugcacagugaua

SEQ ID NO: 682435 - RNA, 21 nt, Homo sapiens
aggacgcacgcucgcugccau

SEQ ID NO: 682436 - RNA, 23 nt, Homo sapiens
aggacgccacucauuucaucuca

SEQ ID NO: 682437 - RNA, 13 nt, Homo sapiens
aggacgcgcacuc

SEQ ID NO: 682438 - RNA, 18 nt, Homo sapiens
aggacggacucacuucuc

SEQ ID NO: 682439 - RNA, 18 nt, Homo sapiens
aggacgugggcagcaaaa

SEQ ID NO: 682440 - RNA, 16 nt, Homo sapiens
aggacuaggcauguca

SEQ ID NO: 682441 - RNA, 19 nt, Homo sapiens
aggacucacccuccacaaa

SEQ ID NO: 682442 - RNA, 23 nt, Homo sapiens
aggacucaguauuauuucaagac

SEQ ID NO: 682443 - RNA, 20 nt, Homo sapiens
aggacuccagaugaggacaa

SEQ ID NO: 682444 - RNA, 16 nt, Homo sapiens
aggacuccauuucuuu

SEQ ID NO: 682445 - RNA, 18 nt, Homo sapiens
aggacucggccacugugu

SEQ ID NO: 682446 - RNA, 11 nt, Homo sapiens
aggacugagau

SEQ ID NO: 682447 - RNA, 23 nt, Homo sapiens
aggacugcgggacuugggucuca

SEQ ID NO: 682448 - RNA, 12 nt, Homo sapiens
aggacuguagaa

SEQ ID NO: 682449 - RNA, 17 nt, Homo sapiens
aggacuucugcagcuau

SEQ ID NO: 682450 - RNA, 23 nt, Homo sapiens
aggacuugcuaaagcacuuugca

SEQ ID NO: 682451 - RNA, 17 nt, Homo sapiens
aggacuuguuuacaaag

SEQ ID NO: 682452 - RNA, 22 nt, Homo sapiens
aggagaaaagugggcugcagca

SEQ ID NO: 682453 - RNA, 17 nt, Homo sapiens
aggagaaacacaucuuc

SEQ ID NO: 682454 - RNA, 15 nt, Homo sapiens
aggagaagcacagcu

SEQ ID NO: 682455 - RNA, 14 nt, Homo sapiens
aggagaaggggaag

SEQ ID NO: 682456 - RNA, 23 nt, Homo sapiens
aggagaaucacuggaaccuggga

SEQ ID NO: 682457 - RNA, 13 nt, Homo sapiens
aggagaauugaau

SEQ ID NO: 682458 - RNA, 12 nt, Homo sapiens
aggagaccaagg

SEQ ID NO: 682459 - RNA, 15 nt, Homo sapiens
aggagacucaccucu

SEQ ID NO: 682460 - RNA, 21 nt, Homo sapiens
aggagacuuaggaaccuacca

SEQ ID NO: 682461 - RNA, 23 nt, Homo sapiens
aggagacuuuacauggaugccaa

SEQ ID NO: 682462 - RNA, 22 nt, Homo sapiens
aggagaggacugggccugaugg

SEQ ID NO: 682463 - RNA, 19 nt, Homo sapiens
aggagaggggaagggccag

SEQ ID NO: 682464 - RNA, 18 nt, Homo sapiens
aggagaggggcacagggu

SEQ ID NO: 682465 - RNA, 22 nt, Homo sapiens
aggagaggggcagaacagccgc

SEQ ID NO: 682466 - RNA, 21 nt, Homo sapiens
aggagauaauuguuucauuca

SEQ ID NO: 682467 - RNA, 15 nt, Homo sapiens
aggcagagacugaaa

SEQ ID NO: 682468 - RNA, 17 nt, Homo sapiens
aggcagagacugaaaau

SEQ ID NO: 682469 - RNA, 13 nt, Homo sapiens
aggcagaggaauu

SEQ ID NO: 682470 - RNA, 15 nt, Homo sapiens
aggcagaguuugccu

SEQ ID NO: 682471 - RNA, 23 nt, Homo sapiens
aggcagaucugugccccaugccu

SEQ ID NO: 682472 - RNA, 18 nt, Homo sapiens
aggcagcagacacaugcc

SEQ ID NO: 682473 - RNA, 12 nt, Homo sapiens
aggcagcagggg

SEQ ID NO: 682474 - RNA, 18 nt, Homo sapiens
aggcagccaccaguggac

SEQ ID NO: 682475 - RNA, 19 nt, Homo sapiens
aggcagcuggaugagacuu

SEQ ID NO: 682476 - RNA, 16 nt, Homo sapiens
aggcagcuucuagaca

SEQ ID NO: 682477 - RNA, 21 nt, Homo sapiens
aggcaggaacaaacagggcug

SEQ ID NO: 682478 - RNA, 15 nt, Homo sapiens
aggcaggagguacaa

SEQ ID NO: 682479 - RNA, 17 nt, Homo sapiens
aguucaauacagugaag

SEQ ID NO: 682480 - RNA, 15 nt, Homo sapiens
aguucacuguagaaa

SEQ ID NO: 682481 - RNA, 14 nt, Homo sapiens
aguucagcuccuuc

SEQ ID NO: 682482 - RNA, 17 nt, Homo sapiens
aguucaguggugcaaac

SEQ ID NO: 682483 - RNA, 19 nt, Homo sapiens
aguucaugcagcuguggca

SEQ ID NO: 682484 - RNA, 18 nt, Homo sapiens
aguucauggugaucagug

SEQ ID NO: 682485 - RNA, 17 nt, Homo sapiens
aguuccacgaaacacug

SEQ ID NO: 682486 - RNA, 19 nt, Homo sapiens
aguuccagaaaaccucucc

SEQ ID NO: 682487 - RNA, 13 nt, Homo sapiens
aguucccaugacu

SEQ ID NO: 682488 - RNA, 19 nt, Homo sapiens
aguuccccgagaacuuucu

SEQ ID NO: 682489 - RNA, 21 nt, Homo sapiens
aguucccuccugcccaggacu

SEQ ID NO: 682490 - RNA, 13 nt, Homo sapiens
aguucccuuggcc

SEQ ID NO: 682491 - RNA, 20 nt, Homo sapiens
aguucccuuuuuauuugcag

SEQ ID NO: 682492 - RNA, 23 nt, Homo sapiens
aguuccugcuacaacuucagcag

SEQ ID NO: 682493 - RNA, 20 nt, Homo sapiens
aguuccuguaacaggugugg

SEQ ID NO: 682494 - RNA, 21 nt, Homo sapiens
aguuccuucuggugucugcuu

SEQ ID NO: 682495 - RNA, 20 nt, Homo sapiens
aguucuagaaauagauuuaa

SEQ ID NO: 682496 - RNA, 24 nt, Homo sapiens
aguucucccuguacaguguuacca

SEQ ID NO: 682497 - RNA, 17 nt, Homo sapiens
aguucuccuaucuugau

SEQ ID NO: 682498 - RNA, 17 nt, Homo sapiens
aguucugaguccugaga

SEQ ID NO: 682499 - RNA, 19 nt, Homo sapiens
aguucuggcugaacacugg

SEQ ID NO: 682500 - RNA, 15 nt, Homo sapiens
aguucugguugauuc

SEQ ID NO: 682501 - RNA, 21 nt, Homo sapiens
aguucugguugauucacucaa

SEQ ID NO: 682502 - RNA, 13 nt, Homo sapiens
aguucuuccugua

SEQ ID NO: 682503 - RNA, 18 nt, Homo sapiens
aguucuuugaaccacagc

SEQ ID NO: 682504 - RNA, 13 nt, Homo sapiens
aguugaaacaaga

SEQ ID NO: 682505 - RNA, 19 nt, Homo sapiens
aguugaaaggccucaagaa

SEQ ID NO: 682506 - RNA, 17 nt, Homo sapiens
aguugaaauucuauucu

SEQ ID NO: 682507 - RNA, 20 nt, Homo sapiens
aguugaagcugacucaaaaa

SEQ ID NO: 682508 - RNA, 18 nt, Homo sapiens
aguugaauaguugcuuaa

SEQ ID NO: 682509 - RNA, 19 nt, Homo sapiens
aguugagagguuggagcag

SEQ ID NO: 682510 - RNA, 17 nt, Homo sapiens
aguugagauuuuaauuc

SEQ ID NO: 682511 - RNA, 23 nt, Homo sapiens
aguugaggagacauuacaaugug

SEQ ID NO: 682512 - RNA, 15 nt, Homo sapiens
aguugaucagacuga

SEQ ID NO: 682513 - RNA, 15 nt, Homo sapiens
aguugauucagcucu

SEQ ID NO: 682514 - RNA, 17 nt, Homo sapiens
aguugcaauugaauuaa

SEQ ID NO: 682515 - RNA, 14 nt, Homo sapiens
aguugcacauuaau

SEQ ID NO: 682516 - RNA, 14 nt, Homo sapiens
aguugcagccaggg

SEQ ID NO: 682517 - RNA, 13 nt, Homo sapiens
aguugcaguauug

SEQ ID NO: 682518 - RNA, 11 nt, Homo sapiens
aguugccugac

SEQ ID NO: 682519 - RNA, 23 nt, Homo sapiens
aguugcgacggagagaaaaaaga

SEQ ID NO: 682520 - RNA, 16 nt, Homo sapiens
aguugcugaugaacuc

SEQ ID NO: 682521 - RNA, 20 nt, Homo sapiens
aguugcugcuugugaucuca

SEQ ID NO: 682522 - RNA, 22 nt, Homo sapiens
aguugcugggauuacaggugug

SEQ ID NO: 682523 - RNA, 11 nt, Homo sapiens
aguugcuguau

SEQ ID NO: 682524 - RNA, 17 nt, Homo sapiens
aguuggcaaaauggggu

SEQ ID NO: 682525 - RNA, 23 nt, Homo sapiens
aguugggcuuucacaaaaggcau

SEQ ID NO: 682526 - RNA, 23 nt, Homo sapiens
aguuggguuaauaccagcuuaaa

SEQ ID NO: 682527 - RNA, 16 nt, Homo sapiens
aguuggugacugggaa

SEQ ID NO: 682528 - RNA, 15 nt, Homo sapiens
aguuggugcugcuuu

SEQ ID NO: 682529 - RNA, 22 nt, Homo sapiens
aguuggugcuuuugagaaccaa

SEQ ID NO: 682530 - RNA, 17 nt, Homo sapiens
aguugguucacuucaaa

SEQ ID NO: 682531 - RNA, 16 nt, Homo sapiens
aguuguaguguuauca

SEQ ID NO: 682532 - RNA, 21 nt, Homo sapiens
aguuguccuauggacaacuua

SEQ ID NO: 682533 - RNA, 14 nt, Homo sapiens
aguugucugucuga

SEQ ID NO: 682534 - RNA, 17 nt, Homo sapiens
aguugucuuuccuggca

SEQ ID NO: 682535 - RNA, 22 nt, Homo sapiens
aguuguguuguuuuuuguucaa

SEQ ID NO: 682536 - RNA, 20 nt, Homo sapiens
aguuguuccuuaagucagaa

SEQ ID NO: 682537 - RNA, 18 nt, Homo sapiens
aguuguucuagcagugaa

SEQ ID NO: 682538 - RNA, 16 nt, Homo sapiens
aguuguuugaggcaaa

SEQ ID NO: 682539 - RNA, 18 nt, Homo sapiens
aguuguuuggaugauuaa

SEQ ID NO: 682540 - RNA, 18 nt, Homo sapiens
aguuguuuuccugcuuua

SEQ ID NO: 682541 - RNA, 15 nt, Homo sapiens
aguuguuuugcauaa

SEQ ID NO: 682542 - RNA, 15 nt, Homo sapiens
aguuuaaagacacuu

SEQ ID NO: 682543 - RNA, 16 nt, Homo sapiens
aguuuaaagcuuuuau

SEQ ID NO: 682544 - RNA, 22 nt, Homo sapiens
aguuuaaggaauaugggagaaa

SEQ ID NO: 682545 - RNA, 23 nt, Homo sapiens
aguuuaaggguggaaaaaugccc

SEQ ID NO: 682546 - RNA, 13 nt, Homo sapiens
aguuuaaguaauu

SEQ ID NO: 682547 - RNA, 22 nt, Homo sapiens
aguuuacagaauggaaccaaaa

SEQ ID NO: 682548 - RNA, 24 nt, Homo sapiens
aguuuacagacgcugcugucacaa

SEQ ID NO: 682549 - RNA, 13 nt, Homo sapiens
aguuuacaggaua

SEQ ID NO: 682550 - RNA, 16 nt, Homo sapiens
aguuuacuuugccaac

SEQ ID NO: 682551 - RNA, 17 nt, Homo sapiens
aguuuaguucuguugac

SEQ ID NO: 682552 - RNA, 15 nt, Homo sapiens
aguuuauaugcuucu

SEQ ID NO: 682553 - RNA, 14 nt, Homo sapiens
aguuuauauucuga

SEQ ID NO: 682554 - RNA, 16 nt, Homo sapiens
aguuuaucaguaaaua

SEQ ID NO: 682555 - RNA, 14 nt, Homo sapiens
aguuuaucauguca

SEQ ID NO: 682556 - RNA, 14 nt, Homo sapiens
aguuuauccauccu

SEQ ID NO: 682557 - RNA, 13 nt, Homo sapiens
aguuuaucuuuca

SEQ ID NO: 682558 - RNA, 19 nt, Homo sapiens
aguuucaaaagcaaaacau

SEQ ID NO: 682559 - RNA, 15 nt, Homo sapiens
aguuucacaugagcu

SEQ ID NO: 682560 - RNA, 17 nt, Homo sapiens
aguuucacuguacugca

SEQ ID NO: 682561 - RNA, 15 nt, Homo sapiens
aguuucagacuugga

SEQ ID NO: 682562 - RNA, 22 nt, Homo sapiens
aguuucagagaaauacuuucag

SEQ ID NO: 682563 - RNA, 21 nt, Homo sapiens
aguuuccacuaucccaaucaa

SEQ ID NO: 682564 - RNA, 15 nt, Homo sapiens
aguuuccauauguua

SEQ ID NO: 682565 - RNA, 21 nt, Homo sapiens
aguuuccuaugggaacaauug

SEQ ID NO: 682566 - RNA, 23 nt, Homo sapiens
aguuuccucagaacccacaguga

SEQ ID NO: 682567 - RNA, 17 nt, Homo sapiens
aguuuccucaucugcaa

SEQ ID NO: 682568 - RNA, 20 nt, Homo sapiens
aguuucuccuuuugaccaaa

SEQ ID NO: 682569 - RNA, 21 nt, Homo sapiens
aguuucuuaacccuuuccaga

SEQ ID NO: 682570 - RNA, 14 nt, Homo sapiens
aguuucuuccugua

SEQ ID NO: 682571 - RNA, 17 nt, Homo sapiens
aguuucuugaggccaaa

SEQ ID NO: 682572 - RNA, 23 nt, Homo sapiens
aguuugaacucuguaaaaccuca

SEQ ID NO: 682573 - RNA, 13 nt, Homo sapiens
aguuugagaccag

SEQ ID NO: 682574 - RNA, 10 nt, Homo sapiens
aguuugauau

SEQ ID NO: 682575 - RNA, 19 nt, Homo sapiens
aguuugcaaauaggcagaa

SEQ ID NO: 682576 - RNA, 13 nt, Homo sapiens
aguuugcacuaua

SEQ ID NO: 682577 - RNA, 16 nt, Homo sapiens
aguuugccuuccuuuc

SEQ ID NO: 682578 - RNA, 22 nt, Homo sapiens
aguuugcugccauggacauaaa

SEQ ID NO: 682579 - RNA, 20 nt, Homo sapiens
aguuugcuuugcugaccaaa

SEQ ID NO: 682580 - RNA, 17 nt, Homo sapiens
aguuuggagucacugua

SEQ ID NO: 682581 - RNA, 15 nt, Homo sapiens
aguuuguagccaggu

SEQ ID NO: 682582 - RNA, 20 nt, Homo sapiens
aguuuguugaaaacaaaaac

SEQ ID NO: 682583 - RNA, 18 nt, Homo sapiens
aguuuguuuuuaaacuaa

SEQ ID NO: 682584 - RNA, 15 nt, Homo sapiens
aguuuuaaauaagcu

SEQ ID NO: 682585 - RNA, 14 nt, Homo sapiens
aguuuuaacuguaa

SEQ ID NO: 682586 - RNA, 21 nt, Homo sapiens
aguuuuaauguauaguuuuga

SEQ ID NO: 682587 - RNA, 22 nt, Homo sapiens
aguuuuacaauagacauugcaa

SEQ ID NO: 682588 - RNA, 15 nt, Homo sapiens
aguuuuacauuuuaa

SEQ ID NO: 682589 - RNA, 17 nt, Homo sapiens
aguuuuacccagacuca

SEQ ID NO: 682590 - RNA, 13 nt, Homo sapiens
aguuuuaccucuu

SEQ ID NO: 682591 - RNA, 15 nt, Homo sapiens
aguuuucaaaacaca

SEQ ID NO: 682592 - RNA, 15 nt, Homo sapiens
aguuuuccaggaaua

SEQ ID NO: 682593 - RNA, 13 nt, Homo sapiens
aguuuuccaugaa

SEQ ID NO: 682594 - RNA, 19 nt, Homo sapiens
aguuuuccuacacuugaga

SEQ ID NO: 682595 - RNA, 21 nt, Homo sapiens
aguuuuccucuauacaucucu

SEQ ID NO: 682596 - RNA, 15 nt, Homo sapiens
aguuuucuaaacuca

SEQ ID NO: 682597 - RNA, 17 nt, Homo sapiens
aguuuugaguguauaca

SEQ ID NO: 682598 - RNA, 17 nt, Homo sapiens
aguuuugauaaaguaau

SEQ ID NO: 682599 - RNA, 17 nt, Homo sapiens
aguuuugcaaagugcaa

SEQ ID NO: 682600 - RNA, 12 nt, Homo sapiens
aguuuugcacuu

SEQ ID NO: 682601 - RNA, 16 nt, Homo sapiens
aguuuuggacuggaua

SEQ ID NO: 682602 - RNA, 18 nt, Homo sapiens
aggggaagaggccuguuu

SEQ ID NO: 682603 - RNA, 22 nt, Homo sapiens
aggggaagggccagucugggcu

SEQ ID NO: 682604 - RNA, 15 nt, Homo sapiens
aggggacaagggauu

SEQ ID NO: 682605 - RNA, 14 nt, Homo sapiens
aggggacacuggcc

SEQ ID NO: 682606 - RNA, 16 nt, Homo sapiens
aggggacccauguaau

SEQ ID NO: 682607 - RNA, 18 nt, Homo sapiens
aggggacccauguaaucc

SEQ ID NO: 682608 - RNA, 14 nt, Homo sapiens
aggggacgugggcc

SEQ ID NO: 682609 - RNA, 16 nt, Homo sapiens
aggggacuugaaucuu

SEQ ID NO: 682610 - RNA, 12 nt, Homo sapiens
aggggagcacaa

SEQ ID NO: 682611 - RNA, 14 nt, Homo sapiens
aggggagccagggu

SEQ ID NO: 682612 - RNA, 23 nt, Homo sapiens
aggggagcuaugcuaggacucca

SEQ ID NO: 682613 - RNA, 16 nt, Homo sapiens
aggggaggcaccucca

SEQ ID NO: 682614 - RNA, 12 nt, Homo sapiens
aggggauguuua

SEQ ID NO: 682615 - RNA, 19 nt, Homo sapiens
aggggauugaagcccucca

SEQ ID NO: 682616 - RNA, 16 nt, Homo sapiens
aggggauuuggggcuu

SEQ ID NO: 682617 - RNA, 17 nt, Homo sapiens
aggggcaagcucuugcc

SEQ ID NO: 682618 - RNA, 16 nt, Homo sapiens
aggggcacuucauuga

SEQ ID NO: 682619 - RNA, 18 nt, Homo sapiens
aggggcagauaggagcug

SEQ ID NO: 682620 - RNA, 16 nt, Homo sapiens
aggggcagccaggaca

SEQ ID NO: 682621 - RNA, 14 nt, Homo sapiens
aggggcagccugaa

SEQ ID NO: 682622 - RNA, 23 nt, Homo sapiens
aggggcaggccugggacccagcu

SEQ ID NO: 682623 - RNA, 22 nt, Homo sapiens
aggggcccaaauucuuucagug

SEQ ID NO: 682624 - RNA, 18 nt, Homo sapiens
aggggcccuggccaggac

SEQ ID NO: 682625 - RNA, 17 nt, Homo sapiens
aggggccuaagugccac

SEQ ID NO: 682626 - RNA, 19 nt, Homo sapiens
aggggccucagguuugccu

SEQ ID NO: 682627 - RNA, 22 nt, Homo sapiens
aggggccucccccagcacagau

SEQ ID NO: 682628 - RNA, 18 nt, Homo sapiens
aggggccuugcucugagc

SEQ ID NO: 682629 - RNA, 19 nt, Homo sapiens
aggggcucccuacauuccc

SEQ ID NO: 682630 - RNA, 14 nt, Homo sapiens
aggggcugcugccu

SEQ ID NO: 682631 - RNA, 21 nt, Homo sapiens
agggggaaagguguaggcugg

SEQ ID NO: 682632 - RNA, 18 nt, Homo sapiens
agggggaagaagcagaga

SEQ ID NO: 682633 - RNA, 18 nt, Homo sapiens
agggggaagacagauaug

SEQ ID NO: 682634 - RNA, 22 nt, Homo sapiens
agggggagccccuucugcucag

SEQ ID NO: 682635 - RNA, 21 nt, Homo sapiens
agggggcgcuggagcuuccaa

SEQ ID NO: 682636 - RNA, 18 nt, Homo sapiens
agggggcugcccucucca

SEQ ID NO: 682637 - RNA, 20 nt, Homo sapiens
agggggguugugaggccugg

SEQ ID NO: 682638 - RNA, 18 nt, Homo sapiens
agggggucugggccagug

SEQ ID NO: 682639 - RNA, 16 nt, Homo sapiens
agggggugacuggaag

SEQ ID NO: 682640 - RNA, 22 nt, Homo sapiens
agggggugcaaagacucugagc

SEQ ID NO: 682641 - RNA, 14 nt, Homo sapiens
agggggugucagaa

SEQ ID NO: 682642 - RNA, 22 nt, Homo sapiens
aggggugaaaggggggaaccag

SEQ ID NO: 682643 - RNA, 19 nt, Homo sapiens
aggggugguccugacucaa

SEQ ID NO: 682644 - RNA, 19 nt, Homo sapiens
agggguugagggaagguuc

SEQ ID NO: 682645 - RNA, 15 nt, Homo sapiens
agggguuugccaaac

SEQ ID NO: 682646 - RNA, 20 nt, Homo sapiens
agggguuuucccaugacucu

SEQ ID NO: 682647 - RNA, 23 nt, Homo sapiens
aggguaaauaaaccacugugcgu

SEQ ID NO: 682648 - RNA, 18 nt, Homo sapiens
aggguacagaugugcugu

SEQ ID NO: 682649 - RNA, 23 nt, Homo sapiens
aggguacagaugugcuguagcag

SEQ ID NO: 682650 - RNA, 20 nt, Homo sapiens
aggguagauaaccuguacuu

SEQ ID NO: 682651 - RNA, 23 nt, Homo sapiens
aggguagucugguuucuagacuu

SEQ ID NO: 682652 - RNA, 22 nt, Homo sapiens
aggguauaaauuauauccguga

SEQ ID NO: 682653 - RNA, 21 nt, Homo sapiens
aggguauuuguggaaacuguc

SEQ ID NO: 682654 - RNA, 19 nt, Homo sapiens
agggucacaguaccuugaa

SEQ ID NO: 682655 - RNA, 22 nt, Homo sapiens
agggucacgcuugccuggucac

SEQ ID NO: 682656 - RNA, 19 nt, Homo sapiens
agggucacugaaccacugc

SEQ ID NO: 682657 - RNA, 15 nt, Homo sapiens
agggucccucugugu

SEQ ID NO: 682658 - RNA, 14 nt, Homo sapiens
agggucucuucagg

SEQ ID NO: 682659 - RNA, 17 nt, Homo sapiens
agggucugugugaaugu

SEQ ID NO: 682660 - RNA, 18 nt, Homo sapiens
agggucuucccuaccuca

SEQ ID NO: 682661 - RNA, 16 nt, Homo sapiens
agggucuuugguguuu

SEQ ID NO: 682662 - RNA, 12 nt, Homo sapiens
agggugagacac

SEQ ID NO: 682663 - RNA, 15 nt, Homo sapiens
agggugagugcaagg

SEQ ID NO: 682664 - RNA, 14 nt, Homo sapiens
agggugauagucaa

SEQ ID NO: 682665 - RNA, 19 nt, Homo sapiens
agggugcaagaagccauuu

SEQ ID NO: 682666 - RNA, 16 nt, Homo sapiens
agggugcagugugagu

SEQ ID NO: 682667 - RNA, 18 nt, Homo sapiens
aggguggacuucagugug

SEQ ID NO: 682668 - RNA, 14 nt, Homo sapiens
aggguggagaggga

SEQ ID NO: 682669 - RNA, 16 nt, Homo sapiens
aggguggcccuugcag

SEQ ID NO: 682670 - RNA, 22 nt, Homo sapiens
agggugggaucagcccugccag

SEQ ID NO: 682671 - RNA, 20 nt, Homo sapiens
agggugggguacuggaguua

SEQ ID NO: 682672 - RNA, 19 nt, Homo sapiens
aggguguuuuggguggcau

SEQ ID NO: 682673 - RNA, 14 nt, Homo sapiens
aggguuacaaaucu

SEQ ID NO: 682674 - RNA, 17 nt, Homo sapiens
aggguuccuguagaccu

SEQ ID NO: 682675 - RNA, 16 nt, Homo sapiens
aggguucuaaguggga

SEQ ID NO: 682676 - RNA, 15 nt, Homo sapiens
aggguuuugacacuu

SEQ ID NO: 682677 - RNA, 13 nt, Homo sapiens
aggguuuugcccc

SEQ ID NO: 682678 - RNA, 15 nt, Homo sapiens
agguaacacauuaua

SEQ ID NO: 682679 - RNA, 17 nt, Homo sapiens
agguaacaguuauauca

SEQ ID NO: 682680 - RNA, 15 nt, Homo sapiens
agguaacuacugcua

SEQ ID NO: 682681 - RNA, 21 nt, Homo sapiens
agguaacugagguaaaauguu

SEQ ID NO: 682682 - RNA, 14 nt, Homo sapiens
agguaaugugaaua

SEQ ID NO: 682683 - RNA, 18 nt, Homo sapiens
agguaauuguagcacauu

SEQ ID NO: 682684 - RNA, 11 nt, Homo sapiens
agguacaggag

SEQ ID NO: 682685 - RNA, 20 nt, Homo sapiens
agguacgauuauacuugaga

SEQ ID NO: 682686 - RNA, 19 nt, Homo sapiens
agguagacuuuuaauauca

SEQ ID NO: 682687 - RNA, 18 nt, Homo sapiens
agguagcuuuagggcaau

SEQ ID NO: 682688 - RNA, 18 nt, Homo sapiens
agguaggcaccacagaga

SEQ ID NO: 682689 - RNA, 22 nt, Homo sapiens
agguauaagaaguccuaucuca

SEQ ID NO: 682690 - RNA, 23 nt, Homo sapiens
agguauccaaaaauguguaagaa

SEQ ID NO: 682691 - RNA, 13 nt, Homo sapiens
agguauggcagag

SEQ ID NO: 682692 - RNA, 21 nt, Homo sapiens
agguaugugucagccaugacc

SEQ ID NO: 682693 - RNA, 22 nt, Homo sapiens
agguaugugucagccaugacca

SEQ ID NO: 682694 - RNA, 13 nt, Homo sapiens
agguauguugccu

SEQ ID NO: 682695 - RNA, 20 nt, Homo sapiens
agguauugucuacucugaag

SEQ ID NO: 682696 - RNA, 16 nt, Homo sapiens
agguauuuacccaaga

SEQ ID NO: 682697 - RNA, 18 nt, Homo sapiens
agguauuucgaaacugcc

SEQ ID NO: 682698 - RNA, 21 nt, Homo sapiens
agguauuuuguagaugugauu

SEQ ID NO: 682699 - RNA, 17 nt, Homo sapiens
aggucaagaacaugcaa

SEQ ID NO: 682700 - RNA, 22 nt, Homo sapiens
aggucaaggcugcagugagcca

SEQ ID NO: 682701 - RNA, 19 nt, Homo sapiens
aggucaauuuccugaugca

SEQ ID NO: 682702 - RNA, 15 nt, Homo sapiens
aggucacacagugau

SEQ ID NO: 682703 - RNA, 19 nt, Homo sapiens
aggucaccaagcaguggcc

SEQ ID NO: 682704 - RNA, 22 nt, Homo sapiens
aggucacucuuggucccuggaa

SEQ ID NO: 682705 - RNA, 13 nt, Homo sapiens
aggucagacugaa

SEQ ID NO: 682706 - RNA, 17 nt, Homo sapiens
aggucagaggagggcau

SEQ ID NO: 682707 - RNA, 22 nt, Homo sapiens
aggucagauggagguucucaga

SEQ ID NO: 682708 - RNA, 21 nt, Homo sapiens
aggucagcccagccccuccaa

SEQ ID NO: 682709 - RNA, 19 nt, Homo sapiens
aguuuugggaaugcacuug

SEQ ID NO: 682710 - RNA, 13 nt, Homo sapiens
aguuuuguugccc

SEQ ID NO: 682711 - RNA, 10 nt, Homo sapiens
aguuuuuacu

SEQ ID NO: 682712 - RNA, 22 nt, Homo sapiens
aguuuuuauggcuuuugugcau

SEQ ID NO: 682713 - RNA, 21 nt, Homo sapiens
aguuuuuauuacaaauuuuca

SEQ ID NO: 682714 - RNA, 21 nt, Homo sapiens
auaaaaaagauucuacuaaca

SEQ ID NO: 682715 - RNA, 23 nt, Homo sapiens
auaaaaaaugguucagaauuaaa

SEQ ID NO: 682716 - RNA, 14 nt, Homo sapiens
auaaaaagaaauuu

SEQ ID NO: 682717 - RNA, 14 nt, Homo sapiens
auaaaaagcagaau

SEQ ID NO: 682718 - RNA, 14 nt, Homo sapiens
auaaaaagccaggg

SEQ ID NO: 682719 - RNA, 14 nt, Homo sapiens
auaaaaagugaacu

SEQ ID NO: 682720 - RNA, 15 nt, Homo sapiens
auaaaaauaaaucag

SEQ ID NO: 682721 - RNA, 16 nt, Homo sapiens
auaaaaauauguacaa

SEQ ID NO: 682722 - RNA, 18 nt, Homo sapiens
auaaaaauuguagcuuuu

SEQ ID NO: 682723 - RNA, 16 nt, Homo sapiens
auaaaacaacucugau

SEQ ID NO: 682724 - RNA, 19 nt, Homo sapiens
auaaaacaugggaaucucc

SEQ ID NO: 682725 - RNA, 17 nt, Homo sapiens
auaaaaccccaucucua

SEQ ID NO: 682726 - RNA, 13 nt, Homo sapiens
auaaaacuaugug

SEQ ID NO: 682727 - RNA, 19 nt, Homo sapiens
auaaaacuucacauuuaug

SEQ ID NO: 682728 - RNA, 19 nt, Homo sapiens
auaaaagaucuugaauagu

SEQ ID NO: 682729 - RNA, 18 nt, Homo sapiens
auaaaagauguacuugug

SEQ ID NO: 682730 - RNA, 12 nt, Homo sapiens
auaaaagcuaug

SEQ ID NO: 682731 - RNA, 15 nt, Homo sapiens
auaaaagcuaugaca

SEQ ID NO: 682732 - RNA, 19 nt, Homo sapiens
auaaaagcucagaugacau

SEQ ID NO: 682733 - RNA, 18 nt, Homo sapiens
auaaaaguguucauuguu

SEQ ID NO: 682734 - RNA, 20 nt, Homo sapiens
auaaaauaaaguacauuauu

SEQ ID NO: 682735 - RNA, 13 nt, Homo sapiens
auaaaauaauuau

SEQ ID NO: 682736 - RNA, 22 nt, Homo sapiens
auaaaauaauuauaaauaucau

SEQ ID NO: 682737 - RNA, 18 nt, Homo sapiens
auaaaauauaaucuaauu

SEQ ID NO: 682738 - RNA, 14 nt, Homo sapiens
auaaaauauguaca

SEQ ID NO: 682739 - RNA, 18 nt, Homo sapiens
auaaaauauuauugaacu

SEQ ID NO: 682740 - RNA, 19 nt, Homo sapiens
auaaaaugcaaaugaauca

SEQ ID NO: 682741 - RNA, 19 nt, Homo sapiens
auaaaaugucuucucccac

SEQ ID NO: 682742 - RNA, 20 nt, Homo sapiens
auaaaaugugugaugaauca

SEQ ID NO: 682743 - RNA, 22 nt, Homo sapiens
auaaaauguucagugcaaucag

SEQ ID NO: 682744 - RNA, 20 nt, Homo sapiens
auaaaauguuucauuaugca

SEQ ID NO: 682745 - RNA, 18 nt, Homo sapiens
auaaaauuccuaucucau

SEQ ID NO: 682746 - RNA, 13 nt, Homo sapiens
auaaaauuuaacu

SEQ ID NO: 682747 - RNA, 20 nt, Homo sapiens
auaaaauuugauaaacauuc

SEQ ID NO: 682748 - RNA, 23 nt, Homo sapiens
auaaacaacgcauugccacggaa

SEQ ID NO: 682749 - RNA, 23 nt, Homo sapiens
auaaacacccaugaaucaaagac

SEQ ID NO: 682750 - RNA, 20 nt, Homo sapiens
auaaacacuccacaguguuu

SEQ ID NO: 682751 - RNA, 17 nt, Homo sapiens
auaaacagaacucccuu

SEQ ID NO: 682752 - RNA, 19 nt, Homo sapiens
auaaacaggcugacuggca

SEQ ID NO: 682753 - RNA, 16 nt, Homo sapiens
auaaacagugagcaua

SEQ ID NO: 682754 - RNA, 19 nt, Homo sapiens
auaaacauuaaacacugua

SEQ ID NO: 682755 - RNA, 15 nt, Homo sapiens
auaaaccacugugcg

SEQ ID NO: 682756 - RNA, 12 nt, Homo sapiens
auaaaccacuuu

SEQ ID NO: 682757 - RNA, 13 nt, Homo sapiens
auaaaccaguuga

SEQ ID NO: 682758 - RNA, 15 nt, Homo sapiens
auaaaccaguugaau

SEQ ID NO: 682759 - RNA, 18 nt, Homo sapiens
auaaaccaguugaaucau

SEQ ID NO: 682760 - RNA, 14 nt, Homo sapiens
auaaacccaguugc

SEQ ID NO: 682761 - RNA, 22 nt, Homo sapiens
auaaaccguuuuuaacacauag

SEQ ID NO: 682762 - RNA, 16 nt, Homo sapiens
auaaaccucaucuagg

SEQ ID NO: 682763 - RNA, 16 nt, Homo sapiens
auaaacucagaaauuu

SEQ ID NO: 682764 - RNA, 14 nt, Homo sapiens
auaaacuccuacua

SEQ ID NO: 682765 - RNA, 20 nt, Homo sapiens
auaaacuccuacuaaauccc

SEQ ID NO: 682766 - RNA, 15 nt, Homo sapiens
auaaagaaauugcaa

SEQ ID NO: 682767 - RNA, 15 nt, Homo sapiens
auaaagaaguauuuc

SEQ ID NO: 682768 - RNA, 11 nt, Homo sapiens
auaaagacaga

SEQ ID NO: 682769 - RNA, 16 nt, Homo sapiens
auaaagaguacagaua

SEQ ID NO: 682770 - RNA, 17 nt, Homo sapiens
auaaagauuucaagauc

SEQ ID NO: 682771 - RNA, 22 nt, Homo sapiens
auaaagcacccuguaucacaga

SEQ ID NO: 682772 - RNA, 13 nt, Homo sapiens
auaaagcauucuu

SEQ ID NO: 682773 - RNA, 15 nt, Homo sapiens
auaaagccacuucug

SEQ ID NO: 682774 - RNA, 12 nt, Homo sapiens
auaaagccuuua

SEQ ID NO: 682775 - RNA, 22 nt, Homo sapiens
auaaaggacaggcuggugcuaa

SEQ ID NO: 682776 - RNA, 21 nt, Homo sapiens
auaaaggagaaaagugggcug

SEQ ID NO: 682777 - RNA, 14 nt, Homo sapiens
auaaaggauaaaga

SEQ ID NO: 682778 - RNA, 22 nt, Homo sapiens
auaaaggcagcugccucugcuc

SEQ ID NO: 682779 - RNA, 15 nt, Homo sapiens
auaaaggcauuucaa

SEQ ID NO: 682780 - RNA, 22 nt, Homo sapiens
auaaaggcccagacuccauggu

SEQ ID NO: 682781 - RNA, 22 nt, Homo sapiens
auaaagguuggugaaguguaau

SEQ ID NO: 682782 - RNA, 22 nt, Homo sapiens
auaaaguacaagagcuuaacag

SEQ ID NO: 682783 - RNA, 12 nt, Homo sapiens
auaaaguaccac

SEQ ID NO: 682784 - RNA, 13 nt, Homo sapiens
auaaaguaccaca

SEQ ID NO: 682785 - RNA, 16 nt, Homo sapiens
auaaaguaccacacau

SEQ ID NO: 682786 - RNA, 22 nt, Homo sapiens
auaaaguaccacacauauugca

SEQ ID NO: 682787 - RNA, 12 nt, Homo sapiens
auaaaguaccau

SEQ ID NO: 682788 - RNA, 17 nt, Homo sapiens
auaaaguaccauuaguu

SEQ ID NO: 682789 - RNA, 18 nt, Homo sapiens
auaaagucacuuccagug

SEQ ID NO: 682790 - RNA, 22 nt, Homo sapiens
auaaagucauccucucacugca

SEQ ID NO: 682791 - RNA, 12 nt, Homo sapiens
auaaaguggaaa

SEQ ID NO: 682792 - RNA, 20 nt, Homo sapiens
auaaaguuggccauguauua

SEQ ID NO: 682793 - RNA, 19 nt, Homo sapiens
auaaauaaacuguugcucg

SEQ ID NO: 682794 - RNA, 19 nt, Homo sapiens
auaaauaaucuacuguaca

SEQ ID NO: 682795 - RNA, 15 nt, Homo sapiens
auaaauaauucuucc

SEQ ID NO: 682796 - RNA, 19 nt, Homo sapiens
auaaauacauuuuugucag

SEQ ID NO: 682797 - RNA, 18 nt, Homo sapiens
auaaauacugcaaaucag

SEQ ID NO: 682798 - RNA, 20 nt, Homo sapiens
auaaauacugucaaacaaua

SEQ ID NO: 682799 - RNA, 14 nt, Homo sapiens
auaaauauauauuc

SEQ ID NO: 682800 - RNA, 14 nt, Homo sapiens
auaaauauauuuau

SEQ ID NO: 682801 - RNA, 11 nt, Homo sapiens
auaaauaucaa

SEQ ID NO: 682802 - RNA, 23 nt, Homo sapiens
auaaauaugguuaauuucaugua

SEQ ID NO: 682803 - RNA, 20 nt, Homo sapiens
auaaauauuauuagauuuau

SEQ ID NO: 682804 - RNA, 23 nt, Homo sapiens
auaaaucaacaccuuaauaugcu

SEQ ID NO: 682805 - RNA, 12 nt, Homo sapiens
auaaaucacuug

SEQ ID NO: 682806 - RNA, 21 nt, Homo sapiens
auaaaucauuaagacaacuga

SEQ ID NO: 682807 - RNA, 19 nt, Homo sapiens
auaaauccaauaucauguc

SEQ ID NO: 682808 - RNA, 23 nt, Homo sapiens
auaaauccucagguaguacuggg

SEQ ID NO: 682809 - RNA, 17 nt, Homo sapiens
auaaaucuaauaauuau

SEQ ID NO: 682810 - RNA, 17 nt, Homo sapiens
auaacagauccuuucaa

SEQ ID NO: 682811 - RNA, 17 nt, Homo sapiens
auaacagccucuugccc

SEQ ID NO: 682812 - RNA, 20 nt, Homo sapiens
auaacaguaguccuuugaua

SEQ ID NO: 682813 - RNA, 15 nt, Homo sapiens
auaacaucaacaaca

SEQ ID NO: 682814 - RNA, 18 nt, Homo sapiens
auaacaucaacaacacag

SEQ ID NO: 682815 - RNA, 16 nt, Homo sapiens
auaacauuuaaauucc

SEQ ID NO: 682816 - RNA, 23 nt, Homo sapiens
auaacauuuaaauuccacagauu

SEQ ID NO: 682817 - RNA, 17 nt, Homo sapiens
auaaccauaugauacua

SEQ ID NO: 682818 - RNA, 21 nt, Homo sapiens
auaacccuaggaauuuagaca

SEQ ID NO: 682819 - RNA, 19 nt, Homo sapiens
auaaccuuuauaugauaua

SEQ ID NO: 682820 - RNA, 22 nt, Homo sapiens
auaacguggggcuaggacacug

SEQ ID NO: 682821 - RNA, 16 nt, Homo sapiens
auaacuaaacuaacga

SEQ ID NO: 682822 - RNA, 23 nt, Homo sapiens
auaacucuacccuggcacuauaa

SEQ ID NO: 682823 - RNA, 17 nt, Homo sapiens
auaacucugcacuacuc

SEQ ID NO: 682824 - RNA, 18 nt, Homo sapiens
auaacucuguaaaaacac

SEQ ID NO: 682825 - RNA, 13 nt, Homo sapiens
auaacucuucuaa

SEQ ID NO: 682826 - RNA, 14 nt, Homo sapiens
auaacuuacuguau

SEQ ID NO: 682827 - RNA, 19 nt, Homo sapiens
auaacuuggccauguucuc

SEQ ID NO: 682828 - RNA, 16 nt, Homo sapiens
auaacuuuacagaaau

SEQ ID NO: 682829 - RNA, 20 nt, Homo sapiens
auaacuuuguuuagcccaaa

SEQ ID NO: 682830 - RNA, 21 nt, Homo sapiens
auaacuuuugguaucuacuuc

SEQ ID NO: 682831 - RNA, 15 nt, Homo sapiens
auaagaaacaugaug

SEQ ID NO: 682832 - RNA, 20 nt, Homo sapiens
auaagaaacaugaugugaga

SEQ ID NO: 682833 - RNA, 18 nt, Homo sapiens
auaagaaagaucaaagac

SEQ ID NO: 682834 - RNA, 15 nt, Homo sapiens
auaagaaagcacuau

SEQ ID NO: 682835 - RNA, 22 nt, Homo sapiens
auaagaacagagugccugcauu

SEQ ID NO: 682836 - RNA, 16 nt, Homo sapiens
auaagaagauacacug

SEQ ID NO: 682837 - RNA, 13 nt, Homo sapiens
auaagacuuccac

SEQ ID NO: 682838 - RNA, 16 nt, Homo sapiens
auaagagaagucucau

SEQ ID NO: 682839 - RNA, 14 nt, Homo sapiens
auaagagauccuuu

SEQ ID NO: 682840 - RNA, 17 nt, Homo sapiens
auaagaggugaucucug

SEQ ID NO: 682841 - RNA, 21 nt, Homo sapiens
auaagaguugagauuuugcaa

SEQ ID NO: 682842 - RNA, 20 nt, Homo sapiens
auaagauauauaugugcucu

SEQ ID NO: 682843 - RNA, 19 nt, Homo sapiens
auaagauauuuaguaauau

SEQ ID NO: 682844 - RNA, 13 nt, Homo sapiens
auaagauuccaaa

SEQ ID NO: 682845 - RNA, 19 nt, Homo sapiens
auaagcagaagcacauaug

SEQ ID NO: 682846 - RNA, 18 nt, Homo sapiens
auaagcauacaacuggac

SEQ ID NO: 682847 - RNA, 18 nt, Homo sapiens
auaagcccaguucaucac

SEQ ID NO: 682848 - RNA, 13 nt, Homo sapiens
auaagcucaguga

SEQ ID NO: 682849 - RNA, 17 nt, Homo sapiens
auaagcucgagugaauu

SEQ ID NO: 682850 - RNA, 14 nt, Homo sapiens
auaaggagaaaaau

SEQ ID NO: 682851 - RNA, 21 nt, Homo sapiens
auaaggaugacuuuagaauaa

SEQ ID NO: 682852 - RNA, 19 nt, Homo sapiens
auaaggccagaaacuccuu

SEQ ID NO: 682853 - RNA, 15 nt, Homo sapiens
auaagggguggggga

SEQ ID NO: 682854 - RNA, 21 nt, Homo sapiens
auaaggucuguaguauacaga

SEQ ID NO: 682855 - RNA, 13 nt, Homo sapiens
auaaguacauuau

SEQ ID NO: 682856 - RNA, 23 nt, Homo sapiens
auaaguacuagaugcaucacugg

SEQ ID NO: 682857 - RNA, 16 nt, Homo sapiens
auaaguagaaagaauu

SEQ ID NO: 682858 - RNA, 15 nt, Homo sapiens
auaagucuacauuaa

SEQ ID NO: 682859 - RNA, 16 nt, Homo sapiens
auaaguuaacuuccaa

SEQ ID NO: 682860 - RNA, 19 nt, Homo sapiens
auaaguuauugcaguuuau

SEQ ID NO: 682861 - RNA, 12 nt, Homo sapiens
auaaguuucaua

SEQ ID NO: 682862 - RNA, 22 nt, Homo sapiens
auaauaaaaaaauuagugagua

SEQ ID NO: 682863 - RNA, 18 nt, Homo sapiens
auaauaaaggcauuucaa

SEQ ID NO: 682864 - RNA, 19 nt, Homo sapiens
auaauaacucggauuccag

SEQ ID NO: 682865 - RNA, 15 nt, Homo sapiens
auaauaauugaucaa

SEQ ID NO: 682866 - RNA, 16 nt, Homo sapiens
auaauacuagucuuau

SEQ ID NO: 682867 - RNA, 18 nt, Homo sapiens
auaauacugugcagauuu

SEQ ID NO: 682868 - RNA, 13 nt, Homo sapiens
auaauacuugacc

SEQ ID NO: 682869 - RNA, 23 nt, Homo sapiens
auaauacuugcaacuaaggacaa

SEQ ID NO: 682870 - RNA, 14 nt, Homo sapiens
auaauagaugaugg

SEQ ID NO: 682871 - RNA, 22 nt, Homo sapiens
auaauagcacuaaugcuuuaag

SEQ ID NO: 682872 - RNA, 12 nt, Homo sapiens
auaauauacaug

SEQ ID NO: 682873 - RNA, 18 nt, Homo sapiens
auaauaucaaaacaagua

SEQ ID NO: 682874 - RNA, 12 nt, Homo sapiens
auaauaucccac

SEQ ID NO: 682875 - RNA, 23 nt, Homo sapiens
auaauaugaaaaucuccaucuca

SEQ ID NO: 682876 - RNA, 18 nt, Homo sapiens
auaauaugaugccacuuu

SEQ ID NO: 682877 - RNA, 16 nt, Homo sapiens
auaauauuagugauuc

SEQ ID NO: 682878 - RNA, 18 nt, Homo sapiens
auaauauucacacauauu

SEQ ID NO: 682879 - RNA, 19 nt, Homo sapiens
auaauauucagccagcuua

SEQ ID NO: 682880 - RNA, 19 nt, Homo sapiens
auaauauuuuacauacacu

SEQ ID NO: 682881 - RNA, 17 nt, Homo sapiens
auaauauuuuucuuaga

SEQ ID NO: 682882 - RNA, 22 nt, Homo sapiens
auaaucaacugaauugcaaaau

SEQ ID NO: 682883 - RNA, 21 nt, Homo sapiens
auaaucacagauuagcuguaa

SEQ ID NO: 682884 - RNA, 18 nt, Homo sapiens
auaaucaucucugucaca

SEQ ID NO: 682885 - RNA, 15 nt, Homo sapiens
auaaucgaaguaauu

SEQ ID NO: 682886 - RNA, 12 nt, Homo sapiens
auaaucuacucc

SEQ ID NO: 682887 - RNA, 17 nt, Homo sapiens
auaaucuguauucuugc

SEQ ID NO: 682888 - RNA, 22 nt, Homo sapiens
auaaucuuggcaauuuuugaca

SEQ ID NO: 682889 - RNA, 13 nt, Homo sapiens
auaaugaaugaga

SEQ ID NO: 682890 - RNA, 14 nt, Homo sapiens
auaaugauacuuaa

SEQ ID NO: 682891 - RNA, 12 nt, Homo sapiens
auaaugaugaug

SEQ ID NO: 682892 - RNA, 14 nt, Homo sapiens
auaaugaugcuguc

SEQ ID NO: 682893 - RNA, 20 nt, Homo sapiens
auaaugauucauaagacacu

SEQ ID NO: 682894 - RNA, 13 nt, Homo sapiens
auaaugcaauccu

SEQ ID NO: 682895 - RNA, 17 nt, Homo sapiens
auaaugcaauggaagaa

SEQ ID NO: 682896 - RNA, 15 nt, Homo sapiens
auaaugcucacuugg

SEQ ID NO: 682897 - RNA, 18 nt, Homo sapiens
auaaugcucccaucuccu

SEQ ID NO: 682898 - RNA, 23 nt, Homo sapiens
auaaugcugaagaccccaaagau

SEQ ID NO: 682899 - RNA, 22 nt, Homo sapiens
auaaugcuuucacaacauuugc

SEQ ID NO: 682900 - RNA, 20 nt, Homo sapiens
auaauggcaucaauauacau

SEQ ID NO: 682901 - RNA, 22 nt, Homo sapiens
auaauggucaguccucaucucu

SEQ ID NO: 682902 - RNA, 18 nt, Homo sapiens
auaaugguugacuggguu

SEQ ID NO: 682903 - RNA, 14 nt, Homo sapiens
auaauguauuuuca

SEQ ID NO: 682904 - RNA, 14 nt, Homo sapiens
auaaugugcaaauc

SEQ ID NO: 682905 - RNA, 16 nt, Homo sapiens
auaauguuaagcuuua

SEQ ID NO: 682906 - RNA, 22 nt, Homo sapiens
auaauguuaucuguguagcaag

SEQ ID NO: 682907 - RNA, 18 nt, Homo sapiens
auaauuccuacagcacua

SEQ ID NO: 682908 - RNA, 22 nt, Homo sapiens
auaauuccuauauccugugacu

SEQ ID NO: 682909 - RNA, 15 nt, Homo sapiens
auacuauccaguuac

SEQ ID NO: 682910 - RNA, 22 nt, Homo sapiens
auacucaggacuccucuccgca

SEQ ID NO: 682911 - RNA, 23 nt, Homo sapiens
auacucagguaccucuuucaggg

SEQ ID NO: 682912 - RNA, 21 nt, Homo sapiens
auacuccaacugaaauguuaa

SEQ ID NO: 682913 - RNA, 18 nt, Homo sapiens
auacuccauacauaacuu

SEQ ID NO: 682914 - RNA, 14 nt, Homo sapiens
auacuccugucacc

SEQ ID NO: 682915 - RNA, 19 nt, Homo sapiens
auacucuagaacaugcaca

SEQ ID NO: 682916 - RNA, 15 nt, Homo sapiens
auacucuagaugaag

SEQ ID NO: 682917 - RNA, 15 nt, Homo sapiens
auacucucuccacuu

SEQ ID NO: 682918 - RNA, 16 nt, Homo sapiens
auacucugaauuugga

SEQ ID NO: 682919 - RNA, 18 nt, Homo sapiens
auacugaaggaaaaacac

SEQ ID NO: 682920 - RNA, 14 nt, Homo sapiens
auacugaaggacac

SEQ ID NO: 682921 - RNA, 19 nt, Homo sapiens
auacugacacuuugccaga

SEQ ID NO: 682922 - RNA, 13 nt, Homo sapiens
auacugacuccua

SEQ ID NO: 682923 - RNA, 15 nt, Homo sapiens
auacugagccugcca

SEQ ID NO: 682924 - RNA, 14 nt, Homo sapiens
auacugaugcauug

SEQ ID NO: 682925 - RNA, 15 nt, Homo sapiens
auacugcuacuguaa

SEQ ID NO: 682926 - RNA, 20 nt, Homo sapiens
auacuggccaugccuggaga

SEQ ID NO: 682927 - RNA, 19 nt, Homo sapiens
auacuggccuggacuguuu

SEQ ID NO: 682928 - RNA, 22 nt, Homo sapiens
auacuggguucuuaguugacaa

SEQ ID NO: 682929 - RNA, 22 nt, Homo sapiens
auacuguaggcacacuuugcac

SEQ ID NO: 682930 - RNA, 13 nt, Homo sapiens
auacuguguaugu

SEQ ID NO: 682931 - RNA, 20 nt, Homo sapiens
auacuguucaaugguucuga

SEQ ID NO: 682932 - RNA, 19 nt, Homo sapiens
auacuuaaaaugacaaagc

SEQ ID NO: 682933 - RNA, 14 nt, Homo sapiens
auacuuaaucucac

SEQ ID NO: 682934 - RNA, 15 nt, Homo sapiens
augcuguugccucau

SEQ ID NO: 682935 - RNA, 17 nt, Homo sapiens
augcuuaaacuaaauaa

SEQ ID NO: 682936 - RNA, 11 nt, Homo sapiens
augcuuaccuu

SEQ ID NO: 682937 - RNA, 16 nt, Homo sapiens
augcuuacuccacuuc

SEQ ID NO: 682938 - RNA, 15 nt, Homo sapiens
augcuucagauauua

SEQ ID NO: 682939 - RNA, 17 nt, Homo sapiens
augcuuggcuaacuaua

SEQ ID NO: 682940 - RNA, 23 nt, Homo sapiens
augcuuggguacacuucucuuaa

SEQ ID NO: 682941 - RNA, 15 nt, Homo sapiens
augcuuugcuucaaa

SEQ ID NO: 682942 - RNA, 20 nt, Homo sapiens
augcuuuucugccacuccau

SEQ ID NO: 682943 - RNA, 15 nt, Homo sapiens
augcuuuugcuugca

SEQ ID NO: 682944 - RNA, 23 nt, Homo sapiens
augcuuuugguccagguacugag

SEQ ID NO: 682945 - RNA, 16 nt, Homo sapiens
auggaaaaaucuugga

SEQ ID NO: 682946 - RNA, 16 nt, Homo sapiens
auggaaaacagacuca

SEQ ID NO: 682947 - RNA, 15 nt, Homo sapiens
auggaaaacuguguu

SEQ ID NO: 682948 - RNA, 18 nt, Homo sapiens
auggaaacauuacaguuc

SEQ ID NO: 682949 - RNA, 15 nt, Homo sapiens
auggaaacauuuuau

SEQ ID NO: 682950 - RNA, 14 nt, Homo sapiens
auggaacacggcca

SEQ ID NO: 682951 - RNA, 15 nt, Homo sapiens
auggaacagcauuac

SEQ ID NO: 682952 - RNA, 16 nt, Homo sapiens
auggaacucucuccac

SEQ ID NO: 682953 - RNA, 18 nt, Homo sapiens
auggaaguggcagugaaa

SEQ ID NO: 682954 - RNA, 23 nt, Homo sapiens
auggaaguugcagugagcugaua

SEQ ID NO: 682955 - RNA, 15 nt, Homo sapiens
auggaauaaaccauu

SEQ ID NO: 682956 - RNA, 18 nt, Homo sapiens
auggaauaagcagaaacu

SEQ ID NO: 682957 - RNA, 16 nt, Homo sapiens
auggaauaucagaagu

SEQ ID NO: 682958 - RNA, 18 nt, Homo sapiens
auggaauauucauuuuac

SEQ ID NO: 682959 - RNA, 14 nt, Homo sapiens
auggaaucaauuca

SEQ ID NO: 682960 - RNA, 15 nt, Homo sapiens
auggaaucaauucaa

SEQ ID NO: 682961 - RNA, 19 nt, Homo sapiens
auggaauucccuccugagu

SEQ ID NO: 682962 - RNA, 22 nt, Homo sapiens
auggaauucguguuaugaaucu

SEQ ID NO: 682963 - RNA, 15 nt, Homo sapiens
auggacaaaggccug

SEQ ID NO: 682964 - RNA, 15 nt, Homo sapiens
auggacaagauuacc

SEQ ID NO: 682965 - RNA, 12 nt, Homo sapiens
auggacacucca

SEQ ID NO: 682966 - RNA, 18 nt, Homo sapiens
auggacacuccagugcca

SEQ ID NO: 682967 - RNA, 11 nt, Homo sapiens
auggacacuuu

SEQ ID NO: 682968 - RNA, 14 nt, Homo sapiens
auggacagcgauga

SEQ ID NO: 682969 - RNA, 18 nt, Homo sapiens
auggacaugaucuucuuu

SEQ ID NO: 682970 - RNA, 16 nt, Homo sapiens
auggaccagaagccaa

SEQ ID NO: 682971 - RNA, 23 nt, Homo sapiens
auggaccugccccggaccuaccu

SEQ ID NO: 682972 - RNA, 22 nt, Homo sapiens
auggacuggagcucaucugcaa

SEQ ID NO: 682973 - RNA, 20 nt, Homo sapiens
auggacugggaaaaacauca

SEQ ID NO: 682974 - RNA, 20 nt, Homo sapiens
auggacuuccacugccaucc

SEQ ID NO: 682975 - RNA, 15 nt, Homo sapiens
auggacuuguauauu

SEQ ID NO: 682976 - RNA, 22 nt, Homo sapiens
auggagacuuuuaucuacuucu

SEQ ID NO: 682977 - RNA, 16 nt, Homo sapiens
auggagaggacagagc

SEQ ID NO: 682978 - RNA, 19 nt, Homo sapiens
auggagccuggaacugcau

SEQ ID NO: 682979 - RNA, 18 nt, Homo sapiens
auggaggaaagugauauc

SEQ ID NO: 682980 - RNA, 16 nt, Homo sapiens
auggaggaacccaaga

SEQ ID NO: 682981 - RNA, 17 nt, Homo sapiens
auggaggcaugccaaau

SEQ ID NO: 682982 - RNA, 14 nt, Homo sapiens
auggaggccagcua

SEQ ID NO: 682983 - RNA, 19 nt, Homo sapiens
auggaggucauacaugcau

SEQ ID NO: 682984 - RNA, 18 nt, Homo sapiens
auggagugcaccaaagag

SEQ ID NO: 682985 - RNA, 19 nt, Homo sapiens
auggaguguuuuaguucuu

SEQ ID NO: 682986 - RNA, 17 nt, Homo sapiens
auggauaaacugagccu

SEQ ID NO: 682987 - RNA, 22 nt, Homo sapiens
auggaugaaucucccacuccag

SEQ ID NO: 682988 - RNA, 15 nt, Homo sapiens
auggaugaucuggga

SEQ ID NO: 682989 - RNA, 15 nt, Homo sapiens
auggaugucuucuag

SEQ ID NO: 682990 - RNA, 18 nt, Homo sapiens
auggauguuuuagccauu

SEQ ID NO: 682991 - RNA, 14 nt, Homo sapiens
auggauuuccagcc

SEQ ID NO: 682992 - RNA, 17 nt, Homo sapiens
auggcaagugauaucac

SEQ ID NO: 682993 - RNA, 22 nt, Homo sapiens
auggcaccacugcacuccagcc

SEQ ID NO: 682994 - RNA, 15 nt, Homo sapiens
auggcaccuuuugca

SEQ ID NO: 682995 - RNA, 16 nt, Homo sapiens
auggcagaaccaaagc

SEQ ID NO: 682996 - RNA, 17 nt, Homo sapiens
auggcagcugguugcuc

SEQ ID NO: 682997 - RNA, 19 nt, Homo sapiens
auggcagcugguugcucca

SEQ ID NO: 682998 - RNA, 18 nt, Homo sapiens
auggcagcuguuucucau

SEQ ID NO: 682999 - RNA, 19 nt, Homo sapiens
auggcaggauccaaggggc

SEQ ID NO: 683000 - RNA, 19 nt, Homo sapiens
auggcaguuugaagucaaa

SEQ ID NO: 683001 - RNA, 13 nt, Homo sapiens
auggcaucuucaa

SEQ ID NO: 683002 - RNA, 16 nt, Homo sapiens
auggcauuuggucuca

SEQ ID NO: 683003 - RNA, 16 nt, Homo sapiens
auggccaauaacuuuu

SEQ ID NO: 683004 - RNA, 13 nt, Homo sapiens
auggccacuguga

SEQ ID NO: 683005 - RNA, 14 nt, Homo sapiens
auggccaggccaga

SEQ ID NO: 683006 - RNA, 12 nt, Homo sapiens
auggccaugcag

SEQ ID NO: 683007 - RNA, 13 nt, Homo sapiens
auggccaugcccu

SEQ ID NO: 683008 - RNA, 21 nt, Homo sapiens
auggcccucccagugccuccu

SEQ ID NO: 683009 - RNA, 23 nt, Homo sapiens
auggccgaaaaggauaugcagua

SEQ ID NO: 683010 - RNA, 15 nt, Homo sapiens
auggccuaaauuuau

SEQ ID NO: 683011 - RNA, 13 nt, Homo sapiens
auggccucauggg

SEQ ID NO: 683012 - RNA, 15 nt, Homo sapiens
auggccuggauucac

SEQ ID NO: 683013 - RNA, 19 nt, Homo sapiens
auggccuggcugccuggug

SEQ ID NO: 683014 - RNA, 17 nt, Homo sapiens
auggcggccugcagugg

SEQ ID NO: 683015 - RNA, 16 nt, Homo sapiens
auggcgggcacugggu

SEQ ID NO: 683016 - RNA, 18 nt, Homo sapiens
auggcggucagccccuuc

SEQ ID NO: 683017 - RNA, 17 nt, Homo sapiens
auggcuaugccuugcac

SEQ ID NO: 683018 - RNA, 22 nt, Homo sapiens
auggcuggaagggguccagccu

SEQ ID NO: 683019 - RNA, 17 nt, Homo sapiens
auggcugggaacaugac

SEQ ID NO: 683020 - RNA, 18 nt, Homo sapiens
auguaucagccagccuuc

SEQ ID NO: 683021 - RNA, 14 nt, Homo sapiens
auguaucaguuuuc

SEQ ID NO: 683022 - RNA, 14 nt, Homo sapiens
auguaugcaccuca

SEQ ID NO: 683023 - RNA, 15 nt, Homo sapiens
auguaugcaccucaa

SEQ ID NO: 683024 - RNA, 12 nt, Homo sapiens
auguaugcagcu

SEQ ID NO: 683025 - RNA, 21 nt, Homo sapiens
auguauggaaucccacuguau

SEQ ID NO: 683026 - RNA, 17 nt, Homo sapiens
auguauguacaauacaa

SEQ ID NO: 683027 - RNA, 12 nt, Homo sapiens
auguaugugcac

SEQ ID NO: 683028 - RNA, 21 nt, Homo sapiens
auguauuaguaugguucaaga

SEQ ID NO: 683029 - RNA, 21 nt, Homo sapiens
auguauuuauuugggagaccg

SEQ ID NO: 683030 - RNA, 20 nt, Homo sapiens
auguauuucagggaccucag

SEQ ID NO: 683031 - RNA, 16 nt, Homo sapiens
auguauuugaacacuu

SEQ ID NO: 683032 - RNA, 20 nt, Homo sapiens
auguauuuguuugcaauuuu

SEQ ID NO: 683033 - RNA, 16 nt, Homo sapiens
auguauuuuugucaau

SEQ ID NO: 683034 - RNA, 13 nt, Homo sapiens
augucaacagauc

SEQ ID NO: 683035 - RNA, 14 nt, Homo sapiens
augucaacagaucc

SEQ ID NO: 683036 - RNA, 22 nt, Homo sapiens
augucaacuucuggcuccucaa

SEQ ID NO: 683037 - RNA, 14 nt, Homo sapiens
augucaagagucgc

SEQ ID NO: 683038 - RNA, 23 nt, Homo sapiens
augucaaguaccaaaauguuaau

SEQ ID NO: 683039 - RNA, 19 nt, Homo sapiens
augucacagauuccuggca

SEQ ID NO: 683040 - RNA, 18 nt, Homo sapiens
augucacagggccaacuu

SEQ ID NO: 683041 - RNA, 13 nt, Homo sapiens
augucaccaccuu

SEQ ID NO: 683042 - RNA, 20 nt, Homo sapiens
augucaccguggaccuuccu

SEQ ID NO: 683043 - RNA, 19 nt, Homo sapiens
augucagacagaacuugaa

SEQ ID NO: 683044 - RNA, 19 nt, Homo sapiens
augucagauaaguguaaau

SEQ ID NO: 683045 - RNA, 16 nt, Homo sapiens
augucagugucacugg

SEQ ID NO: 683046 - RNA, 16 nt, Homo sapiens
augucauagccaaagc

SEQ ID NO: 683047 - RNA, 18 nt, Homo sapiens
augucauauuuugccacu

SEQ ID NO: 683048 - RNA, 13 nt, Homo sapiens
augucaucaugcu

SEQ ID NO: 683049 - RNA, 16 nt, Homo sapiens
augucaucaugcuuau

SEQ ID NO: 683050 - RNA, 20 nt, Homo sapiens
augucaugaggaaacuacug

SEQ ID NO: 683051 - RNA, 22 nt, Homo sapiens
augucauuauuuauuguuaaau

SEQ ID NO: 683052 - RNA, 15 nt, Homo sapiens
auguccaaacuaauu

SEQ ID NO: 683053 - RNA, 22 nt, Homo sapiens
auguccaauggaguucagagau

SEQ ID NO: 683054 - RNA, 14 nt, Homo sapiens
auguccaccaugaa

SEQ ID NO: 683055 - RNA, 21 nt, Homo sapiens
auguccaccaugaacuugaua

SEQ ID NO: 683056 - RNA, 13 nt, Homo sapiens
auguccaggaaag

SEQ ID NO: 683057 - RNA, 15 nt, Homo sapiens
auguccauacuauga

SEQ ID NO: 683058 - RNA, 20 nt, Homo sapiens
auauuaaauuucaaaugcag

SEQ ID NO: 683059 - RNA, 19 nt, Homo sapiens
auauuaacaacaauaacac

SEQ ID NO: 683060 - RNA, 14 nt, Homo sapiens
auauuaacauucuu

SEQ ID NO: 683061 - RNA, 12 nt, Homo sapiens
auauuaacuuuu

SEQ ID NO: 683062 - RNA, 21 nt, Homo sapiens
auauuaagaaagacuaucuaa

SEQ ID NO: 683063 - RNA, 19 nt, Homo sapiens
auauuaaguccaaauccaa

SEQ ID NO: 683064 - RNA, 13 nt, Homo sapiens
auauuacagugaa

SEQ ID NO: 683065 - RNA, 14 nt, Homo sapiens
auauuagggaguaa

SEQ ID NO: 683066 - RNA, 19 nt, Homo sapiens
auauuaguuaaucuccuca

SEQ ID NO: 683067 - RNA, 13 nt, Homo sapiens
auauuauaacucu

SEQ ID NO: 683068 - RNA, 14 nt, Homo sapiens
auauuaucuaccug

SEQ ID NO: 683069 - RNA, 12 nt, Homo sapiens
auauuaucucau

SEQ ID NO: 683070 - RNA, 16 nt, Homo sapiens
auauucaaaauuccaa

SEQ ID NO: 683071 - RNA, 13 nt, Homo sapiens
auauucaaguaac

SEQ ID NO: 683072 - RNA, 17 nt, Homo sapiens
auauucaaguaacacuu

SEQ ID NO: 683073 - RNA, 14 nt, Homo sapiens
auauucaaugcaag

SEQ ID NO: 683074 - RNA, 20 nt, Homo sapiens
auauucagauauaaaacagu

SEQ ID NO: 683075 - RNA, 22 nt, Homo sapiens
auauucaggcuacucauucagu

SEQ ID NO: 683076 - RNA, 16 nt, Homo sapiens
auauuccaauacccua

SEQ ID NO: 683077 - RNA, 17 nt, Homo sapiens
auauuccaccauucaca

SEQ ID NO: 683078 - RNA, 21 nt, Homo sapiens
auauuccugcauuugugaaau

SEQ ID NO: 683079 - RNA, 21 nt, Homo sapiens
auauuccugguguagcacuua

SEQ ID NO: 683080 - RNA, 16 nt, Homo sapiens
auauuccuuugaagau

SEQ ID NO: 683081 - RNA, 14 nt, Homo sapiens
auauucuacuaugc

SEQ ID NO: 683082 - RNA, 16 nt, Homo sapiens
auauucuacuaugcau

SEQ ID NO: 683083 - RNA, 15 nt, Homo sapiens
auauucucauuuuaa

SEQ ID NO: 683084 - RNA, 17 nt, Homo sapiens
auauucugcaacacugu

SEQ ID NO: 683085 - RNA, 23 nt, Homo sapiens
auauucuguugcuuuacaguuac

SEQ ID NO: 683086 - RNA, 14 nt, Homo sapiens
auauucuucuacca

SEQ ID NO: 683087 - RNA, 22 nt, Homo sapiens
auauucuuuaaacaaauaugaa

SEQ ID NO: 683088 - RNA, 16 nt, Homo sapiens
auauucuuugguugug

SEQ ID NO: 683089 - RNA, 23 nt, Homo sapiens
auauugaaauuuauuuaauguga

SEQ ID NO: 683090 - RNA, 18 nt, Homo sapiens
auauugcaguaguauuua

SEQ ID NO: 683091 - RNA, 18 nt, Homo sapiens
auauugcagucaaucucu

SEQ ID NO: 683092 - RNA, 20 nt, Homo sapiens
auauuggaaagugauuuuau

SEQ ID NO: 683093 - RNA, 16 nt, Homo sapiens
auauuguaaagcccau

SEQ ID NO: 683094 - RNA, 18 nt, Homo sapiens
auauuguaaucacauucc

SEQ ID NO: 683095 - RNA, 14 nt, Homo sapiens
auauuguagcucaa

SEQ ID NO: 683096 - RNA, 22 nt, Homo sapiens
auauugugaacccuagcugugu

SEQ ID NO: 683097 - RNA, 20 nt, Homo sapiens
auauugugucauagaauuaa

SEQ ID NO: 683098 - RNA, 14 nt, Homo sapiens
auauuguuuuacaa

SEQ ID NO: 683099 - RNA, 15 nt, Homo sapiens
auauuuaaaacauca

SEQ ID NO: 683100 - RNA, 14 nt, Homo sapiens
auauuuaaugcauu

SEQ ID NO: 683101 - RNA, 21 nt, Homo sapiens
auauuuaauguggaaugucaa

SEQ ID NO: 683102 - RNA, 14 nt, Homo sapiens
auauuuacaaugua

SEQ ID NO: 683103 - RNA, 19 nt, Homo sapiens
auauuuacauaaagacugu

SEQ ID NO: 683104 - RNA, 20 nt, Homo sapiens
auauuuagaaaaacauccca

SEQ ID NO: 683105 - RNA, 16 nt, Homo sapiens
auauuuauaacucauc

SEQ ID NO: 683106 - RNA, 19 nt, Homo sapiens
auauuuauagcaauccaug

SEQ ID NO: 683107 - RNA, 14 nt, Homo sapiens
auauuuauguagau

SEQ ID NO: 683108 - RNA, 21 nt, Homo sapiens
auauuuauuuauguguucaca

SEQ ID NO: 683109 - RNA, 14 nt, Homo sapiens
auauuuauuuccag

SEQ ID NO: 683110 - RNA, 22 nt, Homo sapiens
auauuucagauaucagaaucau

SEQ ID NO: 683111 - RNA, 13 nt, Homo sapiens
auauuucaggcau

SEQ ID NO: 683112 - RNA, 14 nt, Homo sapiens
auauuucaggcaua

SEQ ID NO: 683113 - RNA, 16 nt, Homo sapiens
auauuuccauuaacag

SEQ ID NO: 683114 - RNA, 23 nt, Homo sapiens
auauuuccuauuguucacuuuau

SEQ ID NO: 683115 - RNA, 17 nt, Homo sapiens
auauuuccugacuugag

SEQ ID NO: 683116 - RNA, 16 nt, Homo sapiens
auauuucuaacuauau

SEQ ID NO: 683117 - RNA, 14 nt, Homo sapiens
auauuucuagacau

SEQ ID NO: 683118 - RNA, 21 nt, Homo sapiens
auauuugaauuuuaaaucuaa

SEQ ID NO: 683119 - RNA, 13 nt, Homo sapiens
auauuugcuagac

SEQ ID NO: 683120 - RNA, 17 nt, Homo sapiens
auauuugcuagauuucu

SEQ ID NO: 683121 - RNA, 23 nt, Homo sapiens
auauuugcuagauuucuaaagaa

SEQ ID NO: 683122 - RNA, 13 nt, Homo sapiens
auauuugucauaa

SEQ ID NO: 683123 - RNA, 21 nt, Homo sapiens
auauuuuaaaaauaaauucaa

SEQ ID NO: 683124 - RNA, 16 nt, Homo sapiens
auauuuuaaagaccaa

SEQ ID NO: 683125 - RNA, 14 nt, Homo sapiens
auauuuuaaauauc

SEQ ID NO: 683126 - RNA, 16 nt, Homo sapiens
auauuuuaagccuuca

SEQ ID NO: 683127 - RNA, 14 nt, Homo sapiens
auauuuuagaagcu

SEQ ID NO: 683128 - RNA, 17 nt, Homo sapiens
auauuuuagcauuuuaa

SEQ ID NO: 683129 - RNA, 18 nt, Homo sapiens
auauuuuguaacuauuac

SEQ ID NO: 683130 - RNA, 22 nt, Homo sapiens
auauuuuuaguagagacagggu

SEQ ID NO: 683131 - RNA, 18 nt, Homo sapiens
auauuuuuaugugcaaua

SEQ ID NO: 683132 - RNA, 20 nt, Homo sapiens
auauuuuucaucaaacauug

SEQ ID NO: 683133 - RNA, 15 nt, Homo sapiens
auauuuuucugagau

SEQ ID NO: 683134 - RNA, 22 nt, Homo sapiens
auauuuuuguacugaaucucau

SEQ ID NO: 683135 - RNA, 18 nt, Homo sapiens
aucaaaaaaccuuuacag

SEQ ID NO: 683136 - RNA, 14 nt, Homo sapiens
aucaaaaagccuua

SEQ ID NO: 683137 - RNA, 19 nt, Homo sapiens
aucaaaacuaaccaucuga

SEQ ID NO: 683138 - RNA, 20 nt, Homo sapiens
aucaaaauaaaaagugacac

SEQ ID NO: 683139 - RNA, 23 nt, Homo sapiens
aucaaacauuggauuuuuccuua

SEQ ID NO: 683140 - RNA, 19 nt, Homo sapiens
aucaaacauuuucuggcca

SEQ ID NO: 683141 - RNA, 21 nt, Homo sapiens
aucaaaccaggugcaauuauu

SEQ ID NO: 683142 - RNA, 16 nt, Homo sapiens
aucaaaccucagggau

SEQ ID NO: 683143 - RNA, 17 nt, Homo sapiens
aucaaagaaagaugaaa

SEQ ID NO: 683144 - RNA, 16 nt, Homo sapiens
aucaaagaaauucaga

SEQ ID NO: 683145 - RNA, 17 nt, Homo sapiens
aucaaagaacaaacauc

SEQ ID NO: 683146 - RNA, 13 nt, Homo sapiens
aucaaagaauuac

SEQ ID NO: 683147 - RNA, 12 nt, Homo sapiens
aucaaagcacuu

SEQ ID NO: 683148 - RNA, 17 nt, Homo sapiens
aucaaaucucuuccaca

SEQ ID NO: 683149 - RNA, 21 nt, Homo sapiens
aucaaaugccccgaauuuagu

SEQ ID NO: 683150 - RNA, 22 nt, Homo sapiens
augacagugaagcagcacugug

SEQ ID NO: 683151 - RNA, 23 nt, Homo sapiens
augacagugaagcagcacuguga

SEQ ID NO: 683152 - RNA, 20 nt, Homo sapiens
augacauagccaauggacaa

SEQ ID NO: 683153 - RNA, 13 nt, Homo sapiens
augacaucacuug

SEQ ID NO: 683154 - RNA, 14 nt, Homo sapiens
augacaucagcaau

SEQ ID NO: 683155 - RNA, 18 nt, Homo sapiens
augacaucucaggggcca

SEQ ID NO: 683156 - RNA, 21 nt, Homo sapiens
augacaugcacucagcucuug

SEQ ID NO: 683157 - RNA, 12 nt, Homo sapiens
augacauguuau

SEQ ID NO: 683158 - RNA, 18 nt, Homo sapiens
augacauuucaucugggu

SEQ ID NO: 683159 - RNA, 24 nt, Homo sapiens
augaccaaaaucaggaaccacaga

SEQ ID NO: 683160 - RNA, 19 nt, Homo sapiens
augaccaggccaagacuca

SEQ ID NO: 683161 - RNA, 23 nt, Homo sapiens
augaccaguaaaggcugcugcua

SEQ ID NO: 683162 - RNA, 14 nt, Homo sapiens
augacccacacugc

SEQ ID NO: 683163 - RNA, 20 nt, Homo sapiens
augaccccuucucucuccag

SEQ ID NO: 683164 - RNA, 18 nt, Homo sapiens
augaccucucuacuuccc

SEQ ID NO: 683165 - RNA, 20 nt, Homo sapiens
augaccuggcaacaaaaagu

SEQ ID NO: 683166 - RNA, 22 nt, Homo sapiens
augaccuguuauuaccauuagc

SEQ ID NO: 683167 - RNA, 21 nt, Homo sapiens
augacggggccacgugugcug

SEQ ID NO: 683168 - RNA, 23 nt, Homo sapiens
augacgguguccaugccuuccau

SEQ ID NO: 683169 - RNA, 15 nt, Homo sapiens
augacguccucucaa

SEQ ID NO: 683170 - RNA, 22 nt, Homo sapiens
augacguuaugggcacaugccu

SEQ ID NO: 683171 - RNA, 12 nt, Homo sapiens
augacuaaagag

SEQ ID NO: 683172 - RNA, 20 nt, Homo sapiens
augacuauguuucuauucua

SEQ ID NO: 683173 - RNA, 13 nt, Homo sapiens
augacucaguaag

SEQ ID NO: 683174 - RNA, 18 nt, Homo sapiens
augacugcacccagcucc

SEQ ID NO: 683175 - RNA, 15 nt, Homo sapiens
augacugcauuuuac

SEQ ID NO: 683176 - RNA, 20 nt, Homo sapiens
augacugcauuuuacuguac

SEQ ID NO: 683177 - RNA, 22 nt, Homo sapiens
augacuggaguaaaccauguau

SEQ ID NO: 683178 - RNA, 17 nt, Homo sapiens
augacugugaacugggc

SEQ ID NO: 683179 - RNA, 19 nt, Homo sapiens
augacuguuacagcuuucu

SEQ ID NO: 683180 - RNA, 15 nt, Homo sapiens
augacuuaaccauau

SEQ ID NO: 683181 - RNA, 16 nt, Homo sapiens
augacuugccauuaaa

SEQ ID NO: 683182 - RNA, 13 nt, Homo sapiens
augacuugcuacu

SEQ ID NO: 683183 - RNA, 13 nt, Homo sapiens
augagaaagggag

SEQ ID NO: 683184 - RNA, 20 nt, Homo sapiens
augagaaaguucucauuuaa

SEQ ID NO: 683185 - RNA, 19 nt, Homo sapiens
augagaaauuuuguugaua

SEQ ID NO: 683186 - RNA, 13 nt, Homo sapiens
augagaacauucc

SEQ ID NO: 683187 - RNA, 17 nt, Homo sapiens
augagaauuguauguca

SEQ ID NO: 683188 - RNA, 20 nt, Homo sapiens
augagacaauuuugcuucac

SEQ ID NO: 683189 - RNA, 20 nt, Homo sapiens
augagaccguucgcauggca

SEQ ID NO: 683190 - RNA, 15 nt, Homo sapiens
augagagaacuggag

SEQ ID NO: 683191 - RNA, 18 nt, Homo sapiens
augagagaaggaggggag

SEQ ID NO: 683192 - RNA, 13 nt, Homo sapiens
augagagggccca

SEQ ID NO: 683193 - RNA, 19 nt, Homo sapiens
augagcacaucucucugcc

SEQ ID NO: 683194 - RNA, 18 nt, Homo sapiens
augagcauuacuauucac

SEQ ID NO: 683195 - RNA, 22 nt, Homo sapiens
augagccacugcaccugcccag

SEQ ID NO: 683196 - RNA, 16 nt, Homo sapiens
augagccgcugugagc

SEQ ID NO: 683197 - RNA, 14 nt, Homo sapiens
augagcuccagacc

SEQ ID NO: 683198 - RNA, 22 nt, Homo sapiens
augaggaaggaacagcaauggu

SEQ ID NO: 683199 - RNA, 20 nt, Homo sapiens
augaggagaaaggggcccca

SEQ ID NO: 683200 - RNA, 14 nt, Homo sapiens
augaggccaucuca

SEQ ID NO: 683201 - RNA, 15 nt, Homo sapiens
augaggccaucucag

SEQ ID NO: 683202 - RNA, 13 nt, Homo sapiens
augagggaaaaug

SEQ ID NO: 683203 - RNA, 16 nt, Homo sapiens
augagggaaaaugagu

SEQ ID NO: 683204 - RNA, 14 nt, Homo sapiens
augaggggugcugg

SEQ ID NO: 683205 - RNA, 15 nt, Homo sapiens
augagguacucuccu

SEQ ID NO: 683206 - RNA, 22 nt, Homo sapiens
augaggucaauuuccugaugca

SEQ ID NO: 683207 - RNA, 23 nt, Homo sapiens
augaggucuguuuaaaguggcaa

SEQ ID NO: 683208 - RNA, 16 nt, Homo sapiens
augagguuuuuccaaa

SEQ ID NO: 683209 - RNA, 14 nt, Homo sapiens
augaguaucugugg

SEQ ID NO: 683210 - RNA, 22 nt, Homo sapiens
augagucggauacccuggagca

SEQ ID NO: 683211 - RNA, 13 nt, Homo sapiens
augagugacugcc

SEQ ID NO: 683212 - RNA, 14 nt, Homo sapiens
augagugcuuaaac

SEQ ID NO: 683213 - RNA, 16 nt, Homo sapiens
augaguuacuguuuaa

SEQ ID NO: 683214 - RNA, 14 nt, Homo sapiens
augaguuacuugaa

SEQ ID NO: 683215 - RNA, 13 nt, Homo sapiens
augaguugguucu

SEQ ID NO: 683216 - RNA, 17 nt, Homo sapiens
augaguuuaucauguca

SEQ ID NO: 683217 - RNA, 16 nt, Homo sapiens
augaguuucacuguac

SEQ ID NO: 683218 - RNA, 19 nt, Homo sapiens
augaguuucuuaacccuuu

SEQ ID NO: 683219 - RNA, 21 nt, Homo sapiens
augaguuuuugauagcuuuau

SEQ ID NO: 683220 - RNA, 15 nt, Homo sapiens
augauaaaauacuaa

SEQ ID NO: 683221 - RNA, 13 nt, Homo sapiens
augauaccaccuu

SEQ ID NO: 683222 - RNA, 14 nt, Homo sapiens
augauacuucccac

SEQ ID NO: 683223 - RNA, 13 nt, Homo sapiens
augauaugaccag

SEQ ID NO: 683224 - RNA, 20 nt, Homo sapiens
augaucacauucuuuccaaa

SEQ ID NO: 683225 - RNA, 19 nt, Homo sapiens
augaucagacauacagcug

SEQ ID NO: 683226 - RNA, 22 nt, Homo sapiens
augaucaguguuguugcucuag

SEQ ID NO: 683227 - RNA, 21 nt, Homo sapiens
augaucauaauguuaacuaaa

SEQ ID NO: 683228 - RNA, 15 nt, Homo sapiens
augaucccagucacu

SEQ ID NO: 683229 - RNA, 16 nt, Homo sapiens
augauccuugcugaua

SEQ ID NO: 683230 - RNA, 15 nt, Homo sapiens
augaucgcuaucuag

SEQ ID NO: 683231 - RNA, 14 nt, Homo sapiens
augaucuuguguaa

SEQ ID NO: 683232 - RNA, 18 nt, Homo sapiens
augaucuuguuacuguga

SEQ ID NO: 683233 - RNA, 16 nt, Homo sapiens
augaugaaacauucau

SEQ ID NO: 683234 - RNA, 16 nt, Homo sapiens
augaugagaagcagaa

SEQ ID NO: 683235 - RNA, 19 nt, Homo sapiens
augaugagaguuucuguua

SEQ ID NO: 683236 - RNA, 12 nt, Homo sapiens
augaugcaaauu

SEQ ID NO: 683237 - RNA, 23 nt, Homo sapiens
augaugcaaauuuauacacugau

SEQ ID NO: 683238 - RNA, 12 nt, Homo sapiens
auguuccaguga

SEQ ID NO: 683239 - RNA, 17 nt, Homo sapiens
auguuccgagaagaaca

SEQ ID NO: 683240 - RNA, 19 nt, Homo sapiens
auguuccugccccacagga

SEQ ID NO: 683241 - RNA, 15 nt, Homo sapiens
auguucucagauuuc

SEQ ID NO: 683242 - RNA, 15 nt, Homo sapiens
auguucugacauuaa

SEQ ID NO: 683243 - RNA, 16 nt, Homo sapiens
auguucugugacugaa

SEQ ID NO: 683244 - RNA, 19 nt, Homo sapiens
auguucugugacugaagaa

SEQ ID NO: 683245 - RNA, 17 nt, Homo sapiens
auguucuugucauaaaa

SEQ ID NO: 683246 - RNA, 19 nt, Homo sapiens
auguucuuugugugauuaa

SEQ ID NO: 683247 - RNA, 22 nt, Homo sapiens
auguugagaauguucaucucuc

SEQ ID NO: 683248 - RNA, 15 nt, Homo sapiens
auguugaucauguac

SEQ ID NO: 683249 - RNA, 17 nt, Homo sapiens
auguugaucuuucucaa

SEQ ID NO: 683250 - RNA, 23 nt, Homo sapiens
auguugcaugccuauguacucua

SEQ ID NO: 683251 - RNA, 15 nt, Homo sapiens
auguugcucagucuc

SEQ ID NO: 683252 - RNA, 20 nt, Homo sapiens
auguuggccaggauggucuc

SEQ ID NO: 683253 - RNA, 20 nt, Homo sapiens
auguuggucugacaucaagg

SEQ ID NO: 683254 - RNA, 14 nt, Homo sapiens
auguugguuuccag

SEQ ID NO: 683255 - RNA, 21 nt, Homo sapiens
auguugguuuuaauacuugau

SEQ ID NO: 683256 - RNA, 18 nt, Homo sapiens
auguuguaauucaugcca

SEQ ID NO: 683257 - RNA, 23 nt, Homo sapiens
auguuguguggcaaugggauuug

SEQ ID NO: 683258 - RNA, 22 nt, Homo sapiens
auguuguguuuuuaacauguca

SEQ ID NO: 683259 - RNA, 20 nt, Homo sapiens
auguuguugaggcugucaca

SEQ ID NO: 683260 - RNA, 23 nt, Homo sapiens
auguuguuguugauggcaaaaaa

SEQ ID NO: 683261 - RNA, 12 nt, Homo sapiens
auguuuacuucu

SEQ ID NO: 683262 - RNA, 20 nt, Homo sapiens
auguuuacuuuucagggcau

SEQ ID NO: 683263 - RNA, 22 nt, Homo sapiens
auguuuagauuuuuuuauuuga

SEQ ID NO: 683264 - RNA, 18 nt, Homo sapiens
auguuuauaaacugagag

SEQ ID NO: 683265 - RNA, 20 nt, Homo sapiens
auguuuauaaagguaaaaug

SEQ ID NO: 683266 - RNA, 16 nt, Homo sapiens
auguuuauacuguauu

SEQ ID NO: 683267 - RNA, 21 nt, Homo sapiens
auguuuauuauuuacaucacu

SEQ ID NO: 683268 - RNA, 16 nt, Homo sapiens
auguuuauucuguucc

SEQ ID NO: 683269 - RNA, 21 nt, Homo sapiens
auguuucaagaaaauggauuu

SEQ ID NO: 683270 - RNA, 20 nt, Homo sapiens
auguuucacauaaaaccuca

SEQ ID NO: 683271 - RNA, 15 nt, Homo sapiens
auguuucagagcuca

SEQ ID NO: 683272 - RNA, 22 nt, Homo sapiens
auguuucauguuuugugacuau

SEQ ID NO: 683273 - RNA, 15 nt, Homo sapiens
auguuucgcugauau

SEQ ID NO: 683274 - RNA, 23 nt, Homo sapiens
auguuucgugaaguauacuguau

SEQ ID NO: 683275 - RNA, 18 nt, Homo sapiens
auguuugaguauucugca

SEQ ID NO: 683276 - RNA, 16 nt, Homo sapiens
auguuugcacuuguga

SEQ ID NO: 683277 - RNA, 21 nt, Homo sapiens
auguuuguuauuuacacuggu

SEQ ID NO: 683278 - RNA, 19 nt, Homo sapiens
auguuuuaaacacaugccu

SEQ ID NO: 683279 - RNA, 21 nt, Homo sapiens
auguuuuagccauuguuggcu

SEQ ID NO: 683280 - RNA, 15 nt, Homo sapiens
auguuuucuuucuca

SEQ ID NO: 683281 - RNA, 18 nt, Homo sapiens
auguuuuuaauucuagua

SEQ ID NO: 683282 - RNA, 14 nt, Homo sapiens
auguuuuucuucau

SEQ ID NO: 683283 - RNA, 13 nt, Homo sapiens
auguuuuugacuc

SEQ ID NO: 683284 - RNA, 14 nt, Homo sapiens
auguuuuugccaaa

SEQ ID NO: 683285 - RNA, 20 nt, Homo sapiens
auguuuuuuuucugcuggaa

SEQ ID NO: 683286 - RNA, 14 nt, Homo sapiens
auuaaaaaacuuca

SEQ ID NO: 683287 - RNA, 22 nt, Homo sapiens
auuaaaaaagcucaaugcauug

SEQ ID NO: 683288 - RNA, 15 nt, Homo sapiens
auuaaaaaccugaug

SEQ ID NO: 683289 - RNA, 15 nt, Homo sapiens
auuaaaaacugagug

SEQ ID NO: 683290 - RNA, 19 nt, Homo sapiens
auuaaaaagauagacuuca

SEQ ID NO: 683291 - RNA, 12 nt, Homo sapiens
auuaaaaagccu

SEQ ID NO: 683292 - RNA, 11 nt, Homo sapiens
auuaaaaccaa

SEQ ID NO: 683293 - RNA, 12 nt, Homo sapiens
auuaaaacugag

SEQ ID NO: 683294 - RNA, 18 nt, Homo sapiens
auuaaaagugacauuugu

SEQ ID NO: 683295 - RNA, 12 nt, Homo sapiens
auuaaaauaucc

SEQ ID NO: 683296 - RNA, 11 nt, Homo sapiens
auuaaacaauu

SEQ ID NO: 683297 - RNA, 22 nt, Homo sapiens
auuaaaccugucuccacugugc

SEQ ID NO: 683298 - RNA, 17 nt, Homo sapiens
auuaaacguaugcaugu

SEQ ID NO: 683299 - RNA, 16 nt, Homo sapiens
auuaaagaagaccuga

SEQ ID NO: 683300 - RNA, 17 nt, Homo sapiens
auuaaagaauucagaau

SEQ ID NO: 683301 - RNA, 15 nt, Homo sapiens
auuaaauaaaucauu

SEQ ID NO: 683302 - RNA, 18 nt, Homo sapiens
auuaaauggcaucagcac

SEQ ID NO: 683303 - RNA, 14 nt, Homo sapiens
auuaaauggccuag

SEQ ID NO: 683304 - RNA, 14 nt, Homo sapiens
auuaaauguugcuu

SEQ ID NO: 683305 - RNA, 13 nt, Homo sapiens
auuaaauuuggcu

SEQ ID NO: 683306 - RNA, 14 nt, Homo sapiens
auuaacaaaaugua

SEQ ID NO: 683307 - RNA, 13 nt, Homo sapiens
auuaacaaaugug

SEQ ID NO: 683308 - RNA, 17 nt, Homo sapiens
auuaacaaaugugcugc

SEQ ID NO: 683309 - RNA, 19 nt, Homo sapiens
auuaacaacaauaacacug

SEQ ID NO: 683310 - RNA, 13 nt, Homo sapiens
auuaacauaccua

SEQ ID NO: 683311 - RNA, 16 nt, Homo sapiens
auuaaccaccaaucca

SEQ ID NO: 683312 - RNA, 17 nt, Homo sapiens
auuaacuaauaugggca

SEQ ID NO: 683313 - RNA, 21 nt, Homo sapiens
auuaacuacugaauaaugcua

SEQ ID NO: 683314 - RNA, 18 nt, Homo sapiens
auuaacuuuaauucucuu

SEQ ID NO: 683315 - RNA, 20 nt, Homo sapiens
auuaacuuuuauaaacuuua

SEQ ID NO: 683316 - RNA, 21 nt, Homo sapiens
auuaacuuuuauaaacuuuac

SEQ ID NO: 683317 - RNA, 20 nt, Homo sapiens
auuauuaagguaacuacugc

SEQ ID NO: 683318 - RNA, 14 nt, Homo sapiens
auuauucaucucuc

SEQ ID NO: 683319 - RNA, 23 nt, Homo sapiens
auuauuccucaaaaaauugcaca

SEQ ID NO: 683320 - RNA, 14 nt, Homo sapiens
auuauuguaccauu

SEQ ID NO: 683321 - RNA, 17 nt, Homo sapiens
auuauuguagacaugcc

SEQ ID NO: 683322 - RNA, 14 nt, Homo sapiens
auuauugugacuuc

SEQ ID NO: 683323 - RNA, 17 nt, Homo sapiens
auuauugugacuucacu

SEQ ID NO: 683324 - RNA, 21 nt, Homo sapiens
auuauugugacuucacuguau

SEQ ID NO: 683325 - RNA, 16 nt, Homo sapiens
auuauuuacaagaaga

SEQ ID NO: 683326 - RNA, 14 nt, Homo sapiens
auuauuuacaucac

SEQ ID NO: 683327 - RNA, 13 nt, Homo sapiens
auuauuuaccguu

SEQ ID NO: 683328 - RNA, 15 nt, Homo sapiens
auuauuucaauguga

SEQ ID NO: 683329 - RNA, 13 nt, Homo sapiens
auuauuucagugu

SEQ ID NO: 683330 - RNA, 19 nt, Homo sapiens
auuauuuccuuauaugugu

SEQ ID NO: 683331 - RNA, 11 nt, Homo sapiens
auuauuugccc

SEQ ID NO: 683332 - RNA, 19 nt, Homo sapiens
auuauuuggagccugccaa

SEQ ID NO: 683333 - RNA, 20 nt, Homo sapiens
auuauuugucauucauucaa

SEQ ID NO: 683334 - RNA, 17 nt, Homo sapiens
auuauuuucuucaucca

SEQ ID NO: 683335 - RNA, 18 nt, Homo sapiens
auuauuuuuccacuuugu

SEQ ID NO: 683336 - RNA, 17 nt, Homo sapiens
auuauuuuuucuaugaa

SEQ ID NO: 683337 - RNA, 23 nt, Homo sapiens
auucaaaaguauugaaagccaac

SEQ ID NO: 683338 - RNA, 14 nt, Homo sapiens
auucaaaagugauu

SEQ ID NO: 683339 - RNA, 14 nt, Homo sapiens
auucaaaauuccaa

SEQ ID NO: 683340 - RNA, 14 nt, Homo sapiens
auucaaacauauuc

SEQ ID NO: 683341 - RNA, 17 nt, Homo sapiens
auucaaacugccuauau

SEQ ID NO: 683342 - RNA, 13 nt, Homo sapiens
auucaaagcucua

SEQ ID NO: 683343 - RNA, 18 nt, Homo sapiens
auucaaauuuguacagga

SEQ ID NO: 683344 - RNA, 22 nt, Homo sapiens
auucaaauuuguacaggacugu

SEQ ID NO: 683345 - RNA, 18 nt, Homo sapiens
auucaaauuuuaucucca

SEQ ID NO: 683346 - RNA, 15 nt, Homo sapiens
auucaacaauuucaa

SEQ ID NO: 683347 - RNA, 14 nt, Homo sapiens
auucaaccacugua

SEQ ID NO: 683348 - RNA, 19 nt, Homo sapiens
auucaagaggaaaugucac

SEQ ID NO: 683349 - RNA, 14 nt, Homo sapiens
auucaagccuguga

SEQ ID NO: 683350 - RNA, 15 nt, Homo sapiens
auucaagccugugaa

SEQ ID NO: 683351 - RNA, 13 nt, Homo sapiens
auucaaguguaca

SEQ ID NO: 683352 - RNA, 21 nt, Homo sapiens
auucaauaccgcucaguauuu

SEQ ID NO: 683353 - RNA, 15 nt, Homo sapiens
auucaauauuaugaa

SEQ ID NO: 683354 - RNA, 23 nt, Homo sapiens
auucaaucuuuggaggcuuuuaa

SEQ ID NO: 683355 - RNA, 21 nt, Homo sapiens
auucaauuaguggucauaaaa

SEQ ID NO: 683356 - RNA, 14 nt, Homo sapiens
auucacagcccaga

SEQ ID NO: 683357 - RNA, 14 nt, Homo sapiens
auucacagucucau

SEQ ID NO: 683358 - RNA, 12 nt, Homo sapiens
auucacaucuca

SEQ ID NO: 683359 - RNA, 17 nt, Homo sapiens
auucacaugaugcacuu

SEQ ID NO: 683360 - RNA, 22 nt, Homo sapiens
auucaccaaaauagucuucuca

SEQ ID NO: 683361 - RNA, 14 nt, Homo sapiens
auucaccaacacag

SEQ ID NO: 683362 - RNA, 15 nt, Homo sapiens
auucaccuauguuau

SEQ ID NO: 683363 - RNA, 14 nt, Homo sapiens
auucaccuguaaaa

SEQ ID NO: 683364 - RNA, 14 nt, Homo sapiens
auuuggaaccaaag

SEQ ID NO: 683365 - RNA, 18 nt, Homo sapiens
auuuggagccugccaaga

SEQ ID NO: 683366 - RNA, 20 nt, Homo sapiens
auuuggagccugccaagagg

SEQ ID NO: 683367 - RNA, 15 nt, Homo sapiens
auuuggccugcacua

SEQ ID NO: 683368 - RNA, 17 nt, Homo sapiens
auuuggcucacuugccu

SEQ ID NO: 683369 - RNA, 16 nt, Homo sapiens
auuuggcuugcuguuu

SEQ ID NO: 683370 - RNA, 20 nt, Homo sapiens
auuugggaaccaagcuauuc

SEQ ID NO: 683371 - RNA, 22 nt, Homo sapiens
auuugggcuacccuaaagggag

SEQ ID NO: 683372 - RNA, 22 nt, Homo sapiens
auuugguagggugaguguuucc

SEQ ID NO: 683373 - RNA, 22 nt, Homo sapiens
auuuggucacacucucaccuag

SEQ ID NO: 683374 - RNA, 16 nt, Homo sapiens
auuuggugacugugua

SEQ ID NO: 683375 - RNA, 17 nt, Homo sapiens
auuuggugacuguguaa

SEQ ID NO: 683376 - RNA, 20 nt, Homo sapiens
auuuguaauugaacuuaucc

SEQ ID NO: 683377 - RNA, 15 nt, Homo sapiens
auuuguaccauuccu

SEQ ID NO: 683378 - RNA, 15 nt, Homo sapiens
auuuguagauuuacu

SEQ ID NO: 683379 - RNA, 15 nt, Homo sapiens
auuuguagcacugag

SEQ ID NO: 683380 - RNA, 23 nt, Homo sapiens
auuuguaugguuccaaagacacu

SEQ ID NO: 683381 - RNA, 17 nt, Homo sapiens
auuuguauuaauaaagc

SEQ ID NO: 683382 - RNA, 21 nt, Homo sapiens
auuuguauuaauaaagcauuc

SEQ ID NO: 683383 - RNA, 17 nt, Homo sapiens
auuuguccaauugagua

SEQ ID NO: 683384 - RNA, 23 nt, Homo sapiens
auuugucccagccuggggcuccc

SEQ ID NO: 683385 - RNA, 19 nt, Homo sapiens
auuugucugaaacauuuca

SEQ ID NO: 683386 - RNA, 20 nt, Homo sapiens
auuugugcuagaaauuuuca

SEQ ID NO: 683387 - RNA, 23 nt, Homo sapiens
auuuguguugaaggaacuugucu

SEQ ID NO: 683388 - RNA, 18 nt, Homo sapiens
auuuguuaaaauuaucaa

SEQ ID NO: 683389 - RNA, 14 nt, Homo sapiens
auuuguuacuguau

SEQ ID NO: 683390 - RNA, 13 nt, Homo sapiens
auuuguuccugcu

SEQ ID NO: 683391 - RNA, 20 nt, Homo sapiens
auuuguuuucuucuguaugu

SEQ ID NO: 683392 - RNA, 14 nt, Homo sapiens
auuuuaaaaacaua

SEQ ID NO: 683393 - RNA, 17 nt, Homo sapiens
auuuuaaaaagucuuca

SEQ ID NO: 683394 - RNA, 19 nt, Homo sapiens
auuuuaaaaucagcuauuu

SEQ ID NO: 683395 - RNA, 14 nt, Homo sapiens
auuuuaaacauauc

SEQ ID NO: 683396 - RNA, 18 nt, Homo sapiens
auuuuaaacauauccaag

SEQ ID NO: 683397 - RNA, 18 nt, Homo sapiens
auuuuaaagacucaaggu

SEQ ID NO: 683398 - RNA, 19 nt, Homo sapiens
auuuuaaaguaaaagucua

SEQ ID NO: 683399 - RNA, 16 nt, Homo sapiens
auuuuaaauacaaaag

SEQ ID NO: 683400 - RNA, 13 nt, Homo sapiens
auuuuaaauaucc

SEQ ID NO: 683401 - RNA, 18 nt, Homo sapiens
auuuuaaaucauuaggaa

SEQ ID NO: 683402 - RNA, 18 nt, Homo sapiens
auuuuaaauuccacugaa

SEQ ID NO: 683403 - RNA, 20 nt, Homo sapiens
auuuuaaccaaucagaugac

SEQ ID NO: 683404 - RNA, 17 nt, Homo sapiens
auuuuaacugauuuaac

SEQ ID NO: 683405 - RNA, 16 nt, Homo sapiens
auuuuaagaagacaua

SEQ ID NO: 683406 - RNA, 19 nt, Homo sapiens
auuuuaagaauuucacaag

SEQ ID NO: 683407 - RNA, 14 nt, Homo sapiens
auuuuaaguaggaa

SEQ ID NO: 683408 - RNA, 19 nt, Homo sapiens
auuuuaaguaugugaagaa

SEQ ID NO: 683409 - RNA, 13 nt, Homo sapiens
auuuuaagugcuu

SEQ ID NO: 683410 - RNA, 21 nt, Homo sapiens
auuuuaaguuucucugcagaa

SEQ ID NO: 683411 - RNA, 16 nt, Homo sapiens
auuuuaauguuuccuu

SEQ ID NO: 683412 - RNA, 14 nt, Homo sapiens
auuuuaauuauaau

SEQ ID NO: 683413 - RNA, 15 nt, Homo sapiens
auuuuaauucuguga

SEQ ID NO: 683414 - RNA, 20 nt, Homo sapiens
auuuuaauugauuauucuga

SEQ ID NO: 683415 - RNA, 14 nt, Homo sapiens
auuuuacaguaucu

SEQ ID NO: 683416 - RNA, 17 nt, Homo sapiens
auuuuacaugacagaua

SEQ ID NO: 683417 - RNA, 18 nt, Homo sapiens
auuuuacccacacacaga

SEQ ID NO: 683418 - RNA, 17 nt, Homo sapiens
auuuuacccuuuagacu

SEQ ID NO: 683419 - RNA, 23 nt, Homo sapiens
auuuuacuauuggaaucugauau

SEQ ID NO: 683420 - RNA, 13 nt, Homo sapiens
auuuuacuuccau

SEQ ID NO: 683421 - RNA, 19 nt, Homo sapiens
caaaccuguguaggcauuu

SEQ ID NO: 683422 - RNA, 17 nt, Homo sapiens
caaacgcccuuuccucc

SEQ ID NO: 683423 - RNA, 13 nt, Homo sapiens
caaacgcugaaaa

SEQ ID NO: 683424 - RNA, 19 nt, Homo sapiens
caaacgggcugcccugcca

SEQ ID NO: 683425 - RNA, 17 nt, Homo sapiens
caaacguacaagucagu

SEQ ID NO: 683426 - RNA, 19 nt, Homo sapiens
caaacuaacaggaacaaaa

SEQ ID NO: 683427 - RNA, 21 nt, Homo sapiens
caaacuacuggcaauuuguaa

SEQ ID NO: 683428 - RNA, 15 nt, Homo sapiens
caaacuauacuacaa

SEQ ID NO: 683429 - RNA, 16 nt, Homo sapiens
caaacucccgaccuca

SEQ ID NO: 683430 - RNA, 11 nt, Homo sapiens
caaacucccua

SEQ ID NO: 683431 - RNA, 21 nt, Homo sapiens
caaacucgcacaaccaugacg

SEQ ID NO: 683432 - RNA, 18 nt, Homo sapiens
caaacucuaaaauuauaa

SEQ ID NO: 683433 - RNA, 15 nt, Homo sapiens
caaacugaggaauuu

SEQ ID NO: 683434 - RNA, 16 nt, Homo sapiens
caaacugcaaaccaug

SEQ ID NO: 683435 - RNA, 13 nt, Homo sapiens
caaacugccaguu

SEQ ID NO: 683436 - RNA, 21 nt, Homo sapiens
caaacugccuuggcuucaggg

SEQ ID NO: 683437 - RNA, 23 nt, Homo sapiens
caaacugcuuuuuccaacucaga

SEQ ID NO: 683438 - RNA, 22 nt, Homo sapiens
caaacuggcugcuuuguucaau

SEQ ID NO: 683439 - RNA, 21 nt, Homo sapiens
caaacuggggccucccugguc

SEQ ID NO: 683440 - RNA, 20 nt, Homo sapiens
caaacuguagaaaugaugau

SEQ ID NO: 683441 - RNA, 21 nt, Homo sapiens
caaacuguagcaagaugcaaa

SEQ ID NO: 683442 - RNA, 11 nt, Homo sapiens
caaacugugaa

SEQ ID NO: 683443 - RNA, 19 nt, Homo sapiens
caaacugugaaaauagugu

SEQ ID NO: 683444 - RNA, 19 nt, Homo sapiens
caaacuguggcaacugaga

SEQ ID NO: 683445 - RNA, 21 nt, Homo sapiens
caaacuuaagaaacacugacu

SEQ ID NO: 683446 - RNA, 14 nt, Homo sapiens
caaacuuccaguca

SEQ ID NO: 683447 - RNA, 21 nt, Homo sapiens
caaacuugagaaaauaucuug

SEQ ID NO: 683448 - RNA, 15 nt, Homo sapiens
caaacuuucacuuug

SEQ ID NO: 683449 - RNA, 16 nt, Homo sapiens
caaacuuugcaucuca

SEQ ID NO: 683450 - RNA, 20 nt, Homo sapiens
caaagaaaaauaacccuuug

SEQ ID NO: 683451 - RNA, 13 nt, Homo sapiens
caaagaaggcauu

SEQ ID NO: 683452 - RNA, 20 nt, Homo sapiens
caaagaaugggcuugaaaca

SEQ ID NO: 683453 - RNA, 19 nt, Homo sapiens
caaagacauagaugugaaa

SEQ ID NO: 683454 - RNA, 21 nt, Homo sapiens
caaagaccaaguuaucaucuc

SEQ ID NO: 683455 - RNA, 13 nt, Homo sapiens
caaagaccaccuc

SEQ ID NO: 683456 - RNA, 21 nt, Homo sapiens
caaagacccagagcaaaccca

SEQ ID NO: 683457 - RNA, 14 nt, Homo sapiens
caaagacugcagua

SEQ ID NO: 683458 - RNA, 23 nt, Homo sapiens
caaagacuguacuggccaguguc

SEQ ID NO: 683459 - RNA, 22 nt, Homo sapiens
caaagagacagcucuucuacua

SEQ ID NO: 683460 - RNA, 17 nt, Homo sapiens
caaagaggcugccccuc

SEQ ID NO: 683461 - RNA, 16 nt, Homo sapiens
caaagauaacaugcuu

SEQ ID NO: 683462 - RNA, 23 nt, Homo sapiens
caaagaucaaaauaaaaagugac

SEQ ID NO: 683463 - RNA, 18 nt, Homo sapiens
caaagaugccacauucaa

SEQ ID NO: 683464 - RNA, 20 nt, Homo sapiens
caaagaugcccccuccagga

SEQ ID NO: 683465 - RNA, 16 nt, Homo sapiens
caaagauuaaaugugu

SEQ ID NO: 683466 - RNA, 20 nt, Homo sapiens
caaagauuucaugacgaaga

SEQ ID NO: 683467 - RNA, 15 nt, Homo sapiens
caaagcaagcauuca

SEQ ID NO: 683468 - RNA, 23 nt, Homo sapiens
caaagcaaggaaacuauguaaca

SEQ ID NO: 683469 - RNA, 21 nt, Homo sapiens
caaagcaaguuucaucaguca

SEQ ID NO: 683470 - RNA, 23 nt, Homo sapiens
caaagcaaguuucaucagucaau

SEQ ID NO: 683471 - RNA, 13 nt, Homo sapiens
caaagcaccagcu

SEQ ID NO: 683472 - RNA, 11 nt, Homo sapiens
caaagcacuug

SEQ ID NO: 683473 - RNA, 17 nt, Homo sapiens
caaagcaggaagaagcu

SEQ ID NO: 683474 - RNA, 14 nt, Homo sapiens
caaagccacacucu

SEQ ID NO: 683475 - RNA, 20 nt, Homo sapiens
caaagccacauuauuucuag

SEQ ID NO: 683476 - RNA, 22 nt, Homo sapiens
caaagcggucccugucccucua

SEQ ID NO: 683477 - RNA, 16 nt, Homo sapiens
caaagcuuacaacauu

SEQ ID NO: 683478 - RNA, 17 nt, Homo sapiens
caaagcuuucauguaaa

SEQ ID NO: 683479 - RNA, 22 nt, Homo sapiens
caaagcuuucauguaaacugug

SEQ ID NO: 683480 - RNA, 15 nt, Homo sapiens
caaagcuuuccugcc

SEQ ID NO: 683481 - RNA, 18 nt, Homo sapiens
caaaggacagaguaugaa

SEQ ID NO: 683482 - RNA, 14 nt, Homo sapiens
caaaggaugugaua

SEQ ID NO: 683483 - RNA, 23 nt, Homo sapiens
caaaggcacugaggcccagggag

SEQ ID NO: 683484 - RNA, 17 nt, Homo sapiens
caaaggcauaucuucua

SEQ ID NO: 683485 - RNA, 16 nt, Homo sapiens
caaaggcgacaauaaa

SEQ ID NO: 683486 - RNA, 15 nt, Homo sapiens
caaagggaauacuca

SEQ ID NO: 683487 - RNA, 20 nt, Homo sapiens
caaagggccagcagucuacc

SEQ ID NO: 683488 - RNA, 17 nt, Homo sapiens
caaaggugugcccugua

SEQ ID NO: 683489 - RNA, 23 nt, Homo sapiens
caaaggugugcuuccugcuguau

SEQ ID NO: 683490 - RNA, 17 nt, Homo sapiens
caaagguugcagugcug

SEQ ID NO: 683491 - RNA, 23 nt, Homo sapiens
caaaguaaaaauugaacuguaaa

SEQ ID NO: 683492 - RNA, 17 nt, Homo sapiens
caaaguaaucuacugua

SEQ ID NO: 683493 - RNA, 13 nt, Homo sapiens
caaaguacaugua

SEQ ID NO: 683494 - RNA, 14 nt, Homo sapiens
caaaguacauguau

SEQ ID NO: 683495 - RNA, 14 nt, Homo sapiens
caaaguauuugcug

SEQ ID NO: 683496 - RNA, 17 nt, Homo sapiens
caaagucacauccacaa

SEQ ID NO: 683497 - RNA, 20 nt, Homo sapiens
caaagucauccccucucagg

SEQ ID NO: 683498 - RNA, 18 nt, Homo sapiens
caaaguccacuuuacuca

SEQ ID NO: 683499 - RNA, 16 nt, Homo sapiens
caaagucucaaugaaa

SEQ ID NO: 683500 - RNA, 17 nt, Homo sapiens
caaagugagacuccguc

SEQ ID NO: 683501 - RNA, 12 nt, Homo sapiens
caaagugaggag

SEQ ID NO: 683502 - RNA, 23 nt, Homo sapiens
caaagugccagagucuaggcuaa

SEQ ID NO: 683503 - RNA, 11 nt, Homo sapiens
caaagugcugg

SEQ ID NO: 683504 - RNA, 22 nt, Homo sapiens
caaagugcugggauuacaggcg

SEQ ID NO: 683505 - RNA, 16 nt, Homo sapiens
caaagugguacaggaa

SEQ ID NO: 683506 - RNA, 13 nt, Homo sapiens
caaaguguacaaa

SEQ ID NO: 683507 - RNA, 16 nt, Homo sapiens
caaaguuucuguugaa

SEQ ID NO: 683508 - RNA, 19 nt, Homo sapiens
caaaguuuggauuguauca

SEQ ID NO: 683509 - RNA, 14 nt, Homo sapiens
caaauaaaaauccu

SEQ ID NO: 683510 - RNA, 14 nt, Homo sapiens
caaauaaaacccaa

SEQ ID NO: 683511 - RNA, 18 nt, Homo sapiens
caaauaaaauguucccua

SEQ ID NO: 683512 - RNA, 15 nt, Homo sapiens
caaauaaaguaccau

SEQ ID NO: 683513 - RNA, 22 nt, Homo sapiens
caaauaauaaaaacagaaggaa

SEQ ID NO: 683514 - RNA, 22 nt, Homo sapiens
caaauaauagaauugcucccua

SEQ ID NO: 683515 - RNA, 13 nt, Homo sapiens
caaauaaucacag

SEQ ID NO: 683516 - RNA, 17 nt, Homo sapiens
caaauaauccauuccaa

SEQ ID NO: 683517 - RNA, 18 nt, Homo sapiens
caaauacauugaguuuaa

SEQ ID NO: 683518 - RNA, 16 nt, Homo sapiens
caaauacccaaauguc

SEQ ID NO: 683519 - RNA, 21 nt, Homo sapiens
caaauacuuagagcagugaag

SEQ ID NO: 683520 - RNA, 16 nt, Homo sapiens
caaauagaucaugcau

SEQ ID NO: 683521 - RNA, 20 nt, Homo sapiens
caaauaggagggagacugug

SEQ ID NO: 683522 - RNA, 20 nt, Homo sapiens
caaauauauuucaagcuaua

SEQ ID NO: 683523 - RNA, 16 nt, Homo sapiens
caaauauauuuuggaa

SEQ ID NO: 683524 - RNA, 22 nt, Homo sapiens
caaauaucauacuguucaaugg

SEQ ID NO: 683525 - RNA, 22 nt, Homo sapiens
caaauaugcacuuucccuagaa

SEQ ID NO: 683526 - RNA, 12 nt, Homo sapiens
caaauaugcuuu

SEQ ID NO: 683527 - RNA, 20 nt, Homo sapiens
caaauauugguuaguauuua

SEQ ID NO: 683528 - RNA, 16 nt, Homo sapiens
caaauauuguugacaa

SEQ ID NO: 683529 - RNA, 12 nt, Homo sapiens
caaauauuuccc

SEQ ID NO: 683530 - RNA, 13 nt, Homo sapiens
caaaucaaggcaa

SEQ ID NO: 683531 - RNA, 18 nt, Homo sapiens
caaaucacauauuuuaaa

SEQ ID NO: 683532 - RNA, 20 nt, Homo sapiens
caaaucacuucaauccucaa

SEQ ID NO: 683533 - RNA, 16 nt, Homo sapiens
caaaucaucuguaaca

SEQ ID NO: 683534 - RNA, 13 nt, Homo sapiens
caaaucauuccuu

SEQ ID NO: 683535 - RNA, 17 nt, Homo sapiens
caaauccauaauuauua

SEQ ID NO: 683536 - RNA, 15 nt, Homo sapiens
caaaucccuuucaug

SEQ ID NO: 683537 - RNA, 17 nt, Homo sapiens
caaauccucaccaucca

SEQ ID NO: 683538 - RNA, 18 nt, Homo sapiens
caaauccucccuacuucc

SEQ ID NO: 683539 - RNA, 16 nt, Homo sapiens
caaaucuaccacugua

SEQ ID NO: 683540 - RNA, 13 nt, Homo sapiens
caaaucucaaagu

SEQ ID NO: 683541 - RNA, 16 nt, Homo sapiens
caaaucucaaagugua

SEQ ID NO: 683542 - RNA, 13 nt, Homo sapiens
caaaucucuauua

SEQ ID NO: 683543 - RNA, 17 nt, Homo sapiens
caaaucugauggccuua

SEQ ID NO: 683544 - RNA, 18 nt, Homo sapiens
uggaugccuugaauaaua

SEQ ID NO: 683545 - RNA, 13 nt, Homo sapiens
uggaugcggccau

SEQ ID NO: 683546 - RNA, 17 nt, Homo sapiens
uggaugcggccauucaa

SEQ ID NO: 683547 - RNA, 13 nt, Homo sapiens
uggaugcucgcca

SEQ ID NO: 683548 - RNA, 16 nt, Homo sapiens
uggauguacuuaagag

SEQ ID NO: 683549 - RNA, 18 nt, Homo sapiens
uggaugucgaugacuuca

SEQ ID NO: 683550 - RNA, 13 nt, Homo sapiens
uggaugucuuccu

SEQ ID NO: 683551 - RNA, 15 nt, Homo sapiens
uggaugugggguccc

SEQ ID NO: 683552 - RNA, 20 nt, Homo sapiens
uggauguuacucucuugcac

SEQ ID NO: 683553 - RNA, 13 nt, Homo sapiens
uggauguucugac

SEQ ID NO: 683554 - RNA, 15 nt, Homo sapiens
uggauuaacauauag

SEQ ID NO: 683555 - RNA, 11 nt, Homo sapiens
uggauuacaaa

SEQ ID NO: 683556 - RNA, 13 nt, Homo sapiens
uggauuacuauug

SEQ ID NO: 683557 - RNA, 14 nt, Homo sapiens
uggauuauucauuu

SEQ ID NO: 683558 - RNA, 23 nt, Homo sapiens
uggauucauuacagcuuaaucaa

SEQ ID NO: 683559 - RNA, 15 nt, Homo sapiens
uggauucgugacaac

SEQ ID NO: 683560 - RNA, 20 nt, Homo sapiens
uggauucuuuaaacgcucua

SEQ ID NO: 683561 - RNA, 13 nt, Homo sapiens
uggauugauaucg

SEQ ID NO: 683562 - RNA, 22 nt, Homo sapiens
uggauugggacgcacagugcag

SEQ ID NO: 683563 - RNA, 14 nt, Homo sapiens
uggauugggguccc

SEQ ID NO: 683564 - RNA, 22 nt, Homo sapiens
uggauuuaaaagccugcucaau

SEQ ID NO: 683565 - RNA, 22 nt, Homo sapiens
uggauuuauaguaugugacuuu

SEQ ID NO: 683566 - RNA, 18 nt, Homo sapiens
uggauuuaugacauuaca

SEQ ID NO: 683567 - RNA, 16 nt, Homo sapiens
uggauuuauucugcca

SEQ ID NO: 683568 - RNA, 17 nt, Homo sapiens
uggauuuauucugccaa

SEQ ID NO: 683569 - RNA, 17 nt, Homo sapiens
uggauuucauacuguaa

SEQ ID NO: 683570 - RNA, 15 nt, Homo sapiens
uggauuucauuugua

SEQ ID NO: 683571 - RNA, 23 nt, Homo sapiens
uggauuuguuuguuuucuugucu

SEQ ID NO: 683572 - RNA, 19 nt, Homo sapiens
uggauuuugaaauuuacug

SEQ ID NO: 683573 - RNA, 18 nt, Homo sapiens
uggauuuugcauguaaua

SEQ ID NO: 683574 - RNA, 21 nt, Homo sapiens
uggauuuuguggaggugagaa

SEQ ID NO: 683575 - RNA, 18 nt, Homo sapiens
uggauuuuucuuuaacug

SEQ ID NO: 683576 - RNA, 22 nt, Homo sapiens
uggcaaaaucuuguuaauguca

SEQ ID NO: 683577 - RNA, 18 nt, Homo sapiens
uggcaaagcucaccaucu

SEQ ID NO: 683578 - RNA, 17 nt, Homo sapiens
uggcaaagguggcucuc

SEQ ID NO: 683579 - RNA, 15 nt, Homo sapiens
uggcaaagugcugua

SEQ ID NO: 683580 - RNA, 18 nt, Homo sapiens
uggcaacaacaaagccaa

SEQ ID NO: 683581 - RNA, 20 nt, Homo sapiens
uggcaacaacuuagaagaaa

SEQ ID NO: 683582 - RNA, 17 nt, Homo sapiens
uggcaacagagcaagac

SEQ ID NO: 683583 - RNA, 21 nt, Homo sapiens
uggcaacagagcaagacucca

SEQ ID NO: 683584 - RNA, 20 nt, Homo sapiens
uggcaacaugaagaaugcau

SEQ ID NO: 683585 - RNA, 20 nt, Homo sapiens
uggcaacauuguacaaguca

SEQ ID NO: 683586 - RNA, 21 nt, Homo sapiens
uggcaaccauuauaaccuuaa

SEQ ID NO: 683587 - RNA, 19 nt, Homo sapiens
uggcaacggaagaaugaga

SEQ ID NO: 683588 - RNA, 20 nt, Homo sapiens
uggcaagauaaacacuuucu

SEQ ID NO: 683589 - RNA, 22 nt, Homo sapiens
uggcaaggacuuuguacauuug

SEQ ID NO: 683590 - RNA, 15 nt, Homo sapiens
uggcaaggugacauu

SEQ ID NO: 683591 - RNA, 16 nt, Homo sapiens
uggcaagucacaugcg

SEQ ID NO: 683592 - RNA, 22 nt, Homo sapiens
uggcaagucugcccuagaguca

SEQ ID NO: 683593 - RNA, 14 nt, Homo sapiens
uggcaagugauauc

SEQ ID NO: 683594 - RNA, 16 nt, Homo sapiens
uggcaauaaacuccua

SEQ ID NO: 683595 - RNA, 20 nt, Homo sapiens
uggcaauaaacuccuacuaa

SEQ ID NO: 683596 - RNA, 16 nt, Homo sapiens
uggcaauauccaaaua

SEQ ID NO: 683597 - RNA, 20 nt, Homo sapiens
uggcaaugaaaaauucucag

SEQ ID NO: 683598 - RNA, 11 nt, Homo sapiens
uggacacagau

SEQ ID NO: 683599 - RNA, 15 nt, Homo sapiens
uggacacgagccaca

SEQ ID NO: 683600 - RNA, 20 nt, Homo sapiens
uggacacuugcucaugcccu

SEQ ID NO: 683601 - RNA, 17 nt, Homo sapiens
uggacagcuuuucccaa

SEQ ID NO: 683602 - RNA, 15 nt, Homo sapiens
uggacaggcaaagac

SEQ ID NO: 683603 - RNA, 17 nt, Homo sapiens
uggacaggcagccuccu

SEQ ID NO: 683604 - RNA, 16 nt, Homo sapiens
uggacauagagaggga

SEQ ID NO: 683605 - RNA, 14 nt, Homo sapiens
uggacauguacaaa

SEQ ID NO: 683606 - RNA, 14 nt, Homo sapiens
uggacauguguaca

SEQ ID NO: 683607 - RNA, 14 nt, Homo sapiens
uggacauuugccuu

SEQ ID NO: 683608 - RNA, 18 nt, Homo sapiens
uggacauuuuuucaguca

SEQ ID NO: 683609 - RNA, 12 nt, Homo sapiens
uggaccacugca

SEQ ID NO: 683610 - RNA, 14 nt, Homo sapiens
uggaccaggccauu

SEQ ID NO: 683611 - RNA, 15 nt, Homo sapiens
uggaccaugccagau

SEQ ID NO: 683612 - RNA, 14 nt, Homo sapiens
uggacccugcugaa

SEQ ID NO: 683613 - RNA, 15 nt, Homo sapiens
uggaccuaacauucg

SEQ ID NO: 683614 - RNA, 20 nt, Homo sapiens
uggaccuagcuugaggcaau

SEQ ID NO: 683615 - RNA, 19 nt, Homo sapiens
uggaccuauguccuaagga

SEQ ID NO: 683616 - RNA, 15 nt, Homo sapiens
uggaccuguucaaaa

SEQ ID NO: 683617 - RNA, 20 nt, Homo sapiens
uggacgcuggccugggauga

SEQ ID NO: 683618 - RNA, 15 nt, Homo sapiens
uggacggacaagaca

SEQ ID NO: 683619 - RNA, 14 nt, Homo sapiens
uggacgugcucaga

SEQ ID NO: 683620 - RNA, 13 nt, Homo sapiens
uggacuaagcaau

SEQ ID NO: 683621 - RNA, 20 nt, Homo sapiens
uggacuacacccaagccuga

SEQ ID NO: 683622 - RNA, 17 nt, Homo sapiens
uggacucagaaagccaa

SEQ ID NO: 683623 - RNA, 22 nt, Homo sapiens
uggacuccaucucucauccucc

SEQ ID NO: 683624 - RNA, 14 nt, Homo sapiens
uggacucuugcucu

SEQ ID NO: 683625 - RNA, 16 nt, Homo sapiens
uggacugauaaucucu

SEQ ID NO: 683626 - RNA, 15 nt, Homo sapiens
uggacugcaggggag

SEQ ID NO: 683627 - RNA, 22 nt, Homo sapiens
uggacuguaacauccauguugu

SEQ ID NO: 683628 - RNA, 15 nt, Homo sapiens
uggacugucauagaa

SEQ ID NO: 683629 - RNA, 16 nt, Homo sapiens
uggacuuaacuaguua

SEQ ID NO: 683630 - RNA, 21 nt, Homo sapiens
uggacuuggcaggugccuguu

SEQ ID NO: 683631 - RNA, 20 nt, Homo sapiens
uggacuuggucaccagcucc

SEQ ID NO: 683632 - RNA, 14 nt, Homo sapiens
uggagaaaaugggc

SEQ ID NO: 683633 - RNA, 22 nt, Homo sapiens
uggagaaaauggguuuauucac

SEQ ID NO: 683634 - RNA, 19 nt, Homo sapiens
uggagaaauaaaaauaccu

SEQ ID NO: 683635 - RNA, 16 nt, Homo sapiens
uggagaaccagggcuc

SEQ ID NO: 683636 - RNA, 23 nt, Homo sapiens
uggagaaccagggcucuucucag

SEQ ID NO: 683637 - RNA, 22 nt, Homo sapiens
uggagaacccaggggacagcug

SEQ ID NO: 683638 - RNA, 18 nt, Homo sapiens
uggagaaggguucugccc

SEQ ID NO: 683639 - RNA, 19 nt, Homo sapiens
uggagaagugucguuuuca

SEQ ID NO: 683640 - RNA, 19 nt, Homo sapiens
uggagaauacuuugcuuca

SEQ ID NO: 683641 - RNA, 17 nt, Homo sapiens
uggagaaucugcugcau

SEQ ID NO: 683642 - RNA, 22 nt, Homo sapiens
uggagaauuuuuggauggugau

SEQ ID NO: 683643 - RNA, 13 nt, Homo sapiens
uggagacacugag

SEQ ID NO: 683644 - RNA, 18 nt, Homo sapiens
uggagacccugcaaacag

SEQ ID NO: 683645 - RNA, 19 nt, Homo sapiens
uggagacccugccacagcc

SEQ ID NO: 683646 - RNA, 23 nt, Homo sapiens
uggagacggguguugucggggaa

SEQ ID NO: 683647 - RNA, 19 nt, Homo sapiens
uggagacugagaucacuga

SEQ ID NO: 683648 - RNA, 23 nt, Homo sapiens
uggagacuuccuaugugugcauu

SEQ ID NO: 683649 - RNA, 19 nt, Homo sapiens
uggagagggugucaucuag

SEQ ID NO: 683650 - RNA, 20 nt, Homo sapiens
uggagaguaagaauauagua

SEQ ID NO: 683651 - RNA, 23 nt, Homo sapiens
uggagagucagaucuuucuccuu

SEQ ID NO: 683652 - RNA, 14 nt, Homo sapiens
uggaaaaggaagac

SEQ ID NO: 683653 - RNA, 18 nt, Homo sapiens
uggaaaagggucuuggga

SEQ ID NO: 683654 - RNA, 23 nt, Homo sapiens
uggaaaagugauguauuuucaua

SEQ ID NO: 683655 - RNA, 17 nt, Homo sapiens
uggaaaaucagcugcuc

SEQ ID NO: 683656 - RNA, 13 nt, Homo sapiens
uggaaaaugcaau

SEQ ID NO: 683657 - RNA, 19 nt, Homo sapiens
uggaaaaugccaugaauua

SEQ ID NO: 683658 - RNA, 17 nt, Homo sapiens
uggaaaaugugacccag

SEQ ID NO: 683659 - RNA, 16 nt, Homo sapiens
uggaaaaugugcaaua

SEQ ID NO: 683660 - RNA, 20 nt, Homo sapiens
uggaaaccugcccugccuga

SEQ ID NO: 683661 - RNA, 19 nt, Homo sapiens
uggaaagcaucaccucagg

SEQ ID NO: 683662 - RNA, 19 nt, Homo sapiens
uggaaaucuuuuacauuuu

SEQ ID NO: 683663 - RNA, 21 nt, Homo sapiens
uggaaaugaaacugcugugaa

SEQ ID NO: 683664 - RNA, 19 nt, Homo sapiens
uggaaaugacccuauuuga

SEQ ID NO: 683665 - RNA, 22 nt, Homo sapiens
uggaaaugacccuauuugauau

SEQ ID NO: 683666 - RNA, 12 nt, Homo sapiens
uggaaaugucug

SEQ ID NO: 683667 - RNA, 19 nt, Homo sapiens
uggaacaacugauacuuca

SEQ ID NO: 683668 - RNA, 23 nt, Homo sapiens
uggaacacauaagaacugugcag

SEQ ID NO: 683669 - RNA, 15 nt, Homo sapiens
uggaacacggccaca

SEQ ID NO: 683670 - RNA, 19 nt, Homo sapiens
uggaacacggccacaucaa

SEQ ID NO: 683671 - RNA, 14 nt, Homo sapiens
uggaacacugcuga

SEQ ID NO: 683672 - RNA, 19 nt, Homo sapiens
uggaacacuuucaguuuca

SEQ ID NO: 683673 - RNA, 18 nt, Homo sapiens
uggaacauauagaaugca

SEQ ID NO: 683674 - RNA, 22 nt, Homo sapiens
uggaacaugcccacaacuuguc

SEQ ID NO: 683675 - RNA, 13 nt, Homo sapiens
uggaacauuccag

SEQ ID NO: 683676 - RNA, 16 nt, Homo sapiens
uggaacauuugauauu

SEQ ID NO: 683677 - RNA, 14 nt, Homo sapiens
uggaacuacuguac

SEQ ID NO: 683678 - RNA, 16 nt, Homo sapiens
uggaacucaaggaaau

SEQ ID NO: 683679 - RNA, 14 nt, Homo sapiens
uggaacuuuaguga

SEQ ID NO: 683680 - RNA, 16 nt, Homo sapiens
uggaagaaauggcuau

SEQ ID NO: 683681 - RNA, 14 nt, Homo sapiens
uggaagaaauuccu

SEQ ID NO: 683682 - RNA, 17 nt, Homo sapiens
uggaagacuaucuuacu

SEQ ID NO: 683683 - RNA, 23 nt, Homo sapiens
uggaagagagaaagcauauugac

SEQ ID NO: 683684 - RNA, 16 nt, Homo sapiens
uggaagaggaacagca

SEQ ID NO: 683685 - RNA, 16 nt, Homo sapiens
uggaagaggccuuccc

SEQ ID NO: 683686 - RNA, 20 nt, Homo sapiens
uggaagaggugggugguggg

SEQ ID NO: 683687 - RNA, 15 nt, Homo sapiens
uggaagauggcauaa

SEQ ID NO: 683688 - RNA, 18 nt, Homo sapiens
uggaagcaggacagacac

SEQ ID NO: 683689 - RNA, 23 nt, Homo sapiens
uggaagcauagugaacacacuga

SEQ ID NO: 683690 - RNA, 21 nt, Homo sapiens
uggaagccaccucaccaagga

SEQ ID NO: 683691 - RNA, 11 nt, Homo sapiens
uggaagccauc

SEQ ID NO: 683692 - RNA, 17 nt, Homo sapiens
uggaagcuuguuuucca

SEQ ID NO: 683693 - RNA, 18 nt, Homo sapiens
uggaaggacacagugaug

SEQ ID NO: 683694 - RNA, 15 nt, Homo sapiens
uggaaggcagacagc

SEQ ID NO: 683695 - RNA, 23 nt, Homo sapiens
uggaaggugacagcgauucccug

SEQ ID NO: 683696 - RNA, 22 nt, Homo sapiens
uggaaguaaccauuugcacugg

SEQ ID NO: 683697 - RNA, 20 nt, Homo sapiens
uggaagucaucucauuccac

SEQ ID NO: 683698 - RNA, 21 nt, Homo sapiens
uggaaguguauuuauuuuaca

SEQ ID NO: 683699 - RNA, 19 nt, Homo sapiens
uggaaguguucaagaaaua

SEQ ID NO: 683700 - RNA, 14 nt, Homo sapiens
uggaauaaagucaa

SEQ ID NO: 683701 - RNA, 21 nt, Homo sapiens
uggaauaacaacuuucagugg

SEQ ID NO: 683702 - RNA, 14 nt, Homo sapiens
uggaauaggaauaa

SEQ ID NO: 683703 - RNA, 18 nt, Homo sapiens
uggaauaguuuuguaucg

SEQ ID NO: 683704 - RNA, 13 nt, Homo sapiens
uggaauauuacaa

SEQ ID NO: 683705 - RNA, 15 nt, Homo sapiens
uggaaucccacugua

SEQ ID NO: 683706 - RNA, 21 nt, Homo sapiens
uggaaucuuuuauaaugauuc

SEQ ID NO: 683707 - RNA, 20 nt, Homo sapiens
uggaaugcccuucacuguca

SEQ ID NO: 683708 - RNA, 18 nt, Homo sapiens
uggaauguaaagugcaau

SEQ ID NO: 683709 - RNA, 16 nt, Homo sapiens
uggaauguacucuguu

SEQ ID NO: 683710 - RNA, 22 nt, Homo sapiens
uggaauuacaaaacucagagaa

SEQ ID NO: 683711 - RNA, 21 nt, Homo sapiens
uggaauuagagggccuugcuu

SEQ ID NO: 683712 - RNA, 21 nt, Homo sapiens
uggaauuauuguagacaugcc

SEQ ID NO: 683713 - RNA, 21 nt, Homo sapiens
uggaauuuugcaaagauuuaa

SEQ ID NO: 683714 - RNA, 21 nt, Homo sapiens
uggaauuuuucuguacuucag

SEQ ID NO: 683715 - RNA, 23 nt, Homo sapiens
uggacaaaauuaauacauucuau

SEQ ID NO: 683716 - RNA, 17 nt, Homo sapiens
uggacaaagacuaccug

SEQ ID NO: 683717 - RNA, 12 nt, Homo sapiens
uggacaaaucac

SEQ ID NO: 683718 - RNA, 17 nt, Homo sapiens
uggacaaccuggaccca

SEQ ID NO: 683719 - RNA, 14 nt, Homo sapiens
uggacacaaggcac

SEQ ID NO: 683720 - RNA, 16 nt, Homo sapiens
ugccugugauuuccua

SEQ ID NO: 683721 - RNA, 16 nt, Homo sapiens
ugccugugccaugccc

SEQ ID NO: 683722 - RNA, 13 nt, Homo sapiens
ugccugugcuaca

SEQ ID NO: 683723 - RNA, 21 nt, Homo sapiens
ugccuguuaaggaaacuuuau

SEQ ID NO: 683724 - RNA, 18 nt, Homo sapiens
ugccuuaaaaccaaagag

SEQ ID NO: 683725 - RNA, 16 nt, Homo sapiens
ugccuuacccugguaa

SEQ ID NO: 683726 - RNA, 16 nt, Homo sapiens
ugccuuaggccuaccu

SEQ ID NO: 683727 - RNA, 14 nt, Homo sapiens
ugccuuaucuugca

SEQ ID NO: 683728 - RNA, 18 nt, Homo sapiens
ugccuuauuaaagcaaaa

SEQ ID NO: 683729 - RNA, 22 nt, Homo sapiens
ugccuucaacuucagcaccugc

SEQ ID NO: 683730 - RNA, 19 nt, Homo sapiens
ugccuuccucucucuacca

SEQ ID NO: 683731 - RNA, 22 nt, Homo sapiens
ugccuucucuguucccuugcag

SEQ ID NO: 683732 - RNA, 22 nt, Homo sapiens
ugccuucugguuauuuaugguu

SEQ ID NO: 683733 - RNA, 18 nt, Homo sapiens
ugccuugcuaaaagauua

SEQ ID NO: 683734 - RNA, 23 nt, Homo sapiens
ugccuugggucucagcugcugac

SEQ ID NO: 683735 - RNA, 17 nt, Homo sapiens
ugccuuguccucagggc

SEQ ID NO: 683736 - RNA, 18 nt, Homo sapiens
ugccuuucagaagugauu

SEQ ID NO: 683737 - RNA, 18 nt, Homo sapiens
ugccuuucgaggccugaa

SEQ ID NO: 683738 - RNA, 18 nt, Homo sapiens
ugccuuucugguggcuuu

SEQ ID NO: 683739 - RNA, 22 nt, Homo sapiens
ugccuuuguauguggaaguaua

SEQ ID NO: 683740 - RNA, 21 nt, Homo sapiens
ugccuuuuaucuauuugagau

SEQ ID NO: 683741 - RNA, 16 nt, Homo sapiens
ugccuuuugcaaccag

SEQ ID NO: 683742 - RNA, 20 nt, Homo sapiens
ugccuuuugcaccccuccca

SEQ ID NO: 683743 - RNA, 20 nt, Homo sapiens
ugccuuuugguuucaccuuc

SEQ ID NO: 683744 - RNA, 17 nt, Homo sapiens
ugccuuuuuaaugaaca

SEQ ID NO: 683745 - RNA, 13 nt, Homo sapiens
ugcgaaauccaga

SEQ ID NO: 683746 - RNA, 12 nt, Homo sapiens
ugcgaaccaccc

SEQ ID NO: 683747 - RNA, 18 nt, Homo sapiens
ugcgaaccacccaaaaca

SEQ ID NO: 683748 - RNA, 20 nt, Homo sapiens
ugcgaagacccucuugccca

SEQ ID NO: 683749 - RNA, 14 nt, Homo sapiens
ugcgagggccacag

SEQ ID NO: 683750 - RNA, 19 nt, Homo sapiens
ugcgcacaaggcugaccaa

SEQ ID NO: 683751 - RNA, 16 nt, Homo sapiens
ugcgcauggugcagug

SEQ ID NO: 683752 - RNA, 20 nt, Homo sapiens
ugcgcccuucauugccacac

SEQ ID NO: 683753 - RNA, 15 nt, Homo sapiens
ugcgccugagugagu

SEQ ID NO: 683754 - RNA, 13 nt, Homo sapiens
ugcggaagccaua

SEQ ID NO: 683755 - RNA, 23 nt, Homo sapiens
ugcggaggaaggaggacccagga

SEQ ID NO: 683756 - RNA, 15 nt, Homo sapiens
ugcggaguccaggcu

SEQ ID NO: 683757 - RNA, 16 nt, Homo sapiens
ugcggauggauggaag

SEQ ID NO: 683758 - RNA, 13 nt, Homo sapiens
ugcggcaucagau

SEQ ID NO: 683759 - RNA, 11 nt, Homo sapiens
ugcggccaaga

SEQ ID NO: 683760 - RNA, 18 nt, Homo sapiens
ugcggguccucagcugcu

SEQ ID NO: 683761 - RNA, 13 nt, Homo sapiens
ugcguacacagag

SEQ ID NO: 683762 - RNA, 21 nt, Homo sapiens
ugcgucagaccaguacuggga

SEQ ID NO: 683763 - RNA, 13 nt, Homo sapiens
ugcgucauuucag

SEQ ID NO: 683764 - RNA, 14 nt, Homo sapiens
ugcgucugcucuuc

SEQ ID NO: 683765 - RNA, 11 nt, Homo sapiens
ugcgucuuccg

SEQ ID NO: 683766 - RNA, 15 nt, Homo sapiens
ugcgugcaugugcac

SEQ ID NO: 683767 - RNA, 11 nt, Homo sapiens
ugcgugccauc

SEQ ID NO: 683768 - RNA, 23 nt, Homo sapiens
ugcgugggugugugcguguuugg

SEQ ID NO: 683769 - RNA, 16 nt, Homo sapiens
ugcgugugucagggau

SEQ ID NO: 683770 - RNA, 15 nt, Homo sapiens
ugcgugugugcaagu

SEQ ID NO: 683771 - RNA, 22 nt, Homo sapiens
ugcuaaauaguucuaucaggaa

SEQ ID NO: 683772 - RNA, 17 nt, Homo sapiens
ugcuaaaugcacugacc

SEQ ID NO: 683773 - RNA, 22 nt, Homo sapiens
ugcuaaauggucgcccaggaga

SEQ ID NO: 683774 - RNA, 14 nt, Homo sapiens
ugcuaaccuggaaa

SEQ ID NO: 683775 - RNA, 19 nt, Homo sapiens
ugcuaaccuuuucaccucc

SEQ ID NO: 683776 - RNA, 16 nt, Homo sapiens
ugcuaaggaguucuca

SEQ ID NO: 683777 - RNA, 17 nt, Homo sapiens
ugcuaaguaauuuagaa

SEQ ID NO: 683778 - RNA, 23 nt, Homo sapiens
ugcuaaucaugugggugagccag

SEQ ID NO: 683779 - RNA, 20 nt, Homo sapiens
ugcuaaucuucuuaugcaau

SEQ ID NO: 683780 - RNA, 21 nt, Homo sapiens
ugcuaauggaauuacugccuu

SEQ ID NO: 683781 - RNA, 15 nt, Homo sapiens
ugcuaaugugugaug

SEQ ID NO: 683782 - RNA, 13 nt, Homo sapiens
ugcuaauguugcu

SEQ ID NO: 683783 - RNA, 18 nt, Homo sapiens
ugcuaauucaaagcucua

SEQ ID NO: 683784 - RNA, 21 nt, Homo sapiens
ugcuaauuugccacaggagcu

SEQ ID NO: 683785 - RNA, 15 nt, Homo sapiens
ugcuacaacauguga

SEQ ID NO: 683786 - RNA, 13 nt, Homo sapiens
ugcuacagugcau

SEQ ID NO: 683787 - RNA, 14 nt, Homo sapiens
ugcuacauacucca

SEQ ID NO: 683788 - RNA, 18 nt, Homo sapiens
ugcuacauucuaaugcau

SEQ ID NO: 683789 - RNA, 20 nt, Homo sapiens
ugcuaccacagcaacuauau

SEQ ID NO: 683790 - RNA, 20 nt, Homo sapiens
ugcuacccugaguucaucca

SEQ ID NO: 683791 - RNA, 16 nt, Homo sapiens
ugcuaccucacugggg

SEQ ID NO: 683792 - RNA, 17 nt, Homo sapiens
ugcuagaaaggaagaca

SEQ ID NO: 683793 - RNA, 23 nt, Homo sapiens
ugcuagaaaguuaggggguucuu

SEQ ID NO: 683794 - RNA, 23 nt, Homo sapiens
ugcuagaacaacgccugucacag

SEQ ID NO: 683795 - RNA, 14 nt, Homo sapiens
ugcuagaggugcuc

SEQ ID NO: 683796 - RNA, 23 nt, Homo sapiens
ugcuagugggcccucucucuggg

SEQ ID NO: 683797 - RNA, 18 nt, Homo sapiens
ugcuauacugcauacuuu

SEQ ID NO: 683798 - RNA, 23 nt, Homo sapiens
ugcuauaggcuggagaagcucac

SEQ ID NO: 683799 - RNA, 19 nt, Homo sapiens
ugcuauauuaacaucaucu

SEQ ID NO: 683800 - RNA, 21 nt, Homo sapiens
ugcuauccccaucucccugcc

SEQ ID NO: 683801 - RNA, 15 nt, Homo sapiens
ugcuaucgcaccacu

SEQ ID NO: 683802 - RNA, 16 nt, Homo sapiens
ugcuaugaaugauacc

SEQ ID NO: 683803 - RNA, 16 nt, Homo sapiens
ugcuaugguuugccau

SEQ ID NO: 683804 - RNA, 20 nt, Homo sapiens
ugcuaugucccaagagccau

SEQ ID NO: 683805 - RNA, 23 nt, Homo sapiens
ugcuauuauguaacauccagaag

SEQ ID NO: 683806 - RNA, 20 nt, Homo sapiens
ugcuauuuuauuuguauuca

SEQ ID NO: 683807 - RNA, 16 nt, Homo sapiens
ugcucaaaaucuuucc

SEQ ID NO: 683808 - RNA, 22 nt, Homo sapiens
ugcucaacaauuuauccauuca

SEQ ID NO: 683809 - RNA, 17 nt, Homo sapiens
ugcucaaggaccaagag

SEQ ID NO: 683810 - RNA, 19 nt, Homo sapiens
ugcucaauaaaaauguguu

SEQ ID NO: 683811 - RNA, 17 nt, Homo sapiens
ugcucaauaaaguacaa

SEQ ID NO: 683812 - RNA, 21 nt, Homo sapiens
ugcucaauaaaguacaagagc

SEQ ID NO: 683813 - RNA, 18 nt, Homo sapiens
ugcucaaucccugaggac

SEQ ID NO: 683814 - RNA, 12 nt, Homo sapiens
ugcucaccagcc

SEQ ID NO: 683815 - RNA, 15 nt, Homo sapiens
ugcucagagacacug

SEQ ID NO: 683816 - RNA, 18 nt, Homo sapiens
ugcucagauagaaugaca

SEQ ID NO: 683817 - RNA, 17 nt, Homo sapiens
ugcucagcaugauucuu

SEQ ID NO: 683818 - RNA, 20 nt, Homo sapiens
ugcucaggccucccuagcac

SEQ ID NO: 683819 - RNA, 20 nt, Homo sapiens
ugcucaggcuugaaaugcau

SEQ ID NO: 683820 - RNA, 17 nt, Homo sapiens
ugcucauauugugauuc

SEQ ID NO: 683821 - RNA, 13 nt, Homo sapiens
ugcucauguauau

SEQ ID NO: 683822 - RNA, 18 nt, Homo sapiens
ugcucauguauauuuagu

SEQ ID NO: 683823 - RNA, 23 nt, Homo sapiens
ugcuccaacccccgccaccucag

SEQ ID NO: 683824 - RNA, 12 nt, Homo sapiens
ugcuccaccagc

SEQ ID NO: 683825 - RNA, 17 nt, Homo sapiens
ugcuccaguguaucuca

SEQ ID NO: 683826 - RNA, 17 nt, Homo sapiens
ugcuccauuaauccagg

SEQ ID NO: 683827 - RNA, 14 nt, Homo sapiens
ugcucccacagaac

SEQ ID NO: 683828 - RNA, 17 nt, Homo sapiens
ugcucccgaugcugcua

SEQ ID NO: 683829 - RNA, 15 nt, Homo sapiens
ugcucccuagccaga

SEQ ID NO: 683830 - RNA, 21 nt, Homo sapiens
ugcucccuccucuccuaccca

SEQ ID NO: 683831 - RNA, 21 nt, Homo sapiens
ugcuccgaggacccaggaaag

SEQ ID NO: 683832 - RNA, 18 nt, Homo sapiens
ugcuccguggacugcagu

SEQ ID NO: 683833 - RNA, 16 nt, Homo sapiens
ugcuccuaaggguaga

SEQ ID NO: 683834 - RNA, 21 nt, Homo sapiens
ugcuccuagagggaggggccu

SEQ ID NO: 683835 - RNA, 19 nt, Homo sapiens
ugcuccuuggcuuaccuga

SEQ ID NO: 683836 - RNA, 16 nt, Homo sapiens
ugcucuacccaugagc

SEQ ID NO: 683837 - RNA, 17 nt, Homo sapiens
ugcucuaggaagacauu

SEQ ID NO: 683838 - RNA, 16 nt, Homo sapiens
ugcucucucaucuugu

SEQ ID NO: 683839 - RNA, 12 nt, Homo sapiens
ugcucucuucag

SEQ ID NO: 683840 - RNA, 17 nt, Homo sapiens
ugcucugaccuuccaga

SEQ ID NO: 683841 - RNA, 18 nt, Homo sapiens
ugcucugagaauuguuga

SEQ ID NO: 683842 - RNA, 13 nt, Homo sapiens
ugcucugccucag

SEQ ID NO: 683843 - RNA, 14 nt, Homo sapiens
ugcccacggucuga

SEQ ID NO: 683844 - RNA, 22 nt, Homo sapiens
ugcccacguaugugaaacacac

SEQ ID NO: 683845 - RNA, 20 nt, Homo sapiens
ugcccacguccccacccacg

SEQ ID NO: 683846 - RNA, 14 nt, Homo sapiens
ugcccagacacaga

SEQ ID NO: 683847 - RNA, 15 nt, Homo sapiens
ugcccagacuacagg

SEQ ID NO: 683848 - RNA, 13 nt, Homo sapiens
ugcccagaucaac

SEQ ID NO: 683849 - RNA, 12 nt, Homo sapiens
ugcccagauucc

SEQ ID NO: 683850 - RNA, 23 nt, Homo sapiens
ugcccagcagagguuugcugaca

SEQ ID NO: 683851 - RNA, 21 nt, Homo sapiens
ugcccagcccggaccuuggca

SEQ ID NO: 683852 - RNA, 19 nt, Homo sapiens
ugcccagccuguggugcuu

SEQ ID NO: 683853 - RNA, 17 nt, Homo sapiens
ugcccaggaagagccau

SEQ ID NO: 683854 - RNA, 19 nt, Homo sapiens
ugcccaggauugaaggugu

SEQ ID NO: 683855 - RNA, 20 nt, Homo sapiens
ugcccaggcuggaaugcagu

SEQ ID NO: 683856 - RNA, 20 nt, Homo sapiens
ugcccaggcuggaguggagu

SEQ ID NO: 683857 - RNA, 20 nt, Homo sapiens
ugcccagggcucagccuggu

SEQ ID NO: 683858 - RNA, 17 nt, Homo sapiens
ugcccaggguuuugccc

SEQ ID NO: 683859 - RNA, 16 nt, Homo sapiens
ugcccaguacauuuaa

SEQ ID NO: 683860 - RNA, 16 nt, Homo sapiens
ugcccagugaccaguc

SEQ ID NO: 683861 - RNA, 19 nt, Homo sapiens
ugcccagugaccagucacu

SEQ ID NO: 683862 - RNA, 14 nt, Homo sapiens
ugcccaguguucuc

SEQ ID NO: 683863 - RNA, 17 nt, Homo sapiens
ugcccaucaagugcagu

SEQ ID NO: 683864 - RNA, 19 nt, Homo sapiens
ugcccaucagccauuugcc

SEQ ID NO: 683865 - RNA, 17 nt, Homo sapiens
ugcccauccugacugaa

SEQ ID NO: 683866 - RNA, 20 nt, Homo sapiens
ugccccacgcuguggcccug

SEQ ID NO: 683867 - RNA, 16 nt, Homo sapiens
ugccccacuucuggca

SEQ ID NO: 683868 - RNA, 18 nt, Homo sapiens
ugccccagaaaaauaacu

SEQ ID NO: 683869 - RNA, 19 nt, Homo sapiens
ugccccagauagguggugc

SEQ ID NO: 683870 - RNA, 14 nt, Homo sapiens
ugccccagggggau

SEQ ID NO: 683871 - RNA, 23 nt, Homo sapiens
ugccccaguagaguuagcugaua

SEQ ID NO: 683872 - RNA, 11 nt, Homo sapiens
ugccccagugu

SEQ ID NO: 683873 - RNA, 21 nt, Homo sapiens
ugccccaucacugcgccacug

SEQ ID NO: 683874 - RNA, 17 nt, Homo sapiens
ugcccccaccccgggga

SEQ ID NO: 683875 - RNA, 22 nt, Homo sapiens
ugcccccagacccaugugauuu

SEQ ID NO: 683876 - RNA, 13 nt, Homo sapiens
ugcccccaggcag

SEQ ID NO: 683877 - RNA, 17 nt, Homo sapiens
ugccccccaugaggaag

SEQ ID NO: 683878 - RNA, 17 nt, Homo sapiens
ugcccccuccaggagag

SEQ ID NO: 683879 - RNA, 18 nt, Homo sapiens
ugcccccuucucccacac

SEQ ID NO: 683880 - RNA, 15 nt, Homo sapiens
ugccccgaauuuagu

SEQ ID NO: 683881 - RNA, 18 nt, Homo sapiens
ugccccgccuccccgaaa

SEQ ID NO: 683882 - RNA, 20 nt, Homo sapiens
ugccccgugggcugugccaa

SEQ ID NO: 683883 - RNA, 16 nt, Homo sapiens
ugccccucuguaacaa

SEQ ID NO: 683884 - RNA, 19 nt, Homo sapiens
ugccccugcccacacggca

SEQ ID NO: 683885 - RNA, 23 nt, Homo sapiens
ugccccuggugcccugagacaga

SEQ ID NO: 683886 - RNA, 18 nt, Homo sapiens
ugccccuuccacuuugag

SEQ ID NO: 683887 - RNA, 19 nt, Homo sapiens
ugccccuugcaagccauaa

SEQ ID NO: 683888 - RNA, 21 nt, Homo sapiens
ugccccuuguccugaagccca

SEQ ID NO: 683889 - RNA, 16 nt, Homo sapiens
ugcccgagcuggugca

SEQ ID NO: 683890 - RNA, 23 nt, Homo sapiens
ugcccggggcagcugccagagaa

SEQ ID NO: 683891 - RNA, 17 nt, Homo sapiens
ugcccuaaaguguauuu

SEQ ID NO: 683892 - RNA, 19 nt, Homo sapiens
ugcccuagaucaacagauc

SEQ ID NO: 683893 - RNA, 20 nt, Homo sapiens
ugcccuagcccagacucuga

SEQ ID NO: 683894 - RNA, 16 nt, Homo sapiens
ugcccucaggggacuu

SEQ ID NO: 683895 - RNA, 20 nt, Homo sapiens
ugcccuccaauccuuuccac

SEQ ID NO: 683896 - RNA, 23 nt, Homo sapiens
ugcccucucccuguguucugggc

SEQ ID NO: 683897 - RNA, 17 nt, Homo sapiens
ugcccugaguccaagag

SEQ ID NO: 683898 - RNA, 11 nt, Homo sapiens
ugcccuggcag

SEQ ID NO: 683899 - RNA, 15 nt, Homo sapiens
ugcccuggcauuaag

SEQ ID NO: 683900 - RNA, 21 nt, Homo sapiens
ugcccugggccaaaaccaaug

SEQ ID NO: 683901 - RNA, 16 nt, Homo sapiens
ugcccugguccaggga

SEQ ID NO: 683902 - RNA, 19 nt, Homo sapiens
ugcccuguaccugugcacg

SEQ ID NO: 683903 - RNA, 18 nt, Homo sapiens
ugcccuuccgcagugugg

SEQ ID NO: 683904 - RNA, 16 nt, Homo sapiens
ugcccuuccucagggc

SEQ ID NO: 683905 - RNA, 21 nt, Homo sapiens
ugcccuuggagcugccgugcc

SEQ ID NO: 683906 - RNA, 22 nt, Homo sapiens
ugccgacucccccaaccaagga

SEQ ID NO: 683907 - RNA, 16 nt, Homo sapiens
ugccgcaauacaggaa

SEQ ID NO: 683908 - RNA, 18 nt, Homo sapiens
ugccgcaggugggugcug

SEQ ID NO: 683909 - RNA, 15 nt, Homo sapiens
ugccggaggccuucc

SEQ ID NO: 683910 - RNA, 19 nt, Homo sapiens
ugccgggacccugcucaca

SEQ ID NO: 683911 - RNA, 22 nt, Homo sapiens
ugccgguguugaccuuccuuca

SEQ ID NO: 683912 - RNA, 21 nt, Homo sapiens
ugccguaacaacuguggucaa

SEQ ID NO: 683913 - RNA, 18 nt, Homo sapiens
ugccguaggaaaaauaaa

SEQ ID NO: 683914 - RNA, 15 nt, Homo sapiens
ugccgucaccaccac

SEQ ID NO: 683915 - RNA, 16 nt, Homo sapiens
ugccguuaucauggag

SEQ ID NO: 683916 - RNA, 17 nt, Homo sapiens
ugccuaaaucccaagaa

SEQ ID NO: 683917 - RNA, 13 nt, Homo sapiens
ugccuaccccagc

SEQ ID NO: 683918 - RNA, 16 nt, Homo sapiens
ugccuagaaauaucuu

SEQ ID NO: 683919 - RNA, 20 nt, Homo sapiens
ugccuagaaauaucuuucuc

SEQ ID NO: 683920 - RNA, 20 nt, Homo sapiens
ugccuagaguguagccuaaa

SEQ ID NO: 683921 - RNA, 15 nt, Homo sapiens
ugccuaguaacacau

SEQ ID NO: 683922 - RNA, 17 nt, Homo sapiens
ugccuauagucgcagcu

SEQ ID NO: 683923 - RNA, 21 nt, Homo sapiens
ugccucaacccaaggggauuu

SEQ ID NO: 683924 - RNA, 14 nt, Homo sapiens
ugccucaaguucca

SEQ ID NO: 683925 - RNA, 15 nt, Homo sapiens
ugccucaaguuccau

SEQ ID NO: 683926 - RNA, 17 nt, Homo sapiens
ugccucaaguuccaugc

SEQ ID NO: 683927 - RNA, 13 nt, Homo sapiens
ugccucagcaauu

SEQ ID NO: 683928 - RNA, 22 nt, Homo sapiens
ugccucagccucccaauuagcu

SEQ ID NO: 683929 - RNA, 20 nt, Homo sapiens
ugccucaggccagggcucac

SEQ ID NO: 683930 - RNA, 15 nt, Homo sapiens
ugccucauagcauag

SEQ ID NO: 683931 - RNA, 18 nt, Homo sapiens
ugccuccacucaccacaa

SEQ ID NO: 683932 - RNA, 16 nt, Homo sapiens
ugccucccagguucca

SEQ ID NO: 683933 - RNA, 19 nt, Homo sapiens
ugccucccagguuccagca

SEQ ID NO: 683934 - RNA, 12 nt, Homo sapiens
ugccuccgugcc

SEQ ID NO: 683935 - RNA, 23 nt, Homo sapiens
ugccuccucccugggcagaaagu

SEQ ID NO: 683936 - RNA, 18 nt, Homo sapiens
ugccucuaagcugcucua

SEQ ID NO: 683937 - RNA, 13 nt, Homo sapiens
ugccucuacuuug

SEQ ID NO: 683938 - RNA, 14 nt, Homo sapiens
ugccucucucagga

SEQ ID NO: 683939 - RNA, 22 nt, Homo sapiens
ugccucucucauccacuuucca

SEQ ID NO: 683940 - RNA, 14 nt, Homo sapiens
ugccucucuugccc

SEQ ID NO: 683941 - RNA, 23 nt, Homo sapiens
ugccucugacagcagccugugag

SEQ ID NO: 683942 - RNA, 16 nt, Homo sapiens
ugccucugcucccucu

SEQ ID NO: 683943 - RNA, 15 nt, Homo sapiens
ugccucuguauuuaa

SEQ ID NO: 683944 - RNA, 14 nt, Homo sapiens
ugccucuucuacuu

SEQ ID NO: 683945 - RNA, 14 nt, Homo sapiens
ugccugagcccagg

SEQ ID NO: 683946 - RNA, 16 nt, Homo sapiens
ugccugaucugcacau

SEQ ID NO: 683947 - RNA, 20 nt, Homo sapiens
ugccugaucugcacauuuca

SEQ ID NO: 683948 - RNA, 19 nt, Homo sapiens
ugccugcaaaaaugaaauc

SEQ ID NO: 683949 - RNA, 15 nt, Homo sapiens
ugccugcagcacaug

SEQ ID NO: 683950 - RNA, 16 nt, Homo sapiens
ugccugcccugccuca

SEQ ID NO: 683951 - RNA, 17 nt, Homo sapiens
ugccugcccugccucag

SEQ ID NO: 683952 - RNA, 18 nt, Homo sapiens
ugccuggacagaggacaa

SEQ ID NO: 683953 - RNA, 14 nt, Homo sapiens
ugccuggcacagac

SEQ ID NO: 683954 - RNA, 19 nt, Homo sapiens
ugccuggcacagaccaggc

SEQ ID NO: 683955 - RNA, 18 nt, Homo sapiens
ugccuggccuccgaugcc

SEQ ID NO: 683956 - RNA, 13 nt, Homo sapiens
ugccugggaccug

SEQ ID NO: 683957 - RNA, 20 nt, Homo sapiens
ugccuggucugucuggaucc

SEQ ID NO: 683958 - RNA, 16 nt, Homo sapiens
ugccuggugugccuca

SEQ ID NO: 683959 - RNA, 19 nt, Homo sapiens
ugccugguuuuauuuauau

SEQ ID NO: 683960 - RNA, 14 nt, Homo sapiens
ugccuguaauccca

SEQ ID NO: 683961 - RNA, 20 nt, Homo sapiens
ugccuguaaucucagcacuu

SEQ ID NO: 683962 - RNA, 23 nt, Homo sapiens
ugccuguagagacaauacaguaa

SEQ ID NO: 683963 - RNA, 18 nt, Homo sapiens
ugccugucccucucaggc

SEQ ID NO: 683964 - RNA, 13 nt, Homo sapiens
ugccugucucuag

SEQ ID NO: 683965 - RNA, 15 nt, Homo sapiens
ugcauguaugacuua

SEQ ID NO: 683966 - RNA, 21 nt, Homo sapiens
ugcaugucaucuucuaggcca

SEQ ID NO: 683967 - RNA, 22 nt, Homo sapiens
ugcauguccggcugaaggcuga

SEQ ID NO: 683968 - RNA, 21 nt, Homo sapiens
ugcaugucuuaaaugcucaua

SEQ ID NO: 683969 - RNA, 18 nt, Homo sapiens
ugcaugugcgucaccguc

SEQ ID NO: 683970 - RNA, 22 nt, Homo sapiens
ugcaugugugcgagugugugca

SEQ ID NO: 683971 - RNA, 19 nt, Homo sapiens
ugcauuaaaacaaaggaag

SEQ ID NO: 683972 - RNA, 19 nt, Homo sapiens
ugcauuaaaagaaaauaaa

SEQ ID NO: 683973 - RNA, 15 nt, Homo sapiens
ugcauuaaaccuguc

SEQ ID NO: 683974 - RNA, 16 nt, Homo sapiens
ugcauuauaucaaauc

SEQ ID NO: 683975 - RNA, 12 nt, Homo sapiens
ugcauuccagaa

SEQ ID NO: 683976 - RNA, 15 nt, Homo sapiens
ugcauucuucucugu

SEQ ID NO: 683977 - RNA, 20 nt, Homo sapiens
ugcauucuucugagcacugu

SEQ ID NO: 683978 - RNA, 21 nt, Homo sapiens
ugcauucuucugagcacuguu

SEQ ID NO: 683979 - RNA, 19 nt, Homo sapiens
ugcauugaaagaauuagau

SEQ ID NO: 683980 - RNA, 14 nt, Homo sapiens
ugcauugaaaugca

SEQ ID NO: 683981 - RNA, 18 nt, Homo sapiens
ugcauugcuaaaauauua

SEQ ID NO: 683982 - RNA, 12 nt, Homo sapiens
ugcauugcucuu

SEQ ID NO: 683983 - RNA, 23 nt, Homo sapiens
ugcauuggcuaauaaauguugcc

SEQ ID NO: 683984 - RNA, 23 nt, Homo sapiens
ugcauugucuccuuccacaauga

SEQ ID NO: 683985 - RNA, 16 nt, Homo sapiens
ugcauugugaggguua

SEQ ID NO: 683986 - RNA, 15 nt, Homo sapiens
ugcauuuaugaugca

SEQ ID NO: 683987 - RNA, 16 nt, Homo sapiens
ugcauuuaugaugcag

SEQ ID NO: 683988 - RNA, 21 nt, Homo sapiens
ugcauuucaagcagcugaaga

SEQ ID NO: 683989 - RNA, 22 nt, Homo sapiens
ugcauuuccucgcagccucuca

SEQ ID NO: 683990 - RNA, 16 nt, Homo sapiens
ugcauuuggucagggg

SEQ ID NO: 683991 - RNA, 15 nt, Homo sapiens
ugcauuuggugguuu

SEQ ID NO: 683992 - RNA, 13 nt, Homo sapiens
ugcauuugugagg

SEQ ID NO: 683993 - RNA, 21 nt, Homo sapiens
ugcauuugugcguaugcagug

SEQ ID NO: 683994 - RNA, 13 nt, Homo sapiens
ugcauuuguuacu

SEQ ID NO: 683995 - RNA, 17 nt, Homo sapiens
ugcauuuucuucacagu

SEQ ID NO: 683996 - RNA, 19 nt, Homo sapiens
ugcauuuucuucacagugc

SEQ ID NO: 683997 - RNA, 23 nt, Homo sapiens
ugcauuuucuucacagugcagcu

SEQ ID NO: 683998 - RNA, 16 nt, Homo sapiens
ugcauuuuuagaccau

SEQ ID NO: 683999 - RNA, 10 nt, Homo sapiens
ugccaaaaaa

SEQ ID NO: 684000 - RNA, 15 nt, Homo sapiens
ugccaaaaaucuuuu

SEQ ID NO: 684001 - RNA, 15 nt, Homo sapiens
ugccaaaauaccuuc

SEQ ID NO: 684002 - RNA, 14 nt, Homo sapiens
ugccaaaaugcucu

SEQ ID NO: 684003 - RNA, 13 nt, Homo sapiens
ugccaaacagccc

SEQ ID NO: 684004 - RNA, 16 nt, Homo sapiens
ugccaaaccaagcaaa

SEQ ID NO: 684005 - RNA, 16 nt, Homo sapiens
ugccaaaccuguguag

SEQ ID NO: 684006 - RNA, 22 nt, Homo sapiens
ugccaaaccuguguaggcauuu

SEQ ID NO: 684007 - RNA, 19 nt, Homo sapiens
ugccaaaggaugugauaua

SEQ ID NO: 684008 - RNA, 15 nt, Homo sapiens
ugccaaauguuccau

SEQ ID NO: 684009 - RNA, 16 nt, Homo sapiens
ugccaaccaguuugaa

SEQ ID NO: 684010 - RNA, 20 nt, Homo sapiens
ugccaaccucuggagcaaug

SEQ ID NO: 684011 - RNA, 17 nt, Homo sapiens
ugccaaccuguucuuag

SEQ ID NO: 684012 - RNA, 22 nt, Homo sapiens
ugccaacuuuuuguuacagauu

SEQ ID NO: 684013 - RNA, 11 nt, Homo sapiens
ugccaagagcc

SEQ ID NO: 684014 - RNA, 22 nt, Homo sapiens
ugccaagagggucugauggcac

SEQ ID NO: 684015 - RNA, 22 nt, Homo sapiens
ugccaagcuuccugugcccuca

SEQ ID NO: 684016 - RNA, 22 nt, Homo sapiens
ugccaaggcaaaaaacucuuaa

SEQ ID NO: 684017 - RNA, 19 nt, Homo sapiens
ugccaagggguuaaugaaa

SEQ ID NO: 684018 - RNA, 17 nt, Homo sapiens
ugccaaugaccaaacag

SEQ ID NO: 684019 - RNA, 19 nt, Homo sapiens
ugccaauggcggacucaaa

SEQ ID NO: 684020 - RNA, 23 nt, Homo sapiens
ugccaauugaauaggaucaaauu

SEQ ID NO: 684021 - RNA, 16 nt, Homo sapiens
ugccacacccagguga

SEQ ID NO: 684022 - RNA, 20 nt, Homo sapiens
ugccacagaugauacuucca

SEQ ID NO: 684023 - RNA, 19 nt, Homo sapiens
ugccaccacaccuggcuaa

SEQ ID NO: 684024 - RNA, 18 nt, Homo sapiens
ugccaccaucauagcuca

SEQ ID NO: 684025 - RNA, 20 nt, Homo sapiens
ugccaccauggccagccaac

SEQ ID NO: 684026 - RNA, 15 nt, Homo sapiens
ugccaccccuuccuc

SEQ ID NO: 684027 - RNA, 11 nt, Homo sapiens
ugccacgcagg

SEQ ID NO: 684028 - RNA, 17 nt, Homo sapiens
ugccacggaaacauaca

SEQ ID NO: 684029 - RNA, 19 nt, Homo sapiens
ugccacucccugcugugug

SEQ ID NO: 684030 - RNA, 15 nt, Homo sapiens
ugccacugcacucua

SEQ ID NO: 684031 - RNA, 11 nt, Homo sapiens
ugccacugggc

SEQ ID NO: 684032 - RNA, 18 nt, Homo sapiens
ugccacuguguacugugg

SEQ ID NO: 684033 - RNA, 19 nt, Homo sapiens
ugccacuguguacugugga

SEQ ID NO: 684034 - RNA, 22 nt, Homo sapiens
ugccacugugugccuucugcca

SEQ ID NO: 684035 - RNA, 19 nt, Homo sapiens
ugccacuugauggggccug

SEQ ID NO: 684036 - RNA, 17 nt, Homo sapiens
ugccacuugucaaagaa

SEQ ID NO: 684037 - RNA, 17 nt, Homo sapiens
ugccacuuuacccaccu

SEQ ID NO: 684038 - RNA, 12 nt, Homo sapiens
ugccacuuugca

SEQ ID NO: 684039 - RNA, 14 nt, Homo sapiens
ugccagacaugugg

SEQ ID NO: 684040 - RNA, 15 nt, Homo sapiens
ugccagagauguacu

SEQ ID NO: 684041 - RNA, 21 nt, Homo sapiens
ugccagaggcuggaccacaca

SEQ ID NO: 684042 - RNA, 20 nt, Homo sapiens
ugccagaguagugaagcuaa

SEQ ID NO: 684043 - RNA, 18 nt, Homo sapiens
ugccagaugauuguucaa

SEQ ID NO: 684044 - RNA, 19 nt, Homo sapiens
ugccagcaaugacaucuca

SEQ ID NO: 684045 - RNA, 17 nt, Homo sapiens
ugccagcaggaggaaug

SEQ ID NO: 684046 - RNA, 22 nt, Homo sapiens
ugccagcauauacugaagucuu

SEQ ID NO: 684047 - RNA, 14 nt, Homo sapiens
ugccaggcacuuug

SEQ ID NO: 684048 - RNA, 15 nt, Homo sapiens
ugccaggccuggcaa

SEQ ID NO: 684049 - RNA, 15 nt, Homo sapiens
ugccaggcugcuaaa

SEQ ID NO: 684050 - RNA, 19 nt, Homo sapiens
ugccaggcuugcagucucc

SEQ ID NO: 684051 - RNA, 21 nt, Homo sapiens
ugccaggugcaaucuacugga

SEQ ID NO: 684052 - RNA, 23 nt, Homo sapiens
ugccaggugcaaucuacuggaaa

SEQ ID NO: 684053 - RNA, 20 nt, Homo sapiens
ugccagucagcaaccuguaa

SEQ ID NO: 684054 - RNA, 17 nt, Homo sapiens
ugccagucccagaucac

SEQ ID NO: 684055 - RNA, 15 nt, Homo sapiens
ugccagugccucuca

SEQ ID NO: 684056 - RNA, 22 nt, Homo sapiens
ugccagugccuuaccuccugcc

SEQ ID NO: 684057 - RNA, 17 nt, Homo sapiens
ugccauacuaaugauga

SEQ ID NO: 684058 - RNA, 18 nt, Homo sapiens
ugccauacuuuccuguau

SEQ ID NO: 684059 - RNA, 18 nt, Homo sapiens
ugccauaguuugugaauc

SEQ ID NO: 684060 - RNA, 13 nt, Homo sapiens
ugccauaucagug

SEQ ID NO: 684061 - RNA, 23 nt, Homo sapiens
ugccaucaagaugagagaacugg

SEQ ID NO: 684062 - RNA, 21 nt, Homo sapiens
ugccaucaccgcugggugguu

SEQ ID NO: 684063 - RNA, 13 nt, Homo sapiens
ugccaucaugccu

SEQ ID NO: 684064 - RNA, 15 nt, Homo sapiens
ugccaugccagcuua

SEQ ID NO: 684065 - RNA, 15 nt, Homo sapiens
ugccaugcucagaaa

SEQ ID NO: 684066 - RNA, 15 nt, Homo sapiens
ugccauggacauaaa

SEQ ID NO: 684067 - RNA, 10 nt, Homo sapiens
ugccauguca

SEQ ID NO: 684068 - RNA, 18 nt, Homo sapiens
ugccauguuuuugccaaa

SEQ ID NO: 684069 - RNA, 18 nt, Homo sapiens
ugccauuauuuucuguca

SEQ ID NO: 684070 - RNA, 16 nt, Homo sapiens
ugccauuccacuccac

SEQ ID NO: 684071 - RNA, 17 nt, Homo sapiens
ugccauuccacuccacu

SEQ ID NO: 684072 - RNA, 16 nt, Homo sapiens
ugccauugcauuccag

SEQ ID NO: 684073 - RNA, 16 nt, Homo sapiens
ugccauugguuccuug

SEQ ID NO: 684074 - RNA, 23 nt, Homo sapiens
ugccauuuucagaaucaucuuuu

SEQ ID NO: 684075 - RNA, 22 nt, Homo sapiens
ugcccaaaagaggugucaugcu

SEQ ID NO: 684076 - RNA, 18 nt, Homo sapiens
ugcccaaacaccagucac

SEQ ID NO: 684077 - RNA, 20 nt, Homo sapiens
ugcccaaacagcuguauuua

SEQ ID NO: 684078 - RNA, 21 nt, Homo sapiens
ugcccaaccuauccuguucuu

SEQ ID NO: 684079 - RNA, 13 nt, Homo sapiens
ugcccaacugccu

SEQ ID NO: 684080 - RNA, 18 nt, Homo sapiens
ugcccaagagugggguuu

SEQ ID NO: 684081 - RNA, 13 nt, Homo sapiens
ugcccaaggagcc

SEQ ID NO: 684082 - RNA, 21 nt, Homo sapiens
ugcccaaggagcccccugaga

SEQ ID NO: 684083 - RNA, 21 nt, Homo sapiens
ugcccaaggauagguauuuua

SEQ ID NO: 684084 - RNA, 13 nt, Homo sapiens
ugcccaauuccag

SEQ ID NO: 684085 - RNA, 13 nt, Homo sapiens
ugcccaccaaagg

SEQ ID NO: 684086 - RNA, 18 nt, Homo sapiens
ugcccacccgucuucaau

SEQ ID NO: 684087 - RNA, 18 nt, Homo sapiens
ugcccacggcaacugccu

SEQ ID NO: 684088 - RNA, 18 nt, Homo sapiens
ugagaaaagccucuccag

SEQ ID NO: 684089 - RNA, 21 nt, Homo sapiens
ugagaaaaguucaauacucuu

SEQ ID NO: 684090 - RNA, 22 nt, Homo sapiens
ugagaaaauccccaacuaugca

SEQ ID NO: 684091 - RNA, 18 nt, Homo sapiens
ugagaaacucuacaugua

SEQ ID NO: 684092 - RNA, 16 nt, Homo sapiens
ugagaaacugauuuau

SEQ ID NO: 684093 - RNA, 18 nt, Homo sapiens
ugagaaagagcacuuaag

SEQ ID NO: 684094 - RNA, 12 nt, Homo sapiens
ugagaaagccuu

SEQ ID NO: 684095 - RNA, 13 nt, Homo sapiens
ugagaaagcucaa

SEQ ID NO: 684096 - RNA, 20 nt, Homo sapiens
ugagaaagcuuuuauuccuu

SEQ ID NO: 684097 - RNA, 17 nt, Homo sapiens
ugagaaagggagaggaa

SEQ ID NO: 684098 - RNA, 14 nt, Homo sapiens
ugagaaauuuacua

SEQ ID NO: 684099 - RNA, 23 nt, Homo sapiens
ugagaaauuuacuacaguaguua

SEQ ID NO: 684100 - RNA, 21 nt, Homo sapiens
ugagaacaagucacagcugca

SEQ ID NO: 684101 - RNA, 14 nt, Homo sapiens
ugagaacagcauau

SEQ ID NO: 684102 - RNA, 16 nt, Homo sapiens
ugagaaccauuuacuu

SEQ ID NO: 684103 - RNA, 13 nt, Homo sapiens
ugagaacccccua

SEQ ID NO: 684104 - RNA, 18 nt, Homo sapiens
ugagaacuccucauuccc

SEQ ID NO: 684105 - RNA, 13 nt, Homo sapiens
ugagaacuggaca

SEQ ID NO: 684106 - RNA, 15 nt, Homo sapiens
ugagaacuugacaag

SEQ ID NO: 684107 - RNA, 13 nt, Homo sapiens
ugagaagaaugaa

SEQ ID NO: 684108 - RNA, 21 nt, Homo sapiens
ugagaagacauggaugaucug

SEQ ID NO: 684109 - RNA, 18 nt, Homo sapiens
ugagaagcuucuaauuag

SEQ ID NO: 684110 - RNA, 14 nt, Homo sapiens
ugagaaggacccug

SEQ ID NO: 684111 - RNA, 19 nt, Homo sapiens
ugagaagucaaacauuuca

SEQ ID NO: 684112 - RNA, 17 nt, Homo sapiens
ugagaagugcacuuuaa

SEQ ID NO: 684113 - RNA, 18 nt, Homo sapiens
ugagaauauaauacugua

SEQ ID NO: 684114 - RNA, 23 nt, Homo sapiens
ugagaauauaauacuguauuuga

SEQ ID NO: 684115 - RNA, 16 nt, Homo sapiens
ugagaaucagacugac

SEQ ID NO: 684116 - RNA, 17 nt, Homo sapiens
ugagaaucaugcacuuu

SEQ ID NO: 684117 - RNA, 14 nt, Homo sapiens
ugagaauguacuaa

SEQ ID NO: 684118 - RNA, 17 nt, Homo sapiens
ugagaauuguaugucau

SEQ ID NO: 684119 - RNA, 15 nt, Homo sapiens
ugagaauugugcuuu

SEQ ID NO: 684120 - RNA, 13 nt, Homo sapiens
ugagacaagcccu

SEQ ID NO: 684121 - RNA, 20 nt, Homo sapiens
ugagacaggaaaaaccaaca

SEQ ID NO: 684122 - RNA, 15 nt, Homo sapiens
ugagacagucuugcu

SEQ ID NO: 684123 - RNA, 22 nt, Homo sapiens
ugagaccagccugggcagcaua

SEQ ID NO: 684124 - RNA, 19 nt, Homo sapiens
ugagacccuuuucucagga

SEQ ID NO: 684125 - RNA, 17 nt, Homo sapiens
ugagaccgagucuugcu

SEQ ID NO: 684126 - RNA, 12 nt, Homo sapiens
ugagaccuggaa

SEQ ID NO: 684127 - RNA, 21 nt, Homo sapiens
ugagaccugggauuugagaua

SEQ ID NO: 684128 - RNA, 19 nt, Homo sapiens
ugagacuaaucuuauucau

SEQ ID NO: 684129 - RNA, 15 nt, Homo sapiens
ugagacucacaggaa

SEQ ID NO: 684130 - RNA, 15 nt, Homo sapiens
ugagacuccaccuca

SEQ ID NO: 684131 - RNA, 16 nt, Homo sapiens
ugagacuccgucacaa

SEQ ID NO: 684132 - RNA, 23 nt, Homo sapiens
ugagacucuaggguccaguggau

SEQ ID NO: 684133 - RNA, 14 nt, Homo sapiens
ugagacuguaaaac

SEQ ID NO: 684134 - RNA, 13 nt, Homo sapiens
ugagacugugcug

SEQ ID NO: 684135 - RNA, 21 nt, Homo sapiens
ugagacuuucuucuagugcuu

SEQ ID NO: 684136 - RNA, 20 nt, Homo sapiens
ugagacuuuucugcgugaug

SEQ ID NO: 684137 - RNA, 18 nt, Homo sapiens
ugagagaauaaaaacuuc

SEQ ID NO: 684138 - RNA, 12 nt, Homo sapiens
ugagagcaauau

SEQ ID NO: 684139 - RNA, 13 nt, Homo sapiens
ugcagggagacau

SEQ ID NO: 684140 - RNA, 18 nt, Homo sapiens
ugcagggagcacuguuca

SEQ ID NO: 684141 - RNA, 21 nt, Homo sapiens
ugcaggggguggguguguuag

SEQ ID NO: 684142 - RNA, 21 nt, Homo sapiens
ugcagggggugugucugcuca

SEQ ID NO: 684143 - RNA, 12 nt, Homo sapiens
ugcagggguccc

SEQ ID NO: 684144 - RNA, 15 nt, Homo sapiens
ugcaggggugccugg

SEQ ID NO: 684145 - RNA, 20 nt, Homo sapiens
ugcaggguggauuguuacag

SEQ ID NO: 684146 - RNA, 15 nt, Homo sapiens
ugcaggugaugccau

SEQ ID NO: 684147 - RNA, 21 nt, Homo sapiens
ugcaggugggguucgagggga

SEQ ID NO: 684148 - RNA, 12 nt, Homo sapiens
ugcagguggugu

SEQ ID NO: 684149 - RNA, 23 nt, Homo sapiens
ugcagguucauggauuacuucuc

SEQ ID NO: 684150 - RNA, 21 nt, Homo sapiens
ugcagguuccuuaucugucac

SEQ ID NO: 684151 - RNA, 22 nt, Homo sapiens
ugcagguuccuuaucugucaca

SEQ ID NO: 684152 - RNA, 23 nt, Homo sapiens
ugcagguuucuccuugaagcaaa

SEQ ID NO: 684153 - RNA, 13 nt, Homo sapiens
ugcaguaagccaa

SEQ ID NO: 684154 - RNA, 20 nt, Homo sapiens
ugcaguacaacaguuuuaga

SEQ ID NO: 684155 - RNA, 11 nt, Homo sapiens
ugcaguagcac

SEQ ID NO: 684156 - RNA, 17 nt, Homo sapiens
ugcaguagcacgaucuc

SEQ ID NO: 684157 - RNA, 14 nt, Homo sapiens
ugcaguagccguuu

SEQ ID NO: 684158 - RNA, 15 nt, Homo sapiens
ugcaguagccguuug

SEQ ID NO: 684159 - RNA, 20 nt, Homo sapiens
ugcaguaucucuuacaucag

SEQ ID NO: 684160 - RNA, 19 nt, Homo sapiens
ugcaguaugaacuauugcc

SEQ ID NO: 684161 - RNA, 14 nt, Homo sapiens
ugcagucacuggag

SEQ ID NO: 684162 - RNA, 16 nt, Homo sapiens
ugcagucccacacugu

SEQ ID NO: 684163 - RNA, 18 nt, Homo sapiens
ugcagucccacacugugc

SEQ ID NO: 684164 - RNA, 12 nt, Homo sapiens
ugcaguggcaca

SEQ ID NO: 684165 - RNA, 16 nt, Homo sapiens
ugcaguguuaguauuc

SEQ ID NO: 684166 - RNA, 23 nt, Homo sapiens
ugcaguuagagcugagcacuuuu

SEQ ID NO: 684167 - RNA, 16 nt, Homo sapiens
ugcaguuggacucuca

SEQ ID NO: 684168 - RNA, 18 nt, Homo sapiens
ugcaguuggacucucagg

SEQ ID NO: 684169 - RNA, 15 nt, Homo sapiens
ugcaguuuccaaucc

SEQ ID NO: 684170 - RNA, 22 nt, Homo sapiens
ugcaguuuccaaucccauagau

SEQ ID NO: 684171 - RNA, 21 nt, Homo sapiens
ugcaguuucuuguguagauuu

SEQ ID NO: 684172 - RNA, 23 nt, Homo sapiens
ugcaguuuugccuaauggcaaaa

SEQ ID NO: 684173 - RNA, 18 nt, Homo sapiens
ugcauaaaccaaugagcu

SEQ ID NO: 684174 - RNA, 22 nt, Homo sapiens
ugcauaaacuguuguaugccug

SEQ ID NO: 684175 - RNA, 14 nt, Homo sapiens
ugcauaagauuaaa

SEQ ID NO: 684176 - RNA, 18 nt, Homo sapiens
ugcauaauaagcuaaaga

SEQ ID NO: 684177 - RNA, 22 nt, Homo sapiens
ugcauacauauauauuuuuggc

SEQ ID NO: 684178 - RNA, 20 nt, Homo sapiens
ugcauacuggccgagcugcu

SEQ ID NO: 684179 - RNA, 13 nt, Homo sapiens
ugcauacuuuauu

SEQ ID NO: 684180 - RNA, 14 nt, Homo sapiens
ugcauaggaaguau

SEQ ID NO: 684181 - RNA, 15 nt, Homo sapiens
ugcauaggcucuuaa

SEQ ID NO: 684182 - RNA, 12 nt, Homo sapiens
ugcauauccaaa

SEQ ID NO: 684183 - RNA, 16 nt, Homo sapiens
ugcauaucugccuccc

SEQ ID NO: 684184 - RNA, 13 nt, Homo sapiens
ugcauaugaaauc

SEQ ID NO: 684185 - RNA, 14 nt, Homo sapiens
ugcauauuugcaaa

SEQ ID NO: 684186 - RNA, 21 nt, Homo sapiens
ugcaucacauauucauauugu

SEQ ID NO: 684187 - RNA, 13 nt, Homo sapiens
ugcaucacugggu

SEQ ID NO: 684188 - RNA, 22 nt, Homo sapiens
ugcaucagugacugaauucugc

SEQ ID NO: 684189 - RNA, 13 nt, Homo sapiens
ugcaucccugaaa

SEQ ID NO: 684190 - RNA, 16 nt, Homo sapiens
ugcaucccugcagcuc

SEQ ID NO: 684191 - RNA, 17 nt, Homo sapiens
ugcaucccugcagcuca

SEQ ID NO: 684192 - RNA, 20 nt, Homo sapiens
ugcauccuuuucaaaaccua

SEQ ID NO: 684193 - RNA, 19 nt, Homo sapiens
ugcaucguuucaucuucca

SEQ ID NO: 684194 - RNA, 23 nt, Homo sapiens
ugcaucuaaugaaaaacaaaaag

SEQ ID NO: 684195 - RNA, 21 nt, Homo sapiens
ugcaucuccccucagauucca

SEQ ID NO: 684196 - RNA, 23 nt, Homo sapiens
ugcaucuccccucagauuccacc

SEQ ID NO: 684197 - RNA, 13 nt, Homo sapiens
ugcaucucuaaua

SEQ ID NO: 684198 - RNA, 21 nt, Homo sapiens
ugcaucuguauaaguaagaaa

SEQ ID NO: 684199 - RNA, 22 nt, Homo sapiens
ugcaugaccacauagaacaugu

SEQ ID NO: 684200 - RNA, 14 nt, Homo sapiens
ugcaugaccuacca

SEQ ID NO: 684201 - RNA, 13 nt, Homo sapiens
ugcaugaccugau

SEQ ID NO: 684202 - RNA, 16 nt, Homo sapiens
ugcaugauaagagcau

SEQ ID NO: 684203 - RNA, 16 nt, Homo sapiens
ugcaugcuguagcugc

SEQ ID NO: 684204 - RNA, 14 nt, Homo sapiens
ugcaugcuugcaua

SEQ ID NO: 684205 - RNA, 17 nt, Homo sapiens
ugcauggaggcccuccu

SEQ ID NO: 684206 - RNA, 14 nt, Homo sapiens
ugcauggcuccaga

SEQ ID NO: 684207 - RNA, 19 nt, Homo sapiens
ugcauguaauacacaguga

SEQ ID NO: 684208 - RNA, 14 nt, Homo sapiens
ugcauguacuguau

SEQ ID NO: 684209 - RNA, 19 nt, Homo sapiens
ucuuaaauguuuauacugu

SEQ ID NO: 684210 - RNA, 22 nt, Homo sapiens
ucuuaacaaaccaacaucuuug

SEQ ID NO: 684211 - RNA, 20 nt, Homo sapiens
ucuuaacagaucuuuacucu

SEQ ID NO: 684212 - RNA, 19 nt, Homo sapiens
ucuuaacccccuagaaaga

SEQ ID NO: 684213 - RNA, 16 nt, Homo sapiens
ucuuaacuucuugcuu

SEQ ID NO: 684214 - RNA, 15 nt, Homo sapiens
ucuuaacuuugaacc

SEQ ID NO: 684215 - RNA, 23 nt, Homo sapiens
ucuuaagacgugauuuugcugua

SEQ ID NO: 684216 - RNA, 22 nt, Homo sapiens
ucuuaagcuuccgccgucucaa

SEQ ID NO: 684217 - RNA, 22 nt, Homo sapiens
ucuuaaguggucuagucaagga

SEQ ID NO: 684218 - RNA, 16 nt, Homo sapiens
ucuuaauagcuauaca

SEQ ID NO: 684219 - RNA, 21 nt, Homo sapiens
ucuuaaucauuauccuucuaa

SEQ ID NO: 684220 - RNA, 20 nt, Homo sapiens
ucuuaaugaaccuuagaaag

SEQ ID NO: 684221 - RNA, 21 nt, Homo sapiens
ucuuaaugacauuucacugau

SEQ ID NO: 684222 - RNA, 18 nt, Homo sapiens
ucuuaauguacacauugc

SEQ ID NO: 684223 - RNA, 14 nt, Homo sapiens
ucuuaauucuuagc

SEQ ID NO: 684224 - RNA, 18 nt, Homo sapiens
ucuuacaaaggugaaaau

SEQ ID NO: 684225 - RNA, 23 nt, Homo sapiens
ucuuacaacaggcuuaugaauau

SEQ ID NO: 684226 - RNA, 16 nt, Homo sapiens
ucuuacaauugcacug

SEQ ID NO: 684227 - RNA, 17 nt, Homo sapiens
ucuuacauaugauccag

SEQ ID NO: 684228 - RNA, 23 nt, Homo sapiens
ucuuaccagaucuaauauugacu

SEQ ID NO: 684229 - RNA, 22 nt, Homo sapiens
ucuuacccgaaagcaucacugc

SEQ ID NO: 684230 - RNA, 19 nt, Homo sapiens
ucuuaccuguaugucucca

SEQ ID NO: 684231 - RNA, 19 nt, Homo sapiens
ucuuacguggagagugcac

SEQ ID NO: 684232 - RNA, 14 nt, Homo sapiens
ucuuacuacacuga

SEQ ID NO: 684233 - RNA, 13 nt, Homo sapiens
ucuuacucugaaa

SEQ ID NO: 684234 - RNA, 19 nt, Homo sapiens
ucuuacugaaguucaguga

SEQ ID NO: 684235 - RNA, 22 nt, Homo sapiens
ucuuacugcaggcaagugggau

SEQ ID NO: 684236 - RNA, 23 nt, Homo sapiens
ucuuacuguaccuguuccuuaga

SEQ ID NO: 684237 - RNA, 13 nt, Homo sapiens
ucuuagaagccau

SEQ ID NO: 684238 - RNA, 14 nt, Homo sapiens
ucuuagaagccaug

SEQ ID NO: 684239 - RNA, 16 nt, Homo sapiens
ucuuagauauucacua

SEQ ID NO: 684240 - RNA, 21 nt, Homo sapiens
ucuuagcagcuuccagauuga

SEQ ID NO: 684241 - RNA, 20 nt, Homo sapiens
ucuuagccccagacucuuca

SEQ ID NO: 684242 - RNA, 11 nt, Homo sapiens
ucuuagcucau

SEQ ID NO: 684243 - RNA, 18 nt, Homo sapiens
ucuuagcucuaccgggag

SEQ ID NO: 684244 - RNA, 17 nt, Homo sapiens
ucuuagcugucugcuca

SEQ ID NO: 684245 - RNA, 17 nt, Homo sapiens
ucuuagcuuacaggaag

SEQ ID NO: 684246 - RNA, 15 nt, Homo sapiens
ucuuaggcaugugcu

SEQ ID NO: 684247 - RNA, 15 nt, Homo sapiens
ucuuagugcaaaaaa

SEQ ID NO: 684248 - RNA, 15 nt, Homo sapiens
ucuuaguguaugauu

SEQ ID NO: 684249 - RNA, 22 nt, Homo sapiens
ucuuaguguaugauuacuggcc

SEQ ID NO: 684250 - RNA, 13 nt, Homo sapiens
ucuuagugucacu

SEQ ID NO: 684251 - RNA, 14 nt, Homo sapiens
ucuuaguuugcagu

SEQ ID NO: 684252 - RNA, 11 nt, Homo sapiens
ucuuaucauuu

SEQ ID NO: 684253 - RNA, 20 nt, Homo sapiens
ucuuaucuuugcucccugca

SEQ ID NO: 684254 - RNA, 18 nt, Homo sapiens
ucuuauuaaucauacaaa

SEQ ID NO: 684255 - RNA, 19 nt, Homo sapiens
ucuuauucccaaacuacag

SEQ ID NO: 684256 - RNA, 18 nt, Homo sapiens
ucuuauucucacuccacc

SEQ ID NO: 684257 - RNA, 22 nt, Homo sapiens
ucuuauucuuucuaaacuacaa

SEQ ID NO: 684258 - RNA, 21 nt, Homo sapiens
ucuuauuuauaccucaguuug

SEQ ID NO: 684259 - RNA, 15 nt, Homo sapiens
ucuucaaaugucuaa

SEQ ID NO: 684260 - RNA, 17 nt, Homo sapiens
ucuucaaccucauugac

SEQ ID NO: 684261 - RNA, 20 nt, Homo sapiens
ugaccuugcacaaacagccc

SEQ ID NO: 684262 - RNA, 15 nt, Homo sapiens
ugaccuuugaccucg

SEQ ID NO: 684263 - RNA, 17 nt, Homo sapiens
ugacgaagacgccaaaa

SEQ ID NO: 684264 - RNA, 15 nt, Homo sapiens
ugacgacaagugcug

SEQ ID NO: 684265 - RNA, 20 nt, Homo sapiens
ugacgacagugcauuugccu

SEQ ID NO: 684266 - RNA, 19 nt, Homo sapiens
ugacgacauacaugcuacu

SEQ ID NO: 684267 - RNA, 15 nt, Homo sapiens
ugacgacgacaacga

SEQ ID NO: 684268 - RNA, 17 nt, Homo sapiens
ugacgauguucuguaca

SEQ ID NO: 684269 - RNA, 18 nt, Homo sapiens
ugacgcacagcacuccug

SEQ ID NO: 684270 - RNA, 17 nt, Homo sapiens
ugacgcaccacugccaa

SEQ ID NO: 684271 - RNA, 12 nt, Homo sapiens
ugacgcuggaag

SEQ ID NO: 684272 - RNA, 18 nt, Homo sapiens
ugacgcuugugacagugc

SEQ ID NO: 684273 - RNA, 15 nt, Homo sapiens
ugacggcaccaucug

SEQ ID NO: 684274 - RNA, 21 nt, Homo sapiens
ugacggcgcccccagugugca

SEQ ID NO: 684275 - RNA, 20 nt, Homo sapiens
ugacggucccacacugguga

SEQ ID NO: 684276 - RNA, 17 nt, Homo sapiens
ugacguguuucuugaac

SEQ ID NO: 684277 - RNA, 22 nt, Homo sapiens
ugacguuguugucauuguccag

SEQ ID NO: 684278 - RNA, 12 nt, Homo sapiens
ugacuaaagcua

SEQ ID NO: 684279 - RNA, 19 nt, Homo sapiens
ugacuaaagguuaccuguu

SEQ ID NO: 684280 - RNA, 19 nt, Homo sapiens
ugacuaauuaggcaaggcu

SEQ ID NO: 684281 - RNA, 17 nt, Homo sapiens
ugacuagaacaacuuga

SEQ ID NO: 684282 - RNA, 19 nt, Homo sapiens
ugacucaacauguuacuga

SEQ ID NO: 684283 - RNA, 15 nt, Homo sapiens
ugacucauggcagcu

SEQ ID NO: 684284 - RNA, 14 nt, Homo sapiens
ugacuccauucaaa

SEQ ID NO: 684285 - RNA, 18 nt, Homo sapiens
ugacucccaaguuuccau

SEQ ID NO: 684286 - RNA, 23 nt, Homo sapiens
ugacucccaaguuuccauagcaa

SEQ ID NO: 684287 - RNA, 19 nt, Homo sapiens
ugacucccagaucagucag

SEQ ID NO: 684288 - RNA, 16 nt, Homo sapiens
ugacuccuccaaggaa

SEQ ID NO: 684289 - RNA, 20 nt, Homo sapiens
ugacucgacaccgugucacc

SEQ ID NO: 684290 - RNA, 14 nt, Homo sapiens
ugacucugacucau

SEQ ID NO: 684291 - RNA, 21 nt, Homo sapiens
ugacucuggcaaagcuuuuag

SEQ ID NO: 684292 - RNA, 18 nt, Homo sapiens
ugacucuuagccccagac

SEQ ID NO: 684293 - RNA, 14 nt, Homo sapiens
ugacugaaacauuc

SEQ ID NO: 684294 - RNA, 19 nt, Homo sapiens
ugacugaauucugccuugg

SEQ ID NO: 684295 - RNA, 21 nt, Homo sapiens
ugacugaauuugggccucuug

SEQ ID NO: 684296 - RNA, 16 nt, Homo sapiens
ugacugagauggagug

SEQ ID NO: 684297 - RNA, 20 nt, Homo sapiens
ugacugauagcuuacacuga

SEQ ID NO: 684298 - RNA, 22 nt, Homo sapiens
ugacugauagcuuacacugagg

SEQ ID NO: 684299 - RNA, 18 nt, Homo sapiens
ugacugauguuacaucac

SEQ ID NO: 684300 - RNA, 20 nt, Homo sapiens
ugacugcauugaaaugcaau

SEQ ID NO: 684301 - RNA, 16 nt, Homo sapiens
ugacugccacccacac

SEQ ID NO: 684302 - RNA, 18 nt, Homo sapiens
ugacugcccggcacagau

SEQ ID NO: 684303 - RNA, 18 nt, Homo sapiens
ugacugccggucauuuga

SEQ ID NO: 684304 - RNA, 23 nt, Homo sapiens
ugacugccugcagaagucccaag

SEQ ID NO: 684305 - RNA, 17 nt, Homo sapiens
ugacugcugcuccccac

SEQ ID NO: 684306 - RNA, 13 nt, Homo sapiens
ugacugcugugaa

SEQ ID NO: 684307 - RNA, 23 nt, Homo sapiens
ugacuggcagggcuuugggcagu

SEQ ID NO: 684308 - RNA, 14 nt, Homo sapiens
ugacugggccuccc

SEQ ID NO: 684309 - RNA, 16 nt, Homo sapiens
ugacuggggagucuga

SEQ ID NO: 684310 - RNA, 12 nt, Homo sapiens
ugacuguaucug

SEQ ID NO: 684311 - RNA, 17 nt, Homo sapiens
ugacuguccaagugcca

SEQ ID NO: 684312 - RNA, 16 nt, Homo sapiens
ugacugugaccaccuu

SEQ ID NO: 684313 - RNA, 19 nt, Homo sapiens
ugacugugauuagaucaca

SEQ ID NO: 684314 - RNA, 10 nt, Homo sapiens
ugacuguugc

SEQ ID NO: 684315 - RNA, 19 nt, Homo sapiens
ugacuuaacagaacucaac

SEQ ID NO: 684316 - RNA, 15 nt, Homo sapiens
ugacuuaagcugccu

SEQ ID NO: 684317 - RNA, 19 nt, Homo sapiens
ugacuuagcgucaagacau

SEQ ID NO: 684318 - RNA, 18 nt, Homo sapiens
ugacuuaguugcguuaca

SEQ ID NO: 684319 - RNA, 17 nt, Homo sapiens
ugacuuauuaggacuuu

SEQ ID NO: 684320 - RNA, 14 nt, Homo sapiens
ugacuucacuguau

SEQ ID NO: 684321 - RNA, 18 nt, Homo sapiens
ugacuucauuugugccac

SEQ ID NO: 684322 - RNA, 18 nt, Homo sapiens
ugacuuccccacugcucu

SEQ ID NO: 684323 - RNA, 15 nt, Homo sapiens
ugacuuccugccaug

SEQ ID NO: 684324 - RNA, 15 nt, Homo sapiens
ugacuuccuuacuaa

SEQ ID NO: 684325 - RNA, 14 nt, Homo sapiens
ugacuugcaauaaa

SEQ ID NO: 684326 - RNA, 16 nt, Homo sapiens
ugacuuguuacaugaa

SEQ ID NO: 684327 - RNA, 21 nt, Homo sapiens
ugacuuuauguuguaugauuc

SEQ ID NO: 684328 - RNA, 12 nt, Homo sapiens
ugacuuugccaa

SEQ ID NO: 684329 - RNA, 13 nt, Homo sapiens
ugacuuugccaaa

SEQ ID NO: 684330 - RNA, 23 nt, Homo sapiens
ugacuuugcccccuugcccauca

SEQ ID NO: 684331 - RNA, 20 nt, Homo sapiens
ugacuuugggcaagccaagu

SEQ ID NO: 684332 - RNA, 15 nt, Homo sapiens
ugacuuuuaauguca

SEQ ID NO: 684333 - RNA, 14 nt, Homo sapiens
ucccccaaccucag

SEQ ID NO: 684334 - RNA, 15 nt, Homo sapiens
ucccccaaugucuuc

SEQ ID NO: 684335 - RNA, 15 nt, Homo sapiens
ucccccacagccacu

SEQ ID NO: 684336 - RNA, 12 nt, Homo sapiens
ucccccacugau

SEQ ID NO: 684337 - RNA, 22 nt, Homo sapiens
ucccccagaaaagaaagcuaca

SEQ ID NO: 684338 - RNA, 14 nt, Homo sapiens
ucccccagagugcu

SEQ ID NO: 684339 - RNA, 15 nt, Homo sapiens
ucccccagcacagau

SEQ ID NO: 684340 - RNA, 19 nt, Homo sapiens
ucccccagcgucaguuuca

SEQ ID NO: 684341 - RNA, 17 nt, Homo sapiens
ucccccaguauguccuu

SEQ ID NO: 684342 - RNA, 19 nt, Homo sapiens
ucccccauggaaacugccc

SEQ ID NO: 684343 - RNA, 17 nt, Homo sapiens
ucccccgccuccaguca

SEQ ID NO: 684344 - RNA, 23 nt, Homo sapiens
ucccccgugacagugacggcugc

SEQ ID NO: 684345 - RNA, 18 nt, Homo sapiens
ucccccucccaguacuag

SEQ ID NO: 684346 - RNA, 22 nt, Homo sapiens
ucccccuggggcuucuccugac

SEQ ID NO: 684347 - RNA, 19 nt, Homo sapiens
ucccccuuucacacuggau

SEQ ID NO: 684348 - RNA, 23 nt, Homo sapiens
uccccgauugaaagaaccagaga

SEQ ID NO: 684349 - RNA, 14 nt, Homo sapiens
uccccgcuggcuca

SEQ ID NO: 684350 - RNA, 13 nt, Homo sapiens
uccccgugccaaa

SEQ ID NO: 684351 - RNA, 22 nt, Homo sapiens
uccccuaacccccaguccucac

SEQ ID NO: 684352 - RNA, 15 nt, Homo sapiens
uccccuacagaauuu

SEQ ID NO: 684353 - RNA, 22 nt, Homo sapiens
uccccuagcuuuccccagacac

SEQ ID NO: 684354 - RNA, 18 nt, Homo sapiens
uccccucaacccuugaga

SEQ ID NO: 684355 - RNA, 16 nt, Homo sapiens
uccccucagagugcaa

SEQ ID NO: 684356 - RNA, 17 nt, Homo sapiens
uccccucagagugcaag

SEQ ID NO: 684357 - RNA, 14 nt, Homo sapiens
uccccucagauucc

SEQ ID NO: 684358 - RNA, 16 nt, Homo sapiens
uccccucagauuccac

SEQ ID NO: 684359 - RNA, 15 nt, Homo sapiens
uccccucagccucuu

SEQ ID NO: 684360 - RNA, 13 nt, Homo sapiens
uccccuccacugu

SEQ ID NO: 684361 - RNA, 13 nt, Homo sapiens
uccccucccagau

SEQ ID NO: 684362 - RNA, 17 nt, Homo sapiens
uccccucccuguauaag

SEQ ID NO: 684363 - RNA, 12 nt, Homo sapiens
uccccuccgcca

SEQ ID NO: 684364 - RNA, 17 nt, Homo sapiens
uccccuccgucugugac

SEQ ID NO: 684365 - RNA, 18 nt, Homo sapiens
uccccuccuugggcacuu

SEQ ID NO: 684366 - RNA, 16 nt, Homo sapiens
uccccucucaccucau

SEQ ID NO: 684367 - RNA, 15 nt, Homo sapiens
uccccucucugcugc

SEQ ID NO: 684368 - RNA, 17 nt, Homo sapiens
uccccugacagggccag

SEQ ID NO: 684369 - RNA, 20 nt, Homo sapiens
uccccugacagggccagugc

SEQ ID NO: 684370 - RNA, 15 nt, Homo sapiens
uccccugaccuguga

SEQ ID NO: 684371 - RNA, 22 nt, Homo sapiens
uccccugcccccuguacauuug

SEQ ID NO: 684372 - RNA, 12 nt, Homo sapiens
uccccugcugaa

SEQ ID NO: 684373 - RNA, 21 nt, Homo sapiens
uccccuggggagucugggcac

SEQ ID NO: 684374 - RNA, 22 nt, Homo sapiens
uccccuggggagucugggcaca

SEQ ID NO: 684375 - RNA, 22 nt, Homo sapiens
uccccuggggguuucaccuggg

SEQ ID NO: 684376 - RNA, 16 nt, Homo sapiens
uccccuggugguggaa

SEQ ID NO: 684377 - RNA, 12 nt, Homo sapiens
uccccugucagu

SEQ ID NO: 684378 - RNA, 15 nt, Homo sapiens
uccccugucccacca

SEQ ID NO: 684379 - RNA, 12 nt, Homo sapiens
ucuggcucucau

SEQ ID NO: 684380 - RNA, 13 nt, Homo sapiens
ucuggcugcacag

SEQ ID NO: 684381 - RNA, 14 nt, Homo sapiens
ucuggcuuugcucu

SEQ ID NO: 684382 - RNA, 19 nt, Homo sapiens
ucugggaaucaacagcaua

SEQ ID NO: 684383 - RNA, 15 nt, Homo sapiens
ucugggagucacaca

SEQ ID NO: 684384 - RNA, 20 nt, Homo sapiens
ucugggauuaagggcaaauc

SEQ ID NO: 684385 - RNA, 16 nt, Homo sapiens
ucugggcacugggaau

SEQ ID NO: 684386 - RNA, 12 nt, Homo sapiens
ucugggccagug

SEQ ID NO: 684387 - RNA, 21 nt, Homo sapiens
ucuggggaggcaggcauuccu

SEQ ID NO: 684388 - RNA, 15 nt, Homo sapiens
ucuggggcaucagcc

SEQ ID NO: 684389 - RNA, 15 nt, Homo sapiens
ucuggggcucaagca

SEQ ID NO: 684390 - RNA, 20 nt, Homo sapiens
ucugggggacagagaaggcg

SEQ ID NO: 684391 - RNA, 22 nt, Homo sapiens
ucugggguccauucucugaguc

SEQ ID NO: 684392 - RNA, 13 nt, Homo sapiens
ucuggggugcuaa

SEQ ID NO: 684393 - RNA, 13 nt, Homo sapiens
ucugggucuacca

SEQ ID NO: 684394 - RNA, 20 nt, Homo sapiens
ucugguaguuguggcuuuua

SEQ ID NO: 684395 - RNA, 18 nt, Homo sapiens
ucugguauucacagaaag

SEQ ID NO: 684396 - RNA, 22 nt, Homo sapiens
ucugguccaggcccuguggcag

SEQ ID NO: 684397 - RNA, 16 nt, Homo sapiens
ucuggucgcuccugcc

SEQ ID NO: 684398 - RNA, 19 nt, Homo sapiens
ucuggucuaguuaaccuag

SEQ ID NO: 684399 - RNA, 12 nt, Homo sapiens
ucuggucuucca

SEQ ID NO: 684400 - RNA, 17 nt, Homo sapiens
ucuggugccccuuugcc

SEQ ID NO: 684401 - RNA, 17 nt, Homo sapiens
ucuggugcuuucuguca

SEQ ID NO: 684402 - RNA, 21 nt, Homo sapiens
ucugguuugaaagaugcagug

SEQ ID NO: 684403 - RNA, 22 nt, Homo sapiens
ucugguuuuaggaaacuuguag

SEQ ID NO: 684404 - RNA, 23 nt, Homo sapiens
ucuguaaaaagaucccugagauu

SEQ ID NO: 684405 - RNA, 16 nt, Homo sapiens
ucuguaaacuguguau

SEQ ID NO: 684406 - RNA, 12 nt, Homo sapiens
ucuguaaauacu

SEQ ID NO: 684407 - RNA, 16 nt, Homo sapiens
ucuguaaguaacuuca

SEQ ID NO: 684408 - RNA, 18 nt, Homo sapiens
ucuguaaguaacuucaca

SEQ ID NO: 684409 - RNA, 19 nt, Homo sapiens
ucuguaauagugaacauau

SEQ ID NO: 684410 - RNA, 18 nt, Homo sapiens
ucuguaaucaaacugcaa

SEQ ID NO: 684411 - RNA, 22 nt, Homo sapiens
ucuguaccacacuagaauucau

SEQ ID NO: 684412 - RNA, 16 nt, Homo sapiens
ucuguacuaaaguauu

SEQ ID NO: 684413 - RNA, 16 nt, Homo sapiens
ucuguagccuccuuug

SEQ ID NO: 684414 - RNA, 18 nt, Homo sapiens
ucuguagcuuucuggaau

SEQ ID NO: 684415 - RNA, 17 nt, Homo sapiens
ucuguaggaaacccaac

SEQ ID NO: 684416 - RNA, 13 nt, Homo sapiens
ucuguagggauuu

SEQ ID NO: 684417 - RNA, 18 nt, Homo sapiens
ucuguaggugucucuggg

SEQ ID NO: 684418 - RNA, 15 nt, Homo sapiens
ucuguaguaaacuau

SEQ ID NO: 684419 - RNA, 13 nt, Homo sapiens
ucuguauucuugc

SEQ ID NO: 684420 - RNA, 21 nt, Homo sapiens
ucuguauugggguacaggaau

SEQ ID NO: 684421 - RNA, 15 nt, Homo sapiens
ucugucaaaaaucaa

SEQ ID NO: 684422 - RNA, 18 nt, Homo sapiens
ucugucacaaagggacuu

SEQ ID NO: 684423 - RNA, 14 nt, Homo sapiens
ucugucaccagcua

SEQ ID NO: 684424 - RNA, 21 nt, Homo sapiens
ucugucaccagcuaucuguca

SEQ ID NO: 684425 - RNA, 18 nt, Homo sapiens
ucugucacguucuccaca

SEQ ID NO: 684426 - RNA, 14 nt, Homo sapiens
ucugucagcugcaa

SEQ ID NO: 684427 - RNA, 17 nt, Homo sapiens
ucugucagucacagcca

SEQ ID NO: 684428 - RNA, 15 nt, Homo sapiens
ucugucauaugcaga

SEQ ID NO: 684429 - RNA, 17 nt, Homo sapiens
ucugucauccucaggaa

SEQ ID NO: 684430 - RNA, 15 nt, Homo sapiens
ucugucauuuacaca

SEQ ID NO: 684431 - RNA, 23 nt, Homo sapiens
ucuguccaucugucuguccuacc

SEQ ID NO: 684432 - RNA, 16 nt, Homo sapiens
ucuguccauuuaucca

SEQ ID NO: 684433 - RNA, 20 nt, Homo sapiens
ucugucccauucccugggau

SEQ ID NO: 684434 - RNA, 23 nt, Homo sapiens
ucugucccuuaauaaaaauauau

SEQ ID NO: 684435 - RNA, 18 nt, Homo sapiens
ucuguccguuuacuccaa

SEQ ID NO: 684436 - RNA, 15 nt, Homo sapiens
ucuguccuaccucca

SEQ ID NO: 684437 - RNA, 20 nt, Homo sapiens
ucuguccugauuucuacaac

SEQ ID NO: 684438 - RNA, 21 nt, Homo sapiens
ucuguccuggaggcacuggga

SEQ ID NO: 684439 - RNA, 15 nt, Homo sapiens
ucugucuaccuggga

SEQ ID NO: 684440 - RNA, 14 nt, Homo sapiens
ucugucuacugugg

SEQ ID NO: 684441 - RNA, 13 nt, Homo sapiens
ucugucugcauuu

SEQ ID NO: 684442 - RNA, 14 nt, Homo sapiens
ucugucuguggcaa

SEQ ID NO: 684443 - RNA, 21 nt, Homo sapiens
ucugucuucagcuguacauac

SEQ ID NO: 684444 - RNA, 14 nt, Homo sapiens
ucugucuuguucau

SEQ ID NO: 684445 - RNA, 14 nt, Homo sapiens
ucugugaagaaaga

SEQ ID NO: 684446 - RNA, 19 nt, Homo sapiens
ucugugaagaaagagguua

SEQ ID NO: 684447 - RNA, 23 nt, Homo sapiens
ucugugacauacauauuaucuca

SEQ ID NO: 684448 - RNA, 22 nt, Homo sapiens
ucugugcaaauccuugauacug

SEQ ID NO: 684449 - RNA, 22 nt, Homo sapiens
ucugugcagagaugacugucca

SEQ ID NO: 684450 - RNA, 23 nt, Homo sapiens
ucugugcagagaugacuguccaa

SEQ ID NO: 684451 - RNA, 16 nt, Homo sapiens
ucugugcagucacugg

SEQ ID NO: 684452 - RNA, 18 nt, Homo sapiens
ucugugcagucacuggag

SEQ ID NO: 684453 - RNA, 16 nt, Homo sapiens
ucugugccccaugccu

SEQ ID NO: 684454 - RNA, 18 nt, Homo sapiens
ucugugcccuacucauug

SEQ ID NO: 684455 - RNA, 16 nt, Homo sapiens
ucuguggagguggaaa

SEQ ID NO: 684456 - RNA, 19 nt, Homo sapiens
ucuguggauuggccuuuaa

SEQ ID NO: 684457 - RNA, 17 nt, Homo sapiens
ucuguggcacucagaua

SEQ ID NO: 684458 - RNA, 13 nt, Homo sapiens
ucuguggccacuc

SEQ ID NO: 684459 - RNA, 12 nt, Homo sapiens
ucuguggucaca

SEQ ID NO: 684460 - RNA, 16 nt, Homo sapiens
ucuguggucacaguga

SEQ ID NO: 684461 - RNA, 23 nt, Homo sapiens
ucuguguacacaucuauucucaa

SEQ ID NO: 684462 - RNA, 23 nt, Homo sapiens
ucuguguagucaauaaaaugaac

SEQ ID NO: 684463 - RNA, 21 nt, Homo sapiens
ucugugucagcgggugcacca

SEQ ID NO: 684464 - RNA, 17 nt, Homo sapiens
ucugugugcguggcgug

SEQ ID NO: 684465 - RNA, 12 nt, Homo sapiens
ucuguguggcag

SEQ ID NO: 684466 - RNA, 14 nt, Homo sapiens
ucuguguuaggggu

SEQ ID NO: 684467 - RNA, 15 nt, Homo sapiens
ucuguguuaggggua

SEQ ID NO: 684468 - RNA, 18 nt, Homo sapiens
ucuguguucccagaggca

SEQ ID NO: 684469 - RNA, 18 nt, Homo sapiens
ucuguguugaagcacugu

SEQ ID NO: 684470 - RNA, 18 nt, Homo sapiens
ucuguguuuuauugacau

SEQ ID NO: 684471 - RNA, 20 nt, Homo sapiens
ucuguguuuuugaaauauua

SEQ ID NO: 684472 - RNA, 17 nt, Homo sapiens
ucuguuaacucuugaag

SEQ ID NO: 684473 - RNA, 15 nt, Homo sapiens
ucuguuaaucaugua

SEQ ID NO: 684474 - RNA, 14 nt, Homo sapiens
ucuguuaccagagg

SEQ ID NO: 684475 - RNA, 19 nt, Homo sapiens
ucuguuaccaugucacugu

SEQ ID NO: 684476 - RNA, 17 nt, Homo sapiens
ucuguuaucgaacacau

SEQ ID NO: 684477 - RNA, 14 nt, Homo sapiens
ucuguuauguacua

SEQ ID NO: 684478 - RNA, 17 nt, Homo sapiens
ucuguucaaagcugccu

SEQ ID NO: 684479 - RNA, 16 nt, Homo sapiens
ucuguuccagucacau

SEQ ID NO: 684480 - RNA, 17 nt, Homo sapiens
ucuguucugcacacagc

SEQ ID NO: 684481 - RNA, 16 nt, Homo sapiens
ucuguucuugaagcag

SEQ ID NO: 684482 - RNA, 17 nt, Homo sapiens
ucuguugaaaagcacac

SEQ ID NO: 684483 - RNA, 23 nt, Homo sapiens
ucuguugaauuauguuuugacac

SEQ ID NO: 684484 - RNA, 15 nt, Homo sapiens
ucuguugauugauga

SEQ ID NO: 684485 - RNA, 23 nt, Homo sapiens
ucuguugcaagccccucuuucug

SEQ ID NO: 684486 - RNA, 18 nt, Homo sapiens
ucuguugguccacugugu

SEQ ID NO: 684487 - RNA, 15 nt, Homo sapiens
ucuguugucauugcu

SEQ ID NO: 684488 - RNA, 17 nt, Homo sapiens
ucuguugucauugcugu

SEQ ID NO: 684489 - RNA, 14 nt, Homo sapiens
ucuguuuaacauuu

SEQ ID NO: 684490 - RNA, 16 nt, Homo sapiens
ucuguuucaggcuucc

SEQ ID NO: 684491 - RNA, 17 nt, Homo sapiens
ucuguuugcguacuugu

SEQ ID NO: 684492 - RNA, 16 nt, Homo sapiens
ucuguuuggaucuaua

SEQ ID NO: 684493 - RNA, 17 nt, Homo sapiens
ucuguuugucugaacaa

SEQ ID NO: 684494 - RNA, 14 nt, Homo sapiens
ucuguuuuaucuuc

SEQ ID NO: 684495 - RNA, 21 nt, Homo sapiens
ucuguuuuuuaaaugaucaug

SEQ ID NO: 684496 - RNA, 21 nt, Homo sapiens
ucuguuuuuucagucugugaa

SEQ ID NO: 684497 - RNA, 17 nt, Homo sapiens
ucuuaaaaaacauauau

SEQ ID NO: 684498 - RNA, 18 nt, Homo sapiens
ucuuaaaacacuuuucaa

SEQ ID NO: 684499 - RNA, 17 nt, Homo sapiens
ucuuaaaaguacuuuaa

SEQ ID NO: 684500 - RNA, 21 nt, Homo sapiens
ucuuaaacuaaaugugcaaua

SEQ ID NO: 684501 - RNA, 23 nt, Homo sapiens
ucuuaaagcauuucaggccagug

SEQ ID NO: 684502 - RNA, 23 nt, Homo sapiens
uccggcugaaggcugaguguccg

SEQ ID NO: 684503 - RNA, 14 nt, Homo sapiens
uccgggaacuggag

SEQ ID NO: 684504 - RNA, 22 nt, Homo sapiens
uccgggaagugagggcucacuc

SEQ ID NO: 684505 - RNA, 13 nt, Homo sapiens
uccguacauucaa

SEQ ID NO: 684506 - RNA, 15 nt, Homo sapiens
uccguagacuguuua

SEQ ID NO: 684507 - RNA, 20 nt, Homo sapiens
uccguggcacugcauacaau

SEQ ID NO: 684508 - RNA, 20 nt, Homo sapiens
uccguucaauaagcauuuca

SEQ ID NO: 684509 - RNA, 15 nt, Homo sapiens
uccuaaaaaguucca

SEQ ID NO: 684510 - RNA, 21 nt, Homo sapiens
uccuaaaauuauggaaacaga

SEQ ID NO: 684511 - RNA, 23 nt, Homo sapiens
uccuaaagaaaaauaucuuggcc

SEQ ID NO: 684512 - RNA, 24 nt, Homo sapiens
uccuaaagaaaaauaucuuggccu

SEQ ID NO: 684513 - RNA, 22 nt, Homo sapiens
uccuaaauauccaaagacugua

SEQ ID NO: 684514 - RNA, 15 nt, Homo sapiens
uccuaacugugauuu

SEQ ID NO: 684515 - RNA, 17 nt, Homo sapiens
uccuaagacacaaaugc

SEQ ID NO: 684516 - RNA, 17 nt, Homo sapiens
uccuaagcaacuaggcc

SEQ ID NO: 684517 - RNA, 15 nt, Homo sapiens
uccuaagccauaaaa

SEQ ID NO: 684518 - RNA, 12 nt, Homo sapiens
uccuaaggcaug

SEQ ID NO: 684519 - RNA, 16 nt, Homo sapiens
uccuaagguccaacaa

SEQ ID NO: 684520 - RNA, 21 nt, Homo sapiens
uccuaauaucaaaugcaguau

SEQ ID NO: 684521 - RNA, 15 nt, Homo sapiens
uccuaauaugcuuua

SEQ ID NO: 684522 - RNA, 22 nt, Homo sapiens
uccuaauauuuuguucugcaaa

SEQ ID NO: 684523 - RNA, 22 nt, Homo sapiens
uccuaaucuuaucaauucugau

SEQ ID NO: 684524 - RNA, 18 nt, Homo sapiens
uccuaauuccacagcugc

SEQ ID NO: 684525 - RNA, 14 nt, Homo sapiens
uccuacaagcuaaa

SEQ ID NO: 684526 - RNA, 13 nt, Homo sapiens
uccuacacuugag

SEQ ID NO: 684527 - RNA, 19 nt, Homo sapiens
uccuacagcacuacugggu

SEQ ID NO: 684528 - RNA, 17 nt, Homo sapiens
uccuacagccagcagca

SEQ ID NO: 684529 - RNA, 22 nt, Homo sapiens
uccuacagcccuuuguacuuca

SEQ ID NO: 684530 - RNA, 17 nt, Homo sapiens
uccuaccccuuugcacu

SEQ ID NO: 684531 - RNA, 14 nt, Homo sapiens
uccuacccuuccag

SEQ ID NO: 684532 - RNA, 19 nt, Homo sapiens
uccuaccugcugcugcuau

SEQ ID NO: 684533 - RNA, 20 nt, Homo sapiens
uccuaccuguuuugugguca

SEQ ID NO: 684534 - RNA, 18 nt, Homo sapiens
uccuacuguaugugggaa

SEQ ID NO: 684535 - RNA, 15 nt, Homo sapiens
uccuagaaguucagu

SEQ ID NO: 684536 - RNA, 16 nt, Homo sapiens
uccuagcaaccuccac

SEQ ID NO: 684537 - RNA, 19 nt, Homo sapiens
uccuagccaacaucgugaa

SEQ ID NO: 684538 - RNA, 22 nt, Homo sapiens
uccuagccccucucucacacau

SEQ ID NO: 684539 - RNA, 19 nt, Homo sapiens
uccuagccuuauccucuga

SEQ ID NO: 684540 - RNA, 19 nt, Homo sapiens
uccuagcucucccagugaa

SEQ ID NO: 684541 - RNA, 17 nt, Homo sapiens
uccuagcugugugaaua

SEQ ID NO: 684542 - RNA, 18 nt, Homo sapiens
uccuagguccucugaggc

SEQ ID NO: 684543 - RNA, 23 nt, Homo sapiens
uccuagugggccauuaaaaacua

SEQ ID NO: 684544 - RNA, 15 nt, Homo sapiens
uccuauaagcuuaaa

SEQ ID NO: 684545 - RNA, 13 nt, Homo sapiens
uccuauacucuau

SEQ ID NO: 684546 - RNA, 14 nt, Homo sapiens
uccuauauauagau

SEQ ID NO: 684547 - RNA, 12 nt, Homo sapiens
uccuaucugugu

SEQ ID NO: 684548 - RNA, 23 nt, Homo sapiens
uccuauggaauguaaagugcaau

SEQ ID NO: 684549 - RNA, 12 nt, Homo sapiens
uccuauguguaa

SEQ ID NO: 684550 - RNA, 15 nt, Homo sapiens
uccuauuaagacuua

SEQ ID NO: 684551 - RNA, 15 nt, Homo sapiens
uccuauucccuguca

SEQ ID NO: 684552 - RNA, 20 nt, Homo sapiens
uccuauuuaugaaaaccaua

SEQ ID NO: 684553 - RNA, 17 nt, Homo sapiens
uccucaaaccacuugcc

SEQ ID NO: 684554 - RNA, 22 nt, Homo sapiens
uccucaauucaauguggugaug

SEQ ID NO: 684555 - RNA, 21 nt, Homo sapiens
uccucacacacccugagguca

SEQ ID NO: 684556 - RNA, 14 nt, Homo sapiens
uccucaccacuucc

SEQ ID NO: 684557 - RNA, 19 nt, Homo sapiens
uccucacccaucaaaagca

SEQ ID NO: 684558 - RNA, 20 nt, Homo sapiens
uccucagauccccagcuuuc

SEQ ID NO: 684559 - RNA, 21 nt, Homo sapiens
uccucagcugccaagcacucg

SEQ ID NO: 684560 - RNA, 22 nt, Homo sapiens
uccucaggaaauuagauaaaua

SEQ ID NO: 684561 - RNA, 24 nt, Homo sapiens
uccucagggacagagacaccugca

SEQ ID NO: 684562 - RNA, 16 nt, Homo sapiens
uccucaguaacauuuc

SEQ ID NO: 684563 - RNA, 16 nt, Homo sapiens
uccucaguuucucaaa

SEQ ID NO: 684564 - RNA, 13 nt, Homo sapiens
uccucauguacau

SEQ ID NO: 684565 - RNA, 22 nt, Homo sapiens
uccuccaacaccaagcacagca

SEQ ID NO: 684566 - RNA, 12 nt, Homo sapiens
uccuccaacagc

SEQ ID NO: 684567 - RNA, 14 nt, Homo sapiens
uccuccaagcuauu

SEQ ID NO: 684568 - RNA, 15 nt, Homo sapiens
uccuccaagcucacg

SEQ ID NO: 684569 - RNA, 18 nt, Homo sapiens
uccuccacagugcugcuu

SEQ ID NO: 684570 - RNA, 16 nt, Homo sapiens
uccuccacucacucca

SEQ ID NO: 684571 - RNA, 12 nt, Homo sapiens
uccuccagacaa

SEQ ID NO: 684572 - RNA, 12 nt, Homo sapiens
uccuccaucacc

SEQ ID NO: 684573 - RNA, 12 nt, Homo sapiens
uccucccaacaa

SEQ ID NO: 684574 - RNA, 15 nt, Homo sapiens
uccuccccucuugag

SEQ ID NO: 684575 - RNA, 15 nt, Homo sapiens
uccugucaccaucaa

SEQ ID NO: 684576 - RNA, 14 nt, Homo sapiens
uccugucacugagc

SEQ ID NO: 684577 - RNA, 19 nt, Homo sapiens
uccugucuaauuugcaccu

SEQ ID NO: 684578 - RNA, 15 nt, Homo sapiens
uccugucugcccuag

SEQ ID NO: 684579 - RNA, 20 nt, Homo sapiens
uccugugaaugccacugccu

SEQ ID NO: 684580 - RNA, 20 nt, Homo sapiens
uccugugacugucucacuua

SEQ ID NO: 684581 - RNA, 18 nt, Homo sapiens
uccugugauuuaugccaa

SEQ ID NO: 684582 - RNA, 23 nt, Homo sapiens
uccugugcggugucaccaugagc

SEQ ID NO: 684583 - RNA, 18 nt, Homo sapiens
uccuguggagacacugag

SEQ ID NO: 684584 - RNA, 18 nt, Homo sapiens
uccugugggagaucuuca

SEQ ID NO: 684585 - RNA, 19 nt, Homo sapiens
uccugugguuuuauuacaa

SEQ ID NO: 684586 - RNA, 18 nt, Homo sapiens
uccuguugaagacuuccu

SEQ ID NO: 684587 - RNA, 22 nt, Homo sapiens
uccuguuugaaagccucugcgu

SEQ ID NO: 684588 - RNA, 23 nt, Homo sapiens
uccuguuuguugagugcacugac

SEQ ID NO: 684589 - RNA, 23 nt, Homo sapiens
uccuguuuucuuaggcacugagg

SEQ ID NO: 684590 - RNA, 17 nt, Homo sapiens
uccuguuuuucugggug

SEQ ID NO: 684591 - RNA, 14 nt, Homo sapiens
uccuuaaaaacugg

SEQ ID NO: 684592 - RNA, 21 nt, Homo sapiens
uccuuaaaacaauucugugac

SEQ ID NO: 684593 - RNA, 21 nt, Homo sapiens
uccuuaaauuuuuagccauuu

SEQ ID NO: 684594 - RNA, 20 nt, Homo sapiens
uccuuaauagccauaugcaa

SEQ ID NO: 684595 - RNA, 23 nt, Homo sapiens
uccuuaauuuaauugcuuugaag

SEQ ID NO: 684596 - RNA, 13 nt, Homo sapiens
uccuuacuccauc

SEQ ID NO: 684597 - RNA, 22 nt, Homo sapiens
uccuuaggaaaaacaugagcau

SEQ ID NO: 684598 - RNA, 14 nt, Homo sapiens
uccuuaggccucug

SEQ ID NO: 684599 - RNA, 17 nt, Homo sapiens
uccuuaggccucugaga

SEQ ID NO: 684600 - RNA, 17 nt, Homo sapiens
uccuuaggugugagguc

SEQ ID NO: 684601 - RNA, 13 nt, Homo sapiens
uccuuagugccag

SEQ ID NO: 684602 - RNA, 15 nt, Homo sapiens
uccuuaucacugaca

SEQ ID NO: 684603 - RNA, 20 nt, Homo sapiens
uccuuaugacuccauucaaa

SEQ ID NO: 684604 - RNA, 18 nt, Homo sapiens
uccuuauuguuaaaaaca

SEQ ID NO: 684605 - RNA, 19 nt, Homo sapiens
uccuucaacuggcuacuga

SEQ ID NO: 684606 - RNA, 15 nt, Homo sapiens
uccuucaaucuucau

SEQ ID NO: 684607 - RNA, 23 nt, Homo sapiens
uccuucacaggcagugcauguga

SEQ ID NO: 684608 - RNA, 22 nt, Homo sapiens
uccuucagaauuaaaauacuua

SEQ ID NO: 684609 - RNA, 21 nt, Homo sapiens
uccuucauuaaugaugaucuu

SEQ ID NO: 684610 - RNA, 16 nt, Homo sapiens
uccuuccaauuuggaa

SEQ ID NO: 684611 - RNA, 18 nt, Homo sapiens
uccuucccccucacugaa

SEQ ID NO: 684612 - RNA, 22 nt, Homo sapiens
uccuucccucaaagaggccuua

SEQ ID NO: 684613 - RNA, 14 nt, Homo sapiens
uccuucccugaugg

SEQ ID NO: 684614 - RNA, 18 nt, Homo sapiens
uccuucccuucuuugcug

SEQ ID NO: 684615 - RNA, 23 nt, Homo sapiens
uccuuccugcuugaguucccaga

SEQ ID NO: 684616 - RNA, 14 nt, Homo sapiens
uccuuccuucccug

SEQ ID NO: 684617 - RNA, 19 nt, Homo sapiens
uccuucuaauuuuucagcu

SEQ ID NO: 684618 - RNA, 16 nt, Homo sapiens
uccuucucaucuguga

SEQ ID NO: 684619 - RNA, 21 nt, Homo sapiens
uccuucugccuaacuuguaaa

SEQ ID NO: 684620 - RNA, 15 nt, Homo sapiens
uccuucugcuggaua

SEQ ID NO: 684621 - RNA, 18 nt, Homo sapiens
uccuucugucuccagggc

SEQ ID NO: 684622 - RNA, 16 nt, Homo sapiens
uccuugaccugcauug

SEQ ID NO: 684623 - RNA, 16 nt, Homo sapiens
uccuugcacauaguag

SEQ ID NO: 684624 - RNA, 18 nt, Homo sapiens
uccuugcccccauuucac

SEQ ID NO: 684625 - RNA, 21 nt, Homo sapiens
uccuugccuucgcauggcugg

SEQ ID NO: 684626 - RNA, 11 nt, Homo sapiens
uccuugcugca

SEQ ID NO: 684627 - RNA, 22 nt, Homo sapiens
ucauauuggacugauaaucucu

SEQ ID NO: 684628 - RNA, 15 nt, Homo sapiens
ucauauugugccaau

SEQ ID NO: 684629 - RNA, 14 nt, Homo sapiens
ucauauuuugccac

SEQ ID NO: 684630 - RNA, 12 nt, Homo sapiens
ucaucaaaaaga

SEQ ID NO: 684631 - RNA, 17 nt, Homo sapiens
ucaucaaaaagaacaac

SEQ ID NO: 684632 - RNA, 14 nt, Homo sapiens
ucaucaaaaagccu

SEQ ID NO: 684633 - RNA, 18 nt, Homo sapiens
ucaucaacagugagagac

SEQ ID NO: 684634 - RNA, 19 nt, Homo sapiens
ucaucaacuuauuauauga

SEQ ID NO: 684635 - RNA, 13 nt, Homo sapiens
ucaucaccccaga

SEQ ID NO: 684636 - RNA, 20 nt, Homo sapiens
ucaucacgacacauuugccu

SEQ ID NO: 684637 - RNA, 13 nt, Homo sapiens
ucaucacuuugac

SEQ ID NO: 684638 - RNA, 20 nt, Homo sapiens
ucaucagaauccuuggcuga

SEQ ID NO: 684639 - RNA, 19 nt, Homo sapiens
ucaucagcauuuggaccaa

SEQ ID NO: 684640 - RNA, 21 nt, Homo sapiens
ucaucagccuguguaggcagu

SEQ ID NO: 684641 - RNA, 18 nt, Homo sapiens
ucaucagcuuugugccac

SEQ ID NO: 684642 - RNA, 14 nt, Homo sapiens
ucaucaggugcaua

SEQ ID NO: 684643 - RNA, 23 nt, Homo sapiens
ucaucaggugcauagcaagugaa

SEQ ID NO: 684644 - RNA, 19 nt, Homo sapiens
ucaucaguaaaguaccuuu

SEQ ID NO: 684645 - RNA, 23 nt, Homo sapiens
ucaucaguguccucuugcucaaa

SEQ ID NO: 684646 - RNA, 21 nt, Homo sapiens
ucaucauaaaauaaaguauau

SEQ ID NO: 684647 - RNA, 19 nt, Homo sapiens
ucaucauauuguauguaag

SEQ ID NO: 684648 - RNA, 19 nt, Homo sapiens
ucaucaucgaagucuuccc

SEQ ID NO: 684649 - RNA, 11 nt, Homo sapiens
ucaucaugcuu

SEQ ID NO: 684650 - RNA, 19 nt, Homo sapiens
ucaucauggaggucauaca

SEQ ID NO: 684651 - RNA, 12 nt, Homo sapiens
ucaucauucccu

SEQ ID NO: 684652 - RNA, 16 nt, Homo sapiens
ucaucauucccucuca

SEQ ID NO: 684653 - RNA, 18 nt, Homo sapiens
ucaucauucucugucuca

SEQ ID NO: 684654 - RNA, 17 nt, Homo sapiens
ucaucauuucagccaaa

SEQ ID NO: 684655 - RNA, 12 nt, Homo sapiens
ucaucauuugca

SEQ ID NO: 684656 - RNA, 15 nt, Homo sapiens
ucauccaaagaacau

SEQ ID NO: 684657 - RNA, 14 nt, Homo sapiens
ucauccaacuuaug

SEQ ID NO: 684658 - RNA, 17 nt, Homo sapiens
ucauccaggacugagau

SEQ ID NO: 684659 - RNA, 21 nt, Homo sapiens
ucauccaggacugagaugcaa

SEQ ID NO: 684660 - RNA, 15 nt, Homo sapiens
ucauccaggccucag

SEQ ID NO: 684661 - RNA, 14 nt, Homo sapiens
ucauccaugcacuu

SEQ ID NO: 684662 - RNA, 23 nt, Homo sapiens
ucauccccacagcuggcucugac

SEQ ID NO: 684663 - RNA, 17 nt, Homo sapiens
ucauccccucucaggag

SEQ ID NO: 684664 - RNA, 11 nt, Homo sapiens
ucauccuccau

SEQ ID NO: 684665 - RNA, 12 nt, Homo sapiens
ucauccuggcac

SEQ ID NO: 684666 - RNA, 21 nt, Homo sapiens
ucauccuuggucuaugugcuc

SEQ ID NO: 684667 - RNA, 14 nt, Homo sapiens
ucaucguggcuguu

SEQ ID NO: 684668 - RNA, 20 nt, Homo sapiens
ucaucuaaauauuuccauau

SEQ ID NO: 684669 - RNA, 13 nt, Homo sapiens
ucaucuauaguug

SEQ ID NO: 684670 - RNA, 11 nt, Homo sapiens
ucaucucauga

SEQ ID NO: 684671 - RNA, 15 nt, Homo sapiens
ucaucucucuaccuc

SEQ ID NO: 684672 - RNA, 14 nt, Homo sapiens
ucaucucuuuauuc

SEQ ID NO: 684673 - RNA, 13 nt, Homo sapiens
ucaucugacucau

SEQ ID NO: 684674 - RNA, 17 nt, Homo sapiens
ucaucugcaugucuacu

SEQ ID NO: 684675 - RNA, 18 nt, Homo sapiens
ucaucuucacugcaauuu

SEQ ID NO: 684676 - RNA, 18 nt, Homo sapiens
ucaucuuccuguguccug

SEQ ID NO: 684677 - RNA, 13 nt, Homo sapiens
ucaucuucuggaa

SEQ ID NO: 684678 - RNA, 15 nt, Homo sapiens
ucaucuugcuaccag

SEQ ID NO: 684679 - RNA, 19 nt, Homo sapiens
ucaucuuggucacauacaa

SEQ ID NO: 684680 - RNA, 15 nt, Homo sapiens
ucaugaaacugucca

SEQ ID NO: 684681 - RNA, 21 nt, Homo sapiens
ucaugaagcagauuugcacug

SEQ ID NO: 684682 - RNA, 17 nt, Homo sapiens
ucaugaagcccaaguga

SEQ ID NO: 684683 - RNA, 13 nt, Homo sapiens
ucaugaagccuug

SEQ ID NO: 684684 - RNA, 20 nt, Homo sapiens
ucaugaauauauuaaucagc

SEQ ID NO: 684685 - RNA, 16 nt, Homo sapiens
ucaugacacuauacag

SEQ ID NO: 684686 - RNA, 14 nt, Homo sapiens
ucaugagcaaguga

SEQ ID NO: 684687 - RNA, 14 nt, Homo sapiens
ucaugagccugcug

SEQ ID NO: 684688 - RNA, 17 nt, Homo sapiens
ucaugagccugcuggaa

SEQ ID NO: 684689 - RNA, 20 nt, Homo sapiens
ucaugauguauuguugcuuu

SEQ ID NO: 684690 - RNA, 16 nt, Homo sapiens
ucaugauuuggcaugg

SEQ ID NO: 684691 - RNA, 18 nt, Homo sapiens
ucaugcaaacugcuuuau

SEQ ID NO: 684692 - RNA, 19 nt, Homo sapiens
ucaugcauguccuguaaag

SEQ ID NO: 684693 - RNA, 10 nt, Homo sapiens
ucaugcauuu

SEQ ID NO: 684694 - RNA, 14 nt, Homo sapiens
ucaugccacugcac

SEQ ID NO: 684695 - RNA, 19 nt, Homo sapiens
ucaugccauugcauuccag

SEQ ID NO: 684696 - RNA, 18 nt, Homo sapiens
ucaugccgacgcuugcac

SEQ ID NO: 684697 - RNA, 17 nt, Homo sapiens
ucaugccuguaaucuca

SEQ ID NO: 684698 - RNA, 21 nt, Homo sapiens
ucaugccuucacgugucuguu

SEQ ID NO: 684699 - RNA, 16 nt, Homo sapiens
ucaugcggacccucac

SEQ ID NO: 684700 - RNA, 22 nt, Homo sapiens
ucaugcuggaaccugcaaaaaa

SEQ ID NO: 684701 - RNA, 22 nt, Homo sapiens
ucaugcuuaauaaacaugucac

SEQ ID NO: 684702 - RNA, 14 nt, Homo sapiens
ucaugcuucacuua

SEQ ID NO: 684703 - RNA, 14 nt, Homo sapiens
ucaugcuugacaua

SEQ ID NO: 684704 - RNA, 20 nt, Homo sapiens
ucaugcuuuuucagccaugu

SEQ ID NO: 684705 - RNA, 19 nt, Homo sapiens
ucauggaaguggcagugaa

SEQ ID NO: 684706 - RNA, 14 nt, Homo sapiens
ucauggagaccuca

SEQ ID NO: 684707 - RNA, 16 nt, Homo sapiens
ucauggauuauguuga

SEQ ID NO: 684708 - RNA, 19 nt, Homo sapiens
ucauggauucauuacagcu

SEQ ID NO: 684709 - RNA, 17 nt, Homo sapiens
ucauggcaccaaagcca

SEQ ID NO: 684710 - RNA, 19 nt, Homo sapiens
ucaugggaaggggaggacc

SEQ ID NO: 684711 - RNA, 21 nt, Homo sapiens
ucaugggagcaugcuuaccuu

SEQ ID NO: 684712 - RNA, 23 nt, Homo sapiens
ucauggggugggguuggggcaaa

SEQ ID NO: 684713 - RNA, 22 nt, Homo sapiens
ucaugguauuugaccauuuuag

SEQ ID NO: 684714 - RNA, 18 nt, Homo sapiens
ucauguaccucugauuaa

SEQ ID NO: 684715 - RNA, 17 nt, Homo sapiens
ucauguauaguuuuccc

SEQ ID NO: 684716 - RNA, 16 nt, Homo sapiens
ucaugucuugugcaua

SEQ ID NO: 684717 - RNA, 15 nt, Homo sapiens
ucaugugauaacuga

SEQ ID NO: 684718 - RNA, 15 nt, Homo sapiens
ucaugugcucagaag

SEQ ID NO: 684719 - RNA, 19 nt, Homo sapiens
ucaugugcugccugcaagc

SEQ ID NO: 684720 - RNA, 22 nt, Homo sapiens
ucauguggcucagugccuuccu

SEQ ID NO: 684721 - RNA, 16 nt, Homo sapiens
ucaugugguacuugag

SEQ ID NO: 684722 - RNA, 14 nt, Homo sapiens
ucaugugugcaugu

SEQ ID NO: 684723 - RNA, 14 nt, Homo sapiens
ucauguuacuuccc

SEQ ID NO: 684724 - RNA, 15 nt, Homo sapiens
ucauguuccucaaaa

SEQ ID NO: 684725 - RNA, 23 nt, Homo sapiens
ucauguucucuucccaggccuuu

SEQ ID NO: 684726 - RNA, 16 nt, Homo sapiens
ucauuaagaagcuggg

SEQ ID NO: 684727 - RNA, 15 nt, Homo sapiens
ucauuaauauaugga

SEQ ID NO: 684728 - RNA, 13 nt, Homo sapiens
ucauuacaguucu

SEQ ID NO: 684729 - RNA, 14 nt, Homo sapiens
ucauuacaguucuu

SEQ ID NO: 684730 - RNA, 12 nt, Homo sapiens
ucauuaccaaua

SEQ ID NO: 684731 - RNA, 23 nt, Homo sapiens
ucauuaccacgccuugaccuucc

SEQ ID NO: 684732 - RNA, 13 nt, Homo sapiens
ucauuagcaguug

SEQ ID NO: 684733 - RNA, 17 nt, Homo sapiens
ucauuagcauuuugcua

SEQ ID NO: 684734 - RNA, 20 nt, Homo sapiens
ucauuaggcaaaguacaaaa

SEQ ID NO: 684735 - RNA, 16 nt, Homo sapiens
ucauuaucacagugaa

SEQ ID NO: 684736 - RNA, 14 nt, Homo sapiens
ucauuaugccacuu

SEQ ID NO: 684737 - RNA, 16 nt, Homo sapiens
ucauuaugcuuugaac

SEQ ID NO: 684738 - RNA, 22 nt, Homo sapiens
ucauuauuccucagauugcuga

SEQ ID NO: 684739 - RNA, 22 nt, Homo sapiens
ucauuauucuuuuucaguuuua

SEQ ID NO: 684740 - RNA, 14 nt, Homo sapiens
uuucaccacuccuc

SEQ ID NO: 684741 - RNA, 22 nt, Homo sapiens
uuucaccauauugcccagggug

SEQ ID NO: 684742 - RNA, 15 nt, Homo sapiens
uuucaccauguuggc

SEQ ID NO: 684743 - RNA, 13 nt, Homo sapiens
uuucacgaacugu

SEQ ID NO: 684744 - RNA, 22 nt, Homo sapiens
uuucacuaggaaaaucaugugc

SEQ ID NO: 684745 - RNA, 18 nt, Homo sapiens
ugggggagggaagaccag

SEQ ID NO: 684746 - RNA, 19 nt, Homo sapiens
ugggggagguccaagcaga

SEQ ID NO: 684747 - RNA, 20 nt, Homo sapiens
ugggggagugugaguuuugc

SEQ ID NO: 684748 - RNA, 15 nt, Homo sapiens
ugggggcacugacca

SEQ ID NO: 684749 - RNA, 17 nt, Homo sapiens
ugggggccaugagcucc

SEQ ID NO: 684750 - RNA, 23 nt, Homo sapiens
ugggggcuaagguuuccagucag

SEQ ID NO: 684751 - RNA, 17 nt, Homo sapiens
ugggggguuuucuugcc

SEQ ID NO: 684752 - RNA, 20 nt, Homo sapiens
ugggggguuuucuugccuug

SEQ ID NO: 684753 - RNA, 11 nt, Homo sapiens
ugggggucccu

SEQ ID NO: 684754 - RNA, 13 nt, Homo sapiens
uggggguguagua

SEQ ID NO: 684755 - RNA, 23 nt, Homo sapiens
ugggguacuggaguuagaucucu

SEQ ID NO: 684756 - RNA, 21 nt, Homo sapiens
ugggguaggcugucugugcca

SEQ ID NO: 684757 - RNA, 15 nt, Homo sapiens
uggggucaugcccuc

SEQ ID NO: 684758 - RNA, 21 nt, Homo sapiens
uggggucuuugugguagcuua

SEQ ID NO: 684759 - RNA, 19 nt, Homo sapiens
uggggugcauccuccucag

SEQ ID NO: 684760 - RNA, 17 nt, Homo sapiens
ugggguggccaccagua

SEQ ID NO: 684761 - RNA, 17 nt, Homo sapiens
uggggugggacagggag

SEQ ID NO: 684762 - RNA, 16 nt, Homo sapiens
uggggugggcacauug

SEQ ID NO: 684763 - RNA, 14 nt, Homo sapiens
ugggguggggucau

SEQ ID NO: 684764 - RNA, 19 nt, Homo sapiens
ugggguucgagacuccauc

SEQ ID NO: 684765 - RNA, 12 nt, Homo sapiens
ugggguucucag

SEQ ID NO: 684766 - RNA, 11 nt, Homo sapiens
ugggguugagg

SEQ ID NO: 684767 - RNA, 16 nt, Homo sapiens
ugggguuucaccauau

SEQ ID NO: 684768 - RNA, 17 nt, Homo sapiens
ugggguuucaccauauu

SEQ ID NO: 684769 - RNA, 16 nt, Homo sapiens
ugggguuucaccaucu

SEQ ID NO: 684770 - RNA, 17 nt, Homo sapiens
uggguaaaugcuuuuaa

SEQ ID NO: 684771 - RNA, 21 nt, Homo sapiens
uggguaaugugaaggcccaag

SEQ ID NO: 684772 - RNA, 14 nt, Homo sapiens
uggguacaaaaagu

SEQ ID NO: 684773 - RNA, 16 nt, Homo sapiens
uggguacaaaaaguca

SEQ ID NO: 684774 - RNA, 19 nt, Homo sapiens
uggguacugaaagccuuag

SEQ ID NO: 684775 - RNA, 23 nt, Homo sapiens
uggguacugaaagccuuagggaa

SEQ ID NO: 684776 - RNA, 22 nt, Homo sapiens
uggguauaaaggcuaaaaggga

SEQ ID NO: 684777 - RNA, 16 nt, Homo sapiens
uggguaugcucuguga

SEQ ID NO: 684778 - RNA, 18 nt, Homo sapiens
uggguaugcucugugaca

SEQ ID NO: 684779 - RNA, 17 nt, Homo sapiens
ugggucaaaccaagaag

SEQ ID NO: 684780 - RNA, 18 nt, Homo sapiens
ugggucaaguacaccagc

SEQ ID NO: 684781 - RNA, 19 nt, Homo sapiens
ugggucacucauuaaugaa

SEQ ID NO: 684782 - RNA, 17 nt, Homo sapiens
ugggucagguucuugcc

SEQ ID NO: 684783 - RNA, 13 nt, Homo sapiens
ugggucaugugca

SEQ ID NO: 684784 - RNA, 15 nt, Homo sapiens
uggguccaugcuaac

SEQ ID NO: 684785 - RNA, 22 nt, Homo sapiens
uggguccucgcugcuggcugcu

SEQ ID NO: 684786 - RNA, 17 nt, Homo sapiens
ugggucucagcugcuga

SEQ ID NO: 684787 - RNA, 13 nt, Homo sapiens
ugggucugagcug

SEQ ID NO: 684788 - RNA, 14 nt, Homo sapiens
ugggucuucaagga

SEQ ID NO: 684789 - RNA, 15 nt, Homo sapiens
ugggucuucccugua

SEQ ID NO: 684790 - RNA, 20 nt, Homo sapiens
ugggugaauaauacaguauc

SEQ ID NO: 684791 - RNA, 13 nt, Homo sapiens
ugggugacaggau

SEQ ID NO: 684792 - RNA, 13 nt, Homo sapiens
ugggugacauuug

SEQ ID NO: 684793 - RNA, 16 nt, Homo sapiens
uggguggaaaggugug

SEQ ID NO: 684794 - RNA, 18 nt, Homo sapiens
ugggugucagucagggac

SEQ ID NO: 684795 - RNA, 17 nt, Homo sapiens
uggguuagcuaaaccaa

SEQ ID NO: 684796 - RNA, 20 nt, Homo sapiens
uggguuagcuaaaccaagaa

SEQ ID NO: 684797 - RNA, 20 nt, Homo sapiens
uggguuauucagaaccuaaa

SEQ ID NO: 684798 - RNA, 23 nt, Homo sapiens
uggguucacagaagcacagcacc

SEQ ID NO: 684799 - RNA, 15 nt, Homo sapiens
uggguucacuugcca

SEQ ID NO: 684800 - RNA, 12 nt, Homo sapiens
uggguuccagag

SEQ ID NO: 684801 - RNA, 17 nt, Homo sapiens
uggguucuccuguucuc

SEQ ID NO: 684802 - RNA, 21 nt, Homo sapiens
uggguuggugcacagugauuu

SEQ ID NO: 684803 - RNA, 14 nt, Homo sapiens
uggguuugguuaga

SEQ ID NO: 684804 - RNA, 12 nt, Homo sapiens
uggguuuuacca

SEQ ID NO: 684805 - RNA, 18 nt, Homo sapiens
ugguaaaacucacuguga

SEQ ID NO: 684806 - RNA, 19 nt, Homo sapiens
ugguaaaccaagccuccca

SEQ ID NO: 684807 - RNA, 16 nt, Homo sapiens
guugcuuuuuuuccaa

SEQ ID NO: 684808 - RNA, 14 nt, Homo sapiens
guuggaagcuuguu

SEQ ID NO: 684809 - RNA, 21 nt, Homo sapiens
guuggacuguaagggauugaa

SEQ ID NO: 684810 - RNA, 16 nt, Homo sapiens
guuggagcuacugcaa

SEQ ID NO: 684811 - RNA, 20 nt, Homo sapiens
guuggaugaugaaacauuca

SEQ ID NO: 684812 - RNA, 18 nt, Homo sapiens
guuggaugggagugggca

SEQ ID NO: 684813 - RNA, 18 nt, Homo sapiens
guuggccaggcuguucuc

SEQ ID NO: 684814 - RNA, 13 nt, Homo sapiens
guugggaccucag

SEQ ID NO: 684815 - RNA, 15 nt, Homo sapiens
guugggagcacugga

SEQ ID NO: 684816 - RNA, 17 nt, Homo sapiens
guugggcuagauuacag

SEQ ID NO: 684817 - RNA, 23 nt, Homo sapiens
guugggggcaguguuguggcccu

SEQ ID NO: 684818 - RNA, 15 nt, Homo sapiens
guugguaaaggguua

SEQ ID NO: 684819 - RNA, 16 nt, Homo sapiens
guugguagagcccuca

SEQ ID NO: 684820 - RNA, 18 nt, Homo sapiens
guuggucaggcgcagugg

SEQ ID NO: 684821 - RNA, 22 nt, Homo sapiens
guuggucaugugggucuuccag

SEQ ID NO: 684822 - RNA, 15 nt, Homo sapiens
guugguccacugugu

SEQ ID NO: 684823 - RNA, 12 nt, Homo sapiens
guuggucuugaa

SEQ ID NO: 684824 - RNA, 16 nt, Homo sapiens
guuggugacaccucac

SEQ ID NO: 684825 - RNA, 18 nt, Homo sapiens
guuguagaaauuaacaaa

SEQ ID NO: 684826 - RNA, 16 nt, Homo sapiens
guuguauaaagcaaaa

SEQ ID NO: 684827 - RNA, 23 nt, Homo sapiens
guugucaaacugaaauucagagc

SEQ ID NO: 684828 - RNA, 19 nt, Homo sapiens
guuguccccgcuggcucac

SEQ ID NO: 684829 - RNA, 19 nt, Homo sapiens
guuguccugcccuguggaa

SEQ ID NO: 684830 - RNA, 19 nt, Homo sapiens
guugucucugaugcagcuu

SEQ ID NO: 684831 - RNA, 15 nt, Homo sapiens
guugugagcuuugaa

SEQ ID NO: 684832 - RNA, 12 nt, Homo sapiens
guugugccaaau

SEQ ID NO: 684833 - RNA, 14 nt, Homo sapiens
guuguguagucaag

SEQ ID NO: 684834 - RNA, 16 nt, Homo sapiens
guuguguggacuuuga

SEQ ID NO: 684835 - RNA, 16 nt, Homo sapiens
guuguguucuguugaa

SEQ ID NO: 684836 - RNA, 19 nt, Homo sapiens
guuguuaauaaaaguacau

SEQ ID NO: 684837 - RNA, 19 nt, Homo sapiens
guuguuaaugaaaauguca

SEQ ID NO: 684838 - RNA, 17 nt, Homo sapiens
guuguucuguggucaca

SEQ ID NO: 684839 - RNA, 15 nt, Homo sapiens
guuguugacugugau

SEQ ID NO: 684840 - RNA, 13 nt, Homo sapiens
guuguuguuguug

SEQ ID NO: 684841 - RNA, 11 nt, Homo sapiens
guuguuugcaa

SEQ ID NO: 684842 - RNA, 14 nt, Homo sapiens
guuguuuguuugau

SEQ ID NO: 684843 - RNA, 24 nt, Homo sapiens
guuguuuucagacucagacuccau

SEQ ID NO: 684844 - RNA, 14 nt, Homo sapiens
guuguuuucugacu

SEQ ID NO: 684845 - RNA, 20 nt, Homo sapiens
guuuaaaaagaaaaaaugca

SEQ ID NO: 684846 - RNA, 19 nt, Homo sapiens
guuuaaaguggcaaucuca

SEQ ID NO: 684847 - RNA, 13 nt, Homo sapiens
guuuaacauucac

SEQ ID NO: 684848 - RNA, 14 nt, Homo sapiens
guuuaacauuugcc

SEQ ID NO: 684849 - RNA, 22 nt, Homo sapiens
guuuaagccugcggcgccagcc

SEQ ID NO: 684850 - RNA, 14 nt, Homo sapiens
guuuaaucagcgau

SEQ ID NO: 684851 - RNA, 20 nt, Homo sapiens
guuuacagacgcugcuguca

SEQ ID NO: 684852 - RNA, 15 nt, Homo sapiens
guuuacagcacuacu

SEQ ID NO: 684853 - RNA, 16 nt, Homo sapiens
guuuacagcacuacuc

SEQ ID NO: 684854 - RNA, 17 nt, Homo sapiens
guuuacagcacuacucu

SEQ ID NO: 684855 - RNA, 14 nt, Homo sapiens
guuuacaguggaau

SEQ ID NO: 684856 - RNA, 20 nt, Homo sapiens
guuuacaguuuguguuuuaa

SEQ ID NO: 684857 - RNA, 15 nt, Homo sapiens
guuuaccacuaacuc

SEQ ID NO: 684858 - RNA, 21 nt, Homo sapiens
guuuagacaguaugagucaau

SEQ ID NO: 684859 - RNA, 21 nt, Homo sapiens
guuuagagcauuucuuuugaa

SEQ ID NO: 684860 - RNA, 22 nt, Homo sapiens
guuuagaucugucccuuaauaa

SEQ ID NO: 684861 - RNA, 18 nt, Homo sapiens
guuuagcccaaaaccaag

SEQ ID NO: 684862 - RNA, 16 nt, Homo sapiens
guuuaggauuacuuag

SEQ ID NO: 684863 - RNA, 15 nt, Homo sapiens
guuuaucaagccaua

SEQ ID NO: 684864 - RNA, 13 nt, Homo sapiens
guuuaugaaugac

SEQ ID NO: 684865 - RNA, 18 nt, Homo sapiens
guuuauuaaauugcaaga

SEQ ID NO: 684866 - RNA, 16 nt, Homo sapiens
guuuauuaacuacuga

SEQ ID NO: 684867 - RNA, 14 nt, Homo sapiens
guuuauuacaauuu

SEQ ID NO: 684868 - RNA, 16 nt, Homo sapiens
uggugaaaucccaucu

SEQ ID NO: 684869 - RNA, 21 nt, Homo sapiens
uggugaacaguguauaggaag

SEQ ID NO: 684870 - RNA, 20 nt, Homo sapiens
uggugaacugagcugggcag

SEQ ID NO: 684871 - RNA, 16 nt, Homo sapiens
uggugaccuuucacga

SEQ ID NO: 684872 - RNA, 11 nt, Homo sapiens
uggugacucac

SEQ ID NO: 684873 - RNA, 20 nt, Homo sapiens
uggugacugccacauaauaa

SEQ ID NO: 684874 - RNA, 12 nt, Homo sapiens
uggugacugucc

SEQ ID NO: 684875 - RNA, 18 nt, Homo sapiens
uggugaggcgaaggccag

SEQ ID NO: 684876 - RNA, 14 nt, Homo sapiens
uggugaucagugca

SEQ ID NO: 684877 - RNA, 15 nt, Homo sapiens
uggugaugguuucca

SEQ ID NO: 684878 - RNA, 24 nt, Homo sapiens
uggugauguugaaauaugcauacu

SEQ ID NO: 684879 - RNA, 14 nt, Homo sapiens
uggugcaaguugag

SEQ ID NO: 684880 - RNA, 18 nt, Homo sapiens
uggugcaaucacagcuca

SEQ ID NO: 684881 - RNA, 20 nt, Homo sapiens
uggugcaauuacagcaaaaa

SEQ ID NO: 684882 - RNA, 12 nt, Homo sapiens
uggugcagacag

SEQ ID NO: 684883 - RNA, 17 nt, Homo sapiens
uggugccaaacaaaaag

SEQ ID NO: 684884 - RNA, 22 nt, Homo sapiens
uggugccuucucacaucugucc

SEQ ID NO: 684885 - RNA, 18 nt, Homo sapiens
uggugcgucuaagaugag

SEQ ID NO: 684886 - RNA, 22 nt, Homo sapiens
uggugcuuaggcuguauauuca

SEQ ID NO: 684887 - RNA, 21 nt, Homo sapiens
uggugcuuugcgacuugucac

SEQ ID NO: 684888 - RNA, 19 nt, Homo sapiens
ugguggagaaagcacugac

SEQ ID NO: 684889 - RNA, 15 nt, Homo sapiens
ugguggagaaccaca

SEQ ID NO: 684890 - RNA, 15 nt, Homo sapiens
ugguggagcagagug

SEQ ID NO: 684891 - RNA, 18 nt, Homo sapiens
ugguggagggcacuucag

SEQ ID NO: 684892 - RNA, 23 nt, Homo sapiens
ugguggaguggagugagagcaau

SEQ ID NO: 684893 - RNA, 14 nt, Homo sapiens
ugguggcaccagau

SEQ ID NO: 684894 - RNA, 11 nt, Homo sapiens
ugguggcaugg

SEQ ID NO: 684895 - RNA, 18 nt, Homo sapiens
ugguggcauuguuuacag

SEQ ID NO: 684896 - RNA, 19 nt, Homo sapiens
ugguggcucacgccuguaa

SEQ ID NO: 684897 - RNA, 17 nt, Homo sapiens
uggugggaacauucgag

SEQ ID NO: 684898 - RNA, 14 nt, Homo sapiens
uggugggacacugg

SEQ ID NO: 684899 - RNA, 23 nt, Homo sapiens
ugguggggagcacagacacagga

SEQ ID NO: 684900 - RNA, 22 nt, Homo sapiens
uggugggggugggcgccuguag

SEQ ID NO: 684901 - RNA, 14 nt, Homo sapiens
uggugggucagggg

SEQ ID NO: 684902 - RNA, 17 nt, Homo sapiens
uggugggucuauguucc

SEQ ID NO: 684903 - RNA, 18 nt, Homo sapiens
uggugguuccgccuccag

SEQ ID NO: 684904 - RNA, 22 nt, Homo sapiens
ugguguaaagccaacacccugu

SEQ ID NO: 684905 - RNA, 13 nt, Homo sapiens
ugguguagacugu

SEQ ID NO: 684906 - RNA, 14 nt, Homo sapiens
ugguguagcacuua

SEQ ID NO: 684907 - RNA, 19 nt, Homo sapiens
ugguguagguaggucuguu

SEQ ID NO: 684908 - RNA, 21 nt, Homo sapiens
ugguguaguuucuucauuuca

SEQ ID NO: 684909 - RNA, 13 nt, Homo sapiens
uggugucaggcag

SEQ ID NO: 684910 - RNA, 14 nt, Homo sapiens
uggugucaguaucc

SEQ ID NO: 684911 - RNA, 15 nt, Homo sapiens
ugguguccagucuuu

SEQ ID NO: 684912 - RNA, 20 nt, Homo sapiens
uggugucccaguaaagccaa

SEQ ID NO: 684913 - RNA, 19 nt, Homo sapiens
uggugucuugcgccuguac

SEQ ID NO: 684914 - RNA, 20 nt, Homo sapiens
ugguguggccagcacucuga

SEQ ID NO: 684915 - RNA, 16 nt, Homo sapiens
ugguguggguguccug

SEQ ID NO: 684916 - RNA, 20 nt, Homo sapiens
ugguguuaaagcuguacacc

SEQ ID NO: 684917 - RNA, 19 nt, Homo sapiens
ugguguucaaaaaaacacu

SEQ ID NO: 684918 - RNA, 15 nt, Homo sapiens
ugguguuuuuacaga

SEQ ID NO: 684919 - RNA, 19 nt, Homo sapiens
ugguuacaaucauugcuga

SEQ ID NO: 684920 - RNA, 22 nt, Homo sapiens
ugguuauuggaaggcaagucau

SEQ ID NO: 684921 - RNA, 19 nt, Homo sapiens
ugguucacauccuaccccu

SEQ ID NO: 684922 - RNA, 16 nt, Homo sapiens
ugguucaccugaauca

SEQ ID NO: 684923 - RNA, 15 nt, Homo sapiens
ugguucagugccuuc

SEQ ID NO: 684924 - RNA, 14 nt, Homo sapiens
ugguuccaaagaca

SEQ ID NO: 684925 - RNA, 14 nt, Homo sapiens
ugguuccaugcagc

SEQ ID NO: 684926 - RNA, 12 nt, Homo sapiens
ugguuccauuuu

SEQ ID NO: 684927 - RNA, 19 nt, Homo sapiens
ugguucccccacugaucac

SEQ ID NO: 684928 - RNA, 18 nt, Homo sapiens
ugguuccuuggggggcca

SEQ ID NO: 684929 - RNA, 11 nt, Homo sapiens
ugguucugcuu

SEQ ID NO: 684930 - RNA, 22 nt, Homo sapiens
ugguugcauuugucaaagcauu

SEQ ID NO: 684931 - RNA, 17 nt, Homo sapiens
guuugauuauucagugu

SEQ ID NO: 684932 - RNA, 15 nt, Homo sapiens
guuugauucagcaaa

SEQ ID NO: 684933 - RNA, 16 nt, Homo sapiens
guuugcaaaugucagu

SEQ ID NO: 684934 - RNA, 14 nt, Homo sapiens
guuugcaccgccug

SEQ ID NO: 684935 - RNA, 20 nt, Homo sapiens
guuugcaguuggcuaagaga

SEQ ID NO: 684936 - RNA, 20 nt, Homo sapiens
guuugccacacccaggugau

SEQ ID NO: 684937 - RNA, 11 nt, Homo sapiens
guuugccaugu

SEQ ID NO: 684938 - RNA, 16 nt, Homo sapiens
guuugcuaauguuucc

SEQ ID NO: 684939 - RNA, 14 nt, Homo sapiens
guuugcucuuuuaa

SEQ ID NO: 684940 - RNA, 15 nt, Homo sapiens
guuugcuguuugcaa

SEQ ID NO: 684941 - RNA, 17 nt, Homo sapiens
guuugcuuauuguucca

SEQ ID NO: 684942 - RNA, 15 nt, Homo sapiens
guuugcuucuugcca

SEQ ID NO: 684943 - RNA, 21 nt, Homo sapiens
guuuggacccaguucagugag

SEQ ID NO: 684944 - RNA, 19 nt, Homo sapiens
guuuggagguccuagguca

SEQ ID NO: 684945 - RNA, 15 nt, Homo sapiens
guuuggccucucuau

SEQ ID NO: 684946 - RNA, 21 nt, Homo sapiens
guuugggagacugugcucucu

SEQ ID NO: 684947 - RNA, 13 nt, Homo sapiens
guuuggggagaaa

SEQ ID NO: 684948 - RNA, 13 nt, Homo sapiens
guuuggggagcag

SEQ ID NO: 684949 - RNA, 21 nt, Homo sapiens
guuugguaguuagccaucuaa

SEQ ID NO: 684950 - RNA, 22 nt, Homo sapiens
guuugucacacgauaaagggau

SEQ ID NO: 684951 - RNA, 21 nt, Homo sapiens
guuugucacgucuucugagaa

SEQ ID NO: 684952 - RNA, 20 nt, Homo sapiens
guuugucuucauguacugua

SEQ ID NO: 684953 - RNA, 19 nt, Homo sapiens
guuugugucaaaacugguu

SEQ ID NO: 684954 - RNA, 19 nt, Homo sapiens
guuuguguguugucucuug

SEQ ID NO: 684955 - RNA, 16 nt, Homo sapiens
guuuguuaccuaccuu

SEQ ID NO: 684956 - RNA, 17 nt, Homo sapiens
guuuguuauaucaggga

SEQ ID NO: 684957 - RNA, 21 nt, Homo sapiens
guuuguuucaagaaccuggaa

SEQ ID NO: 684958 - RNA, 16 nt, Homo sapiens
guuuguuucauauaua

SEQ ID NO: 684959 - RNA, 22 nt, Homo sapiens
guuuuaaaagagaagcaucauu

SEQ ID NO: 684960 - RNA, 15 nt, Homo sapiens
guuuuaaacuugccu

SEQ ID NO: 684961 - RNA, 14 nt, Homo sapiens
guuuuaaaguucau

SEQ ID NO: 684962 - RNA, 18 nt, Homo sapiens
guuuuaaauaaaccuaua

SEQ ID NO: 684963 - RNA, 21 nt, Homo sapiens
guuuuacacuaaaaaaaugca

SEQ ID NO: 684964 - RNA, 20 nt, Homo sapiens
guuuuacauuguugagcuau

SEQ ID NO: 684965 - RNA, 23 nt, Homo sapiens
guuuuaccaucugcauccagccu

SEQ ID NO: 684966 - RNA, 14 nt, Homo sapiens
guuuuacugcagcu

SEQ ID NO: 684967 - RNA, 12 nt, Homo sapiens
guuuuagaacca

SEQ ID NO: 684968 - RNA, 16 nt, Homo sapiens
guuuuagaaccagccg

SEQ ID NO: 684969 - RNA, 16 nt, Homo sapiens
guuuuauaauuugaau

SEQ ID NO: 684970 - RNA, 16 nt, Homo sapiens
guuuuauauguugcua

SEQ ID NO: 684971 - RNA, 15 nt, Homo sapiens
guuuuaugcauugau

SEQ ID NO: 684972 - RNA, 16 nt, Homo sapiens
guuuucaacacuuuuu

SEQ ID NO: 684973 - RNA, 19 nt, Homo sapiens
guuuucaagucaaauuaau

SEQ ID NO: 684974 - RNA, 14 nt, Homo sapiens
guuuucaaugugaa

SEQ ID NO: 684975 - RNA, 24 nt, Homo sapiens
guuuucacauaugacaauguugca

SEQ ID NO: 684976 - RNA, 16 nt, Homo sapiens
guuuucagucuucuga

SEQ ID NO: 684977 - RNA, 14 nt, Homo sapiens
guuuucaguggacu

SEQ ID NO: 684978 - RNA, 14 nt, Homo sapiens
guuuucaguguaca

SEQ ID NO: 684979 - RNA, 17 nt, Homo sapiens
guuuucauggugaaaau

SEQ ID NO: 684980 - RNA, 18 nt, Homo sapiens
guuuucccaaagcacuuu

SEQ ID NO: 684981 - RNA, 21 nt, Homo sapiens
guuuucccugaccucccucua

SEQ ID NO: 684982 - RNA, 19 nt, Homo sapiens
guuuuccucccuucugcua

SEQ ID NO: 684983 - RNA, 19 nt, Homo sapiens
guuuucguagguugacuau

SEQ ID NO: 684984 - RNA, 17 nt, Homo sapiens
guuuucuauuucacuaa

SEQ ID NO: 684985 - RNA, 14 nt, Homo sapiens
guuuucuucacuau

SEQ ID NO: 684986 - RNA, 20 nt, Homo sapiens
guuuugaaggcaaaauugca

SEQ ID NO: 684987 - RNA, 14 nt, Homo sapiens
guuuugacauuuac

SEQ ID NO: 684988 - RNA, 15 nt, Homo sapiens
guuuugaguaauuca

SEQ ID NO: 684989 - RNA, 13 nt, Homo sapiens
guuuugauuuauu

SEQ ID NO: 684990 - RNA, 21 nt, Homo sapiens
uguaacaauuguguagccuuu

SEQ ID NO: 684991 - RNA, 13 nt, Homo sapiens
uguaacacuuguc

SEQ ID NO: 684992 - RNA, 16 nt, Homo sapiens
uguaacaugauguuaa

SEQ ID NO: 684993 - RNA, 12 nt, Homo sapiens
uguaaccaaaaa

SEQ ID NO: 684994 - RNA, 14 nt, Homo sapiens
uguaacccgcucau

SEQ ID NO: 684995 - RNA, 16 nt, Homo sapiens
uguaaccugcugugau

SEQ ID NO: 684996 - RNA, 21 nt, Homo sapiens
uguaacugagagaaagauucu

SEQ ID NO: 684997 - RNA, 22 nt, Homo sapiens
uguaacugcucagagcuuuaaa

SEQ ID NO: 684998 - RNA, 19 nt, Homo sapiens
uguaacuguaaaacauuga

SEQ ID NO: 684999 - RNA, 14 nt, Homo sapiens
uguaacuuucauac

SEQ ID NO: 685000 - RNA, 17 nt, Homo sapiens
uguaagaaguuucuuaa

SEQ ID NO: 685001 - RNA, 16 nt, Homo sapiens
uguaagacucauuccc

SEQ ID NO: 685002 - RNA, 14 nt, Homo sapiens
uguaagacuuacaa

SEQ ID NO: 685003 - RNA, 17 nt, Homo sapiens
uguaagcaagucacuua

SEQ ID NO: 685004 - RNA, 16 nt, Homo sapiens
uguaagcauacuuugu

SEQ ID NO: 685005 - RNA, 18 nt, Homo sapiens
uguaagcauucugagcug

SEQ ID NO: 685006 - RNA, 22 nt, Homo sapiens
uguaagcucuacugaggugcua

SEQ ID NO: 685007 - RNA, 19 nt, Homo sapiens
uguaaggaauuaucaauua

SEQ ID NO: 685008 - RNA, 17 nt, Homo sapiens
uguaaggaugauuuuaa

SEQ ID NO: 685009 - RNA, 21 nt, Homo sapiens
uguaaguaauugccacagcug

SEQ ID NO: 685010 - RNA, 14 nt, Homo sapiens
uguaaguacccuga

SEQ ID NO: 685011 - RNA, 15 nt, Homo sapiens
uguaaguacuuccac

SEQ ID NO: 685012 - RNA, 13 nt, Homo sapiens
uguaagugcugcu

SEQ ID NO: 685013 - RNA, 14 nt, Homo sapiens
uguaaguuuaccua

SEQ ID NO: 685014 - RNA, 18 nt, Homo sapiens
uguaauaaaaguuuacaa

SEQ ID NO: 685015 - RNA, 13 nt, Homo sapiens
uguaauaagcaau

SEQ ID NO: 685016 - RNA, 15 nt, Homo sapiens
uguaauaagcaauca

SEQ ID NO: 685017 - RNA, 22 nt, Homo sapiens
uguaauacuuaaauaaacauga

SEQ ID NO: 685018 - RNA, 15 nt, Homo sapiens
uguaauacuuuacaa

SEQ ID NO: 685019 - RNA, 19 nt, Homo sapiens
uguaauagugaacauaugg

SEQ ID NO: 685020 - RNA, 18 nt, Homo sapiens
uguaauauuaacuaaaua

SEQ ID NO: 685021 - RNA, 19 nt, Homo sapiens
uguaauauuuacaauguau

SEQ ID NO: 685022 - RNA, 20 nt, Homo sapiens
uguaaucccaacauuuuggg

SEQ ID NO: 685023 - RNA, 17 nt, Homo sapiens
uguaaucccagcuacuc

SEQ ID NO: 685024 - RNA, 19 nt, Homo sapiens
uguaaucccagcuacuugg

SEQ ID NO: 685025 - RNA, 21 nt, Homo sapiens
uguaaucgcccuacuauucag

SEQ ID NO: 685026 - RNA, 16 nt, Homo sapiens
uguaaucucagcacuu

SEQ ID NO: 685027 - RNA, 12 nt, Homo sapiens
uguaaugaucau

SEQ ID NO: 685028 - RNA, 18 nt, Homo sapiens
uguaauggaacuuagcca

SEQ ID NO: 685029 - RNA, 13 nt, Homo sapiens
uguaauucauuga

SEQ ID NO: 685030 - RNA, 23 nt, Homo sapiens
uguaauuggaaucuucaccucag

SEQ ID NO: 685031 - RNA, 19 nt, Homo sapiens
uguaauuguuguuuguaug

SEQ ID NO: 685032 - RNA, 21 nt, Homo sapiens
uguaauuuauuaacuaaucaa

SEQ ID NO: 685033 - RNA, 16 nt, Homo sapiens
uguaauuucgccuuaa

SEQ ID NO: 685034 - RNA, 23 nt, Homo sapiens
uguaauuuuaaccaaucagauga

SEQ ID NO: 685035 - RNA, 14 nt, Homo sapiens
uguacaaagaaaua

SEQ ID NO: 685036 - RNA, 20 nt, Homo sapiens
uguacaauaaagcaaugugg

SEQ ID NO: 685037 - RNA, 20 nt, Homo sapiens
uguacaaucaugaacagcuc

SEQ ID NO: 685038 - RNA, 15 nt, Homo sapiens
uguacacaacaaucc

SEQ ID NO: 685039 - RNA, 15 nt, Homo sapiens
uguacagaacacaaa

SEQ ID NO: 685040 - RNA, 17 nt, Homo sapiens
uguacagacuucuuggu

SEQ ID NO: 685041 - RNA, 20 nt, Homo sapiens
uguacaguagauuuuccaaa

SEQ ID NO: 685042 - RNA, 19 nt, Homo sapiens
uguacaguguguaaagugu

SEQ ID NO: 685043 - RNA, 23 nt, Homo sapiens
uguacauaccuccuugcacaaau

SEQ ID NO: 685044 - RNA, 22 nt, Homo sapiens
uguacauuauaaaccuucagaa

SEQ ID NO: 685045 - RNA, 14 nt, Homo sapiens
uguacauucuucca

SEQ ID NO: 685046 - RNA, 16 nt, Homo sapiens
uguacauuuaauaaua

SEQ ID NO: 685047 - RNA, 12 nt, Homo sapiens
uguacauuucac

SEQ ID NO: 685048 - RNA, 18 nt, Homo sapiens
uguacauuucacaaaaag

SEQ ID NO: 685049 - RNA, 20 nt, Homo sapiens
uguaccaaaacauccacuua

SEQ ID NO: 685050 - RNA, 14 nt, Homo sapiens
uguaccauuugccu

SEQ ID NO: 685051 - RNA, 17 nt, Homo sapiens
uguacccccagguggaa

SEQ ID NO: 685052 - RNA, 13 nt, Homo sapiens
uguaccucagugg

SEQ ID NO: 685053 - RNA, 15 nt, Homo sapiens
uguaccugugcacgu

SEQ ID NO: 685054 - RNA, 20 nt, Homo sapiens
uguacgacacggguggggaa

SEQ ID NO: 685055 - RNA, 19 nt, Homo sapiens
uaaaaauguuacgugaaga

SEQ ID NO: 685056 - RNA, 15 nt, Homo sapiens
uaaaaauguucucaa

SEQ ID NO: 685057 - RNA, 18 nt, Homo sapiens
uaaaaauuauuugguccu

SEQ ID NO: 685058 - RNA, 23 nt, Homo sapiens
uaaaaauuguagcuuuuuauuaa

SEQ ID NO: 685059 - RNA, 20 nt, Homo sapiens
uaaaaauuuauacaccagca

SEQ ID NO: 685060 - RNA, 23 nt, Homo sapiens
uaaaaauuuuuacaaaacugcca

SEQ ID NO: 685061 - RNA, 23 nt, Homo sapiens
uaaaacaaaaucugaacucucaa

SEQ ID NO: 685062 - RNA, 22 nt, Homo sapiens
uaaaacaaaauuugacuaauuu

SEQ ID NO: 685063 - RNA, 11 nt, Homo sapiens
uaaaacaaaca

SEQ ID NO: 685064 - RNA, 15 nt, Homo sapiens
uaaaacaauacucaa

SEQ ID NO: 685065 - RNA, 19 nt, Homo sapiens
uaaaacacaccuaagagaa

SEQ ID NO: 685066 - RNA, 23 nt, Homo sapiens
uaaaacaccuuuccuuaugucuc

SEQ ID NO: 685067 - RNA, 20 nt, Homo sapiens
uaaaacagaagccugaugcu

SEQ ID NO: 685068 - RNA, 22 nt, Homo sapiens
uaaaacagccaaaacuccacag

SEQ ID NO: 685069 - RNA, 21 nt, Homo sapiens
uaaaacagguagaauuaucua

SEQ ID NO: 685070 - RNA, 22 nt, Homo sapiens
uaaaacagguuauaacaguguu

SEQ ID NO: 685071 - RNA, 18 nt, Homo sapiens
uaaaacaugcugaaaacu

SEQ ID NO: 685072 - RNA, 22 nt, Homo sapiens
uaaaacaugcugaaaacuacac

SEQ ID NO: 685073 - RNA, 15 nt, Homo sapiens
uaaaacauguacaaa

SEQ ID NO: 685074 - RNA, 15 nt, Homo sapiens
uaaaacauuuugacu

SEQ ID NO: 685075 - RNA, 22 nt, Homo sapiens
uaaaaccaacaaaaagaacaaa

SEQ ID NO: 685076 - RNA, 19 nt, Homo sapiens
uaaaaccagaaaggugauu

SEQ ID NO: 685077 - RNA, 13 nt, Homo sapiens
uaaaaccagagaa

SEQ ID NO: 685078 - RNA, 18 nt, Homo sapiens
uaaaaccugucaaugaua

SEQ ID NO: 685079 - RNA, 17 nt, Homo sapiens
uaaaacggauaccaagu

SEQ ID NO: 685080 - RNA, 20 nt, Homo sapiens
uaaaacuaaauguaauuuau

SEQ ID NO: 685081 - RNA, 18 nt, Homo sapiens
uaaaacuaaggcuuuuau

SEQ ID NO: 685082 - RNA, 17 nt, Homo sapiens
uaaaacuauauucucag

SEQ ID NO: 685083 - RNA, 21 nt, Homo sapiens
uaaaacuauuuauugugcugg

SEQ ID NO: 685084 - RNA, 18 nt, Homo sapiens
uaaaacuauuugcagaug

SEQ ID NO: 685085 - RNA, 23 nt, Homo sapiens
uaaaacucaaaacacccaaaaau

SEQ ID NO: 685086 - RNA, 16 nt, Homo sapiens
uaaaacucacugugau

SEQ ID NO: 685087 - RNA, 12 nt, Homo sapiens
uaaaacuguaua

SEQ ID NO: 685088 - RNA, 20 nt, Homo sapiens
uaaaacuuaccuuuacugaa

SEQ ID NO: 685089 - RNA, 14 nt, Homo sapiens
uaaaacuuuccaaa

SEQ ID NO: 685090 - RNA, 15 nt, Homo sapiens
uaaaagaaggaugaa

SEQ ID NO: 685091 - RNA, 21 nt, Homo sapiens
uaaaagaauaaaauugcacuu

SEQ ID NO: 685092 - RNA, 14 nt, Homo sapiens
uaaaagagccuagu

SEQ ID NO: 685093 - RNA, 15 nt, Homo sapiens
uaaaagaguuaacau

SEQ ID NO: 685094 - RNA, 23 nt, Homo sapiens
uaaaagaucuugaauagucucau

SEQ ID NO: 685095 - RNA, 20 nt, Homo sapiens
uaaaagaugguaaaccagau

SEQ ID NO: 685096 - RNA, 21 nt, Homo sapiens
uaaaagauguuuaugauguaa

SEQ ID NO: 685097 - RNA, 21 nt, Homo sapiens
uaaaagcaggagguuaucugu

SEQ ID NO: 685098 - RNA, 13 nt, Homo sapiens
uaaaagcaguuga

SEQ ID NO: 685099 - RNA, 13 nt, Homo sapiens
uaaaagcauuuug

SEQ ID NO: 685100 - RNA, 22 nt, Homo sapiens
uaaaagccccaaauggugguaa

SEQ ID NO: 685101 - RNA, 24 nt, Homo sapiens
uaaaagcggaaaguuagugcuugu

SEQ ID NO: 685102 - RNA, 21 nt, Homo sapiens
uaaaaggaaagaaaacaucuu

SEQ ID NO: 685103 - RNA, 14 nt, Homo sapiens
uaaaaggcccugug

SEQ ID NO: 685104 - RNA, 16 nt, Homo sapiens
uaaaaggcuucacuuu

SEQ ID NO: 685105 - RNA, 18 nt, Homo sapiens
uaaaagggaaagaaggcc

SEQ ID NO: 685106 - RNA, 21 nt, Homo sapiens
uaaaagggucguuaccagaga

SEQ ID NO: 685107 - RNA, 16 nt, Homo sapiens
uaaaagguaugcaauc

SEQ ID NO: 685108 - RNA, 17 nt, Homo sapiens
uaaaaguauuugcuuaa

SEQ ID NO: 685109 - RNA, 15 nt, Homo sapiens
uaaaagucuaugauc

SEQ ID NO: 685110 - RNA, 13 nt, Homo sapiens
uaaaagugcauuu

SEQ ID NO: 685111 - RNA, 18 nt, Homo sapiens
uguauacuaccauaguga

SEQ ID NO: 685112 - RNA, 16 nt, Homo sapiens
uguauacuguaggcac

SEQ ID NO: 685113 - RNA, 15 nt, Homo sapiens
uguauaguaucugua

SEQ ID NO: 685114 - RNA, 14 nt, Homo sapiens
uguauauaguauga

SEQ ID NO: 685115 - RNA, 13 nt, Homo sapiens
uguauaugcauuc

SEQ ID NO: 685116 - RNA, 22 nt, Homo sapiens
uguauaugccucauacacauaa

SEQ ID NO: 685117 - RNA, 23 nt, Homo sapiens
uguauaugccucauacacauaau

SEQ ID NO: 685118 - RNA, 20 nt, Homo sapiens
uguauauuccaccauucaca

SEQ ID NO: 685119 - RNA, 20 nt, Homo sapiens
uguauauuugagaaaacagg

SEQ ID NO: 685120 - RNA, 15 nt, Homo sapiens
uguauauuuguacaa

SEQ ID NO: 685121 - RNA, 14 nt, Homo sapiens
uguaucaucagugc

SEQ ID NO: 685122 - RNA, 12 nt, Homo sapiens
uguaucaugaca

SEQ ID NO: 685123 - RNA, 14 nt, Homo sapiens
uguauccacaaauc

SEQ ID NO: 685124 - RNA, 15 nt, Homo sapiens
uguauccacaaauca

SEQ ID NO: 685125 - RNA, 21 nt, Homo sapiens
uguauccauuaaccugggcau

SEQ ID NO: 685126 - RNA, 23 nt, Homo sapiens
uguauccccccccuguauaguua

SEQ ID NO: 685127 - RNA, 18 nt, Homo sapiens
uguaucggagacagugau

SEQ ID NO: 685128 - RNA, 17 nt, Homo sapiens
uguaucguauugagugg

SEQ ID NO: 685129 - RNA, 16 nt, Homo sapiens
uguaucuuauucacau

SEQ ID NO: 685130 - RNA, 20 nt, Homo sapiens
uguaucuuccuuucuugucu

SEQ ID NO: 685131 - RNA, 17 nt, Homo sapiens
uguaugaaaaguaacug

SEQ ID NO: 685132 - RNA, 14 nt, Homo sapiens
uguaugacagugaa

SEQ ID NO: 685133 - RNA, 14 nt, Homo sapiens
uguaugacuaaaga

SEQ ID NO: 685134 - RNA, 18 nt, Homo sapiens
uguaugcacgugugcaca

SEQ ID NO: 685135 - RNA, 19 nt, Homo sapiens
uguaugcagggagcacugu

SEQ ID NO: 685136 - RNA, 16 nt, Homo sapiens
uguaugccaagugaga

SEQ ID NO: 685137 - RNA, 20 nt, Homo sapiens
uguauggaaucccacuguau

SEQ ID NO: 685138 - RNA, 22 nt, Homo sapiens
uguauggaaucccacuguauga

SEQ ID NO: 685139 - RNA, 18 nt, Homo sapiens
uguauguacguuuguaug

SEQ ID NO: 685140 - RNA, 23 nt, Homo sapiens
uguaugugagagauucugugauc

SEQ ID NO: 685141 - RNA, 20 nt, Homo sapiens
uguaugugcgugugugcaag

SEQ ID NO: 685142 - RNA, 22 nt, Homo sapiens
uguaugugcgugugugcaagug

SEQ ID NO: 685143 - RNA, 17 nt, Homo sapiens
uguauguguggcugugg

SEQ ID NO: 685144 - RNA, 18 nt, Homo sapiens
uguauguuccucuaugaa

SEQ ID NO: 685145 - RNA, 16 nt, Homo sapiens
uguauuaauaccaaag

SEQ ID NO: 685146 - RNA, 19 nt, Homo sapiens
uguauuaauccccaucauu

SEQ ID NO: 685147 - RNA, 18 nt, Homo sapiens
uguauuacacacaguuuu

SEQ ID NO: 685148 - RNA, 23 nt, Homo sapiens
uguauucacgccauugguuggaa

SEQ ID NO: 685149 - RNA, 18 nt, Homo sapiens
uguauucagaggcaguga

SEQ ID NO: 685150 - RNA, 15 nt, Homo sapiens
uguauucgugcauuu

SEQ ID NO: 685151 - RNA, 16 nt, Homo sapiens
uguauucuucaaccuc

SEQ ID NO: 685152 - RNA, 18 nt, Homo sapiens
uguauucuucaaccucau

SEQ ID NO: 685153 - RNA, 13 nt, Homo sapiens
uguauugauucaa

SEQ ID NO: 685154 - RNA, 22 nt, Homo sapiens
uguauugcuccucccacuucuc

SEQ ID NO: 685155 - RNA, 16 nt, Homo sapiens
uguauuguucccagug

SEQ ID NO: 685156 - RNA, 11 nt, Homo sapiens
uguauuuacuu

SEQ ID NO: 685157 - RNA, 20 nt, Homo sapiens
uguauuuccagugcaauugu

SEQ ID NO: 685158 - RNA, 16 nt, Homo sapiens
uguauuuuaagugaau

SEQ ID NO: 685159 - RNA, 23 nt, Homo sapiens
uguauuuuauuacaucuuucaca

SEQ ID NO: 685160 - RNA, 16 nt, Homo sapiens
uguauuuucauaguga

SEQ ID NO: 685161 - RNA, 22 nt, Homo sapiens
uguauuuucuuacacuguguca

SEQ ID NO: 685162 - RNA, 17 nt, Homo sapiens
uguauuuuuaauagaga

SEQ ID NO: 685163 - RNA, 17 nt, Homo sapiens
ugucaaaagccagaugu

SEQ ID NO: 685164 - RNA, 16 nt, Homo sapiens
ugucaaacaguaauaa

SEQ ID NO: 685165 - RNA, 13 nt, Homo sapiens
ugucaacauuugg

SEQ ID NO: 685166 - RNA, 22 nt, Homo sapiens
ugucaagcaauggggaauacaa

SEQ ID NO: 685167 - RNA, 20 nt, Homo sapiens
ugucaagccugugcaaaaaa

SEQ ID NO: 685168 - RNA, 20 nt, Homo sapiens
ugucaagcugcucugagcca

SEQ ID NO: 685169 - RNA, 17 nt, Homo sapiens
ugucaagguccuaaagu

SEQ ID NO: 685170 - RNA, 20 nt, Homo sapiens
ugucaauaaggagcaucagc

SEQ ID NO: 685171 - RNA, 17 nt, Homo sapiens
ugucaaucacagucuca

SEQ ID NO: 685172 - RNA, 12 nt, Homo sapiens
ugucaaugauac

SEQ ID NO: 685173 - RNA, 16 nt, Homo sapiens
ugucacaaauugauca

SEQ ID NO: 685174 - RNA, 15 nt, Homo sapiens
ugucacacaaaaagu

SEQ ID NO: 685175 - RNA, 20 nt, Homo sapiens
ugucacagaugaagacauca

SEQ ID NO: 685176 - RNA, 12 nt, Homo sapiens
ugucacagccug

SEQ ID NO: 685177 - RNA, 19 nt, Homo sapiens
uaaacauuuugacacaaaa

SEQ ID NO: 685178 - RNA, 19 nt, Homo sapiens
uaaacauuuuuaaguauuu

SEQ ID NO: 685179 - RNA, 13 nt, Homo sapiens
uaaaccaccaucu

SEQ ID NO: 685180 - RNA, 13 nt, Homo sapiens
uaaaccacuaaaa

SEQ ID NO: 685181 - RNA, 16 nt, Homo sapiens
uaaaccagaggacaaa

SEQ ID NO: 685182 - RNA, 14 nt, Homo sapiens
uaaacccaagugcu

SEQ ID NO: 685183 - RNA, 22 nt, Homo sapiens
uaaacccaaucagaugccucag

SEQ ID NO: 685184 - RNA, 17 nt, Homo sapiens
uaaacccauaaguuuaa

SEQ ID NO: 685185 - RNA, 20 nt, Homo sapiens
uaaaccuagaguuuuaucaa

SEQ ID NO: 685186 - RNA, 22 nt, Homo sapiens
uaaaccucaguuauuacaugua

SEQ ID NO: 685187 - RNA, 14 nt, Homo sapiens
uaaacuacauuuua

SEQ ID NO: 685188 - RNA, 22 nt, Homo sapiens
uaaacucaagauuugaccaaau

SEQ ID NO: 685189 - RNA, 15 nt, Homo sapiens
uaaacucagaucuga

SEQ ID NO: 685190 - RNA, 12 nt, Homo sapiens
uaaacucagauu

SEQ ID NO: 685191 - RNA, 19 nt, Homo sapiens
uaaacucagcuacugcaaa

SEQ ID NO: 685192 - RNA, 14 nt, Homo sapiens
uaaacuccuacuaa

SEQ ID NO: 685193 - RNA, 12 nt, Homo sapiens
uaaacucucuag

SEQ ID NO: 685194 - RNA, 16 nt, Homo sapiens
uaaacucucuagcuua

SEQ ID NO: 685195 - RNA, 21 nt, Homo sapiens
uaaacucuguuguaaguaaua

SEQ ID NO: 685196 - RNA, 22 nt, Homo sapiens
uaaacucuguuguaaguaauaa

SEQ ID NO: 685197 - RNA, 21 nt, Homo sapiens
uaaacugaaucuauggcuuua

SEQ ID NO: 685198 - RNA, 15 nt, Homo sapiens
uaaacugacuuuauc

SEQ ID NO: 685199 - RNA, 19 nt, Homo sapiens
uaaacuggaauccuuucac

SEQ ID NO: 685200 - RNA, 14 nt, Homo sapiens
uaaacuguacagug

SEQ ID NO: 685201 - RNA, 11 nt, Homo sapiens
uaaacugugua

SEQ ID NO: 685202 - RNA, 18 nt, Homo sapiens
uaaacuuauuuacaaaua

SEQ ID NO: 685203 - RNA, 14 nt, Homo sapiens
uaaacuucagggau

SEQ ID NO: 685204 - RNA, 16 nt, Homo sapiens
uaaacuuguaaagaca

SEQ ID NO: 685205 - RNA, 17 nt, Homo sapiens
uaaacuuguuuacaaag

SEQ ID NO: 685206 - RNA, 22 nt, Homo sapiens
uaaacuuuauuuguaaaccauu

SEQ ID NO: 685207 - RNA, 16 nt, Homo sapiens
uaaagaaaaaugccug

SEQ ID NO: 685208 - RNA, 20 nt, Homo sapiens
uaaagaaaaaugccugucuc

SEQ ID NO: 685209 - RNA, 15 nt, Homo sapiens
uaaagaaaggaacua

SEQ ID NO: 685210 - RNA, 14 nt, Homo sapiens
uaaagaaguuugau

SEQ ID NO: 685211 - RNA, 15 nt, Homo sapiens
uaaagaauagcuuua

SEQ ID NO: 685212 - RNA, 19 nt, Homo sapiens
uaaagaauuuucagaugga

SEQ ID NO: 685213 - RNA, 19 nt, Homo sapiens
uaaagacaaaaaaaucacg

SEQ ID NO: 685214 - RNA, 11 nt, Homo sapiens
uaaagacagag

SEQ ID NO: 685215 - RNA, 21 nt, Homo sapiens
uaaagacagggaagagcagaa

SEQ ID NO: 685216 - RNA, 13 nt, Homo sapiens
uaaagacaggguc

SEQ ID NO: 685217 - RNA, 17 nt, Homo sapiens
uaaagacccaacuugcc

SEQ ID NO: 685218 - RNA, 19 nt, Homo sapiens
uaaagacccaacuugccaa

SEQ ID NO: 685219 - RNA, 19 nt, Homo sapiens
uaaagacgucucuuuuugg

SEQ ID NO: 685220 - RNA, 16 nt, Homo sapiens
uaaagagaguuugcca

SEQ ID NO: 685221 - RNA, 16 nt, Homo sapiens
uaaagaucacacauca

SEQ ID NO: 685222 - RNA, 16 nt, Homo sapiens
uaaagaugaucuacuc

SEQ ID NO: 685223 - RNA, 18 nt, Homo sapiens
uaaagaugaucuacucag

SEQ ID NO: 685224 - RNA, 17 nt, Homo sapiens
uaaagauuauugugacu

SEQ ID NO: 685225 - RNA, 19 nt, Homo sapiens
uaaagcacuuugcacuuaa

SEQ ID NO: 685226 - RNA, 15 nt, Homo sapiens
uaaagcauauuggug

SEQ ID NO: 685227 - RNA, 19 nt, Homo sapiens
uaaagcauuuagaaaacuu

SEQ ID NO: 685228 - RNA, 13 nt, Homo sapiens
uaaagcauuucag

SEQ ID NO: 685229 - RNA, 14 nt, Homo sapiens
uaaagccaaaguuu

SEQ ID NO: 685230 - RNA, 16 nt, Homo sapiens
uaaagccaaauuucca

SEQ ID NO: 685231 - RNA, 15 nt, Homo sapiens
uaaagccaagcacuu

SEQ ID NO: 685232 - RNA, 21 nt, Homo sapiens
uaaagccacuguaugauucuc

SEQ ID NO: 685233 - RNA, 11 nt, Homo sapiens
uguccaugugu

SEQ ID NO: 685234 - RNA, 15 nt, Homo sapiens
uguccauuugcaaau

SEQ ID NO: 685235 - RNA, 22 nt, Homo sapiens
ugucccaaaccagacaccugga

SEQ ID NO: 685236 - RNA, 19 nt, Homo sapiens
ugucccacgugucuuccac

SEQ ID NO: 685237 - RNA, 21 nt, Homo sapiens
ugucccacuaucugggugcau

SEQ ID NO: 685238 - RNA, 12 nt, Homo sapiens
ugucccauuugc

SEQ ID NO: 685239 - RNA, 13 nt, Homo sapiens
uguccccaacagg

SEQ ID NO: 685240 - RNA, 18 nt, Homo sapiens
ugucccccaacuugagau

SEQ ID NO: 685241 - RNA, 15 nt, Homo sapiens
uguccccgccuuccc

SEQ ID NO: 685242 - RNA, 23 nt, Homo sapiens
uguccccgccuucccucacucuu

SEQ ID NO: 685243 - RNA, 21 nt, Homo sapiens
uguccccugacagggccagug

SEQ ID NO: 685244 - RNA, 23 nt, Homo sapiens
ugucccucaaaugacccaaagac

SEQ ID NO: 685245 - RNA, 23 nt, Homo sapiens
ugucccuuucuuggccaguuauc

SEQ ID NO: 685246 - RNA, 19 nt, Homo sapiens
uguccguccacccuuccau

SEQ ID NO: 685247 - RNA, 14 nt, Homo sapiens
uguccuaagagauu

SEQ ID NO: 685248 - RNA, 11 nt, Homo sapiens
uguccuaagca

SEQ ID NO: 685249 - RNA, 19 nt, Homo sapiens
uguccuaaggcccauuuga

SEQ ID NO: 685250 - RNA, 23 nt, Homo sapiens
uguccuauucccugucacuacac

SEQ ID NO: 685251 - RNA, 18 nt, Homo sapiens
uguccucuuccaccacag

SEQ ID NO: 685252 - RNA, 15 nt, Homo sapiens
uguccucuucugcau

SEQ ID NO: 685253 - RNA, 19 nt, Homo sapiens
uguccugauggcacucugu

SEQ ID NO: 685254 - RNA, 21 nt, Homo sapiens
uguccugcagucccacacugu

SEQ ID NO: 685255 - RNA, 14 nt, Homo sapiens
uguccugccagcug

SEQ ID NO: 685256 - RNA, 17 nt, Homo sapiens
uguccugcccuguggaa

SEQ ID NO: 685257 - RNA, 18 nt, Homo sapiens
uguccuggaggcacuggg

SEQ ID NO: 685258 - RNA, 21 nt, Homo sapiens
uguccuguacauugugggaug

SEQ ID NO: 685259 - RNA, 14 nt, Homo sapiens
uguccuguccugcu

SEQ ID NO: 685260 - RNA, 17 nt, Homo sapiens
uguccuucccuguucuc

SEQ ID NO: 685261 - RNA, 19 nt, Homo sapiens
uguccuuuccaucugucca

SEQ ID NO: 685262 - RNA, 15 nt, Homo sapiens
uguccuuuugcaaag

SEQ ID NO: 685263 - RNA, 21 nt, Homo sapiens
uguccuuuuggcacugagaua

SEQ ID NO: 685264 - RNA, 19 nt, Homo sapiens
uguccuuuuucacuuugaa

SEQ ID NO: 685265 - RNA, 17 nt, Homo sapiens
ugucgaauuccuacuga

SEQ ID NO: 685266 - RNA, 21 nt, Homo sapiens
ugucgagagcuggccaaagag

SEQ ID NO: 685267 - RNA, 18 nt, Homo sapiens
ugucgaugacuucaucaa

SEQ ID NO: 685268 - RNA, 19 nt, Homo sapiens
ugucgcaugagaacauuaa

SEQ ID NO: 685269 - RNA, 13 nt, Homo sapiens
ugucgccaaaaau

SEQ ID NO: 685270 - RNA, 16 nt, Homo sapiens
ugucgccucugcauuc

SEQ ID NO: 685271 - RNA, 14 nt, Homo sapiens
ugucgcuaugugac

SEQ ID NO: 685272 - RNA, 21 nt, Homo sapiens
ugucggcggcuugauaaacag

SEQ ID NO: 685273 - RNA, 13 nt, Homo sapiens
ugucguagccaag

SEQ ID NO: 685274 - RNA, 15 nt, Homo sapiens
ugucgugcuucauag

SEQ ID NO: 685275 - RNA, 15 nt, Homo sapiens
ugucguugugcuuuu

SEQ ID NO: 685276 - RNA, 23 nt, Homo sapiens
ugucguuugugaacgcugugaug

SEQ ID NO: 685277 - RNA, 18 nt, Homo sapiens
ugucguuuucacauauga

SEQ ID NO: 685278 - RNA, 17 nt, Homo sapiens
ugucuaaaaucccuccu

SEQ ID NO: 685279 - RNA, 17 nt, Homo sapiens
ugucuaaaaugccucag

SEQ ID NO: 685280 - RNA, 17 nt, Homo sapiens
ugucuaaacaaugcuga

SEQ ID NO: 685281 - RNA, 13 nt, Homo sapiens
ugucuaauuugca

SEQ ID NO: 685282 - RNA, 18 nt, Homo sapiens
ugucuacacacagaugac

SEQ ID NO: 685283 - RNA, 14 nt, Homo sapiens
ugucuaccugggag

SEQ ID NO: 685284 - RNA, 18 nt, Homo sapiens
ugucuaggacugcagugu

SEQ ID NO: 685285 - RNA, 15 nt, Homo sapiens
ugucuauaauggaaa

SEQ ID NO: 685286 - RNA, 19 nt, Homo sapiens
ugucuauuuaagugcaauu

SEQ ID NO: 685287 - RNA, 23 nt, Homo sapiens
ugucucaauucuuuguauaugca

SEQ ID NO: 685288 - RNA, 16 nt, Homo sapiens
ugucucacugaaacau

SEQ ID NO: 685289 - RNA, 15 nt, Homo sapiens
ugucucagaagugaa

SEQ ID NO: 685290 - RNA, 14 nt, Homo sapiens
ugucuccagaguug

SEQ ID NO: 685291 - RNA, 21 nt, Homo sapiens
ugucuccaugugcguccauau

SEQ ID NO: 685292 - RNA, 16 nt, Homo sapiens
ugucucccacuuccca

SEQ ID NO: 685293 - RNA, 17 nt, Homo sapiens
ugucucccuucuugggu

SEQ ID NO: 685294 - RNA, 15 nt, Homo sapiens
ugucuccuuccacaa

SEQ ID NO: 685295 - RNA, 13 nt, Homo sapiens
ugucuccuuccau

SEQ ID NO: 685296 - RNA, 18 nt, Homo sapiens
ugucuccuuucucuuaug

SEQ ID NO: 685297 - RNA, 23 nt, Homo sapiens
ugucucgugguaggacuguagaa

SEQ ID NO: 685298 - RNA, 16 nt, Homo sapiens
ugucucuaaccauuca

SEQ ID NO: 685299 - RNA, 15 nt, Homo sapiens
ugucucucacugcau

SEQ ID NO: 685300 - RNA, 23 nt, Homo sapiens
ugucugaacuugcauugugauug

SEQ ID NO: 685301 - RNA, 21 nt, Homo sapiens
uaaauaugccuaaaauacuua

SEQ ID NO: 685302 - RNA, 19 nt, Homo sapiens
uaaauaugccuaguaacac

SEQ ID NO: 685303 - RNA, 21 nt, Homo sapiens
uaaauauuagaagccugcaga

SEQ ID NO: 685304 - RNA, 14 nt, Homo sapiens
uaaauauugucaua

SEQ ID NO: 685305 - RNA, 13 nt, Homo sapiens
uaaauauuuccau

SEQ ID NO: 685306 - RNA, 18 nt, Homo sapiens
uaaauauuuuucacauaa

SEQ ID NO: 685307 - RNA, 21 nt, Homo sapiens
uaaaucaaaccaggugcaauu

SEQ ID NO: 685308 - RNA, 18 nt, Homo sapiens
uaaaucaaauauauguca

SEQ ID NO: 685309 - RNA, 16 nt, Homo sapiens
uaaaucaaguccuuua

SEQ ID NO: 685310 - RNA, 22 nt, Homo sapiens
uaaaucaccauagggcugggga

SEQ ID NO: 685311 - RNA, 20 nt, Homo sapiens
uaaaucagagagcaaggcau

SEQ ID NO: 685312 - RNA, 13 nt, Homo sapiens
uaaaucccaagaa

SEQ ID NO: 685313 - RNA, 13 nt, Homo sapiens
uaaauccugccau

SEQ ID NO: 685314 - RNA, 12 nt, Homo sapiens
uaaaucugaaua

SEQ ID NO: 685315 - RNA, 19 nt, Homo sapiens
uaaaucuucagcauagaag

SEQ ID NO: 685316 - RNA, 15 nt, Homo sapiens
uaaaucuuuuugcug

SEQ ID NO: 685317 - RNA, 18 nt, Homo sapiens
uaaaucuuuuugcugcug

SEQ ID NO: 685318 - RNA, 23 nt, Homo sapiens
uaaaugaaauuguaaaaccuguc

SEQ ID NO: 685319 - RNA, 21 nt, Homo sapiens
uaaaugaagaaaaguauugca

SEQ ID NO: 685320 - RNA, 24 nt, Homo sapiens
uaaaugaagaaaaguauugcaccu

SEQ ID NO: 685321 - RNA, 14 nt, Homo sapiens
uaaaugaagugauu

SEQ ID NO: 685322 - RNA, 17 nt, Homo sapiens
uaaaugaaugagccaaa

SEQ ID NO: 685323 - RNA, 22 nt, Homo sapiens
uaaaugagagggaaucgacugu

SEQ ID NO: 685324 - RNA, 18 nt, Homo sapiens
uaaaugagggcugcacau

SEQ ID NO: 685325 - RNA, 18 nt, Homo sapiens
uaaaugauagacaauuga

SEQ ID NO: 685326 - RNA, 11 nt, Homo sapiens
uaaaugaucau

SEQ ID NO: 685327 - RNA, 16 nt, Homo sapiens
uaaaugcacauuucag

SEQ ID NO: 685328 - RNA, 16 nt, Homo sapiens
uaaaugcaccaagaaa

SEQ ID NO: 685329 - RNA, 12 nt, Homo sapiens
uaaaugcauugg

SEQ ID NO: 685330 - RNA, 13 nt, Homo sapiens
uaaaugcccaguu

SEQ ID NO: 685331 - RNA, 14 nt, Homo sapiens
uaaaugcuguagaa

SEQ ID NO: 685332 - RNA, 20 nt, Homo sapiens
uaaauggacaaaugcuuaug

SEQ ID NO: 685333 - RNA, 14 nt, Homo sapiens
uaaauggcaugaca

SEQ ID NO: 685334 - RNA, 19 nt, Homo sapiens
uaaauggccagugcugcuu

SEQ ID NO: 685335 - RNA, 19 nt, Homo sapiens
uaaaugggaauucucaggu

SEQ ID NO: 685336 - RNA, 17 nt, Homo sapiens
uaaaugggggugcauuu

SEQ ID NO: 685337 - RNA, 21 nt, Homo sapiens
uaaauguaaauauguacacaa

SEQ ID NO: 685338 - RNA, 16 nt, Homo sapiens
uaaauguacagacaua

SEQ ID NO: 685339 - RNA, 19 nt, Homo sapiens
uaaauguaucuuauucaca

SEQ ID NO: 685340 - RNA, 21 nt, Homo sapiens
uaaauguauuuaauuccauau

SEQ ID NO: 685341 - RNA, 19 nt, Homo sapiens
uaaaugugaaacaucuucu

SEQ ID NO: 685342 - RNA, 14 nt, Homo sapiens
uaaaugugaacuua

SEQ ID NO: 685343 - RNA, 16 nt, Homo sapiens
uaaaugugauucaccu

SEQ ID NO: 685344 - RNA, 18 nt, Homo sapiens
uaaauguguuagcacuga

SEQ ID NO: 685345 - RNA, 16 nt, Homo sapiens
uaaauguuaugacuau

SEQ ID NO: 685346 - RNA, 19 nt, Homo sapiens
uaaauguuaugacuaugua

SEQ ID NO: 685347 - RNA, 15 nt, Homo sapiens
uaaauguucuaacag

SEQ ID NO: 685348 - RNA, 15 nt, Homo sapiens
uaaauguucuaauaa

SEQ ID NO: 685349 - RNA, 16 nt, Homo sapiens
uaaauguuuauacugu

SEQ ID NO: 685350 - RNA, 18 nt, Homo sapiens
uaaauuauuugcuaagca

SEQ ID NO: 685351 - RNA, 18 nt, Homo sapiens
uaaauucagaaagucaua

SEQ ID NO: 685352 - RNA, 14 nt, Homo sapiens
uaaauucagaucaa

SEQ ID NO: 685353 - RNA, 24 nt, Homo sapiens
uaaauucagccaacaugugacuaa

SEQ ID NO: 685354 - RNA, 23 nt, Homo sapiens
uaaauuccaucuaucaguaguau

SEQ ID NO: 685355 - RNA, 15 nt, Homo sapiens
ugugacuggcaguau

SEQ ID NO: 685356 - RNA, 20 nt, Homo sapiens
ugugacuucuccaggucuca

SEQ ID NO: 685357 - RNA, 22 nt, Homo sapiens
ugugacuuuuuagccagugacu

SEQ ID NO: 685358 - RNA, 20 nt, Homo sapiens
ugugacuuuuucagaguugc

SEQ ID NO: 685359 - RNA, 22 nt, Homo sapiens
ugugagauccucuuuacucugg

SEQ ID NO: 685360 - RNA, 14 nt, Homo sapiens
ugugagcagggauu

SEQ ID NO: 685361 - RNA, 22 nt, Homo sapiens
ugugagcagucccucuggaaag

SEQ ID NO: 685362 - RNA, 17 nt, Homo sapiens
ugugagcagugaguuac

SEQ ID NO: 685363 - RNA, 19 nt, Homo sapiens
ugugagcauuaaauaaagg

SEQ ID NO: 685364 - RNA, 16 nt, Homo sapiens
ugugagccaccacguc

SEQ ID NO: 685365 - RNA, 16 nt, Homo sapiens
ugugagcucugguuau

SEQ ID NO: 685366 - RNA, 17 nt, Homo sapiens
ugugagguauacauauu

SEQ ID NO: 685367 - RNA, 15 nt, Homo sapiens
ugugaguccaaagaa

SEQ ID NO: 685368 - RNA, 13 nt, Homo sapiens
ugugauaaaaccc

SEQ ID NO: 685369 - RNA, 14 nt, Homo sapiens
ugugauacauuucu

SEQ ID NO: 685370 - RNA, 18 nt, Homo sapiens
ugugauagcacuuucuac

SEQ ID NO: 685371 - RNA, 14 nt, Homo sapiens
ugugauauaugcau

SEQ ID NO: 685372 - RNA, 18 nt, Homo sapiens
ugugaucggccuggggaa

SEQ ID NO: 685373 - RNA, 20 nt, Homo sapiens
ugugauggacacuccaggga

SEQ ID NO: 685374 - RNA, 20 nt, Homo sapiens
ugugaugucaugaaacugua

SEQ ID NO: 685375 - RNA, 15 nt, Homo sapiens
ugugauuagaucaca

SEQ ID NO: 685376 - RNA, 16 nt, Homo sapiens
ugugauuagaucacau

SEQ ID NO: 685377 - RNA, 19 nt, Homo sapiens
ugugauuauuucacuuuag

SEQ ID NO: 685378 - RNA, 20 nt, Homo sapiens
ugugauugacgggacuguug

SEQ ID NO: 685379 - RNA, 17 nt, Homo sapiens
ugugauugcacagaauu

SEQ ID NO: 685380 - RNA, 19 nt, Homo sapiens
ugugauugcugccauaauu

SEQ ID NO: 685381 - RNA, 15 nt, Homo sapiens
ugugcaaaugugcug

SEQ ID NO: 685382 - RNA, 17 nt, Homo sapiens
ugugcaagggcagugaa

SEQ ID NO: 685383 - RNA, 21 nt, Homo sapiens
ugugcaauauucuuaaauacu

SEQ ID NO: 685384 - RNA, 23 nt, Homo sapiens
ugugcacacauauacauguagga

SEQ ID NO: 685385 - RNA, 17 nt, Homo sapiens
ugugcacacauuaggca

SEQ ID NO: 685386 - RNA, 14 nt, Homo sapiens
ugugcacaugugug

SEQ ID NO: 685387 - RNA, 13 nt, Homo sapiens
ugugcacauuuau

SEQ ID NO: 685388 - RNA, 19 nt, Homo sapiens
ugugcacauuuaugaauca

SEQ ID NO: 685389 - RNA, 17 nt, Homo sapiens
ugugcaccuguaauccc

SEQ ID NO: 685390 - RNA, 17 nt, Homo sapiens
ugugcacuuaguaguuu

SEQ ID NO: 685391 - RNA, 12 nt, Homo sapiens
ugugcagacuga

SEQ ID NO: 685392 - RNA, 15 nt, Homo sapiens
ugugcagggaaucau

SEQ ID NO: 685393 - RNA, 20 nt, Homo sapiens
ugugcagguuuugaaaaugu

SEQ ID NO: 685394 - RNA, 21 nt, Homo sapiens
ugugcaguguugacaguucau

SEQ ID NO: 685395 - RNA, 21 nt, Homo sapiens
ugugccaaaccuacuaggcca

SEQ ID NO: 685396 - RNA, 17 nt, Homo sapiens
ugugccaaagugcauag

SEQ ID NO: 685397 - RNA, 13 nt, Homo sapiens
ugugccaaccugu

SEQ ID NO: 685398 - RNA, 15 nt, Homo sapiens
ugugccacacaguga

SEQ ID NO: 685399 - RNA, 23 nt, Homo sapiens
ugugccaccaagcauuccugcuc

SEQ ID NO: 685400 - RNA, 14 nt, Homo sapiens
ugugccagcaccuu

SEQ ID NO: 685401 - RNA, 19 nt, Homo sapiens
ugugccaucauaagaauag

SEQ ID NO: 685402 - RNA, 17 nt, Homo sapiens
ugugccauggaucugau

SEQ ID NO: 685403 - RNA, 12 nt, Homo sapiens
ugugccauguca

SEQ ID NO: 685404 - RNA, 13 nt, Homo sapiens
ugugccaugucac

SEQ ID NO: 685405 - RNA, 17 nt, Homo sapiens
ugugcccaggguuuugc

SEQ ID NO: 685406 - RNA, 16 nt, Homo sapiens
ugugccccaccacguc

SEQ ID NO: 685407 - RNA, 16 nt, Homo sapiens
ugugccccaugccugu

SEQ ID NO: 685408 - RNA, 15 nt, Homo sapiens
ugugccccaugucca

SEQ ID NO: 685409 - RNA, 20 nt, Homo sapiens
ugugcccuccaaagagccuu

SEQ ID NO: 685410 - RNA, 23 nt, Homo sapiens
ugugcccuugggguaagccagag

SEQ ID NO: 685411 - RNA, 17 nt, Homo sapiens
ugugccugaagucccag

SEQ ID NO: 685412 - RNA, 22 nt, Homo sapiens
ugugccuggaagaguuggucuc

SEQ ID NO: 685413 - RNA, 18 nt, Homo sapiens
ugugccuuugcaaaucag

SEQ ID NO: 685414 - RNA, 13 nt, Homo sapiens
ugugcgcacacau

SEQ ID NO: 685415 - RNA, 18 nt, Homo sapiens
ugugcgcacacaugcuuc

SEQ ID NO: 685416 - RNA, 16 nt, Homo sapiens
ugugcggcugaacuga

SEQ ID NO: 685417 - RNA, 23 nt, Homo sapiens
ugugcguccauauuuaacaugua

SEQ ID NO: 685418 - RNA, 13 nt, Homo sapiens
ugugcuacagaug

SEQ ID NO: 685419 - RNA, 17 nt, Homo sapiens
ugugcucauuuugcaau

SEQ ID NO: 685420 - RNA, 23 nt, Homo sapiens
ugugcugaaauaauuacugguaa

SEQ ID NO: 685421 - RNA, 22 nt, Homo sapiens
ugugcugacucuggccuuacaa

SEQ ID NO: 685422 - RNA, 21 nt, Homo sapiens
ugugcugcagcucccauuuca

SEQ ID NO: 685423 - RNA, 16 nt, Homo sapiens
ugugcuggacacuguc

SEQ ID NO: 685424 - RNA, 17 nt, Homo sapiens
ugugcuggccucucuga

SEQ ID NO: 685425 - RNA, 19 nt, Homo sapiens
uaaccaguguuguggauuu

SEQ ID NO: 685426 - RNA, 19 nt, Homo sapiens
uaaccauccuuaaauuauu

SEQ ID NO: 685427 - RNA, 18 nt, Homo sapiens
uaacccaaugccugugaa

SEQ ID NO: 685428 - RNA, 20 nt, Homo sapiens
uaacccaaugccugugaagc

SEQ ID NO: 685429 - RNA, 16 nt, Homo sapiens
uaacccucacccacag

SEQ ID NO: 685430 - RNA, 16 nt, Homo sapiens
uaacccucccauggca

SEQ ID NO: 685431 - RNA, 13 nt, Homo sapiens
uaacccucucuuc

SEQ ID NO: 685432 - RNA, 17 nt, Homo sapiens
uaacccugucugagaug

SEQ ID NO: 685433 - RNA, 12 nt, Homo sapiens
uaacccuuuuuc

SEQ ID NO: 685434 - RNA, 21 nt, Homo sapiens
uaaccgagccagcagcugaag

SEQ ID NO: 685435 - RNA, 23 nt, Homo sapiens
uaaccucgcucgaugacugugaa

SEQ ID NO: 685436 - RNA, 17 nt, Homo sapiens
uaaccucucugugccau

SEQ ID NO: 685437 - RNA, 18 nt, Homo sapiens
uaaccugcgucauuucag

SEQ ID NO: 685438 - RNA, 15 nt, Homo sapiens
uaaccuugugccuug

SEQ ID NO: 685439 - RNA, 22 nt, Homo sapiens
uaaccuuguucucugcuugaca

SEQ ID NO: 685440 - RNA, 23 nt, Homo sapiens
uaaccuuuucaccuccaacugga

SEQ ID NO: 685441 - RNA, 16 nt, Homo sapiens
uaacgauaaaagguaa

SEQ ID NO: 685442 - RNA, 18 nt, Homo sapiens
uaacgccagcacacuauu

SEQ ID NO: 685443 - RNA, 16 nt, Homo sapiens
uaacgggcauguauua

SEQ ID NO: 685444 - RNA, 13 nt, Homo sapiens
uaacgugccccca

SEQ ID NO: 685445 - RNA, 22 nt, Homo sapiens
uaacguggggcuaggacacuga

SEQ ID NO: 685446 - RNA, 13 nt, Homo sapiens
uaacgugugcgca

SEQ ID NO: 685447 - RNA, 16 nt, Homo sapiens
uaacguucugcugcuu

SEQ ID NO: 685448 - RNA, 14 nt, Homo sapiens
uaacuaaacuaacg

SEQ ID NO: 685449 - RNA, 12 nt, Homo sapiens
uaacuaaauaac

SEQ ID NO: 685450 - RNA, 17 nt, Homo sapiens
uaacuaaaugcucauac

SEQ ID NO: 685451 - RNA, 15 nt, Homo sapiens
uaacuaaugccauag

SEQ ID NO: 685452 - RNA, 23 nt, Homo sapiens
uaacuacugcuaauguugaucag

SEQ ID NO: 685453 - RNA, 15 nt, Homo sapiens
uaacuagacaucugc

SEQ ID NO: 685454 - RNA, 18 nt, Homo sapiens
uaacuagaggagaauuua

SEQ ID NO: 685455 - RNA, 15 nt, Homo sapiens
uaacuauacuugaua

SEQ ID NO: 685456 - RNA, 19 nt, Homo sapiens
uaacuauauguacagcucu

SEQ ID NO: 685457 - RNA, 18 nt, Homo sapiens
uaacuaugagccaggcau

SEQ ID NO: 685458 - RNA, 15 nt, Homo sapiens
uaacuauguaucagu

SEQ ID NO: 685459 - RNA, 15 nt, Homo sapiens
uaacuauugcauuua

SEQ ID NO: 685460 - RNA, 16 nt, Homo sapiens
uaacuauuuguaaaag

SEQ ID NO: 685461 - RNA, 18 nt, Homo sapiens
uaacucaccucucaaggu

SEQ ID NO: 685462 - RNA, 15 nt, Homo sapiens
uaacucacugagggu

SEQ ID NO: 685463 - RNA, 16 nt, Homo sapiens
uaacucagacauucca

SEQ ID NO: 685464 - RNA, 13 nt, Homo sapiens
uaacucauagauu

SEQ ID NO: 685465 - RNA, 21 nt, Homo sapiens
uaacucgaauucucacaagga

SEQ ID NO: 685466 - RNA, 16 nt, Homo sapiens
uaacucuagaauuugg

SEQ ID NO: 685467 - RNA, 17 nt, Homo sapiens
uaacucugcacuacucc

SEQ ID NO: 685468 - RNA, 23 nt, Homo sapiens
uaacucugggaggggcucgagag

SEQ ID NO: 685469 - RNA, 17 nt, Homo sapiens
uaacugaaccauuccaa

SEQ ID NO: 685470 - RNA, 13 nt, Homo sapiens
uaacugacagcuu

SEQ ID NO: 685471 - RNA, 18 nt, Homo sapiens
uaacugaggacuguuugc

SEQ ID NO: 685472 - RNA, 12 nt, Homo sapiens
uaacugcaauuu

SEQ ID NO: 685473 - RNA, 14 nt, Homo sapiens
uaacugcacaaaca

SEQ ID NO: 685474 - RNA, 17 nt, Homo sapiens
uaacugccuuguguaca

SEQ ID NO: 685475 - RNA, 19 nt, Homo sapiens
uaacuggaaggccuuccac

SEQ ID NO: 685476 - RNA, 15 nt, Homo sapiens
uaacuggccagccau

SEQ ID NO: 685477 - RNA, 15 nt, Homo sapiens
uuaauuaaaucucaa

SEQ ID NO: 685478 - RNA, 16 nt, Homo sapiens
uuaauuaaguaucugg

SEQ ID NO: 685479 - RNA, 21 nt, Homo sapiens
uuaauuaguuuauauuacucu

SEQ ID NO: 685480 - RNA, 15 nt, Homo sapiens
uuaauuauauuucua

SEQ ID NO: 685481 - RNA, 23 nt, Homo sapiens
uuaauuaugauaauaaagagauu

SEQ ID NO: 685482 - RNA, 13 nt, Homo sapiens
uuaauuauugcuu

SEQ ID NO: 685483 - RNA, 15 nt, Homo sapiens
uuaauucacagaaua

SEQ ID NO: 685484 - RNA, 17 nt, Homo sapiens
uuaauucauaaaucaca

SEQ ID NO: 685485 - RNA, 14 nt, Homo sapiens
uuaauucaucuuua

SEQ ID NO: 685486 - RNA, 12 nt, Homo sapiens
uuaauucuuaga

SEQ ID NO: 685487 - RNA, 15 nt, Homo sapiens
uuaauugccagcaaa

SEQ ID NO: 685488 - RNA, 16 nt, Homo sapiens
uuaauuguguauuuaa

SEQ ID NO: 685489 - RNA, 13 nt, Homo sapiens
uuaauuucaggaa

SEQ ID NO: 685490 - RNA, 12 nt, Homo sapiens
uuaauuucuaac

SEQ ID NO: 685491 - RNA, 15 nt, Homo sapiens
uuaauuucugucaaa

SEQ ID NO: 685492 - RNA, 19 nt, Homo sapiens
uuaauuucugucaaaugca

SEQ ID NO: 685493 - RNA, 23 nt, Homo sapiens
uuaauuugaaaacauaaucugca

SEQ ID NO: 685494 - RNA, 18 nt, Homo sapiens
uuaauuuuaaccaaaaca

SEQ ID NO: 685495 - RNA, 15 nt, Homo sapiens
uuaauuuucaguaua

SEQ ID NO: 685496 - RNA, 14 nt, Homo sapiens
uuaauuuugauuca

SEQ ID NO: 685497 - RNA, 22 nt, Homo sapiens
uuaauuuuuaaggauguugcca

SEQ ID NO: 685498 - RNA, 16 nt, Homo sapiens
uuacaaaacugcuuug

SEQ ID NO: 685499 - RNA, 19 nt, Homo sapiens
uuacaaaauacagggauua

SEQ ID NO: 685500 - RNA, 12 nt, Homo sapiens
uuacaaacagac

SEQ ID NO: 685501 - RNA, 17 nt, Homo sapiens
uuacaaaccucaagcca

SEQ ID NO: 685502 - RNA, 13 nt, Homo sapiens
uuacaaacugcaa

SEQ ID NO: 685503 - RNA, 20 nt, Homo sapiens
uuacaaagcaucucauucau

SEQ ID NO: 685504 - RNA, 16 nt, Homo sapiens
uuacaaaggugaaaau

SEQ ID NO: 685505 - RNA, 20 nt, Homo sapiens
uuacaaaguaauuucuuuga

SEQ ID NO: 685506 - RNA, 14 nt, Homo sapiens
uuacaaaguuucaa

SEQ ID NO: 685507 - RNA, 16 nt, Homo sapiens
uuacaacauggcugau

SEQ ID NO: 685508 - RNA, 15 nt, Homo sapiens
uuacaaccacagaaa

SEQ ID NO: 685509 - RNA, 17 nt, Homo sapiens
uuacaagagcuguucau

SEQ ID NO: 685510 - RNA, 11 nt, Homo sapiens
uuacaagcccc

SEQ ID NO: 685511 - RNA, 14 nt, Homo sapiens
uuacaaggugacaa

SEQ ID NO: 685512 - RNA, 16 nt, Homo sapiens
uuacaaguuugcuaaa

SEQ ID NO: 685513 - RNA, 20 nt, Homo sapiens
uuacaaguuuuuuaggauuc

SEQ ID NO: 685514 - RNA, 19 nt, Homo sapiens
uuacaaucagccacauucu

SEQ ID NO: 685515 - RNA, 20 nt, Homo sapiens
uuacaaucagccacauucua

SEQ ID NO: 685516 - RNA, 20 nt, Homo sapiens
uuacaaucuguuuuagacau

SEQ ID NO: 685517 - RNA, 13 nt, Homo sapiens
uuacaauugcagu

SEQ ID NO: 685518 - RNA, 18 nt, Homo sapiens
uuacaauugcaguuuugc

SEQ ID NO: 685519 - RNA, 13 nt, Homo sapiens
uuacaauugugag

SEQ ID NO: 685520 - RNA, 19 nt, Homo sapiens
uuacacagaaaugcugcug

SEQ ID NO: 685521 - RNA, 11 nt, Homo sapiens
uuacacaggag

SEQ ID NO: 685522 - RNA, 18 nt, Homo sapiens
uuacacuaaaaaaaugca

SEQ ID NO: 685523 - RNA, 19 nt, Homo sapiens
uuacacuauugugaauauu

SEQ ID NO: 685524 - RNA, 21 nt, Homo sapiens
uuacacuccucguccauuuua

SEQ ID NO: 685525 - RNA, 21 nt, Homo sapiens
uuacacugggagaggugccag

SEQ ID NO: 685526 - RNA, 21 nt, Homo sapiens
uuacacuugggauugucuuac

SEQ ID NO: 685527 - RNA, 14 nt, Homo sapiens
uuacagaaacugca

SEQ ID NO: 685528 - RNA, 23 nt, Homo sapiens
uuacagagagcuugcugugacua

SEQ ID NO: 685529 - RNA, 14 nt, Homo sapiens
uuacagagccuuga

SEQ ID NO: 685530 - RNA, 22 nt, Homo sapiens
uuacagcccucagcaaugugcc

SEQ ID NO: 685531 - RNA, 12 nt, Homo sapiens
uuacagcuuucu

SEQ ID NO: 685532 - RNA, 16 nt, Homo sapiens
uuacaggaacuucauc

SEQ ID NO: 685533 - RNA, 20 nt, Homo sapiens
uuacaggaagucccuugcca

SEQ ID NO: 685534 - RNA, 22 nt, Homo sapiens
uuacaggcacgugccaccacgc

SEQ ID NO: 685535 - RNA, 18 nt, Homo sapiens
uuacaggcuugagccucc

SEQ ID NO: 685536 - RNA, 16 nt, Homo sapiens
uuacagggugacucac

SEQ ID NO: 685537 - RNA, 17 nt, Homo sapiens
uuacagggugacucaca

SEQ ID NO: 685538 - RNA, 23 nt, Homo sapiens
uuacaguaggagcccagcucuga

SEQ ID NO: 685539 - RNA, 15 nt, Homo sapiens
uuacaguauacauau

SEQ ID NO: 685540 - RNA, 12 nt, Homo sapiens
uuacagugcaga

SEQ ID NO: 685541 - RNA, 14 nt, Homo sapiens
uuacauaaguuccu

SEQ ID NO: 685542 - RNA, 10 nt, Homo sapiens
uuacauacac

SEQ ID NO: 685543 - RNA, 14 nt, Homo sapiens
uuacauacuuuauc

SEQ ID NO: 685544 - RNA, 20 nt, Homo sapiens
uuacauagaucagccauuaa

SEQ ID NO: 685545 - RNA, 22 nt, Homo sapiens
uuacaucaugcuggaaccugca

SEQ ID NO: 685546 - RNA, 12 nt, Homo sapiens
uuacaucuggcu

SEQ ID NO: 685547 - RNA, 13 nt, Homo sapiens
uuacaucuuucac

SEQ ID NO: 685548 - RNA, 14 nt, Homo sapiens
uuacaugcauuuga

SEQ ID NO: 685549 - RNA, 14 nt, Homo sapiens
uuacauguguaaag

SEQ ID NO: 685550 - RNA, 18 nt, Homo sapiens
uuacauguuuuuucauuu

SEQ ID NO: 685551 - RNA, 14 nt, Homo sapiens
uuacauuguugagc

SEQ ID NO: 685552 - RNA, 12 nt, Homo sapiens
uuacauuuacaa

SEQ ID NO: 685553 - RNA, 14 nt, Homo sapiens
uuacauuuauacau

SEQ ID NO: 685554 - RNA, 18 nt, Homo sapiens
uuacauuucauacaacag

SEQ ID NO: 685555 - RNA, 16 nt, Homo sapiens
uuaccaaaaaccaugu

SEQ ID NO: 685556 - RNA, 19 nt, Homo sapiens
uuaccaaagcaucaauaca

SEQ ID NO: 685557 - RNA, 16 nt, Homo sapiens
uuaccaaggaugaauu

SEQ ID NO: 685558 - RNA, 17 nt, Homo sapiens
uuaccacagcaacugac

SEQ ID NO: 685559 - RNA, 20 nt, Homo sapiens
uacauuguauuaauaccaaa

SEQ ID NO: 685560 - RNA, 16 nt, Homo sapiens
uacauuguuaccucua

SEQ ID NO: 685561 - RNA, 17 nt, Homo sapiens
uacauuuaugcacauuc

SEQ ID NO: 685562 - RNA, 22 nt, Homo sapiens
uacauuugaugcaugucuuuua

SEQ ID NO: 685563 - RNA, 18 nt, Homo sapiens
uacauuugugaacaaaaa

SEQ ID NO: 685564 - RNA, 16 nt, Homo sapiens
uacauuugugcuccau

SEQ ID NO: 685565 - RNA, 19 nt, Homo sapiens
uacauuuuauuaagcuuuu

SEQ ID NO: 685566 - RNA, 15 nt, Homo sapiens
uaccaaaauguuaau

SEQ ID NO: 685567 - RNA, 16 nt, Homo sapiens
uaccaaacucagguga

SEQ ID NO: 685568 - RNA, 13 nt, Homo sapiens
uaccaaagugucu

SEQ ID NO: 685569 - RNA, 21 nt, Homo sapiens
uaccacaaggaaaauaguuua

SEQ ID NO: 685570 - RNA, 22 nt, Homo sapiens
uaccacacugaguucuaucagu

SEQ ID NO: 685571 - RNA, 18 nt, Homo sapiens
uaccacagcuauuuagaa

SEQ ID NO: 685572 - RNA, 16 nt, Homo sapiens
uaccacaguggaugua

SEQ ID NO: 685573 - RNA, 18 nt, Homo sapiens
uaccacagugucuguauc

SEQ ID NO: 685574 - RNA, 15 nt, Homo sapiens
uaccaccaugcacug

SEQ ID NO: 685575 - RNA, 19 nt, Homo sapiens
uaccacucuguaauugcaa

SEQ ID NO: 685576 - RNA, 20 nt, Homo sapiens
uaccacucuuuaccuuuauu

SEQ ID NO: 685577 - RNA, 12 nt, Homo sapiens
uaccacuugccu

SEQ ID NO: 685578 - RNA, 17 nt, Homo sapiens
uaccagaaggagaugcu

SEQ ID NO: 685579 - RNA, 14 nt, Homo sapiens
uaccagagauuuac

SEQ ID NO: 685580 - RNA, 15 nt, Homo sapiens
uaccagagauuuacc

SEQ ID NO: 685581 - RNA, 20 nt, Homo sapiens
uaccagaggaaguuauggca

SEQ ID NO: 685582 - RNA, 18 nt, Homo sapiens
uaccagaugaacauuuca

SEQ ID NO: 685583 - RNA, 14 nt, Homo sapiens
uaccagaugcugac

SEQ ID NO: 685584 - RNA, 15 nt, Homo sapiens
uaccagcucagggga

SEQ ID NO: 685585 - RNA, 22 nt, Homo sapiens
uaccaguauaagcaucugccau

SEQ ID NO: 685586 - RNA, 15 nt, Homo sapiens
uaccagucuauuucc

SEQ ID NO: 685587 - RNA, 13 nt, Homo sapiens
uaccaguugccuu

SEQ ID NO: 685588 - RNA, 23 nt, Homo sapiens
uaccaguuuguccaucuugagau

SEQ ID NO: 685589 - RNA, 24 nt, Homo sapiens
uaccauaauuuauuuuguccauug

SEQ ID NO: 685590 - RNA, 20 nt, Homo sapiens
uaccauagaaagaugacaaa

SEQ ID NO: 685591 - RNA, 15 nt, Homo sapiens
uaccaucugcaucca

SEQ ID NO: 685592 - RNA, 17 nt, Homo sapiens
uaccaucuuguauacac

SEQ ID NO: 685593 - RNA, 16 nt, Homo sapiens
uaccauucacuacuca

SEQ ID NO: 685594 - RNA, 23 nt, Homo sapiens
uaccauuuuuuaaggaaacaaua

SEQ ID NO: 685595 - RNA, 21 nt, Homo sapiens
uacccaaauuuuaauauucca

SEQ ID NO: 685596 - RNA, 17 nt, Homo sapiens
uacccaagcuguggcag

SEQ ID NO: 685597 - RNA, 21 nt, Homo sapiens
uacccacauguacagacauac

SEQ ID NO: 685598 - RNA, 19 nt, Homo sapiens
uacccaccuagaacacuaa

SEQ ID NO: 685599 - RNA, 23 nt, Homo sapiens
uacccagagaauauauacauucu

SEQ ID NO: 685600 - RNA, 19 nt, Homo sapiens
uuacugaucucuuuaagua

SEQ ID NO: 685601 - RNA, 13 nt, Homo sapiens
uuacugaugugau

SEQ ID NO: 685602 - RNA, 21 nt, Homo sapiens
uuacugcuucuuuucacuuca

SEQ ID NO: 685603 - RNA, 18 nt, Homo sapiens
uuacugcuugaccaaaga

SEQ ID NO: 685604 - RNA, 19 nt, Homo sapiens
uuacugguagaaaggcagu

SEQ ID NO: 685605 - RNA, 15 nt, Homo sapiens
uuacuguacauacaa

SEQ ID NO: 685606 - RNA, 23 nt, Homo sapiens
uuacuguacauacaaauucuacu

SEQ ID NO: 685607 - RNA, 21 nt, Homo sapiens
uuacuguacccucgcaugacu

SEQ ID NO: 685608 - RNA, 18 nt, Homo sapiens
uuacuguccaccaguuua

SEQ ID NO: 685609 - RNA, 17 nt, Homo sapiens
uuacugugaaacuggca

SEQ ID NO: 685610 - RNA, 23 nt, Homo sapiens
uuacugugaaacuggcacugaau

SEQ ID NO: 685611 - RNA, 18 nt, Homo sapiens
uuacuguuccagauuccu

SEQ ID NO: 685612 - RNA, 17 nt, Homo sapiens
uuacuuaauugccagca

SEQ ID NO: 685613 - RNA, 17 nt, Homo sapiens
uuacuuaccuaaacaga

SEQ ID NO: 685614 - RNA, 17 nt, Homo sapiens
uuacuuaugaugaugaa

SEQ ID NO: 685615 - RNA, 21 nt, Homo sapiens
uuacuuauuuaacugauuaaa

SEQ ID NO: 685616 - RNA, 20 nt, Homo sapiens
uuacuuccuaucaagccagu

SEQ ID NO: 685617 - RNA, 16 nt, Homo sapiens
uuacuugcauugaaua

SEQ ID NO: 685618 - RNA, 20 nt, Homo sapiens
uuacuuguguuacuugccaa

SEQ ID NO: 685619 - RNA, 17 nt, Homo sapiens
uuacuuuuuuacacuga

SEQ ID NO: 685620 - RNA, 17 nt, Homo sapiens
uuagaaaaaaguuuaca

SEQ ID NO: 685621 - RNA, 13 nt, Homo sapiens
uuagaaaaaccac

SEQ ID NO: 685622 - RNA, 17 nt, Homo sapiens
uuagaaaauagagcuuu

SEQ ID NO: 685623 - RNA, 21 nt, Homo sapiens
uuagaaaauucaagcauuuag

SEQ ID NO: 685624 - RNA, 22 nt, Homo sapiens
uuagaaacagaaauagacuuaa

SEQ ID NO: 685625 - RNA, 21 nt, Homo sapiens
uuagaaauaaugaaggugcca

SEQ ID NO: 685626 - RNA, 17 nt, Homo sapiens
uuagaaauaauggucau

SEQ ID NO: 685627 - RNA, 12 nt, Homo sapiens
uuagaaauggau

SEQ ID NO: 685628 - RNA, 12 nt, Homo sapiens
uuagaaauucag

SEQ ID NO: 685629 - RNA, 14 nt, Homo sapiens
uuagaacauucacu

SEQ ID NO: 685630 - RNA, 19 nt, Homo sapiens
uuagaagauagaugcacuu

SEQ ID NO: 685631 - RNA, 20 nt, Homo sapiens
uuagaagauauuauuugucu

SEQ ID NO: 685632 - RNA, 20 nt, Homo sapiens
uuagaaggacucaguauuau

SEQ ID NO: 685633 - RNA, 18 nt, Homo sapiens
uuagaaguagaauugaca

SEQ ID NO: 685634 - RNA, 19 nt, Homo sapiens
uuagaagugcuaauuucug

SEQ ID NO: 685635 - RNA, 21 nt, Homo sapiens
uuagaauauaagaaaucuuua

SEQ ID NO: 685636 - RNA, 18 nt, Homo sapiens
uuagaauauccaugaccu

SEQ ID NO: 685637 - RNA, 12 nt, Homo sapiens
uuagaauaucug

SEQ ID NO: 685638 - RNA, 22 nt, Homo sapiens
uuagaaucuuuuaaauacauuc

SEQ ID NO: 685639 - RNA, 17 nt, Homo sapiens
uuagaauuaccauuugu

SEQ ID NO: 685640 - RNA, 13 nt, Homo sapiens
uuagacacuuugg

SEQ ID NO: 685641 - RNA, 22 nt, Homo sapiens
uuagaccccauacaaguuuaua

SEQ ID NO: 685642 - RNA, 21 nt, Homo sapiens
uuagacccgcccuccccuuuu

SEQ ID NO: 685643 - RNA, 15 nt, Homo sapiens
uuagacccugcauuu

SEQ ID NO: 685644 - RNA, 18 nt, Homo sapiens
uuagacguccuccgucca

SEQ ID NO: 685645 - RNA, 14 nt, Homo sapiens
uuagacuccccuga

SEQ ID NO: 685646 - RNA, 13 nt, Homo sapiens
uuagagaaugaga

SEQ ID NO: 685647 - RNA, 14 nt, Homo sapiens
uuagagacaucaaa

SEQ ID NO: 685648 - RNA, 15 nt, Homo sapiens
uuagagauacuguug

SEQ ID NO: 685649 - RNA, 17 nt, Homo sapiens
uuagagcaaccucugua

SEQ ID NO: 685650 - RNA, 14 nt, Homo sapiens
uuagagcacagcuu

SEQ ID NO: 685651 - RNA, 13 nt, Homo sapiens
uuagaguauuuac

SEQ ID NO: 685652 - RNA, 17 nt, Homo sapiens
uuagagucaauuugcug

SEQ ID NO: 685653 - RNA, 15 nt, Homo sapiens
uuagaucaaauacuu

SEQ ID NO: 685654 - RNA, 24 nt, Homo sapiens
uuagaucaaccuccaacaacgaca

SEQ ID NO: 685655 - RNA, 20 nt, Homo sapiens
uuagauguaauuuuguguaa

SEQ ID NO: 685656 - RNA, 22 nt, Homo sapiens
uuagauguuucaacugugcucu

SEQ ID NO: 685657 - RNA, 14 nt, Homo sapiens
uuagauguuucaca

SEQ ID NO: 685658 - RNA, 16 nt, Homo sapiens
uuagauuauauauucc

SEQ ID NO: 685659 - RNA, 14 nt, Homo sapiens
uuagauucagggga

SEQ ID NO: 685660 - RNA, 22 nt, Homo sapiens
uuagauugggucguuacuaaaa

SEQ ID NO: 685661 - RNA, 16 nt, Homo sapiens
uuagcaaccauaauau

SEQ ID NO: 685662 - RNA, 15 nt, Homo sapiens
uuagcagcagccuuu

SEQ ID NO: 685663 - RNA, 22 nt, Homo sapiens
uuagcagggauguuccuuacca

SEQ ID NO: 685664 - RNA, 22 nt, Homo sapiens
uuagcaguaacggguagcagca

SEQ ID NO: 685665 - RNA, 21 nt, Homo sapiens
uuagcauaaaauuuucuacuc

SEQ ID NO: 685666 - RNA, 20 nt, Homo sapiens
uuagcauauuuuaaugcagu

SEQ ID NO: 685667 - RNA, 16 nt, Homo sapiens
uuagcaucaaguucuc

SEQ ID NO: 685668 - RNA, 21 nt, Homo sapiens
uuagcaugacccuaaaauucu

SEQ ID NO: 685669 - RNA, 16 nt, Homo sapiens
uuagcauguuguugaa

SEQ ID NO: 685670 - RNA, 23 nt, Homo sapiens
uuagcauuccuauugacaacucu

SEQ ID NO: 685671 - RNA, 16 nt, Homo sapiens
uuagccagauuugucu

SEQ ID NO: 685672 - RNA, 23 nt, Homo sapiens
uuagccauaauuuugcauacuga

SEQ ID NO: 685673 - RNA, 15 nt, Homo sapiens
uuagccauuucucca

SEQ ID NO: 685674 - RNA, 21 nt, Homo sapiens
uuagcccuguguccugaguua

SEQ ID NO: 685675 - RNA, 19 nt, Homo sapiens
uuagccuaaauguuaacua

SEQ ID NO: 685676 - RNA, 13 nt, Homo sapiens
uuagccugugcug

SEQ ID NO: 685677 - RNA, 10 nt, Homo sapiens
uuagccuuua

SEQ ID NO: 685678 - RNA, 23 nt, Homo sapiens
uuagcgucaagacauuugcugaa

SEQ ID NO: 685679 - RNA, 18 nt, Homo sapiens
uuagcuacacagugcaga

SEQ ID NO: 685680 - RNA, 20 nt, Homo sapiens
uuagcuaguuuuauucuugg

SEQ ID NO: 685681 - RNA, 18 nt, Homo sapiens
uuagcucacugaaucuuc

SEQ ID NO: 685682 - RNA, 18 nt, Homo sapiens
uacuaaaagcaauguuua

SEQ ID NO: 685683 - RNA, 15 nt, Homo sapiens
uacuaaagugccuac

SEQ ID NO: 685684 - RNA, 22 nt, Homo sapiens
uacuaaauaaaaaaaugaauau

SEQ ID NO: 685685 - RNA, 22 nt, Homo sapiens
uacuaaaugguguuacauuaaa

SEQ ID NO: 685686 - RNA, 20 nt, Homo sapiens
uacuaacuaaauaccauuca

SEQ ID NO: 685687 - RNA, 16 nt, Homo sapiens
uacuaagauacuccau

SEQ ID NO: 685688 - RNA, 23 nt, Homo sapiens
uacuaagccacaagaaauuugau

SEQ ID NO: 685689 - RNA, 20 nt, Homo sapiens
uacuaagggaacaauccaug

SEQ ID NO: 685690 - RNA, 22 nt, Homo sapiens
uacuaaugugccccauguccaa

SEQ ID NO: 685691 - RNA, 21 nt, Homo sapiens
uacuaauuuucuagauuuucu

SEQ ID NO: 685692 - RNA, 19 nt, Homo sapiens
uacuacaaacuucaaagag

SEQ ID NO: 685693 - RNA, 17 nt, Homo sapiens
uacuacagcuucaguga

SEQ ID NO: 685694 - RNA, 14 nt, Homo sapiens
uacuaccacaagga

SEQ ID NO: 685695 - RNA, 12 nt, Homo sapiens
uacuaccccagc

SEQ ID NO: 685696 - RNA, 22 nt, Homo sapiens
uacuacccgagcccagcuacau

SEQ ID NO: 685697 - RNA, 14 nt, Homo sapiens
uacuaccugucaag

SEQ ID NO: 685698 - RNA, 15 nt, Homo sapiens
uacuagaaguuuuac

SEQ ID NO: 685699 - RNA, 17 nt, Homo sapiens
uacuagauugugauccc

SEQ ID NO: 685700 - RNA, 17 nt, Homo sapiens
uacuagcaacaaacaau

SEQ ID NO: 685701 - RNA, 16 nt, Homo sapiens
uacuagcaggaauauu

SEQ ID NO: 685702 - RNA, 19 nt, Homo sapiens
uacuaggagaggggggcca

SEQ ID NO: 685703 - RNA, 22 nt, Homo sapiens
uacuaguguguguguguauaua

SEQ ID NO: 685704 - RNA, 23 nt, Homo sapiens
uacuaguguguguguguauauau

SEQ ID NO: 685705 - RNA, 16 nt, Homo sapiens
uacuaguuuugcugaa

SEQ ID NO: 685706 - RNA, 16 nt, Homo sapiens
uacuauagguccagaa

SEQ ID NO: 685707 - RNA, 12 nt, Homo sapiens
uacuauaugauu

SEQ ID NO: 685708 - RNA, 20 nt, Homo sapiens
uacuauauuuauacuguaua

SEQ ID NO: 685709 - RNA, 13 nt, Homo sapiens
uacuaucauucuc

SEQ ID NO: 685710 - RNA, 14 nt, Homo sapiens
uacuaucauucuca

SEQ ID NO: 685711 - RNA, 17 nt, Homo sapiens
uacuaucauucucagug

SEQ ID NO: 685712 - RNA, 12 nt, Homo sapiens
uacuauguuaau

SEQ ID NO: 685713 - RNA, 14 nt, Homo sapiens
uacucaaauggugu

SEQ ID NO: 685714 - RNA, 22 nt, Homo sapiens
uacucaagcagaucucaucuca

SEQ ID NO: 685715 - RNA, 15 nt, Homo sapiens
uacucaccaauuuau

SEQ ID NO: 685716 - RNA, 13 nt, Homo sapiens
uacucagcauuug

SEQ ID NO: 685717 - RNA, 20 nt, Homo sapiens
uacucagcauuugauuaaca

SEQ ID NO: 685718 - RNA, 20 nt, Homo sapiens
uacucaggaggcugaggcag

SEQ ID NO: 685719 - RNA, 23 nt, Homo sapiens
uacucaggcugguggagaacucu

SEQ ID NO: 685720 - RNA, 16 nt, Homo sapiens
uacucagugacuguug

SEQ ID NO: 685721 - RNA, 13 nt, Homo sapiens
uuagucauucugc

SEQ ID NO: 685722 - RNA, 17 nt, Homo sapiens
uuaguccucuacugcua

SEQ ID NO: 685723 - RNA, 16 nt, Homo sapiens
uuagucucaagggcua

SEQ ID NO: 685724 - RNA, 15 nt, Homo sapiens
uuagucucaugugaa

SEQ ID NO: 685725 - RNA, 23 nt, Homo sapiens
uuagucuguuuucuaaagccagg

SEQ ID NO: 685726 - RNA, 21 nt, Homo sapiens
uuagugaucaaauugugcagu

SEQ ID NO: 685727 - RNA, 14 nt, Homo sapiens
uuagugcagccaag

SEQ ID NO: 685728 - RNA, 13 nt, Homo sapiens
uuagugcuuugug

SEQ ID NO: 685729 - RNA, 20 nt, Homo sapiens
uuaguggcucaacauugugu

SEQ ID NO: 685730 - RNA, 15 nt, Homo sapiens
uuagugucuguccau

SEQ ID NO: 685731 - RNA, 19 nt, Homo sapiens
uuaguucagccauugugga

SEQ ID NO: 685732 - RNA, 14 nt, Homo sapiens
uuaguucccaacau

SEQ ID NO: 685733 - RNA, 23 nt, Homo sapiens
uuaguuccccaaauacaaaguua

SEQ ID NO: 685734 - RNA, 23 nt, Homo sapiens
uuaguuguaaaccaagugaucaa

SEQ ID NO: 685735 - RNA, 13 nt, Homo sapiens
uuaguuguuauua

SEQ ID NO: 685736 - RNA, 20 nt, Homo sapiens
uuaguuuacaaucagccaca

SEQ ID NO: 685737 - RNA, 14 nt, Homo sapiens
uuaguuuuugauca

SEQ ID NO: 685738 - RNA, 13 nt, Homo sapiens
uuauaaaaaaugg

SEQ ID NO: 685739 - RNA, 17 nt, Homo sapiens
uuauaaaaaaugguuca

SEQ ID NO: 685740 - RNA, 23 nt, Homo sapiens
uuauaaaagaauaaaauugcacu

SEQ ID NO: 685741 - RNA, 20 nt, Homo sapiens
uuauaaaggauaaagaagga

SEQ ID NO: 685742 - RNA, 12 nt, Homo sapiens
uuauaaauauca

SEQ ID NO: 685743 - RNA, 22 nt, Homo sapiens
uuauaaauauuauuagauuuau

SEQ ID NO: 685744 - RNA, 19 nt, Homo sapiens
uuauaaaucuuucucucac

SEQ ID NO: 685745 - RNA, 22 nt, Homo sapiens
uuauaaaucuuucucucacugu

SEQ ID NO: 685746 - RNA, 15 nt, Homo sapiens
uuauaaaugcuauuu

SEQ ID NO: 685747 - RNA, 20 nt, Homo sapiens
uuauaaauucagaacaagca

SEQ ID NO: 685748 - RNA, 13 nt, Homo sapiens
uuauaacuguaaa

SEQ ID NO: 685749 - RNA, 14 nt, Homo sapiens
uuauaagacuggaa

SEQ ID NO: 685750 - RNA, 19 nt, Homo sapiens
uuauaagcauacaacugga

SEQ ID NO: 685751 - RNA, 14 nt, Homo sapiens
uuauaagcauguau

SEQ ID NO: 685752 - RNA, 21 nt, Homo sapiens
uuauaagugaagugauacuau

SEQ ID NO: 685753 - RNA, 19 nt, Homo sapiens
uuauaauaaaauugguguu

SEQ ID NO: 685754 - RNA, 14 nt, Homo sapiens
uuauaauauacuau

SEQ ID NO: 685755 - RNA, 20 nt, Homo sapiens
uuauaauuguucucagaauc

SEQ ID NO: 685756 - RNA, 20 nt, Homo sapiens
uuauacacaacuuugcaaau

SEQ ID NO: 685757 - RNA, 13 nt, Homo sapiens
uuauacaccagca

SEQ ID NO: 685758 - RNA, 13 nt, Homo sapiens
uuauacacugucu

SEQ ID NO: 685759 - RNA, 15 nt, Homo sapiens
uuauacagaacucac

SEQ ID NO: 685760 - RNA, 21 nt, Homo sapiens
uuauacaucacagcagugcau

SEQ ID NO: 685761 - RNA, 23 nt, Homo sapiens
uuauacauguaacagaguagcag

SEQ ID NO: 685762 - RNA, 13 nt, Homo sapiens
uuauacccaugaa

SEQ ID NO: 685763 - RNA, 16 nt, Homo sapiens
uuauacuggguuucaa

SEQ ID NO: 685764 - RNA, 19 nt, Homo sapiens
uuauacuguagcugaugaa

SEQ ID NO: 685765 - RNA, 11 nt, Homo sapiens
uuauacuguau

SEQ ID NO: 685766 - RNA, 21 nt, Homo sapiens
uuauagaagagaaaugcugcu

SEQ ID NO: 685767 - RNA, 16 nt, Homo sapiens
uuauagaaguagcaaa

SEQ ID NO: 685768 - RNA, 19 nt, Homo sapiens
uuauagacagucguuccca

SEQ ID NO: 685769 - RNA, 20 nt, Homo sapiens
uuauagaccagaaccagagc

SEQ ID NO: 685770 - RNA, 16 nt, Homo sapiens
uuauagaccucuagua

SEQ ID NO: 685771 - RNA, 19 nt, Homo sapiens
uuauagauguacauaccuc

SEQ ID NO: 685772 - RNA, 18 nt, Homo sapiens
uuauagcaacaacaauug

SEQ ID NO: 685773 - RNA, 22 nt, Homo sapiens
uuauagcaacaacaauugguaa

SEQ ID NO: 685774 - RNA, 16 nt, Homo sapiens
uuauagccauaaaaga

SEQ ID NO: 685775 - RNA, 20 nt, Homo sapiens
uuauaggauuuuugagcaca

SEQ ID NO: 685776 - RNA, 14 nt, Homo sapiens
uuauaguaugugac

SEQ ID NO: 685777 - RNA, 15 nt, Homo sapiens
uuauaguuacugugu

SEQ ID NO: 685778 - RNA, 20 nt, Homo sapiens
uuauauaagaccacuacagu

SEQ ID NO: 685779 - RNA, 18 nt, Homo sapiens
uuauauagguugugcaaa

SEQ ID NO: 685780 - RNA, 16 nt, Homo sapiens
uuauauauuacuuguu

SEQ ID NO: 685781 - RNA, 14 nt, Homo sapiens
uuauaucaguuuca

SEQ ID NO: 685782 - RNA, 19 nt, Homo sapiens
uuauaucauacaguuuuca

SEQ ID NO: 685783 - RNA, 13 nt, Homo sapiens
uuauaucugugaa

SEQ ID NO: 685784 - RNA, 15 nt, Homo sapiens
uuauaugaaugccua

SEQ ID NO: 685785 - RNA, 16 nt, Homo sapiens
uuauaugauauacuau

SEQ ID NO: 685786 - RNA, 12 nt, Homo sapiens
uuauaugauuca

SEQ ID NO: 685787 - RNA, 10 nt, Homo sapiens
uuauaugcac

SEQ ID NO: 685788 - RNA, 22 nt, Homo sapiens
uuauauguggacuaaauaucug

SEQ ID NO: 685789 - RNA, 12 nt, Homo sapiens
uuauauguugcu

SEQ ID NO: 685790 - RNA, 17 nt, Homo sapiens
uuauauuaauguacuug

SEQ ID NO: 685791 - RNA, 15 nt, Homo sapiens
uuauauuacucucau

SEQ ID NO: 685792 - RNA, 13 nt, Homo sapiens
uuauauuguggaa

SEQ ID NO: 685793 - RNA, 22 nt, Homo sapiens
uuauauuuccuuuaugugaauu

SEQ ID NO: 685794 - RNA, 14 nt, Homo sapiens
uuaucaagccauaa

SEQ ID NO: 685795 - RNA, 18 nt, Homo sapiens
uuaucaauuuuucccagu

SEQ ID NO: 685796 - RNA, 18 nt, Homo sapiens
uuaucaccgugggcuccc

SEQ ID NO: 685797 - RNA, 18 nt, Homo sapiens
uuaucaccucauucugaa

SEQ ID NO: 685798 - RNA, 22 nt, Homo sapiens
uuaucagcaaaaaaguccaauu

SEQ ID NO: 685799 - RNA, 16 nt, Homo sapiens
uuaucaguaauuugac

SEQ ID NO: 685800 - RNA, 19 nt, Homo sapiens
uuaucaucucaccacacca

SEQ ID NO: 685801 - RNA, 12 nt, Homo sapiens
uuaucaucugaa

SEQ ID NO: 685802 - RNA, 19 nt, Homo sapiens
uuaucauuaaaaauuaccu

SEQ ID NO: 685803 - RNA, 13 nt, Homo sapiens
uuaucauugcuaa

SEQ ID NO: 685804 - RNA, 22 nt, Homo sapiens
uuauccaagaccugaaagaugg

SEQ ID NO: 685805 - RNA, 14 nt, Homo sapiens
uuauccacaaagua

SEQ ID NO: 685806 - RNA, 18 nt, Homo sapiens
uacuuuaauauaaaccca

SEQ ID NO: 685807 - RNA, 22 nt, Homo sapiens
uacuuuacaaaccauuaccugu

SEQ ID NO: 685808 - RNA, 18 nt, Homo sapiens
uacuuuacagacaggaaa

SEQ ID NO: 685809 - RNA, 15 nt, Homo sapiens
uacuuuauuaacuua

SEQ ID NO: 685810 - RNA, 20 nt, Homo sapiens
uacuuuauuucugaucuaua

SEQ ID NO: 685811 - RNA, 18 nt, Homo sapiens
uacuuuguaaauaggauu

SEQ ID NO: 685812 - RNA, 12 nt, Homo sapiens
uacuuugugcau

SEQ ID NO: 685813 - RNA, 15 nt, Homo sapiens
uacuuugugcauucu

SEQ ID NO: 685814 - RNA, 15 nt, Homo sapiens
uacuuuuacucugcc

SEQ ID NO: 685815 - RNA, 16 nt, Homo sapiens
uacuuuuauaaugaaa

SEQ ID NO: 685816 - RNA, 17 nt, Homo sapiens
uacuuuucacacugucu

SEQ ID NO: 685817 - RNA, 22 nt, Homo sapiens
uacuuuugaaaaucaacuguau

SEQ ID NO: 685818 - RNA, 17 nt, Homo sapiens
uacuuuugauccugggg

SEQ ID NO: 685819 - RNA, 16 nt, Homo sapiens
uacuuuuuauacucca

SEQ ID NO: 685820 - RNA, 12 nt, Homo sapiens
uacuuuuugccc

SEQ ID NO: 685821 - RNA, 14 nt, Homo sapiens
uacuuuuuuacacu

SEQ ID NO: 685822 - RNA, 16 nt, Homo sapiens
uacuuuuuuacacuga

SEQ ID NO: 685823 - RNA, 22 nt, Homo sapiens
uacuuuuuucuuauuuaacuua

SEQ ID NO: 685824 - RNA, 20 nt, Homo sapiens
uacuuuuuuuuaguucaaua

SEQ ID NO: 685825 - RNA, 21 nt, Homo sapiens
uagaaaaaaaaauucacauga

SEQ ID NO: 685826 - RNA, 14 nt, Homo sapiens
uagaaaaagauucu

SEQ ID NO: 685827 - RNA, 14 nt, Homo sapiens
uagaaaaaggaaug

SEQ ID NO: 685828 - RNA, 17 nt, Homo sapiens
uagaaaaaucucauucc

SEQ ID NO: 685829 - RNA, 15 nt, Homo sapiens
uagaaaagugaauug

SEQ ID NO: 685830 - RNA, 17 nt, Homo sapiens
uagaaaauauaaguaaa

SEQ ID NO: 685831 - RNA, 23 nt, Homo sapiens
uagaaaaugacuuauuucugcuc

SEQ ID NO: 685832 - RNA, 12 nt, Homo sapiens
uagaaacaaaca

SEQ ID NO: 685833 - RNA, 12 nt, Homo sapiens
uagaaacccaag

SEQ ID NO: 685834 - RNA, 14 nt, Homo sapiens
uagaaagaaacuaa

SEQ ID NO: 685835 - RNA, 17 nt, Homo sapiens
uagaaagagaaacaguu

SEQ ID NO: 685836 - RNA, 17 nt, Homo sapiens
uagaaagccauauucca

SEQ ID NO: 685837 - RNA, 17 nt, Homo sapiens
uagaaaggacaacaguu

SEQ ID NO: 685838 - RNA, 17 nt, Homo sapiens
uagaaagggccuugaca

SEQ ID NO: 685839 - RNA, 14 nt, Homo sapiens
uagaaagggucccu

SEQ ID NO: 685840 - RNA, 12 nt, Homo sapiens
uagaaauaagcc

SEQ ID NO: 685841 - RNA, 20 nt, Homo sapiens
uagaaauagaacacugccuc

SEQ ID NO: 685842 - RNA, 12 nt, Homo sapiens
uagaaauggauu

SEQ ID NO: 685843 - RNA, 18 nt, Homo sapiens
uagaaauguaaacugcca

SEQ ID NO: 685844 - RNA, 11 nt, Homo sapiens
uuauguacaaa

SEQ ID NO: 685845 - RNA, 11 nt, Homo sapiens
uuauguacugc

SEQ ID NO: 685846 - RNA, 20 nt, Homo sapiens
uuauguaugaaaauuauucu

SEQ ID NO: 685847 - RNA, 23 nt, Homo sapiens
uuauguauuugaaaacucacaga

SEQ ID NO: 685848 - RNA, 14 nt, Homo sapiens
uuaugucuauaacu

SEQ ID NO: 685849 - RNA, 18 nt, Homo sapiens
uuaugugagccccuucag

SEQ ID NO: 685850 - RNA, 16 nt, Homo sapiens
uuaugugcaaguuuau

SEQ ID NO: 685851 - RNA, 20 nt, Homo sapiens
uuauguuuuaaacacaugcc

SEQ ID NO: 685852 - RNA, 19 nt, Homo sapiens
uuauuaaagguaugcauuu

SEQ ID NO: 685853 - RNA, 14 nt, Homo sapiens
uuauuaaaucaaaa

SEQ ID NO: 685854 - RNA, 22 nt, Homo sapiens
uuauuaacaguauaauuguguu

SEQ ID NO: 685855 - RNA, 13 nt, Homo sapiens
uuauuaacuacug

SEQ ID NO: 685856 - RNA, 14 nt, Homo sapiens
uuauuaacuuuaau

SEQ ID NO: 685857 - RNA, 16 nt, Homo sapiens
uuauuaagauguauaa

SEQ ID NO: 685858 - RNA, 18 nt, Homo sapiens
uuauuaagcuuuuuggaa

SEQ ID NO: 685859 - RNA, 16 nt, Homo sapiens
uuauuacaucuuucac

SEQ ID NO: 685860 - RNA, 15 nt, Homo sapiens
uuauuacucuauaca

SEQ ID NO: 685861 - RNA, 11 nt, Homo sapiens
uuauuacugaa

SEQ ID NO: 685862 - RNA, 18 nt, Homo sapiens
uuauuagaacauucacuu

SEQ ID NO: 685863 - RNA, 20 nt, Homo sapiens
uuauuauuucuguucuuaca

SEQ ID NO: 685864 - RNA, 23 nt, Homo sapiens
uuauucagaaccuaaaaguauua

SEQ ID NO: 685865 - RNA, 23 nt, Homo sapiens
uuauuccaagggaauauugccaa

SEQ ID NO: 685866 - RNA, 15 nt, Homo sapiens
uuauucccuuucaca

SEQ ID NO: 685867 - RNA, 15 nt, Homo sapiens
uuauuccuccaggaa

SEQ ID NO: 685868 - RNA, 13 nt, Homo sapiens
uuauuccuuugaa

SEQ ID NO: 685869 - RNA, 20 nt, Homo sapiens
uuauucuacaucauuaacca

SEQ ID NO: 685870 - RNA, 15 nt, Homo sapiens
uuauucucuucacuc

SEQ ID NO: 685871 - RNA, 18 nt, Homo sapiens
uuauucugccaaaccugu

SEQ ID NO: 685872 - RNA, 16 nt, Homo sapiens
uuauucugugguucua

SEQ ID NO: 685873 - RNA, 15 nt, Homo sapiens
uuauucuugguuuuc

SEQ ID NO: 685874 - RNA, 12 nt, Homo sapiens
uuauugaaucua

SEQ ID NO: 685875 - RNA, 14 nt, Homo sapiens
uuauugacacugaa

SEQ ID NO: 685876 - RNA, 12 nt, Homo sapiens
uuauugagcucu

SEQ ID NO: 685877 - RNA, 21 nt, Homo sapiens
uuauugcaaaguuguauucag

SEQ ID NO: 685878 - RNA, 12 nt, Homo sapiens
uuauugcauaau

SEQ ID NO: 685879 - RNA, 15 nt, Homo sapiens
uuauugcgcugcuac

SEQ ID NO: 685880 - RNA, 19 nt, Homo sapiens
uuauugucucugugacuga

SEQ ID NO: 685881 - RNA, 15 nt, Homo sapiens
uuauugucuguaaau

SEQ ID NO: 685882 - RNA, 22 nt, Homo sapiens
uuauuguguuuaagaaaguagc

SEQ ID NO: 685883 - RNA, 21 nt, Homo sapiens
uuauuuaggaaguugacuuau

SEQ ID NO: 685884 - RNA, 13 nt, Homo sapiens
uuauuuauuguau

SEQ ID NO: 685885 - RNA, 17 nt, Homo sapiens
uuauuuccacuugcccu

SEQ ID NO: 685886 - RNA, 13 nt, Homo sapiens
uuauuucugcucu

SEQ ID NO: 685887 - RNA, 17 nt, Homo sapiens
uuauuucugucacagua

SEQ ID NO: 685888 - RNA, 17 nt, Homo sapiens
uuauuugccagagccaa

SEQ ID NO: 685889 - RNA, 22 nt, Homo sapiens
uuauuuggaguuagguccucac

SEQ ID NO: 685890 - RNA, 16 nt, Homo sapiens
uuauuuuacagcucau

SEQ ID NO: 685891 - RNA, 14 nt, Homo sapiens
uuauuuuccaggua

SEQ ID NO: 685892 - RNA, 16 nt, Homo sapiens
uuauuuuuacaguucu

SEQ ID NO: 685893 - RNA, 19 nt, Homo sapiens
uuauuuuuauaucagccug

SEQ ID NO: 685894 - RNA, 17 nt, Homo sapiens
uuauuuuugaaacaaac

SEQ ID NO: 685895 - RNA, 14 nt, Homo sapiens
uuauuuuugcaaaa

SEQ ID NO: 685896 - RNA, 14 nt, Homo sapiens
uuauuuuugucaaa

SEQ ID NO: 685897 - RNA, 20 nt, Homo sapiens
uucaaaaaagucaacaaacu

SEQ ID NO: 685898 - RNA, 21 nt, Homo sapiens
uucaaaaacauuucaugcaau

SEQ ID NO: 685899 - RNA, 14 nt, Homo sapiens
uucaaaacauucau

SEQ ID NO: 685900 - RNA, 18 nt, Homo sapiens
uucaaaaccugcaguuaa

SEQ ID NO: 685901 - RNA, 13 nt, Homo sapiens
uucaaaagaagac

SEQ ID NO: 685902 - RNA, 13 nt, Homo sapiens
uucaaaagugauu

SEQ ID NO: 685903 - RNA, 15 nt, Homo sapiens
uucaaaagugauuau

SEQ ID NO: 685904 - RNA, 12 nt, Homo sapiens
uucaaaauaugu

SEQ ID NO: 685905 - RNA, 12 nt, Homo sapiens
uucaaaauucca

SEQ ID NO: 685906 - RNA, 22 nt, Homo sapiens
uucaaaauuuuguaaauaugca

SEQ ID NO: 685907 - RNA, 13 nt, Homo sapiens
uucaaaccaggau

SEQ ID NO: 685908 - RNA, 19 nt, Homo sapiens
uucaaaccugaccacagaa

SEQ ID NO: 685909 - RNA, 17 nt, Homo sapiens
uucaaacugcaugauuc

SEQ ID NO: 685910 - RNA, 19 nt, Homo sapiens
uucaaagacggaguauucu

SEQ ID NO: 685911 - RNA, 17 nt, Homo sapiens
uucaaagagacauauac

SEQ ID NO: 685912 - RNA, 22 nt, Homo sapiens
uucaaagagacauauacuaaga

SEQ ID NO: 685913 - RNA, 15 nt, Homo sapiens
uucaaagagucauau

SEQ ID NO: 685914 - RNA, 20 nt, Homo sapiens
uucaaagauuuuuauuuuga

SEQ ID NO: 685915 - RNA, 13 nt, Homo sapiens
uucaaagcacaga

SEQ ID NO: 685916 - RNA, 13 nt, Homo sapiens
uucaaagucucac

SEQ ID NO: 685917 - RNA, 20 nt, Homo sapiens
uucaaauccuuauuguucag

SEQ ID NO: 685918 - RNA, 23 nt, Homo sapiens
uucaaauccuuauuguucagagu

SEQ ID NO: 685919 - RNA, 23 nt, Homo sapiens
uucaaaucuacgguuaugaaggc

SEQ ID NO: 685920 - RNA, 18 nt, Homo sapiens
uucaaaugaaaauuccau

SEQ ID NO: 685921 - RNA, 17 nt, Homo sapiens
uucaaauuauaaaccaa

SEQ ID NO: 685922 - RNA, 14 nt, Homo sapiens
uucaacaaguaccu

SEQ ID NO: 685923 - RNA, 22 nt, Homo sapiens
uucaacagaugaccguguacaa

SEQ ID NO: 685924 - RNA, 16 nt, Homo sapiens
uucaacagggaagaaa

SEQ ID NO: 685925 - RNA, 12 nt, Homo sapiens
uucaacaugaca

SEQ ID NO: 685926 - RNA, 23 nt, Homo sapiens
uucaacauggucuaauuauuuac

SEQ ID NO: 685927 - RNA, 18 nt, Homo sapiens
uucaacccagcaaucuca

SEQ ID NO: 685928 - RNA, 22 nt, Homo sapiens
uucaacugccauguuuugccac

SEQ ID NO: 685929 - RNA, 16 nt, Homo sapiens
uucaagaaaaucuuug

SEQ ID NO: 685930 - RNA, 15 nt, Homo sapiens
uucaagaacauucua

SEQ ID NO: 685931 - RNA, 11 nt, Homo sapiens
uucaagaccag

SEQ ID NO: 685932 - RNA, 23 nt, Homo sapiens
uagaggauauugggucucagccc

SEQ ID NO: 685933 - RNA, 14 nt, Homo sapiens
uagaggcuuucaaa

SEQ ID NO: 685934 - RNA, 16 nt, Homo sapiens
uagagggaacagggcg

SEQ ID NO: 685935 - RNA, 22 nt, Homo sapiens
uagaggguagcuguggcuucua

SEQ ID NO: 685936 - RNA, 13 nt, Homo sapiens
uagaggugagaaa

SEQ ID NO: 685937 - RNA, 23 nt, Homo sapiens
uagaggugggcagcugggcccca

SEQ ID NO: 685938 - RNA, 19 nt, Homo sapiens
uagaguauauaaccuucau

SEQ ID NO: 685939 - RNA, 14 nt, Homo sapiens
uagagucaucucca

SEQ ID NO: 685940 - RNA, 15 nt, Homo sapiens
uagagucauuuacuc

SEQ ID NO: 685941 - RNA, 19 nt, Homo sapiens
uagagucggccaccacaga

SEQ ID NO: 685942 - RNA, 18 nt, Homo sapiens
uagagucuuaaagcauuu

SEQ ID NO: 685943 - RNA, 14 nt, Homo sapiens
uagaguggugcugc

SEQ ID NO: 685944 - RNA, 22 nt, Homo sapiens
uagaguguagccuaaagggcag

SEQ ID NO: 685945 - RNA, 17 nt, Homo sapiens
uagagugucucagggug

SEQ ID NO: 685946 - RNA, 18 nt, Homo sapiens
uagagugugguuaugaac

SEQ ID NO: 685947 - RNA, 20 nt, Homo sapiens
uagagugugguuaugaacuu

SEQ ID NO: 685948 - RNA, 13 nt, Homo sapiens
uagaguguuauca

SEQ ID NO: 685949 - RNA, 18 nt, Homo sapiens
uagaguguuaucagucau

SEQ ID NO: 685950 - RNA, 19 nt, Homo sapiens
uagaguuagcugauaagga

SEQ ID NO: 685951 - RNA, 14 nt, Homo sapiens
uagaguugggacaa

SEQ ID NO: 685952 - RNA, 21 nt, Homo sapiens
uagaguuuacuauuuuagcag

SEQ ID NO: 685953 - RNA, 20 nt, Homo sapiens
uagaguuuuaucaacuuugg

SEQ ID NO: 685954 - RNA, 21 nt, Homo sapiens
uagauacacuaaaaaucugag

SEQ ID NO: 685955 - RNA, 22 nt, Homo sapiens
uagauacucauuagugacuuca

SEQ ID NO: 685956 - RNA, 14 nt, Homo sapiens
uagauauacauauc

SEQ ID NO: 685957 - RNA, 14 nt, Homo sapiens
uagauauaugccuu

SEQ ID NO: 685958 - RNA, 16 nt, Homo sapiens
uagaucagaagacuac

SEQ ID NO: 685959 - RNA, 17 nt, Homo sapiens
uagauccagauccagac

SEQ ID NO: 685960 - RNA, 14 nt, Homo sapiens
uagaucuaguucuc

SEQ ID NO: 685961 - RNA, 16 nt, Homo sapiens
uagaucugucccuuaa

SEQ ID NO: 685962 - RNA, 19 nt, Homo sapiens
uagaucuuaaaaaaugaau

SEQ ID NO: 685963 - RNA, 13 nt, Homo sapiens
uagaucuuucuag

SEQ ID NO: 685964 - RNA, 17 nt, Homo sapiens
uagaugaccuuuuugca

SEQ ID NO: 685965 - RNA, 13 nt, Homo sapiens
uagaugacuacuu

SEQ ID NO: 685966 - RNA, 16 nt, Homo sapiens
uagaugauuucuagca

SEQ ID NO: 685967 - RNA, 22 nt, Homo sapiens
uuccaucagugaaaacauuucu

SEQ ID NO: 685968 - RNA, 16 nt, Homo sapiens
uuccaucaucacugua

SEQ ID NO: 685969 - RNA, 22 nt, Homo sapiens
uuccaucauuucugucuuuaag

SEQ ID NO: 685970 - RNA, 14 nt, Homo sapiens
uuccaugaaguuug

SEQ ID NO: 685971 - RNA, 18 nt, Homo sapiens
uuccaugacgacauacau

SEQ ID NO: 685972 - RNA, 22 nt, Homo sapiens
uuccaugagaacagcaggguag

SEQ ID NO: 685973 - RNA, 19 nt, Homo sapiens
uuccaugagaagaagcaga

SEQ ID NO: 685974 - RNA, 15 nt, Homo sapiens
uuccaugaugguuau

SEQ ID NO: 685975 - RNA, 14 nt, Homo sapiens
uuccaugauucuau

SEQ ID NO: 685976 - RNA, 12 nt, Homo sapiens
uuccauggaaau

SEQ ID NO: 685977 - RNA, 23 nt, Homo sapiens
uuccaugucgccucugcauucag

SEQ ID NO: 685978 - RNA, 15 nt, Homo sapiens
uuccauuagaacaaa

SEQ ID NO: 685979 - RNA, 16 nt, Homo sapiens
uuccauuaugauucuu

SEQ ID NO: 685980 - RNA, 13 nt, Homo sapiens
uuccauugccaua

SEQ ID NO: 685981 - RNA, 17 nt, Homo sapiens
uuccauuuacagucucu

SEQ ID NO: 685982 - RNA, 22 nt, Homo sapiens
uuccauuugugugugugcaagu

SEQ ID NO: 685983 - RNA, 23 nt, Homo sapiens
uuccauuuuuauuucaaaauaua

SEQ ID NO: 685984 - RNA, 20 nt, Homo sapiens
uucccaaauaaacucuaaac

SEQ ID NO: 685985 - RNA, 16 nt, Homo sapiens
uucccaagcccaugag

SEQ ID NO: 685986 - RNA, 20 nt, Homo sapiens
uucccaagcucuagugggaa

SEQ ID NO: 685987 - RNA, 17 nt, Homo sapiens
uucccaaguaugccuua

SEQ ID NO: 685988 - RNA, 23 nt, Homo sapiens
uucccaauuaggaaguguaacag

SEQ ID NO: 685989 - RNA, 23 nt, Homo sapiens
uucccacaaaagacagacccagu

SEQ ID NO: 685990 - RNA, 13 nt, Homo sapiens
uucccaccaacaa

SEQ ID NO: 685991 - RNA, 23 nt, Homo sapiens
uucccacccuccaccucucacgg

SEQ ID NO: 685992 - RNA, 20 nt, Homo sapiens
uucccaccugcuggagugaa

SEQ ID NO: 685993 - RNA, 12 nt, Homo sapiens
uucccacugcca

SEQ ID NO: 685994 - RNA, 22 nt, Homo sapiens
uucccacuggaggucacauuca

SEQ ID NO: 685995 - RNA, 20 nt, Homo sapiens
uucccacuugcagucuugua

SEQ ID NO: 685996 - RNA, 11 nt, Homo sapiens
uucccagagau

SEQ ID NO: 685997 - RNA, 19 nt, Homo sapiens
uucccagagauguugagaa

SEQ ID NO: 685998 - RNA, 23 nt, Homo sapiens
uucccaggagauggguccagggg

SEQ ID NO: 685999 - RNA, 21 nt, Homo sapiens
uucccaggccagcaagcucuu

SEQ ID NO: 686000 - RNA, 13 nt, Homo sapiens
uucccagguguua

SEQ ID NO: 686001 - RNA, 14 nt, Homo sapiens
uucccauccagcuc

SEQ ID NO: 686002 - RNA, 19 nt, Homo sapiens
uucccaucgcugucacagg

SEQ ID NO: 686003 - RNA, 17 nt, Homo sapiens
uucccaucugcaccccu

SEQ ID NO: 686004 - RNA, 20 nt, Homo sapiens
uucccauuguggcuccuauc

SEQ ID NO: 686005 - RNA, 17 nt, Homo sapiens
uucccauuugugccaga

SEQ ID NO: 686006 - RNA, 16 nt, Homo sapiens
uucccauuuuugcuua

SEQ ID NO: 686007 - RNA, 14 nt, Homo sapiens
uuccccaaccacag

SEQ ID NO: 686008 - RNA, 16 nt, Homo sapiens
uuccccaucuucuaaa

SEQ ID NO: 686009 - RNA, 19 nt, Homo sapiens
uucccccaccgguccagcu

SEQ ID NO: 686010 - RNA, 17 nt, Homo sapiens
uucccccugcaaaaaga

SEQ ID NO: 686011 - RNA, 19 nt, Homo sapiens
uucccccuuuucugcauuu

SEQ ID NO: 686012 - RNA, 23 nt, Homo sapiens
uuccccggggucuucuaccucag

SEQ ID NO: 686013 - RNA, 11 nt, Homo sapiens
uuccccugugg

SEQ ID NO: 686014 - RNA, 18 nt, Homo sapiens
uuccccuucccacacugu

SEQ ID NO: 686015 - RNA, 21 nt, Homo sapiens
uuccccuugcccagggcucag

SEQ ID NO: 686016 - RNA, 21 nt, Homo sapiens
uucccgacgacacauauacau

SEQ ID NO: 686017 - RNA, 18 nt, Homo sapiens
uucccuagaccuuggcau

SEQ ID NO: 686018 - RNA, 18 nt, Homo sapiens
uucccuaggaaacucaca

SEQ ID NO: 686019 - RNA, 17 nt, Homo sapiens
uucccuaggggacacuu

SEQ ID NO: 686020 - RNA, 20 nt, Homo sapiens
uucccuaucuucucccccac

SEQ ID NO: 686021 - RNA, 22 nt, Homo sapiens
uucccucucagcugcugggacg

SEQ ID NO: 686022 - RNA, 22 nt, Homo sapiens
uucccucucccggcaacaucuc

SEQ ID NO: 686023 - RNA, 23 nt, Homo sapiens
uucccucuuggugugauugcaca

SEQ ID NO: 686024 - RNA, 17 nt, Homo sapiens
uucccucuuuucuuacu

SEQ ID NO: 686025 - RNA, 20 nt, Homo sapiens
uucccugaaaacccagagag

SEQ ID NO: 686026 - RNA, 22 nt, Homo sapiens
uucccugaauguauugaacuug

SEQ ID NO: 686027 - RNA, 21 nt, Homo sapiens
uucccugaggaaugaaaaagg

SEQ ID NO: 686028 - RNA, 20 nt, Homo sapiens
uucccugauuuaauaugcaa

SEQ ID NO: 686029 - RNA, 18 nt, Homo sapiens
uucccugccacauccagc

SEQ ID NO: 686030 - RNA, 20 nt, Homo sapiens
uucccuguaugauuccuuga

SEQ ID NO: 686031 - RNA, 14 nt, Homo sapiens
uucccuguucuccc

SEQ ID NO: 686032 - RNA, 20 nt, Homo sapiens
uucccuugagaugaguuucu

SEQ ID NO: 686033 - RNA, 13 nt, Homo sapiens
uucccuugccauc

SEQ ID NO: 686034 - RNA, 20 nt, Homo sapiens
uucccuuuuaaucaacugua

SEQ ID NO: 686035 - RNA, 17 nt, Homo sapiens
uuccgagauccaccaga

SEQ ID NO: 686036 - RNA, 21 nt, Homo sapiens
uuccgauggaugaaucuccca

SEQ ID NO: 686037 - RNA, 23 nt, Homo sapiens
uuccgcaguguggccaggcugcc

SEQ ID NO: 686038 - RNA, 14 nt, Homo sapiens
uuccguaaacauau

SEQ ID NO: 686039 - RNA, 16 nt, Homo sapiens
uuccuaaaauggugau

SEQ ID NO: 686040 - RNA, 20 nt, Homo sapiens
uuccuaagccuguugcugaa

SEQ ID NO: 686041 - RNA, 22 nt, Homo sapiens
uuccuaaggcacccacaaauaa

SEQ ID NO: 686042 - RNA, 20 nt, Homo sapiens
uuccuaauaagugaagggaa

SEQ ID NO: 686043 - RNA, 19 nt, Homo sapiens
uuccuaauaugcuuuacaa

SEQ ID NO: 686044 - RNA, 14 nt, Homo sapiens
uucuacagcagaua

SEQ ID NO: 686045 - RNA, 17 nt, Homo sapiens
uucuacagcagcacugu

SEQ ID NO: 686046 - RNA, 13 nt, Homo sapiens
uucuaccagcuca

SEQ ID NO: 686047 - RNA, 15 nt, Homo sapiens
uucuaccauuugaau

SEQ ID NO: 686048 - RNA, 13 nt, Homo sapiens
uucuaccugcccu

SEQ ID NO: 686049 - RNA, 12 nt, Homo sapiens
uucuacuggaaa

SEQ ID NO: 686050 - RNA, 23 nt, Homo sapiens
uucuacuggaaaaaaauacaaaa

SEQ ID NO: 686051 - RNA, 22 nt, Homo sapiens
uucuacuguaucgccagugccu

SEQ ID NO: 686052 - RNA, 15 nt, Homo sapiens
uucuacugugacuga

SEQ ID NO: 686053 - RNA, 21 nt, Homo sapiens
uucuacuuuaagguuugcaga

SEQ ID NO: 686054 - RNA, 21 nt, Homo sapiens
uucuacuuuuuuugaugaccu

SEQ ID NO: 686055 - RNA, 22 nt, Homo sapiens
uucuagagcuuagcauaucuga

SEQ ID NO: 686056 - RNA, 19 nt, Homo sapiens
uucuagccccucuggauuc

SEQ ID NO: 686057 - RNA, 14 nt, Homo sapiens
uucuagguucaaaa

SEQ ID NO: 686058 - RNA, 22 nt, Homo sapiens
uucuagucuccuuugcacugag

SEQ ID NO: 686059 - RNA, 19 nt, Homo sapiens
uucuagugggaaggggugc

SEQ ID NO: 686060 - RNA, 19 nt, Homo sapiens
uucuaguucagcugcccca

SEQ ID NO: 686061 - RNA, 17 nt, Homo sapiens
uucuauaggaacauaug

SEQ ID NO: 686062 - RNA, 22 nt, Homo sapiens
uucuauauaguuccuugccuua

SEQ ID NO: 686063 - RNA, 21 nt, Homo sapiens
uucuaucccacccaacagcuc

SEQ ID NO: 686064 - RNA, 13 nt, Homo sapiens
uucuauugggaua

SEQ ID NO: 686065 - RNA, 14 nt, Homo sapiens
uucuauugggauau

SEQ ID NO: 686066 - RNA, 15 nt, Homo sapiens
uucuauuuauuuacu

SEQ ID NO: 686067 - RNA, 16 nt, Homo sapiens
uucucaagugccuuaa

SEQ ID NO: 686068 - RNA, 20 nt, Homo sapiens
uucucaauguucuuuuccaa

SEQ ID NO: 686069 - RNA, 23 nt, Homo sapiens
uucucacccaggcaaucuugccu

SEQ ID NO: 686070 - RNA, 21 nt, Homo sapiens
uucucagaaucucaaauaacu

SEQ ID NO: 686071 - RNA, 16 nt, Homo sapiens
uucucagucuccuuaa

SEQ ID NO: 686072 - RNA, 18 nt, Homo sapiens
uucucagugggacucuga

SEQ ID NO: 686073 - RNA, 16 nt, Homo sapiens
uucucaucauauugua

SEQ ID NO: 686074 - RNA, 16 nt, Homo sapiens
uucucaucccaaccuc

SEQ ID NO: 686075 - RNA, 20 nt, Homo sapiens
uucucaucuaaauauuucca

SEQ ID NO: 686076 - RNA, 22 nt, Homo sapiens
uucuccaaaacaauuuucugca

SEQ ID NO: 686077 - RNA, 20 nt, Homo sapiens
uucuccaaagaagauaugca

SEQ ID NO: 686078 - RNA, 14 nt, Homo sapiens
uucuccaaaugaga

SEQ ID NO: 686079 - RNA, 19 nt, Homo sapiens
uucuccaagcuuucagaca

SEQ ID NO: 686080 - RNA, 13 nt, Homo sapiens
uucuccaauauca

SEQ ID NO: 686081 - RNA, 21 nt, Homo sapiens
uucuccaccuagacuguaaac

SEQ ID NO: 686082 - RNA, 11 nt, Homo sapiens
uucuccacugg

SEQ ID NO: 686083 - RNA, 17 nt, Homo sapiens
uucuccagggaagaccc

SEQ ID NO: 686084 - RNA, 22 nt, Homo sapiens
uucuccagggguuuacagugaa

SEQ ID NO: 686085 - RNA, 20 nt, Homo sapiens
uucuccauacgcacugguau

SEQ ID NO: 686086 - RNA, 15 nt, Homo sapiens
uucuccccaggguag

SEQ ID NO: 686087 - RNA, 19 nt, Homo sapiens
uucucccucacuccugcca

SEQ ID NO: 686088 - RNA, 16 nt, Homo sapiens
uucucccucgacauuu

SEQ ID NO: 686089 - RNA, 13 nt, Homo sapiens
uucucccuguaaa

SEQ ID NO: 686090 - RNA, 23 nt, Homo sapiens
uucucccuguacaguguuaccau

SEQ ID NO: 686091 - RNA, 17 nt, Homo sapiens
uucuccuaugucuuuca

SEQ ID NO: 686092 - RNA, 17 nt, Homo sapiens
uucuccuccugucuuua

SEQ ID NO: 686093 - RNA, 11 nt, Homo sapiens
uucuccugacc

SEQ ID NO: 686094 - RNA, 13 nt, Homo sapiens
uucuccugccuca

SEQ ID NO: 686095 - RNA, 22 nt, Homo sapiens
uucuccugugaauggaggcaga

SEQ ID NO: 686096 - RNA, 19 nt, Homo sapiens
uucuccuguuuauucccau

SEQ ID NO: 686097 - RNA, 16 nt, Homo sapiens
uucucggcucagguuu

SEQ ID NO: 686098 - RNA, 18 nt, Homo sapiens
uucucgggguccagugca

SEQ ID NO: 686099 - RNA, 18 nt, Homo sapiens
uucucgugacaccaccaa

SEQ ID NO: 686100 - RNA, 19 nt, Homo sapiens
uucucgugguagaagccag

SEQ ID NO: 686101 - RNA, 20 nt, Homo sapiens
uucucgugguagaagccagu

SEQ ID NO: 686102 - RNA, 16 nt, Homo sapiens
uucucguuuucacagg

SEQ ID NO: 686103 - RNA, 22 nt, Homo sapiens
uucucuaauauggcaaccauua

SEQ ID NO: 686104 - RNA, 15 nt, Homo sapiens
uucucuacagacucc

SEQ ID NO: 686105 - RNA, 16 nt, Homo sapiens
uucucuacagacucca

SEQ ID NO: 686106 - RNA, 20 nt, Homo sapiens
uucucuauuagacuuuagaa

SEQ ID NO: 686107 - RNA, 15 nt, Homo sapiens
uucucuauugcugcu

SEQ ID NO: 686108 - RNA, 22 nt, Homo sapiens
uucucucacuguguuacugcuu

SEQ ID NO: 686109 - RNA, 20 nt, Homo sapiens
uucucucacuuugauuugcu

SEQ ID NO: 686110 - RNA, 22 nt, Homo sapiens
uucucucccuuccucucuccuu

SEQ ID NO: 686111 - RNA, 22 nt, Homo sapiens
uucucuccugugugcuugucag

SEQ ID NO: 686112 - RNA, 17 nt, Homo sapiens
uucucucuuaguaacau

SEQ ID NO: 686113 - RNA, 18 nt, Homo sapiens
uucucucuuguuguccag

SEQ ID NO: 686114 - RNA, 14 nt, Homo sapiens
uucucugaacacau

SEQ ID NO: 686115 - RNA, 15 nt, Homo sapiens
uucucugaucuccau

SEQ ID NO: 686116 - RNA, 18 nt, Homo sapiens
uucucugccuucuuccag

SEQ ID NO: 686117 - RNA, 22 nt, Homo sapiens
uucucugcuccagguucacuuu

SEQ ID NO: 686118 - RNA, 22 nt, Homo sapiens
uucucugggccuucucaccaca

SEQ ID NO: 686119 - RNA, 19 nt, Homo sapiens
uucucuguaugaaugugau

SEQ ID NO: 686120 - RNA, 13 nt, Homo sapiens
uucucugugcucu

SEQ ID NO: 686121 - RNA, 21 nt, Homo sapiens
uucucuguguuuguuccuaca

SEQ ID NO: 686122 - RNA, 20 nt, Homo sapiens
uucucuuaaucacuacugua

SEQ ID NO: 686123 - RNA, 21 nt, Homo sapiens
uucucuuagaacauuguauua

SEQ ID NO: 686124 - RNA, 15 nt, Homo sapiens
uucucuucauccauu

SEQ ID NO: 686125 - RNA, 13 nt, Homo sapiens
uucucuuccuccc

SEQ ID NO: 686126 - RNA, 14 nt, Homo sapiens
uucucuuccuucac

SEQ ID NO: 686127 - RNA, 19 nt, Homo sapiens
uucucuucuuuauugcacu

SEQ ID NO: 686128 - RNA, 21 nt, Homo sapiens
uucucuugaaaaguucaggga

SEQ ID NO: 686129 - RNA, 18 nt, Homo sapiens
uucucuugacguuuacau

SEQ ID NO: 686130 - RNA, 17 nt, Homo sapiens
uucucuugagcuggccu

SEQ ID NO: 686131 - RNA, 13 nt, Homo sapiens
uucucuuucuccc

SEQ ID NO: 686132 - RNA, 22 nt, Homo sapiens
uucucuuugcugcuggugcuaa

SEQ ID NO: 686133 - RNA, 17 nt, Homo sapiens
uucucuuugguguuaca

SEQ ID NO: 686134 - RNA, 20 nt, Homo sapiens
uucucuuuuccuuugguccu

SEQ ID NO: 686135 - RNA, 13 nt, Homo sapiens
uucugaaacacac

SEQ ID NO: 686136 - RNA, 14 nt, Homo sapiens
uucugaaaugugca

SEQ ID NO: 686137 - RNA, 23 nt, Homo sapiens
uucugaaauuaaaguaugcaaaa

SEQ ID NO: 686138 - RNA, 16 nt, Homo sapiens
uucugaagacugagaa

SEQ ID NO: 686139 - RNA, 18 nt, Homo sapiens
uucugacacuuucugcug

SEQ ID NO: 686140 - RNA, 21 nt, Homo sapiens
uucugacacuuucugcuggaa

SEQ ID NO: 686141 - RNA, 16 nt, Homo sapiens
uucugaccacagcauc

SEQ ID NO: 686142 - RNA, 11 nt, Homo sapiens
uucugacccac

SEQ ID NO: 686143 - RNA, 23 nt, Homo sapiens
uucugaccccacuuaugcugcug

SEQ ID NO: 686144 - RNA, 22 nt, Homo sapiens
uucugagaguuggcucaggcag

SEQ ID NO: 686145 - RNA, 20 nt, Homo sapiens
uucugagcuguaucuugaug

SEQ ID NO: 686146 - RNA, 17 nt, Homo sapiens
uucugauaccacugcac

SEQ ID NO: 686147 - RNA, 21 nt, Homo sapiens
uucugaucucagagcauuuca

SEQ ID NO: 686148 - RNA, 21 nt, Homo sapiens
uucugauggccaaaauaccaa

SEQ ID NO: 686149 - RNA, 14 nt, Homo sapiens
uucugauguauuac

SEQ ID NO: 686150 - RNA, 18 nt, Homo sapiens
uucugauguuacugagau

SEQ ID NO: 686151 - RNA, 17 nt, Homo sapiens
uucugauuggugauuca

SEQ ID NO: 686152 - RNA, 17 nt, Homo sapiens
uucugcauauguugaau

SEQ ID NO: 686153 - RNA, 21 nt, Homo sapiens
uucugcauguucauugcaaac

SEQ ID NO: 686154 - RNA, 22 nt, Homo sapiens
uucugccaccccuaaacuccag

SEQ ID NO: 686155 - RNA, 21 nt, Homo sapiens
uucugccuugguucuggccac

SEQ ID NO: 686156 - RNA, 18 nt, Homo sapiens
uucugcuagagcagacag

SEQ ID NO: 686157 - RNA, 19 nt, Homo sapiens
uucugcuccucuccaggca

SEQ ID NO: 686158 - RNA, 22 nt, Homo sapiens
uucugcucugguuagaaaaagg

SEQ ID NO: 686159 - RNA, 21 nt, Homo sapiens
uucugcugaaggacagaacau

SEQ ID NO: 686160 - RNA, 13 nt, Homo sapiens
uucugcuguucuu

SEQ ID NO: 686161 - RNA, 22 nt, Homo sapiens
uucugcuguugccucucuuuga

SEQ ID NO: 686162 - RNA, 19 nt, Homo sapiens
uucugcuuuaucuuuucau

SEQ ID NO: 686163 - RNA, 18 nt, Homo sapiens
uucuggagucuccagugg

SEQ ID NO: 686164 - RNA, 23 nt, Homo sapiens
uucugggagacacccaaagggug

SEQ ID NO: 686165 - RNA, 19 nt, Homo sapiens
uucugggucaugcacugag

SEQ ID NO: 686166 - RNA, 18 nt, Homo sapiens
uucuggguccauacacca

SEQ ID NO: 686167 - RNA, 22 nt, Homo sapiens
uucugguagcauauucaugguu

SEQ ID NO: 686168 - RNA, 22 nt, Homo sapiens
uucuggucuggcggcugugcau

SEQ ID NO: 686169 - RNA, 17 nt, Homo sapiens
uucuggugucugcucag

SEQ ID NO: 686170 - RNA, 13 nt, Homo sapiens
uucugguuccaaa

SEQ ID NO: 686171 - RNA, 11 nt, Homo sapiens
uucuguaaaac

SEQ ID NO: 686172 - RNA, 16 nt, Homo sapiens
uucuguaaaacagguu

SEQ ID NO: 686173 - RNA, 16 nt, Homo sapiens
uucuguaaacugugcu

SEQ ID NO: 686174 - RNA, 15 nt, Homo sapiens
uucuguacucaaaug

SEQ ID NO: 686175 - RNA, 15 nt, Homo sapiens
uucuguagcaccaga

SEQ ID NO: 686176 - RNA, 15 nt, Homo sapiens
uucugucagaaucac

SEQ ID NO: 686177 - RNA, 17 nt, Homo sapiens
uucugucagaaucacau

SEQ ID NO: 686178 - RNA, 19 nt, Homo sapiens
uucuguccaccagacccac

SEQ ID NO: 686179 - RNA, 15 nt, Homo sapiens
uucuguccaggacau

SEQ ID NO: 686180 - RNA, 20 nt, Homo sapiens
uucuguccgagcuuugaaaa

SEQ ID NO: 686181 - RNA, 21 nt, Homo sapiens
uucuguccuuuuggcacugag

SEQ ID NO: 686182 - RNA, 21 nt, Homo sapiens
uucugucuucccaaacccagu

SEQ ID NO: 686183 - RNA, 23 nt, Homo sapiens
uucugugcagagaugacugucca

SEQ ID NO: 686184 - RNA, 21 nt, Homo sapiens
uucuguggaccacugcaugag

SEQ ID NO: 686185 - RNA, 12 nt, Homo sapiens
uucuguggcuca

SEQ ID NO: 686186 - RNA, 22 nt, Homo sapiens
uucugugggagaauucuuacau

SEQ ID NO: 686187 - RNA, 19 nt, Homo sapiens
uucugugguuucauguuag

SEQ ID NO: 686188 - RNA, 15 nt, Homo sapiens
uucuguguugccaag

SEQ ID NO: 686189 - RNA, 15 nt, Homo sapiens
uucuguucaucuuaa

SEQ ID NO: 686190 - RNA, 18 nt, Homo sapiens
uucuguucucccugggaa

SEQ ID NO: 686191 - RNA, 16 nt, Homo sapiens
uucuguugaaguuuac

SEQ ID NO: 686192 - RNA, 12 nt, Homo sapiens
uucuguugccaa

SEQ ID NO: 686193 - RNA, 19 nt, Homo sapiens
uucuguuggaugacuuuga

SEQ ID NO: 686194 - RNA, 21 nt, Homo sapiens
uucuguuggaugacuuugaga

SEQ ID NO: 686195 - RNA, 14 nt, Homo sapiens
uucuguuuggcacu

SEQ ID NO: 686196 - RNA, 22 nt, Homo sapiens
uucuguuuuguuguuugauuca

SEQ ID NO: 686197 - RNA, 17 nt, Homo sapiens
uucuuaaaaaacauaua

SEQ ID NO: 686198 - RNA, 17 nt, Homo sapiens
uucuuaaagaguucuua

SEQ ID NO: 686199 - RNA, 22 nt, Homo sapiens
uucuuaaauggaauuauuuuga

SEQ ID NO: 686200 - RNA, 13 nt, Homo sapiens
uucuuaacagauc

SEQ ID NO: 686201 - RNA, 21 nt, Homo sapiens
uucuuaagugcccacauuuga

SEQ ID NO: 686202 - RNA, 18 nt, Homo sapiens
uucuuaauccaguucugc

SEQ ID NO: 686203 - RNA, 21 nt, Homo sapiens
uucuuaauccaguucugcaaa

SEQ ID NO: 686204 - RNA, 16 nt, Homo sapiens
uucuuacaauugcacu

SEQ ID NO: 686205 - RNA, 19 nt, Homo sapiens
uucuuacaauugcacugcu

SEQ ID NO: 686206 - RNA, 14 nt, Homo sapiens
uucuuacaugcauu

SEQ ID NO: 686207 - RNA, 17 nt, Homo sapiens
uucuuacaugcauuuga

SEQ ID NO: 686208 - RNA, 14 nt, Homo sapiens
uucuuacuguagua

SEQ ID NO: 686209 - RNA, 14 nt, Homo sapiens
uucuuagucauuac

SEQ ID NO: 686210 - RNA, 14 nt, Homo sapiens
uucuuaguucauau

SEQ ID NO: 686211 - RNA, 22 nt, Homo sapiens
uucuuauagaaccccuucugac

SEQ ID NO: 686212 - RNA, 14 nt, Homo sapiens
uucuuauagaguau

SEQ ID NO: 686213 - RNA, 15 nt, Homo sapiens
uucuuauuaauuuca

SEQ ID NO: 686214 - RNA, 14 nt, Homo sapiens
uucuucaaaucuca

SEQ ID NO: 686215 - RNA, 18 nt, Homo sapiens
uucuucaacaugcuccaa

SEQ ID NO: 686216 - RNA, 13 nt, Homo sapiens
uucuucaaccuca

SEQ ID NO: 686217 - RNA, 19 nt, Homo sapiens
uucuucacagugcagugaa

SEQ ID NO: 686218 - RNA, 11 nt, Homo sapiens
uucuucacucu

SEQ ID NO: 686219 - RNA, 11 nt, Homo sapiens
uucuucacuua

SEQ ID NO: 686220 - RNA, 17 nt, Homo sapiens
uucuucagcuugauccu

SEQ ID NO: 686221 - RNA, 14 nt, Homo sapiens
uucuucagggccag

SEQ ID NO: 686222 - RNA, 19 nt, Homo sapiens
uucuucagguaacacuaca

SEQ ID NO: 686223 - RNA, 20 nt, Homo sapiens
uucuucaggucguagcauuu

SEQ ID NO: 686224 - RNA, 17 nt, Homo sapiens
uucuucaugcaaugaca

SEQ ID NO: 686225 - RNA, 12 nt, Homo sapiens
uucuuccagaau

SEQ ID NO: 686226 - RNA, 21 nt, Homo sapiens
uucuuccaucaucacuguaaa

SEQ ID NO: 686227 - RNA, 18 nt, Homo sapiens
uucuuccccgaaucacac

SEQ ID NO: 686228 - RNA, 16 nt, Homo sapiens
uucuucccuacaguug

SEQ ID NO: 686229 - RNA, 20 nt, Homo sapiens
uucuucguacauagucuguu

SEQ ID NO: 686230 - RNA, 17 nt, Homo sapiens
uucuucucuuaauuuca

SEQ ID NO: 686231 - RNA, 13 nt, Homo sapiens
uucuucuugcuac

SEQ ID NO: 686232 - RNA, 16 nt, Homo sapiens
uucuugaaccaauaau

SEQ ID NO: 686233 - RNA, 18 nt, Homo sapiens
uucuugacaaaaccuaac

SEQ ID NO: 686234 - RNA, 14 nt, Homo sapiens
uucuugcaucuaau

SEQ ID NO: 686235 - RNA, 21 nt, Homo sapiens
uucuugccugaacuccugcca

SEQ ID NO: 686236 - RNA, 12 nt, Homo sapiens
uucuugcuccaa

SEQ ID NO: 686237 - RNA, 18 nt, Homo sapiens
uucuugcuggcucugaga

SEQ ID NO: 686238 - RNA, 16 nt, Homo sapiens
uucuuggcuucuggga

SEQ ID NO: 686239 - RNA, 16 nt, Homo sapiens
uucuugggaaacaccc

SEQ ID NO: 686240 - RNA, 15 nt, Homo sapiens
uucuugggucugccc

SEQ ID NO: 686241 - RNA, 18 nt, Homo sapiens
uucuuggugguggaugac

SEQ ID NO: 686242 - RNA, 22 nt, Homo sapiens
uucuugguucuuuuuucaguua

SEQ ID NO: 686243 - RNA, 15 nt, Homo sapiens
uucuuguagaugcau

SEQ ID NO: 686244 - RNA, 13 nt, Homo sapiens
uucuuguauugua

SEQ ID NO: 686245 - RNA, 22 nt, Homo sapiens
uucuuuaaaaaacaacuaugga

SEQ ID NO: 686246 - RNA, 18 nt, Homo sapiens
uucuuuaauguuguccag

SEQ ID NO: 686247 - RNA, 20 nt, Homo sapiens
uucuuuaccaaggauauuua

SEQ ID NO: 686248 - RNA, 12 nt, Homo sapiens
uucuuuaccuca

SEQ ID NO: 686249 - RNA, 19 nt, Homo sapiens
uucuuuauaaaauguauaa

SEQ ID NO: 686250 - RNA, 15 nt, Homo sapiens
uucuuuauaucugaa

SEQ ID NO: 686251 - RNA, 12 nt, Homo sapiens
uucuuucacuug

SEQ ID NO: 686252 - RNA, 13 nt, Homo sapiens
uucuuuccucaca

SEQ ID NO: 686253 - RNA, 14 nt, Homo sapiens
uucuuucuguugaa

SEQ ID NO: 686254 - RNA, 20 nt, Homo sapiens
uucuuugacauuugguggua

SEQ ID NO: 686255 - RNA, 16 nt, Homo sapiens
uucuuugcaccaaaga

SEQ ID NO: 686256 - RNA, 13 nt, Homo sapiens
uucuuugcugcug

SEQ ID NO: 686257 - RNA, 12 nt, Homo sapiens
uucuuuggucaa

SEQ ID NO: 686258 - RNA, 21 nt, Homo sapiens
uucuuuuccaagcuccuuauu

SEQ ID NO: 686259 - RNA, 13 nt, Homo sapiens
uucuuuucucuca

SEQ ID NO: 686260 - RNA, 19 nt, Homo sapiens
uucuuuugaacauccccac

SEQ ID NO: 686261 - RNA, 16 nt, Homo sapiens
uucuuuuggcuuccau

SEQ ID NO: 686262 - RNA, 18 nt, Homo sapiens
uucuuuuucguuggugua

SEQ ID NO: 686263 - RNA, 18 nt, Homo sapiens
uucuuuuuugcccccaga

SEQ ID NO: 686264 - RNA, 21 nt, Homo sapiens
uugaaaaaaacuucauucucg

SEQ ID NO: 686265 - RNA, 18 nt, Homo sapiens
uugaaaaacaacugcaua

SEQ ID NO: 686266 - RNA, 19 nt, Homo sapiens
uugaaaaggguaggcacga

SEQ ID NO: 686267 - RNA, 13 nt, Homo sapiens
uugaaaagucaaa

SEQ ID NO: 686268 - RNA, 19 nt, Homo sapiens
uugaaaauauuucuaugua

SEQ ID NO: 686269 - RNA, 15 nt, Homo sapiens
uugaaacaaagaagg

SEQ ID NO: 686270 - RNA, 21 nt, Homo sapiens
uugaaaccagaagaaguguga

SEQ ID NO: 686271 - RNA, 16 nt, Homo sapiens
uugaaacugcauuugu

SEQ ID NO: 686272 - RNA, 13 nt, Homo sapiens
uugaaagaaccag

SEQ ID NO: 686273 - RNA, 15 nt, Homo sapiens
uugaaagaaccagag

SEQ ID NO: 686274 - RNA, 16 nt, Homo sapiens
uugaaagaaccagaga

SEQ ID NO: 686275 - RNA, 11 nt, Homo sapiens
uugaaagaaga

SEQ ID NO: 686276 - RNA, 13 nt, Homo sapiens
uugaaagauuaca

SEQ ID NO: 686277 - RNA, 16 nt, Homo sapiens
uugaaagcauccaugu

SEQ ID NO: 686278 - RNA, 22 nt, Homo sapiens
uugaaagcugaaaagcauacaa

SEQ ID NO: 686279 - RNA, 21 nt, Homo sapiens
uugaaaggagaugucuuggaa

SEQ ID NO: 686280 - RNA, 22 nt, Homo sapiens
uugaaaggccaacagcaagugu

SEQ ID NO: 686281 - RNA, 16 nt, Homo sapiens
uugaaauaagaauuca

SEQ ID NO: 686282 - RNA, 17 nt, Homo sapiens
uugaaauaccagugaac

SEQ ID NO: 686283 - RNA, 14 nt, Homo sapiens
uugaaauaguugau

SEQ ID NO: 686284 - RNA, 20 nt, Homo sapiens
uugaaauauaguaaacacuu

SEQ ID NO: 686285 - RNA, 14 nt, Homo sapiens
uugaaauaucaugu

SEQ ID NO: 686286 - RNA, 23 nt, Homo sapiens
uugaaauauucagaaauucucca

SEQ ID NO: 686287 - RNA, 18 nt, Homo sapiens
uugaaauuugccuugagu

SEQ ID NO: 686288 - RNA, 21 nt, Homo sapiens
uugaacaaaaauguuuccacu

SEQ ID NO: 686289 - RNA, 17 nt, Homo sapiens
uuuaagaguuacuuaau

SEQ ID NO: 686290 - RNA, 18 nt, Homo sapiens
uuuaagccugcauucuua

SEQ ID NO: 686291 - RNA, 19 nt, Homo sapiens
uuuaagccugcggcgccag

SEQ ID NO: 686292 - RNA, 11 nt, Homo sapiens
uuuaagcucaa

SEQ ID NO: 686293 - RNA, 13 nt, Homo sapiens
uuuaaggcaaaaa

SEQ ID NO: 686294 - RNA, 23 nt, Homo sapiens
uuuaagggauugcuuucaucuaa

SEQ ID NO: 686295 - RNA, 23 nt, Homo sapiens
uuuaagggggaaaacuguucucu

SEQ ID NO: 686296 - RNA, 19 nt, Homo sapiens
uuuaagguuuuuacuguga

SEQ ID NO: 686297 - RNA, 14 nt, Homo sapiens
uuuaaguaguaaga

SEQ ID NO: 686298 - RNA, 13 nt, Homo sapiens
uuuaaguugugau

SEQ ID NO: 686299 - RNA, 21 nt, Homo sapiens
uuuaauaaauugcuuacugau

SEQ ID NO: 686300 - RNA, 15 nt, Homo sapiens
uuuaauacaggguag

SEQ ID NO: 686301 - RNA, 14 nt, Homo sapiens
uuuaauagcaaaga

SEQ ID NO: 686302 - RNA, 16 nt, Homo sapiens
uuuaauauacuuuaaa

SEQ ID NO: 686303 - RNA, 14 nt, Homo sapiens
uuuaauauaugcau

SEQ ID NO: 686304 - RNA, 21 nt, Homo sapiens
uuuaauaucaacucucacucc

SEQ ID NO: 686305 - RNA, 15 nt, Homo sapiens
uuuaauaugcuuaaa

SEQ ID NO: 686306 - RNA, 19 nt, Homo sapiens
uuuaauauuuuauucucau

SEQ ID NO: 686307 - RNA, 19 nt, Homo sapiens
uuuaaucauuuugccucuu

SEQ ID NO: 686308 - RNA, 15 nt, Homo sapiens
uuuaaucccauugca

SEQ ID NO: 686309 - RNA, 22 nt, Homo sapiens
uuuaaucucuuaauauugagaa

SEQ ID NO: 686310 - RNA, 12 nt, Homo sapiens
uuuaaucugcac

SEQ ID NO: 686311 - RNA, 21 nt, Homo sapiens
uuuaaugaacuaccaucugau

SEQ ID NO: 686312 - RNA, 18 nt, Homo sapiens
uuuaauggaaaguuguau

SEQ ID NO: 686313 - RNA, 15 nt, Homo sapiens
uuuaauggcauguca

SEQ ID NO: 686314 - RNA, 17 nt, Homo sapiens
uuuaauguuuccuuuaa

SEQ ID NO: 686315 - RNA, 22 nt, Homo sapiens
uuuaauuauaaucucuucuuau

SEQ ID NO: 686316 - RNA, 16 nt, Homo sapiens
uuuaauugauuauucu

SEQ ID NO: 686317 - RNA, 15 nt, Homo sapiens
uuuaauugcauuuaa

SEQ ID NO: 686318 - RNA, 12 nt, Homo sapiens
uuuaauuugcua

SEQ ID NO: 686319 - RNA, 15 nt, Homo sapiens
uuuaauuuuaguuuc

SEQ ID NO: 686320 - RNA, 14 nt, Homo sapiens
uuuacaaaccauua

SEQ ID NO: 686321 - RNA, 21 nt, Homo sapiens
uuuacaaagcaucucauucau

SEQ ID NO: 686322 - RNA, 23 nt, Homo sapiens
uuucaauaacaaagcacauaacu

SEQ ID NO: 686323 - RNA, 15 nt, Homo sapiens
uuucaaugaccugua

SEQ ID NO: 686324 - RNA, 18 nt, Homo sapiens
uuucaaugguugggacaa

SEQ ID NO: 686325 - RNA, 14 nt, Homo sapiens
uuucaaugugaaac

SEQ ID NO: 686326 - RNA, 15 nt, Homo sapiens
uuucaauuacaaagc

SEQ ID NO: 686327 - RNA, 15 nt, Homo sapiens
uuucaauugucacuu

SEQ ID NO: 686328 - RNA, 18 nt, Homo sapiens
uuucaauuugagauucua

SEQ ID NO: 686329 - RNA, 16 nt, Homo sapiens
uuucaauuuuaaacau

SEQ ID NO: 686330 - RNA, 21 nt, Homo sapiens
uuucacaaaaaggcauaugca

SEQ ID NO: 686331 - RNA, 14 nt, Homo sapiens
uuucacacagugaa

SEQ ID NO: 686332 - RNA, 16 nt, Homo sapiens
uuucacacagugaaac

SEQ ID NO: 686333 - RNA, 15 nt, Homo sapiens
uuucacagucacuga

SEQ ID NO: 686334 - RNA, 20 nt, Homo sapiens
uuucaccccacagacacuua

SEQ ID NO: 686335 - RNA, 15 nt, Homo sapiens
uuucacccucaugaa

SEQ ID NO: 686336 - RNA, 20 nt, Homo sapiens
uuucacgcaugugugcugca

SEQ ID NO: 686337 - RNA, 23 nt, Homo sapiens
uuucacggggccgugacagugac

SEQ ID NO: 686338 - RNA, 20 nt, Homo sapiens
uuucagaaauuccaacuccu

SEQ ID NO: 686339 - RNA, 17 nt, Homo sapiens
uuucagaagcaagccag

SEQ ID NO: 686340 - RNA, 15 nt, Homo sapiens
uuucagaagcauuca

SEQ ID NO: 686341 - RNA, 16 nt, Homo sapiens
uuucagaagcauucag

SEQ ID NO: 686342 - RNA, 23 nt, Homo sapiens
uuucagaagugagcuuugcugcu

SEQ ID NO: 686343 - RNA, 19 nt, Homo sapiens
uuucagacuuuaaaauucu

SEQ ID NO: 686344 - RNA, 20 nt, Homo sapiens
uuucagagaaaggacugugg

SEQ ID NO: 686345 - RNA, 17 nt, Homo sapiens
uuucagauaaacaacaa

SEQ ID NO: 686346 - RNA, 21 nt, Homo sapiens
uuucagaucauauuucacaau

SEQ ID NO: 686347 - RNA, 14 nt, Homo sapiens
uuucagcacauucu

SEQ ID NO: 686348 - RNA, 21 nt, Homo sapiens
uuucagcccccccacuccagc

SEQ ID NO: 686349 - RNA, 17 nt, Homo sapiens
uuucagcgauguaugca

SEQ ID NO: 686350 - RNA, 19 nt, Homo sapiens
uuucagcuccuucaaugca

SEQ ID NO: 686351 - RNA, 20 nt, Homo sapiens
uuucagcuccuucaaugcaa

SEQ ID NO: 686352 - RNA, 21 nt, Homo sapiens
uuucaggaaaauguauugauu

SEQ ID NO: 686353 - RNA, 13 nt, Homo sapiens
uuucagggccagg

SEQ ID NO: 686354 - RNA, 18 nt, Homo sapiens
uuucagguuccaaucaga

SEQ ID NO: 686355 - RNA, 19 nt, Homo sapiens
uuucagguuccaaucagaa

SEQ ID NO: 686356 - RNA, 16 nt, Homo sapiens
uuucaguauacugugu

SEQ ID NO: 686357 - RNA, 22 nt, Homo sapiens
uuucagugcugugucauuccaa

SEQ ID NO: 686358 - RNA, 18 nt, Homo sapiens
uuucaguggacuaucuua

SEQ ID NO: 686359 - RNA, 16 nt, Homo sapiens
uuucauaauaccucac

SEQ ID NO: 686360 - RNA, 15 nt, Homo sapiens
uuucauacuauuuag

SEQ ID NO: 686361 - RNA, 20 nt, Homo sapiens
uuucauacuguaacauucag

SEQ ID NO: 686362 - RNA, 19 nt, Homo sapiens
uuucauagagauuugucua

SEQ ID NO: 686363 - RNA, 18 nt, Homo sapiens
uuucauagcgaguuuucu

SEQ ID NO: 686364 - RNA, 21 nt, Homo sapiens
uuucauagcgaguuuucugac

SEQ ID NO: 686365 - RNA, 12 nt, Homo sapiens
uuucauaguuuc

SEQ ID NO: 686366 - RNA, 19 nt, Homo sapiens
uuucauccauaacugaaca

SEQ ID NO: 686367 - RNA, 13 nt, Homo sapiens
uuucauccuccuu

SEQ ID NO: 686368 - RNA, 20 nt, Homo sapiens
uuucauguaacauacauauu

SEQ ID NO: 686369 - RNA, 14 nt, Homo sapiens
uuucauguacagca

SEQ ID NO: 686370 - RNA, 19 nt, Homo sapiens
uuucauguauguauauaau

SEQ ID NO: 686371 - RNA, 21 nt, Homo sapiens
uuucauguggcuguagauccc

SEQ ID NO: 686372 - RNA, 19 nt, Homo sapiens
uuucauguuuuugaucaaa

SEQ ID NO: 686373 - RNA, 14 nt, Homo sapiens
uuucauucauccca

SEQ ID NO: 686374 - RNA, 18 nt, Homo sapiens
uuucauugaugagcaaga

SEQ ID NO: 686375 - RNA, 12 nt, Homo sapiens
uuucauuucuca

SEQ ID NO: 686376 - RNA, 12 nt, Homo sapiens
uuucauuugcca

SEQ ID NO: 686377 - RNA, 16 nt, Homo sapiens
uuuccaaaacauuucu

SEQ ID NO: 686378 - RNA, 19 nt, Homo sapiens
uuuccaaaucccuuucaug

SEQ ID NO: 686379 - RNA, 15 nt, Homo sapiens
uuuccaaauucacaa

SEQ ID NO: 686380 - RNA, 16 nt, Homo sapiens
uuuccaacacaucuau

SEQ ID NO: 686381 - RNA, 20 nt, Homo sapiens
uuuccacucaaaauauguca

SEQ ID NO: 686382 - RNA, 19 nt, Homo sapiens
uuuccagacuuccuugaga

SEQ ID NO: 686383 - RNA, 15 nt, Homo sapiens
uuuccagauauucaa

SEQ ID NO: 686384 - RNA, 19 nt, Homo sapiens
uuuccaggagacauauaua

SEQ ID NO: 686385 - RNA, 10 nt, Homo sapiens
uuuccaggga

SEQ ID NO: 686386 - RNA, 11 nt, Homo sapiens
uuuccagucag

SEQ ID NO: 686387 - RNA, 19 nt, Homo sapiens
uuuccagugaguguaaaua

SEQ ID NO: 686388 - RNA, 15 nt, Homo sapiens
uuuccauauagucua

SEQ ID NO: 686389 - RNA, 16 nt, Homo sapiens
uuuccauguugcugcc

SEQ ID NO: 686390 - RNA, 23 nt, Homo sapiens
uuuccauuaaguacaugugccag

SEQ ID NO: 686391 - RNA, 14 nt, Homo sapiens
uuucccaacacaaa

SEQ ID NO: 686392 - RNA, 20 nt, Homo sapiens
uuucccacaucuuuccucaa

SEQ ID NO: 686393 - RNA, 19 nt, Homo sapiens
uuucccagagucaucugau

SEQ ID NO: 686394 - RNA, 13 nt, Homo sapiens
uuucccauugcca

SEQ ID NO: 686395 - RNA, 23 nt, Homo sapiens
uuuccccaaggccucucacccca

SEQ ID NO: 686396 - RNA, 23 nt, Homo sapiens
uuuccccaccccagcucaugccc

SEQ ID NO: 686397 - RNA, 22 nt, Homo sapiens
uuucccccuucccgccuuccaa

SEQ ID NO: 686398 - RNA, 20 nt, Homo sapiens
uuuccccuggccucaguucc

SEQ ID NO: 686399 - RNA, 21 nt, Homo sapiens
uuucccucucccaguccauuu

SEQ ID NO: 686400 - RNA, 17 nt, Homo sapiens
uuucccugccccugucc

SEQ ID NO: 686401 - RNA, 22 nt, Homo sapiens
uuucccuuugccuucauucugc

SEQ ID NO: 686402 - RNA, 15 nt, Homo sapiens
uuuccgaaaucagaa

SEQ ID NO: 686403 - RNA, 13 nt, Homo sapiens
uuuccgaaucucu

SEQ ID NO: 686404 - RNA, 18 nt, Homo sapiens
uuuccgccagaccucaac

SEQ ID NO: 686405 - RNA, 14 nt, Homo sapiens
uuuccuaaagccaa

SEQ ID NO: 686406 - RNA, 18 nt, Homo sapiens
uuuccuacuuucuccuga

SEQ ID NO: 686407 - RNA, 18 nt, Homo sapiens
uuuccuauuugcaguuac

SEQ ID NO: 686408 - RNA, 16 nt, Homo sapiens
uuuccucaccaggagc

SEQ ID NO: 686409 - RNA, 20 nt, Homo sapiens
uuuccucacuuuauggaaga

SEQ ID NO: 686410 - RNA, 22 nt, Homo sapiens
uuuccucagccuuaagaaccau

SEQ ID NO: 686411 - RNA, 15 nt, Homo sapiens
uuuccuccaggcaaa

SEQ ID NO: 686412 - RNA, 15 nt, Homo sapiens
uuuccuccucaggca

SEQ ID NO: 686413 - RNA, 21 nt, Homo sapiens
uuuccuccugcuucaugggaa

SEQ ID NO: 686414 - RNA, 16 nt, Homo sapiens
uugaacacaauugaua

SEQ ID NO: 686415 - RNA, 14 nt, Homo sapiens
uugaaccaaucagu

SEQ ID NO: 686416 - RNA, 22 nt, Homo sapiens
uugaaccacgugaaacugcugu

SEQ ID NO: 686417 - RNA, 21 nt, Homo sapiens
uugaaccagugauccaugucc

SEQ ID NO: 686418 - RNA, 13 nt, Homo sapiens
uugaaccugggaa

SEQ ID NO: 686419 - RNA, 15 nt, Homo sapiens
uugaacgcuuaaguc

SEQ ID NO: 686420 - RNA, 12 nt, Homo sapiens
uugaacuauaac

SEQ ID NO: 686421 - RNA, 18 nt, Homo sapiens
uugaacuauaacuguugg

SEQ ID NO: 686422 - RNA, 15 nt, Homo sapiens
uugaacucuguaaaa

SEQ ID NO: 686423 - RNA, 20 nt, Homo sapiens
uugaacugauucacaucuca

SEQ ID NO: 686424 - RNA, 18 nt, Homo sapiens
uugaacugguucaugaaa

SEQ ID NO: 686425 - RNA, 23 nt, Homo sapiens
uugaacuguauucuaguggcugu

SEQ ID NO: 686426 - RNA, 22 nt, Homo sapiens
uugaacuguuagaugcugaaua

SEQ ID NO: 686427 - RNA, 19 nt, Homo sapiens
uugaacuuauuuacacaua

SEQ ID NO: 686428 - RNA, 12 nt, Homo sapiens
uugaacuuggaa

SEQ ID NO: 686429 - RNA, 18 nt, Homo sapiens
uugaagaagaguuucucc

SEQ ID NO: 686430 - RNA, 21 nt, Homo sapiens
uugaagaagaguuucuccuuu

SEQ ID NO: 686431 - RNA, 14 nt, Homo sapiens
uugaagaaggguua

SEQ ID NO: 686432 - RNA, 23 nt, Homo sapiens
uugaagaauuuguuuuagguaga

SEQ ID NO: 686433 - RNA, 18 nt, Homo sapiens
uugaagagcauugcaugg

SEQ ID NO: 686434 - RNA, 12 nt, Homo sapiens
uugaagcacuua

SEQ ID NO: 686435 - RNA, 14 nt, Homo sapiens
uugaagcacuuaag

SEQ ID NO: 686436 - RNA, 13 nt, Homo sapiens
uugaagccaaaga

SEQ ID NO: 686437 - RNA, 14 nt, Homo sapiens
uugaagccaaagaa

SEQ ID NO: 686438 - RNA, 23 nt, Homo sapiens
uugaagcccuccaaaagcacuua

SEQ ID NO: 686439 - RNA, 12 nt, Homo sapiens
uugaagccucag

SEQ ID NO: 686440 - RNA, 16 nt, Homo sapiens
uugaaggaucaucuga

SEQ ID NO: 686441 - RNA, 19 nt, Homo sapiens
uugaaggcccugcugaguc

SEQ ID NO: 686442 - RNA, 20 nt, Homo sapiens
uugaagggcaagaaauggcg

SEQ ID NO: 686443 - RNA, 22 nt, Homo sapiens
uugaaggguguugcacccuuuu

SEQ ID NO: 686444 - RNA, 19 nt, Homo sapiens
uugaaguaggacuuuccua

SEQ ID NO: 686445 - RNA, 14 nt, Homo sapiens
uugaaguaugguug

SEQ ID NO: 686446 - RNA, 19 nt, Homo sapiens
uugaaguccuccagacaac

SEQ ID NO: 686447 - RNA, 14 nt, Homo sapiens
uugaauaaacuaga

SEQ ID NO: 686448 - RNA, 15 nt, Homo sapiens
uugaauaaagagaug

SEQ ID NO: 686449 - RNA, 17 nt, Homo sapiens
uugaauaauaagcagga

SEQ ID NO: 686450 - RNA, 14 nt, Homo sapiens
uugaauacaacauu

SEQ ID NO: 686451 - RNA, 14 nt, Homo sapiens
uugaauagucucau

SEQ ID NO: 686452 - RNA, 23 nt, Homo sapiens
uugaauauuccuggacuuacaaa

SEQ ID NO: 686453 - RNA, 17 nt, Homo sapiens
uugaaucaaagcaguua

SEQ ID NO: 686454 - RNA, 21 nt, Homo sapiens
uuucucagcucccaaggcucu

SEQ ID NO: 686455 - RNA, 20 nt, Homo sapiens
uuucucauguuuuccauugu

SEQ ID NO: 686456 - RNA, 14 nt, Homo sapiens
uuucucccaggaag

SEQ ID NO: 686457 - RNA, 21 nt, Homo sapiens
uuucuccccacgaugauaucu

SEQ ID NO: 686458 - RNA, 18 nt, Homo sapiens
uuucucgccucacuuucc

SEQ ID NO: 686459 - RNA, 23 nt, Homo sapiens
uuucucuccagcgguccaaaguu

SEQ ID NO: 686460 - RNA, 16 nt, Homo sapiens
uuucucugccagugac

SEQ ID NO: 686461 - RNA, 19 nt, Homo sapiens
uuucucuguaaacuuccaa

SEQ ID NO: 686462 - RNA, 23 nt, Homo sapiens
uuucucuuugauuauuugcaugu

SEQ ID NO: 686463 - RNA, 18 nt, Homo sapiens
uuucugaagggcauacaa

SEQ ID NO: 686464 - RNA, 21 nt, Homo sapiens
uuucugauaaaagauggccau

SEQ ID NO: 686465 - RNA, 22 nt, Homo sapiens
uuucugauuagagugcaaaagu

SEQ ID NO: 686466 - RNA, 22 nt, Homo sapiens
uuucugcuaaaaaguccuugau

SEQ ID NO: 686467 - RNA, 23 nt, Homo sapiens
uuucugcucccucgacacuugau

SEQ ID NO: 686468 - RNA, 23 nt, Homo sapiens
uuucuggacaguaccugauugua

SEQ ID NO: 686469 - RNA, 17 nt, Homo sapiens
uuucuggcagccaguac

SEQ ID NO: 686470 - RNA, 12 nt, Homo sapiens
uuucuggcucuu

SEQ ID NO: 686471 - RNA, 19 nt, Homo sapiens
uuucugggguccauucucu

SEQ ID NO: 686472 - RNA, 13 nt, Homo sapiens
uuucuguaaacuc

SEQ ID NO: 686473 - RNA, 15 nt, Homo sapiens
uuucuguaaccaaaa

SEQ ID NO: 686474 - RNA, 18 nt, Homo sapiens
uuucuguagcaccagaga

SEQ ID NO: 686475 - RNA, 20 nt, Homo sapiens
uuucugugauaacucugcaa

SEQ ID NO: 686476 - RNA, 14 nt, Homo sapiens
uuucuguugcccca

SEQ ID NO: 686477 - RNA, 17 nt, Homo sapiens
uuucuguuucaaagcac

SEQ ID NO: 686478 - RNA, 16 nt, Homo sapiens
uuucuuaccaccucuu

SEQ ID NO: 686479 - RNA, 19 nt, Homo sapiens
uuucuuaucccagugauca

SEQ ID NO: 686480 - RNA, 22 nt, Homo sapiens
uuucuucagagagcuaaauuac

SEQ ID NO: 686481 - RNA, 23 nt, Homo sapiens
uuucuuccagaaggcaaaaagac

SEQ ID NO: 686482 - RNA, 13 nt, Homo sapiens
uuucuuccuccaa

SEQ ID NO: 686483 - RNA, 12 nt, Homo sapiens
uuucuuccugca

SEQ ID NO: 686484 - RNA, 18 nt, Homo sapiens
uuucuuccuuuacuuucc

SEQ ID NO: 686485 - RNA, 23 nt, Homo sapiens
uuucuucuacugcuaucuacuac

SEQ ID NO: 686486 - RNA, 17 nt, Homo sapiens
uuucuucuagugcuuuu

SEQ ID NO: 686487 - RNA, 15 nt, Homo sapiens
uuucuucuuaaccua

SEQ ID NO: 686488 - RNA, 22 nt, Homo sapiens
uuucuucuugugauugcugcca

SEQ ID NO: 686489 - RNA, 20 nt, Homo sapiens
uuucuugaagaauaaauucu

SEQ ID NO: 686490 - RNA, 21 nt, Homo sapiens
uuucuugacaaaaccuaacuu

SEQ ID NO: 686491 - RNA, 19 nt, Homo sapiens
uuucuuuaccugagaccag

SEQ ID NO: 686492 - RNA, 18 nt, Homo sapiens
uuucuuuagcaugcuaca

SEQ ID NO: 686493 - RNA, 17 nt, Homo sapiens
uuucuuucucacuaaau

SEQ ID NO: 686494 - RNA, 17 nt, Homo sapiens
uuucuuuuccuucauuc

SEQ ID NO: 686495 - RNA, 21 nt, Homo sapiens
uuugaaaaauauugcuaaaag

SEQ ID NO: 686496 - RNA, 14 nt, Homo sapiens
uuugaaaaugcucu

SEQ ID NO: 686497 - RNA, 18 nt, Homo sapiens
uuugaaacaaaguacucu

SEQ ID NO: 686498 - RNA, 19 nt, Homo sapiens
uuugaaagcuuauuugaua

SEQ ID NO: 686499 - RNA, 18 nt, Homo sapiens
uuugaaauuaaccucuca

SEQ ID NO: 686500 - RNA, 15 nt, Homo sapiens
uuugaacaugcugaa

SEQ ID NO: 686501 - RNA, 12 nt, Homo sapiens
uuugaaggcaaa

SEQ ID NO: 686502 - RNA, 20 nt, Homo sapiens
uuugaaggcaaaauugcaaa

SEQ ID NO: 686503 - RNA, 20 nt, Homo sapiens
uuugaagucaaaugucacau

SEQ ID NO: 686504 - RNA, 15 nt, Homo sapiens
uuugaagucuucccu

SEQ ID NO: 686505 - RNA, 22 nt, Homo sapiens
uuugaagucuucccucagauuu

SEQ ID NO: 686506 - RNA, 21 nt, Homo sapiens
uuugaauauuuguauacacau

SEQ ID NO: 686507 - RNA, 20 nt, Homo sapiens
uuugaaucugaaucagccag

SEQ ID NO: 686508 - RNA, 21 nt, Homo sapiens
uuugacaagguucccaagaca

SEQ ID NO: 686509 - RNA, 17 nt, Homo sapiens
uuugaccaaauaaagua

SEQ ID NO: 686510 - RNA, 17 nt, Homo sapiens
uuugaccggaucuacac

SEQ ID NO: 686511 - RNA, 19 nt, Homo sapiens
uuugaccucauuuguaaaa

SEQ ID NO: 686512 - RNA, 15 nt, Homo sapiens
uuugaccuuccccaa

SEQ ID NO: 686513 - RNA, 22 nt, Homo sapiens
uuugaccuuucuagguucaaaa

SEQ ID NO: 686514 - RNA, 17 nt, Homo sapiens
uuugacuucagauugaa

SEQ ID NO: 686515 - RNA, 15 nt, Homo sapiens
uuugacuuugccaaa

SEQ ID NO: 686516 - RNA, 13 nt, Homo sapiens
uuugacuuuucca

SEQ ID NO: 686517 - RNA, 17 nt, Homo sapiens
uuugagacugagucucu

SEQ ID NO: 686518 - RNA, 14 nt, Homo sapiens
uuugagacuuagaa

SEQ ID NO: 686519 - RNA, 22 nt, Homo sapiens
uuugagauaaagucaaaugcca

SEQ ID NO: 686520 - RNA, 21 nt, Homo sapiens
uuugagcuccaucaaggguau

SEQ ID NO: 686521 - RNA, 20 nt, Homo sapiens
uuugaggaccccuuaaucuu

SEQ ID NO: 686522 - RNA, 13 nt, Homo sapiens
uuugaggccaaaa

SEQ ID NO: 686523 - RNA, 17 nt, Homo sapiens
uuugaggugaggguugg

SEQ ID NO: 686524 - RNA, 13 nt, Homo sapiens
uuugagugauccu

SEQ ID NO: 686525 - RNA, 18 nt, Homo sapiens
uuugauacuaagcauuga

SEQ ID NO: 686526 - RNA, 20 nt, Homo sapiens
uuugauaguugguguucaaa

SEQ ID NO: 686527 - RNA, 16 nt, Homo sapiens
uuugauauacauugug

SEQ ID NO: 686528 - RNA, 16 nt, Homo sapiens
uuugauauccaugcca

SEQ ID NO: 686529 - RNA, 14 nt, Homo sapiens
uuugaucaguugaa

SEQ ID NO: 686530 - RNA, 14 nt, Homo sapiens
uuugaucccagaaa

SEQ ID NO: 686531 - RNA, 13 nt, Homo sapiens
uuugaugaacugu

SEQ ID NO: 686532 - RNA, 20 nt, Homo sapiens
uuugaugauuaauucaccuu

SEQ ID NO: 686533 - RNA, 12 nt, Homo sapiens
uuugaugccauu

SEQ ID NO: 686534 - RNA, 20 nt, Homo sapiens
uuugaugugaaaaucaugaa

SEQ ID NO: 686535 - RNA, 15 nt, Homo sapiens
uuugauuauucagug

SEQ ID NO: 686536 - RNA, 13 nt, Homo sapiens
uuugauugcacau

SEQ ID NO: 686537 - RNA, 18 nt, Homo sapiens
uuugauugcuuugcugca

SEQ ID NO: 686538 - RNA, 13 nt, Homo sapiens
uuugcaaacguuc

SEQ ID NO: 686539 - RNA, 17 nt, Homo sapiens
uuugcaaagaccaccuc

SEQ ID NO: 686540 - RNA, 23 nt, Homo sapiens
uuugcaaagaccuucgucuuuga

SEQ ID NO: 686541 - RNA, 23 nt, Homo sapiens
uuugcaacucacugauucucuac

SEQ ID NO: 686542 - RNA, 15 nt, Homo sapiens
uuugcaacugucucu

SEQ ID NO: 686543 - RNA, 21 nt, Homo sapiens
uuugcaauaaaagguuuccua

SEQ ID NO: 686544 - RNA, 20 nt, Homo sapiens
uuugcaccaacauagucaua

SEQ ID NO: 686545 - RNA, 12 nt, Homo sapiens
uuugcacugagg

SEQ ID NO: 686546 - RNA, 19 nt, Homo sapiens
uuugcaguaugaacuauug

SEQ ID NO: 686547 - RNA, 17 nt, Homo sapiens
uuugcauaugagccgug

SEQ ID NO: 686548 - RNA, 21 nt, Homo sapiens
uuuugguagaugcaugacuug

SEQ ID NO: 686549 - RNA, 15 nt, Homo sapiens
uuuuguaaacuguau

SEQ ID NO: 686550 - RNA, 19 nt, Homo sapiens
uuuuguacaguuaucauga

SEQ ID NO: 686551 - RNA, 15 nt, Homo sapiens
uuuuguaccaaauag

SEQ ID NO: 686552 - RNA, 16 nt, Homo sapiens
uuuugucaacauugug

SEQ ID NO: 686553 - RNA, 19 nt, Homo sapiens
uuuuguccauaaaucucag

SEQ ID NO: 686554 - RNA, 15 nt, Homo sapiens
uuuugugaagccaug

SEQ ID NO: 686555 - RNA, 13 nt, Homo sapiens
uuuugugauugcc

SEQ ID NO: 686556 - RNA, 13 nt, Homo sapiens
uuuugugccauua

SEQ ID NO: 686557 - RNA, 13 nt, Homo sapiens
uuuuguguacugu

SEQ ID NO: 686558 - RNA, 13 nt, Homo sapiens
uuuuguuaccuuu

SEQ ID NO: 686559 - RNA, 15 nt, Homo sapiens
uuuuguuauugggca

SEQ ID NO: 686560 - RNA, 11 nt, Homo sapiens
uuuuguuccag

SEQ ID NO: 686561 - RNA, 17 nt, Homo sapiens
uuuuguucucaacuuca

SEQ ID NO: 686562 - RNA, 18 nt, Homo sapiens
uuuuguucugcaaauuaa

SEQ ID NO: 686563 - RNA, 19 nt, Homo sapiens
uuuuguuuuuucuugccag

SEQ ID NO: 686564 - RNA, 14 nt, Homo sapiens
uuuuuaaaguaugu

SEQ ID NO: 686565 - RNA, 15 nt, Homo sapiens
uuuuuaacugauucu

SEQ ID NO: 686566 - RNA, 20 nt, Homo sapiens
uuuuuaaguauuucagaugc

SEQ ID NO: 686567 - RNA, 18 nt, Homo sapiens
uuuuuaccuaggcaccau

SEQ ID NO: 686568 - RNA, 17 nt, Homo sapiens
uuuuuagaaaucacaac

SEQ ID NO: 686569 - RNA, 20 nt, Homo sapiens
uuuuuagcugguggcaauaa

SEQ ID NO: 686570 - RNA, 18 nt, Homo sapiens
uuuuuauacaauggaaua

SEQ ID NO: 686571 - RNA, 14 nt, Homo sapiens
uuuuuauccaccuc

SEQ ID NO: 686572 - RNA, 16 nt, Homo sapiens
uuuuucaaaugaucuu

SEQ ID NO: 686573 - RNA, 13 nt, Homo sapiens
uuuuucaagagcu

SEQ ID NO: 686574 - RNA, 22 nt, Homo sapiens
uuuuucaagagcuccuugaccc

SEQ ID NO: 686575 - RNA, 18 nt, Homo sapiens
uuuuucacuguacauuau

SEQ ID NO: 686576 - RNA, 18 nt, Homo sapiens
uuuuuccucccagugaga

SEQ ID NO: 686577 - RNA, 16 nt, Homo sapiens
uuuuucuaagguucuc

SEQ ID NO: 686578 - RNA, 15 nt, Homo sapiens
uuuuucuaaugagga

SEQ ID NO: 686579 - RNA, 22 nt, Homo sapiens
uuuuucuggccucgcuguucuc

SEQ ID NO: 686580 - RNA, 22 nt, Homo sapiens
uuuuucuuugagacugggucuc

SEQ ID NO: 686581 - RNA, 22 nt, Homo sapiens
uuuuugacucccagaucaguca

SEQ ID NO: 686582 - RNA, 22 nt, Homo sapiens
uuuuuggaaaauaaaaagugcc

SEQ ID NO: 686583 - RNA, 20 nt, Homo sapiens
uuuuuggaacuaaagcaaau

SEQ ID NO: 686584 - RNA, 18 nt, Homo sapiens
uuuuuggcauuccaccuc

SEQ ID NO: 686585 - RNA, 21 nt, Homo sapiens
uuuuuggcuacacacaaacca

SEQ ID NO: 686586 - RNA, 18 nt, Homo sapiens
uuuuuggcugugaccucu

SEQ ID NO: 686587 - RNA, 18 nt, Homo sapiens
uuuuugggggaaggucag

SEQ ID NO: 686588 - RNA, 13 nt, Homo sapiens
uuuuuguaaagga

SEQ ID NO: 686589 - RNA, 19 nt, Homo sapiens
uuuuuguuaucagucaaua

SEQ ID NO: 686590 - RNA, 23 nt, Homo sapiens
uuuuuguuuuuaaauaaagcauc

SEQ ID NO: 686591 - RNA, 23 nt, Homo sapiens
uuuuuuaaaacacuaaaagcagc

SEQ ID NO: 686592 - RNA, 14 nt, Homo sapiens
uuuuuuacacaaau

SEQ ID NO: 686593 - RNA, 11 nt, Homo sapiens
uuuuuuacucg

SEQ ID NO: 686594 - RNA, 12 nt, Homo sapiens
uuuuuuccuuaa

SEQ ID NO: 686595 - RNA, 17 nt, Homo sapiens
uuuuuucugccuaauag

SEQ ID NO: 686596 - RNA, 20 nt, Homo sapiens
uuuuuugcauuuucacaaau

SEQ ID NO: 686597 - RNA, 13 nt, Homo sapiens
uuuuuuuauacug

SEQ ID NO: 686598 - RNA, 23 nt, Homo sapiens
ugaccuaaauuauuuacugcaaa

SEQ ID NO: 686599 - RNA, 14 nt, Homo sapiens
ugaccuaaccacuu

SEQ ID NO: 686600 - RNA, 22 nt, Homo sapiens
ugaccuacuuugguaguggaau

SEQ ID NO: 686601 - RNA, 18 nt, Homo sapiens
ugaccuaugaugaaguca

SEQ ID NO: 686602 - RNA, 16 nt, Homo sapiens
ugaccucacugugacc

SEQ ID NO: 686603 - RNA, 13 nt, Homo sapiens
ugaccuccacagc

SEQ ID NO: 686604 - RNA, 18 nt, Homo sapiens
ugaccucccaacucuaaa

SEQ ID NO: 686605 - RNA, 15 nt, Homo sapiens
ugaccucgugaucca

SEQ ID NO: 686606 - RNA, 12 nt, Homo sapiens
ugaccucuagcc

SEQ ID NO: 686607 - RNA, 17 nt, Homo sapiens
ugaccucugugaccaac

SEQ ID NO: 686608 - RNA, 23 nt, Homo sapiens
ugaccugcggcaguauguacuuc

SEQ ID NO: 686609 - RNA, 21 nt, Homo sapiens
ugaccugcugaccugugcaca

SEQ ID NO: 686610 - RNA, 21 nt, Homo sapiens
ugaccugucaccgugagcagc

SEQ ID NO: 686611 - RNA, 18 nt, Homo sapiens
ugaccuguguuucacuua

SEQ ID NO: 686612 - RNA, 16 nt, Homo sapiens
ugaccuucagagccag

SEQ ID NO: 686613 - RNA, 18 nt, Homo sapiens
ugaccuugcugccacaac

SEQ ID NO: 686614 - RNA, 20 nt, Homo sapiens
ugaccuuggaggaaugacaa

SEQ ID NO: 686615 - RNA, 19 nt, Homo sapiens
ugaccuuggcugacugggg

SEQ ID NO: 686616 - RNA, 18 nt, Homo sapiens
ugaccuuuaaaugcaaca

SEQ ID NO: 686617 - RNA, 18 nt, Homo sapiens
ugacgaagacgccaaaaa

SEQ ID NO: 686618 - RNA, 15 nt, Homo sapiens
ugacgacagugcauu

SEQ ID NO: 686619 - RNA, 17 nt, Homo sapiens
ugacgacuucacacuau

SEQ ID NO: 686620 - RNA, 22 nt, Homo sapiens
ugacgucacuggaccacugggc

SEQ ID NO: 686621 - RNA, 20 nt, Homo sapiens
ugacgucagcgcaccaaaac

SEQ ID NO: 686622 - RNA, 23 nt, Homo sapiens
ugacgugcaccuguacucaggag

SEQ ID NO: 686623 - RNA, 16 nt, Homo sapiens
ugacgugccuaccucu

SEQ ID NO: 686624 - RNA, 11 nt, Homo sapiens
ugacuaaagag

SEQ ID NO: 686625 - RNA, 23 nt, Homo sapiens
ugacuaaguuuuuauaccagcuu

SEQ ID NO: 686626 - RNA, 18 nt, Homo sapiens
ugacuagaacaacuugaa

SEQ ID NO: 686627 - RNA, 16 nt, Homo sapiens
ugacuaguagauuucu

SEQ ID NO: 686628 - RNA, 19 nt, Homo sapiens
ugacucaaaaaugagguac

SEQ ID NO: 686629 - RNA, 21 nt, Homo sapiens
ugacucacaccugaacugaac

SEQ ID NO: 686630 - RNA, 13 nt, Homo sapiens
ugacucaccuguu

SEQ ID NO: 686631 - RNA, 16 nt, Homo sapiens
ugacucacuuauccca

SEQ ID NO: 686632 - RNA, 15 nt, Homo sapiens
ugacucaggauuuaa

SEQ ID NO: 686633 - RNA, 21 nt, Homo sapiens
ugacucauaggucccugacau

SEQ ID NO: 686634 - RNA, 15 nt, Homo sapiens
ugacuccauucaaau

SEQ ID NO: 686635 - RNA, 16 nt, Homo sapiens
ugacuccugcucucug

SEQ ID NO: 686636 - RNA, 16 nt, Homo sapiens
ugacuccuuucucuaa

SEQ ID NO: 686637 - RNA, 16 nt, Homo sapiens
ugacucgggagcugca

SEQ ID NO: 686638 - RNA, 18 nt, Homo sapiens
caaaucugugcucuuuca

SEQ ID NO: 686639 - RNA, 20 nt, Homo sapiens
caaaucugugcucuuucauu

SEQ ID NO: 686640 - RNA, 16 nt, Homo sapiens
caaaucuucacugagc

SEQ ID NO: 686641 - RNA, 22 nt, Homo sapiens
caaaucuucuugauccacuucu

SEQ ID NO: 686642 - RNA, 16 nt, Homo sapiens
caaaucuugaaauuaa

SEQ ID NO: 686643 - RNA, 20 nt, Homo sapiens
caaaucuugaauuucugcca

SEQ ID NO: 686644 - RNA, 15 nt, Homo sapiens
caaaugaaaacccca

SEQ ID NO: 686645 - RNA, 17 nt, Homo sapiens
caaaugaaauucugccu

SEQ ID NO: 686646 - RNA, 14 nt, Homo sapiens
caaaugaacuugca

SEQ ID NO: 686647 - RNA, 15 nt, Homo sapiens
caaaugacaaaaagc

SEQ ID NO: 686648 - RNA, 11 nt, Homo sapiens
caaaugagauc

SEQ ID NO: 686649 - RNA, 13 nt, Homo sapiens
caaaugaguucag

SEQ ID NO: 686650 - RNA, 14 nt, Homo sapiens
caaaugcacaucuc

SEQ ID NO: 686651 - RNA, 20 nt, Homo sapiens
caaaugcacaucucauggca

SEQ ID NO: 686652 - RNA, 17 nt, Homo sapiens
caaaugcagaaccacaa

SEQ ID NO: 686653 - RNA, 20 nt, Homo sapiens
caaaugcaguucauugcaga

SEQ ID NO: 686654 - RNA, 20 nt, Homo sapiens
caaaugcccaaggaugccuu

SEQ ID NO: 686655 - RNA, 16 nt, Homo sapiens
caaaugcuauauugca

SEQ ID NO: 686656 - RNA, 15 nt, Homo sapiens
caaaugcuuuggacu

SEQ ID NO: 686657 - RNA, 16 nt, Homo sapiens
caaauggcagaaccaa

SEQ ID NO: 686658 - RNA, 14 nt, Homo sapiens
caaauggcauauga

SEQ ID NO: 686659 - RNA, 17 nt, Homo sapiens
caaauggccaguuuucu

SEQ ID NO: 686660 - RNA, 14 nt, Homo sapiens
caaauggccucaug

SEQ ID NO: 686661 - RNA, 14 nt, Homo sapiens
caaaugggggaaaa

SEQ ID NO: 686662 - RNA, 23 nt, Homo sapiens
caaaugggggaaaaguuagucaa

SEQ ID NO: 686663 - RNA, 12 nt, Homo sapiens
caaaugguguga

SEQ ID NO: 686664 - RNA, 21 nt, Homo sapiens
caaauguaaauuuacugagcg

SEQ ID NO: 686665 - RNA, 20 nt, Homo sapiens
caaauguacagugguccuuu

SEQ ID NO: 686666 - RNA, 13 nt, Homo sapiens
caaauguauuuca

SEQ ID NO: 686667 - RNA, 14 nt, Homo sapiens
caaaugucaucagg

SEQ ID NO: 686668 - RNA, 17 nt, Homo sapiens
caaaugucauugucuac

SEQ ID NO: 686669 - RNA, 11 nt, Homo sapiens
caaauguccua

SEQ ID NO: 686670 - RNA, 19 nt, Homo sapiens
caaauguuuauaacucuag

SEQ ID NO: 686671 - RNA, 22 nt, Homo sapiens
caaauuaaaacugagacacauu

SEQ ID NO: 686672 - RNA, 15 nt, Homo sapiens
caaauuaagaaucua

SEQ ID NO: 686673 - RNA, 22 nt, Homo sapiens
caaauuacuccaagguuuauaa

SEQ ID NO: 686674 - RNA, 22 nt, Homo sapiens
caaauuauagaaacaauacugu

SEQ ID NO: 686675 - RNA, 15 nt, Homo sapiens
caaauuauaugcuaa

SEQ ID NO: 686676 - RNA, 11 nt, Homo sapiens
caaauucugug

SEQ ID NO: 686677 - RNA, 19 nt, Homo sapiens
caaauugcugggauuacag

SEQ ID NO: 686678 - RNA, 14 nt, Homo sapiens
caaauugcuucuag

SEQ ID NO: 686679 - RNA, 16 nt, Homo sapiens
caaauugcuucuagga

SEQ ID NO: 686680 - RNA, 20 nt, Homo sapiens
caaauugggaaauccauucc

SEQ ID NO: 686681 - RNA, 21 nt, Homo sapiens
caaauugggaaauccauucca

SEQ ID NO: 686682 - RNA, 22 nt, Homo sapiens
caaauugggacaacagugcuuu

SEQ ID NO: 686683 - RNA, 13 nt, Homo sapiens
caaauuguguaua

SEQ ID NO: 686684 - RNA, 23 nt, Homo sapiens
caaauuuagaagaaaaaaccacc

SEQ ID NO: 686685 - RNA, 15 nt, Homo sapiens
caaauuuagugcucu

SEQ ID NO: 686686 - RNA, 17 nt, Homo sapiens
caaauuucauuuccauu

SEQ ID NO: 686687 - RNA, 19 nt, Homo sapiens
caaauuugaauuuguauaa

SEQ ID NO: 686688 - RNA, 21 nt, Homo sapiens
caaauuugauugauuugaaga

SEQ ID NO: 686689 - RNA, 18 nt, Homo sapiens
caaauuuggccuuaagaa

SEQ ID NO: 686690 - RNA, 17 nt, Homo sapiens
caaauuuugccagagaa

SEQ ID NO: 686691 - RNA, 15 nt, Homo sapiens
caacaaaaaccaaaa

SEQ ID NO: 686692 - RNA, 23 nt, Homo sapiens
caacaaaagaauuuuuguuugga

SEQ ID NO: 686693 - RNA, 19 nt, Homo sapiens
caacaaaccauccagugac

SEQ ID NO: 686694 - RNA, 13 nt, Homo sapiens
caacaaaucuuca

SEQ ID NO: 686695 - RNA, 19 nt, Homo sapiens
caacaacacaauaacacua

SEQ ID NO: 686696 - RNA, 13 nt, Homo sapiens
caacaacucugau

SEQ ID NO: 686697 - RNA, 16 nt, Homo sapiens
caacaacucugauuaa

SEQ ID NO: 686698 - RNA, 18 nt, Homo sapiens
caaaaagccuuuuccaga

SEQ ID NO: 686699 - RNA, 14 nt, Homo sapiens
caaaaagcucugaa

SEQ ID NO: 686700 - RNA, 14 nt, Homo sapiens
caaaaaggcaaaua

SEQ ID NO: 686701 - RNA, 20 nt, Homo sapiens
caaaaauagcccugcaaaaa

SEQ ID NO: 686702 - RNA, 14 nt, Homo sapiens
caaaaauauuccau

SEQ ID NO: 686703 - RNA, 16 nt, Homo sapiens
caaaaaucaauaugca

SEQ ID NO: 686704 - RNA, 15 nt, Homo sapiens
caaaaaugaaaucca

SEQ ID NO: 686705 - RNA, 14 nt, Homo sapiens
caaaaaugaacuga

SEQ ID NO: 686706 - RNA, 13 nt, Homo sapiens
caaaaauguaaug

SEQ ID NO: 686707 - RNA, 19 nt, Homo sapiens
caaaaauguaaugaucaua

SEQ ID NO: 686708 - RNA, 15 nt, Homo sapiens
caaaaauucacaaau

SEQ ID NO: 686709 - RNA, 16 nt, Homo sapiens
caaaaauucacaaaug

SEQ ID NO: 686710 - RNA, 17 nt, Homo sapiens
caaaaauugacuuagau

SEQ ID NO: 686711 - RNA, 22 nt, Homo sapiens
caaaaauuuauuauauauuuac

SEQ ID NO: 686712 - RNA, 17 nt, Homo sapiens
caaaacaaaaaaaaacu

SEQ ID NO: 686713 - RNA, 19 nt, Homo sapiens
caaaacaagugacaugaag

SEQ ID NO: 686714 - RNA, 16 nt, Homo sapiens
caaaacaagugcaaga

SEQ ID NO: 686715 - RNA, 15 nt, Homo sapiens
caaaacaaucucuca

SEQ ID NO: 686716 - RNA, 15 nt, Homo sapiens
caaaacacaaacugu

SEQ ID NO: 686717 - RNA, 13 nt, Homo sapiens
caaaacacccaaa

SEQ ID NO: 686718 - RNA, 15 nt, Homo sapiens
caaaacacccaaaaa

SEQ ID NO: 686719 - RNA, 18 nt, Homo sapiens
caaaaccacuagaacucu

SEQ ID NO: 686720 - RNA, 16 nt, Homo sapiens
caaaacccacagaaga

SEQ ID NO: 686721 - RNA, 18 nt, Homo sapiens
caaaacccucagcacugu

SEQ ID NO: 686722 - RNA, 22 nt, Homo sapiens
caaaaccuacacacauaccuuc

SEQ ID NO: 686723 - RNA, 14 nt, Homo sapiens
caaaaccuguauua

SEQ ID NO: 686724 - RNA, 14 nt, Homo sapiens
caaaacuacaugag

SEQ ID NO: 686725 - RNA, 14 nt, Homo sapiens
caaaacuaguucaa

SEQ ID NO: 686726 - RNA, 20 nt, Homo sapiens
caaaacuauccugauuccaa

SEQ ID NO: 686727 - RNA, 15 nt, Homo sapiens
caaaacugacaguaa

SEQ ID NO: 686728 - RNA, 23 nt, Homo sapiens
caaaacugguuuaggauuacuua

SEQ ID NO: 686729 - RNA, 14 nt, Homo sapiens
caaaacuuaggcau

SEQ ID NO: 686730 - RNA, 16 nt, Homo sapiens
caaaagaaaaaaaacu

SEQ ID NO: 686731 - RNA, 18 nt, Homo sapiens
caaaagaaaccaugacaa

SEQ ID NO: 686732 - RNA, 17 nt, Homo sapiens
caaaagaaacuuaccaa

SEQ ID NO: 686733 - RNA, 22 nt, Homo sapiens
caaaagaucaaauguauucaga

SEQ ID NO: 686734 - RNA, 12 nt, Homo sapiens
caaaagauguau

SEQ ID NO: 686735 - RNA, 18 nt, Homo sapiens
caaaagcaagaaaaccac

SEQ ID NO: 686736 - RNA, 15 nt, Homo sapiens
caaaagcacauauau

SEQ ID NO: 686737 - RNA, 17 nt, Homo sapiens
caaaagcagauacuuga

SEQ ID NO: 686738 - RNA, 15 nt, Homo sapiens
caaaagcagcacaag

SEQ ID NO: 686739 - RNA, 15 nt, Homo sapiens
caaaagcuauuuaaa

SEQ ID NO: 686740 - RNA, 23 nt, Homo sapiens
caaaagcuuugaauacugugaaa

SEQ ID NO: 686741 - RNA, 15 nt, Homo sapiens
caaaaggacucucag

SEQ ID NO: 686742 - RNA, 15 nt, Homo sapiens
caaaaggcagcucac

SEQ ID NO: 686743 - RNA, 18 nt, Homo sapiens
caaaaggcugauuacuga

SEQ ID NO: 686744 - RNA, 16 nt, Homo sapiens
caaaagggccaaagaa

SEQ ID NO: 686745 - RNA, 14 nt, Homo sapiens
caaaagucagucuu

SEQ ID NO: 686746 - RNA, 21 nt, Homo sapiens
caaaaguggggcuaaaugaag

SEQ ID NO: 686747 - RNA, 14 nt, Homo sapiens
caaaaguuacaugu

SEQ ID NO: 686748 - RNA, 19 nt, Homo sapiens
caaaaguuacauguuugca

SEQ ID NO: 686749 - RNA, 18 nt, Homo sapiens
caaaauaaaaagugacac

SEQ ID NO: 686750 - RNA, 20 nt, Homo sapiens
caaaauaaaaagugacacag

SEQ ID NO: 686751 - RNA, 18 nt, Homo sapiens
caaaauaaagaauaugcc

SEQ ID NO: 686752 - RNA, 23 nt, Homo sapiens
caaaauaaauuggaaaugugaau

SEQ ID NO: 686753 - RNA, 15 nt, Homo sapiens
caaaauaaauuguga

SEQ ID NO: 686754 - RNA, 23 nt, Homo sapiens
caaaauaccuucugaacuacacu

SEQ ID NO: 686755 - RNA, 19 nt, Homo sapiens
caaaauagagaaucccacu

SEQ ID NO: 686756 - RNA, 16 nt, Homo sapiens
caaaauauguuuaaaa

SEQ ID NO: 686757 - RNA, 19 nt, Homo sapiens
caaaauauuuaagugaagg

SEQ ID NO: 686758 - RNA, 17 nt, Homo sapiens
caaaauauuuuuugcaa

SEQ ID NO: 686759 - RNA, 14 nt, Homo sapiens
caaaaucacacagc

SEQ ID NO: 686760 - RNA, 15 nt, Homo sapiens
caaaaucacacagcc

SEQ ID NO: 686761 - RNA, 12 nt, Homo sapiens
caaaaucaggaa

SEQ ID NO: 686762 - RNA, 16 nt, Homo sapiens
cccaaguaugccuuaa

SEQ ID NO: 686763 - RNA, 13 nt, Homo sapiens
cccaagugccuca

SEQ ID NO: 686764 - RNA, 18 nt, Homo sapiens
cccaaguuauugggaugu

SEQ ID NO: 686765 - RNA, 17 nt, Homo sapiens
cccaauacuuuugucca

SEQ ID NO: 686766 - RNA, 14 nt, Homo sapiens
cccaauccaugcuu

SEQ ID NO: 686767 - RNA, 16 nt, Homo sapiens
cccaauccccagacuc

SEQ ID NO: 686768 - RNA, 13 nt, Homo sapiens
cccaaugccugcu

SEQ ID NO: 686769 - RNA, 19 nt, Homo sapiens
cccaaugcgacaaguaguu

SEQ ID NO: 686770 - RNA, 22 nt, Homo sapiens
cccaauuaaaauacuaugcagu

SEQ ID NO: 686771 - RNA, 18 nt, Homo sapiens
cccaauuaagaaauucca

SEQ ID NO: 686772 - RNA, 16 nt, Homo sapiens
cccaauucacaucuaa

SEQ ID NO: 686773 - RNA, 20 nt, Homo sapiens
cccaauugggaaugcaauau

SEQ ID NO: 686774 - RNA, 22 nt, Homo sapiens
cccaauuucggauuuuuuccaa

SEQ ID NO: 686775 - RNA, 18 nt, Homo sapiens
cccacaaaacuucagugu

SEQ ID NO: 686776 - RNA, 18 nt, Homo sapiens
cccacaacuugucaccca

SEQ ID NO: 686777 - RNA, 19 nt, Homo sapiens
cccacacccucccuuaccc

SEQ ID NO: 686778 - RNA, 15 nt, Homo sapiens
cccacaccguguaaa

SEQ ID NO: 686779 - RNA, 20 nt, Homo sapiens
cccacacugaaaccaaaaca

SEQ ID NO: 686780 - RNA, 17 nt, Homo sapiens
cccacacuggagccauc

SEQ ID NO: 686781 - RNA, 20 nt, Homo sapiens
cccaggucucucaacuucau

SEQ ID NO: 686782 - RNA, 18 nt, Homo sapiens
cccaggugcaggugcuga

SEQ ID NO: 686783 - RNA, 22 nt, Homo sapiens
cccaggugguuauggagagggu

SEQ ID NO: 686784 - RNA, 24 nt, Homo sapiens
cccagguugcugugggugcagcug

SEQ ID NO: 686785 - RNA, 14 nt, Homo sapiens
cccaguaacugcac

SEQ ID NO: 686786 - RNA, 16 nt, Homo sapiens
cccaguaucaugcgau

SEQ ID NO: 686787 - RNA, 15 nt, Homo sapiens
cccagucccauuccu

SEQ ID NO: 686788 - RNA, 19 nt, Homo sapiens
cccagugacaacaucgcaa

SEQ ID NO: 686789 - RNA, 22 nt, Homo sapiens
cccagugcagggcuggucuugg

SEQ ID NO: 686790 - RNA, 19 nt, Homo sapiens
cccagugcgugaagaccaa

SEQ ID NO: 686791 - RNA, 15 nt, Homo sapiens
cccagugcugcugua

SEQ ID NO: 686792 - RNA, 16 nt, Homo sapiens
cccaguggaacaguca

SEQ ID NO: 686793 - RNA, 14 nt, Homo sapiens
cccaguggccucaa

SEQ ID NO: 686794 - RNA, 21 nt, Homo sapiens
cccagugggaacugugcaaag

SEQ ID NO: 686795 - RNA, 15 nt, Homo sapiens
cccaguguguguuua

SEQ ID NO: 686796 - RNA, 23 nt, Homo sapiens
cccaguguguguuuaacauucac

SEQ ID NO: 686797 - RNA, 19 nt, Homo sapiens
cccaguguuccauuugaac

SEQ ID NO: 686798 - RNA, 23 nt, Homo sapiens
cccaguuaaauuuucauuucaga

SEQ ID NO: 686799 - RNA, 14 nt, Homo sapiens
cccaguucaucacc

SEQ ID NO: 686800 - RNA, 21 nt, Homo sapiens
cccaguucaucaccauuuccu

SEQ ID NO: 686801 - RNA, 15 nt, Homo sapiens
cccaguuuggggugc

SEQ ID NO: 686802 - RNA, 20 nt, Homo sapiens
cccauaaaaugauccugcca

SEQ ID NO: 686803 - RNA, 16 nt, Homo sapiens
cccauacaauguaugu

SEQ ID NO: 686804 - RNA, 23 nt, Homo sapiens
cccauacaauguauguacaauac

SEQ ID NO: 686805 - RNA, 14 nt, Homo sapiens
cccauaucugugaa

SEQ ID NO: 686806 - RNA, 23 nt, Homo sapiens
cccauaucugugaaaugcuggca

SEQ ID NO: 686807 - RNA, 13 nt, Homo sapiens
cccaucaauucuu

SEQ ID NO: 686808 - RNA, 16 nt, Homo sapiens
cccaucauguggccca

SEQ ID NO: 686809 - RNA, 22 nt, Homo sapiens
cccaucauuacugguaaagccu

SEQ ID NO: 686810 - RNA, 15 nt, Homo sapiens
cccauccagccacgg

SEQ ID NO: 686811 - RNA, 12 nt, Homo sapiens
cccauccagcua

SEQ ID NO: 686812 - RNA, 22 nt, Homo sapiens
cccauccaucugcuuacaauuc

SEQ ID NO: 686813 - RNA, 16 nt, Homo sapiens
cccauccccuuuccuc

SEQ ID NO: 686814 - RNA, 15 nt, Homo sapiens
cccaucucuacugaa

SEQ ID NO: 686815 - RNA, 13 nt, Homo sapiens
cccaucugugaau

SEQ ID NO: 686816 - RNA, 23 nt, Homo sapiens
cccaucuuguuucacacuaguca

SEQ ID NO: 686817 - RNA, 18 nt, Homo sapiens
cccaugaacacacugugu

SEQ ID NO: 686818 - RNA, 15 nt, Homo sapiens
cccaugaaucaaaga

SEQ ID NO: 686819 - RNA, 23 nt, Homo sapiens
cccaugaccccaaagccaagggc

SEQ ID NO: 686820 - RNA, 14 nt, Homo sapiens
cccaugacucuugg

SEQ ID NO: 686821 - RNA, 19 nt, Homo sapiens
cccaugcaggcccuuugaa

SEQ ID NO: 686822 - RNA, 16 nt, Homo sapiens
cccaugcgugcugaga

SEQ ID NO: 686823 - RNA, 14 nt, Homo sapiens
cccaugcuuaacau

SEQ ID NO: 686824 - RNA, 15 nt, Homo sapiens
cccauggaagcaaua

SEQ ID NO: 686825 - RNA, 22 nt, Homo sapiens
cccaugggcuaucaacuuaaua

SEQ ID NO: 686826 - RNA, 23 nt, Homo sapiens
cccauguguagguauugaaaaag

SEQ ID NO: 686827 - RNA, 22 nt, Homo sapiens
cccaugugugagugugugcaag

SEQ ID NO: 686828 - RNA, 17 nt, Homo sapiens
cccauguugcaugccua

SEQ ID NO: 686829 - RNA, 18 nt, Homo sapiens
cccauuccaaagcuuuau

SEQ ID NO: 686830 - RNA, 21 nt, Homo sapiens
cccauuccuaagaggaguuua

SEQ ID NO: 686831 - RNA, 18 nt, Homo sapiens
cccauuccucccuccggc

SEQ ID NO: 686832 - RNA, 17 nt, Homo sapiens
cccauucucugccugua

SEQ ID NO: 686833 - RNA, 17 nt, Homo sapiens
cccauugcucuaugaaa

SEQ ID NO: 686834 - RNA, 13 nt, Homo sapiens
cccauugcugcca

SEQ ID NO: 686835 - RNA, 18 nt, Homo sapiens
cccauuucaggugugaga

SEQ ID NO: 686836 - RNA, 18 nt, Homo sapiens
cccauuuccuguacaauc

SEQ ID NO: 686837 - RNA, 17 nt, Homo sapiens
cccauuuugagugacuc

SEQ ID NO: 686838 - RNA, 21 nt, Homo sapiens
cccauuuuuaaaauacauugu

SEQ ID NO: 686839 - RNA, 19 nt, Homo sapiens
ccccaaaaauugacuuaga

SEQ ID NO: 686840 - RNA, 22 nt, Homo sapiens
ccccaaacauuaaucaccaaag

SEQ ID NO: 686841 - RNA, 23 nt, Homo sapiens
ccccaaacauuaaucaccaaagu

SEQ ID NO: 686842 - RNA, 20 nt, Homo sapiens
ccccaacaaaccauccagug

SEQ ID NO: 686843 - RNA, 13 nt, Homo sapiens
ccccaaccacaga

SEQ ID NO: 686844 - RNA, 19 nt, Homo sapiens
ccccaagaccaucccugaa

SEQ ID NO: 686845 - RNA, 23 nt, Homo sapiens
ccccaagagaacucgcgcucagu

SEQ ID NO: 686846 - RNA, 21 nt, Homo sapiens
ccccaagguuuuggagucagu

SEQ ID NO: 686847 - RNA, 12 nt, Homo sapiens
ccccaauaccua

SEQ ID NO: 686848 - RNA, 21 nt, Homo sapiens
ccccaauuacagggugacuca

SEQ ID NO: 686849 - RNA, 23 nt, Homo sapiens
ccccacacuggagccaucucuuc

SEQ ID NO: 686850 - RNA, 14 nt, Homo sapiens
ccccaccaugcagc

SEQ ID NO: 686851 - RNA, 20 nt, Homo sapiens
ccccacccaguuucuggaaa

SEQ ID NO: 686852 - RNA, 23 nt, Homo sapiens
ccccacccccaaauccuguucca

SEQ ID NO: 686853 - RNA, 18 nt, Homo sapiens
ccccacccuccucuugga

SEQ ID NO: 686854 - RNA, 23 nt, Homo sapiens
ccccaccucggcacacacugugc

SEQ ID NO: 686855 - RNA, 22 nt, Homo sapiens
ccccacguugccucuacuuuau

SEQ ID NO: 686856 - RNA, 19 nt, Homo sapiens
ccccacugccugucccaga

SEQ ID NO: 686857 - RNA, 21 nt, Homo sapiens
ccccacugccugucccagaga

SEQ ID NO: 686858 - RNA, 17 nt, Homo sapiens
ccccagagagcaggcag

SEQ ID NO: 686859 - RNA, 15 nt, Homo sapiens
ccccagcaguugaau

SEQ ID NO: 686860 - RNA, 14 nt, Homo sapiens
ccccagcauuucca

SEQ ID NO: 686861 - RNA, 15 nt, Homo sapiens
ccccagccugggcca

SEQ ID NO: 686862 - RNA, 22 nt, Homo sapiens
ccccaggagggaggcaggggag

SEQ ID NO: 686863 - RNA, 14 nt, Homo sapiens
ccccaggcacuguu

SEQ ID NO: 686864 - RNA, 20 nt, Homo sapiens
ccccaggccggagcccagau

SEQ ID NO: 686865 - RNA, 16 nt, Homo sapiens
ccccagggaggucaau

SEQ ID NO: 686866 - RNA, 19 nt, Homo sapiens
ccccaggggacaagggauu

SEQ ID NO: 686867 - RNA, 22 nt, Homo sapiens
ccccaggucuuccugcuuucca

SEQ ID NO: 686868 - RNA, 17 nt, Homo sapiens
ccccaguagcugggauu

SEQ ID NO: 686869 - RNA, 19 nt, Homo sapiens
ccccagucggcugaacucu

SEQ ID NO: 686870 - RNA, 23 nt, Homo sapiens
ccccaguucaaucucccgcugcu

SEQ ID NO: 686871 - RNA, 17 nt, Homo sapiens
ccccauaaaaugauccu

SEQ ID NO: 686872 - RNA, 15 nt, Homo sapiens
ccccaucucccugcc

SEQ ID NO: 686873 - RNA, 14 nt, Homo sapiens
ccccaucugagcug

SEQ ID NO: 686874 - RNA, 13 nt, Homo sapiens
ccccaucugucca

SEQ ID NO: 686875 - RNA, 14 nt, Homo sapiens
ccccaucugugaau

SEQ ID NO: 686876 - RNA, 22 nt, Homo sapiens
ccccaugcaccucagggccaag

SEQ ID NO: 686877 - RNA, 18 nt, Homo sapiens
ccccaugccuguccagcc

SEQ ID NO: 686878 - RNA, 19 nt, Homo sapiens
ccccaugcucccuuuuaca

SEQ ID NO: 686879 - RNA, 13 nt, Homo sapiens
ccccaugggaucu

SEQ ID NO: 686880 - RNA, 16 nt, Homo sapiens
ccccauuagaauguga

SEQ ID NO: 686881 - RNA, 17 nt, Homo sapiens
ccccauuguucuggaaa

SEQ ID NO: 686882 - RNA, 11 nt, Homo sapiens
cccccaaagcc

SEQ ID NO: 686883 - RNA, 15 nt, Homo sapiens
cccccaaaguucaca

SEQ ID NO: 686884 - RNA, 12 nt, Homo sapiens
cccccaccacaa

SEQ ID NO: 686885 - RNA, 14 nt, Homo sapiens
cccccaccucaggu

SEQ ID NO: 686886 - RNA, 15 nt, Homo sapiens
cccucccucagggag

SEQ ID NO: 686887 - RNA, 18 nt, Homo sapiens
cccuccucccuccaagcc

SEQ ID NO: 686888 - RNA, 16 nt, Homo sapiens
cccuccucuagccauc

SEQ ID NO: 686889 - RNA, 18 nt, Homo sapiens
cccuccuggcucuugaua

SEQ ID NO: 686890 - RNA, 23 nt, Homo sapiens
cccuccugugacuuauucccuga

SEQ ID NO: 686891 - RNA, 17 nt, Homo sapiens
cccucgcgcccaaaaga

SEQ ID NO: 686892 - RNA, 19 nt, Homo sapiens
cccucgggccccauccuca

SEQ ID NO: 686893 - RNA, 21 nt, Homo sapiens
cccucgucaucaggugcauag

SEQ ID NO: 686894 - RNA, 21 nt, Homo sapiens
cccucgucuagagcagaccca

SEQ ID NO: 686895 - RNA, 21 nt, Homo sapiens
cccucguggccagcccggcug

SEQ ID NO: 686896 - RNA, 12 nt, Homo sapiens
cccucucaauaa

SEQ ID NO: 686897 - RNA, 13 nt, Homo sapiens
cccucucaccuca

SEQ ID NO: 686898 - RNA, 14 nt, Homo sapiens
cccucugcaaagcu

SEQ ID NO: 686899 - RNA, 18 nt, Homo sapiens
cccucugcuguucaggau

SEQ ID NO: 686900 - RNA, 18 nt, Homo sapiens
cccucugcuuuuaacucu

SEQ ID NO: 686901 - RNA, 16 nt, Homo sapiens
ccgaagaugguggcca

SEQ ID NO: 686902 - RNA, 22 nt, Homo sapiens
ccgaauaaauguuuuauuucua

SEQ ID NO: 686903 - RNA, 12 nt, Homo sapiens
ccgaauauugag

SEQ ID NO: 686904 - RNA, 12 nt, Homo sapiens
ccgaauccacag

SEQ ID NO: 686905 - RNA, 15 nt, Homo sapiens
ccgaaugucacuggu

SEQ ID NO: 686906 - RNA, 18 nt, Homo sapiens
ccgacaaccgaugcucca

SEQ ID NO: 686907 - RNA, 12 nt, Homo sapiens
ccgacacauuua

SEQ ID NO: 686908 - RNA, 21 nt, Homo sapiens
ccgaccacggggccgacauug

SEQ ID NO: 686909 - RNA, 14 nt, Homo sapiens
ccgaccacuuccag

SEQ ID NO: 686910 - RNA, 21 nt, Homo sapiens
ccgacugcuagggaguggucu

SEQ ID NO: 686911 - RNA, 18 nt, Homo sapiens
ccgagauccccagggcag

SEQ ID NO: 686912 - RNA, 17 nt, Homo sapiens
ccgaggccgugcagugg

SEQ ID NO: 686913 - RNA, 19 nt, Homo sapiens
ccgaggcugagaaucagac

SEQ ID NO: 686914 - RNA, 15 nt, Homo sapiens
ccgagguaggggugg

SEQ ID NO: 686915 - RNA, 20 nt, Homo sapiens
ccgagucucuucuccacugg

SEQ ID NO: 686916 - RNA, 12 nt, Homo sapiens
ccgagugcaaug

SEQ ID NO: 686917 - RNA, 17 nt, Homo sapiens
ccgagugcaaugaauga

SEQ ID NO: 686918 - RNA, 22 nt, Homo sapiens
ccgauaccgggacacagaauua

SEQ ID NO: 686919 - RNA, 16 nt, Homo sapiens
ccgaucuccacuguug

SEQ ID NO: 686920 - RNA, 14 nt, Homo sapiens
ccgaugauucuuaa

SEQ ID NO: 686921 - RNA, 14 nt, Homo sapiens
ccgaugguccucac

SEQ ID NO: 686922 - RNA, 12 nt, Homo sapiens
ccgauucucugc

SEQ ID NO: 686923 - RNA, 18 nt, Homo sapiens
ccgauuugggaaccaagc

SEQ ID NO: 686924 - RNA, 23 nt, Homo sapiens
ccgcaacaguuuuuuaugcuaau

SEQ ID NO: 686925 - RNA, 19 nt, Homo sapiens
ccgcaagaaagcaugacuu

SEQ ID NO: 686926 - RNA, 13 nt, Homo sapiens
ccgcaauacugua

SEQ ID NO: 686927 - RNA, 14 nt, Homo sapiens
ccgcacaugcacac

SEQ ID NO: 686928 - RNA, 20 nt, Homo sapiens
ccgcaggcagacuacacagg

SEQ ID NO: 686929 - RNA, 18 nt, Homo sapiens
ccgcagugggaagugaau

SEQ ID NO: 686930 - RNA, 23 nt, Homo sapiens
ccgcauccgggguucaagccauu

SEQ ID NO: 686931 - RNA, 16 nt, Homo sapiens
ccgcccucuuccugac

SEQ ID NO: 686932 - RNA, 23 nt, Homo sapiens
ccgccggacugggcagauccuca

SEQ ID NO: 686933 - RNA, 20 nt, Homo sapiens
ccgccugcccagacugauga

SEQ ID NO: 686934 - RNA, 13 nt, Homo sapiens
ccgcgcuccgggc

SEQ ID NO: 686935 - RNA, 15 nt, Homo sapiens
ccgcuccaaugccua

SEQ ID NO: 686936 - RNA, 15 nt, Homo sapiens
ccgcucugauuucag

SEQ ID NO: 686937 - RNA, 12 nt, Homo sapiens
ccgcugagcuga

SEQ ID NO: 686938 - RNA, 16 nt, Homo sapiens
ccgcugccugcacugg

SEQ ID NO: 686939 - RNA, 19 nt, Homo sapiens
ccggaaggaaugucagggc

SEQ ID NO: 686940 - RNA, 23 nt, Homo sapiens
ccggaauccuuggggagcacuug

SEQ ID NO: 686941 - RNA, 20 nt, Homo sapiens
ccggcauccuugccugucua

SEQ ID NO: 686942 - RNA, 13 nt, Homo sapiens
ccggccaccagau

SEQ ID NO: 686943 - RNA, 19 nt, Homo sapiens
ccggccaggccaccuccag

SEQ ID NO: 686944 - RNA, 21 nt, Homo sapiens
ccggcgaggguaugucagugu

SEQ ID NO: 686945 - RNA, 16 nt, Homo sapiens
ccggcugaaggcugag

SEQ ID NO: 686946 - RNA, 16 nt, Homo sapiens
ccggcugaggccugag

SEQ ID NO: 686947 - RNA, 19 nt, Homo sapiens
ccggcugugccagggugag

SEQ ID NO: 686948 - RNA, 22 nt, Homo sapiens
ccgggaacuggagucugucucu

SEQ ID NO: 686949 - RNA, 13 nt, Homo sapiens
ccgggaagagcca

SEQ ID NO: 686950 - RNA, 19 nt, Homo sapiens
ccgggaccauugaccucag

SEQ ID NO: 686951 - RNA, 18 nt, Homo sapiens
ccgggacccucaggugua

SEQ ID NO: 686952 - RNA, 14 nt, Homo sapiens
ccgggacgcagggg

SEQ ID NO: 686953 - RNA, 23 nt, Homo sapiens
ccgggaggcagagguugcagugu

SEQ ID NO: 686954 - RNA, 21 nt, Homo sapiens
ccgggcgugguggcacaugcc

SEQ ID NO: 686955 - RNA, 17 nt, Homo sapiens
ccggugcaugaugcugc

SEQ ID NO: 686956 - RNA, 12 nt, Homo sapiens
ccggugcucugg

SEQ ID NO: 686957 - RNA, 17 nt, Homo sapiens
ccgguucuuaaauccau

SEQ ID NO: 686958 - RNA, 18 nt, Homo sapiens
ccguaacaacugugguca

SEQ ID NO: 686959 - RNA, 17 nt, Homo sapiens
ccguacaucugcaauau

SEQ ID NO: 686960 - RNA, 14 nt, Homo sapiens
ccguaccaaucucu

SEQ ID NO: 686961 - RNA, 21 nt, Homo sapiens
ccguaccucuucccaugacug

SEQ ID NO: 686962 - RNA, 22 nt, Homo sapiens
ccguaccucuucccaugacugc

SEQ ID NO: 686963 - RNA, 16 nt, Homo sapiens
ccguaucacaguguuu

SEQ ID NO: 686964 - RNA, 14 nt, Homo sapiens
ccguaucugucaca

SEQ ID NO: 686965 - RNA, 21 nt, Homo sapiens
ccgucggacugcccccagaaa

SEQ ID NO: 686966 - RNA, 13 nt, Homo sapiens
ccgucucuuuaaa

SEQ ID NO: 686967 - RNA, 11 nt, Homo sapiens
ccgucuucucc

SEQ ID NO: 686968 - RNA, 16 nt, Homo sapiens
ccgugaacugugcaua

SEQ ID NO: 686969 - RNA, 14 nt, Homo sapiens
ccgugccaaaagac

SEQ ID NO: 686970 - RNA, 15 nt, Homo sapiens
ccguggagacugaga

SEQ ID NO: 686971 - RNA, 14 nt, Homo sapiens
ccguggccuggcau

SEQ ID NO: 686972 - RNA, 23 nt, Homo sapiens
ccguguaaauaauuuauuacaag

SEQ ID NO: 686973 - RNA, 15 nt, Homo sapiens
ccguguggacugugc

SEQ ID NO: 686974 - RNA, 22 nt, Homo sapiens
ccguguggguggcgggugcaca

SEQ ID NO: 686975 - RNA, 16 nt, Homo sapiens
ccgugugguaccuuca

SEQ ID NO: 686976 - RNA, 23 nt, Homo sapiens
ccguguugcaugaaggagcagca

SEQ ID NO: 686977 - RNA, 18 nt, Homo sapiens
ccguugcugaaaaugauu

SEQ ID NO: 686978 - RNA, 14 nt, Homo sapiens
ccuaaaaacuggca

SEQ ID NO: 686979 - RNA, 19 nt, Homo sapiens
ccuaaaaaguaucauuaca

SEQ ID NO: 686980 - RNA, 13 nt, Homo sapiens
ccuaaaagcacac

SEQ ID NO: 686981 - RNA, 21 nt, Homo sapiens
ccuaaaagccaccccacuucu

SEQ ID NO: 686982 - RNA, 12 nt, Homo sapiens
ccuaaaauccau

SEQ ID NO: 686983 - RNA, 14 nt, Homo sapiens
ccuaaaaugaauuu

SEQ ID NO: 686984 - RNA, 17 nt, Homo sapiens
ccuaaaauuguaugaaa

SEQ ID NO: 686985 - RNA, 19 nt, Homo sapiens
ccuaaagacuaacuugaaa

SEQ ID NO: 686986 - RNA, 14 nt, Homo sapiens
ccuaaaucccaaga

SEQ ID NO: 686987 - RNA, 22 nt, Homo sapiens
ccuaaauguuaacuacauauug

SEQ ID NO: 686988 - RNA, 16 nt, Homo sapiens
ccuaacaaguguaucu

SEQ ID NO: 686989 - RNA, 21 nt, Homo sapiens
ccuaacaugacaguauuccau

SEQ ID NO: 686990 - RNA, 21 nt, Homo sapiens
ccuaacauucgaucucauuca

SEQ ID NO: 686991 - RNA, 15 nt, Homo sapiens
ccuaaccacuuagca

SEQ ID NO: 686992 - RNA, 21 nt, Homo sapiens
ccuaacugaaagaugaucauu

SEQ ID NO: 686993 - RNA, 13 nt, Homo sapiens
ccuaacugaauuu

SEQ ID NO: 686994 - RNA, 14 nt, Homo sapiens
ccuaagagauuuau

SEQ ID NO: 686995 - RNA, 21 nt, Homo sapiens
ccuaagaucucgguuugccaa

SEQ ID NO: 686996 - RNA, 16 nt, Homo sapiens
ccuaaggaaccuuccu

SEQ ID NO: 686997 - RNA, 16 nt, Homo sapiens
ccuaaggaaugacuuu

SEQ ID NO: 686998 - RNA, 20 nt, Homo sapiens
ccuaaggacaagacacugag

SEQ ID NO: 686999 - RNA, 20 nt, Homo sapiens
ccuaaggugagugugcagua

SEQ ID NO: 687000 - RNA, 14 nt, Homo sapiens
ccuaaggugucuga

SEQ ID NO: 687001 - RNA, 12 nt, Homo sapiens
ccuaaguacaag

SEQ ID NO: 687002 - RNA, 17 nt, Homo sapiens
ccuaagucucugugaau

SEQ ID NO: 687003 - RNA, 22 nt, Homo sapiens
ccuaauaaacauccuucaagaa

SEQ ID NO: 687004 - RNA, 15 nt, Homo sapiens
ccuaauaacgugaaa

SEQ ID NO: 687005 - RNA, 16 nt, Homo sapiens
ccuaauaggcugggag

SEQ ID NO: 687006 - RNA, 14 nt, Homo sapiens
ccuaaucaaauggc

SEQ ID NO: 687007 - RNA, 14 nt, Homo sapiens
ccuaauggaccucc

SEQ ID NO: 687008 - RNA, 15 nt, Homo sapiens
ccuacaagauuuccu

SEQ ID NO: 687009 - RNA, 16 nt, Homo sapiens
ccuacagaagggcagu

SEQ ID NO: 687010 - RNA, 23 nt, Homo sapiens
ccacauccuccacguucugcuca

SEQ ID NO: 687011 - RNA, 11 nt, Homo sapiens
ccacaucuugc

SEQ ID NO: 687012 - RNA, 14 nt, Homo sapiens
ccacaugaccucca

SEQ ID NO: 687013 - RNA, 19 nt, Homo sapiens
ccacaugggugcauuugua

SEQ ID NO: 687014 - RNA, 12 nt, Homo sapiens
ccacaugguguc

SEQ ID NO: 687015 - RNA, 19 nt, Homo sapiens
ccacauuauacauuugaug

SEQ ID NO: 687016 - RNA, 18 nt, Homo sapiens
ccacauucaaaauagggu

SEQ ID NO: 687017 - RNA, 17 nt, Homo sapiens
ccacauucgucacagau

SEQ ID NO: 687018 - RNA, 15 nt, Homo sapiens
ccaccaaaacugcuc

SEQ ID NO: 687019 - RNA, 16 nt, Homo sapiens
ccaccaaaacugcucc

SEQ ID NO: 687020 - RNA, 16 nt, Homo sapiens
ccaccaaagacaguug

SEQ ID NO: 687021 - RNA, 23 nt, Homo sapiens
ccaccaagaagcacugggugacc

SEQ ID NO: 687022 - RNA, 17 nt, Homo sapiens
ccaccaaugggccucca

SEQ ID NO: 687023 - RNA, 18 nt, Homo sapiens
ccaccaauugagcaagau

SEQ ID NO: 687024 - RNA, 20 nt, Homo sapiens
ccaccaccaaaacugcuccu

SEQ ID NO: 687025 - RNA, 15 nt, Homo sapiens
ccaccaccacuggcc

SEQ ID NO: 687026 - RNA, 16 nt, Homo sapiens
ccaccaccccuaccac

SEQ ID NO: 687027 - RNA, 13 nt, Homo sapiens
ccaccacugcagc

SEQ ID NO: 687028 - RNA, 12 nt, Homo sapiens
ccaccagaugag

SEQ ID NO: 687029 - RNA, 17 nt, Homo sapiens
ccaccauccagguggag

SEQ ID NO: 687030 - RNA, 16 nt, Homo sapiens
ccacccaaaagucaaa

SEQ ID NO: 687031 - RNA, 21 nt, Homo sapiens
ccacccaauugugguugugca

SEQ ID NO: 687032 - RNA, 16 nt, Homo sapiens
ccacccacgggggaga

SEQ ID NO: 687033 - RNA, 14 nt, Homo sapiens
ccacccauaucaug

SEQ ID NO: 687034 - RNA, 13 nt, Homo sapiens
ccaccccaagaga

SEQ ID NO: 687035 - RNA, 13 nt, Homo sapiens
ccuacgugccacu

SEQ ID NO: 687036 - RNA, 22 nt, Homo sapiens
ccuacuaucacugaacaaacua

SEQ ID NO: 687037 - RNA, 16 nt, Homo sapiens
ccuacucuucaggguc

SEQ ID NO: 687038 - RNA, 15 nt, Homo sapiens
ccuacugaaugcucu

SEQ ID NO: 687039 - RNA, 19 nt, Homo sapiens
ccuacugagcauuugcacc

SEQ ID NO: 687040 - RNA, 14 nt, Homo sapiens
ccuacugaugucag

SEQ ID NO: 687041 - RNA, 23 nt, Homo sapiens
ccuacuguucggacaaaaaaagu

SEQ ID NO: 687042 - RNA, 14 nt, Homo sapiens
ccuagaaagacaga

SEQ ID NO: 687043 - RNA, 18 nt, Homo sapiens
ccuagaaguucaguuuuu

SEQ ID NO: 687044 - RNA, 22 nt, Homo sapiens
ccuagaaugucagauuucuggu

SEQ ID NO: 687045 - RNA, 15 nt, Homo sapiens
ccuagagcuccaguu

SEQ ID NO: 687046 - RNA, 23 nt, Homo sapiens
ccuagagguggaguucuuagcua

SEQ ID NO: 687047 - RNA, 12 nt, Homo sapiens
ccuagagugcag

SEQ ID NO: 687048 - RNA, 20 nt, Homo sapiens
ccuagauuuuguugaccuca

SEQ ID NO: 687049 - RNA, 23 nt, Homo sapiens
ccuagcaaggcaugauguuaacc

SEQ ID NO: 687050 - RNA, 19 nt, Homo sapiens
ccuagccagcacuuguaua

SEQ ID NO: 687051 - RNA, 20 nt, Homo sapiens
ccuagccaggcuaucuggcc

SEQ ID NO: 687052 - RNA, 22 nt, Homo sapiens
ccuagcccagacucugagcugc

SEQ ID NO: 687053 - RNA, 21 nt, Homo sapiens
ccuagcccagcaaaugaucag

SEQ ID NO: 687054 - RNA, 19 nt, Homo sapiens
ccuagccucgcucuuggca

SEQ ID NO: 687055 - RNA, 18 nt, Homo sapiens
ccuagcucucccagugaa

SEQ ID NO: 687056 - RNA, 15 nt, Homo sapiens
ccuaggaaaauguag

SEQ ID NO: 687057 - RNA, 16 nt, Homo sapiens
ccuaggaggcuggcca

SEQ ID NO: 687058 - RNA, 17 nt, Homo sapiens
ccuaggaggcuggccaa

SEQ ID NO: 687059 - RNA, 18 nt, Homo sapiens
ccuaggauccccccaugc

SEQ ID NO: 687060 - RNA, 20 nt, Homo sapiens
ccuaggauuucaugauuuca

SEQ ID NO: 687061 - RNA, 17 nt, Homo sapiens
ccuaggcaacaugguga

SEQ ID NO: 687062 - RNA, 15 nt, Homo sapiens
ccuagggcacuuuaa

SEQ ID NO: 687063 - RNA, 18 nt, Homo sapiens
ccuagguaucuauagcau

SEQ ID NO: 687064 - RNA, 15 nt, Homo sapiens
ccuaguaauugccua

SEQ ID NO: 687065 - RNA, 22 nt, Homo sapiens
ccuaguacugccccccaugagg

SEQ ID NO: 687066 - RNA, 21 nt, Homo sapiens
ccuaguagaauauggacuugg

SEQ ID NO: 687067 - RNA, 21 nt, Homo sapiens
ccuagucaccaagaacuccac

SEQ ID NO: 687068 - RNA, 13 nt, Homo sapiens
ccuaguccaacau

SEQ ID NO: 687069 - RNA, 22 nt, Homo sapiens
ccuaguccccagccugcucccu

SEQ ID NO: 687070 - RNA, 18 nt, Homo sapiens
ccuaguccuugcugcauu

SEQ ID NO: 687071 - RNA, 12 nt, Homo sapiens
ccuagucuccac

SEQ ID NO: 687072 - RNA, 18 nt, Homo sapiens
ccuaguuaucaaggggau

SEQ ID NO: 687073 - RNA, 13 nt, Homo sapiens
ccuauaaauauua

SEQ ID NO: 687074 - RNA, 12 nt, Homo sapiens
ccuauaagcuua

SEQ ID NO: 687075 - RNA, 18 nt, Homo sapiens
ccuauaaggagaguucaa

SEQ ID NO: 687076 - RNA, 14 nt, Homo sapiens
ccuauaaucuguca

SEQ ID NO: 687077 - RNA, 15 nt, Homo sapiens
ccuauaaucugucaa

SEQ ID NO: 687078 - RNA, 15 nt, Homo sapiens
ccuauacacuagaca

SEQ ID NO: 687079 - RNA, 18 nt, Homo sapiens
ccuauagcacugagcuca

SEQ ID NO: 687080 - RNA, 20 nt, Homo sapiens
ccuauauagaugcagcauuu

SEQ ID NO: 687081 - RNA, 19 nt, Homo sapiens
ccuauauguaguauaaaga

SEQ ID NO: 687082 - RNA, 19 nt, Homo sapiens
ccuauauuguuuucagugu

SEQ ID NO: 687083 - RNA, 14 nt, Homo sapiens
ccuaucacugauag

SEQ ID NO: 687084 - RNA, 23 nt, Homo sapiens
ccuaucagaaguuucucagcucc

SEQ ID NO: 687085 - RNA, 17 nt, Homo sapiens
ccuauccacaauaguca

SEQ ID NO: 687086 - RNA, 17 nt, Homo sapiens
ccuauccacaggggugu

SEQ ID NO: 687087 - RNA, 12 nt, Homo sapiens
ccuaucuggaag

SEQ ID NO: 687088 - RNA, 12 nt, Homo sapiens
ccuaugcaaaua

SEQ ID NO: 687089 - RNA, 23 nt, Homo sapiens
ccuaugccaauaaaaaugucuca

SEQ ID NO: 687090 - RNA, 16 nt, Homo sapiens
ccuaugcccugcccuu

SEQ ID NO: 687091 - RNA, 13 nt, Homo sapiens
ccuaugcuuaaua

SEQ ID NO: 687092 - RNA, 22 nt, Homo sapiens
ccuauguccuaaggacacacua

SEQ ID NO: 687093 - RNA, 22 nt, Homo sapiens
ccuaugugggugggaccacaga

SEQ ID NO: 687094 - RNA, 21 nt, Homo sapiens
ccuauuaucagaaggugacaa

SEQ ID NO: 687095 - RNA, 16 nt, Homo sapiens
ccuauucuauugcagu

SEQ ID NO: 687096 - RNA, 17 nt, Homo sapiens
ccuauugaaagaccaga

SEQ ID NO: 687097 - RNA, 14 nt, Homo sapiens
ccuauuucugauga

SEQ ID NO: 687098 - RNA, 17 nt, Homo sapiens
ccucaaaacaaaggccu

SEQ ID NO: 687099 - RNA, 21 nt, Homo sapiens
ccucaaacuuccagucaggua

SEQ ID NO: 687100 - RNA, 17 nt, Homo sapiens
ccucaaaugacccaaag

SEQ ID NO: 687101 - RNA, 20 nt, Homo sapiens
ccucaaaugacccaaagacc

SEQ ID NO: 687102 - RNA, 19 nt, Homo sapiens
ccucaaaugucagagcuau

SEQ ID NO: 687103 - RNA, 21 nt, Homo sapiens
ccucaacauugcauggugcua

SEQ ID NO: 687104 - RNA, 15 nt, Homo sapiens
ccucaaccaaugcca

SEQ ID NO: 687105 - RNA, 20 nt, Homo sapiens
ccucaaccaaugccaaaaaa

SEQ ID NO: 687106 - RNA, 16 nt, Homo sapiens
ccucaaccugugauga

SEQ ID NO: 687107 - RNA, 18 nt, Homo sapiens
ccucaagguguucucugu

SEQ ID NO: 687108 - RNA, 14 nt, Homo sapiens
ccucaaucuauucu

SEQ ID NO: 687109 - RNA, 18 nt, Homo sapiens
ccucaaugucacuuggug

SEQ ID NO: 687110 - RNA, 15 nt, Homo sapiens
ccucaauucacauag

SEQ ID NO: 687111 - RNA, 21 nt, Homo sapiens
ccucaauuuccucaucugggu

SEQ ID NO: 687112 - RNA, 21 nt, Homo sapiens
ccucacaggagcuuacuggca

SEQ ID NO: 687113 - RNA, 18 nt, Homo sapiens
ccucacauggucugcuua

SEQ ID NO: 687114 - RNA, 17 nt, Homo sapiens
ccucacauucucuaugu

SEQ ID NO: 687115 - RNA, 14 nt, Homo sapiens
ccucaccacaccca

SEQ ID NO: 687116 - RNA, 22 nt, Homo sapiens
ccucaccacacccaggucucuu

SEQ ID NO: 687117 - RNA, 14 nt, Homo sapiens
ccucaccaccacac

SEQ ID NO: 687118 - RNA, 23 nt, Homo sapiens
ccucaccaggagcccggcuucca

SEQ ID NO: 687119 - RNA, 18 nt, Homo sapiens
ccucacccaucaaaagca

SEQ ID NO: 687120 - RNA, 20 nt, Homo sapiens
ccucacccccagcuuugcua

SEQ ID NO: 687121 - RNA, 22 nt, Homo sapiens
ccucacccugcccuuguugucu

SEQ ID NO: 687122 - RNA, 18 nt, Homo sapiens
ccucaccugguugaccca

SEQ ID NO: 687123 - RNA, 16 nt, Homo sapiens
ccucacgacuggucac

SEQ ID NO: 687124 - RNA, 19 nt, Homo sapiens
ccucacgcucuggacauga

SEQ ID NO: 687125 - RNA, 14 nt, Homo sapiens
ccucacucauuccc

SEQ ID NO: 687126 - RNA, 16 nt, Homo sapiens
ccucacugaaaacauc

SEQ ID NO: 687127 - RNA, 17 nt, Homo sapiens
ccucacugaaugccuca

SEQ ID NO: 687128 - RNA, 11 nt, Homo sapiens
ccucacugaga

SEQ ID NO: 687129 - RNA, 15 nt, Homo sapiens
ccucacugagccuca

SEQ ID NO: 687130 - RNA, 14 nt, Homo sapiens
ccucacuguggaau

SEQ ID NO: 687131 - RNA, 15 nt, Homo sapiens
ccucagaaagggauu

SEQ ID NO: 687132 - RNA, 19 nt, Homo sapiens
ccucagaaagucaccagga

SEQ ID NO: 687133 - RNA, 16 nt, Homo sapiens
ccucagaauaaaagau

SEQ ID NO: 687134 - RNA, 12 nt, Homo sapiens
ccucagacaucc

SEQ ID NO: 687135 - RNA, 18 nt, Homo sapiens
ccucagagccugaccuga

SEQ ID NO: 687136 - RNA, 14 nt, Homo sapiens
ccucagaguggagu

SEQ ID NO: 687137 - RNA, 19 nt, Homo sapiens
ccucagaguguggguccuu

SEQ ID NO: 687138 - RNA, 13 nt, Homo sapiens
ccucagauuccac

SEQ ID NO: 687139 - RNA, 17 nt, Homo sapiens
ccucagccauucacugc

SEQ ID NO: 687140 - RNA, 22 nt, Homo sapiens
ccucagcccaggucagcuguua

SEQ ID NO: 687141 - RNA, 21 nt, Homo sapiens
ccucagccuggggcucucuga

SEQ ID NO: 687142 - RNA, 11 nt, Homo sapiens
ccucagcuaug

SEQ ID NO: 687143 - RNA, 17 nt, Homo sapiens
ccucagcuucuucacag

SEQ ID NO: 687144 - RNA, 12 nt, Homo sapiens
ccucagcuuucc

SEQ ID NO: 687145 - RNA, 23 nt, Homo sapiens
cggcaggcguguggcagccacac

SEQ ID NO: 687146 - RNA, 20 nt, Homo sapiens
cggccaggcuggagugcagu

SEQ ID NO: 687147 - RNA, 16 nt, Homo sapiens
cggccccaucucucau

SEQ ID NO: 687148 - RNA, 18 nt, Homo sapiens
cggcccccucaccccagc

SEQ ID NO: 687149 - RNA, 14 nt, Homo sapiens
cggccgacugccug

SEQ ID NO: 687150 - RNA, 16 nt, Homo sapiens
cggccgccgccaggac

SEQ ID NO: 687151 - RNA, 22 nt, Homo sapiens
cggccuccggcgucuugcccag

SEQ ID NO: 687152 - RNA, 21 nt, Homo sapiens
cggccugcaccgacccgaggc

SEQ ID NO: 687153 - RNA, 18 nt, Homo sapiens
cggcucacgccuguaauc

SEQ ID NO: 687154 - RNA, 13 nt, Homo sapiens
cggcuccugaugg

SEQ ID NO: 687155 - RNA, 12 nt, Homo sapiens
cggcugaacuga

SEQ ID NO: 687156 - RNA, 11 nt, Homo sapiens
cggcugaccau

SEQ ID NO: 687157 - RNA, 21 nt, Homo sapiens
cggcugagucaugaucucccu

SEQ ID NO: 687158 - RNA, 16 nt, Homo sapiens
cggcugcccgacucag

SEQ ID NO: 687159 - RNA, 15 nt, Homo sapiens
cggcuggagcugccu

SEQ ID NO: 687160 - RNA, 22 nt, Homo sapiens
cggcugucccucauggagaccu

SEQ ID NO: 687161 - RNA, 17 nt, Homo sapiens
cggcuugugaggcuucc

SEQ ID NO: 687162 - RNA, 19 nt, Homo sapiens
cggcuugugggcuggugcc

SEQ ID NO: 687163 - RNA, 17 nt, Homo sapiens
cgggaaacacacaagca

SEQ ID NO: 687164 - RNA, 14 nt, Homo sapiens
cgggaacuggaguc

SEQ ID NO: 687165 - RNA, 15 nt, Homo sapiens
cgggacccucaggug

SEQ ID NO: 687166 - RNA, 23 nt, Homo sapiens
cgggacgguaggucaugucugua

SEQ ID NO: 687167 - RNA, 15 nt, Homo sapiens
cgggagcagugucuu

SEQ ID NO: 687168 - RNA, 20 nt, Homo sapiens
cgggaggaggaggagcaccu

SEQ ID NO: 687169 - RNA, 15 nt, Homo sapiens
cgggaggcugagaca

SEQ ID NO: 687170 - RNA, 13 nt, Homo sapiens
cgggauccagcuc

SEQ ID NO: 687171 - RNA, 14 nt, Homo sapiens
cgggauuaguacac

SEQ ID NO: 687172 - RNA, 13 nt, Homo sapiens
cgggcaccuguag

SEQ ID NO: 687173 - RNA, 13 nt, Homo sapiens
cgggccagggugg

SEQ ID NO: 687174 - RNA, 14 nt, Homo sapiens
cgggcccaugaaga

SEQ ID NO: 687175 - RNA, 16 nt, Homo sapiens
cgggccccauccucau

SEQ ID NO: 687176 - RNA, 16 nt, Homo sapiens
cgggcccugcugagga

SEQ ID NO: 687177 - RNA, 16 nt, Homo sapiens
cgggcucuaugccugc

SEQ ID NO: 687178 - RNA, 21 nt, Homo sapiens
cggggaagugcucuaacuuuu

SEQ ID NO: 687179 - RNA, 22 nt, Homo sapiens
cggggcugucccgugcaugggu

SEQ ID NO: 687180 - RNA, 15 nt, Homo sapiens
cgggggccuguggug

SEQ ID NO: 687181 - RNA, 22 nt, Homo sapiens
cgggggugugucuguagguguc

SEQ ID NO: 687182 - RNA, 19 nt, Homo sapiens
cggggucugcagcaaugaa

SEQ ID NO: 687183 - RNA, 21 nt, Homo sapiens
cggggucuggcuguguugccc

SEQ ID NO: 687184 - RNA, 16 nt, Homo sapiens
cgggguuucuccaugu

SEQ ID NO: 687185 - RNA, 15 nt, Homo sapiens
cgggucugagacuga

SEQ ID NO: 687186 - RNA, 19 nt, Homo sapiens
cgggugccaugaagugugu

SEQ ID NO: 687187 - RNA, 14 nt, Homo sapiens
cggguggaucacaa

SEQ ID NO: 687188 - RNA, 15 nt, Homo sapiens
cggguuacuuucaca

SEQ ID NO: 687189 - RNA, 14 nt, Homo sapiens
cggucaccuguugg

SEQ ID NO: 687190 - RNA, 14 nt, Homo sapiens
cggucagugccuuu

SEQ ID NO: 687191 - RNA, 18 nt, Homo sapiens
cggugaaaccccaucucu

SEQ ID NO: 687192 - RNA, 23 nt, Homo sapiens
cggugagccggggccgucugugu

SEQ ID NO: 687193 - RNA, 23 nt, Homo sapiens
cggugcugggggcacagcugucu

SEQ ID NO: 687194 - RNA, 16 nt, Homo sapiens
cgguggacccagggau

SEQ ID NO: 687195 - RNA, 22 nt, Homo sapiens
cgguggaggaaggcucugucac

SEQ ID NO: 687196 - RNA, 15 nt, Homo sapiens
cgguggcucaugccu

SEQ ID NO: 687197 - RNA, 19 nt, Homo sapiens
cgguugcagucacugugau

SEQ ID NO: 687198 - RNA, 22 nt, Homo sapiens
cgguuuacagcuaucgaacuuc

SEQ ID NO: 687199 - RNA, 16 nt, Homo sapiens
cgguuugcuacauucu

SEQ ID NO: 687200 - RNA, 18 nt, Homo sapiens
cgguuuggauaaucuuaa

SEQ ID NO: 687201 - RNA, 20 nt, Homo sapiens
cgguuugguagacuuggaca

SEQ ID NO: 687202 - RNA, 12 nt, Homo sapiens
cgguuuuagcuu

SEQ ID NO: 687203 - RNA, 18 nt, Homo sapiens
cguaaacgacacucucug

SEQ ID NO: 687204 - RNA, 14 nt, Homo sapiens
cguaacaacugugg

SEQ ID NO: 687205 - RNA, 15 nt, Homo sapiens
cguaacaacuguggu

SEQ ID NO: 687206 - RNA, 15 nt, Homo sapiens
cguaaucguuccuga

SEQ ID NO: 687207 - RNA, 16 nt, Homo sapiens
cguaaugaaagccaca

SEQ ID NO: 687208 - RNA, 19 nt, Homo sapiens
cguacccagccauguguug

SEQ ID NO: 687209 - RNA, 17 nt, Homo sapiens
cguaccuucaugugauu

SEQ ID NO: 687210 - RNA, 15 nt, Homo sapiens
cguagacagguguua

SEQ ID NO: 687211 - RNA, 14 nt, Homo sapiens
cguagacuugacaa

SEQ ID NO: 687212 - RNA, 17 nt, Homo sapiens
cguagggcuaagggagg

SEQ ID NO: 687213 - RNA, 16 nt, Homo sapiens
cguaguccgcuuucuc

SEQ ID NO: 687214 - RNA, 23 nt, Homo sapiens
cguauacauaggcaucauuucac

SEQ ID NO: 687215 - RNA, 13 nt, Homo sapiens
cguauagguugau

SEQ ID NO: 687216 - RNA, 13 nt, Homo sapiens
cguaucucuagaa

SEQ ID NO: 687217 - RNA, 19 nt, Homo sapiens
cguauguaacaugauguua

SEQ ID NO: 687218 - RNA, 17 nt, Homo sapiens
cgucaaagcaguaguca

SEQ ID NO: 687219 - RNA, 17 nt, Homo sapiens
cgucagaccaguacugg

SEQ ID NO: 687220 - RNA, 15 nt, Homo sapiens
cgucagccaccuggg

SEQ ID NO: 687221 - RNA, 18 nt, Homo sapiens
cgucaggaaaccaaauaa

SEQ ID NO: 687222 - RNA, 16 nt, Homo sapiens
cgucaugcuuguguua

SEQ ID NO: 687223 - RNA, 21 nt, Homo sapiens
cguccacuccuccuacuguau

SEQ ID NO: 687224 - RNA, 15 nt, Homo sapiens
cgucccauccagcua

SEQ ID NO: 687225 - RNA, 12 nt, Homo sapiens
cgucccuaagca

SEQ ID NO: 687226 - RNA, 18 nt, Homo sapiens
cguccuugugccagguca

SEQ ID NO: 687227 - RNA, 20 nt, Homo sapiens
cgucucuacuaaaaauacaa

SEQ ID NO: 687228 - RNA, 14 nt, Homo sapiens
cgucucugcuaaac

SEQ ID NO: 687229 - RNA, 16 nt, Homo sapiens
cgucuguuuuugcaac

SEQ ID NO: 687230 - RNA, 22 nt, Homo sapiens
cgucuuagcaagaaguaaaaug

SEQ ID NO: 687231 - RNA, 23 nt, Homo sapiens
cgucuuccugaguggugccaaac

SEQ ID NO: 687232 - RNA, 20 nt, Homo sapiens
cgugaaauuugccucugucc

SEQ ID NO: 687233 - RNA, 16 nt, Homo sapiens
cgugaacugugcauag

SEQ ID NO: 687234 - RNA, 18 nt, Homo sapiens
cgugaaucuguaucuugc

SEQ ID NO: 687235 - RNA, 14 nt, Homo sapiens
cgugacaacaugcg

SEQ ID NO: 687236 - RNA, 22 nt, Homo sapiens
cgugacggagcccacacugcca

SEQ ID NO: 687237 - RNA, 20 nt, Homo sapiens
cgugagugacauagccucau

SEQ ID NO: 687238 - RNA, 20 nt, Homo sapiens
cgugauaaugcagacuuccu

SEQ ID NO: 687239 - RNA, 15 nt, Homo sapiens
cgugaucaaagccac

SEQ ID NO: 687240 - RNA, 16 nt, Homo sapiens
cgugaucaaagccaca

SEQ ID NO: 687241 - RNA, 22 nt, Homo sapiens
cgugauggcuaugccuugcaca

SEQ ID NO: 687242 - RNA, 9 nt, Homo sapiens
cgugcaaua

SEQ ID NO: 687243 - RNA, 14 nt, Homo sapiens
cgugcacucaguca

SEQ ID NO: 687244 - RNA, 13 nt, Homo sapiens
cgugcacugugaa

SEQ ID NO: 687245 - RNA, 14 nt, Homo sapiens
cgugcagucaggug

SEQ ID NO: 687246 - RNA, 20 nt, Homo sapiens
cgugccaaaaaucuuuucau

SEQ ID NO: 687247 - RNA, 20 nt, Homo sapiens
cgugccagcucuaguuuuca

SEQ ID NO: 687248 - RNA, 13 nt, Homo sapiens
cgugccuguaguc

SEQ ID NO: 687249 - RNA, 15 nt, Homo sapiens
cgugccuguguccug

SEQ ID NO: 687250 - RNA, 17 nt, Homo sapiens
cgugccuguuugcuuag

SEQ ID NO: 687251 - RNA, 19 nt, Homo sapiens
cgugcuacugcacuccagc

SEQ ID NO: 687252 - RNA, 20 nt, Homo sapiens
cgugcucccgaugcugcuau

SEQ ID NO: 687253 - RNA, 14 nt, Homo sapiens
cgugcuggcgacac

SEQ ID NO: 687254 - RNA, 15 nt, Homo sapiens
cguggaauugacccc

SEQ ID NO: 687255 - RNA, 13 nt, Homo sapiens
cguggacacccca

SEQ ID NO: 687256 - RNA, 13 nt, Homo sapiens
cguggccuggcau

SEQ ID NO: 687257 - RNA, 19 nt, Homo sapiens
cgugggccguaucugucac

SEQ ID NO: 687258 - RNA, 17 nt, Homo sapiens
cgugggggcacugacca

SEQ ID NO: 687259 - RNA, 17 nt, Homo sapiens
cgugguauaaucuccau

SEQ ID NO: 687260 - RNA, 23 nt, Homo sapiens
cgugguaugucugccauguugcc

SEQ ID NO: 687261 - RNA, 14 nt, Homo sapiens
cguguaaauuaugu

SEQ ID NO: 687262 - RNA, 16 nt, Homo sapiens
cguguaaauugcacag

SEQ ID NO: 687263 - RNA, 15 nt, Homo sapiens
cguguacaauaccgu

SEQ ID NO: 687264 - RNA, 17 nt, Homo sapiens
cuaagaagagauuucuc

SEQ ID NO: 687265 - RNA, 16 nt, Homo sapiens
cuaagaaguuacuuuu

SEQ ID NO: 687266 - RNA, 17 nt, Homo sapiens
cgaugcagugcuuccaa

SEQ ID NO: 687267 - RNA, 13 nt, Homo sapiens
cgaugcugcuaug

SEQ ID NO: 687268 - RNA, 16 nt, Homo sapiens
cgaugcugcuauggaa

SEQ ID NO: 687269 - RNA, 22 nt, Homo sapiens
cgauggaugggaugcacucuca

SEQ ID NO: 687270 - RNA, 15 nt, Homo sapiens
cgauggggcaugacc

SEQ ID NO: 687271 - RNA, 23 nt, Homo sapiens
cgaugugcaaguguaugcacgug

SEQ ID NO: 687272 - RNA, 13 nt, Homo sapiens
cgauucccugugu

SEQ ID NO: 687273 - RNA, 20 nt, Homo sapiens
cgauuuaugccucagccacu

SEQ ID NO: 687274 - RNA, 14 nt, Homo sapiens
cgcaaaugaguauu

SEQ ID NO: 687275 - RNA, 16 nt, Homo sapiens
cgcaagaccagucacu

SEQ ID NO: 687276 - RNA, 12 nt, Homo sapiens
cgcaauacugua

SEQ ID NO: 687277 - RNA, 16 nt, Homo sapiens
cgcacaaauuccacau

SEQ ID NO: 687278 - RNA, 17 nt, Homo sapiens
cgcacaaggcugaccaa

SEQ ID NO: 687279 - RNA, 21 nt, Homo sapiens
cgcacaaggcugaccaagaga

SEQ ID NO: 687280 - RNA, 17 nt, Homo sapiens
cgcacaaugcaugugcu

SEQ ID NO: 687281 - RNA, 13 nt, Homo sapiens
cgcacaugcacac

SEQ ID NO: 687282 - RNA, 13 nt, Homo sapiens
cgcaccacugcac

SEQ ID NO: 687283 - RNA, 17 nt, Homo sapiens
cgcaccagacacucaca

SEQ ID NO: 687284 - RNA, 12 nt, Homo sapiens
cgcaccaugugg

SEQ ID NO: 687285 - RNA, 20 nt, Homo sapiens
cgcaccauucuccugccuca

SEQ ID NO: 687286 - RNA, 14 nt, Homo sapiens
cgcaccauugcacu

SEQ ID NO: 687287 - RNA, 13 nt, Homo sapiens
cgcaccccagugc

SEQ ID NO: 687288 - RNA, 13 nt, Homo sapiens
cgcaccugccuca

SEQ ID NO: 687289 - RNA, 17 nt, Homo sapiens
cgcacgcucgcugccau

SEQ ID NO: 687290 - RNA, 19 nt, Homo sapiens
cgcagagguguaggggugg

SEQ ID NO: 687291 - RNA, 15 nt, Homo sapiens
cgcagcccuaccuua

SEQ ID NO: 687292 - RNA, 14 nt, Homo sapiens
cgcaggcccaguga

SEQ ID NO: 687293 - RNA, 17 nt, Homo sapiens
cgcagugugcacuaagg

SEQ ID NO: 687294 - RNA, 20 nt, Homo sapiens
cgcaguuuggagucacugua

SEQ ID NO: 687295 - RNA, 21 nt, Homo sapiens
cgcaguuuggagucacuguag

SEQ ID NO: 687296 - RNA, 20 nt, Homo sapiens
cgcauacuacaguaacugug

SEQ ID NO: 687297 - RNA, 16 nt, Homo sapiens
cgcauagacugaggua

SEQ ID NO: 687298 - RNA, 16 nt, Homo sapiens
cgcaucccaucucucc

SEQ ID NO: 687299 - RNA, 16 nt, Homo sapiens
cgcaucucagugcagg

SEQ ID NO: 687300 - RNA, 14 nt, Homo sapiens
cgcauggugcagug

SEQ ID NO: 687301 - RNA, 16 nt, Homo sapiens
cgcaugugcagcuauu

SEQ ID NO: 687302 - RNA, 13 nt, Homo sapiens
cgcauucccugag

SEQ ID NO: 687303 - RNA, 19 nt, Homo sapiens
cgcauugagccaguggugc

SEQ ID NO: 687304 - RNA, 21 nt, Homo sapiens
cgccacucccgggccaagaca

SEQ ID NO: 687305 - RNA, 17 nt, Homo sapiens
cgccagcguguggagca

SEQ ID NO: 687306 - RNA, 14 nt, Homo sapiens
cgccagcucuacca

SEQ ID NO: 687307 - RNA, 16 nt, Homo sapiens
cgccaggcugaccaca

SEQ ID NO: 687308 - RNA, 17 nt, Homo sapiens
cgccaggcugaccacag

SEQ ID NO: 687309 - RNA, 15 nt, Homo sapiens
cgccauaggccaagg

SEQ ID NO: 687310 - RNA, 13 nt, Homo sapiens
cgccauccagggu

SEQ ID NO: 687311 - RNA, 18 nt, Homo sapiens
cgccaugaucagacauac

SEQ ID NO: 687312 - RNA, 17 nt, Homo sapiens
cgccauuccaagucaac

SEQ ID NO: 687313 - RNA, 21 nt, Homo sapiens
cgcccacccacgcauacacac

SEQ ID NO: 687314 - RNA, 21 nt, Homo sapiens
cgcccacuugucccacuaucu

SEQ ID NO: 687315 - RNA, 21 nt, Homo sapiens
cgcccagacaccaugugcaau

SEQ ID NO: 687316 - RNA, 16 nt, Homo sapiens
cgcccagcgcucgcca

SEQ ID NO: 687317 - RNA, 19 nt, Homo sapiens
cgcccagcugcaccugcca

SEQ ID NO: 687318 - RNA, 20 nt, Homo sapiens
cgcccaggcuggagugcagu

SEQ ID NO: 687319 - RNA, 21 nt, Homo sapiens
cgcccagguccccgcuuucuu

SEQ ID NO: 687320 - RNA, 23 nt, Homo sapiens
cgccccagcaggugcugacuuca

SEQ ID NO: 687321 - RNA, 17 nt, Homo sapiens
cgccccaguggcacuga

SEQ ID NO: 687322 - RNA, 21 nt, Homo sapiens
cgcccccagaacauacacugu

SEQ ID NO: 687323 - RNA, 19 nt, Homo sapiens
cgcccuccucccugucaua

SEQ ID NO: 687324 - RNA, 16 nt, Homo sapiens
cgcccugccuccugga

SEQ ID NO: 687325 - RNA, 19 nt, Homo sapiens
cgcccugggcugucuguca

SEQ ID NO: 687326 - RNA, 13 nt, Homo sapiens
cgcccuuccucag

SEQ ID NO: 687327 - RNA, 19 nt, Homo sapiens
cgcccuugagcuacuucaa

SEQ ID NO: 687328 - RNA, 13 nt, Homo sapiens
cgccugagcucac

SEQ ID NO: 687329 - RNA, 13 nt, Homo sapiens
cgccugagugagu

SEQ ID NO: 687330 - RNA, 13 nt, Homo sapiens
cgccugcugcauc

SEQ ID NO: 687331 - RNA, 16 nt, Homo sapiens
cgccuggcagaacuga

SEQ ID NO: 687332 - RNA, 22 nt, Homo sapiens
cgccuggcccucuguggucaca

SEQ ID NO: 687333 - RNA, 18 nt, Homo sapiens
cgccugucugugugcauc

SEQ ID NO: 687334 - RNA, 21 nt, Homo sapiens
cgccugugggcgcauacuaca

SEQ ID NO: 687335 - RNA, 18 nt, Homo sapiens
cgccuucccuccugcuuu

SEQ ID NO: 687336 - RNA, 22 nt, Homo sapiens
cgcgagcugcugauacagaaga

SEQ ID NO: 687337 - RNA, 14 nt, Homo sapiens
cgcggaagugacca

SEQ ID NO: 687338 - RNA, 19 nt, Homo sapiens
cgcggggccgcuguccagg

SEQ ID NO: 687339 - RNA, 14 nt, Homo sapiens
cgcguacagaucuc

SEQ ID NO: 687340 - RNA, 17 nt, Homo sapiens
cgcuaauucaaggaauu

SEQ ID NO: 687341 - RNA, 22 nt, Homo sapiens
cgcuaccucccuccccgucuca

SEQ ID NO: 687342 - RNA, 13 nt, Homo sapiens
cgcuaucuagcaa

SEQ ID NO: 687343 - RNA, 16 nt, Homo sapiens
cgcuccccucuggaau

SEQ ID NO: 687344 - RNA, 13 nt, Homo sapiens
cgcuccccugaga

SEQ ID NO: 687345 - RNA, 20 nt, Homo sapiens
cgcuccuauugaaagaccag

SEQ ID NO: 687346 - RNA, 20 nt, Homo sapiens
cgcuccuccuucccagggac

SEQ ID NO: 687347 - RNA, 13 nt, Homo sapiens
cgcucucuuccag

SEQ ID NO: 687348 - RNA, 9 nt, Homo sapiens
cgcucugau

SEQ ID NO: 687349 - RNA, 22 nt, Homo sapiens
cgcucuuggcagguacucagcg

SEQ ID NO: 687350 - RNA, 16 nt, Homo sapiens
cgcugacuucauggaa

SEQ ID NO: 687351 - RNA, 20 nt, Homo sapiens
cgcugagcugaguggccagc

SEQ ID NO: 687352 - RNA, 20 nt, Homo sapiens
cgcugcaucccugcagcuca

SEQ ID NO: 687353 - RNA, 18 nt, Homo sapiens
cgcugcccgcucagccca

SEQ ID NO: 687354 - RNA, 14 nt, Homo sapiens
cgcugcgugccauc

SEQ ID NO: 687355 - RNA, 18 nt, Homo sapiens
cgcugcuaagaagcuaaa

SEQ ID NO: 687356 - RNA, 21 nt, Homo sapiens
cgcugcugucacaaccaagaa

SEQ ID NO: 687357 - RNA, 16 nt, Homo sapiens
cgcuggcauguuucac

SEQ ID NO: 687358 - RNA, 16 nt, Homo sapiens
cgcuggcucccugggc

SEQ ID NO: 687359 - RNA, 18 nt, Homo sapiens
cgcuguauuuacagacac

SEQ ID NO: 687360 - RNA, 17 nt, Homo sapiens
cgcuuaucaacuaauga

SEQ ID NO: 687361 - RNA, 12 nt, Homo sapiens
cgcuuggcauca

SEQ ID NO: 687362 - RNA, 21 nt, Homo sapiens
cggaaggagggagcucugaug

SEQ ID NO: 687363 - RNA, 17 nt, Homo sapiens
cggaagggguuccucaa

SEQ ID NO: 687364 - RNA, 12 nt, Homo sapiens
cggaaguuuuca

SEQ ID NO: 687365 - RNA, 13 nt, Homo sapiens
cggaaguuuucaa

SEQ ID NO: 687366 - RNA, 13 nt, Homo sapiens
cggaauguaacuu

SEQ ID NO: 687367 - RNA, 22 nt, Homo sapiens
cggacaagacccccagcacuug

SEQ ID NO: 687368 - RNA, 15 nt, Homo sapiens
cggaccccagagccc

SEQ ID NO: 687369 - RNA, 18 nt, Homo sapiens
cggaccuccaucagagcc

SEQ ID NO: 687370 - RNA, 20 nt, Homo sapiens
cggacucaccaacuugccac

SEQ ID NO: 687371 - RNA, 13 nt, Homo sapiens
cggacucacuucu

SEQ ID NO: 687372 - RNA, 17 nt, Homo sapiens
cggacugcccccagaaa

SEQ ID NO: 687373 - RNA, 14 nt, Homo sapiens
cggagaaacucauc

SEQ ID NO: 687374 - RNA, 14 nt, Homo sapiens
cggagaguacagug

SEQ ID NO: 687375 - RNA, 17 nt, Homo sapiens
cggagccuccucucuca

SEQ ID NO: 687376 - RNA, 21 nt, Homo sapiens
cggagcucccgggcacaucca

SEQ ID NO: 687377 - RNA, 13 nt, Homo sapiens
cggaggacugagc

SEQ ID NO: 687378 - RNA, 22 nt, Homo sapiens
cggagggccccugcgugggggc

SEQ ID NO: 687379 - RNA, 18 nt, Homo sapiens
cggagugagcaauggagu

SEQ ID NO: 687380 - RNA, 14 nt, Homo sapiens
cggauacaaacugg

SEQ ID NO: 687381 - RNA, 13 nt, Homo sapiens
cggauagcauuug

SEQ ID NO: 687382 - RNA, 22 nt, Homo sapiens
cggaugugugucucaccccuca

SEQ ID NO: 687383 - RNA, 16 nt, Homo sapiens
cggauuccagcccaca

SEQ ID NO: 687384 - RNA, 16 nt, Homo sapiens
cuagcauuuucuugaa

SEQ ID NO: 687385 - RNA, 13 nt, Homo sapiens
cuagccaauucac

SEQ ID NO: 687386 - RNA, 17 nt, Homo sapiens
cuagccagaggcucuaa

SEQ ID NO: 687387 - RNA, 19 nt, Homo sapiens
cuagccagaggcucuaaug

SEQ ID NO: 687388 - RNA, 14 nt, Homo sapiens
cuagccagcaaaga

SEQ ID NO: 687389 - RNA, 18 nt, Homo sapiens
cuagcccagacucugagc

SEQ ID NO: 687390 - RNA, 21 nt, Homo sapiens
cuagccccucuggauucccuu

SEQ ID NO: 687391 - RNA, 18 nt, Homo sapiens
cuagcccucucacauuua

SEQ ID NO: 687392 - RNA, 15 nt, Homo sapiens
cuagcgcaagaccag

SEQ ID NO: 687393 - RNA, 17 nt, Homo sapiens
cuagcgcaagaccaguc

SEQ ID NO: 687394 - RNA, 17 nt, Homo sapiens
cuagcuagaaauaugau

SEQ ID NO: 687395 - RNA, 19 nt, Homo sapiens
cuagcugggacuacaggug

SEQ ID NO: 687396 - RNA, 21 nt, Homo sapiens
cuaggaaaaucacuugccaaa

SEQ ID NO: 687397 - RNA, 19 nt, Homo sapiens
cuaggaaacucacacuccc

SEQ ID NO: 687398 - RNA, 13 nt, Homo sapiens
cuaggaaaucaca

SEQ ID NO: 687399 - RNA, 21 nt, Homo sapiens
cuaggacuacagacaugugca

SEQ ID NO: 687400 - RNA, 15 nt, Homo sapiens
cuaggauuacaggcc

SEQ ID NO: 687401 - RNA, 22 nt, Homo sapiens
cuaggcaccucagaccaaucau

SEQ ID NO: 687402 - RNA, 18 nt, Homo sapiens
cuaggccacaccaucucc

SEQ ID NO: 687403 - RNA, 21 nt, Homo sapiens
cuaggccacuccuccaaagga

SEQ ID NO: 687404 - RNA, 22 nt, Homo sapiens
cuaggcguuuguuauauaaaaa

SEQ ID NO: 687405 - RNA, 18 nt, Homo sapiens
cuaggcugcccacucucc

SEQ ID NO: 687406 - RNA, 19 nt, Homo sapiens
cuagggagacgccauguga

SEQ ID NO: 687407 - RNA, 14 nt, Homo sapiens
cuagggagccauuu

SEQ ID NO: 687408 - RNA, 15 nt, Homo sapiens
cuagggaucccucau

SEQ ID NO: 687409 - RNA, 21 nt, Homo sapiens
cuagggcacuuuaagucagug

SEQ ID NO: 687410 - RNA, 14 nt, Homo sapiens
cuagggcagggaau

SEQ ID NO: 687411 - RNA, 15 nt, Homo sapiens
cuaggguacaugucc

SEQ ID NO: 687412 - RNA, 20 nt, Homo sapiens
cuaggguuuggcaagucugc

SEQ ID NO: 687413 - RNA, 15 nt, Homo sapiens
cuagguaggggccca

SEQ ID NO: 687414 - RNA, 17 nt, Homo sapiens
cuagguaggggcccacu

SEQ ID NO: 687415 - RNA, 13 nt, Homo sapiens
cuagguaucauuc

SEQ ID NO: 687416 - RNA, 16 nt, Homo sapiens
cuaggucacuucucac

SEQ ID NO: 687417 - RNA, 14 nt, Homo sapiens
cuaggugacauaua

SEQ ID NO: 687418 - RNA, 18 nt, Homo sapiens
cuaggugacauauacaua

SEQ ID NO: 687419 - RNA, 19 nt, Homo sapiens
cuaggugcccgaguagcau

SEQ ID NO: 687420 - RNA, 19 nt, Homo sapiens
cuagguggagguugugcau

SEQ ID NO: 687421 - RNA, 22 nt, Homo sapiens
cuagguggcaggacaaauugcg

SEQ ID NO: 687422 - RNA, 16 nt, Homo sapiens
cuagguguggcuguga

SEQ ID NO: 687423 - RNA, 20 nt, Homo sapiens
cuagguucuaaaaauuguga

SEQ ID NO: 687424 - RNA, 16 nt, Homo sapiens
cuaguaagaugcacug

SEQ ID NO: 687425 - RNA, 13 nt, Homo sapiens
cuaguacuguauu

SEQ ID NO: 687426 - RNA, 20 nt, Homo sapiens
cuaguagaacuggaucccaa

SEQ ID NO: 687427 - RNA, 16 nt, Homo sapiens
cuaguauaaacaugac

SEQ ID NO: 687428 - RNA, 16 nt, Homo sapiens
cuaguauaucagugac

SEQ ID NO: 687429 - RNA, 14 nt, Homo sapiens
cuaguaucacuuuu

SEQ ID NO: 687430 - RNA, 15 nt, Homo sapiens
cuaguccuugcugca

SEQ ID NO: 687431 - RNA, 16 nt, Homo sapiens
cuagucugucagggcc

SEQ ID NO: 687432 - RNA, 23 nt, Homo sapiens
cuagugaaaauacagcaggcaga

SEQ ID NO: 687433 - RNA, 16 nt, Homo sapiens
cuagugacaagcuccu

SEQ ID NO: 687434 - RNA, 19 nt, Homo sapiens
cuagugagucagcaccuug

SEQ ID NO: 687435 - RNA, 22 nt, Homo sapiens
cuagugcugacgauguucugua

SEQ ID NO: 687436 - RNA, 13 nt, Homo sapiens
cuagugcugugaa

SEQ ID NO: 687437 - RNA, 17 nt, Homo sapiens
cuagugggaaggggugc

SEQ ID NO: 687438 - RNA, 14 nt, Homo sapiens
cuaguggucucacc

SEQ ID NO: 687439 - RNA, 20 nt, Homo sapiens
cuaguguagagcaagccagu

SEQ ID NO: 687440 - RNA, 22 nt, Homo sapiens
cuagugucuuauggucuugauc

SEQ ID NO: 687441 - RNA, 18 nt, Homo sapiens
cuaguguucuguuuguua

SEQ ID NO: 687442 - RNA, 19 nt, Homo sapiens
cuaguuaaugucagugaca

SEQ ID NO: 687443 - RNA, 12 nt, Homo sapiens
cuaguuacacau

SEQ ID NO: 687444 - RNA, 17 nt, Homo sapiens
cuaguuaggagcccacc

SEQ ID NO: 687445 - RNA, 17 nt, Homo sapiens
cuaguugagagcaccuu

SEQ ID NO: 687446 - RNA, 21 nt, Homo sapiens
cuaguuuaauguggauccaaa

SEQ ID NO: 687447 - RNA, 21 nt, Homo sapiens
cuaguuuauuggaaguguuca

SEQ ID NO: 687448 - RNA, 14 nt, Homo sapiens
cuaguuucccugaa

SEQ ID NO: 687449 - RNA, 20 nt, Homo sapiens
cuaguuuugucaaacuguag

SEQ ID NO: 687450 - RNA, 16 nt, Homo sapiens
cuauaaaauauaguuu

SEQ ID NO: 687451 - RNA, 15 nt, Homo sapiens
cuauaaaaucuuaga

SEQ ID NO: 687452 - RNA, 19 nt, Homo sapiens
cuauaaagaagaacuugca

SEQ ID NO: 687453 - RNA, 20 nt, Homo sapiens
cuauaaagaagaacuugcau

SEQ ID NO: 687454 - RNA, 20 nt, Homo sapiens
cuauaaagguugacaauaaa

SEQ ID NO: 687455 - RNA, 18 nt, Homo sapiens
cuauaacaugucuuucag

SEQ ID NO: 687456 - RNA, 23 nt, Homo sapiens
cuauaacaugucuuucagcauua

SEQ ID NO: 687457 - RNA, 18 nt, Homo sapiens
cuauaagauuccaaaaag

SEQ ID NO: 687458 - RNA, 12 nt, Homo sapiens
cuauaagccaga

SEQ ID NO: 687459 - RNA, 18 nt, Homo sapiens
cuauaaggccauaaaaca

SEQ ID NO: 687460 - RNA, 19 nt, Homo sapiens
cuauaaguuguaccaaaac

SEQ ID NO: 687461 - RNA, 17 nt, Homo sapiens
cuauaauaaaacuaaac

SEQ ID NO: 687462 - RNA, 17 nt, Homo sapiens
cuauaauaaguuuugau

SEQ ID NO: 687463 - RNA, 15 nt, Homo sapiens
cuauaaucacuuggg

SEQ ID NO: 687464 - RNA, 19 nt, Homo sapiens
cuauaaucccagcacuuug

SEQ ID NO: 687465 - RNA, 21 nt, Homo sapiens
cuauaaucucuugaauuuggu

SEQ ID NO: 687466 - RNA, 14 nt, Homo sapiens
cuauaaucugucaa

SEQ ID NO: 687467 - RNA, 14 nt, Homo sapiens
cuauaauuuugccu

SEQ ID NO: 687468 - RNA, 17 nt, Homo sapiens
cuauaauuuugccuuua

SEQ ID NO: 687469 - RNA, 12 nt, Homo sapiens
cuauacaaguug

SEQ ID NO: 687470 - RNA, 13 nt, Homo sapiens
cuauacagccaua

SEQ ID NO: 687471 - RNA, 20 nt, Homo sapiens
cuauacauagagcucuauuu

SEQ ID NO: 687472 - RNA, 12 nt, Homo sapiens
cuauacaucucu

SEQ ID NO: 687473 - RNA, 21 nt, Homo sapiens
cuauagaaauagaacacugcc

SEQ ID NO: 687474 - RNA, 23 nt, Homo sapiens
cuauagaaauagaacacugccuc

SEQ ID NO: 687475 - RNA, 18 nt, Homo sapiens
cuauagcugcuauagcaa

SEQ ID NO: 687476 - RNA, 21 nt, Homo sapiens
cuauaguucacugacacagua

SEQ ID NO: 687477 - RNA, 17 nt, Homo sapiens
cuauaguuucaccacuc

SEQ ID NO: 687478 - RNA, 20 nt, Homo sapiens
cuauaguuucaccacuccuc

SEQ ID NO: 687479 - RNA, 21 nt, Homo sapiens
cuauaguuucaccacuccucu

SEQ ID NO: 687480 - RNA, 17 nt, Homo sapiens
cuauauacacagacaug

SEQ ID NO: 687481 - RNA, 14 nt, Homo sapiens
cuauauauguguau

SEQ ID NO: 687482 - RNA, 17 nt, Homo sapiens
cuauaucaaacaugcac

SEQ ID NO: 687483 - RNA, 21 nt, Homo sapiens
cuauaucauaacuauacuuga

SEQ ID NO: 687484 - RNA, 21 nt, Homo sapiens
cuauaucgaauauaguucugu

SEQ ID NO: 687485 - RNA, 16 nt, Homo sapiens
cuauauguagcuuuau

SEQ ID NO: 687486 - RNA, 14 nt, Homo sapiens
cuauauugcacugu

SEQ ID NO: 687487 - RNA, 18 nt, Homo sapiens
cuauauugcuuaccugau

SEQ ID NO: 687488 - RNA, 13 nt, Homo sapiens
cuauauugguuua

SEQ ID NO: 687489 - RNA, 16 nt, Homo sapiens
cuauauuuccaccucu

SEQ ID NO: 687490 - RNA, 12 nt, Homo sapiens
cuauauuugcuu

SEQ ID NO: 687491 - RNA, 13 nt, Homo sapiens
cuaucaacaaaga

SEQ ID NO: 687492 - RNA, 20 nt, Homo sapiens
cuaucaacaccacuaggaau

SEQ ID NO: 687493 - RNA, 19 nt, Homo sapiens
cuaucauaauucagcacuu

SEQ ID NO: 687494 - RNA, 21 nt, Homo sapiens
cuaucauacuacugaaacaga

SEQ ID NO: 687495 - RNA, 19 nt, Homo sapiens
cuaucauggugaaaagcuc

SEQ ID NO: 687496 - RNA, 20 nt, Homo sapiens
cuauccauauuuuacugauc

SEQ ID NO: 687497 - RNA, 23 nt, Homo sapiens
cuaucccccgcagcgcucuccuu

SEQ ID NO: 687498 - RNA, 17 nt, Homo sapiens
cuauccuccuaccucca

SEQ ID NO: 687499 - RNA, 22 nt, Homo sapiens
cuauccugauccccaacugaag

SEQ ID NO: 687500 - RNA, 18 nt, Homo sapiens
cuauccugcgggaucacu

SEQ ID NO: 687501 - RNA, 17 nt, Homo sapiens
cuauccugggcauccuu

SEQ ID NO: 687502 - RNA, 14 nt, Homo sapiens
cuauccuuuugccu

SEQ ID NO: 687503 - RNA, 20 nt, Homo sapiens
cuaucgucaggaaaccaaau

SEQ ID NO: 687504 - RNA, 23 nt, Homo sapiens
cuaucuacuacaaacuucaaaga

SEQ ID NO: 687505 - RNA, 14 nt, Homo sapiens
cuaucucacuucca

SEQ ID NO: 687506 - RNA, 17 nt, Homo sapiens
cuaucucacuuccagau

SEQ ID NO: 687507 - RNA, 17 nt, Homo sapiens
cucaaccauaacacuug

SEQ ID NO: 687508 - RNA, 14 nt, Homo sapiens
cucaaccuauggua

SEQ ID NO: 687509 - RNA, 13 nt, Homo sapiens
cucaacucggggg

SEQ ID NO: 687510 - RNA, 22 nt, Homo sapiens
cugacagccuuccccagcucca

SEQ ID NO: 687511 - RNA, 16 nt, Homo sapiens
cugacagccuugccca

SEQ ID NO: 687512 - RNA, 16 nt, Homo sapiens
cugacagcuucaugaa

SEQ ID NO: 687513 - RNA, 20 nt, Homo sapiens
cugacaggcgcaacuccucc

SEQ ID NO: 687514 - RNA, 16 nt, Homo sapiens
cugacagggccagugc

SEQ ID NO: 687515 - RNA, 23 nt, Homo sapiens
cugacaguuaauaaaccuuugca

SEQ ID NO: 687516 - RNA, 19 nt, Homo sapiens
cugacauauucaagugaua

SEQ ID NO: 687517 - RNA, 16 nt, Homo sapiens
cugacauugccaaaaa

SEQ ID NO: 687518 - RNA, 15 nt, Homo sapiens
cugaccaaauggcca

SEQ ID NO: 687519 - RNA, 14 nt, Homo sapiens
cugaccaacaugga

SEQ ID NO: 687520 - RNA, 12 nt, Homo sapiens
cugaccaagaga

SEQ ID NO: 687521 - RNA, 21 nt, Homo sapiens
cugaccacgugcuacccccau

SEQ ID NO: 687522 - RNA, 22 nt, Homo sapiens
cugaccauauugugcuucacag

SEQ ID NO: 687523 - RNA, 21 nt, Homo sapiens
cugaccaugcacuauauuugu

SEQ ID NO: 687524 - RNA, 16 nt, Homo sapiens
cugaccccagugguau

SEQ ID NO: 687525 - RNA, 13 nt, Homo sapiens
cugacccuagcuc

SEQ ID NO: 687526 - RNA, 23 nt, Homo sapiens
cugacccucccacucccaucucc

SEQ ID NO: 687527 - RNA, 20 nt, Homo sapiens
cugacccuccuccacuccac

SEQ ID NO: 687528 - RNA, 23 nt, Homo sapiens
cugaccguggagcuuaagccacu

SEQ ID NO: 687529 - RNA, 19 nt, Homo sapiens
cugaccucaagugauccac

SEQ ID NO: 687530 - RNA, 19 nt, Homo sapiens
cugaccucaggugauccgc

SEQ ID NO: 687531 - RNA, 22 nt, Homo sapiens
cugaccuccccgcugugggggu

SEQ ID NO: 687532 - RNA, 17 nt, Homo sapiens
cugaccucgugauccac

SEQ ID NO: 687533 - RNA, 17 nt, Homo sapiens
cugaccucuugcugcca

SEQ ID NO: 687534 - RNA, 14 nt, Homo sapiens
cugaccugccugua

SEQ ID NO: 687535 - RNA, 20 nt, Homo sapiens
cugaccuggaaagaaaaagc

SEQ ID NO: 687536 - RNA, 19 nt, Homo sapiens
cugaccuggcuggugacag

SEQ ID NO: 687537 - RNA, 23 nt, Homo sapiens
cugaccugugcacaccccacucc

SEQ ID NO: 687538 - RNA, 15 nt, Homo sapiens
cugaccuuaaaugca

SEQ ID NO: 687539 - RNA, 17 nt, Homo sapiens
cugaccuuaaaugcaac

SEQ ID NO: 687540 - RNA, 17 nt, Homo sapiens
cugaccuuccagagccc

SEQ ID NO: 687541 - RNA, 15 nt, Homo sapiens
cugaccuugaaucuu

SEQ ID NO: 687542 - RNA, 17 nt, Homo sapiens
cugaccuugugauccac

SEQ ID NO: 687543 - RNA, 16 nt, Homo sapiens
cugaccuuuguccuua

SEQ ID NO: 687544 - RNA, 17 nt, Homo sapiens
cugacgugcagccacac

SEQ ID NO: 687545 - RNA, 23 nt, Homo sapiens
cugacucaacauguuacugacca

SEQ ID NO: 687546 - RNA, 20 nt, Homo sapiens
cugacucacaagaagaccag

SEQ ID NO: 687547 - RNA, 15 nt, Homo sapiens
cugacucugacucau

SEQ ID NO: 687548 - RNA, 15 nt, Homo sapiens
cugacucuggccuua

SEQ ID NO: 687549 - RNA, 21 nt, Homo sapiens
cugacugaaggaaaagcaaga

SEQ ID NO: 687550 - RNA, 18 nt, Homo sapiens
cugacugcuaguugccau

SEQ ID NO: 687551 - RNA, 11 nt, Homo sapiens
cugacuguugc

SEQ ID NO: 687552 - RNA, 15 nt, Homo sapiens
cugacuuacugucag

SEQ ID NO: 687553 - RNA, 23 nt, Homo sapiens
cugacuucagaguggacuugugu

SEQ ID NO: 687554 - RNA, 15 nt, Homo sapiens
cugacuugagccacu

SEQ ID NO: 687555 - RNA, 17 nt, Homo sapiens
cugacuugaguguuccu

SEQ ID NO: 687556 - RNA, 20 nt, Homo sapiens
cugacuugguucugaagcca

SEQ ID NO: 687557 - RNA, 16 nt, Homo sapiens
cugacuuucucuccag

SEQ ID NO: 687558 - RNA, 17 nt, Homo sapiens
cugacuuucugauuacu

SEQ ID NO: 687559 - RNA, 15 nt, Homo sapiens
cugagaaaggucuga

SEQ ID NO: 687560 - RNA, 17 nt, Homo sapiens
cugagaaauguucagaa

SEQ ID NO: 687561 - RNA, 18 nt, Homo sapiens
cugagaacuccucauucc

SEQ ID NO: 687562 - RNA, 22 nt, Homo sapiens
cugagaagaaugaaaaugcagu

SEQ ID NO: 687563 - RNA, 17 nt, Homo sapiens
cugagaaggcaaaagaa

SEQ ID NO: 687564 - RNA, 21 nt, Homo sapiens
cugagaaguacuuuaccugaa

SEQ ID NO: 687565 - RNA, 18 nt, Homo sapiens
cugagaagugcacuuuaa

SEQ ID NO: 687566 - RNA, 20 nt, Homo sapiens
cugagaauauaauacuguau

SEQ ID NO: 687567 - RNA, 16 nt, Homo sapiens
cugagaauuccaagga

SEQ ID NO: 687568 - RNA, 13 nt, Homo sapiens
cugagaauuucca

SEQ ID NO: 687569 - RNA, 20 nt, Homo sapiens
cugagacauucuucaccucc

SEQ ID NO: 687570 - RNA, 15 nt, Homo sapiens
cugagacucacagga

SEQ ID NO: 687571 - RNA, 18 nt, Homo sapiens
cugagacuuucagugcac

SEQ ID NO: 687572 - RNA, 16 nt, Homo sapiens
cugagagacccaagga

SEQ ID NO: 687573 - RNA, 22 nt, Homo sapiens
cugagagacccaaggaggaaaa

SEQ ID NO: 687574 - RNA, 23 nt, Homo sapiens
cugagagaguggagagugacaug

SEQ ID NO: 687575 - RNA, 16 nt, Homo sapiens
cugagagcccacugca

SEQ ID NO: 687576 - RNA, 15 nt, Homo sapiens
cugagaggucacaaa

SEQ ID NO: 687577 - RNA, 21 nt, Homo sapiens
cugagagugaaaccaugacug

SEQ ID NO: 687578 - RNA, 20 nt, Homo sapiens
cugagaguuggcucaggcag

SEQ ID NO: 687579 - RNA, 14 nt, Homo sapiens
cugagauaccagcg

SEQ ID NO: 687580 - RNA, 17 nt, Homo sapiens
cugagauauauuugcua

SEQ ID NO: 687581 - RNA, 14 nt, Homo sapiens
cugagaucgugcua

SEQ ID NO: 687582 - RNA, 12 nt, Homo sapiens
cugagaugucag

SEQ ID NO: 687583 - RNA, 17 nt, Homo sapiens
cugagauuacucugaaa

SEQ ID NO: 687584 - RNA, 12 nt, Homo sapiens
cugagauucaau

SEQ ID NO: 687585 - RNA, 19 nt, Homo sapiens
cugagauucgaauccucaa

SEQ ID NO: 687586 - RNA, 18 nt, Homo sapiens
cugagauugcagauguga

SEQ ID NO: 687587 - RNA, 17 nt, Homo sapiens
cugagcacggacucucc

SEQ ID NO: 687588 - RNA, 18 nt, Homo sapiens
cugagcacuguuuauaca

SEQ ID NO: 687589 - RNA, 20 nt, Homo sapiens
cugagcagaagcuggaggca

SEQ ID NO: 687590 - RNA, 16 nt, Homo sapiens
cugagcagaauacugg

SEQ ID NO: 687591 - RNA, 20 nt, Homo sapiens
cugagcagggcgaggaccaa

SEQ ID NO: 687592 - RNA, 23 nt, Homo sapiens
cugagccaggagcuaaaaccuua

SEQ ID NO: 687593 - RNA, 20 nt, Homo sapiens
cugagcccccacugcuucua

SEQ ID NO: 687594 - RNA, 22 nt, Homo sapiens
cugagcccuacucccugcagau

SEQ ID NO: 687595 - RNA, 21 nt, Homo sapiens
cugagccugcuuguugggaaa

SEQ ID NO: 687596 - RNA, 22 nt, Homo sapiens
cugagcgaagcuauaggcucuu

SEQ ID NO: 687597 - RNA, 22 nt, Homo sapiens
cugagcucuccaggccaggugg

SEQ ID NO: 687598 - RNA, 22 nt, Homo sapiens
cugagcugaacacauuugccca

SEQ ID NO: 687599 - RNA, 19 nt, Homo sapiens
cugagcugcaucccugcuc

SEQ ID NO: 687600 - RNA, 13 nt, Homo sapiens
cugagcugugaug

SEQ ID NO: 687601 - RNA, 19 nt, Homo sapiens
cugaggaagaagggauaau

SEQ ID NO: 687602 - RNA, 14 nt, Homo sapiens
cugaggacaaagug

SEQ ID NO: 687603 - RNA, 16 nt, Homo sapiens
cugaggacuuugccca

SEQ ID NO: 687604 - RNA, 19 nt, Homo sapiens
cugaggaggggccugggca

SEQ ID NO: 687605 - RNA, 22 nt, Homo sapiens
cugaggcaggagaauugcuuga

SEQ ID NO: 687606 - RNA, 15 nt, Homo sapiens
cugaggccagaguca

SEQ ID NO: 687607 - RNA, 14 nt, Homo sapiens
cugaggccaucagg

SEQ ID NO: 687608 - RNA, 22 nt, Homo sapiens
cugaggcccagugcauaugcaa

SEQ ID NO: 687609 - RNA, 22 nt, Homo sapiens
cugaggcccgaucuccacuguu

SEQ ID NO: 687610 - RNA, 13 nt, Homo sapiens
cugaggcuuagga

SEQ ID NO: 687611 - RNA, 19 nt, Homo sapiens
cugagggacaggaucuaua

SEQ ID NO: 687612 - RNA, 23 nt, Homo sapiens
cugagggcagcuuugcaaaauga

SEQ ID NO: 687613 - RNA, 14 nt, Homo sapiens
cugagggcagugcc

SEQ ID NO: 687614 - RNA, 17 nt, Homo sapiens
cugagggcagugcccuu

SEQ ID NO: 687615 - RNA, 18 nt, Homo sapiens
cugagggcagugcccuuu

SEQ ID NO: 687616 - RNA, 21 nt, Homo sapiens
cugaggggcacucuccccuga

SEQ ID NO: 687617 - RNA, 21 nt, Homo sapiens
cugaggggggccgugcccagg

SEQ ID NO: 687618 - RNA, 17 nt, Homo sapiens
cugaggguaucugacaa

SEQ ID NO: 687619 - RNA, 21 nt, Homo sapiens
cugaggguccccaccugggac

SEQ ID NO: 687620 - RNA, 21 nt, Homo sapiens
cugcggcaguauguacuucag

SEQ ID NO: 687621 - RNA, 15 nt, Homo sapiens
cugcggcgucugucu

SEQ ID NO: 687622 - RNA, 16 nt, Homo sapiens
cugcgggccagggucc

SEQ ID NO: 687623 - RNA, 16 nt, Homo sapiens
cugcgugacauauacu

SEQ ID NO: 687624 - RNA, 21 nt, Homo sapiens
cugcuaaagaaaggaacuaag

SEQ ID NO: 687625 - RNA, 12 nt, Homo sapiens
cugcuaaaugca

SEQ ID NO: 687626 - RNA, 21 nt, Homo sapiens
cugcuaauguugaucagcaaa

SEQ ID NO: 687627 - RNA, 15 nt, Homo sapiens
cugcuacaacuucag

SEQ ID NO: 687628 - RNA, 17 nt, Homo sapiens
cugcuaccucacugggg

SEQ ID NO: 687629 - RNA, 20 nt, Homo sapiens
cugcuacugucuuacuauua

SEQ ID NO: 687630 - RNA, 15 nt, Homo sapiens
cugcuacuuaauucc

SEQ ID NO: 687631 - RNA, 19 nt, Homo sapiens
cugcuaggccagagccaug

SEQ ID NO: 687632 - RNA, 17 nt, Homo sapiens
cugcucaaggaccaaga

SEQ ID NO: 687633 - RNA, 20 nt, Homo sapiens
cugcucacaaaaucacuuua

SEQ ID NO: 687634 - RNA, 17 nt, Homo sapiens
cugcucagagcuuuaaa

SEQ ID NO: 687635 - RNA, 16 nt, Homo sapiens
cugcucagcagagccu

SEQ ID NO: 687636 - RNA, 18 nt, Homo sapiens
cugcucaggaaaccacaa

SEQ ID NO: 687637 - RNA, 18 nt, Homo sapiens
cugcucaggcccaugcua

SEQ ID NO: 687638 - RNA, 22 nt, Homo sapiens
cugcucaggcugcagcuggaca

SEQ ID NO: 687639 - RNA, 15 nt, Homo sapiens
cugcucauauuguga

SEQ ID NO: 687640 - RNA, 20 nt, Homo sapiens
cugcuccaaaggaaauccaa

SEQ ID NO: 687641 - RNA, 13 nt, Homo sapiens
cugcuccaacccc

SEQ ID NO: 687642 - RNA, 14 nt, Homo sapiens
cugcuccaccacau

SEQ ID NO: 687643 - RNA, 22 nt, Homo sapiens
cugcuccaccagcagcauggca

SEQ ID NO: 687644 - RNA, 13 nt, Homo sapiens
cugcuccacccuu

SEQ ID NO: 687645 - RNA, 18 nt, Homo sapiens
cugcuccacgaagccuua

SEQ ID NO: 687646 - RNA, 14 nt, Homo sapiens
cugcuccagugcag

SEQ ID NO: 687647 - RNA, 19 nt, Homo sapiens
cugcuccccaacaccugcc

SEQ ID NO: 687648 - RNA, 21 nt, Homo sapiens
cugcuccguggaggagguugg

SEQ ID NO: 687649 - RNA, 22 nt, Homo sapiens
cugcuccuccccuuucacaggu

SEQ ID NO: 687650 - RNA, 19 nt, Homo sapiens
cugcuccuggagccuuuga

SEQ ID NO: 687651 - RNA, 24 nt, Homo sapiens
cugcucguugccugccacugagca

SEQ ID NO: 687652 - RNA, 13 nt, Homo sapiens
cugcucuacugcu

SEQ ID NO: 687653 - RNA, 18 nt, Homo sapiens
cugcucuggaaaauguga

SEQ ID NO: 687654 - RNA, 15 nt, Homo sapiens
cugcucuuaggugcu

SEQ ID NO: 687655 - RNA, 12 nt, Homo sapiens
cugcucuugcag

SEQ ID NO: 687656 - RNA, 22 nt, Homo sapiens
cugcucuugcaguugcucugac

SEQ ID NO: 687657 - RNA, 18 nt, Homo sapiens
cugcugaacacagugucu

SEQ ID NO: 687658 - RNA, 23 nt, Homo sapiens
cugcugaaggcagucauaucaaa

SEQ ID NO: 687659 - RNA, 11 nt, Homo sapiens
cugcugaauaa

SEQ ID NO: 687660 - RNA, 14 nt, Homo sapiens
cugcugaaugcagg

SEQ ID NO: 687661 - RNA, 12 nt, Homo sapiens
cugcugauccag

SEQ ID NO: 687662 - RNA, 13 nt, Homo sapiens
cugcugauccaga

SEQ ID NO: 687663 - RNA, 14 nt, Homo sapiens
cugcugauuuucug

SEQ ID NO: 687664 - RNA, 13 nt, Homo sapiens
cugcugcugcuau

SEQ ID NO: 687665 - RNA, 17 nt, Homo sapiens
cugcugcuggaucacag

SEQ ID NO: 687666 - RNA, 20 nt, Homo sapiens
cugcugcuucuccaagcuuu

SEQ ID NO: 687667 - RNA, 20 nt, Homo sapiens
cugcugcuugaguugccuga

SEQ ID NO: 687668 - RNA, 18 nt, Homo sapiens
cugcuggaaacacaguca

SEQ ID NO: 687669 - RNA, 18 nt, Homo sapiens
cugcuggaaggggcagca

SEQ ID NO: 687670 - RNA, 15 nt, Homo sapiens
cugcuggagugcagu

SEQ ID NO: 687671 - RNA, 18 nt, Homo sapiens
cugcugggggcaacuggc

SEQ ID NO: 687672 - RNA, 14 nt, Homo sapiens
cugcugggugccuc

SEQ ID NO: 687673 - RNA, 11 nt, Homo sapiens
cugcuggugag

SEQ ID NO: 687674 - RNA, 15 nt, Homo sapiens
cugcuggugcuaaaa

SEQ ID NO: 687675 - RNA, 18 nt, Homo sapiens
cugcugucacaaccaaga

SEQ ID NO: 687676 - RNA, 16 nt, Homo sapiens
cugcugucccugucag

SEQ ID NO: 687677 - RNA, 19 nt, Homo sapiens
cugcugucugguugagagc

SEQ ID NO: 687678 - RNA, 14 nt, Homo sapiens
cugcugucuuguug

SEQ ID NO: 687679 - RNA, 23 nt, Homo sapiens
cugcugugcacauuuaugaauca

SEQ ID NO: 687680 - RNA, 23 nt, Homo sapiens
cugcuguggggcgaauucauccc

SEQ ID NO: 687681 - RNA, 16 nt, Homo sapiens
cugcuguuaaagacau

SEQ ID NO: 687682 - RNA, 22 nt, Homo sapiens
cugcuguuaucuuuuuaacugu

SEQ ID NO: 687683 - RNA, 12 nt, Homo sapiens
cugcuguugcca

SEQ ID NO: 687684 - RNA, 18 nt, Homo sapiens
cugcuuaaaauaagcaaa

SEQ ID NO: 687685 - RNA, 19 nt, Homo sapiens
cugcuucacaaaccuugcu

SEQ ID NO: 687686 - RNA, 21 nt, Homo sapiens
cugcuucaguccacaguacau

SEQ ID NO: 687687 - RNA, 20 nt, Homo sapiens
cugcuuccaauuuucuggaa

SEQ ID NO: 687688 - RNA, 19 nt, Homo sapiens
cugcuuccgagauccccag

SEQ ID NO: 687689 - RNA, 16 nt, Homo sapiens
cugcuugaccaaagag

SEQ ID NO: 687690 - RNA, 22 nt, Homo sapiens
cugcuugcagccaggagaaggu

SEQ ID NO: 687691 - RNA, 13 nt, Homo sapiens
cugcuugguuaaa

SEQ ID NO: 687692 - RNA, 21 nt, Homo sapiens
cugcuuguccugcucucuuca

SEQ ID NO: 687693 - RNA, 21 nt, Homo sapiens
cugcuuguucaaauacugugu

SEQ ID NO: 687694 - RNA, 19 nt, Homo sapiens
cugcuuuccccugugggga

SEQ ID NO: 687695 - RNA, 20 nt, Homo sapiens
cugcuuucuuguugcugcau

SEQ ID NO: 687696 - RNA, 17 nt, Homo sapiens
cugcuuugggaagccgu

SEQ ID NO: 687697 - RNA, 16 nt, Homo sapiens
cugcuuuggucuugcc

SEQ ID NO: 687698 - RNA, 13 nt, Homo sapiens
cugcuuuguucaa

SEQ ID NO: 687699 - RNA, 17 nt, Homo sapiens
cugcuuuucccauugcc

SEQ ID NO: 687700 - RNA, 16 nt, Homo sapiens
cuggaaaacucaggau

SEQ ID NO: 687701 - RNA, 14 nt, Homo sapiens
cuggaaaaugugac

SEQ ID NO: 687702 - RNA, 22 nt, Homo sapiens
cuggaaaccacacuucuugaaa

SEQ ID NO: 687703 - RNA, 14 nt, Homo sapiens
cuggaaaugcugac

SEQ ID NO: 687704 - RNA, 18 nt, Homo sapiens
cuggaaauguagcacuua

SEQ ID NO: 687705 - RNA, 16 nt, Homo sapiens
cuggaaauucugcugc

SEQ ID NO: 687706 - RNA, 16 nt, Homo sapiens
cuggaaccugcaaaaa

SEQ ID NO: 687707 - RNA, 20 nt, Homo sapiens
cuggaacugcaucagugacu

SEQ ID NO: 687708 - RNA, 22 nt, Homo sapiens
cuggaacuuuagugaaacauaa

SEQ ID NO: 687709 - RNA, 15 nt, Homo sapiens
cuggaagaacaucaa

SEQ ID NO: 687710 - RNA, 16 nt, Homo sapiens
cuggaagaggaaccag

SEQ ID NO: 687711 - RNA, 19 nt, Homo sapiens
cuggaagcauccugugcug

SEQ ID NO: 687712 - RNA, 16 nt, Homo sapiens
cuggaagcauggagca

SEQ ID NO: 687713 - RNA, 23 nt, Homo sapiens
cuggaagcauguaggagaaucca

SEQ ID NO: 687714 - RNA, 16 nt, Homo sapiens
cuggaagccagagaaa

SEQ ID NO: 687715 - RNA, 12 nt, Homo sapiens
cuggaagccauc

SEQ ID NO: 687716 - RNA, 21 nt, Homo sapiens
cuggaagcugcagaucuuugc

SEQ ID NO: 687717 - RNA, 19 nt, Homo sapiens
cuggaaggggccacgugga

SEQ ID NO: 687718 - RNA, 19 nt, Homo sapiens
cuggaaggugccacuccag

SEQ ID NO: 687719 - RNA, 12 nt, Homo sapiens
cuggaaguagaa

SEQ ID NO: 687720 - RNA, 15 nt, Homo sapiens
cuggaagucaucuca

SEQ ID NO: 687721 - RNA, 14 nt, Homo sapiens
cuggaaucagcuca

SEQ ID NO: 687722 - RNA, 12 nt, Homo sapiens
cuggaauggugu

SEQ ID NO: 687723 - RNA, 20 nt, Homo sapiens
cuggaauguaaucaauguuu

SEQ ID NO: 687724 - RNA, 22 nt, Homo sapiens
cuggaauuacaaaacucagaga

SEQ ID NO: 687725 - RNA, 12 nt, Homo sapiens
cuggaauucuuc

SEQ ID NO: 687726 - RNA, 21 nt, Homo sapiens
cuggaauuguggcuauccuga

SEQ ID NO: 687727 - RNA, 18 nt, Homo sapiens
cuggacaaagacuaccug

SEQ ID NO: 687728 - RNA, 14 nt, Homo sapiens
cuggacaacacagc

SEQ ID NO: 687729 - RNA, 22 nt, Homo sapiens
cugggagcccggcaacucuagu

SEQ ID NO: 687730 - RNA, 22 nt, Homo sapiens
cugggagccggaggcugcagug

SEQ ID NO: 687731 - RNA, 17 nt, Homo sapiens
cugggaguccuuaccuc

SEQ ID NO: 687732 - RNA, 18 nt, Homo sapiens
cugggaucgugcauuuga

SEQ ID NO: 687733 - RNA, 17 nt, Homo sapiens
cugggaugaggggugcu

SEQ ID NO: 687734 - RNA, 13 nt, Homo sapiens
cugggaugcagug

SEQ ID NO: 687735 - RNA, 18 nt, Homo sapiens
cugggaugggaacacugg

SEQ ID NO: 687736 - RNA, 23 nt, Homo sapiens
cugggauggggcuucacugcugu

SEQ ID NO: 687737 - RNA, 15 nt, Homo sapiens
cugggauguuuugag

SEQ ID NO: 687738 - RNA, 22 nt, Homo sapiens
cugggauuacaggcaugagcca

SEQ ID NO: 687739 - RNA, 23 nt, Homo sapiens
cugggauuauaggcaugagccac

SEQ ID NO: 687740 - RNA, 23 nt, Homo sapiens
cugggcacacgccucccacuggg

SEQ ID NO: 687741 - RNA, 17 nt, Homo sapiens
cugggcacgcacugggu

SEQ ID NO: 687742 - RNA, 23 nt, Homo sapiens
cugggcagaccccucuaccuccu

SEQ ID NO: 687743 - RNA, 21 nt, Homo sapiens
cuugccucaaguuccaugcuu

SEQ ID NO: 687744 - RNA, 16 nt, Homo sapiens
cuugccucucucagga

SEQ ID NO: 687745 - RNA, 17 nt, Homo sapiens
cuugccucucucaggag

SEQ ID NO: 687746 - RNA, 16 nt, Homo sapiens
cuugccucuuucucca

SEQ ID NO: 687747 - RNA, 17 nt, Homo sapiens
cuugccugaacuccugc

SEQ ID NO: 687748 - RNA, 21 nt, Homo sapiens
cuugccuugggaccauggcca

SEQ ID NO: 687749 - RNA, 20 nt, Homo sapiens
cuugcucaugcccugccaag

SEQ ID NO: 687750 - RNA, 21 nt, Homo sapiens
cuugcuccacagggcccuguu

SEQ ID NO: 687751 - RNA, 22 nt, Homo sapiens
cuugcuccuacccuuggugccu

SEQ ID NO: 687752 - RNA, 12 nt, Homo sapiens
cuugcucugagc

SEQ ID NO: 687753 - RNA, 17 nt, Homo sapiens
cuugcucugagcacagg

SEQ ID NO: 687754 - RNA, 16 nt, Homo sapiens
cuugcuggacggggac

SEQ ID NO: 687755 - RNA, 15 nt, Homo sapiens
cuugcuggucuaguc

SEQ ID NO: 687756 - RNA, 16 nt, Homo sapiens
cuugcuggucuaguca

SEQ ID NO: 687757 - RNA, 17 nt, Homo sapiens
cuugcugugugaccuca

SEQ ID NO: 687758 - RNA, 17 nt, Homo sapiens
cuugcuguugacauauu

SEQ ID NO: 687759 - RNA, 21 nt, Homo sapiens
cuugcuuaguaugguucucag

SEQ ID NO: 687760 - RNA, 22 nt, Homo sapiens
cuugcuucucccauuuccugau

SEQ ID NO: 687761 - RNA, 18 nt, Homo sapiens
cuugcuuuaauaaaucac

SEQ ID NO: 687762 - RNA, 16 nt, Homo sapiens
cuugcuuuccugcauc

SEQ ID NO: 687763 - RNA, 18 nt, Homo sapiens
cuuggaaaugguggugcu

SEQ ID NO: 687764 - RNA, 15 nt, Homo sapiens
cuuggaacccggugc

SEQ ID NO: 687765 - RNA, 16 nt, Homo sapiens
cuuggaaccuaagguu

SEQ ID NO: 687766 - RNA, 19 nt, Homo sapiens
cugaguccagagcuugugc

SEQ ID NO: 687767 - RNA, 13 nt, Homo sapiens
cugagugauccac

SEQ ID NO: 687768 - RNA, 22 nt, Homo sapiens
cugagugcaccacuucaaguga

SEQ ID NO: 687769 - RNA, 12 nt, Homo sapiens
cugagugcagcc

SEQ ID NO: 687770 - RNA, 19 nt, Homo sapiens
cugaguggaucuccaagga

SEQ ID NO: 687771 - RNA, 22 nt, Homo sapiens
cugaguggccagccagugccau

SEQ ID NO: 687772 - RNA, 13 nt, Homo sapiens
cugaguggucuga

SEQ ID NO: 687773 - RNA, 14 nt, Homo sapiens
cugaguggugccaa

SEQ ID NO: 687774 - RNA, 16 nt, Homo sapiens
cugaguugcuuuucag

SEQ ID NO: 687775 - RNA, 21 nt, Homo sapiens
cugaguuugcuguuugcaauu

SEQ ID NO: 687776 - RNA, 15 nt, Homo sapiens
cugauaaguuucaua

SEQ ID NO: 687777 - RNA, 15 nt, Homo sapiens
cugauaauaauugau

SEQ ID NO: 687778 - RNA, 17 nt, Homo sapiens
cugauaauaauugauca

SEQ ID NO: 687779 - RNA, 17 nt, Homo sapiens
cugauaauaugcaaaug

SEQ ID NO: 687780 - RNA, 15 nt, Homo sapiens
cugauaccacugcac

SEQ ID NO: 687781 - RNA, 16 nt, Homo sapiens
cugauacccuuugaaa

SEQ ID NO: 687782 - RNA, 15 nt, Homo sapiens
cugauacguguauga

SEQ ID NO: 687783 - RNA, 22 nt, Homo sapiens
cugauagcuauaauugggucau

SEQ ID NO: 687784 - RNA, 20 nt, Homo sapiens
cugauagcucugccuuaccc

SEQ ID NO: 687785 - RNA, 14 nt, Homo sapiens
cugauagggguuca

SEQ ID NO: 687786 - RNA, 14 nt, Homo sapiens
cugauaguauuccu

SEQ ID NO: 687787 - RNA, 16 nt, Homo sapiens
cugauauuaaucaaaa

SEQ ID NO: 687788 - RNA, 19 nt, Homo sapiens
cugauauuuuaccucuuau

SEQ ID NO: 687789 - RNA, 12 nt, Homo sapiens
cugauauuuuag

SEQ ID NO: 687790 - RNA, 20 nt, Homo sapiens
cugauccugacacauucuga

SEQ ID NO: 687791 - RNA, 11 nt, Homo sapiens
cugaucugcag

SEQ ID NO: 687792 - RNA, 18 nt, Homo sapiens
cugaucuuuuuauacaca

SEQ ID NO: 687793 - RNA, 22 nt, Homo sapiens
cugaugaaaaauaugugcuuga

SEQ ID NO: 687794 - RNA, 16 nt, Homo sapiens
cugaugaaaaggucag

SEQ ID NO: 687795 - RNA, 21 nt, Homo sapiens
cugaugaaaaggucagacuga

SEQ ID NO: 687796 - RNA, 17 nt, Homo sapiens
cugaugacacauuuggc

SEQ ID NO: 687797 - RNA, 19 nt, Homo sapiens
cugaugacuuuauccugag

SEQ ID NO: 687798 - RNA, 17 nt, Homo sapiens
cugaugagaaucaugca

SEQ ID NO: 687799 - RNA, 20 nt, Homo sapiens
cugaugauccagaacagugg

SEQ ID NO: 687800 - RNA, 22 nt, Homo sapiens
cugaugaugucucuuguagaag

SEQ ID NO: 687801 - RNA, 14 nt, Homo sapiens
cugaugcagccugu

SEQ ID NO: 687802 - RNA, 11 nt, Homo sapiens
cugaugcauug

SEQ ID NO: 687803 - RNA, 12 nt, Homo sapiens
cugaugcugaca

SEQ ID NO: 687804 - RNA, 18 nt, Homo sapiens
cugaugcuguuaaccaaa

SEQ ID NO: 687805 - RNA, 15 nt, Homo sapiens
cugaugcuucuauca

SEQ ID NO: 687806 - RNA, 23 nt, Homo sapiens
cugaugcuuugcuucaaauccau

SEQ ID NO: 687807 - RNA, 16 nt, Homo sapiens
cugauggaaaauacca

SEQ ID NO: 687808 - RNA, 20 nt, Homo sapiens
cugauggaaguaaagccuca

SEQ ID NO: 687809 - RNA, 21 nt, Homo sapiens
cugauggaaguaaagccucaa

SEQ ID NO: 687810 - RNA, 21 nt, Homo sapiens
cugauggaccgggugggccug

SEQ ID NO: 687811 - RNA, 19 nt, Homo sapiens
cugauggagcucagaauuc

SEQ ID NO: 687812 - RNA, 14 nt, Homo sapiens
cugauggcacucug

SEQ ID NO: 687813 - RNA, 15 nt, Homo sapiens
cugauggcacucugu

SEQ ID NO: 687814 - RNA, 19 nt, Homo sapiens
cugauggccuuuggaccca

SEQ ID NO: 687815 - RNA, 12 nt, Homo sapiens
cugaugggacau

SEQ ID NO: 687816 - RNA, 16 nt, Homo sapiens
cugauggugcugcuca

SEQ ID NO: 687817 - RNA, 16 nt, Homo sapiens
cugaugucauaucauu

SEQ ID NO: 687818 - RNA, 16 nt, Homo sapiens
cugauguuacugagau

SEQ ID NO: 687819 - RNA, 22 nt, Homo sapiens
cugauguuuugguguauuguca

SEQ ID NO: 687820 - RNA, 16 nt, Homo sapiens
cugauuacucagagca

SEQ ID NO: 687821 - RNA, 22 nt, Homo sapiens
cugauuacugaaauuuaagaaa

SEQ ID NO: 687822 - RNA, 20 nt, Homo sapiens
cugauuagaaaugaccaaua

SEQ ID NO: 687823 - RNA, 16 nt, Homo sapiens
cugauuagagugcaaa

SEQ ID NO: 687824 - RNA, 18 nt, Homo sapiens
cugauuauuuagagccau

SEQ ID NO: 687825 - RNA, 14 nt, Homo sapiens
cugauucacagucu

SEQ ID NO: 687826 - RNA, 13 nt, Homo sapiens
cugauucauaaua

SEQ ID NO: 687827 - RNA, 15 nt, Homo sapiens
cugauuccacuuuua

SEQ ID NO: 687828 - RNA, 16 nt, Homo sapiens
cugauuccgcagcuca

SEQ ID NO: 687829 - RNA, 17 nt, Homo sapiens
cugauucucuacaugcu

SEQ ID NO: 687830 - RNA, 18 nt, Homo sapiens
cugauuuaauaugcaaag

SEQ ID NO: 687831 - RNA, 14 nt, Homo sapiens
cugauuuacauuca

SEQ ID NO: 687832 - RNA, 23 nt, Homo sapiens
cugauuugggcugaauguaugua

SEQ ID NO: 687833 - RNA, 16 nt, Homo sapiens
cugauuuucuggaaug

SEQ ID NO: 687834 - RNA, 16 nt, Homo sapiens
cugauuuuuagcuuua

SEQ ID NO: 687835 - RNA, 17 nt, Homo sapiens
cugauuuuuagcuuuac

SEQ ID NO: 687836 - RNA, 23 nt, Homo sapiens
cugcaaaaauauaaccauuacau

SEQ ID NO: 687837 - RNA, 19 nt, Homo sapiens
cugcaaacucacugcucaa

SEQ ID NO: 687838 - RNA, 19 nt, Homo sapiens
cugcaaaggcgcagugcuu

SEQ ID NO: 687839 - RNA, 14 nt, Homo sapiens
cugcaaauacugua

SEQ ID NO: 687840 - RNA, 15 nt, Homo sapiens
cugcaaauacuguau

SEQ ID NO: 687841 - RNA, 23 nt, Homo sapiens
cugcaaauauuagcaaagaagcu

SEQ ID NO: 687842 - RNA, 17 nt, Homo sapiens
cugcaaauugccugcaa

SEQ ID NO: 687843 - RNA, 23 nt, Homo sapiens
cugcaagaaaggggacccaagaa

SEQ ID NO: 687844 - RNA, 16 nt, Homo sapiens
cugcaagcacagcaua

SEQ ID NO: 687845 - RNA, 15 nt, Homo sapiens
cugcaauaauaucaa

SEQ ID NO: 687846 - RNA, 18 nt, Homo sapiens
cugcaaucccagcuacuu

SEQ ID NO: 687847 - RNA, 19 nt, Homo sapiens
cugcaaucugagccagugc

SEQ ID NO: 687848 - RNA, 17 nt, Homo sapiens
cugcaauuaaagugaua

SEQ ID NO: 687849 - RNA, 16 nt, Homo sapiens
cugcacaaaagcagau

SEQ ID NO: 687850 - RNA, 22 nt, Homo sapiens
cugcacaaaagcagauacuuga

SEQ ID NO: 687851 - RNA, 19 nt, Homo sapiens
cugcacacagugacuuccu

SEQ ID NO: 687852 - RNA, 18 nt, Homo sapiens
cugcacacccuccagaga

SEQ ID NO: 687853 - RNA, 16 nt, Homo sapiens
cugcacagauaccuca

SEQ ID NO: 687854 - RNA, 15 nt, Homo sapiens
cugcacagcaaaaga

SEQ ID NO: 687855 - RNA, 20 nt, Homo sapiens
cugcacaugaaaguuuugca

SEQ ID NO: 687856 - RNA, 18 nt, Homo sapiens
cugcacaugguucaccau

SEQ ID NO: 687857 - RNA, 16 nt, Homo sapiens
cugcaccaacucaccu

SEQ ID NO: 687858 - RNA, 21 nt, Homo sapiens
cugcaccagagcaaccucuca

SEQ ID NO: 687859 - RNA, 19 nt, Homo sapiens
cugcaccccucugcccuca

SEQ ID NO: 687860 - RNA, 16 nt, Homo sapiens
cugcaccccugggcca

SEQ ID NO: 687861 - RNA, 17 nt, Homo sapiens
cugcaccguacugugga

SEQ ID NO: 687862 - RNA, 20 nt, Homo sapiens
cugcaccugauuaguugaaa

SEQ ID NO: 687863 - RNA, 21 nt, Homo sapiens
cugcaccuuacaacucgggga

SEQ ID NO: 687864 - RNA, 22 nt, Homo sapiens
cugcaccuuacaacucggggac

SEQ ID NO: 687865 - RNA, 15 nt, Homo sapiens
cugcaccuuugcacg

SEQ ID NO: 687866 - RNA, 16 nt, Homo sapiens
cugcaccuuugcacgu

SEQ ID NO: 687867 - RNA, 17 nt, Homo sapiens
cugcacguaacacuccu

SEQ ID NO: 687868 - RNA, 20 nt, Homo sapiens
cugcacuaauuugauguuua

SEQ ID NO: 687869 - RNA, 14 nt, Homo sapiens
cugcacuacugaca

SEQ ID NO: 687870 - RNA, 22 nt, Homo sapiens
cugcacucauagggugcucuga

SEQ ID NO: 687871 - RNA, 14 nt, Homo sapiens
cugcacuccagccu

SEQ ID NO: 687872 - RNA, 16 nt, Homo sapiens
cugcacuccauggcca

SEQ ID NO: 687873 - RNA, 15 nt, Homo sapiens
cugcacuggggccac

SEQ ID NO: 687874 - RNA, 18 nt, Homo sapiens
cugcagaacagcaucaug

SEQ ID NO: 687875 - RNA, 17 nt, Homo sapiens
cugcagaagucccaaga

SEQ ID NO: 687876 - RNA, 21 nt, Homo sapiens
cuuccauaauuaugacaguua

SEQ ID NO: 687877 - RNA, 20 nt, Homo sapiens
cuuccauccugucaccauga

SEQ ID NO: 687878 - RNA, 19 nt, Homo sapiens
cuuccaugguacuguagca

SEQ ID NO: 687879 - RNA, 19 nt, Homo sapiens
cuuccauucacaccagcua

SEQ ID NO: 687880 - RNA, 11 nt, Homo sapiens
cuuccauuugc

SEQ ID NO: 687881 - RNA, 22 nt, Homo sapiens
cuuccauuuucccccacuacug

SEQ ID NO: 687882 - RNA, 21 nt, Homo sapiens
cuucccacacuguccauucuu

SEQ ID NO: 687883 - RNA, 20 nt, Homo sapiens
cuucccaccuacugcacuuu

SEQ ID NO: 687884 - RNA, 18 nt, Homo sapiens
cuucccaccucacaguga

SEQ ID NO: 687885 - RNA, 21 nt, Homo sapiens
cuucccagcgguuccugugca

SEQ ID NO: 687886 - RNA, 18 nt, Homo sapiens
cuucccauacuugcauac

SEQ ID NO: 687887 - RNA, 17 nt, Homo sapiens
cuuccccaacuucccua

SEQ ID NO: 687888 - RNA, 17 nt, Homo sapiens
cuuccccaaugcuccau

SEQ ID NO: 687889 - RNA, 17 nt, Homo sapiens
cuuccccagacucagcu

SEQ ID NO: 687890 - RNA, 13 nt, Homo sapiens
cuuccccauuuca

SEQ ID NO: 687891 - RNA, 15 nt, Homo sapiens
cuucccccaccacca

SEQ ID NO: 687892 - RNA, 16 nt, Homo sapiens
cuucccccugcaaaaa

SEQ ID NO: 687893 - RNA, 20 nt, Homo sapiens
cuuccccuccaaaaccucca

SEQ ID NO: 687894 - RNA, 13 nt, Homo sapiens
cuucccgccuucc

SEQ ID NO: 687895 - RNA, 15 nt, Homo sapiens
cuucccgccuuccaa

SEQ ID NO: 687896 - RNA, 20 nt, Homo sapiens
cuucccggcgucccuaccuc

SEQ ID NO: 687897 - RNA, 14 nt, Homo sapiens
cuuguuuucuugcc

SEQ ID NO: 687898 - RNA, 15 nt, Homo sapiens
cuuuaaaaaagcaaa

SEQ ID NO: 687899 - RNA, 15 nt, Homo sapiens
cuuuaaaaagauauu

SEQ ID NO: 687900 - RNA, 22 nt, Homo sapiens
cuuuaaaacuguauuuaaggaa

SEQ ID NO: 687901 - RNA, 17 nt, Homo sapiens
cuuuaaaccuuucauaa

SEQ ID NO: 687902 - RNA, 15 nt, Homo sapiens
cuuuaaacucaggga

SEQ ID NO: 687903 - RNA, 15 nt, Homo sapiens
cuuuaaagagaguuu

SEQ ID NO: 687904 - RNA, 15 nt, Homo sapiens
cuuuaaagauguaau

SEQ ID NO: 687905 - RNA, 18 nt, Homo sapiens
cuuuaaagccgugcucuu

SEQ ID NO: 687906 - RNA, 19 nt, Homo sapiens
cuuuaaagccugccucuuc

SEQ ID NO: 687907 - RNA, 20 nt, Homo sapiens
cuuuaaagcguuugcacaga

SEQ ID NO: 687908 - RNA, 19 nt, Homo sapiens
cuuuaaagucagguccaau

SEQ ID NO: 687909 - RNA, 22 nt, Homo sapiens
cuuuaaauacuauuauuugcua

SEQ ID NO: 687910 - RNA, 13 nt, Homo sapiens
cuuuaaauggaaa

SEQ ID NO: 687911 - RNA, 15 nt, Homo sapiens
cuuuaacacauucuu

SEQ ID NO: 687912 - RNA, 22 nt, Homo sapiens
cuuuaacucugcggauagcauu

SEQ ID NO: 687913 - RNA, 14 nt, Homo sapiens
cuuuaacugacuua

SEQ ID NO: 687914 - RNA, 21 nt, Homo sapiens
cuuuaacuuucagaggcaaua

SEQ ID NO: 687915 - RNA, 17 nt, Homo sapiens
cuuuaacuuuuacaaaa

SEQ ID NO: 687916 - RNA, 20 nt, Homo sapiens
cuuuaagaacaaacucugaa

SEQ ID NO: 687917 - RNA, 20 nt, Homo sapiens
cuuuaaguaaaaauccaaaa

SEQ ID NO: 687918 - RNA, 18 nt, Homo sapiens
cuuuaauaaaggccacag

SEQ ID NO: 687919 - RNA, 20 nt, Homo sapiens
cuuuaauaaaggccacagga

SEQ ID NO: 687920 - RNA, 10 nt, Homo sapiens
cuuuccugcc

SEQ ID NO: 687921 - RNA, 15 nt, Homo sapiens
cuuucgguacuguaa

SEQ ID NO: 687922 - RNA, 22 nt, Homo sapiens
cuuucguucugcugaccaaaug

SEQ ID NO: 687923 - RNA, 20 nt, Homo sapiens
cuuucuaaguaggaugaauc

SEQ ID NO: 687924 - RNA, 15 nt, Homo sapiens
cuuucuacacuguau

SEQ ID NO: 687925 - RNA, 16 nt, Homo sapiens
cuuucuagguucaaaa

SEQ ID NO: 687926 - RNA, 23 nt, Homo sapiens
cuuucuaucgugacucaauucaa

SEQ ID NO: 687927 - RNA, 18 nt, Homo sapiens
cuuucuccaggaccaaua

SEQ ID NO: 687928 - RNA, 14 nt, Homo sapiens
cuuucucccaguga

SEQ ID NO: 687929 - RNA, 15 nt, Homo sapiens
cuuucucccagugaa

SEQ ID NO: 687930 - RNA, 20 nt, Homo sapiens
cuuucuccuguuuauuccca

SEQ ID NO: 687931 - RNA, 20 nt, Homo sapiens
cuuucucugccagugacaga

SEQ ID NO: 687932 - RNA, 22 nt, Homo sapiens
cuuucucuuuuaggaggcacaa

SEQ ID NO: 687933 - RNA, 17 nt, Homo sapiens
cuuucugaauugcacau

SEQ ID NO: 687934 - RNA, 20 nt, Homo sapiens
cuuucugcaggaaauaguca

SEQ ID NO: 687935 - RNA, 14 nt, Homo sapiens
cuuucugcaugcuu

SEQ ID NO: 687936 - RNA, 19 nt, Homo sapiens
cuuucugcuaucaaagagg

SEQ ID NO: 687937 - RNA, 16 nt, Homo sapiens
cuuucuggaaaagagg

SEQ ID NO: 687938 - RNA, 16 nt, Homo sapiens
cuuucugugcagagau

SEQ ID NO: 687939 - RNA, 20 nt, Homo sapiens
cuuucuguugaaaagcacac

SEQ ID NO: 687940 - RNA, 16 nt, Homo sapiens
cuuucuguugucauug

SEQ ID NO: 687941 - RNA, 18 nt, Homo sapiens
cuuucuuaucccagugau

SEQ ID NO: 687942 - RNA, 16 nt, Homo sapiens
cuuucuucaccaaauc

SEQ ID NO: 687943 - RNA, 23 nt, Homo sapiens
cuuucuucaccaagugcaauaga

SEQ ID NO: 687944 - RNA, 13 nt, Homo sapiens
cuuugugccuuug

SEQ ID NO: 687945 - RNA, 22 nt, Homo sapiens
cuuuguggauggugucuccuuu

SEQ ID NO: 687946 - RNA, 15 nt, Homo sapiens
cuuugugguagcuua

SEQ ID NO: 687947 - RNA, 16 nt, Homo sapiens
cuuugugugauugaau

SEQ ID NO: 687948 - RNA, 15 nt, Homo sapiens
cuuuguuaaaaccaa

SEQ ID NO: 687949 - RNA, 14 nt, Homo sapiens
cuuuguuaggauuu

SEQ ID NO: 687950 - RNA, 18 nt, Homo sapiens
cuuuguuaugacagugaa

SEQ ID NO: 687951 - RNA, 23 nt, Homo sapiens
cuuuguugcuuccguucauggaa

SEQ ID NO: 687952 - RNA, 16 nt, Homo sapiens
cuuuguuuaaaugcca

SEQ ID NO: 687953 - RNA, 21 nt, Homo sapiens
cuuuguuuguugucagcugaa

SEQ ID NO: 687954 - RNA, 19 nt, Homo sapiens
cuuuguuuuuuaauguugu

SEQ ID NO: 687955 - RNA, 22 nt, Homo sapiens
cuuuuaaaaacuagagcacaga

SEQ ID NO: 687956 - RNA, 15 nt, Homo sapiens
cuuuuaaaaaugucc

SEQ ID NO: 687957 - RNA, 22 nt, Homo sapiens
cuuuuaaaaauucaaaugauuu

SEQ ID NO: 687958 - RNA, 18 nt, Homo sapiens
cuuuuaaaacacuuccau

SEQ ID NO: 687959 - RNA, 16 nt, Homo sapiens
cuuuuaaaauacauuu

SEQ ID NO: 687960 - RNA, 19 nt, Homo sapiens
cuuuuaaaaugcaauguaa

SEQ ID NO: 687961 - RNA, 19 nt, Homo sapiens
cuuuuaaagaaacuuggcu

SEQ ID NO: 687962 - RNA, 23 nt, Homo sapiens
cuuuuaaauucaaauuuuaucuc

SEQ ID NO: 687963 - RNA, 22 nt, Homo sapiens
cuuuuaaggcuaaaacuuaaca

SEQ ID NO: 687964 - RNA, 15 nt, Homo sapiens
cuuuuaaucagugaa

SEQ ID NO: 687965 - RNA, 20 nt, Homo sapiens
cuuuuaauccaauccacuaa

SEQ ID NO: 687966 - RNA, 17 nt, Homo sapiens
cuuuuaaugaacaaaug

SEQ ID NO: 687967 - RNA, 15 nt, Homo sapiens
cuuuuaaugaauuua

SEQ ID NO: 687968 - RNA, 17 nt, Homo sapiens
cuuuuaaugcuucauuc

SEQ ID NO: 687969 - RNA, 18 nt, Homo sapiens
gaaaaaaaccacacaaag

SEQ ID NO: 687970 - RNA, 18 nt, Homo sapiens
gaaaaaaacuucauucuc

SEQ ID NO: 687971 - RNA, 21 nt, Homo sapiens
gaaaaaaauacaaaaagcaaa

SEQ ID NO: 687972 - RNA, 19 nt, Homo sapiens
gaaaaaaguuccuuccuaa

SEQ ID NO: 687973 - RNA, 22 nt, Homo sapiens
gaaaaaauacucaacauuauua

SEQ ID NO: 687974 - RNA, 13 nt, Homo sapiens
gaaaaaauggaug

SEQ ID NO: 687975 - RNA, 15 nt, Homo sapiens
gaaaaaauucccuca

SEQ ID NO: 687976 - RNA, 15 nt, Homo sapiens
gaaaaacaucccaaa

SEQ ID NO: 687977 - RNA, 22 nt, Homo sapiens
gaaaaaccacugcuaugccauu

SEQ ID NO: 687978 - RNA, 13 nt, Homo sapiens
gaaaaacuuccau

SEQ ID NO: 687979 - RNA, 18 nt, Homo sapiens
gaaaaagacaauaguauu

SEQ ID NO: 687980 - RNA, 20 nt, Homo sapiens
gaaaaagaccuaugagcaca

SEQ ID NO: 687981 - RNA, 17 nt, Homo sapiens
gaaaaagaccugcauuu

SEQ ID NO: 687982 - RNA, 17 nt, Homo sapiens
gaaaaagcaaguguuca

SEQ ID NO: 687983 - RNA, 22 nt, Homo sapiens
gaaaaagcuuaaugauucugau

SEQ ID NO: 687984 - RNA, 20 nt, Homo sapiens
gaaaaagguuugcauucuca

SEQ ID NO: 687985 - RNA, 17 nt, Homo sapiens
gaaaaauauagccuuua

SEQ ID NO: 687986 - RNA, 19 nt, Homo sapiens
gaaaaauaugauacucuca

SEQ ID NO: 687987 - RNA, 18 nt, Homo sapiens
gaaaaaucaugggccaga

SEQ ID NO: 687988 - RNA, 21 nt, Homo sapiens
gaaaaauguaaauacucauga

SEQ ID NO: 687989 - RNA, 15 nt, Homo sapiens
gaaaaauguguaauu

SEQ ID NO: 687990 - RNA, 22 nt, Homo sapiens
gaaaacaauucaagcugagaaa

SEQ ID NO: 687991 - RNA, 14 nt, Homo sapiens
gaaaacacugugca

SEQ ID NO: 687992 - RNA, 16 nt, Homo sapiens
gaaaacacugugcaca

SEQ ID NO: 687993 - RNA, 19 nt, Homo sapiens
gaaaacacugugcacaucu

SEQ ID NO: 687994 - RNA, 15 nt, Homo sapiens
gaaaacauauuugug

SEQ ID NO: 687995 - RNA, 20 nt, Homo sapiens
gacugcugauuuucuggaau

SEQ ID NO: 687996 - RNA, 15 nt, Homo sapiens
gacuggaaccaggga

SEQ ID NO: 687997 - RNA, 17 nt, Homo sapiens
gacuggaagacacuuca

SEQ ID NO: 687998 - RNA, 17 nt, Homo sapiens
gacuggauucgugacaa

SEQ ID NO: 687999 - RNA, 23 nt, Homo sapiens
gacuggcaguaaccuagugaauu

SEQ ID NO: 688000 - RNA, 15 nt, Homo sapiens
gacuggcucaugccu

SEQ ID NO: 688001 - RNA, 16 nt, Homo sapiens
gacuggcuuuuauuaa

SEQ ID NO: 688002 - RNA, 18 nt, Homo sapiens
gacugguuguugccaaac

SEQ ID NO: 688003 - RNA, 22 nt, Homo sapiens
gacugguuuuaaacagugcuuu

SEQ ID NO: 688004 - RNA, 17 nt, Homo sapiens
gacuguaggauuugaag

SEQ ID NO: 688005 - RNA, 21 nt, Homo sapiens
gacugucaguucucugggaag

SEQ ID NO: 688006 - RNA, 14 nt, Homo sapiens
gacugucuuucaga

SEQ ID NO: 688007 - RNA, 15 nt, Homo sapiens
gacugugacuuucaa

SEQ ID NO: 688008 - RNA, 22 nt, Homo sapiens
gacugugcauacuuucccucau

SEQ ID NO: 688009 - RNA, 12 nt, Homo sapiens
gacugugggugg

SEQ ID NO: 688010 - RNA, 16 nt, Homo sapiens
gacuguugccacuuaa

SEQ ID NO: 688011 - RNA, 22 nt, Homo sapiens
gacuguugcucaaaucuauuca

SEQ ID NO: 688012 - RNA, 22 nt, Homo sapiens
gacuuaaaauauuccugcauuu

SEQ ID NO: 688013 - RNA, 18 nt, Homo sapiens
gacuuaacugguucauau

SEQ ID NO: 688014 - RNA, 23 nt, Homo sapiens
gacuuaauaaagguuuaaagcug

SEQ ID NO: 688015 - RNA, 23 nt, Homo sapiens
gacuuaauguaaaacccaaaaca

SEQ ID NO: 688016 - RNA, 15 nt, Homo sapiens
gacuuacaaaaugcc

SEQ ID NO: 688017 - RNA, 15 nt, Homo sapiens
gacuuacaauaccau

SEQ ID NO: 688018 - RNA, 22 nt, Homo sapiens
gacuuaccuguucaguacucua

SEQ ID NO: 688019 - RNA, 21 nt, Homo sapiens
gacuuagcgucaagacauuug

SEQ ID NO: 688020 - RNA, 17 nt, Homo sapiens
gacuuaguugcguuaca

SEQ ID NO: 688021 - RNA, 14 nt, Homo sapiens
gacuucacuguaua

SEQ ID NO: 688022 - RNA, 20 nt, Homo sapiens
gacuucauugucccucuuca

SEQ ID NO: 688023 - RNA, 23 nt, Homo sapiens
gacuuccccacugcucucugugg

SEQ ID NO: 688024 - RNA, 17 nt, Homo sapiens
gacuuccuuacuaagca

SEQ ID NO: 688025 - RNA, 15 nt, Homo sapiens
gacuucuagcugucu

SEQ ID NO: 688026 - RNA, 12 nt, Homo sapiens
gacuucucugaa

SEQ ID NO: 688027 - RNA, 14 nt, Homo sapiens
gacuucugaguaau

SEQ ID NO: 688028 - RNA, 18 nt, Homo sapiens
gacuucuuacccaaagca

SEQ ID NO: 688029 - RNA, 16 nt, Homo sapiens
gacuugaaaccagaag

SEQ ID NO: 688030 - RNA, 21 nt, Homo sapiens
gacuugaacuagauugcaugc

SEQ ID NO: 688031 - RNA, 16 nt, Homo sapiens
gacuugacccuuuccu

SEQ ID NO: 688032 - RNA, 17 nt, Homo sapiens
gacuugagccacuccuu

SEQ ID NO: 688033 - RNA, 13 nt, Homo sapiens
gacuuggaaucag

SEQ ID NO: 688034 - RNA, 15 nt, Homo sapiens
gacuuggagacuccu

SEQ ID NO: 688035 - RNA, 19 nt, Homo sapiens
gacuuggcacuccuggaca

SEQ ID NO: 688036 - RNA, 12 nt, Homo sapiens
gacuuggcacuu

SEQ ID NO: 688037 - RNA, 14 nt, Homo sapiens
gacuuggcacuuaa

SEQ ID NO: 688038 - RNA, 18 nt, Homo sapiens
gacuuggguugaacuaua

SEQ ID NO: 688039 - RNA, 22 nt, Homo sapiens
gacuugguaagaugacucugag

SEQ ID NO: 688040 - RNA, 16 nt, Homo sapiens
gacuuguagucuccau

SEQ ID NO: 688041 - RNA, 15 nt, Homo sapiens
gacuuguuucuccau

SEQ ID NO: 688042 - RNA, 18 nt, Homo sapiens
gacuuguuugucuuccau

SEQ ID NO: 688043 - RNA, 15 nt, Homo sapiens
gacuuuaaaccaccu

SEQ ID NO: 688044 - RNA, 13 nt, Homo sapiens
gacuuucugauua

SEQ ID NO: 688045 - RNA, 16 nt, Homo sapiens
gacuuugaaacuauua

SEQ ID NO: 688046 - RNA, 15 nt, Homo sapiens
gacuuugagcugagu

SEQ ID NO: 688047 - RNA, 22 nt, Homo sapiens
gacuuugagcugagugcugaaa

SEQ ID NO: 688048 - RNA, 17 nt, Homo sapiens
gacuuugauagauuucu

SEQ ID NO: 688049 - RNA, 18 nt, Homo sapiens
gacuuugcugcauuuuac

SEQ ID NO: 688050 - RNA, 12 nt, Homo sapiens
gacuuugcuugc

SEQ ID NO: 688051 - RNA, 17 nt, Homo sapiens
gacuuuguauagaaggu

SEQ ID NO: 688052 - RNA, 19 nt, Homo sapiens
gacuuuguccccacuuaca

SEQ ID NO: 688053 - RNA, 19 nt, Homo sapiens
gacuuuguguucauuucau

SEQ ID NO: 688054 - RNA, 18 nt, Homo sapiens
gacuuuuaaucagugaag

SEQ ID NO: 688055 - RNA, 17 nt, Homo sapiens
gacuuuucugauuaaua

SEQ ID NO: 688056 - RNA, 23 nt, Homo sapiens
gacuuuuuguacugaaaacaauu

SEQ ID NO: 688057 - RNA, 15 nt, Homo sapiens
gagaaaacaauuccu

SEQ ID NO: 688058 - RNA, 12 nt, Homo sapiens
gagaaaacaugc

SEQ ID NO: 688059 - RNA, 17 nt, Homo sapiens
gagaaaagugggcugca

SEQ ID NO: 688060 - RNA, 15 nt, Homo sapiens
gagaaaaugccucaa

SEQ ID NO: 688061 - RNA, 21 nt, Homo sapiens
gagaaaauuggaacucuacuc

SEQ ID NO: 688062 - RNA, 19 nt, Homo sapiens
gagaaaauuugaaaauguc

SEQ ID NO: 688063 - RNA, 18 nt, Homo sapiens
gagaaacacuaaagcauu

SEQ ID NO: 688064 - RNA, 23 nt, Homo sapiens
gagaaacagagacaggcccaaga

SEQ ID NO: 688065 - RNA, 19 nt, Homo sapiens
gagaaaccgaggugcaaau

SEQ ID NO: 688066 - RNA, 11 nt, Homo sapiens
gagaaacugaa

SEQ ID NO: 688067 - RNA, 16 nt, Homo sapiens
gagaaagaccaugcau

SEQ ID NO: 688068 - RNA, 13 nt, Homo sapiens
gagaaagcacuga

SEQ ID NO: 688069 - RNA, 20 nt, Homo sapiens
gagaaauaaaaauaccucuu

SEQ ID NO: 688070 - RNA, 15 nt, Homo sapiens
gagaaauacuuucag

SEQ ID NO: 688071 - RNA, 23 nt, Homo sapiens
gagaaauacuuucaggcacuaag

SEQ ID NO: 688072 - RNA, 19 nt, Homo sapiens
gagaaauggcgaaugucau

SEQ ID NO: 688073 - RNA, 23 nt, Homo sapiens
gagaaauuccuuagucauggugu

SEQ ID NO: 688074 - RNA, 15 nt, Homo sapiens
gagaaauugacagau

SEQ ID NO: 688075 - RNA, 14 nt, Homo sapiens
gagaaauugaggau

SEQ ID NO: 688076 - RNA, 21 nt, Homo sapiens
gagaaauuuaaacuauaagca

SEQ ID NO: 688077 - RNA, 19 nt, Homo sapiens
gagaacaucauaacccaug

SEQ ID NO: 688078 - RNA, 9 nt, Homo sapiens
gagaaccac

SEQ ID NO: 688079 - RNA, 17 nt, Homo sapiens
gagaacccuuccuuucc

SEQ ID NO: 688080 - RNA, 17 nt, Homo sapiens
gagaucuuucuuuccaa

SEQ ID NO: 688081 - RNA, 17 nt, Homo sapiens
gagaugaagccuaagaa

SEQ ID NO: 688082 - RNA, 22 nt, Homo sapiens
gagaugacaaaccauaacugac

SEQ ID NO: 688083 - RNA, 18 nt, Homo sapiens
gagaugaccagugccuug

SEQ ID NO: 688084 - RNA, 19 nt, Homo sapiens
gagaugagucagugccaug

SEQ ID NO: 688085 - RNA, 14 nt, Homo sapiens
gagaugcagccagc

SEQ ID NO: 688086 - RNA, 15 nt, Homo sapiens
gagaugcagcuggaa

SEQ ID NO: 688087 - RNA, 20 nt, Homo sapiens
gagaugcaggugaugccauu

SEQ ID NO: 688088 - RNA, 22 nt, Homo sapiens
gagaugcagucacuuauugucc

SEQ ID NO: 688089 - RNA, 18 nt, Homo sapiens
gagauggacaacucaaug

SEQ ID NO: 688090 - RNA, 17 nt, Homo sapiens
gagauggaggaaaguga

SEQ ID NO: 688091 - RNA, 16 nt, Homo sapiens
gagauggguccagggg

SEQ ID NO: 688092 - RNA, 21 nt, Homo sapiens
gagauguggcaaagugcugua

SEQ ID NO: 688093 - RNA, 12 nt, Homo sapiens
gagauucugggu

SEQ ID NO: 688094 - RNA, 20 nt, Homo sapiens
gagauugaauuucacugucu

SEQ ID NO: 688095 - RNA, 12 nt, Homo sapiens
gagauugcacag

SEQ ID NO: 688096 - RNA, 17 nt, Homo sapiens
gagauuggccagcaaaa

SEQ ID NO: 688097 - RNA, 17 nt, Homo sapiens
gagauuuuaauucugug

SEQ ID NO: 688098 - RNA, 18 nt, Homo sapiens
gagcaaaaaucugagaaa

SEQ ID NO: 688099 - RNA, 23 nt, Homo sapiens
gagcaaaagccucagaaagggau

SEQ ID NO: 688100 - RNA, 17 nt, Homo sapiens
gagcaaaaggcagcuca

SEQ ID NO: 688101 - RNA, 18 nt, Homo sapiens
gagcaaaaucaacaugac

SEQ ID NO: 688102 - RNA, 23 nt, Homo sapiens
gagcaaacuaacuugacuuuuaa

SEQ ID NO: 688103 - RNA, 22 nt, Homo sapiens
gagcaaauaucauacuguucaa

SEQ ID NO: 688104 - RNA, 17 nt, Homo sapiens
gagcaaauggugcugaa

SEQ ID NO: 688105 - RNA, 13 nt, Homo sapiens
gagcaacagccua

SEQ ID NO: 688106 - RNA, 22 nt, Homo sapiens
gagcaagacucugucucaaaaa

SEQ ID NO: 688107 - RNA, 21 nt, Homo sapiens
gagcaagucuuagacaucaua

SEQ ID NO: 688108 - RNA, 23 nt, Homo sapiens
gagcacaagccacaagucuucca

SEQ ID NO: 688109 - RNA, 22 nt, Homo sapiens
gagcacaaggccuuaauggaca

SEQ ID NO: 688110 - RNA, 19 nt, Homo sapiens
gagcacaauggucuuacau

SEQ ID NO: 688111 - RNA, 16 nt, Homo sapiens
gagcacagaaggaaua

SEQ ID NO: 688112 - RNA, 14 nt, Homo sapiens
gagcacagcuucuu

SEQ ID NO: 688113 - RNA, 16 nt, Homo sapiens
gagcacauagagcuuu

SEQ ID NO: 688114 - RNA, 21 nt, Homo sapiens
gagcacauaguguccugccca

SEQ ID NO: 688115 - RNA, 17 nt, Homo sapiens
gagcacaucucucugcc

SEQ ID NO: 688116 - RNA, 21 nt, Homo sapiens
gagcacccugcccaccaagaa

SEQ ID NO: 688117 - RNA, 18 nt, Homo sapiens
gagcaccuugcaguuccc

SEQ ID NO: 688118 - RNA, 21 nt, Homo sapiens
gagcacggacugucaguucuc

SEQ ID NO: 688119 - RNA, 17 nt, Homo sapiens
gaauauauucuauucca

SEQ ID NO: 688120 - RNA, 18 nt, Homo sapiens
gaauauauucuauuccau

SEQ ID NO: 688121 - RNA, 17 nt, Homo sapiens
gaauaucauugauuuua

SEQ ID NO: 688122 - RNA, 18 nt, Homo sapiens
gaauaucugggauucuac

SEQ ID NO: 688123 - RNA, 13 nt, Homo sapiens
gaauaucuguuca

SEQ ID NO: 688124 - RNA, 15 nt, Homo sapiens
gaauaugaaugucac

SEQ ID NO: 688125 - RNA, 21 nt, Homo sapiens
gaauaugauaaaacacugccc

SEQ ID NO: 688126 - RNA, 22 nt, Homo sapiens
gaauaugaucagguaacuuucg

SEQ ID NO: 688127 - RNA, 20 nt, Homo sapiens
gaauauggaacauaugcaca

SEQ ID NO: 688128 - RNA, 21 nt, Homo sapiens
gaauauggaacauaugcacag

SEQ ID NO: 688129 - RNA, 17 nt, Homo sapiens
gaauauggacuuggaaa

SEQ ID NO: 688130 - RNA, 17 nt, Homo sapiens
gaauaugguggaaaaua

SEQ ID NO: 688131 - RNA, 16 nt, Homo sapiens
gaauauguuaaugcaa

SEQ ID NO: 688132 - RNA, 22 nt, Homo sapiens
gaauauguuaaugcaaagcuaa

SEQ ID NO: 688133 - RNA, 16 nt, Homo sapiens
gaauauguugaucauu

SEQ ID NO: 688134 - RNA, 21 nt, Homo sapiens
gaauauuaauaaaacuuuaug

SEQ ID NO: 688135 - RNA, 16 nt, Homo sapiens
gaauauuccuggacuu

SEQ ID NO: 688136 - RNA, 13 nt, Homo sapiens
gaauauugccaau

SEQ ID NO: 688137 - RNA, 15 nt, Homo sapiens
gaaucaaaucugugc

SEQ ID NO: 688138 - RNA, 18 nt, Homo sapiens
gaaucaacaagauuucca

SEQ ID NO: 688139 - RNA, 19 nt, Homo sapiens
gaaucaacaagauuuccac

SEQ ID NO: 688140 - RNA, 13 nt, Homo sapiens
gaaucaauucaau

SEQ ID NO: 688141 - RNA, 22 nt, Homo sapiens
gaaucaccaauggcuccuugcc

SEQ ID NO: 688142 - RNA, 20 nt, Homo sapiens
gaaucacuguuuagaacaca

SEQ ID NO: 688143 - RNA, 17 nt, Homo sapiens
gaaucacuuaaauguca

SEQ ID NO: 688144 - RNA, 21 nt, Homo sapiens
gaaucacuuaagccuggaagg

SEQ ID NO: 688145 - RNA, 19 nt, Homo sapiens
gaaucagacugacaguuua

SEQ ID NO: 688146 - RNA, 22 nt, Homo sapiens
gaaucaguccuagaauguuuca

SEQ ID NO: 688147 - RNA, 20 nt, Homo sapiens
gaaucagugaagaugccagu

SEQ ID NO: 688148 - RNA, 22 nt, Homo sapiens
gaaucagugaagccaaagggac

SEQ ID NO: 688149 - RNA, 17 nt, Homo sapiens
gaugcaauauaagcaua

SEQ ID NO: 688150 - RNA, 18 nt, Homo sapiens
gaugcaaugacucaggac

SEQ ID NO: 688151 - RNA, 13 nt, Homo sapiens
gaugcacauuucu

SEQ ID NO: 688152 - RNA, 17 nt, Homo sapiens
gaugcacguggggccca

SEQ ID NO: 688153 - RNA, 22 nt, Homo sapiens
gaugcacuauauguuuacacaa

SEQ ID NO: 688154 - RNA, 18 nt, Homo sapiens
gaugcacucucagaccaa

SEQ ID NO: 688155 - RNA, 16 nt, Homo sapiens
gaugcagaaagacguu

SEQ ID NO: 688156 - RNA, 15 nt, Homo sapiens
gaugcagauccagag

SEQ ID NO: 688157 - RNA, 15 nt, Homo sapiens
gaugcagcacugcgc

SEQ ID NO: 688158 - RNA, 20 nt, Homo sapiens
gaugcagcucuugggaccgu

SEQ ID NO: 688159 - RNA, 19 nt, Homo sapiens
gaugcagugaugugaucau

SEQ ID NO: 688160 - RNA, 15 nt, Homo sapiens
gaugcagugcuucca

SEQ ID NO: 688161 - RNA, 21 nt, Homo sapiens
gaugcaucacuggguguugau

SEQ ID NO: 688162 - RNA, 18 nt, Homo sapiens
gaugcaucuuguuucaua

SEQ ID NO: 688163 - RNA, 11 nt, Homo sapiens
gaugcauuuaa

SEQ ID NO: 688164 - RNA, 19 nt, Homo sapiens
gaugccaaagauguuugaa

SEQ ID NO: 688165 - RNA, 20 nt, Homo sapiens
gaugccaauuuccucuccac

SEQ ID NO: 688166 - RNA, 20 nt, Homo sapiens
gaugccacgcuuugcugcua

SEQ ID NO: 688167 - RNA, 19 nt, Homo sapiens
gaugccagcauauacugaa

SEQ ID NO: 688168 - RNA, 16 nt, Homo sapiens
gaugccagggcuggaa

SEQ ID NO: 688169 - RNA, 19 nt, Homo sapiens
gaugccucgcucuuuucaa

SEQ ID NO: 688170 - RNA, 15 nt, Homo sapiens
gaugcuaagcugaua

SEQ ID NO: 688171 - RNA, 14 nt, Homo sapiens
gaugcugacccagg

SEQ ID NO: 688172 - RNA, 14 nt, Homo sapiens
gaugcugagccaua

SEQ ID NO: 688173 - RNA, 17 nt, Homo sapiens
gauggaauaacucugug

SEQ ID NO: 688174 - RNA, 12 nt, Homo sapiens
gauggaauauca

SEQ ID NO: 688175 - RNA, 22 nt, Homo sapiens
gauggaccuccuucgcuggaag

SEQ ID NO: 688176 - RNA, 22 nt, Homo sapiens
gauggacucaggauccagugac

SEQ ID NO: 688177 - RNA, 16 nt, Homo sapiens
gauggagcgcaccugc

SEQ ID NO: 688178 - RNA, 14 nt, Homo sapiens
gauggaggacucca

SEQ ID NO: 688179 - RNA, 21 nt, Homo sapiens
gauggaggguccaauccuagg

SEQ ID NO: 688180 - RNA, 17 nt, Homo sapiens
gauggagucagguuugg

SEQ ID NO: 688181 - RNA, 13 nt, Homo sapiens
gauggauguuggg

SEQ ID NO: 688182 - RNA, 14 nt, Homo sapiens
gauggcaccagagg

SEQ ID NO: 688183 - RNA, 18 nt, Homo sapiens
gauggcaucuccauguag

SEQ ID NO: 688184 - RNA, 22 nt, Homo sapiens
gauggccacugugaauaacugu

SEQ ID NO: 688185 - RNA, 15 nt, Homo sapiens
gauggccaggccaga

SEQ ID NO: 688186 - RNA, 17 nt, Homo sapiens
gauggccaugcccucca

SEQ ID NO: 688187 - RNA, 16 nt, Homo sapiens
gauggccccuccacug

SEQ ID NO: 688188 - RNA, 18 nt, Homo sapiens
gauggccccuccuugcaa

SEQ ID NO: 688189 - RNA, 12 nt, Homo sapiens
gauggccuggau

SEQ ID NO: 688190 - RNA, 17 nt, Homo sapiens
gauggccuuacacugaa

SEQ ID NO: 688191 - RNA, 13 nt, Homo sapiens
gauggcuaugccu

SEQ ID NO: 688192 - RNA, 14 nt, Homo sapiens
gaugggaacacugg

SEQ ID NO: 688193 - RNA, 15 nt, Homo sapiens
gaugggaugcacucu

SEQ ID NO: 688194 - RNA, 19 nt, Homo sapiens
gaugggaugcacucucaga

SEQ ID NO: 688195 - RNA, 18 nt, Homo sapiens
gauggggcaagggcacaa

SEQ ID NO: 688196 - RNA, 15 nt, Homo sapiens
gauggggcauauuca

SEQ ID NO: 688197 - RNA, 22 nt, Homo sapiens
gauggggcaugaccucagucag

SEQ ID NO: 688198 - RNA, 16 nt, Homo sapiens
gacauaaugggguccu

SEQ ID NO: 688199 - RNA, 13 nt, Homo sapiens
gacauacaugcua

SEQ ID NO: 688200 - RNA, 18 nt, Homo sapiens
gacauagccgauucucug

SEQ ID NO: 688201 - RNA, 13 nt, Homo sapiens
gacauauaucuau

SEQ ID NO: 688202 - RNA, 20 nt, Homo sapiens
gacaucagccugcuucuucc

SEQ ID NO: 688203 - RNA, 13 nt, Homo sapiens
gacaucaggaaac

SEQ ID NO: 688204 - RNA, 19 nt, Homo sapiens
gacauccccccgccaaaag

SEQ ID NO: 688205 - RNA, 20 nt, Homo sapiens
gacauccugagcagugccag

SEQ ID NO: 688206 - RNA, 20 nt, Homo sapiens
gacaucgcuggaaaugaaua

SEQ ID NO: 688207 - RNA, 21 nt, Homo sapiens
gacaucgguguucuucuuccc

SEQ ID NO: 688208 - RNA, 18 nt, Homo sapiens
gacaucgguucauauuaa

SEQ ID NO: 688209 - RNA, 13 nt, Homo sapiens
gacaucucagggg

SEQ ID NO: 688210 - RNA, 18 nt, Homo sapiens
gacaucucaggggccaga

SEQ ID NO: 688211 - RNA, 16 nt, Homo sapiens
gacaugauuuccuuga

SEQ ID NO: 688212 - RNA, 14 nt, Homo sapiens
gacaugcacuauga

SEQ ID NO: 688213 - RNA, 15 nt, Homo sapiens
gacaugcccaaaacu

SEQ ID NO: 688214 - RNA, 18 nt, Homo sapiens
gacaugcccaaggccacg

SEQ ID NO: 688215 - RNA, 13 nt, Homo sapiens
gacaugcccugug

SEQ ID NO: 688216 - RNA, 12 nt, Homo sapiens
gacaugccuugg

SEQ ID NO: 688217 - RNA, 16 nt, Homo sapiens
gacaugccuuggugcc

SEQ ID NO: 688218 - RNA, 18 nt, Homo sapiens
gacaugccuuggugccgg

SEQ ID NO: 688219 - RNA, 16 nt, Homo sapiens
gacaugcggcugccca

SEQ ID NO: 688220 - RNA, 15 nt, Homo sapiens
gacauggagauguaa

SEQ ID NO: 688221 - RNA, 23 nt, Homo sapiens
gacauggcucauuguagcacaau

SEQ ID NO: 688222 - RNA, 15 nt, Homo sapiens
gacaugguaccuaag

SEQ ID NO: 688223 - RNA, 14 nt, Homo sapiens
gacauggugccuua

SEQ ID NO: 688224 - RNA, 14 nt, Homo sapiens
gacaugugacauuu

SEQ ID NO: 688225 - RNA, 15 nt, Homo sapiens
gacauguggggccag

SEQ ID NO: 688226 - RNA, 18 nt, Homo sapiens
gacauguuggaaauguag

SEQ ID NO: 688227 - RNA, 21 nt, Homo sapiens
gacauuacaauguguaaugga

SEQ ID NO: 688228 - RNA, 18 nt, Homo sapiens
gacauucaaaacgugaug

SEQ ID NO: 688229 - RNA, 22 nt, Homo sapiens
gacauucaaggcauuucuauca

SEQ ID NO: 688230 - RNA, 13 nt, Homo sapiens
gacauuccaccau

SEQ ID NO: 688231 - RNA, 20 nt, Homo sapiens
gacauucuggaaaagcaaaa

SEQ ID NO: 688232 - RNA, 19 nt, Homo sapiens
gacauugaccuauuuccag

SEQ ID NO: 688233 - RNA, 18 nt, Homo sapiens
gacauuguaugcagggag

SEQ ID NO: 688234 - RNA, 14 nt, Homo sapiens
gacauugucucccg

SEQ ID NO: 688235 - RNA, 19 nt, Homo sapiens
gacauuucuccaaagaaga

SEQ ID NO: 688236 - RNA, 22 nt, Homo sapiens
gacauuugggagacaugugaca

SEQ ID NO: 688237 - RNA, 20 nt, Homo sapiens
gacauuuggugguacuuuau

SEQ ID NO: 688238 - RNA, 22 nt, Homo sapiens
gacauuuuuauuuuauggaaua

SEQ ID NO: 688239 - RNA, 20 nt, Homo sapiens
gacauuuuuugcuauaauca

SEQ ID NO: 688240 - RNA, 17 nt, Homo sapiens
gaccaaaaugacaauga

SEQ ID NO: 688241 - RNA, 15 nt, Homo sapiens
gaccaaaugugccau

SEQ ID NO: 688242 - RNA, 21 nt, Homo sapiens
gaccaacgcacaacaggaaac

SEQ ID NO: 688243 - RNA, 20 nt, Homo sapiens
gaccaagacugagccagcuu

SEQ ID NO: 688244 - RNA, 22 nt, Homo sapiens
gaccaaguuaucaucucaccac

SEQ ID NO: 688245 - RNA, 13 nt, Homo sapiens
gaccaauacuacu

SEQ ID NO: 688246 - RNA, 19 nt, Homo sapiens
gaccaaugucuugaugcau

SEQ ID NO: 688247 - RNA, 16 nt, Homo sapiens
gaccacagacucacau

SEQ ID NO: 688248 - RNA, 17 nt, Homo sapiens
gaccacagcacagccaa

SEQ ID NO: 688249 - RNA, 19 nt, Homo sapiens
gaccacagcacagccaaca

SEQ ID NO: 688250 - RNA, 18 nt, Homo sapiens
gaccacaucuguccucac

SEQ ID NO: 688251 - RNA, 13 nt, Homo sapiens
gaccaccaccagg

SEQ ID NO: 688252 - RNA, 23 nt, Homo sapiens
gaccaccaccccaacaaaccauc

SEQ ID NO: 688253 - RNA, 18 nt, Homo sapiens
gaccaccuuuuugaguga

SEQ ID NO: 688254 - RNA, 21 nt, Homo sapiens
gaccacgcuuucuagcuguug

SEQ ID NO: 688255 - RNA, 12 nt, Homo sapiens
gaccacuccugu

SEQ ID NO: 688256 - RNA, 17 nt, Homo sapiens
gaccacugggcaaugau

SEQ ID NO: 688257 - RNA, 17 nt, Homo sapiens
gaccacuguuaucaaaa

SEQ ID NO: 688258 - RNA, 22 nt, Homo sapiens
gaccagaaaguguguguguucu

SEQ ID NO: 688259 - RNA, 22 nt, Homo sapiens
gaccagaaccagagcucagaga

SEQ ID NO: 688260 - RNA, 15 nt, Homo sapiens
gaccagaagccuugg

SEQ ID NO: 688261 - RNA, 14 nt, Homo sapiens
gaccagaaguggac

SEQ ID NO: 688262 - RNA, 22 nt, Homo sapiens
gaccagaccccaaaccagcccu

SEQ ID NO: 688263 - RNA, 14 nt, Homo sapiens
gaccagccugucac

SEQ ID NO: 688264 - RNA, 13 nt, Homo sapiens
gaccagcuuugca

SEQ ID NO: 688265 - RNA, 16 nt, Homo sapiens
gaccaggcuacuucuc

SEQ ID NO: 688266 - RNA, 17 nt, Homo sapiens
gaccagggcuuuuccca

SEQ ID NO: 688267 - RNA, 15 nt, Homo sapiens
gaccagucacucccu

SEQ ID NO: 688268 - RNA, 22 nt, Homo sapiens
gaccaguccuguuugcagggaa

SEQ ID NO: 688269 - RNA, 17 nt, Homo sapiens
gaccauucaggacacag

SEQ ID NO: 688270 - RNA, 19 nt, Homo sapiens
gacccaaaaaaucaucuca

SEQ ID NO: 688271 - RNA, 20 nt, Homo sapiens
gacccaaaaaaucaucucac

SEQ ID NO: 688272 - RNA, 13 nt, Homo sapiens
gacccaagcugcc

SEQ ID NO: 688273 - RNA, 20 nt, Homo sapiens
gacccacaugcuccagauua

SEQ ID NO: 688274 - RNA, 13 nt, Homo sapiens
gacccacccagcc

SEQ ID NO: 688275 - RNA, 17 nt, Homo sapiens
gacccaccccugugcuc

SEQ ID NO: 688276 - RNA, 16 nt, Homo sapiens
gacccacgaaacugcc

SEQ ID NO: 688277 - RNA, 13 nt, Homo sapiens
gacccacggggca

SEQ ID NO: 688278 - RNA, 15 nt, Homo sapiens
gacccacuggacuca

SEQ ID NO: 688279 - RNA, 15 nt, Homo sapiens
gacccagaauaucca

SEQ ID NO: 688280 - RNA, 22 nt, Homo sapiens
gacccagcugcagaccaugcca

SEQ ID NO: 688281 - RNA, 18 nt, Homo sapiens
gacccagggaugacaugu

SEQ ID NO: 688282 - RNA, 17 nt, Homo sapiens
gacccaucuuccaccuc

SEQ ID NO: 688283 - RNA, 15 nt, Homo sapiens
gaccccaaaccagcc

SEQ ID NO: 688284 - RNA, 12 nt, Homo sapiens
gaccccaaagag

SEQ ID NO: 688285 - RNA, 21 nt, Homo sapiens
gaccccacaacuucaggagcu

SEQ ID NO: 688286 - RNA, 16 nt, Homo sapiens
gaccccacccaagcuu

SEQ ID NO: 688287 - RNA, 18 nt, Homo sapiens
gggaaagcuucauucucc

SEQ ID NO: 688288 - RNA, 22 nt, Homo sapiens
gggaaauagccaaaaaggcaaa

SEQ ID NO: 688289 - RNA, 14 nt, Homo sapiens
gggaaaucaguguu

SEQ ID NO: 688290 - RNA, 23 nt, Homo sapiens
gggaaauggcuugaagccaaguc

SEQ ID NO: 688291 - RNA, 12 nt, Homo sapiens
gggaaauugcuu

SEQ ID NO: 688292 - RNA, 21 nt, Homo sapiens
gggaacagcagcagugccaua

SEQ ID NO: 688293 - RNA, 14 nt, Homo sapiens
gggaacauguccua

SEQ ID NO: 688294 - RNA, 15 nt, Homo sapiens
gggaagagugcauuu

SEQ ID NO: 688295 - RNA, 14 nt, Homo sapiens
gggaagccuagaga

SEQ ID NO: 688296 - RNA, 21 nt, Homo sapiens
gggaagccugugccagcaccu

SEQ ID NO: 688297 - RNA, 14 nt, Homo sapiens
gggaagcucagggg

SEQ ID NO: 688298 - RNA, 23 nt, Homo sapiens
gggaagcuggcuuucuggcugcu

SEQ ID NO: 688299 - RNA, 21 nt, Homo sapiens
gggaaggaggccaagcagugc

SEQ ID NO: 688300 - RNA, 20 nt, Homo sapiens
gggaaggcaaaggcagagga

SEQ ID NO: 688301 - RNA, 12 nt, Homo sapiens
gggaagggugca

SEQ ID NO: 688302 - RNA, 14 nt, Homo sapiens
gggaaguaacagac

SEQ ID NO: 688303 - RNA, 14 nt, Homo sapiens
gggaauauugccaa

SEQ ID NO: 688304 - RNA, 22 nt, Homo sapiens
gggaaucauuuuagcugguguc

SEQ ID NO: 688305 - RNA, 16 nt, Homo sapiens
gggaaugcaccucccc

SEQ ID NO: 688306 - RNA, 23 nt, Homo sapiens
gggaauggaggggcagagccagg

SEQ ID NO: 688307 - RNA, 15 nt, Homo sapiens
gggaauggauccugg

SEQ ID NO: 688308 - RNA, 15 nt, Homo sapiens
gggaauucccucccc

SEQ ID NO: 688309 - RNA, 17 nt, Homo sapiens
gggaauugaggucugcu

SEQ ID NO: 688310 - RNA, 17 nt, Homo sapiens
gggaauuuucucuccau

SEQ ID NO: 688311 - RNA, 16 nt, Homo sapiens
gggacacaacacagau

SEQ ID NO: 688312 - RNA, 13 nt, Homo sapiens
gggacacagcagu

SEQ ID NO: 688313 - RNA, 18 nt, Homo sapiens
gggacacucgggcccaug

SEQ ID NO: 688314 - RNA, 21 nt, Homo sapiens
gggacagagccaugcugggaa

SEQ ID NO: 688315 - RNA, 23 nt, Homo sapiens
gggacagagccccacgcuguuga

SEQ ID NO: 688316 - RNA, 19 nt, Homo sapiens
gggacagcaagugagcaga

SEQ ID NO: 688317 - RNA, 13 nt, Homo sapiens
gggaccaaugagg

SEQ ID NO: 688318 - RNA, 19 nt, Homo sapiens
gggaccagugaccaucaca

SEQ ID NO: 688319 - RNA, 15 nt, Homo sapiens
gggacccugcucaca

SEQ ID NO: 688320 - RNA, 15 nt, Homo sapiens
gggaccgaaagcaaa

SEQ ID NO: 688321 - RNA, 20 nt, Homo sapiens
gggaccuggccccaggcugu

SEQ ID NO: 688322 - RNA, 17 nt, Homo sapiens
gggacgcacagugcagu

SEQ ID NO: 688323 - RNA, 21 nt, Homo sapiens
gggacgcacagugcaguugag

SEQ ID NO: 688324 - RNA, 14 nt, Homo sapiens
gggacuaacccaau

SEQ ID NO: 688325 - RNA, 22 nt, Homo sapiens
gggacuauuuugcaugcugaaa

SEQ ID NO: 688326 - RNA, 18 nt, Homo sapiens
gggacuggcugggcugcu

SEQ ID NO: 688327 - RNA, 16 nt, Homo sapiens
gggacugggagucaga

SEQ ID NO: 688328 - RNA, 12 nt, Homo sapiens
gggagaaaaaga

SEQ ID NO: 688329 - RNA, 15 nt, Homo sapiens
gggagaagagcccug

SEQ ID NO: 688330 - RNA, 13 nt, Homo sapiens
gggagaaggcagu

SEQ ID NO: 688331 - RNA, 21 nt, Homo sapiens
gggagaccccuuguugcacug

SEQ ID NO: 688332 - RNA, 19 nt, Homo sapiens
gggagacugggcugaggga

SEQ ID NO: 688333 - RNA, 19 nt, Homo sapiens
gggagagcgaaggggguca

SEQ ID NO: 688334 - RNA, 13 nt, Homo sapiens
gggagagucucac

SEQ ID NO: 688335 - RNA, 21 nt, Homo sapiens
gggagauucuggguuugccca

SEQ ID NO: 688336 - RNA, 21 nt, Homo sapiens
gggagauuuuuuugagucaaa

SEQ ID NO: 688337 - RNA, 19 nt, Homo sapiens
gggagcacuguucacauca

SEQ ID NO: 688338 - RNA, 19 nt, Homo sapiens
gggagcagagagagccaga

SEQ ID NO: 688339 - RNA, 13 nt, Homo sapiens
gggagcagugucu

SEQ ID NO: 688340 - RNA, 16 nt, Homo sapiens
gggagcccagugaagc

SEQ ID NO: 688341 - RNA, 17 nt, Homo sapiens
gggagcccccaccacaa

SEQ ID NO: 688342 - RNA, 13 nt, Homo sapiens
gggagcugccaag

SEQ ID NO: 688343 - RNA, 17 nt, Homo sapiens
gggaggaggaagccguu

SEQ ID NO: 688344 - RNA, 20 nt, Homo sapiens
gggaggcagaguuugccuuc

SEQ ID NO: 688345 - RNA, 20 nt, Homo sapiens
gggaggcggagguugcaaug

SEQ ID NO: 688346 - RNA, 20 nt, Homo sapiens
gggaggcggagguugcagug

SEQ ID NO: 688347 - RNA, 14 nt, Homo sapiens
gggaggggguccug

SEQ ID NO: 688348 - RNA, 20 nt, Homo sapiens
gggaggucaaggcugcagug

SEQ ID NO: 688349 - RNA, 20 nt, Homo sapiens
gggagguggagguugcagug

SEQ ID NO: 688350 - RNA, 15 nt, Homo sapiens
gggaggugggguaca

SEQ ID NO: 688351 - RNA, 12 nt, Homo sapiens
gggagucugggc

SEQ ID NO: 688352 - RNA, 21 nt, Homo sapiens
gggagugugaguuuugccuuu

SEQ ID NO: 688353 - RNA, 15 nt, Homo sapiens
gggagugugucugcu

SEQ ID NO: 688354 - RNA, 18 nt, Homo sapiens
gggaguuguuaugccaug

SEQ ID NO: 688355 - RNA, 18 nt, Homo sapiens
gggauauggcugcccagg

SEQ ID NO: 688356 - RNA, 15 nt, Homo sapiens
gggaucacagcguuu

SEQ ID NO: 688357 - RNA, 23 nt, Homo sapiens
gggaucagaguucccaagaaagg

SEQ ID NO: 688358 - RNA, 17 nt, Homo sapiens
gggaucucaggggcugu

SEQ ID NO: 688359 - RNA, 13 nt, Homo sapiens
gggaucugaugaa

SEQ ID NO: 688360 - RNA, 18 nt, Homo sapiens
gggaucuggcacacuccc

SEQ ID NO: 688361 - RNA, 18 nt, Homo sapiens
gggaugccaauuuccucu

SEQ ID NO: 688362 - RNA, 20 nt, Homo sapiens
gggaugcugggcugggcccu

SEQ ID NO: 688363 - RNA, 14 nt, Homo sapiens
gggaugcugugagc

SEQ ID NO: 688364 - RNA, 13 nt, Homo sapiens
gggaugcuugccu

SEQ ID NO: 688365 - RNA, 22 nt, Homo sapiens
gggaugggcucccacccucccc

SEQ ID NO: 688366 - RNA, 14 nt, Homo sapiens
gggaugggcucgcu

SEQ ID NO: 688367 - RNA, 23 nt, Homo sapiens
gggauuacaggcgugagccacug

SEQ ID NO: 688368 - RNA, 17 nt, Homo sapiens
gggauugcuuugcauua

SEQ ID NO: 688369 - RNA, 18 nt, Homo sapiens
gggauugucccuguguug

SEQ ID NO: 688370 - RNA, 19 nt, Homo sapiens
gggauuuagagauacuguu

SEQ ID NO: 688371 - RNA, 22 nt, Homo sapiens
gggauuucucccucucagugga

SEQ ID NO: 688372 - RNA, 23 nt, Homo sapiens
gggcaaaagacgggaagcaagau

SEQ ID NO: 688373 - RNA, 22 nt, Homo sapiens
gggcaaaugaauuucaugugaa

SEQ ID NO: 688374 - RNA, 17 nt, Homo sapiens
gggcaacagagcaagau

SEQ ID NO: 688375 - RNA, 16 nt, Homo sapiens
gggcaagucccugacu

SEQ ID NO: 688376 - RNA, 13 nt, Homo sapiens
gggcaaucuuugc

SEQ ID NO: 688377 - RNA, 12 nt, Homo sapiens
gggcaauggauu

SEQ ID NO: 688378 - RNA, 18 nt, Homo sapiens
gggcacaaacugcagcug

SEQ ID NO: 688379 - RNA, 15 nt, Homo sapiens
gggcacaguccagga

SEQ ID NO: 688380 - RNA, 23 nt, Homo sapiens
gggcacccaaaacucaagcaaga

SEQ ID NO: 688381 - RNA, 21 nt, Homo sapiens
gggcacgguggcucaugccug

SEQ ID NO: 688382 - RNA, 18 nt, Homo sapiens
gggcacugaggaccagcc

SEQ ID NO: 688383 - RNA, 15 nt, Homo sapiens
gggcacuuucauccu

SEQ ID NO: 688384 - RNA, 20 nt, Homo sapiens
gggcagaaauuugauuugaa

SEQ ID NO: 688385 - RNA, 21 nt, Homo sapiens
gggcagaauaaauaagcaaaa

SEQ ID NO: 688386 - RNA, 23 nt, Homo sapiens
gggcagaguuucugcaguuccau

SEQ ID NO: 688387 - RNA, 19 nt, Homo sapiens
gggcaggaacagaggguga

SEQ ID NO: 688388 - RNA, 14 nt, Homo sapiens
gggcaggaccaaug

SEQ ID NO: 688389 - RNA, 17 nt, Homo sapiens
gggcaggccagggcagu

SEQ ID NO: 688390 - RNA, 16 nt, Homo sapiens
gggcaggcugggccau

SEQ ID NO: 688391 - RNA, 20 nt, Homo sapiens
gggcaggguggggagggagc

SEQ ID NO: 688392 - RNA, 15 nt, Homo sapiens
gggcagguccuaguc

SEQ ID NO: 688393 - RNA, 14 nt, Homo sapiens
gggcagugcccaug

SEQ ID NO: 688394 - RNA, 11 nt, Homo sapiens
gggcaucuccu

SEQ ID NO: 688395 - RNA, 17 nt, Homo sapiens
gggcaugccacccucac

SEQ ID NO: 688396 - RNA, 22 nt, Homo sapiens
gggcaugcuggggcaagucccu

SEQ ID NO: 688397 - RNA, 23 nt, Homo sapiens
gggcauguccuuuccaucugucc

SEQ ID NO: 688398 - RNA, 14 nt, Homo sapiens
gggccaagcccagg

SEQ ID NO: 688399 - RNA, 20 nt, Homo sapiens
gggccacaccugagcgcugu

SEQ ID NO: 688400 - RNA, 16 nt, Homo sapiens
gggccacaugggucca

SEQ ID NO: 688401 - RNA, 18 nt, Homo sapiens
gggccacauggguccacu

SEQ ID NO: 688402 - RNA, 14 nt, Homo sapiens
gggccacccagcca

SEQ ID NO: 688403 - RNA, 12 nt, Homo sapiens
gggccaccuccu

SEQ ID NO: 688404 - RNA, 16 nt, Homo sapiens
gggccaccuccuaccc

SEQ ID NO: 688405 - RNA, 23 nt, Homo sapiens
gggccagcuuuuccucaccagga

SEQ ID NO: 688406 - RNA, 17 nt, Homo sapiens
gggccaggggugggagc

SEQ ID NO: 688407 - RNA, 24 nt, Homo sapiens
gggccaugcagaccucaugcccag

SEQ ID NO: 688408 - RNA, 20 nt, Homo sapiens
gggggcacagcugucugcca

SEQ ID NO: 688409 - RNA, 20 nt, Homo sapiens
gggggccaggcgguggcuuc

SEQ ID NO: 688410 - RNA, 21 nt, Homo sapiens
gggggcggggaguauugaaug

SEQ ID NO: 688411 - RNA, 16 nt, Homo sapiens
gggggcugucuuugca

SEQ ID NO: 688412 - RNA, 14 nt, Homo sapiens
gggggcugugccaa

SEQ ID NO: 688413 - RNA, 13 nt, Homo sapiens
ggggguuccguga

SEQ ID NO: 688414 - RNA, 16 nt, Homo sapiens
ggggguuucaccuggg

SEQ ID NO: 688415 - RNA, 23 nt, Homo sapiens
gggguaccuuaagagacacucca

SEQ ID NO: 688416 - RNA, 15 nt, Homo sapiens
gggguccacugugag

SEQ ID NO: 688417 - RNA, 14 nt, Homo sapiens
ggggucguuugcuu

SEQ ID NO: 688418 - RNA, 18 nt, Homo sapiens
ggggucuccuauacucua

SEQ ID NO: 688419 - RNA, 18 nt, Homo sapiens
gggguggugggaaccaug

SEQ ID NO: 688420 - RNA, 12 nt, Homo sapiens
gggguuccucaa

SEQ ID NO: 688421 - RNA, 16 nt, Homo sapiens
gggguuggacaucucu

SEQ ID NO: 688422 - RNA, 17 nt, Homo sapiens
gggguuucuggggucca

SEQ ID NO: 688423 - RNA, 20 nt, Homo sapiens
ggguaacugggguugagggc

SEQ ID NO: 688424 - RNA, 22 nt, Homo sapiens
ggguaauccaggcacagcugag

SEQ ID NO: 688425 - RNA, 15 nt, Homo sapiens
ggguacagaugugcu

SEQ ID NO: 688426 - RNA, 17 nt, Homo sapiens
ggguacagaugugcugu

SEQ ID NO: 688427 - RNA, 23 nt, Homo sapiens
ggguaccuaguccccagccugcu

SEQ ID NO: 688428 - RNA, 23 nt, Homo sapiens
ggguaccuucaggcagccagugu

SEQ ID NO: 688429 - RNA, 21 nt, Homo sapiens
ggguaggcugucugugccaug

SEQ ID NO: 688430 - RNA, 13 nt, Homo sapiens
gggucaacaucuu

SEQ ID NO: 688431 - RNA, 22 nt, Homo sapiens
gggucaaguacaccagccaccu

SEQ ID NO: 688432 - RNA, 16 nt, Homo sapiens
gggucagccauuuuua

SEQ ID NO: 688433 - RNA, 17 nt, Homo sapiens
ggguccaucucagagaa

SEQ ID NO: 688434 - RNA, 16 nt, Homo sapiens
gggucccagggcugca

SEQ ID NO: 688435 - RNA, 23 nt, Homo sapiens
gggucccccugcuugucuucacc

SEQ ID NO: 688436 - RNA, 10 nt, Homo sapiens
gggucccugu

SEQ ID NO: 688437 - RNA, 15 nt, Homo sapiens
ggguccuugguguga

SEQ ID NO: 688438 - RNA, 19 nt, Homo sapiens
ggguccuuuugacacugcu

SEQ ID NO: 688439 - RNA, 14 nt, Homo sapiens
gggucuccuuggcu

SEQ ID NO: 688440 - RNA, 19 nt, Homo sapiens
gggucucgcuuuguugccc

SEQ ID NO: 688441 - RNA, 21 nt, Homo sapiens
gggucucgcuuuguugcccag

SEQ ID NO: 688442 - RNA, 16 nt, Homo sapiens
gggucugagacugaaa

SEQ ID NO: 688443 - RNA, 20 nt, Homo sapiens
gggucuggcuguguggccaa

SEQ ID NO: 688444 - RNA, 16 nt, Homo sapiens
gggucugggccagugc

SEQ ID NO: 688445 - RNA, 23 nt, Homo sapiens
gggucugggcugggcaccugacu

SEQ ID NO: 688446 - RNA, 21 nt, Homo sapiens
gggucuugcuauauugcccag

SEQ ID NO: 688447 - RNA, 20 nt, Homo sapiens
gggucuugcuauguugccca

SEQ ID NO: 688448 - RNA, 11 nt, Homo sapiens
gggucuuggcc

SEQ ID NO: 688449 - RNA, 20 nt, Homo sapiens
gggucuuggggacuaaccca

SEQ ID NO: 688450 - RNA, 12 nt, Homo sapiens
gggucuuugugg

SEQ ID NO: 688451 - RNA, 21 nt, Homo sapiens
guaaauauucuacacauguaa

SEQ ID NO: 688452 - RNA, 17 nt, Homo sapiens
guaaauauucuugucca

SEQ ID NO: 688453 - RNA, 21 nt, Homo sapiens
guaaauauuuguuacuuuuag

SEQ ID NO: 688454 - RNA, 17 nt, Homo sapiens
guaaaucaaauuugaau

SEQ ID NO: 688455 - RNA, 21 nt, Homo sapiens
guaaaucauauuuuagcugca

SEQ ID NO: 688456 - RNA, 20 nt, Homo sapiens
guaaaugggggugcauuuga

SEQ ID NO: 688457 - RNA, 21 nt, Homo sapiens
guaaaugguguacauaaugua

SEQ ID NO: 688458 - RNA, 22 nt, Homo sapiens
guaaauugacguacuugcaguu

SEQ ID NO: 688459 - RNA, 23 nt, Homo sapiens
guaaauugcaaauaaaccacuuu

SEQ ID NO: 688460 - RNA, 21 nt, Homo sapiens
guaacaaaaauaaaaacucuu

SEQ ID NO: 688461 - RNA, 14 nt, Homo sapiens
guaacaacuguggu

SEQ ID NO: 688462 - RNA, 20 nt, Homo sapiens
guaacaauuguguagccuuu

SEQ ID NO: 688463 - RNA, 15 nt, Homo sapiens
guaacacauccacau

SEQ ID NO: 688464 - RNA, 23 nt, Homo sapiens
guaacagcauuaacugucuuaaa

SEQ ID NO: 688465 - RNA, 16 nt, Homo sapiens
guaacaguucauguuu

SEQ ID NO: 688466 - RNA, 15 nt, Homo sapiens
guaacaucagccauu

SEQ ID NO: 688467 - RNA, 18 nt, Homo sapiens
guaacaucauaauuacau

SEQ ID NO: 688468 - RNA, 15 nt, Homo sapiens
guaacauuugccuua

SEQ ID NO: 688469 - RNA, 15 nt, Homo sapiens
guaacccucacccac

SEQ ID NO: 688470 - RNA, 23 nt, Homo sapiens
guaacuaaaacuuuucaguucua

SEQ ID NO: 688471 - RNA, 14 nt, Homo sapiens
guaacuacugcuaa

SEQ ID NO: 688472 - RNA, 20 nt, Homo sapiens
guaacuauuaaaccauacua

SEQ ID NO: 688473 - RNA, 17 nt, Homo sapiens
guaacuccccucaggga

SEQ ID NO: 688474 - RNA, 17 nt, Homo sapiens
guaacucuuucugagga

SEQ ID NO: 688475 - RNA, 14 nt, Homo sapiens
guaacugcaccugg

SEQ ID NO: 688476 - RNA, 20 nt, Homo sapiens
guaacugucucagaaccacu

SEQ ID NO: 688477 - RNA, 16 nt, Homo sapiens
guaacuuacaccugga

SEQ ID NO: 688478 - RNA, 22 nt, Homo sapiens
guaacuugcaaugggcagcuau

SEQ ID NO: 688479 - RNA, 21 nt, Homo sapiens
guaacuuuuuuucaguucaua

SEQ ID NO: 688480 - RNA, 17 nt, Homo sapiens
guaagaaaaaucugcua

SEQ ID NO: 688481 - RNA, 17 nt, Homo sapiens
guaagaaggcaauauua

SEQ ID NO: 688482 - RNA, 21 nt, Homo sapiens
guaagacccuuauugcugucc

SEQ ID NO: 688483 - RNA, 15 nt, Homo sapiens
guaagaugacucuga

SEQ ID NO: 688484 - RNA, 20 nt, Homo sapiens
guaagauguccuccuugaua

SEQ ID NO: 688485 - RNA, 14 nt, Homo sapiens
guaagcaacuugcu

SEQ ID NO: 688486 - RNA, 22 nt, Homo sapiens
guaagcucuacugaggugcuau

SEQ ID NO: 688487 - RNA, 19 nt, Homo sapiens
guaagcugcucuauuguag

SEQ ID NO: 688488 - RNA, 14 nt, Homo sapiens
guaagucauuuaac

SEQ ID NO: 688489 - RNA, 14 nt, Homo sapiens
guaaguuucuuccu

SEQ ID NO: 688490 - RNA, 14 nt, Homo sapiens
guaccgucuucucc

SEQ ID NO: 688491 - RNA, 18 nt, Homo sapiens
guaccugguccccacugc

SEQ ID NO: 688492 - RNA, 17 nt, Homo sapiens
guaccuucccacuggcc

SEQ ID NO: 688493 - RNA, 18 nt, Homo sapiens
guaccuucccacuggccu

SEQ ID NO: 688494 - RNA, 20 nt, Homo sapiens
guacuaacuagcauuguaaa

SEQ ID NO: 688495 - RNA, 18 nt, Homo sapiens
guacuacggagaaacuca

SEQ ID NO: 688496 - RNA, 15 nt, Homo sapiens
guacuaguccaucau

SEQ ID NO: 688497 - RNA, 17 nt, Homo sapiens
guacuaguucagacacu

SEQ ID NO: 688498 - RNA, 12 nt, Homo sapiens
guacucaaugga

SEQ ID NO: 688499 - RNA, 15 nt, Homo sapiens
guacucguuggaugu

SEQ ID NO: 688500 - RNA, 17 nt, Homo sapiens
guacucuaaucaguccu

SEQ ID NO: 688501 - RNA, 19 nt, Homo sapiens
guacucuuuagaucuccca

SEQ ID NO: 688502 - RNA, 17 nt, Homo sapiens
guacugacuuugcuugc

SEQ ID NO: 688503 - RNA, 22 nt, Homo sapiens
guacugcacccagcagugucac

SEQ ID NO: 688504 - RNA, 13 nt, Homo sapiens
guacugcauguga

SEQ ID NO: 688505 - RNA, 17 nt, Homo sapiens
guacugcugucuuccaa

SEQ ID NO: 688506 - RNA, 19 nt, Homo sapiens
guacuguuuuccaguucau

SEQ ID NO: 688507 - RNA, 21 nt, Homo sapiens
guacuguuuuuaauguucaca

SEQ ID NO: 688508 - RNA, 14 nt, Homo sapiens
guacuuauguugca

SEQ ID NO: 688509 - RNA, 17 nt, Homo sapiens
guacuuauuacugcuaa

SEQ ID NO: 688510 - RNA, 20 nt, Homo sapiens
guacuuguagaguggugcug

SEQ ID NO: 688511 - RNA, 14 nt, Homo sapiens
guacuuguuugcaa

SEQ ID NO: 688512 - RNA, 22 nt, Homo sapiens
guacuuugaguauaacaucaag

SEQ ID NO: 688513 - RNA, 22 nt, Homo sapiens
guacuuuuucuaccuguacaca

SEQ ID NO: 688514 - RNA, 15 nt, Homo sapiens
guagaaaaauuauua

SEQ ID NO: 688515 - RNA, 20 nt, Homo sapiens
guagaaaagaaaacauuuaa

SEQ ID NO: 688516 - RNA, 19 nt, Homo sapiens
guagaaaagggaacugaac

SEQ ID NO: 688517 - RNA, 23 nt, Homo sapiens
guagaaagauccuucgggugcug

SEQ ID NO: 688518 - RNA, 14 nt, Homo sapiens
guagaaagccaaau

SEQ ID NO: 688519 - RNA, 21 nt, Homo sapiens
guagaaaggucauccaaagaa

SEQ ID NO: 688520 - RNA, 22 nt, Homo sapiens
guagaacucacucugggcugua

SEQ ID NO: 688521 - RNA, 12 nt, Homo sapiens
guagaagccagu

SEQ ID NO: 688522 - RNA, 22 nt, Homo sapiens
guagaaggggaggacacuggug

SEQ ID NO: 688523 - RNA, 19 nt, Homo sapiens
guagacaagcaagugcaca

SEQ ID NO: 688524 - RNA, 18 nt, Homo sapiens
guagaccaaaucuuguua

SEQ ID NO: 688525 - RNA, 20 nt, Homo sapiens
guagaccucuuuuucuuacc

SEQ ID NO: 688526 - RNA, 18 nt, Homo sapiens
guagacucauucuucaca

SEQ ID NO: 688527 - RNA, 14 nt, Homo sapiens
gugagaucaugcca

SEQ ID NO: 688528 - RNA, 14 nt, Homo sapiens
gugagaugagggau

SEQ ID NO: 688529 - RNA, 13 nt, Homo sapiens
gugagauguaauu

SEQ ID NO: 688530 - RNA, 20 nt, Homo sapiens
gugagcagagauguacugca

SEQ ID NO: 688531 - RNA, 21 nt, Homo sapiens
gugagcagggucaagccucuu

SEQ ID NO: 688532 - RNA, 14 nt, Homo sapiens
gugagcaguggaca

SEQ ID NO: 688533 - RNA, 20 nt, Homo sapiens
gugagcauggaacacuucga

SEQ ID NO: 688534 - RNA, 21 nt, Homo sapiens
gugagccaagaaacacugccu

SEQ ID NO: 688535 - RNA, 15 nt, Homo sapiens
gugagcugagauugc

SEQ ID NO: 688536 - RNA, 22 nt, Homo sapiens
gugagcuggauagacuugggau

SEQ ID NO: 688537 - RNA, 20 nt, Homo sapiens
gugaggaacccugaucucuc

SEQ ID NO: 688538 - RNA, 16 nt, Homo sapiens
gugaggaagaacuaca

SEQ ID NO: 688539 - RNA, 21 nt, Homo sapiens
gugaggacucggccacugugu

SEQ ID NO: 688540 - RNA, 17 nt, Homo sapiens
gugaggcccauucuuca

SEQ ID NO: 688541 - RNA, 19 nt, Homo sapiens
gugaggcuccggauguuuc

SEQ ID NO: 688542 - RNA, 14 nt, Homo sapiens
gugaggcuguaaag

SEQ ID NO: 688543 - RNA, 12 nt, Homo sapiens
gugaggggcccu

SEQ ID NO: 688544 - RNA, 16 nt, Homo sapiens
gugagugagacucugc

SEQ ID NO: 688545 - RNA, 16 nt, Homo sapiens
gugauacaaauugaua

SEQ ID NO: 688546 - RNA, 13 nt, Homo sapiens
gugauacccaagu

SEQ ID NO: 688547 - RNA, 19 nt, Homo sapiens
gugauauacugguucacau

SEQ ID NO: 688548 - RNA, 16 nt, Homo sapiens
gugauauauaauuucc

SEQ ID NO: 688549 - RNA, 15 nt, Homo sapiens
gugauauaugcaugu

SEQ ID NO: 688550 - RNA, 15 nt, Homo sapiens
gugauauaugccuau

SEQ ID NO: 688551 - RNA, 14 nt, Homo sapiens
gugauaucaccucu

SEQ ID NO: 688552 - RNA, 21 nt, Homo sapiens
gugauauuuucacacugguaa

SEQ ID NO: 688553 - RNA, 17 nt, Homo sapiens
gugaucacugagccauc

SEQ ID NO: 688554 - RNA, 16 nt, Homo sapiens
gugauccgccuaccuc

SEQ ID NO: 688555 - RNA, 22 nt, Homo sapiens
gugaugacuuagcgucaagaca

SEQ ID NO: 688556 - RNA, 18 nt, Homo sapiens
gugaugaugcugugacaa

SEQ ID NO: 688557 - RNA, 13 nt, Homo sapiens
gugauggggcaag

SEQ ID NO: 688558 - RNA, 18 nt, Homo sapiens
gugauguuuugaaugugg

SEQ ID NO: 688559 - RNA, 20 nt, Homo sapiens
gugauuacauaaucuguaca

SEQ ID NO: 688560 - RNA, 24 nt, Homo sapiens
gugauuacauagaucagccauuaa

SEQ ID NO: 688561 - RNA, 23 nt, Homo sapiens
gugauucccuccugcuacucugu

SEQ ID NO: 688562 - RNA, 21 nt, Homo sapiens
gugauucuguuuauucuucca

SEQ ID NO: 688563 - RNA, 16 nt, Homo sapiens
gugauucuguuugccu

SEQ ID NO: 688564 - RNA, 18 nt, Homo sapiens
gugauucuuccaccucag

SEQ ID NO: 688565 - RNA, 23 nt, Homo sapiens
gugauugacagcuuugcugcuga

SEQ ID NO: 688566 - RNA, 15 nt, Homo sapiens
gugauuggugcugag

SEQ ID NO: 688567 - RNA, 19 nt, Homo sapiens
gugauuucaccccacagac

SEQ ID NO: 688568 - RNA, 15 nt, Homo sapiens
gugauuucagagagg

SEQ ID NO: 688569 - RNA, 18 nt, Homo sapiens
gugauuucuuucuuugca

SEQ ID NO: 688570 - RNA, 14 nt, Homo sapiens
gugcaaaaucuguu

SEQ ID NO: 688571 - RNA, 21 nt, Homo sapiens
gugcaaacgccuagauugcuu

SEQ ID NO: 688572 - RNA, 23 nt, Homo sapiens
gugcaaggaccuaaaacaucuca

SEQ ID NO: 688573 - RNA, 20 nt, Homo sapiens
gugcaagugucugugugcaa

SEQ ID NO: 688574 - RNA, 16 nt, Homo sapiens
gugcaagugugugcac

SEQ ID NO: 688575 - RNA, 17 nt, Homo sapiens
gugcaagugugugcaca

SEQ ID NO: 688576 - RNA, 17 nt, Homo sapiens
gugcaagugugugcaug

SEQ ID NO: 688577 - RNA, 17 nt, Homo sapiens
gugcaaucacagcucac

SEQ ID NO: 688578 - RNA, 21 nt, Homo sapiens
gugcaaucacagcucacugca

SEQ ID NO: 688579 - RNA, 14 nt, Homo sapiens
gugcacacauauac

SEQ ID NO: 688580 - RNA, 19 nt, Homo sapiens
gugcacacguguguaugag

SEQ ID NO: 688581 - RNA, 15 nt, Homo sapiens
gugcaccugggagaa

SEQ ID NO: 688582 - RNA, 15 nt, Homo sapiens
gugcacuagcauuuu

SEQ ID NO: 688583 - RNA, 18 nt, Homo sapiens
gugcacugcuuugggauu

SEQ ID NO: 688584 - RNA, 17 nt, Homo sapiens
gugcacugucacuuugc

SEQ ID NO: 688585 - RNA, 14 nt, Homo sapiens
gugcagacaggcug

SEQ ID NO: 688586 - RNA, 21 nt, Homo sapiens
gugcagagaugacuguccaag

SEQ ID NO: 688587 - RNA, 19 nt, Homo sapiens
gugcagaugguacugcuga

SEQ ID NO: 688588 - RNA, 17 nt, Homo sapiens
gugcagccacacacaga

SEQ ID NO: 688589 - RNA, 23 nt, Homo sapiens
gugcagcgcagcuggacucugca

SEQ ID NO: 688590 - RNA, 17 nt, Homo sapiens
gugcagcuucgaggaca

SEQ ID NO: 688591 - RNA, 20 nt, Homo sapiens
gugcaggggguggguguguu

SEQ ID NO: 688592 - RNA, 13 nt, Homo sapiens
gugcaguacuuaa

SEQ ID NO: 688593 - RNA, 12 nt, Homo sapiens
gugcagucacug

SEQ ID NO: 688594 - RNA, 13 nt, Homo sapiens
gugcagugauaca

SEQ ID NO: 688595 - RNA, 19 nt, Homo sapiens
gugcaguggcgcauucuag

SEQ ID NO: 688596 - RNA, 21 nt, Homo sapiens
gugcaguggcuccgaucucug

SEQ ID NO: 688597 - RNA, 20 nt, Homo sapiens
gugcaguggugcaaucacag

SEQ ID NO: 688598 - RNA, 21 nt, Homo sapiens
gugcaguugcuguuuacuuga

SEQ ID NO: 688599 - RNA, 13 nt, Homo sapiens
gugcaugaugcug

SEQ ID NO: 688600 - RNA, 17 nt, Homo sapiens
gugcaugccgggaccau

SEQ ID NO: 688601 - RNA, 15 nt, Homo sapiens
gugcauggaggcccu

SEQ ID NO: 688602 - RNA, 18 nt, Homo sapiens
gugcaugugagcacaugc

SEQ ID NO: 688603 - RNA, 16 nt, Homo sapiens
gugcaugugcacuugc

SEQ ID NO: 688604 - RNA, 18 nt, Homo sapiens
gugcaugugcgcgcgugc

SEQ ID NO: 688605 - RNA, 14 nt, Homo sapiens
gugcauuaaacaaa

SEQ ID NO: 688606 - RNA, 19 nt, Homo sapiens
gugcauuuuuaaacuugaa

SEQ ID NO: 688607 - RNA, 16 nt, Homo sapiens
gugccaaagcuuuacu

SEQ ID NO: 688608 - RNA, 16 nt, Homo sapiens
gugccaaguuccacuu

SEQ ID NO: 688609 - RNA, 17 nt, Homo sapiens
gugccacaccccaugca

SEQ ID NO: 688610 - RNA, 19 nt, Homo sapiens
gugccaccacgcccagcua

SEQ ID NO: 688611 - RNA, 14 nt, Homo sapiens
gugccacucauucc

SEQ ID NO: 688612 - RNA, 16 nt, Homo sapiens
gugccaggcuugccug

SEQ ID NO: 688613 - RNA, 17 nt, Homo sapiens
gugccaguggcuuauua

SEQ ID NO: 688614 - RNA, 21 nt, Homo sapiens
gugccaguucuuuccauaaua

SEQ ID NO: 688615 - RNA, 14 nt, Homo sapiens
gugccaugcccaag

SEQ ID NO: 688616 - RNA, 22 nt, Homo sapiens
gugccauggccccccacucccc

SEQ ID NO: 688617 - RNA, 19 nt, Homo sapiens
gugccauuacuacuguaca

SEQ ID NO: 688618 - RNA, 14 nt, Homo sapiens
gugccauuccacuc

SEQ ID NO: 688619 - RNA, 23 nt, Homo sapiens
gugcccaaacaccagucaccucg

SEQ ID NO: 688620 - RNA, 18 nt, Homo sapiens
gugcccaccgcccuccuc

SEQ ID NO: 688621 - RNA, 21 nt, Homo sapiens
gugcccaggggcccacaggga

SEQ ID NO: 688622 - RNA, 12 nt, Homo sapiens
gugcccaucagc

SEQ ID NO: 688623 - RNA, 20 nt, Homo sapiens
gugccccacaaaacuucagu

SEQ ID NO: 688624 - RNA, 18 nt, Homo sapiens
gugcccccaggcucucau

SEQ ID NO: 688625 - RNA, 18 nt, Homo sapiens
gugccccccuccuccagu

SEQ ID NO: 688626 - RNA, 14 nt, Homo sapiens
gugcccuacucauu

SEQ ID NO: 688627 - RNA, 15 nt, Homo sapiens
gugcccuccaaagag

SEQ ID NO: 688628 - RNA, 13 nt, Homo sapiens
gugcccucucagg

SEQ ID NO: 688629 - RNA, 15 nt, Homo sapiens
gugcccugagacaga

SEQ ID NO: 688630 - RNA, 13 nt, Homo sapiens
gugcccugcaaau

SEQ ID NO: 688631 - RNA, 21 nt, Homo sapiens
gugcccuuuucauauacuuau

SEQ ID NO: 688632 - RNA, 15 nt, Homo sapiens
gugccgaaugugcag

SEQ ID NO: 688633 - RNA, 19 nt, Homo sapiens
gugccuccuagagugcagg

SEQ ID NO: 688634 - RNA, 20 nt, Homo sapiens
gugccuccuuccaccucccu

SEQ ID NO: 688635 - RNA, 22 nt, Homo sapiens
gugccucugggacuggacaauu

SEQ ID NO: 688636 - RNA, 23 nt, Homo sapiens
gugccugacacauagaaaacaau

SEQ ID NO: 688637 - RNA, 17 nt, Homo sapiens
gugccugcucagcagcc

SEQ ID NO: 688638 - RNA, 14 nt, Homo sapiens
gugccuuccauaau

SEQ ID NO: 688639 - RNA, 18 nt, Homo sapiens
gugccuugugcaauguga

SEQ ID NO: 688640 - RNA, 17 nt, Homo sapiens
gugccuuugaccaucuc

SEQ ID NO: 688641 - RNA, 14 nt, Homo sapiens
gugccuuuugcaga

SEQ ID NO: 688642 - RNA, 19 nt, Homo sapiens
gugcgcgccaccgugccug

SEQ ID NO: 688643 - RNA, 16 nt, Homo sapiens
gugcgugcaugugcac

SEQ ID NO: 688644 - RNA, 21 nt, Homo sapiens
gugcuaaagccaaccagccuu

SEQ ID NO: 688645 - RNA, 13 nt, Homo sapiens
gugcuacaauuca

SEQ ID NO: 688646 - RNA, 14 nt, Homo sapiens
gugcuacaugaugc

SEQ ID NO: 688647 - RNA, 15 nt, Homo sapiens
gugcuagaugugcaa

SEQ ID NO: 688648 - RNA, 21 nt, Homo sapiens
gugcuaugaauuuucaaguaa

SEQ ID NO: 688649 - RNA, 17 nt, Homo sapiens
gugcucaauagcuugaa

SEQ ID NO: 688650 - RNA, 13 nt, Homo sapiens
gugcucaccagcc

SEQ ID NO: 688651 - RNA, 15 nt, Homo sapiens
gugcucacugaccug

SEQ ID NO: 688652 - RNA, 22 nt, Homo sapiens
gugcucauacguaucugcucau

SEQ ID NO: 688653 - RNA, 13 nt, Homo sapiens
gugcucauuuaag

SEQ ID NO: 688654 - RNA, 21 nt, Homo sapiens
gugcuccucucgcacaaugca

SEQ ID NO: 688655 - RNA, 16 nt, Homo sapiens
gugcucgaccuugaua

SEQ ID NO: 688656 - RNA, 22 nt, Homo sapiens
gugcucucagcuggcagugcaa

SEQ ID NO: 688657 - RNA, 20 nt, Homo sapiens
gugcucucugccacuggaag

SEQ ID NO: 688658 - RNA, 13 nt, Homo sapiens
gugcucugacccu

SEQ ID NO: 688659 - RNA, 15 nt, Homo sapiens
gugcucugaggucaa

SEQ ID NO: 688660 - RNA, 22 nt, Homo sapiens
gugcucuugaaccugugcucau

SEQ ID NO: 688661 - RNA, 17 nt, Homo sapiens
gugcugaguguacagag

SEQ ID NO: 688662 - RNA, 19 nt, Homo sapiens
gugcugcagccaaagacag

SEQ ID NO: 688663 - RNA, 14 nt, Homo sapiens
gugcugccauuuga

SEQ ID NO: 688664 - RNA, 15 nt, Homo sapiens
gugcugcucuaagca

SEQ ID NO: 688665 - RNA, 19 nt, Homo sapiens
gugcuggagcaaaagucau

SEQ ID NO: 688666 - RNA, 11 nt, Homo sapiens
gugcugggaug

SEQ ID NO: 688667 - RNA, 11 nt, Homo sapiens
gugcugggauu

SEQ ID NO: 688668 - RNA, 18 nt, Homo sapiens
gugcugggauuacaggca

SEQ ID NO: 688669 - RNA, 19 nt, Homo sapiens
gugcugggauuacagggau

SEQ ID NO: 688670 - RNA, 16 nt, Homo sapiens
gugcugggcauuuuua

SEQ ID NO: 688671 - RNA, 13 nt, Homo sapiens
gugcugugacucg

SEQ ID NO: 688672 - RNA, 21 nt, Homo sapiens
gugcuguggagagaagcugau

SEQ ID NO: 688673 - RNA, 18 nt, Homo sapiens
gugcuguggccugggcaa

SEQ ID NO: 688674 - RNA, 15 nt, Homo sapiens
gugcuguuguucucg

SEQ ID NO: 688675 - RNA, 15 nt, Homo sapiens
gugcuucacaguaga

SEQ ID NO: 688676 - RNA, 18 nt, Homo sapiens
gugcuuccaacaaggaca

SEQ ID NO: 688677 - RNA, 17 nt, Homo sapiens
gugcuucgacuacugcu

SEQ ID NO: 688678 - RNA, 14 nt, Homo sapiens
gugcuucuucacuu

SEQ ID NO: 688679 - RNA, 19 nt, Homo sapiens
gugcuuggucuguuugacu

SEQ ID NO: 688680 - RNA, 21 nt, Homo sapiens
gugcuuuccguggcacugcau

SEQ ID NO: 688681 - RNA, 17 nt, Homo sapiens
gugcuuugcauguauua

SEQ ID NO: 688682 - RNA, 21 nt, Homo sapiens
gugcuuuuugggaccaucacu

SEQ ID NO: 688683 - RNA, 15 nt, Homo sapiens
guggaaaaugcaaug

SEQ ID NO: 688684 - RNA, 18 nt, Homo sapiens
guggaaagugaauuugaa

SEQ ID NO: 688685 - RNA, 23 nt, Homo sapiens
guggaauauaaggaaagcaauaa

SEQ ID NO: 688686 - RNA, 23 nt, Homo sapiens
guggaaugcaguccucaucucca

SEQ ID NO: 688687 - RNA, 14 nt, Homo sapiens
guggagacaguccu

SEQ ID NO: 688688 - RNA, 13 nt, Homo sapiens
guggagagugcac

SEQ ID NO: 688689 - RNA, 16 nt, Homo sapiens
guggagauagugccag

SEQ ID NO: 688690 - RNA, 18 nt, Homo sapiens
guggagauuuacacuaca

SEQ ID NO: 688691 - RNA, 22 nt, Homo sapiens
guggaggguggggggcgcugag

SEQ ID NO: 688692 - RNA, 13 nt, Homo sapiens
guggagguugcua

SEQ ID NO: 688693 - RNA, 13 nt, Homo sapiens
guggagugucaca

SEQ ID NO: 688694 - RNA, 15 nt, Homo sapiens
guggauagcauuguu

SEQ ID NO: 688695 - RNA, 15 nt, Homo sapiens
guggaucaagcuugu

SEQ ID NO: 688696 - RNA, 15 nt, Homo sapiens
guggaugaugcugcc

SEQ ID NO: 688697 - RNA, 19 nt, Homo sapiens
guggaugcaugugcgucac

SEQ ID NO: 688698 - RNA, 18 nt, Homo sapiens
guggaugcugagcuguga

SEQ ID NO: 688699 - RNA, 21 nt, Homo sapiens
guggauguauggggaaucuaa

SEQ ID NO: 688700 - RNA, 14 nt, Homo sapiens
guggcaacugagau

SEQ ID NO: 688701 - RNA, 16 nt, Homo sapiens
guggcaagggaugugc

SEQ ID NO: 688702 - RNA, 11 nt, Homo sapiens
guggcaauggg

SEQ ID NO: 688703 - RNA, 20 nt, Homo sapiens
guggcaugaucauagcucac

SEQ ID NO: 688704 - RNA, 13 nt, Homo sapiens
guggcauguggcc

SEQ ID NO: 688705 - RNA, 17 nt, Homo sapiens
guggccacagcgugcug

SEQ ID NO: 688706 - RNA, 13 nt, Homo sapiens
guggccaguauuu

SEQ ID NO: 688707 - RNA, 16 nt, Homo sapiens
guggcccugugccugg

SEQ ID NO: 688708 - RNA, 18 nt, Homo sapiens
guggccgaggacuuugau

SEQ ID NO: 688709 - RNA, 19 nt, Homo sapiens
guggccugcgcuagcuucu

SEQ ID NO: 688710 - RNA, 22 nt, Homo sapiens
guggccuuccccuuuugccugg

SEQ ID NO: 688711 - RNA, 22 nt, Homo sapiens
guggcgagaaauaaaguuugcu

SEQ ID NO: 688712 - RNA, 18 nt, Homo sapiens
guggcgcgggagcuggga

SEQ ID NO: 688713 - RNA, 16 nt, Homo sapiens
guggcucaacauugug

SEQ ID NO: 688714 - RNA, 14 nt, Homo sapiens
guggcucacuacug

SEQ ID NO: 688715 - RNA, 15 nt, Homo sapiens
guggcucacuacuga

SEQ ID NO: 688716 - RNA, 17 nt, Homo sapiens
guggcuccuaccagcaa

SEQ ID NO: 688717 - RNA, 16 nt, Homo sapiens
guggcucugaugcuga

SEQ ID NO: 688718 - RNA, 17 nt, Homo sapiens
guggcugccccaccugc

SEQ ID NO: 688719 - RNA, 22 nt, Homo sapiens
guggcuucaucagcugugugca

SEQ ID NO: 688720 - RNA, 19 nt, Homo sapiens
guggcuuguaucaacacug

SEQ ID NO: 688721 - RNA, 22 nt, Homo sapiens
guggcuuugcauagcuuucaca

SEQ ID NO: 688722 - RNA, 18 nt, Homo sapiens
guggcuuuuuaacaugaa

SEQ ID NO: 688723 - RNA, 23 nt, Homo sapiens
gugggaacggcugauguggacug

SEQ ID NO: 688724 - RNA, 20 nt, Homo sapiens
gugggacaauggguggugaa

SEQ ID NO: 688725 - RNA, 17 nt, Homo sapiens
gugggacacaacacaga

SEQ ID NO: 688726 - RNA, 17 nt, Homo sapiens
gugggacccuucagcca

SEQ ID NO: 688727 - RNA, 15 nt, Homo sapiens
gugggagaucuucac

SEQ ID NO: 688728 - RNA, 20 nt, Homo sapiens
gugggauacuuagugguaug

SEQ ID NO: 688729 - RNA, 19 nt, Homo sapiens
gugggaucagcccugccag

SEQ ID NO: 688730 - RNA, 18 nt, Homo sapiens
gugggauccacacugaga

SEQ ID NO: 688731 - RNA, 17 nt, Homo sapiens
gugggcaaacaggcagu

SEQ ID NO: 688732 - RNA, 17 nt, Homo sapiens
gugggcagagccuucca

SEQ ID NO: 688733 - RNA, 19 nt, Homo sapiens
gugggcagagguucauuuc

SEQ ID NO: 688734 - RNA, 15 nt, Homo sapiens
gugggccacagccau

SEQ ID NO: 688735 - RNA, 20 nt, Homo sapiens
gugggccugcugaggccuuc

SEQ ID NO: 688736 - RNA, 15 nt, Homo sapiens
guggggauuggggga

SEQ ID NO: 688737 - RNA, 19 nt, Homo sapiens
guggggccuguggaaugag

SEQ ID NO: 688738 - RNA, 21 nt, Homo sapiens
gugggguaaccaaauguuggc

SEQ ID NO: 688739 - RNA, 23 nt, Homo sapiens
gugggguacagagaugaaagagg

SEQ ID NO: 688740 - RNA, 14 nt, Homo sapiens
gugggguacauuuc

SEQ ID NO: 688741 - RNA, 20 nt, Homo sapiens
gugggguccccaucauccca

SEQ ID NO: 688742 - RNA, 18 nt, Homo sapiens
guggguacaaaaagucaa

SEQ ID NO: 688743 - RNA, 21 nt, Homo sapiens
gugggugcugcccuguguaca

SEQ ID NO: 688744 - RNA, 23 nt, Homo sapiens
gugggugggagugugucugcuga

SEQ ID NO: 688745 - RNA, 18 nt, Homo sapiens
guggguucuccuguucuc

SEQ ID NO: 688746 - RNA, 13 nt, Homo sapiens
guggguuuuacac

SEQ ID NO: 688747 - RNA, 14 nt, Homo sapiens
gugguacagcacug

SEQ ID NO: 688748 - RNA, 15 nt, Homo sapiens
gugguacuugaggga

SEQ ID NO: 688749 - RNA, 15 nt, Homo sapiens
gugguauaaucucca

SEQ ID NO: 688750 - RNA, 20 nt, Homo sapiens
gugguaugguuguauacaca

SEQ ID NO: 688751 - RNA, 16 nt, Homo sapiens
gugguaugucugccau

SEQ ID NO: 688752 - RNA, 13 nt, Homo sapiens
gugguauucuguc

SEQ ID NO: 688753 - RNA, 18 nt, Homo sapiens
guggucaaaccgcacuca

SEQ ID NO: 688754 - RNA, 18 nt, Homo sapiens
guggucagcccuaggaua

SEQ ID NO: 688755 - RNA, 24 nt, Homo sapiens
guggucaguaaauaacaggcauuu

SEQ ID NO: 688756 - RNA, 11 nt, Homo sapiens
guggucauuuc

SEQ ID NO: 688757 - RNA, 20 nt, Homo sapiens
guggucauuuccuaugcaaa

SEQ ID NO: 688758 - RNA, 14 nt, Homo sapiens
guggucgagcuuuu

SEQ ID NO: 688759 - RNA, 14 nt, Homo sapiens
guggugauguugcc

SEQ ID NO: 688760 - RNA, 16 nt, Homo sapiens
gugguggaagcaagac

SEQ ID NO: 688761 - RNA, 17 nt, Homo sapiens
guggugggacacugggc

SEQ ID NO: 688762 - RNA, 23 nt, Homo sapiens
guggugggggucagguggacucu

SEQ ID NO: 688763 - RNA, 15 nt, Homo sapiens
gugguguaauaugaa

SEQ ID NO: 688764 - RNA, 14 nt, Homo sapiens
guggugucugugaa

SEQ ID NO: 688765 - RNA, 15 nt, Homo sapiens
guggugucugugaag

SEQ ID NO: 688766 - RNA, 19 nt, Homo sapiens
gugguuacuuccuacugua

SEQ ID NO: 688767 - RNA, 20 nt, Homo sapiens
gugguucuuaaauguuuaua

SEQ ID NO: 688768 - RNA, 16 nt, Homo sapiens
guguaaaauguauauu

SEQ ID NO: 688769 - RNA, 20 nt, Homo sapiens
guguaacccccaguucaaga

SEQ ID NO: 688770 - RNA, 14 nt, Homo sapiens
guguaaguaauuau

SEQ ID NO: 688771 - RNA, 23 nt, Homo sapiens
guguaguuucuucauuucaggaa

SEQ ID NO: 688772 - RNA, 12 nt, Homo sapiens
guguauacaugu

SEQ ID NO: 688773 - RNA, 16 nt, Homo sapiens
guuuauuuagcucuga

SEQ ID NO: 688774 - RNA, 22 nt, Homo sapiens
guuuauuuagcucugaagcaag

SEQ ID NO: 688775 - RNA, 21 nt, Homo sapiens
guuuauuuuauuuucuucauu

SEQ ID NO: 688776 - RNA, 20 nt, Homo sapiens
guuuauuuuuauacuuucag

SEQ ID NO: 688777 - RNA, 23 nt, Homo sapiens
guuucaaaaaaucugaccaaaac

SEQ ID NO: 688778 - RNA, 14 nt, Homo sapiens
guuucaaaccagga

SEQ ID NO: 688779 - RNA, 17 nt, Homo sapiens
guuucaacugugcucuu

SEQ ID NO: 688780 - RNA, 23 nt, Homo sapiens
guuucaaguuauucaaauuugua

SEQ ID NO: 688781 - RNA, 17 nt, Homo sapiens
guuucacacuagucaca

SEQ ID NO: 688782 - RNA, 14 nt, Homo sapiens
guuucaccuuccau

SEQ ID NO: 688783 - RNA, 13 nt, Homo sapiens
guuucacugagag

SEQ ID NO: 688784 - RNA, 16 nt, Homo sapiens
guuucacuguacugca

SEQ ID NO: 688785 - RNA, 20 nt, Homo sapiens
guuucacuuuuguugcccag

SEQ ID NO: 688786 - RNA, 21 nt, Homo sapiens
guuucagcuaaaugcagggaa

SEQ ID NO: 688787 - RNA, 20 nt, Homo sapiens
guuucauauccagcugagug

SEQ ID NO: 688788 - RNA, 18 nt, Homo sapiens
guuucauaucuggucaag

SEQ ID NO: 688789 - RNA, 16 nt, Homo sapiens
guuuccacagccugca

SEQ ID NO: 688790 - RNA, 17 nt, Homo sapiens
guuucccauaauuuucu

SEQ ID NO: 688791 - RNA, 16 nt, Homo sapiens
guuuccccaucucugu

SEQ ID NO: 688792 - RNA, 23 nt, Homo sapiens
guuuccuaggaaaucacaggcuu

SEQ ID NO: 688793 - RNA, 21 nt, Homo sapiens
guuuccuauuugcaguuacuu

SEQ ID NO: 688794 - RNA, 13 nt, Homo sapiens
guuuccuccccau

SEQ ID NO: 688795 - RNA, 17 nt, Homo sapiens
guuuccugcuccagugu

SEQ ID NO: 688796 - RNA, 12 nt, Homo sapiens
guuuccugguca

SEQ ID NO: 688797 - RNA, 19 nt, Homo sapiens
guuucgaaguugaugcaau

SEQ ID NO: 688798 - RNA, 18 nt, Homo sapiens
uaaaagguugcauacuga

SEQ ID NO: 688799 - RNA, 18 nt, Homo sapiens
uaaaaguaaaggaugcuu

SEQ ID NO: 688800 - RNA, 14 nt, Homo sapiens
uaaaaguaaauuca

SEQ ID NO: 688801 - RNA, 14 nt, Homo sapiens
uaaaaguacauuaa

SEQ ID NO: 688802 - RNA, 13 nt, Homo sapiens
uaaaagucuacca

SEQ ID NO: 688803 - RNA, 15 nt, Homo sapiens
uaaaagugacucuca

SEQ ID NO: 688804 - RNA, 16 nt, Homo sapiens
uaaaagugacucucag

SEQ ID NO: 688805 - RNA, 13 nt, Homo sapiens
uaaaaguggcauu

SEQ ID NO: 688806 - RNA, 15 nt, Homo sapiens
uaaaaguugugcaug

SEQ ID NO: 688807 - RNA, 20 nt, Homo sapiens
uaaaaguuuacaacuugauu

SEQ ID NO: 688808 - RNA, 17 nt, Homo sapiens
uaaaauaaaaauucuga

SEQ ID NO: 688809 - RNA, 17 nt, Homo sapiens
uaaaauaaaaguuuaca

SEQ ID NO: 688810 - RNA, 19 nt, Homo sapiens
uaaaauaaacuagauauua

SEQ ID NO: 688811 - RNA, 21 nt, Homo sapiens
uaaaauaaagaaauagaacaa

SEQ ID NO: 688812 - RNA, 16 nt, Homo sapiens
uaaaauaagagauccu

SEQ ID NO: 688813 - RNA, 20 nt, Homo sapiens
uaaaauaagcucagugauac

SEQ ID NO: 688814 - RNA, 15 nt, Homo sapiens
uaaaauaagucugau

SEQ ID NO: 688815 - RNA, 16 nt, Homo sapiens
uaaaauaaugaacacu

SEQ ID NO: 688816 - RNA, 22 nt, Homo sapiens
uaaaauaauuauauaacuguau

SEQ ID NO: 688817 - RNA, 17 nt, Homo sapiens
uaaaauacuauucucau

SEQ ID NO: 688818 - RNA, 14 nt, Homo sapiens
uaaaauacugaaua

SEQ ID NO: 688819 - RNA, 22 nt, Homo sapiens
uaaaauagacuuacugcaguua

SEQ ID NO: 688820 - RNA, 14 nt, Homo sapiens
uaaaauauaucauc

SEQ ID NO: 688821 - RNA, 16 nt, Homo sapiens
uaauuggcccaaguca

SEQ ID NO: 688822 - RNA, 22 nt, Homo sapiens
uaauugugaaguauuaagccua

SEQ ID NO: 688823 - RNA, 16 nt, Homo sapiens
uaauugugugucacaa

SEQ ID NO: 688824 - RNA, 19 nt, Homo sapiens
uaauugugugucacaagaa

SEQ ID NO: 688825 - RNA, 19 nt, Homo sapiens
uaauuuaaaaaauaacuac

SEQ ID NO: 688826 - RNA, 16 nt, Homo sapiens
uaauuuacagcuuuca

SEQ ID NO: 688827 - RNA, 15 nt, Homo sapiens
uaauuuauaaauaca

SEQ ID NO: 688828 - RNA, 17 nt, Homo sapiens
uaauuuauuauacaccu

SEQ ID NO: 688829 - RNA, 13 nt, Homo sapiens
uaauuuauuucca

SEQ ID NO: 688830 - RNA, 13 nt, Homo sapiens
uaauuuccagggu

SEQ ID NO: 688831 - RNA, 17 nt, Homo sapiens
uaauuuccucugacaug

SEQ ID NO: 688832 - RNA, 22 nt, Homo sapiens
uaauuucuuugaucuggacaga

SEQ ID NO: 688833 - RNA, 18 nt, Homo sapiens
uaauuugaaaacauaauc

SEQ ID NO: 688834 - RNA, 20 nt, Homo sapiens
uaauuugagagaaauaugaa

SEQ ID NO: 688835 - RNA, 16 nt, Homo sapiens
uacagcacuacucugu

SEQ ID NO: 688836 - RNA, 10 nt, Homo sapiens
uacagcagca

SEQ ID NO: 688837 - RNA, 18 nt, Homo sapiens
uacagcccucacuaacaa

SEQ ID NO: 688838 - RNA, 16 nt, Homo sapiens
uacagcccucagcaau

SEQ ID NO: 688839 - RNA, 15 nt, Homo sapiens
uacagcucccuuccc

SEQ ID NO: 688840 - RNA, 20 nt, Homo sapiens
uacagcugcuuugagcuaca

SEQ ID NO: 688841 - RNA, 17 nt, Homo sapiens
uacagcuggcuaucuac

SEQ ID NO: 688842 - RNA, 22 nt, Homo sapiens
uacagcuucacuagaguucuuu

SEQ ID NO: 688843 - RNA, 15 nt, Homo sapiens
uacagcuuucacagu

SEQ ID NO: 688844 - RNA, 15 nt, Homo sapiens
uacaggaaagcaaua

SEQ ID NO: 688845 - RNA, 21 nt, Homo sapiens
uacaggaagcaccccaugcca

SEQ ID NO: 688846 - RNA, 21 nt, Homo sapiens
uacaggaaggugccuggccau

SEQ ID NO: 688847 - RNA, 13 nt, Homo sapiens
uacaggacauaua

SEQ ID NO: 688848 - RNA, 19 nt, Homo sapiens
uacaggaggcagacaauga

SEQ ID NO: 688849 - RNA, 19 nt, Homo sapiens
uacaggccauacuuuacaa

SEQ ID NO: 688850 - RNA, 18 nt, Homo sapiens
uacaggcuccugccacca

SEQ ID NO: 688851 - RNA, 15 nt, Homo sapiens
uacagggauuacugg

SEQ ID NO: 688852 - RNA, 15 nt, Homo sapiens
uacaguaaccaaaac

SEQ ID NO: 688853 - RNA, 16 nt, Homo sapiens
uacaguagaagcucac

SEQ ID NO: 688854 - RNA, 22 nt, Homo sapiens
uacaguaggagcccagcucuga

SEQ ID NO: 688855 - RNA, 21 nt, Homo sapiens
uacagucuaaaauugcuucuu

SEQ ID NO: 688856 - RNA, 22 nt, Homo sapiens
uacagugaugcugugcuaugaa

SEQ ID NO: 688857 - RNA, 19 nt, Homo sapiens
uacagugccaacuccucac

SEQ ID NO: 688858 - RNA, 21 nt, Homo sapiens
uacagugcccaccgcccuccu

SEQ ID NO: 688859 - RNA, 20 nt, Homo sapiens
uacagugcuguguacccugg

SEQ ID NO: 688860 - RNA, 16 nt, Homo sapiens
uacaguggaauuguga

SEQ ID NO: 688861 - RNA, 15 nt, Homo sapiens
uacaguucugucaua

SEQ ID NO: 688862 - RNA, 17 nt, Homo sapiens
uacaguucugugguuuc

SEQ ID NO: 688863 - RNA, 18 nt, Homo sapiens
uacauaaaguacauaaca

SEQ ID NO: 688864 - RNA, 13 nt, Homo sapiens
uacauaagaccau

SEQ ID NO: 688865 - RNA, 16 nt, Homo sapiens
uacauaaggaugacuu

SEQ ID NO: 688866 - RNA, 22 nt, Homo sapiens
uacauaauuuaaaagcacacuc

SEQ ID NO: 688867 - RNA, 15 nt, Homo sapiens
uacauacaaauucua

SEQ ID NO: 688868 - RNA, 21 nt, Homo sapiens
uacauacacuguauguuauag

SEQ ID NO: 688869 - RNA, 17 nt, Homo sapiens
uacauacauacauacau

SEQ ID NO: 688870 - RNA, 15 nt, Homo sapiens
uacauacauacauau

SEQ ID NO: 688871 - RNA, 16 nt, Homo sapiens
uacauacauuguauag

SEQ ID NO: 688872 - RNA, 12 nt, Homo sapiens
uacauacugcug

SEQ ID NO: 688873 - RNA, 17 nt, Homo sapiens
uacauaggucuguaugg

SEQ ID NO: 688874 - RNA, 20 nt, Homo sapiens
uacauauaauaaacuuuuca

SEQ ID NO: 688875 - RNA, 20 nt, Homo sapiens
uacauauauacauugcuuag

SEQ ID NO: 688876 - RNA, 15 nt, Homo sapiens
uacauaugagaauau

SEQ ID NO: 688877 - RNA, 19 nt, Homo sapiens
uacauaugagaauauaccu

SEQ ID NO: 688878 - RNA, 21 nt, Homo sapiens
uacauaugagaauauaccuua

SEQ ID NO: 688879 - RNA, 22 nt, Homo sapiens
uacauauguauuauauaaacuu

SEQ ID NO: 688880 - RNA, 13 nt, Homo sapiens
uacaucaaagcuu

SEQ ID NO: 688881 - RNA, 20 nt, Homo sapiens
uacaucaaguccaucugaca

SEQ ID NO: 688882 - RNA, 19 nt, Homo sapiens
uacaucacucucaccuucc

SEQ ID NO: 688883 - RNA, 14 nt, Homo sapiens
uacauccucugaua

SEQ ID NO: 688884 - RNA, 21 nt, Homo sapiens
uacaucugcaauaugaauuca

SEQ ID NO: 688885 - RNA, 11 nt, Homo sapiens
uacaucuggcc

SEQ ID NO: 688886 - RNA, 21 nt, Homo sapiens
uacaucuuaaaucuuuucaau

SEQ ID NO: 688887 - RNA, 19 nt, Homo sapiens
uacaugaagcuucaugcac

SEQ ID NO: 688888 - RNA, 22 nt, Homo sapiens
uacaugacaucaaaaugaguca

SEQ ID NO: 688889 - RNA, 13 nt, Homo sapiens
uacaugacauuua

SEQ ID NO: 688890 - RNA, 10 nt, Homo sapiens
uacaugacug

SEQ ID NO: 688891 - RNA, 19 nt, Homo sapiens
uacaugcaccuuauauuuc

SEQ ID NO: 688892 - RNA, 14 nt, Homo sapiens
uacaugcauauaau

SEQ ID NO: 688893 - RNA, 20 nt, Homo sapiens
uacauggaauaacauguaau

SEQ ID NO: 688894 - RNA, 14 nt, Homo sapiens
uacaugucuuccau

SEQ ID NO: 688895 - RNA, 19 nt, Homo sapiens
uacaugugccgaaugugca

SEQ ID NO: 688896 - RNA, 21 nt, Homo sapiens
uacauguucuugucauaaaau

SEQ ID NO: 688897 - RNA, 18 nt, Homo sapiens
uacauuaaaaaaauucca

SEQ ID NO: 688898 - RNA, 17 nt, Homo sapiens
uacauuaacggugcuaa

SEQ ID NO: 688899 - RNA, 13 nt, Homo sapiens
uacauuaguacac

SEQ ID NO: 688900 - RNA, 16 nt, Homo sapiens
uacauuaucucacuua

SEQ ID NO: 688901 - RNA, 15 nt, Homo sapiens
uacauuccucagcug

SEQ ID NO: 688902 - RNA, 19 nt, Homo sapiens
uacauucgugugugucugc

SEQ ID NO: 688903 - RNA, 12 nt, Homo sapiens
uacauucuucca

SEQ ID NO: 688904 - RNA, 23 nt, Homo sapiens
uacauucuugguuguuaauuuag

SEQ ID NO: 688905 - RNA, 23 nt, Homo sapiens
uacauugaucuuuugcuaaugca

SEQ ID NO: 688906 - RNA, 23 nt, Homo sapiens
uacauugcuuaaaauauauagug

SEQ ID NO: 688907 - RNA, 19 nt, Homo sapiens
uacauugugggauguucag

SEQ ID NO: 688908 - RNA, 23 nt, Homo sapiens
uacauuguuugucugucuucaua

SEQ ID NO: 688909 - RNA, 15 nt, Homo sapiens
uacauuuaucacuga

SEQ ID NO: 688910 - RNA, 13 nt, Homo sapiens
uacauuuaugcac

SEQ ID NO: 688911 - RNA, 21 nt, Homo sapiens
uacauuucauaaggccugccc

SEQ ID NO: 688912 - RNA, 13 nt, Homo sapiens
uacauuuccaaau

SEQ ID NO: 688913 - RNA, 22 nt, Homo sapiens
uacauuuugccugacuuaccuu

SEQ ID NO: 688914 - RNA, 19 nt, Homo sapiens
uacauuuuuuaaaacugaa

SEQ ID NO: 688915 - RNA, 21 nt, Homo sapiens
uacauuuuuugggcagcaauu

SEQ ID NO: 688916 - RNA, 11 nt, Homo sapiens
uaccaaaagau

SEQ ID NO: 688917 - RNA, 14 nt, Homo sapiens
uaccaaagcaucaa

SEQ ID NO: 688918 - RNA, 19 nt, Homo sapiens
uaccaaagcaucaauacaa

SEQ ID NO: 688919 - RNA, 23 nt, Homo sapiens
uaccaacagcuuuucccaggaga

SEQ ID NO: 688920 - RNA, 17 nt, Homo sapiens
uaccaacaucuggucuu

SEQ ID NO: 688921 - RNA, 19 nt, Homo sapiens
uaccaacuuccucugccau

SEQ ID NO: 688922 - RNA, 14 nt, Homo sapiens
uaccaaguauuuau

SEQ ID NO: 688923 - RNA, 16 nt, Homo sapiens
uaccaauauuuacuca

SEQ ID NO: 688924 - RNA, 18 nt, Homo sapiens
uaccacacaaacuauggg

SEQ ID NO: 688925 - RNA, 13 nt, Homo sapiens
uaccacacauauu

SEQ ID NO: 688926 - RNA, 18 nt, Homo sapiens
uaccacacccagggcuau

SEQ ID NO: 688927 - RNA, 21 nt, Homo sapiens
uaccaccaugcacuguaaaua

SEQ ID NO: 688928 - RNA, 18 nt, Homo sapiens
uaccaccccuuccugucc

SEQ ID NO: 688929 - RNA, 16 nt, Homo sapiens
uaccacuaacuccuga

SEQ ID NO: 688930 - RNA, 16 nt, Homo sapiens
uaccacucuaccaaau

SEQ ID NO: 688931 - RNA, 18 nt, Homo sapiens
uaccagagaccugaggca

SEQ ID NO: 688932 - RNA, 13 nt, Homo sapiens
uaccagaugcuac

SEQ ID NO: 688933 - RNA, 22 nt, Homo sapiens
uaccagcauacgcucaccuuac

SEQ ID NO: 688934 - RNA, 21 nt, Homo sapiens
uaccaguauaauugaguuuuc

SEQ ID NO: 688935 - RNA, 16 nt, Homo sapiens
uaccagugaaccaaag

SEQ ID NO: 688936 - RNA, 17 nt, Homo sapiens
uaccagugaaccaaaga

SEQ ID NO: 688937 - RNA, 11 nt, Homo sapiens
uaccauagaaa

SEQ ID NO: 688938 - RNA, 18 nt, Homo sapiens
uaccauauaauguaaaaa

SEQ ID NO: 688939 - RNA, 13 nt, Homo sapiens
uaccauguggcaa

SEQ ID NO: 688940 - RNA, 23 nt, Homo sapiens
uaccauuaaaguucucaaugcaa

SEQ ID NO: 688941 - RNA, 21 nt, Homo sapiens
uaccauucaacccagcaaucu

SEQ ID NO: 688942 - RNA, 19 nt, Homo sapiens
uaccauucaggacauaggc

SEQ ID NO: 688943 - RNA, 14 nt, Homo sapiens
uaccauuuccucag

SEQ ID NO: 688944 - RNA, 22 nt, Homo sapiens
uaccauuuguaauaaaguauau

SEQ ID NO: 688945 - RNA, 20 nt, Homo sapiens
uccucaauuuuugucucaga

SEQ ID NO: 688946 - RNA, 12 nt, Homo sapiens
uccucacacaga

SEQ ID NO: 688947 - RNA, 15 nt, Homo sapiens
uccucacagaccucu

SEQ ID NO: 688948 - RNA, 19 nt, Homo sapiens
uccucacagagguccgggu

SEQ ID NO: 688949 - RNA, 14 nt, Homo sapiens
uccucaccgucucg

SEQ ID NO: 688950 - RNA, 20 nt, Homo sapiens
uccucaccucuggacuggcu

SEQ ID NO: 688951 - RNA, 13 nt, Homo sapiens
uccucacuuccau

SEQ ID NO: 688952 - RNA, 17 nt, Homo sapiens
uccucacuuuauggaag

SEQ ID NO: 688953 - RNA, 23 nt, Homo sapiens
uccucagaaugauuuguaaauag

SEQ ID NO: 688954 - RNA, 22 nt, Homo sapiens
uccucagagaauuucuaccauu

SEQ ID NO: 688955 - RNA, 16 nt, Homo sapiens
uccucagaggacaguu

SEQ ID NO: 688956 - RNA, 12 nt, Homo sapiens
uccucagccucu

SEQ ID NO: 688957 - RNA, 11 nt, Homo sapiens
uccucagggag

SEQ ID NO: 688958 - RNA, 21 nt, Homo sapiens
uccucauauggcccaguguca

SEQ ID NO: 688959 - RNA, 14 nt, Homo sapiens
uccucaucugcaaa

SEQ ID NO: 688960 - RNA, 19 nt, Homo sapiens
uccucaucugggucuccca

SEQ ID NO: 688961 - RNA, 13 nt, Homo sapiens
uccuccaacagcu

SEQ ID NO: 688962 - RNA, 17 nt, Homo sapiens
uccuccacaauagcaga

SEQ ID NO: 688963 - RNA, 16 nt, Homo sapiens
uccuccacauccuuuc

SEQ ID NO: 688964 - RNA, 13 nt, Homo sapiens
uauuaaucaccuc

SEQ ID NO: 688965 - RNA, 15 nt, Homo sapiens
uauuaaucauacaaa

SEQ ID NO: 688966 - RNA, 22 nt, Homo sapiens
uauuaauugccuuugagguuau

SEQ ID NO: 688967 - RNA, 16 nt, Homo sapiens
uauuacaaaacaaaca

SEQ ID NO: 688968 - RNA, 22 nt, Homo sapiens
uauuacaaauuuucacugcugc

SEQ ID NO: 688969 - RNA, 23 nt, Homo sapiens
uauuacaguguuuauccuuucau

SEQ ID NO: 688970 - RNA, 16 nt, Homo sapiens
uauuacaucuuucaca

SEQ ID NO: 688971 - RNA, 14 nt, Homo sapiens
uauuacauugcugc

SEQ ID NO: 688972 - RNA, 11 nt, Homo sapiens
uauuaccuccc

SEQ ID NO: 688973 - RNA, 22 nt, Homo sapiens
uauuaccuccccuacucccuua

SEQ ID NO: 688974 - RNA, 18 nt, Homo sapiens
uauuacucuacacugaaa

SEQ ID NO: 688975 - RNA, 22 nt, Homo sapiens
uauuacugguauuaguuaaaac

SEQ ID NO: 688976 - RNA, 12 nt, Homo sapiens
uauuacuguugc

SEQ ID NO: 688977 - RNA, 18 nt, Homo sapiens
uauuacuguugcauuuac

SEQ ID NO: 688978 - RNA, 20 nt, Homo sapiens
uauuacuuagguuauuuugc

SEQ ID NO: 688979 - RNA, 22 nt, Homo sapiens
uauuacuuauuuuugacagugu

SEQ ID NO: 688980 - RNA, 21 nt, Homo sapiens
uauuagaucaaauaguugcau

SEQ ID NO: 688981 - RNA, 18 nt, Homo sapiens
uauuagcagggauucucu

SEQ ID NO: 688982 - RNA, 20 nt, Homo sapiens
uauuaggaaauucugaugag

SEQ ID NO: 688983 - RNA, 17 nt, Homo sapiens
uauuaggauaauacaua

SEQ ID NO: 688984 - RNA, 22 nt, Homo sapiens
uauuagugccguuaucauggag

SEQ ID NO: 688985 - RNA, 21 nt, Homo sapiens
uauuauauauauauaucuaua

SEQ ID NO: 688986 - RNA, 19 nt, Homo sapiens
uauuaucugucagcugcaa

SEQ ID NO: 688987 - RNA, 13 nt, Homo sapiens
uauuaucuugcaa

SEQ ID NO: 688988 - RNA, 14 nt, Homo sapiens
uauuaugcauauau

SEQ ID NO: 688989 - RNA, 15 nt, Homo sapiens
uauuauggcaaguga

SEQ ID NO: 688990 - RNA, 17 nt, Homo sapiens
uauuauguuaaugaaga

SEQ ID NO: 688991 - RNA, 14 nt, Homo sapiens
uauuauuaucacau

SEQ ID NO: 688992 - RNA, 12 nt, Homo sapiens
uauuauucuuga

SEQ ID NO: 688993 - RNA, 15 nt, Homo sapiens
uauuauugcugccaa

SEQ ID NO: 688994 - RNA, 21 nt, Homo sapiens
uauuauuucugguucuaauga

SEQ ID NO: 688995 - RNA, 23 nt, Homo sapiens
uauuauuuuucgucucaauggua

SEQ ID NO: 688996 - RNA, 14 nt, Homo sapiens
uauucaaaaaauca

SEQ ID NO: 688997 - RNA, 23 nt, Homo sapiens
uauucaaagagaaaacaucucau

SEQ ID NO: 688998 - RNA, 14 nt, Homo sapiens
uauucaagcacuua

SEQ ID NO: 688999 - RNA, 19 nt, Homo sapiens
uauucaaguaacacuuuaa

SEQ ID NO: 689000 - RNA, 20 nt, Homo sapiens
uauucaauaaaucgugcugg

SEQ ID NO: 689001 - RNA, 19 nt, Homo sapiens
uauucaauggaaagcugcu

SEQ ID NO: 689002 - RNA, 21 nt, Homo sapiens
uauucacaaccacucauucaa

SEQ ID NO: 689003 - RNA, 17 nt, Homo sapiens
uauucacuaaggacuua

SEQ ID NO: 689004 - RNA, 15 nt, Homo sapiens
uauucagacaaaaug

SEQ ID NO: 689005 - RNA, 18 nt, Homo sapiens
uauucagagucucugaua

SEQ ID NO: 689006 - RNA, 15 nt, Homo sapiens
uauucagcacuaaaa

SEQ ID NO: 689007 - RNA, 13 nt, Homo sapiens
uauucagcccacu

SEQ ID NO: 689008 - RNA, 23 nt, Homo sapiens
uauucaggcuguuguuggcuuag

SEQ ID NO: 689009 - RNA, 15 nt, Homo sapiens
uauucaucagaaugu

SEQ ID NO: 689010 - RNA, 17 nt, Homo sapiens
uauucauccuaaaaagu

SEQ ID NO: 689011 - RNA, 12 nt, Homo sapiens
uauucaugccau

SEQ ID NO: 689012 - RNA, 16 nt, Homo sapiens
uauucauuaagcuuuu

SEQ ID NO: 689013 - RNA, 19 nt, Homo sapiens
uauucauuagggaaaugca

SEQ ID NO: 689014 - RNA, 16 nt, Homo sapiens
uauuccaaaccaaauu

SEQ ID NO: 689015 - RNA, 14 nt, Homo sapiens
uauuccaagggaau

SEQ ID NO: 689016 - RNA, 17 nt, Homo sapiens
uauuccaccauucacau

SEQ ID NO: 689017 - RNA, 14 nt, Homo sapiens
uauuccaccuuaaa

SEQ ID NO: 689018 - RNA, 21 nt, Homo sapiens
uauuccacuggcgcaucauau

SEQ ID NO: 689019 - RNA, 11 nt, Homo sapiens
uauuccacuua

SEQ ID NO: 689020 - RNA, 16 nt, Homo sapiens
uauuccacuuaggaag

SEQ ID NO: 689021 - RNA, 23 nt, Homo sapiens
uauuccagcagugaaacuugugc

SEQ ID NO: 689022 - RNA, 16 nt, Homo sapiens
uauuccauugugugag

SEQ ID NO: 689023 - RNA, 14 nt, Homo sapiens
uauuccccauuucc

SEQ ID NO: 689024 - RNA, 23 nt, Homo sapiens
uauuccccccacuuaagacugug

SEQ ID NO: 689025 - RNA, 16 nt, Homo sapiens
uauucuaaaaccauuc

SEQ ID NO: 689026 - RNA, 20 nt, Homo sapiens
uauucuaagcccuuugccau

SEQ ID NO: 689027 - RNA, 23 nt, Homo sapiens
uauucuaguuuugucaaacugua

SEQ ID NO: 689028 - RNA, 19 nt, Homo sapiens
uauucuauaaucacuacua

SEQ ID NO: 689029 - RNA, 20 nt, Homo sapiens
uauucucccacugacagaaa

SEQ ID NO: 689030 - RNA, 22 nt, Homo sapiens
uauucuccuauguuuggcugcu

SEQ ID NO: 689031 - RNA, 16 nt, Homo sapiens
uauucucugcaauuug

SEQ ID NO: 689032 - RNA, 11 nt, Homo sapiens
uauucuggaaa

SEQ ID NO: 689033 - RNA, 18 nt, Homo sapiens
uauucuucacuuaaacuc

SEQ ID NO: 689034 - RNA, 15 nt, Homo sapiens
uauucuucauaacaa

SEQ ID NO: 689035 - RNA, 18 nt, Homo sapiens
uauucuuccccgaaucac

SEQ ID NO: 689036 - RNA, 13 nt, Homo sapiens
uauugaacauucu

SEQ ID NO: 689037 - RNA, 18 nt, Homo sapiens
uauugaaugaugugauac

SEQ ID NO: 689038 - RNA, 14 nt, Homo sapiens
uauugaccuaauaa

SEQ ID NO: 689039 - RNA, 21 nt, Homo sapiens
uauugacugggcaacacugca

SEQ ID NO: 689040 - RNA, 13 nt, Homo sapiens
uauugauauucaa

SEQ ID NO: 689041 - RNA, 18 nt, Homo sapiens
uauugaugagagggaaaa

SEQ ID NO: 689042 - RNA, 12 nt, Homo sapiens
uauugauuacaa

SEQ ID NO: 689043 - RNA, 20 nt, Homo sapiens
uauugauuuuaaauggaugu

SEQ ID NO: 689044 - RNA, 17 nt, Homo sapiens
uauugcaaaauacauga

SEQ ID NO: 689045 - RNA, 21 nt, Homo sapiens
uauugcagagacucauuucac

SEQ ID NO: 689046 - RNA, 22 nt, Homo sapiens
uauugcagagacucauuucaca

SEQ ID NO: 689047 - RNA, 18 nt, Homo sapiens
uauugcaggauucuguaa

SEQ ID NO: 689048 - RNA, 18 nt, Homo sapiens
uauugcagucaaucucuu

SEQ ID NO: 689049 - RNA, 15 nt, Homo sapiens
uauugcaguuuauca

SEQ ID NO: 689050 - RNA, 10 nt, Homo sapiens
uauugcccua

SEQ ID NO: 689051 - RNA, 14 nt, Homo sapiens
uauugcucugagaa

SEQ ID NO: 689052 - RNA, 17 nt, Homo sapiens
uauugcugcaaacacuu

SEQ ID NO: 689053 - RNA, 11 nt, Homo sapiens
uauugcugcuc

SEQ ID NO: 689054 - RNA, 17 nt, Homo sapiens
uauugcuugaguuauau

SEQ ID NO: 689055 - RNA, 13 nt, Homo sapiens
uauuggggaacag

SEQ ID NO: 689056 - RNA, 13 nt, Homo sapiens
uauuggugcuaga

SEQ ID NO: 689057 - RNA, 14 nt, Homo sapiens
uauugguguuuacc

SEQ ID NO: 689058 - RNA, 17 nt, Homo sapiens
uauugguguuuacccag

SEQ ID NO: 689059 - RNA, 18 nt, Homo sapiens
uauuguaaaacauucaca

SEQ ID NO: 689060 - RNA, 21 nt, Homo sapiens
uauuguaaaguucaauuucaa

SEQ ID NO: 689061 - RNA, 19 nt, Homo sapiens
uauuguaagaaauacugua

SEQ ID NO: 689062 - RNA, 20 nt, Homo sapiens
uauuguaaucgugugccaug

SEQ ID NO: 689063 - RNA, 12 nt, Homo sapiens
uauuguacauaa

SEQ ID NO: 689064 - RNA, 15 nt, Homo sapiens
uauuguauaaacuau

SEQ ID NO: 689065 - RNA, 21 nt, Homo sapiens
uauugucgguuaccucugcau

SEQ ID NO: 689066 - RNA, 19 nt, Homo sapiens
uauugugccaauauguauu

SEQ ID NO: 689067 - RNA, 22 nt, Homo sapiens
uauuguggauguguucauucaa

SEQ ID NO: 689068 - RNA, 15 nt, Homo sapiens
uauuguuacacauua

SEQ ID NO: 689069 - RNA, 14 nt, Homo sapiens
uauuguucacuuua

SEQ ID NO: 689070 - RNA, 18 nt, Homo sapiens
uauuguuguccuuuucau

SEQ ID NO: 689071 - RNA, 12 nt, Homo sapiens
uauuguuuccaa

SEQ ID NO: 689072 - RNA, 14 nt, Homo sapiens
uauuguuucugcau

SEQ ID NO: 689073 - RNA, 20 nt, Homo sapiens
uauuuaaaaaaaaagucaga

SEQ ID NO: 689074 - RNA, 13 nt, Homo sapiens
uauuuaaacaauu

SEQ ID NO: 689075 - RNA, 19 nt, Homo sapiens
uauuuaaacucaagacaau

SEQ ID NO: 689076 - RNA, 18 nt, Homo sapiens
uauuuaaagacaaagaca

SEQ ID NO: 689077 - RNA, 22 nt, Homo sapiens
uauuuaaagccuccucaucccg

SEQ ID NO: 689078 - RNA, 14 nt, Homo sapiens
uauuuaacaacugg

SEQ ID NO: 689079 - RNA, 13 nt, Homo sapiens
uauuuaagugcaa

SEQ ID NO: 689080 - RNA, 14 nt, Homo sapiens
uauuuaaguucaca

SEQ ID NO: 689081 - RNA, 14 nt, Homo sapiens
uauuuaaguucaua

SEQ ID NO: 689082 - RNA, 23 nt, Homo sapiens
uauuuaaucaaacaguaaucuag

SEQ ID NO: 689083 - RNA, 20 nt, Homo sapiens
uauuuaauguggaaugucaa

SEQ ID NO: 689084 - RNA, 13 nt, Homo sapiens
uauuuaauuuuga

SEQ ID NO: 689085 - RNA, 16 nt, Homo sapiens
uauuuagaacugccaa

SEQ ID NO: 689086 - RNA, 22 nt, Homo sapiens
uauuuagaagccaacuaugauu

SEQ ID NO: 689087 - RNA, 17 nt, Homo sapiens
uauuuauaaaugagcaa

SEQ ID NO: 689088 - RNA, 18 nt, Homo sapiens
uauuuauaaaugagcaaa

SEQ ID NO: 689089 - RNA, 14 nt, Homo sapiens
uauuuauacuguau

SEQ ID NO: 689090 - RNA, 12 nt, Homo sapiens
uauuuauagucg

SEQ ID NO: 689091 - RNA, 16 nt, Homo sapiens
uauuuaucugugcaaa

SEQ ID NO: 689092 - RNA, 15 nt, Homo sapiens
uauuuaugugugagg

SEQ ID NO: 689093 - RNA, 16 nt, Homo sapiens
uauuuauguguucaca

SEQ ID NO: 689094 - RNA, 17 nt, Homo sapiens
uauuuauuacuuccuca

SEQ ID NO: 689095 - RNA, 15 nt, Homo sapiens
uauuuauugcugaau

SEQ ID NO: 689096 - RNA, 13 nt, Homo sapiens
uauuuauuuacug

SEQ ID NO: 689097 - RNA, 16 nt, Homo sapiens
uauuuauuuuuugcca

SEQ ID NO: 689098 - RNA, 13 nt, Homo sapiens
uauuucaauguaa

SEQ ID NO: 689099 - RNA, 19 nt, Homo sapiens
uauuucaauguuagccuca

SEQ ID NO: 689100 - RNA, 14 nt, Homo sapiens
uauuucacagagca

SEQ ID NO: 689101 - RNA, 19 nt, Homo sapiens
uauuucacuaaucaugaga

SEQ ID NO: 689102 - RNA, 15 nt, Homo sapiens
uauuucacuugauga

SEQ ID NO: 689103 - RNA, 15 nt, Homo sapiens
uauuucauaaacaac

SEQ ID NO: 689104 - RNA, 14 nt, Homo sapiens
uauuucauaucuau

SEQ ID NO: 689105 - RNA, 16 nt, Homo sapiens
uauuucauccaguuug

SEQ ID NO: 689106 - RNA, 14 nt, Homo sapiens
uauuucaugauaga

SEQ ID NO: 689107 - RNA, 19 nt, Homo sapiens
uauuucauugccuguguau

SEQ ID NO: 689108 - RNA, 14 nt, Homo sapiens
uauuuccaccuccu

SEQ ID NO: 689109 - RNA, 21 nt, Homo sapiens
uauuuccauagcuuuuggcug

SEQ ID NO: 689110 - RNA, 18 nt, Homo sapiens
uauuucccucaccuuucc

SEQ ID NO: 689111 - RNA, 16 nt, Homo sapiens
uauuuccuuagugcca

SEQ ID NO: 689112 - RNA, 15 nt, Homo sapiens
uauuucuaaguauuu

SEQ ID NO: 689113 - RNA, 17 nt, Homo sapiens
uauuucuagaagcacau

SEQ ID NO: 689114 - RNA, 15 nt, Homo sapiens
uauuucuagcauuac

SEQ ID NO: 689115 - RNA, 21 nt, Homo sapiens
uauuucucucuuaacacuggc

SEQ ID NO: 689116 - RNA, 16 nt, Homo sapiens
uauuucugcauggaaa

SEQ ID NO: 689117 - RNA, 23 nt, Homo sapiens
uauuucuucaaauaaaucucucc

SEQ ID NO: 689118 - RNA, 17 nt, Homo sapiens
uauuucuuccuaccaag

SEQ ID NO: 689119 - RNA, 20 nt, Homo sapiens
uauuucuucgugaacauaga

SEQ ID NO: 689120 - RNA, 15 nt, Homo sapiens
uauuucuugcuuuca

SEQ ID NO: 689121 - RNA, 12 nt, Homo sapiens
uauuucuuuaaa

SEQ ID NO: 689122 - RNA, 21 nt, Homo sapiens
uauuugaagcaucacauaaaa

SEQ ID NO: 689123 - RNA, 16 nt, Homo sapiens
uauuugaaucuacaaa

SEQ ID NO: 689124 - RNA, 16 nt, Homo sapiens
uauuugauaacaguua

SEQ ID NO: 689125 - RNA, 21 nt, Homo sapiens
uauuugauaacaguuacucca

SEQ ID NO: 689126 - RNA, 19 nt, Homo sapiens
uauuugaugaaacucauga

SEQ ID NO: 689127 - RNA, 15 nt, Homo sapiens
uauuugcuauucaaa

SEQ ID NO: 689128 - RNA, 14 nt, Homo sapiens
uauuugcugccaga

SEQ ID NO: 689129 - RNA, 16 nt, Homo sapiens
uauuugcuuuuugcua

SEQ ID NO: 689130 - RNA, 19 nt, Homo sapiens
uauuuggaaauaaagucag

SEQ ID NO: 689131 - RNA, 16 nt, Homo sapiens
uauuuggaaugaagga

SEQ ID NO: 689132 - RNA, 17 nt, Homo sapiens
uauuuguaaauuuagug

SEQ ID NO: 689133 - RNA, 20 nt, Homo sapiens
uauuugugugugugauauau

SEQ ID NO: 689134 - RNA, 17 nt, Homo sapiens
uauuuguuugcaauuuu

SEQ ID NO: 689135 - RNA, 17 nt, Homo sapiens
uauuuuaaaucuuaaca

SEQ ID NO: 689136 - RNA, 22 nt, Homo sapiens
uauuuuagcugcacggcauuac

SEQ ID NO: 689137 - RNA, 16 nt, Homo sapiens
uauuuucaaagacuua

SEQ ID NO: 689138 - RNA, 17 nt, Homo sapiens
uauuuucacacugguaa

SEQ ID NO: 689139 - RNA, 16 nt, Homo sapiens
uauuuucaguauacug

SEQ ID NO: 689140 - RNA, 14 nt, Homo sapiens
uauuuucagugcau

SEQ ID NO: 689141 - RNA, 12 nt, Homo sapiens
uauuuuccaaag

SEQ ID NO: 689142 - RNA, 16 nt, Homo sapiens
uauuuucucuuaacaa

SEQ ID NO: 689143 - RNA, 13 nt, Homo sapiens
uauuuucuguuga

SEQ ID NO: 689144 - RNA, 21 nt, Homo sapiens
uauuuucuucuccagugguca

SEQ ID NO: 689145 - RNA, 22 nt, Homo sapiens
uauuuugcauaguaccaaucau

SEQ ID NO: 689146 - RNA, 12 nt, Homo sapiens
uauuuugcccag

SEQ ID NO: 689147 - RNA, 16 nt, Homo sapiens
uauuuuguucugcaaa

SEQ ID NO: 689148 - RNA, 16 nt, Homo sapiens
uauuuuuaaagcaagu

SEQ ID NO: 689149 - RNA, 14 nt, Homo sapiens
uauuuuuaccuaaa

SEQ ID NO: 689150 - RNA, 12 nt, Homo sapiens
uauuuuuacuaa

SEQ ID NO: 689151 - RNA, 15 nt, Homo sapiens
uauuuuuauguucuu

SEQ ID NO: 689152 - RNA, 13 nt, Homo sapiens
uauuuuucugaua

SEQ ID NO: 689153 - RNA, 21 nt, Homo sapiens
uauuuuuguacugaaucucau

SEQ ID NO: 689154 - RNA, 20 nt, Homo sapiens
uauuuuuguguuuucuugua

SEQ ID NO: 689155 - RNA, 18 nt, Homo sapiens
uauuuuuucccuccugac

SEQ ID NO: 689156 - RNA, 22 nt, Homo sapiens
uauuuuuucgugcacucugcua

SEQ ID NO: 689157 - RNA, 15 nt, Homo sapiens
uauuuuuucuugcaa

SEQ ID NO: 689158 - RNA, 13 nt, Homo sapiens
uauuuuuugccau

SEQ ID NO: 689159 - RNA, 16 nt, Homo sapiens
uauuuuuuuuuugcca

SEQ ID NO: 689160 - RNA, 23 nt, Homo sapiens
ucaaaaaagaaaaaagaaaagaa

SEQ ID NO: 689161 - RNA, 17 nt, Homo sapiens
ucaaaaaaucugaccaa

SEQ ID NO: 689162 - RNA, 20 nt, Homo sapiens
ucaaaaaaucugaccaaaac

SEQ ID NO: 689163 - RNA, 13 nt, Homo sapiens
ucaaaaaccugcc

SEQ ID NO: 689164 - RNA, 13 nt, Homo sapiens
ucaaaaaguaauu

SEQ ID NO: 689165 - RNA, 14 nt, Homo sapiens
ucaaaaaguacaau

SEQ ID NO: 689166 - RNA, 14 nt, Homo sapiens
ucaaaaaguguuua

SEQ ID NO: 689167 - RNA, 23 nt, Homo sapiens
ucaaaaauuaucuauagcuaagu

SEQ ID NO: 689168 - RNA, 16 nt, Homo sapiens
ucaaaaauuauucuau

SEQ ID NO: 689169 - RNA, 17 nt, Homo sapiens
ucaaaacaaguacuggu

SEQ ID NO: 689170 - RNA, 17 nt, Homo sapiens
ucaaaacaauuggcaaa

SEQ ID NO: 689171 - RNA, 12 nt, Homo sapiens
ucaaaacacaua

SEQ ID NO: 689172 - RNA, 14 nt, Homo sapiens
ucaaaacacugugg

SEQ ID NO: 689173 - RNA, 17 nt, Homo sapiens
ucaaaacagagauguga

SEQ ID NO: 689174 - RNA, 18 nt, Homo sapiens
ucaaaacauucauaggca

SEQ ID NO: 689175 - RNA, 13 nt, Homo sapiens
ucaaaaccugugc

SEQ ID NO: 689176 - RNA, 14 nt, Homo sapiens
ucaaaaccuuucaa

SEQ ID NO: 689177 - RNA, 21 nt, Homo sapiens
ucaaaacgacucuaaacacac

SEQ ID NO: 689178 - RNA, 18 nt, Homo sapiens
ucaaaacuaaccaucuga

SEQ ID NO: 689179 - RNA, 22 nt, Homo sapiens
ucaaaacuguuuguuaucucuu

SEQ ID NO: 689180 - RNA, 22 nt, Homo sapiens
ucaaaagaaauuuaaguucuau

SEQ ID NO: 689181 - RNA, 16 nt, Homo sapiens
ucaaaagauggcuuau

SEQ ID NO: 689182 - RNA, 15 nt, Homo sapiens
ucaaaagcaccagca

SEQ ID NO: 689183 - RNA, 20 nt, Homo sapiens
ucaaaagccugggugagaau

SEQ ID NO: 689184 - RNA, 15 nt, Homo sapiens
ucaaaaggaaaccaa

SEQ ID NO: 689185 - RNA, 19 nt, Homo sapiens
ucaaaaguuuguuugcuua

SEQ ID NO: 689186 - RNA, 23 nt, Homo sapiens
ucaaaauaaaaaguaaugacuua

SEQ ID NO: 689187 - RNA, 16 nt, Homo sapiens
ucaaaauauacauuca

SEQ ID NO: 689188 - RNA, 14 nt, Homo sapiens
ucaaaaucaauuaa

SEQ ID NO: 689189 - RNA, 13 nt, Homo sapiens
ucaaaaugaauag

SEQ ID NO: 689190 - RNA, 13 nt, Homo sapiens
ucaaaauuugcug

SEQ ID NO: 689191 - RNA, 13 nt, Homo sapiens
ucaaacacaguua

SEQ ID NO: 689192 - RNA, 21 nt, Homo sapiens
ucaaaccaauuucuuccuucc

SEQ ID NO: 689193 - RNA, 17 nt, Homo sapiens
ucaaacccagucucaga

SEQ ID NO: 689194 - RNA, 18 nt, Homo sapiens
ucaaacccccaacccaaa

SEQ ID NO: 689195 - RNA, 18 nt, Homo sapiens
ucaaaccccgaccaccug

SEQ ID NO: 689196 - RNA, 14 nt, Homo sapiens
ucaaacccucaaga

SEQ ID NO: 689197 - RNA, 23 nt, Homo sapiens
ucaaaccgccggccacacugguc

SEQ ID NO: 689198 - RNA, 22 nt, Homo sapiens
ucaaaccucugccgcccuccac

SEQ ID NO: 689199 - RNA, 17 nt, Homo sapiens
ucaaacuagugcaugaa

SEQ ID NO: 689200 - RNA, 19 nt, Homo sapiens
ucaaacucccuagucucca

SEQ ID NO: 689201 - RNA, 17 nt, Homo sapiens
ucaaacuccugaccuca

SEQ ID NO: 689202 - RNA, 21 nt, Homo sapiens
ucaaacuccugaccucaggug

SEQ ID NO: 689203 - RNA, 12 nt, Homo sapiens
ucaaacugugaa

SEQ ID NO: 689204 - RNA, 15 nt, Homo sapiens
ucaaagaaauccaaa

SEQ ID NO: 689205 - RNA, 13 nt, Homo sapiens
ucaaagacuucca

SEQ ID NO: 689206 - RNA, 18 nt, Homo sapiens
ucaaagagcaaccaguau

SEQ ID NO: 689207 - RNA, 23 nt, Homo sapiens
ucaaagaggcugaggcuggcaca

SEQ ID NO: 689208 - RNA, 21 nt, Homo sapiens
ucaaagcacagaauuugucag

SEQ ID NO: 689209 - RNA, 12 nt, Homo sapiens
ucaaagcaguag

SEQ ID NO: 689210 - RNA, 13 nt, Homo sapiens
ucaaagcaguagu

SEQ ID NO: 689211 - RNA, 16 nt, Homo sapiens
ucaaaggaagacuuga

SEQ ID NO: 689212 - RNA, 16 nt, Homo sapiens
ucaaaggagcuuucuc

SEQ ID NO: 689213 - RNA, 16 nt, Homo sapiens
ucaaaguaaaacuugc

SEQ ID NO: 689214 - RNA, 21 nt, Homo sapiens
ucaaagucuaacauauucaau

SEQ ID NO: 689215 - RNA, 22 nt, Homo sapiens
ucaaagugagaaaaugccucaa

SEQ ID NO: 689216 - RNA, 21 nt, Homo sapiens
ucaaauacuuagagcagugaa

SEQ ID NO: 689217 - RNA, 18 nt, Homo sapiens
ucaaauaguugcauagca

SEQ ID NO: 689218 - RNA, 23 nt, Homo sapiens
ucaaauauuucugauacugcuga

SEQ ID NO: 689219 - RNA, 19 nt, Homo sapiens
ucaaaucaaggcaaaagga

SEQ ID NO: 689220 - RNA, 21 nt, Homo sapiens
ucaaaucaggguccaguggga

SEQ ID NO: 689221 - RNA, 15 nt, Homo sapiens
ucaaaucucuuccac

SEQ ID NO: 689222 - RNA, 15 nt, Homo sapiens
ucaaaugacccaaag

SEQ ID NO: 689223 - RNA, 17 nt, Homo sapiens
ucaaaugacccaaagac

SEQ ID NO: 689224 - RNA, 22 nt, Homo sapiens
ucaaaugacccaaagaccaaua

SEQ ID NO: 689225 - RNA, 21 nt, Homo sapiens
ucaaaugagccccuucauccg

SEQ ID NO: 689226 - RNA, 21 nt, Homo sapiens
ucaaaugaguaacauuugcug

SEQ ID NO: 689227 - RNA, 17 nt, Homo sapiens
ucaaaugcacaucucau

SEQ ID NO: 689228 - RNA, 15 nt, Homo sapiens
ucaaauggacuuuca

SEQ ID NO: 689229 - RNA, 12 nt, Homo sapiens
ucaaaugggcug

SEQ ID NO: 689230 - RNA, 18 nt, Homo sapiens
ucaaauguaaauuuacug

SEQ ID NO: 689231 - RNA, 19 nt, Homo sapiens
ucaaauguaaauuuacuga

SEQ ID NO: 689232 - RNA, 16 nt, Homo sapiens
ucaaauguauucagau

SEQ ID NO: 689233 - RNA, 17 nt, Homo sapiens
ucaaauguuacaguuua

SEQ ID NO: 689234 - RNA, 19 nt, Homo sapiens
ucaaauucuucugaacuca

SEQ ID NO: 689235 - RNA, 15 nt, Homo sapiens
ucaaauugcugcuug

SEQ ID NO: 689236 - RNA, 16 nt, Homo sapiens
ucaaauuggagcuuca

SEQ ID NO: 689237 - RNA, 23 nt, Homo sapiens
ucaaauuuauuuccaauguuuca

SEQ ID NO: 689238 - RNA, 14 nt, Homo sapiens
ucaaauuucaugaa

SEQ ID NO: 689239 - RNA, 14 nt, Homo sapiens
ucaaauuuuauuaa

SEQ ID NO: 689240 - RNA, 23 nt, Homo sapiens
ucaaauuuugaugccaagaaagu

SEQ ID NO: 689241 - RNA, 21 nt, Homo sapiens
ucaacaaaauggucauccaaa

SEQ ID NO: 689242 - RNA, 14 nt, Homo sapiens
ucaacaaaccaagc

SEQ ID NO: 689243 - RNA, 21 nt, Homo sapiens
ucaacaaacugcaagcaccug

SEQ ID NO: 689244 - RNA, 18 nt, Homo sapiens
ucaacaaccugaaugucc

SEQ ID NO: 689245 - RNA, 17 nt, Homo sapiens
ucaacaagaguugucuu

SEQ ID NO: 689246 - RNA, 22 nt, Homo sapiens
ucaacacuauuguaaucauuug

SEQ ID NO: 689247 - RNA, 16 nt, Homo sapiens
ucaacacucuucuuga

SEQ ID NO: 689248 - RNA, 23 nt, Homo sapiens
ucaacacugaaaaaauacuaccu

SEQ ID NO: 689249 - RNA, 15 nt, Homo sapiens
ucaacagaaguauca

SEQ ID NO: 689250 - RNA, 22 nt, Homo sapiens
ucaacagagggaguuuaauaca

SEQ ID NO: 689251 - RNA, 22 nt, Homo sapiens
ucaacagcauuuucaagcaguu

SEQ ID NO: 689252 - RNA, 15 nt, Homo sapiens
ucaacaguaucugug

SEQ ID NO: 689253 - RNA, 21 nt, Homo sapiens
ucaacauaggccugcucagcc

SEQ ID NO: 689254 - RNA, 19 nt, Homo sapiens
ucaacaucuuuuacauucu

SEQ ID NO: 689255 - RNA, 13 nt, Homo sapiens
ucaacaugcauug

SEQ ID NO: 689256 - RNA, 14 nt, Homo sapiens
ucaacauuaccaaa

SEQ ID NO: 689257 - RNA, 22 nt, Homo sapiens
ucaacccauauuucauccagga

SEQ ID NO: 689258 - RNA, 18 nt, Homo sapiens
ucaacccauuguugucaa

SEQ ID NO: 689259 - RNA, 17 nt, Homo sapiens
ucaaccccagacacugg

SEQ ID NO: 689260 - RNA, 16 nt, Homo sapiens
ucaaccuaacacauua

SEQ ID NO: 689261 - RNA, 20 nt, Homo sapiens
ucaaccugggacuuccuaaa

SEQ ID NO: 689262 - RNA, 18 nt, Homo sapiens
ucaaccugggcaaagccu

SEQ ID NO: 689263 - RNA, 20 nt, Homo sapiens
ucaacgcucccagacgguca

SEQ ID NO: 689264 - RNA, 13 nt, Homo sapiens
ucaacgugcauuu

SEQ ID NO: 689265 - RNA, 13 nt, Homo sapiens
ucaacuaugauau

SEQ ID NO: 689266 - RNA, 20 nt, Homo sapiens
ucaacucacagcuucuccaa

SEQ ID NO: 689267 - RNA, 12 nt, Homo sapiens
ucaacucugauc

SEQ ID NO: 689268 - RNA, 17 nt, Homo sapiens
ucaacugaaugagguca

SEQ ID NO: 689269 - RNA, 11 nt, Homo sapiens
ucaacugccua

SEQ ID NO: 689270 - RNA, 21 nt, Homo sapiens
ucaacuggggaauugaagcca

SEQ ID NO: 689271 - RNA, 19 nt, Homo sapiens
ucaacuguuuuugucuaca

SEQ ID NO: 689272 - RNA, 21 nt, Homo sapiens
ucaacuuaccaggcaccaaaa

SEQ ID NO: 689273 - RNA, 19 nt, Homo sapiens
ucaacuucuggcuccucaa

SEQ ID NO: 689274 - RNA, 12 nt, Homo sapiens
ucaacuuugaca

SEQ ID NO: 689275 - RNA, 17 nt, Homo sapiens
ucaagaaaaaaagggag

SEQ ID NO: 689276 - RNA, 15 nt, Homo sapiens
ucaagaaaaucuuug

SEQ ID NO: 689277 - RNA, 17 nt, Homo sapiens
ucaagaacaaacacugc

SEQ ID NO: 689278 - RNA, 21 nt, Homo sapiens
ucaagaaccgguuuccaaaga

SEQ ID NO: 689279 - RNA, 14 nt, Homo sapiens
ucaagaauagcauu

SEQ ID NO: 689280 - RNA, 13 nt, Homo sapiens
ucaagaaugcaau

SEQ ID NO: 689281 - RNA, 21 nt, Homo sapiens
ucaagaauuuuuugacuugaa

SEQ ID NO: 689282 - RNA, 13 nt, Homo sapiens
ucaagacacugag

SEQ ID NO: 689283 - RNA, 20 nt, Homo sapiens
ucaagaccagccugggcaac

SEQ ID NO: 689284 - RNA, 19 nt, Homo sapiens
ucaagaccauagugaccaa

SEQ ID NO: 689285 - RNA, 15 nt, Homo sapiens
ucaagagacugaguc

SEQ ID NO: 689286 - RNA, 18 nt, Homo sapiens
ucaagagaucgagaccau

SEQ ID NO: 689287 - RNA, 16 nt, Homo sapiens
ucaagagcaugcacau

SEQ ID NO: 689288 - RNA, 16 nt, Homo sapiens
ucaagaggcagaguuc

SEQ ID NO: 689289 - RNA, 18 nt, Homo sapiens
ucaagaguaguuauauaa

SEQ ID NO: 689290 - RNA, 20 nt, Homo sapiens
ucaagaguccggauuucuaa

SEQ ID NO: 689291 - RNA, 21 nt, Homo sapiens
ucaagauaauccuagagucuu

SEQ ID NO: 689292 - RNA, 19 nt, Homo sapiens
ucaagauauauguguauac

SEQ ID NO: 689293 - RNA, 16 nt, Homo sapiens
ucaagaucaacauucc

SEQ ID NO: 689294 - RNA, 17 nt, Homo sapiens
ucaagaucaacauucca

SEQ ID NO: 689295 - RNA, 18 nt, Homo sapiens
ucaagaugagagaacugg

SEQ ID NO: 689296 - RNA, 23 nt, Homo sapiens
ucaagauucuacuuggugguuug

SEQ ID NO: 689297 - RNA, 18 nt, Homo sapiens
ucaagauuugaccaaauc

SEQ ID NO: 689298 - RNA, 22 nt, Homo sapiens
ucaagcaaaaugcuuacagggc

SEQ ID NO: 689299 - RNA, 16 nt, Homo sapiens
ucaagcaaacaucaaa

SEQ ID NO: 689300 - RNA, 20 nt, Homo sapiens
ucaagcaauccuccuaccuc

SEQ ID NO: 689301 - RNA, 14 nt, Homo sapiens
ucaagcacauguaa

SEQ ID NO: 689302 - RNA, 18 nt, Homo sapiens
ucaagcaccugcaugugc

SEQ ID NO: 689303 - RNA, 17 nt, Homo sapiens
ucaagcacuuacagcuc

SEQ ID NO: 689304 - RNA, 19 nt, Homo sapiens
ucaagcagagaaaauaauu

SEQ ID NO: 689305 - RNA, 15 nt, Homo sapiens
ucaagcaggacccua

SEQ ID NO: 689306 - RNA, 13 nt, Homo sapiens
ucaagcaugcaau

SEQ ID NO: 689307 - RNA, 22 nt, Homo sapiens
ucaagccagcccccuccagcuc

SEQ ID NO: 689308 - RNA, 11 nt, Homo sapiens
ucaagccaugg

SEQ ID NO: 689309 - RNA, 20 nt, Homo sapiens
ucaagccccacgaugacugc

SEQ ID NO: 689310 - RNA, 22 nt, Homo sapiens
ucaagccuagcccuucucucau

SEQ ID NO: 689311 - RNA, 21 nt, Homo sapiens
ucaagccuccccaguucuacu

SEQ ID NO: 689312 - RNA, 18 nt, Homo sapiens
ucaagcugagauugagca

SEQ ID NO: 689313 - RNA, 16 nt, Homo sapiens
ucaagcuuacuacagu

SEQ ID NO: 689314 - RNA, 21 nt, Homo sapiens
ucaaggaagggacaagacaaa

SEQ ID NO: 689315 - RNA, 20 nt, Homo sapiens
ucaaggaguacaaugcccag

SEQ ID NO: 689316 - RNA, 19 nt, Homo sapiens
ucaaggcaguagaacucca

SEQ ID NO: 689317 - RNA, 21 nt, Homo sapiens
ucaaggcccauaucugugaaa

SEQ ID NO: 689318 - RNA, 22 nt, Homo sapiens
ucaaggcccucagagaugauca

SEQ ID NO: 689319 - RNA, 17 nt, Homo sapiens
ucaaggccuucaguuua

SEQ ID NO: 689320 - RNA, 18 nt, Homo sapiens
ucaaggccuucaguuuau

SEQ ID NO: 689321 - RNA, 15 nt, Homo sapiens
ucaaggcugcaguga

SEQ ID NO: 689322 - RNA, 23 nt, Homo sapiens
ucacuggaaugaagaccaugccu

SEQ ID NO: 689323 - RNA, 14 nt, Homo sapiens
ucacuggacugcau

SEQ ID NO: 689324 - RNA, 18 nt, Homo sapiens
ucacuggggggcucucag

SEQ ID NO: 689325 - RNA, 17 nt, Homo sapiens
ucacuguaaaugguaau

SEQ ID NO: 689326 - RNA, 12 nt, Homo sapiens
ucacuguacugc

SEQ ID NO: 689327 - RNA, 14 nt, Homo sapiens
ucacuguacugcau

SEQ ID NO: 689328 - RNA, 23 nt, Homo sapiens
ucacuguagaaugauuucaugcu

SEQ ID NO: 689329 - RNA, 15 nt, Homo sapiens
ucacugucaccaccc

SEQ ID NO: 689330 - RNA, 19 nt, Homo sapiens
ucacugucagggucuuucu

SEQ ID NO: 689331 - RNA, 16 nt, Homo sapiens
ucacugucaucuucaa

SEQ ID NO: 689332 - RNA, 19 nt, Homo sapiens
ucacugucccucaaaugac

SEQ ID NO: 689333 - RNA, 14 nt, Homo sapiens
ucacuguccuccaa

SEQ ID NO: 689334 - RNA, 13 nt, Homo sapiens
ucacuguccuguu

SEQ ID NO: 689335 - RNA, 22 nt, Homo sapiens
ucacugucuuuaauucuguauc

SEQ ID NO: 689336 - RNA, 20 nt, Homo sapiens
ucacuguuuguuacuaugua

SEQ ID NO: 689337 - RNA, 15 nt, Homo sapiens
ucacuuaagccugga

SEQ ID NO: 689338 - RNA, 14 nt, Homo sapiens
ucacuuaaucuuuc

SEQ ID NO: 689339 - RNA, 20 nt, Homo sapiens
ucacuuauuucauaaacaac

SEQ ID NO: 689340 - RNA, 16 nt, Homo sapiens
ucacuucaauguguca

SEQ ID NO: 689341 - RNA, 15 nt, Homo sapiens
ucacuucauaaucca

SEQ ID NO: 689342 - RNA, 18 nt, Homo sapiens
ucacuucauuuaucuuaa

SEQ ID NO: 689343 - RNA, 18 nt, Homo sapiens
ucacuucucacaaugucc

SEQ ID NO: 689344 - RNA, 15 nt, Homo sapiens
ucacuugccaugcag

SEQ ID NO: 689345 - RNA, 18 nt, Homo sapiens
ucacuugccaugcaggaa

SEQ ID NO: 689346 - RNA, 12 nt, Homo sapiens
ucacuugccuua

SEQ ID NO: 689347 - RNA, 17 nt, Homo sapiens
ucacuugucgggggccc

SEQ ID NO: 689348 - RNA, 20 nt, Homo sapiens
ucacuuuacaaauucaagcc

SEQ ID NO: 689349 - RNA, 16 nt, Homo sapiens
ucacuuuagaugcuga

SEQ ID NO: 689350 - RNA, 16 nt, Homo sapiens
ucacuuuauuaucccu

SEQ ID NO: 689351 - RNA, 18 nt, Homo sapiens
ucacuuuccaccaagugu

SEQ ID NO: 689352 - RNA, 12 nt, Homo sapiens
ucacuuugccuu

SEQ ID NO: 689353 - RNA, 23 nt, Homo sapiens
ucacuuugcucucaauuaaaguc

SEQ ID NO: 689354 - RNA, 17 nt, Homo sapiens
ucacuuuuaaugaacaa

SEQ ID NO: 689355 - RNA, 17 nt, Homo sapiens
ucacuuuuacuacccca

SEQ ID NO: 689356 - RNA, 18 nt, Homo sapiens
ucacuuuucuccaugagu

SEQ ID NO: 689357 - RNA, 22 nt, Homo sapiens
ucacuuuuuuugaggacauuga

SEQ ID NO: 689358 - RNA, 23 nt, Homo sapiens
ucagaaaagaugugcagauauca

SEQ ID NO: 689359 - RNA, 13 nt, Homo sapiens
ucagaaaaguaau

SEQ ID NO: 689360 - RNA, 16 nt, Homo sapiens
ucagaaaagugacagu

SEQ ID NO: 689361 - RNA, 17 nt, Homo sapiens
ucagaaaauaacagaug

SEQ ID NO: 689362 - RNA, 13 nt, Homo sapiens
ucagaaagcaaua

SEQ ID NO: 689363 - RNA, 12 nt, Homo sapiens
ucagaaagccaa

SEQ ID NO: 689364 - RNA, 13 nt, Homo sapiens
ucagaaagucaua

SEQ ID NO: 689365 - RNA, 17 nt, Homo sapiens
ucagaacaagcaauugu

SEQ ID NO: 689366 - RNA, 18 nt, Homo sapiens
ucagaacacucaaagguu

SEQ ID NO: 689367 - RNA, 14 nt, Homo sapiens
ucagaacacuccaa

SEQ ID NO: 689368 - RNA, 12 nt, Homo sapiens
ucagaaccagag

SEQ ID NO: 689369 - RNA, 16 nt, Homo sapiens
ucagaacuggcugugg

SEQ ID NO: 689370 - RNA, 14 nt, Homo sapiens
ucagaacuuucuag

SEQ ID NO: 689371 - RNA, 19 nt, Homo sapiens
ucagaagaccccugacuca

SEQ ID NO: 689372 - RNA, 16 nt, Homo sapiens
ucagaagcaagccaga

SEQ ID NO: 689373 - RNA, 18 nt, Homo sapiens
ucagaaggauggcauuuu

SEQ ID NO: 689374 - RNA, 20 nt, Homo sapiens
ucagaaggccccagagagac

SEQ ID NO: 689375 - RNA, 21 nt, Homo sapiens
ucagaauaaggcaggcauuga

SEQ ID NO: 689376 - RNA, 15 nt, Homo sapiens
ucagaauagccacau

SEQ ID NO: 689377 - RNA, 23 nt, Homo sapiens
ucagaauaggaaaacauugcaau

SEQ ID NO: 689378 - RNA, 22 nt, Homo sapiens
ucagaaucauugaaguauuuuc

SEQ ID NO: 689379 - RNA, 15 nt, Homo sapiens
ucagaauccacaacu

SEQ ID NO: 689380 - RNA, 18 nt, Homo sapiens
ucagaaugcucacacuga

SEQ ID NO: 689381 - RNA, 16 nt, Homo sapiens
ucagaauuaagcagaa

SEQ ID NO: 689382 - RNA, 17 nt, Homo sapiens
ucagaauuggaaucaca

SEQ ID NO: 689383 - RNA, 17 nt, Homo sapiens
ucagaauuuguguugaa

SEQ ID NO: 689384 - RNA, 13 nt, Homo sapiens
ucagacacagcuc

SEQ ID NO: 689385 - RNA, 14 nt, Homo sapiens
ucagacacaggaaa

SEQ ID NO: 689386 - RNA, 19 nt, Homo sapiens
ucagacacccucuccuuaa

SEQ ID NO: 689387 - RNA, 13 nt, Homo sapiens
ucagacacuuugg

SEQ ID NO: 689388 - RNA, 14 nt, Homo sapiens
ucagacagcuugaa

SEQ ID NO: 689389 - RNA, 13 nt, Homo sapiens
ucagacaggcaaa

SEQ ID NO: 689390 - RNA, 21 nt, Homo sapiens
ucagacaguggaugagacaca

SEQ ID NO: 689391 - RNA, 12 nt, Homo sapiens
ucagacauacag

SEQ ID NO: 689392 - RNA, 18 nt, Homo sapiens
ucagacauacagcugccu

SEQ ID NO: 689393 - RNA, 13 nt, Homo sapiens
ucagacauuccaa

SEQ ID NO: 689394 - RNA, 23 nt, Homo sapiens
ucagaccuuuacugauacuacaa

SEQ ID NO: 689395 - RNA, 17 nt, Homo sapiens
ucagacuccugugcaac

SEQ ID NO: 689396 - RNA, 19 nt, Homo sapiens
ucagacuugucaagccugu

SEQ ID NO: 689397 - RNA, 15 nt, Homo sapiens
ucagacuuugcugca

SEQ ID NO: 689398 - RNA, 22 nt, Homo sapiens
ucagacuuuguguucauuucau

SEQ ID NO: 689399 - RNA, 18 nt, Homo sapiens
ucagagaaauacuuucag

SEQ ID NO: 689400 - RNA, 15 nt, Homo sapiens
ucagagaacuuuccc

SEQ ID NO: 689401 - RNA, 12 nt, Homo sapiens
ucagagacagau

SEQ ID NO: 689402 - RNA, 14 nt, Homo sapiens
ucagagacagauac

SEQ ID NO: 689403 - RNA, 19 nt, Homo sapiens
ucagagacagauaccucca

SEQ ID NO: 689404 - RNA, 16 nt, Homo sapiens
ucagagaccagcacuc

SEQ ID NO: 689405 - RNA, 20 nt, Homo sapiens
ucagagacuauguagcaaua

SEQ ID NO: 689406 - RNA, 22 nt, Homo sapiens
ucagagagccuagaacaucccu

SEQ ID NO: 689407 - RNA, 14 nt, Homo sapiens
ucagagcacagcag

SEQ ID NO: 689408 - RNA, 22 nt, Homo sapiens
ucagagccagccggcuaugaaa

SEQ ID NO: 689409 - RNA, 14 nt, Homo sapiens
ucagagccagugaa

SEQ ID NO: 689410 - RNA, 21 nt, Homo sapiens
ucagagcccagucgagaccuc

SEQ ID NO: 689411 - RNA, 17 nt, Homo sapiens
ucagagccuuuccucaa

SEQ ID NO: 689412 - RNA, 15 nt, Homo sapiens
ucagagcuaaacucc

SEQ ID NO: 689413 - RNA, 17 nt, Homo sapiens
ucagagcugagaugugg

SEQ ID NO: 689414 - RNA, 16 nt, Homo sapiens
ucagaggaagacaucu

SEQ ID NO: 689415 - RNA, 19 nt, Homo sapiens
ucagaggaccccagggugg

SEQ ID NO: 689416 - RNA, 21 nt, Homo sapiens
ucagaggacuggacgugcuca

SEQ ID NO: 689417 - RNA, 17 nt, Homo sapiens
ucagaggagcgcaggca

SEQ ID NO: 689418 - RNA, 20 nt, Homo sapiens
ucagaggagcggccagaaga

SEQ ID NO: 689419 - RNA, 14 nt, Homo sapiens
ucagaggagcugca

SEQ ID NO: 689420 - RNA, 16 nt, Homo sapiens
ucagaggggacucuga

SEQ ID NO: 689421 - RNA, 16 nt, Homo sapiens
ucagaguccuugcaaa

SEQ ID NO: 689422 - RNA, 16 nt, Homo sapiens
ucagagugacagucau

SEQ ID NO: 689423 - RNA, 22 nt, Homo sapiens
ucagaguggaguugaaacugcu

SEQ ID NO: 689424 - RNA, 17 nt, Homo sapiens
ucagaguuuguguguau

SEQ ID NO: 689425 - RNA, 21 nt, Homo sapiens
ucagaguuuguguguauuugu

SEQ ID NO: 689426 - RNA, 22 nt, Homo sapiens
ucagaguuuguguguauuugua

SEQ ID NO: 689427 - RNA, 23 nt, Homo sapiens
ucagaguuuuuauuuuguuacaa

SEQ ID NO: 689428 - RNA, 18 nt, Homo sapiens
ucagauaccgacuggggc

SEQ ID NO: 689429 - RNA, 16 nt, Homo sapiens
ucagauaucaaaauuc

SEQ ID NO: 689430 - RNA, 15 nt, Homo sapiens
ucagauauucugcuc

SEQ ID NO: 689431 - RNA, 21 nt, Homo sapiens
ucagauauuuuuucagaaaua

SEQ ID NO: 689432 - RNA, 17 nt, Homo sapiens
ucagaucauauuucaca

SEQ ID NO: 689433 - RNA, 17 nt, Homo sapiens
ucagauccccagcuuuc

SEQ ID NO: 689434 - RNA, 19 nt, Homo sapiens
ucagaucguucauugccuu

SEQ ID NO: 689435 - RNA, 19 nt, Homo sapiens
ucagaucuaucuugucaau

SEQ ID NO: 689436 - RNA, 16 nt, Homo sapiens
ucagaugaacucuuag

SEQ ID NO: 689437 - RNA, 21 nt, Homo sapiens
ucagaugauucagaaauuuuc

SEQ ID NO: 689438 - RNA, 23 nt, Homo sapiens
ucagaugcuguuaguaccuacau

SEQ ID NO: 689439 - RNA, 13 nt, Homo sapiens
ucagaugucucug

SEQ ID NO: 689440 - RNA, 20 nt, Homo sapiens
ucagauuauuuaaaugggaa

SEQ ID NO: 689441 - RNA, 22 nt, Homo sapiens
ucagauucaauaaugagagcuc

SEQ ID NO: 689442 - RNA, 12 nt, Homo sapiens
ucagauuccacc

SEQ ID NO: 689443 - RNA, 19 nt, Homo sapiens
ucagauugaauguauuuaa

SEQ ID NO: 689444 - RNA, 18 nt, Homo sapiens
ucagauuguuaucuauca

SEQ ID NO: 689445 - RNA, 18 nt, Homo sapiens
uccccaaauggcugcuuu

SEQ ID NO: 689446 - RNA, 19 nt, Homo sapiens
uccccaacaagauugcuua

SEQ ID NO: 689447 - RNA, 18 nt, Homo sapiens
uccccaaccccucagauu

SEQ ID NO: 689448 - RNA, 22 nt, Homo sapiens
uccccaaucccggucaugcuuu

SEQ ID NO: 689449 - RNA, 22 nt, Homo sapiens
uccccaauuggcucuagucacu

SEQ ID NO: 689450 - RNA, 16 nt, Homo sapiens
uccccacacagccucu

SEQ ID NO: 689451 - RNA, 15 nt, Homo sapiens
uccccacacuccacu

SEQ ID NO: 689452 - RNA, 14 nt, Homo sapiens
uccccacauaccau

SEQ ID NO: 689453 - RNA, 13 nt, Homo sapiens
uccccacccaaga

SEQ ID NO: 689454 - RNA, 16 nt, Homo sapiens
uccccaccucuucccu

SEQ ID NO: 689455 - RNA, 20 nt, Homo sapiens
uccccaccuuccccagacuc

SEQ ID NO: 689456 - RNA, 13 nt, Homo sapiens
uccccacucccuu

SEQ ID NO: 689457 - RNA, 12 nt, Homo sapiens
uccccacugcuc

SEQ ID NO: 689458 - RNA, 13 nt, Homo sapiens
uccccacugcuga

SEQ ID NO: 689459 - RNA, 18 nt, Homo sapiens
uccccacuucugugccac

SEQ ID NO: 689460 - RNA, 18 nt, Homo sapiens
uccccagaaacagugugc

SEQ ID NO: 689461 - RNA, 17 nt, Homo sapiens
ucgcaugacuguuacag

SEQ ID NO: 689462 - RNA, 16 nt, Homo sapiens
ucgccaaucaucauua

SEQ ID NO: 689463 - RNA, 22 nt, Homo sapiens
ucgccaccacuuccagagccag

SEQ ID NO: 689464 - RNA, 17 nt, Homo sapiens
ucgccagucacugcugc

SEQ ID NO: 689465 - RNA, 17 nt, Homo sapiens
ucgcccgcccacacggc

SEQ ID NO: 689466 - RNA, 18 nt, Homo sapiens
ucgcccuacucaccugag

SEQ ID NO: 689467 - RNA, 20 nt, Homo sapiens
ucgcuaugugacuugcgcuu

SEQ ID NO: 689468 - RNA, 21 nt, Homo sapiens
ucgcuaugugacuugcgcuua

SEQ ID NO: 689469 - RNA, 21 nt, Homo sapiens
ucgcuauugauuuuuacuuca

SEQ ID NO: 689470 - RNA, 22 nt, Homo sapiens
ucgcuauugauuuuuacuucaa

SEQ ID NO: 689471 - RNA, 18 nt, Homo sapiens
ucgcuccagacuugggaa

SEQ ID NO: 689472 - RNA, 14 nt, Homo sapiens
ucgcuccuccuucc

SEQ ID NO: 689473 - RNA, 15 nt, Homo sapiens
ucgcuuugccuauug

SEQ ID NO: 689474 - RNA, 16 nt, Homo sapiens
ucgcuuuguugcccag

SEQ ID NO: 689475 - RNA, 19 nt, Homo sapiens
ucggaagggguuccucaaa

SEQ ID NO: 689476 - RNA, 22 nt, Homo sapiens
ucggaggccauccugccagggg

SEQ ID NO: 689477 - RNA, 21 nt, Homo sapiens
ucggagucuguaaaaccagca

SEQ ID NO: 689478 - RNA, 17 nt, Homo sapiens
ucggaugaccaaaccag

SEQ ID NO: 689479 - RNA, 11 nt, Homo sapiens
ucggaugucag

SEQ ID NO: 689480 - RNA, 13 nt, Homo sapiens
ucggcacccugca

SEQ ID NO: 689481 - RNA, 21 nt, Homo sapiens
ucggccaggcuggagugcagu

SEQ ID NO: 689482 - RNA, 14 nt, Homo sapiens
ucggccccagcaca

SEQ ID NO: 689483 - RNA, 16 nt, Homo sapiens
ucggccccagcacaug

SEQ ID NO: 689484 - RNA, 14 nt, Homo sapiens
ucggcccuggggua

SEQ ID NO: 689485 - RNA, 14 nt, Homo sapiens
ucggccgucuucac

SEQ ID NO: 689486 - RNA, 16 nt, Homo sapiens
ucggcuccaccccagg

SEQ ID NO: 689487 - RNA, 11 nt, Homo sapiens
ucggcuggaag

SEQ ID NO: 689488 - RNA, 12 nt, Homo sapiens
ucggcuugauca

SEQ ID NO: 689489 - RNA, 14 nt, Homo sapiens
ucgggaacaguguu

SEQ ID NO: 689490 - RNA, 16 nt, Homo sapiens
ucgggaccacaucugu

SEQ ID NO: 689491 - RNA, 20 nt, Homo sapiens
ucgggacuugaaaaccacua

SEQ ID NO: 689492 - RNA, 19 nt, Homo sapiens
ucgggacuuguaacauaga

SEQ ID NO: 689493 - RNA, 12 nt, Homo sapiens
ucgggagcugca

SEQ ID NO: 689494 - RNA, 17 nt, Homo sapiens
ucgggcagggccccuga

SEQ ID NO: 689495 - RNA, 22 nt, Homo sapiens
ucggggaacuccuggaaauauc

SEQ ID NO: 689496 - RNA, 10 nt, Homo sapiens
ucggggagcu

SEQ ID NO: 689497 - RNA, 15 nt, Homo sapiens
ucgggggcuguggau

SEQ ID NO: 689498 - RNA, 17 nt, Homo sapiens
ucggguggccugcgcua

SEQ ID NO: 689499 - RNA, 20 nt, Homo sapiens
ucgguagaggauuucuaguu

SEQ ID NO: 689500 - RNA, 22 nt, Homo sapiens
ucggucacuccaacucccuuaa

SEQ ID NO: 689501 - RNA, 16 nt, Homo sapiens
ucgguggcucaugccu

SEQ ID NO: 689502 - RNA, 12 nt, Homo sapiens
ucgguggcugcc

SEQ ID NO: 689503 - RNA, 12 nt, Homo sapiens
ucggugugcacc

SEQ ID NO: 689504 - RNA, 18 nt, Homo sapiens
ucguagccuaaaagacaa

SEQ ID NO: 689505 - RNA, 19 nt, Homo sapiens
ucgucaagagcaugcacau

SEQ ID NO: 689506 - RNA, 19 nt, Homo sapiens
ucgugaaaccccaucucua

SEQ ID NO: 689507 - RNA, 20 nt, Homo sapiens
ucgugcccaucaagugcagu

SEQ ID NO: 689508 - RNA, 21 nt, Homo sapiens
ucgugcccaucaagugcaguc

SEQ ID NO: 689509 - RNA, 19 nt, Homo sapiens
ucgugggucagcucugagg

SEQ ID NO: 689510 - RNA, 20 nt, Homo sapiens
ucguggguguguguagccaa

SEQ ID NO: 689511 - RNA, 19 nt, Homo sapiens
ucgugguaggacuguagaa

SEQ ID NO: 689512 - RNA, 18 nt, Homo sapiens
ucguguaauuggcccaag

SEQ ID NO: 689513 - RNA, 14 nt, Homo sapiens
ucgugucagcucag

SEQ ID NO: 689514 - RNA, 15 nt, Homo sapiens
ucgugugcugcugcu

SEQ ID NO: 689515 - RNA, 18 nt, Homo sapiens
ucguguggcuccugguaa

SEQ ID NO: 689516 - RNA, 13 nt, Homo sapiens
ucguuaccagaga

SEQ ID NO: 689517 - RNA, 13 nt, Homo sapiens
ucguucccagugu

SEQ ID NO: 689518 - RNA, 15 nt, Homo sapiens
ucguucucugccuca

SEQ ID NO: 689519 - RNA, 21 nt, Homo sapiens
ucguuuaaaaacaaaggaaua

SEQ ID NO: 689520 - RNA, 14 nt, Homo sapiens
ucguuuaccaaaua

SEQ ID NO: 689521 - RNA, 18 nt, Homo sapiens
ucguuuucauaacuugcu

SEQ ID NO: 689522 - RNA, 16 nt, Homo sapiens
ucguuuugaugccauu

SEQ ID NO: 689523 - RNA, 20 nt, Homo sapiens
ucuaaacaucuuuguugaug

SEQ ID NO: 689524 - RNA, 18 nt, Homo sapiens
ucuaaaccagaggacaaa

SEQ ID NO: 689525 - RNA, 13 nt, Homo sapiens
ucuaaacuacaac

SEQ ID NO: 689526 - RNA, 21 nt, Homo sapiens
ucuaaacuuccccaucuucua

SEQ ID NO: 689527 - RNA, 16 nt, Homo sapiens
ucuaaagaauguguuc

SEQ ID NO: 689528 - RNA, 16 nt, Homo sapiens
ucuaaagagcaucuga

SEQ ID NO: 689529 - RNA, 20 nt, Homo sapiens
ucuaaagauggaaaaaccac

SEQ ID NO: 689530 - RNA, 15 nt, Homo sapiens
ucuaaagguaccaaa

SEQ ID NO: 689531 - RNA, 13 nt, Homo sapiens
ucuaaaucauaua

SEQ ID NO: 689532 - RNA, 20 nt, Homo sapiens
ucuaaaugaaugagccaaaa

SEQ ID NO: 689533 - RNA, 23 nt, Homo sapiens
ucuaaaugcauauccugagccau

SEQ ID NO: 689534 - RNA, 12 nt, Homo sapiens
ucuaaaugccca

SEQ ID NO: 689535 - RNA, 19 nt, Homo sapiens
ucuaaauuacagugcaguu

SEQ ID NO: 689536 - RNA, 16 nt, Homo sapiens
ucuaacaaaaacuaca

SEQ ID NO: 689537 - RNA, 17 nt, Homo sapiens
ucuaacaaaacaaguug

SEQ ID NO: 689538 - RNA, 23 nt, Homo sapiens
ucuaacaccaacauaagguacua

SEQ ID NO: 689539 - RNA, 21 nt, Homo sapiens
ucuaacagaucagaacaugaa

SEQ ID NO: 689540 - RNA, 21 nt, Homo sapiens
ucuaacauauucaaugcaagu

SEQ ID NO: 689541 - RNA, 21 nt, Homo sapiens
ucuaaccuugaaugcugccag

SEQ ID NO: 689542 - RNA, 23 nt, Homo sapiens
ucuaacuauauguacagcucucc

SEQ ID NO: 689543 - RNA, 16 nt, Homo sapiens
ucuaacuguagcuauc

SEQ ID NO: 689544 - RNA, 15 nt, Homo sapiens
ucuaagaaccaaaaa

SEQ ID NO: 689545 - RNA, 16 nt, Homo sapiens
ucuaagccaguuuuca

SEQ ID NO: 689546 - RNA, 18 nt, Homo sapiens
ucuaaggcaggaauuuga

SEQ ID NO: 689547 - RNA, 20 nt, Homo sapiens
ucuaagguaguaacuuucca

SEQ ID NO: 689548 - RNA, 15 nt, Homo sapiens
ucuaagucauguaug

SEQ ID NO: 689549 - RNA, 12 nt, Homo sapiens
ucuaagugauau

SEQ ID NO: 689550 - RNA, 14 nt, Homo sapiens
ucuaagugggagaa

SEQ ID NO: 689551 - RNA, 19 nt, Homo sapiens
ucuaauaaaauauaaucua

SEQ ID NO: 689552 - RNA, 14 nt, Homo sapiens
ucuaauaaacuugg

SEQ ID NO: 689553 - RNA, 19 nt, Homo sapiens
ucuaauaaauauacuauga

SEQ ID NO: 689554 - RNA, 21 nt, Homo sapiens
ucuaauaguuuuucacuuugu

SEQ ID NO: 689555 - RNA, 14 nt, Homo sapiens
ucuaaucuagugac

SEQ ID NO: 689556 - RNA, 14 nt, Homo sapiens
ucuaaugagcauuu

SEQ ID NO: 689557 - RNA, 15 nt, Homo sapiens
ucuaaugcauguauu

SEQ ID NO: 689558 - RNA, 21 nt, Homo sapiens
ucuaauguacaauaaagcaau

SEQ ID NO: 689559 - RNA, 12 nt, Homo sapiens
ucuaaugucuuc

SEQ ID NO: 689560 - RNA, 14 nt, Homo sapiens
ucuaaugugcauua

SEQ ID NO: 689561 - RNA, 23 nt, Homo sapiens
ucuaccagucuauuuccacugaa

SEQ ID NO: 689562 - RNA, 16 nt, Homo sapiens
ucuaccccugcuccca

SEQ ID NO: 689563 - RNA, 18 nt, Homo sapiens
ucuacccggcccagagac

SEQ ID NO: 689564 - RNA, 19 nt, Homo sapiens
ucuacccugcugaccuccc

SEQ ID NO: 689565 - RNA, 22 nt, Homo sapiens
ucuaccgggaggacagcugccu

SEQ ID NO: 689566 - RNA, 15 nt, Homo sapiens
ucuaccugagcauuc

SEQ ID NO: 689567 - RNA, 19 nt, Homo sapiens
ucuacgugauuuggcugca

SEQ ID NO: 689568 - RNA, 13 nt, Homo sapiens
ucuacgugcuccu

SEQ ID NO: 689569 - RNA, 15 nt, Homo sapiens
ucuacuaaaaauaca

SEQ ID NO: 689570 - RNA, 19 nt, Homo sapiens
ucuacuaaaaauacaaaaa

SEQ ID NO: 689571 - RNA, 15 nt, Homo sapiens
ucuacuaacaaucag

SEQ ID NO: 689572 - RNA, 21 nt, Homo sapiens
ucuacuacaaacuucaaagag

SEQ ID NO: 689573 - RNA, 13 nt, Homo sapiens
ucuacucccaagu

SEQ ID NO: 689574 - RNA, 19 nt, Homo sapiens
ucuacugaccuuuguccuu

SEQ ID NO: 689575 - RNA, 17 nt, Homo sapiens
ucuacugcuaaauaagu

SEQ ID NO: 689576 - RNA, 21 nt, Homo sapiens
ucuacuggaaauguagcacuu

SEQ ID NO: 689577 - RNA, 22 nt, Homo sapiens
ucuacugugacugauguuacau

SEQ ID NO: 689578 - RNA, 15 nt, Homo sapiens
ucuacuucagucuuc

SEQ ID NO: 689579 - RNA, 21 nt, Homo sapiens
ucuacuuccccuucuugccau

SEQ ID NO: 689580 - RNA, 14 nt, Homo sapiens
ucuacuuguaaaag

SEQ ID NO: 689581 - RNA, 14 nt, Homo sapiens
ucuagaaacucugg

SEQ ID NO: 689582 - RNA, 21 nt, Homo sapiens
ucuagaaagcucuaaagacca

SEQ ID NO: 689583 - RNA, 15 nt, Homo sapiens
ucuagaagacuguca

SEQ ID NO: 689584 - RNA, 13 nt, Homo sapiens
ucuagaagcacau

SEQ ID NO: 689585 - RNA, 19 nt, Homo sapiens
ucuagaaucauacuuaaca

SEQ ID NO: 689586 - RNA, 22 nt, Homo sapiens
ucuagaaugucugaaguacaaa

SEQ ID NO: 689587 - RNA, 12 nt, Homo sapiens
ucuagaauuugg

SEQ ID NO: 689588 - RNA, 16 nt, Homo sapiens
ucuagacuugugcuga

SEQ ID NO: 689589 - RNA, 17 nt, Homo sapiens
ucuagagacacauugga

SEQ ID NO: 689590 - RNA, 14 nt, Homo sapiens
ucuagagucacuga

SEQ ID NO: 689591 - RNA, 16 nt, Homo sapiens
ucuagagucacugaua

SEQ ID NO: 689592 - RNA, 15 nt, Homo sapiens
ucuagagucauguga

SEQ ID NO: 689593 - RNA, 23 nt, Homo sapiens
ucuagauacaauaaauugcuaau

SEQ ID NO: 689594 - RNA, 16 nt, Homo sapiens
ucuagaugcaaauaca

SEQ ID NO: 689595 - RNA, 18 nt, Homo sapiens
ucuagauuauaaacugac

SEQ ID NO: 689596 - RNA, 18 nt, Homo sapiens
ucuagauuauggagcuuu

SEQ ID NO: 689597 - RNA, 18 nt, Homo sapiens
ucuagauuuucuacuuua

SEQ ID NO: 689598 - RNA, 16 nt, Homo sapiens
ucuagcaccaggacuc

SEQ ID NO: 689599 - RNA, 14 nt, Homo sapiens
ucuagcacuccuca

SEQ ID NO: 689600 - RNA, 21 nt, Homo sapiens
ucuagccagagcccuucacug

SEQ ID NO: 689601 - RNA, 15 nt, Homo sapiens
ucuaggaugugauga

SEQ ID NO: 689602 - RNA, 14 nt, Homo sapiens
ucuaggcuaagcac

SEQ ID NO: 689603 - RNA, 16 nt, Homo sapiens
ucuaggcuaagcacuu

SEQ ID NO: 689604 - RNA, 16 nt, Homo sapiens
ucuagggaaaaaccag

SEQ ID NO: 689605 - RNA, 23 nt, Homo sapiens
ucuagggaaauuuuucagacuuu

SEQ ID NO: 689606 - RNA, 19 nt, Homo sapiens
ucuaggggugccucugugu

SEQ ID NO: 689607 - RNA, 20 nt, Homo sapiens
ucuagguggagguugugcau

SEQ ID NO: 689608 - RNA, 15 nt, Homo sapiens
ucuagguuauacaau

SEQ ID NO: 689609 - RNA, 21 nt, Homo sapiens
ucuaguaagaugcacugaaaa

SEQ ID NO: 689610 - RNA, 17 nt, Homo sapiens
ucuagugaaugaaucuc

SEQ ID NO: 689611 - RNA, 22 nt, Homo sapiens
ucuagugacaccucagucauau

SEQ ID NO: 689612 - RNA, 13 nt, Homo sapiens
ucuagugcaaaag

SEQ ID NO: 689613 - RNA, 15 nt, Homo sapiens
ucuagugcugugaaa

SEQ ID NO: 689614 - RNA, 19 nt, Homo sapiens
ucuaguuucacguaaauau

SEQ ID NO: 689615 - RNA, 23 nt, Homo sapiens
ucuaguuuccuuuuugagauacu

SEQ ID NO: 689616 - RNA, 14 nt, Homo sapiens
ucuaguuugcaacu

SEQ ID NO: 689617 - RNA, 16 nt, Homo sapiens
ucuauaaaauacuggu

SEQ ID NO: 689618 - RNA, 15 nt, Homo sapiens
ucuauaaacuucaga

SEQ ID NO: 689619 - RNA, 13 nt, Homo sapiens
ucuauaaauaacc

SEQ ID NO: 689620 - RNA, 21 nt, Homo sapiens
ucuauaaauccccaguuuucc

SEQ ID NO: 689621 - RNA, 14 nt, Homo sapiens
ucuauaacuccuug

SEQ ID NO: 689622 - RNA, 20 nt, Homo sapiens
ucuauacaaauuuucagaag

SEQ ID NO: 689623 - RNA, 23 nt, Homo sapiens
ucuauaccaaccaaaccaauuca

SEQ ID NO: 689624 - RNA, 21 nt, Homo sapiens
ucuauacguaauuuaaacaaa

SEQ ID NO: 689625 - RNA, 19 nt, Homo sapiens
ucuauacucagguaccucu

SEQ ID NO: 689626 - RNA, 15 nt, Homo sapiens
ucuauacuuaaucuc

SEQ ID NO: 689627 - RNA, 14 nt, Homo sapiens
ucuauauaccaaag

SEQ ID NO: 689628 - RNA, 13 nt, Homo sapiens
ucuauaucaaaaa

SEQ ID NO: 689629 - RNA, 20 nt, Homo sapiens
ucuauauuagaucaaauagu

SEQ ID NO: 689630 - RNA, 13 nt, Homo sapiens
ucuauauucucau

SEQ ID NO: 689631 - RNA, 24 nt, Homo sapiens
ucuauauuuuuuguaacauaaugc

SEQ ID NO: 689632 - RNA, 20 nt, Homo sapiens
ucuaucaccaaggagccaaa

SEQ ID NO: 689633 - RNA, 14 nt, Homo sapiens
ucuaucauggaaua

SEQ ID NO: 689634 - RNA, 19 nt, Homo sapiens
ucuauccaaagaacuugau

SEQ ID NO: 689635 - RNA, 17 nt, Homo sapiens
ucuauccuguacauuuc

SEQ ID NO: 689636 - RNA, 19 nt, Homo sapiens
ucuaugaaacugcacauug

SEQ ID NO: 689637 - RNA, 16 nt, Homo sapiens
ucuaugacacaugcaa

SEQ ID NO: 689638 - RNA, 21 nt, Homo sapiens
ucuaugccagcucagucccau

SEQ ID NO: 689639 - RNA, 17 nt, Homo sapiens
ucuaugcccacauaccc

SEQ ID NO: 689640 - RNA, 18 nt, Homo sapiens
ucuaugguugacauugua

SEQ ID NO: 689641 - RNA, 16 nt, Homo sapiens
ucuaugucucaugaug

SEQ ID NO: 689642 - RNA, 14 nt, Homo sapiens
ucuauguguaugca

SEQ ID NO: 689643 - RNA, 18 nt, Homo sapiens
ucuauguguaugcaagua

SEQ ID NO: 689644 - RNA, 17 nt, Homo sapiens
ucuauguguaugcagaa

SEQ ID NO: 689645 - RNA, 22 nt, Homo sapiens
ucuauguuugcacuugugcuuu

SEQ ID NO: 689646 - RNA, 20 nt, Homo sapiens
ucuauuaauaucaacucuga

SEQ ID NO: 689647 - RNA, 13 nt, Homo sapiens
ucuauuaucucaa

SEQ ID NO: 689648 - RNA, 16 nt, Homo sapiens
ucuauucaagcacuua

SEQ ID NO: 689649 - RNA, 13 nt, Homo sapiens
ucuauucuaagua

SEQ ID NO: 689650 - RNA, 18 nt, Homo sapiens
ucuauucuagccugcauu

SEQ ID NO: 689651 - RNA, 14 nt, Homo sapiens
ucuauugauguaca

SEQ ID NO: 689652 - RNA, 19 nt, Homo sapiens
ucuauuggccaacaauccu

SEQ ID NO: 689653 - RNA, 13 nt, Homo sapiens
ucuauugggauau

SEQ ID NO: 689654 - RNA, 13 nt, Homo sapiens
ucuauuucuauga

SEQ ID NO: 689655 - RNA, 22 nt, Homo sapiens
ucuauuuguauaucucaacaga

SEQ ID NO: 689656 - RNA, 13 nt, Homo sapiens
ucuauuugugcuu

SEQ ID NO: 689657 - RNA, 20 nt, Homo sapiens
ucuauuuuaauuacugcuau

SEQ ID NO: 689658 - RNA, 18 nt, Homo sapiens
ucuauuuuucaaucauca

SEQ ID NO: 689659 - RNA, 14 nt, Homo sapiens
ucucacuagugcca

SEQ ID NO: 689660 - RNA, 18 nt, Homo sapiens
ucucacucuguugcccag

SEQ ID NO: 689661 - RNA, 19 nt, Homo sapiens
ucucacucuguugcccagg

SEQ ID NO: 689662 - RNA, 15 nt, Homo sapiens
ucucacugccaugga

SEQ ID NO: 689663 - RNA, 22 nt, Homo sapiens
ucucacuuaccccgagaccuca

SEQ ID NO: 689664 - RNA, 11 nt, Homo sapiens
ucucacuuugg

SEQ ID NO: 689665 - RNA, 20 nt, Homo sapiens
ucucacuuuucuccaugagu

SEQ ID NO: 689666 - RNA, 20 nt, Homo sapiens
ucucacuuuuuacccagaac

SEQ ID NO: 689667 - RNA, 15 nt, Homo sapiens
ucucagaagcacaga

SEQ ID NO: 689668 - RNA, 19 nt, Homo sapiens
ucucagacugcauguacca

SEQ ID NO: 689669 - RNA, 19 nt, Homo sapiens
ucucagagaccagcacuca

SEQ ID NO: 689670 - RNA, 16 nt, Homo sapiens
ucucagagccuuccau

SEQ ID NO: 689671 - RNA, 13 nt, Homo sapiens
ucucagaguccac

SEQ ID NO: 689672 - RNA, 18 nt, Homo sapiens
ucucagagugacagucau

SEQ ID NO: 689673 - RNA, 13 nt, Homo sapiens
ucucagaugcagu

SEQ ID NO: 689674 - RNA, 21 nt, Homo sapiens
ucucagccccuuuaaaucacc

SEQ ID NO: 689675 - RNA, 16 nt, Homo sapiens
ucucagcuaacauucc

SEQ ID NO: 689676 - RNA, 18 nt, Homo sapiens
ucucagcuaccuaagaaa

SEQ ID NO: 689677 - RNA, 20 nt, Homo sapiens
ucucaggaaaaucugugauu

SEQ ID NO: 689678 - RNA, 21 nt, Homo sapiens
ucucaggauugcuaggagcuc

SEQ ID NO: 689679 - RNA, 18 nt, Homo sapiens
ucucaggcgcuucuccaa

SEQ ID NO: 689680 - RNA, 21 nt, Homo sapiens
ucucaggcucuugacuacuug

SEQ ID NO: 689681 - RNA, 15 nt, Homo sapiens
ucucagguguugcca

SEQ ID NO: 689682 - RNA, 16 nt, Homo sapiens
ucucagguguugccaa

SEQ ID NO: 689683 - RNA, 19 nt, Homo sapiens
ucucaguaugaauuauuca

SEQ ID NO: 689684 - RNA, 20 nt, Homo sapiens
ucucagucaguaauugccaa

SEQ ID NO: 689685 - RNA, 20 nt, Homo sapiens
ucucagugcuuugcauguau

SEQ ID NO: 689686 - RNA, 13 nt, Homo sapiens
ucucaguggagcc

SEQ ID NO: 689687 - RNA, 19 nt, Homo sapiens
ucucaguuauguaguuucu

SEQ ID NO: 689688 - RNA, 19 nt, Homo sapiens
ucucauagggaugcuguga

SEQ ID NO: 689689 - RNA, 18 nt, Homo sapiens
ucucauagguugagcaau

SEQ ID NO: 689690 - RNA, 18 nt, Homo sapiens
ucucaucaguauccagug

SEQ ID NO: 689691 - RNA, 19 nt, Homo sapiens
ucucaucccacgcacucca

SEQ ID NO: 689692 - RNA, 14 nt, Homo sapiens
ucucaucugugauu

SEQ ID NO: 689693 - RNA, 16 nt, Homo sapiens
ucucaugggaagggga

SEQ ID NO: 689694 - RNA, 17 nt, Homo sapiens
ucucaugggaaggggag

SEQ ID NO: 689695 - RNA, 18 nt, Homo sapiens
ucucaugggaaggggagg

SEQ ID NO: 689696 - RNA, 18 nt, Homo sapiens
ucucauguuuuccauugu

SEQ ID NO: 689697 - RNA, 20 nt, Homo sapiens
ucucauuaaaauccaguauu

SEQ ID NO: 689698 - RNA, 17 nt, Homo sapiens
ucucauuacuuauacug

SEQ ID NO: 689699 - RNA, 10 nt, Homo sapiens
ucucauuccc

SEQ ID NO: 689700 - RNA, 16 nt, Homo sapiens
ucucauuuagaacuug

SEQ ID NO: 689701 - RNA, 19 nt, Homo sapiens
ucuccaacagccagugugu

SEQ ID NO: 689702 - RNA, 18 nt, Homo sapiens
ucuccaaccacugugcca

SEQ ID NO: 689703 - RNA, 15 nt, Homo sapiens
ucuccaaggcuuuua

SEQ ID NO: 689704 - RNA, 12 nt, Homo sapiens
ucuccacaaagu

SEQ ID NO: 689705 - RNA, 23 nt, Homo sapiens
ucuccaccagccccucacaggcu

SEQ ID NO: 689706 - RNA, 19 nt, Homo sapiens
ucuccaccagcccuacucc

SEQ ID NO: 689707 - RNA, 20 nt, Homo sapiens
ucuccaccagcccuacuccu

SEQ ID NO: 689708 - RNA, 18 nt, Homo sapiens
ucuccaccuuguuacaca

SEQ ID NO: 689709 - RNA, 20 nt, Homo sapiens
ucuccacgguagcacuugac

SEQ ID NO: 689710 - RNA, 12 nt, Homo sapiens
ucuccacuccau

SEQ ID NO: 689711 - RNA, 24 nt, Homo sapiens
ucuccagccagcaaugauguccag

SEQ ID NO: 689712 - RNA, 22 nt, Homo sapiens
ucuccagccaucaagagacuga

SEQ ID NO: 689713 - RNA, 19 nt, Homo sapiens
ucuccagcucagaacccag

SEQ ID NO: 689714 - RNA, 13 nt, Homo sapiens
ucuccaggcauuu

SEQ ID NO: 689715 - RNA, 22 nt, Homo sapiens
ucuccaggcauuuagcccucac

SEQ ID NO: 689716 - RNA, 10 nt, Homo sapiens
ucuccaggga

SEQ ID NO: 689717 - RNA, 22 nt, Homo sapiens
ucuccagugguugcuguugaug

SEQ ID NO: 689718 - RNA, 14 nt, Homo sapiens
ucuccagugugcca

SEQ ID NO: 689719 - RNA, 20 nt, Homo sapiens
ucuccaucccucuaaugaga

SEQ ID NO: 689720 - RNA, 22 nt, Homo sapiens
ucuccaucccugaaauuucuca

SEQ ID NO: 689721 - RNA, 15 nt, Homo sapiens
ucuccaucucaaaaa

SEQ ID NO: 689722 - RNA, 18 nt, Homo sapiens
ucuccaugcaagauuucu

SEQ ID NO: 689723 - RNA, 14 nt, Homo sapiens
ucuccauuuuacag

SEQ ID NO: 689724 - RNA, 21 nt, Homo sapiens
ucuccauuuucuucucuguga

SEQ ID NO: 689725 - RNA, 18 nt, Homo sapiens
ucucccaaaaaacuacuu

SEQ ID NO: 689726 - RNA, 18 nt, Homo sapiens
ucucccaaagccccaaau

SEQ ID NO: 689727 - RNA, 19 nt, Homo sapiens
ucucccaacucaagguucu

SEQ ID NO: 689728 - RNA, 20 nt, Homo sapiens
ucucccaacucuugcacagu

SEQ ID NO: 689729 - RNA, 14 nt, Homo sapiens
ucucccaguccauu

SEQ ID NO: 689730 - RNA, 21 nt, Homo sapiens
ucucccagugggugaugcuuu

SEQ ID NO: 689731 - RNA, 12 nt, Homo sapiens
ucucccauuucc

SEQ ID NO: 689732 - RNA, 21 nt, Homo sapiens
ucucccauuucuugcuagcua

SEQ ID NO: 689733 - RNA, 18 nt, Homo sapiens
ucucccauuuuggaauuu

SEQ ID NO: 689734 - RNA, 13 nt, Homo sapiens
ucuccccacucca

SEQ ID NO: 689735 - RNA, 21 nt, Homo sapiens
ucuccccacucuaggggucag

SEQ ID NO: 689736 - RNA, 16 nt, Homo sapiens
ucuccccaggccucca

SEQ ID NO: 689737 - RNA, 19 nt, Homo sapiens
ucuccccagugccugccac

SEQ ID NO: 689738 - RNA, 17 nt, Homo sapiens
ucucccccguguucccc

SEQ ID NO: 689739 - RNA, 18 nt, Homo sapiens
ucuccccucagagugcaa

SEQ ID NO: 689740 - RNA, 21 nt, Homo sapiens
ucuccccuugucugcacuguu

SEQ ID NO: 689741 - RNA, 23 nt, Homo sapiens
ucucccggcaacaucucugggaa

SEQ ID NO: 689742 - RNA, 18 nt, Homo sapiens
ucucccuccccaaauggc

SEQ ID NO: 689743 - RNA, 17 nt, Homo sapiens
ucucccucccuugccac

SEQ ID NO: 689744 - RNA, 13 nt, Homo sapiens
ucucccugcuuug

SEQ ID NO: 689745 - RNA, 23 nt, Homo sapiens
ucucccugguugccucucuugcc

SEQ ID NO: 689746 - RNA, 21 nt, Homo sapiens
ucucccuucuugggucugccc

SEQ ID NO: 689747 - RNA, 14 nt, Homo sapiens
ucucccuugaggga

SEQ ID NO: 689748 - RNA, 16 nt, Homo sapiens
ucucccuuguuuacuc

SEQ ID NO: 689749 - RNA, 16 nt, Homo sapiens
ucuccgacuuccccug

SEQ ID NO: 689750 - RNA, 11 nt, Homo sapiens
ucuccuacuuu

SEQ ID NO: 689751 - RNA, 13 nt, Homo sapiens
ucuccuacuuuga

SEQ ID NO: 689752 - RNA, 12 nt, Homo sapiens
ucuccucagggu

SEQ ID NO: 689753 - RNA, 13 nt, Homo sapiens
ucuccuccagugu

SEQ ID NO: 689754 - RNA, 13 nt, Homo sapiens
ucuccuccuugag

SEQ ID NO: 689755 - RNA, 13 nt, Homo sapiens
ucuccucuuguaa

SEQ ID NO: 689756 - RNA, 16 nt, Homo sapiens
ucuucugggaacuucc

SEQ ID NO: 689757 - RNA, 16 nt, Homo sapiens
ucuucuguucucuggu

SEQ ID NO: 689758 - RNA, 14 nt, Homo sapiens
ucuucuuacaugca

SEQ ID NO: 689759 - RNA, 19 nt, Homo sapiens
ucuucuuacaugcauuuga

SEQ ID NO: 689760 - RNA, 17 nt, Homo sapiens
ucuucuuuauugcacua

SEQ ID NO: 689761 - RNA, 19 nt, Homo sapiens
ucuucuuuuuuugugaugu

SEQ ID NO: 689762 - RNA, 21 nt, Homo sapiens
ucuugaaacauagagaucuau

SEQ ID NO: 689763 - RNA, 15 nt, Homo sapiens
ucuugaaauguagaa

SEQ ID NO: 689764 - RNA, 20 nt, Homo sapiens
ucuugaagcugggcugucuc

SEQ ID NO: 689765 - RNA, 14 nt, Homo sapiens
ucuugaauacucug

SEQ ID NO: 689766 - RNA, 16 nt, Homo sapiens
ucuugaauagucucau

SEQ ID NO: 689767 - RNA, 23 nt, Homo sapiens
ucuugaauguaguauucaaugau

SEQ ID NO: 689768 - RNA, 17 nt, Homo sapiens
ucuugacauucaaggca

SEQ ID NO: 689769 - RNA, 13 nt, Homo sapiens
ucuugacuaggua

SEQ ID NO: 689770 - RNA, 15 nt, Homo sapiens
ucuugacuagugcaa

SEQ ID NO: 689771 - RNA, 15 nt, Homo sapiens
ucuugacuuccccac

SEQ ID NO: 689772 - RNA, 19 nt, Homo sapiens
ucuugagauuggguuuugc

SEQ ID NO: 689773 - RNA, 15 nt, Homo sapiens
ucuugaggccaggag

SEQ ID NO: 689774 - RNA, 17 nt, Homo sapiens
ucuugaggccugugcuc

SEQ ID NO: 689775 - RNA, 20 nt, Homo sapiens
ucuugagggacaaugccaau

SEQ ID NO: 689776 - RNA, 13 nt, Homo sapiens
ucuugaguuccuc

SEQ ID NO: 689777 - RNA, 14 nt, Homo sapiens
ucuugauaaaugac

SEQ ID NO: 689778 - RNA, 18 nt, Homo sapiens
ucuugauaugaccuguua

SEQ ID NO: 689779 - RNA, 11 nt, Homo sapiens
ucuugaucucc

SEQ ID NO: 689780 - RNA, 17 nt, Homo sapiens
ucuugaucuuugagccc

SEQ ID NO: 689781 - RNA, 17 nt, Homo sapiens
ucuugaugcaugcacug

SEQ ID NO: 689782 - RNA, 20 nt, Homo sapiens
ucuugaugguguuucuuucc

SEQ ID NO: 689783 - RNA, 17 nt, Homo sapiens
ucuugcaacuuguuaaa

SEQ ID NO: 689784 - RNA, 21 nt, Homo sapiens
ucuugcagaaugucuguagga

SEQ ID NO: 689785 - RNA, 13 nt, Homo sapiens
ucuugccaucacu

SEQ ID NO: 689786 - RNA, 22 nt, Homo sapiens
ucuugccugcaugaaacauguu

SEQ ID NO: 689787 - RNA, 13 nt, Homo sapiens
ucuugcucaaaaa

SEQ ID NO: 689788 - RNA, 21 nt, Homo sapiens
ucuugcucuaaugaucaaaac

SEQ ID NO: 689789 - RNA, 17 nt, Homo sapiens
ucuugcugggcauacuu

SEQ ID NO: 689790 - RNA, 18 nt, Homo sapiens
ucuugcuguugacauauu

SEQ ID NO: 689791 - RNA, 19 nt, Homo sapiens
ucuuggaccucugcucuga

SEQ ID NO: 689792 - RNA, 22 nt, Homo sapiens
ucuuggcauuaaaccacaucau

SEQ ID NO: 689793 - RNA, 14 nt, Homo sapiens
ucuuggcguggcag

SEQ ID NO: 689794 - RNA, 17 nt, Homo sapiens
ucuugggauaguuccca

SEQ ID NO: 689795 - RNA, 21 nt, Homo sapiens
ucuugggccccagaccccagg

SEQ ID NO: 689796 - RNA, 15 nt, Homo sapiens
ucuugguacuacuag

SEQ ID NO: 689797 - RNA, 17 nt, Homo sapiens
ucuuggugaacacacau

SEQ ID NO: 689798 - RNA, 23 nt, Homo sapiens
ucuuggugccuuuugugugaugc

SEQ ID NO: 689799 - RNA, 22 nt, Homo sapiens
ucuugguugaggaaacaaacau

SEQ ID NO: 689800 - RNA, 15 nt, Homo sapiens
ucuuguaaaucuuuu

SEQ ID NO: 689801 - RNA, 16 nt, Homo sapiens
ucuuguagaugcauua

SEQ ID NO: 689802 - RNA, 17 nt, Homo sapiens
ucuuguauacacauaua

SEQ ID NO: 689803 - RNA, 18 nt, Homo sapiens
ucuuguauacacauauau

SEQ ID NO: 689804 - RNA, 18 nt, Homo sapiens
ucuugucaacaugcauug

SEQ ID NO: 689805 - RNA, 19 nt, Homo sapiens
ucuugucauaaaaugcaua

SEQ ID NO: 689806 - RNA, 17 nt, Homo sapiens
ucuugucauugccagcu

SEQ ID NO: 689807 - RNA, 15 nt, Homo sapiens
ucuugucccuaagua

SEQ ID NO: 689808 - RNA, 14 nt, Homo sapiens
ucuuguccugugau

SEQ ID NO: 689809 - RNA, 19 nt, Homo sapiens
ucuugugccaaaccuacua

SEQ ID NO: 689810 - RNA, 20 nt, Homo sapiens
ucuugugguaacuugcugcu

SEQ ID NO: 689811 - RNA, 21 nt, Homo sapiens
ucuugugguaacuugcugcuu

SEQ ID NO: 689812 - RNA, 18 nt, Homo sapiens
ucuuguguaagguuuugg

SEQ ID NO: 689813 - RNA, 16 nt, Homo sapiens
ucuuguguuaccugaa

SEQ ID NO: 689814 - RNA, 15 nt, Homo sapiens
ucuuguucagauuaa

SEQ ID NO: 689815 - RNA, 14 nt, Homo sapiens
ucuuguugcucaaa

SEQ ID NO: 689816 - RNA, 15 nt, Homo sapiens
ucuuguugcugcauc

SEQ ID NO: 689817 - RNA, 17 nt, Homo sapiens
ucuuguugcugcaucuc

SEQ ID NO: 689818 - RNA, 16 nt, Homo sapiens
ucuuguuuaacauaua

SEQ ID NO: 689819 - RNA, 17 nt, Homo sapiens
ucuuguuuuauauaccu

SEQ ID NO: 689820 - RNA, 22 nt, Homo sapiens
ucuuguuuuuuuuuuccacuua

SEQ ID NO: 689821 - RNA, 24 nt, Homo sapiens
ucuuuaaguauuuguuccugccac

SEQ ID NO: 689822 - RNA, 20 nt, Homo sapiens
ucuuuacaaaaaaauacaaa

SEQ ID NO: 689823 - RNA, 20 nt, Homo sapiens
ucuuuaccaaaaccauccau

SEQ ID NO: 689824 - RNA, 17 nt, Homo sapiens
ucuuuaccuaauggucu

SEQ ID NO: 689825 - RNA, 19 nt, Homo sapiens
ucuuuaccuaauggucucu

SEQ ID NO: 689826 - RNA, 12 nt, Homo sapiens
ucuuuaccucag

SEQ ID NO: 689827 - RNA, 18 nt, Homo sapiens
ucuuuacuaacacuggcu

SEQ ID NO: 689828 - RNA, 22 nt, Homo sapiens
ucuuuagaaggacucaguauua

SEQ ID NO: 689829 - RNA, 19 nt, Homo sapiens
ucuuuaggagacuaaugga

SEQ ID NO: 689830 - RNA, 23 nt, Homo sapiens
ucuuuaguauaauugaccuacuu

SEQ ID NO: 689831 - RNA, 17 nt, Homo sapiens
ucuuuauaaucuacucc

SEQ ID NO: 689832 - RNA, 18 nt, Homo sapiens
ucuuuauaaucuacuccu

SEQ ID NO: 689833 - RNA, 13 nt, Homo sapiens
ucuuuauaauucu

SEQ ID NO: 689834 - RNA, 12 nt, Homo sapiens
ucuuuauacugg

SEQ ID NO: 689835 - RNA, 16 nt, Homo sapiens
ucuuuauaucugaacc

SEQ ID NO: 689836 - RNA, 22 nt, Homo sapiens
ucuuuaucaugaagcacaucaa

SEQ ID NO: 689837 - RNA, 14 nt, Homo sapiens
ucuuuaugacuguu

SEQ ID NO: 689838 - RNA, 13 nt, Homo sapiens
ucuuuaugaucug

SEQ ID NO: 689839 - RNA, 17 nt, Homo sapiens
ucuuuauuaauguuuag

SEQ ID NO: 689840 - RNA, 23 nt, Homo sapiens
ucuuuauuauuccuagucuuucc

SEQ ID NO: 689841 - RNA, 16 nt, Homo sapiens
ucuuucacacggcaca

SEQ ID NO: 689842 - RNA, 13 nt, Homo sapiens
ucuuucacagugg

SEQ ID NO: 689843 - RNA, 20 nt, Homo sapiens
ucuuucacauuguuugcugc

SEQ ID NO: 689844 - RNA, 12 nt, Homo sapiens
ucuuucacuuca

SEQ ID NO: 689845 - RNA, 12 nt, Homo sapiens
ucuuucagagag

SEQ ID NO: 689846 - RNA, 18 nt, Homo sapiens
ucuuucaggacucuaccu

SEQ ID NO: 689847 - RNA, 20 nt, Homo sapiens
ucuuucaggacucuaccuca

SEQ ID NO: 689848 - RNA, 18 nt, Homo sapiens
ucuuucaucuccugagua

SEQ ID NO: 689849 - RNA, 16 nt, Homo sapiens
ucuuucaucucugcuu

SEQ ID NO: 689850 - RNA, 13 nt, Homo sapiens
ucuuuccaaaaca

SEQ ID NO: 689851 - RNA, 23 nt, Homo sapiens
ucuuuccaaaaggaacucuagaa

SEQ ID NO: 689852 - RNA, 12 nt, Homo sapiens
ucuuuccacuuu

SEQ ID NO: 689853 - RNA, 14 nt, Homo sapiens
ucuuuccacuuugu

SEQ ID NO: 689854 - RNA, 17 nt, Homo sapiens
ucuuuccauuaugauuc

SEQ ID NO: 689855 - RNA, 14 nt, Homo sapiens
ucuuucccaauuca

SEQ ID NO: 689856 - RNA, 23 nt, Homo sapiens
ucuuucccacccuccaccucuca

SEQ ID NO: 689857 - RNA, 14 nt, Homo sapiens
ucuuuccuguaaag

SEQ ID NO: 689858 - RNA, 15 nt, Homo sapiens
ucuuucuaaacuaca

SEQ ID NO: 689859 - RNA, 18 nt, Homo sapiens
ucuuucuaaugugugaau

SEQ ID NO: 689860 - RNA, 15 nt, Homo sapiens
ucuuucuacaugacu

SEQ ID NO: 689861 - RNA, 15 nt, Homo sapiens
ucuuucuauuuaugc

SEQ ID NO: 689862 - RNA, 16 nt, Homo sapiens
ucuuucucaaucuuga

SEQ ID NO: 689863 - RNA, 19 nt, Homo sapiens
ucuuucuccagcagcugau

SEQ ID NO: 689864 - RNA, 17 nt, Homo sapiens
ucuuucucugccaguga

SEQ ID NO: 689865 - RNA, 22 nt, Homo sapiens
ucuuucucugccagugacagac

SEQ ID NO: 689866 - RNA, 13 nt, Homo sapiens
ucuuucuguaaac

SEQ ID NO: 689867 - RNA, 19 nt, Homo sapiens
ucuuucuguaaacagaaua

SEQ ID NO: 689868 - RNA, 21 nt, Homo sapiens
ucuuucuuaaugaaccuuaga

SEQ ID NO: 689869 - RNA, 13 nt, Homo sapiens
ucuuucuuuccaa

SEQ ID NO: 689870 - RNA, 20 nt, Homo sapiens
ucuuucuuugcaccaaagac

SEQ ID NO: 689871 - RNA, 20 nt, Homo sapiens
ucuuugaacccuugcuugca

SEQ ID NO: 689872 - RNA, 17 nt, Homo sapiens
ucuuugccagucauuca

SEQ ID NO: 689873 - RNA, 18 nt, Homo sapiens
ucuuugcucccugcaaga

SEQ ID NO: 689874 - RNA, 19 nt, Homo sapiens
ucuuugcucuaauuuugga

SEQ ID NO: 689875 - RNA, 18 nt, Homo sapiens
ucuuugcugccagccacu

SEQ ID NO: 689876 - RNA, 22 nt, Homo sapiens
ucuuugcugccagccacuucau

SEQ ID NO: 689877 - RNA, 14 nt, Homo sapiens
ucuuugcugcugcu

SEQ ID NO: 689878 - RNA, 14 nt, Homo sapiens
ucuuuggauuugau

SEQ ID NO: 689879 - RNA, 21 nt, Homo sapiens
ucuuuggggguuagaccacuu

SEQ ID NO: 689880 - RNA, 13 nt, Homo sapiens
ucuuugguuuugg

SEQ ID NO: 689881 - RNA, 21 nt, Homo sapiens
ucuuuguaagaguggaaccaa

SEQ ID NO: 689882 - RNA, 14 nt, Homo sapiens
ucuuuguaccaaaa

SEQ ID NO: 689883 - RNA, 17 nt, Homo sapiens
ucuuuguauaugcauuc

SEQ ID NO: 689884 - RNA, 15 nt, Homo sapiens
ucuuugucauaccuu

SEQ ID NO: 689885 - RNA, 21 nt, Homo sapiens
ucuuuguggggaagaggggcu

SEQ ID NO: 689886 - RNA, 18 nt, Homo sapiens
ucuuuguggucaugugau

SEQ ID NO: 689887 - RNA, 17 nt, Homo sapiens
ucuuuguuagauauuag

SEQ ID NO: 689888 - RNA, 23 nt, Homo sapiens
ucuuuguuagauauuagguccca

SEQ ID NO: 689889 - RNA, 19 nt, Homo sapiens
ucuuuguuaugacagugaa

SEQ ID NO: 689890 - RNA, 21 nt, Homo sapiens
ucuuuguuaugacagugaaua

SEQ ID NO: 689891 - RNA, 19 nt, Homo sapiens
ucuuuuaaagccagaaguc

SEQ ID NO: 689892 - RNA, 15 nt, Homo sapiens
ucuuuuaaaguauuu

SEQ ID NO: 689893 - RNA, 21 nt, Homo sapiens
ucuuuuaaauauuugugacuc

SEQ ID NO: 689894 - RNA, 16 nt, Homo sapiens
ucuuuucaucugggaa

SEQ ID NO: 689895 - RNA, 11 nt, Homo sapiens
ucuuuuccacu

SEQ ID NO: 689896 - RNA, 15 nt, Homo sapiens
ucuuuucucaugugu

SEQ ID NO: 689897 - RNA, 15 nt, Homo sapiens
ucuuuucuccuacuc

SEQ ID NO: 689898 - RNA, 18 nt, Homo sapiens
ucuuuucuccuuuaccag

SEQ ID NO: 689899 - RNA, 18 nt, Homo sapiens
ucuuuucuucuauggggu

SEQ ID NO: 689900 - RNA, 21 nt, Homo sapiens
ucuuuugaaaauaaccaugaa

SEQ ID NO: 689901 - RNA, 15 nt, Homo sapiens
ucuuuugaagcuuuc

SEQ ID NO: 689902 - RNA, 14 nt, Homo sapiens
ucuuuugaguggua

SEQ ID NO: 689903 - RNA, 19 nt, Homo sapiens
ucuuuuggggaagcuuucu

SEQ ID NO: 689904 - RNA, 15 nt, Homo sapiens
ucuuuuguuguccuu

SEQ ID NO: 689905 - RNA, 19 nt, Homo sapiens
ucuuuuuccuucuacuccu

SEQ ID NO: 689906 - RNA, 19 nt, Homo sapiens
ucuuuuucuggacucugga

SEQ ID NO: 689907 - RNA, 13 nt, Homo sapiens
ucuuuuugcuuca

SEQ ID NO: 689908 - RNA, 21 nt, Homo sapiens
ucuuuuuuaaguugucaaaga

SEQ ID NO: 689909 - RNA, 21 nt, Homo sapiens
ucuuuuuuaauaaacuacucu

SEQ ID NO: 689910 - RNA, 17 nt, Homo sapiens
ucuuuuuuaauuuccag

SEQ ID NO: 689911 - RNA, 19 nt, Homo sapiens
ugaagagauuucaacaaga

SEQ ID NO: 689912 - RNA, 14 nt, Homo sapiens
ugaagagcuucauu

SEQ ID NO: 689913 - RNA, 16 nt, Homo sapiens
ugaagaggagaacaaa

SEQ ID NO: 689914 - RNA, 16 nt, Homo sapiens
ugaagaggagauuggc

SEQ ID NO: 689915 - RNA, 18 nt, Homo sapiens
ugaagagggagaagcaug

SEQ ID NO: 689916 - RNA, 15 nt, Homo sapiens
ugaagaguccucuga

SEQ ID NO: 689917 - RNA, 19 nt, Homo sapiens
ugaagaugacaaaaguaaa

SEQ ID NO: 689918 - RNA, 13 nt, Homo sapiens
ugaagaugaucau

SEQ ID NO: 689919 - RNA, 21 nt, Homo sapiens
ugaagaugccagugaaacuuc

SEQ ID NO: 689920 - RNA, 20 nt, Homo sapiens
ugaagauggcauccugugaa

SEQ ID NO: 689921 - RNA, 22 nt, Homo sapiens
ugaagauguugguuaugguguu

SEQ ID NO: 689922 - RNA, 19 nt, Homo sapiens
ugaagauucuccugugcua

SEQ ID NO: 689923 - RNA, 19 nt, Homo sapiens
ugaagauuuaugaugcacu

SEQ ID NO: 689924 - RNA, 23 nt, Homo sapiens
ugaagcaaaucagaaacuuguga

SEQ ID NO: 689925 - RNA, 15 nt, Homo sapiens
ugaagcaaguacaau

SEQ ID NO: 689926 - RNA, 13 nt, Homo sapiens
ugaagcacuuaag

SEQ ID NO: 689927 - RNA, 14 nt, Homo sapiens
ugaagcagcacugu

SEQ ID NO: 689928 - RNA, 16 nt, Homo sapiens
ugaagcagucuugcuc

SEQ ID NO: 689929 - RNA, 13 nt, Homo sapiens
ugaagcagugauu

SEQ ID NO: 689930 - RNA, 19 nt, Homo sapiens
ugaagccaauucagacagg

SEQ ID NO: 689931 - RNA, 21 nt, Homo sapiens
ugaagccaauucagacaggca

SEQ ID NO: 689932 - RNA, 13 nt, Homo sapiens
ugaagccacugaa

SEQ ID NO: 689933 - RNA, 13 nt, Homo sapiens
ugaagccaugucu

SEQ ID NO: 689934 - RNA, 17 nt, Homo sapiens
ugaagccucagcuaccc

SEQ ID NO: 689935 - RNA, 15 nt, Homo sapiens
ugaagcuaauaauuc

SEQ ID NO: 689936 - RNA, 15 nt, Homo sapiens
ugaagcuaaugucac

SEQ ID NO: 689937 - RNA, 18 nt, Homo sapiens
ugaagcuaaugucacaau

SEQ ID NO: 689938 - RNA, 22 nt, Homo sapiens
ugaagcuaauugugcacaucuu

SEQ ID NO: 689939 - RNA, 20 nt, Homo sapiens
ugaagcuguuauuugcaguc

SEQ ID NO: 689940 - RNA, 22 nt, Homo sapiens
ugaagcuucggccgcgccaccc

SEQ ID NO: 689941 - RNA, 22 nt, Homo sapiens
ugaagcuuugugaaaacuacug

SEQ ID NO: 689942 - RNA, 16 nt, Homo sapiens
ugaaggaaaaacacaa

SEQ ID NO: 689943 - RNA, 16 nt, Homo sapiens
ugaaggaacauuccuu

SEQ ID NO: 689944 - RNA, 16 nt, Homo sapiens
ugaaggaaucauucca

SEQ ID NO: 689945 - RNA, 13 nt, Homo sapiens
ugaaggacacuuc

SEQ ID NO: 689946 - RNA, 18 nt, Homo sapiens
ugaaggacacuuccugcc

SEQ ID NO: 689947 - RNA, 20 nt, Homo sapiens
ugaaggacagaacauugccu

SEQ ID NO: 689948 - RNA, 17 nt, Homo sapiens
ugaauguugcaauguga

SEQ ID NO: 689949 - RNA, 23 nt, Homo sapiens
ugaauuaacacaguguuucaauu

SEQ ID NO: 689950 - RNA, 19 nt, Homo sapiens
ugaauuagagaauuuucug

SEQ ID NO: 689951 - RNA, 22 nt, Homo sapiens
ugaauuaugauggucugcauua

SEQ ID NO: 689952 - RNA, 23 nt, Homo sapiens
ugaauuauucugccuacguucuc

SEQ ID NO: 689953 - RNA, 13 nt, Homo sapiens
ugaauucaagaaa

SEQ ID NO: 689954 - RNA, 14 nt, Homo sapiens
ugaauuccauggaa

SEQ ID NO: 689955 - RNA, 20 nt, Homo sapiens
ugaauuccauggaauuucua

SEQ ID NO: 689956 - RNA, 15 nt, Homo sapiens
ugaauucuuaugcuu

SEQ ID NO: 689957 - RNA, 18 nt, Homo sapiens
ugaauugaguuuguaauu

SEQ ID NO: 689958 - RNA, 13 nt, Homo sapiens
ugaauugccaggg

SEQ ID NO: 689959 - RNA, 20 nt, Homo sapiens
ugaauuguuuuuguacaguu

SEQ ID NO: 689960 - RNA, 15 nt, Homo sapiens
ugaauuucacaagcu

SEQ ID NO: 689961 - RNA, 18 nt, Homo sapiens
ugaauuucacaagcuauu

SEQ ID NO: 689962 - RNA, 23 nt, Homo sapiens
ugaauuucuagacaguauugcca

SEQ ID NO: 689963 - RNA, 17 nt, Homo sapiens
ugaauuuguuagacuag

SEQ ID NO: 689964 - RNA, 16 nt, Homo sapiens
ugaauuuuuaugauau

SEQ ID NO: 689965 - RNA, 11 nt, Homo sapiens
ugacaaaaagc

SEQ ID NO: 689966 - RNA, 14 nt, Homo sapiens
ugacaaaacacagc

SEQ ID NO: 689967 - RNA, 17 nt, Homo sapiens
ugacaaaagcagcacaa

SEQ ID NO: 689968 - RNA, 20 nt, Homo sapiens
ugacaaaccauaacugacaa

SEQ ID NO: 689969 - RNA, 12 nt, Homo sapiens
ugacaaaccauc

SEQ ID NO: 689970 - RNA, 14 nt, Homo sapiens
ugacaaauauuuca

SEQ ID NO: 689971 - RNA, 20 nt, Homo sapiens
ugacaaaugcccugcaccua

SEQ ID NO: 689972 - RNA, 13 nt, Homo sapiens
ugacaacaaagau

SEQ ID NO: 689973 - RNA, 19 nt, Homo sapiens
ugacaacaucccacagugg

SEQ ID NO: 689974 - RNA, 12 nt, Homo sapiens
ugacaacaucgc

SEQ ID NO: 689975 - RNA, 16 nt, Homo sapiens
ugacaacaucgcaaua

SEQ ID NO: 689976 - RNA, 13 nt, Homo sapiens
ugacaacaugcua

SEQ ID NO: 689977 - RNA, 19 nt, Homo sapiens
ugacaacauuucuauagcc

SEQ ID NO: 689978 - RNA, 20 nt, Homo sapiens
ugacaaccgaguggcuguca

SEQ ID NO: 689979 - RNA, 23 nt, Homo sapiens
ugacaacgucucuucaagcaucc

SEQ ID NO: 689980 - RNA, 15 nt, Homo sapiens
ugacaacuuugccag

SEQ ID NO: 689981 - RNA, 18 nt, Homo sapiens
ugacaagagcgaaacucc

SEQ ID NO: 689982 - RNA, 12 nt, Homo sapiens
ugacaagcacua

SEQ ID NO: 689983 - RNA, 16 nt, Homo sapiens
ugacaagggcccuucu

SEQ ID NO: 689984 - RNA, 21 nt, Homo sapiens
ugacaagguucccaagacaau

SEQ ID NO: 689985 - RNA, 15 nt, Homo sapiens
ugacaagugagacaa

SEQ ID NO: 689986 - RNA, 15 nt, Homo sapiens
ugacaauaauuucag

SEQ ID NO: 689987 - RNA, 15 nt, Homo sapiens
aaaaacaggucuuca

SEQ ID NO: 689988 - RNA, 22 nt, Homo sapiens
aaaaugcagcagggaugcccug

SEQ ID NO: 689989 - RNA, 13 nt, Homo sapiens
aaacccaauccaa

SEQ ID NO: 689990 - RNA, 20 nt, Homo sapiens
aaacgucuucuaaacuuccc

SEQ ID NO: 689991 - RNA, 22 nt, Homo sapiens
aaagcagccacgaggugcaaca

SEQ ID NO: 689992 - RNA, 17 nt, Homo sapiens
aaauaaaaggaagccaa

SEQ ID NO: 689993 - RNA, 16 nt, Homo sapiens
aaauacaaaacuucca

SEQ ID NO: 689994 - RNA, 23 nt, Homo sapiens
aaaucggaucuggggcucuggga

SEQ ID NO: 689995 - RNA, 21 nt, Homo sapiens
aaaugcagcagggaugcccug

SEQ ID NO: 689996 - RNA, 21 nt, Homo sapiens
aaauggggccagauccagccu

SEQ ID NO: 689997 - RNA, 18 nt, Homo sapiens
aaauguugagaaucccaa

SEQ ID NO: 689998 - RNA, 23 nt, Homo sapiens
aacaagguccucugucagucaca

SEQ ID NO: 689999 - RNA, 18 nt, Homo sapiens
aaccccccagcacugagg

SEQ ID NO: 690000 - RNA, 21 nt, Homo sapiens
aaccucagccuggccagacac

SEQ ID NO: 690001 - RNA, 15 nt, Homo sapiens
aaccucauuccccaa

SEQ ID NO: 690002 - RNA, 17 nt, Homo sapiens
aaccucuucuggcucaa

SEQ ID NO: 690003 - RNA, 22 nt, Homo sapiens
aacuuucauuuuuuuccaggcu

SEQ ID NO: 690004 - RNA, 13 nt, Homo sapiens
aagaacacccucu

SEQ ID NO: 690005 - RNA, 12 nt, Homo sapiens
aagaacauguga

SEQ ID NO: 690006 - RNA, 17 nt, Homo sapiens
aagagagucgcaucuca

SEQ ID NO: 690007 - RNA, 14 nt, Homo sapiens
aagauaacuaggaa

SEQ ID NO: 690008 - RNA, 21 nt, Homo sapiens
aagaucaggucauacuaucua

SEQ ID NO: 690009 - RNA, 15 nt, Homo sapiens
aagaucuguuuugaa

SEQ ID NO: 690010 - RNA, 20 nt, Homo sapiens
aagaucuguuuugaaggcaa

SEQ ID NO: 690011 - RNA, 21 nt, Homo sapiens
aagcagccacgaggugcaaca

SEQ ID NO: 690012 - RNA, 19 nt, Homo sapiens
aagcuguuuccauagggug

SEQ ID NO: 690013 - RNA, 18 nt, Homo sapiens
aaggagaggcaacaucca

SEQ ID NO: 690014 - RNA, 20 nt, Homo sapiens
aaguuacuagguaacuucau

SEQ ID NO: 690015 - RNA, 14 nt, Homo sapiens
aaguuuuacauugu

SEQ ID NO: 690016 - RNA, 17 nt, Homo sapiens
aauagccacauuuggaa

SEQ ID NO: 690017 - RNA, 15 nt, Homo sapiens
aauaguguucugcaa

SEQ ID NO: 690018 - RNA, 17 nt, Homo sapiens
aauauuuauuaccucug

SEQ ID NO: 690019 - RNA, 20 nt, Homo sapiens
aauauuuauuauuuucaccu

SEQ ID NO: 690020 - RNA, 16 nt, Homo sapiens
aauccaggcagaucca

SEQ ID NO: 690021 - RNA, 14 nt, Homo sapiens
aaugagccaugaga

SEQ ID NO: 690022 - RNA, 20 nt, Homo sapiens
aaugcugcaggacuugagaa

SEQ ID NO: 690023 - RNA, 12 nt, Homo sapiens
aauggggccaga

SEQ ID NO: 690024 - RNA, 13 nt, Homo sapiens
aauuccucuggga

SEQ ID NO: 690025 - RNA, 13 nt, Homo sapiens
aauugacaugugc

SEQ ID NO: 690026 - RNA, 16 nt, Homo sapiens
aauugcaaaucuugaa

SEQ ID NO: 690027 - RNA, 23 nt, Homo sapiens
aauuguuugucuuuaacugucaa

SEQ ID NO: 690028 - RNA, 16 nt, Homo sapiens
aauuuggguucugccu

SEQ ID NO: 690029 - RNA, 12 nt, Homo sapiens
acaaggccaucu

SEQ ID NO: 690030 - RNA, 18 nt, Homo sapiens
acacaaggauagaugcug

SEQ ID NO: 690031 - RNA, 21 nt, Homo sapiens
acacugcugcuccagugcagg

SEQ ID NO: 690032 - RNA, 21 nt, Homo sapiens
acagaagccugaugcugacau

SEQ ID NO: 690033 - RNA, 14 nt, Homo sapiens
accguucugugcac

SEQ ID NO: 690034 - RNA, 16 nt, Homo sapiens
accuaaauuugguucu

SEQ ID NO: 690035 - RNA, 14 nt, Homo sapiens
accuaauccaggca

SEQ ID NO: 690036 - RNA, 15 nt, Homo sapiens
accuguaaucccagc

SEQ ID NO: 690037 - RNA, 19 nt, Homo sapiens
accuguuuuuaagcuguuu

SEQ ID NO: 690038 - RNA, 16 nt, Homo sapiens
accuuggcaccagaca

SEQ ID NO: 690039 - RNA, 22 nt, Homo sapiens
accuuggcaccagacacccagg

SEQ ID NO: 690040 - RNA, 13 nt, Homo sapiens
acgaggugcaaca

SEQ ID NO: 690041 - RNA, 14 nt, Homo sapiens
acgcaccugccuca

SEQ ID NO: 690042 - RNA, 18 nt, Homo sapiens
acggccagggagaagcuc

SEQ ID NO: 690043 - RNA, 14 nt, Homo sapiens
acguggcucagcca

SEQ ID NO: 690044 - RNA, 16 nt, Homo sapiens
acguggcucagccagc

SEQ ID NO: 690045 - RNA, 16 nt, Homo sapiens
acuaaaaauacaaaaa

SEQ ID NO: 690046 - RNA, 19 nt, Homo sapiens
acuaacuaugcauggugcc

SEQ ID NO: 690047 - RNA, 19 nt, Homo sapiens
acuaucuacucuccucauc

SEQ ID NO: 690048 - RNA, 22 nt, Homo sapiens
acuaugcauggugccccaggac

SEQ ID NO: 690049 - RNA, 16 nt, Homo sapiens
acucaguugcaacuug

SEQ ID NO: 690050 - RNA, 16 nt, Homo sapiens
acucuccucaucucua

SEQ ID NO: 690051 - RNA, 17 nt, Homo sapiens
acugccaaaaugcucua

SEQ ID NO: 690052 - RNA, 19 nt, Homo sapiens
acugccucgaaacacagaa

SEQ ID NO: 690053 - RNA, 19 nt, Homo sapiens
acugcugcuccagugcagg

SEQ ID NO: 690054 - RNA, 23 nt, Homo sapiens
acuggggccuccagaacucacug

SEQ ID NO: 690055 - RNA, 14 nt, Homo sapiens
acuguguguugcca

SEQ ID NO: 690056 - RNA, 18 nt, Homo sapiens
acuguguguugccacagg

SEQ ID NO: 690057 - RNA, 13 nt, Homo sapiens
acuuaugauuuca

SEQ ID NO: 690058 - RNA, 14 nt, Homo sapiens
acuucgaaaccugg

SEQ ID NO: 690059 - RNA, 16 nt, Homo sapiens
acuucgaaaccuggga

SEQ ID NO: 690060 - RNA, 14 nt, Homo sapiens
acuucucaagauac

SEQ ID NO: 690061 - RNA, 16 nt, Homo sapiens
acuuggacuuguccuc

SEQ ID NO: 690062 - RNA, 23 nt, Homo sapiens
acuuggggaguuaagaccuggca

SEQ ID NO: 690063 - RNA, 12 nt, Homo sapiens
agaaaacaucua

SEQ ID NO: 690064 - RNA, 21 nt, Homo sapiens
agaaaccuuauuguaccucuc

SEQ ID NO: 690065 - RNA, 18 nt, Homo sapiens
agaaauauggacacuuaa

SEQ ID NO: 690066 - RNA, 18 nt, Homo sapiens
agaacggggcucuucuca

SEQ ID NO: 690067 - RNA, 19 nt, Homo sapiens
agaacucaaauggggccag

SEQ ID NO: 690068 - RNA, 23 nt, Homo sapiens
agaagccugaugcugacauucac

SEQ ID NO: 690069 - RNA, 14 nt, Homo sapiens
agaaggcaaaaaug

SEQ ID NO: 690070 - RNA, 19 nt, Homo sapiens
agaauauuuauuaccucug

SEQ ID NO: 690071 - RNA, 11 nt, Homo sapiens
agaauccaaac

SEQ ID NO: 690072 - RNA, 22 nt, Homo sapiens
agaaugcugcaggacuugagaa

SEQ ID NO: 690073 - RNA, 22 nt, Homo sapiens
agacacggagcccagcccuccc

SEQ ID NO: 690074 - RNA, 13 nt, Homo sapiens
agacauacuugaa

SEQ ID NO: 690075 - RNA, 21 nt, Homo sapiens
agacauacuugaagggccaga

SEQ ID NO: 690076 - RNA, 21 nt, Homo sapiens
agacaugauuuccuugaaugu

SEQ ID NO: 690077 - RNA, 16 nt, Homo sapiens
agagaccauugcaaug

SEQ ID NO: 690078 - RNA, 20 nt, Homo sapiens
agagcaagacucugucucaa

SEQ ID NO: 690079 - RNA, 19 nt, Homo sapiens
agagcaaggguucccucaa

SEQ ID NO: 690080 - RNA, 20 nt, Homo sapiens
agaggcugaggcuggcacag

SEQ ID NO: 690081 - RNA, 13 nt, Homo sapiens
agaguuuccugaa

SEQ ID NO: 690082 - RNA, 23 nt, Homo sapiens
agauccagggacugaagccaaag

SEQ ID NO: 690083 - RNA, 17 nt, Homo sapiens
agaugauggaugccaau

SEQ ID NO: 690084 - RNA, 14 nt, Homo sapiens
agaugcuggcccag

SEQ ID NO: 690085 - RNA, 20 nt, Homo sapiens
agauuggcucacacugagaa

SEQ ID NO: 690086 - RNA, 13 nt, Homo sapiens
agauuucaucugc

SEQ ID NO: 690087 - RNA, 17 nt, Homo sapiens
agcaccguucugugcac

SEQ ID NO: 690088 - RNA, 15 nt, Homo sapiens
agcacugaggaagaa

SEQ ID NO: 690089 - RNA, 21 nt, Homo sapiens
agcagcaccguucugugcaca

SEQ ID NO: 690090 - RNA, 17 nt, Homo sapiens
agcaggugcugacuuca

SEQ ID NO: 690091 - RNA, 20 nt, Homo sapiens
agccaaaguuaugcaaggga

SEQ ID NO: 690092 - RNA, 21 nt, Homo sapiens
agccacaggccugagauuuca

SEQ ID NO: 690093 - RNA, 20 nt, Homo sapiens
agcccagagacauacuugaa

SEQ ID NO: 690094 - RNA, 16 nt, Homo sapiens
agcccauccagucucc

SEQ ID NO: 690095 - RNA, 15 nt, Homo sapiens
agcccuguugacaca

SEQ ID NO: 690096 - RNA, 20 nt, Homo sapiens
agccuaaaagugggcuugau

SEQ ID NO: 690097 - RNA, 20 nt, Homo sapiens
agccugaugcugacauucac

SEQ ID NO: 690098 - RNA, 15 nt, Homo sapiens
agcucuauguuuaca

SEQ ID NO: 690099 - RNA, 21 nt, Homo sapiens
agcucuauguuuacaaaugga

SEQ ID NO: 690100 - RNA, 23 nt, Homo sapiens
agcucuggacagccccacccugg

SEQ ID NO: 690101 - RNA, 22 nt, Homo sapiens
agcugccuuggcucagacaugu

SEQ ID NO: 690102 - RNA, 19 nt, Homo sapiens
agcuguggccagcuuguua

SEQ ID NO: 690103 - RNA, 14 nt, Homo sapiens
agcuguuuccauag

SEQ ID NO: 690104 - RNA, 12 nt, Homo sapiens
agcuuugcugcu

SEQ ID NO: 690105 - RNA, 21 nt, Homo sapiens
aggacccugaaggggccauga

SEQ ID NO: 690106 - RNA, 22 nt, Homo sapiens
aggacccugaaggggccaugau

SEQ ID NO: 690107 - RNA, 20 nt, Homo sapiens
aggagaccuggcacuggaug

SEQ ID NO: 690108 - RNA, 20 nt, Homo sapiens
aggagauggaaguugcagug

SEQ ID NO: 690109 - RNA, 16 nt, Homo sapiens
aggagucaaaacuaca

SEQ ID NO: 690110 - RNA, 23 nt, Homo sapiens
aggcagggugcaguaucaugccc

SEQ ID NO: 690111 - RNA, 19 nt, Homo sapiens
aggccacacucagcacaag

SEQ ID NO: 690112 - RNA, 20 nt, Homo sapiens
aggcccaguucacccugauu

SEQ ID NO: 690113 - RNA, 20 nt, Homo sapiens
aggccgggcgcgguggcuca

SEQ ID NO: 690114 - RNA, 23 nt, Homo sapiens
aggcugaggcuggcacaggacau

SEQ ID NO: 690115 - RNA, 14 nt, Homo sapiens
agggacccaugagu

SEQ ID NO: 690116 - RNA, 20 nt, Homo sapiens
agggaggcaagcccuguuga

SEQ ID NO: 690117 - RNA, 15 nt, Homo sapiens
agggagggcugucau

SEQ ID NO: 690118 - RNA, 19 nt, Homo sapiens
aggggccuaggccucagcc

SEQ ID NO: 690119 - RNA, 22 nt, Homo sapiens
agggggagccccuucugcucag

SEQ ID NO: 690120 - RNA, 20 nt, Homo sapiens
aggguuucaccauguugccc

SEQ ID NO: 690121 - RNA, 17 nt, Homo sapiens
agguaauuucuugugcc

SEQ ID NO: 690122 - RNA, 13 nt, Homo sapiens
aggucuccaaaau

SEQ ID NO: 690123 - RNA, 21 nt, Homo sapiens
aguaucaugcccugugcaacc

SEQ ID NO: 690124 - RNA, 19 nt, Homo sapiens
agucgcaucucagugcagg

SEQ ID NO: 690125 - RNA, 14 nt, Homo sapiens
agugaagacuggaa

SEQ ID NO: 690126 - RNA, 18 nt, Homo sapiens
agugcaauaaaucugacc

SEQ ID NO: 690127 - RNA, 20 nt, Homo sapiens
agugccuucuaaagguguug

SEQ ID NO: 690128 - RNA, 16 nt, Homo sapiens
ccaaaaaugcacccaa

SEQ ID NO: 690129 - RNA, 22 nt, Homo sapiens
ccaaagaguagaauugcauuga

SEQ ID NO: 690130 - RNA, 20 nt, Homo sapiens
ccaaaguccuuuuuuuccau

SEQ ID NO: 690131 - RNA, 21 nt, Homo sapiens
ccaacacugcugcuccagugc

SEQ ID NO: 690132 - RNA, 17 nt, Homo sapiens
ccaaccggucacccagg

SEQ ID NO: 690133 - RNA, 13 nt, Homo sapiens
ccaagccugacca

SEQ ID NO: 690134 - RNA, 15 nt, Homo sapiens
ccaaggggaaucaga

SEQ ID NO: 690135 - RNA, 17 nt, Homo sapiens
ccaauuucagacuccca

SEQ ID NO: 690136 - RNA, 19 nt, Homo sapiens
ccacagcaaccccaggcug

SEQ ID NO: 690137 - RNA, 21 nt, Homo sapiens
ccacagcaaccccaggcugaa

SEQ ID NO: 690138 - RNA, 14 nt, Homo sapiens
ccacagcacagcca

SEQ ID NO: 690139 - RNA, 19 nt, Homo sapiens
ccacaggccugagauuuca

SEQ ID NO: 690140 - RNA, 14 nt, Homo sapiens
ccacuaagaauuca

SEQ ID NO: 690141 - RNA, 12 nt, Homo sapiens
ccacugaccaga

SEQ ID NO: 690142 - RNA, 21 nt, Homo sapiens
ccacuucuggguggggcagug

SEQ ID NO: 690143 - RNA, 19 nt, Homo sapiens
ccagaaugcugcaggacuu

SEQ ID NO: 690144 - RNA, 15 nt, Homo sapiens
ccagacucagacauu

SEQ ID NO: 690145 - RNA, 14 nt, Homo sapiens
ccagagcccagcuc

SEQ ID NO: 690146 - RNA, 17 nt, Homo sapiens
ccagagcccagcuccaa

SEQ ID NO: 690147 - RNA, 19 nt, Homo sapiens
ccagauuggcucacacuga

SEQ ID NO: 690148 - RNA, 23 nt, Homo sapiens
ccagauuggcucacacugagaau

SEQ ID NO: 690149 - RNA, 14 nt, Homo sapiens
ccagcacugaggaa

SEQ ID NO: 690150 - RNA, 20 nt, Homo sapiens
ccagccaucaaaaugcuuuu

SEQ ID NO: 690151 - RNA, 17 nt, Homo sapiens
ccagccaugucugcauu

SEQ ID NO: 690152 - RNA, 18 nt, Homo sapiens
ccaggcugaccacagcac

SEQ ID NO: 690153 - RNA, 18 nt, Homo sapiens
ccagggcuggacugaggc

SEQ ID NO: 690154 - RNA, 15 nt, Homo sapiens
ccaguucacccugau

SEQ ID NO: 690155 - RNA, 17 nt, Homo sapiens
ccaucacugguugcacu

SEQ ID NO: 690156 - RNA, 17 nt, Homo sapiens
ccaugauggcaacagau

SEQ ID NO: 690157 - RNA, 22 nt, Homo sapiens
ccaugauggcaacagaucugga

SEQ ID NO: 690158 - RNA, 23 nt, Homo sapiens
ccauucgguguggugcaguguga

SEQ ID NO: 690159 - RNA, 18 nt, Homo sapiens
cccagagacauacuugaa

SEQ ID NO: 690160 - RNA, 22 nt, Homo sapiens
cccagauuggcucacacugaga

SEQ ID NO: 690161 - RNA, 15 nt, Homo sapiens
cccagccucccugaa

SEQ ID NO: 690162 - RNA, 13 nt, Homo sapiens
cccaggaccagcu

SEQ ID NO: 690163 - RNA, 18 nt, Homo sapiens
cccaggacccugaagggg

SEQ ID NO: 690164 - RNA, 22 nt, Homo sapiens
cccagugcccccacugaccaga

SEQ ID NO: 690165 - RNA, 14 nt, Homo sapiens
cccauuccugaaga

SEQ ID NO: 690166 - RNA, 17 nt, Homo sapiens
ccccggggugcccacag

SEQ ID NO: 690167 - RNA, 21 nt, Homo sapiens
cccugacaucuggaaucugga

SEQ ID NO: 690168 - RNA, 17 nt, Homo sapiens
cccugcaguuugagaca

SEQ ID NO: 690169 - RNA, 20 nt, Homo sapiens
cccuggagcccauccagucu

SEQ ID NO: 690170 - RNA, 12 nt, Homo sapiens
cccugugcaacc

SEQ ID NO: 690171 - RNA, 20 nt, Homo sapiens
cccuucccucaccuuggcac

SEQ ID NO: 690172 - RNA, 19 nt, Homo sapiens
cccuuugaugauuaauuca

SEQ ID NO: 690173 - RNA, 20 nt, Homo sapiens
ccuaaaacaccugguaggag

SEQ ID NO: 690174 - RNA, 12 nt, Homo sapiens
ccuaaugcuccu

SEQ ID NO: 690175 - RNA, 14 nt, Homo sapiens
ccucagccagagaa

SEQ ID NO: 690176 - RNA, 18 nt, Homo sapiens
ccucccaaaugagccaug

SEQ ID NO: 690177 - RNA, 14 nt, Homo sapiens
ccucccgggcucaa

SEQ ID NO: 690178 - RNA, 20 nt, Homo sapiens
ccucugucagucacagccac

SEQ ID NO: 690179 - RNA, 19 nt, Homo sapiens
ccucuguccccuucucuca

SEQ ID NO: 690180 - RNA, 13 nt, Homo sapiens
ccucuuugcuuug

SEQ ID NO: 690181 - RNA, 15 nt, Homo sapiens
ccugaagaaccaguc

SEQ ID NO: 690182 - RNA, 21 nt, Homo sapiens
ccugagauccggcaacaucaa

SEQ ID NO: 690183 - RNA, 17 nt, Homo sapiens
ccugagauuucaucugc

SEQ ID NO: 690184 - RNA, 19 nt, Homo sapiens
ccugauuuaggagaagcca

SEQ ID NO: 690185 - RNA, 20 nt, Homo sapiens
ccugcgccaccgcccagaga

SEQ ID NO: 690186 - RNA, 23 nt, Homo sapiens
ccugcgggugaacaaagcagcca

SEQ ID NO: 690187 - RNA, 16 nt, Homo sapiens
ccugcuuugggaagcc

SEQ ID NO: 690188 - RNA, 15 nt, Homo sapiens
ccuggcagcucugga

SEQ ID NO: 690189 - RNA, 13 nt, Homo sapiens
ccuggccagacac

SEQ ID NO: 690190 - RNA, 21 nt, Homo sapiens
ccuggcuccaacacugcugcu

SEQ ID NO: 690191 - RNA, 20 nt, Homo sapiens
ccuguguguccaaaacugcc

SEQ ID NO: 690192 - RNA, 17 nt, Homo sapiens
ccuguucugaacugugg

SEQ ID NO: 690193 - RNA, 21 nt, Homo sapiens
cgaaaccgguggggcugguuc

SEQ ID NO: 690194 - RNA, 22 nt, Homo sapiens
cgacuaauuucaaaaugcuuuu

SEQ ID NO: 690195 - RNA, 17 nt, Homo sapiens
cgcagugugcacuaagg

SEQ ID NO: 690196 - RNA, 15 nt, Homo sapiens
cgcaucucagugcag

SEQ ID NO: 690197 - RNA, 20 nt, Homo sapiens
cgcgcaccuguaaucccagc

SEQ ID NO: 690198 - RNA, 15 nt, Homo sapiens
cguucugugcacaaa

SEQ ID NO: 690199 - RNA, 18 nt, Homo sapiens
cuaaaagugggcuugauu

SEQ ID NO: 690200 - RNA, 15 nt, Homo sapiens
cuaaaugcacaguca

SEQ ID NO: 690201 - RNA, 21 nt, Homo sapiens
cuaaaugcacagucaugugcc

SEQ ID NO: 690202 - RNA, 22 nt, Homo sapiens
cuagagagggaggcaagcccug

SEQ ID NO: 690203 - RNA, 19 nt, Homo sapiens
cuagaugauggaugccaau

SEQ ID NO: 690204 - RNA, 13 nt, Homo sapiens
cuagcagcaccgu

SEQ ID NO: 690205 - RNA, 19 nt, Homo sapiens
cuauuuauauguacaugag

SEQ ID NO: 690206 - RNA, 14 nt, Homo sapiens
cucaaaguuucaga

SEQ ID NO: 690207 - RNA, 23 nt, Homo sapiens
cucaagaaauaaaaggaagccaa

SEQ ID NO: 690208 - RNA, 13 nt, Homo sapiens
cucacaaccugaa

SEQ ID NO: 690209 - RNA, 16 nt, Homo sapiens
cucagaggcgcacugu

SEQ ID NO: 690210 - RNA, 18 nt, Homo sapiens
cucagaucaguguaccau

SEQ ID NO: 690211 - RNA, 15 nt, Homo sapiens
cucagcccugacccu

SEQ ID NO: 690212 - RNA, 21 nt, Homo sapiens
cucagccuugccagagaucca

SEQ ID NO: 690213 - RNA, 13 nt, Homo sapiens
cucaggacagaug

SEQ ID NO: 690214 - RNA, 18 nt, Homo sapiens
cucauuccccaaccacuu

SEQ ID NO: 690215 - RNA, 17 nt, Homo sapiens
cuccacucaguugcaac

SEQ ID NO: 690216 - RNA, 18 nt, Homo sapiens
cuccagaugcagggcagu

SEQ ID NO: 690217 - RNA, 20 nt, Homo sapiens
cuccagauguuuccagacuu

SEQ ID NO: 690218 - RNA, 19 nt, Homo sapiens
cuccaguuuuuuguuauau

SEQ ID NO: 690219 - RNA, 19 nt, Homo sapiens
cucccaaagugcugggauu

SEQ ID NO: 690220 - RNA, 13 nt, Homo sapiens
cuccccaggggag

SEQ ID NO: 690221 - RNA, 12 nt, Homo sapiens
cuccccauggag

SEQ ID NO: 690222 - RNA, 16 nt, Homo sapiens
cucccugaagccuuug

SEQ ID NO: 690223 - RNA, 20 nt, Homo sapiens
cucccugcaucugaccagca

SEQ ID NO: 690224 - RNA, 15 nt, Homo sapiens
cuccuucagacaccc

SEQ ID NO: 690225 - RNA, 14 nt, Homo sapiens
cucgaaacacagaa

SEQ ID NO: 690226 - RNA, 20 nt, Homo sapiens
cucuacuaaaaauacaaaaa

SEQ ID NO: 690227 - RNA, 22 nt, Homo sapiens
cucucauguuuucaacugccaa

SEQ ID NO: 690228 - RNA, 16 nt, Homo sapiens
cagugcccccacugac

SEQ ID NO: 690229 - RNA, 22 nt, Homo sapiens
cauaaauuagaggucuccaaaa

SEQ ID NO: 690230 - RNA, 19 nt, Homo sapiens
cauaggacucaaaguuuca

SEQ ID NO: 690231 - RNA, 13 nt, Homo sapiens
cauaucuuuauua

SEQ ID NO: 690232 - RNA, 13 nt, Homo sapiens
caucuaagccuga

SEQ ID NO: 690233 - RNA, 15 nt, Homo sapiens
caucucagugcagga

SEQ ID NO: 690234 - RNA, 17 nt, Homo sapiens
caugauuuccuugaaug

SEQ ID NO: 690235 - RNA, 16 nt, Homo sapiens
caugccacaaggacuu

SEQ ID NO: 690236 - RNA, 16 nt, Homo sapiens
caugcccugugcaacc

SEQ ID NO: 690237 - RNA, 20 nt, Homo sapiens
caugcgguagccagcacaca

SEQ ID NO: 690238 - RNA, 21 nt, Homo sapiens
caugugcggggaucaucugcc

SEQ ID NO: 690239 - RNA, 23 nt, Homo sapiens
cauuagggggaacucuagccaaa

SEQ ID NO: 690240 - RNA, 13 nt, Homo sapiens
cauuccugaagaa

SEQ ID NO: 690241 - RNA, 23 nt, Homo sapiens
cauugaccgcgacuaauuucaaa

SEQ ID NO: 690242 - RNA, 17 nt, Homo sapiens
cuggaaucuggagacca

SEQ ID NO: 690243 - RNA, 22 nt, Homo sapiens
cuggaguugaucuggaacccag

SEQ ID NO: 690244 - RNA, 17 nt, Homo sapiens
cuguaaucccagcacuu

SEQ ID NO: 690245 - RNA, 18 nt, Homo sapiens
cuguaaucccagcuacuu

SEQ ID NO: 690246 - RNA, 22 nt, Homo sapiens
cuguacuccagccugggugaca

SEQ ID NO: 690247 - RNA, 17 nt, Homo sapiens
cuguccccuucucucau

SEQ ID NO: 690248 - RNA, 19 nt, Homo sapiens
cugugagcccagcuggguc

SEQ ID NO: 690249 - RNA, 20 nt, Homo sapiens
cugugcccggggaaaggcaa

SEQ ID NO: 690250 - RNA, 14 nt, Homo sapiens
cuguucuccagugu

SEQ ID NO: 690251 - RNA, 16 nt, Homo sapiens
cuuaauacuaccuuga

SEQ ID NO: 690252 - RNA, 20 nt, Homo sapiens
cuuagaacauuuuaauucau

SEQ ID NO: 690253 - RNA, 19 nt, Homo sapiens
cuuagauguuccaguaauc

SEQ ID NO: 690254 - RNA, 13 nt, Homo sapiens
cuuaucauggucu

SEQ ID NO: 690255 - RNA, 17 nt, Homo sapiens
cuucacccuggagccca

SEQ ID NO: 690256 - RNA, 12 nt, Homo sapiens
cuucagacaccc

SEQ ID NO: 690257 - RNA, 23 nt, Homo sapiens
cuuccagguguuacuguaauucc

SEQ ID NO: 690258 - RNA, 20 nt, Homo sapiens
cuuccuggcuccaacacugc

SEQ ID NO: 690259 - RNA, 22 nt, Homo sapiens
cuucuuauggaauugauuugca

SEQ ID NO: 690260 - RNA, 21 nt, Homo sapiens
cuugagaaaccuuauuguacc

SEQ ID NO: 690261 - RNA, 22 nt, Homo sapiens
cuugaucaacaucuuuucuugc

SEQ ID NO: 690262 - RNA, 12 nt, Homo sapiens
cuugccagagau

SEQ ID NO: 690263 - RNA, 16 nt, Homo sapiens
cuuggcaccagacacc

SEQ ID NO: 690264 - RNA, 22 nt, Homo sapiens
cuuguauuaaacucuucacaaa

SEQ ID NO: 690265 - RNA, 13 nt, Homo sapiens
cuuuccuccugag

SEQ ID NO: 690266 - RNA, 23 nt, Homo sapiens
cuuucugauaacuagauggugcu

SEQ ID NO: 690267 - RNA, 13 nt, Homo sapiens
cuuucuguucucc

SEQ ID NO: 690268 - RNA, 15 nt, Homo sapiens
cuuucuguucuccag

SEQ ID NO: 690269 - RNA, 22 nt, Homo sapiens
cuuugaucccugacaucuggaa

SEQ ID NO: 690270 - RNA, 20 nt, Homo sapiens
cuuugggccagacaugccac

SEQ ID NO: 690271 - RNA, 18 nt, Homo sapiens
cuuuuauugacacagaaa

SEQ ID NO: 690272 - RNA, 21 nt, Homo sapiens
gaaaauguugagaaucccaaa

SEQ ID NO: 690273 - RNA, 21 nt, Homo sapiens
gaaacgucuucuaaacuuccc

SEQ ID NO: 690274 - RNA, 16 nt, Homo sapiens
gaaauuaagaaggcaa

SEQ ID NO: 690275 - RNA, 17 nt, Homo sapiens
gaaauuaagaaggcaaa

SEQ ID NO: 690276 - RNA, 23 nt, Homo sapiens
gaacacuaacuaugcauggugcc

SEQ ID NO: 690277 - RNA, 18 nt, Homo sapiens
gaacacucuuuugcuuua

SEQ ID NO: 690278 - RNA, 15 nt, Homo sapiens
gaacccagacucaga

SEQ ID NO: 690279 - RNA, 13 nt, Homo sapiens
gaaccguuuugaa

SEQ ID NO: 690280 - RNA, 15 nt, Homo sapiens
gaaccuggaacuugg

SEQ ID NO: 690281 - RNA, 17 nt, Homo sapiens
gaacuaaacucauuuau

SEQ ID NO: 690282 - RNA, 19 nt, Homo sapiens
gaacucaaauggggccaga

SEQ ID NO: 690283 - RNA, 14 nt, Homo sapiens
gaacucacuggggc

SEQ ID NO: 690284 - RNA, 14 nt, Homo sapiens
gaacuuuaagcaac

SEQ ID NO: 690285 - RNA, 14 nt, Homo sapiens
gaagaaaacaucua

SEQ ID NO: 690286 - RNA, 18 nt, Homo sapiens
gaagccaggaauuuccca

SEQ ID NO: 690287 - RNA, 17 nt, Homo sapiens
gaagccugaugcugaca

SEQ ID NO: 690288 - RNA, 15 nt, Homo sapiens
gaagcuuccauucca

SEQ ID NO: 690289 - RNA, 14 nt, Homo sapiens
gaaggaacuuccag

SEQ ID NO: 690290 - RNA, 12 nt, Homo sapiens
gaagggccagag

SEQ ID NO: 690291 - RNA, 20 nt, Homo sapiens
gaaguugcagugagcugaua

SEQ ID NO: 690292 - RNA, 18 nt, Homo sapiens
gaauauuuauuaccucug

SEQ ID NO: 690293 - RNA, 14 nt, Homo sapiens
gaaucuggagacca

SEQ ID NO: 690294 - RNA, 23 nt, Homo sapiens
gaauuggauacauacaccagcau

SEQ ID NO: 690295 - RNA, 18 nt, Homo sapiens
gacaaguggacucagggc

SEQ ID NO: 690296 - RNA, 21 nt, Homo sapiens
gacauaaugggguccuggcca

SEQ ID NO: 690297 - RNA, 15 nt, Homo sapiens
gaccaccacuucgaa

SEQ ID NO: 690298 - RNA, 21 nt, Homo sapiens
gaccacgcuuucuagcuguug

SEQ ID NO: 690299 - RNA, 16 nt, Homo sapiens
gaccuggcagcucugg

SEQ ID NO: 690300 - RNA, 22 nt, Homo sapiens
gacuaauuucaaaaugcuuuuu

SEQ ID NO: 690301 - RNA, 16 nt, Homo sapiens
gagaauguaagaacua

SEQ ID NO: 690302 - RNA, 14 nt, Homo sapiens
gagacagugaggcu

SEQ ID NO: 690303 - RNA, 14 nt, Homo sapiens
gagacauacuugaa

SEQ ID NO: 690304 - RNA, 22 nt, Homo sapiens
gagacauacuugaagggccaga

SEQ ID NO: 690305 - RNA, 23 nt, Homo sapiens
gagacauacuugaagggccagag

SEQ ID NO: 690306 - RNA, 19 nt, Homo sapiens
gagacucgagaacuuucau

SEQ ID NO: 690307 - RNA, 17 nt, Homo sapiens
gagagccuggugcugcu

SEQ ID NO: 690308 - RNA, 20 nt, Homo sapiens
gagauggaaguugcagugag

SEQ ID NO: 690309 - RNA, 15 nt, Homo sapiens
gagccagcucccucu

SEQ ID NO: 690310 - RNA, 20 nt, Homo sapiens
gaggcaagagaauugcuuga

SEQ ID NO: 690311 - RNA, 16 nt, Homo sapiens
gaggcugaggcaagag

SEQ ID NO: 690312 - RNA, 17 nt, Homo sapiens
gagggaggcucaggucc

SEQ ID NO: 690313 - RNA, 17 nt, Homo sapiens
gagggaggguggccuaa

SEQ ID NO: 690314 - RNA, 13 nt, Homo sapiens
gaguugaucugga

SEQ ID NO: 690315 - RNA, 12 nt, Homo sapiens
gauagcacuuuc

SEQ ID NO: 690316 - RNA, 12 nt, Homo sapiens
gaucccugacau

SEQ ID NO: 690317 - RNA, 18 nt, Homo sapiens
gaucuggaaccucagccu

SEQ ID NO: 690318 - RNA, 18 nt, Homo sapiens
gaucuguuuugaaggcaa

SEQ ID NO: 690319 - RNA, 21 nt, Homo sapiens
gaugaaguuuuacauuguuga

SEQ ID NO: 690320 - RNA, 13 nt, Homo sapiens
gaugauacaucca

SEQ ID NO: 690321 - RNA, 20 nt, Homo sapiens
gaugcugccccucaucucuc

SEQ ID NO: 690322 - RNA, 13 nt, Homo sapiens
gaugugaagccaa

SEQ ID NO: 690323 - RNA, 18 nt, Homo sapiens
gauguuuccagacuuccu

SEQ ID NO: 690324 - RNA, 12 nt, Homo sapiens
gauuauguugcu

SEQ ID NO: 690325 - RNA, 12 nt, Homo sapiens
gcaaaauugcaa

SEQ ID NO: 690326 - RNA, 17 nt, Homo sapiens
gcaaagaucuguccuca

SEQ ID NO: 690327 - RNA, 16 nt, Homo sapiens
gcaccguucugugcac

SEQ ID NO: 690328 - RNA, 15 nt, Homo sapiens
gcacugacugggcau

SEQ ID NO: 690329 - RNA, 20 nt, Homo sapiens
gcacugaugcugccccucau

SEQ ID NO: 690330 - RNA, 17 nt, Homo sapiens
gcagcgccaggcugacc

SEQ ID NO: 690331 - RNA, 17 nt, Homo sapiens
gcagcgccuuucccaac

SEQ ID NO: 690332 - RNA, 17 nt, Homo sapiens
gcagcugguaaucuugc

SEQ ID NO: 690333 - RNA, 21 nt, Homo sapiens
gcaggacuugagaagaccuca

SEQ ID NO: 690334 - RNA, 21 nt, Homo sapiens
gcagggugcaguaucaugccc

SEQ ID NO: 690335 - RNA, 19 nt, Homo sapiens
gcaguaucaugcccugugc

SEQ ID NO: 690336 - RNA, 20 nt, Homo sapiens
gcaucuagauuauggagcuu

SEQ ID NO: 690337 - RNA, 15 nt, Homo sapiens
gcaucugaccagcag

SEQ ID NO: 690338 - RNA, 22 nt, Homo sapiens
gcauguaccccagguacaucca

SEQ ID NO: 690339 - RNA, 13 nt, Homo sapiens
gcauuaaauucac

SEQ ID NO: 690340 - RNA, 10 nt, Homo sapiens
uuaaacuggu

SEQ ID NO: 690341 - RNA, 12 nt, Homo sapiens
uuaccucugaua

SEQ ID NO: 690342 - RNA, 21 nt, Homo sapiens
uuagaauaguguucugcaaaa

SEQ ID NO: 690343 - RNA, 15 nt, Homo sapiens
uuagcagcagccuuu

SEQ ID NO: 690344 - RNA, 12 nt, Homo sapiens
uuauuaccucug

SEQ ID NO: 690345 - RNA, 23 nt, Homo sapiens
uucagacucccauuccugaagaa

SEQ ID NO: 690346 - RNA, 14 nt, Homo sapiens
uuccagguguuacu

SEQ ID NO: 690347 - RNA, 18 nt, Homo sapiens
uucccugaccucccucua

SEQ ID NO: 690348 - RNA, 21 nt, Homo sapiens
uuccuugaauguggcuugaga

SEQ ID NO: 690349 - RNA, 21 nt, Homo sapiens
uucuauuuauauguacaugag

SEQ ID NO: 690350 - RNA, 17 nt, Homo sapiens
uucuccugugugauuga

SEQ ID NO: 690351 - RNA, 14 nt, Homo sapiens
uucuccuucagccc

SEQ ID NO: 690352 - RNA, 22 nt, Homo sapiens
uucuuuaaaaaacaacuaugga

SEQ ID NO: 690353 - RNA, 14 nt, Homo sapiens
uugagacaggagac

SEQ ID NO: 690354 - RNA, 15 nt, Homo sapiens
uuggauugggguccc

SEQ ID NO: 690355 - RNA, 12 nt, Homo sapiens
uuggauuugaca

SEQ ID NO: 690356 - RNA, 17 nt, Homo sapiens
uuggcucacacugagaa

SEQ ID NO: 690357 - RNA, 16 nt, Homo sapiens
uugggccagacaugcc

SEQ ID NO: 690358 - RNA, 19 nt, Homo sapiens
uuuaaugccgauauacucu

SEQ ID NO: 690359 - RNA, 17 nt, Homo sapiens
uuuauuauuuucaccug

SEQ ID NO: 690360 - RNA, 12 nt, Homo sapiens
uuucaagucaaa

SEQ ID NO: 690361 - RNA, 15 nt, Homo sapiens
uuucaucugcucucc

SEQ ID NO: 690362 - RNA, 13 nt, Homo sapiens
uuucauguaaucc

SEQ ID NO: 690363 - RNA, 19 nt, Homo sapiens
uuuccagacuuccuugaga

SEQ ID NO: 690364 - RNA, 12 nt, Homo sapiens
uuuccuccugag

SEQ ID NO: 690365 - RNA, 20 nt, Homo sapiens
uuucuacaaugugaacuuua

SEQ ID NO: 690366 - RNA, 18 nt, Homo sapiens
uuugaagaacaugugaga

SEQ ID NO: 690367 - RNA, 15 nt, Homo sapiens
uuugacucuggcaaa

SEQ ID NO: 690368 - RNA, 14 nt, Homo sapiens
uuugagacaggaga

SEQ ID NO: 690369 - RNA, 15 nt, Homo sapiens
uuugcuuucugcuca

SEQ ID NO: 690370 - RNA, 14 nt, Homo sapiens
uuugggccagacau

SEQ ID NO: 690371 - RNA, 12 nt, Homo sapiens
uuuugaaggcaa

SEQ ID NO: 690372 - RNA, 14 nt, Homo sapiens
uacaaauggacaua

SEQ ID NO: 690373 - RNA, 20 nt, Homo sapiens
uacaaugugaacuuuauuaa

SEQ ID NO: 690374 - RNA, 21 nt, Homo sapiens
uacaugagaaggaacuuccag

SEQ ID NO: 690375 - RNA, 23 nt, Homo sapiens
uacauuguuugucugucuucaua

SEQ ID NO: 690376 - RNA, 21 nt, Homo sapiens
uacucuuagauggauucucca

SEQ ID NO: 690377 - RNA, 21 nt, Homo sapiens
uacugaaaaggaggggucugg

SEQ ID NO: 690378 - RNA, 23 nt, Homo sapiens
uagaauauuuauuaccucugaua

SEQ ID NO: 690379 - RNA, 22 nt, Homo sapiens
uagcagcaccguucugugcaca

SEQ ID NO: 690380 - RNA, 16 nt, Homo sapiens
uagccugggguggggu

SEQ ID NO: 690381 - RNA, 16 nt, Homo sapiens
uagcucuauguuuaca

SEQ ID NO: 690382 - RNA, 22 nt, Homo sapiens
uaguccgugcugacagcugcuc

SEQ ID NO: 690383 - RNA, 15 nt, Homo sapiens
uauaaaaagcuucca

SEQ ID NO: 690384 - RNA, 21 nt, Homo sapiens
uauacaaauuagaaaauguua

SEQ ID NO: 690385 - RNA, 13 nt, Homo sapiens
uauauacauagca

SEQ ID NO: 690386 - RNA, 21 nt, Homo sapiens
uauauagggaucaaccagcua

SEQ ID NO: 690387 - RNA, 19 nt, Homo sapiens
uauauuugugauagcacuu

SEQ ID NO: 690388 - RNA, 17 nt, Homo sapiens
uaucaugcccugugcaa

SEQ ID NO: 690389 - RNA, 19 nt, Homo sapiens
uaucaugcccugugcaacc

SEQ ID NO: 690390 - RNA, 22 nt, Homo sapiens
uauccauucuuucugauaacua

SEQ ID NO: 690391 - RNA, 13 nt, Homo sapiens
uaucuuugauucu

SEQ ID NO: 690392 - RNA, 19 nt, Homo sapiens
uauggaauugauuugcauu

SEQ ID NO: 690393 - RNA, 23 nt, Homo sapiens
uauguaguaauugacaugugcca

SEQ ID NO: 690394 - RNA, 14 nt, Homo sapiens
uauugcuguuucag

SEQ ID NO: 690395 - RNA, 21 nt, Homo sapiens
uauuuacugagcuucucugug

SEQ ID NO: 690396 - RNA, 20 nt, Homo sapiens
ucaaauggggccagauccag

SEQ ID NO: 690397 - RNA, 11 nt, Homo sapiens
ucacacacuga

SEQ ID NO: 690398 - RNA, 20 nt, Homo sapiens
ucacagccaccccugagauc

SEQ ID NO: 690399 - RNA, 23 nt, Homo sapiens
ucacaguucuuugggccagacau

SEQ ID NO: 690400 - RNA, 13 nt, Homo sapiens
ucaccauguugcc

SEQ ID NO: 690401 - RNA, 14 nt, Homo sapiens
ucaccuuccagugu

SEQ ID NO: 690402 - RNA, 17 nt, Homo sapiens
ucacugucuuuccuaga

SEQ ID NO: 690403 - RNA, 12 nt, Homo sapiens
ucacuucacccu

SEQ ID NO: 690404 - RNA, 17 nt, Homo sapiens
ucagcccugacccugug

SEQ ID NO: 690405 - RNA, 21 nt, Homo sapiens
ucagccuugccagagauccaa

SEQ ID NO: 690406 - RNA, 13 nt, Homo sapiens
ucaggcagggugc

SEQ ID NO: 690407 - RNA, 16 nt, Homo sapiens
ucaggcagggugcagu

SEQ ID NO: 690408 - RNA, 16 nt, Homo sapiens
ucagugauuacuguca

SEQ ID NO: 690409 - RNA, 13 nt, Homo sapiens
ucaucugugcacu

SEQ ID NO: 690410 - RNA, 13 nt, Homo sapiens
uccaaaaaugcac

SEQ ID NO: 690411 - RNA, 23 nt, Homo sapiens
uccaaaaaugcacccaacuagcu

SEQ ID NO: 690412 - RNA, 17 nt, Homo sapiens
uccaacaccaagcacag

SEQ ID NO: 690413 - RNA, 10 nt, Homo sapiens
uccacagcaa

SEQ ID NO: 690414 - RNA, 15 nt, Homo sapiens
uccaggcagauccag

SEQ ID NO: 690415 - RNA, 13 nt, Homo sapiens
uccagugcaggag

SEQ ID NO: 690416 - RNA, 15 nt, Homo sapiens
uccagugcaggagac

SEQ ID NO: 690417 - RNA, 13 nt, Homo sapiens
ucccaagcucaga

SEQ ID NO: 690418 - RNA, 20 nt, Homo sapiens
ucccaaguagcugggauuac

SEQ ID NO: 690419 - RNA, 16 nt, Homo sapiens
uccccuccaaccuggg

SEQ ID NO: 690420 - RNA, 16 nt, Homo sapiens
uccccugaccugugag

SEQ ID NO: 690421 - RNA, 18 nt, Homo sapiens
uccccuucucucaucucu

SEQ ID NO: 690422 - RNA, 23 nt, Homo sapiens
ucccucaccuuggcaccagacac

SEQ ID NO: 690423 - RNA, 17 nt, Homo sapiens
ucccucccccccaugca

SEQ ID NO: 690424 - RNA, 20 nt, Homo sapiens
uccuagauggcagucacuga

SEQ ID NO: 690425 - RNA, 18 nt, Homo sapiens
uccuaucaccuauuucca

SEQ ID NO: 690426 - RNA, 19 nt, Homo sapiens
uccucagccuugccagaga

SEQ ID NO: 690427 - RNA, 20 nt, Homo sapiens
uccuccagggugugugcucg

SEQ ID NO: 690428 - RNA, 15 nt, Homo sapiens
uccucccugcaucug

SEQ ID NO: 690429 - RNA, 16 nt, Homo sapiens
uccugaaacaacuugg

SEQ ID NO: 690430 - RNA, 13 nt, Homo sapiens
uccuuguuccuag

SEQ ID NO: 690431 - RNA, 21 nt, Homo sapiens
ucgcccugcgguagaugggag

SEQ ID NO: 690432 - RNA, 14 nt, Homo sapiens
ucuaauauggccac

SEQ ID NO: 690433 - RNA, 12 nt, Homo sapiens
ucucagugcagg

SEQ ID NO: 690434 - RNA, 21 nt, Homo sapiens
ucuccaaccccccagcacuga

SEQ ID NO: 690435 - RNA, 17 nt, Homo sapiens
ucuccccagcccagaga

SEQ ID NO: 690436 - RNA, 18 nt, Homo sapiens
ucuccccagcccagagac

SEQ ID NO: 690437 - RNA, 19 nt, Homo sapiens
ucucucaucucuuagcucc

SEQ ID NO: 690438 - RNA, 18 nt, Homo sapiens
ucugacaugauuccuucc

SEQ ID NO: 690439 - RNA, 20 nt, Homo sapiens
ucugagugaaccuguauaag

SEQ ID NO: 690440 - RNA, 23 nt, Homo sapiens
ucugcauuucgguggcuagucaa

SEQ ID NO: 690441 - RNA, 18 nt, Homo sapiens
ucuggaacccagacucag

SEQ ID NO: 690442 - RNA, 14 nt, Homo sapiens
ucugguccuaccca

SEQ ID NO: 690443 - RNA, 15 nt, Homo sapiens
ucugugcacugccca

SEQ ID NO: 690444 - RNA, 23 nt, Homo sapiens
ucuuagcuccccuccaaccuggg

SEQ ID NO: 690445 - RNA, 14 nt, Homo sapiens
ucuucuaaacuucc

SEQ ID NO: 690446 - RNA, 13 nt, Homo sapiens
ucuucucauuuca

SEQ ID NO: 690447 - RNA, 19 nt, Homo sapiens
ucuuuccuccuuccaugga

SEQ ID NO: 690448 - RNA, 17 nt, Homo sapiens
ugaacaaagcagccacg

SEQ ID NO: 690449 - RNA, 13 nt, Homo sapiens
ugaaccuguauaa

SEQ ID NO: 690450 - RNA, 20 nt, Homo sapiens
ugaaugaacacucuuuugcu

SEQ ID NO: 690451 - RNA, 19 nt, Homo sapiens
ugacauuucuuugugcuuu

SEQ ID NO: 690452 - RNA, 15 nt, Homo sapiens
ugaccacagcacagc

SEQ ID NO: 690453 - RNA, 18 nt, Homo sapiens
ugaccacagcacagccaa

SEQ ID NO: 690454 - RNA, 13 nt, Homo sapiens
ugacguagcugca

SEQ ID NO: 690455 - RNA, 23 nt, Homo sapiens
ugagaaaugggacuuaacuccuu

SEQ ID NO: 690456 - RNA, 19 nt, Homo sapiens
ugagcaacucuugauuauc

SEQ ID NO: 690457 - RNA, 14 nt, Homo sapiens
ugagccaugagaug

SEQ ID NO: 690458 - RNA, 21 nt, Homo sapiens
ugagcuauugcuguucucuug

SEQ ID NO: 690459 - RNA, 17 nt, Homo sapiens
ugagucagguuugagua

SEQ ID NO: 690460 - RNA, 20 nt, Homo sapiens
ugauaacuagauggugcuga

SEQ ID NO: 690461 - RNA, 23 nt, Homo sapiens
ugauagcacuuucuacaauguga

SEQ ID NO: 690462 - RNA, 18 nt, Homo sapiens
ugaucagaucugacauga

SEQ ID NO: 690463 - RNA, 20 nt, Homo sapiens
ugauccuggaggcccaguuc

SEQ ID NO: 690464 - RNA, 12 nt, Homo sapiens
ugaugaaugaga

SEQ ID NO: 690465 - RNA, 17 nt, Homo sapiens
ugaugauuaauucaccu

SEQ ID NO: 690466 - RNA, 23 nt, Homo sapiens
ugauuauccauauugagucaaau

SEQ ID NO: 690467 - RNA, 22 nt, Homo sapiens
ugauuuuuugcauuccugacaa

SEQ ID NO: 690468 - RNA, 15 nt, Homo sapiens
ugcaaaggacagauc

SEQ ID NO: 690469 - RNA, 13 nt, Homo sapiens
ugcaaugucugag

SEQ ID NO: 690470 - RNA, 16 nt, Homo sapiens
ugcaggacuugagaag

SEQ ID NO: 690471 - RNA, 20 nt, Homo sapiens
ugcauuuggauugggguccc

SEQ ID NO: 690472 - RNA, 14 nt, Homo sapiens
ugccaaaaugcucu

SEQ ID NO: 690473 - RNA, 20 nt, Homo sapiens
ugccaaccggucacccagga

SEQ ID NO: 690474 - RNA, 18 nt, Homo sapiens
ugccauacuuuccuguau

SEQ ID NO: 690475 - RNA, 20 nt, Homo sapiens
ugcuacaaauacucuuagga

SEQ ID NO: 690476 - RNA, 17 nt, Homo sapiens
ugcuccuuguuccuaga

SEQ ID NO: 690477 - RNA, 20 nt, Homo sapiens
ugcucugcuugacaacaucu

SEQ ID NO: 690478 - RNA, 15 nt, Homo sapiens
ugcugauuuggugac

SEQ ID NO: 690479 - RNA, 19 nt, Homo sapiens
uggaacacggccacaucaa

SEQ ID NO: 690480 - RNA, 15 nt, Homo sapiens
uggaacccagacuca

SEQ ID NO: 690481 - RNA, 15 nt, Homo sapiens
uggaauggagauuca

SEQ ID NO: 690482 - RNA, 24 nt, Homo sapiens
uggaguuucauguacaagaugaag

SEQ ID NO: 690483 - RNA, 17 nt, Homo sapiens
uggaugccaaccgguca

SEQ ID NO: 690484 - RNA, 16 nt, Homo sapiens
uggccaaggagcugcu

SEQ ID NO: 690485 - RNA, 18 nt, Homo sapiens
uggccaaggagcugcuau

SEQ ID NO: 690486 - RNA, 17 nt, Homo sapiens
uggcucagccagcacuu

SEQ ID NO: 690487 - RNA, 20 nt, Homo sapiens
uggcuccaacacugcugcuc

SEQ ID NO: 690488 - RNA, 21 nt, Homo sapiens
cauuucuauuuauuuacugag

SEQ ID NO: 690489 - RNA, 13 nt, Homo sapiens
ccaaaagaagccc

SEQ ID NO: 690490 - RNA, 16 nt, Homo sapiens
ccaaaaucuuaucaug

SEQ ID NO: 690491 - RNA, 22 nt, Homo sapiens
ccaaaaucuuaucauggucuca

SEQ ID NO: 690492 - RNA, 18 nt, Homo sapiens
ccaaccuggggggcagug

SEQ ID NO: 690493 - RNA, 18 nt, Homo sapiens
ccaagcaggaaccccagg

SEQ ID NO: 690494 - RNA, 23 nt, Homo sapiens
ccaaucccuuuauuacccccucc

SEQ ID NO: 690495 - RNA, 22 nt, Homo sapiens
ccacccucauucuacugaaaag

SEQ ID NO: 690496 - RNA, 21 nt, Homo sapiens
ccacccuggugggccaacaaa

SEQ ID NO: 690497 - RNA, 14 nt, Homo sapiens
ccaccgcccagaga

SEQ ID NO: 690498 - RNA, 21 nt, Homo sapiens
ccaccucccugccuccaggaa

SEQ ID NO: 690499 - RNA, 15 nt, Homo sapiens
ccacgaggugcaaca

SEQ ID NO: 690500 - RNA, 19 nt, Homo sapiens
ccacgugggcaaacaggca

SEQ ID NO: 690501 - RNA, 15 nt, Homo sapiens
ccacucaguugcaac

SEQ ID NO: 690502 - RNA, 12 nt, Homo sapiens
ccagaaugcugc

SEQ ID NO: 690503 - RNA, 20 nt, Homo sapiens
ccagagacauacuugaaggg

SEQ ID NO: 690504 - RNA, 12 nt, Homo sapiens
ccagauccagcc

SEQ ID NO: 690505 - RNA, 16 nt, Homo sapiens
ccagaugcagggcagu

SEQ ID NO: 690506 - RNA, 21 nt, Homo sapiens
ccagauuggcucacacugaga

SEQ ID NO: 690507 - RNA, 22 nt, Homo sapiens
ccagauuggcucacacugagaa

SEQ ID NO: 690508 - RNA, 14 nt, Homo sapiens
ccagcacacagggc

SEQ ID NO: 690509 - RNA, 17 nt, Homo sapiens
ccagcacacagggcagu

SEQ ID NO: 690510 - RNA, 20 nt, Homo sapiens
ccagccugggugacagagca

SEQ ID NO: 690511 - RNA, 18 nt, Homo sapiens
ccagcuaagaaccuggaa

SEQ ID NO: 690512 - RNA, 23 nt, Homo sapiens
ccagcugggucaggcagggugca

SEQ ID NO: 690513 - RNA, 14 nt, Homo sapiens
ccaggaaaggccca

SEQ ID NO: 690514 - RNA, 13 nt, Homo sapiens
ccaggacccugaa

SEQ ID NO: 690515 - RNA, 21 nt, Homo sapiens
ccaggacuauauuugggccug

SEQ ID NO: 690516 - RNA, 13 nt, Homo sapiens
ccaggacugggcc

SEQ ID NO: 690517 - RNA, 22 nt, Homo sapiens
ccagggacugaagccaaaguua

SEQ ID NO: 690518 - RNA, 23 nt, Homo sapiens
ccaucugggcuccuccagggugu

SEQ ID NO: 690519 - RNA, 14 nt, Homo sapiens
ccauggacaggcug

SEQ ID NO: 690520 - RNA, 13 nt, Homo sapiens
cccaauaauugca

SEQ ID NO: 690521 - RNA, 19 nt, Homo sapiens
cccagagacauacuugaag

SEQ ID NO: 690522 - RNA, 13 nt, Homo sapiens
cccagcacugagg

SEQ ID NO: 690523 - RNA, 14 nt, Homo sapiens
cccagcacugagga

SEQ ID NO: 690524 - RNA, 19 nt, Homo sapiens
gcccaggaccaucauccua

SEQ ID NO: 690525 - RNA, 13 nt, Homo sapiens
gcccugugcaacc

SEQ ID NO: 690526 - RNA, 15 nt, Homo sapiens
gccgaguccaagcug

SEQ ID NO: 690527 - RNA, 15 nt, Homo sapiens
gccucagccagagaa

SEQ ID NO: 690528 - RNA, 23 nt, Homo sapiens
gcgccaaauaaugucucugugag

SEQ ID NO: 690529 - RNA, 21 nt, Homo sapiens
gcgccaggauggaacacggcc

SEQ ID NO: 690530 - RNA, 20 nt, Homo sapiens
gcgccaggcugaccacagca

SEQ ID NO: 690531 - RNA, 18 nt, Homo sapiens
gcuacuguaauuuuauau

SEQ ID NO: 690532 - RNA, 22 nt, Homo sapiens
gcucagcuucuccugugugauu

SEQ ID NO: 690533 - RNA, 22 nt, Homo sapiens
gcuccaaccugcaaagaucugu

SEQ ID NO: 690534 - RNA, 16 nt, Homo sapiens
gcuccagaugcagggc

SEQ ID NO: 690535 - RNA, 19 nt, Homo sapiens
gcuccagaugcagggcagu

SEQ ID NO: 690536 - RNA, 13 nt, Homo sapiens
gcuccagugcagg

SEQ ID NO: 690537 - RNA, 22 nt, Homo sapiens
gcucccucuauuuauguuugca

SEQ ID NO: 690538 - RNA, 15 nt, Homo sapiens
gcuccuccagggugu

SEQ ID NO: 690539 - RNA, 21 nt, Homo sapiens
gcuccucuccccagcccagag

SEQ ID NO: 690540 - RNA, 15 nt, Homo sapiens
gcucuucucauuuca

SEQ ID NO: 690541 - RNA, 14 nt, Homo sapiens
gcugaccacagcac

SEQ ID NO: 690542 - RNA, 14 nt, Homo sapiens
gcugagcgccagga

SEQ ID NO: 690543 - RNA, 16 nt, Homo sapiens
gcugaggcaagagaau

SEQ ID NO: 690544 - RNA, 16 nt, Homo sapiens
gcugaggccacacuca

SEQ ID NO: 690545 - RNA, 17 nt, Homo sapiens
gcugcacccacccagga

SEQ ID NO: 690546 - RNA, 17 nt, Homo sapiens
gcugcaggacuugagaa

SEQ ID NO: 690547 - RNA, 17 nt, Homo sapiens
gcugccuuggcucagac

SEQ ID NO: 690548 - RNA, 16 nt, Homo sapiens
gcugcuccagugcagg

SEQ ID NO: 690549 - RNA, 23 nt, Homo sapiens
gcugggacguggcucagccagca

SEQ ID NO: 690550 - RNA, 20 nt, Homo sapiens
gcuguuuccauagggugaca

SEQ ID NO: 690551 - RNA, 14 nt, Homo sapiens
gcuuccuaacugcu

SEQ ID NO: 690552 - RNA, 22 nt, Homo sapiens
gcuucuccugugugauugacag

SEQ ID NO: 690553 - RNA, 20 nt, Homo sapiens
gcuuuauuccagaaugcugu

SEQ ID NO: 690554 - RNA, 16 nt, Homo sapiens
gcuuugcuuucugcuc

SEQ ID NO: 690555 - RNA, 16 nt, Homo sapiens
gcuuuggauuugacau

SEQ ID NO: 690556 - RNA, 16 nt, Homo sapiens
ggaacucagauccagg

SEQ ID NO: 690557 - RNA, 15 nt, Homo sapiens
ggaagaucaggucau

SEQ ID NO: 690558 - RNA, 20 nt, Homo sapiens
ggacacagucagauuuccag

SEQ ID NO: 690559 - RNA, 22 nt, Homo sapiens
ggacagaauuggauacauacac

SEQ ID NO: 690560 - RNA, 16 nt, Homo sapiens
ggagaaaauucaauug

SEQ ID NO: 690561 - RNA, 16 nt, Homo sapiens
ggagacuuuacaugga

SEQ ID NO: 690562 - RNA, 23 nt, Homo sapiens
aguguggccacgugggcaaacag

SEQ ID NO: 690563 - RNA, 17 nt, Homo sapiens
aguucuuugggccagac

SEQ ID NO: 690564 - RNA, 21 nt, Homo sapiens
aguuucauguacaagaugaag

SEQ ID NO: 690565 - RNA, 13 nt, Homo sapiens
aguuugagacagg

SEQ ID NO: 690566 - RNA, 13 nt, Homo sapiens
aguuuucaaguca

SEQ ID NO: 690567 - RNA, 14 nt, Homo sapiens
auaaauuugguucu

SEQ ID NO: 690568 - RNA, 22 nt, Homo sapiens
auaacuaggaaauccauucaca

SEQ ID NO: 690569 - RNA, 17 nt, Homo sapiens
auacauaucuuuauuaa

SEQ ID NO: 690570 - RNA, 21 nt, Homo sapiens
auaccucaacccccauuucua

SEQ ID NO: 690571 - RNA, 17 nt, Homo sapiens
auacuaucuacucuccu

SEQ ID NO: 690572 - RNA, 15 nt, Homo sapiens
auacucuagaugaag

SEQ ID NO: 690573 - RNA, 22 nt, Homo sapiens
auagaugcuggcccagggccca

SEQ ID NO: 690574 - RNA, 14 nt, Homo sapiens
auaguuaagacaug

SEQ ID NO: 690575 - RNA, 18 nt, Homo sapiens
aucaugcccugugcaacc

SEQ ID NO: 690576 - RNA, 17 nt, Homo sapiens
aucauggucucagucau

SEQ ID NO: 690577 - RNA, 16 nt, Homo sapiens
auccaggcagauccag

SEQ ID NO: 690578 - RNA, 17 nt, Homo sapiens
auccauauugagucaaa

SEQ ID NO: 690579 - RNA, 15 nt, Homo sapiens
auccauucacaguuc

SEQ ID NO: 690580 - RNA, 23 nt, Homo sapiens
aucggaucuggggcucugggaua

SEQ ID NO: 690581 - RNA, 22 nt, Homo sapiens
aucuaauauggccacaguaguc

SEQ ID NO: 690582 - RNA, 16 nt, Homo sapiens
caugauuuccuugaau

SEQ ID NO: 690583 - RNA, 14 nt, Homo sapiens
caugccccuggcug

SEQ ID NO: 690584 - RNA, 14 nt, Homo sapiens
caugcccugugcaa

SEQ ID NO: 690585 - RNA, 15 nt, Homo sapiens
caugcccugugcaac

SEQ ID NO: 690586 - RNA, 18 nt, Homo sapiens
caugcgguagccagcaca

SEQ ID NO: 690587 - RNA, 22 nt, Homo sapiens
cauggugccccaggaccagcuc

SEQ ID NO: 690588 - RNA, 21 nt, Homo sapiens
cauguagcccccuggccucug

SEQ ID NO: 690589 - RNA, 14 nt, Homo sapiens
caugucugcauuuc

SEQ ID NO: 690590 - RNA, 17 nt, Homo sapiens
caugugccagggcaaug

SEQ ID NO: 690591 - RNA, 18 nt, Homo sapiens
cauuaaauucacaaacuu

SEQ ID NO: 690592 - RNA, 13 nt, Homo sapiens
cauucacaguucu

SEQ ID NO: 690593 - RNA, 22 nt, Homo sapiens
cauucacaguucuuugggccag

SEQ ID NO: 690594 - RNA, 20 nt, Homo sapiens
cauucagugauuacugucaa

SEQ ID NO: 690595 - RNA, 22 nt, Homo sapiens
cauucagugauuacugucaagg

SEQ ID NO: 690596 - RNA, 19 nt, Homo sapiens
cauuccugaagaaccaguc

SEQ ID NO: 690597 - RNA, 14 nt, Homo sapiens
cauuccugacaaag

SEQ ID NO: 690598 - RNA, 19 nt, Homo sapiens
ccaaaauaguuaagacaug

SEQ ID NO: 690599 - RNA, 18 nt, Homo sapiens
ccaaaaucggaucugggg

SEQ ID NO: 690600 - RNA, 21 nt, Homo sapiens
ccaacagaagcuuccauucca

SEQ ID NO: 690601 - RNA, 20 nt, Homo sapiens
ccaaccccccagcacugagg

SEQ ID NO: 690602 - RNA, 18 nt, Homo sapiens
cugacguagcugcaaagg

SEQ ID NO: 690603 - RNA, 18 nt, Homo sapiens
cugcaaaggacagaucca

SEQ ID NO: 690604 - RNA, 22 nt, Homo sapiens
cugcaaaggacagauccaggga

SEQ ID NO: 690605 - RNA, 20 nt, Homo sapiens
cugcccaacccuucccucac

SEQ ID NO: 690606 - RNA, 22 nt, Homo sapiens
cugcccauggacaggcuggcuc

SEQ ID NO: 690607 - RNA, 18 nt, Homo sapiens
cugcugcuccagugcagg

SEQ ID NO: 690608 - RNA, 20 nt, Homo sapiens
cugcuugagucagguuugag

SEQ ID NO: 690609 - RNA, 12 nt, Homo sapiens
cuggaacccaga

SEQ ID NO: 690610 - RNA, 21 nt, Homo sapiens
cuggagaccagggagccuuug

SEQ ID NO: 690611 - RNA, 17 nt, Homo sapiens
cugggcuccuccagggu

SEQ ID NO: 690612 - RNA, 13 nt, Homo sapiens
cuguauaagugga

SEQ ID NO: 690613 - RNA, 12 nt, Homo sapiens
cuguccagcucc

SEQ ID NO: 690614 - RNA, 21 nt, Homo sapiens
cuguccccuucucucaucucu

SEQ ID NO: 690615 - RNA, 19 nt, Homo sapiens
cuguccucagccuugccag

SEQ ID NO: 690616 - RNA, 20 nt, Homo sapiens
cuguccucagccuugccaga

SEQ ID NO: 690617 - RNA, 16 nt, Homo sapiens
cuguguguccaaaacu

SEQ ID NO: 690618 - RNA, 15 nt, Homo sapiens
cuguguguugccaca

SEQ ID NO: 690619 - RNA, 15 nt, Homo sapiens
cuguuccccagagaa

SEQ ID NO: 690620 - RNA, 23 nt, Homo sapiens
cuuaggccuuccucucuccagau

SEQ ID NO: 690621 - RNA, 18 nt, Homo sapiens
cuuauggaauugauuugc

SEQ ID NO: 690622 - RNA, 15 nt, Homo sapiens
gcucuauguuuacaa

SEQ ID NO: 690623 - RNA, 20 nt, Homo sapiens
gcucugcuugacaacaucug

SEQ ID NO: 690624 - RNA, 16 nt, Homo sapiens
gcucuucucauuucac

SEQ ID NO: 690625 - RNA, 20 nt, Homo sapiens
gcugaccacagcacagccaa

SEQ ID NO: 690626 - RNA, 15 nt, Homo sapiens
gcugaggcuggcaca

SEQ ID NO: 690627 - RNA, 16 nt, Homo sapiens
gcugcacccacccagg

SEQ ID NO: 690628 - RNA, 16 nt, Homo sapiens
gcugggacguggcuca

SEQ ID NO: 690629 - RNA, 17 nt, Homo sapiens
gcugguaaucuugcucu

SEQ ID NO: 690630 - RNA, 16 nt, Homo sapiens
gcugucaucugugcac

SEQ ID NO: 690631 - RNA, 22 nt, Homo sapiens
gcuguuuuccucccuucugcua

SEQ ID NO: 690632 - RNA, 23 nt, Homo sapiens
ggaacacggccacaucaaagagg

SEQ ID NO: 690633 - RNA, 14 nt, Homo sapiens
ggaacccagacuca

SEQ ID NO: 690634 - RNA, 16 nt, Homo sapiens
ggaacccagacucaga

SEQ ID NO: 690635 - RNA, 18 nt, Homo sapiens
ggaacccagacucagaca

SEQ ID NO: 690636 - RNA, 20 nt, Homo sapiens
ggaaccucagccuggccaga

SEQ ID NO: 690637 - RNA, 23 nt, Homo sapiens
ggacacuuaauacuaccuugaaa

SEQ ID NO: 690638 - RNA, 18 nt, Homo sapiens
ggacagccccacccuggu

SEQ ID NO: 690639 - RNA, 15 nt, Homo sapiens
ggaccagcucaggac

SEQ ID NO: 690640 - RNA, 15 nt, Homo sapiens
ggacugaagccaaag

SEQ ID NO: 690641 - RNA, 18 nt, Homo sapiens
ggacuuccuguccagcuc

SEQ ID NO: 690642 - RNA, 17 nt, Homo sapiens
aucacugguugcacuua

SEQ ID NO: 690643 - RNA, 12 nt, Homo sapiens
auccaccugccu

SEQ ID NO: 690644 - RNA, 15 nt, Homo sapiens
auccaggcagaucca

SEQ ID NO: 690645 - RNA, 23 nt, Homo sapiens
auccagggacugaagccaaaguu

SEQ ID NO: 690646 - RNA, 20 nt, Homo sapiens
auccccgcagugugcacuaa

SEQ ID NO: 690647 - RNA, 22 nt, Homo sapiens
aucccugacaucuggaaucugg

SEQ ID NO: 690648 - RNA, 19 nt, Homo sapiens
aucgaaucuacuaauucca

SEQ ID NO: 690649 - RNA, 14 nt, Homo sapiens
aucuauucucucca

SEQ ID NO: 690650 - RNA, 22 nt, Homo sapiens
aucuucuaaacccaauccaaau

SEQ ID NO: 690651 - RNA, 18 nt, Homo sapiens
aucuuugauucuccuuca

SEQ ID NO: 690652 - RNA, 17 nt, Homo sapiens
augagaacaaacagauc

SEQ ID NO: 690653 - RNA, 13 nt, Homo sapiens
augagccaugaga

SEQ ID NO: 690654 - RNA, 16 nt, Homo sapiens
augauggcaacagauc

SEQ ID NO: 690655 - RNA, 21 nt, Homo sapiens
augauuccuuccuguucugaa

SEQ ID NO: 690656 - RNA, 22 nt, Homo sapiens
augcauggugccccaggaccag

SEQ ID NO: 690657 - RNA, 21 nt, Homo sapiens
augccaaccggucacccagga

SEQ ID NO: 690658 - RNA, 18 nt, Homo sapiens
augcugcaggacuugaga

SEQ ID NO: 690659 - RNA, 17 nt, Homo sapiens
augcugcuggacaguau

SEQ ID NO: 690660 - RNA, 16 nt, Homo sapiens
auggaauugauuugca

SEQ ID NO: 690661 - RNA, 21 nt, Homo sapiens
auggaugggggaacucagauc

SEQ ID NO: 690662 - RNA, 17 nt, Homo sapiens
augggggaacucagauc

SEQ ID NO: 690663 - RNA, 20 nt, Homo sapiens
auguaguccgugcugacagc

SEQ ID NO: 690664 - RNA, 21 nt, Homo sapiens
auguauuuauuugggagaccg

SEQ ID NO: 690665 - RNA, 21 nt, Homo sapiens
augugaagccaauucagacag

SEQ ID NO: 690666 - RNA, 16 nt, Homo sapiens
auguuugcacuuguga

SEQ ID NO: 690667 - RNA, 14 nt, Homo sapiens
auuaaagacagagg

SEQ ID NO: 690668 - RNA, 14 nt, Homo sapiens
auuaaauucacaaa

SEQ ID NO: 690669 - RNA, 17 nt, Homo sapiens
auuaccucugauaccuc

SEQ ID NO: 690670 - RNA, 18 nt, Homo sapiens
auuagaggucuccaaaau

SEQ ID NO: 690671 - RNA, 18 nt, Homo sapiens
auuagccgggcauggugg

SEQ ID NO: 690672 - RNA, 22 nt, Homo sapiens
auucaccuuccagugucucgga

SEQ ID NO: 690673 - RNA, 17 nt, Homo sapiens
auucagugauuacuguc

SEQ ID NO: 690674 - RNA, 19 nt, Homo sapiens
auucuauuuauauguacau

SEQ ID NO: 690675 - RNA, 21 nt, Homo sapiens
auucuauuuauauguacauga

SEQ ID NO: 690676 - RNA, 15 nt, Homo sapiens
auugaacacaaacug

SEQ ID NO: 690677 - RNA, 24 nt, Homo sapiens
auugacaugugccagggcaaugau

SEQ ID NO: 690678 - RNA, 22 nt, Homo sapiens
auugaccgcgacuaauuucaaa

SEQ ID NO: 690679 - RNA, 13 nt, Homo sapiens
auugcuguuucag

SEQ ID NO: 690680 - RNA, 21 nt, Homo sapiens
auuggcaccuaauccaggcag

SEQ ID NO: 690681 - RNA, 14 nt, Homo sapiens
auuuacgcuuugau

SEQ ID NO: 690682 - RNA, 18 nt, Homo sapiens
auuuagguuuuuauuagu

SEQ ID NO: 690683 - RNA, 17 nt, Homo sapiens
auuuauaaaacuucuca

SEQ ID NO: 690684 - RNA, 19 nt, Homo sapiens
auuuauaaaacuucucaag

SEQ ID NO: 690685 - RNA, 21 nt, Homo sapiens
auuuauaaaacuucucaagau

SEQ ID NO: 690686 - RNA, 12 nt, Homo sapiens
auuucaucugcu

SEQ ID NO: 690687 - RNA, 22 nt, Homo sapiens
auuucaugugcggggaucaucu

SEQ ID NO: 690688 - RNA, 12 nt, Homo sapiens
auuucccaggac

SEQ ID NO: 690689 - RNA, 22 nt, Homo sapiens
auuucuccaggauuuccugcuu

SEQ ID NO: 690690 - RNA, 16 nt, Homo sapiens
auuugcauuaaauuca

SEQ ID NO: 690691 - RNA, 20 nt, Homo sapiens
auuugggccugcuccagacc

SEQ ID NO: 690692 - RNA, 22 nt, Homo sapiens
caaaaaugcacccaacuagcuc

SEQ ID NO: 690693 - RNA, 14 nt, Homo sapiens
caaaacuacaaauc

SEQ ID NO: 690694 - RNA, 13 nt, Homo sapiens
caaaacugccuca

SEQ ID NO: 690695 - RNA, 16 nt, Homo sapiens
caaacuuuuauacucu

SEQ ID NO: 690696 - RNA, 22 nt, Homo sapiens
caaagaucuguccucagccuug

SEQ ID NO: 690697 - RNA, 20 nt, Homo sapiens
caaaguccuuuuuuuccauc

SEQ ID NO: 690698 - RNA, 13 nt, Homo sapiens
caaaguuaugcaa

SEQ ID NO: 690699 - RNA, 17 nt, Homo sapiens
caaccccccagcacuga

SEQ ID NO: 690700 - RNA, 14 nt, Homo sapiens
caacccgagucauu

SEQ ID NO: 690701 - RNA, 22 nt, Homo sapiens
caacucuccccugaccugugag

SEQ ID NO: 690702 - RNA, 12 nt, Homo sapiens
caacucuugauu

SEQ ID NO: 690703 - RNA, 20 nt, Homo sapiens
caacuuguauuaaagacaga

SEQ ID NO: 690704 - RNA, 16 nt, Homo sapiens
caagaaacgucuucua

SEQ ID NO: 690705 - RNA, 19 nt, Homo sapiens
caagacucugucucaaaaa

SEQ ID NO: 690706 - RNA, 15 nt, Homo sapiens
caagggacccaugag

SEQ ID NO: 690707 - RNA, 16 nt, Homo sapiens
caagggacccaugagu

SEQ ID NO: 690708 - RNA, 21 nt, Homo sapiens
caagguccucugucagucaca

SEQ ID NO: 690709 - RNA, 14 nt, Homo sapiens
caaugaauccccaa

SEQ ID NO: 690710 - RNA, 16 nt, Homo sapiens
cacaaggacuuccugu

SEQ ID NO: 690711 - RNA, 16 nt, Homo sapiens
cacaaguggaccuuag

SEQ ID NO: 690712 - RNA, 12 nt, Homo sapiens
cacaggacacag

SEQ ID NO: 690713 - RNA, 15 nt, Homo sapiens
cacaggacacaguca

SEQ ID NO: 690714 - RNA, 15 nt, Homo sapiens
caccagacacccagg

SEQ ID NO: 690715 - RNA, 17 nt, Homo sapiens
caccguucugugcacaa

SEQ ID NO: 690716 - RNA, 12 nt, Homo sapiens
caccuaauccag

SEQ ID NO: 690717 - RNA, 15 nt, Homo sapiens
caccucucccugacc

SEQ ID NO: 690718 - RNA, 16 nt, Homo sapiens
cacgccuguaauccca

SEQ ID NO: 690719 - RNA, 15 nt, Homo sapiens
cacuacauucauuua

SEQ ID NO: 690720 - RNA, 22 nt, Homo sapiens
cacugaugcuuagauguuccag

SEQ ID NO: 690721 - RNA, 16 nt, Homo sapiens
cacugguugcacuuau

SEQ ID NO: 690722 - RNA, 17 nt, Homo sapiens
cacuuuagggcuguaaa

SEQ ID NO: 690723 - RNA, 23 nt, Homo sapiens
cagaaaauguugagaaucccaaa

SEQ ID NO: 690724 - RNA, 17 nt, Homo sapiens
cagacaugccacaagga

SEQ ID NO: 690725 - RNA, 16 nt, Homo sapiens
cagaccuaaugcuccu

SEQ ID NO: 690726 - RNA, 23 nt, Homo sapiens
cagagaaaggggagcccacuguc

SEQ ID NO: 690727 - RNA, 15 nt, Homo sapiens
cagagauccaaaaga

SEQ ID NO: 690728 - RNA, 22 nt, Homo sapiens
cagaggaggggccgcugccacc

SEQ ID NO: 690729 - RNA, 12 nt, Homo sapiens
cagauccaggga

SEQ ID NO: 690730 - RNA, 20 nt, Homo sapiens
cagaucugacaugauuccuu

SEQ ID NO: 690731 - RNA, 17 nt, Homo sapiens
cagaugccacacaagga

SEQ ID NO: 690732 - RNA, 17 nt, Homo sapiens
cagccacgaggugcaac

SEQ ID NO: 690733 - RNA, 12 nt, Homo sapiens
cagccagcacuu

SEQ ID NO: 690734 - RNA, 17 nt, Homo sapiens
cagccaugucugcauuu

SEQ ID NO: 690735 - RNA, 14 nt, Homo sapiens
cagccucccugaag

SEQ ID NO: 690736 - RNA, 18 nt, Homo sapiens
cagccucccugaagccuu

SEQ ID NO: 690737 - RNA, 19 nt, Homo sapiens
cagccugggugacagagca

SEQ ID NO: 690738 - RNA, 12 nt, Homo sapiens
cagcugcuccua

SEQ ID NO: 690739 - RNA, 23 nt, Homo sapiens
caggaauuucccaggacccugaa

SEQ ID NO: 690740 - RNA, 19 nt, Homo sapiens
caggacagaugccacacaa

SEQ ID NO: 690741 - RNA, 20 nt, Homo sapiens
caggacuugagaagaccuca

SEQ ID NO: 690742 - RNA, 19 nt, Homo sapiens
caggagagacagugaggcu

SEQ ID NO: 690743 - RNA, 15 nt, Homo sapiens
caggcagggugcagu

SEQ ID NO: 690744 - RNA, 22 nt, Homo sapiens
caggccgcccugcgggugaaca

SEQ ID NO: 690745 - RNA, 19 nt, Homo sapiens
cagggcccagagcccagcu

SEQ ID NO: 690746 - RNA, 16 nt, Homo sapiens
cagggcccccaucuca

SEQ ID NO: 690747 - RNA, 22 nt, Homo sapiens
cagggguggcugccucauuuag

SEQ ID NO: 690748 - RNA, 22 nt, Homo sapiens
caggugcugacuucaucuccca

SEQ ID NO: 690749 - RNA, 18 nt, Homo sapiens
cauacuaucuacucuccu

SEQ ID NO: 690750 - RNA, 16 nt, Homo sapiens
caucacugguugcacu

SEQ ID NO: 690751 - RNA, 19 nt, Homo sapiens
caucuauucucuccaaaaa

SEQ ID NO: 690752 - RNA, 13 nt, Homo sapiens
caucucagugcag

SEQ ID NO: 690753 - RNA, 12 nt, Homo sapiens
caucucaugccc

SEQ ID NO: 690754 - RNA, 14 nt, Homo sapiens
caucugaccagcag

SEQ ID NO: 690755 - RNA, 14 nt, Homo sapiens
caucuuuucuugcc

SEQ ID NO: 690756 - RNA, 21 nt, Homo sapiens
cauguuuuccgugaaaacgga

SEQ ID NO: 690757 - RNA, 14 nt, Homo sapiens
cauucuacugaaaa

SEQ ID NO: 690758 - RNA, 17 nt, Homo sapiens
ucauugcugagccucug

SEQ ID NO: 690759 - RNA, 19 nt, Homo sapiens
uccaaccccccagcacuga

SEQ ID NO: 690760 - RNA, 23 nt, Homo sapiens
uccaaccccccagcacugaggaa

SEQ ID NO: 690761 - RNA, 15 nt, Homo sapiens
uccaaccuucccaaa

SEQ ID NO: 690762 - RNA, 23 nt, Homo sapiens
uccaagccugaccacgcuuucua

SEQ ID NO: 690763 - RNA, 17 nt, Homo sapiens
uccaauauuuucuuuaa

SEQ ID NO: 690764 - RNA, 17 nt, Homo sapiens
uccacaccuuuuauuga

SEQ ID NO: 690765 - RNA, 18 nt, Homo sapiens
uccagcuccaaccugcaa

SEQ ID NO: 690766 - RNA, 19 nt, Homo sapiens
uccagggcuggacugaggc

SEQ ID NO: 690767 - RNA, 11 nt, Homo sapiens
uccagugcagg

SEQ ID NO: 690768 - RNA, 20 nt, Homo sapiens
uccaucuuuacaaaacuaca

SEQ ID NO: 690769 - RNA, 20 nt, Homo sapiens
uccauucuuucugauaacua

SEQ ID NO: 690770 - RNA, 16 nt, Homo sapiens
ucccaaauuugauuga

SEQ ID NO: 690771 - RNA, 15 nt, Homo sapiens
ucccagcuacuuggg

SEQ ID NO: 690772 - RNA, 18 nt, Homo sapiens
ucccaggacccugaaggg

SEQ ID NO: 690773 - RNA, 16 nt, Homo sapiens
ucccauuccugaagaa

SEQ ID NO: 690774 - RNA, 16 nt, Homo sapiens
uccccaaccacuucau

SEQ ID NO: 690775 - RNA, 20 nt, Homo sapiens
uccccauucgguguggugca

SEQ ID NO: 690776 - RNA, 15 nt, Homo sapiens
ucccccuucacaaag

SEQ ID NO: 690777 - RNA, 21 nt, Homo sapiens
uccccgcagugugcacuaagg

SEQ ID NO: 690778 - RNA, 19 nt, Homo sapiens
ucccucuaauuuaucuugu

SEQ ID NO: 690779 - RNA, 23 nt, Homo sapiens
uccugauacuuucuguucuccag

SEQ ID NO: 690780 - RNA, 14 nt, Homo sapiens
uccuguccagcucc

SEQ ID NO: 690781 - RNA, 23 nt, Homo sapiens
uccuguccagcuccaaccugcaa

SEQ ID NO: 690782 - RNA, 18 nt, Homo sapiens
uccuuccaguguccuuag

SEQ ID NO: 690783 - RNA, 19 nt, Homo sapiens
ucgcaucucagugcaggag

SEQ ID NO: 690784 - RNA, 13 nt, Homo sapiens
ucuaacagcucag

SEQ ID NO: 690785 - RNA, 12 nt, Homo sapiens
ucuacuaauucc

SEQ ID NO: 690786 - RNA, 15 nt, Homo sapiens
ucuacuaauuccaca

SEQ ID NO: 690787 - RNA, 11 nt, Homo sapiens
ucuagccaaau

SEQ ID NO: 690788 - RNA, 19 nt, Homo sapiens
ucucaucuuucuugaucaa

SEQ ID NO: 690789 - RNA, 13 nt, Homo sapiens
ucuccucuuguaa

SEQ ID NO: 690790 - RNA, 12 nt, Homo sapiens
ucucucaucucu

SEQ ID NO: 690791 - RNA, 13 nt, Homo sapiens
ucugaccagcagc

SEQ ID NO: 690792 - RNA, 22 nt, Homo sapiens
ucugccugcaccccugcaguuu

SEQ ID NO: 690793 - RNA, 13 nt, Homo sapiens
ucuggaaccucag

SEQ ID NO: 690794 - RNA, 13 nt, Homo sapiens
ucuggaaguccaa

SEQ ID NO: 690795 - RNA, 13 nt, Homo sapiens
ucuggaaucugga

SEQ ID NO: 690796 - RNA, 18 nt, Homo sapiens
ucuggaaucuggagacca

SEQ ID NO: 690797 - RNA, 20 nt, Homo sapiens
ucugggcuuggggcuuccua

SEQ ID NO: 690798 - RNA, 18 nt, Homo sapiens
ucuggguacuucuugaag

SEQ ID NO: 690799 - RNA, 14 nt, Homo sapiens
ucuuaucauggucu

SEQ ID NO: 690800 - RNA, 22 nt, Homo sapiens
ucuucccucuccccauucggug

SEQ ID NO: 690801 - RNA, 22 nt, Homo sapiens
ucuuccuggcuccaacacugcu

SEQ ID NO: 690802 - RNA, 13 nt, Homo sapiens
ucuugaaagcugu

SEQ ID NO: 690803 - RNA, 21 nt, Homo sapiens
ucuuuacaaaacuacaugaga

SEQ ID NO: 690804 - RNA, 12 nt, Homo sapiens
ucuuuccuagau

SEQ ID NO: 690805 - RNA, 22 nt, Homo sapiens
ucuuugggccagacaugccaca

SEQ ID NO: 690806 - RNA, 18 nt, Homo sapiens
ugaacuguggggugugca

SEQ ID NO: 690807 - RNA, 15 nt, Homo sapiens
ugaagcagguuccca

SEQ ID NO: 690808 - RNA, 18 nt, Homo sapiens
ugacacaaguggaccuua

SEQ ID NO: 690809 - RNA, 23 nt, Homo sapiens
ugagaaaccuuauuguaccucuc

SEQ ID NO: 690810 - RNA, 20 nt, Homo sapiens
ugagaaauauggacacuuaa

SEQ ID NO: 690811 - RNA, 12 nt, Homo sapiens
ugagaacaacca

SEQ ID NO: 690812 - RNA, 16 nt, Homo sapiens
ugagaaggaacuucca

SEQ ID NO: 690813 - RNA, 22 nt, Homo sapiens
ugagaugauacauccaaagcag

SEQ ID NO: 690814 - RNA, 12 nt, Homo sapiens
ugagcaacucuu

SEQ ID NO: 690815 - RNA, 14 nt, Homo sapiens
ugaggcugcaccca

SEQ ID NO: 690816 - RNA, 17 nt, Homo sapiens
ugaggggcuggcacuga

SEQ ID NO: 690817 - RNA, 22 nt, Homo sapiens
ugauacauccaaagcagacagc

SEQ ID NO: 690818 - RNA, 13 nt, Homo sapiens
ugauagcacuuuc

SEQ ID NO: 690819 - RNA, 17 nt, Homo sapiens
ugauggcaacagaucug

SEQ ID NO: 690820 - RNA, 19 nt, Homo sapiens
ugauucauaguaacuucuu

SEQ ID NO: 690821 - RNA, 21 nt, Homo sapiens
ugcaaaggacagauccaggga

SEQ ID NO: 690822 - RNA, 21 nt, Homo sapiens
ugcaaccucuuggccugauca

SEQ ID NO: 690823 - RNA, 16 nt, Homo sapiens
ugcacuuaugauuuca

SEQ ID NO: 690824 - RNA, 22 nt, Homo sapiens
ugcaggacuugagaagaccuca

SEQ ID NO: 690825 - RNA, 17 nt, Homo sapiens
ugcaguggugugaucuc

SEQ ID NO: 690826 - RNA, 13 nt, Homo sapiens
ugcccacaggccg

SEQ ID NO: 690827 - RNA, 16 nt, Homo sapiens
ugcugcuccagugcag

SEQ ID NO: 690828 - RNA, 19 nt, Homo sapiens
ugcuggacaguaucacugu

SEQ ID NO: 690829 - RNA, 12 nt, Homo sapiens
uggaacacggcc

SEQ ID NO: 690830 - RNA, 18 nt, Homo sapiens
uggaagcuaauuugcauu

SEQ ID NO: 690831 - RNA, 21 nt, Homo sapiens
uggacuuguccucagcagcug

SEQ ID NO: 690832 - RNA, 21 nt, Homo sapiens
uggagauucaguuuucauuug

SEQ ID NO: 690833 - RNA, 23 nt, Homo sapiens
uggagauucaguuuucauuuggu

SEQ ID NO: 690834 - RNA, 13 nt, Homo sapiens
uggaggcacuuua

SEQ ID NO: 690835 - RNA, 22 nt, Homo sapiens
uggaggcccaguucacccugau

SEQ ID NO: 690836 - RNA, 19 nt, Homo sapiens
uggaugcagaaacaguuca

SEQ ID NO: 690837 - RNA, 22 nt, Homo sapiens
uggaugccaaccggucacccag

SEQ ID NO: 690838 - RNA, 16 nt, Homo sapiens
uggcacugacugggca

SEQ ID NO: 690839 - RNA, 17 nt, Homo sapiens
uggccaaggagcugcua

SEQ ID NO: 690840 - RNA, 23 nt, Homo sapiens
uggccagagagccuggugcugcu

SEQ ID NO: 690841 - RNA, 19 nt, Homo sapiens
uggcuccaacacugcugcu

SEQ ID NO: 690842 - RNA, 12 nt, Homo sapiens
ugggaagugaag

SEQ ID NO: 690843 - RNA, 16 nt, Homo sapiens
ugggcaaacaggcagu

SEQ ID NO: 690844 - RNA, 16 nt, Homo sapiens
ugggccagacaugcca

SEQ ID NO: 690845 - RNA, 14 nt, Homo sapiens
uggggccagaucca

SEQ ID NO: 690846 - RNA, 15 nt, Homo sapiens
ugguaggcauuuccu

SEQ ID NO: 690847 - RNA, 19 nt, Homo sapiens
uggugccccaggaccagcu

SEQ ID NO: 690848 - RNA, 12 nt, Homo sapiens
uggugcugagaa

SEQ ID NO: 690849 - RNA, 17 nt, Homo sapiens
ugguucauuaauucuau

SEQ ID NO: 690850 - RNA, 14 nt, Homo sapiens
uguaccauuugccu

SEQ ID NO: 690851 - RNA, 16 nt, Homo sapiens
uguaguccgugcugac

SEQ ID NO: 690852 - RNA, 16 nt, Homo sapiens
ugucagucacagccac

SEQ ID NO: 690853 - RNA, 20 nt, Homo sapiens
uguccccuucucucaucucu

SEQ ID NO: 690854 - RNA, 22 nt, Homo sapiens
uguccucagccuugccagagau

SEQ ID NO: 690855 - RNA, 13 nt, Homo sapiens
uguccuccaacac

SEQ ID NO: 690856 - RNA, 17 nt, Homo sapiens
ugucuaaacaaugcuga

SEQ ID NO: 690857 - RNA, 13 nt, Homo sapiens
ugucuuuccuaga

SEQ ID NO: 690858 - RNA, 18 nt, Homo sapiens
ugugugauugacagcuuu

SEQ ID NO: 690859 - RNA, 12 nt, Homo sapiens
uuacacauaccc

SEQ ID NO: 690860 - RNA, 14 nt, Homo sapiens
uuacauuguugagc

SEQ ID NO: 690861 - RNA, 12 nt, Homo sapiens
uuagcagacagg

SEQ ID NO: 690862 - RNA, 16 nt, Homo sapiens
uuaugcugaaacagaa

SEQ ID NO: 690863 - RNA, 14 nt, Homo sapiens
uuauuaaauacaaa

SEQ ID NO: 690864 - RNA, 15 nt, Homo sapiens
uuauuaccucugaua

SEQ ID NO: 690865 - RNA, 21 nt, Homo sapiens
uuauuaccucugauaccucaa

SEQ ID NO: 690866 - RNA, 18 nt, Homo sapiens
uucaagggacccaugagu

SEQ ID NO: 690867 - RNA, 20 nt, Homo sapiens
uucaccuuccagugucucgg

SEQ ID NO: 690868 - RNA, 19 nt, Homo sapiens
uucagagaccauugcaaug

SEQ ID NO: 690869 - RNA, 16 nt, Homo sapiens
uucaucugcucuccuu

SEQ ID NO: 690870 - RNA, 18 nt, Homo sapiens
uucaucugcucuccuucc

SEQ ID NO: 690871 - RNA, 15 nt, Homo sapiens
uuccauuccaagccu

SEQ ID NO: 690872 - RNA, 17 nt, Homo sapiens
uuccucccuucugcuac

SEQ ID NO: 690873 - RNA, 20 nt, Homo sapiens
uuccuggcuccaacacugcu

SEQ ID NO: 690874 - RNA, 15 nt, Homo sapiens
uucuauuuauuuacu

SEQ ID NO: 690875 - RNA, 18 nt, Homo sapiens
acagcaaccccaggcuga

SEQ ID NO: 690876 - RNA, 14 nt, Homo sapiens
acagcacagccaac

SEQ ID NO: 690877 - RNA, 15 nt, Homo sapiens
acagcagccuggggc

SEQ ID NO: 690878 - RNA, 22 nt, Homo sapiens
acaggacacagucagauuucca

SEQ ID NO: 690879 - RNA, 15 nt, Homo sapiens
acaggagaccuggca

SEQ ID NO: 690880 - RNA, 13 nt, Homo sapiens
acaggcaccugcc

SEQ ID NO: 690881 - RNA, 14 nt, Homo sapiens
acaggcaccugcca

SEQ ID NO: 690882 - RNA, 14 nt, Homo sapiens
acaggccugagauu

SEQ ID NO: 690883 - RNA, 22 nt, Homo sapiens
acaucuauuuuggauuguauau

SEQ ID NO: 690884 - RNA, 18 nt, Homo sapiens
acaucucugcuugaguca

SEQ ID NO: 690885 - RNA, 15 nt, Homo sapiens
acauggaugccaacc

SEQ ID NO: 690886 - RNA, 14 nt, Homo sapiens
accaagcacagcag

SEQ ID NO: 690887 - RNA, 15 nt, Homo sapiens
accaggaaccucuuc

SEQ ID NO: 690888 - RNA, 12 nt, Homo sapiens
acccacccagga

SEQ ID NO: 690889 - RNA, 18 nt, Homo sapiens
accccccagcacugagga

SEQ ID NO: 690890 - RNA, 21 nt, Homo sapiens
accccggggugcccacaggcc

SEQ ID NO: 690891 - RNA, 15 nt, Homo sapiens
accccugguucucau

SEQ ID NO: 690892 - RNA, 19 nt, Homo sapiens
acccucauucuacugaaaa

SEQ ID NO: 690893 - RNA, 19 nt, Homo sapiens
acccugaaggggccaugau

SEQ ID NO: 690894 - RNA, 21 nt, Homo sapiens
acccuggagcccauccagucu

SEQ ID NO: 690895 - RNA, 23 nt, Homo sapiens
acccuggagcccauccagucucc

SEQ ID NO: 690896 - RNA, 14 nt, Homo sapiens
ucuauaaggccaua

SEQ ID NO: 690897 - RNA, 20 nt, Homo sapiens
ucuccccugaccugugagcc

SEQ ID NO: 690898 - RNA, 13 nt, Homo sapiens
ucucccugacccu

SEQ ID NO: 690899 - RNA, 22 nt, Homo sapiens
ucucuaacagcucaggaucucu

SEQ ID NO: 690900 - RNA, 17 nt, Homo sapiens
ucucuccaaaaaugcac

SEQ ID NO: 690901 - RNA, 16 nt, Homo sapiens
ucucuuauagaauauu

SEQ ID NO: 690902 - RNA, 12 nt, Homo sapiens
ucugacccagug

SEQ ID NO: 690903 - RNA, 22 nt, Homo sapiens
ucugacccagugcccccacuga

SEQ ID NO: 690904 - RNA, 13 nt, Homo sapiens
ucugauaccucaa

SEQ ID NO: 690905 - RNA, 15 nt, Homo sapiens
ucuugugccucuaau

SEQ ID NO: 690906 - RNA, 20 nt, Homo sapiens
ucuuuacaaaacuacaugag

SEQ ID NO: 690907 - RNA, 18 nt, Homo sapiens
ugaaacagaauacuguua

SEQ ID NO: 690908 - RNA, 17 nt, Homo sapiens
ugaaauuaagaaggcaa

SEQ ID NO: 690909 - RNA, 11 nt, Homo sapiens
ugaacaaagca

SEQ ID NO: 690910 - RNA, 20 nt, Homo sapiens
ugaacacucuuuugcuuuau

SEQ ID NO: 690911 - RNA, 14 nt, Homo sapiens
ugaagccaauucag

SEQ ID NO: 690912 - RNA, 19 nt, Homo sapiens
ugaagccaauucagacagg

SEQ ID NO: 690913 - RNA, 14 nt, Homo sapiens
ugaaggggccauga

SEQ ID NO: 690914 - RNA, 19 nt, Homo sapiens
ugacagcuuugcugcugaa

SEQ ID NO: 690915 - RNA, 12 nt, Homo sapiens
ugaccacagcac

SEQ ID NO: 690916 - RNA, 17 nt, Homo sapiens
ugaccacagcacagcca

SEQ ID NO: 690917 - RNA, 14 nt, Homo sapiens
ugacccccagcucc

SEQ ID NO: 690918 - RNA, 10 nt, Homo sapiens
ugacccugua

SEQ ID NO: 690919 - RNA, 19 nt, Homo sapiens
ugagauccggcaacaucaa

SEQ ID NO: 690920 - RNA, 17 nt, Homo sapiens
ugagaugauacauccaa

SEQ ID NO: 690921 - RNA, 18 nt, Homo sapiens
ugagcuauugcuguucuc

SEQ ID NO: 690922 - RNA, 16 nt, Homo sapiens
ugaguuacagccuguu

SEQ ID NO: 690923 - RNA, 12 nt, Homo sapiens
ugauacauccaa

SEQ ID NO: 690924 - RNA, 19 nt, Homo sapiens
ugaugcuuagauguuccag

SEQ ID NO: 690925 - RNA, 17 nt, Homo sapiens
ugauuguggaauggaga

SEQ ID NO: 690926 - RNA, 16 nt, Homo sapiens
ugauuuggugaccaac

SEQ ID NO: 690927 - RNA, 16 nt, Homo sapiens
ugcaagggacugugug

SEQ ID NO: 690928 - RNA, 22 nt, Homo sapiens
ugcaauaaaucugacccagugc

SEQ ID NO: 690929 - RNA, 15 nt, Homo sapiens
ugcacccacccagga

SEQ ID NO: 690930 - RNA, 15 nt, Homo sapiens
ugcacugugaaggac

SEQ ID NO: 690931 - RNA, 18 nt, Homo sapiens
ugcagcagggaugcccug

SEQ ID NO: 690932 - RNA, 17 nt, Homo sapiens
ugcaggagagacaguga

SEQ ID NO: 690933 - RNA, 21 nt, Homo sapiens
ugccaaccggucacccaggag

SEQ ID NO: 690934 - RNA, 18 nt, Homo sapiens
ugcgggugaacaaagcag

SEQ ID NO: 690935 - RNA, 16 nt, Homo sapiens
ugcgguagaugggagg

SEQ ID NO: 690936 - RNA, 14 nt, Homo sapiens
ugcuccagugcagg

SEQ ID NO: 690937 - RNA, 21 nt, Homo sapiens
ugcuccuagagggaggggccu

SEQ ID NO: 690938 - RNA, 16 nt, Homo sapiens
ugcugaaacagaauac

SEQ ID NO: 690939 - RNA, 16 nt, Homo sapiens
ugcuugacaacaucug

SEQ ID NO: 690940 - RNA, 17 nt, Homo sapiens
ugcuugacaacaucuga

SEQ ID NO: 690941 - RNA, 15 nt, Homo sapiens
uggaacacggccaca

SEQ ID NO: 690942 - RNA, 20 nt, Homo sapiens
uggaaccucagccuggccag

SEQ ID NO: 690943 - RNA, 16 nt, Homo sapiens
uggacagccugaguca

SEQ ID NO: 690944 - RNA, 23 nt, Homo sapiens
uggagaagccacaggccugagau

SEQ ID NO: 690945 - RNA, 12 nt, Homo sapiens
uggaucagaaua

SEQ ID NO: 690946 - RNA, 23 nt, Homo sapiens
uggcaacagaucuggaaccucag

SEQ ID NO: 690947 - RNA, 16 nt, Homo sapiens
uggcacuggaugcaga

SEQ ID NO: 690948 - RNA, 19 nt, Homo sapiens
uggccaaggagcugcuaua

SEQ ID NO: 690949 - RNA, 22 nt, Homo sapiens
uggccacgugggcaaacaggca

SEQ ID NO: 690950 - RNA, 21 nt, Homo sapiens
uggccucugugccuucuuuug

SEQ ID NO: 690951 - RNA, 15 nt, Homo sapiens
uggcucacacugaga

SEQ ID NO: 690952 - RNA, 16 nt, Homo sapiens
uggcucacacugagaa

SEQ ID NO: 690953 - RNA, 16 nt, Homo sapiens
ugggaagccgugcucg

SEQ ID NO: 690954 - RNA, 15 nt, Homo sapiens
uggggccagauccag

SEQ ID NO: 690955 - RNA, 22 nt, Homo sapiens
uggggcuggccucccaaaugag

SEQ ID NO: 690956 - RNA, 14 nt, Homo sapiens
ugggguggggucau

SEQ ID NO: 690957 - RNA, 15 nt, Homo sapiens
uggguacuucuugaa

SEQ ID NO: 690958 - RNA, 19 nt, Homo sapiens
ugggugagaacaaccaaaa

SEQ ID NO: 690959 - RNA, 15 nt, Homo sapiens
uggucacacacugau

SEQ ID NO: 690960 - RNA, 17 nt, Homo sapiens
uguaacccagauuuugc

SEQ ID NO: 690961 - RNA, 21 nt, Homo sapiens
uguaaucgcccuacuauucag

SEQ ID NO: 690962 - RNA, 14 nt, Homo sapiens
uguccaaaacugcc

SEQ ID NO: 690963 - RNA, 12 nt, Homo sapiens
ugucucugugag

SEQ ID NO: 690964 - RNA, 15 nt, Homo sapiens
ugugauagcacuuuc

SEQ ID NO: 690965 - RNA, 21 nt, Homo sapiens
uguguauuuacgcuuugauuc

SEQ ID NO: 690966 - RNA, 11 nt, Homo sapiens
uguguccaaaa

SEQ ID NO: 690967 - RNA, 20 nt, Homo sapiens
uguguguugccacaggacac

SEQ ID NO: 690968 - RNA, 13 nt, Homo sapiens
uguuccccagaga

SEQ ID NO: 690969 - RNA, 16 nt, Homo sapiens
uuaaaaauagacacuc

SEQ ID NO: 690970 - RNA, 22 nt, Homo sapiens
uuaaaauauuuaucugauuaag

SEQ ID NO: 690971 - RNA, 18 nt, Homo sapiens
uuaagaccuggcagcucu

SEQ ID NO: 690972 - RNA, 12 nt, Homo sapiens
uuaauccagcug

SEQ ID NO: 690973 - RNA, 14 nt, Homo sapiens
uuacauuguucaau

SEQ ID NO: 690974 - RNA, 20 nt, Homo sapiens
uuacugagcuucucugugaa

SEQ ID NO: 690975 - RNA, 22 nt, Homo sapiens
uuagagacaguugggugagaac

SEQ ID NO: 690976 - RNA, 15 nt, Homo sapiens
uuaucuugucucugg

SEQ ID NO: 690977 - RNA, 14 nt, Homo sapiens
uuauuguaccucuc

SEQ ID NO: 690978 - RNA, 18 nt, Homo sapiens
uucaauuguaaauugaau

SEQ ID NO: 690979 - RNA, 21 nt, Homo sapiens
uucacaguucuuugggccaga

SEQ ID NO: 690980 - RNA, 19 nt, Homo sapiens
uuccagacuuccuugagac

SEQ ID NO: 690981 - RNA, 18 nt, Homo sapiens
uuccagguguuacuguaa

SEQ ID NO: 690982 - RNA, 22 nt, Homo sapiens
uuccaguguccuuagaacauuu

SEQ ID NO: 690983 - RNA, 14 nt, Homo sapiens
uuccaugauucuau

SEQ ID NO: 690984 - RNA, 17 nt, Homo sapiens
uucggauuuggggugga

SEQ ID NO: 690985 - RNA, 13 nt, Homo sapiens
uugaagggccaga

SEQ ID NO: 690986 - RNA, 22 nt, Homo sapiens
uugacuagaugauggaugccaa

SEQ ID NO: 690987 - RNA, 14 nt, Homo sapiens
uugagaaucccaaa

SEQ ID NO: 690988 - RNA, 22 nt, Homo sapiens
uugaucuggaacccagacucag

SEQ ID NO: 690989 - RNA, 18 nt, Homo sapiens
uuggauacauacaccagc

SEQ ID NO: 690990 - RNA, 19 nt, Homo sapiens
uuggauacauacaccagca

SEQ ID NO: 690991 - RNA, 20 nt, Homo sapiens
uuggauacauacaccagcau

SEQ ID NO: 690992 - RNA, 23 nt, Homo sapiens
uuggauuuuugacucuggcaaag

SEQ ID NO: 690993 - RNA, 22 nt, Homo sapiens
uuggcaccagacacccaggacu

SEQ ID NO: 690994 - RNA, 20 nt, Homo sapiens
gccaacaaagaacacuaacu

SEQ ID NO: 690995 - RNA, 19 nt, Homo sapiens
gccaagaaacgucuucuaa

SEQ ID NO: 690996 - RNA, 11 nt, Homo sapiens
gccaaggagcu

SEQ ID NO: 690997 - RNA, 17 nt, Homo sapiens
gccaaggagcugcuaua

SEQ ID NO: 690998 - RNA, 22 nt, Homo sapiens
gccacacucagcacaaggccau

SEQ ID NO: 690999 - RNA, 20 nt, Homo sapiens
gccacaggccugagauuuca

SEQ ID NO: 691000 - RNA, 18 nt, Homo sapiens
gccacauuuggaauacuu

SEQ ID NO: 691001 - RNA, 14 nt, Homo sapiens
gccacgugggcaaa

SEQ ID NO: 691002 - RNA, 22 nt, Homo sapiens
gccacgugggcaaacaggcagu

SEQ ID NO: 691003 - RNA, 18 nt, Homo sapiens
gccaucaaaaugcuuuuu

SEQ ID NO: 691004 - RNA, 17 nt, Homo sapiens
gcccagagcccagcucc

SEQ ID NO: 691005 - RNA, 21 nt, Homo sapiens
gcccauccccaggcaccucac

SEQ ID NO: 691006 - RNA, 21 nt, Homo sapiens
gccccauccuccagcagggaa

SEQ ID NO: 691007 - RNA, 17 nt, Homo sapiens
gccuaaaugcacaguca

SEQ ID NO: 691008 - RNA, 17 nt, Homo sapiens
gccucagcccugacccu

SEQ ID NO: 691009 - RNA, 21 nt, Homo sapiens
gccuccccucuccuuccugug

SEQ ID NO: 691010 - RNA, 18 nt, Homo sapiens
gccucccugaagccuuug

SEQ ID NO: 691011 - RNA, 22 nt, Homo sapiens
gccugggguggggucaugcccu

SEQ ID NO: 691012 - RNA, 16 nt, Homo sapiens
gcggggaucaucugcc

SEQ ID NO: 691013 - RNA, 19 nt, Homo sapiens
gcucaggacagaugccaca

SEQ ID NO: 691014 - RNA, 16 nt, Homo sapiens
gcuccaaccugcaaag

SEQ ID NO: 691015 - RNA, 20 nt, Homo sapiens
gcuccacccuggccgagucc

SEQ ID NO: 691016 - RNA, 17 nt, Homo sapiens
gcuccagugcaggagac

SEQ ID NO: 691017 - RNA, 14 nt, Homo sapiens
gcuccggccugucc

SEQ ID NO: 691018 - RNA, 13 nt, Homo sapiens
gcuccuccagggu

SEQ ID NO: 691019 - RNA, 22 nt, Homo sapiens
gcucgccccagcaggugcugac

SEQ ID NO: 691020 - RNA, 14 nt, Homo sapiens
gcugaagcagguuc

SEQ ID NO: 691021 - RNA, 13 nt, Homo sapiens
gcugcaaaggaca

SEQ ID NO: 691022 - RNA, 18 nt, Homo sapiens
gcugcaucccccccaccu

SEQ ID NO: 691023 - RNA, 13 nt, Homo sapiens
gcugcuccagugc

SEQ ID NO: 691024 - RNA, 15 nt, Homo sapiens
gcugcuggacaguau

SEQ ID NO: 691025 - RNA, 18 nt, Homo sapiens
gcuggagugcaguggugu

SEQ ID NO: 691026 - RNA, 18 nt, Homo sapiens
gcuggcaaccacuaagaa

SEQ ID NO: 691027 - RNA, 23 nt, Homo sapiens
gcugggucaggcagggugcagua

SEQ ID NO: 691028 - RNA, 18 nt, Homo sapiens
gcugucaucugugcacug

SEQ ID NO: 691029 - RNA, 21 nt, Homo sapiens
gcugucaucugugcacugccc

SEQ ID NO: 691030 - RNA, 14 nt, Homo sapiens
gcuugacaacaucu

SEQ ID NO: 691031 - RNA, 15 nt, Homo sapiens
gcuugacaacaucug

SEQ ID NO: 691032 - RNA, 20 nt, Homo sapiens
ggaaccacaccacaucuaag

SEQ ID NO: 691033 - RNA, 14 nt, Homo sapiens
ggaacucagaucca

SEQ ID NO: 691034 - RNA, 14 nt, Homo sapiens
ggaagccaaagagu

SEQ ID NO: 691035 - RNA, 23 nt, Homo sapiens
ggaaucagaacucaaauggggcc

SEQ ID NO: 691036 - RNA, 15 nt, Homo sapiens
ggaauugauuugcau

SEQ ID NO: 691037 - RNA, 17 nt, Homo sapiens
ggacauaaugggguccu

SEQ ID NO: 691038 - RNA, 23 nt, Homo sapiens
ggacauaaugggguccuggccau

SEQ ID NO: 691039 - RNA, 22 nt, Homo sapiens
ggacguggcucagccagcacuu

SEQ ID NO: 691040 - RNA, 20 nt, Homo sapiens
ggacucaaaguuucagagac

SEQ ID NO: 691041 - RNA, 17 nt, Homo sapiens
ggagaccuggcacugga

SEQ ID NO: 691042 - RNA, 19 nt, Homo sapiens
ggagccccuucugcucagc

SEQ ID NO: 691043 - RNA, 15 nt, Homo sapiens
ggagcugaggccaca

SEQ ID NO: 691044 - RNA, 11 nt, Homo sapiens
ggagcugcuau

SEQ ID NO: 691045 - RNA, 12 nt, Homo sapiens
ggaggcacuuua

SEQ ID NO: 691046 - RNA, 23 nt, Homo sapiens
ggaugccaaccggucacccagga

SEQ ID NO: 691047 - RNA, 19 nt, Homo sapiens
ggcaccagacacccaggac

SEQ ID NO: 691048 - RNA, 21 nt, Homo sapiens
ggcagugguguggagaagcca

SEQ ID NO: 691049 - RNA, 19 nt, Homo sapiens
ggcccagagcccagcucca

SEQ ID NO: 691050 - RNA, 18 nt, Homo sapiens
ggcccaguucacccugau

SEQ ID NO: 691051 - RNA, 14 nt, Homo sapiens
ggccuacagcuuug

SEQ ID NO: 691052 - RNA, 14 nt, Homo sapiens
ggccugcuccagac

SEQ ID NO: 691053 - RNA, 19 nt, Homo sapiens
ggccuuccucucuccagau

SEQ ID NO: 691054 - RNA, 14 nt, Homo sapiens
ggcucacacugaga

SEQ ID NO: 691055 - RNA, 13 nt, Homo sapiens
ggcucagccagca

SEQ ID NO: 691056 - RNA, 16 nt, Homo sapiens
ggcugaggcuggcaca

SEQ ID NO: 691057 - RNA, 19 nt, Homo sapiens
ggcugccucauuuagagag

SEQ ID NO: 691058 - RNA, 14 nt, Homo sapiens
ggcuggccucccaa

SEQ ID NO: 691059 - RNA, 17 nt, Homo sapiens
ggcugggacguggcuca

SEQ ID NO: 691060 - RNA, 22 nt, Homo sapiens
gggagcccacuguccugggccu

SEQ ID NO: 691061 - RNA, 18 nt, Homo sapiens
gggccauucuccacagca

SEQ ID NO: 691062 - RNA, 17 nt, Homo sapiens
gggcuccuccagggugu

SEQ ID NO: 691063 - RNA, 15 nt, Homo sapiens
ggggccagauccagc

SEQ ID NO: 691064 - RNA, 22 nt, Homo sapiens
ggguacuucuugaaggugcuga

SEQ ID NO: 691065 - RNA, 12 nt, Homo sapiens
ggucacccagga

SEQ ID NO: 691066 - RNA, 13 nt, Homo sapiens
gguccuacccauc

SEQ ID NO: 691067 - RNA, 17 nt, Homo sapiens
gguggcugccucauuua

SEQ ID NO: 691068 - RNA, 22 nt, Homo sapiens
gguggcugccucauuuagagag

SEQ ID NO: 691069 - RNA, 23 nt, Homo sapiens
guaacaugaggggacauuuuggu

SEQ ID NO: 691070 - RNA, 11 nt, Homo sapiens
guacaugagaa

SEQ ID NO: 691071 - RNA, 12 nt, Homo sapiens
guacuucuugaa

SEQ ID NO: 691072 - RNA, 15 nt, Homo sapiens
guagaauugcauuga

SEQ ID NO: 691073 - RNA, 20 nt, Homo sapiens
guagaggcuuagagacaguu

SEQ ID NO: 691074 - RNA, 21 nt, Homo sapiens
guauaaguggaggcacuuuag

SEQ ID NO: 691075 - RNA, 23 nt, Homo sapiens
guauauuugugauagcacuuucu

SEQ ID NO: 691076 - RNA, 20 nt, Homo sapiens
guaucaugcccugugcaacc

SEQ ID NO: 691077 - RNA, 13 nt, Homo sapiens
guauuaaagacag

SEQ ID NO: 691078 - RNA, 13 nt, Homo sapiens
guccaaaacugcc

SEQ ID NO: 691079 - RNA, 21 nt, Homo sapiens
gucuuuuuuucccuaccauuc

SEQ ID NO: 691080 - RNA, 16 nt, Homo sapiens
gugaaugaacacucuu

SEQ ID NO: 691081 - RNA, 16 nt, Homo sapiens
gugcagccguuugaga

SEQ ID NO: 691082 - RNA, 23 nt, Homo sapiens
guggccaaggagcugcuauagcc

SEQ ID NO: 691083 - RNA, 14 nt, Homo sapiens
guggccacuaagca

SEQ ID NO: 691084 - RNA, 14 nt, Homo sapiens
guggcgacucuaua

SEQ ID NO: 691085 - RNA, 15 nt, Homo sapiens
guggcucagccagca

SEQ ID NO: 691086 - RNA, 20 nt, Homo sapiens
guggggugugcacaucucug

SEQ ID NO: 691087 - RNA, 16 nt, Homo sapiens
guugagcuauugcugu

SEQ ID NO: 691088 - RNA, 22 nt, Homo sapiens
guugaucuggaacccagacuca

SEQ ID NO: 691089 - RNA, 14 nt, Homo sapiens
guugccacaggaca

SEQ ID NO: 691090 - RNA, 19 nt, Homo sapiens
guuuggagguccuagguca

SEQ ID NO: 691091 - RNA, 20 nt, Homo sapiens
guuuugaaggcaaaauugca

SEQ ID NO: 691092 - RNA, 13 nt, Homo sapiens
uaaaaauagacac

SEQ ID NO: 691093 - RNA, 14 nt, Homo sapiens
uaaaacagaagccu

SEQ ID NO: 691094 - RNA, 22 nt, Homo sapiens
uaaacucuguugcaagugcaau

SEQ ID NO: 691095 - RNA, 17 nt, Homo sapiens
uaaaugcacagucaugu

SEQ ID NO: 691096 - RNA, 19 nt, Homo sapiens
uaaauguaucuuauucaca

SEQ ID NO: 691097 - RNA, 20 nt, Homo sapiens
uaaccaucacugguugcacu

SEQ ID NO: 691098 - RNA, 12 nt, Homo sapiens
uaacuagaauuu

SEQ ID NO: 691099 - RNA, 14 nt, Homo sapiens
uaagaauagaaaua

SEQ ID NO: 691100 - RNA, 19 nt, Homo sapiens
uaagaauucaaacuggggc

SEQ ID NO: 691101 - RNA, 18 nt, Homo sapiens
uaagacaugauuuccuug

SEQ ID NO: 691102 - RNA, 22 nt, Homo sapiens
uaauauaaaaagcuuccaugau

SEQ ID NO: 691103 - RNA, 20 nt, Homo sapiens
uaaucccagcuacuugggag

SEQ ID NO: 691104 - RNA, 20 nt, Homo sapiens
uaaucuugcucugcuugaca

SEQ ID NO: 691105 - RNA, 12 nt, Homo sapiens
uaaugcuuuuau

SEQ ID NO: 691106 - RNA, 18 nt, Homo sapiens
uacaaaacuacaugagaa

SEQ ID NO: 691107 - RNA, 13 nt, Homo sapiens
uacaaauggacau

SEQ ID NO: 691108 - RNA, 15 nt, Homo sapiens
auaaaaggaagccaa

SEQ ID NO: 691109 - RNA, 13 nt, Homo sapiens
auaaagcuaaaau

SEQ ID NO: 691110 - RNA, 17 nt, Homo sapiens
auacuugaagggccaga

SEQ ID NO: 691111 - RNA, 18 nt, Homo sapiens
auacuuucuguucuccag

SEQ ID NO: 691112 - RNA, 13 nt, Homo sapiens
auacuuuuuacaa

SEQ ID NO: 691113 - RNA, 11 nt, Homo sapiens
auagcacuuuc

SEQ ID NO: 691114 - RNA, 19 nt, Homo sapiens
auauagggaucaaccagcu

SEQ ID NO: 691115 - RNA, 22 nt, Homo sapiens
auaugccuaaaugcacagucau

SEQ ID NO: 691116 - RNA, 19 nt, Homo sapiens
auauuugggccugcuccag

SEQ ID NO: 691117 - RNA, 18 nt, Homo sapiens
auauuuuuagauaguuag

SEQ ID NO: 691118 - RNA, 15 nt, Homo sapiens
aucagaucugacaug

SEQ ID NO: 691119 - RNA, 22 nt, Homo sapiens
aucaggucauacuaucuacucu

SEQ ID NO: 691120 - RNA, 21 nt, Homo sapiens
aaaaauauuuauaaaacuucu

SEQ ID NO: 691121 - RNA, 11 nt, Homo sapiens
aaaacugccuc

SEQ ID NO: 691122 - RNA, 23 nt, Homo sapiens
aaaauaaccggauauauacauag

SEQ ID NO: 691123 - RNA, 12 nt, Homo sapiens
aaaaucuuauca

SEQ ID NO: 691124 - RNA, 19 nt, Homo sapiens
aaaauguugagaaucccaa

SEQ ID NO: 691125 - RNA, 22 nt, Homo sapiens
aaacaggcaguuggccagagag

SEQ ID NO: 691126 - RNA, 16 nt, Homo sapiens
aaacggauuccaaaga

SEQ ID NO: 691127 - RNA, 22 nt, Homo sapiens
aaagcagacagcuccacccugg

SEQ ID NO: 691128 - RNA, 20 nt, Homo sapiens
aaaguuacuagguaacuuca

SEQ ID NO: 691129 - RNA, 18 nt, Homo sapiens
aaaugauguguacccaaa

SEQ ID NO: 691130 - RNA, 13 nt, Homo sapiens
aaauggggccaga

SEQ ID NO: 691131 - RNA, 18 nt, Homo sapiens
aaaugguaggcauuuccu

SEQ ID NO: 691132 - RNA, 16 nt, Homo sapiens
aaauucacaaacuuuu

SEQ ID NO: 691133 - RNA, 18 nt, Homo sapiens
aaauuugauugauuugaa

SEQ ID NO: 691134 - RNA, 16 nt, Homo sapiens
aacaaagcagccacga

SEQ ID NO: 691135 - RNA, 15 nt, Homo sapiens
aacaccaagcacagc

SEQ ID NO: 691136 - RNA, 13 nt, Homo sapiens
aacagaagccuga

SEQ ID NO: 691137 - RNA, 16 nt, Homo sapiens
aacagaagcuuccauu

SEQ ID NO: 691138 - RNA, 12 nt, Homo sapiens
aacaggcaguug

SEQ ID NO: 691139 - RNA, 20 nt, Homo sapiens
aaccaguccccccacccuca

SEQ ID NO: 691140 - RNA, 12 nt, Homo sapiens
aacccagacuca

SEQ ID NO: 691141 - RNA, 16 nt, Homo sapiens
aaccggucacccagga

SEQ ID NO: 691142 - RNA, 18 nt, Homo sapiens
aaccuuauuguaccucuc

SEQ ID NO: 691143 - RNA, 16 nt, Homo sapiens
aacuaaacucauuuau

SEQ ID NO: 691144 - RNA, 14 nt, Homo sapiens
aacugaacucacuu

SEQ ID NO: 691145 - RNA, 23 nt, Homo sapiens
aagagagucgcaucucagugcag

SEQ ID NO: 691146 - RNA, 13 nt, Homo sapiens
aagaguugagcuc

SEQ ID NO: 691147 - RNA, 15 nt, Homo sapiens
aagcccaauauuaua

SEQ ID NO: 691148 - RNA, 20 nt, Homo sapiens
aagccugaugcugacauuca

SEQ ID NO: 691149 - RNA, 21 nt, Homo sapiens
aagcucagaggcgcacuguga

SEQ ID NO: 691150 - RNA, 22 nt, Homo sapiens
aagcuuccauuccaagccugac

SEQ ID NO: 691151 - RNA, 18 nt, Homo sapiens
aaggggaaucagaacuca

SEQ ID NO: 691152 - RNA, 14 nt, Homo sapiens
aaguggacucaggg

SEQ ID NO: 691153 - RNA, 20 nt, Homo sapiens
aauaaaggaugugauugugg

SEQ ID NO: 691154 - RNA, 17 nt, Homo sapiens
aauaaaucugacccagu

SEQ ID NO: 691155 - RNA, 13 nt, Homo sapiens
aauaaucuuauua

SEQ ID NO: 691156 - RNA, 16 nt, Homo sapiens
aauaaugucucuguga

SEQ ID NO: 691157 - RNA, 21 nt, Homo sapiens
aauagucuagauggcuccucu

SEQ ID NO: 691158 - RNA, 20 nt, Homo sapiens
aauccaggcagauccaggac

SEQ ID NO: 691159 - RNA, 14 nt, Homo sapiens
aaucccagcacuuu

SEQ ID NO: 691160 - RNA, 14 nt, Homo sapiens
aaucuacuaauucc

SEQ ID NO: 691161 - RNA, 16 nt, Homo sapiens
aaucuacuaauuccac

SEQ ID NO: 691162 - RNA, 18 nt, Homo sapiens
aaucuuuuacaacugccu

SEQ ID NO: 691163 - RNA, 23 nt, Homo sapiens
aaugggaaaguauucuguacucu

SEQ ID NO: 691164 - RNA, 13 nt, Homo sapiens
aauggggccagau

SEQ ID NO: 691165 - RNA, 22 nt, Homo sapiens
aauuagaauaguguucugcaaa

SEQ ID NO: 691166 - RNA, 14 nt, Homo sapiens
aauucaaacugggg

SEQ ID NO: 691167 - RNA, 23 nt, Homo sapiens
aauugugugugaugugaagccaa

SEQ ID NO: 691168 - RNA, 11 nt, Homo sapiens
acaaaacuaca

SEQ ID NO: 691169 - RNA, 16 nt, Homo sapiens
acaaaacuacaugaga

SEQ ID NO: 691170 - RNA, 20 nt, Homo sapiens
acaagguccucugucaguca

SEQ ID NO: 691171 - RNA, 13 nt, Homo sapiens
acacagucagauu

SEQ ID NO: 691172 - RNA, 18 nt, Homo sapiens
acacugcugcuccagugc

SEQ ID NO: 691173 - RNA, 20 nt, Homo sapiens
acacugcugcuccagugcag

SEQ ID NO: 691174 - RNA, 20 nt, Homo sapiens
acagagcaagacucugucuc

SEQ ID NO: 691175 - RNA, 22 nt, Homo sapiens
acagauccagggacugaagcca

SEQ ID NO: 691176 - RNA, 23 nt, Homo sapiens
acagccccacccuggugggccaa

SEQ ID NO: 691177 - RNA, 16 nt, Homo sapiens
auaucuuuauuaauca

SEQ ID NO: 691178 - RNA, 13 nt, Homo sapiens
auauuuaucugau

SEQ ID NO: 691179 - RNA, 19 nt, Homo sapiens
aucagaauagccacauuug

SEQ ID NO: 691180 - RNA, 20 nt, Homo sapiens
aucaugccccuguacuccag

SEQ ID NO: 691181 - RNA, 16 nt, Homo sapiens
auccagucucccaacu

SEQ ID NO: 691182 - RNA, 16 nt, Homo sapiens
auccccaggcaccuca

SEQ ID NO: 691183 - RNA, 16 nt, Homo sapiens
aucgaaucuacuaauu

SEQ ID NO: 691184 - RNA, 14 nt, Homo sapiens
aucuacuaauucca

SEQ ID NO: 691185 - RNA, 13 nt, Homo sapiens
aucugacccagug

SEQ ID NO: 691186 - RNA, 18 nt, Homo sapiens
aucuggaacccagacuca

SEQ ID NO: 691187 - RNA, 10 nt, Homo sapiens
aucugugcac

SEQ ID NO: 691188 - RNA, 17 nt, Homo sapiens
aucuuaucauggucuca

SEQ ID NO: 691189 - RNA, 21 nt, Homo sapiens
aucuuuacaaaacuacaugag

SEQ ID NO: 691190 - RNA, 18 nt, Homo sapiens
aucuuuguggccaaggag

SEQ ID NO: 691191 - RNA, 22 nt, Homo sapiens
augaauccccaauaauugcaga

SEQ ID NO: 691192 - RNA, 13 nt, Homo sapiens
augcagcagggau

SEQ ID NO: 691193 - RNA, 23 nt, Homo sapiens
augccacaaggacuuccugucca

SEQ ID NO: 691194 - RNA, 16 nt, Homo sapiens
auggaacacggccaca

SEQ ID NO: 691195 - RNA, 23 nt, Homo sapiens
auggaaguugcagugagcugaua

SEQ ID NO: 691196 - RNA, 20 nt, Homo sapiens
auggcagucacugaauucca

SEQ ID NO: 691197 - RNA, 18 nt, Homo sapiens
augggagcugaggccaca

SEQ ID NO: 691198 - RNA, 13 nt, Homo sapiens
auggggccagauc

SEQ ID NO: 691199 - RNA, 22 nt, Homo sapiens
auggugccccaggaccagcuca

SEQ ID NO: 691200 - RNA, 20 nt, Homo sapiens
augguggcgcgcaccuguaa

SEQ ID NO: 691201 - RNA, 11 nt, Homo sapiens
auguacaugag

SEQ ID NO: 691202 - RNA, 12 nt, Homo sapiens
augugaagccaa

SEQ ID NO: 691203 - RNA, 20 nt, Homo sapiens
auuaauucuauaaggccaua

SEQ ID NO: 691204 - RNA, 15 nt, Homo sapiens
auuacaggcaccugc

SEQ ID NO: 691205 - RNA, 19 nt, Homo sapiens
auuacccccuccuucagac

SEQ ID NO: 691206 - RNA, 22 nt, Homo sapiens
auucaacaagagcacuacauuc

SEQ ID NO: 691207 - RNA, 17 nt, Homo sapiens
auucaguuuucauuugg

SEQ ID NO: 691208 - RNA, 12 nt, Homo sapiens
auucuccacagc

SEQ ID NO: 691209 - RNA, 20 nt, Homo sapiens
auuggcaccuaauccaggca

SEQ ID NO: 691210 - RNA, 19 nt, Homo sapiens
auuuaggagaagccaggaa

SEQ ID NO: 691211 - RNA, 21 nt, Homo sapiens
auuuccagucuccaccaggaa

SEQ ID NO: 691212 - RNA, 15 nt, Homo sapiens
cccagcccagagaca

SEQ ID NO: 691213 - RNA, 16 nt, Homo sapiens
cccaggaguguggcca

SEQ ID NO: 691214 - RNA, 15 nt, Homo sapiens
cccagguacauccau

SEQ ID NO: 691215 - RNA, 17 nt, Homo sapiens
cccagguacauccauga

SEQ ID NO: 691216 - RNA, 17 nt, Homo sapiens
cccagugcccccacuga

SEQ ID NO: 691217 - RNA, 14 nt, Homo sapiens
cccaugcacuguga

SEQ ID NO: 691218 - RNA, 16 nt, Homo sapiens
ccccuucucucaucuc

SEQ ID NO: 691219 - RNA, 22 nt, Homo sapiens
cccucuggaguggccacuaagc

SEQ ID NO: 691220 - RNA, 20 nt, Homo sapiens
ccgaagucuuuuguucgcau

SEQ ID NO: 691221 - RNA, 19 nt, Homo sapiens
ccgauauacucuagaugaa

SEQ ID NO: 691222 - RNA, 15 nt, Homo sapiens
ccggggaaaggcaag

SEQ ID NO: 691223 - RNA, 19 nt, Homo sapiens
ccuaaaagugggcuugauu

SEQ ID NO: 691224 - RNA, 23 nt, Homo sapiens
ccucaagaaauaaaaggaagcca

SEQ ID NO: 691225 - RNA, 18 nt, Homo sapiens
ccucacaggccccaggaa

SEQ ID NO: 691226 - RNA, 19 nt, Homo sapiens
ccucagccuggccagacac

SEQ ID NO: 691227 - RNA, 19 nt, Homo sapiens
ccucagccuugccagagau

SEQ ID NO: 691228 - RNA, 20 nt, Homo sapiens
ccucauuccccaaccacuuc

SEQ ID NO: 691229 - RNA, 14 nt, Homo sapiens
ccuccaacaccaag

SEQ ID NO: 691230 - RNA, 22 nt, Homo sapiens
ccuccaggaaccacaccacauc

SEQ ID NO: 691231 - RNA, 18 nt, Homo sapiens
ccucccugccuccaggaa

SEQ ID NO: 691232 - RNA, 20 nt, Homo sapiens
ccucccuguuccccagagaa

SEQ ID NO: 691233 - RNA, 15 nt, Homo sapiens
ccuccuuccauggaa

SEQ ID NO: 691234 - RNA, 16 nt, Homo sapiens
ccucucuuauagaaua

SEQ ID NO: 691235 - RNA, 16 nt, Homo sapiens
ccugagauuucaucug

SEQ ID NO: 691236 - RNA, 18 nt, Homo sapiens
ccugcaccccugcaguuu

SEQ ID NO: 691237 - RNA, 15 nt, Homo sapiens
ccugcaucugaccag

SEQ ID NO: 691238 - RNA, 12 nt, Homo sapiens
ccuggcaguuua

SEQ ID NO: 691239 - RNA, 15 nt, Homo sapiens
ccuggccgaguccaa

SEQ ID NO: 691240 - RNA, 20 nt, Homo sapiens
ccuggggcuagggggagccc

SEQ ID NO: 691241 - RNA, 17 nt, Homo sapiens
ccuggucaacaugguga

SEQ ID NO: 691242 - RNA, 19 nt, Homo sapiens
ccuggucaacauggugaaa

SEQ ID NO: 691243 - RNA, 12 nt, Homo sapiens
ccugguucucau

SEQ ID NO: 691244 - RNA, 21 nt, Homo sapiens
ccugugugauugacagcuuug

SEQ ID NO: 691245 - RNA, 16 nt, Homo sapiens
ccuuauuguaccucuc

SEQ ID NO: 691246 - RNA, 21 nt, Homo sapiens
ccuuauuguaccucucuuaua

SEQ ID NO: 691247 - RNA, 17 nt, Homo sapiens
cgaaucuacuaauucca

SEQ ID NO: 691248 - RNA, 17 nt, Homo sapiens
cgacuaauuucaaaaug

SEQ ID NO: 691249 - RNA, 13 nt, Homo sapiens
cgcaccugccuca

SEQ ID NO: 691250 - RNA, 16 nt, Homo sapiens
cgcaucucagugcagg

SEQ ID NO: 691251 - RNA, 20 nt, Homo sapiens
cgcccaggcuggagugcagu

SEQ ID NO: 691252 - RNA, 22 nt, Homo sapiens
cgccuguggacagccugaguca

SEQ ID NO: 691253 - RNA, 21 nt, Homo sapiens
cggaucuggggcucugggaua

SEQ ID NO: 691254 - RNA, 17 nt, Homo sapiens
cggcaacaucaacccga

SEQ ID NO: 691255 - RNA, 16 nt, Homo sapiens
cggccagccaugucug

SEQ ID NO: 691256 - RNA, 15 nt, Homo sapiens
cggggcucuucucau

SEQ ID NO: 691257 - RNA, 20 nt, Homo sapiens
cgucucuacuaaaaauacaa

SEQ ID NO: 691258 - RNA, 16 nt, Homo sapiens
cuaaaauuuaaugcau

SEQ ID NO: 691259 - RNA, 20 nt, Homo sapiens
cuaaacaaugcugauuuggu

SEQ ID NO: 691260 - RNA, 16 nt, Homo sapiens
cuaaacccaauccaaa

SEQ ID NO: 691261 - RNA, 16 nt, Homo sapiens
cuaaacggauuccaaa

SEQ ID NO: 691262 - RNA, 17 nt, Homo sapiens
cuaaccagccuggucaa

SEQ ID NO: 691263 - RNA, 21 nt, Homo sapiens
cuaacuaugcauggugcccca

SEQ ID NO: 691264 - RNA, 18 nt, Homo sapiens
cuaagaauucaaacuggg

SEQ ID NO: 691265 - RNA, 17 nt, Homo sapiens
cuaauagcccaagaaug

SEQ ID NO: 691266 - RNA, 19 nt, Homo sapiens
cuacuugggaggcugaggc

SEQ ID NO: 691267 - RNA, 16 nt, Homo sapiens
cuaggaaauccauuca

SEQ ID NO: 691268 - RNA, 18 nt, Homo sapiens
cuaggaaauccauucaca

SEQ ID NO: 691269 - RNA, 16 nt, Homo sapiens
cuauucucuccaaaaa

SEQ ID NO: 691270 - RNA, 14 nt, Homo sapiens
cucagccagcacuu

SEQ ID NO: 691271 - RNA, 19 nt, Homo sapiens
cucagccuggccagacaca

SEQ ID NO: 691272 - RNA, 20 nt, Homo sapiens
cucagggcagcgccaggcug

SEQ ID NO: 691273 - RNA, 18 nt, Homo sapiens
cucagucauaaucauuag

SEQ ID NO: 691274 - RNA, 15 nt, Homo sapiens
cucauaaaaagcaaa

SEQ ID NO: 691275 - RNA, 22 nt, Homo sapiens
cuccaacaccaagcacagcagc

SEQ ID NO: 691276 - RNA, 18 nt, Homo sapiens
cuccacucaguugcaacu

SEQ ID NO: 691277 - RNA, 12 nt, Homo sapiens
cuccagugcagg

SEQ ID NO: 691278 - RNA, 19 nt, Homo sapiens
cucccaaguagcugggauu

SEQ ID NO: 691279 - RNA, 17 nt, Homo sapiens
cuccccagcccagagac

SEQ ID NO: 691280 - RNA, 17 nt, Homo sapiens
cucccuguuccccagag

SEQ ID NO: 691281 - RNA, 22 nt, Homo sapiens
cuccugugugauugacagcuuu

SEQ ID NO: 691282 - RNA, 23 nt, Homo sapiens
cuccuuccuggagcccagaggag

SEQ ID NO: 691283 - RNA, 23 nt, Homo sapiens
cucuauguuuacaaauggacaua

SEQ ID NO: 691284 - RNA, 11 nt, Homo sapiens
cucucaucucu

SEQ ID NO: 691285 - RNA, 21 nt, Homo sapiens
cucugugaacgauuuagaaag

SEQ ID NO: 691286 - RNA, 15 nt, Homo sapiens
cucuucucauuucac

SEQ ID NO: 691287 - RNA, 15 nt, Homo sapiens
cucuuggccugauca

SEQ ID NO: 691288 - RNA, 21 nt, Homo sapiens
cucuugggaacugaacucacu

SEQ ID NO: 691289 - RNA, 17 nt, Homo sapiens
cugaaauagaggcuaaa

SEQ ID NO: 691290 - RNA, 22 nt, Homo sapiens
cugaagccaaaguuaugcaagg

SEQ ID NO: 691291 - RNA, 21 nt, Homo sapiens
ggagcugccuuggcucagaca

SEQ ID NO: 691292 - RNA, 15 nt, Homo sapiens
ggaggcugaggcaag

SEQ ID NO: 691293 - RNA, 13 nt, Homo sapiens
ggagggacaagug

SEQ ID NO: 691294 - RNA, 21 nt, Homo sapiens
ggagggcugucaucugugcac

SEQ ID NO: 691295 - RNA, 18 nt, Homo sapiens
ggaguguggccacguggg

SEQ ID NO: 691296 - RNA, 23 nt, Homo sapiens
ggauggaacacggccacaucaaa

SEQ ID NO: 691297 - RNA, 13 nt, Homo sapiens
ggauugggguccc

SEQ ID NO: 691298 - RNA, 14 nt, Homo sapiens
ggcaaacaggcagu

SEQ ID NO: 691299 - RNA, 12 nt, Homo sapiens
ggcaccagacac

SEQ ID NO: 691300 - RNA, 12 nt, Homo sapiens
ggcagauccagg

SEQ ID NO: 691301 - RNA, 19 nt, Homo sapiens
ggcagucacugaauuccau

SEQ ID NO: 691302 - RNA, 17 nt, Homo sapiens
ggccgcccugcggguga

SEQ ID NO: 691303 - RNA, 20 nt, Homo sapiens
ggccucccaaaugagccaug

SEQ ID NO: 691304 - RNA, 13 nt, Homo sapiens
ggccugcuccaga

SEQ ID NO: 691305 - RNA, 14 nt, Homo sapiens
ggccuguccuccaa

SEQ ID NO: 691306 - RNA, 20 nt, Homo sapiens
ggcuccagaugcagggcagu

SEQ ID NO: 691307 - RNA, 18 nt, Homo sapiens
ggcugcacccacccagga

SEQ ID NO: 691308 - RNA, 13 nt, Homo sapiens
ggcuggcacugac

SEQ ID NO: 691309 - RNA, 20 nt, Homo sapiens
ggcugguggcccaggaccau

SEQ ID NO: 691310 - RNA, 17 nt, Homo sapiens
ggcugucaucugugcac

SEQ ID NO: 691311 - RNA, 19 nt, Homo sapiens
gggagaagcuccucucccc

SEQ ID NO: 691312 - RNA, 17 nt, Homo sapiens
gggcagcgccaggcuga

SEQ ID NO: 691313 - RNA, 12 nt, Homo sapiens
gggccagagcca

SEQ ID NO: 691314 - RNA, 14 nt, Homo sapiens
gggcccagagccca

SEQ ID NO: 691315 - RNA, 16 nt, Homo sapiens
gggcuggcacugacug

SEQ ID NO: 691316 - RNA, 20 nt, Homo sapiens
gggcugucaucugugcacug

SEQ ID NO: 691317 - RNA, 11 nt, Homo sapiens
gguagccagca

SEQ ID NO: 691318 - RNA, 20 nt, Homo sapiens
gguagccagcacacagggca

SEQ ID NO: 691319 - RNA, 19 nt, Homo sapiens
gguccucugucagucacag

SEQ ID NO: 691320 - RNA, 20 nt, Homo sapiens
ggugaacaaagcagccacga

SEQ ID NO: 691321 - RNA, 17 nt, Homo sapiens
ggugaggggcuggcacu

SEQ ID NO: 691322 - RNA, 20 nt, Homo sapiens
guaaauugaaucaguauaaa

SEQ ID NO: 691323 - RNA, 16 nt, Homo sapiens
guaaucccagcacuuu

SEQ ID NO: 691324 - RNA, 20 nt, Homo sapiens
guaaucccagcuacuuggga

SEQ ID NO: 691325 - RNA, 20 nt, Homo sapiens
guaauuuuaguagagacagg

SEQ ID NO: 691326 - RNA, 14 nt, Homo sapiens
guaccucucuuaua

SEQ ID NO: 691327 - RNA, 15 nt, Homo sapiens
guaggagcugccuug

SEQ ID NO: 691328 - RNA, 18 nt, Homo sapiens
guaucaugcccugugcaa

SEQ ID NO: 691329 - RNA, 12 nt, Homo sapiens
gucacacacuga

SEQ ID NO: 691330 - RNA, 11 nt, Homo sapiens
gucaugcccuc

SEQ ID NO: 691331 - RNA, 20 nt, Homo sapiens
guccaaaacugccucaggag

SEQ ID NO: 691332 - RNA, 20 nt, Homo sapiens
guccucccaauuucagacuc

SEQ ID NO: 691333 - RNA, 15 nt, Homo sapiens
gucuuuaacugucaa

SEQ ID NO: 691334 - RNA, 19 nt, Homo sapiens
gucuuuccuaaggcugcaa

SEQ ID NO: 691335 - RNA, 19 nt, Homo sapiens
gugaacaaagcagccacga

SEQ ID NO: 691336 - RNA, 13 nt, Homo sapiens
gugauagcacuuu

SEQ ID NO: 691337 - RNA, 22 nt, Homo sapiens
gugauugacagcuuugcugcug

SEQ ID NO: 691338 - RNA, 19 nt, Homo sapiens
gugcaguggugugaucuca

SEQ ID NO: 691339 - RNA, 13 nt, Homo sapiens
guggaggcacuuu

SEQ ID NO: 691340 - RNA, 20 nt, Homo sapiens
guucgcauggucacacacug

SEQ ID NO: 691341 - RNA, 12 nt, Homo sapiens
guucuccagugu

SEQ ID NO: 691342 - RNA, 12 nt, Homo sapiens
guuuccugaaac

SEQ ID NO: 691343 - RNA, 21 nt, Homo sapiens
guuugacuuauugcuguuuca

SEQ ID NO: 691344 - RNA, 19 nt, Homo sapiens
guuuuccucccuucugcua

SEQ ID NO: 691345 - RNA, 20 nt, Homo sapiens
guuuuccucccuucugcuac

SEQ ID NO: 691346 - RNA, 23 nt, Homo sapiens
guuuugaaggcaaaauugcaaau

SEQ ID NO: 691347 - RNA, 23 nt, Homo sapiens
uaaacugguauuuuaucuuugau

SEQ ID NO: 691348 - RNA, 20 nt, Homo sapiens
uaaauguaucuuauucacau

SEQ ID NO: 691349 - RNA, 13 nt, Homo sapiens
uaagaccuggcag

SEQ ID NO: 691350 - RNA, 18 nt, Homo sapiens
uaauugcuuugagcacaa

SEQ ID NO: 691351 - RNA, 18 nt, Homo sapiens
uacaaaacuuccaggcua

SEQ ID NO: 691352 - RNA, 15 nt, Homo sapiens
uacauacaccagcau

SEQ ID NO: 691353 - RNA, 16 nt, Homo sapiens
uacauaucuuuauuaa

SEQ ID NO: 691354 - RNA, 13 nt, Homo sapiens
uacccaaacguga

SEQ ID NO: 691355 - RNA, 14 nt, Homo sapiens
uaccccagguacau

SEQ ID NO: 691356 - RNA, 17 nt, Homo sapiens
uaccucugauaccucaa

SEQ ID NO: 691357 - RNA, 21 nt, Homo sapiens
uacuaauuccacaccuuuuau

SEQ ID NO: 691358 - RNA, 13 nt, Homo sapiens
uacuguaauuccu

SEQ ID NO: 691359 - RNA, 12 nt, Homo sapiens
uagaauugcauu

SEQ ID NO: 691360 - RNA, 13 nt, Homo sapiens
uagaauuuauuca

SEQ ID NO: 691361 - RNA, 18 nt, Homo sapiens
uagccagcacacagggca

SEQ ID NO: 691362 - RNA, 19 nt, Homo sapiens
uagcuaaacggauuccaaa

SEQ ID NO: 691363 - RNA, 17 nt, Homo sapiens
uaggacucaaaguuuca

SEQ ID NO: 691364 - RNA, 13 nt, Homo sapiens
uagggcuguaaaa

SEQ ID NO: 691365 - RNA, 23 nt, Homo sapiens
uagggggagccccuucugcucag

SEQ ID NO: 691366 - RNA, 14 nt, Homo sapiens
uauagacucuagga

SEQ ID NO: 691367 - RNA, 20 nt, Homo sapiens
uauagccuggggugggguca

SEQ ID NO: 691368 - RNA, 18 nt, Homo sapiens
uauauuugggccugcucc

SEQ ID NO: 691369 - RNA, 12 nt, Homo sapiens
acacugcugcuc

SEQ ID NO: 691370 - RNA, 18 nt, Homo sapiens
acagaucuggaaccucag

SEQ ID NO: 691371 - RNA, 18 nt, Homo sapiens
acagaugccacacaagga

SEQ ID NO: 691372 - RNA, 17 nt, Homo sapiens
acagcucaggaucucuu

SEQ ID NO: 691373 - RNA, 12 nt, Homo sapiens
acaguaucacug

SEQ ID NO: 691374 - RNA, 14 nt, Homo sapiens
acagucucacuuug

SEQ ID NO: 691375 - RNA, 14 nt, Homo sapiens
acauagcaugacau

SEQ ID NO: 691376 - RNA, 19 nt, Homo sapiens
acauccaaagcagacagcu

SEQ ID NO: 691377 - RNA, 15 nt, Homo sapiens
acaucuauucucucc

SEQ ID NO: 691378 - RNA, 19 nt, Homo sapiens
acaugagaacaaacagauc

SEQ ID NO: 691379 - RNA, 12 nt, Homo sapiens
acaagugguggu

SEQ ID NO: 691380 - RNA, 11 nt, Homo sapiens
acaaugcugau

SEQ ID NO: 691381 - RNA, 12 nt, Homo sapiens
acaaugcugauu

SEQ ID NO: 691382 - RNA, 20 nt, Homo sapiens
acacaaggauagaugcuggc

SEQ ID NO: 691383 - RNA, 14 nt, Homo sapiens
acacuaacuaugca

SEQ ID NO: 691384 - RNA, 16 nt, Homo sapiens
acacugaugcuuagau

SEQ ID NO: 691385 - RNA, 19 nt, Homo sapiens
acacugcugcuccagugca

SEQ ID NO: 691386 - RNA, 22 nt, Homo sapiens
acacugcugcuccagugcagga

SEQ ID NO: 691387 - RNA, 13 nt, Homo sapiens
acagcacagccaa

SEQ ID NO: 691388 - RNA, 20 nt, Homo sapiens
acagccugagucaccugcag

SEQ ID NO: 691389 - RNA, 17 nt, Homo sapiens
acaggccugagauuuca

SEQ ID NO: 691390 - RNA, 21 nt, Homo sapiens
acagggagacccguccauuug

SEQ ID NO: 691391 - RNA, 14 nt, Homo sapiens
acagugaggcugca

SEQ ID NO: 691392 - RNA, 17 nt, Homo sapiens
acaguucuuugggccag

SEQ ID NO: 691393 - RNA, 20 nt, Homo sapiens
acauuguuugucugucuuca

SEQ ID NO: 691394 - RNA, 21 nt, Homo sapiens
accacuaagaauucaaacugg

SEQ ID NO: 691395 - RNA, 15 nt, Homo sapiens
accauaguaccauuu

SEQ ID NO: 691396 - RNA, 17 nt, Homo sapiens
acccaggaguguggcca

SEQ ID NO: 691397 - RNA, 15 nt, Homo sapiens
accccaagcaggaac

SEQ ID NO: 691398 - RNA, 17 nt, Homo sapiens
accccucccuuucuccc

SEQ ID NO: 691399 - RNA, 16 nt, Homo sapiens
accccugguucucauc

SEQ ID NO: 691400 - RNA, 19 nt, Homo sapiens
acccuuguuuacacauacc

SEQ ID NO: 691401 - RNA, 21 nt, Homo sapiens
accguuuugaagcuacugugu

SEQ ID NO: 691402 - RNA, 19 nt, Homo sapiens
accucagccuggccagaca

SEQ ID NO: 691403 - RNA, 20 nt, Homo sapiens
accucagccuggccagacac

SEQ ID NO: 691404 - RNA, 21 nt, Homo sapiens
accucaggugauccaccugcc

SEQ ID NO: 691405 - RNA, 19 nt, Homo sapiens
accucccugccuccaggaa

SEQ ID NO: 691406 - RNA, 22 nt, Homo sapiens
accugugagcccagcuggguca

SEQ ID NO: 691407 - RNA, 17 nt, Homo sapiens
accuuauuguaccucuc

SEQ ID NO: 691408 - RNA, 21 nt, Homo sapiens
acgccuguaaucccagcacuu

SEQ ID NO: 691409 - RNA, 15 nt, Homo sapiens
acggggcucuucuca

SEQ ID NO: 691410 - RNA, 19 nt, Homo sapiens
acucaaauggggccagauc

SEQ ID NO: 691411 - RNA, 15 nt, Homo sapiens
acucccauuccugaa

SEQ ID NO: 691412 - RNA, 15 nt, Homo sapiens
acucgagaacuuuca

SEQ ID NO: 691413 - RNA, 21 nt, Homo sapiens
acucuagaugaaguuuuacau

SEQ ID NO: 691414 - RNA, 15 nt, Homo sapiens
acugaacucacuuuc

SEQ ID NO: 691415 - RNA, 15 nt, Homo sapiens
acugcccauggacag

SEQ ID NO: 691416 - RNA, 17 nt, Homo sapiens
acugcugcuccagugca

SEQ ID NO: 691417 - RNA, 19 nt, Homo sapiens
acugguauuuuaucuuuga

SEQ ID NO: 691418 - RNA, 20 nt, Homo sapiens
agaaaccuuauuguaccucu

SEQ ID NO: 691419 - RNA, 19 nt, Homo sapiens
agaaauauggaacuuacau

SEQ ID NO: 691420 - RNA, 22 nt, Homo sapiens
agaaauugacacaaguggaccu

SEQ ID NO: 691421 - RNA, 13 nt, Homo sapiens
agaacaaccaaaa

SEQ ID NO: 691422 - RNA, 19 nt, Homo sapiens
agacaggccccgugaggca

SEQ ID NO: 691423 - RNA, 17 nt, Homo sapiens
agacaugauuuccuuga

SEQ ID NO: 691424 - RNA, 18 nt, Homo sapiens
agacauuggcaccuaauc

SEQ ID NO: 691425 - RNA, 13 nt, Homo sapiens
agaccauugcaau

SEQ ID NO: 691426 - RNA, 15 nt, Homo sapiens
agaccuaaugcuccu

SEQ ID NO: 691427 - RNA, 21 nt, Homo sapiens
agaccuggcacuggaugcaga

SEQ ID NO: 691428 - RNA, 19 nt, Homo sapiens
agacucagacauuggcacc

SEQ ID NO: 691429 - RNA, 22 nt, Homo sapiens
agagagucgcaucucagugcag

SEQ ID NO: 691430 - RNA, 23 nt, Homo sapiens
agagagucgcaucucagugcagg

SEQ ID NO: 691431 - RNA, 13 nt, Homo sapiens
agagcccagcucc

SEQ ID NO: 691432 - RNA, 17 nt, Homo sapiens
agagccuggugcugcug

SEQ ID NO: 691433 - RNA, 21 nt, Homo sapiens
agagucgcaucucagugcagg

SEQ ID NO: 691434 - RNA, 24 nt, Homo sapiens
agaguuuccugaaacaacuuggaa

SEQ ID NO: 691435 - RNA, 15 nt, Homo sapiens
agauccagggacuga

SEQ ID NO: 691436 - RNA, 19 nt, Homo sapiens
agaugauggaugccaauau

SEQ ID NO: 691437 - RNA, 18 nt, Homo sapiens
agaugcagggcagucauu

SEQ ID NO: 691438 - RNA, 18 nt, Homo sapiens
agcaagacucugucucaa

SEQ ID NO: 691439 - RNA, 15 nt, Homo sapiens
agcacacagggcagu

SEQ ID NO: 691440 - RNA, 13 nt, Homo sapiens
agcagccacgagg

SEQ ID NO: 691441 - RNA, 11 nt, Homo sapiens
agccacaggcc

SEQ ID NO: 691442 - RNA, 20 nt, Homo sapiens
agccacaggccugagauuuc

SEQ ID NO: 691443 - RNA, 19 nt, Homo sapiens
agcccagcugggucaggca

SEQ ID NO: 691444 - RNA, 18 nt, Homo sapiens
agcccauccagucuccca

SEQ ID NO: 691445 - RNA, 22 nt, Homo sapiens
agcccccagcuaagaaccugga

SEQ ID NO: 691446 - RNA, 21 nt, Homo sapiens
agcccucaccccugguucuca

SEQ ID NO: 691447 - RNA, 13 nt, Homo sapiens
agccuggccagac

SEQ ID NO: 691448 - RNA, 14 nt, Homo sapiens
agccuggccagaca

SEQ ID NO: 691449 - RNA, 20 nt, Homo sapiens
agccuggccagacacaggcc

SEQ ID NO: 691450 - RNA, 18 nt, Homo sapiens
agcgccaggcugaccaca

SEQ ID NO: 691451 - RNA, 15 nt, Homo sapiens
agcuccaaccugcaa

SEQ ID NO: 691452 - RNA, 15 nt, Homo sapiens
agcuccggccugucc

SEQ ID NO: 691453 - RNA, 18 nt, Homo sapiens
agcugaacaauaggcugu

SEQ ID NO: 691454 - RNA, 16 nt, Homo sapiens
agcugccuuggcucag

SEQ ID NO: 691455 - RNA, 20 nt, Homo sapiens
agcugggucaggcagggugc

SEQ ID NO: 691456 - RNA, 23 nt, Homo sapiens
aggaaauccauucacaguucuuu

SEQ ID NO: 691457 - RNA, 22 nt, Homo sapiens
aggaagaacggggcucuucuca

SEQ ID NO: 691458 - RNA, 13 nt, Homo sapiens
aggacacagucag

SEQ ID NO: 691459 - RNA, 11 nt, Homo sapiens
aggacccugaa

SEQ ID NO: 691460 - RNA, 14 nt, Homo sapiens
aggacugggccacu

SEQ ID NO: 691461 - RNA, 21 nt, Homo sapiens
aggagacuuuacauggaugcc

SEQ ID NO: 691462 - RNA, 22 nt, Homo sapiens
aggaggggccgcugccacccac

SEQ ID NO: 691463 - RNA, 14 nt, Homo sapiens
aggauggcaaagag

SEQ ID NO: 691464 - RNA, 18 nt, Homo sapiens
aggauggcaaagagaguc

SEQ ID NO: 691465 - RNA, 19 nt, Homo sapiens
aggcaccugccaccaugcc

SEQ ID NO: 691466 - RNA, 19 nt, Homo sapiens
aggccccagccucccugaa

SEQ ID NO: 691467 - RNA, 20 nt, Homo sapiens
aggcuggagugcaguggugu

SEQ ID NO: 691468 - RNA, 12 nt, Homo sapiens
agggaggcucag

SEQ ID NO: 691469 - RNA, 16 nt, Homo sapiens
agggcccccaucucau

SEQ ID NO: 691470 - RNA, 14 nt, Homo sapiens
aggggcuggcacug

SEQ ID NO: 691471 - RNA, 14 nt, Homo sapiens
agguacauccauga

SEQ ID NO: 691472 - RNA, 17 nt, Homo sapiens
aggugauccaccugccu

SEQ ID NO: 691473 - RNA, 19 nt, Homo sapiens
aggugcugacuucaucucc

SEQ ID NO: 691474 - RNA, 22 nt, Homo sapiens
aguaacaugaggggacauuuug

SEQ ID NO: 691475 - RNA, 15 nt, Homo sapiens
aguagucuugaugac

SEQ ID NO: 691476 - RNA, 23 nt, Homo sapiens
aguauuugggaagugaagacugg

SEQ ID NO: 691477 - RNA, 13 nt, Homo sapiens
agucacagccacc

SEQ ID NO: 691478 - RNA, 18 nt, Homo sapiens
agugcaggagagacagug

SEQ ID NO: 691479 - RNA, 15 nt, Homo sapiens
aguggaggcacuuua

SEQ ID NO: 691480 - RNA, 15 nt, Homo sapiens
aguguaccauuugcc

SEQ ID NO: 691481 - RNA, 12 nt, Homo sapiens
aguuaagacaug

SEQ ID NO: 691482 - RNA, 18 nt, Homo sapiens
aguuacuagguaacuuca

SEQ ID NO: 691483 - RNA, 18 nt, Homo sapiens
aguuaugcaagggacugu

SEQ ID NO: 691484 - RNA, 16 nt, Homo sapiens
aguucuuugggccaga

SEQ ID NO: 691485 - RNA, 21 nt, Homo sapiens
aguugaucuggaacccagacu

SEQ ID NO: 691486 - RNA, 20 nt, Homo sapiens
aguuuaaaacagaagccuga

SEQ ID NO: 691487 - RNA, 20 nt, Homo sapiens
aguuucagagaccauugcaa

SEQ ID NO: 691488 - RNA, 20 nt, Homo sapiens
auaaacaaaguuacuaggua

SEQ ID NO: 691489 - RNA, 14 nt, Homo sapiens
auaaaggaugugau

SEQ ID NO: 691490 - RNA, 16 nt, Homo sapiens
auacauagcaugacau

SEQ ID NO: 691491 - RNA, 23 nt, Homo sapiens
auacucuagaugaaguuuuacau

SEQ ID NO: 691492 - RNA, 23 nt, Homo sapiens
auagaugcuggcccagggcccag

SEQ ID NO: 691493 - RNA, 19 nt, Homo sapiens
auaguaccauuuauacaaa

SEQ ID NO: 691494 - RNA, 23 nt, Homo sapiens
auaucaugccccuguacuccagc

SEQ ID NO: 691495 - RNA, 21 nt, Homo sapiens
gcucagaggcgcacugugacc

SEQ ID NO: 691496 - RNA, 22 nt, Homo sapiens
gcucagccagcacuuguccagc

SEQ ID NO: 691497 - RNA, 20 nt, Homo sapiens
gcuccucuccccagcccaga

SEQ ID NO: 691498 - RNA, 14 nt, Homo sapiens
gcucugcuugacaa

SEQ ID NO: 691499 - RNA, 17 nt, Homo sapiens
gcucugggauagcugac

SEQ ID NO: 691500 - RNA, 17 nt, Homo sapiens
gcugaacaauaggcugu

SEQ ID NO: 691501 - RNA, 21 nt, Homo sapiens
gcugaggcuggcacaggacau

SEQ ID NO: 691502 - RNA, 17 nt, Homo sapiens
gcugcacugaugcugcc

SEQ ID NO: 691503 - RNA, 20 nt, Homo sapiens
gcuggagugcagugguguga

SEQ ID NO: 691504 - RNA, 13 nt, Homo sapiens
gcuggcaaccacu

SEQ ID NO: 691505 - RNA, 15 nt, Homo sapiens
gcuguuucagcuuua

SEQ ID NO: 691506 - RNA, 15 nt, Homo sapiens
gcuuccaugauucua

SEQ ID NO: 691507 - RNA, 12 nt, Homo sapiens
gcuuccuaacug

SEQ ID NO: 691508 - RNA, 16 nt, Homo sapiens
gcuucuccugugugau

SEQ ID NO: 691509 - RNA, 14 nt, Homo sapiens
ggaacacggccaca

SEQ ID NO: 691510 - RNA, 21 nt, Homo sapiens
ggaaccucagccuggccagac

SEQ ID NO: 691511 - RNA, 22 nt, Homo sapiens
ggaaccucagccuggccagaca

SEQ ID NO: 691512 - RNA, 16 nt, Homo sapiens
ggaacucuagccaaau

SEQ ID NO: 691513 - RNA, 15 nt, Homo sapiens
ggaagcuaauuugca

SEQ ID NO: 691514 - RNA, 19 nt, Homo sapiens
ggacuauauuugggccugc

SEQ ID NO: 691515 - RNA, 14 nt, Homo sapiens
ggagaccuggcacu

SEQ ID NO: 691516 - RNA, 15 nt, Homo sapiens
ggagaccuggcacug

SEQ ID NO: 691517 - RNA, 15 nt, Homo sapiens
ggaguggccacuaag

SEQ ID NO: 691518 - RNA, 16 nt, Homo sapiens
ggauuacaggcuugag

SEQ ID NO: 691519 - RNA, 22 nt, Homo sapiens
ggauucuccacucaguugcaac

SEQ ID NO: 691520 - RNA, 12 nt, Homo sapiens
ggcaacaucaac

SEQ ID NO: 691521 - RNA, 18 nt, Homo sapiens
ggcaccagacacccagga

SEQ ID NO: 691522 - RNA, 16 nt, Homo sapiens
ggcaccuaauccaggc

SEQ ID NO: 691523 - RNA, 22 nt, Homo sapiens
ggcaggaaaaggugauauccau

SEQ ID NO: 691524 - RNA, 14 nt, Homo sapiens
ggcagggugcagua

SEQ ID NO: 691525 - RNA, 12 nt, Homo sapiens
ggccaacaaaga

SEQ ID NO: 691526 - RNA, 13 nt, Homo sapiens
ggccagauccagc

SEQ ID NO: 691527 - RNA, 21 nt, Homo sapiens
ggccccgugaggcaaugggag

SEQ ID NO: 691528 - RNA, 15 nt, Homo sapiens
ggcccggccagccau

SEQ ID NO: 691529 - RNA, 15 nt, Homo sapiens
ggccugagauuucau

SEQ ID NO: 691530 - RNA, 17 nt, Homo sapiens
ggcucagacauguuuuc

SEQ ID NO: 691531 - RNA, 16 nt, Homo sapiens
ggcuccaacacugcug

SEQ ID NO: 691532 - RNA, 18 nt, Homo sapiens
ggcuccagaugcagggca

SEQ ID NO: 691533 - RNA, 15 nt, Homo sapiens
gggcccccaucucau

SEQ ID NO: 691534 - RNA, 14 nt, Homo sapiens
ggggaucccucccc

SEQ ID NO: 691535 - RNA, 13 nt, Homo sapiens
ggggccuccagaa

SEQ ID NO: 691536 - RNA, 10 nt, Homo sapiens
ggggcuuccu

SEQ ID NO: 691537 - RNA, 15 nt, Homo sapiens
ggucaggcagggugc

SEQ ID NO: 691538 - RNA, 12 nt, Homo sapiens
ggucaugcccuc

SEQ ID NO: 691539 - RNA, 17 nt, Homo sapiens
ggugcaguaucaugccc

SEQ ID NO: 691540 - RNA, 19 nt, Homo sapiens
ggugcaguaucaugcccug

SEQ ID NO: 691541 - RNA, 13 nt, Homo sapiens
ggugcccacaggc

SEQ ID NO: 691542 - RNA, 14 nt, Homo sapiens
gguggugucuccaa

SEQ ID NO: 691543 - RNA, 20 nt, Homo sapiens
guacuccagccugggugaca

SEQ ID NO: 691544 - RNA, 21 nt, Homo sapiens
guaggagcugccuuggcucag

SEQ ID NO: 691545 - RNA, 19 nt, Homo sapiens
guauaaguggaggcacuuu

SEQ ID NO: 691546 - RNA, 13 nt, Homo sapiens
gucacagccaccc

SEQ ID NO: 691547 - RNA, 15 nt, Homo sapiens
gucacucauugcuga

SEQ ID NO: 691548 - RNA, 14 nt, Homo sapiens
gucaucugugcacu

SEQ ID NO: 691549 - RNA, 19 nt, Homo sapiens
guccucagccuugccagag

SEQ ID NO: 691550 - RNA, 18 nt, Homo sapiens
gucgcaucucagugcagg

SEQ ID NO: 691551 - RNA, 16 nt, Homo sapiens
gucucagucauaauca

SEQ ID NO: 691552 - RNA, 20 nt, Homo sapiens
gucuuuccuaaggcugcaag

SEQ ID NO: 691553 - RNA, 14 nt, Homo sapiens
gugaacaaagcagc

SEQ ID NO: 691554 - RNA, 23 nt, Homo sapiens
gugauugacagcuuugcugcuga

SEQ ID NO: 691555 - RNA, 23 nt, Homo sapiens
guggccaugccucagcccugacc

SEQ ID NO: 691556 - RNA, 22 nt, Homo sapiens
guggcgagaaauaaaguuugcu

SEQ ID NO: 691557 - RNA, 12 nt, Homo sapiens
guguguccaaaa

SEQ ID NO: 691558 - RNA, 12 nt, Homo sapiens
guucugugcaca

SEQ ID NO: 691559 - RNA, 14 nt, Homo sapiens
guucuuugggccag

SEQ ID NO: 691560 - RNA, 19 nt, Homo sapiens
guugaucuggaacccagac

SEQ ID NO: 691561 - RNA, 15 nt, Homo sapiens
guuuaaaacagaagc

SEQ ID NO: 691562 - RNA, 14 nt, Homo sapiens
guuuacaaauggac

SEQ ID NO: 691563 - RNA, 20 nt, Homo sapiens
guuugagaagaaaacaucua

SEQ ID NO: 691564 - RNA, 14 nt, Homo sapiens
guuuucaagucaaa

SEQ ID NO: 691565 - RNA, 15 nt, Homo sapiens
guuuuuaagcuguuu

SEQ ID NO: 691566 - RNA, 17 nt, Homo sapiens
uaaaagugggcuugauu

SEQ ID NO: 691567 - RNA, 18 nt, Homo sapiens
uaaaauauuuaucugauu

SEQ ID NO: 691568 - RNA, 15 nt, Homo sapiens
uaaacucuguugcaa

SEQ ID NO: 691569 - RNA, 21 nt, Homo sapiens
uaaauaaauguaucuuauuca

SEQ ID NO: 691570 - RNA, 14 nt, Homo sapiens
uaaauguaucuuau

SEQ ID NO: 691571 - RNA, 17 nt, Homo sapiens
uaaauuugguucuaggc

SEQ ID NO: 691572 - RNA, 20 nt, Homo sapiens
uaaucacuauuguuccagca

SEQ ID NO: 691573 - RNA, 21 nt, Homo sapiens
uaauuuaucuugucucugggc

SEQ ID NO: 691574 - RNA, 11 nt, Homo sapiens
uacaaauggac

SEQ ID NO: 691575 - RNA, 18 nt, Homo sapiens
uacaacugccucgaaaca

SEQ ID NO: 691576 - RNA, 13 nt, Homo sapiens
uacauccaaagca

SEQ ID NO: 691577 - RNA, 16 nt, Homo sapiens
uacauccaaagcagac

SEQ ID NO: 691578 - RNA, 23 nt, Homo sapiens
uaccuguuuuguggucagcugua

SEQ ID NO: 691579 - RNA, 13 nt, Homo sapiens
uacuaccuugaaa

SEQ ID NO: 691580 - RNA, 14 nt, Homo sapiens
uacuguuaaaggaa

SEQ ID NO: 691581 - RNA, 17 nt, Homo sapiens
uagaauauuuauuaccu

SEQ ID NO: 691582 - RNA, 20 nt, Homo sapiens
uagaauauuuauuaccucug

SEQ ID NO: 691583 - RNA, 14 nt, Homo sapiens
uagcagacaggccc

SEQ ID NO: 691584 - RNA, 20 nt, Homo sapiens
uagccagcacacagggcagu

SEQ ID NO: 691585 - RNA, 12 nt, Homo sapiens
uagcucuauguu

SEQ ID NO: 691586 - RNA, 21 nt, Homo sapiens
uaguccgugcugacagcugcu

SEQ ID NO: 691587 - RNA, 19 nt, Homo sapiens
uaugcauggugccccagga

SEQ ID NO: 691588 - RNA, 17 nt, Homo sapiens
uauggagagaaaacaga

SEQ ID NO: 691589 - RNA, 20 nt, Homo sapiens
uauggagagaaaacagaccu

SEQ ID NO: 691590 - RNA, 14 nt, Homo sapiens
uauguacaugagaa

SEQ ID NO: 691591 - RNA, 18 nt, Homo sapiens
uauuuauguuugcacuug

SEQ ID NO: 691592 - RNA, 13 nt, Homo sapiens
uauuuauuuacug

SEQ ID NO: 691593 - RNA, 19 nt, Homo sapiens
uauuuccauucaacaagag

SEQ ID NO: 691594 - RNA, 14 nt, Homo sapiens
ucaaaaugcuuuuu

SEQ ID NO: 691595 - RNA, 23 nt, Homo sapiens
ucaagaaauaaaaggaagccaaa

SEQ ID NO: 691596 - RNA, 19 nt, Homo sapiens
ucaagauacugcuacugua

SEQ ID NO: 691597 - RNA, 19 nt, Homo sapiens
ucacaaccugaaccuagga

SEQ ID NO: 691598 - RNA, 17 nt, Homo sapiens
ucacaggccccaggaaa

SEQ ID NO: 691599 - RNA, 22 nt, Homo sapiens
ucaccuuggcaccagacaccca

SEQ ID NO: 691600 - RNA, 14 nt, Homo sapiens
ucacucauugcuga

SEQ ID NO: 691601 - RNA, 13 nt, Homo sapiens
ucagaauagccac

SEQ ID NO: 691602 - RNA, 15 nt, Homo sapiens
ucagagaccauugca

SEQ ID NO: 691603 - RNA, 17 nt, Homo sapiens
ucagaggcgcacuguga

SEQ ID NO: 691604 - RNA, 13 nt, Homo sapiens
ucagcucugggcc

SEQ ID NO: 691605 - RNA, 19 nt, Homo sapiens
ucagcuguaguccucauaa

SEQ ID NO: 691606 - RNA, 14 nt, Homo sapiens
ucaggacagaugcc

SEQ ID NO: 691607 - RNA, 16 nt, Homo sapiens
ucaggacagaugccac

SEQ ID NO: 691608 - RNA, 18 nt, Homo sapiens
ucaggacagaugccacac

SEQ ID NO: 691609 - RNA, 17 nt, Homo sapiens
ucaguguaccauuugcc

SEQ ID NO: 691610 - RNA, 20 nt, Homo sapiens
ucaugccccuggcugggacg

SEQ ID NO: 691611 - RNA, 13 nt, Homo sapiens
ucaugcccugugc

SEQ ID NO: 691612 - RNA, 13 nt, Homo sapiens
ucauucuacugaa

SEQ ID NO: 691613 - RNA, 16 nt, Homo sapiens
cauugaacacaaacug

SEQ ID NO: 691614 - RNA, 13 nt, Homo sapiens
cauuucuuugugc

SEQ ID NO: 691615 - RNA, 19 nt, Homo sapiens
ccaaagcagacagcuccac

SEQ ID NO: 691616 - RNA, 19 nt, Homo sapiens
ccaacuagcucuauguuua

SEQ ID NO: 691617 - RNA, 12 nt, Homo sapiens
ccacacucagca

SEQ ID NO: 691618 - RNA, 16 nt, Homo sapiens
ccacagcaaccccagg

SEQ ID NO: 691619 - RNA, 20 nt, Homo sapiens
ccacgugggcaaacaggcag

SEQ ID NO: 691620 - RNA, 22 nt, Homo sapiens
ccagaaugcugcaggacuugag

SEQ ID NO: 691621 - RNA, 20 nt, Homo sapiens
ccagagagccuggugcugcu

SEQ ID NO: 691622 - RNA, 22 nt, Homo sapiens
ccagagccaggggggugaggag

SEQ ID NO: 691623 - RNA, 14 nt, Homo sapiens
ccagauuggcucac

SEQ ID NO: 691624 - RNA, 15 nt, Homo sapiens
ccagcagcgccuuuc

SEQ ID NO: 691625 - RNA, 19 nt, Homo sapiens
ccagcagggaaaaugcagc

SEQ ID NO: 691626 - RNA, 20 nt, Homo sapiens
ccagcuccaaccugcaaaga

SEQ ID NO: 691627 - RNA, 16 nt, Homo sapiens
ccagcuccaaggggaa

SEQ ID NO: 691628 - RNA, 18 nt, Homo sapiens
ccagcugcacugaugcug

SEQ ID NO: 691629 - RNA, 17 nt, Homo sapiens
ccagcugggucaggcag

SEQ ID NO: 691630 - RNA, 22 nt, Homo sapiens
ccaggacccugaaggggccaug

SEQ ID NO: 691631 - RNA, 21 nt, Homo sapiens
ccaggagauggaaguugcagu

SEQ ID NO: 691632 - RNA, 13 nt, Homo sapiens
ccaggcagaucca

SEQ ID NO: 691633 - RNA, 23 nt, Homo sapiens
ccaggcugaccacagcacagcca

SEQ ID NO: 691634 - RNA, 20 nt, Homo sapiens
ccaggcuggagugcaguggu

SEQ ID NO: 691635 - RNA, 17 nt, Homo sapiens
ccagggagaagcuccuc

SEQ ID NO: 691636 - RNA, 13 nt, Homo sapiens
ccagguacaucca

SEQ ID NO: 691637 - RNA, 15 nt, Homo sapiens
ccauauugagucaaa

SEQ ID NO: 691638 - RNA, 22 nt, Homo sapiens
ccaucuucuaaacccaauccaa

SEQ ID NO: 691639 - RNA, 20 nt, Homo sapiens
ccaugagaugauacauccaa

SEQ ID NO: 691640 - RNA, 15 nt, Homo sapiens
ccaugucugcauuuc

SEQ ID NO: 691641 - RNA, 11 nt, Homo sapiens
ccauugcaaug

SEQ ID NO: 691642 - RNA, 21 nt, Homo sapiens
cccagaccuguuagcagacag

SEQ ID NO: 691643 - RNA, 22 nt, Homo sapiens
cccagagacauacuugaagggc

SEQ ID NO: 691644 - RNA, 14 nt, Homo sapiens
cccagccaccgaag

SEQ ID NO: 691645 - RNA, 18 nt, Homo sapiens
cccagcuaagaaccugga

SEQ ID NO: 691646 - RNA, 21 nt, Homo sapiens
cccagcuccggccuguccucc

SEQ ID NO: 691647 - RNA, 14 nt, Homo sapiens
cccaggaccagcuc

SEQ ID NO: 691648 - RNA, 23 nt, Homo sapiens
cccaggacccugaaggggccaug

SEQ ID NO: 691649 - RNA, 15 nt, Homo sapiens
cccaggaccuggcug

SEQ ID NO: 691650 - RNA, 20 nt, Homo sapiens
cccagugcccccacugacca

SEQ ID NO: 691651 - RNA, 22 nt, Homo sapiens
cccaguucacccugauuuagga

SEQ ID NO: 691652 - RNA, 17 nt, Homo sapiens
cccaugcacugugaagg

SEQ ID NO: 691653 - RNA, 15 nt, Homo sapiens
cccauuucuauuuau

SEQ ID NO: 691654 - RNA, 12 nt, Homo sapiens
ccccacugacca

SEQ ID NO: 691655 - RNA, 15 nt, Homo sapiens
ccccaugcacuguga

SEQ ID NO: 691656 - RNA, 15 nt, Homo sapiens
cccccagcacugagg

SEQ ID NO: 691657 - RNA, 13 nt, Homo sapiens
cccccuucacaaa

SEQ ID NO: 691658 - RNA, 16 nt, Homo sapiens
ccccuccuccacucuc

SEQ ID NO: 691659 - RNA, 18 nt, Homo sapiens
cccuacuauucaguggcg

SEQ ID NO: 691660 - RNA, 21 nt, Homo sapiens
cccucaccuuggcaccagaca

SEQ ID NO: 691661 - RNA, 18 nt, Homo sapiens
cccucauucuacugaaaa

SEQ ID NO: 691662 - RNA, 14 nt, Homo sapiens
cccucccuuucucc

SEQ ID NO: 691663 - RNA, 16 nt, Homo sapiens
cccucuucauggaugg

SEQ ID NO: 691664 - RNA, 19 nt, Homo sapiens
cccugcgggugaacaaagc

SEQ ID NO: 691665 - RNA, 21 nt, Homo sapiens
cccuggugggccaacaaagaa

SEQ ID NO: 691666 - RNA, 15 nt, Homo sapiens
ccggauauauacaua

SEQ ID NO: 691667 - RNA, 17 nt, Homo sapiens
ccuaaaugcacagucau

SEQ ID NO: 691668 - RNA, 19 nt, Homo sapiens
ccuaauccaggcagaucca

SEQ ID NO: 691669 - RNA, 20 nt, Homo sapiens
ccuauuuccauucaacaaga

SEQ ID NO: 691670 - RNA, 21 nt, Homo sapiens
ccucaccuuggcaccagacac

SEQ ID NO: 691671 - RNA, 18 nt, Homo sapiens
ccucagccuugccagaga

SEQ ID NO: 691672 - RNA, 18 nt, Homo sapiens
ccucaucucucugcccaa

SEQ ID NO: 691673 - RNA, 19 nt, Homo sapiens
ccucccuguuccccagaga

SEQ ID NO: 691674 - RNA, 15 nt, Homo sapiens
ccucucaguacuuug

SEQ ID NO: 691675 - RNA, 19 nt, Homo sapiens
ccucugucagucacagcca

SEQ ID NO: 691676 - RNA, 21 nt, Homo sapiens
ccugaaacaacuuggaaagau

SEQ ID NO: 691677 - RNA, 12 nt, Homo sapiens
ccugaagaacca

SEQ ID NO: 691678 - RNA, 19 nt, Homo sapiens
ccuggagcccauccagucu

SEQ ID NO: 691679 - RNA, 15 nt, Homo sapiens
ccuggugcugcugcu

SEQ ID NO: 691680 - RNA, 15 nt, Homo sapiens
ccuguccagcuccaa

SEQ ID NO: 691681 - RNA, 23 nt, Homo sapiens
ccuguccuccaacaccaagcaca

SEQ ID NO: 691682 - RNA, 21 nt, Homo sapiens
ccuguguguccaaaacugccu

SEQ ID NO: 691683 - RNA, 20 nt, Homo sapiens
ccuucacaaagcccaaggga

SEQ ID NO: 691684 - RNA, 14 nt, Homo sapiens
ccuucucucaucuc

SEQ ID NO: 691685 - RNA, 23 nt, Homo sapiens
ccuucugcucagcucugggccau

SEQ ID NO: 691686 - RNA, 11 nt, Homo sapiens
ccuugagaaac

SEQ ID NO: 691687 - RNA, 16 nt, Homo sapiens
cgccaggcugaccaca

SEQ ID NO: 691688 - RNA, 17 nt, Homo sapiens
cgccaggcugaccacag

SEQ ID NO: 691689 - RNA, 23 nt, Homo sapiens
cgccccagcaggugcugacuuca

SEQ ID NO: 691690 - RNA, 18 nt, Homo sapiens
cggauauauacauagcau

SEQ ID NO: 691691 - RNA, 16 nt, Homo sapiens
cggcucgauuucucca

SEQ ID NO: 691692 - RNA, 21 nt, Homo sapiens
cguuugagaagaaaacaucua

SEQ ID NO: 691693 - RNA, 15 nt, Homo sapiens
cuaaauuugguucua

SEQ ID NO: 691694 - RNA, 16 nt, Homo sapiens
cuaaccagccugguca

SEQ ID NO: 691695 - RNA, 21 nt, Homo sapiens
cuaauuugcauuaaauucaca

SEQ ID NO: 691696 - RNA, 13 nt, Homo sapiens
cuagccaaauggu

SEQ ID NO: 691697 - RNA, 12 nt, Homo sapiens
cuauuaagguga

SEQ ID NO: 691698 - RNA, 23 nt, Homo sapiens
cucacuggggccuacagcuuuga

SEQ ID NO: 691699 - RNA, 15 nt, Homo sapiens
cucaucuuucuugau

SEQ ID NO: 691700 - RNA, 23 nt, Homo sapiens
cuccaaccuggggggcaguggug

SEQ ID NO: 691701 - RNA, 22 nt, Homo sapiens
cuccacucaguugcaacuugga

SEQ ID NO: 691702 - RNA, 14 nt, Homo sapiens
cuccaggauuuccu

SEQ ID NO: 691703 - RNA, 20 nt, Homo sapiens
cucccaaaugagccaugaga

SEQ ID NO: 691704 - RNA, 21 nt, Homo sapiens
cucccugaagccuuugcauuu

SEQ ID NO: 691705 - RNA, 13 nt, Homo sapiens
cuccuuccagugu

SEQ ID NO: 691706 - RNA, 21 nt, Homo sapiens
cuccuuguuccuagaguagag

SEQ ID NO: 691707 - RNA, 13 nt, Homo sapiens
cucuagccaaaug

SEQ ID NO: 691708 - RNA, 21 nt, Homo sapiens
cucuauagacucuaggacaua

SEQ ID NO: 691709 - RNA, 21 nt, Homo sapiens
cucucggaacugcaugcugcu

SEQ ID NO: 691710 - RNA, 21 nt, Homo sapiens
cucugcuugagucagguuuga

SEQ ID NO: 691711 - RNA, 23 nt, Homo sapiens
cucuuguauuaaacucuucacaa

SEQ ID NO: 691712 - RNA, 18 nt, Homo sapiens
cucuuucuguauauacuu

SEQ ID NO: 691713 - RNA, 15 nt, Homo sapiens
cugaaauagaggcua

SEQ ID NO: 691714 - RNA, 23 nt, Homo sapiens
cugaacuguggggugugcacauc

SEQ ID NO: 691715 - RNA, 12 nt, Homo sapiens
cugaagccaaag

SEQ ID NO: 691716 - RNA, 11 nt, Homo sapiens
cugacccugua

SEQ ID NO: 691717 - RNA, 17 nt, Homo sapiens
cugagcaacucuugauu

SEQ ID NO: 691718 - RNA, 20 nt, Homo sapiens
cugaggccacacucagcaca

SEQ ID NO: 691719 - RNA, 15 nt, Homo sapiens
cugaugcugccccuc

SEQ ID NO: 691720 - RNA, 17 nt, Homo sapiens
cugcaaaggacagaucc

SEQ ID NO: 691721 - RNA, 22 nt, Homo sapiens
cugcacugaugcugccccucau

SEQ ID NO: 691722 - RNA, 23 nt, Homo sapiens
cugcaugcugcuggacaguauca

SEQ ID NO: 691723 - RNA, 21 nt, Homo sapiens
cugccucggccucccaaagug

SEQ ID NO: 691724 - RNA, 14 nt, Homo sapiens
cugcuccagugcag

SEQ ID NO: 691725 - RNA, 20 nt, Homo sapiens
cuggagcccauccagucucc

SEQ ID NO: 691726 - RNA, 22 nt, Homo sapiens
cuggaggcccaguucacccuga

SEQ ID NO: 691727 - RNA, 20 nt, Homo sapiens
cuggagugcaguggugugau

SEQ ID NO: 691728 - RNA, 18 nt, Homo sapiens
cuggaguggccacuaagc

SEQ ID NO: 691729 - RNA, 14 nt, Homo sapiens
uucucauuucaccc

SEQ ID NO: 691730 - RNA, 13 nt, Homo sapiens
uucucucaucucu

SEQ ID NO: 691731 - RNA, 17 nt, Homo sapiens
uucuuugggccagacau

SEQ ID NO: 691732 - RNA, 20 nt, Homo sapiens
uugaaauuaagaaggcaaaa

SEQ ID NO: 691733 - RNA, 15 nt, Homo sapiens
uugaacccaggagau

SEQ ID NO: 691734 - RNA, 20 nt, Homo sapiens
uugaaggugcugacggccag

SEQ ID NO: 691735 - RNA, 19 nt, Homo sapiens
uugacagcuuugcugcuga

SEQ ID NO: 691736 - RNA, 21 nt, Homo sapiens
uugaucuggaacccagacuca

SEQ ID NO: 691737 - RNA, 19 nt, Homo sapiens
uugaugauuaauucaccuu

SEQ ID NO: 691738 - RNA, 17 nt, Homo sapiens
uugcacuuaugauuuca

SEQ ID NO: 691739 - RNA, 11 nt, Homo sapiens
uugcuguauau

SEQ ID NO: 691740 - RNA, 15 nt, Homo sapiens
uugcuuuauuccaga

SEQ ID NO: 691741 - RNA, 13 nt, Homo sapiens
uuggcaccagaca

SEQ ID NO: 691742 - RNA, 14 nt, Homo sapiens
uuggcaccagacac

SEQ ID NO: 691743 - RNA, 22 nt, Homo sapiens
uugggaggcugaggcaagagaa

SEQ ID NO: 691744 - RNA, 15 nt, Homo sapiens
uugggccugcuccag

SEQ ID NO: 691745 - RNA, 18 nt, Homo sapiens
uugucuaaacaaugcuga

SEQ ID NO: 691746 - RNA, 16 nt, Homo sapiens
uuguuaucagucaaua

SEQ ID NO: 691747 - RNA, 17 nt, Homo sapiens
uuguucgggugugcaau

SEQ ID NO: 691748 - RNA, 14 nt, Homo sapiens
uuuaacagcugaau

SEQ ID NO: 691749 - RNA, 21 nt, Homo sapiens
uuucauuugguucauuaauuc

SEQ ID NO: 691750 - RNA, 18 nt, Homo sapiens
uuuccucccuucugcuac

SEQ ID NO: 691751 - RNA, 22 nt, Homo sapiens
uuugaagcuacuguguguguga

SEQ ID NO: 691752 - RNA, 12 nt, Homo sapiens
uuugaaggcaaa

SEQ ID NO: 691753 - RNA, 20 nt, Homo sapiens
uuugaaggcaaaauugcaaa

SEQ ID NO: 691754 - RNA, 13 nt, Homo sapiens
uuugggccagaca

SEQ ID NO: 691755 - RNA, 12 nt, Homo sapiens
uuuuuuccuuaa

SEQ ID NO: 691756 - RNA, 14 nt, Homo sapiens
acaugccacaagga

SEQ ID NO: 691757 - RNA, 20 nt, Homo sapiens
acccuccuugggacugaagg

SEQ ID NO: 691758 - RNA, 17 nt, Homo sapiens
acccugaaggggccaug

SEQ ID NO: 691759 - RNA, 21 nt, Homo sapiens
acccuggugggccaacaaaga

SEQ ID NO: 691760 - RNA, 13 nt, Homo sapiens
acccuucccucac

SEQ ID NO: 691761 - RNA, 15 nt, Homo sapiens
accguucugugcaca

SEQ ID NO: 691762 - RNA, 18 nt, Homo sapiens
accuaauccaggcagauc

SEQ ID NO: 691763 - RNA, 16 nt, Homo sapiens
accucucccugacccu

SEQ ID NO: 691764 - RNA, 13 nt, Homo sapiens
accugauccugga

SEQ ID NO: 691765 - RNA, 22 nt, Homo sapiens
accugcaaagaucuguccucag

SEQ ID NO: 691766 - RNA, 19 nt, Homo sapiens
accuggcagcucuggacag

SEQ ID NO: 691767 - RNA, 19 nt, Homo sapiens
accuguuagcagacaggcc

SEQ ID NO: 691768 - RNA, 17 nt, Homo sapiens
accuuggcaccagacac

SEQ ID NO: 691769 - RNA, 23 nt, Homo sapiens
accuuggcaccagacacccagga

SEQ ID NO: 691770 - RNA, 20 nt, Homo sapiens
accuuuugggaauguuuuaa

SEQ ID NO: 691771 - RNA, 14 nt, Homo sapiens
acggccacaucaaa

SEQ ID NO: 691772 - RNA, 20 nt, Homo sapiens
acggggcucuucucauuuca

SEQ ID NO: 691773 - RNA, 15 nt, Homo sapiens
acguagcugcaaagg

SEQ ID NO: 691774 - RNA, 19 nt, Homo sapiens
acgugggcaaacaggcagu

SEQ ID NO: 691775 - RNA, 17 nt, Homo sapiens
acuaucuacucuccuca

SEQ ID NO: 691776 - RNA, 17 nt, Homo sapiens
acucaaauggggccaga

SEQ ID NO: 691777 - RNA, 21 nt, Homo sapiens
acucaaauggggccagaucca

SEQ ID NO: 691778 - RNA, 14 nt, Homo sapiens
acucaguugcaacu

SEQ ID NO: 691779 - RNA, 21 nt, Homo sapiens
acucuuagauggauucuccac

SEQ ID NO: 691780 - RNA, 12 nt, Homo sapiens
acugaugcugcc

SEQ ID NO: 691781 - RNA, 13 nt, Homo sapiens
acugguugcacuu

SEQ ID NO: 691782 - RNA, 23 nt, Homo sapiens
acugucaaaaaguuugguucugu

SEQ ID NO: 691783 - RNA, 20 nt, Homo sapiens
acugucaaggcugcuuagaa

SEQ ID NO: 691784 - RNA, 18 nt, Homo sapiens
acuuaugauuucaugugc

SEQ ID NO: 691785 - RNA, 18 nt, Homo sapiens
acuucauauugcugagag

SEQ ID NO: 691786 - RNA, 23 nt, Homo sapiens
acuucuuauggaauugauuugca

SEQ ID NO: 691787 - RNA, 18 nt, Homo sapiens
acuugaagggccagagcc

SEQ ID NO: 691788 - RNA, 15 nt, Homo sapiens
agaaagugugcuuua

SEQ ID NO: 691789 - RNA, 12 nt, Homo sapiens
agaacauuuuaa

SEQ ID NO: 691790 - RNA, 23 nt, Homo sapiens
agaacauuuuaauucaucccaac

SEQ ID NO: 691791 - RNA, 15 nt, Homo sapiens
agaacucacuggggc

SEQ ID NO: 691792 - RNA, 20 nt, Homo sapiens
agaagccugaugcugacauu

SEQ ID NO: 691793 - RNA, 21 nt, Homo sapiens
agaauuuauucaauuccucug

SEQ ID NO: 691794 - RNA, 21 nt, Homo sapiens
agacauuggcaccuaauccag

SEQ ID NO: 691795 - RNA, 17 nt, Homo sapiens
agacucgagaacuuuca

SEQ ID NO: 691796 - RNA, 20 nt, Homo sapiens
agacuuuacauggaugccaa

SEQ ID NO: 691797 - RNA, 13 nt, Homo sapiens
agagagccuggug

SEQ ID NO: 691798 - RNA, 16 nt, Homo sapiens
agagagucgcaucuca

SEQ ID NO: 691799 - RNA, 14 nt, Homo sapiens
agagucgcaucuca

SEQ ID NO: 691800 - RNA, 14 nt, Homo sapiens
agaguugagcucuc

SEQ ID NO: 691801 - RNA, 13 nt, Homo sapiens
agauaacuaggaa

SEQ ID NO: 691802 - RNA, 22 nt, Homo sapiens
agauccagggacugaagccaaa

SEQ ID NO: 691803 - RNA, 19 nt, Homo sapiens
agaucuggaaccucagccu

SEQ ID NO: 691804 - RNA, 20 nt, Homo sapiens
agaugaaggagaggcaacau

SEQ ID NO: 691805 - RNA, 15 nt, Homo sapiens
agaugauacauccaa

SEQ ID NO: 691806 - RNA, 22 nt, Homo sapiens
agaugauacauccaaagcagac

SEQ ID NO: 691807 - RNA, 14 nt, Homo sapiens
agaugcagggcagu

SEQ ID NO: 691808 - RNA, 21 nt, Homo sapiens
agauguaauuguuugucuuua

SEQ ID NO: 691809 - RNA, 19 nt, Homo sapiens
agauuggcucacacugaga

SEQ ID NO: 691810 - RNA, 16 nt, Homo sapiens
agcaacucuugauuau

SEQ ID NO: 691811 - RNA, 11 nt, Homo sapiens
agcacagccaa

SEQ ID NO: 691812 - RNA, 18 nt, Homo sapiens
agcaccguucugugcaca

SEQ ID NO: 691813 - RNA, 10 nt, Homo sapiens
agcacugagg

SEQ ID NO: 691814 - RNA, 16 nt, Homo sapiens
agcagcugguaaucuu

SEQ ID NO: 691815 - RNA, 22 nt, Homo sapiens
agcaggugcugacuucaucucc

SEQ ID NO: 691816 - RNA, 20 nt, Homo sapiens
agcagguucccaagcucaga

SEQ ID NO: 691817 - RNA, 14 nt, Homo sapiens
agccaaaugguuua

SEQ ID NO: 691818 - RNA, 18 nt, Homo sapiens
agccaauucagacaggca

SEQ ID NO: 691819 - RNA, 14 nt, Homo sapiens
agcccugacccugu

SEQ ID NO: 691820 - RNA, 23 nt, Homo sapiens
agccguuugagaagaaaacaucu

SEQ ID NO: 691821 - RNA, 15 nt, Homo sapiens
agccuggugcugcug

SEQ ID NO: 691822 - RNA, 16 nt, Homo sapiens
agccuggugcugcugc

SEQ ID NO: 691823 - RNA, 12 nt, Homo sapiens
agcuaauuugca

SEQ ID NO: 691824 - RNA, 23 nt, Homo sapiens
agcuacugugugugugaaugaac

SEQ ID NO: 691825 - RNA, 14 nt, Homo sapiens
agcucaggaucucu

SEQ ID NO: 691826 - RNA, 21 nt, Homo sapiens
agcuccacccuggccgagucc

SEQ ID NO: 691827 - RNA, 23 nt, Homo sapiens
agcucucggaacugcaugcugcu

SEQ ID NO: 691828 - RNA, 19 nt, Homo sapiens
agcugcacugaugcugccc

SEQ ID NO: 691829 - RNA, 19 nt, Homo sapiens
agcugcuccuagagggagg

SEQ ID NO: 691830 - RNA, 18 nt, Homo sapiens
agcugguaaucuugcucu

SEQ ID NO: 691831 - RNA, 16 nt, Homo sapiens
agcuguuuucccugac

SEQ ID NO: 691832 - RNA, 20 nt, Homo sapiens
aggacagauccagggacuga

SEQ ID NO: 691833 - RNA, 23 nt, Homo sapiens
aggacaugcgguagccagcacac

SEQ ID NO: 691834 - RNA, 16 nt, Homo sapiens
aggaccuggcugccau

SEQ ID NO: 691835 - RNA, 22 nt, Homo sapiens
aggagaccuggcacuggaugca

SEQ ID NO: 691836 - RNA, 14 nt, Homo sapiens
aggauagaugcugg

SEQ ID NO: 691837 - RNA, 19 nt, Homo sapiens
aggaugugauuguggaaug

SEQ ID NO: 691838 - RNA, 17 nt, Homo sapiens
aggcaguuggccagaga

SEQ ID NO: 691839 - RNA, 19 nt, Homo sapiens
aggcucaggucccuggggc

SEQ ID NO: 691840 - RNA, 17 nt, Homo sapiens
aggcugaccacagcaca

SEQ ID NO: 691841 - RNA, 18 nt, Homo sapiens
aggcugaccacagcacag

SEQ ID NO: 691842 - RNA, 16 nt, Homo sapiens
agggagggcugucauc

SEQ ID NO: 691843 - RNA, 16 nt, Homo sapiens
agggauuccccuaacc

SEQ ID NO: 691844 - RNA, 20 nt, Homo sapiens
agggcccccaucucaugccc

SEQ ID NO: 691845 - RNA, 19 nt, Homo sapiens
agggugcaguaucaugccc

SEQ ID NO: 691846 - RNA, 20 nt, Homo sapiens
aggugcugacuucaucuccc

SEQ ID NO: 691847 - RNA, 20 nt, Homo sapiens
aguaaaucuuuuacaacugc

SEQ ID NO: 691848 - RNA, 16 nt, Homo sapiens
aguauaaacaaaguua

SEQ ID NO: 691849 - RNA, 17 nt, Homo sapiens
aguaucacugucuuucc

SEQ ID NO: 691850 - RNA, 17 nt, Homo sapiens
agucaaaacuacaaauc

SEQ ID NO: 691851 - RNA, 18 nt, Homo sapiens
agucagguuugaguagag

SEQ ID NO: 691852 - RNA, 13 nt, Homo sapiens
agucaugugccua

SEQ ID NO: 691853 - RNA, 22 nt, Homo sapiens
agucuuuuguucgcauggucac

SEQ ID NO: 691854 - RNA, 15 nt, Homo sapiens
agugagcugauauca

SEQ ID NO: 691855 - RNA, 14 nt, Homo sapiens
agugauuacuguca

SEQ ID NO: 691856 - RNA, 18 nt, Homo sapiens
aguucuuugggccagaca

SEQ ID NO: 691857 - RNA, 13 nt, Homo sapiens
aguugaucuggaa

SEQ ID NO: 691858 - RNA, 21 nt, Homo sapiens
aguuucagagaccauugcaau

SEQ ID NO: 691859 - RNA, 20 nt, Homo sapiens
aguuugagacaggagaccug

SEQ ID NO: 691860 - RNA, 16 nt, Homo sapiens
aucaguguaccauuug

SEQ ID NO: 691861 - RNA, 20 nt, Homo sapiens
auccagggcccccaucucau

SEQ ID NO: 691862 - RNA, 22 nt, Homo sapiens
auccuacuguaauaaagaugau

SEQ ID NO: 691863 - RNA, 22 nt, Homo sapiens
auccugggggacccaauguagg

SEQ ID NO: 691864 - RNA, 12 nt, Homo sapiens
aucucagugcag

SEQ ID NO: 691865 - RNA, 22 nt, Homo sapiens
aucucaugccccuggcugggac

SEQ ID NO: 691866 - RNA, 18 nt, Homo sapiens
aucugacaugauuccuuc

SEQ ID NO: 691867 - RNA, 14 nt, Homo sapiens
aucuggaacccaga

SEQ ID NO: 691868 - RNA, 19 nt, Homo sapiens
aucuggaacccagacucag

SEQ ID NO: 691869 - RNA, 15 nt, Homo sapiens
aucuggaaccucagc

SEQ ID NO: 691870 - RNA, 20 nt, Homo sapiens
aucuucuaaacccaauccaa

SEQ ID NO: 691871 - RNA, 22 nt, Homo sapiens
aucuugaaauuaagaaggcaaa

SEQ ID NO: 691872 - RNA, 20 nt, Homo sapiens
aucuuuacaaaacuacauga

SEQ ID NO: 691873 - RNA, 18 nt, Homo sapiens
augagaugauacauccaa

SEQ ID NO: 691874 - RNA, 11 nt, Homo sapiens
augagccauga

SEQ ID NO: 691875 - RNA, 12 nt, Homo sapiens
augcacugugaa

SEQ ID NO: 691876 - RNA, 19 nt, Homo sapiens
augcagcagggaugcccug

SEQ ID NO: 691877 - RNA, 21 nt, Homo sapiens
augcauggugccccaggacca

SEQ ID NO: 691878 - RNA, 23 nt, Homo sapiens
augcauggugccccaggaccagc

SEQ ID NO: 691879 - RNA, 19 nt, Homo sapiens
augcccugugcaaccucuu

SEQ ID NO: 691880 - RNA, 22 nt, Homo sapiens
augccgauauacucuagaugaa

SEQ ID NO: 691881 - RNA, 20 nt, Homo sapiens
augcgguagccagcacacag

SEQ ID NO: 691882 - RNA, 19 nt, Homo sapiens
auggaugggggaacucaga

SEQ ID NO: 691883 - RNA, 22 nt, Homo sapiens
auggauucuccacucaguugca

SEQ ID NO: 691884 - RNA, 15 nt, Homo sapiens
augggacuuaacucc

SEQ ID NO: 691885 - RNA, 15 nt, Homo sapiens
auggucacacacuga

SEQ ID NO: 691886 - RNA, 21 nt, Homo sapiens
augucucugugagacucgaga

SEQ ID NO: 691887 - RNA, 18 nt, Homo sapiens
augugcggggaucaucug

SEQ ID NO: 691888 - RNA, 18 nt, Homo sapiens
auuaauaaucuuauuagg

SEQ ID NO: 691889 - RNA, 12 nt, Homo sapiens
auuaauucaccu

SEQ ID NO: 691890 - RNA, 19 nt, Homo sapiens
auucaagggacccaugagu

SEQ ID NO: 691891 - RNA, 17 nt, Homo sapiens
auucuauuuauauguac

SEQ ID NO: 691892 - RNA, 22 nt, Homo sapiens
auugacacagaaaauguugaga

SEQ ID NO: 691893 - RNA, 15 nt, Homo sapiens
auugucccucugccc

SEQ ID NO: 691894 - RNA, 21 nt, Homo sapiens
auuuagcuaaacggauuccaa

SEQ ID NO: 691895 - RNA, 17 nt, Homo sapiens
auuuauuuacagaugaa

SEQ ID NO: 691896 - RNA, 17 nt, Homo sapiens
auuugggccugcuccag

SEQ ID NO: 691897 - RNA, 20 nt, Homo sapiens
auuuggguucugccugccag

SEQ ID NO: 691898 - RNA, 15 nt, Homo sapiens
caaaacuacaugaga

SEQ ID NO: 691899 - RNA, 14 nt, Homo sapiens
caaacaaaauuucu

SEQ ID NO: 691900 - RNA, 13 nt, Homo sapiens
caaacaggcaguu

SEQ ID NO: 691901 - RNA, 15 nt, Homo sapiens
caaaggacagaucca

SEQ ID NO: 691902 - RNA, 16 nt, Homo sapiens
caaaggacagauccag

SEQ ID NO: 691903 - RNA, 23 nt, Homo sapiens
caaaguuaugcaagggacugugu

SEQ ID NO: 691904 - RNA, 16 nt, Homo sapiens
caaaucuugaaauuaa

SEQ ID NO: 691905 - RNA, 13 nt, Homo sapiens
caaauggacauag

SEQ ID NO: 691906 - RNA, 20 nt, Homo sapiens
caaaugguaggcauuuccua

SEQ ID NO: 691907 - RNA, 15 nt, Homo sapiens
caacaccaagcacag

SEQ ID NO: 691908 - RNA, 22 nt, Homo sapiens
caacacugcugcuccagugcag

SEQ ID NO: 691909 - RNA, 23 nt, Homo sapiens
caacacugcugcuccagugcagg

SEQ ID NO: 691910 - RNA, 18 nt, Homo sapiens
caacagaagcuuccauuc

SEQ ID NO: 691911 - RNA, 19 nt, Homo sapiens
caaccccccagcacugagg

SEQ ID NO: 691912 - RNA, 23 nt, Homo sapiens
caacccgagucauucguucugug

SEQ ID NO: 691913 - RNA, 18 nt, Homo sapiens
caaccggucacccaggag

SEQ ID NO: 691914 - RNA, 21 nt, Homo sapiens
caacucuccccugaccuguga

SEQ ID NO: 691915 - RNA, 18 nt, Homo sapiens
caagcccuguugacacag

SEQ ID NO: 691916 - RNA, 20 nt, Homo sapiens
caaggcugcuuagaauccaa

SEQ ID NO: 691917 - RNA, 22 nt, Homo sapiens
caaguggaccuuaggccuuccu

SEQ ID NO: 691918 - RNA, 17 nt, Homo sapiens
caauaauugcagaacua

SEQ ID NO: 691919 - RNA, 19 nt, Homo sapiens
caaugagggagcauguacc

SEQ ID NO: 691920 - RNA, 19 nt, Homo sapiens
caaugggagcugaggccac

SEQ ID NO: 691921 - RNA, 17 nt, Homo sapiens
caaugugaacuuuauua

SEQ ID NO: 691922 - RNA, 16 nt, Homo sapiens
caauucagacaggcaa

SEQ ID NO: 691923 - RNA, 15 nt, Homo sapiens
caauuccucugggaa

SEQ ID NO: 691924 - RNA, 14 nt, Homo sapiens
caauuucagacucc

SEQ ID NO: 691925 - RNA, 17 nt, Homo sapiens
cacaccuuuuauugaca

SEQ ID NO: 691926 - RNA, 14 nt, Homo sapiens
cacagccaacacgc

SEQ ID NO: 691927 - RNA, 16 nt, Homo sapiens
cacaguagucuugaug

SEQ ID NO: 691928 - RNA, 13 nt, Homo sapiens
caccccugcaguu

SEQ ID NO: 691929 - RNA, 20 nt, Homo sapiens
cacccucauucuacugaaaa

SEQ ID NO: 691930 - RNA, 12 nt, Homo sapiens
caccguucugug

SEQ ID NO: 691931 - RNA, 12 nt, Homo sapiens
caccuauuucca

SEQ ID NO: 691932 - RNA, 20 nt, Homo sapiens
caccucacaggccccaggaa

SEQ ID NO: 691933 - RNA, 14 nt, Homo sapiens
caccuguaauccca

SEQ ID NO: 691934 - RNA, 22 nt, Homo sapiens
caccuuggcaccagacacccag

SEQ ID NO: 691935 - RNA, 22 nt, Homo sapiens
cacgccuguaaucccagcacuu

SEQ ID NO: 691936 - RNA, 20 nt, Homo sapiens
cacggccacaucaaagaggc

SEQ ID NO: 691937 - RNA, 20 nt, Homo sapiens
cacuaagaauucaaacuggg

SEQ ID NO: 691938 - RNA, 14 nt, Homo sapiens
cacugaauuccauu

SEQ ID NO: 691939 - RNA, 14 nt, Homo sapiens
cagaacuaaacuca

SEQ ID NO: 691940 - RNA, 14 nt, Homo sapiens
cagaagccugaugc

SEQ ID NO: 691941 - RNA, 18 nt, Homo sapiens
cagaagccugaugcugac

SEQ ID NO: 691942 - RNA, 15 nt, Homo sapiens
cagaaggggguggug

SEQ ID NO: 691943 - RNA, 14 nt, Homo sapiens
cagacacccaggac

SEQ ID NO: 691944 - RNA, 14 nt, Homo sapiens
cagacucccauucc

SEQ ID NO: 691945 - RNA, 15 nt, Homo sapiens
cagacuuccuugaga

SEQ ID NO: 691946 - RNA, 20 nt, Homo sapiens
cagagcaagacucugucuca

SEQ ID NO: 691947 - RNA, 16 nt, Homo sapiens
cagauuuugcuguaua

SEQ ID NO: 691948 - RNA, 16 nt, Homo sapiens
cagcacacagggcagu

SEQ ID NO: 691949 - RNA, 16 nt, Homo sapiens
cagcagggaugcccug

SEQ ID NO: 691950 - RNA, 16 nt, Homo sapiens
cagccaccccugagau

SEQ ID NO: 691951 - RNA, 14 nt, Homo sapiens
cagccuggccagac

SEQ ID NO: 691952 - RNA, 14 nt, Homo sapiens
cagccuugccagag

SEQ ID NO: 691953 - RNA, 18 nt, Homo sapiens
cagcuccaaccugcaaag

SEQ ID NO: 691954 - RNA, 23 nt, Homo sapiens
caggaaaaggugauauccauucu

SEQ ID NO: 691955 - RNA, 12 nt, Homo sapiens
caggcaccugcc

SEQ ID NO: 691956 - RNA, 15 nt, Homo sapiens
caggcagauccagga

SEQ ID NO: 691957 - RNA, 16 nt, Homo sapiens
caggcagauccaggac

SEQ ID NO: 691958 - RNA, 17 nt, Homo sapiens
caggccccgugaggcaa

SEQ ID NO: 691959 - RNA, 22 nt, Homo sapiens
cagggcagucauuggcugucuc

SEQ ID NO: 691960 - RNA, 17 nt, Homo sapiens
cagggcccccaucucau

SEQ ID NO: 691961 - RNA, 21 nt, Homo sapiens
caggguuucaccauguugccc

SEQ ID NO: 691962 - RNA, 17 nt, Homo sapiens
caggugauccaccugcc

SEQ ID NO: 691963 - RNA, 18 nt, Homo sapiens
cucuccccagcccagaga

SEQ ID NO: 691964 - RNA, 17 nt, Homo sapiens
cucucccugacccugua

SEQ ID NO: 691965 - RNA, 12 nt, Homo sapiens
cucugauaccuc

SEQ ID NO: 691966 - RNA, 12 nt, Homo sapiens
cucugucaguca

SEQ ID NO: 691967 - RNA, 14 nt, Homo sapiens
cucuucucauuuca

SEQ ID NO: 691968 - RNA, 15 nt, Homo sapiens
cugaggccacacuca

SEQ ID NO: 691969 - RNA, 12 nt, Homo sapiens
cugauaccucaa

SEQ ID NO: 691970 - RNA, 12 nt, Homo sapiens
cugaugcugaca

SEQ ID NO: 691971 - RNA, 22 nt, Homo sapiens
cugauuuaggagaagccaggaa

SEQ ID NO: 691972 - RNA, 16 nt, Homo sapiens
cugcacccacccagga

SEQ ID NO: 691973 - RNA, 19 nt, Homo sapiens
cugcaccccugcaguuuga

SEQ ID NO: 691974 - RNA, 15 nt, Homo sapiens
cugccaaaaugcucu

SEQ ID NO: 691975 - RNA, 16 nt, Homo sapiens
cugccagcugcacuga

SEQ ID NO: 691976 - RNA, 15 nt, Homo sapiens
cugcuccagugcagg

SEQ ID NO: 691977 - RNA, 16 nt, Homo sapiens
cugcuccagugcagga

SEQ ID NO: 691978 - RNA, 21 nt, Homo sapiens
cugcuguggcgugagggugag

SEQ ID NO: 691979 - RNA, 17 nt, Homo sapiens
cugcuuugggaagccgu

SEQ ID NO: 691980 - RNA, 13 nt, Homo sapiens
acugaauuccauu

SEQ ID NO: 691981 - RNA, 19 nt, Homo sapiens
acugcccauggacaggcug

SEQ ID NO: 691982 - RNA, 17 nt, Homo sapiens
acuguguuucaaguuca

SEQ ID NO: 691983 - RNA, 19 nt, Homo sapiens
acuuucuguucuccagugu

SEQ ID NO: 691984 - RNA, 22 nt, Homo sapiens
agaaaacagaccuaaugcuccu

SEQ ID NO: 691985 - RNA, 22 nt, Homo sapiens
agaaaaugauguguacccaaac

SEQ ID NO: 691986 - RNA, 22 nt, Homo sapiens
agaaaauguugagaaucccaaa

SEQ ID NO: 691987 - RNA, 14 nt, Homo sapiens
agaaacgucuucua

SEQ ID NO: 691988 - RNA, 14 nt, Homo sapiens
agaaauauggacac

SEQ ID NO: 691989 - RNA, 20 nt, Homo sapiens
agaacacccucuaaauggga

SEQ ID NO: 691990 - RNA, 16 nt, Homo sapiens
agaacauuuuaauuca

SEQ ID NO: 691991 - RNA, 23 nt, Homo sapiens
agaacggggcucuucucauuuca

SEQ ID NO: 691992 - RNA, 21 nt, Homo sapiens
agaacucaaauggggccagau

SEQ ID NO: 691993 - RNA, 19 nt, Homo sapiens
agaauugcuugaacccagg

SEQ ID NO: 691994 - RNA, 19 nt, Homo sapiens
agacacccaggacuuauuu

SEQ ID NO: 691995 - RNA, 23 nt, Homo sapiens
agacaggcaaauaaaagugaccu

SEQ ID NO: 691996 - RNA, 14 nt, Homo sapiens
agaccugauccugg

SEQ ID NO: 691997 - RNA, 15 nt, Homo sapiens
agaccuggcacugga

SEQ ID NO: 691998 - RNA, 13 nt, Homo sapiens
agacucugucuca

SEQ ID NO: 691999 - RNA, 14 nt, Homo sapiens
agacuuuacaugga

SEQ ID NO: 692000 - RNA, 13 nt, Homo sapiens
agagaaaacagac

SEQ ID NO: 692001 - RNA, 22 nt, Homo sapiens
agagaaaacagaccuaaugcuc

SEQ ID NO: 692002 - RNA, 16 nt, Homo sapiens
agagacccaagcugcc

SEQ ID NO: 692003 - RNA, 19 nt, Homo sapiens
agagagccuggugcugcug

SEQ ID NO: 692004 - RNA, 19 nt, Homo sapiens
agagcaagacucugucuca

SEQ ID NO: 692005 - RNA, 23 nt, Homo sapiens
agagccaggggggugaggagcug

SEQ ID NO: 692006 - RNA, 19 nt, Homo sapiens
agaggaaaaguaaccauca

SEQ ID NO: 692007 - RNA, 19 nt, Homo sapiens
agaggcugaggcuggcaca

SEQ ID NO: 692008 - RNA, 15 nt, Homo sapiens
agaggcuuagagaca

SEQ ID NO: 692009 - RNA, 18 nt, Homo sapiens
agaguagaauugcauuga

SEQ ID NO: 692010 - RNA, 17 nt, Homo sapiens
agaucuguccucagccu

SEQ ID NO: 692011 - RNA, 19 nt, Homo sapiens
agaugauacauccaaagca

SEQ ID NO: 692012 - RNA, 14 nt, Homo sapiens
agauggauucucca

SEQ ID NO: 692013 - RNA, 13 nt, Homo sapiens
agauggugcugag

SEQ ID NO: 692014 - RNA, 15 nt, Homo sapiens
agcaacaagaccacc

SEQ ID NO: 692015 - RNA, 20 nt, Homo sapiens
agcacaaggccaucugggcu

SEQ ID NO: 692016 - RNA, 21 nt, Homo sapiens
agcaccguucugugcacaaaa

SEQ ID NO: 692017 - RNA, 20 nt, Homo sapiens
agcagacaggccccgugagg

SEQ ID NO: 692018 - RNA, 18 nt, Homo sapiens
agcaggaaccccaggaga

SEQ ID NO: 692019 - RNA, 14 nt, Homo sapiens
agcauguaccccag

SEQ ID NO: 692020 - RNA, 17 nt, Homo sapiens
agccacgaggugcaaca

SEQ ID NO: 692021 - RNA, 11 nt, Homo sapiens
agcccagagac

SEQ ID NO: 692022 - RNA, 17 nt, Homo sapiens
agccccuucugcucagc

SEQ ID NO: 692023 - RNA, 17 nt, Homo sapiens
agcccugggaucacugu

SEQ ID NO: 692024 - RNA, 18 nt, Homo sapiens
agccugagucaccugcag

SEQ ID NO: 692025 - RNA, 22 nt, Homo sapiens
agcgccuuucccaacucuagcu

SEQ ID NO: 692026 - RNA, 18 nt, Homo sapiens
agcuaaacggauuccaaa

SEQ ID NO: 692027 - RNA, 14 nt, Homo sapiens
agcuaagaaccugg

SEQ ID NO: 692028 - RNA, 14 nt, Homo sapiens
agcugaacaauagg

SEQ ID NO: 692029 - RNA, 18 nt, Homo sapiens
agcugaauuaucuauaca

SEQ ID NO: 692030 - RNA, 14 nt, Homo sapiens
agcuucucugugaa

SEQ ID NO: 692031 - RNA, 20 nt, Homo sapiens
agcuuuuagaaauacugcaa

SEQ ID NO: 692032 - RNA, 16 nt, Homo sapiens
aggaaccccaggagau

SEQ ID NO: 692033 - RNA, 16 nt, Homo sapiens
aggacucaaaguuuca

SEQ ID NO: 692034 - RNA, 23 nt, Homo sapiens
aggagacuuuacauggaugccaa

SEQ ID NO: 692035 - RNA, 23 nt, Homo sapiens
aggaggggucuggguacuucuug

SEQ ID NO: 692036 - RNA, 14 nt, Homo sapiens
aggcaaaauugcaa

SEQ ID NO: 692037 - RNA, 14 nt, Homo sapiens
aggcaacauccaaa

SEQ ID NO: 692038 - RNA, 15 nt, Homo sapiens
aggcaacauccaaaa

SEQ ID NO: 692039 - RNA, 13 nt, Homo sapiens
aggcaaugggagc

SEQ ID NO: 692040 - RNA, 12 nt, Homo sapiens
aggccugagauu

SEQ ID NO: 692041 - RNA, 16 nt, Homo sapiens
aggccugagauuucau

SEQ ID NO: 692042 - RNA, 23 nt, Homo sapiens
aggccugagauuucaucugcucu

SEQ ID NO: 692043 - RNA, 20 nt, Homo sapiens
aggcggguggaucacuugag

SEQ ID NO: 692044 - RNA, 19 nt, Homo sapiens
aggcugaccacagcacagc

SEQ ID NO: 692045 - RNA, 17 nt, Homo sapiens
aggcuggcacaggacau

SEQ ID NO: 692046 - RNA, 18 nt, Homo sapiens
aggcuggcuccagaugca

SEQ ID NO: 692047 - RNA, 20 nt, Homo sapiens
aggcuggcuccagaugcagg

SEQ ID NO: 692048 - RNA, 17 nt, Homo sapiens
agggacugaagccaaag

SEQ ID NO: 692049 - RNA, 12 nt, Homo sapiens
agggcagcagaa

SEQ ID NO: 692050 - RNA, 19 nt, Homo sapiens
agggcugucaucugugcac

SEQ ID NO: 692051 - RNA, 16 nt, Homo sapiens
aggggaaccccggggu

SEQ ID NO: 692052 - RNA, 19 nt, Homo sapiens
agguccucugucagucaca

SEQ ID NO: 692053 - RNA, 19 nt, Homo sapiens
aguaaucuaauauggccac

SEQ ID NO: 692054 - RNA, 21 nt, Homo sapiens
agugaggcugcacccacccag

SEQ ID NO: 692055 - RNA, 20 nt, Homo sapiens
agugcaguggugugaucuca

SEQ ID NO: 692056 - RNA, 16 nt, Homo sapiens
aguggaggcacuuuag

SEQ ID NO: 692057 - RNA, 19 nt, Homo sapiens
aguucuuugggccagacau

SEQ ID NO: 692058 - RNA, 19 nt, Homo sapiens
aguugaucuggaacccaga

SEQ ID NO: 692059 - RNA, 18 nt, Homo sapiens
auaaaucugacccagugc

SEQ ID NO: 692060 - RNA, 15 nt, Homo sapiens
auacugcuacuguaa

SEQ ID NO: 692061 - RNA, 20 nt, Homo sapiens
auaggacucaaaguuucaga

SEQ ID NO: 692062 - RNA, 14 nt, Homo sapiens
cugaaggggaaccc

SEQ ID NO: 692063 - RNA, 19 nt, Homo sapiens
cugaccagcagcgccuuuc

SEQ ID NO: 692064 - RNA, 17 nt, Homo sapiens
cugacccagugccccca

SEQ ID NO: 692065 - RNA, 22 nt, Homo sapiens
cugaggcaagagaauugcuuga

SEQ ID NO: 692066 - RNA, 22 nt, Homo sapiens
cugaggccacacucagcacaag

SEQ ID NO: 692067 - RNA, 20 nt, Homo sapiens
cugcaaagaucuguccucag

SEQ ID NO: 692068 - RNA, 13 nt, Homo sapiens
cugcacagugaag

SEQ ID NO: 692069 - RNA, 17 nt, Homo sapiens
cugcacccacccaggag

SEQ ID NO: 692070 - RNA, 15 nt, Homo sapiens
cugcacugaugcugc

SEQ ID NO: 692071 - RNA, 21 nt, Homo sapiens
cugcuacuggcaaaaggaucu

SEQ ID NO: 692072 - RNA, 15 nt, Homo sapiens
cugcuccagaccuga

SEQ ID NO: 692073 - RNA, 16 nt, Homo sapiens
cugcugcuccagugca

SEQ ID NO: 692074 - RNA, 17 nt, Homo sapiens
cuggaagcuaauuugca

SEQ ID NO: 692075 - RNA, 23 nt, Homo sapiens
cuggaggcccaguucacccugau

SEQ ID NO: 692076 - RNA, 12 nt, Homo sapiens
cuggcacugacu

SEQ ID NO: 692077 - RNA, 22 nt, Homo sapiens
cugggccauucuccacagcaac

SEQ ID NO: 692078 - RNA, 20 nt, Homo sapiens
cuggggccuacagcuuugau

SEQ ID NO: 692079 - RNA, 15 nt, Homo sapiens
cuggggccuccagaa

SEQ ID NO: 692080 - RNA, 21 nt, Homo sapiens
cugggguggggucaugcccuc

SEQ ID NO: 692081 - RNA, 19 nt, Homo sapiens
cugguauuuuaucuuugau

SEQ ID NO: 692082 - RNA, 21 nt, Homo sapiens
cuguaaucccagcacuuuggg

SEQ ID NO: 692083 - RNA, 17 nt, Homo sapiens
cugucaaggcugcuuag

SEQ ID NO: 692084 - RNA, 22 nt, Homo sapiens
cuguccucagccuugccagaga

SEQ ID NO: 692085 - RNA, 19 nt, Homo sapiens
cugugcacaaaacccagac

SEQ ID NO: 692086 - RNA, 14 nt, Homo sapiens
cuguguguccaaaa

SEQ ID NO: 692087 - RNA, 15 nt, Homo sapiens
cugugugugugaaug

SEQ ID NO: 692088 - RNA, 14 nt, Homo sapiens
cuguuccccagaga

SEQ ID NO: 692089 - RNA, 20 nt, Homo sapiens
cuguucucuugggaacugaa

SEQ ID NO: 692090 - RNA, 19 nt, Homo sapiens
cuguuuccauagggugaca

SEQ ID NO: 692091 - RNA, 23 nt, Homo sapiens
cuuauggaauugauuugcauuga

SEQ ID NO: 692092 - RNA, 14 nt, Homo sapiens
cuuauugcuguuuc

SEQ ID NO: 692093 - RNA, 16 nt, Homo sapiens
cuuccaguguccuuag

SEQ ID NO: 692094 - RNA, 15 nt, Homo sapiens
cuucugcucagcucu

SEQ ID NO: 692095 - RNA, 22 nt, Homo sapiens
cuugaagaaccucucacuucac

SEQ ID NO: 692096 - RNA, 15 nt, Homo sapiens
cuugacaacaucuga

SEQ ID NO: 692097 - RNA, 13 nt, Homo sapiens
cuuggacuugucc

SEQ ID NO: 692098 - RNA, 15 nt, Homo sapiens
cuuuaaugcuuuuau

SEQ ID NO: 692099 - RNA, 20 nt, Homo sapiens
ugggaaaguauucuguacuc

SEQ ID NO: 692100 - RNA, 15 nt, Homo sapiens
ugggacguggcucag

SEQ ID NO: 692101 - RNA, 14 nt, Homo sapiens
ugggccugcuccag

SEQ ID NO: 692102 - RNA, 18 nt, Homo sapiens
ugggcuccuccagggugu

SEQ ID NO: 692103 - RNA, 14 nt, Homo sapiens
ugggcuugauucug

SEQ ID NO: 692104 - RNA, 18 nt, Homo sapiens
uggggccuccagaacuca

SEQ ID NO: 692105 - RNA, 13 nt, Homo sapiens
uggggucaugccc

SEQ ID NO: 692106 - RNA, 22 nt, Homo sapiens
uggugccccaggaccagcucag

SEQ ID NO: 692107 - RNA, 15 nt, Homo sapiens
ugguucucaucuuuc

SEQ ID NO: 692108 - RNA, 19 nt, Homo sapiens
uguaaucccagcacuuugg

SEQ ID NO: 692109 - RNA, 23 nt, Homo sapiens
uguacaucuauuuuggauuguau

SEQ ID NO: 692110 - RNA, 20 nt, Homo sapiens
uguauggagagaaaacagac

SEQ ID NO: 692111 - RNA, 15 nt, Homo sapiens
ugucaucugugcacu

SEQ ID NO: 692112 - RNA, 21 nt, Homo sapiens
ugucucggagggauuccccua

SEQ ID NO: 692113 - RNA, 18 nt, Homo sapiens
ugucuucauagcagauuu

SEQ ID NO: 692114 - RNA, 18 nt, Homo sapiens
ugugauagcacuuucuac

SEQ ID NO: 692115 - RNA, 12 nt, Homo sapiens
ugugcccgggga

SEQ ID NO: 692116 - RNA, 15 nt, Homo sapiens
uguuaucagucaaua

SEQ ID NO: 692117 - RNA, 15 nt, Homo sapiens
uguucugaacugugg

SEQ ID NO: 692118 - RNA, 13 nt, Homo sapiens
uguuuuuaagcug

SEQ ID NO: 692119 - RNA, 13 nt, Homo sapiens
uuaaaacagaagc

SEQ ID NO: 692120 - RNA, 11 nt, Homo sapiens
uuaaacucugu

SEQ ID NO: 692121 - RNA, 16 nt, Homo sapiens
aucuacuaauuccaca

SEQ ID NO: 692122 - RNA, 15 nt, Homo sapiens
aucucugcuugaguc

SEQ ID NO: 692123 - RNA, 23 nt, Homo sapiens
aucugugcacugcccauggacag

SEQ ID NO: 692124 - RNA, 20 nt, Homo sapiens
aucuguuuugaaggcaaaau

SEQ ID NO: 692125 - RNA, 20 nt, Homo sapiens
aucuuaucauggucucaguc

SEQ ID NO: 692126 - RNA, 13 nt, Homo sapiens
augauacauccaa

SEQ ID NO: 692127 - RNA, 14 nt, Homo sapiens
augauggaugccaa

SEQ ID NO: 692128 - RNA, 15 nt, Homo sapiens
augcaagggacugug

SEQ ID NO: 692129 - RNA, 16 nt, Homo sapiens
augcauggugccccag

SEQ ID NO: 692130 - RNA, 18 nt, Homo sapiens
augccaaccggucaccca

SEQ ID NO: 692131 - RNA, 23 nt, Homo sapiens
augccucagcccugacccugugg

SEQ ID NO: 692132 - RNA, 14 nt, Homo sapiens
augcugacauucac

SEQ ID NO: 692133 - RNA, 14 nt, Homo sapiens
auggaacacggcca

SEQ ID NO: 692134 - RNA, 17 nt, Homo sapiens
auggaugggggaacuca

SEQ ID NO: 692135 - RNA, 18 nt, Homo sapiens
auggaugggggaacucag

SEQ ID NO: 692136 - RNA, 23 nt, Homo sapiens
auggcaacagaucuggaaccuca

SEQ ID NO: 692137 - RNA, 16 nt, Homo sapiens
auggugccccaggacc

SEQ ID NO: 692138 - RNA, 22 nt, Homo sapiens
auguggcaaggaaaaacagguc

SEQ ID NO: 692139 - RNA, 17 nt, Homo sapiens
auuaaauucacaaacuu

SEQ ID NO: 692140 - RNA, 17 nt, Homo sapiens
auuccagaaugcuguac

SEQ ID NO: 692141 - RNA, 19 nt, Homo sapiens
auuccagaaugcuguacau

SEQ ID NO: 692142 - RNA, 23 nt, Homo sapiens
auucugcaguaaaucuuuuacaa

SEQ ID NO: 692143 - RNA, 17 nt, Homo sapiens
auuggcucacacugaga

SEQ ID NO: 692144 - RNA, 14 nt, Homo sapiens
auuuauuaccucug

SEQ ID NO: 692145 - RNA, 17 nt, Homo sapiens
auuuauuaccucugaua

SEQ ID NO: 692146 - RNA, 12 nt, Homo sapiens
auuucagacucc

SEQ ID NO: 692147 - RNA, 14 nt, Homo sapiens
auuuccagucucca

SEQ ID NO: 692148 - RNA, 15 nt, Homo sapiens
caaaaaugcacccaa

SEQ ID NO: 692149 - RNA, 14 nt, Homo sapiens
caaaacuacaugag

SEQ ID NO: 692150 - RNA, 12 nt, Homo sapiens
caaaacugccuc

SEQ ID NO: 692151 - RNA, 19 nt, Homo sapiens
caaaauugcaaaucuugaa

SEQ ID NO: 692152 - RNA, 23 nt, Homo sapiens
caaacuggggccuccagaacuca

SEQ ID NO: 692153 - RNA, 11 nt, Homo sapiens
caaagugcugg

SEQ ID NO: 692154 - RNA, 18 nt, Homo sapiens
caaauaaugucucuguga

SEQ ID NO: 692155 - RNA, 14 nt, Homo sapiens
caaaugagccauga

SEQ ID NO: 692156 - RNA, 16 nt, Homo sapiens
caaaugagccaugaga

SEQ ID NO: 692157 - RNA, 19 nt, Homo sapiens
caaauggacauaggacuca

SEQ ID NO: 692158 - RNA, 13 nt, Homo sapiens
caaauggggccag

SEQ ID NO: 692159 - RNA, 17 nt, Homo sapiens
caaauggggccagaucc

SEQ ID NO: 692160 - RNA, 21 nt, Homo sapiens
caaauuugauugauuugaaga

SEQ ID NO: 692161 - RNA, 14 nt, Homo sapiens
caacacugcugcuc

SEQ ID NO: 692162 - RNA, 11 nt, Homo sapiens
caaccaaaauc

SEQ ID NO: 692163 - RNA, 14 nt, Homo sapiens
caacccuucccuca

SEQ ID NO: 692164 - RNA, 20 nt, Homo sapiens
caagcaggaaccccaggaga

SEQ ID NO: 692165 - RNA, 17 nt, Homo sapiens
caagcccuguugacaca

SEQ ID NO: 692166 - RNA, 12 nt, Homo sapiens
caagcugccucc

SEQ ID NO: 692167 - RNA, 20 nt, Homo sapiens
caaggaaaaacaggucuuca

SEQ ID NO: 692168 - RNA, 14 nt, Homo sapiens
caaguucaauccua

SEQ ID NO: 692169 - RNA, 13 nt, Homo sapiens
caaugggagcuga

SEQ ID NO: 692170 - RNA, 14 nt, Homo sapiens
cacaggccugagau

SEQ ID NO: 692171 - RNA, 23 nt, Homo sapiens
cacaguucuuugggccagacaug

SEQ ID NO: 692172 - RNA, 14 nt, Homo sapiens
cacccacccaggag

SEQ ID NO: 692173 - RNA, 16 nt, Homo sapiens
caccuuggcaccagac

SEQ ID NO: 692174 - RNA, 20 nt, Homo sapiens
cacgugggcaaacaggcagu

SEQ ID NO: 692175 - RNA, 20 nt, Homo sapiens
cacucuuuugcuuuauucca

SEQ ID NO: 692176 - RNA, 19 nt, Homo sapiens
cagaaacaguucaccuuga

SEQ ID NO: 692177 - RNA, 14 nt, Homo sapiens
cagaagaacugugu

SEQ ID NO: 692178 - RNA, 16 nt, Homo sapiens
cagaccacggcucgau

SEQ ID NO: 692179 - RNA, 16 nt, Homo sapiens
cagagaccauugcaau

SEQ ID NO: 692180 - RNA, 18 nt, Homo sapiens
cagagacccaagcugccu

SEQ ID NO: 692181 - RNA, 15 nt, Homo sapiens
cagaugcagggcagu

SEQ ID NO: 692182 - RNA, 18 nt, Homo sapiens
cagauuggcucacacuga

SEQ ID NO: 692183 - RNA, 20 nt, Homo sapiens
cagauuggcucacacugaga

SEQ ID NO: 692184 - RNA, 14 nt, Homo sapiens
cagcacaaggccau

SEQ ID NO: 692185 - RNA, 11 nt, Homo sapiens
cagcacugagg

SEQ ID NO: 692186 - RNA, 18 nt, Homo sapiens
cagccucccauccagggc

SEQ ID NO: 692187 - RNA, 21 nt, Homo sapiens
cagccuggucaacauggugaa

SEQ ID NO: 692188 - RNA, 21 nt, Homo sapiens
cagcgccaggcugaccacagc

SEQ ID NO: 692189 - RNA, 14 nt, Homo sapiens
cagcucugggccau

SEQ ID NO: 692190 - RNA, 16 nt, Homo sapiens
cagcugguaaucuugc

SEQ ID NO: 692191 - RNA, 15 nt, Homo sapiens
caggaaccacaccac

SEQ ID NO: 692192 - RNA, 17 nt, Homo sapiens
caggaccagcucaggac

SEQ ID NO: 692193 - RNA, 19 nt, Homo sapiens
caggacuauauuugggccu

SEQ ID NO: 692194 - RNA, 17 nt, Homo sapiens
caggagaccuggcacug

SEQ ID NO: 692195 - RNA, 18 nt, Homo sapiens
caggagaccuggcacugg

SEQ ID NO: 692196 - RNA, 19 nt, Homo sapiens
caggagaccuggcacugga

SEQ ID NO: 692197 - RNA, 22 nt, Homo sapiens
caggagaccuggcacuggaugc

SEQ ID NO: 692198 - RNA, 21 nt, Homo sapiens
caggagacuuuacauggaugc

SEQ ID NO: 692199 - RNA, 13 nt, Homo sapiens
caggcaccugcca

SEQ ID NO: 692200 - RNA, 17 nt, Homo sapiens
caggcuggagugcagug

SEQ ID NO: 692201 - RNA, 15 nt, Homo sapiens
cagggugcaguauca

SEQ ID NO: 692202 - RNA, 20 nt, Homo sapiens
caggucuuuccuaaggcugc

SEQ ID NO: 692203 - RNA, 12 nt, Homo sapiens
cagucacagcca

SEQ ID NO: 692204 - RNA, 22 nt, Homo sapiens
cagucagauuuccagucuccac

SEQ ID NO: 692205 - RNA, 16 nt, Homo sapiens
caguucaccuugaaga

SEQ ID NO: 692206 - RNA, 18 nt, Homo sapiens
caguucuuugggccagac

SEQ ID NO: 692207 - RNA, 22 nt, Homo sapiens
caguugggugagaacaaccaaa

SEQ ID NO: 692208 - RNA, 13 nt, Homo sapiens
cauacaccagcau

SEQ ID NO: 692209 - RNA, 14 nt, Homo sapiens
cauagcaugacauu

SEQ ID NO: 692210 - RNA, 14 nt, Homo sapiens
caucacugguugca

SEQ ID NO: 692211 - RNA, 22 nt, Homo sapiens
caucgaaucuacuaauuccaca

SEQ ID NO: 692212 - RNA, 14 nt, Homo sapiens
caucucagugcagg

SEQ ID NO: 692213 - RNA, 23 nt, Homo sapiens
caucugagugcagccguuugaga

SEQ ID NO: 692214 - RNA, 15 nt, Homo sapiens
caucuggaaucugga

SEQ ID NO: 692215 - RNA, 21 nt, Homo sapiens
caucugugcacugcccaugga

SEQ ID NO: 692216 - RNA, 22 nt, Homo sapiens
caucuuuacaaaacuacaugag

SEQ ID NO: 692217 - RNA, 22 nt, Homo sapiens
caugaacugcggcagcaguuug

SEQ ID NO: 692218 - RNA, 21 nt, Homo sapiens
ccaacuagcucuauguuuaca

SEQ ID NO: 692219 - RNA, 22 nt, Homo sapiens
ccaacuagcucuauguuuacaa

SEQ ID NO: 692220 - RNA, 20 nt, Homo sapiens
ccaaggggaaucagaacuca

SEQ ID NO: 692221 - RNA, 15 nt, Homo sapiens
ccaauuucagacucc

SEQ ID NO: 692222 - RNA, 14 nt, Homo sapiens
ccacacucagcaca

SEQ ID NO: 692223 - RNA, 23 nt, Homo sapiens
ccacaggccgcccugcgggugaa

SEQ ID NO: 692224 - RNA, 21 nt, Homo sapiens
ccacaggccugagauuucauc

SEQ ID NO: 692225 - RNA, 21 nt, Homo sapiens
ccacgugggcaaacaggcagu

SEQ ID NO: 692226 - RNA, 18 nt, Homo sapiens
ccagauguuuccagacuu

SEQ ID NO: 692227 - RNA, 13 nt, Homo sapiens
ccagcccagagac

SEQ ID NO: 692228 - RNA, 23 nt, Homo sapiens
ccagcucaggacagaugccacac

SEQ ID NO: 692229 - RNA, 19 nt, Homo sapiens
ccagcuccaaccugcaaag

SEQ ID NO: 692230 - RNA, 21 nt, Homo sapiens
ccagcuccaaccugcaaagau

SEQ ID NO: 692231 - RNA, 13 nt, Homo sapiens
ccagcugcacuga

SEQ ID NO: 692232 - RNA, 19 nt, Homo sapiens
ccaggcugaccacagcaca

SEQ ID NO: 692233 - RNA, 16 nt, Homo sapiens
ccauaguaccauuuau

SEQ ID NO: 692234 - RNA, 16 nt, Homo sapiens
ccauccccaggcaccu

SEQ ID NO: 692235 - RNA, 13 nt, Homo sapiens
ccauugcaaugaa

SEQ ID NO: 692236 - RNA, 21 nt, Homo sapiens
cccagcaggugcugacuucau

SEQ ID NO: 692237 - RNA, 14 nt, Homo sapiens
cccaggacccugaa

SEQ ID NO: 692238 - RNA, 13 nt, Homo sapiens
cccaggacugggc

SEQ ID NO: 692239 - RNA, 14 nt, Homo sapiens
ccccagcccagaga

SEQ ID NO: 692240 - RNA, 19 nt, Homo sapiens
ccccagcccagagacauac

SEQ ID NO: 692241 - RNA, 13 nt, Homo sapiens
ccccaugcacugu

SEQ ID NO: 692242 - RNA, 16 nt, Homo sapiens
cccccacugaccagaa

SEQ ID NO: 692243 - RNA, 14 nt, Homo sapiens
cccccagcuaagaa

SEQ ID NO: 692244 - RNA, 17 nt, Homo sapiens
cccucauucuacugaaa

SEQ ID NO: 692245 - RNA, 20 nt, Homo sapiens
cccucccuguuccccagaga

SEQ ID NO: 692246 - RNA, 14 nt, Homo sapiens
cccucuucauggau

SEQ ID NO: 692247 - RNA, 22 nt, Homo sapiens
cccugaccugugagcccagcug

SEQ ID NO: 692248 - RNA, 21 nt, Homo sapiens
cccugcgggugaacaaagcag

SEQ ID NO: 692249 - RNA, 16 nt, Homo sapiens
cccuggccgaguccaa

SEQ ID NO: 692250 - RNA, 13 nt, Homo sapiens
cccuucacaaagc

SEQ ID NO: 692251 - RNA, 15 nt, Homo sapiens
cccuucugcucagcu

SEQ ID NO: 692252 - RNA, 22 nt, Homo sapiens
ccggauauauacauagcaugac

SEQ ID NO: 692253 - RNA, 18 nt, Homo sapiens
ccgugaggcaaugggagc

SEQ ID NO: 692254 - RNA, 18 nt, Homo sapiens
ccguucugugcacaaaac

SEQ ID NO: 692255 - RNA, 15 nt, Homo sapiens
ccuaaccucauuccc

SEQ ID NO: 692256 - RNA, 20 nt, Homo sapiens
ccuaauccaggcagauccag

SEQ ID NO: 692257 - RNA, 23 nt, Homo sapiens
ccuagcagcaccguucugugcac

SEQ ID NO: 692258 - RNA, 15 nt, Homo sapiens
ccucagccuugccag

SEQ ID NO: 692259 - RNA, 15 nt, Homo sapiens
ccucauucuacugaa

SEQ ID NO: 692260 - RNA, 13 nt, Homo sapiens
ccuccagaacuca

SEQ ID NO: 692261 - RNA, 21 nt, Homo sapiens
ccuccagggcuggacugaggc

SEQ ID NO: 692262 - RNA, 16 nt, Homo sapiens
ccucccccccaugcac

SEQ ID NO: 692263 - RNA, 15 nt, Homo sapiens
ccucccugcaucuga

SEQ ID NO: 692264 - RNA, 22 nt, Homo sapiens
ccucuuggccugaucagaccac

SEQ ID NO: 692265 - RNA, 14 nt, Homo sapiens
ccugaagaaccagu

SEQ ID NO: 692266 - RNA, 12 nt, Homo sapiens
ccugacccugua

SEQ ID NO: 692267 - RNA, 20 nt, Homo sapiens
ccugacguagcugcaaagga

SEQ ID NO: 692268 - RNA, 17 nt, Homo sapiens
ccugcaccccugcaguu

SEQ ID NO: 692269 - RNA, 21 nt, Homo sapiens
ccugcaccccugcaguuugag

SEQ ID NO: 692270 - RNA, 20 nt, Homo sapiens
ccuggcacuggaugcagaaa

SEQ ID NO: 692271 - RNA, 13 nt, Homo sapiens
ccuggugcugcug

SEQ ID NO: 692272 - RNA, 23 nt, Homo sapiens
ccuguauaaguggaggcacuuua

SEQ ID NO: 692273 - RNA, 17 nt, Homo sapiens
ccuguccuccaacacca

SEQ ID NO: 692274 - RNA, 23 nt, Homo sapiens
ccuguuccccagagaaaggggag

SEQ ID NO: 692275 - RNA, 14 nt, Homo sapiens
ccuuauuguaccuc

SEQ ID NO: 692276 - RNA, 16 nt, Homo sapiens
ccuucagacacccuca

SEQ ID NO: 692277 - RNA, 21 nt, Homo sapiens
ccuucgggcugugcccgggga

SEQ ID NO: 692278 - RNA, 17 nt, Homo sapiens
ccuuggcaccagacacc

SEQ ID NO: 692279 - RNA, 21 nt, Homo sapiens
cgaaaccugggauucaggaau

SEQ ID NO: 692280 - RNA, 17 nt, Homo sapiens
cggaacugcaugcugcu

SEQ ID NO: 692281 - RNA, 17 nt, Homo sapiens
cgggcugugcccgggga

SEQ ID NO: 692282 - RNA, 18 nt, Homo sapiens
cgugggcaaacaggcagu

SEQ ID NO: 692283 - RNA, 16 nt, Homo sapiens
cuaaacaaugcugauu

SEQ ID NO: 692284 - RNA, 16 nt, Homo sapiens
cuaaacucauuuauaa

SEQ ID NO: 692285 - RNA, 21 nt, Homo sapiens
cuaaacucauuuauaaagcua

SEQ ID NO: 692286 - RNA, 23 nt, Homo sapiens
cuaaggggcccggccagccaugu

SEQ ID NO: 692287 - RNA, 20 nt, Homo sapiens
cuacuugggaggcugaggca

SEQ ID NO: 692288 - RNA, 11 nt, Homo sapiens
cuagaguagag

SEQ ID NO: 692289 - RNA, 15 nt, Homo sapiens
cuagauggcuccucu

SEQ ID NO: 692290 - RNA, 14 nt, Homo sapiens
cuagucaagcuccu

SEQ ID NO: 692291 - RNA, 18 nt, Homo sapiens
cuauaaggccauaaaaca

SEQ ID NO: 692292 - RNA, 11 nt, Homo sapiens
cuauuuccauu

SEQ ID NO: 692293 - RNA, 20 nt, Homo sapiens
cucaaauggggccagaucca

SEQ ID NO: 692294 - RNA, 18 nt, Homo sapiens
cucacaggccccaggaaa

SEQ ID NO: 692295 - RNA, 22 nt, Homo sapiens
cucagaggcgcacugugacccc

SEQ ID NO: 692296 - RNA, 21 nt, Homo sapiens
cucagcagcugguaaucuugc

SEQ ID NO: 692297 - RNA, 15 nt, Homo sapiens
cucaggaucucuuag

SEQ ID NO: 692298 - RNA, 11 nt, Homo sapiens
cucagugcagg

SEQ ID NO: 692299 - RNA, 16 nt, Homo sapiens
cucaucucuuagcucc

SEQ ID NO: 692300 - RNA, 13 nt, Homo sapiens
cuccaacaccaag

SEQ ID NO: 692301 - RNA, 17 nt, Homo sapiens
cuccagaccugauccug

SEQ ID NO: 692302 - RNA, 16 nt, Homo sapiens
cuccccagcccagaga

SEQ ID NO: 692303 - RNA, 21 nt, Homo sapiens
cuccucaucucuaacagcuca

SEQ ID NO: 692304 - RNA, 23 nt, Homo sapiens
cuccugaggcuuuggauuugaca

SEQ ID NO: 692305 - RNA, 15 nt, Homo sapiens
cucgaaacacagaaa

SEQ ID NO: 692306 - RNA, 21 nt, Homo sapiens
cucuaacagcucaggaucucu

SEQ ID NO: 692307 - RNA, 23 nt, Homo sapiens
cucuagcugggggugggccaggc

SEQ ID NO: 692308 - RNA, 20 nt, Homo sapiens
cucuuuccuccuuccaugga

SEQ ID NO: 692309 - RNA, 16 nt, Homo sapiens
cugaaacaacuuggaa

SEQ ID NO: 692310 - RNA, 13 nt, Homo sapiens
cugaagcagguuc

SEQ ID NO: 692311 - RNA, 17 nt, Homo sapiens
cugaccacagcacagcc

SEQ ID NO: 692312 - RNA, 19 nt, Homo sapiens
cugaccacagcacagccaa

SEQ ID NO: 692313 - RNA, 19 nt, Homo sapiens
cugaccucaggugauccac

SEQ ID NO: 692314 - RNA, 22 nt, Homo sapiens
cuucagcccucaccccugguuc

SEQ ID NO: 692315 - RNA, 22 nt, Homo sapiens
cuucaucgaaucuacuaauucc

SEQ ID NO: 692316 - RNA, 16 nt, Homo sapiens
cuuccccaucuucuaa

SEQ ID NO: 692317 - RNA, 22 nt, Homo sapiens
cuuccuguguguccaaaacugc

SEQ ID NO: 692318 - RNA, 19 nt, Homo sapiens
cuucuaaacccaauccaaa

SEQ ID NO: 692319 - RNA, 21 nt, Homo sapiens
cuucuaaacccaauccaaaug

SEQ ID NO: 692320 - RNA, 18 nt, Homo sapiens
cuucuaggguuauugcau

SEQ ID NO: 692321 - RNA, 12 nt, Homo sapiens
cuucugcuacug

SEQ ID NO: 692322 - RNA, 18 nt, Homo sapiens
cuugaagggccagagcca

SEQ ID NO: 692323 - RNA, 16 nt, Homo sapiens
cuugaaggugcugacg

SEQ ID NO: 692324 - RNA, 16 nt, Homo sapiens
cuugaauguggcuuga

SEQ ID NO: 692325 - RNA, 14 nt, Homo sapiens
cuugacaacaucug

SEQ ID NO: 692326 - RNA, 23 nt, Homo sapiens
cuugaucaacaucuuuucuugcc

SEQ ID NO: 692327 - RNA, 21 nt, Homo sapiens
cuuggcaccagacacccagga

SEQ ID NO: 692328 - RNA, 17 nt, Homo sapiens
cuuuccuaaggcugcaa

SEQ ID NO: 692329 - RNA, 18 nt, Homo sapiens
cuuuuacaacugccucga

SEQ ID NO: 692330 - RNA, 21 nt, Homo sapiens
cuuuuauguaguaauugacau

SEQ ID NO: 692331 - RNA, 14 nt, Homo sapiens
gaaaacagaccuaa

SEQ ID NO: 692332 - RNA, 16 nt, Homo sapiens
gaaaacaucuauucuc

SEQ ID NO: 692333 - RNA, 22 nt, Homo sapiens
gaaaaugcagcagggaugcccu

SEQ ID NO: 692334 - RNA, 22 nt, Homo sapiens
gaaagcuguggccagcuuguua

SEQ ID NO: 692335 - RNA, 17 nt, Homo sapiens
gaaaguauucuguacuc

SEQ ID NO: 692336 - RNA, 19 nt, Homo sapiens
gaaauaaaggaugugauug

SEQ ID NO: 692337 - RNA, 19 nt, Homo sapiens
gaacacccucuaaauggga

SEQ ID NO: 692338 - RNA, 17 nt, Homo sapiens
gaacauccaaccuuccc

SEQ ID NO: 692339 - RNA, 19 nt, Homo sapiens
gaacauuuuaauucauccc

SEQ ID NO: 692340 - RNA, 14 nt, Homo sapiens
gaaccccaggagau

SEQ ID NO: 692341 - RNA, 15 nt, Homo sapiens
gaacucuagccaaau

SEQ ID NO: 692342 - RNA, 20 nt, Homo sapiens
gaagaacggggcucuucuca

SEQ ID NO: 692343 - RNA, 12 nt, Homo sapiens
gaaggcaaaauu

SEQ ID NO: 692344 - RNA, 23 nt, Homo sapiens
gaauguguggccugcacagugaa

SEQ ID NO: 692345 - RNA, 17 nt, Homo sapiens
gaauuuauucaauuccu

SEQ ID NO: 692346 - RNA, 17 nt, Homo sapiens
gacacaggucuuuccua

SEQ ID NO: 692347 - RNA, 14 nt, Homo sapiens
gacagccugaguca

SEQ ID NO: 692348 - RNA, 15 nt, Homo sapiens
gacagugaggcugca

SEQ ID NO: 692349 - RNA, 21 nt, Homo sapiens
gacauaggacucaaaguuuca

SEQ ID NO: 692350 - RNA, 19 nt, Homo sapiens
gacauuggcaccuaaucca

SEQ ID NO: 692351 - RNA, 15 nt, Homo sapiens
gaccugauccuggag

SEQ ID NO: 692352 - RNA, 14 nt, Homo sapiens
gacuaauuucaaaa

SEQ ID NO: 692353 - RNA, 20 nt, Homo sapiens
gagaaaccuuauuguaccuc

SEQ ID NO: 692354 - RNA, 20 nt, Homo sapiens
gagaagccacaggccugaga

SEQ ID NO: 692355 - RNA, 17 nt, Homo sapiens
gagacccaagcugccuc

SEQ ID NO: 692356 - RNA, 22 nt, Homo sapiens
gagagaaaacagaccuaaugcu

SEQ ID NO: 692357 - RNA, 22 nt, Homo sapiens
gagaggcccucuggaguggcca

SEQ ID NO: 692358 - RNA, 15 nt, Homo sapiens
gagcccauccagucu

SEQ ID NO: 692359 - RNA, 13 nt, Homo sapiens
gagcgcuccugcc

SEQ ID NO: 692360 - RNA, 20 nt, Homo sapiens
gagcuguuuucccugaccuc

SEQ ID NO: 692361 - RNA, 18 nt, Homo sapiens
gaggcugaggcgggugga

SEQ ID NO: 692362 - RNA, 16 nt, Homo sapiens
gaggugcaacaagguc

SEQ ID NO: 692363 - RNA, 14 nt, Homo sapiens
gaguagaauugcau

SEQ ID NO: 692364 - RNA, 17 nt, Homo sapiens
gauaacuagauggugcu

SEQ ID NO: 692365 - RNA, 21 nt, Homo sapiens
gauaccucaacccccauuucu

SEQ ID NO: 692366 - RNA, 15 nt, Homo sapiens
gauaucaugccccug

SEQ ID NO: 692367 - RNA, 20 nt, Homo sapiens
gauccaagcagccugagcaa

SEQ ID NO: 692368 - RNA, 19 nt, Homo sapiens
gaucuggaacccagacuca

SEQ ID NO: 692369 - RNA, 16 nt, Homo sapiens
gaugauggaugccaau

SEQ ID NO: 692370 - RNA, 18 nt, Homo sapiens
gauggaaguugcagugag

SEQ ID NO: 692371 - RNA, 16 nt, Homo sapiens
gauuacaggcaccugc

SEQ ID NO: 692372 - RNA, 12 nt, Homo sapiens
gauucuccuuca

SEQ ID NO: 692373 - RNA, 12 nt, Homo sapiens
gauugggguccc

SEQ ID NO: 692374 - RNA, 13 nt, Homo sapiens
gauuuccuugaau

SEQ ID NO: 692375 - RNA, 23 nt, Homo sapiens
gauuuccuugaauguggcuugag

SEQ ID NO: 692376 - RNA, 14 nt, Homo sapiens
gauuucuccaggau

SEQ ID NO: 692377 - RNA, 19 nt, Homo sapiens
gauuugaagaacaugugag

SEQ ID NO: 692378 - RNA, 13 nt, Homo sapiens
gauuuggugacca

SEQ ID NO: 692379 - RNA, 19 nt, Homo sapiens
gauuuuugacucuggcaaa

SEQ ID NO: 692380 - RNA, 19 nt, Homo sapiens
gcaaaacaaaaauuaggua

SEQ ID NO: 692381 - RNA, 21 nt, Homo sapiens
gcaaaaggaucuuuguggcca

SEQ ID NO: 692382 - RNA, 14 nt, Homo sapiens
gcaaccacuaagaa

SEQ ID NO: 692383 - RNA, 23 nt, Homo sapiens
gcacaggacaugcgguagccagc

SEQ ID NO: 692384 - RNA, 15 nt, Homo sapiens
gcaccuaauccaggc

SEQ ID NO: 692385 - RNA, 21 nt, Homo sapiens
gcaccuaauccaggcagaucc

SEQ ID NO: 692386 - RNA, 21 nt, Homo sapiens
gcaccucacaggccccaggaa

SEQ ID NO: 692387 - RNA, 19 nt, Homo sapiens
gcagcaccguucugugcac

SEQ ID NO: 692388 - RNA, 19 nt, Homo sapiens
gcagccacgaggugcaaca

SEQ ID NO: 692389 - RNA, 19 nt, Homo sapiens
gcagccugagcaacucuug

SEQ ID NO: 692390 - RNA, 15 nt, Homo sapiens
gcauauguugaauac

SEQ ID NO: 692391 - RNA, 15 nt, Homo sapiens
gcaucucagugcagg

SEQ ID NO: 692392 - RNA, 18 nt, Homo sapiens
gccaaccggucacccagg

SEQ ID NO: 692393 - RNA, 16 nt, Homo sapiens
gccaaggagcugcuau

SEQ ID NO: 692394 - RNA, 16 nt, Homo sapiens
gccacgaggugcaaca

SEQ ID NO: 692395 - RNA, 15 nt, Homo sapiens
gccagcugcacugau

SEQ ID NO: 692396 - RNA, 16 nt, Homo sapiens
gccaugagaugauaca

SEQ ID NO: 692397 - RNA, 19 nt, Homo sapiens
gcccacuguccugggccug

SEQ ID NO: 692398 - RNA, 14 nt, Homo sapiens
gcccagagcccagc

SEQ ID NO: 692399 - RNA, 19 nt, Homo sapiens
gcccaggcuggagugcagu

SEQ ID NO: 692400 - RNA, 23 nt, Homo sapiens
gccguuugagaagaaaacaucua

SEQ ID NO: 692401 - RNA, 20 nt, Homo sapiens
gccuaaaagugggcuugauu

SEQ ID NO: 692402 - RNA, 16 nt, Homo sapiens
gccucccauccagggc

SEQ ID NO: 692403 - RNA, 14 nt, Homo sapiens
gccucugugccuuc

SEQ ID NO: 692404 - RNA, 20 nt, Homo sapiens
gccugagcaacucuugauua

SEQ ID NO: 692405 - RNA, 14 nt, Homo sapiens
gccugaugcugaca

SEQ ID NO: 692406 - RNA, 23 nt, Homo sapiens
gccugggguggggucaugcccuc

SEQ ID NO: 692407 - RNA, 18 nt, Homo sapiens
gccuugccagagauccaa

SEQ ID NO: 692408 - RNA, 21 nt, Homo sapiens
gcgguagccagcacacagggc

SEQ ID NO: 692409 - RNA, 21 nt, Homo sapiens
gcucccucuauuuauguuugc

SEQ ID NO: 692410 - RNA, 22 nt, Homo sapiens
ggagccccuucugcucagcucu

SEQ ID NO: 692411 - RNA, 21 nt, Homo sapiens
ggaugccaaccggucacccag

SEQ ID NO: 692412 - RNA, 22 nt, Homo sapiens
ggaugccaaccggucacccagg

SEQ ID NO: 692413 - RNA, 12 nt, Homo sapiens
ggcaaacaggca

SEQ ID NO: 692414 - RNA, 22 nt, Homo sapiens
ggcaaagagagucgcaucucag

SEQ ID NO: 692415 - RNA, 13 nt, Homo sapiens
ggcagggugcagu

SEQ ID NO: 692416 - RNA, 23 nt, Homo sapiens
ggccaugauggcaacagaucugg

SEQ ID NO: 692417 - RNA, 13 nt, Homo sapiens
ggccaugccucag

SEQ ID NO: 692418 - RNA, 11 nt, Homo sapiens
ggccuccagaa

SEQ ID NO: 692419 - RNA, 18 nt, Homo sapiens
ggccugcuccagaccuga

SEQ ID NO: 692420 - RNA, 12 nt, Homo sapiens
ggcucuucucau

SEQ ID NO: 692421 - RNA, 15 nt, Homo sapiens
ggcucuucucauuuc

SEQ ID NO: 692422 - RNA, 16 nt, Homo sapiens
ggcucuucucauuuca

SEQ ID NO: 692423 - RNA, 17 nt, Homo sapiens
ggcugcacccacccagg

SEQ ID NO: 692424 - RNA, 11 nt, Homo sapiens
ggcuggcacug

SEQ ID NO: 692425 - RNA, 17 nt, Homo sapiens
gggaacucagauccagg

SEQ ID NO: 692426 - RNA, 21 nt, Homo sapiens
gggagauucaagggacccaug

SEQ ID NO: 692427 - RNA, 21 nt, Homo sapiens
gggccagagccagggggguga

SEQ ID NO: 692428 - RNA, 16 nt, Homo sapiens
gggccugcuccagacc

SEQ ID NO: 692429 - RNA, 12 nt, Homo sapiens
gggcgcgguggc

SEQ ID NO: 692430 - RNA, 13 nt, Homo sapiens
ggggcucuucuca

SEQ ID NO: 692431 - RNA, 22 nt, Homo sapiens
gguagccagcacacagggcagu

SEQ ID NO: 692432 - RNA, 17 nt, Homo sapiens
gguauccugggggaccc

SEQ ID NO: 692433 - RNA, 18 nt, Homo sapiens
ggucaggcagggugcagu

SEQ ID NO: 692434 - RNA, 21 nt, Homo sapiens
ggucuuuccuaaggcugcaag

SEQ ID NO: 692435 - RNA, 14 nt, Homo sapiens
ggugacagagcaag

SEQ ID NO: 692436 - RNA, 15 nt, Homo sapiens
gguggcgcgcaccug

SEQ ID NO: 692437 - RNA, 17 nt, Homo sapiens
gguggcucacgccugua

SEQ ID NO: 692438 - RNA, 21 nt, Homo sapiens
guaacaugaggggacauuuug

SEQ ID NO: 692439 - RNA, 15 nt, Homo sapiens
guaauccucaagaaa

SEQ ID NO: 692440 - RNA, 12 nt, Homo sapiens
guagaugggagg

SEQ ID NO: 692441 - RNA, 17 nt, Homo sapiens
guaucaugcccugugca

SEQ ID NO: 692442 - RNA, 17 nt, Homo sapiens
gucaggcagggugcagu

SEQ ID NO: 692443 - RNA, 15 nt, Homo sapiens
gucagucacagccac

SEQ ID NO: 692444 - RNA, 13 nt, Homo sapiens
gucaucugugcac

SEQ ID NO: 692445 - RNA, 19 nt, Homo sapiens
guccccuucucucaucucu

SEQ ID NO: 692446 - RNA, 21 nt, Homo sapiens
guccucagccuugccagagau

SEQ ID NO: 692447 - RNA, 20 nt, Homo sapiens
guccuccaacaccaagcaca

SEQ ID NO: 692448 - RNA, 22 nt, Homo sapiens
guccucugucagucacagccac

SEQ ID NO: 692449 - RNA, 14 nt, Homo sapiens
gucgcaucucagug

SEQ ID NO: 692450 - RNA, 20 nt, Homo sapiens
gucggaacccaagcuuagaa

SEQ ID NO: 692451 - RNA, 13 nt, Homo sapiens
gucucugugagac

SEQ ID NO: 692452 - RNA, 13 nt, Homo sapiens
gucuucuaaacuu

SEQ ID NO: 692453 - RNA, 22 nt, Homo sapiens
gucuuuuuuucccuaccauuca

SEQ ID NO: 692454 - RNA, 15 nt, Homo sapiens
gugcacaucucugcu

SEQ ID NO: 692455 - RNA, 23 nt, Homo sapiens
gugcaguaucaugcccugugcaa

SEQ ID NO: 692456 - RNA, 19 nt, Homo sapiens
guggccaaggagcugcuau

SEQ ID NO: 692457 - RNA, 17 nt, Homo sapiens
gugggcaaacaggcagu

SEQ ID NO: 692458 - RNA, 19 nt, Homo sapiens
guguguccaaaacugccuc

SEQ ID NO: 692459 - RNA, 13 nt, Homo sapiens
guuccccagagaa

SEQ ID NO: 692460 - RNA, 18 nt, Homo sapiens
guucucaucuuucuugau

SEQ ID NO: 692461 - RNA, 14 nt, Homo sapiens
guucugugcacaaa

SEQ ID NO: 692462 - RNA, 15 nt, Homo sapiens
guucuuugggccaga

SEQ ID NO: 692463 - RNA, 16 nt, Homo sapiens
guucuuugggccagac

SEQ ID NO: 692464 - RNA, 20 nt, Homo sapiens
guuuuacauuguugagcuau

SEQ ID NO: 692465 - RNA, 19 nt, Homo sapiens
guuuucaagucaaauuaau

SEQ ID NO: 692466 - RNA, 21 nt, Homo sapiens
guuuucccugaccucccucua

SEQ ID NO: 692467 - RNA, 14 nt, Homo sapiens
uaaaaagcuuccau

SEQ ID NO: 692468 - RNA, 20 nt, Homo sapiens
uaaaacagaagccugaugcu

SEQ ID NO: 692469 - RNA, 22 nt, Homo sapiens
uaaaauauuuaucugauuaagu

SEQ ID NO: 692470 - RNA, 22 nt, Homo sapiens
uaaccaucacugguugcacuua

SEQ ID NO: 692471 - RNA, 17 nt, Homo sapiens
uaacuagaauuuauuca

SEQ ID NO: 692472 - RNA, 12 nt, Homo sapiens
uaacuagauggu

SEQ ID NO: 692473 - RNA, 21 nt, Homo sapiens
uaagacaugauuuccuugaau

SEQ ID NO: 692474 - RNA, 22 nt, Homo sapiens
uaaguugucuaaacaaugcuga

SEQ ID NO: 692475 - RNA, 18 nt, Homo sapiens
uaauccaggcagauccag

SEQ ID NO: 692476 - RNA, 15 nt, Homo sapiens
uaaucccagcacuuu

SEQ ID NO: 692477 - RNA, 22 nt, Homo sapiens
uacauccaaagcagacagcucc

SEQ ID NO: 692478 - RNA, 20 nt, Homo sapiens
uagcacuuucuacaauguga

SEQ ID NO: 692479 - RNA, 17 nt, Homo sapiens
uagcugcaaaggacaga

SEQ ID NO: 692480 - RNA, 16 nt, Homo sapiens
uaggaagagaaaccag

SEQ ID NO: 692481 - RNA, 19 nt, Homo sapiens
uaggacucaaaguuucaga

SEQ ID NO: 692482 - RNA, 14 nt, Homo sapiens
uauauguacaugag

SEQ ID NO: 692483 - RNA, 19 nt, Homo sapiens
ucaaccucuucuggcucaa

SEQ ID NO: 692484 - RNA, 19 nt, Homo sapiens
ucacaaacuuuuauacucu

SEQ ID NO: 692485 - RNA, 14 nt, Homo sapiens
ucacccaggaggau

SEQ ID NO: 692486 - RNA, 18 nt, Homo sapiens
ucaccuuggcaccagaca

SEQ ID NO: 692487 - RNA, 19 nt, Homo sapiens
ucaccuuggcaccagacac

SEQ ID NO: 692488 - RNA, 14 nt, Homo sapiens
ucacugguugcacu

SEQ ID NO: 692489 - RNA, 16 nt, Homo sapiens
ucacugucuuuccuag

SEQ ID NO: 692490 - RNA, 15 nt, Homo sapiens
ucagaauagccacau

SEQ ID NO: 692491 - RNA, 17 nt, Homo sapiens
ucagagaccauugcaau

SEQ ID NO: 692492 - RNA, 15 nt, Homo sapiens
ucagauccagggaca

SEQ ID NO: 692493 - RNA, 16 nt, Homo sapiens
ucagccuggccagaca

SEQ ID NO: 692494 - RNA, 22 nt, Homo sapiens
ucagccuggccagacacaggcc

SEQ ID NO: 692495 - RNA, 18 nt, Homo sapiens
ucagccuugccagagauc

SEQ ID NO: 692496 - RNA, 22 nt, Homo sapiens
ucagucacagccaccccugaga

SEQ ID NO: 692497 - RNA, 13 nt, Homo sapiens
ucagucauaauca

SEQ ID NO: 692498 - RNA, 14 nt, Homo sapiens
ucagugcaggagag

SEQ ID NO: 692499 - RNA, 16 nt, Homo sapiens
ucaucucucugcccaa

SEQ ID NO: 692500 - RNA, 20 nt, Homo sapiens
ucauggaugggggaacucag

SEQ ID NO: 692501 - RNA, 23 nt, Homo sapiens
uccaaagaguagaauugcauuga

SEQ ID NO: 692502 - RNA, 21 nt, Homo sapiens
uccaacaccaagcacagcagc

SEQ ID NO: 692503 - RNA, 16 nt, Homo sapiens
uccaacacugcugcuc

SEQ ID NO: 692504 - RNA, 17 nt, Homo sapiens
uccaaccugcaaagauc

SEQ ID NO: 692505 - RNA, 20 nt, Homo sapiens
uccagacuuccuugagacac

SEQ ID NO: 692506 - RNA, 18 nt, Homo sapiens
uccaggaaccacaccaca

SEQ ID NO: 692507 - RNA, 20 nt, Homo sapiens
uauauuugugauagcacuuu

SEQ ID NO: 692508 - RNA, 20 nt, Homo sapiens
uauauuuuuuuaaaauguua

SEQ ID NO: 692509 - RNA, 19 nt, Homo sapiens
uaucuuuauuaaucacuau

SEQ ID NO: 692510 - RNA, 20 nt, Homo sapiens
uaucuuuauuaaucacuauu

SEQ ID NO: 692511 - RNA, 14 nt, Homo sapiens
uaugcaagggacug

SEQ ID NO: 692512 - RNA, 14 nt, Homo sapiens
uaugcugaaacaga

SEQ ID NO: 692513 - RNA, 23 nt, Homo sapiens
ucaaagaggcugaggcuggcaca

SEQ ID NO: 692514 - RNA, 18 nt, Homo sapiens
ucaccccugguucucauc

SEQ ID NO: 692515 - RNA, 13 nt, Homo sapiens
ucagacaggcaaa

SEQ ID NO: 692516 - RNA, 16 nt, Homo sapiens
ucagacauuggcaccu

SEQ ID NO: 692517 - RNA, 14 nt, Homo sapiens
ucagcagacaagga

SEQ ID NO: 692518 - RNA, 17 nt, Homo sapiens
ucaggacagaugccaca

SEQ ID NO: 692519 - RNA, 18 nt, Homo sapiens
ucaggaguuccuaaccag

SEQ ID NO: 692520 - RNA, 17 nt, Homo sapiens
ucaggcagggugcagua

SEQ ID NO: 692521 - RNA, 14 nt, Homo sapiens
ucagucacagccac

SEQ ID NO: 692522 - RNA, 15 nt, Homo sapiens
ucagucacagccacc

SEQ ID NO: 692523 - RNA, 17 nt, Homo sapiens
ucagugauuacugucaa

SEQ ID NO: 692524 - RNA, 14 nt, Homo sapiens
ucauaguaacuucu

SEQ ID NO: 692525 - RNA, 18 nt, Homo sapiens
ucaucucccaccuagcag

SEQ ID NO: 692526 - RNA, 10 nt, Homo sapiens
ucaugcccuc

SEQ ID NO: 692527 - RNA, 11 nt, Homo sapiens
ucauugcugag

SEQ ID NO: 692528 - RNA, 13 nt, Homo sapiens
uccacucaguugc

SEQ ID NO: 692529 - RNA, 17 nt, Homo sapiens
uccagaugcagggcagu

SEQ ID NO: 692530 - RNA, 20 nt, Homo sapiens
uccagcucuuuccuccuucc

SEQ ID NO: 692531 - RNA, 19 nt, Homo sapiens
uccagggcccccaucucau

SEQ ID NO: 692532 - RNA, 19 nt, Homo sapiens
ucccaaaugagccaugaga

SEQ ID NO: 692533 - RNA, 21 nt, Homo sapiens
ucccaacuuguauuaaagaca

SEQ ID NO: 692534 - RNA, 21 nt, Homo sapiens
ucccagauuggcucacacuga

SEQ ID NO: 692535 - RNA, 14 nt, Homo sapiens
ucccaggacccuga

SEQ ID NO: 692536 - RNA, 16 nt, Homo sapiens
uccccaggcaccucac

SEQ ID NO: 692537 - RNA, 12 nt, Homo sapiens
ucccccccaugc

SEQ ID NO: 692538 - RNA, 15 nt, Homo sapiens
uccccugaccuguga

SEQ ID NO: 692539 - RNA, 20 nt, Homo sapiens
uccuaccuguuuugugguca

SEQ ID NO: 692540 - RNA, 15 nt, Homo sapiens
uccucccuucugcua

SEQ ID NO: 692541 - RNA, 21 nt, Homo sapiens
uccucugucagucacagccac

SEQ ID NO: 692542 - RNA, 23 nt, Homo sapiens
uccugaggcuuuggauuugacau

SEQ ID NO: 692543 - RNA, 16 nt, Homo sapiens
uccugggccugcagaa

SEQ ID NO: 692544 - RNA, 14 nt, Homo sapiens
uccuuguuccuaga

SEQ ID NO: 692545 - RNA, 19 nt, Homo sapiens
ucgcaaugagggagcaugu

SEQ ID NO: 692546 - RNA, 18 nt, Homo sapiens
ucuagauuauggagcuuu

SEQ ID NO: 692547 - RNA, 19 nt, Homo sapiens
ucuauguuuacaaauggac

SEQ ID NO: 692548 - RNA, 16 nt, Homo sapiens
ucucaucuuucuugau

SEQ ID NO: 692549 - RNA, 23 nt, Homo sapiens
ucuccaaccccccagcacugagg

SEQ ID NO: 692550 - RNA, 20 nt, Homo sapiens
ucuccacucaguugcaacuu

SEQ ID NO: 692551 - RNA, 13 nt, Homo sapiens
ucucucaucucuu

SEQ ID NO: 692552 - RNA, 21 nt, Homo sapiens
ucugcauuucgguggcuaguc

SEQ ID NO: 692553 - RNA, 13 nt, Homo sapiens
ucugccuguggaa

SEQ ID NO: 692554 - RNA, 20 nt, Homo sapiens
ucuggcagccucccauccag

SEQ ID NO: 692555 - RNA, 17 nt, Homo sapiens
ucugucagucacagcca

SEQ ID NO: 692556 - RNA, 17 nt, Homo sapiens
ucuguccccuucucuca

SEQ ID NO: 692557 - RNA, 17 nt, Homo sapiens
ucuguuuugaaggcaaa

SEQ ID NO: 692558 - RNA, 15 nt, Homo sapiens
ucuucuaaacuuccc

SEQ ID NO: 692559 - RNA, 20 nt, Homo sapiens
ucuugaaauuaagaaggcaa

SEQ ID NO: 692560 - RNA, 21 nt, Homo sapiens
ucuugaaauuaagaaggcaaa

SEQ ID NO: 692561 - RNA, 14 nt, Homo sapiens
ucuugaaggugcug

SEQ ID NO: 692562 - RNA, 21 nt, Homo sapiens
ugaacacucuuuugcuuuauu

SEQ ID NO: 692563 - RNA, 20 nt, Homo sapiens
ugaacuguggggugugcaca

SEQ ID NO: 692564 - RNA, 21 nt, Homo sapiens
ugaagccaauucagacaggca

SEQ ID NO: 692565 - RNA, 24 nt, Homo sapiens
ugaaggggaaccccggggugccca

SEQ ID NO: 692566 - RNA, 13 nt, Homo sapiens
ugaaggggccaug

SEQ ID NO: 692567 - RNA, 17 nt, Homo sapiens
ugacauugcguuugacc

SEQ ID NO: 692568 - RNA, 23 nt, Homo sapiens
ugacauugcguuugaccuuuuau

SEQ ID NO: 692569 - RNA, 21 nt, Homo sapiens
ugacucuggcaaagcuuuuag

SEQ ID NO: 692570 - RNA, 22 nt, Homo sapiens
ugagaagaaaacaucuauucuc

SEQ ID NO: 692571 - RNA, 23 nt, Homo sapiens
ugagacaggagaccuggcacugg

SEQ ID NO: 692572 - RNA, 16 nt, Homo sapiens
ugagcaacucuugauu

SEQ ID NO: 692573 - RNA, 22 nt, Homo sapiens
ugagcccagcugggucaggcag

SEQ ID NO: 692574 - RNA, 21 nt, Homo sapiens
ugaggcggguggaucacuuga

SEQ ID NO: 692575 - RNA, 18 nt, Homo sapiens
ugaggcuggcacaggaca

SEQ ID NO: 692576 - RNA, 17 nt, Homo sapiens
ugagugaaccuguauaa

SEQ ID NO: 692577 - RNA, 21 nt, Homo sapiens
ugauuauccauauugagucaa

SEQ ID NO: 692578 - RNA, 22 nt, Homo sapiens
ugcacagugaagugcuggcaac

SEQ ID NO: 692579 - RNA, 17 nt, Homo sapiens
ugcagaaacaguucacc

SEQ ID NO: 692580 - RNA, 20 nt, Homo sapiens
ugcaggacuugagaagaccu

SEQ ID NO: 692581 - RNA, 15 nt, Homo sapiens
ugcaucugaccagca

SEQ ID NO: 692582 - RNA, 16 nt, Homo sapiens
ugcaucugaccagcag

SEQ ID NO: 692583 - RNA, 15 nt, Homo sapiens
ugccaaccggucacc

SEQ ID NO: 692584 - RNA, 18 nt, Homo sapiens
ugcuccagugcaggagac

SEQ ID NO: 692585 - RNA, 19 nt, Homo sapiens
ugcugagagaaauauggaa

SEQ ID NO: 692586 - RNA, 17 nt, Homo sapiens
ugcugcuccagugcagg

SEQ ID NO: 692587 - RNA, 12 nt, Homo sapiens
ugcuuucugcuc

SEQ ID NO: 692588 - RNA, 20 nt, Homo sapiens
uggaaccugacguagcugca

SEQ ID NO: 692589 - RNA, 19 nt, Homo sapiens
uggagcccauccagucucc

SEQ ID NO: 692590 - RNA, 16 nt, Homo sapiens
uggaugggggaacuca

SEQ ID NO: 692591 - RNA, 23 nt, Homo sapiens
uggaugggggaacucagauccag

SEQ ID NO: 692592 - RNA, 14 nt, Homo sapiens
uggauugggguccc

SEQ ID NO: 692593 - RNA, 17 nt, Homo sapiens
uggcacuggaugcagaa

SEQ ID NO: 692594 - RNA, 13 nt, Homo sapiens
uggcagucacuga

SEQ ID NO: 692595 - RNA, 15 nt, Homo sapiens
uggcuccaacacugc

SEQ ID NO: 692596 - RNA, 20 nt, Homo sapiens
ugggagauucaagggaccca

SEQ ID NO: 692597 - RNA, 19 nt, Homo sapiens
ugggccagacaugccacaa

SEQ ID NO: 692598 - RNA, 15 nt, Homo sapiens
uggggucaugcccuc

SEQ ID NO: 692599 - RNA, 21 nt, Homo sapiens
ugggucccagauuggcucaca

SEQ ID NO: 692600 - RNA, 22 nt, Homo sapiens
ugggugggcaggaaaaggugau

SEQ ID NO: 692601 - RNA, 19 nt, Homo sapiens
uguaaucccagcuacuugg

SEQ ID NO: 692602 - RNA, 14 nt, Homo sapiens
uguaguaauugaca

SEQ ID NO: 692603 - RNA, 17 nt, Homo sapiens
uguaguccgugcugaca

SEQ ID NO: 692604 - RNA, 16 nt, Homo sapiens
uguaucuuauucacau

SEQ ID NO: 692605 - RNA, 18 nt, Homo sapiens
uguauuaaacucuucaca

SEQ ID NO: 692606 - RNA, 18 nt, Homo sapiens
uguauuaaagacagaggc

SEQ ID NO: 692607 - RNA, 18 nt, Homo sapiens
uguccaaaacugccucag

SEQ ID NO: 692608 - RNA, 13 nt, Homo sapiens
ugucccucugccc

SEQ ID NO: 692609 - RNA, 18 nt, Homo sapiens
uguccucagccuugccag

SEQ ID NO: 692610 - RNA, 19 nt, Homo sapiens
uguccucagccuugccaga

SEQ ID NO: 692611 - RNA, 15 nt, Homo sapiens
ugucuuuaacuguca

SEQ ID NO: 692612 - RNA, 23 nt, Homo sapiens
ugugagacucgagaacuuucauu

SEQ ID NO: 692613 - RNA, 14 nt, Homo sapiens
uguuacuguaauuc

SEQ ID NO: 692614 - RNA, 23 nt, Homo sapiens
uguuauauagggaucaaccagcu

SEQ ID NO: 692615 - RNA, 15 nt, Homo sapiens
uguuauuuaacagcu

SEQ ID NO: 692616 - RNA, 23 nt, Homo sapiens
uuaagaggacauaaugggguccu

SEQ ID NO: 692617 - RNA, 19 nt, Homo sapiens
uuaaucacuauuguuccag

SEQ ID NO: 692618 - RNA, 18 nt, Homo sapiens
uuacaaauggacauagga

SEQ ID NO: 692619 - RNA, 16 nt, Homo sapiens
uuagaaauacugcaag

SEQ ID NO: 692620 - RNA, 21 nt, Homo sapiens
uuauagaauauuuauuaccuc

SEQ ID NO: 692621 - RNA, 18 nt, Homo sapiens
uuauguaguaauugacau

SEQ ID NO: 692622 - RNA, 15 nt, Homo sapiens
uucaauaaagcauuu

SEQ ID NO: 692623 - RNA, 14 nt, Homo sapiens
uuccaggcugguuc

SEQ ID NO: 692624 - RNA, 12 nt, Homo sapiens
uuccccagagaa

SEQ ID NO: 692625 - RNA, 16 nt, Homo sapiens
uuccccaucuucuaaa

SEQ ID NO: 692626 - RNA, 19 nt, Homo sapiens
uucccuaccauucagugau

SEQ ID NO: 692627 - RNA, 15 nt, Homo sapiens
uucccuuugugcaca

SEQ ID NO: 692628 - RNA, 15 nt, Homo sapiens
uuccuguccagcucc

SEQ ID NO: 692629 - RNA, 18 nt, Homo sapiens
uuccuuaauccagcugau

SEQ ID NO: 692630 - RNA, 15 nt, Homo sapiens
uucuauaaggccaua

SEQ ID NO: 692631 - RNA, 17 nt, Homo sapiens
uucugcauauguugaau

SEQ ID NO: 692632 - RNA, 14 nt, Homo sapiens
uugauucuccuuca

SEQ ID NO: 692633 - RNA, 16 nt, Homo sapiens
uugcaaaucuugaaau

SEQ ID NO: 692634 - RNA, 23 nt, Homo sapiens
uugccucccgggcucaagcgauu

SEQ ID NO: 692635 - RNA, 19 nt, Homo sapiens
uuggucacauauaugccua

SEQ ID NO: 692636 - RNA, 20 nt, Homo sapiens
uuguaaauaaagcccuggga

SEQ ID NO: 692637 - RNA, 14 nt, Homo sapiens
uugucccucugccc

SEQ ID NO: 692638 - RNA, 15 nt, Homo sapiens
uugugauagcacuuu

SEQ ID NO: 692639 - RNA, 15 nt, Homo sapiens
uuguuaucagucaau

SEQ ID NO: 692640 - RNA, 11 nt, Homo sapiens
uuguucaauua

SEQ ID NO: 692641 - RNA, 23 nt, Homo sapiens
uuguuccagcaguuuucaaguca

SEQ ID NO: 692642 - RNA, 20 nt, Homo sapiens
uuuacaaaacuacaugagaa

SEQ ID NO: 692643 - RNA, 17 nt, Homo sapiens
uuuauauguacaugaga

SEQ ID NO: 692644 - RNA, 17 nt, Homo sapiens
uuuaucuugucucuggg

SEQ ID NO: 692645 - RNA, 13 nt, Homo sapiens
uuuauuaccucug

SEQ ID NO: 692646 - RNA, 16 nt, Homo sapiens
uuuauuaccucugaua

SEQ ID NO: 692647 - RNA, 13 nt, Homo sapiens
uuucaacugccaa

SEQ ID NO: 692648 - RNA, 21 nt, Homo sapiens
uuucaccuguuuuuaagcugu

SEQ ID NO: 692649 - RNA, 17 nt, Homo sapiens
uuucauuuuuuuccagg

SEQ ID NO: 692650 - RNA, 19 nt, Homo sapiens
uuugagaagaaaacaucua

SEQ ID NO: 692651 - RNA, 15 nt, Homo sapiens
uuugagcacaacuuu

SEQ ID NO: 692652 - RNA, 23 nt, Homo sapiens
uuuguuccccuccuccacucucc

SEQ ID NO: 692653 - RNA, 13 nt, Homo sapiens
uuuugaaggcaaa

SEQ ID NO: 692654 - RNA, 14 nt, Homo sapiens
uuuugaaggcaaaa

SEQ ID NO: 692655 - RNA, 22 nt, Homo sapiens
uuuuguccuaaaacaccuggua

SEQ ID NO: 692656 - RNA, 16 nt, Homo sapiens
aaaaaugcacccaacu

SEQ ID NO: 692657 - RNA, 15 nt, Homo sapiens
aaaacaggucuucau

SEQ ID NO: 692658 - RNA, 16 nt, Homo sapiens
aaaacuuaugaccucu

SEQ ID NO: 692659 - RNA, 18 nt, Homo sapiens
aaaauaguuaagacauga

SEQ ID NO: 692660 - RNA, 14 nt, Homo sapiens
aaacagaagccuga

SEQ ID NO: 692661 - RNA, 14 nt, Homo sapiens
aaacaucuauucuc

SEQ ID NO: 692662 - RNA, 21 nt, Homo sapiens
aaagaggcugaggcuggcaca

SEQ ID NO: 692663 - RNA, 21 nt, Homo sapiens
aaagcuuuuagaaauacugca

SEQ ID NO: 692664 - RNA, 14 nt, Homo sapiens
aaagugggcuugau

SEQ ID NO: 692665 - RNA, 16 nt, Homo sapiens
aaauauggaacuuaca

SEQ ID NO: 692666 - RNA, 21 nt, Homo sapiens
aaauauuuauaaaacuucuca

SEQ ID NO: 692667 - RNA, 15 nt, Homo sapiens
aaaucugacccagug

SEQ ID NO: 692668 - RNA, 12 nt, Homo sapiens
aaauuaagaagg

SEQ ID NO: 692669 - RNA, 15 nt, Homo sapiens
aaauuaagaaggcaa

SEQ ID NO: 692670 - RNA, 20 nt, Homo sapiens
aacaaugcugauuuggugac

SEQ ID NO: 692671 - RNA, 14 nt, Homo sapiens
aacagaagcuucca

SEQ ID NO: 692672 - RNA, 13 nt, Homo sapiens
aacagaucuggaa

SEQ ID NO: 692673 - RNA, 23 nt, Homo sapiens
aacaucuuuucuugccucugucc

SEQ ID NO: 692674 - RNA, 23 nt, Homo sapiens
aacaugugagagguuugacuaga

SEQ ID NO: 692675 - RNA, 22 nt, Homo sapiens
aaccacuaagaauucaaacugg

SEQ ID NO: 692676 - RNA, 18 nt, Homo sapiens
aaccacuucauucuugaa

SEQ ID NO: 692677 - RNA, 23 nt, Homo sapiens
aacccuucccucaccuuggcacc

SEQ ID NO: 692678 - RNA, 20 nt, Homo sapiens
aaccucagccuggccagaca

SEQ ID NO: 692679 - RNA, 20 nt, Homo sapiens
aaccugcaaagaucuguccu

SEQ ID NO: 692680 - RNA, 23 nt, Homo sapiens
aacucagauccagggacagaggc

SEQ ID NO: 692681 - RNA, 15 nt, Homo sapiens
aacucuagccaaaug

SEQ ID NO: 692682 - RNA, 14 nt, Homo sapiens
aacugcaugcugcu

SEQ ID NO: 692683 - RNA, 14 nt, Homo sapiens
aacugucacucauu

SEQ ID NO: 692684 - RNA, 18 nt, Homo sapiens
aacuuguauuaaagacag

SEQ ID NO: 692685 - RNA, 15 nt, Homo sapiens
aagaaacgucuucua

SEQ ID NO: 692686 - RNA, 22 nt, Homo sapiens
aagacuggaagcuaauuugcau

SEQ ID NO: 692687 - RNA, 18 nt, Homo sapiens
aagaucuguccucagccu

SEQ ID NO: 692688 - RNA, 21 nt, Homo sapiens
aagcagguucccaagcucaga

SEQ ID NO: 692689 - RNA, 17 nt, Homo sapiens
aagcgauucuccugccu

SEQ ID NO: 692690 - RNA, 12 nt, Homo sapiens
aaggaacuucca

SEQ ID NO: 692691 - RNA, 20 nt, Homo sapiens
aaggacuuccuguccagcuc

SEQ ID NO: 692692 - RNA, 11 nt, Homo sapiens
aaggagucaaa

SEQ ID NO: 692693 - RNA, 12 nt, Homo sapiens
aaggaugugauu

SEQ ID NO: 692694 - RNA, 16 nt, Homo sapiens
aaggcugcaagguuua

SEQ ID NO: 692695 - RNA, 20 nt, Homo sapiens
aaggcugcuuagaauccaaa

SEQ ID NO: 692696 - RNA, 20 nt, Homo sapiens
aagguccucugucagucaca

SEQ ID NO: 692697 - RNA, 18 nt, Homo sapiens
aagugcuggcaaccacua

SEQ ID NO: 692698 - RNA, 19 nt, Homo sapiens
aauaaaucugacccagugc

SEQ ID NO: 692699 - RNA, 23 nt, Homo sapiens
aauaaccggauauauacauagca

SEQ ID NO: 692700 - RNA, 15 nt, Homo sapiens
aauagccacauuugg

SEQ ID NO: 692701 - RNA, 20 nt, Homo sapiens
aauauuuauuaccucugaua

SEQ ID NO: 692702 - RNA, 15 nt, Homo sapiens
aaucccagcuacuug

SEQ ID NO: 692703 - RNA, 16 nt, Homo sapiens
aaugcagcagggaugc

SEQ ID NO: 692704 - RNA, 20 nt, Homo sapiens
aaugcagcagggaugcccug

SEQ ID NO: 692705 - RNA, 13 nt, Homo sapiens
aaugucucuguga

SEQ ID NO: 692706 - RNA, 13 nt, Homo sapiens
aauucaaacuggg

SEQ ID NO: 692707 - RNA, 13 nt, Homo sapiens
aauugauuugcau

SEQ ID NO: 692708 - RNA, 16 nt, Homo sapiens
aauugauuugcauuga

SEQ ID NO: 692709 - RNA, 18 nt, Homo sapiens
aauuuauucaauuccucu

SEQ ID NO: 692710 - RNA, 15 nt, Homo sapiens
acaagaccaccacuu

SEQ ID NO: 692711 - RNA, 18 nt, Homo sapiens
acaaggauagaugcuggc

SEQ ID NO: 692712 - RNA, 21 nt, Homo sapiens
cuggaguuucauguacaagau

SEQ ID NO: 692713 - RNA, 20 nt, Homo sapiens
cugggccauucuccacagca

SEQ ID NO: 692714 - RNA, 15 nt, Homo sapiens
cugguaaucuugcuc

SEQ ID NO: 692715 - RNA, 20 nt, Homo sapiens
cugguucucaucuuucuuga

SEQ ID NO: 692716 - RNA, 23 nt, Homo sapiens
cuguaaucccagcacuuugggag

SEQ ID NO: 692717 - RNA, 21 nt, Homo sapiens
cuguaaucccagcuacuuggg

SEQ ID NO: 692718 - RNA, 15 nt, Homo sapiens
cugucagucacagcc

SEQ ID NO: 692719 - RNA, 15 nt, Homo sapiens
cuguccucagccuug

SEQ ID NO: 692720 - RNA, 22 nt, Homo sapiens
cugugcaaccucuuggccugau

SEQ ID NO: 692721 - RNA, 18 nt, Homo sapiens
cugugcacugcccaugga

SEQ ID NO: 692722 - RNA, 16 nt, Homo sapiens
cugugugauugacagc

SEQ ID NO: 692723 - RNA, 18 nt, Homo sapiens
cuuaauacuaccuugaaa

SEQ ID NO: 692724 - RNA, 13 nt, Homo sapiens
cuuagaauccaaa

SEQ ID NO: 692725 - RNA, 22 nt, Homo sapiens
cuuauuagggagaaaauucaau

SEQ ID NO: 692726 - RNA, 14 nt, Homo sapiens
cuuauuguaccucu

SEQ ID NO: 692727 - RNA, 23 nt, Homo sapiens
cuuauuuaaugccgauauacucu

SEQ ID NO: 692728 - RNA, 19 nt, Homo sapiens
cuucacaaaaucuguuuag

SEQ ID NO: 692729 - RNA, 15 nt, Homo sapiens
cuuccuguccagcuc

SEQ ID NO: 692730 - RNA, 22 nt, Homo sapiens
cuucgggcugugcccggggaaa

SEQ ID NO: 692731 - RNA, 20 nt, Homo sapiens
cuugaaauuaagaaggcaaa

SEQ ID NO: 692732 - RNA, 19 nt, Homo sapiens
cuugaagggccagagccag

SEQ ID NO: 692733 - RNA, 17 nt, Homo sapiens
cuugauucugcaguaaa

SEQ ID NO: 692734 - RNA, 20 nt, Homo sapiens
cuuggcaccagacacccagg

SEQ ID NO: 692735 - RNA, 16 nt, Homo sapiens
cuuuacauggaugcca

SEQ ID NO: 692736 - RNA, 16 nt, Homo sapiens
cuuuauuaaauacaaa

SEQ ID NO: 692737 - RNA, 14 nt, Homo sapiens
cuuuccuagauggc

SEQ ID NO: 692738 - RNA, 11 nt, Homo sapiens
cuuugcugcug

SEQ ID NO: 692739 - RNA, 21 nt, Homo sapiens
cuuugggccagacaugccaca

SEQ ID NO: 692740 - RNA, 17 nt, Homo sapiens
cuuuuagaaauacugca

SEQ ID NO: 692741 - RNA, 17 nt, Homo sapiens
cuuuuauugacacagaa

SEQ ID NO: 692742 - RNA, 18 nt, Homo sapiens
cuuuucuugccucugucc

SEQ ID NO: 692743 - RNA, 18 nt, Homo sapiens
gaaauaaaaggaagccaa

SEQ ID NO: 692744 - RNA, 22 nt, Homo sapiens
gaaauauggaacuuacauuguu

SEQ ID NO: 692745 - RNA, 20 nt, Homo sapiens
gaacacucuuuugcuuuauu

SEQ ID NO: 692746 - RNA, 21 nt, Homo sapiens
gaaccacaccacaucuaagcc

SEQ ID NO: 692747 - RNA, 22 nt, Homo sapiens
gaacccaagcuuagaacuuuaa

SEQ ID NO: 692748 - RNA, 19 nt, Homo sapiens
gaaccucagccuggccaga

SEQ ID NO: 692749 - RNA, 23 nt, Homo sapiens
gaacucaaauggggccagaucca

SEQ ID NO: 692750 - RNA, 15 nt, Homo sapiens
gaacugcaugcugcu

SEQ ID NO: 692751 - RNA, 18 nt, Homo sapiens
gaauaaauaaauguaucu

SEQ ID NO: 692752 - RNA, 21 nt, Homo sapiens
gaauauuuauuaccucugaua

SEQ ID NO: 692753 - RNA, 13 nt, Homo sapiens
gaauucaaacugg

SEQ ID NO: 692754 - RNA, 16 nt, Homo sapiens
gaauucaaacuggggc

SEQ ID NO: 692755 - RNA, 12 nt, Homo sapiens
gacaacaucuga

SEQ ID NO: 692756 - RNA, 19 nt, Homo sapiens
gacacuccccgaagucuuu

SEQ ID NO: 692757 - RNA, 20 nt, Homo sapiens
gacacuuaauacuaccuuga

SEQ ID NO: 692758 - RNA, 15 nt, Homo sapiens
gacagcuuugcugcu

SEQ ID NO: 692759 - RNA, 16 nt, Homo sapiens
gacauaaugggguccu

SEQ ID NO: 692760 - RNA, 16 nt, Homo sapiens
gacaugauuuccuuga

SEQ ID NO: 692761 - RNA, 17 nt, Homo sapiens
gaccacagcacagccaa

SEQ ID NO: 692762 - RNA, 19 nt, Homo sapiens
gaccacagcacagccaaca

SEQ ID NO: 692763 - RNA, 13 nt, Homo sapiens
gacccaagcugcc

SEQ ID NO: 692764 - RNA, 16 nt, Homo sapiens
gaccucaccuagaaau

SEQ ID NO: 692765 - RNA, 17 nt, Homo sapiens
gaccuuaggccuuccuc

SEQ ID NO: 692766 - RNA, 18 nt, Homo sapiens
gaccuuaggccuuccucu

SEQ ID NO: 692767 - RNA, 14 nt, Homo sapiens
gacugaagccaaag

SEQ ID NO: 692768 - RNA, 22 nt, Homo sapiens
gagaaaccuuauuguaccucuc

SEQ ID NO: 692769 - RNA, 20 nt, Homo sapiens
gagaagccaggaauuuccca

SEQ ID NO: 692770 - RNA, 21 nt, Homo sapiens
gagaaucccaaauuugauuga

SEQ ID NO: 692771 - RNA, 16 nt, Homo sapiens
gagacccguccauuug

SEQ ID NO: 692772 - RNA, 17 nt, Homo sapiens
gagacuuuacauggaug

SEQ ID NO: 692773 - RNA, 16 nt, Homo sapiens
gagagucgcaucucag

SEQ ID NO: 692774 - RNA, 16 nt, Homo sapiens
gagaugauacauccaa

SEQ ID NO: 692775 - RNA, 21 nt, Homo sapiens
gagauucaagggacccaugag

SEQ ID NO: 692776 - RNA, 17 nt, Homo sapiens
gagauuucaucugcucu

SEQ ID NO: 692777 - RNA, 22 nt, Homo sapiens
gagcaagacucugucucaaaaa

SEQ ID NO: 692778 - RNA, 18 nt, Homo sapiens
gagcaaggguucccucaa

SEQ ID NO: 692779 - RNA, 18 nt, Homo sapiens
gagcucucggaacugcau

SEQ ID NO: 692780 - RNA, 14 nt, Homo sapiens
gaggcaaugggagc

SEQ ID NO: 692781 - RNA, 19 nt, Homo sapiens
gagugcaguggugugaucu

SEQ ID NO: 692782 - RNA, 18 nt, Homo sapiens
gauaacuaggaaauccau

SEQ ID NO: 692783 - RNA, 14 nt, Homo sapiens
gauagaugcuggcc

SEQ ID NO: 692784 - RNA, 21 nt, Homo sapiens
gauaucaugccccuguacucc

SEQ ID NO: 692785 - RNA, 20 nt, Homo sapiens
gaucaacaucuuuucuugcc

SEQ ID NO: 692786 - RNA, 22 nt, Homo sapiens
gauccaaaagaagcccccagcu

SEQ ID NO: 692787 - RNA, 20 nt, Homo sapiens
gauggaacacggccacauca

SEQ ID NO: 692788 - RNA, 21 nt, Homo sapiens
gauuucaucugcucuccuucc

SEQ ID NO: 692789 - RNA, 15 nt, Homo sapiens
gauuuggugaccaac

SEQ ID NO: 692790 - RNA, 22 nt, Homo sapiens
gauuuuuugcauuccugacaaa

SEQ ID NO: 692791 - RNA, 13 nt, Homo sapiens
gcaaacaggcagu

SEQ ID NO: 692792 - RNA, 21 nt, Homo sapiens
gcaacaagaccaccacuucga

SEQ ID NO: 692793 - RNA, 22 nt, Homo sapiens
gcaacaagaccaccacuucgaa

SEQ ID NO: 692794 - RNA, 18 nt, Homo sapiens
gcacaaggccaucugggc

SEQ ID NO: 692795 - RNA, 17 nt, Homo sapiens
gcaccagacacccagga

SEQ ID NO: 692796 - RNA, 16 nt, Homo sapiens
gcacccaacuagcucu

SEQ ID NO: 692797 - RNA, 18 nt, Homo sapiens
gcaccguucugugcacaa

SEQ ID NO: 692798 - RNA, 21 nt, Homo sapiens
gcacuacauucauuuagcuaa

SEQ ID NO: 692799 - RNA, 19 nt, Homo sapiens
gcacugaggaagaacgggg

SEQ ID NO: 692800 - RNA, 13 nt, Homo sapiens
gcacugaugcugc

SEQ ID NO: 692801 - RNA, 20 nt, Homo sapiens
gcagcaccguucugugcaca

SEQ ID NO: 692802 - RNA, 16 nt, Homo sapiens
gcagguucccaagcuc

SEQ ID NO: 692803 - RNA, 13 nt, Homo sapiens
gcaugauagacac

SEQ ID NO: 692804 - RNA, 17 nt, Homo sapiens
gccaaccggucacccag

SEQ ID NO: 692805 - RNA, 14 nt, Homo sapiens
gccaaggagcugcu

SEQ ID NO: 692806 - RNA, 16 nt, Homo sapiens
gccaccgcccagagac

SEQ ID NO: 692807 - RNA, 19 nt, Homo sapiens
gccagacaugccacaagga

SEQ ID NO: 692808 - RNA, 23 nt, Homo sapiens
gcccagcuccaaggggaaucaga

SEQ ID NO: 692809 - RNA, 20 nt, Homo sapiens
gcccaggcuggagugcagug

SEQ ID NO: 692810 - RNA, 14 nt, Homo sapiens
gcccauccagucuc

SEQ ID NO: 692811 - RNA, 18 nt, Homo sapiens
gcccauccccaggcaccu

SEQ ID NO: 692812 - RNA, 15 nt, Homo sapiens
gccccaggaccagcu

SEQ ID NO: 692813 - RNA, 21 nt, Homo sapiens
gcccccaccgugggcagggag

SEQ ID NO: 692814 - RNA, 13 nt, Homo sapiens
gcccccacugacc

SEQ ID NO: 692815 - RNA, 21 nt, Homo sapiens
gcccucaccccugguucucau

SEQ ID NO: 692816 - RNA, 14 nt, Homo sapiens
gcccugacccugug

SEQ ID NO: 692817 - RNA, 17 nt, Homo sapiens
gcccugacccuguggaa

SEQ ID NO: 692818 - RNA, 16 nt, Homo sapiens
gcccugcgggugaaca

SEQ ID NO: 692819 - RNA, 21 nt, Homo sapiens
gccuaaaagugggcuugauuc

SEQ ID NO: 692820 - RNA, 16 nt, Homo sapiens
gccucgaaacacagaa

SEQ ID NO: 692821 - RNA, 13 nt, Homo sapiens
gccugagucaccu

SEQ ID NO: 692822 - RNA, 18 nt, Homo sapiens
gccugaugcugacauuca

SEQ ID NO: 692823 - RNA, 21 nt, Homo sapiens
gccugcacagugaagugcugg

SEQ ID NO: 692824 - RNA, 15 nt, Homo sapiens
gccuggggucuggag

SEQ ID NO: 692825 - RNA, 20 nt, Homo sapiens
gccuguaaucccagcacuuu

SEQ ID NO: 692826 - RNA, 13 nt, Homo sapiens
gcuaagaaccugg

SEQ ID NO: 692827 - RNA, 22 nt, Homo sapiens
gcucacacugagaauguaagaa

SEQ ID NO: 692828 - RNA, 17 nt, Homo sapiens
uccagguguuacuguaa

SEQ ID NO: 692829 - RNA, 18 nt, Homo sapiens
uccagucuccaccaggaa

SEQ ID NO: 692830 - RNA, 22 nt, Homo sapiens
ucccaauuucagacucccauuc

SEQ ID NO: 692831 - RNA, 17 nt, Homo sapiens
uccccaauaauugcaga

SEQ ID NO: 692832 - RNA, 16 nt, Homo sapiens
uccccagcccagagac

SEQ ID NO: 692833 - RNA, 21 nt, Homo sapiens
uccccagcccagagacauacu

SEQ ID NO: 692834 - RNA, 14 nt, Homo sapiens
uccccuucucucau

SEQ ID NO: 692835 - RNA, 15 nt, Homo sapiens
uccccuucucucauc

SEQ ID NO: 692836 - RNA, 20 nt, Homo sapiens
uccccuucucucaucucuua

SEQ ID NO: 692837 - RNA, 18 nt, Homo sapiens
ucccucccccccaugcac

SEQ ID NO: 692838 - RNA, 22 nt, Homo sapiens
ucccucccccccaugcacugug

SEQ ID NO: 692839 - RNA, 22 nt, Homo sapiens
uccgugcugacagcugcuccua

SEQ ID NO: 692840 - RNA, 16 nt, Homo sapiens
uccuccaacaccaagc

SEQ ID NO: 692841 - RNA, 22 nt, Homo sapiens
uccuccaacaccaagcacagca

SEQ ID NO: 692842 - RNA, 15 nt, Homo sapiens
uccuccuuccaugga

SEQ ID NO: 692843 - RNA, 18 nt, Homo sapiens
ucgaaaccugggauucag

SEQ ID NO: 692844 - RNA, 16 nt, Homo sapiens
ucgcaucucagugcag

SEQ ID NO: 692845 - RNA, 17 nt, Homo sapiens
ucgcaucucagugcagg

SEQ ID NO: 692846 - RNA, 21 nt, Homo sapiens
ucuaaacuuccccaucuucua

SEQ ID NO: 692847 - RNA, 16 nt, Homo sapiens
uuggcucacacugaga

SEQ ID NO: 692848 - RNA, 21 nt, Homo sapiens
uugugugugaugugaagccaa

SEQ ID NO: 692849 - RNA, 21 nt, Homo sapiens
uuuaacuagaauuuauucaau

SEQ ID NO: 692850 - RNA, 21 nt, Homo sapiens
uuuaacuucugccuguggaac

SEQ ID NO: 692851 - RNA, 16 nt, Homo sapiens
uuuaaucaaguugaau

SEQ ID NO: 692852 - RNA, 19 nt, Homo sapiens
uuuaucuuugauucuccuu

SEQ ID NO: 692853 - RNA, 13 nt, Homo sapiens
uuucaaguucaau

SEQ ID NO: 692854 - RNA, 22 nt, Homo sapiens
uuucaucugcucuccuuccugg

SEQ ID NO: 692855 - RNA, 22 nt, Homo sapiens
uuugagaagaaaacaucuauuc

SEQ ID NO: 692856 - RNA, 20 nt, Homo sapiens
uuugaugauuaauucaccuu

SEQ ID NO: 692857 - RNA, 14 nt, Homo sapiens
uuugauugauuuga

SEQ ID NO: 692858 - RNA, 19 nt, Homo sapiens
uuugcauuaaauucacaaa

SEQ ID NO: 692859 - RNA, 16 nt, Homo sapiens
uuuggauugggguccc

SEQ ID NO: 692860 - RNA, 19 nt, Homo sapiens
uuugugauagcacuuucua

SEQ ID NO: 692861 - RNA, 18 nt, Homo sapiens
uuuuggguguuccuggca

SEQ ID NO: 692862 - RNA, 19 nt, Homo sapiens
uuuuuguuaucagucaaua

SEQ ID NO: 692863 - RNA, 14 nt, Homo sapiens
acagcugcuccuag

SEQ ID NO: 692864 - RNA, 20 nt, Homo sapiens
acagcuuugcugcugaaggc

SEQ ID NO: 692865 - RNA, 14 nt, Homo sapiens
acaggacacaguca

SEQ ID NO: 692866 - RNA, 23 nt, Homo sapiens
acagguaauauaaaaagcuucca

SEQ ID NO: 692867 - RNA, 21 nt, Homo sapiens
acaguucuuugggccagacau

SEQ ID NO: 692868 - RNA, 19 nt, Homo sapiens
acauacuugaagggccaga

SEQ ID NO: 692869 - RNA, 17 nt, Homo sapiens
acauccaaaauaguuaa

SEQ ID NO: 692870 - RNA, 20 nt, Homo sapiens
acauccaaagcagacagcuc

SEQ ID NO: 692871 - RNA, 19 nt, Homo sapiens
acaugagaaggaacuucca

SEQ ID NO: 692872 - RNA, 22 nt, Homo sapiens
acaugauuccuuccuguucuga

SEQ ID NO: 692873 - RNA, 17 nt, Homo sapiens
acaugcgguagccagca

SEQ ID NO: 692874 - RNA, 17 nt, Homo sapiens
acauuggcaccuaaucc

SEQ ID NO: 692875 - RNA, 22 nt, Homo sapiens
acauuggcaccuaauccaggca

SEQ ID NO: 692876 - RNA, 16 nt, Homo sapiens
accacagcacagccaa

SEQ ID NO: 692877 - RNA, 17 nt, Homo sapiens
accacuucgaaaccugg

SEQ ID NO: 692878 - RNA, 15 nt, Homo sapiens
accagacacccagga

SEQ ID NO: 692879 - RNA, 14 nt, Homo sapiens
accagcagcgccuu

SEQ ID NO: 692880 - RNA, 22 nt, Homo sapiens
accagccuggucaacaugguga

SEQ ID NO: 692881 - RNA, 19 nt, Homo sapiens
accaucacugguugcacuu

SEQ ID NO: 692882 - RNA, 19 nt, Homo sapiens
accccagguacauccauga

SEQ ID NO: 692883 - RNA, 20 nt, Homo sapiens
accccugagauccggcaaca

SEQ ID NO: 692884 - RNA, 21 nt, Homo sapiens
accgguggggcugguucugua

SEQ ID NO: 692885 - RNA, 15 nt, Homo sapiens
accuaauccaggcag

SEQ ID NO: 692886 - RNA, 20 nt, Homo sapiens
accucacaggccccaggaaa

SEQ ID NO: 692887 - RNA, 16 nt, Homo sapiens
accucagccuggccag

SEQ ID NO: 692888 - RNA, 15 nt, Homo sapiens
accugugagcccagc

SEQ ID NO: 692889 - RNA, 16 nt, Homo sapiens
accuguuagcagacag

SEQ ID NO: 692890 - RNA, 19 nt, Homo sapiens
accuugaagaaccucucac

SEQ ID NO: 692891 - RNA, 15 nt, Homo sapiens
acgaucuuccuggcu

SEQ ID NO: 692892 - RNA, 17 nt, Homo sapiens
acguggcucagccagca

SEQ ID NO: 692893 - RNA, 12 nt, Homo sapiens
acucagcacaag

SEQ ID NO: 692894 - RNA, 13 nt, Homo sapiens
acucauugcugag

SEQ ID NO: 692895 - RNA, 13 nt, Homo sapiens
acucuagccaaau

SEQ ID NO: 692896 - RNA, 18 nt, Homo sapiens
acucuggcaaagcuuuua

SEQ ID NO: 692897 - RNA, 19 nt, Homo sapiens
auuucccaggacccugaag

SEQ ID NO: 692898 - RNA, 17 nt, Homo sapiens
auuugaagaacauguga

SEQ ID NO: 692899 - RNA, 15 nt, Homo sapiens
auuuuauaugaagau

SEQ ID NO: 692900 - RNA, 20 nt, Homo sapiens
auuuuggagaguuuccugaa

SEQ ID NO: 692901 - RNA, 13 nt, Homo sapiens
caaaaugcuuuuu

SEQ ID NO: 692902 - RNA, 22 nt, Homo sapiens
caaacaggcaguuggccagaga

SEQ ID NO: 692903 - RNA, 23 nt, Homo sapiens
caaagcagccacgaggugcaaca

SEQ ID NO: 692904 - RNA, 22 nt, Homo sapiens
caaaggacagauccagggacug

SEQ ID NO: 692905 - RNA, 18 nt, Homo sapiens
caaaguccuuuuuuucca

SEQ ID NO: 692906 - RNA, 20 nt, Homo sapiens
caaauggacauaggacucaa

SEQ ID NO: 692907 - RNA, 19 nt, Homo sapiens
caaauggggccagauccag

SEQ ID NO: 692908 - RNA, 15 nt, Homo sapiens
caacaagaccaccac

SEQ ID NO: 692909 - RNA, 14 nt, Homo sapiens
caacauccaaaaua

SEQ ID NO: 692910 - RNA, 13 nt, Homo sapiens
caaccccaggcug

SEQ ID NO: 692911 - RNA, 18 nt, Homo sapiens
caagaaugggagguugau

SEQ ID NO: 692912 - RNA, 21 nt, Homo sapiens
caagauacugcuacuguaauu

SEQ ID NO: 692913 - RNA, 22 nt, Homo sapiens
caagcuccuccucccugcaucu

SEQ ID NO: 692914 - RNA, 17 nt, Homo sapiens
caagggaucugguccua

SEQ ID NO: 692915 - RNA, 18 nt, Homo sapiens
caagguccucugucaguc

SEQ ID NO: 692916 - RNA, 17 nt, Homo sapiens
caaugaauccccaauaa

SEQ ID NO: 692917 - RNA, 13 nt, Homo sapiens
caauuccucuggg

SEQ ID NO: 692918 - RNA, 15 nt, Homo sapiens
caauuucagacuccc

SEQ ID NO: 692919 - RNA, 13 nt, Homo sapiens
cacaaaacccaga

SEQ ID NO: 692920 - RNA, 14 nt, Homo sapiens
cacacucagcacaa

SEQ ID NO: 692921 - RNA, 13 nt, Homo sapiens
cacagcacagcca

SEQ ID NO: 692922 - RNA, 19 nt, Homo sapiens
cacagccaccccugagauc

SEQ ID NO: 692923 - RNA, 19 nt, Homo sapiens
cacaggccugagauuucau

SEQ ID NO: 692924 - RNA, 14 nt, Homo sapiens
cacagucaugugcc

SEQ ID NO: 692925 - RNA, 19 nt, Homo sapiens
cacaucucugcuugaguca

SEQ ID NO: 692926 - RNA, 20 nt, Homo sapiens
caccuaauccaggcagaucc

SEQ ID NO: 692927 - RNA, 22 nt, Homo sapiens
caccuaauccaggcagauccag

SEQ ID NO: 692928 - RNA, 17 nt, Homo sapiens
caccuuuuauugacaca

SEQ ID NO: 692929 - RNA, 21 nt, Homo sapiens
cacuauuguuccagcaguuuu

SEQ ID NO: 692930 - RNA, 15 nt, Homo sapiens
cacucaguugcaacu

SEQ ID NO: 692931 - RNA, 16 nt, Homo sapiens
cacucuuuugcuuuau

SEQ ID NO: 692932 - RNA, 20 nt, Homo sapiens
cacugcugcuccagugcagg

SEQ ID NO: 692933 - RNA, 14 nt, Homo sapiens
cacuggaugcagaa

SEQ ID NO: 692934 - RNA, 21 nt, Homo sapiens
cacuguccugggccugcagaa

SEQ ID NO: 692935 - RNA, 14 nt, Homo sapiens
cacuuaugauuuca

SEQ ID NO: 692936 - RNA, 19 nt, Homo sapiens
cacuuaugauuucaugugc

SEQ ID NO: 692937 - RNA, 19 nt, Homo sapiens
cacuuugggaggcugaggc

SEQ ID NO: 692938 - RNA, 21 nt, Homo sapiens
cagaaagugugcuuuaugcug

SEQ ID NO: 692939 - RNA, 18 nt, Homo sapiens
cagaaugcugcaggacuu

SEQ ID NO: 692940 - RNA, 22 nt, Homo sapiens
cagaaugcugcaggacuugaga

SEQ ID NO: 692941 - RNA, 13 nt, Homo sapiens
cagacaugccaca

SEQ ID NO: 692942 - RNA, 13 nt, Homo sapiens
cagagacauacuu

SEQ ID NO: 692943 - RNA, 17 nt, Homo sapiens
cagagacauacuugaag

SEQ ID NO: 692944 - RNA, 15 nt, Homo sapiens
cagagaccauugcaa

SEQ ID NO: 692945 - RNA, 19 nt, Homo sapiens
cagagagccuggugcugcu

SEQ ID NO: 692946 - RNA, 16 nt, Homo sapiens
cagagcccagcuccaa

SEQ ID NO: 692947 - RNA, 22 nt, Homo sapiens
cagauccagggacugaagccaa

SEQ ID NO: 692948 - RNA, 12 nt, Homo sapiens
cagcacagccaa

SEQ ID NO: 692949 - RNA, 13 nt, Homo sapiens
cagcaggugcuga

SEQ ID NO: 692950 - RNA, 16 nt, Homo sapiens
cagccacgaggugcaa

SEQ ID NO: 692951 - RNA, 15 nt, Homo sapiens
cagccucccauccag

SEQ ID NO: 692952 - RNA, 16 nt, Homo sapiens
cagccuugccagagau

SEQ ID NO: 692953 - RNA, 23 nt, Homo sapiens
cagccuugccagagauccaaaag

SEQ ID NO: 692954 - RNA, 23 nt, Homo sapiens
caggaaccucuucagaaagugug

SEQ ID NO: 692955 - RNA, 16 nt, Homo sapiens
caggaauguguggccu

SEQ ID NO: 692956 - RNA, 16 nt, Homo sapiens
caggacagaugccaca

SEQ ID NO: 692957 - RNA, 15 nt, Homo sapiens
caggaggauggcaaa

SEQ ID NO: 692958 - RNA, 20 nt, Homo sapiens
caggaguguggccacguggg

SEQ ID NO: 692959 - RNA, 12 nt, Homo sapiens
caggcaccucac

SEQ ID NO: 692960 - RNA, 18 nt, Homo sapiens
cagggcagcgccaggcug

SEQ ID NO: 692961 - RNA, 20 nt, Homo sapiens
caggguuucaccauguugcc

SEQ ID NO: 692962 - RNA, 20 nt, Homo sapiens
cagguguuacuguaauuccu

SEQ ID NO: 692963 - RNA, 13 nt, Homo sapiens
cagucacagccac

SEQ ID NO: 692964 - RNA, 13 nt, Homo sapiens
cagucucacuuug

SEQ ID NO: 692965 - RNA, 20 nt, Homo sapiens
cagugagcugauaucaugcc

SEQ ID NO: 692966 - RNA, 18 nt, Homo sapiens
cagugaggcugcacccac

SEQ ID NO: 692967 - RNA, 17 nt, Homo sapiens
cauacuugaagggccag

SEQ ID NO: 692968 - RNA, 20 nt, Homo sapiens
cauaguaccauuuauacaaa

SEQ ID NO: 692969 - RNA, 17 nt, Homo sapiens
caucacugguugcacuu

SEQ ID NO: 692970 - RNA, 12 nt, Homo sapiens
cauccaaagcag

SEQ ID NO: 692971 - RNA, 21 nt, Homo sapiens
caucuauuuuggauuguauau

SEQ ID NO: 692972 - RNA, 22 nt, Homo sapiens
caucugugcacugcccauggac

SEQ ID NO: 692973 - RNA, 19 nt, Homo sapiens
caugagaugauacauccaa

SEQ ID NO: 692974 - RNA, 18 nt, Homo sapiens
caugauggcaacagaucu

SEQ ID NO: 692975 - RNA, 12 nt, Homo sapiens
cauggaugccaa

SEQ ID NO: 692976 - RNA, 16 nt, Homo sapiens
cauggugccccaggac

SEQ ID NO: 692977 - RNA, 21 nt, Homo sapiens
cauggugccccaggaccagcu

SEQ ID NO: 692978 - RNA, 18 nt, Homo sapiens
cuuuaugcugaaacagaa

SEQ ID NO: 692979 - RNA, 19 nt, Homo sapiens
cuuugggccagacaugcca

SEQ ID NO: 692980 - RNA, 21 nt, Homo sapiens
cuuuuagaaauacugcaagaa

SEQ ID NO: 692981 - RNA, 16 nt, Homo sapiens
cuuuuuacaauuaaaa

SEQ ID NO: 692982 - RNA, 12 nt, Homo sapiens
gaaacaacuugg

SEQ ID NO: 692983 - RNA, 17 nt, Homo sapiens
gaaacacagaaaccuuu

SEQ ID NO: 692984 - RNA, 17 nt, Homo sapiens
gaaaccuuauuguaccu

SEQ ID NO: 692985 - RNA, 20 nt, Homo sapiens
gaaaccuuauuguaccucuc

SEQ ID NO: 692986 - RNA, 20 nt, Homo sapiens
gaaauauggaacuuacauug

SEQ ID NO: 692987 - RNA, 17 nt, Homo sapiens
gaacaaagcagccacga

SEQ ID NO: 692988 - RNA, 13 nt, Homo sapiens
gaacucagaucca

SEQ ID NO: 692989 - RNA, 24 nt, Homo sapiens
gaacuuuaagcaacaagaccacca

SEQ ID NO: 692990 - RNA, 18 nt, Homo sapiens
gaagccacaggccugaga

SEQ ID NO: 692991 - RNA, 19 nt, Homo sapiens
gaagugcuggcaaccacua

SEQ ID NO: 692992 - RNA, 23 nt, Homo sapiens
gaauagaaauaaaggaugugauu

SEQ ID NO: 692993 - RNA, 17 nt, Homo sapiens
gaaucuacuaauuccac

SEQ ID NO: 692994 - RNA, 13 nt, Homo sapiens
gacacagaaaaug

SEQ ID NO: 692995 - RNA, 19 nt, Homo sapiens
gacacaggcccucccuguu

SEQ ID NO: 692996 - RNA, 14 nt, Homo sapiens
gacacuuaauacua

SEQ ID NO: 692997 - RNA, 22 nt, Homo sapiens
gacacuuaauacuaccuugaaa

SEQ ID NO: 692998 - RNA, 19 nt, Homo sapiens
gacagaugccacacaagga

SEQ ID NO: 692999 - RNA, 17 nt, Homo sapiens
gacagcuuugcugcuga

SEQ ID NO: 693000 - RNA, 16 nt, Homo sapiens
gacaguaucacugucu

SEQ ID NO: 693001 - RNA, 18 nt, Homo sapiens
gacaugauuuccuugaau

SEQ ID NO: 693002 - RNA, 14 nt, Homo sapiens
gaccugauccugga

SEQ ID NO: 693003 - RNA, 12 nt, Homo sapiens
gaccuggcacug

SEQ ID NO: 693004 - RNA, 15 nt, Homo sapiens
gacguagcugcaaag

SEQ ID NO: 693005 - RNA, 16 nt, Homo sapiens
gacuagaugauggaug

SEQ ID NO: 693006 - RNA, 18 nt, Homo sapiens
gacuuauuuaaacucugu

SEQ ID NO: 693007 - RNA, 23 nt, Homo sapiens
gagaaaccagggagccccuuuga

SEQ ID NO: 693008 - RNA, 14 nt, Homo sapiens
gagaacaaccaaaa

SEQ ID NO: 693009 - RNA, 22 nt, Homo sapiens
gagaagaaaacaucuauucucu

SEQ ID NO: 693010 - RNA, 18 nt, Homo sapiens
gagaagcuccucucccca

SEQ ID NO: 693011 - RNA, 22 nt, Homo sapiens
gagagucgcaucucagugcagg

SEQ ID NO: 693012 - RNA, 17 nt, Homo sapiens
gagcccauccagucucc

SEQ ID NO: 693013 - RNA, 16 nt, Homo sapiens
gagcuggggaucccuc

SEQ ID NO: 693014 - RNA, 19 nt, Homo sapiens
gaggacauaaugggguccu

SEQ ID NO: 693015 - RNA, 16 nt, Homo sapiens
gaggccacacucagca

SEQ ID NO: 693016 - RNA, 19 nt, Homo sapiens
gaggcggguggaucacuug

SEQ ID NO: 693017 - RNA, 20 nt, Homo sapiens
gaggcugcacccacccagga

SEQ ID NO: 693018 - RNA, 21 nt, Homo sapiens
gagggugaggggcuggcacug

SEQ ID NO: 693019 - RNA, 17 nt, Homo sapiens
gaguagaauugcauuga

SEQ ID NO: 693020 - RNA, 20 nt, Homo sapiens
gagucgcaucucagugcagg

SEQ ID NO: 693021 - RNA, 17 nt, Homo sapiens
gauacauacaccagcau

SEQ ID NO: 693022 - RNA, 23 nt, Homo sapiens
gauccaaaagaagcccccagcua

SEQ ID NO: 693023 - RNA, 23 nt, Homo sapiens
gaucuggaacccagacucagaca

SEQ ID NO: 693024 - RNA, 19 nt, Homo sapiens
gaucuguuuugaaggcaaa

SEQ ID NO: 693025 - RNA, 14 nt, Homo sapiens
gaugauacauccaa

SEQ ID NO: 693026 - RNA, 20 nt, Homo sapiens
gauggacagacucacaaccu

SEQ ID NO: 693027 - RNA, 14 nt, Homo sapiens
gauguuuccagacu

SEQ ID NO: 693028 - RNA, 19 nt, Homo sapiens
gauguuuccagacuuccuu

SEQ ID NO: 693029 - RNA, 19 nt, Homo sapiens
gauucugcaguaaaucuuu

SEQ ID NO: 693030 - RNA, 22 nt, Homo sapiens
gcaaaaggaucuuuguggccaa

SEQ ID NO: 693031 - RNA, 13 nt, Homo sapiens
gcaaaggacagau

SEQ ID NO: 693032 - RNA, 18 nt, Homo sapiens
gcaacaagaccaccacuu

SEQ ID NO: 693033 - RNA, 23 nt, Homo sapiens
gcaagguuuaggcugguggccca

SEQ ID NO: 693034 - RNA, 19 nt, Homo sapiens
gcaauaaaucugacccagu

SEQ ID NO: 693035 - RNA, 21 nt, Homo sapiens
gcaauaaaucugacccagugc

SEQ ID NO: 693036 - RNA, 22 nt, Homo sapiens
gcaaugaauccccaauaauugc

SEQ ID NO: 693037 - RNA, 18 nt, Homo sapiens
gcaaugagggagcaugua

SEQ ID NO: 693038 - RNA, 14 nt, Homo sapiens
gcacacagggcagu

SEQ ID NO: 693039 - RNA, 22 nt, Homo sapiens
gcacagggagacccguccauuu

SEQ ID NO: 693040 - RNA, 17 nt, Homo sapiens
gcacugcccauggacag

SEQ ID NO: 693041 - RNA, 19 nt, Homo sapiens
gcacugugacccccagcuc

SEQ ID NO: 693042 - RNA, 16 nt, Homo sapiens
gcacuuaugauuucau

SEQ ID NO: 693043 - RNA, 21 nt, Homo sapiens
gcagacagcuccacccuggcc

SEQ ID NO: 693044 - RNA, 22 nt, Homo sapiens
gcaggugcugacuucaucuccc

SEQ ID NO: 693045 - RNA, 21 nt, Homo sapiens
gcaguaucaugcccugugcaa

SEQ ID NO: 693046 - RNA, 21 nt, Homo sapiens
gcagugagcugauaucaugcc

SEQ ID NO: 693047 - RNA, 17 nt, Homo sapiens
gcagugugaaaaguccu

SEQ ID NO: 693048 - RNA, 13 nt, Homo sapiens
gccaaaaugcucu

SEQ ID NO: 693049 - RNA, 19 nt, Homo sapiens
gccaaccggucacccagga

SEQ ID NO: 693050 - RNA, 15 nt, Homo sapiens
gccagacaugccaca

SEQ ID NO: 693051 - RNA, 17 nt, Homo sapiens
gccagagauccaaaaga

SEQ ID NO: 693052 - RNA, 18 nt, Homo sapiens
gccagcacacagggcagu

SEQ ID NO: 693053 - RNA, 18 nt, Homo sapiens
gccagggcaaugaugaau

SEQ ID NO: 693054 - RNA, 22 nt, Homo sapiens
gccaugagaugauacauccaaa

SEQ ID NO: 693055 - RNA, 15 nt, Homo sapiens
gcccagagcccagcu

SEQ ID NO: 693056 - RNA, 12 nt, Homo sapiens
aaaaagcuucca

SEQ ID NO: 693057 - RNA, 15 nt, Homo sapiens
aaaaauagacacucc

SEQ ID NO: 693058 - RNA, 14 nt, Homo sapiens
aaaacuacaaauca

SEQ ID NO: 693059 - RNA, 21 nt, Homo sapiens
aaaauuagccgggcauggugg

SEQ ID NO: 693060 - RNA, 19 nt, Homo sapiens
aaacgucuucuaaacuucc

SEQ ID NO: 693061 - RNA, 18 nt, Homo sapiens
aaagagagucgcaucuca

SEQ ID NO: 693062 - RNA, 19 nt, Homo sapiens
aaagagagucgcaucucag

SEQ ID NO: 693063 - RNA, 12 nt, Homo sapiens
aaagcagccacg

SEQ ID NO: 693064 - RNA, 16 nt, Homo sapiens
aaagcagccacgaggu

SEQ ID NO: 693065 - RNA, 16 nt, Homo sapiens
aaaguauucuguacuc

SEQ ID NO: 693066 - RNA, 15 nt, Homo sapiens
aaauagaggcuaaau

SEQ ID NO: 693067 - RNA, 15 nt, Homo sapiens
aaaugagccaugaga

SEQ ID NO: 693068 - RNA, 14 nt, Homo sapiens
aacaccaagcacag

SEQ ID NO: 693069 - RNA, 13 nt, Homo sapiens
aacacugcugcuc

SEQ ID NO: 693070 - RNA, 21 nt, Homo sapiens
aacacugcugcuccagugcag

SEQ ID NO: 693071 - RNA, 23 nt, Homo sapiens
aacagaagccugaugcugacauu

SEQ ID NO: 693072 - RNA, 17 nt, Homo sapiens
aaccaucacugguugca

SEQ ID NO: 693073 - RNA, 20 nt, Homo sapiens
aacccaggagauggaaguug

SEQ ID NO: 693074 - RNA, 18 nt, Homo sapiens
aacccuggugguugcugu

SEQ ID NO: 693075 - RNA, 21 nt, Homo sapiens
aaccucauuccccaaccacuu

SEQ ID NO: 693076 - RNA, 17 nt, Homo sapiens
aacuagaauuuauucaa

SEQ ID NO: 693077 - RNA, 19 nt, Homo sapiens
aacuagcucuauguuuaca

SEQ ID NO: 693078 - RNA, 18 nt, Homo sapiens
aacucaaauggggccaga

SEQ ID NO: 693079 - RNA, 23 nt, Homo sapiens
aacucaaauggggccagauccag

SEQ ID NO: 693080 - RNA, 13 nt, Homo sapiens
aacucagauccag

SEQ ID NO: 693081 - RNA, 19 nt, Homo sapiens
aacugccucgaaacacaga

SEQ ID NO: 693082 - RNA, 20 nt, Homo sapiens
aacugguauuuuaucuuuga

SEQ ID NO: 693083 - RNA, 20 nt, Homo sapiens
aacugucacucauugcugag

SEQ ID NO: 693084 - RNA, 19 nt, Homo sapiens
aagaaaacaucuauucucu

SEQ ID NO: 693085 - RNA, 13 nt, Homo sapiens
aagaaccucucac

SEQ ID NO: 693086 - RNA, 12 nt, Homo sapiens
aagaaccuggaa

SEQ ID NO: 693087 - RNA, 23 nt, Homo sapiens
aagaauucaaacuggggccucca

SEQ ID NO: 693088 - RNA, 20 nt, Homo sapiens
aagacaugauuuccuugaau

SEQ ID NO: 693089 - RNA, 13 nt, Homo sapiens
aagaccaccacuu

SEQ ID NO: 693090 - RNA, 20 nt, Homo sapiens
aagaccuggcagcucuggac

SEQ ID NO: 693091 - RNA, 21 nt, Homo sapiens
aagacuggaagcuaauuugca

SEQ ID NO: 693092 - RNA, 19 nt, Homo sapiens
aagccaauucagacaggca

SEQ ID NO: 693093 - RNA, 21 nt, Homo sapiens
aagccaauucagacaggcaaa

SEQ ID NO: 693094 - RNA, 18 nt, Homo sapiens
aagguccucugucaguca

SEQ ID NO: 693095 - RNA, 18 nt, Homo sapiens
aagugugcuuuaugcuga

SEQ ID NO: 693096 - RNA, 22 nt, Homo sapiens
aaguuaugcaagggacugugug

SEQ ID NO: 693097 - RNA, 18 nt, Homo sapiens
aauacuuuuuacaauuaa

SEQ ID NO: 693098 - RNA, 16 nt, Homo sapiens
aauagccacauuugga

SEQ ID NO: 693099 - RNA, 15 nt, Homo sapiens
aauauuuaucugauu

SEQ ID NO: 693100 - RNA, 17 nt, Homo sapiens
aauauuuaucugauuaa

SEQ ID NO: 693101 - RNA, 22 nt, Homo sapiens
aaucaaguauuugggaagugaa

SEQ ID NO: 693102 - RNA, 20 nt, Homo sapiens
aauccaaauggcgucuggaa

SEQ ID NO: 693103 - RNA, 20 nt, Homo sapiens
aauccccaauaauugcagaa

SEQ ID NO: 693104 - RNA, 15 nt, Homo sapiens
aaucuacuaauucca

SEQ ID NO: 693105 - RNA, 17 nt, Homo sapiens
aaucuugcucugcuuga

SEQ ID NO: 693106 - RNA, 20 nt, Homo sapiens
aaucuugcucugcuugacaa

SEQ ID NO: 693107 - RNA, 22 nt, Homo sapiens
aaugaacacucuuuugcuuuau

SEQ ID NO: 693108 - RNA, 22 nt, Homo sapiens
aauuccacaccuuuuauugaca

SEQ ID NO: 693109 - RNA, 20 nt, Homo sapiens
aauuuaucuugucucugggc

SEQ ID NO: 693110 - RNA, 23 nt, Homo sapiens
acaccacaucuaagccugaaggg

SEQ ID NO: 693111 - RNA, 18 nt, Homo sapiens
acaccuuuuauugacaca

SEQ ID NO: 693112 - RNA, 19 nt, Homo sapiens
acacgcaccugccucagga

SEQ ID NO: 693113 - RNA, 12 nt, Homo sapiens
auuagcugugau

SEQ ID NO: 693114 - RNA, 18 nt, Homo sapiens
auucauuagcugugauuu

SEQ ID NO: 693115 - RNA, 20 nt, Homo sapiens
auuccucccaccccaagcaa

SEQ ID NO: 693116 - RNA, 23 nt, Homo sapiens
auugaauuauuuuguuacugucu

SEQ ID NO: 693117 - RNA, 15 nt, Homo sapiens
auugagauuuaauuc

SEQ ID NO: 693118 - RNA, 12 nt, Homo sapiens
auugcaugacuu

SEQ ID NO: 693119 - RNA, 18 nt, Homo sapiens
auuguggugugagcuuca

SEQ ID NO: 693120 - RNA, 22 nt, Homo sapiens
auuuucauguucuugcagucau

SEQ ID NO: 693121 - RNA, 23 nt, Homo sapiens
auuuugucugcuuaguaucucau

SEQ ID NO: 693122 - RNA, 14 nt, Homo sapiens
caaaaaaaccacaa

SEQ ID NO: 693123 - RNA, 16 nt, Homo sapiens
caaacccaacucuaau

SEQ ID NO: 693124 - RNA, 15 nt, Homo sapiens
caaauaaauaucauc

SEQ ID NO: 693125 - RNA, 16 nt, Homo sapiens
caacccugagcacucu

SEQ ID NO: 693126 - RNA, 20 nt, Homo sapiens
caacccugagcacucuuauc

SEQ ID NO: 693127 - RNA, 18 nt, Homo sapiens
caagaaagauaucuauga

SEQ ID NO: 693128 - RNA, 19 nt, Homo sapiens
caaggaacaaaaaaaccac

SEQ ID NO: 693129 - RNA, 17 nt, Homo sapiens
cacaagcagagugcaca

SEQ ID NO: 693130 - RNA, 16 nt, Homo sapiens
cacucuuaucaauccc

SEQ ID NO: 693131 - RNA, 17 nt, Homo sapiens
cacugaaagacaccauu

SEQ ID NO: 693132 - RNA, 17 nt, Homo sapiens
cacuucagaauuccaua

SEQ ID NO: 693133 - RNA, 18 nt, Homo sapiens
cacuucagaauuccauau

SEQ ID NO: 693134 - RNA, 23 nt, Homo sapiens
cagaacccagggcucugccccag

SEQ ID NO: 693135 - RNA, 14 nt, Homo sapiens
cagaccaccaucca

SEQ ID NO: 693136 - RNA, 19 nt, Homo sapiens
cagccacacccaggcacuu

SEQ ID NO: 693137 - RNA, 20 nt, Homo sapiens
cagccccuagaaacccaagc

SEQ ID NO: 693138 - RNA, 20 nt, Homo sapiens
cagcuguccacugggccauu

SEQ ID NO: 693139 - RNA, 14 nt, Homo sapiens
cagcuuuugccuuu

SEQ ID NO: 693140 - RNA, 20 nt, Homo sapiens
ugaaagacaccauuuaucua

SEQ ID NO: 693141 - RNA, 20 nt, Homo sapiens
ugaagcuuuuuguugccuua

SEQ ID NO: 693142 - RNA, 14 nt, Homo sapiens
ugaauugcaugacu

SEQ ID NO: 693143 - RNA, 17 nt, Homo sapiens
ugacaaugacugugcua

SEQ ID NO: 693144 - RNA, 14 nt, Homo sapiens
ugacacaauuggaa

SEQ ID NO: 693145 - RNA, 13 nt, Homo sapiens
ugauucaaauggg

SEQ ID NO: 693146 - RNA, 16 nt, Homo sapiens
ugcaaaauagacauau

SEQ ID NO: 693147 - RNA, 24 nt, Homo sapiens
ugcuaauuaaaaaguuaaucuuca

SEQ ID NO: 693148 - RNA, 17 nt, Homo sapiens
ugcuucaguacuuguga

SEQ ID NO: 693149 - RNA, 12 nt, Homo sapiens
uggauaugugua

SEQ ID NO: 693150 - RNA, 12 nt, Homo sapiens
uggaucugugug

SEQ ID NO: 693151 - RNA, 18 nt, Homo sapiens
uggcauuguugaugcuca

SEQ ID NO: 693152 - RNA, 19 nt, Homo sapiens
uguaaaaagaaaaaccacu

SEQ ID NO: 693153 - RNA, 17 nt, Homo sapiens
uguaaaacgcugucaaa

SEQ ID NO: 693154 - RNA, 13 nt, Homo sapiens
uguaaauguuaug

SEQ ID NO: 693155 - RNA, 21 nt, Homo sapiens
uguaaauugagauuuaauucc

SEQ ID NO: 693156 - RNA, 15 nt, Homo sapiens
uguacaggcagauga

SEQ ID NO: 693157 - RNA, 16 nt, Homo sapiens
uguacaggcagaugaa

SEQ ID NO: 693158 - RNA, 15 nt, Homo sapiens
ugucagaaugcuauu

SEQ ID NO: 693159 - RNA, 17 nt, Homo sapiens
ugucagaaugcuauuga

SEQ ID NO: 693160 - RNA, 20 nt, Homo sapiens
ugugaacucucagacaucuc

SEQ ID NO: 693161 - RNA, 16 nt, Homo sapiens
uguggcuaaaugccua

SEQ ID NO: 693162 - RNA, 17 nt, Homo sapiens
ugugugggugugugaga

SEQ ID NO: 693163 - RNA, 19 nt, Homo sapiens
uguuaacacuguaauaucu

SEQ ID NO: 693164 - RNA, 13 nt, Homo sapiens
uuaagcacaagca

SEQ ID NO: 693165 - RNA, 18 nt, Homo sapiens
uuaauuacccuacuuuca

SEQ ID NO: 693166 - RNA, 16 nt, Homo sapiens
uuacuauucauuaaau

SEQ ID NO: 693167 - RNA, 21 nt, Homo sapiens
uuauccagaggguugugauuu

SEQ ID NO: 693168 - RNA, 16 nt, Homo sapiens
uuaugacuccuugaua

SEQ ID NO: 693169 - RNA, 22 nt, Homo sapiens
uucaagaaagauaucuaugacu

SEQ ID NO: 693170 - RNA, 18 nt, Homo sapiens
uucacccuuaacccaagg

SEQ ID NO: 693171 - RNA, 14 nt, Homo sapiens
uucacgcaacuuga

SEQ ID NO: 693172 - RNA, 18 nt, Homo sapiens
uucagauggugaagcauu

SEQ ID NO: 693173 - RNA, 19 nt, Homo sapiens
uucaguguguugacuucua

SEQ ID NO: 693174 - RNA, 22 nt, Homo sapiens
uucauuaauuacccuacuuuca

SEQ ID NO: 693175 - RNA, 22 nt, Homo sapiens
uucauuuccucugagcuguuau

SEQ ID NO: 693176 - RNA, 17 nt, Homo sapiens
uuccaaaccaacaaacc

SEQ ID NO: 693177 - RNA, 14 nt, Homo sapiens
uucccaaauguauu

SEQ ID NO: 693178 - RNA, 20 nt, Homo sapiens
uuccccuugccuuaucccau

SEQ ID NO: 693179 - RNA, 19 nt, Homo sapiens
uugaaauuauaucuguggu

SEQ ID NO: 693180 - RNA, 22 nt, Homo sapiens
uugauaaaaaauuuauuauguc

SEQ ID NO: 693181 - RNA, 23 nt, Homo sapiens
uugauaaaaaauuuauuaugucc

SEQ ID NO: 693182 - RNA, 14 nt, Homo sapiens
uugauuaaaacauu

SEQ ID NO: 693183 - RNA, 22 nt, Homo sapiens
uugucauguggcuaaaugccua

SEQ ID NO: 693184 - RNA, 21 nt, Homo sapiens
uuguugaugcucacauaugau

SEQ ID NO: 693185 - RNA, 20 nt, Homo sapiens
uuucagaauuuaaucuuuga

SEQ ID NO: 693186 - RNA, 19 nt, Homo sapiens
uuucccuguagauguauca

SEQ ID NO: 693187 - RNA, 21 nt, Homo sapiens
uuucgcacaaugggaaucucu

SEQ ID NO: 693188 - RNA, 12 nt, Homo sapiens
uuuguuguaaaa

SEQ ID NO: 693189 - RNA, 20 nt, Homo sapiens
aaaaaaguguccuauaauuc

SEQ ID NO: 693190 - RNA, 17 nt, Homo sapiens
aaaaaguuaaucuucau

SEQ ID NO: 693191 - RNA, 21 nt, Homo sapiens
ucaucaacaaagaaauauuau

SEQ ID NO: 693192 - RNA, 12 nt, Homo sapiens
ucauggaacuca

SEQ ID NO: 693193 - RNA, 13 nt, Homo sapiens
ucauguucuugca

SEQ ID NO: 693194 - RNA, 14 nt, Homo sapiens
ucauuagcugugau

SEQ ID NO: 693195 - RNA, 16 nt, Homo sapiens
uccaaaccaacaaacc

SEQ ID NO: 693196 - RNA, 13 nt, Homo sapiens
uccacaacucaag

SEQ ID NO: 693197 - RNA, 18 nt, Homo sapiens
uccacccccaagcacucc

SEQ ID NO: 693198 - RNA, 16 nt, Homo sapiens
uccagaggguugugau

SEQ ID NO: 693199 - RNA, 13 nt, Homo sapiens
ucccaacauuucu

SEQ ID NO: 693200 - RNA, 20 nt, Homo sapiens
uccccaacccugagcacucu

SEQ ID NO: 693201 - RNA, 13 nt, Homo sapiens
uccccuugccuua

SEQ ID NO: 693202 - RNA, 21 nt, Homo sapiens
ucccuuccgacccucugggaa

SEQ ID NO: 693203 - RNA, 17 nt, Homo sapiens
uccgcacuucagaauuc

SEQ ID NO: 693204 - RNA, 20 nt, Homo sapiens
uccuguuaacacuguaauau

SEQ ID NO: 693205 - RNA, 17 nt, Homo sapiens
ucgcuuguaaauaccag

SEQ ID NO: 693206 - RNA, 19 nt, Homo sapiens
ucgcuuguaaauaccagga

SEQ ID NO: 693207 - RNA, 13 nt, Homo sapiens
ucuaacgcuuuaa

SEQ ID NO: 693208 - RNA, 23 nt, Homo sapiens
ucuaauggcuguggcauuguuga

SEQ ID NO: 693209 - RNA, 14 nt, Homo sapiens
ucuacuuguucuaa

SEQ ID NO: 693210 - RNA, 23 nt, Homo sapiens
ucucaucaacaaagaaauauuau

SEQ ID NO: 693211 - RNA, 14 nt, Homo sapiens
ucugccccagucgu

SEQ ID NO: 693212 - RNA, 18 nt, Homo sapiens
ucuggugaguuaaugggg

SEQ ID NO: 693213 - RNA, 15 nt, Homo sapiens
ucuuaucaaucccaa

SEQ ID NO: 693214 - RNA, 21 nt, Homo sapiens
ucuuuaauuucugucagaaug

SEQ ID NO: 693215 - RNA, 15 nt, Homo sapiens
ugaaauuauaucugu

SEQ ID NO: 693216 - RNA, 20 nt, Homo sapiens
ugaacuuguagcuguaaaac

SEQ ID NO: 693217 - RNA, 19 nt, Homo sapiens
ugaagcuuuuuguugccuu

SEQ ID NO: 693218 - RNA, 12 nt, Homo sapiens
ugaauauacaga

SEQ ID NO: 693219 - RNA, 19 nt, Homo sapiens
ugaauauacagaaguucca

SEQ ID NO: 693220 - RNA, 19 nt, Homo sapiens
ugacaaaucuguguauauu

SEQ ID NO: 693221 - RNA, 15 nt, Homo sapiens
ugagacugaguucua

SEQ ID NO: 693222 - RNA, 13 nt, Homo sapiens
ugagcuguuaucu

SEQ ID NO: 693223 - RNA, 19 nt, Homo sapiens
uggaaaaauguuugucuca

SEQ ID NO: 693224 - RNA, 23 nt, Homo sapiens
uggacaaagggaaauacucuuaa

SEQ ID NO: 693225 - RNA, 23 nt, Homo sapiens
uggaugugguuuaauuguuuguc

SEQ ID NO: 693226 - RNA, 20 nt, Homo sapiens
uggggacccaggcuccgccc

SEQ ID NO: 693227 - RNA, 20 nt, Homo sapiens
uggguccuaauuaccagucu

SEQ ID NO: 693228 - RNA, 18 nt, Homo sapiens
uguaaaaagaaaaaccac

SEQ ID NO: 693229 - RNA, 15 nt, Homo sapiens
uguauauuauuuggc

SEQ ID NO: 693230 - RNA, 13 nt, Homo sapiens
uguauggauaugu

SEQ ID NO: 693231 - RNA, 18 nt, Homo sapiens
ugucacugacacaaagga

SEQ ID NO: 693232 - RNA, 18 nt, Homo sapiens
ugucuuuaauuucuguca

SEQ ID NO: 693233 - RNA, 23 nt, Homo sapiens
ugugagacugaguucuauauucu

SEQ ID NO: 693234 - RNA, 20 nt, Homo sapiens
ugugagagagcggcugguuc

SEQ ID NO: 693235 - RNA, 19 nt, Homo sapiens
uguguaaauguuaugacuc

SEQ ID NO: 693236 - RNA, 13 nt, Homo sapiens
ugugugugugaau

SEQ ID NO: 693237 - RNA, 15 nt, Homo sapiens
uguugacuucuaucc

SEQ ID NO: 693238 - RNA, 17 nt, Homo sapiens
uguuugacacaauugga

SEQ ID NO: 693239 - RNA, 18 nt, Homo sapiens
uguuugacacaauuggaa

SEQ ID NO: 693240 - RNA, 14 nt, Homo sapiens
uuaacacuguaaua

SEQ ID NO: 693241 - RNA, 14 nt, Homo sapiens
uuaauaguauaucu

SEQ ID NO: 693242 - RNA, 15 nt, Homo sapiens
uuacgauuaguauau

SEQ ID NO: 693243 - RNA, 20 nt, Homo sapiens
uuauuauguccauuauucaa

SEQ ID NO: 693244 - RNA, 17 nt, Homo sapiens
uucacugaaagacacca

SEQ ID NO: 693245 - RNA, 22 nt, Homo sapiens
uucccaaauguauucuacuugu

SEQ ID NO: 693246 - RNA, 21 nt, Homo sapiens
uugcaugacuuguagcauauu

SEQ ID NO: 693247 - RNA, 22 nt, Homo sapiens
uuggacuauccgaagagaucca

SEQ ID NO: 693248 - RNA, 18 nt, Homo sapiens
uuuaaauggcuacuuugg

SEQ ID NO: 693249 - RNA, 24 nt, Homo sapiens
uuuauuacgauuaguauaugauca

SEQ ID NO: 693250 - RNA, 13 nt, Homo sapiens
uuucaauuuauca

SEQ ID NO: 693251 - RNA, 23 nt, Homo sapiens
uuuccacgcuagggcggggcaca

SEQ ID NO: 693252 - RNA, 17 nt, Homo sapiens
uuuuccccuugccuuau

SEQ ID NO: 693253 - RNA, 21 nt, Homo sapiens
uuuugucugcuuaguaucuca

SEQ ID NO: 693254 - RNA, 22 nt, Homo sapiens
uuuugucugcuuaguaucucau

SEQ ID NO: 693255 - RNA, 14 nt, Homo sapiens
cagggcaaucaaug

SEQ ID NO: 693256 - RNA, 14 nt, Homo sapiens
caguccugcuccag

SEQ ID NO: 693257 - RNA, 14 nt, Homo sapiens
cauauacuagggaa

SEQ ID NO: 693258 - RNA, 15 nt, Homo sapiens
cauauuaacaugcuu

SEQ ID NO: 693259 - RNA, 15 nt, Homo sapiens
caucucggagcaucc

SEQ ID NO: 693260 - RNA, 19 nt, Homo sapiens
cauguggcuaaaugccuaa

SEQ ID NO: 693261 - RNA, 14 nt, Homo sapiens
ccaaaguuauccag

SEQ ID NO: 693262 - RNA, 20 nt, Homo sapiens
ccaacaaacccaacucuaau

SEQ ID NO: 693263 - RNA, 22 nt, Homo sapiens
ccaaggaacaaaaaaaccacaa

SEQ ID NO: 693264 - RNA, 21 nt, Homo sapiens
ccacaaaggccaaacugcugg

SEQ ID NO: 693265 - RNA, 21 nt, Homo sapiens
ccacgcuagggcggggcacag

SEQ ID NO: 693266 - RNA, 23 nt, Homo sapiens
ccacgcuagggcggggcacagau

SEQ ID NO: 693267 - RNA, 17 nt, Homo sapiens
ccagaggguugugauuu

SEQ ID NO: 693268 - RNA, 17 nt, Homo sapiens
ccagcccaaaggggaca

SEQ ID NO: 693269 - RNA, 16 nt, Homo sapiens
ccagcuuguaggagcu

SEQ ID NO: 693270 - RNA, 13 nt, Homo sapiens
cccaaauguauuc

SEQ ID NO: 693271 - RNA, 18 nt, Homo sapiens
cccaagcacuccacaacu

SEQ ID NO: 693272 - RNA, 14 nt, Homo sapiens
cccucugggaaccu

SEQ ID NO: 693273 - RNA, 16 nt, Homo sapiens
ccgcuuguggggaccc

SEQ ID NO: 693274 - RNA, 22 nt, Homo sapiens
ccuccagcccgggagccuagga

SEQ ID NO: 693275 - RNA, 16 nt, Homo sapiens
ccucugggaaccuccc

SEQ ID NO: 693276 - RNA, 15 nt, Homo sapiens
ccugagcacucuuau

SEQ ID NO: 693277 - RNA, 13 nt, Homo sapiens
cgcugucaaaagu

SEQ ID NO: 693278 - RNA, 15 nt, Homo sapiens
cuagagccagaccaa

SEQ ID NO: 693279 - RNA, 17 nt, Homo sapiens
cuaguuucugugugaac

SEQ ID NO: 693280 - RNA, 16 nt, Homo sapiens
cuauaauucuauugaa

SEQ ID NO: 693281 - RNA, 13 nt, Homo sapiens
cucacugauauau

SEQ ID NO: 693282 - RNA, 18 nt, Homo sapiens
cucagccccuaggaguau

SEQ ID NO: 693283 - RNA, 16 nt, Homo sapiens
cucugagcuguuaucu

SEQ ID NO: 693284 - RNA, 18 nt, Homo sapiens
cucugcuuugucaugcca

SEQ ID NO: 693285 - RNA, 21 nt, Homo sapiens
cucuggacucuaaagaccaaa

SEQ ID NO: 693286 - RNA, 20 nt, Homo sapiens
cucuuaucaaucccaaccau

SEQ ID NO: 693287 - RNA, 14 nt, Homo sapiens
cugcaggaaucaaa

SEQ ID NO: 693288 - RNA, 13 nt, Homo sapiens
cuggccgccuagg

SEQ ID NO: 693289 - RNA, 22 nt, Homo sapiens
cugggaaccucccagaggucca

SEQ ID NO: 693290 - RNA, 17 nt, Homo sapiens
cuguccacugggccauu

SEQ ID NO: 693291 - RNA, 19 nt, Homo sapiens
cuguggcuucccaugucuu

SEQ ID NO: 693292 - RNA, 14 nt, Homo sapiens
cugugugugggugu

SEQ ID NO: 693293 - RNA, 12 nt, Homo sapiens
cuuacuauucau

SEQ ID NO: 693294 - RNA, 22 nt, Homo sapiens
cuuaguaucucaucaacaaaga

SEQ ID NO: 693295 - RNA, 18 nt, Homo sapiens
cuuauguagauauuuggc

SEQ ID NO: 693296 - RNA, 23 nt, Homo sapiens
cuucaaauugucuuuugucaugu

SEQ ID NO: 693297 - RNA, 19 nt, Homo sapiens
cuucacugaaagacaccau

SEQ ID NO: 693298 - RNA, 14 nt, Homo sapiens
cuucagaauuccau

SEQ ID NO: 693299 - RNA, 14 nt, Homo sapiens
cuucauacuuugaa

SEQ ID NO: 693300 - RNA, 21 nt, Homo sapiens
cuuccauauuugccuugggaa

SEQ ID NO: 693301 - RNA, 21 nt, Homo sapiens
cuucccaugucuuucuccaaa

SEQ ID NO: 693302 - RNA, 16 nt, Homo sapiens
cuugaaauuauaucug

SEQ ID NO: 693303 - RNA, 19 nt, Homo sapiens
cuugauaaaaaauuuauua

SEQ ID NO: 693304 - RNA, 12 nt, Homo sapiens
cuuguagcauau

SEQ ID NO: 693305 - RNA, 22 nt, Homo sapiens
cuuuuuguugauuccaaaccaa

SEQ ID NO: 693306 - RNA, 14 nt, Homo sapiens
gaaagccucacuga

SEQ ID NO: 693307 - RNA, 23 nt, Homo sapiens
gaagaaacgcuuggagugcuucu

SEQ ID NO: 693308 - RNA, 17 nt, Homo sapiens
gaagcaaauaaauauca

SEQ ID NO: 693309 - RNA, 14 nt, Homo sapiens
gaauuuggaaaucc

SEQ ID NO: 693310 - RNA, 22 nt, Homo sapiens
gacacaauuggaauugucuuua

SEQ ID NO: 693311 - RNA, 13 nt, Homo sapiens
gacccucugggaa

SEQ ID NO: 693312 - RNA, 20 nt, Homo sapiens
gacugcaaacauguugccuc

SEQ ID NO: 693313 - RNA, 13 nt, Homo sapiens
gacuuugcugauu

SEQ ID NO: 693314 - RNA, 22 nt, Homo sapiens
gagauccacccccaagcacucc

SEQ ID NO: 693315 - RNA, 13 nt, Homo sapiens
gagcacucuuauc

SEQ ID NO: 693316 - RNA, 18 nt, Homo sapiens
gaggacucgcuuguaaau

SEQ ID NO: 693317 - RNA, 13 nt, Homo sapiens
gagugcacagcug

SEQ ID NO: 693318 - RNA, 15 nt, Homo sapiens
gauagcucauauuau

SEQ ID NO: 693319 - RNA, 13 nt, Homo sapiens
gauaucuaugacu

SEQ ID NO: 693320 - RNA, 17 nt, Homo sapiens
gaugcucacauaugaua

SEQ ID NO: 693321 - RNA, 14 nt, Homo sapiens
gcacuucagaauuc

SEQ ID NO: 693322 - RNA, 18 nt, Homo sapiens
gccaucacaugaucuguu

SEQ ID NO: 693323 - RNA, 12 nt, Homo sapiens
gccucaccucua

SEQ ID NO: 693324 - RNA, 18 nt, Homo sapiens
gccucccagcuucuuaua

SEQ ID NO: 693325 - RNA, 18 nt, Homo sapiens
gccucgauuuugcacuuu

SEQ ID NO: 693326 - RNA, 23 nt, Homo sapiens
gccuucauggaacucagcugucu

SEQ ID NO: 693327 - RNA, 18 nt, Homo sapiens
gcgaggggugaguguuca

SEQ ID NO: 693328 - RNA, 20 nt, Homo sapiens
gcuucccaugucuuucucca

SEQ ID NO: 693329 - RNA, 16 nt, Homo sapiens
ggaauaagaagcaaau

SEQ ID NO: 693330 - RNA, 23 nt, Homo sapiens
ggauauguguaaauguuaugacu

SEQ ID NO: 693331 - RNA, 18 nt, Homo sapiens
ggccccuuuaacucuuau

SEQ ID NO: 693332 - RNA, 17 nt, Homo sapiens
ggugaguguucagagag

SEQ ID NO: 693333 - RNA, 16 nt, Homo sapiens
guaauaaauuguuauu

SEQ ID NO: 693334 - RNA, 16 nt, Homo sapiens
guaaucuguacauuuu

SEQ ID NO: 693335 - RNA, 23 nt, Homo sapiens
guacagucuguaucaaacccacg

SEQ ID NO: 693336 - RNA, 12 nt, Homo sapiens
guccagcccauc

SEQ ID NO: 693337 - RNA, 18 nt, Homo sapiens
guccuauaauucuauuga

SEQ ID NO: 693338 - RNA, 14 nt, Homo sapiens
gucuguaguguuuu

SEQ ID NO: 693339 - RNA, 13 nt, Homo sapiens
gugaacucucaga

SEQ ID NO: 693340 - RNA, 15 nt, Homo sapiens
guuuaauaguauauc

SEQ ID NO: 693341 - RNA, 19 nt, Homo sapiens
guuuagaccaaggaacaaa

SEQ ID NO: 693342 - RNA, 14 nt, Homo sapiens
guuucugucuguaa

SEQ ID NO: 693343 - RNA, 16 nt, Homo sapiens
uaaaacaaucugucca

SEQ ID NO: 693344 - RNA, 13 nt, Homo sapiens
uaaauguuugaca

SEQ ID NO: 693345 - RNA, 20 nt, Homo sapiens
uaagaagcaaauaaauauca

SEQ ID NO: 693346 - RNA, 21 nt, Homo sapiens
uaauuaaaaaguuaaucuuca

SEQ ID NO: 693347 - RNA, 14 nt, Homo sapiens
uaccaccuacugau

SEQ ID NO: 693348 - RNA, 19 nt, Homo sapiens
uagaacuuacuauucauua

SEQ ID NO: 693349 - RNA, 22 nt, Homo sapiens
uaguagacauguguguguguga

SEQ ID NO: 693350 - RNA, 21 nt, Homo sapiens
uauauacccccccaugcaguc

SEQ ID NO: 693351 - RNA, 18 nt, Homo sapiens
uauaucagcuuuugccuu

SEQ ID NO: 693352 - RNA, 17 nt, Homo sapiens
uaucaaucccaaccauc

SEQ ID NO: 693353 - RNA, 19 nt, Homo sapiens
uauccagaggguugugauu

SEQ ID NO: 693354 - RNA, 12 nt, Homo sapiens
uaucuaugacug

SEQ ID NO: 693355 - RNA, 13 nt, Homo sapiens
uauuauguccauu

SEQ ID NO: 693356 - RNA, 19 nt, Homo sapiens
uauucaagaaagauaucua

SEQ ID NO: 693357 - RNA, 22 nt, Homo sapiens
ucaaacuuccauauuugccuug

SEQ ID NO: 693358 - RNA, 15 nt, Homo sapiens
ucacccuuaacccaa

SEQ ID NO: 693359 - RNA, 23 nt, Homo sapiens
ucaguacuugugaaacacagcug

SEQ ID NO: 693360 - RNA, 20 nt, Homo sapiens
ucaguccugcuccagaauuu

SEQ ID NO: 693361 - RNA, 15 nt, Homo sapiens
ucauuaaauguuuga

SEQ ID NO: 693362 - RNA, 19 nt, Homo sapiens
uccauugguggacagccuu

SEQ ID NO: 693363 - RNA, 23 nt, Homo sapiens
uccccaacccugagcacucuuau

SEQ ID NO: 693364 - RNA, 16 nt, Homo sapiens
uccugccuucauggaa

SEQ ID NO: 693365 - RNA, 10 nt, Homo sapiens
uccuuuuugu

SEQ ID NO: 693366 - RNA, 19 nt, Homo sapiens
uccuuuuuguugauuccaa

SEQ ID NO: 693367 - RNA, 18 nt, Homo sapiens
ucuaauggcuguggcauu

SEQ ID NO: 693368 - RNA, 19 nt, Homo sapiens
ucuccagcucagaacccag

SEQ ID NO: 693369 - RNA, 22 nt, Homo sapiens
ucuccccaguguaugucuugua

SEQ ID NO: 693370 - RNA, 16 nt, Homo sapiens
ucugccccagucguua

SEQ ID NO: 693371 - RNA, 23 nt, Homo sapiens
ucuguuuuucaccacuucacuga

SEQ ID NO: 693372 - RNA, 19 nt, Homo sapiens
ucuuuggaaaaauguuugu

SEQ ID NO: 693373 - RNA, 22 nt, Homo sapiens
ugaaaaugugaauugcaugacu

SEQ ID NO: 693374 - RNA, 14 nt, Homo sapiens
ugaagagagauaua

SEQ ID NO: 693375 - RNA, 22 nt, Homo sapiens
ugaagccagcugcaggaaucaa

SEQ ID NO: 693376 - RNA, 21 nt, Homo sapiens
ugaagcuuuuuguugccuuau

SEQ ID NO: 693377 - RNA, 16 nt, Homo sapiens
ugaauaaaaacuuugc

SEQ ID NO: 693378 - RNA, 17 nt, Homo sapiens
ugaauagcucucugugu

SEQ ID NO: 693379 - RNA, 18 nt, Homo sapiens
ugaauagcucucugugug

SEQ ID NO: 693380 - RNA, 18 nt, Homo sapiens
ugaauugcaugacuugua

SEQ ID NO: 693381 - RNA, 21 nt, Homo sapiens
ugacaaugacugugcuacugu

SEQ ID NO: 693382 - RNA, 21 nt, Homo sapiens
ugacauggcucuggacucuaa

SEQ ID NO: 693383 - RNA, 14 nt, Homo sapiens
ugagcacucuuauc

SEQ ID NO: 693384 - RNA, 16 nt, Homo sapiens
ugaugcucacauauga

SEQ ID NO: 693385 - RNA, 17 nt, Homo sapiens
aaaaaauuuauuauguc

SEQ ID NO: 693386 - RNA, 21 nt, Homo sapiens
aaaaugugaauugcaugacuu

SEQ ID NO: 693387 - RNA, 21 nt, Homo sapiens
aaacuucccucucuagacagu

SEQ ID NO: 693388 - RNA, 13 nt, Homo sapiens
aaagacaccauuu

SEQ ID NO: 693389 - RNA, 20 nt, Homo sapiens
aaauaacuucaguccugcuc

SEQ ID NO: 693390 - RNA, 20 nt, Homo sapiens
aaaugugaauugcaugacuu

SEQ ID NO: 693391 - RNA, 24 nt, Homo sapiens
aaauugucuuuugucauguggcua

SEQ ID NO: 693392 - RNA, 14 nt, Homo sapiens
aacaaaaaaaccac

SEQ ID NO: 693393 - RNA, 19 nt, Homo sapiens
uuguaaaaagaaaaaccac

SEQ ID NO: 693394 - RNA, 23 nt, Homo sapiens
uuguuauuuucgcacaaugggaa

SEQ ID NO: 693395 - RNA, 19 nt, Homo sapiens
uuuacuuggagaagagauu

SEQ ID NO: 693396 - RNA, 21 nt, Homo sapiens
uuuauucauuagcugugauuu

SEQ ID NO: 693397 - RNA, 19 nt, Homo sapiens
uuucaauuuaucaaucucu

SEQ ID NO: 693398 - RNA, 16 nt, Homo sapiens
uuuccccuugccuuau

SEQ ID NO: 693399 - RNA, 23 nt, Homo sapiens
uuucccuguagauguaucaaaau

SEQ ID NO: 693400 - RNA, 23 nt, Homo sapiens
uuuguuguaaaaagaaaaaccac

SEQ ID NO: 693401 - RNA, 12 nt, Homo sapiens
uuuuguuuacuu

SEQ ID NO: 693402 - RNA, 15 nt, Homo sapiens
aacaaaaaaaccaca

SEQ ID NO: 693403 - RNA, 20 nt, Homo sapiens
aacauuucucuucagugugu

SEQ ID NO: 693404 - RNA, 20 nt, Homo sapiens
aaccacaaaggccaaacugc

SEQ ID NO: 693405 - RNA, 23 nt, Homo sapiens
aaccuggccgcguuuagaccaag

SEQ ID NO: 693406 - RNA, 20 nt, Homo sapiens
aacuguaaauugagauuuaa

SEQ ID NO: 693407 - RNA, 12 nt, Homo sapiens
aagaaaaaccac

SEQ ID NO: 693408 - RNA, 12 nt, Homo sapiens
aagacaccauuu

SEQ ID NO: 693409 - RNA, 16 nt, Homo sapiens
aagacaccauuuaucu

SEQ ID NO: 693410 - RNA, 19 nt, Homo sapiens
aagccagcugcaggaauca

SEQ ID NO: 693411 - RNA, 12 nt, Homo sapiens
aagcucacaaua

SEQ ID NO: 693412 - RNA, 17 nt, Homo sapiens
aauauuuauugaauuau

SEQ ID NO: 693413 - RNA, 17 nt, Homo sapiens
aaugaaaaacaaccaag

SEQ ID NO: 693414 - RNA, 13 nt, Homo sapiens
aaugacugugcua

SEQ ID NO: 693415 - RNA, 11 nt, Homo sapiens
aauuucuguca

SEQ ID NO: 693416 - RNA, 21 nt, Homo sapiens
aauuucugucagaaugcuauu

SEQ ID NO: 693417 - RNA, 18 nt, Homo sapiens
aauuuucgaaaacuuccc

SEQ ID NO: 693418 - RNA, 19 nt, Homo sapiens
acaggucccaccuccagcc

SEQ ID NO: 693419 - RNA, 20 nt, Homo sapiens
acaugaucuguuuuucacca

SEQ ID NO: 693420 - RNA, 22 nt, Homo sapiens
acaugcuuaugacaaugacugu

SEQ ID NO: 693421 - RNA, 20 nt, Homo sapiens
accaacaaacccaacucuaa

SEQ ID NO: 693422 - RNA, 13 nt, Homo sapiens
accacuucacuga

SEQ ID NO: 693423 - RNA, 18 nt, Homo sapiens
acccuacuuucauuccuc

SEQ ID NO: 693424 - RNA, 19 nt, Homo sapiens
acccucugggaaccuccca

SEQ ID NO: 693425 - RNA, 15 nt, Homo sapiens
acugaaagacaccau

SEQ ID NO: 693426 - RNA, 21 nt, Homo sapiens
acuguaauaucuuuaaaugau

SEQ ID NO: 693427 - RNA, 12 nt, Homo sapiens
acugugcuacug

SEQ ID NO: 693428 - RNA, 16 nt, Homo sapiens
acuuguagcauauucu

SEQ ID NO: 693429 - RNA, 18 nt, Homo sapiens
acuugucacugacacaaa

SEQ ID NO: 693430 - RNA, 17 nt, Homo sapiens
acuugugaaacacagcu

SEQ ID NO: 693431 - RNA, 12 nt, Homo sapiens
acuuugcugauu

SEQ ID NO: 693432 - RNA, 12 nt, Homo sapiens
agaaaaaccacu

SEQ ID NO: 693433 - RNA, 14 nt, Homo sapiens
agacaugugugugu

SEQ ID NO: 693434 - RNA, 16 nt, Homo sapiens
agagagauauaucuga

SEQ ID NO: 693435 - RNA, 19 nt, Homo sapiens
agagagcggcugguucauu

SEQ ID NO: 693436 - RNA, 23 nt, Homo sapiens
agagauccacccccaagcacucc

SEQ ID NO: 693437 - RNA, 19 nt, Homo sapiens
agaggaaagagucuucaac

SEQ ID NO: 693438 - RNA, 13 nt, Homo sapiens
agagguccagccc

SEQ ID NO: 693439 - RNA, 19 nt, Homo sapiens
agauuuucauguucuugca

SEQ ID NO: 693440 - RNA, 20 nt, Homo sapiens
agauuuucauguucuugcag

SEQ ID NO: 693441 - RNA, 17 nt, Homo sapiens
agcagagugcacagcug

SEQ ID NO: 693442 - RNA, 18 nt, Homo sapiens
agcagagugcacagcugu

SEQ ID NO: 693443 - RNA, 18 nt, Homo sapiens
agcgcauccaaucucaag

SEQ ID NO: 693444 - RNA, 20 nt, Homo sapiens
agcgcucugccucaccgcuu

SEQ ID NO: 693445 - RNA, 19 nt, Homo sapiens
agcuguaaaacgcugucaa

SEQ ID NO: 693446 - RNA, 15 nt, Homo sapiens
agcuuuuuguugccu

SEQ ID NO: 693447 - RNA, 18 nt, Homo sapiens
aggaccacucagccccua

SEQ ID NO: 693448 - RNA, 15 nt, Homo sapiens
aguacuugugaaaca

SEQ ID NO: 693449 - RNA, 21 nt, Homo sapiens
aguacuugugaaacacagcug

SEQ ID NO: 693450 - RNA, 20 nt, Homo sapiens
agucuucaacauaacccacu

SEQ ID NO: 693451 - RNA, 12 nt, Homo sapiens
agugcacagcug

SEQ ID NO: 693452 - RNA, 17 nt, Homo sapiens
auaaaaacuuugcagaa

SEQ ID NO: 693453 - RNA, 14 nt, Homo sapiens
auaaagcauuauaa

SEQ ID NO: 693454 - RNA, 16 nt, Homo sapiens
auaacccacuugucac

SEQ ID NO: 693455 - RNA, 15 nt, Homo sapiens
auacagaaguuccau

SEQ ID NO: 693456 - RNA, 15 nt, Homo sapiens
auaucuguggucuuc

SEQ ID NO: 693457 - RNA, 17 nt, Homo sapiens
auaugaucaaacuucca

SEQ ID NO: 693458 - RNA, 18 nt, Homo sapiens
auauuauuugcuaauuaa

SEQ ID NO: 693459 - RNA, 13 nt, Homo sapiens
aucaaacccacga

SEQ ID NO: 693460 - RNA, 20 nt, Homo sapiens
aucaaacccacgauuuucuc

SEQ ID NO: 693461 - RNA, 18 nt, Homo sapiens
aucauccugccuucaugg

SEQ ID NO: 693462 - RNA, 19 nt, Homo sapiens
auccacccccaagcacucc

SEQ ID NO: 693463 - RNA, 19 nt, Homo sapiens
auccagaggguugugauuu

SEQ ID NO: 693464 - RNA, 19 nt, Homo sapiens
aucuguuuuucaccacuuc

SEQ ID NO: 693465 - RNA, 19 nt, Homo sapiens
augauaaaaaaguguccua

SEQ ID NO: 693466 - RNA, 15 nt, Homo sapiens
augaucaaacuucca

SEQ ID NO: 693467 - RNA, 21 nt, Homo sapiens
augaucuguuuuucaccacuu

SEQ ID NO: 693468 - RNA, 22 nt, Homo sapiens
augccuaauaaacaauucaagu

SEQ ID NO: 693469 - RNA, 21 nt, Homo sapiens
auggcuacuuugguuucuguc

SEQ ID NO: 693470 - RNA, 14 nt, Homo sapiens
auguguaaauguua

SEQ ID NO: 693471 - RNA, 13 nt, Homo sapiens
auuagcugugauu

SEQ ID NO: 693472 - RNA, 14 nt, Homo sapiens
auuauuuuguuacu

SEQ ID NO: 693473 - RNA, 13 nt, Homo sapiens
auuccaaaccaac

SEQ ID NO: 693474 - RNA, 17 nt, Homo sapiens
auugaauuauuuuguua

SEQ ID NO: 693475 - RNA, 20 nt, Homo sapiens
auugucuuuaauuucuguca

SEQ ID NO: 693476 - RNA, 16 nt, Homo sapiens
auuguugaugcucaca

SEQ ID NO: 693477 - RNA, 21 nt, Homo sapiens
auuuccucugagcuguuaucu

SEQ ID NO: 693478 - RNA, 20 nt, Homo sapiens
auuugcggcgucagucuuuu

SEQ ID NO: 693479 - RNA, 16 nt, Homo sapiens
auuuuaaaauuaggaa

SEQ ID NO: 693480 - RNA, 19 nt, Homo sapiens
auuuucagaauuuaaucuu

SEQ ID NO: 693481 - RNA, 22 nt, Homo sapiens
caaaaauugaagagagauauau

SEQ ID NO: 693482 - RNA, 17 nt, Homo sapiens
caaccaagcgcauccaa

SEQ ID NO: 693483 - RNA, 14 nt, Homo sapiens
caacucaaggcuca

SEQ ID NO: 693484 - RNA, 22 nt, Homo sapiens
caacuugaaauuauaucugugg

SEQ ID NO: 693485 - RNA, 19 nt, Homo sapiens
caagcaaaucccaacauuu

SEQ ID NO: 693486 - RNA, 12 nt, Homo sapiens
caaucucuuaaa

SEQ ID NO: 693487 - RNA, 15 nt, Homo sapiens
caaucuguccacaaa

SEQ ID NO: 693488 - RNA, 20 nt, Homo sapiens
cacaagcagagugcacagcu

SEQ ID NO: 693489 - RNA, 13 nt, Homo sapiens
cacuucagaauuc

SEQ ID NO: 693490 - RNA, 21 nt, Homo sapiens
cacuugucacugacacaaagg

SEQ ID NO: 693491 - RNA, 16 nt, Homo sapiens
cagaacccagggcucu

SEQ ID NO: 693492 - RNA, 14 nt, Homo sapiens
cagaggguugugau

SEQ ID NO: 693493 - RNA, 18 nt, Homo sapiens
cagagugcacagcugucc

SEQ ID NO: 693494 - RNA, 20 nt, Homo sapiens
cagcaaagaggacucgcuug

SEQ ID NO: 693495 - RNA, 23 nt, Homo sapiens
cagccccuagaaacccaagcucc

SEQ ID NO: 693496 - RNA, 16 nt, Homo sapiens
cagccuaugagcaucc

SEQ ID NO: 693497 - RNA, 13 nt, Homo sapiens
caggcuccgcccu

SEQ ID NO: 693498 - RNA, 16 nt, Homo sapiens
caguacuugugaaaca

SEQ ID NO: 693499 - RNA, 15 nt, Homo sapiens
cauaacccacuuguc

SEQ ID NO: 693500 - RNA, 17 nt, Homo sapiens
cauauuaacaugcuuau

SEQ ID NO: 693501 - RNA, 16 nt, Homo sapiens
cauauucuuuucugca

SEQ ID NO: 693502 - RNA, 13 nt, Homo sapiens
cauauuugccuug

SEQ ID NO: 693503 - RNA, 21 nt, Homo sapiens
caucaacaaagaaauauuauu

SEQ ID NO: 693504 - RNA, 22 nt, Homo sapiens
cauggaacucagcugucugugg

SEQ ID NO: 693505 - RNA, 19 nt, Homo sapiens
cauggcucuggacucuaaa

SEQ ID NO: 693506 - RNA, 14 nt, Homo sapiens
cauuaaauguuuga

SEQ ID NO: 693507 - RNA, 21 nt, Homo sapiens
cauuauagauuuucauguucu

SEQ ID NO: 693508 - RNA, 22 nt, Homo sapiens
cauuauucaagaaagauaucua

SEQ ID NO: 693509 - RNA, 17 nt, Homo sapiens
ccaacucuaaugcugca

SEQ ID NO: 693510 - RNA, 22 nt, Homo sapiens
ccaagcucccugccccaaauaa

SEQ ID NO: 693511 - RNA, 20 nt, Homo sapiens
ccaaggaacaaaaaaaccac

SEQ ID NO: 693512 - RNA, 18 nt, Homo sapiens
ccacgauuuucuccagcu

SEQ ID NO: 693513 - RNA, 19 nt, Homo sapiens
ccagcugcaggaaucaaaa

SEQ ID NO: 693514 - RNA, 17 nt, Homo sapiens
ccaguguaugucuugua

SEQ ID NO: 693515 - RNA, 14 nt, Homo sapiens
ccauccaccgcugc

SEQ ID NO: 693516 - RNA, 14 nt, Homo sapiens
cccaaauguauucu

SEQ ID NO: 693517 - RNA, 21 nt, Homo sapiens
cccaacccugagcacucuuau

SEQ ID NO: 693518 - RNA, 23 nt, Homo sapiens
cccacuugucacugacacaaagg

SEQ ID NO: 693519 - RNA, 22 nt, Homo sapiens
cccagccggccaauggaaaccu

SEQ ID NO: 693520 - RNA, 12 nt, Homo sapiens
cccagccuauga

SEQ ID NO: 693521 - RNA, 13 nt, Homo sapiens
cccuuaacccaag

SEQ ID NO: 693522 - RNA, 20 nt, Homo sapiens
ccgcguuuagaccaaggaac

SEQ ID NO: 693523 - RNA, 14 nt, Homo sapiens
ccuaauaaacaauu

SEQ ID NO: 693524 - RNA, 18 nt, Homo sapiens
ccucccagagguccagcc

SEQ ID NO: 693525 - RNA, 17 nt, Homo sapiens
ccucgauuuugcacuuu

SEQ ID NO: 693526 - RNA, 20 nt, Homo sapiens
ccucuucccuucaacaugaa

SEQ ID NO: 693527 - RNA, 12 nt, Homo sapiens
ccucuuugccuc

SEQ ID NO: 693528 - RNA, 11 nt, Homo sapiens
ccuugccuuau

SEQ ID NO: 693529 - RNA, 13 nt, Homo sapiens
ccuuggguucauu

SEQ ID NO: 693530 - RNA, 14 nt, Homo sapiens
ccuuuaacucuuau

SEQ ID NO: 693531 - RNA, 15 nt, Homo sapiens
cguuuagaccaagga

SEQ ID NO: 693532 - RNA, 17 nt, Homo sapiens
cuacccaaacccuaggu

SEQ ID NO: 693533 - RNA, 19 nt, Homo sapiens
cuacugaugguuacauaua

SEQ ID NO: 693534 - RNA, 21 nt, Homo sapiens
cuacuuugguuucugucugua

SEQ ID NO: 693535 - RNA, 13 nt, Homo sapiens
cuagaaacccaag

SEQ ID NO: 693536 - RNA, 15 nt, Homo sapiens
cuaugacuguguuua

SEQ ID NO: 693537 - RNA, 14 nt, Homo sapiens
cucagccccuagga

SEQ ID NO: 693538 - RNA, 20 nt, Homo sapiens
cuccagaauuuggaaauccu

SEQ ID NO: 693539 - RNA, 21 nt, Homo sapiens
cugaauauacagaaguuccau

SEQ ID NO: 693540 - RNA, 20 nt, Homo sapiens
cugagcuguuaucuugugua

SEQ ID NO: 693541 - RNA, 19 nt, Homo sapiens
cugcaaacauguugccucg

SEQ ID NO: 693542 - RNA, 14 nt, Homo sapiens
cugccagcaaagag

SEQ ID NO: 693543 - RNA, 19 nt, Homo sapiens
cuggaauaagaagcaaaua

SEQ ID NO: 693544 - RNA, 14 nt, Homo sapiens
cugggccauugugg

SEQ ID NO: 693545 - RNA, 16 nt, Homo sapiens
cuuaacccaaggagca

SEQ ID NO: 693546 - RNA, 13 nt, Homo sapiens
cuuaguaucucau

SEQ ID NO: 693547 - RNA, 16 nt, Homo sapiens
cuucacucugggcaca

SEQ ID NO: 693548 - RNA, 24 nt, Homo sapiens
cuucagauggugaagcauucuccc

SEQ ID NO: 693549 - RNA, 20 nt, Homo sapiens
cuucaguguguugacuucua

SEQ ID NO: 693550 - RNA, 16 nt, Homo sapiens
cuucuguucugcagac

SEQ ID NO: 693551 - RNA, 16 nt, Homo sapiens
cuuggagugcuucuga

SEQ ID NO: 693552 - RNA, 13 nt, Homo sapiens
cuuggaugugguu

SEQ ID NO: 693553 - RNA, 19 nt, Homo sapiens
cuuugguuucugucuguaa

SEQ ID NO: 693554 - RNA, 17 nt, Homo sapiens
cuuuuauucauuagcug

SEQ ID NO: 693555 - RNA, 16 nt, Homo sapiens
gaaaaaccacucccag

SEQ ID NO: 693556 - RNA, 17 nt, Homo sapiens
gaaaaauguuugucuca

SEQ ID NO: 693557 - RNA, 13 nt, Homo sapiens
gaaacccaagcuc

SEQ ID NO: 693558 - RNA, 19 nt, Homo sapiens
gaacucagcugucuguggc

SEQ ID NO: 693559 - RNA, 16 nt, Homo sapiens
gaagagagauauaucu

SEQ ID NO: 693560 - RNA, 17 nt, Homo sapiens
gaagcuuuuuguugccu

SEQ ID NO: 693561 - RNA, 13 nt, Homo sapiens
gaauaagaagcaa

SEQ ID NO: 693562 - RNA, 14 nt, Homo sapiens
gaauauaggucucu

SEQ ID NO: 693563 - RNA, 16 nt, Homo sapiens
gaaucaaaaauugaag

SEQ ID NO: 693564 - RNA, 12 nt, Homo sapiens
gaauccaagcuc

SEQ ID NO: 693565 - RNA, 13 nt, Homo sapiens
gacaaugacugug

SEQ ID NO: 693566 - RNA, 15 nt, Homo sapiens
gacugaguucuauau

SEQ ID NO: 693567 - RNA, 16 nt, Homo sapiens
gacuucauacuuugaa

SEQ ID NO: 693568 - RNA, 21 nt, Homo sapiens
gagcacaggucccaccuccag

SEQ ID NO: 693569 - RNA, 23 nt, Homo sapiens
gagguuucacccuuaacccaagg

SEQ ID NO: 693570 - RNA, 18 nt, Homo sapiens
gcaaaauagacauauuaa

SEQ ID NO: 693571 - RNA, 23 nt, Homo sapiens
gcagagaagggcauaaaacagcu

SEQ ID NO: 693572 - RNA, 18 nt, Homo sapiens
gcaucccggaggaaaucu

SEQ ID NO: 693573 - RNA, 16 nt, Homo sapiens
gcauuguugaugcuca

SEQ ID NO: 693574 - RNA, 15 nt, Homo sapiens
gcuuuuuguugccuu

SEQ ID NO: 693575 - RNA, 14 nt, Homo sapiens
ggaaaaauguuugu

SEQ ID NO: 693576 - RNA, 19 nt, Homo sapiens
ggaaagccucacugauaua

SEQ ID NO: 693577 - RNA, 21 nt, Homo sapiens
ggaacaaaaaaaccacaaagg

SEQ ID NO: 693578 - RNA, 20 nt, Homo sapiens
ggaccacucagccccuagga

SEQ ID NO: 693579 - RNA, 22 nt, Homo sapiens
ggaguauauuuccgcacuucag

SEQ ID NO: 693580 - RNA, 17 nt, Homo sapiens
ggauccccaacccugag

SEQ ID NO: 693581 - RNA, 23 nt, Homo sapiens
ggauccccaacccugagcacucu

SEQ ID NO: 693582 - RNA, 17 nt, Homo sapiens
gguuuuguuccagagac

SEQ ID NO: 693583 - RNA, 18 nt, Homo sapiens
guaucccgagucugggac

SEQ ID NO: 693584 - RNA, 17 nt, Homo sapiens
gucugcuuaguaucuca

SEQ ID NO: 693585 - RNA, 19 nt, Homo sapiens
guuaucuuguguauggaua

SEQ ID NO: 693586 - RNA, 11 nt, Homo sapiens
guuaugacucc

SEQ ID NO: 693587 - RNA, 20 nt, Homo sapiens
guuguaaaaagaaaaaccac

SEQ ID NO: 693588 - RNA, 21 nt, Homo sapiens
guuguaaaaagaaaaaccacu

SEQ ID NO: 693589 - RNA, 19 nt, Homo sapiens
guuucacccuuaacccaag

SEQ ID NO: 693590 - RNA, 23 nt, Homo sapiens
uaaaacauuauagauuuucaugu

SEQ ID NO: 693591 - RNA, 19 nt, Homo sapiens
uaaaacuuuucugcugaua

SEQ ID NO: 693592 - RNA, 18 nt, Homo sapiens
uaaaauguuauauaauaa

SEQ ID NO: 693593 - RNA, 22 nt, Homo sapiens
uaaauguuaugacuccuugaua

SEQ ID NO: 693594 - RNA, 17 nt, Homo sapiens
uaagaagcuucuaauaa

SEQ ID NO: 693595 - RNA, 16 nt, Homo sapiens
uaauaguauaucuaau

SEQ ID NO: 693596 - RNA, 18 nt, Homo sapiens
uacauuuuguuguaaaaa

SEQ ID NO: 693597 - RNA, 13 nt, Homo sapiens
uacccaaacccua

SEQ ID NO: 693598 - RNA, 21 nt, Homo sapiens
uacucagggcuccucccagcu

SEQ ID NO: 693599 - RNA, 20 nt, Homo sapiens
uacuugugaaacacagcugu

SEQ ID NO: 693600 - RNA, 12 nt, Homo sapiens
uagcuguaaaac

SEQ ID NO: 693601 - RNA, 12 nt, Homo sapiens
uauauuauuugg

SEQ ID NO: 693602 - RNA, 20 nt, Homo sapiens
uaucauccugccuucaugga

SEQ ID NO: 693603 - RNA, 21 nt, Homo sapiens
uaucuacccaagggcagaaag

SEQ ID NO: 693604 - RNA, 18 nt, Homo sapiens
uauucaagaaagauaucu

SEQ ID NO: 693605 - RNA, 16 nt, Homo sapiens
ucacccuuaacccaag

SEQ ID NO: 693606 - RNA, 19 nt, Homo sapiens
ucacgcaacuugaaauuau

SEQ ID NO: 693607 - RNA, 18 nt, Homo sapiens
ucacugauauauuuucca

SEQ ID NO: 693608 - RNA, 19 nt, Homo sapiens
ucauauuauaaauuucuaa

SEQ ID NO: 693609 - RNA, 19 nt, Homo sapiens
ucauccugccuucauggaa

SEQ ID NO: 693610 - RNA, 20 nt, Homo sapiens
ucauguucuugcagucauca

SEQ ID NO: 693611 - RNA, 17 nt, Homo sapiens
ucauuaaauguuugaca

SEQ ID NO: 693612 - RNA, 16 nt, Homo sapiens
ucauuagcugugauuu

SEQ ID NO: 693613 - RNA, 14 nt, Homo sapiens
uccaaaguuaucca

SEQ ID NO: 693614 - RNA, 15 nt, Homo sapiens
uccauauuugccuug

SEQ ID NO: 693615 - RNA, 17 nt, Homo sapiens
uccuauaauucuauuga

SEQ ID NO: 693616 - RNA, 15 nt, Homo sapiens
uccugccuucaugga

SEQ ID NO: 693617 - RNA, 20 nt, Homo sapiens
ucguaucccgagucugggac

SEQ ID NO: 693618 - RNA, 18 nt, Homo sapiens
ucuaaaacaaucugucca

SEQ ID NO: 693619 - RNA, 19 nt, Homo sapiens
ucuccccaguguaugucuu

SEQ ID NO: 693620 - RNA, 21 nt, Homo sapiens
ucucuuaaucacaagauuauu

SEQ ID NO: 693621 - RNA, 16 nt, Homo sapiens
ucugccucaccgcuuc

SEQ ID NO: 693622 - RNA, 19 nt, Homo sapiens
ucugucagaaugcuauuga

SEQ ID NO: 693623 - RNA, 11 nt, Homo sapiens
ucuucauggcc

SEQ ID NO: 693624 - RNA, 17 nt, Homo sapiens
ucuugcagucaucagaa

SEQ ID NO: 693625 - RNA, 14 nt, Homo sapiens
ucuuggacuauccg

SEQ ID NO: 693626 - RNA, 13 nt, Homo sapiens
ugaaacacagcug

SEQ ID NO: 693627 - RNA, 13 nt, Homo sapiens
ugaagcuuuuugu

SEQ ID NO: 693628 - RNA, 21 nt, Homo sapiens
ugacugugcuacugucuuugg

SEQ ID NO: 693629 - RNA, 17 nt, Homo sapiens
ugacuucauacuuugaa

SEQ ID NO: 693630 - RNA, 14 nt, Homo sapiens
ugauauauuuucca

SEQ ID NO: 693631 - RNA, 15 nt, Homo sapiens
ugauuccaaaccaac

SEQ ID NO: 693632 - RNA, 20 nt, Homo sapiens
ugccauuaagcucacaauaa

SEQ ID NO: 693633 - RNA, 23 nt, Homo sapiens
ugccuaguuuuuaguaaucugua

SEQ ID NO: 693634 - RNA, 17 nt, Homo sapiens
ugcuacugucuuuggaa

SEQ ID NO: 693635 - RNA, 13 nt, Homo sapiens
ugcucacauauga

SEQ ID NO: 693636 - RNA, 14 nt, Homo sapiens
ugcuuaguaucuca

SEQ ID NO: 693637 - RNA, 15 nt, Homo sapiens
ugcuuaguaucucau

SEQ ID NO: 693638 - RNA, 18 nt, Homo sapiens
ugcuuaguaucucaucaa

SEQ ID NO: 693639 - RNA, 16 nt, Homo sapiens
ugcuucaguacuugug

SEQ ID NO: 693640 - RNA, 18 nt, Homo sapiens
uggaacucagcugucugu

SEQ ID NO: 693641 - RNA, 19 nt, Homo sapiens
uguaacuuauguagauauu

SEQ ID NO: 693642 - RNA, 23 nt, Homo sapiens
uguaacuuauguagauauuuggc

SEQ ID NO: 693643 - RNA, 21 nt, Homo sapiens
uguagcauauucuuuucugca

SEQ ID NO: 693644 - RNA, 16 nt, Homo sapiens
uguaguguuuugugga

SEQ ID NO: 693645 - RNA, 13 nt, Homo sapiens
ugucuuucuccaa

SEQ ID NO: 693646 - RNA, 15 nt, Homo sapiens
ugugaaacacagcug

SEQ ID NO: 693647 - RNA, 20 nt, Homo sapiens
ugugagcuucagauggugaa

SEQ ID NO: 693648 - RNA, 18 nt, Homo sapiens
uguggcuucccaugucuu

SEQ ID NO: 693649 - RNA, 19 nt, Homo sapiens
uguucuugcagucaucaga

SEQ ID NO: 693650 - RNA, 21 nt, Homo sapiens
uuaacaugcuuaugacaauga

SEQ ID NO: 693651 - RNA, 18 nt, Homo sapiens
uuaacucuuauguuacuu

SEQ ID NO: 693652 - RNA, 16 nt, Homo sapiens
uuaauaguauaucuaa

SEQ ID NO: 693653 - RNA, 13 nt, Homo sapiens
uuaguaaucugua

SEQ ID NO: 693654 - RNA, 18 nt, Homo sapiens
uuauaucuguggucuuca

SEQ ID NO: 693655 - RNA, 17 nt, Homo sapiens
uuauucauuagcuguga

SEQ ID NO: 693656 - RNA, 17 nt, Homo sapiens
uucacccuuaacccaag

SEQ ID NO: 693657 - RNA, 14 nt, Homo sapiens
uucaguacuuguga

SEQ ID NO: 693658 - RNA, 15 nt, Homo sapiens
uucaguacuugugaa

SEQ ID NO: 693659 - RNA, 18 nt, Homo sapiens
uucccuucaacaugaaaa

SEQ ID NO: 693660 - RNA, 19 nt, Homo sapiens
uuccuuuuuguugauucca

SEQ ID NO: 693661 - RNA, 20 nt, Homo sapiens
uucugcaaaauagacauauu

SEQ ID NO: 693662 - RNA, 21 nt, Homo sapiens
uucugucagaaugcuauugaa

SEQ ID NO: 693663 - RNA, 17 nt, Homo sapiens
uucuugcagucaucaga

SEQ ID NO: 693664 - RNA, 16 nt, Homo sapiens
uugauuaaaacauuau

SEQ ID NO: 693665 - RNA, 21 nt, Homo sapiens
uuggaaaaauguuugucucag

SEQ ID NO: 693666 - RNA, 21 nt, Homo sapiens
caguacuugugaaacacagcu

SEQ ID NO: 693667 - RNA, 22 nt, Homo sapiens
cauguggcuaaaugccuaauaa

SEQ ID NO: 693668 - RNA, 15 nt, Homo sapiens
cauguguguguguga

SEQ ID NO: 693669 - RNA, 13 nt, Homo sapiens
ccaaauguauucu

SEQ ID NO: 693670 - RNA, 16 nt, Homo sapiens
ccaauggaaaccucac

SEQ ID NO: 693671 - RNA, 20 nt, Homo sapiens
ccacugggccauuguggugu

SEQ ID NO: 693672 - RNA, 21 nt, Homo sapiens
ccagccuaugagcauccugag

SEQ ID NO: 693673 - RNA, 12 nt, Homo sapiens
ccaucacaugau

SEQ ID NO: 693674 - RNA, 18 nt, Homo sapiens
cccaacccugagcacucu

SEQ ID NO: 693675 - RNA, 15 nt, Homo sapiens
cccuagaaacccaag

SEQ ID NO: 693676 - RNA, 11 nt, Homo sapiens
cccuugccuua

SEQ ID NO: 693677 - RNA, 12 nt, Homo sapiens
cccuugccuuau

SEQ ID NO: 693678 - RNA, 22 nt, Homo sapiens
ccggaucagagcaggaccuccc

SEQ ID NO: 693679 - RNA, 15 nt, Homo sapiens
ccucacugauauauu

SEQ ID NO: 693680 - RNA, 17 nt, Homo sapiens
ccucucuagacaguaga

SEQ ID NO: 693681 - RNA, 21 nt, Homo sapiens
ccuggccgcguuuagaccaag

SEQ ID NO: 693682 - RNA, 14 nt, Homo sapiens
cgccacacagacca

SEQ ID NO: 693683 - RNA, 17 nt, Homo sapiens
cgggagccuaggaccac

SEQ ID NO: 693684 - RNA, 19 nt, Homo sapiens
cuaaugugaaaauguauuc

SEQ ID NO: 693685 - RNA, 23 nt, Homo sapiens
cuaauuaaaaaguuaaucuucau

SEQ ID NO: 693686 - RNA, 16 nt, Homo sapiens
cuacugaugguuacau

SEQ ID NO: 693687 - RNA, 19 nt, Homo sapiens
cucaaggcucagcugguuu

SEQ ID NO: 693688 - RNA, 21 nt, Homo sapiens
cucagccacacccaggcacuu

SEQ ID NO: 693689 - RNA, 23 nt, Homo sapiens
cucagccacacccaggcacuuaa

SEQ ID NO: 693690 - RNA, 15 nt, Homo sapiens
cugcaggaaucaaaa

SEQ ID NO: 693691 - RNA, 16 nt, Homo sapiens
cugcuccacgcgcuuc

SEQ ID NO: 693692 - RNA, 19 nt, Homo sapiens
cuggacucuaaagaccaaa

SEQ ID NO: 693693 - RNA, 20 nt, Homo sapiens
cuggccgcguuuagaccaag

SEQ ID NO: 693694 - RNA, 19 nt, Homo sapiens
cugucagaaugcuauugaa

SEQ ID NO: 693695 - RNA, 18 nt, Homo sapiens
cuuaucaaucccaaccau

SEQ ID NO: 693696 - RNA, 12 nt, Homo sapiens
cuucaguguguu

SEQ ID NO: 693697 - RNA, 10 nt, Homo sapiens
cuugccuuau

SEQ ID NO: 693698 - RNA, 14 nt, Homo sapiens
cuuggaugugguuu

SEQ ID NO: 693699 - RNA, 19 nt, Homo sapiens
cuugucacugacacaaagg

SEQ ID NO: 693700 - RNA, 22 nt, Homo sapiens
cuuguuuuuuccccuugccuua

SEQ ID NO: 693701 - RNA, 13 nt, Homo sapiens
cuuuaacucuuau

SEQ ID NO: 693702 - RNA, 15 nt, Homo sapiens
cuuugcugauuuccc

SEQ ID NO: 693703 - RNA, 13 nt, Homo sapiens
cuuuuuguugccu

SEQ ID NO: 693704 - RNA, 15 nt, Homo sapiens
cuuuuuguugccuua

SEQ ID NO: 693705 - RNA, 16 nt, Homo sapiens
cuuuuuguugccuuau

SEQ ID NO: 693706 - RNA, 17 nt, Homo sapiens
gaaaaugaaaaacaacc

SEQ ID NO: 693707 - RNA, 21 nt, Homo sapiens
gaaaguagaacuuacuauuca

SEQ ID NO: 693708 - RNA, 19 nt, Homo sapiens
gaaaguuuuuaauauuuau

SEQ ID NO: 693709 - RNA, 17 nt, Homo sapiens
gaaauuauaucuguggu

SEQ ID NO: 693710 - RNA, 18 nt, Homo sapiens
gaaauuauaucugugguc

SEQ ID NO: 693711 - RNA, 15 nt, Homo sapiens
gaacaaaaaaaccac

SEQ ID NO: 693712 - RNA, 16 nt, Homo sapiens
gaacaaaaaaaccaca

SEQ ID NO: 693713 - RNA, 21 nt, Homo sapiens
gaacaaaaaaaccacaaaggc

SEQ ID NO: 693714 - RNA, 20 nt, Homo sapiens
gaacucucagacaucucuuu

SEQ ID NO: 693715 - RNA, 16 nt, Homo sapiens
gaacuuacuauucauu

SEQ ID NO: 693716 - RNA, 21 nt, Homo sapiens
gaagaauugauguaugccucu

SEQ ID NO: 693717 - RNA, 15 nt, Homo sapiens
gaagcauucucccca

SEQ ID NO: 693718 - RNA, 20 nt, Homo sapiens
gaagcuuuuuguugccuuau

SEQ ID NO: 693719 - RNA, 18 nt, Homo sapiens
gaagugguaggaaagccu

SEQ ID NO: 693720 - RNA, 17 nt, Homo sapiens
gaauaaaaacuuugcag

SEQ ID NO: 693721 - RNA, 15 nt, Homo sapiens
gaauaauggacaaag

SEQ ID NO: 693722 - RNA, 11 nt, Homo sapiens
gacacaaagga

SEQ ID NO: 693723 - RNA, 15 nt, Homo sapiens
gacaccauuuaucua

SEQ ID NO: 693724 - RNA, 19 nt, Homo sapiens
gacugcaaacauguugccu

SEQ ID NO: 693725 - RNA, 14 nt, Homo sapiens
gacugugcuacugu

SEQ ID NO: 693726 - RNA, 21 nt, Homo sapiens
gaguauauuuccgcacuucag

SEQ ID NO: 693727 - RNA, 21 nt, Homo sapiens
gauaaaaaauuuauuaugucc

SEQ ID NO: 693728 - RNA, 21 nt, Homo sapiens
gauccacccccaagcacucca

SEQ ID NO: 693729 - RNA, 15 nt, Homo sapiens
gcauuguugaugcuc

SEQ ID NO: 693730 - RNA, 17 nt, Homo sapiens
gccccuagaaacccaag

SEQ ID NO: 693731 - RNA, 23 nt, Homo sapiens
gcccucuuccugacgaaacuggc

SEQ ID NO: 693732 - RNA, 19 nt, Homo sapiens
gcuagggcggggcacagau

SEQ ID NO: 693733 - RNA, 22 nt, Homo sapiens
gcucuggacucuaaagaccaaa

SEQ ID NO: 693734 - RNA, 14 nt, Homo sapiens
gcugcaggaaucaa

SEQ ID NO: 693735 - RNA, 14 nt, Homo sapiens
gcuuaguaucucau

SEQ ID NO: 693736 - RNA, 17 nt, Homo sapiens
gcuucaguacuugugaa

SEQ ID NO: 693737 - RNA, 22 nt, Homo sapiens
gcuucauuuccucugagcuguu

SEQ ID NO: 693738 - RNA, 15 nt, Homo sapiens
ggaaagccucacuga

SEQ ID NO: 693739 - RNA, 14 nt, Homo sapiens
ggcuucccaugucu

SEQ ID NO: 693740 - RNA, 22 nt, Homo sapiens
gggcacacucugccagcaaaga

SEQ ID NO: 693741 - RNA, 15 nt, Homo sapiens
ggugugagcuucaga

SEQ ID NO: 693742 - RNA, 14 nt, Homo sapiens
ggugugugagagag

SEQ ID NO: 693743 - RNA, 21 nt, Homo sapiens
gguuucacccuuaacccaagg

SEQ ID NO: 693744 - RNA, 17 nt, Homo sapiens
guauucuacuuguucua

SEQ ID NO: 693745 - RNA, 16 nt, Homo sapiens
gucacugacacaaagg

SEQ ID NO: 693746 - RNA, 21 nt, Homo sapiens
guccccagcccuucacauuuu

SEQ ID NO: 693747 - RNA, 20 nt, Homo sapiens
gucugcuuaguaucucauca

SEQ ID NO: 693748 - RNA, 23 nt, Homo sapiens
gugaagcauucuccccaguguau

SEQ ID NO: 693749 - RNA, 17 nt, Homo sapiens
guggcuaaaugccuaau

SEQ ID NO: 693750 - RNA, 16 nt, Homo sapiens
gugggagggacuuugc

SEQ ID NO: 693751 - RNA, 17 nt, Homo sapiens
guucacgcaacuugaaa

SEQ ID NO: 693752 - RNA, 19 nt, Homo sapiens
guucuucuguucugcagac

SEQ ID NO: 693753 - RNA, 12 nt, Homo sapiens
guuuagaccaag

SEQ ID NO: 693754 - RNA, 14 nt, Homo sapiens
guuuagaccaagga

SEQ ID NO: 693755 - RNA, 17 nt, Homo sapiens
uaaaacuauaaguaaua

SEQ ID NO: 693756 - RNA, 11 nt, Homo sapiens
uaaagaccaaa

SEQ ID NO: 693757 - RNA, 13 nt, Homo sapiens
uaaaugccuaaua

SEQ ID NO: 693758 - RNA, 11 nt, Homo sapiens
uaacucuuaug

SEQ ID NO: 693759 - RNA, 17 nt, Homo sapiens
uaauggacaaagggaaa

SEQ ID NO: 693760 - RNA, 19 nt, Homo sapiens
uaauuuucgaaaacuuccc

SEQ ID NO: 693761 - RNA, 18 nt, Homo sapiens
uacauaguagacaugugu

SEQ ID NO: 693762 - RNA, 17 nt, Homo sapiens
uacugaugguuacauau

SEQ ID NO: 693763 - RNA, 21 nt, Homo sapiens
uacugaugguuacauauacua

SEQ ID NO: 693764 - RNA, 21 nt, Homo sapiens
uacuugugaaacacagcuguu

SEQ ID NO: 693765 - RNA, 22 nt, Homo sapiens
uacuuugguuucugucuguaag

SEQ ID NO: 693766 - RNA, 12 nt, Homo sapiens
uagaaacccaag

SEQ ID NO: 693767 - RNA, 16 nt, Homo sapiens
uagaauauaggucucu

SEQ ID NO: 693768 - RNA, 16 nt, Homo sapiens
aaaaauaaagcauuau

SEQ ID NO: 693769 - RNA, 14 nt, Homo sapiens
aaacaugauauauc

SEQ ID NO: 693770 - RNA, 23 nt, Homo sapiens
aaacccacgauuuucuccagcuc

SEQ ID NO: 693771 - RNA, 19 nt, Homo sapiens
aaagagaauccaacuuuau

SEQ ID NO: 693772 - RNA, 22 nt, Homo sapiens
aaagggaaauacucuuaauuca

SEQ ID NO: 693773 - RNA, 14 nt, Homo sapiens
aaauagacauauua

SEQ ID NO: 693774 - RNA, 20 nt, Homo sapiens
aaauauauacccccccaugc

SEQ ID NO: 693775 - RNA, 16 nt, Homo sapiens
aaaucccaacauuucu

SEQ ID NO: 693776 - RNA, 15 nt, Homo sapiens
aacaaccaagcgcau

SEQ ID NO: 693777 - RNA, 20 nt, Homo sapiens
aacccacgauuuucuccagc

SEQ ID NO: 693778 - RNA, 13 nt, Homo sapiens
aagaaaaaccacu

SEQ ID NO: 693779 - RNA, 14 nt, Homo sapiens
aagacaccauuuau

SEQ ID NO: 693780 - RNA, 12 nt, Homo sapiens
aagcacaagcag

SEQ ID NO: 693781 - RNA, 17 nt, Homo sapiens
aagcagccaucacauga

SEQ ID NO: 693782 - RNA, 18 nt, Homo sapiens
aagcauucuccccagugu

SEQ ID NO: 693783 - RNA, 19 nt, Homo sapiens
aaggaaucuuuaagcagag

SEQ ID NO: 693784 - RNA, 19 nt, Homo sapiens
aagugguaggaaagccuca

SEQ ID NO: 693785 - RNA, 22 nt, Homo sapiens
aaguuauccagaggguugugau

SEQ ID NO: 693786 - RNA, 19 nt, Homo sapiens
aauaucuuuaaaugaugua

SEQ ID NO: 693787 - RNA, 13 nt, Homo sapiens
aaucccaaccauc

SEQ ID NO: 693788 - RNA, 23 nt, Homo sapiens
aaucuuuaagcagagaagggcau

SEQ ID NO: 693789 - RNA, 15 nt, Homo sapiens
aaugaaaaacaacca

SEQ ID NO: 693790 - RNA, 13 nt, Homo sapiens
aauguuugucuca

SEQ ID NO: 693791 - RNA, 21 nt, Homo sapiens
aauuaaaaaguuaaucuucau

SEQ ID NO: 693792 - RNA, 23 nt, Homo sapiens
aauugaagagagauauaucugaa

SEQ ID NO: 693793 - RNA, 13 nt, Homo sapiens
aauugcaugacuu

SEQ ID NO: 693794 - RNA, 16 nt, Homo sapiens
aauugcaugacuugua

SEQ ID NO: 693795 - RNA, 20 nt, Homo sapiens
aauugucuuuugucaugugg

SEQ ID NO: 693796 - RNA, 16 nt, Homo sapiens
acaaagggaaauacuc

SEQ ID NO: 693797 - RNA, 18 nt, Homo sapiens
acaaauauaaaacuauaa

SEQ ID NO: 693798 - RNA, 13 nt, Homo sapiens
acacagaccacca

SEQ ID NO: 693799 - RNA, 14 nt, Homo sapiens
acacagaccaccau

SEQ ID NO: 693800 - RNA, 13 nt, Homo sapiens
acacagcuguucu

SEQ ID NO: 693801 - RNA, 14 nt, Homo sapiens
acaccauuuaucua

SEQ ID NO: 693802 - RNA, 22 nt, Homo sapiens
acaugaucuguuuuucaccacu

SEQ ID NO: 693803 - RNA, 17 nt, Homo sapiens
acccuacuuucauuccu

SEQ ID NO: 693804 - RNA, 14 nt, Homo sapiens
acccugagcacucu

SEQ ID NO: 693805 - RNA, 16 nt, Homo sapiens
acccugagcacucuua

SEQ ID NO: 693806 - RNA, 21 nt, Homo sapiens
accgcuuguggggacccaggc

SEQ ID NO: 693807 - RNA, 22 nt, Homo sapiens
acgcuggguccuaauuaccagu

SEQ ID NO: 693808 - RNA, 20 nt, Homo sapiens
acucagggcuccucccagcu

SEQ ID NO: 693809 - RNA, 21 nt, Homo sapiens
acucgcuuguaaauaccagga

SEQ ID NO: 693810 - RNA, 18 nt, Homo sapiens
acucuuaucaaucccaac

SEQ ID NO: 693811 - RNA, 18 nt, Homo sapiens
acugaguucuauauucug

SEQ ID NO: 693812 - RNA, 22 nt, Homo sapiens
acuguacaaguuuuguuuacuu

SEQ ID NO: 693813 - RNA, 18 nt, Homo sapiens
acuuacuauucauuaaau

SEQ ID NO: 693814 - RNA, 18 nt, Homo sapiens
acuucuauccuguuaaca

SEQ ID NO: 693815 - RNA, 15 nt, Homo sapiens
acuuuucugcugaua

SEQ ID NO: 693816 - RNA, 19 nt, Homo sapiens
agaacccagggcucugccc

SEQ ID NO: 693817 - RNA, 23 nt, Homo sapiens
agaccaaggaacaaaaaaaccac

SEQ ID NO: 693818 - RNA, 20 nt, Homo sapiens
agacugcaaacauguugccu

SEQ ID NO: 693819 - RNA, 17 nt, Homo sapiens
agagagauauaucugaa

SEQ ID NO: 693820 - RNA, 17 nt, Homo sapiens
agauaucuaugacugug

SEQ ID NO: 693821 - RNA, 20 nt, Homo sapiens
agaugaaaccaggucacugg

SEQ ID NO: 693822 - RNA, 19 nt, Homo sapiens
agcaaaucccaacauuucu

SEQ ID NO: 693823 - RNA, 18 nt, Homo sapiens
agccccuagaaacccaag

SEQ ID NO: 693824 - RNA, 21 nt, Homo sapiens
agccuggaucuguguguaugu

SEQ ID NO: 693825 - RNA, 16 nt, Homo sapiens
agcucagaacccaggg

SEQ ID NO: 693826 - RNA, 23 nt, Homo sapiens
agcuucuaauaaauuauacaaau

SEQ ID NO: 693827 - RNA, 15 nt, Homo sapiens
agcuuguaggagcug

SEQ ID NO: 693828 - RNA, 16 nt, Homo sapiens
agggacuuugcugauu

SEQ ID NO: 693829 - RNA, 14 nt, Homo sapiens
aguaaucuguacau

SEQ ID NO: 693830 - RNA, 18 nt, Homo sapiens
aguccugcuccagaauuu

SEQ ID NO: 693831 - RNA, 19 nt, Homo sapiens
auaaaaaaguguccuauaa

SEQ ID NO: 693832 - RNA, 13 nt, Homo sapiens
auaagaagcaaau

SEQ ID NO: 693833 - RNA, 22 nt, Homo sapiens
auagauuuucauguucuugcag

SEQ ID NO: 693834 - RNA, 21 nt, Homo sapiens
auaucauccugccuucaugga

SEQ ID NO: 693835 - RNA, 12 nt, Homo sapiens
auaucuaugacu

SEQ ID NO: 693836 - RNA, 12 nt, Homo sapiens
auauuauuuggc

SEQ ID NO: 693837 - RNA, 16 nt, Homo sapiens
auauucuuuucugcaa

SEQ ID NO: 693838 - RNA, 18 nt, Homo sapiens
auccagaggguugugauu

SEQ ID NO: 693839 - RNA, 16 nt, Homo sapiens
aucccgagucugggac

SEQ ID NO: 693840 - RNA, 16 nt, Homo sapiens
aucuguggucuucaaa

SEQ ID NO: 693841 - RNA, 15 nt, Homo sapiens
augacugugcuacug

SEQ ID NO: 693842 - RNA, 16 nt, Homo sapiens
augaucaaacuuccau

SEQ ID NO: 693843 - RNA, 18 nt, Homo sapiens
augcuucaguacuuguga

SEQ ID NO: 693844 - RNA, 22 nt, Homo sapiens
auggccauagcuuuuauucauu

SEQ ID NO: 693845 - RNA, 19 nt, Homo sapiens
auguuaugacuccuugaua

SEQ ID NO: 693846 - RNA, 14 nt, Homo sapiens
auguuugacacaau

SEQ ID NO: 693847 - RNA, 23 nt, Homo sapiens
auuaacaugcuuaugacaaugac

SEQ ID NO: 693848 - RNA, 16 nt, Homo sapiens
auuaagcucacaauaa

SEQ ID NO: 693849 - RNA, 22 nt, Homo sapiens
auugaaaaugugaauugcauga

SEQ ID NO: 693850 - RNA, 17 nt, Homo sapiens
auugagauuuaauuccc

SEQ ID NO: 693851 - RNA, 13 nt, Homo sapiens
caaaaaaaccaca

SEQ ID NO: 693852 - RNA, 17 nt, Homo sapiens
caaacccaacucuaaug

SEQ ID NO: 693853 - RNA, 21 nt, Homo sapiens
caaacccacgauuuucuccag

SEQ ID NO: 693854 - RNA, 20 nt, Homo sapiens
caaagaggacucgcuuguaa

SEQ ID NO: 693855 - RNA, 20 nt, Homo sapiens
caacaaacccaacucuaaug

SEQ ID NO: 693856 - RNA, 19 nt, Homo sapiens
caacuugaaauuauaucug

SEQ ID NO: 693857 - RNA, 21 nt, Homo sapiens
caacuugaaauuauaucugug

SEQ ID NO: 693858 - RNA, 15 nt, Homo sapiens
caagcagagugcaca

SEQ ID NO: 693859 - RNA, 17 nt, Homo sapiens
caagcucccugccccaa

SEQ ID NO: 693860 - RNA, 17 nt, Homo sapiens
caaucuguccacaaaua

SEQ ID NO: 693861 - RNA, 22 nt, Homo sapiens
caaugacugugcuacugucuuu

SEQ ID NO: 693862 - RNA, 19 nt, Homo sapiens
cacaauaaggaagaaauaa

SEQ ID NO: 693863 - RNA, 16 nt, Homo sapiens
cacccuuaacccaagg

SEQ ID NO: 693864 - RNA, 21 nt, Homo sapiens
cagaugaaaccaggucacugg

SEQ ID NO: 693865 - RNA, 21 nt, Homo sapiens
cagcugguuuuguuccagaga

SEQ ID NO: 693866 - RNA, 16 nt, Homo sapiens
cagcugucuguggcuu

SEQ ID NO: 693867 - RNA, 19 nt, Homo sapiens
caggaccucccuuccgacc

SEQ ID NO: 693868 - RNA, 15 nt, Homo sapiens
ugauuaaaacauuau

SEQ ID NO: 693869 - RNA, 19 nt, Homo sapiens
ugcaugacuuguagcauau

SEQ ID NO: 693870 - RNA, 14 nt, Homo sapiens
uggacucuaaagac

SEQ ID NO: 693871 - RNA, 18 nt, Homo sapiens
uggacucuaaagaccaaa

SEQ ID NO: 693872 - RNA, 20 nt, Homo sapiens
ugggacacaaaacuccgccc

SEQ ID NO: 693873 - RNA, 15 nt, Homo sapiens
ugggcauugacaaau

SEQ ID NO: 693874 - RNA, 20 nt, Homo sapiens
ugggcauugacaaaucugug

SEQ ID NO: 693875 - RNA, 22 nt, Homo sapiens
uggguccuaauuaccagucuuu

SEQ ID NO: 693876 - RNA, 15 nt, Homo sapiens
uguccacaaauauaa

SEQ ID NO: 693877 - RNA, 18 nt, Homo sapiens
uguccucaaaaggaauaa

SEQ ID NO: 693878 - RNA, 16 nt, Homo sapiens
uguguguauguacaua

SEQ ID NO: 693879 - RNA, 14 nt, Homo sapiens
uguuaugacuccuu

SEQ ID NO: 693880 - RNA, 22 nt, Homo sapiens
uguuguaaaaagaaaaaccacu

SEQ ID NO: 693881 - RNA, 18 nt, Homo sapiens
uguuugucucaguuggaa

SEQ ID NO: 693882 - RNA, 13 nt, Homo sapiens
uuaguaucucauc

SEQ ID NO: 693883 - RNA, 15 nt, Homo sapiens
uuaguaucucaucaa

SEQ ID NO: 693884 - RNA, 14 nt, Homo sapiens
uuaugacaaugacu

SEQ ID NO: 693885 - RNA, 21 nt, Homo sapiens
uucaagaaagauaucuaugac

SEQ ID NO: 693886 - RNA, 23 nt, Homo sapiens
uucaguacuugugaaacacagcu

SEQ ID NO: 693887 - RNA, 13 nt, Homo sapiens
uucaguuccaaga

SEQ ID NO: 693888 - RNA, 12 nt, Homo sapiens
uucauacuuuga

SEQ ID NO: 693889 - RNA, 22 nt, Homo sapiens
uucaugaauaaaaacuuugcag

SEQ ID NO: 693890 - RNA, 15 nt, Homo sapiens
uuccccuugccuuau

SEQ ID NO: 693891 - RNA, 19 nt, Homo sapiens
uucugucagaaugcuauug

SEQ ID NO: 693892 - RNA, 19 nt, Homo sapiens
uugccucccagcuucuuau

SEQ ID NO: 693893 - RNA, 20 nt, Homo sapiens
uuuauuauguccauuauuca

SEQ ID NO: 693894 - RNA, 19 nt, Homo sapiens
uuuauucauuagcugugau

SEQ ID NO: 693895 - RNA, 20 nt, Homo sapiens
uuugucaugccauuaagcuc

SEQ ID NO: 693896 - RNA, 13 nt, Homo sapiens
uuuguugccuuau

SEQ ID NO: 693897 - RNA, 13 nt, Homo sapiens
cacccaggcacuu

SEQ ID NO: 693898 - RNA, 14 nt, Homo sapiens
cacucugggcacac

SEQ ID NO: 693899 - RNA, 18 nt, Homo sapiens
cagaauuuggaaauccua

SEQ ID NO: 693900 - RNA, 17 nt, Homo sapiens
cagccaucacaugaucu

SEQ ID NO: 693901 - RNA, 18 nt, Homo sapiens
cagccuucuucucuuaau

SEQ ID NO: 693902 - RNA, 16 nt, Homo sapiens
cagcucagaacccagg

SEQ ID NO: 693903 - RNA, 15 nt, Homo sapiens
cagucugccaggaga

SEQ ID NO: 693904 - RNA, 22 nt, Homo sapiens
caugacuuguagcauauucuuu

SEQ ID NO: 693905 - RNA, 17 nt, Homo sapiens
cauguggcuaaaugccu

SEQ ID NO: 693906 - RNA, 20 nt, Homo sapiens
cauuaaauguuugacacaau

SEQ ID NO: 693907 - RNA, 15 nt, Homo sapiens
cauuaagcucacaau

SEQ ID NO: 693908 - RNA, 19 nt, Homo sapiens
ccaaaaaaauaaagcauua

SEQ ID NO: 693909 - RNA, 14 nt, Homo sapiens
ccaaauaacuucag

SEQ ID NO: 693910 - RNA, 20 nt, Homo sapiens
ccaacccugagcacucuuau

SEQ ID NO: 693911 - RNA, 22 nt, Homo sapiens
ccaacucugagcccauguucug

SEQ ID NO: 693912 - RNA, 19 nt, Homo sapiens
ccaagcacuccacaacuca

SEQ ID NO: 693913 - RNA, 9 nt, Homo sapiens
ccacaaagg

SEQ ID NO: 693914 - RNA, 22 nt, Homo sapiens
ccacgauuuucuccagcucaga

SEQ ID NO: 693915 - RNA, 23 nt, Homo sapiens
ccagcaaagaggacucgcuugua

SEQ ID NO: 693916 - RNA, 17 nt, Homo sapiens
ccagggcucugccccag

SEQ ID NO: 693917 - RNA, 22 nt, Homo sapiens
ccauaucuugcgaauccaagcu

SEQ ID NO: 693918 - RNA, 23 nt, Homo sapiens
ccauguucugcccccagcccaaa

SEQ ID NO: 693919 - RNA, 12 nt, Homo sapiens
cccaagcacucc

SEQ ID NO: 693920 - RNA, 13 nt, Homo sapiens
cccaccuccagcc

SEQ ID NO: 693921 - RNA, 15 nt, Homo sapiens
cccagcccaaagggg

SEQ ID NO: 693922 - RNA, 22 nt, Homo sapiens
cccaguccccagcccuucacau

SEQ ID NO: 693923 - RNA, 19 nt, Homo sapiens
cccaguguaugucuuguau

SEQ ID NO: 693924 - RNA, 21 nt, Homo sapiens
cccucuggccgccuaggcuca

SEQ ID NO: 693925 - RNA, 16 nt, Homo sapiens
ccgcccucuuccugac

SEQ ID NO: 693926 - RNA, 15 nt, Homo sapiens
ccucccagcuucuua

SEQ ID NO: 693927 - RNA, 15 nt, Homo sapiens
ccugcuccagaauuu

SEQ ID NO: 693928 - RNA, 17 nt, Homo sapiens
ccuuaacccaaggagca

SEQ ID NO: 693929 - RNA, 12 nt, Homo sapiens
ccuuaucccaua

SEQ ID NO: 693930 - RNA, 19 nt, Homo sapiens
ccuuccgacccucugggaa

SEQ ID NO: 693931 - RNA, 19 nt, Homo sapiens
cgacuuuucuuaacaaccu

SEQ ID NO: 693932 - RNA, 15 nt, Homo sapiens
cgcacuucagaauuc

SEQ ID NO: 693933 - RNA, 21 nt, Homo sapiens
cgcuucgacuuuucuuaacaa

SEQ ID NO: 693934 - RNA, 19 nt, Homo sapiens
cguaucccgagucugggac

SEQ ID NO: 693935 - RNA, 21 nt, Homo sapiens
cgucagucuuuuucuguugua

SEQ ID NO: 693936 - RNA, 13 nt, Homo sapiens
cuaauaaacaauu

SEQ ID NO: 693937 - RNA, 20 nt, Homo sapiens
cuaaugugaaaauguauucu

SEQ ID NO: 693938 - RNA, 22 nt, Homo sapiens
cuaauuaaaaaguuaaucuuca

SEQ ID NO: 693939 - RNA, 18 nt, Homo sapiens
cuagaaacccaagcuccu

SEQ ID NO: 693940 - RNA, 20 nt, Homo sapiens
cuauauucuggugaguuaau

SEQ ID NO: 693941 - RNA, 23 nt, Homo sapiens
cucaccucuacccaaacccuagg

SEQ ID NO: 693942 - RNA, 20 nt, Homo sapiens
cucagccacacccaggcacu

SEQ ID NO: 693943 - RNA, 14 nt, Homo sapiens
cucaucaacaaaga

SEQ ID NO: 693944 - RNA, 22 nt, Homo sapiens
cucaucaacaaagaaauauuau

SEQ ID NO: 693945 - RNA, 13 nt, Homo sapiens
cuccacaacucaa

SEQ ID NO: 693946 - RNA, 21 nt, Homo sapiens
cuccagaauuuggaaauccua

SEQ ID NO: 693947 - RNA, 16 nt, Homo sapiens
cucccagaaucccagc

SEQ ID NO: 693948 - RNA, 14 nt, Homo sapiens
cucuaaagaccaaa

SEQ ID NO: 693949 - RNA, 20 nt, Homo sapiens
cucugugcugacauggcucu

SEQ ID NO: 693950 - RNA, 23 nt, Homo sapiens
cucuuaucaaucccaaccauccu

SEQ ID NO: 693951 - RNA, 12 nt, Homo sapiens
cucuuccugacg

SEQ ID NO: 693952 - RNA, 15 nt, Homo sapiens
cugaaaacuggaaua

SEQ ID NO: 693953 - RNA, 20 nt, Homo sapiens
cugcaaaauagacauauuaa

SEQ ID NO: 693954 - RNA, 17 nt, Homo sapiens
cugcaaacauguugccu

SEQ ID NO: 693955 - RNA, 14 nt, Homo sapiens
cugcuuaguaucuc

SEQ ID NO: 693956 - RNA, 23 nt, Homo sapiens
cuggaauaagaagcaaauaaaua

SEQ ID NO: 693957 - RNA, 15 nt, Homo sapiens
cugucagaaugcuau

SEQ ID NO: 693958 - RNA, 23 nt, Homo sapiens
cuguccacugggccauuguggug

SEQ ID NO: 693959 - RNA, 21 nt, Homo sapiens
cuguggucuucaaauugucuu

SEQ ID NO: 693960 - RNA, 18 nt, Homo sapiens
cuguguauauuauuuggc

SEQ ID NO: 693961 - RNA, 18 nt, Homo sapiens
cuguguguggguguguga

SEQ ID NO: 693962 - RNA, 21 nt, Homo sapiens
cuguguuuaauaguauaucua

SEQ ID NO: 693963 - RNA, 20 nt, Homo sapiens
cuuauaagacucacaguaua

SEQ ID NO: 693964 - RNA, 15 nt, Homo sapiens
cuucagaauuccaua

SEQ ID NO: 693965 - RNA, 14 nt, Homo sapiens
cuucauggaacuca

SEQ ID NO: 693966 - RNA, 18 nt, Homo sapiens
cuucauggaacucagcug

SEQ ID NO: 693967 - RNA, 21 nt, Homo sapiens
cuucauggaacucagcugucu

SEQ ID NO: 693968 - RNA, 13 nt, Homo sapiens
cuuguagcuguaa

SEQ ID NO: 693969 - RNA, 15 nt, Homo sapiens
cuuguagcuguaaaa

SEQ ID NO: 693970 - RNA, 19 nt, Homo sapiens
cuugugaaacacagcuguu

SEQ ID NO: 693971 - RNA, 20 nt, Homo sapiens
cuuuuauucauuagcuguga

SEQ ID NO: 693972 - RNA, 14 nt, Homo sapiens
cuuuugccuuucaa

SEQ ID NO: 693973 - RNA, 16 nt, Homo sapiens
cuuuugucauguggcu

SEQ ID NO: 693974 - RNA, 12 nt, Homo sapiens
gaaaaacaacca

SEQ ID NO: 693975 - RNA, 19 nt, Homo sapiens
gaaaaauguuugucucagu

SEQ ID NO: 693976 - RNA, 14 nt, Homo sapiens
gaacaaaaaaacca

SEQ ID NO: 693977 - RNA, 19 nt, Homo sapiens
gaagcagccaucacaugau

SEQ ID NO: 693978 - RNA, 20 nt, Homo sapiens
gaaguuccauuuaagggcaa

SEQ ID NO: 693979 - RNA, 22 nt, Homo sapiens
gaauaaaacuuuucugcugaua

SEQ ID NO: 693980 - RNA, 16 nt, Homo sapiens
gaauuuaaucuuugag

SEQ ID NO: 693981 - RNA, 22 nt, Homo sapiens
gaauuuaaucuuugaggaaaag

SEQ ID NO: 693982 - RNA, 13 nt, Homo sapiens
gacacaaaacucc

SEQ ID NO: 693983 - RNA, 18 nt, Homo sapiens
gacacaaaacuccgcccc

SEQ ID NO: 693984 - RNA, 20 nt, Homo sapiens
gacuguguuuaauaguauau

SEQ ID NO: 693985 - RNA, 14 nt, Homo sapiens
gagcggcugguuca

SEQ ID NO: 693986 - RNA, 17 nt, Homo sapiens
gagggacuuugcugauu

SEQ ID NO: 693987 - RNA, 23 nt, Homo sapiens
gauauauuuuccagggcaaucaa

SEQ ID NO: 693988 - RNA, 18 nt, Homo sapiens
gauaucuaugacuguguu

SEQ ID NO: 693989 - RNA, 12 nt, Homo sapiens
gauccccaaccc

SEQ ID NO: 693990 - RNA, 17 nt, Homo sapiens
gaucuguuuuucaccac

SEQ ID NO: 693991 - RNA, 22 nt, Homo sapiens
gaucuguuuuucaccacuucac

SEQ ID NO: 693992 - RNA, 14 nt, Homo sapiens
gauuccaaaccaac

SEQ ID NO: 693993 - RNA, 15 nt, Homo sapiens
gauuccaaaccaaca

SEQ ID NO: 693994 - RNA, 12 nt, Homo sapiens
gauuuugcacuu

SEQ ID NO: 693995 - RNA, 14 nt, Homo sapiens
gcaaauaaauauca

SEQ ID NO: 693996 - RNA, 15 nt, Homo sapiens
gcacuucagaauucc

SEQ ID NO: 693997 - RNA, 16 nt, Homo sapiens
gcagagugcacagcug

SEQ ID NO: 693998 - RNA, 22 nt, Homo sapiens
gcccagccccuagaaacccaag

SEQ ID NO: 693999 - RNA, 16 nt, Homo sapiens
gccccuuuaacucuua

SEQ ID NO: 694000 - RNA, 17 nt, Homo sapiens
gcccgggagccuaggac

SEQ ID NO: 694001 - RNA, 19 nt, Homo sapiens
gccucgauuuugcacuuuu

SEQ ID NO: 694002 - RNA, 13 nt, Homo sapiens
gcucagaacccag

SEQ ID NO: 694003 - RNA, 20 nt, Homo sapiens
gcugauuuccccucuucccu

SEQ ID NO: 694004 - RNA, 16 nt, Homo sapiens
gcugcaggaaucaaaa

SEQ ID NO: 694005 - RNA, 21 nt, Homo sapiens
gcuguggcauuguugaugcuc

SEQ ID NO: 694006 - RNA, 21 nt, Homo sapiens
gcuguucuucuguucugcaga

SEQ ID NO: 694007 - RNA, 19 nt, Homo sapiens
ggaagccuggaucugugug

SEQ ID NO: 694008 - RNA, 19 nt, Homo sapiens
ggagccuaggaccacucag

SEQ ID NO: 694009 - RNA, 18 nt, Homo sapiens
ggagucugcuucauuucc

SEQ ID NO: 694010 - RNA, 20 nt, Homo sapiens
guacuugugaaacacagcug

SEQ ID NO: 694011 - RNA, 15 nt, Homo sapiens
guaucaaacccacga

SEQ ID NO: 694012 - RNA, 17 nt, Homo sapiens
gucacugacacaaagga

SEQ ID NO: 694013 - RNA, 12 nt, Homo sapiens
guccauuauuca

SEQ ID NO: 694014 - RNA, 12 nt, Homo sapiens
gugaacuuguag

SEQ ID NO: 694015 - RNA, 19 nt, Homo sapiens
gugguaggaaagccucacu

SEQ ID NO: 694016 - RNA, 17 nt, Homo sapiens
guuaacacuguaauauc

SEQ ID NO: 694017 - RNA, 11 nt, Homo sapiens
guuacauauac

SEQ ID NO: 694018 - RNA, 18 nt, Homo sapiens
guuggacuaaaugccuag

SEQ ID NO: 694019 - RNA, 21 nt, Homo sapiens
guuuuucaccacuucacugaa

SEQ ID NO: 694020 - RNA, 16 nt, Homo sapiens
uaaaaagaaaaaccac

SEQ ID NO: 694021 - RNA, 17 nt, Homo sapiens
uaaaaaguuaaucuuca

SEQ ID NO: 694022 - RNA, 18 nt, Homo sapiens
uaaaaaguuaaucuucau

SEQ ID NO: 694023 - RNA, 20 nt, Homo sapiens
uaaauaucauccugccuuca

SEQ ID NO: 694024 - RNA, 16 nt, Homo sapiens
uaaauguuaugacucc

SEQ ID NO: 694025 - RNA, 18 nt, Homo sapiens
uaacacuguaauaucuuu

SEQ ID NO: 694026 - RNA, 13 nt, Homo sapiens
uaacaugcuuaug

SEQ ID NO: 694027 - RNA, 22 nt, Homo sapiens
uaacaugcuuaugacaaugacu

SEQ ID NO: 694028 - RNA, 19 nt, Homo sapiens
uaagaagcagccaucacau

SEQ ID NO: 694029 - RNA, 19 nt, Homo sapiens
aaaaugaaaaacaaccaag

SEQ ID NO: 694030 - RNA, 17 nt, Homo sapiens
aaacuuuucugcugaua

SEQ ID NO: 694031 - RNA, 14 nt, Homo sapiens
aaagacaccauuua

SEQ ID NO: 694032 - RNA, 15 nt, Homo sapiens
aaauauuauuugcua

SEQ ID NO: 694033 - RNA, 13 nt, Homo sapiens
aaccaacaaaccc

SEQ ID NO: 694034 - RNA, 13 nt, Homo sapiens
aacccaagcuccu

SEQ ID NO: 694035 - RNA, 14 nt, Homo sapiens
aacccaaggagcac

SEQ ID NO: 694036 - RNA, 21 nt, Homo sapiens
aacccacuugucacugacaca

SEQ ID NO: 694037 - RNA, 22 nt, Homo sapiens
aacccagggcucugccccaguc

SEQ ID NO: 694038 - RNA, 13 nt, Homo sapiens
aacucagcugucu

SEQ ID NO: 694039 - RNA, 16 nt, Homo sapiens
aacuuacuauucauua

SEQ ID NO: 694040 - RNA, 20 nt, Homo sapiens
aacuuauguagauauuuggc

SEQ ID NO: 694041 - RNA, 18 nt, Homo sapiens
aacuuuucugcugauaag

SEQ ID NO: 694042 - RNA, 15 nt, Homo sapiens
aagauucaccugaga

SEQ ID NO: 694043 - RNA, 20 nt, Homo sapiens
aaggaaucuuuaagcagaga

SEQ ID NO: 694044 - RNA, 18 nt, Homo sapiens
aagugguaggaaagccuc

SEQ ID NO: 694045 - RNA, 16 nt, Homo sapiens
aaguuaaucuucaugg

SEQ ID NO: 694046 - RNA, 14 nt, Homo sapiens
aauaaagcauuaua

SEQ ID NO: 694047 - RNA, 23 nt, Homo sapiens
aauagacauauuaacaugcuuau

SEQ ID NO: 694048 - RNA, 15 nt, Homo sapiens
aauauuauuugcuaa

SEQ ID NO: 694049 - RNA, 17 nt, Homo sapiens
aaucaauguucacgcaa

SEQ ID NO: 694050 - RNA, 13 nt, Homo sapiens
aauccaagcuccc

SEQ ID NO: 694051 - RNA, 21 nt, Homo sapiens
aaucuguacauuuuguuguaa

SEQ ID NO: 694052 - RNA, 19 nt, Homo sapiens
aauucccaaauguauucua

SEQ ID NO: 694053 - RNA, 20 nt, Homo sapiens
acaaauauaaaacuauaagu

SEQ ID NO: 694054 - RNA, 16 nt, Homo sapiens
acaauuggaauugucu

SEQ ID NO: 694055 - RNA, 20 nt, Homo sapiens
acagcuuuggggugucuuuu

SEQ ID NO: 694056 - RNA, 23 nt, Homo sapiens
acauaugauaaaaaaguguccua

SEQ ID NO: 694057 - RNA, 16 nt, Homo sapiens
acauauuaacaugcuu

SEQ ID NO: 694058 - RNA, 23 nt, Homo sapiens
acauuauagauuuucauguucuu

SEQ ID NO: 694059 - RNA, 16 nt, Homo sapiens
accaacaaacccaacu

SEQ ID NO: 694060 - RNA, 15 nt, Homo sapiens
accauuuaucuaccc

SEQ ID NO: 694061 - RNA, 15 nt, Homo sapiens
acccaaacccuaggu

SEQ ID NO: 694062 - RNA, 15 nt, Homo sapiens
acccccaagcacucc

SEQ ID NO: 694063 - RNA, 21 nt, Homo sapiens
acuggaauaagaagcaaauaa

SEQ ID NO: 694064 - RNA, 15 nt, Homo sapiens
acuuaagcacaagca

SEQ ID NO: 694065 - RNA, 15 nt, Homo sapiens
acuucuauccuguua

SEQ ID NO: 694066 - RNA, 12 nt, Homo sapiens
agaaacccaagc

SEQ ID NO: 694067 - RNA, 22 nt, Homo sapiens
agaagcagccaucacaugaucu

SEQ ID NO: 694068 - RNA, 22 nt, Homo sapiens
agaccaacguuacucagggcuc

SEQ ID NO: 694069 - RNA, 10 nt, Homo sapiens
agagacuggu

SEQ ID NO: 694070 - RNA, 15 nt, Homo sapiens
agagauauaucugaa

SEQ ID NO: 694071 - RNA, 22 nt, Homo sapiens
agcaaagaggacucgcuuguaa

SEQ ID NO: 694072 - RNA, 17 nt, Homo sapiens
agcaaauaaauaucauc

SEQ ID NO: 694073 - RNA, 16 nt, Homo sapiens
agccaucacaugaucu

SEQ ID NO: 694074 - RNA, 22 nt, Homo sapiens
agcccaaaggggacaggccuca

SEQ ID NO: 694075 - RNA, 17 nt, Homo sapiens
agccccuagaaacccaa

SEQ ID NO: 694076 - RNA, 16 nt, Homo sapiens
agccuaggaccacuca

SEQ ID NO: 694077 - RNA, 18 nt, Homo sapiens
agccuaggaccacucagc

SEQ ID NO: 694078 - RNA, 18 nt, Homo sapiens
agcuuuuuguugccuuau

SEQ ID NO: 694079 - RNA, 21 nt, Homo sapiens
aggaaagccucacugauauau

SEQ ID NO: 694080 - RNA, 21 nt, Homo sapiens
aguauauuuccgcacuucaga

SEQ ID NO: 694081 - RNA, 23 nt, Homo sapiens
agucccccaacucugagcccaug

SEQ ID NO: 694082 - RNA, 21 nt, Homo sapiens
aguuucugugugaacucucag

SEQ ID NO: 694083 - RNA, 20 nt, Homo sapiens
auaaaacuuuucugcugaua

SEQ ID NO: 694084 - RNA, 16 nt, Homo sapiens
auaaaagauucaccug

SEQ ID NO: 694085 - RNA, 17 nt, Homo sapiens
auaacagauaaguccau

SEQ ID NO: 694086 - RNA, 22 nt, Homo sapiens
auaucuugcgaauccaagcucc

SEQ ID NO: 694087 - RNA, 18 nt, Homo sapiens
auaugaucaaacuuccau

SEQ ID NO: 694088 - RNA, 12 nt, Homo sapiens
aucaaacuucca

SEQ ID NO: 694089 - RNA, 17 nt, Homo sapiens
auccaaucucaaggaau

SEQ ID NO: 694090 - RNA, 20 nt, Homo sapiens
auccuguuaacacuguaaua

SEQ ID NO: 694091 - RNA, 23 nt, Homo sapiens
aucuaacgcuuuaaauggcuacu

SEQ ID NO: 694092 - RNA, 12 nt, Homo sapiens
augacugugcua

SEQ ID NO: 694093 - RNA, 13 nt, Homo sapiens
augacuuguagca

SEQ ID NO: 694094 - RNA, 14 nt, Homo sapiens
augcuuaugacaau

SEQ ID NO: 694095 - RNA, 19 nt, Homo sapiens
auguccauuauucaagaaa

SEQ ID NO: 694096 - RNA, 17 nt, Homo sapiens
augugaaaauguauucu

SEQ ID NO: 694097 - RNA, 19 nt, Homo sapiens
auguuugacacaauuggaa

SEQ ID NO: 694098 - RNA, 16 nt, Homo sapiens
uagacaguagauacca

SEQ ID NO: 694099 - RNA, 22 nt, Homo sapiens
uagauguaucaaaauacuacca

SEQ ID NO: 694100 - RNA, 22 nt, Homo sapiens
uagcuguaaaacgcugucaaaa

SEQ ID NO: 694101 - RNA, 14 nt, Homo sapiens
uagcuuuuauucau

SEQ ID NO: 694102 - RNA, 22 nt, Homo sapiens
uauaacuaaacaugauauauca

SEQ ID NO: 694103 - RNA, 14 nt, Homo sapiens
uauccgaagagauc

SEQ ID NO: 694104 - RNA, 15 nt, Homo sapiens
uaucuuguguaugga

SEQ ID NO: 694105 - RNA, 15 nt, Homo sapiens
uauguagauauuugg

SEQ ID NO: 694106 - RNA, 22 nt, Homo sapiens
ucaaucucuuaaagagaaucca

SEQ ID NO: 694107 - RNA, 18 nt, Homo sapiens
ucacugaaagacaccauu

SEQ ID NO: 694108 - RNA, 16 nt, Homo sapiens
ucagaaugcuauugaa

SEQ ID NO: 694109 - RNA, 15 nt, Homo sapiens
ucagauggugaagca

SEQ ID NO: 694110 - RNA, 15 nt, Homo sapiens
ucagcuuuugccuuu

SEQ ID NO: 694111 - RNA, 20 nt, Homo sapiens
ucaugaauaaaaacuuugca

SEQ ID NO: 694112 - RNA, 23 nt, Homo sapiens
ucauggccauagcuuuuauucau

SEQ ID NO: 694113 - RNA, 13 nt, Homo sapiens
ucauuagcuguga

SEQ ID NO: 694114 - RNA, 18 nt, Homo sapiens
uccagaggguugugauuu

SEQ ID NO: 694115 - RNA, 14 nt, Homo sapiens
uccauauuugccuu

SEQ ID NO: 694116 - RNA, 16 nt, Homo sapiens
ucccaccccaagcaaa

SEQ ID NO: 694117 - RNA, 14 nt, Homo sapiens
uccccuugccuuau

SEQ ID NO: 694118 - RNA, 14 nt, Homo sapiens
uccuaauuaccagu

SEQ ID NO: 694119 - RNA, 21 nt, Homo sapiens
uccucugagcuguuaucuugu

SEQ ID NO: 694120 - RNA, 20 nt, Homo sapiens
ucgacuuuucuuaacaaccu

SEQ ID NO: 694121 - RNA, 12 nt, Homo sapiens
ucuaugacugug

SEQ ID NO: 694122 - RNA, 15 nt, Homo sapiens
ucucuuaaucacaag

SEQ ID NO: 694123 - RNA, 23 nt, Homo sapiens
ucucuuccuguuuuguacauaga

SEQ ID NO: 694124 - RNA, 22 nt, Homo sapiens
ucuguacauuuuguuguaaaaa

SEQ ID NO: 694125 - RNA, 19 nt, Homo sapiens
ucuguguauauuauuuggc

SEQ ID NO: 694126 - RNA, 14 nt, Homo sapiens
ucuucauggccaua

SEQ ID NO: 694127 - RNA, 15 nt, Homo sapiens
ucuuuaagcagagaa

SEQ ID NO: 694128 - RNA, 16 nt, Homo sapiens
aaaaauguuugucuca

SEQ ID NO: 694129 - RNA, 14 nt, Homo sapiens
aaaauagacauauu

SEQ ID NO: 694130 - RNA, 13 nt, Homo sapiens
aaagaaaaaccac

SEQ ID NO: 694131 - RNA, 12 nt, Homo sapiens
aaagauaucuau

SEQ ID NO: 694132 - RNA, 22 nt, Homo sapiens
aaauauauacccccccaugcag

SEQ ID NO: 694133 - RNA, 14 nt, Homo sapiens
aacaauucaaguga

SEQ ID NO: 694134 - RNA, 14 nt, Homo sapiens
aacagauaagucca

SEQ ID NO: 694135 - RNA, 13 nt, Homo sapiens
aacauguugccuc

SEQ ID NO: 694136 - RNA, 11 nt, Homo sapiens
aaccacaaagg

SEQ ID NO: 694137 - RNA, 15 nt, Homo sapiens
aacccugagcacucu

SEQ ID NO: 694138 - RNA, 13 nt, Homo sapiens
aacuuacuauuca

SEQ ID NO: 694139 - RNA, 15 nt, Homo sapiens
aacuuguagcuguaa

SEQ ID NO: 694140 - RNA, 16 nt, Homo sapiens
aacuuguagcuguaaa

SEQ ID NO: 694141 - RNA, 13 nt, Homo sapiens
aagaccaaacuuc

SEQ ID NO: 694142 - RNA, 22 nt, Homo sapiens
aagacugcaaacauguugccuc

SEQ ID NO: 694143 - RNA, 17 nt, Homo sapiens
aagauaucuaugacugu

SEQ ID NO: 694144 - RNA, 18 nt, Homo sapiens
aagauaucuaugacugug

SEQ ID NO: 694145 - RNA, 22 nt, Homo sapiens
aagauaucuaugacuguguuua

SEQ ID NO: 694146 - RNA, 20 nt, Homo sapiens
aagcacaagcagagugcaca

SEQ ID NO: 694147 - RNA, 18 nt, Homo sapiens
aagcacuccacaacucaa

SEQ ID NO: 694148 - RNA, 18 nt, Homo sapiens
aaggaacaaaaaaaccac

SEQ ID NO: 694149 - RNA, 19 nt, Homo sapiens
aaggaacaaaaaaaccaca

SEQ ID NO: 694150 - RNA, 14 nt, Homo sapiens
aaggcucagcuggu

SEQ ID NO: 694151 - RNA, 16 nt, Homo sapiens
aauaaaagauucaccu

SEQ ID NO: 694152 - RNA, 18 nt, Homo sapiens
aauaucuuuaaaugaugu

SEQ ID NO: 694153 - RNA, 17 nt, Homo sapiens
aauauuauuugcuaauu

SEQ ID NO: 694154 - RNA, 12 nt, Homo sapiens
aaucaauguuca

SEQ ID NO: 694155 - RNA, 16 nt, Homo sapiens
aaucccaacauuucuc

SEQ ID NO: 694156 - RNA, 22 nt, Homo sapiens
aaugcugauagcucauauuaua

SEQ ID NO: 694157 - RNA, 18 nt, Homo sapiens
aaugugaauugcaugacu

SEQ ID NO: 694158 - RNA, 19 nt, Homo sapiens
aauuaaaaaguuaaucuuc

SEQ ID NO: 694159 - RNA, 21 nt, Homo sapiens
aauuacccuacuuucauuccu

SEQ ID NO: 694160 - RNA, 16 nt, Homo sapiens
aauugucuuuugucau

SEQ ID NO: 694161 - RNA, 14 nt, Homo sapiens
acaaaaaaaccaca

SEQ ID NO: 694162 - RNA, 14 nt, Homo sapiens
acaaagaaauauua

SEQ ID NO: 694163 - RNA, 19 nt, Homo sapiens
acacucugccagcaaagag

SEQ ID NO: 694164 - RNA, 16 nt, Homo sapiens
acaugcuuaugacaau

SEQ ID NO: 694165 - RNA, 21 nt, Homo sapiens
acauuuuuuaugggcauugac

SEQ ID NO: 694166 - RNA, 20 nt, Homo sapiens
accaaaaaaauaaagcauua

SEQ ID NO: 694167 - RNA, 17 nt, Homo sapiens
accaccauccaccgcug

SEQ ID NO: 694168 - RNA, 14 nt, Homo sapiens
acccaaaacaaacg

SEQ ID NO: 694169 - RNA, 21 nt, Homo sapiens
accccaagcaaaucccaacau

SEQ ID NO: 694170 - RNA, 20 nt, Homo sapiens
acgcuagggcggggcacaga

SEQ ID NO: 694171 - RNA, 15 nt, Homo sapiens
acuccacaacucaag

SEQ ID NO: 694172 - RNA, 14 nt, Homo sapiens
acucuaaugcugca

SEQ ID NO: 694173 - RNA, 17 nt, Homo sapiens
acucuuaucaaucccaa

SEQ ID NO: 694174 - RNA, 17 nt, Homo sapiens
acugcaaacauguugcc

SEQ ID NO: 694175 - RNA, 18 nt, Homo sapiens
acugcuggacgucuuucu

SEQ ID NO: 694176 - RNA, 23 nt, Homo sapiens
acuggaccaaaaaaauaaagcau

SEQ ID NO: 694177 - RNA, 13 nt, Homo sapiens
acugugcuacugu

SEQ ID NO: 694178 - RNA, 18 nt, Homo sapiens
acuguuaagaagcagcca

SEQ ID NO: 694179 - RNA, 22 nt, Homo sapiens
acuguuaagaagcagccaucac

SEQ ID NO: 694180 - RNA, 20 nt, Homo sapiens
acuucacugaaagacaccau

SEQ ID NO: 694181 - RNA, 19 nt, Homo sapiens
acuugucacugacacaaag

SEQ ID NO: 694182 - RNA, 21 nt, Homo sapiens
acuugucacugacacaaagga

SEQ ID NO: 694183 - RNA, 11 nt, Homo sapiens
agaaacccaag

SEQ ID NO: 694184 - RNA, 15 nt, Homo sapiens
agaauauaggucucu

SEQ ID NO: 694185 - RNA, 22 nt, Homo sapiens
agaccaaggaacaaaaaaacca

SEQ ID NO: 694186 - RNA, 15 nt, Homo sapiens
agauuuaauucccaa

SEQ ID NO: 694187 - RNA, 23 nt, Homo sapiens
agauuuucauguucuugcaguca

SEQ ID NO: 694188 - RNA, 19 nt, Homo sapiens
agcacaagcagagugcaca

SEQ ID NO: 694189 - RNA, 15 nt, Homo sapiens
agcggugggcacugu

SEQ ID NO: 694190 - RNA, 22 nt, Homo sapiens
agcuccuccucggaaccgcuca

SEQ ID NO: 694191 - RNA, 11 nt, Homo sapiens
agcugugauuu

SEQ ID NO: 694192 - RNA, 15 nt, Homo sapiens
agcuucagaugguga

SEQ ID NO: 694193 - RNA, 18 nt, Homo sapiens
aggaacaaaaaaaccaca

SEQ ID NO: 694194 - RNA, 19 nt, Homo sapiens
aggaacaaaaaaaccacaa

SEQ ID NO: 694195 - RNA, 17 nt, Homo sapiens
aggaaucaaaaauugaa

SEQ ID NO: 694196 - RNA, 15 nt, Homo sapiens
aggaccacucagccc

SEQ ID NO: 694197 - RNA, 16 nt, Homo sapiens
aggagcacagguccca

SEQ ID NO: 694198 - RNA, 17 nt, Homo sapiens
aggagcacaggucccac

SEQ ID NO: 694199 - RNA, 17 nt, Homo sapiens
aggagcugagguuucac

SEQ ID NO: 694200 - RNA, 22 nt, Homo sapiens
agguuucacccuuaacccaagg

SEQ ID NO: 694201 - RNA, 13 nt, Homo sapiens
aguaaucuguaca

SEQ ID NO: 694202 - RNA, 22 nt, Homo sapiens
aguagacaugugugugugugaa

SEQ ID NO: 694203 - RNA, 16 nt, Homo sapiens
agucugcuucauuucc

SEQ ID NO: 694204 - RNA, 18 nt, Homo sapiens
agucugcuucauuuccuc

SEQ ID NO: 694205 - RNA, 14 nt, Homo sapiens
agugcacagcuguc

SEQ ID NO: 694206 - RNA, 15 nt, Homo sapiens
agugcacagcugucc

SEQ ID NO: 694207 - RNA, 16 nt, Homo sapiens
agugcacagcugucca

SEQ ID NO: 694208 - RNA, 15 nt, Homo sapiens
aguguguugacuucu

SEQ ID NO: 694209 - RNA, 13 nt, Homo sapiens
aguuaaucuucau

SEQ ID NO: 694210 - RNA, 15 nt, Homo sapiens
aguuucugugugaac

SEQ ID NO: 694211 - RNA, 18 nt, Homo sapiens
auaagacucacaguauaa

SEQ ID NO: 694212 - RNA, 14 nt, Homo sapiens
auauaaaacuauaa

SEQ ID NO: 694213 - RNA, 17 nt, Homo sapiens
auaucuguggucuucaa

SEQ ID NO: 694214 - RNA, 21 nt, Homo sapiens
auauguguaaauguuaugacu

SEQ ID NO: 694215 - RNA, 23 nt, Homo sapiens
auauguguaaauguuaugacucc

SEQ ID NO: 694216 - RNA, 23 nt, Homo sapiens
aucaauguucacgcaacuugaaa

SEQ ID NO: 694217 - RNA, 15 nt, Homo sapiens
aucccaaccauccuc

SEQ ID NO: 694218 - RNA, 22 nt, Homo sapiens
aucucuuucccggauccccaac

SEQ ID NO: 694219 - RNA, 16 nt, Homo sapiens
augaaaaacaaccaag

SEQ ID NO: 694220 - RNA, 22 nt, Homo sapiens
augaucuguuuuucaccacuuc

SEQ ID NO: 694221 - RNA, 23 nt, Homo sapiens
augauguacaggcagaugaaacc

SEQ ID NO: 694222 - RNA, 14 nt, Homo sapiens
augcuauugaaaau

SEQ ID NO: 694223 - RNA, 19 nt, Homo sapiens
augcuauugaaaaugugaa

SEQ ID NO: 694224 - RNA, 24 nt, Homo sapiens
augcuuaugacaaugacugugcua

SEQ ID NO: 694225 - RNA, 19 nt, Homo sapiens
auggcuguggcauuguuga

SEQ ID NO: 694226 - RNA, 14 nt, Homo sapiens
auguauucuaugaa

SEQ ID NO: 694227 - RNA, 20 nt, Homo sapiens
auuaaauguuugacacaauu

SEQ ID NO: 694228 - RNA, 19 nt, Homo sapiens
auuauagauuuucauguuc

SEQ ID NO: 694229 - RNA, 18 nt, Homo sapiens
auucaagaaagauaucua

SEQ ID NO: 694230 - RNA, 16 nt, Homo sapiens
auucauuagcugugau

SEQ ID NO: 694231 - RNA, 13 nt, Homo sapiens
auuuaucaaucuc

SEQ ID NO: 694232 - RNA, 17 nt, Homo sapiens
auuuccucugagcuguu

SEQ ID NO: 694233 - RNA, 18 nt, Homo sapiens
auuucucuucaguguguu

SEQ ID NO: 694234 - RNA, 20 nt, Homo sapiens
auuucugucagaaugcuauu

SEQ ID NO: 694235 - RNA, 17 nt, Homo sapiens
caaaaaaaccacaaagg

SEQ ID NO: 694236 - RNA, 14 nt, Homo sapiens
caaacauguugccu

SEQ ID NO: 694237 - RNA, 20 nt, Homo sapiens
caaagggaaauacucuuaau

SEQ ID NO: 694238 - RNA, 20 nt, Homo sapiens
caacauuucucuucagugug

SEQ ID NO: 694239 - RNA, 21 nt, Homo sapiens
cacaugaucuguuuuucacca

SEQ ID NO: 694240 - RNA, 15 nt, Homo sapiens
uaaucuucauggcca

SEQ ID NO: 694241 - RNA, 14 nt, Homo sapiens
uaccuccucucagu

SEQ ID NO: 694242 - RNA, 18 nt, Homo sapiens
uacuugugaaacacagcu

SEQ ID NO: 694243 - RNA, 22 nt, Homo sapiens
uauacccccccaugcagucuaa

SEQ ID NO: 694244 - RNA, 17 nt, Homo sapiens
uauaucuguggucuuca

SEQ ID NO: 694245 - RNA, 18 nt, Homo sapiens
uauaugaucaaacuucca

SEQ ID NO: 694246 - RNA, 17 nt, Homo sapiens
uaucccgagucugggac

SEQ ID NO: 694247 - RNA, 22 nt, Homo sapiens
uaucuugcgaauccaagcuccc

SEQ ID NO: 694248 - RNA, 16 nt, Homo sapiens
uauguagauauuuggc

SEQ ID NO: 694249 - RNA, 19 nt, Homo sapiens
uauuaacaugcuuaugaca

SEQ ID NO: 694250 - RNA, 18 nt, Homo sapiens
uauucauuagcugugauu

SEQ ID NO: 694251 - RNA, 16 nt, Homo sapiens
ucaaauggguuuucca

SEQ ID NO: 694252 - RNA, 23 nt, Homo sapiens
ucaaauugucuuuugucaugugg

SEQ ID NO: 694253 - RNA, 21 nt, Homo sapiens
ucaccucuacccaaacccuag

SEQ ID NO: 694254 - RNA, 14 nt, Homo sapiens
ucagccccuaggag

SEQ ID NO: 694255 - RNA, 13 nt, Homo sapiens
agaacuacugaua

SEQ ID NO: 694256 - RNA, 15 nt, Homo sapiens
agaagacacagggga

SEQ ID NO: 694257 - RNA, 14 nt, Homo sapiens
agaauacacuauca

SEQ ID NO: 694258 - RNA, 18 nt, Homo sapiens
agacauuugcuaugagcu

SEQ ID NO: 694259 - RNA, 14 nt, Homo sapiens
agaccgaaucucac

SEQ ID NO: 694260 - RNA, 13 nt, Homo sapiens
agagcacuuuuaa

SEQ ID NO: 694261 - RNA, 23 nt, Homo sapiens
agagcugccugugccuuuugcca

SEQ ID NO: 694262 - RNA, 14 nt, Homo sapiens
agaggacaguauuu

SEQ ID NO: 694263 - RNA, 12 nt, Homo sapiens
agagugaauuau

SEQ ID NO: 694264 - RNA, 13 nt, Homo sapiens
agauuugccuuau

SEQ ID NO: 694265 - RNA, 11 nt, Homo sapiens
agcacaugugu

SEQ ID NO: 694266 - RNA, 21 nt, Homo sapiens
agcaccaucucuuuaccuccu

SEQ ID NO: 694267 - RNA, 13 nt, Homo sapiens
cacaggggagcag

SEQ ID NO: 694268 - RNA, 18 nt, Homo sapiens
caccaucucuuuaccucc

SEQ ID NO: 694269 - RNA, 13 nt, Homo sapiens
cacccaugccaua

SEQ ID NO: 694270 - RNA, 13 nt, Homo sapiens
cagaggacaguau

SEQ ID NO: 694271 - RNA, 21 nt, Homo sapiens
cagcaccaucucuuuaccucc

SEQ ID NO: 694272 - RNA, 23 nt, Homo sapiens
cagcacguguggccuguucuucu

SEQ ID NO: 694273 - RNA, 20 nt, Homo sapiens
cagggauucuuccugcuuag

SEQ ID NO: 694274 - RNA, 19 nt, Homo sapiens
cagggcugaggccucucau

SEQ ID NO: 694275 - RNA, 22 nt, Homo sapiens
caggguguuaaggcagugacuu

SEQ ID NO: 694276 - RNA, 18 nt, Homo sapiens
cagguucuuuaaaaugcc

SEQ ID NO: 694277 - RNA, 13 nt, Homo sapiens
caguguugccaga

SEQ ID NO: 694278 - RNA, 21 nt, Homo sapiens
cauaccuggcccugugccuug

SEQ ID NO: 694279 - RNA, 17 nt, Homo sapiens
cauccauagcaccucca

SEQ ID NO: 694280 - RNA, 14 nt, Homo sapiens
caucuguaccucug

SEQ ID NO: 694281 - RNA, 13 nt, Homo sapiens
cauggauuccacu

SEQ ID NO: 694282 - RNA, 17 nt, Homo sapiens
cauuauuucaaccgcuu

SEQ ID NO: 694283 - RNA, 23 nt, Homo sapiens
cauuauuucaaccgcuugccaua

SEQ ID NO: 694284 - RNA, 12 nt, Homo sapiens
cauugguguuga

SEQ ID NO: 694285 - RNA, 15 nt, Homo sapiens
cauuuuguuauagaa

SEQ ID NO: 694286 - RNA, 13 nt, Homo sapiens
ccaaagacuacac

SEQ ID NO: 694287 - RNA, 16 nt, Homo sapiens
ccaaagacuacacugu

SEQ ID NO: 694288 - RNA, 18 nt, Homo sapiens
ccaaagacuacacuguug

SEQ ID NO: 694289 - RNA, 23 nt, Homo sapiens
ccaagcuggcacugccacugugg

SEQ ID NO: 694290 - RNA, 19 nt, Homo sapiens
ccacucaggggucauucau

SEQ ID NO: 694291 - RNA, 17 nt, Homo sapiens
ccacuuggcaucauuca

SEQ ID NO: 694292 - RNA, 17 nt, Homo sapiens
ccagaaaagcaguggcu

SEQ ID NO: 694293 - RNA, 18 nt, Homo sapiens
ccagaggucuggcccuau

SEQ ID NO: 694294 - RNA, 19 nt, Homo sapiens
ccagcaucucccaguucau

SEQ ID NO: 694295 - RNA, 17 nt, Homo sapiens
ccaggcuggagugcagu

SEQ ID NO: 694296 - RNA, 20 nt, Homo sapiens
ccaggcuggagugcaguggu

SEQ ID NO: 694297 - RNA, 14 nt, Homo sapiens
ccauagcaccucca

SEQ ID NO: 694298 - RNA, 16 nt, Homo sapiens
ccaucucuuuaccucc

SEQ ID NO: 694299 - RNA, 21 nt, Homo sapiens
ccauggggcugauuguauuua

SEQ ID NO: 694300 - RNA, 23 nt, Homo sapiens
ccauuauuucaaccgcuugccau

SEQ ID NO: 694301 - RNA, 18 nt, Homo sapiens
cccagaaugccuccugca

SEQ ID NO: 694302 - RNA, 11 nt, Homo sapiens
cccugccauca

SEQ ID NO: 694303 - RNA, 19 nt, Homo sapiens
ccggccuccugucccucau

SEQ ID NO: 694304 - RNA, 22 nt, Homo sapiens
ccucacugcuguagacauuugc

SEQ ID NO: 694305 - RNA, 14 nt, Homo sapiens
ccucacuucuggca

SEQ ID NO: 694306 - RNA, 16 nt, Homo sapiens
ccucacuucuggcacu

SEQ ID NO: 694307 - RNA, 20 nt, Homo sapiens
ccucacuucuggcacuguga

SEQ ID NO: 694308 - RNA, 16 nt, Homo sapiens
ccucagugagaagcca

SEQ ID NO: 694309 - RNA, 17 nt, Homo sapiens
ccucuuggcugccuugu

SEQ ID NO: 694310 - RNA, 17 nt, Homo sapiens
ccugaaaauuaugaguc

SEQ ID NO: 694311 - RNA, 19 nt, Homo sapiens
cgauugcaggagucccugc

SEQ ID NO: 694312 - RNA, 23 nt, Homo sapiens
cuaauucugagggaauuuaacca

SEQ ID NO: 694313 - RNA, 13 nt, Homo sapiens
cuaccucuuggcu

SEQ ID NO: 694314 - RNA, 13 nt, Homo sapiens
cuaugaucuuggc

SEQ ID NO: 694315 - RNA, 11 nt, Homo sapiens
cuaugguucuc

SEQ ID NO: 694316 - RNA, 14 nt, Homo sapiens
cucaucaggccauu

SEQ ID NO: 694317 - RNA, 23 nt, Homo sapiens
cucaucaggccauugucccugaa

SEQ ID NO: 694318 - RNA, 12 nt, Homo sapiens
cuccacauaccu

SEQ ID NO: 694319 - RNA, 13 nt, Homo sapiens
cuccugcagggau

SEQ ID NO: 694320 - RNA, 21 nt, Homo sapiens
cucgcaagggaaguccuugca

SEQ ID NO: 694321 - RNA, 23 nt, Homo sapiens
cucucgcaagggaaguccuugca

SEQ ID NO: 694322 - RNA, 12 nt, Homo sapiens
cucuuuaccucc

SEQ ID NO: 694323 - RNA, 17 nt, Homo sapiens
cugaaauagagugaauu

SEQ ID NO: 694324 - RNA, 12 nt, Homo sapiens
cugccacugugg

SEQ ID NO: 694325 - RNA, 15 nt, Homo sapiens
cugccagaacaugga

SEQ ID NO: 694326 - RNA, 21 nt, Homo sapiens
cugccuugccaugucuuguuc

SEQ ID NO: 694327 - RNA, 20 nt, Homo sapiens
cuggagugcaguggugcgau

SEQ ID NO: 694328 - RNA, 19 nt, Homo sapiens
cuggggaugucucucauga

SEQ ID NO: 694329 - RNA, 20 nt, Homo sapiens
cugugccuuggugugcugua

SEQ ID NO: 694330 - RNA, 23 nt, Homo sapiens
cuuaucaacauuuguuccaugag

SEQ ID NO: 694331 - RNA, 19 nt, Homo sapiens
cuucaucacacacugagag

SEQ ID NO: 694332 - RNA, 17 nt, Homo sapiens
cuucauuaccucaguga

SEQ ID NO: 694333 - RNA, 19 nt, Homo sapiens
cuuggcagcccgggucauc

SEQ ID NO: 694334 - RNA, 16 nt, Homo sapiens
cuuuccucaucaggcc

SEQ ID NO: 694335 - RNA, 18 nt, Homo sapiens
cuuucgaauaaagugaau

SEQ ID NO: 694336 - RNA, 22 nt, Homo sapiens
cuuuuaguucuuagagcacuuu

SEQ ID NO: 694337 - RNA, 14 nt, Homo sapiens
cuuuugucccagaa

SEQ ID NO: 694338 - RNA, 13 nt, Homo sapiens
gaaaacaugacuu

SEQ ID NO: 694339 - RNA, 22 nt, Homo sapiens
gaaaaccucauuuaccauaaaa

SEQ ID NO: 694340 - RNA, 18 nt, Homo sapiens
gaaaccacacagacuugg

SEQ ID NO: 694341 - RNA, 21 nt, Homo sapiens
gaaacugaggccauuauuuca

SEQ ID NO: 694342 - RNA, 14 nt, Homo sapiens
gaaauagagugaau

SEQ ID NO: 694343 - RNA, 18 nt, Homo sapiens
gaagcaucaaagcacugu

SEQ ID NO: 694344 - RNA, 17 nt, Homo sapiens
gaagccagcuuuccuca

SEQ ID NO: 694345 - RNA, 14 nt, Homo sapiens
gaaggaauuauucc

SEQ ID NO: 694346 - RNA, 15 nt, Homo sapiens
gaaggaauuauuccc

SEQ ID NO: 694347 - RNA, 15 nt, Homo sapiens
gacaaccucauuuua

SEQ ID NO: 694348 - RNA, 20 nt, Homo sapiens
gaccaaaugcuuuuccucaa

SEQ ID NO: 694349 - RNA, 12 nt, Homo sapiens
gacuauggagcu

SEQ ID NO: 694350 - RNA, 21 nt, Homo sapiens
gagaagccagcuuuccucauc

SEQ ID NO: 694351 - RNA, 11 nt, Homo sapiens
gagcacuguga

SEQ ID NO: 694352 - RNA, 22 nt, Homo sapiens
gagcuggggaugucucucauga

SEQ ID NO: 694353 - RNA, 12 nt, Homo sapiens
gaggaagggaca

SEQ ID NO: 694354 - RNA, 16 nt, Homo sapiens
gaggccucucauucca

SEQ ID NO: 694355 - RNA, 11 nt, Homo sapiens
gagugaccuca

SEQ ID NO: 694356 - RNA, 20 nt, Homo sapiens
gagugggguagguugggaga

SEQ ID NO: 694357 - RNA, 14 nt, Homo sapiens
gauagaaggcuaug

SEQ ID NO: 694358 - RNA, 17 nt, Homo sapiens
gauguuuuguacuuaca

SEQ ID NO: 694359 - RNA, 14 nt, Homo sapiens
gcaacauugaccca

SEQ ID NO: 694360 - RNA, 14 nt, Homo sapiens
gcaagucacuggcc

SEQ ID NO: 694361 - RNA, 19 nt, Homo sapiens
gcagguguucuucauuacc

SEQ ID NO: 694362 - RNA, 15 nt, Homo sapiens
gcagugacuuuagaa

SEQ ID NO: 694363 - RNA, 21 nt, Homo sapiens
gcagugacuuuagaaacaaau

SEQ ID NO: 694364 - RNA, 17 nt, Homo sapiens
gcaucucccaguucaua

SEQ ID NO: 694365 - RNA, 19 nt, Homo sapiens
gcccaggcuggagugcagu

SEQ ID NO: 694366 - RNA, 20 nt, Homo sapiens
gcccaggcuggagugcagug

SEQ ID NO: 694367 - RNA, 23 nt, Homo sapiens
gcccuuuuaguucuuagagcacu

SEQ ID NO: 694368 - RNA, 16 nt, Homo sapiens
gcucacgugucuuuag

SEQ ID NO: 694369 - RNA, 19 nt, Homo sapiens
gcucuacccugaguucaua

SEQ ID NO: 694370 - RNA, 23 nt, Homo sapiens
auguguaguuaauuuuauuccag

SEQ ID NO: 694371 - RNA, 14 nt, Homo sapiens
auguuuuguacuua

SEQ ID NO: 694372 - RNA, 15 nt, Homo sapiens
auuaauuuucuauga

SEQ ID NO: 694373 - RNA, 12 nt, Homo sapiens
auuauucccaug

SEQ ID NO: 694374 - RNA, 21 nt, Homo sapiens
auuauuucaaccgcuugccau

SEQ ID NO: 694375 - RNA, 23 nt, Homo sapiens
auuccacacccucacugcuguag

SEQ ID NO: 694376 - RNA, 21 nt, Homo sapiens
auuuaugguucucaggccuga

SEQ ID NO: 694377 - RNA, 13 nt, Homo sapiens
auuuaugugaugg

SEQ ID NO: 694378 - RNA, 20 nt, Homo sapiens
auuucaaccgcuugccauau

SEQ ID NO: 694379 - RNA, 18 nt, Homo sapiens
auuugagugucuuugacu

SEQ ID NO: 694380 - RNA, 23 nt, Homo sapiens
auuuguucauuaaacgucauuca

SEQ ID NO: 694381 - RNA, 19 nt, Homo sapiens
auuuugcacaaaguaagcc

SEQ ID NO: 694382 - RNA, 15 nt, Homo sapiens
caaaguaagccucac

SEQ ID NO: 694383 - RNA, 18 nt, Homo sapiens
caacauuuguuccaugag

SEQ ID NO: 694384 - RNA, 23 nt, Homo sapiens
cacauaccuggcccugugccuug

SEQ ID NO: 694385 - RNA, 19 nt, Homo sapiens
cacugaaauagagugaauu

SEQ ID NO: 694386 - RNA, 14 nt, Homo sapiens
cacugccacugugg

SEQ ID NO: 694387 - RNA, 16 nt, Homo sapiens
cagaaaacauaugcau

SEQ ID NO: 694388 - RNA, 22 nt, Homo sapiens
cagaaaacauaugcauuaugaa

SEQ ID NO: 694389 - RNA, 16 nt, Homo sapiens
cagcaacauugaccca

SEQ ID NO: 694390 - RNA, 18 nt, Homo sapiens
cagcccgggucaucugua

SEQ ID NO: 694391 - RNA, 18 nt, Homo sapiens
caggccauugucccugaa

SEQ ID NO: 694392 - RNA, 16 nt, Homo sapiens
caggcuggagugcagu

SEQ ID NO: 694393 - RNA, 17 nt, Homo sapiens
cagugagaagccagcuu

SEQ ID NO: 694394 - RNA, 23 nt, Homo sapiens
cauaaauuuaugguucucaggcc

SEQ ID NO: 694395 - RNA, 14 nt, Homo sapiens
caucaaagcacugu

SEQ ID NO: 694396 - RNA, 15 nt, Homo sapiens
caucacacacugaga

SEQ ID NO: 694397 - RNA, 15 nt, Homo sapiens
caucuuuguuuacca

SEQ ID NO: 694398 - RNA, 22 nt, Homo sapiens
caugcuugcauuauauuuguaa

SEQ ID NO: 694399 - RNA, 16 nt, Homo sapiens
cauggggcugauugua

SEQ ID NO: 694400 - RNA, 22 nt, Homo sapiens
cauguguugccuggaagcacau

SEQ ID NO: 694401 - RNA, 20 nt, Homo sapiens
cauuaucagccugugccacg

SEQ ID NO: 694402 - RNA, 22 nt, Homo sapiens
cauucacagcaagucacuggcc

SEQ ID NO: 694403 - RNA, 14 nt, Homo sapiens
cauuugagugucuu

SEQ ID NO: 694404 - RNA, 14 nt, Homo sapiens
cauuuguuccauga

SEQ ID NO: 694405 - RNA, 21 nt, Homo sapiens
ccaacauuaaaagccaccccc

SEQ ID NO: 694406 - RNA, 11 nt, Homo sapiens
ccaauuccuca

SEQ ID NO: 694407 - RNA, 18 nt, Homo sapiens
ccagaaugccuccugcag

SEQ ID NO: 694408 - RNA, 21 nt, Homo sapiens
ccaguggcuggaucugugagg

SEQ ID NO: 694409 - RNA, 13 nt, Homo sapiens
ccauagaaacuga

SEQ ID NO: 694410 - RNA, 13 nt, Homo sapiens
ccaucucuuuacc

SEQ ID NO: 694411 - RNA, 19 nt, Homo sapiens
cccacuuggcaucauucac

SEQ ID NO: 694412 - RNA, 13 nt, Homo sapiens
cccagaaauguau

SEQ ID NO: 694413 - RNA, 17 nt, Homo sapiens
cccaggcuggagugcag

SEQ ID NO: 694414 - RNA, 16 nt, Homo sapiens
cccucuacuccaugca

SEQ ID NO: 694415 - RNA, 23 nt, Homo sapiens
ccucacugcuguagacauuugcu

SEQ ID NO: 694416 - RNA, 13 nt, Homo sapiens
ccucccucaggcc

SEQ ID NO: 694417 - RNA, 15 nt, Homo sapiens
ccugugccuuuugcc

SEQ ID NO: 694418 - RNA, 22 nt, Homo sapiens
ccuuaaaaugugagugaccuca

SEQ ID NO: 694419 - RNA, 12 nt, Homo sapiens
ccuucaugauga

SEQ ID NO: 694420 - RNA, 13 nt, Homo sapiens
ccuuccaacugcc

SEQ ID NO: 694421 - RNA, 14 nt, Homo sapiens
ccuugccaugucuu

SEQ ID NO: 694422 - RNA, 17 nt, Homo sapiens
ccuuuccccucccucag

SEQ ID NO: 694423 - RNA, 21 nt, Homo sapiens
ccuuuggcuaucuacugagac

SEQ ID NO: 694424 - RNA, 14 nt, Homo sapiens
ccuuugucccagaa

SEQ ID NO: 694425 - RNA, 13 nt, Homo sapiens
cgagcacugugac

SEQ ID NO: 694426 - RNA, 18 nt, Homo sapiens
cggccuccugucccucau

SEQ ID NO: 694427 - RNA, 15 nt, Homo sapiens
cuacugagacaugac

SEQ ID NO: 694428 - RNA, 20 nt, Homo sapiens
cuaucuacugagacaugacu

SEQ ID NO: 694429 - RNA, 23 nt, Homo sapiens
cucagaucauuaucagccugugc

SEQ ID NO: 694430 - RNA, 16 nt, Homo sapiens
cucaggggucauucau

SEQ ID NO: 694431 - RNA, 18 nt, Homo sapiens
cuccauugguguugacau

SEQ ID NO: 694432 - RNA, 18 nt, Homo sapiens
cuccugucccucauccau

SEQ ID NO: 694433 - RNA, 11 nt, Homo sapiens
cucucucauga

SEQ ID NO: 694434 - RNA, 17 nt, Homo sapiens
cugaaacuucaucacac

SEQ ID NO: 694435 - RNA, 15 nt, Homo sapiens
cugaaauagagugaa

SEQ ID NO: 694436 - RNA, 22 nt, Homo sapiens
cugcuuucgaauaaagugaaua

SEQ ID NO: 694437 - RNA, 13 nt, Homo sapiens
cuggagugcagug

SEQ ID NO: 694438 - RNA, 21 nt, Homo sapiens
cugugccuuggugugcuguau

SEQ ID NO: 694439 - RNA, 13 nt, Homo sapiens
cuguuuagaacua

SEQ ID NO: 694440 - RNA, 21 nt, Homo sapiens
cuuaaaaugugagugaccuca

SEQ ID NO: 694441 - RNA, 15 nt, Homo sapiens
cuuaggccagcacca

SEQ ID NO: 694442 - RNA, 13 nt, Homo sapiens
cuucgaugacugg

SEQ ID NO: 694443 - RNA, 16 nt, Homo sapiens
cuucuggcacugugac

SEQ ID NO: 694444 - RNA, 18 nt, Homo sapiens
gaaaaaaaauaauagaaa

SEQ ID NO: 694445 - RNA, 18 nt, Homo sapiens
gaaaagaaaaaaaauaau

SEQ ID NO: 694446 - RNA, 15 nt, Homo sapiens
gaaaauuaugagucu

SEQ ID NO: 694447 - RNA, 13 nt, Homo sapiens
gaauaaagugaau

SEQ ID NO: 694448 - RNA, 23 nt, Homo sapiens
gaauugcuaauucugagggaauu

SEQ ID NO: 694449 - RNA, 15 nt, Homo sapiens
gacaugacuaggaag

SEQ ID NO: 694450 - RNA, 23 nt, Homo sapiens
gacccuaaauguggacaucauga

SEQ ID NO: 694451 - RNA, 14 nt, Homo sapiens
gaccuguugggagu

SEQ ID NO: 694452 - RNA, 14 nt, Homo sapiens
gacucucagcagcu

SEQ ID NO: 694453 - RNA, 12 nt, Homo sapiens
gacuuaucaaca

SEQ ID NO: 694454 - RNA, 13 nt, Homo sapiens
gagaaugucagua

SEQ ID NO: 694455 - RNA, 17 nt, Homo sapiens
gagcaggguuagcucac

SEQ ID NO: 694456 - RNA, 18 nt, Homo sapiens
gaucauuaucagccugug

SEQ ID NO: 694457 - RNA, 16 nt, Homo sapiens
gauucuuccugcuuag

SEQ ID NO: 694458 - RNA, 15 nt, Homo sapiens
gcacugccacugugg

SEQ ID NO: 694459 - RNA, 11 nt, Homo sapiens
gcaucauucac

SEQ ID NO: 694460 - RNA, 16 nt, Homo sapiens
gcauguguaguuaauu

SEQ ID NO: 694461 - RNA, 14 nt, Homo sapiens
gccacagugcaauu

SEQ ID NO: 694462 - RNA, 13 nt, Homo sapiens
gccagagccuuaa

SEQ ID NO: 694463 - RNA, 21 nt, Homo sapiens
gccaguggcuggaucugugag

SEQ ID NO: 694464 - RNA, 23 nt, Homo sapiens
gccauuauuucaaccgcuugcca

SEQ ID NO: 694465 - RNA, 21 nt, Homo sapiens
gccuccuuuccccucccucag

SEQ ID NO: 694466 - RNA, 15 nt, Homo sapiens
gccuugccaugucuu

SEQ ID NO: 694467 - RNA, 20 nt, Homo sapiens
gcuauggggauagaugugug

SEQ ID NO: 694468 - RNA, 19 nt, Homo sapiens
gcugggaauaagugccagg

SEQ ID NO: 694469 - RNA, 14 nt, Homo sapiens
gcuggggaugucuc

SEQ ID NO: 694470 - RNA, 19 nt, Homo sapiens
gcuguagacauuugcuaug

SEQ ID NO: 694471 - RNA, 14 nt, Homo sapiens
gcuuagcuugaggg

SEQ ID NO: 694472 - RNA, 13 nt, Homo sapiens
ggaagggacacca

SEQ ID NO: 694473 - RNA, 16 nt, Homo sapiens
ggaauuauucccauga

SEQ ID NO: 694474 - RNA, 22 nt, Homo sapiens
cugacccuaaauguggacauca

SEQ ID NO: 694475 - RNA, 18 nt, Homo sapiens
cugagacaugacuaggaa

SEQ ID NO: 694476 - RNA, 19 nt, Homo sapiens
cugagcagguguucuucau

SEQ ID NO: 694477 - RNA, 19 nt, Homo sapiens
cugagggaauuuaaccagc

SEQ ID NO: 694478 - RNA, 23 nt, Homo sapiens
cugccaucauguuuacagaggac

SEQ ID NO: 694479 - RNA, 13 nt, Homo sapiens
cugccuugccaug

SEQ ID NO: 694480 - RNA, 12 nt, Homo sapiens
cuggcccugugc

SEQ ID NO: 694481 - RNA, 22 nt, Homo sapiens
cugggagugauaugauguguag

SEQ ID NO: 694482 - RNA, 21 nt, Homo sapiens
cuggggaugucucucaugacc

SEQ ID NO: 694483 - RNA, 19 nt, Homo sapiens
cugucccucauccauagca

SEQ ID NO: 694484 - RNA, 16 nt, Homo sapiens
cuguucuuuuguccca

SEQ ID NO: 694485 - RNA, 18 nt, Homo sapiens
cuuaaaagaacauguaua

SEQ ID NO: 694486 - RNA, 17 nt, Homo sapiens
cuuagcugaacaaugaa

SEQ ID NO: 694487 - RNA, 19 nt, Homo sapiens
cuuaucaacauuuguucca

SEQ ID NO: 694488 - RNA, 14 nt, Homo sapiens
cuucagauuugccu

SEQ ID NO: 694489 - RNA, 16 nt, Homo sapiens
cuucaucacacacuga

SEQ ID NO: 694490 - RNA, 13 nt, Homo sapiens
cuucauuaccuca

SEQ ID NO: 694491 - RNA, 14 nt, Homo sapiens
cuucauuaccucag

SEQ ID NO: 694492 - RNA, 23 nt, Homo sapiens
cuucuaccucuuggcugccuugu

SEQ ID NO: 694493 - RNA, 16 nt, Homo sapiens
cuuuccccucccucag

SEQ ID NO: 694494 - RNA, 13 nt, Homo sapiens
cuuuugucccaga

SEQ ID NO: 694495 - RNA, 15 nt, Homo sapiens
gaaaacauaugcauu

SEQ ID NO: 694496 - RNA, 14 nt, Homo sapiens
gaacaaugaaugcu

SEQ ID NO: 694497 - RNA, 20 nt, Homo sapiens
gaacauggauuccacugaaa

SEQ ID NO: 694498 - RNA, 19 nt, Homo sapiens
gaacuccaguacucaccca

SEQ ID NO: 694499 - RNA, 13 nt, Homo sapiens
gaagagaagggca

SEQ ID NO: 694500 - RNA, 19 nt, Homo sapiens
gaaggaggagucagggaga

SEQ ID NO: 694501 - RNA, 22 nt, Homo sapiens
gaagugugucacccuuaggcca

SEQ ID NO: 694502 - RNA, 17 nt, Homo sapiens
gaauuauauuuccuuaa

SEQ ID NO: 694503 - RNA, 16 nt, Homo sapiens
gacaaccucauuuuaa

SEQ ID NO: 694504 - RNA, 16 nt, Homo sapiens
gaccgaaucucacucu

SEQ ID NO: 694505 - RNA, 14 nt, Homo sapiens
gagagagugcuauu

SEQ ID NO: 694506 - RNA, 19 nt, Homo sapiens
gagaggccacagugcaauu

SEQ ID NO: 694507 - RNA, 17 nt, Homo sapiens
gagcuccuuagccuuug

SEQ ID NO: 694508 - RNA, 16 nt, Homo sapiens
gauacagaaugaaucc

SEQ ID NO: 694509 - RNA, 20 nt, Homo sapiens
gauauaugacuuuuucucag

SEQ ID NO: 694510 - RNA, 23 nt, Homo sapiens
gaucauuaucagccugugccacg

SEQ ID NO: 694511 - RNA, 20 nt, Homo sapiens
gauguaccagcaucucccag

SEQ ID NO: 694512 - RNA, 13 nt, Homo sapiens
gauguguggacac

SEQ ID NO: 694513 - RNA, 20 nt, Homo sapiens
gauuugcacccaugccauag

SEQ ID NO: 694514 - RNA, 18 nt, Homo sapiens
gcacaaaguaagccucac

SEQ ID NO: 694515 - RNA, 15 nt, Homo sapiens
gcacaaauuguacau

SEQ ID NO: 694516 - RNA, 19 nt, Homo sapiens
gccacucaggggucauuca

SEQ ID NO: 694517 - RNA, 14 nt, Homo sapiens
gccagaaaacauau

SEQ ID NO: 694518 - RNA, 19 nt, Homo sapiens
gccagaaaacauaugcauu

SEQ ID NO: 694519 - RNA, 16 nt, Homo sapiens
gccuccugucccucau

SEQ ID NO: 694520 - RNA, 16 nt, Homo sapiens
gccugggggauguacc

SEQ ID NO: 694521 - RNA, 14 nt, Homo sapiens
gccuugccaugucu

SEQ ID NO: 694522 - RNA, 18 nt, Homo sapiens
gcuaugguucucucgcaa

SEQ ID NO: 694523 - RNA, 15 nt, Homo sapiens
gcuauuguagagcca

SEQ ID NO: 694524 - RNA, 18 nt, Homo sapiens
gcugaggccucucauucc

SEQ ID NO: 694525 - RNA, 11 nt, Homo sapiens
gcuugccauau

SEQ ID NO: 694526 - RNA, 15 nt, Homo sapiens
ggaaguuuguucacu

SEQ ID NO: 694527 - RNA, 15 nt, Homo sapiens
ggacaccaagccuug

SEQ ID NO: 694528 - RNA, 14 nt, Homo sapiens
ggccugacucucag

SEQ ID NO: 694529 - RNA, 16 nt, Homo sapiens
gggagaaugucaguau

SEQ ID NO: 694530 - RNA, 18 nt, Homo sapiens
ggguuagcucacgugucu

SEQ ID NO: 694531 - RNA, 11 nt, Homo sapiens
gguucucaggc

SEQ ID NO: 694532 - RNA, 18 nt, Homo sapiens
guaauuuaaaauugugau

SEQ ID NO: 694533 - RNA, 12 nt, Homo sapiens
guacagacacuc

SEQ ID NO: 694534 - RNA, 14 nt, Homo sapiens
gugaggggcucucu

SEQ ID NO: 694535 - RNA, 17 nt, Homo sapiens
gugaggggcucucucau

SEQ ID NO: 694536 - RNA, 14 nt, Homo sapiens
gugagugaccucac

SEQ ID NO: 694537 - RNA, 13 nt, Homo sapiens
gugucacccuuag

SEQ ID NO: 694538 - RNA, 13 nt, Homo sapiens
guguguguguaug

SEQ ID NO: 694539 - RNA, 18 nt, Homo sapiens
guguugccagagccuuaa

SEQ ID NO: 694540 - RNA, 19 nt, Homo sapiens
guuaaggcagugacuuuag

SEQ ID NO: 694541 - RNA, 11 nt, Homo sapiens
guucucaggcc

SEQ ID NO: 694542 - RNA, 14 nt, Homo sapiens
uaaacaugcuugca

SEQ ID NO: 694543 - RNA, 22 nt, Homo sapiens
uaaauauuaaccugaauuauuc

SEQ ID NO: 694544 - RNA, 21 nt, Homo sapiens
uaaauuuaugguucucaggcc

SEQ ID NO: 694545 - RNA, 16 nt, Homo sapiens
uaaauuuaugugaugg

SEQ ID NO: 694546 - RNA, 22 nt, Homo sapiens
uaaccagcaacauugacccaga

SEQ ID NO: 694547 - RNA, 12 nt, Homo sapiens
uaaccugaauua

SEQ ID NO: 694548 - RNA, 17 nt, Homo sapiens
uaaccugaauuauucca

SEQ ID NO: 694549 - RNA, 22 nt, Homo sapiens
uaagccucaccuuugccuucca

SEQ ID NO: 694550 - RNA, 14 nt, Homo sapiens
uacagaggacagua

SEQ ID NO: 694551 - RNA, 16 nt, Homo sapiens
uacuccaugcacauag

SEQ ID NO: 694552 - RNA, 16 nt, Homo sapiens
uagaacuccaguacuc

SEQ ID NO: 694553 - RNA, 20 nt, Homo sapiens
uaggccagcaccaucucuuu

SEQ ID NO: 694554 - RNA, 19 nt, Homo sapiens
uaguucuuagagcacuuuu

SEQ ID NO: 694555 - RNA, 13 nt, Homo sapiens
uauccauccaugg

SEQ ID NO: 694556 - RNA, 23 nt, Homo sapiens
uaugagcuggggaugucucucau

SEQ ID NO: 694557 - RNA, 22 nt, Homo sapiens
uaugguaggaacugcugggcuu

SEQ ID NO: 694558 - RNA, 22 nt, Homo sapiens
uauguggaagugugggucugug

SEQ ID NO: 694559 - RNA, 12 nt, Homo sapiens
uauucccaugag

SEQ ID NO: 694560 - RNA, 14 nt, Homo sapiens
uauuggcagcucua

SEQ ID NO: 694561 - RNA, 18 nt, Homo sapiens
uauuuaccuucuaccucu

SEQ ID NO: 694562 - RNA, 14 nt, Homo sapiens
ucaaagcacuguuu

SEQ ID NO: 694563 - RNA, 17 nt, Homo sapiens
ucaaccgcuugccauau

SEQ ID NO: 694564 - RNA, 19 nt, Homo sapiens
ucacuucgaugacuggaua

SEQ ID NO: 694565 - RNA, 16 nt, Homo sapiens
ucagacuuacuuacuc

SEQ ID NO: 694566 - RNA, 12 nt, Homo sapiens
ucaucaggccau

SEQ ID NO: 694567 - RNA, 19 nt, Homo sapiens
ucauguuuacagaggacag

SEQ ID NO: 694568 - RNA, 19 nt, Homo sapiens
ucauuuuguuauagaaacu

SEQ ID NO: 694569 - RNA, 17 nt, Homo sapiens
uccaacauuaaaagcca

SEQ ID NO: 694570 - RNA, 14 nt, Homo sapiens
uccacagaguauaa

SEQ ID NO: 694571 - RNA, 19 nt, Homo sapiens
uccggccuccugucccuca

SEQ ID NO: 694572 - RNA, 22 nt, Homo sapiens
uccugaggaagagggacuguuc

SEQ ID NO: 694573 - RNA, 13 nt, Homo sapiens
ucgauauaugacu

SEQ ID NO: 694574 - RNA, 16 nt, Homo sapiens
ucggggacacaggcca

SEQ ID NO: 694575 - RNA, 15 nt, Homo sapiens
ucucacuaaaaugga

SEQ ID NO: 694576 - RNA, 16 nt, Homo sapiens
ucucucgcaagggaag

SEQ ID NO: 694577 - RNA, 23 nt, Homo sapiens
ucuguguguguguaugugggggu

SEQ ID NO: 694578 - RNA, 18 nt, Homo sapiens
ugaaaauuaugagucucu

SEQ ID NO: 694579 - RNA, 20 nt, Homo sapiens
ugaauacauuuugcacaaag

SEQ ID NO: 694580 - RNA, 17 nt, Homo sapiens
ugagcuggggaugucuc

SEQ ID NO: 694581 - RNA, 15 nt, Homo sapiens
ugaggggcucucuca

SEQ ID NO: 694582 - RNA, 17 nt, Homo sapiens
ugauaagcugagcuccu

SEQ ID NO: 694583 - RNA, 15 nt, Homo sapiens
ugauuguauuuaccu

SEQ ID NO: 694584 - RNA, 21 nt, Homo sapiens
ugcaggagucccugccaucau

SEQ ID NO: 694585 - RNA, 18 nt, Homo sapiens
ugccugugccuuuugcca

SEQ ID NO: 694586 - RNA, 20 nt, Homo sapiens
ugcuguagacauuugcuaug

SEQ ID NO: 694587 - RNA, 15 nt, Homo sapiens
ugcuguauccaucca

SEQ ID NO: 694588 - RNA, 15 nt, Homo sapiens
uggaagcacaugugu

SEQ ID NO: 694589 - RNA, 21 nt, Homo sapiens
uggaauacuugaaaaccucau

SEQ ID NO: 694590 - RNA, 21 nt, Homo sapiens
uggcugggaauaagugccagg

SEQ ID NO: 694591 - RNA, 16 nt, Homo sapiens
ugggcgaagcuaaaag

SEQ ID NO: 694592 - RNA, 16 nt, Homo sapiens
uggggaugucucucau

SEQ ID NO: 694593 - RNA, 18 nt, Homo sapiens
uggggaugucucucauga

SEQ ID NO: 694594 - RNA, 15 nt, Homo sapiens
uggugcgaucuuggc

SEQ ID NO: 694595 - RNA, 19 nt, Homo sapiens
uguauccauccauggggcu

SEQ ID NO: 694596 - RNA, 20 nt, Homo sapiens
uguauuuaccuucuaccucu

SEQ ID NO: 694597 - RNA, 14 nt, Homo sapiens
ugucacaccugaaa

SEQ ID NO: 694598 - RNA, 16 nt, Homo sapiens
ugucccagaaugccuc

SEQ ID NO: 694599 - RNA, 15 nt, Homo sapiens
ugucccucauccaua

SEQ ID NO: 694600 - RNA, 21 nt, Homo sapiens
uguggggagggauuuggggcu

SEQ ID NO: 694601 - RNA, 18 nt, Homo sapiens
uguugccuggaagcacau

SEQ ID NO: 694602 - RNA, 19 nt, Homo sapiens
uguuuacagaggacaguau

SEQ ID NO: 694603 - RNA, 19 nt, Homo sapiens
uguuuagaacuacugauaa

SEQ ID NO: 694604 - RNA, 17 nt, Homo sapiens
uuaaaagaaaacaugag

SEQ ID NO: 694605 - RNA, 11 nt, Homo sapiens
uuaaacgucau

SEQ ID NO: 694606 - RNA, 15 nt, Homo sapiens
uuaauuuuauuccag

SEQ ID NO: 694607 - RNA, 16 nt, Homo sapiens
uuaauuuuauuccagu

SEQ ID NO: 694608 - RNA, 14 nt, Homo sapiens
uuaccgagcacugu

SEQ ID NO: 694609 - RNA, 17 nt, Homo sapiens
uuaccgagcacugugac

SEQ ID NO: 694610 - RNA, 20 nt, Homo sapiens
uuaccuucuaccucuuggcu

SEQ ID NO: 694611 - RNA, 13 nt, Homo sapiens
uuagcugaacaau

SEQ ID NO: 694612 - RNA, 17 nt, Homo sapiens
uuccaacugccagaaca

SEQ ID NO: 694613 - RNA, 21 nt, Homo sapiens
uuccacugaaauagagugaau

SEQ ID NO: 694614 - RNA, 22 nt, Homo sapiens
uuccccucuacuccaugcacau

SEQ ID NO: 694615 - RNA, 21 nt, Homo sapiens
uuccggccuccugucccucau

SEQ ID NO: 694616 - RNA, 21 nt, Homo sapiens
uucuauggguuggacaaccuc

SEQ ID NO: 694617 - RNA, 15 nt, Homo sapiens
uucuccuguugcaau

SEQ ID NO: 694618 - RNA, 22 nt, Homo sapiens
uucugauuugaagguauaaccu

SEQ ID NO: 694619 - RNA, 12 nt, Homo sapiens
uucuggcacugu

SEQ ID NO: 694620 - RNA, 23 nt, Homo sapiens
uucuggcacugugacuacuaugg

SEQ ID NO: 694621 - RNA, 21 nt, Homo sapiens
uugcacaaaguaagccucacc

SEQ ID NO: 694622 - RNA, 14 nt, Homo sapiens
uuggaauacuugaa

SEQ ID NO: 694623 - RNA, 19 nt, Homo sapiens
uuggaauacuugaaaaccu

SEQ ID NO: 694624 - RNA, 16 nt, Homo sapiens
uuggcagcucuacucu

SEQ ID NO: 694625 - RNA, 23 nt, Homo sapiens
uuggcagcucuacucuggagguu

SEQ ID NO: 694626 - RNA, 22 nt, Homo sapiens
uuggcccacgcagcagcagagc

SEQ ID NO: 694627 - RNA, 16 nt, Homo sapiens
uuguauuuaccuucua

SEQ ID NO: 694628 - RNA, 16 nt, Homo sapiens
uugugauguguccuga

SEQ ID NO: 694629 - RNA, 16 nt, Homo sapiens
uuguucagaagacaca

SEQ ID NO: 694630 - RNA, 22 nt, Homo sapiens
uuuaccauaaaaauccuucuca

SEQ ID NO: 694631 - RNA, 17 nt, Homo sapiens
uuuaccgagcacuguga

SEQ ID NO: 694632 - RNA, 19 nt, Homo sapiens
uuugagugucuuugacuug

SEQ ID NO: 694633 - RNA, 22 nt, Homo sapiens
uuugcuggguuguuuaccgagc

SEQ ID NO: 694634 - RNA, 19 nt, Homo sapiens
uuuguucacuucgaugacu

SEQ ID NO: 694635 - RNA, 14 nt, Homo sapiens
cugugccuuuugcc

SEQ ID NO: 694636 - RNA, 16 nt, Homo sapiens
cuucagauuugccuua

SEQ ID NO: 694637 - RNA, 19 nt, Homo sapiens
cuugggaguguugucacac

SEQ ID NO: 694638 - RNA, 13 nt, Homo sapiens
cuuugucccagaa

SEQ ID NO: 694639 - RNA, 22 nt, Homo sapiens
cuuuuuuuugagaauacacuau

SEQ ID NO: 694640 - RNA, 12 nt, Homo sapiens
gaaaacauaugc

SEQ ID NO: 694641 - RNA, 12 nt, Homo sapiens
gaaaacaugacu

SEQ ID NO: 694642 - RNA, 16 nt, Homo sapiens
gaaaacaugacuuuau

SEQ ID NO: 694643 - RNA, 16 nt, Homo sapiens
gaaaagaaagcugcuu

SEQ ID NO: 694644 - RNA, 19 nt, Homo sapiens
gaaaagcaguggcuccauu

SEQ ID NO: 694645 - RNA, 17 nt, Homo sapiens
gaacauggauuccacug

SEQ ID NO: 694646 - RNA, 15 nt, Homo sapiens
gaacuccaguacuca

SEQ ID NO: 694647 - RNA, 14 nt, Homo sapiens
gaagaaaacaugac

SEQ ID NO: 694648 - RNA, 15 nt, Homo sapiens
gaagaaaacaugacu

SEQ ID NO: 694649 - RNA, 14 nt, Homo sapiens
gaaggcuaugggga

SEQ ID NO: 694650 - RNA, 17 nt, Homo sapiens
gaagugugggucugugu

SEQ ID NO: 694651 - RNA, 23 nt, Homo sapiens
gacacaggccagcuccacagugu

SEQ ID NO: 694652 - RNA, 20 nt, Homo sapiens
gagaagccagcuuuccucau

SEQ ID NO: 694653 - RNA, 18 nt, Homo sapiens
gagauucuugugccucag

SEQ ID NO: 694654 - RNA, 23 nt, Homo sapiens
gagugaccucacuucuggcacug

SEQ ID NO: 694655 - RNA, 20 nt, Homo sapiens
gauaaaucaguuaugucaau

SEQ ID NO: 694656 - RNA, 21 nt, Homo sapiens
gauaaaucaguuaugucaauu

SEQ ID NO: 694657 - RNA, 19 nt, Homo sapiens
gauauaugacuuuuucuca

SEQ ID NO: 694658 - RNA, 18 nt, Homo sapiens
gcacccaugccauagaaa

SEQ ID NO: 694659 - RNA, 22 nt, Homo sapiens
gcacguguggccuguucuucua

SEQ ID NO: 694660 - RNA, 13 nt, Homo sapiens
gcagcucuacucu

SEQ ID NO: 694661 - RNA, 14 nt, Homo sapiens
gcagggauucuucc

SEQ ID NO: 694662 - RNA, 12 nt, Homo sapiens
gccugugccuuu

SEQ ID NO: 694663 - RNA, 15 nt, Homo sapiens
gccuuauuggcagcu

SEQ ID NO: 694664 - RNA, 17 nt, Homo sapiens
gcuccacaguguugcca

SEQ ID NO: 694665 - RNA, 20 nt, Homo sapiens
gcuccauugguguugacaua

SEQ ID NO: 694666 - RNA, 23 nt, Homo sapiens
gcugagcagguguucuucauuac

SEQ ID NO: 694667 - RNA, 22 nt, Homo sapiens
gcugaggccucucauuccagag

SEQ ID NO: 694668 - RNA, 20 nt, Homo sapiens
gcuggagugcaguggugcga

SEQ ID NO: 694669 - RNA, 17 nt, Homo sapiens
gcuguauccauccaugg

SEQ ID NO: 694670 - RNA, 21 nt, Homo sapiens
gcuguuuagaacuacugauaa

SEQ ID NO: 694671 - RNA, 16 nt, Homo sapiens
ggacaaccucauuuua

SEQ ID NO: 694672 - RNA, 23 nt, Homo sapiens
ggagugaggaugucugggccacu

SEQ ID NO: 694673 - RNA, 16 nt, Homo sapiens
ggauguaccagcaucu

SEQ ID NO: 694674 - RNA, 18 nt, Homo sapiens
ggccacagugcaauuuua

SEQ ID NO: 694675 - RNA, 11 nt, Homo sapiens
ggccagcacca

SEQ ID NO: 694676 - RNA, 15 nt, Homo sapiens
ggcccugugccuugg

SEQ ID NO: 694677 - RNA, 17 nt, Homo sapiens
ggccuccugucccucau

SEQ ID NO: 694678 - RNA, 20 nt, Homo sapiens
ggcugaggccucucauucca

SEQ ID NO: 694679 - RNA, 15 nt, Homo sapiens
gggaguguugucaca

SEQ ID NO: 694680 - RNA, 16 nt, Homo sapiens
gggcucagaguggggu

SEQ ID NO: 694681 - RNA, 19 nt, Homo sapiens
gggcucucucaugauagaa

SEQ ID NO: 694682 - RNA, 13 nt, Homo sapiens
ggggcucucucau

SEQ ID NO: 694683 - RNA, 12 nt, Homo sapiens
ggugugcuguau

SEQ ID NO: 694684 - RNA, 21 nt, Homo sapiens
guauaaccuucaugaugaauu

SEQ ID NO: 694685 - RNA, 15 nt, Homo sapiens
gucaguauguggaag

SEQ ID NO: 694686 - RNA, 18 nt, Homo sapiens
gucucuaugaucuuggca

SEQ ID NO: 694687 - RNA, 16 nt, Homo sapiens
gugcgauaacuuaaca

SEQ ID NO: 694688 - RNA, 22 nt, Homo sapiens
guggcuggaucugugaggggcu

SEQ ID NO: 694689 - RNA, 23 nt, Homo sapiens
guguucuucauuaccucagugag

SEQ ID NO: 694690 - RNA, 19 nt, Homo sapiens
guuauagaaacugauauau

SEQ ID NO: 694691 - RNA, 19 nt, Homo sapiens
guucuuagcugaacaauga

SEQ ID NO: 694692 - RNA, 14 nt, Homo sapiens
uaaaauucuuggga

SEQ ID NO: 694693 - RNA, 15 nt, Homo sapiens
uaaauaacagugugu

SEQ ID NO: 694694 - RNA, 20 nt, Homo sapiens
uaagcugagcuccuuagccu

SEQ ID NO: 694695 - RNA, 17 nt, Homo sapiens
uaaggaacggcccuuuu

SEQ ID NO: 694696 - RNA, 16 nt, Homo sapiens
uaaucugagaggccac

SEQ ID NO: 694697 - RNA, 21 nt, Homo sapiens
uaaucugagaggccacagugc

SEQ ID NO: 694698 - RNA, 15 nt, Homo sapiens
uaccgagcacuguga

SEQ ID NO: 694699 - RNA, 15 nt, Homo sapiens
uaccuucuaccucuu

SEQ ID NO: 694700 - RNA, 21 nt, Homo sapiens
uacucacccagggacuccagu

SEQ ID NO: 694701 - RNA, 20 nt, Homo sapiens
uacugagacaugacuaggaa

SEQ ID NO: 694702 - RNA, 21 nt, Homo sapiens
uacuuacaucuuuguuuacca

SEQ ID NO: 694703 - RNA, 12 nt, Homo sapiens
uagagcacuuuu

SEQ ID NO: 694704 - RNA, 18 nt, Homo sapiens
uagcaccuccacauaccu

SEQ ID NO: 694705 - RNA, 21 nt, Homo sapiens
uaggaacugcugggcuuggca

SEQ ID NO: 694706 - RNA, 18 nt, Homo sapiens
uauauuaaagacuaacua

SEQ ID NO: 694707 - RNA, 15 nt, Homo sapiens
uaucgcugccuugcc

SEQ ID NO: 694708 - RNA, 22 nt, Homo sapiens
uaugagcuggggaugucucuca

SEQ ID NO: 694709 - RNA, 17 nt, Homo sapiens
uaugugggggucugugu

SEQ ID NO: 694710 - RNA, 21 nt, Homo sapiens
uauuagagcugccugugccuu

SEQ ID NO: 694711 - RNA, 21 nt, Homo sapiens
uauuucaaccgcuugccauau

SEQ ID NO: 694712 - RNA, 14 nt, Homo sapiens
uauuuuucucauga

SEQ ID NO: 694713 - RNA, 16 nt, Homo sapiens
ucacugcuguagacau

SEQ ID NO: 694714 - RNA, 19 nt, Homo sapiens
ucagcacguguggccuguu

SEQ ID NO: 694715 - RNA, 18 nt, Homo sapiens
ucaggguguuaaggcagu

SEQ ID NO: 694716 - RNA, 12 nt, Homo sapiens
ucaguaugugga

SEQ ID NO: 694717 - RNA, 15 nt, Homo sapiens
ucauaaucacaaccc

SEQ ID NO: 694718 - RNA, 11 nt, Homo sapiens
ucauuaccuca

SEQ ID NO: 694719 - RNA, 14 nt, Homo sapiens
ucauucaguacuua

SEQ ID NO: 694720 - RNA, 13 nt, Homo sapiens
ucauuuaccauaa

SEQ ID NO: 694721 - RNA, 15 nt, Homo sapiens
ucauuuguucauuaa

SEQ ID NO: 694722 - RNA, 20 nt, Homo sapiens
uccauccauggggcugauug

SEQ ID NO: 694723 - RNA, 17 nt, Homo sapiens
uccauugguguugacau

SEQ ID NO: 694724 - RNA, 11 nt, Homo sapiens
ucccucaggcc

SEQ ID NO: 694725 - RNA, 14 nt, Homo sapiens
ucccucauccauag

SEQ ID NO: 694726 - RNA, 13 nt, Homo sapiens
uccugucccucau

SEQ ID NO: 694727 - RNA, 16 nt, Homo sapiens
uccugucccucaucca

SEQ ID NO: 694728 - RNA, 19 nt, Homo sapiens
uccugucccucauccauag

SEQ ID NO: 694729 - RNA, 24 nt, Homo sapiens
uccuguugcaaugacacauaggaa

SEQ ID NO: 694730 - RNA, 23 nt, Homo sapiens
uccuuaaaaugugagugaccuca

SEQ ID NO: 694731 - RNA, 17 nt, Homo sapiens
uccuuuccccucccuca

SEQ ID NO: 694732 - RNA, 18 nt, Homo sapiens
uccuuuccccucccucag

SEQ ID NO: 694733 - RNA, 17 nt, Homo sapiens
ucuacuccaugcacaua

SEQ ID NO: 694734 - RNA, 19 nt, Homo sapiens
ucuguguguguguaugugg

SEQ ID NO: 694735 - RNA, 21 nt, Homo sapiens
ucuucaggguguuaaggcagu

SEQ ID NO: 694736 - RNA, 15 nt, Homo sapiens
ucuucauuaccucag

SEQ ID NO: 694737 - RNA, 16 nt, Homo sapiens
ucuuggaauacuugaa

SEQ ID NO: 694738 - RNA, 19 nt, Homo sapiens
aguacuuacccuaaaacau

SEQ ID NO: 694739 - RNA, 20 nt, Homo sapiens
agucagacuuacuuacuccc

SEQ ID NO: 694740 - RNA, 13 nt, Homo sapiens
agucauccucaga

SEQ ID NO: 694741 - RNA, 17 nt, Homo sapiens
agucccugccaucaugu

SEQ ID NO: 694742 - RNA, 15 nt, Homo sapiens
agugaauacauuuug

SEQ ID NO: 694743 - RNA, 20 nt, Homo sapiens
agugacuuuagaaacaaauu

SEQ ID NO: 694744 - RNA, 21 nt, Homo sapiens
aguucacaggccagaaaacau

SEQ ID NO: 694745 - RNA, 18 nt, Homo sapiens
aguuccccucuacuccau

SEQ ID NO: 694746 - RNA, 15 nt, Homo sapiens
auaaaucaguuaugu

SEQ ID NO: 694747 - RNA, 20 nt, Homo sapiens
auaaccuucaugaugaauua

SEQ ID NO: 694748 - RNA, 23 nt, Homo sapiens
auaaccuucaugaugaauuacuu

SEQ ID NO: 694749 - RNA, 15 nt, Homo sapiens
auaauugacaugggc

SEQ ID NO: 694750 - RNA, 12 nt, Homo sapiens
auagaaacugau

SEQ ID NO: 694751 - RNA, 22 nt, Homo sapiens
auaggaaaccacacagacuugg

SEQ ID NO: 694752 - RNA, 18 nt, Homo sapiens
auauaugacuuuuucuca

SEQ ID NO: 694753 - RNA, 17 nt, Homo sapiens
auaugacuuuuucucag

SEQ ID NO: 694754 - RNA, 14 nt, Homo sapiens
auaugcauuaugaa

SEQ ID NO: 694755 - RNA, 17 nt, Homo sapiens
aucaaaucagucuugga

SEQ ID NO: 694756 - RNA, 17 nt, Homo sapiens
aucaacauuuguuccau

SEQ ID NO: 694757 - RNA, 18 nt, Homo sapiens
aucaacauuuguuccaug

SEQ ID NO: 694758 - RNA, 16 nt, Homo sapiens
aucgcugccuugccau

SEQ ID NO: 694759 - RNA, 23 nt, Homo sapiens
aucugugaggggcucucucauga

SEQ ID NO: 694760 - RNA, 22 nt, Homo sapiens
augagcuggggaugucucucau

SEQ ID NO: 694761 - RNA, 15 nt, Homo sapiens
augauguguagggcu

SEQ ID NO: 694762 - RNA, 11 nt, Homo sapiens
auguguugccu

SEQ ID NO: 694763 - RNA, 20 nt, Homo sapiens
auguguugccuggaagcaca

SEQ ID NO: 694764 - RNA, 13 nt, Homo sapiens
auguuuuguacuu

SEQ ID NO: 694765 - RNA, 20 nt, Homo sapiens
auuaaccugaauuauuccaa

SEQ ID NO: 694766 - RNA, 16 nt, Homo sapiens
auugcaggagucccug

SEQ ID NO: 694767 - RNA, 12 nt, Homo sapiens
auugucccugaa

SEQ ID NO: 694768 - RNA, 13 nt, Homo sapiens
auuuaaacuucuu

SEQ ID NO: 694769 - RNA, 15 nt, Homo sapiens
auuuaugguucucag

SEQ ID NO: 694770 - RNA, 20 nt, Homo sapiens
auuuguaaauuuaugugaug

SEQ ID NO: 694771 - RNA, 20 nt, Homo sapiens
caaaguaagccucaccuuug

SEQ ID NO: 694772 - RNA, 19 nt, Homo sapiens
caauucuccuguugcaaug

SEQ ID NO: 694773 - RNA, 12 nt, Homo sapiens
cacaaauuguac

SEQ ID NO: 694774 - RNA, 21 nt, Homo sapiens
cacaguguugccagagccuua

SEQ ID NO: 694775 - RNA, 18 nt, Homo sapiens
cacugaaauagagugaau

SEQ ID NO: 694776 - RNA, 21 nt, Homo sapiens
cacuucgaugacuggauacag

SEQ ID NO: 694777 - RNA, 20 nt, Homo sapiens
cagcuuuccucaucaggcca

SEQ ID NO: 694778 - RNA, 18 nt, Homo sapiens
caggccagaaaacauaug

SEQ ID NO: 694779 - RNA, 17 nt, Homo sapiens
caggguguuaaggcagu

SEQ ID NO: 694780 - RNA, 21 nt, Homo sapiens
cagguguucuucauuaccuca

SEQ ID NO: 694781 - RNA, 19 nt, Homo sapiens
caguaaauauuaaccugaa

SEQ ID NO: 694782 - RNA, 12 nt, Homo sapiens
cagucuuggaau

SEQ ID NO: 694783 - RNA, 13 nt, Homo sapiens
cagucuuggaaua

SEQ ID NO: 694784 - RNA, 17 nt, Homo sapiens
cagugacuuuagaaaca

SEQ ID NO: 694785 - RNA, 18 nt, Homo sapiens
caguggcuggaucuguga

SEQ ID NO: 694786 - RNA, 19 nt, Homo sapiens
cauccaacauuaaaagcca

SEQ ID NO: 694787 - RNA, 16 nt, Homo sapiens
caucucuuuaccuccu

SEQ ID NO: 694788 - RNA, 23 nt, Homo sapiens
caugaccaaaugcuuuuccucaa

SEQ ID NO: 694789 - RNA, 17 nt, Homo sapiens
caugaguuggcugggaa

SEQ ID NO: 694790 - RNA, 16 nt, Homo sapiens
cauggauuccacugaa

SEQ ID NO: 694791 - RNA, 16 nt, Homo sapiens
caugucuuguucagaa

SEQ ID NO: 694792 - RNA, 17 nt, Homo sapiens
cauguguugccuggaag

SEQ ID NO: 694793 - RNA, 19 nt, Homo sapiens
cauugguguugacauacau

SEQ ID NO: 694794 - RNA, 12 nt, Homo sapiens
cauugucccuga

SEQ ID NO: 694795 - RNA, 15 nt, Homo sapiens
ccaaaaguacuuacc

SEQ ID NO: 694796 - RNA, 12 nt, Homo sapiens
ccaauuccucau

SEQ ID NO: 694797 - RNA, 18 nt, Homo sapiens
ccacucaggggucauuca

SEQ ID NO: 694798 - RNA, 18 nt, Homo sapiens
ccagaaugaacaacacaa

SEQ ID NO: 694799 - RNA, 23 nt, Homo sapiens
ccagagccuuaauaaacguccac

SEQ ID NO: 694800 - RNA, 20 nt, Homo sapiens
ccagaggaagggacaccaag

SEQ ID NO: 694801 - RNA, 23 nt, Homo sapiens
ccagcuccacaguguugccagag

SEQ ID NO: 694802 - RNA, 16 nt, Homo sapiens
ccauagaaacugaggc

SEQ ID NO: 694803 - RNA, 15 nt, Homo sapiens
ccauugguguugaca

SEQ ID NO: 694804 - RNA, 14 nt, Homo sapiens
cccacuuggcauca

SEQ ID NO: 694805 - RNA, 17 nt, Homo sapiens
cccagaaauguauggca

SEQ ID NO: 694806 - RNA, 14 nt, Homo sapiens
cccuaaaacaugug

SEQ ID NO: 694807 - RNA, 22 nt, Homo sapiens
cccuaaauguggacaucaugaa

SEQ ID NO: 694808 - RNA, 13 nt, Homo sapiens
ccgagcacuguga

SEQ ID NO: 694809 - RNA, 13 nt, Homo sapiens
ccgcuugccauau

SEQ ID NO: 694810 - RNA, 20 nt, Homo sapiens
ccgggucaucuguaccucug

SEQ ID NO: 694811 - RNA, 17 nt, Homo sapiens
ccuaauuccacacccuc

SEQ ID NO: 694812 - RNA, 14 nt, Homo sapiens
ccucauuuaccaua

SEQ ID NO: 694813 - RNA, 15 nt, Homo sapiens
ccuccugucccucau

SEQ ID NO: 694814 - RNA, 14 nt, Homo sapiens
ccuucagauuugcc

SEQ ID NO: 694815 - RNA, 21 nt, Homo sapiens
ccuucaugaugaauuacuucu

SEQ ID NO: 694816 - RNA, 17 nt, Homo sapiens
ccuucgauauaugacuu

SEQ ID NO: 694817 - RNA, 12 nt, Homo sapiens
ccuucuaccucu

SEQ ID NO: 694818 - RNA, 22 nt, Homo sapiens
ccuugcaagcuaauucuuugac

SEQ ID NO: 694819 - RNA, 23 nt, Homo sapiens
ccuuggugugcuguauccaucca

SEQ ID NO: 694820 - RNA, 13 nt, Homo sapiens
ccuugugaaggaa

SEQ ID NO: 694821 - RNA, 13 nt, Homo sapiens
ccuuuugccaucc

SEQ ID NO: 694822 - RNA, 22 nt, Homo sapiens
cgaauaaagugaauacauuuug

SEQ ID NO: 694823 - RNA, 15 nt, Homo sapiens
cuaauuccacacccu

SEQ ID NO: 694824 - RNA, 17 nt, Homo sapiens
cuaauuccacacccuca

SEQ ID NO: 694825 - RNA, 14 nt, Homo sapiens
cuacugauaacgua

SEQ ID NO: 694826 - RNA, 15 nt, Homo sapiens
cucauuccagaggaa

SEQ ID NO: 694827 - RNA, 14 nt, Homo sapiens
cucauuuuaacuca

SEQ ID NO: 694828 - RNA, 13 nt, Homo sapiens
cuccacaguguug

SEQ ID NO: 694829 - RNA, 18 nt, Homo sapiens
cuccccuuguacucuugc

SEQ ID NO: 694830 - RNA, 16 nt, Homo sapiens
cuccuguugcaaugac

SEQ ID NO: 694831 - RNA, 12 nt, Homo sapiens
cucuacccugag

SEQ ID NO: 694832 - RNA, 20 nt, Homo sapiens
cucuacucuggagguuuguu

SEQ ID NO: 694833 - RNA, 17 nt, Homo sapiens
cucuaugaucuuggcac

SEQ ID NO: 694834 - RNA, 23 nt, Homo sapiens
cugagcagguguucuucauuacc

SEQ ID NO: 694835 - RNA, 23 nt, Homo sapiens
cugccuccuuuccccucccucag

SEQ ID NO: 694836 - RNA, 20 nt, Homo sapiens
cuggaucugugaggggcucu

SEQ ID NO: 694837 - RNA, 17 nt, Homo sapiens
cuggcccugugccuugg

SEQ ID NO: 694838 - RNA, 21 nt, Homo sapiens
cuguagacauuugcuaugagc

SEQ ID NO: 694839 - RNA, 16 nt, Homo sapiens
cugugacuacuauggc

SEQ ID NO: 694840 - RNA, 21 nt, Homo sapiens
cugugaggggcucucucauga

SEQ ID NO: 694841 - RNA, 19 nt, Homo sapiens
aaaaccucauuuaccauaa

SEQ ID NO: 694842 - RNA, 12 nt, Homo sapiens
aaaaugugagug

SEQ ID NO: 694843 - RNA, 13 nt, Homo sapiens
aaacuucaucaca

SEQ ID NO: 694844 - RNA, 14 nt, Homo sapiens
aaagaaaacaugag

SEQ ID NO: 694845 - RNA, 16 nt, Homo sapiens
aaagacuacacuguug

SEQ ID NO: 694846 - RNA, 20 nt, Homo sapiens
aaagcacuguuuaacuggga

SEQ ID NO: 694847 - RNA, 15 nt, Homo sapiens
aaauuguacauuuga

SEQ ID NO: 694848 - RNA, 12 nt, Homo sapiens
aaccagcaacau

SEQ ID NO: 694849 - RNA, 19 nt, Homo sapiens
aaccagcaacauugaccca

SEQ ID NO: 694850 - RNA, 20 nt, Homo sapiens
aacccuucagauuugccuua

SEQ ID NO: 694851 - RNA, 14 nt, Homo sapiens
aaccucauuuacca

SEQ ID NO: 694852 - RNA, 14 nt, Homo sapiens
aacugccagaacau

SEQ ID NO: 694853 - RNA, 12 nt, Homo sapiens
aacuucuuguug

SEQ ID NO: 694854 - RNA, 12 nt, Homo sapiens
aagcacaugugu

SEQ ID NO: 694855 - RNA, 18 nt, Homo sapiens
aagggacaccaagccuug

SEQ ID NO: 694856 - RNA, 16 nt, Homo sapiens
aagugaauacauuuug

SEQ ID NO: 694857 - RNA, 13 nt, Homo sapiens
aauaacagugugu

SEQ ID NO: 694858 - RNA, 12 nt, Homo sapiens
aauaagugccag

SEQ ID NO: 694859 - RNA, 13 nt, Homo sapiens
aauagagugaauu

SEQ ID NO: 694860 - RNA, 17 nt, Homo sapiens
aauauuuaaacuucuug

SEQ ID NO: 694861 - RNA, 17 nt, Homo sapiens
aaugucaguauguggaa

SEQ ID NO: 694862 - RNA, 12 nt, Homo sapiens
aauuacuucuuc

SEQ ID NO: 694863 - RNA, 19 nt, Homo sapiens
aauucuccuguugcaauga

SEQ ID NO: 694864 - RNA, 19 nt, Homo sapiens
aauuuucuaugaauugcua

SEQ ID NO: 694865 - RNA, 20 nt, Homo sapiens
aauuuucuaugaauugcuaa

SEQ ID NO: 694866 - RNA, 17 nt, Homo sapiens
acaaauuguacauuuga

SEQ ID NO: 694867 - RNA, 19 nt, Homo sapiens
acaaauuuuuuucuuguuu

SEQ ID NO: 694868 - RNA, 20 nt, Homo sapiens
acagacacucccacuuggca

SEQ ID NO: 694869 - RNA, 16 nt, Homo sapiens
acaugcuugcauuaua

SEQ ID NO: 694870 - RNA, 19 nt, Homo sapiens
accaaaugcuuuuccucaa

SEQ ID NO: 694871 - RNA, 23 nt, Homo sapiens
accaagccuuggcucuacccuga

SEQ ID NO: 694872 - RNA, 20 nt, Homo sapiens
accaucucuuuaccuccuaa

SEQ ID NO: 694873 - RNA, 13 nt, Homo sapiens
acccaugccauag

SEQ ID NO: 694874 - RNA, 19 nt, Homo sapiens
accuggcccugugccuugg

SEQ ID NO: 694875 - RNA, 17 nt, Homo sapiens
acucaggggucauucau

SEQ ID NO: 694876 - RNA, 13 nt, Homo sapiens
acugccacugugg

SEQ ID NO: 694877 - RNA, 15 nt, Homo sapiens
acuucuggcacugug

SEQ ID NO: 694878 - RNA, 14 nt, Homo sapiens
agaaaacaugacuu

SEQ ID NO: 694879 - RNA, 23 nt, Homo sapiens
agaaacugaggccauuauuucaa

SEQ ID NO: 694880 - RNA, 12 nt, Homo sapiens
agaacuacugau

SEQ ID NO: 694881 - RNA, 14 nt, Homo sapiens
agaacuacugauaa

SEQ ID NO: 694882 - RNA, 19 nt, Homo sapiens
agacauuugcuaugagcug

SEQ ID NO: 694883 - RNA, 17 nt, Homo sapiens
agacuuacuuacuccca

SEQ ID NO: 694884 - RNA, 14 nt, Homo sapiens
agagagugcuauug

SEQ ID NO: 694885 - RNA, 17 nt, Homo sapiens
agagcugaacuauuaga

SEQ ID NO: 694886 - RNA, 21 nt, Homo sapiens
agagugggguagguugggaga

SEQ ID NO: 694887 - RNA, 20 nt, Homo sapiens
agcauaggaaaccacacaga

SEQ ID NO: 694888 - RNA, 23 nt, Homo sapiens
agcccgggucaucuguaccucug

SEQ ID NO: 694889 - RNA, 19 nt, Homo sapiens
agcuuuccucaucaggcca

SEQ ID NO: 694890 - RNA, 14 nt, Homo sapiens
aggagucagggaga

SEQ ID NO: 694891 - RNA, 15 nt, Homo sapiens
aggagucccugccau

SEQ ID NO: 694892 - RNA, 15 nt, Homo sapiens
aggccagcaccaucu

SEQ ID NO: 694893 - RNA, 20 nt, Homo sapiens
agggacaccaagccuuggcu

SEQ ID NO: 694894 - RNA, 16 nt, Homo sapiens
agggacuccaguucac

SEQ ID NO: 694895 - RNA, 16 nt, Homo sapiens
agggagagagugcuau

SEQ ID NO: 694896 - RNA, 14 nt, Homo sapiens
aggggcucucucau

SEQ ID NO: 694897 - RNA, 17 nt, Homo sapiens
agguaaacaaacaaaua

SEQ ID NO: 694898 - RNA, 21 nt, Homo sapiens
agguguucuucauuaccucag

SEQ ID NO: 694899 - RNA, 23 nt, Homo sapiens
agguguucuucauuaccucagug

SEQ ID NO: 694900 - RNA, 12 nt, Homo sapiens
agucucuaugau

SEQ ID NO: 694901 - RNA, 18 nt, Homo sapiens
agucucuaugaucuuggc

SEQ ID NO: 694902 - RNA, 17 nt, Homo sapiens
agugauaugauguguag

SEQ ID NO: 694903 - RNA, 15 nt, Homo sapiens
agugggguagguugg

SEQ ID NO: 694904 - RNA, 20 nt, Homo sapiens
aguggugcgaucuuggcuca

SEQ ID NO: 694905 - RNA, 17 nt, Homo sapiens
aguuaauuuuauuccag

SEQ ID NO: 694906 - RNA, 23 nt, Homo sapiens
aguuaauuuuauuccaguaagga

SEQ ID NO: 694907 - RNA, 12 nt, Homo sapiens
auagaaacugag

SEQ ID NO: 694908 - RNA, 18 nt, Homo sapiens
auagcaccuccacauacc

SEQ ID NO: 694909 - RNA, 18 nt, Homo sapiens
auauaaacaugcuugcau

SEQ ID NO: 694910 - RNA, 22 nt, Homo sapiens
auccauagcaccuccacauacc

SEQ ID NO: 694911 - RNA, 19 nt, Homo sapiens
auccauggggcugauugua

SEQ ID NO: 694912 - RNA, 18 nt, Homo sapiens
aucuacugagacaugacu

SEQ ID NO: 694913 - RNA, 17 nt, Homo sapiens
aucucacucuguugccc

SEQ ID NO: 694914 - RNA, 19 nt, Homo sapiens
aucucacucuguugcccag

SEQ ID NO: 694915 - RNA, 14 nt, Homo sapiens
aucucuuuaccucc

SEQ ID NO: 694916 - RNA, 17 nt, Homo sapiens
aucugagaggccacagu

SEQ ID NO: 694917 - RNA, 14 nt, Homo sapiens
augaaagugcgaua

SEQ ID NO: 694918 - RNA, 23 nt, Homo sapiens
augagcuggggaugucucucaug

SEQ ID NO: 694919 - RNA, 12 nt, Homo sapiens
augaucuuggca

SEQ ID NO: 694920 - RNA, 14 nt, Homo sapiens
augucaauugucag

SEQ ID NO: 694921 - RNA, 21 nt, Homo sapiens
augugggggucuguguguuua

SEQ ID NO: 694922 - RNA, 12 nt, Homo sapiens
ggacacaggcca

SEQ ID NO: 694923 - RNA, 15 nt, Homo sapiens
ggagagagugcuauu

SEQ ID NO: 694924 - RNA, 16 nt, Homo sapiens
ggccagcaccaucucu

SEQ ID NO: 694925 - RNA, 16 nt, Homo sapiens
gggacuccaguucaca

SEQ ID NO: 694926 - RNA, 16 nt, Homo sapiens
gggagagagugcuauu

SEQ ID NO: 694927 - RNA, 14 nt, Homo sapiens
gggaguguguaauu

SEQ ID NO: 694928 - RNA, 19 nt, Homo sapiens
gggcugauuguauuuaccu

SEQ ID NO: 694929 - RNA, 15 nt, Homo sapiens
ggggaugucucucau

SEQ ID NO: 694930 - RNA, 10 nt, Homo sapiens
gggucugugu

SEQ ID NO: 694931 - RNA, 19 nt, Homo sapiens
ggguguuaaggcagugacu

SEQ ID NO: 694932 - RNA, 17 nt, Homo sapiens
ggguuggacaaccucau

SEQ ID NO: 694933 - RNA, 21 nt, Homo sapiens
gguacagacacucccacuugg

SEQ ID NO: 694934 - RNA, 22 nt, Homo sapiens
ggugcgaucuuggcucacugca

SEQ ID NO: 694935 - RNA, 13 nt, Homo sapiens
guacagacacucc

SEQ ID NO: 694936 - RNA, 23 nt, Homo sapiens
guacuuacaucuuuguuuaccau

SEQ ID NO: 694937 - RNA, 14 nt, Homo sapiens
guaggaacugcugg

SEQ ID NO: 694938 - RNA, 16 nt, Homo sapiens
gucaucuguaccucug

SEQ ID NO: 694939 - RNA, 16 nt, Homo sapiens
gucugggccacucagg

SEQ ID NO: 694940 - RNA, 17 nt, Homo sapiens
gucugggccacucaggg

SEQ ID NO: 694941 - RNA, 19 nt, Homo sapiens
gucuguguguuuaugugug

SEQ ID NO: 694942 - RNA, 16 nt, Homo sapiens
gugaauacauuuugca

SEQ ID NO: 694943 - RNA, 14 nt, Homo sapiens
guguucuucauuac

SEQ ID NO: 694944 - RNA, 19 nt, Homo sapiens
guguucuucauuaccucag

SEQ ID NO: 694945 - RNA, 16 nt, Homo sapiens
guucuucauuaccuca

SEQ ID NO: 694946 - RNA, 22 nt, Homo sapiens
guuuaacugggagugauaugau

SEQ ID NO: 694947 - RNA, 18 nt, Homo sapiens
guuuaccgagcacuguga

SEQ ID NO: 694948 - RNA, 12 nt, Homo sapiens
uaaaacaugugu

SEQ ID NO: 694949 - RNA, 18 nt, Homo sapiens
uaaauaaccaauuccuca

SEQ ID NO: 694950 - RNA, 19 nt, Homo sapiens
uacagaaugaaucccauaa

SEQ ID NO: 694951 - RNA, 13 nt, Homo sapiens
uaccgagcacugu

SEQ ID NO: 694952 - RNA, 23 nt, Homo sapiens
uaccuccuaauuccacacccuca

SEQ ID NO: 694953 - RNA, 14 nt, Homo sapiens
uaccucuuggcugc

SEQ ID NO: 694954 - RNA, 15 nt, Homo sapiens
uacucccauuuuccc

SEQ ID NO: 694955 - RNA, 17 nt, Homo sapiens
uaggccagcaccaucuc

SEQ ID NO: 694956 - RNA, 19 nt, Homo sapiens
uaucagccugugccacgau

SEQ ID NO: 694957 - RNA, 23 nt, Homo sapiens
uaugagucucuaugaucuuggca

SEQ ID NO: 694958 - RNA, 19 nt, Homo sapiens
uauggcauguguaguuaau

SEQ ID NO: 694959 - RNA, 20 nt, Homo sapiens
uauggguuggacaaccucau

SEQ ID NO: 694960 - RNA, 13 nt, Homo sapiens
uauuaaccugaau

SEQ ID NO: 694961 - RNA, 18 nt, Homo sapiens
uauuagagcugccugugc

SEQ ID NO: 694962 - RNA, 20 nt, Homo sapiens
ucaaagggagagagugcuau

SEQ ID NO: 694963 - RNA, 18 nt, Homo sapiens
ucaggccauugucccuga

SEQ ID NO: 694964 - RNA, 15 nt, Homo sapiens
ucaucuguaccucug

SEQ ID NO: 694965 - RNA, 20 nt, Homo sapiens
uccaacugccagaacaugga

SEQ ID NO: 694966 - RNA, 13 nt, Homo sapiens
ucccacuuggcau

SEQ ID NO: 694967 - RNA, 13 nt, Homo sapiens
uccccucaaccca

SEQ ID NO: 694968 - RNA, 18 nt, Homo sapiens
ucccugaagagaagggca

SEQ ID NO: 694969 - RNA, 20 nt, Homo sapiens
uccggccuccugucccucau

SEQ ID NO: 694970 - RNA, 14 nt, Homo sapiens
uccucaaagggaga

SEQ ID NO: 694971 - RNA, 17 nt, Homo sapiens
uccucagaucauuauca

SEQ ID NO: 694972 - RNA, 15 nt, Homo sapiens
ucgaauaaagugaau

SEQ ID NO: 694973 - RNA, 20 nt, Homo sapiens
ucuaccucuuggcugccuug

SEQ ID NO: 694974 - RNA, 16 nt, Homo sapiens
ucuacuccaugcacau

SEQ ID NO: 694975 - RNA, 17 nt, Homo sapiens
ucuacugagacaugacu

SEQ ID NO: 694976 - RNA, 18 nt, Homo sapiens
ucuacugagacaugacua

SEQ ID NO: 694977 - RNA, 15 nt, Homo sapiens
ucuaugaauugcuaa

SEQ ID NO: 694978 - RNA, 19 nt, Homo sapiens
ucuauggguuggacaaccu

SEQ ID NO: 694979 - RNA, 17 nt, Homo sapiens
ucucacuaaaauggaua

SEQ ID NO: 694980 - RNA, 18 nt, Homo sapiens
ucucaggccugacucuca

SEQ ID NO: 694981 - RNA, 17 nt, Homo sapiens
ucucaugauagaaggcu

SEQ ID NO: 694982 - RNA, 13 nt, Homo sapiens
ucucauuccagag

SEQ ID NO: 694983 - RNA, 13 nt, Homo sapiens
ucucucaugacca

SEQ ID NO: 694984 - RNA, 15 nt, Homo sapiens
ucucuuuaccuccua

SEQ ID NO: 694985 - RNA, 21 nt, Homo sapiens
ucugugaggggcucucucaug

SEQ ID NO: 694986 - RNA, 15 nt, Homo sapiens
ucuuaaaauucuugg

SEQ ID NO: 694987 - RNA, 19 nt, Homo sapiens
ucuuagagcacuuuuaaca

SEQ ID NO: 694988 - RNA, 12 nt, Homo sapiens
ucuucauuaccu

SEQ ID NO: 694989 - RNA, 22 nt, Homo sapiens
ucuucuauggguuggacaaccu

SEQ ID NO: 694990 - RNA, 16 nt, Homo sapiens
ucuuuugucccagaaa

SEQ ID NO: 694991 - RNA, 15 nt, Homo sapiens
ugaaauagagugaau

SEQ ID NO: 694992 - RNA, 23 nt, Homo sapiens
ugaacagguucuuuaaaaugcca

SEQ ID NO: 694993 - RNA, 19 nt, Homo sapiens
ugaacuauuagagcugccu

SEQ ID NO: 694994 - RNA, 18 nt, Homo sapiens
ugacuacuauggcuguuu

SEQ ID NO: 694995 - RNA, 19 nt, Homo sapiens
ugagaggccacagugcaau

SEQ ID NO: 694996 - RNA, 23 nt, Homo sapiens
ugagcagguguucuucauuaccu

SEQ ID NO: 694997 - RNA, 18 nt, Homo sapiens
ugagcuggggaugucucu

SEQ ID NO: 694998 - RNA, 20 nt, Homo sapiens
ugagcuggggaugucucuca

SEQ ID NO: 694999 - RNA, 13 nt, Homo sapiens
ugaggccucucau

SEQ ID NO: 695000 - RNA, 14 nt, Homo sapiens
ugaggccucucauu

SEQ ID NO: 695001 - RNA, 14 nt, Homo sapiens
ugagugaccucacu

SEQ ID NO: 695002 - RNA, 20 nt, Homo sapiens
ugcaguggugcgaucuuggc

SEQ ID NO: 695003 - RNA, 16 nt, Homo sapiens
ugccuuccaacugcca

SEQ ID NO: 695004 - RNA, 15 nt, Homo sapiens
ugcugggcuuggcag

SEQ ID NO: 695005 - RNA, 18 nt, Homo sapiens
uggaagugugggucugug

SEQ ID NO: 695006 - RNA, 24 nt, Homo sapiens
uggagcugagcagguguucuucau

SEQ ID NO: 695007 - RNA, 21 nt, Homo sapiens
uggauacagaaugaaucccau

SEQ ID NO: 695008 - RNA, 12 nt, Homo sapiens
uggaucugugag

SEQ ID NO: 695009 - RNA, 17 nt, Homo sapiens
uggcacugccacugugg

SEQ ID NO: 695010 - RNA, 22 nt, Homo sapiens
uggccuguucuucuauggguug

SEQ ID NO: 695011 - RNA, 15 nt, Homo sapiens
uggcuggaucuguga

SEQ ID NO: 695012 - RNA, 18 nt, Homo sapiens
ugggcaggguacagacac

SEQ ID NO: 695013 - RNA, 22 nt, Homo sapiens
ugggccacucaggggucauuca

SEQ ID NO: 695014 - RNA, 17 nt, Homo sapiens
uggguuggacaaccuca

SEQ ID NO: 695015 - RNA, 13 nt, Homo sapiens
uggugugcuguau

SEQ ID NO: 695016 - RNA, 16 nt, Homo sapiens
uguaaauuuaugugau

SEQ ID NO: 695017 - RNA, 14 nt, Homo sapiens
uguauccauccaug

SEQ ID NO: 695018 - RNA, 21 nt, Homo sapiens
ugucccagaaugccuccugca

SEQ ID NO: 695019 - RNA, 16 nt, Homo sapiens
ugugauggcaaagaag

SEQ ID NO: 695020 - RNA, 15 nt, Homo sapiens
ugugccucagccucc

SEQ ID NO: 695021 - RNA, 14 nt, Homo sapiens
ugugugaccccaaa

SEQ ID NO: 695022 - RNA, 15 nt, Homo sapiens
uguucuuagcugaac

SEQ ID NO: 695023 - RNA, 23 nt, Homo sapiens
uguucuucauuaccucagugaga

SEQ ID NO: 695024 - RNA, 16 nt, Homo sapiens
uguugucacaccugaa

SEQ ID NO: 695025 - RNA, 18 nt, Homo sapiens
uuaaucugagaggccaca

SEQ ID NO: 695026 - RNA, 17 nt, Homo sapiens
ugggagaaugucaguau

SEQ ID NO: 695027 - RNA, 18 nt, Homo sapiens
uguaauuuaaaauuguga

SEQ ID NO: 695028 - RNA, 15 nt, Homo sapiens
ugucccagaaaagca

SEQ ID NO: 695029 - RNA, 12 nt, Homo sapiens
ugucucucauga

SEQ ID NO: 695030 - RNA, 22 nt, Homo sapiens
ugucuuugacuugguuaaagga

SEQ ID NO: 695031 - RNA, 23 nt, Homo sapiens
ugugaaggaauuauucccaugag

SEQ ID NO: 695032 - RNA, 14 nt, Homo sapiens
ugugacuacuaugg

SEQ ID NO: 695033 - RNA, 14 nt, Homo sapiens
ugugauguguccug

SEQ ID NO: 695034 - RNA, 18 nt, Homo sapiens
ugugccuuggugugcugu

SEQ ID NO: 695035 - RNA, 21 nt, Homo sapiens
uguucuuagcugaacaaugaa

SEQ ID NO: 695036 - RNA, 14 nt, Homo sapiens
uuaaagacuaacua

SEQ ID NO: 695037 - RNA, 13 nt, Homo sapiens
uuagagcacuuuu

SEQ ID NO: 695038 - RNA, 23 nt, Homo sapiens
uuauauuuguaaauuuaugugau

SEQ ID NO: 695039 - RNA, 14 nt, Homo sapiens
uuaucagccugugc

SEQ ID NO: 695040 - RNA, 16 nt, Homo sapiens
uucaagagauucuugu

SEQ ID NO: 695041 - RNA, 16 nt, Homo sapiens
uucaucacacacugag

SEQ ID NO: 695042 - RNA, 17 nt, Homo sapiens
uucaucacacacugaga

SEQ ID NO: 695043 - RNA, 12 nt, Homo sapiens
uucauuaccuca

SEQ ID NO: 695044 - RNA, 21 nt, Homo sapiens
uuccacacccucacugcugua

SEQ ID NO: 695045 - RNA, 16 nt, Homo sapiens
uuccuuaaaaugugag

SEQ ID NO: 695046 - RNA, 20 nt, Homo sapiens
uucuaccucuuggcugccuu

SEQ ID NO: 695047 - RNA, 23 nt, Homo sapiens
uucucaguaaauauuaaccugaa

SEQ ID NO: 695048 - RNA, 20 nt, Homo sapiens
uucuggcacugugacuacua

SEQ ID NO: 695049 - RNA, 16 nt, Homo sapiens
uucuucauuaccucag

SEQ ID NO: 695050 - RNA, 12 nt, Homo sapiens
uucuucuauggg

SEQ ID NO: 695051 - RNA, 16 nt, Homo sapiens
uugccuggaagcacau

SEQ ID NO: 695052 - RNA, 14 nt, Homo sapiens
uuggacaaccucau

SEQ ID NO: 695053 - RNA, 18 nt, Homo sapiens
uuggcaugaaagugcgau

SEQ ID NO: 695054 - RNA, 23 nt, Homo sapiens
uugguuaaaggaaguuuguucac

SEQ ID NO: 695055 - RNA, 13 nt, Homo sapiens
uuguacucuugcu

SEQ ID NO: 695056 - RNA, 18 nt, Homo sapiens
uuguuuaccgagcacugu

SEQ ID NO: 695057 - RNA, 12 nt, Homo sapiens
uuuaugguucuc

SEQ ID NO: 695058 - RNA, 16 nt, Homo sapiens
uuuauuuuucucauga

SEQ ID NO: 695059 - RNA, 21 nt, Homo sapiens
uuugauguuuuguacuuacau

SEQ ID NO: 695060 - RNA, 16 nt, Homo sapiens
uuugcacccaugccau

SEQ ID NO: 695061 - RNA, 13 nt, Homo sapiens
uuuguuccaugag

SEQ ID NO: 695062 - RNA, 12 nt, Homo sapiens
uuuucugauuug

SEQ ID NO: 695063 - RNA, 23 nt, Homo sapiens
gcugcuuucgaauaaagugaaua

SEQ ID NO: 695064 - RNA, 17 nt, Homo sapiens
ggauacagaaugaaucc

SEQ ID NO: 695065 - RNA, 12 nt, Homo sapiens
ggaugucucuca

SEQ ID NO: 695066 - RNA, 15 nt, Homo sapiens
ggaugucucucauga

SEQ ID NO: 695067 - RNA, 20 nt, Homo sapiens
ggcacaaauuguacauuuga

SEQ ID NO: 695068 - RNA, 21 nt, Homo sapiens
ggcagggcugaggccucucau

SEQ ID NO: 695069 - RNA, 16 nt, Homo sapiens
ggcauguguaguuaau

SEQ ID NO: 695070 - RNA, 11 nt, Homo sapiens
ggcugccuugu

SEQ ID NO: 695071 - RNA, 22 nt, Homo sapiens
gggccacucaggggucauucau

SEQ ID NO: 695072 - RNA, 14 nt, Homo sapiens
gggcucucucauga

SEQ ID NO: 695073 - RNA, 17 nt, Homo sapiens
gggcugaggccucucau

SEQ ID NO: 695074 - RNA, 14 nt, Homo sapiens
gguagguugggaga

SEQ ID NO: 695075 - RNA, 19 nt, Homo sapiens
guaagccucaccuuugccu

SEQ ID NO: 695076 - RNA, 16 nt, Homo sapiens
guagacauuugcuaug

SEQ ID NO: 695077 - RNA, 14 nt, Homo sapiens
guauaaauaaccaa

SEQ ID NO: 695078 - RNA, 23 nt, Homo sapiens
gucccagaaugccuccugcaggg

SEQ ID NO: 695079 - RNA, 22 nt, Homo sapiens
gugaggaugucugggccacuca

SEQ ID NO: 695080 - RNA, 21 nt, Homo sapiens
gugauguguccugauaagcug

SEQ ID NO: 695081 - RNA, 16 nt, Homo sapiens
gugccaggauggaaug

SEQ ID NO: 695082 - RNA, 18 nt, Homo sapiens
gugccuuggugugcugua

SEQ ID NO: 695083 - RNA, 19 nt, Homo sapiens
guguaucgcugccuugcca

SEQ ID NO: 695084 - RNA, 16 nt, Homo sapiens
gugugggaguguguaa

SEQ ID NO: 695085 - RNA, 22 nt, Homo sapiens
guguguaucgcugccuugccau

SEQ ID NO: 695086 - RNA, 19 nt, Homo sapiens
gugugugggaguguguaau

SEQ ID NO: 695087 - RNA, 15 nt, Homo sapiens
guuauagaaacugau

SEQ ID NO: 695088 - RNA, 16 nt, Homo sapiens
guucuuagagcacuuu

SEQ ID NO: 695089 - RNA, 13 nt, Homo sapiens
guucuuagcugaa

SEQ ID NO: 695090 - RNA, 15 nt, Homo sapiens
guugucacaccugaa

SEQ ID NO: 695091 - RNA, 15 nt, Homo sapiens
guuuuguacuuacau

SEQ ID NO: 695092 - RNA, 12 nt, Homo sapiens
uaaaaugccaag

SEQ ID NO: 695093 - RNA, 14 nt, Homo sapiens
uaaaauugugaugu

SEQ ID NO: 695094 - RNA, 14 nt, Homo sapiens
uaaagacuaacuaa

SEQ ID NO: 695095 - RNA, 13 nt, Homo sapiens
uaaauaaccaauu

SEQ ID NO: 695096 - RNA, 15 nt, Homo sapiens
uaaauuuaugugaug

SEQ ID NO: 695097 - RNA, 22 nt, Homo sapiens
uaacucagucuuuaaucugaga

SEQ ID NO: 695098 - RNA, 19 nt, Homo sapiens
uaagauaaucugucaguca

SEQ ID NO: 695099 - RNA, 23 nt, Homo sapiens
uaauuccacacccucacugcugu

SEQ ID NO: 695100 - RNA, 21 nt, Homo sapiens
uacagacacucccacuuggca

SEQ ID NO: 695101 - RNA, 15 nt, Homo sapiens
uaccagcaucuccca

SEQ ID NO: 695102 - RNA, 19 nt, Homo sapiens
uaccucuuggcugccuugu

SEQ ID NO: 695103 - RNA, 19 nt, Homo sapiens
uaccuggcccugugccuug

SEQ ID NO: 695104 - RNA, 20 nt, Homo sapiens
uaccuggcccugugccuugg

SEQ ID NO: 695105 - RNA, 14 nt, Homo sapiens
uaccuucuaccucu

SEQ ID NO: 695106 - RNA, 21 nt, Homo sapiens
uaccuucuaccucuuggcugc

SEQ ID NO: 695107 - RNA, 15 nt, Homo sapiens
uacuugaaaaccuca

SEQ ID NO: 695108 - RNA, 22 nt, Homo sapiens
uagaaacugaggccauuauuuc

SEQ ID NO: 695109 - RNA, 14 nt, Homo sapiens
uagagcugccugug

SEQ ID NO: 695110 - RNA, 15 nt, Homo sapiens
uagccuuugucccag

SEQ ID NO: 695111 - RNA, 13 nt, Homo sapiens
uauauuuccuuaa

SEQ ID NO: 695112 - RNA, 20 nt, Homo sapiens
uaugagucucuaugaucuug

SEQ ID NO: 695113 - RNA, 18 nt, Homo sapiens
uauggguuggacaaccuc

SEQ ID NO: 695114 - RNA, 14 nt, Homo sapiens
uaugguucucaggc

SEQ ID NO: 695115 - RNA, 15 nt, Homo sapiens
uaugguucucaggcc

SEQ ID NO: 695116 - RNA, 17 nt, Homo sapiens
uaugguucucucgcaag

SEQ ID NO: 695117 - RNA, 23 nt, Homo sapiens
uauguggaagugugggucugugu

SEQ ID NO: 695118 - RNA, 16 nt, Homo sapiens
uaugugggggucugug

SEQ ID NO: 695119 - RNA, 17 nt, Homo sapiens
uauuucaaccgcuugcc

SEQ ID NO: 695120 - RNA, 22 nt, Homo sapiens
ucaaagggagagagugcuauug

SEQ ID NO: 695121 - RNA, 15 nt, Homo sapiens
ucaaccgcuugccau

SEQ ID NO: 695122 - RNA, 16 nt, Homo sapiens
ucaaccgcuugccaua

SEQ ID NO: 695123 - RNA, 20 nt, Homo sapiens
ucacagcaagucacuggcca

SEQ ID NO: 695124 - RNA, 23 nt, Homo sapiens
ucacgugucuuuagaacuccagu

SEQ ID NO: 695125 - RNA, 14 nt, Homo sapiens
ucacuucgaugacu

SEQ ID NO: 695126 - RNA, 14 nt, Homo sapiens
ucagaucauuauca

SEQ ID NO: 695127 - RNA, 12 nt, Homo sapiens
ucagauuugccu

SEQ ID NO: 695128 - RNA, 20 nt, Homo sapiens
aaaauucuugggaguguugu

SEQ ID NO: 695129 - RNA, 12 nt, Homo sapiens
aaagcacuguuu

SEQ ID NO: 695130 - RNA, 15 nt, Homo sapiens
aaaucaguuauguca

SEQ ID NO: 695131 - RNA, 15 nt, Homo sapiens
aaaugcuuuuccuca

SEQ ID NO: 695132 - RNA, 20 nt, Homo sapiens
aacauggauuccacugaaau

SEQ ID NO: 695133 - RNA, 20 nt, Homo sapiens
aaccgcuugccauauuccga

SEQ ID NO: 695134 - RNA, 18 nt, Homo sapiens
aacguccacagaguauaa

SEQ ID NO: 695135 - RNA, 12 nt, Homo sapiens
aacuacugauaa

SEQ ID NO: 695136 - RNA, 19 nt, Homo sapiens
aacugaggccauuauuuca

SEQ ID NO: 695137 - RNA, 18 nt, Homo sapiens
aacugccagaacauggau

SEQ ID NO: 695138 - RNA, 16 nt, Homo sapiens
aagccagcuuuccuca

SEQ ID NO: 695139 - RNA, 21 nt, Homo sapiens
aagcuggcacugccacugugg

SEQ ID NO: 695140 - RNA, 14 nt, Homo sapiens
aaggagagcauagg

SEQ ID NO: 695141 - RNA, 19 nt, Homo sapiens
aagggacaccaagccuugg

SEQ ID NO: 695142 - RNA, 16 nt, Homo sapiens
aauacauuuugcacaa

SEQ ID NO: 695143 - RNA, 14 nt, Homo sapiens
aaugaugggucagu

SEQ ID NO: 695144 - RNA, 20 nt, Homo sapiens
aauuuaaccagcaacauuga

SEQ ID NO: 695145 - RNA, 22 nt, Homo sapiens
aauuuucuaugaauugcuaauu

SEQ ID NO: 695146 - RNA, 17 nt, Homo sapiens
acacucccacuuggcau

SEQ ID NO: 695147 - RNA, 15 nt, Homo sapiens
acagacacucccacu

SEQ ID NO: 695148 - RNA, 23 nt, Homo sapiens
acagacacucccacuuggcauca

SEQ ID NO: 695149 - RNA, 15 nt, Homo sapiens
acauacauccaacau

SEQ ID NO: 695150 - RNA, 20 nt, Homo sapiens
acaucuuuguuuaccauuaa

SEQ ID NO: 695151 - RNA, 14 nt, Homo sapiens
acauuuguuccaug

SEQ ID NO: 695152 - RNA, 18 nt, Homo sapiens
accagcaacauugaccca

SEQ ID NO: 695153 - RNA, 22 nt, Homo sapiens
accauuaaaaaguuggaguuau

SEQ ID NO: 695154 - RNA, 16 nt, Homo sapiens
acccagcuaugguucu

SEQ ID NO: 695155 - RNA, 13 nt, Homo sapiens
acccugaguucau

SEQ ID NO: 695156 - RNA, 14 nt, Homo sapiens
acccuuaggccagc

SEQ ID NO: 695157 - RNA, 17 nt, Homo sapiens
acccuucagauuugccu

SEQ ID NO: 695158 - RNA, 23 nt, Homo sapiens
accgauuugcacccaugccauag

SEQ ID NO: 695159 - RNA, 14 nt, Homo sapiens
accgcuugccauau

SEQ ID NO: 695160 - RNA, 16 nt, Homo sapiens
accucacuucuggcac

SEQ ID NO: 695161 - RNA, 23 nt, Homo sapiens
accuccuaauuccacacccucac

SEQ ID NO: 695162 - RNA, 18 nt, Homo sapiens
accuggcccugugccuug

SEQ ID NO: 695163 - RNA, 15 nt, Homo sapiens
accuuuccugaggaa

SEQ ID NO: 695164 - RNA, 21 nt, Homo sapiens
acuauggagcugagcaggugu

SEQ ID NO: 695165 - RNA, 18 nt, Homo sapiens
acucagucuuuaaucuga

SEQ ID NO: 695166 - RNA, 15 nt, Homo sapiens
acucccacuuggcau

SEQ ID NO: 695167 - RNA, 16 nt, Homo sapiens
acugcugggcuuggca

SEQ ID NO: 695168 - RNA, 13 nt, Homo sapiens
acugcuguagaca

SEQ ID NO: 695169 - RNA, 17 nt, Homo sapiens
acuuaaaagaacaugua

SEQ ID NO: 695170 - RNA, 13 nt, Homo sapiens
acuuaacaauuaa

SEQ ID NO: 695171 - RNA, 23 nt, Homo sapiens
acuucuggcacugugacuacuau

SEQ ID NO: 695172 - RNA, 15 nt, Homo sapiens
acuugaaaaccucau

SEQ ID NO: 695173 - RNA, 19 nt, Homo sapiens
agaaaagcaguggcuccau

SEQ ID NO: 695174 - RNA, 22 nt, Homo sapiens
agaaagacuuaucaacauuugu

SEQ ID NO: 695175 - RNA, 23 nt, Homo sapiens
agacacucccacuuggcaucauu

SEQ ID NO: 695176 - RNA, 16 nt, Homo sapiens
agagauucuugugccu

SEQ ID NO: 695177 - RNA, 12 nt, Homo sapiens
agagcacuuuua

SEQ ID NO: 695178 - RNA, 18 nt, Homo sapiens
agaguauaaauaaccaau

SEQ ID NO: 695179 - RNA, 19 nt, Homo sapiens
agcaacauugacccagaaa

SEQ ID NO: 695180 - RNA, 16 nt, Homo sapiens
agcaagucacuggcca

SEQ ID NO: 695181 - RNA, 14 nt, Homo sapiens
agcaucaaagcacu

SEQ ID NO: 695182 - RNA, 17 nt, Homo sapiens
agcaucucccaguucau

SEQ ID NO: 695183 - RNA, 22 nt, Homo sapiens
agcaucucccaguucauaauca

SEQ ID NO: 695184 - RNA, 18 nt, Homo sapiens
agccuuggcucuacccug

SEQ ID NO: 695185 - RNA, 13 nt, Homo sapiens
agcuccacagugu

SEQ ID NO: 695186 - RNA, 18 nt, Homo sapiens
agcuggcacugccacugu

SEQ ID NO: 695187 - RNA, 21 nt, Homo sapiens
agcuugagggugacuauggag

SEQ ID NO: 695188 - RNA, 20 nt, Homo sapiens
aggaaaaucuuaaaauucuu

SEQ ID NO: 695189 - RNA, 21 nt, Homo sapiens
aggagucccugccaucauguu

SEQ ID NO: 695190 - RNA, 15 nt, Homo sapiens
aggccauugucccug

SEQ ID NO: 695191 - RNA, 15 nt, Homo sapiens
agggaaguccuugca

SEQ ID NO: 695192 - RNA, 15 nt, Homo sapiens
aguauguggaagugu

SEQ ID NO: 695193 - RNA, 16 nt, Homo sapiens
agucauccucagauca

SEQ ID NO: 695194 - RNA, 15 nt, Homo sapiens
agugcuauuguagag

SEQ ID NO: 695195 - RNA, 17 nt, Homo sapiens
aguggugcgaucuuggc

SEQ ID NO: 695196 - RNA, 18 nt, Homo sapiens
auaaacaugcuugcauua

SEQ ID NO: 695197 - RNA, 19 nt, Homo sapiens
auaaccuucaugaugaauu

SEQ ID NO: 695198 - RNA, 20 nt, Homo sapiens
auaagcagucauccucagau

SEQ ID NO: 695199 - RNA, 14 nt, Homo sapiens
auacagaaugaauc

SEQ ID NO: 695200 - RNA, 20 nt, Homo sapiens
auaccuggcccugugccuug

SEQ ID NO: 695201 - RNA, 15 nt, Homo sapiens
aucauuaucagccug

SEQ ID NO: 695202 - RNA, 20 nt, Homo sapiens
aucgcugccuugccaugucu

SEQ ID NO: 695203 - RNA, 13 nt, Homo sapiens
aucuguaccucug

SEQ ID NO: 695204 - RNA, 22 nt, Homo sapiens
augaugagguuuucuuaacuua

SEQ ID NO: 695205 - RNA, 16 nt, Homo sapiens
auggauuccacugaaa

SEQ ID NO: 695206 - RNA, 14 nt, Homo sapiens
auguaccagcaucu

SEQ ID NO: 695207 - RNA, 16 nt, Homo sapiens
auuaaagacuaacuaa

SEQ ID NO: 695208 - RNA, 22 nt, Homo sapiens
auuauauuuccuuaaaauguga

SEQ ID NO: 695209 - RNA, 18 nt, Homo sapiens
auuaugagucucuaugau

SEQ ID NO: 695210 - RNA, 18 nt, Homo sapiens
auucacagcaagucacug

SEQ ID NO: 695211 - RNA, 15 nt, Homo sapiens
auuccacacccucac

SEQ ID NO: 695212 - RNA, 22 nt, Homo sapiens
auuccacugaaauagagugaau

SEQ ID NO: 695213 - RNA, 18 nt, Homo sapiens
auugguguugacauacau

SEQ ID NO: 695214 - RNA, 18 nt, Homo sapiens
auuuaccuucuaccucuu

SEQ ID NO: 695215 - RNA, 20 nt, Homo sapiens
auuuccuuaaaaugugagug

SEQ ID NO: 695216 - RNA, 18 nt, Homo sapiens
auuuuauuuuucucauga

SEQ ID NO: 695217 - RNA, 16 nt, Homo sapiens
caaaugcuuuuccuca

SEQ ID NO: 695218 - RNA, 16 nt, Homo sapiens
caaccgcuugccauau

SEQ ID NO: 695219 - RNA, 18 nt, Homo sapiens
caaccucauuuuaacuca

SEQ ID NO: 695220 - RNA, 23 nt, Homo sapiens
caagcuggcacugccacugugga

SEQ ID NO: 695221 - RNA, 13 nt, Homo sapiens
caaugacacauag

SEQ ID NO: 695222 - RNA, 23 nt, Homo sapiens
cacaacccuucagauuugccuua

SEQ ID NO: 695223 - RNA, 21 nt, Homo sapiens
cacagcaagucacuggccagu

SEQ ID NO: 695224 - RNA, 15 nt, Homo sapiens
uuaauuuucuaugaa

SEQ ID NO: 695225 - RNA, 16 nt, Homo sapiens
uuagagcugccugugc

SEQ ID NO: 695226 - RNA, 20 nt, Homo sapiens
uuagagcugccugugccuuu

SEQ ID NO: 695227 - RNA, 16 nt, Homo sapiens
uuagcugaacaaugaa

SEQ ID NO: 695228 - RNA, 13 nt, Homo sapiens
uuauuccaacucc

SEQ ID NO: 695229 - RNA, 14 nt, Homo sapiens
uucagauuugccuu

SEQ ID NO: 695230 - RNA, 20 nt, Homo sapiens
uucucaguaaauauuaaccu

SEQ ID NO: 695231 - RNA, 22 nt, Homo sapiens
uucucaguaaauauuaaccuga

SEQ ID NO: 695232 - RNA, 22 nt, Homo sapiens
uucuccuguugcaaugacacau

SEQ ID NO: 695233 - RNA, 18 nt, Homo sapiens
uugagaauacacuaucaa

SEQ ID NO: 695234 - RNA, 15 nt, Homo sapiens
uugccagagccuuaa

SEQ ID NO: 695235 - RNA, 15 nt, Homo sapiens
uuggcucuacccuga

SEQ ID NO: 695236 - RNA, 20 nt, Homo sapiens
uuguauuuaccuucuaccuc

SEQ ID NO: 695237 - RNA, 16 nt, Homo sapiens
uuuaccgagcacugug

SEQ ID NO: 695238 - RNA, 19 nt, Homo sapiens
uuugaagguauaaccuuca

SEQ ID NO: 695239 - RNA, 11 nt, Homo sapiens
uuuggggcuca

SEQ ID NO: 695240 - RNA, 20 nt, Homo sapiens
uuuggggcucagaguggggu

SEQ ID NO: 695241 - RNA, 12 nt, Homo sapiens
aaaacauaugca

SEQ ID NO: 695242 - RNA, 14 nt, Homo sapiens
aaacauaugcauua

SEQ ID NO: 695243 - RNA, 15 nt, Homo sapiens
aaagacuacacuguu

SEQ ID NO: 695244 - RNA, 14 nt, Homo sapiens
aaauagagugaauu

SEQ ID NO: 695245 - RNA, 18 nt, Homo sapiens
aaauguauggcaugugua

SEQ ID NO: 695246 - RNA, 20 nt, Homo sapiens
aacauaugcauuaugaaguu

SEQ ID NO: 695247 - RNA, 17 nt, Homo sapiens
aacaugcuugcauuaua

SEQ ID NO: 695248 - RNA, 16 nt, Homo sapiens
aacauugacccagaaa

SEQ ID NO: 695249 - RNA, 14 nt, Homo sapiens
aaccgcuugccaua

SEQ ID NO: 695250 - RNA, 13 nt, Homo sapiens
aacugccagaaca

SEQ ID NO: 695251 - RNA, 19 nt, Homo sapiens
aacuucaucacacacugag

SEQ ID NO: 695252 - RNA, 15 nt, Homo sapiens
aagacuacacuguug

SEQ ID NO: 695253 - RNA, 17 nt, Homo sapiens
aagacuuaucaacauuu

SEQ ID NO: 695254 - RNA, 19 nt, Homo sapiens
aagcaucaaagcacuguuu

SEQ ID NO: 695255 - RNA, 18 nt, Homo sapiens
aaguaagccucaccuuug

SEQ ID NO: 695256 - RNA, 22 nt, Homo sapiens
aaucagucuuggaauacuugaa

SEQ ID NO: 695257 - RNA, 16 nt, Homo sapiens
aauuauauuuccuuaa

SEQ ID NO: 695258 - RNA, 19 nt, Homo sapiens
acaaccucauuuuaacuca

SEQ ID NO: 695259 - RNA, 20 nt, Homo sapiens
acacucccacuuggcaucau

SEQ ID NO: 695260 - RNA, 16 nt, Homo sapiens
acauaugcauuaugaa

SEQ ID NO: 695261 - RNA, 13 nt, Homo sapiens
acauggauuccac

SEQ ID NO: 695262 - RNA, 18 nt, Homo sapiens
accaaaugcuuuuccuca

SEQ ID NO: 695263 - RNA, 17 nt, Homo sapiens
accaucucuuuaccucc

SEQ ID NO: 695264 - RNA, 16 nt, Homo sapiens
acccuaaaacaugugu

SEQ ID NO: 695265 - RNA, 15 nt, Homo sapiens
acccuaaauguggac

SEQ ID NO: 695266 - RNA, 22 nt, Homo sapiens
acccuuaggccagcaccaucuc

SEQ ID NO: 695267 - RNA, 12 nt, Homo sapiens
accgagcacugu

SEQ ID NO: 695268 - RNA, 22 nt, Homo sapiens
accucacuucuggcacugugac

SEQ ID NO: 695269 - RNA, 21 nt, Homo sapiens
accucauuuaccauaaaaauc

SEQ ID NO: 695270 - RNA, 17 nt, Homo sapiens
accucuuggcugccuug

SEQ ID NO: 695271 - RNA, 16 nt, Homo sapiens
acguauuuugauguuu

SEQ ID NO: 695272 - RNA, 16 nt, Homo sapiens
acucaggggucauuca

SEQ ID NO: 695273 - RNA, 14 nt, Homo sapiens
acucccauuuuccc

SEQ ID NO: 695274 - RNA, 20 nt, Homo sapiens
acucucagcagcuaugguag

SEQ ID NO: 695275 - RNA, 17 nt, Homo sapiens
acugccagaacauggau

SEQ ID NO: 695276 - RNA, 22 nt, Homo sapiens
acugccagaacauggauuccac

SEQ ID NO: 695277 - RNA, 20 nt, Homo sapiens
acugcuguagacauuugcua

SEQ ID NO: 695278 - RNA, 14 nt, Homo sapiens
acuuaucaacauuu

SEQ ID NO: 695279 - RNA, 17 nt, Homo sapiens
acuucaucacacacuga

SEQ ID NO: 695280 - RNA, 13 nt, Homo sapiens
agaaaacaugaga

SEQ ID NO: 695281 - RNA, 16 nt, Homo sapiens
agaaaagcaguggcuc

SEQ ID NO: 695282 - RNA, 22 nt, Homo sapiens
ucuucaggguguuaaggcagug

SEQ ID NO: 695283 - RNA, 20 nt, Homo sapiens
ucuucauuaccucagugaga

SEQ ID NO: 695284 - RNA, 12 nt, Homo sapiens
ucuuuaccuccu

SEQ ID NO: 695285 - RNA, 21 nt, Homo sapiens
ugaaacuucaucacacacuga

SEQ ID NO: 695286 - RNA, 16 nt, Homo sapiens
ugacauacauccaaca

SEQ ID NO: 695287 - RNA, 22 nt, Homo sapiens
ugaccucacuucuggcacugug

SEQ ID NO: 695288 - RNA, 15 nt, Homo sapiens
ugagcagguguucuu

SEQ ID NO: 695289 - RNA, 22 nt, Homo sapiens
ugagcuggggaugucucucaug

SEQ ID NO: 695290 - RNA, 16 nt, Homo sapiens
ugaggggcucucucau

SEQ ID NO: 695291 - RNA, 18 nt, Homo sapiens
ugaggggcucucucauga

SEQ ID NO: 695292 - RNA, 22 nt, Homo sapiens
ugagucucuaugaucuuggcac

SEQ ID NO: 695293 - RNA, 14 nt, Homo sapiens
ugaugaauuacuuc

SEQ ID NO: 695294 - RNA, 20 nt, Homo sapiens
ugcccaggcuggagugcagu

SEQ ID NO: 695295 - RNA, 21 nt, Homo sapiens
ugcuauuguagagccagaggu

SEQ ID NO: 695296 - RNA, 23 nt, Homo sapiens
ugcuuagcuugagggugacuaug

SEQ ID NO: 695297 - RNA, 17 nt, Homo sapiens
uggaacucuuuaucuca

SEQ ID NO: 695298 - RNA, 21 nt, Homo sapiens
uggagguuuguuuagaagaag

SEQ ID NO: 695299 - RNA, 14 nt, Homo sapiens
uggcccuaugcuuc

SEQ ID NO: 695300 - RNA, 12 nt, Homo sapiens
uggcugccuugu

SEQ ID NO: 695301 - RNA, 15 nt, Homo sapiens
uggggcugauuguau

SEQ ID NO: 695302 - RNA, 14 nt, Homo sapiens
ugggucaguuguau

SEQ ID NO: 695303 - RNA, 16 nt, Homo sapiens
ugguguugacauacau

SEQ ID NO: 695304 - RNA, 17 nt, Homo sapiens
uguacauuugagugucu

SEQ ID NO: 695305 - RNA, 20 nt, Homo sapiens
uguacuuuuggcaugaaagu

SEQ ID NO: 695306 - RNA, 18 nt, Homo sapiens
ugucccagaaugccuccu

SEQ ID NO: 695307 - RNA, 22 nt, Homo sapiens
ugucccucauccauagcaccuc

SEQ ID NO: 695308 - RNA, 15 nt, Homo sapiens
ugucucucaugacca

SEQ ID NO: 695309 - RNA, 12 nt, Homo sapiens
ugugacuacuau

SEQ ID NO: 695310 - RNA, 23 nt, Homo sapiens
ugugagugaccucacuucuggca

SEQ ID NO: 695311 - RNA, 16 nt, Homo sapiens
uguugcaaugacacau

SEQ ID NO: 695312 - RNA, 21 nt, Homo sapiens
uuaaaaugugagugaccucac

SEQ ID NO: 695313 - RNA, 21 nt, Homo sapiens
uuaacaauuaauuuucuauga

SEQ ID NO: 695314 - RNA, 21 nt, Homo sapiens
uuaaccugaauuauuccaacu

SEQ ID NO: 695315 - RNA, 21 nt, Homo sapiens
uuaacuuaaaagaacauguau

SEQ ID NO: 695316 - RNA, 16 nt, Homo sapiens
uuaccgagcacuguga

SEQ ID NO: 695317 - RNA, 23 nt, Homo sapiens
uuaugagucucuaugaucuuggc

SEQ ID NO: 695318 - RNA, 15 nt, Homo sapiens
uucagauuugccuua

SEQ ID NO: 695319 - RNA, 14 nt, Homo sapiens
uuccaacugccaga

SEQ ID NO: 695320 - RNA, 16 nt, Homo sapiens
uucgaauaaagugaau

SEQ ID NO: 695321 - RNA, 18 nt, Homo sapiens
uucgaauaaagugaauac

SEQ ID NO: 695322 - RNA, 16 nt, Homo sapiens
uugcacccaugccaua

SEQ ID NO: 695323 - RNA, 13 nt, Homo sapiens
uugccagagccuu

SEQ ID NO: 695324 - RNA, 18 nt, Homo sapiens
uugccaugucuuguucag

SEQ ID NO: 695325 - RNA, 21 nt, Homo sapiens
uugcccaggcuggagugcagu

SEQ ID NO: 695326 - RNA, 20 nt, Homo sapiens
uugccuuauuggcagcucua

SEQ ID NO: 695327 - RNA, 20 nt, Homo sapiens
uuggcuaucuacugagacau

SEQ ID NO: 695328 - RNA, 16 nt, Homo sapiens
uuggcucacugcaacu

SEQ ID NO: 695329 - RNA, 14 nt, Homo sapiens
uuuaaaauugugau

SEQ ID NO: 695330 - RNA, 14 nt, Homo sapiens
uuuaaccagcaaca

SEQ ID NO: 695331 - RNA, 11 nt, Homo sapiens
uuuaugguucu

SEQ ID NO: 695332 - RNA, 18 nt, Homo sapiens
uuucaaccgcuugccaua

SEQ ID NO: 695333 - RNA, 14 nt, Homo sapiens
uuuucucaugauga

SEQ ID NO: 695334 - RNA, 20 nt, Homo sapiens
uuuugagaauacacuaucaa

SEQ ID NO: 695335 - RNA, 21 nt, Homo sapiens
uuuugcacaaaguaagccuca

SEQ ID NO: 695336 - RNA, 22 nt, Homo sapiens
agcacuuuuaacaaaaaaggaa

SEQ ID NO: 695337 - RNA, 16 nt, Homo sapiens
agcaguggcuccauug

SEQ ID NO: 695338 - RNA, 17 nt, Homo sapiens
agccagaggucuggccc

SEQ ID NO: 695339 - RNA, 17 nt, Homo sapiens
agccuuggcucuacccu

SEQ ID NO: 695340 - RNA, 17 nt, Homo sapiens
agcugaacaaugaaugc

SEQ ID NO: 695341 - RNA, 22 nt, Homo sapiens
agcugcuuucgaauaaagugaa

SEQ ID NO: 695342 - RNA, 20 nt, Homo sapiens
agcuggcacugccacugugg

SEQ ID NO: 695343 - RNA, 19 nt, Homo sapiens
agcuggggaugucucucau

SEQ ID NO: 695344 - RNA, 23 nt, Homo sapiens
aggccagaaaacauaugcauuau

SEQ ID NO: 695345 - RNA, 23 nt, Homo sapiens
agggcagggcugaggccucucau

SEQ ID NO: 695346 - RNA, 15 nt, Homo sapiens
aggggcucucucaug

SEQ ID NO: 695347 - RNA, 14 nt, Homo sapiens
aggggucauucaug

SEQ ID NO: 695348 - RNA, 14 nt, Homo sapiens
agggugacuaugga

SEQ ID NO: 695349 - RNA, 21 nt, Homo sapiens
agguuuguuuagaagaagugu

SEQ ID NO: 695350 - RNA, 14 nt, Homo sapiens
agucucuaugaucu

SEQ ID NO: 695351 - RNA, 13 nt, Homo sapiens
agugagaagccag

SEQ ID NO: 695352 - RNA, 23 nt, Homo sapiens
agugcaguggugcgaucuuggcu

SEQ ID NO: 695353 - RNA, 12 nt, Homo sapiens
auaaagugaaua

SEQ ID NO: 695354 - RNA, 12 nt, Homo sapiens
auaaauaaccaa

SEQ ID NO: 695355 - RNA, 23 nt, Homo sapiens
auaagcagucauccucagaucau

SEQ ID NO: 695356 - RNA, 18 nt, Homo sapiens
auaaucacaacccuucag

SEQ ID NO: 695357 - RNA, 15 nt, Homo sapiens
auagcaccuccacau

SEQ ID NO: 695358 - RNA, 20 nt, Homo sapiens
auagcaccuccacauaccug

SEQ ID NO: 695359 - RNA, 21 nt, Homo sapiens
aucagucuuggaauacuugaa

SEQ ID NO: 695360 - RNA, 18 nt, Homo sapiens
aucgcugccuugccaugu

SEQ ID NO: 695361 - RNA, 15 nt, Homo sapiens
aucucuuuaccuccu

SEQ ID NO: 695362 - RNA, 19 nt, Homo sapiens
augaaucccauaauugaca

SEQ ID NO: 695363 - RNA, 20 nt, Homo sapiens
augacuuuaucauuuuguua

SEQ ID NO: 695364 - RNA, 15 nt, Homo sapiens
augcuugcauuauau

SEQ ID NO: 695365 - RNA, 11 nt, Homo sapiens
auggauuccac

SEQ ID NO: 695366 - RNA, 15 nt, Homo sapiens
auguaccagcaucuc

SEQ ID NO: 695367 - RNA, 14 nt, Homo sapiens
auguauggcaugug

SEQ ID NO: 695368 - RNA, 13 nt, Homo sapiens
augucucucauga

SEQ ID NO: 695369 - RNA, 16 nt, Homo sapiens
auguguguguguugug

SEQ ID NO: 695370 - RNA, 13 nt, Homo sapiens
auuauucccauga

SEQ ID NO: 695371 - RNA, 13 nt, Homo sapiens
auucacagcaagu

SEQ ID NO: 695372 - RNA, 20 nt, Homo sapiens
auucacagcaagucacuggc

SEQ ID NO: 695373 - RNA, 13 nt, Homo sapiens
auucuuccugcuu

SEQ ID NO: 695374 - RNA, 15 nt, Homo sapiens
auucuuugaccuguu

SEQ ID NO: 695375 - RNA, 14 nt, Homo sapiens
auugacccagaaau

SEQ ID NO: 695376 - RNA, 18 nt, Homo sapiens
auugacccagaaauguau

SEQ ID NO: 695377 - RNA, 21 nt, Homo sapiens
auuguauuuaccuucuaccuc

SEQ ID NO: 695378 - RNA, 10 nt, Homo sapiens
auugugaugu

SEQ ID NO: 695379 - RNA, 17 nt, Homo sapiens
auuuaccuucuaccucu

SEQ ID NO: 695380 - RNA, 19 nt, Homo sapiens
auuucaaccgcuugccaua

SEQ ID NO: 695381 - RNA, 19 nt, Homo sapiens
auuugcacccaugccauag

SEQ ID NO: 695382 - RNA, 13 nt, Homo sapiens
auuugcuaugagc

SEQ ID NO: 695383 - RNA, 22 nt, Homo sapiens
auuuucccuucgauauaugacu

SEQ ID NO: 695384 - RNA, 19 nt, Homo sapiens
caacugccagaacauggau

SEQ ID NO: 695385 - RNA, 19 nt, Homo sapiens
caccaucucuuuaccuccu

SEQ ID NO: 695386 - RNA, 14 nt, Homo sapiens
cacccaugccauag

SEQ ID NO: 695387 - RNA, 19 nt, Homo sapiens
cacccaugccauagaaacu

SEQ ID NO: 695388 - RNA, 11 nt, Homo sapiens
cacugcuguag

SEQ ID NO: 695389 - RNA, 22 nt, Homo sapiens
cacuguuuaacugggagugaua

SEQ ID NO: 695390 - RNA, 19 nt, Homo sapiens
cagauauuaaauaacagug

SEQ ID NO: 695391 - RNA, 15 nt, Homo sapiens
cagcuccacaguguu

SEQ ID NO: 695392 - RNA, 19 nt, Homo sapiens
cagcuccacaguguugcca

SEQ ID NO: 695393 - RNA, 13 nt, Homo sapiens
caggagucccugc

SEQ ID NO: 695394 - RNA, 18 nt, Homo sapiens
caggagucccugccauca

SEQ ID NO: 695395 - RNA, 14 nt, Homo sapiens
caggccagcuccac

SEQ ID NO: 695396 - RNA, 20 nt, Homo sapiens
caggccauugucccugaaga

SEQ ID NO: 695397 - RNA, 18 nt, Homo sapiens
cagggauucuuccugcuu

SEQ ID NO: 695398 - RNA, 21 nt, Homo sapiens
caggguuagcucacgugucuu

SEQ ID NO: 695399 - RNA, 19 nt, Homo sapiens
caguggcuggaucugugag

SEQ ID NO: 695400 - RNA, 18 nt, Homo sapiens
caguggugcgaucuuggc

SEQ ID NO: 695401 - RNA, 22 nt, Homo sapiens
cauaccuggcccugugccuugg

SEQ ID NO: 695402 - RNA, 13 nt, Homo sapiens
caucacacacuga

SEQ ID NO: 695403 - RNA, 23 nt, Homo sapiens
caucucuuuaccuccuaauucca

SEQ ID NO: 695404 - RNA, 15 nt, Homo sapiens
caugaugaauuacuu

SEQ ID NO: 695405 - RNA, 21 nt, Homo sapiens
cauuggaccuuuccugaggaa

SEQ ID NO: 695406 - RNA, 16 nt, Homo sapiens
ccacacccucacugcu

SEQ ID NO: 695407 - RNA, 14 nt, Homo sapiens
ccacauaccuggcc

SEQ ID NO: 695408 - RNA, 22 nt, Homo sapiens
ccagaacauggauuccacugaa

SEQ ID NO: 695409 - RNA, 17 nt, Homo sapiens
ccagcaacauugaccca

SEQ ID NO: 695410 - RNA, 14 nt, Homo sapiens
ccagcuuuccucau

SEQ ID NO: 695411 - RNA, 17 nt, Homo sapiens
ccagcuuuccucaucag

SEQ ID NO: 695412 - RNA, 19 nt, Homo sapiens
cccagaaauguauggcaug

SEQ ID NO: 695413 - RNA, 21 nt, Homo sapiens
ccuaaauguggacaucaugaa

SEQ ID NO: 695414 - RNA, 14 nt, Homo sapiens
ccucauccauagca

SEQ ID NO: 695415 - RNA, 18 nt, Homo sapiens
ccuccugucccucaucca

SEQ ID NO: 695416 - RNA, 12 nt, Homo sapiens
ccucucauucca

SEQ ID NO: 695417 - RNA, 15 nt, Homo sapiens
ccuuggugugcugua

SEQ ID NO: 695418 - RNA, 15 nt, Homo sapiens
ccuuuuaguucuuag

SEQ ID NO: 695419 - RNA, 13 nt, Homo sapiens
cgaauaaagugaa

SEQ ID NO: 695420 - RNA, 11 nt, Homo sapiens
cgaucuuggcu

SEQ ID NO: 695421 - RNA, 14 nt, Homo sapiens
cgcugccuugccau

SEQ ID NO: 695422 - RNA, 17 nt, Homo sapiens
cuacugagacaugacua

SEQ ID NO: 695423 - RNA, 23 nt, Homo sapiens
cuauuagagcugccugugccuuu

SEQ ID NO: 695424 - RNA, 15 nt, Homo sapiens
cucagaucauuauca

SEQ ID NO: 695425 - RNA, 22 nt, Homo sapiens
cuccauugguguugacauacau

SEQ ID NO: 695426 - RNA, 13 nt, Homo sapiens
cucucucaugaua

SEQ ID NO: 695427 - RNA, 13 nt, Homo sapiens
cucuuuaccuccu

SEQ ID NO: 695428 - RNA, 11 nt, Homo sapiens
aaaacauaugc

SEQ ID NO: 695429 - RNA, 22 nt, Homo sapiens
aaaacauaugcauuaugaaguu

SEQ ID NO: 695430 - RNA, 13 nt, Homo sapiens
aaaacaugacuuu

SEQ ID NO: 695431 - RNA, 15 nt, Homo sapiens
aaacguccacagagu

SEQ ID NO: 695432 - RNA, 21 nt, Homo sapiens
aaacuucaucacacacugaga

SEQ ID NO: 695433 - RNA, 20 nt, Homo sapiens
aaagcaguggcuccauuggu

SEQ ID NO: 695434 - RNA, 16 nt, Homo sapiens
aaaugcuuuuccucaa

SEQ ID NO: 695435 - RNA, 17 nt, Homo sapiens
aaauguggacaucauga

SEQ ID NO: 695436 - RNA, 13 nt, Homo sapiens
aaauuuaugugau

SEQ ID NO: 695437 - RNA, 16 nt, Homo sapiens
aacaugcuugcauuau

SEQ ID NO: 695438 - RNA, 18 nt, Homo sapiens
aacauggauuccacugaa

SEQ ID NO: 695439 - RNA, 21 nt, Homo sapiens
aacauugacccagaaauguau

SEQ ID NO: 695440 - RNA, 19 nt, Homo sapiens
aaccgcuugccauauuccg

SEQ ID NO: 695441 - RNA, 16 nt, Homo sapiens
aaccugaauuauucca

SEQ ID NO: 695442 - RNA, 18 nt, Homo sapiens
aacuccccuuguacucuu

SEQ ID NO: 695443 - RNA, 15 nt, Homo sapiens
aagaaagacuuauca

SEQ ID NO: 695444 - RNA, 15 nt, Homo sapiens
aagucacuggccagu

SEQ ID NO: 695445 - RNA, 20 nt, Homo sapiens
aagucacuggccaguggcug

SEQ ID NO: 695446 - RNA, 15 nt, Homo sapiens
aagugcgauaacuua

SEQ ID NO: 695447 - RNA, 14 nt, Homo sapiens
aauacauuuugcac

SEQ ID NO: 695448 - RNA, 17 nt, Homo sapiens
aauccuucucacuaaaa

SEQ ID NO: 695449 - RNA, 23 nt, Homo sapiens
aaucugagaggccacagugcaau

SEQ ID NO: 695450 - RNA, 17 nt, Homo sapiens
aauuaauuuucuaugaa

SEQ ID NO: 695451 - RNA, 15 nt, Homo sapiens
aauuaugagucucua

SEQ ID NO: 695452 - RNA, 21 nt, Homo sapiens
acacaggccagcuccacagug

SEQ ID NO: 695453 - RNA, 20 nt, Homo sapiens
acaccugaaaauuaugaguc

SEQ ID NO: 695454 - RNA, 17 nt, Homo sapiens
acagaaugaaucccaua

SEQ ID NO: 695455 - RNA, 21 nt, Homo sapiens
acaguguugccagagccuuaa

SEQ ID NO: 695456 - RNA, 22 nt, Homo sapiens
acauaccuggcccugugccuug

SEQ ID NO: 695457 - RNA, 23 nt, Homo sapiens
acauaccuggcccugugccuugg

SEQ ID NO: 695458 - RNA, 13 nt, Homo sapiens
acaugacuaggaa

SEQ ID NO: 695459 - RNA, 14 nt, Homo sapiens
acauggauuccacu

SEQ ID NO: 695460 - RNA, 12 nt, Homo sapiens
acauuuguucca

SEQ ID NO: 695461 - RNA, 13 nt, Homo sapiens
accaauuccucau

SEQ ID NO: 695462 - RNA, 20 nt, Homo sapiens
accauaaaaauccuucucac

SEQ ID NO: 695463 - RNA, 20 nt, Homo sapiens
accauuaaaaaguuggaguu

SEQ ID NO: 695464 - RNA, 15 nt, Homo sapiens
acccaugccauagaa

SEQ ID NO: 695465 - RNA, 14 nt, Homo sapiens
accgagcacuguga

SEQ ID NO: 695466 - RNA, 15 nt, Homo sapiens
accuccacauaccug

SEQ ID NO: 695467 - RNA, 20 nt, Homo sapiens
ucaguaaauauuaaccugaa

SEQ ID NO: 695468 - RNA, 11 nt, Homo sapiens
ucaguaugugg

SEQ ID NO: 695469 - RNA, 18 nt, Homo sapiens
ucagucuuuaaucugaga

SEQ ID NO: 695470 - RNA, 13 nt, Homo sapiens
ucauucaguacuu

SEQ ID NO: 695471 - RNA, 17 nt, Homo sapiens
uccacacccucacugcu

SEQ ID NO: 695472 - RNA, 17 nt, Homo sapiens
uccacaguguugccaga

SEQ ID NO: 695473 - RNA, 13 nt, Homo sapiens
uccccucccucag

SEQ ID NO: 695474 - RNA, 19 nt, Homo sapiens
ucccucaggccgaaggagg

SEQ ID NO: 695475 - RNA, 20 nt, Homo sapiens
ucccugaagagaagggcagg

SEQ ID NO: 695476 - RNA, 19 nt, Homo sapiens
ucccuucgauauaugacuu

SEQ ID NO: 695477 - RNA, 22 nt, Homo sapiens
uccucaaagggagagagugcua

SEQ ID NO: 695478 - RNA, 22 nt, Homo sapiens
uccuuagccuuugucccagaau

SEQ ID NO: 695479 - RNA, 21 nt, Homo sapiens
uccuuuccccucccucaggcc

SEQ ID NO: 695480 - RNA, 22 nt, Homo sapiens
ucgauauaugacuuuuucucag

SEQ ID NO: 695481 - RNA, 14 nt, Homo sapiens
ucuaugaucuuggc

SEQ ID NO: 695482 - RNA, 17 nt, Homo sapiens
ucucaugaccaaaugcu

SEQ ID NO: 695483 - RNA, 13 nt, Homo sapiens
ucucuaugaucuu

SEQ ID NO: 695484 - RNA, 18 nt, Homo sapiens
ucuuagcugaacaaugaa

SEQ ID NO: 695485 - RNA, 14 nt, Homo sapiens
ucuucauuaccuca

SEQ ID NO: 695486 - RNA, 22 nt, Homo sapiens
ucuuguuguggaggcugaaaag

SEQ ID NO: 695487 - RNA, 14 nt, Homo sapiens
ucuuuugucccaga

SEQ ID NO: 695488 - RNA, 13 nt, Homo sapiens
ugaaacuucauca

SEQ ID NO: 695489 - RNA, 16 nt, Homo sapiens
ugacucucagcagcua

SEQ ID NO: 695490 - RNA, 18 nt, Homo sapiens
ugagaagccagcuuuccu

SEQ ID NO: 695491 - RNA, 16 nt, Homo sapiens
ugagaccgaaucucac

SEQ ID NO: 695492 - RNA, 19 nt, Homo sapiens
ugagggugacuauggagcu

SEQ ID NO: 695493 - RNA, 20 nt, Homo sapiens
ugagggugacuauggagcug

SEQ ID NO: 695494 - RNA, 16 nt, Homo sapiens
ugaucuuggcacaaau

SEQ ID NO: 695495 - RNA, 16 nt, Homo sapiens
ugcaacuucuaccucc

SEQ ID NO: 695496 - RNA, 17 nt, Homo sapiens
ugccaugucuuguucag

SEQ ID NO: 695497 - RNA, 16 nt, Homo sapiens
ugccuugccaugucuu

SEQ ID NO: 695498 - RNA, 16 nt, Homo sapiens
ugccuuggugugcugu

SEQ ID NO: 695499 - RNA, 19 nt, Homo sapiens
ugcuauuguagagccagag

SEQ ID NO: 695500 - RNA, 18 nt, Homo sapiens
ugcuguagacauuugcua

SEQ ID NO: 695501 - RNA, 21 nt, Homo sapiens
ugcuguagacauuugcuauga

SEQ ID NO: 695502 - RNA, 18 nt, Homo sapiens
ugcuguauccauccaugg

SEQ ID NO: 695503 - RNA, 18 nt, Homo sapiens
uggagugcaguggugcga

SEQ ID NO: 695504 - RNA, 23 nt, Homo sapiens
uggcaugaaagugcgauaacuua

SEQ ID NO: 695505 - RNA, 14 nt, Homo sapiens
accuucuaccucuu

SEQ ID NO: 695506 - RNA, 21 nt, Homo sapiens
accuuugccuuccaacugcca

SEQ ID NO: 695507 - RNA, 12 nt, Homo sapiens
acgucauucagu

SEQ ID NO: 695508 - RNA, 14 nt, Homo sapiens
acucaggggucauu

SEQ ID NO: 695509 - RNA, 21 nt, Homo sapiens
acucuggagguuuguuuagaa

SEQ ID NO: 695510 - RNA, 18 nt, Homo sapiens
acugaaauagagugaauu

SEQ ID NO: 695511 - RNA, 17 nt, Homo sapiens
acugcugggcuuggcag

SEQ ID NO: 695512 - RNA, 20 nt, Homo sapiens
acuuacccuaaaacaugugu

SEQ ID NO: 695513 - RNA, 19 nt, Homo sapiens
acuucuggcacugugacua

SEQ ID NO: 695514 - RNA, 15 nt, Homo sapiens
acuuggcaucauuca

SEQ ID NO: 695515 - RNA, 19 nt, Homo sapiens
agaaacugaggccauuauu

SEQ ID NO: 695516 - RNA, 22 nt, Homo sapiens
agaaagguaaacaaacaaauaa

SEQ ID NO: 695517 - RNA, 13 nt, Homo sapiens
agaagccagcuuu

SEQ ID NO: 695518 - RNA, 15 nt, Homo sapiens
agaaggcuaugggga

SEQ ID NO: 695519 - RNA, 22 nt, Homo sapiens
agagugaauuauauuuccuuaa

SEQ ID NO: 695520 - RNA, 19 nt, Homo sapiens
agcaagucacuggccagug

SEQ ID NO: 695521 - RNA, 17 nt, Homo sapiens
agcacguguggccuguu

SEQ ID NO: 695522 - RNA, 13 nt, Homo sapiens
agcucuacucugg

SEQ ID NO: 695523 - RNA, 17 nt, Homo sapiens
aggccacagugcaauuu

SEQ ID NO: 695524 - RNA, 17 nt, Homo sapiens
aggccagcaccaucucu

SEQ ID NO: 695525 - RNA, 11 nt, Homo sapiens
agggaauuuaa

SEQ ID NO: 695526 - RNA, 18 nt, Homo sapiens
agggauuuggggcucaga

SEQ ID NO: 695527 - RNA, 13 nt, Homo sapiens
aggggucauucau

SEQ ID NO: 695528 - RNA, 20 nt, Homo sapiens
agguguucuucauuaccuca

SEQ ID NO: 695529 - RNA, 18 nt, Homo sapiens
agguucuuuaaaaugcca

SEQ ID NO: 695530 - RNA, 21 nt, Homo sapiens
aguaaggaacggcccuuuuag

SEQ ID NO: 695531 - RNA, 16 nt, Homo sapiens
acaaaaagcuucccca

SEQ ID NO: 695532 - RNA, 24 nt, Homo sapiens
acaaaggagagcuagcagcaggga

SEQ ID NO: 695533 - RNA, 13 nt, Homo sapiens
acaaagugccaaa

SEQ ID NO: 695534 - RNA, 16 nt, Homo sapiens
acaagcugcacccuca

SEQ ID NO: 695535 - RNA, 18 nt, Homo sapiens
acaaggcuuuaucucagg

SEQ ID NO: 695536 - RNA, 19 nt, Homo sapiens
acaaggcuuuaucucaggg

SEQ ID NO: 695537 - RNA, 14 nt, Homo sapiens
acaaguaguucugu

SEQ ID NO: 695538 - RNA, 16 nt, Homo sapiens
acaaguuggaauucac

SEQ ID NO: 695539 - RNA, 19 nt, Homo sapiens
acaaguuggaugcggccau

SEQ ID NO: 695540 - RNA, 23 nt, Homo sapiens
acaauacugggguuggacuguaa

SEQ ID NO: 695541 - RNA, 20 nt, Homo sapiens
acaauccaugaacagcauua

SEQ ID NO: 695542 - RNA, 18 nt, Homo sapiens
acaaucggcugcauugaa

SEQ ID NO: 695543 - RNA, 21 nt, Homo sapiens
acaaucggcugcauugaagau

SEQ ID NO: 695544 - RNA, 16 nt, Homo sapiens
acugucuuccucaaaa

SEQ ID NO: 695545 - RNA, 12 nt, Homo sapiens
acugugacugua

SEQ ID NO: 695546 - RNA, 15 nt, Homo sapiens
acugugucucaugga

SEQ ID NO: 695547 - RNA, 19 nt, Homo sapiens
acuuaaaugguaauaagca

SEQ ID NO: 695548 - RNA, 16 nt, Homo sapiens
acuuagguguggggga

SEQ ID NO: 695549 - RNA, 14 nt, Homo sapiens
acuuccagcauuua

SEQ ID NO: 695550 - RNA, 16 nt, Homo sapiens
acuucgaaaccuggga

SEQ ID NO: 695551 - RNA, 16 nt, Homo sapiens
acuugaagccaucuaa

SEQ ID NO: 695552 - RNA, 15 nt, Homo sapiens
acuuguagauuugau

SEQ ID NO: 695553 - RNA, 17 nt, Homo sapiens
acuuguuuuugcacaug

SEQ ID NO: 695554 - RNA, 17 nt, Homo sapiens
acuuuaaaagugaucua

SEQ ID NO: 695555 - RNA, 14 nt, Homo sapiens
acuuuaaaaugcca

SEQ ID NO: 695556 - RNA, 17 nt, Homo sapiens
acuuuguaaauucugau

SEQ ID NO: 695557 - RNA, 14 nt, Homo sapiens
acuuuuucccucac

SEQ ID NO: 695558 - RNA, 11 nt, Homo sapiens
agaaaaaccac

SEQ ID NO: 695559 - RNA, 14 nt, Homo sapiens
agaaaacugugauu

SEQ ID NO: 695560 - RNA, 12 nt, Homo sapiens
agaaaagauuau

SEQ ID NO: 695561 - RNA, 13 nt, Homo sapiens
agaaacaucucaa

SEQ ID NO: 695562 - RNA, 15 nt, Homo sapiens
agaaaccacuagaaa

SEQ ID NO: 695563 - RNA, 15 nt, Homo sapiens
agaaacuuauuucuc

SEQ ID NO: 695564 - RNA, 13 nt, Homo sapiens
agaaaggcucuau

SEQ ID NO: 695565 - RNA, 20 nt, Homo sapiens
agaaagucauagauuucuga

SEQ ID NO: 695566 - RNA, 16 nt, Homo sapiens
agaaaguggucuuaag

SEQ ID NO: 695567 - RNA, 23 nt, Homo sapiens
agaaauacaauuuuagauaucau

SEQ ID NO: 695568 - RNA, 16 nt, Homo sapiens
agaaauacaguacugu

SEQ ID NO: 695569 - RNA, 21 nt, Homo sapiens
agaaaugaggaggaugcuaaa

SEQ ID NO: 695570 - RNA, 18 nt, Homo sapiens
agaaaugaugauguggaa

SEQ ID NO: 695571 - RNA, 20 nt, Homo sapiens
agaaauggacuggagcucau

SEQ ID NO: 695572 - RNA, 13 nt, Homo sapiens
agaaauguauaaa

SEQ ID NO: 695573 - RNA, 22 nt, Homo sapiens
agaaauugacacaaguggaccu

SEQ ID NO: 695574 - RNA, 19 nt, Homo sapiens
agaacguuuuuuccucagu

SEQ ID NO: 695575 - RNA, 11 nt, Homo sapiens
agaacuacuuc

SEQ ID NO: 695576 - RNA, 15 nt, Homo sapiens
agaacucacuggggc

SEQ ID NO: 695577 - RNA, 14 nt, Homo sapiens
agaacuugaaugug

SEQ ID NO: 695578 - RNA, 13 nt, Homo sapiens
agaagcacuacac

SEQ ID NO: 695579 - RNA, 23 nt, Homo sapiens
agaagugcagaauuggggcacuu

SEQ ID NO: 695580 - RNA, 21 nt, Homo sapiens
agaaguuuggcugcugucaua

SEQ ID NO: 695581 - RNA, 22 nt, Homo sapiens
agaauacuauuuccaaacucau

SEQ ID NO: 695582 - RNA, 21 nt, Homo sapiens
agaauuauaauuaguuccuca

SEQ ID NO: 695583 - RNA, 23 nt, Homo sapiens
agaauuggggcacuuaaugguca

SEQ ID NO: 695584 - RNA, 17 nt, Homo sapiens
agacaauaaacccucag

SEQ ID NO: 695585 - RNA, 21 nt, Homo sapiens
agacaccuuggacauccuccu

SEQ ID NO: 695586 - RNA, 11 nt, Homo sapiens
agacauacucc

SEQ ID NO: 695587 - RNA, 22 nt, Homo sapiens
agaccacgcccguccugccugu

SEQ ID NO: 695588 - RNA, 13 nt, Homo sapiens
agaccagauuaaa

SEQ ID NO: 695589 - RNA, 20 nt, Homo sapiens
agaccauuuaucugggauua

SEQ ID NO: 695590 - RNA, 20 nt, Homo sapiens
agacccuccuauucuauaaa

SEQ ID NO: 695591 - RNA, 16 nt, Homo sapiens
agacucgacucugugc

SEQ ID NO: 695592 - RNA, 20 nt, Homo sapiens
agacugaccauauugugcuu

SEQ ID NO: 695593 - RNA, 17 nt, Homo sapiens
agacugguuuucugcca

SEQ ID NO: 695594 - RNA, 20 nt, Homo sapiens
agacuguggcuagugacaaa

SEQ ID NO: 695595 - RNA, 19 nt, Homo sapiens
agagaacucgcgcucagua

SEQ ID NO: 695596 - RNA, 21 nt, Homo sapiens
agagaaguuguaaaguaugua

SEQ ID NO: 695597 - RNA, 13 nt, Homo sapiens
agagacacuccaa

SEQ ID NO: 695598 - RNA, 16 nt, Homo sapiens
agagacagauaccucc

SEQ ID NO: 695599 - RNA, 19 nt, Homo sapiens
agagagccuggugcugcug

SEQ ID NO: 695600 - RNA, 13 nt, Homo sapiens
agagagcugccau

SEQ ID NO: 695601 - RNA, 13 nt, Homo sapiens
agagcccuugccu

SEQ ID NO: 695602 - RNA, 14 nt, Homo sapiens
agagcccuugccuc

SEQ ID NO: 695603 - RNA, 19 nt, Homo sapiens
agagcccuugccuccccau

SEQ ID NO: 695604 - RNA, 18 nt, Homo sapiens
agagccucuggcaucucu

SEQ ID NO: 695605 - RNA, 17 nt, Homo sapiens
agagccuggugcugcug

SEQ ID NO: 695606 - RNA, 19 nt, Homo sapiens
agagcgagacuccgucuca

SEQ ID NO: 695607 - RNA, 20 nt, Homo sapiens
agagcgagacuccgucucaa

SEQ ID NO: 695608 - RNA, 18 nt, Homo sapiens
agaggcugccccucucac

SEQ ID NO: 695609 - RNA, 16 nt, Homo sapiens
agagggaggucacugg

SEQ ID NO: 695610 - RNA, 18 nt, Homo sapiens
agagggaggucacuggaa

SEQ ID NO: 695611 - RNA, 23 nt, Homo sapiens
agaggugucacccaaaccggcag

SEQ ID NO: 695612 - RNA, 14 nt, Homo sapiens
agauagacaaucac

SEQ ID NO: 695613 - RNA, 22 nt, Homo sapiens
agaucacugccacacucuccau

SEQ ID NO: 695614 - RNA, 19 nt, Homo sapiens
agaucacuguuuagauuug

SEQ ID NO: 695615 - RNA, 18 nt, Homo sapiens
agaucgcgccacugcacu

SEQ ID NO: 695616 - RNA, 20 nt, Homo sapiens
agaugaacaugguguucaac

SEQ ID NO: 695617 - RNA, 13 nt, Homo sapiens
agauggucaucca

SEQ ID NO: 695618 - RNA, 12 nt, Homo sapiens
agauuaacaaca

SEQ ID NO: 695619 - RNA, 13 nt, Homo sapiens
agauucuaccaca

SEQ ID NO: 695620 - RNA, 22 nt, Homo sapiens
agauugugccacuucacuccag

SEQ ID NO: 695621 - RNA, 16 nt, Homo sapiens
agauuucaugccuggu

SEQ ID NO: 695622 - RNA, 19 nt, Homo sapiens
agauuuucugguucuacuu

SEQ ID NO: 695623 - RNA, 13 nt, Homo sapiens
agauuuuugcaau

SEQ ID NO: 695624 - RNA, 17 nt, Homo sapiens
agcaaaggaaacuuugc

SEQ ID NO: 695625 - RNA, 17 nt, Homo sapiens
agcaaauaaagaccuga

SEQ ID NO: 695626 - RNA, 16 nt, Homo sapiens
agcaaauuuucagcau

SEQ ID NO: 695627 - RNA, 22 nt, Homo sapiens
agcaagaucccauggguugugu

SEQ ID NO: 695628 - RNA, 14 nt, Homo sapiens
agcacaauuugcac

SEQ ID NO: 695629 - RNA, 16 nt, Homo sapiens
agcaccauaacuuugu

SEQ ID NO: 695630 - RNA, 17 nt, Homo sapiens
agcagagacaugacuca

SEQ ID NO: 695631 - RNA, 20 nt, Homo sapiens
agcagaggaccagggccuuu

SEQ ID NO: 695632 - RNA, 18 nt, Homo sapiens
agcagccaguucaaaaac

SEQ ID NO: 695633 - RNA, 14 nt, Homo sapiens
agcaggcacgggug

SEQ ID NO: 695634 - RNA, 23 nt, Homo sapiens
agcaguuacaaaaaccuucccca

SEQ ID NO: 695635 - RNA, 21 nt, Homo sapiens
agcauacuggcuucaccauca

SEQ ID NO: 695636 - RNA, 15 nt, Homo sapiens
agcauagaaaccacu

SEQ ID NO: 695637 - RNA, 18 nt, Homo sapiens
agcaucacuuaaaacacg

SEQ ID NO: 695638 - RNA, 20 nt, Homo sapiens
agccaaauauuaggcuuaaa

SEQ ID NO: 695639 - RNA, 19 nt, Homo sapiens
agccaagggaaaggggugc

SEQ ID NO: 695640 - RNA, 17 nt, Homo sapiens
agccaaguggggugcug

SEQ ID NO: 695641 - RNA, 21 nt, Homo sapiens
agccaaguuuuauaauccuua

SEQ ID NO: 695642 - RNA, 17 nt, Homo sapiens
agccaauucacaaguua

SEQ ID NO: 695643 - RNA, 23 nt, Homo sapiens
agccagcuuggggccaccaaagc

SEQ ID NO: 695644 - RNA, 18 nt, Homo sapiens
agccaguuaaaauguguu

SEQ ID NO: 695645 - RNA, 14 nt, Homo sapiens
agccaugccagcug

SEQ ID NO: 695646 - RNA, 20 nt, Homo sapiens
agcccaaucugccagacuua

SEQ ID NO: 695647 - RNA, 13 nt, Homo sapiens
agcccaccccuca

SEQ ID NO: 695648 - RNA, 17 nt, Homo sapiens
agcccacccugcugcug

SEQ ID NO: 695649 - RNA, 15 nt, Homo sapiens
agcccaggagccuca

SEQ ID NO: 695650 - RNA, 17 nt, Homo sapiens
agcccaggagccucacu

SEQ ID NO: 695651 - RNA, 20 nt, Homo sapiens
agcccauuucuccauacgca

SEQ ID NO: 695652 - RNA, 18 nt, Homo sapiens
agcccuaaccccuuccag

SEQ ID NO: 695653 - RNA, 13 nt, Homo sapiens
agcccuaaucuca

SEQ ID NO: 695654 - RNA, 16 nt, Homo sapiens
agccgaggccuacccc

SEQ ID NO: 695655 - RNA, 23 nt, Homo sapiens
agccggggaagagauccaaagac

SEQ ID NO: 695656 - RNA, 19 nt, Homo sapiens
agccuaacaugauuauuug

SEQ ID NO: 695657 - RNA, 16 nt, Homo sapiens
agccuagcacagcagc

SEQ ID NO: 695658 - RNA, 18 nt, Homo sapiens
agccucagcccccugcuu

SEQ ID NO: 695659 - RNA, 17 nt, Homo sapiens
agccuccccgugccaaa

SEQ ID NO: 695660 - RNA, 20 nt, Homo sapiens
agccuccccgugccaaaaau

SEQ ID NO: 695661 - RNA, 16 nt, Homo sapiens
agccucugaaaaccaa

SEQ ID NO: 695662 - RNA, 21 nt, Homo sapiens
agccugagcagagacaugacu

SEQ ID NO: 695663 - RNA, 12 nt, Homo sapiens
agccugcacagu

SEQ ID NO: 695664 - RNA, 13 nt, Homo sapiens
agccugcagggaa

SEQ ID NO: 695665 - RNA, 16 nt, Homo sapiens
agccuggacugcuacc

SEQ ID NO: 695666 - RNA, 15 nt, Homo sapiens
agccuggugcugcug

SEQ ID NO: 695667 - RNA, 16 nt, Homo sapiens
agccuggugcugcugc

SEQ ID NO: 695668 - RNA, 21 nt, Homo sapiens
agccuuuuuaaaacacauguu

SEQ ID NO: 695669 - RNA, 17 nt, Homo sapiens
agcgcuuuuccuuggca

SEQ ID NO: 695670 - RNA, 16 nt, Homo sapiens
agcgugugacuacucc

SEQ ID NO: 695671 - RNA, 19 nt, Homo sapiens
agcuaccccggccggccac

SEQ ID NO: 695672 - RNA, 17 nt, Homo sapiens
agcuacuagcaaaauaa

SEQ ID NO: 695673 - RNA, 20 nt, Homo sapiens
agcuaguugaauacuugaac

SEQ ID NO: 695674 - RNA, 19 nt, Homo sapiens
agcuaugacuuaacauagc

SEQ ID NO: 695675 - RNA, 14 nt, Homo sapiens
agcugaacaauagg

SEQ ID NO: 695676 - RNA, 16 nt, Homo sapiens
agcugaagaauugaaa

SEQ ID NO: 695677 - RNA, 16 nt, Homo sapiens
agcugagaucgugcua

SEQ ID NO: 695678 - RNA, 20 nt, Homo sapiens
agcugagaucgugcuacugc

SEQ ID NO: 695679 - RNA, 23 nt, Homo sapiens
agcugaucugcggaucucagcuu

SEQ ID NO: 695680 - RNA, 19 nt, Homo sapiens
agcugccuucccuagcuuu

SEQ ID NO: 695681 - RNA, 22 nt, Homo sapiens
agcugccuuggcucagacaugu

SEQ ID NO: 695682 - RNA, 16 nt, Homo sapiens
agcuggccucucuagc

SEQ ID NO: 695683 - RNA, 20 nt, Homo sapiens
agcugggcccgacauggcuc

SEQ ID NO: 695684 - RNA, 13 nt, Homo sapiens
agcugugcucaga

SEQ ID NO: 695685 - RNA, 17 nt, Homo sapiens
agcuguuccuguucagu

SEQ ID NO: 695686 - RNA, 12 nt, Homo sapiens
agcuuaucucag

SEQ ID NO: 695687 - RNA, 21 nt, Homo sapiens
agcuucauauaccagcaauau

SEQ ID NO: 695688 - RNA, 16 nt, Homo sapiens
agcuuugaaaauucag

SEQ ID NO: 695689 - RNA, 19 nt, Homo sapiens
aggaaaaacacaagcaaaa

SEQ ID NO: 695690 - RNA, 17 nt, Homo sapiens
aggaaaaggcugguaca

SEQ ID NO: 695691 - RNA, 13 nt, Homo sapiens
aggaaagugauuu

SEQ ID NO: 695692 - RNA, 14 nt, Homo sapiens
aggaacacugcacu

SEQ ID NO: 695693 - RNA, 16 nt, Homo sapiens
aggaacacugcacucu

SEQ ID NO: 695694 - RNA, 17 nt, Homo sapiens
aggaacugcaggucaag

SEQ ID NO: 695695 - RNA, 11 nt, Homo sapiens
aggaagcccag

SEQ ID NO: 695696 - RNA, 21 nt, Homo sapiens
aggaauccuggcagcccagag

SEQ ID NO: 695697 - RNA, 23 nt, Homo sapiens
aggaauccuggcagcccagagac

SEQ ID NO: 695698 - RNA, 15 nt, Homo sapiens
aggaccuuuccacca

SEQ ID NO: 695699 - RNA, 18 nt, Homo sapiens
aggacggacucacuucuc

SEQ ID NO: 695700 - RNA, 20 nt, Homo sapiens
aggagagcuagcagcaggga

SEQ ID NO: 695701 - RNA, 18 nt, Homo sapiens
aggagaggggcacagggu

SEQ ID NO: 695702 - RNA, 16 nt, Homo sapiens
aggagccucacugggg

SEQ ID NO: 695703 - RNA, 17 nt, Homo sapiens
aggagccucacuggggc

SEQ ID NO: 695704 - RNA, 18 nt, Homo sapiens
aggaggcgcccuuggcuu

SEQ ID NO: 695705 - RNA, 18 nt, Homo sapiens
aggaugcuaaaaauguca

SEQ ID NO: 695706 - RNA, 14 nt, Homo sapiens
aggauggcaaagag

SEQ ID NO: 695707 - RNA, 18 nt, Homo sapiens
aggauggcaaagagaguc

SEQ ID NO: 695708 - RNA, 22 nt, Homo sapiens
aggauugaaaauguccaggaaa

SEQ ID NO: 695709 - RNA, 14 nt, Homo sapiens
aggauuguggucac

SEQ ID NO: 695710 - RNA, 21 nt, Homo sapiens
aggcaacugugaguccgggaa

SEQ ID NO: 695711 - RNA, 19 nt, Homo sapiens
aggcaaggcuaugugauua

SEQ ID NO: 695712 - RNA, 19 nt, Homo sapiens
aggcaccuuuuacugugau

SEQ ID NO: 695713 - RNA, 17 nt, Homo sapiens
aggcaggagaauggugu

SEQ ID NO: 695714 - RNA, 20 nt, Homo sapiens
aggcaggaggaucacuugag

SEQ ID NO: 695715 - RNA, 18 nt, Homo sapiens
aggcauuuucaucuuucc

SEQ ID NO: 695716 - RNA, 15 nt, Homo sapiens
aggccaagaauauug

SEQ ID NO: 695717 - RNA, 18 nt, Homo sapiens
aggcgcugagacugugcu

SEQ ID NO: 695718 - RNA, 19 nt, Homo sapiens
aggcgcugagacugugcug

SEQ ID NO: 695719 - RNA, 15 nt, Homo sapiens
aggcuccugccugag

SEQ ID NO: 695720 - RNA, 16 nt, Homo sapiens
aggcugccccucucac

SEQ ID NO: 695721 - RNA, 12 nt, Homo sapiens
aggcugggccau

SEQ ID NO: 695722 - RNA, 10 nt, Homo sapiens
aggcuuccug

SEQ ID NO: 695723 - RNA, 13 nt, Homo sapiens
aggcuuugccauu

SEQ ID NO: 695724 - RNA, 14 nt, Homo sapiens
aggcuuugccauug

SEQ ID NO: 695725 - RNA, 13 nt, Homo sapiens
agggaaaaaccag

SEQ ID NO: 695726 - RNA, 16 nt, Homo sapiens
agggaauacugugcau

SEQ ID NO: 695727 - RNA, 14 nt, Homo sapiens
agggaggucacugg

SEQ ID NO: 695728 - RNA, 15 nt, Homo sapiens
aggggagacuuugau

SEQ ID NO: 695729 - RNA, 18 nt, Homo sapiens
aggggcaacuguaugaaa

SEQ ID NO: 695730 - RNA, 17 nt, Homo sapiens
agggggugggauuccac

SEQ ID NO: 695731 - RNA, 13 nt, Homo sapiens
agggguuccucaa

SEQ ID NO: 695732 - RNA, 18 nt, Homo sapiens
agguagaagugagcaaaa

SEQ ID NO: 695733 - RNA, 12 nt, Homo sapiens
aggucacuggaa

SEQ ID NO: 695734 - RNA, 12 nt, Homo sapiens
aggucaggagau

SEQ ID NO: 695735 - RNA, 15 nt, Homo sapiens
aggugagaaaaccau

SEQ ID NO: 695736 - RNA, 17 nt, Homo sapiens
aggugagaaaaccaugg

SEQ ID NO: 695737 - RNA, 19 nt, Homo sapiens
aggugaguuugagcugccu

SEQ ID NO: 695738 - RNA, 20 nt, Homo sapiens
aggugggaggaucucuugag

SEQ ID NO: 695739 - RNA, 20 nt, Homo sapiens
aggugggccagucuguggau

SEQ ID NO: 695740 - RNA, 16 nt, Homo sapiens
agguucaguauuaugu

SEQ ID NO: 695741 - RNA, 17 nt, Homo sapiens
agguuucccccugucuc

SEQ ID NO: 695742 - RNA, 23 nt, Homo sapiens
aguaacugugagaacccaguuuc

SEQ ID NO: 695743 - RNA, 16 nt, Homo sapiens
aguaagaauaccacau

SEQ ID NO: 695744 - RNA, 17 nt, Homo sapiens
aguaaucaucuaaguca

SEQ ID NO: 695745 - RNA, 23 nt, Homo sapiens
aguaaucuuguugguucaccauu

SEQ ID NO: 695746 - RNA, 21 nt, Homo sapiens
aguaaucuuuggcuguaaggc

SEQ ID NO: 695747 - RNA, 17 nt, Homo sapiens
aguaugguaaucuuuac

SEQ ID NO: 695748 - RNA, 14 nt, Homo sapiens
aguauguaugugua

SEQ ID NO: 695749 - RNA, 12 nt, Homo sapiens
aguauuaauauc

SEQ ID NO: 695750 - RNA, 19 nt, Homo sapiens
aguauuagaugcacuuaag

SEQ ID NO: 695751 - RNA, 21 nt, Homo sapiens
agucaaauuuguaaaucuuau

SEQ ID NO: 695752 - RNA, 15 nt, Homo sapiens
agucagagacagaua

SEQ ID NO: 695753 - RNA, 16 nt, Homo sapiens
agucagagacagauac

SEQ ID NO: 695754 - RNA, 21 nt, Homo sapiens
agucagagacagauaccucca

SEQ ID NO: 695755 - RNA, 23 nt, Homo sapiens
agucauucagcagcaaauuuuca

SEQ ID NO: 695756 - RNA, 15 nt, Homo sapiens
agucccagcuacuug

SEQ ID NO: 695757 - RNA, 16 nt, Homo sapiens
agucccucugcucuca

SEQ ID NO: 695758 - RNA, 23 nt, Homo sapiens
aguccuugauuucaaaguuuugu

SEQ ID NO: 695759 - RNA, 16 nt, Homo sapiens
agucucuagguucuga

SEQ ID NO: 695760 - RNA, 14 nt, Homo sapiens
agucugaugacaca

SEQ ID NO: 695761 - RNA, 13 nt, Homo sapiens
agucuucuguaua

SEQ ID NO: 695762 - RNA, 13 nt, Homo sapiens
agucuuugccagu

SEQ ID NO: 695763 - RNA, 13 nt, Homo sapiens
agugaaccuuuag

SEQ ID NO: 695764 - RNA, 13 nt, Homo sapiens
agugagacccugu

SEQ ID NO: 695765 - RNA, 21 nt, Homo sapiens
agugaggcugcacccacccag

SEQ ID NO: 695766 - RNA, 17 nt, Homo sapiens
agugagucauaucuuaa

SEQ ID NO: 695767 - RNA, 16 nt, Homo sapiens
agugcccuuccugcug

SEQ ID NO: 695768 - RNA, 22 nt, Homo sapiens
agugccucaagaggaaugaaaa

SEQ ID NO: 695769 - RNA, 19 nt, Homo sapiens
agugcugaaggaauggaag

SEQ ID NO: 695770 - RNA, 19 nt, Homo sapiens
gaacacuaacucaccagcc

SEQ ID NO: 695771 - RNA, 12 nt, Homo sapiens
gaacacuugaag

SEQ ID NO: 695772 - RNA, 16 nt, Homo sapiens
gaacauacuguucacu

SEQ ID NO: 695773 - RNA, 17 nt, Homo sapiens
gaacauccaaccuuccc

SEQ ID NO: 695774 - RNA, 14 nt, Homo sapiens
gaacaugaaucaaa

SEQ ID NO: 695775 - RNA, 21 nt, Homo sapiens
gaaccaaaucuggaagccaaa

SEQ ID NO: 695776 - RNA, 12 nt, Homo sapiens
gaaccauaucaa

SEQ ID NO: 695777 - RNA, 19 nt, Homo sapiens
gaaccccacgcccugucua

SEQ ID NO: 695778 - RNA, 13 nt, Homo sapiens
gaacuacuaaagu

SEQ ID NO: 695779 - RNA, 17 nt, Homo sapiens
gaacuauauuaguaugu

SEQ ID NO: 695780 - RNA, 22 nt, Homo sapiens
gaacucagagaugaacaucuaa

SEQ ID NO: 695781 - RNA, 23 nt, Homo sapiens
gaacuggaaaccaggaacucugg

SEQ ID NO: 695782 - RNA, 13 nt, Homo sapiens
gaacugucuguga

SEQ ID NO: 695783 - RNA, 17 nt, Homo sapiens
gaacuuaauaacugugu

SEQ ID NO: 695784 - RNA, 22 nt, Homo sapiens
gaacuugccuuaaacacucacc

SEQ ID NO: 695785 - RNA, 13 nt, Homo sapiens
gaagaacaggccu

SEQ ID NO: 695786 - RNA, 13 nt, Homo sapiens
gaagacaauguga

SEQ ID NO: 695787 - RNA, 23 nt, Homo sapiens
gaagagccuugcggaagguucua

SEQ ID NO: 695788 - RNA, 23 nt, Homo sapiens
gaagauacuuuguauuguccuau

SEQ ID NO: 695789 - RNA, 21 nt, Homo sapiens
gaagcugcaggcuuugccauu

SEQ ID NO: 695790 - RNA, 15 nt, Homo sapiens
gaagggguuccucaa

SEQ ID NO: 695791 - RNA, 14 nt, Homo sapiens
gaaguauguauauu

SEQ ID NO: 695792 - RNA, 20 nt, Homo sapiens
gaagucuucucugccuguaa

SEQ ID NO: 695793 - RNA, 23 nt, Homo sapiens
gaagugugaggcggcccugacca

SEQ ID NO: 695794 - RNA, 15 nt, Homo sapiens
gaaguuaagaaccug

SEQ ID NO: 695795 - RNA, 18 nt, Homo sapiens
gaauaaaucaaauauucc

SEQ ID NO: 695796 - RNA, 14 nt, Homo sapiens
gaauacauuuccaa

SEQ ID NO: 695797 - RNA, 17 nt, Homo sapiens
gaauacuaaauuauagu

SEQ ID NO: 695798 - RNA, 22 nt, Homo sapiens
gaauauauuugugugugugaua

SEQ ID NO: 695799 - RNA, 20 nt, Homo sapiens
gaaucaggaauauuuuccaa

SEQ ID NO: 695800 - RNA, 17 nt, Homo sapiens
gaauccuuccauuccac

SEQ ID NO: 695801 - RNA, 20 nt, Homo sapiens
gaauccuuccauuccacaca

SEQ ID NO: 695802 - RNA, 15 nt, Homo sapiens
gaaucucugugccuu

SEQ ID NO: 695803 - RNA, 15 nt, Homo sapiens
gaaugaaagacugaa

SEQ ID NO: 695804 - RNA, 14 nt, Homo sapiens
gaaugaacacuccc

SEQ ID NO: 695805 - RNA, 18 nt, Homo sapiens
gaaugcaacuccauuuac

SEQ ID NO: 695806 - RNA, 17 nt, Homo sapiens
gaauuauauguucagau

SEQ ID NO: 695807 - RNA, 16 nt, Homo sapiens
gaauuauugacacuga

SEQ ID NO: 695808 - RNA, 14 nt, Homo sapiens
gaauuccagcaaaa

SEQ ID NO: 695809 - RNA, 23 nt, Homo sapiens
gaauugucuuuggugcuuuucac

SEQ ID NO: 695810 - RNA, 13 nt, Homo sapiens
gacaaagugccaa

SEQ ID NO: 695811 - RNA, 15 nt, Homo sapiens
gacaaagugccaaag

SEQ ID NO: 695812 - RNA, 13 nt, Homo sapiens
gacaacugugacu

SEQ ID NO: 695813 - RNA, 22 nt, Homo sapiens
gacaagagaugggaaugaggug

SEQ ID NO: 695814 - RNA, 14 nt, Homo sapiens
gacaauacuggggu

SEQ ID NO: 695815 - RNA, 18 nt, Homo sapiens
gacaaucacuacaaguca

SEQ ID NO: 695816 - RNA, 15 nt, Homo sapiens
gacacauacauguca

SEQ ID NO: 695817 - RNA, 17 nt, Homo sapiens
gacacauacaugucaca

SEQ ID NO: 695818 - RNA, 21 nt, Homo sapiens
gacacugaaaguuuuguaaaa

SEQ ID NO: 695819 - RNA, 23 nt, Homo sapiens
gacagaaggugccacuuuaccca

SEQ ID NO: 695820 - RNA, 15 nt, Homo sapiens
gacagagcaagugag

SEQ ID NO: 695821 - RNA, 16 nt, Homo sapiens
gacagauugccuguuu

SEQ ID NO: 695822 - RNA, 15 nt, Homo sapiens
gacaggcaggugauc

SEQ ID NO: 695823 - RNA, 15 nt, Homo sapiens
gacagugaggcugca

SEQ ID NO: 695824 - RNA, 23 nt, Homo sapiens
gaccaaacuggauagaaccacca

SEQ ID NO: 695825 - RNA, 15 nt, Homo sapiens
gaccaccacuucgaa

SEQ ID NO: 695826 - RNA, 21 nt, Homo sapiens
gaccaugcucaucugcugguc

SEQ ID NO: 695827 - RNA, 23 nt, Homo sapiens
gacccacggagcccuuaugacau

SEQ ID NO: 695828 - RNA, 12 nt, Homo sapiens
gacccaggaaag

SEQ ID NO: 695829 - RNA, 20 nt, Homo sapiens
gacccuuuggggguugaaua

SEQ ID NO: 695830 - RNA, 18 nt, Homo sapiens
gaccuaguauaucaguga

SEQ ID NO: 695831 - RNA, 13 nt, Homo sapiens
gaccuauuuccag

SEQ ID NO: 695832 - RNA, 12 nt, Homo sapiens
gaccuguguucc

SEQ ID NO: 695833 - RNA, 13 nt, Homo sapiens
gaccuuaagacag

SEQ ID NO: 695834 - RNA, 19 nt, Homo sapiens
gacgaggggugucuugggc

SEQ ID NO: 695835 - RNA, 21 nt, Homo sapiens
gacgccacucauuucaucuca

SEQ ID NO: 695836 - RNA, 19 nt, Homo sapiens
gacgucagacuuggcucag

SEQ ID NO: 695837 - RNA, 16 nt, Homo sapiens
gacuccgucucaaaaa

SEQ ID NO: 695838 - RNA, 20 nt, Homo sapiens
gacucuggguccuuccugaa

SEQ ID NO: 695839 - RNA, 14 nt, Homo sapiens
gacugcuaccuuuc

SEQ ID NO: 695840 - RNA, 13 nt, Homo sapiens
gacuggugcugca

SEQ ID NO: 695841 - RNA, 16 nt, Homo sapiens
gacugguuuucugcca

SEQ ID NO: 695842 - RNA, 18 nt, Homo sapiens
gacuuaacauagccaaaa

SEQ ID NO: 695843 - RNA, 19 nt, Homo sapiens
gacuuccgagcuaugucag

SEQ ID NO: 695844 - RNA, 16 nt, Homo sapiens
gacuucuaccugcccu

SEQ ID NO: 695845 - RNA, 23 nt, Homo sapiens
gagaaaaaauauuuuccugccag

SEQ ID NO: 695846 - RNA, 20 nt, Homo sapiens
gagaauauacaugaagaaua

SEQ ID NO: 695847 - RNA, 11 nt, Homo sapiens
gagacacucca

SEQ ID NO: 695848 - RNA, 17 nt, Homo sapiens
gagacagauaccuccaa

SEQ ID NO: 695849 - RNA, 15 nt, Homo sapiens
gagacaggcagguga

SEQ ID NO: 695850 - RNA, 14 nt, Homo sapiens
gagacgccauguga

SEQ ID NO: 695851 - RNA, 18 nt, Homo sapiens
gagacgguguuuugccau

SEQ ID NO: 695852 - RNA, 14 nt, Homo sapiens
gagacuccgucuca

SEQ ID NO: 695853 - RNA, 16 nt, Homo sapiens
gagaggcaggcauaga

SEQ ID NO: 695854 - RNA, 22 nt, Homo sapiens
gagagucgcaucucagugcagg

SEQ ID NO: 695855 - RNA, 21 nt, Homo sapiens
gagaucgcgccacugcacucc

SEQ ID NO: 695856 - RNA, 17 nt, Homo sapiens
gagauugugccacuuca

SEQ ID NO: 695857 - RNA, 23 nt, Homo sapiens
gagcaaacuaacuugacuuuuaa

SEQ ID NO: 695858 - RNA, 20 nt, Homo sapiens
gagcaaaucaauucuaguca

SEQ ID NO: 695859 - RNA, 23 nt, Homo sapiens
gagcacaauuucccuucauacuc

SEQ ID NO: 695860 - RNA, 15 nt, Homo sapiens
gagccaaaaucucaa

SEQ ID NO: 695861 - RNA, 15 nt, Homo sapiens
gagcccauccagucu

SEQ ID NO: 695862 - RNA, 16 nt, Homo sapiens
gagccuggcaagaaug

SEQ ID NO: 695863 - RNA, 15 nt, Homo sapiens
gagccuuuaccuuuu

SEQ ID NO: 695864 - RNA, 20 nt, Homo sapiens
gagcuggccucucuagcaca

SEQ ID NO: 695865 - RNA, 22 nt, Homo sapiens
gagcuggccucucuagcacaau

SEQ ID NO: 695866 - RNA, 18 nt, Homo sapiens
gagcuucauauaccagca

SEQ ID NO: 695867 - RNA, 13 nt, Homo sapiens
gaggaaagauuca

SEQ ID NO: 695868 - RNA, 23 nt, Homo sapiens
gaggcagcgugaaagcagaugag

SEQ ID NO: 695869 - RNA, 20 nt, Homo sapiens
gaggcaggagaauggcguga

SEQ ID NO: 695870 - RNA, 12 nt, Homo sapiens
gaggcaggugag

SEQ ID NO: 695871 - RNA, 15 nt, Homo sapiens
gaggccgaggccaug

SEQ ID NO: 695872 - RNA, 15 nt, Homo sapiens
gaggccucgacccac

SEQ ID NO: 695873 - RNA, 18 nt, Homo sapiens
gaggcugccccucucacc

SEQ ID NO: 695874 - RNA, 20 nt, Homo sapiens
gaggcugccccucucaccaa

SEQ ID NO: 695875 - RNA, 21 nt, Homo sapiens
gagggaagaaugaacacuccc

SEQ ID NO: 695876 - RNA, 20 nt, Homo sapiens
gagggcugcaguucuacuca

SEQ ID NO: 695877 - RNA, 22 nt, Homo sapiens
gagggcuuccucuagaagccaa

SEQ ID NO: 695878 - RNA, 20 nt, Homo sapiens
gagguggggcuggaugucuc

SEQ ID NO: 695879 - RNA, 15 nt, Homo sapiens
gaguagaaaauguga

SEQ ID NO: 695880 - RNA, 22 nt, Homo sapiens
gaguauacaaacauuuaagcug

SEQ ID NO: 695881 - RNA, 19 nt, Homo sapiens
gaguugaucaaaaucaauu

SEQ ID NO: 695882 - RNA, 22 nt, Homo sapiens
gaguugauuuccucccucugcc

SEQ ID NO: 695883 - RNA, 20 nt, Homo sapiens
gauacaaugaacacuuauaa

SEQ ID NO: 695884 - RNA, 16 nt, Homo sapiens
gauacauguaauucua

SEQ ID NO: 695885 - RNA, 12 nt, Homo sapiens
gauacauuucau

SEQ ID NO: 695886 - RNA, 12 nt, Homo sapiens
gauaccuccaac

SEQ ID NO: 695887 - RNA, 19 nt, Homo sapiens
gauagaaccaccauaguga

SEQ ID NO: 695888 - RNA, 18 nt, Homo sapiens
gauagacagguccugauu

SEQ ID NO: 695889 - RNA, 20 nt, Homo sapiens
gauauuggggccaugaguaa

SEQ ID NO: 695890 - RNA, 23 nt, Homo sapiens
gaucacagccucugaaaaccaau

SEQ ID NO: 695891 - RNA, 14 nt, Homo sapiens
gaucacugccacac

SEQ ID NO: 695892 - RNA, 16 nt, Homo sapiens
gaucaucuuuccuguu

SEQ ID NO: 695893 - RNA, 12 nt, Homo sapiens
gaucccugacau

SEQ ID NO: 695894 - RNA, 19 nt, Homo sapiens
gauccuccaacagcuguca

SEQ ID NO: 695895 - RNA, 18 nt, Homo sapiens
gauccuuagagguccucu

SEQ ID NO: 695896 - RNA, 14 nt, Homo sapiens
gaucuaauuuacau

SEQ ID NO: 695897 - RNA, 13 nt, Homo sapiens
gaucuaccagcau

SEQ ID NO: 695898 - RNA, 18 nt, Homo sapiens
gaucuuuguauauuacau

SEQ ID NO: 695899 - RNA, 14 nt, Homo sapiens
gaugaacaucuaac

SEQ ID NO: 695900 - RNA, 16 nt, Homo sapiens
gaugauaaaacacaaa

SEQ ID NO: 695901 - RNA, 17 nt, Homo sapiens
gaugugauuaaagcuaa

SEQ ID NO: 695902 - RNA, 19 nt, Homo sapiens
gauguuuacagacugugag

SEQ ID NO: 695903 - RNA, 15 nt, Homo sapiens
gauuaaauacauaug

SEQ ID NO: 695904 - RNA, 17 nt, Homo sapiens
gauuaacaacaggaaau

SEQ ID NO: 695905 - RNA, 22 nt, Homo sapiens
gauuauuagccagguaauguga

SEQ ID NO: 695906 - RNA, 12 nt, Homo sapiens
gauuauuugaac

SEQ ID NO: 695907 - RNA, 12 nt, Homo sapiens
gauuauuugcau

SEQ ID NO: 695908 - RNA, 22 nt, Homo sapiens
gauucaugauuuauaaaugcca

SEQ ID NO: 695909 - RNA, 20 nt, Homo sapiens
gauuccacacugcacuguua

SEQ ID NO: 695910 - RNA, 16 nt, Homo sapiens
gauugaaucugaacca

SEQ ID NO: 695911 - RNA, 16 nt, Homo sapiens
gauuuaaucugccaag

SEQ ID NO: 695912 - RNA, 15 nt, Homo sapiens
gauuuggugaccaac

SEQ ID NO: 695913 - RNA, 19 nt, Homo sapiens
gauuuuuuaauuguuuaaa

SEQ ID NO: 695914 - RNA, 12 nt, Homo sapiens
gcaaaagucauu

SEQ ID NO: 695915 - RNA, 16 nt, Homo sapiens
gcaaaagucauuacac

SEQ ID NO: 695916 - RNA, 21 nt, Homo sapiens
gcaaacaggguuugauagcac

SEQ ID NO: 695917 - RNA, 22 nt, Homo sapiens
gcaaagaccgauugcauaggaa

SEQ ID NO: 695918 - RNA, 11 nt, Homo sapiens
gcaaagccaaa

SEQ ID NO: 695919 - RNA, 15 nt, Homo sapiens
gcaaaugcaaaaacu

SEQ ID NO: 695920 - RNA, 15 nt, Homo sapiens
gcaacuccauuuacc

SEQ ID NO: 695921 - RNA, 17 nt, Homo sapiens
gcaauacagacuacuuc

SEQ ID NO: 695922 - RNA, 22 nt, Homo sapiens
gcaauacagacuacuucuuccc

SEQ ID NO: 695923 - RNA, 16 nt, Homo sapiens
gcaaugcccugugcau

SEQ ID NO: 695924 - RNA, 19 nt, Homo sapiens
gcaauuagauuaguauuuu

SEQ ID NO: 695925 - RNA, 22 nt, Homo sapiens
gcacauauggaauuuugcaaag

SEQ ID NO: 695926 - RNA, 16 nt, Homo sapiens
gcaccaccaagccaag

SEQ ID NO: 695927 - RNA, 20 nt, Homo sapiens
gcaccacugcacuccagccu

SEQ ID NO: 695928 - RNA, 18 nt, Homo sapiens
gcacucuguauauuugau

SEQ ID NO: 695929 - RNA, 15 nt, Homo sapiens
gcacugacugggcau

SEQ ID NO: 695930 - RNA, 13 nt, Homo sapiens
gcacuucauguaa

SEQ ID NO: 695931 - RNA, 14 nt, Homo sapiens
gcagaggccagagg

SEQ ID NO: 695932 - RNA, 22 nt, Homo sapiens
gcagcagggagggcuucugcca

SEQ ID NO: 695933 - RNA, 15 nt, Homo sapiens
gcagcccaaucugcc

SEQ ID NO: 695934 - RNA, 21 nt, Homo sapiens
gcaggacuugagaagaccuca

SEQ ID NO: 695935 - RNA, 18 nt, Homo sapiens
gcaggagaauggugugaa

SEQ ID NO: 695936 - RNA, 19 nt, Homo sapiens
gcaggcugggccaugucca

SEQ ID NO: 695937 - RNA, 19 nt, Homo sapiens
gcaggcuuugccauuguga

SEQ ID NO: 695938 - RNA, 16 nt, Homo sapiens
gcaggggccuggagau

SEQ ID NO: 695939 - RNA, 13 nt, Homo sapiens
gcagucacuggag

SEQ ID NO: 695940 - RNA, 15 nt, Homo sapiens
gcagugagcugagau

SEQ ID NO: 695941 - RNA, 13 nt, Homo sapiens
gcaguucuacuca

SEQ ID NO: 695942 - RNA, 23 nt, Homo sapiens
gcaucaauauacauaauacauga

SEQ ID NO: 695943 - RNA, 16 nt, Homo sapiens
gcaucuaucugugcua

SEQ ID NO: 695944 - RNA, 17 nt, Homo sapiens
gcauggaaaucagccaa

SEQ ID NO: 695945 - RNA, 14 nt, Homo sapiens
gcaugugugugaug

SEQ ID NO: 695946 - RNA, 16 nt, Homo sapiens
gcauuuagucuugcca

SEQ ID NO: 695947 - RNA, 15 nt, Homo sapiens
gccaagucauagcca

SEQ ID NO: 695948 - RNA, 19 nt, Homo sapiens
gccacauggcggagaguuu

SEQ ID NO: 695949 - RNA, 14 nt, Homo sapiens
gccacccuagccaa

SEQ ID NO: 695950 - RNA, 14 nt, Homo sapiens
gccacgugggcaaa

SEQ ID NO: 695951 - RNA, 16 nt, Homo sapiens
gccacuuuacccaccu

SEQ ID NO: 695952 - RNA, 22 nt, Homo sapiens
gccagcuuggggccaccaaagc

SEQ ID NO: 695953 - RNA, 18 nt, Homo sapiens
gccaggcaugguggccca

SEQ ID NO: 695954 - RNA, 11 nt, Homo sapiens
gccaguauuuu

SEQ ID NO: 695955 - RNA, 21 nt, Homo sapiens
gccaucuaaaguaaaaaggga

SEQ ID NO: 695956 - RNA, 17 nt, Homo sapiens
gccauggugauggugua

SEQ ID NO: 695957 - RNA, 15 nt, Homo sapiens
gccauguccaaagag

SEQ ID NO: 695958 - RNA, 21 nt, Homo sapiens
gcccagauucuaccacacagc

SEQ ID NO: 695959 - RNA, 22 nt, Homo sapiens
gcccagauucuaccacacagca

SEQ ID NO: 695960 - RNA, 15 nt, Homo sapiens
gcccaggagccucac

SEQ ID NO: 695961 - RNA, 12 nt, Homo sapiens
gcccagugcaug

SEQ ID NO: 695962 - RNA, 12 nt, Homo sapiens
gccccacugcca

SEQ ID NO: 695963 - RNA, 13 nt, Homo sapiens
gcccguucuugaa

SEQ ID NO: 695964 - RNA, 16 nt, Homo sapiens
gcccguucuugaaaug

SEQ ID NO: 695965 - RNA, 16 nt, Homo sapiens
gcccuacucccugcag

SEQ ID NO: 695966 - RNA, 19 nt, Homo sapiens
gcccuuggcuucugugaug

SEQ ID NO: 695967 - RNA, 21 nt, Homo sapiens
gccgagaucgcgccacugcac

SEQ ID NO: 695968 - RNA, 12 nt, Homo sapiens
gccguaucuccg

SEQ ID NO: 695969 - RNA, 21 nt, Homo sapiens
gccguccuggcgccuggcagu

SEQ ID NO: 695970 - RNA, 16 nt, Homo sapiens
gccuauaagccaaaau

SEQ ID NO: 695971 - RNA, 12 nt, Homo sapiens
gccucacugggg

SEQ ID NO: 695972 - RNA, 22 nt, Homo sapiens
gccucacuggggcagacaauaa

SEQ ID NO: 695973 - RNA, 19 nt, Homo sapiens
gccucccuccccagugcaa

SEQ ID NO: 695974 - RNA, 13 nt, Homo sapiens
gccugcccagaca

SEQ ID NO: 695975 - RNA, 15 nt, Homo sapiens
gccugcuuugaauaa

SEQ ID NO: 695976 - RNA, 14 nt, Homo sapiens
gccuggacccugug

SEQ ID NO: 695977 - RNA, 16 nt, Homo sapiens
gccuggucguuuucaa

SEQ ID NO: 695978 - RNA, 13 nt, Homo sapiens
gccuguaauccca

SEQ ID NO: 695979 - RNA, 13 nt, Homo sapiens
gccuguaguccca

SEQ ID NO: 695980 - RNA, 17 nt, Homo sapiens
gccuuaaacacucaccu

SEQ ID NO: 695981 - RNA, 21 nt, Homo sapiens
gccuuagccgcccaugcacug

SEQ ID NO: 695982 - RNA, 16 nt, Homo sapiens
gccuugaguuccaguu

SEQ ID NO: 695983 - RNA, 19 nt, Homo sapiens
gccuuuugugcaaagccaa

SEQ ID NO: 695984 - RNA, 20 nt, Homo sapiens
gcgcaguguuuugcaagugc

SEQ ID NO: 695985 - RNA, 13 nt, Homo sapiens
gcgccacaggacc

SEQ ID NO: 695986 - RNA, 15 nt, Homo sapiens
gcgcucucuuugcaa

SEQ ID NO: 695987 - RNA, 15 nt, Homo sapiens
gcggcgucccuucca

SEQ ID NO: 695988 - RNA, 13 nt, Homo sapiens
gcggcuggcagcc

SEQ ID NO: 695989 - RNA, 16 nt, Homo sapiens
gcgggacccgaccccc

SEQ ID NO: 695990 - RNA, 23 nt, Homo sapiens
gcuaauucuacucacagugcuuu

SEQ ID NO: 695991 - RNA, 22 nt, Homo sapiens
gcuaucaucauccuacaacuca

SEQ ID NO: 695992 - RNA, 17 nt, Homo sapiens
gcuauuuggacucaggu

SEQ ID NO: 695993 - RNA, 21 nt, Homo sapiens
gcucaagucacuuuuauuuga

SEQ ID NO: 695994 - RNA, 22 nt, Homo sapiens
gcucagcaaaagaugcuucuca

SEQ ID NO: 695995 - RNA, 20 nt, Homo sapiens
gcucagcucgguacccgggg

SEQ ID NO: 695996 - RNA, 20 nt, Homo sapiens
gcucagucccucugcucuca

SEQ ID NO: 695997 - RNA, 21 nt, Homo sapiens
gcucaguguuuuugugaauug

SEQ ID NO: 695998 - RNA, 15 nt, Homo sapiens
gcucaucugcaaaag

SEQ ID NO: 695999 - RNA, 12 nt, Homo sapiens
gcuccagcaaca

SEQ ID NO: 696000 - RNA, 19 nt, Homo sapiens
gcuccagggaauccaagcc

SEQ ID NO: 696001 - RNA, 13 nt, Homo sapiens
gcuccagugcagg

SEQ ID NO: 696002 - RNA, 21 nt, Homo sapiens
gcucccucuauuuauguuugc

SEQ ID NO: 696003 - RNA, 17 nt, Homo sapiens
gcuccgaggacccagga

SEQ ID NO: 696004 - RNA, 20 nt, Homo sapiens
gcucugugcagucacuggag

SEQ ID NO: 696005 - RNA, 17 nt, Homo sapiens
gcugcacccacccagga

SEQ ID NO: 696006 - RNA, 13 nt, Homo sapiens
gcugcuccagugc

SEQ ID NO: 696007 - RNA, 16 nt, Homo sapiens
gcugcuccagugcagg

SEQ ID NO: 696008 - RNA, 22 nt, Homo sapiens
gcugcucuucaucccauuccag

SEQ ID NO: 696009 - RNA, 14 nt, Homo sapiens
gguuccuccucucc

SEQ ID NO: 696010 - RNA, 13 nt, Homo sapiens
gguuggcaaaaua

SEQ ID NO: 696011 - RNA, 16 nt, Homo sapiens
gguugugcacuguuua

SEQ ID NO: 696012 - RNA, 21 nt, Homo sapiens
gguuugccaaaauucauuucu

SEQ ID NO: 696013 - RNA, 15 nt, Homo sapiens
gguuuuacugcagcu

SEQ ID NO: 696014 - RNA, 21 nt, Homo sapiens
gguuuuauaaggcugauguca

SEQ ID NO: 696015 - RNA, 14 nt, Homo sapiens
guaaaacaguuaca

SEQ ID NO: 696016 - RNA, 14 nt, Homo sapiens
guaaaauauaucau

SEQ ID NO: 696017 - RNA, 20 nt, Homo sapiens
guaaacuucugcaacaagca

SEQ ID NO: 696018 - RNA, 21 nt, Homo sapiens
guaaauacacauagcauguaa

SEQ ID NO: 696019 - RNA, 21 nt, Homo sapiens
guaaaucauguugaucaugua

SEQ ID NO: 696020 - RNA, 13 nt, Homo sapiens
guaacuuacuuag

SEQ ID NO: 696021 - RNA, 12 nt, Homo sapiens
guaagaaaguga

SEQ ID NO: 696022 - RNA, 17 nt, Homo sapiens
guaagaaggcaauauua

SEQ ID NO: 696023 - RNA, 16 nt, Homo sapiens
guaaucccagcacuuu

SEQ ID NO: 696024 - RNA, 20 nt, Homo sapiens
guaauguuuuauacuguuua

SEQ ID NO: 696025 - RNA, 15 nt, Homo sapiens
guacagauucuuuca

SEQ ID NO: 696026 - RNA, 18 nt, Homo sapiens
guacaguagauuuuccaa

SEQ ID NO: 696027 - RNA, 15 nt, Homo sapiens
guaccaagugaaauu

SEQ ID NO: 696028 - RNA, 16 nt, Homo sapiens
guaccugguugguccu

SEQ ID NO: 696029 - RNA, 14 nt, Homo sapiens
guacguggccaugu

SEQ ID NO: 696030 - RNA, 18 nt, Homo sapiens
guacuuuuaaaaacauaa

SEQ ID NO: 696031 - RNA, 21 nt, Homo sapiens
guacuuuuaaaaacauaacau

SEQ ID NO: 696032 - RNA, 17 nt, Homo sapiens
guagagaagcaaguaaa

SEQ ID NO: 696033 - RNA, 17 nt, Homo sapiens
guagauaauuucagggu

SEQ ID NO: 696034 - RNA, 14 nt, Homo sapiens
guagcauacuggcu

SEQ ID NO: 696035 - RNA, 22 nt, Homo sapiens
guaguucuaccggcuuugccau

SEQ ID NO: 696036 - RNA, 19 nt, Homo sapiens
guauauauguguaugcaca

SEQ ID NO: 696037 - RNA, 22 nt, Homo sapiens
guauauugguuuuaugaugacg

SEQ ID NO: 696038 - RNA, 19 nt, Homo sapiens
guauccccccaucuugcuu

SEQ ID NO: 696039 - RNA, 15 nt, Homo sapiens
guaugacugcacaug

SEQ ID NO: 696040 - RNA, 18 nt, Homo sapiens
guauguguaccuaaggga

SEQ ID NO: 696041 - RNA, 17 nt, Homo sapiens
guauuaucaaagggaua

SEQ ID NO: 696042 - RNA, 21 nt, Homo sapiens
guauuuauuuuacagcucauu

SEQ ID NO: 696043 - RNA, 16 nt, Homo sapiens
guauuugaaauaagaa

SEQ ID NO: 696044 - RNA, 20 nt, Homo sapiens
gucaaggcaguagaacucca

SEQ ID NO: 696045 - RNA, 15 nt, Homo sapiens
gucacucauugcuga

SEQ ID NO: 696046 - RNA, 10 nt, Homo sapiens
gucacuggaa

SEQ ID NO: 696047 - RNA, 17 nt, Homo sapiens
gucacuuuuauuugaaa

SEQ ID NO: 696048 - RNA, 18 nt, Homo sapiens
gucagagacagauaccuc

SEQ ID NO: 696049 - RNA, 20 nt, Homo sapiens
gucagagacagauaccucca

SEQ ID NO: 696050 - RNA, 17 nt, Homo sapiens
gucagccauaucuccau

SEQ ID NO: 696051 - RNA, 13 nt, Homo sapiens
gucauaacaucca

SEQ ID NO: 696052 - RNA, 21 nt, Homo sapiens
gucauaguggguggauuuguu

SEQ ID NO: 696053 - RNA, 16 nt, Homo sapiens
guccacccugccugcc

SEQ ID NO: 696054 - RNA, 13 nt, Homo sapiens
guccagcaccuug

SEQ ID NO: 696055 - RNA, 17 nt, Homo sapiens
guccaguaagaucacug

SEQ ID NO: 696056 - RNA, 21 nt, Homo sapiens
gucccaagauguugauuuuua

SEQ ID NO: 696057 - RNA, 22 nt, Homo sapiens
gucccuugcuugccugcagggc

SEQ ID NO: 696058 - RNA, 12 nt, Homo sapiens
guccucauucuu

SEQ ID NO: 696059 - RNA, 15 nt, Homo sapiens
guccucccaggccag

SEQ ID NO: 696060 - RNA, 14 nt, Homo sapiens
gucgcaucucagug

SEQ ID NO: 696061 - RNA, 18 nt, Homo sapiens
gucgcaucucagugcagg

SEQ ID NO: 696062 - RNA, 19 nt, Homo sapiens
gucuauauuuuaaccugca

SEQ ID NO: 696063 - RNA, 21 nt, Homo sapiens
gucuauuuaaaaaaaaaguca

SEQ ID NO: 696064 - RNA, 20 nt, Homo sapiens
gucucaaccccucacaggag

SEQ ID NO: 696065 - RNA, 18 nt, Homo sapiens
gucuccaucucugucuca

SEQ ID NO: 696066 - RNA, 18 nt, Homo sapiens
gucucuucuuggggccca

SEQ ID NO: 696067 - RNA, 13 nt, Homo sapiens
gucuucagcaccc

SEQ ID NO: 696068 - RNA, 19 nt, Homo sapiens
gucuuugccagucauucag

SEQ ID NO: 696069 - RNA, 21 nt, Homo sapiens
gugaaccauggugaagugcuu

SEQ ID NO: 696070 - RNA, 19 nt, Homo sapiens
gugaggcggcccugaccaa

SEQ ID NO: 696071 - RNA, 12 nt, Homo sapiens
gugagggguccc

SEQ ID NO: 696072 - RNA, 19 nt, Homo sapiens
gugaguccgggaaucucuu

SEQ ID NO: 696073 - RNA, 15 nt, Homo sapiens
gugaugcuguacaca

SEQ ID NO: 696074 - RNA, 21 nt, Homo sapiens
gugcacauccgcgugugccug

SEQ ID NO: 696075 - RNA, 15 nt, Homo sapiens
gugcagucacuggag

SEQ ID NO: 696076 - RNA, 19 nt, Homo sapiens
gugcaguggcgcauucuag

SEQ ID NO: 696077 - RNA, 15 nt, Homo sapiens
gugcaucccugagac

SEQ ID NO: 696078 - RNA, 19 nt, Homo sapiens
gugccaaaaaucuuuucau

SEQ ID NO: 696079 - RNA, 13 nt, Homo sapiens
gugccguggcacc

SEQ ID NO: 696080 - RNA, 21 nt, Homo sapiens
gugcuaugaauuuucaaguaa

SEQ ID NO: 696081 - RNA, 18 nt, Homo sapiens
gugcugaaggaauggaag

SEQ ID NO: 696082 - RNA, 19 nt, Homo sapiens
gugcuggagcaaaagucau

SEQ ID NO: 696083 - RNA, 15 nt, Homo sapiens
gugcuguuguucucg

SEQ ID NO: 696084 - RNA, 21 nt, Homo sapiens
guggauguauggggaaucuaa

SEQ ID NO: 696085 - RNA, 16 nt, Homo sapiens
guggccaggcugccug

SEQ ID NO: 696086 - RNA, 14 nt, Homo sapiens
guggccuguggcug

SEQ ID NO: 696087 - RNA, 16 nt, Homo sapiens
guggcugucgguggga

SEQ ID NO: 696088 - RNA, 13 nt, Homo sapiens
gugggacugagau

SEQ ID NO: 696089 - RNA, 22 nt, Homo sapiens
gugggcgcuugcaccacuuccg

SEQ ID NO: 696090 - RNA, 21 nt, Homo sapiens
gugguagagaagcaaguaaaa

SEQ ID NO: 696091 - RNA, 16 nt, Homo sapiens
gugguccccguuccac

SEQ ID NO: 696092 - RNA, 22 nt, Homo sapiens
gugguuuuauacugaaggaaaa

SEQ ID NO: 696093 - RNA, 15 nt, Homo sapiens
guguaaaaaaaccac

SEQ ID NO: 696094 - RNA, 22 nt, Homo sapiens
guguauuuauuuuacagcucau

SEQ ID NO: 696095 - RNA, 22 nt, Homo sapiens
gugugggaaagcgcggacgugc

SEQ ID NO: 696096 - RNA, 13 nt, Homo sapiens
gugugugugauau

SEQ ID NO: 696097 - RNA, 23 nt, Homo sapiens
guguuuuguaggagacuugccag

SEQ ID NO: 696098 - RNA, 24 nt, Homo sapiens
guuaaguugaaguaaaagcaagua

SEQ ID NO: 696099 - RNA, 19 nt, Homo sapiens
guuacaaaaauaaacuaua

SEQ ID NO: 696100 - RNA, 14 nt, Homo sapiens
guuacaaguuuaua

SEQ ID NO: 696101 - RNA, 19 nt, Homo sapiens
guuacuggauuuguuguuc

SEQ ID NO: 696102 - RNA, 14 nt, Homo sapiens
guuacugucuucag

SEQ ID NO: 696103 - RNA, 23 nt, Homo sapiens
guuacuguguaaacucaucugaa

SEQ ID NO: 696104 - RNA, 15 nt, Homo sapiens
guuauaucuaugcaa

SEQ ID NO: 696105 - RNA, 13 nt, Homo sapiens
guuaugcaucauu

SEQ ID NO: 696106 - RNA, 18 nt, Homo sapiens
guuccucccccaguuccu

SEQ ID NO: 696107 - RNA, 22 nt, Homo sapiens
guucucaaauauuugcuaugaa

SEQ ID NO: 696108 - RNA, 14 nt, Homo sapiens
guucuguauuugaa

SEQ ID NO: 696109 - RNA, 18 nt, Homo sapiens
guucuucaccuccugcca

SEQ ID NO: 696110 - RNA, 15 nt, Homo sapiens
guugacaacugugac

SEQ ID NO: 696111 - RNA, 23 nt, Homo sapiens
guugcagcccuugugaugugauu

SEQ ID NO: 696112 - RNA, 19 nt, Homo sapiens
guugcaggaccucagguga

SEQ ID NO: 696113 - RNA, 16 nt, Homo sapiens
guuggaaaguaacugu

SEQ ID NO: 696114 - RNA, 22 nt, Homo sapiens
guugggggaggggagacuuuga

SEQ ID NO: 696115 - RNA, 23 nt, Homo sapiens
guugggggaggggagacuuugau

SEQ ID NO: 696116 - RNA, 20 nt, Homo sapiens
guugguucguucuguacugu

SEQ ID NO: 696117 - RNA, 22 nt, Homo sapiens
guugguucguucuguacuguua

SEQ ID NO: 696118 - RNA, 21 nt, Homo sapiens
guuguaccaaaauucaucugu

SEQ ID NO: 696119 - RNA, 15 nt, Homo sapiens
guuuagauuugccau

SEQ ID NO: 696120 - RNA, 18 nt, Homo sapiens
guuuagcccaaaaccaag

SEQ ID NO: 696121 - RNA, 18 nt, Homo sapiens
guuuauuuacaagggaag

SEQ ID NO: 696122 - RNA, 16 nt, Homo sapiens
guuuccuggcacugga

SEQ ID NO: 696123 - RNA, 14 nt, Homo sapiens
guuuguccugagau

SEQ ID NO: 696124 - RNA, 23 nt, Homo sapiens
guuuuccaguucaucgauuuucu

SEQ ID NO: 696125 - RNA, 15 nt, Homo sapiens
guuuugcaagugcug

SEQ ID NO: 696126 - RNA, 21 nt, Homo sapiens
guuuuguaggagacuugccag

SEQ ID NO: 696127 - RNA, 21 nt, Homo sapiens
uaagacauacuccuuccauca

SEQ ID NO: 696128 - RNA, 19 nt, Homo sapiens
uaagagacacuccaaaccu

SEQ ID NO: 696129 - RNA, 20 nt, Homo sapiens
uaagcccccucaacuaccau

SEQ ID NO: 696130 - RNA, 22 nt, Homo sapiens
uaagcuguggucaaggcuacag

SEQ ID NO: 696131 - RNA, 17 nt, Homo sapiens
uaaggacaaagugccaa

SEQ ID NO: 696132 - RNA, 18 nt, Homo sapiens
uaaggacaaagugccaaa

SEQ ID NO: 696133 - RNA, 21 nt, Homo sapiens
uaaggacaaagugccaaagaa

SEQ ID NO: 696134 - RNA, 13 nt, Homo sapiens
uaagguguuugaa

SEQ ID NO: 696135 - RNA, 15 nt, Homo sapiens
uaagugucucacuaa

SEQ ID NO: 696136 - RNA, 17 nt, Homo sapiens
uaauaacuguguacugu

SEQ ID NO: 696137 - RNA, 16 nt, Homo sapiens
uaauaaugcuggaugg

SEQ ID NO: 696138 - RNA, 15 nt, Homo sapiens
uaauacaugauugca

SEQ ID NO: 696139 - RNA, 15 nt, Homo sapiens
uaauaggcucugccu

SEQ ID NO: 696140 - RNA, 16 nt, Homo sapiens
uaauagucuuugccag

SEQ ID NO: 696141 - RNA, 22 nt, Homo sapiens
uaaucacaguuuuuccuggaau

SEQ ID NO: 696142 - RNA, 15 nt, Homo sapiens
uaaucacuguguaua

SEQ ID NO: 696143 - RNA, 22 nt, Homo sapiens
uaaucauaguuacuguguaaac

SEQ ID NO: 696144 - RNA, 22 nt, Homo sapiens
uaaucaucuaagucaguaccca

SEQ ID NO: 696145 - RNA, 23 nt, Homo sapiens
uaaucauuuguuuacauuugaug

SEQ ID NO: 696146 - RNA, 19 nt, Homo sapiens
uaaucuggaauaugcaaca

SEQ ID NO: 696147 - RNA, 15 nt, Homo sapiens
uaaugaaaaugaaua

SEQ ID NO: 696148 - RNA, 14 nt, Homo sapiens
uaaugaaauacauc

SEQ ID NO: 696149 - RNA, 19 nt, Homo sapiens
uaaugaaguuaagaaccug

SEQ ID NO: 696150 - RNA, 20 nt, Homo sapiens
uaaugcaaacugggaugaaa

SEQ ID NO: 696151 - RNA, 15 nt, Homo sapiens
uaauguuauuuccac

SEQ ID NO: 696152 - RNA, 14 nt, Homo sapiens
uaauguuccucaaa

SEQ ID NO: 696153 - RNA, 21 nt, Homo sapiens
uaauuaaauucugagccugau

SEQ ID NO: 696154 - RNA, 16 nt, Homo sapiens
uaauuauaaauaucau

SEQ ID NO: 696155 - RNA, 19 nt, Homo sapiens
uaauuauuauuuccagugu

SEQ ID NO: 696156 - RNA, 18 nt, Homo sapiens
uaauugugugaacuugga

SEQ ID NO: 696157 - RNA, 16 nt, Homo sapiens
uaauuuacagcuuuca

SEQ ID NO: 696158 - RNA, 20 nt, Homo sapiens
uaauuuagaccccauacaag

SEQ ID NO: 696159 - RNA, 21 nt, Homo sapiens
uaauuuccuuuuugacacuga

SEQ ID NO: 696160 - RNA, 22 nt, Homo sapiens
uaauuuccuuuuugacacugaa

SEQ ID NO: 696161 - RNA, 14 nt, Homo sapiens
uaauuuuacauguu

SEQ ID NO: 696162 - RNA, 21 nt, Homo sapiens
uacaaaaccuacccucaguga

SEQ ID NO: 696163 - RNA, 11 nt, Homo sapiens
uacaagggaag

SEQ ID NO: 696164 - RNA, 14 nt, Homo sapiens
uacaaguaguucug

SEQ ID NO: 696165 - RNA, 16 nt, Homo sapiens
uacaagucagcuccag

SEQ ID NO: 696166 - RNA, 22 nt, Homo sapiens
uacaaugaaagcccucaugugc

SEQ ID NO: 696167 - RNA, 18 nt, Homo sapiens
uacacagaaacacugccu

SEQ ID NO: 696168 - RNA, 23 nt, Homo sapiens
uacacucuugacuagugcaauuu

SEQ ID NO: 696169 - RNA, 17 nt, Homo sapiens
uacagaaaguagugcug

SEQ ID NO: 696170 - RNA, 13 nt, Homo sapiens
uacagacugugag

SEQ ID NO: 696171 - RNA, 14 nt, Homo sapiens
uacagaugugcuga

SEQ ID NO: 696172 - RNA, 12 nt, Homo sapiens
uacagugguuuu

SEQ ID NO: 696173 - RNA, 18 nt, Homo sapiens
uaccuuaagagacacucc

SEQ ID NO: 696174 - RNA, 13 nt, Homo sapiens
uacgccaggggaa

SEQ ID NO: 696175 - RNA, 20 nt, Homo sapiens
uacgguggucggugggaccc

SEQ ID NO: 696176 - RNA, 20 nt, Homo sapiens
uacgugauccucucaccuca

SEQ ID NO: 696177 - RNA, 17 nt, Homo sapiens
uacguggccauguauga

SEQ ID NO: 696178 - RNA, 13 nt, Homo sapiens
uacugccuugaaa

SEQ ID NO: 696179 - RNA, 14 nt, Homo sapiens
uacugguugcaugg

SEQ ID NO: 696180 - RNA, 12 nt, Homo sapiens
uacuugaaccau

SEQ ID NO: 696181 - RNA, 17 nt, Homo sapiens
uacuugcaagccucaaa

SEQ ID NO: 696182 - RNA, 16 nt, Homo sapiens
uacuugccaucaguga

SEQ ID NO: 696183 - RNA, 15 nt, Homo sapiens
uacuuuuuaguaauu

SEQ ID NO: 696184 - RNA, 15 nt, Homo sapiens
uagaaaugucucaag

SEQ ID NO: 696185 - RNA, 23 nt, Homo sapiens
uagaaaugucucaaggcaguuaa

SEQ ID NO: 696186 - RNA, 14 nt, Homo sapiens
uagaaauuccccac

SEQ ID NO: 696187 - RNA, 11 nt, Homo sapiens
uagaagccaag

SEQ ID NO: 696188 - RNA, 18 nt, Homo sapiens
uagaagcuguaacagaau

SEQ ID NO: 696189 - RNA, 15 nt, Homo sapiens
uagaaugaaagacug

SEQ ID NO: 696190 - RNA, 16 nt, Homo sapiens
uagacaaucacuacaa

SEQ ID NO: 696191 - RNA, 19 nt, Homo sapiens
uagagaggacaauacuggg

SEQ ID NO: 696192 - RNA, 21 nt, Homo sapiens
uagagaggacaauacuggggu

SEQ ID NO: 696193 - RNA, 17 nt, Homo sapiens
uagagauggggguuuca

SEQ ID NO: 696194 - RNA, 12 nt, Homo sapiens
uagagccagcuu

SEQ ID NO: 696195 - RNA, 14 nt, Homo sapiens
uagauaucaugcaa

SEQ ID NO: 696196 - RNA, 14 nt, Homo sapiens
uagaugauguauuu

SEQ ID NO: 696197 - RNA, 21 nt, Homo sapiens
uagauuucuauaggauuuuuc

SEQ ID NO: 696198 - RNA, 23 nt, Homo sapiens
uagauuuuagacccuauugcugc

SEQ ID NO: 696199 - RNA, 14 nt, Homo sapiens
uagauuuucacuua

SEQ ID NO: 696200 - RNA, 19 nt, Homo sapiens
uagauuuucuuuugccuuu

SEQ ID NO: 696201 - RNA, 20 nt, Homo sapiens
uagcagcccacccugcugcu

SEQ ID NO: 696202 - RNA, 17 nt, Homo sapiens
uagccgcccaugcacug

SEQ ID NO: 696203 - RNA, 18 nt, Homo sapiens
uaggaaacucacacuccc

SEQ ID NO: 696204 - RNA, 19 nt, Homo sapiens
uaggaaggugaaucugccc

SEQ ID NO: 696205 - RNA, 21 nt, Homo sapiens
uaggcauuugcugaauacaga

SEQ ID NO: 696206 - RNA, 18 nt, Homo sapiens
uagucugcuuugguacua

SEQ ID NO: 696207 - RNA, 21 nt, Homo sapiens
uagugccucuguuaccaccac

SEQ ID NO: 696208 - RNA, 20 nt, Homo sapiens
uaguuaaauguuaccucuga

SEQ ID NO: 696209 - RNA, 23 nt, Homo sapiens
uauaaaauaguaugaaaauggaa

SEQ ID NO: 696210 - RNA, 18 nt, Homo sapiens
uauaaaauauaaacaaag

SEQ ID NO: 696211 - RNA, 18 nt, Homo sapiens
uauaaauuuguguucuca

SEQ ID NO: 696212 - RNA, 22 nt, Homo sapiens
uauaacucuccuuugcucucug

SEQ ID NO: 696213 - RNA, 23 nt, Homo sapiens
uauaaugggcucuccggggccau

SEQ ID NO: 696214 - RNA, 15 nt, Homo sapiens
uauaauguugccagc

SEQ ID NO: 696215 - RNA, 20 nt, Homo sapiens
uauaugaacauacaaaugca

SEQ ID NO: 696216 - RNA, 17 nt, Homo sapiens
uauauuacaagggauaa

SEQ ID NO: 696217 - RNA, 21 nt, Homo sapiens
uauauuuugugugaaauugca

SEQ ID NO: 696218 - RNA, 11 nt, Homo sapiens
uaucaugcaaa

SEQ ID NO: 696219 - RNA, 15 nt, Homo sapiens
uauccugugacuguc

SEQ ID NO: 696220 - RNA, 23 nt, Homo sapiens
uaucuccugacagaaggugccac

SEQ ID NO: 696221 - RNA, 12 nt, Homo sapiens
uaugcauaucag

SEQ ID NO: 696222 - RNA, 22 nt, Homo sapiens
uaugcuuuguagaguuuuguca

SEQ ID NO: 696223 - RNA, 20 nt, Homo sapiens
uaugguauauauacauauau

SEQ ID NO: 696224 - RNA, 22 nt, Homo sapiens
uauguauguguuuagaauugaa

SEQ ID NO: 696225 - RNA, 23 nt, Homo sapiens
uaugugagagaaagugugagcaa

SEQ ID NO: 696226 - RNA, 19 nt, Homo sapiens
uauuaaauauauacugacu

SEQ ID NO: 696227 - RNA, 18 nt, Homo sapiens
uauuaacauaagaaaaga

SEQ ID NO: 696228 - RNA, 20 nt, Homo sapiens
uauucaacagcaagugugaa

SEQ ID NO: 696229 - RNA, 12 nt, Homo sapiens
uauucagaugua

SEQ ID NO: 696230 - RNA, 15 nt, Homo sapiens
uauucagcacuaaaa

SEQ ID NO: 696231 - RNA, 23 nt, Homo sapiens
uauucuaguuuugucaaacugua

SEQ ID NO: 696232 - RNA, 18 nt, Homo sapiens
uauuguugacaacuguga

SEQ ID NO: 696233 - RNA, 12 nt, Homo sapiens
uauuguuuccaa

SEQ ID NO: 696234 - RNA, 14 nt, Homo sapiens
uauuguuucugcau

SEQ ID NO: 696235 - RNA, 19 nt, Homo sapiens
uauuuaaaaaaaaagucag

SEQ ID NO: 696236 - RNA, 14 nt, Homo sapiens
uauuuacaagggaa

SEQ ID NO: 696237 - RNA, 12 nt, Homo sapiens
uauuuacauuua

SEQ ID NO: 696238 - RNA, 13 nt, Homo sapiens
uauuuaccagacc

SEQ ID NO: 696239 - RNA, 21 nt, Homo sapiens
uauuuauaauuccuauauccu

SEQ ID NO: 696240 - RNA, 15 nt, Homo sapiens
uauuucacuugauga

SEQ ID NO: 696241 - RNA, 16 nt, Homo sapiens
uauuucuacugucaaa

SEQ ID NO: 696242 - RNA, 15 nt, Homo sapiens
uauuuggauaucaaa

SEQ ID NO: 696243 - RNA, 13 nt, Homo sapiens
uauuugguacugu

SEQ ID NO: 696244 - RNA, 13 nt, Homo sapiens
uauuuuacacaga

SEQ ID NO: 696245 - RNA, 17 nt, Homo sapiens
uauuuuauuuagacaag

SEQ ID NO: 696246 - RNA, 23 nt, Homo sapiens
gguucucuuagcaacucagagaa

SEQ ID NO: 696247 - RNA, 23 nt, Homo sapiens
gguugaaaaaauagauccaauca

SEQ ID NO: 696248 - RNA, 17 nt, Homo sapiens
gguugagcucuucuuaa

SEQ ID NO: 696249 - RNA, 12 nt, Homo sapiens
gguuucauucug

SEQ ID NO: 696250 - RNA, 13 nt, Homo sapiens
gguuucuugcaag

SEQ ID NO: 696251 - RNA, 13 nt, Homo sapiens
guaaaaagggaau

SEQ ID NO: 696252 - RNA, 12 nt, Homo sapiens
guaaaacaugcu

SEQ ID NO: 696253 - RNA, 15 nt, Homo sapiens
guaaaauaacaucag

SEQ ID NO: 696254 - RNA, 18 nt, Homo sapiens
guaaagacugguuuucug

SEQ ID NO: 696255 - RNA, 23 nt, Homo sapiens
guaaaguuuccgugcguggcacu

SEQ ID NO: 696256 - RNA, 12 nt, Homo sapiens
guaaauguuucu

SEQ ID NO: 696257 - RNA, 20 nt, Homo sapiens
guaacuuauuuuaaauaugc

SEQ ID NO: 696258 - RNA, 17 nt, Homo sapiens
guaauaagcaaucaagg

SEQ ID NO: 696259 - RNA, 15 nt, Homo sapiens
guacauacgauuuaa

SEQ ID NO: 696260 - RNA, 19 nt, Homo sapiens
guacuguuuuccaguucau

SEQ ID NO: 696261 - RNA, 16 nt, Homo sapiens
guagaaaagaacugga

SEQ ID NO: 696262 - RNA, 13 nt, Homo sapiens
guagaacuuugua

SEQ ID NO: 696263 - RNA, 12 nt, Homo sapiens
guagacuguggc

SEQ ID NO: 696264 - RNA, 21 nt, Homo sapiens
guagagacgguguuuugccau

SEQ ID NO: 696265 - RNA, 18 nt, Homo sapiens
guagauguggccuuugaa

SEQ ID NO: 696266 - RNA, 19 nt, Homo sapiens
guaggaaagaggaagcaaa

SEQ ID NO: 696267 - RNA, 16 nt, Homo sapiens
guaggcuuaguuugug

SEQ ID NO: 696268 - RNA, 18 nt, Homo sapiens
guauauuacaaugaucac

SEQ ID NO: 696269 - RNA, 18 nt, Homo sapiens
guaucccacauccaacuc

SEQ ID NO: 696270 - RNA, 12 nt, Homo sapiens
guaugccaagug

SEQ ID NO: 696271 - RNA, 15 nt, Homo sapiens
guauguguaccuaag

SEQ ID NO: 696272 - RNA, 14 nt, Homo sapiens
guauuauacaugug

SEQ ID NO: 696273 - RNA, 18 nt, Homo sapiens
guauuauauaaacuuaac

SEQ ID NO: 696274 - RNA, 16 nt, Homo sapiens
guauucuucaaccagu

SEQ ID NO: 696275 - RNA, 18 nt, Homo sapiens
guauuuauuuauguacuu

SEQ ID NO: 696276 - RNA, 20 nt, Homo sapiens
guauuuuguuuuugucuuaa

SEQ ID NO: 696277 - RNA, 19 nt, Homo sapiens
gucaaaaggaagucucuag

SEQ ID NO: 696278 - RNA, 11 nt, Homo sapiens
gucaaacugua

SEQ ID NO: 696279 - RNA, 16 nt, Homo sapiens
gucaacagcgugcagg

SEQ ID NO: 696280 - RNA, 17 nt, Homo sapiens
gucaauggcuuguucau

SEQ ID NO: 696281 - RNA, 20 nt, Homo sapiens
gucaaugggaccuguggcug

SEQ ID NO: 696282 - RNA, 12 nt, Homo sapiens
gucaccagagac

SEQ ID NO: 696283 - RNA, 16 nt, Homo sapiens
gucagcaugccucuag

SEQ ID NO: 696284 - RNA, 20 nt, Homo sapiens
gucauauauuaaacauccac

SEQ ID NO: 696285 - RNA, 21 nt, Homo sapiens
guccaaccagaccuggaagaa

SEQ ID NO: 696286 - RNA, 22 nt, Homo sapiens
guccauacacuuuguugcaaga

SEQ ID NO: 696287 - RNA, 13 nt, Homo sapiens
guccgagcuuuga

SEQ ID NO: 696288 - RNA, 18 nt, Homo sapiens
guccuaaauguaaucacg

SEQ ID NO: 696289 - RNA, 12 nt, Homo sapiens
gucuaaagugua

SEQ ID NO: 696290 - RNA, 18 nt, Homo sapiens
gucucucuucucagagug

SEQ ID NO: 696291 - RNA, 19 nt, Homo sapiens
gucugcgucgucaccaaau

SEQ ID NO: 696292 - RNA, 16 nt, Homo sapiens
gucugcuuugguacua

SEQ ID NO: 696293 - RNA, 18 nt, Homo sapiens
ucauaucaacuuagucaa

SEQ ID NO: 696294 - RNA, 18 nt, Homo sapiens
ucaucuggaguucucaaa

SEQ ID NO: 696295 - RNA, 22 nt, Homo sapiens
ucaugaaacuuguuucacugaa

SEQ ID NO: 696296 - RNA, 20 nt, Homo sapiens
ucaugggagggggcuugaag

SEQ ID NO: 696297 - RNA, 15 nt, Homo sapiens
ucauggugcacugag

SEQ ID NO: 696298 - RNA, 19 nt, Homo sapiens
ucauguguaauaugcacaa

SEQ ID NO: 696299 - RNA, 11 nt, Homo sapiens
ucauugcugag

SEQ ID NO: 696300 - RNA, 20 nt, Homo sapiens
uccaaauggagaagcugcag

SEQ ID NO: 696301 - RNA, 18 nt, Homo sapiens
uccaacccgccggucuca

SEQ ID NO: 696302 - RNA, 20 nt, Homo sapiens
uccaacccugccgucaccac

SEQ ID NO: 696303 - RNA, 14 nt, Homo sapiens
uccaacuauuuauu

SEQ ID NO: 696304 - RNA, 17 nt, Homo sapiens
uccacucguguguuucu

SEQ ID NO: 696305 - RNA, 16 nt, Homo sapiens
uccacuuauaaaggaa

SEQ ID NO: 696306 - RNA, 16 nt, Homo sapiens
uccagaucacugccac

SEQ ID NO: 696307 - RNA, 17 nt, Homo sapiens
uccagccucauaaagua

SEQ ID NO: 696308 - RNA, 16 nt, Homo sapiens
uccagccugggggaca

SEQ ID NO: 696309 - RNA, 15 nt, Homo sapiens
uccagcuuucugcca

SEQ ID NO: 696310 - RNA, 20 nt, Homo sapiens
uccaggaacugcaggucaag

SEQ ID NO: 696311 - RNA, 12 nt, Homo sapiens
uccaggugcaga

SEQ ID NO: 696312 - RNA, 14 nt, Homo sapiens
uccaguauaaccag

SEQ ID NO: 696313 - RNA, 11 nt, Homo sapiens
uccagugcagg

SEQ ID NO: 696314 - RNA, 15 nt, Homo sapiens
uccagugcaggagac

SEQ ID NO: 696315 - RNA, 21 nt, Homo sapiens
uccauaaacaugaaaacacuu

SEQ ID NO: 696316 - RNA, 17 nt, Homo sapiens
uccaucucugucucaaa

SEQ ID NO: 696317 - RNA, 21 nt, Homo sapiens
ucccaacuuguauuaaagaca

SEQ ID NO: 696318 - RNA, 17 nt, Homo sapiens
ucccacauccaacucca

SEQ ID NO: 696319 - RNA, 15 nt, Homo sapiens
ucccacuaaugcaaa

SEQ ID NO: 696320 - RNA, 15 nt, Homo sapiens
ucccagcuacuuggg

SEQ ID NO: 696321 - RNA, 22 nt, Homo sapiens
ucccauggguuguguguuuauu

SEQ ID NO: 696322 - RNA, 14 nt, Homo sapiens
uccccacacugacc

SEQ ID NO: 696323 - RNA, 13 nt, Homo sapiens
ucccccaguuccu

SEQ ID NO: 696324 - RNA, 21 nt, Homo sapiens
ucccccaguuccucccaggaa

SEQ ID NO: 696325 - RNA, 13 nt, Homo sapiens
uccccgugccaaa

SEQ ID NO: 696326 - RNA, 15 nt, Homo sapiens
uccccuaaaauaaca

SEQ ID NO: 696327 - RNA, 21 nt, Homo sapiens
uccccugaggaauaugucaua

SEQ ID NO: 696328 - RNA, 22 nt, Homo sapiens
ucccuaggaaacucacacuccc

SEQ ID NO: 696329 - RNA, 16 nt, Homo sapiens
ucccuccccagugcaa

SEQ ID NO: 696330 - RNA, 23 nt, Homo sapiens
ucccugcagaugccacccuagcc

SEQ ID NO: 696331 - RNA, 22 nt, Homo sapiens
ucccuguacaguagauuuucca

SEQ ID NO: 696332 - RNA, 15 nt, Homo sapiens
ucccuuccagcaaua

SEQ ID NO: 696333 - RNA, 12 nt, Homo sapiens
ucccuugagggc

SEQ ID NO: 696334 - RNA, 14 nt, Homo sapiens
uccgcccugccacu

SEQ ID NO: 696335 - RNA, 17 nt, Homo sapiens
uccggccucugccuuug

SEQ ID NO: 696336 - RNA, 22 nt, Homo sapiens
uccguaggccuuaaaucugccu

SEQ ID NO: 696337 - RNA, 24 nt, Homo sapiens
uccuaaagaaaaauaucuuggccu

SEQ ID NO: 696338 - RNA, 12 nt, Homo sapiens
uccuacacuuga

SEQ ID NO: 696339 - RNA, 15 nt, Homo sapiens
uccucgguucaaggu

SEQ ID NO: 696340 - RNA, 17 nt, Homo sapiens
uccugaagagcauuugg

SEQ ID NO: 696341 - RNA, 19 nt, Homo sapiens
uccugacagaaggugccac

SEQ ID NO: 696342 - RNA, 20 nt, Homo sapiens
uccugacugaaaguaggggg

SEQ ID NO: 696343 - RNA, 17 nt, Homo sapiens
uccugccuuucugcaaa

SEQ ID NO: 696344 - RNA, 21 nt, Homo sapiens
uccuggcagcccagagacuuu

SEQ ID NO: 696345 - RNA, 19 nt, Homo sapiens
uccugggcacgcacugggu

SEQ ID NO: 696346 - RNA, 13 nt, Homo sapiens
uccugugacuguc

SEQ ID NO: 696347 - RNA, 13 nt, Homo sapiens
uccugugauccac

SEQ ID NO: 696348 - RNA, 14 nt, Homo sapiens
uccuguguagcaua

SEQ ID NO: 696349 - RNA, 15 nt, Homo sapiens
uccuuacuuuacugc

SEQ ID NO: 696350 - RNA, 17 nt, Homo sapiens
uccuuccugaaacuaua

SEQ ID NO: 696351 - RNA, 20 nt, Homo sapiens
uccuuugccugauccuccaa

SEQ ID NO: 696352 - RNA, 16 nt, Homo sapiens
uccuuuuaagcaguga

SEQ ID NO: 696353 - RNA, 21 nt, Homo sapiens
ucgagccacaaccgaccagau

SEQ ID NO: 696354 - RNA, 16 nt, Homo sapiens
ucgagggacuuuaugu

SEQ ID NO: 696355 - RNA, 18 nt, Homo sapiens
ucgauuuucuauuaugga

SEQ ID NO: 696356 - RNA, 21 nt, Homo sapiens
ucgcaacuguccacgcgugcc

SEQ ID NO: 696357 - RNA, 19 nt, Homo sapiens
ucgcaucucagugcaggag

SEQ ID NO: 696358 - RNA, 19 nt, Homo sapiens
ucggaagggguuccucaaa

SEQ ID NO: 696359 - RNA, 22 nt, Homo sapiens
ucggucacuccaacucccuuaa

SEQ ID NO: 696360 - RNA, 15 nt, Homo sapiens
ucuaaaaucaugaaa

SEQ ID NO: 696361 - RNA, 21 nt, Homo sapiens
ucuaaacagugggaguaccaa

SEQ ID NO: 696362 - RNA, 16 nt, Homo sapiens
ucuaaagagcaucuga

SEQ ID NO: 696363 - RNA, 20 nt, Homo sapiens
ucuaaagguggugaggcaau

SEQ ID NO: 696364 - RNA, 17 nt, Homo sapiens
ucuaagagagcugccau

SEQ ID NO: 696365 - RNA, 18 nt, Homo sapiens
ucuacucaggcuggugga

SEQ ID NO: 696366 - RNA, 20 nt, Homo sapiens
ucuagagcuuaaugcuacau

SEQ ID NO: 696367 - RNA, 16 nt, Homo sapiens
ucuagguucugagcuc

SEQ ID NO: 696368 - RNA, 16 nt, Homo sapiens
ucuauaggaacauaug

SEQ ID NO: 696369 - RNA, 17 nt, Homo sapiens
ucucaaugaaccauaaa

SEQ ID NO: 696370 - RNA, 15 nt, Homo sapiens
gcugcuggugcacag

SEQ ID NO: 696371 - RNA, 17 nt, Homo sapiens
gcuggacuucuaccugc

SEQ ID NO: 696372 - RNA, 16 nt, Homo sapiens
aaaguauaaaauagua

SEQ ID NO: 696373 - RNA, 23 nt, Homo sapiens
aaaguauuuucuucucugugaga

SEQ ID NO: 696374 - RNA, 12 nt, Homo sapiens
aaagucagagac

SEQ ID NO: 696375 - RNA, 22 nt, Homo sapiens
aaagucagagacagauaccucc

SEQ ID NO: 696376 - RNA, 13 nt, Homo sapiens
aaagugccaaaga

SEQ ID NO: 696377 - RNA, 16 nt, Homo sapiens
aaaguggaaguaugua

SEQ ID NO: 696378 - RNA, 19 nt, Homo sapiens
aaaguguguuucuauguga

SEQ ID NO: 696379 - RNA, 13 nt, Homo sapiens
aaaguuugacagg

SEQ ID NO: 696380 - RNA, 14 nt, Homo sapiens
aaauaaaaacccaa

SEQ ID NO: 696381 - RNA, 14 nt, Homo sapiens
aaauaaugaauaca

SEQ ID NO: 696382 - RNA, 20 nt, Homo sapiens
aaauaauuauauaacuguau

SEQ ID NO: 696383 - RNA, 14 nt, Homo sapiens
aaauacacauagca

SEQ ID NO: 696384 - RNA, 16 nt, Homo sapiens
aaauauauucuuucaa

SEQ ID NO: 696385 - RNA, 18 nt, Homo sapiens
aaauaucaaagucauuaa

SEQ ID NO: 696386 - RNA, 17 nt, Homo sapiens
aaauaugccuaguaaca

SEQ ID NO: 696387 - RNA, 23 nt, Homo sapiens
aaauauuguugacaacugugacu

SEQ ID NO: 696388 - RNA, 15 nt, Homo sapiens
aaauauuucagugaa

SEQ ID NO: 696389 - RNA, 23 nt, Homo sapiens
aaauauuucccauuugugccaga

SEQ ID NO: 696390 - RNA, 15 nt, Homo sapiens
aaaucaaauauucca

SEQ ID NO: 696391 - RNA, 19 nt, Homo sapiens
aaaucacaaggcaacugug

SEQ ID NO: 696392 - RNA, 10 nt, Homo sapiens
aaaucacuuu

SEQ ID NO: 696393 - RNA, 21 nt, Homo sapiens
aaaucaugaaacuuguuucac

SEQ ID NO: 696394 - RNA, 13 nt, Homo sapiens
aaaucguccuccc

SEQ ID NO: 696395 - RNA, 14 nt, Homo sapiens
aaaucguccuccca

SEQ ID NO: 696396 - RNA, 16 nt, Homo sapiens
aaaugaaaacagugug

SEQ ID NO: 696397 - RNA, 22 nt, Homo sapiens
aaaugcauauuugcaaagugua

SEQ ID NO: 696398 - RNA, 11 nt, Homo sapiens
aaaugcauucg

SEQ ID NO: 696399 - RNA, 20 nt, Homo sapiens
aaauggaggaucucuaaaga

SEQ ID NO: 696400 - RNA, 18 nt, Homo sapiens
aaauggugagauguaugu

SEQ ID NO: 696401 - RNA, 18 nt, Homo sapiens
aaauguauaaauauacag

SEQ ID NO: 696402 - RNA, 22 nt, Homo sapiens
aaauguccaguaagaucacugu

SEQ ID NO: 696403 - RNA, 21 nt, Homo sapiens
aaauuaucuugauacauucaa

SEQ ID NO: 696404 - RNA, 13 nt, Homo sapiens
aaauuguguuucc

SEQ ID NO: 696405 - RNA, 18 nt, Homo sapiens
aaauuuaauaccagauac

SEQ ID NO: 696406 - RNA, 14 nt, Homo sapiens
aaauuucaccacug

SEQ ID NO: 696407 - RNA, 20 nt, Homo sapiens
aacaaugcugauuuggugac

SEQ ID NO: 696408 - RNA, 12 nt, Homo sapiens
aacacacaaaaa

SEQ ID NO: 696409 - RNA, 13 nt, Homo sapiens
aacaccucugcac

SEQ ID NO: 696410 - RNA, 22 nt, Homo sapiens
aacaccuucuauagcaucacuu

SEQ ID NO: 696411 - RNA, 21 nt, Homo sapiens
aacagaaauuguauauuguaa

SEQ ID NO: 696412 - RNA, 14 nt, Homo sapiens
aacagcaaguguga

SEQ ID NO: 696413 - RNA, 21 nt, Homo sapiens
aacaggguuugauagcacuua

SEQ ID NO: 696414 - RNA, 19 nt, Homo sapiens
aacagugguggcaacauuc

SEQ ID NO: 696415 - RNA, 22 nt, Homo sapiens
aacauacaaaugcaucuuugau

SEQ ID NO: 696416 - RNA, 21 nt, Homo sapiens
aacauaccguuuauaaugcca

SEQ ID NO: 696417 - RNA, 22 nt, Homo sapiens
aacauaccguuuauaaugccau

SEQ ID NO: 696418 - RNA, 21 nt, Homo sapiens
aacaugcggugccaugaaggg

SEQ ID NO: 696419 - RNA, 22 nt, Homo sapiens
aacauggugaaaccccgucucu

SEQ ID NO: 696420 - RNA, 18 nt, Homo sapiens
aacauuugcugccauuac

SEQ ID NO: 696421 - RNA, 14 nt, Homo sapiens
aaccacacuugaaa

SEQ ID NO: 696422 - RNA, 11 nt, Homo sapiens
aaccaccaaaa

SEQ ID NO: 696423 - RNA, 15 nt, Homo sapiens
aaccaccauagugaa

SEQ ID NO: 696424 - RNA, 22 nt, Homo sapiens
aaccacuucagcugacuuuucu

SEQ ID NO: 696425 - RNA, 22 nt, Homo sapiens
aaccaggaacucuggaguucau

SEQ ID NO: 696426 - RNA, 16 nt, Homo sapiens
aaccccaucucuacaa

SEQ ID NO: 696427 - RNA, 21 nt, Homo sapiens
aaccccuuccagaucacugcc

SEQ ID NO: 696428 - RNA, 17 nt, Homo sapiens
aacccuaucuccugaca

SEQ ID NO: 696429 - RNA, 19 nt, Homo sapiens
aacccuaucuccugacaga

SEQ ID NO: 696430 - RNA, 20 nt, Homo sapiens
aacccuuuuaaaguugauau

SEQ ID NO: 696431 - RNA, 18 nt, Homo sapiens
aaccgaauaaauguuuua

SEQ ID NO: 696432 - RNA, 19 nt, Homo sapiens
aaccgaguagaaaauguga

SEQ ID NO: 696433 - RNA, 14 nt, Homo sapiens
aaccuacccucagu

SEQ ID NO: 696434 - RNA, 23 nt, Homo sapiens
aaccucagggcucccaggggucu

SEQ ID NO: 696435 - RNA, 24 nt, Homo sapiens
aaccuuaaguaaucaucuaaguca

SEQ ID NO: 696436 - RNA, 20 nt, Homo sapiens
aaccuuguauaaauuauuca

SEQ ID NO: 696437 - RNA, 20 nt, Homo sapiens
aacgaagaguucccuugaaa

SEQ ID NO: 696438 - RNA, 24 nt, Homo sapiens
aacggcucagacaggcagauuuga

SEQ ID NO: 696439 - RNA, 19 nt, Homo sapiens
aacuacuucuuacuucuuu

SEQ ID NO: 696440 - RNA, 21 nt, Homo sapiens
aacuauacauuuauuguuacg

SEQ ID NO: 696441 - RNA, 16 nt, Homo sapiens
aacucaaacucuuaaa

SEQ ID NO: 696442 - RNA, 20 nt, Homo sapiens
aacucaaacucuuaaaaccc

SEQ ID NO: 696443 - RNA, 15 nt, Homo sapiens
aacuccaauacucac

SEQ ID NO: 696444 - RNA, 24 nt, Homo sapiens
aacucuccuuugcucucuggccac

SEQ ID NO: 696445 - RNA, 23 nt, Homo sapiens
ugaugagucgguccucuuuccag

SEQ ID NO: 696446 - RNA, 13 nt, Homo sapiens
ugaugauacuucc

SEQ ID NO: 696447 - RNA, 22 nt, Homo sapiens
ugaugcagucuuagaucauagu

SEQ ID NO: 696448 - RNA, 24 nt, Homo sapiens
ugauuccuuuccuaaaaguguaag

SEQ ID NO: 696449 - RNA, 23 nt, Homo sapiens
ugauuggaccaggccauucugcc

SEQ ID NO: 696450 - RNA, 14 nt, Homo sapiens
ugauuuaaaucagc

SEQ ID NO: 696451 - RNA, 20 nt, Homo sapiens
ugauuucaggagaaccuaac

SEQ ID NO: 696452 - RNA, 12 nt, Homo sapiens
ugauuugcaaua

SEQ ID NO: 696453 - RNA, 19 nt, Homo sapiens
ugcaaaggcgucugaaugu

SEQ ID NO: 696454 - RNA, 17 nt, Homo sapiens
ugcaaaguguauuagga

SEQ ID NO: 696455 - RNA, 14 nt, Homo sapiens
ugcaaaugcaugcu

SEQ ID NO: 696456 - RNA, 19 nt, Homo sapiens
ugcaaggccugguguuucu

SEQ ID NO: 696457 - RNA, 17 nt, Homo sapiens
ugcaauaacagcugcaa

SEQ ID NO: 696458 - RNA, 14 nt, Homo sapiens
ugcaccaccaagcc

SEQ ID NO: 696459 - RNA, 17 nt, Homo sapiens
ugcaccaccaagccaag

SEQ ID NO: 696460 - RNA, 23 nt, Homo sapiens
ugcacuuaaagaaguauuuuuag

SEQ ID NO: 696461 - RNA, 21 nt, Homo sapiens
ugcagcccuugugaugugauu

SEQ ID NO: 696462 - RNA, 17 nt, Homo sapiens
ugcaggagagacaguga

SEQ ID NO: 696463 - RNA, 17 nt, Homo sapiens
ugcaggauuucuucaca

SEQ ID NO: 696464 - RNA, 12 nt, Homo sapiens
ugcagucacugg

SEQ ID NO: 696465 - RNA, 14 nt, Homo sapiens
ugcagugaauucau

SEQ ID NO: 696466 - RNA, 15 nt, Homo sapiens
ugcagugaauucaua

SEQ ID NO: 696467 - RNA, 14 nt, Homo sapiens
ugcaguucuacuca

SEQ ID NO: 696468 - RNA, 15 nt, Homo sapiens
ugcaguuucuucauc

SEQ ID NO: 696469 - RNA, 14 nt, Homo sapiens
ugcauauuugcaaa

SEQ ID NO: 696470 - RNA, 12 nt, Homo sapiens
ugcaucagaaag

SEQ ID NO: 696471 - RNA, 17 nt, Homo sapiens
ugcaucuuugauguguu

SEQ ID NO: 696472 - RNA, 16 nt, Homo sapiens
ugcauuuuuagaccau

SEQ ID NO: 696473 - RNA, 15 nt, Homo sapiens
ugccaaaaaucuuuu

SEQ ID NO: 696474 - RNA, 16 nt, Homo sapiens
ugccaaccaguuugaa

SEQ ID NO: 696475 - RNA, 17 nt, Homo sapiens
ugccaaugaccaaacag

SEQ ID NO: 696476 - RNA, 15 nt, Homo sapiens
ugccaugccagcuua

SEQ ID NO: 696477 - RNA, 23 nt, Homo sapiens
ugccaugccagcuuaucucaggg

SEQ ID NO: 696478 - RNA, 23 nt, Homo sapiens
ugccauguggaaggcaagccagg

SEQ ID NO: 696479 - RNA, 21 nt, Homo sapiens
ugcccaggccucuggcuuuuu

SEQ ID NO: 696480 - RNA, 14 nt, Homo sapiens
ugccccucucacca

SEQ ID NO: 696481 - RNA, 18 nt, Homo sapiens
ugcccggcaggguccuag

SEQ ID NO: 696482 - RNA, 15 nt, Homo sapiens
ugccuaguaacacau

SEQ ID NO: 696483 - RNA, 16 nt, Homo sapiens
ugccuaucugaccaaa

SEQ ID NO: 696484 - RNA, 23 nt, Homo sapiens
ugccucucuuuuugggcuuucau

SEQ ID NO: 696485 - RNA, 16 nt, Homo sapiens
gaaagcccucaugugc

SEQ ID NO: 696486 - RNA, 20 nt, Homo sapiens
gaaagcccucaugugcagua

SEQ ID NO: 696487 - RNA, 18 nt, Homo sapiens
gaaagcuauauaagacaa

SEQ ID NO: 696488 - RNA, 15 nt, Homo sapiens
gaaagugaccauguu

SEQ ID NO: 696489 - RNA, 20 nt, Homo sapiens
gaaauaaaaaaugaaaaaca

SEQ ID NO: 696490 - RNA, 17 nt, Homo sapiens
gaaauuuuguaagaagg

SEQ ID NO: 696491 - RNA, 12 nt, Homo sapiens
gaacacugcacu

SEQ ID NO: 696492 - RNA, 13 nt, Homo sapiens
gaacaggccucuc

SEQ ID NO: 696493 - RNA, 12 nt, Homo sapiens
gaacaugaauca

SEQ ID NO: 696494 - RNA, 20 nt, Homo sapiens
gaacaugcccccugcagaca

SEQ ID NO: 696495 - RNA, 21 nt, Homo sapiens
gaaccacggaggaugaugcca

SEQ ID NO: 696496 - RNA, 13 nt, Homo sapiens
gaaccacuaugaa

SEQ ID NO: 696497 - RNA, 21 nt, Homo sapiens
gaaccauguggauaacuuuac

SEQ ID NO: 696498 - RNA, 22 nt, Homo sapiens
gaacccaagcuuagaacuuuaa

SEQ ID NO: 696499 - RNA, 13 nt, Homo sapiens
gaaccgcacagcu

SEQ ID NO: 696500 - RNA, 17 nt, Homo sapiens
gaaccgcacagcucagg

SEQ ID NO: 696501 - RNA, 17 nt, Homo sapiens
gaacuacuuuuggugcu

SEQ ID NO: 696502 - RNA, 16 nt, Homo sapiens
gaacucuggaguucau

SEQ ID NO: 696503 - RNA, 14 nt, Homo sapiens
gaacuuuuguacug

SEQ ID NO: 696504 - RNA, 14 nt, Homo sapiens
gaagagauccaaag

SEQ ID NO: 696505 - RNA, 16 nt, Homo sapiens
gaagagcgcaguguuu

SEQ ID NO: 696506 - RNA, 23 nt, Homo sapiens
gaagcacuccucgguacucccau

SEQ ID NO: 696507 - RNA, 12 nt, Homo sapiens
gaagccaaagaa

SEQ ID NO: 696508 - RNA, 20 nt, Homo sapiens
gaagccaggugagaaaacca

SEQ ID NO: 696509 - RNA, 18 nt, Homo sapiens
gaagcccaggagccucac

SEQ ID NO: 696510 - RNA, 22 nt, Homo sapiens
gaagcccaggagccucacuggg

SEQ ID NO: 696511 - RNA, 19 nt, Homo sapiens
gaaggcaagagggggugga

SEQ ID NO: 696512 - RNA, 20 nt, Homo sapiens
gaaguaaaagcaaguacucu

SEQ ID NO: 696513 - RNA, 16 nt, Homo sapiens
gaagucaauaugugga

SEQ ID NO: 696514 - RNA, 15 nt, Homo sapiens
gaaguuuacaaucaa

SEQ ID NO: 696515 - RNA, 18 nt, Homo sapiens
gaauaauacaguaucuca

SEQ ID NO: 696516 - RNA, 13 nt, Homo sapiens
gaauacugaugga

SEQ ID NO: 696517 - RNA, 18 nt, Homo sapiens
gaauauaaggaaagcaau

SEQ ID NO: 696518 - RNA, 22 nt, Homo sapiens
gaauaugauuaaaaauaucaaa

SEQ ID NO: 696519 - RNA, 22 nt, Homo sapiens
gaaucagcauuuagucuugcca

SEQ ID NO: 696520 - RNA, 19 nt, Homo sapiens
gaaugcaaccaagucacac

SEQ ID NO: 696521 - RNA, 15 nt, Homo sapiens
gaaugccacugccuu

SEQ ID NO: 696522 - RNA, 16 nt, Homo sapiens
gaauucaaacuggggc

SEQ ID NO: 696523 - RNA, 19 nt, Homo sapiens
gaauugucuuuggugcuuu

SEQ ID NO: 696524 - RNA, 22 nt, Homo sapiens
gacaaauauuccuuugcauauu

SEQ ID NO: 696525 - RNA, 11 nt, Homo sapiens
gacaacauguu

SEQ ID NO: 696526 - RNA, 12 nt, Homo sapiens
gacaagggauuu

SEQ ID NO: 696527 - RNA, 16 nt, Homo sapiens
gacaauaaacccucag

SEQ ID NO: 696528 - RNA, 21 nt, Homo sapiens
gacaauaaacccucagagccu

SEQ ID NO: 696529 - RNA, 21 nt, Homo sapiens
gacaauauuccagaucuuuca

SEQ ID NO: 696530 - RNA, 19 nt, Homo sapiens
gacaauguuguaguguccc

SEQ ID NO: 696531 - RNA, 14 nt, Homo sapiens
gacagugaacauuc

SEQ ID NO: 696532 - RNA, 16 nt, Homo sapiens
gacagugaacauucug

SEQ ID NO: 696533 - RNA, 16 nt, Homo sapiens
gacaguugcagcccuu

SEQ ID NO: 696534 - RNA, 22 nt, Homo sapiens
gacauaucaucuguggacugac

SEQ ID NO: 696535 - RNA, 18 nt, Homo sapiens
gacccauugcuguugucc

SEQ ID NO: 696536 - RNA, 14 nt, Homo sapiens
gacccuauugcugc

SEQ ID NO: 696537 - RNA, 18 nt, Homo sapiens
ggaggcuuccccucacua

SEQ ID NO: 696538 - RNA, 18 nt, Homo sapiens
ggaguguggccacguggg

SEQ ID NO: 696539 - RNA, 13 nt, Homo sapiens
ggaguuacuggau

SEQ ID NO: 696540 - RNA, 15 nt, Homo sapiens
ggauacuucauuaaa

SEQ ID NO: 696541 - RNA, 21 nt, Homo sapiens
ggaugccaaccggucacccag

SEQ ID NO: 696542 - RNA, 17 nt, Homo sapiens
ggaugcuaaaaauguca

SEQ ID NO: 696543 - RNA, 23 nt, Homo sapiens
ggcaagaggaauuacgugcucug

SEQ ID NO: 696544 - RNA, 22 nt, Homo sapiens
ggcaaugcccugugcaugccau

SEQ ID NO: 696545 - RNA, 22 nt, Homo sapiens
ggcaggccuauuucaucacaag

SEQ ID NO: 696546 - RNA, 22 nt, Homo sapiens
ggcaggcucacugccaggccag

SEQ ID NO: 696547 - RNA, 15 nt, Homo sapiens
ggcaggcugggccau

SEQ ID NO: 696548 - RNA, 20 nt, Homo sapiens
ggcaggcugggccaugucca

SEQ ID NO: 696549 - RNA, 21 nt, Homo sapiens
ggcauguaaauguaaacucag

SEQ ID NO: 696550 - RNA, 23 nt, Homo sapiens
ggccaagguggguggaucacuug

SEQ ID NO: 696551 - RNA, 16 nt, Homo sapiens
ggccauguccaaagag

SEQ ID NO: 696552 - RNA, 13 nt, Homo sapiens
ggccauuugcaau

SEQ ID NO: 696553 - RNA, 12 nt, Homo sapiens
ggcccagugcau

SEQ ID NO: 696554 - RNA, 13 nt, Homo sapiens
ggcccagugcaug

SEQ ID NO: 696555 - RNA, 15 nt, Homo sapiens
ggccuagcgaucucu

SEQ ID NO: 696556 - RNA, 22 nt, Homo sapiens
ggccugcgacccugggggcaca

SEQ ID NO: 696557 - RNA, 17 nt, Homo sapiens
ggccuggucguuuucaa

SEQ ID NO: 696558 - RNA, 19 nt, Homo sapiens
ggccuuccucucuccagau

SEQ ID NO: 696559 - RNA, 19 nt, Homo sapiens
ggccuuguccucagccagu

SEQ ID NO: 696560 - RNA, 20 nt, Homo sapiens
ggcgacagagcgagacuccg

SEQ ID NO: 696561 - RNA, 15 nt, Homo sapiens
ggcgcaucauaugca

SEQ ID NO: 696562 - RNA, 22 nt, Homo sapiens
ggcgcccuuggcuucugugaug

SEQ ID NO: 696563 - RNA, 15 nt, Homo sapiens
ggcgcugagacugug

SEQ ID NO: 696564 - RNA, 16 nt, Homo sapiens
ggcggcccugaccaau

SEQ ID NO: 696565 - RNA, 17 nt, Homo sapiens
ggcggcccugaccaaug

SEQ ID NO: 696566 - RNA, 22 nt, Homo sapiens
ggcgugguagcgggcgccugua

SEQ ID NO: 696567 - RNA, 19 nt, Homo sapiens
ggcuaugcgggggugccua

SEQ ID NO: 696568 - RNA, 17 nt, Homo sapiens
ggcucagacauguuuuc

SEQ ID NO: 696569 - RNA, 19 nt, Homo sapiens
ggcugcagugagcugagau

SEQ ID NO: 696570 - RNA, 17 nt, Homo sapiens
ggcugcaguucuacuca

SEQ ID NO: 696571 - RNA, 17 nt, Homo sapiens
ggcugccccucucacca

SEQ ID NO: 696572 - RNA, 17 nt, Homo sapiens
ggcuggcuccugaucca

SEQ ID NO: 696573 - RNA, 21 nt, Homo sapiens
ggcugucaaugggaccugugg

SEQ ID NO: 696574 - RNA, 22 nt, Homo sapiens
ggcuguugacgcaccugugguu

SEQ ID NO: 696575 - RNA, 13 nt, Homo sapiens
ggcuugaagccaa

SEQ ID NO: 696576 - RNA, 17 nt, Homo sapiens
ggcuuucccacuuccca

SEQ ID NO: 696577 - RNA, 14 nt, Homo sapiens
ggcuuucuugacau

SEQ ID NO: 696578 - RNA, 15 nt, Homo sapiens
gggacccagugcaga

SEQ ID NO: 696579 - RNA, 20 nt, Homo sapiens
gggaggcggagcuugcagug

SEQ ID NO: 696580 - RNA, 13 nt, Homo sapiens
gggaggcuucccc

SEQ ID NO: 696581 - RNA, 18 nt, Homo sapiens
gggaguauugaauggugg

SEQ ID NO: 696582 - RNA, 19 nt, Homo sapiens
gggcauccugugccacuaa

SEQ ID NO: 696583 - RNA, 12 nt, Homo sapiens
gggcauugccau

SEQ ID NO: 696584 - RNA, 16 nt, Homo sapiens
gggccauguccaaaga

SEQ ID NO: 696585 - RNA, 17 nt, Homo sapiens
gggccauguccaaagag

SEQ ID NO: 696586 - RNA, 21 nt, Homo sapiens
gggcccucggugggagccaug

SEQ ID NO: 696587 - RNA, 12 nt, Homo sapiens
gggcgcgguggc

SEQ ID NO: 696588 - RNA, 11 nt, Homo sapiens
gggcuuucaua

SEQ ID NO: 696589 - RNA, 15 nt, Homo sapiens
gggcuuucauagugu

SEQ ID NO: 696590 - RNA, 20 nt, Homo sapiens
ggggcagacaauaaacccuc

SEQ ID NO: 696591 - RNA, 16 nt, Homo sapiens
ggggccauuugcaaua

SEQ ID NO: 696592 - RNA, 23 nt, Homo sapiens
gggggcaacuggccauuugccaa

SEQ ID NO: 696593 - RNA, 15 nt, Homo sapiens
gggguggaggggugu

SEQ ID NO: 696594 - RNA, 12 nt, Homo sapiens
gggucuuugugg

SEQ ID NO: 696595 - RNA, 19 nt, Homo sapiens
gggugacagagcaagugag

SEQ ID NO: 696596 - RNA, 14 nt, Homo sapiens
gggugcuuccuugu

SEQ ID NO: 696597 - RNA, 17 nt, Homo sapiens
ggguuagauguugccau

SEQ ID NO: 696598 - RNA, 17 nt, Homo sapiens
gguaaaacucacuguga

SEQ ID NO: 696599 - RNA, 16 nt, Homo sapiens
gguacccagucaccuc

SEQ ID NO: 696600 - RNA, 22 nt, Homo sapiens
ggugagacccauggcuguguug

SEQ ID NO: 696601 - RNA, 14 nt, Homo sapiens
ggugaggcaauaaa

SEQ ID NO: 696602 - RNA, 16 nt, Homo sapiens
ggugaggguuggcgcu

SEQ ID NO: 696603 - RNA, 10 nt, Homo sapiens
ggugcacagc

SEQ ID NO: 696604 - RNA, 17 nt, Homo sapiens
gguggaggcugcaguga

SEQ ID NO: 696605 - RNA, 19 nt, Homo sapiens
gguggccgcugaguggcag

SEQ ID NO: 696606 - RNA, 22 nt, Homo sapiens
gguggucucuucuuggggccca

SEQ ID NO: 696607 - RNA, 20 nt, Homo sapiens
gguguuugaaaauaguuuau

SEQ ID NO: 696608 - RNA, 10 nt, Homo sapiens
cuucugccau

SEQ ID NO: 696609 - RNA, 20 nt, Homo sapiens
cuucuugccucugugcugug

SEQ ID NO: 696610 - RNA, 15 nt, Homo sapiens
cuugaaaauagaaca

SEQ ID NO: 696611 - RNA, 19 nt, Homo sapiens
cuugaauccuuccauucca

SEQ ID NO: 696612 - RNA, 23 nt, Homo sapiens
cuugagggcugcaguucuacuca

SEQ ID NO: 696613 - RNA, 12 nt, Homo sapiens
cuugagugcucu

SEQ ID NO: 696614 - RNA, 14 nt, Homo sapiens
cuugauaaacuagg

SEQ ID NO: 696615 - RNA, 18 nt, Homo sapiens
cuugauacauguaauucu

SEQ ID NO: 696616 - RNA, 18 nt, Homo sapiens
cuugauucagucacaugg

SEQ ID NO: 696617 - RNA, 20 nt, Homo sapiens
cuugcaccacuuccguccca

SEQ ID NO: 696618 - RNA, 12 nt, Homo sapiens
cuugccugauga

SEQ ID NO: 696619 - RNA, 18 nt, Homo sapiens
cuugccugcagggccaug

SEQ ID NO: 696620 - RNA, 19 nt, Homo sapiens
cuuggaagcacaccaaucu

SEQ ID NO: 696621 - RNA, 22 nt, Homo sapiens
cuuggagaaaugaaaacagugu

SEQ ID NO: 696622 - RNA, 15 nt, Homo sapiens
cuuggggcccagugc

SEQ ID NO: 696623 - RNA, 19 nt, Homo sapiens
cuuguaacaguuuugugua

SEQ ID NO: 696624 - RNA, 23 nt, Homo sapiens
cuuguauagcaugaaauaaaaua

SEQ ID NO: 696625 - RNA, 22 nt, Homo sapiens
cuuguggcuucucucucuagca

SEQ ID NO: 696626 - RNA, 14 nt, Homo sapiens
cuuguggguccaug

SEQ ID NO: 696627 - RNA, 22 nt, Homo sapiens
cuugugucuuuggaggugcugc

SEQ ID NO: 696628 - RNA, 15 nt, Homo sapiens
cuuguugacucagcu

SEQ ID NO: 696629 - RNA, 13 nt, Homo sapiens
cuuguugcucaaa

SEQ ID NO: 696630 - RNA, 16 nt, Homo sapiens
cuuguuuuugcacaug

SEQ ID NO: 696631 - RNA, 17 nt, Homo sapiens
cuuuacccaccuagaac

SEQ ID NO: 696632 - RNA, 14 nt, Homo sapiens
cuuuagacuugaaa

SEQ ID NO: 696633 - RNA, 16 nt, Homo sapiens
cuuuaggagauuuauu

SEQ ID NO: 696634 - RNA, 18 nt, Homo sapiens
cuuuauuugaacaaugaa

SEQ ID NO: 696635 - RNA, 20 nt, Homo sapiens
cuuucaagcagucgugccug

SEQ ID NO: 696636 - RNA, 21 nt, Homo sapiens
cuuucagaaagcuuugaauac

SEQ ID NO: 696637 - RNA, 22 nt, Homo sapiens
cuuugaauauguaguaucuaua

SEQ ID NO: 696638 - RNA, 21 nt, Homo sapiens
cuuugagaagccuucagcucc

SEQ ID NO: 696639 - RNA, 22 nt, Homo sapiens
cuuugagaggaagggugaagcc

SEQ ID NO: 696640 - RNA, 22 nt, Homo sapiens
cuuugaucccugacaucuggaa

SEQ ID NO: 696641 - RNA, 16 nt, Homo sapiens
cuuugauuauuugcau

SEQ ID NO: 696642 - RNA, 18 nt, Homo sapiens
cuuugauuauuugcaugu

SEQ ID NO: 696643 - RNA, 17 nt, Homo sapiens
cuuugcucucuggccac

SEQ ID NO: 696644 - RNA, 22 nt, Homo sapiens
cuuuggcccuauuuaaggcaga

SEQ ID NO: 696645 - RNA, 15 nt, Homo sapiens
cuuuguaagugcagg

SEQ ID NO: 696646 - RNA, 16 nt, Homo sapiens
cuuuguauauuacaua

SEQ ID NO: 696647 - RNA, 19 nt, Homo sapiens
cuuuguauauuacauacau

SEQ ID NO: 696648 - RNA, 15 nt, Homo sapiens
cuuugucuugccccu

SEQ ID NO: 696649 - RNA, 19 nt, Homo sapiens
cuuuuaaaaacauaacaua

SEQ ID NO: 696650 - RNA, 21 nt, Homo sapiens
cuuuuaccuagccacuuaaua

SEQ ID NO: 696651 - RNA, 12 nt, Homo sapiens
cuuuuacuguga

SEQ ID NO: 696652 - RNA, 19 nt, Homo sapiens
cuuuuauuaaugcacuuuc

SEQ ID NO: 696653 - RNA, 20 nt, Homo sapiens
cuuuucaaccacaaaacuca

SEQ ID NO: 696654 - RNA, 21 nt, Homo sapiens
cuuuugaauuaugcuuuguag

SEQ ID NO: 696655 - RNA, 17 nt, Homo sapiens
cuuuugugcaaagccaa

SEQ ID NO: 696656 - RNA, 22 nt, Homo sapiens
cuuuugugcaaagccaaaaccu

SEQ ID NO: 696657 - RNA, 14 nt, Homo sapiens
gaaaaacauuauuu

SEQ ID NO: 696658 - RNA, 20 nt, Homo sapiens
gaaaaagaccuaugagcaca

SEQ ID NO: 696659 - RNA, 14 nt, Homo sapiens
gaaaacauguuaau

SEQ ID NO: 696660 - RNA, 13 nt, Homo sapiens
gaaaacauuugcu

SEQ ID NO: 696661 - RNA, 14 nt, Homo sapiens
gaaaauaacaaagc

SEQ ID NO: 696662 - RNA, 12 nt, Homo sapiens
gaaaauaugccu

SEQ ID NO: 696663 - RNA, 15 nt, Homo sapiens
gaaacaaacaucuaa

SEQ ID NO: 696664 - RNA, 16 nt, Homo sapiens
gaaacaacacaguuuu

SEQ ID NO: 696665 - RNA, 13 nt, Homo sapiens
gaaacacugccuu

SEQ ID NO: 696666 - RNA, 23 nt, Homo sapiens
gaaaccagaaggauauuuacuac

SEQ ID NO: 696667 - RNA, 17 nt, Homo sapiens
gaaaccaggaacucugg

SEQ ID NO: 696668 - RNA, 15 nt, Homo sapiens
gaaacccccagugua

SEQ ID NO: 696669 - RNA, 18 nt, Homo sapiens
gaaacggaggccagagag

SEQ ID NO: 696670 - RNA, 14 nt, Homo sapiens
gaaacgucaugugu

SEQ ID NO: 696671 - RNA, 23 nt, Homo sapiens
gaaacuauauuuugucauaucaa

SEQ ID NO: 696672 - RNA, 21 nt, Homo sapiens
gaaacuuauuucucauaucaa

SEQ ID NO: 696673 - RNA, 18 nt, Homo sapiens
gaaagaugaucauuugua

SEQ ID NO: 696674 - RNA, 19 nt, Homo sapiens
aggaucccugaucccauuu

SEQ ID NO: 696675 - RNA, 23 nt, Homo sapiens
aggaugguagaaguuuggcugcu

SEQ ID NO: 696676 - RNA, 17 nt, Homo sapiens
aggcaguuggccagaga

SEQ ID NO: 696677 - RNA, 23 nt, Homo sapiens
aggccggaaaaggcgcaucuaac

SEQ ID NO: 696678 - RNA, 21 nt, Homo sapiens
aggccugccucccacuucacu

SEQ ID NO: 696679 - RNA, 18 nt, Homo sapiens
aggccugggccgcugcca

SEQ ID NO: 696680 - RNA, 15 nt, Homo sapiens
aggcuaaggcaggaa

SEQ ID NO: 696681 - RNA, 12 nt, Homo sapiens
aggcugcaguga

SEQ ID NO: 696682 - RNA, 18 nt, Homo sapiens
aggcugccccucucacca

SEQ ID NO: 696683 - RNA, 16 nt, Homo sapiens
aggcuuaaaaacugaa

SEQ ID NO: 696684 - RNA, 16 nt, Homo sapiens
agggaaaggggugcuu

SEQ ID NO: 696685 - RNA, 23 nt, Homo sapiens
agggaagaacuauugugcucaga

SEQ ID NO: 696686 - RNA, 20 nt, Homo sapiens
agggauauuuuuuucuauua

SEQ ID NO: 696687 - RNA, 17 nt, Homo sapiens
agggccugcccagacaa

SEQ ID NO: 696688 - RNA, 13 nt, Homo sapiens
aggggagacuuug

SEQ ID NO: 696689 - RNA, 13 nt, Homo sapiens
aggggcacagggu

SEQ ID NO: 696690 - RNA, 14 nt, Homo sapiens
aggggcuggcacug

SEQ ID NO: 696691 - RNA, 21 nt, Homo sapiens
aggguaaauaggaaucauuca

SEQ ID NO: 696692 - RNA, 15 nt, Homo sapiens
agggucccucugugu

SEQ ID NO: 696693 - RNA, 16 nt, Homo sapiens
agggucccucugugua

SEQ ID NO: 696694 - RNA, 21 nt, Homo sapiens
agggugcagcccaaucugcca

SEQ ID NO: 696695 - RNA, 18 nt, Homo sapiens
aggguuugauagcacuua

SEQ ID NO: 696696 - RNA, 21 nt, Homo sapiens
agguaccagcugcgcuugcuu

SEQ ID NO: 696697 - RNA, 15 nt, Homo sapiens
aggucaggaguucga

SEQ ID NO: 696698 - RNA, 15 nt, Homo sapiens
agguccagcucugga

SEQ ID NO: 696699 - RNA, 23 nt, Homo sapiens
aggucuauuuaaaaaaaaaguca

SEQ ID NO: 696700 - RNA, 18 nt, Homo sapiens
aggugcuggagcacuggg

SEQ ID NO: 696701 - RNA, 20 nt, Homo sapiens
aggugucuucuuugacuuaa

SEQ ID NO: 696702 - RNA, 20 nt, Homo sapiens
agguguuauaucuaugcaaa

SEQ ID NO: 696703 - RNA, 15 nt, Homo sapiens
agguucacaccauuu

SEQ ID NO: 696704 - RNA, 13 nt, Homo sapiens
agguucaguauua

SEQ ID NO: 696705 - RNA, 14 nt, Homo sapiens
agguuggcaaaaag

SEQ ID NO: 696706 - RNA, 17 nt, Homo sapiens
aguaaaggcugcugcua

SEQ ID NO: 696707 - RNA, 17 nt, Homo sapiens
aguaacauucauguucu

SEQ ID NO: 696708 - RNA, 14 nt, Homo sapiens
aguaagaauaccac

SEQ ID NO: 696709 - RNA, 14 nt, Homo sapiens
aguaagauaucuca

SEQ ID NO: 696710 - RNA, 19 nt, Homo sapiens
aguaauauagcugagacua

SEQ ID NO: 696711 - RNA, 20 nt, Homo sapiens
aguacacugccugccuuaag

SEQ ID NO: 696712 - RNA, 21 nt, Homo sapiens
aguaccaaagaaauuauaaac

SEQ ID NO: 696713 - RNA, 21 nt, Homo sapiens
aguagaacuuuguauaguuau

SEQ ID NO: 696714 - RNA, 16 nt, Homo sapiens
aguaugcacuuggccu

SEQ ID NO: 696715 - RNA, 22 nt, Homo sapiens
aguauguauuauuuacauuuaa

SEQ ID NO: 696716 - RNA, 18 nt, Homo sapiens
aguauucuuaguuguuca

SEQ ID NO: 696717 - RNA, 15 nt, Homo sapiens
aguauuuuucuugac

SEQ ID NO: 696718 - RNA, 15 nt, Homo sapiens
aguauuuuuucaagu

SEQ ID NO: 696719 - RNA, 14 nt, Homo sapiens
agucagagacagau

SEQ ID NO: 696720 - RNA, 12 nt, Homo sapiens
aguccauuuuaa

SEQ ID NO: 696721 - RNA, 16 nt, Homo sapiens
aguccuggaaucacau

SEQ ID NO: 696722 - RNA, 13 nt, Homo sapiens
agucuaaaacaca

SEQ ID NO: 696723 - RNA, 20 nt, Homo sapiens
agucuauaccauagcaaugu

SEQ ID NO: 696724 - RNA, 17 nt, Homo sapiens
agucucuucuaagcaaa

SEQ ID NO: 696725 - RNA, 15 nt, Homo sapiens
agucugaguaaaauc

SEQ ID NO: 696726 - RNA, 19 nt, Homo sapiens
agugcaggaaaccgaguag

SEQ ID NO: 696727 - RNA, 23 nt, Homo sapiens
cauuaaggggaagaaugaaagcu

SEQ ID NO: 696728 - RNA, 21 nt, Homo sapiens
cauuagaauuuacagcaagaa

SEQ ID NO: 696729 - RNA, 16 nt, Homo sapiens
cauuaugagaggcaau

SEQ ID NO: 696730 - RNA, 16 nt, Homo sapiens
cauuaugccacuuccu

SEQ ID NO: 696731 - RNA, 23 nt, Homo sapiens
cauucugccgcccccuccugaac

SEQ ID NO: 696732 - RNA, 23 nt, Homo sapiens
cauugaugcugcuggcuaagcau

SEQ ID NO: 696733 - RNA, 15 nt, Homo sapiens
cauugcacauaagcu

SEQ ID NO: 696734 - RNA, 22 nt, Homo sapiens
cauugcuguuguccaacuauuu

SEQ ID NO: 696735 - RNA, 21 nt, Homo sapiens
cauuucaucucauuuaaggga

SEQ ID NO: 696736 - RNA, 20 nt, Homo sapiens
cauuucauuaagguuccagu

SEQ ID NO: 696737 - RNA, 22 nt, Homo sapiens
cauuucauuaagguuccaguua

SEQ ID NO: 696738 - RNA, 21 nt, Homo sapiens
cauuuccucgcagccucucag

SEQ ID NO: 696739 - RNA, 20 nt, Homo sapiens
cauuucugagaucaaaacgg

SEQ ID NO: 696740 - RNA, 15 nt, Homo sapiens
cauuuuauaaauuca

SEQ ID NO: 696741 - RNA, 18 nt, Homo sapiens
cauuuuuuugcaugcaug

SEQ ID NO: 696742 - RNA, 15 nt, Homo sapiens
ccaaaaaacuacuuc

SEQ ID NO: 696743 - RNA, 23 nt, Homo sapiens
ccaaaauggucucuaacauuucc

SEQ ID NO: 696744 - RNA, 15 nt, Homo sapiens
ccaaaauucaucugu

SEQ ID NO: 696745 - RNA, 15 nt, Homo sapiens
ccaaaauucauuucu

SEQ ID NO: 696746 - RNA, 16 nt, Homo sapiens
ccaaaccuuaucucca

SEQ ID NO: 696747 - RNA, 19 nt, Homo sapiens
ccaaagauagacagguccu

SEQ ID NO: 696748 - RNA, 13 nt, Homo sapiens
ccaaccaguuuga

SEQ ID NO: 696749 - RNA, 17 nt, Homo sapiens
ccaaccggucacccagg

SEQ ID NO: 696750 - RNA, 15 nt, Homo sapiens
ccaacuaaaauuuga

SEQ ID NO: 696751 - RNA, 13 nt, Homo sapiens
ccaacucugggaa

SEQ ID NO: 696752 - RNA, 20 nt, Homo sapiens
ccaagaauauugcaaaauac

SEQ ID NO: 696753 - RNA, 22 nt, Homo sapiens
ccaagccuucgggcgucugugu

SEQ ID NO: 696754 - RNA, 21 nt, Homo sapiens
ccaaggaaacccccaguguaa

SEQ ID NO: 696755 - RNA, 22 nt, Homo sapiens
ccaaggaaacccccaguguaau

SEQ ID NO: 696756 - RNA, 17 nt, Homo sapiens
ccaagggaaaggggugc

SEQ ID NO: 696757 - RNA, 16 nt, Homo sapiens
ccaauauuuaccagac

SEQ ID NO: 696758 - RNA, 16 nt, Homo sapiens
ccacaaccgaccagau

SEQ ID NO: 696759 - RNA, 15 nt, Homo sapiens
ccacaauguuuauaa

SEQ ID NO: 696760 - RNA, 15 nt, Homo sapiens
ccacacagcagcagu

SEQ ID NO: 696761 - RNA, 21 nt, Homo sapiens
ccacagcgagggcagcugcua

SEQ ID NO: 696762 - RNA, 17 nt, Homo sapiens
ccaccaaagcugcccac

SEQ ID NO: 696763 - RNA, 12 nt, Homo sapiens
ccaccaccccua

SEQ ID NO: 696764 - RNA, 16 nt, Homo sapiens
ccaccaccccuaccac

SEQ ID NO: 696765 - RNA, 15 nt, Homo sapiens
ccaccaucaccagac

SEQ ID NO: 696766 - RNA, 19 nt, Homo sapiens
ccacccaacccuaucuccu

SEQ ID NO: 696767 - RNA, 14 nt, Homo sapiens
ccaccccaagagaa

SEQ ID NO: 696768 - RNA, 21 nt, Homo sapiens
ccacgugggcaaacaggcagu

SEQ ID NO: 696769 - RNA, 12 nt, Homo sapiens
ccacuaaacuac

SEQ ID NO: 696770 - RNA, 14 nt, Homo sapiens
ccacuaagaauuca

SEQ ID NO: 696771 - RNA, 22 nt, Homo sapiens
ccacuaauuguguacauaugua

SEQ ID NO: 696772 - RNA, 19 nt, Homo sapiens
ccacugugaagagaaccau

SEQ ID NO: 696773 - RNA, 21 nt, Homo sapiens
ccacuuccuuuuaacugccaa

SEQ ID NO: 696774 - RNA, 16 nt, Homo sapiens
ccagaaggauauuuac

SEQ ID NO: 696775 - RNA, 19 nt, Homo sapiens
ccagaggugucacccaaac

SEQ ID NO: 696776 - RNA, 12 nt, Homo sapiens
ccagagguugug

SEQ ID NO: 696777 - RNA, 17 nt, Homo sapiens
ccagaucacugccacac

SEQ ID NO: 696778 - RNA, 18 nt, Homo sapiens
ccagauguuuccagacuu

SEQ ID NO: 696779 - RNA, 19 nt, Homo sapiens
ccagccuccccgugccaaa

SEQ ID NO: 696780 - RNA, 21 nt, Homo sapiens
ccagccugcuagcuagcucaa

SEQ ID NO: 696781 - RNA, 21 nt, Homo sapiens
ccagcuggccuggacaguauc

SEQ ID NO: 696782 - RNA, 21 nt, Homo sapiens
ccaggaacagcaaaugcaaaa

SEQ ID NO: 696783 - RNA, 18 nt, Homo sapiens
ccaggagcaggcacgggu

SEQ ID NO: 696784 - RNA, 13 nt, Homo sapiens
ccaggagccucac

SEQ ID NO: 696785 - RNA, 17 nt, Homo sapiens
ccaggagccucacuggg

SEQ ID NO: 696786 - RNA, 14 nt, Homo sapiens
ccaggcaggggugg

SEQ ID NO: 696787 - RNA, 21 nt, Homo sapiens
ccaggcuggacgugguggcuc

SEQ ID NO: 696788 - RNA, 16 nt, Homo sapiens
ccagggcaagcuccgc

SEQ ID NO: 696789 - RNA, 18 nt, Homo sapiens
ccagugugggcuugacca

SEQ ID NO: 696790 - RNA, 13 nt, Homo sapiens
ccaguuacuugcu

SEQ ID NO: 696791 - RNA, 13 nt, Homo sapiens
ccauacacauucu

SEQ ID NO: 696792 - RNA, 13 nt, Homo sapiens
ccaucaauccuga

SEQ ID NO: 696793 - RNA, 23 nt, Homo sapiens
ccaucagugaaaaagauguacag

SEQ ID NO: 696794 - RNA, 16 nt, Homo sapiens
ccauccuguauucuuc

SEQ ID NO: 696795 - RNA, 19 nt, Homo sapiens
ccaucucuacaaaaagcau

SEQ ID NO: 696796 - RNA, 16 nt, Homo sapiens
ccauggcucagggugg

SEQ ID NO: 696797 - RNA, 13 nt, Homo sapiens
ccauguccaaaga

SEQ ID NO: 696798 - RNA, 17 nt, Homo sapiens
ccauuucugagaucaaa

SEQ ID NO: 696799 - RNA, 11 nt, Homo sapiens
ccauuugcaau

SEQ ID NO: 696800 - RNA, 12 nt, Homo sapiens
ccauuugcaaua

SEQ ID NO: 696801 - RNA, 16 nt, Homo sapiens
ccauuuuuaaaauaca

SEQ ID NO: 696802 - RNA, 16 nt, Homo sapiens
cccaaaaaacuacuuc

SEQ ID NO: 696803 - RNA, 21 nt, Homo sapiens
cccaaaccggcaggugcgauu

SEQ ID NO: 696804 - RNA, 18 nt, Homo sapiens
cccaacaagauugcuuaa

SEQ ID NO: 696805 - RNA, 15 nt, Homo sapiens
cccaacccuaucucc

SEQ ID NO: 696806 - RNA, 17 nt, Homo sapiens
cccaaucugccagacuu

SEQ ID NO: 696807 - RNA, 19 nt, Homo sapiens
cccacaccccaacacuucc

SEQ ID NO: 696808 - RNA, 22 nt, Homo sapiens
cccacacugaccuguguucccu

SEQ ID NO: 696809 - RNA, 17 nt, Homo sapiens
cccacauccaacuccag

SEQ ID NO: 696810 - RNA, 15 nt, Homo sapiens
cccaccgguccagcu

SEQ ID NO: 696811 - RNA, 16 nt, Homo sapiens
cccaccgguccagcug

SEQ ID NO: 696812 - RNA, 20 nt, Homo sapiens
cccaccuuuggaaagcucug

SEQ ID NO: 696813 - RNA, 13 nt, Homo sapiens
cccacugccagca

SEQ ID NO: 696814 - RNA, 21 nt, Homo sapiens
cccagauagcuggcugggugg

SEQ ID NO: 696815 - RNA, 18 nt, Homo sapiens
cccagccauccagggggc

SEQ ID NO: 696816 - RNA, 12 nt, Homo sapiens
cccagcuacucg

SEQ ID NO: 696817 - RNA, 15 nt, Homo sapiens
cccagcuacucggga

SEQ ID NO: 696818 - RNA, 19 nt, Homo sapiens
cccagcuuugcugccugag

SEQ ID NO: 696819 - RNA, 19 nt, Homo sapiens
cccagggcuccugcacuua

SEQ ID NO: 696820 - RNA, 13 nt, Homo sapiens
cccagggggcaug

SEQ ID NO: 696821 - RNA, 12 nt, Homo sapiens
cccaugcuuccu

SEQ ID NO: 696822 - RNA, 23 nt, Homo sapiens
ccccaagagaacucgcgcucagu

SEQ ID NO: 696823 - RNA, 22 nt, Homo sapiens
ccccacacugaccuguguuccc

SEQ ID NO: 696824 - RNA, 17 nt, Homo sapiens
ccccagcccuaaucuca

SEQ ID NO: 696825 - RNA, 19 nt, Homo sapiens
ccccaggggacaagggauu

SEQ ID NO: 696826 - RNA, 21 nt, Homo sapiens
ccccaguuccucccaggaagc

SEQ ID NO: 696827 - RNA, 12 nt, Homo sapiens
cccccaguguaa

SEQ ID NO: 696828 - RNA, 18 nt, Homo sapiens
ccccggccggccacccag

SEQ ID NO: 696829 - RNA, 22 nt, Homo sapiens
ccccuaaugccuaucugaccaa

SEQ ID NO: 696830 - RNA, 18 nt, Homo sapiens
ccccucaacaccucugca

SEQ ID NO: 696831 - RNA, 14 nt, Homo sapiens
ccccucucaccaaa

SEQ ID NO: 696832 - RNA, 18 nt, Homo sapiens
ccccuggaucuaccagca

SEQ ID NO: 696833 - RNA, 16 nt, Homo sapiens
cccggggugaguccau

SEQ ID NO: 696834 - RNA, 16 nt, Homo sapiens
cccuagccaaugucuc

SEQ ID NO: 696835 - RNA, 23 nt, Homo sapiens
cccucaacaccucugcacaagcu

SEQ ID NO: 696836 - RNA, 13 nt, Homo sapiens
cccucagagccuc

SEQ ID NO: 696837 - RNA, 23 nt, Homo sapiens
cccugccgucaccaccaccccua

SEQ ID NO: 696838 - RNA, 20 nt, Homo sapiens
cccuggaucuaccagcauaa

SEQ ID NO: 696839 - RNA, 14 nt, Homo sapiens
cccugucucaaaaa

SEQ ID NO: 696840 - RNA, 18 nt, Homo sapiens
cccuuaacugcauccagc

SEQ ID NO: 696841 - RNA, 19 nt, Homo sapiens
cccuuaaugaaauacauca

SEQ ID NO: 696842 - RNA, 14 nt, Homo sapiens
ccgugcguggcacu

SEQ ID NO: 696843 - RNA, 15 nt, Homo sapiens
ccuaaaagcacuccu

SEQ ID NO: 696844 - RNA, 14 nt, Homo sapiens
ccuaaaucacuuug

SEQ ID NO: 696845 - RNA, 16 nt, Homo sapiens
ccuaaaucacuuugag

SEQ ID NO: 696846 - RNA, 13 nt, Homo sapiens
acagaaauuguau

SEQ ID NO: 696847 - RNA, 12 nt, Homo sapiens
acagacugugag

SEQ ID NO: 696848 - RNA, 13 nt, Homo sapiens
acagacugugagu

SEQ ID NO: 696849 - RNA, 16 nt, Homo sapiens
acagaugugcugacaa

SEQ ID NO: 696850 - RNA, 17 nt, Homo sapiens
acaggaggcaggcaugg

SEQ ID NO: 696851 - RNA, 18 nt, Homo sapiens
acaggccucuccauuugc

SEQ ID NO: 696852 - RNA, 16 nt, Homo sapiens
acaguaucccacaucc

SEQ ID NO: 696853 - RNA, 21 nt, Homo sapiens
acaguaucccacauccaacuc

SEQ ID NO: 696854 - RNA, 23 nt, Homo sapiens
acaguaucuacuugcauguguau

SEQ ID NO: 696855 - RNA, 12 nt, Homo sapiens
acaguaucucag

SEQ ID NO: 696856 - RNA, 21 nt, Homo sapiens
acagucuccggccucuccagc

SEQ ID NO: 696857 - RNA, 11 nt, Homo sapiens
acauaauacug

SEQ ID NO: 696858 - RNA, 13 nt, Homo sapiens
acauagcaucuca

SEQ ID NO: 696859 - RNA, 13 nt, Homo sapiens
acauagugaaaau

SEQ ID NO: 696860 - RNA, 13 nt, Homo sapiens
acauauauauuac

SEQ ID NO: 696861 - RNA, 22 nt, Homo sapiens
acaucucaauaaagugcuuuaa

SEQ ID NO: 696862 - RNA, 19 nt, Homo sapiens
acaucuugaauccuuccau

SEQ ID NO: 696863 - RNA, 20 nt, Homo sapiens
acaugcggugccaugaaggg

SEQ ID NO: 696864 - RNA, 15 nt, Homo sapiens
acauggaugccaacc

SEQ ID NO: 696865 - RNA, 23 nt, Homo sapiens
acauggcuccggccucugccuuu

SEQ ID NO: 696866 - RNA, 21 nt, Homo sapiens
acauguuaaugacaauauucc

SEQ ID NO: 696867 - RNA, 22 nt, Homo sapiens
acauucauguucuagucugcuu

SEQ ID NO: 696868 - RNA, 21 nt, Homo sapiens
acauuuagcugugcucagaag

SEQ ID NO: 696869 - RNA, 11 nt, Homo sapiens
accaaccuggg

SEQ ID NO: 696870 - RNA, 14 nt, Homo sapiens
accaagguauacau

SEQ ID NO: 696871 - RNA, 16 nt, Homo sapiens
accaagguauacaucu

SEQ ID NO: 696872 - RNA, 13 nt, Homo sapiens
accaaugugugaa

SEQ ID NO: 696873 - RNA, 20 nt, Homo sapiens
accaaugugugaaguaugca

SEQ ID NO: 696874 - RNA, 15 nt, Homo sapiens
accaccaccaucacc

SEQ ID NO: 696875 - RNA, 21 nt, Homo sapiens
accaccaccucuaaugccucu

SEQ ID NO: 696876 - RNA, 17 nt, Homo sapiens
accaccuucuucuccua

SEQ ID NO: 696877 - RNA, 22 nt, Homo sapiens
accacgccucuugaccaggcug

SEQ ID NO: 696878 - RNA, 20 nt, Homo sapiens
accacggaggaugaugccag

SEQ ID NO: 696879 - RNA, 15 nt, Homo sapiens
accagagacuuuagg

SEQ ID NO: 696880 - RNA, 17 nt, Homo sapiens
accagcaucaccugccu

SEQ ID NO: 696881 - RNA, 17 nt, Homo sapiens
accagccccacugccag

SEQ ID NO: 696882 - RNA, 14 nt, Homo sapiens
accaggcuuggccu

SEQ ID NO: 696883 - RNA, 12 nt, Homo sapiens
accagugaaaag

SEQ ID NO: 696884 - RNA, 22 nt, Homo sapiens
accauaccgggucuugauucag

SEQ ID NO: 696885 - RNA, 17 nt, Homo sapiens
accauagugaaguguga

SEQ ID NO: 696886 - RNA, 19 nt, Homo sapiens
accauauugugcuucacag

SEQ ID NO: 696887 - RNA, 17 nt, Homo sapiens
accauauuuuuuguaaa

SEQ ID NO: 696888 - RNA, 14 nt, Homo sapiens
accauccuguauuc

SEQ ID NO: 696889 - RNA, 20 nt, Homo sapiens
accaugauuaaccacuucag

SEQ ID NO: 696890 - RNA, 24 nt, Homo sapiens
accaugauuaaccacuucagcuga

SEQ ID NO: 696891 - RNA, 12 nt, Homo sapiens
acccagccaggc

SEQ ID NO: 696892 - RNA, 9 nt, Homo sapiens
acccagugc

SEQ ID NO: 696893 - RNA, 11 nt, Homo sapiens
acccagugcag

SEQ ID NO: 696894 - RNA, 12 nt, Homo sapiens
acccagugcaga

SEQ ID NO: 696895 - RNA, 18 nt, Homo sapiens
accccaaacuguugauua

SEQ ID NO: 696896 - RNA, 15 nt, Homo sapiens
accccaagcaggaac

SEQ ID NO: 696897 - RNA, 16 nt, Homo sapiens
accccagccauccagg

SEQ ID NO: 696898 - RNA, 13 nt, Homo sapiens
acccccugcccug

SEQ ID NO: 696899 - RNA, 20 nt, Homo sapiens
accccggggacccugugaca

SEQ ID NO: 696900 - RNA, 16 nt, Homo sapiens
accccucaacaccucu

SEQ ID NO: 696901 - RNA, 17 nt, Homo sapiens
acccguggcugauggug

SEQ ID NO: 696902 - RNA, 16 nt, Homo sapiens
acccuaucuccugaca

SEQ ID NO: 696903 - RNA, 23 nt, Homo sapiens
acccuccguuuuucuacuagaua

SEQ ID NO: 696904 - RNA, 17 nt, Homo sapiens
acccucuccuccagugu

SEQ ID NO: 696905 - RNA, 19 nt, Homo sapiens
acccucuuagaaaaaccac

SEQ ID NO: 696906 - RNA, 21 nt, Homo sapiens
acccugguuauugauguggcc

SEQ ID NO: 696907 - RNA, 22 nt, Homo sapiens
accgcccaucaggguucucuua

SEQ ID NO: 696908 - RNA, 18 nt, Homo sapiens
accgugaagauacuuugu

SEQ ID NO: 696909 - RNA, 19 nt, Homo sapiens
accgugaagauacuuugua

SEQ ID NO: 696910 - RNA, 20 nt, Homo sapiens
accuaaauggccucaugugg

SEQ ID NO: 696911 - RNA, 17 nt, Homo sapiens
accuaagggaguagugu

SEQ ID NO: 696912 - RNA, 15 nt, Homo sapiens
accuagccacuuaau

SEQ ID NO: 696913 - RNA, 15 nt, Homo sapiens
accuagugaaacuuu

SEQ ID NO: 696914 - RNA, 18 nt, Homo sapiens
accucaaacuuccaguca

SEQ ID NO: 696915 - RNA, 12 nt, Homo sapiens
accuccacaccc

SEQ ID NO: 696916 - RNA, 21 nt, Homo sapiens
agaccuggcacuggaugcaga

SEQ ID NO: 696917 - RNA, 16 nt, Homo sapiens
agacgguuuccaggga

SEQ ID NO: 696918 - RNA, 13 nt, Homo sapiens
agacucagugcag

SEQ ID NO: 696919 - RNA, 15 nt, Homo sapiens
agacucagugcagau

SEQ ID NO: 696920 - RNA, 14 nt, Homo sapiens
agacuggcuuuuau

SEQ ID NO: 696921 - RNA, 20 nt, Homo sapiens
agacuuuacauggaugccaa

SEQ ID NO: 696922 - RNA, 23 nt, Homo sapiens
agacuuuaggaaugguucucuca

SEQ ID NO: 696923 - RNA, 18 nt, Homo sapiens
agagacgguguuuugcca

SEQ ID NO: 696924 - RNA, 19 nt, Homo sapiens
agagacgguguuuugccau

SEQ ID NO: 696925 - RNA, 13 nt, Homo sapiens
agagagccuggug

SEQ ID NO: 696926 - RNA, 22 nt, Homo sapiens
agagaguauuuuuauacaaacc

SEQ ID NO: 696927 - RNA, 16 nt, Homo sapiens
agagagucgcaucuca

SEQ ID NO: 696928 - RNA, 17 nt, Homo sapiens
agagauaagucuuucau

SEQ ID NO: 696929 - RNA, 15 nt, Homo sapiens
agagauccaaagacu

SEQ ID NO: 696930 - RNA, 15 nt, Homo sapiens
agagaugaaccacau

SEQ ID NO: 696931 - RNA, 19 nt, Homo sapiens
agagccucuggcaucucuu

SEQ ID NO: 696932 - RNA, 20 nt, Homo sapiens
agagcuauugccaaccaguu

SEQ ID NO: 696933 - RNA, 18 nt, Homo sapiens
agagcugccaucgcugug

SEQ ID NO: 696934 - RNA, 15 nt, Homo sapiens
agaggaaaaggcugg

SEQ ID NO: 696935 - RNA, 22 nt, Homo sapiens
agaggaaaccaguuuggugaua

SEQ ID NO: 696936 - RNA, 22 nt, Homo sapiens
agaggcaaugauuguuaauuua

SEQ ID NO: 696937 - RNA, 22 nt, Homo sapiens
agaggccgcgcguccagcugcc

SEQ ID NO: 696938 - RNA, 13 nt, Homo sapiens
agagggcuuccuc

SEQ ID NO: 696939 - RNA, 13 nt, Homo sapiens
agaggguacuuua

SEQ ID NO: 696940 - RNA, 21 nt, Homo sapiens
agagucgcaucucagugcagg

SEQ ID NO: 696941 - RNA, 11 nt, Homo sapiens
agagugguggg

SEQ ID NO: 696942 - RNA, 17 nt, Homo sapiens
agauaguguaacuugcu

SEQ ID NO: 696943 - RNA, 12 nt, Homo sapiens
agauccaaagac

SEQ ID NO: 696944 - RNA, 17 nt, Homo sapiens
agaucgcgccacugcac

SEQ ID NO: 696945 - RNA, 20 nt, Homo sapiens
agaucgcgccacugcacucc

SEQ ID NO: 696946 - RNA, 17 nt, Homo sapiens
agaucucgguuugccaa

SEQ ID NO: 696947 - RNA, 13 nt, Homo sapiens
agaugaaccacau

SEQ ID NO: 696948 - RNA, 15 nt, Homo sapiens
agauggaaaaacuga

SEQ ID NO: 696949 - RNA, 22 nt, Homo sapiens
agauggaaaaacugaggcuuag

SEQ ID NO: 696950 - RNA, 21 nt, Homo sapiens
agauguauuauaccagugaaa

SEQ ID NO: 696951 - RNA, 22 nt, Homo sapiens
agauguauuuguuguagacuua

SEQ ID NO: 696952 - RNA, 22 nt, Homo sapiens
agaugugaauuauugacacuga

SEQ ID NO: 696953 - RNA, 19 nt, Homo sapiens
agauguggcuacugacaua

SEQ ID NO: 696954 - RNA, 15 nt, Homo sapiens
agauuuucuuuugcc

SEQ ID NO: 696955 - RNA, 21 nt, Homo sapiens
agcaaauguuaaaaguuuuau

SEQ ID NO: 696956 - RNA, 16 nt, Homo sapiens
agcaagugugaauacu

SEQ ID NO: 696957 - RNA, 15 nt, Homo sapiens
agcaaguucugagag

SEQ ID NO: 696958 - RNA, 19 nt, Homo sapiens
agcaaguucugagagccag

SEQ ID NO: 696959 - RNA, 20 nt, Homo sapiens
agcaauuagauuaguauuuu

SEQ ID NO: 696960 - RNA, 15 nt, Homo sapiens
agcacaauuugcacu

SEQ ID NO: 696961 - RNA, 21 nt, Homo sapiens
agcacaauuugcacuaaauca

SEQ ID NO: 696962 - RNA, 18 nt, Homo sapiens
agcaggaaccccaggaga

SEQ ID NO: 696963 - RNA, 20 nt, Homo sapiens
agcauuuugcuaaaugugaa

SEQ ID NO: 696964 - RNA, 16 nt, Homo sapiens
agccaaugucuccucc

SEQ ID NO: 696965 - RNA, 14 nt, Homo sapiens
agccagaggcaucu

SEQ ID NO: 696966 - RNA, 16 nt, Homo sapiens
agccagaggcaucuga

SEQ ID NO: 696967 - RNA, 13 nt, Homo sapiens
agccagcccggcc

SEQ ID NO: 696968 - RNA, 11 nt, Homo sapiens
acaaugcugau

SEQ ID NO: 696969 - RNA, 14 nt, Homo sapiens
acacaaauucuaaa

SEQ ID NO: 696970 - RNA, 15 nt, Homo sapiens
acacagcagcaguua

SEQ ID NO: 696971 - RNA, 20 nt, Homo sapiens
acacauugcauuuugauaaa

SEQ ID NO: 696972 - RNA, 14 nt, Homo sapiens
acacccaagaagaa

SEQ ID NO: 696973 - RNA, 22 nt, Homo sapiens
acaccuaagagaaaaagaucga

SEQ ID NO: 696974 - RNA, 20 nt, Homo sapiens
acaccucuccuuugugacuu

SEQ ID NO: 696975 - RNA, 21 nt, Homo sapiens
acacggaugacuuaacugcau

SEQ ID NO: 696976 - RNA, 14 nt, Homo sapiens
acacuaacucacca

SEQ ID NO: 696977 - RNA, 15 nt, Homo sapiens
acacuaacucaccag

SEQ ID NO: 696978 - RNA, 16 nt, Homo sapiens
acacucaaaagcuggg

SEQ ID NO: 696979 - RNA, 14 nt, Homo sapiens
acacugaacuuaau

SEQ ID NO: 696980 - RNA, 22 nt, Homo sapiens
acacugcugcuccagugcagga

SEQ ID NO: 696981 - RNA, 12 nt, Homo sapiens
acagaacuacuu

SEQ ID NO: 696982 - RNA, 22 nt, Homo sapiens
acagacugugaguacagcagaa

SEQ ID NO: 696983 - RNA, 18 nt, Homo sapiens
acagccucugaaaaccaa

SEQ ID NO: 696984 - RNA, 15 nt, Homo sapiens
acaguagaacugucu

SEQ ID NO: 696985 - RNA, 14 nt, Homo sapiens
acagugaggcugca

SEQ ID NO: 696986 - RNA, 12 nt, Homo sapiens
acagugaugcug

SEQ ID NO: 696987 - RNA, 22 nt, Homo sapiens
acaguugaaaaacagcugaggg

SEQ ID NO: 696988 - RNA, 23 nt, Homo sapiens
acaguuuuuccuggaauugccag

SEQ ID NO: 696989 - RNA, 21 nt, Homo sapiens
acauaccguuuauaaugccau

SEQ ID NO: 696990 - RNA, 16 nt, Homo sapiens
acauacuccuuccauc

SEQ ID NO: 696991 - RNA, 19 nt, Homo sapiens
acauacuccuuccaucaaa

SEQ ID NO: 696992 - RNA, 16 nt, Homo sapiens
acauacuguucacuca

SEQ ID NO: 696993 - RNA, 12 nt, Homo sapiens
acauagccaaaa

SEQ ID NO: 696994 - RNA, 14 nt, Homo sapiens
acauauaguguaca

SEQ ID NO: 696995 - RNA, 15 nt, Homo sapiens
acauauauauuacaa

SEQ ID NO: 696996 - RNA, 15 nt, Homo sapiens
acauaucccuuccag

SEQ ID NO: 696997 - RNA, 19 nt, Homo sapiens
acauaucuacacuucgcac

SEQ ID NO: 696998 - RNA, 20 nt, Homo sapiens
acauauggauguuacucucu

SEQ ID NO: 696999 - RNA, 12 nt, Homo sapiens
acaucauuccuu

SEQ ID NO: 697000 - RNA, 15 nt, Homo sapiens
acauccaacuccagc

SEQ ID NO: 697001 - RNA, 17 nt, Homo sapiens
acauccaacuccagcaa

SEQ ID NO: 697002 - RNA, 19 nt, Homo sapiens
acauccgcgugugccugug

SEQ ID NO: 697003 - RNA, 22 nt, Homo sapiens
acaugaaucaaaagugccucaa

SEQ ID NO: 697004 - RNA, 15 nt, Homo sapiens
acaugcuuaccagau

SEQ ID NO: 697005 - RNA, 16 nt, Homo sapiens
acaugcuuugaaguuu

SEQ ID NO: 697006 - RNA, 18 nt, Homo sapiens
acauggucaaaauuucac

SEQ ID NO: 697007 - RNA, 15 nt, Homo sapiens
acauguaauuugaug

SEQ ID NO: 697008 - RNA, 23 nt, Homo sapiens
acauguuaaugacaauauuccag

SEQ ID NO: 697009 - RNA, 15 nt, Homo sapiens
acauugucaccauuu

SEQ ID NO: 697010 - RNA, 13 nt, Homo sapiens
acauuuccuuaca

SEQ ID NO: 697011 - RNA, 16 nt, Homo sapiens
acauuucuucuaguga

SEQ ID NO: 697012 - RNA, 17 nt, Homo sapiens
acauuuuuuugcaugca

SEQ ID NO: 697013 - RNA, 16 nt, Homo sapiens
accaaagagggcuucc

SEQ ID NO: 697014 - RNA, 18 nt, Homo sapiens
accaaagcugcccacugu

SEQ ID NO: 697015 - RNA, 19 nt, Homo sapiens
accaaguaaaacaaaacca

SEQ ID NO: 697016 - RNA, 16 nt, Homo sapiens
accaaucuuacuuugu

SEQ ID NO: 697017 - RNA, 21 nt, Homo sapiens
accaaugugugaaguaugcac

SEQ ID NO: 697018 - RNA, 14 nt, Homo sapiens
accaccaagccaag

SEQ ID NO: 697019 - RNA, 13 nt, Homo sapiens
accaccccuacca

SEQ ID NO: 697020 - RNA, 15 nt, Homo sapiens
accagaggagccuuu

SEQ ID NO: 697021 - RNA, 16 nt, Homo sapiens
accagauuaaacuuca

SEQ ID NO: 697022 - RNA, 18 nt, Homo sapiens
accagcgugugacuacuc

SEQ ID NO: 697023 - RNA, 22 nt, Homo sapiens
accaggcaccucuuccuugaug

SEQ ID NO: 697024 - RNA, 22 nt, Homo sapiens
accaguaaaggcugcugcuaca

SEQ ID NO: 697025 - RNA, 22 nt, Homo sapiens
accaguuuuuggauaaagaaua

SEQ ID NO: 697026 - RNA, 19 nt, Homo sapiens
accauggcaugguuauuga

SEQ ID NO: 697027 - RNA, 19 nt, Homo sapiens
accauguggcagaagggau

SEQ ID NO: 697028 - RNA, 21 nt, Homo sapiens
accauguggcagaagggauaa

SEQ ID NO: 697029 - RNA, 21 nt, Homo sapiens
accauucguacauaauacuga

SEQ ID NO: 697030 - RNA, 23 nt, Homo sapiens
accauuugauagggaacugggga

SEQ ID NO: 697031 - RNA, 14 nt, Homo sapiens
acccaccccagugc

SEQ ID NO: 697032 - RNA, 20 nt, Homo sapiens
acccaccuagaacacuaacu

SEQ ID NO: 697033 - RNA, 17 nt, Homo sapiens
acccaggaguguggcca

SEQ ID NO: 697034 - RNA, 16 nt, Homo sapiens
acccaguuagcucuca

SEQ ID NO: 697035 - RNA, 15 nt, Homo sapiens
acccauggcuguguu

SEQ ID NO: 697036 - RNA, 19 nt, Homo sapiens
accccagcugccaaggaaa

SEQ ID NO: 697037 - RNA, 19 nt, Homo sapiens
acccccguguccaccguga

SEQ ID NO: 697038 - RNA, 18 nt, Homo sapiens
acccccuguccugacucu

SEQ ID NO: 697039 - RNA, 21 nt, Homo sapiens
accccuuccagaucacugcca

SEQ ID NO: 697040 - RNA, 23 nt, Homo sapiens
acccuggagcccauccagucucc

SEQ ID NO: 697041 - RNA, 18 nt, Homo sapiens
acccugguuauugaugug

SEQ ID NO: 697042 - RNA, 20 nt, Homo sapiens
acccuuuggggguugaauag

SEQ ID NO: 697043 - RNA, 17 nt, Homo sapiens
accgcccaucaggguuc

SEQ ID NO: 697044 - RNA, 16 nt, Homo sapiens
accuagaacacuaacu

SEQ ID NO: 697045 - RNA, 18 nt, Homo sapiens
accuagaacacuaacuca

SEQ ID NO: 697046 - RNA, 17 nt, Homo sapiens
accuagaccuaaacggc

SEQ ID NO: 697047 - RNA, 19 nt, Homo sapiens
accuauuuccagaaauaca

SEQ ID NO: 697048 - RNA, 20 nt, Homo sapiens
accucaggugagaagcagag

SEQ ID NO: 697049 - RNA, 23 nt, Homo sapiens
augccacuuccuuuuaacugcca

SEQ ID NO: 697050 - RNA, 19 nt, Homo sapiens
augccagcuuaucucaggg

SEQ ID NO: 697051 - RNA, 14 nt, Homo sapiens
augccugcaaucug

SEQ ID NO: 697052 - RNA, 20 nt, Homo sapiens
augcgucccaagauguugau

SEQ ID NO: 697053 - RNA, 18 nt, Homo sapiens
augcugcaggacuugaga

SEQ ID NO: 697054 - RNA, 17 nt, Homo sapiens
augcuguacacauauuu

SEQ ID NO: 697055 - RNA, 21 nt, Homo sapiens
augcuuccuugccugaugaca

SEQ ID NO: 697056 - RNA, 23 nt, Homo sapiens
augcuucuucucaaagcacuguu

SEQ ID NO: 697057 - RNA, 15 nt, Homo sapiens
auggaacucagagau

SEQ ID NO: 697058 - RNA, 23 nt, Homo sapiens
auggacuggagcucaucugcaaa

SEQ ID NO: 697059 - RNA, 17 nt, Homo sapiens
auggccucauguggcug

SEQ ID NO: 697060 - RNA, 21 nt, Homo sapiens
augggagccuuuaccuuuuau

SEQ ID NO: 697061 - RNA, 16 nt, Homo sapiens
augguaauaagcacug

SEQ ID NO: 697062 - RNA, 20 nt, Homo sapiens
augguagaaguuuggcugcu

SEQ ID NO: 697063 - RNA, 14 nt, Homo sapiens
auggugaagugcuu

SEQ ID NO: 697064 - RNA, 23 nt, Homo sapiens
augguguagcccucccacuuugc

SEQ ID NO: 697065 - RNA, 20 nt, Homo sapiens
augguuacuucuucucuuag

SEQ ID NO: 697066 - RNA, 14 nt, Homo sapiens
auguaaaacaagaa

SEQ ID NO: 697067 - RNA, 14 nt, Homo sapiens
auguaaagugucag

SEQ ID NO: 697068 - RNA, 17 nt, Homo sapiens
auguaaauguaaacuca

SEQ ID NO: 697069 - RNA, 22 nt, Homo sapiens
auguagaagcaugaagucuuaa

SEQ ID NO: 697070 - RNA, 13 nt, Homo sapiens
auguaugucagaa

SEQ ID NO: 697071 - RNA, 21 nt, Homo sapiens
auguauguguuuagaauugaa

SEQ ID NO: 697072 - RNA, 21 nt, Homo sapiens
auguauuuauuugggagaccg

SEQ ID NO: 697073 - RNA, 16 nt, Homo sapiens
augucaacagagcaag

SEQ ID NO: 697074 - RNA, 18 nt, Homo sapiens
augucaacagagcaagga

SEQ ID NO: 697075 - RNA, 21 nt, Homo sapiens
augucaguacuauucagguaa

SEQ ID NO: 697076 - RNA, 17 nt, Homo sapiens
auguccagcaccuugug

SEQ ID NO: 697077 - RNA, 18 nt, Homo sapiens
augugaauuauugacacu

SEQ ID NO: 697078 - RNA, 21 nt, Homo sapiens
augugauggacacuccaggga

SEQ ID NO: 697079 - RNA, 22 nt, Homo sapiens
augugucaggugacccugauga

SEQ ID NO: 697080 - RNA, 15 nt, Homo sapiens
auguguggacugugg

SEQ ID NO: 697081 - RNA, 19 nt, Homo sapiens
auguguuucuccugagcua

SEQ ID NO: 697082 - RNA, 18 nt, Homo sapiens
auguuaaagagaaugagu

SEQ ID NO: 697083 - RNA, 23 nt, Homo sapiens
auguugauuuuuacuguguuuua

SEQ ID NO: 697084 - RNA, 16 nt, Homo sapiens
auuaacauaagaaaag

SEQ ID NO: 697085 - RNA, 13 nt, Homo sapiens
auuaaccuaauca

SEQ ID NO: 697086 - RNA, 17 nt, Homo sapiens
auuacacuuugaaguau

SEQ ID NO: 697087 - RNA, 22 nt, Homo sapiens
auuagcaaguuacagugaugcu

SEQ ID NO: 697088 - RNA, 23 nt, Homo sapiens
auuagccaagugugguagagugu

SEQ ID NO: 697089 - RNA, 12 nt, Homo sapiens
auuauaccagug

SEQ ID NO: 697090 - RNA, 19 nt, Homo sapiens
auuaucuugauacauucaa

SEQ ID NO: 697091 - RNA, 13 nt, Homo sapiens
auuauuaauugca

SEQ ID NO: 697092 - RNA, 13 nt, Homo sapiens
auuauugacacug

SEQ ID NO: 697093 - RNA, 13 nt, Homo sapiens
auucaacaaauau

SEQ ID NO: 697094 - RNA, 20 nt, Homo sapiens
auucacucccacacccaaga

SEQ ID NO: 697095 - RNA, 16 nt, Homo sapiens
auucagaaagucauag

SEQ ID NO: 697096 - RNA, 17 nt, Homo sapiens
auucagcucugcaagaa

SEQ ID NO: 697097 - RNA, 16 nt, Homo sapiens
auucagguaacacuag

SEQ ID NO: 697098 - RNA, 12 nt, Homo sapiens
auucagucacau

SEQ ID NO: 697099 - RNA, 22 nt, Homo sapiens
auucagucucuucuaagcaaaa

SEQ ID NO: 697100 - RNA, 14 nt, Homo sapiens
auuccacacugcac

SEQ ID NO: 697101 - RNA, 17 nt, Homo sapiens
auuccaggcagccucug

SEQ ID NO: 697102 - RNA, 20 nt, Homo sapiens
auucccaagguuacuggaua

SEQ ID NO: 697103 - RNA, 17 nt, Homo sapiens
auucgcugugucagcau

SEQ ID NO: 697104 - RNA, 20 nt, Homo sapiens
auugaccuauuuccagaaau

SEQ ID NO: 697105 - RNA, 19 nt, Homo sapiens
auugagaaagaaacuaaua

SEQ ID NO: 697106 - RNA, 14 nt, Homo sapiens
auugagagugauuc

SEQ ID NO: 697107 - RNA, 23 nt, Homo sapiens
auugaggccaagaauauugcaaa

SEQ ID NO: 697108 - RNA, 15 nt, Homo sapiens
auugaguuuuuacaa

SEQ ID NO: 697109 - RNA, 14 nt, Homo sapiens
auugcauacuuugu

SEQ ID NO: 697110 - RNA, 17 nt, Homo sapiens
auugccaaccaguuuga

SEQ ID NO: 697111 - RNA, 15 nt, Homo sapiens
auugcuaguuuauuu

SEQ ID NO: 697112 - RNA, 16 nt, Homo sapiens
auuguucaucaugaca

SEQ ID NO: 697113 - RNA, 17 nt, Homo sapiens
auuguugacaacuguga

SEQ ID NO: 697114 - RNA, 19 nt, Homo sapiens
auuguuuaaaaaccgaaua

SEQ ID NO: 697115 - RNA, 16 nt, Homo sapiens
auuuacuuccuugcau

SEQ ID NO: 697116 - RNA, 18 nt, Homo sapiens
auuuagaccccauacaag

SEQ ID NO: 697117 - RNA, 21 nt, Homo sapiens
auuuagaccccauacaaguuu

SEQ ID NO: 697118 - RNA, 23 nt, Homo sapiens
auuuagaccccauacaaguuuau

SEQ ID NO: 697119 - RNA, 19 nt, Homo sapiens
auuuaugacagugaacauu

SEQ ID NO: 697120 - RNA, 13 nt, Homo sapiens
auuuauguguaua

SEQ ID NO: 697121 - RNA, 17 nt, Homo sapiens
auuuauuuacagaugaa

SEQ ID NO: 697122 - RNA, 19 nt, Homo sapiens
auuucaaaauauacauuca

SEQ ID NO: 697123 - RNA, 17 nt, Homo sapiens
ccacuaaaaauauuguu

SEQ ID NO: 697124 - RNA, 22 nt, Homo sapiens
ccacugccuucgcuucuugccu

SEQ ID NO: 697125 - RNA, 10 nt, Homo sapiens
ccacugggag

SEQ ID NO: 697126 - RNA, 23 nt, Homo sapiens
ccacugugcuuucagaagugccc

SEQ ID NO: 697127 - RNA, 19 nt, Homo sapiens
ccagaaugcugcaggacuu

SEQ ID NO: 697128 - RNA, 14 nt, Homo sapiens
ccagaucacugcca

SEQ ID NO: 697129 - RNA, 13 nt, Homo sapiens
ccagaugccaggg

SEQ ID NO: 697130 - RNA, 18 nt, Homo sapiens
ccagauggucauccagac

SEQ ID NO: 697131 - RNA, 20 nt, Homo sapiens
ccagauguuuacagacugug

SEQ ID NO: 697132 - RNA, 20 nt, Homo sapiens
ccagauucuaccacacagca

SEQ ID NO: 697133 - RNA, 21 nt, Homo sapiens
ccagccagaggcaucugaggg

SEQ ID NO: 697134 - RNA, 18 nt, Homo sapiens
ccagcgugugacuacucc

SEQ ID NO: 697135 - RNA, 15 nt, Homo sapiens
ccagcuacucgggag

SEQ ID NO: 697136 - RNA, 14 nt, Homo sapiens
ccagcuuaucucag

SEQ ID NO: 697137 - RNA, 22 nt, Homo sapiens
ccaggagguggaggcugcagug

SEQ ID NO: 697138 - RNA, 21 nt, Homo sapiens
ccaggccaccuccccagcauu

SEQ ID NO: 697139 - RNA, 15 nt, Homo sapiens
ccagugcaaaugcau

SEQ ID NO: 697140 - RNA, 21 nt, Homo sapiens
ccagugcaaaugcaugcuucu

SEQ ID NO: 697141 - RNA, 18 nt, Homo sapiens
ccaguggaucauaagaca

SEQ ID NO: 697142 - RNA, 21 nt, Homo sapiens
ccaguuccucccccaguuccu

SEQ ID NO: 697143 - RNA, 19 nt, Homo sapiens
ccauagaaauguagguccu

SEQ ID NO: 697144 - RNA, 20 nt, Homo sapiens
ccauagucaaauuuguaaau

SEQ ID NO: 697145 - RNA, 22 nt, Homo sapiens
ccauauugugcuucacaguaga

SEQ ID NO: 697146 - RNA, 16 nt, Homo sapiens
ccauccugaccagcug

SEQ ID NO: 697147 - RNA, 22 nt, Homo sapiens
ccaugaaacuuuagagauuaac

SEQ ID NO: 697148 - RNA, 23 nt, Homo sapiens
ccaugaacagcauuagaauuuac

SEQ ID NO: 697149 - RNA, 15 nt, Homo sapiens
ccaugcuuccuugcc

SEQ ID NO: 697150 - RNA, 21 nt, Homo sapiens
ccauggcuguuggugggaccc

SEQ ID NO: 697151 - RNA, 19 nt, Homo sapiens
ccauguggcagaagggaua

SEQ ID NO: 697152 - RNA, 15 nt, Homo sapiens
ccauuaaaguucuca

SEQ ID NO: 697153 - RNA, 15 nt, Homo sapiens
ccauuugcucuucag

SEQ ID NO: 697154 - RNA, 14 nt, Homo sapiens
ccauuuuaaggaaa

SEQ ID NO: 697155 - RNA, 21 nt, Homo sapiens
cccaaagauagacagguccug

SEQ ID NO: 697156 - RNA, 20 nt, Homo sapiens
cccaagauuuuuuauuugag

SEQ ID NO: 697157 - RNA, 18 nt, Homo sapiens
cccaagccagcccggccg

SEQ ID NO: 697158 - RNA, 22 nt, Homo sapiens
cccaaucucugccauaucagug

SEQ ID NO: 697159 - RNA, 18 nt, Homo sapiens
cccacgagaccccggcuu

SEQ ID NO: 697160 - RNA, 19 nt, Homo sapiens
cccacuguuucucuugagc

SEQ ID NO: 697161 - RNA, 23 nt, Homo sapiens
cccagcccagggcuccugcacuu

SEQ ID NO: 697162 - RNA, 19 nt, Homo sapiens
cccagccuccccgugccaa

SEQ ID NO: 697163 - RNA, 20 nt, Homo sapiens
cccaggcuggacugcaauga

SEQ ID NO: 697164 - RNA, 20 nt, Homo sapiens
cccagugcaaaugcaugcuu

SEQ ID NO: 697165 - RNA, 19 nt, Homo sapiens
cccaucgugaagaagccug

SEQ ID NO: 697166 - RNA, 22 nt, Homo sapiens
ccccaacaaugugagggguccc

SEQ ID NO: 697167 - RNA, 13 nt, Homo sapiens
ccccaacacuucc

SEQ ID NO: 697168 - RNA, 23 nt, Homo sapiens
ccccaacaucucccucccacauu

SEQ ID NO: 697169 - RNA, 19 nt, Homo sapiens
ccccaguuccucccaggaa

SEQ ID NO: 697170 - RNA, 17 nt, Homo sapiens
ccccaucugccccacag

SEQ ID NO: 697171 - RNA, 13 nt, Homo sapiens
ccccaugcuuccu

SEQ ID NO: 697172 - RNA, 13 nt, Homo sapiens
cccccaguguaau

SEQ ID NO: 697173 - RNA, 14 nt, Homo sapiens
cccccaguguaaua

SEQ ID NO: 697174 - RNA, 21 nt, Homo sapiens
cccccaguuccucccaggaag

SEQ ID NO: 697175 - RNA, 19 nt, Homo sapiens
ccccuggaucuaccagcau

SEQ ID NO: 697176 - RNA, 16 nt, Homo sapiens
ccccuuccuucuuugu

SEQ ID NO: 697177 - RNA, 15 nt, Homo sapiens
cccgucgugcuuccu

SEQ ID NO: 697178 - RNA, 20 nt, Homo sapiens
cccgugacuguuacuuuaua

SEQ ID NO: 697179 - RNA, 22 nt, Homo sapiens
cccuacucccugcagaugccac

SEQ ID NO: 697180 - RNA, 16 nt, Homo sapiens
cccuagccaauucaca

SEQ ID NO: 697181 - RNA, 20 nt, Homo sapiens
cccuaggaaacucacacucc

SEQ ID NO: 697182 - RNA, 22 nt, Homo sapiens
cccuaguuaguguuuugccuca

SEQ ID NO: 697183 - RNA, 18 nt, Homo sapiens
cccucaacaccucugcac

SEQ ID NO: 697184 - RNA, 21 nt, Homo sapiens
cccucacuaauugguacuuuu

SEQ ID NO: 697185 - RNA, 15 nt, Homo sapiens
cccucuuccugugau

SEQ ID NO: 697186 - RNA, 16 nt, Homo sapiens
cccucuuccugugauc

SEQ ID NO: 697187 - RNA, 21 nt, Homo sapiens
cccugacaucuggaaucugga

SEQ ID NO: 697188 - RNA, 23 nt, Homo sapiens
cccugcagaugccacccuagcca

SEQ ID NO: 697189 - RNA, 17 nt, Homo sapiens
cccugcaguuugagaca

SEQ ID NO: 697190 - RNA, 13 nt, Homo sapiens
cccuuccagauca

SEQ ID NO: 697191 - RNA, 15 nt, Homo sapiens
cccuuccccaugcuu

SEQ ID NO: 697192 - RNA, 18 nt, Homo sapiens
cccuuggcuucugugaug

SEQ ID NO: 697193 - RNA, 13 nt, Homo sapiens
ccggcuuugccau

SEQ ID NO: 697194 - RNA, 22 nt, Homo sapiens
ccggggaagagauccaaagacu

SEQ ID NO: 697195 - RNA, 14 nt, Homo sapiens
ccguaccaaucucu

SEQ ID NO: 697196 - RNA, 18 nt, Homo sapiens
ccgugaagauacuuugua

SEQ ID NO: 697197 - RNA, 21 nt, Homo sapiens
ccgugccaaaaaucuuuucau

SEQ ID NO: 697198 - RNA, 15 nt, Homo sapiens
ccuaaaucacuuuga

SEQ ID NO: 697199 - RNA, 16 nt, Homo sapiens
ccuaaauguaaucacg

SEQ ID NO: 697200 - RNA, 23 nt, Homo sapiens
ccuaaauguaaucacgaguaaga

SEQ ID NO: 697201 - RNA, 20 nt, Homo sapiens
ccuaagguccuaaggcaucu

SEQ ID NO: 697202 - RNA, 12 nt, Homo sapiens
ccuaaugaaguu

SEQ ID NO: 697203 - RNA, 18 nt, Homo sapiens
ccuacaccucuugaaaau

SEQ ID NO: 697204 - RNA, 23 nt, Homo sapiens
ccuacaguugaaaaacagcugag

SEQ ID NO: 697205 - RNA, 19 nt, Homo sapiens
cagccugggugacagagca

SEQ ID NO: 697206 - RNA, 15 nt, Homo sapiens
cagcgccagccucag

SEQ ID NO: 697207 - RNA, 11 nt, Homo sapiens
cagcucugcaa

SEQ ID NO: 697208 - RNA, 15 nt, Homo sapiens
cagcucugcaagaau

SEQ ID NO: 697209 - RNA, 14 nt, Homo sapiens
cagcugccaaggaa

SEQ ID NO: 697210 - RNA, 17 nt, Homo sapiens
caggaagcccaggagcc

SEQ ID NO: 697211 - RNA, 17 nt, Homo sapiens
caggagacaaaagagca

SEQ ID NO: 697212 - RNA, 22 nt, Homo sapiens
caggagaccuggcacuggaugc

SEQ ID NO: 697213 - RNA, 12 nt, Homo sapiens
caggauugaaaa

SEQ ID NO: 697214 - RNA, 17 nt, Homo sapiens
caggcauagaggcuucu

SEQ ID NO: 697215 - RNA, 19 nt, Homo sapiens
caggccaaagugccgguga

SEQ ID NO: 697216 - RNA, 22 nt, Homo sapiens
caggcccuggccuccccugcca

SEQ ID NO: 697217 - RNA, 16 nt, Homo sapiens
caggcucacucacaga

SEQ ID NO: 697218 - RNA, 15 nt, Homo sapiens
caggcuggccagucc

SEQ ID NO: 697219 - RNA, 18 nt, Homo sapiens
caggcugggccaugucca

SEQ ID NO: 697220 - RNA, 19 nt, Homo sapiens
caggcugggccauguccaa

SEQ ID NO: 697221 - RNA, 22 nt, Homo sapiens
caggcugggccauguccaaaga

SEQ ID NO: 697222 - RNA, 23 nt, Homo sapiens
caggcugggccauguccaaagag

SEQ ID NO: 697223 - RNA, 22 nt, Homo sapiens
cagggacacacagccuagcaca

SEQ ID NO: 697224 - RNA, 21 nt, Homo sapiens
cagggugcagcccaaucugcc

SEQ ID NO: 697225 - RNA, 13 nt, Homo sapiens
cagguaaugugaa

SEQ ID NO: 697226 - RNA, 14 nt, Homo sapiens
cagguaaugugaau

SEQ ID NO: 697227 - RNA, 16 nt, Homo sapiens
caggugagaaaaccau

SEQ ID NO: 697228 - RNA, 14 nt, Homo sapiens
caggugagcaauua

SEQ ID NO: 697229 - RNA, 13 nt, Homo sapiens
caguaaacgggaa

SEQ ID NO: 697230 - RNA, 12 nt, Homo sapiens
caguaacuguca

SEQ ID NO: 697231 - RNA, 18 nt, Homo sapiens
caguaucccacauccaac

SEQ ID NO: 697232 - RNA, 16 nt, Homo sapiens
cagucacauggcaugg

SEQ ID NO: 697233 - RNA, 20 nt, Homo sapiens
cagucacauggcaugguuuu

SEQ ID NO: 697234 - RNA, 16 nt, Homo sapiens
cagugcaaaugcaugc

SEQ ID NO: 697235 - RNA, 15 nt, Homo sapiens
cagugccuauugaua

SEQ ID NO: 697236 - RNA, 18 nt, Homo sapiens
cagugggaguaccaaaga

SEQ ID NO: 697237 - RNA, 14 nt, Homo sapiens
caguuagcucucaa

SEQ ID NO: 697238 - RNA, 12 nt, Homo sapiens
caguucuacuca

SEQ ID NO: 697239 - RNA, 17 nt, Homo sapiens
caguuuauacccuaguu

SEQ ID NO: 697240 - RNA, 21 nt, Homo sapiens
caguuuugaccuaacauaccg

SEQ ID NO: 697241 - RNA, 21 nt, Homo sapiens
cauaaacaaguucgagucaaa

SEQ ID NO: 697242 - RNA, 22 nt, Homo sapiens
cauaaaucuuguaaucauguua

SEQ ID NO: 697243 - RNA, 21 nt, Homo sapiens
cauaagucgucacuaauacac

SEQ ID NO: 697244 - RNA, 12 nt, Homo sapiens
cauaauacauga

SEQ ID NO: 697245 - RNA, 21 nt, Homo sapiens
cauaauacugaaccacuugua

SEQ ID NO: 697246 - RNA, 15 nt, Homo sapiens
cauaauuuaaaaaua

SEQ ID NO: 697247 - RNA, 17 nt, Homo sapiens
cauacaugucacauuua

SEQ ID NO: 697248 - RNA, 16 nt, Homo sapiens
cauacuccuuccauca

SEQ ID NO: 697249 - RNA, 15 nt, Homo sapiens
cauagaaauguaggu

SEQ ID NO: 697250 - RNA, 19 nt, Homo sapiens
cauagaaauguagguccuc

SEQ ID NO: 697251 - RNA, 13 nt, Homo sapiens
cauagaggcuucu

SEQ ID NO: 697252 - RNA, 15 nt, Homo sapiens
cauaggaauugcaca

SEQ ID NO: 697253 - RNA, 22 nt, Homo sapiens
cauaguggguggauuuguugcc

SEQ ID NO: 697254 - RNA, 22 nt, Homo sapiens
cauaguuacuguguaaacucau

SEQ ID NO: 697255 - RNA, 19 nt, Homo sapiens
cauauauauauauaacaua

SEQ ID NO: 697256 - RNA, 13 nt, Homo sapiens
cauauauggaaga

SEQ ID NO: 697257 - RNA, 16 nt, Homo sapiens
cauaucaacuuaguca

SEQ ID NO: 697258 - RNA, 13 nt, Homo sapiens
cauaucagugaac

SEQ ID NO: 697259 - RNA, 22 nt, Homo sapiens
cauaucuacacuucgcaccgga

SEQ ID NO: 697260 - RNA, 18 nt, Homo sapiens
cauaugaaaaaaaugcau

SEQ ID NO: 697261 - RNA, 16 nt, Homo sapiens
cauaugcagugauaua

SEQ ID NO: 697262 - RNA, 14 nt, Homo sapiens
cauauguaaucucu

SEQ ID NO: 697263 - RNA, 16 nt, Homo sapiens
caucacccucuuccug

SEQ ID NO: 697264 - RNA, 21 nt, Homo sapiens
caucagguuccaguugcuuga

SEQ ID NO: 697265 - RNA, 13 nt, Homo sapiens
cauccagaggcaa

SEQ ID NO: 697266 - RNA, 12 nt, Homo sapiens
cauccuugaugc

SEQ ID NO: 697267 - RNA, 18 nt, Homo sapiens
caucgugaagaagccugu

SEQ ID NO: 697268 - RNA, 21 nt, Homo sapiens
caucuaaaguaaaaagggaau

SEQ ID NO: 697269 - RNA, 19 nt, Homo sapiens
caucuaauaaguauauaau

SEQ ID NO: 697270 - RNA, 15 nt, Homo sapiens
caucucagugcagga

SEQ ID NO: 697271 - RNA, 13 nt, Homo sapiens
caucucuacaaaa

SEQ ID NO: 697272 - RNA, 15 nt, Homo sapiens
caucuggaaucugga

SEQ ID NO: 697273 - RNA, 14 nt, Homo sapiens
caucuuccaacuca

SEQ ID NO: 697274 - RNA, 23 nt, Homo sapiens
caucuugaauccuuccauuccac

SEQ ID NO: 697275 - RNA, 10 nt, Homo sapiens
caucuuuaag

SEQ ID NO: 697276 - RNA, 20 nt, Homo sapiens
caugaaaaauauugcugaac

SEQ ID NO: 697277 - RNA, 14 nt, Homo sapiens
caugaaaacacuug

SEQ ID NO: 697278 - RNA, 19 nt, Homo sapiens
caugaagcuucaugcacuu

SEQ ID NO: 697279 - RNA, 17 nt, Homo sapiens
caugaaggcagagccau

SEQ ID NO: 697280 - RNA, 15 nt, Homo sapiens
caugagacucagugc

SEQ ID NO: 697281 - RNA, 23 nt, Homo sapiens
caugagauguguggacuguggca

SEQ ID NO: 697282 - RNA, 21 nt, Homo sapiens
caugcuuugaaguuucuggaa

SEQ ID NO: 697283 - RNA, 12 nt, Homo sapiens
cauggaugccaa

SEQ ID NO: 697284 - RNA, 15 nt, Homo sapiens
cauguaaaacaguua

SEQ ID NO: 697285 - RNA, 21 nt, Homo sapiens
cuuaauaaucaagagccuuaa

SEQ ID NO: 697286 - RNA, 15 nt, Homo sapiens
cuuaauaccaaacau

SEQ ID NO: 697287 - RNA, 17 nt, Homo sapiens
cuuaauaccaaacaugc

SEQ ID NO: 697288 - RNA, 14 nt, Homo sapiens
cuuaauauguucuu

SEQ ID NO: 697289 - RNA, 18 nt, Homo sapiens
cuuaaugcuacaugugag

SEQ ID NO: 697290 - RNA, 14 nt, Homo sapiens
cuuaaugguuuccu

SEQ ID NO: 697291 - RNA, 14 nt, Homo sapiens
cuuacguaguucua

SEQ ID NO: 697292 - RNA, 14 nt, Homo sapiens
cuuagaaaaaccac

SEQ ID NO: 697293 - RNA, 15 nt, Homo sapiens
cuuagauugaaucug

SEQ ID NO: 697294 - RNA, 18 nt, Homo sapiens
cuuagcaacucagagaaa

SEQ ID NO: 697295 - RNA, 22 nt, Homo sapiens
cuuaguuauauagcaucuggaa

SEQ ID NO: 697296 - RNA, 18 nt, Homo sapiens
cuuaguuguucaguugcc

SEQ ID NO: 697297 - RNA, 13 nt, Homo sapiens
cuucaaccaguga

SEQ ID NO: 697298 - RNA, 19 nt, Homo sapiens
cuucauauaccagcaauau

SEQ ID NO: 697299 - RNA, 15 nt, Homo sapiens
cuucaucccauucca

SEQ ID NO: 697300 - RNA, 17 nt, Homo sapiens
cuucaucucaccauccu

SEQ ID NO: 697301 - RNA, 13 nt, Homo sapiens
cuucccaugcauu

SEQ ID NO: 697302 - RNA, 17 nt, Homo sapiens
cuuccccaugcuuccuu

SEQ ID NO: 697303 - RNA, 16 nt, Homo sapiens
cuuccucuagaagcca

SEQ ID NO: 697304 - RNA, 15 nt, Homo sapiens
cuuccugugauccac

SEQ ID NO: 697305 - RNA, 22 nt, Homo sapiens
cuucuaauugcuguguguccca

SEQ ID NO: 697306 - RNA, 22 nt, Homo sapiens
cuucuaggauagcuaacuguaa

SEQ ID NO: 697307 - RNA, 14 nt, Homo sapiens
cuucucaaagcacu

SEQ ID NO: 697308 - RNA, 18 nt, Homo sapiens
cuucucagaagcacagaa

SEQ ID NO: 697309 - RNA, 20 nt, Homo sapiens
cuucucagauuucugaggaa

SEQ ID NO: 697310 - RNA, 15 nt, Homo sapiens
cuucucauuacuugu

SEQ ID NO: 697311 - RNA, 17 nt, Homo sapiens
cuucuccgccagccucc

SEQ ID NO: 697312 - RNA, 21 nt, Homo sapiens
cuucugugcccagaauacuga

SEQ ID NO: 697313 - RNA, 16 nt, Homo sapiens
cuucuuccuuaauuca

SEQ ID NO: 697314 - RNA, 18 nt, Homo sapiens
cuugaaauguaggcauca

SEQ ID NO: 697315 - RNA, 22 nt, Homo sapiens
cuugaagaaccucucacuucac

SEQ ID NO: 697316 - RNA, 11 nt, Homo sapiens
cuugaagccaa

SEQ ID NO: 697317 - RNA, 12 nt, Homo sapiens
cuugaagccaaa

SEQ ID NO: 697318 - RNA, 15 nt, Homo sapiens
cuugaagccaaagaa

SEQ ID NO: 697319 - RNA, 22 nt, Homo sapiens
cuugagaggguggaauauccaa

SEQ ID NO: 697320 - RNA, 15 nt, Homo sapiens
cuugcagaacuguag

SEQ ID NO: 697321 - RNA, 19 nt, Homo sapiens
cuugccuccaggugcagag

SEQ ID NO: 697322 - RNA, 16 nt, Homo sapiens
cuugcugugcuucaaa

SEQ ID NO: 697323 - RNA, 22 nt, Homo sapiens
cuugcuuuaccuuuucagggcu

SEQ ID NO: 697324 - RNA, 12 nt, Homo sapiens
cuuggaacauac

SEQ ID NO: 697325 - RNA, 22 nt, Homo sapiens
cuuggaacauacuguucacuca

SEQ ID NO: 697326 - RNA, 21 nt, Homo sapiens
cuuggagaaugugagaagcca

SEQ ID NO: 697327 - RNA, 17 nt, Homo sapiens
cuuggcuucugugauga

SEQ ID NO: 697328 - RNA, 16 nt, Homo sapiens
cuuggggccaccaaag

SEQ ID NO: 697329 - RNA, 17 nt, Homo sapiens
cuuggucccuccagaac

SEQ ID NO: 697330 - RNA, 19 nt, Homo sapiens
cuuguaaaagacaguguau

SEQ ID NO: 697331 - RNA, 22 nt, Homo sapiens
cuuguucaucauccagaugugg

SEQ ID NO: 697332 - RNA, 20 nt, Homo sapiens
cuuuaaaaguauccagagau

SEQ ID NO: 697333 - RNA, 21 nt, Homo sapiens
cuuuaaaauauuguugaacac

SEQ ID NO: 697334 - RNA, 14 nt, Homo sapiens
cuuuaccuuuucag

SEQ ID NO: 697335 - RNA, 17 nt, Homo sapiens
cuuuauaaauccaguga

SEQ ID NO: 697336 - RNA, 11 nt, Homo sapiens
cuuuaucucag

SEQ ID NO: 697337 - RNA, 16 nt, Homo sapiens
cuuucaucuuugugga

SEQ ID NO: 697338 - RNA, 13 nt, Homo sapiens
cuuuccuguucca

SEQ ID NO: 697339 - RNA, 18 nt, Homo sapiens
cuuucugcuaucaaagag

SEQ ID NO: 697340 - RNA, 13 nt, Homo sapiens
cuuucuguugcca

SEQ ID NO: 697341 - RNA, 11 nt, Homo sapiens
cuuucuucccu

SEQ ID NO: 697342 - RNA, 20 nt, Homo sapiens
cuuucuugaauuagcauuuu

SEQ ID NO: 697343 - RNA, 16 nt, Homo sapiens
cuuugcucucuggcca

SEQ ID NO: 697344 - RNA, 20 nt, Homo sapiens
cuuuggugcuuuucacuugu

SEQ ID NO: 697345 - RNA, 20 nt, Homo sapiens
cuuuguugcaagaugugaau

SEQ ID NO: 697346 - RNA, 18 nt, Homo sapiens
cuuuuaaaaacauaacau

SEQ ID NO: 697347 - RNA, 15 nt, Homo sapiens
cuuuuaaggcuaaaa

SEQ ID NO: 697348 - RNA, 13 nt, Homo sapiens
cuuuuaauucaaa

SEQ ID NO: 697349 - RNA, 15 nt, Homo sapiens
cuuuuauuuuacaca

SEQ ID NO: 697350 - RNA, 18 nt, Homo sapiens
cuuuucauuaaagaaugu

SEQ ID NO: 697351 - RNA, 20 nt, Homo sapiens
cuuuucuggggaaagacacu

SEQ ID NO: 697352 - RNA, 17 nt, Homo sapiens
cuuuugagaaccaagua

SEQ ID NO: 697353 - RNA, 13 nt, Homo sapiens
cuuuuguacugaa

SEQ ID NO: 697354 - RNA, 19 nt, Homo sapiens
gaaaaaguuaaacauugaa

SEQ ID NO: 697355 - RNA, 20 nt, Homo sapiens
gaaaacauagcaucucagga

SEQ ID NO: 697356 - RNA, 20 nt, Homo sapiens
gaaaacauggaacagugugg

SEQ ID NO: 697357 - RNA, 18 nt, Homo sapiens
gaaaacuucagaagcaaa

SEQ ID NO: 697358 - RNA, 14 nt, Homo sapiens
gaaaagaacuggaa

SEQ ID NO: 697359 - RNA, 20 nt, Homo sapiens
gaaaagagaaggaaagugau

SEQ ID NO: 697360 - RNA, 11 nt, Homo sapiens
gaaaagccuaa

SEQ ID NO: 697361 - RNA, 20 nt, Homo sapiens
gaaaagccuaaucacaguuu

SEQ ID NO: 697362 - RNA, 19 nt, Homo sapiens
gaaaaguguccuucuugcu

SEQ ID NO: 697363 - RNA, 23 nt, Homo sapiens
gaaaaguguccuucuugcucccc

SEQ ID NO: 697364 - RNA, 23 nt, Homo sapiens
gaaaaguguguauauauuuugug

SEQ ID NO: 697365 - RNA, 19 nt, Homo sapiens
gaaaauaacaaagcccuua

SEQ ID NO: 697366 - RNA, 14 nt, Homo sapiens
gaaaauagaacaac

SEQ ID NO: 697367 - RNA, 14 nt, Homo sapiens
gaaaaucauaggca

SEQ ID NO: 697368 - RNA, 22 nt, Homo sapiens
gaaaauuuuuaaauauucacaa

SEQ ID NO: 697369 - RNA, 17 nt, Homo sapiens
gaaacccccaguguaau

SEQ ID NO: 697370 - RNA, 14 nt, Homo sapiens
gaaacuaaagcaau

SEQ ID NO: 697371 - RNA, 19 nt, Homo sapiens
gaaacuaguguacauuucu

SEQ ID NO: 697372 - RNA, 15 nt, Homo sapiens
gaaacuauacauuua

SEQ ID NO: 697373 - RNA, 15 nt, Homo sapiens
gaaacuuauuucuca

SEQ ID NO: 697374 - RNA, 15 nt, Homo sapiens
gaaagaggaagcaaa

SEQ ID NO: 697375 - RNA, 21 nt, Homo sapiens
uuuuuguaugaaaacauggaa

SEQ ID NO: 697376 - RNA, 14 nt, Homo sapiens
uucuagugccucug

SEQ ID NO: 697377 - RNA, 15 nt, Homo sapiens
uucucugaucuccau

SEQ ID NO: 697378 - RNA, 22 nt, Homo sapiens
uucucuugagaggguggaauau

SEQ ID NO: 697379 - RNA, 20 nt, Homo sapiens
gagucuguacuaaacaguaa

SEQ ID NO: 697380 - RNA, 21 nt, Homo sapiens
gaguugauucagcucugcaag

SEQ ID NO: 697381 - RNA, 14 nt, Homo sapiens
gauaaaauuaauuu

SEQ ID NO: 697382 - RNA, 10 nt, Homo sapiens
gauaaacuag

SEQ ID NO: 697383 - RNA, 17 nt, Homo sapiens
gauacugcgacuuucug

SEQ ID NO: 697384 - RNA, 14 nt, Homo sapiens
gaucaaaaucaauu

SEQ ID NO: 697385 - RNA, 20 nt, Homo sapiens
gaucagccugggcaauguga

SEQ ID NO: 697386 - RNA, 17 nt, Homo sapiens
gaucgcgccacugcacu

SEQ ID NO: 697387 - RNA, 20 nt, Homo sapiens
gaucgcgccacugcacucca

SEQ ID NO: 697388 - RNA, 18 nt, Homo sapiens
gaucuuucugcaggaaau

SEQ ID NO: 697389 - RNA, 14 nt, Homo sapiens
gaugcaagugcaac

SEQ ID NO: 697390 - RNA, 13 nt, Homo sapiens
gauggauuuccag

SEQ ID NO: 697391 - RNA, 19 nt, Homo sapiens
gaugugaauuauugacacu

SEQ ID NO: 697392 - RNA, 18 nt, Homo sapiens
gauuagugucucaugugg

SEQ ID NO: 697393 - RNA, 17 nt, Homo sapiens
gauucugguuccagggu

SEQ ID NO: 697394 - RNA, 17 nt, Homo sapiens
gauuguucaucaugaca

SEQ ID NO: 697395 - RNA, 14 nt, Homo sapiens
gauuucaugccugg

SEQ ID NO: 697396 - RNA, 22 nt, Homo sapiens
gauuugauugggaugaaugcca

SEQ ID NO: 697397 - RNA, 13 nt, Homo sapiens
gauuuggugacca

SEQ ID NO: 697398 - RNA, 13 nt, Homo sapiens
gauuuuugcaaua

SEQ ID NO: 697399 - RNA, 12 nt, Homo sapiens
gcaaacaaguug

SEQ ID NO: 697400 - RNA, 15 nt, Homo sapiens
gcaaagccaaaaccu

SEQ ID NO: 697401 - RNA, 12 nt, Homo sapiens
aaaaaaaauccc

SEQ ID NO: 697402 - RNA, 13 nt, Homo sapiens
aaaaaaagucaga

SEQ ID NO: 697403 - RNA, 17 nt, Homo sapiens
aaaaaccccaaacuguu

SEQ ID NO: 697404 - RNA, 17 nt, Homo sapiens
aaaaaccgaauaaaugu

SEQ ID NO: 697405 - RNA, 11 nt, Homo sapiens
aaaaacuacuu

SEQ ID NO: 697406 - RNA, 18 nt, Homo sapiens
aaaaagcaucuaucucau

SEQ ID NO: 697407 - RNA, 14 nt, Homo sapiens
aaaaagccugugaa

SEQ ID NO: 697408 - RNA, 11 nt, Homo sapiens
aaaaagggaau

SEQ ID NO: 697409 - RNA, 15 nt, Homo sapiens
aaaaaggucuuuaaa

SEQ ID NO: 697410 - RNA, 23 nt, Homo sapiens
aaaaauauuguuucugcauucau

SEQ ID NO: 697411 - RNA, 17 nt, Homo sapiens
aaaaaucauaguacucu

SEQ ID NO: 697412 - RNA, 23 nt, Homo sapiens
aaaaauggauacuggugcaguca

SEQ ID NO: 697413 - RNA, 13 nt, Homo sapiens
aaaacauuugcug

SEQ ID NO: 697414 - RNA, 22 nt, Homo sapiens
aaaaccacugggaggagucuau

SEQ ID NO: 697415 - RNA, 18 nt, Homo sapiens
aaaaccuacccucaguga

SEQ ID NO: 697416 - RNA, 13 nt, Homo sapiens
aaaaccuucccca

SEQ ID NO: 697417 - RNA, 11 nt, Homo sapiens
aaaacuacuuc

SEQ ID NO: 697418 - RNA, 19 nt, Homo sapiens
aaaacuaggaauccuccaa

SEQ ID NO: 697419 - RNA, 16 nt, Homo sapiens
aaaacuauuauaugua

SEQ ID NO: 697420 - RNA, 15 nt, Homo sapiens
aaaagaaugacuaua

SEQ ID NO: 697421 - RNA, 23 nt, Homo sapiens
aaaagaugcuucucacugccaug

SEQ ID NO: 697422 - RNA, 13 nt, Homo sapiens
aaaagcugggcag

SEQ ID NO: 697423 - RNA, 16 nt, Homo sapiens
aaaaggauaguaagca

SEQ ID NO: 697424 - RNA, 15 nt, Homo sapiens
aaaauauacauucaa

SEQ ID NO: 697425 - RNA, 13 nt, Homo sapiens
aaaaugucaaaag

SEQ ID NO: 697426 - RNA, 23 nt, Homo sapiens
aaaaugugacccuccaaauggag

SEQ ID NO: 697427 - RNA, 13 nt, Homo sapiens
aaaauucaucugu

SEQ ID NO: 697428 - RNA, 20 nt, Homo sapiens
aaacaaaauggguuacuuga

SEQ ID NO: 697429 - RNA, 22 nt, Homo sapiens
aaacagccucuuuuugauacug

SEQ ID NO: 697430 - RNA, 14 nt, Homo sapiens
aaacagcugagggu

SEQ ID NO: 697431 - RNA, 22 nt, Homo sapiens
aaacaggcaguuggccagagag

SEQ ID NO: 697432 - RNA, 11 nt, Homo sapiens
aaacauuugcu

SEQ ID NO: 697433 - RNA, 17 nt, Homo sapiens
aaaccaggaacucugga

SEQ ID NO: 697434 - RNA, 22 nt, Homo sapiens
aaaccauggucucucugcuugc

SEQ ID NO: 697435 - RNA, 23 nt, Homo sapiens
aaacccaagugccuucagaggau

SEQ ID NO: 697436 - RNA, 17 nt, Homo sapiens
aaacccccaguguaaua

SEQ ID NO: 697437 - RNA, 13 nt, Homo sapiens
aaaccccgucucu

SEQ ID NO: 697438 - RNA, 13 nt, Homo sapiens
aaaccuaccaaaa

SEQ ID NO: 697439 - RNA, 17 nt, Homo sapiens
aaaccuacccucaguga

SEQ ID NO: 697440 - RNA, 16 nt, Homo sapiens
aaaccuaggucuccag

SEQ ID NO: 697441 - RNA, 12 nt, Homo sapiens
aaacuacuucuu

SEQ ID NO: 697442 - RNA, 18 nt, Homo sapiens
aaacuaugaggacugccu

SEQ ID NO: 697443 - RNA, 15 nt, Homo sapiens
aaacucagcaucaaa

SEQ ID NO: 697444 - RNA, 20 nt, Homo sapiens
aaacucaucuggaguucuca

SEQ ID NO: 697445 - RNA, 20 nt, Homo sapiens
aaacugagaaauuuacuaca

SEQ ID NO: 697446 - RNA, 15 nt, Homo sapiens
aaacuuaacauucau

SEQ ID NO: 697447 - RNA, 13 nt, Homo sapiens
aaacuuccaguca

SEQ ID NO: 697448 - RNA, 12 nt, Homo sapiens
aaacuuugcaga

SEQ ID NO: 697449 - RNA, 14 nt, Homo sapiens
aaagaccugagaac

SEQ ID NO: 697450 - RNA, 16 nt, Homo sapiens
aaagacuggcuuuuau

SEQ ID NO: 697451 - RNA, 17 nt, Homo sapiens
aaagagacuccgucuca

SEQ ID NO: 697452 - RNA, 19 nt, Homo sapiens
aaagagagucgcaucucag

SEQ ID NO: 697453 - RNA, 18 nt, Homo sapiens
aaagauuuucugguucua

SEQ ID NO: 697454 - RNA, 17 nt, Homo sapiens
aaagcgcuuuuccuugg

SEQ ID NO: 697455 - RNA, 11 nt, Homo sapiens
aaagcuucccc

SEQ ID NO: 697456 - RNA, 23 nt, Homo sapiens
aaagcuuggagggaagccgugaa

SEQ ID NO: 697457 - RNA, 15 nt, Homo sapiens
aaaggccucuuguaa

SEQ ID NO: 697458 - RNA, 15 nt, Homo sapiens
aguuccucccaggaa

SEQ ID NO: 697459 - RNA, 16 nt, Homo sapiens
aguucucaaagaccug

SEQ ID NO: 697460 - RNA, 20 nt, Homo sapiens
aguucuggugaauguucaau

SEQ ID NO: 697461 - RNA, 21 nt, Homo sapiens
aguuggugcuuuugagaacca

SEQ ID NO: 697462 - RNA, 23 nt, Homo sapiens
aguuguuggcaagguagcaauac

SEQ ID NO: 697463 - RNA, 14 nt, Homo sapiens
aguuuaugauggaa

SEQ ID NO: 697464 - RNA, 18 nt, Homo sapiens
aguuucugugguuggcug

SEQ ID NO: 697465 - RNA, 22 nt, Homo sapiens
aguuuggcugcugucauaacau

SEQ ID NO: 697466 - RNA, 18 nt, Homo sapiens
aguuugugagaaacaucu

SEQ ID NO: 697467 - RNA, 14 nt, Homo sapiens
aguuuuaacuguaa

SEQ ID NO: 697468 - RNA, 19 nt, Homo sapiens
aguuuuccuacacuugaga

SEQ ID NO: 697469 - RNA, 13 nt, Homo sapiens
auaaaacggugcu

SEQ ID NO: 697470 - RNA, 22 nt, Homo sapiens
auaaaauaauuauaaauaucau

SEQ ID NO: 697471 - RNA, 17 nt, Homo sapiens
auaaaauguaauuacuu

SEQ ID NO: 697472 - RNA, 18 nt, Homo sapiens
auaaaauugaaaguaaua

SEQ ID NO: 697473 - RNA, 16 nt, Homo sapiens
auaaaccaaaggaaaa

SEQ ID NO: 697474 - RNA, 17 nt, Homo sapiens
auaaacuauacacuuaa

SEQ ID NO: 697475 - RNA, 23 nt, Homo sapiens
auaaacuauacacuuaaugauac

SEQ ID NO: 697476 - RNA, 14 nt, Homo sapiens
auaaagaauacuau

SEQ ID NO: 697477 - RNA, 14 nt, Homo sapiens
auaaagcauguuca

SEQ ID NO: 697478 - RNA, 14 nt, Homo sapiens
auaaaggauaaaga

SEQ ID NO: 697479 - RNA, 15 nt, Homo sapiens
auaaagugcuuuaaa

SEQ ID NO: 697480 - RNA, 14 nt, Homo sapiens
auaaauauacagua

SEQ ID NO: 697481 - RNA, 15 nt, Homo sapiens
auaaaucaaauauuc

SEQ ID NO: 697482 - RNA, 20 nt, Homo sapiens
auaaaucauucuuacuaaaa

SEQ ID NO: 697483 - RNA, 21 nt, Homo sapiens
auaaaucguccucccaggcca

SEQ ID NO: 697484 - RNA, 22 nt, Homo sapiens
auaaauucuauaggaacauaug

SEQ ID NO: 697485 - RNA, 14 nt, Homo sapiens
auaacaaagcccuu

SEQ ID NO: 697486 - RNA, 15 nt, Homo sapiens
auaacaaagcccuua

SEQ ID NO: 697487 - RNA, 20 nt, Homo sapiens
auaacuuuguuuagcccaaa

SEQ ID NO: 697488 - RNA, 19 nt, Homo sapiens
auaagaaacuuauuucuca

SEQ ID NO: 697489 - RNA, 19 nt, Homo sapiens
auaagcuacuagcaaaaua

SEQ ID NO: 697490 - RNA, 23 nt, Homo sapiens
auaagcuaguugaauacuugaac

SEQ ID NO: 697491 - RNA, 19 nt, Homo sapiens
auaagucaauuccuagaag

SEQ ID NO: 697492 - RNA, 22 nt, Homo sapiens
auaagugaagugauacuaucca

SEQ ID NO: 697493 - RNA, 18 nt, Homo sapiens
auaauaaaugcccucuuc

SEQ ID NO: 697494 - RNA, 23 nt, Homo sapiens
auaauauuaaggaagacaaugug

SEQ ID NO: 697495 - RNA, 21 nt, Homo sapiens
auaaugccauuuuaaggaaaa

SEQ ID NO: 697496 - RNA, 19 nt, Homo sapiens
auaauguaaacgcaaacag

SEQ ID NO: 697497 - RNA, 22 nt, Homo sapiens
auaauuccuauauccugugacu

SEQ ID NO: 697498 - RNA, 20 nt, Homo sapiens
auacacuuaaugauacaugu

SEQ ID NO: 697499 - RNA, 21 nt, Homo sapiens
auacacuuaaugauacauguu

SEQ ID NO: 697500 - RNA, 15 nt, Homo sapiens
auacaggaaagcaau

SEQ ID NO: 697501 - RNA, 15 nt, Homo sapiens
auacauagugaaaau

SEQ ID NO: 697502 - RNA, 12 nt, Homo sapiens
auaccguuuaua

SEQ ID NO: 697503 - RNA, 14 nt, Homo sapiens
auaccuccaacccu

SEQ ID NO: 697504 - RNA, 18 nt, Homo sapiens
auacgcuuugguuucuca

SEQ ID NO: 697505 - RNA, 17 nt, Homo sapiens
auacuaaauuauagugu

SEQ ID NO: 697506 - RNA, 15 nt, Homo sapiens
auacuauccaguuac

SEQ ID NO: 697507 - RNA, 13 nt, Homo sapiens
auacugacuccua

SEQ ID NO: 697508 - RNA, 14 nt, Homo sapiens
auacuguucacuca

SEQ ID NO: 697509 - RNA, 13 nt, Homo sapiens
auagaaagcuaua

SEQ ID NO: 697510 - RNA, 14 nt, Homo sapiens
auagaaauuuugua

SEQ ID NO: 697511 - RNA, 18 nt, Homo sapiens
auagacacauacauguca

SEQ ID NO: 697512 - RNA, 14 nt, Homo sapiens
auagaggcuagcuu

SEQ ID NO: 697513 - RNA, 15 nt, Homo sapiens
auagcauguaauggu

SEQ ID NO: 697514 - RNA, 14 nt, Homo sapiens
auagucuuugccag

SEQ ID NO: 697515 - RNA, 18 nt, Homo sapiens
auagucuuugccagucau

SEQ ID NO: 697516 - RNA, 21 nt, Homo sapiens
auaguguagaaaagaacugga

SEQ ID NO: 697517 - RNA, 22 nt, Homo sapiens
auaguuuguuuuuaaacuaaua

SEQ ID NO: 697518 - RNA, 19 nt, Homo sapiens
auauaaauuuguguucuca

SEQ ID NO: 697519 - RNA, 16 nt, Homo sapiens
auauaaggaaagcaau

SEQ ID NO: 697520 - RNA, 18 nt, Homo sapiens
auauaaggaaagcaauaa

SEQ ID NO: 697521 - RNA, 16 nt, Homo sapiens
auauaauuuauuucca

SEQ ID NO: 697522 - RNA, 17 nt, Homo sapiens
auauacauaauacauga

SEQ ID NO: 697523 - RNA, 14 nt, Homo sapiens
auauauaacauaua

SEQ ID NO: 697524 - RNA, 14 nt, Homo sapiens
auauauauuacaag

SEQ ID NO: 697525 - RNA, 12 nt, Homo sapiens
auauauugaacu

SEQ ID NO: 697526 - RNA, 13 nt, Homo sapiens
auaucagugacag

SEQ ID NO: 697527 - RNA, 13 nt, Homo sapiens
auaucccuuccag

SEQ ID NO: 697528 - RNA, 15 nt, Homo sapiens
auauccugugacugu

SEQ ID NO: 697529 - RNA, 15 nt, Homo sapiens
auaugcagugauaua

SEQ ID NO: 697530 - RNA, 14 nt, Homo sapiens
auauguauauacau

SEQ ID NO: 697531 - RNA, 19 nt, Homo sapiens
auauguggaagcaaccaag

SEQ ID NO: 697532 - RNA, 15 nt, Homo sapiens
auauguucagauuau

SEQ ID NO: 697533 - RNA, 21 nt, Homo sapiens
auauuaaggaagacaauguga

SEQ ID NO: 697534 - RNA, 12 nt, Homo sapiens
auauucuuucaa

SEQ ID NO: 697535 - RNA, 12 nt, Homo sapiens
auauugcaaaau

SEQ ID NO: 697536 - RNA, 17 nt, Homo sapiens
auauuggggccaugagu

SEQ ID NO: 697537 - RNA, 17 nt, Homo sapiens
auauuuaccagaccaca

SEQ ID NO: 697538 - RNA, 12 nt, Homo sapiens
auauuuacuacu

SEQ ID NO: 697539 - RNA, 13 nt, Homo sapiens
auauuuaucugau

SEQ ID NO: 697540 - RNA, 19 nt, Homo sapiens
auauuuuaaccugcauaaa

SEQ ID NO: 697541 - RNA, 20 nt, Homo sapiens
aucaaaauauuucagugaau

SEQ ID NO: 697542 - RNA, 17 nt, Homo sapiens
aucaaagaacaaacauc

SEQ ID NO: 697543 - RNA, 12 nt, Homo sapiens
aucaauauacau

SEQ ID NO: 697544 - RNA, 22 nt, Homo sapiens
aucaauauuuuuauaucaugca

SEQ ID NO: 697545 - RNA, 24 nt, Homo sapiens
aucaauauuuuuauaucaugcaaa

SEQ ID NO: 697546 - RNA, 14 nt, Homo sapiens
aucacccucuuccu

SEQ ID NO: 697547 - RNA, 18 nt, Homo sapiens
aucacgaggucaggagau

SEQ ID NO: 697548 - RNA, 14 nt, Homo sapiens
aucacugccacacu

SEQ ID NO: 697549 - RNA, 16 nt, Homo sapiens
aucacugccacacucu

SEQ ID NO: 697550 - RNA, 21 nt, Homo sapiens
aucacugccacacucuccauc

SEQ ID NO: 697551 - RNA, 22 nt, Homo sapiens
aucacugccacacucuccauca

SEQ ID NO: 697552 - RNA, 22 nt, Homo sapiens
aucagcaugaaaaugcaguuuc

SEQ ID NO: 697553 - RNA, 16 nt, Homo sapiens
aucagccaaguuuuau

SEQ ID NO: 697554 - RNA, 18 nt, Homo sapiens
aucaggaauauuuuccaa

SEQ ID NO: 697555 - RNA, 21 nt, Homo sapiens
aucagugaaaaagauguacag

SEQ ID NO: 697556 - RNA, 23 nt, Homo sapiens
aucauaggcaccuuuuacuguga

SEQ ID NO: 697557 - RNA, 15 nt, Homo sapiens
aucauguaugcaucc

SEQ ID NO: 697558 - RNA, 13 nt, Homo sapiens
auccaacuccagc

SEQ ID NO: 697559 - RNA, 21 nt, Homo sapiens
auccaagauuuaaaugccaua

SEQ ID NO: 697560 - RNA, 21 nt, Homo sapiens
auccacccaacccuaucuccu

SEQ ID NO: 697561 - RNA, 16 nt, Homo sapiens
auccagucucccaacu

SEQ ID NO: 697562 - RNA, 19 nt, Homo sapiens
auccauauuuuauuacugu

SEQ ID NO: 697563 - RNA, 17 nt, Homo sapiens
auccaugaacagcauua

SEQ ID NO: 697564 - RNA, 15 nt, Homo sapiens
aucccacuaaugcaa

SEQ ID NO: 697565 - RNA, 16 nt, Homo sapiens
aucccacuaaugcaaa

SEQ ID NO: 697566 - RNA, 19 nt, Homo sapiens
aucccgccgauagagggac

SEQ ID NO: 697567 - RNA, 17 nt, Homo sapiens
aucccuuaacaguugua

SEQ ID NO: 697568 - RNA, 16 nt, Homo sapiens
aucccuuaccucggug

SEQ ID NO: 697569 - RNA, 17 nt, Homo sapiens
auccgcugccagccuug

SEQ ID NO: 697570 - RNA, 12 nt, Homo sapiens
auccugugcaau

SEQ ID NO: 697571 - RNA, 23 nt, Homo sapiens
auccugugcaauagacacauaca

SEQ ID NO: 697572 - RNA, 20 nt, Homo sapiens
auccuguguagcauacuggc

SEQ ID NO: 697573 - RNA, 14 nt, Homo sapiens
auccuuccauucca

SEQ ID NO: 697574 - RNA, 15 nt, Homo sapiens
auccuuccauuccac

SEQ ID NO: 697575 - RNA, 21 nt, Homo sapiens
aucgacuuguuuuugcacaug

SEQ ID NO: 697576 - RNA, 18 nt, Homo sapiens
aucuaaaguaaaaaggga

SEQ ID NO: 697577 - RNA, 20 nt, Homo sapiens
aucuaaaguaaaaagggaau

SEQ ID NO: 697578 - RNA, 14 nt, Homo sapiens
aucuaccagcauaa

SEQ ID NO: 697579 - RNA, 13 nt, Homo sapiens
aucucagcuuuga

SEQ ID NO: 697580 - RNA, 17 nt, Homo sapiens
aucucauuuaagggaaa

SEQ ID NO: 697581 - RNA, 17 nt, Homo sapiens
aucuccauaaacaugaa

SEQ ID NO: 697582 - RNA, 13 nt, Homo sapiens
aucuccugacaga

SEQ ID NO: 697583 - RNA, 15 nt, Homo sapiens
aucucuaaagagcau

SEQ ID NO: 697584 - RNA, 16 nt, Homo sapiens
aucucuaggaagucaa

SEQ ID NO: 697585 - RNA, 15 nt, Homo sapiens
aucugaaauguuaca

SEQ ID NO: 697586 - RNA, 22 nt, Homo sapiens
aucuugaauccuuccauuccac

SEQ ID NO: 697587 - RNA, 19 nt, Homo sapiens
aucuuggagaaugugagaa

SEQ ID NO: 697588 - RNA, 17 nt, Homo sapiens
aucuuuguauauuacau

SEQ ID NO: 697589 - RNA, 18 nt, Homo sapiens
aucuuuguauauuacaua

SEQ ID NO: 697590 - RNA, 16 nt, Homo sapiens
aucuuuucauuaaaga

SEQ ID NO: 697591 - RNA, 20 nt, Homo sapiens
augaaaaaaaugcauuuuau

SEQ ID NO: 697592 - RNA, 21 nt, Homo sapiens
augaaaacauagcaucucagg

SEQ ID NO: 697593 - RNA, 16 nt, Homo sapiens
augaaaccagaaggau

SEQ ID NO: 697594 - RNA, 16 nt, Homo sapiens
augaaacgucaugugu

SEQ ID NO: 697595 - RNA, 21 nt, Homo sapiens
augaagggacccuuugggggu

SEQ ID NO: 697596 - RNA, 19 nt, Homo sapiens
augaaguugaaaaucauag

SEQ ID NO: 697597 - RNA, 16 nt, Homo sapiens
augaauaaaguguaag

SEQ ID NO: 697598 - RNA, 22 nt, Homo sapiens
augacacacaaaucccauuaaa

SEQ ID NO: 697599 - RNA, 11 nt, Homo sapiens
augacagugaa

SEQ ID NO: 697600 - RNA, 12 nt, Homo sapiens
augacagugcua

SEQ ID NO: 697601 - RNA, 13 nt, Homo sapiens
augagagcauaau

SEQ ID NO: 697602 - RNA, 16 nt, Homo sapiens
augaggaggaugcuaa

SEQ ID NO: 697603 - RNA, 17 nt, Homo sapiens
augaguuuaucauguca

SEQ ID NO: 697604 - RNA, 22 nt, Homo sapiens
augauccuaggcauuugcugaa

SEQ ID NO: 697605 - RNA, 15 nt, Homo sapiens
augaugauguggaag

SEQ ID NO: 697606 - RNA, 15 nt, Homo sapiens
augauuaaaaauauc

SEQ ID NO: 697607 - RNA, 19 nt, Homo sapiens
augauucagaaauuuucau

SEQ ID NO: 697608 - RNA, 15 nt, Homo sapiens
augcaaaagguuuau

SEQ ID NO: 697609 - RNA, 21 nt, Homo sapiens
augcaaaguucuucauaucau

SEQ ID NO: 697610 - RNA, 20 nt, Homo sapiens
augcacuuaaagaaguauuu

SEQ ID NO: 697611 - RNA, 14 nt, Homo sapiens
augcaucauuucag

SEQ ID NO: 697612 - RNA, 21 nt, Homo sapiens
augccaaacaggaacaaucca

SEQ ID NO: 697613 - RNA, 16 nt, Homo sapiens
augccagcuuaucuca

SEQ ID NO: 697614 - RNA, 17 nt, Homo sapiens
augccagcuuaucucag

SEQ ID NO: 697615 - RNA, 16 nt, Homo sapiens
augccaguuacuugcu

SEQ ID NO: 697616 - RNA, 17 nt, Homo sapiens
augcccugugcaugcca

SEQ ID NO: 697617 - RNA, 20 nt, Homo sapiens
augcuaacaaagacaaaagu

SEQ ID NO: 697618 - RNA, 22 nt, Homo sapiens
augcuaccccacuaugacagag

SEQ ID NO: 697619 - RNA, 19 nt, Homo sapiens
augcuguggcuccuuccua

SEQ ID NO: 697620 - RNA, 20 nt, Homo sapiens
augcuuccuugccugaugac

SEQ ID NO: 697621 - RNA, 17 nt, Homo sapiens
auggaaaaacugaggcu

SEQ ID NO: 697622 - RNA, 22 nt, Homo sapiens
auggacuggagcucaucugcaa

SEQ ID NO: 697623 - RNA, 14 nt, Homo sapiens
auggauuuccagcc

SEQ ID NO: 697624 - RNA, 18 nt, Homo sapiens
auggcuuguucaucaucc

SEQ ID NO: 697625 - RNA, 18 nt, Homo sapiens
augggcucaagucacuuu

SEQ ID NO: 697626 - RNA, 14 nt, Homo sapiens
auggugauaaggga

SEQ ID NO: 697627 - RNA, 21 nt, Homo sapiens
augguguggccuguggcuguc

SEQ ID NO: 697628 - RNA, 19 nt, Homo sapiens
auguaaaaagauucccaaa

SEQ ID NO: 697629 - RNA, 14 nt, Homo sapiens
auguaauucuacca

SEQ ID NO: 697630 - RNA, 21 nt, Homo sapiens
auguagaagcaugaagucuua

SEQ ID NO: 697631 - RNA, 17 nt, Homo sapiens
auguauaaaacuaggaa

SEQ ID NO: 697632 - RNA, 17 nt, Homo sapiens
auguauggggaaucuaa

SEQ ID NO: 697633 - RNA, 20 nt, Homo sapiens
augucaacagagcaaggaga

SEQ ID NO: 697634 - RNA, 23 nt, Homo sapiens
augucaaguaccaaaauguuaau

SEQ ID NO: 697635 - RNA, 12 nt, Homo sapiens
augucacauuua

SEQ ID NO: 697636 - RNA, 12 nt, Homo sapiens
auguccaaagag

SEQ ID NO: 697637 - RNA, 14 nt, Homo sapiens
augucuccaucucu

SEQ ID NO: 697638 - RNA, 21 nt, Homo sapiens
augugaaaauuacaguccaaa

SEQ ID NO: 697639 - RNA, 21 nt, Homo sapiens
augugaauuauugacacugaa

SEQ ID NO: 697640 - RNA, 21 nt, Homo sapiens
augugagcucuuccuaucccu

SEQ ID NO: 697641 - RNA, 22 nt, Homo sapiens
augugauaaaaccccaucucua

SEQ ID NO: 697642 - RNA, 16 nt, Homo sapiens
augugauuagugucuc

SEQ ID NO: 697643 - RNA, 21 nt, Homo sapiens
auguggaagaacuuaggcauc

SEQ ID NO: 697644 - RNA, 22 nt, Homo sapiens
auguggaccuuagaauacaguu

SEQ ID NO: 697645 - RNA, 16 nt, Homo sapiens
auguggccacaaucca

SEQ ID NO: 697646 - RNA, 15 nt, Homo sapiens
auguggcccuggcug

SEQ ID NO: 697647 - RNA, 20 nt, Homo sapiens
auguggcuacugacauaucu

SEQ ID NO: 697648 - RNA, 20 nt, Homo sapiens
auguggcuggaagauccugc

SEQ ID NO: 697649 - RNA, 16 nt, Homo sapiens
augugugaaguaugca

SEQ ID NO: 697650 - RNA, 13 nt, Homo sapiens
auguuaaagggau

SEQ ID NO: 697651 - RNA, 15 nt, Homo sapiens
auguucuagucugcu

SEQ ID NO: 697652 - RNA, 14 nt, Homo sapiens
auguuuaaaacacc

SEQ ID NO: 697653 - RNA, 18 nt, Homo sapiens
auguuuacagacugugag

SEQ ID NO: 697654 - RNA, 21 nt, Homo sapiens
auguuuauaaaucuuaugcuc

SEQ ID NO: 697655 - RNA, 15 nt, Homo sapiens
auguuugaaugauuu

SEQ ID NO: 697656 - RNA, 16 nt, Homo sapiens
auguuugcacuuguga

SEQ ID NO: 697657 - RNA, 14 nt, Homo sapiens
auuaaagacagagg

SEQ ID NO: 697658 - RNA, 13 nt, Homo sapiens
auuaaauuaggaa

SEQ ID NO: 697659 - RNA, 17 nt, Homo sapiens
auuaagcaaauguuaaa

SEQ ID NO: 697660 - RNA, 12 nt, Homo sapiens
auuaagcaugaa

SEQ ID NO: 697661 - RNA, 23 nt, Homo sapiens
auuaagcauguuuuguugcucag

SEQ ID NO: 697662 - RNA, 22 nt, Homo sapiens
auuaagugacuauagaaugcaa

SEQ ID NO: 697663 - RNA, 22 nt, Homo sapiens
auuacaaggcuuuaucucaggg

SEQ ID NO: 697664 - RNA, 21 nt, Homo sapiens
auuacaguccaaaauacuguu

SEQ ID NO: 697665 - RNA, 20 nt, Homo sapiens
auuacuguuuauuacuucca

SEQ ID NO: 697666 - RNA, 15 nt, Homo sapiens
auuagaugcacuuaa

SEQ ID NO: 697667 - RNA, 18 nt, Homo sapiens
auuauaauuaguuccuca

SEQ ID NO: 697668 - RNA, 15 nt, Homo sapiens
auuauauaacuguau

SEQ ID NO: 697669 - RNA, 16 nt, Homo sapiens
auuaugagaggcaaug

SEQ ID NO: 697670 - RNA, 13 nt, Homo sapiens
auuauuauuucca

SEQ ID NO: 697671 - RNA, 14 nt, Homo sapiens
auuauugacacuga

SEQ ID NO: 697672 - RNA, 18 nt, Homo sapiens
auuauuuuuucugugguc

SEQ ID NO: 697673 - RNA, 14 nt, Homo sapiens
auucaaggggagcc

SEQ ID NO: 697674 - RNA, 19 nt, Homo sapiens
auucagguauuuguaauag

SEQ ID NO: 697675 - RNA, 16 nt, Homo sapiens
auuccccacccugaaa

SEQ ID NO: 697676 - RNA, 15 nt, Homo sapiens
auuccuuugcauauu

SEQ ID NO: 697677 - RNA, 20 nt, Homo sapiens
auucucuuuuuuucuugucc

SEQ ID NO: 697678 - RNA, 18 nt, Homo sapiens
auucuguuuuuaaugcua

SEQ ID NO: 697679 - RNA, 18 nt, Homo sapiens
auugaacuuuuguacuga

SEQ ID NO: 697680 - RNA, 21 nt, Homo sapiens
auugaacuuuuguacugaauu

SEQ ID NO: 697681 - RNA, 12 nt, Homo sapiens
auugaaguaaug

SEQ ID NO: 697682 - RNA, 15 nt, Homo sapiens
auugcauacuuugua

SEQ ID NO: 697683 - RNA, 23 nt, Homo sapiens
auuggagucacugccaagucaua

SEQ ID NO: 697684 - RNA, 20 nt, Homo sapiens
auuggauaaaauaaaugcaa

SEQ ID NO: 697685 - RNA, 17 nt, Homo sapiens
uuaaaagaauguaaaau

SEQ ID NO: 697686 - RNA, 14 nt, Homo sapiens
uuaaaauaccuaga

SEQ ID NO: 697687 - RNA, 22 nt, Homo sapiens
uuaaaauauuuaucugauuaag

SEQ ID NO: 697688 - RNA, 17 nt, Homo sapiens
uuaaacaaauaauuuag

SEQ ID NO: 697689 - RNA, 16 nt, Homo sapiens
uuaaacuucauaugua

SEQ ID NO: 697690 - RNA, 22 nt, Homo sapiens
uuaaacuucauauguaaucucu

SEQ ID NO: 697691 - RNA, 22 nt, Homo sapiens
uuaaaguucucaaugcaaccau

SEQ ID NO: 697692 - RNA, 20 nt, Homo sapiens
uuaaauauauaauguugcca

SEQ ID NO: 697693 - RNA, 17 nt, Homo sapiens
uuaaauuuaauaccaga

SEQ ID NO: 697694 - RNA, 13 nt, Homo sapiens
uuaacauaagaaa

SEQ ID NO: 697695 - RNA, 15 nt, Homo sapiens
uuaacugcauccagc

SEQ ID NO: 697696 - RNA, 16 nt, Homo sapiens
uuaaguggguuugccc

SEQ ID NO: 697697 - RNA, 19 nt, Homo sapiens
uuaaucauaguuacugugu

SEQ ID NO: 697698 - RNA, 14 nt, Homo sapiens
uuaaugaaugaguc

SEQ ID NO: 697699 - RNA, 20 nt, Homo sapiens
uuaauguuuuuuaaacuagu

SEQ ID NO: 697700 - RNA, 23 nt, Homo sapiens
uuaauguuuuuuaaacuaguuua

SEQ ID NO: 697701 - RNA, 17 nt, Homo sapiens
uuacacaaauuugccug

SEQ ID NO: 697702 - RNA, 22 nt, Homo sapiens
uuacacuggcaaugguaguuuc

SEQ ID NO: 697703 - RNA, 14 nt, Homo sapiens
uuacagaacuacuu

SEQ ID NO: 697704 - RNA, 12 nt, Homo sapiens
uuacagcaagaa

SEQ ID NO: 697705 - RNA, 20 nt, Homo sapiens
uuacaggauaucacauugga

SEQ ID NO: 697706 - RNA, 18 nt, Homo sapiens
uuacauacaugcuuugaa

SEQ ID NO: 697707 - RNA, 21 nt, Homo sapiens
uuaccugauuugaugauacau

SEQ ID NO: 697708 - RNA, 18 nt, Homo sapiens
uuacucucuugcaccaaa

SEQ ID NO: 697709 - RNA, 14 nt, Homo sapiens
uuagaauacaguuu

SEQ ID NO: 697710 - RNA, 15 nt, Homo sapiens
uuagaauuauaucac

SEQ ID NO: 697711 - RNA, 17 nt, Homo sapiens
uuagaguugcucuacaa

SEQ ID NO: 697712 - RNA, 14 nt, Homo sapiens
uuagauugaaucug

SEQ ID NO: 697713 - RNA, 18 nt, Homo sapiens
uuagccgcccaugcacug

SEQ ID NO: 697714 - RNA, 13 nt, Homo sapiens
uuaguaacauuca

SEQ ID NO: 697715 - RNA, 23 nt, Homo sapiens
uuaguuguaaaccaagugaucaa

SEQ ID NO: 697716 - RNA, 15 nt, Homo sapiens
uuauagucaauggcu

SEQ ID NO: 697717 - RNA, 18 nt, Homo sapiens
uuauauuaaaacacuuag

SEQ ID NO: 697718 - RNA, 22 nt, Homo sapiens
uuauauuuccuuuaugugaauu

SEQ ID NO: 697719 - RNA, 19 nt, Homo sapiens
uuauccagaaaacugugau

SEQ ID NO: 697720 - RNA, 16 nt, Homo sapiens
uuaucuauucugagaa

SEQ ID NO: 697721 - RNA, 16 nt, Homo sapiens
uuaugacagugaacau

SEQ ID NO: 697722 - RNA, 21 nt, Homo sapiens
uuaugcaucauuucaggaguu

SEQ ID NO: 697723 - RNA, 17 nt, Homo sapiens
uuauguagguaagacug

SEQ ID NO: 697724 - RNA, 17 nt, Homo sapiens
uuauucaguaacuguca

SEQ ID NO: 697725 - RNA, 14 nt, Homo sapiens
uuauugacacugaa

SEQ ID NO: 697726 - RNA, 14 nt, Homo sapiens
uuauugacucuuga

SEQ ID NO: 697727 - RNA, 14 nt, Homo sapiens
uuauuguuaauaca

SEQ ID NO: 697728 - RNA, 16 nt, Homo sapiens
uuauuuuacagcucau

SEQ ID NO: 697729 - RNA, 18 nt, Homo sapiens
uucaaaauauacauucaa

SEQ ID NO: 697730 - RNA, 18 nt, Homo sapiens
uucaaaugaaaauuccau

SEQ ID NO: 697731 - RNA, 12 nt, Homo sapiens
uucaaguguaaa

SEQ ID NO: 697732 - RNA, 15 nt, Homo sapiens
uucaauuaguaacau

SEQ ID NO: 697733 - RNA, 20 nt, Homo sapiens
uucacuccagccugggugac

SEQ ID NO: 697734 - RNA, 18 nt, Homo sapiens
uucacuugaugauacaau

SEQ ID NO: 697735 - RNA, 22 nt, Homo sapiens
uucagauccugaauuccagcaa

SEQ ID NO: 697736 - RNA, 17 nt, Homo sapiens
uucaggaguuacuggau

SEQ ID NO: 697737 - RNA, 17 nt, Homo sapiens
uucauauaccagcaaua

SEQ ID NO: 697738 - RNA, 18 nt, Homo sapiens
uucauggugcacugagcu

SEQ ID NO: 697739 - RNA, 23 nt, Homo sapiens
uucauuccuaaagaaaaauaucu

SEQ ID NO: 697740 - RNA, 14 nt, Homo sapiens
uuccacacugcacu

SEQ ID NO: 697741 - RNA, 19 nt, Homo sapiens
uuccagacuuccuugagac

SEQ ID NO: 697742 - RNA, 17 nt, Homo sapiens
uuccagaguccuccuuu

SEQ ID NO: 697743 - RNA, 16 nt, Homo sapiens
uuccagaucacugcca

SEQ ID NO: 697744 - RNA, 15 nt, Homo sapiens
uuccagaucuuucag

SEQ ID NO: 697745 - RNA, 23 nt, Homo sapiens
uuccauuuuuauuucaaaauaua

SEQ ID NO: 697746 - RNA, 17 nt, Homo sapiens
uucccaucugcaccccu

SEQ ID NO: 697747 - RNA, 17 nt, Homo sapiens
uucccauuugugccaga

SEQ ID NO: 697748 - RNA, 19 nt, Homo sapiens
uucccccaccgguccagcu

SEQ ID NO: 697749 - RNA, 14 nt, Homo sapiens
uuccccucacuauc

SEQ ID NO: 697750 - RNA, 12 nt, Homo sapiens
uucccuagcuuu

SEQ ID NO: 697751 - RNA, 21 nt, Homo sapiens
uuccucccaggaagcccagga

SEQ ID NO: 697752 - RNA, 16 nt, Homo sapiens
uuccucccccaguucc

SEQ ID NO: 697753 - RNA, 21 nt, Homo sapiens
uuccucccccaguuccuccca

SEQ ID NO: 697754 - RNA, 16 nt, Homo sapiens
uuccuggaauugccag

SEQ ID NO: 697755 - RNA, 15 nt, Homo sapiens
uuccuguucaguaau

SEQ ID NO: 697756 - RNA, 18 nt, Homo sapiens
uuccuguugaaugacaaa

SEQ ID NO: 697757 - RNA, 13 nt, Homo sapiens
uucgacuaccuuu

SEQ ID NO: 697758 - RNA, 14 nt, Homo sapiens
uucggucuuuccca

SEQ ID NO: 697759 - RNA, 21 nt, Homo sapiens
uucuacuuuuuuugaugaccu

SEQ ID NO: 697760 - RNA, 15 nt, Homo sapiens
uucuagaaacaaaca

SEQ ID NO: 697761 - RNA, 16 nt, Homo sapiens
uucuaggcucacugca

SEQ ID NO: 697762 - RNA, 14 nt, Homo sapiens
uucuaguuaccaca

SEQ ID NO: 697763 - RNA, 17 nt, Homo sapiens
uucuauaggaacauaug

SEQ ID NO: 697764 - RNA, 14 nt, Homo sapiens
uucucaaaauuccu

SEQ ID NO: 697765 - RNA, 20 nt, Homo sapiens
uucuccauacgcacugguau

SEQ ID NO: 697766 - RNA, 16 nt, Homo sapiens
uucucguuuucacagg

SEQ ID NO: 697767 - RNA, 20 nt, Homo sapiens
uucucuuaguuauugcugaa

SEQ ID NO: 697768 - RNA, 13 nt, Homo sapiens
uucuuucaaagga

SEQ ID NO: 697769 - RNA, 22 nt, Homo sapiens
uucuuugucuugccccuaggaa

SEQ ID NO: 697770 - RNA, 17 nt, Homo sapiens
uugaaaaacugaguauu

SEQ ID NO: 697771 - RNA, 21 nt, Homo sapiens
uugaaacuuugggaaaacaug

SEQ ID NO: 697772 - RNA, 16 nt, Homo sapiens
uugaaauaagaauuca

SEQ ID NO: 697773 - RNA, 17 nt, Homo sapiens
uugaacaaagacuacua

SEQ ID NO: 697774 - RNA, 19 nt, Homo sapiens
uugaacuuauuuacacaua

SEQ ID NO: 697775 - RNA, 14 nt, Homo sapiens
uugaagaagauaug

SEQ ID NO: 697776 - RNA, 11 nt, Homo sapiens
uugaagccaaa

SEQ ID NO: 697777 - RNA, 13 nt, Homo sapiens
uugaagccaaaga

SEQ ID NO: 697778 - RNA, 13 nt, Homo sapiens
uugaagucuuuaa

SEQ ID NO: 697779 - RNA, 14 nt, Homo sapiens
uugaaugugucagg

SEQ ID NO: 697780 - RNA, 13 nt, Homo sapiens
uugacaacauguu

SEQ ID NO: 697781 - RNA, 15 nt, Homo sapiens
uugacaacugugacu

SEQ ID NO: 697782 - RNA, 12 nt, Homo sapiens
uugacacugaac

SEQ ID NO: 697783 - RNA, 14 nt, Homo sapiens
uugacgcaccugug

SEQ ID NO: 697784 - RNA, 15 nt, Homo sapiens
uugacuagugcaauu

SEQ ID NO: 697785 - RNA, 14 nt, Homo sapiens
uugagacaggagac

SEQ ID NO: 697786 - RNA, 20 nt, Homo sapiens
uugagcucaggaguuugaga

SEQ ID NO: 697787 - RNA, 18 nt, Homo sapiens
uugauuauuugcauguua

SEQ ID NO: 697788 - RNA, 23 nt, Homo sapiens
uugauuuaagcuuuccuguugaa

SEQ ID NO: 697789 - RNA, 13 nt, Homo sapiens
uugcaaagauuua

SEQ ID NO: 697790 - RNA, 17 nt, Homo sapiens
uugcaagaugugaauua

SEQ ID NO: 697791 - RNA, 18 nt, Homo sapiens
uugcacugaggauauuca

SEQ ID NO: 697792 - RNA, 20 nt, Homo sapiens
uugcaggaccucaggugaga

SEQ ID NO: 697793 - RNA, 17 nt, Homo sapiens
uugcagugaauucauau

SEQ ID NO: 697794 - RNA, 20 nt, Homo sapiens
uugcauggaaaucagccaag

SEQ ID NO: 697795 - RNA, 13 nt, Homo sapiens
uugccauguguuu

SEQ ID NO: 697796 - RNA, 15 nt, Homo sapiens
uugccucugugcugu

SEQ ID NO: 697797 - RNA, 20 nt, Homo sapiens
uugccuuuugcaaccaggaa

SEQ ID NO: 697798 - RNA, 19 nt, Homo sapiens
uugcuguuccuuacuuuac

SEQ ID NO: 697799 - RNA, 13 nt, Homo sapiens
uugcuguugucca

SEQ ID NO: 697800 - RNA, 21 nt, Homo sapiens
uuggauaaaauaaaugcaauu

SEQ ID NO: 697801 - RNA, 18 nt, Homo sapiens
uuggcaggcuggccaguc

SEQ ID NO: 697802 - RNA, 13 nt, Homo sapiens
uuggcuuugccag

SEQ ID NO: 697803 - RNA, 22 nt, Homo sapiens
uugggaggcugaggcaggagaa

SEQ ID NO: 697804 - RNA, 14 nt, Homo sapiens
uugggcaugccauu

SEQ ID NO: 697805 - RNA, 13 nt, Homo sapiens
aaauauuucccau

SEQ ID NO: 697806 - RNA, 17 nt, Homo sapiens
aaauccagugaccucuc

SEQ ID NO: 697807 - RNA, 18 nt, Homo sapiens
aaaucuguugauaaaucc

SEQ ID NO: 697808 - RNA, 19 nt, Homo sapiens
aaaucuucccaugcauucu

SEQ ID NO: 697809 - RNA, 15 nt, Homo sapiens
aaaugaaaauuccau

SEQ ID NO: 697810 - RNA, 19 nt, Homo sapiens
aaaugccugcuuugaauaa

SEQ ID NO: 697811 - RNA, 21 nt, Homo sapiens
aaauggucacguuuggugcuu

SEQ ID NO: 697812 - RNA, 15 nt, Homo sapiens
aaauucaacuuugua

SEQ ID NO: 697813 - RNA, 21 nt, Homo sapiens
aaauucuauaggaacauauga

SEQ ID NO: 697814 - RNA, 21 nt, Homo sapiens
aaauucuguuuuucuaggccu

SEQ ID NO: 697815 - RNA, 16 nt, Homo sapiens
aaauugggcaugccau

SEQ ID NO: 697816 - RNA, 15 nt, Homo sapiens
aacaaauaauuuaga

SEQ ID NO: 697817 - RNA, 18 nt, Homo sapiens
aacaagcaaguucugaga

SEQ ID NO: 697818 - RNA, 20 nt, Homo sapiens
aacaaguugagcuaugacuu

SEQ ID NO: 697819 - RNA, 20 nt, Homo sapiens
aacacaaacgggcucagcaa

SEQ ID NO: 697820 - RNA, 13 nt, Homo sapiens
aacacaagcaaaa

SEQ ID NO: 697821 - RNA, 15 nt, Homo sapiens
aacacacacauauac

SEQ ID NO: 697822 - RNA, 21 nt, Homo sapiens
aacacauuucucugaucucca

SEQ ID NO: 697823 - RNA, 18 nt, Homo sapiens
aacaccaacauguuggga

SEQ ID NO: 697824 - RNA, 20 nt, Homo sapiens
aacaccacuaauuguguaca

SEQ ID NO: 697825 - RNA, 21 nt, Homo sapiens
aacacugcugcuccagugcag

SEQ ID NO: 697826 - RNA, 14 nt, Homo sapiens
aacagaaauuguau

SEQ ID NO: 697827 - RNA, 13 nt, Homo sapiens
aacauagccaaaa

SEQ ID NO: 697828 - RNA, 19 nt, Homo sapiens
aacaucuaauaaguauaua

SEQ ID NO: 697829 - RNA, 14 nt, Homo sapiens
aacaugagaugugu

SEQ ID NO: 697830 - RNA, 16 nt, Homo sapiens
aacaugcuggugaaua

SEQ ID NO: 697831 - RNA, 19 nt, Homo sapiens
aacauguaaaacaguuaca

SEQ ID NO: 697832 - RNA, 20 nt, Homo sapiens
aacauguuuuguauguuaaa

SEQ ID NO: 697833 - RNA, 20 nt, Homo sapiens
aacauuauuuggauaucaaa

SEQ ID NO: 697834 - RNA, 16 nt, Homo sapiens
aacauuugcugccauu

SEQ ID NO: 697835 - RNA, 18 nt, Homo sapiens
aaccacagucuauaccau

SEQ ID NO: 697836 - RNA, 16 nt, Homo sapiens
aaccacauugaagaau

SEQ ID NO: 697837 - RNA, 22 nt, Homo sapiens
aaccacuaugaagcuaccucaa

SEQ ID NO: 697838 - RNA, 14 nt, Homo sapiens
aaccacuucagcug

SEQ ID NO: 697839 - RNA, 14 nt, Homo sapiens
aaccagagugcuga

SEQ ID NO: 697840 - RNA, 17 nt, Homo sapiens
aaccauggugaagugcu

SEQ ID NO: 697841 - RNA, 23 nt, Homo sapiens
aaccccugcgcucucuuugcaac

SEQ ID NO: 697842 - RNA, 12 nt, Homo sapiens
aaccccuuccag

SEQ ID NO: 697843 - RNA, 22 nt, Homo sapiens
aaccccuuccagaucacugcca

SEQ ID NO: 697844 - RNA, 19 nt, Homo sapiens
aacccugccgucaccacca

SEQ ID NO: 697845 - RNA, 22 nt, Homo sapiens
aacccuuuauuugaacaaugaa

SEQ ID NO: 697846 - RNA, 11 nt, Homo sapiens
aaccgaauaaa

SEQ ID NO: 697847 - RNA, 16 nt, Homo sapiens
aaccgagaagguuuau

SEQ ID NO: 697848 - RNA, 16 nt, Homo sapiens
aaccggucacccagga

SEQ ID NO: 697849 - RNA, 17 nt, Homo sapiens
aaccuacccucagugag

SEQ ID NO: 697850 - RNA, 20 nt, Homo sapiens
aaccuccgcauccgggguuc

SEQ ID NO: 697851 - RNA, 17 nt, Homo sapiens
aaccucuucuggcucaa

SEQ ID NO: 697852 - RNA, 23 nt, Homo sapiens
aaccugaauauaaauuuguguuc

SEQ ID NO: 697853 - RNA, 20 nt, Homo sapiens
aaccuggguaacuagggaag

SEQ ID NO: 697854 - RNA, 22 nt, Homo sapiens
aaccuuacuaauuauacuacuu

SEQ ID NO: 697855 - RNA, 16 nt, Homo sapiens
aacgcguaucuaggcu

SEQ ID NO: 697856 - RNA, 23 nt, Homo sapiens
aacuacauauuguaaagcccauu

SEQ ID NO: 697857 - RNA, 17 nt, Homo sapiens
aacuacuucuuacuucu

SEQ ID NO: 697858 - RNA, 21 nt, Homo sapiens
aacuagauuuucacuuaugaa

SEQ ID NO: 697859 - RNA, 14 nt, Homo sapiens
aacuauugugcuca

SEQ ID NO: 697860 - RNA, 20 nt, Homo sapiens
aacucaaauacacauuugcu

SEQ ID NO: 697861 - RNA, 14 nt, Homo sapiens
aacucaaugcuuua

SEQ ID NO: 697862 - RNA, 16 nt, Homo sapiens
aacugauaaguuucau

SEQ ID NO: 697863 - RNA, 21 nt, Homo sapiens
aacugcuucccuuacuuugcu

SEQ ID NO: 697864 - RNA, 20 nt, Homo sapiens
aacugggaugaaacuaaagc

SEQ ID NO: 697865 - RNA, 14 nt, Homo sapiens
aacugggguugagg

SEQ ID NO: 697866 - RNA, 13 nt, Homo sapiens
aacuguguugcca

SEQ ID NO: 697867 - RNA, 14 nt, Homo sapiens
aacuucauauguaa

SEQ ID NO: 697868 - RNA, 12 nt, Homo sapiens
aacuuccaguca

SEQ ID NO: 697869 - RNA, 22 nt, Homo sapiens
aacuugcagaauugagagugau

SEQ ID NO: 697870 - RNA, 20 nt, Homo sapiens
aacuuuguuuagcccaaaac

SEQ ID NO: 697871 - RNA, 23 nt, Homo sapiens
aacuuuguuuagcccaaaaccaa

SEQ ID NO: 697872 - RNA, 19 nt, Homo sapiens
aagaaaauauauucuuuca

SEQ ID NO: 697873 - RNA, 22 nt, Homo sapiens
aagaaacuuauuucucauauca

SEQ ID NO: 697874 - RNA, 16 nt, Homo sapiens
aagaauuugcauacuu

SEQ ID NO: 697875 - RNA, 14 nt, Homo sapiens
aagaccgauugcau

SEQ ID NO: 697876 - RNA, 19 nt, Homo sapiens
aagacugguuuucugccaa

SEQ ID NO: 697877 - RNA, 23 nt, Homo sapiens
aagacuguuaaaugaaaccagaa

SEQ ID NO: 697878 - RNA, 19 nt, Homo sapiens
aagagaaaaaauauuuucc

SEQ ID NO: 697879 - RNA, 14 nt, Homo sapiens
aagagaaguuguaa

SEQ ID NO: 697880 - RNA, 17 nt, Homo sapiens
aagagacaggcagguga

SEQ ID NO: 697881 - RNA, 22 nt, Homo sapiens
aagagcaaaucaauucuaguca

SEQ ID NO: 697882 - RNA, 13 nt, Homo sapiens
aagagggcuuccu

SEQ ID NO: 697883 - RNA, 22 nt, Homo sapiens
aagaguucccuugaaacuuugg

SEQ ID NO: 697884 - RNA, 22 nt, Homo sapiens
aagaugguauauuugguacugu

SEQ ID NO: 697885 - RNA, 21 nt, Homo sapiens
aagauuuaaaugccauagaaa

SEQ ID NO: 697886 - RNA, 18 nt, Homo sapiens
aagcacuacaccuugccu

SEQ ID NO: 697887 - RNA, 14 nt, Homo sapiens
aagcagcuuacuua

SEQ ID NO: 697888 - RNA, 20 nt, Homo sapiens
aagcauaaaaauuagccaag

SEQ ID NO: 697889 - RNA, 16 nt, Homo sapiens
aagcaugaagucuuaa

SEQ ID NO: 697890 - RNA, 14 nt, Homo sapiens
aagccauuaugaua

SEQ ID NO: 697891 - RNA, 20 nt, Homo sapiens
aagcccaggagccucacugg

SEQ ID NO: 697892 - RNA, 21 nt, Homo sapiens
aagcccaggagccucacuggg

SEQ ID NO: 697893 - RNA, 15 nt, Homo sapiens
aagccgugauuuuca

SEQ ID NO: 697894 - RNA, 14 nt, Homo sapiens
aagccuaauuccag

SEQ ID NO: 697895 - RNA, 14 nt, Homo sapiens
aagccugugaaagg

SEQ ID NO: 697896 - RNA, 21 nt, Homo sapiens
aagcuaguugaauacuugaac

SEQ ID NO: 697897 - RNA, 22 nt, Homo sapiens
aagcuauuauaaaacuugaauu

SEQ ID NO: 697898 - RNA, 21 nt, Homo sapiens
aagcucacucuggauuccaca

SEQ ID NO: 697899 - RNA, 18 nt, Homo sapiens
aagcugcaggcuuugcca

SEQ ID NO: 697900 - RNA, 16 nt, Homo sapiens
aagcugcccacuguuu

SEQ ID NO: 697901 - RNA, 18 nt, Homo sapiens
aagcuuaacacuugaccu

SEQ ID NO: 697902 - RNA, 19 nt, Homo sapiens
aaggaaacccccaguguaa

SEQ ID NO: 697903 - RNA, 20 nt, Homo sapiens
aaggaaacccccaguguaau

SEQ ID NO: 697904 - RNA, 19 nt, Homo sapiens
aaggaaagaaaacaucuuu

SEQ ID NO: 697905 - RNA, 18 nt, Homo sapiens
aaggaaguuucaguauua

SEQ ID NO: 697906 - RNA, 16 nt, Homo sapiens
aaggacaaagugccaa

SEQ ID NO: 697907 - RNA, 13 nt, Homo sapiens
aaaaaacuacuuc

SEQ ID NO: 697908 - RNA, 21 nt, Homo sapiens
aaaaacacccgacgucaugua

SEQ ID NO: 697909 - RNA, 12 nt, Homo sapiens
aaaaacuacuuc

SEQ ID NO: 697910 - RNA, 13 nt, Homo sapiens
aaaaagcauacuu

SEQ ID NO: 697911 - RNA, 14 nt, Homo sapiens
aaaaaggcugugcu

SEQ ID NO: 697912 - RNA, 16 nt, Homo sapiens
aaaaagucagagacag

SEQ ID NO: 697913 - RNA, 18 nt, Homo sapiens
aaaaagucagagacagau

SEQ ID NO: 697914 - RNA, 16 nt, Homo sapiens
aaaaaguuaaacauug

SEQ ID NO: 697915 - RNA, 20 nt, Homo sapiens
aaaaaucuuuucauuaaaga

SEQ ID NO: 697916 - RNA, 13 nt, Homo sapiens
aaaaaugagcucg

SEQ ID NO: 697917 - RNA, 20 nt, Homo sapiens
aaaaauguauuuuuccuaaa

SEQ ID NO: 697918 - RNA, 22 nt, Homo sapiens
aaaacaccacuaauuguguaca

SEQ ID NO: 697919 - RNA, 13 nt, Homo sapiens
aaaacauguuaau

SEQ ID NO: 697920 - RNA, 12 nt, Homo sapiens
aaaacauuugcu

SEQ ID NO: 697921 - RNA, 17 nt, Homo sapiens
aaaaccagcgugugacu

SEQ ID NO: 697922 - RNA, 17 nt, Homo sapiens
aaaaccaucuugugucu

SEQ ID NO: 697923 - RNA, 21 nt, Homo sapiens
aaaaccgcaaggguagacugg

SEQ ID NO: 697924 - RNA, 13 nt, Homo sapiens
aaaaccuacccuc

SEQ ID NO: 697925 - RNA, 14 nt, Homo sapiens
aaaacucacuguga

SEQ ID NO: 697926 - RNA, 15 nt, Homo sapiens
aaaacucugcaugua

SEQ ID NO: 697927 - RNA, 19 nt, Homo sapiens
aaaacugauugaaugauau

SEQ ID NO: 697928 - RNA, 17 nt, Homo sapiens
aaaacuguguugccaca

SEQ ID NO: 697929 - RNA, 14 nt, Homo sapiens
aaaacuuaacauuc

SEQ ID NO: 697930 - RNA, 18 nt, Homo sapiens
aaaacuuuucuaauacuc

SEQ ID NO: 697931 - RNA, 17 nt, Homo sapiens
aaaagaaaacaccacua

SEQ ID NO: 697932 - RNA, 23 nt, Homo sapiens
aaaagggaauuaugaguuuuuca

SEQ ID NO: 697933 - RNA, 12 nt, Homo sapiens
aaaaggucuuua

SEQ ID NO: 697934 - RNA, 16 nt, Homo sapiens
aaaagucagagacaga

SEQ ID NO: 697935 - RNA, 14 nt, Homo sapiens
aaaagugccucaag

SEQ ID NO: 697936 - RNA, 19 nt, Homo sapiens
aaaauaauuauaaauauca

SEQ ID NO: 697937 - RNA, 14 nt, Homo sapiens
aaaauacuguucuu

SEQ ID NO: 697938 - RNA, 21 nt, Homo sapiens
aaaauauuuuuagaacuccaa

SEQ ID NO: 697939 - RNA, 19 nt, Homo sapiens
aaaaucagccugcuccagc

SEQ ID NO: 697940 - RNA, 16 nt, Homo sapiens
aaaaucauaguacucu

SEQ ID NO: 697941 - RNA, 20 nt, Homo sapiens
aaaaugaaaggaaguuucag

SEQ ID NO: 697942 - RNA, 18 nt, Homo sapiens
aaaaugaagcugcccuaa

SEQ ID NO: 697943 - RNA, 21 nt, Homo sapiens
aaaauggucacguuuggugcu

SEQ ID NO: 697944 - RNA, 16 nt, Homo sapiens
aaaauggucucuaaca

SEQ ID NO: 697945 - RNA, 15 nt, Homo sapiens
aaaauguauuuuucc

SEQ ID NO: 697946 - RNA, 17 nt, Homo sapiens
aaaauuaucaauaucua

SEQ ID NO: 697947 - RNA, 17 nt, Homo sapiens
aaaauucuuaaguaugu

SEQ ID NO: 697948 - RNA, 13 nt, Homo sapiens
aaaauuggacaga

SEQ ID NO: 697949 - RNA, 17 nt, Homo sapiens
aaaauugggcaugccau

SEQ ID NO: 697950 - RNA, 18 nt, Homo sapiens
aaaauuuuguauguuaaa

SEQ ID NO: 697951 - RNA, 21 nt, Homo sapiens
aaacaaaaugaagcugcccua

SEQ ID NO: 697952 - RNA, 17 nt, Homo sapiens
aaacaaaauuugacuaa

SEQ ID NO: 697953 - RNA, 15 nt, Homo sapiens
aaacaaccaugucau

SEQ ID NO: 697954 - RNA, 21 nt, Homo sapiens
aaacacccgacgucauguauu

SEQ ID NO: 697955 - RNA, 21 nt, Homo sapiens
aaacagcaggacuuguuuaca

SEQ ID NO: 697956 - RNA, 16 nt, Homo sapiens
aaacaggaacaaucca

SEQ ID NO: 697957 - RNA, 24 nt, Homo sapiens
aaacaggguuugauagcacuuaaa

SEQ ID NO: 697958 - RNA, 21 nt, Homo sapiens
aaacauugaaguaaugaauuu

SEQ ID NO: 697959 - RNA, 18 nt, Homo sapiens
aaaccaaagagggcuucc

SEQ ID NO: 697960 - RNA, 13 nt, Homo sapiens
aaacccccagugu

SEQ ID NO: 697961 - RNA, 15 nt, Homo sapiens
aaacucauuggcuua

SEQ ID NO: 697962 - RNA, 19 nt, Homo sapiens
aaacuccacaucugccuua

SEQ ID NO: 697963 - RNA, 22 nt, Homo sapiens
aaacugagaaauuuacuacagu

SEQ ID NO: 697964 - RNA, 14 nt, Homo sapiens
aaacuguguugcca

SEQ ID NO: 697965 - RNA, 21 nt, Homo sapiens
aaacuucauauguaaucucua

SEQ ID NO: 697966 - RNA, 13 nt, Homo sapiens
aaacuuguuuaca

SEQ ID NO: 697967 - RNA, 23 nt, Homo sapiens
aaagaaaaauaucuuggccuaaa

SEQ ID NO: 697968 - RNA, 19 nt, Homo sapiens
aaagaaauaaaccaaagga

SEQ ID NO: 697969 - RNA, 18 nt, Homo sapiens
aaagagagaugaaccaca

SEQ ID NO: 697970 - RNA, 18 nt, Homo sapiens
aaagagagucgcaucuca

SEQ ID NO: 697971 - RNA, 14 nt, Homo sapiens
aaagaggaagcaaa

SEQ ID NO: 697972 - RNA, 15 nt, Homo sapiens
aaagaggcugccccu

SEQ ID NO: 697973 - RNA, 22 nt, Homo sapiens
aaagaggcugccccucucacca

SEQ ID NO: 697974 - RNA, 14 nt, Homo sapiens
aaagagggcuuccu

SEQ ID NO: 697975 - RNA, 20 nt, Homo sapiens
aaagauucuucuguguuuau

SEQ ID NO: 697976 - RNA, 12 nt, Homo sapiens
aaagcacuguug

SEQ ID NO: 697977 - RNA, 17 nt, Homo sapiens
aaagcagaugagcugug

SEQ ID NO: 697978 - RNA, 17 nt, Homo sapiens
aaagcuaaggaccuuaa

SEQ ID NO: 697979 - RNA, 22 nt, Homo sapiens
aaagcuacaacaaauacuacag

SEQ ID NO: 697980 - RNA, 22 nt, Homo sapiens
aaagcuacugggccuccucuca

SEQ ID NO: 697981 - RNA, 13 nt, Homo sapiens
aaagcuagucaac

SEQ ID NO: 697982 - RNA, 13 nt, Homo sapiens
aaagcuuccccaa

SEQ ID NO: 697983 - RNA, 21 nt, Homo sapiens
aaagggccugcccagacaaga

SEQ ID NO: 697984 - RNA, 18 nt, Homo sapiens
aaagguauuauacaugug

SEQ ID NO: 697985 - RNA, 23 nt, Homo sapiens
aaagucagagacagauaccucca

SEQ ID NO: 697986 - RNA, 19 nt, Homo sapiens
aaagucugucuuuccugaa

SEQ ID NO: 697987 - RNA, 19 nt, Homo sapiens
aaagugagacuccgucaca

SEQ ID NO: 697988 - RNA, 12 nt, Homo sapiens
aaagugccaaag

SEQ ID NO: 697989 - RNA, 14 nt, Homo sapiens
aaagugccaaagaa

SEQ ID NO: 697990 - RNA, 15 nt, Homo sapiens
aaaguuaaacauuga

SEQ ID NO: 697991 - RNA, 17 nt, Homo sapiens
aaaguucuucauaucau

SEQ ID NO: 697992 - RNA, 15 nt, Homo sapiens
aaauaaaacauagca

SEQ ID NO: 697993 - RNA, 15 nt, Homo sapiens
aaauacacauuugcu

SEQ ID NO: 697994 - RNA, 21 nt, Homo sapiens
aaauacaugaagcuucaugca

SEQ ID NO: 697995 - RNA, 17 nt, Homo sapiens
aaauagaaccacuauga

SEQ ID NO: 697996 - RNA, 13 nt, Homo sapiens
aaauagucacuca

SEQ ID NO: 697997 - RNA, 19 nt, Homo sapiens
aaauauuguugaacacuug

SEQ ID NO: 697998 - RNA, 18 nt, Homo sapiens
aaauauuugcuaugaagc

SEQ ID NO: 697999 - RNA, 13 nt, Homo sapiens
aaaucaaauauuc

SEQ ID NO: 698000 - RNA, 18 nt, Homo sapiens
aaaucaauacacuaguug

SEQ ID NO: 698001 - RNA, 15 nt, Homo sapiens
aaaucaauucuaguc

SEQ ID NO: 698002 - RNA, 20 nt, Homo sapiens
aaaucuaggugauuguucau

SEQ ID NO: 698003 - RNA, 18 nt, Homo sapiens
aaaucugauggccuuaau

SEQ ID NO: 698004 - RNA, 19 nt, Homo sapiens
aaaugaaaaaucuguugau

SEQ ID NO: 698005 - RNA, 18 nt, Homo sapiens
aaaugaggaggaugcuaa

SEQ ID NO: 698006 - RNA, 12 nt, Homo sapiens
cugcuccagcug

SEQ ID NO: 698007 - RNA, 15 nt, Homo sapiens
cugcuccagugcagg

SEQ ID NO: 698008 - RNA, 16 nt, Homo sapiens
cugcuccagugcagga

SEQ ID NO: 698009 - RNA, 21 nt, Homo sapiens
cugcugccucuuucccuagga

SEQ ID NO: 698010 - RNA, 12 nt, Homo sapiens
cugcugcuggug

SEQ ID NO: 698011 - RNA, 18 nt, Homo sapiens
cugcugggggcaacuggc

SEQ ID NO: 698012 - RNA, 19 nt, Homo sapiens
cugcugugauuccacuaca

SEQ ID NO: 698013 - RNA, 19 nt, Homo sapiens
cugcuuacccaucuucaaa

SEQ ID NO: 698014 - RNA, 13 nt, Homo sapiens
cugcuucccuuac

SEQ ID NO: 698015 - RNA, 15 nt, Homo sapiens
cugcuugcuuggccc

SEQ ID NO: 698016 - RNA, 18 nt, Homo sapiens
cugcuuguuaugcaucau

SEQ ID NO: 698017 - RNA, 16 nt, Homo sapiens
cugcuuuagacuugaa

SEQ ID NO: 698018 - RNA, 12 nt, Homo sapiens
cuggaagccaaa

SEQ ID NO: 698019 - RNA, 16 nt, Homo sapiens
cuggacaguaucccac

SEQ ID NO: 698020 - RNA, 22 nt, Homo sapiens
cuggacggcaggcucacugcca

SEQ ID NO: 698021 - RNA, 12 nt, Homo sapiens
cuggacugcaau

SEQ ID NO: 698022 - RNA, 17 nt, Homo sapiens
cuggagcaaaagucauu

SEQ ID NO: 698023 - RNA, 21 nt, Homo sapiens
cuggaucuaccagcauaaaua

SEQ ID NO: 698024 - RNA, 12 nt, Homo sapiens
cuggcacugacu

SEQ ID NO: 698025 - RNA, 20 nt, Homo sapiens
cuggccuuuguaagugcagg

SEQ ID NO: 698026 - RNA, 14 nt, Homo sapiens
cuggcugagguucc

SEQ ID NO: 698027 - RNA, 16 nt, Homo sapiens
cugggagacugaagac

SEQ ID NO: 698028 - RNA, 16 nt, Homo sapiens
cugggccauguccaaa

SEQ ID NO: 698029 - RNA, 16 nt, Homo sapiens
cugggcggcugugcuu

SEQ ID NO: 698030 - RNA, 20 nt, Homo sapiens
cuggggaaagacacugccug

SEQ ID NO: 698031 - RNA, 16 nt, Homo sapiens
cuggggcagacaauaa

SEQ ID NO: 698032 - RNA, 19 nt, Homo sapiens
cuggggccuagcgaucucu

SEQ ID NO: 698033 - RNA, 22 nt, Homo sapiens
cuggguuccuccucuccuacuc

SEQ ID NO: 698034 - RNA, 11 nt, Homo sapiens
cuggugcacag

SEQ ID NO: 698035 - RNA, 14 nt, Homo sapiens
cuguaaagacuuuu

SEQ ID NO: 698036 - RNA, 16 nt, Homo sapiens
cuguaaggcauuuuca

SEQ ID NO: 698037 - RNA, 21 nt, Homo sapiens
cuguaaucccagcacuuuggg

SEQ ID NO: 698038 - RNA, 12 nt, Homo sapiens
cuguacuguuac

SEQ ID NO: 698039 - RNA, 22 nt, Homo sapiens
cuguacuguuacugggcccuga

SEQ ID NO: 698040 - RNA, 21 nt, Homo sapiens
cuguauuugaaauaagaauuc

SEQ ID NO: 698041 - RNA, 21 nt, Homo sapiens
cugucaaaugaugugcaaaac

SEQ ID NO: 698042 - RNA, 16 nt, Homo sapiens
cuguccccacacugac

SEQ ID NO: 698043 - RNA, 17 nt, Homo sapiens
cuguccccacacugacc

SEQ ID NO: 698044 - RNA, 14 nt, Homo sapiens
cugucggugggacc

SEQ ID NO: 698045 - RNA, 15 nt, Homo sapiens
cugucggugggacuc

SEQ ID NO: 698046 - RNA, 13 nt, Homo sapiens
cugucuuccucaa

SEQ ID NO: 698047 - RNA, 18 nt, Homo sapiens
cugugaccaggaaggaag

SEQ ID NO: 698048 - RNA, 15 nt, Homo sapiens
cugugcuaugaauuu

SEQ ID NO: 698049 - RNA, 21 nt, Homo sapiens
cuguguuaauuuaaguuuuga

SEQ ID NO: 698050 - RNA, 17 nt, Homo sapiens
cuguuucugcuugcucu

SEQ ID NO: 698051 - RNA, 20 nt, Homo sapiens
cuuaaaauaaugaauacauu

SEQ ID NO: 698052 - RNA, 23 nt, Homo sapiens
cuuaaauaauaaacaguggaaua

SEQ ID NO: 698053 - RNA, 13 nt, Homo sapiens
cuuaaauaaucuc

SEQ ID NO: 698054 - RNA, 12 nt, Homo sapiens
cuuaacauucau

SEQ ID NO: 698055 - RNA, 15 nt, Homo sapiens
cuuaacauucauaga

SEQ ID NO: 698056 - RNA, 18 nt, Homo sapiens
cuuaaccuuuuaauacug

SEQ ID NO: 698057 - RNA, 17 nt, Homo sapiens
cuuaacucugaugguuc

SEQ ID NO: 698058 - RNA, 21 nt, Homo sapiens
cuuaagcuuccgccgucucaa

SEQ ID NO: 698059 - RNA, 18 nt, Homo sapiens
cuuaaggacaaagugcca

SEQ ID NO: 698060 - RNA, 22 nt, Homo sapiens
cuuaaggacaaagugccaaaga

SEQ ID NO: 698061 - RNA, 19 nt, Homo sapiens
cuuaauaaauuguguuucc

SEQ ID NO: 698062 - RNA, 17 nt, Homo sapiens
cuuaccuagugaaacuu

SEQ ID NO: 698063 - RNA, 21 nt, Homo sapiens
cuuacuaaaaaguauaaaaua

SEQ ID NO: 698064 - RNA, 15 nt, Homo sapiens
cuuacuuaggugugg

SEQ ID NO: 698065 - RNA, 16 nt, Homo sapiens
cuuacuuuacugccug

SEQ ID NO: 698066 - RNA, 22 nt, Homo sapiens
cuuagagaggacaauacugggg

SEQ ID NO: 698067 - RNA, 17 nt, Homo sapiens
cuuagguuggcaaaaag

SEQ ID NO: 698068 - RNA, 18 nt, Homo sapiens
cuuauaauuguucucaga

SEQ ID NO: 698069 - RNA, 16 nt, Homo sapiens
cuuauuucucauauca

SEQ ID NO: 698070 - RNA, 20 nt, Homo sapiens
cuucacaguagagccagcuu

SEQ ID NO: 698071 - RNA, 17 nt, Homo sapiens
cuucacccuggagccca

SEQ ID NO: 698072 - RNA, 23 nt, Homo sapiens
cuucagagaaaucugcauucuau

SEQ ID NO: 698073 - RNA, 20 nt, Homo sapiens
cuucagaggauaaauaucaa

SEQ ID NO: 698074 - RNA, 16 nt, Homo sapiens
cuucagccaaacacaa

SEQ ID NO: 698075 - RNA, 16 nt, Homo sapiens
cuucauaucaucacaa

SEQ ID NO: 698076 - RNA, 15 nt, Homo sapiens
cuucauuccaaucua

SEQ ID NO: 698077 - RNA, 23 nt, Homo sapiens
cuucauuccaaucuauugcuuca

SEQ ID NO: 698078 - RNA, 20 nt, Homo sapiens
cuuccaacccgccggucuca

SEQ ID NO: 698079 - RNA, 21 nt, Homo sapiens
cuuccaacucaaacucuuaaa

SEQ ID NO: 698080 - RNA, 18 nt, Homo sapiens
cuuccagaucacugccac

SEQ ID NO: 698081 - RNA, 13 nt, Homo sapiens
cuuccagcaauaa

SEQ ID NO: 698082 - RNA, 23 nt, Homo sapiens
cuuccagcauuuagcuggccaca

SEQ ID NO: 698083 - RNA, 15 nt, Homo sapiens
cuuccauuccacaca

SEQ ID NO: 698084 - RNA, 17 nt, Homo sapiens
cuuccccaaugcuccau

SEQ ID NO: 698085 - RNA, 23 nt, Homo sapiens
cuuccuacacguuagauuugccg

SEQ ID NO: 698086 - RNA, 17 nt, Homo sapiens
cuuccugaaacuauauu

SEQ ID NO: 698087 - RNA, 20 nt, Homo sapiens
cuuccuggcuccaacacugc

SEQ ID NO: 698088 - RNA, 20 nt, Homo sapiens
cuuccugugauccacccaac

SEQ ID NO: 698089 - RNA, 20 nt, Homo sapiens
cuuccuuaauucacucccac

SEQ ID NO: 698090 - RNA, 18 nt, Homo sapiens
cuuccuugccugaugaca

SEQ ID NO: 698091 - RNA, 18 nt, Homo sapiens
cuuccuuuuaacugccaa

SEQ ID NO: 698092 - RNA, 16 nt, Homo sapiens
cuucuaagaaaagccu

SEQ ID NO: 698093 - RNA, 15 nt, Homo sapiens
cuucuagugccucug

SEQ ID NO: 698094 - RNA, 21 nt, Homo sapiens
cuucugaggcgcugcuuuguc

SEQ ID NO: 698095 - RNA, 23 nt, Homo sapiens
cuucuggggcaggcugggccaug

SEQ ID NO: 698096 - RNA, 22 nt, Homo sapiens
cuucugugcccagaauacugau

SEQ ID NO: 698097 - RNA, 11 nt, Homo sapiens
cuucuugccuc

SEQ ID NO: 698098 - RNA, 13 nt, Homo sapiens
cuucuugcucccc

SEQ ID NO: 698099 - RNA, 20 nt, Homo sapiens
cuucuuggggcccagugcau

SEQ ID NO: 698100 - RNA, 17 nt, Homo sapiens
cuugaauaaacaccacu

SEQ ID NO: 698101 - RNA, 20 nt, Homo sapiens
cuugagccgggccccugggc

SEQ ID NO: 698102 - RNA, 16 nt, Homo sapiens
cuugauucagucacau

SEQ ID NO: 698103 - RNA, 22 nt, Homo sapiens
cuuggcuucugugaugagcuga

SEQ ID NO: 698104 - RNA, 15 nt, Homo sapiens
cuugguguaauuuga

SEQ ID NO: 698105 - RNA, 16 nt, Homo sapiens
cuugguucacugcaac

SEQ ID NO: 698106 - RNA, 20 nt, Homo sapiens
cuugguugucuggcaaggac

SEQ ID NO: 698107 - RNA, 18 nt, Homo sapiens
cuuguaucccuagugcuc

SEQ ID NO: 698108 - RNA, 19 nt, Homo sapiens
cuuguccuugagugcucuu

SEQ ID NO: 698109 - RNA, 18 nt, Homo sapiens
cuuguggguccaugcuaa

SEQ ID NO: 698110 - RNA, 13 nt, Homo sapiens
cuuguucccacac

SEQ ID NO: 698111 - RNA, 13 nt, Homo sapiens
cuuguuucacuga

SEQ ID NO: 698112 - RNA, 14 nt, Homo sapiens
cuuuaaaaugccaa

SEQ ID NO: 698113 - RNA, 22 nt, Homo sapiens
cuuuaaacacucuucagagaaa

SEQ ID NO: 698114 - RNA, 22 nt, Homo sapiens
cuuuaagccuucaaaacuauag

SEQ ID NO: 698115 - RNA, 16 nt, Homo sapiens
cuuuaauccaguguua

SEQ ID NO: 698116 - RNA, 16 nt, Homo sapiens
cuuuacauggaugcca

SEQ ID NO: 698117 - RNA, 17 nt, Homo sapiens
cuuuagaaacucaaaaa

SEQ ID NO: 698118 - RNA, 12 nt, Homo sapiens
cuuuauuuuaga

SEQ ID NO: 698119 - RNA, 20 nt, Homo sapiens
cuuucccauuucuaccuaag

SEQ ID NO: 698120 - RNA, 15 nt, Homo sapiens
cuuuccugaaccaug

SEQ ID NO: 698121 - RNA, 14 nt, Homo sapiens
cuuucucucucuaa

SEQ ID NO: 698122 - RNA, 19 nt, Homo sapiens
cuuucugcuaucaaagagg

SEQ ID NO: 698123 - RNA, 18 nt, Homo sapiens
cuuugccuuggcuuugcc

SEQ ID NO: 698124 - RNA, 11 nt, Homo sapiens
ggaggcuuccu

SEQ ID NO: 698125 - RNA, 20 nt, Homo sapiens
ggagguggaggcugcaguga

SEQ ID NO: 698126 - RNA, 17 nt, Homo sapiens
ggauacuggugcaguca

SEQ ID NO: 698127 - RNA, 16 nt, Homo sapiens
ggauagacgaguugau

SEQ ID NO: 698128 - RNA, 13 nt, Homo sapiens
ggaucuaccagca

SEQ ID NO: 698129 - RNA, 16 nt, Homo sapiens
ggaugaaacuaaagca

SEQ ID NO: 698130 - RNA, 15 nt, Homo sapiens
ggaugaacaauuaua

SEQ ID NO: 698131 - RNA, 13 nt, Homo sapiens
ggauuuguugcca

SEQ ID NO: 698132 - RNA, 21 nt, Homo sapiens
ggauuuuaacuuaacugaaau

SEQ ID NO: 698133 - RNA, 14 nt, Homo sapiens
ggcaaacaggcagu

SEQ ID NO: 698134 - RNA, 24 nt, Homo sapiens
ggcaaagaaaaugaaaugcauauu

SEQ ID NO: 698135 - RNA, 17 nt, Homo sapiens
ggcaaagaccgauugca

SEQ ID NO: 698136 - RNA, 21 nt, Homo sapiens
ggcacggcccguggcuguuga

SEQ ID NO: 698137 - RNA, 12 nt, Homo sapiens
ggcagauuugag

SEQ ID NO: 698138 - RNA, 20 nt, Homo sapiens
ggcaggaaaauuguuugaac

SEQ ID NO: 698139 - RNA, 18 nt, Homo sapiens
ggcaggcugggccauguc

SEQ ID NO: 698140 - RNA, 20 nt, Homo sapiens
ggcagggagcugggcccgac

SEQ ID NO: 698141 - RNA, 16 nt, Homo sapiens
ggcaguagaacuccag

SEQ ID NO: 698142 - RNA, 22 nt, Homo sapiens
ggcaguuugaggauuaguuuag

SEQ ID NO: 698143 - RNA, 22 nt, Homo sapiens
ggcaucaugcaugucaaacaug

SEQ ID NO: 698144 - RNA, 16 nt, Homo sapiens
ggcaugagacucagug

SEQ ID NO: 698145 - RNA, 15 nt, Homo sapiens
ggccacccagccagg

SEQ ID NO: 698146 - RNA, 15 nt, Homo sapiens
ggccauguccaaaga

SEQ ID NO: 698147 - RNA, 23 nt, Homo sapiens
ggcccuccucucccauccuugau

SEQ ID NO: 698148 - RNA, 14 nt, Homo sapiens
ggccuacagcuuug

SEQ ID NO: 698149 - RNA, 17 nt, Homo sapiens
ggcgccaucgccaagua

SEQ ID NO: 698150 - RNA, 22 nt, Homo sapiens
ggcgcuugcaccacuuccgucc

SEQ ID NO: 698151 - RNA, 17 nt, Homo sapiens
ggcggagcuugcaguga

SEQ ID NO: 698152 - RNA, 14 nt, Homo sapiens
ggcggaucaucuaa

SEQ ID NO: 698153 - RNA, 16 nt, Homo sapiens
ggcgucccuuccaacc

SEQ ID NO: 698154 - RNA, 13 nt, Homo sapiens
ggcgugggcgcuu

SEQ ID NO: 698155 - RNA, 14 nt, Homo sapiens
ggcucacucacaga

SEQ ID NO: 698156 - RNA, 16 nt, Homo sapiens
ggcuccaacacugcug

SEQ ID NO: 698157 - RNA, 23 nt, Homo sapiens
ggcugaccccgguggcggcccca

SEQ ID NO: 698158 - RNA, 17 nt, Homo sapiens
ggcugaugguguggccu

SEQ ID NO: 698159 - RNA, 17 nt, Homo sapiens
ggcugcacccacccagg

SEQ ID NO: 698160 - RNA, 11 nt, Homo sapiens
ggcuggcacug

SEQ ID NO: 698161 - RNA, 13 nt, Homo sapiens
ggcuggcacugac

SEQ ID NO: 698162 - RNA, 21 nt, Homo sapiens
ggcuguguugguguggcccau

SEQ ID NO: 698163 - RNA, 13 nt, Homo sapiens
ggcuucugugaug

SEQ ID NO: 698164 - RNA, 14 nt, Homo sapiens
ggcuugaagccaaa

SEQ ID NO: 698165 - RNA, 17 nt, Homo sapiens
gggacaucacagggugg

SEQ ID NO: 698166 - RNA, 20 nt, Homo sapiens
gggacgcuccgcugccgugc

SEQ ID NO: 698167 - RNA, 15 nt, Homo sapiens
gggacucguggcugu

SEQ ID NO: 698168 - RNA, 11 nt, Homo sapiens
gggagccagcc

SEQ ID NO: 698169 - RNA, 21 nt, Homo sapiens
gggaggccccagggggucuca

SEQ ID NO: 698170 - RNA, 21 nt, Homo sapiens
gggaggcccugagacagggau

SEQ ID NO: 698171 - RNA, 17 nt, Homo sapiens
gggaggcgggggcugcc

SEQ ID NO: 698172 - RNA, 23 nt, Homo sapiens
gggcaagggguucccuugagggc

SEQ ID NO: 698173 - RNA, 13 nt, Homo sapiens
gggcagacaauaa

SEQ ID NO: 698174 - RNA, 21 nt, Homo sapiens
gggcaggcugggccaugucca

SEQ ID NO: 698175 - RNA, 14 nt, Homo sapiens
gggccacccagcca

SEQ ID NO: 698176 - RNA, 15 nt, Homo sapiens
gggcccucgguggga

SEQ ID NO: 698177 - RNA, 21 nt, Homo sapiens
gggcccucugugcucuucucu

SEQ ID NO: 698178 - RNA, 16 nt, Homo sapiens
gggccugcccagacaa

SEQ ID NO: 698179 - RNA, 16 nt, Homo sapiens
gggcucccaggggucu

SEQ ID NO: 698180 - RNA, 18 nt, Homo sapiens
gggcucugugaccaggaa

SEQ ID NO: 698181 - RNA, 17 nt, Homo sapiens
ggggacaagggauuuga

SEQ ID NO: 698182 - RNA, 15 nt, Homo sapiens
ggggcagacaauaaa

SEQ ID NO: 698183 - RNA, 18 nt, Homo sapiens
ggggcaggcugggccaug

SEQ ID NO: 698184 - RNA, 18 nt, Homo sapiens
ggggccgggcgcgguggc

SEQ ID NO: 698185 - RNA, 16 nt, Homo sapiens
ggggccugaggucauc

SEQ ID NO: 698186 - RNA, 12 nt, Homo sapiens
gggguuccucaa

SEQ ID NO: 698187 - RNA, 15 nt, Homo sapiens
ggguaccuggcuaug

SEQ ID NO: 698188 - RNA, 19 nt, Homo sapiens
ggguuggacuguaagggau

SEQ ID NO: 698189 - RNA, 19 nt, Homo sapiens
gguaaaacucacugugauc

SEQ ID NO: 698190 - RNA, 22 nt, Homo sapiens
gguauguguggaugaugcugcc

SEQ ID NO: 698191 - RNA, 15 nt, Homo sapiens
ggucaaaggcucaaa

SEQ ID NO: 698192 - RNA, 12 nt, Homo sapiens
ggucacccagga

SEQ ID NO: 698193 - RNA, 11 nt, Homo sapiens
ggucucaaagu

SEQ ID NO: 698194 - RNA, 18 nt, Homo sapiens
ggugaaaccccgucucua

SEQ ID NO: 698195 - RNA, 17 nt, Homo sapiens
ggugaggggcuggcacu

SEQ ID NO: 698196 - RNA, 17 nt, Homo sapiens
gguggcucacgccugua

SEQ ID NO: 698197 - RNA, 17 nt, Homo sapiens
ggugggacccguggcug

SEQ ID NO: 698198 - RNA, 20 nt, Homo sapiens
ggugggauuccacucgugug

SEQ ID NO: 698199 - RNA, 18 nt, Homo sapiens
gguggggggcauugagua

SEQ ID NO: 698200 - RNA, 22 nt, Homo sapiens
gguuccagggucccucugugua

SEQ ID NO: 698201 - RNA, 19 nt, Homo sapiens
gguuggacuguaagggauu

SEQ ID NO: 698202 - RNA, 18 nt, Homo sapiens
guaaaaaaaccaccaaaa

SEQ ID NO: 698203 - RNA, 18 nt, Homo sapiens
guaaaacaugcuggugaa

SEQ ID NO: 698204 - RNA, 18 nt, Homo sapiens
guaaaaggauaguaagca

SEQ ID NO: 698205 - RNA, 17 nt, Homo sapiens
guaaacgggaacaugcc

SEQ ID NO: 698206 - RNA, 16 nt, Homo sapiens
guaaauacaugcauau

SEQ ID NO: 698207 - RNA, 15 nt, Homo sapiens
guaaauguaaacuca

SEQ ID NO: 698208 - RNA, 23 nt, Homo sapiens
guaacuugcuuaaauuucuuaug

SEQ ID NO: 698209 - RNA, 23 nt, Homo sapiens
guaagaucacuguuuagauuugc

SEQ ID NO: 698210 - RNA, 21 nt, Homo sapiens
guaaggacggacucacuucuc

SEQ ID NO: 698211 - RNA, 16 nt, Homo sapiens
guaagggaacaaguug

SEQ ID NO: 698212 - RNA, 16 nt, Homo sapiens
guaaguuaucuuugaa

SEQ ID NO: 698213 - RNA, 13 nt, Homo sapiens
guaauaagcaauc

SEQ ID NO: 698214 - RNA, 22 nt, Homo sapiens
guaauaauaaaucguccuccca

SEQ ID NO: 698215 - RNA, 19 nt, Homo sapiens
guaaucucuaggaagucaa

SEQ ID NO: 698216 - RNA, 17 nt, Homo sapiens
guaaucuuuggcuguaa

SEQ ID NO: 698217 - RNA, 14 nt, Homo sapiens
guacauaauacuga

SEQ ID NO: 698218 - RNA, 17 nt, Homo sapiens
guacugugucucaugga

SEQ ID NO: 698219 - RNA, 23 nt, Homo sapiens
guagaaguuuggcugcugucaua

SEQ ID NO: 698220 - RNA, 15 nt, Homo sapiens
guagagaagcaagua

SEQ ID NO: 698221 - RNA, 15 nt, Homo sapiens
guaggagacuugcca

SEQ ID NO: 698222 - RNA, 19 nt, Homo sapiens
guagugucacugcuuguua

SEQ ID NO: 698223 - RNA, 16 nt, Homo sapiens
guauaaauauacagua

SEQ ID NO: 698224 - RNA, 17 nt, Homo sapiens
guauacuaagugauaca

SEQ ID NO: 698225 - RNA, 21 nt, Homo sapiens
guauaggggcaacuguaugaa

SEQ ID NO: 698226 - RNA, 15 nt, Homo sapiens
guauauagaagucua

SEQ ID NO: 698227 - RNA, 17 nt, Homo sapiens
guauauuugguacugua

SEQ ID NO: 698228 - RNA, 21 nt, Homo sapiens
guaucuccggcucccagccuc

SEQ ID NO: 698229 - RNA, 14 nt, Homo sapiens
guauguguuuagaa

SEQ ID NO: 698230 - RNA, 11 nt, Homo sapiens
guauguuaaag

SEQ ID NO: 698231 - RNA, 13 nt, Homo sapiens
guauuaaagacag

SEQ ID NO: 698232 - RNA, 17 nt, Homo sapiens
guauucuucaaccagug

SEQ ID NO: 698233 - RNA, 23 nt, Homo sapiens
guauuuaaaaauagaaacauauc

SEQ ID NO: 698234 - RNA, 21 nt, Homo sapiens
guauuuucaugaaaauaccau

SEQ ID NO: 698235 - RNA, 18 nt, Homo sapiens
gucacguuuggugcuucu

SEQ ID NO: 698236 - RNA, 19 nt, Homo sapiens
gucagagacagauaccucc

SEQ ID NO: 698237 - RNA, 16 nt, Homo sapiens
gucauguguuuugcca

SEQ ID NO: 698238 - RNA, 11 nt, Homo sapiens
guccaaaaagc

SEQ ID NO: 698239 - RNA, 21 nt, Homo sapiens
guccacgcgugccguggcacc

SEQ ID NO: 698240 - RNA, 11 nt, Homo sapiens
guccagcaccu

SEQ ID NO: 698241 - RNA, 15 nt, Homo sapiens
guccaguaagaucac

SEQ ID NO: 698242 - RNA, 15 nt, Homo sapiens
gucccaggcagggag

SEQ ID NO: 698243 - RNA, 16 nt, Homo sapiens
uccagcauuuagcugg

SEQ ID NO: 698244 - RNA, 16 nt, Homo sapiens
uccaggccaaagugcc

SEQ ID NO: 698245 - RNA, 16 nt, Homo sapiens
uccagggacacacagc

SEQ ID NO: 698246 - RNA, 14 nt, Homo sapiens
uccaguaagaucac

SEQ ID NO: 698247 - RNA, 17 nt, Homo sapiens
uccaguaagaucacugu

SEQ ID NO: 698248 - RNA, 13 nt, Homo sapiens
uccagugcaggag

SEQ ID NO: 698249 - RNA, 17 nt, Homo sapiens
uccaguguuugggauga

SEQ ID NO: 698250 - RNA, 15 nt, Homo sapiens
uccauacacuuuguu

SEQ ID NO: 698251 - RNA, 17 nt, Homo sapiens
ucccagcuacucgggag

SEQ ID NO: 698252 - RNA, 17 nt, Homo sapiens
ucccaucagcgugcauu

SEQ ID NO: 698253 - RNA, 15 nt, Homo sapiens
uccccaacaauguga

SEQ ID NO: 698254 - RNA, 13 nt, Homo sapiens
uccccagggggca

SEQ ID NO: 698255 - RNA, 18 nt, Homo sapiens
ucccccaccgguccagcu

SEQ ID NO: 698256 - RNA, 21 nt, Homo sapiens
uccccgugccaaaaaucuuuu

SEQ ID NO: 698257 - RNA, 14 nt, Homo sapiens
ucccucuaaugaga

SEQ ID NO: 698258 - RNA, 13 nt, Homo sapiens
ucccugaucccau

SEQ ID NO: 698259 - RNA, 15 nt, Homo sapiens
ucccuugcuugccug

SEQ ID NO: 698260 - RNA, 19 nt, Homo sapiens
uccgagaggugggccaguc

SEQ ID NO: 698261 - RNA, 23 nt, Homo sapiens
uccuaaagaaaaauaucuuggcc

SEQ ID NO: 698262 - RNA, 18 nt, Homo sapiens
uccuaaauguaaucacga

SEQ ID NO: 698263 - RNA, 19 nt, Homo sapiens
uccuaaggaauuaccaaga

SEQ ID NO: 698264 - RNA, 23 nt, Homo sapiens
uccuacacguuagauuugccgua

SEQ ID NO: 698265 - RNA, 23 nt, Homo sapiens
uccuacauaucccuuccagaugg

SEQ ID NO: 698266 - RNA, 13 nt, Homo sapiens
uccuagcacuuug

SEQ ID NO: 698267 - RNA, 21 nt, Homo sapiens
uccucauuagcauuuugcuaa

SEQ ID NO: 698268 - RNA, 12 nt, Homo sapiens
uccuccaacagc

SEQ ID NO: 698269 - RNA, 17 nt, Homo sapiens
uccucccaggaagccca

SEQ ID NO: 698270 - RNA, 14 nt, Homo sapiens
uccucucugcacac

SEQ ID NO: 698271 - RNA, 15 nt, Homo sapiens
uccugaaacuauauu

SEQ ID NO: 698272 - RNA, 23 nt, Homo sapiens
uccugaaacuauauuuugucaua

SEQ ID NO: 698273 - RNA, 13 nt, Homo sapiens
uccugacugaaag

SEQ ID NO: 698274 - RNA, 19 nt, Homo sapiens
uccuggcuaacauggugaa

SEQ ID NO: 698275 - RNA, 16 nt, Homo sapiens
uccugugaaaauauga

SEQ ID NO: 698276 - RNA, 13 nt, Homo sapiens
uccuuccauucca

SEQ ID NO: 698277 - RNA, 15 nt, Homo sapiens
uccuuccauuccaca

SEQ ID NO: 698278 - RNA, 16 nt, Homo sapiens
uccuuugccugauccu

SEQ ID NO: 698279 - RNA, 17 nt, Homo sapiens
uccuuuuugacacugaa

SEQ ID NO: 698280 - RNA, 17 nt, Homo sapiens
ucgaaucucugugccuu

SEQ ID NO: 698281 - RNA, 18 nt, Homo sapiens
ucgagaccauccuggcua

SEQ ID NO: 698282 - RNA, 12 nt, Homo sapiens
ucgcaacugucc

SEQ ID NO: 698283 - RNA, 17 nt, Homo sapiens
ucgcaucucagugcagg

SEQ ID NO: 698284 - RNA, 20 nt, Homo sapiens
ucgcaucuugugucgcugaa

SEQ ID NO: 698285 - RNA, 13 nt, Homo sapiens
ucgcuucuugccu

SEQ ID NO: 698286 - RNA, 16 nt, Homo sapiens
ucgugaagaagccugu

SEQ ID NO: 698287 - RNA, 22 nt, Homo sapiens
ucuaaacagugggaguaccaaa

SEQ ID NO: 698288 - RNA, 16 nt, Homo sapiens
ucuaccuuuacuacau

SEQ ID NO: 698289 - RNA, 23 nt, Homo sapiens
ucuacuagggaaaaauaaacaca

SEQ ID NO: 698290 - RNA, 12 nt, Homo sapiens
ucuagaagccaa

SEQ ID NO: 698291 - RNA, 13 nt, Homo sapiens
ucuagaagccaag

SEQ ID NO: 698292 - RNA, 23 nt, Homo sapiens
ucuauugcuucaccauggccuua

SEQ ID NO: 698293 - RNA, 18 nt, Homo sapiens
ucuauuuuaaucuugcua

SEQ ID NO: 698294 - RNA, 23 nt, Homo sapiens
ucucaaagaaauauuaagcaugu

SEQ ID NO: 698295 - RNA, 21 nt, Homo sapiens
ucucaaggcaguuaauucuca

SEQ ID NO: 698296 - RNA, 18 nt, Homo sapiens
ucucauauaagacaaaua

SEQ ID NO: 698297 - RNA, 20 nt, Homo sapiens
ucuccaucccucuaaugaga

SEQ ID NO: 698298 - RNA, 19 nt, Homo sapiens
ucucuccacugugcuuuca

SEQ ID NO: 698299 - RNA, 18 nt, Homo sapiens
ucucucuacagagaggaa

SEQ ID NO: 698300 - RNA, 13 nt, Homo sapiens
ucucucuucucca

SEQ ID NO: 698301 - RNA, 14 nt, Homo sapiens
ucucucuucuccac

SEQ ID NO: 698302 - RNA, 12 nt, Homo sapiens
ucugaaaaccaa

SEQ ID NO: 698303 - RNA, 17 nt, Homo sapiens
ucugagagccaggguuu

SEQ ID NO: 698304 - RNA, 21 nt, Homo sapiens
ucugagcucuggcuuugccuu

SEQ ID NO: 698305 - RNA, 16 nt, Homo sapiens
ucugcaguccuacuca

SEQ ID NO: 698306 - RNA, 19 nt, Homo sapiens
ucugcaguccuacucaagc

SEQ ID NO: 698307 - RNA, 17 nt, Homo sapiens
ucugccauaucagugaa

SEQ ID NO: 698308 - RNA, 18 nt, Homo sapiens
ucugcggaucucagcuuu

SEQ ID NO: 698309 - RNA, 18 nt, Homo sapiens
ucuggaagaucauuuuga

SEQ ID NO: 698310 - RNA, 20 nt, Homo sapiens
ucuggcaucuuagaccucca

SEQ ID NO: 698311 - RNA, 21 nt, Homo sapiens
ucuggggggacccagugcaga

SEQ ID NO: 698312 - RNA, 22 nt, Homo sapiens
ucuguagcuauaaugagcaugu

SEQ ID NO: 698313 - RNA, 16 nt, Homo sapiens
ucugugcagucacugg

SEQ ID NO: 698314 - RNA, 14 nt, Homo sapiens
ucuguggaugccag

SEQ ID NO: 698315 - RNA, 21 nt, Homo sapiens
ucugugugcgcucuguggaug

SEQ ID NO: 698316 - RNA, 20 nt, Homo sapiens
ucuguuaauagucaucacau

SEQ ID NO: 698317 - RNA, 15 nt, Homo sapiens
ucuuaaaauguuaac

SEQ ID NO: 698318 - RNA, 20 nt, Homo sapiens
ucuuacuucccuaaugaagu

SEQ ID NO: 698319 - RNA, 16 nt, Homo sapiens
ucuuagaaaaaccacc

SEQ ID NO: 698320 - RNA, 11 nt, Homo sapiens
ucuucauccca

SEQ ID NO: 698321 - RNA, 17 nt, Homo sapiens
ucuucaucccauuccag

SEQ ID NO: 698322 - RNA, 14 nt, Homo sapiens
ucuucccaugcauu

SEQ ID NO: 698323 - RNA, 14 nt, Homo sapiens
ucuucuaagcaaaa

SEQ ID NO: 698324 - RNA, 12 nt, Homo sapiens
ucuucucaaagc

SEQ ID NO: 698325 - RNA, 17 nt, Homo sapiens
ucuucucaaagcacugu

SEQ ID NO: 698326 - RNA, 14 nt, Homo sapiens
ucuucucguuuuca

SEQ ID NO: 698327 - RNA, 15 nt, Homo sapiens
ucuucucguuuucac

SEQ ID NO: 698328 - RNA, 21 nt, Homo sapiens
ucuucuuggggcccagugcau

SEQ ID NO: 698329 - RNA, 23 nt, Homo sapiens
ucuugaaaauagaacaacuugca

SEQ ID NO: 698330 - RNA, 23 nt, Homo sapiens
ucuugaccuaguauaucagugac

SEQ ID NO: 698331 - RNA, 17 nt, Homo sapiens
ucuugauucagucacau

SEQ ID NO: 698332 - RNA, 21 nt, Homo sapiens
ucuugcaccaaauuaucuuga

SEQ ID NO: 698333 - RNA, 16 nt, Homo sapiens
ucuuggccuaaaccuc

SEQ ID NO: 698334 - RNA, 14 nt, Homo sapiens
ucuuguugcucaaa

SEQ ID NO: 698335 - RNA, 16 nt, Homo sapiens
ucuuuccugaaccaug

SEQ ID NO: 698336 - RNA, 20 nt, Homo sapiens
ucuuuccugaaccaugugga

SEQ ID NO: 698337 - RNA, 20 nt, Homo sapiens
ucuuucucaaagaaauauua

SEQ ID NO: 698338 - RNA, 14 nt, Homo sapiens
ucuuugucuugccc

SEQ ID NO: 698339 - RNA, 22 nt, Homo sapiens
ucuuuuugggcuuucauagugu

SEQ ID NO: 698340 - RNA, 22 nt, Homo sapiens
ucuuuuuuuuuaaguucuuaug

SEQ ID NO: 698341 - RNA, 16 nt, Homo sapiens
ugaaaaaaaugcauuu

SEQ ID NO: 698342 - RNA, 17 nt, Homo sapiens
ugaaaaaauagauccaa

SEQ ID NO: 698343 - RNA, 13 nt, Homo sapiens
ugaaaaacuuaag

SEQ ID NO: 698344 - RNA, 22 nt, Homo sapiens
ugaaaauacaacuuaaauaaua

SEQ ID NO: 698345 - RNA, 16 nt, Homo sapiens
ugaaaaugaauaucua

SEQ ID NO: 698346 - RNA, 13 nt, Homo sapiens
ugaaaauguguuc

SEQ ID NO: 698347 - RNA, 18 nt, Homo sapiens
ugaaaccccaaacaguga

SEQ ID NO: 698348 - RNA, 17 nt, Homo sapiens
ugaaacgucauguguuu

SEQ ID NO: 698349 - RNA, 16 nt, Homo sapiens
ugaaagaugaucauuu

SEQ ID NO: 698350 - RNA, 20 nt, Homo sapiens
ugaaaggggggaaccaguga

SEQ ID NO: 698351 - RNA, 19 nt, Homo sapiens
ugaaauuacggguaccuga

SEQ ID NO: 698352 - RNA, 19 nt, Homo sapiens
ugaaauugcauacuuugua

SEQ ID NO: 698353 - RNA, 11 nt, Homo sapiens
ugaacacuccc

SEQ ID NO: 698354 - RNA, 22 nt, Homo sapiens
ugaacacuugaagccaucuaaa

SEQ ID NO: 698355 - RNA, 15 nt, Homo sapiens
ugaacagcauuagaa

SEQ ID NO: 698356 - RNA, 14 nt, Homo sapiens
ugaacuacuaaagu

SEQ ID NO: 698357 - RNA, 16 nt, Homo sapiens
ugaacuuuuguacuga

SEQ ID NO: 698358 - RNA, 19 nt, Homo sapiens
ugaagaugacaaaaguaaa

SEQ ID NO: 698359 - RNA, 19 nt, Homo sapiens
ugaagucccagauacuugg

SEQ ID NO: 698360 - RNA, 22 nt, Homo sapiens
ugaauaauacaguaucucaggg

SEQ ID NO: 698361 - RNA, 20 nt, Homo sapiens
auuucagaaguuaguuugua

SEQ ID NO: 698362 - RNA, 19 nt, Homo sapiens
auuucaggagaaccuaaca

SEQ ID NO: 698363 - RNA, 19 nt, Homo sapiens
auuuccuuuuugacacuga

SEQ ID NO: 698364 - RNA, 11 nt, Homo sapiens
auuucuacugu

SEQ ID NO: 698365 - RNA, 14 nt, Homo sapiens
auuucuacugucaa

SEQ ID NO: 698366 - RNA, 15 nt, Homo sapiens
auuucuauaaauaga

SEQ ID NO: 698367 - RNA, 13 nt, Homo sapiens
auuucucauauca

SEQ ID NO: 698368 - RNA, 20 nt, Homo sapiens
auuugccauagaguacacug

SEQ ID NO: 698369 - RNA, 12 nt, Homo sapiens
auuugccuguuu

SEQ ID NO: 698370 - RNA, 16 nt, Homo sapiens
auuugcugaauacaga

SEQ ID NO: 698371 - RNA, 20 nt, Homo sapiens
auuuguucguauuuagaaug

SEQ ID NO: 698372 - RNA, 12 nt, Homo sapiens
auuuuaaaacaa

SEQ ID NO: 698373 - RNA, 22 nt, Homo sapiens
auuuucaagagucuaauagucu

SEQ ID NO: 698374 - RNA, 21 nt, Homo sapiens
auuuuuauacaaaccuaccaa

SEQ ID NO: 698375 - RNA, 13 nt, Homo sapiens
caaaaaacuacuu

SEQ ID NO: 698376 - RNA, 16 nt, Homo sapiens
caaaaagaaaugaugu

SEQ ID NO: 698377 - RNA, 14 nt, Homo sapiens
caaaaauaguauuc

SEQ ID NO: 698378 - RNA, 16 nt, Homo sapiens
caaaauauuucaguga

SEQ ID NO: 698379 - RNA, 23 nt, Homo sapiens
caaaauauuucagugaauuugca

SEQ ID NO: 698380 - RNA, 21 nt, Homo sapiens
caaaauauuuggaaugaagga

SEQ ID NO: 698381 - RNA, 13 nt, Homo sapiens
caaaauccaaaaa

SEQ ID NO: 698382 - RNA, 15 nt, Homo sapiens
caaaauccaaaaaga

SEQ ID NO: 698383 - RNA, 21 nt, Homo sapiens
caaacaugcggugccaugaag

SEQ ID NO: 698384 - RNA, 17 nt, Homo sapiens
caaacguacaagucagu

SEQ ID NO: 698385 - RNA, 15 nt, Homo sapiens
caaacugcuucccuu

SEQ ID NO: 698386 - RNA, 20 nt, Homo sapiens
caaagaaaaauaacccuuug

SEQ ID NO: 698387 - RNA, 22 nt, Homo sapiens
caaagaaaaugaaaugcauauu

SEQ ID NO: 698388 - RNA, 22 nt, Homo sapiens
caaagaacaaacauccuugcaa

SEQ ID NO: 698389 - RNA, 13 nt, Homo sapiens
caaagacuacuaa

SEQ ID NO: 698390 - RNA, 21 nt, Homo sapiens
caaagacuacuaaugacuuug

SEQ ID NO: 698391 - RNA, 13 nt, Homo sapiens
caaagaggcugcc

SEQ ID NO: 698392 - RNA, 17 nt, Homo sapiens
caaagaggcugccccuc

SEQ ID NO: 698393 - RNA, 20 nt, Homo sapiens
caaagaggcugccccucuca

SEQ ID NO: 698394 - RNA, 14 nt, Homo sapiens
caaagcacuguuga

SEQ ID NO: 698395 - RNA, 18 nt, Homo sapiens
caaagggcccacagugac

SEQ ID NO: 698396 - RNA, 17 nt, Homo sapiens
caaagugagacuccguc

SEQ ID NO: 698397 - RNA, 20 nt, Homo sapiens
caaagugagacuccgucaca

SEQ ID NO: 698398 - RNA, 19 nt, Homo sapiens
caaaguucuucauaucauc

SEQ ID NO: 698399 - RNA, 21 nt, Homo sapiens
caaauaaagaccugagaaccu

SEQ ID NO: 698400 - RNA, 17 nt, Homo sapiens
caacaacaacaaaaagc

SEQ ID NO: 698401 - RNA, 15 nt, Homo sapiens
caacaagaaauaaua

SEQ ID NO: 698402 - RNA, 22 nt, Homo sapiens
caacacugcugcuccagugcag

SEQ ID NO: 698403 - RNA, 19 nt, Homo sapiens
caaccaggcuccugugaua

SEQ ID NO: 698404 - RNA, 15 nt, Homo sapiens
caaccaugucauuuc

SEQ ID NO: 698405 - RNA, 18 nt, Homo sapiens
caaccgagaagguuuauc

SEQ ID NO: 698406 - RNA, 12 nt, Homo sapiens
caacucacauua

SEQ ID NO: 698407 - RNA, 13 nt, Homo sapiens
caacucaucuuag

SEQ ID NO: 698408 - RNA, 18 nt, Homo sapiens
caacugucucucuucuca

SEQ ID NO: 698409 - RNA, 19 nt, Homo sapiens
caagaaaaguugaagaaga

SEQ ID NO: 698410 - RNA, 19 nt, Homo sapiens
caagaacacacacauauac

SEQ ID NO: 698411 - RNA, 17 nt, Homo sapiens
caagaauauugcaaaau

SEQ ID NO: 698412 - RNA, 20 nt, Homo sapiens
caagaauauugcaaaauaca

SEQ ID NO: 698413 - RNA, 21 nt, Homo sapiens
caagaugugaauuauugacac

SEQ ID NO: 698414 - RNA, 22 nt, Homo sapiens
caagauuuuuuaauuguuuaaa

SEQ ID NO: 698415 - RNA, 13 nt, Homo sapiens
caagcaugcuugu

SEQ ID NO: 698416 - RNA, 18 nt, Homo sapiens
caagcuggcuuacacugg

SEQ ID NO: 698417 - RNA, 23 nt, Homo sapiens
caaggaaacccccaguguaauaa

SEQ ID NO: 698418 - RNA, 18 nt, Homo sapiens
caaggcacuucauguaaa

SEQ ID NO: 698419 - RNA, 19 nt, Homo sapiens
caaggcugggggaagaagc

SEQ ID NO: 698420 - RNA, 17 nt, Homo sapiens
caaguaacugggauuac

SEQ ID NO: 698421 - RNA, 15 nt, Homo sapiens
ucuugacuagugcaa

SEQ ID NO: 698422 - RNA, 17 nt, Homo sapiens
ucuuggccuaaaccuca

SEQ ID NO: 698423 - RNA, 17 nt, Homo sapiens
ucuuggcuuaaucauuu

SEQ ID NO: 698424 - RNA, 23 nt, Homo sapiens
ucuuggggggguggccgcugagu

SEQ ID NO: 698425 - RNA, 20 nt, Homo sapiens
ucuuuaaaaguauccagaga

SEQ ID NO: 698426 - RNA, 19 nt, Homo sapiens
ucuuucagaaagcuuugaa

SEQ ID NO: 698427 - RNA, 19 nt, Homo sapiens
ucuuugauauuggcuuaaa

SEQ ID NO: 698428 - RNA, 18 nt, Homo sapiens
ucuuugauuauuugcaug

SEQ ID NO: 698429 - RNA, 16 nt, Homo sapiens
ucuuugcaacugucuc

SEQ ID NO: 698430 - RNA, 18 nt, Homo sapiens
ucuuugcauguaagcucu

SEQ ID NO: 698431 - RNA, 17 nt, Homo sapiens
ucuuugccagucauuca

SEQ ID NO: 698432 - RNA, 12 nt, Homo sapiens
ucuuuugccuuu

SEQ ID NO: 698433 - RNA, 17 nt, Homo sapiens
ugaaaaaaaaaagacaa

SEQ ID NO: 698434 - RNA, 16 nt, Homo sapiens
ugaaaaacaaaauggg

SEQ ID NO: 698435 - RNA, 18 nt, Homo sapiens
ugaaaacauagcaucuca

SEQ ID NO: 698436 - RNA, 14 nt, Homo sapiens
ugaaaacauggaac

SEQ ID NO: 698437 - RNA, 15 nt, Homo sapiens
ugaaaaucauaggca

SEQ ID NO: 698438 - RNA, 15 nt, Homo sapiens
ugaaaccccgucucu

SEQ ID NO: 698439 - RNA, 10 nt, Homo sapiens
ugaaagcaga

SEQ ID NO: 698440 - RNA, 13 nt, Homo sapiens
ugaaagugcauuu

SEQ ID NO: 698441 - RNA, 22 nt, Homo sapiens
ugaaauggaggaucucuaaaga

SEQ ID NO: 698442 - RNA, 24 nt, Homo sapiens
ugaaauguaggcaucaugcauguc

SEQ ID NO: 698443 - RNA, 19 nt, Homo sapiens
ugaacacuuauaagugaag

SEQ ID NO: 698444 - RNA, 23 nt, Homo sapiens
ugaacauacaaaugcaucuuuga

SEQ ID NO: 698445 - RNA, 14 nt, Homo sapiens
ugaaccauggugaa

SEQ ID NO: 698446 - RNA, 14 nt, Homo sapiens
ugaaccgcacagcu

SEQ ID NO: 698447 - RNA, 16 nt, Homo sapiens
ugaaccgcacagcuca

SEQ ID NO: 698448 - RNA, 18 nt, Homo sapiens
ugaaccgcacagcucagg

SEQ ID NO: 698449 - RNA, 13 nt, Homo sapiens
ugaacuugccuua

SEQ ID NO: 698450 - RNA, 16 nt, Homo sapiens
ugaagaaaagaccuuu

SEQ ID NO: 698451 - RNA, 17 nt, Homo sapiens
ugaagaagauaugugaa

SEQ ID NO: 698452 - RNA, 13 nt, Homo sapiens
ugaagccaaagaa

SEQ ID NO: 698453 - RNA, 16 nt, Homo sapiens
ugaaggaaaaacacaa

SEQ ID NO: 698454 - RNA, 13 nt, Homo sapiens
ugaagguuuuuga

SEQ ID NO: 698455 - RNA, 21 nt, Homo sapiens
ugaauaaaguguaaguucaca

SEQ ID NO: 698456 - RNA, 22 nt, Homo sapiens
ugaauaaaguguaaguucacaa

SEQ ID NO: 698457 - RNA, 20 nt, Homo sapiens
ugaauaauacaguaucucag

SEQ ID NO: 698458 - RNA, 20 nt, Homo sapiens
ugaauacauuuccaaaaugg

SEQ ID NO: 698459 - RNA, 13 nt, Homo sapiens
ugaauacuugaac

SEQ ID NO: 698460 - RNA, 14 nt, Homo sapiens
ugaaugguggugga

SEQ ID NO: 698461 - RNA, 14 nt, Homo sapiens
ugaaugugucaggu

SEQ ID NO: 698462 - RNA, 12 nt, Homo sapiens
ugaauguucaau

SEQ ID NO: 698463 - RNA, 18 nt, Homo sapiens
ugaauuauauguucagau

SEQ ID NO: 698464 - RNA, 17 nt, Homo sapiens
ugacaacugugacugua

SEQ ID NO: 698465 - RNA, 13 nt, Homo sapiens
ugacaagugccuu

SEQ ID NO: 698466 - RNA, 18 nt, Homo sapiens
ugacacaaguggaccuua

SEQ ID NO: 698467 - RNA, 10 nt, Homo sapiens
ugacacugaa

SEQ ID NO: 698468 - RNA, 17 nt, Homo sapiens
ugacaguugcagcccuu

SEQ ID NO: 698469 - RNA, 18 nt, Homo sapiens
ugacaucagcaauacaga

SEQ ID NO: 698470 - RNA, 22 nt, Homo sapiens
ugaccagaaauggugagaugua

SEQ ID NO: 698471 - RNA, 22 nt, Homo sapiens
ugaccaggaucccaagccuccu

SEQ ID NO: 698472 - RNA, 22 nt, Homo sapiens
ugaccccuguccccacacugac

SEQ ID NO: 698473 - RNA, 23 nt, Homo sapiens
ugaccccuguccccacacugacc

SEQ ID NO: 698474 - RNA, 21 nt, Homo sapiens
ugaccuggauacgcuuugguu

SEQ ID NO: 698475 - RNA, 21 nt, Homo sapiens
ugaccuuguaaaagacagugu

SEQ ID NO: 698476 - RNA, 19 nt, Homo sapiens
ugacuaauuaggcaaggcu

SEQ ID NO: 698477 - RNA, 23 nt, Homo sapiens
ugacugaggcaguuugaggauua

SEQ ID NO: 698478 - RNA, 14 nt, Homo sapiens
ugagaagccuucag

SEQ ID NO: 698479 - RNA, 19 nt, Homo sapiens
ugagaagccuucagcucca

SEQ ID NO: 698480 - RNA, 15 nt, Homo sapiens
ugagaccaaccuggg

SEQ ID NO: 698481 - RNA, 16 nt, Homo sapiens
ugagacccugucucaa

SEQ ID NO: 698482 - RNA, 16 nt, Homo sapiens
ugagacuccgucacaa

SEQ ID NO: 698483 - RNA, 14 nt, Homo sapiens
ugagaggcaaugau

SEQ ID NO: 698484 - RNA, 22 nt, Homo sapiens
ugagcugcaacuucuuacuucc

SEQ ID NO: 698485 - RNA, 15 nt, Homo sapiens
ugaggaggaugcuaa

SEQ ID NO: 698486 - RNA, 14 nt, Homo sapiens
ugaggcaauaaaaa

SEQ ID NO: 698487 - RNA, 13 nt, Homo sapiens
ugaggcaggagaa

SEQ ID NO: 698488 - RNA, 22 nt, Homo sapiens
ugaggcaggagaauggcgugaa

SEQ ID NO: 698489 - RNA, 14 nt, Homo sapiens
ugaggcaugauuua

SEQ ID NO: 698490 - RNA, 15 nt, Homo sapiens
ugagggcauggguaa

SEQ ID NO: 698491 - RNA, 15 nt, Homo sapiens
ugagucauaucuuaa

SEQ ID NO: 698492 - RNA, 19 nt, Homo sapiens
ugagucuguugugugucau

SEQ ID NO: 698493 - RNA, 19 nt, Homo sapiens
ugaguuuuuacaagaugua

SEQ ID NO: 698494 - RNA, 21 nt, Homo sapiens
ugauaaagcuuaacacuugac

SEQ ID NO: 698495 - RNA, 15 nt, Homo sapiens
ugauagggaacuggg

SEQ ID NO: 698496 - RNA, 14 nt, Homo sapiens
ugauauaugcaugu

SEQ ID NO: 698497 - RNA, 14 nt, Homo sapiens
ugauauaugccuau

SEQ ID NO: 698498 - RNA, 14 nt, Homo sapiens
ugauauuggcuuaa

SEQ ID NO: 698499 - RNA, 22 nt, Homo sapiens
auccugggggacccaauguagg

SEQ ID NO: 698500 - RNA, 17 nt, Homo sapiens
auccugggggccugggu

SEQ ID NO: 698501 - RNA, 22 nt, Homo sapiens
auccuguauucuucaaccagug

SEQ ID NO: 698502 - RNA, 17 nt, Homo sapiens
auccugugacugucuca

SEQ ID NO: 698503 - RNA, 22 nt, Homo sapiens
aucgagauguccauagucaaau

SEQ ID NO: 698504 - RNA, 16 nt, Homo sapiens
aucggcugcauugaag

SEQ ID NO: 698505 - RNA, 15 nt, Homo sapiens
aucuaagcagcuuau

SEQ ID NO: 698506 - RNA, 11 nt, Homo sapiens
aucuaccagca

SEQ ID NO: 698507 - RNA, 15 nt, Homo sapiens
aucuagagcuuaaug

SEQ ID NO: 698508 - RNA, 18 nt, Homo sapiens
aucuauaaaauagauaua

SEQ ID NO: 698509 - RNA, 15 nt, Homo sapiens
aucucagcuuugaga

SEQ ID NO: 698510 - RNA, 17 nt, Homo sapiens
aucucugccauaucagu

SEQ ID NO: 698511 - RNA, 22 nt, Homo sapiens
aucugccaagggccgacuaaga

SEQ ID NO: 698512 - RNA, 13 nt, Homo sapiens
aucugcccuagcc

SEQ ID NO: 698513 - RNA, 18 nt, Homo sapiens
aucuguugauaaauccau

SEQ ID NO: 698514 - RNA, 19 nt, Homo sapiens
aucuuagaagcacuacacc

SEQ ID NO: 698515 - RNA, 23 nt, Homo sapiens
aucuuccuuuguugcacaaauag

SEQ ID NO: 698516 - RNA, 18 nt, Homo sapiens
aucuugccuccaggugca

SEQ ID NO: 698517 - RNA, 18 nt, Homo sapiens
aucuuggagaaugugaga

SEQ ID NO: 698518 - RNA, 12 nt, Homo sapiens
aucuuuguauau

SEQ ID NO: 698519 - RNA, 12 nt, Homo sapiens
augaaaaauugg

SEQ ID NO: 698520 - RNA, 14 nt, Homo sapiens
augaaaaugaauau

SEQ ID NO: 698521 - RNA, 15 nt, Homo sapiens
augaaacuuguuuca

SEQ ID NO: 698522 - RNA, 14 nt, Homo sapiens
augaaaugcauauu

SEQ ID NO: 698523 - RNA, 13 nt, Homo sapiens
augaacagcauua

SEQ ID NO: 698524 - RNA, 13 nt, Homo sapiens
augaagcaugcua

SEQ ID NO: 698525 - RNA, 20 nt, Homo sapiens
augaagcuaccucaaacuuc

SEQ ID NO: 698526 - RNA, 19 nt, Homo sapiens
augaagucuuaaggacaaa

SEQ ID NO: 698527 - RNA, 17 nt, Homo sapiens
augaaucaaaagugccu

SEQ ID NO: 698528 - RNA, 23 nt, Homo sapiens
augaccaguaaaggcugcugcua

SEQ ID NO: 698529 - RNA, 20 nt, Homo sapiens
augaugguuuuaaacuuuca

SEQ ID NO: 698530 - RNA, 17 nt, Homo sapiens
augaugugaguauuuag

SEQ ID NO: 698531 - RNA, 15 nt, Homo sapiens
augcaaauuucauga

SEQ ID NO: 698532 - RNA, 22 nt, Homo sapiens
augcacuuggccugacucagga

SEQ ID NO: 698533 - RNA, 20 nt, Homo sapiens
augcaugucaaacaugagau

SEQ ID NO: 698534 - RNA, 18 nt, Homo sapiens
augccaaccggucaccca

SEQ ID NO: 698535 - RNA, 21 nt, Homo sapiens
augccaaccggucacccagga

SEQ ID NO: 698536 - RNA, 21 nt, Homo sapiens
augccaauaauaaaugcccuc

SEQ ID NO: 698537 - RNA, 14 nt, Homo sapiens
augccacccuagcc

SEQ ID NO: 698538 - RNA, 15 nt, Homo sapiens
augccacccuagcca

SEQ ID NO: 698539 - RNA, 14 nt, Homo sapiens
augcgggggugccu

SEQ ID NO: 698540 - RNA, 14 nt, Homo sapiens
augcuaacaaagac

SEQ ID NO: 698541 - RNA, 21 nt, Homo sapiens
augcuccagcaacacagccug

SEQ ID NO: 698542 - RNA, 16 nt, Homo sapiens
augcuguacacauauu

SEQ ID NO: 698543 - RNA, 15 nt, Homo sapiens
augcugugcuaugaa

SEQ ID NO: 698544 - RNA, 16 nt, Homo sapiens
auggaagggcaaguuu

SEQ ID NO: 698545 - RNA, 20 nt, Homo sapiens
auggaaguuuuccuacacuu

SEQ ID NO: 698546 - RNA, 18 nt, Homo sapiens
auggaauuuugcaaagau

SEQ ID NO: 698547 - RNA, 20 nt, Homo sapiens
auggcaaaggaagguggaug

SEQ ID NO: 698548 - RNA, 14 nt, Homo sapiens
auggcagccuacuc

SEQ ID NO: 698549 - RNA, 20 nt, Homo sapiens
auggcuccggccucugccuu

SEQ ID NO: 698550 - RNA, 18 nt, Homo sapiens
augggaccuguggcuguc

SEQ ID NO: 698551 - RNA, 23 nt, Homo sapiens
augggagggggcuugaagccaaa

SEQ ID NO: 698552 - RNA, 19 nt, Homo sapiens
auggugaaaccccgucucu

SEQ ID NO: 698553 - RNA, 19 nt, Homo sapiens
auggugcacugagcugcaa

SEQ ID NO: 698554 - RNA, 22 nt, Homo sapiens
augguguagcccucccacuuug

SEQ ID NO: 698555 - RNA, 15 nt, Homo sapiens
auguaagugggccca

SEQ ID NO: 698556 - RNA, 20 nt, Homo sapiens
auguagaggcuuguuuaccu

SEQ ID NO: 698557 - RNA, 22 nt, Homo sapiens
augucacgaauauggacauauc

SEQ ID NO: 698558 - RNA, 23 nt, Homo sapiens
augucacgaauauggacauauca

SEQ ID NO: 698559 - RNA, 19 nt, Homo sapiens
augucagacagaacuugaa

SEQ ID NO: 698560 - RNA, 14 nt, Homo sapiens
augucaguacuauu

SEQ ID NO: 698561 - RNA, 14 nt, Homo sapiens
auacaugcauauaa

SEQ ID NO: 698562 - RNA, 14 nt, Homo sapiens
auacauguaauucu

SEQ ID NO: 698563 - RNA, 15 nt, Homo sapiens
auacauguaauucua

SEQ ID NO: 698564 - RNA, 12 nt, Homo sapiens
auaccagcaaua

SEQ ID NO: 698565 - RNA, 13 nt, Homo sapiens
auacuucauuaaa

SEQ ID NO: 698566 - RNA, 13 nt, Homo sapiens
auacuugccauca

SEQ ID NO: 698567 - RNA, 21 nt, Homo sapiens
auacuuuuuaaaguuuaccau

SEQ ID NO: 698568 - RNA, 15 nt, Homo sapiens
auagaaaugucucaa

SEQ ID NO: 698569 - RNA, 20 nt, Homo sapiens
auagagcuuucaaguacaug

SEQ ID NO: 698570 - RNA, 15 nt, Homo sapiens
auagaugcuguguau

SEQ ID NO: 698571 - RNA, 20 nt, Homo sapiens
auaggacucuagacggcauc

SEQ ID NO: 698572 - RNA, 17 nt, Homo sapiens
auagucuauauuuuaac

SEQ ID NO: 698573 - RNA, 22 nt, Homo sapiens
auaguuacuguguaaacucauc

SEQ ID NO: 698574 - RNA, 16 nt, Homo sapiens
auauaaauuuguguuc

SEQ ID NO: 698575 - RNA, 13 nt, Homo sapiens
auauauauuacaa

SEQ ID NO: 698576 - RNA, 14 nt, Homo sapiens
auaucaaaagcaaa

SEQ ID NO: 698577 - RNA, 22 nt, Homo sapiens
auauccaagauuuaaaugccau

SEQ ID NO: 698578 - RNA, 14 nt, Homo sapiens
auauccugugacug

SEQ ID NO: 698579 - RNA, 15 nt, Homo sapiens
auauggaauuuugca

SEQ ID NO: 698580 - RNA, 19 nt, Homo sapiens
auaugggaaaccauguagc

SEQ ID NO: 698581 - RNA, 13 nt, Homo sapiens
auauguaaucucu

SEQ ID NO: 698582 - RNA, 14 nt, Homo sapiens
auauguaguauaau

SEQ ID NO: 698583 - RNA, 18 nt, Homo sapiens
auauguauauacauauca

SEQ ID NO: 698584 - RNA, 14 nt, Homo sapiens
auauuaaacaucca

SEQ ID NO: 698585 - RNA, 15 nt, Homo sapiens
auauuaaacauccac

SEQ ID NO: 698586 - RNA, 23 nt, Homo sapiens
auauugauugggaaaacauuugc

SEQ ID NO: 698587 - RNA, 14 nt, Homo sapiens
auauuguuuuacaa

SEQ ID NO: 698588 - RNA, 14 nt, Homo sapiens
auauuuaaucuuaa

SEQ ID NO: 698589 - RNA, 17 nt, Homo sapiens
auauuuggaaugaagga

SEQ ID NO: 698590 - RNA, 16 nt, Homo sapiens
auauuuuauuacuguu

SEQ ID NO: 698591 - RNA, 18 nt, Homo sapiens
aucaaaauauuucaguga

SEQ ID NO: 698592 - RNA, 15 nt, Homo sapiens
aucaagagccuuaaa

SEQ ID NO: 698593 - RNA, 20 nt, Homo sapiens
aucacccucuuccugugauc

SEQ ID NO: 698594 - RNA, 19 nt, Homo sapiens
aucacugccacacucucca

SEQ ID NO: 698595 - RNA, 18 nt, Homo sapiens
aucacuguuuagauuugc

SEQ ID NO: 698596 - RNA, 15 nt, Homo sapiens
aucacuuaguucuca

SEQ ID NO: 698597 - RNA, 16 nt, Homo sapiens
aucacuuaguucucag

SEQ ID NO: 698598 - RNA, 18 nt, Homo sapiens
aucacuucacuguucucu

SEQ ID NO: 698599 - RNA, 15 nt, Homo sapiens
aucagaaagcuuuau

SEQ ID NO: 698600 - RNA, 17 nt, Homo sapiens
aucagccugcuccagcu

SEQ ID NO: 698601 - RNA, 16 nt, Homo sapiens
aucauaagacaaugga

SEQ ID NO: 698602 - RNA, 16 nt, Homo sapiens
aucauacuuacuaguu

SEQ ID NO: 698603 - RNA, 23 nt, Homo sapiens
aucauaguuacuguguaaacuca

SEQ ID NO: 698604 - RNA, 15 nt, Homo sapiens
aucaucuuuccuguu

SEQ ID NO: 698605 - RNA, 11 nt, Homo sapiens
auccaaaaaga

SEQ ID NO: 698606 - RNA, 21 nt, Homo sapiens
auccagugaccucucucucug

SEQ ID NO: 698607 - RNA, 15 nt, Homo sapiens
aucccaagaaugcaa

SEQ ID NO: 698608 - RNA, 16 nt, Homo sapiens
aucccaagaaugcaag

SEQ ID NO: 698609 - RNA, 11 nt, Homo sapiens
aucccauucca

SEQ ID NO: 698610 - RNA, 22 nt, Homo sapiens
aucccugacaucuggaaucugg

SEQ ID NO: 698611 - RNA, 22 nt, Homo sapiens
aucccuuccagauggucaucca

SEQ ID NO: 698612 - RNA, 19 nt, Homo sapiens
auccuacccuuuucugggg

SEQ ID NO: 698613 - RNA, 14 nt, Homo sapiens
auccuagcacuuug

SEQ ID NO: 698614 - RNA, 14 nt, Homo sapiens
auccuaggcauuug

SEQ ID NO: 698615 - RNA, 13 nt, Homo sapiens
auccugauuccuc

SEQ ID NO: 698616 - RNA, 17 nt, Homo sapiens
uaccuguauacagugca

SEQ ID NO: 698617 - RNA, 17 nt, Homo sapiens
uacuagucaccagagac

SEQ ID NO: 698618 - RNA, 23 nt, Homo sapiens
uacuaguguguguguguauauau

SEQ ID NO: 698619 - RNA, 23 nt, Homo sapiens
uacucaggcugguggagaacucu

SEQ ID NO: 698620 - RNA, 16 nt, Homo sapiens
uacuccuuccaucaaa

SEQ ID NO: 698621 - RNA, 13 nt, Homo sapiens
uacucucuugcac

SEQ ID NO: 698622 - RNA, 15 nt, Homo sapiens
uacucuuuguagcaa

SEQ ID NO: 698623 - RNA, 18 nt, Homo sapiens
uacugaaccacuuguaga

SEQ ID NO: 698624 - RNA, 17 nt, Homo sapiens
uacugaucuuuguauau

SEQ ID NO: 698625 - RNA, 14 nt, Homo sapiens
uacuggugcaguca

SEQ ID NO: 698626 - RNA, 18 nt, Homo sapiens
uacugguugcauggaaau

SEQ ID NO: 698627 - RNA, 15 nt, Homo sapiens
uacugugauguuugu

SEQ ID NO: 698628 - RNA, 14 nt, Homo sapiens
uacuugaaccauaa

SEQ ID NO: 698629 - RNA, 18 nt, Homo sapiens
uacuuuguaaauaggauu

SEQ ID NO: 698630 - RNA, 15 nt, Homo sapiens
uacuuuguuaggauu

SEQ ID NO: 698631 - RNA, 19 nt, Homo sapiens
uacuuuuaaaaacauaaca

SEQ ID NO: 698632 - RNA, 12 nt, Homo sapiens
uagaaacaaaca

SEQ ID NO: 698633 - RNA, 12 nt, Homo sapiens
uagaaacauauc

SEQ ID NO: 698634 - RNA, 16 nt, Homo sapiens
uagaacugucugugaa

SEQ ID NO: 698635 - RNA, 14 nt, Homo sapiens
uagaagcacuacac

SEQ ID NO: 698636 - RNA, 15 nt, Homo sapiens
uagaagcaugaaguc

SEQ ID NO: 698637 - RNA, 21 nt, Homo sapiens
uagaagcuguaacagaauaca

SEQ ID NO: 698638 - RNA, 14 nt, Homo sapiens
uagaccccauacaa

SEQ ID NO: 698639 - RNA, 22 nt, Homo sapiens
uagaccuccacacccgugagaa

SEQ ID NO: 698640 - RNA, 14 nt, Homo sapiens
uagacuagcaaucu

SEQ ID NO: 698641 - RNA, 17 nt, Homo sapiens
uagaggcuagcuucugc

SEQ ID NO: 698642 - RNA, 18 nt, Homo sapiens
uagaguguagacuguggc

SEQ ID NO: 698643 - RNA, 20 nt, Homo sapiens
uagauaaacuauacacuuaa

SEQ ID NO: 698644 - RNA, 16 nt, Homo sapiens
uagaugguuugagccu

SEQ ID NO: 698645 - RNA, 14 nt, Homo sapiens
uagauguugccaug

SEQ ID NO: 698646 - RNA, 17 nt, Homo sapiens
uagauuaguauuuucca

SEQ ID NO: 698647 - RNA, 17 nt, Homo sapiens
uagauugcuaguuuauu

SEQ ID NO: 698648 - RNA, 22 nt, Homo sapiens
uagcagcagggagggcuucugc

SEQ ID NO: 698649 - RNA, 12 nt, Homo sapiens
uagcaucucagg

SEQ ID NO: 698650 - RNA, 22 nt, Homo sapiens
uagcaugaaauaaaauauaucu

SEQ ID NO: 698651 - RNA, 22 nt, Homo sapiens
uagcuucugcuuuucugcccug

SEQ ID NO: 698652 - RNA, 16 nt, Homo sapiens
uaggaauaaauaaaaa

SEQ ID NO: 698653 - RNA, 12 nt, Homo sapiens
uaggcauguaaa

SEQ ID NO: 698654 - RNA, 15 nt, Homo sapiens
uaggcauuugcugaa

SEQ ID NO: 698655 - RNA, 13 nt, Homo sapiens
uaguccaaaaagc

SEQ ID NO: 698656 - RNA, 15 nt, Homo sapiens
uagucccagcuacuu

SEQ ID NO: 698657 - RNA, 13 nt, Homo sapiens
uagucucuuuaaa

SEQ ID NO: 698658 - RNA, 13 nt, Homo sapiens
uagucuuugccag

SEQ ID NO: 698659 - RNA, 14 nt, Homo sapiens
uagugguuacccag

SEQ ID NO: 698660 - RNA, 20 nt, Homo sapiens
uaguguucauugaugcugcu

SEQ ID NO: 698661 - RNA, 22 nt, Homo sapiens
uaguucaauauuuguuacuguu

SEQ ID NO: 698662 - RNA, 23 nt, Homo sapiens
uauaaagcaguauuuuucuugac

SEQ ID NO: 698663 - RNA, 23 nt, Homo sapiens
uauaaauuauucaguaacuguca

SEQ ID NO: 698664 - RNA, 23 nt, Homo sapiens
uauaagugaagugauacuaucca

SEQ ID NO: 698665 - RNA, 16 nt, Homo sapiens
uauacacgaauagaca

SEQ ID NO: 698666 - RNA, 15 nt, Homo sapiens
uauaccucaaugucc

SEQ ID NO: 698667 - RNA, 13 nt, Homo sapiens
uauacuugccauc

SEQ ID NO: 698668 - RNA, 14 nt, Homo sapiens
uauauaaacuuaac

SEQ ID NO: 698669 - RNA, 17 nt, Homo sapiens
uauauaauguugccagc

SEQ ID NO: 698670 - RNA, 17 nt, Homo sapiens
uauauauguguaugcac

SEQ ID NO: 698671 - RNA, 18 nt, Homo sapiens
uauaucacuucacuguuc

SEQ ID NO: 698672 - RNA, 12 nt, Homo sapiens
uauauccuguga

SEQ ID NO: 698673 - RNA, 16 nt, Homo sapiens
uauaucugaagagcua

SEQ ID NO: 698674 - RNA, 16 nt, Homo sapiens
uauaugggaaaccaug

SEQ ID NO: 698675 - RNA, 21 nt, Homo sapiens
uauauuucagguuauauccaa

SEQ ID NO: 698676 - RNA, 12 nt, Homo sapiens
uaucaggagaaa

SEQ ID NO: 698677 - RNA, 12 nt, Homo sapiens
uaucuccugaca

SEQ ID NO: 698678 - RNA, 15 nt, Homo sapiens
uaucuugauaaacua

SEQ ID NO: 698679 - RNA, 15 nt, Homo sapiens
uaugacaucagcaau

SEQ ID NO: 698680 - RNA, 22 nt, Homo sapiens
uaugauuaaaaauaucaaauua

SEQ ID NO: 698681 - RNA, 22 nt, Homo sapiens
uauggugccgaauugucuuugg

SEQ ID NO: 698682 - RNA, 18 nt, Homo sapiens
uaugugggaguacucuca

SEQ ID NO: 698683 - RNA, 18 nt, Homo sapiens
uauuccuuugcauauuau

SEQ ID NO: 698684 - RNA, 16 nt, Homo sapiens
uauugaaugguggugg

SEQ ID NO: 698685 - RNA, 13 nt, Homo sapiens
uauugacacugaa

SEQ ID NO: 698686 - RNA, 15 nt, Homo sapiens
uauugcaguuuauca

SEQ ID NO: 698687 - RNA, 20 nt, Homo sapiens
uauuuaaaaaaaaagucaga

SEQ ID NO: 698688 - RNA, 22 nt, Homo sapiens
uauuuaaaaaaaaagucagaga

SEQ ID NO: 698689 - RNA, 19 nt, Homo sapiens
uauuuaaucuuaaucuguu

SEQ ID NO: 698690 - RNA, 21 nt, Homo sapiens
uauuugaacuuauuuacacau

SEQ ID NO: 698691 - RNA, 17 nt, Homo sapiens
uauuuguaaauuuagug

SEQ ID NO: 698692 - RNA, 20 nt, Homo sapiens
uauuuguaauagugacauau

SEQ ID NO: 698693 - RNA, 20 nt, Homo sapiens
uauuugugugugugauauau

SEQ ID NO: 698694 - RNA, 15 nt, Homo sapiens
uauuuuaaccugcau

SEQ ID NO: 698695 - RNA, 22 nt, Homo sapiens
ucaaaagguauuauacauguga

SEQ ID NO: 698696 - RNA, 13 nt, Homo sapiens
ucaaaagugccuc

SEQ ID NO: 698697 - RNA, 14 nt, Homo sapiens
ucaaaauccaaaaa

SEQ ID NO: 698698 - RNA, 15 nt, Homo sapiens
ucaaaauccaaaaag

SEQ ID NO: 698699 - RNA, 16 nt, Homo sapiens
ucaaaauccaaaaaga

SEQ ID NO: 698700 - RNA, 20 nt, Homo sapiens
ucaaaggaaaauaguaaugu

SEQ ID NO: 698701 - RNA, 20 nt, Homo sapiens
ucaaauagaaccacuaugaa

SEQ ID NO: 698702 - RNA, 15 nt, Homo sapiens
ucaaauuaauugugu

SEQ ID NO: 698703 - RNA, 18 nt, Homo sapiens
ucaaauuaauugugugaa

SEQ ID NO: 698704 - RNA, 14 nt, Homo sapiens
ucaagaggaaugaa

SEQ ID NO: 698705 - RNA, 16 nt, Homo sapiens
ucaaguaauugugaaa

SEQ ID NO: 698706 - RNA, 19 nt, Homo sapiens
ucaauaaaguuuccugccu

SEQ ID NO: 698707 - RNA, 24 nt, Homo sapiens
ucaauauacauaauacaugauugc

SEQ ID NO: 698708 - RNA, 21 nt, Homo sapiens
ucaauauuuuuauaucaugca

SEQ ID NO: 698709 - RNA, 12 nt, Homo sapiens
ucaaugggaccu

SEQ ID NO: 698710 - RNA, 15 nt, Homo sapiens
ucaauucuagucaua

SEQ ID NO: 698711 - RNA, 16 nt, Homo sapiens
ucaauucuagucauau

SEQ ID NO: 698712 - RNA, 18 nt, Homo sapiens
ucacaaggcaacugugag

SEQ ID NO: 698713 - RNA, 13 nt, Homo sapiens
ucacaaguucaau

SEQ ID NO: 698714 - RNA, 17 nt, Homo sapiens
ucacacauuacaaaguu

SEQ ID NO: 698715 - RNA, 22 nt, Homo sapiens
ucacaccauuuuguuuagacaa

SEQ ID NO: 698716 - RNA, 21 nt, Homo sapiens
ucacacugguucucaaugaaa

SEQ ID NO: 698717 - RNA, 14 nt, Homo sapiens
ucacauucuuggcu

SEQ ID NO: 698718 - RNA, 17 nt, Homo sapiens
ucacauuggagucacug

SEQ ID NO: 698719 - RNA, 23 nt, Homo sapiens
ucaccacugaaacccugcacuua

SEQ ID NO: 698720 - RNA, 18 nt, Homo sapiens
ucaccaugcccagcuaau

SEQ ID NO: 698721 - RNA, 19 nt, Homo sapiens
ucacccucuuccugugauc

SEQ ID NO: 698722 - RNA, 15 nt, Homo sapiens
ucaccuucuagucuu

SEQ ID NO: 698723 - RNA, 21 nt, Homo sapiens
ucacguuuggugcuucucaga

SEQ ID NO: 698724 - RNA, 12 nt, Homo sapiens
ucacucacagag

SEQ ID NO: 698725 - RNA, 14 nt, Homo sapiens
ucacucauugcuga

SEQ ID NO: 698726 - RNA, 15 nt, Homo sapiens
acaaugaaguugaaa

SEQ ID NO: 698727 - RNA, 15 nt, Homo sapiens
acaauggaguauucu

SEQ ID NO: 698728 - RNA, 13 nt, Homo sapiens
acaaugugaaaag

SEQ ID NO: 698729 - RNA, 15 nt, Homo sapiens
acacaaauuugccug

SEQ ID NO: 698730 - RNA, 15 nt, Homo sapiens
acacacagccuagca

SEQ ID NO: 698731 - RNA, 16 nt, Homo sapiens
acacacggaggcaucc

SEQ ID NO: 698732 - RNA, 17 nt, Homo sapiens
acacauuuggcaguuua

SEQ ID NO: 698733 - RNA, 19 nt, Homo sapiens
acaccaaucuuacuuugua

SEQ ID NO: 698734 - RNA, 15 nt, Homo sapiens
acaccccaacacuuc

SEQ ID NO: 698735 - RNA, 16 nt, Homo sapiens
acacugaccuguguuc

SEQ ID NO: 698736 - RNA, 12 nt, Homo sapiens
acacugcugcuc

SEQ ID NO: 698737 - RNA, 19 nt, Homo sapiens
acacugcugcuccagugca

SEQ ID NO: 698738 - RNA, 20 nt, Homo sapiens
acacugcugcuccagugcag

SEQ ID NO: 698739 - RNA, 21 nt, Homo sapiens
acacugcugcuccagugcagg

SEQ ID NO: 698740 - RNA, 14 nt, Homo sapiens
acacuuaaugauac

SEQ ID NO: 698741 - RNA, 16 nt, Homo sapiens
acacuuccagcauuua

SEQ ID NO: 698742 - RNA, 20 nt, Homo sapiens
acagaaagagacuccgucuc

SEQ ID NO: 698743 - RNA, 15 nt, Homo sapiens
acagacuucuuggua

SEQ ID NO: 698744 - RNA, 20 nt, Homo sapiens
acagagcgagacuccgucuc

SEQ ID NO: 698745 - RNA, 21 nt, Homo sapiens
acagagcgagacuccgucuca

SEQ ID NO: 698746 - RNA, 13 nt, Homo sapiens
acagauaccucca

SEQ ID NO: 698747 - RNA, 21 nt, Homo sapiens
acagauaccuccaacccugcc

SEQ ID NO: 698748 - RNA, 14 nt, Homo sapiens
acagauucuuucag

SEQ ID NO: 698749 - RNA, 14 nt, Homo sapiens
acagauugccuguu

SEQ ID NO: 698750 - RNA, 18 nt, Homo sapiens
acaggguuugauagcacu

SEQ ID NO: 698751 - RNA, 13 nt, Homo sapiens
acaguagagccag

SEQ ID NO: 698752 - RNA, 22 nt, Homo sapiens
acaguaguuagaauuauaucac

SEQ ID NO: 698753 - RNA, 14 nt, Homo sapiens
acaguaucccacau

SEQ ID NO: 698754 - RNA, 16 nt, Homo sapiens
acagugccuauugaua

SEQ ID NO: 698755 - RNA, 15 nt, Homo sapiens
acauagcaucucagg

SEQ ID NO: 698756 - RNA, 18 nt, Homo sapiens
acauauuguaaagcccau

SEQ ID NO: 698757 - RNA, 13 nt, Homo sapiens
acaucauuccuuu

SEQ ID NO: 698758 - RNA, 22 nt, Homo sapiens
acaugaagcuucaugcacuuaa

SEQ ID NO: 698759 - RNA, 14 nt, Homo sapiens
acauucauguucua

SEQ ID NO: 698760 - RNA, 17 nt, Homo sapiens
acauuucuaugccaaac

SEQ ID NO: 698761 - RNA, 21 nt, Homo sapiens
accaaaaacaaaaaccaaaug

SEQ ID NO: 698762 - RNA, 16 nt, Homo sapiens
accaaagaaauuauaa

SEQ ID NO: 698763 - RNA, 15 nt, Homo sapiens
accaaagcugcccac

SEQ ID NO: 698764 - RNA, 16 nt, Homo sapiens
accaaagcugcccacu

SEQ ID NO: 698765 - RNA, 16 nt, Homo sapiens
accaaauuaucuugau

SEQ ID NO: 698766 - RNA, 19 nt, Homo sapiens
accaagaaagcucacugua

SEQ ID NO: 698767 - RNA, 13 nt, Homo sapiens
accaagguauaca

SEQ ID NO: 698768 - RNA, 22 nt, Homo sapiens
accaaugugugaaguaugcacu

SEQ ID NO: 698769 - RNA, 14 nt, Homo sapiens
accaccccuaccac

SEQ ID NO: 698770 - RNA, 23 nt, Homo sapiens
accacuagaaagugggcuuaaug

SEQ ID NO: 698771 - RNA, 14 nt, Homo sapiens
accacuucagcuga

SEQ ID NO: 698772 - RNA, 17 nt, Homo sapiens
accacuucgaaaccugg

SEQ ID NO: 698773 - RNA, 16 nt, Homo sapiens
accaggccaccucccc

SEQ ID NO: 698774 - RNA, 23 nt, Homo sapiens
accauauugugcuucacaguaga

SEQ ID NO: 698775 - RNA, 23 nt, Homo sapiens
accaugauuaaccacuucagcug

SEQ ID NO: 698776 - RNA, 21 nt, Homo sapiens
accauuuuuuaauuuacuugu

SEQ ID NO: 698777 - RNA, 12 nt, Homo sapiens
acccacccagga

SEQ ID NO: 698778 - RNA, 13 nt, Homo sapiens
acccagugcagaa

SEQ ID NO: 698779 - RNA, 17 nt, Homo sapiens
acccaguuagcucucaa

SEQ ID NO: 698780 - RNA, 19 nt, Homo sapiens
acccaugcaagcagaggac

SEQ ID NO: 698781 - RNA, 23 nt, Homo sapiens
accccaggacgccacucauuuca

SEQ ID NO: 698782 - RNA, 12 nt, Homo sapiens
acccccagugua

SEQ ID NO: 698783 - RNA, 13 nt, Homo sapiens
acccccuuccuuc

SEQ ID NO: 698784 - RNA, 23 nt, Homo sapiens
accccugcccccagccccggggu

SEQ ID NO: 698785 - RNA, 20 nt, Homo sapiens
acccuagccaaugucuccuc

SEQ ID NO: 698786 - RNA, 16 nt, Homo sapiens
acccucuuccugugau

SEQ ID NO: 698787 - RNA, 17 nt, Homo sapiens
acccucuuccugugauc

SEQ ID NO: 698788 - RNA, 15 nt, Homo sapiens
acccugccgucacca

SEQ ID NO: 698789 - RNA, 16 nt, Homo sapiens
acccugccgucaccac

SEQ ID NO: 698790 - RNA, 14 nt, Homo sapiens
acccugggggcaca

SEQ ID NO: 698791 - RNA, 12 nt, Homo sapiens
accuaccaaaau

SEQ ID NO: 698792 - RNA, 18 nt, Homo sapiens
accucaguuauuacaugu

SEQ ID NO: 698793 - RNA, 19 nt, Homo sapiens
accuccaggcuuucccacu

SEQ ID NO: 698794 - RNA, 23 nt, Homo sapiens
accuccaggcuuucccacuuccc

SEQ ID NO: 698795 - RNA, 16 nt, Homo sapiens
accucugaauuuacuu

SEQ ID NO: 698796 - RNA, 20 nt, Homo sapiens
accuggaagaacaggccucu

SEQ ID NO: 698797 - RNA, 18 nt, Homo sapiens
accuguauacagugcaga

SEQ ID NO: 698798 - RNA, 18 nt, Homo sapiens
accuuaagagacacucca

SEQ ID NO: 698799 - RNA, 13 nt, Homo sapiens
accuuagaauaca

SEQ ID NO: 698800 - RNA, 20 nt, Homo sapiens
accuucuucuccuacauauc

SEQ ID NO: 698801 - RNA, 21 nt, Homo sapiens
accuuguaaaagacaguguau

SEQ ID NO: 698802 - RNA, 19 nt, Homo sapiens
acgaagaguucccuugaaa

SEQ ID NO: 698803 - RNA, 17 nt, Homo sapiens
acgaauauggacauauc

SEQ ID NO: 698804 - RNA, 18 nt, Homo sapiens
acgaauauggacauauca

SEQ ID NO: 698805 - RNA, 20 nt, Homo sapiens
acgagcauaguccaaaaagc

SEQ ID NO: 698806 - RNA, 16 nt, Homo sapiens
acgcacugguaugugu

SEQ ID NO: 698807 - RNA, 19 nt, Homo sapiens
acgccacucauuucaucuc

SEQ ID NO: 698808 - RNA, 21 nt, Homo sapiens
acgccacucauuucaucucau

SEQ ID NO: 698809 - RNA, 20 nt, Homo sapiens
acgcgguuccagauguggau

SEQ ID NO: 698810 - RNA, 14 nt, Homo sapiens
acuaaacaguaaga

SEQ ID NO: 698811 - RNA, 14 nt, Homo sapiens
acuaaugacuuugu

SEQ ID NO: 698812 - RNA, 18 nt, Homo sapiens
acuaaugcaaacugggau

SEQ ID NO: 698813 - RNA, 20 nt, Homo sapiens
acuaauuauacuacuuuguu

SEQ ID NO: 698814 - RNA, 21 nt, Homo sapiens
acuacaccuggcugagguucc

SEQ ID NO: 698815 - RNA, 18 nt, Homo sapiens
acuagaccuguaacuuuu

SEQ ID NO: 698816 - RNA, 22 nt, Homo sapiens
acuaguguguguguguauauau

SEQ ID NO: 698817 - RNA, 14 nt, Homo sapiens
acuauacacuuaau

SEQ ID NO: 698818 - RNA, 20 nt, Homo sapiens
acuauagaaugcaacuccau

SEQ ID NO: 698819 - RNA, 15 nt, Homo sapiens
acuauauuaguaugu

SEQ ID NO: 698820 - RNA, 17 nt, Homo sapiens
acucacuucucuuuuua

SEQ ID NO: 698821 - RNA, 20 nt, Homo sapiens
acucagagaugaacaucuaa

SEQ ID NO: 698822 - RNA, 14 nt, Homo sapiens
acucagugcagaug

SEQ ID NO: 698823 - RNA, 18 nt, Homo sapiens
acucaucugaaauguuac

SEQ ID NO: 698824 - RNA, 16 nt, Homo sapiens
acucauuucaucucau

SEQ ID NO: 698825 - RNA, 16 nt, Homo sapiens
acucccagugaugcug

SEQ ID NO: 698826 - RNA, 17 nt, Homo sapiens
acucccugcagaugcca

SEQ ID NO: 698827 - RNA, 18 nt, Homo sapiens
acucccugcagaugccac

SEQ ID NO: 698828 - RNA, 13 nt, Homo sapiens
acuccuuccauca

SEQ ID NO: 698829 - RNA, 12 nt, Homo sapiens
acucucuugcac

SEQ ID NO: 698830 - RNA, 17 nt, Homo sapiens
acucugccucuguauau

SEQ ID NO: 698831 - RNA, 23 nt, Homo sapiens
acucuuacaagaguggacucagu

SEQ ID NO: 698832 - RNA, 19 nt, Homo sapiens
aagucgagggacuuuaugu

SEQ ID NO: 698833 - RNA, 20 nt, Homo sapiens
aagucugucugucugaugau

SEQ ID NO: 698834 - RNA, 15 nt, Homo sapiens
aagucuuacuacaga

SEQ ID NO: 698835 - RNA, 22 nt, Homo sapiens
aagugagacccugucucaaaaa

SEQ ID NO: 698836 - RNA, 15 nt, Homo sapiens
aagugauacuaucca

SEQ ID NO: 698837 - RNA, 17 nt, Homo sapiens
aagugauacuauccagu

SEQ ID NO: 698838 - RNA, 15 nt, Homo sapiens
aagugaucaaacuac

SEQ ID NO: 698839 - RNA, 19 nt, Homo sapiens
aagugaucaaacuacauau

SEQ ID NO: 698840 - RNA, 22 nt, Homo sapiens
aagugauuuuuuuccacaagau

SEQ ID NO: 698841 - RNA, 13 nt, Homo sapiens
aagugccaaagaa

SEQ ID NO: 698842 - RNA, 18 nt, Homo sapiens
aagugggcccacccggug

SEQ ID NO: 698843 - RNA, 15 nt, Homo sapiens
aaguggucuuaagaa

SEQ ID NO: 698844 - RNA, 23 nt, Homo sapiens
aagugugugccaccaugccucac

SEQ ID NO: 698845 - RNA, 22 nt, Homo sapiens
aaguuagccuccaccacccuuu

SEQ ID NO: 698846 - RNA, 23 nt, Homo sapiens
aaguuaggguuuaggcaucauuu

SEQ ID NO: 698847 - RNA, 19 nt, Homo sapiens
aaguucgagucaaaguuga

SEQ ID NO: 698848 - RNA, 21 nt, Homo sapiens
aaguuuuguaaaagaaaucau

SEQ ID NO: 698849 - RNA, 14 nt, Homo sapiens
aauaaaaccgaagg

SEQ ID NO: 698850 - RNA, 14 nt, Homo sapiens
aauaaacuaugagg

SEQ ID NO: 698851 - RNA, 17 nt, Homo sapiens
aauaaaucguccuccca

SEQ ID NO: 698852 - RNA, 23 nt, Homo sapiens
aauaaaucguccucccaggccag

SEQ ID NO: 698853 - RNA, 16 nt, Homo sapiens
aauaaauuguguuucc

SEQ ID NO: 698854 - RNA, 20 nt, Homo sapiens
aauaagaaacuuauuucuca

SEQ ID NO: 698855 - RNA, 21 nt, Homo sapiens
aauaagaauucagacaucuga

SEQ ID NO: 698856 - RNA, 19 nt, Homo sapiens
aauaauaaaucguccuccc

SEQ ID NO: 698857 - RNA, 15 nt, Homo sapiens
aauaauauacaugca

SEQ ID NO: 698858 - RNA, 16 nt, Homo sapiens
aauaaugaauacauuu

SEQ ID NO: 698859 - RNA, 14 nt, Homo sapiens
aauacacauuugcu

SEQ ID NO: 698860 - RNA, 14 nt, Homo sapiens
aauacguacauguu

SEQ ID NO: 698861 - RNA, 12 nt, Homo sapiens
aauacugaacca

SEQ ID NO: 698862 - RNA, 13 nt, Homo sapiens
aauagaaacaaca

SEQ ID NO: 698863 - RNA, 20 nt, Homo sapiens
aauagaaccacuaugaagcu

SEQ ID NO: 698864 - RNA, 10 nt, Homo sapiens
aauagaucuc

SEQ ID NO: 698865 - RNA, 21 nt, Homo sapiens
aauagucuaaggccauggcau

SEQ ID NO: 698866 - RNA, 18 nt, Homo sapiens
aauauacauucaaacuua

SEQ ID NO: 698867 - RNA, 19 nt, Homo sapiens
aauauauuuuuagacucau

SEQ ID NO: 698868 - RNA, 20 nt, Homo sapiens
aauauguucuuuuaaaugau

SEQ ID NO: 698869 - RNA, 22 nt, Homo sapiens
aauauuagguugucacgaugaa

SEQ ID NO: 698870 - RNA, 15 nt, Homo sapiens
aauauuccuuugcau

SEQ ID NO: 698871 - RNA, 19 nt, Homo sapiens
aauauugcugaacuacuuu

SEQ ID NO: 698872 - RNA, 20 nt, Homo sapiens
aauauuuaauggaaguguau

SEQ ID NO: 698873 - RNA, 14 nt, Homo sapiens
aauauuuaccagac

SEQ ID NO: 698874 - RNA, 15 nt, Homo sapiens
aauauuugcuaugaa

SEQ ID NO: 698875 - RNA, 11 nt, Homo sapiens
aauauuuggaa

SEQ ID NO: 698876 - RNA, 17 nt, Homo sapiens
aaucaaaagugccucaa

SEQ ID NO: 698877 - RNA, 13 nt, Homo sapiens
aaucagagacaaa

SEQ ID NO: 698878 - RNA, 19 nt, Homo sapiens
aaucaggaauauuuuccaa

SEQ ID NO: 698879 - RNA, 15 nt, Homo sapiens
aaucauaguuacugu

SEQ ID NO: 698880 - RNA, 14 nt, Homo sapiens
aaucaucuaaguca

SEQ ID NO: 698881 - RNA, 18 nt, Homo sapiens
aaucauuuucauuccuaa

SEQ ID NO: 698882 - RNA, 12 nt, Homo sapiens
aauccaaaaaga

SEQ ID NO: 698883 - RNA, 19 nt, Homo sapiens
aauccaauggguuuuuccc

SEQ ID NO: 698884 - RNA, 20 nt, Homo sapiens
aauccaugaacagcauuaga

SEQ ID NO: 698885 - RNA, 14 nt, Homo sapiens
aaucccagcacuuu

SEQ ID NO: 698886 - RNA, 22 nt, Homo sapiens
aauccugauuccucucuaagug

SEQ ID NO: 698887 - RNA, 20 nt, Homo sapiens
aaucucacccucuccuccag

SEQ ID NO: 698888 - RNA, 18 nt, Homo sapiens
aaucuguugauaaaucca

SEQ ID NO: 698889 - RNA, 23 nt, Homo sapiens
aaucuguugauaaauccaucacu

SEQ ID NO: 698890 - RNA, 14 nt, Homo sapiens
aaucuuacuuugua

SEQ ID NO: 698891 - RNA, 21 nt, Homo sapiens
aaucuuccuuuguugcacaaa

SEQ ID NO: 698892 - RNA, 13 nt, Homo sapiens
aaugaagacuguu

SEQ ID NO: 698893 - RNA, 14 nt, Homo sapiens
aaugacucaaaguc

SEQ ID NO: 698894 - RNA, 14 nt, Homo sapiens
aaugagacugacca

SEQ ID NO: 698895 - RNA, 16 nt, Homo sapiens
aaugaggaggaugcua

SEQ ID NO: 698896 - RNA, 23 nt, Homo sapiens
aaugaucuugaagaugacaaaag

SEQ ID NO: 698897 - RNA, 19 nt, Homo sapiens
aaugaugauccuaggcauu

SEQ ID NO: 698898 - RNA, 18 nt, Homo sapiens
aaugcaaacugggaugaa

SEQ ID NO: 698899 - RNA, 13 nt, Homo sapiens
aaugcaaccaagu

SEQ ID NO: 698900 - RNA, 18 nt, Homo sapiens
aaugcaaccaagucacac

SEQ ID NO: 698901 - RNA, 13 nt, Homo sapiens
aaugcacuuucua

SEQ ID NO: 698902 - RNA, 14 nt, Homo sapiens
aaugcccugugcau

SEQ ID NO: 698903 - RNA, 23 nt, Homo sapiens
aaugccuaucugaccaaacugga

SEQ ID NO: 698904 - RNA, 12 nt, Homo sapiens
aaugcuccccac

SEQ ID NO: 698905 - RNA, 18 nt, Homo sapiens
aaugcugggacucagccu

SEQ ID NO: 698906 - RNA, 13 nt, Homo sapiens
aaugcuucaauca

SEQ ID NO: 698907 - RNA, 17 nt, Homo sapiens
aaugcuucuagaguuuu

SEQ ID NO: 698908 - RNA, 17 nt, Homo sapiens
aauggaaaguaacucau

SEQ ID NO: 698909 - RNA, 13 nt, Homo sapiens
aauggaaguccau

SEQ ID NO: 698910 - RNA, 23 nt, Homo sapiens
aauguccauaugcuaauagugau

SEQ ID NO: 698911 - RNA, 18 nt, Homo sapiens
aaugugugaaguaugcac

SEQ ID NO: 698912 - RNA, 16 nt, Homo sapiens
aauguuaaagggauau

SEQ ID NO: 698913 - RNA, 12 nt, Homo sapiens
aauguugccagc

SEQ ID NO: 698914 - RNA, 13 nt, Homo sapiens
aauguuuuauuuc

SEQ ID NO: 698915 - RNA, 19 nt, Homo sapiens
aauguuuucaaaagguauu

SEQ ID NO: 698916 - RNA, 17 nt, Homo sapiens
aauuaaaaaagcauacu

SEQ ID NO: 698917 - RNA, 15 nt, Homo sapiens
aauuaaccuuacuaa

SEQ ID NO: 698918 - RNA, 22 nt, Homo sapiens
aauuagcauuuuucaaaugauc

SEQ ID NO: 698919 - RNA, 13 nt, Homo sapiens
aauuauaucacuu

SEQ ID NO: 698920 - RNA, 18 nt, Homo sapiens
aauuaucuugauacauuc

SEQ ID NO: 698921 - RNA, 16 nt, Homo sapiens
aauuauugacacugaa

SEQ ID NO: 698922 - RNA, 17 nt, Homo sapiens
aauuauuuuucacucua

SEQ ID NO: 698923 - RNA, 13 nt, Homo sapiens
aauucacucccac

SEQ ID NO: 698924 - RNA, 18 nt, Homo sapiens
aauuccagcaaaagagcu

SEQ ID NO: 698925 - RNA, 21 nt, Homo sapiens
aauucuauaggaacauaugaa

SEQ ID NO: 698926 - RNA, 18 nt, Homo sapiens
aauucugagccugauauu

SEQ ID NO: 698927 - RNA, 15 nt, Homo sapiens
aauugcauacuuugu

SEQ ID NO: 698928 - RNA, 13 nt, Homo sapiens
aauuggacagauu

SEQ ID NO: 698929 - RNA, 15 nt, Homo sapiens
aauuggcacuaaaga

SEQ ID NO: 698930 - RNA, 22 nt, Homo sapiens
aauuggggcacuuaauggucac

SEQ ID NO: 698931 - RNA, 12 nt, Homo sapiens
aauuguguuucc

SEQ ID NO: 698932 - RNA, 17 nt, Homo sapiens
aauuguuuaaaaaccga

SEQ ID NO: 698933 - RNA, 19 nt, Homo sapiens
aauuguuuaaaaaccgaau

SEQ ID NO: 698934 - RNA, 15 nt, Homo sapiens
aauuuauugaguuuu

SEQ ID NO: 698935 - RNA, 15 nt, Homo sapiens
aauuucagggugcag

SEQ ID NO: 698936 - RNA, 14 nt, Homo sapiens
aauuuguguucuca

SEQ ID NO: 698937 - RNA, 19 nt, Homo sapiens
gcuggccucucuagcacaa

SEQ ID NO: 698938 - RNA, 19 nt, Homo sapiens
gcugggccauguccaaaga

SEQ ID NO: 698939 - RNA, 13 nt, Homo sapiens
gcuggugaauauu

SEQ ID NO: 698940 - RNA, 17 nt, Homo sapiens
gcugguugagguuucaa

SEQ ID NO: 698941 - RNA, 19 nt, Homo sapiens
gcugucccuugcuugccug

SEQ ID NO: 698942 - RNA, 13 nt, Homo sapiens
gcuguuguccaac

SEQ ID NO: 698943 - RNA, 16 nt, Homo sapiens
gcuuaaaguugucacu

SEQ ID NO: 698944 - RNA, 19 nt, Homo sapiens
gcuucccuaaucuaugguc

SEQ ID NO: 698945 - RNA, 13 nt, Homo sapiens
gcuuccuccugcc

SEQ ID NO: 698946 - RNA, 21 nt, Homo sapiens
gcuucucagauuucugaggaa

SEQ ID NO: 698947 - RNA, 20 nt, Homo sapiens
gcuuuauuuuuuugaacucu

SEQ ID NO: 698948 - RNA, 14 nt, Homo sapiens
gcuuucuguugcca

SEQ ID NO: 698949 - RNA, 15 nt, Homo sapiens
ggaaaacuaccugua

SEQ ID NO: 698950 - RNA, 21 nt, Homo sapiens
ggaaaagcauuuuucaauaua

SEQ ID NO: 698951 - RNA, 21 nt, Homo sapiens
ggaaaccaguuuggugauaua

SEQ ID NO: 698952 - RNA, 18 nt, Homo sapiens
ggaaacccccaguguaau

SEQ ID NO: 698953 - RNA, 16 nt, Homo sapiens
ggaaagagacugucau

SEQ ID NO: 698954 - RNA, 20 nt, Homo sapiens
ggaaagugauuuuuuuccac

SEQ ID NO: 698955 - RNA, 14 nt, Homo sapiens
ggaacaaguugagc

SEQ ID NO: 698956 - RNA, 13 nt, Homo sapiens
ggaacacugcacu

SEQ ID NO: 698957 - RNA, 18 nt, Homo sapiens
ggaagaaugaacacuccc

SEQ ID NO: 698958 - RNA, 17 nt, Homo sapiens
ggaagguucuacgccag

SEQ ID NO: 698959 - RNA, 17 nt, Homo sapiens
ggaagucagcaugccuc

SEQ ID NO: 698960 - RNA, 15 nt, Homo sapiens
ggaauacugugcaua

SEQ ID NO: 698961 - RNA, 21 nt, Homo sapiens
ggaauauaaggaaagcaauaa

SEQ ID NO: 698962 - RNA, 20 nt, Homo sapiens
ggaauuacgugcucuguggg

SEQ ID NO: 698963 - RNA, 17 nt, Homo sapiens
ggacagaguagccaggu

SEQ ID NO: 698964 - RNA, 23 nt, Homo sapiens
ggacaguaucccacauccaacuc

SEQ ID NO: 698965 - RNA, 16 nt, Homo sapiens
ggacaucacagggugg

SEQ ID NO: 698966 - RNA, 14 nt, Homo sapiens
ggacccagugcaga

SEQ ID NO: 698967 - RNA, 15 nt, Homo sapiens
ggacggcaggcucac

SEQ ID NO: 698968 - RNA, 15 nt, Homo sapiens
ggacuguaagggauu

SEQ ID NO: 698969 - RNA, 19 nt, Homo sapiens
ggagaacaugaaucaaaag

SEQ ID NO: 698970 - RNA, 17 nt, Homo sapiens
ggagaagagcgcagugu

SEQ ID NO: 698971 - RNA, 17 nt, Homo sapiens
ggagaaugaagacuguu

SEQ ID NO: 698972 - RNA, 21 nt, Homo sapiens
ggagccuuuuuaaaacacaug

SEQ ID NO: 698973 - RNA, 14 nt, Homo sapiens
ggaggaugaugcca

SEQ ID NO: 698974 - RNA, 15 nt, Homo sapiens
ggaggaugcuaaaaa

SEQ ID NO: 698975 - RNA, 21 nt, Homo sapiens
ggaggggcugcuggacccaag

SEQ ID NO: 698976 - RNA, 17 nt, Homo sapiens
ggaggugauuccaguga

SEQ ID NO: 698977 - RNA, 19 nt, Homo sapiens
ggagguggaggcugcagug

SEQ ID NO: 698978 - RNA, 14 nt, Homo sapiens
ggauagaagccaac

SEQ ID NO: 698979 - RNA, 13 nt, Homo sapiens
ggauauuuacuac

SEQ ID NO: 698980 - RNA, 17 nt, Homo sapiens
ggaucuaccagcauaaa

SEQ ID NO: 698981 - RNA, 12 nt, Homo sapiens
ggaucugaggga

SEQ ID NO: 698982 - RNA, 18 nt, Homo sapiens
ggaucuuggagaauguga

SEQ ID NO: 698983 - RNA, 22 nt, Homo sapiens
ggaugaaacuaaagcaauagaa

SEQ ID NO: 698984 - RNA, 22 nt, Homo sapiens
ggaugccaaccggucacccagg

SEQ ID NO: 698985 - RNA, 23 nt, Homo sapiens
ggaugccaaccggucacccagga

SEQ ID NO: 698986 - RNA, 16 nt, Homo sapiens
ggaugcggccauucaa

SEQ ID NO: 698987 - RNA, 12 nt, Homo sapiens
ggcaaacaggca

SEQ ID NO: 698988 - RNA, 19 nt, Homo sapiens
ggcaacauucauugccaag

SEQ ID NO: 698989 - RNA, 12 nt, Homo sapiens
ggcaacugugag

SEQ ID NO: 698990 - RNA, 22 nt, Homo sapiens
ggcagcugcuauccccaucucc

SEQ ID NO: 698991 - RNA, 16 nt, Homo sapiens
ggcaggcuccaggccu

SEQ ID NO: 698992 - RNA, 19 nt, Homo sapiens
ggcaguccuggaaucacau

SEQ ID NO: 698993 - RNA, 14 nt, Homo sapiens
ggcaugguggccca

SEQ ID NO: 698994 - RNA, 14 nt, Homo sapiens
ggccaacuaggcag

SEQ ID NO: 698995 - RNA, 20 nt, Homo sapiens
ggccaggcuggucuugaacu

SEQ ID NO: 698996 - RNA, 14 nt, Homo sapiens
ggccauguccaaag

SEQ ID NO: 698997 - RNA, 18 nt, Homo sapiens
ggcccaaagaaagagcua

SEQ ID NO: 698998 - RNA, 18 nt, Homo sapiens
ggcccauggcuguuggug

SEQ ID NO: 698999 - RNA, 17 nt, Homo sapiens
ggccccagggggucuca

SEQ ID NO: 699000 - RNA, 13 nt, Homo sapiens
ggcccgccucucc

SEQ ID NO: 699001 - RNA, 18 nt, Homo sapiens
ggcccuccucucccaucc

SEQ ID NO: 699002 - RNA, 15 nt, Homo sapiens
ggcccuuugcugucc

SEQ ID NO: 699003 - RNA, 16 nt, Homo sapiens
ggccgaggccaugugc

SEQ ID NO: 699004 - RNA, 19 nt, Homo sapiens
ggccgggcgcgguggcuca

SEQ ID NO: 699005 - RNA, 14 nt, Homo sapiens
ggccugcccagaca

SEQ ID NO: 699006 - RNA, 20 nt, Homo sapiens
ggcggguggaucacgagguc

SEQ ID NO: 699007 - RNA, 14 nt, Homo sapiens
ggcuagcuucugcu

SEQ ID NO: 699008 - RNA, 17 nt, Homo sapiens
ggcuauuuggacucagg

SEQ ID NO: 699009 - RNA, 15 nt, Homo sapiens
ggcugaccaugcuca

SEQ ID NO: 699010 - RNA, 18 nt, Homo sapiens
ggcugcacccacccagga

SEQ ID NO: 699011 - RNA, 22 nt, Homo sapiens
ggcugccggcacggcccguggc

SEQ ID NO: 699012 - RNA, 14 nt, Homo sapiens
ggcuggguggcacc

SEQ ID NO: 699013 - RNA, 20 nt, Homo sapiens
ggcuguugacgcaccugugg

SEQ ID NO: 699014 - RNA, 22 nt, Homo sapiens
ggcuguuggugggacccguggc

SEQ ID NO: 699015 - RNA, 14 nt, Homo sapiens
ggcuucaccaucaa

SEQ ID NO: 699016 - RNA, 23 nt, Homo sapiens
ggcuucugugcccagaauacuga

SEQ ID NO: 699017 - RNA, 17 nt, Homo sapiens
ggcuugaagccaaagaa

SEQ ID NO: 699018 - RNA, 15 nt, Homo sapiens
ggcuuuaucucaggg

SEQ ID NO: 699019 - RNA, 14 nt, Homo sapiens
gggaaucuaagaga

SEQ ID NO: 699020 - RNA, 14 nt, Homo sapiens
gggacaagggauuu

SEQ ID NO: 699021 - RNA, 18 nt, Homo sapiens
gggacucguggcugucaa

SEQ ID NO: 699022 - RNA, 20 nt, Homo sapiens
gggaggucaaggcugcagug

SEQ ID NO: 699023 - RNA, 13 nt, Homo sapiens
gggccauggcuca

SEQ ID NO: 699024 - RNA, 19 nt, Homo sapiens
gggccauggcucagggugg

SEQ ID NO: 699025 - RNA, 14 nt, Homo sapiens
gggccauguccaaa

SEQ ID NO: 699026 - RNA, 22 nt, Homo sapiens
gggcccggcccgcgccacagga

SEQ ID NO: 699027 - RNA, 15 nt, Homo sapiens
gggccugcccagaca

SEQ ID NO: 699028 - RNA, 17 nt, Homo sapiens
gggcgugggcgcuugca

SEQ ID NO: 699029 - RNA, 12 nt, Homo sapiens
gggcucagcaaa

SEQ ID NO: 699030 - RNA, 16 nt, Homo sapiens
gggcuuucuggggccu

SEQ ID NO: 699031 - RNA, 15 nt, Homo sapiens
ggggagccuuagccg

SEQ ID NO: 699032 - RNA, 14 nt, Homo sapiens
ggggcccagugcau

SEQ ID NO: 699033 - RNA, 13 nt, Homo sapiens
ggggccuccagaa

SEQ ID NO: 699034 - RNA, 15 nt, Homo sapiens
ggggcguucgcugcg

SEQ ID NO: 699035 - RNA, 18 nt, Homo sapiens
gggggagaagaagccgag

SEQ ID NO: 699036 - RNA, 23 nt, Homo sapiens
gggguaccuuaagagacacucca

SEQ ID NO: 699037 - RNA, 20 nt, Homo sapiens
ggguaacugggguugagggc

SEQ ID NO: 699038 - RNA, 22 nt, Homo sapiens
ggguaccuuaagagacacucca

SEQ ID NO: 699039 - RNA, 22 nt, Homo sapiens
ggguaggaaagaggaagcaaau

SEQ ID NO: 699040 - RNA, 21 nt, Homo sapiens
ggguuccuccucuccuacucg

SEQ ID NO: 699041 - RNA, 13 nt, Homo sapiens
gguaaauguuucu

SEQ ID NO: 699042 - RNA, 15 nt, Homo sapiens
gguaaugugaauaaa

SEQ ID NO: 699043 - RNA, 17 nt, Homo sapiens
gguauccugggggaccc

SEQ ID NO: 699044 - RNA, 21 nt, Homo sapiens
ggucacguuuggugcuucuca

SEQ ID NO: 699045 - RNA, 18 nt, Homo sapiens
ggucgccgcacuucugau

SEQ ID NO: 699046 - RNA, 19 nt, Homo sapiens
ggucucuucuuggggccca

SEQ ID NO: 699047 - RNA, 21 nt, Homo sapiens
ggucugugugugugugugugc

SEQ ID NO: 699048 - RNA, 11 nt, Homo sapiens
ggugauggugu

SEQ ID NO: 699049 - RNA, 15 nt, Homo sapiens
ggugcugcagcaccg

SEQ ID NO: 699050 - RNA, 17 nt, Homo sapiens
gguggcccacgccugua

SEQ ID NO: 699051 - RNA, 17 nt, Homo sapiens
ggugggacucguggcug

SEQ ID NO: 699052 - RNA, 15 nt, Homo sapiens
ggugggauuccacuc

SEQ ID NO: 699053 - RNA, 22 nt, Homo sapiens
ggugggcccucugaacuugccu

SEQ ID NO: 699054 - RNA, 20 nt, Homo sapiens
aaaaacugauugaaugauau

SEQ ID NO: 699055 - RNA, 14 nt, Homo sapiens
aaaaagucagagac

SEQ ID NO: 699056 - RNA, 17 nt, Homo sapiens
aaaaagucagagacaga

SEQ ID NO: 699057 - RNA, 22 nt, Homo sapiens
aaaaagucagagacagauaccu

SEQ ID NO: 699058 - RNA, 15 nt, Homo sapiens
aaaaauauugcugaa

SEQ ID NO: 699059 - RNA, 19 nt, Homo sapiens
aaaaauauuguuucugcau

SEQ ID NO: 699060 - RNA, 20 nt, Homo sapiens
aaaaauauuguuucugcauu

SEQ ID NO: 699061 - RNA, 15 nt, Homo sapiens
aaaaaucccuuaccu

SEQ ID NO: 699062 - RNA, 17 nt, Homo sapiens
aaaaaucuuuucauuaa

SEQ ID NO: 699063 - RNA, 21 nt, Homo sapiens
aaaaauggaaacuauauugac

SEQ ID NO: 699064 - RNA, 19 nt, Homo sapiens
aaaacaucuuuaaggggag

SEQ ID NO: 699065 - RNA, 19 nt, Homo sapiens
aaaacauggaacagugugg

SEQ ID NO: 699066 - RNA, 12 nt, Homo sapiens
aaaaccaaagag

SEQ ID NO: 699067 - RNA, 24 nt, Homo sapiens
aaaaccaauguucucucuucucca

SEQ ID NO: 699068 - RNA, 18 nt, Homo sapiens
aaaaccauggucucucug

SEQ ID NO: 699069 - RNA, 11 nt, Homo sapiens
aaaacccggga

SEQ ID NO: 699070 - RNA, 19 nt, Homo sapiens
aaaaccuacccucagugag

SEQ ID NO: 699071 - RNA, 22 nt, Homo sapiens
aaaaccuacccucagugagcau

SEQ ID NO: 699072 - RNA, 14 nt, Homo sapiens
aaaaccuuccccag

SEQ ID NO: 699073 - RNA, 15 nt, Homo sapiens
aaaacucacugugau

SEQ ID NO: 699074 - RNA, 23 nt, Homo sapiens
aaaacuuuucuaauacucuaccc

SEQ ID NO: 699075 - RNA, 15 nt, Homo sapiens
aaaagaaaugaacau

SEQ ID NO: 699076 - RNA, 16 nt, Homo sapiens
aaaagccuaaucacag

SEQ ID NO: 699077 - RNA, 15 nt, Homo sapiens
aaaaguaauauuuau

SEQ ID NO: 699078 - RNA, 18 nt, Homo sapiens
aaaagucagagacagaua

SEQ ID NO: 699079 - RNA, 13 nt, Homo sapiens
aaaauacauugua

SEQ ID NO: 699080 - RNA, 21 nt, Homo sapiens
aaaauacuauuuaagauguga

SEQ ID NO: 699081 - RNA, 22 nt, Homo sapiens
aaaauagauccaaucaguuuau

SEQ ID NO: 699082 - RNA, 12 nt, Homo sapiens
aaaauauaucau

SEQ ID NO: 699083 - RNA, 15 nt, Homo sapiens
aaaauauauucuuuc

SEQ ID NO: 699084 - RNA, 22 nt, Homo sapiens
aaaauaugaaaaaaagaaauga

SEQ ID NO: 699085 - RNA, 15 nt, Homo sapiens
aaaauauuucaguga

SEQ ID NO: 699086 - RNA, 22 nt, Homo sapiens
aaaaucacaaggcaacugugag

SEQ ID NO: 699087 - RNA, 23 nt, Homo sapiens
aacugggaugaaacuaaagcaau

SEQ ID NO: 699088 - RNA, 17 nt, Homo sapiens
aacugucucucuucuca

SEQ ID NO: 699089 - RNA, 18 nt, Homo sapiens
aacuugaaugugucaggu

SEQ ID NO: 699090 - RNA, 12 nt, Homo sapiens
aacuugggccac

SEQ ID NO: 699091 - RNA, 18 nt, Homo sapiens
aagaaaacaccacuaauu

SEQ ID NO: 699092 - RNA, 14 nt, Homo sapiens
aagaaacuuauuuc

SEQ ID NO: 699093 - RNA, 23 nt, Homo sapiens
aagaaacuuauuucucauaucaa

SEQ ID NO: 699094 - RNA, 16 nt, Homo sapiens
aagaaaguggucuuaa

SEQ ID NO: 699095 - RNA, 21 nt, Homo sapiens
aagaaaguggucuuaagaaau

SEQ ID NO: 699096 - RNA, 13 nt, Homo sapiens
aagaaccucucac

SEQ ID NO: 699097 - RNA, 15 nt, Homo sapiens
aagaagcucucuccu

SEQ ID NO: 699098 - RNA, 15 nt, Homo sapiens
aagaaggcaauauua

SEQ ID NO: 699099 - RNA, 16 nt, Homo sapiens
aagaaugaacacuccc

SEQ ID NO: 699100 - RNA, 12 nt, Homo sapiens
aagaauuugcau

SEQ ID NO: 699101 - RNA, 13 nt, Homo sapiens
aagacacugccug

SEQ ID NO: 699102 - RNA, 13 nt, Homo sapiens
aagaccaccacuu

SEQ ID NO: 699103 - RNA, 16 nt, Homo sapiens
aagagaaccauaucaa

SEQ ID NO: 699104 - RNA, 13 nt, Homo sapiens
aagagacacucca

SEQ ID NO: 699105 - RNA, 16 nt, Homo sapiens
aagagacuccgucuca

SEQ ID NO: 699106 - RNA, 21 nt, Homo sapiens
aagaggcugccccucucacca

SEQ ID NO: 699107 - RNA, 20 nt, Homo sapiens
aagauaauuuguugggccau

SEQ ID NO: 699108 - RNA, 18 nt, Homo sapiens
aagaucucgguuugccaa

SEQ ID NO: 699109 - RNA, 20 nt, Homo sapiens
aagaugcuucucacugccau

SEQ ID NO: 699110 - RNA, 22 nt, Homo sapiens
aagaugcuucucacugccaugc

SEQ ID NO: 699111 - RNA, 21 nt, Homo sapiens
aagaugcuuuguuucuuucau

SEQ ID NO: 699112 - RNA, 15 nt, Homo sapiens
aagaugggagccuuu

SEQ ID NO: 699113 - RNA, 17 nt, Homo sapiens
aagaugugaaaauuaca

SEQ ID NO: 699114 - RNA, 17 nt, Homo sapiens
aagcaaugguugaugau

SEQ ID NO: 699115 - RNA, 18 nt, Homo sapiens
aagcaaugguugaugaua

SEQ ID NO: 699116 - RNA, 14 nt, Homo sapiens
aagcacuacaccuu

SEQ ID NO: 699117 - RNA, 23 nt, Homo sapiens
aagcacucuggaugauggauucc

SEQ ID NO: 699118 - RNA, 14 nt, Homo sapiens
aagcagucgugccu

SEQ ID NO: 699119 - RNA, 20 nt, Homo sapiens
aagcaguggccuuauugcau

SEQ ID NO: 699120 - RNA, 21 nt, Homo sapiens
aagcaguuguaccaagugaaa

SEQ ID NO: 699121 - RNA, 13 nt, Homo sapiens
aagcauacuuugu

SEQ ID NO: 699122 - RNA, 17 nt, Homo sapiens
aagccagccagaggcau

SEQ ID NO: 699123 - RNA, 13 nt, Homo sapiens
aagcccaggagcc

SEQ ID NO: 699124 - RNA, 23 nt, Homo sapiens
aagccggggaagagauccaaaga

SEQ ID NO: 699125 - RNA, 19 nt, Homo sapiens
aagcgauuaugaaagcaac

SEQ ID NO: 699126 - RNA, 22 nt, Homo sapiens
aagcuaaugacgaggaaccgaa

SEQ ID NO: 699127 - RNA, 19 nt, Homo sapiens
aagcucgugacaagugccu

SEQ ID NO: 699128 - RNA, 16 nt, Homo sapiens
aagcuuaacacuugac

SEQ ID NO: 699129 - RNA, 16 nt, Homo sapiens
aagcuucaugcacuua

SEQ ID NO: 699130 - RNA, 17 nt, Homo sapiens
aagcuuccgccgucuca

SEQ ID NO: 699131 - RNA, 12 nt, Homo sapiens
aaggaaagugau

SEQ ID NO: 699132 - RNA, 22 nt, Homo sapiens
uucucuuugauuauuugcaugu

SEQ ID NO: 699133 - RNA, 20 nt, Homo sapiens
uucugccgcccccuccugaa

SEQ ID NO: 699134 - RNA, 19 nt, Homo sapiens
uucuggggaaagacacugc

SEQ ID NO: 699135 - RNA, 20 nt, Homo sapiens
uucuguccgagcuuugaaaa

SEQ ID NO: 699136 - RNA, 20 nt, Homo sapiens
uucugugcccagaauacuga

SEQ ID NO: 699137 - RNA, 15 nt, Homo sapiens
uucuguguugccaag

SEQ ID NO: 699138 - RNA, 22 nt, Homo sapiens
uucuguuuuuaaugcuauuuga

SEQ ID NO: 699139 - RNA, 19 nt, Homo sapiens
uucuuacuucccuaaugaa

SEQ ID NO: 699140 - RNA, 20 nt, Homo sapiens
uucuugaaauguaggcauca

SEQ ID NO: 699141 - RNA, 18 nt, Homo sapiens
uucuugccuugaguucca

SEQ ID NO: 699142 - RNA, 18 nt, Homo sapiens
uucuuugacuuaaugucu

SEQ ID NO: 699143 - RNA, 20 nt, Homo sapiens
uugaaaauuuuuaaauauuc

SEQ ID NO: 699144 - RNA, 13 nt, Homo sapiens
uugaaguuuacaa

SEQ ID NO: 699145 - RNA, 11 nt, Homo sapiens
uugacacugaa

SEQ ID NO: 699146 - RNA, 15 nt, Homo sapiens
uugacgcaccugugg

SEQ ID NO: 699147 - RNA, 22 nt, Homo sapiens
uugagaagccuucagcuccagg

SEQ ID NO: 699148 - RNA, 23 nt, Homo sapiens
uugagaccgugaagauacuuugu

SEQ ID NO: 699149 - RNA, 17 nt, Homo sapiens
uugagcucuucuuaaag

SEQ ID NO: 699150 - RNA, 21 nt, Homo sapiens
uugagcuucauauaccagcaa

SEQ ID NO: 699151 - RNA, 12 nt, Homo sapiens
uugagggccaaa

SEQ ID NO: 699152 - RNA, 17 nt, Homo sapiens
uugaguagaguugauca

SEQ ID NO: 699153 - RNA, 19 nt, Homo sapiens
uugauaaauccaucacuau

SEQ ID NO: 699154 - RNA, 22 nt, Homo sapiens
uugauggauuaauuaaauaagu

SEQ ID NO: 699155 - RNA, 21 nt, Homo sapiens
uugcaauaacagcugcaauuc

SEQ ID NO: 699156 - RNA, 15 nt, Homo sapiens
uugcacaauccauga

SEQ ID NO: 699157 - RNA, 14 nt, Homo sapiens
uugcaccacugcac

SEQ ID NO: 699158 - RNA, 18 nt, Homo sapiens
uugcaggaccucagguga

SEQ ID NO: 699159 - RNA, 17 nt, Homo sapiens
uugccaggacaugcaau

SEQ ID NO: 699160 - RNA, 14 nt, Homo sapiens
uugccucaccuaau

SEQ ID NO: 699161 - RNA, 13 nt, Homo sapiens
uugccugaugaca

SEQ ID NO: 699162 - RNA, 16 nt, Homo sapiens
uugcgggacagaguag

SEQ ID NO: 699163 - RNA, 19 nt, Homo sapiens
uugcucuacaaugacacac

SEQ ID NO: 699164 - RNA, 21 nt, Homo sapiens
uugcucuucagaugccacuuc

SEQ ID NO: 699165 - RNA, 21 nt, Homo sapiens
uuggaaucccacuaaugcaaa

SEQ ID NO: 699166 - RNA, 12 nt, Homo sapiens
uuggaauucacc

SEQ ID NO: 699167 - RNA, 18 nt, Homo sapiens
uuggacuguaagggauug

SEQ ID NO: 699168 - RNA, 13 nt, Homo sapiens
uuggaggugcugc

SEQ ID NO: 699169 - RNA, 17 nt, Homo sapiens
uuggccugacucaggaa

SEQ ID NO: 699170 - RNA, 14 nt, Homo sapiens
uuggcuuaaauaau

SEQ ID NO: 699171 - RNA, 15 nt, Homo sapiens
uuggcuucugugaug

SEQ ID NO: 699172 - RNA, 22 nt, Homo sapiens
uugggcagagcuggcucugagc

SEQ ID NO: 699173 - RNA, 13 nt, Homo sapiens
uugggcaugccau

SEQ ID NO: 699174 - RNA, 18 nt, Homo sapiens
uugggcuauuuggacuca

SEQ ID NO: 699175 - RNA, 22 nt, Homo sapiens
uugggggaggggagacuuugau

SEQ ID NO: 699176 - RNA, 20 nt, Homo sapiens
uugguaaaacucacugugau

SEQ ID NO: 699177 - RNA, 14 nt, Homo sapiens
uuggugcuuuucac

SEQ ID NO: 699178 - RNA, 20 nt, Homo sapiens
uuguaaaacaaaauuugacu

SEQ ID NO: 699179 - RNA, 20 nt, Homo sapiens
uuguaaauacacauagcaug

SEQ ID NO: 699180 - RNA, 15 nt, Homo sapiens
uuguaaauaggauuu

SEQ ID NO: 699181 - RNA, 13 nt, Homo sapiens
uuguaagccauaa

SEQ ID NO: 699182 - RNA, 19 nt, Homo sapiens
uuguagaguuuugucauuc

SEQ ID NO: 699183 - RNA, 15 nt, Homo sapiens
uugucaaaaggaagu

SEQ ID NO: 699184 - RNA, 18 nt, Homo sapiens
uugucccuaugcauauca

SEQ ID NO: 699185 - RNA, 21 nt, Homo sapiens
uugucuggcaaggacuuugua

SEQ ID NO: 699186 - RNA, 18 nt, Homo sapiens
uugucuugccccuaggaa

SEQ ID NO: 699187 - RNA, 23 nt, Homo sapiens
uugugaaguggaaauguucuaaa

SEQ ID NO: 699188 - RNA, 21 nt, Homo sapiens
uugugcuucacaguagagcca

SEQ ID NO: 699189 - RNA, 17 nt, Homo sapiens
uuguggguccaugcuaa

SEQ ID NO: 699190 - RNA, 15 nt, Homo sapiens
uugugugucaugcca

SEQ ID NO: 699191 - RNA, 21 nt, Homo sapiens
uuguguguuuauuucacuuga

SEQ ID NO: 699192 - RNA, 13 nt, Homo sapiens
uuguguucucaaa

SEQ ID NO: 699193 - RNA, 18 nt, Homo sapiens
uuguuaucagauauguga

SEQ ID NO: 699194 - RNA, 21 nt, Homo sapiens
uuguucguauuuagaauggga

SEQ ID NO: 699195 - RNA, 16 nt, Homo sapiens
uuguucugugguuauc

SEQ ID NO: 699196 - RNA, 15 nt, Homo sapiens
uuguugaacacuuga

SEQ ID NO: 699197 - RNA, 13 nt, Homo sapiens
uuguuuacucauc

SEQ ID NO: 699198 - RNA, 20 nt, Homo sapiens
uuuaaaaaaaaauugaacaa

SEQ ID NO: 699199 - RNA, 13 nt, Homo sapiens
uuuaaaacacaug

SEQ ID NO: 699200 - RNA, 21 nt, Homo sapiens
uuuaauagggaauauaucucu

SEQ ID NO: 699201 - RNA, 15 nt, Homo sapiens
uuuaauggcauguca

SEQ ID NO: 699202 - RNA, 21 nt, Homo sapiens
uuuacacagaaacacugccuu

SEQ ID NO: 699203 - RNA, 16 nt, Homo sapiens
uuuacugguugcaugg

SEQ ID NO: 699204 - RNA, 22 nt, Homo sapiens
uuuagaauaagaauuugcauac

SEQ ID NO: 699205 - RNA, 16 nt, Homo sapiens
uuuagaccccauacaa

SEQ ID NO: 699206 - RNA, 18 nt, Homo sapiens
uuuagauuuucuuuugcc

SEQ ID NO: 699207 - RNA, 14 nt, Homo sapiens
uuuauaaacagaaa

SEQ ID NO: 699208 - RNA, 15 nt, Homo sapiens
uuuauaaaggccaaa

SEQ ID NO: 699209 - RNA, 15 nt, Homo sapiens
uuuauacuguuuacu

SEQ ID NO: 699210 - RNA, 20 nt, Homo sapiens
uuuaucauucaaguguaaaa

SEQ ID NO: 699211 - RNA, 17 nt, Homo sapiens
uuuaugagaaacuuaaa

SEQ ID NO: 699212 - RNA, 19 nt, Homo sapiens
uuuauguuugaaugauuua

SEQ ID NO: 699213 - RNA, 17 nt, Homo sapiens
uuuauuaaaauauuuca

SEQ ID NO: 699214 - RNA, 22 nt, Homo sapiens
uuucaaaagguauuauacaugu

SEQ ID NO: 699215 - RNA, 19 nt, Homo sapiens
uuucaaaauauacauucaa

SEQ ID NO: 699216 - RNA, 19 nt, Homo sapiens
uuucaacugucuuccucaa

SEQ ID NO: 699217 - RNA, 23 nt, Homo sapiens
uuucagugaauuugcacuguuua

SEQ ID NO: 699218 - RNA, 18 nt, Homo sapiens
uuucauuaaagaauguuu

SEQ ID NO: 699219 - RNA, 14 nt, Homo sapiens
uuuccaaaccuuau

SEQ ID NO: 699220 - RNA, 18 nt, Homo sapiens
uuuccuggaauugccagc

SEQ ID NO: 699221 - RNA, 16 nt, Homo sapiens
uuucuaaagacuugua

SEQ ID NO: 699222 - RNA, 18 nt, Homo sapiens
uuugcaauaaaaaugaua

SEQ ID NO: 699223 - RNA, 18 nt, Homo sapiens
uuugccaggacaugcaau

SEQ ID NO: 699224 - RNA, 19 nt, Homo sapiens
uuugcuaaaugugaaugau

SEQ ID NO: 699225 - RNA, 14 nt, Homo sapiens
uuugcucuucagau

SEQ ID NO: 699226 - RNA, 21 nt, Homo sapiens
uuugcuuccucccaacaagca

SEQ ID NO: 699227 - RNA, 14 nt, Homo sapiens
uuuggaggugcugc

SEQ ID NO: 699228 - RNA, 13 nt, Homo sapiens
uuugggaugacca

SEQ ID NO: 699229 - RNA, 21 nt, Homo sapiens
uuuuaaaaaaaucccauuuaa

SEQ ID NO: 699230 - RNA, 15 nt, Homo sapiens
uuuuaagcugcaaau

SEQ ID NO: 699231 - RNA, 15 nt, Homo sapiens
uuuuaauuuacuugu

SEQ ID NO: 699232 - RNA, 22 nt, Homo sapiens
uuuuagaauuaaaaaagcauac

SEQ ID NO: 699233 - RNA, 19 nt, Homo sapiens
uuuuagacccuauugcugc

SEQ ID NO: 699234 - RNA, 22 nt, Homo sapiens
uuuuauaaauucagaaagucau

SEQ ID NO: 699235 - RNA, 14 nt, Homo sapiens
uuuuauuuauaugu

SEQ ID NO: 699236 - RNA, 19 nt, Homo sapiens
uuuucaaaauccaaaaaga

SEQ ID NO: 699237 - RNA, 14 nt, Homo sapiens
uuuucaagaugcuu

SEQ ID NO: 699238 - RNA, 20 nt, Homo sapiens
uuuucaauuaguaacauuca

SEQ ID NO: 699239 - RNA, 13 nt, Homo sapiens
uuuucagggcugg

SEQ ID NO: 699240 - RNA, 13 nt, Homo sapiens
uuuucugguucua

SEQ ID NO: 699241 - RNA, 21 nt, Homo sapiens
uuuucuuguccucauucuugc

SEQ ID NO: 699242 - RNA, 21 nt, Homo sapiens
uuuugagcacuuuucaaacaa

SEQ ID NO: 699243 - RNA, 21 nt, Homo sapiens
uuuugaguaaagcuccuaucu

SEQ ID NO: 699244 - RNA, 16 nt, Homo sapiens
ugucguauuuggcaca

SEQ ID NO: 699245 - RNA, 20 nt, Homo sapiens
ugucugcgucgucaccaaau

SEQ ID NO: 699246 - RNA, 14 nt, Homo sapiens
ugucuuuggugcuu

SEQ ID NO: 699247 - RNA, 16 nt, Homo sapiens
ugugaaguggaaaugu

SEQ ID NO: 699248 - RNA, 12 nt, Homo sapiens
ugugaauacugc

SEQ ID NO: 699249 - RNA, 20 nt, Homo sapiens
ugugaauuauugacacugaa

SEQ ID NO: 699250 - RNA, 18 nt, Homo sapiens
ugugaccaggaaggaagu

SEQ ID NO: 699251 - RNA, 17 nt, Homo sapiens
ugugagaaacaucucaa

SEQ ID NO: 699252 - RNA, 15 nt, Homo sapiens
ugugagagaaagugu

SEQ ID NO: 699253 - RNA, 20 nt, Homo sapiens
ugugauggacacuccaggga

SEQ ID NO: 699254 - RNA, 14 nt, Homo sapiens
ugugauuagugucu

SEQ ID NO: 699255 - RNA, 13 nt, Homo sapiens
ugugcaugccaug

SEQ ID NO: 699256 - RNA, 22 nt, Homo sapiens
ugugcgcucuguggaugccagg

SEQ ID NO: 699257 - RNA, 19 nt, Homo sapiens
ugugcuuucagaagugccc

SEQ ID NO: 699258 - RNA, 17 nt, Homo sapiens
uguggaugauaaaacac

SEQ ID NO: 699259 - RNA, 15 nt, Homo sapiens
uguggcagugguuuu

SEQ ID NO: 699260 - RNA, 15 nt, Homo sapiens
uguggccacaaucca

SEQ ID NO: 699261 - RNA, 13 nt, Homo sapiens
ugugguuuacuag

SEQ ID NO: 699262 - RNA, 14 nt, Homo sapiens
ugugucaugccagu

SEQ ID NO: 699263 - RNA, 10 nt, Homo sapiens
ugugugcaca

SEQ ID NO: 699264 - RNA, 16 nt, Homo sapiens
ugugugcgugcgcauc

SEQ ID NO: 699265 - RNA, 17 nt, Homo sapiens
uguguuuauuucacuug

SEQ ID NO: 699266 - RNA, 11 nt, Homo sapiens
uguuagauauu

SEQ ID NO: 699267 - RNA, 17 nt, Homo sapiens
uguuagugguuacccag

SEQ ID NO: 699268 - RNA, 22 nt, Homo sapiens
uguucccuccccgaucaucuuu

SEQ ID NO: 699269 - RNA, 16 nt, Homo sapiens
uguucgacuaccuuuu

SEQ ID NO: 699270 - RNA, 14 nt, Homo sapiens
uguugaaguuuaca

SEQ ID NO: 699271 - RNA, 10 nt, Homo sapiens
uguugccagc

SEQ ID NO: 699272 - RNA, 16 nt, Homo sapiens
uguugccauggugaug

SEQ ID NO: 699273 - RNA, 21 nt, Homo sapiens
uguuguacuuaaaugguaaua

SEQ ID NO: 699274 - RNA, 18 nt, Homo sapiens
uguuuagcccaaaaccaa

SEQ ID NO: 699275 - RNA, 13 nt, Homo sapiens
uguuugaauuauc

SEQ ID NO: 699276 - RNA, 21 nt, Homo sapiens
uguuuucugacuaauuaggca

SEQ ID NO: 699277 - RNA, 16 nt, Homo sapiens
uguuuuuaaacuaaua

SEQ ID NO: 699278 - RNA, 20 nt, Homo sapiens
uuaaaaaaaaagucagagac

SEQ ID NO: 699279 - RNA, 15 nt, Homo sapiens
uuaaaaagaaugacg

SEQ ID NO: 699280 - RNA, 19 nt, Homo sapiens
uuaaaacuggaccuguaua

SEQ ID NO: 699281 - RNA, 13 nt, Homo sapiens
uuaaaaugccaau

SEQ ID NO: 699282 - RNA, 19 nt, Homo sapiens
uuaaaauuaucaauaucua

SEQ ID NO: 699283 - RNA, 18 nt, Homo sapiens
uuaaacauugaaguaaug

SEQ ID NO: 699284 - RNA, 12 nt, Homo sapiens
uuaaacuuucaa

SEQ ID NO: 699285 - RNA, 20 nt, Homo sapiens
uuaaacuuucaauugucacu

SEQ ID NO: 699286 - RNA, 17 nt, Homo sapiens
uuaaacuuuuuuaacca

SEQ ID NO: 699287 - RNA, 21 nt, Homo sapiens
uuaaagacaggagacaaaaga

SEQ ID NO: 699288 - RNA, 16 nt, Homo sapiens
uuaaaguauucuucuc

SEQ ID NO: 699289 - RNA, 13 nt, Homo sapiens
uuaaaguucucaa

SEQ ID NO: 699290 - RNA, 13 nt, Homo sapiens
uuaaauaaucucu

SEQ ID NO: 699291 - RNA, 24 nt, Homo sapiens
uuaaaucagccguguaaccaugga

SEQ ID NO: 699292 - RNA, 13 nt, Homo sapiens
uuaaaugguaaua

SEQ ID NO: 699293 - RNA, 21 nt, Homo sapiens
uuaacagauggaaaaacugag

SEQ ID NO: 699294 - RNA, 14 nt, Homo sapiens
uuaacauagccaaa

SEQ ID NO: 699295 - RNA, 19 nt, Homo sapiens
uuaacccuauuuuaccuag

SEQ ID NO: 699296 - RNA, 11 nt, Homo sapiens
uuaacugccaa

SEQ ID NO: 699297 - RNA, 18 nt, Homo sapiens
uuaacuuuauaaauccag

SEQ ID NO: 699298 - RNA, 19 nt, Homo sapiens
uuaagcuuccgccgucuca

SEQ ID NO: 699299 - RNA, 19 nt, Homo sapiens
uuaaggacaaagugccaaa

SEQ ID NO: 699300 - RNA, 15 nt, Homo sapiens
uuaaggggaagaaug

SEQ ID NO: 699301 - RNA, 14 nt, Homo sapiens
uuaagguguuugaa

SEQ ID NO: 699302 - RNA, 20 nt, Homo sapiens
uuaauaaucaagagccuuaa

SEQ ID NO: 699303 - RNA, 13 nt, Homo sapiens
uuaauacuguuua

SEQ ID NO: 699304 - RNA, 19 nt, Homo sapiens
uuaauuguuuaaaaaccga

SEQ ID NO: 699305 - RNA, 21 nt, Homo sapiens
uuaauuguuuaaaaaccgaau

SEQ ID NO: 699306 - RNA, 22 nt, Homo sapiens
uuaauuuccuuuuugacacuga

SEQ ID NO: 699307 - RNA, 20 nt, Homo sapiens
uuacaauaggaguggugauu

SEQ ID NO: 699308 - RNA, 16 nt, Homo sapiens
uuacgcaaugcuucua

SEQ ID NO: 699309 - RNA, 13 nt, Homo sapiens
uuacguaguucua

SEQ ID NO: 699310 - RNA, 21 nt, Homo sapiens
uuacugaaagaaaaagaccua

SEQ ID NO: 699311 - RNA, 14 nt, Homo sapiens
uuacugaagucuua

SEQ ID NO: 699312 - RNA, 16 nt, Homo sapiens
uuacuguguaaacuca

SEQ ID NO: 699313 - RNA, 16 nt, Homo sapiens
uuagaguaaugaaaug

SEQ ID NO: 699314 - RNA, 22 nt, Homo sapiens
uuagaguugcucuacaaugaca

SEQ ID NO: 699315 - RNA, 22 nt, Homo sapiens
uuagauauuuuucauaaacaag

SEQ ID NO: 699316 - RNA, 22 nt, Homo sapiens
uuagcauuuuucaaaugaucuu

SEQ ID NO: 699317 - RNA, 16 nt, Homo sapiens
uuagccagauuugucu

SEQ ID NO: 699318 - RNA, 17 nt, Homo sapiens
uuagccagguaauguga

SEQ ID NO: 699319 - RNA, 23 nt, Homo sapiens
uuagguggugguagagaagcaag

SEQ ID NO: 699320 - RNA, 15 nt, Homo sapiens
uuagugauauuacau

SEQ ID NO: 699321 - RNA, 18 nt, Homo sapiens
uuagugucucauguggaa

SEQ ID NO: 699322 - RNA, 16 nt, Homo sapiens
uuaguguuuugccuca

SEQ ID NO: 699323 - RNA, 16 nt, Homo sapiens
uuauaaaaagaaugaa

SEQ ID NO: 699324 - RNA, 18 nt, Homo sapiens
uuauaaaauccugugcaa

SEQ ID NO: 699325 - RNA, 21 nt, Homo sapiens
uuauaagugaagugauacuau

SEQ ID NO: 699326 - RNA, 18 nt, Homo sapiens
uuauacaaaccuaccaaa

SEQ ID NO: 699327 - RNA, 13 nt, Homo sapiens
uuauaucaugcaa

SEQ ID NO: 699328 - RNA, 15 nt, Homo sapiens
uuauauguacuguuu

SEQ ID NO: 699329 - RNA, 18 nt, Homo sapiens
uuaugaguuuuucaauua

SEQ ID NO: 699330 - RNA, 14 nt, Homo sapiens
uuauuacauguaau

SEQ ID NO: 699331 - RNA, 16 nt, Homo sapiens
uucaaguaauugugaa

SEQ ID NO: 699332 - RNA, 16 nt, Homo sapiens
uucacugcgaagaccc

SEQ ID NO: 699333 - RNA, 23 nt, Homo sapiens
uucacuuguguuuuaaaauaagg

SEQ ID NO: 699334 - RNA, 14 nt, Homo sapiens
uucagcuccaggga

SEQ ID NO: 699335 - RNA, 15 nt, Homo sapiens
uucagcugguugagg

SEQ ID NO: 699336 - RNA, 20 nt, Homo sapiens
uucaguauuagaugcacuua

SEQ ID NO: 699337 - RNA, 13 nt, Homo sapiens
uucaguugccaag

SEQ ID NO: 699338 - RNA, 14 nt, Homo sapiens
uucaucaugacaac

SEQ ID NO: 699339 - RNA, 22 nt, Homo sapiens
uucauggugcacugagcugcaa

SEQ ID NO: 699340 - RNA, 21 nt, Homo sapiens
uucauucccaagguuacugga

SEQ ID NO: 699341 - RNA, 23 nt, Homo sapiens
uuccagauguggauuuggcaaaa

SEQ ID NO: 699342 - RNA, 16 nt, Homo sapiens
uuccaguuauaaauau

SEQ ID NO: 699343 - RNA, 15 nt, Homo sapiens
uucccacagugccua

SEQ ID NO: 699344 - RNA, 16 nt, Homo sapiens
uucccauuugugccag

SEQ ID NO: 699345 - RNA, 16 nt, Homo sapiens
uuccccaaugcuccau

SEQ ID NO: 699346 - RNA, 22 nt, Homo sapiens
uucccuacaguugaaaaacagc

SEQ ID NO: 699347 - RNA, 23 nt, Homo sapiens
uuccgcaguguggccaggcugcc

SEQ ID NO: 699348 - RNA, 23 nt, Homo sapiens
uuccucauuagcauuuugcuaaa

SEQ ID NO: 699349 - RNA, 20 nt, Homo sapiens
uuccucccaggaagcccagg

SEQ ID NO: 699350 - RNA, 17 nt, Homo sapiens
uuccucuagaagccaag

SEQ ID NO: 699351 - RNA, 22 nt, Homo sapiens
uuccucuugugauuucuuuaaa

SEQ ID NO: 699352 - RNA, 11 nt, Homo sapiens
uuccugugauc

SEQ ID NO: 699353 - RNA, 22 nt, Homo sapiens
uucuaacagugaaguuuuacug

SEQ ID NO: 699354 - RNA, 15 nt, Homo sapiens
uucuaauuaaccuua

SEQ ID NO: 699355 - RNA, 13 nt, Homo sapiens
uucuacguuucuu

SEQ ID NO: 699356 - RNA, 17 nt, Homo sapiens
uucuacugucaaaugau

SEQ ID NO: 699357 - RNA, 19 nt, Homo sapiens
uucuacugucaaaugaugu

SEQ ID NO: 699358 - RNA, 14 nt, Homo sapiens
uucuaggauagcua

SEQ ID NO: 699359 - RNA, 14 nt, Homo sapiens
uucuagucauauau

SEQ ID NO: 699360 - RNA, 19 nt, Homo sapiens
ccuuaauucacucccacac

SEQ ID NO: 699361 - RNA, 22 nt, Homo sapiens
ccuuacuggcuuaccuccucau

SEQ ID NO: 699362 - RNA, 19 nt, Homo sapiens
ccuuaugauuaaacuuccu

SEQ ID NO: 699363 - RNA, 16 nt, Homo sapiens
ccuucagacacccuca

SEQ ID NO: 699364 - RNA, 16 nt, Homo sapiens
ccuucagcuccaggga

SEQ ID NO: 699365 - RNA, 18 nt, Homo sapiens
ccuuccagaucacugcca

SEQ ID NO: 699366 - RNA, 21 nt, Homo sapiens
ccuuccugcugcgcaguucuc

SEQ ID NO: 699367 - RNA, 17 nt, Homo sapiens
ccuucgcuucuugccuc

SEQ ID NO: 699368 - RNA, 18 nt, Homo sapiens
ccuucggguuggcaaaau

SEQ ID NO: 699369 - RNA, 16 nt, Homo sapiens
ccuuggcuucugugau

SEQ ID NO: 699370 - RNA, 16 nt, Homo sapiens
ccuuguccucagccag

SEQ ID NO: 699371 - RNA, 20 nt, Homo sapiens
ccuuuagaaacucaaaaacu

SEQ ID NO: 699372 - RNA, 22 nt, Homo sapiens
ccuuuccaaaugcccagcuuaa

SEQ ID NO: 699373 - RNA, 23 nt, Homo sapiens
ccuuuccagaguccuccuuugcc

SEQ ID NO: 699374 - RNA, 16 nt, Homo sapiens
ccuuucuugaauuagc

SEQ ID NO: 699375 - RNA, 21 nt, Homo sapiens
ccuuucuugaauuagcauuuu

SEQ ID NO: 699376 - RNA, 14 nt, Homo sapiens
ccuuuuaaaaaccu

SEQ ID NO: 699377 - RNA, 15 nt, Homo sapiens
ccuuuuuaaaacaca

SEQ ID NO: 699378 - RNA, 15 nt, Homo sapiens
ccuuuuugacacuga

SEQ ID NO: 699379 - RNA, 20 nt, Homo sapiens
cgagaucgcgccacugcacu

SEQ ID NO: 699380 - RNA, 21 nt, Homo sapiens
cgagaucgcgccacugcacuc

SEQ ID NO: 699381 - RNA, 20 nt, Homo sapiens
cgagauugcaccacugcacu

SEQ ID NO: 699382 - RNA, 14 nt, Homo sapiens
cgagccugcacugg

SEQ ID NO: 699383 - RNA, 14 nt, Homo sapiens
cgagggcagcugcu

SEQ ID NO: 699384 - RNA, 17 nt, Homo sapiens
cgcaguguuuugcaagu

SEQ ID NO: 699385 - RNA, 23 nt, Homo sapiens
cgcccugucuaaaguguauuuuc

SEQ ID NO: 699386 - RNA, 19 nt, Homo sapiens
cgcccuuggcuucugugau

SEQ ID NO: 699387 - RNA, 22 nt, Homo sapiens
cgcuugcaccacuuccguccca

SEQ ID NO: 699388 - RNA, 21 nt, Homo sapiens
cggaaacuaguguacauuucu

SEQ ID NO: 699389 - RNA, 15 nt, Homo sapiens
cggccccucccacac

SEQ ID NO: 699390 - RNA, 13 nt, Homo sapiens
cgggcaccuguag

SEQ ID NO: 699391 - RNA, 20 nt, Homo sapiens
cggggaagagauccaaagac

SEQ ID NO: 699392 - RNA, 14 nt, Homo sapiens
cggggacccuguga

SEQ ID NO: 699393 - RNA, 17 nt, Homo sapiens
cgggggaggcccgcaga

SEQ ID NO: 699394 - RNA, 16 nt, Homo sapiens
cggucucauuucuucu

SEQ ID NO: 699395 - RNA, 20 nt, Homo sapiens
cgguuugaaaauaugccugc

SEQ ID NO: 699396 - RNA, 16 nt, Homo sapiens
cguacaaguaguucug

SEQ ID NO: 699397 - RNA, 13 nt, Homo sapiens
cguauagguugau

SEQ ID NO: 699398 - RNA, 11 nt, Homo sapiens
cgucaccaaau

SEQ ID NO: 699399 - RNA, 15 nt, Homo sapiens
cgucacuaauacaca

SEQ ID NO: 699400 - RNA, 16 nt, Homo sapiens
cgucuauccuguguag

SEQ ID NO: 699401 - RNA, 20 nt, Homo sapiens
cgucugccggacccggaggc

SEQ ID NO: 699402 - RNA, 19 nt, Homo sapiens
cgugaagaagccuguaaca

SEQ ID NO: 699403 - RNA, 15 nt, Homo sapiens
cgugccaaaaaucuu

SEQ ID NO: 699404 - RNA, 20 nt, Homo sapiens
cgugccaaaaaucuuuucau

SEQ ID NO: 699405 - RNA, 19 nt, Homo sapiens
cgugcuacugcacuccagc

SEQ ID NO: 699406 - RNA, 15 nt, Homo sapiens
cgugugacuacuccc

SEQ ID NO: 699407 - RNA, 17 nt, Homo sapiens
cguuauauuaaaacacu

SEQ ID NO: 699408 - RNA, 23 nt, Homo sapiens
cuaaaaaaaaaauccagccucau

SEQ ID NO: 699409 - RNA, 15 nt, Homo sapiens
cuaaaaagcaaaaau

SEQ ID NO: 699410 - RNA, 18 nt, Homo sapiens
cuaaaaaugucacgaaua

SEQ ID NO: 699411 - RNA, 12 nt, Homo sapiens
cuaaaaucauga

SEQ ID NO: 699412 - RNA, 20 nt, Homo sapiens
cuaaagagagaugaaccaca

SEQ ID NO: 699413 - RNA, 18 nt, Homo sapiens
cuaaaguaaaaagggaau

SEQ ID NO: 699414 - RNA, 23 nt, Homo sapiens
cuaaaucacuuugagccugggaa

SEQ ID NO: 699415 - RNA, 18 nt, Homo sapiens
cuaaauguuuggcaugua

SEQ ID NO: 699416 - RNA, 23 nt, Homo sapiens
cuaacauaccguuuauaaugcca

SEQ ID NO: 699417 - RNA, 12 nt, Homo sapiens
cuaacauuuccu

SEQ ID NO: 699418 - RNA, 14 nt, Homo sapiens
cuaaccccuuccag

SEQ ID NO: 699419 - RNA, 22 nt, Homo sapiens
cuaagcaaaauugcuaaagaga

SEQ ID NO: 699420 - RNA, 16 nt, Homo sapiens
cuaaggagccuggaaa

SEQ ID NO: 699421 - RNA, 17 nt, Homo sapiens
cuaaguccaguguuucu

SEQ ID NO: 699422 - RNA, 15 nt, Homo sapiens
cuaauaaguauauaa

SEQ ID NO: 699423 - RNA, 16 nt, Homo sapiens
cuaauagucuuugcca

SEQ ID NO: 699424 - RNA, 17 nt, Homo sapiens
cuaauagucuuugccag

SEQ ID NO: 699425 - RNA, 21 nt, Homo sapiens
cuaauuaaucuggaauaugca

SEQ ID NO: 699426 - RNA, 16 nt, Homo sapiens
cuaauucucuguggaa

SEQ ID NO: 699427 - RNA, 21 nt, Homo sapiens
cuacaacaaauacuacaggcc

SEQ ID NO: 699428 - RNA, 19 nt, Homo sapiens
cuacaguauuacucuuaca

SEQ ID NO: 699429 - RNA, 18 nt, Homo sapiens
cuagaccuauuacaaaga

SEQ ID NO: 699430 - RNA, 23 nt, Homo sapiens
cuagcacaauuugcacuaaauca

SEQ ID NO: 699431 - RNA, 16 nt, Homo sapiens
cuaguauaucagugac

SEQ ID NO: 699432 - RNA, 14 nt, Homo sapiens
cuaguguacauuuc

SEQ ID NO: 699433 - RNA, 22 nt, Homo sapiens
cuaguguacauuucuauaaaua

SEQ ID NO: 699434 - RNA, 23 nt, Homo sapiens
cuaguugaauacuugaaccauaa

SEQ ID NO: 699435 - RNA, 20 nt, Homo sapiens
cuaguuuugucaaacuguag

SEQ ID NO: 699436 - RNA, 19 nt, Homo sapiens
cuauaaaacucugcaugua

SEQ ID NO: 699437 - RNA, 16 nt, Homo sapiens
cuauaaaauagauaua

SEQ ID NO: 699438 - RNA, 17 nt, Homo sapiens
cuauaggaacauaugaa

SEQ ID NO: 699439 - RNA, 15 nt, Homo sapiens
cuaucccucuccuaa

SEQ ID NO: 699440 - RNA, 20 nt, Homo sapiens
cuaucugcuguauauggaau

SEQ ID NO: 699441 - RNA, 22 nt, Homo sapiens
cuaugucaguacuauucaggua

SEQ ID NO: 699442 - RNA, 13 nt, Homo sapiens
cuaugugauuaca

SEQ ID NO: 699443 - RNA, 14 nt, Homo sapiens
cuaugugauuacaa

SEQ ID NO: 699444 - RNA, 13 nt, Homo sapiens
cuauuaauauuca

SEQ ID NO: 699445 - RNA, 15 nt, Homo sapiens
ucucgguuugccaaa

SEQ ID NO: 699446 - RNA, 12 nt, Homo sapiens
ucucugcuugcu

SEQ ID NO: 699447 - RNA, 14 nt, Homo sapiens
ucucugugccuucg

SEQ ID NO: 699448 - RNA, 15 nt, Homo sapiens
ucucuuagcaacuca

SEQ ID NO: 699449 - RNA, 14 nt, Homo sapiens
ucagcaggcaaaga

SEQ ID NO: 699450 - RNA, 21 nt, Homo sapiens
ucagcauuuagucuugccagg

SEQ ID NO: 699451 - RNA, 21 nt, Homo sapiens
ucagccaggaccauaccgggu

SEQ ID NO: 699452 - RNA, 13 nt, Homo sapiens
ucagccugcacag

SEQ ID NO: 699453 - RNA, 17 nt, Homo sapiens
ucagguuauauccaaua

SEQ ID NO: 699454 - RNA, 19 nt, Homo sapiens
ucaguaauaaaaccgguca

SEQ ID NO: 699455 - RNA, 19 nt, Homo sapiens
ucaguauuagaugcacuua

SEQ ID NO: 699456 - RNA, 20 nt, Homo sapiens
ucagugaaaaagauguacag

SEQ ID NO: 699457 - RNA, 17 nt, Homo sapiens
ucagugaaaaauaauua

SEQ ID NO: 699458 - RNA, 22 nt, Homo sapiens
ucauacuccuuuuaagcaguga

SEQ ID NO: 699459 - RNA, 17 nt, Homo sapiens
ucauaguuacuguguaa

SEQ ID NO: 699460 - RNA, 14 nt, Homo sapiens
ucauauaccagcaa

SEQ ID NO: 699461 - RNA, 20 nt, Homo sapiens
ucauauaccagcaauauauc

SEQ ID NO: 699462 - RNA, 15 nt, Homo sapiens
ucaucaaucaaauaa

SEQ ID NO: 699463 - RNA, 20 nt, Homo sapiens
ucaucacauuucuaugccaa

SEQ ID NO: 699464 - RNA, 13 nt, Homo sapiens
ucaucccauucca

SEQ ID NO: 699465 - RNA, 19 nt, Homo sapiens
ucaucuaauucucugugga

SEQ ID NO: 699466 - RNA, 22 nt, Homo sapiens
ucaucugaaauguuacaaaaau

SEQ ID NO: 699467 - RNA, 15 nt, Homo sapiens
ucauguucuagucug

SEQ ID NO: 699468 - RNA, 18 nt, Homo sapiens
ucauguugaucauguacu

SEQ ID NO: 699469 - RNA, 17 nt, Homo sapiens
ucauuacuuguugccua

SEQ ID NO: 699470 - RNA, 20 nt, Homo sapiens
ucauucagguauuuguaaua

SEQ ID NO: 699471 - RNA, 21 nt, Homo sapiens
ucauuccaaucuauugcuuca

SEQ ID NO: 699472 - RNA, 22 nt, Homo sapiens
ucauuccaaucuauugcuucac

SEQ ID NO: 699473 - RNA, 17 nt, Homo sapiens
ucauugcugagccucug

SEQ ID NO: 699474 - RNA, 14 nt, Homo sapiens
ucauuuaagggaaa

SEQ ID NO: 699475 - RNA, 18 nt, Homo sapiens
ucauuuguaguugccuua

SEQ ID NO: 699476 - RNA, 19 nt, Homo sapiens
ucauuuguuuacauuugau

SEQ ID NO: 699477 - RNA, 10 nt, Homo sapiens
uccaaaaaga

SEQ ID NO: 699478 - RNA, 22 nt, Homo sapiens
uccaaagaggcugccccucuca

SEQ ID NO: 699479 - RNA, 17 nt, Homo sapiens
uccaaauauuguugaca

SEQ ID NO: 699480 - RNA, 20 nt, Homo sapiens
uccaagauuuaaaugccaua

SEQ ID NO: 699481 - RNA, 17 nt, Homo sapiens
uccacccacaacaucua

SEQ ID NO: 699482 - RNA, 17 nt, Homo sapiens
uccacgcuucuccggau

SEQ ID NO: 699483 - RNA, 17 nt, Homo sapiens
uccacugugcacaccca

SEQ ID NO: 699484 - RNA, 14 nt, Homo sapiens
uccaggcagccucu

SEQ ID NO: 699485 - RNA, 18 nt, Homo sapiens
uccagggucccucugugu

SEQ ID NO: 699486 - RNA, 23 nt, Homo sapiens
uccaucacccucuuccugugauc

SEQ ID NO: 699487 - RNA, 11 nt, Homo sapiens
ucccacuaaug

SEQ ID NO: 699488 - RNA, 15 nt, Homo sapiens
ucccagcuacucggg

SEQ ID NO: 699489 - RNA, 13 nt, Homo sapiens
ucccaggccaggc

SEQ ID NO: 699490 - RNA, 13 nt, Homo sapiens
ucccauccuugau

SEQ ID NO: 699491 - RNA, 23 nt, Homo sapiens
uccccagccuccccgugccaaaa

SEQ ID NO: 699492 - RNA, 19 nt, Homo sapiens
ucccccaccgguccagcug

SEQ ID NO: 699493 - RNA, 23 nt, Homo sapiens
ucccccaccgguccagcuggccu

SEQ ID NO: 699494 - RNA, 13 nt, Homo sapiens
ucccccagcacuu

SEQ ID NO: 699495 - RNA, 17 nt, Homo sapiens
ucccccagcagccuggg

SEQ ID NO: 699496 - RNA, 21 nt, Homo sapiens
ucccccucaauagaucuccag

SEQ ID NO: 699497 - RNA, 15 nt, Homo sapiens
ucccugcagaugcca

SEQ ID NO: 699498 - RNA, 16 nt, Homo sapiens
ucccugcagaugccac

SEQ ID NO: 699499 - RNA, 17 nt, Homo sapiens
ucccugcagaugccacc

SEQ ID NO: 699500 - RNA, 21 nt, Homo sapiens
ucccuguaggguccaaccaga

SEQ ID NO: 699501 - RNA, 13 nt, Homo sapiens
ucccuuucuuccc

SEQ ID NO: 699502 - RNA, 21 nt, Homo sapiens
uccggcaaugcccugugcaug

SEQ ID NO: 699503 - RNA, 18 nt, Homo sapiens
uccuaggcauuugcugaa

SEQ ID NO: 699504 - RNA, 22 nt, Homo sapiens
uccucaaauuuuuugacuuuuu

SEQ ID NO: 699505 - RNA, 15 nt, Homo sapiens
uccucagaaagugua

SEQ ID NO: 699506 - RNA, 13 nt, Homo sapiens
uccuccaacagcu

SEQ ID NO: 699507 - RNA, 14 nt, Homo sapiens
uccuccaagcuauu

SEQ ID NO: 699508 - RNA, 12 nt, Homo sapiens
uccucccaacaa

SEQ ID NO: 699509 - RNA, 14 nt, Homo sapiens
uccucccccaguuc

SEQ ID NO: 699510 - RNA, 16 nt, Homo sapiens
uccucccccaguuccu

SEQ ID NO: 699511 - RNA, 17 nt, Homo sapiens
uccucccccaguuccuc

SEQ ID NO: 699512 - RNA, 14 nt, Homo sapiens
uccucgcagccucu

SEQ ID NO: 699513 - RNA, 16 nt, Homo sapiens
uccucgguacucccau

SEQ ID NO: 699514 - RNA, 17 nt, Homo sapiens
uccucgugaaagugcau

SEQ ID NO: 699515 - RNA, 19 nt, Homo sapiens
uccucucccauccuugaug

SEQ ID NO: 699516 - RNA, 14 nt, Homo sapiens
uccucuccuacucg

SEQ ID NO: 699517 - RNA, 16 nt, Homo sapiens
uccucuggagcccuaa

SEQ ID NO: 699518 - RNA, 14 nt, Homo sapiens
uccucuugugauuu

SEQ ID NO: 699519 - RNA, 19 nt, Homo sapiens
uccugaccuugugauccac

SEQ ID NO: 699520 - RNA, 19 nt, Homo sapiens
uccugauuauaggauuuua

SEQ ID NO: 699521 - RNA, 22 nt, Homo sapiens
uccugauuucuagaacccguga

SEQ ID NO: 699522 - RNA, 18 nt, Homo sapiens
uccugcuuaaucuucaaa

SEQ ID NO: 699523 - RNA, 14 nt, Homo sapiens
uccuggaauugcca

SEQ ID NO: 699524 - RNA, 18 nt, Homo sapiens
uccuguauucuucaacca

SEQ ID NO: 699525 - RNA, 20 nt, Homo sapiens
uccugugacugucucacuua

SEQ ID NO: 699526 - RNA, 11 nt, Homo sapiens
uccugugcaau

SEQ ID NO: 699527 - RNA, 13 nt, Homo sapiens
uccugugccacua

SEQ ID NO: 699528 - RNA, 19 nt, Homo sapiens
uccuuccccagcuuugcug

SEQ ID NO: 699529 - RNA, 14 nt, Homo sapiens
uccuucgucuuugc

SEQ ID NO: 699530 - RNA, 14 nt, Homo sapiens
uccuugccugauga

SEQ ID NO: 699531 - RNA, 20 nt, Homo sapiens
uccuuuuaaaaaccuagguc

SEQ ID NO: 699532 - RNA, 16 nt, Homo sapiens
uccuuuuaacugccaa

SEQ ID NO: 699533 - RNA, 18 nt, Homo sapiens
ucgaaaccugggauucag

SEQ ID NO: 699534 - RNA, 18 nt, Homo sapiens
ucgaauuuuucagaugau

SEQ ID NO: 699535 - RNA, 14 nt, Homo sapiens
ucgcauuugucaau

SEQ ID NO: 699536 - RNA, 15 nt, Homo sapiens
ucgccacaaacucua

SEQ ID NO: 699537 - RNA, 15 nt, Homo sapiens
ucgcgccacugcacu

SEQ ID NO: 699538 - RNA, 14 nt, Homo sapiens
ucgcuucuugccuc

SEQ ID NO: 699539 - RNA, 15 nt, Homo sapiens
ucggcugaccaugcu

SEQ ID NO: 699540 - RNA, 13 nt, Homo sapiens
ucggucacuccaa

SEQ ID NO: 699541 - RNA, 12 nt, Homo sapiens
ucuaacauuucc

SEQ ID NO: 699542 - RNA, 13 nt, Homo sapiens
ucuaauugcugug

SEQ ID NO: 699543 - RNA, 15 nt, Homo sapiens
ucuaccagcauaaau

SEQ ID NO: 699544 - RNA, 14 nt, Homo sapiens
ucuacgccagggga

SEQ ID NO: 699545 - RNA, 19 nt, Homo sapiens
ucuacuaaaaauacaaaaa

SEQ ID NO: 699546 - RNA, 14 nt, Homo sapiens
ucuagacuagcaau

SEQ ID NO: 699547 - RNA, 16 nt, Homo sapiens
ucuagggaaaaaccag

SEQ ID NO: 699548 - RNA, 15 nt, Homo sapiens
ucuagucugcuuugg

SEQ ID NO: 699549 - RNA, 19 nt, Homo sapiens
ucuauacuccuucccuuaa

SEQ ID NO: 699550 - RNA, 16 nt, Homo sapiens
ucuauagcaucacuua

SEQ ID NO: 699551 - RNA, 16 nt, Homo sapiens
ucuauccucuguaaac

SEQ ID NO: 699552 - RNA, 14 nt, Homo sapiens
ucucaaagcacugu

SEQ ID NO: 699553 - RNA, 17 nt, Homo sapiens
ucucaaaguuugacagg

SEQ ID NO: 699554 - RNA, 22 nt, Homo sapiens
ucucaaauucauggugcacuga

SEQ ID NO: 699555 - RNA, 20 nt, Homo sapiens
ucucaacuggguccagaaga

SEQ ID NO: 699556 - RNA, 21 nt, Homo sapiens
ucucauaucaacuuagucaau

SEQ ID NO: 699557 - RNA, 17 nt, Homo sapiens
ucucauguauaaaacua

SEQ ID NO: 699558 - RNA, 15 nt, Homo sapiens
ucucauuuaagggaa

SEQ ID NO: 699559 - RNA, 16 nt, Homo sapiens
ucucccccuaguuugu

SEQ ID NO: 699560 - RNA, 21 nt, Homo sapiens
ucucccuuugaagaaacuaua

SEQ ID NO: 699561 - RNA, 15 nt, Homo sapiens
ucuccuuuacuaaau

SEQ ID NO: 699562 - RNA, 16 nt, Homo sapiens
gaaaguaacugugaga

SEQ ID NO: 699563 - RNA, 16 nt, Homo sapiens
gaaauuccuguacugu

SEQ ID NO: 699564 - RNA, 16 nt, Homo sapiens
gaaauucuccacugug

SEQ ID NO: 699565 - RNA, 14 nt, Homo sapiens
gaaauuuacuacag

SEQ ID NO: 699566 - RNA, 17 nt, Homo sapiens
gaacaaagacuacuaau

SEQ ID NO: 699567 - RNA, 18 nt, Homo sapiens
gaaccacuuguagauuug

SEQ ID NO: 699568 - RNA, 22 nt, Homo sapiens
gaaccauguggcagaagggaua

SEQ ID NO: 699569 - RNA, 22 nt, Homo sapiens
gaacucuucucauuacuuguug

SEQ ID NO: 699570 - RNA, 14 nt, Homo sapiens
gaacuuauuuacac

SEQ ID NO: 699571 - RNA, 14 nt, Homo sapiens
gaacuugccuuaaa

SEQ ID NO: 699572 - RNA, 24 nt, Homo sapiens
gaacuuuaagcaacaagaccacca

SEQ ID NO: 699573 - RNA, 23 nt, Homo sapiens
gaagaagauaugugaagaaaaau

SEQ ID NO: 699574 - RNA, 16 nt, Homo sapiens
gaagagauccaaagac

SEQ ID NO: 699575 - RNA, 21 nt, Homo sapiens
gaagagcgcaguguuuugcaa

SEQ ID NO: 699576 - RNA, 14 nt, Homo sapiens
gaagauacuuugua

SEQ ID NO: 699577 - RNA, 23 nt, Homo sapiens
gaagcaaaucagaaacuugugaa

SEQ ID NO: 699578 - RNA, 19 nt, Homo sapiens
gaagcacuacaccuugccu

SEQ ID NO: 699579 - RNA, 18 nt, Homo sapiens
gaagcccccagcccuaau

SEQ ID NO: 699580 - RNA, 19 nt, Homo sapiens
gaagccuucagcuccaggg

SEQ ID NO: 699581 - RNA, 19 nt, Homo sapiens
gaagcugcaggcuuugcca

SEQ ID NO: 699582 - RNA, 18 nt, Homo sapiens
gaagcuucaugcacuuaa

SEQ ID NO: 699583 - RNA, 21 nt, Homo sapiens
gaaggaagucagcaugccucu

SEQ ID NO: 699584 - RNA, 19 nt, Homo sapiens
gaaggagaaguaagaggcu

SEQ ID NO: 699585 - RNA, 17 nt, Homo sapiens
gaagucuuaaggacaaa

SEQ ID NO: 699586 - RNA, 18 nt, Homo sapiens
gaagucuuaaggacaaag

SEQ ID NO: 699587 - RNA, 18 nt, Homo sapiens
gcaaauaaagaccugaga

SEQ ID NO: 699588 - RNA, 18 nt, Homo sapiens
gcaacaagaccaccacuu

SEQ ID NO: 699589 - RNA, 22 nt, Homo sapiens
gcaacaagaccaccacuucgaa

SEQ ID NO: 699590 - RNA, 19 nt, Homo sapiens
gcaaccaagucacacgcuu

SEQ ID NO: 699591 - RNA, 18 nt, Homo sapiens
gcaacuucuucuccaucc

SEQ ID NO: 699592 - RNA, 17 nt, Homo sapiens
gcaagugagacccuguc

SEQ ID NO: 699593 - RNA, 19 nt, Homo sapiens
gcaauagacacauacaugu

SEQ ID NO: 699594 - RNA, 21 nt, Homo sapiens
gcaauauaucugaagagcuau

SEQ ID NO: 699595 - RNA, 18 nt, Homo sapiens
gcacaauuugcacuaaau

SEQ ID NO: 699596 - RNA, 17 nt, Homo sapiens
gcacaguaaaaauggaa

SEQ ID NO: 699597 - RNA, 11 nt, Homo sapiens
gcaccuggcau

SEQ ID NO: 699598 - RNA, 21 nt, Homo sapiens
gcaccuguagucccagcuacu

SEQ ID NO: 699599 - RNA, 16 nt, Homo sapiens
gcacggcccguggcug

SEQ ID NO: 699600 - RNA, 19 nt, Homo sapiens
gcacuggggccacccagcc

SEQ ID NO: 699601 - RNA, 20 nt, Homo sapiens
gcacuguuuaaucauaguua

SEQ ID NO: 699602 - RNA, 18 nt, Homo sapiens
gcacuuuucaaacaauca

SEQ ID NO: 699603 - RNA, 18 nt, Homo sapiens
gcaggacuaaaugucuag

SEQ ID NO: 699604 - RNA, 17 nt, Homo sapiens
gcaggagaauggcguga

SEQ ID NO: 699605 - RNA, 15 nt, Homo sapiens
gcaggcugggccaug

SEQ ID NO: 699606 - RNA, 22 nt, Homo sapiens
gcaggggcuggagggaggcggg

SEQ ID NO: 699607 - RNA, 12 nt, Homo sapiens
gcaggugcgauu

SEQ ID NO: 699608 - RNA, 20 nt, Homo sapiens
gcaggugcuggagcacuggg

SEQ ID NO: 699609 - RNA, 16 nt, Homo sapiens
gcaguacagccgagac

SEQ ID NO: 699610 - RNA, 22 nt, Homo sapiens
gcagucauuaugagaggcaaug

SEQ ID NO: 699611 - RNA, 17 nt, Homo sapiens
gcagucgugccuguguc

SEQ ID NO: 699612 - RNA, 13 nt, Homo sapiens
gcauaguccaaaa

SEQ ID NO: 699613 - RNA, 15 nt, Homo sapiens
gcaucucagugcagg

SEQ ID NO: 699614 - RNA, 22 nt, Homo sapiens
gcaugcagcuuugcaaacccau

SEQ ID NO: 699615 - RNA, 15 nt, Homo sapiens
gcaugcuucuucuca

SEQ ID NO: 699616 - RNA, 15 nt, Homo sapiens
gcauguuugccuaga

SEQ ID NO: 699617 - RNA, 22 nt, Homo sapiens
gcauugccauguggaaggcaag

SEQ ID NO: 699618 - RNA, 19 nt, Homo sapiens
gccaaccggucacccagga

SEQ ID NO: 699619 - RNA, 21 nt, Homo sapiens
gccaagauuuuccucuuguga

SEQ ID NO: 699620 - RNA, 23 nt, Homo sapiens
gccaaggaaacccccaguguaau

SEQ ID NO: 699621 - RNA, 19 nt, Homo sapiens
gccaagggccgacuaagag

SEQ ID NO: 699622 - RNA, 16 nt, Homo sapiens
gccaaguggggugcug

SEQ ID NO: 699623 - RNA, 17 nt, Homo sapiens
gccacaguagaacuguc

SEQ ID NO: 699624 - RNA, 20 nt, Homo sapiens
gccagacuuaaaaaaaccau

SEQ ID NO: 699625 - RNA, 21 nt, Homo sapiens
gccagcuuggggccaccaaag

SEQ ID NO: 699626 - RNA, 23 nt, Homo sapiens
gccagugcuuuaauggcauguca

SEQ ID NO: 699627 - RNA, 15 nt, Homo sapiens
gccaucgccaaguaa

SEQ ID NO: 699628 - RNA, 13 nt, Homo sapiens
gccauguccaaag

SEQ ID NO: 699629 - RNA, 22 nt, Homo sapiens
gccauuuuaaggaaaacuaccu

SEQ ID NO: 699630 - RNA, 22 nt, Homo sapiens
gcccaaucucugccauaucagu

SEQ ID NO: 699631 - RNA, 21 nt, Homo sapiens
gcccacgccuguaaucccagc

SEQ ID NO: 699632 - RNA, 22 nt, Homo sapiens
gcccaggagccucacuggggca

SEQ ID NO: 699633 - RNA, 20 nt, Homo sapiens
gcccaggcuggagugcagug

SEQ ID NO: 699634 - RNA, 16 nt, Homo sapiens
gcccauuucuccauac

SEQ ID NO: 699635 - RNA, 20 nt, Homo sapiens
gcccauuuuucuagacuguc

SEQ ID NO: 699636 - RNA, 19 nt, Homo sapiens
gccccacagucuccggccu

SEQ ID NO: 699637 - RNA, 13 nt, Homo sapiens
gccccacaugucc

SEQ ID NO: 699638 - RNA, 22 nt, Homo sapiens
gccccacauguccagcaccuug

SEQ ID NO: 699639 - RNA, 21 nt, Homo sapiens
gccccaggcucguggacugag

SEQ ID NO: 699640 - RNA, 14 nt, Homo sapiens
gccccucucaccaa

SEQ ID NO: 699641 - RNA, 16 nt, Homo sapiens
gccccuggcacucuug

SEQ ID NO: 699642 - RNA, 21 nt, Homo sapiens
gcccuaaccccuuccagauca

SEQ ID NO: 699643 - RNA, 18 nt, Homo sapiens
gcccucugaacuugccuu

SEQ ID NO: 699644 - RNA, 12 nt, Homo sapiens
gcccugaccaau

SEQ ID NO: 699645 - RNA, 21 nt, Homo sapiens
gcccugaccaaugugugaagu

SEQ ID NO: 699646 - RNA, 17 nt, Homo sapiens
gcccugcacgucauggg

SEQ ID NO: 699647 - RNA, 19 nt, Homo sapiens
gccgagccugcacuggggc

SEQ ID NO: 699648 - RNA, 23 nt, Homo sapiens
gccgcaucucacagcuaugcaaa

SEQ ID NO: 699649 - RNA, 16 nt, Homo sapiens
gccggaucugagggag

SEQ ID NO: 699650 - RNA, 16 nt, Homo sapiens
gccgggaccacccuga

SEQ ID NO: 699651 - RNA, 13 nt, Homo sapiens
gccgucugugcuu

SEQ ID NO: 699652 - RNA, 14 nt, Homo sapiens
gccuagcgaucucu

SEQ ID NO: 699653 - RNA, 15 nt, Homo sapiens
gccuauaagccaaaa

SEQ ID NO: 699654 - RNA, 22 nt, Homo sapiens
gccuccccauuucccaucugca

SEQ ID NO: 699655 - RNA, 17 nt, Homo sapiens
gccuccccgugccaaaa

SEQ ID NO: 699656 - RNA, 18 nt, Homo sapiens
gccuccccgugccaaaaa

SEQ ID NO: 699657 - RNA, 21 nt, Homo sapiens
gccucccuccccagugcaaau

SEQ ID NO: 699658 - RNA, 18 nt, Homo sapiens
gccucccuuguggcagca

SEQ ID NO: 699659 - RNA, 17 nt, Homo sapiens
gccuccugcugccacaa

SEQ ID NO: 699660 - RNA, 14 nt, Homo sapiens
gccucugugccuuc

SEQ ID NO: 699661 - RNA, 23 nt, Homo sapiens
gccucuucugagcuuacguaguu

SEQ ID NO: 699662 - RNA, 11 nt, Homo sapiens
gccugcacugg

SEQ ID NO: 699663 - RNA, 14 nt, Homo sapiens
gccugcuuugaaua

SEQ ID NO: 699664 - RNA, 15 nt, Homo sapiens
gccuggacaguaucc

SEQ ID NO: 699665 - RNA, 13 nt, Homo sapiens
gccuggacugcua

SEQ ID NO: 699666 - RNA, 20 nt, Homo sapiens
gccuggaguguaugacugca

SEQ ID NO: 699667 - RNA, 17 nt, Homo sapiens
gccuggggucugacaau

SEQ ID NO: 699668 - RNA, 23 nt, Homo sapiens
gccuggggucugacaauaccucg

SEQ ID NO: 699669 - RNA, 23 nt, Homo sapiens
gccuguggcgccgucuccagggg

SEQ ID NO: 699670 - RNA, 14 nt, Homo sapiens
gccuguuccaugaa

SEQ ID NO: 699671 - RNA, 11 nt, Homo sapiens
gcgaguguuuc

SEQ ID NO: 699672 - RNA, 21 nt, Homo sapiens
gcgcccuuaacugcauccagc

SEQ ID NO: 699673 - RNA, 14 nt, Homo sapiens
gcgcgguggcucac

SEQ ID NO: 699674 - RNA, 13 nt, Homo sapiens
gcggaucaucuaa

SEQ ID NO: 699675 - RNA, 22 nt, Homo sapiens
gcggaucaucuaauucucugug

SEQ ID NO: 699676 - RNA, 22 nt, Homo sapiens
gcgguggcucacgccuguaauc

SEQ ID NO: 699677 - RNA, 15 nt, Homo sapiens
gcgugccguggcacc

SEQ ID NO: 699678 - RNA, 17 nt, Homo sapiens
gcgugggcgcuugcacc

SEQ ID NO: 699679 - RNA, 16 nt, Homo sapiens
gcgugugccugugugc

SEQ ID NO: 699680 - RNA, 17 nt, Homo sapiens
gcucaccgcccaucagg

SEQ ID NO: 699681 - RNA, 20 nt, Homo sapiens
gcucacucuggauuccacac

SEQ ID NO: 699682 - RNA, 20 nt, Homo sapiens
gcucaggguggucucuucuu

SEQ ID NO: 699683 - RNA, 13 nt, Homo sapiens
aagaaaagccuaa

SEQ ID NO: 699684 - RNA, 17 nt, Homo sapiens
aagaaacuuauuucuca

SEQ ID NO: 699685 - RNA, 22 nt, Homo sapiens
aagaaauaauagaaaugucuca

SEQ ID NO: 699686 - RNA, 23 nt, Homo sapiens
aagaaaucuacuauaucccuuaa

SEQ ID NO: 699687 - RNA, 21 nt, Homo sapiens
aagaacugaaaggcuuuucaa

SEQ ID NO: 699688 - RNA, 17 nt, Homo sapiens
aagaauaugacuuuuua

SEQ ID NO: 699689 - RNA, 18 nt, Homo sapiens
aagaauguguuuaaacuu

SEQ ID NO: 699690 - RNA, 20 nt, Homo sapiens
aagaauuugcauacuuaccu

SEQ ID NO: 699691 - RNA, 23 nt, Homo sapiens
aagacugauuuuaauagggaaua

SEQ ID NO: 699692 - RNA, 21 nt, Homo sapiens
aagagaacucgcgcucaguaa

SEQ ID NO: 699693 - RNA, 18 nt, Homo sapiens
aagagaauuaagcccuaa

SEQ ID NO: 699694 - RNA, 14 nt, Homo sapiens
aagagacacuccaa

SEQ ID NO: 699695 - RNA, 17 nt, Homo sapiens
aagagagucgcaucuca

SEQ ID NO: 699696 - RNA, 14 nt, Homo sapiens
aagagauccaaaga

SEQ ID NO: 699697 - RNA, 22 nt, Homo sapiens
aagagcagugguaagaauagua

SEQ ID NO: 699698 - RNA, 21 nt, Homo sapiens
aagagguuuuaaaaaaauccc

SEQ ID NO: 699699 - RNA, 14 nt, Homo sapiens
aagagucauuguua

SEQ ID NO: 699700 - RNA, 13 nt, Homo sapiens
aagaugacugugu

SEQ ID NO: 699701 - RNA, 18 nt, Homo sapiens
aagauguacagaacacau

SEQ ID NO: 699702 - RNA, 16 nt, Homo sapiens
aagauuuuccucuugu

SEQ ID NO: 699703 - RNA, 17 nt, Homo sapiens
aagauuuuccucuugug

SEQ ID NO: 699704 - RNA, 22 nt, Homo sapiens
aagcacaccaaucuuacuuugu

SEQ ID NO: 699705 - RNA, 19 nt, Homo sapiens
aagcacuacaccuugccuu

SEQ ID NO: 699706 - RNA, 20 nt, Homo sapiens
aagcagucgugccugugucc

SEQ ID NO: 699707 - RNA, 14 nt, Homo sapiens
aagcauacuuugua

SEQ ID NO: 699708 - RNA, 13 nt, Homo sapiens
aagcaugaagucu

SEQ ID NO: 699709 - RNA, 17 nt, Homo sapiens
aagcaugaagucuuaag

SEQ ID NO: 699710 - RNA, 11 nt, Homo sapiens
aagccaaagaa

SEQ ID NO: 699711 - RNA, 23 nt, Homo sapiens
aagccaaagaaaaauaacccuuu

SEQ ID NO: 699712 - RNA, 22 nt, Homo sapiens
aagcccaggagccucacugggg

SEQ ID NO: 699713 - RNA, 12 nt, Homo sapiens
aagccugugaaa

SEQ ID NO: 699714 - RNA, 16 nt, Homo sapiens
aagcuauauaagacaa

SEQ ID NO: 699715 - RNA, 16 nt, Homo sapiens
aagcucacucuggauu

SEQ ID NO: 699716 - RNA, 19 nt, Homo sapiens
aauggcaucaauauacaua

SEQ ID NO: 699717 - RNA, 15 nt, Homo sapiens
aauggguuacuugau

SEQ ID NO: 699718 - RNA, 17 nt, Homo sapiens
aauggucucuaacauuu

SEQ ID NO: 699719 - RNA, 14 nt, Homo sapiens
aauguaagcauacu

SEQ ID NO: 699720 - RNA, 19 nt, Homo sapiens
aauguaggcaucaugcaug

SEQ ID NO: 699721 - RNA, 23 nt, Homo sapiens
aaugugucaggugacccugauga

SEQ ID NO: 699722 - RNA, 22 nt, Homo sapiens
aauguuaccucugaauuuacuu

SEQ ID NO: 699723 - RNA, 16 nt, Homo sapiens
aauuauacuacuuugu

SEQ ID NO: 699724 - RNA, 15 nt, Homo sapiens
aauuauaucacuuca

SEQ ID NO: 699725 - RNA, 21 nt, Homo sapiens
aauuauaucacuucacuguuc

SEQ ID NO: 699726 - RNA, 15 nt, Homo sapiens
aauuauccacaugaa

SEQ ID NO: 699727 - RNA, 16 nt, Homo sapiens
aauuccuguacugugu

SEQ ID NO: 699728 - RNA, 13 nt, Homo sapiens
aauucuagucaua

SEQ ID NO: 699729 - RNA, 13 nt, Homo sapiens
aauucucugugga

SEQ ID NO: 699730 - RNA, 21 nt, Homo sapiens
aauucuguuuuuaaugcuauu

SEQ ID NO: 699731 - RNA, 20 nt, Homo sapiens
aauuguuuagugauauuaca

SEQ ID NO: 699732 - RNA, 19 nt, Homo sapiens
aauuuaaacuuguuuacaa

SEQ ID NO: 699733 - RNA, 16 nt, Homo sapiens
aauuuaacauguguau

SEQ ID NO: 699734 - RNA, 13 nt, Homo sapiens
aauuuaauaccag

SEQ ID NO: 699735 - RNA, 20 nt, Homo sapiens
aauuuauugaguuuuuacaa

SEQ ID NO: 699736 - RNA, 11 nt, Homo sapiens
aauuucagggu

SEQ ID NO: 699737 - RNA, 20 nt, Homo sapiens
aauuuccuuuuugacacuga

SEQ ID NO: 699738 - RNA, 20 nt, Homo sapiens
aauuugggagagccauacau

SEQ ID NO: 699739 - RNA, 15 nt, Homo sapiens
aauuuucagcauuaa

SEQ ID NO: 699740 - RNA, 18 nt, Homo sapiens
aauuuuuaagcugcaaau

SEQ ID NO: 699741 - RNA, 12 nt, Homo sapiens
acaaaagucugu

SEQ ID NO: 699742 - RNA, 18 nt, Homo sapiens
acaaacauuuaagcugug

SEQ ID NO: 699743 - RNA, 16 nt, Homo sapiens
acaaaccuaccaaaau

SEQ ID NO: 699744 - RNA, 14 nt, Homo sapiens
acaaagacuacuaa

SEQ ID NO: 699745 - RNA, 13 nt, Homo sapiens
acaaauacuacag

SEQ ID NO: 699746 - RNA, 23 nt, Homo sapiens
acaacaggcauagcaaaugacau

SEQ ID NO: 699747 - RNA, 10 nt, Homo sapiens
acaacauguu

SEQ ID NO: 699748 - RNA, 14 nt, Homo sapiens
acaagauugcuuaa

SEQ ID NO: 699749 - RNA, 14 nt, Homo sapiens
acaauaaacccuca

SEQ ID NO: 699750 - RNA, 21 nt, Homo sapiens
acaauaaacgguacuugucau

SEQ ID NO: 699751 - RNA, 20 nt, Homo sapiens
acaauauauuuaguuguaaa

SEQ ID NO: 699752 - RNA, 21 nt, Homo sapiens
acaauauuccagaucuuucag

SEQ ID NO: 699753 - RNA, 19 nt, Homo sapiens
acaauccaugaacagcauu

SEQ ID NO: 699754 - RNA, 12 nt, Homo sapiens
acaaugcugauu

SEQ ID NO: 699755 - RNA, 23 nt, Homo sapiens
acaauugguaaaacucacuguga

SEQ ID NO: 699756 - RNA, 14 nt, Homo sapiens
acacacacauauac

SEQ ID NO: 699757 - RNA, 20 nt, Homo sapiens
acacacgugagcaacugugc

SEQ ID NO: 699758 - RNA, 16 nt, Homo sapiens
acacagccuagcacag

SEQ ID NO: 699759 - RNA, 17 nt, Homo sapiens
acaccaugauuaaccac

SEQ ID NO: 699760 - RNA, 22 nt, Homo sapiens
acacuaacgaaauaucaaaguc

SEQ ID NO: 699761 - RNA, 15 nt, Homo sapiens
acacuuaaugauaca

SEQ ID NO: 699762 - RNA, 23 nt, Homo sapiens
acagaaaugaggaggaugcuaaa

SEQ ID NO: 699763 - RNA, 13 nt, Homo sapiens
aggacaaagugcc

SEQ ID NO: 699764 - RNA, 19 nt, Homo sapiens
aggacaaagugccaaagaa

SEQ ID NO: 699765 - RNA, 23 nt, Homo sapiens
aggacgccacucauuucaucuca

SEQ ID NO: 699766 - RNA, 22 nt, Homo sapiens
aggagaccuggcacuggaugca

SEQ ID NO: 699767 - RNA, 23 nt, Homo sapiens
aggagacuuuacauggaugccaa

SEQ ID NO: 699768 - RNA, 11 nt, Homo sapiens
aggagcaggca

SEQ ID NO: 699769 - RNA, 21 nt, Homo sapiens
aggagccuuuuuaaaacacau

SEQ ID NO: 699770 - RNA, 22 nt, Homo sapiens
aggaggggaggaacacugcacu

SEQ ID NO: 699771 - RNA, 14 nt, Homo sapiens
aggaguuacuggau

SEQ ID NO: 699772 - RNA, 21 nt, Homo sapiens
aggaugaaagugaccauguuu

SEQ ID NO: 699773 - RNA, 14 nt, Homo sapiens
aggcaacugugagu

SEQ ID NO: 699774 - RNA, 20 nt, Homo sapiens
aggcaagccaggcucacuca

SEQ ID NO: 699775 - RNA, 13 nt, Homo sapiens
aggcaccaggaag

SEQ ID NO: 699776 - RNA, 16 nt, Homo sapiens
aggcagagacaucuuu

SEQ ID NO: 699777 - RNA, 16 nt, Homo sapiens
aggcaguagaacucca

SEQ ID NO: 699778 - RNA, 16 nt, Homo sapiens
aggcauagaggcuucu

SEQ ID NO: 699779 - RNA, 16 nt, Homo sapiens
aggcaucuaucugugc

SEQ ID NO: 699780 - RNA, 16 nt, Homo sapiens
aggcccccacuugccu

SEQ ID NO: 699781 - RNA, 17 nt, Homo sapiens
aggcccccacuugccuc

SEQ ID NO: 699782 - RNA, 23 nt, Homo sapiens
aggcgcccuuggcuucugugaug

SEQ ID NO: 699783 - RNA, 18 nt, Homo sapiens
aggcggagcuugcaguga

SEQ ID NO: 699784 - RNA, 15 nt, Homo sapiens
aggcggaucaucuaa

SEQ ID NO: 699785 - RNA, 15 nt, Homo sapiens
aggcugccccucuca

SEQ ID NO: 699786 - RNA, 19 nt, Homo sapiens
aggcugccccucucaccaa

SEQ ID NO: 699787 - RNA, 15 nt, Homo sapiens
aggcuggacugcaau

SEQ ID NO: 699788 - RNA, 15 nt, Homo sapiens
aggcuggccagucca

SEQ ID NO: 699789 - RNA, 16 nt, Homo sapiens
aggcugggccaugucc

SEQ ID NO: 699790 - RNA, 17 nt, Homo sapiens
aggcugggccaugucca

SEQ ID NO: 699791 - RNA, 18 nt, Homo sapiens
aggcugggccauguccaa

SEQ ID NO: 699792 - RNA, 21 nt, Homo sapiens
aggcugggccauguccaaaga

SEQ ID NO: 699793 - RNA, 23 nt, Homo sapiens
aggcugggccauguccaaagagg

SEQ ID NO: 699794 - RNA, 13 nt, Homo sapiens
aggcugugcugcc

SEQ ID NO: 699795 - RNA, 19 nt, Homo sapiens
aggcuuguuuaccuuucuc

SEQ ID NO: 699796 - RNA, 16 nt, Homo sapiens
aggcuuucuguugcca

SEQ ID NO: 699797 - RNA, 15 nt, Homo sapiens
agggaaccugugucc

SEQ ID NO: 699798 - RNA, 19 nt, Homo sapiens
agggaaguugaacgagcau

SEQ ID NO: 699799 - RNA, 20 nt, Homo sapiens
agggaggcgggggcugcccu

SEQ ID NO: 699800 - RNA, 16 nt, Homo sapiens
agggaggucacuggaa

SEQ ID NO: 699801 - RNA, 19 nt, Homo sapiens
agggauuugaggugagggu

SEQ ID NO: 699802 - RNA, 19 nt, Homo sapiens
agggcuccugcacuuacuu

SEQ ID NO: 699803 - RNA, 22 nt, Homo sapiens
aggggugaaaggggggaaccag

SEQ ID NO: 699804 - RNA, 14 nt, Homo sapiens
agguaaugugaaua

SEQ ID NO: 699805 - RNA, 20 nt, Homo sapiens
agguaccagcugcgcuugcu

SEQ ID NO: 699806 - RNA, 16 nt, Homo sapiens
aggugacccugaugaa

SEQ ID NO: 699807 - RNA, 15 nt, Homo sapiens
agguggugaggcaau

SEQ ID NO: 699808 - RNA, 18 nt, Homo sapiens
agguugagcucuucuuaa

SEQ ID NO: 699809 - RNA, 13 nt, Homo sapiens
aguaaaaagggaa

SEQ ID NO: 699810 - RNA, 23 nt, Homo sapiens
aguaaaggcugcugcuacaaugu

SEQ ID NO: 699811 - RNA, 15 nt, Homo sapiens
aguaagauaucucaa

SEQ ID NO: 699812 - RNA, 13 nt, Homo sapiens
aguagaacugucu

SEQ ID NO: 699813 - RNA, 15 nt, Homo sapiens
aguagauccauuucc

SEQ ID NO: 699814 - RNA, 14 nt, Homo sapiens
aguaucauacuuac

SEQ ID NO: 699815 - RNA, 23 nt, Homo sapiens
aguauucuaauaagcuaguugaa

SEQ ID NO: 699816 - RNA, 21 nt, Homo sapiens
agucaucacauuucuaugcca

SEQ ID NO: 699817 - RNA, 19 nt, Homo sapiens
agucauuaugagaggcaau

SEQ ID NO: 699818 - RNA, 17 nt, Homo sapiens
aguccaaaauacuguuc

SEQ ID NO: 699819 - RNA, 20 nt, Homo sapiens
agucucuucuaagcaaaauu

SEQ ID NO: 699820 - RNA, 19 nt, Homo sapiens
agucugucugucugaugau

SEQ ID NO: 699821 - RNA, 22 nt, Homo sapiens
agucuguugugugucaugccag

SEQ ID NO: 699822 - RNA, 17 nt, Homo sapiens
agugaauuugcacuguu

SEQ ID NO: 699823 - RNA, 20 nt, Homo sapiens
agugacaguugcagcccuug

SEQ ID NO: 699824 - RNA, 18 nt, Homo sapiens
agugagacuccgucacaa

SEQ ID NO: 699825 - RNA, 19 nt, Homo sapiens
agugaucaaacuacauauu

SEQ ID NO: 699826 - RNA, 20 nt, Homo sapiens
agugcaaccucgcugagggc

SEQ ID NO: 699827 - RNA, 18 nt, Homo sapiens
agugcaggagagacagug

SEQ ID NO: 699828 - RNA, 16 nt, Homo sapiens
agugcauuugugcuag

SEQ ID NO: 699829 - RNA, 12 nt, Homo sapiens
aguggggugcug

SEQ ID NO: 699830 - RNA, 21 nt, Homo sapiens
aguggguuugccccaucacuu

SEQ ID NO: 699831 - RNA, 13 nt, Homo sapiens
agugguugaauau

SEQ ID NO: 699832 - RNA, 17 nt, Homo sapiens
aguguaugacugcacau

SEQ ID NO: 699833 - RNA, 14 nt, Homo sapiens
agugugaauacugc

SEQ ID NO: 699834 - RNA, 17 nt, Homo sapiens
aguguggccaggcugcc

SEQ ID NO: 699835 - RNA, 16 nt, Homo sapiens
aguguguaugccaaga

SEQ ID NO: 699836 - RNA, 18 nt, Homo sapiens
aguguucauugaugcugc

SEQ ID NO: 699837 - RNA, 16 nt, Homo sapiens
aguguuuuugugaauu

SEQ ID NO: 699838 - RNA, 19 nt, Homo sapiens
aguuaaacauugaaguaau

SEQ ID NO: 699839 - RNA, 20 nt, Homo sapiens
aguuauuacauguaauuuga

SEQ ID NO: 699840 - RNA, 21 nt, Homo sapiens
aguuccucauuagcauuuugc

SEQ ID NO: 699841 - RNA, 20 nt, Homo sapiens
aguugaagggaauacugugc

SEQ ID NO: 699842 - RNA, 20 nt, Homo sapiens
aguugcagauguuagauauu

SEQ ID NO: 699843 - RNA, 22 nt, Homo sapiens
aguuggugcuuuugagaaccaa

SEQ ID NO: 699844 - RNA, 17 nt, Homo sapiens
aguuucccguccaucuc

SEQ ID NO: 699845 - RNA, 19 nt, Homo sapiens
aguuuccgugcguggcacu

SEQ ID NO: 699846 - RNA, 13 nt, Homo sapiens
aguuuguagcuca

SEQ ID NO: 699847 - RNA, 15 nt, Homo sapiens
aguuuugaccuaaca

SEQ ID NO: 699848 - RNA, 16 nt, Homo sapiens
aguuuuggacuggaua

SEQ ID NO: 699849 - RNA, 22 nt, Homo sapiens
aguuuuucaauuaguaacauuc

SEQ ID NO: 699850 - RNA, 12 nt, Homo sapiens
auaaaacauagc

SEQ ID NO: 699851 - RNA, 23 nt, Homo sapiens
auaaaagagaagaugaggcauga

SEQ ID NO: 699852 - RNA, 17 nt, Homo sapiens
auaaaauccugugcaau

SEQ ID NO: 699853 - RNA, 21 nt, Homo sapiens
auaaacuuuagaguagaguuu

SEQ ID NO: 699854 - RNA, 14 nt, Homo sapiens
auaaauauauuuau

SEQ ID NO: 699855 - RNA, 23 nt, Homo sapiens
auaaauaugguuaauuucaugua

SEQ ID NO: 699856 - RNA, 12 nt, Homo sapiens
auaaauccauca

SEQ ID NO: 699857 - RNA, 17 nt, Homo sapiens
auaaauccaucacuaua

SEQ ID NO: 699858 - RNA, 19 nt, Homo sapiens
auaaauguuuuauuucuag

SEQ ID NO: 699859 - RNA, 16 nt, Homo sapiens
auaacauccagagcuu

SEQ ID NO: 699860 - RNA, 23 nt, Homo sapiens
auaaccagcugaaguugcagaug

SEQ ID NO: 699861 - RNA, 16 nt, Homo sapiens
auaacuuuacagaaau

SEQ ID NO: 699862 - RNA, 14 nt, Homo sapiens
auaagaauuugcau

SEQ ID NO: 699863 - RNA, 16 nt, Homo sapiens
auaauacaguaucuca

SEQ ID NO: 699864 - RNA, 14 nt, Homo sapiens
auaauauaagccau

SEQ ID NO: 699865 - RNA, 13 nt, Homo sapiens
auaaugagcaugu

SEQ ID NO: 699866 - RNA, 14 nt, Homo sapiens
auaaugagcauguu

SEQ ID NO: 699867 - RNA, 15 nt, Homo sapiens
auaauuaguuccuca

SEQ ID NO: 699868 - RNA, 23 nt, Homo sapiens
auaauuccuauauccugugacug

SEQ ID NO: 699869 - RNA, 20 nt, Homo sapiens
auaauuucuagaaacaaaca

SEQ ID NO: 699870 - RNA, 17 nt, Homo sapiens
auacaaaccuaccaaaa

SEQ ID NO: 699871 - RNA, 15 nt, Homo sapiens
auacaaaugcaucuu

SEQ ID NO: 699872 - RNA, 16 nt, Homo sapiens
auacacgaauagacau

SEQ ID NO: 699873 - RNA, 13 nt, Homo sapiens
auacacuuaauga

SEQ ID NO: 699874 - RNA, 16 nt, Homo sapiens
auacaguaucucaggg

SEQ ID NO: 699875 - RNA, 13 nt, Homo sapiens
auacauacaugua

SEQ ID NO: 699876 - RNA, 19 nt, Homo sapiens
auacaugcuuugaaguuuc

SEQ ID NO: 699877 - RNA, 16 nt, Homo sapiens
auacuauccaguuacu

SEQ ID NO: 699878 - RNA, 18 nt, Homo sapiens
auacugaaggaaaaacac

SEQ ID NO: 699879 - RNA, 13 nt, Homo sapiens
auacuguuuauuu

SEQ ID NO: 699880 - RNA, 15 nt, Homo sapiens
auagaaccacuauga

SEQ ID NO: 699881 - RNA, 16 nt, Homo sapiens
caaggaaagaaauaca

SEQ ID NO: 699882 - RNA, 15 nt, Homo sapiens
caaggcaacugugag

SEQ ID NO: 699883 - RNA, 13 nt, Homo sapiens
caaggcaguuaau

SEQ ID NO: 699884 - RNA, 17 nt, Homo sapiens
caaggccugguguuucu

SEQ ID NO: 699885 - RNA, 19 nt, Homo sapiens
caaguugagcuaugacuua

SEQ ID NO: 699886 - RNA, 16 nt, Homo sapiens
caaguugcaucagaaa

SEQ ID NO: 699887 - RNA, 18 nt, Homo sapiens
caaguugcuuuuaccuga

SEQ ID NO: 699888 - RNA, 14 nt, Homo sapiens
caauaaacccucag

SEQ ID NO: 699889 - RNA, 15 nt, Homo sapiens
caauaaacccucaga

SEQ ID NO: 699890 - RNA, 14 nt, Homo sapiens
caauaaagugcuuu

SEQ ID NO: 699891 - RNA, 18 nt, Homo sapiens
caauaugggcucaaguca

SEQ ID NO: 699892 - RNA, 16 nt, Homo sapiens
caauauuaacauaaga

SEQ ID NO: 699893 - RNA, 18 nt, Homo sapiens
caauauuuuuauaucaug

SEQ ID NO: 699894 - RNA, 19 nt, Homo sapiens
caaugaucaccgacugaaa

SEQ ID NO: 699895 - RNA, 20 nt, Homo sapiens
caaugcccugugcaugccau

SEQ ID NO: 699896 - RNA, 16 nt, Homo sapiens
caaugcuccaucccaa

SEQ ID NO: 699897 - RNA, 11 nt, Homo sapiens
caaugggaccu

SEQ ID NO: 699898 - RNA, 17 nt, Homo sapiens
caauuuaacauguguau

SEQ ID NO: 699899 - RNA, 17 nt, Homo sapiens
caauuuuagauaucaug

SEQ ID NO: 699900 - RNA, 16 nt, Homo sapiens
cacaccacaaauggga

SEQ ID NO: 699901 - RNA, 23 nt, Homo sapiens
cacagaaugcaaccaagucacac

SEQ ID NO: 699902 - RNA, 15 nt, Homo sapiens
cacagcagcaguuac

SEQ ID NO: 699903 - RNA, 15 nt, Homo sapiens
cacagccuagcacag

SEQ ID NO: 699904 - RNA, 17 nt, Homo sapiens
cacagcuaugcaaaaag

SEQ ID NO: 699905 - RNA, 14 nt, Homo sapiens
cacaguagaacugu

SEQ ID NO: 699906 - RNA, 21 nt, Homo sapiens
cacaguagaacugucugugaa

SEQ ID NO: 699907 - RNA, 18 nt, Homo sapiens
cacauauggaauuuugca

SEQ ID NO: 699908 - RNA, 20 nt, Homo sapiens
cacauggcggagaguuuuaa

SEQ ID NO: 699909 - RNA, 19 nt, Homo sapiens
caccaaucuuacuuuguaa

SEQ ID NO: 699910 - RNA, 18 nt, Homo sapiens
caccaucaccagacaggu

SEQ ID NO: 699911 - RNA, 15 nt, Homo sapiens
caccaugaaacuuua

SEQ ID NO: 699912 - RNA, 13 nt, Homo sapiens
caccauucguaca

SEQ ID NO: 699913 - RNA, 14 nt, Homo sapiens
cacccacaacaucu

SEQ ID NO: 699914 - RNA, 14 nt, Homo sapiens
cacccacccaggag

SEQ ID NO: 699915 - RNA, 14 nt, Homo sapiens
caccccaacacuuc

SEQ ID NO: 699916 - RNA, 13 nt, Homo sapiens
caccccaacaucu

SEQ ID NO: 699917 - RNA, 12 nt, Homo sapiens
caccccaagaga

SEQ ID NO: 699918 - RNA, 14 nt, Homo sapiens
cacccccgugucca

SEQ ID NO: 699919 - RNA, 13 nt, Homo sapiens
caccccugcaguu

SEQ ID NO: 699920 - RNA, 21 nt, Homo sapiens
cacccuuguccuugagugcuc

SEQ ID NO: 699921 - RNA, 18 nt, Homo sapiens
caccuaauaggcugggag

SEQ ID NO: 699922 - RNA, 13 nt, Homo sapiens
caccucugcacaa

SEQ ID NO: 699923 - RNA, 19 nt, Homo sapiens
caccucugcacaagcugca

SEQ ID NO: 699924 - RNA, 19 nt, Homo sapiens
cacgacugcccggcagggu

SEQ ID NO: 699925 - RNA, 18 nt, Homo sapiens
cacuacaccuugccuugc

SEQ ID NO: 699926 - RNA, 17 nt, Homo sapiens
cacucauuucaucucau

SEQ ID NO: 699927 - RNA, 23 nt, Homo sapiens
cacuccgagaggugggccagucu

SEQ ID NO: 699928 - RNA, 13 nt, Homo sapiens
cacugcacuccag

SEQ ID NO: 699929 - RNA, 18 nt, Homo sapiens
cacuggggcagacaauaa

SEQ ID NO: 699930 - RNA, 21 nt, Homo sapiens
cacuguuuaaucauaguuacu

SEQ ID NO: 699931 - RNA, 19 nt, Homo sapiens
cacuguuuagauuugccau

SEQ ID NO: 699932 - RNA, 13 nt, Homo sapiens
cacuuaaaacacg

SEQ ID NO: 699933 - RNA, 16 nt, Homo sapiens
cacuuaaugauacaug

SEQ ID NO: 699934 - RNA, 22 nt, Homo sapiens
cacuuuguugcaagaugugaau

SEQ ID NO: 699935 - RNA, 20 nt, Homo sapiens
cagaaacuugugaaguggaa

SEQ ID NO: 699936 - RNA, 14 nt, Homo sapiens
cagaaagcuuugaa

SEQ ID NO: 699937 - RNA, 22 nt, Homo sapiens
cagaaaugaggaggaugcuaaa

SEQ ID NO: 699938 - RNA, 23 nt, Homo sapiens
cagaacacauuucucugaucucc

SEQ ID NO: 699939 - RNA, 22 nt, Homo sapiens
cagaacagugguggcaacauuc

SEQ ID NO: 699940 - RNA, 16 nt, Homo sapiens
cagaaccaccccggcc

SEQ ID NO: 699941 - RNA, 12 nt, Homo sapiens
cagaacuacuuc

SEQ ID NO: 699942 - RNA, 14 nt, Homo sapiens
cagaacuacuucuu

SEQ ID NO: 699943 - RNA, 21 nt, Homo sapiens
cagaaggauauuuacuacuuu

SEQ ID NO: 699944 - RNA, 22 nt, Homo sapiens
cagaaggugccacuuuacccac

SEQ ID NO: 699945 - RNA, 15 nt, Homo sapiens
cagaagugcccuucc

SEQ ID NO: 699946 - RNA, 15 nt, Homo sapiens
cagaaucccuuaaca

SEQ ID NO: 699947 - RNA, 15 nt, Homo sapiens
cagaauugagaguga

SEQ ID NO: 699948 - RNA, 18 nt, Homo sapiens
cagacaauaaacccucag

SEQ ID NO: 699949 - RNA, 18 nt, Homo sapiens
cagagaugaacaucuaac

SEQ ID NO: 699950 - RNA, 23 nt, Homo sapiens
cagagaugcaccaccaagccaag

SEQ ID NO: 699951 - RNA, 20 nt, Homo sapiens
cagaggccgcgcguccagcu

SEQ ID NO: 699952 - RNA, 12 nt, Homo sapiens
cagauaccucca

SEQ ID NO: 699953 - RNA, 19 nt, Homo sapiens
cagauguuuacagacugug

SEQ ID NO: 699954 - RNA, 13 nt, Homo sapiens
cagauucuuucag

SEQ ID NO: 699955 - RNA, 15 nt, Homo sapiens
cagauuuuugcaaua

SEQ ID NO: 699956 - RNA, 14 nt, Homo sapiens
cagcaaaagagcua

SEQ ID NO: 699957 - RNA, 19 nt, Homo sapiens
cagcaacuucuucuccauc

SEQ ID NO: 699958 - RNA, 20 nt, Homo sapiens
cagcaacuucuucuccaucc

SEQ ID NO: 699959 - RNA, 17 nt, Homo sapiens
cagcagcaaauuuucag

SEQ ID NO: 699960 - RNA, 15 nt, Homo sapiens
cagcaucaccugccu

SEQ ID NO: 699961 - RNA, 15 nt, Homo sapiens
cagcccuugugaugu

SEQ ID NO: 699962 - RNA, 16 nt, Homo sapiens
cagccuccccgugcca

SEQ ID NO: 699963 - RNA, 18 nt, Homo sapiens
cagccugggcaaugugau

SEQ ID NO: 699964 - RNA, 21 nt, Homo sapiens
cagcugcucccuggcauucaa

SEQ ID NO: 699965 - RNA, 21 nt, Homo sapiens
caggaaacuccacaucugccu

SEQ ID NO: 699966 - RNA, 20 nt, Homo sapiens
caggaacagcaaaugcaaaa

SEQ ID NO: 699967 - RNA, 20 nt, Homo sapiens
caggacuugagaagaccuca

SEQ ID NO: 699968 - RNA, 17 nt, Homo sapiens
caggagccucacugggg

SEQ ID NO: 699969 - RNA, 18 nt, Homo sapiens
caggagccucacuggggc

SEQ ID NO: 699970 - RNA, 15 nt, Homo sapiens
caggaggauggcaaa

SEQ ID NO: 699971 - RNA, 19 nt, Homo sapiens
caggcgcugcccaccugcc

SEQ ID NO: 699972 - RNA, 16 nt, Homo sapiens
caggcuccaggccuca

SEQ ID NO: 699973 - RNA, 18 nt, Homo sapiens
caggcugaaaacaaugga

SEQ ID NO: 699974 - RNA, 14 nt, Homo sapiens
caggcugggccaug

SEQ ID NO: 699975 - RNA, 20 nt, Homo sapiens
caggcugggccauguccaaa

SEQ ID NO: 699976 - RNA, 20 nt, Homo sapiens
cagggcagccucccccggcu

SEQ ID NO: 699977 - RNA, 19 nt, Homo sapiens
cagggccauggcucagggu

SEQ ID NO: 699978 - RNA, 16 nt, Homo sapiens
cagggcuccugcacuu

SEQ ID NO: 699979 - RNA, 23 nt, Homo sapiens
cagggguggggguggaggcuucc

SEQ ID NO: 699980 - RNA, 17 nt, Homo sapiens
caggguuugauagcacu

SEQ ID NO: 699981 - RNA, 22 nt, Homo sapiens
caggugagcaauuagauuagua

SEQ ID NO: 699982 - RNA, 15 nt, Homo sapiens
cagguuggugggggc

SEQ ID NO: 699983 - RNA, 20 nt, Homo sapiens
caguaaacgggaacaugccc

SEQ ID NO: 699984 - RNA, 18 nt, Homo sapiens
caguagaacugucuguga

SEQ ID NO: 699985 - RNA, 14 nt, Homo sapiens
caguagcauuugcu

SEQ ID NO: 699986 - RNA, 19 nt, Homo sapiens
cagucucuucuaagcaaaa

SEQ ID NO: 699987 - RNA, 17 nt, Homo sapiens
cagugagucauaucuua

SEQ ID NO: 699988 - RNA, 17 nt, Homo sapiens
cagugaugcugugcuau

SEQ ID NO: 699989 - RNA, 16 nt, Homo sapiens
cagugcacuguauaua

SEQ ID NO: 699990 - RNA, 22 nt, Homo sapiens
caguguaauaauaaaucguccu

SEQ ID NO: 699991 - RNA, 19 nt, Homo sapiens
caguguuacuguguuuauc

SEQ ID NO: 699992 - RNA, 18 nt, Homo sapiens
caguuaaaauguguuucu

SEQ ID NO: 699993 - RNA, 16 nt, Homo sapiens
caguucaccuugaaga

SEQ ID NO: 699994 - RNA, 18 nt, Homo sapiens
cauaaaaaggucuuuaaa

SEQ ID NO: 699995 - RNA, 22 nt, Homo sapiens
cauaagcucaguaacugugcau

SEQ ID NO: 699996 - RNA, 17 nt, Homo sapiens
cauaauacaugauugca

SEQ ID NO: 699997 - RNA, 18 nt, Homo sapiens
cauacaugucacauuuag

SEQ ID NO: 699998 - RNA, 20 nt, Homo sapiens
cauaccguuuauaaugccau

SEQ ID NO: 699999 - RNA, 22 nt, Homo sapiens
cuaaaugugaaugaugauccua

SEQ ID NO: 700000 - RNA, 17 nt, Homo sapiens
cuaaugagacugaccau

SEQ ID NO: 700001 - RNA, 14 nt, Homo sapiens
cuaauuguguacau

SEQ ID NO: 700002 - RNA, 14 nt, Homo sapiens
cuacacucuugacu

SEQ ID NO: 700003 - RNA, 17 nt, Homo sapiens
cuacccuuuucugggga

SEQ ID NO: 700004 - RNA, 19 nt, Homo sapiens
cuaccuuuuaccuagccac

SEQ ID NO: 700005 - RNA, 19 nt, Homo sapiens
cuacucaggcugguggaga

SEQ ID NO: 700006 - RNA, 16 nt, Homo sapiens
cuacucucaugcugca

SEQ ID NO: 700007 - RNA, 19 nt, Homo sapiens
cuagaaacaaacaucuaau

SEQ ID NO: 700008 - RNA, 14 nt, Homo sapiens
cuagaacccgugac

SEQ ID NO: 700009 - RNA, 12 nt, Homo sapiens
cuagaagccaag

SEQ ID NO: 700010 - RNA, 13 nt, Homo sapiens
cuagacagcuuuu

SEQ ID NO: 700011 - RNA, 17 nt, Homo sapiens
cuagacagcuuuucuca

SEQ ID NO: 700012 - RNA, 15 nt, Homo sapiens
cuagaggcccuuugc

SEQ ID NO: 700013 - RNA, 13 nt, Homo sapiens
cuagccaauucac

SEQ ID NO: 700014 - RNA, 19 nt, Homo sapiens
cuaggaaacucacacuccc

SEQ ID NO: 700015 - RNA, 20 nt, Homo sapiens
cuaggaaggugaaucugccc

SEQ ID NO: 700016 - RNA, 21 nt, Homo sapiens
cuagggagacgccaugugaug

SEQ ID NO: 700017 - RNA, 17 nt, Homo sapiens
cuaguauaucagugaca

SEQ ID NO: 700018 - RNA, 16 nt, Homo sapiens
cuagucugcuuuggua

SEQ ID NO: 700019 - RNA, 22 nt, Homo sapiens
cuauacacuuaaugauacaugu

SEQ ID NO: 700020 - RNA, 18 nt, Homo sapiens
cuauagcugcuauagcaa

SEQ ID NO: 700021 - RNA, 14 nt, Homo sapiens
cuauauaagacaag

SEQ ID NO: 700022 - RNA, 21 nt, Homo sapiens
cuaucuuugauauuggcuuaa

SEQ ID NO: 700023 - RNA, 16 nt, Homo sapiens
cuaugagcacauagga

SEQ ID NO: 700024 - RNA, 22 nt, Homo sapiens
cuaugcgggggugccuaaggag

SEQ ID NO: 700025 - RNA, 15 nt, Homo sapiens
cuaugugauuacaag

SEQ ID NO: 700026 - RNA, 19 nt, Homo sapiens
cuauuauggaaaacugugu

SEQ ID NO: 700027 - RNA, 18 nt, Homo sapiens
cuauucaauucuuuuaac

SEQ ID NO: 700028 - RNA, 20 nt, Homo sapiens
cuauuuaaaaaaaaagucag

SEQ ID NO: 700029 - RNA, 21 nt, Homo sapiens
cuauuuaaaaaaaaagucaga

SEQ ID NO: 700030 - RNA, 15 nt, Homo sapiens
cuauuugaacaagug

SEQ ID NO: 700031 - RNA, 19 nt, Homo sapiens
cucaaacguacaagucagu

SEQ ID NO: 700032 - RNA, 13 nt, Homo sapiens
cucaaagcacugu

SEQ ID NO: 700033 - RNA, 20 nt, Homo sapiens
cucaccagccccacugccag

SEQ ID NO: 700034 - RNA, 17 nt, Homo sapiens
cucacuggggcagacaa

SEQ ID NO: 700035 - RNA, 21 nt, Homo sapiens
cucacuggggcagacaauaaa

SEQ ID NO: 700036 - RNA, 23 nt, Homo sapiens
cucacuggggccuacagcuuuga

SEQ ID NO: 700037 - RNA, 14 nt, Homo sapiens
cucagcaucaaaau

SEQ ID NO: 700038 - RNA, 17 nt, Homo sapiens
cucagcccccugcuuca

SEQ ID NO: 700039 - RNA, 18 nt, Homo sapiens
cucagccuguuccaugaa

SEQ ID NO: 700040 - RNA, 16 nt, Homo sapiens
cucagcucggggagcc

SEQ ID NO: 700041 - RNA, 18 nt, Homo sapiens
cucagcuuugagaagccu

SEQ ID NO: 700042 - RNA, 20 nt, Homo sapiens
cucaggacccccuguccuga

SEQ ID NO: 700043 - RNA, 18 nt, Homo sapiens
cucaggaguuugagacca

SEQ ID NO: 700044 - RNA, 22 nt, Homo sapiens
cucaggcaaagaaaaugaaaug

SEQ ID NO: 700045 - RNA, 17 nt, Homo sapiens
cucagggcagccucccc

SEQ ID NO: 700046 - RNA, 21 nt, Homo sapiens
cucaguaaacgggaacaugcc

SEQ ID NO: 700047 - RNA, 16 nt, Homo sapiens
cucauaaaguagauua

SEQ ID NO: 700048 - RNA, 22 nt, Homo sapiens
cucaucuuagguuggcaaaaag

SEQ ID NO: 700049 - RNA, 21 nt, Homo sapiens
cucaugcugcagaggguacuu

SEQ ID NO: 700050 - RNA, 20 nt, Homo sapiens
cucauguauaaaacuaggaa

SEQ ID NO: 700051 - RNA, 16 nt, Homo sapiens
cucauuaauacucuuu

SEQ ID NO: 700052 - RNA, 16 nt, Homo sapiens
cuccaaaccugaaguu

SEQ ID NO: 700053 - RNA, 13 nt, Homo sapiens
cuccacugugcac

SEQ ID NO: 700054 - RNA, 21 nt, Homo sapiens
cuccagccugggggacagaaa

SEQ ID NO: 700055 - RNA, 12 nt, Homo sapiens
cuccaggcuuuc

SEQ ID NO: 700056 - RNA, 12 nt, Homo sapiens
cuccagugcagg

SEQ ID NO: 700057 - RNA, 18 nt, Homo sapiens
cuccaucccaaccaggca

SEQ ID NO: 700058 - RNA, 15 nt, Homo sapiens
cuccauuuaccagua

SEQ ID NO: 700059 - RNA, 20 nt, Homo sapiens
cuccauuuaccaguaacuua

SEQ ID NO: 700060 - RNA, 14 nt, Homo sapiens
cuccauuugcucuu

SEQ ID NO: 700061 - RNA, 18 nt, Homo sapiens
cucccacuucacugcgaa

SEQ ID NO: 700062 - RNA, 16 nt, Homo sapiens
cucccaggaagcccag

SEQ ID NO: 700063 - RNA, 12 nt, Homo sapiens
cuccccauggag

SEQ ID NO: 700064 - RNA, 20 nt, Homo sapiens
cuccccuagggggagaagaa

SEQ ID NO: 700065 - RNA, 16 nt, Homo sapiens
cucccuccccagugca

SEQ ID NO: 700066 - RNA, 20 nt, Homo sapiens
cuccugaaccgcacagcuca

SEQ ID NO: 700067 - RNA, 17 nt, Homo sapiens
cucgcagccucucagug

SEQ ID NO: 700068 - RNA, 14 nt, Homo sapiens
cucuaaugccucug

SEQ ID NO: 700069 - RNA, 15 nt, Homo sapiens
cucuacuuaauccaa

SEQ ID NO: 700070 - RNA, 14 nt, Homo sapiens
cucuagaagccaag

SEQ ID NO: 700071 - RNA, 21 nt, Homo sapiens
cucucccaaaaaacuacuucu

SEQ ID NO: 700072 - RNA, 13 nt, Homo sapiens
cucugaaaaccaa

SEQ ID NO: 700073 - RNA, 19 nt, Homo sapiens
cucugccugagacuuucag

SEQ ID NO: 700074 - RNA, 22 nt, Homo sapiens
cucuggcaucucuuucugcaaa

SEQ ID NO: 700075 - RNA, 15 nt, Homo sapiens
cucuuagauucuuaa

SEQ ID NO: 700076 - RNA, 14 nt, Homo sapiens
cucuucaucccauu

SEQ ID NO: 700077 - RNA, 17 nt, Homo sapiens
cucuucaucccauucca

SEQ ID NO: 700078 - RNA, 19 nt, Homo sapiens
cucuugaaaauagaacaac

SEQ ID NO: 700079 - RNA, 22 nt, Homo sapiens
cucuugaguuguuuuuguauau

SEQ ID NO: 700080 - RNA, 19 nt, Homo sapiens
cucuugggagggaguuacu

SEQ ID NO: 700081 - RNA, 18 nt, Homo sapiens
cucuuugauuauuugcau

SEQ ID NO: 700082 - RNA, 12 nt, Homo sapiens
cucuuuggugua

SEQ ID NO: 700083 - RNA, 11 nt, Homo sapiens
cugaaaaccaa

SEQ ID NO: 700084 - RNA, 20 nt, Homo sapiens
cugaaaagaugguaucauau

SEQ ID NO: 700085 - RNA, 13 nt, Homo sapiens
cugaaaugccugc

SEQ ID NO: 700086 - RNA, 17 nt, Homo sapiens
cugaaccgcacagcuca

SEQ ID NO: 700087 - RNA, 22 nt, Homo sapiens
cugaacuugccuuaaacacuca

SEQ ID NO: 700088 - RNA, 18 nt, Homo sapiens
cugaagucuuacuacaga

SEQ ID NO: 700089 - RNA, 20 nt, Homo sapiens
cugaagucuuacuacagaaa

SEQ ID NO: 700090 - RNA, 16 nt, Homo sapiens
cugaaucagcaugaaa

SEQ ID NO: 700091 - RNA, 19 nt, Homo sapiens
cugaauuuacuuccuugca

SEQ ID NO: 700092 - RNA, 21 nt, Homo sapiens
cugacauuucuucuagugaug

SEQ ID NO: 700093 - RNA, 15 nt, Homo sapiens
cugaccuugugaucc

SEQ ID NO: 700094 - RNA, 20 nt, Homo sapiens
cugacuaggugucaccauac

SEQ ID NO: 700095 - RNA, 14 nt, Homo sapiens
cugagacugugcug

SEQ ID NO: 700096 - RNA, 22 nt, Homo sapiens
cugaggucaucggcguggccca

SEQ ID NO: 700097 - RNA, 17 nt, Homo sapiens
cugaucugcggaucuca

SEQ ID NO: 700098 - RNA, 24 nt, Homo sapiens
cugaucugcggaucucagcuuuga

SEQ ID NO: 700099 - RNA, 22 nt, Homo sapiens
cugaugaaaacauagcaucuca

SEQ ID NO: 700100 - RNA, 12 nt, Homo sapiens
cugaugacaaua

SEQ ID NO: 700101 - RNA, 15 nt, Homo sapiens
cugaugggaaaacug

SEQ ID NO: 700102 - RNA, 21 nt, Homo sapiens
cugcaaucugagccagugcuu

SEQ ID NO: 700103 - RNA, 19 nt, Homo sapiens
cugcaccccugcaguuuga

SEQ ID NO: 700104 - RNA, 15 nt, Homo sapiens
cugcacuggggccac

SEQ ID NO: 700105 - RNA, 17 nt, Homo sapiens
cugcaggcuuugccauu

SEQ ID NO: 700106 - RNA, 16 nt, Homo sapiens
cugcaguccuacucaa

SEQ ID NO: 700107 - RNA, 23 nt, Homo sapiens
cugccaaggaaacccccagugua

SEQ ID NO: 700108 - RNA, 12 nt, Homo sapiens
cugccagccuug

SEQ ID NO: 700109 - RNA, 15 nt, Homo sapiens
cugccaugccagcuu

SEQ ID NO: 700110 - RNA, 17 nt, Homo sapiens
cugcccagacaagauuu

SEQ ID NO: 700111 - RNA, 15 nt, Homo sapiens
cugccccucucacca

SEQ ID NO: 700112 - RNA, 19 nt, Homo sapiens
cugccgcccccuccugaac

SEQ ID NO: 700113 - RNA, 15 nt, Homo sapiens
cugccgucugugcuu

SEQ ID NO: 700114 - RNA, 20 nt, Homo sapiens
cugccugugugggacugaga

SEQ ID NO: 700115 - RNA, 19 nt, Homo sapiens
cugccuuugcaccacggga

SEQ ID NO: 700116 - RNA, 21 nt, Homo sapiens
cugcguccuccucaccucaug

SEQ ID NO: 700117 - RNA, 19 nt, Homo sapiens
gcaucugaaauaggaaaca

SEQ ID NO: 700118 - RNA, 22 nt, Homo sapiens
gcaugaucuuucugcaggaaau

SEQ ID NO: 700119 - RNA, 20 nt, Homo sapiens
gcauuccagccccucugguc

SEQ ID NO: 700120 - RNA, 18 nt, Homo sapiens
gcauuuagucuugccagg

SEQ ID NO: 700121 - RNA, 21 nt, Homo sapiens
gcauuugucaaugacaguuuc

SEQ ID NO: 700122 - RNA, 14 nt, Homo sapiens
gccaaagacuguaa

SEQ ID NO: 700123 - RNA, 17 nt, Homo sapiens
gccaaccggucacccag

SEQ ID NO: 700124 - RNA, 18 nt, Homo sapiens
gccaaccggucacccagg

SEQ ID NO: 700125 - RNA, 14 nt, Homo sapiens
gccaagaagcagug

SEQ ID NO: 700126 - RNA, 20 nt, Homo sapiens
gccaaggaaacccccagugu

SEQ ID NO: 700127 - RNA, 21 nt, Homo sapiens
gccaaggaaacccccagugua

SEQ ID NO: 700128 - RNA, 18 nt, Homo sapiens
gccaauaauaaaugcccu

SEQ ID NO: 700129 - RNA, 16 nt, Homo sapiens
gccaauucacaaguua

SEQ ID NO: 700130 - RNA, 20 nt, Homo sapiens
gccacaauccacgcuucucc

SEQ ID NO: 700131 - RNA, 17 nt, Homo sapiens
gccaccaaagcugccca

SEQ ID NO: 700132 - RNA, 22 nt, Homo sapiens
gccacgugggcaaacaggcagu

SEQ ID NO: 700133 - RNA, 13 nt, Homo sapiens
gccacugcacucc

SEQ ID NO: 700134 - RNA, 21 nt, Homo sapiens
gccagaggaauccuggcagcc

SEQ ID NO: 700135 - RNA, 15 nt, Homo sapiens
gccagcugacaucuu

SEQ ID NO: 700136 - RNA, 16 nt, Homo sapiens
gccauguccaaagagg

SEQ ID NO: 700137 - RNA, 13 nt, Homo sapiens
gcccagacaagau

SEQ ID NO: 700138 - RNA, 14 nt, Homo sapiens
gcccagacaagauu

SEQ ID NO: 700139 - RNA, 20 nt, Homo sapiens
gcccaggagccucacugggg

SEQ ID NO: 700140 - RNA, 19 nt, Homo sapiens
gcccaggcuggagugcagu

SEQ ID NO: 700141 - RNA, 19 nt, Homo sapiens
gcccagugcaugguggcca

SEQ ID NO: 700142 - RNA, 14 nt, Homo sapiens
gcccauccagucuc

SEQ ID NO: 700143 - RNA, 20 nt, Homo sapiens
gccccuaggaaggugaaucu

SEQ ID NO: 700144 - RNA, 17 nt, Homo sapiens
gcccuaaccccuuccag

SEQ ID NO: 700145 - RNA, 13 nt, Homo sapiens
gcccuaaucucac

SEQ ID NO: 700146 - RNA, 20 nt, Homo sapiens
gcccucugaacuugccuuaa

SEQ ID NO: 700147 - RNA, 23 nt, Homo sapiens
gccgaauugucuuuggugcuuuu

SEQ ID NO: 700148 - RNA, 21 nt, Homo sapiens
gccgagauugcaccacugcac

SEQ ID NO: 700149 - RNA, 21 nt, Homo sapiens
gccggcccgccucuccucggu

SEQ ID NO: 700150 - RNA, 20 nt, Homo sapiens
gccgugauuuucauugcugg

SEQ ID NO: 700151 - RNA, 19 nt, Homo sapiens
gccuaacaugauuauuuga

SEQ ID NO: 700152 - RNA, 19 nt, Homo sapiens
gccuaaguccaguguuucu

SEQ ID NO: 700153 - RNA, 14 nt, Homo sapiens
gccuaucugaccaa

SEQ ID NO: 700154 - RNA, 21 nt, Homo sapiens
gccuccacagcgagggcagcu

SEQ ID NO: 700155 - RNA, 19 nt, Homo sapiens
gccucugucaggccuucag

SEQ ID NO: 700156 - RNA, 20 nt, Homo sapiens
gccugagaggcaggcauaga

SEQ ID NO: 700157 - RNA, 14 nt, Homo sapiens
gccugccucuucuc

SEQ ID NO: 700158 - RNA, 14 nt, Homo sapiens
gccugcucccugua

SEQ ID NO: 700159 - RNA, 18 nt, Homo sapiens
gccugggggcagccucuc

SEQ ID NO: 700160 - RNA, 21 nt, Homo sapiens
gccugggguguuaguggcacc

SEQ ID NO: 700161 - RNA, 16 nt, Homo sapiens
gccuugagcccuggcu

SEQ ID NO: 700162 - RNA, 20 nt, Homo sapiens
gccuugauucccuuguuauu

SEQ ID NO: 700163 - RNA, 14 nt, Homo sapiens
gcgaccauguggcc

SEQ ID NO: 700164 - RNA, 21 nt, Homo sapiens
gcgcccuuggcuucugugaug

SEQ ID NO: 700165 - RNA, 16 nt, Homo sapiens
gcggugccaugaaggg

SEQ ID NO: 700166 - RNA, 12 nt, Homo sapiens
gcgguggcucac

SEQ ID NO: 700167 - RNA, 15 nt, Homo sapiens
gcuaauagugaucaa

SEQ ID NO: 700168 - RNA, 13 nt, Homo sapiens
gcuacaaaaccua

SEQ ID NO: 700169 - RNA, 21 nt, Homo sapiens
gcuauguauaaaauacauagu

SEQ ID NO: 700170 - RNA, 16 nt, Homo sapiens
gcuauugccaaccagu

SEQ ID NO: 700171 - RNA, 23 nt, Homo sapiens
gcucaguaaacgggaacaugccc

SEQ ID NO: 700172 - RNA, 22 nt, Homo sapiens
gcuccaucccaaccaggcaccu

SEQ ID NO: 700173 - RNA, 14 nt, Homo sapiens
gcuccccugaggaa

SEQ ID NO: 700174 - RNA, 22 nt, Homo sapiens
gcucggagcggcgucccuucca

SEQ ID NO: 700175 - RNA, 23 nt, Homo sapiens
gcucuccggggccauuugcaaua

SEQ ID NO: 700176 - RNA, 18 nt, Homo sapiens
gcucugcaguccuacuca

SEQ ID NO: 700177 - RNA, 16 nt, Homo sapiens
gcucuguggaugccag

SEQ ID NO: 700178 - RNA, 18 nt, Homo sapiens
gcucuucaucccauucca

SEQ ID NO: 700179 - RNA, 22 nt, Homo sapiens
gcugacaaggcacuucauguaa

SEQ ID NO: 700180 - RNA, 16 nt, Homo sapiens
gcugagacugugcugu

SEQ ID NO: 700181 - RNA, 14 nt, Homo sapiens
gcugagaucgugcu

SEQ ID NO: 700182 - RNA, 23 nt, Homo sapiens
gcugagggugagugggugaauaa

SEQ ID NO: 700183 - RNA, 14 nt, Homo sapiens
gcugcaugcccucu

SEQ ID NO: 700184 - RNA, 13 nt, Homo sapiens
gcugcccacuguu

SEQ ID NO: 700185 - RNA, 17 nt, Homo sapiens
gcugccuuggcucagac

SEQ ID NO: 700186 - RNA, 18 nt, Homo sapiens
gcuggacuucuaccugcc

SEQ ID NO: 700187 - RNA, 21 nt, Homo sapiens
gcuggagcaaaagucauuaca

SEQ ID NO: 700188 - RNA, 13 nt, Homo sapiens
gcuggcaaccacu

SEQ ID NO: 700189 - RNA, 16 nt, Homo sapiens
gcuggccucucuagca

SEQ ID NO: 700190 - RNA, 13 nt, Homo sapiens
gcugggccauguc

SEQ ID NO: 700191 - RNA, 18 nt, Homo sapiens
gcugggccauguccaaag

SEQ ID NO: 700192 - RNA, 15 nt, Homo sapiens
gcuguguuggugugg

SEQ ID NO: 700193 - RNA, 19 nt, Homo sapiens
gcuguguugguguggccca

SEQ ID NO: 700194 - RNA, 17 nt, Homo sapiens
gcuuaaugcuacaugug

SEQ ID NO: 700195 - RNA, 15 nt, Homo sapiens
gcuuagagaggacaa

SEQ ID NO: 700196 - RNA, 18 nt, Homo sapiens
gcuuauaucuggccucug

SEQ ID NO: 700197 - RNA, 18 nt, Homo sapiens
gcuuaucuuagaagcacu

SEQ ID NO: 700198 - RNA, 17 nt, Homo sapiens
gcuucauuccaaucuau

SEQ ID NO: 700199 - RNA, 19 nt, Homo sapiens
gcuuccuugccugaugaca

SEQ ID NO: 700200 - RNA, 22 nt, Homo sapiens
gcuucucacugccaugccagcu

SEQ ID NO: 700201 - RNA, 11 nt, Homo sapiens
gcuucugccau

SEQ ID NO: 700202 - RNA, 20 nt, Homo sapiens
gcuucuugccucugugcugu

SEQ ID NO: 700203 - RNA, 15 nt, Homo sapiens
gcuugaagccaaaga

SEQ ID NO: 700204 - RNA, 18 nt, Homo sapiens
gcuugaauaaacaccacu

SEQ ID NO: 700205 - RNA, 16 nt, Homo sapiens
gcuugcaccacuuccg

SEQ ID NO: 700206 - RNA, 23 nt, Homo sapiens
gcuugccugcagggccauggcuc

SEQ ID NO: 700207 - RNA, 10 nt, Homo sapiens
gcuugcucuu

SEQ ID NO: 700208 - RNA, 19 nt, Homo sapiens
gcuuggggccaccaaagcu

SEQ ID NO: 700209 - RNA, 16 nt, Homo sapiens
gcuuuauuuuuuugaa

SEQ ID NO: 700210 - RNA, 21 nt, Homo sapiens
gcuuuccaaaccuuaucucca

SEQ ID NO: 700211 - RNA, 22 nt, Homo sapiens
gcuuucugccaucuagccagcc

SEQ ID NO: 700212 - RNA, 14 nt, Homo sapiens
gcuuugguacuaau

SEQ ID NO: 700213 - RNA, 16 nt, Homo sapiens
gcuuuuaacuuuauaa

SEQ ID NO: 700214 - RNA, 18 nt, Homo sapiens
gcuuuugagaaccaagua

SEQ ID NO: 700215 - RNA, 22 nt, Homo sapiens
ggaaaacuguguugccacagua

SEQ ID NO: 700216 - RNA, 14 nt, Homo sapiens
ggaaacccccagug

SEQ ID NO: 700217 - RNA, 18 nt, Homo sapiens
ggaacacugcacucuuaa

SEQ ID NO: 700218 - RNA, 13 nt, Homo sapiens
ggaacauacuguu

SEQ ID NO: 700219 - RNA, 19 nt, Homo sapiens
ggaacucuggaguucauca

SEQ ID NO: 700220 - RNA, 14 nt, Homo sapiens
ggaagagauccaaa

SEQ ID NO: 700221 - RNA, 19 nt, Homo sapiens
ggaagcccaggagccucac

SEQ ID NO: 700222 - RNA, 16 nt, Homo sapiens
ggaauuacgugcucug

SEQ ID NO: 700223 - RNA, 13 nt, Homo sapiens
ggacaaagugcca

SEQ ID NO: 700224 - RNA, 17 nt, Homo sapiens
ggacaaagugccaaaga

SEQ ID NO: 700225 - RNA, 18 nt, Homo sapiens
ggacaaagugccaaagaa

SEQ ID NO: 700226 - RNA, 23 nt, Homo sapiens
ggacagaaagagacuccgucuca

SEQ ID NO: 700227 - RNA, 14 nt, Homo sapiens
ggacagauugccug

SEQ ID NO: 700228 - RNA, 11 nt, Homo sapiens
ggacugagaug

SEQ ID NO: 700229 - RNA, 21 nt, Homo sapiens
ggacuuccccggagggcugcg

SEQ ID NO: 700230 - RNA, 15 nt, Homo sapiens
ggagaccuggcacug

SEQ ID NO: 700231 - RNA, 17 nt, Homo sapiens
ggagaccuggcacugga

SEQ ID NO: 700232 - RNA, 16 nt, Homo sapiens
ggagacuuuacaugga

SEQ ID NO: 700233 - RNA, 21 nt, Homo sapiens
ggagcugccuuggcucagaca

SEQ ID NO: 700234 - RNA, 22 nt, Homo sapiens
ggagcuugcagugagccgagau

SEQ ID NO: 700235 - RNA, 13 nt, Homo sapiens
uaacucccaguga

SEQ ID NO: 700236 - RNA, 20 nt, Homo sapiens
uaacuuauuuuaaauaugcc

SEQ ID NO: 700237 - RNA, 20 nt, Homo sapiens
uaagaaaagccuaaucacag

SEQ ID NO: 700238 - RNA, 19 nt, Homo sapiens
uaagaauucaaacuggggc

SEQ ID NO: 700239 - RNA, 18 nt, Homo sapiens
uaagacuaaaaguugcau

SEQ ID NO: 700240 - RNA, 15 nt, Homo sapiens
uaagagacacuccaa

SEQ ID NO: 700241 - RNA, 21 nt, Homo sapiens
uaagauaucccuaaggaauuu

SEQ ID NO: 700242 - RNA, 15 nt, Homo sapiens
uaagaugacuguguu

SEQ ID NO: 700243 - RNA, 13 nt, Homo sapiens
uaagaugugaaaa

SEQ ID NO: 700244 - RNA, 18 nt, Homo sapiens
uaagauuuuuuguaggca

SEQ ID NO: 700245 - RNA, 16 nt, Homo sapiens
uaagcuuuccuguuga

SEQ ID NO: 700246 - RNA, 15 nt, Homo sapiens
uaaggaauuaccaag

SEQ ID NO: 700247 - RNA, 16 nt, Homo sapiens
uaaggacaaagugcca

SEQ ID NO: 700248 - RNA, 20 nt, Homo sapiens
uaaggacaaagugccaaaga

SEQ ID NO: 700249 - RNA, 16 nt, Homo sapiens
uaaguccaguguuucu

SEQ ID NO: 700250 - RNA, 12 nt, Homo sapiens
uaagucuuucau

SEQ ID NO: 700251 - RNA, 16 nt, Homo sapiens
uaaguuaucuuugaau

SEQ ID NO: 700252 - RNA, 18 nt, Homo sapiens
uaauagauguuacucaaa

SEQ ID NO: 700253 - RNA, 14 nt, Homo sapiens
uaauauaagccaua

SEQ ID NO: 700254 - RNA, 20 nt, Homo sapiens
uaauaucugaggaugaccag

SEQ ID NO: 700255 - RNA, 21 nt, Homo sapiens
uaaucauguuaccauuacaaa

SEQ ID NO: 700256 - RNA, 13 nt, Homo sapiens
uaaucccagcacu

SEQ ID NO: 700257 - RNA, 14 nt, Homo sapiens
uaaucccagcacuu

SEQ ID NO: 700258 - RNA, 20 nt, Homo sapiens
uaaucucuaggaagucaaua

SEQ ID NO: 700259 - RNA, 18 nt, Homo sapiens
uaaucuggaauaugcaac

SEQ ID NO: 700260 - RNA, 22 nt, Homo sapiens
uaaucuguuuauuuacaaggga

SEQ ID NO: 700261 - RNA, 23 nt, Homo sapiens
uaaucuguuuauuuacaagggaa

SEQ ID NO: 700262 - RNA, 17 nt, Homo sapiens
uaaugaauacauuucca

SEQ ID NO: 700263 - RNA, 18 nt, Homo sapiens
uaaugaauuuuuaugaua

SEQ ID NO: 700264 - RNA, 21 nt, Homo sapiens
uaaugauacauguuuccaauu

SEQ ID NO: 700265 - RNA, 16 nt, Homo sapiens
uaauguuauuuccacu

SEQ ID NO: 700266 - RNA, 14 nt, Homo sapiens
uaauuaguuccuca

SEQ ID NO: 700267 - RNA, 20 nt, Homo sapiens
uaauuguuuaaaaaccgaau

SEQ ID NO: 700268 - RNA, 13 nt, Homo sapiens
uaauuuauuucca

SEQ ID NO: 700269 - RNA, 17 nt, Homo sapiens
uaauuuccuuuuugaca

SEQ ID NO: 700270 - RNA, 13 nt, Homo sapiens
uacaaacauuuaa

SEQ ID NO: 700271 - RNA, 20 nt, Homo sapiens
uacaaggcuuuaucucaggg

SEQ ID NO: 700272 - RNA, 17 nt, Homo sapiens
uacaaugaucaccgacu

SEQ ID NO: 700273 - RNA, 18 nt, Homo sapiens
uacaauuggcacuaaaga

SEQ ID NO: 700274 - RNA, 15 nt, Homo sapiens
uacacacgugagcaa

SEQ ID NO: 700275 - RNA, 17 nt, Homo sapiens
uacacagaaacacugcc

SEQ ID NO: 700276 - RNA, 14 nt, Homo sapiens
uacacauugcauuu

SEQ ID NO: 700277 - RNA, 16 nt, Homo sapiens
uacacugccugccuua

SEQ ID NO: 700278 - RNA, 16 nt, Homo sapiens
uacacuuugaaguauu

SEQ ID NO: 700279 - RNA, 16 nt, Homo sapiens
uacagaacuacuucuu

SEQ ID NO: 700280 - RNA, 15 nt, Homo sapiens
uacaggaaagcaaua

SEQ ID NO: 700281 - RNA, 22 nt, Homo sapiens
uacagugaugcugugcuaugaa

SEQ ID NO: 700282 - RNA, 17 nt, Homo sapiens
uacagugcagagccuuc

SEQ ID NO: 700283 - RNA, 13 nt, Homo sapiens
uacauagugaaaa

SEQ ID NO: 700284 - RNA, 14 nt, Homo sapiens
uacaugcauauaau

SEQ ID NO: 700285 - RNA, 16 nt, Homo sapiens
uacauguaauuugaug

SEQ ID NO: 700286 - RNA, 14 nt, Homo sapiens
uacaugucacauuu

SEQ ID NO: 700287 - RNA, 18 nt, Homo sapiens
uacaugugagugacgaug

SEQ ID NO: 700288 - RNA, 21 nt, Homo sapiens
uacauguuuauaaaucuuaug

SEQ ID NO: 700289 - RNA, 19 nt, Homo sapiens
uacauuuaauagacuuaca

SEQ ID NO: 700290 - RNA, 22 nt, Homo sapiens
uacauuugaugcaugucuuuua

SEQ ID NO: 700291 - RNA, 18 nt, Homo sapiens
uaccauuuaguaagaaua

SEQ ID NO: 700292 - RNA, 15 nt, Homo sapiens
uacccaccaccuucu

SEQ ID NO: 700293 - RNA, 19 nt, Homo sapiens
uacccaccuagaacacuaa

SEQ ID NO: 700294 - RNA, 19 nt, Homo sapiens
uaccuuaagagacacucca

SEQ ID NO: 700295 - RNA, 14 nt, Homo sapiens
uaccuuuucagggc

SEQ ID NO: 700296 - RNA, 18 nt, Homo sapiens
uacuaaaguuuuacagaa

SEQ ID NO: 700297 - RNA, 14 nt, Homo sapiens
uacuaccguuauac

SEQ ID NO: 700298 - RNA, 17 nt, Homo sapiens
uacuagauugugauccc

SEQ ID NO: 700299 - RNA, 16 nt, Homo sapiens
uacuagcaggaauauu

SEQ ID NO: 700300 - RNA, 18 nt, Homo sapiens
uacuccuuuuaagcagug

SEQ ID NO: 700301 - RNA, 15 nt, Homo sapiens
uacucucaugcugca

SEQ ID NO: 700302 - RNA, 15 nt, Homo sapiens
uacucuuacaagagu

SEQ ID NO: 700303 - RNA, 18 nt, Homo sapiens
uacugaaggaaaaacaca

SEQ ID NO: 700304 - RNA, 14 nt, Homo sapiens
uacugaagucuuac

SEQ ID NO: 700305 - RNA, 20 nt, Homo sapiens
uacuuauuguauuuaugugu

SEQ ID NO: 700306 - RNA, 17 nt, Homo sapiens
uacuuuaaaaugccaau

SEQ ID NO: 700307 - RNA, 19 nt, Homo sapiens
uacuuuauacagcaaagga

SEQ ID NO: 700308 - RNA, 12 nt, Homo sapiens
uagaaaaaccac

SEQ ID NO: 700309 - RNA, 13 nt, Homo sapiens
uagaaaaugugac

SEQ ID NO: 700310 - RNA, 17 nt, Homo sapiens
uagaacugucugugaac

SEQ ID NO: 700311 - RNA, 14 nt, Homo sapiens
uagaagccaaggga

SEQ ID NO: 700312 - RNA, 20 nt, Homo sapiens
uagaagccaagggaaagggg

SEQ ID NO: 700313 - RNA, 16 nt, Homo sapiens
uagaauaagaauuugc

SEQ ID NO: 700314 - RNA, 17 nt, Homo sapiens
uagaauuauaucacuuc

SEQ ID NO: 700315 - RNA, 17 nt, Homo sapiens
uagacacauacauguca

SEQ ID NO: 700316 - RNA, 21 nt, Homo sapiens
uagacucggggugcuuccuug

SEQ ID NO: 700317 - RNA, 19 nt, Homo sapiens
uagacuuaucugcauauug

SEQ ID NO: 700318 - RNA, 21 nt, Homo sapiens
uagauaauuucagggugcagc

SEQ ID NO: 700319 - RNA, 21 nt, Homo sapiens
uagauguugccauguguuuua

SEQ ID NO: 700320 - RNA, 21 nt, Homo sapiens
uagauucuuaauucaugagga

SEQ ID NO: 700321 - RNA, 16 nt, Homo sapiens
uagauuugccauagag

SEQ ID NO: 700322 - RNA, 13 nt, Homo sapiens
uagcaaaugacau

SEQ ID NO: 700323 - RNA, 20 nt, Homo sapiens
uagcaaccuucugcauucau

SEQ ID NO: 700324 - RNA, 22 nt, Homo sapiens
uagcauacuggcuucaccauca

SEQ ID NO: 700325 - RNA, 13 nt, Homo sapiens
uagcaucucagga

SEQ ID NO: 700326 - RNA, 21 nt, Homo sapiens
uagccagauuugucuuuuugu

SEQ ID NO: 700327 - RNA, 13 nt, Homo sapiens
uaggagauuuauu

SEQ ID NO: 700328 - RNA, 19 nt, Homo sapiens
uaggcaccuuuuacuguga

SEQ ID NO: 700329 - RNA, 14 nt, Homo sapiens
uaggcuagcuauuu

SEQ ID NO: 700330 - RNA, 14 nt, Homo sapiens
uagggaaaaaccag

SEQ ID NO: 700331 - RNA, 23 nt, Homo sapiens
uaggguccaaccagaccuggaag

SEQ ID NO: 700332 - RNA, 21 nt, Homo sapiens
uaguaauguuuuauacuguuu

SEQ ID NO: 700333 - RNA, 15 nt, Homo sapiens
uagucugcuuuggua

SEQ ID NO: 700334 - RNA, 17 nt, Homo sapiens
uagugucucauguggaa

SEQ ID NO: 700335 - RNA, 20 nt, Homo sapiens
uaguuagaauuauaucacuu

SEQ ID NO: 700336 - RNA, 19 nt, Homo sapiens
uaguugaauggggucucaa

SEQ ID NO: 700337 - RNA, 22 nt, Homo sapiens
uaguuuguaugccaagugagaa

SEQ ID NO: 700338 - RNA, 12 nt, Homo sapiens
uauaaagcagua

SEQ ID NO: 700339 - RNA, 13 nt, Homo sapiens
uauaaaggauaaa

SEQ ID NO: 700340 - RNA, 19 nt, Homo sapiens
uauaaauagaugcugugua

SEQ ID NO: 700341 - RNA, 12 nt, Homo sapiens
uauaacauauau

SEQ ID NO: 700342 - RNA, 16 nt, Homo sapiens
uauaacuguauuugaa

SEQ ID NO: 700343 - RNA, 12 nt, Homo sapiens
uauaagccaaaa

SEQ ID NO: 700344 - RNA, 22 nt, Homo sapiens
uauacaucuuccccuaaugccu

SEQ ID NO: 700345 - RNA, 22 nt, Homo sapiens
uauacugaaggaaaaacacaag

SEQ ID NO: 700346 - RNA, 20 nt, Homo sapiens
uauaggaaacauaauuuuga

SEQ ID NO: 700347 - RNA, 19 nt, Homo sapiens
uauauaauuuauuuccacu

SEQ ID NO: 700348 - RNA, 12 nt, Homo sapiens
uauauacauaua

SEQ ID NO: 700349 - RNA, 13 nt, Homo sapiens
uauauauuacaag

SEQ ID NO: 700350 - RNA, 14 nt, Homo sapiens
uauauccugugacu

SEQ ID NO: 700351 - RNA, 14 nt, Homo sapiens
uauaucuaugcaaa

SEQ ID NO: 700352 - RNA, 18 nt, Homo sapiens
uauauuguauaggggcaa

SEQ ID NO: 700353 - RNA, 18 nt, Homo sapiens
uauauuuguaaagcuauu

SEQ ID NO: 700354 - RNA, 23 nt, Homo sapiens
uggcaaguugcaucagaaagcuu

SEQ ID NO: 700355 - RNA, 18 nt, Homo sapiens
uggcaucucuuucugcaa

SEQ ID NO: 700356 - RNA, 22 nt, Homo sapiens
uggccaagaagcaguggccuua

SEQ ID NO: 700357 - RNA, 13 nt, Homo sapiens
uggcccacgcacu

SEQ ID NO: 700358 - RNA, 22 nt, Homo sapiens
uggcccuauuuaaggcagauuu

SEQ ID NO: 700359 - RNA, 22 nt, Homo sapiens
uggccuauccgcugccagccuu

SEQ ID NO: 700360 - RNA, 22 nt, Homo sapiens
uggccuccccugccaccaggcc

SEQ ID NO: 700361 - RNA, 21 nt, Homo sapiens
uggccucugugccuucuuuug

SEQ ID NO: 700362 - RNA, 12 nt, Homo sapiens
uggccuuugaau

SEQ ID NO: 700363 - RNA, 15 nt, Homo sapiens
uggcgcaucauaugc

SEQ ID NO: 700364 - RNA, 16 nt, Homo sapiens
uggcgcaucauaugca

SEQ ID NO: 700365 - RNA, 21 nt, Homo sapiens
uggcuccggccucugccuuug

SEQ ID NO: 700366 - RNA, 19 nt, Homo sapiens
uggcuguugacgcaccugu

SEQ ID NO: 700367 - RNA, 21 nt, Homo sapiens
uggcuuguucaucauccagau

SEQ ID NO: 700368 - RNA, 22 nt, Homo sapiens
uggcuuugccuuggcuuugcca

SEQ ID NO: 700369 - RNA, 23 nt, Homo sapiens
ugggaauacaggggugaaagggg

SEQ ID NO: 700370 - RNA, 18 nt, Homo sapiens
ugggaggagggagaggga

SEQ ID NO: 700371 - RNA, 16 nt, Homo sapiens
ugggaggccaaggugg

SEQ ID NO: 700372 - RNA, 18 nt, Homo sapiens
ugggaguucuaacaaaac

SEQ ID NO: 700373 - RNA, 20 nt, Homo sapiens
ugggaugaaacuaaagcaau

SEQ ID NO: 700374 - RNA, 15 nt, Homo sapiens
ugggauggauuucca

SEQ ID NO: 700375 - RNA, 16 nt, Homo sapiens
ugggcaugccauuaca

SEQ ID NO: 700376 - RNA, 18 nt, Homo sapiens
ugggcauuuucccagaug

SEQ ID NO: 700377 - RNA, 15 nt, Homo sapiens
ugggccauguccaaa

SEQ ID NO: 700378 - RNA, 21 nt, Homo sapiens
ugggcccacccggugggaccc

SEQ ID NO: 700379 - RNA, 22 nt, Homo sapiens
ugggcccacccggugggacccc

SEQ ID NO: 700380 - RNA, 19 nt, Homo sapiens
ugggcuauuuggacucagg

SEQ ID NO: 700381 - RNA, 16 nt, Homo sapiens
uggggaggagggggcc

SEQ ID NO: 700382 - RNA, 16 nt, Homo sapiens
uggggauaugauuuaa

SEQ ID NO: 700383 - RNA, 22 nt, Homo sapiens
uggggcagacaauaaacccuca

SEQ ID NO: 700384 - RNA, 12 nt, Homo sapiens
uggggccaccaa

SEQ ID NO: 700385 - RNA, 22 nt, Homo sapiens
uggggccaccaaagcugcccac

SEQ ID NO: 700386 - RNA, 22 nt, Homo sapiens
ugggggaucacagccucugaaa

SEQ ID NO: 700387 - RNA, 19 nt, Homo sapiens
uggggggacccagugcaga

SEQ ID NO: 700388 - RNA, 20 nt, Homo sapiens
ugggggguuuucuugccuug

SEQ ID NO: 700389 - RNA, 21 nt, Homo sapiens
uggggucuuugugguagcuua

SEQ ID NO: 700390 - RNA, 11 nt, Homo sapiens
ugggguugagg

SEQ ID NO: 700391 - RNA, 17 nt, Homo sapiens
uggguuguguguuuauu

SEQ ID NO: 700392 - RNA, 16 nt, Homo sapiens
ugguaguuaugugaag

SEQ ID NO: 700393 - RNA, 22 nt, Homo sapiens
uggucacaacuugauggcugcg

SEQ ID NO: 700394 - RNA, 15 nt, Homo sapiens
uggucggugggaccc

SEQ ID NO: 700395 - RNA, 20 nt, Homo sapiens
uggugaaaccccgucucuac

SEQ ID NO: 700396 - RNA, 14 nt, Homo sapiens
uggugaggcaauaa

SEQ ID NO: 700397 - RNA, 19 nt, Homo sapiens
ugguggcccacgccuguaa

SEQ ID NO: 700398 - RNA, 18 nt, Homo sapiens
ugguucguucuguacugu

SEQ ID NO: 700399 - RNA, 17 nt, Homo sapiens
ugguuugacucaucuua

SEQ ID NO: 700400 - RNA, 22 nt, Homo sapiens
ugguuuuuaaaaaacugcugac

SEQ ID NO: 700401 - RNA, 19 nt, Homo sapiens
uguaaaaaaaccaccaaaa

SEQ ID NO: 700402 - RNA, 17 nt, Homo sapiens
uguaaacaaaaugaagc

SEQ ID NO: 700403 - RNA, 20 nt, Homo sapiens
uguaaacuuuuugugcugaa

SEQ ID NO: 700404 - RNA, 17 nt, Homo sapiens
uguaaauguaaacucag

SEQ ID NO: 700405 - RNA, 13 nt, Homo sapiens
uguaauaagcaau

SEQ ID NO: 700406 - RNA, 16 nt, Homo sapiens
uguaauagugacauau

SEQ ID NO: 700407 - RNA, 21 nt, Homo sapiens
uguaaucgcccuacuauucag

SEQ ID NO: 700408 - RNA, 21 nt, Homo sapiens
uguaaugaaaaugaauaucua

SEQ ID NO: 700409 - RNA, 16 nt, Homo sapiens
uguaaugacagugcua

SEQ ID NO: 700410 - RNA, 19 nt, Homo sapiens
uguacguggccauguauga

SEQ ID NO: 700411 - RNA, 18 nt, Homo sapiens
uguacugugucucaugga

SEQ ID NO: 700412 - RNA, 18 nt, Homo sapiens
uguagaaaagaacuggaa

SEQ ID NO: 700413 - RNA, 17 nt, Homo sapiens
uguagacuuaacacuuc

SEQ ID NO: 700414 - RNA, 10 nt, Homo sapiens
uguagagugg

SEQ ID NO: 700415 - RNA, 18 nt, Homo sapiens
uguaguuuuacuuuccua

SEQ ID NO: 700416 - RNA, 15 nt, Homo sapiens
uguauacauacaugu

SEQ ID NO: 700417 - RNA, 16 nt, Homo sapiens
uguauauuacauacau

SEQ ID NO: 700418 - RNA, 18 nt, Homo sapiens
uguauuaaagacagaggc

SEQ ID NO: 700419 - RNA, 22 nt, Homo sapiens
ugucacgaauauggacauauca

SEQ ID NO: 700420 - RNA, 12 nt, Homo sapiens
uguccaaagagg

SEQ ID NO: 700421 - RNA, 14 nt, Homo sapiens
uguccuguccugcu

SEQ ID NO: 700422 - RNA, 18 nt, Homo sapiens
ugucguauaggcauguaa

SEQ ID NO: 700423 - RNA, 21 nt, Homo sapiens
ugucuccuccccuucccccac

SEQ ID NO: 700424 - RNA, 20 nt, Homo sapiens
ugucuucagcacccucauaa

SEQ ID NO: 700425 - RNA, 22 nt, Homo sapiens
ugucuuuaaaaguauccagaga

SEQ ID NO: 700426 - RNA, 21 nt, Homo sapiens
ugugaaaauuacaguccaaaa

SEQ ID NO: 700427 - RNA, 16 nt, Homo sapiens
ugugagaaacaucuca

SEQ ID NO: 700428 - RNA, 17 nt, Homo sapiens
ugugccaaagugcauag

SEQ ID NO: 700429 - RNA, 14 nt, Homo sapiens
ugugcuuccuccug

SEQ ID NO: 700430 - RNA, 19 nt, Homo sapiens
uguggaaggcaagccaggc

SEQ ID NO: 700431 - RNA, 19 nt, Homo sapiens
uguggacuguggcacuugc

SEQ ID NO: 700432 - RNA, 18 nt, Homo sapiens
uguggaugauaaaacaca

SEQ ID NO: 700433 - RNA, 23 nt, Homo sapiens
uguggauggugucuccuuuacua

SEQ ID NO: 700434 - RNA, 22 nt, Homo sapiens
uguggcauaaauugcaucacug

SEQ ID NO: 700435 - RNA, 13 nt, Homo sapiens
uguguaaacucau

SEQ ID NO: 700436 - RNA, 15 nt, Homo sapiens
ugugugugugcacau

SEQ ID NO: 700437 - RNA, 22 nt, Homo sapiens
uguguguuagcagucaaaucua

SEQ ID NO: 700438 - RNA, 18 nt, Homo sapiens
uguuagauauuuuucaua

SEQ ID NO: 700439 - RNA, 17 nt, Homo sapiens
uguuaggagaagcugca

SEQ ID NO: 700440 - RNA, 17 nt, Homo sapiens
uguuccagugucuauaa

SEQ ID NO: 700441 - RNA, 20 nt, Homo sapiens
uguucccuccccgaucaucu

SEQ ID NO: 700442 - RNA, 22 nt, Homo sapiens
uguucuaaagguggugaggcaa

SEQ ID NO: 700443 - RNA, 18 nt, Homo sapiens
uguucucagaaucccuua

SEQ ID NO: 700444 - RNA, 21 nt, Homo sapiens
uguucuggggggacccagugc

SEQ ID NO: 700445 - RNA, 14 nt, Homo sapiens
uguuggugggaccc

SEQ ID NO: 700446 - RNA, 22 nt, Homo sapiens
uguugguguggcccauggcugu

SEQ ID NO: 700447 - RNA, 15 nt, Homo sapiens
uguuuacagacugug

SEQ ID NO: 700448 - RNA, 17 nt, Homo sapiens
uguuuauuuacaaggga

SEQ ID NO: 700449 - RNA, 17 nt, Homo sapiens
uguuucuuucauaugaa

SEQ ID NO: 700450 - RNA, 23 nt, Homo sapiens
uguuuuaaagaauaugacuuuuu

SEQ ID NO: 700451 - RNA, 14 nt, Homo sapiens
uguuuucucuugag

SEQ ID NO: 700452 - RNA, 20 nt, Homo sapiens
uguuuugccauguuggccag

SEQ ID NO: 700453 - RNA, 17 nt, Homo sapiens
uuaaaauaaugaauaca

SEQ ID NO: 700454 - RNA, 15 nt, Homo sapiens
uuaaaauuuuguaug

SEQ ID NO: 700455 - RNA, 19 nt, Homo sapiens
uuaaacugucgugucauac

SEQ ID NO: 700456 - RNA, 23 nt, Homo sapiens
uuaaacuuucaauugucacuuuu

SEQ ID NO: 700457 - RNA, 22 nt, Homo sapiens
uuaaaggguauacuaagugaua

SEQ ID NO: 700458 - RNA, 16 nt, Homo sapiens
uuaaagguaaaacaug

SEQ ID NO: 700459 - RNA, 15 nt, Homo sapiens
uuaaauacauaugga

SEQ ID NO: 700460 - RNA, 17 nt, Homo sapiens
uuaaauauauaauguug

SEQ ID NO: 700461 - RNA, 18 nt, Homo sapiens
uuaaauccugaagagcau

SEQ ID NO: 700462 - RNA, 22 nt, Homo sapiens
uuaaaugguuggcccccaaaga

SEQ ID NO: 700463 - RNA, 14 nt, Homo sapiens
uuaaauuacaauuu

SEQ ID NO: 700464 - RNA, 17 nt, Homo sapiens
uuaaauuacaauuuuau

SEQ ID NO: 700465 - RNA, 20 nt, Homo sapiens
uuaacugcauaauagccuaa

SEQ ID NO: 700466 - RNA, 15 nt, Homo sapiens
uuaacugccaagaaa

SEQ ID NO: 700467 - RNA, 16 nt, Homo sapiens
uuaagaaccugaauau

SEQ ID NO: 700468 - RNA, 21 nt, Homo sapiens
uuaagaagcaguuguaccaag

SEQ ID NO: 700469 - RNA, 12 nt, Homo sapiens
uuaagacuaaaa

SEQ ID NO: 700470 - RNA, 19 nt, Homo sapiens
uuaagacuaaaaguugcau

SEQ ID NO: 700471 - RNA, 23 nt, Homo sapiens
aaaugcccagcuuaaaggggcua

SEQ ID NO: 700472 - RNA, 20 nt, Homo sapiens
aaauucauggugcacugagc

SEQ ID NO: 700473 - RNA, 14 nt, Homo sapiens
aaauugaacaaaga

SEQ ID NO: 700474 - RNA, 16 nt, Homo sapiens
aaauuuuuaaauauuc

SEQ ID NO: 700475 - RNA, 19 nt, Homo sapiens
aaauuuuuaaauauucaca

SEQ ID NO: 700476 - RNA, 12 nt, Homo sapiens
aacaaaaaccaa

SEQ ID NO: 700477 - RNA, 21 nt, Homo sapiens
aacaaagauucaugauuuaua

SEQ ID NO: 700478 - RNA, 13 nt, Homo sapiens
aacaaagcccuua

SEQ ID NO: 700479 - RNA, 18 nt, Homo sapiens
aacaaccaugucauuuca

SEQ ID NO: 700480 - RNA, 24 nt, Homo sapiens
aacaauugguaaaacucacuguga

SEQ ID NO: 700481 - RNA, 15 nt, Homo sapiens
aacacccgacgucau

SEQ ID NO: 700482 - RNA, 14 nt, Homo sapiens
aacacugcacucuu

SEQ ID NO: 700483 - RNA, 13 nt, Homo sapiens
aacacugcugcuc

SEQ ID NO: 700484 - RNA, 17 nt, Homo sapiens
aacacuuccagcauuua

SEQ ID NO: 700485 - RNA, 18 nt, Homo sapiens
aacagaaauuguauauug

SEQ ID NO: 700486 - RNA, 14 nt, Homo sapiens
aacagaguaaucuu

SEQ ID NO: 700487 - RNA, 21 nt, Homo sapiens
aacagcaagugugaauacugc

SEQ ID NO: 700488 - RNA, 12 nt, Homo sapiens
aacaggcaguug

SEQ ID NO: 700489 - RNA, 19 nt, Homo sapiens
aacauccacaauaaccaag

SEQ ID NO: 700490 - RNA, 22 nt, Homo sapiens
aaccaagccugcugucuuguga

SEQ ID NO: 700491 - RNA, 12 nt, Homo sapiens
aaccacauuaua

SEQ ID NO: 700492 - RNA, 23 nt, Homo sapiens
aaccacgccucuugaccaggcug

SEQ ID NO: 700493 - RNA, 19 nt, Homo sapiens
aaccacggaggaugaugcc

SEQ ID NO: 700494 - RNA, 19 nt, Homo sapiens
aaccauggugaagugcuug

SEQ ID NO: 700495 - RNA, 16 nt, Homo sapiens
aaccccgucucuacua

SEQ ID NO: 700496 - RNA, 23 nt, Homo sapiens
aaccccuuccagaucacugccac

SEQ ID NO: 700497 - RNA, 20 nt, Homo sapiens
aacccgugacuguuacuuua

SEQ ID NO: 700498 - RNA, 11 nt, Homo sapiens
aaccucagggc

SEQ ID NO: 700499 - RNA, 13 nt, Homo sapiens
aaccuuaucucca

SEQ ID NO: 700500 - RNA, 19 nt, Homo sapiens
aacgaucacaaaugacuuu

SEQ ID NO: 700501 - RNA, 22 nt, Homo sapiens
aacgucauguguuuugccaaag

SEQ ID NO: 700502 - RNA, 11 nt, Homo sapiens
aacuacuucuu

SEQ ID NO: 700503 - RNA, 19 nt, Homo sapiens
aacuagggaagauaauauu

SEQ ID NO: 700504 - RNA, 13 nt, Homo sapiens
aacucacacuccc

SEQ ID NO: 700505 - RNA, 21 nt, Homo sapiens
aacucaccagccccacugcca

SEQ ID NO: 700506 - RNA, 12 nt, Homo sapiens
aacucacuguga

SEQ ID NO: 700507 - RNA, 14 nt, Homo sapiens
aacucacugugauc

SEQ ID NO: 700508 - RNA, 23 nt, Homo sapiens
aacucuccuuugcucucuggcca

SEQ ID NO: 700509 - RNA, 21 nt, Homo sapiens
aacucugccugagacuuucag

SEQ ID NO: 700510 - RNA, 12 nt, Homo sapiens
aacucuucucau

SEQ ID NO: 700511 - RNA, 21 nt, Homo sapiens
aacugaaaugccugcuuugaa

SEQ ID NO: 700512 - RNA, 22 nt, Homo sapiens
aacugcaggcccuggccucccc

SEQ ID NO: 700513 - RNA, 16 nt, Homo sapiens
aacuggauagaaccac

SEQ ID NO: 700514 - RNA, 23 nt, Homo sapiens
aacuggggaaugggguauggaag

SEQ ID NO: 700515 - RNA, 16 nt, Homo sapiens
aacuguagaugaugua

SEQ ID NO: 700516 - RNA, 16 nt, Homo sapiens
aacuguagcugccaug

SEQ ID NO: 700517 - RNA, 20 nt, Homo sapiens
aacugucacucauugcugag

SEQ ID NO: 700518 - RNA, 15 nt, Homo sapiens
aacugucgugucaua

SEQ ID NO: 700519 - RNA, 14 nt, Homo sapiens
aacugucucucuuc

SEQ ID NO: 700520 - RNA, 12 nt, Homo sapiens
aacugugacugu

SEQ ID NO: 700521 - RNA, 15 nt, Homo sapiens
aacugugcaaggccu

SEQ ID NO: 700522 - RNA, 13 nt, Homo sapiens
aacuuaacauuca

SEQ ID NO: 700523 - RNA, 22 nt, Homo sapiens
aacuucugccucccaugcuuac

SEQ ID NO: 700524 - RNA, 18 nt, Homo sapiens
aacuuguauuaaagacag

SEQ ID NO: 700525 - RNA, 16 nt, Homo sapiens
aacuuuauaaauccag

SEQ ID NO: 700526 - RNA, 12 nt, Homo sapiens
aacuuuuaucua

SEQ ID NO: 700527 - RNA, 23 nt, Homo sapiens
aagaaaaagaccuaugagcacau

SEQ ID NO: 700528 - RNA, 14 nt, Homo sapiens
aagaaaagaccuuu

SEQ ID NO: 700529 - RNA, 18 nt, Homo sapiens
aagaacaggccucuccau

SEQ ID NO: 700530 - RNA, 22 nt, Homo sapiens
aagaacuauugugcucagagac

SEQ ID NO: 700531 - RNA, 14 nt, Homo sapiens
aagaagucuucucu

SEQ ID NO: 700532 - RNA, 23 nt, Homo sapiens
aagaauucaaacuggggccucca

SEQ ID NO: 700533 - RNA, 20 nt, Homo sapiens
aagacauacuccuuccauca

SEQ ID NO: 700534 - RNA, 18 nt, Homo sapiens
aagacugguuuucugcca

SEQ ID NO: 700535 - RNA, 23 nt, Homo sapiens
aagagagucgcaucucagugcag

SEQ ID NO: 700536 - RNA, 15 nt, Homo sapiens
aagagauccaaagac

SEQ ID NO: 700537 - RNA, 18 nt, Homo sapiens
aagaggcugccccucuca

SEQ ID NO: 700538 - RNA, 21 nt, Homo sapiens
aagagggcuuccucuagaagc

SEQ ID NO: 700539 - RNA, 19 nt, Homo sapiens
aagagucuacccgacauaa

SEQ ID NO: 700540 - RNA, 19 nt, Homo sapiens
aagagugaaaaagagaaua

SEQ ID NO: 700541 - RNA, 17 nt, Homo sapiens
aagauccagcugccuau

SEQ ID NO: 700542 - RNA, 22 nt, Homo sapiens
aagauguauuauaccagugaaa

SEQ ID NO: 700543 - RNA, 22 nt, Homo sapiens
aagauguugauuuuuacugugu

SEQ ID NO: 700544 - RNA, 13 nt, Homo sapiens
aagcacagaauau

SEQ ID NO: 700545 - RNA, 19 nt, Homo sapiens
aagcaggacuaaaugucua

SEQ ID NO: 700546 - RNA, 22 nt, Homo sapiens
aagcaguagcauuugcuuccuc

SEQ ID NO: 700547 - RNA, 22 nt, Homo sapiens
aagcaguuguaccaagugaaau

SEQ ID NO: 700548 - RNA, 13 nt, Homo sapiens
aagcauacuucua

SEQ ID NO: 700549 - RNA, 12 nt, Homo sapiens
aagcauacuuug

SEQ ID NO: 700550 - RNA, 23 nt, Homo sapiens
aagcauguuuuguugcucagugu

SEQ ID NO: 700551 - RNA, 16 nt, Homo sapiens
aagcccaggagccuca

SEQ ID NO: 700552 - RNA, 13 nt, Homo sapiens
aagccuucagcuc

SEQ ID NO: 700553 - RNA, 14 nt, Homo sapiens
aagccuuccuacac

SEQ ID NO: 700554 - RNA, 22 nt, Homo sapiens
aagcucaguaacugugcaucug

SEQ ID NO: 700555 - RNA, 14 nt, Homo sapiens
aagcugcauccaga

SEQ ID NO: 700556 - RNA, 15 nt, Homo sapiens
aagcuucaugcacuu

SEQ ID NO: 700557 - RNA, 20 nt, Homo sapiens
aagcuuggauuaaauacaua

SEQ ID NO: 700558 - RNA, 17 nt, Homo sapiens
aaggaaacccccagugu

SEQ ID NO: 700559 - RNA, 17 nt, Homo sapiens
aaggaagacaaugugaa

SEQ ID NO: 700560 - RNA, 23 nt, Homo sapiens
aaggacugacugaggcaguuuga

SEQ ID NO: 700561 - RNA, 22 nt, Homo sapiens
aaggagauaauuacugccuuga

SEQ ID NO: 700562 - RNA, 20 nt, Homo sapiens
aaggauauuuacuacuuuug

SEQ ID NO: 700563 - RNA, 15 nt, Homo sapiens
aaggcaguagaacuc

SEQ ID NO: 700564 - RNA, 23 nt, Homo sapiens
aagggaauacugugcauaagcca

SEQ ID NO: 700565 - RNA, 20 nt, Homo sapiens
aaggggagccaaaaucucaa

SEQ ID NO: 700566 - RNA, 12 nt, Homo sapiens
aaggugaaucug

SEQ ID NO: 700567 - RNA, 13 nt, Homo sapiens
aaguaaaaaggga

SEQ ID NO: 700568 - RNA, 21 nt, Homo sapiens
aaguaacugugagaacccagu

SEQ ID NO: 700569 - RNA, 19 nt, Homo sapiens
aaguaacugugguuuacua

SEQ ID NO: 700570 - RNA, 20 nt, Homo sapiens
aagucagagacagauaccuc

SEQ ID NO: 700571 - RNA, 14 nt, Homo sapiens
aagucugucugucu

SEQ ID NO: 700572 - RNA, 11 nt, Homo sapiens
aagucuuucau

SEQ ID NO: 700573 - RNA, 15 nt, Homo sapiens
aagugacuauagaau

SEQ ID NO: 700574 - RNA, 19 nt, Homo sapiens
aagugagacccugucucaa

SEQ ID NO: 700575 - RNA, 19 nt, Homo sapiens
aagugccaaagaaaguggu

SEQ ID NO: 700576 - RNA, 14 nt, Homo sapiens
aagugccucaagag

SEQ ID NO: 700577 - RNA, 16 nt, Homo sapiens
aagugggcauugccau

SEQ ID NO: 700578 - RNA, 23 nt, Homo sapiens
aaguuggugcuuuugagaaccaa

SEQ ID NO: 700579 - RNA, 19 nt, Homo sapiens
aaguuuacaaucaaaggaa

SEQ ID NO: 700580 - RNA, 13 nt, Homo sapiens
aaguuugagauca

SEQ ID NO: 700581 - RNA, 14 nt, Homo sapiens
aaguuuuacugucu

SEQ ID NO: 700582 - RNA, 15 nt, Homo sapiens
aauaaagaccugaga

SEQ ID NO: 700583 - RNA, 13 nt, Homo sapiens
aauaaauuguaaa

SEQ ID NO: 700584 - RNA, 21 nt, Homo sapiens
aauacagacuacuucuucccc

SEQ ID NO: 700585 - RNA, 15 nt, Homo sapiens
aauacaguacuguuu

SEQ ID NO: 700586 - RNA, 14 nt, Homo sapiens
aauacaguaucuca

SEQ ID NO: 700587 - RNA, 21 nt, Homo sapiens
aauaccuagaccuaaacggcu

SEQ ID NO: 700588 - RNA, 13 nt, Homo sapiens
aauagaaacauau

SEQ ID NO: 700589 - RNA, 13 nt, Homo sapiens
cuuuggacacuca

SEQ ID NO: 700590 - RNA, 16 nt, Homo sapiens
cuuuggugcuuuucac

SEQ ID NO: 700591 - RNA, 21 nt, Homo sapiens
cuuugguuucucaacuucucu

SEQ ID NO: 700592 - RNA, 20 nt, Homo sapiens
cuuuguagaguuuugucauu

SEQ ID NO: 700593 - RNA, 15 nt, Homo sapiens
cuuuguauauuacau

SEQ ID NO: 700594 - RNA, 18 nt, Homo sapiens
cuuuguauuguauauuac

SEQ ID NO: 700595 - RNA, 22 nt, Homo sapiens
cuuuguggauggugucuccuuu

SEQ ID NO: 700596 - RNA, 14 nt, Homo sapiens
cuuuguuaggauuu

SEQ ID NO: 700597 - RNA, 23 nt, Homo sapiens
cuuuguucuggggggacccagug

SEQ ID NO: 700598 - RNA, 16 nt, Homo sapiens
cuuuuaacugccaaga

SEQ ID NO: 700599 - RNA, 18 nt, Homo sapiens
cuuuuaagcagugaguua

SEQ ID NO: 700600 - RNA, 16 nt, Homo sapiens
cuuuuauaaagcaugu

SEQ ID NO: 700601 - RNA, 14 nt, Homo sapiens
cuuuuauagaggcu

SEQ ID NO: 700602 - RNA, 19 nt, Homo sapiens
cuuuuauuuuacacagaaa

SEQ ID NO: 700603 - RNA, 23 nt, Homo sapiens
cuuuuauuuuacacagaaacacu

SEQ ID NO: 700604 - RNA, 21 nt, Homo sapiens
cuuuucagggcuggcuccuga

SEQ ID NO: 700605 - RNA, 16 nt, Homo sapiens
cuuuuccacuccauug

SEQ ID NO: 700606 - RNA, 19 nt, Homo sapiens
cuuuucggucuuucccauu

SEQ ID NO: 700607 - RNA, 21 nt, Homo sapiens
cuuuucuguccgagcuuugaa

SEQ ID NO: 700608 - RNA, 13 nt, Homo sapiens
cuuuugccuuuug

SEQ ID NO: 700609 - RNA, 12 nt, Homo sapiens
cuuuuguacuga

SEQ ID NO: 700610 - RNA, 15 nt, Homo sapiens
cuuuuugccuuacaa

SEQ ID NO: 700611 - RNA, 17 nt, Homo sapiens
cuuuuugggcuuucaua

SEQ ID NO: 700612 - RNA, 17 nt, Homo sapiens
cuuuuuucaaaagaaag

SEQ ID NO: 700613 - RNA, 14 nt, Homo sapiens
cuuuuuuuguaugu

SEQ ID NO: 700614 - RNA, 15 nt, Homo sapiens
gaaaaaaaugucaaa

SEQ ID NO: 700615 - RNA, 23 nt, Homo sapiens
gaaaaauauugcugaacuacuuu

SEQ ID NO: 700616 - RNA, 21 nt, Homo sapiens
gaaaaaucggcuuaccauuaa

SEQ ID NO: 700617 - RNA, 20 nt, Homo sapiens
gaaaagauuauauauuauuu

SEQ ID NO: 700618 - RNA, 17 nt, Homo sapiens
gaaaauguccaggaaag

SEQ ID NO: 700619 - RNA, 17 nt, Homo sapiens
gaaaauguguucucgga

SEQ ID NO: 700620 - RNA, 22 nt, Homo sapiens
gaaaauugggcaugccauuaca

SEQ ID NO: 700621 - RNA, 21 nt, Homo sapiens
gaaaauuguuuagugauauua

SEQ ID NO: 700622 - RNA, 18 nt, Homo sapiens
gaaacaagccugccauaa

SEQ ID NO: 700623 - RNA, 14 nt, Homo sapiens
gaaacccccagugu

SEQ ID NO: 700624 - RNA, 14 nt, Homo sapiens
gaaaccccgucucu

SEQ ID NO: 700625 - RNA, 14 nt, Homo sapiens
gaaacucacacucc

SEQ ID NO: 700626 - RNA, 15 nt, Homo sapiens
gaaacucacacuccc

SEQ ID NO: 700627 - RNA, 16 nt, Homo sapiens
gaaacucacacucccc

SEQ ID NO: 700628 - RNA, 19 nt, Homo sapiens
gaaacuugugaaguggaaa

SEQ ID NO: 700629 - RNA, 20 nt, Homo sapiens
gaaacuuugcagaugugauu

SEQ ID NO: 700630 - RNA, 19 nt, Homo sapiens
gaaagcucacuguagcuuu

SEQ ID NO: 700631 - RNA, 23 nt, Homo sapiens
gaaauaagaauucagacaucuga

SEQ ID NO: 700632 - RNA, 18 nt, Homo sapiens
gaaauacaguacuguuuc

SEQ ID NO: 700633 - RNA, 16 nt, Homo sapiens
gaaaugaaaacagugu

SEQ ID NO: 700634 - RNA, 21 nt, Homo sapiens
gaaaugaaauauuguuuccaa

SEQ ID NO: 700635 - RNA, 21 nt, Homo sapiens
gaaauuuuguaagaaggcaau

SEQ ID NO: 700636 - RNA, 22 nt, Homo sapiens
gaacacuaacucaccagcccca

SEQ ID NO: 700637 - RNA, 17 nt, Homo sapiens
gaacacugcacucuuaa

SEQ ID NO: 700638 - RNA, 20 nt, Homo sapiens
gaacacuugaagccaucuaa

SEQ ID NO: 700639 - RNA, 22 nt, Homo sapiens
gaacaugguuugacucaucuua

SEQ ID NO: 700640 - RNA, 20 nt, Homo sapiens
gaaccaaaucuggaagccaa

SEQ ID NO: 700641 - RNA, 14 nt, Homo sapiens
gaaccaccccggcc

SEQ ID NO: 700642 - RNA, 20 nt, Homo sapiens
gaaccacggaggaugaugcc

SEQ ID NO: 700643 - RNA, 20 nt, Homo sapiens
gaaccacuuguagauuugau

SEQ ID NO: 700644 - RNA, 14 nt, Homo sapiens
gaaccccaggagau

SEQ ID NO: 700645 - RNA, 24 nt, Homo sapiens
gaaccuaacaugcuggugaauauu

SEQ ID NO: 700646 - RNA, 14 nt, Homo sapiens
gaacgaggauuuua

SEQ ID NO: 700647 - RNA, 19 nt, Homo sapiens
gaacuacuuuuggugcuua

SEQ ID NO: 700648 - RNA, 14 nt, Homo sapiens
gaacucacuggggc

SEQ ID NO: 700649 - RNA, 21 nt, Homo sapiens
gaacuuaauaacuguguacug

SEQ ID NO: 700650 - RNA, 14 nt, Homo sapiens
gaacuuuaagcaac

SEQ ID NO: 700651 - RNA, 19 nt, Homo sapiens
gaagaacaggccucuccau

SEQ ID NO: 700652 - RNA, 19 nt, Homo sapiens
gaagaguuaagaagaaaau

SEQ ID NO: 700653 - RNA, 12 nt, Homo sapiens
gaagcacuacac

SEQ ID NO: 700654 - RNA, 15 nt, Homo sapiens
gaagcugcaggcuuu

SEQ ID NO: 700655 - RNA, 20 nt, Homo sapiens
gaaggagauaauuacugccu

SEQ ID NO: 700656 - RNA, 14 nt, Homo sapiens
gaaggcagagccau

SEQ ID NO: 700657 - RNA, 20 nt, Homo sapiens
gaagguucuacgccagggga

SEQ ID NO: 700658 - RNA, 14 nt, Homo sapiens
gaaguugaaaauca

SEQ ID NO: 700659 - RNA, 21 nt, Homo sapiens
gaauacaguuuugaguagagu

SEQ ID NO: 700660 - RNA, 14 nt, Homo sapiens
gaauacugugcaua

SEQ ID NO: 700661 - RNA, 14 nt, Homo sapiens
gaauacuugaacca

SEQ ID NO: 700662 - RNA, 19 nt, Homo sapiens
gaauauaaauuuguguucu

SEQ ID NO: 700663 - RNA, 20 nt, Homo sapiens
gaauauccuuuaaaauuuaa

SEQ ID NO: 700664 - RNA, 13 nt, Homo sapiens
gaauauggacaua

SEQ ID NO: 700665 - RNA, 15 nt, Homo sapiens
gaauauugcaaaaua

SEQ ID NO: 700666 - RNA, 15 nt, Homo sapiens
gaaucaaaagugccu

SEQ ID NO: 700667 - RNA, 20 nt, Homo sapiens
gaaucaaaagugccucaaga

SEQ ID NO: 700668 - RNA, 15 nt, Homo sapiens
gaauccaagccucca

SEQ ID NO: 700669 - RNA, 16 nt, Homo sapiens
gaauccuggcagccca

SEQ ID NO: 700670 - RNA, 14 nt, Homo sapiens
gaaucuggagacca

SEQ ID NO: 700671 - RNA, 13 nt, Homo sapiens
gaaugaacacucc

SEQ ID NO: 700672 - RNA, 14 nt, Homo sapiens
gaaugacaaaguau

SEQ ID NO: 700673 - RNA, 16 nt, Homo sapiens
gaaugcaaccaaguca

SEQ ID NO: 700674 - RNA, 21 nt, Homo sapiens
gaaugugucugcguuccuguu

SEQ ID NO: 700675 - RNA, 17 nt, Homo sapiens
gaauuaaaaaagcauac

SEQ ID NO: 700676 - RNA, 21 nt, Homo sapiens
gaauuagauuucuauaggauu

SEQ ID NO: 700677 - RNA, 20 nt, Homo sapiens
gaauuucugugcccuccuga

SEQ ID NO: 700678 - RNA, 22 nt, Homo sapiens
gaauuugcacuguuuaaucaua

SEQ ID NO: 700679 - RNA, 17 nt, Homo sapiens
gacaaagugagacuccg

SEQ ID NO: 700680 - RNA, 13 nt, Homo sapiens
gacaaucacuaca

SEQ ID NO: 700681 - RNA, 16 nt, Homo sapiens
gacacacaaaucccau

SEQ ID NO: 700682 - RNA, 22 nt, Homo sapiens
gacacauacaugucacauuuag

SEQ ID NO: 700683 - RNA, 21 nt, Homo sapiens
gacacucacacggacacucaa

SEQ ID NO: 700684 - RNA, 16 nt, Homo sapiens
gacagagcgagacucc

SEQ ID NO: 700685 - RNA, 14 nt, Homo sapiens
gacagauaccucca

SEQ ID NO: 700686 - RNA, 22 nt, Homo sapiens
gacagauugccuguuucugauu

SEQ ID NO: 700687 - RNA, 14 nt, Homo sapiens
gacagcuuuucuca

SEQ ID NO: 700688 - RNA, 19 nt, Homo sapiens
gacauugaccuauuuccag

SEQ ID NO: 700689 - RNA, 12 nt, Homo sapiens
gaccaagguaua

SEQ ID NO: 700690 - RNA, 13 nt, Homo sapiens
gaccauguggcca

SEQ ID NO: 700691 - RNA, 23 nt, Homo sapiens
gacccaggaaaggcaggauugaa

SEQ ID NO: 700692 - RNA, 17 nt, Homo sapiens
gaccccagccauccagg

SEQ ID NO: 700693 - RNA, 20 nt, Homo sapiens
gaccccagcugccaaggaaa

SEQ ID NO: 700694 - RNA, 20 nt, Homo sapiens
gacccccguggggcagggag

SEQ ID NO: 700695 - RNA, 18 nt, Homo sapiens
gaccccucgcaacugucc

SEQ ID NO: 700696 - RNA, 14 nt, Homo sapiens
gacccucuaaccuc

SEQ ID NO: 700697 - RNA, 17 nt, Homo sapiens
gaccuaugagcacauag

SEQ ID NO: 700698 - RNA, 17 nt, Homo sapiens
gaccuuaggccuuccuc

SEQ ID NO: 700699 - RNA, 18 nt, Homo sapiens
gacggugcccaagccaga

SEQ ID NO: 700700 - RNA, 15 nt, Homo sapiens
gacuaauuaggcaag

SEQ ID NO: 700701 - RNA, 17 nt, Homo sapiens
gacugaccauauugugc

SEQ ID NO: 700702 - RNA, 16 nt, Homo sapiens
gacugcuaccuuucaa

SEQ ID NO: 700703 - RNA, 18 nt, Homo sapiens
gacuguggcacuugccug

SEQ ID NO: 700704 - RNA, 20 nt, Homo sapiens
gagaagccuucagcuccagg

SEQ ID NO: 700705 - RNA, 22 nt, Homo sapiens
gagaagccuucagcuccaggga

SEQ ID NO: 700706 - RNA, 19 nt, Homo sapiens
gagaaugugagaagccagc

SEQ ID NO: 700707 - RNA, 16 nt, Homo sapiens
gucccucugcucucag

SEQ ID NO: 700708 - RNA, 17 nt, Homo sapiens
gucccuuccccaugcuu

SEQ ID NO: 700709 - RNA, 17 nt, Homo sapiens
guccuaauggugaugca

SEQ ID NO: 700710 - RNA, 18 nt, Homo sapiens
guccuauuaguguuauau

SEQ ID NO: 700711 - RNA, 19 nt, Homo sapiens
guccuggaaucacauucuu

SEQ ID NO: 700712 - RNA, 16 nt, Homo sapiens
guccuguccugcucau

SEQ ID NO: 700713 - RNA, 20 nt, Homo sapiens
gucggaacccaagcuuagaa

SEQ ID NO: 700714 - RNA, 14 nt, Homo sapiens
gucgucaccaaauc

SEQ ID NO: 700715 - RNA, 19 nt, Homo sapiens
gucuaauagucuuugccag

SEQ ID NO: 700716 - RNA, 16 nt, Homo sapiens
gucuauuaauauucag

SEQ ID NO: 700717 - RNA, 13 nt, Homo sapiens
gucucauguggaa

SEQ ID NO: 700718 - RNA, 17 nt, Homo sapiens
gucucuucuaagcaaaa

SEQ ID NO: 700719 - RNA, 14 nt, Homo sapiens
gucuggaauugugg

SEQ ID NO: 700720 - RNA, 21 nt, Homo sapiens
gucugugugcgcucuguggau

SEQ ID NO: 700721 - RNA, 20 nt, Homo sapiens
gucuuuccugaaccaugugg

SEQ ID NO: 700722 - RNA, 21 nt, Homo sapiens
gugaaaaaguuaaacauugaa

SEQ ID NO: 700723 - RNA, 12 nt, Homo sapiens
gugaaaauauga

SEQ ID NO: 700724 - RNA, 19 nt, Homo sapiens
gugaaaauuacaguccaaa

SEQ ID NO: 700725 - RNA, 21 nt, Homo sapiens
gugaaauuauuuuggagauua

SEQ ID NO: 700726 - RNA, 17 nt, Homo sapiens
gugaagaaaaauguauu

SEQ ID NO: 700727 - RNA, 19 nt, Homo sapiens
gugaauuauugacacugaa

SEQ ID NO: 700728 - RNA, 19 nt, Homo sapiens
gugacauauauauguauau

SEQ ID NO: 700729 - RNA, 16 nt, Homo sapiens
gugacccgaccuggcc

SEQ ID NO: 700730 - RNA, 16 nt, Homo sapiens
gugaccucucucucug

SEQ ID NO: 700731 - RNA, 21 nt, Homo sapiens
gugaggaaaucaaagugcuau

SEQ ID NO: 700732 - RNA, 14 nt, Homo sapiens
gugaguuugagcug

SEQ ID NO: 700733 - RNA, 13 nt, Homo sapiens
gugauauaugcau

SEQ ID NO: 700734 - RNA, 15 nt, Homo sapiens
gugauauaugccuau

SEQ ID NO: 700735 - RNA, 14 nt, Homo sapiens
gugauuggaccagg

SEQ ID NO: 700736 - RNA, 21 nt, Homo sapiens
gugcagaauuggggcacuuaa

SEQ ID NO: 700737 - RNA, 17 nt, Homo sapiens
gugcagcccaaucugcc

SEQ ID NO: 700738 - RNA, 19 nt, Homo sapiens
gugcagcccaaucugccag

SEQ ID NO: 700739 - RNA, 11 nt, Homo sapiens
gugcauuuuau

SEQ ID NO: 700740 - RNA, 15 nt, Homo sapiens
gugccugggguguua

SEQ ID NO: 700741 - RNA, 13 nt, Homo sapiens
guggacucagugg

SEQ ID NO: 700742 - RNA, 23 nt, Homo sapiens
guggcaccgccuccccaccucca

SEQ ID NO: 700743 - RNA, 22 nt, Homo sapiens
guggcgagaaauaaaguuugcu

SEQ ID NO: 700744 - RNA, 19 nt, Homo sapiens
gugggacccccguggggca

SEQ ID NO: 700745 - RNA, 17 nt, Homo sapiens
gugggcaaacaggcagu

SEQ ID NO: 700746 - RNA, 21 nt, Homo sapiens
gugggcucugugcagucacug

SEQ ID NO: 700747 - RNA, 13 nt, Homo sapiens
guggucgguggga

SEQ ID NO: 700748 - RNA, 20 nt, Homo sapiens
guguaaacaaaaugaagcug

SEQ ID NO: 700749 - RNA, 14 nt, Homo sapiens
guguacauuucuau

SEQ ID NO: 700750 - RNA, 20 nt, Homo sapiens
gugugaggcggcccugacca

SEQ ID NO: 700751 - RNA, 13 nt, Homo sapiens
guguggccucuuc

SEQ ID NO: 700752 - RNA, 12 nt, Homo sapiens
guguuugggaug

SEQ ID NO: 700753 - RNA, 17 nt, Homo sapiens
guuaaacauugaaguaa

SEQ ID NO: 700754 - RNA, 16 nt, Homo sapiens
guuaacugauuugcaa

SEQ ID NO: 700755 - RNA, 24 nt, Homo sapiens
guuaauauuuauuaagugacuaua

SEQ ID NO: 700756 - RNA, 17 nt, Homo sapiens
guuaauuuaaguuuuga

SEQ ID NO: 700757 - RNA, 17 nt, Homo sapiens
guuaccacauuacucug

SEQ ID NO: 700758 - RNA, 21 nt, Homo sapiens
guuacuguguuuaucuugaua

SEQ ID NO: 700759 - RNA, 15 nt, Homo sapiens
guuauucaacagcaa

SEQ ID NO: 700760 - RNA, 14 nt, Homo sapiens
guuauuuuccauuu

SEQ ID NO: 700761 - RNA, 20 nt, Homo sapiens
guuccuuacuuuacugccug

SEQ ID NO: 700762 - RNA, 20 nt, Homo sapiens
guucguucuguacuguuacu

SEQ ID NO: 700763 - RNA, 19 nt, Homo sapiens
guucuaacaaaacaaguug

SEQ ID NO: 700764 - RNA, 14 nt, Homo sapiens
guucuaacagugaa

SEQ ID NO: 700765 - RNA, 22 nt, Homo sapiens
guugagcuucauauaccagcaa

SEQ ID NO: 700766 - RNA, 22 nt, Homo sapiens
guugcagcccuugugaugugau

SEQ ID NO: 700767 - RNA, 12 nt, Homo sapiens
guugcugacuua

SEQ ID NO: 700768 - RNA, 15 nt, Homo sapiens
guugcugacuuagaa

SEQ ID NO: 700769 - RNA, 14 nt, Homo sapiens
guuguagaagacaa

SEQ ID NO: 700770 - RNA, 19 nt, Homo sapiens
guuguucaguugccaagga

SEQ ID NO: 700771 - RNA, 14 nt, Homo sapiens
guuuaaaacaccuu

SEQ ID NO: 700772 - RNA, 13 nt, Homo sapiens
guuuauaaugcca

SEQ ID NO: 700773 - RNA, 18 nt, Homo sapiens
guuugaaaauaugccugc

SEQ ID NO: 700774 - RNA, 15 nt, Homo sapiens
guuugacucaucuua

SEQ ID NO: 700775 - RNA, 22 nt, Homo sapiens
guuuguuggaaaguaacuguga

SEQ ID NO: 700776 - RNA, 12 nt, Homo sapiens
guuuugccucac

SEQ ID NO: 700777 - RNA, 16 nt, Homo sapiens
guuuugucaaacugua

SEQ ID NO: 700778 - RNA, 22 nt, Homo sapiens
guuuuugggggguuuucuugcc

SEQ ID NO: 700779 - RNA, 22 nt, Homo sapiens
guuuuuuaaaaaaaaauugaac

SEQ ID NO: 700780 - RNA, 22 nt, Homo sapiens
uaaaaaaaaagucagagacaga

SEQ ID NO: 700781 - RNA, 21 nt, Homo sapiens
uaaaaaaugaaaaacauuauu

SEQ ID NO: 700782 - RNA, 15 nt, Homo sapiens
uaaaaaccgaauaaa

SEQ ID NO: 700783 - RNA, 17 nt, Homo sapiens
uaaaaaugauacugaug

SEQ ID NO: 700784 - RNA, 17 nt, Homo sapiens
uaaaacaugcuggugaa

SEQ ID NO: 700785 - RNA, 20 nt, Homo sapiens
uaaaacaugcuggugaacca

SEQ ID NO: 700786 - RNA, 18 nt, Homo sapiens
uaaaacccaagugccuua

SEQ ID NO: 700787 - RNA, 20 nt, Homo sapiens
uaaaacucacugugaucaau

SEQ ID NO: 700788 - RNA, 14 nt, Homo sapiens
uaaaacuggaccug

SEQ ID NO: 700789 - RNA, 15 nt, Homo sapiens
uaaaagaaggaugaa

SEQ ID NO: 700790 - RNA, 20 nt, Homo sapiens
uaaaagcuauaaagcaguau

SEQ ID NO: 700791 - RNA, 16 nt, Homo sapiens
uaaaagugaucuacau

SEQ ID NO: 700792 - RNA, 14 nt, Homo sapiens
uaaaauaaaugcaa

SEQ ID NO: 700793 - RNA, 22 nt, Homo sapiens
uaaaauaacaguaugugggaua

SEQ ID NO: 700794 - RNA, 19 nt, Homo sapiens
uaaaauagaguguaguuua

SEQ ID NO: 700795 - RNA, 21 nt, Homo sapiens
uaaaauagaguguaguuuaca

SEQ ID NO: 700796 - RNA, 22 nt, Homo sapiens
uaaaauauuuaucugauuaagu

SEQ ID NO: 700797 - RNA, 18 nt, Homo sapiens
uaaaauuaucaauaucua

SEQ ID NO: 700798 - RNA, 17 nt, Homo sapiens
uaaacaguggaauauaa

SEQ ID NO: 700799 - RNA, 16 nt, Homo sapiens
uaaaccaagugaucaa

SEQ ID NO: 700800 - RNA, 22 nt, Homo sapiens
uaaaccucaguuauuacaugua

SEQ ID NO: 700801 - RNA, 14 nt, Homo sapiens
uaaacuaggaauuu

SEQ ID NO: 700802 - RNA, 19 nt, Homo sapiens
uaaacuauaaaacaaaaau

SEQ ID NO: 700803 - RNA, 17 nt, Homo sapiens
uaaacuuguuuacaaag

SEQ ID NO: 700804 - RNA, 20 nt, Homo sapiens
uaaagacugguuuucugcca

SEQ ID NO: 700805 - RNA, 22 nt, Homo sapiens
uaaagacuuguauagcaugaaa

SEQ ID NO: 700806 - RNA, 18 nt, Homo sapiens
uaaagagagaugaaccac

SEQ ID NO: 700807 - RNA, 22 nt, Homo sapiens
uaaagcuaaggaccuuaagaca

SEQ ID NO: 700808 - RNA, 22 nt, Homo sapiens
uaaagcuauuuaugggccccug

SEQ ID NO: 700809 - RNA, 22 nt, Homo sapiens
uaaaguauuuucuucucuguga

SEQ ID NO: 700810 - RNA, 17 nt, Homo sapiens
uaaaguggaaguaugua

SEQ ID NO: 700811 - RNA, 23 nt, Homo sapiens
uaaaucauguugaucauguacuu

SEQ ID NO: 700812 - RNA, 19 nt, Homo sapiens
uaaaucauucuuacuaaaa

SEQ ID NO: 700813 - RNA, 14 nt, Homo sapiens
uaaauccaucacua

SEQ ID NO: 700814 - RNA, 19 nt, Homo sapiens
uaaauccaucacuauaaua

SEQ ID NO: 700815 - RNA, 15 nt, Homo sapiens
uaaauuauaguguag

SEQ ID NO: 700816 - RNA, 16 nt, Homo sapiens
uaaauucaacuuugua

SEQ ID NO: 700817 - RNA, 16 nt, Homo sapiens
uaaauuuguguucuca

SEQ ID NO: 700818 - RNA, 21 nt, Homo sapiens
uaacagauggaaaaacugagg

SEQ ID NO: 700819 - RNA, 19 nt, Homo sapiens
uaacauagccaaaauguga

SEQ ID NO: 700820 - RNA, 23 nt, Homo sapiens
uaacauggugaaaccccgucucu

SEQ ID NO: 700821 - RNA, 23 nt, Homo sapiens
uaaccccugcgcucucuuugcaa

SEQ ID NO: 700822 - RNA, 20 nt, Homo sapiens
uaacucaccagccccacugc

SEQ ID NO: 700823 - RNA, 22 nt, Homo sapiens
uaacucaccagccccacugcca

SEQ ID NO: 700824 - RNA, 22 nt, Homo sapiens
ugaauauaaauuuguguucuca

SEQ ID NO: 700825 - RNA, 18 nt, Homo sapiens
ugaauggggucucaaagu

SEQ ID NO: 700826 - RNA, 18 nt, Homo sapiens
ugaauuauugacacugaa

SEQ ID NO: 700827 - RNA, 17 nt, Homo sapiens
ugaauuugcacuguuua

SEQ ID NO: 700828 - RNA, 21 nt, Homo sapiens
ugaauuuucaaguaauuguga

SEQ ID NO: 700829 - RNA, 21 nt, Homo sapiens
ugacaaccgagaagguuuauc

SEQ ID NO: 700830 - RNA, 20 nt, Homo sapiens
ugacaaggcacuucauguaa

SEQ ID NO: 700831 - RNA, 15 nt, Homo sapiens
ugacaagugccuuca

SEQ ID NO: 700832 - RNA, 18 nt, Homo sapiens
ugacauauauauguauau

SEQ ID NO: 700833 - RNA, 17 nt, Homo sapiens
ugaccaaacagccaaga

SEQ ID NO: 700834 - RNA, 22 nt, Homo sapiens
ugaccaaugugugaaguaugca

SEQ ID NO: 700835 - RNA, 15 nt, Homo sapiens
ugaccuaacauaccg

SEQ ID NO: 700836 - RNA, 15 nt, Homo sapiens
ugaccuguguucccu

SEQ ID NO: 700837 - RNA, 16 nt, Homo sapiens
ugacucuggguccuuc

SEQ ID NO: 700838 - RNA, 15 nt, Homo sapiens
ugagacagucuugcu

SEQ ID NO: 700839 - RNA, 17 nt, Homo sapiens
ugagacccauggcugug

SEQ ID NO: 700840 - RNA, 13 nt, Homo sapiens
ugagacugugcug

SEQ ID NO: 700841 - RNA, 22 nt, Homo sapiens
ugagaugcaggauuucuucaca

SEQ ID NO: 700842 - RNA, 15 nt, Homo sapiens
ugagcagagacauga

SEQ ID NO: 700843 - RNA, 15 nt, Homo sapiens
ugagcuaugacuuaa

SEQ ID NO: 700844 - RNA, 21 nt, Homo sapiens
ugagcuggccucucuagcaca

SEQ ID NO: 700845 - RNA, 16 nt, Homo sapiens
ugaggaaaauucuuaa

SEQ ID NO: 700846 - RNA, 16 nt, Homo sapiens
ugaggaagucacuuua

SEQ ID NO: 700847 - RNA, 17 nt, Homo sapiens
ugaggaagucacuuuac

SEQ ID NO: 700848 - RNA, 16 nt, Homo sapiens
ugaggaggaugcuaaa

SEQ ID NO: 700849 - RNA, 14 nt, Homo sapiens
ugaggcugcaccca

SEQ ID NO: 700850 - RNA, 19 nt, Homo sapiens
ugagguuucccccugucuc

SEQ ID NO: 700851 - RNA, 15 nt, Homo sapiens
ugagugggugaauaa

SEQ ID NO: 700852 - RNA, 23 nt, Homo sapiens
ugauaauaaauuagguaagauaa

SEQ ID NO: 700853 - RNA, 16 nt, Homo sapiens
ugauacaguacuuuga

SEQ ID NO: 700854 - RNA, 23 nt, Homo sapiens
ugauacauguuuccaauuauccu

SEQ ID NO: 700855 - RNA, 17 nt, Homo sapiens
ugauauuggggccauga

SEQ ID NO: 700856 - RNA, 14 nt, Homo sapiens
ugaugcugugcuau

SEQ ID NO: 700857 - RNA, 23 nt, Homo sapiens
ugaugguguggccuguggcuguc

SEQ ID NO: 700858 - RNA, 22 nt, Homo sapiens
ugaugugcaaaaccuuuuacug

SEQ ID NO: 700859 - RNA, 22 nt, Homo sapiens
ugauuaaagcuaaggaccuuaa

SEQ ID NO: 700860 - RNA, 20 nt, Homo sapiens
ugauucccuuguuauucaac

SEQ ID NO: 700861 - RNA, 20 nt, Homo sapiens
ugauugggaaaacauuugcu

SEQ ID NO: 700862 - RNA, 16 nt, Homo sapiens
ugauuguuauguguau

SEQ ID NO: 700863 - RNA, 21 nt, Homo sapiens
ugcaaaugcaugcuucuucuc

SEQ ID NO: 700864 - RNA, 14 nt, Homo sapiens
ugcaacuucugccu

SEQ ID NO: 700865 - RNA, 21 nt, Homo sapiens
ugcaacuucuuacuucccuaa

SEQ ID NO: 700866 - RNA, 22 nt, Homo sapiens
ugcaagaauugaagcaggacua

SEQ ID NO: 700867 - RNA, 19 nt, Homo sapiens
ugcaaggcuaagaaguacu

SEQ ID NO: 700868 - RNA, 23 nt, Homo sapiens
ugcaagugcuggagucuccugag

SEQ ID NO: 700869 - RNA, 16 nt, Homo sapiens
ugcaauguaagcauac

SEQ ID NO: 700870 - RNA, 22 nt, Homo sapiens
ugcacuccagccugggggacag

SEQ ID NO: 700871 - RNA, 14 nt, Homo sapiens
ugcacuggggccac

SEQ ID NO: 700872 - RNA, 21 nt, Homo sapiens
ugcacuguauauagaagucua

SEQ ID NO: 700873 - RNA, 12 nt, Homo sapiens
ugcacuuucuau

SEQ ID NO: 700874 - RNA, 17 nt, Homo sapiens
ugcagaaacaguucacc

SEQ ID NO: 700875 - RNA, 20 nt, Homo sapiens
ugcagaugccacccuagcca

SEQ ID NO: 700876 - RNA, 21 nt, Homo sapiens
ugcagaugccacccuagccaa

SEQ ID NO: 700877 - RNA, 16 nt, Homo sapiens
ugcaggaccucaggug

SEQ ID NO: 700878 - RNA, 22 nt, Homo sapiens
ugcagguuccgauguuauuaga

SEQ ID NO: 700879 - RNA, 22 nt, Homo sapiens
ugcagucauuaugagaggcaau

SEQ ID NO: 700880 - RNA, 18 nt, Homo sapiens
ugcauaaaaaggucuuua

SEQ ID NO: 700881 - RNA, 22 nt, Homo sapiens
ugcauaggaauugcacaaucca

SEQ ID NO: 700882 - RNA, 22 nt, Homo sapiens
ugcauuuccucgcagccucuca

SEQ ID NO: 700883 - RNA, 15 nt, Homo sapiens
ugccaaagaaagugg

SEQ ID NO: 700884 - RNA, 20 nt, Homo sapiens
ugccaaccggucacccagga

SEQ ID NO: 700885 - RNA, 22 nt, Homo sapiens
ugccacuuccuuuuaacugcca

SEQ ID NO: 700886 - RNA, 19 nt, Homo sapiens
ugccacuuuacccaccuag

SEQ ID NO: 700887 - RNA, 16 nt, Homo sapiens
ugccagcuuaucucag

SEQ ID NO: 700888 - RNA, 19 nt, Homo sapiens
ugccagcuuaucucagggg

SEQ ID NO: 700889 - RNA, 19 nt, Homo sapiens
ugccagggccugucucuga

SEQ ID NO: 700890 - RNA, 13 nt, Homo sapiens
ugccauaucagug

SEQ ID NO: 700891 - RNA, 17 nt, Homo sapiens
ugccaucgcugugaugc

SEQ ID NO: 700892 - RNA, 20 nt, Homo sapiens
ugccauuuuaaggaaaacua

SEQ ID NO: 700893 - RNA, 11 nt, Homo sapiens
ugcccagacaa

SEQ ID NO: 700894 - RNA, 13 nt, Homo sapiens
ugcccagacaaga

SEQ ID NO: 700895 - RNA, 14 nt, Homo sapiens
ugcccagacaagau

SEQ ID NO: 700896 - RNA, 22 nt, Homo sapiens
ugcccagcccccuggucuuuga

SEQ ID NO: 700897 - RNA, 18 nt, Homo sapiens
ugcccauccugacugaaa

SEQ ID NO: 700898 - RNA, 22 nt, Homo sapiens
ugcccaucgugaagaagccugu

SEQ ID NO: 700899 - RNA, 19 nt, Homo sapiens
ugccccacagucuccggcc

SEQ ID NO: 700900 - RNA, 19 nt, Homo sapiens
ugcccguguaguccccaac

SEQ ID NO: 700901 - RNA, 17 nt, Homo sapiens
ugcccucucccaaaaaa

SEQ ID NO: 700902 - RNA, 18 nt, Homo sapiens
ugcccugugcaugccaug

SEQ ID NO: 700903 - RNA, 19 nt, Homo sapiens
ugccuaguaacacauaugu

SEQ ID NO: 700904 - RNA, 21 nt, Homo sapiens
ugccugugugggacugagaug

SEQ ID NO: 700905 - RNA, 22 nt, Homo sapiens
ugccuucagaggauaaauauca

SEQ ID NO: 700906 - RNA, 16 nt, Homo sapiens
ugccuuggcuuugcca

SEQ ID NO: 700907 - RNA, 23 nt, Homo sapiens
ugccuuuuuauuuauauguacug

SEQ ID NO: 700908 - RNA, 21 nt, Homo sapiens
ugcgacccugggggcacagga

SEQ ID NO: 700909 - RNA, 14 nt, Homo sapiens
ugcgcucuguggau

SEQ ID NO: 700910 - RNA, 13 nt, Homo sapiens
ugcggccauucaa

SEQ ID NO: 700911 - RNA, 16 nt, Homo sapiens
ugcgucgucaccaaau

SEQ ID NO: 700912 - RNA, 13 nt, Homo sapiens
ugcuaaaugugaa

SEQ ID NO: 700913 - RNA, 18 nt, Homo sapiens
ugcuaacaaagacaaaag

SEQ ID NO: 700914 - RNA, 19 nt, Homo sapiens
ugcuauuuauuuuccuaaa

SEQ ID NO: 700915 - RNA, 20 nt, Homo sapiens
ugcuccauaguuuggcauuu

SEQ ID NO: 700916 - RNA, 15 nt, Homo sapiens
ugcuccuacuuucag

SEQ ID NO: 700917 - RNA, 23 nt, Homo sapiens
ugcucuucagaugccacuucuaa

SEQ ID NO: 700918 - RNA, 16 nt, Homo sapiens
ugcucuucaucccauu

SEQ ID NO: 700919 - RNA, 20 nt, Homo sapiens
ugcugaagaggguugguaua

SEQ ID NO: 700920 - RNA, 17 nt, Homo sapiens
ugcugcuccagugcagg

SEQ ID NO: 700921 - RNA, 17 nt, Homo sapiens
ugcugcucuucauccca

SEQ ID NO: 700922 - RNA, 14 nt, Homo sapiens
ugcuguacaaaagc

SEQ ID NO: 700923 - RNA, 21 nt, Homo sapiens
ugcuuaauaaauuguguuucc

SEQ ID NO: 700924 - RNA, 21 nt, Homo sapiens
ugcuuucagaagugcccuucc

SEQ ID NO: 700925 - RNA, 16 nt, Homo sapiens
uggaaaguaacuguga

SEQ ID NO: 700926 - RNA, 21 nt, Homo sapiens
uggaaauuccuguacuguguc

SEQ ID NO: 700927 - RNA, 22 nt, Homo sapiens
uggaauauaaggaaagcaauaa

SEQ ID NO: 700928 - RNA, 20 nt, Homo sapiens
uggaaucccacuaaugcaaa

SEQ ID NO: 700929 - RNA, 13 nt, Homo sapiens
uggacugcaauga

SEQ ID NO: 700930 - RNA, 22 nt, Homo sapiens
uggacugguaaguaacuguggu

SEQ ID NO: 700931 - RNA, 16 nt, Homo sapiens
uggagagacagcuaca

SEQ ID NO: 700932 - RNA, 11 nt, Homo sapiens
uggaggcuucc

SEQ ID NO: 700933 - RNA, 17 nt, Homo sapiens
uggauaaaauaaaugca

SEQ ID NO: 700934 - RNA, 19 nt, Homo sapiens
uggauaaaauaaaugcaau

SEQ ID NO: 700935 - RNA, 18 nt, Homo sapiens
uggauaucaaaagcaaau

SEQ ID NO: 700936 - RNA, 19 nt, Homo sapiens
uggaugcagaaacaguuca

SEQ ID NO: 700937 - RNA, 17 nt, Homo sapiens
uggaugcggccauucaa

SEQ ID NO: 700938 - RNA, 23 nt, Homo sapiens
uggauguauggggaaucuaagag

SEQ ID NO: 700939 - RNA, 16 nt, Homo sapiens
uggauuccacacugca

SEQ ID NO: 700940 - RNA, 22 nt, Homo sapiens
uggcaaggacuuuguacauuug

SEQ ID NO: 700941 - RNA, 24 nt, Homo sapiens
uuggcuucugugaugagcugaucu

SEQ ID NO: 700942 - RNA, 16 nt, Homo sapiens
uuggggcccagugcau

SEQ ID NO: 700943 - RNA, 19 nt, Homo sapiens
uuggugugugugacaauuc

SEQ ID NO: 700944 - RNA, 14 nt, Homo sapiens
uuguaauaagcaau

SEQ ID NO: 700945 - RNA, 19 nt, Homo sapiens
uuguacaaaauuaagcaaa

SEQ ID NO: 700946 - RNA, 20 nt, Homo sapiens
uuguauaggggcaacuguau

SEQ ID NO: 700947 - RNA, 13 nt, Homo sapiens
uugucaaacugua

SEQ ID NO: 700948 - RNA, 17 nt, Homo sapiens
uugucgcucaugugugc

SEQ ID NO: 700949 - RNA, 17 nt, Homo sapiens
uugugagaaacaucuca

SEQ ID NO: 700950 - RNA, 12 nt, Homo sapiens
uuguugaacacu

SEQ ID NO: 700951 - RNA, 19 nt, Homo sapiens
uuguugcaagaugugaauu

SEQ ID NO: 700952 - RNA, 11 nt, Homo sapiens
uuguugccaug

SEQ ID NO: 700953 - RNA, 17 nt, Homo sapiens
uuguuggaaaguaacug

SEQ ID NO: 700954 - RNA, 16 nt, Homo sapiens
uuguuucugcauucau

SEQ ID NO: 700955 - RNA, 17 nt, Homo sapiens
uuguuugccaggacaug

SEQ ID NO: 700956 - RNA, 21 nt, Homo sapiens
uuuaaaaaaaaagucagagac

SEQ ID NO: 700957 - RNA, 22 nt, Homo sapiens
uuuaaaaaaaaagucagagaca

SEQ ID NO: 700958 - RNA, 13 nt, Homo sapiens
uuuaaaaaccgaa

SEQ ID NO: 700959 - RNA, 13 nt, Homo sapiens
uuuaaaugccaua

SEQ ID NO: 700960 - RNA, 14 nt, Homo sapiens
uuuaagaacuguau

SEQ ID NO: 700961 - RNA, 17 nt, Homo sapiens
uuuaagcuucaguugcu

SEQ ID NO: 700962 - RNA, 20 nt, Homo sapiens
uuuaagcuuuccuguugaau

SEQ ID NO: 700963 - RNA, 12 nt, Homo sapiens
uuuaaggcuaaa

SEQ ID NO: 700964 - RNA, 17 nt, Homo sapiens
uuuaauggcaugucaga

SEQ ID NO: 700965 - RNA, 15 nt, Homo sapiens
uuuagaauaaaucaa

SEQ ID NO: 700966 - RNA, 13 nt, Homo sapiens
uuuaggaugcuuu

SEQ ID NO: 700967 - RNA, 23 nt, Homo sapiens
uuuaguuguaaaccaagugauca

SEQ ID NO: 700968 - RNA, 18 nt, Homo sapiens
uuuauaaggcugauguca

SEQ ID NO: 700969 - RNA, 14 nt, Homo sapiens
uuuauaucaugcaa

SEQ ID NO: 700970 - RNA, 17 nt, Homo sapiens
uuuauaucaugcaaaau

SEQ ID NO: 700971 - RNA, 14 nt, Homo sapiens
uuucaaaugaucuu

SEQ ID NO: 700972 - RNA, 16 nt, Homo sapiens
uuucaacaaguaacuu

SEQ ID NO: 700973 - RNA, 15 nt, Homo sapiens
uuucaauagcacaua

SEQ ID NO: 700974 - RNA, 15 nt, Homo sapiens
uuucaauugucacuu

SEQ ID NO: 700975 - RNA, 18 nt, Homo sapiens
uuucacuuguguuuuaaa

SEQ ID NO: 700976 - RNA, 18 nt, Homo sapiens
uuucaggaguuacuggau

SEQ ID NO: 700977 - RNA, 16 nt, Homo sapiens
uuucaucuuuguggau

SEQ ID NO: 700978 - RNA, 22 nt, Homo sapiens
uuuccaguggaucauaagacaa

SEQ ID NO: 700979 - RNA, 23 nt, Homo sapiens
uuucccuaggaaacucacacucc

SEQ ID NO: 700980 - RNA, 17 nt, Homo sapiens
uuuccgugcguggcacu

SEQ ID NO: 700981 - RNA, 22 nt, Homo sapiens
uuuccucagugcauuugugcua

SEQ ID NO: 700982 - RNA, 22 nt, Homo sapiens
uuuccuggaauugccagcugac

SEQ ID NO: 700983 - RNA, 17 nt, Homo sapiens
uuuccuuuaugugaauu

SEQ ID NO: 700984 - RNA, 19 nt, Homo sapiens
uuuccuuuuugacacugaa

SEQ ID NO: 700985 - RNA, 13 nt, Homo sapiens
uuucuaaauuccu

SEQ ID NO: 700986 - RNA, 14 nt, Homo sapiens
uuucuaugugacaa

SEQ ID NO: 700987 - RNA, 20 nt, Homo sapiens
uuucugcuuuagacuugaaa

SEQ ID NO: 700988 - RNA, 16 nt, Homo sapiens
uuucuucagggcugcu

SEQ ID NO: 700989 - RNA, 14 nt, Homo sapiens
uuugaauacuaaau

SEQ ID NO: 700990 - RNA, 19 nt, Homo sapiens
uuugaauuauccacaugaa

SEQ ID NO: 700991 - RNA, 14 nt, Homo sapiens
uuugagacaggaga

SEQ ID NO: 700992 - RNA, 22 nt, Homo sapiens
uuugagcucccacuucugccag

SEQ ID NO: 700993 - RNA, 13 nt, Homo sapiens
uuugauagcacuu

SEQ ID NO: 700994 - RNA, 15 nt, Homo sapiens
uuugcaacugucucu

SEQ ID NO: 700995 - RNA, 17 nt, Homo sapiens
uuugcaugcaugcaaau

SEQ ID NO: 700996 - RNA, 14 nt, Homo sapiens
uuugcucucuggcc

SEQ ID NO: 700997 - RNA, 12 nt, Homo sapiens
uuugguacuaau

SEQ ID NO: 700998 - RNA, 17 nt, Homo sapiens
uuuguaggagacuugcc

SEQ ID NO: 700999 - RNA, 19 nt, Homo sapiens
uuugugagaaacaucucaa

SEQ ID NO: 701000 - RNA, 12 nt, Homo sapiens
uuuguuguaaaa

SEQ ID NO: 701001 - RNA, 21 nt, Homo sapiens
uuuguuucagguucaguauua

SEQ ID NO: 701002 - RNA, 18 nt, Homo sapiens
uuuguuucuuucauauga

SEQ ID NO: 701003 - RNA, 17 nt, Homo sapiens
uuuguuugccaggacau

SEQ ID NO: 701004 - RNA, 15 nt, Homo sapiens
uuuuaacugccaaga

SEQ ID NO: 701005 - RNA, 20 nt, Homo sapiens
uuuuaaggcuaaaacuuaac

SEQ ID NO: 701006 - RNA, 20 nt, Homo sapiens
uuuuauacaaaccuaccaaa

SEQ ID NO: 701007 - RNA, 17 nt, Homo sapiens
uuuucaaaauccaaaaa

SEQ ID NO: 701008 - RNA, 17 nt, Homo sapiens
uuuucaacaaguaacuu

SEQ ID NO: 701009 - RNA, 15 nt, Homo sapiens
uuuucagauccugaa

SEQ ID NO: 701010 - RNA, 14 nt, Homo sapiens
uuuuccugccaggc

SEQ ID NO: 701011 - RNA, 15 nt, Homo sapiens
uuuucucugcauuua

SEQ ID NO: 701012 - RNA, 13 nt, Homo sapiens
uuuugcaagugcu

SEQ ID NO: 701013 - RNA, 18 nt, Homo sapiens
uuuugguugggaaugagg

SEQ ID NO: 701014 - RNA, 14 nt, Homo sapiens
uuuuguugcucagu

SEQ ID NO: 701015 - RNA, 17 nt, Homo sapiens
uuuuuaauuuaguguga

SEQ ID NO: 701016 - RNA, 21 nt, Homo sapiens
uuuuucugcuuuagacuugaa

SEQ ID NO: 701017 - RNA, 12 nt, Homo sapiens
uuuuuuccacaa

SEQ ID NO: 701018 - RNA, 12 nt, Homo sapiens
aaaaaagucaga

SEQ ID NO: 701019 - RNA, 18 nt, Homo sapiens
aaaaacucaggcaaagaa

SEQ ID NO: 701020 - RNA, 19 nt, Homo sapiens
aaaaagaccuaugagcaca

SEQ ID NO: 701021 - RNA, 19 nt, Homo sapiens
aaaaagagaauauacauga

SEQ ID NO: 701022 - RNA, 15 nt, Homo sapiens
aaaaaggaguauaca

SEQ ID NO: 701023 - RNA, 23 nt, Homo sapiens
aaaaauagauaaacuauacacuu

SEQ ID NO: 701024 - RNA, 21 nt, Homo sapiens
aaaaauagccugccucuucuc

SEQ ID NO: 701025 - RNA, 20 nt, Homo sapiens
aaaaaugugccuaguuuuau

SEQ ID NO: 701026 - RNA, 17 nt, Homo sapiens
aaaacaguguguaaaca

SEQ ID NO: 701027 - RNA, 13 nt, Homo sapiens
aaaaccaccaaaa

SEQ ID NO: 701028 - RNA, 23 nt, Homo sapiens
aaaaccaccaccaucaccagaca

SEQ ID NO: 701029 - RNA, 23 nt, Homo sapiens
aaaaccccaucucuacaaaaagc

SEQ ID NO: 701030 - RNA, 15 nt, Homo sapiens
aaaaccuuuuacugg

SEQ ID NO: 701031 - RNA, 13 nt, Homo sapiens
aaaagaccuauga

SEQ ID NO: 701032 - RNA, 17 nt, Homo sapiens
aaaagagcuauugccaa

SEQ ID NO: 701033 - RNA, 17 nt, Homo sapiens
aaaagccuaaucacagu

SEQ ID NO: 701034 - RNA, 23 nt, Homo sapiens
aaaagcgcucccccgucgugcuu

SEQ ID NO: 701035 - RNA, 14 nt, Homo sapiens
aaaaggaguauaca

SEQ ID NO: 701036 - RNA, 12 nt, Homo sapiens
aaaaguaauauu

SEQ ID NO: 701037 - RNA, 21 nt, Homo sapiens
aaaagucagagacagauaccu

SEQ ID NO: 701038 - RNA, 23 nt, Homo sapiens
aaaagucagagacagauaccucc

SEQ ID NO: 701039 - RNA, 17 nt, Homo sapiens
aaaauaacaaagcccuu

SEQ ID NO: 701040 - RNA, 20 nt, Homo sapiens
aaaauaauuauaaauaucau

SEQ ID NO: 701041 - RNA, 14 nt, Homo sapiens
aaaauacauaguga

SEQ ID NO: 701042 - RNA, 13 nt, Homo sapiens
aaaauagaaacau

SEQ ID NO: 701043 - RNA, 13 nt, Homo sapiens
aaaauaguaaugu

SEQ ID NO: 701044 - RNA, 10 nt, Homo sapiens
aaaauaugcc

SEQ ID NO: 701045 - RNA, 15 nt, Homo sapiens
aaaauauuguuucug

SEQ ID NO: 701046 - RNA, 16 nt, Homo sapiens
aaaaucuaagcagcuu

SEQ ID NO: 701047 - RNA, 20 nt, Homo sapiens
aaaaugcaauguaagcauac

SEQ ID NO: 701048 - RNA, 12 nt, Homo sapiens
aaaauguucaca

SEQ ID NO: 701049 - RNA, 19 nt, Homo sapiens
aaaauuguuuagugauauu

SEQ ID NO: 701050 - RNA, 20 nt, Homo sapiens
aaacaauuguaaauuucuuu

SEQ ID NO: 701051 - RNA, 21 nt, Homo sapiens
aaacaccacuaauuguguaca

SEQ ID NO: 701052 - RNA, 20 nt, Homo sapiens
aaacagccaagauuuuccuc

SEQ ID NO: 701053 - RNA, 22 nt, Homo sapiens
aaacaggguuugauagcacuua

SEQ ID NO: 701054 - RNA, 17 nt, Homo sapiens
aaacauagcaucucagg

SEQ ID NO: 701055 - RNA, 19 nt, Homo sapiens
aaacauguuaaugacaaua

SEQ ID NO: 701056 - RNA, 18 nt, Homo sapiens
aaaccauguagcagugag

SEQ ID NO: 701057 - RNA, 10 nt, Homo sapiens
aaacccggga

SEQ ID NO: 701058 - RNA, 11 nt, Homo sapiens
aaaccuaccaa

SEQ ID NO: 701059 - RNA, 17 nt, Homo sapiens
aaacuaaagcaauagaa

SEQ ID NO: 701060 - RNA, 17 nt, Homo sapiens
aaacuaccuguauuuaa

SEQ ID NO: 701061 - RNA, 21 nt, Homo sapiens
aaacuauacacuuaaugauac

SEQ ID NO: 701062 - RNA, 12 nt, Homo sapiens
aaacucaucuga

SEQ ID NO: 701063 - RNA, 17 nt, Homo sapiens
aaacucauuggcuuaaa

SEQ ID NO: 701064 - RNA, 19 nt, Homo sapiens
aaacucuaucggagaacau

SEQ ID NO: 701065 - RNA, 23 nt, Homo sapiens
aaacugcuucccuuacuuugcug

SEQ ID NO: 701066 - RNA, 14 nt, Homo sapiens
aaacugggaugaaa

SEQ ID NO: 701067 - RNA, 23 nt, Homo sapiens
aaacugggaugaaacuaaagcaa

SEQ ID NO: 701068 - RNA, 14 nt, Homo sapiens
aaacuucauaugua

SEQ ID NO: 701069 - RNA, 19 nt, Homo sapiens
aaagaaaaauaucuuggcc

SEQ ID NO: 701070 - RNA, 18 nt, Homo sapiens
aaagaaauacaguacugu

SEQ ID NO: 701071 - RNA, 22 nt, Homo sapiens
aaagaaguaugguaaucuuuac

SEQ ID NO: 701072 - RNA, 12 nt, Homo sapiens
aaagacacugcc

SEQ ID NO: 701073 - RNA, 14 nt, Homo sapiens
aaagaccuaugagc

SEQ ID NO: 701074 - RNA, 17 nt, Homo sapiens
aaagagggcuuccucua

SEQ ID NO: 701075 - RNA, 17 nt, Homo sapiens
aaagcaucuaucucauc

SEQ ID NO: 701076 - RNA, 17 nt, Homo sapiens
aaagccuagaagagcuu

SEQ ID NO: 701077 - RNA, 17 nt, Homo sapiens
aaagcuauauaagacaa

SEQ ID NO: 701078 - RNA, 15 nt, Homo sapiens
aaagcucacuguagc

SEQ ID NO: 701079 - RNA, 16 nt, Homo sapiens
aaagcugagccugcag

SEQ ID NO: 701080 - RNA, 19 nt, Homo sapiens
aaaggaaaauaguaauguu

SEQ ID NO: 701081 - RNA, 15 nt, Homo sapiens
aaaggaggugggggc

SEQ ID NO: 701082 - RNA, 15 nt, Homo sapiens
aaaguaguccuguga

SEQ ID NO: 701083 - RNA, 16 nt, Homo sapiens
aaaguaguccugugaa

SEQ ID NO: 701084 - RNA, 17 nt, Homo sapiens
aaaguguaaguucacaa

SEQ ID NO: 701085 - RNA, 20 nt, Homo sapiens
aaauaaaaaucucuuuucca

SEQ ID NO: 701086 - RNA, 19 nt, Homo sapiens
aaauaauaaacaguggaau

SEQ ID NO: 701087 - RNA, 15 nt, Homo sapiens
aaauagaaacauauc

SEQ ID NO: 701088 - RNA, 14 nt, Homo sapiens
aaauauacauucaa

SEQ ID NO: 701089 - RNA, 16 nt, Homo sapiens
aaauauuuggaaugaa

SEQ ID NO: 701090 - RNA, 16 nt, Homo sapiens
aaauauuuuaaaggua

SEQ ID NO: 701091 - RNA, 13 nt, Homo sapiens
aaaucacuuugag

SEQ ID NO: 701092 - RNA, 14 nt, Homo sapiens
aaaucagagacaaa

SEQ ID NO: 701093 - RNA, 13 nt, Homo sapiens
aaauccaaaaaga

SEQ ID NO: 701094 - RNA, 21 nt, Homo sapiens
aaauccaaaaagaaaugaugu

SEQ ID NO: 701095 - RNA, 22 nt, Homo sapiens
aaauccaaaaagaaaugauguu

SEQ ID NO: 701096 - RNA, 21 nt, Homo sapiens
aaaucguccucccaggccagg

SEQ ID NO: 701097 - RNA, 22 nt, Homo sapiens
aaaugcaauguaagcauacuuu

SEQ ID NO: 701098 - RNA, 16 nt, Homo sapiens
aaauggaaaguaacuc

SEQ ID NO: 701099 - RNA, 15 nt, Homo sapiens
aaauggguuacuuga

SEQ ID NO: 701100 - RNA, 21 nt, Homo sapiens
aaauggucucuaacauuuccu

SEQ ID NO: 701101 - RNA, 18 nt, Homo sapiens
aaauguagcgacugucaa

SEQ ID NO: 701102 - RNA, 21 nt, Homo sapiens
aaauguaggcaucaugcaugu

SEQ ID NO: 701103 - RNA, 20 nt, Homo sapiens
aaauucagaaagucauagau

SEQ ID NO: 701104 - RNA, 20 nt, Homo sapiens
aaauucuauaggaacauaug

SEQ ID NO: 701105 - RNA, 19 nt, Homo sapiens
aaauucuucuaauugcugu

SEQ ID NO: 701106 - RNA, 11 nt, Homo sapiens
aaauugaacaa

SEQ ID NO: 701107 - RNA, 16 nt, Homo sapiens
aaauuguuuagugaua

SEQ ID NO: 701108 - RNA, 14 nt, Homo sapiens
aaauuuaauaccag

SEQ ID NO: 701109 - RNA, 23 nt, Homo sapiens
aaauuuaauguuuuuuaaacuag

SEQ ID NO: 701110 - RNA, 20 nt, Homo sapiens
aaauuuguaaaucuuauucu

SEQ ID NO: 701111 - RNA, 18 nt, Homo sapiens
aaauuuuaaaaaucuaag

SEQ ID NO: 701112 - RNA, 18 nt, Homo sapiens
aacaaacauccuugcaaa

SEQ ID NO: 701113 - RNA, 12 nt, Homo sapiens
aacaaagcccuu

SEQ ID NO: 701114 - RNA, 16 nt, Homo sapiens
aacaauggaguauucu

SEQ ID NO: 701115 - RNA, 13 nt, Homo sapiens
aacaauugguaaa

SEQ ID NO: 701116 - RNA, 19 nt, Homo sapiens
aacacauuuuuuaacuaau

SEQ ID NO: 701117 - RNA, 10 nt, Homo sapiens
aacacugcac

SEQ ID NO: 701118 - RNA, 16 nt, Homo sapiens
aacacuugaagccauc

SEQ ID NO: 701119 - RNA, 15 nt, Homo sapiens
aacauacuguucacu

SEQ ID NO: 701120 - RNA, 15 nt, Homo sapiens
aacauagcaucucag

SEQ ID NO: 701121 - RNA, 17 nt, Homo sapiens
aacauagcaucucagga

SEQ ID NO: 701122 - RNA, 14 nt, Homo sapiens
aacauagccaaaau

SEQ ID NO: 701123 - RNA, 23 nt, Homo sapiens
aacauccuggcuuuugagcacuu

SEQ ID NO: 701124 - RNA, 24 nt, Homo sapiens
aacaugaaucaaaagugccucaag

SEQ ID NO: 701125 - RNA, 19 nt, Homo sapiens
aaccaaagagggcuuccuc

SEQ ID NO: 701126 - RNA, 20 nt, Homo sapiens
aaccaaaucuggaagccaaa

SEQ ID NO: 701127 - RNA, 22 nt, Homo sapiens
aaccacuaagaauucaaacugg

SEQ ID NO: 701128 - RNA, 19 nt, Homo sapiens
aaccacuuguagauuugau

SEQ ID NO: 701129 - RNA, 18 nt, Homo sapiens
aaccaggcaccucuuccu

SEQ ID NO: 701130 - RNA, 15 nt, Homo sapiens
aaccccaaacaguga

SEQ ID NO: 701131 - RNA, 16 nt, Homo sapiens
aaccccaaacagugac

SEQ ID NO: 701132 - RNA, 16 nt, Homo sapiens
aaccccaaacuguuga

SEQ ID NO: 701133 - RNA, 13 nt, Homo sapiens
aacccccagugua

SEQ ID NO: 701134 - RNA, 15 nt, Homo sapiens
aacccccaguguaau

SEQ ID NO: 701135 - RNA, 22 nt, Homo sapiens
aaccucagggcucccagggguc

SEQ ID NO: 701136 - RNA, 21 nt, Homo sapiens
aaccucaguuauuacauguaa

SEQ ID NO: 701137 - RNA, 17 nt, Homo sapiens
aaccuuaaauauauaau

SEQ ID NO: 701138 - RNA, 14 nt, Homo sapiens
aaccuuucccucac

SEQ ID NO: 701139 - RNA, 20 nt, Homo sapiens
aacgagcauaguccaaaaag

SEQ ID NO: 701140 - RNA, 21 nt, Homo sapiens
aacgagcauaguccaaaaagc

SEQ ID NO: 701141 - RNA, 12 nt, Homo sapiens
aacuacuaaagu

SEQ ID NO: 701142 - RNA, 12 nt, Homo sapiens
aacuacuucuua

SEQ ID NO: 701143 - RNA, 12 nt, Homo sapiens
aacuacuucuuu

SEQ ID NO: 701144 - RNA, 15 nt, Homo sapiens
aacuauacacuuaau

SEQ ID NO: 701145 - RNA, 20 nt, Homo sapiens
aacucaccagccccacugcc

SEQ ID NO: 701146 - RNA, 20 nt, Homo sapiens
aacucaucugaaauguuaca

SEQ ID NO: 701147 - RNA, 20 nt, Homo sapiens
aacuccagcaacuucuucuc

SEQ ID NO: 701148 - RNA, 14 nt, Homo sapiens
aacucuuaaaaccc

SEQ ID NO: 701149 - RNA, 17 nt, Homo sapiens
aacugaaaugccugcuu

SEQ ID NO: 701150 - RNA, 14 nt, Homo sapiens
aacugucacucauu

SEQ ID NO: 701151 - RNA, 15 nt, Homo sapiens
aacugucuuccucaa

SEQ ID NO: 701152 - RNA, 17 nt, Homo sapiens
aacugucuuccucaaaa

SEQ ID NO: 701153 - RNA, 21 nt, Homo sapiens
aacuuaccacccccauacuau

SEQ ID NO: 701154 - RNA, 13 nt, Homo sapiens
aacuuagucaaua

SEQ ID NO: 701155 - RNA, 12 nt, Homo sapiens
aacuuccuucuc

SEQ ID NO: 701156 - RNA, 14 nt, Homo sapiens
aagaaaaauaucuu

SEQ ID NO: 701157 - RNA, 11 nt, Homo sapiens
auguccaaaga

SEQ ID NO: 701158 - RNA, 13 nt, Homo sapiens
auguccaggaaag

SEQ ID NO: 701159 - RNA, 22 nt, Homo sapiens
augucuccaucucugucucaaa

SEQ ID NO: 701160 - RNA, 20 nt, Homo sapiens
augugaauuauugacacuga

SEQ ID NO: 701161 - RNA, 13 nt, Homo sapiens
augugacccucca

SEQ ID NO: 701162 - RNA, 22 nt, Homo sapiens
augugacccuccaaauggagaa

SEQ ID NO: 701163 - RNA, 19 nt, Homo sapiens
augugagcucuuccuaucc

SEQ ID NO: 701164 - RNA, 17 nt, Homo sapiens
augugauggacacucca

SEQ ID NO: 701165 - RNA, 16 nt, Homo sapiens
augugcauaguuucuu

SEQ ID NO: 701166 - RNA, 16 nt, Homo sapiens
auguggauaacuuuac

SEQ ID NO: 701167 - RNA, 18 nt, Homo sapiens
auguuaccucugaauuua

SEQ ID NO: 701168 - RNA, 16 nt, Homo sapiens
auguuacucucuugca

SEQ ID NO: 701169 - RNA, 17 nt, Homo sapiens
auguuacucucuugcac

SEQ ID NO: 701170 - RNA, 23 nt, Homo sapiens
auguucuuuuaaaugauugaauu

SEQ ID NO: 701171 - RNA, 16 nt, Homo sapiens
auuaaccacuucagcu

SEQ ID NO: 701172 - RNA, 22 nt, Homo sapiens
auuaaccuuacuaauuauacua

SEQ ID NO: 701173 - RNA, 14 nt, Homo sapiens
auuaagugacuaua

SEQ ID NO: 701174 - RNA, 18 nt, Homo sapiens
auuaaucuggaauaugca

SEQ ID NO: 701175 - RNA, 14 nt, Homo sapiens
auuaauguuuucaa

SEQ ID NO: 701176 - RNA, 19 nt, Homo sapiens
auuacaaggcuuuaucuca

SEQ ID NO: 701177 - RNA, 15 nt, Homo sapiens
auuacuuguugccua

SEQ ID NO: 701178 - RNA, 20 nt, Homo sapiens
auuauacaggaaagcaauau

SEQ ID NO: 701179 - RNA, 15 nt, Homo sapiens
auuauaccucaaugu

SEQ ID NO: 701180 - RNA, 14 nt, Homo sapiens
auuauauguucaga

SEQ ID NO: 701181 - RNA, 15 nt, Homo sapiens
auuaugccacuuccu

SEQ ID NO: 701182 - RNA, 14 nt, Homo sapiens
auuauuuccagugu

SEQ ID NO: 701183 - RNA, 14 nt, Homo sapiens
auuauuugcauguu

SEQ ID NO: 701184 - RNA, 12 nt, Homo sapiens
auucaaggggag

SEQ ID NO: 701185 - RNA, 21 nt, Homo sapiens
auucagucucuucuaagcaaa

SEQ ID NO: 701186 - RNA, 18 nt, Homo sapiens
auucauaguaagauugau

SEQ ID NO: 701187 - RNA, 18 nt, Homo sapiens
auuccacacagaaugcaa

SEQ ID NO: 701188 - RNA, 19 nt, Homo sapiens
auuccuauauccugugacu

SEQ ID NO: 701189 - RNA, 18 nt, Homo sapiens
auucguacauaauacuga

SEQ ID NO: 701190 - RNA, 16 nt, Homo sapiens
auucuaguuuugucaa

SEQ ID NO: 701191 - RNA, 21 nt, Homo sapiens
auucugagccugauauugaua

SEQ ID NO: 701192 - RNA, 19 nt, Homo sapiens
auucugauuuuacauguaa

SEQ ID NO: 701193 - RNA, 22 nt, Homo sapiens
auucuggcaucuuagaccucca

SEQ ID NO: 701194 - RNA, 16 nt, Homo sapiens
auucuuuucucagugu

SEQ ID NO: 701195 - RNA, 22 nt, Homo sapiens
auugaaaauuuuuaaauauuca

SEQ ID NO: 701196 - RNA, 15 nt, Homo sapiens
auugaaguguauaau

SEQ ID NO: 701197 - RNA, 17 nt, Homo sapiens
auugcaucccaaaccac

SEQ ID NO: 701198 - RNA, 13 nt, Homo sapiens
auugccaaccagu

SEQ ID NO: 701199 - RNA, 12 nt, Homo sapiens
auugccaugugg

SEQ ID NO: 701200 - RNA, 13 nt, Homo sapiens
auugccucugaaa

SEQ ID NO: 701201 - RNA, 13 nt, Homo sapiens
auugggcaugcca

SEQ ID NO: 701202 - RNA, 19 nt, Homo sapiens
auugugccacuucacucca

SEQ ID NO: 701203 - RNA, 20 nt, Homo sapiens
auuguggucacaacuugaug

SEQ ID NO: 701204 - RNA, 22 nt, Homo sapiens
auugugugaacuuggaagcaca

SEQ ID NO: 701205 - RNA, 21 nt, Homo sapiens
auuguucuuauccucaauuca

SEQ ID NO: 701206 - RNA, 18 nt, Homo sapiens
auuguugacaacugugac

SEQ ID NO: 701207 - RNA, 19 nt, Homo sapiens
auuuaaaaaaaaagucaga

SEQ ID NO: 701208 - RNA, 17 nt, Homo sapiens
auuuaagaugugaaaau

SEQ ID NO: 701209 - RNA, 18 nt, Homo sapiens
auuuaaucuuaaucuguu

SEQ ID NO: 701210 - RNA, 16 nt, Homo sapiens
auuuaauuauuuccua

SEQ ID NO: 701211 - RNA, 16 nt, Homo sapiens
auuuagcugugcucag

SEQ ID NO: 701212 - RNA, 14 nt, Homo sapiens
auuuauauguacug

SEQ ID NO: 701213 - RNA, 14 nt, Homo sapiens
auuucacuugauga

SEQ ID NO: 701214 - RNA, 15 nt, Homo sapiens
ucucagaagcacaga

SEQ ID NO: 701215 - RNA, 16 nt, Homo sapiens
ucucagcaggcaaaga

SEQ ID NO: 701216 - RNA, 20 nt, Homo sapiens
ucucaggggccaacuaggca

SEQ ID NO: 701217 - RNA, 14 nt, Homo sapiens
ucucaucacuacag

SEQ ID NO: 701218 - RNA, 14 nt, Homo sapiens
ucuccacugugcuu

SEQ ID NO: 701219 - RNA, 18 nt, Homo sapiens
ucuccaucucugucucaa

SEQ ID NO: 701220 - RNA, 14 nt, Homo sapiens
ucuccauuugcucu

SEQ ID NO: 701221 - RNA, 18 nt, Homo sapiens
ucucccaaaaaacuacuu

SEQ ID NO: 701222 - RNA, 14 nt, Homo sapiens
ucucccauccuuga

SEQ ID NO: 701223 - RNA, 21 nt, Homo sapiens
ucuccccucagcucggcucag

SEQ ID NO: 701224 - RNA, 12 nt, Homo sapiens
ucuccugagcua

SEQ ID NO: 701225 - RNA, 21 nt, Homo sapiens
ucucuaagugggcauugccau

SEQ ID NO: 701226 - RNA, 18 nt, Homo sapiens
ucucugcuugcuuggccc

SEQ ID NO: 701227 - RNA, 15 nt, Homo sapiens
ucucugucucaaauu

SEQ ID NO: 701228 - RNA, 14 nt, Homo sapiens
ucugaaccaugugg

SEQ ID NO: 701229 - RNA, 21 nt, Homo sapiens
ucugacuaggugucaccauac

SEQ ID NO: 701230 - RNA, 20 nt, Homo sapiens
ucugagggcuuguaguucuu

SEQ ID NO: 701231 - RNA, 13 nt, Homo sapiens
ucugaucauguau

SEQ ID NO: 701232 - RNA, 21 nt, Homo sapiens
ucugcaaaggcgucugaaugu

SEQ ID NO: 701233 - RNA, 20 nt, Homo sapiens
ucugcacccagaacaguggu

SEQ ID NO: 701234 - RNA, 21 nt, Homo sapiens
ucugccauaucagugaaccuu

SEQ ID NO: 701235 - RNA, 18 nt, Homo sapiens
ucugcgucgucaccaaau

SEQ ID NO: 701236 - RNA, 16 nt, Homo sapiens
ucugcucucauauaag

SEQ ID NO: 701237 - RNA, 18 nt, Homo sapiens
ucuggaaucuggagacca

SEQ ID NO: 701238 - RNA, 18 nt, Homo sapiens
ucuggcaucuuagaccuc

SEQ ID NO: 701239 - RNA, 16 nt, Homo sapiens
ucuggucgcuccugcc

SEQ ID NO: 701240 - RNA, 18 nt, Homo sapiens
ucugugcagucacuggag

SEQ ID NO: 701241 - RNA, 17 nt, Homo sapiens
ucuguugccauggugau

SEQ ID NO: 701242 - RNA, 22 nt, Homo sapiens
ucuguuggcaggcuggccaguc

SEQ ID NO: 701243 - RNA, 20 nt, Homo sapiens
ucuuaaggacaaagugccaa

SEQ ID NO: 701244 - RNA, 13 nt, Homo sapiens
ucuuaauguuccu

SEQ ID NO: 701245 - RNA, 11 nt, Homo sapiens
ucuuacuuugu

SEQ ID NO: 701246 - RNA, 21 nt, Homo sapiens
ucuuacuuuguaaauucugau

SEQ ID NO: 701247 - RNA, 20 nt, Homo sapiens
ucuuagaagcacuacaccuu

SEQ ID NO: 701248 - RNA, 20 nt, Homo sapiens
ucuuagcacaccuacaccuc

SEQ ID NO: 701249 - RNA, 12 nt, Homo sapiens
ucuuaguuauug

SEQ ID NO: 701250 - RNA, 12 nt, Homo sapiens
ucuucaucccau

SEQ ID NO: 701251 - RNA, 14 nt, Homo sapiens
ucuuccuuuuauca

SEQ ID NO: 701252 - RNA, 16 nt, Homo sapiens
ucuucucauuacuugu

SEQ ID NO: 701253 - RNA, 18 nt, Homo sapiens
ucuucugauuugucccua

SEQ ID NO: 701254 - RNA, 20 nt, Homo sapiens
ucuugaauccuuccauucca

SEQ ID NO: 701255 - RNA, 14 nt, Homo sapiens
caaguaauugugaa

SEQ ID NO: 701256 - RNA, 19 nt, Homo sapiens
caagucacacgcuuuugaa

SEQ ID NO: 701257 - RNA, 14 nt, Homo sapiens
caagucagcuccag

SEQ ID NO: 701258 - RNA, 15 nt, Homo sapiens
caagugccuuagcaa

SEQ ID NO: 701259 - RNA, 13 nt, Homo sapiens
caaguuacaguga

SEQ ID NO: 701260 - RNA, 17 nt, Homo sapiens
caaguuacagugaugcu

SEQ ID NO: 701261 - RNA, 20 nt, Homo sapiens
caaguugagcuaugacuuaa

SEQ ID NO: 701262 - RNA, 18 nt, Homo sapiens
caaguuuuauaauccuua

SEQ ID NO: 701263 - RNA, 19 nt, Homo sapiens
caauaaacccucagagccu

SEQ ID NO: 701264 - RNA, 20 nt, Homo sapiens
caauaaagugcuuuaaaaag

SEQ ID NO: 701265 - RNA, 23 nt, Homo sapiens
caauaucuaauauauaugaauaa

SEQ ID NO: 701266 - RNA, 15 nt, Homo sapiens
caaucggcugcauug

SEQ ID NO: 701267 - RNA, 21 nt, Homo sapiens
caaucugagccagugcuuuaa

SEQ ID NO: 701268 - RNA, 14 nt, Homo sapiens
caaucuuacuuugu

SEQ ID NO: 701269 - RNA, 17 nt, Homo sapiens
caaugcuucuagaguuu

SEQ ID NO: 701270 - RNA, 15 nt, Homo sapiens
caaugguugaugaua

SEQ ID NO: 701271 - RNA, 23 nt, Homo sapiens
caauugguaaaacucacugugau

SEQ ID NO: 701272 - RNA, 14 nt, Homo sapiens
cacaaauagaguuu

SEQ ID NO: 701273 - RNA, 16 nt, Homo sapiens
cacaaguggaccuuag

SEQ ID NO: 701274 - RNA, 13 nt, Homo sapiens
cacaauaaccaag

SEQ ID NO: 701275 - RNA, 18 nt, Homo sapiens
cacacaccuguagcacuu

SEQ ID NO: 701276 - RNA, 19 nt, Homo sapiens
cacaccucuccuuugugac

SEQ ID NO: 701277 - RNA, 13 nt, Homo sapiens
cacagaaacacug

SEQ ID NO: 701278 - RNA, 14 nt, Homo sapiens
cacagaaacacugc

SEQ ID NO: 701279 - RNA, 15 nt, Homo sapiens
cacagaaacacugcc

SEQ ID NO: 701280 - RNA, 20 nt, Homo sapiens
cacagacuauuuuuagauuu

SEQ ID NO: 701281 - RNA, 19 nt, Homo sapiens
cacauacaugucacauuua

SEQ ID NO: 701282 - RNA, 15 nt, Homo sapiens
cacauuucuaugcca

SEQ ID NO: 701283 - RNA, 22 nt, Homo sapiens
caccaaaaacaaaaaccaaaug

SEQ ID NO: 701284 - RNA, 17 nt, Homo sapiens
caccaaucuuacuuugu

SEQ ID NO: 701285 - RNA, 13 nt, Homo sapiens
caccaccacuuac

SEQ ID NO: 701286 - RNA, 13 nt, Homo sapiens
caccagcagccug

SEQ ID NO: 701287 - RNA, 22 nt, Homo sapiens
cacccaacccuaucuccugaca

SEQ ID NO: 701288 - RNA, 21 nt, Homo sapiens
cacccaccuuuggaaagcucu

SEQ ID NO: 701289 - RNA, 14 nt, Homo sapiens
cacccagaacagug

SEQ ID NO: 701290 - RNA, 21 nt, Homo sapiens
caccccaagagaacucgcgcu

SEQ ID NO: 701291 - RNA, 18 nt, Homo sapiens
cacccucuccuccagugu

SEQ ID NO: 701292 - RNA, 12 nt, Homo sapiens
cacccuuucauu

SEQ ID NO: 701293 - RNA, 23 nt, Homo sapiens
caccgccuccccaccuccaggcu

SEQ ID NO: 701294 - RNA, 21 nt, Homo sapiens
caccgugaccccuguccccac

SEQ ID NO: 701295 - RNA, 19 nt, Homo sapiens
caccuagaacacuaacuca

SEQ ID NO: 701296 - RNA, 14 nt, Homo sapiens
caccucuuccuuga

SEQ ID NO: 701297 - RNA, 17 nt, Homo sapiens
caccucuuccuugaugu

SEQ ID NO: 701298 - RNA, 13 nt, Homo sapiens
caccuucuucucc

SEQ ID NO: 701299 - RNA, 13 nt, Homo sapiens
caccuugugccug

SEQ ID NO: 701300 - RNA, 17 nt, Homo sapiens
cacggcccguggcuguu

SEQ ID NO: 701301 - RNA, 20 nt, Homo sapiens
cacgugggcaaacaggcagu

SEQ ID NO: 701302 - RNA, 16 nt, Homo sapiens
cacuaaagcaugaaau

SEQ ID NO: 701303 - RNA, 20 nt, Homo sapiens
cacuauuaaguggguuugcc

SEQ ID NO: 701304 - RNA, 16 nt, Homo sapiens
cacucauuucaucuca

SEQ ID NO: 701305 - RNA, 13 nt, Homo sapiens
cacuccccuaggg

SEQ ID NO: 701306 - RNA, 19 nt, Homo sapiens
cacuccucgguacucccau

SEQ ID NO: 701307 - RNA, 21 nt, Homo sapiens
cacuccugcuuaaucuucaaa

SEQ ID NO: 701308 - RNA, 20 nt, Homo sapiens
cacugcugcuccagugcagg

SEQ ID NO: 701309 - RNA, 19 nt, Homo sapiens
cacuggagguugaagccaa

SEQ ID NO: 701310 - RNA, 17 nt, Homo sapiens
cacugggaggagucuau

SEQ ID NO: 701311 - RNA, 23 nt, Homo sapiens
cacugugaagagaaccauaucaa

SEQ ID NO: 701312 - RNA, 20 nt, Homo sapiens
cacuuaaugauacauguuuc

SEQ ID NO: 701313 - RNA, 19 nt, Homo sapiens
cacuucuaagaaaagccua

SEQ ID NO: 701314 - RNA, 12 nt, Homo sapiens
uauuuuccaaag

SEQ ID NO: 701315 - RNA, 17 nt, Homo sapiens
uauuuucuacagugguu

SEQ ID NO: 701316 - RNA, 21 nt, Homo sapiens
uauuuuuauacaaaccuacca

SEQ ID NO: 701317 - RNA, 16 nt, Homo sapiens
uauuuuucauaaacaa

SEQ ID NO: 701318 - RNA, 19 nt, Homo sapiens
ucaaaaguagaacuuugua

SEQ ID NO: 701319 - RNA, 17 nt, Homo sapiens
ucaaaagugccucaaga

SEQ ID NO: 701320 - RNA, 20 nt, Homo sapiens
ucaaaauagucuaaggccau

SEQ ID NO: 701321 - RNA, 14 nt, Homo sapiens
ucaaaaucaauuaa

SEQ ID NO: 701322 - RNA, 14 nt, Homo sapiens
ucaaagaacaaaca

SEQ ID NO: 701323 - RNA, 13 nt, Homo sapiens
ucaaagccuucuc

SEQ ID NO: 701324 - RNA, 16 nt, Homo sapiens
ucaaagucauuaaaga

SEQ ID NO: 701325 - RNA, 16 nt, Homo sapiens
ucaacaccucugcaca

SEQ ID NO: 701326 - RNA, 17 nt, Homo sapiens
ucaacagcaagugugaa

SEQ ID NO: 701327 - RNA, 16 nt, Homo sapiens
ucaagcagucgugccu

SEQ ID NO: 701328 - RNA, 19 nt, Homo sapiens
ucaaggcaguagaacucca

SEQ ID NO: 701329 - RNA, 20 nt, Homo sapiens
ucaaggcaguagaacuccag

SEQ ID NO: 701330 - RNA, 19 nt, Homo sapiens
ucaaggcaguuaauucuca

SEQ ID NO: 701331 - RNA, 17 nt, Homo sapiens
ucaaggccugcucccug

SEQ ID NO: 701332 - RNA, 13 nt, Homo sapiens
ucaaugggaccug

SEQ ID NO: 701333 - RNA, 23 nt, Homo sapiens
ucacaagaacacacacauauaca

SEQ ID NO: 701334 - RNA, 16 nt, Homo sapiens
ucaccagagacuuuag

SEQ ID NO: 701335 - RNA, 19 nt, Homo sapiens
ucaccagccccacugccag

SEQ ID NO: 701336 - RNA, 14 nt, Homo sapiens
ucacccaggaggau

SEQ ID NO: 701337 - RNA, 16 nt, Homo sapiens
ucacucacagagucaa

SEQ ID NO: 701338 - RNA, 19 nt, Homo sapiens
ucacucuaagucauguaug

SEQ ID NO: 701339 - RNA, 24 nt, Homo sapiens
ucacuggccccuacuuuguggcaa

SEQ ID NO: 701340 - RNA, 18 nt, Homo sapiens
ucacuguguauauuugau

SEQ ID NO: 701341 - RNA, 13 nt, Homo sapiens
ucagaaagucaua

SEQ ID NO: 701342 - RNA, 22 nt, Homo sapiens
ucagaaggagcuacaaaaccua

SEQ ID NO: 701343 - RNA, 16 nt, Homo sapiens
ucagaagugcccuucc

SEQ ID NO: 701344 - RNA, 20 nt, Homo sapiens
ucagaaguuaguuuguauau

SEQ ID NO: 701345 - RNA, 12 nt, Homo sapiens
ucagagacagau

SEQ ID NO: 701346 - RNA, 18 nt, Homo sapiens
ucagagacagauaccucc

SEQ ID NO: 701347 - RNA, 14 nt, Homo sapiens
ucagagaugaacau

SEQ ID NO: 701348 - RNA, 16 nt, Homo sapiens
ucaggaagccagguga

SEQ ID NO: 701349 - RNA, 12 nt, Homo sapiens
ucagguauuugu

SEQ ID NO: 701350 - RNA, 18 nt, Homo sapiens
ucaguaacugugcaucug

SEQ ID NO: 701351 - RNA, 23 nt, Homo sapiens
ucagucacauggcaugguuuugu

SEQ ID NO: 701352 - RNA, 14 nt, Homo sapiens
ucagugcaggagag

SEQ ID NO: 701353 - RNA, 23 nt, Homo sapiens
ucauaguuaaauguuaccucuga

SEQ ID NO: 701354 - RNA, 13 nt, Homo sapiens
ucauauaccagca

SEQ ID NO: 701355 - RNA, 17 nt, Homo sapiens
ucauaucaacuuaguca

SEQ ID NO: 701356 - RNA, 13 nt, Homo sapiens
gucuuuggugcuu

SEQ ID NO: 701357 - RNA, 16 nt, Homo sapiens
gugaucccguuuuccc

SEQ ID NO: 701358 - RNA, 11 nt, Homo sapiens
gugccaaaaau

SEQ ID NO: 701359 - RNA, 23 nt, Homo sapiens
gugccucuguuaccaccaccucu

SEQ ID NO: 701360 - RNA, 20 nt, Homo sapiens
gugcgugcgcaucuugccuc

SEQ ID NO: 701361 - RNA, 15 nt, Homo sapiens
gugcuucacaguaga

SEQ ID NO: 701362 - RNA, 22 nt, Homo sapiens
guggcauaaauugcaucacugu

SEQ ID NO: 701363 - RNA, 23 nt, Homo sapiens
gugggcucugugcagucacugga

SEQ ID NO: 701364 - RNA, 17 nt, Homo sapiens
gugguuccucugcucac

SEQ ID NO: 701365 - RNA, 15 nt, Homo sapiens
gugucaugccaguga

SEQ ID NO: 701366 - RNA, 22 nt, Homo sapiens
guguggacuguggcacuugccu

SEQ ID NO: 701367 - RNA, 14 nt, Homo sapiens
guguggagcuguau

SEQ ID NO: 701368 - RNA, 19 nt, Homo sapiens
gugugggggaagcaccaua

SEQ ID NO: 701369 - RNA, 15 nt, Homo sapiens
gugugugacaauucu

SEQ ID NO: 701370 - RNA, 14 nt, Homo sapiens
guguguguguauau

SEQ ID NO: 701371 - RNA, 19 nt, Homo sapiens
guguuugggaugaccagga

SEQ ID NO: 701372 - RNA, 21 nt, Homo sapiens
guuaaccccugcgcucucuuu

SEQ ID NO: 701373 - RNA, 16 nt, Homo sapiens
guuacugggcccugag

SEQ ID NO: 701374 - RNA, 17 nt, Homo sapiens
guuaugcaucauuucag

SEQ ID NO: 701375 - RNA, 15 nt, Homo sapiens
guucauugaugcugc

SEQ ID NO: 701376 - RNA, 23 nt, Homo sapiens
guucccacaccccaacacuucca

SEQ ID NO: 701377 - RNA, 21 nt, Homo sapiens
guuccgaagaagaugcuccag

SEQ ID NO: 701378 - RNA, 20 nt, Homo sapiens
guuccucccaggaagcccag

SEQ ID NO: 701379 - RNA, 23 nt, Homo sapiens
guucuggggggacccagugcaga

SEQ ID NO: 701380 - RNA, 18 nt, Homo sapiens
guugcagugaauucauau

SEQ ID NO: 701381 - RNA, 21 nt, Homo sapiens
guuggacuguaagggauugaa

SEQ ID NO: 701382 - RNA, 20 nt, Homo sapiens
guuguaaaccaagugaucaa

SEQ ID NO: 701383 - RNA, 14 nt, Homo sapiens
guuuacagacugug

SEQ ID NO: 701384 - RNA, 21 nt, Homo sapiens
guuuauuuuuuuaaaacacaa

SEQ ID NO: 701385 - RNA, 23 nt, Homo sapiens
guuucugaaaagaugguaucaua

SEQ ID NO: 701386 - RNA, 20 nt, Homo sapiens
guuugaggauuaguuuagaa

SEQ ID NO: 701387 - RNA, 22 nt, Homo sapiens
guuuuaaggacugacugaggca

SEQ ID NO: 701388 - RNA, 14 nt, Homo sapiens
guuuuacugcagcu

SEQ ID NO: 701389 - RNA, 17 nt, Homo sapiens
guuuuccaguucaucga

SEQ ID NO: 701390 - RNA, 13 nt, Homo sapiens
guuuucugacuaa

SEQ ID NO: 701391 - RNA, 14 nt, Homo sapiens
guuuuuaaacuaau

SEQ ID NO: 701392 - RNA, 14 nt, Homo sapiens
uaaaaaaucuuaau

SEQ ID NO: 701393 - RNA, 19 nt, Homo sapiens
uaaaaaccccaaacuguug

SEQ ID NO: 701394 - RNA, 16 nt, Homo sapiens
uaaaacaaaauuugac

SEQ ID NO: 701395 - RNA, 11 nt, Homo sapiens
uaaaacacuua

SEQ ID NO: 701396 - RNA, 14 nt, Homo sapiens
uaaaacauagcaaa

SEQ ID NO: 701397 - RNA, 12 nt, Homo sapiens
uaaaaccaaaga

SEQ ID NO: 701398 - RNA, 16 nt, Homo sapiens
uaaaacccaagugccu

SEQ ID NO: 701399 - RNA, 17 nt, Homo sapiens
uaaaacggugcugugag

SEQ ID NO: 701400 - RNA, 15 nt, Homo sapiens
uaaaagaaugacuau

SEQ ID NO: 701401 - RNA, 21 nt, Homo sapiens
uaaaaggaaagaaaacaucuu

SEQ ID NO: 701402 - RNA, 15 nt, Homo sapiens
uaaaauaguaugaaa

SEQ ID NO: 701403 - RNA, 14 nt, Homo sapiens
uaaaauauaucauc

SEQ ID NO: 701404 - RNA, 18 nt, Homo sapiens
uaaaauauuuaucugauu

SEQ ID NO: 701405 - RNA, 17 nt, Homo sapiens
uaaacugucgugucaua

SEQ ID NO: 701406 - RNA, 17 nt, Homo sapiens
uaaagaaaaaaauacua

SEQ ID NO: 701407 - RNA, 18 nt, Homo sapiens
uaaagaauucgguugaaa

SEQ ID NO: 701408 - RNA, 14 nt, Homo sapiens
uaaagaccugagaa

SEQ ID NO: 701409 - RNA, 16 nt, Homo sapiens
uaaaguaaaaagggaa

SEQ ID NO: 701410 - RNA, 17 nt, Homo sapiens
uaaaguaaauacaugca

SEQ ID NO: 701411 - RNA, 19 nt, Homo sapiens
uaaauaugccuaguaacac

SEQ ID NO: 701412 - RNA, 16 nt, Homo sapiens
uaaaucguccucccag

SEQ ID NO: 701413 - RNA, 14 nt, Homo sapiens
uaaauguaaacuca

SEQ ID NO: 701414 - RNA, 21 nt, Homo sapiens
uaaauguagcgacugucaaca

SEQ ID NO: 701415 - RNA, 12 nt, Homo sapiens
uaaaugugaaug

SEQ ID NO: 701416 - RNA, 18 nt, Homo sapiens
uaaauguuuggcauguaa

SEQ ID NO: 701417 - RNA, 12 nt, Homo sapiens
uaaauugcauca

SEQ ID NO: 701418 - RNA, 16 nt, Homo sapiens
uaaauugcaucacugu

SEQ ID NO: 701419 - RNA, 14 nt, Homo sapiens
uaaauuguguuucc

SEQ ID NO: 701420 - RNA, 18 nt, Homo sapiens
uaaauuuuuuuguaugaa

SEQ ID NO: 701421 - RNA, 16 nt, Homo sapiens
uaacagaaauuguaua

SEQ ID NO: 701422 - RNA, 22 nt, Homo sapiens
uaacagauggaaaaacugaggc

SEQ ID NO: 701423 - RNA, 20 nt, Homo sapiens
uaacaucaguuuuguuuacu

SEQ ID NO: 701424 - RNA, 12 nt, Homo sapiens
uaacauccagag

SEQ ID NO: 701425 - RNA, 14 nt, Homo sapiens
uaacucccagugau

SEQ ID NO: 701426 - RNA, 15 nt, Homo sapiens
uaacugauuugcaau

SEQ ID NO: 701427 - RNA, 14 nt, Homo sapiens
uaacugcauccagc

SEQ ID NO: 701428 - RNA, 14 nt, Homo sapiens
uaagaauaguagau

SEQ ID NO: 701429 - RNA, 14 nt, Homo sapiens
agugcaugguggcc

SEQ ID NO: 701430 - RNA, 12 nt, Homo sapiens
agugccaaagaa

SEQ ID NO: 701431 - RNA, 17 nt, Homo sapiens
agugccuauugauacuu

SEQ ID NO: 701432 - RNA, 19 nt, Homo sapiens
agugccucuguuaccacca

SEQ ID NO: 701433 - RNA, 20 nt, Homo sapiens
agugggagcugaguggggga

SEQ ID NO: 701434 - RNA, 13 nt, Homo sapiens
agugguuacccag

SEQ ID NO: 701435 - RNA, 15 nt, Homo sapiens
aguguaaguucacaa

SEQ ID NO: 701436 - RNA, 15 nt, Homo sapiens
aguguagacuguggc

SEQ ID NO: 701437 - RNA, 18 nt, Homo sapiens
agugucacugcuuguuau

SEQ ID NO: 701438 - RNA, 23 nt, Homo sapiens
aguguggccacgugggcaaacag

SEQ ID NO: 701439 - RNA, 17 nt, Homo sapiens
agugugggcuugaccag

SEQ ID NO: 701440 - RNA, 18 nt, Homo sapiens
aguguuauaugaacauac

SEQ ID NO: 701441 - RNA, 13 nt, Homo sapiens
aguuacaaaaacc

SEQ ID NO: 701442 - RNA, 19 nt, Homo sapiens
aguuaccacauuacucugc

SEQ ID NO: 701443 - RNA, 14 nt, Homo sapiens
aguuacugaagucu

SEQ ID NO: 701444 - RNA, 18 nt, Homo sapiens
aguuacuguguaaacuca

SEQ ID NO: 701445 - RNA, 20 nt, Homo sapiens
aguuagaauuauaucacuuc

SEQ ID NO: 701446 - RNA, 23 nt, Homo sapiens
aguuaguguuuugccucaccuaa

SEQ ID NO: 701447 - RNA, 17 nt, Homo sapiens
aguuccucccccaguuc

SEQ ID NO: 701448 - RNA, 14 nt, Homo sapiens
aguugauucagcuc

SEQ ID NO: 701449 - RNA, 15 nt, Homo sapiens
aguugauucagcucu

SEQ ID NO: 701450 - RNA, 19 nt, Homo sapiens
aguuguaccaagugaaauu

SEQ ID NO: 701451 - RNA, 16 nt, Homo sapiens
aguuuaucaugucagu

SEQ ID NO: 701452 - RNA, 13 nt, Homo sapiens
aguuucaguuugu

SEQ ID NO: 701453 - RNA, 21 nt, Homo sapiens
aguuucuuaacccuuuccaga

SEQ ID NO: 701454 - RNA, 20 nt, Homo sapiens
aguuugagacaggagaccug

SEQ ID NO: 701455 - RNA, 16 nt, Homo sapiens
aguuuguauauauuau

SEQ ID NO: 701456 - RNA, 19 nt, Homo sapiens
aguuugugagaaacaucuc

SEQ ID NO: 701457 - RNA, 14 nt, Homo sapiens
aguuuugacaagcu

SEQ ID NO: 701458 - RNA, 18 nt, Homo sapiens
aguuuugaccuaacauac

SEQ ID NO: 701459 - RNA, 21 nt, Homo sapiens
aguuuuuccuggaauugccag

SEQ ID NO: 701460 - RNA, 12 nt, Homo sapiens
auaaaaacccaa

SEQ ID NO: 701461 - RNA, 16 nt, Homo sapiens
auaaaaacccaauuca

SEQ ID NO: 701462 - RNA, 17 nt, Homo sapiens
auaaaaccccaucucua

SEQ ID NO: 701463 - RNA, 18 nt, Homo sapiens
auaaaacucugcauguag

SEQ ID NO: 701464 - RNA, 22 nt, Homo sapiens
auaaaagaaauaaaccaaagga

SEQ ID NO: 701465 - RNA, 13 nt, Homo sapiens
auaaaauaauuau

SEQ ID NO: 701466 - RNA, 21 nt, Homo sapiens
auaaaauaauuauaaauauca

SEQ ID NO: 701467 - RNA, 13 nt, Homo sapiens
auaaacacacaaa

SEQ ID NO: 701468 - RNA, 15 nt, Homo sapiens
auaaaccacugugcg

SEQ ID NO: 701469 - RNA, 18 nt, Homo sapiens
auaaacccucagagccuc

SEQ ID NO: 701470 - RNA, 19 nt, Homo sapiens
auaaagacaccugguugcu

SEQ ID NO: 701471 - RNA, 15 nt, Homo sapiens
auaaagaccugagaa

SEQ ID NO: 701472 - RNA, 17 nt, Homo sapiens
auaaagagccauaguuu

SEQ ID NO: 701473 - RNA, 21 nt, Homo sapiens
auaaagcaguauuuuucuuga

SEQ ID NO: 701474 - RNA, 18 nt, Homo sapiens
auaaaguaguccugugaa

SEQ ID NO: 701475 - RNA, 18 nt, Homo sapiens
auaaaguguaaguucaca

SEQ ID NO: 701476 - RNA, 13 nt, Homo sapiens
auaaauccaguga

SEQ ID NO: 701477 - RNA, 14 nt, Homo sapiens
auaaauccagugac

SEQ ID NO: 701478 - RNA, 15 nt, Homo sapiens
auaaauccaucacua

SEQ ID NO: 701479 - RNA, 23 nt, Homo sapiens
auaaaucguccucccaggccagg

SEQ ID NO: 701480 - RNA, 23 nt, Homo sapiens
auaagcucaguaacugugcaucu

SEQ ID NO: 701481 - RNA, 13 nt, Homo sapiens
auaagucuuucau

SEQ ID NO: 701482 - RNA, 19 nt, Homo sapiens
auaaguuauugcaguuuau

SEQ ID NO: 701483 - RNA, 16 nt, Homo sapiens
auaauaaacaguggaa

SEQ ID NO: 701484 - RNA, 17 nt, Homo sapiens
auaauacaguaucucag

SEQ ID NO: 701485 - RNA, 12 nt, Homo sapiens
auaauauacaug

SEQ ID NO: 701486 - RNA, 15 nt, Homo sapiens
auaaucaagagccuu

SEQ ID NO: 701487 - RNA, 16 nt, Homo sapiens
auaaucagucaugugu

SEQ ID NO: 701488 - RNA, 12 nt, Homo sapiens
auacaaaccuac

SEQ ID NO: 701489 - RNA, 16 nt, Homo sapiens
auacaaaugcaucuuu

SEQ ID NO: 701490 - RNA, 15 nt, Homo sapiens
auacaguaucucagg

SEQ ID NO: 701491 - RNA, 15 nt, Homo sapiens
auacauaauacauga

SEQ ID NO: 701492 - RNA, 17 nt, Homo sapiens
auacauaauacaugauu

SEQ ID NO: 701493 - RNA, 16 nt, Homo sapiens
auacaugaagcuucau

SEQ ID NO: 701494 - RNA, 17 nt, Homo sapiens
caugaggaaucugggag

SEQ ID NO: 701495 - RNA, 11 nt, Homo sapiens
caugauuuaga

SEQ ID NO: 701496 - RNA, 15 nt, Homo sapiens
caugcaaaauauguu

SEQ ID NO: 701497 - RNA, 22 nt, Homo sapiens
caugcaguugcagugaauucau

SEQ ID NO: 701498 - RNA, 12 nt, Homo sapiens
caugcuggugaa

SEQ ID NO: 701499 - RNA, 15 nt, Homo sapiens
caugcuuccuugccu

SEQ ID NO: 701500 - RNA, 23 nt, Homo sapiens
caugggagggggcuugaagccaa

SEQ ID NO: 701501 - RNA, 20 nt, Homo sapiens
cauggugaaaccccgucucu

SEQ ID NO: 701502 - RNA, 22 nt, Homo sapiens
ccuaaucuauggucgggagaca

SEQ ID NO: 701503 - RNA, 18 nt, Homo sapiens
ccuacaacucacauuaga

SEQ ID NO: 701504 - RNA, 19 nt, Homo sapiens
ccuacuagucaccagagac

SEQ ID NO: 701505 - RNA, 15 nt, Homo sapiens
ccuagccaauucaca

SEQ ID NO: 701506 - RNA, 19 nt, Homo sapiens
ccuaucuccugacagaagg

SEQ ID NO: 701507 - RNA, 21 nt, Homo sapiens
ccucaaacuuccagucaggua

SEQ ID NO: 701508 - RNA, 17 nt, Homo sapiens
ccucaagaggaaugaaa

SEQ ID NO: 701509 - RNA, 13 nt, Homo sapiens
cuaucuccugaca

SEQ ID NO: 701510 - RNA, 23 nt, Homo sapiens
cuaucuccugacagaaggugcca

SEQ ID NO: 701511 - RNA, 17 nt, Homo sapiens
cuaugaauuuucaagua

SEQ ID NO: 701512 - RNA, 23 nt, Homo sapiens
cuauucuauaaaacucugcaugu

SEQ ID NO: 701513 - RNA, 18 nt, Homo sapiens
cuauucugagaaaacaag

SEQ ID NO: 701514 - RNA, 22 nt, Homo sapiens
cuauuuaaaaaaaaagucagag

SEQ ID NO: 701515 - RNA, 20 nt, Homo sapiens
cuguaacuuccaaauaaaua

SEQ ID NO: 701516 - RNA, 23 nt, Homo sapiens
cuguagaaaugaugauguggaag

SEQ ID NO: 701517 - RNA, 21 nt, Homo sapiens
cuguagucccagcuacuuggg

SEQ ID NO: 701518 - RNA, 15 nt, Homo sapiens
cugucauaacaucca

SEQ ID NO: 701519 - RNA, 14 nt, Homo sapiens
cugucauugcacau

SEQ ID NO: 701520 - RNA, 22 nt, Homo sapiens
cugucuauuaauauucagggua

SEQ ID NO: 701521 - RNA, 16 nt, Homo sapiens
ucuugauucagucaca

SEQ ID NO: 701522 - RNA, 16 nt, Homo sapiens
ucuuggggcccagugc

SEQ ID NO: 701523 - RNA, 18 nt, Homo sapiens
ucuuggggcccagugcau

SEQ ID NO: 701524 - RNA, 15 nt, Homo sapiens
ucuuuaaccuuguau

SEQ ID NO: 701525 - RNA, 15 nt, Homo sapiens
ugaaaaacaaaaugg

SEQ ID NO: 701526 - RNA, 18 nt, Homo sapiens
ugaaaaaucggcuuacca

SEQ ID NO: 701527 - RNA, 15 nt, Homo sapiens
ugaaaacagugugua

SEQ ID NO: 701528 - RNA, 17 nt, Homo sapiens
ugaaaagaugguaucau

SEQ ID NO: 701529 - RNA, 22 nt, Homo sapiens
ugaaaagauucuucuguguuua

SEQ ID NO: 701530 - RNA, 13 nt, Homo sapiens
ugaaaagugugua

SEQ ID NO: 701531 - RNA, 19 nt, Homo sapiens
ugaaaccccaaacagugac

SEQ ID NO: 701532 - RNA, 14 nt, Homo sapiens
ugaaagcagaugag

SEQ ID NO: 701533 - RNA, 20 nt, Homo sapiens
ugaacaaagacuacuaauga

SEQ ID NO: 701534 - RNA, 21 nt, Homo sapiens
ugaacacuugaagccaucuaa

SEQ ID NO: 701535 - RNA, 17 nt, Homo sapiens
ugaacuguaguacaugg

SEQ ID NO: 701536 - RNA, 23 nt, Homo sapiens
ugaagaacugcaggcccuggccu

SEQ ID NO: 701537 - RNA, 16 nt, Homo sapiens
ugaagaagauauguga

SEQ ID NO: 701538 - RNA, 18 nt, Homo sapiens
ugaagaggguugguauaa

SEQ ID NO: 701539 - RNA, 16 nt, Homo sapiens
ugaagcaaaucagaaa

SEQ ID NO: 701540 - RNA, 23 nt, Homo sapiens
ugaagcaaaucagaaacuuguga

SEQ ID NO: 701541 - RNA, 15 nt, Homo sapiens
ugaagcuucaugcac

SEQ ID NO: 701542 - RNA, 17 nt, Homo sapiens
ugaaguggccagaugag

SEQ ID NO: 701543 - RNA, 20 nt, Homo sapiens
ugaaguuaagaaccugaaua

SEQ ID NO: 701544 - RNA, 15 nt, Homo sapiens
ugaaguuuacaauca

SEQ ID NO: 701545 - RNA, 15 nt, Homo sapiens
ugaauaaauguguug

SEQ ID NO: 701546 - RNA, 16 nt, Homo sapiens
ugaauaauacaguauc

SEQ ID NO: 701547 - RNA, 13 nt, Homo sapiens
ugaauacauuucc

SEQ ID NO: 701548 - RNA, 16 nt, Homo sapiens
ugaaucaaaagugccu

SEQ ID NO: 701549 - RNA, 17 nt, Homo sapiens
ugaauccuuccauucca

SEQ ID NO: 701550 - RNA, 13 nt, Homo sapiens
ugaaugaagucaa

SEQ ID NO: 701551 - RNA, 21 nt, Homo sapiens
ugaauuuacuuccuugcaugu

SEQ ID NO: 701552 - RNA, 19 nt, Homo sapiens
ugaauuuuuaagcugcaaa

SEQ ID NO: 701553 - RNA, 17 nt, Homo sapiens
ugacaaaguaugugguu

SEQ ID NO: 701554 - RNA, 12 nt, Homo sapiens
ugacaacauguu

SEQ ID NO: 701555 - RNA, 12 nt, Homo sapiens
ugacaacuguga

SEQ ID NO: 701556 - RNA, 17 nt, Homo sapiens
ugacagaaggugccacu

SEQ ID NO: 701557 - RNA, 15 nt, Homo sapiens
ugacccugaugaaaa

SEQ ID NO: 701558 - RNA, 14 nt, Homo sapiens
ugaccuauuuccag

SEQ ID NO: 701559 - RNA, 14 nt, Homo sapiens
ugacgcaccugugg

SEQ ID NO: 701560 - RNA, 11 nt, Homo sapiens
ugacuggugcu

SEQ ID NO: 701561 - RNA, 19 nt, Homo sapiens
ugacuuaacauagccaaaa

SEQ ID NO: 701562 - RNA, 15 nt, Homo sapiens
ugagaaacaucucaa

SEQ ID NO: 701563 - RNA, 14 nt, Homo sapiens
ugagaaauuuacua

SEQ ID NO: 701564 - RNA, 23 nt, Homo sapiens
ugagaaauuuacuacaguaguua

SEQ ID NO: 701565 - RNA, 18 nt, Homo sapiens
ugagaagccuucagcucc

SEQ ID NO: 701566 - RNA, 23 nt, Homo sapiens
ugagacaggagaccuggcacugg

SEQ ID NO: 701567 - RNA, 22 nt, Homo sapiens
ugagacuacaagugugugccac

SEQ ID NO: 701568 - RNA, 15 nt, Homo sapiens
ugagacucagugcag

SEQ ID NO: 701569 - RNA, 16 nt, Homo sapiens
ugagacucagugcaga

SEQ ID NO: 701570 - RNA, 22 nt, Homo sapiens
ugagauguguggacuguggcac

SEQ ID NO: 701571 - RNA, 20 nt, Homo sapiens
ugagcuucauauaccagcaa

SEQ ID NO: 701572 - RNA, 17 nt, Homo sapiens
ugagggcagacuggggc

SEQ ID NO: 701573 - RNA, 13 nt, Homo sapiens
ugaguaaaaucua

SEQ ID NO: 701574 - RNA, 17 nt, Homo sapiens
ugauaaguuucauacuc

SEQ ID NO: 701575 - RNA, 21 nt, Homo sapiens
ugaucaauauuuuuauaucau

SEQ ID NO: 701576 - RNA, 15 nt, Homo sapiens
ugaugcagucuuaga

SEQ ID NO: 701577 - RNA, 14 nt, Homo sapiens
ugauggacacucca

SEQ ID NO: 701578 - RNA, 20 nt, Homo sapiens
ugauguacagauucuuucag

SEQ ID NO: 701579 - RNA, 17 nt, Homo sapiens
ugauuacaaggcuuuau

SEQ ID NO: 701580 - RNA, 17 nt, Homo sapiens
ugauuggaccaggccau

SEQ ID NO: 701581 - RNA, 19 nt, Homo sapiens
ugauuucuagaacccguga

SEQ ID NO: 701582 - RNA, 18 nt, Homo sapiens
ugauuugucccuaugcau

SEQ ID NO: 701583 - RNA, 15 nt, Homo sapiens
ugauuuuuuuccaca

SEQ ID NO: 701584 - RNA, 13 nt, Homo sapiens
ugcaaccaggaac

SEQ ID NO: 701585 - RNA, 15 nt, Homo sapiens
ugcaauaacagcugc

SEQ ID NO: 701586 - RNA, 23 nt, Homo sapiens
ugcaauaccaaguauagccuaug

SEQ ID NO: 701587 - RNA, 15 nt, Homo sapiens
ugcaauguaagcaua

SEQ ID NO: 701588 - RNA, 12 nt, Homo sapiens
ugcacagccacu

SEQ ID NO: 701589 - RNA, 16 nt, Homo sapiens
ugcacaguaaaaaugg

SEQ ID NO: 701590 - RNA, 22 nt, Homo sapiens
ugcacagugaagugcuggcaac

SEQ ID NO: 701591 - RNA, 14 nt, Homo sapiens
ugcaccacugcacu

SEQ ID NO: 701592 - RNA, 15 nt, Homo sapiens
ugcacccacccagga

SEQ ID NO: 701593 - RNA, 23 nt, Homo sapiens
ugcacuaaaucagagacaaaaua

SEQ ID NO: 701594 - RNA, 16 nt, Homo sapiens
ugcacuccagccuggg

SEQ ID NO: 701595 - RNA, 21 nt, Homo sapiens
ugcacuccagccugggggaca

SEQ ID NO: 701596 - RNA, 14 nt, Homo sapiens
ugcacuuacuugcu

SEQ ID NO: 701597 - RNA, 21 nt, Homo sapiens
ugcagcaccgaggggccuuug

SEQ ID NO: 701598 - RNA, 17 nt, Homo sapiens
ugcagcccuugugaugu

SEQ ID NO: 701599 - RNA, 22 nt, Homo sapiens
ugcaggacuugagaagaccuca

SEQ ID NO: 701600 - RNA, 14 nt, Homo sapiens
ugcagucacuggag

SEQ ID NO: 701601 - RNA, 15 nt, Homo sapiens
ugcaguugcagugaa

SEQ ID NO: 701602 - RNA, 16 nt, Homo sapiens
ugcauaggaauugcac

SEQ ID NO: 701603 - RNA, 22 nt, Homo sapiens
ugcauauuauaaaggauaaaga

SEQ ID NO: 701604 - RNA, 19 nt, Homo sapiens
ugcaucguuucaucuucca

SEQ ID NO: 701605 - RNA, 11 nt, Homo sapiens
ugcauguguau

SEQ ID NO: 701606 - RNA, 15 nt, Homo sapiens
ugcaugugugugaug

SEQ ID NO: 701607 - RNA, 21 nt, Homo sapiens
ugcauuuuuguaaauguguac

SEQ ID NO: 701608 - RNA, 12 nt, Homo sapiens
ugccaaccaguu

SEQ ID NO: 701609 - RNA, 15 nt, Homo sapiens
ugccaaccggucacc

SEQ ID NO: 701610 - RNA, 21 nt, Homo sapiens
ugccaaggaaacccccagugu

SEQ ID NO: 701611 - RNA, 14 nt, Homo sapiens
ugccacugccuucg

SEQ ID NO: 701612 - RNA, 16 nt, Homo sapiens
ugccacuucuaagaaa

SEQ ID NO: 701613 - RNA, 22 nt, Homo sapiens
ugccacuucuaagaaaagccua

SEQ ID NO: 701614 - RNA, 14 nt, Homo sapiens
ugccagggccuguc

SEQ ID NO: 701615 - RNA, 15 nt, Homo sapiens
ugccauaucagugaa

SEQ ID NO: 701616 - RNA, 24 nt, Homo sapiens
ugccauaucagugaaccuuuagaa

SEQ ID NO: 701617 - RNA, 12 nt, Homo sapiens
ugccauggugau

SEQ ID NO: 701618 - RNA, 14 nt, Homo sapiens
ugccauuacauugc

SEQ ID NO: 701619 - RNA, 18 nt, Homo sapiens
ugcccagaauaaguuauu

SEQ ID NO: 701620 - RNA, 17 nt, Homo sapiens
ugcccauccugacugaa

SEQ ID NO: 701621 - RNA, 17 nt, Homo sapiens
ugcccccaccccgggga

SEQ ID NO: 701622 - RNA, 18 nt, Homo sapiens
ugcccccagccccggggu

SEQ ID NO: 701623 - RNA, 24 nt, Homo sapiens
ugcccguucuugaaauguaggcau

SEQ ID NO: 701624 - RNA, 17 nt, Homo sapiens
ugcccugugcaugccau

SEQ ID NO: 701625 - RNA, 22 nt, Homo sapiens
ugccggugagacccauggcugu

SEQ ID NO: 701626 - RNA, 15 nt, Homo sapiens
ugccgucaccaccac

SEQ ID NO: 701627 - RNA, 16 nt, Homo sapiens
ugccgucaccaccacc

SEQ ID NO: 701628 - RNA, 14 nt, Homo sapiens
ugccgucugugcuu

SEQ ID NO: 701629 - RNA, 20 nt, Homo sapiens
ugccuaaguccaguguuucu

SEQ ID NO: 701630 - RNA, 16 nt, Homo sapiens
ugccuauaagccaaaa

SEQ ID NO: 701631 - RNA, 19 nt, Homo sapiens
ugccugauccuccaacagc

SEQ ID NO: 701632 - RNA, 20 nt, Homo sapiens
ugccugauccuccaacagcu

SEQ ID NO: 701633 - RNA, 21 nt, Homo sapiens
ugccuggcguccccucccucu

SEQ ID NO: 701634 - RNA, 16 nt, Homo sapiens
ugccuguaacuugaga

SEQ ID NO: 701635 - RNA, 18 nt, Homo sapiens
ugccuuaaaaccaaagag

SEQ ID NO: 701636 - RNA, 13 nt, Homo sapiens
ugccuuuugcaac

SEQ ID NO: 701637 - RNA, 22 nt, Homo sapiens
ugccuuuuuuucucugcauuua

SEQ ID NO: 701638 - RNA, 20 nt, Homo sapiens
ugcgaagacccucuugccca

SEQ ID NO: 701639 - RNA, 12 nt, Homo sapiens
ugcuacugcacu

SEQ ID NO: 701640 - RNA, 16 nt, Homo sapiens
ugcuauccccaucucc

SEQ ID NO: 701641 - RNA, 23 nt, Homo sapiens
ugcuauuuauuuuccuaaagaga

SEQ ID NO: 701642 - RNA, 15 nt, Homo sapiens
ugcucagagacacug

SEQ ID NO: 701643 - RNA, 15 nt, Homo sapiens
ugcugauuuggugac

SEQ ID NO: 701644 - RNA, 16 nt, Homo sapiens
ugcugcuacaaugucc

SEQ ID NO: 701645 - RNA, 15 nt, Homo sapiens
ugcugcuggugcaca

SEQ ID NO: 701646 - RNA, 19 nt, Homo sapiens
ugcugcuugaggcaacuca

SEQ ID NO: 701647 - RNA, 19 nt, Homo sapiens
ugcuggauggccugaggaa

SEQ ID NO: 701648 - RNA, 22 nt, Homo sapiens
ugcuggcucugcuguccuugcc

SEQ ID NO: 701649 - RNA, 12 nt, Homo sapiens
ugcuggugcaca

SEQ ID NO: 701650 - RNA, 14 nt, Homo sapiens
ugcugucauaacau

SEQ ID NO: 701651 - RNA, 22 nt, Homo sapiens
ugcuucacaguagagccagcuu

SEQ ID NO: 701652 - RNA, 16 nt, Homo sapiens
ugcuucauuccaaucu

SEQ ID NO: 701653 - RNA, 21 nt, Homo sapiens
ugcuuccucccaacaagcagc

SEQ ID NO: 701654 - RNA, 12 nt, Homo sapiens
ugcuuccuugcc

SEQ ID NO: 701655 - RNA, 18 nt, Homo sapiens
ugcuuugaauaaaugugu

SEQ ID NO: 701656 - RNA, 13 nt, Homo sapiens
uggaaaaagccug

SEQ ID NO: 701657 - RNA, 20 nt, Homo sapiens
uggaaauuugggagagccau

SEQ ID NO: 701658 - RNA, 12 nt, Homo sapiens
uggaagaaggga

SEQ ID NO: 701659 - RNA, 21 nt, Homo sapiens
uggaaguguauuuauuuuaca

SEQ ID NO: 701660 - RNA, 18 nt, Homo sapiens
uggaaucccacuaaugca

SEQ ID NO: 701661 - RNA, 15 nt, Homo sapiens
uggaauuuugcaaag

SEQ ID NO: 701662 - RNA, 15 nt, Homo sapiens
uggacagauugccug

SEQ ID NO: 701663 - RNA, 17 nt, Homo sapiens
uggacagauugccuguu

SEQ ID NO: 701664 - RNA, 14 nt, Homo sapiens
uggaccaggccauu

SEQ ID NO: 701665 - RNA, 19 nt, Homo sapiens
uggagcccauccagucucc

SEQ ID NO: 701666 - RNA, 11 nt, Homo sapiens
uggaggggugu

SEQ ID NO: 701667 - RNA, 16 nt, Homo sapiens
uggagguugaagccaa

SEQ ID NO: 701668 - RNA, 19 nt, Homo sapiens
uggauaagugcuaccuuaa

SEQ ID NO: 701669 - RNA, 22 nt, Homo sapiens
uggaucuaccagcauaaauauc

SEQ ID NO: 701670 - RNA, 17 nt, Homo sapiens
uggaugccaaccgguca

SEQ ID NO: 701671 - RNA, 23 nt, Homo sapiens
uggaugucuccaucucugucuca

SEQ ID NO: 701672 - RNA, 20 nt, Homo sapiens
uggauguuacucucuugcac

SEQ ID NO: 701673 - RNA, 12 nt, Homo sapiens
uggcaccagcag

SEQ ID NO: 701674 - RNA, 21 nt, Homo sapiens
uggcacuaaagaauacauuua

SEQ ID NO: 701675 - RNA, 16 nt, Homo sapiens
uggcacuggaugcaga

SEQ ID NO: 701676 - RNA, 12 nt, Homo sapiens
uggcacuugccu

SEQ ID NO: 701677 - RNA, 22 nt, Homo sapiens
uggccacgugggcaaacaggca

SEQ ID NO: 701678 - RNA, 16 nt, Homo sapiens
uggccagaggugucac

SEQ ID NO: 701679 - RNA, 17 nt, Homo sapiens
uggccagaggugucacc

SEQ ID NO: 701680 - RNA, 18 nt, Homo sapiens
uggccaguccacccugcc

SEQ ID NO: 701681 - RNA, 16 nt, Homo sapiens
uggcccacgcacuucg

SEQ ID NO: 701682 - RNA, 22 nt, Homo sapiens
uggcccauggcuguugguggga

SEQ ID NO: 701683 - RNA, 16 nt, Homo sapiens
uggccuauccgcugcc

SEQ ID NO: 701684 - RNA, 18 nt, Homo sapiens
uggccucuucugagcuua

SEQ ID NO: 701685 - RNA, 19 nt, Homo sapiens
uggcgcuuagagaggacaa

SEQ ID NO: 701686 - RNA, 21 nt, Homo sapiens
uggcgcuuagagaggacaaua

SEQ ID NO: 701687 - RNA, 23 nt, Homo sapiens
uggcucagcucggggagccuuag

SEQ ID NO: 701688 - RNA, 15 nt, Homo sapiens
uggcuccaacacugc

SEQ ID NO: 701689 - RNA, 22 nt, Homo sapiens
uggcuccaggccaaagugccgg

SEQ ID NO: 701690 - RNA, 20 nt, Homo sapiens
uggcugcugucauaacaucc

SEQ ID NO: 701691 - RNA, 23 nt, Homo sapiens
uggcugcuguugcuuaaaccacu

SEQ ID NO: 701692 - RNA, 21 nt, Homo sapiens
uggcugucaaugggaccugug

SEQ ID NO: 701693 - RNA, 17 nt, Homo sapiens
uggcuuaaauaaucucu

SEQ ID NO: 701694 - RNA, 24 nt, Homo sapiens
uggcuuacacuggcaaugguaguu

SEQ ID NO: 701695 - RNA, 14 nt, Homo sapiens
uggcuucugugaug

SEQ ID NO: 701696 - RNA, 21 nt, Homo sapiens
ugggaaggggagcacaauuuc

SEQ ID NO: 701697 - RNA, 12 nt, Homo sapiens
ugggacugagau

SEQ ID NO: 701698 - RNA, 14 nt, Homo sapiens
ugggacugcuaaau

SEQ ID NO: 701699 - RNA, 18 nt, Homo sapiens
ugggagacugaagacuca

SEQ ID NO: 701700 - RNA, 21 nt, Homo sapiens
uggggauccccgccuggccag

SEQ ID NO: 701701 - RNA, 14 nt, Homo sapiens
uggggcagacaaua

SEQ ID NO: 701702 - RNA, 19 nt, Homo sapiens
uggggcaggcugggccaug

SEQ ID NO: 701703 - RNA, 23 nt, Homo sapiens
uggggggggguccuaaauguaau

SEQ ID NO: 701704 - RNA, 15 nt, Homo sapiens
ugggguaauacuucc

SEQ ID NO: 701705 - RNA, 23 nt, Homo sapiens
ugguaaacaguuuggaaaagugg

SEQ ID NO: 701706 - RNA, 13 nt, Homo sapiens
uggugaggcaaua

SEQ ID NO: 701707 - RNA, 13 nt, Homo sapiens
uggugcacugagc

SEQ ID NO: 701708 - RNA, 19 nt, Homo sapiens
ugguggcucacgccuguaa

SEQ ID NO: 701709 - RNA, 20 nt, Homo sapiens
uggugguggaaggguagaga

SEQ ID NO: 701710 - RNA, 17 nt, Homo sapiens
uggugucuccuuuacua

SEQ ID NO: 701711 - RNA, 14 nt, Homo sapiens
uguaaaaaaaccac

SEQ ID NO: 701712 - RNA, 17 nt, Homo sapiens
uguaaauacacauagca

SEQ ID NO: 701713 - RNA, 18 nt, Homo sapiens
uguaaauacacauagcau

SEQ ID NO: 701714 - RNA, 18 nt, Homo sapiens
uguaaugaaaaugaauau

SEQ ID NO: 701715 - RNA, 22 nt, Homo sapiens
uguaaugguaucuuaaagugug

SEQ ID NO: 701716 - RNA, 17 nt, Homo sapiens
uguacagacuucuuggu

SEQ ID NO: 701717 - RNA, 18 nt, Homo sapiens
uguacauguaacauuaaa

SEQ ID NO: 701718 - RNA, 22 nt, Homo sapiens
uguagagacgguguuuugccau

SEQ ID NO: 701719 - RNA, 19 nt, Homo sapiens
ugucaaaugaugugcaaaa

SEQ ID NO: 701720 - RNA, 14 nt, Homo sapiens
ugucaaugggaccu

SEQ ID NO: 701721 - RNA, 14 nt, Homo sapiens
ugucauaacaucca

SEQ ID NO: 701722 - RNA, 14 nt, Homo sapiens
uguccagcaccuug

SEQ ID NO: 701723 - RNA, 18 nt, Homo sapiens
uguccuuuuucaggagaa

SEQ ID NO: 701724 - RNA, 20 nt, Homo sapiens
ugucuaggauuuuggauguu

SEQ ID NO: 701725 - RNA, 16 nt, Homo sapiens
ugucucaaauucaugg

SEQ ID NO: 701726 - RNA, 15 nt, Homo sapiens
ugugaaguaugcacu

SEQ ID NO: 701727 - RNA, 23 nt, Homo sapiens
ugugaaugaugauccuaggcauu

SEQ ID NO: 701728 - RNA, 16 nt, Homo sapiens
ugugaauuauugacac

SEQ ID NO: 701729 - RNA, 19 nt, Homo sapiens
ugugaggcggcccugacca

SEQ ID NO: 701730 - RNA, 16 nt, Homo sapiens
ugugauguuuguccug

SEQ ID NO: 701731 - RNA, 15 nt, Homo sapiens
ugugauuacaaggcu

SEQ ID NO: 701732 - RNA, 16 nt, Homo sapiens
ugugcuucauuccaau

SEQ ID NO: 701733 - RNA, 13 nt, Homo sapiens
uguggcagugguu

SEQ ID NO: 701734 - RNA, 11 nt, Homo sapiens
uguggccacaa

SEQ ID NO: 701735 - RNA, 18 nt, Homo sapiens
uguggcuggaagauccug

SEQ ID NO: 701736 - RNA, 13 nt, Homo sapiens
ugugggacugaga

SEQ ID NO: 701737 - RNA, 17 nt, Homo sapiens
ugugggacugagaugca

SEQ ID NO: 701738 - RNA, 12 nt, Homo sapiens
ugugucagcaua

SEQ ID NO: 701739 - RNA, 11 nt, Homo sapiens
ugugugcacau

SEQ ID NO: 701740 - RNA, 13 nt, Homo sapiens
ugugugugcacau

SEQ ID NO: 701741 - RNA, 14 nt, Homo sapiens
ugugugugugcaca

SEQ ID NO: 701742 - RNA, 13 nt, Homo sapiens
ugugugugugcgu

SEQ ID NO: 701743 - RNA, 16 nt, Homo sapiens
ugugugugugugcaca

SEQ ID NO: 701744 - RNA, 15 nt, Homo sapiens
uguuacugucuucag

SEQ ID NO: 701745 - RNA, 21 nt, Homo sapiens
uguuaugcaucauuucaggag

SEQ ID NO: 701746 - RNA, 22 nt, Homo sapiens
uguuauuuucuguugaaguuua

SEQ ID NO: 701747 - RNA, 14 nt, Homo sapiens
uguuccucaaagcu

SEQ ID NO: 701748 - RNA, 23 nt, Homo sapiens
uguucuggggggacccagugcag

SEQ ID NO: 701749 - RNA, 15 nt, Homo sapiens
uguugaacacuugaa

SEQ ID NO: 701750 - RNA, 13 nt, Homo sapiens
uguuguagacuua

SEQ ID NO: 701751 - RNA, 14 nt, Homo sapiens
uguuuagugauauu

SEQ ID NO: 701752 - RNA, 16 nt, Homo sapiens
uguuucuuucauauga

SEQ ID NO: 701753 - RNA, 21 nt, Homo sapiens
uguuuuguaggagacuugcca

SEQ ID NO: 701754 - RNA, 15 nt, Homo sapiens
uuaaaaacauaacau

SEQ ID NO: 701755 - RNA, 14 nt, Homo sapiens
uuaaaaauaucaaa

SEQ ID NO: 701756 - RNA, 16 nt, Homo sapiens
uucagaggauaaauau

SEQ ID NO: 701757 - RNA, 13 nt, Homo sapiens
uucaucagaguua

SEQ ID NO: 701758 - RNA, 12 nt, Homo sapiens
uucauguaaaac

SEQ ID NO: 701759 - RNA, 20 nt, Homo sapiens
uucauuuaggaugcuuucau

SEQ ID NO: 701760 - RNA, 13 nt, Homo sapiens
uuccgcagugugg

SEQ ID NO: 701761 - RNA, 22 nt, Homo sapiens
uuccuacacguuagauuugccg

SEQ ID NO: 701762 - RNA, 20 nt, Homo sapiens
uuccuccaagcuauucaauu

SEQ ID NO: 701763 - RNA, 15 nt, Homo sapiens
uuccucccaacaagc

SEQ ID NO: 701764 - RNA, 20 nt, Homo sapiens
uuccuggcuccaacacugcu

SEQ ID NO: 701765 - RNA, 13 nt, Homo sapiens
uuccugugaucca

SEQ ID NO: 701766 - RNA, 18 nt, Homo sapiens
uuccuucuuuaaacacuc

SEQ ID NO: 701767 - RNA, 17 nt, Homo sapiens
uuccuuuaugugaauuu

SEQ ID NO: 701768 - RNA, 16 nt, Homo sapiens
uuccuuuguugcacaa

SEQ ID NO: 701769 - RNA, 17 nt, Homo sapiens
uuccuuuuugacacuga

SEQ ID NO: 701770 - RNA, 19 nt, Homo sapiens
uuccuuuuugacacugaaa

SEQ ID NO: 701771 - RNA, 20 nt, Homo sapiens
uucgagaccagccuggccaa

SEQ ID NO: 701772 - RNA, 15 nt, Homo sapiens
uucggguuggcaaaa

SEQ ID NO: 701773 - RNA, 21 nt, Homo sapiens
uucuaaagacuuguauagcau

SEQ ID NO: 701774 - RNA, 17 nt, Homo sapiens
uucuaagcaaaauugcu

SEQ ID NO: 701775 - RNA, 15 nt, Homo sapiens
uucuagucuuggcca

SEQ ID NO: 701776 - RNA, 16 nt, Homo sapiens
uucuagucuuggccag

SEQ ID NO: 701777 - RNA, 24 nt, Homo sapiens
uucuaguuuugucaaacuguagaa

SEQ ID NO: 701778 - RNA, 14 nt, Homo sapiens
uucucaacuucucu

SEQ ID NO: 701779 - RNA, 15 nt, Homo sapiens
uucucucuucuccac

SEQ ID NO: 701780 - RNA, 20 nt, Homo sapiens
uucugaaaagaugguaucau

SEQ ID NO: 701781 - RNA, 11 nt, Homo sapiens
uucugagauca

SEQ ID NO: 701782 - RNA, 22 nt, Homo sapiens
uucugauuugucccuaugcaua

SEQ ID NO: 701783 - RNA, 15 nt, Homo sapiens
uucugguucuacuuu

SEQ ID NO: 701784 - RNA, 14 nt, Homo sapiens
uucugguuggugua

SEQ ID NO: 701785 - RNA, 21 nt, Homo sapiens
uucuuaaggaagaagaguauu

SEQ ID NO: 701786 - RNA, 16 nt, Homo sapiens
uucuuacuaaaaagua

SEQ ID NO: 701787 - RNA, 16 nt, Homo sapiens
uucuucccuacaguug

SEQ ID NO: 701788 - RNA, 19 nt, Homo sapiens
uucuuucagaaagcuuuga

SEQ ID NO: 701789 - RNA, 17 nt, Homo sapiens
uugaaaaaauagaucca

SEQ ID NO: 701790 - RNA, 17 nt, Homo sapiens
uugaaaauguccaggaa

SEQ ID NO: 701791 - RNA, 21 nt, Homo sapiens
uugaaauguaggcaucaugca

SEQ ID NO: 701792 - RNA, 22 nt, Homo sapiens
gcucuucagaugccacuucuaa

SEQ ID NO: 701793 - RNA, 14 nt, Homo sapiens
gcugacaucuugaa

SEQ ID NO: 701794 - RNA, 21 nt, Homo sapiens
gcugaggcugaggcacuggcg

SEQ ID NO: 701795 - RNA, 18 nt, Homo sapiens
gcugagguuccucugccu

SEQ ID NO: 701796 - RNA, 16 nt, Homo sapiens
gcugcacccacccagg

SEQ ID NO: 701797 - RNA, 13 nt, Homo sapiens
gcugccaaggaaa

SEQ ID NO: 701798 - RNA, 21 nt, Homo sapiens
gcugccuggccuuguccucag

SEQ ID NO: 701799 - RNA, 23 nt, Homo sapiens
gcugccuucccuagcuuuagacc

SEQ ID NO: 701800 - RNA, 15 nt, Homo sapiens
gcugcuuaauaccaa

SEQ ID NO: 701801 - RNA, 20 nt, Homo sapiens
gcuggaugucuccaucucug

SEQ ID NO: 701802 - RNA, 17 nt, Homo sapiens
gcuggccucucuagcac

SEQ ID NO: 701803 - RNA, 16 nt, Homo sapiens
gcugggccauguccaa

SEQ ID NO: 701804 - RNA, 17 nt, Homo sapiens
gcugggccauguccaaa

SEQ ID NO: 701805 - RNA, 20 nt, Homo sapiens
gcugucaguaugacauuuca

SEQ ID NO: 701806 - RNA, 22 nt, Homo sapiens
gcuuaaauuucuuaugugacau

SEQ ID NO: 701807 - RNA, 16 nt, Homo sapiens
gcuuaguuuguguguu

SEQ ID NO: 701808 - RNA, 21 nt, Homo sapiens
gcuucacaguagagccagcuu

SEQ ID NO: 701809 - RNA, 16 nt, Homo sapiens
gcuucauauaccagca

SEQ ID NO: 701810 - RNA, 16 nt, Homo sapiens
gcuuccgccgucucaa

SEQ ID NO: 701811 - RNA, 10 nt, Homo sapiens
gcuuccucua

SEQ ID NO: 701812 - RNA, 15 nt, Homo sapiens
gcuucuucucaaagc

SEQ ID NO: 701813 - RNA, 14 nt, Homo sapiens
gcuucuugccucug

SEQ ID NO: 701814 - RNA, 13 nt, Homo sapiens
gcuugaagccaaa

SEQ ID NO: 701815 - RNA, 16 nt, Homo sapiens
gcuugaagccaaagaa

SEQ ID NO: 701816 - RNA, 15 nt, Homo sapiens
gcuuuagacuugaaa

SEQ ID NO: 701817 - RNA, 15 nt, Homo sapiens
gcuuucccacuuccc

SEQ ID NO: 701818 - RNA, 19 nt, Homo sapiens
gcuuugaauaaauguguug

SEQ ID NO: 701819 - RNA, 15 nt, Homo sapiens
gcuuugccauuguga

SEQ ID NO: 701820 - RNA, 19 nt, Homo sapiens
ggaaacuaguguacauuuc

SEQ ID NO: 701821 - RNA, 17 nt, Homo sapiens
ggaaacucacacucccc

SEQ ID NO: 701822 - RNA, 15 nt, Homo sapiens
ggaagacaaugugaa

SEQ ID NO: 701823 - RNA, 13 nt, Homo sapiens
ggaaguccaucug

SEQ ID NO: 701824 - RNA, 16 nt, Homo sapiens
ggaauaacuuuuacac

SEQ ID NO: 701825 - RNA, 23 nt, Homo sapiens
ggaauauauuugugugugugaua

SEQ ID NO: 701826 - RNA, 20 nt, Homo sapiens
ggaauccaagccuccacagc

SEQ ID NO: 701827 - RNA, 22 nt, Homo sapiens
ggaauccuggcagcccagagac

SEQ ID NO: 701828 - RNA, 15 nt, Homo sapiens
ggaauggugaaugaa

SEQ ID NO: 701829 - RNA, 16 nt, Homo sapiens
ggacaguaucccacau

SEQ ID NO: 701830 - RNA, 22 nt, Homo sapiens
ggacccaaggcucagucccucu

SEQ ID NO: 701831 - RNA, 13 nt, Homo sapiens
ggacccagugcag

SEQ ID NO: 701832 - RNA, 14 nt, Homo sapiens
ggacuguaagggau

SEQ ID NO: 701833 - RNA, 19 nt, Homo sapiens
ggacuguggcacuugccug

SEQ ID NO: 701834 - RNA, 15 nt, Homo sapiens
ggagaauuagauuuc

SEQ ID NO: 701835 - RNA, 22 nt, Homo sapiens
ggagccccaggggacaagggau

SEQ ID NO: 701836 - RNA, 23 nt, Homo sapiens
ggagcugggcccgacauggcucc

SEQ ID NO: 701837 - RNA, 14 nt, Homo sapiens
ggaggaugcuaaaa

SEQ ID NO: 701838 - RNA, 19 nt, Homo sapiens
ggaggcggagcuugcagug

SEQ ID NO: 701839 - RNA, 14 nt, Homo sapiens
ggaggcugcaguga

SEQ ID NO: 701840 - RNA, 24 nt, Homo sapiens
ugccucuggucgccgcacuucuga

SEQ ID NO: 701841 - RNA, 16 nt, Homo sapiens
ugccuuuugcaaccag

SEQ ID NO: 701842 - RNA, 22 nt, Homo sapiens
ugcgauuuuguuaacccagcga

SEQ ID NO: 701843 - RNA, 17 nt, Homo sapiens
ugcgucgucaccaaauc

SEQ ID NO: 701844 - RNA, 14 nt, Homo sapiens
ugcgugcgcaucuu

SEQ ID NO: 701845 - RNA, 17 nt, Homo sapiens
ugcuaacaaagacaaaa

SEQ ID NO: 701846 - RNA, 20 nt, Homo sapiens
ugcucaguguuuuugugaau

SEQ ID NO: 701847 - RNA, 14 nt, Homo sapiens
ugcuccagugcagg

SEQ ID NO: 701848 - RNA, 16 nt, Homo sapiens
ugcugcuccagugcag

SEQ ID NO: 701849 - RNA, 22 nt, Homo sapiens
ugcuggagucuccugaggacac

SEQ ID NO: 701850 - RNA, 18 nt, Homo sapiens
ugcugggggcaacuggcc

SEQ ID NO: 701851 - RNA, 14 nt, Homo sapiens
ugcuguuguucucg

SEQ ID NO: 701852 - RNA, 18 nt, Homo sapiens
ugcuuccucccaacaagc

SEQ ID NO: 701853 - RNA, 19 nt, Homo sapiens
ugcuuccucccaacaagca

SEQ ID NO: 701854 - RNA, 23 nt, Homo sapiens
ugcuuccucccaacaagcagcug

SEQ ID NO: 701855 - RNA, 14 nt, Homo sapiens
ugcuugaauugcaa

SEQ ID NO: 701856 - RNA, 19 nt, Homo sapiens
ugcuugaauugcaaggcua

SEQ ID NO: 701857 - RNA, 16 nt, Homo sapiens
ugcuugagcucaggag

SEQ ID NO: 701858 - RNA, 14 nt, Homo sapiens
uggaaaacuguguu

SEQ ID NO: 701859 - RNA, 21 nt, Homo sapiens
uggaagcacaccaaucuuacu

SEQ ID NO: 701860 - RNA, 21 nt, Homo sapiens
uggaauauaaggaaagcaaua

SEQ ID NO: 701861 - RNA, 13 nt, Homo sapiens
uggacauaucauc

SEQ ID NO: 701862 - RNA, 22 nt, Homo sapiens
uggacugaccuuguaaaagaca

SEQ ID NO: 701863 - RNA, 21 nt, Homo sapiens
uggacuguggcacuugccugg

SEQ ID NO: 701864 - RNA, 20 nt, Homo sapiens
uggagaaaugaaaacagugu

SEQ ID NO: 701865 - RNA, 22 nt, Homo sapiens
uggagcccuaaccccuuccaga

SEQ ID NO: 701866 - RNA, 19 nt, Homo sapiens
uggaggcugcagugagcug

SEQ ID NO: 701867 - RNA, 14 nt, Homo sapiens
uggauaacuuuaca

SEQ ID NO: 701868 - RNA, 15 nt, Homo sapiens
uggauaacuuuacag

SEQ ID NO: 701869 - RNA, 18 nt, Homo sapiens
uggauagaaccaccauag

SEQ ID NO: 701870 - RNA, 15 nt, Homo sapiens
uggaucuaccagcau

SEQ ID NO: 701871 - RNA, 17 nt, Homo sapiens
uggaucuaccagcauaa

SEQ ID NO: 701872 - RNA, 22 nt, Homo sapiens
uggaucuuggagaaugugagaa

SEQ ID NO: 701873 - RNA, 13 nt, Homo sapiens
uggaugcggccau

SEQ ID NO: 701874 - RNA, 17 nt, Homo sapiens
uggauuccacacugcac

SEQ ID NO: 701875 - RNA, 20 nt, Homo sapiens
uggcaauuuaacauguguau

SEQ ID NO: 701876 - RNA, 17 nt, Homo sapiens
uggcaccaggcgcugcc

SEQ ID NO: 701877 - RNA, 17 nt, Homo sapiens
uggcacuggaugcagaa

SEQ ID NO: 701878 - RNA, 23 nt, Homo sapiens
uggccagagagccuggugcugcu

SEQ ID NO: 701879 - RNA, 14 nt, Homo sapiens
uggccucucuagca

SEQ ID NO: 701880 - RNA, 19 nt, Homo sapiens
uggcuccaacacugcugcu

SEQ ID NO: 701881 - RNA, 20 nt, Homo sapiens
uggcugucaaugggaccugu

SEQ ID NO: 701882 - RNA, 19 nt, Homo sapiens
uggcuguuggugggacccg

SEQ ID NO: 701883 - RNA, 14 nt, Homo sapiens
uggcuuguucauca

SEQ ID NO: 701884 - RNA, 16 nt, Homo sapiens
ugggaaaacauuugcu

SEQ ID NO: 701885 - RNA, 12 nt, Homo sapiens
ugggaaaccaug

SEQ ID NO: 701886 - RNA, 21 nt, Homo sapiens
ugggaaagcgcggacgugcug

SEQ ID NO: 701887 - RNA, 18 nt, Homo sapiens
ugggaaggaaacaaccau

SEQ ID NO: 701888 - RNA, 18 nt, Homo sapiens
ugggacgggaugguucug

SEQ ID NO: 701889 - RNA, 18 nt, Homo sapiens
ugggaugaaacuaaagca

SEQ ID NO: 701890 - RNA, 13 nt, Homo sapiens
ugggaugagaaaa

SEQ ID NO: 701891 - RNA, 14 nt, Homo sapiens
ugggcaaugugaua

SEQ ID NO: 701892 - RNA, 14 nt, Homo sapiens
ugggccauguccaa

SEQ ID NO: 701893 - RNA, 17 nt, Homo sapiens
ugggccauguccaaaga

SEQ ID NO: 701894 - RNA, 18 nt, Homo sapiens
ugggccauguccaaagag

SEQ ID NO: 701895 - RNA, 14 nt, Homo sapiens
ugggccgggaccca

SEQ ID NO: 701896 - RNA, 15 nt, Homo sapiens
ugggccguaucuccg

SEQ ID NO: 701897 - RNA, 14 nt, Homo sapiens
ugggcucuccgggg

SEQ ID NO: 701898 - RNA, 23 nt, Homo sapiens
ugggcucugugcagucacuggag

SEQ ID NO: 701899 - RNA, 13 nt, Homo sapiens
ugggcuugaccag

SEQ ID NO: 701900 - RNA, 12 nt, Homo sapiens
ugggcuuucaua

SEQ ID NO: 701901 - RNA, 24 nt, Homo sapiens
uggggcaggcugggccauguccaa

SEQ ID NO: 701902 - RNA, 13 nt, Homo sapiens
uggggcccagugc

SEQ ID NO: 701903 - RNA, 15 nt, Homo sapiens
uggggcccagugcau

SEQ ID NO: 701904 - RNA, 18 nt, Homo sapiens
uggggccuccagaacuca

SEQ ID NO: 701905 - RNA, 21 nt, Homo sapiens
uggggcuggaugucuccaucu

SEQ ID NO: 701906 - RNA, 12 nt, Homo sapiens
uggggggaccca

SEQ ID NO: 701907 - RNA, 17 nt, Homo sapiens
ugggggguuuucuugcc

SEQ ID NO: 701908 - RNA, 21 nt, Homo sapiens
ugggguggggggggguccuaa

SEQ ID NO: 701909 - RNA, 15 nt, Homo sapiens
uggguccaugcuaac

SEQ ID NO: 701910 - RNA, 16 nt, Homo sapiens
ugggugacaaagugag

SEQ ID NO: 701911 - RNA, 18 nt, Homo sapiens
ugguaaaacucacuguga

SEQ ID NO: 701912 - RNA, 20 nt, Homo sapiens
ugguaaaacucacugugauc

SEQ ID NO: 701913 - RNA, 13 nt, Homo sapiens
ugguaaguaacug

SEQ ID NO: 701914 - RNA, 22 nt, Homo sapiens
uggucugucaaugagagcauaa

SEQ ID NO: 701915 - RNA, 22 nt, Homo sapiens
uggugccgaauugucuuuggug

SEQ ID NO: 701916 - RNA, 20 nt, Homo sapiens
ugguggcaacauucauugcc

SEQ ID NO: 701917 - RNA, 15 nt, Homo sapiens
ugguugagguuucaa

SEQ ID NO: 701918 - RNA, 16 nt, Homo sapiens
uguaaauguaaacuca

SEQ ID NO: 701919 - RNA, 14 nt, Homo sapiens
cuguagaaaugaug

SEQ ID NO: 701920 - RNA, 13 nt, Homo sapiens
cuguagaugaugu

SEQ ID NO: 701921 - RNA, 21 nt, Homo sapiens
cuguagucccagcuacucggg

SEQ ID NO: 701922 - RNA, 12 nt, Homo sapiens
cugucauaacau

SEQ ID NO: 701923 - RNA, 16 nt, Homo sapiens
cugucauaacauccag

SEQ ID NO: 701924 - RNA, 15 nt, Homo sapiens
cuguccccacacuga

SEQ ID NO: 701925 - RNA, 20 nt, Homo sapiens
cuguccugacucucuccuga

SEQ ID NO: 701926 - RNA, 15 nt, Homo sapiens
cugugauccacccaa

SEQ ID NO: 701927 - RNA, 22 nt, Homo sapiens
cugugauguuuguguauguggg

SEQ ID NO: 701928 - RNA, 19 nt, Homo sapiens
cugugcaacggucuccuga

SEQ ID NO: 701929 - RNA, 23 nt, Homo sapiens
cugugcaauagacacauacaugu

SEQ ID NO: 701930 - RNA, 15 nt, Homo sapiens
cuguggcacuugccu

SEQ ID NO: 701931 - RNA, 14 nt, Homo sapiens
cugugucucaugga

SEQ ID NO: 701932 - RNA, 15 nt, Homo sapiens
cugugugcgugcgca

SEQ ID NO: 701933 - RNA, 21 nt, Homo sapiens
cuguguugccaagcuccaagc

SEQ ID NO: 701934 - RNA, 13 nt, Homo sapiens
cuguuaauaguca

SEQ ID NO: 701935 - RNA, 19 nt, Homo sapiens
cuguuuaaucauaguuacu

SEQ ID NO: 701936 - RNA, 17 nt, Homo sapiens
cuguuugacaacauguu

SEQ ID NO: 701937 - RNA, 23 nt, Homo sapiens
cuuaaaauaaugaauacauuucc

SEQ ID NO: 701938 - RNA, 14 nt, Homo sapiens
cuuaaaauguuaac

SEQ ID NO: 701939 - RNA, 18 nt, Homo sapiens
cuuaacugcauuuuuaga

SEQ ID NO: 701940 - RNA, 21 nt, Homo sapiens
cuuaagagacacuccaaaccu

SEQ ID NO: 701941 - RNA, 15 nt, Homo sapiens
cuuaaucuguuuauu

SEQ ID NO: 701942 - RNA, 16 nt, Homo sapiens
cuuaaugauacauguu

SEQ ID NO: 701943 - RNA, 19 nt, Homo sapiens
cuuaaugucuuuaaaagua

SEQ ID NO: 701944 - RNA, 16 nt, Homo sapiens
cuuaauucacucccac

SEQ ID NO: 701945 - RNA, 23 nt, Homo sapiens
cuuaauuuccuuuuugacacuga

SEQ ID NO: 701946 - RNA, 21 nt, Homo sapiens
cuuacaagaguggacucagug

SEQ ID NO: 701947 - RNA, 20 nt, Homo sapiens
cuuacaauuggcacuaaaga

SEQ ID NO: 701948 - RNA, 16 nt, Homo sapiens
cuuacagaacuacuuc

SEQ ID NO: 701949 - RNA, 16 nt, Homo sapiens
cuuacuagaccuguaa

SEQ ID NO: 701950 - RNA, 18 nt, Homo sapiens
cuuacuagaccuguaacu

SEQ ID NO: 701951 - RNA, 15 nt, Homo sapiens
cuuagagaggacaau

SEQ ID NO: 701952 - RNA, 23 nt, Homo sapiens
cuuaggccuuccucucuccagau

SEQ ID NO: 701953 - RNA, 16 nt, Homo sapiens
cuuaguuauugcugaa

SEQ ID NO: 701954 - RNA, 18 nt, Homo sapiens
cuuaucuuacaauauuga

SEQ ID NO: 701955 - RNA, 18 nt, Homo sapiens
cuucaagagccucuggca

SEQ ID NO: 701956 - RNA, 23 nt, Homo sapiens
cuucagaagucacacauuacaaa

SEQ ID NO: 701957 - RNA, 17 nt, Homo sapiens
cuuccagaucacugcca

SEQ ID NO: 701958 - RNA, 14 nt, Homo sapiens
cuucccuaaugaag

SEQ ID NO: 701959 - RNA, 17 nt, Homo sapiens
cuuccgcaguguggcca

SEQ ID NO: 701960 - RNA, 21 nt, Homo sapiens
cuuccucccaacaagcagcug

SEQ ID NO: 701961 - RNA, 18 nt, Homo sapiens
cuuccucuagaagccaag

SEQ ID NO: 701962 - RNA, 19 nt, Homo sapiens
cuuccuugaagaacugcag

SEQ ID NO: 701963 - RNA, 16 nt, Homo sapiens
cuuccuugccugauga

SEQ ID NO: 701964 - RNA, 23 nt, Homo sapiens
cuuccuuuuauuccucacucggg

SEQ ID NO: 701965 - RNA, 18 nt, Homo sapiens
cuucuaaaaacuucucaa

SEQ ID NO: 701966 - RNA, 19 nt, Homo sapiens
cuucucagauuucugagga

SEQ ID NO: 701967 - RNA, 20 nt, Homo sapiens
cuucuccaucccucuaauga

SEQ ID NO: 701968 - RNA, 14 nt, Homo sapiens
cuucuccuacauau

SEQ ID NO: 701969 - RNA, 19 nt, Homo sapiens
cuucugaggcgcugcuuug

SEQ ID NO: 701970 - RNA, 23 nt, Homo sapiens
cuucugaggcgcugcuuugucaa

SEQ ID NO: 701971 - RNA, 24 nt, Homo sapiens
gacccuuguggguccaugcuaaca

SEQ ID NO: 701972 - RNA, 13 nt, Homo sapiens
gaccuaacauacc

SEQ ID NO: 701973 - RNA, 23 nt, Homo sapiens
gaccuauuuccagaaauacaauu

SEQ ID NO: 701974 - RNA, 12 nt, Homo sapiens
gaccuggcacug

SEQ ID NO: 701975 - RNA, 18 nt, Homo sapiens
gaccuuaggccuuccucu

SEQ ID NO: 701976 - RNA, 22 nt, Homo sapiens
gacgugcugggcggcugugcuu

SEQ ID NO: 701977 - RNA, 16 nt, Homo sapiens
gacucgguuucuccaa

SEQ ID NO: 701978 - RNA, 19 nt, Homo sapiens
gacucuggguccuuccuga

SEQ ID NO: 701979 - RNA, 17 nt, Homo sapiens
gacucuuuggacacuca

SEQ ID NO: 701980 - RNA, 16 nt, Homo sapiens
gacugaagacucagcc

SEQ ID NO: 701981 - RNA, 23 nt, Homo sapiens
gacuuagaaucccuguguuaauu

SEQ ID NO: 701982 - RNA, 18 nt, Homo sapiens
gacuuuuucaaagauuua

SEQ ID NO: 701983 - RNA, 21 nt, Homo sapiens
gagaaaaaugcuccccacagc

SEQ ID NO: 701984 - RNA, 12 nt, Homo sapiens
gagaacaggacu

SEQ ID NO: 701985 - RNA, 20 nt, Homo sapiens
gagacuccgucacaacaaca

SEQ ID NO: 701986 - RNA, 19 nt, Homo sapiens
gagacuccgucucaaaaaa

SEQ ID NO: 701987 - RNA, 17 nt, Homo sapiens
gagacuuuacauggaug

SEQ ID NO: 701988 - RNA, 18 nt, Homo sapiens
gagauguccauagucaaa

SEQ ID NO: 701989 - RNA, 19 nt, Homo sapiens
gagcaaaucaauucuaguc

SEQ ID NO: 701990 - RNA, 17 nt, Homo sapiens
gagcauaguccaaaaag

SEQ ID NO: 701991 - RNA, 21 nt, Homo sapiens
gagccucacuggggcagacaa

SEQ ID NO: 701992 - RNA, 15 nt, Homo sapiens
gagccugcagggaag

SEQ ID NO: 701993 - RNA, 15 nt, Homo sapiens
gagccugcauuuccu

SEQ ID NO: 701994 - RNA, 19 nt, Homo sapiens
gagcuaggaagagucuacc

SEQ ID NO: 701995 - RNA, 13 nt, Homo sapiens
gaggaacacugca

SEQ ID NO: 701996 - RNA, 16 nt, Homo sapiens
gaggaugaugccaguu

SEQ ID NO: 701997 - RNA, 19 nt, Homo sapiens
gaggaugaugccaguuacu

SEQ ID NO: 701998 - RNA, 21 nt, Homo sapiens
gaggcaggagaauggugugaa

SEQ ID NO: 701999 - RNA, 20 nt, Homo sapiens
gaggcaggaggaucacuuga

SEQ ID NO: 702000 - RNA, 19 nt, Homo sapiens
gaggcccugagacagggau

SEQ ID NO: 702001 - RNA, 17 nt, Homo sapiens
gaggccugaucugccca

SEQ ID NO: 702002 - RNA, 15 nt, Homo sapiens
gagggagagggaggu

SEQ ID NO: 702003 - RNA, 16 nt, Homo sapiens
gagggcagacuggggc

SEQ ID NO: 702004 - RNA, 13 nt, Homo sapiens
gagggcagcugcu

SEQ ID NO: 702005 - RNA, 23 nt, Homo sapiens
gagggcuuccucuagaagccaag

SEQ ID NO: 702006 - RNA, 20 nt, Homo sapiens
gaggucaaggcugcagugag

SEQ ID NO: 702007 - RNA, 13 nt, Homo sapiens
gaggucacuggaa

SEQ ID NO: 702008 - RNA, 14 nt, Homo sapiens
gagguugaagccaa

SEQ ID NO: 702009 - RNA, 20 nt, Homo sapiens
gagucgcaucucagugcagg

SEQ ID NO: 702010 - RNA, 19 nt, Homo sapiens
gagucugaggccguugcug

SEQ ID NO: 702011 - RNA, 14 nt, Homo sapiens
gagugcucuugcua

SEQ ID NO: 702012 - RNA, 16 nt, Homo sapiens
gaguguagacuguggc

SEQ ID NO: 702013 - RNA, 16 nt, Homo sapiens
gaguguaguuuacaga

SEQ ID NO: 702014 - RNA, 23 nt, Homo sapiens
gauaaaauuacaggauaucacau

SEQ ID NO: 702015 - RNA, 16 nt, Homo sapiens
gauaaagcaguauuug

SEQ ID NO: 702016 - RNA, 14 nt, Homo sapiens
gauaccuccaaccc

SEQ ID NO: 702017 - RNA, 19 nt, Homo sapiens
gauacugcgacuuucugcc

SEQ ID NO: 702018 - RNA, 16 nt, Homo sapiens
gauagggaacugggga

SEQ ID NO: 702019 - RNA, 16 nt, Homo sapiens
gauauauaggcuauuu

SEQ ID NO: 702020 - RNA, 16 nt, Homo sapiens
gauaucaaaagcaaau

SEQ ID NO: 702021 - RNA, 17 nt, Homo sapiens
gauaucaaaagcaaaua

SEQ ID NO: 702022 - RNA, 22 nt, Homo sapiens
gauauuauacaggaaagcaaua

SEQ ID NO: 702023 - RNA, 16 nt, Homo sapiens
gauauugaauguuaaa

SEQ ID NO: 702024 - RNA, 14 nt, Homo sapiens
gauauuggcuuaaa

SEQ ID NO: 702025 - RNA, 16 nt, Homo sapiens
gaucaaacuacauauu

SEQ ID NO: 702026 - RNA, 19 nt, Homo sapiens
gaucagccugggcaaugug

SEQ ID NO: 702027 - RNA, 17 nt, Homo sapiens
gaucaucuaauucucug

SEQ ID NO: 702028 - RNA, 20 nt, Homo sapiens
gaucaucuuuccuguuccag

SEQ ID NO: 702029 - RNA, 20 nt, Homo sapiens
gaucgugcuacugcacucca

SEQ ID NO: 702030 - RNA, 16 nt, Homo sapiens
gaucucgguuugccaa

SEQ ID NO: 702031 - RNA, 18 nt, Homo sapiens
gaugaguuuaucauguca

SEQ ID NO: 702032 - RNA, 16 nt, Homo sapiens
gaugcaggauuucuuc

SEQ ID NO: 702033 - RNA, 16 nt, Homo sapiens
gaugccagggacccac

SEQ ID NO: 702034 - RNA, 22 nt, Homo sapiens
gaugugaauuauugacacugaa

SEQ ID NO: 702035 - RNA, 16 nt, Homo sapiens
gaugugauuagugucu

SEQ ID NO: 702036 - RNA, 19 nt, Homo sapiens
gauguguuaggaaugucaa

SEQ ID NO: 702037 - RNA, 19 nt, Homo sapiens
gauguuauuagauguuaca

SEQ ID NO: 702038 - RNA, 21 nt, Homo sapiens
ccuaagaucucgguuugccaa

SEQ ID NO: 702039 - RNA, 16 nt, Homo sapiens
ccuacaccucuugaaa

SEQ ID NO: 702040 - RNA, 22 nt, Homo sapiens
ccuacgguggucggugggaccc

SEQ ID NO: 702041 - RNA, 21 nt, Homo sapiens
ccuagacucggggugcuuccu

SEQ ID NO: 702042 - RNA, 20 nt, Homo sapiens
ccuagcacuuugggaggcca

SEQ ID NO: 702043 - RNA, 22 nt, Homo sapiens
ccuaguauaucagugacaguug

SEQ ID NO: 702044 - RNA, 23 nt, Homo sapiens
ccuaguuugugagaaacaucuca

SEQ ID NO: 702045 - RNA, 13 nt, Homo sapiens
ccuaucugaccaa

SEQ ID NO: 702046 - RNA, 20 nt, Homo sapiens
ccuaucugaccaaacuggau

SEQ ID NO: 702047 - RNA, 20 nt, Homo sapiens
ccucauuagcauuuugcuaa

SEQ ID NO: 702048 - RNA, 13 nt, Homo sapiens
ccucccuuugaug

SEQ ID NO: 702049 - RNA, 19 nt, Homo sapiens
ccuccugaaccgcacagcu

SEQ ID NO: 702050 - RNA, 11 nt, Homo sapiens
ccucucuagca

SEQ ID NO: 702051 - RNA, 23 nt, Homo sapiens
ccucugaauuuacuuccuugcau

SEQ ID NO: 702052 - RNA, 19 nt, Homo sapiens
ccugaagaugggagccuuu

SEQ ID NO: 702053 - RNA, 18 nt, Homo sapiens
ccugaugaaaacauagca

SEQ ID NO: 702054 - RNA, 12 nt, Homo sapiens
ccugaugacaau

SEQ ID NO: 702055 - RNA, 21 nt, Homo sapiens
ccugcaccccugcaguuugag

SEQ ID NO: 702056 - RNA, 13 nt, Homo sapiens
ccugcccagacaa

SEQ ID NO: 702057 - RNA, 16 nt, Homo sapiens
ccugcccagacaagau

SEQ ID NO: 702058 - RNA, 17 nt, Homo sapiens
ccugccgucaccaccac

SEQ ID NO: 702059 - RNA, 19 nt, Homo sapiens
ccugccuguggcgccgucu

SEQ ID NO: 702060 - RNA, 22 nt, Homo sapiens
ccuggacaguaucccacaucca

SEQ ID NO: 702061 - RNA, 19 nt, Homo sapiens
ccuggagcccauccagucu

SEQ ID NO: 702062 - RNA, 16 nt, Homo sapiens
ccuggaucuaccagca

SEQ ID NO: 702063 - RNA, 22 nt, Homo sapiens
ccuggcacucuuguucccacac

SEQ ID NO: 702064 - RNA, 20 nt, Homo sapiens
ccuggcacuggaugcagaaa

SEQ ID NO: 702065 - RNA, 20 nt, Homo sapiens
ccuggcccacugcaucguuu

SEQ ID NO: 702066 - RNA, 18 nt, Homo sapiens
ccugggcugaccccggug

SEQ ID NO: 702067 - RNA, 12 nt, Homo sapiens
ccugggggccug

SEQ ID NO: 702068 - RNA, 12 nt, Homo sapiens
ccugguguuucu

SEQ ID NO: 702069 - RNA, 18 nt, Homo sapiens
ccuguaaucccagcacuu

SEQ ID NO: 702070 - RNA, 12 nt, Homo sapiens
ccugugacuguc

SEQ ID NO: 702071 - RNA, 22 nt, Homo sapiens
ccuuaaaauaaugaauacauuu

SEQ ID NO: 702072 - RNA, 16 nt, Homo sapiens
ccuuaauugaugcaaa

SEQ ID NO: 702073 - RNA, 20 nt, Homo sapiens
ccuuacagaacuacuucuua

SEQ ID NO: 702074 - RNA, 17 nt, Homo sapiens
ccuucagcuccagggaa

SEQ ID NO: 702075 - RNA, 20 nt, Homo sapiens
ccuuccagaucacugccaca

SEQ ID NO: 702076 - RNA, 13 nt, Homo sapiens
ccuuccauuccac

SEQ ID NO: 702077 - RNA, 17 nt, Homo sapiens
ccuuggcuucugugaug

SEQ ID NO: 702078 - RNA, 13 nt, Homo sapiens
ccuuuaugugaau

SEQ ID NO: 702079 - RNA, 22 nt, Homo sapiens
ccuuugcagcucagaaccacag

SEQ ID NO: 702080 - RNA, 16 nt, Homo sapiens
ccuuuguaagugcagg

SEQ ID NO: 702081 - RNA, 15 nt, Homo sapiens
ccuuuuaacugccaa

SEQ ID NO: 702082 - RNA, 17 nt, Homo sapiens
ccuuuugcaaccaggaa

SEQ ID NO: 702083 - RNA, 22 nt, Homo sapiens
ccuuuuuauuuauauguacugu

SEQ ID NO: 702084 - RNA, 23 nt, Homo sapiens
ccuuuuuucaaaauccaaaaaga

SEQ ID NO: 702085 - RNA, 21 nt, Homo sapiens
cgaaaccugggauucaggaau

SEQ ID NO: 702086 - RNA, 19 nt, Homo sapiens
cgacuuguuuuugcacaug

SEQ ID NO: 702087 - RNA, 14 nt, Homo sapiens
cgaggucaggagau

SEQ ID NO: 702088 - RNA, 20 nt, Homo sapiens
cgccagacagauugcugaua

SEQ ID NO: 702089 - RNA, 20 nt, Homo sapiens
cgcccaggcuggagugcagu

SEQ ID NO: 702090 - RNA, 19 nt, Homo sapiens
cgccccccgccucucccca

SEQ ID NO: 702091 - RNA, 19 nt, Homo sapiens
cgcccccuccgcccugcca

SEQ ID NO: 702092 - RNA, 20 nt, Homo sapiens
cgcccuuggcuucugugaug

SEQ ID NO: 702093 - RNA, 22 nt, Homo sapiens
agccaggccugggggcagccuc

SEQ ID NO: 702094 - RNA, 16 nt, Homo sapiens
agccagguaaugugaa

SEQ ID NO: 702095 - RNA, 11 nt, Homo sapiens
agccauccagg

SEQ ID NO: 702096 - RNA, 13 nt, Homo sapiens
agccaugccagcu

SEQ ID NO: 702097 - RNA, 18 nt, Homo sapiens
agccauucauguauguca

SEQ ID NO: 702098 - RNA, 13 nt, Homo sapiens
agcccaaucugcc

SEQ ID NO: 702099 - RNA, 21 nt, Homo sapiens
agcccaggagccucacugggg

SEQ ID NO: 702100 - RNA, 16 nt, Homo sapiens
agcccauccagucucc

SEQ ID NO: 702101 - RNA, 19 nt, Homo sapiens
agcccauccugaccagcug

SEQ ID NO: 702102 - RNA, 13 nt, Homo sapiens
agccccacugcca

SEQ ID NO: 702103 - RNA, 16 nt, Homo sapiens
agccccaggggacaag

SEQ ID NO: 702104 - RNA, 13 nt, Homo sapiens
agccccgacucca

SEQ ID NO: 702105 - RNA, 21 nt, Homo sapiens
agccgagaucgcgccacugca

SEQ ID NO: 702106 - RNA, 23 nt, Homo sapiens
agccgagaucgcgccacugcacu

SEQ ID NO: 702107 - RNA, 20 nt, Homo sapiens
agccgagauugcaccacugc

SEQ ID NO: 702108 - RNA, 17 nt, Homo sapiens
agccgccccaucugccc

SEQ ID NO: 702109 - RNA, 18 nt, Homo sapiens
agccgugaauucaguugg

SEQ ID NO: 702110 - RNA, 22 nt, Homo sapiens
agccuccacagcgagggcagcu

SEQ ID NO: 702111 - RNA, 18 nt, Homo sapiens
agccuccccgugccaaaa

SEQ ID NO: 702112 - RNA, 17 nt, Homo sapiens
agccucucaaguaauau

SEQ ID NO: 702113 - RNA, 19 nt, Homo sapiens
agccucucgaagugcugag

SEQ ID NO: 702114 - RNA, 14 nt, Homo sapiens
agccuggacccugu

SEQ ID NO: 702115 - RNA, 15 nt, Homo sapiens
agccuggacugcuac

SEQ ID NO: 702116 - RNA, 15 nt, Homo sapiens
agccugggcaaugug

SEQ ID NO: 702117 - RNA, 17 nt, Homo sapiens
agccuuaaaacaucauu

SEQ ID NO: 702118 - RNA, 21 nt, Homo sapiens
agcgaucucuccacugugcuu

SEQ ID NO: 702119 - RNA, 21 nt, Homo sapiens
agcuaccucaaacuuccaguc

SEQ ID NO: 702120 - RNA, 14 nt, Homo sapiens
agcuaugcaaaaag

SEQ ID NO: 702121 - RNA, 20 nt, Homo sapiens
agcucacucuggauuccaca

SEQ ID NO: 702122 - RNA, 17 nt, Homo sapiens
agcucaguaacugugca

SEQ ID NO: 702123 - RNA, 16 nt, Homo sapiens
agcucaucugcaaaag

SEQ ID NO: 702124 - RNA, 16 nt, Homo sapiens
agcucgguacccgggg

SEQ ID NO: 702125 - RNA, 22 nt, Homo sapiens
agcugagacuacaagugugugc

SEQ ID NO: 702126 - RNA, 16 nt, Homo sapiens
agcugccuuggcucag

SEQ ID NO: 702127 - RNA, 19 nt, Homo sapiens
agcugcuauccccaucucc

SEQ ID NO: 702128 - RNA, 23 nt, Homo sapiens
agcugcuccgaggacccaggaaa

SEQ ID NO: 702129 - RNA, 19 nt, Homo sapiens
agcuuaaugcuacauguga

SEQ ID NO: 702130 - RNA, 13 nt, Homo sapiens
agcuugcagugag

SEQ ID NO: 702131 - RNA, 19 nt, Homo sapiens
agcuuucugcuaucaaaga

SEQ ID NO: 702132 - RNA, 13 nt, Homo sapiens
aggaaacaaccau

SEQ ID NO: 702133 - RNA, 19 nt, Homo sapiens
aggaaacaagugaaagcau

SEQ ID NO: 702134 - RNA, 16 nt, Homo sapiens
aggaaacccccagugu

SEQ ID NO: 702135 - RNA, 17 nt, Homo sapiens
aggaaacccccagugua

SEQ ID NO: 702136 - RNA, 18 nt, Homo sapiens
aggaaacccccaguguaa

SEQ ID NO: 702137 - RNA, 19 nt, Homo sapiens
aggaaacccccaguguaau

SEQ ID NO: 702138 - RNA, 20 nt, Homo sapiens
aggaaacccccaguguaaua

SEQ ID NO: 702139 - RNA, 22 nt, Homo sapiens
aggaaacccccaguguaauaau

SEQ ID NO: 702140 - RNA, 13 nt, Homo sapiens
aggaaacuuugca

SEQ ID NO: 702141 - RNA, 12 nt, Homo sapiens
aggaaagugauu

SEQ ID NO: 702142 - RNA, 21 nt, Homo sapiens
aggaaagugauuuuuuuccac

SEQ ID NO: 702143 - RNA, 12 nt, Homo sapiens
aggaacacugca

SEQ ID NO: 702144 - RNA, 16 nt, Homo sapiens
aggaaccccaggagau

SEQ ID NO: 702145 - RNA, 14 nt, Homo sapiens
aggaagccagguga

SEQ ID NO: 702146 - RNA, 16 nt, Homo sapiens
aggacaauacuggggu

SEQ ID NO: 702147 - RNA, 14 nt, Homo sapiens
aggaccaagcaucu

SEQ ID NO: 702148 - RNA, 18 nt, Homo sapiens
aggacugacugaggcagu

SEQ ID NO: 702149 - RNA, 17 nt, Homo sapiens
aggacuuguuuacaaag

SEQ ID NO: 702150 - RNA, 13 nt, Homo sapiens
aggagaacaugag

SEQ ID NO: 702151 - RNA, 20 nt, Homo sapiens
aggagaccuggcacuggaug

SEQ ID NO: 702152 - RNA, 21 nt, Homo sapiens
aggagacuuuacauggaugcc

SEQ ID NO: 702153 - RNA, 16 nt, Homo sapiens
aggagauuucaugccu

SEQ ID NO: 702154 - RNA, 18 nt, Homo sapiens
aggagcagauuuuugcaa

SEQ ID NO: 702155 - RNA, 17 nt, Homo sapiens
aggagcaggcacgggug

SEQ ID NO: 702156 - RNA, 19 nt, Homo sapiens
aggagccucacuggggcag

SEQ ID NO: 702157 - RNA, 13 nt, Homo sapiens
aggaggaugcuaa

SEQ ID NO: 702158 - RNA, 21 nt, Homo sapiens
aggaggggaggaacacugcac

SEQ ID NO: 702159 - RNA, 18 nt, Homo sapiens
caggcuggucuugaacuc

SEQ ID NO: 702160 - RNA, 21 nt, Homo sapiens
cagggagacgguuuccaggga

SEQ ID NO: 702161 - RNA, 14 nt, Homo sapiens
caggggacaaggga

SEQ ID NO: 702162 - RNA, 15 nt, Homo sapiens
cagggugcagcccaa

SEQ ID NO: 702163 - RNA, 12 nt, Homo sapiens
cagggugggccu

SEQ ID NO: 702164 - RNA, 15 nt, Homo sapiens
caguagagccagcuu

SEQ ID NO: 702165 - RNA, 22 nt, Homo sapiens
caguaucuacuugcauguguau

SEQ ID NO: 702166 - RNA, 18 nt, Homo sapiens
caguauuagaugcacuua

SEQ ID NO: 702167 - RNA, 12 nt, Homo sapiens
caguccuacuca

SEQ ID NO: 702168 - RNA, 21 nt, Homo sapiens
cagugaaaaagauguacagaa

SEQ ID NO: 702169 - RNA, 23 nt, Homo sapiens
cagugaugcugugcuaugaauuu

SEQ ID NO: 702170 - RNA, 19 nt, Homo sapiens
cagugguuuuauacugaag

SEQ ID NO: 702171 - RNA, 21 nt, Homo sapiens
caguguggccaggcugccugg

SEQ ID NO: 702172 - RNA, 14 nt, Homo sapiens
caguucucccaucc

SEQ ID NO: 702173 - RNA, 18 nt, Homo sapiens
caguugcagcccuuguga

SEQ ID NO: 702174 - RNA, 20 nt, Homo sapiens
caguuuucauaguauccaua

SEQ ID NO: 702175 - RNA, 15 nt, Homo sapiens
caguuuucguagguu

SEQ ID NO: 702176 - RNA, 15 nt, Homo sapiens
cauaagaaaagauua

SEQ ID NO: 702177 - RNA, 19 nt, Homo sapiens
cauaauacugaaccacuug

SEQ ID NO: 702178 - RNA, 21 nt, Homo sapiens
cauaauuauuauuuccagugu

SEQ ID NO: 702179 - RNA, 13 nt, Homo sapiens
cauacacuuuguu

SEQ ID NO: 702180 - RNA, 22 nt, Homo sapiens
cauacuccuuuuaagcagugag

SEQ ID NO: 702181 - RNA, 13 nt, Homo sapiens
cauacuguucacu

SEQ ID NO: 702182 - RNA, 20 nt, Homo sapiens
cauaggcaccuuuuacugug

SEQ ID NO: 702183 - RNA, 13 nt, Homo sapiens
cauaguuacugug

SEQ ID NO: 702184 - RNA, 21 nt, Homo sapiens
cauaguuacuguguaaacuca

SEQ ID NO: 702185 - RNA, 16 nt, Homo sapiens
cauauaccagcaauau

SEQ ID NO: 702186 - RNA, 13 nt, Homo sapiens
cauauauauguau

SEQ ID NO: 702187 - RNA, 18 nt, Homo sapiens
cauauauuaaacauccac

SEQ ID NO: 702188 - RNA, 17 nt, Homo sapiens
cauaucagugaaccuuu

SEQ ID NO: 702189 - RNA, 21 nt, Homo sapiens
caucaaaauauuucagugaau

SEQ ID NO: 702190 - RNA, 18 nt, Homo sapiens
caucaaagaacaaacauc

SEQ ID NO: 702191 - RNA, 21 nt, Homo sapiens
caucacccucuuccugugauc

SEQ ID NO: 702192 - RNA, 19 nt, Homo sapiens
caucaguuuuguuuacuca

SEQ ID NO: 702193 - RNA, 12 nt, Homo sapiens
caucaugcaugu

SEQ ID NO: 702194 - RNA, 18 nt, Homo sapiens
cauccacaauaaccaaga

SEQ ID NO: 702195 - RNA, 13 nt, Homo sapiens
cauccugugccac

SEQ ID NO: 702196 - RNA, 21 nt, Homo sapiens
caucgauuuucuauuauggaa

SEQ ID NO: 702197 - RNA, 13 nt, Homo sapiens
caucucagugcag

SEQ ID NO: 702198 - RNA, 11 nt, Homo sapiens
caucucugucu

SEQ ID NO: 702199 - RNA, 15 nt, Homo sapiens
caucucugucucaaa

SEQ ID NO: 702200 - RNA, 12 nt, Homo sapiens
caucugcaaaag

SEQ ID NO: 702201 - RNA, 23 nt, Homo sapiens
caucuuuccuucggguuggcaaa

SEQ ID NO: 702202 - RNA, 21 nt, Homo sapiens
caugaaacuuguuucacugaa

SEQ ID NO: 702203 - RNA, 14 nt, Homo sapiens
caugaaauaaaaua

SEQ ID NO: 702204 - RNA, 14 nt, Homo sapiens
caugaacagcauua

SEQ ID NO: 702205 - RNA, 18 nt, Homo sapiens
caugagacucagugcaga

SEQ ID NO: 702206 - RNA, 20 nt, Homo sapiens
caugagacucagugcagaug

SEQ ID NO: 702207 - RNA, 17 nt, Homo sapiens
caugaugaaaccccauc

SEQ ID NO: 702208 - RNA, 14 nt, Homo sapiens
caugcaaaugagcu

SEQ ID NO: 702209 - RNA, 18 nt, Homo sapiens
cauggguaaaaauauuuc

SEQ ID NO: 702210 - RNA, 22 nt, Homo sapiens
caugguuauugaugaguuucuu

SEQ ID NO: 702211 - RNA, 22 nt, Homo sapiens
caugguuuugugccaucuguag

SEQ ID NO: 702212 - RNA, 18 nt, Homo sapiens
cauguaaauguaaacuca

SEQ ID NO: 702213 - RNA, 17 nt, Homo sapiens
cauguaagcucuuugag

SEQ ID NO: 702214 - RNA, 21 nt, Homo sapiens
cauguagcccccuggccucug

SEQ ID NO: 702215 - RNA, 21 nt, Homo sapiens
cauguaugucagaagugcaga

SEQ ID NO: 702216 - RNA, 19 nt, Homo sapiens
caugucauuucagaaguua

SEQ ID NO: 702217 - RNA, 14 nt, Homo sapiens
cauguguauacaua

SEQ ID NO: 702218 - RNA, 18 nt, Homo sapiens
cauguuuuguugcucagu

SEQ ID NO: 702219 - RNA, 15 nt, Homo sapiens
acuggauagaaccac

SEQ ID NO: 702220 - RNA, 23 nt, Homo sapiens
acugggcucccgggccccacaga

SEQ ID NO: 702221 - RNA, 23 nt, Homo sapiens
acuggggccuccagaacucacug

SEQ ID NO: 702222 - RNA, 14 nt, Homo sapiens
acuguaagggauug

SEQ ID NO: 702223 - RNA, 23 nt, Homo sapiens
acuguagaaaugaugauguggaa

SEQ ID NO: 702224 - RNA, 19 nt, Homo sapiens
acuguccuguccugcucau

SEQ ID NO: 702225 - RNA, 16 nt, Homo sapiens
acugucucucuucuca

SEQ ID NO: 702226 - RNA, 22 nt, Homo sapiens
acuguguuguaccaaaauucau

SEQ ID NO: 702227 - RNA, 16 nt, Homo sapiens
acuguucacucacucu

SEQ ID NO: 702228 - RNA, 17 nt, Homo sapiens
acuguuuauuacuucca

SEQ ID NO: 702229 - RNA, 21 nt, Homo sapiens
acuuaaauaauaaacagugga

SEQ ID NO: 702230 - RNA, 17 nt, Homo sapiens
acuuaacauagccaaaa

SEQ ID NO: 702231 - RNA, 17 nt, Homo sapiens
acuucauauguaaucuc

SEQ ID NO: 702232 - RNA, 14 nt, Homo sapiens
acuucccuaaugaa

SEQ ID NO: 702233 - RNA, 16 nt, Homo sapiens
acuucccuaaugaagu

SEQ ID NO: 702234 - RNA, 12 nt, Homo sapiens
acuuccuugcau

SEQ ID NO: 702235 - RNA, 21 nt, Homo sapiens
acuuccuuuuaacugccaaga

SEQ ID NO: 702236 - RNA, 22 nt, Homo sapiens
acuucuaagaaaagccuaauca

SEQ ID NO: 702237 - RNA, 19 nt, Homo sapiens
acuucuugguacccaguca

SEQ ID NO: 702238 - RNA, 14 nt, Homo sapiens
acuugaagccaucu

SEQ ID NO: 702239 - RNA, 18 nt, Homo sapiens
acuugaccuaaacuucua

SEQ ID NO: 702240 - RNA, 20 nt, Homo sapiens
acuugggccacugugaagag

SEQ ID NO: 702241 - RNA, 22 nt, Homo sapiens
acuuguugccuauaagccaaaa

SEQ ID NO: 702242 - RNA, 14 nt, Homo sapiens
acuuuauaaaucca

SEQ ID NO: 702243 - RNA, 15 nt, Homo sapiens
acuuuauaaauccag

SEQ ID NO: 702244 - RNA, 18 nt, Homo sapiens
acuuuauaaauccaguga

SEQ ID NO: 702245 - RNA, 23 nt, Homo sapiens
acuuugggggaggagaacaugag

SEQ ID NO: 702246 - RNA, 14 nt, Homo sapiens
acuuuguacauuug

SEQ ID NO: 702247 - RNA, 15 nt, Homo sapiens
acuuuguauuuugau

SEQ ID NO: 702248 - RNA, 18 nt, Homo sapiens
acuuuuaaaaacauaaca

SEQ ID NO: 702249 - RNA, 16 nt, Homo sapiens
acuuuuguguaaugaa

SEQ ID NO: 702250 - RNA, 17 nt, Homo sapiens
agaaaaaaagagugaaa

SEQ ID NO: 702251 - RNA, 16 nt, Homo sapiens
agaaaagaacuggaaa

SEQ ID NO: 702252 - RNA, 14 nt, Homo sapiens
agaaaagaccuuuu

SEQ ID NO: 702253 - RNA, 20 nt, Homo sapiens
agaaacaaacuccauuacuc

SEQ ID NO: 702254 - RNA, 16 nt, Homo sapiens
agaaacaacacaguuu

SEQ ID NO: 702255 - RNA, 14 nt, Homo sapiens
agaaacacugccuu

SEQ ID NO: 702256 - RNA, 20 nt, Homo sapiens
agaaacuuauuucucauauc

SEQ ID NO: 702257 - RNA, 14 nt, Homo sapiens
agaaagcaugauau

SEQ ID NO: 702258 - RNA, 19 nt, Homo sapiens
agaaauacaguacuguuuc

SEQ ID NO: 702259 - RNA, 20 nt, Homo sapiens
agaaaugaggaggaugcuaa

SEQ ID NO: 702260 - RNA, 15 nt, Homo sapiens
agaaauuauaaacaa

SEQ ID NO: 702261 - RNA, 14 nt, Homo sapiens
agaacacuaacuca

SEQ ID NO: 702262 - RNA, 23 nt, Homo sapiens
agaacaggccucuccauuugcuc

SEQ ID NO: 702263 - RNA, 23 nt, Homo sapiens
agaaccaccauagugaaguguga

SEQ ID NO: 702264 - RNA, 16 nt, Homo sapiens
agaacgaaccuuggcc

SEQ ID NO: 702265 - RNA, 16 nt, Homo sapiens
agaacuccaauacuca

SEQ ID NO: 702266 - RNA, 23 nt, Homo sapiens
agaagucugucugucugaugaug

SEQ ID NO: 702267 - RNA, 20 nt, Homo sapiens
agaaguuuggcugcugucau

SEQ ID NO: 702268 - RNA, 17 nt, Homo sapiens
agaauaagaauuugcau

SEQ ID NO: 702269 - RNA, 13 nt, Homo sapiens
agaauaugacuuu

SEQ ID NO: 702270 - RNA, 16 nt, Homo sapiens
agaauuagauuucuau

SEQ ID NO: 702271 - RNA, 17 nt, Homo sapiens
agaauucagacaucuga

SEQ ID NO: 702272 - RNA, 13 nt, Homo sapiens
agacaauaaaccc

SEQ ID NO: 702273 - RNA, 14 nt, Homo sapiens
agacaauaaacccu

SEQ ID NO: 702274 - RNA, 12 nt, Homo sapiens
agacaccugguu

SEQ ID NO: 702275 - RNA, 22 nt, Homo sapiens
agacacggagcccagcccuccc

SEQ ID NO: 702276 - RNA, 14 nt, Homo sapiens
agacagauaccucc

SEQ ID NO: 702277 - RNA, 15 nt, Homo sapiens
agacagauaccucca

SEQ ID NO: 702278 - RNA, 22 nt, Homo sapiens
agacagauaccuccaacccugc

SEQ ID NO: 702279 - RNA, 14 nt, Homo sapiens
agacagauugcuga

SEQ ID NO: 702280 - RNA, 14 nt, Homo sapiens
agacagccaaaggc

SEQ ID NO: 702281 - RNA, 22 nt, Homo sapiens
agacagguccugauuucuagaa

SEQ ID NO: 702282 - RNA, 14 nt, Homo sapiens
agacaguguaugua

SEQ ID NO: 702283 - RNA, 21 nt, Homo sapiens
agaccacgcccguccugccug

SEQ ID NO: 702284 - RNA, 20 nt, Homo sapiens
agaccgugaagauacuuugu

SEQ ID NO: 702285 - RNA, 15 nt, Homo sapiens
agaccugagaaccuu

SEQ ID NO: 702286 - RNA, 15 nt, Homo sapiens
aaggacaaagugcca

SEQ ID NO: 702287 - RNA, 17 nt, Homo sapiens
aaggacaaagugccaaa

SEQ ID NO: 702288 - RNA, 19 nt, Homo sapiens
aaggacaaagugccaaaga

SEQ ID NO: 702289 - RNA, 14 nt, Homo sapiens
aaggcaacugugag

SEQ ID NO: 702290 - RNA, 16 nt, Homo sapiens
aaggcauuuucaucuu

SEQ ID NO: 702291 - RNA, 22 nt, Homo sapiens
aagggaacaaguugagcuauga

SEQ ID NO: 702292 - RNA, 17 nt, Homo sapiens
aagggccugcccagaca

SEQ ID NO: 702293 - RNA, 13 nt, Homo sapiens
aaggucacuguuu

SEQ ID NO: 702294 - RNA, 17 nt, Homo sapiens
aaggugaguuugagcug

SEQ ID NO: 702295 - RNA, 12 nt, Homo sapiens
aaggugccacuu

SEQ ID NO: 702296 - RNA, 14 nt, Homo sapiens
aaggugccacuuua

SEQ ID NO: 702297 - RNA, 14 nt, Homo sapiens
aaguaaucaucuaa

SEQ ID NO: 702298 - RNA, 13 nt, Homo sapiens
aaguaaugaauuu

SEQ ID NO: 702299 - RNA, 15 nt, Homo sapiens
aaguagaacuuugua

SEQ ID NO: 702300 - RNA, 19 nt, Homo sapiens
aaguagaucuuuucuugac

SEQ ID NO: 702301 - RNA, 22 nt, Homo sapiens
aaguagauuagaaaacuagauu

SEQ ID NO: 702302 - RNA, 19 nt, Homo sapiens
aaguauauaauccugugaa

SEQ ID NO: 702303 - RNA, 21 nt, Homo sapiens
aagucacacgcuuuugaauua

SEQ ID NO: 702304 - RNA, 13 nt, Homo sapiens
aagucauagccau

SEQ ID NO: 702305 - RNA, 22 nt, Homo sapiens
aagucuuaaggacaaagugcca

SEQ ID NO: 702306 - RNA, 20 nt, Homo sapiens
aagugagacccugucucaaa

SEQ ID NO: 702307 - RNA, 18 nt, Homo sapiens
aagugcugagauuacaca

SEQ ID NO: 702308 - RNA, 24 nt, Homo sapiens
aaguguauuuauuuuacagcucau

SEQ ID NO: 702309 - RNA, 16 nt, Homo sapiens
aaguguccuucuugcu

SEQ ID NO: 702310 - RNA, 14 nt, Homo sapiens
aaguuagccuccac

SEQ ID NO: 702311 - RNA, 23 nt, Homo sapiens
aaguugaaaaucauaggcaccuu

SEQ ID NO: 702312 - RNA, 22 nt, Homo sapiens
aaguugcaucagaaagcuuuau

SEQ ID NO: 702313 - RNA, 15 nt, Homo sapiens
aaguuucauacucaa

SEQ ID NO: 702314 - RNA, 18 nt, Homo sapiens
aauaaaaaagcucuuuua

SEQ ID NO: 702315 - RNA, 13 nt, Homo sapiens
aauaagcaaucaa

SEQ ID NO: 702316 - RNA, 18 nt, Homo sapiens
aauaagcaaucaagguua

SEQ ID NO: 702317 - RNA, 14 nt, Homo sapiens
aauaauaaacagug

SEQ ID NO: 702318 - RNA, 22 nt, Homo sapiens
aauaaugcuggauggccugagg

SEQ ID NO: 702319 - RNA, 22 nt, Homo sapiens
aauaauuacccacaaaugccac

SEQ ID NO: 702320 - RNA, 14 nt, Homo sapiens
aauacacacaagua

SEQ ID NO: 702321 - RNA, 15 nt, Homo sapiens
aauacaggggugaaa

SEQ ID NO: 702322 - RNA, 17 nt, Homo sapiens
aauacaguaucucaggg

SEQ ID NO: 702323 - RNA, 17 nt, Homo sapiens
aauaccauuuaguaaga

SEQ ID NO: 702324 - RNA, 19 nt, Homo sapiens
aauacuauuuaagauguga

SEQ ID NO: 702325 - RNA, 14 nt, Homo sapiens
aauagaaacauauc

SEQ ID NO: 702326 - RNA, 16 nt, Homo sapiens
aauagaaccacuauga

SEQ ID NO: 702327 - RNA, 19 nt, Homo sapiens
aauagacacauacauguca

SEQ ID NO: 702328 - RNA, 14 nt, Homo sapiens
aauauacauucaaa

SEQ ID NO: 702329 - RNA, 17 nt, Homo sapiens
aauauauaauguugcca

SEQ ID NO: 702330 - RNA, 22 nt, Homo sapiens
aauaucugaggaugaccagaaa

SEQ ID NO: 702331 - RNA, 19 nt, Homo sapiens
aauaugggcucaagucacu

SEQ ID NO: 702332 - RNA, 19 nt, Homo sapiens
aauauguggaagcaaccaa

SEQ ID NO: 702333 - RNA, 16 nt, Homo sapiens
aauauuaacauaagaa

SEQ ID NO: 702334 - RNA, 14 nt, Homo sapiens
aauauuguugacaa

SEQ ID NO: 702335 - RNA, 15 nt, Homo sapiens
aauauuuaucugauu

SEQ ID NO: 702336 - RNA, 17 nt, Homo sapiens
aauauuuaucugauuaa

SEQ ID NO: 702337 - RNA, 14 nt, Homo sapiens
aauauuucagugaa

SEQ ID NO: 702338 - RNA, 20 nt, Homo sapiens
aauauuucccauuugugcca

SEQ ID NO: 702339 - RNA, 18 nt, Homo sapiens
aauauuuucucuguacuu

SEQ ID NO: 702340 - RNA, 23 nt, Homo sapiens
aauauuuuuauaucaugcaaaau

SEQ ID NO: 702341 - RNA, 22 nt, Homo sapiens
aaucaaaggaaaauaguaaugu

SEQ ID NO: 702342 - RNA, 20 nt, Homo sapiens
aaucacaaggcaacugugag

SEQ ID NO: 702343 - RNA, 12 nt, Homo sapiens
aaucacuuugag

SEQ ID NO: 702344 - RNA, 15 nt, Homo sapiens
aaucaugaaucuuug

SEQ ID NO: 702345 - RNA, 11 nt, Homo sapiens
aauccaaaaag

SEQ ID NO: 702346 - RNA, 20 nt, Homo sapiens
aaucugagccagugcuuuaa

SEQ ID NO: 702347 - RNA, 23 nt, Homo sapiens
aaucuguuuauuuacaagggaag

SEQ ID NO: 702348 - RNA, 13 nt, Homo sapiens
aaucuuacuuugu

SEQ ID NO: 702349 - RNA, 18 nt, Homo sapiens
aaucuucaaagccuucuc

SEQ ID NO: 702350 - RNA, 21 nt, Homo sapiens
aaugaaaacaguguguaaaca

SEQ ID NO: 702351 - RNA, 18 nt, Homo sapiens
aaugacuauauaauuuau

SEQ ID NO: 702352 - RNA, 22 nt, Homo sapiens
aaugagcauguuugccuagaca

SEQ ID NO: 702353 - RNA, 15 nt, Homo sapiens
aaugagccuggcaag

SEQ ID NO: 702354 - RNA, 19 nt, Homo sapiens
aaugagcucugaaaucuuc

SEQ ID NO: 702355 - RNA, 18 nt, Homo sapiens
aaugcaugcuucuucuca

SEQ ID NO: 702356 - RNA, 10 nt, Homo sapiens
aaugcuccau

SEQ ID NO: 702357 - RNA, 12 nt, Homo sapiens
aauggacuggag

SEQ ID NO: 702358 - RNA, 19 nt, Homo sapiens
uuugauagggaacugggga

SEQ ID NO: 702359 - RNA, 18 nt, Homo sapiens
uuugcaauaccaaguaua

SEQ ID NO: 702360 - RNA, 17 nt, Homo sapiens
uuugccaaaauucauuu

SEQ ID NO: 702361 - RNA, 21 nt, Homo sapiens
uuugccaugugcuucugccac

SEQ ID NO: 702362 - RNA, 22 nt, Homo sapiens
uuugcccugcccucucccaaaa

SEQ ID NO: 702363 - RNA, 19 nt, Homo sapiens
uuugccuuggcuuugccag

SEQ ID NO: 702364 - RNA, 21 nt, Homo sapiens
uuuggauaucaaaagcaaaua

SEQ ID NO: 702365 - RNA, 13 nt, Homo sapiens
uuuggcauguaaa

SEQ ID NO: 702366 - RNA, 17 nt, Homo sapiens
uuugucuuggauauaua

SEQ ID NO: 702367 - RNA, 23 nt, Homo sapiens
uuuguguaaaaaaaccaccaaaa

SEQ ID NO: 702368 - RNA, 15 nt, Homo sapiens
uuugugugugugaua

SEQ ID NO: 702369 - RNA, 15 nt, Homo sapiens
uuuguugccaugugc

SEQ ID NO: 702370 - RNA, 16 nt, Homo sapiens
uuuuaacuuauugaca

SEQ ID NO: 702371 - RNA, 17 nt, Homo sapiens
uuuuaaugcuauuugaa

SEQ ID NO: 702372 - RNA, 16 nt, Homo sapiens
uuuuauaucaugcaaa

SEQ ID NO: 702373 - RNA, 13 nt, Homo sapiens
uuuuauuguugua

SEQ ID NO: 702374 - RNA, 18 nt, Homo sapiens
uuuucaaaauccaaaaag

SEQ ID NO: 702375 - RNA, 16 nt, Homo sapiens
uuuucaaagauuuaaa

SEQ ID NO: 702376 - RNA, 23 nt, Homo sapiens
uuuucacucuaagucauguaugu

SEQ ID NO: 702377 - RNA, 12 nt, Homo sapiens
uuuucaguauga

SEQ ID NO: 702378 - RNA, 23 nt, Homo sapiens
uuuuccauuuuuauuucaaaaua

SEQ ID NO: 702379 - RNA, 11 nt, Homo sapiens
uuuucccaaag

SEQ ID NO: 702380 - RNA, 16 nt, Homo sapiens
uuuucuauuauggaaa

SEQ ID NO: 702381 - RNA, 22 nt, Homo sapiens
uuuucuuacuagaccuguaacu

SEQ ID NO: 702382 - RNA, 16 nt, Homo sapiens
uuuucuucuugggaua

SEQ ID NO: 702383 - RNA, 23 nt, Homo sapiens
uuuuggcaaugacucaaagucug

SEQ ID NO: 702384 - RNA, 22 nt, Homo sapiens
uuuugggcuuucauaguguuca

SEQ ID NO: 702385 - RNA, 13 nt, Homo sapiens
uuuugucauucag

SEQ ID NO: 702386 - RNA, 17 nt, Homo sapiens
uuuugugcaaagccaaa

SEQ ID NO: 702387 - RNA, 22 nt, Homo sapiens
uuuuguuaacugauuugcaaua

SEQ ID NO: 702388 - RNA, 17 nt, Homo sapiens
uuuuuaacugcauaaua

SEQ ID NO: 702389 - RNA, 18 nt, Homo sapiens
uuuuugcugcugccucuu

SEQ ID NO: 702390 - RNA, 13 nt, Homo sapiens
uuuuuguuauuaa

SEQ ID NO: 702391 - RNA, 15 nt, Homo sapiens
aagcucugaccacuu

SEQ ID NO: 702392 - RNA, 18 nt, Homo sapiens
aaggaagaagaguauuaa

SEQ ID NO: 702393 - RNA, 20 nt, Homo sapiens
aaggacaaagugccaaagaa

SEQ ID NO: 702394 - RNA, 14 nt, Homo sapiens
aaggcauaaaugac

SEQ ID NO: 702395 - RNA, 19 nt, Homo sapiens
aaggcuguacgacacgggu

SEQ ID NO: 702396 - RNA, 15 nt, Homo sapiens
aaggcuugaagcugu

SEQ ID NO: 702397 - RNA, 17 nt, Homo sapiens
aagggaauacugugcau

SEQ ID NO: 702398 - RNA, 23 nt, Homo sapiens
aagggauuugaggugaggguugg

SEQ ID NO: 702399 - RNA, 22 nt, Homo sapiens
aagggcccagauucuaccacac

SEQ ID NO: 702400 - RNA, 21 nt, Homo sapiens
aagggccugcccagacaagau

SEQ ID NO: 702401 - RNA, 16 nt, Homo sapiens
aaggggaggaaccaga

SEQ ID NO: 702402 - RNA, 20 nt, Homo sapiens
aagguggguggaucacuuga

SEQ ID NO: 702403 - RNA, 23 nt, Homo sapiens
aagguuuuauaaggcugauguca

SEQ ID NO: 702404 - RNA, 13 nt, Homo sapiens
aaguaaaagcaag

SEQ ID NO: 702405 - RNA, 14 nt, Homo sapiens
aaguaaugcuucaa

SEQ ID NO: 702406 - RNA, 14 nt, Homo sapiens
aaguaauugugaaa

SEQ ID NO: 702407 - RNA, 19 nt, Homo sapiens
aagucagagacagauaccu

SEQ ID NO: 702408 - RNA, 21 nt, Homo sapiens
aagucagagacagauaccucc

SEQ ID NO: 702409 - RNA, 17 nt, Homo sapiens
aagucagcaugccucua

SEQ ID NO: 702410 - RNA, 22 nt, Homo sapiens
aagucagcuccagcuuucugcc

SEQ ID NO: 702411 - RNA, 20 nt, Homo sapiens
aagucaguacccaccaccuu

SEQ ID NO: 702412 - RNA, 15 nt, Homo sapiens
aaguccaguguuucu

SEQ ID NO: 702413 - RNA, 18 nt, Homo sapiens
aagucgucacuaauacac

SEQ ID NO: 702414 - RNA, 19 nt, Homo sapiens
aagugagacuccgucacaa

SEQ ID NO: 702415 - RNA, 18 nt, Homo sapiens
aagugcuggcaaccacua

SEQ ID NO: 702416 - RNA, 19 nt, Homo sapiens
aaguggccaagaagcagug

SEQ ID NO: 702417 - RNA, 13 nt, Homo sapiens
aaguggucuuaag

SEQ ID NO: 702418 - RNA, 17 nt, Homo sapiens
aaguggucuuaagaaau

SEQ ID NO: 702419 - RNA, 21 nt, Homo sapiens
aaguuguaaaguauguauuau

SEQ ID NO: 702420 - RNA, 16 nt, Homo sapiens
aauaaaaguuuacaga

SEQ ID NO: 702421 - RNA, 12 nt, Homo sapiens
aauaaacccuca

SEQ ID NO: 702422 - RNA, 13 nt, Homo sapiens
aauaaacccucag

SEQ ID NO: 702423 - RNA, 18 nt, Homo sapiens
aauaaacccucagagccu

SEQ ID NO: 702424 - RNA, 16 nt, Homo sapiens
aauaaaucaaauauuc

SEQ ID NO: 702425 - RNA, 20 nt, Homo sapiens
aauaaaucguccucccaggc

SEQ ID NO: 702426 - RNA, 18 nt, Homo sapiens
aauaaauguuuuauuucu

SEQ ID NO: 702427 - RNA, 15 nt, Homo sapiens
aauaagaauuugcau

SEQ ID NO: 702428 - RNA, 20 nt, Homo sapiens
aauaagcuaguugaauacuu

SEQ ID NO: 702429 - RNA, 21 nt, Homo sapiens
aauaaguauauaauccuguga

SEQ ID NO: 702430 - RNA, 20 nt, Homo sapiens
aauaauaaaucguccuccca

SEQ ID NO: 702431 - RNA, 20 nt, Homo sapiens
aauaauacaguaucucaggg

SEQ ID NO: 702432 - RNA, 19 nt, Homo sapiens
aauaaucucuuuauucuaa

SEQ ID NO: 702433 - RNA, 17 nt, Homo sapiens
aauaaugaauacauuuc

SEQ ID NO: 702434 - RNA, 20 nt, Homo sapiens
aauaauggcaucaauauaca

SEQ ID NO: 702435 - RNA, 19 nt, Homo sapiens
aauacaggggugaaagggg

SEQ ID NO: 702436 - RNA, 21 nt, Homo sapiens
aauacaugaagcuucaugcac

SEQ ID NO: 702437 - RNA, 19 nt, Homo sapiens
aauacugaaccacuuguag

SEQ ID NO: 702438 - RNA, 20 nt, Homo sapiens
aauacugugcauaagccauu

SEQ ID NO: 702439 - RNA, 14 nt, Homo sapiens
aauagacacauaca

SEQ ID NO: 702440 - RNA, 14 nt, Homo sapiens
aauagcacauaugg

SEQ ID NO: 702441 - RNA, 12 nt, Homo sapiens
aauauacauuca

SEQ ID NO: 702442 - RNA, 16 nt, Homo sapiens
aauauagaaugaaaga

SEQ ID NO: 702443 - RNA, 22 nt, Homo sapiens
aauauccaagauuuaaaugcca

SEQ ID NO: 702444 - RNA, 13 nt, Homo sapiens
aauauggacauau

SEQ ID NO: 702445 - RNA, 17 nt, Homo sapiens
aauaugggcucaaguca

SEQ ID NO: 702446 - RNA, 13 nt, Homo sapiens
aauauuguugaca

SEQ ID NO: 702447 - RNA, 22 nt, Homo sapiens
aauauuguugacaacugugacu

SEQ ID NO: 702448 - RNA, 23 nt, Homo sapiens
aauauuguugacaacugugacug

SEQ ID NO: 702449 - RNA, 22 nt, Homo sapiens
aauauuuuuauauuuccuuuau

SEQ ID NO: 702450 - RNA, 14 nt, Homo sapiens
aaucagagacaaaa

SEQ ID NO: 702451 - RNA, 18 nt, Homo sapiens
aaucaggaauauuuucca

SEQ ID NO: 702452 - RNA, 22 nt, Homo sapiens
aaucauaggcaccuuuuacugu

SEQ ID NO: 702453 - RNA, 21 nt, Homo sapiens
aaucauguugaucauguacuu

SEQ ID NO: 702454 - RNA, 21 nt, Homo sapiens
aaucauuuguuuacauuugau

SEQ ID NO: 702455 - RNA, 20 nt, Homo sapiens
aaucauuuucauuccuaaag

SEQ ID NO: 702456 - RNA, 16 nt, Homo sapiens
aaucccacuaaugcaa

SEQ ID NO: 702457 - RNA, 15 nt, Homo sapiens
aauccugaagagcau

SEQ ID NO: 702458 - RNA, 16 nt, Homo sapiens
aauccuuccauuccac

SEQ ID NO: 702459 - RNA, 12 nt, Homo sapiens
aaucguccuccc

SEQ ID NO: 702460 - RNA, 19 nt, Homo sapiens
aaucucuaggaagucaaua

SEQ ID NO: 702461 - RNA, 23 nt, Homo sapiens
aaucugagccagugcuuuaaugg

SEQ ID NO: 702462 - RNA, 22 nt, Homo sapiens
aaucuguuuauuuacaagggaa

SEQ ID NO: 702463 - RNA, 13 nt, Homo sapiens
aaucuuaugcucu

SEQ ID NO: 702464 - RNA, 14 nt, Homo sapiens
aaucuuccuuuuau

SEQ ID NO: 702465 - RNA, 15 nt, Homo sapiens
aaucuuuaccuguau

SEQ ID NO: 702466 - RNA, 22 nt, Homo sapiens
aaugaaagcccucaugugcagu

SEQ ID NO: 702467 - RNA, 18 nt, Homo sapiens
aaugaaguugaaaaucau

SEQ ID NO: 702468 - RNA, 13 nt, Homo sapiens
aaugcaaacuggg

SEQ ID NO: 702469 - RNA, 14 nt, Homo sapiens
aaugcaugcuucuu

SEQ ID NO: 702470 - RNA, 13 nt, Homo sapiens
aauggcaugucag

SEQ ID NO: 702471 - RNA, 16 nt, Homo sapiens
aauggcuuguucauca

SEQ ID NO: 702472 - RNA, 17 nt, Homo sapiens
aauggugguggaagggu

SEQ ID NO: 702473 - RNA, 13 nt, Homo sapiens
accuccucauggc

SEQ ID NO: 702474 - RNA, 15 nt, Homo sapiens
accucugcacaagcu

SEQ ID NO: 702475 - RNA, 14 nt, Homo sapiens
accucuuccuugau

SEQ ID NO: 702476 - RNA, 21 nt, Homo sapiens
accucuugaaaauagaacaac

SEQ ID NO: 702477 - RNA, 15 nt, Homo sapiens
accugauuugaugau

SEQ ID NO: 702478 - RNA, 16 nt, Homo sapiens
accuucguccuuuuaa

SEQ ID NO: 702479 - RNA, 16 nt, Homo sapiens
accuuggacauccucc

SEQ ID NO: 702480 - RNA, 19 nt, Homo sapiens
accuuguauaaauuauuca

SEQ ID NO: 702481 - RNA, 13 nt, Homo sapiens
accuuucccucac

SEQ ID NO: 702482 - RNA, 18 nt, Homo sapiens
acgauucuucacuucuug

SEQ ID NO: 702483 - RNA, 17 nt, Homo sapiens
acgcgugccguggcacc

SEQ ID NO: 702484 - RNA, 17 nt, Homo sapiens
acgcuaaagagcccuug

SEQ ID NO: 702485 - RNA, 17 nt, Homo sapiens
acggacacucaaaagcu

SEQ ID NO: 702486 - RNA, 18 nt, Homo sapiens
acggaggcauccuacccu

SEQ ID NO: 702487 - RNA, 14 nt, Homo sapiens
acggaggccugcga

SEQ ID NO: 702488 - RNA, 14 nt, Homo sapiens
acgggcucagcaaa

SEQ ID NO: 702489 - RNA, 21 nt, Homo sapiens
acgggggccgcguggugccau

SEQ ID NO: 702490 - RNA, 14 nt, Homo sapiens
acggugcugugagg

SEQ ID NO: 702491 - RNA, 15 nt, Homo sapiens
acgguguuuugccau

SEQ ID NO: 702492 - RNA, 20 nt, Homo sapiens
acgguuucgaagucauuaaa

SEQ ID NO: 702493 - RNA, 23 nt, Homo sapiens
acuaacucaaauacacauuugcu

SEQ ID NO: 702494 - RNA, 19 nt, Homo sapiens
acuaauuauacuacuuugu

SEQ ID NO: 702495 - RNA, 18 nt, Homo sapiens
acuaauucuaauguggac

SEQ ID NO: 702496 - RNA, 19 nt, Homo sapiens
acuacaguauuacucuuac

SEQ ID NO: 702497 - RNA, 17 nt, Homo sapiens
acuacuaaugacuuugu

SEQ ID NO: 702498 - RNA, 14 nt, Homo sapiens
acuauccuacccca

SEQ ID NO: 702499 - RNA, 21 nt, Homo sapiens
acucacacggacacucaaaag

SEQ ID NO: 702500 - RNA, 12 nt, Homo sapiens
acucacagaguc

SEQ ID NO: 702501 - RNA, 17 nt, Homo sapiens
acucagagcucucucua

SEQ ID NO: 702502 - RNA, 11 nt, Homo sapiens
acucagugcag

SEQ ID NO: 702503 - RNA, 12 nt, Homo sapiens
acucgcuguaug

SEQ ID NO: 702504 - RNA, 20 nt, Homo sapiens
acugaacuuaauaacugugu

SEQ ID NO: 702505 - RNA, 20 nt, Homo sapiens
acugaccauauugugcuuca

SEQ ID NO: 702506 - RNA, 12 nt, Homo sapiens
acugauuugcaa

SEQ ID NO: 702507 - RNA, 12 nt, Homo sapiens
acugccaagaaa

SEQ ID NO: 702508 - RNA, 20 nt, Homo sapiens
acugcuucccuuacuuugcu

SEQ ID NO: 702509 - RNA, 23 nt, Homo sapiens
acuggauagaaccaccauaguga

SEQ ID NO: 702510 - RNA, 17 nt, Homo sapiens
acuggccauuugccaau

SEQ ID NO: 702511 - RNA, 21 nt, Homo sapiens
auuuccuuacagaacuacuuc

SEQ ID NO: 702512 - RNA, 22 nt, Homo sapiens
auuuccuuacagaacuacuucu

SEQ ID NO: 702513 - RNA, 13 nt, Homo sapiens
auuuccuuuaugu

SEQ ID NO: 702514 - RNA, 15 nt, Homo sapiens
auuuccuuuuugaca

SEQ ID NO: 702515 - RNA, 16 nt, Homo sapiens
auuucuaccuaaguca

SEQ ID NO: 702516 - RNA, 17 nt, Homo sapiens
auuucuagaacccguga

SEQ ID NO: 702517 - RNA, 18 nt, Homo sapiens
auuucuagaacccgugac

SEQ ID NO: 702518 - RNA, 18 nt, Homo sapiens
auuucucauaucaacuua

SEQ ID NO: 702519 - RNA, 20 nt, Homo sapiens
auuucugugcccuccugacc

SEQ ID NO: 702520 - RNA, 21 nt, Homo sapiens
auuugcagguauuauaccauu

SEQ ID NO: 702521 - RNA, 15 nt, Homo sapiens
auuuggaaugaagga

SEQ ID NO: 702522 - RNA, 17 nt, Homo sapiens
auuuguaaagcuauuua

SEQ ID NO: 702523 - RNA, 20 nt, Homo sapiens
auuugugcuagaaauuuuca

SEQ ID NO: 702524 - RNA, 18 nt, Homo sapiens
auuugugugugugauaua

SEQ ID NO: 702525 - RNA, 17 nt, Homo sapiens
auuuuauaagaugacug

SEQ ID NO: 702526 - RNA, 14 nt, Homo sapiens
auuuuauacuugcc

SEQ ID NO: 702527 - RNA, 14 nt, Homo sapiens
auuuucaaguaauu

SEQ ID NO: 702528 - RNA, 14 nt, Homo sapiens
auuuuguaugaaaa

SEQ ID NO: 702529 - RNA, 19 nt, Homo sapiens
auuuuguuuuugucuuaaa

SEQ ID NO: 702530 - RNA, 14 nt, Homo sapiens
caaaaaacuacuuc

SEQ ID NO: 702531 - RNA, 16 nt, Homo sapiens
caaaaaacuacuucuu

SEQ ID NO: 702532 - RNA, 10 nt, Homo sapiens
caaaaaccaa

SEQ ID NO: 702533 - RNA, 15 nt, Homo sapiens
caaaaaccuucccca

SEQ ID NO: 702534 - RNA, 17 nt, Homo sapiens
caaaacaaguuggaugc

SEQ ID NO: 702535 - RNA, 18 nt, Homo sapiens
caaaaggccucuuguaaa

SEQ ID NO: 702536 - RNA, 18 nt, Homo sapiens
caaaaguagaacuuugua

SEQ ID NO: 702537 - RNA, 14 nt, Homo sapiens
caaaauguucacaa

SEQ ID NO: 702538 - RNA, 18 nt, Homo sapiens
caaaauucuuaaguaugu

SEQ ID NO: 702539 - RNA, 13 nt, Homo sapiens
caaacaggcaguu

SEQ ID NO: 702540 - RNA, 20 nt, Homo sapiens
caaacaggguuugauagcac

SEQ ID NO: 702541 - RNA, 22 nt, Homo sapiens
caaacugggaugaaacuaaagc

SEQ ID NO: 702542 - RNA, 23 nt, Homo sapiens
caaacugggaugaaacuaaagca

SEQ ID NO: 702543 - RNA, 20 nt, Homo sapiens
caaacuguagaaaugaugau

SEQ ID NO: 702544 - RNA, 17 nt, Homo sapiens
caaagaaaguggucuua

SEQ ID NO: 702545 - RNA, 16 nt, Homo sapiens
caaagagagaaaguuu

SEQ ID NO: 702546 - RNA, 18 nt, Homo sapiens
caaagagguacaaaaaag

SEQ ID NO: 702547 - RNA, 23 nt, Homo sapiens
caaagccuccuccagccgccaug

SEQ ID NO: 702548 - RNA, 15 nt, Homo sapiens
caaauaaaaacccaa

SEQ ID NO: 702549 - RNA, 15 nt, Homo sapiens
caaauaaagaccuga

SEQ ID NO: 702550 - RNA, 22 nt, Homo sapiens
caaauaaguauuuauaauagca

SEQ ID NO: 702551 - RNA, 17 nt, Homo sapiens
caaauacacauuugcua

SEQ ID NO: 702552 - RNA, 16 nt, Homo sapiens
caaauauuguugacaa

SEQ ID NO: 702553 - RNA, 18 nt, Homo sapiens
caaaucagaaacuuguga

SEQ ID NO: 702554 - RNA, 19 nt, Homo sapiens
caaaugacuuuauuauuua

SEQ ID NO: 702555 - RNA, 20 nt, Homo sapiens
caaaugcaugcuucuucuca

SEQ ID NO: 702556 - RNA, 14 nt, Homo sapiens
caaaugcccagcuu

SEQ ID NO: 702557 - RNA, 15 nt, Homo sapiens
caaauuaucuugaua

SEQ ID NO: 702558 - RNA, 21 nt, Homo sapiens
caaauucauggugcacugagc

SEQ ID NO: 702559 - RNA, 21 nt, Homo sapiens
caacaaugugaggggucccua

SEQ ID NO: 702560 - RNA, 15 nt, Homo sapiens
caacacaguuuugac

SEQ ID NO: 702561 - RNA, 21 nt, Homo sapiens
caacacaguuuugaccuaaca

SEQ ID NO: 702562 - RNA, 22 nt, Homo sapiens
caacaccucugcacaagcugca

SEQ ID NO: 702563 - RNA, 11 nt, Homo sapiens
caacaggaaau

SEQ ID NO: 702564 - RNA, 21 nt, Homo sapiens
caacaugaugaaaccccaucu

SEQ ID NO: 702565 - RNA, 14 nt, Homo sapiens
caaccaagucacac

SEQ ID NO: 702566 - RNA, 18 nt, Homo sapiens
caacccuaucuccugaca

SEQ ID NO: 702567 - RNA, 13 nt, Homo sapiens
caacuguuuucau

SEQ ID NO: 702568 - RNA, 20 nt, Homo sapiens
caagagaugggaaugaggug

SEQ ID NO: 702569 - RNA, 16 nt, Homo sapiens
caagagccuuaaaaca

SEQ ID NO: 702570 - RNA, 16 nt, Homo sapiens
caagauuuucuacuuu

SEQ ID NO: 702571 - RNA, 19 nt, Homo sapiens
caagccugcugucuuguga

SEQ ID NO: 702572 - RNA, 20 nt, Homo sapiens
caaggaaacccccaguguaa

SEQ ID NO: 702573 - RNA, 18 nt, Homo sapiens
caaggagaaaaaaggcag

SEQ ID NO: 702574 - RNA, 14 nt, Homo sapiens
caaggcugcaguga

SEQ ID NO: 702575 - RNA, 15 nt, Homo sapiens
caaggcugcagugag

SEQ ID NO: 702576 - RNA, 17 nt, Homo sapiens
caaggcuggcaggucaa

SEQ ID NO: 702577 - RNA, 15 nt, Homo sapiens
caaggcuuuaucuca

SEQ ID NO: 702578 - RNA, 18 nt, Homo sapiens
caaguaaaacaaaaccac

SEQ ID NO: 702579 - RNA, 21 nt, Homo sapiens
caaguaagaaagugaagcaaa

SEQ ID NO: 702580 - RNA, 19 nt, Homo sapiens
caaguacauggcuagcuuu

SEQ ID NO: 702581 - RNA, 18 nt, Homo sapiens
caagucaagugaaaaagg

SEQ ID NO: 702582 - RNA, 22 nt, Homo sapiens
caaguggaccuuaggccuuccu

SEQ ID NO: 702583 - RNA, 22 nt, Homo sapiens
caaguguaaaauauuuugaauc

SEQ ID NO: 702584 - RNA, 21 nt, Homo sapiens
caagugugaauacugcuugaa

SEQ ID NO: 702585 - RNA, 15 nt, Homo sapiens
caaguugcaucagaa

SEQ ID NO: 702586 - RNA, 13 nt, Homo sapiens
caauaaacccuca

SEQ ID NO: 702587 - RNA, 21 nt, Homo sapiens
caauaaagcuuguugacucag

SEQ ID NO: 702588 - RNA, 14 nt, Homo sapiens
caauagaucuccag

SEQ ID NO: 702589 - RNA, 16 nt, Homo sapiens
caauauauugaacuuu

SEQ ID NO: 702590 - RNA, 21 nt, Homo sapiens
caauauuuuuauaucaugcaa

SEQ ID NO: 702591 - RNA, 15 nt, Homo sapiens
caaucuuacuuugua

SEQ ID NO: 702592 - RNA, 13 nt, Homo sapiens
caaugaccaaaca

SEQ ID NO: 702593 - RNA, 23 nt, Homo sapiens
caaugccccuggaucuaccagca

SEQ ID NO: 702594 - RNA, 21 nt, Homo sapiens
caauggcuuguucaucaucca

SEQ ID NO: 702595 - RNA, 19 nt, Homo sapiens
caaugguugaugauacuuc

SEQ ID NO: 702596 - RNA, 14 nt, Homo sapiens
caauguaagcauac

SEQ ID NO: 702597 - RNA, 18 nt, Homo sapiens
caauuauauuuauauuuc

SEQ ID NO: 702598 - RNA, 16 nt, Homo sapiens
caauuggcacuaaaga

SEQ ID NO: 702599 - RNA, 13 nt, Homo sapiens
caauuucccuuca

SEQ ID NO: 702600 - RNA, 14 nt, Homo sapiens
caauuucuaccuuu

SEQ ID NO: 702601 - RNA, 13 nt, Homo sapiens
cacaaaugacuuu

SEQ ID NO: 702602 - RNA, 23 nt, Homo sapiens
cacaagaccaagguauacaucuu

SEQ ID NO: 702603 - RNA, 14 nt, Homo sapiens
cacaaguuacacug

SEQ ID NO: 702604 - RNA, 18 nt, Homo sapiens
cacaaguuacacugccau

SEQ ID NO: 702605 - RNA, 14 nt, Homo sapiens
cacacagaaugcaa

SEQ ID NO: 702606 - RNA, 16 nt, Homo sapiens
cacaccccaacacuuc

SEQ ID NO: 702607 - RNA, 19 nt, Homo sapiens
cacaccccaacacuuccag

SEQ ID NO: 702608 - RNA, 19 nt, Homo sapiens
cacaccuacaccucuugaa

SEQ ID NO: 702609 - RNA, 22 nt, Homo sapiens
cacagaauauuuuuauauuucc

SEQ ID NO: 702610 - RNA, 22 nt, Homo sapiens
cacaguugcucuaugcuuucca

SEQ ID NO: 702611 - RNA, 16 nt, Homo sapiens
cacauauguaguauaa

SEQ ID NO: 702612 - RNA, 13 nt, Homo sapiens
caccaaagcugcc

SEQ ID NO: 702613 - RNA, 18 nt, Homo sapiens
caccaaucuuacuuugua

SEQ ID NO: 702614 - RNA, 17 nt, Homo sapiens
caccacagccagcaccu

SEQ ID NO: 702615 - RNA, 22 nt, Homo sapiens
caccacugaaacccugcacuua

SEQ ID NO: 702616 - RNA, 21 nt, Homo sapiens
caccauuuuguuuagacaauu

SEQ ID NO: 702617 - RNA, 21 nt, Homo sapiens
caccccggggacccugugaca

SEQ ID NO: 702618 - RNA, 13 nt, Homo sapiens
cacccgugagaaa

SEQ ID NO: 702619 - RNA, 22 nt, Homo sapiens
cacccuuguccuugagugcucu

SEQ ID NO: 702620 - RNA, 22 nt, Homo sapiens
caccuaagaucucgguuugcca

SEQ ID NO: 702621 - RNA, 16 nt, Homo sapiens
caccuagaacacuaac

SEQ ID NO: 702622 - RNA, 23 nt, Homo sapiens
caccuccaggcuuucccacuucc

SEQ ID NO: 702623 - RNA, 19 nt, Homo sapiens
caccuuuggaaagcucuga

SEQ ID NO: 702624 - RNA, 15 nt, Homo sapiens
caccuuuuacuguga

SEQ ID NO: 702625 - RNA, 14 nt, Homo sapiens
cacgcacuggguug

SEQ ID NO: 702626 - RNA, 20 nt, Homo sapiens
cacggaggaugaugccaguu

SEQ ID NO: 702627 - RNA, 18 nt, Homo sapiens
cacggaugacuuaacugc

SEQ ID NO: 702628 - RNA, 15 nt, Homo sapiens
cacguuagauuugcc

SEQ ID NO: 702629 - RNA, 15 nt, Homo sapiens
ccuaccaaaauggaa

SEQ ID NO: 702630 - RNA, 18 nt, Homo sapiens
ccuagccaaugucuccuc

SEQ ID NO: 702631 - RNA, 15 nt, Homo sapiens
ccuaggcauuugcug

SEQ ID NO: 702632 - RNA, 17 nt, Homo sapiens
ccuauaagccaaaauua

SEQ ID NO: 702633 - RNA, 14 nt, Homo sapiens
ccuaucuccugaca

SEQ ID NO: 702634 - RNA, 21 nt, Homo sapiens
ccucacaggagcuuacuggca

SEQ ID NO: 702635 - RNA, 13 nt, Homo sapiens
ccucacuggggca

SEQ ID NO: 702636 - RNA, 18 nt, Homo sapiens
ccucagcccccugcuuca

SEQ ID NO: 702637 - RNA, 17 nt, Homo sapiens
ccucaggcaggugggau

SEQ ID NO: 702638 - RNA, 12 nt, Homo sapiens
ccucagugcauu

SEQ ID NO: 702639 - RNA, 22 nt, Homo sapiens
ccucauuuaaguaaaagguuag

SEQ ID NO: 702640 - RNA, 13 nt, Homo sapiens
ccuccagaacuca

SEQ ID NO: 702641 - RNA, 13 nt, Homo sapiens
ccuccucauggca

SEQ ID NO: 702642 - RNA, 17 nt, Homo sapiens
ccucgguacucccauaa

SEQ ID NO: 702643 - RNA, 14 nt, Homo sapiens
ccucuagaggcaag

SEQ ID NO: 702644 - RNA, 22 nt, Homo sapiens
ccucuccccaagaggaacugaa

SEQ ID NO: 702645 - RNA, 15 nt, Homo sapiens
ccucuccuccagugu

SEQ ID NO: 702646 - RNA, 14 nt, Homo sapiens
ccucugaaaaccaa

SEQ ID NO: 702647 - RNA, 16 nt, Homo sapiens
ccucugcgucuauccu

SEQ ID NO: 702648 - RNA, 21 nt, Homo sapiens
ccucuucucuacucuagggaa

SEQ ID NO: 702649 - RNA, 18 nt, Homo sapiens
ccugcaccccugcaguuu

SEQ ID NO: 702650 - RNA, 23 nt, Homo sapiens
ccugccucccacuucacugcgaa

SEQ ID NO: 702651 - RNA, 14 nt, Homo sapiens
ccugccugccgucu

SEQ ID NO: 702652 - RNA, 20 nt, Homo sapiens
ccugcgacccugggggcaca

SEQ ID NO: 702653 - RNA, 23 nt, Homo sapiens
ccuggaguguaugacugcacaug

SEQ ID NO: 702654 - RNA, 17 nt, Homo sapiens
ccuggccuuguccucag

SEQ ID NO: 702655 - RNA, 18 nt, Homo sapiens
ccuggguaacuagggaag

SEQ ID NO: 702656 - RNA, 22 nt, Homo sapiens
ccugggugacagagcaagugag

SEQ ID NO: 702657 - RNA, 13 nt, Homo sapiens
ccuggugcugcug

SEQ ID NO: 702658 - RNA, 13 nt, Homo sapiens
ccugucuccuuau

SEQ ID NO: 702659 - RNA, 13 nt, Homo sapiens
ccugugaaugcca

SEQ ID NO: 702660 - RNA, 20 nt, Homo sapiens
ccuguggcugucggugggac

SEQ ID NO: 702661 - RNA, 18 nt, Homo sapiens
ccuuaagggguaucaugu

SEQ ID NO: 702662 - RNA, 20 nt, Homo sapiens
cacuaagaauucaaacuggg

SEQ ID NO: 702663 - RNA, 22 nt, Homo sapiens
cacuacaguauuacucuuacaa

SEQ ID NO: 702664 - RNA, 19 nt, Homo sapiens
cacuagaggaaaccaguuu

SEQ ID NO: 702665 - RNA, 23 nt, Homo sapiens
cacuauuaaguggguuugcccca

SEQ ID NO: 702666 - RNA, 21 nt, Homo sapiens
cacucacacggacacucaaaa

SEQ ID NO: 702667 - RNA, 16 nt, Homo sapiens
cacucuaagucaugua

SEQ ID NO: 702668 - RNA, 23 nt, Homo sapiens
cacugcgcccuuaacugcaucca

SEQ ID NO: 702669 - RNA, 14 nt, Homo sapiens
cacuggaugcagaa

SEQ ID NO: 702670 - RNA, 19 nt, Homo sapiens
cacuggggcagacaauaaa

SEQ ID NO: 702671 - RNA, 17 nt, Homo sapiens
cacuguguauauuugau

SEQ ID NO: 702672 - RNA, 14 nt, Homo sapiens
cacuguuuagauuu

SEQ ID NO: 702673 - RNA, 17 nt, Homo sapiens
cacuuaagacuguguau

SEQ ID NO: 702674 - RNA, 17 nt, Homo sapiens
cacuuaaugauacaugu

SEQ ID NO: 702675 - RNA, 15 nt, Homo sapiens
cacuuccagcauuua

SEQ ID NO: 702676 - RNA, 13 nt, Homo sapiens
cacuucugauguc

SEQ ID NO: 702677 - RNA, 15 nt, Homo sapiens
cacuuguagauuuga

SEQ ID NO: 702678 - RNA, 19 nt, Homo sapiens
cagaaacaguucaccuuga

SEQ ID NO: 702679 - RNA, 21 nt, Homo sapiens
cagaaagcuuugaauacuaaa

SEQ ID NO: 702680 - RNA, 14 nt, Homo sapiens
cagaaauuguauau

SEQ ID NO: 702681 - RNA, 21 nt, Homo sapiens
cagaacuugaaugugucaggu

SEQ ID NO: 702682 - RNA, 16 nt, Homo sapiens
cagaaguuugagauca

SEQ ID NO: 702683 - RNA, 16 nt, Homo sapiens
cagaauugagagugau

SEQ ID NO: 702684 - RNA, 14 nt, Homo sapiens
cagacaauaaaccc

SEQ ID NO: 702685 - RNA, 22 nt, Homo sapiens
cagacaauaaacccucagagcc

SEQ ID NO: 702686 - RNA, 15 nt, Homo sapiens
cagacagauugcuga

SEQ ID NO: 702687 - RNA, 17 nt, Homo sapiens
cagagaaaaaugcuccc

SEQ ID NO: 702688 - RNA, 17 nt, Homo sapiens
cagagacagauaccucc

SEQ ID NO: 702689 - RNA, 19 nt, Homo sapiens
cagagagccuggugcugcu

SEQ ID NO: 702690 - RNA, 20 nt, Homo sapiens
cagagcgagacuccgucuca

SEQ ID NO: 702691 - RNA, 16 nt, Homo sapiens
cagagcugagcccuca

SEQ ID NO: 702692 - RNA, 15 nt, Homo sapiens
cagaguuauggugcc

SEQ ID NO: 702693 - RNA, 13 nt, Homo sapiens
cagauaccuccaa

SEQ ID NO: 702694 - RNA, 14 nt, Homo sapiens
cagcaacacagccu

SEQ ID NO: 702695 - RNA, 17 nt, Homo sapiens
cagcccaaucugccaga

SEQ ID NO: 702696 - RNA, 15 nt, Homo sapiens
cagccccacugccag

SEQ ID NO: 702697 - RNA, 19 nt, Homo sapiens
cagccuccccgugccaaaa

SEQ ID NO: 702698 - RNA, 18 nt, Homo sapiens
cagccugcgccugcugca

SEQ ID NO: 702699 - RNA, 15 nt, Homo sapiens
cagccugcuccagcu

SEQ ID NO: 702700 - RNA, 24 nt, Homo sapiens
cagccugggccccagcucgcggga

SEQ ID NO: 702701 - RNA, 17 nt, Homo sapiens
ucacuggggcagacaau

SEQ ID NO: 702702 - RNA, 18 nt, Homo sapiens
ucacuggggcagacaaua

SEQ ID NO: 702703 - RNA, 12 nt, Homo sapiens
ucacuucacccu

SEQ ID NO: 702704 - RNA, 17 nt, Homo sapiens
ucacuugaggucaggag

SEQ ID NO: 702705 - RNA, 14 nt, Homo sapiens
ucagaagugcagaa

SEQ ID NO: 702706 - RNA, 16 nt, Homo sapiens
ucagagcucucucuac

SEQ ID NO: 702707 - RNA, 16 nt, Homo sapiens
ucagauguuuaaaaca

SEQ ID NO: 702708 - RNA, 16 nt, Homo sapiens
ucucuuagcaacucag

SEQ ID NO: 702709 - RNA, 19 nt, Homo sapiens
ucucuuccggucggaucuc

SEQ ID NO: 702710 - RNA, 15 nt, Homo sapiens
ucucuuuauucuaaa

SEQ ID NO: 702711 - RNA, 14 nt, Homo sapiens
ucucuuucugcaaa

SEQ ID NO: 702712 - RNA, 21 nt, Homo sapiens
ucucuuugauuauuugcaugu

SEQ ID NO: 702713 - RNA, 22 nt, Homo sapiens
ucugaaucgagauguccauagu

SEQ ID NO: 702714 - RNA, 18 nt, Homo sapiens
ucugaucauguaugcauc

SEQ ID NO: 702715 - RNA, 14 nt, Homo sapiens
ucugcacaccuacu

SEQ ID NO: 702716 - RNA, 16 nt, Homo sapiens
ucugccauaucaguga

SEQ ID NO: 702717 - RNA, 13 nt, Homo sapiens
ucugcggaucuca

SEQ ID NO: 702718 - RNA, 19 nt, Homo sapiens
ucugcuugcucuuguccua

SEQ ID NO: 702719 - RNA, 13 nt, Homo sapiens
ucuggcaucucuu

SEQ ID NO: 702720 - RNA, 13 nt, Homo sapiens
ucuguacuguuac

SEQ ID NO: 702721 - RNA, 14 nt, Homo sapiens
ucuguagcuauaau

SEQ ID NO: 702722 - RNA, 20 nt, Homo sapiens
ucugucacccuuguccuuga

SEQ ID NO: 702723 - RNA, 19 nt, Homo sapiens
ucugucaggccuucagggu

SEQ ID NO: 702724 - RNA, 13 nt, Homo sapiens
ucuguugccaugg

SEQ ID NO: 702725 - RNA, 22 nt, Homo sapiens
ucuuaagcuuccgccgucucaa

SEQ ID NO: 702726 - RNA, 19 nt, Homo sapiens
ucuuaaggacaaagugcca

SEQ ID NO: 702727 - RNA, 18 nt, Homo sapiens
ucuuaauguacacauugc

SEQ ID NO: 702728 - RNA, 14 nt, Homo sapiens
ucuuacuaaaaagu

SEQ ID NO: 702729 - RNA, 19 nt, Homo sapiens
ucuuauucuuuuguaauau

SEQ ID NO: 702730 - RNA, 13 nt, Homo sapiens
ucuucagaugcca

SEQ ID NO: 702731 - RNA, 15 nt, Homo sapiens
ucuucagaugccacu

SEQ ID NO: 702732 - RNA, 16 nt, Homo sapiens
ucuucaucccauucca

SEQ ID NO: 702733 - RNA, 13 nt, Homo sapiens
ucuuccccagaua

SEQ ID NO: 702734 - RNA, 22 nt, Homo sapiens
ucuuccuggcuccaacacugcu

SEQ ID NO: 702735 - RNA, 15 nt, Homo sapiens
ucuucuaaauggcaa

SEQ ID NO: 702736 - RNA, 15 nt, Homo sapiens
ucuucucccuuugaa

SEQ ID NO: 702737 - RNA, 13 nt, Homo sapiens
ucuucucuacucu

SEQ ID NO: 702738 - RNA, 19 nt, Homo sapiens
ucuucuuggggcccagugc

SEQ ID NO: 702739 - RNA, 21 nt, Homo sapiens
ucuugaauccuuccauuccac

SEQ ID NO: 702740 - RNA, 10 nt, Homo sapiens
ucuugccuug

SEQ ID NO: 702741 - RNA, 21 nt, Homo sapiens
ucuugggguuuucaguaugaa

SEQ ID NO: 702742 - RNA, 17 nt, Homo sapiens
ucuugguaauccccuaa

SEQ ID NO: 702743 - RNA, 22 nt, Homo sapiens
ucuuuaaacacucuucagagaa

SEQ ID NO: 702744 - RNA, 14 nt, Homo sapiens
ucuuuaagaugugu

SEQ ID NO: 702745 - RNA, 16 nt, Homo sapiens
ucuuugauuauuugca

SEQ ID NO: 702746 - RNA, 23 nt, Homo sapiens
ucuuugauuauuugcauguuaug

SEQ ID NO: 702747 - RNA, 17 nt, Homo sapiens
ucuuuggaggugcugcu

SEQ ID NO: 702748 - RNA, 15 nt, Homo sapiens
ugaaaaaaaugcauu

SEQ ID NO: 702749 - RNA, 19 nt, Homo sapiens
ugaaaaagauguacagaac

SEQ ID NO: 702750 - RNA, 20 nt, Homo sapiens
ugaaaacaguguguaaacaa

SEQ ID NO: 702751 - RNA, 21 nt, Homo sapiens
ugaaaacauagcaucucagga

SEQ ID NO: 702752 - RNA, 16 nt, Homo sapiens
ugaaaagaaucagcau

SEQ ID NO: 702753 - RNA, 16 nt, Homo sapiens
ugaaaagaugguauca

SEQ ID NO: 702754 - RNA, 14 nt, Homo sapiens
ugaaaaugaaagga

SEQ ID NO: 702755 - RNA, 17 nt, Homo sapiens
ugaaaauguccaggaaa

SEQ ID NO: 702756 - RNA, 20 nt, Homo sapiens
ugaaaauugggcaugccauu

SEQ ID NO: 702757 - RNA, 22 nt, Homo sapiens
ugaaaccagaaggauauuuacu

SEQ ID NO: 702758 - RNA, 16 nt, Homo sapiens
ugaaacuaaagcaaua

SEQ ID NO: 702759 - RNA, 24 nt, Homo sapiens
ugaaacuuuagagauuaacgacaa

SEQ ID NO: 702760 - RNA, 12 nt, Homo sapiens
ugaaaugcauau

SEQ ID NO: 702761 - RNA, 22 nt, Homo sapiens
ugaaauguaggcaucaugcaug

SEQ ID NO: 702762 - RNA, 13 nt, Homo sapiens
ugaaauguuacaa

SEQ ID NO: 702763 - RNA, 12 nt, Homo sapiens
ugaacacucccc

SEQ ID NO: 702764 - RNA, 20 nt, Homo sapiens
ugaacuacuaaaguuuuaca

SEQ ID NO: 702765 - RNA, 15 nt, Homo sapiens
ugaagagcuauuaua

SEQ ID NO: 702766 - RNA, 18 nt, Homo sapiens
ugaagggucuuucucaaa

SEQ ID NO: 702767 - RNA, 23 nt, Homo sapiens
ugaaguaaugaauuuuuaugaua

SEQ ID NO: 702768 - RNA, 14 nt, Homo sapiens
ugaaguuuuacugu

SEQ ID NO: 702769 - RNA, 17 nt, Homo sapiens
ugaaguuuuacugucua

SEQ ID NO: 702770 - RNA, 15 nt, Homo sapiens
ugaauaaaguguaag

SEQ ID NO: 702771 - RNA, 13 nt, Homo sapiens
ugaauaauacagu

SEQ ID NO: 702772 - RNA, 13 nt, Homo sapiens
ugaauauguagua

SEQ ID NO: 702773 - RNA, 17 nt, Homo sapiens
ugaauuauugacacuga

SEQ ID NO: 702774 - RNA, 17 nt, Homo sapiens
ugaauuuucaaguaauu

SEQ ID NO: 702775 - RNA, 16 nt, Homo sapiens
ugaauuuuuaugauau

SEQ ID NO: 702776 - RNA, 22 nt, Homo sapiens
ugacaacugugacuguacccaa

SEQ ID NO: 702777 - RNA, 21 nt, Homo sapiens
ugacacacaaaucccauuaaa

SEQ ID NO: 702778 - RNA, 15 nt, Homo sapiens
ugaccaaugugugaa

SEQ ID NO: 702779 - RNA, 18 nt, Homo sapiens
ugaccacuugaggccuga

SEQ ID NO: 702780 - RNA, 15 nt, Homo sapiens
ugacugucucacuua

SEQ ID NO: 702781 - RNA, 20 nt, Homo sapiens
ugacuguguuguaccaaaau

SEQ ID NO: 702782 - RNA, 17 nt, Homo sapiens
ugagaaagaaacuaaua

SEQ ID NO: 702783 - RNA, 20 nt, Homo sapiens
ugagacucagugcagaugga

SEQ ID NO: 702784 - RNA, 19 nt, Homo sapiens
ugagcugccuguaacuuga

SEQ ID NO: 702785 - RNA, 18 nt, Homo sapiens
ugaggcggcccugaccaa

SEQ ID NO: 702786 - RNA, 17 nt, Homo sapiens
ugaggggcuggcacuga

SEQ ID NO: 702787 - RNA, 17 nt, Homo sapiens
ugaguagaguugaucaa

SEQ ID NO: 702788 - RNA, 22 nt, Homo sapiens
ugaguugcacuuauugaccauu

SEQ ID NO: 702789 - RNA, 18 nt, Homo sapiens
ugaguuucuuaacccuuu

SEQ ID NO: 702790 - RNA, 22 nt, Homo sapiens
ugaguuucuuaacccuuuccag

SEQ ID NO: 702791 - RNA, 15 nt, Homo sapiens
ugauaaagcaguauu

SEQ ID NO: 702792 - RNA, 18 nt, Homo sapiens
ugauaaagcaguauuugg

SEQ ID NO: 702793 - RNA, 20 nt, Homo sapiens
ugauacuggaggaacacuug

SEQ ID NO: 702794 - RNA, 23 nt, Homo sapiens
ugauccacuuugggggaggagaa

SEQ ID NO: 702795 - RNA, 19 nt, Homo sapiens
ugauccuaggcauuugcug

SEQ ID NO: 702796 - RNA, 17 nt, Homo sapiens
ugauccuccaacagcug

SEQ ID NO: 702797 - RNA, 14 nt, Homo sapiens
ugaucuaauuuaca

SEQ ID NO: 702798 - RNA, 18 nt, Homo sapiens
ugaucuccauaaacauga

SEQ ID NO: 702799 - RNA, 20 nt, Homo sapiens
ugaucuccauaaacaugaaa

SEQ ID NO: 702800 - RNA, 21 nt, Homo sapiens
ugauggacacuccagggacac

SEQ ID NO: 702801 - RNA, 20 nt, Homo sapiens
ugauguuuguguauguggga

SEQ ID NO: 702802 - RNA, 21 nt, Homo sapiens
ugauugggaaaacauuugcug

SEQ ID NO: 702803 - RNA, 12 nt, Homo sapiens
ugauuuacauaa

SEQ ID NO: 702804 - RNA, 16 nt, Homo sapiens
ugauuuggugaccaac

SEQ ID NO: 702805 - RNA, 14 nt, Homo sapiens
ugauuuuuuuccac

SEQ ID NO: 702806 - RNA, 17 nt, Homo sapiens
ugcaaaaagcuagucaa

SEQ ID NO: 702807 - RNA, 22 nt, Homo sapiens
ugcaaaauacaugaagcuucau

SEQ ID NO: 702808 - RNA, 18 nt, Homo sapiens
ugcaauagacacauacau

SEQ ID NO: 702809 - RNA, 21 nt, Homo sapiens
ugcacauccgcgugugccugu

SEQ ID NO: 702810 - RNA, 20 nt, Homo sapiens
ugcaccacuuccgucccauc

SEQ ID NO: 702811 - RNA, 19 nt, Homo sapiens
ugcagaauugagagugauu

SEQ ID NO: 702812 - RNA, 16 nt, Homo sapiens
ugcaggacuugagaag

SEQ ID NO: 702813 - RNA, 20 nt, Homo sapiens
ugcaggacuugagaagaccu

SEQ ID NO: 702814 - RNA, 14 nt, Homo sapiens
ugcaguccuacuca

SEQ ID NO: 702815 - RNA, 15 nt, Homo sapiens
ugcaguucuacucag

SEQ ID NO: 702816 - RNA, 17 nt, Homo sapiens
ugcauaggaauugcaca

SEQ ID NO: 702817 - RNA, 13 nt, Homo sapiens
ugcaucuuugaug

SEQ ID NO: 702818 - RNA, 16 nt, Homo sapiens
ugcaugcuucuucuca

SEQ ID NO: 702819 - RNA, 22 nt, Homo sapiens
ugcauucauuuuuauagcaaca

SEQ ID NO: 702820 - RNA, 10 nt, Homo sapiens
ugccaaaaau

SEQ ID NO: 702821 - RNA, 21 nt, Homo sapiens
ugccaaccggucacccaggag

SEQ ID NO: 702822 - RNA, 22 nt, Homo sapiens
ugccaaggaaacccccagugua

SEQ ID NO: 702823 - RNA, 18 nt, Homo sapiens
cuauuauaaaacuugaau

SEQ ID NO: 702824 - RNA, 16 nt, Homo sapiens
cuauucugagaaaaca

SEQ ID NO: 702825 - RNA, 16 nt, Homo sapiens
cuauuucaucacaaga

SEQ ID NO: 702826 - RNA, 19 nt, Homo sapiens
cucaaacucuuaaaaccca

SEQ ID NO: 702827 - RNA, 20 nt, Homo sapiens
cucaaauauuugcuaugaag

SEQ ID NO: 702828 - RNA, 16 nt, Homo sapiens
cucaacuaccauuccu

SEQ ID NO: 702829 - RNA, 22 nt, Homo sapiens
cucaaugcaguuagcugaagaa

SEQ ID NO: 702830 - RNA, 22 nt, Homo sapiens
cucacacggacacucaaaagcu

SEQ ID NO: 702831 - RNA, 19 nt, Homo sapiens
cucaccuagccugaugaga

SEQ ID NO: 702832 - RNA, 12 nt, Homo sapiens
cucacgccugua

SEQ ID NO: 702833 - RNA, 13 nt, Homo sapiens
cucagagcucucu

SEQ ID NO: 702834 - RNA, 13 nt, Homo sapiens
cucagcaaaagau

SEQ ID NO: 702835 - RNA, 14 nt, Homo sapiens
cucagggcagccuc

SEQ ID NO: 702836 - RNA, 23 nt, Homo sapiens
cucagggcagccucccccggcuc

SEQ ID NO: 702837 - RNA, 15 nt, Homo sapiens
cucauauaagacaaa

SEQ ID NO: 702838 - RNA, 17 nt, Homo sapiens
cucaucacuacaguauu

SEQ ID NO: 702839 - RNA, 13 nt, Homo sapiens
cuccaaacugaag

SEQ ID NO: 702840 - RNA, 17 nt, Homo sapiens
cuccaacccugccguca

SEQ ID NO: 702841 - RNA, 23 nt, Homo sapiens
cuccaacccugccgucaccacca

SEQ ID NO: 702842 - RNA, 13 nt, Homo sapiens
cuccacaucugcc

SEQ ID NO: 702843 - RNA, 17 nt, Homo sapiens
cuccacaucugccuuaa

SEQ ID NO: 702844 - RNA, 20 nt, Homo sapiens
cuccagauguuuccagacuu

SEQ ID NO: 702845 - RNA, 13 nt, Homo sapiens
cuccaggugcaga

SEQ ID NO: 702846 - RNA, 21 nt, Homo sapiens
cucccaaaaaacuacuucuuu

SEQ ID NO: 702847 - RNA, 16 nt, Homo sapiens
cucccagugaugcugu

SEQ ID NO: 702848 - RNA, 11 nt, Homo sapiens
cuccccagugc

SEQ ID NO: 702849 - RNA, 19 nt, Homo sapiens
cuccccagugcaaaugcau

SEQ ID NO: 702850 - RNA, 13 nt, Homo sapiens
cucccccaguucc

SEQ ID NO: 702851 - RNA, 23 nt, Homo sapiens
cucccugcagaugccacccuagc

SEQ ID NO: 702852 - RNA, 15 nt, Homo sapiens
cuccgcaggacuucc

SEQ ID NO: 702853 - RNA, 22 nt, Homo sapiens
cuccucuggacggcaggcucac

SEQ ID NO: 702854 - RNA, 19 nt, Homo sapiens
cuccugucccuugaccuua

SEQ ID NO: 702855 - RNA, 13 nt, Homo sapiens
cuccuuuacuaaa

SEQ ID NO: 702856 - RNA, 12 nt, Homo sapiens
cucguggcuguc

SEQ ID NO: 702857 - RNA, 13 nt, Homo sapiens
cucuaacauuucc

SEQ ID NO: 702858 - RNA, 17 nt, Homo sapiens
cucuaagucauguaugu

SEQ ID NO: 702859 - RNA, 21 nt, Homo sapiens
cucuaagucauguauguuucu

SEQ ID NO: 702860 - RNA, 13 nt, Homo sapiens
cucuacaaaaagc

SEQ ID NO: 702861 - RNA, 22 nt, Homo sapiens
cucuacuugcaagccucaaaga

SEQ ID NO: 702862 - RNA, 13 nt, Homo sapiens
cucuagaagccaa

SEQ ID NO: 702863 - RNA, 20 nt, Homo sapiens
cucuaucggagaacaugaau

SEQ ID NO: 702864 - RNA, 17 nt, Homo sapiens
cucucagcaggcaaaga

SEQ ID NO: 702865 - RNA, 19 nt, Homo sapiens
cucucauauaagacaaaua

SEQ ID NO: 702866 - RNA, 21 nt, Homo sapiens
cucuccggggccauuugcaau

SEQ ID NO: 702867 - RNA, 17 nt, Homo sapiens
cucuccucgguucaagg

SEQ ID NO: 702868 - RNA, 17 nt, Homo sapiens
cucugaauuuacuuccu

SEQ ID NO: 702869 - RNA, 22 nt, Homo sapiens
cucugcacaagcugcacccuca

SEQ ID NO: 702870 - RNA, 19 nt, Homo sapiens
cucuggauuccacacugca

SEQ ID NO: 702871 - RNA, 19 nt, Homo sapiens
cucugugcagucacuggag

SEQ ID NO: 702872 - RNA, 12 nt, Homo sapiens
cucugugcucuu

SEQ ID NO: 702873 - RNA, 20 nt, Homo sapiens
cucuguuaccacgacuucua

SEQ ID NO: 702874 - RNA, 14 nt, Homo sapiens
cucuucagaugcca

SEQ ID NO: 702875 - RNA, 13 nt, Homo sapiens
cucuucaucccau

SEQ ID NO: 702876 - RNA, 14 nt, Homo sapiens
cucuuccugugauc

SEQ ID NO: 702877 - RNA, 16 nt, Homo sapiens
cucuuccugugaucca

SEQ ID NO: 702878 - RNA, 17 nt, Homo sapiens
cucuugcccauccugac

SEQ ID NO: 702879 - RNA, 18 nt, Homo sapiens
cugaaccauguggauaac

SEQ ID NO: 702880 - RNA, 15 nt, Homo sapiens
cugaaccauguggca

SEQ ID NO: 702881 - RNA, 15 nt, Homo sapiens
cugaacuugccuuaa

SEQ ID NO: 702882 - RNA, 22 nt, Homo sapiens
cugaaggaaaaacacaagcaaa

SEQ ID NO: 702883 - RNA, 20 nt, Homo sapiens
cugaauuccagcaaaagagc

SEQ ID NO: 702884 - RNA, 16 nt, Homo sapiens
cugaccuguguucccu

SEQ ID NO: 702885 - RNA, 15 nt, Homo sapiens
cugacuggugcugca

SEQ ID NO: 702886 - RNA, 14 nt, Homo sapiens
cugagacagggauu

SEQ ID NO: 702887 - RNA, 12 nt, Homo sapiens
cugagacugugc

SEQ ID NO: 702888 - RNA, 18 nt, Homo sapiens
cugagacuuucagugcac

SEQ ID NO: 702889 - RNA, 22 nt, Homo sapiens
cugaggaaagauucaacugccu

SEQ ID NO: 702890 - RNA, 12 nt, Homo sapiens
cugaggugggag

SEQ ID NO: 702891 - RNA, 20 nt, Homo sapiens
cugaugguguggccuguggc

SEQ ID NO: 702892 - RNA, 14 nt, Homo sapiens
cugauuugaugaua

SEQ ID NO: 702893 - RNA, 22 nt, Homo sapiens
cugcaaaggcgucugaaugugu

SEQ ID NO: 702894 - RNA, 21 nt, Homo sapiens
cugcagcuuuguuuguuguca

SEQ ID NO: 702895 - RNA, 22 nt, Homo sapiens
cugcagggccauggcucagggu

SEQ ID NO: 702896 - RNA, 15 nt, Homo sapiens
cugcaguccuacuca

SEQ ID NO: 702897 - RNA, 22 nt, Homo sapiens
cugcauuuagggaguauucuaa

SEQ ID NO: 702898 - RNA, 15 nt, Homo sapiens
cugcauuuccucgca

SEQ ID NO: 702899 - RNA, 21 nt, Homo sapiens
cugccauuacagagguauuaa

SEQ ID NO: 702900 - RNA, 20 nt, Homo sapiens
cugcccacuguuucucuuga

SEQ ID NO: 702901 - RNA, 13 nt, Homo sapiens
cugcccagacaag

SEQ ID NO: 702902 - RNA, 23 nt, Homo sapiens
cugccccaucuccccucagcucg

SEQ ID NO: 702903 - RNA, 18 nt, Homo sapiens
cugccucuuucccuagga

SEQ ID NO: 702904 - RNA, 12 nt, Homo sapiens
cugccuguaacu

SEQ ID NO: 702905 - RNA, 19 nt, Homo sapiens
cugcgcucucuuugcaacu

SEQ ID NO: 702906 - RNA, 15 nt, Homo sapiens
cugcuagcuagcuca

SEQ ID NO: 702907 - RNA, 13 nt, Homo sapiens
cugcucccuggca

SEQ ID NO: 702908 - RNA, 16 nt, Homo sapiens
cugcugcuccagugca

SEQ ID NO: 702909 - RNA, 15 nt, Homo sapiens
cugcugucauaacau

SEQ ID NO: 702910 - RNA, 22 nt, Homo sapiens
cugcuugaauaaacaccacugg

SEQ ID NO: 702911 - RNA, 15 nt, Homo sapiens
cuggaaucacauucu

SEQ ID NO: 702912 - RNA, 21 nt, Homo sapiens
cuggaauuguggcuauccuga

SEQ ID NO: 702913 - RNA, 21 nt, Homo sapiens
cuggacaguaucccacaucca

SEQ ID NO: 702914 - RNA, 21 nt, Homo sapiens
cuggagcccuaaccccuucca

SEQ ID NO: 702915 - RNA, 17 nt, Homo sapiens
cuggagcucaucugcaa

SEQ ID NO: 702916 - RNA, 18 nt, Homo sapiens
cuggagcucaucugcaaa

SEQ ID NO: 702917 - RNA, 17 nt, Homo sapiens
cuggagguugaagccaa

SEQ ID NO: 702918 - RNA, 13 nt, Homo sapiens
cuggaugucucca

SEQ ID NO: 702919 - RNA, 20 nt, Homo sapiens
cuggccucucuagcacaauu

SEQ ID NO: 702920 - RNA, 18 nt, Homo sapiens
cuggcugagguuccucug

SEQ ID NO: 702921 - RNA, 13 nt, Homo sapiens
cugggccaugucc

SEQ ID NO: 702922 - RNA, 15 nt, Homo sapiens
cugggccauguccaa

SEQ ID NO: 702923 - RNA, 18 nt, Homo sapiens
cugggccauguccaaaga

SEQ ID NO: 702924 - RNA, 16 nt, Homo sapiens
cugggccgcugccacg

SEQ ID NO: 702925 - RNA, 14 nt, Homo sapiens
cugggccgggaccc

SEQ ID NO: 702926 - RNA, 15 nt, Homo sapiens
cugggcuugucugua

SEQ ID NO: 702927 - RNA, 15 nt, Homo sapiens
cuggggccuccagaa

SEQ ID NO: 702928 - RNA, 17 nt, Homo sapiens
cuggggggacccagugc

SEQ ID NO: 702929 - RNA, 19 nt, Homo sapiens
cuggggggacccagugcag

SEQ ID NO: 702930 - RNA, 15 nt, Homo sapiens
cuggguuugagaaau

SEQ ID NO: 702931 - RNA, 16 nt, Homo sapiens
cugguuuucugccaau

SEQ ID NO: 702932 - RNA, 21 nt, Homo sapiens
cuguaaagacuuuuucaaaga

SEQ ID NO: 702933 - RNA, 17 nt, Homo sapiens
cuguaaucccagcacuu

SEQ ID NO: 702934 - RNA, 21 nt, Homo sapiens
cuguaaucccagcuacucggg

SEQ ID NO: 702935 - RNA, 21 nt, Homo sapiens
cuguaauccuagcacuuuggg

SEQ ID NO: 702936 - RNA, 16 nt, Homo sapiens
cuguacacauauuuga

SEQ ID NO: 702937 - RNA, 19 nt, Homo sapiens
cuguagucccagcuacucg

SEQ ID NO: 702938 - RNA, 18 nt, Homo sapiens
cuguagucccagcuacuu

SEQ ID NO: 702939 - RNA, 21 nt, Homo sapiens
cuguauuugaaagugccuuug

SEQ ID NO: 702940 - RNA, 14 nt, Homo sapiens
cugucaaaugaugu

SEQ ID NO: 702941 - RNA, 18 nt, Homo sapiens
cugucauaacauccagag

SEQ ID NO: 702942 - RNA, 23 nt, Homo sapiens
cuguccacgcgugccguggcacc

SEQ ID NO: 702943 - RNA, 18 nt, Homo sapiens
cugucccauagucccugc

SEQ ID NO: 702944 - RNA, 15 nt, Homo sapiens
cugugcagucacugg

SEQ ID NO: 702945 - RNA, 22 nt, Homo sapiens
cugugcccuccugacccauugc

SEQ ID NO: 702946 - RNA, 18 nt, Homo sapiens
cugugcuucgguaggcga

SEQ ID NO: 702947 - RNA, 18 nt, Homo sapiens
cuguggaugauaaaacac

SEQ ID NO: 702948 - RNA, 22 nt, Homo sapiens
cugugggcauggucaaaggcuc

SEQ ID NO: 702949 - RNA, 20 nt, Homo sapiens
cugugguuccucugcucacc

SEQ ID NO: 702950 - RNA, 18 nt, Homo sapiens
cuguguaaacucaucuga

SEQ ID NO: 702951 - RNA, 19 nt, Homo sapiens
cuguguaaacucaucugaa

SEQ ID NO: 702952 - RNA, 14 nt, Homo sapiens
cuguuaauagucau

SEQ ID NO: 702953 - RNA, 17 nt, Homo sapiens
cuguucagcugguugag

SEQ ID NO: 702954 - RNA, 22 nt, Homo sapiens
cuguucggaagggguuccucaa

SEQ ID NO: 702955 - RNA, 18 nt, Homo sapiens
cuguugcuuaaaccacuu

SEQ ID NO: 702956 - RNA, 14 nt, Homo sapiens
cuguuggugggacc

SEQ ID NO: 702957 - RNA, 17 nt, Homo sapiens
cuguuguagaagacaaa

SEQ ID NO: 702958 - RNA, 23 nt, Homo sapiens
cuguuuaaucauaguuacugugu

SEQ ID NO: 702959 - RNA, 19 nt, Homo sapiens
cuguuugaaaacuucagaa

SEQ ID NO: 702960 - RNA, 19 nt, Homo sapiens
cuguuuucuuuugguaaag

SEQ ID NO: 702961 - RNA, 14 nt, Homo sapiens
cuuaaaaaaaccau

SEQ ID NO: 702962 - RNA, 14 nt, Homo sapiens
cuuaaaacacguuu

SEQ ID NO: 702963 - RNA, 17 nt, Homo sapiens
cuuaaaacacguuuuaa

SEQ ID NO: 702964 - RNA, 19 nt, Homo sapiens
cuuaaaauaauauacaugc

SEQ ID NO: 702965 - RNA, 23 nt, Homo sapiens
cuuaaaccgccaaggcuggggga

SEQ ID NO: 702966 - RNA, 14 nt, Homo sapiens
cuuaacacuugacc

SEQ ID NO: 702967 - RNA, 18 nt, Homo sapiens
cuuaagacagaguauccu

SEQ ID NO: 702968 - RNA, 16 nt, Homo sapiens
cuuaagagacacucca

SEQ ID NO: 702969 - RNA, 20 nt, Homo sapiens
cuuaaggaagaagaguauua

SEQ ID NO: 702970 - RNA, 20 nt, Homo sapiens
cuuaagggguaucauguaug

SEQ ID NO: 702971 - RNA, 19 nt, Homo sapiens
gaagugcuggcaaccacua

SEQ ID NO: 702972 - RNA, 15 nt, Homo sapiens
gaaguucaagaucaa

SEQ ID NO: 702973 - RNA, 16 nt, Homo sapiens
gaaguugaaaaucaua

SEQ ID NO: 702974 - RNA, 16 nt, Homo sapiens
gaauaaauguuuuauu

SEQ ID NO: 702975 - RNA, 13 nt, Homo sapiens
gaauacugugcau

SEQ ID NO: 702976 - RNA, 21 nt, Homo sapiens
gaauaugauuaaaaauaucaa

SEQ ID NO: 702977 - RNA, 13 nt, Homo sapiens
gaaucacauucuu

SEQ ID NO: 702978 - RNA, 14 nt, Homo sapiens
gaaucagcaugaaa

SEQ ID NO: 702979 - RNA, 15 nt, Homo sapiens
gaaugaacacucccc

SEQ ID NO: 702980 - RNA, 23 nt, Homo sapiens
gaauguguggccugcacagugaa

SEQ ID NO: 702981 - RNA, 14 nt, Homo sapiens
gaauuaagcccuaa

SEQ ID NO: 702982 - RNA, 15 nt, Homo sapiens
gaauuacgugcucug

SEQ ID NO: 702983 - RNA, 20 nt, Homo sapiens
gaauuauaauuaguuccuca

SEQ ID NO: 702984 - RNA, 13 nt, Homo sapiens
gaauucaaacugg

SEQ ID NO: 702985 - RNA, 22 nt, Homo sapiens
gaauuuaguauuaucaaaggga

SEQ ID NO: 702986 - RNA, 22 nt, Homo sapiens
gaauuuuuuuguaauaagcaau

SEQ ID NO: 702987 - RNA, 16 nt, Homo sapiens
gacaaaauauuuccca

SEQ ID NO: 702988 - RNA, 16 nt, Homo sapiens
gacaaagugagacucc

SEQ ID NO: 702989 - RNA, 15 nt, Homo sapiens
gacaacugugacugu

SEQ ID NO: 702990 - RNA, 16 nt, Homo sapiens
gacaacugugacugua

SEQ ID NO: 702991 - RNA, 23 nt, Homo sapiens
gacaagauuuuuuaauuguuuaa

SEQ ID NO: 702992 - RNA, 17 nt, Homo sapiens
gacagaaggugccacuu

SEQ ID NO: 702993 - RNA, 23 nt, Homo sapiens
gaccaaugugugaaguaugcacu

SEQ ID NO: 702994 - RNA, 12 nt, Homo sapiens
gacccagugcag

SEQ ID NO: 702995 - RNA, 16 nt, Homo sapiens
gaccuaguauaucagu

SEQ ID NO: 702996 - RNA, 16 nt, Homo sapiens
gaccucaccuagaaau

SEQ ID NO: 702997 - RNA, 14 nt, Homo sapiens
gaccugagaaccuu

SEQ ID NO: 702998 - RNA, 17 nt, Homo sapiens
gaccugaggcugugguc

SEQ ID NO: 702999 - RNA, 22 nt, Homo sapiens
gacgccacucauuucaucucau

SEQ ID NO: 703000 - RNA, 14 nt, Homo sapiens
gacgccaugugaug

SEQ ID NO: 703001 - RNA, 20 nt, Homo sapiens
gacuacccauagacaugaaa

SEQ ID NO: 703002 - RNA, 14 nt, Homo sapiens
gacucagagcucuc

SEQ ID NO: 703003 - RNA, 13 nt, Homo sapiens
gacucagugcaga

SEQ ID NO: 703004 - RNA, 17 nt, Homo sapiens
gacucaguggguuaaca

SEQ ID NO: 703005 - RNA, 20 nt, Homo sapiens
gacugacugaggcaguuuga

SEQ ID NO: 703006 - RNA, 13 nt, Homo sapiens
gacuggagcucau

SEQ ID NO: 703007 - RNA, 17 nt, Homo sapiens
gacuggagcucaucugc

SEQ ID NO: 703008 - RNA, 16 nt, Homo sapiens
gacuggcuuuuauuaa

SEQ ID NO: 703009 - RNA, 16 nt, Homo sapiens
gacugguaaguaacug

SEQ ID NO: 703010 - RNA, 16 nt, Homo sapiens
gacugucucacuuaau

SEQ ID NO: 703011 - RNA, 16 nt, Homo sapiens
gacuuaacauagccaa

SEQ ID NO: 703012 - RNA, 17 nt, Homo sapiens
gacuuaacauagccaaa

SEQ ID NO: 703013 - RNA, 17 nt, Homo sapiens
gacuucugccuggagac

SEQ ID NO: 703014 - RNA, 23 nt, Homo sapiens
gacuucuugguacccagucaccu

SEQ ID NO: 703015 - RNA, 12 nt, Homo sapiens
gagaaccuucca

SEQ ID NO: 703016 - RNA, 20 nt, Homo sapiens
gagaagcugcaggcuuugcc

SEQ ID NO: 703017 - RNA, 15 nt, Homo sapiens
gagaaggaaagugau

SEQ ID NO: 703018 - RNA, 16 nt, Homo sapiens
gagaaggaaagugauu

SEQ ID NO: 703019 - RNA, 14 nt, Homo sapiens
gagacagugaggcu

SEQ ID NO: 703020 - RNA, 18 nt, Homo sapiens
gagacgguuuccagggag

SEQ ID NO: 703021 - RNA, 13 nt, Homo sapiens
gagacuaauucua

SEQ ID NO: 703022 - RNA, 16 nt, Homo sapiens
gagacuccgucucaaa

SEQ ID NO: 703023 - RNA, 20 nt, Homo sapiens
gagagcaaauaaagaccuga

SEQ ID NO: 703024 - RNA, 17 nt, Homo sapiens
gagagccuggugcugcu

SEQ ID NO: 703025 - RNA, 13 nt, Homo sapiens
gagaggcaggcau

SEQ ID NO: 703026 - RNA, 18 nt, Homo sapiens
gagagggaggucacugga

SEQ ID NO: 703027 - RNA, 16 nt, Homo sapiens
gagagucgcaucucag

SEQ ID NO: 703028 - RNA, 16 nt, Homo sapiens
gagauaagucuuucau

SEQ ID NO: 703029 - RNA, 17 nt, Homo sapiens
gagaucgcgccacugca

SEQ ID NO: 703030 - RNA, 20 nt, Homo sapiens
gagaucgcgccacugcacuc

SEQ ID NO: 703031 - RNA, 21 nt, Homo sapiens
gagaucgugcuacugcacucc

SEQ ID NO: 703032 - RNA, 16 nt, Homo sapiens
gagauuucaugccugg

SEQ ID NO: 703033 - RNA, 21 nt, Homo sapiens
gagcaaauaaagaccugagaa

SEQ ID NO: 703034 - RNA, 20 nt, Homo sapiens
gagccagcuuggggccacca

SEQ ID NO: 703035 - RNA, 21 nt, Homo sapiens
gagccagcuuggggccaccaa

SEQ ID NO: 703036 - RNA, 17 nt, Homo sapiens
gagcccauccagucucc

SEQ ID NO: 703037 - RNA, 23 nt, Homo sapiens
gagccucacuggggcagacaaua

SEQ ID NO: 703038 - RNA, 14 nt, Homo sapiens
gagccugcagggaa

SEQ ID NO: 703039 - RNA, 20 nt, Homo sapiens
gagccuucucagaagcacag

SEQ ID NO: 703040 - RNA, 14 nt, Homo sapiens
gagcuuucugcuau

SEQ ID NO: 703041 - RNA, 23 nt, Homo sapiens
gaggaaaagagaaggaaagugau

SEQ ID NO: 703042 - RNA, 17 nt, Homo sapiens
gaggaacacugcacucu

SEQ ID NO: 703043 - RNA, 12 nt, Homo sapiens
gaggagccuuuu

SEQ ID NO: 703044 - RNA, 19 nt, Homo sapiens
gaggauugcuugagcucag

SEQ ID NO: 703045 - RNA, 18 nt, Homo sapiens
gaggcaaagcuggcucac

SEQ ID NO: 703046 - RNA, 14 nt, Homo sapiens
gaggccaugugcau

SEQ ID NO: 703047 - RNA, 18 nt, Homo sapiens
gaggccgaggcgggugga

SEQ ID NO: 703048 - RNA, 14 nt, Homo sapiens
gaggcgcggaguga

SEQ ID NO: 703049 - RNA, 17 nt, Homo sapiens
gaggcugaggcacuggc

SEQ ID NO: 703050 - RNA, 13 nt, Homo sapiens
gaggcugcaguga

SEQ ID NO: 703051 - RNA, 21 nt, Homo sapiens
gaggcuucuccgccagccucc

SEQ ID NO: 703052 - RNA, 15 nt, Homo sapiens
gagggaguuacugaa

SEQ ID NO: 703053 - RNA, 22 nt, Homo sapiens
gagggccaaaauauuuggaaug

SEQ ID NO: 703054 - RNA, 13 nt, Homo sapiens
gagggcugcaguu

SEQ ID NO: 703055 - RNA, 21 nt, Homo sapiens
gaggggccggcccugugugca

SEQ ID NO: 703056 - RNA, 18 nt, Homo sapiens
gagggggcuugaagccaa

SEQ ID NO: 703057 - RNA, 19 nt, Homo sapiens
gagggggcuugaagccaaa

SEQ ID NO: 703058 - RNA, 19 nt, Homo sapiens
gaggguaaauaaaccacug

SEQ ID NO: 703059 - RNA, 21 nt, Homo sapiens
gagggugaggggcuggcacug

SEQ ID NO: 703060 - RNA, 14 nt, Homo sapiens
gaggucuaaucuag

SEQ ID NO: 703061 - RNA, 15 nt, Homo sapiens
gaggugggaggugga

SEQ ID NO: 703062 - RNA, 15 nt, Homo sapiens
gagguugaagccaag

SEQ ID NO: 703063 - RNA, 20 nt, Homo sapiens
gaguacacugccugccuuaa

SEQ ID NO: 703064 - RNA, 19 nt, Homo sapiens
gagucacugccaagucaua

SEQ ID NO: 703065 - RNA, 16 nt, Homo sapiens
ugccacuaaacuacau

SEQ ID NO: 703066 - RNA, 17 nt, Homo sapiens
ugccacuuuacccaccu

SEQ ID NO: 703067 - RNA, 20 nt, Homo sapiens
ugccagcuuaucucaggggu

SEQ ID NO: 703068 - RNA, 17 nt, Homo sapiens
ugccaucuguagcuaua

SEQ ID NO: 703069 - RNA, 23 nt, Homo sapiens
ugcccagaauaaguuauugcagu

SEQ ID NO: 703070 - RNA, 13 nt, Homo sapiens
ugccccaucuccc

SEQ ID NO: 703071 - RNA, 18 nt, Homo sapiens
ugcccuuccgcagugugg

SEQ ID NO: 703072 - RNA, 15 nt, Homo sapiens
ugccuaucugaccaa

SEQ ID NO: 703073 - RNA, 17 nt, Homo sapiens
ugccuaucugaccaaac

SEQ ID NO: 703074 - RNA, 23 nt, Homo sapiens
ugccucaccuaauaggcugggag

SEQ ID NO: 703075 - RNA, 16 nt, Homo sapiens
ugccucccacuucacu

SEQ ID NO: 703076 - RNA, 18 nt, Homo sapiens
ugccucccuccccagugc

SEQ ID NO: 703077 - RNA, 15 nt, Homo sapiens
ugccuuaaacacuca

SEQ ID NO: 703078 - RNA, 18 nt, Homo sapiens
ugcggccuuuggcuucac

SEQ ID NO: 703079 - RNA, 15 nt, Homo sapiens
ugcuagaagcuguaa

SEQ ID NO: 703080 - RNA, 21 nt, Homo sapiens
ugcuauccccaucucccugcc

SEQ ID NO: 703081 - RNA, 19 nt, Homo sapiens
ugcuaugaagcguugaugg

SEQ ID NO: 703082 - RNA, 18 nt, Homo sapiens
ugcuccagugcaggagac

SEQ ID NO: 703083 - RNA, 20 nt, Homo sapiens
ugcuccgaggacccaggaaa

SEQ ID NO: 703084 - RNA, 21 nt, Homo sapiens
ugcuccgaggacccaggaaag

SEQ ID NO: 703085 - RNA, 15 nt, Homo sapiens
ugcugcagagcagua

SEQ ID NO: 703086 - RNA, 14 nt, Homo sapiens
ugcuggugaaccag

SEQ ID NO: 703087 - RNA, 13 nt, Homo sapiens
ugcuggugcacag

SEQ ID NO: 703088 - RNA, 14 nt, Homo sapiens
ugcugugauuccac

SEQ ID NO: 703089 - RNA, 14 nt, Homo sapiens
ugcuguguguccca

SEQ ID NO: 703090 - RNA, 19 nt, Homo sapiens
ugcuucacaguagagccag

SEQ ID NO: 703091 - RNA, 22 nt, Homo sapiens
ugcuuccucccaacaagcagcu

SEQ ID NO: 703092 - RNA, 16 nt, Homo sapiens
ugcuucgucaauggcu

SEQ ID NO: 703093 - RNA, 13 nt, Homo sapiens
ugcuuggcacuua

SEQ ID NO: 703094 - RNA, 17 nt, Homo sapiens
uggaaaaagccugugaa

SEQ ID NO: 703095 - RNA, 15 nt, Homo sapiens
uggaaaacuguguug

SEQ ID NO: 703096 - RNA, 14 nt, Homo sapiens
uggaauuuugcaaa

SEQ ID NO: 703097 - RNA, 21 nt, Homo sapiens
uggaauuuugcaaagauuuaa

SEQ ID NO: 703098 - RNA, 19 nt, Homo sapiens
uggacuguggcacuugccu

SEQ ID NO: 703099 - RNA, 17 nt, Homo sapiens
uggagccccaggggaca

SEQ ID NO: 703100 - RNA, 21 nt, Homo sapiens
uggagcccuaaccccuuccag

SEQ ID NO: 703101 - RNA, 19 nt, Homo sapiens
uggaggaggaaggcaagag

SEQ ID NO: 703102 - RNA, 15 nt, Homo sapiens
uggaggcugcaguga

SEQ ID NO: 703103 - RNA, 20 nt, Homo sapiens
uggaguauguuaaguugaag

SEQ ID NO: 703104 - RNA, 14 nt, Homo sapiens
uggaucuaccagca

SEQ ID NO: 703105 - RNA, 22 nt, Homo sapiens
uggaugccaaccggucacccag

SEQ ID NO: 703106 - RNA, 16 nt, Homo sapiens
uggcacugacugggca

SEQ ID NO: 703107 - RNA, 16 nt, Homo sapiens
uggccaacaugaugaa

SEQ ID NO: 703108 - RNA, 22 nt, Homo sapiens
uggcccaaucucugccauauca

SEQ ID NO: 703109 - RNA, 13 nt, Homo sapiens
uggcccacugcau

SEQ ID NO: 703110 - RNA, 20 nt, Homo sapiens
uggcccuauuuaaggcagau

SEQ ID NO: 703111 - RNA, 20 nt, Homo sapiens
uggccgcggagccugcauuu

SEQ ID NO: 703112 - RNA, 17 nt, Homo sapiens
uggccuccccugccacc

SEQ ID NO: 703113 - RNA, 19 nt, Homo sapiens
uggccugcugugauuccac

SEQ ID NO: 703114 - RNA, 21 nt, Homo sapiens
uggccugcugugauuccacua

SEQ ID NO: 703115 - RNA, 20 nt, Homo sapiens
uggccuggacaguaucccac

SEQ ID NO: 703116 - RNA, 16 nt, Homo sapiens
uggcgggcaccuguag

SEQ ID NO: 703117 - RNA, 15 nt, Homo sapiens
uggcuaagcauuuau

SEQ ID NO: 703118 - RNA, 20 nt, Homo sapiens
uggcuccaacacugcugcuc

SEQ ID NO: 703119 - RNA, 17 nt, Homo sapiens
uggcugagguuccucug

SEQ ID NO: 703120 - RNA, 20 nt, Homo sapiens
uggcuguugacgcaccugug

SEQ ID NO: 703121 - RNA, 21 nt, Homo sapiens
uggcuucaccaucaauccuga

SEQ ID NO: 703122 - RNA, 13 nt, Homo sapiens
ugggacugagaug

SEQ ID NO: 703123 - RNA, 20 nt, Homo sapiens
ugggagacugaagacucagc

SEQ ID NO: 703124 - RNA, 21 nt, Homo sapiens
ugggaggcccugagacaggga

SEQ ID NO: 703125 - RNA, 14 nt, Homo sapiens
ugggaggcuucccc

SEQ ID NO: 703126 - RNA, 21 nt, Homo sapiens
ugggagggaguuacugaaguc

SEQ ID NO: 703127 - RNA, 21 nt, Homo sapiens
ugggagggggcuugaagccaa

SEQ ID NO: 703128 - RNA, 16 nt, Homo sapiens
ugggagguggaagaag

SEQ ID NO: 703129 - RNA, 23 nt, Homo sapiens
ugggaucacgaggaaaagagaag

SEQ ID NO: 703130 - RNA, 24 nt, Homo sapiens
ugggaugaaacuaaagcaauagaa

SEQ ID NO: 703131 - RNA, 16 nt, Homo sapiens
ugggcaaacaggcagu

SEQ ID NO: 703132 - RNA, 14 nt, Homo sapiens
ugggccacugugaa

SEQ ID NO: 703133 - RNA, 17 nt, Homo sapiens
ugggccccuggcacucu

SEQ ID NO: 703134 - RNA, 19 nt, Homo sapiens
ugggccccuggcacucuug

SEQ ID NO: 703135 - RNA, 12 nt, Homo sapiens
uggggcagacaa

SEQ ID NO: 703136 - RNA, 20 nt, Homo sapiens
ugggugaauaauacaguauc

SEQ ID NO: 703137 - RNA, 20 nt, Homo sapiens
ugggugacagagcaagugag

SEQ ID NO: 703138 - RNA, 23 nt, Homo sapiens
uggguugcaggaccucaggugag

SEQ ID NO: 703139 - RNA, 19 nt, Homo sapiens
ugguagcgggcgccuguag

SEQ ID NO: 703140 - RNA, 14 nt, Homo sapiens
ugguaucacugaac

SEQ ID NO: 703141 - RNA, 21 nt, Homo sapiens
ugguaucacugaacuacuaaa

SEQ ID NO: 703142 - RNA, 23 nt, Homo sapiens
uggucaagggcugucauugcaca

SEQ ID NO: 703143 - RNA, 16 nt, Homo sapiens
uggucggugggacccu

SEQ ID NO: 703144 - RNA, 20 nt, Homo sapiens
uggucguuuucaacagaauu

SEQ ID NO: 703145 - RNA, 20 nt, Homo sapiens
uggucuuaagaaauguauaa

SEQ ID NO: 703146 - RNA, 12 nt, Homo sapiens
uggugaugcagu

SEQ ID NO: 703147 - RNA, 17 nt, Homo sapiens
uggugcacugagcugca

SEQ ID NO: 703148 - RNA, 14 nt, Homo sapiens
ugguucacugcaac

SEQ ID NO: 703149 - RNA, 16 nt, Homo sapiens
uguaaaagacagugua

SEQ ID NO: 703150 - RNA, 20 nt, Homo sapiens
uguaaaguaaaagcuauaaa

SEQ ID NO: 703151 - RNA, 23 nt, Homo sapiens
uguaaauauuuauuuauguguuc

SEQ ID NO: 703152 - RNA, 16 nt, Homo sapiens
uguaagaaagcauaga

SEQ ID NO: 703153 - RNA, 16 nt, Homo sapiens
uguaagcauacuuugu

SEQ ID NO: 703154 - RNA, 14 nt, Homo sapiens
uguaaggugcuaca

SEQ ID NO: 703155 - RNA, 15 nt, Homo sapiens
uguaagugggcccac

SEQ ID NO: 703156 - RNA, 18 nt, Homo sapiens
uguaauaauaaaucgucc

SEQ ID NO: 703157 - RNA, 17 nt, Homo sapiens
uguaauguuauuuccac

SEQ ID NO: 703158 - RNA, 17 nt, Homo sapiens
uguacagauucuuucag

SEQ ID NO: 703159 - RNA, 20 nt, Homo sapiens
uguacaguagauuuuccaaa

SEQ ID NO: 703160 - RNA, 21 nt, Homo sapiens
uguacaguagauuuuccaaau

SEQ ID NO: 703161 - RNA, 16 nt, Homo sapiens
uguaccaagugaaauu

SEQ ID NO: 703162 - RNA, 19 nt, Homo sapiens
uguagaaaagaacuggaaa

SEQ ID NO: 703163 - RNA, 21 nt, Homo sapiens
uguagaguuuugucauucaga

SEQ ID NO: 703164 - RNA, 17 nt, Homo sapiens
uguaggcaucaugcaug

SEQ ID NO: 703165 - RNA, 18 nt, Homo sapiens
uguaggguccaaccagac

SEQ ID NO: 703166 - RNA, 13 nt, Homo sapiens
uguagguccucag

SEQ ID NO: 703167 - RNA, 21 nt, Homo sapiens
uguagucccagcuacuuggga

SEQ ID NO: 703168 - RNA, 22 nt, Homo sapiens
uguauauauuauuauaaucuua

SEQ ID NO: 703169 - RNA, 12 nt, Homo sapiens
uguauauuacau

SEQ ID NO: 703170 - RNA, 18 nt, Homo sapiens
uguaugaaaaauugggga

SEQ ID NO: 703171 - RNA, 16 nt, Homo sapiens
uguaugaaaacaugga

SEQ ID NO: 703172 - RNA, 11 nt, Homo sapiens
uguauguuaaa

SEQ ID NO: 703173 - RNA, 16 nt, Homo sapiens
ugucaaugacaguuuc

SEQ ID NO: 703174 - RNA, 21 nt, Homo sapiens
ugucacauuuagcugugcuca

SEQ ID NO: 703175 - RNA, 14 nt, Homo sapiens
ugucaccaugccca

SEQ ID NO: 703176 - RNA, 22 nt, Homo sapiens
ugucacccuuguccuugagugc

SEQ ID NO: 703177 - RNA, 14 nt, Homo sapiens
ugucauucagaguc

SEQ ID NO: 703178 - RNA, 11 nt, Homo sapiens
uguccaaagag

SEQ ID NO: 703179 - RNA, 17 nt, Homo sapiens
uguccaaagaggcugcc

SEQ ID NO: 703180 - RNA, 20 nt, Homo sapiens
uguccagcaccuugugccug

SEQ ID NO: 703181 - RNA, 23 nt, Homo sapiens
uguccuauuaguguuauaugaac

SEQ ID NO: 703182 - RNA, 19 nt, Homo sapiens
uguccuuaauugaugcaaa

SEQ ID NO: 703183 - RNA, 17 nt, Homo sapiens
uuuugccucaccuaaua

SEQ ID NO: 703184 - RNA, 18 nt, Homo sapiens
uuuugucuagaccuauua

SEQ ID NO: 703185 - RNA, 20 nt, Homo sapiens
uuuuuauaucaugcaaaaua

SEQ ID NO: 703186 - RNA, 16 nt, Homo sapiens
uuuuucaaaugaucuu

SEQ ID NO: 703187 - RNA, 15 nt, Homo sapiens
uuuuucuguggucuu

SEQ ID NO: 703188 - RNA, 11 nt, Homo sapiens
uuuuugcaaua

SEQ ID NO: 703189 - RNA, 21 nt, Homo sapiens
agaaauaauagaaaugucuca

SEQ ID NO: 703190 - RNA, 21 nt, Homo sapiens
agaaauacaauuuuagauauc

SEQ ID NO: 703191 - RNA, 14 nt, Homo sapiens
agaaaugucucaag

SEQ ID NO: 703192 - RNA, 23 nt, Homo sapiens
agaaauuuucauucagguauuug

SEQ ID NO: 703193 - RNA, 21 nt, Homo sapiens
agaacaugaaucaaaagugcc

SEQ ID NO: 703194 - RNA, 13 nt, Homo sapiens
agaacuacuucuu

SEQ ID NO: 703195 - RNA, 21 nt, Homo sapiens
agaacuauugugcucagagac

SEQ ID NO: 703196 - RNA, 18 nt, Homo sapiens
agaacucgcgcucaguaa

SEQ ID NO: 703197 - RNA, 22 nt, Homo sapiens
agaagauaugugaagaaaaaug

SEQ ID NO: 703198 - RNA, 21 nt, Homo sapiens
agaagcaguuguaccaaguga

SEQ ID NO: 703199 - RNA, 21 nt, Homo sapiens
agaaggugccacuuuacccac

SEQ ID NO: 703200 - RNA, 17 nt, Homo sapiens
agaaguugagagagcaa

SEQ ID NO: 703201 - RNA, 19 nt, Homo sapiens
agaauaccacaucaaauaa

SEQ ID NO: 703202 - RNA, 23 nt, Homo sapiens
agaaucagcauuuagucuugcca

SEQ ID NO: 703203 - RNA, 21 nt, Homo sapiens
agaaucccuguguuaauuuaa

SEQ ID NO: 703204 - RNA, 15 nt, Homo sapiens
agaaugaacacuccc

SEQ ID NO: 703205 - RNA, 22 nt, Homo sapiens
agaaugcugcaggacuugagaa

SEQ ID NO: 703206 - RNA, 16 nt, Homo sapiens
agacaaaauauuuccc

SEQ ID NO: 703207 - RNA, 20 nt, Homo sapiens
agacagauaccuccaacccu

SEQ ID NO: 703208 - RNA, 23 nt, Homo sapiens
agacagauaccuccaacccugcc

SEQ ID NO: 703209 - RNA, 17 nt, Homo sapiens
agacauacuccuuccau

SEQ ID NO: 703210 - RNA, 22 nt, Homo sapiens
agacauuuuaaaaaauggucac

SEQ ID NO: 703211 - RNA, 23 nt, Homo sapiens
agaccuggcggaggcuuuuccca

SEQ ID NO: 703212 - RNA, 17 nt, Homo sapiens
agacgguguuuugccau

SEQ ID NO: 703213 - RNA, 18 nt, Homo sapiens
agacuaauucuaaugugg

SEQ ID NO: 703214 - RNA, 17 nt, Homo sapiens
agacuacuaaugacuuu

SEQ ID NO: 703215 - RNA, 19 nt, Homo sapiens
agacuacuaaugacuuugu

SEQ ID NO: 703216 - RNA, 15 nt, Homo sapiens
agacuuaacacuucu

SEQ ID NO: 703217 - RNA, 13 nt, Homo sapiens
agagaaaguguga

SEQ ID NO: 703218 - RNA, 14 nt, Homo sapiens
agagaauauacaug

SEQ ID NO: 703219 - RNA, 17 nt, Homo sapiens
agagacagauaccucca

SEQ ID NO: 703220 - RNA, 15 nt, Homo sapiens
agagacuccgucuca

SEQ ID NO: 703221 - RNA, 20 nt, Homo sapiens
agagagaaaguuucguuaua

SEQ ID NO: 703222 - RNA, 22 nt, Homo sapiens
agagagucgcaucucagugcag

SEQ ID NO: 703223 - RNA, 23 nt, Homo sapiens
agagagucgcaucucagugcagg

SEQ ID NO: 703224 - RNA, 14 nt, Homo sapiens
agagauccaaagac

SEQ ID NO: 703225 - RNA, 21 nt, Homo sapiens
agagcaaaucaauucuaguca

SEQ ID NO: 703226 - RNA, 15 nt, Homo sapiens
agagcuuucaaguac

SEQ ID NO: 703227 - RNA, 17 nt, Homo sapiens
agaggcugccccucuca

SEQ ID NO: 703228 - RNA, 15 nt, Homo sapiens
agagggaggucacug

SEQ ID NO: 703229 - RNA, 21 nt, Homo sapiens
agagggcgugggcgcuugcac

SEQ ID NO: 703230 - RNA, 22 nt, Homo sapiens
agagggguggaguuuuaacugu

SEQ ID NO: 703231 - RNA, 22 nt, Homo sapiens
agagucuaauagucuuugccag

SEQ ID NO: 703232 - RNA, 17 nt, Homo sapiens
agaguuuugucauucag

SEQ ID NO: 703233 - RNA, 18 nt, Homo sapiens
agauaccuccaacccugc

SEQ ID NO: 703234 - RNA, 21 nt, Homo sapiens
agauauguauucuuuucucag

SEQ ID NO: 703235 - RNA, 13 nt, Homo sapiens
agauaugugaaga

SEQ ID NO: 703236 - RNA, 10 nt, Homo sapiens
agaucacugc

SEQ ID NO: 703237 - RNA, 20 nt, Homo sapiens
agaucgagaccauccuggcu

SEQ ID NO: 703238 - RNA, 18 nt, Homo sapiens
agaucgugcuacugcacu

SEQ ID NO: 703239 - RNA, 16 nt, Homo sapiens
agaugguuucuugcaa

SEQ ID NO: 703240 - RNA, 17 nt, Homo sapiens
agauguggcuacugaca

SEQ ID NO: 703241 - RNA, 20 nt, Homo sapiens
agauguggcuacugacauau

SEQ ID NO: 703242 - RNA, 19 nt, Homo sapiens
agauguguuaggaauguca

SEQ ID NO: 703243 - RNA, 23 nt, Homo sapiens
agauuaguauuuuccacgucacu

SEQ ID NO: 703244 - RNA, 18 nt, Homo sapiens
agauuauauauuauuucu

SEQ ID NO: 703245 - RNA, 14 nt, Homo sapiens
agauucuaccacac

SEQ ID NO: 703246 - RNA, 14 nt, Homo sapiens
agauucuucugugu

SEQ ID NO: 703247 - RNA, 12 nt, Homo sapiens
agauugaaucug

SEQ ID NO: 703248 - RNA, 22 nt, Homo sapiens
agauuuuacagagcgcaccuca

SEQ ID NO: 703249 - RNA, 17 nt, Homo sapiens
agcaaaagucauuacac

SEQ ID NO: 703250 - RNA, 13 nt, Homo sapiens
agcaaacaaguug

SEQ ID NO: 703251 - RNA, 14 nt, Homo sapiens
agcaacucagagaa

SEQ ID NO: 703252 - RNA, 13 nt, Homo sapiens
agcaacugugcaa

SEQ ID NO: 703253 - RNA, 18 nt, Homo sapiens
agcaaguuacagugaugc

SEQ ID NO: 703254 - RNA, 18 nt, Homo sapiens
agcaauacagacuacuuc

SEQ ID NO: 703255 - RNA, 22 nt, Homo sapiens
agcaauauaucugaagagcuau

SEQ ID NO: 703256 - RNA, 21 nt, Homo sapiens
agcaguuguaccaagugaaau

SEQ ID NO: 703257 - RNA, 20 nt, Homo sapiens
agcauagaaaccacuagaaa

SEQ ID NO: 703258 - RNA, 12 nt, Homo sapiens
agcaucucagga

SEQ ID NO: 703259 - RNA, 12 nt, Homo sapiens
agcaugaagucu

SEQ ID NO: 703260 - RNA, 16 nt, Homo sapiens
agcaugauauuuacug

SEQ ID NO: 703261 - RNA, 15 nt, Homo sapiens
agcaugcagcuuugc

SEQ ID NO: 703262 - RNA, 19 nt, Homo sapiens
agcauguuugccuagacag

SEQ ID NO: 703263 - RNA, 17 nt, Homo sapiens
agcauuuagucuugcca

SEQ ID NO: 703264 - RNA, 23 nt, Homo sapiens
agccaggccugggggcagccucu

SEQ ID NO: 703265 - RNA, 15 nt, Homo sapiens
agccagguaauguga

SEQ ID NO: 703266 - RNA, 22 nt, Homo sapiens
agccaucuaaaguaaaaaggga

SEQ ID NO: 703267 - RNA, 19 nt, Homo sapiens
agcccaccccucaacaccu

SEQ ID NO: 703268 - RNA, 22 nt, Homo sapiens
agcccacccugcugcuggugca

SEQ ID NO: 703269 - RNA, 18 nt, Homo sapiens
agcccauccagucuccca

SEQ ID NO: 703270 - RNA, 14 nt, Homo sapiens
agccccacugccag

SEQ ID NO: 703271 - RNA, 21 nt, Homo sapiens
agccgagacucgacucugugc

SEQ ID NO: 703272 - RNA, 19 nt, Homo sapiens
agccuagaagagcuucuga

SEQ ID NO: 703273 - RNA, 19 nt, Homo sapiens
agccuagcacagcagcuua

SEQ ID NO: 703274 - RNA, 13 nt, Homo sapiens
agccucacugggg

SEQ ID NO: 703275 - RNA, 20 nt, Homo sapiens
agccucacuggggcagacaa

SEQ ID NO: 703276 - RNA, 20 nt, Homo sapiens
agccucagcgcggcccuccc

SEQ ID NO: 703277 - RNA, 15 nt, Homo sapiens
agccuccccgugcca

SEQ ID NO: 703278 - RNA, 17 nt, Homo sapiens
agccugagcagagacau

SEQ ID NO: 703279 - RNA, 17 nt, Homo sapiens
agccugauauugauaug

SEQ ID NO: 703280 - RNA, 13 nt, Homo sapiens
agccugcacuggg

SEQ ID NO: 703281 - RNA, 17 nt, Homo sapiens
agccugcuccagcuguu

SEQ ID NO: 703282 - RNA, 18 nt, Homo sapiens
agccugcuggcacccacc

SEQ ID NO: 703283 - RNA, 14 nt, Homo sapiens
agccugggggacag

SEQ ID NO: 703284 - RNA, 18 nt, Homo sapiens
agcgcaguguuuugcaag

SEQ ID NO: 703285 - RNA, 16 nt, Homo sapiens
agcuaccucaaacuuc

SEQ ID NO: 703286 - RNA, 16 nt, Homo sapiens
agcuaugcaaaaagcu

SEQ ID NO: 703287 - RNA, 14 nt, Homo sapiens
agcucuuccuaucc

SEQ ID NO: 703288 - RNA, 13 nt, Homo sapiens
agcugaaccuggg

SEQ ID NO: 703289 - RNA, 13 nt, Homo sapiens
agcugcacccuca

SEQ ID NO: 703290 - RNA, 23 nt, Homo sapiens
agcugcaggcuuugccauuguga

SEQ ID NO: 703291 - RNA, 18 nt, Homo sapiens
agcuggccuggacaguau

SEQ ID NO: 703292 - RNA, 21 nt, Homo sapiens
agcugggccgggacccagggc

SEQ ID NO: 703293 - RNA, 23 nt, Homo sapiens
agcugucccuugcuugccugcag

SEQ ID NO: 703294 - RNA, 21 nt, Homo sapiens
agcuguggucaaggcuacaga

SEQ ID NO: 703295 - RNA, 20 nt, Homo sapiens
agcuuacuggcaaacaugaa

SEQ ID NO: 703296 - RNA, 14 nt, Homo sapiens
agcuuaucucaggg

SEQ ID NO: 703297 - RNA, 19 nt, Homo sapiens
agcuuggauuaaauacaua

SEQ ID NO: 703298 - RNA, 16 nt, Homo sapiens
agcuuugcugccugag

SEQ ID NO: 703299 - RNA, 21 nt, Homo sapiens
aggaaaacuaccuguauuuaa

SEQ ID NO: 703300 - RNA, 20 nt, Homo sapiens
aggaaacuccacaucugccu

SEQ ID NO: 703301 - RNA, 20 nt, Homo sapiens
aggaaauucuccacugugca

SEQ ID NO: 703302 - RNA, 21 nt, Homo sapiens
aggaacagcaaaugcaaaaac

SEQ ID NO: 703303 - RNA, 18 nt, Homo sapiens
aggaagccaggugagaaa

SEQ ID NO: 703304 - RNA, 20 nt, Homo sapiens
aggaagccucccacgacugc

SEQ ID NO: 703305 - RNA, 20 nt, Homo sapiens
aggaauauagaaugaaagac

SEQ ID NO: 703306 - RNA, 19 nt, Homo sapiens
auuaaucuggaauaugcaa

SEQ ID NO: 703307 - RNA, 15 nt, Homo sapiens
auuaaugcacuuucu

SEQ ID NO: 703308 - RNA, 21 nt, Homo sapiens
auuacaaggcuuuaucucagg

SEQ ID NO: 703309 - RNA, 19 nt, Homo sapiens
auuacccccuccuucagac

SEQ ID NO: 703310 - RNA, 24 nt, Homo sapiens
auuagaagacaacaggcauagcaa

SEQ ID NO: 703311 - RNA, 23 nt, Homo sapiens
auuagauuucuauaggauuuuuc

SEQ ID NO: 703312 - RNA, 18 nt, Homo sapiens
auuagcauuuugcuaaau

SEQ ID NO: 703313 - RNA, 17 nt, Homo sapiens
auuagccaaguguggua

SEQ ID NO: 703314 - RNA, 14 nt, Homo sapiens
auuaguaacauuca

SEQ ID NO: 703315 - RNA, 14 nt, Homo sapiens
auuauccacaugaa

SEQ ID NO: 703316 - RNA, 21 nt, Homo sapiens
auuauggaaaacuguguugcc

SEQ ID NO: 703317 - RNA, 19 nt, Homo sapiens
auuauugacacugaacuua

SEQ ID NO: 703318 - RNA, 21 nt, Homo sapiens
auucaauucuuuuaacuguug

SEQ ID NO: 703319 - RNA, 14 nt, Homo sapiens
auucagcucugcaa

SEQ ID NO: 703320 - RNA, 16 nt, Homo sapiens
auucagucacauggca

SEQ ID NO: 703321 - RNA, 17 nt, Homo sapiens
auucaucauagggauaa

SEQ ID NO: 703322 - RNA, 21 nt, Homo sapiens
auucaugugguuucuaugcaa

SEQ ID NO: 703323 - RNA, 16 nt, Homo sapiens
auuccagaucuuucag

SEQ ID NO: 703324 - RNA, 12 nt, Homo sapiens
auuccaguauca

SEQ ID NO: 703325 - RNA, 21 nt, Homo sapiens
auuccggaaacuaguguacau

SEQ ID NO: 703326 - RNA, 15 nt, Homo sapiens
auuccuagaaguuga

SEQ ID NO: 703327 - RNA, 16 nt, Homo sapiens
auucucaaaauuccua

SEQ ID NO: 703328 - RNA, 14 nt, Homo sapiens
auucuccacugugc

SEQ ID NO: 703329 - RNA, 21 nt, Homo sapiens
auucugccgcccccuccugaa

SEQ ID NO: 703330 - RNA, 22 nt, Homo sapiens
auucuuaguuguucaguugcca

SEQ ID NO: 703331 - RNA, 14 nt, Homo sapiens
auucuucaaccagu

SEQ ID NO: 703332 - RNA, 20 nt, Homo sapiens
auucuucagauauacuggaa

SEQ ID NO: 703333 - RNA, 15 nt, Homo sapiens
auucuuuuguaauau

SEQ ID NO: 703334 - RNA, 19 nt, Homo sapiens
auucuuuuuuuuuugucua

SEQ ID NO: 703335 - RNA, 21 nt, Homo sapiens
auugaaaauuuuuaaauauuc

SEQ ID NO: 703336 - RNA, 21 nt, Homo sapiens
auugaauuauauguucagauu

SEQ ID NO: 703337 - RNA, 21 nt, Homo sapiens
auugacaaccgagaagguuua

SEQ ID NO: 703338 - RNA, 12 nt, Homo sapiens
auugacacugaa

SEQ ID NO: 703339 - RNA, 23 nt, Homo sapiens
auugaccauuuuuuaauuuacuu

SEQ ID NO: 703340 - RNA, 23 nt, Homo sapiens
auugauauacacggaugacuuaa

SEQ ID NO: 703341 - RNA, 17 nt, Homo sapiens
auugggaaaacauuugc

SEQ ID NO: 703342 - RNA, 16 nt, Homo sapiens
auuguugaacacuuga

SEQ ID NO: 703343 - RNA, 21 nt, Homo sapiens
auuuaaaaauagaaacauauc

SEQ ID NO: 703344 - RNA, 15 nt, Homo sapiens
auuuaaaugccauag

SEQ ID NO: 703345 - RNA, 23 nt, Homo sapiens
auuuaaauuacaauuuuaucugu

SEQ ID NO: 703346 - RNA, 16 nt, Homo sapiens
auuuagucuugccagg

SEQ ID NO: 703347 - RNA, 21 nt, Homo sapiens
auuuaguuuguagcucauuaa

SEQ ID NO: 703348 - RNA, 20 nt, Homo sapiens
auuuauccagaaaacuguga

SEQ ID NO: 703349 - RNA, 22 nt, Homo sapiens
auuucaaaguuuuguuguacuu

SEQ ID NO: 703350 - RNA, 14 nt, Homo sapiens
auuucaccacugaa

SEQ ID NO: 703351 - RNA, 23 nt, Homo sapiens
auuucacuugaugauacaaugaa

SEQ ID NO: 703352 - RNA, 11 nt, Homo sapiens
auuucagggug

SEQ ID NO: 703353 - RNA, 20 nt, Homo sapiens
auuuccauugcuuauuaugu

SEQ ID NO: 703354 - RNA, 20 nt, Homo sapiens
auuucccuucauacuccuuu

SEQ ID NO: 703355 - RNA, 18 nt, Homo sapiens
auuuccuuuuugacacug

SEQ ID NO: 703356 - RNA, 13 nt, Homo sapiens
auuucuacuguca

SEQ ID NO: 703357 - RNA, 22 nt, Homo sapiens
auuucucauaucaacuuaguca

SEQ ID NO: 703358 - RNA, 19 nt, Homo sapiens
auuucucauugacuuuuau

SEQ ID NO: 703359 - RNA, 19 nt, Homo sapiens
auuucuccucccuuccuuu

SEQ ID NO: 703360 - RNA, 23 nt, Homo sapiens
auuugauuuuuuuuuuuaaucua

SEQ ID NO: 703361 - RNA, 20 nt, Homo sapiens
auuugcugcucuucauccca

SEQ ID NO: 703362 - RNA, 23 nt, Homo sapiens
auuugugugugugauauaugcau

SEQ ID NO: 703363 - RNA, 19 nt, Homo sapiens
auuuguuaaaauuaucaau

SEQ ID NO: 703364 - RNA, 23 nt, Homo sapiens
auuuuaauuuuuuuuaguauuua

SEQ ID NO: 703365 - RNA, 16 nt, Homo sapiens
auuuuacaagggcaua

SEQ ID NO: 703366 - RNA, 20 nt, Homo sapiens
auuuuacagagcgcaccuca

SEQ ID NO: 703367 - RNA, 16 nt, Homo sapiens
auuuugcaaagauuua

SEQ ID NO: 703368 - RNA, 19 nt, Homo sapiens
auuuugcuaaaugugaaug

SEQ ID NO: 703369 - RNA, 19 nt, Homo sapiens
auuuuguaagaaggcaaua

SEQ ID NO: 703370 - RNA, 24 nt, Homo sapiens
auuuuguaugaaaaaucaauguca

SEQ ID NO: 703371 - RNA, 15 nt, Homo sapiens
auuuuguauguuaaa

SEQ ID NO: 703372 - RNA, 17 nt, Homo sapiens
auuuuuaagcugcaaau

SEQ ID NO: 703373 - RNA, 22 nt, Homo sapiens
auuuuuagaauaagaauuugca

SEQ ID NO: 703374 - RNA, 17 nt, Homo sapiens
auuuuuagacucaucaa

SEQ ID NO: 703375 - RNA, 15 nt, Homo sapiens
auuuuugauacaguu

SEQ ID NO: 703376 - RNA, 13 nt, Homo sapiens
auuuuuugacuuu

SEQ ID NO: 703377 - RNA, 13 nt, Homo sapiens
caaaaaccaaaug

SEQ ID NO: 703378 - RNA, 15 nt, Homo sapiens
caaaaagcuucccca

SEQ ID NO: 703379 - RNA, 17 nt, Homo sapiens
caaaaauaaacgaacuc

SEQ ID NO: 703380 - RNA, 19 nt, Homo sapiens
caaaaccuacccucaguga

SEQ ID NO: 703381 - RNA, 20 nt, Homo sapiens
caaaaccuacccucagugag

SEQ ID NO: 703382 - RNA, 21 nt, Homo sapiens
caaaaccucauuuaaguaaaa

SEQ ID NO: 703383 - RNA, 19 nt, Homo sapiens
caaaauacaugaagcuuca

SEQ ID NO: 703384 - RNA, 15 nt, Homo sapiens
caaaauauacauuca

SEQ ID NO: 703385 - RNA, 16 nt, Homo sapiens
caaaauauguuuaaaa

SEQ ID NO: 703386 - RNA, 18 nt, Homo sapiens
caaaauauuucagugaau

SEQ ID NO: 703387 - RNA, 21 nt, Homo sapiens
caaaauuaagcaaauguuaaa

SEQ ID NO: 703388 - RNA, 14 nt, Homo sapiens
caaaauucaucugu

SEQ ID NO: 703389 - RNA, 12 nt, Homo sapiens
caaaauugcuaa

SEQ ID NO: 703390 - RNA, 12 nt, Homo sapiens
caaacaucuaau

SEQ ID NO: 703391 - RNA, 23 nt, Homo sapiens
caaacaugcggugccaugaaggg

SEQ ID NO: 703392 - RNA, 15 nt, Homo sapiens
caaaccuaccaaaau

SEQ ID NO: 703393 - RNA, 23 nt, Homo sapiens
caaacucaaugcuuuauuuguaa

SEQ ID NO: 703394 - RNA, 17 nt, Homo sapiens
caaacucauuggcuuaa

SEQ ID NO: 703395 - RNA, 23 nt, Homo sapiens
caaacuggggccuccagaacuca

SEQ ID NO: 703396 - RNA, 14 nt, Homo sapiens
caaacuuccaguca

SEQ ID NO: 703397 - RNA, 19 nt, Homo sapiens
caaagaagaguuaagaaga

SEQ ID NO: 703398 - RNA, 14 nt, Homo sapiens
caaagacuguaaau

SEQ ID NO: 703399 - RNA, 12 nt, Homo sapiens
caaagcacuguu

SEQ ID NO: 703400 - RNA, 13 nt, Homo sapiens
caaagccaaaacc

SEQ ID NO: 703401 - RNA, 23 nt, Homo sapiens
caaaggaacauugugucuaggau

SEQ ID NO: 703402 - RNA, 14 nt, Homo sapiens
caaagugccaaaga

SEQ ID NO: 703403 - RNA, 16 nt, Homo sapiens
caaaguugaaaauuca

SEQ ID NO: 703404 - RNA, 14 nt, Homo sapiens
caaauaaaaaccca

SEQ ID NO: 703405 - RNA, 16 nt, Homo sapiens
caaauacacauuugcu

SEQ ID NO: 703406 - RNA, 18 nt, Homo sapiens
caaauauuaggcuuaaaa

SEQ ID NO: 703407 - RNA, 17 nt, Homo sapiens
caaaucugauggccuua

SEQ ID NO: 703408 - RNA, 16 nt, Homo sapiens
caaaugcaucuuugau

SEQ ID NO: 703409 - RNA, 21 nt, Homo sapiens
caaauuaucuugauacauuca

SEQ ID NO: 703410 - RNA, 15 nt, Homo sapiens
caacaauugguaaaa

SEQ ID NO: 703411 - RNA, 14 nt, Homo sapiens
caaccuuucccuca

SEQ ID NO: 703412 - RNA, 15 nt, Homo sapiens
caacgaucacaaaug

SEQ ID NO: 703413 - RNA, 18 nt, Homo sapiens
caacuguccacgcgugcc

SEQ ID NO: 703414 - RNA, 22 nt, Homo sapiens
caagaaagcucacuguagcuuu

SEQ ID NO: 703415 - RNA, 20 nt, Homo sapiens
caagacucuuuggacacuca

SEQ ID NO: 703416 - RNA, 18 nt, Homo sapiens
caagagauaagucuuuca

SEQ ID NO: 703417 - RNA, 15 nt, Homo sapiens
caagaucuguaaugu

SEQ ID NO: 703418 - RNA, 23 nt, Homo sapiens
caagauguugauuuuuacugugu

SEQ ID NO: 703419 - RNA, 21 nt, Homo sapiens
caagauuuuuuaauuguuuaa

SEQ ID NO: 703420 - RNA, 16 nt, Homo sapiens
caagccagcccggccg

SEQ ID NO: 703421 - RNA, 16 nt, Homo sapiens
caagcugguauuuuca

SEQ ID NO: 703422 - RNA, 17 nt, Homo sapiens
caagcugguauuuucau

SEQ ID NO: 703423 - RNA, 17 nt, Homo sapiens
cauacuaugguuuucau

SEQ ID NO: 703424 - RNA, 18 nt, Homo sapiens
cauagaaaccacuagaaa

SEQ ID NO: 703425 - RNA, 13 nt, Homo sapiens
cauaguccaaaaa

SEQ ID NO: 703426 - RNA, 14 nt, Homo sapiens
cauaguccaaaaag

SEQ ID NO: 703427 - RNA, 14 nt, Homo sapiens
cauaguuacugugu

SEQ ID NO: 703428 - RNA, 13 nt, Homo sapiens
cauauaccagcaa

SEQ ID NO: 703429 - RNA, 13 nt, Homo sapiens
cauauauauuaca

SEQ ID NO: 703430 - RNA, 14 nt, Homo sapiens
cauauauauuacaa

SEQ ID NO: 703431 - RNA, 23 nt, Homo sapiens
cauauguaguauaauuucuagaa

SEQ ID NO: 703432 - RNA, 23 nt, Homo sapiens
cauauuuuaggacagguaaaaua

SEQ ID NO: 703433 - RNA, 13 nt, Homo sapiens
caucacagggugg

SEQ ID NO: 703434 - RNA, 19 nt, Homo sapiens
caucacccucuuccuguga

SEQ ID NO: 703435 - RNA, 20 nt, Homo sapiens
caucacccucuuccugugau

SEQ ID NO: 703436 - RNA, 17 nt, Homo sapiens
caucauuucaggaguua

SEQ ID NO: 703437 - RNA, 21 nt, Homo sapiens
caucccccaaggaugaaauca

SEQ ID NO: 703438 - RNA, 20 nt, Homo sapiens
cauccuacaacucacauuag

SEQ ID NO: 703439 - RNA, 14 nt, Homo sapiens
cauccugaccagcu

SEQ ID NO: 703440 - RNA, 21 nt, Homo sapiens
caucucaauaaagugcuuuaa

SEQ ID NO: 703441 - RNA, 16 nt, Homo sapiens
caucucccucccacau

SEQ ID NO: 703442 - RNA, 16 nt, Homo sapiens
caucucuuucugcaaa

SEQ ID NO: 703443 - RNA, 18 nt, Homo sapiens
caucugaaauguuacaaa

SEQ ID NO: 703444 - RNA, 15 nt, Homo sapiens
caucuuagaccucca

SEQ ID NO: 703445 - RNA, 15 nt, Homo sapiens
caugaaaauaccauu

SEQ ID NO: 703446 - RNA, 22 nt, Homo sapiens
caugaguagauaauuucagggu

SEQ ID NO: 703447 - RNA, 10 nt, Homo sapiens
caugcaaaau

SEQ ID NO: 703448 - RNA, 21 nt, Homo sapiens
caugcacuuaaagaaguauuu

SEQ ID NO: 703449 - RNA, 21 nt, Homo sapiens
caugcaguugcagugaauuca

SEQ ID NO: 703450 - RNA, 22 nt, Homo sapiens
caugcuccuggcccacugcauc

SEQ ID NO: 703451 - RNA, 20 nt, Homo sapiens
cauggcuguuggugggaccc

SEQ ID NO: 703452 - RNA, 15 nt, Homo sapiens
cauggugcacugagc

SEQ ID NO: 703453 - RNA, 15 nt, Homo sapiens
caugguuauugauga

SEQ ID NO: 703454 - RNA, 14 nt, Homo sapiens
caugguuugacuca

SEQ ID NO: 703455 - RNA, 13 nt, Homo sapiens
cauguaagcucuu

SEQ ID NO: 703456 - RNA, 13 nt, Homo sapiens
caugucacauuua

SEQ ID NO: 703457 - RNA, 21 nt, Homo sapiens
cauguuaaugacaauauucca

SEQ ID NO: 703458 - RNA, 23 nt, Homo sapiens
cauguuuauaaaucuuaugcucu

SEQ ID NO: 703459 - RNA, 14 nt, Homo sapiens
cauguuuuuauaca

SEQ ID NO: 703460 - RNA, 20 nt, Homo sapiens
cauuccacacagaaugcaac

SEQ ID NO: 703461 - RNA, 15 nt, Homo sapiens
cauucuucagauaua

SEQ ID NO: 703462 - RNA, 18 nt, Homo sapiens
cauugcacauaagcuucc

SEQ ID NO: 703463 - RNA, 15 nt, Homo sapiens
cauuuaauagacuua

SEQ ID NO: 703464 - RNA, 17 nt, Homo sapiens
ccaaaccuuaucuccac

SEQ ID NO: 703465 - RNA, 15 nt, Homo sapiens
ccaaauuaucuugau

SEQ ID NO: 703466 - RNA, 19 nt, Homo sapiens
ccaacccuaucuccugaca

SEQ ID NO: 703467 - RNA, 10 nt, Homo sapiens
ccaaccucag

SEQ ID NO: 703468 - RNA, 23 nt, Homo sapiens
ccaacgcgccucgccggaucuga

SEQ ID NO: 703469 - RNA, 22 nt, Homo sapiens
ccaagagaacucgcgcucagua

SEQ ID NO: 703470 - RNA, 18 nt, Homo sapiens
ccaagcaggaaccccagg

SEQ ID NO: 703471 - RNA, 19 nt, Homo sapiens
ccaaggaaacccccagugu

SEQ ID NO: 703472 - RNA, 23 nt, Homo sapiens
ccaaggaaacccccaguguaaua

SEQ ID NO: 703473 - RNA, 11 nt, Homo sapiens
ccaagucacac

SEQ ID NO: 703474 - RNA, 23 nt, Homo sapiens
ccaaucccuuuauuacccccucc

SEQ ID NO: 703475 - RNA, 15 nt, Homo sapiens
ccaaugugugaagua

SEQ ID NO: 703476 - RNA, 18 nt, Homo sapiens
ccacaaccgaccagaugc

SEQ ID NO: 703477 - RNA, 15 nt, Homo sapiens
ccacaauccacgcuu

SEQ ID NO: 703478 - RNA, 12 nt, Homo sapiens
ccacacccaaag

SEQ ID NO: 703479 - RNA, 14 nt, Homo sapiens
ccacacucuccauc

SEQ ID NO: 703480 - RNA, 18 nt, Homo sapiens
ccaccaaagcugcccacu

SEQ ID NO: 703481 - RNA, 13 nt, Homo sapiens
ccaccccaagaga

SEQ ID NO: 703482 - RNA, 18 nt, Homo sapiens
ccacgccucuugaccagg

SEQ ID NO: 703483 - RNA, 19 nt, Homo sapiens
ccacggaggaugaugccag

SEQ ID NO: 703484 - RNA, 13 nt, Homo sapiens
ccacuaaugcaaa

SEQ ID NO: 703485 - RNA, 17 nt, Homo sapiens
ccacucauuucaucuca

SEQ ID NO: 703486 - RNA, 14 nt, Homo sapiens
ccacugugcuuuca

SEQ ID NO: 703487 - RNA, 21 nt, Homo sapiens
ccacuguuucucuugagcugg

SEQ ID NO: 703488 - RNA, 20 nt, Homo sapiens
ccacuucuaagaaaagccua

SEQ ID NO: 703489 - RNA, 12 nt, Homo sapiens
ccagaauacuga

SEQ ID NO: 703490 - RNA, 12 nt, Homo sapiens
ccagaggcaucu

SEQ ID NO: 703491 - RNA, 17 nt, Homo sapiens
ccagagguugugcacug

SEQ ID NO: 703492 - RNA, 16 nt, Homo sapiens
ccagcacuuugggagg

SEQ ID NO: 703493 - RNA, 15 nt, Homo sapiens
ccagccccacugcca

SEQ ID NO: 703494 - RNA, 17 nt, Homo sapiens
ccagccccacugccagc

SEQ ID NO: 703495 - RNA, 21 nt, Homo sapiens
ccagccccacugccagcagca

SEQ ID NO: 703496 - RNA, 22 nt, Homo sapiens
ccagccugcuagcuagcucaac

SEQ ID NO: 703497 - RNA, 20 nt, Homo sapiens
ccagccugggugacagagca

SEQ ID NO: 703498 - RNA, 16 nt, Homo sapiens
ccagcugccaaggaaa

SEQ ID NO: 703499 - RNA, 12 nt, Homo sapiens
ccaggagccuca

SEQ ID NO: 703500 - RNA, 20 nt, Homo sapiens
ccaggcuggacugcaaugac

SEQ ID NO: 703501 - RNA, 18 nt, Homo sapiens
ccagguagaaacuuuuau

SEQ ID NO: 703502 - RNA, 17 nt, Homo sapiens
ccagugcuuuaauggca

SEQ ID NO: 703503 - RNA, 12 nt, Homo sapiens
ccaguguaauaa

SEQ ID NO: 703504 - RNA, 14 nt, Homo sapiens
ccaucaccagacag

SEQ ID NO: 703505 - RNA, 14 nt, Homo sapiens
ccaucagugaaaaa

SEQ ID NO: 703506 - RNA, 15 nt, Homo sapiens
ccaugcuaacaaaga

SEQ ID NO: 703507 - RNA, 17 nt, Homo sapiens
ccauggacccaauauuu

SEQ ID NO: 703508 - RNA, 20 nt, Homo sapiens
ccauggcuguguuggugugg

SEQ ID NO: 703509 - RNA, 19 nt, Homo sapiens
ccauggcuguuggugggac

SEQ ID NO: 703510 - RNA, 21 nt, Homo sapiens
ccauguaugaagccaaauauu

SEQ ID NO: 703511 - RNA, 10 nt, Homo sapiens
ccauguccaa

SEQ ID NO: 703512 - RNA, 21 nt, Homo sapiens
ccauguccaaagaggcugccc

SEQ ID NO: 703513 - RNA, 23 nt, Homo sapiens
ccauuccaggcagccucugucag

SEQ ID NO: 703514 - RNA, 19 nt, Homo sapiens
ccauucugccgcccccucc

SEQ ID NO: 703515 - RNA, 15 nt, Homo sapiens
ccauuugugccagag

SEQ ID NO: 703516 - RNA, 18 nt, Homo sapiens
ccauuuuucuagacuguc

SEQ ID NO: 703517 - RNA, 12 nt, Homo sapiens
cccaaacaguga

SEQ ID NO: 703518 - RNA, 19 nt, Homo sapiens
cccaacacuuccagcauuu

SEQ ID NO: 703519 - RNA, 17 nt, Homo sapiens
cccaauauuuaccagac

SEQ ID NO: 703520 - RNA, 19 nt, Homo sapiens
cccacauguccagcaccuu

SEQ ID NO: 703521 - RNA, 13 nt, Homo sapiens
cccagaauacuga

SEQ ID NO: 703522 - RNA, 18 nt, Homo sapiens
cccagcagguuaccugga

SEQ ID NO: 703523 - RNA, 14 nt, Homo sapiens
cccagccaugccag

SEQ ID NO: 703524 - RNA, 13 nt, Homo sapiens
cccaggaagccca

SEQ ID NO: 703525 - RNA, 16 nt, Homo sapiens
cccaggaguguggcca

SEQ ID NO: 703526 - RNA, 17 nt, Homo sapiens
cccaggcuggacugcaa

SEQ ID NO: 703527 - RNA, 14 nt, Homo sapiens
cccagguaccagcu

SEQ ID NO: 703528 - RNA, 22 nt, Homo sapiens
cccaggugguuauggagagggu

SEQ ID NO: 703529 - RNA, 13 nt, Homo sapiens
cccaguguaauaa

SEQ ID NO: 703530 - RNA, 16 nt, Homo sapiens
cccaguuagcucucaa

SEQ ID NO: 703531 - RNA, 21 nt, Homo sapiens
cccaguuccucccccaguucc

SEQ ID NO: 703532 - RNA, 24 nt, Homo sapiens
cccauuccaggcagccucugucag

SEQ ID NO: 703533 - RNA, 15 nt, Homo sapiens
ccccaucucccugcc

SEQ ID NO: 703534 - RNA, 16 nt, Homo sapiens
cccccuggucuuugag

SEQ ID NO: 703535 - RNA, 17 nt, Homo sapiens
ccccucagagacugaaa

SEQ ID NO: 703536 - RNA, 22 nt, Homo sapiens
ccccuguagagugggagcugag

SEQ ID NO: 703537 - RNA, 22 nt, Homo sapiens
ccccuuccagaucacugccaca

SEQ ID NO: 703538 - RNA, 23 nt, Homo sapiens
cccgaucaucuuuccuguuccag

SEQ ID NO: 703539 - RNA, 21 nt, Homo sapiens
cccggccgcuccaccagcauc

SEQ ID NO: 703540 - RNA, 19 nt, Homo sapiens
cccggguggggcugcagaa

SEQ ID NO: 703541 - RNA, 23 nt, Homo sapiens
cccggugggacccccguggggca

SEQ ID NO: 703542 - RNA, 19 nt, Homo sapiens
uuguagaaaugagccagaa

SEQ ID NO: 703543 - RNA, 13 nt, Homo sapiens
uugugagaaacau

SEQ ID NO: 703544 - RNA, 16 nt, Homo sapiens
uugugauuucuuuaaa

SEQ ID NO: 703545 - RNA, 15 nt, Homo sapiens
uugugcaaagccaaa

SEQ ID NO: 703546 - RNA, 19 nt, Homo sapiens
uuguuaugcaucauuucag

SEQ ID NO: 703547 - RNA, 12 nt, Homo sapiens
uuguucucagaa

SEQ ID NO: 703548 - RNA, 15 nt, Homo sapiens
uuguuguucuuucag

SEQ ID NO: 703549 - RNA, 19 nt, Homo sapiens
uuuaaaaaauauuuucucu

SEQ ID NO: 703550 - RNA, 12 nt, Homo sapiens
uuuaaaacacaa

SEQ ID NO: 703551 - RNA, 13 nt, Homo sapiens
uuuaaaagugauc

SEQ ID NO: 703552 - RNA, 12 nt, Homo sapiens
uuuaaaguugau

SEQ ID NO: 703553 - RNA, 22 nt, Homo sapiens
uuuaaauuacaauuuuaucugu

SEQ ID NO: 703554 - RNA, 14 nt, Homo sapiens
uuuaacugcauaau

SEQ ID NO: 703555 - RNA, 14 nt, Homo sapiens
uuuaauaccagaua

SEQ ID NO: 703556 - RNA, 12 nt, Homo sapiens
uuuacauuugau

SEQ ID NO: 703557 - RNA, 19 nt, Homo sapiens
uuuaccuguauacagugca

SEQ ID NO: 703558 - RNA, 20 nt, Homo sapiens
uuuagaauaagaauuugcau

SEQ ID NO: 703559 - RNA, 22 nt, Homo sapiens
uuuaggaaugguucucucaaca

SEQ ID NO: 703560 - RNA, 18 nt, Homo sapiens
uuuaucuguuuccugaca

SEQ ID NO: 703561 - RNA, 14 nt, Homo sapiens
uuuauugacucuug

SEQ ID NO: 703562 - RNA, 14 nt, Homo sapiens
uuuauuuccacuaa

SEQ ID NO: 703563 - RNA, 16 nt, Homo sapiens
uuuauuuccacuaaaa

SEQ ID NO: 703564 - RNA, 22 nt, Homo sapiens
uuuauuuuuuuaaaacacaaau

SEQ ID NO: 703565 - RNA, 16 nt, Homo sapiens
uuucacauucuuggcu

SEQ ID NO: 703566 - RNA, 14 nt, Homo sapiens
uuucauaguguuca

SEQ ID NO: 703567 - RNA, 12 nt, Homo sapiens
uuucauugcugg

SEQ ID NO: 703568 - RNA, 16 nt, Homo sapiens
uuuccucagugcauuu

SEQ ID NO: 703569 - RNA, 20 nt, Homo sapiens
uuuccuucggguuggcaaaa

SEQ ID NO: 703570 - RNA, 16 nt, Homo sapiens
uuuccuuuaugugaau

SEQ ID NO: 703571 - RNA, 16 nt, Homo sapiens
uuucguagguugacua

SEQ ID NO: 703572 - RNA, 13 nt, Homo sapiens
uuucuaagagaag

SEQ ID NO: 703573 - RNA, 15 nt, Homo sapiens
uuucuauuauggaaa

SEQ ID NO: 703574 - RNA, 19 nt, Homo sapiens
uuucucaacuggguccaga

SEQ ID NO: 703575 - RNA, 18 nt, Homo sapiens
uuucucauaucaacuuag

SEQ ID NO: 703576 - RNA, 21 nt, Homo sapiens
uuucucauaucaacuuaguca

SEQ ID NO: 703577 - RNA, 17 nt, Homo sapiens
uuucuccuuuaauugua

SEQ ID NO: 703578 - RNA, 17 nt, Homo sapiens
uuucugcaaacaccaac

SEQ ID NO: 703579 - RNA, 23 nt, Homo sapiens
uuucuggggaaagacacugccug

SEQ ID NO: 703580 - RNA, 22 nt, Homo sapiens
uuucuguggucuuacugaucuu

SEQ ID NO: 703581 - RNA, 15 nt, Homo sapiens
uuugaacaaugaagu

SEQ ID NO: 703582 - RNA, 20 nt, Homo sapiens
uuugaacaaugaaguugaaa

SEQ ID NO: 703583 - RNA, 18 nt, Homo sapiens
uuugaaguggccagauga

SEQ ID NO: 703584 - RNA, 14 nt, Homo sapiens
uuugauaaagcagu

SEQ ID NO: 703585 - RNA, 22 nt, Homo sapiens
uuugcaacugucucucuucuca

SEQ ID NO: 703586 - RNA, 15 nt, Homo sapiens
uuugcaugcaugcaa

SEQ ID NO: 703587 - RNA, 22 nt, Homo sapiens
uuugccugauccuccaacagcu

SEQ ID NO: 703588 - RNA, 21 nt, Homo sapiens
uuugcuaaaugugaaugauga

SEQ ID NO: 703589 - RNA, 22 nt, Homo sapiens
uuuggauucuaaauacaugcca

SEQ ID NO: 703590 - RNA, 18 nt, Homo sapiens
uuugggguaauacuucca

SEQ ID NO: 703591 - RNA, 13 nt, Homo sapiens
uuugguuucucaa

SEQ ID NO: 703592 - RNA, 20 nt, Homo sapiens
uuuguaggagacuugccaga

SEQ ID NO: 703593 - RNA, 23 nt, Homo sapiens
uuugugccagaggaauccuggca

SEQ ID NO: 703594 - RNA, 21 nt, Homo sapiens
uuuguuugccaggacaugcaa

SEQ ID NO: 703595 - RNA, 12 nt, Homo sapiens
uuuuaacugcau

SEQ ID NO: 703596 - RNA, 18 nt, Homo sapiens
uuuuaugauuugucucug

SEQ ID NO: 703597 - RNA, 15 nt, Homo sapiens
uuuucuagacugucu

SEQ ID NO: 703598 - RNA, 19 nt, Homo sapiens
uuuucucaguguugguaua

SEQ ID NO: 703599 - RNA, 19 nt, Homo sapiens
uuuucuugccuugguuguc

SEQ ID NO: 703600 - RNA, 14 nt, Homo sapiens
uuuugcaugcaugc

SEQ ID NO: 703601 - RNA, 18 nt, Homo sapiens
uuuugccucaccuaauag

SEQ ID NO: 703602 - RNA, 19 nt, Homo sapiens
uuuuggcccaaucucugcc

SEQ ID NO: 703603 - RNA, 17 nt, Homo sapiens
uuuuguaagaaggcaau

SEQ ID NO: 703604 - RNA, 18 nt, Homo sapiens
uuuuuaaaaaacugcuga

SEQ ID NO: 703605 - RNA, 13 nt, Homo sapiens
uuuuuuaaacuag

SEQ ID NO: 703606 - RNA, 20 nt, Homo sapiens
uuuuuucaaaauccaaaaag

SEQ ID NO: 703607 - RNA, 19 nt, Homo sapiens
guuuuuaaaaaacugcuga

SEQ ID NO: 703608 - RNA, 22 nt, Homo sapiens
guuuuucugcuuuagacuugaa

SEQ ID NO: 703609 - RNA, 19 nt, Homo sapiens
uaaaaaaaaagucagagac

SEQ ID NO: 703610 - RNA, 17 nt, Homo sapiens
uaaaaaaaccaccaaaa

SEQ ID NO: 703611 - RNA, 14 nt, Homo sapiens
uaaaaaagagacau

SEQ ID NO: 703612 - RNA, 12 nt, Homo sapiens
uaaaaaccgaau

SEQ ID NO: 703613 - RNA, 13 nt, Homo sapiens
uaaaaaccgaaua

SEQ ID NO: 703614 - RNA, 18 nt, Homo sapiens
uaaaaaggcuaaauggaa

SEQ ID NO: 703615 - RNA, 14 nt, Homo sapiens
uaaaaauagaaaca

SEQ ID NO: 703616 - RNA, 18 nt, Homo sapiens
uaaaaaucauaguacucu

SEQ ID NO: 703617 - RNA, 11 nt, Homo sapiens
uaaaaauggaa

SEQ ID NO: 703618 - RNA, 22 nt, Homo sapiens
uaaaacaaaauuugacuaauuu

SEQ ID NO: 703619 - RNA, 12 nt, Homo sapiens
uaaaacauagca

SEQ ID NO: 703620 - RNA, 18 nt, Homo sapiens
uaaaacucacugugauca

SEQ ID NO: 703621 - RNA, 17 nt, Homo sapiens
uaaaacuuaacauucau

SEQ ID NO: 703622 - RNA, 19 nt, Homo sapiens
uaaaagugaucuacaugag

SEQ ID NO: 703623 - RNA, 17 nt, Homo sapiens
uaaaauaaaaguuuaca

SEQ ID NO: 703624 - RNA, 17 nt, Homo sapiens
uaaaauaaggauuuuuc

SEQ ID NO: 703625 - RNA, 20 nt, Homo sapiens
uaaaauuaucaauaucuaau

SEQ ID NO: 703626 - RNA, 17 nt, Homo sapiens
uaaaauugaaaguaaua

SEQ ID NO: 703627 - RNA, 13 nt, Homo sapiens
uaaacccucagag

SEQ ID NO: 703628 - RNA, 22 nt, Homo sapiens
uaaacggcucagacaggcagau

SEQ ID NO: 703629 - RNA, 13 nt, Homo sapiens
uaaacgggaacau

SEQ ID NO: 703630 - RNA, 15 nt, Homo sapiens
uaaacgggaacaugc

SEQ ID NO: 703631 - RNA, 19 nt, Homo sapiens
uaaacuaauauuuguuuca

SEQ ID NO: 703632 - RNA, 17 nt, Homo sapiens
uaaacuaugaggacugc

SEQ ID NO: 703633 - RNA, 18 nt, Homo sapiens
uaaagacuuguauagcau

SEQ ID NO: 703634 - RNA, 19 nt, Homo sapiens
uaaagagagaugaaccaca

SEQ ID NO: 703635 - RNA, 15 nt, Homo sapiens
uaaagcuacaacaaa

SEQ ID NO: 703636 - RNA, 15 nt, Homo sapiens
uaaagcuuguugacu

SEQ ID NO: 703637 - RNA, 18 nt, Homo sapiens
uaaaguaguccugugaau

SEQ ID NO: 703638 - RNA, 18 nt, Homo sapiens
uaaauaaaccacugugcg

SEQ ID NO: 703639 - RNA, 17 nt, Homo sapiens
uaaauagaugcugugua

SEQ ID NO: 703640 - RNA, 14 nt, Homo sapiens
uaaaucguccuccc

SEQ ID NO: 703641 - RNA, 15 nt, Homo sapiens
uaaaucguccuccca

SEQ ID NO: 703642 - RNA, 20 nt, Homo sapiens
uaaaucguccucccaggcca

SEQ ID NO: 703643 - RNA, 16 nt, Homo sapiens
uaaauguaaucacgag

SEQ ID NO: 703644 - RNA, 21 nt, Homo sapiens
uaaaugugaaugaugauccua

SEQ ID NO: 703645 - RNA, 14 nt, Homo sapiens
uaaauuuguguucu

SEQ ID NO: 703646 - RNA, 17 nt, Homo sapiens
uaaauuuuuaagagaaa

SEQ ID NO: 703647 - RNA, 21 nt, Homo sapiens
uaacaaagcccuuauucucuu

SEQ ID NO: 703648 - RNA, 21 nt, Homo sapiens
uaacacauuuuuuaacuaaua

SEQ ID NO: 703649 - RNA, 21 nt, Homo sapiens
uaacacauuuuuuugcaugca

SEQ ID NO: 703650 - RNA, 19 nt, Homo sapiens
uaacaccaugauuaaccac

SEQ ID NO: 703651 - RNA, 15 nt, Homo sapiens
uaacagaauacauag

SEQ ID NO: 703652 - RNA, 22 nt, Homo sapiens
uaacauaccguuuauaaugcca

SEQ ID NO: 703653 - RNA, 17 nt, Homo sapiens
uaacuaauaaugcugga

SEQ ID NO: 703654 - RNA, 14 nt, Homo sapiens
uaacugccaagaaa

SEQ ID NO: 703655 - RNA, 20 nt, Homo sapiens
uaacugggguugagggccaa

SEQ ID NO: 703656 - RNA, 20 nt, Homo sapiens
uaacuuuauaaauccaguga

SEQ ID NO: 703657 - RNA, 14 nt, Homo sapiens
uaagaaccugaaua

SEQ ID NO: 703658 - RNA, 14 nt, Homo sapiens
uaagaauuugcaua

SEQ ID NO: 703659 - RNA, 19 nt, Homo sapiens
uaagacaauggacccuuuu

SEQ ID NO: 703660 - RNA, 19 nt, Homo sapiens
uaagaucucgguuugccaa

SEQ ID NO: 703661 - RNA, 17 nt, Homo sapiens
uaagcagcuuacuuagu

SEQ ID NO: 703662 - RNA, 23 nt, Homo sapiens
uaagccaaaauuaagguguuuga

SEQ ID NO: 703663 - RNA, 14 nt, Homo sapiens
uaaggaaagcaaua

SEQ ID NO: 703664 - RNA, 17 nt, Homo sapiens
uaaggacggacucacuu

SEQ ID NO: 703665 - RNA, 18 nt, Homo sapiens
uaagggguaucauguaug

SEQ ID NO: 703666 - RNA, 19 nt, Homo sapiens
uaaguaaucaucuaaguca

SEQ ID NO: 703667 - RNA, 19 nt, Homo sapiens
uaauaagcaaucaagguua

SEQ ID NO: 703668 - RNA, 12 nt, Homo sapiens
uaauagucauca

SEQ ID NO: 703669 - RNA, 15 nt, Homo sapiens
uaauccaguguuacu

SEQ ID NO: 703670 - RNA, 23 nt, Homo sapiens
uaaugaaaaugaauaucuauuaa

SEQ ID NO: 703671 - RNA, 21 nt, Homo sapiens
uaauggcaucaauauacauaa

SEQ ID NO: 703672 - RNA, 20 nt, Homo sapiens
uaauguacacauugcauuuu

SEQ ID NO: 703673 - RNA, 16 nt, Homo sapiens
uaauguccauaugcua

SEQ ID NO: 703674 - RNA, 23 nt, Homo sapiens
uaaugucuuuaaaaguauccaga

SEQ ID NO: 703675 - RNA, 18 nt, Homo sapiens
uaauguuuaauauugaga

SEQ ID NO: 703676 - RNA, 19 nt, Homo sapiens
uaauguuuuauacuguuua

SEQ ID NO: 703677 - RNA, 20 nt, Homo sapiens
uaauuacuuauuguauuuau

SEQ ID NO: 703678 - RNA, 17 nt, Homo sapiens
uaauuauaaauaucauu

SEQ ID NO: 703679 - RNA, 17 nt, Homo sapiens
uaauuauacuacuuugu

SEQ ID NO: 703680 - RNA, 15 nt, Homo sapiens
uaauucucuguggaa

SEQ ID NO: 703681 - RNA, 12 nt, Homo sapiens
uaauuucagggu

SEQ ID NO: 703682 - RNA, 18 nt, Homo sapiens
uaauuucagggugcagcc

SEQ ID NO: 703683 - RNA, 14 nt, Homo sapiens
uaauuuuguuguuu

SEQ ID NO: 703684 - RNA, 15 nt, Homo sapiens
uacaaauucuucuaa

SEQ ID NO: 703685 - RNA, 18 nt, Homo sapiens
uacaagggaagauuuaug

SEQ ID NO: 703686 - RNA, 20 nt, Homo sapiens
uacacacauauauauuacaa

SEQ ID NO: 703687 - RNA, 14 nt, Homo sapiens
uacacuuuguugca

SEQ ID NO: 703688 - RNA, 23 nt, Homo sapiens
uacagcagaaaaucuuuuacuag

SEQ ID NO: 703689 - RNA, 13 nt, Homo sapiens
uacauaauacuga

SEQ ID NO: 703690 - RNA, 17 nt, Homo sapiens
uacauaucccuuccaga

SEQ ID NO: 703691 - RNA, 22 nt, Homo sapiens
uacauauguauuauauaaacuu

SEQ ID NO: 703692 - RNA, 22 nt, Homo sapiens
uacauauuaaaggaagcacucu

SEQ ID NO: 703693 - RNA, 13 nt, Homo sapiens
uacaugaagaaua

SEQ ID NO: 703694 - RNA, 16 nt, Homo sapiens
uacaugcuggggucaa

SEQ ID NO: 703695 - RNA, 13 nt, Homo sapiens
uacauuucauuaa

SEQ ID NO: 703696 - RNA, 15 nt, Homo sapiens
uaccaaaauguuaau

SEQ ID NO: 703697 - RNA, 23 nt, Homo sapiens
uaccauuaaaguucucaaugcaa

SEQ ID NO: 703698 - RNA, 15 nt, Homo sapiens
uacguggccauguau

SEQ ID NO: 703699 - RNA, 19 nt, Homo sapiens
uacuaaaaaguauaaaaua

SEQ ID NO: 703700 - RNA, 22 nt, Homo sapiens
uacuaguguguguguguauaua

SEQ ID NO: 703701 - RNA, 21 nt, Homo sapiens
uacugaagucuuacuacagaa

SEQ ID NO: 703702 - RNA, 23 nt, Homo sapiens
uacugcagcuuuguuuguuguca

SEQ ID NO: 703703 - RNA, 11 nt, Homo sapiens
uacuucauuaa

SEQ ID NO: 703704 - RNA, 23 nt, Homo sapiens
uacuugcuuuaccuuuucagggc

SEQ ID NO: 703705 - RNA, 14 nt, Homo sapiens
uacuuuacugccug

SEQ ID NO: 703706 - RNA, 13 nt, Homo sapiens
uagaaaaaccacc

SEQ ID NO: 703707 - RNA, 14 nt, Homo sapiens
uagaaaugagccag

SEQ ID NO: 703708 - RNA, 18 nt, Homo sapiens
uagaacuccaauacucac

SEQ ID NO: 703709 - RNA, 18 nt, Homo sapiens
uagaacugucugugaaca

SEQ ID NO: 703710 - RNA, 17 nt, Homo sapiens
uagaagacaacaggcau

SEQ ID NO: 703711 - RNA, 18 nt, Homo sapiens
uagaagcaugaagucuua

SEQ ID NO: 703712 - RNA, 23 nt, Homo sapiens
uagaaguuuggcugcugucauaa

SEQ ID NO: 703713 - RNA, 12 nt, Homo sapiens
uagagaagcaag

SEQ ID NO: 703714 - RNA, 20 nt, Homo sapiens
uagagacgguguuuugccau

SEQ ID NO: 703715 - RNA, 18 nt, Homo sapiens
uagagaggacaauacugg

SEQ ID NO: 703716 - RNA, 14 nt, Homo sapiens
uagagaugcaguuu

SEQ ID NO: 703717 - RNA, 23 nt, Homo sapiens
uagaguuuggaaucccacuaaug

SEQ ID NO: 703718 - RNA, 15 nt, Homo sapiens
uagauaucaugcaaa

SEQ ID NO: 703719 - RNA, 18 nt, Homo sapiens
uagauguggccuuugaau

SEQ ID NO: 703720 - RNA, 18 nt, Homo sapiens
uagcacaauuugcacuaa

SEQ ID NO: 703721 - RNA, 15 nt, Homo sapiens
uagcagucaaaucua

SEQ ID NO: 703722 - RNA, 15 nt, Homo sapiens
uagccaaguguggua

SEQ ID NO: 703723 - RNA, 15 nt, Homo sapiens
uagccaaugucuccu

SEQ ID NO: 703724 - RNA, 22 nt, Homo sapiens
uagccagccccucuuccccaau

SEQ ID NO: 703725 - RNA, 14 nt, Homo sapiens
uagcccaaaaccaa

SEQ ID NO: 703726 - RNA, 20 nt, Homo sapiens
uccaauauucgcugugucag

SEQ ID NO: 703727 - RNA, 18 nt, Homo sapiens
uccacaugaaaauaaaga

SEQ ID NO: 703728 - RNA, 19 nt, Homo sapiens
uccagauguggcuacugac

SEQ ID NO: 703729 - RNA, 17 nt, Homo sapiens
uccaggaaaguggccaa

SEQ ID NO: 703730 - RNA, 13 nt, Homo sapiens
uccaggaacugca

SEQ ID NO: 703731 - RNA, 20 nt, Homo sapiens
uccagugugggcuugaccag

SEQ ID NO: 703732 - RNA, 16 nt, Homo sapiens
uccauaaacaugaaaa

SEQ ID NO: 703733 - RNA, 14 nt, Homo sapiens
uccaucucccuuag

SEQ ID NO: 703734 - RNA, 19 nt, Homo sapiens
uccauuuuuguaagccaua

SEQ ID NO: 703735 - RNA, 14 nt, Homo sapiens
ucccaagaaugcaa

SEQ ID NO: 703736 - RNA, 15 nt, Homo sapiens
ucccaagaaugcaag

SEQ ID NO: 703737 - RNA, 20 nt, Homo sapiens
ucccaaguaacugggauuac

SEQ ID NO: 703738 - RNA, 20 nt, Homo sapiens
ucccacuuugcuguuccuua

SEQ ID NO: 703739 - RNA, 16 nt, Homo sapiens
ucccagcuacucggga

SEQ ID NO: 703740 - RNA, 14 nt, Homo sapiens
ucccaggaagccca

SEQ ID NO: 703741 - RNA, 16 nt, Homo sapiens
ucccagugaugcugua

SEQ ID NO: 703742 - RNA, 9 nt, Homo sapiens
ucccagugc

SEQ ID NO: 703743 - RNA, 14 nt, Homo sapiens
ucccauccuugaug

SEQ ID NO: 703744 - RNA, 17 nt, Homo sapiens
ucccauccuugaugcaa

SEQ ID NO: 703745 - RNA, 19 nt, Homo sapiens
uccccaacaagauugcuua

SEQ ID NO: 703746 - RNA, 14 nt, Homo sapiens
uccccggcaugaga

SEQ ID NO: 703747 - RNA, 14 nt, Homo sapiens
uccccgugccaaaa

SEQ ID NO: 703748 - RNA, 20 nt, Homo sapiens
uccccguuccaccccaagag

SEQ ID NO: 703749 - RNA, 15 nt, Homo sapiens
ucccuaggaaacuca

SEQ ID NO: 703750 - RNA, 16 nt, Homo sapiens
ucccuaggaaacucac

SEQ ID NO: 703751 - RNA, 23 nt, Homo sapiens
ucccuuccccaugcuuccuugcc

SEQ ID NO: 703752 - RNA, 15 nt, Homo sapiens
uccgcaggacuuccc

SEQ ID NO: 703753 - RNA, 18 nt, Homo sapiens
uccuaaaaguguaagaaa

SEQ ID NO: 703754 - RNA, 21 nt, Homo sapiens
uccuaacugaaagaugaucau

SEQ ID NO: 703755 - RNA, 13 nt, Homo sapiens
uccuacacuugag

SEQ ID NO: 703756 - RNA, 14 nt, Homo sapiens
uccuauauccugug

SEQ ID NO: 703757 - RNA, 22 nt, Homo sapiens
uccucaauucaauguggugaug

SEQ ID NO: 703758 - RNA, 11 nt, Homo sapiens
uccuccccaaa

SEQ ID NO: 703759 - RNA, 20 nt, Homo sapiens
uccucccuuccuuuucccug

SEQ ID NO: 703760 - RNA, 23 nt, Homo sapiens
uccucucuaagugggcauugcca

SEQ ID NO: 703761 - RNA, 16 nt, Homo sapiens
uccucuguaaacuuuu

SEQ ID NO: 703762 - RNA, 18 nt, Homo sapiens
uccugaaccgcacagcuc

SEQ ID NO: 703763 - RNA, 20 nt, Homo sapiens
uccugugaaugccacugccu

SEQ ID NO: 703764 - RNA, 19 nt, Homo sapiens
uccuguuagcauaauguga

SEQ ID NO: 703765 - RNA, 11 nt, Homo sapiens
uccuugcaaau

SEQ ID NO: 703766 - RNA, 17 nt, Homo sapiens
uccuuuuaagcagugag

SEQ ID NO: 703767 - RNA, 18 nt, Homo sapiens
uccuuuuaguauucuuag

SEQ ID NO: 703768 - RNA, 16 nt, Homo sapiens
uccuuuuugacacuga

SEQ ID NO: 703769 - RNA, 23 nt, Homo sapiens
uccuuuuuucaaaauccaaaaag

SEQ ID NO: 703770 - RNA, 16 nt, Homo sapiens
ucgcaucucagugcag

SEQ ID NO: 703771 - RNA, 17 nt, Homo sapiens
ucggagcggcgucccuu

SEQ ID NO: 703772 - RNA, 21 nt, Homo sapiens
ucgguauccccccaucuugcu

SEQ ID NO: 703773 - RNA, 12 nt, Homo sapiens
ucggugggaccc

SEQ ID NO: 703774 - RNA, 14 nt, Homo sapiens
ucggugggacccug

SEQ ID NO: 703775 - RNA, 22 nt, Homo sapiens
ucggugggacucguggcuguca

SEQ ID NO: 703776 - RNA, 18 nt, Homo sapiens
ucgugacaagugccuuca

SEQ ID NO: 703777 - RNA, 14 nt, Homo sapiens
ucuaaaaucaugaa

SEQ ID NO: 703778 - RNA, 17 nt, Homo sapiens
ucuaaauacaugccaca

SEQ ID NO: 703779 - RNA, 13 nt, Homo sapiens
ucuaaauguuugg

SEQ ID NO: 703780 - RNA, 17 nt, Homo sapiens
ucuaacaaaacaaguug

SEQ ID NO: 703781 - RNA, 21 nt, Homo sapiens
ucuaagaaaagccuaaucaca

SEQ ID NO: 703782 - RNA, 15 nt, Homo sapiens
ucuaagucauguaug

SEQ ID NO: 703783 - RNA, 18 nt, Homo sapiens
ucuaaugagacugaccau

SEQ ID NO: 703784 - RNA, 22 nt, Homo sapiens
ucuacaaauggugaaauuuaau

SEQ ID NO: 703785 - RNA, 20 nt, Homo sapiens
ucuagacuagcaaucucuuc

SEQ ID NO: 703786 - RNA, 22 nt, Homo sapiens
ucuagacugucucuguggaaua

SEQ ID NO: 703787 - RNA, 15 nt, Homo sapiens
ucuagaggcaaggag

SEQ ID NO: 703788 - RNA, 15 nt, Homo sapiens
ucuaguuuugucaaa

SEQ ID NO: 703789 - RNA, 19 nt, Homo sapiens
ucuauaaauagaugcugug

SEQ ID NO: 703790 - RNA, 19 nt, Homo sapiens
ucuauagcugcuauagcaa

SEQ ID NO: 703791 - RNA, 18 nt, Homo sapiens
ucuaucggagaacaugaa

SEQ ID NO: 703792 - RNA, 19 nt, Homo sapiens
ucuaucggagaacaugaau

SEQ ID NO: 703793 - RNA, 21 nt, Homo sapiens
ucuauuuuaagacugauuuua

SEQ ID NO: 703794 - RNA, 14 nt, Homo sapiens
ucuauuuuaaucuu

SEQ ID NO: 703795 - RNA, 19 nt, Homo sapiens
ucucaaaguuugacaggaa

SEQ ID NO: 703796 - RNA, 15 nt, Homo sapiens
ucucaaggcaguuaa

SEQ ID NO: 703797 - RNA, 16 nt, Homo sapiens
ucucaaggcaguuaau

SEQ ID NO: 703798 - RNA, 18 nt, Homo sapiens
ucucaaguuaucagggua

SEQ ID NO: 703799 - RNA, 14 nt, Homo sapiens
ucucagcuuugaga

SEQ ID NO: 703800 - RNA, 12 nt, Homo sapiens
ucucagugcagg

SEQ ID NO: 703801 - RNA, 16 nt, Homo sapiens
ucucauugacuuuuau

SEQ ID NO: 703802 - RNA, 19 nt, Homo sapiens
ucuccaucccucuaaugag

SEQ ID NO: 703803 - RNA, 19 nt, Homo sapiens
ucucccuuugaagaaacua

SEQ ID NO: 703804 - RNA, 13 nt, Homo sapiens
ucuccuccagugu

SEQ ID NO: 703805 - RNA, 20 nt, Homo sapiens
ucuccuuugcucucuggcca

SEQ ID NO: 703806 - RNA, 20 nt, Homo sapiens
ucucgaagugcugagauuac

SEQ ID NO: 703807 - RNA, 14 nt, Homo sapiens
ucucgguuugccaa

SEQ ID NO: 703808 - RNA, 14 nt, Homo sapiens
ucucuaacauuucc

SEQ ID NO: 703809 - RNA, 17 nt, Homo sapiens
ucucuaacauuuccuua

SEQ ID NO: 703810 - RNA, 20 nt, Homo sapiens
ucucuaagugggcauugcca

SEQ ID NO: 703811 - RNA, 12 nt, Homo sapiens
ucucuaccccaa

SEQ ID NO: 703812 - RNA, 13 nt, Homo sapiens
ucucuagcacaau

SEQ ID NO: 703813 - RNA, 22 nt, Homo sapiens
ucucuagcacaauuugcacuaa

SEQ ID NO: 703814 - RNA, 20 nt, Homo sapiens
ucucuccacugugcuuucag

SEQ ID NO: 703815 - RNA, 14 nt, Homo sapiens
ucucuccucucuga

SEQ ID NO: 703816 - RNA, 13 nt, Homo sapiens
ucucugucucaaa

SEQ ID NO: 703817 - RNA, 14 nt, Homo sapiens
ucucuuaauuuuuc

SEQ ID NO: 703818 - RNA, 23 nt, Homo sapiens
ucucuucauuauucucugcuaua

SEQ ID NO: 703819 - RNA, 16 nt, Homo sapiens
ucucuucuaagcaaaa

SEQ ID NO: 703820 - RNA, 19 nt, Homo sapiens
ucucuuugauuauuugcau

SEQ ID NO: 703821 - RNA, 18 nt, Homo sapiens
ucugaaauaggaaacaag

SEQ ID NO: 703822 - RNA, 19 nt, Homo sapiens
ucugaucauguaugcaucc

SEQ ID NO: 703823 - RNA, 20 nt, Homo sapiens
ucugcaaaaggccucuugua

SEQ ID NO: 703824 - RNA, 22 nt, Homo sapiens
ucugccugcaccccugcaguuu

SEQ ID NO: 703825 - RNA, 20 nt, Homo sapiens
ucugccuuaaaaccaaagag

SEQ ID NO: 703826 - RNA, 13 nt, Homo sapiens
ucuggaaucugga

SEQ ID NO: 703827 - RNA, 21 nt, Homo sapiens
ucuggagcggaauuuaccuga

SEQ ID NO: 703828 - RNA, 22 nt, Homo sapiens
ucuggcaucucuuucugcaaag

SEQ ID NO: 703829 - RNA, 15 nt, Homo sapiens
ucugggaggcccuga

SEQ ID NO: 703830 - RNA, 20 nt, Homo sapiens
ucuggggggacccagugcag

SEQ ID NO: 703831 - RNA, 22 nt, Homo sapiens
ucuggggggacccagugcagaa

SEQ ID NO: 703832 - RNA, 19 nt, Homo sapiens
ucuguauuuuauuuagaca

SEQ ID NO: 703833 - RNA, 15 nt, Homo sapiens
ucugugcccagaaua

SEQ ID NO: 703834 - RNA, 21 nt, Homo sapiens
ucuguggaucagagaugcacc

SEQ ID NO: 703835 - RNA, 16 nt, Homo sapiens
ucuguugugugucaug

SEQ ID NO: 703836 - RNA, 15 nt, Homo sapiens
ucuuagauucuuaau

SEQ ID NO: 703837 - RNA, 14 nt, Homo sapiens
ucuuaguuguucag

SEQ ID NO: 703838 - RNA, 18 nt, Homo sapiens
ucuucaucccauuccagg

SEQ ID NO: 703839 - RNA, 19 nt, Homo sapiens
ucuuccccuaaugccuauc

SEQ ID NO: 703840 - RNA, 13 nt, Homo sapiens
ucuucuaagcaaa

SEQ ID NO: 703841 - RNA, 14 nt, Homo sapiens
ucuucucuacucua

SEQ ID NO: 703842 - RNA, 22 nt, Homo sapiens
ucuugaauuagcauuuuucaaa

SEQ ID NO: 703843 - RNA, 17 nt, Homo sapiens
aauagauaaacuauaca

SEQ ID NO: 703844 - RNA, 15 nt, Homo sapiens
aauagucuuugccag

SEQ ID NO: 703845 - RNA, 22 nt, Homo sapiens
aauauaaauuuguguucucaaa

SEQ ID NO: 703846 - RNA, 15 nt, Homo sapiens
aauauauucuuucaa

SEQ ID NO: 703847 - RNA, 14 nt, Homo sapiens
aauaucaaagucau

SEQ ID NO: 703848 - RNA, 12 nt, Homo sapiens
aauaucuuggcc

SEQ ID NO: 703849 - RNA, 14 nt, Homo sapiens
aauauggacauauc

SEQ ID NO: 703850 - RNA, 15 nt, Homo sapiens
aauauggacauauca

SEQ ID NO: 703851 - RNA, 19 nt, Homo sapiens
aauauugcaaaauacauga

SEQ ID NO: 703852 - RNA, 17 nt, Homo sapiens
aauauuuuuauauuucc

SEQ ID NO: 703853 - RNA, 15 nt, Homo sapiens
aaucaauucuaguca

SEQ ID NO: 703854 - RNA, 18 nt, Homo sapiens
aaucaccauguaagcacu

SEQ ID NO: 703855 - RNA, 13 nt, Homo sapiens
aaucagcauuuag

SEQ ID NO: 703856 - RNA, 16 nt, Homo sapiens
aaucagcauuuagucu

SEQ ID NO: 703857 - RNA, 13 nt, Homo sapiens
aaucaucuaaguc

SEQ ID NO: 703858 - RNA, 17 nt, Homo sapiens
aaucaucuaagucagua

SEQ ID NO: 703859 - RNA, 19 nt, Homo sapiens
aaucaugaaacuuguuuca

SEQ ID NO: 703860 - RNA, 20 nt, Homo sapiens
aauccagugaccucucucuc

SEQ ID NO: 703861 - RNA, 16 nt, Homo sapiens
aaucccccagcacuuc

SEQ ID NO: 703862 - RNA, 15 nt, Homo sapiens
aauccuuccauucca

SEQ ID NO: 703863 - RNA, 16 nt, Homo sapiens
aaucuaagcagcuuau

SEQ ID NO: 703864 - RNA, 13 nt, Homo sapiens
aaucugagccagu

SEQ ID NO: 703865 - RNA, 14 nt, Homo sapiens
aaucugccagacuu

SEQ ID NO: 703866 - RNA, 14 nt, Homo sapiens
aaucuuaugcucuc

SEQ ID NO: 703867 - RNA, 14 nt, Homo sapiens
aaugaaaacagugu

SEQ ID NO: 703868 - RNA, 14 nt, Homo sapiens
aaugaaaauuguau

SEQ ID NO: 703869 - RNA, 13 nt, Homo sapiens
aaugaacacuccc

SEQ ID NO: 703870 - RNA, 13 nt, Homo sapiens
aaugagcauguuu

SEQ ID NO: 703871 - RNA, 18 nt, Homo sapiens
aaugaggaggaugcuaaa

SEQ ID NO: 703872 - RNA, 19 nt, Homo sapiens
aaugaggaggaugcuaaaa

SEQ ID NO: 703873 - RNA, 14 nt, Homo sapiens
aaugauacugaugg

SEQ ID NO: 703874 - RNA, 17 nt, Homo sapiens
aaugauuuacauaaaag

SEQ ID NO: 703875 - RNA, 22 nt, Homo sapiens
aaugcauauuugcaaaguguau

SEQ ID NO: 703876 - RNA, 17 nt, Homo sapiens
aaugccuaucugaccaa

SEQ ID NO: 703877 - RNA, 13 nt, Homo sapiens
aaugcuacaugug

SEQ ID NO: 703878 - RNA, 20 nt, Homo sapiens
aaugcugcaggacuugagaa

SEQ ID NO: 703879 - RNA, 20 nt, Homo sapiens
aauggcuuguucaucaucca

SEQ ID NO: 703880 - RNA, 17 nt, Homo sapiens
aauguaaaauauaucau

SEQ ID NO: 703881 - RNA, 19 nt, Homo sapiens
aauguauuuuaagugaauu

SEQ ID NO: 703882 - RNA, 19 nt, Homo sapiens
aaugugugaaguaugcacu

SEQ ID NO: 703883 - RNA, 16 nt, Homo sapiens
aauuacugccuugaaa

SEQ ID NO: 703884 - RNA, 21 nt, Homo sapiens
aauuauauaacuguauuugaa

SEQ ID NO: 703885 - RNA, 20 nt, Homo sapiens
aauuauugacacugaacuua

SEQ ID NO: 703886 - RNA, 14 nt, Homo sapiens
aauucaaacugggg

SEQ ID NO: 703887 - RNA, 13 nt, Homo sapiens
aauucaacuuugu

SEQ ID NO: 703888 - RNA, 20 nt, Homo sapiens
aauuccuacacucuugacua

SEQ ID NO: 703889 - RNA, 22 nt, Homo sapiens
aauuccuauauccugugacugu

SEQ ID NO: 703890 - RNA, 15 nt, Homo sapiens
aauucugagccugau

SEQ ID NO: 703891 - RNA, 18 nt, Homo sapiens
aauucugauugauuugau

SEQ ID NO: 703892 - RNA, 22 nt, Homo sapiens
aauugguaaaacucacugugau

SEQ ID NO: 703893 - RNA, 19 nt, Homo sapiens
aauugugugaacuuggaag

SEQ ID NO: 703894 - RNA, 16 nt, Homo sapiens
aauuuaaaauaauuau

SEQ ID NO: 703895 - RNA, 20 nt, Homo sapiens
aauuucuaccuuuacuacau

SEQ ID NO: 703896 - RNA, 19 nt, Homo sapiens
aauuucuccucccuuccuu

SEQ ID NO: 703897 - RNA, 15 nt, Homo sapiens
aauuugcacuguuua

SEQ ID NO: 703898 - RNA, 17 nt, Homo sapiens
aauuugggagagccaua

SEQ ID NO: 703899 - RNA, 23 nt, Homo sapiens
aauuuuuauuguuguacauacga

SEQ ID NO: 703900 - RNA, 14 nt, Homo sapiens
acaaaaaccaaaug

SEQ ID NO: 703901 - RNA, 12 nt, Homo sapiens
acaaaaguaaaa

SEQ ID NO: 703902 - RNA, 15 nt, Homo sapiens
acaaaagucugucuu

SEQ ID NO: 703903 - RNA, 13 nt, Homo sapiens
acaaaauuaagca

SEQ ID NO: 703904 - RNA, 14 nt, Homo sapiens
acaaagugccaaag

SEQ ID NO: 703905 - RNA, 12 nt, Homo sapiens
acaacugugacu

SEQ ID NO: 703906 - RNA, 13 nt, Homo sapiens
acaacugugacug

SEQ ID NO: 703907 - RNA, 15 nt, Homo sapiens
acaagaccaccacuu

SEQ ID NO: 703908 - RNA, 19 nt, Homo sapiens
acaagaguggacucagugg

SEQ ID NO: 703909 - RNA, 19 nt, Homo sapiens
acaagcuggcuuacacugg

SEQ ID NO: 703910 - RNA, 20 nt, Homo sapiens
acaagucaguaggacuccuu

SEQ ID NO: 703911 - RNA, 22 nt, Homo sapiens
acaaguugagcuaugacuuaac

SEQ ID NO: 703912 - RNA, 23 nt, Homo sapiens
acaaguuggaugcggccauucaa

SEQ ID NO: 703913 - RNA, 12 nt, Homo sapiens
acaauaaacccu

SEQ ID NO: 703914 - RNA, 14 nt, Homo sapiens
acaauaguucugug

SEQ ID NO: 703915 - RNA, 15 nt, Homo sapiens
acaaugaacacuuau

SEQ ID NO: 703916 - RNA, 14 nt, Homo sapiens
acaauggaguauuc

SEQ ID NO: 703917 - RNA, 19 nt, Homo sapiens
acaauguuuauaaaggcca

SEQ ID NO: 703918 - RNA, 17 nt, Homo sapiens
acaauuggcacuaaaga

SEQ ID NO: 703919 - RNA, 20 nt, Homo sapiens
acacaaacgggcucagcaaa

SEQ ID NO: 703920 - RNA, 20 nt, Homo sapiens
acacagagcuuuggucugug

SEQ ID NO: 703921 - RNA, 23 nt, Homo sapiens
acacccaagaagaaaugcuuucc

SEQ ID NO: 703922 - RNA, 13 nt, Homo sapiens
acaccuaagagaa

SEQ ID NO: 703923 - RNA, 14 nt, Homo sapiens
acacggaggcaucc

SEQ ID NO: 703924 - RNA, 18 nt, Homo sapiens
acacugcugcuccagugc

SEQ ID NO: 703925 - RNA, 14 nt, Homo sapiens
acagaaacacugcc

SEQ ID NO: 703926 - RNA, 21 nt, Homo sapiens
acagaaagagacuccgucuca

SEQ ID NO: 703927 - RNA, 15 nt, Homo sapiens
acagaaauuguauau

SEQ ID NO: 703928 - RNA, 13 nt, Homo sapiens
acagaacuacuuc

SEQ ID NO: 703929 - RNA, 12 nt, Homo sapiens
acagaacuugaa

SEQ ID NO: 703930 - RNA, 14 nt, Homo sapiens
acagauaccuccaa

SEQ ID NO: 703931 - RNA, 17 nt, Homo sapiens
acagcagcaguuacaaa

SEQ ID NO: 703932 - RNA, 18 nt, Homo sapiens
acagcgagggcagcugcu

SEQ ID NO: 703933 - RNA, 21 nt, Homo sapiens
acagcugccugugugggacug

SEQ ID NO: 703934 - RNA, 15 nt, Homo sapiens
acaggagacaaaaga

SEQ ID NO: 703935 - RNA, 15 nt, Homo sapiens
acaggagaccuggca

SEQ ID NO: 703936 - RNA, 20 nt, Homo sapiens
acaguagaacugucugugaa

SEQ ID NO: 703937 - RNA, 16 nt, Homo sapiens
acaguagauuuuccaa

SEQ ID NO: 703938 - RNA, 14 nt, Homo sapiens
acaguaucucaggg

SEQ ID NO: 703939 - RNA, 20 nt, Homo sapiens
acagugaaguuuuacugucu

SEQ ID NO: 703940 - RNA, 12 nt, Homo sapiens
acagugacugua

SEQ ID NO: 703941 - RNA, 13 nt, Homo sapiens
acagugacuguac

SEQ ID NO: 703942 - RNA, 21 nt, Homo sapiens
acagugaugcugugcuaugaa

SEQ ID NO: 703943 - RNA, 16 nt, Homo sapiens
acaguugcagcccuug

SEQ ID NO: 703944 - RNA, 11 nt, Homo sapiens
acaguuuucag

SEQ ID NO: 703945 - RNA, 22 nt, Homo sapiens
acaguuuugaccuaacauaccg

SEQ ID NO: 703946 - RNA, 17 nt, Homo sapiens
acaguuuuuccuggaau

SEQ ID NO: 703947 - RNA, 14 nt, Homo sapiens
acauacuguucacu

SEQ ID NO: 703948 - RNA, 23 nt, Homo sapiens
acauagaaauggaaauuuugcua

SEQ ID NO: 703949 - RNA, 22 nt, Homo sapiens
acauauaaaauguaauuacuua

SEQ ID NO: 703950 - RNA, 17 nt, Homo sapiens
acauaucccuuccagau

SEQ ID NO: 703951 - RNA, 16 nt, Homo sapiens
acauccaacuccagca

SEQ ID NO: 703952 - RNA, 23 nt, Homo sapiens
acaucucaauaaagugcuuuaaa

SEQ ID NO: 703953 - RNA, 16 nt, Homo sapiens
acaucucccucccaca

SEQ ID NO: 703954 - RNA, 23 nt, Homo sapiens
acaucugccuuaaaaccaaagag

SEQ ID NO: 703955 - RNA, 22 nt, Homo sapiens
acaugagauguguggacugugg

SEQ ID NO: 703956 - RNA, 20 nt, Homo sapiens
acauggugaaaccccgucuc

SEQ ID NO: 703957 - RNA, 15 nt, Homo sapiens
acauguaacauuaaa

SEQ ID NO: 703958 - RNA, 10 nt, Homo sapiens
acauguuaau

SEQ ID NO: 703959 - RNA, 12 nt, Homo sapiens
acauucuuggcu

SEQ ID NO: 703960 - RNA, 15 nt, Homo sapiens
acauuugcuacuguu

SEQ ID NO: 703961 - RNA, 13 nt, Homo sapiens
accaaagcugccc

SEQ ID NO: 703962 - RNA, 14 nt, Homo sapiens
gagacagauaccuc

SEQ ID NO: 703963 - RNA, 15 nt, Homo sapiens
gagacagauaccucc

SEQ ID NO: 703964 - RNA, 14 nt, Homo sapiens
gagacucagugcag

SEQ ID NO: 703965 - RNA, 15 nt, Homo sapiens
gagacucagugcaga

SEQ ID NO: 703966 - RNA, 16 nt, Homo sapiens
gagacuccgucacaac

SEQ ID NO: 703967 - RNA, 20 nt, Homo sapiens
gagagaugaaccacauuaua

SEQ ID NO: 703968 - RNA, 22 nt, Homo sapiens
gagaguagaugguuugagccug

SEQ ID NO: 703969 - RNA, 13 nt, Homo sapiens
gagauccaaagac

SEQ ID NO: 703970 - RNA, 11 nt, Homo sapiens
gagauccuccu

SEQ ID NO: 703971 - RNA, 19 nt, Homo sapiens
gagaucgugcuacugcacu

SEQ ID NO: 703972 - RNA, 20 nt, Homo sapiens
gagaucgugcuacugcacuc

SEQ ID NO: 703973 - RNA, 18 nt, Homo sapiens
gagaugaaccacauuaua

SEQ ID NO: 703974 - RNA, 21 nt, Homo sapiens
gagaugcaggauuucuucaca

SEQ ID NO: 703975 - RNA, 20 nt, Homo sapiens
gagauugugccacuucacuc

SEQ ID NO: 703976 - RNA, 18 nt, Homo sapiens
gagauuucuuguugcuca

SEQ ID NO: 703977 - RNA, 19 nt, Homo sapiens
gagcaaauaaagaccugag

SEQ ID NO: 703978 - RNA, 18 nt, Homo sapiens
gagcaagugagacccugu

SEQ ID NO: 703979 - RNA, 16 nt, Homo sapiens
gagcauaguccaaaaa

SEQ ID NO: 703980 - RNA, 19 nt, Homo sapiens
gagcauguuugccuagaca

SEQ ID NO: 703981 - RNA, 15 nt, Homo sapiens
gagccagcucccucu

SEQ ID NO: 703982 - RNA, 21 nt, Homo sapiens
gagccccaggggacaagggau

SEQ ID NO: 703983 - RNA, 14 nt, Homo sapiens
gagcccuuaugaca

SEQ ID NO: 703984 - RNA, 21 nt, Homo sapiens
gagccgagauugcaccacugc

SEQ ID NO: 703985 - RNA, 18 nt, Homo sapiens
gagcgagacuccgucuca

SEQ ID NO: 703986 - RNA, 19 nt, Homo sapiens
gagcucgcauuugucaaug

SEQ ID NO: 703987 - RNA, 13 nt, Homo sapiens
gagcuugcaguga

SEQ ID NO: 703988 - RNA, 14 nt, Homo sapiens
gaggaacacugcac

SEQ ID NO: 703989 - RNA, 17 nt, Homo sapiens
gaggacaauacuggggu

SEQ ID NO: 703990 - RNA, 11 nt, Homo sapiens
gaggcaucuga

SEQ ID NO: 703991 - RNA, 21 nt, Homo sapiens
gaggcggaucaucuaauucuc

SEQ ID NO: 703992 - RNA, 20 nt, Homo sapiens
gaggcugcacccacccagga

SEQ ID NO: 703993 - RNA, 16 nt, Homo sapiens
gaggcugccccucuca

SEQ ID NO: 703994 - RNA, 19 nt, Homo sapiens
gaggcuggguucauuugug

SEQ ID NO: 703995 - RNA, 23 nt, Homo sapiens
gagggaagaaugaacacucccca

SEQ ID NO: 703996 - RNA, 17 nt, Homo sapiens
gagggaggucacuggaa

SEQ ID NO: 703997 - RNA, 21 nt, Homo sapiens
gagggugggaaggaaacaacc

SEQ ID NO: 703998 - RNA, 12 nt, Homo sapiens
gaggucacugga

SEQ ID NO: 703999 - RNA, 20 nt, Homo sapiens
gagguggaggcugcagugag

SEQ ID NO: 704000 - RNA, 17 nt, Homo sapiens
gaguaaucuuguugguu

SEQ ID NO: 704001 - RNA, 15 nt, Homo sapiens
gagucacugccaagu

SEQ ID NO: 704002 - RNA, 14 nt, Homo sapiens
gaguccacuuuguu

SEQ ID NO: 704003 - RNA, 20 nt, Homo sapiens
gaguuacuggauuuguuguu

SEQ ID NO: 704004 - RNA, 21 nt, Homo sapiens
gaguuugagcugccuucccua

SEQ ID NO: 704005 - RNA, 22 nt, Homo sapiens
gaguuuuauagccuggacugcu

SEQ ID NO: 704006 - RNA, 18 nt, Homo sapiens
gauaaauccaucacuaua

SEQ ID NO: 704007 - RNA, 13 nt, Homo sapiens
gauaagucuuuca

SEQ ID NO: 704008 - RNA, 13 nt, Homo sapiens
gauacauguaauu

SEQ ID NO: 704009 - RNA, 17 nt, Homo sapiens
gauaccuccaacccugc

SEQ ID NO: 704010 - RNA, 21 nt, Homo sapiens
gauagaguucuuuuaagccca

SEQ ID NO: 704011 - RNA, 15 nt, Homo sapiens
gauagggaacugggg

SEQ ID NO: 704012 - RNA, 14 nt, Homo sapiens
gauaucaugcaaau

SEQ ID NO: 704013 - RNA, 14 nt, Homo sapiens
gauauuacauuuau

SEQ ID NO: 704014 - RNA, 12 nt, Homo sapiens
gaucacugccac

SEQ ID NO: 704015 - RNA, 17 nt, Homo sapiens
gauccacuaugccuuaa

SEQ ID NO: 704016 - RNA, 18 nt, Homo sapiens
gaucggcggccacugcgc

SEQ ID NO: 704017 - RNA, 14 nt, Homo sapiens
gaucuugguucacu

SEQ ID NO: 704018 - RNA, 23 nt, Homo sapiens
gaugaaaacauagcaucucagga

SEQ ID NO: 704019 - RNA, 11 nt, Homo sapiens
gaugacaauaa

SEQ ID NO: 704020 - RNA, 13 nt, Homo sapiens
gaugauaaaacac

SEQ ID NO: 704021 - RNA, 16 nt, Homo sapiens
gaugcggccauucaag

SEQ ID NO: 704022 - RNA, 16 nt, Homo sapiens
gaugcuaaaaauguca

SEQ ID NO: 704023 - RNA, 19 nt, Homo sapiens
gaugcuccagcaacacagc

SEQ ID NO: 704024 - RNA, 14 nt, Homo sapiens
gaugcugugcuaug

SEQ ID NO: 704025 - RNA, 17 nt, Homo sapiens
gaugucagcaguugcug

SEQ ID NO: 704026 - RNA, 18 nt, Homo sapiens
gauguggcccuggcugcc

SEQ ID NO: 704027 - RNA, 19 nt, Homo sapiens
gauguuuccagacuuccuu

SEQ ID NO: 704028 - RNA, 23 nt, Homo sapiens
gauuacaaggcuuuaucucaggg

SEQ ID NO: 704029 - RNA, 16 nt, Homo sapiens
gauuaugaaagcaaca

SEQ ID NO: 704030 - RNA, 15 nt, Homo sapiens
gauucuaccacacag

SEQ ID NO: 704031 - RNA, 23 nt, Homo sapiens
gauuucaugccuggugcuuccaa

SEQ ID NO: 704032 - RNA, 20 nt, Homo sapiens
gauuugccguaccaaucucu

SEQ ID NO: 704033 - RNA, 22 nt, Homo sapiens
gauuugucccuaugcauaucag

SEQ ID NO: 704034 - RNA, 16 nt, Homo sapiens
gcaaaaccucauuuaa

SEQ ID NO: 704035 - RNA, 21 nt, Homo sapiens
gcaaaacucuacuuaauccaa

SEQ ID NO: 704036 - RNA, 12 nt, Homo sapiens
gcaaaagguuua

SEQ ID NO: 704037 - RNA, 20 nt, Homo sapiens
gcaaacaggguuugauagca

SEQ ID NO: 704038 - RNA, 18 nt, Homo sapiens
gcaaacugggaugaaacu

SEQ ID NO: 704039 - RNA, 19 nt, Homo sapiens
gcaaaggaaacuuugcaga

SEQ ID NO: 704040 - RNA, 16 nt, Homo sapiens
gcaaaggcgucugaau

SEQ ID NO: 704041 - RNA, 22 nt, Homo sapiens
gcaaagggccugcccagacaag

SEQ ID NO: 704042 - RNA, 14 nt, Homo sapiens
gcaaccacuaagaa

SEQ ID NO: 704043 - RNA, 12 nt, Homo sapiens
gcaaccaggaac

SEQ ID NO: 704044 - RNA, 18 nt, Homo sapiens
gcaacgccgugggcugcg

SEQ ID NO: 704045 - RNA, 18 nt, Homo sapiens
gcaacuggccauuugcca

SEQ ID NO: 704046 - RNA, 15 nt, Homo sapiens
gcaacuguaugaaaa

SEQ ID NO: 704047 - RNA, 17 nt, Homo sapiens
gcaagugugaauacugc

SEQ ID NO: 704048 - RNA, 18 nt, Homo sapiens
gcaauaaaaaucauagua

SEQ ID NO: 704049 - RNA, 21 nt, Homo sapiens
gcaauagacacauacauguca

SEQ ID NO: 704050 - RNA, 16 nt, Homo sapiens
gcaaugacucaaaguc

SEQ ID NO: 704051 - RNA, 21 nt, Homo sapiens
gcaauugaauuaaauuaggaa

SEQ ID NO: 704052 - RNA, 13 nt, Homo sapiens
gcaccauucugac

SEQ ID NO: 704053 - RNA, 13 nt, Homo sapiens
gcaccucuuccuu

SEQ ID NO: 704054 - RNA, 20 nt, Homo sapiens
gcacuaaagaauacauuuaa

SEQ ID NO: 704055 - RNA, 16 nt, Homo sapiens
gcacuaaaucagagac

SEQ ID NO: 704056 - RNA, 13 nt, Homo sapiens
gcacuggggccac

SEQ ID NO: 704057 - RNA, 21 nt, Homo sapiens
gcacuuggccugacucaggaa

SEQ ID NO: 704058 - RNA, 17 nt, Homo sapiens
gcagaauugagagugau

SEQ ID NO: 704059 - RNA, 18 nt, Homo sapiens
gcagaauugagagugauu

SEQ ID NO: 704060 - RNA, 22 nt, Homo sapiens
gcagacaauaaacccucagagc

SEQ ID NO: 704061 - RNA, 18 nt, Homo sapiens
gcagagcaaagugcggug

SEQ ID NO: 704062 - RNA, 16 nt, Homo sapiens
gcagauuuuugcaaua

SEQ ID NO: 704063 - RNA, 15 nt, Homo sapiens
gcagcaaauuuucag

SEQ ID NO: 704064 - RNA, 14 nt, Homo sapiens
gcagcccagagacu

SEQ ID NO: 704065 - RNA, 13 nt, Homo sapiens
gcagccucuguca

SEQ ID NO: 704066 - RNA, 19 nt, Homo sapiens
gcagccuggggucugacaa

SEQ ID NO: 704067 - RNA, 19 nt, Homo sapiens
gcagcuuacuuaguaggcu

SEQ ID NO: 704068 - RNA, 12 nt, Homo sapiens
gcaggaccucag

SEQ ID NO: 704069 - RNA, 18 nt, Homo sapiens
gcaggacuuccccggagg

SEQ ID NO: 704070 - RNA, 18 nt, Homo sapiens
gcaggcugggccaugucc

SEQ ID NO: 704071 - RNA, 23 nt, Homo sapiens
gcaggcugggccauguccaaaga

SEQ ID NO: 704072 - RNA, 12 nt, Homo sapiens
gcagucacugga

SEQ ID NO: 704073 - RNA, 13 nt, Homo sapiens
gcaguccuacuca

SEQ ID NO: 704074 - RNA, 23 nt, Homo sapiens
gcaguuugaggauuaguuuagaa

SEQ ID NO: 704075 - RNA, 23 nt, Homo sapiens
gcauaaaguaaauacaugcauau

SEQ ID NO: 704076 - RNA, 20 nt, Homo sapiens
gcauagcaaaugacauaagc

SEQ ID NO: 704077 - RNA, 15 nt, Homo sapiens
gcauaguccaaaaag

SEQ ID NO: 704078 - RNA, 16 nt, Homo sapiens
gcauaguccaaaaagc

SEQ ID NO: 704079 - RNA, 12 nt, Homo sapiens
gcaucauuucag

SEQ ID NO: 704080 - RNA, 22 nt, Homo sapiens
gcaucccaaaccacgccucuug

SEQ ID NO: 704081 - RNA, 20 nt, Homo sapiens
uauauuugugugugugauau

SEQ ID NO: 704082 - RNA, 12 nt, Homo sapiens
uaucaaagucau

SEQ ID NO: 704083 - RNA, 18 nt, Homo sapiens
uaucacuucacuguucuc

SEQ ID NO: 704084 - RNA, 15 nt, Homo sapiens
uaucaggguauucca

SEQ ID NO: 704085 - RNA, 21 nt, Homo sapiens
uaucaguugagcuucauauac

SEQ ID NO: 704086 - RNA, 22 nt, Homo sapiens
uaucccacauccaacuccagca

SEQ ID NO: 704087 - RNA, 18 nt, Homo sapiens
uaucccuagugcuccaua

SEQ ID NO: 704088 - RNA, 20 nt, Homo sapiens
uaucuaauauauaugaauaa

SEQ ID NO: 704089 - RNA, 12 nt, Homo sapiens
uaucuaugcaaa

SEQ ID NO: 704090 - RNA, 22 nt, Homo sapiens
uaucucaggggccaacuaggca

SEQ ID NO: 704091 - RNA, 15 nt, Homo sapiens
uaucuccacaaccuc

SEQ ID NO: 704092 - RNA, 16 nt, Homo sapiens
uaucuugauaaacuag

SEQ ID NO: 704093 - RNA, 19 nt, Homo sapiens
uaugaaaaaucaaugucaa

SEQ ID NO: 704094 - RNA, 15 nt, Homo sapiens
uaugcaaaagguuua

SEQ ID NO: 704095 - RNA, 16 nt, Homo sapiens
uaugccaagagugcac

SEQ ID NO: 704096 - RNA, 14 nt, Homo sapiens
uaugcuaauaguga

SEQ ID NO: 704097 - RNA, 19 nt, Homo sapiens
uaugcuuuccaaaccuuau

SEQ ID NO: 704098 - RNA, 14 nt, Homo sapiens
uauggaauuuugca

SEQ ID NO: 704099 - RNA, 19 nt, Homo sapiens
uauggaauuuugcaaagau

SEQ ID NO: 704100 - RNA, 13 nt, Homo sapiens
uauguacuuuuau

SEQ ID NO: 704101 - RNA, 20 nt, Homo sapiens
uauguagaagcaugaagucu

SEQ ID NO: 704102 - RNA, 15 nt, Homo sapiens
uaugugggauauuga

SEQ ID NO: 704103 - RNA, 20 nt, Homo sapiens
uauguguggaugaugcugcc

SEQ ID NO: 704104 - RNA, 21 nt, Homo sapiens
uauuccacuggcgcaucauau

SEQ ID NO: 704105 - RNA, 23 nt, Homo sapiens
uauuccccccacuuaagacugug

SEQ ID NO: 704106 - RNA, 21 nt, Homo sapiens
uauugaacuuuuguacugaau

SEQ ID NO: 704107 - RNA, 19 nt, Homo sapiens
uauugacacugaacuuaau

SEQ ID NO: 704108 - RNA, 22 nt, Homo sapiens
uauugaggccaagaauauugca

SEQ ID NO: 704109 - RNA, 21 nt, Homo sapiens
uauuggagccccaggggacaa

SEQ ID NO: 704110 - RNA, 14 nt, Homo sapiens
uauuuaagauguga

SEQ ID NO: 704111 - RNA, 14 nt, Homo sapiens
uauuuaaucuuaau

SEQ ID NO: 704112 - RNA, 15 nt, Homo sapiens
uauuuacaagggaag

SEQ ID NO: 704113 - RNA, 16 nt, Homo sapiens
uauuuauguguucaca

SEQ ID NO: 704114 - RNA, 20 nt, Homo sapiens
uauuucaaaauauacauuca

SEQ ID NO: 704115 - RNA, 18 nt, Homo sapiens
uauuucagugaauuugca

SEQ ID NO: 704116 - RNA, 21 nt, Homo sapiens
uauuuccacuuauaaaggaaa

SEQ ID NO: 704117 - RNA, 19 nt, Homo sapiens
uauuucccauuugugccag

SEQ ID NO: 704118 - RNA, 20 nt, Homo sapiens
uauuuccuuuaugugaauuu

SEQ ID NO: 704119 - RNA, 16 nt, Homo sapiens
uauuucugaaucgaga

SEQ ID NO: 704120 - RNA, 17 nt, Homo sapiens
uauuugaaagugccuuu

SEQ ID NO: 704121 - RNA, 13 nt, Homo sapiens
uauuugcuaugaa

SEQ ID NO: 704122 - RNA, 15 nt, Homo sapiens
uauuuuacacagaaa

SEQ ID NO: 704123 - RNA, 19 nt, Homo sapiens
ucaaaaguaaugcuucaau

SEQ ID NO: 704124 - RNA, 15 nt, Homo sapiens
ucaaaagugccucaa

SEQ ID NO: 704125 - RNA, 18 nt, Homo sapiens
ucaaaauauacauucaaa

SEQ ID NO: 704126 - RNA, 18 nt, Homo sapiens
ucaaaauauuucagugaa

SEQ ID NO: 704127 - RNA, 17 nt, Homo sapiens
ucaaauacacauuugcu

SEQ ID NO: 704128 - RNA, 18 nt, Homo sapiens
ucaaauacacauuugcua

SEQ ID NO: 704129 - RNA, 21 nt, Homo sapiens
ucaaauacacauuugcuacug

SEQ ID NO: 704130 - RNA, 16 nt, Homo sapiens
ucaaauauuccauucu

SEQ ID NO: 704131 - RNA, 12 nt, Homo sapiens
ucaaaugaucuu

SEQ ID NO: 704132 - RNA, 21 nt, Homo sapiens
ucaacaaguaacuuuguagaa

SEQ ID NO: 704133 - RNA, 19 nt, Homo sapiens
ucaaccucuucuggcucaa

SEQ ID NO: 704134 - RNA, 13 nt, Homo sapiens
ucaacgugcauuu

SEQ ID NO: 704135 - RNA, 20 nt, Homo sapiens
ucaacuuagucaauaagaaa

SEQ ID NO: 704136 - RNA, 19 nt, Homo sapiens
ucaacuuuuucccucacua

SEQ ID NO: 704137 - RNA, 16 nt, Homo sapiens
ucaaggcugcagugag

SEQ ID NO: 704138 - RNA, 16 nt, Homo sapiens
ucaaggucacuguuuc

SEQ ID NO: 704139 - RNA, 20 nt, Homo sapiens
ucaaguaccaaaauguuaau

SEQ ID NO: 704140 - RNA, 17 nt, Homo sapiens
ucaauauacauaauaca

SEQ ID NO: 704141 - RNA, 21 nt, Homo sapiens
ucaauccugauuccucucuaa

SEQ ID NO: 704142 - RNA, 16 nt, Homo sapiens
ucaauggcuuguucau

SEQ ID NO: 704143 - RNA, 22 nt, Homo sapiens
ucaauggcuuguucaucaucca

SEQ ID NO: 704144 - RNA, 18 nt, Homo sapiens
ucacacagacacuaacga

SEQ ID NO: 704145 - RNA, 14 nt, Homo sapiens
ucacacgcuuuuga

SEQ ID NO: 704146 - RNA, 22 nt, Homo sapiens
ucacacuccccuagggggagaa

SEQ ID NO: 704147 - RNA, 14 nt, Homo sapiens
ucacagccucugaa

SEQ ID NO: 704148 - RNA, 14 nt, Homo sapiens
ucacauggcauggu

SEQ ID NO: 704149 - RNA, 16 nt, Homo sapiens
ucacauuucuaugcca

SEQ ID NO: 704150 - RNA, 18 nt, Homo sapiens
ucaccaccaccccuacca

SEQ ID NO: 704151 - RNA, 18 nt, Homo sapiens
ucaccagccccacugcca

SEQ ID NO: 704152 - RNA, 16 nt, Homo sapiens
ucaccaucaauccuga

SEQ ID NO: 704153 - RNA, 20 nt, Homo sapiens
ucacccaggcuggacugcaa

SEQ ID NO: 704154 - RNA, 16 nt, Homo sapiens
ucacccuuguccuuga

SEQ ID NO: 704155 - RNA, 22 nt, Homo sapiens
ucacgaguaagauuaagagcaa

SEQ ID NO: 704156 - RNA, 15 nt, Homo sapiens
ucacuaauacacagu

SEQ ID NO: 704157 - RNA, 22 nt, Homo sapiens
ucacuaggcccccacuugccuc

SEQ ID NO: 704158 - RNA, 18 nt, Homo sapiens
ucacugcaacuucugccu

SEQ ID NO: 704159 - RNA, 19 nt, Homo sapiens
ucacugcuuguuaugcauc

SEQ ID NO: 704160 - RNA, 19 nt, Homo sapiens
ucagaaguuaguuuguaua

SEQ ID NO: 704161 - RNA, 19 nt, Homo sapiens
ucagaaucccuuaacaguu

SEQ ID NO: 704162 - RNA, 14 nt, Homo sapiens
ucagagacagauac

SEQ ID NO: 704163 - RNA, 19 nt, Homo sapiens
ucagagacagauaccucca

SEQ ID NO: 704164 - RNA, 21 nt, Homo sapiens
ucagaugauucagaaauuuuc

SEQ ID NO: 704165 - RNA, 19 nt, Homo sapiens
ucagcaaaagaugcuucuc

SEQ ID NO: 704166 - RNA, 19 nt, Homo sapiens
ucagcucggggagccuuag

SEQ ID NO: 704167 - RNA, 23 nt, Homo sapiens
ucaggagaaccuaacaugcuggu

SEQ ID NO: 704168 - RNA, 17 nt, Homo sapiens
ucaggagaucgagacca

SEQ ID NO: 704169 - RNA, 18 nt, Homo sapiens
ucaggaguucgagaccag

SEQ ID NO: 704170 - RNA, 20 nt, Homo sapiens
ucaguaacugucaggcugaa

SEQ ID NO: 704171 - RNA, 21 nt, Homo sapiens
ucaguugccaaggaucccuga

SEQ ID NO: 704172 - RNA, 19 nt, Homo sapiens
ucaguuuucauaguaucca

SEQ ID NO: 704173 - RNA, 22 nt, Homo sapiens
ucauaggcaccuuuuacuguga

SEQ ID NO: 704174 - RNA, 15 nt, Homo sapiens
ucauaguaagauuga

SEQ ID NO: 704175 - RNA, 20 nt, Homo sapiens
ucauaugaaaaaaaugcauu

SEQ ID NO: 704176 - RNA, 15 nt, Homo sapiens
ucauauguaaucucu

SEQ ID NO: 704177 - RNA, 14 nt, Homo sapiens
ucaucauccuacaa

SEQ ID NO: 704178 - RNA, 20 nt, Homo sapiens
ucauccuccaggaacugcag

SEQ ID NO: 704179 - RNA, 20 nt, Homo sapiens
ucaucuauagaaagcuauau

SEQ ID NO: 704180 - RNA, 14 nt, Homo sapiens
ucaucuuuguggau

SEQ ID NO: 704181 - RNA, 21 nt, Homo sapiens
ucaugaaacuuguuucacuga

SEQ ID NO: 704182 - RNA, 12 nt, Homo sapiens
ucauguaugcau

SEQ ID NO: 704183 - RNA, 17 nt, Homo sapiens
ucauuagcauuuugcua

SEQ ID NO: 704184 - RNA, 14 nt, Homo sapiens
ucauuaugccacuu

SEQ ID NO: 704185 - RNA, 13 nt, Homo sapiens
ucauucaucauag

SEQ ID NO: 704186 - RNA, 14 nt, Homo sapiens
ucauuuugcacuga

SEQ ID NO: 704187 - RNA, 16 nt, Homo sapiens
uccaaaugcccagcuu

SEQ ID NO: 704188 - RNA, 16 nt, Homo sapiens
uccaaccagaccugga

SEQ ID NO: 704189 - RNA, 19 nt, Homo sapiens
uccaaccaggcuccuguga

SEQ ID NO: 704190 - RNA, 23 nt, Homo sapiens
uccaacccugccgucaccaccac

SEQ ID NO: 704191 - RNA, 18 nt, Homo sapiens
uccacaauaaccaagaua

SEQ ID NO: 704192 - RNA, 21 nt, Homo sapiens
uccaccagcaucaccugccug

SEQ ID NO: 704193 - RNA, 17 nt, Homo sapiens
uccaccuccuaccccau

SEQ ID NO: 704194 - RNA, 20 nt, Homo sapiens
uccagacuuccuugagacac

SEQ ID NO: 704195 - RNA, 15 nt, Homo sapiens
uccagaucacugcca

SEQ ID NO: 704196 - RNA, 17 nt, Homo sapiens
uccagaucacugccaca

SEQ ID NO: 704197 - RNA, 23 nt, Homo sapiens
uccagcaaaagagcuauugccaa

SEQ ID NO: 704198 - RNA, 15 nt, Homo sapiens
uuaagagacacucca

SEQ ID NO: 704199 - RNA, 18 nt, Homo sapiens
uuaagcccuaagguccua

SEQ ID NO: 704200 - RNA, 23 nt, Homo sapiens
uuaaggacaaagugccaaagaaa

SEQ ID NO: 704201 - RNA, 22 nt, Homo sapiens
uuaaguauguuauuuucuguug

SEQ ID NO: 704202 - RNA, 16 nt, Homo sapiens
uuaagugacuauagaa

SEQ ID NO: 704203 - RNA, 22 nt, Homo sapiens
uuaaguggggugggaaggggag

SEQ ID NO: 704204 - RNA, 17 nt, Homo sapiens
uuaauaagcuacuagca

SEQ ID NO: 704205 - RNA, 19 nt, Homo sapiens
uuaauaagcuacuagcaaa

SEQ ID NO: 704206 - RNA, 20 nt, Homo sapiens
uuaauccaguguuacugugu

SEQ ID NO: 704207 - RNA, 19 nt, Homo sapiens
uuaaugaaugagucuguug

SEQ ID NO: 704208 - RNA, 14 nt, Homo sapiens
uuaaugauacaugu

SEQ ID NO: 704209 - RNA, 22 nt, Homo sapiens
uuacaaugaucaccgacugaaa

SEQ ID NO: 704210 - RNA, 16 nt, Homo sapiens
uuacauguaauuugau

SEQ ID NO: 704211 - RNA, 21 nt, Homo sapiens
uuacauuagccauucauguau

SEQ ID NO: 704212 - RNA, 15 nt, Homo sapiens
uuaccuccucauggc

SEQ ID NO: 704213 - RNA, 17 nt, Homo sapiens
uuacuaauuauacuacu

SEQ ID NO: 704214 - RNA, 17 nt, Homo sapiens
uuacugaagucuuacua

SEQ ID NO: 704215 - RNA, 13 nt, Homo sapiens
uuagaaaaaccac

SEQ ID NO: 704216 - RNA, 19 nt, Homo sapiens
uuagaaaaaccaccaccau

SEQ ID NO: 704217 - RNA, 13 nt, Homo sapiens
uuagaaaacuaga

SEQ ID NO: 704218 - RNA, 20 nt, Homo sapiens
uuagaauaaaucaaauauuc

SEQ ID NO: 704219 - RNA, 21 nt, Homo sapiens
uuagaaugggaucacgaggaa

SEQ ID NO: 704220 - RNA, 19 nt, Homo sapiens
uuagaauuaaaaaagcaua

SEQ ID NO: 704221 - RNA, 18 nt, Homo sapiens
uuagaauuuacagcaaga

SEQ ID NO: 704222 - RNA, 19 nt, Homo sapiens
uuagaccccauacaaguuu

SEQ ID NO: 704223 - RNA, 22 nt, Homo sapiens
uuagaccccauacaaguuuaua

SEQ ID NO: 704224 - RNA, 15 nt, Homo sapiens
uuagcauuuugcuaa

SEQ ID NO: 704225 - RNA, 12 nt, Homo sapiens
uuagccauucau

SEQ ID NO: 704226 - RNA, 18 nt, Homo sapiens
uuaggauuuucacauucu

SEQ ID NO: 704227 - RNA, 23 nt, Homo sapiens
uuaggauuuucacauucuuggcu

SEQ ID NO: 704228 - RNA, 14 nt, Homo sapiens
uuaguaacauucau

SEQ ID NO: 704229 - RNA, 20 nt, Homo sapiens
uuauaaaggauaaagaagga

SEQ ID NO: 704230 - RNA, 18 nt, Homo sapiens
uuauaauuccuauauccu

SEQ ID NO: 704231 - RNA, 20 nt, Homo sapiens
uuauaauuguucucagaauc

SEQ ID NO: 704232 - RNA, 19 nt, Homo sapiens
uuauacaaaccuaccaaaa

SEQ ID NO: 704233 - RNA, 14 nt, Homo sapiens
uuauaucacuucac

SEQ ID NO: 704234 - RNA, 17 nt, Homo sapiens
uuaucccaagaaugcaa

SEQ ID NO: 704235 - RNA, 16 nt, Homo sapiens
uuauggaaaacugugu

SEQ ID NO: 704236 - RNA, 20 nt, Homo sapiens
uuaugugagagaaaguguga

SEQ ID NO: 704237 - RNA, 19 nt, Homo sapiens
uuauuacauguaauuugau

SEQ ID NO: 704238 - RNA, 22 nt, Homo sapiens
uuauuccggaaacuaguguaca

SEQ ID NO: 704239 - RNA, 13 nt, Homo sapiens
uuauugacacuga

SEQ ID NO: 704240 - RNA, 13 nt, Homo sapiens
uuauugcaguuua

SEQ ID NO: 704241 - RNA, 21 nt, Homo sapiens
uuauuuggauaucaaaagcaa

SEQ ID NO: 704242 - RNA, 14 nt, Homo sapiens
uuauuuuucacucu

SEQ ID NO: 704243 - RNA, 14 nt, Homo sapiens
uucaaaauccaaaa

SEQ ID NO: 704244 - RNA, 12 nt, Homo sapiens
uucaaacuuaaa

SEQ ID NO: 704245 - RNA, 20 nt, Homo sapiens
uucaauauuuguuacuguua

SEQ ID NO: 704246 - RNA, 19 nt, Homo sapiens
uucaccauauuggccaguc

SEQ ID NO: 704247 - RNA, 18 nt, Homo sapiens
uucaccaucaauccugau

SEQ ID NO: 704248 - RNA, 22 nt, Homo sapiens
uucagagucagccaggaccaua

SEQ ID NO: 704249 - RNA, 15 nt, Homo sapiens
uucagauauacugga

SEQ ID NO: 704250 - RNA, 19 nt, Homo sapiens
uucagauccugaauuccag

SEQ ID NO: 704251 - RNA, 14 nt, Homo sapiens
uucagcucugcaag

SEQ ID NO: 704252 - RNA, 16 nt, Homo sapiens
uucauacuccuuuuaa

SEQ ID NO: 704253 - RNA, 14 nt, Homo sapiens
uucauaguguucau

SEQ ID NO: 704254 - RNA, 19 nt, Homo sapiens
uucaugauuagcaaguuac

SEQ ID NO: 704255 - RNA, 17 nt, Homo sapiens
uucauguaaagugucag

SEQ ID NO: 704256 - RNA, 17 nt, Homo sapiens
uuccacacagaaugcaa

SEQ ID NO: 704257 - RNA, 23 nt, Homo sapiens
uuccacacagaaugcaaccaagu

SEQ ID NO: 704258 - RNA, 16 nt, Homo sapiens
uuccacacugcacugu

SEQ ID NO: 704259 - RNA, 19 nt, Homo sapiens
uuccaggcagccucuguca

SEQ ID NO: 704260 - RNA, 12 nt, Homo sapiens
uuccaguguuug

SEQ ID NO: 704261 - RNA, 14 nt, Homo sapiens
uucccuaaugaagu

SEQ ID NO: 704262 - RNA, 17 nt, Homo sapiens
uucccuacaguugaaaa

SEQ ID NO: 704263 - RNA, 18 nt, Homo sapiens
uucccuaggaaacucaca

SEQ ID NO: 704264 - RNA, 23 nt, Homo sapiens
uucccuaggaaacucacacuccc

SEQ ID NO: 704265 - RNA, 23 nt, Homo sapiens
uucccugcuuccaggaaacucca

SEQ ID NO: 704266 - RNA, 18 nt, Homo sapiens
uuccucauuagcauuuug

SEQ ID NO: 704267 - RNA, 17 nt, Homo sapiens
uuccucccccaguuccu

SEQ ID NO: 704268 - RNA, 19 nt, Homo sapiens
uuccucccccaguuccucc

SEQ ID NO: 704269 - RNA, 18 nt, Homo sapiens
uuccuuuccuaaaagugu

SEQ ID NO: 704270 - RNA, 20 nt, Homo sapiens
uuccuuuucccugcuuccag

SEQ ID NO: 704271 - RNA, 19 nt, Homo sapiens
uucggaagggguuccucaa

SEQ ID NO: 704272 - RNA, 22 nt, Homo sapiens
uucguacauaauacugaaccac

SEQ ID NO: 704273 - RNA, 20 nt, Homo sapiens
uucguagguugacuaucuuu

SEQ ID NO: 704274 - RNA, 13 nt, Homo sapiens
uucuaccugcccu

SEQ ID NO: 704275 - RNA, 21 nt, Homo sapiens
uucuacucaggcugguggaga

SEQ ID NO: 704276 - RNA, 15 nt, Homo sapiens
uucuauuauggaaaa

SEQ ID NO: 704277 - RNA, 19 nt, Homo sapiens
uucuccaucccucuaauga

SEQ ID NO: 704278 - RNA, 21 nt, Homo sapiens
uucuccaucccucuaaugaga

SEQ ID NO: 704279 - RNA, 17 nt, Homo sapiens
uucucuugagcuggccu

SEQ ID NO: 704280 - RNA, 18 nt, Homo sapiens
uucugaucauguaugcau

SEQ ID NO: 704281 - RNA, 19 nt, Homo sapiens
uucugccaaugaccaaaca

SEQ ID NO: 704282 - RNA, 20 nt, Homo sapiens
uucuggggaaagacacugcc

SEQ ID NO: 704283 - RNA, 12 nt, Homo sapiens
uucuguauuuga

SEQ ID NO: 704284 - RNA, 18 nt, Homo sapiens
uucugugcccuccugacc

SEQ ID NO: 704285 - RNA, 16 nt, Homo sapiens
uucuguugaaguuuac

SEQ ID NO: 704286 - RNA, 21 nt, Homo sapiens
uucuuaaaauguuaacuggca

SEQ ID NO: 704287 - RNA, 18 nt, Homo sapiens
uucuuaacccuuuccaga

SEQ ID NO: 704288 - RNA, 15 nt, Homo sapiens
uucuuagacuuaucu

SEQ ID NO: 704289 - RNA, 18 nt, Homo sapiens
uucuucagauauacugga

SEQ ID NO: 704290 - RNA, 19 nt, Homo sapiens
uucuugcaagcaugcuugu

SEQ ID NO: 704291 - RNA, 20 nt, Homo sapiens
uucuuguccucauucuugcc

SEQ ID NO: 704292 - RNA, 13 nt, Homo sapiens
uugaagccaucua

SEQ ID NO: 704293 - RNA, 18 nt, Homo sapiens
uugacacugaaaguuuug

SEQ ID NO: 704294 - RNA, 16 nt, Homo sapiens
uugacgcaccuguggu

SEQ ID NO: 704295 - RNA, 19 nt, Homo sapiens
uugacuuuuauaaagcaug

SEQ ID NO: 704296 - RNA, 19 nt, Homo sapiens
uugaguagaguugaucaaa

SEQ ID NO: 704297 - RNA, 14 nt, Homo sapiens
uugauuauuugcau

SEQ ID NO: 704298 - RNA, 15 nt, Homo sapiens
uugauucagucacau

SEQ ID NO: 704299 - RNA, 20 nt, Homo sapiens
uugcaagaugugaauuauug

SEQ ID NO: 704300 - RNA, 12 nt, Homo sapiens
uugcaugcaugc

SEQ ID NO: 704301 - RNA, 18 nt, Homo sapiens
uugcauggaaaucagcca

SEQ ID NO: 704302 - RNA, 21 nt, Homo sapiens
uugcauuuugauaaaauuaau

SEQ ID NO: 704303 - RNA, 21 nt, Homo sapiens
uugccaauuuuccuacucuca

SEQ ID NO: 704304 - RNA, 22 nt, Homo sapiens
uugccagcgauuuuaguucaau

SEQ ID NO: 704305 - RNA, 23 nt, Homo sapiens
uugccccuaggaaggugaaucug

SEQ ID NO: 704306 - RNA, 13 nt, Homo sapiens
uugccguaccaau

SEQ ID NO: 704307 - RNA, 17 nt, Homo sapiens
uugccuauaagccaaaa

SEQ ID NO: 704308 - RNA, 19 nt, Homo sapiens
uugccugcagggccauggc

SEQ ID NO: 704309 - RNA, 21 nt, Homo sapiens
uugcugcucuucaucccauuc

SEQ ID NO: 704310 - RNA, 21 nt, Homo sapiens
uuggaacauacuguucacuca

SEQ ID NO: 704311 - RNA, 19 nt, Homo sapiens
uuggacuggauaagugcua

SEQ ID NO: 704312 - RNA, 19 nt, Homo sapiens
uuggacuguaagggauuga

SEQ ID NO: 704313 - RNA, 22 nt, Homo sapiens
uuggcucugcuuuuaacuuuau

SEQ ID NO: 704314 - RNA, 18 nt, Homo sapiens
uuggcuuaaauaaucucu

SEQ ID NO: 704315 - RNA, 14 nt, Homo sapiens
aaaaugaaaggaag

SEQ ID NO: 704316 - RNA, 14 nt, Homo sapiens
aaaaugaauaucua

SEQ ID NO: 704317 - RNA, 19 nt, Homo sapiens
aaaaugauuggccccaguc

SEQ ID NO: 704318 - RNA, 16 nt, Homo sapiens
aaaauguaauuacuua

SEQ ID NO: 704319 - RNA, 18 nt, Homo sapiens
aaaauucauuucuaauua

SEQ ID NO: 704320 - RNA, 17 nt, Homo sapiens
aaaauuuuuaaauauuc

SEQ ID NO: 704321 - RNA, 20 nt, Homo sapiens
aaacacauguuuuuauacaa

SEQ ID NO: 704322 - RNA, 14 nt, Homo sapiens
aaacauagcaucuc

SEQ ID NO: 704323 - RNA, 16 nt, Homo sapiens
aaacauccuugcaaau

SEQ ID NO: 704324 - RNA, 21 nt, Homo sapiens
aaacaucuaauaaguauauaa

SEQ ID NO: 704325 - RNA, 17 nt, Homo sapiens
aaacaugcggugccaug

SEQ ID NO: 704326 - RNA, 23 nt, Homo sapiens
aaaccacgccucuugaccaggcu

SEQ ID NO: 704327 - RNA, 17 nt, Homo sapiens
aaacccaauucagucuc

SEQ ID NO: 704328 - RNA, 15 nt, Homo sapiens
aaaccccaaacuguu

SEQ ID NO: 704329 - RNA, 13 nt, Homo sapiens
aaaccccaucucu

SEQ ID NO: 704330 - RNA, 14 nt, Homo sapiens
aaacccccagugua

SEQ ID NO: 704331 - RNA, 18 nt, Homo sapiens
aaaccuacccucagugag

SEQ ID NO: 704332 - RNA, 13 nt, Homo sapiens
aaaccuuccccag

SEQ ID NO: 704333 - RNA, 17 nt, Homo sapiens
aaacggaggccagagag

SEQ ID NO: 704334 - RNA, 16 nt, Homo sapiens
aaacgggaacaugccc

SEQ ID NO: 704335 - RNA, 13 nt, Homo sapiens
aaacuacuucuuu

SEQ ID NO: 704336 - RNA, 21 nt, Homo sapiens
aaacucaucuggaguucucaa

SEQ ID NO: 704337 - RNA, 18 nt, Homo sapiens
aaacucuacuuaauccaa

SEQ ID NO: 704338 - RNA, 23 nt, Homo sapiens
aaacuuggcucgaaucucugugc

SEQ ID NO: 704339 - RNA, 20 nt, Homo sapiens
aaacuuuucuaauacucuac

SEQ ID NO: 704340 - RNA, 18 nt, Homo sapiens
aaagaaaaagaccuauga

SEQ ID NO: 704341 - RNA, 19 nt, Homo sapiens
aaagaaauauuaagcaugu

SEQ ID NO: 704342 - RNA, 23 nt, Homo sapiens
aaagaauuuuuuaagaacuguau

SEQ ID NO: 704343 - RNA, 20 nt, Homo sapiens
aaagaggcugccccucucac

SEQ ID NO: 704344 - RNA, 17 nt, Homo sapiens
aaagauucaugauuuau

SEQ ID NO: 704345 - RNA, 23 nt, Homo sapiens
aaagcaauauuuuggaguauguu

SEQ ID NO: 704346 - RNA, 22 nt, Homo sapiens
aaagcacuccugcuuaaucuuc

SEQ ID NO: 704347 - RNA, 20 nt, Homo sapiens
aaagcagaugagcuguggac

SEQ ID NO: 704348 - RNA, 13 nt, Homo sapiens
aaagcaguauuug

SEQ ID NO: 704349 - RNA, 12 nt, Homo sapiens
aaagcaugauau

SEQ ID NO: 704350 - RNA, 23 nt, Homo sapiens
aaagcuaaggaccuuaagacaga

SEQ ID NO: 704351 - RNA, 15 nt, Homo sapiens
aaagcugcccacugu

SEQ ID NO: 704352 - RNA, 24 nt, Homo sapiens
aaagcuguuccuugguccuaguaa

SEQ ID NO: 704353 - RNA, 23 nt, Homo sapiens
aaagguaaaacaugcuggugaac

SEQ ID NO: 704354 - RNA, 22 nt, Homo sapiens
aaaggugucuucuuugacuuaa

SEQ ID NO: 704355 - RNA, 17 nt, Homo sapiens
aaaguaaauacaugcau

SEQ ID NO: 704356 - RNA, 16 nt, Homo sapiens
aaaguaaugcuucaau

SEQ ID NO: 704357 - RNA, 15 nt, Homo sapiens
aaaguagaacuuugu

SEQ ID NO: 704358 - RNA, 18 nt, Homo sapiens
uguaagaaggcaauauua

SEQ ID NO: 704359 - RNA, 15 nt, Homo sapiens
uguaauaagcaauca

SEQ ID NO: 704360 - RNA, 14 nt, Homo sapiens
uguaauaugcacaa

SEQ ID NO: 704361 - RNA, 20 nt, Homo sapiens
uguacgacacggguggggaa

SEQ ID NO: 704362 - RNA, 21 nt, Homo sapiens
uguagaagacaaaauguucac

SEQ ID NO: 704363 - RNA, 14 nt, Homo sapiens
uguagaagcaugaa

SEQ ID NO: 704364 - RNA, 22 nt, Homo sapiens
uguagacuguggcuagugacaa

SEQ ID NO: 704365 - RNA, 11 nt, Homo sapiens
uguagauuuga

SEQ ID NO: 704366 - RNA, 16 nt, Homo sapiens
uguaggcacaagacca

SEQ ID NO: 704367 - RNA, 23 nt, Homo sapiens
uguauaaauuauucaguaacugu

SEQ ID NO: 704368 - RNA, 16 nt, Homo sapiens
uguaugccaagugaga

SEQ ID NO: 704369 - RNA, 20 nt, Homo sapiens
uguaugugggaguacucuca

SEQ ID NO: 704370 - RNA, 16 nt, Homo sapiens
uguauuuuaagugaau

SEQ ID NO: 704371 - RNA, 13 nt, Homo sapiens
ugucaaagugaua

SEQ ID NO: 704372 - RNA, 17 nt, Homo sapiens
ugucaaugggaccugug

SEQ ID NO: 704373 - RNA, 13 nt, Homo sapiens
ugucauaguucug

SEQ ID NO: 704374 - RNA, 21 nt, Homo sapiens
ugucaucaucacccuuucauu

SEQ ID NO: 704375 - RNA, 13 nt, Homo sapiens
uguccagcaccuu

SEQ ID NO: 704376 - RNA, 17 nt, Homo sapiens
ugucccauagucccugc

SEQ ID NO: 704377 - RNA, 23 nt, Homo sapiens
ugucccugcccaggccucuggcu

SEQ ID NO: 704378 - RNA, 17 nt, Homo sapiens
ugucccuugcuugccug

SEQ ID NO: 704379 - RNA, 19 nt, Homo sapiens
uguccggucccugucccag

SEQ ID NO: 704380 - RNA, 17 nt, Homo sapiens
ugucuaaacaaugcuga

SEQ ID NO: 704381 - RNA, 19 nt, Homo sapiens
ugucuccaucucugucuca

SEQ ID NO: 704382 - RNA, 21 nt, Homo sapiens
ugucugcgucgucaccaaauc

SEQ ID NO: 704383 - RNA, 21 nt, Homo sapiens
ugucuguaauaauagacugua

SEQ ID NO: 704384 - RNA, 16 nt, Homo sapiens
ugucuuuggugcuuuu

SEQ ID NO: 704385 - RNA, 22 nt, Homo sapiens
ugugaaucucuucucccuuuga

SEQ ID NO: 704386 - RNA, 13 nt, Homo sapiens
ugugauaaaaccc

SEQ ID NO: 704387 - RNA, 14 nt, Homo sapiens
ugugauauaugcau

SEQ ID NO: 704388 - RNA, 18 nt, Homo sapiens
ugugauuaaagcuaagga

SEQ ID NO: 704389 - RNA, 10 nt, Homo sapiens
ugugcacauc

SEQ ID NO: 704390 - RNA, 20 nt, Homo sapiens
ugugccucccuccccagugc

SEQ ID NO: 704391 - RNA, 17 nt, Homo sapiens
ugugccugaagucccag

SEQ ID NO: 704392 - RNA, 23 nt, Homo sapiens
ugugccugggguguuaguggcac

SEQ ID NO: 704393 - RNA, 14 nt, Homo sapiens
ugugggcuugacca

SEQ ID NO: 704394 - RNA, 14 nt, Homo sapiens
ugugguuccucugc

SEQ ID NO: 704395 - RNA, 21 nt, Homo sapiens
uguguaaaaaaaccaccaaaa

SEQ ID NO: 704396 - RNA, 13 nt, Homo sapiens
uguguaauaugca

SEQ ID NO: 704397 - RNA, 15 nt, Homo sapiens
uguguaccuaaggga

SEQ ID NO: 704398 - RNA, 16 nt, Homo sapiens
uguguaccuaagggag

SEQ ID NO: 704399 - RNA, 19 nt, Homo sapiens
ugugucccaggcagggaga

SEQ ID NO: 704400 - RNA, 12 nt, Homo sapiens
ugugugugauau

SEQ ID NO: 704401 - RNA, 16 nt, Homo sapiens
ugugugugugcacauc

SEQ ID NO: 704402 - RNA, 13 nt, Homo sapiens
uguguugccacag

SEQ ID NO: 704403 - RNA, 22 nt, Homo sapiens
uguguuuuaaaauaaggauuuu

SEQ ID NO: 704404 - RNA, 22 nt, Homo sapiens
uguuccaugaaggcagagccau

SEQ ID NO: 704405 - RNA, 22 nt, Homo sapiens
uguucccacaccccaacacuuc

SEQ ID NO: 704406 - RNA, 24 nt, Homo sapiens
uguugauaaauccaucacuauaau

SEQ ID NO: 704407 - RNA, 19 nt, Homo sapiens
uguuuccaauuauccuuuu

SEQ ID NO: 704408 - RNA, 23 nt, Homo sapiens
uguuugccaggacaugcaauaaa

SEQ ID NO: 704409 - RNA, 14 nt, Homo sapiens
uguuuuuaaacuaa

SEQ ID NO: 704410 - RNA, 20 nt, Homo sapiens
uguuuuuccuuuaauccagu

SEQ ID NO: 704411 - RNA, 12 nt, Homo sapiens
uuaaaacaucau

SEQ ID NO: 704412 - RNA, 13 nt, Homo sapiens
uuaaaaccaaaga

SEQ ID NO: 704413 - RNA, 14 nt, Homo sapiens
uuaaaaccaaagag

SEQ ID NO: 704414 - RNA, 13 nt, Homo sapiens
uuaaaauaaugaa

SEQ ID NO: 704415 - RNA, 21 nt, Homo sapiens
uuaaaauaaugaauacauuuc

SEQ ID NO: 704416 - RNA, 15 nt, Homo sapiens
uuaaagaauaugacu

SEQ ID NO: 704417 - RNA, 18 nt, Homo sapiens
uuaaagcuaaggaccuua

SEQ ID NO: 704418 - RNA, 21 nt, Homo sapiens
uuaaaugguguuuuauuacaa

SEQ ID NO: 704419 - RNA, 19 nt, Homo sapiens
uuaacaguuguauuuaaca

SEQ ID NO: 704420 - RNA, 18 nt, Homo sapiens
uuaaccugcauaaaaagg

SEQ ID NO: 704421 - RNA, 19 nt, Homo sapiens
uuaacuguuguagaagaca

SEQ ID NO: 704422 - RNA, 14 nt, Homo sapiens
uuaagagacacucc

SEQ ID NO: 704423 - RNA, 21 nt, Homo sapiens
uuaagcuuccgccgucucaac

SEQ ID NO: 704424 - RNA, 20 nt, Homo sapiens
uuaagugacuauagaaugca

SEQ ID NO: 704425 - RNA, 18 nt, Homo sapiens
uuaauagggaauauaucu

SEQ ID NO: 704426 - RNA, 17 nt, Homo sapiens
uuaaugcacuuucuauc

SEQ ID NO: 704427 - RNA, 16 nt, Homo sapiens
uuaauucacucccaca

SEQ ID NO: 704428 - RNA, 19 nt, Homo sapiens
uuaauuuccuuuuugacac

SEQ ID NO: 704429 - RNA, 21 nt, Homo sapiens
uuacaagauguauuuguugua

SEQ ID NO: 704430 - RNA, 18 nt, Homo sapiens
uuacaaguuuauauauau

SEQ ID NO: 704431 - RNA, 15 nt, Homo sapiens
uuacagaacuacuuc

SEQ ID NO: 704432 - RNA, 14 nt, Homo sapiens
uuacagacugugag

SEQ ID NO: 704433 - RNA, 18 nt, Homo sapiens
uuacaguccaaaauacug

SEQ ID NO: 704434 - RNA, 20 nt, Homo sapiens
uuacauuuauuuauccagaa

SEQ ID NO: 704435 - RNA, 22 nt, Homo sapiens
uuaccugauuugaugauacauu

SEQ ID NO: 704436 - RNA, 15 nt, Homo sapiens
uuaccuuuucagggc

SEQ ID NO: 704437 - RNA, 16 nt, Homo sapiens
uuacuucccuaaugaa

SEQ ID NO: 704438 - RNA, 19 nt, Homo sapiens
uuagaaacucaaaaacuga

SEQ ID NO: 704439 - RNA, 18 nt, Homo sapiens
uuagaauaagaauuugca

SEQ ID NO: 704440 - RNA, 17 nt, Homo sapiens
uuagaguaaugaaaugg

SEQ ID NO: 704441 - RNA, 19 nt, Homo sapiens
uuagaguaaugaaauggag

SEQ ID NO: 704442 - RNA, 14 nt, Homo sapiens
uuagauuaguauuu

SEQ ID NO: 704443 - RNA, 21 nt, Homo sapiens
uuagcauuuuucaaaugaucu

SEQ ID NO: 704444 - RNA, 15 nt, Homo sapiens
uuagcccaaaaccaa

SEQ ID NO: 704445 - RNA, 19 nt, Homo sapiens
uuagucuuaauguacacau

SEQ ID NO: 704446 - RNA, 19 nt, Homo sapiens
uuagugguuacccaguuag

SEQ ID NO: 704447 - RNA, 14 nt, Homo sapiens
uuaguucucaggca

SEQ ID NO: 704448 - RNA, 18 nt, Homo sapiens
uuaguugaggccuucuag

SEQ ID NO: 704449 - RNA, 15 nt, Homo sapiens
uuauaaaaagaauga

SEQ ID NO: 704450 - RNA, 16 nt, Homo sapiens
uuauaaauccagugac

SEQ ID NO: 704451 - RNA, 18 nt, Homo sapiens
uuauaauaaauauauaca

SEQ ID NO: 704452 - RNA, 19 nt, Homo sapiens
uuauacaaaauaagaacga

SEQ ID NO: 704453 - RNA, 15 nt, Homo sapiens
uuauacagcaaagga

SEQ ID NO: 704454 - RNA, 14 nt, Homo sapiens
uuauacaugugaua

SEQ ID NO: 704455 - RNA, 14 nt, Homo sapiens
uuauacuacuuugu

SEQ ID NO: 704456 - RNA, 18 nt, Homo sapiens
uuauagcaacaacaauug

SEQ ID NO: 704457 - RNA, 22 nt, Homo sapiens
uuauagcaacaacaauugguaa

SEQ ID NO: 704458 - RNA, 24 nt, Homo sapiens
uuauagucaauggcuuguucauca

SEQ ID NO: 704459 - RNA, 13 nt, Homo sapiens
uuaucucaggggu

SEQ ID NO: 704460 - RNA, 17 nt, Homo sapiens
uuaucuguuuccugaca

SEQ ID NO: 704461 - RNA, 23 nt, Homo sapiens
uuaugagaggcaaugauuguuaa

SEQ ID NO: 704462 - RNA, 23 nt, Homo sapiens
uuauggugccgaauugucuuugg

SEQ ID NO: 704463 - RNA, 12 nt, Homo sapiens
uuaugguuuugg

SEQ ID NO: 704464 - RNA, 13 nt, Homo sapiens
uuauuacauguaa

SEQ ID NO: 704465 - RNA, 22 nt, Homo sapiens
uuauuacuguuuauuacuucca

SEQ ID NO: 704466 - RNA, 17 nt, Homo sapiens
uuauuguuguacauacg

SEQ ID NO: 704467 - RNA, 13 nt, Homo sapiens
uuauuuccacuua

SEQ ID NO: 704468 - RNA, 21 nt, Homo sapiens
uuauuuccacuuauaaaggaa

SEQ ID NO: 704469 - RNA, 16 nt, Homo sapiens
uucaaaauccaaaaag

SEQ ID NO: 704470 - RNA, 20 nt, Homo sapiens
uucaaaguuuuguuguacuu

SEQ ID NO: 704471 - RNA, 23 nt, Homo sapiens
uucaagcagucgugccugugucc

SEQ ID NO: 704472 - RNA, 23 nt, Homo sapiens
uucacuuuuggcaaugacucaaa

SEQ ID NO: 704473 - RNA, 18 nt, Homo sapiens
uucagaagccuaauucca

SEQ ID NO: 704474 - RNA, 19 nt, Homo sapiens
uucagaagccuaauuccag

SEQ ID NO: 704475 - RNA, 12 nt, Homo sapiens
uucagaagugcc

SEQ ID NO: 704476 - RNA, 14 nt, Homo sapiens
gauguuuccagacu

SEQ ID NO: 704477 - RNA, 18 nt, Homo sapiens
gauguuuccagacuuccu

SEQ ID NO: 704478 - RNA, 17 nt, Homo sapiens
gauuacaggcauguguc

SEQ ID NO: 704479 - RNA, 13 nt, Homo sapiens
gauucagucacau

SEQ ID NO: 704480 - RNA, 16 nt, Homo sapiens
gauuccucucuaagug

SEQ ID NO: 704481 - RNA, 22 nt, Homo sapiens
gauuccuuuuuucaaaauccaa

SEQ ID NO: 704482 - RNA, 20 nt, Homo sapiens
gauugcauaggaauugcaca

SEQ ID NO: 704483 - RNA, 20 nt, Homo sapiens
gauugugccacuucacucca

SEQ ID NO: 704484 - RNA, 13 nt, Homo sapiens
gauuuaaaugcca

SEQ ID NO: 704485 - RNA, 16 nt, Homo sapiens
gauuuaauccaguuau

SEQ ID NO: 704486 - RNA, 11 nt, Homo sapiens
gauuugcaaua

SEQ ID NO: 704487 - RNA, 12 nt, Homo sapiens
gauuuguugcca

SEQ ID NO: 704488 - RNA, 16 nt, Homo sapiens
gcaaaaggccucuugu

SEQ ID NO: 704489 - RNA, 13 nt, Homo sapiens
gcaaacaggcagu

SEQ ID NO: 704490 - RNA, 21 nt, Homo sapiens
gcaaagggccugcccagacaa

SEQ ID NO: 704491 - RNA, 13 nt, Homo sapiens
gcaaauguuaaaa

SEQ ID NO: 704492 - RNA, 19 nt, Homo sapiens
gcaaauuuucagcauuaag

SEQ ID NO: 704493 - RNA, 21 nt, Homo sapiens
gcaacaagaccaccacuucga

SEQ ID NO: 704494 - RNA, 16 nt, Homo sapiens
gcaacauuguccuuaa

SEQ ID NO: 704495 - RNA, 20 nt, Homo sapiens
gcaacugucucucuucucag

SEQ ID NO: 704496 - RNA, 13 nt, Homo sapiens
gcaaggagaaaaa

SEQ ID NO: 704497 - RNA, 18 nt, Homo sapiens
gcaaggccugguguuucu

SEQ ID NO: 704498 - RNA, 23 nt, Homo sapiens
gcaaguaaaaaggcuaaauggaa

SEQ ID NO: 704499 - RNA, 16 nt, Homo sapiens
gcaaguuuccaucauc

SEQ ID NO: 704500 - RNA, 18 nt, Homo sapiens
gcaaguuuccaucaucua

SEQ ID NO: 704501 - RNA, 22 nt, Homo sapiens
gcacaauuucccuucauacucc

SEQ ID NO: 704502 - RNA, 15 nt, Homo sapiens
gcacagcuaauucua

SEQ ID NO: 704503 - RNA, 17 nt, Homo sapiens
gcacagggucucuacca

SEQ ID NO: 704504 - RNA, 16 nt, Homo sapiens
gcacagucugaugaca

SEQ ID NO: 704505 - RNA, 16 nt, Homo sapiens
gcacccagaggaggag

SEQ ID NO: 704506 - RNA, 15 nt, Homo sapiens
gcacuuauugaauau

SEQ ID NO: 704507 - RNA, 21 nt, Homo sapiens
gcacuucauguaaagugucag

SEQ ID NO: 704508 - RNA, 11 nt, Homo sapiens
gcacuugccug

SEQ ID NO: 704509 - RNA, 23 nt, Homo sapiens
gcagaauugagagugauuccuuu

SEQ ID NO: 704510 - RNA, 17 nt, Homo sapiens
gcagacaauaaacccuc

SEQ ID NO: 704511 - RNA, 19 nt, Homo sapiens
gcagacaauaaacccucag

SEQ ID NO: 704512 - RNA, 19 nt, Homo sapiens
gcagaugccacccuagcca

SEQ ID NO: 704513 - RNA, 21 nt, Homo sapiens
gcagcccaaucugccagacuu

SEQ ID NO: 704514 - RNA, 13 nt, Homo sapiens
gcagcccagagac

SEQ ID NO: 704515 - RNA, 18 nt, Homo sapiens
gcagccuggggucugaca

SEQ ID NO: 704516 - RNA, 24 nt, Homo sapiens
gcaggauuucuucacaccucuccu

SEQ ID NO: 704517 - RNA, 14 nt, Homo sapiens
gcaggcugggccau

SEQ ID NO: 704518 - RNA, 23 nt, Homo sapiens
gcagguuggugggggccucggug

SEQ ID NO: 704519 - RNA, 16 nt, Homo sapiens
gcagugagcugagauc

SEQ ID NO: 704520 - RNA, 17 nt, Homo sapiens
gcaguuguaccaaguga

SEQ ID NO: 704521 - RNA, 19 nt, Homo sapiens
gcaguuguaccaagugaaa

SEQ ID NO: 704522 - RNA, 23 nt, Homo sapiens
gcaguuucaucaaagaacaaaca

SEQ ID NO: 704523 - RNA, 15 nt, Homo sapiens
gcauaggaauugcac

SEQ ID NO: 704524 - RNA, 21 nt, Homo sapiens
gcaucaaaauauuucagugaa

SEQ ID NO: 704525 - RNA, 19 nt, Homo sapiens
gcaucccugagacagggag

SEQ ID NO: 704526 - RNA, 20 nt, Homo sapiens
gcaucucacagcuaugcaaa

SEQ ID NO: 704527 - RNA, 15 nt, Homo sapiens
gcaucuggaagauca

SEQ ID NO: 704528 - RNA, 22 nt, Homo sapiens
gcaugguuuugugccaucugua

SEQ ID NO: 704529 - RNA, 21 nt, Homo sapiens
gcaugucagacagaacuugaa

SEQ ID NO: 704530 - RNA, 19 nt, Homo sapiens
gcauucauuuuuauagcaa

SEQ ID NO: 704531 - RNA, 23 nt, Homo sapiens
gcauuuuuuuuuuaugauuuguc

SEQ ID NO: 704532 - RNA, 19 nt, Homo sapiens
gccaagaauauugcaaaau

SEQ ID NO: 704533 - RNA, 20 nt, Homo sapiens
gccaagggaaaggggugcuu

SEQ ID NO: 704534 - RNA, 19 nt, Homo sapiens
gccaagggaaccugugucc

SEQ ID NO: 704535 - RNA, 18 nt, Homo sapiens
gccaaguaagaaagugaa

SEQ ID NO: 704536 - RNA, 20 nt, Homo sapiens
gccaaguuuuauaauccuua

SEQ ID NO: 704537 - RNA, 14 nt, Homo sapiens
gccacacucuccau

SEQ ID NO: 704538 - RNA, 17 nt, Homo sapiens
gccagcuuaucucaggg

SEQ ID NO: 704539 - RNA, 19 nt, Homo sapiens
gccagcuuaucucaggggu

SEQ ID NO: 704540 - RNA, 15 nt, Homo sapiens
gccaggagcaggcac

SEQ ID NO: 704541 - RNA, 18 nt, Homo sapiens
gccaguuacuugcuuuac

SEQ ID NO: 704542 - RNA, 14 nt, Homo sapiens
gccauguccaaaga

SEQ ID NO: 704543 - RNA, 22 nt, Homo sapiens
gccauguggaaggcaagccagg

SEQ ID NO: 704544 - RNA, 17 nt, Homo sapiens
gcccaaagaaagagcua

SEQ ID NO: 704545 - RNA, 15 nt, Homo sapiens
gcccagaauacugau

SEQ ID NO: 704546 - RNA, 16 nt, Homo sapiens
gcccagacaagauuuu

SEQ ID NO: 704547 - RNA, 11 nt, Homo sapiens
gcccagugcau

SEQ ID NO: 704548 - RNA, 15 nt, Homo sapiens
gcccaucgugaagaa

SEQ ID NO: 704549 - RNA, 23 nt, Homo sapiens
gccccagcucgcgggacccgacc

SEQ ID NO: 704550 - RNA, 13 nt, Homo sapiens
gccccgacuccag

SEQ ID NO: 704551 - RNA, 17 nt, Homo sapiens
gccccgcgaccaugugg

SEQ ID NO: 704552 - RNA, 22 nt, Homo sapiens
gccccucuuccccaaugcucca

SEQ ID NO: 704553 - RNA, 18 nt, Homo sapiens
gccccuggucaagugcug

SEQ ID NO: 704554 - RNA, 18 nt, Homo sapiens
gcccuggcagggggcaug

SEQ ID NO: 704555 - RNA, 24 nt, Homo sapiens
gccgcgcccuuuccccgacgccca

SEQ ID NO: 704556 - RNA, 21 nt, Homo sapiens
gccggaaaaggcgcaucuaac

SEQ ID NO: 704557 - RNA, 22 nt, Homo sapiens
gccgggacccagggcccucggu

SEQ ID NO: 704558 - RNA, 21 nt, Homo sapiens
gccguacucuuuggggcagcu

SEQ ID NO: 704559 - RNA, 22 nt, Homo sapiens
gccguggggccgccgccucuuu

SEQ ID NO: 704560 - RNA, 22 nt, Homo sapiens
gccuagcgaucucuccuggccu

SEQ ID NO: 704561 - RNA, 15 nt, Homo sapiens
gccuaucugaccaaa

SEQ ID NO: 704562 - RNA, 17 nt, Homo sapiens
gccucaagaggaaugaa

SEQ ID NO: 704563 - RNA, 13 nt, Homo sapiens
gccucacuggggc

SEQ ID NO: 704564 - RNA, 21 nt, Homo sapiens
gccucacuggggcagacaaua

SEQ ID NO: 704565 - RNA, 19 nt, Homo sapiens
gccuccccgugccaaaaau

SEQ ID NO: 704566 - RNA, 17 nt, Homo sapiens
gccucucuuuuugggcu

SEQ ID NO: 704567 - RNA, 17 nt, Homo sapiens
gccucugccuuugcacc

SEQ ID NO: 704568 - RNA, 10 nt, Homo sapiens
gccucugugc

SEQ ID NO: 704569 - RNA, 21 nt, Homo sapiens
gccugcacagugaagugcugg

SEQ ID NO: 704570 - RNA, 15 nt, Homo sapiens
gccuguaacacuccu

SEQ ID NO: 704571 - RNA, 19 nt, Homo sapiens
gccuguaaucccagcacuu

SEQ ID NO: 704572 - RNA, 19 nt, Homo sapiens
gccuguaaucccagcuacu

SEQ ID NO: 704573 - RNA, 19 nt, Homo sapiens
gccuguagucccagcuacu

SEQ ID NO: 704574 - RNA, 18 nt, Homo sapiens
gccuucuaguuaccacau

SEQ ID NO: 704575 - RNA, 22 nt, Homo sapiens
gccuuuuuauuuauauguacug

SEQ ID NO: 704576 - RNA, 15 nt, Homo sapiens
gcgccacugcacucc

SEQ ID NO: 704577 - RNA, 18 nt, Homo sapiens
gcgccagccucagacugg

SEQ ID NO: 704578 - RNA, 15 nt, Homo sapiens
gcgcguccagcugcc

SEQ ID NO: 704579 - RNA, 14 nt, Homo sapiens
gcgcucagggccau

SEQ ID NO: 704580 - RNA, 12 nt, Homo sapiens
gcggccacugcg

SEQ ID NO: 704581 - RNA, 23 nt, Homo sapiens
gcggcccugaccaaugugugaag

SEQ ID NO: 704582 - RNA, 14 nt, Homo sapiens
gcguggcacucgcu

SEQ ID NO: 704583 - RNA, 20 nt, Homo sapiens
gcuaaggaccuuaagacaga

SEQ ID NO: 704584 - RNA, 13 nt, Homo sapiens
gcuacuugggagg

SEQ ID NO: 704585 - RNA, 20 nt, Homo sapiens
gcuagggagacgccauguga

SEQ ID NO: 704586 - RNA, 14 nt, Homo sapiens
gcuauaaagcagua

SEQ ID NO: 704587 - RNA, 22 nt, Homo sapiens
gcucaguaaacgggaacaugcc

SEQ ID NO: 704588 - RNA, 15 nt, Homo sapiens
gcucaguaacugugc

SEQ ID NO: 704589 - RNA, 17 nt, Homo sapiens
gcuccagugcaggagac

SEQ ID NO: 704590 - RNA, 17 nt, Homo sapiens
gcucccacuucugccag

SEQ ID NO: 704591 - RNA, 23 nt, Homo sapiens
gcuccccugaggaauaugucaua

SEQ ID NO: 704592 - RNA, 22 nt, Homo sapiens
gcucccucuauuuauguuugca

SEQ ID NO: 704593 - RNA, 19 nt, Homo sapiens
gcucgcauuugucaaugac

SEQ ID NO: 704594 - RNA, 17 nt, Homo sapiens
cuaugagcacauaggac

SEQ ID NO: 704595 - RNA, 21 nt, Homo sapiens
cucaaaagcugggcagguugg

SEQ ID NO: 704596 - RNA, 20 nt, Homo sapiens
cucaaauucauggugcacug

SEQ ID NO: 704597 - RNA, 15 nt, Homo sapiens
cucaacuguuuucau

SEQ ID NO: 704598 - RNA, 15 nt, Homo sapiens
cucaccagccccacu

SEQ ID NO: 704599 - RNA, 19 nt, Homo sapiens
cucaccagccccacugcca

SEQ ID NO: 704600 - RNA, 12 nt, Homo sapiens
cucacccaugca

SEQ ID NO: 704601 - RNA, 20 nt, Homo sapiens
cucagcucggggagccuuag

SEQ ID NO: 704602 - RNA, 23 nt, Homo sapiens
cucaggcaaagaaaaugaaaugc

SEQ ID NO: 704603 - RNA, 10 nt, Homo sapiens
cucagugcag

SEQ ID NO: 704604 - RNA, 23 nt, Homo sapiens
cucaucugaaauguuacaaaaau

SEQ ID NO: 704605 - RNA, 15 nt, Homo sapiens
cucauuuaagggaaa

SEQ ID NO: 704606 - RNA, 14 nt, Homo sapiens
cucauuucaucuca

SEQ ID NO: 704607 - RNA, 15 nt, Homo sapiens
cucauuucaucucau

SEQ ID NO: 704608 - RNA, 23 nt, Homo sapiens
cuccagggaauccaagccuccac

SEQ ID NO: 704609 - RNA, 15 nt, Homo sapiens
cuccauaaacaugaa

SEQ ID NO: 704610 - RNA, 14 nt, Homo sapiens
cuccaucucugucu

SEQ ID NO: 704611 - RNA, 15 nt, Homo sapiens
cuccauuugagaaaa

SEQ ID NO: 704612 - RNA, 22 nt, Homo sapiens
cuccauuugcucuucagaugcc

SEQ ID NO: 704613 - RNA, 19 nt, Homo sapiens
cucccaaaaaacuacuucu

SEQ ID NO: 704614 - RNA, 20 nt, Homo sapiens
cucccaaagugcugggauua

SEQ ID NO: 704615 - RNA, 15 nt, Homo sapiens
cucccacauugucac

SEQ ID NO: 704616 - RNA, 22 nt, Homo sapiens
cucccacauugucaccauuuca

SEQ ID NO: 704617 - RNA, 17 nt, Homo sapiens
cucccaggaagcccagg

SEQ ID NO: 704618 - RNA, 16 nt, Homo sapiens
cucccaggccaggcuc

SEQ ID NO: 704619 - RNA, 21 nt, Homo sapiens
cucccauccuugaugcaagug

SEQ ID NO: 704620 - RNA, 13 nt, Homo sapiens
cuccccaccucca

SEQ ID NO: 704621 - RNA, 14 nt, Homo sapiens
cucccccaguuccu

SEQ ID NO: 704622 - RNA, 22 nt, Homo sapiens
cucccccaguuccucccaggaa

SEQ ID NO: 704623 - RNA, 20 nt, Homo sapiens
cuccgagaggugggccaguc

SEQ ID NO: 704624 - RNA, 20 nt, Homo sapiens
cuccuacauaucccuuccag

SEQ ID NO: 704625 - RNA, 14 nt, Homo sapiens
cuccugauccacuu

SEQ ID NO: 704626 - RNA, 16 nt, Homo sapiens
cuccuggcccacugca

SEQ ID NO: 704627 - RNA, 17 nt, Homo sapiens
cucgaaucucugugccu

SEQ ID NO: 704628 - RNA, 12 nt, Homo sapiens
cucgagucugag

SEQ ID NO: 704629 - RNA, 14 nt, Homo sapiens
cucgagucugaggc

SEQ ID NO: 704630 - RNA, 17 nt, Homo sapiens
cucgccggaucugaggg

SEQ ID NO: 704631 - RNA, 13 nt, Homo sapiens
cucuaaagagcau

SEQ ID NO: 704632 - RNA, 18 nt, Homo sapiens
cucuaaugagacugacca

SEQ ID NO: 704633 - RNA, 12 nt, Homo sapiens
cucuacaaaaag

SEQ ID NO: 704634 - RNA, 14 nt, Homo sapiens
cucuacucuaggga

SEQ ID NO: 704635 - RNA, 21 nt, Homo sapiens
cucuacucuagggaaaaacca

SEQ ID NO: 704636 - RNA, 20 nt, Homo sapiens
cucuaugcuuuccaaaccuu

SEQ ID NO: 704637 - RNA, 15 nt, Homo sapiens
cucuauuugagaaua

SEQ ID NO: 704638 - RNA, 13 nt, Homo sapiens
cucuccucucuga

SEQ ID NO: 704639 - RNA, 21 nt, Homo sapiens
cucucuaagugggcauugcca

SEQ ID NO: 704640 - RNA, 11 nt, Homo sapiens
cucucuagcac

SEQ ID NO: 704641 - RNA, 12 nt, Homo sapiens
cucucuucucag

SEQ ID NO: 704642 - RNA, 16 nt, Homo sapiens
cucugaacuugccuua

SEQ ID NO: 704643 - RNA, 17 nt, Homo sapiens
cucugaacuugccuuaa

SEQ ID NO: 704644 - RNA, 22 nt, Homo sapiens
cucugaucuccauaaacaugaa

SEQ ID NO: 704645 - RNA, 17 nt, Homo sapiens
cucugcaguccuacuca

SEQ ID NO: 704646 - RNA, 14 nt, Homo sapiens
cucuggaguucauc

SEQ ID NO: 704647 - RNA, 18 nt, Homo sapiens
cucuggguccuuccugaa

SEQ ID NO: 704648 - RNA, 21 nt, Homo sapiens
cucuggucgccgcacuucuga

SEQ ID NO: 704649 - RNA, 15 nt, Homo sapiens
cucuguacuuuucau

SEQ ID NO: 704650 - RNA, 16 nt, Homo sapiens
cucuuagaaaaaccac

SEQ ID NO: 704651 - RNA, 13 nt, Homo sapiens
cucuuccugugau

SEQ ID NO: 704652 - RNA, 15 nt, Homo sapiens
cucuuccugugaucc

SEQ ID NO: 704653 - RNA, 23 nt, Homo sapiens
cucuucuccaccucccacaaagg

SEQ ID NO: 704654 - RNA, 14 nt, Homo sapiens
cucuugaccaggcu

SEQ ID NO: 704655 - RNA, 14 nt, Homo sapiens
cucuuguucccaca

SEQ ID NO: 704656 - RNA, 18 nt, Homo sapiens
cucuuguucccacacccc

SEQ ID NO: 704657 - RNA, 16 nt, Homo sapiens
cucuuuuuuucuuguc

SEQ ID NO: 704658 - RNA, 19 nt, Homo sapiens
cugaaaaccaauguucucu

SEQ ID NO: 704659 - RNA, 15 nt, Homo sapiens
cugaacuacuaaagu

SEQ ID NO: 704660 - RNA, 21 nt, Homo sapiens
cugacagaaggugccacuuua

SEQ ID NO: 704661 - RNA, 22 nt, Homo sapiens
cugaccauauugugcuucacag

SEQ ID NO: 704662 - RNA, 22 nt, Homo sapiens
cugagaggcaggcauagaggcu

SEQ ID NO: 704663 - RNA, 22 nt, Homo sapiens
cugagcccuacucccugcagau

SEQ ID NO: 704664 - RNA, 22 nt, Homo sapiens
cugaggcgcugcuuugucaaaa

SEQ ID NO: 704665 - RNA, 16 nt, Homo sapiens
cugagggcagacuggg

SEQ ID NO: 704666 - RNA, 20 nt, Homo sapiens
cugaggugggaggaucucuu

SEQ ID NO: 704667 - RNA, 18 nt, Homo sapiens
cugagugggggaucacag

SEQ ID NO: 704668 - RNA, 15 nt, Homo sapiens
cugaucauguaugca

SEQ ID NO: 704669 - RNA, 18 nt, Homo sapiens
cugauccuccaacagcug

SEQ ID NO: 704670 - RNA, 21 nt, Homo sapiens
cugauccuccaacagcuguca

SEQ ID NO: 704671 - RNA, 17 nt, Homo sapiens
cugaugacacauuuggc

SEQ ID NO: 704672 - RNA, 21 nt, Homo sapiens
cugauucuggcuuuaagccuu

SEQ ID NO: 704673 - RNA, 13 nt, Homo sapiens
cugauuugcaaua

SEQ ID NO: 704674 - RNA, 19 nt, Homo sapiens
cugcaaucugagccagugc

SEQ ID NO: 704675 - RNA, 16 nt, Homo sapiens
cugcacccacccagga

SEQ ID NO: 704676 - RNA, 17 nt, Homo sapiens
cugcacccacccaggag

SEQ ID NO: 704677 - RNA, 14 nt, Homo sapiens
cugcacuccagccu

SEQ ID NO: 704678 - RNA, 16 nt, Homo sapiens
cugcagagauuucuca

SEQ ID NO: 704679 - RNA, 17 nt, Homo sapiens
cugccacacucuccauc

SEQ ID NO: 704680 - RNA, 17 nt, Homo sapiens
cugccaucuagccagcc

SEQ ID NO: 704681 - RNA, 19 nt, Homo sapiens
cugccuuaaaaccaaagag

SEQ ID NO: 704682 - RNA, 14 nt, Homo sapiens
cugcuccagugcag

SEQ ID NO: 704683 - RNA, 16 nt, Homo sapiens
cugcuggcuaagcauu

SEQ ID NO: 704684 - RNA, 17 nt, Homo sapiens
cugcuggcuaagcauuu

SEQ ID NO: 704685 - RNA, 16 nt, Homo sapiens
cugcugucauaacauc

SEQ ID NO: 704686 - RNA, 21 nt, Homo sapiens
cugcuguggcgugagggugag

SEQ ID NO: 704687 - RNA, 14 nt, Homo sapiens
cugcuuuagacuug

SEQ ID NO: 704688 - RNA, 16 nt, Homo sapiens
cugcuuugucaaaagg

SEQ ID NO: 704689 - RNA, 22 nt, Homo sapiens
cuggaaucacauucuuagcaca

SEQ ID NO: 704690 - RNA, 17 nt, Homo sapiens
cuggaaucuggagacca

SEQ ID NO: 704691 - RNA, 21 nt, Homo sapiens
cuggagaccagggagccuuug

SEQ ID NO: 704692 - RNA, 20 nt, Homo sapiens
cuggagcccauccagucucc

SEQ ID NO: 704693 - RNA, 20 nt, Homo sapiens
cuggagucuccugaggacac

SEQ ID NO: 704694 - RNA, 19 nt, Homo sapiens
cuggagugcaguggcgcau

SEQ ID NO: 704695 - RNA, 15 nt, Homo sapiens
cuggaucuaccagca

SEQ ID NO: 704696 - RNA, 14 nt, Homo sapiens
cuggaugucuccau

SEQ ID NO: 704697 - RNA, 15 nt, Homo sapiens
cuggcaagaaugugu

SEQ ID NO: 704698 - RNA, 21 nt, Homo sapiens
cuggcacucuuguucccacac

SEQ ID NO: 704699 - RNA, 18 nt, Homo sapiens
cuggcgcaucauaugcag

SEQ ID NO: 704700 - RNA, 21 nt, Homo sapiens
cuggcuuacacuggcaauggu

SEQ ID NO: 704701 - RNA, 14 nt, Homo sapiens
cuggcuugcuccua

SEQ ID NO: 704702 - RNA, 17 nt, Homo sapiens
cugggcacgcacugggu

SEQ ID NO: 704703 - RNA, 17 nt, Homo sapiens
cugggcugaccccggug

SEQ ID NO: 704704 - RNA, 23 nt, Homo sapiens
cuggggcagacaauaaacccuca

SEQ ID NO: 704705 - RNA, 16 nt, Homo sapiens
cuggggcauccugugc

SEQ ID NO: 704706 - RNA, 20 nt, Homo sapiens
cuggggccuacagcuuugau

SEQ ID NO: 704707 - RNA, 14 nt, Homo sapiens
cugggguugagggc

SEQ ID NO: 704708 - RNA, 16 nt, Homo sapiens
cugguauguguggaug

SEQ ID NO: 704709 - RNA, 18 nt, Homo sapiens
cuggugcagucauuauga

SEQ ID NO: 704710 - RNA, 15 nt, Homo sapiens
cugguuuucugccaa

SEQ ID NO: 704711 - RNA, 17 nt, Homo sapiens
cugguuuucugccaaug

SEQ ID NO: 704712 - RNA, 12 nt, Homo sapiens
cuguaaauaugu

SEQ ID NO: 704713 - RNA, 14 nt, Homo sapiens
cacuugaggccuga

SEQ ID NO: 704714 - RNA, 13 nt, Homo sapiens
cacuuguagauuu

SEQ ID NO: 704715 - RNA, 16 nt, Homo sapiens
cacuuguagauuugau

SEQ ID NO: 704716 - RNA, 14 nt, Homo sapiens
cagaaacacugccu

SEQ ID NO: 704717 - RNA, 20 nt, Homo sapiens
cagaaagagacuccgucuca

SEQ ID NO: 704718 - RNA, 12 nt, Homo sapiens
cagaagggauaa

SEQ ID NO: 704719 - RNA, 14 nt, Homo sapiens
cagaaggugccacu

SEQ ID NO: 704720 - RNA, 16 nt, Homo sapiens
cagaaguuaguuugua

SEQ ID NO: 704721 - RNA, 19 nt, Homo sapiens
cagaaguuaguuuguauau

SEQ ID NO: 704722 - RNA, 21 nt, Homo sapiens
cagaaguuugagaucagccug

SEQ ID NO: 704723 - RNA, 20 nt, Homo sapiens
cagaaugcaaccaagucaca

SEQ ID NO: 704724 - RNA, 21 nt, Homo sapiens
cagaaugcaaccaagucacac

SEQ ID NO: 704725 - RNA, 18 nt, Homo sapiens
cagaaugcugcaggacuu

SEQ ID NO: 704726 - RNA, 22 nt, Homo sapiens
cagaaugcugcaggacuugaga

SEQ ID NO: 704727 - RNA, 17 nt, Homo sapiens
cagacaauaaacccuca

SEQ ID NO: 704728 - RNA, 21 nt, Homo sapiens
cagacuacuucuuccccagau

SEQ ID NO: 704729 - RNA, 15 nt, Homo sapiens
cagacuuccuugaga

SEQ ID NO: 704730 - RNA, 19 nt, Homo sapiens
cagagaaaucugcauucua

SEQ ID NO: 704731 - RNA, 15 nt, Homo sapiens
cagagacagauaccu

SEQ ID NO: 704732 - RNA, 16 nt, Homo sapiens
cagagacagauaccuc

SEQ ID NO: 704733 - RNA, 13 nt, Homo sapiens
cagagcaagugag

SEQ ID NO: 704734 - RNA, 16 nt, Homo sapiens
cagaggaauccuggca

SEQ ID NO: 704735 - RNA, 15 nt, Homo sapiens
cagaggguacuuuaa

SEQ ID NO: 704736 - RNA, 19 nt, Homo sapiens
cagauaccuccaacccugc

SEQ ID NO: 704737 - RNA, 12 nt, Homo sapiens
cagauacuuggg

SEQ ID NO: 704738 - RNA, 14 nt, Homo sapiens
cagaucacugccac

SEQ ID NO: 704739 - RNA, 17 nt, Homo sapiens
cagauggaaaaacugag

SEQ ID NO: 704740 - RNA, 19 nt, Homo sapiens
cagauggaaaaacugaggc

SEQ ID NO: 704741 - RNA, 14 nt, Homo sapiens
cagauggucaucca

SEQ ID NO: 704742 - RNA, 22 nt, Homo sapiens
cagauguccuaauggugaugca

SEQ ID NO: 704743 - RNA, 18 nt, Homo sapiens
cagccacuccccggcaug

SEQ ID NO: 704744 - RNA, 19 nt, Homo sapiens
cagccagcgccucccucca

SEQ ID NO: 704745 - RNA, 12 nt, Homo sapiens
cagccaugccag

SEQ ID NO: 704746 - RNA, 17 nt, Homo sapiens
cagcccagagacuuugu

SEQ ID NO: 704747 - RNA, 19 nt, Homo sapiens
cagcccccuaaaagcacuc

SEQ ID NO: 704748 - RNA, 19 nt, Homo sapiens
cagccccgcgaccaugugg

SEQ ID NO: 704749 - RNA, 12 nt, Homo sapiens
cagccccggggu

SEQ ID NO: 704750 - RNA, 13 nt, Homo sapiens
cagccuagcacag

SEQ ID NO: 704751 - RNA, 15 nt, Homo sapiens
cagccucccuuugau

SEQ ID NO: 704752 - RNA, 19 nt, Homo sapiens
cagccucucgaagugcuga

SEQ ID NO: 704753 - RNA, 14 nt, Homo sapiens
cagccugcuagcua

SEQ ID NO: 704754 - RNA, 20 nt, Homo sapiens
cagccugggugacagagcaa

SEQ ID NO: 704755 - RNA, 24 nt, Homo sapiens
cagccuuaugauuaaacuuccuuc

SEQ ID NO: 704756 - RNA, 24 nt, Homo sapiens
cagcugacuuuucuguccgagcuu

SEQ ID NO: 704757 - RNA, 18 nt, Homo sapiens
cagcuggagguugagcuc

SEQ ID NO: 704758 - RNA, 13 nt, Homo sapiens
cagcuuaucucag

SEQ ID NO: 704759 - RNA, 22 nt, Homo sapiens
cagcuuaucucaggggugugcg

SEQ ID NO: 704760 - RNA, 23 nt, Homo sapiens
cagcuuuguuuguugucagcuga

SEQ ID NO: 704761 - RNA, 14 nt, Homo sapiens
caggaaauagucac

SEQ ID NO: 704762 - RNA, 16 nt, Homo sapiens
caggaagccaggugag

SEQ ID NO: 704763 - RNA, 15 nt, Homo sapiens
caggaauauuuucca

SEQ ID NO: 704764 - RNA, 18 nt, Homo sapiens
caggagaccuggcacugg

SEQ ID NO: 704765 - RNA, 19 nt, Homo sapiens
caggagaccuggcacugga

SEQ ID NO: 704766 - RNA, 21 nt, Homo sapiens
caggagacuuuacauggaugc

SEQ ID NO: 704767 - RNA, 23 nt, Homo sapiens
caggagguggaggcugcagugag

SEQ ID NO: 704768 - RNA, 12 nt, Homo sapiens
caggcacgggug

SEQ ID NO: 704769 - RNA, 17 nt, Homo sapiens
caggcagccucugucag

SEQ ID NO: 704770 - RNA, 15 nt, Homo sapiens
caggccaaagugccg

SEQ ID NO: 704771 - RNA, 14 nt, Homo sapiens
caggcuggccaguc

SEQ ID NO: 704772 - RNA, 21 nt, Homo sapiens
cgcccuuggcuucugugauga

SEQ ID NO: 704773 - RNA, 23 nt, Homo sapiens
cgccgcuagguagagucugaggg

SEQ ID NO: 704774 - RNA, 22 nt, Homo sapiens
cgccuguaaucccagcacuuug

SEQ ID NO: 704775 - RNA, 22 nt, Homo sapiens
cgcgccccacgagaccccggcu

SEQ ID NO: 704776 - RNA, 12 nt, Homo sapiens
cgcucuguggau

SEQ ID NO: 704777 - RNA, 19 nt, Homo sapiens
cgcugaagcgccuccccca

SEQ ID NO: 704778 - RNA, 16 nt, Homo sapiens
cggagaagagcgcagu

SEQ ID NO: 704779 - RNA, 19 nt, Homo sapiens
cggccccucccacacccaa

SEQ ID NO: 704780 - RNA, 13 nt, Homo sapiens
cggcccugaccaa

SEQ ID NO: 704781 - RNA, 14 nt, Homo sapiens
cgggagccccaucu

SEQ ID NO: 704782 - RNA, 13 nt, Homo sapiens
cggguaccugaag

SEQ ID NO: 704783 - RNA, 16 nt, Homo sapiens
cgguuccugucccugc

SEQ ID NO: 704784 - RNA, 15 nt, Homo sapiens
cgucagcugcucccu

SEQ ID NO: 704785 - RNA, 14 nt, Homo sapiens
cguccccucccucu

SEQ ID NO: 704786 - RNA, 15 nt, Homo sapiens
cgucgucaccaaauc

SEQ ID NO: 704787 - RNA, 20 nt, Homo sapiens
cgucucuacuaaaaauacaa

SEQ ID NO: 704788 - RNA, 14 nt, Homo sapiens
cgucugugcuuccu

SEQ ID NO: 704789 - RNA, 15 nt, Homo sapiens
cgugacaagugccuu

SEQ ID NO: 704790 - RNA, 20 nt, Homo sapiens
cgugacuguuacuuuauaca

SEQ ID NO: 704791 - RNA, 13 nt, Homo sapiens
cgugcguggcacu

SEQ ID NO: 704792 - RNA, 23 nt, Homo sapiens
cguggauguauggggaaucuaag

SEQ ID NO: 704793 - RNA, 22 nt, Homo sapiens
cguuauacacauauaguguaca

SEQ ID NO: 704794 - RNA, 17 nt, Homo sapiens
cguuccaccccaagaga

SEQ ID NO: 704795 - RNA, 13 nt, Homo sapiens
cguuguguuguug

SEQ ID NO: 704796 - RNA, 16 nt, Homo sapiens
cguuucugguggucug

SEQ ID NO: 704797 - RNA, 17 nt, Homo sapiens
cuaaaaaauggugggag

SEQ ID NO: 704798 - RNA, 12 nt, Homo sapiens
cuaaaacuuaac

SEQ ID NO: 704799 - RNA, 14 nt, Homo sapiens
cuaaaacuuaacau

SEQ ID NO: 704800 - RNA, 16 nt, Homo sapiens
cuaaaaguguaagaaa

SEQ ID NO: 704801 - RNA, 16 nt, Homo sapiens
cuaaacaaugcugauu

SEQ ID NO: 704802 - RNA, 20 nt, Homo sapiens
cuaaacaaugcugauuuggu

SEQ ID NO: 704803 - RNA, 15 nt, Homo sapiens
cuaaagagcccuugc

SEQ ID NO: 704804 - RNA, 21 nt, Homo sapiens
cuaaagguggugaggcaauaa

SEQ ID NO: 704805 - RNA, 15 nt, Homo sapiens
cuaaaucacuuugag

SEQ ID NO: 704806 - RNA, 16 nt, Homo sapiens
cuaaauguaaucacga

SEQ ID NO: 704807 - RNA, 15 nt, Homo sapiens
cuaaauuauagugua

SEQ ID NO: 704808 - RNA, 20 nt, Homo sapiens
cuaagaucucgguuugccaa

SEQ ID NO: 704809 - RNA, 20 nt, Homo sapiens
cuaaucaccauguaagcacu

SEQ ID NO: 704810 - RNA, 23 nt, Homo sapiens
cuaauuaaucuggaauaugcaac

SEQ ID NO: 704811 - RNA, 18 nt, Homo sapiens
cuaauuauacuacuuugu

SEQ ID NO: 704812 - RNA, 21 nt, Homo sapiens
cuacacucuugacuagugcaa

SEQ ID NO: 704813 - RNA, 14 nt, Homo sapiens
cuacagaugugcug

SEQ ID NO: 704814 - RNA, 13 nt, Homo sapiens
cuaccagcauaaa

SEQ ID NO: 704815 - RNA, 13 nt, Homo sapiens
cuacccucaguga

SEQ ID NO: 704816 - RNA, 20 nt, Homo sapiens
cuacucuagggaaaaaccag

SEQ ID NO: 704817 - RNA, 21 nt, Homo sapiens
cuacugacauaucuacacuuc

SEQ ID NO: 704818 - RNA, 15 nt, Homo sapiens
cuacuuuguggcaau

SEQ ID NO: 704819 - RNA, 18 nt, Homo sapiens
cuacuuuuggugcuuaaa

SEQ ID NO: 704820 - RNA, 13 nt, Homo sapiens
cuagaaacaaaca

SEQ ID NO: 704821 - RNA, 16 nt, Homo sapiens
cuagaaaucuauuuau

SEQ ID NO: 704822 - RNA, 23 nt, Homo sapiens
cuagaggcccuuugcugucccau

SEQ ID NO: 704823 - RNA, 21 nt, Homo sapiens
cuaggaaacucacacuccccu

SEQ ID NO: 704824 - RNA, 20 nt, Homo sapiens
cuaggaagagucuacccgac

SEQ ID NO: 704825 - RNA, 17 nt, Homo sapiens
cuaggcauuugcugaau

SEQ ID NO: 704826 - RNA, 19 nt, Homo sapiens
cuagggagacgccauguga

SEQ ID NO: 704827 - RNA, 15 nt, Homo sapiens
cuagucaccagagac

SEQ ID NO: 704828 - RNA, 17 nt, Homo sapiens
cuaguugaauacuugaa

SEQ ID NO: 704829 - RNA, 22 nt, Homo sapiens
cuaguuugugagaaacaucuca

SEQ ID NO: 704830 - RNA, 15 nt, Homo sapiens
cuauaaugagcaugu

SEQ ID NO: 704831 - RNA, 20 nt, Homo sapiens
cuauagcaucacuuaaaaca

SEQ ID NO: 704832 - RNA, 15 nt, Homo sapiens
cuauauccugugacu

SEQ ID NO: 704833 - RNA, 22 nt, Homo sapiens
cuauauccugugacugucucac

SEQ ID NO: 704834 - RNA, 13 nt, Homo sapiens
cuaucugaccaaa

SEQ ID NO: 704835 - RNA, 23 nt, Homo sapiens
accugcauaaaaaggucuuuaaa

SEQ ID NO: 704836 - RNA, 13 nt, Homo sapiens
accuguaguccca

SEQ ID NO: 704837 - RNA, 15 nt, Homo sapiens
accuuaagacagagu

SEQ ID NO: 704838 - RNA, 17 nt, Homo sapiens
accuuaagagacacucc

SEQ ID NO: 704839 - RNA, 19 nt, Homo sapiens
accuucuauagcaucacuu

SEQ ID NO: 704840 - RNA, 19 nt, Homo sapiens
accuugaagaaccucucac

SEQ ID NO: 704841 - RNA, 14 nt, Homo sapiens
accuuuuacuguga

SEQ ID NO: 704842 - RNA, 16 nt, Homo sapiens
acgaauauggacauau

SEQ ID NO: 704843 - RNA, 17 nt, Homo sapiens
acgaaucguacuucuuu

SEQ ID NO: 704844 - RNA, 22 nt, Homo sapiens
acgacaagauuuucuacuuuuu

SEQ ID NO: 704845 - RNA, 15 nt, Homo sapiens
acgaucuuccuggcu

SEQ ID NO: 704846 - RNA, 12 nt, Homo sapiens
acggacacucaa

SEQ ID NO: 704847 - RNA, 16 nt, Homo sapiens
acggcggcaguauuga

SEQ ID NO: 704848 - RNA, 18 nt, Homo sapiens
acggucuccugacuggug

SEQ ID NO: 704849 - RNA, 15 nt, Homo sapiens
acgucagacuuggcu

SEQ ID NO: 704850 - RNA, 18 nt, Homo sapiens
acgucauguguuuugcca

SEQ ID NO: 704851 - RNA, 20 nt, Homo sapiens
acgugauccucucaccucag

SEQ ID NO: 704852 - RNA, 22 nt, Homo sapiens
acguuagauuugccguaccaau

SEQ ID NO: 704853 - RNA, 22 nt, Homo sapiens
acguuuauaaacagaaauggaa

SEQ ID NO: 704854 - RNA, 20 nt, Homo sapiens
acuaacgaaauaucaaaguc

SEQ ID NO: 704855 - RNA, 14 nt, Homo sapiens
acuaauuaggcaag

SEQ ID NO: 704856 - RNA, 23 nt, Homo sapiens
acuaauuaggcaaggcuauguga

SEQ ID NO: 704857 - RNA, 15 nt, Homo sapiens
acuaauuuuacaugu

SEQ ID NO: 704858 - RNA, 14 nt, Homo sapiens
acuacaagucagcu

SEQ ID NO: 704859 - RNA, 15 nt, Homo sapiens
acuacauauuguaaa

SEQ ID NO: 704860 - RNA, 23 nt, Homo sapiens
acuaccauuccuucuuuaaacac

SEQ ID NO: 704861 - RNA, 17 nt, Homo sapiens
acuacuuuuggugcuua

SEQ ID NO: 704862 - RNA, 12 nt, Homo sapiens
acuaguuuauuu

SEQ ID NO: 704863 - RNA, 15 nt, Homo sapiens
acuauccuaccccac

SEQ ID NO: 704864 - RNA, 19 nt, Homo sapiens
acuaugaagcuaccucaaa

SEQ ID NO: 704865 - RNA, 19 nt, Homo sapiens
acuaugaggacugccuuau

SEQ ID NO: 704866 - RNA, 20 nt, Homo sapiens
acuaugguuuucauuuacuc

SEQ ID NO: 704867 - RNA, 12 nt, Homo sapiens
acucacacuccc

SEQ ID NO: 704868 - RNA, 18 nt, Homo sapiens
acucacagagucaaggcc

SEQ ID NO: 704869 - RNA, 20 nt, Homo sapiens
acucaccagccccacugcca

SEQ ID NO: 704870 - RNA, 21 nt, Homo sapiens
acucaccagccccacugccag

SEQ ID NO: 704871 - RNA, 13 nt, Homo sapiens
acucacugugauc

SEQ ID NO: 704872 - RNA, 21 nt, Homo sapiens
acucaucugaaauguuacaaa

SEQ ID NO: 704873 - RNA, 15 nt, Homo sapiens
acucauuucaucuca

SEQ ID NO: 704874 - RNA, 23 nt, Homo sapiens
acuccccauuaacagauggaaaa

SEQ ID NO: 704875 - RNA, 14 nt, Homo sapiens
acuccugcuuaauc

SEQ ID NO: 704876 - RNA, 21 nt, Homo sapiens
acucuggaguucaucagaguu

SEQ ID NO: 704877 - RNA, 17 nt, Homo sapiens
acucuucucauuacuug

SEQ ID NO: 704878 - RNA, 17 nt, Homo sapiens
acugaccauauugugcu

SEQ ID NO: 704879 - RNA, 22 nt, Homo sapiens
acugcaucguuucaucuuccaa

SEQ ID NO: 704880 - RNA, 20 nt, Homo sapiens
acugccuucgcuucuugccu

SEQ ID NO: 704881 - RNA, 21 nt, Homo sapiens
acugccuucgcuucuugccuc

SEQ ID NO: 704882 - RNA, 17 nt, Homo sapiens
acuggagcucaucugca

SEQ ID NO: 704883 - RNA, 21 nt, Homo sapiens
acuggaguuuuggacuggaua

SEQ ID NO: 704884 - RNA, 14 nt, Homo sapiens
uugaagccaaagaa

SEQ ID NO: 704885 - RNA, 21 nt, Homo sapiens
uugaagcucgugacaagugcc

SEQ ID NO: 704886 - RNA, 13 nt, Homo sapiens
uugaagucuauaa

SEQ ID NO: 704887 - RNA, 15 nt, Homo sapiens
uugaagucuuuaaua

SEQ ID NO: 704888 - RNA, 19 nt, Homo sapiens
uugaauaaacaccacugga

SEQ ID NO: 704889 - RNA, 20 nt, Homo sapiens
uugaauacuugaaccauaaa

SEQ ID NO: 704890 - RNA, 15 nt, Homo sapiens
uugacaggaaccuua

SEQ ID NO: 704891 - RNA, 20 nt, Homo sapiens
uugaggccaagaauauugca

SEQ ID NO: 704892 - RNA, 20 nt, Homo sapiens
uugaguccagaaguuugaga

SEQ ID NO: 704893 - RNA, 21 nt, Homo sapiens
uugaguuugucgcucaugugu

SEQ ID NO: 704894 - RNA, 12 nt, Homo sapiens
uugauggugaua

SEQ ID NO: 704895 - RNA, 22 nt, Homo sapiens
uugauugggaaaacauuugcug

SEQ ID NO: 704896 - RNA, 14 nt, Homo sapiens
uugauuggugauua

SEQ ID NO: 704897 - RNA, 13 nt, Homo sapiens
uugcaagugcugg

SEQ ID NO: 704898 - RNA, 18 nt, Homo sapiens
uugcacaauccaugaaca

SEQ ID NO: 704899 - RNA, 16 nt, Homo sapiens
uugcauaggaauugca

SEQ ID NO: 704900 - RNA, 19 nt, Homo sapiens
uugccauggugauggugua

SEQ ID NO: 704901 - RNA, 21 nt, Homo sapiens
uugccuagacagcuuuucuca

SEQ ID NO: 704902 - RNA, 14 nt, Homo sapiens
uugccuccaggugc

SEQ ID NO: 704903 - RNA, 14 nt, Homo sapiens
uugcuaugaagcgu

SEQ ID NO: 704904 - RNA, 19 nt, Homo sapiens
uugcucuucagaugccacu

SEQ ID NO: 704905 - RNA, 12 nt, Homo sapiens
uugcugcacuuu

SEQ ID NO: 704906 - RNA, 21 nt, Homo sapiens
uugcugucccauagucccugc

SEQ ID NO: 704907 - RNA, 20 nt, Homo sapiens
uugcuuuaccuuuucagggc

SEQ ID NO: 704908 - RNA, 18 nt, Homo sapiens
uuggaaaaagccugugaa

SEQ ID NO: 704909 - RNA, 19 nt, Homo sapiens
uuggaaaaagccugugaaa

SEQ ID NO: 704910 - RNA, 13 nt, Homo sapiens
uuggaaugaagga

SEQ ID NO: 704911 - RNA, 20 nt, Homo sapiens
uuggauaucaaaagcaaaua

SEQ ID NO: 704912 - RNA, 19 nt, Homo sapiens
uuggaugcggccauucaag

SEQ ID NO: 704913 - RNA, 18 nt, Homo sapiens
uuggauucuaaauacaug

SEQ ID NO: 704914 - RNA, 15 nt, Homo sapiens
uuggccugcugugau

SEQ ID NO: 704915 - RNA, 17 nt, Homo sapiens
uuggcuuaaauaaucuc

SEQ ID NO: 704916 - RNA, 17 nt, Homo sapiens
uugggaaaacauuugcu

SEQ ID NO: 704917 - RNA, 14 nt, Homo sapiens
uugggaggccaagg

SEQ ID NO: 704918 - RNA, 16 nt, Homo sapiens
uuggggccaccaaagc

SEQ ID NO: 704919 - RNA, 23 nt, Homo sapiens
uugggggaggggagacuuugaug

SEQ ID NO: 704920 - RNA, 18 nt, Homo sapiens
uugguuuuccuguggcau

SEQ ID NO: 704921 - RNA, 23 nt, Homo sapiens
uuguaaucauguuaccauuacaa

SEQ ID NO: 704922 - RNA, 19 nt, Homo sapiens
uuguaaugacagugcuaaa

SEQ ID NO: 704923 - RNA, 21 nt, Homo sapiens
uugucaaaaggaagucucuag

SEQ ID NO: 704924 - RNA, 19 nt, Homo sapiens
uugucacuuuuuaugcuau

SEQ ID NO: 704925 - RNA, 18 nt, Homo sapiens
uuguccugagauggaaaa

SEQ ID NO: 704926 - RNA, 16 nt, Homo sapiens
uuguccuucagccaaa

SEQ ID NO: 704927 - RNA, 18 nt, Homo sapiens
uugucuaaacaaugcuga

SEQ ID NO: 704928 - RNA, 20 nt, Homo sapiens
uugugaauugcuugguugua

SEQ ID NO: 704929 - RNA, 21 nt, Homo sapiens
uuguguaaugaaaaugaauau

SEQ ID NO: 704930 - RNA, 16 nt, Homo sapiens
uugugugaacuuggaa

SEQ ID NO: 704931 - RNA, 17 nt, Homo sapiens
uuguuacuucugaggua

SEQ ID NO: 704932 - RNA, 16 nt, Homo sapiens
uuguucaguugccaag

SEQ ID NO: 704933 - RNA, 19 nt, Homo sapiens
uuuaaaaaaaaagucagag

SEQ ID NO: 704934 - RNA, 20 nt, Homo sapiens
uuuaaaaaaaaagucagaga

SEQ ID NO: 704935 - RNA, 22 nt, Homo sapiens
uuuaacuuuauaaauccaguga

SEQ ID NO: 704936 - RNA, 18 nt, Homo sapiens
uuuaagcuuuccuguuga

SEQ ID NO: 704937 - RNA, 19 nt, Homo sapiens
uuuacaagggcauaaagua

SEQ ID NO: 704938 - RNA, 14 nt, Homo sapiens
uuuacagacuguga

SEQ ID NO: 704939 - RNA, 15 nt, Homo sapiens
uuuacagcaagaaca

SEQ ID NO: 704940 - RNA, 14 nt, Homo sapiens
uuuacuagugugug

SEQ ID NO: 704941 - RNA, 19 nt, Homo sapiens
uuuauaaaucuuaugcucu

SEQ ID NO: 704942 - RNA, 14 nt, Homo sapiens
uuuauaaugccauu

SEQ ID NO: 704943 - RNA, 18 nt, Homo sapiens
uuuauagaggcuagcuuc

SEQ ID NO: 704944 - RNA, 21 nt, Homo sapiens
uuuauguuuggugaacuauau

SEQ ID NO: 704945 - RNA, 17 nt, Homo sapiens
uuucaaaauccaaaaag

SEQ ID NO: 704946 - RNA, 12 nt, Homo sapiens
uuucagggcugg

SEQ ID NO: 704947 - RNA, 15 nt, Homo sapiens
uuucauaguguucau

SEQ ID NO: 704948 - RNA, 17 nt, Homo sapiens
uuucauguaaauuuugu

SEQ ID NO: 704949 - RNA, 15 nt, Homo sapiens
uuuccacuccauugu

SEQ ID NO: 704950 - RNA, 19 nt, Homo sapiens
uuuccagacuuccuugaga

SEQ ID NO: 704951 - RNA, 15 nt, Homo sapiens
uuuccuaaaagugua

SEQ ID NO: 704952 - RNA, 21 nt, Homo sapiens
uuuccuggaauugccagcuga

SEQ ID NO: 704953 - RNA, 18 nt, Homo sapiens
uuuccuuuuugacacuga

SEQ ID NO: 704954 - RNA, 16 nt, Homo sapiens
uuucuaccuuuacuac

SEQ ID NO: 704955 - RNA, 13 nt, Homo sapiens
uuucuagacuguc

SEQ ID NO: 704956 - RNA, 12 nt, Homo sapiens
uuucuaugcaaa

SEQ ID NO: 704957 - RNA, 21 nt, Homo sapiens
uuucuauuauggaaaacugug

SEQ ID NO: 704958 - RNA, 17 nt, Homo sapiens
uuucucaacuucucuac

SEQ ID NO: 704959 - RNA, 15 nt, Homo sapiens
uuucucccccuaguu

SEQ ID NO: 704960 - RNA, 14 nt, Homo sapiens
uuucucugaucucc

SEQ ID NO: 704961 - RNA, 23 nt, Homo sapiens
uuucucuuugauuauuugcaugu

SEQ ID NO: 704962 - RNA, 19 nt, Homo sapiens
uuucuggaaaguagaucuu

SEQ ID NO: 704963 - RNA, 21 nt, Homo sapiens
uuucuggggaaagacacugcc

SEQ ID NO: 704964 - RNA, 13 nt, Homo sapiens
uuugaaaugucau

SEQ ID NO: 704965 - RNA, 12 nt, Homo sapiens
uuugacacugaa

SEQ ID NO: 704966 - RNA, 17 nt, Homo sapiens
uuugaggugaggguugg

SEQ ID NO: 704967 - RNA, 17 nt, Homo sapiens
aaugguugaugauacuu

SEQ ID NO: 704968 - RNA, 16 nt, Homo sapiens
aauguauaaacuuuag

SEQ ID NO: 704969 - RNA, 14 nt, Homo sapiens
aauguccauaugcu

SEQ ID NO: 704970 - RNA, 16 nt, Homo sapiens
aauguugggacugcua

SEQ ID NO: 704971 - RNA, 20 nt, Homo sapiens
aauguuuuguaaacauuuau

SEQ ID NO: 704972 - RNA, 16 nt, Homo sapiens
aauuaaaaaagcauac

SEQ ID NO: 704973 - RNA, 19 nt, Homo sapiens
aauuacuuauuguauuuau

SEQ ID NO: 704974 - RNA, 21 nt, Homo sapiens
aauuaguuccucauuagcauu

SEQ ID NO: 704975 - RNA, 23 nt, Homo sapiens
aauuauccacaugaaaauaaaga

SEQ ID NO: 704976 - RNA, 15 nt, Homo sapiens
aauuauugacacuga

SEQ ID NO: 704977 - RNA, 13 nt, Homo sapiens
aauucaaacuggg

SEQ ID NO: 704978 - RNA, 21 nt, Homo sapiens
aauucacaaguuacacugcca

SEQ ID NO: 704979 - RNA, 21 nt, Homo sapiens
aauuccuagaaguugagagag

SEQ ID NO: 704980 - RNA, 22 nt, Homo sapiens
aauucuaccaaggucuucuuaa

SEQ ID NO: 704981 - RNA, 14 nt, Homo sapiens
aauucuagucauau

SEQ ID NO: 704982 - RNA, 23 nt, Homo sapiens
aauugaguugcacuuauugacca

SEQ ID NO: 704983 - RNA, 19 nt, Homo sapiens
aauuguacaaaauuaagca

SEQ ID NO: 704984 - RNA, 15 nt, Homo sapiens
aauuuaacugcuuaa

SEQ ID NO: 704985 - RNA, 18 nt, Homo sapiens
aauuuagaccccauacaa

SEQ ID NO: 704986 - RNA, 19 nt, Homo sapiens
aauuuauuuccacuaaaaa

SEQ ID NO: 704987 - RNA, 21 nt, Homo sapiens
aauuuccuuuuugacacugaa

SEQ ID NO: 704988 - RNA, 17 nt, Homo sapiens
aauuucuuaugugacau

SEQ ID NO: 704989 - RNA, 17 nt, Homo sapiens
aauuuuuaagcugcaaa

SEQ ID NO: 704990 - RNA, 14 nt, Homo sapiens
aauuuuuuuguacg

SEQ ID NO: 704991 - RNA, 15 nt, Homo sapiens
acaaaaccacuggga

SEQ ID NO: 704992 - RNA, 13 nt, Homo sapiens
acaaaauguucac

SEQ ID NO: 704993 - RNA, 15 nt, Homo sapiens
acaaaccuaccaaaa

SEQ ID NO: 704994 - RNA, 15 nt, Homo sapiens
acaaagugccaaaga

SEQ ID NO: 704995 - RNA, 16 nt, Homo sapiens
acaaagugccaaagaa

SEQ ID NO: 704996 - RNA, 14 nt, Homo sapiens
acaaaugacuuuau

SEQ ID NO: 704997 - RNA, 17 nt, Homo sapiens
acaaaugcaucuuugau

SEQ ID NO: 704998 - RNA, 14 nt, Homo sapiens
acaacaaaaagcuu

SEQ ID NO: 704999 - RNA, 23 nt, Homo sapiens
acaagaaaaguugaagaagauau

SEQ ID NO: 705000 - RNA, 18 nt, Homo sapiens
acaagaucuguaauguua

SEQ ID NO: 705001 - RNA, 20 nt, Homo sapiens
acaagauuugcugcauuucc

SEQ ID NO: 705002 - RNA, 16 nt, Homo sapiens
acaauaguucuguggg

SEQ ID NO: 705003 - RNA, 22 nt, Homo sapiens
cauguccauacacuuuguugca

SEQ ID NO: 705004 - RNA, 18 nt, Homo sapiens
cauguguaauaugcacaa

SEQ ID NO: 705005 - RNA, 18 nt, Homo sapiens
cauguuuuguauguuaaa

SEQ ID NO: 705006 - RNA, 22 nt, Homo sapiens
cauguuuuguauguuaaauuca

SEQ ID NO: 705007 - RNA, 19 nt, Homo sapiens
cauuaaggggaagaaugaa

SEQ ID NO: 705008 - RNA, 20 nt, Homo sapiens
cauucagagucagccaggac

SEQ ID NO: 705009 - RNA, 19 nt, Homo sapiens
cauuccacacagaaugcaa

SEQ ID NO: 705010 - RNA, 18 nt, Homo sapiens
cauucccuuuuccauaua

SEQ ID NO: 705011 - RNA, 12 nt, Homo sapiens
cauuggcuuaaa

SEQ ID NO: 705012 - RNA, 22 nt, Homo sapiens
cauugucguauaggcauguaaa

SEQ ID NO: 705013 - RNA, 18 nt, Homo sapiens
cauuuaaaaaaaaucccu

SEQ ID NO: 705014 - RNA, 17 nt, Homo sapiens
cauuuagucuugccagg

SEQ ID NO: 705015 - RNA, 12 nt, Homo sapiens
cauuucaucuca

SEQ ID NO: 705016 - RNA, 16 nt, Homo sapiens
cauuucugagaucaaa

SEQ ID NO: 705017 - RNA, 22 nt, Homo sapiens
cauuugccaauuuuccuacucu

SEQ ID NO: 705018 - RNA, 14 nt, Homo sapiens
cauuugcugccauu

SEQ ID NO: 705019 - RNA, 13 nt, Homo sapiens
ccaaaauggucuc

SEQ ID NO: 705020 - RNA, 13 nt, Homo sapiens
ccaaaauguuaau

SEQ ID NO: 705021 - RNA, 13 nt, Homo sapiens
ccaaacagugacu

SEQ ID NO: 705022 - RNA, 12 nt, Homo sapiens
ccaacuaggcag

SEQ ID NO: 705023 - RNA, 19 nt, Homo sapiens
ccaagaaagcucacuguag

SEQ ID NO: 705024 - RNA, 18 nt, Homo sapiens
ccaagaauauugcaaaau

SEQ ID NO: 705025 - RNA, 17 nt, Homo sapiens
ccaagauuuuuuauuug

SEQ ID NO: 705026 - RNA, 14 nt, Homo sapiens
ccaagccuccacag

SEQ ID NO: 705027 - RNA, 18 nt, Homo sapiens
ccaaggaaacccccagug

SEQ ID NO: 705028 - RNA, 15 nt, Homo sapiens
ccaaggaugaaauca

SEQ ID NO: 705029 - RNA, 15 nt, Homo sapiens
ccaagggaaaggggu

SEQ ID NO: 705030 - RNA, 12 nt, Homo sapiens
ccaaggugggag

SEQ ID NO: 705031 - RNA, 23 nt, Homo sapiens
ccaaucucugccauaucagugaa

SEQ ID NO: 705032 - RNA, 15 nt, Homo sapiens
ccacacucuccauca

SEQ ID NO: 705033 - RNA, 17 nt, Homo sapiens
ccaccaccuucuucucc

SEQ ID NO: 705034 - RNA, 12 nt, Homo sapiens
ccaccccaagag

SEQ ID NO: 705035 - RNA, 21 nt, Homo sapiens
ccacccuagccaaugucuccu

SEQ ID NO: 705036 - RNA, 14 nt, Homo sapiens
ccacgcccugucua

SEQ ID NO: 705037 - RNA, 19 nt, Homo sapiens
ccacgcgugccguggcacc

SEQ ID NO: 705038 - RNA, 19 nt, Homo sapiens
ccacgugggcaaacaggca

SEQ ID NO: 705039 - RNA, 19 nt, Homo sapiens
accaaaucuggaagccaaa

SEQ ID NO: 705040 - RNA, 21 nt, Homo sapiens
accaagauauuuuuaucccaa

SEQ ID NO: 705041 - RNA, 16 nt, Homo sapiens
accaaguauagccuau

SEQ ID NO: 705042 - RNA, 17 nt, Homo sapiens
accaaucuuacuuugua

SEQ ID NO: 705043 - RNA, 13 nt, Homo sapiens
accaauguucucu

SEQ ID NO: 705044 - RNA, 16 nt, Homo sapiens
accacaaaacuuuucu

SEQ ID NO: 705045 - RNA, 15 nt, Homo sapiens
accaccuucuucucc

SEQ ID NO: 705046 - RNA, 20 nt, Homo sapiens
accacgggacaucacagggu

SEQ ID NO: 705047 - RNA, 21 nt, Homo sapiens
accacuaagaauucaaacugg

SEQ ID NO: 705048 - RNA, 22 nt, Homo sapiens
accauggcaugguuauugauga

SEQ ID NO: 705049 - RNA, 16 nt, Homo sapiens
accauguagcagugag

SEQ ID NO: 705050 - RNA, 20 nt, Homo sapiens
accauguggauaacuuuaca

SEQ ID NO: 705051 - RNA, 19 nt, Homo sapiens
acccaauauuuaccagacc

SEQ ID NO: 705052 - RNA, 18 nt, Homo sapiens
acccagucaccucugucu

SEQ ID NO: 705053 - RNA, 15 nt, Homo sapiens
accccaacacuucca

SEQ ID NO: 705054 - RNA, 22 nt, Homo sapiens
accccagugcuuguuccucuca

SEQ ID NO: 705055 - RNA, 15 nt, Homo sapiens
acccccaguguaaua

SEQ ID NO: 705056 - RNA, 17 nt, Homo sapiens
accccuuuuugccuuac

SEQ ID NO: 705057 - RNA, 20 nt, Homo sapiens
acccggcugcagaggccaga

SEQ ID NO: 705058 - RNA, 22 nt, Homo sapiens
acccguggcugaugguguggcc

SEQ ID NO: 705059 - RNA, 23 nt, Homo sapiens
acccugagccggccccaggcucg

SEQ ID NO: 705060 - RNA, 19 nt, Homo sapiens
acccugcugcuggugcaca

SEQ ID NO: 705061 - RNA, 20 nt, Homo sapiens
acccugcugcuggugcacag

SEQ ID NO: 705062 - RNA, 21 nt, Homo sapiens
acccuggagcccauccagucu

SEQ ID NO: 705063 - RNA, 23 nt, Homo sapiens
acccuuauaaaauccugugcaau

SEQ ID NO: 705064 - RNA, 19 nt, Homo sapiens
acccuuucaaacuauuuau

SEQ ID NO: 705065 - RNA, 14 nt, Homo sapiens
accgguccagcugg

SEQ ID NO: 705066 - RNA, 22 nt, Homo sapiens
accguggaggaggaaggcaaga

SEQ ID NO: 705067 - RNA, 17 nt, Homo sapiens
accuaccaaaauggaau

SEQ ID NO: 705068 - RNA, 23 nt, Homo sapiens
accuacgguggucggugggaccc

SEQ ID NO: 705069 - RNA, 18 nt, Homo sapiens
accuaguauaucagugac

SEQ ID NO: 705070 - RNA, 19 nt, Homo sapiens
accuccaacccugccguca

SEQ ID NO: 705071 - RNA, 22 nt, Homo sapiens
accucuguuaccacgacuucua

SEQ ID NO: 705072 - RNA, 15 nt, Homo sapiens
accucuugaaaauag

SEQ ID NO: 705073 - RNA, 13 nt, Homo sapiens
accugagaaccuu

SEQ ID NO: 705074 - RNA, 19 nt, Homo sapiens
accugccaggcaggggugg

SEQ ID NO: 705075 - RNA, 13 nt, Homo sapiens
accuugugccugg

SEQ ID NO: 705076 - RNA, 20 nt, Homo sapiens
acgaauuucugugcccuccu

SEQ ID NO: 705077 - RNA, 15 nt, Homo sapiens
acgccacucauuuca

SEQ ID NO: 705078 - RNA, 20 nt, Homo sapiens
acgccacucauuucaucuca

SEQ ID NO: 705079 - RNA, 16 nt, Homo sapiens
acgccuguaauccuag

SEQ ID NO: 705080 - RNA, 15 nt, Homo sapiens
acggaggaugaugcc

SEQ ID NO: 705081 - RNA, 20 nt, Homo sapiens
acggagucucacucugucac

SEQ ID NO: 705082 - RNA, 19 nt, Homo sapiens
acgugggcaaacaggcagu

SEQ ID NO: 705083 - RNA, 18 nt, Homo sapiens
acuaaaaguugcauuuua

SEQ ID NO: 705084 - RNA, 14 nt, Homo sapiens
acuaaaguuuuaca

SEQ ID NO: 705085 - RNA, 14 nt, Homo sapiens
acuaauugguacuu

SEQ ID NO: 705086 - RNA, 22 nt, Homo sapiens
acuaccuguauuuaaaaauaga

SEQ ID NO: 705087 - RNA, 20 nt, Homo sapiens
acuaggcccccacuugccuc

SEQ ID NO: 705088 - RNA, 16 nt, Homo sapiens
acuauccaguuacugc

SEQ ID NO: 705089 - RNA, 18 nt, Homo sapiens
acucaaauacacauuugc

SEQ ID NO: 705090 - RNA, 23 nt, Homo sapiens
acucacacggacacucaaaagcu

SEQ ID NO: 705091 - RNA, 22 nt, Homo sapiens
acucaccuucuagucuuggcca

SEQ ID NO: 705092 - RNA, 12 nt, Homo sapiens
acucacugugau

SEQ ID NO: 705093 - RNA, 20 nt, Homo sapiens
acucaucugaaauguuacaa

SEQ ID NO: 705094 - RNA, 13 nt, Homo sapiens
acucauugcugag

SEQ ID NO: 705095 - RNA, 14 nt, Homo sapiens
acuccuuauuuggc

SEQ ID NO: 705096 - RNA, 16 nt, Homo sapiens
acucggggugcuuccu

SEQ ID NO: 705097 - RNA, 18 nt, Homo sapiens
acucuagggaaaaaccag

SEQ ID NO: 705098 - RNA, 19 nt, Homo sapiens
acucuaucggagaacauga

SEQ ID NO: 705099 - RNA, 22 nt, Homo sapiens
acucuaucggagaacaugaauc

SEQ ID NO: 705100 - RNA, 17 nt, Homo sapiens
acucucaucacuacagu

SEQ ID NO: 705101 - RNA, 20 nt, Homo sapiens
acucugggaauacaggggug

SEQ ID NO: 705102 - RNA, 16 nt, Homo sapiens
acucuucucauuacuu

SEQ ID NO: 705103 - RNA, 19 nt, Homo sapiens
acugaaaaaucugguucau

SEQ ID NO: 705104 - RNA, 16 nt, Homo sapiens
acugaaagaugaucau

SEQ ID NO: 705105 - RNA, 16 nt, Homo sapiens
acugaaaugccugcuu

SEQ ID NO: 705106 - RNA, 21 nt, Homo sapiens
acugaaauuacggguaccuga

SEQ ID NO: 705107 - RNA, 15 nt, Homo sapiens
acugaaccacuugua

SEQ ID NO: 705108 - RNA, 21 nt, Homo sapiens
acugaacuuaauaacugugua

SEQ ID NO: 705109 - RNA, 19 nt, Homo sapiens
acugacugaggcaguuuga

SEQ ID NO: 705110 - RNA, 16 nt, Homo sapiens
acugcaccaagucuca

SEQ ID NO: 705111 - RNA, 13 nt, Homo sapiens
acugcagcuuugu

SEQ ID NO: 705112 - RNA, 17 nt, Homo sapiens
acugcauaauagccuaa

SEQ ID NO: 705113 - RNA, 13 nt, Homo sapiens
acugccugaauaa

SEQ ID NO: 705114 - RNA, 17 nt, Homo sapiens
acugcugcuccagugca

SEQ ID NO: 705115 - RNA, 19 nt, Homo sapiens
acugcugcuccagugcagg

SEQ ID NO: 705116 - RNA, 19 nt, Homo sapiens
acuggagguugaagccaag

SEQ ID NO: 705117 - RNA, 21 nt, Homo sapiens
acuggcuuaccuccucauggc

SEQ ID NO: 705118 - RNA, 16 nt, Homo sapiens
acugguauguguggau

SEQ ID NO: 705119 - RNA, 22 nt, Homo sapiens
acugguauguguggaugaugcu

SEQ ID NO: 705120 - RNA, 23 nt, Homo sapiens
acugguauguguggaugaugcug

SEQ ID NO: 705121 - RNA, 13 nt, Homo sapiens
acugguucucaau

SEQ ID NO: 705122 - RNA, 14 nt, Homo sapiens
acuguagcuuuuag

SEQ ID NO: 705123 - RNA, 14 nt, Homo sapiens
acugucucacuuaa

SEQ ID NO: 705124 - RNA, 14 nt, Homo sapiens
acugucuuccucaa

SEQ ID NO: 705125 - RNA, 22 nt, Homo sapiens
acugugaagagaaccauaucaa

SEQ ID NO: 705126 - RNA, 18 nt, Homo sapiens
acugugcuguuguucucg

SEQ ID NO: 705127 - RNA, 17 nt, Homo sapiens
acuguggcacuugccug

SEQ ID NO: 705128 - RNA, 18 nt, Homo sapiens
acuguggcuagugacaaa

SEQ ID NO: 705129 - RNA, 21 nt, Homo sapiens
acuguggcuagugacaaauaa

SEQ ID NO: 705130 - RNA, 14 nt, Homo sapiens
acuguuuaaucaua

SEQ ID NO: 705131 - RNA, 13 nt, Homo sapiens
acuuaacacuucu

SEQ ID NO: 705132 - RNA, 14 nt, Homo sapiens
acuuaaccuuuuaa

SEQ ID NO: 705133 - RNA, 20 nt, Homo sapiens
acuucagaagcaaacaauau

SEQ ID NO: 705134 - RNA, 14 nt, Homo sapiens
acuucgaaaccugg

SEQ ID NO: 705135 - RNA, 23 nt, Homo sapiens
acuucugcaacaagcaugcagcu

SEQ ID NO: 705136 - RNA, 21 nt, Homo sapiens
acuucuuacuucccuaaugaa

SEQ ID NO: 705137 - RNA, 19 nt, Homo sapiens
acuugaggccugaucugcc

SEQ ID NO: 705138 - RNA, 14 nt, Homo sapiens
acuugcaagccuca

SEQ ID NO: 705139 - RNA, 23 nt, Homo sapiens
acuugcuuuaccuuuucagggcu

SEQ ID NO: 705140 - RNA, 18 nt, Homo sapiens
acuuguauagcaugaaau

SEQ ID NO: 705141 - RNA, 16 nt, Homo sapiens
acuuucaauugucacu

SEQ ID NO: 705142 - RNA, 15 nt, Homo sapiens
acuuugggggaggag

SEQ ID NO: 705143 - RNA, 19 nt, Homo sapiens
acuuuguggcaaucugugg

SEQ ID NO: 705144 - RNA, 18 nt, Homo sapiens
acuuuucggucuuuccca

SEQ ID NO: 705145 - RNA, 17 nt, Homo sapiens
acuuuugcaugaaaaua

SEQ ID NO: 705146 - RNA, 18 nt, Homo sapiens
agaaaaagaaaugaacau

SEQ ID NO: 705147 - RNA, 16 nt, Homo sapiens
agaaaaaggcugugcu

SEQ ID NO: 705148 - RNA, 17 nt, Homo sapiens
agaaaaauaucuuggcc

SEQ ID NO: 705149 - RNA, 12 nt, Homo sapiens
agaaaacaucuu

SEQ ID NO: 705150 - RNA, 16 nt, Homo sapiens
agaaaaucuuuuacua

SEQ ID NO: 705151 - RNA, 16 nt, Homo sapiens
agaaacaaacaucuaa

SEQ ID NO: 705152 - RNA, 12 nt, Homo sapiens
agaaacaucuca

SEQ ID NO: 705153 - RNA, 21 nt, Homo sapiens
agaaacuuauuucucauauca

SEQ ID NO: 705154 - RNA, 19 nt, Homo sapiens
agaaagagacuccgucuca

SEQ ID NO: 705155 - RNA, 17 nt, Homo sapiens
agaaagcuuugaauacu

SEQ ID NO: 705156 - RNA, 22 nt, Homo sapiens
auagacuguaacuuccaaauaa

SEQ ID NO: 705157 - RNA, 12 nt, Homo sapiens
auagaggcuagc

SEQ ID NO: 705158 - RNA, 20 nt, Homo sapiens
auaguauucaggugagcaau

SEQ ID NO: 705159 - RNA, 13 nt, Homo sapiens
auaguccaaaaag

SEQ ID NO: 705160 - RNA, 19 nt, Homo sapiens
auauaaaguaguccuguga

SEQ ID NO: 705161 - RNA, 13 nt, Homo sapiens
auauaagccauag

SEQ ID NO: 705162 - RNA, 16 nt, Homo sapiens
auauaauguugccagc

SEQ ID NO: 705163 - RNA, 13 nt, Homo sapiens
auauauuuuuaga

SEQ ID NO: 705164 - RNA, 19 nt, Homo sapiens
auaucacauuggagucacu

SEQ ID NO: 705165 - RNA, 14 nt, Homo sapiens
auaucaugcaaaau

SEQ ID NO: 705166 - RNA, 18 nt, Homo sapiens
auaucuaauauauaugaa

SEQ ID NO: 705167 - RNA, 16 nt, Homo sapiens
auaugaucggccauca

SEQ ID NO: 705168 - RNA, 14 nt, Homo sapiens
auaugcagugauau

SEQ ID NO: 705169 - RNA, 20 nt, Homo sapiens
auaugugaagaaaaauguau

SEQ ID NO: 705170 - RNA, 15 nt, Homo sapiens
auauuaaaacacuua

SEQ ID NO: 705171 - RNA, 17 nt, Homo sapiens
auauuacugacauuucu

SEQ ID NO: 705172 - RNA, 16 nt, Homo sapiens
auauuguaaagcccau

SEQ ID NO: 705173 - RNA, 17 nt, Homo sapiens
auauuguauaggggcaa

SEQ ID NO: 705174 - RNA, 18 nt, Homo sapiens
auauuguugaacacuuga

SEQ ID NO: 705175 - RNA, 21 nt, Homo sapiens
auauuguugacaacugugacu

SEQ ID NO: 705176 - RNA, 21 nt, Homo sapiens
auauuuauuuauguguucaca

SEQ ID NO: 705177 - RNA, 14 nt, Homo sapiens
auauuucccauuug

SEQ ID NO: 705178 - RNA, 21 nt, Homo sapiens
auauuugaauuuuaaaucuaa

SEQ ID NO: 705179 - RNA, 17 nt, Homo sapiens
auauuugcuaugaagcg

SEQ ID NO: 705180 - RNA, 14 nt, Homo sapiens
auauuuuauuuccu

SEQ ID NO: 705181 - RNA, 19 nt, Homo sapiens
aucaaacucaaugcuuuau

SEQ ID NO: 705182 - RNA, 15 nt, Homo sapiens
aucaaagaacaaaca

SEQ ID NO: 705183 - RNA, 17 nt, Homo sapiens
aucaaagcauaagcuca

SEQ ID NO: 705184 - RNA, 15 nt, Homo sapiens
aucaauauacauaau

SEQ ID NO: 705185 - RNA, 14 nt, Homo sapiens
aucacaaaugacuu

SEQ ID NO: 705186 - RNA, 16 nt, Homo sapiens
aucacagccucugaaa

SEQ ID NO: 705187 - RNA, 11 nt, Homo sapiens
aucaccagaca

SEQ ID NO: 705188 - RNA, 20 nt, Homo sapiens
aucacugccacacucuccau

SEQ ID NO: 705189 - RNA, 19 nt, Homo sapiens
aucaggaauauuuuccaaa

SEQ ID NO: 705190 - RNA, 13 nt, Homo sapiens
aucagucaugugu

SEQ ID NO: 705191 - RNA, 16 nt, Homo sapiens
aucauaguuacugugu

SEQ ID NO: 705192 - RNA, 17 nt, Homo sapiens
aucaucacccuuucauu

SEQ ID NO: 705193 - RNA, 19 nt, Homo sapiens
aucaucauccuacaacuca

SEQ ID NO: 705194 - RNA, 23 nt, Homo sapiens
aucauguauggugauagguaucu

SEQ ID NO: 705195 - RNA, 19 nt, Homo sapiens
aucauguccauacacuuug

SEQ ID NO: 705196 - RNA, 19 nt, Homo sapiens
aucauguuaccauuacaaa

SEQ ID NO: 705197 - RNA, 22 nt, Homo sapiens
auccacccaacccuaucuccug

SEQ ID NO: 705198 - RNA, 21 nt, Homo sapiens
auccagacucagagcucucuc

SEQ ID NO: 705199 - RNA, 16 nt, Homo sapiens
auccagccucauaaag

SEQ ID NO: 705200 - RNA, 17 nt, Homo sapiens
auccauaacuuuagucu

SEQ ID NO: 705201 - RNA, 15 nt, Homo sapiens
aucccacauccaacu

SEQ ID NO: 705202 - RNA, 14 nt, Homo sapiens
aucccucuaaugag

SEQ ID NO: 705203 - RNA, 16 nt, Homo sapiens
auccgcgugugccugu

SEQ ID NO: 705204 - RNA, 13 nt, Homo sapiens
auccugaccagcu

SEQ ID NO: 705205 - RNA, 19 nt, Homo sapiens
aucgagaccauccuggcua

SEQ ID NO: 705206 - RNA, 18 nt, Homo sapiens
aucguccucccaggccag

SEQ ID NO: 705207 - RNA, 13 nt, Homo sapiens
aucuacacuucgc

SEQ ID NO: 705208 - RNA, 13 nt, Homo sapiens
aucuauuuauuaa

SEQ ID NO: 705209 - RNA, 17 nt, Homo sapiens
aucucaaugaaccauaa

SEQ ID NO: 705210 - RNA, 21 nt, Homo sapiens
aucuccugacagaaggugcca

SEQ ID NO: 705211 - RNA, 13 nt, Homo sapiens
aucucugccauau

SEQ ID NO: 705212 - RNA, 20 nt, Homo sapiens
aucucugccauaucagugaa

SEQ ID NO: 705213 - RNA, 19 nt, Homo sapiens
aucuguugauaaauccauc

SEQ ID NO: 705214 - RNA, 19 nt, Homo sapiens
aucuuauaugggaaaccau

SEQ ID NO: 705215 - RNA, 17 nt, Homo sapiens
aucuugaauccuuccau

SEQ ID NO: 705216 - RNA, 15 nt, Homo sapiens
aucuugauacauuca

SEQ ID NO: 705217 - RNA, 22 nt, Homo sapiens
augaaaacauagcaucucagga

SEQ ID NO: 705218 - RNA, 20 nt, Homo sapiens
augaaaggcaggccuauuuc

SEQ ID NO: 705219 - RNA, 19 nt, Homo sapiens
augaaauggaggaucucua

SEQ ID NO: 705220 - RNA, 16 nt, Homo sapiens
augaaggcagagccau

SEQ ID NO: 705221 - RNA, 13 nt, Homo sapiens
augaaucaaaagu

SEQ ID NO: 705222 - RNA, 14 nt, Homo sapiens
augacaucagcaau

SEQ ID NO: 705223 - RNA, 13 nt, Homo sapiens
augacugcacaug

SEQ ID NO: 705224 - RNA, 16 nt, Homo sapiens
augagacucagugcag

SEQ ID NO: 705225 - RNA, 19 nt, Homo sapiens
augaguuucuuaacccuuu

SEQ ID NO: 705226 - RNA, 14 nt, Homo sapiens
augauacuucccac

SEQ ID NO: 705227 - RNA, 14 nt, Homo sapiens
augaugugcaaaac

SEQ ID NO: 705228 - RNA, 15 nt, Homo sapiens
augauuaaacuuccu

SEQ ID NO: 705229 - RNA, 17 nt, Homo sapiens
augauuguuauguguau

SEQ ID NO: 705230 - RNA, 22 nt, Homo sapiens
augcaaacugggaugaaacuaa

SEQ ID NO: 705231 - RNA, 19 nt, Homo sapiens
augcaaaugagcucugaaa

SEQ ID NO: 705232 - RNA, 19 nt, Homo sapiens
augcacuuggccugacuca

SEQ ID NO: 705233 - RNA, 20 nt, Homo sapiens
augcaguugcagugaauuca

SEQ ID NO: 705234 - RNA, 19 nt, Homo sapiens
augcaugcuucuucucaaa

SEQ ID NO: 705235 - RNA, 18 nt, Homo sapiens
augccagcuuaucucagg

SEQ ID NO: 705236 - RNA, 15 nt, Homo sapiens
augccuaucugacca

SEQ ID NO: 705237 - RNA, 14 nt, Homo sapiens
augcggccauucaa

SEQ ID NO: 705238 - RNA, 15 nt, Homo sapiens
augcuaaaaauguca

SEQ ID NO: 705239 - RNA, 21 nt, Homo sapiens
augcuccaucccaaccaggca

SEQ ID NO: 705240 - RNA, 23 nt, Homo sapiens
augcugacacuuuuucagggcug

SEQ ID NO: 705241 - RNA, 15 nt, Homo sapiens
augcuuccuugccug

SEQ ID NO: 705242 - RNA, 15 nt, Homo sapiens
auggaaaacuguguu

SEQ ID NO: 705243 - RNA, 21 nt, Homo sapiens
auggaggaucucuaaagagca

SEQ ID NO: 705244 - RNA, 14 nt, Homo sapiens
auggcucagggugg

SEQ ID NO: 705245 - RNA, 20 nt, Homo sapiens
augggcucuccggggccauu

SEQ ID NO: 705246 - RNA, 16 nt, Homo sapiens
auggugaaugaaguca

SEQ ID NO: 705247 - RNA, 15 nt, Homo sapiens
auggugcacugagcu

SEQ ID NO: 705248 - RNA, 15 nt, Homo sapiens
augguuugacucauc

SEQ ID NO: 705249 - RNA, 12 nt, Homo sapiens
auguaagcacuc

SEQ ID NO: 705250 - RNA, 12 nt, Homo sapiens
auguaagcucuu

SEQ ID NO: 705251 - RNA, 18 nt, Homo sapiens
auguagcagugagucaua

SEQ ID NO: 705252 - RNA, 18 nt, Homo sapiens
auguaggcaucaugcaug

SEQ ID NO: 705253 - RNA, 16 nt, Homo sapiens
auguauguguaccuaa

SEQ ID NO: 705254 - RNA, 17 nt, Homo sapiens
auguauguguaccuaag

SEQ ID NO: 705255 - RNA, 20 nt, Homo sapiens
auguauguuuggcucugcuu

SEQ ID NO: 705256 - RNA, 17 nt, Homo sapiens
augucagaagugcagaa

SEQ ID NO: 705257 - RNA, 20 nt, Homo sapiens
auguccagcaccuugugccu

SEQ ID NO: 705258 - RNA, 18 nt, Homo sapiens
augucuucauucccaagg

SEQ ID NO: 705259 - RNA, 22 nt, Homo sapiens
augugaauaaauucuauaggaa

SEQ ID NO: 705260 - RNA, 20 nt, Homo sapiens
augugcugacaaggcacuuc

SEQ ID NO: 705261 - RNA, 16 nt, Homo sapiens
auguguaccuaaggga

SEQ ID NO: 705262 - RNA, 20 nt, Homo sapiens
auguguucucggagugugua

SEQ ID NO: 705263 - RNA, 18 nt, Homo sapiens
auguguuuuagaugguuu

SEQ ID NO: 705264 - RNA, 15 nt, Homo sapiens
auguugaucauguac

SEQ ID NO: 705265 - RNA, 18 nt, Homo sapiens
auguugccauguguuuua

SEQ ID NO: 705266 - RNA, 18 nt, Homo sapiens
auguugggaaacuuggcu

SEQ ID NO: 705267 - RNA, 15 nt, Homo sapiens
auguuugccuagaca

SEQ ID NO: 705268 - RNA, 16 nt, Homo sapiens
auguuuguccugaaca

SEQ ID NO: 705269 - RNA, 21 nt, Homo sapiens
auguuuuuuaaacuaguuuau

SEQ ID NO: 705270 - RNA, 13 nt, Homo sapiens
auuaaaacacuua

SEQ ID NO: 705271 - RNA, 23 nt, Homo sapiens
auuaaacuucauauguaaucucu

SEQ ID NO: 705272 - RNA, 19 nt, Homo sapiens
auuaaagaauguuuuggaa

SEQ ID NO: 705273 - RNA, 15 nt, Homo sapiens
auuaaauauauacug

SEQ ID NO: 705274 - RNA, 19 nt, Homo sapiens
auuaaauucugagccugau

SEQ ID NO: 705275 - RNA, 21 nt, Homo sapiens
cccuaaugccuaucugaccaa

SEQ ID NO: 705276 - RNA, 18 nt, Homo sapiens
cccuacuauucaguggcg

SEQ ID NO: 705277 - RNA, 22 nt, Homo sapiens
cccuaggaaggugaaucugccc

SEQ ID NO: 705278 - RNA, 21 nt, Homo sapiens
cccuauugcugcuugaggcaa

SEQ ID NO: 705279 - RNA, 14 nt, Homo sapiens
cccucccacaccca

SEQ ID NO: 705280 - RNA, 18 nt, Homo sapiens
cccugagcuuucugcuau

SEQ ID NO: 705281 - RNA, 16 nt, Homo sapiens
cccugcugcuggugca

SEQ ID NO: 705282 - RNA, 19 nt, Homo sapiens
cccuggccuccccugccac

SEQ ID NO: 705283 - RNA, 21 nt, Homo sapiens
cccuguaggguccaaccagac

SEQ ID NO: 705284 - RNA, 17 nt, Homo sapiens
cccuuaacugcauccag

SEQ ID NO: 705285 - RNA, 21 nt, Homo sapiens
cccuucuucacacagacacua

SEQ ID NO: 705286 - RNA, 14 nt, Homo sapiens
ccgaauaaauguuu

SEQ ID NO: 705287 - RNA, 22 nt, Homo sapiens
ccgaauugucuuuggugcuuuu

SEQ ID NO: 705288 - RNA, 22 nt, Homo sapiens
ccgagcuuugaaaauucagugg

SEQ ID NO: 705289 - RNA, 23 nt, Homo sapiens
ccgcauccgggguucaagccauu

SEQ ID NO: 705290 - RNA, 15 nt, Homo sapiens
ccggcccugugugca

SEQ ID NO: 705291 - RNA, 13 nt, Homo sapiens
ccgugccaaaaau

SEQ ID NO: 705292 - RNA, 15 nt, Homo sapiens
ccuaaccccuuccag

SEQ ID NO: 705293 - RNA, 17 nt, Homo sapiens
ccuagaacacuaacuca

SEQ ID NO: 705294 - RNA, 18 nt, Homo sapiens
ccuagacagcuuuucuca

SEQ ID NO: 705295 - RNA, 17 nt, Homo sapiens
ccuaggcauuugcugaa

SEQ ID NO: 705296 - RNA, 21 nt, Homo sapiens
ccuaguuaguguuuugccuca

SEQ ID NO: 705297 - RNA, 15 nt, Homo sapiens
ccucaauguccccaa

SEQ ID NO: 705298 - RNA, 22 nt, Homo sapiens
ccucaccuagccugaugagauu

SEQ ID NO: 705299 - RNA, 19 nt, Homo sapiens
ccucacuggggcagacaau

SEQ ID NO: 705300 - RNA, 20 nt, Homo sapiens
ccucacuggggcagacaaua

SEQ ID NO: 705301 - RNA, 19 nt, Homo sapiens
ccucauuagcauuuugcua

SEQ ID NO: 705302 - RNA, 12 nt, Homo sapiens
ccucccaggaag

SEQ ID NO: 705303 - RNA, 17 nt, Homo sapiens
ccucccaggccaggcuc

SEQ ID NO: 705304 - RNA, 15 nt, Homo sapiens
ccucccccaguuccu

SEQ ID NO: 705305 - RNA, 20 nt, Homo sapiens
ccuccucgugaaagugcauu

SEQ ID NO: 705306 - RNA, 12 nt, Homo sapiens
ccuccugaaccg

SEQ ID NO: 705307 - RNA, 18 nt, Homo sapiens
ccucggccccucccacac

SEQ ID NO: 705308 - RNA, 14 nt, Homo sapiens
ccucggucacucca

SEQ ID NO: 705309 - RNA, 14 nt, Homo sapiens
ccucuagaagccaa

SEQ ID NO: 705310 - RNA, 13 nt, Homo sapiens
ccucuccauuugc

SEQ ID NO: 705311 - RNA, 22 nt, Homo sapiens
ccucucccaaaaaacuacuucu

SEQ ID NO: 705312 - RNA, 23 nt, Homo sapiens
ccucuccuacucggcucugcagu

SEQ ID NO: 705313 - RNA, 21 nt, Homo sapiens
ccucucuaagugggcauugcc

SEQ ID NO: 705314 - RNA, 23 nt, Homo sapiens
ccucucuagcacaauuugcacua

SEQ ID NO: 705315 - RNA, 16 nt, Homo sapiens
ccucugaacuugccuu

SEQ ID NO: 705316 - RNA, 16 nt, Homo sapiens
ccucuggagcccuaac

SEQ ID NO: 705317 - RNA, 16 nt, Homo sapiens
ccugaacuuacacaaa

SEQ ID NO: 705318 - RNA, 22 nt, Homo sapiens
ccugacagaaggugccacuuua

SEQ ID NO: 705319 - RNA, 20 nt, Homo sapiens
ccugagcccuacucccugca

SEQ ID NO: 705320 - RNA, 17 nt, Homo sapiens
ccugcaccccugcaguu

SEQ ID NO: 705321 - RNA, 16 nt, Homo sapiens
ccugccgucugugcuu

SEQ ID NO: 705322 - RNA, 17 nt, Homo sapiens
ccugcugcuggugcaca

SEQ ID NO: 705323 - RNA, 12 nt, Homo sapiens
ccugcugugauu

SEQ ID NO: 705324 - RNA, 14 nt, Homo sapiens
ccuggagauccucc

SEQ ID NO: 705325 - RNA, 22 nt, Homo sapiens
ccuggaguguaugacugcacau

SEQ ID NO: 705326 - RNA, 12 nt, Homo sapiens
ccuggcaagaau

SEQ ID NO: 705327 - RNA, 20 nt, Homo sapiens
ccuggccaacaugaugaaac

SEQ ID NO: 705328 - RNA, 21 nt, Homo sapiens
ccuggcuccaacacugcugcu

SEQ ID NO: 705329 - RNA, 17 nt, Homo sapiens
ccugggaaauaagcccc

SEQ ID NO: 705330 - RNA, 14 nt, Homo sapiens
ccugggcaauguga

SEQ ID NO: 705331 - RNA, 23 nt, Homo sapiens
ccugggcuuggccugcugugauu

SEQ ID NO: 705332 - RNA, 15 nt, Homo sapiens
ccuggugcugcugcu

SEQ ID NO: 705333 - RNA, 20 nt, Homo sapiens
ccuguaaucccagcuacucg

SEQ ID NO: 705334 - RNA, 23 nt, Homo sapiens
ccuguagcaaccuucugcauuca

SEQ ID NO: 705335 - RNA, 20 nt, Homo sapiens
ccuguauucuucaaccagug

SEQ ID NO: 705336 - RNA, 18 nt, Homo sapiens
ccuguccugacucucucc

SEQ ID NO: 705337 - RNA, 16 nt, Homo sapiens
ccugugacugucucac

SEQ ID NO: 705338 - RNA, 18 nt, Homo sapiens
ccuuaauuuccuuuuuga

SEQ ID NO: 705339 - RNA, 18 nt, Homo sapiens
ccuuacagaacuacuucu

SEQ ID NO: 705340 - RNA, 16 nt, Homo sapiens
ccuucuaguuaccaca

SEQ ID NO: 705341 - RNA, 17 nt, Homo sapiens
ccuucucuuaguuauug

SEQ ID NO: 705342 - RNA, 14 nt, Homo sapiens
ccuucuuuaaacac

SEQ ID NO: 705343 - RNA, 17 nt, Homo sapiens
ccuucuuugucuugccc

SEQ ID NO: 705344 - RNA, 17 nt, Homo sapiens
ccuugagggcugcaguu

SEQ ID NO: 705345 - RNA, 20 nt, Homo sapiens
ccuugagugcucuugcuauu

SEQ ID NO: 705346 - RNA, 15 nt, Homo sapiens
ccuugccugaugaca

SEQ ID NO: 705347 - RNA, 20 nt, Homo sapiens
ccuugggcuauuuggacuca

SEQ ID NO: 705348 - RNA, 14 nt, Homo sapiens
ccuuguaaaagaca

SEQ ID NO: 705349 - RNA, 21 nt, Homo sapiens
ccuuuaccuuuuaugcaaaag

SEQ ID NO: 705350 - RNA, 19 nt, Homo sapiens
ccuuucccccuucucuuag

SEQ ID NO: 705351 - RNA, 13 nt, Homo sapiens
ccuuuuaugcaaa

SEQ ID NO: 705352 - RNA, 12 nt, Homo sapiens
ccuuuucagggc

SEQ ID NO: 705353 - RNA, 11 nt, Homo sapiens
ccuuuugcaac

SEQ ID NO: 705354 - RNA, 12 nt, Homo sapiens
ccuuuugugcaa

SEQ ID NO: 705355 - RNA, 22 nt, Homo sapiens
ccuuuuuucaaaauccaaaaag

SEQ ID NO: 705356 - RNA, 16 nt, Homo sapiens
cgaauugucuuuggug

SEQ ID NO: 705357 - RNA, 18 nt, Homo sapiens
cgaccagaggagccuuuu

SEQ ID NO: 705358 - RNA, 18 nt, Homo sapiens
cgacuuucugccuggagu

SEQ ID NO: 705359 - RNA, 20 nt, Homo sapiens
cgagaccgggcccuggguuc

SEQ ID NO: 705360 - RNA, 15 nt, Homo sapiens
cgagacuccgucuca

SEQ ID NO: 705361 - RNA, 17 nt, Homo sapiens
cgagaggugggccaguc

SEQ ID NO: 705362 - RNA, 19 nt, Homo sapiens
cgagaucgcgccacugcac

SEQ ID NO: 705363 - RNA, 16 nt, Homo sapiens
cgaggacccaggaaag

SEQ ID NO: 705364 - RNA, 23 nt, Homo sapiens
cgaugauguacagauucuuucag

SEQ ID NO: 705365 - RNA, 21 nt, Homo sapiens
cgauguuauuagauguuacaa

SEQ ID NO: 705366 - RNA, 22 nt, Homo sapiens
cgcaaugcuucuagaguuuuau

SEQ ID NO: 705367 - RNA, 20 nt, Homo sapiens
cgcaccggagugucuggaau

SEQ ID NO: 705368 - RNA, 14 nt, Homo sapiens
cgcaucauaugcag

SEQ ID NO: 705369 - RNA, 17 nt, Homo sapiens
cgccuccccaccuccag

SEQ ID NO: 705370 - RNA, 16 nt, Homo sapiens
cgcgugccguggcacc

SEQ ID NO: 705371 - RNA, 18 nt, Homo sapiens
cgcugugucagcauagaa

SEQ ID NO: 705372 - RNA, 13 nt, Homo sapiens
cggacucacuucu

SEQ ID NO: 705373 - RNA, 20 nt, Homo sapiens
cggagcuugcagugagccga

SEQ ID NO: 705374 - RNA, 14 nt, Homo sapiens
cggaggccagagag

SEQ ID NO: 705375 - RNA, 14 nt, Homo sapiens
cggcccugaccaau

SEQ ID NO: 705376 - RNA, 13 nt, Homo sapiens
cggcucugcaguc

SEQ ID NO: 705377 - RNA, 11 nt, Homo sapiens
cggcugaccau

SEQ ID NO: 705378 - RNA, 19 nt, Homo sapiens
cggggaagagauccaaaga

SEQ ID NO: 705379 - RNA, 20 nt, Homo sapiens
cggggaggcuccugccugag

SEQ ID NO: 705380 - RNA, 12 nt, Homo sapiens
cgguacccgggg

SEQ ID NO: 705381 - RNA, 11 nt, Homo sapiens
cgguccagcug

SEQ ID NO: 705382 - RNA, 15 nt, Homo sapiens
cguacauaauacuga

SEQ ID NO: 705383 - RNA, 20 nt, Homo sapiens
cgucagauguuuaaaacacc

SEQ ID NO: 705384 - RNA, 15 nt, Homo sapiens
cguccaucucccuua

SEQ ID NO: 705385 - RNA, 14 nt, Homo sapiens
cgucgucaccaaau

SEQ ID NO: 705386 - RNA, 16 nt, Homo sapiens
cgugaaagcagaugag

SEQ ID NO: 705387 - RNA, 14 nt, Homo sapiens
cgugacaagugccu

SEQ ID NO: 705388 - RNA, 23 nt, Homo sapiens
cguuccuguuagcauaaugugag

SEQ ID NO: 705389 - RNA, 17 nt, Homo sapiens
cuaaaacuuaacauuca

SEQ ID NO: 705390 - RNA, 18 nt, Homo sapiens
cuaaagagagaugaacca

SEQ ID NO: 705391 - RNA, 17 nt, Homo sapiens
cuaaauaagaaaauaac

SEQ ID NO: 705392 - RNA, 13 nt, Homo sapiens
cuaaaucagagac

SEQ ID NO: 705393 - RNA, 19 nt, Homo sapiens
aaaguauucuucucuuccu

SEQ ID NO: 705394 - RNA, 15 nt, Homo sapiens
aaagucagagacaga

SEQ ID NO: 705395 - RNA, 21 nt, Homo sapiens
aaagucagagacagauaccuc

SEQ ID NO: 705396 - RNA, 17 nt, Homo sapiens
aaagugccuuugcagcu

SEQ ID NO: 705397 - RNA, 13 nt, Homo sapiens
aaagugcuuuaaa

SEQ ID NO: 705398 - RNA, 14 nt, Homo sapiens
aaagugugagcaaa

SEQ ID NO: 705399 - RNA, 16 nt, Homo sapiens
aaaguucucaaugcaa

SEQ ID NO: 705400 - RNA, 16 nt, Homo sapiens
aaauaaaaaucucuuu

SEQ ID NO: 705401 - RNA, 13 nt, Homo sapiens
aaauaaacacaca

SEQ ID NO: 705402 - RNA, 19 nt, Homo sapiens
aaauaauagaaaugucuca

SEQ ID NO: 705403 - RNA, 20 nt, Homo sapiens
aaauagauaaacuauacacu

SEQ ID NO: 705404 - RNA, 13 nt, Homo sapiens
aaauagauccaau

SEQ ID NO: 705405 - RNA, 13 nt, Homo sapiens
aaauauacauuca

SEQ ID NO: 705406 - RNA, 21 nt, Homo sapiens
aaauaucaaagucauuaaaga

SEQ ID NO: 705407 - RNA, 22 nt, Homo sapiens
aaauauccaagauuuaaaugcc

SEQ ID NO: 705408 - RNA, 18 nt, Homo sapiens
aaauaucuuggccuaaac

SEQ ID NO: 705409 - RNA, 22 nt, Homo sapiens
agugcuuggaacauacuguuca

SEQ ID NO: 705410 - RNA, 17 nt, Homo sapiens
agugcuuguuccucuca

SEQ ID NO: 705411 - RNA, 15 nt, Homo sapiens
agugggcauugccau

SEQ ID NO: 705412 - RNA, 15 nt, Homo sapiens
agugggggaucacag

SEQ ID NO: 705413 - RNA, 13 nt, Homo sapiens
agugggugaauaa

SEQ ID NO: 705414 - RNA, 19 nt, Homo sapiens
agugggugaauaauacagu

SEQ ID NO: 705415 - RNA, 18 nt, Homo sapiens
aguguaugacugcacaug

SEQ ID NO: 705416 - RNA, 23 nt, Homo sapiens
aguguauuuauuuuacagcucau

SEQ ID NO: 705417 - RNA, 22 nt, Homo sapiens
agugugaggcggcccugaccaa

SEQ ID NO: 705418 - RNA, 21 nt, Homo sapiens
aguuaauucucauuaauacuc

SEQ ID NO: 705419 - RNA, 19 nt, Homo sapiens
aguuacuguguaaacucau

SEQ ID NO: 705420 - RNA, 19 nt, Homo sapiens
auuguauauuguaauuuaa

SEQ ID NO: 705421 - RNA, 22 nt, Homo sapiens
auugucucccuuccagcaauaa

SEQ ID NO: 705422 - RNA, 21 nt, Homo sapiens
auugucuuuggugcuuuucac

SEQ ID NO: 705423 - RNA, 17 nt, Homo sapiens
auugugaaccaugguga

SEQ ID NO: 705424 - RNA, 16 nt, Homo sapiens
auugugcuucacagua

SEQ ID NO: 705425 - RNA, 19 nt, Homo sapiens
auuguugacaacugugacu

SEQ ID NO: 705426 - RNA, 21 nt, Homo sapiens
auuguuugguaaauguuucuu

SEQ ID NO: 705427 - RNA, 18 nt, Homo sapiens
auuuaaaaaaaaagucag

SEQ ID NO: 705428 - RNA, 24 nt, Homo sapiens
auuuaaaaaaaaagucagagacag

SEQ ID NO: 705429 - RNA, 13 nt, Homo sapiens
auuuacaagggaa

SEQ ID NO: 705430 - RNA, 14 nt, Homo sapiens
auuuacaagggaag

SEQ ID NO: 705431 - RNA, 11 nt, Homo sapiens
auuuacuacag

SEQ ID NO: 705432 - RNA, 20 nt, Homo sapiens
auuuauaauaaaucaguaua

SEQ ID NO: 705433 - RNA, 22 nt, Homo sapiens
auuuaucguauagguugaugaa

SEQ ID NO: 705434 - RNA, 18 nt, Homo sapiens
auuuauuuuccuaaagag

SEQ ID NO: 705435 - RNA, 15 nt, Homo sapiens
auuucagaagccuaa

SEQ ID NO: 705436 - RNA, 20 nt, Homo sapiens
auuucagugaauuugcacug

SEQ ID NO: 705437 - RNA, 18 nt, Homo sapiens
auuuccagaaauacaauu

SEQ ID NO: 705438 - RNA, 22 nt, Homo sapiens
auuuccagaaccacacuugaaa

SEQ ID NO: 705439 - RNA, 19 nt, Homo sapiens
auuucccauuugugccaga

SEQ ID NO: 705440 - RNA, 23 nt, Homo sapiens
auuucccauuugugccagaggaa

SEQ ID NO: 705441 - RNA, 20 nt, Homo sapiens
auuuccuuacagaacuacuu

SEQ ID NO: 705442 - RNA, 20 nt, Homo sapiens
auuuccuuuuugacacugaa

SEQ ID NO: 705443 - RNA, 24 nt, Homo sapiens
auuucuaaauguuuggcauguaaa

SEQ ID NO: 705444 - RNA, 13 nt, Homo sapiens
auuucuguguugc

SEQ ID NO: 705445 - RNA, 17 nt, Homo sapiens
auuucuuaugugacauu

SEQ ID NO: 705446 - RNA, 16 nt, Homo sapiens
auuucuuguugcucaa

SEQ ID NO: 705447 - RNA, 14 nt, Homo sapiens
auuugaaaugucau

SEQ ID NO: 705448 - RNA, 14 nt, Homo sapiens
auuugaugcauguc

SEQ ID NO: 705449 - RNA, 22 nt, Homo sapiens
auuugauugggaugaaugccau

SEQ ID NO: 705450 - RNA, 16 nt, Homo sapiens
auuugcacuaaaucag

SEQ ID NO: 705451 - RNA, 20 nt, Homo sapiens
auuugucccuaugcauauca

SEQ ID NO: 705452 - RNA, 18 nt, Homo sapiens
auuuguuaaaauuaucaa

SEQ ID NO: 705453 - RNA, 23 nt, Homo sapiens
auuuuaauagggaauauaucucu

SEQ ID NO: 705454 - RNA, 14 nt, Homo sapiens
auuuuacaguaucu

SEQ ID NO: 705455 - RNA, 14 nt, Homo sapiens
auuuucagcauuaa

SEQ ID NO: 705456 - RNA, 17 nt, Homo sapiens
auuuugcacugaggaua

SEQ ID NO: 705457 - RNA, 20 nt, Homo sapiens
auuuuguguaaaaaaaccac

SEQ ID NO: 705458 - RNA, 21 nt, Homo sapiens
auuuuguuuuugucuuaaaaa

SEQ ID NO: 705459 - RNA, 15 nt, Homo sapiens
auuuuuaaauauuca

SEQ ID NO: 705460 - RNA, 13 nt, Homo sapiens
auuuuuacugugu

SEQ ID NO: 705461 - RNA, 15 nt, Homo sapiens
auuuuuagaauuaaa

SEQ ID NO: 705462 - RNA, 22 nt, Homo sapiens
auuuuucaauauauugaacuuu

SEQ ID NO: 705463 - RNA, 16 nt, Homo sapiens
auuuuuuuaaaacaca

SEQ ID NO: 705464 - RNA, 16 nt, Homo sapiens
auuuuuuugaacucuu

SEQ ID NO: 705465 - RNA, 18 nt, Homo sapiens
auuuuuuugcaugcaugc

SEQ ID NO: 705466 - RNA, 16 nt, Homo sapiens
caaaaaaagaaaaaga

SEQ ID NO: 705467 - RNA, 15 nt, Homo sapiens
caaaaaacuacuucu

SEQ ID NO: 705468 - RNA, 19 nt, Homo sapiens
caaaaauaaauuguaauaa

SEQ ID NO: 705469 - RNA, 19 nt, Homo sapiens
caaaauauuuggaaugaag

SEQ ID NO: 705470 - RNA, 13 nt, Homo sapiens
caaaaucaauuaa

SEQ ID NO: 705471 - RNA, 22 nt, Homo sapiens
caaacaggcaguuggccagaga

SEQ ID NO: 705472 - RNA, 15 nt, Homo sapiens
caaacaggguuugau

SEQ ID NO: 705473 - RNA, 21 nt, Homo sapiens
caaacaggguuugauagcacu

SEQ ID NO: 705474 - RNA, 15 nt, Homo sapiens
caaacagugacugua

SEQ ID NO: 705475 - RNA, 19 nt, Homo sapiens
caaacaugcggugccauga

SEQ ID NO: 705476 - RNA, 24 nt, Homo sapiens
caaaccacgccucuugaccaggcu

SEQ ID NO: 705477 - RNA, 14 nt, Homo sapiens
caaaccuaccaaaa

SEQ ID NO: 705478 - RNA, 13 nt, Homo sapiens
caaacgcugaaaa

SEQ ID NO: 705479 - RNA, 16 nt, Homo sapiens
caaagaccgauugcau

SEQ ID NO: 705480 - RNA, 20 nt, Homo sapiens
caaagggccugcccagacaa

SEQ ID NO: 705481 - RNA, 15 nt, Homo sapiens
caaagugccaaagaa

SEQ ID NO: 705482 - RNA, 15 nt, Homo sapiens
caaauacacauuugc

SEQ ID NO: 705483 - RNA, 22 nt, Homo sapiens
caaauagaaccacuaugaagcu

SEQ ID NO: 705484 - RNA, 17 nt, Homo sapiens
caaaucuggaagccaaa

SEQ ID NO: 705485 - RNA, 16 nt, Homo sapiens
caaauucauggugcac

SEQ ID NO: 705486 - RNA, 15 nt, Homo sapiens
caacaagaccaccac

SEQ ID NO: 705487 - RNA, 14 nt, Homo sapiens
caacacugcugcuc

SEQ ID NO: 705488 - RNA, 23 nt, Homo sapiens
caacacugcugcuccagugcagg

SEQ ID NO: 705489 - RNA, 12 nt, Homo sapiens
caaccacaaaac

SEQ ID NO: 705490 - RNA, 13 nt, Homo sapiens
caacccuaucucc

SEQ ID NO: 705491 - RNA, 18 nt, Homo sapiens
caaccggucacccaggag

SEQ ID NO: 705492 - RNA, 15 nt, Homo sapiens
caacuaccauuccuu

SEQ ID NO: 705493 - RNA, 13 nt, Homo sapiens
caacugugacugu

SEQ ID NO: 705494 - RNA, 20 nt, Homo sapiens
caacuuguauuaaagacaga

SEQ ID NO: 705495 - RNA, 14 nt, Homo sapiens
caagaaagcucacu

SEQ ID NO: 705496 - RNA, 21 nt, Homo sapiens
caagagaacucgcgcucagua

SEQ ID NO: 705497 - RNA, 19 nt, Homo sapiens
caagagauaagucuuucau

SEQ ID NO: 705498 - RNA, 21 nt, Homo sapiens
caagaggggguggaggggugu

SEQ ID NO: 705499 - RNA, 18 nt, Homo sapiens
caagaguggacucagugg

SEQ ID NO: 705500 - RNA, 13 nt, Homo sapiens
caagaucaaaaag

SEQ ID NO: 705501 - RNA, 20 nt, Homo sapiens
caagcaggaaccccaggaga

SEQ ID NO: 705502 - RNA, 19 nt, Homo sapiens
caagccaggcucacucaca

SEQ ID NO: 705503 - RNA, 21 nt, Homo sapiens
caaggaaacccccaguguaau

SEQ ID NO: 705504 - RNA, 22 nt, Homo sapiens
caaggaaacccccaguguaaua

SEQ ID NO: 705505 - RNA, 16 nt, Homo sapiens
caaguaaaaaggcuaa

SEQ ID NO: 705506 - RNA, 23 nt, Homo sapiens
caaguaaaaaggcuaaauggaag

SEQ ID NO: 705507 - RNA, 20 nt, Homo sapiens
caaguauagccuauggcaga

SEQ ID NO: 705508 - RNA, 16 nt, Homo sapiens
caagucacacgcuuuu

SEQ ID NO: 705509 - RNA, 13 nt, Homo sapiens
caagugccuucac

SEQ ID NO: 705510 - RNA, 20 nt, Homo sapiens
caaguugcaucagaaagcuu

SEQ ID NO: 705511 - RNA, 18 nt, Homo sapiens
caauauacauaauacaug

SEQ ID NO: 705512 - RNA, 22 nt, Homo sapiens
caauauuuuuauaucaugcaaa

SEQ ID NO: 705513 - RNA, 18 nt, Homo sapiens
caaucucugccauaucag

SEQ ID NO: 705514 - RNA, 20 nt, Homo sapiens
caaugaaguugaaaaucaua

SEQ ID NO: 705515 - RNA, 17 nt, Homo sapiens
caauggcuuguucauca

SEQ ID NO: 705516 - RNA, 22 nt, Homo sapiens
caauguacaguugaaauaacug

SEQ ID NO: 705517 - RNA, 16 nt, Homo sapiens
caauuaguaacauuca

SEQ ID NO: 705518 - RNA, 12 nt, Homo sapiens
caauucuaguca

SEQ ID NO: 705519 - RNA, 21 nt, Homo sapiens
caauuucccuucauacuccuu

SEQ ID NO: 705520 - RNA, 17 nt, Homo sapiens
cacaagaccaagguaua

SEQ ID NO: 705521 - RNA, 14 nt, Homo sapiens
cacaauaaccaaga

SEQ ID NO: 705522 - RNA, 15 nt, Homo sapiens
cacaauuucccuuca

SEQ ID NO: 705523 - RNA, 19 nt, Homo sapiens
cacacagaaugcaaccaag

SEQ ID NO: 705524 - RNA, 16 nt, Homo sapiens
cacacccgugagaaau

SEQ ID NO: 705525 - RNA, 15 nt, Homo sapiens
cacagacacuaacga

SEQ ID NO: 705526 - RNA, 22 nt, Homo sapiens
cacauauauauuacaagggaua

SEQ ID NO: 705527 - RNA, 17 nt, Homo sapiens
cacauuucuaugccaaa

SEQ ID NO: 705528 - RNA, 14 nt, Homo sapiens
caccaaagcugccc

SEQ ID NO: 705529 - RNA, 18 nt, Homo sapiens
caccacgggacaucacag

SEQ ID NO: 705530 - RNA, 23 nt, Homo sapiens
caccacuuccgucccauccuugc

SEQ ID NO: 705531 - RNA, 18 nt, Homo sapiens
caccagccccacugccag

SEQ ID NO: 705532 - RNA, 19 nt, Homo sapiens
caccauacacauucuuaga

SEQ ID NO: 705533 - RNA, 20 nt, Homo sapiens
cacccaggcuggacugcaau

SEQ ID NO: 705534 - RNA, 13 nt, Homo sapiens
cacccaugcaagc

SEQ ID NO: 705535 - RNA, 12 nt, Homo sapiens
caccccuaccac

SEQ ID NO: 705536 - RNA, 16 nt, Homo sapiens
cacccucuuccuguga

SEQ ID NO: 705537 - RNA, 18 nt, Homo sapiens
cacccucuuccugugauc

SEQ ID NO: 705538 - RNA, 15 nt, Homo sapiens
cacccugaaagcccu

SEQ ID NO: 705539 - RNA, 20 nt, Homo sapiens
cacccugcugcuggugcaca

SEQ ID NO: 705540 - RNA, 12 nt, Homo sapiens
caccgcaguuuu

SEQ ID NO: 705541 - RNA, 16 nt, Homo sapiens
caccucugcacaagcu

SEQ ID NO: 705542 - RNA, 15 nt, Homo sapiens
caccucuuccuugau

SEQ ID NO: 705543 - RNA, 17 nt, Homo sapiens
caccuugccuugcuguu

SEQ ID NO: 705544 - RNA, 16 nt, Homo sapiens
cacgaccauuugauag

SEQ ID NO: 705545 - RNA, 18 nt, Homo sapiens
cacgcggauuaauuugca

SEQ ID NO: 705546 - RNA, 18 nt, Homo sapiens
cacuaauugguacuuuua

SEQ ID NO: 705547 - RNA, 16 nt, Homo sapiens
cacuauucuugaauua

SEQ ID NO: 705548 - RNA, 15 nt, Homo sapiens
cacucacagagucaa

SEQ ID NO: 705549 - RNA, 14 nt, Homo sapiens
cacugccacacucu

SEQ ID NO: 705550 - RNA, 19 nt, Homo sapiens
cacugccaggccagccucc

SEQ ID NO: 705551 - RNA, 16 nt, Homo sapiens
cacuggggcagacaau

SEQ ID NO: 705552 - RNA, 14 nt, Homo sapiens
cacugugcuuucag

SEQ ID NO: 705553 - RNA, 17 nt, Homo sapiens
cacuucauguaaagugu

SEQ ID NO: 705554 - RNA, 15 nt, Homo sapiens
cacuugaugauacaa

SEQ ID NO: 705555 - RNA, 13 nt, Homo sapiens
cacuuuacuacuc

SEQ ID NO: 705556 - RNA, 16 nt, Homo sapiens
cacuuuguugcaagau

SEQ ID NO: 705557 - RNA, 15 nt, Homo sapiens
cagaaauggacugga

SEQ ID NO: 705558 - RNA, 14 nt, Homo sapiens
cagaacuugaaugu

SEQ ID NO: 705559 - RNA, 21 nt, Homo sapiens
cagaaucccuuaacaguugua

SEQ ID NO: 705560 - RNA, 20 nt, Homo sapiens
cagacacuaacgaaauauca

SEQ ID NO: 705561 - RNA, 22 nt, Homo sapiens
cagacuuggcucagcucgggga

SEQ ID NO: 705562 - RNA, 15 nt, Homo sapiens
cagagaaaucugcau

SEQ ID NO: 705563 - RNA, 17 nt, Homo sapiens
cagagacacuguugaua

SEQ ID NO: 705564 - RNA, 12 nt, Homo sapiens
cagagacagaua

SEQ ID NO: 705565 - RNA, 18 nt, Homo sapiens
cagagacagauaccucca

SEQ ID NO: 705566 - RNA, 24 nt, Homo sapiens
cagagcaagagauaagucuuucau

SEQ ID NO: 705567 - RNA, 15 nt, Homo sapiens
cagagcgcaccucaa

SEQ ID NO: 705568 - RNA, 12 nt, Homo sapiens
cagaguuuucau

SEQ ID NO: 705569 - RNA, 19 nt, Homo sapiens
cagaucacugccacacucu

SEQ ID NO: 705570 - RNA, 12 nt, Homo sapiens
cagaucuuucag

SEQ ID NO: 705571 - RNA, 14 nt, Homo sapiens
cagaugugcugaca

SEQ ID NO: 705572 - RNA, 21 nt, Homo sapiens
cagauuaaacuucauauguaa

SEQ ID NO: 705573 - RNA, 16 nt, Homo sapiens
cagcagaaaaucuuuu

SEQ ID NO: 705574 - RNA, 21 nt, Homo sapiens
cagcaugaaaaugcaguuucu

SEQ ID NO: 705575 - RNA, 18 nt, Homo sapiens
cagcauuuagucuugcca

SEQ ID NO: 705576 - RNA, 14 nt, Homo sapiens
cagccaaguuuuau

SEQ ID NO: 705577 - RNA, 22 nt, Homo sapiens
cagccaaguuuuauaauccuua

SEQ ID NO: 705578 - RNA, 15 nt, Homo sapiens
cagccaugccagcug

SEQ ID NO: 705579 - RNA, 15 nt, Homo sapiens
cagcccacccugcug

SEQ ID NO: 705580 - RNA, 21 nt, Homo sapiens
cagcccagagacuuuguagau

SEQ ID NO: 705581 - RNA, 16 nt, Homo sapiens
cagccucccccggcuc

SEQ ID NO: 705582 - RNA, 17 nt, Homo sapiens
cagccuccccgugccaa

SEQ ID NO: 705583 - RNA, 18 nt, Homo sapiens
cagccuccccgugccaaa

SEQ ID NO: 705584 - RNA, 17 nt, Homo sapiens
cagccucccuuugauga

SEQ ID NO: 705585 - RNA, 22 nt, Homo sapiens
cagccucugaaaaccaauguuc

SEQ ID NO: 705586 - RNA, 16 nt, Homo sapiens
cagccuuaugauuaaa

SEQ ID NO: 705587 - RNA, 15 nt, Homo sapiens
cagcuaugcaaaaag

SEQ ID NO: 705588 - RNA, 22 nt, Homo sapiens
cagcucaaugcaguuagcugaa

SEQ ID NO: 705589 - RNA, 16 nt, Homo sapiens
cagcugcgcuugcuuu

SEQ ID NO: 705590 - RNA, 20 nt, Homo sapiens
cagcuuggggccaccaaagc

SEQ ID NO: 705591 - RNA, 23 nt, Homo sapiens
caggaaaauuguuugaacccagg

SEQ ID NO: 705592 - RNA, 19 nt, Homo sapiens
caggaaauaaauuguaaaa

SEQ ID NO: 705593 - RNA, 21 nt, Homo sapiens
caggaagcccaggagccucac

SEQ ID NO: 705594 - RNA, 16 nt, Homo sapiens
caggaauguguggccu

SEQ ID NO: 705595 - RNA, 16 nt, Homo sapiens
caggacuuguuuacaa

SEQ ID NO: 705596 - RNA, 19 nt, Homo sapiens
caggacuuguuuacaaaga

SEQ ID NO: 705597 - RNA, 17 nt, Homo sapiens
caggagaccuggcacug

SEQ ID NO: 705598 - RNA, 19 nt, Homo sapiens
caggagagacagugaggcu

SEQ ID NO: 705599 - RNA, 17 nt, Homo sapiens
caggagcaggcacgggu

SEQ ID NO: 705600 - RNA, 22 nt, Homo sapiens
caggagguggaggcugcaguga

SEQ ID NO: 705601 - RNA, 20 nt, Homo sapiens
caggaguguggccacguggg

SEQ ID NO: 705602 - RNA, 18 nt, Homo sapiens
caggaguuacuggauuug

SEQ ID NO: 705603 - RNA, 17 nt, Homo sapiens
caggauaucacauugga

SEQ ID NO: 705604 - RNA, 19 nt, Homo sapiens
caggcaccucuuccuugau

SEQ ID NO: 705605 - RNA, 14 nt, Homo sapiens
caggcagauuugag

SEQ ID NO: 705606 - RNA, 18 nt, Homo sapiens
caggcauagaggcuucuc

SEQ ID NO: 705607 - RNA, 21 nt, Homo sapiens
caggcaugaggaaucugggag

SEQ ID NO: 705608 - RNA, 20 nt, Homo sapiens
caggcuauguauaaaauaca

SEQ ID NO: 705609 - RNA, 17 nt, Homo sapiens
caggcugggccaugucc

SEQ ID NO: 705610 - RNA, 20 nt, Homo sapiens
cagggcucugugaccaggaa

SEQ ID NO: 705611 - RNA, 20 nt, Homo sapiens
cagggcuggcuccugaucca

SEQ ID NO: 705612 - RNA, 18 nt, Homo sapiens
cagggucccucuguguau

SEQ ID NO: 705613 - RNA, 15 nt, Homo sapiens
caggguucucuuagc

SEQ ID NO: 705614 - RNA, 11 nt, Homo sapiens
caggugcagag

SEQ ID NO: 705615 - RNA, 20 nt, Homo sapiens
cagguuuucuguuucugugu

SEQ ID NO: 705616 - RNA, 15 nt, Homo sapiens
caguaaaaauggaaa

SEQ ID NO: 705617 - RNA, 22 nt, Homo sapiens
caguaaaaauggaaacuauauu

SEQ ID NO: 705618 - RNA, 19 nt, Homo sapiens
caguaaacgggaacaugcc

SEQ ID NO: 705619 - RNA, 18 nt, Homo sapiens
caguaaaggcugcugcua

SEQ ID NO: 705620 - RNA, 14 nt, Homo sapiens
caguagaacuccag

SEQ ID NO: 705621 - RNA, 14 nt, Homo sapiens
caguagauuuucca

SEQ ID NO: 705622 - RNA, 16 nt, Homo sapiens
caguaucccacaucca

SEQ ID NO: 705623 - RNA, 17 nt, Homo sapiens
caguaucccacauccaa

SEQ ID NO: 705624 - RNA, 14 nt, Homo sapiens
caguaugacauuuc

SEQ ID NO: 705625 - RNA, 18 nt, Homo sapiens
cagucucuucuaagcaaa

SEQ ID NO: 705626 - RNA, 19 nt, Homo sapiens
cagugagcugagauugugc

SEQ ID NO: 705627 - RNA, 18 nt, Homo sapiens
cagugaggcugcacccac

SEQ ID NO: 705628 - RNA, 23 nt, Homo sapiens
cagugauauaugccuauaauaua

SEQ ID NO: 705629 - RNA, 23 nt, Homo sapiens
caguggcccauaaguguaaaaua

SEQ ID NO: 705630 - RNA, 15 nt, Homo sapiens
caguuccucccagga

SEQ ID NO: 705631 - RNA, 19 nt, Homo sapiens
caguuccucccccaguucc

SEQ ID NO: 705632 - RNA, 23 nt, Homo sapiens
caguugagcuucauauaccagca

SEQ ID NO: 705633 - RNA, 18 nt, Homo sapiens
caguuguaccaagugaaa

SEQ ID NO: 705634 - RNA, 15 nt, Homo sapiens
cauacuguucacuca

SEQ ID NO: 705635 - RNA, 12 nt, Homo sapiens
cauagucccugc

SEQ ID NO: 705636 - RNA, 12 nt, Homo sapiens
cauauaccagca

SEQ ID NO: 705637 - RNA, 16 nt, Homo sapiens
cauauauauguauaua

SEQ ID NO: 705638 - RNA, 18 nt, Homo sapiens
cauaucaguugagcuuca

SEQ ID NO: 705639 - RNA, 16 nt, Homo sapiens
caucacuuaaaacacg

SEQ ID NO: 705640 - RNA, 13 nt, Homo sapiens
caucauagggaua

SEQ ID NO: 705641 - RNA, 21 nt, Homo sapiens
caucauuuugagaaugcugac

SEQ ID NO: 705642 - RNA, 14 nt, Homo sapiens
cauccgcgugugcc

SEQ ID NO: 705643 - RNA, 16 nt, Homo sapiens
cauccgcgugugccug

SEQ ID NO: 705644 - RNA, 14 nt, Homo sapiens
cauccugacugaaa

SEQ ID NO: 705645 - RNA, 21 nt, Homo sapiens
cauccuugaugcaagugcaac

SEQ ID NO: 705646 - RNA, 16 nt, Homo sapiens
caucuaaaguaaaaag

SEQ ID NO: 705647 - RNA, 14 nt, Homo sapiens
caucucagugcagg

SEQ ID NO: 705648 - RNA, 19 nt, Homo sapiens
caucugccuuaaaaccaaa

SEQ ID NO: 705649 - RNA, 19 nt, Homo sapiens
caucuuauaugggaaacca

SEQ ID NO: 705650 - RNA, 19 nt, Homo sapiens
caucuugaauccuuccauu

SEQ ID NO: 705651 - RNA, 16 nt, Homo sapiens
caucuuuccuguucca

SEQ ID NO: 705652 - RNA, 21 nt, Homo sapiens
caugaaauaaaauauaucuua

SEQ ID NO: 705653 - RNA, 18 nt, Homo sapiens
caugaaucaaaagugccu

SEQ ID NO: 705654 - RNA, 21 nt, Homo sapiens
caugacucggggguggggaaa

SEQ ID NO: 705655 - RNA, 17 nt, Homo sapiens
caugagacucagugcag

SEQ ID NO: 705656 - RNA, 19 nt, Homo sapiens
caugagacucagugcagau

SEQ ID NO: 705657 - RNA, 13 nt, Homo sapiens
cauggugcacuga

SEQ ID NO: 705658 - RNA, 19 nt, Homo sapiens
cauguaaauguaaacucag

SEQ ID NO: 705659 - RNA, 19 nt, Homo sapiens
caugugguuucuaugcaaa

SEQ ID NO: 705660 - RNA, 21 nt, Homo sapiens
cauguuuuccgugaaaacgga

SEQ ID NO: 705661 - RNA, 14 nt, Homo sapiens
cauucagagucagc

SEQ ID NO: 705662 - RNA, 17 nt, Homo sapiens
cauucauguucuagucu

SEQ ID NO: 705663 - RNA, 22 nt, Homo sapiens
cauugaagaauguuagaguaau

SEQ ID NO: 705664 - RNA, 18 nt, Homo sapiens
cauugaaguaaugaauuu

SEQ ID NO: 705665 - RNA, 15 nt, Homo sapiens
cauugagcugugcaa

SEQ ID NO: 705666 - RNA, 21 nt, Homo sapiens
cauuguauauauguguaugca

SEQ ID NO: 705667 - RNA, 18 nt, Homo sapiens
cauugugccuaaguccag

SEQ ID NO: 705668 - RNA, 16 nt, Homo sapiens
cauuucccaucugcac

SEQ ID NO: 705669 - RNA, 21 nt, Homo sapiens
cauuucuucucguuuucacag

SEQ ID NO: 705670 - RNA, 14 nt, Homo sapiens
cauuugcucuucag

SEQ ID NO: 705671 - RNA, 17 nt, Homo sapiens
cauuugcuuccucccaa

SEQ ID NO: 705672 - RNA, 12 nt, Homo sapiens
ccaaaaucucaa

SEQ ID NO: 705673 - RNA, 19 nt, Homo sapiens
ccaaagagggcuuccucua

SEQ ID NO: 705674 - RNA, 21 nt, Homo sapiens
ccaacacugcugcuccagugc

SEQ ID NO: 705675 - RNA, 18 nt, Homo sapiens
ccaacacuuccagcauuu

SEQ ID NO: 705676 - RNA, 15 nt, Homo sapiens
ccaacccugccguca

SEQ ID NO: 705677 - RNA, 21 nt, Homo sapiens
ccaacccugccgucaccacca

SEQ ID NO: 705678 - RNA, 15 nt, Homo sapiens
ccaagaauauugcaa

SEQ ID NO: 705679 - RNA, 19 nt, Homo sapiens
ccaagaaugcaagauuuca

SEQ ID NO: 705680 - RNA, 19 nt, Homo sapiens
ccaagauuuuuuauuugag

SEQ ID NO: 705681 - RNA, 17 nt, Homo sapiens
ccaagguauacaucuuc

SEQ ID NO: 705682 - RNA, 17 nt, Homo sapiens
ccaauauuuaccagacc

SEQ ID NO: 705683 - RNA, 21 nt, Homo sapiens
ccaauauuuaccagaccacaa

SEQ ID NO: 705684 - RNA, 15 nt, Homo sapiens
ccaaucaguuuauac

SEQ ID NO: 705685 - RNA, 13 nt, Homo sapiens
ccacaaaugccac

SEQ ID NO: 705686 - RNA, 15 nt, Homo sapiens
ccacaguugcucuau

SEQ ID NO: 705687 - RNA, 23 nt, Homo sapiens
ccacaguugcucuaugcuuucca

SEQ ID NO: 705688 - RNA, 18 nt, Homo sapiens
ccacauccaacuccagca

SEQ ID NO: 705689 - RNA, 23 nt, Homo sapiens
ccacaucugccuuaaaaccaaag

SEQ ID NO: 705690 - RNA, 18 nt, Homo sapiens
ccaccaccaucaccagac

SEQ ID NO: 705691 - RNA, 18 nt, Homo sapiens
ccaccucggucacuccaa

SEQ ID NO: 705692 - RNA, 21 nt, Homo sapiens
ccaccuucuucuccuacauau

SEQ ID NO: 705693 - RNA, 20 nt, Homo sapiens
ccacgugggcaaacaggcag

SEQ ID NO: 705694 - RNA, 17 nt, Homo sapiens
ccacuuguagauuugau

SEQ ID NO: 705695 - RNA, 18 nt, Homo sapiens
ccacuuugcuguuccuua

SEQ ID NO: 705696 - RNA, 16 nt, Homo sapiens
ccagaaccacacuuga

SEQ ID NO: 705697 - RNA, 12 nt, Homo sapiens
ccagaaugcugc

SEQ ID NO: 705698 - RNA, 22 nt, Homo sapiens
ccagaaugcugcaggacuugag

SEQ ID NO: 705699 - RNA, 20 nt, Homo sapiens
ccagagagccuggugcugcu

SEQ ID NO: 705700 - RNA, 17 nt, Homo sapiens
ccagaggaauccuggca

SEQ ID NO: 705701 - RNA, 15 nt, Homo sapiens
ccagaucacugccac

SEQ ID NO: 705702 - RNA, 22 nt, Homo sapiens
ccagaucacugccacacucucc

SEQ ID NO: 705703 - RNA, 13 nt, Homo sapiens
ccagaucuuucag

SEQ ID NO: 705704 - RNA, 23 nt, Homo sapiens
ccagauggucauccagacucaga

SEQ ID NO: 705705 - RNA, 16 nt, Homo sapiens
ccagauucuaccacac

SEQ ID NO: 705706 - RNA, 22 nt, Homo sapiens
ccagcaaaagagcuauugccaa

SEQ ID NO: 705707 - RNA, 20 nt, Homo sapiens
ccagcacuuugggaggccaa

SEQ ID NO: 705708 - RNA, 16 nt, Homo sapiens
ccagccccacugccag

SEQ ID NO: 705709 - RNA, 23 nt, Homo sapiens
ccagcgaucucuccacugugcuu

SEQ ID NO: 705710 - RNA, 19 nt, Homo sapiens
ccagcugccaaggaaaccc

SEQ ID NO: 705711 - RNA, 14 nt, Homo sapiens
ccaggagccucacu

SEQ ID NO: 705712 - RNA, 17 nt, Homo sapiens
ccaggcuggacugcaau

SEQ ID NO: 705713 - RNA, 13 nt, Homo sapiens
ccaggugagaaac

SEQ ID NO: 705714 - RNA, 24 nt, Homo sapiens
ccaguguaauaauaaaucguccuc

SEQ ID NO: 705715 - RNA, 15 nt, Homo sapiens
ccauaauuauuauuu

SEQ ID NO: 705716 - RNA, 22 nt, Homo sapiens
ccauaauuauuauuuccagugu

SEQ ID NO: 705717 - RNA, 13 nt, Homo sapiens
ccauaucagugaa

SEQ ID NO: 705718 - RNA, 12 nt, Homo sapiens
ccaucaccagac

SEQ ID NO: 705719 - RNA, 13 nt, Homo sapiens
ccaucaggguucu

SEQ ID NO: 705720 - RNA, 19 nt, Homo sapiens
ccauggcuguguuggugug

SEQ ID NO: 705721 - RNA, 11 nt, Homo sapiens
ccauggcuguu

SEQ ID NO: 705722 - RNA, 16 nt, Homo sapiens
ccauggugaagugcuu

SEQ ID NO: 705723 - RNA, 14 nt, Homo sapiens
ccauguccaaagag

SEQ ID NO: 705724 - RNA, 23 nt, Homo sapiens
ccaugugauggacacuccaggga

SEQ ID NO: 705725 - RNA, 16 nt, Homo sapiens
ccauuaaaguucucaa

SEQ ID NO: 705726 - RNA, 16 nt, Homo sapiens
ccauuacagagguauu

SEQ ID NO: 705727 - RNA, 23 nt, Homo sapiens
ccauuuuaauuuuaaagugcaaa

SEQ ID NO: 705728 - RNA, 23 nt, Homo sapiens
cccaacuaaaauuugaaguaguu

SEQ ID NO: 705729 - RNA, 21 nt, Homo sapiens
cccacgacugcccggcagggu

SEQ ID NO: 705730 - RNA, 13 nt, Homo sapiens
cccacuucccacc

SEQ ID NO: 705731 - RNA, 20 nt, Homo sapiens
cccagccuccccgugccaaa

SEQ ID NO: 705732 - RNA, 18 nt, Homo sapiens
cccagcgacgaacuuucc

SEQ ID NO: 705733 - RNA, 22 nt, Homo sapiens
cccaggacgccacucauuucau

SEQ ID NO: 705734 - RNA, 17 nt, Homo sapiens
cccaggagccucacugg

SEQ ID NO: 705735 - RNA, 20 nt, Homo sapiens
cccaggagccucacuggggc

SEQ ID NO: 705736 - RNA, 18 nt, Homo sapiens
cccaggggacaagggauu

SEQ ID NO: 705737 - RNA, 18 nt, Homo sapiens
cccagugcaugguggcca

SEQ ID NO: 705738 - RNA, 19 nt, Homo sapiens
cccauaauuauuauuucca

SEQ ID NO: 705739 - RNA, 13 nt, Homo sapiens
cccaucucuacaa

SEQ ID NO: 705740 - RNA, 20 nt, Homo sapiens
cccaugcuuccuugccugau

SEQ ID NO: 705741 - RNA, 21 nt, Homo sapiens
cccauggaaagagacugucau

SEQ ID NO: 705742 - RNA, 20 nt, Homo sapiens
cccauuugugccagaggaau

SEQ ID NO: 705743 - RNA, 21 nt, Homo sapiens
cccauuuuuaaaauacauugu

SEQ ID NO: 705744 - RNA, 16 nt, Homo sapiens
ccccaccaccacuuac

SEQ ID NO: 705745 - RNA, 14 nt, Homo sapiens
ccccagccauccag

SEQ ID NO: 705746 - RNA, 20 nt, Homo sapiens
ccccaguuccucccccaguu

SEQ ID NO: 705747 - RNA, 13 nt, Homo sapiens
cccccuguccuga

SEQ ID NO: 705748 - RNA, 13 nt, Homo sapiens
ccccucucaccaa

SEQ ID NO: 705749 - RNA, 18 nt, Homo sapiens
cccgcaguugugccaaag

SEQ ID NO: 705750 - RNA, 21 nt, Homo sapiens
cccgguggcggccccagcacc

SEQ ID NO: 705751 - RNA, 13 nt, Homo sapiens
cccgugccaaaaa

SEQ ID NO: 705752 - RNA, 21 nt, Homo sapiens
cccuagcagcccacccugcug

SEQ ID NO: 705753 - RNA, 12 nt, Homo sapiens
cccucacaggag

SEQ ID NO: 705754 - RNA, 17 nt, Homo sapiens
cccugcccucucccaaa

SEQ ID NO: 705755 - RNA, 20 nt, Homo sapiens
cccuggagcccauccagucu

SEQ ID NO: 705756 - RNA, 18 nt, Homo sapiens
cccuggguguccccgcug

SEQ ID NO: 705757 - RNA, 12 nt, Homo sapiens
cccuguguuaau

SEQ ID NO: 705758 - RNA, 20 nt, Homo sapiens
cccuuccuucuuugucuugc

SEQ ID NO: 705759 - RNA, 17 nt, Homo sapiens
cccuuggcuucugugau

SEQ ID NO: 705760 - RNA, 22 nt, Homo sapiens
ccgaauaaauguuuuauuucua

SEQ ID NO: 705761 - RNA, 13 nt, Homo sapiens
ccgcgcuccgggc

SEQ ID NO: 705762 - RNA, 19 nt, Homo sapiens
ccgcuagguagagucugag

SEQ ID NO: 705763 - RNA, 17 nt, Homo sapiens
ccguggcugauggugug

SEQ ID NO: 705764 - RNA, 18 nt, Homo sapiens
ccguuuuccccaugacaa

SEQ ID NO: 705765 - RNA, 21 nt, Homo sapiens
ccuaacugaaagaugaucauu

SEQ ID NO: 705766 - RNA, 16 nt, Homo sapiens
ccuaauaggcugggag

SEQ ID NO: 705767 - RNA, 17 nt, Homo sapiens
ccucagcucaaugcagu

SEQ ID NO: 705768 - RNA, 14 nt, Homo sapiens
ccucaggcaggugg

SEQ ID NO: 705769 - RNA, 13 nt, Homo sapiens
ccucauuagcauu

SEQ ID NO: 705770 - RNA, 13 nt, Homo sapiens
ccuccaacccugc

SEQ ID NO: 705771 - RNA, 18 nt, Homo sapiens
ccuccccgugccaaaaau

SEQ ID NO: 705772 - RNA, 18 nt, Homo sapiens
ccucccuuguggcagcaa

SEQ ID NO: 705773 - RNA, 15 nt, Homo sapiens
ccuccgcccugccac

SEQ ID NO: 705774 - RNA, 23 nt, Homo sapiens
ccuccuccagccgccaugcuccu

SEQ ID NO: 705775 - RNA, 12 nt, Homo sapiens
ccucggugggag

SEQ ID NO: 705776 - RNA, 12 nt, Homo sapiens
ccucuaaugaga

SEQ ID NO: 705777 - RNA, 15 nt, Homo sapiens
ccucuagaagccaag

SEQ ID NO: 705778 - RNA, 12 nt, Homo sapiens
ccucucaccaaa

SEQ ID NO: 705779 - RNA, 17 nt, Homo sapiens
ccucuccuuugugacuu

SEQ ID NO: 705780 - RNA, 17 nt, Homo sapiens
ccucugaacuugccuua

SEQ ID NO: 705781 - RNA, 21 nt, Homo sapiens
ccucuggucgcuccugcccac

SEQ ID NO: 705782 - RNA, 20 nt, Homo sapiens
ccucugugcucuucucuucc

SEQ ID NO: 705783 - RNA, 17 nt, Homo sapiens
ccucuuagaaaaaccac

SEQ ID NO: 705784 - RNA, 16 nt, Homo sapiens
ccugacuggugcugca

SEQ ID NO: 705785 - RNA, 21 nt, Homo sapiens
ccugagaggaaccagagcaga

SEQ ID NO: 705786 - RNA, 13 nt, Homo sapiens
ccugaugagauuu

SEQ ID NO: 705787 - RNA, 13 nt, Homo sapiens
ccugcagaugcca

SEQ ID NO: 705788 - RNA, 23 nt, Homo sapiens
ccugccauaauccuuuggaaaag

SEQ ID NO: 705789 - RNA, 15 nt, Homo sapiens
ccugcuuugaauaaa

SEQ ID NO: 705790 - RNA, 17 nt, Homo sapiens
ccuggaucuaccagcau

SEQ ID NO: 705791 - RNA, 12 nt, Homo sapiens
ccuggcacugga

SEQ ID NO: 705792 - RNA, 18 nt, Homo sapiens
ccuggcccccaaccucag

SEQ ID NO: 705793 - RNA, 15 nt, Homo sapiens
ccugggcaaugugau

SEQ ID NO: 705794 - RNA, 20 nt, Homo sapiens
ccugggguguuaguggcacc

SEQ ID NO: 705795 - RNA, 17 nt, Homo sapiens
ccuggguaacuagggaa

SEQ ID NO: 705796 - RNA, 14 nt, Homo sapiens
ccugugaaugccac

SEQ ID NO: 705797 - RNA, 12 nt, Homo sapiens
ccugugacaugg

SEQ ID NO: 705798 - RNA, 11 nt, Homo sapiens
ccugugacugu

SEQ ID NO: 705799 - RNA, 15 nt, Homo sapiens
ccugugauccaccca

SEQ ID NO: 705800 - RNA, 16 nt, Homo sapiens
ccugugugcgugcgca

SEQ ID NO: 705801 - RNA, 18 nt, Homo sapiens
ccugugugggacugagau

SEQ ID NO: 705802 - RNA, 19 nt, Homo sapiens
ccuguugaaugacaaagua

SEQ ID NO: 705803 - RNA, 16 nt, Homo sapiens
ccuuaaaaccaaagag

SEQ ID NO: 705804 - RNA, 14 nt, Homo sapiens
ccuuaacugcaucc

SEQ ID NO: 705805 - RNA, 15 nt, Homo sapiens
ccuuaagacagagua

SEQ ID NO: 705806 - RNA, 19 nt, Homo sapiens
ccuuaagacagaguauccu

SEQ ID NO: 705807 - RNA, 19 nt, Homo sapiens
ccuuaagggguaucaugua

SEQ ID NO: 705808 - RNA, 14 nt, Homo sapiens
ccuuagagguccuc

SEQ ID NO: 705809 - RNA, 23 nt, Homo sapiens
ccuucccuagcuuuagacccugg

SEQ ID NO: 705810 - RNA, 15 nt, Homo sapiens
ccuucuuugucuugc

SEQ ID NO: 705811 - RNA, 14 nt, Homo sapiens
ccuuugagguugau

SEQ ID NO: 705812 - RNA, 18 nt, Homo sapiens
ccuuugcucucuggccac

SEQ ID NO: 705813 - RNA, 16 nt, Homo sapiens
ccuuuguugcacaaau

SEQ ID NO: 705814 - RNA, 14 nt, Homo sapiens
ccuuuuaacugcca

SEQ ID NO: 705815 - RNA, 15 nt, Homo sapiens
ccuuuuuuucccaaa

SEQ ID NO: 705816 - RNA, 17 nt, Homo sapiens
cgaagugcugagauuac

SEQ ID NO: 705817 - RNA, 24 nt, Homo sapiens
cgacauggcuccggccucugccuu

SEQ ID NO: 705818 - RNA, 14 nt, Homo sapiens
cgagaccccggcuu

SEQ ID NO: 705819 - RNA, 17 nt, Homo sapiens
cgagacuccgucucaaa

SEQ ID NO: 705820 - RNA, 19 nt, Homo sapiens
cgagcauaguccaaaaagc

SEQ ID NO: 705821 - RNA, 23 nt, Homo sapiens
cgaggaaaagagaaggaaaguga

SEQ ID NO: 705822 - RNA, 15 nt, Homo sapiens
cgaucucuccuggcc

SEQ ID NO: 705823 - RNA, 19 nt, Homo sapiens
cgcacuucugauguccgua

SEQ ID NO: 705824 - RNA, 20 nt, Homo sapiens
cgcagcccuggcagggggca

SEQ ID NO: 705825 - RNA, 15 nt, Homo sapiens
cgcaucucagugcag

SEQ ID NO: 705826 - RNA, 16 nt, Homo sapiens
cgcaucucagugcagg

SEQ ID NO: 705827 - RNA, 13 nt, Homo sapiens
cgcaucuugccuc

SEQ ID NO: 705828 - RNA, 14 nt, Homo sapiens
cgcaucuugccucc

SEQ ID NO: 705829 - RNA, 19 nt, Homo sapiens
cgcgcuugcuggccagucc

SEQ ID NO: 705830 - RNA, 17 nt, Homo sapiens
cgcucuguggaugccag

SEQ ID NO: 705831 - RNA, 12 nt, Homo sapiens
cgcuucuugccu

SEQ ID NO: 705832 - RNA, 19 nt, Homo sapiens
cgcuugcuggccaguccac

SEQ ID NO: 705833 - RNA, 14 nt, Homo sapiens
cggaacauguaaaa

SEQ ID NO: 705834 - RNA, 17 nt, Homo sapiens
cggaagggguuccucaa

SEQ ID NO: 705835 - RNA, 16 nt, Homo sapiens
cggagcuugcagugag

SEQ ID NO: 705836 - RNA, 19 nt, Homo sapiens
cggcaaugcccugugcaug

SEQ ID NO: 705837 - RNA, 17 nt, Homo sapiens
cggccucugccuuugca

SEQ ID NO: 705838 - RNA, 17 nt, Homo sapiens
cggggaagagauccaaa

SEQ ID NO: 705839 - RNA, 20 nt, Homo sapiens
cgggucuugauucagucaca

SEQ ID NO: 705840 - RNA, 21 nt, Homo sapiens
cggugagacccauggcugugu

SEQ ID NO: 705841 - RNA, 14 nt, Homo sapiens
cgguguuuugccau

SEQ ID NO: 705842 - RNA, 21 nt, Homo sapiens
cguauuuggcacacagcagag

SEQ ID NO: 705843 - RNA, 17 nt, Homo sapiens
cgucauguguuuugcca

SEQ ID NO: 705844 - RNA, 22 nt, Homo sapiens
cgugcucugugggucuccccca

SEQ ID NO: 705845 - RNA, 18 nt, Homo sapiens
cgugggcaaacaggcagu

SEQ ID NO: 705846 - RNA, 18 nt, Homo sapiens
cuaaaacuuaacauucau

SEQ ID NO: 705847 - RNA, 21 nt, Homo sapiens
cuaaagaaaaauaucuuggcc

SEQ ID NO: 705848 - RNA, 17 nt, Homo sapiens
cuaaagcaauagaaaca

SEQ ID NO: 705849 - RNA, 22 nt, Homo sapiens
cuaaauagaaauaaaugauccc

SEQ ID NO: 705850 - RNA, 18 nt, Homo sapiens
cuaaaucagagacaaaau

SEQ ID NO: 705851 - RNA, 19 nt, Homo sapiens
cuaaauguuuggcauguaa

SEQ ID NO: 705852 - RNA, 16 nt, Homo sapiens
cuaaccccuuccagau

SEQ ID NO: 705853 - RNA, 21 nt, Homo sapiens
cuaagaaaagccuaaucacag

SEQ ID NO: 705854 - RNA, 18 nt, Homo sapiens
cuaagaauucaaacuggg

SEQ ID NO: 705855 - RNA, 13 nt, Homo sapiens
cuaagcagcuuau

SEQ ID NO: 705856 - RNA, 16 nt, Homo sapiens
cuaaguuggugcuuuu

SEQ ID NO: 705857 - RNA, 16 nt, Homo sapiens
cuaaugagacugacca

SEQ ID NO: 705858 - RNA, 19 nt, Homo sapiens
cuaaugagacugaccauau

SEQ ID NO: 705859 - RNA, 18 nt, Homo sapiens
cuaaugccuaucugacca

SEQ ID NO: 705860 - RNA, 13 nt, Homo sapiens
cuaauuaggcaag

SEQ ID NO: 705861 - RNA, 16 nt, Homo sapiens
cuacaagucagcucca

SEQ ID NO: 705862 - RNA, 21 nt, Homo sapiens
cuacaauauuaacauaagaaa

SEQ ID NO: 705863 - RNA, 18 nt, Homo sapiens
cuacaguauuacucuuac

SEQ ID NO: 705864 - RNA, 18 nt, Homo sapiens
cuaccgacccaggguucc

SEQ ID NO: 705865 - RNA, 16 nt, Homo sapiens
cuaccucaaacuucca

SEQ ID NO: 705866 - RNA, 15 nt, Homo sapiens
cuacuagggaaaaau

SEQ ID NO: 705867 - RNA, 12 nt, Homo sapiens
cuacugacauau

SEQ ID NO: 705868 - RNA, 14 nt, Homo sapiens
cuacugucaaauga

SEQ ID NO: 705869 - RNA, 17 nt, Homo sapiens
cuagaacacuaacucac

SEQ ID NO: 705870 - RNA, 15 nt, Homo sapiens
cuagaagccaaggga

SEQ ID NO: 705871 - RNA, 20 nt, Homo sapiens
cuagcacuuugggaggccaa

SEQ ID NO: 705872 - RNA, 16 nt, Homo sapiens
cuagcaggaauauuuc

SEQ ID NO: 705873 - RNA, 13 nt, Homo sapiens
cuaggaaggugaa

SEQ ID NO: 705874 - RNA, 19 nt, Homo sapiens
cuagucaacaguacccugg

SEQ ID NO: 705875 - RNA, 20 nt, Homo sapiens
cuauaaauagaugcugugua

SEQ ID NO: 705876 - RNA, 19 nt, Homo sapiens
cuauacacuuaaugauaca

SEQ ID NO: 705877 - RNA, 16 nt, Homo sapiens
cuauagcaucacuuaa

SEQ ID NO: 705878 - RNA, 18 nt, Homo sapiens
cuauauuuugucauauca

SEQ ID NO: 705879 - RNA, 21 nt, Homo sapiens
cuaucaucauccuacaacuca

SEQ ID NO: 705880 - RNA, 23 nt, Homo sapiens
cuauuuaaaaaaaaagucagaga

SEQ ID NO: 705881 - RNA, 22 nt, Homo sapiens
cuauuucuguauauaaaggugc

SEQ ID NO: 705882 - RNA, 16 nt, Homo sapiens
cucaaacuuccaguca

SEQ ID NO: 705883 - RNA, 17 nt, Homo sapiens
cucaauaaagugcuuua

SEQ ID NO: 705884 - RNA, 13 nt, Homo sapiens
cucacgccuguaa

SEQ ID NO: 705885 - RNA, 22 nt, Homo sapiens
cucacuaggcccccacuugccu

SEQ ID NO: 705886 - RNA, 21 nt, Homo sapiens
cucacuguagcuuuuaggaau

SEQ ID NO: 705887 - RNA, 14 nt, Homo sapiens
cucagaagcacaga

SEQ ID NO: 705888 - RNA, 19 nt, Homo sapiens
cucagacuggagggcaagg

SEQ ID NO: 705889 - RNA, 17 nt, Homo sapiens
cucagagugguggggga

SEQ ID NO: 705890 - RNA, 20 nt, Homo sapiens
cucaggggccaacuaggcag

SEQ ID NO: 705891 - RNA, 22 nt, Homo sapiens
cucaguaaacgggaacaugccc

SEQ ID NO: 705892 - RNA, 11 nt, Homo sapiens
cucagugcagg

SEQ ID NO: 705893 - RNA, 23 nt, Homo sapiens
cucaguuauuacauguaauuuga

SEQ ID NO: 705894 - RNA, 13 nt, Homo sapiens
cucaucaaucaaa

SEQ ID NO: 705895 - RNA, 22 nt, Homo sapiens
cucauccuccaggaacugcagg

SEQ ID NO: 705896 - RNA, 18 nt, Homo sapiens
cucaucugaaauguuaca

SEQ ID NO: 705897 - RNA, 12 nt, Homo sapiens
cucaucugcaaa

SEQ ID NO: 705898 - RNA, 13 nt, Homo sapiens
cucaugugcagua

SEQ ID NO: 705899 - RNA, 13 nt, Homo sapiens
cucauuucaucuc

SEQ ID NO: 705900 - RNA, 13 nt, Homo sapiens
cuccacaaccucu

SEQ ID NO: 705901 - RNA, 19 nt, Homo sapiens
cuccacagcgagggcagcu

SEQ ID NO: 705902 - RNA, 22 nt, Homo sapiens
cuccacaucugccuuaaaacca

SEQ ID NO: 705903 - RNA, 15 nt, Homo sapiens
cuccagcaacacagc

SEQ ID NO: 705904 - RNA, 15 nt, Homo sapiens
cuccauugugccuaa

SEQ ID NO: 705905 - RNA, 14 nt, Homo sapiens
cucccacaaaggag

SEQ ID NO: 705906 - RNA, 12 nt, Homo sapiens
cucccacuuugc

SEQ ID NO: 705907 - RNA, 16 nt, Homo sapiens
cucccagguaccagcu

SEQ ID NO: 705908 - RNA, 13 nt, Homo sapiens
cuccccaggggag

SEQ ID NO: 705909 - RNA, 14 nt, Homo sapiens
cucccuuugaugau

SEQ ID NO: 705910 - RNA, 19 nt, Homo sapiens
cuccucaccucaugcccac

SEQ ID NO: 705911 - RNA, 19 nt, Homo sapiens
cuccucucccauccuugau

SEQ ID NO: 705912 - RNA, 12 nt, Homo sapiens
cuccugccugag

SEQ ID NO: 705913 - RNA, 15 nt, Homo sapiens
cuccuucagacaccc

SEQ ID NO: 705914 - RNA, 18 nt, Homo sapiens
cucggagaagagcgcagu

SEQ ID NO: 705915 - RNA, 13 nt, Homo sapiens
cucuaagucaugu

SEQ ID NO: 705916 - RNA, 22 nt, Homo sapiens
cucuaagugggcauugccaugu

SEQ ID NO: 705917 - RNA, 14 nt, Homo sapiens
cucuacaaaaagca

SEQ ID NO: 705918 - RNA, 22 nt, Homo sapiens
cucuacccucuuagaaaaacca

SEQ ID NO: 705919 - RNA, 20 nt, Homo sapiens
cucucccaaaaaacuacuuc

SEQ ID NO: 705920 - RNA, 21 nt, Homo sapiens
cucuccccagccuccccgugc

SEQ ID NO: 705921 - RNA, 18 nt, Homo sapiens
cucuccucucugaccugg

SEQ ID NO: 705922 - RNA, 22 nt, Homo sapiens
cucucuaagugggcauugccau

SEQ ID NO: 705923 - RNA, 14 nt, Homo sapiens
cucucucuacagag

SEQ ID NO: 705924 - RNA, 13 nt, Homo sapiens
cucugcacaagcu

SEQ ID NO: 705925 - RNA, 19 nt, Homo sapiens
cucugcuuuuaacuuuaua

SEQ ID NO: 705926 - RNA, 15 nt, Homo sapiens
cucuggccacuauua

SEQ ID NO: 705927 - RNA, 22 nt, Homo sapiens
cucuggcuuugccuuggcuuug

SEQ ID NO: 705928 - RNA, 21 nt, Homo sapiens
cucuguggaaugaauacacac

SEQ ID NO: 705929 - RNA, 22 nt, Homo sapiens
cucuuaagcuuccgccgucuca

SEQ ID NO: 705930 - RNA, 18 nt, Homo sapiens
cucuuacaagaguggacu

SEQ ID NO: 705931 - RNA, 20 nt, Homo sapiens
cucuuaguuauugcugaaga

SEQ ID NO: 705932 - RNA, 18 nt, Homo sapiens
cucuucaucccauuccag

SEQ ID NO: 705933 - RNA, 23 nt, Homo sapiens
cucuucuggggcaggcugggcca

SEQ ID NO: 705934 - RNA, 19 nt, Homo sapiens
cucuucuuggggcccagug

SEQ ID NO: 705935 - RNA, 21 nt, Homo sapiens
cucuucuuggggcccagugca

SEQ ID NO: 705936 - RNA, 21 nt, Homo sapiens
cucuugagccugggaggucaa

SEQ ID NO: 705937 - RNA, 22 nt, Homo sapiens
cucuuguaucccuagugcucca

SEQ ID NO: 705938 - RNA, 16 nt, Homo sapiens
cucuuguccuagcuug

SEQ ID NO: 705939 - RNA, 19 nt, Homo sapiens
cugaaaagaugguaucaua

SEQ ID NO: 705940 - RNA, 15 nt, Homo sapiens
cugaaagaugaucau

SEQ ID NO: 705941 - RNA, 22 nt, Homo sapiens
cugaagagcuauuauauaaaaa

SEQ ID NO: 705942 - RNA, 19 nt, Homo sapiens
cugaagaugggagccuuua

SEQ ID NO: 705943 - RNA, 17 nt, Homo sapiens
cugaaucgagaugucca

SEQ ID NO: 705944 - RNA, 23 nt, Homo sapiens
cugaaucuuccuuuguugcacaa

SEQ ID NO: 705945 - RNA, 19 nt, Homo sapiens
cugaccaaugugugaagua

SEQ ID NO: 705946 - RNA, 13 nt, Homo sapiens
cugaccacuugag

SEQ ID NO: 705947 - RNA, 14 nt, Homo sapiens
cugaccuguguucc

SEQ ID NO: 705948 - RNA, 17 nt, Homo sapiens
cugaccuugugauccac

SEQ ID NO: 705949 - RNA, 16 nt, Homo sapiens
cugacuaauuaggcaa

SEQ ID NO: 705950 - RNA, 18 nt, Homo sapiens
cugacugcuaguugccau

SEQ ID NO: 705951 - RNA, 14 nt, Homo sapiens
cugagaucgugcua

SEQ ID NO: 705952 - RNA, 20 nt, Homo sapiens
cugagcugccuguaacuuga

SEQ ID NO: 705953 - RNA, 19 nt, Homo sapiens
cugagggcuuguaguucuu

SEQ ID NO: 705954 - RNA, 18 nt, Homo sapiens
cugaguggcaggggacag

SEQ ID NO: 705955 - RNA, 15 nt, Homo sapiens
cugauaaguuucaua

SEQ ID NO: 705956 - RNA, 18 nt, Homo sapiens
cugauggccuuaauuucc

SEQ ID NO: 705957 - RNA, 20 nt, Homo sapiens
cugauguccguaggccuuaa

SEQ ID NO: 705958 - RNA, 22 nt, Homo sapiens
cugauuucuuaggggaaggaga

SEQ ID NO: 705959 - RNA, 13 nt, Homo sapiens
cugcacagugaag

SEQ ID NO: 705960 - RNA, 20 nt, Homo sapiens
cugcacuccagccuggggga

SEQ ID NO: 705961 - RNA, 16 nt, Homo sapiens
cugcacuggggccacc

SEQ ID NO: 705962 - RNA, 21 nt, Homo sapiens
cugcagaugccacccuagcca

SEQ ID NO: 705963 - RNA, 14 nt, Homo sapiens
cugcaguccuacuc

SEQ ID NO: 705964 - RNA, 16 nt, Homo sapiens
cugcaguucuacucag

SEQ ID NO: 705965 - RNA, 18 nt, Homo sapiens
cugccaucgcugugaugc

SEQ ID NO: 705966 - RNA, 18 nt, Homo sapiens
cugccauuucugagauca

SEQ ID NO: 705967 - RNA, 17 nt, Homo sapiens
cugccccucucaccaaa

SEQ ID NO: 705968 - RNA, 20 nt, Homo sapiens
cugccuggcccccaaccuca

SEQ ID NO: 705969 - RNA, 16 nt, Homo sapiens
cugccuuaaaaccaaa

SEQ ID NO: 705970 - RNA, 21 nt, Homo sapiens
cugcugcccccaccccgggga

SEQ ID NO: 705971 - RNA, 18 nt, Homo sapiens
cugcugcuccagugcagg

SEQ ID NO: 705972 - RNA, 10 nt, Homo sapiens
cugcuuccag

SEQ ID NO: 705973 - RNA, 17 nt, Homo sapiens
cuggaaucacauucuua

SEQ ID NO: 705974 - RNA, 14 nt, Homo sapiens
cuggaauugccagc

SEQ ID NO: 705975 - RNA, 12 nt, Homo sapiens
cuggagauccuc

SEQ ID NO: 705976 - RNA, 15 nt, Homo sapiens
cuggaggaacacuug

SEQ ID NO: 705977 - RNA, 19 nt, Homo sapiens
cuggauagaaccaccauag

SEQ ID NO: 705978 - RNA, 18 nt, Homo sapiens
cuggauuccacacugcac

SEQ ID NO: 705979 - RNA, 17 nt, Homo sapiens
cuggcaccgcaguuuug

SEQ ID NO: 705980 - RNA, 20 nt, Homo sapiens
cuggcugucaguaugacauu

SEQ ID NO: 705981 - RNA, 10 nt, Homo sapiens
cugggccaug

SEQ ID NO: 705982 - RNA, 14 nt, Homo sapiens
cugggccaugucca

SEQ ID NO: 705983 - RNA, 17 nt, Homo sapiens
cugggccauguccaaag

SEQ ID NO: 705984 - RNA, 15 nt, Homo sapiens
cuggggccacccagc

SEQ ID NO: 705985 - RNA, 16 nt, Homo sapiens
cuggggggacccagug

SEQ ID NO: 705986 - RNA, 20 nt, Homo sapiens
cuggggggacccagugcaga

SEQ ID NO: 705987 - RNA, 21 nt, Homo sapiens
cuggggggacccagugcagaa

SEQ ID NO: 705988 - RNA, 21 nt, Homo sapiens
cugggguuggacuguaaggga

SEQ ID NO: 705989 - RNA, 21 nt, Homo sapiens
cuggguugggggcuagggaga

SEQ ID NO: 705990 - RNA, 15 nt, Homo sapiens
cugguauguguggau

SEQ ID NO: 705991 - RNA, 13 nt, Homo sapiens
cuguaacacuccu

SEQ ID NO: 705992 - RNA, 13 nt, Homo sapiens
cugugcaugccau

SEQ ID NO: 705993 - RNA, 18 nt, Homo sapiens
cugugcccagaauacuga

SEQ ID NO: 705994 - RNA, 22 nt, Homo sapiens
cugugcugcccugaagaauggc

SEQ ID NO: 705995 - RNA, 14 nt, Homo sapiens
cuguggacugaccu

SEQ ID NO: 705996 - RNA, 14 nt, Homo sapiens
cuguggaugccagg

SEQ ID NO: 705997 - RNA, 17 nt, Homo sapiens
cuguggcuagugacaaa

SEQ ID NO: 705998 - RNA, 15 nt, Homo sapiens
cuguguauucuaguu

SEQ ID NO: 705999 - RNA, 14 nt, Homo sapiens
cuguguugccacag

SEQ ID NO: 706000 - RNA, 16 nt, Homo sapiens
cuguugauaaauccau

SEQ ID NO: 706001 - RNA, 20 nt, Homo sapiens
cuguugugugucaugccagu

SEQ ID NO: 706002 - RNA, 19 nt, Homo sapiens
cuguuuauuacuuccauga

SEQ ID NO: 706003 - RNA, 15 nt, Homo sapiens
cuguuuccugggcac

SEQ ID NO: 706004 - RNA, 22 nt, Homo sapiens
cuuaaacgaagaguucccuuga

SEQ ID NO: 706005 - RNA, 19 nt, Homo sapiens
cuuaaagcacagucugaug

SEQ ID NO: 706006 - RNA, 21 nt, Homo sapiens
cuuaaauauauaauguugcca

SEQ ID NO: 706007 - RNA, 14 nt, Homo sapiens
cuuaacaguuguau

SEQ ID NO: 706008 - RNA, 20 nt, Homo sapiens
cuuaagcuuccgccgucuca

SEQ ID NO: 706009 - RNA, 20 nt, Homo sapiens
cuuaaggacaaagugccaaa

SEQ ID NO: 706010 - RNA, 19 nt, Homo sapiens
cuuaauaacuguguacugu

SEQ ID NO: 706011 - RNA, 14 nt, Homo sapiens
cuuaauguuccuca

SEQ ID NO: 706012 - RNA, 17 nt, Homo sapiens
cuuacagaacuacuucu

SEQ ID NO: 706013 - RNA, 15 nt, Homo sapiens
cuuacuggcaaacau

SEQ ID NO: 706014 - RNA, 21 nt, Homo sapiens
cuuacuucccuaaugaaguua

SEQ ID NO: 706015 - RNA, 16 nt, Homo sapiens
cuuagaaucccugugu

SEQ ID NO: 706016 - RNA, 24 nt, Homo sapiens
cuuauugcaucccaaaccacgccu

SEQ ID NO: 706017 - RNA, 19 nt, Homo sapiens
cuuauuguuucucugaaag

SEQ ID NO: 706018 - RNA, 18 nt, Homo sapiens
cuucaaagcaagcuggua

SEQ ID NO: 706019 - RNA, 20 nt, Homo sapiens
cuucaaagccuucucccuag

SEQ ID NO: 706020 - RNA, 12 nt, Homo sapiens
cuucagacaccc

SEQ ID NO: 706021 - RNA, 21 nt, Homo sapiens
cuucagaggauaaauaucaau

SEQ ID NO: 706022 - RNA, 14 nt, Homo sapiens
cuucauacuccuuu

SEQ ID NO: 706023 - RNA, 15 nt, Homo sapiens
cuucauauaccagca

SEQ ID NO: 706024 - RNA, 19 nt, Homo sapiens
cuucaucccauuccaggca

SEQ ID NO: 706025 - RNA, 22 nt, Homo sapiens
cuuccagauggucauccagacu

SEQ ID NO: 706026 - RNA, 14 nt, Homo sapiens
cuuccgccgucuca

SEQ ID NO: 706027 - RNA, 12 nt, Homo sapiens
cuuccugugauc

SEQ ID NO: 706028 - RNA, 14 nt, Homo sapiens
cuuccugugaucca

SEQ ID NO: 706029 - RNA, 20 nt, Homo sapiens
cuuccuugccugaugacaau

SEQ ID NO: 706030 - RNA, 20 nt, Homo sapiens
cuuccuuucccaagccuucg

SEQ ID NO: 706031 - RNA, 17 nt, Homo sapiens
cuuccuuuuaacugcca

SEQ ID NO: 706032 - RNA, 14 nt, Homo sapiens
cuucucauuacuug

SEQ ID NO: 706033 - RNA, 12 nt, Homo sapiens
cuugaagccauc

SEQ ID NO: 706034 - RNA, 15 nt, Homo sapiens
cuugaagggcccaga

SEQ ID NO: 706035 - RNA, 16 nt, Homo sapiens
cuugaggcaacucauc

SEQ ID NO: 706036 - RNA, 13 nt, Homo sapiens
cuugaugauacaa

SEQ ID NO: 706037 - RNA, 11 nt, Homo sapiens
cuugccucuuc

SEQ ID NO: 706038 - RNA, 15 nt, Homo sapiens
cuuggauuaaauaca

SEQ ID NO: 706039 - RNA, 16 nt, Homo sapiens
cuuggcuucugugaug

SEQ ID NO: 706040 - RNA, 17 nt, Homo sapiens
cuuggggcccagugcau

SEQ ID NO: 706041 - RNA, 16 nt, Homo sapiens
cuuguaaagacugguu

SEQ ID NO: 706042 - RNA, 18 nt, Homo sapiens
cuuguauagcaugaaaua

SEQ ID NO: 706043 - RNA, 16 nt, Homo sapiens
cuuguccucauucuug

SEQ ID NO: 706044 - RNA, 14 nt, Homo sapiens
cuugucuucuggua

SEQ ID NO: 706045 - RNA, 15 nt, Homo sapiens
cuugugaaaaugugu

SEQ ID NO: 706046 - RNA, 17 nt, Homo sapiens
cuugugaaguggaaaug

SEQ ID NO: 706047 - RNA, 14 nt, Homo sapiens
cuugugaucacuua

SEQ ID NO: 706048 - RNA, 16 nt, Homo sapiens
cuuguuaugcaucauu

SEQ ID NO: 706049 - RNA, 12 nt, Homo sapiens
cuuguugacuca

SEQ ID NO: 706050 - RNA, 15 nt, Homo sapiens
cuuuaaaauauuguu

SEQ ID NO: 706051 - RNA, 17 nt, Homo sapiens
cuuuaccuuuucagggc

SEQ ID NO: 706052 - RNA, 14 nt, Homo sapiens
cuuuacugccugaa

SEQ ID NO: 706053 - RNA, 20 nt, Homo sapiens
cuuuagaguagaguuuggaa

SEQ ID NO: 706054 - RNA, 13 nt, Homo sapiens
cuuuaucucaggg

SEQ ID NO: 706055 - RNA, 18 nt, Homo sapiens
cuuuccuguuccagagag

SEQ ID NO: 706056 - RNA, 20 nt, Homo sapiens
cuuucugcaggaaauaguca

SEQ ID NO: 706057 - RNA, 16 nt, Homo sapiens
cuuucuguugccaugg

SEQ ID NO: 706058 - RNA, 20 nt, Homo sapiens
cuuucuucccuacaguugaa

SEQ ID NO: 706059 - RNA, 18 nt, Homo sapiens
cuuugaaucuaguuguua

SEQ ID NO: 706060 - RNA, 16 nt, Homo sapiens
cuuugagccugggaaa

SEQ ID NO: 706061 - RNA, 17 nt, Homo sapiens
cuuugaguagauccauu

SEQ ID NO: 706062 - RNA, 16 nt, Homo sapiens
cuuugcauauuauaaa

SEQ ID NO: 706063 - RNA, 19 nt, Homo sapiens
cuuugcauguaagcucuuu

SEQ ID NO: 706064 - RNA, 14 nt, Homo sapiens
cuuugcugccugag

SEQ ID NO: 706065 - RNA, 14 nt, Homo sapiens
cuuuguauauuaca

SEQ ID NO: 706066 - RNA, 16 nt, Homo sapiens
cuuugucaaaaggaag

SEQ ID NO: 706067 - RNA, 13 nt, Homo sapiens
cuuugucuugccc

SEQ ID NO: 706068 - RNA, 15 nt, Homo sapiens
cuuugugguagcuua

SEQ ID NO: 706069 - RNA, 21 nt, Homo sapiens
cuuuguuuagcccaaaaccaa

SEQ ID NO: 706070 - RNA, 21 nt, Homo sapiens
cuuuguuuguugucagcugaa

SEQ ID NO: 706071 - RNA, 19 nt, Homo sapiens
cuuuuaaaaugcaauguaa

SEQ ID NO: 706072 - RNA, 21 nt, Homo sapiens
cuuuuaacuuuauaaauccag

SEQ ID NO: 706073 - RNA, 22 nt, Homo sapiens
cuuuuaaggcuaaaacuuaaca

SEQ ID NO: 706074 - RNA, 19 nt, Homo sapiens
cuuuuauuugaaaugucau

SEQ ID NO: 706075 - RNA, 14 nt, Homo sapiens
cuuuucaaccacaa

SEQ ID NO: 706076 - RNA, 14 nt, Homo sapiens
cuuuuugacacuga

SEQ ID NO: 706077 - RNA, 15 nt, Homo sapiens
cuuuuugacacugaa

SEQ ID NO: 706078 - RNA, 20 nt, Homo sapiens
cuuuuuuucuuguccucauu

SEQ ID NO: 706079 - RNA, 19 nt, Homo sapiens
gaaaaaccaccaccaucac

SEQ ID NO: 706080 - RNA, 16 nt, Homo sapiens
gaaaaagccugugaaa

SEQ ID NO: 706081 - RNA, 17 nt, Homo sapiens
gaaaaauaucuuggccu

SEQ ID NO: 706082 - RNA, 22 nt, Homo sapiens
gaaaacuagauugcuaguuuau

SEQ ID NO: 706083 - RNA, 15 nt, Homo sapiens
gaaaaggcugguaca

SEQ ID NO: 706084 - RNA, 17 nt, Homo sapiens
gaaaaugaaaugcauau

SEQ ID NO: 706085 - RNA, 10 nt, Homo sapiens
gaaaauggaa

SEQ ID NO: 706086 - RNA, 15 nt, Homo sapiens
gaaaauuacagucca

SEQ ID NO: 706087 - RNA, 19 nt, Homo sapiens
gaaaauuuuuaaauauuca

SEQ ID NO: 706088 - RNA, 22 nt, Homo sapiens
gaaacagcaggacuuguuuaca

SEQ ID NO: 706089 - RNA, 18 nt, Homo sapiens
gaaacccccaguguaaua

SEQ ID NO: 706090 - RNA, 17 nt, Homo sapiens
gaaacuaaagcaauaga

SEQ ID NO: 706091 - RNA, 20 nt, Homo sapiens
gaaacuaauauuuuauguga

SEQ ID NO: 706092 - RNA, 16 nt, Homo sapiens
gaaacuauacauuuau

SEQ ID NO: 706093 - RNA, 18 nt, Homo sapiens
gaaacuugugaaguggaa

SEQ ID NO: 706094 - RNA, 15 nt, Homo sapiens
gaaagacacugccug

SEQ ID NO: 706095 - RNA, 18 nt, Homo sapiens
gaaagagacuccgucuca

SEQ ID NO: 706096 - RNA, 18 nt, Homo sapiens
gaaagaggcaccaggaag

SEQ ID NO: 706097 - RNA, 14 nt, Homo sapiens
gaaagcucacucug

SEQ ID NO: 706098 - RNA, 22 nt, Homo sapiens
gaaaggcuuuucaaccacaaaa

SEQ ID NO: 706099 - RNA, 13 nt, Homo sapiens
gaaaggggugcuu

SEQ ID NO: 706100 - RNA, 13 nt, Homo sapiens
gaaauaagccccc

SEQ ID NO: 706101 - RNA, 17 nt, Homo sapiens
gaaaugcauauuugcaa

SEQ ID NO: 706102 - RNA, 17 nt, Homo sapiens
gaaaugccugcuuugaa

SEQ ID NO: 706103 - RNA, 20 nt, Homo sapiens
gaaaugccugcuuugaauaa

SEQ ID NO: 706104 - RNA, 18 nt, Homo sapiens
gaaauugcauacuuugua

SEQ ID NO: 706105 - RNA, 17 nt, Homo sapiens
gaacaauccauaacuuu

SEQ ID NO: 706106 - RNA, 22 nt, Homo sapiens
uagccugccucuucucuacucu

SEQ ID NO: 706107 - RNA, 19 nt, Homo sapiens
uagcgacugucaacagcgu

SEQ ID NO: 706108 - RNA, 16 nt, Homo sapiens
uagcuggccacauggc

SEQ ID NO: 706109 - RNA, 14 nt, Homo sapiens
uagcugugcucaga

SEQ ID NO: 706110 - RNA, 18 nt, Homo sapiens
uaggaaagaggaagcaaa

SEQ ID NO: 706111 - RNA, 16 nt, Homo sapiens
uaggaaggugaaucug

SEQ ID NO: 706112 - RNA, 18 nt, Homo sapiens
uaggaaugguucucucaa

SEQ ID NO: 706113 - RNA, 14 nt, Homo sapiens
uaggagacuugcca

SEQ ID NO: 706114 - RNA, 22 nt, Homo sapiens
uaggcaccuuuuacugugaugu

SEQ ID NO: 706115 - RNA, 14 nt, Homo sapiens
uaggcauuugcuga

SEQ ID NO: 706116 - RNA, 22 nt, Homo sapiens
uaggccuggggacggcuuuuac

SEQ ID NO: 706117 - RNA, 14 nt, Homo sapiens
uagggaacugggga

SEQ ID NO: 706118 - RNA, 12 nt, Homo sapiens
uaguaacauuca

SEQ ID NO: 706119 - RNA, 19 nt, Homo sapiens
uaguagauguggccuuuga

SEQ ID NO: 706120 - RNA, 14 nt, Homo sapiens
uagucaccagagac

SEQ ID NO: 706121 - RNA, 12 nt, Homo sapiens
uaguccaaaaag

SEQ ID NO: 706122 - RNA, 17 nt, Homo sapiens
uaguguaacuugcuuaa

SEQ ID NO: 706123 - RNA, 14 nt, Homo sapiens
uagugucacugcuu

SEQ ID NO: 706124 - RNA, 18 nt, Homo sapiens
uaguguguguguguauau

SEQ ID NO: 706125 - RNA, 21 nt, Homo sapiens
uaguuaccacauuacucugcc

SEQ ID NO: 706126 - RNA, 12 nt, Homo sapiens
uaguugccuuaa

SEQ ID NO: 706127 - RNA, 23 nt, Homo sapiens
uaguuguaaaccaagugaucaaa

SEQ ID NO: 706128 - RNA, 20 nt, Homo sapiens
uaguuuugucaaacuguaga

SEQ ID NO: 706129 - RNA, 19 nt, Homo sapiens
uauaaauuuguguucucaa

SEQ ID NO: 706130 - RNA, 20 nt, Homo sapiens
uauaaugccauuuuaaggaa

SEQ ID NO: 706131 - RNA, 17 nt, Homo sapiens
uauaauguccauaugcu

SEQ ID NO: 706132 - RNA, 14 nt, Homo sapiens
uauacuguuuacug

SEQ ID NO: 706133 - RNA, 20 nt, Homo sapiens
uauagccuauggcagaaaaa

SEQ ID NO: 706134 - RNA, 23 nt, Homo sapiens
uauaguuuguuuuuaaacuaaua

SEQ ID NO: 706135 - RNA, 14 nt, Homo sapiens
uauauauguauaua

SEQ ID NO: 706136 - RNA, 20 nt, Homo sapiens
uauaugguauauauacauau

SEQ ID NO: 706137 - RNA, 22 nt, Homo sapiens
uaucaaaauagucuaaggccau

SEQ ID NO: 706138 - RNA, 15 nt, Homo sapiens
uaucaauaucuaaua

SEQ ID NO: 706139 - RNA, 19 nt, Homo sapiens
uaucacuucacuguucucu

SEQ ID NO: 706140 - RNA, 22 nt, Homo sapiens
uaucaugcaaauuucaugacca

SEQ ID NO: 706141 - RNA, 17 nt, Homo sapiens
uaucauguauggugaua

SEQ ID NO: 706142 - RNA, 16 nt, Homo sapiens
uaucccaagaaugcaa

SEQ ID NO: 706143 - RNA, 15 nt, Homo sapiens
uaucuauagcugcua

SEQ ID NO: 706144 - RNA, 23 nt, Homo sapiens
uaucucaggggccaacuaggcag

SEQ ID NO: 706145 - RNA, 19 nt, Homo sapiens
uaugaaaauacaacuuaaa

SEQ ID NO: 706146 - RNA, 14 nt, Homo sapiens
uaugguaaucuuua

SEQ ID NO: 706147 - RNA, 20 nt, Homo sapiens
uauuaaggaagacaauguga

SEQ ID NO: 706148 - RNA, 13 nt, Homo sapiens
uauuaaucacugu

SEQ ID NO: 706149 - RNA, 21 nt, Homo sapiens
uauuacgaaguucaagaucaa

SEQ ID NO: 706150 - RNA, 14 nt, Homo sapiens
uauucuaauaagcu

SEQ ID NO: 706151 - RNA, 20 nt, Homo sapiens
uauucuauaaaacucugcau

SEQ ID NO: 706152 - RNA, 17 nt, Homo sapiens
uauucucuuaauuuuuc

SEQ ID NO: 706153 - RNA, 14 nt, Homo sapiens
uauugaauguuaaa

SEQ ID NO: 706154 - RNA, 17 nt, Homo sapiens
uauugcaaaauacauga

SEQ ID NO: 706155 - RNA, 14 nt, Homo sapiens
uauugcuucaccau

SEQ ID NO: 706156 - RNA, 17 nt, Homo sapiens
uauugcuucaccauggc

SEQ ID NO: 706157 - RNA, 16 nt, Homo sapiens
uauuuaccagaccaca

SEQ ID NO: 706158 - RNA, 17 nt, Homo sapiens
uauuuaccagaccacaa

SEQ ID NO: 706159 - RNA, 15 nt, Homo sapiens
uauuuauauguacug

SEQ ID NO: 706160 - RNA, 21 nt, Homo sapiens
uauuuauccagaaaacuguga

SEQ ID NO: 706161 - RNA, 18 nt, Homo sapiens
uauuuauguuugcacuug

SEQ ID NO: 706162 - RNA, 16 nt, Homo sapiens
uauuuggaaugaagga

SEQ ID NO: 706163 - RNA, 13 nt, Homo sapiens
uauuuucuguuga

SEQ ID NO: 706164 - RNA, 19 nt, Homo sapiens
uauuuuuauaucaugcaaa

SEQ ID NO: 706165 - RNA, 12 nt, Homo sapiens
ucaaaagugccu

SEQ ID NO: 706166 - RNA, 16 nt, Homo sapiens
ucaaaauauacauuca

SEQ ID NO: 706167 - RNA, 17 nt, Homo sapiens
ucaaaauauacauucaa

SEQ ID NO: 706168 - RNA, 18 nt, Homo sapiens
ucaaacucauuggcuuaa

SEQ ID NO: 706169 - RNA, 22 nt, Homo sapiens
ucaaauacacauuugcuacugu

SEQ ID NO: 706170 - RNA, 16 nt, Homo sapiens
ucaacagcaaguguga

SEQ ID NO: 706171 - RNA, 17 nt, Homo sapiens
ucaaccccucacaggag

SEQ ID NO: 706172 - RNA, 16 nt, Homo sapiens
ucaacugccucucuuu

SEQ ID NO: 706173 - RNA, 15 nt, Homo sapiens
ucaaggcugcaguga

SEQ ID NO: 706174 - RNA, 18 nt, Homo sapiens
ucaauaauauauuuucug

SEQ ID NO: 706175 - RNA, 15 nt, Homo sapiens
ucaauagaucuccag

SEQ ID NO: 706176 - RNA, 23 nt, Homo sapiens
ucaauggcuuguucaucauccag

SEQ ID NO: 706177 - RNA, 16 nt, Homo sapiens
ucaaugggaccugugg

SEQ ID NO: 706178 - RNA, 17 nt, Homo sapiens
ucaaugggaccuguggc

SEQ ID NO: 706179 - RNA, 13 nt, Homo sapiens
ucaauucuaguca

SEQ ID NO: 706180 - RNA, 16 nt, Homo sapiens
ucacacauuacaaagu

SEQ ID NO: 706181 - RNA, 12 nt, Homo sapiens
ucacagagucaa

SEQ ID NO: 706182 - RNA, 18 nt, Homo sapiens
ucacagcuaugcaaaaag

SEQ ID NO: 706183 - RNA, 14 nt, Homo sapiens
ucaccauggccuua

SEQ ID NO: 706184 - RNA, 21 nt, Homo sapiens
ucaccuucuagucuuggccag

SEQ ID NO: 706185 - RNA, 21 nt, Homo sapiens
ucacgaggaaaagagaaggaa

SEQ ID NO: 706186 - RNA, 15 nt, Homo sapiens
ucacuaaagcaugaa

SEQ ID NO: 706187 - RNA, 21 nt, Homo sapiens
ucacuaggcccccacuugccu

SEQ ID NO: 706188 - RNA, 23 nt, Homo sapiens
ucacugaugggaaaacugccaau

SEQ ID NO: 706189 - RNA, 15 nt, Homo sapiens
ucacuggaaagggga

SEQ ID NO: 706190 - RNA, 21 nt, Homo sapiens
ucacuggagguugaagccaag

SEQ ID NO: 706191 - RNA, 21 nt, Homo sapiens
ucacuguuuagauuugccaua

SEQ ID NO: 706192 - RNA, 15 nt, Homo sapiens
ucacuuaauccuuug

SEQ ID NO: 706193 - RNA, 16 nt, Homo sapiens
ucacuucacuguucuc

SEQ ID NO: 706194 - RNA, 16 nt, Homo sapiens
ucagaaggagcuacaa

SEQ ID NO: 706195 - RNA, 15 nt, Homo sapiens
ucagacagaacuuga

SEQ ID NO: 706196 - RNA, 13 nt, Homo sapiens
ucagagacagaua

SEQ ID NO: 706197 - RNA, 17 nt, Homo sapiens
ucagagacagauaccuc

SEQ ID NO: 706198 - RNA, 19 nt, Homo sapiens
ucagcaauacagacuacuu

SEQ ID NO: 706199 - RNA, 15 nt, Homo sapiens
ucagcaggcaaagac

SEQ ID NO: 706200 - RNA, 15 nt, Homo sapiens
ucagcugaaccuggg

SEQ ID NO: 706201 - RNA, 17 nt, Homo sapiens
ucagucccucugcucuc

SEQ ID NO: 706202 - RNA, 18 nt, Homo sapiens
ucagucccuuccccaugc

SEQ ID NO: 706203 - RNA, 18 nt, Homo sapiens
ucagugcacuguauauag

SEQ ID NO: 706204 - RNA, 19 nt, Homo sapiens
ucaguguuuuugugaauug

SEQ ID NO: 706205 - RNA, 15 nt, Homo sapiens
ucaguuauuacaugu

SEQ ID NO: 706206 - RNA, 15 nt, Homo sapiens
ucauaagacaaugga

SEQ ID NO: 706207 - RNA, 15 nt, Homo sapiens
ucauaguuacugugu

SEQ ID NO: 706208 - RNA, 22 nt, Homo sapiens
ucauaguuacuguguaaacuca

SEQ ID NO: 706209 - RNA, 16 nt, Homo sapiens
ucauauaccagcaaua

SEQ ID NO: 706210 - RNA, 18 nt, Homo sapiens
ucauauauuaaacaucca

SEQ ID NO: 706211 - RNA, 21 nt, Homo sapiens
ucauaucuuaauauauuucua

SEQ ID NO: 706212 - RNA, 23 nt, Homo sapiens
ucauccagacucagagcucucuc

SEQ ID NO: 706213 - RNA, 18 nt, Homo sapiens
ucaugaagaaaagaccuu

SEQ ID NO: 706214 - RNA, 19 nt, Homo sapiens
ucaugggagggggcuugaa

SEQ ID NO: 706215 - RNA, 19 nt, Homo sapiens
ucauguauaaaacuaggaa

SEQ ID NO: 706216 - RNA, 16 nt, Homo sapiens
ucauguaugucagaag

SEQ ID NO: 706217 - RNA, 11 nt, Homo sapiens
ucauucuugcc

SEQ ID NO: 706218 - RNA, 14 nt, Homo sapiens
ucauugaugcugcu

SEQ ID NO: 706219 - RNA, 13 nt, Homo sapiens
ucauuucaucuca

SEQ ID NO: 706220 - RNA, 12 nt, Homo sapiens
uccaaagaggcu

SEQ ID NO: 706221 - RNA, 15 nt, Homo sapiens
uccaaagaggcugcc

SEQ ID NO: 706222 - RNA, 16 nt, Homo sapiens
uccaacacugcugcuc

SEQ ID NO: 706223 - RNA, 18 nt, Homo sapiens
uccaacccugccgucacc

SEQ ID NO: 706224 - RNA, 15 nt, Homo sapiens
uccaaccuucccaaa

SEQ ID NO: 706225 - RNA, 14 nt, Homo sapiens
ucuugacuagugca

SEQ ID NO: 706226 - RNA, 14 nt, Homo sapiens
uccaacucccuuaa

SEQ ID NO: 706227 - RNA, 19 nt, Homo sapiens
uccaagauuuaaaugccau

SEQ ID NO: 706228 - RNA, 17 nt, Homo sapiens
ugcgcucucuuugcaac

SEQ ID NO: 706229 - RNA, 17 nt, Homo sapiens
ugcggugccaugaaggg

SEQ ID NO: 706230 - RNA, 15 nt, Homo sapiens
uuggggccaccaaag

SEQ ID NO: 706231 - RNA, 17 nt, Homo sapiens
uuggugcuuuucacuug

SEQ ID NO: 706232 - RNA, 22 nt, Homo sapiens
uugguuuuauuuuauacuugcc

SEQ ID NO: 706233 - RNA, 19 nt, Homo sapiens
acugaaccacuuguagauu

SEQ ID NO: 706234 - RNA, 20 nt, Homo sapiens
acugcacuccagccugggug

SEQ ID NO: 706235 - RNA, 16 nt, Homo sapiens
acugccacacucucca

SEQ ID NO: 706236 - RNA, 20 nt, Homo sapiens
acugccacacucuccaucac

SEQ ID NO: 706237 - RNA, 13 nt, Homo sapiens
acugccagcagca

SEQ ID NO: 706238 - RNA, 15 nt, Homo sapiens
acugccaugccagcu

SEQ ID NO: 706239 - RNA, 13 nt, Homo sapiens
acugcuugaauaa

SEQ ID NO: 706240 - RNA, 16 nt, Homo sapiens
acuguaaacuucugca

SEQ ID NO: 706241 - RNA, 12 nt, Homo sapiens
acuguagaugau

SEQ ID NO: 706242 - RNA, 18 nt, Homo sapiens
acuguauuugaaauaaga

SEQ ID NO: 706243 - RNA, 21 nt, Homo sapiens
acugucugugaacagagagac

SEQ ID NO: 706244 - RNA, 15 nt, Homo sapiens
acugucuuccucaaa

SEQ ID NO: 706245 - RNA, 22 nt, Homo sapiens
aaggacagugucaaagugauaa

SEQ ID NO: 706246 - RNA, 14 nt, Homo sapiens
aaggauauuuacua

SEQ ID NO: 706247 - RNA, 18 nt, Homo sapiens
aaggauauuuacuacuuu

SEQ ID NO: 706248 - RNA, 16 nt, Homo sapiens
aaggccugguguuucu

SEQ ID NO: 706249 - RNA, 15 nt, Homo sapiens
aaggcuuuaucucag

SEQ ID NO: 706250 - RNA, 17 nt, Homo sapiens
aaggcuuuaucucaggg

SEQ ID NO: 706251 - RNA, 16 nt, Homo sapiens
aagggccgacuaagag

SEQ ID NO: 706252 - RNA, 16 nt, Homo sapiens
aaggguuucucuauua

SEQ ID NO: 706253 - RNA, 14 nt, Homo sapiens
aagguuacuggaua

SEQ ID NO: 706254 - RNA, 18 nt, Homo sapiens
aaguagaucuuuucuuga

SEQ ID NO: 706255 - RNA, 17 nt, Homo sapiens
aaguaugcacuuggccu

SEQ ID NO: 706256 - RNA, 13 nt, Homo sapiens
aagucacuuuuau

SEQ ID NO: 706257 - RNA, 16 nt, Homo sapiens
aagucagagacagaua

SEQ ID NO: 706258 - RNA, 13 nt, Homo sapiens
aagucagcuccag

SEQ ID NO: 706259 - RNA, 13 nt, Homo sapiens
aagucagcuuuca

SEQ ID NO: 706260 - RNA, 16 nt, Homo sapiens
uacaguaucucagggc

SEQ ID NO: 706261 - RNA, 14 nt, Homo sapiens
uacauagagaauaa

SEQ ID NO: 706262 - RNA, 19 nt, Homo sapiens
uacaugaagcuucaugcac

SEQ ID NO: 706263 - RNA, 22 nt, Homo sapiens
uacaugucacauuuagcugugc

SEQ ID NO: 706264 - RNA, 16 nt, Homo sapiens
uacauucaaauuuguc

SEQ ID NO: 706265 - RNA, 22 nt, Homo sapiens
uacauuguucuuauucuggcau

SEQ ID NO: 706266 - RNA, 14 nt, Homo sapiens
uaccaaucucugaa

SEQ ID NO: 706267 - RNA, 16 nt, Homo sapiens
uaccuccaacccugcc

SEQ ID NO: 706268 - RNA, 18 nt, Homo sapiens
uaccuccaacccugccgu

SEQ ID NO: 706269 - RNA, 19 nt, Homo sapiens
acuggccccuacuuugugg

SEQ ID NO: 706270 - RNA, 17 nt, Homo sapiens
acuggcugucaguauga

SEQ ID NO: 706271 - RNA, 15 nt, Homo sapiens
acuggggcagacaau

SEQ ID NO: 706272 - RNA, 15 nt, Homo sapiens
acugguuuucugcca

SEQ ID NO: 706273 - RNA, 13 nt, Homo sapiens
acuguaagggauu

SEQ ID NO: 706274 - RNA, 18 nt, Homo sapiens
acuguauauagaagucua

SEQ ID NO: 706275 - RNA, 21 nt, Homo sapiens
acugucucucuucucagagug

SEQ ID NO: 706276 - RNA, 18 nt, Homo sapiens
acuguguuuaucuugaua

SEQ ID NO: 706277 - RNA, 17 nt, Homo sapiens
acuguuguucugugguu

SEQ ID NO: 706278 - RNA, 19 nt, Homo sapiens
acuguuucuggacccuuau

SEQ ID NO: 706279 - RNA, 13 nt, Homo sapiens
acuguuuuaucug

SEQ ID NO: 706280 - RNA, 15 nt, Homo sapiens
acuuaagacugugua

SEQ ID NO: 706281 - RNA, 18 nt, Homo sapiens
acuuaaguacccuuucaa

SEQ ID NO: 706282 - RNA, 11 nt, Homo sapiens
acuuaaugucu

SEQ ID NO: 706283 - RNA, 22 nt, Homo sapiens
acuuaccacucgugcaucccug

SEQ ID NO: 706284 - RNA, 19 nt, Homo sapiens
acuucaagagccucuggca

SEQ ID NO: 706285 - RNA, 15 nt, Homo sapiens
acuuccgagcuaugu

SEQ ID NO: 706286 - RNA, 20 nt, Homo sapiens
acuucuagugccucuguuac

SEQ ID NO: 706287 - RNA, 14 nt, Homo sapiens
acuucucuacccca

SEQ ID NO: 706288 - RNA, 15 nt, Homo sapiens
acuugaugauacaau

SEQ ID NO: 706289 - RNA, 18 nt, Homo sapiens
acuugaugauacaaugaa

SEQ ID NO: 706290 - RNA, 22 nt, Homo sapiens
acuugcuuuaccuuuucagggc

SEQ ID NO: 706291 - RNA, 23 nt, Homo sapiens
acuuggcucgaaucucugugccu

SEQ ID NO: 706292 - RNA, 17 nt, Homo sapiens
acuuuacugccugaaua

SEQ ID NO: 706293 - RNA, 16 nt, Homo sapiens
acuuuguaaauucuga

SEQ ID NO: 706294 - RNA, 22 nt, Homo sapiens
acuuuguuuagcccaaaaccaa

SEQ ID NO: 706295 - RNA, 22 nt, Homo sapiens
acuuuuacacgaccauuugaua

SEQ ID NO: 706296 - RNA, 19 nt, Homo sapiens
agaaaaaaagagugaaaaa

SEQ ID NO: 706297 - RNA, 13 nt, Homo sapiens
agaaaaauacuuu

SEQ ID NO: 706298 - RNA, 15 nt, Homo sapiens
agaaaagaacuggaa

SEQ ID NO: 706299 - RNA, 12 nt, Homo sapiens
agaaaagaccuu

SEQ ID NO: 706300 - RNA, 19 nt, Homo sapiens
agaaaagauuauauauuau

SEQ ID NO: 706301 - RNA, 23 nt, Homo sapiens
agaaaauauauucuuucaaagga

SEQ ID NO: 706302 - RNA, 19 nt, Homo sapiens
agaaaaugaaaugcauauu

SEQ ID NO: 706303 - RNA, 18 nt, Homo sapiens
agaaacuugugaagugga

SEQ ID NO: 706304 - RNA, 18 nt, Homo sapiens
agaaagugaagcaaauca

SEQ ID NO: 706305 - RNA, 21 nt, Homo sapiens
agaaaugcuuuccaaaaccgc

SEQ ID NO: 706306 - RNA, 19 nt, Homo sapiens
agaacacacacauauacac

SEQ ID NO: 706307 - RNA, 22 nt, Homo sapiens
agaacaugaaucaaaagugccu

SEQ ID NO: 706308 - RNA, 16 nt, Homo sapiens
agaaccacacuugaaa

SEQ ID NO: 706309 - RNA, 20 nt, Homo sapiens
agaaccacacuugaaaccuu

SEQ ID NO: 706310 - RNA, 23 nt, Homo sapiens
agaacguuuuuuccucagugcau

SEQ ID NO: 706311 - RNA, 14 nt, Homo sapiens
agaacugucuguga

SEQ ID NO: 706312 - RNA, 21 nt, Homo sapiens
agaagcaguggccuuauugca

SEQ ID NO: 706313 - RNA, 14 nt, Homo sapiens
agaagcaugaaguc

SEQ ID NO: 706314 - RNA, 14 nt, Homo sapiens
agaagggcuaucau

SEQ ID NO: 706315 - RNA, 13 nt, Homo sapiens
agaaggugccacu

SEQ ID NO: 706316 - RNA, 22 nt, Homo sapiens
agaaggugccacuuuacccacc

SEQ ID NO: 706317 - RNA, 13 nt, Homo sapiens
agaauaagaauuu

SEQ ID NO: 706318 - RNA, 22 nt, Homo sapiens
agaaugaaagacugaaucuucc

SEQ ID NO: 706319 - RNA, 15 nt, Homo sapiens
agaaugaagacuguu

SEQ ID NO: 706320 - RNA, 10 nt, Homo sapiens
agaaugcaac

SEQ ID NO: 706321 - RNA, 23 nt, Homo sapiens
agaauggcgccaccagcucugcc

SEQ ID NO: 706322 - RNA, 18 nt, Homo sapiens
agaauuaaaaaagcauac

SEQ ID NO: 706323 - RNA, 22 nt, Homo sapiens
agaauuauaucacuucacuguu

SEQ ID NO: 706324 - RNA, 11 nt, Homo sapiens
agaauuugcau

SEQ ID NO: 706325 - RNA, 19 nt, Homo sapiens
agacaauaaacccucagag

SEQ ID NO: 706326 - RNA, 22 nt, Homo sapiens
agacaaugugaaaagaaaaaug

SEQ ID NO: 706327 - RNA, 14 nt, Homo sapiens
agacagaacuugaa

SEQ ID NO: 706328 - RNA, 15 nt, Homo sapiens
agacagcuacacaga

SEQ ID NO: 706329 - RNA, 19 nt, Homo sapiens
agacauacuccuuccauca

SEQ ID NO: 706330 - RNA, 19 nt, Homo sapiens
agacaucuuugggccuguc

SEQ ID NO: 706331 - RNA, 16 nt, Homo sapiens
agaccccggcuuccuu

SEQ ID NO: 706332 - RNA, 15 nt, Homo sapiens
agaccuggcacugga

SEQ ID NO: 706333 - RNA, 23 nt, Homo sapiens
agaccuuuuggcccaaucucugc

SEQ ID NO: 706334 - RNA, 19 nt, Homo sapiens
agacuggggcauccugugc

SEQ ID NO: 706335 - RNA, 19 nt, Homo sapiens
agacugguuuucugccaau

SEQ ID NO: 706336 - RNA, 11 nt, Homo sapiens
agacugugcug

SEQ ID NO: 706337 - RNA, 13 nt, Homo sapiens
agacugugcuguu

SEQ ID NO: 706338 - RNA, 19 nt, Homo sapiens
agacuguggcuagugacaa

SEQ ID NO: 706339 - RNA, 14 nt, Homo sapiens
agacuuuacaugga

SEQ ID NO: 706340 - RNA, 18 nt, Homo sapiens
agagaagcaaguaaaaag

SEQ ID NO: 706341 - RNA, 12 nt, Homo sapiens
agagacagauac

SEQ ID NO: 706342 - RNA, 18 nt, Homo sapiens
agagacagauaccuccaa

SEQ ID NO: 706343 - RNA, 14 nt, Homo sapiens
agagacuccgucuc

SEQ ID NO: 706344 - RNA, 13 nt, Homo sapiens
agagauccaaaga

SEQ ID NO: 706345 - RNA, 17 nt, Homo sapiens
agagccuuuugugcaaa

SEQ ID NO: 706346 - RNA, 20 nt, Homo sapiens
agagcgcaguguuuugcaag

SEQ ID NO: 706347 - RNA, 21 nt, Homo sapiens
agaggaaauucuccacugugc

SEQ ID NO: 706348 - RNA, 13 nt, Homo sapiens
agaggaauccugg

SEQ ID NO: 706349 - RNA, 14 nt, Homo sapiens
agaggcaccaggaa

SEQ ID NO: 706350 - RNA, 21 nt, Homo sapiens
agaggcugccccucucaccaa

SEQ ID NO: 706351 - RNA, 23 nt, Homo sapiens
agagggguggaguuuuaacugua

SEQ ID NO: 706352 - RNA, 12 nt, Homo sapiens
agaguacacugc

SEQ ID NO: 706353 - RNA, 14 nt, Homo sapiens
agagucgcaucuca

SEQ ID NO: 706354 - RNA, 17 nt, Homo sapiens
agaguguagacuguggc

SEQ ID NO: 706355 - RNA, 16 nt, Homo sapiens
agaguuuugucauuca

SEQ ID NO: 706356 - RNA, 15 nt, Homo sapiens
agauaaacuauacac

SEQ ID NO: 706357 - RNA, 16 nt, Homo sapiens
agauaccuccaacccu

SEQ ID NO: 706358 - RNA, 17 nt, Homo sapiens
agauauuuuuaucccaa

SEQ ID NO: 706359 - RNA, 12 nt, Homo sapiens
agaucacugcca

SEQ ID NO: 706360 - RNA, 13 nt, Homo sapiens
agaucacugccac

SEQ ID NO: 706361 - RNA, 15 nt, Homo sapiens
agaucacugccacac

SEQ ID NO: 706362 - RNA, 21 nt, Homo sapiens
agaucagccugggcaauguga

SEQ ID NO: 706363 - RNA, 15 nt, Homo sapiens
agaucauuuugaaau

SEQ ID NO: 706364 - RNA, 19 nt, Homo sapiens
agaucgcgccacugcacuc

SEQ ID NO: 706365 - RNA, 21 nt, Homo sapiens
agaucuuuucuugaccuagua

SEQ ID NO: 706366 - RNA, 17 nt, Homo sapiens
agaugggagccuuuacc

SEQ ID NO: 706367 - RNA, 17 nt, Homo sapiens
agaugguuucuugcaag

SEQ ID NO: 706368 - RNA, 16 nt, Homo sapiens
agauguguuaggaaug

SEQ ID NO: 706369 - RNA, 17 nt, Homo sapiens
agauguuacaaguuuau

SEQ ID NO: 706370 - RNA, 21 nt, Homo sapiens
agauguugauuuuuacugugu

SEQ ID NO: 706371 - RNA, 16 nt, Homo sapiens
agauguuuaaaacacc

SEQ ID NO: 706372 - RNA, 20 nt, Homo sapiens
agauuagaagacaacaggca

SEQ ID NO: 706373 - RNA, 20 nt, Homo sapiens
agauucucaaaauuccuaca

SEQ ID NO: 706374 - RNA, 20 nt, Homo sapiens
agauugaaucugaaccaugu

SEQ ID NO: 706375 - RNA, 20 nt, Homo sapiens
agauugacuaacucaaauac

SEQ ID NO: 706376 - RNA, 23 nt, Homo sapiens
agauugugccacuucacuccagc

SEQ ID NO: 706377 - RNA, 22 nt, Homo sapiens
agauuuuaacuaauaaugcugg

SEQ ID NO: 706378 - RNA, 16 nt, Homo sapiens
agauuuucuuuugccu

SEQ ID NO: 706379 - RNA, 18 nt, Homo sapiens
agauuuucuuuugccuuu

SEQ ID NO: 706380 - RNA, 15 nt, Homo sapiens
agcaacaagaccacc

SEQ ID NO: 706381 - RNA, 13 nt, Homo sapiens
agcaacucagaga

SEQ ID NO: 706382 - RNA, 20 nt, Homo sapiens
agcaacuucuucuccauccc

SEQ ID NO: 706383 - RNA, 13 nt, Homo sapiens
agcaauaccaguu

SEQ ID NO: 706384 - RNA, 19 nt, Homo sapiens
agcaaucaagguuauaauu

SEQ ID NO: 706385 - RNA, 18 nt, Homo sapiens
agcacaauuugcacuaaa

SEQ ID NO: 706386 - RNA, 16 nt, Homo sapiens
agcacagcuugaccug

SEQ ID NO: 706387 - RNA, 19 nt, Homo sapiens
agcacagcuugaccugagg

SEQ ID NO: 706388 - RNA, 17 nt, Homo sapiens
guugugugucaugccag

SEQ ID NO: 706389 - RNA, 22 nt, Homo sapiens
guuuacaauaggaguggugauu

SEQ ID NO: 706390 - RNA, 15 nt, Homo sapiens
guuuagaacagguuu

SEQ ID NO: 706391 - RNA, 13 nt, Homo sapiens
guuuagugauauu

SEQ ID NO: 706392 - RNA, 14 nt, Homo sapiens
guuuauaaugccau

SEQ ID NO: 706393 - RNA, 22 nt, Homo sapiens
guuuauccacccacaacaucua

SEQ ID NO: 706394 - RNA, 23 nt, Homo sapiens
guuuccugggcacgcacuggguu

SEQ ID NO: 706395 - RNA, 15 nt, Homo sapiens
guuucuccugagcua

SEQ ID NO: 706396 - RNA, 17 nt, Homo sapiens
guuucugguggucuguu

SEQ ID NO: 706397 - RNA, 10 nt, Homo sapiens
guuugacaac

SEQ ID NO: 706398 - RNA, 17 nt, Homo sapiens
guuuggaaaaguggcgu

SEQ ID NO: 706399 - RNA, 22 nt, Homo sapiens
guuuggaaucccacuaaugcaa

SEQ ID NO: 706400 - RNA, 16 nt, Homo sapiens
guuuggugaacuauau

SEQ ID NO: 706401 - RNA, 17 nt, Homo sapiens
guuugugagaaacaucu

SEQ ID NO: 706402 - RNA, 19 nt, Homo sapiens
guuuguguguugucucuug

SEQ ID NO: 706403 - RNA, 12 nt, Homo sapiens
guuuuaacugua

SEQ ID NO: 706404 - RNA, 19 nt, Homo sapiens
guuuucguagguugacuau

SEQ ID NO: 706405 - RNA, 19 nt, Homo sapiens
guuuuuccuggaauugcca

SEQ ID NO: 706406 - RNA, 21 nt, Homo sapiens
guuuuucugcuuuagacuuga

SEQ ID NO: 706407 - RNA, 13 nt, Homo sapiens
uaaaaaagcauac

SEQ ID NO: 706408 - RNA, 15 nt, Homo sapiens
uaaaaaagccuuccu

SEQ ID NO: 706409 - RNA, 14 nt, Homo sapiens
uaaaaacauaacau

SEQ ID NO: 706410 - RNA, 15 nt, Homo sapiens
uaaaaagggaauuau

SEQ ID NO: 706411 - RNA, 18 nt, Homo sapiens
uaaaaauggauacuggug

SEQ ID NO: 706412 - RNA, 17 nt, Homo sapiens
uaaaacaaaauuugacu

SEQ ID NO: 706413 - RNA, 19 nt, Homo sapiens
uaaaacacaccuaagagaa

SEQ ID NO: 706414 - RNA, 13 nt, Homo sapiens
uaaaaccaaagag

SEQ ID NO: 706415 - RNA, 16 nt, Homo sapiens
uaaaacucacugugau

SEQ ID NO: 706416 - RNA, 17 nt, Homo sapiens
uaaaauaaaugcaauug

SEQ ID NO: 706417 - RNA, 22 nt, Homo sapiens
uaaaauaauuauauaacuguau

SEQ ID NO: 706418 - RNA, 17 nt, Homo sapiens
uaaaauaccuagaccua

SEQ ID NO: 706419 - RNA, 19 nt, Homo sapiens
uaaaauauuguugaacacu

SEQ ID NO: 706420 - RNA, 18 nt, Homo sapiens
uaaacaagggucaauuca

SEQ ID NO: 706421 - RNA, 20 nt, Homo sapiens
uaaacaagggucaauucaaa

SEQ ID NO: 706422 - RNA, 18 nt, Homo sapiens
uaaacagccucuuuuuga

SEQ ID NO: 706423 - RNA, 17 nt, Homo sapiens
uaaacauugaaguaaug

SEQ ID NO: 706424 - RNA, 11 nt, Homo sapiens
uaaacauuuau

SEQ ID NO: 706425 - RNA, 23 nt, Homo sapiens
uaaacuauacacuuaaugauaca

SEQ ID NO: 706426 - RNA, 22 nt, Homo sapiens
uaaacucaucugaaauguuaca

SEQ ID NO: 706427 - RNA, 14 nt, Homo sapiens
uaaacuuguuuaca

SEQ ID NO: 706428 - RNA, 20 nt, Homo sapiens
uaaagaaaaaaauacuauuu

SEQ ID NO: 706429 - RNA, 17 nt, Homo sapiens
uaaagacccuccuauuc

SEQ ID NO: 706430 - RNA, 21 nt, Homo sapiens
uaaagacugguuuucugccaa

SEQ ID NO: 706431 - RNA, 17 nt, Homo sapiens
uaaagcaugaaauguga

SEQ ID NO: 706432 - RNA, 21 nt, Homo sapiens
uaaagcaugaaaugugaauuu

SEQ ID NO: 706433 - RNA, 17 nt, Homo sapiens
uaaagcuuaacacuuga

SEQ ID NO: 706434 - RNA, 17 nt, Homo sapiens
uaaagcuuguugacuca

SEQ ID NO: 706435 - RNA, 24 nt, Homo sapiens
uaaagguaaaacaugcuggugaac

SEQ ID NO: 706436 - RNA, 20 nt, Homo sapiens
uaaaguaaauacaugcauau

SEQ ID NO: 706437 - RNA, 18 nt, Homo sapiens
uaaaguuaaaagaaugua

SEQ ID NO: 706438 - RNA, 16 nt, Homo sapiens
uaaauaaaauuuguug

SEQ ID NO: 706439 - RNA, 16 nt, Homo sapiens
uaaauaaaccacugug

SEQ ID NO: 706440 - RNA, 13 nt, Homo sapiens
uaaauacauaugg

SEQ ID NO: 706441 - RNA, 21 nt, Homo sapiens
uaaauacauauggauguuacu

SEQ ID NO: 706442 - RNA, 15 nt, Homo sapiens
uaaauacaugcauau

SEQ ID NO: 706443 - RNA, 17 nt, Homo sapiens
uaaauaggaaucauuca

SEQ ID NO: 706444 - RNA, 14 nt, Homo sapiens
uaaaucaaauauuc

SEQ ID NO: 706445 - RNA, 13 nt, Homo sapiens
uaaauuaagcaug

SEQ ID NO: 706446 - RNA, 13 nt, Homo sapiens
uaaauuagcuuuu

SEQ ID NO: 706447 - RNA, 18 nt, Homo sapiens
uaaauucagaaagucaua

SEQ ID NO: 706448 - RNA, 20 nt, Homo sapiens
uaaauucuauaggaacauau

SEQ ID NO: 706449 - RNA, 23 nt, Homo sapiens
uaaauucuauaggaacauaugaa

SEQ ID NO: 706450 - RNA, 18 nt, Homo sapiens
uaaauuucuuaugugaca

SEQ ID NO: 706451 - RNA, 17 nt, Homo sapiens
uaaauuuguguucucaa

SEQ ID NO: 706452 - RNA, 20 nt, Homo sapiens
uaaauuuguguucucaaaua

SEQ ID NO: 706453 - RNA, 19 nt, Homo sapiens
uaacaaagcccuuauucuc

SEQ ID NO: 706454 - RNA, 14 nt, Homo sapiens
uaacaccaugauua

SEQ ID NO: 706455 - RNA, 23 nt, Homo sapiens
uaacauaccguuuauaaugccau

SEQ ID NO: 706456 - RNA, 14 nt, Homo sapiens
uaacaucugaccug

SEQ ID NO: 706457 - RNA, 17 nt, Homo sapiens
uaacauuuccuuacaga

SEQ ID NO: 706458 - RNA, 23 nt, Homo sapiens
uaaccccuuccagaucacugcca

SEQ ID NO: 706459 - RNA, 23 nt, Homo sapiens
uaacucaccagccccacugccag

SEQ ID NO: 706460 - RNA, 15 nt, Homo sapiens
uaacuuaacugaaau

SEQ ID NO: 706461 - RNA, 19 nt, Homo sapiens
uaacuuuucggucuuuccc

SEQ ID NO: 706462 - RNA, 13 nt, Homo sapiens
uaagaaauguaua

SEQ ID NO: 706463 - RNA, 13 nt, Homo sapiens
uaagaauaccaca

SEQ ID NO: 706464 - RNA, 22 nt, Homo sapiens
uaagacaaauauuccuuugcau

SEQ ID NO: 706465 - RNA, 14 nt, Homo sapiens
uaagagacacucca

SEQ ID NO: 706466 - RNA, 23 nt, Homo sapiens
uaagagcaaaucaauucuaguca

SEQ ID NO: 706467 - RNA, 22 nt, Homo sapiens
uaagauguguuaggaaugucaa

SEQ ID NO: 706468 - RNA, 18 nt, Homo sapiens
uaagauugauaucuauaa

SEQ ID NO: 706469 - RNA, 15 nt, Homo sapiens
uaagcaaauguuaaa

SEQ ID NO: 706470 - RNA, 14 nt, Homo sapiens
uaagcauacuuugu

SEQ ID NO: 706471 - RNA, 19 nt, Homo sapiens
uaagcccccucaacuacca

SEQ ID NO: 706472 - RNA, 22 nt, Homo sapiens
uaagcccuaagguccuaaggca

SEQ ID NO: 706473 - RNA, 18 nt, Homo sapiens
uaagugaagugauacuau

SEQ ID NO: 706474 - RNA, 23 nt, Homo sapiens
uaaguggggugggaaggggagca

SEQ ID NO: 706475 - RNA, 16 nt, Homo sapiens
uaaguucuuaugagga

SEQ ID NO: 706476 - RNA, 22 nt, Homo sapiens
uaaguugucuaaacaaugcuga

SEQ ID NO: 706477 - RNA, 18 nt, Homo sapiens
uaauaaaaaggaguauac

SEQ ID NO: 706478 - RNA, 19 nt, Homo sapiens
uaauaaaaaggaguauaca

SEQ ID NO: 706479 - RNA, 21 nt, Homo sapiens
uaauaaaaccggucacugaug

SEQ ID NO: 706480 - RNA, 11 nt, Homo sapiens
uaauaagcaau

SEQ ID NO: 706481 - RNA, 15 nt, Homo sapiens
uaauaauguuuaaua

SEQ ID NO: 706482 - RNA, 14 nt, Homo sapiens
uaauacguacaugu

SEQ ID NO: 706483 - RNA, 17 nt, Homo sapiens
uaauagucuuugccagu

SEQ ID NO: 706484 - RNA, 16 nt, Homo sapiens
uaauagugacauauau

SEQ ID NO: 706485 - RNA, 20 nt, Homo sapiens
uaaugaaaaugaauaucuau

SEQ ID NO: 706486 - RNA, 16 nt, Homo sapiens
uaaugaaauacaucau

SEQ ID NO: 706487 - RNA, 15 nt, Homo sapiens
uaaugaaauggagga

SEQ ID NO: 706488 - RNA, 16 nt, Homo sapiens
uaaugaauacauuucc

SEQ ID NO: 706489 - RNA, 18 nt, Homo sapiens
uaaugaauacauuuccaa

SEQ ID NO: 706490 - RNA, 16 nt, Homo sapiens
uaaugagacugaccau

SEQ ID NO: 706491 - RNA, 14 nt, Homo sapiens
uaaugccucugguc

SEQ ID NO: 706492 - RNA, 15 nt, Homo sapiens
uaauggcaucaauau

SEQ ID NO: 706493 - RNA, 18 nt, Homo sapiens
uaauguacacauugcauu

SEQ ID NO: 706494 - RNA, 17 nt, Homo sapiens
uaauguccauaugcuaa

SEQ ID NO: 706495 - RNA, 19 nt, Homo sapiens
uaauucucuguggaaugaa

SEQ ID NO: 706496 - RNA, 12 nt, Homo sapiens
uaauugugugaa

SEQ ID NO: 706497 - RNA, 16 nt, Homo sapiens
uaauuuuuaacuuauu

SEQ ID NO: 706498 - RNA, 17 nt, Homo sapiens
uacaaaaauaaacuaua

SEQ ID NO: 706499 - RNA, 16 nt, Homo sapiens
uacaaaccuaccaaaa

SEQ ID NO: 706500 - RNA, 14 nt, Homo sapiens
uacaacucacauua

SEQ ID NO: 706501 - RNA, 14 nt, Homo sapiens
uacaaggcuuuauc

SEQ ID NO: 706502 - RNA, 19 nt, Homo sapiens
uacaaggcuuuaucucagg

SEQ ID NO: 706503 - RNA, 19 nt, Homo sapiens
uacaagucagcuccagcuu

SEQ ID NO: 706504 - RNA, 19 nt, Homo sapiens
uacacagaaacacugccuu

SEQ ID NO: 706505 - RNA, 16 nt, Homo sapiens
uacacauagcauguaa

SEQ ID NO: 706506 - RNA, 13 nt, Homo sapiens
uacagaacacauu

SEQ ID NO: 706507 - RNA, 20 nt, Homo sapiens
ggcuugaccaggcuuggccu

SEQ ID NO: 706508 - RNA, 19 nt, Homo sapiens
ggcuuggccugcugugauu

SEQ ID NO: 706509 - RNA, 12 nt, Homo sapiens
gggaacaugccc

SEQ ID NO: 706510 - RNA, 23 nt, Homo sapiens
gggaauacugugcauaagccauu

SEQ ID NO: 706511 - RNA, 22 nt, Homo sapiens
gggaauccaagccuccacagcg

SEQ ID NO: 706512 - RNA, 16 nt, Homo sapiens
gggcaggcugggccau

SEQ ID NO: 706513 - RNA, 16 nt, Homo sapiens
gggcuggcacugacug

SEQ ID NO: 706514 - RNA, 15 nt, Homo sapiens
gggcuugaagccaaa

SEQ ID NO: 706515 - RNA, 21 nt, Homo sapiens
gggggcggggaguauugaaug

SEQ ID NO: 706516 - RNA, 18 nt, Homo sapiens
gggguuuuguaaugacag

SEQ ID NO: 706517 - RNA, 13 nt, Homo sapiens
gggugggggugga

SEQ ID NO: 706518 - RNA, 18 nt, Homo sapiens
ggguucccgcggggcugu

SEQ ID NO: 706519 - RNA, 17 nt, Homo sapiens
ggugcacagccacuccc

SEQ ID NO: 706520 - RNA, 17 nt, Homo sapiens
ggugcuucucagauuuc

SEQ ID NO: 706521 - RNA, 21 nt, Homo sapiens
gguggaucacgaggucaggag

SEQ ID NO: 706522 - RNA, 20 nt, Homo sapiens
ggugguggaaggguagagag

SEQ ID NO: 706523 - RNA, 22 nt, Homo sapiens
ggugucugcgucgucaccaaau

SEQ ID NO: 706524 - RNA, 13 nt, Homo sapiens
gguguuuugccau

SEQ ID NO: 706525 - RNA, 19 nt, Homo sapiens
gguucguucuguacuguua

SEQ ID NO: 706526 - RNA, 18 nt, Homo sapiens
gguuggcccccaaagaua

SEQ ID NO: 706527 - RNA, 19 nt, Homo sapiens
gguuuuuuucuucuguauu

SEQ ID NO: 706528 - RNA, 18 nt, Homo sapiens
guaagaaagugaagcaaa

SEQ ID NO: 706529 - RNA, 14 nt, Homo sapiens
guaagaaggcaaua

SEQ ID NO: 706530 - RNA, 23 nt, Homo sapiens
guaaggauguauguggugaaaac

SEQ ID NO: 706531 - RNA, 23 nt, Homo sapiens
guaauaauaaaucguccucccag

SEQ ID NO: 706532 - RNA, 15 nt, Homo sapiens
guaaucaucuaaguc

SEQ ID NO: 706533 - RNA, 16 nt, Homo sapiens
guaaucaucuaaguca

SEQ ID NO: 706534 - RNA, 14 nt, Homo sapiens
guaaugaaauggag

SEQ ID NO: 706535 - RNA, 18 nt, Homo sapiens
guacauguaacauuaaag

SEQ ID NO: 706536 - RNA, 21 nt, Homo sapiens
guacccuuucaaacuauuuau

SEQ ID NO: 706537 - RNA, 11 nt, Homo sapiens
guacuguuacu

SEQ ID NO: 706538 - RNA, 20 nt, Homo sapiens
guagagacgguguuuugcca

SEQ ID NO: 706539 - RNA, 13 nt, Homo sapiens
guagagccagcuu

SEQ ID NO: 706540 - RNA, 14 nt, Homo sapiens
guagaguuuuguca

SEQ ID NO: 706541 - RNA, 21 nt, Homo sapiens
guaggaccaagcaucuugggg

SEQ ID NO: 706542 - RNA, 15 nt, Homo sapiens
guaggagcugccuug

SEQ ID NO: 706543 - RNA, 21 nt, Homo sapiens
guaggagcugccuuggcucag

SEQ ID NO: 706544 - RNA, 17 nt, Homo sapiens
guaggcacaagaccaag

SEQ ID NO: 706545 - RNA, 23 nt, Homo sapiens
guauauuugauugaauaaugcca

SEQ ID NO: 706546 - RNA, 18 nt, Homo sapiens
guaucauguauggugaua

SEQ ID NO: 706547 - RNA, 23 nt, Homo sapiens
guauccagagauacuacaauauu

SEQ ID NO: 706548 - RNA, 22 nt, Homo sapiens
guaugcacaguaaaaauggaaa

SEQ ID NO: 706549 - RNA, 20 nt, Homo sapiens
guauguauuauuuacauuua

SEQ ID NO: 706550 - RNA, 20 nt, Homo sapiens
guauuugaaauaagaauuca

SEQ ID NO: 706551 - RNA, 13 nt, Homo sapiens
gucaaacuguaga

SEQ ID NO: 706552 - RNA, 19 nt, Homo sapiens
gucaaaugaugugcaaaac

SEQ ID NO: 706553 - RNA, 19 nt, Homo sapiens
gucaauggcuuguucauca

SEQ ID NO: 706554 - RNA, 22 nt, Homo sapiens
gucacaacaacaacaacaaaaa

SEQ ID NO: 706555 - RNA, 19 nt, Homo sapiens
gucacauuuagcugugcuc

SEQ ID NO: 706556 - RNA, 17 nt, Homo sapiens
gucagaaggagcuacaa

SEQ ID NO: 706557 - RNA, 14 nt, Homo sapiens
gucagcugcucccu

SEQ ID NO: 706558 - RNA, 16 nt, Homo sapiens
gucagguaguugcaau

SEQ ID NO: 706559 - RNA, 14 nt, Homo sapiens
gucaguacuauuca

SEQ ID NO: 706560 - RNA, 12 nt, Homo sapiens
gucaguuuucau

SEQ ID NO: 706561 - RNA, 19 nt, Homo sapiens
gucaucaucacccuuucau

SEQ ID NO: 706562 - RNA, 21 nt, Homo sapiens
gucauuuggugccaguauuuu

SEQ ID NO: 706563 - RNA, 22 nt, Homo sapiens
guccuaaggcaucuaucugugc

SEQ ID NO: 706564 - RNA, 15 nt, Homo sapiens
guccucauucuugcc

SEQ ID NO: 706565 - RNA, 16 nt, Homo sapiens
guccucccaggccagg

SEQ ID NO: 706566 - RNA, 23 nt, Homo sapiens
gucuccuuauucggcagccuuau

SEQ ID NO: 706567 - RNA, 18 nt, Homo sapiens
gucugcuuugguacuaau

SEQ ID NO: 706568 - RNA, 11 nt, Homo sapiens
gucuguuggca

SEQ ID NO: 706569 - RNA, 20 nt, Homo sapiens
gucuuaaggacaaagugcca

SEQ ID NO: 706570 - RNA, 21 nt, Homo sapiens
gucuuaaggacaaagugccaa

SEQ ID NO: 706571 - RNA, 15 nt, Homo sapiens
gucuuaauguacaca

SEQ ID NO: 706572 - RNA, 17 nt, Homo sapiens
gucuugauucagucaca

SEQ ID NO: 706573 - RNA, 18 nt, Homo sapiens
gucuugauucagucacau

SEQ ID NO: 706574 - RNA, 11 nt, Homo sapiens
gucuugccagg

SEQ ID NO: 706575 - RNA, 21 nt, Homo sapiens
gucuuucccauuucuaccuaa

SEQ ID NO: 706576 - RNA, 14 nt, Homo sapiens
gugaaaaacuuaag

SEQ ID NO: 706577 - RNA, 13 nt, Homo sapiens
gugaagauacuuu

SEQ ID NO: 706578 - RNA, 18 nt, Homo sapiens
gugaauuauugacacuga

SEQ ID NO: 706579 - RNA, 16 nt, Homo sapiens
gugagaaacaucucaa

SEQ ID NO: 706580 - RNA, 15 nt, Homo sapiens
gugauauaugcaugu

SEQ ID NO: 706581 - RNA, 16 nt, Homo sapiens
gugauggacacuccag

SEQ ID NO: 706582 - RNA, 17 nt, Homo sapiens
gugauuuucauugcugg

SEQ ID NO: 706583 - RNA, 23 nt, Homo sapiens
gugcaauagacacauacauguca

SEQ ID NO: 706584 - RNA, 12 nt, Homo sapiens
gugccaaaaauc

SEQ ID NO: 706585 - RNA, 21 nt, Homo sapiens
gugccaucuguagcuauaaug

SEQ ID NO: 706586 - RNA, 23 nt, Homo sapiens
guggaauauaaggaaagcaauaa

SEQ ID NO: 706587 - RNA, 18 nt, Homo sapiens
guggaccgcccuuuuccc

SEQ ID NO: 706588 - RNA, 13 nt, Homo sapiens
guggaggcuuccu

SEQ ID NO: 706589 - RNA, 16 nt, Homo sapiens
guggauaacuuuacag

SEQ ID NO: 706590 - RNA, 15 nt, Homo sapiens
guggaugaugcugcc

SEQ ID NO: 706591 - RNA, 20 nt, Homo sapiens
guggcacuugccugggucac

SEQ ID NO: 706592 - RNA, 10 nt, Homo sapiens
guggccacag

SEQ ID NO: 706593 - RNA, 21 nt, Homo sapiens
gugggauauugaauguuaaag

SEQ ID NO: 706594 - RNA, 23 nt, Homo sapiens
guggucacaacuugauggcugcg

SEQ ID NO: 706595 - RNA, 20 nt, Homo sapiens
guguaaaaaaaccaccaaaa

SEQ ID NO: 706596 - RNA, 16 nt, Homo sapiens
guguaaacucaucuga

SEQ ID NO: 706597 - RNA, 14 nt, Homo sapiens
guguaauaugcaca

SEQ ID NO: 706598 - RNA, 20 nt, Homo sapiens
guguagaaaagaacuggaaa

SEQ ID NO: 706599 - RNA, 12 nt, Homo sapiens
gugucaggugac

SEQ ID NO: 706600 - RNA, 21 nt, Homo sapiens
guguccccgcugcugugcaac

SEQ ID NO: 706601 - RNA, 14 nt, Homo sapiens
gugugugcacaucc

SEQ ID NO: 706602 - RNA, 14 nt, Homo sapiens
gugugugugcacau

SEQ ID NO: 706603 - RNA, 17 nt, Homo sapiens
guguuugggaugaccag

SEQ ID NO: 706604 - RNA, 12 nt, Homo sapiens
guguuuugccau

SEQ ID NO: 706605 - RNA, 13 nt, Homo sapiens
guuaauaacucuc

SEQ ID NO: 706606 - RNA, 21 nt, Homo sapiens
guuacagugaugcugugcuau

SEQ ID NO: 706607 - RNA, 17 nt, Homo sapiens
guuaccacgacuucuag

SEQ ID NO: 706608 - RNA, 17 nt, Homo sapiens
guuacuguguaaacuca

SEQ ID NO: 706609 - RNA, 16 nt, Homo sapiens
guuauauccaauagua

SEQ ID NO: 706610 - RNA, 17 nt, Homo sapiens
guuauaugaacauacaa

SEQ ID NO: 706611 - RNA, 15 nt, Homo sapiens
guuccagauguggau

SEQ ID NO: 706612 - RNA, 15 nt, Homo sapiens
guuccaguugcuuga

SEQ ID NO: 706613 - RNA, 18 nt, Homo sapiens
guucccugcaggagagag

SEQ ID NO: 706614 - RNA, 15 nt, Homo sapiens
guuccucccaggaag

SEQ ID NO: 706615 - RNA, 20 nt, Homo sapiens
guuccucccccaguuccucc

SEQ ID NO: 706616 - RNA, 19 nt, Homo sapiens
guuccuccucuccuacucg

SEQ ID NO: 706617 - RNA, 21 nt, Homo sapiens
guucguucuguacuguuacug

SEQ ID NO: 706618 - RNA, 19 nt, Homo sapiens
guucuggggggacccagug

SEQ ID NO: 706619 - RNA, 20 nt, Homo sapiens
guucuuucagaaagcuuuga

SEQ ID NO: 706620 - RNA, 14 nt, Homo sapiens
guugaacacuugaa

SEQ ID NO: 706621 - RNA, 19 nt, Homo sapiens
guugauucagcucugcaag

SEQ ID NO: 706622 - RNA, 16 nt, Homo sapiens
guugcaagaugugaau

SEQ ID NO: 706623 - RNA, 20 nt, Homo sapiens
guugccacaguagaacuguc

SEQ ID NO: 706624 - RNA, 14 nt, Homo sapiens
guugcugacuuaga

SEQ ID NO: 706625 - RNA, 19 nt, Homo sapiens
guugugccaaagugcauag

SEQ ID NO: 706626 - RNA, 17 nt, Homo sapiens
gcucaguaacugugcau

SEQ ID NO: 706627 - RNA, 19 nt, Homo sapiens
gcuccaucccaaccaggca

SEQ ID NO: 706628 - RNA, 14 nt, Homo sapiens
gcucccuccuccag

SEQ ID NO: 706629 - RNA, 15 nt, Homo sapiens
gcuccgggcuuucac

SEQ ID NO: 706630 - RNA, 17 nt, Homo sapiens
gcuccuacuuucaggaa

SEQ ID NO: 706631 - RNA, 22 nt, Homo sapiens
gcuccuccccuuccucuugucu

SEQ ID NO: 706632 - RNA, 17 nt, Homo sapiens
gcugaacaauaggcugu

SEQ ID NO: 706633 - RNA, 13 nt, Homo sapiens
gcugauggugugg

SEQ ID NO: 706634 - RNA, 17 nt, Homo sapiens
gcugcaggacuugagaa

SEQ ID NO: 706635 - RNA, 14 nt, Homo sapiens
gcugcccaccugcc

SEQ ID NO: 706636 - RNA, 19 nt, Homo sapiens
gcugcuuccuccuggaaau

SEQ ID NO: 706637 - RNA, 21 nt, Homo sapiens
gcuggagguugagcucuucuu

SEQ ID NO: 706638 - RNA, 18 nt, Homo sapiens
gcuggcaaccacuaagaa

SEQ ID NO: 706639 - RNA, 16 nt, Homo sapiens
gcugucuugugaucac

SEQ ID NO: 706640 - RNA, 15 nt, Homo sapiens
gcuguuccuguucag

SEQ ID NO: 706641 - RNA, 20 nt, Homo sapiens
gcuuaaaggggcuagaguga

SEQ ID NO: 706642 - RNA, 19 nt, Homo sapiens
gcuuaacacuugaccuaaa

SEQ ID NO: 706643 - RNA, 21 nt, Homo sapiens
gcuuaccauuaaaguucucaa

SEQ ID NO: 706644 - RNA, 22 nt, Homo sapiens
gcuuaccauuaaaguucucaau

SEQ ID NO: 706645 - RNA, 17 nt, Homo sapiens
gcuuaccuccucauggc

SEQ ID NO: 706646 - RNA, 20 nt, Homo sapiens
gcuucauauaccagcaauau

SEQ ID NO: 706647 - RNA, 15 nt, Homo sapiens
gcuucccuaaucuau

SEQ ID NO: 706648 - RNA, 17 nt, Homo sapiens
gcuuccgccgucucaac

SEQ ID NO: 706649 - RNA, 18 nt, Homo sapiens
gcuuccucuagaagccaa

SEQ ID NO: 706650 - RNA, 19 nt, Homo sapiens
gcuuccucuagaagccaag

SEQ ID NO: 706651 - RNA, 11 nt, Homo sapiens
gcuuccuugcc

SEQ ID NO: 706652 - RNA, 22 nt, Homo sapiens
gcuuccuugccugaugacaaua

SEQ ID NO: 706653 - RNA, 17 nt, Homo sapiens
gcuucuagaguuuuaua

SEQ ID NO: 706654 - RNA, 18 nt, Homo sapiens
gcuucucugacuucugcc

SEQ ID NO: 706655 - RNA, 12 nt, Homo sapiens
gcuucugugaug

SEQ ID NO: 706656 - RNA, 14 nt, Homo sapiens
gcuugaagccaaag

SEQ ID NO: 706657 - RNA, 18 nt, Homo sapiens
gcuuggauuaaauacaua

SEQ ID NO: 706658 - RNA, 15 nt, Homo sapiens
gcuuugaaaauucag

SEQ ID NO: 706659 - RNA, 15 nt, Homo sapiens
gcuuugaauacuaaa

SEQ ID NO: 706660 - RNA, 16 nt, Homo sapiens
gcuuugaauacuaaau

SEQ ID NO: 706661 - RNA, 21 nt, Homo sapiens
gcuuuguuucuuucauaugaa

SEQ ID NO: 706662 - RNA, 13 nt, Homo sapiens
gcuuuucuguauu

SEQ ID NO: 706663 - RNA, 14 nt, Homo sapiens
ggaaaauucuuaaa

SEQ ID NO: 706664 - RNA, 19 nt, Homo sapiens
ggaaacaaccaugucauuu

SEQ ID NO: 706665 - RNA, 15 nt, Homo sapiens
ggaaagaaauacagu

SEQ ID NO: 706666 - RNA, 14 nt, Homo sapiens
ggaaaggggugcuu

SEQ ID NO: 706667 - RNA, 12 nt, Homo sapiens
ggaacaauccau

SEQ ID NO: 706668 - RNA, 14 nt, Homo sapiens
ggaacacugcacuc

SEQ ID NO: 706669 - RNA, 22 nt, Homo sapiens
ggaacauguaaaacaguuacaa

SEQ ID NO: 706670 - RNA, 12 nt, Homo sapiens
ggaacucuggag

SEQ ID NO: 706671 - RNA, 21 nt, Homo sapiens
ggaagcccauccugaccagcu

SEQ ID NO: 706672 - RNA, 22 nt, Homo sapiens
ggaagccucccacgacugcccg

SEQ ID NO: 706673 - RNA, 22 nt, Homo sapiens
ggaaggagaggagaggggcaca

SEQ ID NO: 706674 - RNA, 23 nt, Homo sapiens
ggaaggcuguacgacacgggugg

SEQ ID NO: 706675 - RNA, 19 nt, Homo sapiens
ggaagggccuacagcccau

SEQ ID NO: 706676 - RNA, 16 nt, Homo sapiens
ggaaguuuuccuacac

SEQ ID NO: 706677 - RNA, 21 nt, Homo sapiens
ggaauacugugcauaagccau

SEQ ID NO: 706678 - RNA, 18 nt, Homo sapiens
ggaaucccacuaaugcaa

SEQ ID NO: 706679 - RNA, 16 nt, Homo sapiens
ggaaugguucucucaa

SEQ ID NO: 706680 - RNA, 11 nt, Homo sapiens
ggaauugccag

SEQ ID NO: 706681 - RNA, 12 nt, Homo sapiens
ggacaagggauu

SEQ ID NO: 706682 - RNA, 15 nt, Homo sapiens
ggacaucacagggug

SEQ ID NO: 706683 - RNA, 17 nt, Homo sapiens
ggaccaggccauucugc

SEQ ID NO: 706684 - RNA, 18 nt, Homo sapiens
ggacgccacucauuucau

SEQ ID NO: 706685 - RNA, 20 nt, Homo sapiens
ggagaagagcgcaguguuuu

SEQ ID NO: 706686 - RNA, 23 nt, Homo sapiens
ggagaagcugcaggcuuugccau

SEQ ID NO: 706687 - RNA, 19 nt, Homo sapiens
ggagaaugaagacuguuaa

SEQ ID NO: 706688 - RNA, 14 nt, Homo sapiens
ggagaccuggcacu

SEQ ID NO: 706689 - RNA, 16 nt, Homo sapiens
ggagacgccaugugau

SEQ ID NO: 706690 - RNA, 18 nt, Homo sapiens
ggagacugaagacucagc

SEQ ID NO: 706691 - RNA, 16 nt, Homo sapiens
ggagacuugccagagc

SEQ ID NO: 706692 - RNA, 16 nt, Homo sapiens
ggagacuuugauguca

SEQ ID NO: 706693 - RNA, 13 nt, Homo sapiens
ggagaggggcaca

SEQ ID NO: 706694 - RNA, 21 nt, Homo sapiens
ggagauuucuuguugcucaaa

SEQ ID NO: 706695 - RNA, 19 nt, Homo sapiens
ggagcagauuuuugcaaua

SEQ ID NO: 706696 - RNA, 18 nt, Homo sapiens
ggagccaaaaucucaaga

SEQ ID NO: 706697 - RNA, 20 nt, Homo sapiens
ggagccccaucuaggggagc

SEQ ID NO: 706698 - RNA, 15 nt, Homo sapiens
ggagccucacugggg

SEQ ID NO: 706699 - RNA, 18 nt, Homo sapiens
ggagcucaucugcaaaag

SEQ ID NO: 706700 - RNA, 17 nt, Homo sapiens
ggaggaacacugcacuc

SEQ ID NO: 706701 - RNA, 18 nt, Homo sapiens
ggaggaacacugcacucu

SEQ ID NO: 706702 - RNA, 15 nt, Homo sapiens
ggaggaugaugccag

SEQ ID NO: 706703 - RNA, 23 nt, Homo sapiens
ggaggcagccgccccaucugccc

SEQ ID NO: 706704 - RNA, 20 nt, Homo sapiens
ggaggcggagcuugcaguga

SEQ ID NO: 706705 - RNA, 13 nt, Homo sapiens
ggaggcugcagug

SEQ ID NO: 706706 - RNA, 15 nt, Homo sapiens
ggagguugaagccaa

SEQ ID NO: 706707 - RNA, 13 nt, Homo sapiens
ggaguagugucac

SEQ ID NO: 706708 - RNA, 14 nt, Homo sapiens
ggagugucuggaau

SEQ ID NO: 706709 - RNA, 22 nt, Homo sapiens
ggauaaagaauacuauuuccaa

SEQ ID NO: 706710 - RNA, 14 nt, Homo sapiens
ggauaucaaaagca

SEQ ID NO: 706711 - RNA, 17 nt, Homo sapiens
ggauaucaaaagcaaau

SEQ ID NO: 706712 - RNA, 17 nt, Homo sapiens
ggaucucucuccucucu

SEQ ID NO: 706713 - RNA, 20 nt, Homo sapiens
ggaucucucuccucucugac

SEQ ID NO: 706714 - RNA, 18 nt, Homo sapiens
ggaugaaacuaaagcaau

SEQ ID NO: 706715 - RNA, 22 nt, Homo sapiens
ggaugucuccaucucugucuca

SEQ ID NO: 706716 - RNA, 14 nt, Homo sapiens
ggauuaauuugcau

SEQ ID NO: 706717 - RNA, 15 nt, Homo sapiens
ggauuuucacauucu

SEQ ID NO: 706718 - RNA, 22 nt, Homo sapiens
ggcaaagagagucgcaucucag

SEQ ID NO: 706719 - RNA, 14 nt, Homo sapiens
ggcaacuguaugaa

SEQ ID NO: 706720 - RNA, 16 nt, Homo sapiens
ggcaaguugcaucaga

SEQ ID NO: 706721 - RNA, 12 nt, Homo sapiens
ggcagagccaug

SEQ ID NO: 706722 - RNA, 20 nt, Homo sapiens
ggcaggagaauggcgugaac

SEQ ID NO: 706723 - RNA, 16 nt, Homo sapiens
ggcaggagaauggugu

SEQ ID NO: 706724 - RNA, 13 nt, Homo sapiens
ggcaucaauauac

SEQ ID NO: 706725 - RNA, 20 nt, Homo sapiens
ggcaugagacucagugcaga

SEQ ID NO: 706726 - RNA, 22 nt, Homo sapiens
ggccagagagggcgugggcgcu

SEQ ID NO: 706727 - RNA, 18 nt, Homo sapiens
ggccauggcucagggugg

SEQ ID NO: 706728 - RNA, 17 nt, Homo sapiens
ggccccucccacaccca

SEQ ID NO: 706729 - RNA, 17 nt, Homo sapiens
ggccccuggcacucuug

SEQ ID NO: 706730 - RNA, 16 nt, Homo sapiens
ggccggcccugugugc

SEQ ID NO: 706731 - RNA, 11 nt, Homo sapiens
ggccuccagaa

SEQ ID NO: 706732 - RNA, 23 nt, Homo sapiens
ggccugcgacccugggggcacag

SEQ ID NO: 706733 - RNA, 15 nt, Homo sapiens
ggccuggacaguauc

SEQ ID NO: 706734 - RNA, 17 nt, Homo sapiens
ggcgaggagagggcgcu

SEQ ID NO: 706735 - RNA, 18 nt, Homo sapiens
ggcgcugcuuugucaaaa

SEQ ID NO: 706736 - RNA, 13 nt, Homo sapiens
ggcuaaauggaag

SEQ ID NO: 706737 - RNA, 21 nt, Homo sapiens
ggcucugugcagucacuggag

SEQ ID NO: 706738 - RNA, 11 nt, Homo sapiens
ggcugcaguga

SEQ ID NO: 706739 - RNA, 18 nt, Homo sapiens
ggcugccccucucaccaa

SEQ ID NO: 706740 - RNA, 20 nt, Homo sapiens
ggcuggagugcaguggcgca

SEQ ID NO: 706741 - RNA, 13 nt, Homo sapiens
ggcugggccaugu

SEQ ID NO: 706742 - RNA, 20 nt, Homo sapiens
ggcuguguugguguggccca

SEQ ID NO: 706743 - RNA, 19 nt, Homo sapiens
ggcuuccucuagaagccaa

SEQ ID NO: 706744 - RNA, 23 nt, Homo sapiens
ggcuucucucucuagcagcaccu

SEQ ID NO: 706745 - RNA, 17 nt, Homo sapiens
aucgccacaaacucuau

SEQ ID NO: 706746 - RNA, 15 nt, Homo sapiens
aucgcgccacugcac

SEQ ID NO: 706747 - RNA, 18 nt, Homo sapiens
aucggccaucaagggaag

SEQ ID NO: 706748 - RNA, 16 nt, Homo sapiens
aucuaauauauaugaa

SEQ ID NO: 706749 - RNA, 19 nt, Homo sapiens
aucucaauaaagugcuuua

SEQ ID NO: 706750 - RNA, 22 nt, Homo sapiens
aucucaaugaaccauaaauuca

SEQ ID NO: 706751 - RNA, 12 nt, Homo sapiens
aucucagugcag

SEQ ID NO: 706752 - RNA, 13 nt, Homo sapiens
aucucugucucaa

SEQ ID NO: 706753 - RNA, 12 nt, Homo sapiens
aucugaccaaac

SEQ ID NO: 706754 - RNA, 17 nt, Homo sapiens
aucugccuuaaaaccaa

SEQ ID NO: 706755 - RNA, 21 nt, Homo sapiens
aucugccuuaaaaccaaagag

SEQ ID NO: 706756 - RNA, 22 nt, Homo sapiens
aucuguuuauuuacaagggaag

SEQ ID NO: 706757 - RNA, 16 nt, Homo sapiens
aucuguuuuucaugua

SEQ ID NO: 706758 - RNA, 20 nt, Homo sapiens
aucuuauucuuuuguaauau

SEQ ID NO: 706759 - RNA, 14 nt, Homo sapiens
aucuucaaagccuu

SEQ ID NO: 706760 - RNA, 16 nt, Homo sapiens
aucuugaauccuucca

SEQ ID NO: 706761 - RNA, 17 nt, Homo sapiens
aucuugauacauucaaa

SEQ ID NO: 706762 - RNA, 16 nt, Homo sapiens
aucuuugggccugucc

SEQ ID NO: 706763 - RNA, 13 nt, Homo sapiens
aucuuuucauuaa

SEQ ID NO: 706764 - RNA, 15 nt, Homo sapiens
augaaaaaagcuuua

SEQ ID NO: 706765 - RNA, 23 nt, Homo sapiens
augaaaaauauugcugaacuacu

SEQ ID NO: 706766 - RNA, 13 nt, Homo sapiens
augaaaaugcagu

SEQ ID NO: 706767 - RNA, 18 nt, Homo sapiens
augaaagaaaauugaguu

SEQ ID NO: 706768 - RNA, 20 nt, Homo sapiens
augaacacuuauaagugaag

SEQ ID NO: 706769 - RNA, 16 nt, Homo sapiens
augaacaugguguuca

SEQ ID NO: 706770 - RNA, 13 nt, Homo sapiens
augaaccacauua

SEQ ID NO: 706771 - RNA, 15 nt, Homo sapiens
augaagcuucaugca

SEQ ID NO: 706772 - RNA, 13 nt, Homo sapiens
augacagugcuaa

SEQ ID NO: 706773 - RNA, 19 nt, Homo sapiens
augacaucagcaauacaga

SEQ ID NO: 706774 - RNA, 20 nt, Homo sapiens
augagccuggcaagaaugug

SEQ ID NO: 706775 - RNA, 22 nt, Homo sapiens
augagcugaucugcggaucuca

SEQ ID NO: 706776 - RNA, 22 nt, Homo sapiens
augagcuguggacuagcaauau

SEQ ID NO: 706777 - RNA, 21 nt, Homo sapiens
augaguagauaauuucagggu

SEQ ID NO: 706778 - RNA, 20 nt, Homo sapiens
augauaaauuaagcaugaaa

SEQ ID NO: 706779 - RNA, 13 nt, Homo sapiens
augauacaaugaa

SEQ ID NO: 706780 - RNA, 23 nt, Homo sapiens
augaugagucgguccucuuucca

SEQ ID NO: 706781 - RNA, 22 nt, Homo sapiens
augauucagaaauuuucauuca

SEQ ID NO: 706782 - RNA, 14 nt, Homo sapiens
augauuuacauaaa

SEQ ID NO: 706783 - RNA, 16 nt, Homo sapiens
augauuugcauaugaa

SEQ ID NO: 706784 - RNA, 12 nt, Homo sapiens
augcaagugcaa

SEQ ID NO: 706785 - RNA, 19 nt, Homo sapiens
augcaauguaagcauacuu

SEQ ID NO: 706786 - RNA, 21 nt, Homo sapiens
augcacuuaaguuagccucca

SEQ ID NO: 706787 - RNA, 13 nt, Homo sapiens
augcagcuuugca

SEQ ID NO: 706788 - RNA, 13 nt, Homo sapiens
augccacuuccuu

SEQ ID NO: 706789 - RNA, 22 nt, Homo sapiens
agugacauauauauguauauac

SEQ ID NO: 706790 - RNA, 16 nt, Homo sapiens
agugcacuguauauag

SEQ ID NO: 706791 - RNA, 13 nt, Homo sapiens
agugcccuuccug

SEQ ID NO: 706792 - RNA, 22 nt, Homo sapiens
agugcuuguuccucucaucucc

SEQ ID NO: 706793 - RNA, 19 nt, Homo sapiens
aguggcaggggacaggagu

SEQ ID NO: 706794 - RNA, 19 nt, Homo sapiens
aguggcgugggagccagcc

SEQ ID NO: 706795 - RNA, 22 nt, Homo sapiens
agugggauuuccagaaccacac

SEQ ID NO: 706796 - RNA, 19 nt, Homo sapiens
agugguugaauaugauuaa

SEQ ID NO: 706797 - RNA, 10 nt, Homo sapiens
aguguaagaa

SEQ ID NO: 706798 - RNA, 20 nt, Homo sapiens
aguguagaaaagaacuggaa

SEQ ID NO: 706799 - RNA, 17 nt, Homo sapiens
aguguccuucuugcucc

SEQ ID NO: 706800 - RNA, 17 nt, Homo sapiens
aguguguguaguuuuac

SEQ ID NO: 706801 - RNA, 13 nt, Homo sapiens
aguuaagaaccug

SEQ ID NO: 706802 - RNA, 14 nt, Homo sapiens
aguuaagaaccuga

SEQ ID NO: 706803 - RNA, 13 nt, Homo sapiens
aguuaauucucau

SEQ ID NO: 706804 - RNA, 17 nt, Homo sapiens
aguuacugccgguuuga

SEQ ID NO: 706805 - RNA, 17 nt, Homo sapiens
aguuaguuuguauauau

SEQ ID NO: 706806 - RNA, 16 nt, Homo sapiens
aguuaucuuugaauau

SEQ ID NO: 706807 - RNA, 14 nt, Homo sapiens
aguuccucccagga

SEQ ID NO: 706808 - RNA, 18 nt, Homo sapiens
aguucuaacaaaacaagu

SEQ ID NO: 706809 - RNA, 17 nt, Homo sapiens
aguucuuggucccucca

SEQ ID NO: 706810 - RNA, 16 nt, Homo sapiens
aguucuuuuaagccca

SEQ ID NO: 706811 - RNA, 17 nt, Homo sapiens
aguugagcuaugacuua

SEQ ID NO: 706812 - RNA, 17 nt, Homo sapiens
aguugcaauugaauuaa

SEQ ID NO: 706813 - RNA, 17 nt, Homo sapiens
aguugcagugaauucau

SEQ ID NO: 706814 - RNA, 18 nt, Homo sapiens
aguuggaauucaccaaga

SEQ ID NO: 706815 - RNA, 18 nt, Homo sapiens
aguuuaauagauguuacu

SEQ ID NO: 706816 - RNA, 14 nt, Homo sapiens
aguuuaucauguca

SEQ ID NO: 706817 - RNA, 13 nt, Homo sapiens
aguuugagacagg

SEQ ID NO: 706818 - RNA, 19 nt, Homo sapiens
aguuugagaccaaccuggg

SEQ ID NO: 706819 - RNA, 21 nt, Homo sapiens
aguuugugagaaacaucucaa

SEQ ID NO: 706820 - RNA, 18 nt, Homo sapiens
aguuuguuuuuaaacuaa

SEQ ID NO: 706821 - RNA, 17 nt, Homo sapiens
aguuuucauaguaucca

SEQ ID NO: 706822 - RNA, 18 nt, Homo sapiens
auaaaauccugugcaaua

SEQ ID NO: 706823 - RNA, 14 nt, Homo sapiens
auaaacuauacacu

SEQ ID NO: 706824 - RNA, 13 nt, Homo sapiens
auaaagugcuuua

SEQ ID NO: 706825 - RNA, 19 nt, Homo sapiens
auaaccuuuuuguauauca

SEQ ID NO: 706826 - RNA, 22 nt, Homo sapiens
auaacuguauuugaaauaagaa

SEQ ID NO: 706827 - RNA, 21 nt, Homo sapiens
auaagaaaauauauucuuuca

SEQ ID NO: 706828 - RNA, 21 nt, Homo sapiens
auaagaagaaguucaugucca

SEQ ID NO: 706829 - RNA, 11 nt, Homo sapiens
auaagccaaaa

SEQ ID NO: 706830 - RNA, 18 nt, Homo sapiens
auaagcuaguugaauacu

SEQ ID NO: 706831 - RNA, 15 nt, Homo sapiens
auaaggaaagcaaua

SEQ ID NO: 706832 - RNA, 16 nt, Homo sapiens
auaaggaaagcaauaa

SEQ ID NO: 706833 - RNA, 21 nt, Homo sapiens
auaagggaggaauauagaaug

SEQ ID NO: 706834 - RNA, 22 nt, Homo sapiens
auaaugaauacauuuccaaaau

SEQ ID NO: 706835 - RNA, 16 nt, Homo sapiens
auaaugaggaguuuau

SEQ ID NO: 706836 - RNA, 20 nt, Homo sapiens
auaauggcaucaauauacau

SEQ ID NO: 706837 - RNA, 20 nt, Homo sapiens
auaauuuagaccccauacaa

SEQ ID NO: 706838 - RNA, 13 nt, Homo sapiens
auaauuucagggu

SEQ ID NO: 706839 - RNA, 17 nt, Homo sapiens
auacaaaaaaaauuuag

SEQ ID NO: 706840 - RNA, 14 nt, Homo sapiens
auacaaaccuacca

SEQ ID NO: 706841 - RNA, 14 nt, Homo sapiens
auacaagguauaau

SEQ ID NO: 706842 - RNA, 13 nt, Homo sapiens
auacacauauagu

SEQ ID NO: 706843 - RNA, 15 nt, Homo sapiens
auacacuuaaugaua

SEQ ID NO: 706844 - RNA, 16 nt, Homo sapiens
auacacuuuguugcaa

SEQ ID NO: 706845 - RNA, 14 nt, Homo sapiens
auacaguaucucag

SEQ ID NO: 706846 - RNA, 12 nt, Homo sapiens
auacauacaugu

SEQ ID NO: 706847 - RNA, 13 nt, Homo sapiens
auacaugauugca

SEQ ID NO: 706848 - RNA, 13 nt, Homo sapiens
auacaugcauaua

SEQ ID NO: 706849 - RNA, 15 nt, Homo sapiens
auacauuuccaaaau

SEQ ID NO: 706850 - RNA, 23 nt, Homo sapiens
auaccaaacaugcggugccauga

SEQ ID NO: 706851 - RNA, 15 nt, Homo sapiens
auaccuccaacccug

SEQ ID NO: 706852 - RNA, 17 nt, Homo sapiens
auaccuccaacccugcc

SEQ ID NO: 706853 - RNA, 22 nt, Homo sapiens
auaccuccaacccugccgucac

SEQ ID NO: 706854 - RNA, 22 nt, Homo sapiens
auacuauuuaagaugugaaaau

SEQ ID NO: 706855 - RNA, 12 nt, Homo sapiens
auacugugcaua

SEQ ID NO: 706856 - RNA, 15 nt, Homo sapiens
auacuguucacucac

SEQ ID NO: 706857 - RNA, 12 nt, Homo sapiens
auagaggcuucu

SEQ ID NO: 706858 - RNA, 13 nt, Homo sapiens
auagcaucucagg

SEQ ID NO: 706859 - RNA, 14 nt, Homo sapiens
auagcaucucagga

SEQ ID NO: 706860 - RNA, 14 nt, Homo sapiens
auaggaauugcaca

SEQ ID NO: 706861 - RNA, 20 nt, Homo sapiens
auaguacucuuuguagcaaa

SEQ ID NO: 706862 - RNA, 18 nt, Homo sapiens
auaguaugaaaauggaaa

SEQ ID NO: 706863 - RNA, 14 nt, Homo sapiens
auauaauccuguga

SEQ ID NO: 706864 - RNA, 14 nt, Homo sapiens
auauaauuuauuga

SEQ ID NO: 706865 - RNA, 10 nt, Homo sapiens
auauacauga

SEQ ID NO: 706866 - RNA, 21 nt, Homo sapiens
auauauauguauauacauauc

SEQ ID NO: 706867 - RNA, 15 nt, Homo sapiens
auauauucuuucaaa

SEQ ID NO: 706868 - RNA, 17 nt, Homo sapiens
auauauuuauaaggaaa

SEQ ID NO: 706869 - RNA, 17 nt, Homo sapiens
auaucaaaagcaaauaa

SEQ ID NO: 706870 - RNA, 15 nt, Homo sapiens
auaucaucuguggac

SEQ ID NO: 706871 - RNA, 15 nt, Homo sapiens
auaucaugcaaauuu

SEQ ID NO: 706872 - RNA, 20 nt, Homo sapiens
auaucugaagagcuauuaua

SEQ ID NO: 706873 - RNA, 11 nt, Homo sapiens
auaucuuggcc

SEQ ID NO: 706874 - RNA, 17 nt, Homo sapiens
auaugaggcuugauaau

SEQ ID NO: 706875 - RNA, 17 nt, Homo sapiens
auaugccugcaaucuga

SEQ ID NO: 706876 - RNA, 16 nt, Homo sapiens
auaugggcucaaguca

SEQ ID NO: 706877 - RNA, 23 nt, Homo sapiens
auauguguaugcacaguaaaaau

SEQ ID NO: 706878 - RNA, 22 nt, Homo sapiens
auauguuuuuaaagguggauuu

SEQ ID NO: 706879 - RNA, 19 nt, Homo sapiens
auauuaguauguaugugua

SEQ ID NO: 706880 - RNA, 15 nt, Homo sapiens
auauugaauguuaaa

SEQ ID NO: 706881 - RNA, 16 nt, Homo sapiens
auauuuauugacucuu

SEQ ID NO: 706882 - RNA, 22 nt, Homo sapiens
aucaagucuuuuuuauauuuau

SEQ ID NO: 706883 - RNA, 17 nt, Homo sapiens
aucaauauacauaauac

SEQ ID NO: 706884 - RNA, 15 nt, Homo sapiens
aucaaugucaaguac

SEQ ID NO: 706885 - RNA, 19 nt, Homo sapiens
aucacugaacuacuaaagu

SEQ ID NO: 706886 - RNA, 18 nt, Homo sapiens
aucacuuaguucucaggc

SEQ ID NO: 706887 - RNA, 16 nt, Homo sapiens
aucagaaacuugugaa

SEQ ID NO: 706888 - RNA, 21 nt, Homo sapiens
aucagccugggcaaugugaua

SEQ ID NO: 706889 - RNA, 16 nt, Homo sapiens
aucauguccauacacu

SEQ ID NO: 706890 - RNA, 17 nt, Homo sapiens
aucauucaaguguaaaa

SEQ ID NO: 706891 - RNA, 21 nt, Homo sapiens
aucauuuguuuacauuugaug

SEQ ID NO: 706892 - RNA, 17 nt, Homo sapiens
auccaacuccagcaacu

SEQ ID NO: 706893 - RNA, 18 nt, Homo sapiens
auccaagauuuaaaugcc

SEQ ID NO: 706894 - RNA, 18 nt, Homo sapiens
auccaauggguuuuuccc

SEQ ID NO: 706895 - RNA, 16 nt, Homo sapiens
auccacccaacccuau

SEQ ID NO: 706896 - RNA, 12 nt, Homo sapiens
aucccacaucca

SEQ ID NO: 706897 - RNA, 12 nt, Homo sapiens
auccccaucucc

SEQ ID NO: 706898 - RNA, 15 nt, Homo sapiens
aucccuagugcucca

SEQ ID NO: 706899 - RNA, 18 nt, Homo sapiens
aucccuuaacaguuguau

SEQ ID NO: 706900 - RNA, 14 nt, Homo sapiens
auccgcgugugccu

SEQ ID NO: 706901 - RNA, 12 nt, Homo sapiens
auccuaccccac

SEQ ID NO: 706902 - RNA, 15 nt, Homo sapiens
auccuagcacuuugg

SEQ ID NO: 706903 - RNA, 15 nt, Homo sapiens
auccuaggcauuugc

SEQ ID NO: 706904 - RNA, 23 nt, Homo sapiens
auccucaauucaauguggugaug

SEQ ID NO: 706905 - RNA, 13 nt, Homo sapiens
auccuccaacagc

SEQ ID NO: 706906 - RNA, 13 nt, Homo sapiens
auccugaauucca

SEQ ID NO: 706907 - RNA, 23 nt, Homo sapiens
auccugaauuccagcaaaagagc

SEQ ID NO: 706908 - RNA, 19 nt, Homo sapiens
auccugggggccuggguug

SEQ ID NO: 706909 - RNA, 22 nt, Homo sapiens
agcacauauggaauuuugcaaa

SEQ ID NO: 706910 - RNA, 17 nt, Homo sapiens
agcacuacaccuugccu

SEQ ID NO: 706911 - RNA, 12 nt, Homo sapiens
agcacuucccac

SEQ ID NO: 706912 - RNA, 15 nt, Homo sapiens
agcagauuuuugcaa

SEQ ID NO: 706913 - RNA, 15 nt, Homo sapiens
agcagucgugccugu

SEQ ID NO: 706914 - RNA, 22 nt, Homo sapiens
agcaguuacaaaaaccuucccc

SEQ ID NO: 706915 - RNA, 12 nt, Homo sapiens
agcauacuuugu

SEQ ID NO: 706916 - RNA, 18 nt, Homo sapiens
agcaucaaaauauuucag

SEQ ID NO: 706917 - RNA, 22 nt, Homo sapiens
agcaucaaaauauuucagugaa

SEQ ID NO: 706918 - RNA, 23 nt, Homo sapiens
agcaucuaucucaucuaucucaa

SEQ ID NO: 706919 - RNA, 15 nt, Homo sapiens
agcaucucaggagau

SEQ ID NO: 706920 - RNA, 19 nt, Homo sapiens
agcaugguacuuggccuuu

SEQ ID NO: 706921 - RNA, 20 nt, Homo sapiens
agcauguuuuguugcucagu

SEQ ID NO: 706922 - RNA, 18 nt, Homo sapiens
agcauuuuucaaaugauc

SEQ ID NO: 706923 - RNA, 21 nt, Homo sapiens
agccaggugagaaaaccaugg

SEQ ID NO: 706924 - RNA, 14 nt, Homo sapiens
agcccaaucugcca

SEQ ID NO: 706925 - RNA, 16 nt, Homo sapiens
agcccagagacuuugu

SEQ ID NO: 706926 - RNA, 22 nt, Homo sapiens
agcccagggcuccugcacuuac

SEQ ID NO: 706927 - RNA, 16 nt, Homo sapiens
agcccucccacuuugc

SEQ ID NO: 706928 - RNA, 15 nt, Homo sapiens
agcccugagcuuucu

SEQ ID NO: 706929 - RNA, 15 nt, Homo sapiens
agccgguaacugucc

SEQ ID NO: 706930 - RNA, 21 nt, Homo sapiens
agccucacuggggcagacaau

SEQ ID NO: 706931 - RNA, 22 nt, Homo sapiens
agccucacuggggcagacaaua

SEQ ID NO: 706932 - RNA, 19 nt, Homo sapiens
agccuccccgugccaaaaa

SEQ ID NO: 706933 - RNA, 17 nt, Homo sapiens
agccuggccaacaugau

SEQ ID NO: 706934 - RNA, 19 nt, Homo sapiens
agccuucgggcgucugugu

SEQ ID NO: 706935 - RNA, 23 nt, Homo sapiens
agcggcuggcagcccaccccuca

SEQ ID NO: 706936 - RNA, 15 nt, Homo sapiens
agcgugaaagcagau

SEQ ID NO: 706937 - RNA, 14 nt, Homo sapiens
agcuaguugaauac

SEQ ID NO: 706938 - RNA, 19 nt, Homo sapiens
agcuauugccaaccaguuu

SEQ ID NO: 706939 - RNA, 16 nt, Homo sapiens
agcucgcauuugucaa

SEQ ID NO: 706940 - RNA, 20 nt, Homo sapiens
agcucgcgggacccgacccc

SEQ ID NO: 706941 - RNA, 18 nt, Homo sapiens
agcugaacaauaggcugu

SEQ ID NO: 706942 - RNA, 22 nt, Homo sapiens
agcugagauugugccacuucac

SEQ ID NO: 706943 - RNA, 14 nt, Homo sapiens
agcugagccugcag

SEQ ID NO: 706944 - RNA, 23 nt, Homo sapiens
agcugccaaggaaacccccagug

SEQ ID NO: 706945 - RNA, 14 nt, Homo sapiens
agcuggccuuugua

SEQ ID NO: 706946 - RNA, 21 nt, Homo sapiens
agcuggccuuuguaagugcag

SEQ ID NO: 706947 - RNA, 13 nt, Homo sapiens
agcuguucagcug

SEQ ID NO: 706948 - RNA, 16 nt, Homo sapiens
agcuuccgccgucuca

SEQ ID NO: 706949 - RNA, 17 nt, Homo sapiens
agcuuccgccgucucaa

SEQ ID NO: 706950 - RNA, 19 nt, Homo sapiens
agcuucugcuuuucugccc

SEQ ID NO: 706951 - RNA, 18 nt, Homo sapiens
agcuuggggccaccaaag

SEQ ID NO: 706952 - RNA, 13 nt, Homo sapiens
agcuuucugccau

SEQ ID NO: 706953 - RNA, 17 nt, Homo sapiens
aggaaacucacacuccc

SEQ ID NO: 706954 - RNA, 21 nt, Homo sapiens
aggaaacuccacaucugccuu

SEQ ID NO: 706955 - RNA, 13 nt, Homo sapiens
aggaaagcaauaa

SEQ ID NO: 706956 - RNA, 13 nt, Homo sapiens
aggaacacugcac

SEQ ID NO: 706957 - RNA, 18 nt, Homo sapiens
aggaaccagagugcugaa

SEQ ID NO: 706958 - RNA, 15 nt, Homo sapiens
aggaagacaauguga

SEQ ID NO: 706959 - RNA, 20 nt, Homo sapiens
aggaagggugaagccuuauu

SEQ ID NO: 706960 - RNA, 14 nt, Homo sapiens
aggaauuacgugcu

SEQ ID NO: 706961 - RNA, 22 nt, Homo sapiens
aggaauuacgugcucugugggu

SEQ ID NO: 706962 - RNA, 15 nt, Homo sapiens
aggacaaagugccaa

SEQ ID NO: 706963 - RNA, 22 nt, Homo sapiens
aggacaaagugccaaagaaagu

SEQ ID NO: 706964 - RNA, 19 nt, Homo sapiens
aggaccuuaagacagagua

SEQ ID NO: 706965 - RNA, 16 nt, Homo sapiens
aggacggacucacuuc

SEQ ID NO: 706966 - RNA, 14 nt, Homo sapiens
aggagaagcugcau

SEQ ID NO: 706967 - RNA, 14 nt, Homo sapiens
aggagccucacugg

SEQ ID NO: 706968 - RNA, 15 nt, Homo sapiens
aggagccucacuggg

SEQ ID NO: 706969 - RNA, 20 nt, Homo sapiens
aggagguggaggcugcagug

SEQ ID NO: 706970 - RNA, 18 nt, Homo sapiens
aggaguuugagaccaacc

SEQ ID NO: 706971 - RNA, 16 nt, Homo sapiens
aggauaucacauugga

SEQ ID NO: 706972 - RNA, 15 nt, Homo sapiens
aggaugaugccaguu

SEQ ID NO: 706973 - RNA, 17 nt, Homo sapiens
aggauggcaaguugcau

SEQ ID NO: 706974 - RNA, 21 nt, Homo sapiens
aggauuuucacauucuuggcu

SEQ ID NO: 706975 - RNA, 13 nt, Homo sapiens
aggcaacugcauu

SEQ ID NO: 706976 - RNA, 18 nt, Homo sapiens
aggcaccucuuccuugau

SEQ ID NO: 706977 - RNA, 16 nt, Homo sapiens
aggcaguuaauucuca

SEQ ID NO: 706978 - RNA, 18 nt, Homo sapiens
aggccaagaauauugcaa

SEQ ID NO: 706979 - RNA, 21 nt, Homo sapiens
aggccugggccgcugccacgu

SEQ ID NO: 706980 - RNA, 18 nt, Homo sapiens
aggcucacucacagaguc

SEQ ID NO: 706981 - RNA, 19 nt, Homo sapiens
aggcucacugcaacuucug

SEQ ID NO: 706982 - RNA, 13 nt, Homo sapiens
aggcugcagugag

SEQ ID NO: 706983 - RNA, 18 nt, Homo sapiens
aggcuguacgacacgggu

SEQ ID NO: 706984 - RNA, 16 nt, Homo sapiens
aggcuuuaucucaggg

SEQ ID NO: 706985 - RNA, 19 nt, Homo sapiens
agggaacaaguugagcuau

SEQ ID NO: 706986 - RNA, 20 nt, Homo sapiens
agggaagaaugaacacuccc

SEQ ID NO: 706987 - RNA, 14 nt, Homo sapiens
agggaagccgugaa

SEQ ID NO: 706988 - RNA, 18 nt, Homo sapiens
agggaguuacugaagucu

SEQ ID NO: 706989 - RNA, 15 nt, Homo sapiens
aggggacaagggauu

SEQ ID NO: 706990 - RNA, 22 nt, Homo sapiens
agggguggggguggaggcuucc

SEQ ID NO: 706991 - RNA, 23 nt, Homo sapiens
aggguaaauaaaccacugugcgu

SEQ ID NO: 706992 - RNA, 20 nt, Homo sapiens
aggguacuuuaagacauacu

SEQ ID NO: 706993 - RNA, 22 nt, Homo sapiens
aggguccaaccagaccuggaag

SEQ ID NO: 706994 - RNA, 20 nt, Homo sapiens
aggucaucggcguggcccaa

SEQ ID NO: 706995 - RNA, 22 nt, Homo sapiens
aggugaucugcugcagagcagu

SEQ ID NO: 706996 - RNA, 16 nt, Homo sapiens
aggugauuccagugaa

SEQ ID NO: 706997 - RNA, 20 nt, Homo sapiens
aggugggaggauugcuugag

SEQ ID NO: 706998 - RNA, 14 nt, Homo sapiens
agguuauauccaau

SEQ ID NO: 706999 - RNA, 22 nt, Homo sapiens
agguucuucagaagucacacau

SEQ ID NO: 707000 - RNA, 14 nt, Homo sapiens
agguugaagccaag

SEQ ID NO: 707001 - RNA, 19 nt, Homo sapiens
aguaaacgggaacaugccc

SEQ ID NO: 707002 - RNA, 21 nt, Homo sapiens
aguaaugaauuuuuaugauau

SEQ ID NO: 707003 - RNA, 15 nt, Homo sapiens
aguacccuuucaaac

SEQ ID NO: 707004 - RNA, 12 nt, Homo sapiens
aguagagccagc

SEQ ID NO: 707005 - RNA, 15 nt, Homo sapiens
aguagugcugugauu

SEQ ID NO: 707006 - RNA, 18 nt, Homo sapiens
aguaguucuguauuugaa

SEQ ID NO: 707007 - RNA, 14 nt, Homo sapiens
aguaucccacaucc

SEQ ID NO: 707008 - RNA, 15 nt, Homo sapiens
aguaucccacaucca

SEQ ID NO: 707009 - RNA, 20 nt, Homo sapiens
aguauguauguguaccuaag

SEQ ID NO: 707010 - RNA, 17 nt, Homo sapiens
aguauuuggggucauau

SEQ ID NO: 707011 - RNA, 15 nt, Homo sapiens
agucaaauuuguaaa

SEQ ID NO: 707012 - RNA, 20 nt, Homo sapiens
agucaauggcuuguucauca

SEQ ID NO: 707013 - RNA, 17 nt, Homo sapiens
agucacugccaagucau

SEQ ID NO: 707014 - RNA, 23 nt, Homo sapiens
agucacuggagguugaagccaag

SEQ ID NO: 707015 - RNA, 10 nt, Homo sapiens
agucagagac

SEQ ID NO: 707016 - RNA, 16 nt, Homo sapiens
agucauaucuuaauau

SEQ ID NO: 707017 - RNA, 16 nt, Homo sapiens
agucauuaaagacagg

SEQ ID NO: 707018 - RNA, 12 nt, Homo sapiens
aguccaaaaagc

SEQ ID NO: 707019 - RNA, 15 nt, Homo sapiens
aguccacccugccug

SEQ ID NO: 707020 - RNA, 18 nt, Homo sapiens
agucccuuccccaugcuu

SEQ ID NO: 707021 - RNA, 11 nt, Homo sapiens
aguccuacuca

SEQ ID NO: 707022 - RNA, 19 nt, Homo sapiens
agucgcaucucagugcagg

SEQ ID NO: 707023 - RNA, 18 nt, Homo sapiens
agucguggggugugcugg

SEQ ID NO: 707024 - RNA, 18 nt, Homo sapiens
agucugcuuugguacuaa

SEQ ID NO: 707025 - RNA, 22 nt, Homo sapiens
agugaaaauuguuuagugauau

SEQ ID NO: 707026 - RNA, 14 nt, Homo sapiens
agugaacauucuga

SEQ ID NO: 707027 - RNA, 22 nt, Homo sapiens
agugaaguuuuacugucuauua

SEQ ID NO: 707028 - RNA, 14 nt, Homo sapiens
aaaagccucaucca

SEQ ID NO: 707029 - RNA, 12 nt, Homo sapiens
aaaauaaauuca

SEQ ID NO: 707030 - RNA, 14 nt, Homo sapiens
aacaaacguuucuu

SEQ ID NO: 707031 - RNA, 18 nt, Homo sapiens
aacuaaauuugucuuuca

SEQ ID NO: 707032 - RNA, 19 nt, Homo sapiens
aacuaaauuugucuuucaa

SEQ ID NO: 707033 - RNA, 22 nt, Homo sapiens
aacugucuuucauuuuugaacc

SEQ ID NO: 707034 - RNA, 20 nt, Homo sapiens
aacuucuguggcaaaugcca

SEQ ID NO: 707035 - RNA, 21 nt, Homo sapiens
aagaccagcuguguuucuuaa

SEQ ID NO: 707036 - RNA, 12 nt, Homo sapiens
aaggauagggaa

SEQ ID NO: 707037 - RNA, 15 nt, Homo sapiens
aagugaaaccagcuu

SEQ ID NO: 707038 - RNA, 18 nt, Homo sapiens
aauauuuuacuuuuacag

SEQ ID NO: 707039 - RNA, 22 nt, Homo sapiens
acacaugacgcaccaguuacag

SEQ ID NO: 707040 - RNA, 13 nt, Homo sapiens
acacuuugaacuc

SEQ ID NO: 707041 - RNA, 23 nt, Homo sapiens
acagaaggacugaagaccagcug

SEQ ID NO: 707042 - RNA, 12 nt, Homo sapiens
acagaguguccu

SEQ ID NO: 707043 - RNA, 19 nt, Homo sapiens
acagcacauccacccaggu

SEQ ID NO: 707044 - RNA, 20 nt, Homo sapiens
acagggucuugcucugucac

SEQ ID NO: 707045 - RNA, 16 nt, Homo sapiens
accacccacaaucaca

SEQ ID NO: 707046 - RNA, 20 nt, Homo sapiens
acccagacuggagugcagug

SEQ ID NO: 707047 - RNA, 14 nt, Homo sapiens
accugucaucucac

SEQ ID NO: 707048 - RNA, 23 nt, Homo sapiens
acuaucuguaaugccuuuucuca

SEQ ID NO: 707049 - RNA, 21 nt, Homo sapiens
acugugcaaauauaucugcua

SEQ ID NO: 707050 - RNA, 22 nt, Homo sapiens
acugugcaaauauaucugcuau

SEQ ID NO: 707051 - RNA, 14 nt, Homo sapiens
agaacugucuuuca

SEQ ID NO: 707052 - RNA, 15 nt, Homo sapiens
agaacugucuuucau

SEQ ID NO: 707053 - RNA, 20 nt, Homo sapiens
agaaggacugaagaccagcu

SEQ ID NO: 707054 - RNA, 14 nt, Homo sapiens
agacagugagacag

SEQ ID NO: 707055 - RNA, 15 nt, Homo sapiens
agacuggagugcagu

SEQ ID NO: 707056 - RNA, 15 nt, Homo sapiens
agaucuagugaacau

SEQ ID NO: 707057 - RNA, 20 nt, Homo sapiens
agauggccuggcugcugcug

SEQ ID NO: 707058 - RNA, 16 nt, Homo sapiens
agauguguauacagaa

SEQ ID NO: 707059 - RNA, 17 nt, Homo sapiens
agcuaauuucuaauggc

SEQ ID NO: 707060 - RNA, 18 nt, Homo sapiens
aggacugaagaccagcug

SEQ ID NO: 707061 - RNA, 20 nt, Homo sapiens
agucuguguuguguccugac

SEQ ID NO: 707062 - RNA, 13 nt, Homo sapiens
agugaaaccagcu

SEQ ID NO: 707063 - RNA, 19 nt, Homo sapiens
agugaacauucgaccucca

SEQ ID NO: 707064 - RNA, 20 nt, Homo sapiens
agugaacauucgaccuccau

SEQ ID NO: 707065 - RNA, 16 nt, Homo sapiens
agugagacaucaggga

SEQ ID NO: 707066 - RNA, 20 nt, Homo sapiens
aguggugugaucauagcuca

SEQ ID NO: 707067 - RNA, 15 nt, Homo sapiens
auaaagcagccucau

SEQ ID NO: 707068 - RNA, 15 nt, Homo sapiens
auaaugcucauacuu

SEQ ID NO: 707069 - RNA, 15 nt, Homo sapiens
auaugauuuguguau

SEQ ID NO: 707070 - RNA, 13 nt, Homo sapiens
aucccaguccuga

SEQ ID NO: 707071 - RNA, 22 nt, Homo sapiens
auggccuggcugcugcugugca

SEQ ID NO: 707072 - RNA, 14 nt, Homo sapiens
auggcuguccuugu

SEQ ID NO: 707073 - RNA, 20 nt, Homo sapiens
auguccccaaugcuguaccu

SEQ ID NO: 707074 - RNA, 17 nt, Homo sapiens
auguuucacugugcaaa

SEQ ID NO: 707075 - RNA, 19 nt, Homo sapiens
auuagcaugagcuuuccag

SEQ ID NO: 707076 - RNA, 16 nt, Homo sapiens
auucuccauacucugu

SEQ ID NO: 707077 - RNA, 20 nt, Homo sapiens
auugcucaggcuggucuuga

SEQ ID NO: 707078 - RNA, 22 nt, Homo sapiens
auuucuuuucugcauguucuaa

SEQ ID NO: 707079 - RNA, 18 nt, Homo sapiens
auuuuaaaaauaaauuca

SEQ ID NO: 707080 - RNA, 19 nt, Homo sapiens
caaauauaucugcuauucu

SEQ ID NO: 707081 - RNA, 15 nt, Homo sapiens
caagugaaaccagcu

SEQ ID NO: 707082 - RNA, 19 nt, Homo sapiens
caaguucuagggccgucag

SEQ ID NO: 707083 - RNA, 16 nt, Homo sapiens
gcuaaggauagggaaa

SEQ ID NO: 707084 - RNA, 14 nt, Homo sapiens
gcuauucuccauac

SEQ ID NO: 707085 - RNA, 17 nt, Homo sapiens
gcucaggcuggucuuga

SEQ ID NO: 707086 - RNA, 22 nt, Homo sapiens
gcucaggcuggucuugaacucc

SEQ ID NO: 707087 - RNA, 18 nt, Homo sapiens
gcucucaggcugagggag

SEQ ID NO: 707088 - RNA, 23 nt, Homo sapiens
gcugagggaggcagaaagggaaa

SEQ ID NO: 707089 - RNA, 12 nt, Homo sapiens
gcugcugugcag

SEQ ID NO: 707090 - RNA, 17 nt, Homo sapiens
ggaagggacagcugcau

SEQ ID NO: 707091 - RNA, 16 nt, Homo sapiens
ggaguaagugacacuu

SEQ ID NO: 707092 - RNA, 22 nt, Homo sapiens
ggaguaagugacacuuugaacu

SEQ ID NO: 707093 - RNA, 21 nt, Homo sapiens
ggcaaucaacaaacguuucuu

SEQ ID NO: 707094 - RNA, 14 nt, Homo sapiens
aaaaagcauuauua

SEQ ID NO: 707095 - RNA, 20 nt, Homo sapiens
gccgcuuggugagugucugg

SEQ ID NO: 707096 - RNA, 12 nt, Homo sapiens
gccucaccuuca

SEQ ID NO: 707097 - RNA, 14 nt, Homo sapiens
gccugagugaucca

SEQ ID NO: 707098 - RNA, 21 nt, Homo sapiens
gccuuuucucaccugucaucu

SEQ ID NO: 707099 - RNA, 18 nt, Homo sapiens
gcucaagugaucuuccca

SEQ ID NO: 707100 - RNA, 15 nt, Homo sapiens
gcucauacuuaucua

SEQ ID NO: 707101 - RNA, 15 nt, Homo sapiens
gcugcucuccugaca

SEQ ID NO: 707102 - RNA, 20 nt, Homo sapiens
ggauuaaaagccucauccac

SEQ ID NO: 707103 - RNA, 19 nt, Homo sapiens
ggcagcucagccaccacuc

SEQ ID NO: 707104 - RNA, 22 nt, Homo sapiens
ggcccagauacagcacauccac

SEQ ID NO: 707105 - RNA, 15 nt, Homo sapiens
ggcucugguuccucc

SEQ ID NO: 707106 - RNA, 16 nt, Homo sapiens
gggacagaguguccuu

SEQ ID NO: 707107 - RNA, 20 nt, Homo sapiens
ggugcacgccaccacaccug

SEQ ID NO: 707108 - RNA, 12 nt, Homo sapiens
gguggugaugcu

SEQ ID NO: 707109 - RNA, 16 nt, Homo sapiens
gguuccuccagccacc

SEQ ID NO: 707110 - RNA, 15 nt, Homo sapiens
guaaugccuuuucuc

SEQ ID NO: 707111 - RNA, 23 nt, Homo sapiens
guacacagaggcgggucuauaac

SEQ ID NO: 707112 - RNA, 14 nt, Homo sapiens
guccucucauccca

SEQ ID NO: 707113 - RNA, 18 nt, Homo sapiens
gugcaaauauaucugcua

SEQ ID NO: 707114 - RNA, 14 nt, Homo sapiens
guguuguguccuga

SEQ ID NO: 707115 - RNA, 14 nt, Homo sapiens
guuccuccagccac

SEQ ID NO: 707116 - RNA, 16 nt, Homo sapiens
guuccuccagccaccu

SEQ ID NO: 707117 - RNA, 13 nt, Homo sapiens
guuucacugugca

SEQ ID NO: 707118 - RNA, 14 nt, Homo sapiens
guuucacugugcaa

SEQ ID NO: 707119 - RNA, 19 nt, Homo sapiens
guuuccuauguuucacugu

SEQ ID NO: 707120 - RNA, 18 nt, Homo sapiens
uaaauucaaauuauucua

SEQ ID NO: 707121 - RNA, 20 nt, Homo sapiens
uaacaguugcauugacuguc

SEQ ID NO: 707122 - RNA, 23 nt, Homo sapiens
uaauaugugggaauuagugagac

SEQ ID NO: 707123 - RNA, 21 nt, Homo sapiens
uaauggccuuccauaauaauu

SEQ ID NO: 707124 - RNA, 17 nt, Homo sapiens
uacagucauuuuccuac

SEQ ID NO: 707125 - RNA, 14 nt, Homo sapiens
uaccuauuccuuca

SEQ ID NO: 707126 - RNA, 13 nt, Homo sapiens
uagagacaggguc

SEQ ID NO: 707127 - RNA, 14 nt, Homo sapiens
uauguuucacugug

SEQ ID NO: 707128 - RNA, 12 nt, Homo sapiens
uauuauaauuca

SEQ ID NO: 707129 - RNA, 20 nt, Homo sapiens
cacaugacgcaccaguuaca

SEQ ID NO: 707130 - RNA, 14 nt, Homo sapiens
cacccacaaucaca

SEQ ID NO: 707131 - RNA, 19 nt, Homo sapiens
cacccagacuggagugcag

SEQ ID NO: 707132 - RNA, 20 nt, Homo sapiens
cacccagacuggagugcagu

SEQ ID NO: 707133 - RNA, 18 nt, Homo sapiens
cacuauauugcucaggcu

SEQ ID NO: 707134 - RNA, 17 nt, Homo sapiens
cagaggcuccacaggcu

SEQ ID NO: 707135 - RNA, 12 nt, Homo sapiens
cagaguguccuu

SEQ ID NO: 707136 - RNA, 18 nt, Homo sapiens
caggcuggucuugaacuc

SEQ ID NO: 707137 - RNA, 22 nt, Homo sapiens
cagggucucacuauauugcuca

SEQ ID NO: 707138 - RNA, 23 nt, Homo sapiens
cagggucucacuauauugcucag

SEQ ID NO: 707139 - RNA, 13 nt, Homo sapiens
cagggucuugcuc

SEQ ID NO: 707140 - RNA, 15 nt, Homo sapiens
cagggucuugcucug

SEQ ID NO: 707141 - RNA, 12 nt, Homo sapiens
caguuagggcug

SEQ ID NO: 707142 - RNA, 20 nt, Homo sapiens
caucagggaguaagugacac

SEQ ID NO: 707143 - RNA, 18 nt, Homo sapiens
caucuuucacuaucugua

SEQ ID NO: 707144 - RNA, 20 nt, Homo sapiens
cauuccagagcaggaggcag

SEQ ID NO: 707145 - RNA, 14 nt, Homo sapiens
cauugacugucaca

SEQ ID NO: 707146 - RNA, 17 nt, Homo sapiens
cauuucuuuucugcaug

SEQ ID NO: 707147 - RNA, 20 nt, Homo sapiens
ccaagcccuccacauuuuca

SEQ ID NO: 707148 - RNA, 20 nt, Homo sapiens
ccacccacaaucacaagaag

SEQ ID NO: 707149 - RNA, 13 nt, Homo sapiens
ccaucuuucacua

SEQ ID NO: 707150 - RNA, 21 nt, Homo sapiens
cccaugccuggucccaagaca

SEQ ID NO: 707151 - RNA, 20 nt, Homo sapiens
cccucggugcagagugcaga

SEQ ID NO: 707152 - RNA, 12 nt, Homo sapiens
ccuaugcuuuca

SEQ ID NO: 707153 - RNA, 19 nt, Homo sapiens
ccuauguuucacugugcaa

SEQ ID NO: 707154 - RNA, 20 nt, Homo sapiens
ccucaaccuccuggguucaa

SEQ ID NO: 707155 - RNA, 18 nt, Homo sapiens
ccuuccucuguccucuca

SEQ ID NO: 707156 - RNA, 22 nt, Homo sapiens
ccuugagucuguguuguguccu

SEQ ID NO: 707157 - RNA, 22 nt, Homo sapiens
cggagaguuuccuauguuucac

SEQ ID NO: 707158 - RNA, 22 nt, Homo sapiens
cgugggccucccaaaacgcugg

SEQ ID NO: 707159 - RNA, 15 nt, Homo sapiens
cuaaguuccuuccca

SEQ ID NO: 707160 - RNA, 18 nt, Homo sapiens
cuauguuucacugugcaa

SEQ ID NO: 707161 - RNA, 21 nt, Homo sapiens
cucagccuccugaacagcugg

SEQ ID NO: 707162 - RNA, 17 nt, Homo sapiens
cuccauacucuguaaca

SEQ ID NO: 707163 - RNA, 15 nt, Homo sapiens
cucuaccuaaguucc

SEQ ID NO: 707164 - RNA, 12 nt, Homo sapiens
cucucaucccag

SEQ ID NO: 707165 - RNA, 19 nt, Homo sapiens
cucuguaacaguugcauug

SEQ ID NO: 707166 - RNA, 18 nt, Homo sapiens
cucuguccucucauccca

SEQ ID NO: 707167 - RNA, 13 nt, Homo sapiens
cugagugauccac

SEQ ID NO: 707168 - RNA, 13 nt, Homo sapiens
cuggcugcugcug

SEQ ID NO: 707169 - RNA, 16 nt, Homo sapiens
cuggucccaagacagu

SEQ ID NO: 707170 - RNA, 22 nt, Homo sapiens
cugguggccugccccagcucuc

SEQ ID NO: 707171 - RNA, 10 nt, Homo sapiens
cugucuuuca

SEQ ID NO: 707172 - RNA, 21 nt, Homo sapiens
cugugcaggagccaguccuga

SEQ ID NO: 707173 - RNA, 17 nt, Homo sapiens
cuguggcaaaugccagu

SEQ ID NO: 707174 - RNA, 15 nt, Homo sapiens
cuguguuguguccug

SEQ ID NO: 707175 - RNA, 20 nt, Homo sapiens
cuuucaagugaaaccagcuu

SEQ ID NO: 707176 - RNA, 18 nt, Homo sapiens
cuuucacuaucuguaaug

SEQ ID NO: 707177 - RNA, 16 nt, Homo sapiens
gaacuccucaagggca

SEQ ID NO: 707178 - RNA, 20 nt, Homo sapiens
gacagggucuugcucuguca

SEQ ID NO: 707179 - RNA, 22 nt, Homo sapiens
gacaucagggaguaagugacac

SEQ ID NO: 707180 - RNA, 22 nt, Homo sapiens
gacccucggugcagagugcaga

SEQ ID NO: 707181 - RNA, 15 nt, Homo sapiens
gacugaagaccagcu

SEQ ID NO: 707182 - RNA, 17 nt, Homo sapiens
gaucauagcucacugca

SEQ ID NO: 707183 - RNA, 21 nt, Homo sapiens
gcaaauauaucugcuauucuc

SEQ ID NO: 707184 - RNA, 15 nt, Homo sapiens
gcucaagugaucuuc

SEQ ID NO: 707185 - RNA, 18 nt, Homo sapiens
gcuggucuugaacuccug

SEQ ID NO: 707186 - RNA, 14 nt, Homo sapiens
gcuuucacuuccca

SEQ ID NO: 707187 - RNA, 16 nt, Homo sapiens
ggaaaggguggaugcu

SEQ ID NO: 707188 - RNA, 13 nt, Homo sapiens
ggcagaaagggaa

SEQ ID NO: 707189 - RNA, 19 nt, Homo sapiens
ggcauuucuuuucugcaug

SEQ ID NO: 707190 - RNA, 17 nt, Homo sapiens
ggguccauaugagggaa

SEQ ID NO: 707191 - RNA, 22 nt, Homo sapiens
guauauuuuaaaaauaaauuca

SEQ ID NO: 707192 - RNA, 21 nt, Homo sapiens
gucacauaaugcucauacuua

SEQ ID NO: 707193 - RNA, 11 nt, Homo sapiens
gucccaagaca

SEQ ID NO: 707194 - RNA, 19 nt, Homo sapiens
gucucacuauauugcucag

SEQ ID NO: 707195 - RNA, 14 nt, Homo sapiens
gugcagagugcaga

SEQ ID NO: 707196 - RNA, 20 nt, Homo sapiens
guuguuuuuagagacagggu

SEQ ID NO: 707197 - RNA, 22 nt, Homo sapiens
uaaaaauaaauucaaauuauuc

SEQ ID NO: 707198 - RNA, 23 nt, Homo sapiens
uaaauuugucuuucaagugaaac

SEQ ID NO: 707199 - RNA, 19 nt, Homo sapiens
uaaggcuaaggauagggaa

SEQ ID NO: 707200 - RNA, 23 nt, Homo sapiens
uaaugccuuuucucaccugucau

SEQ ID NO: 707201 - RNA, 17 nt, Homo sapiens
uagcaugagcuuuccag

SEQ ID NO: 707202 - RNA, 13 nt, Homo sapiens
uagcucacugcac

SEQ ID NO: 707203 - RNA, 19 nt, Homo sapiens
uaggguccauaugagggaa

SEQ ID NO: 707204 - RNA, 13 nt, Homo sapiens
uauguuucacugu

SEQ ID NO: 707205 - RNA, 21 nt, Homo sapiens
uauuuuaaaaauaaauucaaa

SEQ ID NO: 707206 - RNA, 18 nt, Homo sapiens
ucaauccaggagccuuga

SEQ ID NO: 707207 - RNA, 21 nt, Homo sapiens
ucacccagacuggagugcagu

SEQ ID NO: 707208 - RNA, 19 nt, Homo sapiens
ucacugugcaaauauaucu

SEQ ID NO: 707209 - RNA, 20 nt, Homo sapiens
ucagccuccugaacagcugg

SEQ ID NO: 707210 - RNA, 13 nt, Homo sapiens
uccagccaccacc

SEQ ID NO: 707211 - RNA, 15 nt, Homo sapiens
uccaucuuucacuau

SEQ ID NO: 707212 - RNA, 23 nt, Homo sapiens
ucccuucccugaagaucuaguga

SEQ ID NO: 707213 - RNA, 17 nt, Homo sapiens
uccuauguuucacugug

SEQ ID NO: 707214 - RNA, 19 nt, Homo sapiens
uccuccagccaccucaguc

SEQ ID NO: 707215 - RNA, 19 nt, Homo sapiens
uccucuggggcauuaucca

SEQ ID NO: 707216 - RNA, 18 nt, Homo sapiens
uccugggcucaagugauc

SEQ ID NO: 707217 - RNA, 24 nt, Homo sapiens
ucuccauacucuguaacaguugca

SEQ ID NO: 707218 - RNA, 18 nt, Homo sapiens
ucuggaaagugaugucag

SEQ ID NO: 707219 - RNA, 23 nt, Homo sapiens
ucuuaacuaaauuugucuuucaa

SEQ ID NO: 707220 - RNA, 17 nt, Homo sapiens
ucuugcucugucaccca

SEQ ID NO: 707221 - RNA, 12 nt, Homo sapiens
ugaaaccagcuu

SEQ ID NO: 707222 - RNA, 23 nt, Homo sapiens
ugaacuccugggcucaagugauc

SEQ ID NO: 707223 - RNA, 15 nt, Homo sapiens
ugcacgccaccacac

SEQ ID NO: 707224 - RNA, 12 nt, Homo sapiens
ugcagagugcag

SEQ ID NO: 707225 - RNA, 13 nt, Homo sapiens
ugcuacaguauau

SEQ ID NO: 707226 - RNA, 13 nt, Homo sapiens
ugcucuccugaca

SEQ ID NO: 707227 - RNA, 22 nt, Homo sapiens
uggaggcccagauacagcacau

SEQ ID NO: 707228 - RNA, 23 nt, Homo sapiens
uggaggcccagauacagcacauc

SEQ ID NO: 707229 - RNA, 21 nt, Homo sapiens
uggccgcuuggugagugucug

SEQ ID NO: 707230 - RNA, 13 nt, Homo sapiens
uggcuguccuugu

SEQ ID NO: 707231 - RNA, 13 nt, Homo sapiens
uggggcauuaucc

SEQ ID NO: 707232 - RNA, 23 nt, Homo sapiens
ugucuuucaagugaaaccagcuu

SEQ ID NO: 707233 - RNA, 23 nt, Homo sapiens
uguguauuauaauucaaaggcau

SEQ ID NO: 707234 - RNA, 19 nt, Homo sapiens
uguucuaaauaaaaagcau

SEQ ID NO: 707235 - RNA, 19 nt, Homo sapiens
uguuguguccugacaccuc

SEQ ID NO: 707236 - RNA, 12 nt, Homo sapiens
uucacugugcaa

SEQ ID NO: 707237 - RNA, 13 nt, Homo sapiens
uucuccauacucu

SEQ ID NO: 707238 - RNA, 13 nt, Homo sapiens
uuguguccugaca

SEQ ID NO: 707239 - RNA, 21 nt, Homo sapiens
uuguuuaauaauguaccuauu

SEQ ID NO: 707240 - RNA, 19 nt, Homo sapiens
uuguuuuuagagacagggu

SEQ ID NO: 707241 - RNA, 20 nt, Homo sapiens
uuuggggacagaguguccuu

SEQ ID NO: 707242 - RNA, 11 nt, Homo sapiens
uuugucuuuca

SEQ ID NO: 707243 - RNA, 21 nt, Homo sapiens
uuuucucaccugucaucucac

SEQ ID NO: 707244 - RNA, 22 nt, Homo sapiens
aaaguauuagcaugagcuuucc

SEQ ID NO: 707245 - RNA, 12 nt, Homo sapiens
aaauaaauucaa

SEQ ID NO: 707246 - RNA, 19 nt, Homo sapiens
aaauaaauucaaauuauuc

SEQ ID NO: 707247 - RNA, 15 nt, Homo sapiens
aaauauaucugcuau

SEQ ID NO: 707248 - RNA, 15 nt, Homo sapiens
aaauucaaauuauuc

SEQ ID NO: 707249 - RNA, 16 nt, Homo sapiens
aaauucaaauuauucu

SEQ ID NO: 707250 - RNA, 14 nt, Homo sapiens
aaauuugucuuuca

SEQ ID NO: 707251 - RNA, 19 nt, Homo sapiens
aacagcugggaccacaggu

SEQ ID NO: 707252 - RNA, 15 nt, Homo sapiens
aacauucgaccucca

SEQ ID NO: 707253 - RNA, 13 nt, Homo sapiens
aacugucuuucau

SEQ ID NO: 707254 - RNA, 23 nt, Homo sapiens
aacugucuuucauuuuugaaccc

SEQ ID NO: 707255 - RNA, 18 nt, Homo sapiens
aagaccagcuguguuucu

SEQ ID NO: 707256 - RNA, 13 nt, Homo sapiens
aagccucauccac

SEQ ID NO: 707257 - RNA, 23 nt, Homo sapiens
aagcgagcagaggcuccacaggc

SEQ ID NO: 707258 - RNA, 18 nt, Homo sapiens
aaggcuaaggauagggaa

SEQ ID NO: 707259 - RNA, 18 nt, Homo sapiens
aagugacacuuugaacuc

SEQ ID NO: 707260 - RNA, 20 nt, Homo sapiens
aaucaacaaacguuucuuga

SEQ ID NO: 707261 - RNA, 18 nt, Homo sapiens
aaucacaagaagauuccc

SEQ ID NO: 707262 - RNA, 15 nt, Homo sapiens
aauucaaaggcauuu

SEQ ID NO: 707263 - RNA, 13 nt, Homo sapiens
aauuugucuuuca

SEQ ID NO: 707264 - RNA, 20 nt, Homo sapiens
acacaugacgcaccaguuac

SEQ ID NO: 707265 - RNA, 19 nt, Homo sapiens
acaccaauugaagugaaau

SEQ ID NO: 707266 - RNA, 13 nt, Homo sapiens
acagaguguccuu

SEQ ID NO: 707267 - RNA, 18 nt, Homo sapiens
acagcugggaccacaggu

SEQ ID NO: 707268 - RNA, 19 nt, Homo sapiens
acccagacuggagugcagu

SEQ ID NO: 707269 - RNA, 21 nt, Homo sapiens
acccucggugcagagugcaga

SEQ ID NO: 707270 - RNA, 15 nt, Homo sapiens
acugaagaccagcug

SEQ ID NO: 707271 - RNA, 11 nt, Homo sapiens
agacagggucu

SEQ ID NO: 707272 - RNA, 13 nt, Homo sapiens
agagacagggucu

SEQ ID NO: 707273 - RNA, 19 nt, Homo sapiens
agccaccacccacaaucac

SEQ ID NO: 707274 - RNA, 14 nt, Homo sapiens
aggcagaaagggaa

SEQ ID NO: 707275 - RNA, 13 nt, Homo sapiens
aggcuaaggauag

SEQ ID NO: 707276 - RNA, 15 nt, Homo sapiens
agucuggaaagugau

SEQ ID NO: 707277 - RNA, 16 nt, Homo sapiens
aguuagggcuguugau

SEQ ID NO: 707278 - RNA, 19 nt, Homo sapiens
aguugcauugacugucaca

SEQ ID NO: 707279 - RNA, 14 nt, Homo sapiens
auaaaaagcauuau

SEQ ID NO: 707280 - RNA, 15 nt, Homo sapiens
auaaaaagcauuauu

SEQ ID NO: 707281 - RNA, 20 nt, Homo sapiens
auaauucaaaggcauuucuu

SEQ ID NO: 707282 - RNA, 19 nt, Homo sapiens
auauaucugcuauucucca

SEQ ID NO: 707283 - RNA, 16 nt, Homo sapiens
auauuuuacuuuuaca

SEQ ID NO: 707284 - RNA, 14 nt, Homo sapiens
aucccaguccugau

SEQ ID NO: 707285 - RNA, 20 nt, Homo sapiens
aucuaauguugaguuauuaa

SEQ ID NO: 707286 - RNA, 21 nt, Homo sapiens
augacgcaccaguuacagggg

SEQ ID NO: 707287 - RNA, 19 nt, Homo sapiens
augccuggucccaagacag

SEQ ID NO: 707288 - RNA, 17 nt, Homo sapiens
augcuuucacuucccac

SEQ ID NO: 707289 - RNA, 23 nt, Homo sapiens
auggccuggcugcugcugugcag

SEQ ID NO: 707290 - RNA, 22 nt, Homo sapiens
auguucuaaauaaaaagcauua

SEQ ID NO: 707291 - RNA, 13 nt, Homo sapiens
auuaaauagagaa

SEQ ID NO: 707292 - RNA, 15 nt, Homo sapiens
auuagcaugagcuuu

SEQ ID NO: 707293 - RNA, 18 nt, Homo sapiens
auuauccaucuuucacua

SEQ ID NO: 707294 - RNA, 16 nt, Homo sapiens
auucaaaggcauuucu

SEQ ID NO: 707295 - RNA, 14 nt, Homo sapiens
auucaaauuauucu

SEQ ID NO: 707296 - RNA, 14 nt, Homo sapiens
auucuccauacucu

SEQ ID NO: 707297 - RNA, 18 nt, Homo sapiens
auucugaggccugaguga

SEQ ID NO: 707298 - RNA, 23 nt, Homo sapiens
auuuuccuacaucggaauccaag

SEQ ID NO: 707299 - RNA, 23 nt, Homo sapiens
caaauauaucugcuauucuccau

SEQ ID NO: 707300 - RNA, 16 nt, Homo sapiens
cacaggugcacgccac

SEQ ID NO: 707301 - RNA, 19 nt, Homo sapiens
caccgauauuaguccuaca

SEQ ID NO: 707302 - RNA, 15 nt, Homo sapiens
caccucucuaccuaa

SEQ ID NO: 707303 - RNA, 15 nt, Homo sapiens
caccugucaucucac

SEQ ID NO: 707304 - RNA, 19 nt, Homo sapiens
cacgcgacccucggugcag

SEQ ID NO: 707305 - RNA, 23 nt, Homo sapiens
cacugugcaaauauaucugcuau

SEQ ID NO: 707306 - RNA, 18 nt, Homo sapiens
cagaguguccuuccucug

SEQ ID NO: 707307 - RNA, 19 nt, Homo sapiens
caggugcacgccaccacac

SEQ ID NO: 707308 - RNA, 20 nt, Homo sapiens
caguggugugaucauagcuc

SEQ ID NO: 707309 - RNA, 16 nt, Homo sapiens
caucuuucacuaucug

SEQ ID NO: 707310 - RNA, 16 nt, Homo sapiens
caugagcuuuccaguu

SEQ ID NO: 707311 - RNA, 22 nt, Homo sapiens
cauguucuaaauaaaaagcauu

SEQ ID NO: 707312 - RNA, 14 nt, Homo sapiens
cauuauuauuugcu

SEQ ID NO: 707313 - RNA, 17 nt, Homo sapiens
cauugacugucacauaa

SEQ ID NO: 707314 - RNA, 22 nt, Homo sapiens
ccacaggcuuacgcugcucucc

SEQ ID NO: 707315 - RNA, 17 nt, Homo sapiens
ccagacuggagugcagu

SEQ ID NO: 707316 - RNA, 20 nt, Homo sapiens
ccauaauaauucugcuuuag

SEQ ID NO: 707317 - RNA, 12 nt, Homo sapiens
cccaaugcugua

SEQ ID NO: 707318 - RNA, 23 nt, Homo sapiens
cccaugccuggucccaagacagu

SEQ ID NO: 707319 - RNA, 22 nt, Homo sapiens
ccggauuaaaagccucauccac

SEQ ID NO: 707320 - RNA, 13 nt, Homo sapiens
ccuccagccacca

SEQ ID NO: 707321 - RNA, 17 nt, Homo sapiens
ccugaagaucuagugaa

SEQ ID NO: 707322 - RNA, 18 nt, Homo sapiens
ccuuccauaauaauucug

SEQ ID NO: 707323 - RNA, 16 nt, Homo sapiens
cggugcagagugcaga

SEQ ID NO: 707324 - RNA, 17 nt, Homo sapiens
cuaaauuugucuuucaa

SEQ ID NO: 707325 - RNA, 13 nt, Homo sapiens
cuauucuccauac

SEQ ID NO: 707326 - RNA, 22 nt, Homo sapiens
cucuaaggcuaaggauagggaa

SEQ ID NO: 707327 - RNA, 16 nt, Homo sapiens
cucucaggcugaggga

SEQ ID NO: 707328 - RNA, 22 nt, Homo sapiens
cugaagaccagcuguguuucuu

SEQ ID NO: 707329 - RNA, 18 nt, Homo sapiens
cuggcugcugcugugcag

SEQ ID NO: 707330 - RNA, 22 nt, Homo sapiens
cugguuccuccagccaccucag

SEQ ID NO: 707331 - RNA, 11 nt, Homo sapiens
cugucuuucau

SEQ ID NO: 707332 - RNA, 18 nt, Homo sapiens
cugugguuguaaagcagu

SEQ ID NO: 707333 - RNA, 20 nt, Homo sapiens
cuucccaccucucuaccuaa

SEQ ID NO: 707334 - RNA, 19 nt, Homo sapiens
cuuucaagugaaaccagcu

SEQ ID NO: 707335 - RNA, 20 nt, Homo sapiens
gaacauucgaccuccauuac

SEQ ID NO: 707336 - RNA, 23 nt, Homo sapiens
gaacugucuuucauuuuugaacc

SEQ ID NO: 707337 - RNA, 20 nt, Homo sapiens
gaagggacagcugcauucca

SEQ ID NO: 707338 - RNA, 14 nt, Homo sapiens
gacagggucuugcu

SEQ ID NO: 707339 - RNA, 18 nt, Homo sapiens
gacagucuggaaagugau

SEQ ID NO: 707340 - RNA, 14 nt, Homo sapiens
gaccacaggugcac

SEQ ID NO: 707341 - RNA, 14 nt, Homo sapiens
gacuggagugcagu

SEQ ID NO: 707342 - RNA, 15 nt, Homo sapiens
gacuggagugcagug

SEQ ID NO: 707343 - RNA, 21 nt, Homo sapiens
gagacagucuggaaagugaug

SEQ ID NO: 707344 - RNA, 13 nt, Homo sapiens
gagacaucaggga

SEQ ID NO: 707345 - RNA, 20 nt, Homo sapiens
gagugcaguggugugaucau

SEQ ID NO: 707346 - RNA, 23 nt, Homo sapiens
gaguuauuaauauguuauuauua

SEQ ID NO: 707347 - RNA, 13 nt, Homo sapiens
gcagaaagggaaa

SEQ ID NO: 707348 - RNA, 21 nt, Homo sapiens
gccgccucccaccacuccacu

SEQ ID NO: 707349 - RNA, 14 nt, Homo sapiens
gccucccaccacuc

SEQ ID NO: 707350 - RNA, 13 nt, Homo sapiens
gccugagugaucc

SEQ ID NO: 707351 - RNA, 15 nt, Homo sapiens
gcuauucuccauacu

SEQ ID NO: 707352 - RNA, 22 nt, Homo sapiens
gcugagggaggcagaaagggaa

SEQ ID NO: 707353 - RNA, 15 nt, Homo sapiens
gcugcugcugugcag

SEQ ID NO: 707354 - RNA, 15 nt, Homo sapiens
ggauagggaaagggu

SEQ ID NO: 707355 - RNA, 12 nt, Homo sapiens
ggucccaagaca

SEQ ID NO: 707356 - RNA, 20 nt, Homo sapiens
ggucucacuauauugcucag

SEQ ID NO: 707357 - RNA, 15 nt, Homo sapiens
ggugcagagugcaga

SEQ ID NO: 707358 - RNA, 18 nt, Homo sapiens
gucuggaaagugauguca

SEQ ID NO: 707359 - RNA, 12 nt, Homo sapiens
gugaaaccagcu

SEQ ID NO: 707360 - RNA, 23 nt, Homo sapiens
guuuccuauguuucacugugcaa

SEQ ID NO: 707361 - RNA, 13 nt, Homo sapiens
uaaaaagcauuau

SEQ ID NO: 707362 - RNA, 14 nt, Homo sapiens
uaaaaauaaauuca

SEQ ID NO: 707363 - RNA, 18 nt, Homo sapiens
uacgcugcucuccugaca

SEQ ID NO: 707364 - RNA, 21 nt, Homo sapiens
uagugaacauucgaccuccau

SEQ ID NO: 707365 - RNA, 14 nt, Homo sapiens
uauccaucuuucac

SEQ ID NO: 707366 - RNA, 23 nt, Homo sapiens
uauccaucuuucacuaucuguaa

SEQ ID NO: 707367 - RNA, 19 nt, Homo sapiens
uauucuccauacucuguaa

SEQ ID NO: 707368 - RNA, 21 nt, Homo sapiens
ucaagcaauccuccugccuca

SEQ ID NO: 707369 - RNA, 17 nt, Homo sapiens
ucaagugaaaccagcuu

SEQ ID NO: 707370 - RNA, 13 nt, Homo sapiens
ucaagugaucuuc

SEQ ID NO: 707371 - RNA, 19 nt, Homo sapiens
ucacccagacuggagugca

SEQ ID NO: 707372 - RNA, 19 nt, Homo sapiens
ucaccugucaucucacauu

SEQ ID NO: 707373 - RNA, 15 nt, Homo sapiens
ucacugcacccucaa

SEQ ID NO: 707374 - RNA, 22 nt, Homo sapiens
ucacuucccaccucucuaccua

SEQ ID NO: 707375 - RNA, 23 nt, Homo sapiens
ucaggcuggucuugaacuccugg

SEQ ID NO: 707376 - RNA, 15 nt, Homo sapiens
ucaucccaguccuga

SEQ ID NO: 707377 - RNA, 16 nt, Homo sapiens
uccaucuuucacuauc

SEQ ID NO: 707378 - RNA, 17 nt, Homo sapiens
uccaucuuucacuaucu

SEQ ID NO: 707379 - RNA, 18 nt, Homo sapiens
ucccuaugcuuucacuuc

SEQ ID NO: 707380 - RNA, 23 nt, Homo sapiens
ucccugaagaucuagugaacauu

SEQ ID NO: 707381 - RNA, 21 nt, Homo sapiens
uccuauguuucacugugcaaa

SEQ ID NO: 707382 - RNA, 17 nt, Homo sapiens
ucggugcagagugcaga

SEQ ID NO: 707383 - RNA, 16 nt, Homo sapiens
ucuccauacucuguaa

SEQ ID NO: 707384 - RNA, 14 nt, Homo sapiens
ucuggaaagugaug

SEQ ID NO: 707385 - RNA, 17 nt, Homo sapiens
ucuggaaagugauguca

SEQ ID NO: 707386 - RNA, 22 nt, Homo sapiens
ucugguuccuccagccaccuca

SEQ ID NO: 707387 - RNA, 12 nt, Homo sapiens
ugagacaggguc

SEQ ID NO: 707388 - RNA, 17 nt, Homo sapiens
ugagacagggucuugcu

SEQ ID NO: 707389 - RNA, 14 nt, Homo sapiens
ugagacaucaggga

SEQ ID NO: 707390 - RNA, 14 nt, Homo sapiens
ugcaaauauaucug

SEQ ID NO: 707391 - RNA, 17 nt, Homo sapiens
ugcaaauauaucugcua

SEQ ID NO: 707392 - RNA, 14 nt, Homo sapiens
ugccucccaugccu

SEQ ID NO: 707393 - RNA, 13 nt, Homo sapiens
ugcuauucuccau

SEQ ID NO: 707394 - RNA, 19 nt, Homo sapiens
ugcuauucuccauacucug

SEQ ID NO: 707395 - RNA, 15 nt, Homo sapiens
uggaaagugauguca

SEQ ID NO: 707396 - RNA, 21 nt, Homo sapiens
uggaacuacaagugugagcca

SEQ ID NO: 707397 - RNA, 11 nt, Homo sapiens
uggagugcagu

SEQ ID NO: 707398 - RNA, 20 nt, Homo sapiens
ugguggccugccccagcucu

SEQ ID NO: 707399 - RNA, 22 nt, Homo sapiens
ugucacauaaugcucauacuua

SEQ ID NO: 707400 - RNA, 14 nt, Homo sapiens
uguccugacaccuc

SEQ ID NO: 707401 - RNA, 16 nt, Homo sapiens
ugugaucauagcucac

SEQ ID NO: 707402 - RNA, 15 nt, Homo sapiens
uguuguguccugaca

SEQ ID NO: 707403 - RNA, 17 nt, Homo sapiens
uuaaaaauaaauucaaa

SEQ ID NO: 707404 - RNA, 20 nt, Homo sapiens
uuaaauagagaaauaugauu

SEQ ID NO: 707405 - RNA, 19 nt, Homo sapiens
uuacgcugcucuccugaca

SEQ ID NO: 707406 - RNA, 15 nt, Homo sapiens
uucaaaggcauuucu

SEQ ID NO: 707407 - RNA, 13 nt, Homo sapiens
uucaaauuauucu

SEQ ID NO: 707408 - RNA, 15 nt, Homo sapiens
uuccaauaaagcagc

SEQ ID NO: 707409 - RNA, 21 nt, Homo sapiens
uuccuauguuucacugugcaa

SEQ ID NO: 707410 - RNA, 20 nt, Homo sapiens
uucuaauggccuuccauaau

SEQ ID NO: 707411 - RNA, 18 nt, Homo sapiens
uucucaccugucaucuca

SEQ ID NO: 707412 - RNA, 15 nt, Homo sapiens
uugcagaugugccua

SEQ ID NO: 707413 - RNA, 16 nt, Homo sapiens
uugcauugacugucac

SEQ ID NO: 707414 - RNA, 17 nt, Homo sapiens
uuuaaaaauaaauucaa

SEQ ID NO: 707415 - RNA, 16 nt, Homo sapiens
uuucacugugcaaaua

SEQ ID NO: 707416 - RNA, 15 nt, Homo sapiens
uuuuagagacagggu

SEQ ID NO: 707417 - RNA, 21 nt, Homo sapiens
uuuucaaaggccucaccuuca

SEQ ID NO: 707418 - RNA, 21 nt, Homo sapiens
uuuucuuuuuugagacagggu

SEQ ID NO: 707419 - RNA, 22 nt, Homo sapiens
uuuucuuuuuugagacaggguc

SEQ ID NO: 707420 - RNA, 14 nt, Homo sapiens
caaucacaagaaga

SEQ ID NO: 707421 - RNA, 19 nt, Homo sapiens
cacacaugacgcaccaguu

SEQ ID NO: 707422 - RNA, 20 nt, Homo sapiens
ggcucaagugaucuucccac

SEQ ID NO: 707423 - RNA, 16 nt, Homo sapiens
ggcugcugcugugcag

SEQ ID NO: 707424 - RNA, 16 nt, Homo sapiens
gggaggcagaaaggga

SEQ ID NO: 707425 - RNA, 11 nt, Homo sapiens
ggggcauuauc

SEQ ID NO: 707426 - RNA, 21 nt, Homo sapiens
guacacagaggcgggucuaua

SEQ ID NO: 707427 - RNA, 15 nt, Homo sapiens
guccucucaucccag

SEQ ID NO: 707428 - RNA, 22 nt, Homo sapiens
gucuuucaagugaaaccagcuu

SEQ ID NO: 707429 - RNA, 22 nt, Homo sapiens
guucuaaauaaaaagcauuauu

SEQ ID NO: 707430 - RNA, 22 nt, Homo sapiens
guugaguuauuaauauguuauu

SEQ ID NO: 707431 - RNA, 14 nt, Homo sapiens
uaaaaagcauuauu

SEQ ID NO: 707432 - RNA, 22 nt, Homo sapiens
uaaaaagcauuauuauuugcug

SEQ ID NO: 707433 - RNA, 16 nt, Homo sapiens
uaaaaauaaauucaaa

SEQ ID NO: 707434 - RNA, 22 nt, Homo sapiens
uaaauuugucuuucaagugaaa

SEQ ID NO: 707435 - RNA, 20 nt, Homo sapiens
uaacuaaauuugucuuucaa

SEQ ID NO: 707436 - RNA, 13 nt, Homo sapiens
uaaggauagggaa

SEQ ID NO: 707437 - RNA, 20 nt, Homo sapiens
uaaugccuuuucucaccugu

SEQ ID NO: 707438 - RNA, 16 nt, Homo sapiens
uaauggccuuccauaa

SEQ ID NO: 707439 - RNA, 15 nt, Homo sapiens
uagagaaauaugauu

SEQ ID NO: 707440 - RNA, 16 nt, Homo sapiens
uaggguccauaugagg

SEQ ID NO: 707441 - RNA, 21 nt, Homo sapiens
uauauuuuaaaaauaaauuca

SEQ ID NO: 707442 - RNA, 23 nt, Homo sapiens
uauauuuuaaaaauaaauucaaa

SEQ ID NO: 707443 - RNA, 21 nt, Homo sapiens
uaugcuuucacuucccaccuc

SEQ ID NO: 707444 - RNA, 20 nt, Homo sapiens
uauugcucaggcuggucuug

SEQ ID NO: 707445 - RNA, 19 nt, Homo sapiens
ucaagcaauccuccugccu

SEQ ID NO: 707446 - RNA, 16 nt, Homo sapiens
ucaagugaaaccagcu

SEQ ID NO: 707447 - RNA, 13 nt, Homo sapiens
ucauacuuaucua

SEQ ID NO: 707448 - RNA, 14 nt, Homo sapiens
ucauagcucacugc

SEQ ID NO: 707449 - RNA, 15 nt, Homo sapiens
ucauagcucacugca

SEQ ID NO: 707450 - RNA, 14 nt, Homo sapiens
uccauacucuguaa

SEQ ID NO: 707451 - RNA, 22 nt, Homo sapiens
uccauaugagggaaaacccaau

SEQ ID NO: 707452 - RNA, 18 nt, Homo sapiens
uccaucuuucacuaucug

SEQ ID NO: 707453 - RNA, 19 nt, Homo sapiens
uccccucuggagggcuaug

SEQ ID NO: 707454 - RNA, 14 nt, Homo sapiens
uccugacaccucca

SEQ ID NO: 707455 - RNA, 18 nt, Homo sapiens
ucgccagcccugggccug

SEQ ID NO: 707456 - RNA, 17 nt, Homo sapiens
ucucaccugucaucuca

SEQ ID NO: 707457 - RNA, 13 nt, Homo sapiens
ucucaucccaguc

SEQ ID NO: 707458 - RNA, 14 nt, Homo sapiens
ucuggggcauuauc

SEQ ID NO: 707459 - RNA, 21 nt, Homo sapiens
ucugguuccuccagccaccuc

SEQ ID NO: 707460 - RNA, 19 nt, Homo sapiens
ucuguguuguguccugaca

SEQ ID NO: 707461 - RNA, 22 nt, Homo sapiens
ucuuaacuaaauuugucuuuca

SEQ ID NO: 707462 - RNA, 19 nt, Homo sapiens
ugaacauucgaccuccauu

SEQ ID NO: 707463 - RNA, 13 nt, Homo sapiens
ugaagaccagcug

SEQ ID NO: 707464 - RNA, 11 nt, Homo sapiens
ugacagccaca

SEQ ID NO: 707465 - RNA, 11 nt, Homo sapiens
ugagacagggu

SEQ ID NO: 707466 - RNA, 20 nt, Homo sapiens
ugaugucagaauagcuucca

SEQ ID NO: 707467 - RNA, 15 nt, Homo sapiens
ugccuggucccaaga

SEQ ID NO: 707468 - RNA, 20 nt, Homo sapiens
ugcucauacuuaucuaaugu

SEQ ID NO: 707469 - RNA, 13 nt, Homo sapiens
ugcugcugugcag

SEQ ID NO: 707470 - RNA, 19 nt, Homo sapiens
ugcuuucacuucccaccuc

SEQ ID NO: 707471 - RNA, 17 nt, Homo sapiens
uggggcauuauccaucu

SEQ ID NO: 707472 - RNA, 13 nt, Homo sapiens
uggucccaagaca

SEQ ID NO: 707473 - RNA, 18 nt, Homo sapiens
uggucccaagacagugag

SEQ ID NO: 707474 - RNA, 15 nt, Homo sapiens
uuacgcugcucuccu

SEQ ID NO: 707475 - RNA, 16 nt, Homo sapiens
uuagauguguauacag

SEQ ID NO: 707476 - RNA, 20 nt, Homo sapiens
uucuagggccgucaggacac

SEQ ID NO: 707477 - RNA, 14 nt, Homo sapiens
uucucaccgauauu

SEQ ID NO: 707478 - RNA, 18 nt, Homo sapiens
uucugcauguucuaaaua

SEQ ID NO: 707479 - RNA, 21 nt, Homo sapiens
uugagucuguguuguguccug

SEQ ID NO: 707480 - RNA, 22 nt, Homo sapiens
uuguuguuuuuagagacagggu

SEQ ID NO: 707481 - RNA, 19 nt, Homo sapiens
uuuaaaaauaaauucaaau

SEQ ID NO: 707482 - RNA, 16 nt, Homo sapiens
uuuaauaauguaccua

SEQ ID NO: 707483 - RNA, 20 nt, Homo sapiens
uuucuuuuuugagacagggu

SEQ ID NO: 707484 - RNA, 23 nt, Homo sapiens
aaacuaggguccauaugagggaa

SEQ ID NO: 707485 - RNA, 12 nt, Homo sapiens
aaagcauuauua

SEQ ID NO: 707486 - RNA, 17 nt, Homo sapiens
aaauaaaaagcauuauu

SEQ ID NO: 707487 - RNA, 15 nt, Homo sapiens
aaaugccaguuuugu

SEQ ID NO: 707488 - RNA, 19 nt, Homo sapiens
aaauucaaauuauucuacc

SEQ ID NO: 707489 - RNA, 15 nt, Homo sapiens
aaauuugucuuucaa

SEQ ID NO: 707490 - RNA, 22 nt, Homo sapiens
aacaguugcauugacugucaca

SEQ ID NO: 707491 - RNA, 22 nt, Homo sapiens
aagugacacuuugaacuccuca

SEQ ID NO: 707492 - RNA, 22 nt, Homo sapiens
aauaugugggaauuagugagac

SEQ ID NO: 707493 - RNA, 11 nt, Homo sapiens
aaucacaagaa

SEQ ID NO: 707494 - RNA, 15 nt, Homo sapiens
aaugucaaguggcag

SEQ ID NO: 707495 - RNA, 15 nt, Homo sapiens
aauuugucuuucaag

SEQ ID NO: 707496 - RNA, 22 nt, Homo sapiens
acaguugcauugacugucacau

SEQ ID NO: 707497 - RNA, 20 nt, Homo sapiens
acaugacgcaccaguuacag

SEQ ID NO: 707498 - RNA, 16 nt, Homo sapiens
accagcuguguuucuu

SEQ ID NO: 707499 - RNA, 12 nt, Homo sapiens
acugcacccuca

SEQ ID NO: 707500 - RNA, 13 nt, Homo sapiens
acuggagugcagu

SEQ ID NO: 707501 - RNA, 18 nt, Homo sapiens
acugucacauaaugcuca

SEQ ID NO: 707502 - RNA, 19 nt, Homo sapiens
acugucacauaaugcucau

SEQ ID NO: 707503 - RNA, 19 nt, Homo sapiens
acuucccaccucucuaccu

SEQ ID NO: 707504 - RNA, 22 nt, Homo sapiens
agagcagauggccuggcugcug

SEQ ID NO: 707505 - RNA, 11 nt, Homo sapiens
agagcccucca

SEQ ID NO: 707506 - RNA, 12 nt, Homo sapiens
agcaauccuccu

SEQ ID NO: 707507 - RNA, 13 nt, Homo sapiens
agccaccucaguc

SEQ ID NO: 707508 - RNA, 14 nt, Homo sapiens
agccucauucugag

SEQ ID NO: 707509 - RNA, 20 nt, Homo sapiens
agggaaaggguggaugcucu

SEQ ID NO: 707510 - RNA, 18 nt, Homo sapiens
agggacagcugcauucca

SEQ ID NO: 707511 - RNA, 23 nt, Homo sapiens
agggcuauggccucccuaugcuu

SEQ ID NO: 707512 - RNA, 23 nt, Homo sapiens
agggcuguugauuuaugcuuuaa

SEQ ID NO: 707513 - RNA, 16 nt, Homo sapiens
agggucucacuauauu

SEQ ID NO: 707514 - RNA, 17 nt, Homo sapiens
agucuggaaagugaugu

SEQ ID NO: 707515 - RNA, 19 nt, Homo sapiens
agucuggaaagugauguca

SEQ ID NO: 707516 - RNA, 14 nt, Homo sapiens
agugaucuucccac

SEQ ID NO: 707517 - RNA, 15 nt, Homo sapiens
aguggcagcucagcc

SEQ ID NO: 707518 - RNA, 23 nt, Homo sapiens
aguuuccuauguuucacugugca

SEQ ID NO: 707519 - RNA, 20 nt, Homo sapiens
auagcucacugcacccucaa

SEQ ID NO: 707520 - RNA, 11 nt, Homo sapiens
auagcuuccaa

SEQ ID NO: 707521 - RNA, 16 nt, Homo sapiens
auaucugcuauucucc

SEQ ID NO: 707522 - RNA, 16 nt, Homo sapiens
augcaagaaucucaga

SEQ ID NO: 707523 - RNA, 23 nt, Homo sapiens
augccuggucccaagacagugag

SEQ ID NO: 707524 - RNA, 12 nt, Homo sapiens
augcucucaggc

SEQ ID NO: 707525 - RNA, 21 nt, Homo sapiens
auguucuaaauaaaaagcauu

SEQ ID NO: 707526 - RNA, 20 nt, Homo sapiens
auguugaguuauuaauaugu

SEQ ID NO: 707527 - RNA, 16 nt, Homo sapiens
auguuucacugugcaa

SEQ ID NO: 707528 - RNA, 13 nt, Homo sapiens
auuugucuuucaa

SEQ ID NO: 707529 - RNA, 19 nt, Homo sapiens
auuuuaaaaauaaauucaa

SEQ ID NO: 707530 - RNA, 23 nt, Homo sapiens
auuuuaaaaauaaauucaaauua

SEQ ID NO: 707531 - RNA, 14 nt, Homo sapiens
auuuucccuucccu

SEQ ID NO: 707532 - RNA, 18 nt, Homo sapiens
caaauauaucugcuauuc

SEQ ID NO: 707533 - RNA, 16 nt, Homo sapiens
caagugaaaccagcuu

SEQ ID NO: 707534 - RNA, 21 nt, Homo sapiens
cacagaggcgggucuauaaca

SEQ ID NO: 707535 - RNA, 17 nt, Homo sapiens
cacaugacgcaccaguu

SEQ ID NO: 707536 - RNA, 17 nt, Homo sapiens
caccacuccacuccucc

SEQ ID NO: 707537 - RNA, 15 nt, Homo sapiens
cacccacaaucacaa

SEQ ID NO: 707538 - RNA, 18 nt, Homo sapiens
cacccagacuggagugca

SEQ ID NO: 707539 - RNA, 14 nt, Homo sapiens
cacuaucuguaaug

SEQ ID NO: 707540 - RNA, 16 nt, Homo sapiens
cagacuggagugcagu

SEQ ID NO: 707541 - RNA, 17 nt, Homo sapiens
cagacuggagugcagug

SEQ ID NO: 707542 - RNA, 18 nt, Homo sapiens
cagagaacugucuuucau

SEQ ID NO: 707543 - RNA, 17 nt, Homo sapiens
cagauacagcacaucca

SEQ ID NO: 707544 - RNA, 21 nt, Homo sapiens
cagccaccacccacaaucaca

SEQ ID NO: 707545 - RNA, 21 nt, Homo sapiens
cagggucucacuauauugcuc

SEQ ID NO: 707546 - RNA, 16 nt, Homo sapiens
cauuauccaucuuuca

SEQ ID NO: 707547 - RNA, 19 nt, Homo sapiens
cauuauccaucuuucacua

SEQ ID NO: 707548 - RNA, 13 nt, Homo sapiens
cauugacugucac

SEQ ID NO: 707549 - RNA, 16 nt, Homo sapiens
cauuuucaauccagga

SEQ ID NO: 707550 - RNA, 22 nt, Homo sapiens
ccaaugucaaguggcagcucag

SEQ ID NO: 707551 - RNA, 15 nt, Homo sapiens
ccacccacaaucaca

SEQ ID NO: 707552 - RNA, 14 nt, Homo sapiens
ccaggagccuugag

SEQ ID NO: 707553 - RNA, 18 nt, Homo sapiens
cccagacuggagugcagu

SEQ ID NO: 707554 - RNA, 19 nt, Homo sapiens
cccagacuggagugcagug

SEQ ID NO: 707555 - RNA, 19 nt, Homo sapiens
cccagauacagcacaucca

SEQ ID NO: 707556 - RNA, 18 nt, Homo sapiens
cccgagcccucacacccu

SEQ ID NO: 707557 - RNA, 19 nt, Homo sapiens
cccucggugcagagugcag

SEQ ID NO: 707558 - RNA, 17 nt, Homo sapiens
ccuaugcuuucacuucc

SEQ ID NO: 707559 - RNA, 15 nt, Homo sapiens
ccuauguuucacugu

SEQ ID NO: 707560 - RNA, 15 nt, Homo sapiens
ccucuggggcauuau

SEQ ID NO: 707561 - RNA, 12 nt, Homo sapiens
ccugagugaucc

SEQ ID NO: 707562 - RNA, 16 nt, Homo sapiens
ccugucaucucacauu

SEQ ID NO: 707563 - RNA, 23 nt, Homo sapiens
ccuugagucuguguuguguccug

SEQ ID NO: 707564 - RNA, 22 nt, Homo sapiens
cgacccucggugcagagugcag

SEQ ID NO: 707565 - RNA, 16 nt, Homo sapiens
cuaaguuccuucccag

SEQ ID NO: 707566 - RNA, 22 nt, Homo sapiens
cuagugaacauucgaccuccau

SEQ ID NO: 707567 - RNA, 15 nt, Homo sapiens
cuauggccucccuau

SEQ ID NO: 707568 - RNA, 19 nt, Homo sapiens
cucaccugucaucucacau

SEQ ID NO: 707569 - RNA, 15 nt, Homo sapiens
cucccuaugcuuuca

SEQ ID NO: 707570 - RNA, 13 nt, Homo sapiens
cuccugggcucaa

SEQ ID NO: 707571 - RNA, 15 nt, Homo sapiens
cucuggggcauuauc

SEQ ID NO: 707572 - RNA, 21 nt, Homo sapiens
cucuuuccucuggggcauuau

SEQ ID NO: 707573 - RNA, 14 nt, Homo sapiens
cugaagaccagcug

SEQ ID NO: 707574 - RNA, 13 nt, Homo sapiens
cuggaaagugaug

SEQ ID NO: 707575 - RNA, 21 nt, Homo sapiens
cuggaacuacaagugugagcc

SEQ ID NO: 707576 - RNA, 21 nt, Homo sapiens
cuggagugcaguggugugauc

SEQ ID NO: 707577 - RNA, 19 nt, Homo sapiens
cuggcugcugcugugcagu

SEQ ID NO: 707578 - RNA, 23 nt, Homo sapiens
cuggggcauuauccaucuuucac

SEQ ID NO: 707579 - RNA, 16 nt, Homo sapiens
cugugcaggagccagu

SEQ ID NO: 707580 - RNA, 18 nt, Homo sapiens
cuguguuguguccugaca

SEQ ID NO: 707581 - RNA, 22 nt, Homo sapiens
cuuaacuaaauuugucuuucaa

SEQ ID NO: 707582 - RNA, 14 nt, Homo sapiens
cuucccaccucucu

SEQ ID NO: 707583 - RNA, 13 nt, Homo sapiens
cuuucacuaucug

SEQ ID NO: 707584 - RNA, 21 nt, Homo sapiens
cuuuucucaccugucaucuca

SEQ ID NO: 707585 - RNA, 16 nt, Homo sapiens
cuuuucugcauguucu

SEQ ID NO: 707586 - RNA, 22 nt, Homo sapiens
gaacuacaagugugagccaccg

SEQ ID NO: 707587 - RNA, 15 nt, Homo sapiens
gaacuccucaagggc

SEQ ID NO: 707588 - RNA, 22 nt, Homo sapiens
gacagaguguccuuccucuguc

SEQ ID NO: 707589 - RNA, 21 nt, Homo sapiens
gacaucagggaguaagugaca

SEQ ID NO: 707590 - RNA, 21 nt, Homo sapiens
gaccacaggugcacgccacca

SEQ ID NO: 707591 - RNA, 16 nt, Homo sapiens
gacugaagaccagcug

SEQ ID NO: 707592 - RNA, 15 nt, Homo sapiens
gagaacugucuuuca

SEQ ID NO: 707593 - RNA, 23 nt, Homo sapiens
gaggcagaaagggaaaguauuag

SEQ ID NO: 707594 - RNA, 12 nt, Homo sapiens
gaucauagcuca

SEQ ID NO: 707595 - RNA, 17 nt, Homo sapiens
gcaauccuccugccuca

SEQ ID NO: 707596 - RNA, 17 nt, Homo sapiens
gcagaggcuccacaggc

SEQ ID NO: 707597 - RNA, 21 nt, Homo sapiens
gccaccacccacaaucacaag

SEQ ID NO: 707598 - RNA, 22 nt, Homo sapiens
gccuggcccaagcccuccacau

SEQ ID NO: 707599 - RNA, 20 nt, Homo sapiens
aaaaauaaauucaaauuauu

SEQ ID NO: 707600 - RNA, 13 nt, Homo sapiens
aaaauaaauucaa

SEQ ID NO: 707601 - RNA, 13 nt, Homo sapiens
aaagccucaucca

SEQ ID NO: 707602 - RNA, 14 nt, Homo sapiens
aaauauaucugcua

SEQ ID NO: 707603 - RNA, 14 nt, Homo sapiens
aaauaugauuugug

SEQ ID NO: 707604 - RNA, 17 nt, Homo sapiens
aaauucaaauuauucua

SEQ ID NO: 707605 - RNA, 10 nt, Homo sapiens
aagcccucca

SEQ ID NO: 707606 - RNA, 21 nt, Homo sapiens
aaggcauuucuuuucugcaug

SEQ ID NO: 707607 - RNA, 22 nt, Homo sapiens
aagggcagagaacugucuuuca

SEQ ID NO: 707608 - RNA, 14 nt, Homo sapiens
aaguuccuucccag

SEQ ID NO: 707609 - RNA, 21 nt, Homo sapiens
aauauuuuacuuuuacaguca

SEQ ID NO: 707610 - RNA, 14 nt, Homo sapiens
aauuugucuuucaa

SEQ ID NO: 707611 - RNA, 21 nt, Homo sapiens
acacacaugacgcaccaguua

SEQ ID NO: 707612 - RNA, 15 nt, Homo sapiens
acauucgaccuccau

SEQ ID NO: 707613 - RNA, 12 nt, Homo sapiens
accacuccacuc

SEQ ID NO: 707614 - RNA, 23 nt, Homo sapiens
acgcugcucuccugacagccaca

SEQ ID NO: 707615 - RNA, 22 nt, Homo sapiens
acuccuccagccaccacccaca

SEQ ID NO: 707616 - RNA, 18 nt, Homo sapiens
acuccugggcucaaguga

SEQ ID NO: 707617 - RNA, 14 nt, Homo sapiens
acugaagaccagcu

SEQ ID NO: 707618 - RNA, 12 nt, Homo sapiens
acugucacauaa

SEQ ID NO: 707619 - RNA, 22 nt, Homo sapiens
acugucacauaaugcucauacu

SEQ ID NO: 707620 - RNA, 15 nt, Homo sapiens
acuucccaccucucu

SEQ ID NO: 707621 - RNA, 11 nt, Homo sapiens
agagacagggu

SEQ ID NO: 707622 - RNA, 13 nt, Homo sapiens
agccaccacucag

SEQ ID NO: 707623 - RNA, 14 nt, Homo sapiens
agcuuuccaguuag

SEQ ID NO: 707624 - RNA, 15 nt, Homo sapiens
aggccucaccuucaa

SEQ ID NO: 707625 - RNA, 22 nt, Homo sapiens
agggaguaagugacacuuugaa

SEQ ID NO: 707626 - RNA, 15 nt, Homo sapiens
agggcagagaacugu

SEQ ID NO: 707627 - RNA, 21 nt, Homo sapiens
agucuguguuguguccugaca

SEQ ID NO: 707628 - RNA, 14 nt, Homo sapiens
agugaaaccagcuu

SEQ ID NO: 707629 - RNA, 16 nt, Homo sapiens
agugaguguaggggug

SEQ ID NO: 707630 - RNA, 18 nt, Homo sapiens
aguguccuuccucugucc

SEQ ID NO: 707631 - RNA, 17 nt, Homo sapiens
aguugcauugacuguca

SEQ ID NO: 707632 - RNA, 21 nt, Homo sapiens
auauuuuaaaaauaaauucaa

SEQ ID NO: 707633 - RNA, 23 nt, Homo sapiens
aucauagcucacugcacccucaa

SEQ ID NO: 707634 - RNA, 16 nt, Homo sapiens
aucuuucacuaucugu

SEQ ID NO: 707635 - RNA, 18 nt, Homo sapiens
augagcacaaacuucugu

SEQ ID NO: 707636 - RNA, 20 nt, Homo sapiens
augccuuuucucaccuguca

SEQ ID NO: 707637 - RNA, 13 nt, Homo sapiens
auguuauuauuaa

SEQ ID NO: 707638 - RNA, 14 nt, Homo sapiens
auguugaguuauua

SEQ ID NO: 707639 - RNA, 12 nt, Homo sapiens
auguuucacugu

SEQ ID NO: 707640 - RNA, 15 nt, Homo sapiens
auuucuuuucugcau

SEQ ID NO: 707641 - RNA, 14 nt, Homo sapiens
auuuguguauuaua

SEQ ID NO: 707642 - RNA, 16 nt, Homo sapiens
auuuucccuucccuga

SEQ ID NO: 707643 - RNA, 14 nt, Homo sapiens
caaauauaucugcu

SEQ ID NO: 707644 - RNA, 22 nt, Homo sapiens
caauaaagcagccucauucuga

SEQ ID NO: 707645 - RNA, 13 nt, Homo sapiens
caaucacaagaag

SEQ ID NO: 707646 - RNA, 11 nt, Homo sapiens
caccacuccac

SEQ ID NO: 707647 - RNA, 11 nt, Homo sapiens
cacugugcaaa

SEQ ID NO: 707648 - RNA, 21 nt, Homo sapiens
cagaaggacugaagaccagcu

SEQ ID NO: 707649 - RNA, 20 nt, Homo sapiens
cagaauagcuuccaauaaag

SEQ ID NO: 707650 - RNA, 20 nt, Homo sapiens
cagauggccuggcugcugcu

SEQ ID NO: 707651 - RNA, 18 nt, Homo sapiens
cagggucuugcucuguca

SEQ ID NO: 707652 - RNA, 18 nt, Homo sapiens
caggucccgagcccucac

SEQ ID NO: 707653 - RNA, 21 nt, Homo sapiens
cauaaugcucauacuuaucua

SEQ ID NO: 707654 - RNA, 20 nt, Homo sapiens
cauagcucacugcacccuca

SEQ ID NO: 707655 - RNA, 20 nt, Homo sapiens
caucggaauccaagcuaauu

SEQ ID NO: 707656 - RNA, 13 nt, Homo sapiens
caucuuucacuau

SEQ ID NO: 707657 - RNA, 13 nt, Homo sapiens
ccaagacagugag

SEQ ID NO: 707658 - RNA, 19 nt, Homo sapiens
ccagauacagcacauccac

SEQ ID NO: 707659 - RNA, 19 nt, Homo sapiens
ccagcuguguuucuuaacu

SEQ ID NO: 707660 - RNA, 13 nt, Homo sapiens
ccauaugagggaa

SEQ ID NO: 707661 - RNA, 13 nt, Homo sapiens
ccauuguuuuuca

SEQ ID NO: 707662 - RNA, 19 nt, Homo sapiens
ccucggugcagagugcaga

SEQ ID NO: 707663 - RNA, 12 nt, Homo sapiens
ccucucauccca

SEQ ID NO: 707664 - RNA, 16 nt, Homo sapiens
ccuggucccaagacag

SEQ ID NO: 707665 - RNA, 16 nt, Homo sapiens
cuauucuccauacucu

SEQ ID NO: 707666 - RNA, 17 nt, Homo sapiens
cucauucugaggccuga

SEQ ID NO: 707667 - RNA, 23 nt, Homo sapiens
cuccagccaccacccacaaucac

SEQ ID NO: 707668 - RNA, 14 nt, Homo sapiens
cuccugacagccac

SEQ ID NO: 707669 - RNA, 19 nt, Homo sapiens
cuccugggcucaagugauc

SEQ ID NO: 707670 - RNA, 19 nt, Homo sapiens
cuccuggguucaagcaauc

SEQ ID NO: 707671 - RNA, 17 nt, Homo sapiens
cugccucccaugccugg

SEQ ID NO: 707672 - RNA, 17 nt, Homo sapiens
cuggaacuacaagugug

SEQ ID NO: 707673 - RNA, 20 nt, Homo sapiens
cuggagugcaguggugugau

SEQ ID NO: 707674 - RNA, 23 nt, Homo sapiens
cuggucccaagacagugagacag

SEQ ID NO: 707675 - RNA, 18 nt, Homo sapiens
cugucacauaaugcucau

SEQ ID NO: 707676 - RNA, 17 nt, Homo sapiens
cuguccucucaucccag

SEQ ID NO: 707677 - RNA, 20 nt, Homo sapiens
cuuacgcugcucuccugaca

SEQ ID NO: 707678 - RNA, 21 nt, Homo sapiens
cuucccacgugggccucccaa

SEQ ID NO: 707679 - RNA, 15 nt, Homo sapiens
cuugagcuagaccaa

SEQ ID NO: 707680 - RNA, 20 nt, Homo sapiens
cuugagucuguguugugucc

SEQ ID NO: 707681 - RNA, 13 nt, Homo sapiens
cuuucacuuccca

SEQ ID NO: 707682 - RNA, 23 nt, Homo sapiens
cuuuugcuacaguauauuuuaaa

SEQ ID NO: 707683 - RNA, 23 nt, Homo sapiens
cuuuuucuuuuuugagacagggu

SEQ ID NO: 707684 - RNA, 13 nt, Homo sapiens
gaacugucuuuca

SEQ ID NO: 707685 - RNA, 13 nt, Homo sapiens
gaauagcuuccaa

SEQ ID NO: 707686 - RNA, 14 nt, Homo sapiens
gacgcaccaguuac

SEQ ID NO: 707687 - RNA, 16 nt, Homo sapiens
gagaacugucuuucau

SEQ ID NO: 707688 - RNA, 15 nt, Homo sapiens
gagcuuuccaguuag

SEQ ID NO: 707689 - RNA, 21 nt, Homo sapiens
gaggcgggucuauaacaggca

SEQ ID NO: 707690 - RNA, 21 nt, Homo sapiens
gccagaauggcuguccuuguc

SEQ ID NO: 707691 - RNA, 15 nt, Homo sapiens
uauucuccauacucu

SEQ ID NO: 707692 - RNA, 17 nt, Homo sapiens
ucacauaaugcucauac

SEQ ID NO: 707693 - RNA, 23 nt, Homo sapiens
ucacauaaugcucauacuuaucu

SEQ ID NO: 707694 - RNA, 15 nt, Homo sapiens
ucaccuucaacuguc

SEQ ID NO: 707695 - RNA, 17 nt, Homo sapiens
ucacuaucuguaaugcc

SEQ ID NO: 707696 - RNA, 20 nt, Homo sapiens
ucagugcuucucugugcagg

SEQ ID NO: 707697 - RNA, 16 nt, Homo sapiens
ucaucucacauuuucc

SEQ ID NO: 707698 - RNA, 17 nt, Homo sapiens
ucaucucacauuuuccc

SEQ ID NO: 707699 - RNA, 22 nt, Homo sapiens
uccagccaccacccacaaucac

SEQ ID NO: 707700 - RNA, 13 nt, Homo sapiens
uccagccaccuca

SEQ ID NO: 707701 - RNA, 14 nt, Homo sapiens
uccagccaccucag

SEQ ID NO: 707702 - RNA, 18 nt, Homo sapiens
ucccaugccuggucccaa

SEQ ID NO: 707703 - RNA, 15 nt, Homo sapiens
uccuauguuucacug

SEQ ID NO: 707704 - RNA, 20 nt, Homo sapiens
uccucucaucccaguccuga

SEQ ID NO: 707705 - RNA, 19 nt, Homo sapiens
ucuaaauaaaaagcauuau

SEQ ID NO: 707706 - RNA, 21 nt, Homo sapiens
ucucuucuggcuuucugagca

SEQ ID NO: 707707 - RNA, 21 nt, Homo sapiens
ucugaggccugagugauccac

SEQ ID NO: 707708 - RNA, 14 nt, Homo sapiens
ucugucacccagac

SEQ ID NO: 707709 - RNA, 16 nt, Homo sapiens
ucuguguuguguccug

SEQ ID NO: 707710 - RNA, 22 nt, Homo sapiens
ucuuugggaggugauguuccca

SEQ ID NO: 707711 - RNA, 12 nt, Homo sapiens
ucuuuucugcau

SEQ ID NO: 707712 - RNA, 18 nt, Homo sapiens
ugacugucacauaaugcu

SEQ ID NO: 707713 - RNA, 20 nt, Homo sapiens
ugagucuguguuguguccug

SEQ ID NO: 707714 - RNA, 21 nt, Homo sapiens
ugagucuguguuguguccuga

SEQ ID NO: 707715 - RNA, 19 nt, Homo sapiens
ugcaaauauaucugcuauu

SEQ ID NO: 707716 - RNA, 22 nt, Homo sapiens
ugcaaauauaucugcuauucuc

SEQ ID NO: 707717 - RNA, 17 nt, Homo sapiens
ugcacccucaaccuccu

SEQ ID NO: 707718 - RNA, 13 nt, Homo sapiens
ugcagagugcaga

SEQ ID NO: 707719 - RNA, 19 nt, Homo sapiens
ugcagcucucuuuccucug

SEQ ID NO: 707720 - RNA, 15 nt, Homo sapiens
ugccccagcucucuu

SEQ ID NO: 707721 - RNA, 23 nt, Homo sapiens
ugcuuucacuucccaccucucua

SEQ ID NO: 707722 - RNA, 18 nt, Homo sapiens
uggaacuacaagugugag

SEQ ID NO: 707723 - RNA, 23 nt, Homo sapiens
uggccuggcugcugcugugcagu

SEQ ID NO: 707724 - RNA, 14 nt, Homo sapiens
uggcugcugcugug

SEQ ID NO: 707725 - RNA, 20 nt, Homo sapiens
ugggaggugauguucccauu

SEQ ID NO: 707726 - RNA, 18 nt, Homo sapiens
uggggacagaguguccuu

SEQ ID NO: 707727 - RNA, 17 nt, Homo sapiens
ugguuccuccagccacc

SEQ ID NO: 707728 - RNA, 20 nt, Homo sapiens
ugguuccuccagccaccuca

SEQ ID NO: 707729 - RNA, 23 nt, Homo sapiens
uguaacaguugcauugacuguca

SEQ ID NO: 707730 - RNA, 24 nt, Homo sapiens
uguaaugccuuuucucaccuguca

SEQ ID NO: 707731 - RNA, 14 nt, Homo sapiens
ugucacauaaugcu

SEQ ID NO: 707732 - RNA, 23 nt, Homo sapiens
ugucacccagacuggagugcagu

SEQ ID NO: 707733 - RNA, 20 nt, Homo sapiens
ugucguagagcccuccacau

SEQ ID NO: 707734 - RNA, 18 nt, Homo sapiens
ugugcaaauauaucugcu

SEQ ID NO: 707735 - RNA, 19 nt, Homo sapiens
uguuuuuagagacaggguc

SEQ ID NO: 707736 - RNA, 16 nt, Homo sapiens
uuaaaaauaaauucaa

SEQ ID NO: 707737 - RNA, 15 nt, Homo sapiens
uuaauauguuauuau

SEQ ID NO: 707738 - RNA, 20 nt, Homo sapiens
uuauccaucuuucacuaucu

SEQ ID NO: 707739 - RNA, 14 nt, Homo sapiens
uucacuaucuguaa

SEQ ID NO: 707740 - RNA, 20 nt, Homo sapiens
uucacugugcaaauauaucu

SEQ ID NO: 707741 - RNA, 20 nt, Homo sapiens
uucagagugaguguaggggu

SEQ ID NO: 707742 - RNA, 19 nt, Homo sapiens
uucccugaagaucuaguga

SEQ ID NO: 707743 - RNA, 16 nt, Homo sapiens
uuccuccagccaccuc

SEQ ID NO: 707744 - RNA, 16 nt, Homo sapiens
uuccuucccagcacau

SEQ ID NO: 707745 - RNA, 19 nt, Homo sapiens
uucuaaauaaaaagcauua

SEQ ID NO: 707746 - RNA, 14 nt, Homo sapiens
uucugagcaggaag

SEQ ID NO: 707747 - RNA, 19 nt, Homo sapiens
uucugaggccugagugauc

SEQ ID NO: 707748 - RNA, 19 nt, Homo sapiens
uugaacccucgguguacac

SEQ ID NO: 707749 - RNA, 17 nt, Homo sapiens
uugaacuccugggcuca

SEQ ID NO: 707750 - RNA, 12 nt, Homo sapiens
uugagacagggu

SEQ ID NO: 707751 - RNA, 15 nt, Homo sapiens
uugcauugacuguca

SEQ ID NO: 707752 - RNA, 19 nt, Homo sapiens
uugggaggugauguuccca

SEQ ID NO: 707753 - RNA, 22 nt, Homo sapiens
uuuccuauguuucacugugcaa

SEQ ID NO: 707754 - RNA, 21 nt, Homo sapiens
uuuccucuggggcauuaucca

SEQ ID NO: 707755 - RNA, 19 nt, Homo sapiens
uuucucaccugucaucuca

SEQ ID NO: 707756 - RNA, 14 nt, Homo sapiens
uuuggggacagagu

SEQ ID NO: 707757 - RNA, 16 nt, Homo sapiens
aaaaaguucagcauga

SEQ ID NO: 707758 - RNA, 14 nt, Homo sapiens
aaaacuucaauauc

SEQ ID NO: 707759 - RNA, 19 nt, Homo sapiens
aaaagagauggccugagaa

SEQ ID NO: 707760 - RNA, 21 nt, Homo sapiens
aaaaggcuugagucuggauaa

SEQ ID NO: 707761 - RNA, 12 nt, Homo sapiens
aaaaucaaacag

SEQ ID NO: 707762 - RNA, 11 nt, Homo sapiens
aaacucaaaau

SEQ ID NO: 707763 - RNA, 16 nt, Homo sapiens
aaagaagcagaccauu

SEQ ID NO: 707764 - RNA, 22 nt, Homo sapiens
aaagccaucaaacacaaugccu

SEQ ID NO: 707765 - RNA, 16 nt, Homo sapiens
aaauaguuaccuucaa

SEQ ID NO: 707766 - RNA, 18 nt, Homo sapiens
aaauauuugacaggcuua

SEQ ID NO: 707767 - RNA, 18 nt, Homo sapiens
aaaugauuaagugcuuga

SEQ ID NO: 707768 - RNA, 22 nt, Homo sapiens
aacagaucacaugccccucuua

SEQ ID NO: 707769 - RNA, 20 nt, Homo sapiens
aaccuacuuucauacugaag

SEQ ID NO: 707770 - RNA, 14 nt, Homo sapiens
aagaaaaugauugc

SEQ ID NO: 707771 - RNA, 16 nt, Homo sapiens
aagaaauuaugucagc

SEQ ID NO: 707772 - RNA, 19 nt, Homo sapiens
aagacauaguugugcaugc

SEQ ID NO: 707773 - RNA, 13 nt, Homo sapiens
aagagagaucaaa

SEQ ID NO: 707774 - RNA, 14 nt, Homo sapiens
aagaugaugcuauu

SEQ ID NO: 707775 - RNA, 24 nt, Homo sapiens
aagcacaaccauguucuugagcag

SEQ ID NO: 707776 - RNA, 17 nt, Homo sapiens
caguagaggguccaguc

SEQ ID NO: 707777 - RNA, 21 nt, Homo sapiens
caguccccagguaucugauga

SEQ ID NO: 707778 - RNA, 22 nt, Homo sapiens
caguucuuuucaaccuacuuuc

SEQ ID NO: 707779 - RNA, 20 nt, Homo sapiens
cauaaaaauaaaaucuguaa

SEQ ID NO: 707780 - RNA, 16 nt, Homo sapiens
caucagucaaugaaua

SEQ ID NO: 707781 - RNA, 18 nt, Homo sapiens
caugagggagaugccaug

SEQ ID NO: 707782 - RNA, 23 nt, Homo sapiens
caugagggagaugccaugagccg

SEQ ID NO: 707783 - RNA, 13 nt, Homo sapiens
caugcucccucau

SEQ ID NO: 707784 - RNA, 17 nt, Homo sapiens
cauggaguagagucagg

SEQ ID NO: 707785 - RNA, 23 nt, Homo sapiens
cauuaaacuaauuaaacugaugg

SEQ ID NO: 707786 - RNA, 15 nt, Homo sapiens
ccaaaaaaaguucag

SEQ ID NO: 707787 - RNA, 15 nt, Homo sapiens
ccaagaguccaagcc

SEQ ID NO: 707788 - RNA, 11 nt, Homo sapiens
ccaagugccaa

SEQ ID NO: 707789 - RNA, 13 nt, Homo sapiens
ccacuacuuagag

SEQ ID NO: 707790 - RNA, 14 nt, Homo sapiens
ccccaccagugccu

SEQ ID NO: 707791 - RNA, 14 nt, Homo sapiens
cccuggcacuggca

SEQ ID NO: 707792 - RNA, 11 nt, Homo sapiens
cccuuccccac

SEQ ID NO: 707793 - RNA, 20 nt, Homo sapiens
ccucauuguucagaaaagca

SEQ ID NO: 707794 - RNA, 23 nt, Homo sapiens
ccugagaagagagaucaaaugga

SEQ ID NO: 707795 - RNA, 20 nt, Homo sapiens
ccuguaggucuaugaugucc

SEQ ID NO: 707796 - RNA, 19 nt, Homo sapiens
ccuguggaugcugcugccc

SEQ ID NO: 707797 - RNA, 19 nt, Homo sapiens
ccuucaaaggccaagagaa

SEQ ID NO: 707798 - RNA, 20 nt, Homo sapiens
ccuuuaauaggcuuguguaa

SEQ ID NO: 707799 - RNA, 22 nt, Homo sapiens
uaguugugcaugccuggcacaa

SEQ ID NO: 707800 - RNA, 17 nt, Homo sapiens
uauaccugggcauacua

SEQ ID NO: 707801 - RNA, 20 nt, Homo sapiens
uauaccugggcauacuaaua

SEQ ID NO: 707802 - RNA, 14 nt, Homo sapiens
uauauauauuuugg

SEQ ID NO: 707803 - RNA, 19 nt, Homo sapiens
uaucaguaguaucaaugau

SEQ ID NO: 707804 - RNA, 20 nt, Homo sapiens
uauuaacagcugauacaggu

SEQ ID NO: 707805 - RNA, 14 nt, Homo sapiens
uauuugcuaugucc

SEQ ID NO: 707806 - RNA, 12 nt, Homo sapiens
ucagucaaugaa

SEQ ID NO: 707807 - RNA, 15 nt, Homo sapiens
ucaguguacucugag

SEQ ID NO: 707808 - RNA, 16 nt, Homo sapiens
ucaugcuucuacucca

SEQ ID NO: 707809 - RNA, 17 nt, Homo sapiens
ucauucccaggcacucu

SEQ ID NO: 707810 - RNA, 14 nt, Homo sapiens
ucauugacugaugg

SEQ ID NO: 707811 - RNA, 18 nt, Homo sapiens
ucauugacugauggugaa

SEQ ID NO: 707812 - RNA, 14 nt, Homo sapiens
ucccuugauucaaa

SEQ ID NO: 707813 - RNA, 19 nt, Homo sapiens
uccugcuccuccaguacaa

SEQ ID NO: 707814 - RNA, 24 nt, Homo sapiens
uccuuccaaccuguucacgugacu

SEQ ID NO: 707815 - RNA, 21 nt, Homo sapiens
ucucaaaauaaaaccagaaag

SEQ ID NO: 707816 - RNA, 14 nt, Homo sapiens
ucucccugcugcuc

SEQ ID NO: 707817 - RNA, 21 nt, Homo sapiens
ucucuucaugcgcagucccca

SEQ ID NO: 707818 - RNA, 14 nt, Homo sapiens
ucugugcaacaaac

SEQ ID NO: 707819 - RNA, 15 nt, Homo sapiens
ucuucaauccccaua

SEQ ID NO: 707820 - RNA, 22 nt, Homo sapiens
ucuugcuugacucuacuauuaa

SEQ ID NO: 707821 - RNA, 17 nt, Homo sapiens
ucuugguuuccaucaaa

SEQ ID NO: 707822 - RNA, 21 nt, Homo sapiens
ucuuuugcucucucauuccca

SEQ ID NO: 707823 - RNA, 19 nt, Homo sapiens
ugaaaacucuaauugucca

SEQ ID NO: 707824 - RNA, 15 nt, Homo sapiens
ugaagaugaugcuau

SEQ ID NO: 707825 - RNA, 16 nt, Homo sapiens
ugaagcaugcucugua

SEQ ID NO: 707826 - RNA, 23 nt, Homo sapiens
ugagcaugcucccucaugcagau

SEQ ID NO: 707827 - RNA, 15 nt, Homo sapiens
ugagggagaugccau

SEQ ID NO: 707828 - RNA, 12 nt, Homo sapiens
ugaugauguucu

SEQ ID NO: 707829 - RNA, 15 nt, Homo sapiens
ugauuauagugacaa

SEQ ID NO: 707830 - RNA, 22 nt, Homo sapiens
ugauuauauaaaauacauaaua

SEQ ID NO: 707831 - RNA, 20 nt, Homo sapiens
ugauucaaauaacccugaau

SEQ ID NO: 707832 - RNA, 21 nt, Homo sapiens
ugauugagagcagccucuuga

SEQ ID NO: 707833 - RNA, 13 nt, Homo sapiens
ugauugugauuau

SEQ ID NO: 707834 - RNA, 17 nt, Homo sapiens
ugcacagcaggcugcca

SEQ ID NO: 707835 - RNA, 13 nt, Homo sapiens
ugcauauuugcua

SEQ ID NO: 707836 - RNA, 11 nt, Homo sapiens
ugccagugccu

SEQ ID NO: 707837 - RNA, 19 nt, Homo sapiens
ugcccagccuggaugccau

SEQ ID NO: 707838 - RNA, 19 nt, Homo sapiens
ugcuugacucuacuauuaa

SEQ ID NO: 707839 - RNA, 12 nt, Homo sapiens
uggaugccaucc

SEQ ID NO: 707840 - RNA, 21 nt, Homo sapiens
uggaugccauccaaguuguau

SEQ ID NO: 707841 - RNA, 14 nt, Homo sapiens
uggggucugugaug

SEQ ID NO: 707842 - RNA, 14 nt, Homo sapiens
uguacaaaauaucc

SEQ ID NO: 707843 - RNA, 20 nt, Homo sapiens
uguaccacuacuuagagaua

SEQ ID NO: 707844 - RNA, 15 nt, Homo sapiens
uguagacucuggaag

SEQ ID NO: 707845 - RNA, 18 nt, Homo sapiens
uguagaugacauggugaa

SEQ ID NO: 707846 - RNA, 19 nt, Homo sapiens
uguaugccaagugaaaaaa

SEQ ID NO: 707847 - RNA, 16 nt, Homo sapiens
uguguacaaaauaucc

SEQ ID NO: 707848 - RNA, 18 nt, Homo sapiens
ugugugaauaccccaaga

SEQ ID NO: 707849 - RNA, 15 nt, Homo sapiens
uuaaaagccaucaaa

SEQ ID NO: 707850 - RNA, 20 nt, Homo sapiens
uuaaaagccaucaaacacaa

SEQ ID NO: 707851 - RNA, 23 nt, Homo sapiens
uuaagcacaaccauguucuugag

SEQ ID NO: 707852 - RNA, 21 nt, Homo sapiens
uuaauaaguauuuauugcaua

SEQ ID NO: 707853 - RNA, 13 nt, Homo sapiens
uuauaaaaucaaa

SEQ ID NO: 707854 - RNA, 19 nt, Homo sapiens
uuauauucccaaaucucaa

SEQ ID NO: 707855 - RNA, 22 nt, Homo sapiens
uuauauucccaaaucucaaaag

SEQ ID NO: 707856 - RNA, 15 nt, Homo sapiens
uucaaccuacuuuca

SEQ ID NO: 707857 - RNA, 14 nt, Homo sapiens
uucaauuuugaaaa

SEQ ID NO: 707858 - RNA, 15 nt, Homo sapiens
uuccugcuccuccag

SEQ ID NO: 707859 - RNA, 18 nt, Homo sapiens
uuccuuugaagaggaaaa

SEQ ID NO: 707860 - RNA, 14 nt, Homo sapiens
uucuugcaugguuu

SEQ ID NO: 707861 - RNA, 22 nt, Homo sapiens
uugaauggcaugcuaguagcag

SEQ ID NO: 707862 - RNA, 23 nt, Homo sapiens
aaaaaguucagcaugaaggaugc

SEQ ID NO: 707863 - RNA, 14 nt, Homo sapiens
aaaagcaccucuug

SEQ ID NO: 707864 - RNA, 17 nt, Homo sapiens
aaauaaucauacacaga

SEQ ID NO: 707865 - RNA, 15 nt, Homo sapiens
aaauaguuaccuuca

SEQ ID NO: 707866 - RNA, 16 nt, Homo sapiens
aaaugaguucccuuga

SEQ ID NO: 707867 - RNA, 23 nt, Homo sapiens
aacacaaugccucaucuucccug

SEQ ID NO: 707868 - RNA, 14 nt, Homo sapiens
aacauuuucuugaa

SEQ ID NO: 707869 - RNA, 20 nt, Homo sapiens
aaccaauuuguucugugcaa

SEQ ID NO: 707870 - RNA, 19 nt, Homo sapiens
aaccuacuuucauacugaa

SEQ ID NO: 707871 - RNA, 19 nt, Homo sapiens
aacugauggguaucaugcu

SEQ ID NO: 707872 - RNA, 19 nt, Homo sapiens
aagaaauuaugucagcuua

SEQ ID NO: 707873 - RNA, 22 nt, Homo sapiens
aagcccagccuaucucucuucu

SEQ ID NO: 707874 - RNA, 18 nt, Homo sapiens
aaggaagucagacuuuuu

SEQ ID NO: 707875 - RNA, 17 nt, Homo sapiens
aaguucagcaugaagga

SEQ ID NO: 707876 - RNA, 13 nt, Homo sapiens
aauaaaaugauua

SEQ ID NO: 707877 - RNA, 15 nt, Homo sapiens
aauaacagccucauu

SEQ ID NO: 707878 - RNA, 18 nt, Homo sapiens
aauaaguauuuauugcau

SEQ ID NO: 707879 - RNA, 18 nt, Homo sapiens
aauauuugacaggcuuau

SEQ ID NO: 707880 - RNA, 15 nt, Homo sapiens
aaucuaugccacuca

SEQ ID NO: 707881 - RNA, 17 nt, Homo sapiens
aaucuccuucuuuccug

SEQ ID NO: 707882 - RNA, 21 nt, Homo sapiens
aaucuccuucuuuccuggacu

SEQ ID NO: 707883 - RNA, 18 nt, Homo sapiens
aaugaccaguaauuguga

SEQ ID NO: 707884 - RNA, 21 nt, Homo sapiens
aaugauuauauaaaauacaua

SEQ ID NO: 707885 - RNA, 16 nt, Homo sapiens
aauuugcuuagccuuu

SEQ ID NO: 707886 - RNA, 21 nt, Homo sapiens
acaaaucuaugccacucagaa

SEQ ID NO: 707887 - RNA, 14 nt, Homo sapiens
acaaccauguucuu

SEQ ID NO: 707888 - RNA, 18 nt, Homo sapiens
acaauaggcuuagugcuu

SEQ ID NO: 707889 - RNA, 18 nt, Homo sapiens
acaaugacuaaagacaua

SEQ ID NO: 707890 - RNA, 13 nt, Homo sapiens
acaccuagacucu

SEQ ID NO: 707891 - RNA, 20 nt, Homo sapiens
acacuuggaacacaaugacu

SEQ ID NO: 707892 - RNA, 15 nt, Homo sapiens
acaguaaccuuucaa

SEQ ID NO: 707893 - RNA, 13 nt, Homo sapiens
acaucaaugauga

SEQ ID NO: 707894 - RNA, 17 nt, Homo sapiens
acaucaaugaugaggcu

SEQ ID NO: 707895 - RNA, 22 nt, Homo sapiens
acaucauaaacaaagaguagaa

SEQ ID NO: 707896 - RNA, 14 nt, Homo sapiens
acaucucuucaugc

SEQ ID NO: 707897 - RNA, 20 nt, Homo sapiens
acauugaauuagaaacauaa

SEQ ID NO: 707898 - RNA, 19 nt, Homo sapiens
auggugaaaauauuugaca

SEQ ID NO: 707899 - RNA, 12 nt, Homo sapiens
augucagcuuau

SEQ ID NO: 707900 - RNA, 17 nt, Homo sapiens
auguccaaacuuaacag

SEQ ID NO: 707901 - RNA, 17 nt, Homo sapiens
auguucuugagcagcug

SEQ ID NO: 707902 - RNA, 16 nt, Homo sapiens
auuaacagcugauaca

SEQ ID NO: 707903 - RNA, 16 nt, Homo sapiens
auuccagggaaccaga

SEQ ID NO: 707904 - RNA, 17 nt, Homo sapiens
auuccagggaaccagag

SEQ ID NO: 707905 - RNA, 17 nt, Homo sapiens
auucugaaucaagguga

SEQ ID NO: 707906 - RNA, 15 nt, Homo sapiens
auucuugcuugacuc

SEQ ID NO: 707907 - RNA, 15 nt, Homo sapiens
auugaauuagaaaca

SEQ ID NO: 707908 - RNA, 18 nt, Homo sapiens
auugacugauggugaaau

SEQ ID NO: 707909 - RNA, 21 nt, Homo sapiens
auugcuuaucaguaguaucaa

SEQ ID NO: 707910 - RNA, 19 nt, Homo sapiens
auuuucuugaauggcaugc

SEQ ID NO: 707911 - RNA, 17 nt, Homo sapiens
caagaggggaugaguug

SEQ ID NO: 707912 - RNA, 17 nt, Homo sapiens
caagcccagccuaucuc

SEQ ID NO: 707913 - RNA, 16 nt, Homo sapiens
cacccacaccauaagc

SEQ ID NO: 707914 - RNA, 23 nt, Homo sapiens
caccuggcucuguggcgagccau

SEQ ID NO: 707915 - RNA, 15 nt, Homo sapiens
cagaagcagcagcua

SEQ ID NO: 707916 - RNA, 14 nt, Homo sapiens
cagcaaaaugugaa

SEQ ID NO: 707917 - RNA, 20 nt, Homo sapiens
cagcaaaaugugaaugggaa

SEQ ID NO: 707918 - RNA, 14 nt, Homo sapiens
cagcagcagcaguu

SEQ ID NO: 707919 - RNA, 18 nt, Homo sapiens
cagcaguuugugaucugu

SEQ ID NO: 707920 - RNA, 16 nt, Homo sapiens
cagccucauugauguc

SEQ ID NO: 707921 - RNA, 20 nt, Homo sapiens
caguguacucugaguccuca

SEQ ID NO: 707922 - RNA, 18 nt, Homo sapiens
caguucccucagcccuca

SEQ ID NO: 707923 - RNA, 19 nt, Homo sapiens
caguucccucagcccucau

SEQ ID NO: 707924 - RNA, 18 nt, Homo sapiens
cauaagcuacugccaucc

SEQ ID NO: 707925 - RNA, 21 nt, Homo sapiens
cauacugaagaugcagcaaaa

SEQ ID NO: 707926 - RNA, 18 nt, Homo sapiens
cauaguugugcaugccug

SEQ ID NO: 707927 - RNA, 13 nt, Homo sapiens
caucaaagcccuc

SEQ ID NO: 707928 - RNA, 15 nt, Homo sapiens
caucagucaaugaau

SEQ ID NO: 707929 - RNA, 18 nt, Homo sapiens
cauugacugauggugaaa

SEQ ID NO: 707930 - RNA, 19 nt, Homo sapiens
cauuguguacaaaauaucc

SEQ ID NO: 707931 - RNA, 22 nt, Homo sapiens
cauuguucagaaaagcaccucu

SEQ ID NO: 707932 - RNA, 14 nt, Homo sapiens
ccaaaucucaaaag

SEQ ID NO: 707933 - RNA, 23 nt, Homo sapiens
ccaaaugaguucccuugauucaa

SEQ ID NO: 707934 - RNA, 15 nt, Homo sapiens
ccagaagcagcagcu

SEQ ID NO: 707935 - RNA, 16 nt, Homo sapiens
ccagaagcagcagcua

SEQ ID NO: 707936 - RNA, 17 nt, Homo sapiens
ccagccuggaugccauc

SEQ ID NO: 707937 - RNA, 11 nt, Homo sapiens
ccaucaaacac

SEQ ID NO: 707938 - RNA, 14 nt, Homo sapiens
ccauggugaacuga

SEQ ID NO: 707939 - RNA, 19 nt, Homo sapiens
ccauguucuugagcagcug

SEQ ID NO: 707940 - RNA, 14 nt, Homo sapiens
cccaagacucccau

SEQ ID NO: 707941 - RNA, 12 nt, Homo sapiens
cccaagugccaa

SEQ ID NO: 707942 - RNA, 19 nt, Homo sapiens
cccagccuggaugccaucc

SEQ ID NO: 707943 - RNA, 21 nt, Homo sapiens
cccaugagggagaugccauga

SEQ ID NO: 707944 - RNA, 19 nt, Homo sapiens
cccucaacugugucugaug

SEQ ID NO: 707945 - RNA, 17 nt, Homo sapiens
cccuguggaugcugcug

SEQ ID NO: 707946 - RNA, 11 nt, Homo sapiens
cccuuccccau

SEQ ID NO: 707947 - RNA, 13 nt, Homo sapiens
ccuccugaugucu

SEQ ID NO: 707948 - RNA, 19 nt, Homo sapiens
ccucuuaaugucucaaaau

SEQ ID NO: 707949 - RNA, 23 nt, Homo sapiens
ccucuugaaugcuuaaaugauca

SEQ ID NO: 707950 - RNA, 15 nt, Homo sapiens
ccugcuccuccagua

SEQ ID NO: 707951 - RNA, 18 nt, Homo sapiens
ccuguaggucuaugaugu

SEQ ID NO: 707952 - RNA, 15 nt, Homo sapiens
ccuguggaugcugcu

SEQ ID NO: 707953 - RNA, 17 nt, Homo sapiens
ccuuggacugagaaauu

SEQ ID NO: 707954 - RNA, 13 nt, Homo sapiens
cggaaaugauuga

SEQ ID NO: 707955 - RNA, 14 nt, Homo sapiens
cuaaaauuaaguau

SEQ ID NO: 707956 - RNA, 20 nt, Homo sapiens
cuaacauccuuggacugaga

SEQ ID NO: 707957 - RNA, 17 nt, Homo sapiens
cuagacaaaaaccauug

SEQ ID NO: 707958 - RNA, 22 nt, Homo sapiens
cuauuaguaguuaauucuguca

SEQ ID NO: 707959 - RNA, 16 nt, Homo sapiens
cuauucauugacugau

SEQ ID NO: 707960 - RNA, 16 nt, Homo sapiens
cucaccccuccaagcu

SEQ ID NO: 707961 - RNA, 16 nt, Homo sapiens
cucacuccccaacccc

SEQ ID NO: 707962 - RNA, 15 nt, Homo sapiens
cucagcauuguguac

SEQ ID NO: 707963 - RNA, 19 nt, Homo sapiens
cucaguguaccacuacuua

SEQ ID NO: 707964 - RNA, 21 nt, Homo sapiens
cucaguguaccacuacuuaga

SEQ ID NO: 707965 - RNA, 21 nt, Homo sapiens
cucaugcagauaguauacaca

SEQ ID NO: 707966 - RNA, 15 nt, Homo sapiens
cucauugaugucaaa

SEQ ID NO: 707967 - RNA, 14 nt, Homo sapiens
cuccccccacaagu

SEQ ID NO: 707968 - RNA, 15 nt, Homo sapiens
cucuaaaacuaucag

SEQ ID NO: 707969 - RNA, 15 nt, Homo sapiens
cucucccugcugcuc

SEQ ID NO: 707970 - RNA, 14 nt, Homo sapiens
cugacuuccugaac

SEQ ID NO: 707971 - RNA, 14 nt, Homo sapiens
cuggggucugugau

SEQ ID NO: 707972 - RNA, 12 nt, Homo sapiens
cuguaugccaag

SEQ ID NO: 707973 - RNA, 22 nt, Homo sapiens
cuuacaguagaggguccagucu

SEQ ID NO: 707974 - RNA, 15 nt, Homo sapiens
cuuacauaugcaaaa

SEQ ID NO: 707975 - RNA, 18 nt, Homo sapiens
cuuacuucuggcauaacu

SEQ ID NO: 707976 - RNA, 17 nt, Homo sapiens
cuuaucaguaguaucaa

SEQ ID NO: 707977 - RNA, 19 nt, Homo sapiens
cuuccugaacucccaguca

SEQ ID NO: 707978 - RNA, 15 nt, Homo sapiens
cuucuggcauaacua

SEQ ID NO: 707979 - RNA, 23 nt, Homo sapiens
cuugaauggcaugcuaguagcag

SEQ ID NO: 707980 - RNA, 14 nt, Homo sapiens
cuugacucuacuau

SEQ ID NO: 707981 - RNA, 18 nt, Homo sapiens
cuugguuuccaucaaagc

SEQ ID NO: 707982 - RNA, 13 nt, Homo sapiens
gaaaaccucuuuc

SEQ ID NO: 707983 - RNA, 22 nt, Homo sapiens
gaaaaccucuuucggaaaugau

SEQ ID NO: 707984 - RNA, 15 nt, Homo sapiens
gaaaaggcuugaguc

SEQ ID NO: 707985 - RNA, 23 nt, Homo sapiens
gaaaaugauugcuuaucaguagu

SEQ ID NO: 707986 - RNA, 17 nt, Homo sapiens
gaaauuauacuuacuuc

SEQ ID NO: 707987 - RNA, 13 nt, Homo sapiens
ugaaggaugccau

SEQ ID NO: 707988 - RNA, 16 nt, Homo sapiens
ugaccaguaauuguga

SEQ ID NO: 707989 - RNA, 23 nt, Homo sapiens
ugacuuccugaacucccagucau

SEQ ID NO: 707990 - RNA, 20 nt, Homo sapiens
ugauuauauaaaauacauaa

SEQ ID NO: 707991 - RNA, 21 nt, Homo sapiens
ugauuuuuucuuuugcuuuau

SEQ ID NO: 707992 - RNA, 23 nt, Homo sapiens
ugcaugccuggcacaacaucaag

SEQ ID NO: 707993 - RNA, 21 nt, Homo sapiens
ugcccccuguggaugcugcug

SEQ ID NO: 707994 - RNA, 17 nt, Homo sapiens
ugcuuuagguaaaaagc

SEQ ID NO: 707995 - RNA, 20 nt, Homo sapiens
uggcucuguggcgagccauu

SEQ ID NO: 707996 - RNA, 17 nt, Homo sapiens
ugggccucggaccccac

SEQ ID NO: 707997 - RNA, 17 nt, Homo sapiens
uggugaaauggcuggag

SEQ ID NO: 707998 - RNA, 18 nt, Homo sapiens
uguacaaaauauccaagc

SEQ ID NO: 707999 - RNA, 19 nt, Homo sapiens
ugucacucaccacuacauc

SEQ ID NO: 708000 - RNA, 21 nt, Homo sapiens
ugucucaaaauaaaaccagaa

SEQ ID NO: 708001 - RNA, 13 nt, Homo sapiens
ugucucucuuuug

SEQ ID NO: 708002 - RNA, 14 nt, Homo sapiens
uguucagaaaagca

SEQ ID NO: 708003 - RNA, 23 nt, Homo sapiens
uguugaugaggcagaugccucua

SEQ ID NO: 708004 - RNA, 13 nt, Homo sapiens
uuaaacauugccu

SEQ ID NO: 708005 - RNA, 17 nt, Homo sapiens
uuauauaaaauacauaa

SEQ ID NO: 708006 - RNA, 17 nt, Homo sapiens
uucauaacagaacaaga

SEQ ID NO: 708007 - RNA, 13 nt, Homo sapiens
uucauugacugau

SEQ ID NO: 708008 - RNA, 16 nt, Homo sapiens
uuccagggaaccagag

SEQ ID NO: 708009 - RNA, 17 nt, Homo sapiens
uucccaaaucucaaaag

SEQ ID NO: 708010 - RNA, 19 nt, Homo sapiens
uuccccacaauaggcuuag

SEQ ID NO: 708011 - RNA, 16 nt, Homo sapiens
uuccugaacucccagu

SEQ ID NO: 708012 - RNA, 17 nt, Homo sapiens
uucugaaucaaggugau

SEQ ID NO: 708013 - RNA, 16 nt, Homo sapiens
uucuugagcagcugaa

SEQ ID NO: 708014 - RNA, 14 nt, Homo sapiens
uugacaucaaugau

SEQ ID NO: 708015 - RNA, 13 nt, Homo sapiens
uugagucuggaua

SEQ ID NO: 708016 - RNA, 20 nt, Homo sapiens
uugauucaaauaacccugaa

SEQ ID NO: 708017 - RNA, 21 nt, Homo sapiens
uugcccagccuggaugccauc

SEQ ID NO: 708018 - RNA, 12 nt, Homo sapiens
uugguacccugg

SEQ ID NO: 708019 - RNA, 21 nt, Homo sapiens
uuuaaaagccaucaaacacaa

SEQ ID NO: 708020 - RNA, 17 nt, Homo sapiens
uuucaaucaaaacucag

SEQ ID NO: 708021 - RNA, 18 nt, Homo sapiens
uuucagcuguuucaccau

SEQ ID NO: 708022 - RNA, 15 nt, Homo sapiens
uuucggaaaugauug

SEQ ID NO: 708023 - RNA, 16 nt, Homo sapiens
uuuugcuuuauggguu

SEQ ID NO: 708024 - RNA, 17 nt, Homo sapiens
aaagagaaaaagcccuc

SEQ ID NO: 708025 - RNA, 15 nt, Homo sapiens
aaagccaucaaacac

SEQ ID NO: 708026 - RNA, 20 nt, Homo sapiens
aaagcuuaaacauugccuua

SEQ ID NO: 708027 - RNA, 17 nt, Homo sapiens
aaaguaugguauugaaa

SEQ ID NO: 708028 - RNA, 18 nt, Homo sapiens
aaauaacccugaaucaga

SEQ ID NO: 708029 - RNA, 12 nt, Homo sapiens
aaauauuugaca

SEQ ID NO: 708030 - RNA, 18 nt, Homo sapiens
aacagagacuucuagaca

SEQ ID NO: 708031 - RNA, 20 nt, Homo sapiens
aaccauuucagcuguuucac

SEQ ID NO: 708032 - RNA, 20 nt, Homo sapiens
aacuaaaauuaaguauauau

SEQ ID NO: 708033 - RNA, 15 nt, Homo sapiens
aagaaaaugauugcu

SEQ ID NO: 708034 - RNA, 21 nt, Homo sapiens
aagagaaaaagcccucuucaa

SEQ ID NO: 708035 - RNA, 13 nt, Homo sapiens
aagagaauucuau

SEQ ID NO: 708036 - RNA, 19 nt, Homo sapiens
aagaugcagcaaaauguga

SEQ ID NO: 708037 - RNA, 12 nt, Homo sapiens
aagcagcagcua

SEQ ID NO: 708038 - RNA, 20 nt, Homo sapiens
aagcuuaaacauugccuuau

SEQ ID NO: 708039 - RNA, 16 nt, Homo sapiens
aagugcuugaggccaa

SEQ ID NO: 708040 - RNA, 20 nt, Homo sapiens
aauauauaguggacaguaac

SEQ ID NO: 708041 - RNA, 20 nt, Homo sapiens
aaucaaggugauugugauua

SEQ ID NO: 708042 - RNA, 21 nt, Homo sapiens
aaucaaggugauugugauuau

SEQ ID NO: 708043 - RNA, 22 nt, Homo sapiens
aauccuaacauuauauucccaa

SEQ ID NO: 708044 - RNA, 20 nt, Homo sapiens
aaugaagaugaugcuauuaa

SEQ ID NO: 708045 - RNA, 13 nt, Homo sapiens
aaugacuaaagac

SEQ ID NO: 708046 - RNA, 20 nt, Homo sapiens
aaugaguucccuugauucaa

SEQ ID NO: 708047 - RNA, 18 nt, Homo sapiens
aaugauuuacucaauauc

SEQ ID NO: 708048 - RNA, 15 nt, Homo sapiens
aaugggaaaagagau

SEQ ID NO: 708049 - RNA, 13 nt, Homo sapiens
aaugucucaaaau

SEQ ID NO: 708050 - RNA, 22 nt, Homo sapiens
aauucugucacucaccacuaca

SEQ ID NO: 708051 - RNA, 20 nt, Homo sapiens
aauuggcugccaagagucca

SEQ ID NO: 708052 - RNA, 18 nt, Homo sapiens
acaaugaagaugaugcua

SEQ ID NO: 708053 - RNA, 22 nt, Homo sapiens
acaaugaagaugaugcuauuaa

SEQ ID NO: 708054 - RNA, 20 nt, Homo sapiens
acaccauaagcuacugccau

SEQ ID NO: 708055 - RNA, 22 nt, Homo sapiens
acaccauaagcuacugccaucc

SEQ ID NO: 708056 - RNA, 20 nt, Homo sapiens
acagcaggcugccagugccu

SEQ ID NO: 708057 - RNA, 18 nt, Homo sapiens
acaucaagccugugauug

SEQ ID NO: 708058 - RNA, 12 nt, Homo sapiens
acaucaaugaug

SEQ ID NO: 708059 - RNA, 22 nt, Homo sapiens
acaucacuugagacaaaucuau

SEQ ID NO: 708060 - RNA, 12 nt, Homo sapiens
acaucucuucau

SEQ ID NO: 708061 - RNA, 15 nt, Homo sapiens
accaguaauugugaa

SEQ ID NO: 708062 - RNA, 14 nt, Homo sapiens
acccacuuccugau

SEQ ID NO: 708063 - RNA, 20 nt, Homo sapiens
acccacuuccugaucccuca

SEQ ID NO: 708064 - RNA, 15 nt, Homo sapiens
acccuggacagugcc

SEQ ID NO: 708065 - RNA, 22 nt, Homo sapiens
accuguucacgugacuccucaa

SEQ ID NO: 708066 - RNA, 14 nt, Homo sapiens
acgugacuccucaa

SEQ ID NO: 708067 - RNA, 22 nt, Homo sapiens
acuacuuagagauauguaucau

SEQ ID NO: 708068 - RNA, 23 nt, Homo sapiens
acucccaugagggagaugccaug

SEQ ID NO: 708069 - RNA, 20 nt, Homo sapiens
acugaauggacuuugcacac

SEQ ID NO: 708070 - RNA, 20 nt, Homo sapiens
acugcauaaaaagugccugu

SEQ ID NO: 708071 - RNA, 21 nt, Homo sapiens
acugcauaaaaagugccugua

SEQ ID NO: 708072 - RNA, 16 nt, Homo sapiens
acuuagagauauguau

SEQ ID NO: 708073 - RNA, 17 nt, Homo sapiens
acuuggaacacaaugac

SEQ ID NO: 708074 - RNA, 19 nt, Homo sapiens
agaaauuauacuuacuucu

SEQ ID NO: 708075 - RNA, 24 nt, Homo sapiens
agacucccaugagggagaugccau

SEQ ID NO: 708076 - RNA, 20 nt, Homo sapiens
agacucuggaaguauacuuu

SEQ ID NO: 708077 - RNA, 21 nt, Homo sapiens
agagaaaaagcccucuucaau

SEQ ID NO: 708078 - RNA, 17 nt, Homo sapiens
agagaccuccugauguc

SEQ ID NO: 708079 - RNA, 22 nt, Homo sapiens
agaguuauuuuguguccuuuaa

SEQ ID NO: 708080 - RNA, 15 nt, Homo sapiens
agaucuccugugcac

SEQ ID NO: 708081 - RNA, 15 nt, Homo sapiens
agcacaucucuucau

SEQ ID NO: 708082 - RNA, 16 nt, Homo sapiens
agcacaucucuucaug

SEQ ID NO: 708083 - RNA, 16 nt, Homo sapiens
agcagcagcagcagca

SEQ ID NO: 708084 - RNA, 20 nt, Homo sapiens
agccucauugaugucaaaaa

SEQ ID NO: 708085 - RNA, 13 nt, Homo sapiens
agccuggaugcca

SEQ ID NO: 708086 - RNA, 20 nt, Homo sapiens
agcucagcauuguguacaaa

SEQ ID NO: 708087 - RNA, 21 nt, Homo sapiens
agcuguuucaccaucagucaa

SEQ ID NO: 708088 - RNA, 23 nt, Homo sapiens
agcuuaauaaguauuuauugcau

SEQ ID NO: 708089 - RNA, 22 nt, Homo sapiens
agcuuauaaaaucaaacagaga

SEQ ID NO: 708090 - RNA, 15 nt, Homo sapiens
aggaagucagacuuu

SEQ ID NO: 708091 - RNA, 15 nt, Homo sapiens
aggagaugaggcugg

SEQ ID NO: 708092 - RNA, 17 nt, Homo sapiens
aggagaugaggcuggau

SEQ ID NO: 708093 - RNA, 22 nt, Homo sapiens
aggccuuccccuggcacuggca

SEQ ID NO: 708094 - RNA, 15 nt, Homo sapiens
aggcuuagugcuugg

SEQ ID NO: 708095 - RNA, 22 nt, Homo sapiens
agguaaauaaucauacacagaa

SEQ ID NO: 708096 - RNA, 12 nt, Homo sapiens
agguaucugaug

SEQ ID NO: 708097 - RNA, 21 nt, Homo sapiens
agguuggagugcauucauuca

SEQ ID NO: 708098 - RNA, 14 nt, Homo sapiens
aguaguaucaauga

SEQ ID NO: 708099 - RNA, 23 nt, Homo sapiens
aguucuuuucaaccuacuuucau

SEQ ID NO: 708100 - RNA, 14 nt, Homo sapiens
aguugucuauucau

SEQ ID NO: 708101 - RNA, 21 nt, Homo sapiens
aguuugugaucuguccuucca

SEQ ID NO: 708102 - RNA, 17 nt, Homo sapiens
auaaaaucaaacagaga

SEQ ID NO: 708103 - RNA, 18 nt, Homo sapiens
auaaaaucaaacagagac

SEQ ID NO: 708104 - RNA, 21 nt, Homo sapiens
auaaaguaugguauugaaacu

SEQ ID NO: 708105 - RNA, 14 nt, Homo sapiens
auaacccugaauca

SEQ ID NO: 708106 - RNA, 23 nt, Homo sapiens
auacagguauucugcugaugcua

SEQ ID NO: 708107 - RNA, 18 nt, Homo sapiens
auaccccaagacucccau

SEQ ID NO: 708108 - RNA, 14 nt, Homo sapiens
auaguugugcaugc

SEQ ID NO: 708109 - RNA, 15 nt, Homo sapiens
auauguaucauaaaa

SEQ ID NO: 708110 - RNA, 19 nt, Homo sapiens
aaaaaucccauuuaugcaa

SEQ ID NO: 708111 - RNA, 20 nt, Homo sapiens
aaaaaucccauuuaugcaau

SEQ ID NO: 708112 - RNA, 17 nt, Homo sapiens
aaaacucaguaucauaa

SEQ ID NO: 708113 - RNA, 22 nt, Homo sapiens
aaaacucuaauuguccauucuu

SEQ ID NO: 708114 - RNA, 16 nt, Homo sapiens
aaaaucaaacagagac

SEQ ID NO: 708115 - RNA, 19 nt, Homo sapiens
aaaaugaauaauacauuga

SEQ ID NO: 708116 - RNA, 13 nt, Homo sapiens
aaacauugccuua

SEQ ID NO: 708117 - RNA, 22 nt, Homo sapiens
aaaccucuuucggaaaugauug

SEQ ID NO: 708118 - RNA, 13 nt, Homo sapiens
aaacuucaauauc

SEQ ID NO: 708119 - RNA, 15 nt, Homo sapiens
aacacaaugccucau

SEQ ID NO: 708120 - RNA, 19 nt, Homo sapiens
aacacguuuuuucacuauu

SEQ ID NO: 708121 - RNA, 23 nt, Homo sapiens
aaccuguucacgugacuccucaa

SEQ ID NO: 708122 - RNA, 12 nt, Homo sapiens
aacuccuuacag

SEQ ID NO: 708123 - RNA, 19 nt, Homo sapiens
aacucuaauuguccauucu

SEQ ID NO: 708124 - RNA, 17 nt, Homo sapiens
aacugaagcagagucaa

SEQ ID NO: 708125 - RNA, 21 nt, Homo sapiens
aacuucaauauccacuucuuu

SEQ ID NO: 708126 - RNA, 16 nt, Homo sapiens
aagaugaugcuauuaa

SEQ ID NO: 708127 - RNA, 15 nt, Homo sapiens
aagaugcagcaaaau

SEQ ID NO: 708128 - RNA, 22 nt, Homo sapiens
aagcaacauggcuuugaugaua

SEQ ID NO: 708129 - RNA, 13 nt, Homo sapiens
aagcccucuucaa

SEQ ID NO: 708130 - RNA, 15 nt, Homo sapiens
aagcuacugccaucc

SEQ ID NO: 708131 - RNA, 15 nt, Homo sapiens
aaguauuuauugcau

SEQ ID NO: 708132 - RNA, 13 nt, Homo sapiens
aauaaaaccagaa

SEQ ID NO: 708133 - RNA, 17 nt, Homo sapiens
aauaacccugaaucaga

SEQ ID NO: 708134 - RNA, 18 nt, Homo sapiens
aauaacccugaaucagag

SEQ ID NO: 708135 - RNA, 11 nt, Homo sapiens
aauaggcuugu

SEQ ID NO: 708136 - RNA, 17 nt, Homo sapiens
aauauaccuucagagac

SEQ ID NO: 708137 - RNA, 13 nt, Homo sapiens
aauuauacuuacu

SEQ ID NO: 708138 - RNA, 16 nt, Homo sapiens
aauuuguucugugcaa

SEQ ID NO: 708139 - RNA, 17 nt, Homo sapiens
acaacaucaagccugug

SEQ ID NO: 708140 - RNA, 16 nt, Homo sapiens
acaaugacuaaagaca

SEQ ID NO: 708141 - RNA, 22 nt, Homo sapiens
acagguauucugcugaugcuac

SEQ ID NO: 708142 - RNA, 17 nt, Homo sapiens
acauacgcacugggcau

SEQ ID NO: 708143 - RNA, 13 nt, Homo sapiens
acaucacuugaga

SEQ ID NO: 708144 - RNA, 14 nt, Homo sapiens
acauccuuggacug

SEQ ID NO: 708145 - RNA, 16 nt, Homo sapiens
accagagcgauguguu

SEQ ID NO: 708146 - RNA, 22 nt, Homo sapiens
accugacuuuggagacgaugcu

SEQ ID NO: 708147 - RNA, 23 nt, Homo sapiens
accuguucacgugacuccucaau

SEQ ID NO: 708148 - RNA, 16 nt, Homo sapiens
acuaauuaaacugaug

SEQ ID NO: 708149 - RNA, 14 nt, Homo sapiens
acuccuuacagaag

SEQ ID NO: 708150 - RNA, 19 nt, Homo sapiens
acucuaaaacuaucagcag

SEQ ID NO: 708151 - RNA, 22 nt, Homo sapiens
acucuaauuguccauucuugcu

SEQ ID NO: 708152 - RNA, 18 nt, Homo sapiens
acugaagaugcagcaaaa

SEQ ID NO: 708153 - RNA, 17 nt, Homo sapiens
acugaagcagagucaag

SEQ ID NO: 708154 - RNA, 19 nt, Homo sapiens
acuuaacagaucacaugcc

SEQ ID NO: 708155 - RNA, 12 nt, Homo sapiens
acuugagacaaa

SEQ ID NO: 708156 - RNA, 16 nt, Homo sapiens
agaaaaugauugcuua

SEQ ID NO: 708157 - RNA, 14 nt, Homo sapiens
agaaauaugagcau

SEQ ID NO: 708158 - RNA, 15 nt, Homo sapiens
agaaauuauacuuac

SEQ ID NO: 708159 - RNA, 18 nt, Homo sapiens
agaaauuaugucagcuua

SEQ ID NO: 708160 - RNA, 18 nt, Homo sapiens
agacguuuaaaagccauc

SEQ ID NO: 708161 - RNA, 16 nt, Homo sapiens
agagauggccugagaa

SEQ ID NO: 708162 - RNA, 15 nt, Homo sapiens
agaggaaaaggcuug

SEQ ID NO: 708163 - RNA, 16 nt, Homo sapiens
agaugacauggugaaa

SEQ ID NO: 708164 - RNA, 12 nt, Homo sapiens
agcagagucaag

SEQ ID NO: 708165 - RNA, 18 nt, Homo sapiens
agcaugcauucauaacag

SEQ ID NO: 708166 - RNA, 12 nt, Homo sapiens
agccuggaugcc

SEQ ID NO: 708167 - RNA, 16 nt, Homo sapiens
agccuggaugccaucc

SEQ ID NO: 708168 - RNA, 15 nt, Homo sapiens
aggaaaaggcuugag

SEQ ID NO: 708169 - RNA, 18 nt, Homo sapiens
aggcagaugccucuagaa

SEQ ID NO: 708170 - RNA, 16 nt, Homo sapiens
agggggccuggaugcc

SEQ ID NO: 708171 - RNA, 14 nt, Homo sapiens
agguuggagugcau

SEQ ID NO: 708172 - RNA, 20 nt, Homo sapiens
aguaaccuuucaaucaaaac

SEQ ID NO: 708173 - RNA, 13 nt, Homo sapiens
aguaauugugaaa

SEQ ID NO: 708174 - RNA, 22 nt, Homo sapiens
aguagaggguccagucuucuag

SEQ ID NO: 708175 - RNA, 22 nt, Homo sapiens
aguauacuuuuugcauauguaa

SEQ ID NO: 708176 - RNA, 15 nt, Homo sapiens
agucaagcugaugaa

SEQ ID NO: 708177 - RNA, 14 nt, Homo sapiens
agugcauucauuca

SEQ ID NO: 708178 - RNA, 17 nt, Homo sapiens
aguuuugacaucaauga

SEQ ID NO: 708179 - RNA, 21 nt, Homo sapiens
auaaaauauauugguauguaa

SEQ ID NO: 708180 - RNA, 18 nt, Homo sapiens
auaagaugcugcugagca

SEQ ID NO: 708181 - RNA, 15 nt, Homo sapiens
auaagcuacugccau

SEQ ID NO: 708182 - RNA, 15 nt, Homo sapiens
auaaguagagacuga

SEQ ID NO: 708183 - RNA, 22 nt, Homo sapiens
auacuuuuugcauauguaagga

SEQ ID NO: 708184 - RNA, 17 nt, Homo sapiens
auauaguggacaguaac

SEQ ID NO: 708185 - RNA, 18 nt, Homo sapiens
auauguaaggaagucaga

SEQ ID NO: 708186 - RNA, 13 nt, Homo sapiens
aucaagccuguga

SEQ ID NO: 708187 - RNA, 20 nt, Homo sapiens
aucaugcuucuacuccaugg

SEQ ID NO: 708188 - RNA, 22 nt, Homo sapiens
auccaagcccagccuaucucuc

SEQ ID NO: 708189 - RNA, 16 nt, Homo sapiens
augacauggugaaaau

SEQ ID NO: 708190 - RNA, 16 nt, Homo sapiens
augagggagaugccau

SEQ ID NO: 708191 - RNA, 16 nt, Homo sapiens
augauuaagugcuuga

SEQ ID NO: 708192 - RNA, 16 nt, Homo sapiens
augcagcaaaauguga

SEQ ID NO: 708193 - RNA, 20 nt, Homo sapiens
augcuaguagcagugagcaa

SEQ ID NO: 708194 - RNA, 18 nt, Homo sapiens
auggugaaaauauuugac

SEQ ID NO: 708195 - RNA, 14 nt, Homo sapiens
ugcaauuuacuugg

SEQ ID NO: 708196 - RNA, 19 nt, Homo sapiens
ugcauauguaaggaaguca

SEQ ID NO: 708197 - RNA, 17 nt, Homo sapiens
ugcuucuuuccucuuaa

SEQ ID NO: 708198 - RNA, 19 nt, Homo sapiens
ugcuucuuuccucuuaaug

SEQ ID NO: 708199 - RNA, 16 nt, Homo sapiens
acucuaaaacuaucag

SEQ ID NO: 708200 - RNA, 13 nt, Homo sapiens
acucuacuauuaa

SEQ ID NO: 708201 - RNA, 15 nt, Homo sapiens
acucugaguccucau

SEQ ID NO: 708202 - RNA, 21 nt, Homo sapiens
acuguagacucuggaaguaua

SEQ ID NO: 708203 - RNA, 14 nt, Homo sapiens
acuuggaacacaau

SEQ ID NO: 708204 - RNA, 24 nt, Homo sapiens
agaaauaugagcaugcucccucau

SEQ ID NO: 708205 - RNA, 14 nt, Homo sapiens
agacaccuagacuc

SEQ ID NO: 708206 - RNA, 21 nt, Homo sapiens
agacauaguugugcaugccug

SEQ ID NO: 708207 - RNA, 19 nt, Homo sapiens
agagacugaaaacuugccg

SEQ ID NO: 708208 - RNA, 15 nt, Homo sapiens
agauaguauacacau

SEQ ID NO: 708209 - RNA, 14 nt, Homo sapiens
agaucaaauggaaa

SEQ ID NO: 708210 - RNA, 15 nt, Homo sapiens
agaugacauggugaa

SEQ ID NO: 708211 - RNA, 18 nt, Homo sapiens
agaugacauggugaaaau

SEQ ID NO: 708212 - RNA, 12 nt, Homo sapiens
agcacacuggcu

SEQ ID NO: 708213 - RNA, 14 nt, Homo sapiens
agcaccucuugaag

SEQ ID NO: 708214 - RNA, 15 nt, Homo sapiens
agcagcagcagcagc

SEQ ID NO: 708215 - RNA, 16 nt, Homo sapiens
agccaucaaacacaau

SEQ ID NO: 708216 - RNA, 15 nt, Homo sapiens
agcuuaaacauugcc

SEQ ID NO: 708217 - RNA, 15 nt, Homo sapiens
agcuuaauaaguauu

SEQ ID NO: 708218 - RNA, 18 nt, Homo sapiens
agggacuccagaagcagc

SEQ ID NO: 708219 - RNA, 13 nt, Homo sapiens
agggagaugccau

SEQ ID NO: 708220 - RNA, 14 nt, Homo sapiens
agguaaauaaucau

SEQ ID NO: 708221 - RNA, 19 nt, Homo sapiens
agguauucugcugaugcua

SEQ ID NO: 708222 - RNA, 19 nt, Homo sapiens
agugauucugaaucaaggu

SEQ ID NO: 708223 - RNA, 20 nt, Homo sapiens
agugccucucccugcugcuc

SEQ ID NO: 708224 - RNA, 16 nt, Homo sapiens
agugccuggguggaug

SEQ ID NO: 708225 - RNA, 17 nt, Homo sapiens
aguuugaaaauaguuac

SEQ ID NO: 708226 - RNA, 13 nt, Homo sapiens
auaacagccucau

SEQ ID NO: 708227 - RNA, 16 nt, Homo sapiens
auaaguauuuauugca

SEQ ID NO: 708228 - RNA, 23 nt, Homo sapiens
auaauacauugaauuagaaacau

SEQ ID NO: 708229 - RNA, 14 nt, Homo sapiens
auaaucauacacag

SEQ ID NO: 708230 - RNA, 11 nt, Homo sapiens
auaaugcuucu

SEQ ID NO: 708231 - RNA, 13 nt, Homo sapiens
auacugcauaaaa

SEQ ID NO: 708232 - RNA, 19 nt, Homo sapiens
auaugagcaugcucccuca

SEQ ID NO: 708233 - RNA, 24 nt, Homo sapiens
aucaugcuucuacuccauggugaa

SEQ ID NO: 708234 - RNA, 18 nt, Homo sapiens
aucucaaaagaucuccug

SEQ ID NO: 708235 - RNA, 16 nt, Homo sapiens
augaauaauacauuga

SEQ ID NO: 708236 - RNA, 15 nt, Homo sapiens
augacuaaagacaua

SEQ ID NO: 708237 - RNA, 20 nt, Homo sapiens
augagcaugcucccucaugc

SEQ ID NO: 708238 - RNA, 18 nt, Homo sapiens
augauugcuuaucaguag

SEQ ID NO: 708239 - RNA, 17 nt, Homo sapiens
auggaaaggagaggaaa

SEQ ID NO: 708240 - RNA, 18 nt, Homo sapiens
auuauagugacaaugaag

SEQ ID NO: 708241 - RNA, 20 nt, Homo sapiens
auuauauucccaaaucucaa

SEQ ID NO: 708242 - RNA, 23 nt, Homo sapiens
auuauauucccaaaucucaaaag

SEQ ID NO: 708243 - RNA, 17 nt, Homo sapiens
auucauaacagaacaag

SEQ ID NO: 708244 - RNA, 19 nt, Homo sapiens
auucuguaugccaagugaa

SEQ ID NO: 708245 - RNA, 15 nt, Homo sapiens
auucugucacucacc

SEQ ID NO: 708246 - RNA, 22 nt, Homo sapiens
auucugucacucaccacuacau

SEQ ID NO: 708247 - RNA, 16 nt, Homo sapiens
auugaaguuuugacau

SEQ ID NO: 708248 - RNA, 19 nt, Homo sapiens
auugaaguuuugacaucaa

SEQ ID NO: 708249 - RNA, 16 nt, Homo sapiens
auugacugauggugaa

SEQ ID NO: 708250 - RNA, 16 nt, Homo sapiens
auuguccauucuugcu

SEQ ID NO: 708251 - RNA, 23 nt, Homo sapiens
auugugauuauagugacaaugaa

SEQ ID NO: 708252 - RNA, 14 nt, Homo sapiens
auuuacucaauauc

SEQ ID NO: 708253 - RNA, 22 nt, Homo sapiens
caaacuuaacagaucacaugcc

SEQ ID NO: 708254 - RNA, 17 nt, Homo sapiens
caacaucaagccuguga

SEQ ID NO: 708255 - RNA, 21 nt, Homo sapiens
caaccuguucacgugacuccu

SEQ ID NO: 708256 - RNA, 20 nt, Homo sapiens
caaugaauaacagccucauu

SEQ ID NO: 708257 - RNA, 17 nt, Homo sapiens
caaugauuuacucaaua

SEQ ID NO: 708258 - RNA, 20 nt, Homo sapiens
cacagcaggcugccagugcc

SEQ ID NO: 708259 - RNA, 18 nt, Homo sapiens
caccaucagucaaugaau

SEQ ID NO: 708260 - RNA, 19 nt, Homo sapiens
cacuccggcccuccagagc

SEQ ID NO: 708261 - RNA, 13 nt, Homo sapiens
cagaaaagcaccu

SEQ ID NO: 708262 - RNA, 20 nt, Homo sapiens
cagaugccucuagaagagac

SEQ ID NO: 708263 - RNA, 19 nt, Homo sapiens
cagcaugaaggaugccaua

SEQ ID NO: 708264 - RNA, 19 nt, Homo sapiens
cagccucauugaugucaaa

SEQ ID NO: 708265 - RNA, 21 nt, Homo sapiens
cagcuuauaaaaucaaacaga

SEQ ID NO: 708266 - RNA, 22 nt, Homo sapiens
cagguaucugaugauguucuga

SEQ ID NO: 708267 - RNA, 21 nt, Homo sapiens
cagugccucucccugcugcuc

SEQ ID NO: 708268 - RNA, 15 nt, Homo sapiens
caguugucuauucau

SEQ ID NO: 708269 - RNA, 15 nt, Homo sapiens
caguuugugaucugu

SEQ ID NO: 708270 - RNA, 17 nt, Homo sapiens
cauaaguagagacugaa

SEQ ID NO: 708271 - RNA, 20 nt, Homo sapiens
caucaaacacaaugccucau

SEQ ID NO: 708272 - RNA, 12 nt, Homo sapiens
caucaaagcccu

SEQ ID NO: 708273 - RNA, 22 nt, Homo sapiens
cauccuuggacugagaaauuau

SEQ ID NO: 708274 - RNA, 19 nt, Homo sapiens
cauucauaacagaacaaga

SEQ ID NO: 708275 - RNA, 13 nt, Homo sapiens
ccaccagugccuc

SEQ ID NO: 708276 - RNA, 22 nt, Homo sapiens
ccaguugucuauucauugacug

SEQ ID NO: 708277 - RNA, 19 nt, Homo sapiens
ccaugagggagaugccaug

SEQ ID NO: 708278 - RNA, 18 nt, Homo sapiens
ccauuucagcuguuucac

SEQ ID NO: 708279 - RNA, 16 nt, Homo sapiens
gaaauuauacuuacuu

SEQ ID NO: 708280 - RNA, 15 nt, Homo sapiens
gaagaugaugcuauu

SEQ ID NO: 708281 - RNA, 20 nt, Homo sapiens
gaaguuuugacaucaaugau

SEQ ID NO: 708282 - RNA, 19 nt, Homo sapiens
gacaaugaagaugaugcua

SEQ ID NO: 708283 - RNA, 17 nt, Homo sapiens
gacucuacuauuaaguu

SEQ ID NO: 708284 - RNA, 14 nt, Homo sapiens
gacugauggugaaa

SEQ ID NO: 708285 - RNA, 20 nt, Homo sapiens
gacugucaguaggcuggaag

SEQ ID NO: 708286 - RNA, 15 nt, Homo sapiens
gaggaauaaaaugau

SEQ ID NO: 708287 - RNA, 23 nt, Homo sapiens
gaugcccccuguggaugcugcug

SEQ ID NO: 708288 - RNA, 14 nt, Homo sapiens
gaugcuacugcugc

SEQ ID NO: 708289 - RNA, 14 nt, Homo sapiens
gaugcugcugagca

SEQ ID NO: 708290 - RNA, 20 nt, Homo sapiens
gaugucuugguuuccaucaa

SEQ ID NO: 708291 - RNA, 20 nt, Homo sapiens
gauuauauaaaauacauaau

SEQ ID NO: 708292 - RNA, 22 nt, Homo sapiens
gauucaaauaacccugaaucag

SEQ ID NO: 708293 - RNA, 18 nt, Homo sapiens
gcacacuggcucacccag

SEQ ID NO: 708294 - RNA, 13 nt, Homo sapiens
gcaccucuugaag

SEQ ID NO: 708295 - RNA, 11 nt, Homo sapiens
gcacucucuuu

SEQ ID NO: 708296 - RNA, 15 nt, Homo sapiens
gcagcagcagcagca

SEQ ID NO: 708297 - RNA, 14 nt, Homo sapiens
gcagugcucaccca

SEQ ID NO: 708298 - RNA, 15 nt, Homo sapiens
gcagugcucacccac

SEQ ID NO: 708299 - RNA, 15 nt, Homo sapiens
gccucauugauguca

SEQ ID NO: 708300 - RNA, 22 nt, Homo sapiens
gccucugcggagcacacuggcu

SEQ ID NO: 708301 - RNA, 13 nt, Homo sapiens
gccuggguggaug

SEQ ID NO: 708302 - RNA, 22 nt, Homo sapiens
gccuguagaugacauggugaaa

SEQ ID NO: 708303 - RNA, 18 nt, Homo sapiens
gccuuccccuggcacugg

SEQ ID NO: 708304 - RNA, 23 nt, Homo sapiens
gcuauaccugggcauacuaauaa

SEQ ID NO: 708305 - RNA, 15 nt, Homo sapiens
gcucacccaguccug

SEQ ID NO: 708306 - RNA, 18 nt, Homo sapiens
gcuuauaaaaucaaacag

SEQ ID NO: 708307 - RNA, 21 nt, Homo sapiens
gcuuaucaguaguaucaauga

SEQ ID NO: 708308 - RNA, 18 nt, Homo sapiens
gcuucuacuccaugguga

SEQ ID NO: 708309 - RNA, 20 nt, Homo sapiens
gcuuuagguaaaaagcuuaa

SEQ ID NO: 708310 - RNA, 13 nt, Homo sapiens
ggaaguauacuuu

SEQ ID NO: 708311 - RNA, 21 nt, Homo sapiens
ggacccgucuccagcugcuga

SEQ ID NO: 708312 - RNA, 13 nt, Homo sapiens
ggacuuugcacac

SEQ ID NO: 708313 - RNA, 15 nt, Homo sapiens
ggagaugccaugagc

SEQ ID NO: 708314 - RNA, 15 nt, Homo sapiens
ggagugaaaaccucu

SEQ ID NO: 708315 - RNA, 15 nt, Homo sapiens
ggaucaggaacccuu

SEQ ID NO: 708316 - RNA, 22 nt, Homo sapiens
ggaugcccccuguggaugcugc

SEQ ID NO: 708317 - RNA, 14 nt, Homo sapiens
ggcacucucuuuug

SEQ ID NO: 708318 - RNA, 21 nt, Homo sapiens
ggcuauaccugggcauacuaa

SEQ ID NO: 708319 - RNA, 19 nt, Homo sapiens
gggugugaaagguuuccaa

SEQ ID NO: 708320 - RNA, 17 nt, Homo sapiens
gguaagggacuccagaa

SEQ ID NO: 708321 - RNA, 17 nt, Homo sapiens
ggugaacugaagcagag

SEQ ID NO: 708322 - RNA, 18 nt, Homo sapiens
guauucugcugaugcuac

SEQ ID NO: 708323 - RNA, 15 nt, Homo sapiens
gugccuaacuccuua

SEQ ID NO: 708324 - RNA, 19 nt, Homo sapiens
guucacgugacuccucaau

SEQ ID NO: 708325 - RNA, 20 nt, Homo sapiens
guuucaccaucagucaauga

SEQ ID NO: 708326 - RNA, 13 nt, Homo sapiens
guuuugacaucaa

SEQ ID NO: 708327 - RNA, 17 nt, Homo sapiens
uaaaacuaucagcagcg

SEQ ID NO: 708328 - RNA, 12 nt, Homo sapiens
uaaaaugauuaa

SEQ ID NO: 708329 - RNA, 21 nt, Homo sapiens
uaaaggauucuguaugccaag

SEQ ID NO: 708330 - RNA, 14 nt, Homo sapiens
uaauucuagagucu

SEQ ID NO: 708331 - RNA, 14 nt, Homo sapiens
uaauucugucacuc

SEQ ID NO: 708332 - RNA, 14 nt, Homo sapiens
uacuuacuucuggc

SEQ ID NO: 708333 - RNA, 14 nt, Homo sapiens
uagacaaaaaccau

SEQ ID NO: 708334 - RNA, 18 nt, Homo sapiens
uaggcuuguguaauuucc

SEQ ID NO: 708335 - RNA, 20 nt, Homo sapiens
uaguaguuaauucugucacu

SEQ ID NO: 708336 - RNA, 23 nt, Homo sapiens
uaguaguuaauucugucacucac

SEQ ID NO: 708337 - RNA, 16 nt, Homo sapiens
uauauaaaauacauaa

SEQ ID NO: 708338 - RNA, 12 nt, Homo sapiens
uaugccacucag

SEQ ID NO: 708339 - RNA, 16 nt, Homo sapiens
uauucccaaaucucaa

SEQ ID NO: 708340 - RNA, 15 nt, Homo sapiens
uauuugcuauguccu

SEQ ID NO: 708341 - RNA, 17 nt, Homo sapiens
ucaaaacucaguaucau

SEQ ID NO: 708342 - RNA, 13 nt, Homo sapiens
ucaaaauguggac

SEQ ID NO: 708343 - RNA, 19 nt, Homo sapiens
ucaaucaaaacucaguauc

SEQ ID NO: 708344 - RNA, 14 nt, Homo sapiens
ucacccacaccaua

SEQ ID NO: 708345 - RNA, 21 nt, Homo sapiens
ucagcuuauaaaaucaaacag

SEQ ID NO: 708346 - RNA, 17 nt, Homo sapiens
ucaggagaaaccccuga

SEQ ID NO: 708347 - RNA, 18 nt, Homo sapiens
ucaguaguaucaaugauu

SEQ ID NO: 708348 - RNA, 13 nt, Homo sapiens
uccauucuugcuu

SEQ ID NO: 708349 - RNA, 12 nt, Homo sapiens
ucccaagugcca

SEQ ID NO: 708350 - RNA, 13 nt, Homo sapiens
ucccaggcacucu

SEQ ID NO: 708351 - RNA, 16 nt, Homo sapiens
uccccuggcacuggca

SEQ ID NO: 708352 - RNA, 16 nt, Homo sapiens
ucccuuccccacaaua

SEQ ID NO: 708353 - RNA, 16 nt, Homo sapiens
ucuagacaaaaaccau

SEQ ID NO: 708354 - RNA, 11 nt, Homo sapiens
ucucauuccca

SEQ ID NO: 708355 - RNA, 15 nt, Homo sapiens
ucuggggucugugau

SEQ ID NO: 708356 - RNA, 14 nt, Homo sapiens
ucuuaaugucucaa

SEQ ID NO: 708357 - RNA, 23 nt, Homo sapiens
ucuuuccuggacuuaacucuaau

SEQ ID NO: 708358 - RNA, 15 nt, Homo sapiens
ucuuuucaaccuacu

SEQ ID NO: 708359 - RNA, 16 nt, Homo sapiens
ugagggagaugccaug

SEQ ID NO: 708360 - RNA, 18 nt, Homo sapiens
ugaucgcuucucccccac

SEQ ID NO: 708361 - RNA, 13 nt, Homo sapiens
ugaugauguucug

SEQ ID NO: 708362 - RNA, 20 nt, Homo sapiens
ugauugcuuaucaguaguau

SEQ ID NO: 708363 - RNA, 19 nt, Homo sapiens
ugauuguguuuauugauga

SEQ ID NO: 708364 - RNA, 21 nt, Homo sapiens
ccuccuuacauaugcaaaaau

SEQ ID NO: 708365 - RNA, 19 nt, Homo sapiens
ccucuuagaagaaauauga

SEQ ID NO: 708366 - RNA, 17 nt, Homo sapiens
ccugaaucagaggcaga

SEQ ID NO: 708367 - RNA, 22 nt, Homo sapiens
ccugggcauacuaauaaaguau

SEQ ID NO: 708368 - RNA, 21 nt, Homo sapiens
ccuguagaugacauggugaaa

SEQ ID NO: 708369 - RNA, 19 nt, Homo sapiens
cgcacugggcauuggguaa

SEQ ID NO: 708370 - RNA, 19 nt, Homo sapiens
cuagaaagagaaaaagccc

SEQ ID NO: 708371 - RNA, 13 nt, Homo sapiens
cuauuugaagcau

SEQ ID NO: 708372 - RNA, 18 nt, Homo sapiens
cucagacaccuagacucu

SEQ ID NO: 708373 - RNA, 20 nt, Homo sapiens
cucaguguaccacuacuuag

SEQ ID NO: 708374 - RNA, 23 nt, Homo sapiens
cucuaauucuagagucucuguua

SEQ ID NO: 708375 - RNA, 20 nt, Homo sapiens
cucuaauuguccauucuugc

SEQ ID NO: 708376 - RNA, 20 nt, Homo sapiens
cucuucaugcgcagucccca

SEQ ID NO: 708377 - RNA, 14 nt, Homo sapiens
cugaacucccaguc

SEQ ID NO: 708378 - RNA, 15 nt, Homo sapiens
cugaagcagagucaa

SEQ ID NO: 708379 - RNA, 20 nt, Homo sapiens
cugccuauuaguaguuaauu

SEQ ID NO: 708380 - RNA, 15 nt, Homo sapiens
cugcuccuccaguac

SEQ ID NO: 708381 - RNA, 15 nt, Homo sapiens
cuguggaugcugcug

SEQ ID NO: 708382 - RNA, 16 nt, Homo sapiens
cuuaaaugaucaagga

SEQ ID NO: 708383 - RNA, 15 nt, Homo sapiens
cuuaauaaguauuua

SEQ ID NO: 708384 - RNA, 20 nt, Homo sapiens
cuuccugaacucccagucau

SEQ ID NO: 708385 - RNA, 18 nt, Homo sapiens
cuucuaguggguuuaaug

SEQ ID NO: 708386 - RNA, 22 nt, Homo sapiens
cuugcccagccuggaugccauc

SEQ ID NO: 708387 - RNA, 20 nt, Homo sapiens
cuugcuugacucuacuauua

SEQ ID NO: 708388 - RNA, 20 nt, Homo sapiens
cuuuccucuuaaugucucaa

SEQ ID NO: 708389 - RNA, 23 nt, Homo sapiens
cuuuccucuuaaugucucaaaau

SEQ ID NO: 708390 - RNA, 20 nt, Homo sapiens
gaaaagagauggccugagaa

SEQ ID NO: 708391 - RNA, 22 nt, Homo sapiens
gaacacguuuuuucacuauuaa

SEQ ID NO: 708392 - RNA, 21 nt, Homo sapiens
gaagagacguuuaaaagccau

SEQ ID NO: 708393 - RNA, 22 nt, Homo sapiens
gacaaaucuaugccacucagaa

SEQ ID NO: 708394 - RNA, 13 nt, Homo sapiens
gacugauggugaa

SEQ ID NO: 708395 - RNA, 19 nt, Homo sapiens
gacugucaguaggcuggaa

SEQ ID NO: 708396 - RNA, 13 nt, Homo sapiens
gacuuaacucuaa

SEQ ID NO: 708397 - RNA, 18 nt, Homo sapiens
gagaaaaagcccucuuca

SEQ ID NO: 708398 - RNA, 13 nt, Homo sapiens
gagacgaugcuuu

SEQ ID NO: 708399 - RNA, 14 nt, Homo sapiens
gagacugucaguag

SEQ ID NO: 708400 - RNA, 14 nt, Homo sapiens
gagagcagccucuu

SEQ ID NO: 708401 - RNA, 14 nt, Homo sapiens
gagcagccucuuga

SEQ ID NO: 708402 - RNA, 22 nt, Homo sapiens
gagcagccucuugaaugcuuaa

SEQ ID NO: 708403 - RNA, 19 nt, Homo sapiens
gagcaugcucccucaugca

SEQ ID NO: 708404 - RNA, 15 nt, Homo sapiens
gagggagaugccaug

SEQ ID NO: 708405 - RNA, 21 nt, Homo sapiens
gaguaaguguaagaaaaugau

SEQ ID NO: 708406 - RNA, 17 nt, Homo sapiens
gaguauguuauuucucu

SEQ ID NO: 708407 - RNA, 15 nt, Homo sapiens
gaguuauuuuguguc

SEQ ID NO: 708408 - RNA, 20 nt, Homo sapiens
gaugucaaaaacuucaauau

SEQ ID NO: 708409 - RNA, 18 nt, Homo sapiens
gauuauagugacaaugaa

SEQ ID NO: 708410 - RNA, 21 nt, Homo sapiens
gauugagagcagccucuugaa

SEQ ID NO: 708411 - RNA, 15 nt, Homo sapiens
gcaaaaauauaccuu

SEQ ID NO: 708412 - RNA, 15 nt, Homo sapiens
gcaacaaacucaaaa

SEQ ID NO: 708413 - RNA, 20 nt, Homo sapiens
gcacagcaggcugccagugc

SEQ ID NO: 708414 - RNA, 22 nt, Homo sapiens
gcacagcaggcugccagugccu

SEQ ID NO: 708415 - RNA, 19 nt, Homo sapiens
gcccagccuaucucucuuc

SEQ ID NO: 708416 - RNA, 19 nt, Homo sapiens
gcccccuguggaugcugcu

SEQ ID NO: 708417 - RNA, 16 nt, Homo sapiens
gccccucuuagaagaa

SEQ ID NO: 708418 - RNA, 22 nt, Homo sapiens
gccuggaugcccccuguggaug

SEQ ID NO: 708419 - RNA, 16 nt, Homo sapiens
gccuuccccuggcacu

SEQ ID NO: 708420 - RNA, 20 nt, Homo sapiens
gccuugcccagccuggaugc

SEQ ID NO: 708421 - RNA, 20 nt, Homo sapiens
gcuagaaagagaaaaagccc

SEQ ID NO: 708422 - RNA, 18 nt, Homo sapiens
gcucuguggcgagccauu

SEQ ID NO: 708423 - RNA, 13 nt, Homo sapiens
gcuuaauaaguau

SEQ ID NO: 708424 - RNA, 14 nt, Homo sapiens
ggaagucagacuuu

SEQ ID NO: 708425 - RNA, 15 nt, Homo sapiens
ggcacaacaucaagc

SEQ ID NO: 708426 - RNA, 22 nt, Homo sapiens
ggccugagaagagagaucaaau

SEQ ID NO: 708427 - RNA, 23 nt, Homo sapiens
ggcgagccauuugucccaagugc

SEQ ID NO: 708428 - RNA, 19 nt, Homo sapiens
gggccaccgccuugcccag

SEQ ID NO: 708429 - RNA, 15 nt, Homo sapiens
guaccacuacuuaga

SEQ ID NO: 708430 - RNA, 13 nt, Homo sapiens
guacucugagucc

SEQ ID NO: 708431 - RNA, 17 nt, Homo sapiens
guagaugacauggugaa

SEQ ID NO: 708432 - RNA, 14 nt, Homo sapiens
guaugccaagugaa

SEQ ID NO: 708433 - RNA, 15 nt, Homo sapiens
guccucauuguucag

SEQ ID NO: 708434 - RNA, 20 nt, Homo sapiens
gucggccccaccagugccuc

SEQ ID NO: 708435 - RNA, 14 nt, Homo sapiens
gucugucucucuuu

SEQ ID NO: 708436 - RNA, 23 nt, Homo sapiens
gugaucuguccuuccaaccuguu

SEQ ID NO: 708437 - RNA, 18 nt, Homo sapiens
gugcaacaaacucaaaau

SEQ ID NO: 708438 - RNA, 22 nt, Homo sapiens
gugcaugccuggcacaacauca

SEQ ID NO: 708439 - RNA, 21 nt, Homo sapiens
gugccaaagaagcagaccauu

SEQ ID NO: 708440 - RNA, 17 nt, Homo sapiens
guggaccaguucccuca

SEQ ID NO: 708441 - RNA, 16 nt, Homo sapiens
guuauuaacagcugau

SEQ ID NO: 708442 - RNA, 17 nt, Homo sapiens
guucacuucagcuuaau

SEQ ID NO: 708443 - RNA, 16 nt, Homo sapiens
guucagaaaagcaccu

SEQ ID NO: 708444 - RNA, 22 nt, Homo sapiens
guucagaaaagcaccucuugaa

SEQ ID NO: 708445 - RNA, 19 nt, Homo sapiens
guugcuuccuaacauccuu

SEQ ID NO: 708446 - RNA, 11 nt, Homo sapiens
guuguugccaa

SEQ ID NO: 708447 - RNA, 20 nt, Homo sapiens
guuuaaaagccaucaaacac

SEQ ID NO: 708448 - RNA, 15 nt, Homo sapiens
guuuaauguuuaguc

SEQ ID NO: 708449 - RNA, 22 nt, Homo sapiens
guuugaaaauaguuaccuucaa

SEQ ID NO: 708450 - RNA, 16 nt, Homo sapiens
guuuugacaucaauga

SEQ ID NO: 708451 - RNA, 14 nt, Homo sapiens
uaaaauacauaaua

SEQ ID NO: 708452 - RNA, 23 nt, Homo sapiens
uaaaaugaccaguaauugugaaa

SEQ ID NO: 708453 - RNA, 23 nt, Homo sapiens
uaauucuagagucucuguuacug

SEQ ID NO: 708454 - RNA, 20 nt, Homo sapiens
uaauugugaaaauuacaguu

SEQ ID NO: 708455 - RNA, 14 nt, Homo sapiens
uacaaaauauccaa

SEQ ID NO: 708456 - RNA, 24 nt, Homo sapiens
uacagcagcaugcauucauaacag

SEQ ID NO: 708457 - RNA, 13 nt, Homo sapiens
uaccacuacuuag

SEQ ID NO: 708458 - RNA, 16 nt, Homo sapiens
uaccugggcauacuaa

SEQ ID NO: 708459 - RNA, 13 nt, Homo sapiens
uacuuacguguga

SEQ ID NO: 708460 - RNA, 14 nt, Homo sapiens
uacuuucauacuga

SEQ ID NO: 708461 - RNA, 21 nt, Homo sapiens
uagucaguguacucugagucc

SEQ ID NO: 708462 - RNA, 14 nt, Homo sapiens
uauaaaauacauaa

SEQ ID NO: 708463 - RNA, 15 nt, Homo sapiens
uauagugacaaugaa

SEQ ID NO: 708464 - RNA, 14 nt, Homo sapiens
uauauuuuggcuca

SEQ ID NO: 708465 - RNA, 19 nt, Homo sapiens
uaucaugcuucuacuccau

SEQ ID NO: 708466 - RNA, 12 nt, Homo sapiens
uauguaucauaa

SEQ ID NO: 708467 - RNA, 19 nt, Homo sapiens
uauugaugauguugaacaa

SEQ ID NO: 708468 - RNA, 20 nt, Homo sapiens
ucaaugauuuacucaauauc

SEQ ID NO: 708469 - RNA, 18 nt, Homo sapiens
ucacaugccccucuuaga

SEQ ID NO: 708470 - RNA, 14 nt, Homo sapiens
ucaccacuacauca

SEQ ID NO: 708471 - RNA, 17 nt, Homo sapiens
ucagcuuauaaaaucaa

SEQ ID NO: 708472 - RNA, 21 nt, Homo sapiens
ucaguguacucugaguccuca

SEQ ID NO: 708473 - RNA, 13 nt, Homo sapiens
ucauaaacaaaga

SEQ ID NO: 708474 - RNA, 19 nt, Homo sapiens
ucauccucuuauaugugcc

SEQ ID NO: 708475 - RNA, 21 nt, Homo sapiens
ucauucccaggcacucucuuu

SEQ ID NO: 708476 - RNA, 21 nt, Homo sapiens
ucauuguucagaaaagcaccu

SEQ ID NO: 708477 - RNA, 13 nt, Homo sapiens
uccacuucuuuca

SEQ ID NO: 708478 - RNA, 16 nt, Homo sapiens
uccaguugucuauuca

SEQ ID NO: 708479 - RNA, 21 nt, Homo sapiens
ucccaugagggagaugccaug

SEQ ID NO: 708480 - RNA, 23 nt, Homo sapiens
ucccugucugucugucucucuuu

SEQ ID NO: 708481 - RNA, 21 nt, Homo sapiens
ucccuuccccacaauaggcuu

SEQ ID NO: 708482 - RNA, 23 nt, Homo sapiens
uccuaacauccuuggacugagaa

SEQ ID NO: 708483 - RNA, 16 nt, Homo sapiens
uccucaauuccaggga

SEQ ID NO: 708484 - RNA, 14 nt, Homo sapiens
uccugaacucccag

SEQ ID NO: 708485 - RNA, 19 nt, Homo sapiens
uccuuacauaugcaaaaau

SEQ ID NO: 708486 - RNA, 23 nt, Homo sapiens
ucucaaaauaaaaccagaaagag

SEQ ID NO: 708487 - RNA, 16 nt, Homo sapiens
ucucauucccaggcac

SEQ ID NO: 708488 - RNA, 22 nt, Homo sapiens
ucuguaaguugcuuccuaacau

SEQ ID NO: 708489 - RNA, 15 nt, Homo sapiens
ucuuaaugucucaaa

SEQ ID NO: 708490 - RNA, 17 nt, Homo sapiens
ucuuagaagaaauauga

SEQ ID NO: 708491 - RNA, 17 nt, Homo sapiens
ucuuucggaaaugauug

SEQ ID NO: 708492 - RNA, 21 nt, Homo sapiens
ugaacacguuuuuucacuauu

SEQ ID NO: 708493 - RNA, 16 nt, Homo sapiens
ugacugauggugaaau

SEQ ID NO: 708494 - RNA, 19 nt, Homo sapiens
ugaguucccuugauucaaa

SEQ ID NO: 708495 - RNA, 21 nt, Homo sapiens
ugaguugugugaauaccccaa

SEQ ID NO: 708496 - RNA, 17 nt, Homo sapiens
ugaugaggcagaugccu

SEQ ID NO: 708497 - RNA, 23 nt, Homo sapiens
ugauguccaaacuuaacagauca

SEQ ID NO: 708498 - RNA, 14 nt, Homo sapiens
ugauucugaaucaa

SEQ ID NO: 708499 - RNA, 22 nt, Homo sapiens
ugcauucauucauccucuuaua

SEQ ID NO: 708500 - RNA, 18 nt, Homo sapiens
ugccucucccugcugcuc

SEQ ID NO: 708501 - RNA, 21 nt, Homo sapiens
ugcuccuaggacccgucucca

SEQ ID NO: 708502 - RNA, 17 nt, Homo sapiens
uggguaucaugcuucua

SEQ ID NO: 708503 - RNA, 15 nt, Homo sapiens
uggguuuggcuuguu

SEQ ID NO: 708504 - RNA, 18 nt, Homo sapiens
uguauaagaugcugcuga

SEQ ID NO: 708505 - RNA, 23 nt, Homo sapiens
uguccucaguguaccacuacuua

SEQ ID NO: 708506 - RNA, 18 nt, Homo sapiens
ugucucaaaauaaaacca

SEQ ID NO: 708507 - RNA, 22 nt, Homo sapiens
ugugauuccuuugaagaggaaa

SEQ ID NO: 708508 - RNA, 16 nt, Homo sapiens
uguggaccaguucccu

SEQ ID NO: 708509 - RNA, 14 nt, Homo sapiens
uuaaguauauauau

SEQ ID NO: 708510 - RNA, 13 nt, Homo sapiens
uuaaguuugaaaa

SEQ ID NO: 708511 - RNA, 18 nt, Homo sapiens
uuacuucuggcauaacua

SEQ ID NO: 708512 - RNA, 19 nt, Homo sapiens
uuagucaguguacucugag

SEQ ID NO: 708513 - RNA, 16 nt, Homo sapiens
uuauauaaaauacaua

SEQ ID NO: 708514 - RNA, 13 nt, Homo sapiens
uuaucaguaguau

SEQ ID NO: 708515 - RNA, 23 nt, Homo sapiens
uuauggaaggacuacagcagcau

SEQ ID NO: 708516 - RNA, 20 nt, Homo sapiens
uucaauccccauaaugcuuc

SEQ ID NO: 708517 - RNA, 23 nt, Homo sapiens
uucauacugaagaugcagcaaaa

SEQ ID NO: 708518 - RNA, 23 nt, Homo sapiens
uucauggaguagagucaggagaa

SEQ ID NO: 708519 - RNA, 18 nt, Homo sapiens
uuccugcuccuccaguac

SEQ ID NO: 708520 - RNA, 22 nt, Homo sapiens
uucuaguggguuuaauguuuag

SEQ ID NO: 708521 - RNA, 17 nt, Homo sapiens
uucugcugaugcuacug

SEQ ID NO: 708522 - RNA, 13 nt, Homo sapiens
uugaaaauaguua

SEQ ID NO: 708523 - RNA, 18 nt, Homo sapiens
uugaaugcuuaaaugauc

SEQ ID NO: 708524 - RNA, 13 nt, Homo sapiens
uugacucuacuau

SEQ ID NO: 708525 - RNA, 20 nt, Homo sapiens
uugcccagccuggaugccau

SEQ ID NO: 708526 - RNA, 16 nt, Homo sapiens
uugucccaagugccaa

SEQ ID NO: 708527 - RNA, 17 nt, Homo sapiens
uuguguacaaaauaucc

SEQ ID NO: 708528 - RNA, 23 nt, Homo sapiens
uuucaaucaaaacucaguaucau

SEQ ID NO: 708529 - RNA, 22 nt, Homo sapiens
uuuccucuuaaugucucaaaau

SEQ ID NO: 708530 - RNA, 17 nt, Homo sapiens
uuuccugcuccuccagu

SEQ ID NO: 708531 - RNA, 23 nt, Homo sapiens
uuuucaauuuugaaaacucuaau

SEQ ID NO: 708532 - RNA, 23 nt, Homo sapiens
uuuugacaucaaugaugaggcuc

SEQ ID NO: 708533 - RNA, 22 nt, Homo sapiens
cccacaccauaagcuacugcca

SEQ ID NO: 708534 - RNA, 12 nt, Homo sapiens
cccaccagugcc

SEQ ID NO: 708535 - RNA, 14 nt, Homo sapiens
cccaccagugccuc

SEQ ID NO: 708536 - RNA, 21 nt, Homo sapiens
ccccagguaucugaugauguu

SEQ ID NO: 708537 - RNA, 23 nt, Homo sapiens
ccccaucugcgggggcagugcuc

SEQ ID NO: 708538 - RNA, 21 nt, Homo sapiens
ccucaguguaccacuacuuag

SEQ ID NO: 708539 - RNA, 18 nt, Homo sapiens
ccuccuuacauaugcaaa

SEQ ID NO: 708540 - RNA, 13 nt, Homo sapiens
aaaauaguuaccu

SEQ ID NO: 708541 - RNA, 23 nt, Homo sapiens
aaaauauaccuucagagacuguc

SEQ ID NO: 708542 - RNA, 15 nt, Homo sapiens
aaacaaagaguagaa

SEQ ID NO: 708543 - RNA, 23 nt, Homo sapiens
aaacauuuucuugaauggcaugc

SEQ ID NO: 708544 - RNA, 23 nt, Homo sapiens
aaaccaauuuguucugugcaaca

SEQ ID NO: 708545 - RNA, 14 nt, Homo sapiens
aaacucaguaucau

SEQ ID NO: 708546 - RNA, 18 nt, Homo sapiens
aaagaacucagugcugcc

SEQ ID NO: 708547 - RNA, 21 nt, Homo sapiens
accaugaacacguuuuuucac

SEQ ID NO: 708548 - RNA, 14 nt, Homo sapiens
acccugaaucagag

SEQ ID NO: 708549 - RNA, 17 nt, Homo sapiens
accuacuuucauacuga

SEQ ID NO: 708550 - RNA, 18 nt, Homo sapiens
accucuugaagaacugac

SEQ ID NO: 708551 - RNA, 14 nt, Homo sapiens
acuacaucacuuga

SEQ ID NO: 708552 - RNA, 22 nt, Homo sapiens
acuccuuacagaagggagugaa

SEQ ID NO: 708553 - RNA, 14 nt, Homo sapiens
acucuaaaacuauc

SEQ ID NO: 708554 - RNA, 18 nt, Homo sapiens
acugaaaacuugccguua

SEQ ID NO: 708555 - RNA, 18 nt, Homo sapiens
acugagaaauuauacuua

SEQ ID NO: 708556 - RNA, 23 nt, Homo sapiens
acuucuggcauaacuaaaauuaa

SEQ ID NO: 708557 - RNA, 15 nt, Homo sapiens
acuuuuaaguacuua

SEQ ID NO: 708558 - RNA, 17 nt, Homo sapiens
agaaauuauacuuacuu

SEQ ID NO: 708559 - RNA, 14 nt, Homo sapiens
agaagcagaccauu

SEQ ID NO: 708560 - RNA, 13 nt, Homo sapiens
agaagcagcagcu

SEQ ID NO: 708561 - RNA, 20 nt, Homo sapiens
agaccauuggggcucccagc

SEQ ID NO: 708562 - RNA, 13 nt, Homo sapiens
agacugucaguag

SEQ ID NO: 708563 - RNA, 20 nt, Homo sapiens
agagaaaaagcccucuucaa

SEQ ID NO: 708564 - RNA, 17 nt, Homo sapiens
agagucaagcugaugaa

SEQ ID NO: 708565 - RNA, 14 nt, Homo sapiens
agccuggaugccau

SEQ ID NO: 708566 - RNA, 15 nt, Homo sapiens
agccuggaugccauc

SEQ ID NO: 708567 - RNA, 18 nt, Homo sapiens
agccuuuaauaggcuugu

SEQ ID NO: 708568 - RNA, 22 nt, Homo sapiens
agcuacugccauccuggcccag

SEQ ID NO: 708569 - RNA, 15 nt, Homo sapiens
aggaaaaugaauaau

SEQ ID NO: 708570 - RNA, 15 nt, Homo sapiens
aggacccacuuccug

SEQ ID NO: 708571 - RNA, 16 nt, Homo sapiens
aggcugccagugccug

SEQ ID NO: 708572 - RNA, 15 nt, Homo sapiens
agggggcugcuccca

SEQ ID NO: 708573 - RNA, 14 nt, Homo sapiens
agguaucugaugau

SEQ ID NO: 708574 - RNA, 14 nt, Homo sapiens
aguauacacaucau

SEQ ID NO: 708575 - RNA, 16 nt, Homo sapiens
aguguaccacuacuua

SEQ ID NO: 708576 - RNA, 12 nt, Homo sapiens
aguucacuucag

SEQ ID NO: 708577 - RNA, 19 nt, Homo sapiens
auaaaagaaagaugcugau

SEQ ID NO: 708578 - RNA, 16 nt, Homo sapiens
auaggcuuagugcuug

SEQ ID NO: 708579 - RNA, 17 nt, Homo sapiens
auaguauacacaucaua

SEQ ID NO: 708580 - RNA, 22 nt, Homo sapiens
auaguggacaguaaccuuucaa

SEQ ID NO: 708581 - RNA, 15 nt, Homo sapiens
auaguuaccuucaaa

SEQ ID NO: 708582 - RNA, 18 nt, Homo sapiens
aucaaacacaaugccuca

SEQ ID NO: 708583 - RNA, 15 nt, Homo sapiens
auccacuucuuucag

SEQ ID NO: 708584 - RNA, 15 nt, Homo sapiens
augaagaugaugcua

SEQ ID NO: 708585 - RNA, 18 nt, Homo sapiens
augaccaguaauugugaa

SEQ ID NO: 708586 - RNA, 14 nt, Homo sapiens
augauuaagugcuu

SEQ ID NO: 708587 - RNA, 17 nt, Homo sapiens
augcagcaaaaugugaa

SEQ ID NO: 708588 - RNA, 16 nt, Homo sapiens
augcccccuguggaug

SEQ ID NO: 708589 - RNA, 22 nt, Homo sapiens
augcccccuguggaugcugcug

SEQ ID NO: 708590 - RNA, 18 nt, Homo sapiens
auggcuggagugauucug

SEQ ID NO: 708591 - RNA, 21 nt, Homo sapiens
auguccucaguguaccacuac

SEQ ID NO: 708592 - RNA, 23 nt, Homo sapiens
auguugguacccuggacagugcc

SEQ ID NO: 708593 - RNA, 21 nt, Homo sapiens
auuauauaaaauacauaauau

SEQ ID NO: 708594 - RNA, 13 nt, Homo sapiens
auucuagagucuc

SEQ ID NO: 708595 - RNA, 12 nt, Homo sapiens
auucugcugaug

SEQ ID NO: 708596 - RNA, 15 nt, Homo sapiens
auucugcugaugcua

SEQ ID NO: 708597 - RNA, 18 nt, Homo sapiens
auucugcugaugcuacug

SEQ ID NO: 708598 - RNA, 23 nt, Homo sapiens
auugaaguuuugacaucaaugau

SEQ ID NO: 708599 - RNA, 21 nt, Homo sapiens
caaaaauauaccuucagagac

SEQ ID NO: 708600 - RNA, 16 nt, Homo sapiens
caaaacucaguaucau

SEQ ID NO: 708601 - RNA, 16 nt, Homo sapiens
caagacucccaugagg

SEQ ID NO: 708602 - RNA, 18 nt, Homo sapiens
caagccugugauuguguu

SEQ ID NO: 708603 - RNA, 22 nt, Homo sapiens
cacagcaggcugccagugccug

SEQ ID NO: 708604 - RNA, 19 nt, Homo sapiens
caccauaagcuacugccau

SEQ ID NO: 708605 - RNA, 17 nt, Homo sapiens
cagagucaagcugauga

SEQ ID NO: 708606 - RNA, 19 nt, Homo sapiens
cagcaggcugccagugccu

SEQ ID NO: 708607 - RNA, 20 nt, Homo sapiens
cagcaggcugccagugccug

SEQ ID NO: 708608 - RNA, 16 nt, Homo sapiens
cagccuggaugccauc

SEQ ID NO: 708609 - RNA, 17 nt, Homo sapiens
cagccuggaugccaucc

SEQ ID NO: 708610 - RNA, 23 nt, Homo sapiens
cagcuagaaagagaaaaagcccu

SEQ ID NO: 708611 - RNA, 23 nt, Homo sapiens
cagcuuaauaaguauuuauugca

SEQ ID NO: 708612 - RNA, 19 nt, Homo sapiens
guccaaacuuaacagauca

SEQ ID NO: 708613 - RNA, 22 nt, Homo sapiens
guccaggagaugaggcuggaua

SEQ ID NO: 708614 - RNA, 20 nt, Homo sapiens
guccuuuaaaaaaaucccau

SEQ ID NO: 708615 - RNA, 20 nt, Homo sapiens
gucucaaaauaaaaccagaa

SEQ ID NO: 708616 - RNA, 15 nt, Homo sapiens
gugaacugaagcaga

SEQ ID NO: 708617 - RNA, 20 nt, Homo sapiens
gugcauucauucauccucuu

SEQ ID NO: 708618 - RNA, 14 nt, Homo sapiens
guguaccacuacuu

SEQ ID NO: 708619 - RNA, 19 nt, Homo sapiens
guuauuaacagcugauaca

SEQ ID NO: 708620 - RNA, 22 nt, Homo sapiens
guuuaaaagccaucaaacacaa

SEQ ID NO: 708621 - RNA, 20 nt, Homo sapiens
guuuuuguuaguucacuuca

SEQ ID NO: 708622 - RNA, 23 nt, Homo sapiens
uaaaaagugccuguagaugacau

SEQ ID NO: 708623 - RNA, 18 nt, Homo sapiens
uaaaaucuguaaaccaua

SEQ ID NO: 708624 - RNA, 18 nt, Homo sapiens
uaaaguaugguauugaaa

SEQ ID NO: 708625 - RNA, 21 nt, Homo sapiens
uaacagccucauugaugucaa

SEQ ID NO: 708626 - RNA, 19 nt, Homo sapiens
uaagcacaaccauguucuu

SEQ ID NO: 708627 - RNA, 14 nt, Homo sapiens
uaagcuacugccau

SEQ ID NO: 708628 - RNA, 16 nt, Homo sapiens
uaagcuacugccaucc

SEQ ID NO: 708629 - RNA, 11 nt, Homo sapiens
uaaugcuucuu

SEQ ID NO: 708630 - RNA, 20 nt, Homo sapiens
uaaugguuuuuguuaguuca

SEQ ID NO: 708631 - RNA, 23 nt, Homo sapiens
uaccacuacuuagagauauguau

SEQ ID NO: 708632 - RNA, 22 nt, Homo sapiens
uacuuacuucuggcauaacuaa

SEQ ID NO: 708633 - RNA, 18 nt, Homo sapiens
uagagauauguaucauaa

SEQ ID NO: 708634 - RNA, 19 nt, Homo sapiens
uagaggguccagucuucua

SEQ ID NO: 708635 - RNA, 16 nt, Homo sapiens
uagagucucuguuacu

SEQ ID NO: 708636 - RNA, 17 nt, Homo sapiens
gaacugaagcagaguca

SEQ ID NO: 708637 - RNA, 14 nt, Homo sapiens
gaauaaaaugauua

SEQ ID NO: 708638 - RNA, 15 nt, Homo sapiens
gaaugcuuaaaugau

SEQ ID NO: 708639 - RNA, 17 nt, Homo sapiens
gaauuugcuuagccuuu

SEQ ID NO: 708640 - RNA, 15 nt, Homo sapiens
gaccuccugaugucu

SEQ ID NO: 708641 - RNA, 18 nt, Homo sapiens
gaccuccuuacauaugca

SEQ ID NO: 708642 - RNA, 21 nt, Homo sapiens
gacugagaaauuauacuuacu

SEQ ID NO: 708643 - RNA, 14 nt, Homo sapiens
gacuuccugaacuc

SEQ ID NO: 708644 - RNA, 11 nt, Homo sapiens
gagaugccaug

SEQ ID NO: 708645 - RNA, 14 nt, Homo sapiens
gagauggccugaga

SEQ ID NO: 708646 - RNA, 15 nt, Homo sapiens
gagcacaucucuuca

SEQ ID NO: 708647 - RNA, 22 nt, Homo sapiens
gagucuggauaauuuguauaag

SEQ ID NO: 708648 - RNA, 14 nt, Homo sapiens
gaugaggcuggaua

SEQ ID NO: 708649 - RNA, 18 nt, Homo sapiens
gauggguaucaugcuucu

SEQ ID NO: 708650 - RNA, 23 nt, Homo sapiens
gauguccaaacuuaacagaucac

SEQ ID NO: 708651 - RNA, 17 nt, Homo sapiens
gauuauagugacaauga

SEQ ID NO: 708652 - RNA, 18 nt, Homo sapiens
gauugagagcagccucuu

SEQ ID NO: 708653 - RNA, 16 nt, Homo sapiens
gauugcuuaucaguag

SEQ ID NO: 708654 - RNA, 16 nt, Homo sapiens
gcacacuuuggcccag

SEQ ID NO: 708655 - RNA, 23 nt, Homo sapiens
gcacagcaggcugccagugccug

SEQ ID NO: 708656 - RNA, 14 nt, Homo sapiens
gcagaccauugggg

SEQ ID NO: 708657 - RNA, 18 nt, Homo sapiens
gcauucauucauccucuu

SEQ ID NO: 708658 - RNA, 19 nt, Homo sapiens
gcccagccuggaugccauc

SEQ ID NO: 708659 - RNA, 13 nt, Homo sapiens
gcccuccaggcuu

SEQ ID NO: 708660 - RNA, 21 nt, Homo sapiens
gccucauugaugucaaaaacu

SEQ ID NO: 708661 - RNA, 16 nt, Homo sapiens
gcugagauccuggacu

SEQ ID NO: 708662 - RNA, 20 nt, Homo sapiens
gcugaugaaguuaagcacaa

SEQ ID NO: 708663 - RNA, 15 nt, Homo sapiens
gcugccagugccugg

SEQ ID NO: 708664 - RNA, 14 nt, Homo sapiens
gcuuaaaugaucaa

SEQ ID NO: 708665 - RNA, 14 nt, Homo sapiens
gcuuauaaaaucaa

SEQ ID NO: 708666 - RNA, 23 nt, Homo sapiens
ggaugcccccuguggaugcugcu

SEQ ID NO: 708667 - RNA, 21 nt, Homo sapiens
ggcauuggguaagggacucca

SEQ ID NO: 708668 - RNA, 14 nt, Homo sapiens
ggccccaccagugc

SEQ ID NO: 708669 - RNA, 11 nt, Homo sapiens
gggaaccagag

SEQ ID NO: 708670 - RNA, 12 nt, Homo sapiens
gggucugugaug

SEQ ID NO: 708671 - RNA, 17 nt, Homo sapiens
gguaucugaugauguuc

SEQ ID NO: 708672 - RNA, 13 nt, Homo sapiens
ggucuaugauguc

SEQ ID NO: 708673 - RNA, 13 nt, Homo sapiens
guaccacuacuua

SEQ ID NO: 708674 - RNA, 14 nt, Homo sapiens
guaguaucaaugau

SEQ ID NO: 708675 - RNA, 20 nt, Homo sapiens
guaucaugcuucuacuccau

SEQ ID NO: 708676 - RNA, 17 nt, Homo sapiens
guauguaacuacaggaa

SEQ ID NO: 708677 - RNA, 16 nt, Homo sapiens
guccccugcccaugcu

SEQ ID NO: 708678 - RNA, 14 nt, Homo sapiens
gugcaacaaacuca

SEQ ID NO: 708679 - RNA, 13 nt, Homo sapiens
guggaugcugcug

SEQ ID NO: 708680 - RNA, 14 nt, Homo sapiens
guucagcaugaagg

SEQ ID NO: 708681 - RNA, 18 nt, Homo sapiens
guuguuauuaacagcuga

SEQ ID NO: 708682 - RNA, 21 nt, Homo sapiens
guuucaccaucagucaaugaa

SEQ ID NO: 708683 - RNA, 15 nt, Homo sapiens
guuuuucuugcaugg

SEQ ID NO: 708684 - RNA, 13 nt, Homo sapiens
guuuuuucacuau

SEQ ID NO: 708685 - RNA, 19 nt, Homo sapiens
uaaaagaaagaugcugaug

SEQ ID NO: 708686 - RNA, 15 nt, Homo sapiens
uaagcuacugccauc

SEQ ID NO: 708687 - RNA, 15 nt, Homo sapiens
uaaguugcuuccuaa

SEQ ID NO: 708688 - RNA, 22 nt, Homo sapiens
uaaugauuauauaaaauacaua

SEQ ID NO: 708689 - RNA, 14 nt, Homo sapiens
uaauuaaacugaug

SEQ ID NO: 708690 - RNA, 17 nt, Homo sapiens
uacaaaauauccaagcc

SEQ ID NO: 708691 - RNA, 21 nt, Homo sapiens
uacauaugcaaaaauauaccu

SEQ ID NO: 708692 - RNA, 18 nt, Homo sapiens
uacuguagacucuggaag

SEQ ID NO: 708693 - RNA, 15 nt, Homo sapiens
uacuuggaauuugcu

SEQ ID NO: 708694 - RNA, 23 nt, Homo sapiens
uagaagagacguuuaaaagccau

SEQ ID NO: 708695 - RNA, 16 nt, Homo sapiens
uagaugacauggugaa

SEQ ID NO: 708696 - RNA, 17 nt, Homo sapiens
uauaaaauacauaauau

SEQ ID NO: 708697 - RNA, 18 nt, Homo sapiens
uauaccugggcauacuaa

SEQ ID NO: 708698 - RNA, 15 nt, Homo sapiens
uauacuuacuucugg

SEQ ID NO: 708699 - RNA, 12 nt, Homo sapiens
uauauucccaaa

SEQ ID NO: 708700 - RNA, 20 nt, Homo sapiens
uauugaaguuuugacaucaa

SEQ ID NO: 708701 - RNA, 17 nt, Homo sapiens
uauuugaagcaugcucu

SEQ ID NO: 708702 - RNA, 14 nt, Homo sapiens
ucaaaacucaguau

SEQ ID NO: 708703 - RNA, 20 nt, Homo sapiens
ucaaaagaucuccugugcac

SEQ ID NO: 708704 - RNA, 22 nt, Homo sapiens
ucaaaauguggaccaguucccu

SEQ ID NO: 708705 - RNA, 21 nt, Homo sapiens
ucaauaucugaaucaccuuga

SEQ ID NO: 708706 - RNA, 18 nt, Homo sapiens
ucaccaucagucaaugaa

SEQ ID NO: 708707 - RNA, 20 nt, Homo sapiens
ucagcaugaaggaugccaua

SEQ ID NO: 708708 - RNA, 17 nt, Homo sapiens
ucaguaguaucaaugau

SEQ ID NO: 708709 - RNA, 22 nt, Homo sapiens
uccaggagaugaggcuggauag

SEQ ID NO: 708710 - RNA, 16 nt, Homo sapiens
ucccaaaucucaaaag

SEQ ID NO: 708711 - RNA, 13 nt, Homo sapiens
ucccaagugccaa

SEQ ID NO: 708712 - RNA, 19 nt, Homo sapiens
ucccaugagggagaugcca

SEQ ID NO: 708713 - RNA, 20 nt, Homo sapiens
ucccaugagggagaugccau

SEQ ID NO: 708714 - RNA, 19 nt, Homo sapiens
ucccucagcccucauuaaa

SEQ ID NO: 708715 - RNA, 17 nt, Homo sapiens
uccugaacucccaguca

SEQ ID NO: 708716 - RNA, 18 nt, Homo sapiens
ucuccugugcaccugacu

SEQ ID NO: 708717 - RNA, 16 nt, Homo sapiens
ucugaaucaaggugau

SEQ ID NO: 708718 - RNA, 19 nt, Homo sapiens
ucugcggagcacacuggcu

SEQ ID NO: 708719 - RNA, 18 nt, Homo sapiens
ucugugcaacaaacucaa

SEQ ID NO: 708720 - RNA, 13 nt, Homo sapiens
ucuuaaugucuca

SEQ ID NO: 708721 - RNA, 21 nt, Homo sapiens
ucuugaaugcuuaaaugauca

SEQ ID NO: 708722 - RNA, 15 nt, Homo sapiens
ucuuggggaagauac

SEQ ID NO: 708723 - RNA, 16 nt, Homo sapiens
ucuugguuuccaucaa

SEQ ID NO: 708724 - RNA, 18 nt, Homo sapiens
ucuuucggaaaugauuga

SEQ ID NO: 708725 - RNA, 17 nt, Homo sapiens
uugauuguuguuauuaa

SEQ ID NO: 708726 - RNA, 22 nt, Homo sapiens
uugcuuagccuuuaauaggcuu

SEQ ID NO: 708727 - RNA, 19 nt, Homo sapiens
uuggguaagggacuccaga

SEQ ID NO: 708728 - RNA, 17 nt, Homo sapiens
uuugcucucucauuccc

SEQ ID NO: 708729 - RNA, 17 nt, Homo sapiens
uuuguaccuguaggucu

SEQ ID NO: 708730 - RNA, 16 nt, Homo sapiens
uuugucccaagugcca

SEQ ID NO: 708731 - RNA, 12 nt, Homo sapiens
uuugugaucugu

SEQ ID NO: 708732 - RNA, 19 nt, Homo sapiens
aucaaacacaaugccucau

SEQ ID NO: 708733 - RNA, 16 nt, Homo sapiens
aucuaugccacucaga

SEQ ID NO: 708734 - RNA, 18 nt, Homo sapiens
augaauaauacauugaau

SEQ ID NO: 708735 - RNA, 18 nt, Homo sapiens
augaugcuauuaauacug

SEQ ID NO: 708736 - RNA, 21 nt, Homo sapiens
augauuuacucaauaucugaa

SEQ ID NO: 708737 - RNA, 17 nt, Homo sapiens
augccacucagaaucuc

SEQ ID NO: 708738 - RNA, 21 nt, Homo sapiens
augcccccuguggaugcugcu

SEQ ID NO: 708739 - RNA, 20 nt, Homo sapiens
augcuacugcugccuaguua

SEQ ID NO: 708740 - RNA, 22 nt, Homo sapiens
augcugcugagcacaucucuuc

SEQ ID NO: 708741 - RNA, 14 nt, Homo sapiens
augcuuaaaugauc

SEQ ID NO: 708742 - RNA, 14 nt, Homo sapiens
auguaacuacagga

SEQ ID NO: 708743 - RNA, 19 nt, Homo sapiens
auuauacuuacuucuggca

SEQ ID NO: 708744 - RNA, 14 nt, Homo sapiens
auuauagugacaau

SEQ ID NO: 708745 - RNA, 23 nt, Homo sapiens
auucaaauaacccugaaucagag

SEQ ID NO: 708746 - RNA, 20 nt, Homo sapiens
auugaugucaaaaacuucaa

SEQ ID NO: 708747 - RNA, 16 nt, Homo sapiens
auugcauauuugcuau

SEQ ID NO: 708748 - RNA, 22 nt, Homo sapiens
auuggaucaggaacccuuacag

SEQ ID NO: 708749 - RNA, 18 nt, Homo sapiens
auuugucccaagugccaa

SEQ ID NO: 708750 - RNA, 21 nt, Homo sapiens
caaaaaaaguucagcaugaag

SEQ ID NO: 708751 - RNA, 15 nt, Homo sapiens
caaccuacuuucaua

SEQ ID NO: 708752 - RNA, 24 nt, Homo sapiens
caauuuugaaaacucuaauugucc

SEQ ID NO: 708753 - RNA, 14 nt, Homo sapiens
cacaaugccucauc

SEQ ID NO: 708754 - RNA, 19 nt, Homo sapiens
cacaugccccucuuagaag

SEQ ID NO: 708755 - RNA, 23 nt, Homo sapiens
caccaucagucaaugaauaacag

SEQ ID NO: 708756 - RNA, 17 nt, Homo sapiens
cacucagaaucuccuuc

SEQ ID NO: 708757 - RNA, 23 nt, Homo sapiens
cacuucagcuuaauaaguauuua

SEQ ID NO: 708758 - RNA, 14 nt, Homo sapiens
cacuuggaacacaa

SEQ ID NO: 708759 - RNA, 15 nt, Homo sapiens
cagaagggagugaaa

SEQ ID NO: 708760 - RNA, 15 nt, Homo sapiens
cagacaccuagacuc

SEQ ID NO: 708761 - RNA, 13 nt, Homo sapiens
cagcaaaauguga

SEQ ID NO: 708762 - RNA, 19 nt, Homo sapiens
cagcaugcauucauaacag

SEQ ID NO: 708763 - RNA, 21 nt, Homo sapiens
caggagaaaccccugacaccu

SEQ ID NO: 708764 - RNA, 19 nt, Homo sapiens
caguacaauaaauaaaaga

SEQ ID NO: 708765 - RNA, 12 nt, Homo sapiens
caguaguaucaa

SEQ ID NO: 708766 - RNA, 13 nt, Homo sapiens
cagugccuaacuc

SEQ ID NO: 708767 - RNA, 22 nt, Homo sapiens
caguuugugaucuguccuucca

SEQ ID NO: 708768 - RNA, 15 nt, Homo sapiens
cauaacagaacaaga

SEQ ID NO: 708769 - RNA, 19 nt, Homo sapiens
cauauguaaggaagucaga

SEQ ID NO: 708770 - RNA, 11 nt, Homo sapiens
caucaaugaug

SEQ ID NO: 708771 - RNA, 22 nt, Homo sapiens
caugcagauaguauacacauca

SEQ ID NO: 708772 - RNA, 15 nt, Homo sapiens
caugcgcagucccca

SEQ ID NO: 708773 - RNA, 22 nt, Homo sapiens
cauucuugcuugacucuacuau

SEQ ID NO: 708774 - RNA, 13 nt, Homo sapiens
ccacuucuuucag

SEQ ID NO: 708775 - RNA, 23 nt, Homo sapiens
ccagugccucucccugcugcucc

SEQ ID NO: 708776 - RNA, 17 nt, Homo sapiens
ccauaagcuacugccau

SEQ ID NO: 708777 - RNA, 20 nt, Homo sapiens
ccaugaacacguuuuuucac

SEQ ID NO: 708778 - RNA, 19 nt, Homo sapiens
ccaugcucagcucagcauu

SEQ ID NO: 708779 - RNA, 17 nt, Homo sapiens
cccaaaucucaaaagau

SEQ ID NO: 708780 - RNA, 23 nt, Homo sapiens
cccacaccauaagcuacugccau

SEQ ID NO: 708781 - RNA, 17 nt, Homo sapiens
cccagccuggaugccau

SEQ ID NO: 708782 - RNA, 13 nt, Homo sapiens
cccagguaucuga

SEQ ID NO: 708783 - RNA, 20 nt, Homo sapiens
cccaugagggagaugccaug

SEQ ID NO: 708784 - RNA, 16 nt, Homo sapiens
ccccuggcacuggcaa

SEQ ID NO: 708785 - RNA, 17 nt, Homo sapiens
cccucaccccuccaagc

SEQ ID NO: 708786 - RNA, 22 nt, Homo sapiens
ccuaacauccuuggacugagaa

SEQ ID NO: 708787 - RNA, 20 nt, Homo sapiens
ccuagacucuaaaacuauca

SEQ ID NO: 708788 - RNA, 18 nt, Homo sapiens
ccucucccugcugcuccu

SEQ ID NO: 708789 - RNA, 19 nt, Homo sapiens
ccucuugaaugcuuaaaug

SEQ ID NO: 708790 - RNA, 22 nt, Homo sapiens
ccugaugucuugguuuccauca

SEQ ID NO: 708791 - RNA, 21 nt, Homo sapiens
ccuggcccagggcaucuggga

SEQ ID NO: 708792 - RNA, 23 nt, Homo sapiens
ccuuccccacaauaggcuuagug

SEQ ID NO: 708793 - RNA, 16 nt, Homo sapiens
cuacuuucauacugaa

SEQ ID NO: 708794 - RNA, 16 nt, Homo sapiens
cucauuguucagaaaa

SEQ ID NO: 708795 - RNA, 23 nt, Homo sapiens
cucucuuuugguuugugggucca

SEQ ID NO: 708796 - RNA, 18 nt, Homo sapiens
cucuuaaugucucaaaau

SEQ ID NO: 708797 - RNA, 17 nt, Homo sapiens
cucuugaagaacugacu

SEQ ID NO: 708798 - RNA, 21 nt, Homo sapiens
cugaccuccuuacauaugcaa

SEQ ID NO: 708799 - RNA, 17 nt, Homo sapiens
cugcacagcaggcugcc

SEQ ID NO: 708800 - RNA, 17 nt, Homo sapiens
cugccaagaguccaagc

SEQ ID NO: 708801 - RNA, 18 nt, Homo sapiens
cugcuccuccaguacaau

SEQ ID NO: 708802 - RNA, 13 nt, Homo sapiens
cuggcacuggcaa

SEQ ID NO: 708803 - RNA, 16 nt, Homo sapiens
cuggguggaugggcca

SEQ ID NO: 708804 - RNA, 17 nt, Homo sapiens
cuguaugccaagugaaa

SEQ ID NO: 708805 - RNA, 18 nt, Homo sapiens
cuguaugccaagugaaaa

SEQ ID NO: 708806 - RNA, 20 nt, Homo sapiens
cugugcaacaaacucaaaau

SEQ ID NO: 708807 - RNA, 14 nt, Homo sapiens
cuuauaaaaucaaa

SEQ ID NO: 708808 - RNA, 17 nt, Homo sapiens
cuucagcuuaauaagua

SEQ ID NO: 708809 - RNA, 22 nt, Homo sapiens
cuucaugcgcaguccccaggua

SEQ ID NO: 708810 - RNA, 18 nt, Homo sapiens
cuuccccuggcacuggca

SEQ ID NO: 708811 - RNA, 17 nt, Homo sapiens
cuucuuuccucuuaaug

SEQ ID NO: 708812 - RNA, 16 nt, Homo sapiens
cuugacucuacuauua

SEQ ID NO: 708813 - RNA, 19 nt, Homo sapiens
cuugagacaaaucuaugcc

SEQ ID NO: 708814 - RNA, 18 nt, Homo sapiens
cuugauucagaaccauuu

SEQ ID NO: 708815 - RNA, 16 nt, Homo sapiens
cuuggcucagacaccu

SEQ ID NO: 708816 - RNA, 21 nt, Homo sapiens
cuuuccucuuaaugucucaaa

SEQ ID NO: 708817 - RNA, 21 nt, Homo sapiens
gaaaaggcuugagucuggaua

SEQ ID NO: 708818 - RNA, 22 nt, Homo sapiens
gaaaaggcuugagucuggauaa

SEQ ID NO: 708819 - RNA, 18 nt, Homo sapiens
gaaaccccugacaccuuu

SEQ ID NO: 708820 - RNA, 18 nt, Homo sapiens
ugcuugggcuauaccugg

SEQ ID NO: 708821 - RNA, 23 nt, Homo sapiens
uggaacacaaugacuaaagacau

SEQ ID NO: 708822 - RNA, 17 nt, Homo sapiens
uggacuuaacucuaauu

SEQ ID NO: 708823 - RNA, 16 nt, Homo sapiens
uggagacgaugcuuua

SEQ ID NO: 708824 - RNA, 17 nt, Homo sapiens
uggaucaggaacccuua

SEQ ID NO: 708825 - RNA, 16 nt, Homo sapiens
ugguuuccaucaaagc

SEQ ID NO: 708826 - RNA, 14 nt, Homo sapiens
ugucccaagugcca

SEQ ID NO: 708827 - RNA, 18 nt, Homo sapiens
ugugccccuuccccaugc

SEQ ID NO: 708828 - RNA, 14 nt, Homo sapiens
uguggaugcugcug

SEQ ID NO: 708829 - RNA, 22 nt, Homo sapiens
uuaccuucaaaggccaagagaa

SEQ ID NO: 708830 - RNA, 17 nt, Homo sapiens
uuauaaaaucaaacaga

SEQ ID NO: 708831 - RNA, 17 nt, Homo sapiens
uuauagugacaaugaag

SEQ ID NO: 708832 - RNA, 15 nt, Homo sapiens
uucagaaaagcaccu

SEQ ID NO: 708833 - RNA, 19 nt, Homo sapiens
uucauugacugauggugaa

SEQ ID NO: 708834 - RNA, 21 nt, Homo sapiens
uucuacuccauggugaacuga

SEQ ID NO: 708835 - RNA, 14 nt, Homo sapiens
uucuggcauaacua

SEQ ID NO: 708836 - RNA, 17 nt, Homo sapiens
uucugucacucaccacu

SEQ ID NO: 708837 - RNA, 19 nt, Homo sapiens
uucuugcuugacucuacua

SEQ ID NO: 708838 - RNA, 20 nt, Homo sapiens
uugaaaauaguuaccuucaa

SEQ ID NO: 708839 - RNA, 18 nt, Homo sapiens
uugacaggcuuauggaag

SEQ ID NO: 708840 - RNA, 20 nt, Homo sapiens
uugacaucaaugaugaggcu

SEQ ID NO: 708841 - RNA, 19 nt, Homo sapiens
uugaugucaaaaacuucaa

SEQ ID NO: 708842 - RNA, 17 nt, Homo sapiens
uugcauauguaaggaag

SEQ ID NO: 708843 - RNA, 21 nt, Homo sapiens
uuggguaagggacuccagaag

SEQ ID NO: 708844 - RNA, 21 nt, Homo sapiens
uugucggccccaccagugccu

SEQ ID NO: 708845 - RNA, 19 nt, Homo sapiens
uuuagguaaaaagcuuaaa

SEQ ID NO: 708846 - RNA, 19 nt, Homo sapiens
uuuccugcuccuccaguac

SEQ ID NO: 708847 - RNA, 20 nt, Homo sapiens
uuuccuggacuuaacucuaa

SEQ ID NO: 708848 - RNA, 12 nt, Homo sapiens
uuuugacaucaa

SEQ ID NO: 708849 - RNA, 18 nt, Homo sapiens
uuuugacaucaaugauga

SEQ ID NO: 708850 - RNA, 14 nt, Homo sapiens
accaguaauuguga

SEQ ID NO: 708851 - RNA, 14 nt, Homo sapiens
accgccuugcccag

SEQ ID NO: 708852 - RNA, 20 nt, Homo sapiens
accucuuuucauggaguaga

SEQ ID NO: 708853 - RNA, 23 nt, Homo sapiens
accuggcucuguggcgagccauu

SEQ ID NO: 708854 - RNA, 19 nt, Homo sapiens
accuguaggucuaugaugu

SEQ ID NO: 708855 - RNA, 22 nt, Homo sapiens
accuucaaaggccaagagaauu

SEQ ID NO: 708856 - RNA, 13 nt, Homo sapiens
acgugacuccuca

SEQ ID NO: 708857 - RNA, 22 nt, Homo sapiens
acucccaugagggagaugccau

SEQ ID NO: 708858 - RNA, 22 nt, Homo sapiens
aagccaucaaacacaaugccuc

SEQ ID NO: 708859 - RNA, 21 nt, Homo sapiens
aagcccagccuaucucucuuc

SEQ ID NO: 708860 - RNA, 22 nt, Homo sapiens
aagcugaugaaguuaagcacaa

SEQ ID NO: 708861 - RNA, 15 nt, Homo sapiens
aaggauucuguaugc

SEQ ID NO: 708862 - RNA, 19 nt, Homo sapiens
aaguuuugacaucaaugau

SEQ ID NO: 708863 - RNA, 19 nt, Homo sapiens
aauauauaguggacaguaa

SEQ ID NO: 708864 - RNA, 20 nt, Homo sapiens
aauauccaagcccagccuau

SEQ ID NO: 708865 - RNA, 19 nt, Homo sapiens
aaucccauuuaugcaauuu

SEQ ID NO: 708866 - RNA, 14 nt, Homo sapiens
aaugaagaugaugc

SEQ ID NO: 708867 - RNA, 15 nt, Homo sapiens
aaugaagaugaugcu

SEQ ID NO: 708868 - RNA, 16 nt, Homo sapiens
aaugaagaugaugcua

SEQ ID NO: 708869 - RNA, 18 nt, Homo sapiens
aaugaauaacagccucau

SEQ ID NO: 708870 - RNA, 13 nt, Homo sapiens
aaugaugaggcuc

SEQ ID NO: 708871 - RNA, 15 nt, Homo sapiens
aaugugaaugggaaa

SEQ ID NO: 708872 - RNA, 15 nt, Homo sapiens
aauuagaaacauaaa

SEQ ID NO: 708873 - RNA, 16 nt, Homo sapiens
aauuauacuuacuucu

SEQ ID NO: 708874 - RNA, 21 nt, Homo sapiens
aauucuagagucucuguuacu

SEQ ID NO: 708875 - RNA, 18 nt, Homo sapiens
acaaaauauccaagccca

SEQ ID NO: 708876 - RNA, 19 nt, Homo sapiens
acaacaucaagccugugau

SEQ ID NO: 708877 - RNA, 15 nt, Homo sapiens
acacaagaggggaug

SEQ ID NO: 708878 - RNA, 23 nt, Homo sapiens
accagugccucucccugcugcuc

SEQ ID NO: 708879 - RNA, 17 nt, Homo sapiens
accauaagcuacugcca

SEQ ID NO: 708880 - RNA, 19 nt, Homo sapiens
cuaauuguccauucuugcu

SEQ ID NO: 708881 - RNA, 21 nt, Homo sapiens
cuacuuagagauauguaucau

SEQ ID NO: 708882 - RNA, 15 nt, Homo sapiens
cucaaaauaaaacca

SEQ ID NO: 708883 - RNA, 22 nt, Homo sapiens
cucccaugagggagaugccaug

SEQ ID NO: 708884 - RNA, 15 nt, Homo sapiens
cugccaagaguccaa

SEQ ID NO: 708885 - RNA, 16 nt, Homo sapiens
cugccaagaguccaag

SEQ ID NO: 708886 - RNA, 21 nt, Homo sapiens
cuguagaugacauggugaaaa

SEQ ID NO: 708887 - RNA, 18 nt, Homo sapiens
cugugcaacaaacucaaa

SEQ ID NO: 708888 - RNA, 22 nt, Homo sapiens
cuguuacugcuugggcuauacc

SEQ ID NO: 708889 - RNA, 16 nt, Homo sapiens
cuuagaagaaauauga

SEQ ID NO: 708890 - RNA, 22 nt, Homo sapiens
cuuaucaguaguaucaaugauu

SEQ ID NO: 708891 - RNA, 15 nt, Homo sapiens
cuucuaguggguuua

SEQ ID NO: 708892 - RNA, 20 nt, Homo sapiens
cuugaaugcuuaaaugauca

SEQ ID NO: 708893 - RNA, 20 nt, Homo sapiens
cuugagacaaaucuaugcca

SEQ ID NO: 708894 - RNA, 12 nt, Homo sapiens
cuugagcagcug

SEQ ID NO: 708895 - RNA, 16 nt, Homo sapiens
cuugaggccaaaugag

SEQ ID NO: 708896 - RNA, 22 nt, Homo sapiens
cuugaggccaaaugaguucccu

SEQ ID NO: 708897 - RNA, 21 nt, Homo sapiens
cuuuccuggacuuaacucuaa

SEQ ID NO: 708898 - RNA, 19 nt, Homo sapiens
cuuuguaccuguaggucua

SEQ ID NO: 708899 - RNA, 15 nt, Homo sapiens
gaaaaagcccucuuc

SEQ ID NO: 708900 - RNA, 16 nt, Homo sapiens
gaaaagcaccucuuga

SEQ ID NO: 708901 - RNA, 11 nt, Homo sapiens
gaaaauuacag

SEQ ID NO: 708902 - RNA, 14 nt, Homo sapiens
gaaaccccugacac

SEQ ID NO: 708903 - RNA, 13 nt, Homo sapiens
gaaauuauacuua

SEQ ID NO: 708904 - RNA, 12 nt, Homo sapiens
gaagcagcagcu

SEQ ID NO: 708905 - RNA, 20 nt, Homo sapiens
gaaucaaggugauugugauu

SEQ ID NO: 708906 - RNA, 16 nt, Homo sapiens
gaaucaccuugauuca

SEQ ID NO: 708907 - RNA, 20 nt, Homo sapiens
gacaaugaagaugaugcuau

SEQ ID NO: 708908 - RNA, 18 nt, Homo sapiens
gacaccuagacucuaaaa

SEQ ID NO: 708909 - RNA, 15 nt, Homo sapiens
gacagugccuaacuc

SEQ ID NO: 708910 - RNA, 23 nt, Homo sapiens
gagacaaaucuaugccacucaga

SEQ ID NO: 708911 - RNA, 16 nt, Homo sapiens
gagagcagccucuuga

SEQ ID NO: 708912 - RNA, 17 nt, Homo sapiens
gagaugaggcuggauag

SEQ ID NO: 708913 - RNA, 16 nt, Homo sapiens
gagaugccaugagccg

SEQ ID NO: 708914 - RNA, 23 nt, Homo sapiens
gagccauuugucccaagugccaa

SEQ ID NO: 708915 - RNA, 20 nt, Homo sapiens
gauacagguauucugcugau

SEQ ID NO: 708916 - RNA, 16 nt, Homo sapiens
gaugaggcagaugccu

SEQ ID NO: 708917 - RNA, 20 nt, Homo sapiens
gaugcugcugagcacaucuc

SEQ ID NO: 708918 - RNA, 16 nt, Homo sapiens
gcaauuuacuuggaau

SEQ ID NO: 708919 - RNA, 17 nt, Homo sapiens
gcacacuggcucaccca

SEQ ID NO: 708920 - RNA, 15 nt, Homo sapiens
gcauucauaacagaa

SEQ ID NO: 708921 - RNA, 16 nt, Homo sapiens
gcauucauaacagaac

SEQ ID NO: 708922 - RNA, 13 nt, Homo sapiens
gccaagugaaaaa

SEQ ID NO: 708923 - RNA, 16 nt, Homo sapiens
gccccaccagugccuc

SEQ ID NO: 708924 - RNA, 15 nt, Homo sapiens
gcccucuucaauccc

SEQ ID NO: 708925 - RNA, 16 nt, Homo sapiens
gccucucccugcugcu

SEQ ID NO: 708926 - RNA, 18 nt, Homo sapiens
gccuugcccagccuggau

SEQ ID NO: 708927 - RNA, 17 nt, Homo sapiens
gcgagccauuuguccca

SEQ ID NO: 708928 - RNA, 22 nt, Homo sapiens
gcgugggaguauguuauuucuc

SEQ ID NO: 708929 - RNA, 19 nt, Homo sapiens
gcuccaguugucuauucau

SEQ ID NO: 708930 - RNA, 20 nt, Homo sapiens
gcugccuaguuaccaugaac

SEQ ID NO: 708931 - RNA, 12 nt, Homo sapiens
gcugcuccuagg

SEQ ID NO: 708932 - RNA, 18 nt, Homo sapiens
ggaaaaugaauaauacau

SEQ ID NO: 708933 - RNA, 19 nt, Homo sapiens
ggaaaugauugagagcagc

SEQ ID NO: 708934 - RNA, 13 nt, Homo sapiens
ggaacacaaugac

SEQ ID NO: 708935 - RNA, 13 nt, Homo sapiens
ggacagugccuaa

SEQ ID NO: 708936 - RNA, 19 nt, Homo sapiens
ggacugagaaauuauacuu

SEQ ID NO: 708937 - RNA, 21 nt, Homo sapiens
ggacugagggggccuggaugc

SEQ ID NO: 708938 - RNA, 16 nt, Homo sapiens
ggauucuguaugccaa

SEQ ID NO: 708939 - RNA, 12 nt, Homo sapiens
ggcauacuaaua

SEQ ID NO: 708940 - RNA, 21 nt, Homo sapiens
gguaaauaaucauacacagaa

SEQ ID NO: 708941 - RNA, 20 nt, Homo sapiens
guauacuuuuugcauaugua

SEQ ID NO: 708942 - RNA, 19 nt, Homo sapiens
guaucaugcuucuacucca

SEQ ID NO: 708943 - RNA, 22 nt, Homo sapiens
gucacucaccacuacaucacuu

SEQ ID NO: 708944 - RNA, 14 nt, Homo sapiens
caaggcacugagac

SEQ ID NO: 708945 - RNA, 17 nt, Homo sapiens
caaggccagaugcacau

SEQ ID NO: 708946 - RNA, 14 nt, Homo sapiens
caagguauuacacu

SEQ ID NO: 708947 - RNA, 18 nt, Homo sapiens
caagugaauuugccugua

SEQ ID NO: 708948 - RNA, 23 nt, Homo sapiens
caagugaccauaaaggcauggca

SEQ ID NO: 708949 - RNA, 22 nt, Homo sapiens
caauaaagcagccucauucuga

SEQ ID NO: 708950 - RNA, 12 nt, Homo sapiens
caauaagccagc

SEQ ID NO: 708951 - RNA, 14 nt, Homo sapiens
caaucacaagaaga

SEQ ID NO: 708952 - RNA, 19 nt, Homo sapiens
caauguuucaaacaaaaag

SEQ ID NO: 708953 - RNA, 21 nt, Homo sapiens
caauuagcaauugacugucac

SEQ ID NO: 708954 - RNA, 14 nt, Homo sapiens
caauugacaacagu

SEQ ID NO: 708955 - RNA, 23 nt, Homo sapiens
caauuuucuuuuuuauacucaau

SEQ ID NO: 708956 - RNA, 14 nt, Homo sapiens
cacaacacaguucu

SEQ ID NO: 708957 - RNA, 19 nt, Homo sapiens
cacaauaauuuucuaccug

SEQ ID NO: 708958 - RNA, 15 nt, Homo sapiens
cacacaaacaccucc

SEQ ID NO: 708959 - RNA, 22 nt, Homo sapiens
cacagcacaaauuaguuguaua

SEQ ID NO: 708960 - RNA, 17 nt, Homo sapiens
cacagugcugaccagac

SEQ ID NO: 708961 - RNA, 13 nt, Homo sapiens
cacaucacacaaa

SEQ ID NO: 708962 - RNA, 15 nt, Homo sapiens
cacauguaucuaugc

SEQ ID NO: 708963 - RNA, 21 nt, Homo sapiens
cacauuuuaaaagugccauua

SEQ ID NO: 708964 - RNA, 14 nt, Homo sapiens
caccagaauguaua

SEQ ID NO: 708965 - RNA, 12 nt, Homo sapiens
caccagcaaaac

SEQ ID NO: 708966 - RNA, 21 nt, Homo sapiens
caccaggauagagacuggaac

SEQ ID NO: 708967 - RNA, 15 nt, Homo sapiens
caccaugcccggcua

SEQ ID NO: 708968 - RNA, 11 nt, Homo sapiens
cccucaugcaa

SEQ ID NO: 708969 - RNA, 15 nt, Homo sapiens
cccuccccuccaucc

SEQ ID NO: 708970 - RNA, 20 nt, Homo sapiens
cccucccuggaugacauuaa

SEQ ID NO: 708971 - RNA, 13 nt, Homo sapiens
cccucccuuugaa

SEQ ID NO: 708972 - RNA, 22 nt, Homo sapiens
cccuccuuuggaaugcuguauu

SEQ ID NO: 708973 - RNA, 20 nt, Homo sapiens
cccugcucaguaaagcacuu

SEQ ID NO: 708974 - RNA, 18 nt, Homo sapiens
cccuggaaggacauccau

SEQ ID NO: 708975 - RNA, 21 nt, Homo sapiens
cccugggacguggcuagucau

SEQ ID NO: 708976 - RNA, 19 nt, Homo sapiens
cccuguagugaccuguaaa

SEQ ID NO: 708977 - RNA, 16 nt, Homo sapiens
cccuuuccccagugac

SEQ ID NO: 708978 - RNA, 22 nt, Homo sapiens
ccgacuuuuguuuaccagagaa

SEQ ID NO: 708979 - RNA, 15 nt, Homo sapiens
ccgugugggagaccg

SEQ ID NO: 708980 - RNA, 18 nt, Homo sapiens
ccuaaaguacugggauua

SEQ ID NO: 708981 - RNA, 16 nt, Homo sapiens
ccuaaucucuguaaag

SEQ ID NO: 708982 - RNA, 20 nt, Homo sapiens
ccuaccaggcacgucugcag

SEQ ID NO: 708983 - RNA, 16 nt, Homo sapiens
ccuacuucuuuugcuc

SEQ ID NO: 708984 - RNA, 14 nt, Homo sapiens
ccuaugucauuuca

SEQ ID NO: 708985 - RNA, 15 nt, Homo sapiens
ccucaaaaagauuuc

SEQ ID NO: 708986 - RNA, 19 nt, Homo sapiens
ccucaauaagccagcaaac

SEQ ID NO: 708987 - RNA, 20 nt, Homo sapiens
ccucacccccagcuuugcua

SEQ ID NO: 708988 - RNA, 13 nt, Homo sapiens
ccucagugccuuc

SEQ ID NO: 708989 - RNA, 22 nt, Homo sapiens
ccucaugccuguaaucccagca

SEQ ID NO: 708990 - RNA, 15 nt, Homo sapiens
ccuccacccacugug

SEQ ID NO: 708991 - RNA, 13 nt, Homo sapiens
ccuccagccacca

SEQ ID NO: 708992 - RNA, 22 nt, Homo sapiens
ccucccaggaacugggccaacu

SEQ ID NO: 708993 - RNA, 16 nt, Homo sapiens
ccucccuggaugacau

SEQ ID NO: 708994 - RNA, 19 nt, Homo sapiens
ccuccucccagacuuucua

SEQ ID NO: 708995 - RNA, 16 nt, Homo sapiens
ccuccucugcccggga

SEQ ID NO: 708996 - RNA, 20 nt, Homo sapiens
ccucgagaucccaacacugc

SEQ ID NO: 708997 - RNA, 22 nt, Homo sapiens
ccucuccacucaugugacucuu

SEQ ID NO: 708998 - RNA, 18 nt, Homo sapiens
ccucucguaagauuuccu

SEQ ID NO: 708999 - RNA, 15 nt, Homo sapiens
ccugaacacugugac

SEQ ID NO: 709000 - RNA, 18 nt, Homo sapiens
ccugacgaacuccuugau

SEQ ID NO: 709001 - RNA, 17 nt, Homo sapiens
ccugcagacucacugug

SEQ ID NO: 709002 - RNA, 17 nt, Homo sapiens
ccuggacaguuuucugc

SEQ ID NO: 709003 - RNA, 12 nt, Homo sapiens
ccuggaugacau

SEQ ID NO: 709004 - RNA, 18 nt, Homo sapiens
ccugguaccuagcaaagc

SEQ ID NO: 709005 - RNA, 18 nt, Homo sapiens
ccugugacuggcagcauu

SEQ ID NO: 709006 - RNA, 23 nt, Homo sapiens
ccuguuaccuacuuugacuuuuu

SEQ ID NO: 709007 - RNA, 13 nt, Homo sapiens
ccuuaaggcucuu

SEQ ID NO: 709008 - RNA, 22 nt, Homo sapiens
ccuuagcuggcauuacagcugg

SEQ ID NO: 709009 - RNA, 17 nt, Homo sapiens
ccuucuucuccaucucc

SEQ ID NO: 709010 - RNA, 23 nt, Homo sapiens
ccuugcggcuccucagggacuca

SEQ ID NO: 709011 - RNA, 18 nt, Homo sapiens
ccuuguucugauaaugaa

SEQ ID NO: 709012 - RNA, 20 nt, Homo sapiens
ccuuuggacuugucccggga

SEQ ID NO: 709013 - RNA, 22 nt, Homo sapiens
ccuuuggggagcaggaggccaa

SEQ ID NO: 709014 - RNA, 17 nt, Homo sapiens
cgaaacacacaaaccag

SEQ ID NO: 709015 - RNA, 13 nt, Homo sapiens
cgaaugacacugu

SEQ ID NO: 709016 - RNA, 16 nt, Homo sapiens
cgagaaaaacacacag

SEQ ID NO: 709017 - RNA, 17 nt, Homo sapiens
cgcuagccaagaaccua

SEQ ID NO: 709018 - RNA, 20 nt, Homo sapiens
cgcugagccccugagcccaa

SEQ ID NO: 709019 - RNA, 14 nt, Homo sapiens
cggcuccucaggga

SEQ ID NO: 709020 - RNA, 14 nt, Homo sapiens
cggugaacucuggc

SEQ ID NO: 709021 - RNA, 16 nt, Homo sapiens
cgugacacaaacacac

SEQ ID NO: 709022 - RNA, 15 nt, Homo sapiens
cgugauccaccugcc

SEQ ID NO: 709023 - RNA, 18 nt, Homo sapiens
cguguuucugacucugag

SEQ ID NO: 709024 - RNA, 14 nt, Homo sapiens
cuaaaguacuggga

SEQ ID NO: 709025 - RNA, 19 nt, Homo sapiens
cuaacauaggugaacgugu

SEQ ID NO: 709026 - RNA, 21 nt, Homo sapiens
cuaagaaacauuuauauugau

SEQ ID NO: 709027 - RNA, 19 nt, Homo sapiens
cuaaucucuguaaagcuaa

SEQ ID NO: 709028 - RNA, 21 nt, Homo sapiens
cuaaucuucuuaugcaauuuc

SEQ ID NO: 709029 - RNA, 17 nt, Homo sapiens
cuaauuuuuuguuguuu

SEQ ID NO: 709030 - RNA, 23 nt, Homo sapiens
cuacaaacucccacuugucaugu

SEQ ID NO: 709031 - RNA, 21 nt, Homo sapiens
cuacaggcgugagccaccaug

SEQ ID NO: 709032 - RNA, 20 nt, Homo sapiens
cuacccccugugccuuguca

SEQ ID NO: 709033 - RNA, 16 nt, Homo sapiens
cuacuuacaugcauua

SEQ ID NO: 709034 - RNA, 17 nt, Homo sapiens
cuacuucuuuugcucuu

SEQ ID NO: 709035 - RNA, 17 nt, Homo sapiens
cuacuugcucagguacu

SEQ ID NO: 709036 - RNA, 16 nt, Homo sapiens
cuacuuuauuugccua

SEQ ID NO: 709037 - RNA, 12 nt, Homo sapiens
cuagagacucaa

SEQ ID NO: 709038 - RNA, 13 nt, Homo sapiens
cuagagugacuca

SEQ ID NO: 709039 - RNA, 20 nt, Homo sapiens
cuagagugcgguggcgcgau

SEQ ID NO: 709040 - RNA, 18 nt, Homo sapiens
cuagcuuaucuacuucca

SEQ ID NO: 709041 - RNA, 19 nt, Homo sapiens
cuaugauauuuucugugcc

SEQ ID NO: 709042 - RNA, 19 nt, Homo sapiens
cuaugcaggguagcacugg

SEQ ID NO: 709043 - RNA, 18 nt, Homo sapiens
cucaaacuccugaccuca

SEQ ID NO: 709044 - RNA, 23 nt, Homo sapiens
cucaaccccuccccuccaucccu

SEQ ID NO: 709045 - RNA, 19 nt, Homo sapiens
cucaacucucuuauugccu

SEQ ID NO: 709046 - RNA, 19 nt, Homo sapiens
cucaacugccuacuccaaa

SEQ ID NO: 709047 - RNA, 10 nt, Homo sapiens
cucacaaaag

SEQ ID NO: 709048 - RNA, 14 nt, Homo sapiens
cucacuaauucauu

SEQ ID NO: 709049 - RNA, 15 nt, Homo sapiens
cucagaggguguccu

SEQ ID NO: 709050 - RNA, 21 nt, Homo sapiens
cucagccuuggcagcccugau

SEQ ID NO: 709051 - RNA, 16 nt, Homo sapiens
cucaggaaccgaggca

SEQ ID NO: 709052 - RNA, 16 nt, Homo sapiens
cucaggcaaucugccc

SEQ ID NO: 709053 - RNA, 22 nt, Homo sapiens
cucaguaagaagagcuuggaaa

SEQ ID NO: 709054 - RNA, 13 nt, Homo sapiens
cucauuguagaaa

SEQ ID NO: 709055 - RNA, 22 nt, Homo sapiens
cucauuguagaaaagcuauaaa

SEQ ID NO: 709056 - RNA, 15 nt, Homo sapiens
cuccacccacugugg

SEQ ID NO: 709057 - RNA, 22 nt, Homo sapiens
cuccaggcaggucugaagcuca

SEQ ID NO: 709058 - RNA, 20 nt, Homo sapiens
cucccaggcuggagugcagu

SEQ ID NO: 709059 - RNA, 13 nt, Homo sapiens
cucccaugcacac

SEQ ID NO: 709060 - RNA, 16 nt, Homo sapiens
cucccaugcacacaaa

SEQ ID NO: 709061 - RNA, 21 nt, Homo sapiens
cuccccuucuucuccaucucc

SEQ ID NO: 709062 - RNA, 18 nt, Homo sapiens
cucccugaagaccaaaau

SEQ ID NO: 709063 - RNA, 15 nt, Homo sapiens
cuccuagcaagaccu

SEQ ID NO: 709064 - RNA, 15 nt, Homo sapiens
cuccucgagauccca

SEQ ID NO: 709065 - RNA, 22 nt, Homo sapiens
cuccucgagaucccaacacugc

SEQ ID NO: 709066 - RNA, 19 nt, Homo sapiens
cuccugcucauauugugau

SEQ ID NO: 709067 - RNA, 15 nt, Homo sapiens
cuccuguuuccaugg

SEQ ID NO: 709068 - RNA, 23 nt, Homo sapiens
cuccuuacccugccccagcuggg

SEQ ID NO: 709069 - RNA, 16 nt, Homo sapiens
cucgcuccucaacccc

SEQ ID NO: 709070 - RNA, 12 nt, Homo sapiens
cucuacugcaaa

SEQ ID NO: 709071 - RNA, 16 nt, Homo sapiens
cucuccuuguucugau

SEQ ID NO: 709072 - RNA, 23 nt, Homo sapiens
cucucuugcaggaaggacuauga

SEQ ID NO: 709073 - RNA, 19 nt, Homo sapiens
cucugcuugauuuuugccu

SEQ ID NO: 709074 - RNA, 22 nt, Homo sapiens
cucuguaaagcuaaaauaaaga

SEQ ID NO: 709075 - RNA, 17 nt, Homo sapiens
cucugucgccaggcuag

SEQ ID NO: 709076 - RNA, 14 nt, Homo sapiens
cucuguucauuucc

SEQ ID NO: 709077 - RNA, 15 nt, Homo sapiens
cucuguucauuuccu

SEQ ID NO: 709078 - RNA, 18 nt, Homo sapiens
cucuucaauauuugugua

SEQ ID NO: 709079 - RNA, 19 nt, Homo sapiens
cugaacucaaacugaggaa

SEQ ID NO: 709080 - RNA, 14 nt, Homo sapiens
cugacagaaugaga

SEQ ID NO: 709081 - RNA, 15 nt, Homo sapiens
cugacagaaugagac

SEQ ID NO: 709082 - RNA, 20 nt, Homo sapiens
cugaccagccgugagcaugu

SEQ ID NO: 709083 - RNA, 22 nt, Homo sapiens
cugacccucaucuuucuuccaa

SEQ ID NO: 709084 - RNA, 20 nt, Homo sapiens
cugagauacauacagaauua

SEQ ID NO: 709085 - RNA, 20 nt, Homo sapiens
uaccaggcacgucugcagaa

SEQ ID NO: 709086 - RNA, 17 nt, Homo sapiens
uacccccugugccuugu

SEQ ID NO: 709087 - RNA, 19 nt, Homo sapiens
uaccuuuuuauuugcaugu

SEQ ID NO: 709088 - RNA, 14 nt, Homo sapiens
uacuacaugcacuu

SEQ ID NO: 709089 - RNA, 21 nt, Homo sapiens
uacugcaagguucaacuuauu

SEQ ID NO: 709090 - RNA, 23 nt, Homo sapiens
uacugggagaggggccucaaaug

SEQ ID NO: 709091 - RNA, 18 nt, Homo sapiens
uacuggucuuguggaauu

SEQ ID NO: 709092 - RNA, 18 nt, Homo sapiens
uacuuuuaaacuguguac

SEQ ID NO: 709093 - RNA, 19 nt, Homo sapiens
uagaaaaguuauguagaaa

SEQ ID NO: 709094 - RNA, 17 nt, Homo sapiens
uagaacacacacacuua

SEQ ID NO: 709095 - RNA, 18 nt, Homo sapiens
uagaauccaguuugcaau

SEQ ID NO: 709096 - RNA, 11 nt, Homo sapiens
uagaucuggca

SEQ ID NO: 709097 - RNA, 15 nt, Homo sapiens
uagccacuucacuuu

SEQ ID NO: 709098 - RNA, 16 nt, Homo sapiens
uagccagugaaaaacu

SEQ ID NO: 709099 - RNA, 20 nt, Homo sapiens
uagcccucagcccaccuggg

SEQ ID NO: 709100 - RNA, 21 nt, Homo sapiens
uagccuucucuguucauuucc

SEQ ID NO: 709101 - RNA, 16 nt, Homo sapiens
uagcugggacuacagg

SEQ ID NO: 709102 - RNA, 18 nt, Homo sapiens
uagcugguucacacugac

SEQ ID NO: 709103 - RNA, 18 nt, Homo sapiens
uaggacuuuuauugugaa

SEQ ID NO: 709104 - RNA, 22 nt, Homo sapiens
uaggcauuaaauuuuagcaaag

SEQ ID NO: 709105 - RNA, 19 nt, Homo sapiens
uagguggguugaaagccaa

SEQ ID NO: 709106 - RNA, 19 nt, Homo sapiens
uagugcacagcacaaauua

SEQ ID NO: 709107 - RNA, 17 nt, Homo sapiens
uagugguggcagugcag

SEQ ID NO: 709108 - RNA, 14 nt, Homo sapiens
uaguguacaugaaa

SEQ ID NO: 709109 - RNA, 14 nt, Homo sapiens
uaguucaugucugc

SEQ ID NO: 709110 - RNA, 16 nt, Homo sapiens
uaguucugccaggaga

SEQ ID NO: 709111 - RNA, 15 nt, Homo sapiens
uaguuugcuguugca

SEQ ID NO: 709112 - RNA, 17 nt, Homo sapiens
uaguuuggauuacuuaa

SEQ ID NO: 709113 - RNA, 13 nt, Homo sapiens
uauaaaaguacua

SEQ ID NO: 709114 - RNA, 12 nt, Homo sapiens
uauaaccuuaau

SEQ ID NO: 709115 - RNA, 14 nt, Homo sapiens
uauaaucauuauua

SEQ ID NO: 709116 - RNA, 20 nt, Homo sapiens
uauauuuuaucugugauuag

SEQ ID NO: 709117 - RNA, 12 nt, Homo sapiens
uaucaacugcca

SEQ ID NO: 709118 - RNA, 13 nt, Homo sapiens
uaucuaugcauuu

SEQ ID NO: 709119 - RNA, 14 nt, Homo sapiens
uaugcagaauguug

SEQ ID NO: 709120 - RNA, 14 nt, Homo sapiens
uaugcauacaguaa

SEQ ID NO: 709121 - RNA, 19 nt, Homo sapiens
uauggagugcaccaaagag

SEQ ID NO: 709122 - RNA, 15 nt, Homo sapiens
uaugguugacacuag

SEQ ID NO: 709123 - RNA, 21 nt, Homo sapiens
uauguaaauagaaacguguau

SEQ ID NO: 709124 - RNA, 21 nt, Homo sapiens
uaugugaaauguauagcugcu

SEQ ID NO: 709125 - RNA, 18 nt, Homo sapiens
uauguuacuacaugcacu

SEQ ID NO: 709126 - RNA, 16 nt, Homo sapiens
uauugaacuuaugcaa

SEQ ID NO: 709127 - RNA, 17 nt, Homo sapiens
uauugaacuuaugcaaa

SEQ ID NO: 709128 - RNA, 14 nt, Homo sapiens
uauugccuugugaa

SEQ ID NO: 709129 - RNA, 21 nt, Homo sapiens
uauuuggugauuacauuuuaa

SEQ ID NO: 709130 - RNA, 21 nt, Homo sapiens
uauuuucagaugugaaccauu

SEQ ID NO: 709131 - RNA, 17 nt, Homo sapiens
uauuuugccaagggcau

SEQ ID NO: 709132 - RNA, 16 nt, Homo sapiens
uauuuugucuuuuugc

SEQ ID NO: 709133 - RNA, 17 nt, Homo sapiens
ucaaaagggccaaagaa

SEQ ID NO: 709134 - RNA, 22 nt, Homo sapiens
ucaaacaaaaagucauaaaagu

SEQ ID NO: 709135 - RNA, 17 nt, Homo sapiens
ucaaacugcaugauuca

SEQ ID NO: 709136 - RNA, 21 nt, Homo sapiens
ucaaacugcaugauucaugcc

SEQ ID NO: 709137 - RNA, 22 nt, Homo sapiens
ucaaagagggagugcauuuaug

SEQ ID NO: 709138 - RNA, 20 nt, Homo sapiens
ucaaaguguuuucucugaac

SEQ ID NO: 709139 - RNA, 19 nt, Homo sapiens
ucaaauucuucugaacuca

SEQ ID NO: 709140 - RNA, 20 nt, Homo sapiens
ucaaccccuccccuccaucc

SEQ ID NO: 709141 - RNA, 21 nt, Homo sapiens
ucaacuuaccaggcaccaaaa

SEQ ID NO: 709142 - RNA, 15 nt, Homo sapiens
ucaagaauaaucacg

SEQ ID NO: 709143 - RNA, 16 nt, Homo sapiens
ucaaggcggugcuuga

SEQ ID NO: 709144 - RNA, 23 nt, Homo sapiens
ucaaguuguuccuuaagucagaa

SEQ ID NO: 709145 - RNA, 13 nt, Homo sapiens
ucaauaagccagc

SEQ ID NO: 709146 - RNA, 17 nt, Homo sapiens
ucaaucccucaaaacaa

SEQ ID NO: 709147 - RNA, 16 nt, Homo sapiens
ucaauguaccugugug

SEQ ID NO: 709148 - RNA, 13 nt, Homo sapiens
ucacagaauguga

SEQ ID NO: 709149 - RNA, 20 nt, Homo sapiens
ucaccuccucccagacuuuc

SEQ ID NO: 709150 - RNA, 17 nt, Homo sapiens
ucacucuucaaaugccu

SEQ ID NO: 709151 - RNA, 18 nt, Homo sapiens
ucacugaguuuuccaugg

SEQ ID NO: 709152 - RNA, 13 nt, Homo sapiens
ucacuuguacaaa

SEQ ID NO: 709153 - RNA, 19 nt, Homo sapiens
ucacuuucucaguuuucau

SEQ ID NO: 709154 - RNA, 17 nt, Homo sapiens
ucagacucuaagaaaga

SEQ ID NO: 709155 - RNA, 23 nt, Homo sapiens
ucagagacauacaccuaugucau

SEQ ID NO: 709156 - RNA, 18 nt, Homo sapiens
ucagagaccuuccagaaa

SEQ ID NO: 709157 - RNA, 21 nt, Homo sapiens
ucagaguugcugcaaaccuga

SEQ ID NO: 709158 - RNA, 22 nt, Homo sapiens
ucagauaagguaaaaugccaug

SEQ ID NO: 709159 - RNA, 16 nt, Homo sapiens
ucagcaacucgcuuua

SEQ ID NO: 709160 - RNA, 18 nt, Homo sapiens
ucagcagggacuguaaac

SEQ ID NO: 709161 - RNA, 23 nt, Homo sapiens
ucagcagggacuguaaacacaga

SEQ ID NO: 709162 - RNA, 13 nt, Homo sapiens
ucagccagguuug

SEQ ID NO: 709163 - RNA, 15 nt, Homo sapiens
ucagcuagcucugcc

SEQ ID NO: 709164 - RNA, 15 nt, Homo sapiens
ucaggcaacgcacaa

SEQ ID NO: 709165 - RNA, 19 nt, Homo sapiens
cugagcccaaggcacugag

SEQ ID NO: 709166 - RNA, 17 nt, Homo sapiens
cugaguaucacaucaca

SEQ ID NO: 709167 - RNA, 22 nt, Homo sapiens
cugaguaucacaucacacaaaa

SEQ ID NO: 709168 - RNA, 16 nt, Homo sapiens
cugaguuccugcaugc

SEQ ID NO: 709169 - RNA, 20 nt, Homo sapiens
cugaguuuuccauggcagga

SEQ ID NO: 709170 - RNA, 19 nt, Homo sapiens
cugauaaugaaaauuauga

SEQ ID NO: 709171 - RNA, 14 nt, Homo sapiens
cugauauggcuuuu

SEQ ID NO: 709172 - RNA, 19 nt, Homo sapiens
cugauguagcuuauacaaa

SEQ ID NO: 709173 - RNA, 17 nt, Homo sapiens
cugauuaggacuuuuau

SEQ ID NO: 709174 - RNA, 16 nt, Homo sapiens
cugauuccgcagcuca

SEQ ID NO: 709175 - RNA, 22 nt, Homo sapiens
cugcaagcuuuucaaaauugga

SEQ ID NO: 709176 - RNA, 21 nt, Homo sapiens
cugcauaaaauagagugcauu

SEQ ID NO: 709177 - RNA, 22 nt, Homo sapiens
cugccaacacgcccggcuaauu

SEQ ID NO: 709178 - RNA, 16 nt, Homo sapiens
cugccagcauuucccu

SEQ ID NO: 709179 - RNA, 22 nt, Homo sapiens
cugccauucacuucauaaucca

SEQ ID NO: 709180 - RNA, 18 nt, Homo sapiens
cugccauuggacuaugga

SEQ ID NO: 709181 - RNA, 17 nt, Homo sapiens
cugcccugcucccacag

SEQ ID NO: 709182 - RNA, 17 nt, Homo sapiens
cugccuacuccaaaaug

SEQ ID NO: 709183 - RNA, 16 nt, Homo sapiens
cugccugguauaucca

SEQ ID NO: 709184 - RNA, 19 nt, Homo sapiens
cugccuugguauagcauau

SEQ ID NO: 709185 - RNA, 20 nt, Homo sapiens
cugcuauuugaaguguaauu

SEQ ID NO: 709186 - RNA, 12 nt, Homo sapiens
cugcuauuuuag

SEQ ID NO: 709187 - RNA, 15 nt, Homo sapiens
cugcucauauuguga

SEQ ID NO: 709188 - RNA, 14 nt, Homo sapiens
cugcucccacagaa

SEQ ID NO: 709189 - RNA, 15 nt, Homo sapiens
cugcuccccacguca

SEQ ID NO: 709190 - RNA, 20 nt, Homo sapiens
cugcuuccaauuuucuggaa

SEQ ID NO: 709191 - RNA, 20 nt, Homo sapiens
cuggaacugucucucaugaa

SEQ ID NO: 709192 - RNA, 15 nt, Homo sapiens
cuggaagcauuuguu

SEQ ID NO: 709193 - RNA, 14 nt, Homo sapiens
cuggaaucagcuca

SEQ ID NO: 709194 - RNA, 18 nt, Homo sapiens
cuggaccagccucuccac

SEQ ID NO: 709195 - RNA, 12 nt, Homo sapiens
cuggaugacauu

SEQ ID NO: 709196 - RNA, 16 nt, Homo sapiens
cuggcacccaauguuu

SEQ ID NO: 709197 - RNA, 21 nt, Homo sapiens
cuggcccccucccuggaugac

SEQ ID NO: 709198 - RNA, 20 nt, Homo sapiens
cuggcuguggccuaaccugc

SEQ ID NO: 709199 - RNA, 14 nt, Homo sapiens
cuggcuucuggcca

SEQ ID NO: 709200 - RNA, 22 nt, Homo sapiens
cugggagcacuuuguaggcauu

SEQ ID NO: 709201 - RNA, 21 nt, Homo sapiens
cuggggacagguccucagugu

SEQ ID NO: 709202 - RNA, 19 nt, Homo sapiens
cuggggaguuuacuaccug

SEQ ID NO: 709203 - RNA, 16 nt, Homo sapiens
cugguauauccaaaag

SEQ ID NO: 709204 - RNA, 23 nt, Homo sapiens
cuggucccaagacagugagacag

SEQ ID NO: 709205 - RNA, 13 nt, Homo sapiens
cugguuuucacau

SEQ ID NO: 709206 - RNA, 23 nt, Homo sapiens
cuguaaaauggaggccauugugu

SEQ ID NO: 709207 - RNA, 21 nt, Homo sapiens
cuguaagaaaccuacugccca

SEQ ID NO: 709208 - RNA, 17 nt, Homo sapiens
cuguaaucccagcaugc

SEQ ID NO: 709209 - RNA, 18 nt, Homo sapiens
cuguaauguuaauauuga

SEQ ID NO: 709210 - RNA, 17 nt, Homo sapiens
cuguauuucaagaccuc

SEQ ID NO: 709211 - RNA, 20 nt, Homo sapiens
cugucaucaauuaaaggcaa

SEQ ID NO: 709212 - RNA, 20 nt, Homo sapiens
cugucucucaugaaccucaa

SEQ ID NO: 709213 - RNA, 18 nt, Homo sapiens
cugugauuagccauuuga

SEQ ID NO: 709214 - RNA, 18 nt, Homo sapiens
cuguggacuccaugccuc

SEQ ID NO: 709215 - RNA, 22 nt, Homo sapiens
cuguggagguauugccuuguga

SEQ ID NO: 709216 - RNA, 18 nt, Homo sapiens
cuguugaauuucccacau

SEQ ID NO: 709217 - RNA, 15 nt, Homo sapiens
cuguugcauuguaau

SEQ ID NO: 709218 - RNA, 22 nt, Homo sapiens
cuguuuugguuuugcucacaaa

SEQ ID NO: 709219 - RNA, 17 nt, Homo sapiens
cuuaaaaucuaauucaa

SEQ ID NO: 709220 - RNA, 14 nt, Homo sapiens
cuuaaacacuugca

SEQ ID NO: 709221 - RNA, 15 nt, Homo sapiens
cuuaaacacuugcaa

SEQ ID NO: 709222 - RNA, 14 nt, Homo sapiens
cuuaaugcucugau

SEQ ID NO: 709223 - RNA, 18 nt, Homo sapiens
cuuaauuuauuauuaaca

SEQ ID NO: 709224 - RNA, 14 nt, Homo sapiens
cuuacaugauucau

SEQ ID NO: 709225 - RNA, 17 nt, Homo sapiens
cuuaccaggcaccaaaa

SEQ ID NO: 709226 - RNA, 14 nt, Homo sapiens
cuuagaccucuuca

SEQ ID NO: 709227 - RNA, 16 nt, Homo sapiens
cuuagcugucugcuca

SEQ ID NO: 709228 - RNA, 18 nt, Homo sapiens
cuucaaaugccugacuag

SEQ ID NO: 709229 - RNA, 13 nt, Homo sapiens
cuucagugcugcu

SEQ ID NO: 709230 - RNA, 14 nt, Homo sapiens
cuucagugcugcuc

SEQ ID NO: 709231 - RNA, 14 nt, Homo sapiens
cuuccaaacaggcu

SEQ ID NO: 709232 - RNA, 15 nt, Homo sapiens
cuucccacggcuccu

SEQ ID NO: 709233 - RNA, 21 nt, Homo sapiens
cuucccacggcuccucgagau

SEQ ID NO: 709234 - RNA, 20 nt, Homo sapiens
cuucuaguucugccaggaga

SEQ ID NO: 709235 - RNA, 12 nt, Homo sapiens
cuucugcuaaaa

SEQ ID NO: 709236 - RNA, 14 nt, Homo sapiens
cuucuggccaggaa

SEQ ID NO: 709237 - RNA, 13 nt, Homo sapiens
cuugaacugauuc

SEQ ID NO: 709238 - RNA, 17 nt, Homo sapiens
cuugaaguucugaaauu

SEQ ID NO: 709239 - RNA, 16 nt, Homo sapiens
cuugauagaaaugcca

SEQ ID NO: 709240 - RNA, 13 nt, Homo sapiens
cuugauuuuugcc

SEQ ID NO: 709241 - RNA, 22 nt, Homo sapiens
cuugccuagcccuuuggugaua

SEQ ID NO: 709242 - RNA, 15 nt, Homo sapiens
cuuggcagcccugau

SEQ ID NO: 709243 - RNA, 15 nt, Homo sapiens
cuugguaauuguacu

SEQ ID NO: 709244 - RNA, 22 nt, Homo sapiens
cuuguuagugcacagcacaaau

SEQ ID NO: 709245 - RNA, 19 nt, Homo sapiens
cuuuaaaauguaaagccau

SEQ ID NO: 709246 - RNA, 14 nt, Homo sapiens
cuuuaggcauuaaa

SEQ ID NO: 709247 - RNA, 19 nt, Homo sapiens
cuuuauguuacuacaugca

SEQ ID NO: 709248 - RNA, 20 nt, Homo sapiens
cuuuauguuacuacaugcac

SEQ ID NO: 709249 - RNA, 17 nt, Homo sapiens
cuuuauuggcugagaua

SEQ ID NO: 709250 - RNA, 21 nt, Homo sapiens
cuuucacugagccuccacagc

SEQ ID NO: 709251 - RNA, 14 nt, Homo sapiens
cuuucaugcuccuu

SEQ ID NO: 709252 - RNA, 14 nt, Homo sapiens
cuuuccaaccggcu

SEQ ID NO: 709253 - RNA, 14 nt, Homo sapiens
cuuuccccagugac

SEQ ID NO: 709254 - RNA, 22 nt, Homo sapiens
cuuuccccagugacaccucagc

SEQ ID NO: 709255 - RNA, 21 nt, Homo sapiens
gccuggagaaggugacagucc

SEQ ID NO: 709256 - RNA, 15 nt, Homo sapiens
gccuggcuauguccu

SEQ ID NO: 709257 - RNA, 22 nt, Homo sapiens
gccuggcuguggccuaaccugc

SEQ ID NO: 709258 - RNA, 22 nt, Homo sapiens
gccuuggggauucuuccaucug

SEQ ID NO: 709259 - RNA, 21 nt, Homo sapiens
gccuuuauuaaaaacugagug

SEQ ID NO: 709260 - RNA, 20 nt, Homo sapiens
gcuacugccgucagugcugu

SEQ ID NO: 709261 - RNA, 15 nt, Homo sapiens
gcuagagugacucac

SEQ ID NO: 709262 - RNA, 17 nt, Homo sapiens
gcuaggaaugaaauccu

SEQ ID NO: 709263 - RNA, 22 nt, Homo sapiens
gcuaugucaggcuuucaucuaa

SEQ ID NO: 709264 - RNA, 15 nt, Homo sapiens
gcuauguccuaauaa

SEQ ID NO: 709265 - RNA, 22 nt, Homo sapiens
gcucaacucucuuauugccuca

SEQ ID NO: 709266 - RNA, 17 nt, Homo sapiens
gcucacugcaaccucca

SEQ ID NO: 709267 - RNA, 22 nt, Homo sapiens
gcucagaaaauaucccuccugu

SEQ ID NO: 709268 - RNA, 17 nt, Homo sapiens
gcucagcccuagcccuc

SEQ ID NO: 709269 - RNA, 14 nt, Homo sapiens
gcucccacagaaca

SEQ ID NO: 709270 - RNA, 22 nt, Homo sapiens
gcugaauagcuacuauauguca

SEQ ID NO: 709271 - RNA, 14 nt, Homo sapiens
gcugaucaguuuuu

SEQ ID NO: 709272 - RNA, 19 nt, Homo sapiens
gcugccuuuggacuugucc

SEQ ID NO: 709273 - RNA, 20 nt, Homo sapiens
gcugcuuuugaugaaaagca

SEQ ID NO: 709274 - RNA, 20 nt, Homo sapiens
gcuggagugcaguggcgcga

SEQ ID NO: 709275 - RNA, 15 nt, Homo sapiens
gcuguaaacuuguag

SEQ ID NO: 709276 - RNA, 16 nt, Homo sapiens
gcuguggcauccagag

SEQ ID NO: 709277 - RNA, 16 nt, Homo sapiens
gcuguggggcauagaa

SEQ ID NO: 709278 - RNA, 18 nt, Homo sapiens
gcuugauagaaaugccaa

SEQ ID NO: 709279 - RNA, 16 nt, Homo sapiens
gcuuucaucuaaucuu

SEQ ID NO: 709280 - RNA, 12 nt, Homo sapiens
gcuuugugauuc

SEQ ID NO: 709281 - RNA, 15 nt, Homo sapiens
gcuuuguggcacugg

SEQ ID NO: 709282 - RNA, 12 nt, Homo sapiens
ggaaaucaaaag

SEQ ID NO: 709283 - RNA, 22 nt, Homo sapiens
ggaaaucaaaagggccaaagaa

SEQ ID NO: 709284 - RNA, 23 nt, Homo sapiens
ggaacucugcuugauuuuugccu

SEQ ID NO: 709285 - RNA, 11 nt, Homo sapiens
ggaacugugua

SEQ ID NO: 709286 - RNA, 24 nt, Homo sapiens
ggaagagugguuaagacuacugaa

SEQ ID NO: 709287 - RNA, 23 nt, Homo sapiens
ggaagcauuuguuucuacuuuga

SEQ ID NO: 709288 - RNA, 14 nt, Homo sapiens
ggaaggucagccag

SEQ ID NO: 709289 - RNA, 21 nt, Homo sapiens
ggagaaaggaguuuugcaaag

SEQ ID NO: 709290 - RNA, 24 nt, Homo sapiens
ggagaggggccucaaaugcaccau

SEQ ID NO: 709291 - RNA, 21 nt, Homo sapiens
ggagccuggcuccguccagga

SEQ ID NO: 709292 - RNA, 23 nt, Homo sapiens
ggagcuuuagcuucucugccaag

SEQ ID NO: 709293 - RNA, 23 nt, Homo sapiens
ggaggacccagggcucuguaagu

SEQ ID NO: 709294 - RNA, 17 nt, Homo sapiens
ggagucacugagaccaa

SEQ ID NO: 709295 - RNA, 15 nt, Homo sapiens
ggagugcaccaaaga

SEQ ID NO: 709296 - RNA, 23 nt, Homo sapiens
ggaguuuacuaccuggggacccc

SEQ ID NO: 709297 - RNA, 16 nt, Homo sapiens
ggauagagacuggaac

SEQ ID NO: 709298 - RNA, 23 nt, Homo sapiens
ggauuccccaucucaggccagag

SEQ ID NO: 709299 - RNA, 17 nt, Homo sapiens
ggauucuuccaucugau

SEQ ID NO: 709300 - RNA, 22 nt, Homo sapiens
gcuuccuucauuuccuccguca

SEQ ID NO: 709301 - RNA, 23 nt, Homo sapiens
gcuugcaaaaacuacaaccaaug

SEQ ID NO: 709302 - RNA, 17 nt, Homo sapiens
gcuugggaaagguggug

SEQ ID NO: 709303 - RNA, 13 nt, Homo sapiens
gcuuuaauuucau

SEQ ID NO: 709304 - RNA, 12 nt, Homo sapiens
gcuuuacuuuag

SEQ ID NO: 709305 - RNA, 20 nt, Homo sapiens
gcuuuggugagaaccugggu

SEQ ID NO: 709306 - RNA, 12 nt, Homo sapiens
gcuuuucacaaa

SEQ ID NO: 709307 - RNA, 13 nt, Homo sapiens
gcuuuugaugaaa

SEQ ID NO: 709308 - RNA, 22 nt, Homo sapiens
ggaaaacaggaacccaccaaac

SEQ ID NO: 709309 - RNA, 17 nt, Homo sapiens
ggaaaggugguguuucu

SEQ ID NO: 709310 - RNA, 19 nt, Homo sapiens
ggaaaucaaaagggccaaa

SEQ ID NO: 709311 - RNA, 17 nt, Homo sapiens
ggaaggacauccauguu

SEQ ID NO: 709312 - RNA, 15 nt, Homo sapiens
ggacaaaccuugaaa

SEQ ID NO: 709313 - RNA, 19 nt, Homo sapiens
ggacaugcuucagugcugc

SEQ ID NO: 709314 - RNA, 20 nt, Homo sapiens
ggaccagccucuccacucau

SEQ ID NO: 709315 - RNA, 16 nt, Homo sapiens
ggaccaggagugggug

SEQ ID NO: 709316 - RNA, 17 nt, Homo sapiens
ggagaccggccugccag

SEQ ID NO: 709317 - RNA, 17 nt, Homo sapiens
ggagauaaucuagaaca

SEQ ID NO: 709318 - RNA, 23 nt, Homo sapiens
ggagcaaaccaaagaccaucuga

SEQ ID NO: 709319 - RNA, 15 nt, Homo sapiens
ggagcaggaggccaa

SEQ ID NO: 709320 - RNA, 12 nt, Homo sapiens
ggaggaugacca

SEQ ID NO: 709321 - RNA, 14 nt, Homo sapiens
ggaggccaauaaaa

SEQ ID NO: 709322 - RNA, 21 nt, Homo sapiens
ggauacgacaguacacuguca

SEQ ID NO: 709323 - RNA, 14 nt, Homo sapiens
ggauauuuauuuaa

SEQ ID NO: 709324 - RNA, 21 nt, Homo sapiens
ggaucucuccugaacucccac

SEQ ID NO: 709325 - RNA, 17 nt, Homo sapiens
ggaugugucacuguugg

SEQ ID NO: 709326 - RNA, 20 nt, Homo sapiens
ggauuacagguguaagccac

SEQ ID NO: 709327 - RNA, 21 nt, Homo sapiens
ggcaauuuuuuuauacuacca

SEQ ID NO: 709328 - RNA, 20 nt, Homo sapiens
ggcacugauaauauguuuga

SEQ ID NO: 709329 - RNA, 16 nt, Homo sapiens
ggcaggcucccaggga

SEQ ID NO: 709330 - RNA, 16 nt, Homo sapiens
ggcaugaaggugucau

SEQ ID NO: 709331 - RNA, 17 nt, Homo sapiens
ggccagaugcacauccc

SEQ ID NO: 709332 - RNA, 15 nt, Homo sapiens
ggcccagcgcagugc

SEQ ID NO: 709333 - RNA, 17 nt, Homo sapiens
ggccuugcggcuccuca

SEQ ID NO: 709334 - RNA, 21 nt, Homo sapiens
ggcucccagggacaccuggga

SEQ ID NO: 709335 - RNA, 15 nt, Homo sapiens
ggcuucagccaucca

SEQ ID NO: 709336 - RNA, 13 nt, Homo sapiens
gggaaaaccagac

SEQ ID NO: 709337 - RNA, 18 nt, Homo sapiens
gggagccugacccucauc

SEQ ID NO: 709338 - RNA, 11 nt, Homo sapiens
gggaugaugau

SEQ ID NO: 709339 - RNA, 14 nt, Homo sapiens
gggcaacacaguga

SEQ ID NO: 709340 - RNA, 15 nt, Homo sapiens
gggccaaagaaccaa

SEQ ID NO: 709341 - RNA, 22 nt, Homo sapiens
gggccucaaaugcaccauguca

SEQ ID NO: 709342 - RNA, 22 nt, Homo sapiens
gggcuccccuucgcguauuuca

SEQ ID NO: 709343 - RNA, 15 nt, Homo sapiens
ggguagcacugggaa

SEQ ID NO: 709344 - RNA, 20 nt, Homo sapiens
ggguauaguucaugucugcu

SEQ ID NO: 709345 - RNA, 14 nt, Homo sapiens
gggugugucugcuc

SEQ ID NO: 709346 - RNA, 24 nt, Homo sapiens
ggguuucaccauguuagccaggcu

SEQ ID NO: 709347 - RNA, 21 nt, Homo sapiens
gguaaaauaaucaguguuucc

SEQ ID NO: 709348 - RNA, 21 nt, Homo sapiens
gguaaaaugccaugaugccuc

SEQ ID NO: 709349 - RNA, 14 nt, Homo sapiens
gguaagagcaaaag

SEQ ID NO: 709350 - RNA, 22 nt, Homo sapiens
gguacaguauggggguuguaaa

SEQ ID NO: 709351 - RNA, 18 nt, Homo sapiens
gguauaguucaugucugc

SEQ ID NO: 709352 - RNA, 19 nt, Homo sapiens
gguaucaaccaaauggagu

SEQ ID NO: 709353 - RNA, 21 nt, Homo sapiens
gguauuaaauugauguugcug

SEQ ID NO: 709354 - RNA, 22 nt, Homo sapiens
ggucaaaguguuuucucugaac

SEQ ID NO: 709355 - RNA, 21 nt, Homo sapiens
ggugaacaaaguuuaccagaa

SEQ ID NO: 709356 - RNA, 23 nt, Homo sapiens
ggugaacguguucaaagccaagc

SEQ ID NO: 709357 - RNA, 14 nt, Homo sapiens
gguggucccugggu

SEQ ID NO: 709358 - RNA, 12 nt, Homo sapiens
ggugugcugcuu

SEQ ID NO: 709359 - RNA, 14 nt, Homo sapiens
gguugcuacuuuau

SEQ ID NO: 709360 - RNA, 13 nt, Homo sapiens
guaaaaagaaaua

SEQ ID NO: 709361 - RNA, 17 nt, Homo sapiens
guaaaauggaggccauu

SEQ ID NO: 709362 - RNA, 17 nt, Homo sapiens
guaaaguacagacuuuu

SEQ ID NO: 709363 - RNA, 21 nt, Homo sapiens
guaaguuuaugcauacaguaa

SEQ ID NO: 709364 - RNA, 20 nt, Homo sapiens
guaauaaaaggugucuuucc

SEQ ID NO: 709365 - RNA, 17 nt, Homo sapiens
guaauagauguuugaua

SEQ ID NO: 709366 - RNA, 22 nt, Homo sapiens
guaaugaaacaaagaguucaag

SEQ ID NO: 709367 - RNA, 12 nt, Homo sapiens
guacacuguguu

SEQ ID NO: 709368 - RNA, 18 nt, Homo sapiens
guacagaaagcugccugg

SEQ ID NO: 709369 - RNA, 14 nt, Homo sapiens
guacauagcuguuu

SEQ ID NO: 709370 - RNA, 16 nt, Homo sapiens
guacauguguguacau

SEQ ID NO: 709371 - RNA, 17 nt, Homo sapiens
guacucaagggcuuuau

SEQ ID NO: 709372 - RNA, 15 nt, Homo sapiens
guagccacuucacuu

SEQ ID NO: 709373 - RNA, 12 nt, Homo sapiens
guauaccucacu

SEQ ID NO: 709374 - RNA, 18 nt, Homo sapiens
guaucaaccaaauggagu

SEQ ID NO: 709375 - RNA, 16 nt, Homo sapiens
guauuauuagucuguu

SEQ ID NO: 709376 - RNA, 19 nt, Homo sapiens
guauucaugacuauggaua

SEQ ID NO: 709377 - RNA, 23 nt, Homo sapiens
gucaaaacagauuguuugcaaag

SEQ ID NO: 709378 - RNA, 13 nt, Homo sapiens
gucaccucagaga

SEQ ID NO: 709379 - RNA, 17 nt, Homo sapiens
gucaccucagagacaua

SEQ ID NO: 709380 - RNA, 16 nt, Homo sapiens
gucagucuucuuccau

SEQ ID NO: 709381 - RNA, 17 nt, Homo sapiens
guccccugccucaagaa

SEQ ID NO: 709382 - RNA, 20 nt, Homo sapiens
gucccuacuagagaccucuc

SEQ ID NO: 709383 - RNA, 20 nt, Homo sapiens
guccucaguguccucagggg

SEQ ID NO: 709384 - RNA, 19 nt, Homo sapiens
gucuccuaaaguacuggga

SEQ ID NO: 709385 - RNA, 16 nt, Homo sapiens
gugacuaauggcauga

SEQ ID NO: 709386 - RNA, 18 nt, Homo sapiens
gugcacuugcuggaagac

SEQ ID NO: 709387 - RNA, 23 nt, Homo sapiens
gugcagcaaccagagcacuguau

SEQ ID NO: 709388 - RNA, 16 nt, Homo sapiens
gugcuauggugcucug

SEQ ID NO: 709389 - RNA, 15 nt, Homo sapiens
gugcucacugaccug

SEQ ID NO: 709390 - RNA, 18 nt, Homo sapiens
gugcucugucuacuugcu

SEQ ID NO: 709391 - RNA, 11 nt, Homo sapiens
guggacaugcg

SEQ ID NO: 709392 - RNA, 17 nt, Homo sapiens
guggacaugcgugacca

SEQ ID NO: 709393 - RNA, 22 nt, Homo sapiens
guggcccuuaugacugccaaga

SEQ ID NO: 709394 - RNA, 15 nt, Homo sapiens
guguagcuuugcucu

SEQ ID NO: 709395 - RNA, 22 nt, Homo sapiens
gugucacucaaggcggugcuug

SEQ ID NO: 709396 - RNA, 14 nt, Homo sapiens
guguccugcaccgg

SEQ ID NO: 709397 - RNA, 18 nt, Homo sapiens
guguguuuggaagacuau

SEQ ID NO: 709398 - RNA, 17 nt, Homo sapiens
guguuuuuuuacauacg

SEQ ID NO: 709399 - RNA, 18 nt, Homo sapiens
guuacauguuugcaccuu

SEQ ID NO: 709400 - RNA, 15 nt, Homo sapiens
guuaguaucaucaga

SEQ ID NO: 709401 - RNA, 16 nt, Homo sapiens
guucaaauucuucuga

SEQ ID NO: 709402 - RNA, 21 nt, Homo sapiens
guucuauauaaaaaacauaau

SEQ ID NO: 709403 - RNA, 17 nt, Homo sapiens
guucuuuaaaauguaaa

SEQ ID NO: 709404 - RNA, 14 nt, Homo sapiens
guugaaagcuguau

SEQ ID NO: 709405 - RNA, 20 nt, Homo sapiens
guugcauuaaaaaugcauau

SEQ ID NO: 709406 - RNA, 15 nt, Homo sapiens
guugcuggacuguca

SEQ ID NO: 709407 - RNA, 12 nt, Homo sapiens
guuuaccagaga

SEQ ID NO: 709408 - RNA, 23 nt, Homo sapiens
guuugcaccuuucuaguugaaaa

SEQ ID NO: 709409 - RNA, 13 nt, Homo sapiens
guuuggcuuucag

SEQ ID NO: 709410 - RNA, 17 nt, Homo sapiens
guuuguaagguggucac

SEQ ID NO: 709411 - RNA, 15 nt, Homo sapiens
uaaaaacucuuauaa

SEQ ID NO: 709412 - RNA, 17 nt, Homo sapiens
uaaaaacugagugacuc

SEQ ID NO: 709413 - RNA, 16 nt, Homo sapiens
uaaaacauguuugcac

SEQ ID NO: 709414 - RNA, 12 nt, Homo sapiens
uaaaaccucagc

SEQ ID NO: 709415 - RNA, 14 nt, Homo sapiens
uaaaaccucagcua

SEQ ID NO: 709416 - RNA, 16 nt, Homo sapiens
uaaaacgauuacugac

SEQ ID NO: 709417 - RNA, 15 nt, Homo sapiens
uaaaagucacucuga

SEQ ID NO: 709418 - RNA, 21 nt, Homo sapiens
uaaaauaagaaagcccuaaaa

SEQ ID NO: 709419 - RNA, 21 nt, Homo sapiens
uaaaauaaucaguguuuccaa

SEQ ID NO: 709420 - RNA, 11 nt, Homo sapiens
uaaaauggagg

SEQ ID NO: 709421 - RNA, 16 nt, Homo sapiens
uaaaauguaaagccau

SEQ ID NO: 709422 - RNA, 17 nt, Homo sapiens
uaaaauguaaagccaug

SEQ ID NO: 709423 - RNA, 20 nt, Homo sapiens
uaaacagugagccugaauuu

SEQ ID NO: 709424 - RNA, 16 nt, Homo sapiens
uaaaccguacacugug

SEQ ID NO: 709425 - RNA, 17 nt, Homo sapiens
uaaaccguacacugugu

SEQ ID NO: 709426 - RNA, 18 nt, Homo sapiens
uaaaccguacacuguguu

SEQ ID NO: 709427 - RNA, 12 nt, Homo sapiens
uaaacuguguau

SEQ ID NO: 709428 - RNA, 22 nt, Homo sapiens
uaaagauuuuuuaauaauuuag

SEQ ID NO: 709429 - RNA, 19 nt, Homo sapiens
uaaagcauuuagaaaacuu

SEQ ID NO: 709430 - RNA, 23 nt, Homo sapiens
aauuuaugacuccacuguggaaa

SEQ ID NO: 709431 - RNA, 12 nt, Homo sapiens
aauuugccugua

SEQ ID NO: 709432 - RNA, 20 nt, Homo sapiens
aauuuuauaugcuuacugau

SEQ ID NO: 709433 - RNA, 20 nt, Homo sapiens
aauuuuuaaaacccauuuaa

SEQ ID NO: 709434 - RNA, 20 nt, Homo sapiens
aauuuuuauuuuugcugaga

SEQ ID NO: 709435 - RNA, 22 nt, Homo sapiens
aauuuuuauuuuugcugagacu

SEQ ID NO: 709436 - RNA, 19 nt, Homo sapiens
acaacuugucuauuaccug

SEQ ID NO: 709437 - RNA, 22 nt, Homo sapiens
acaagcauucugucuugaaggg

SEQ ID NO: 709438 - RNA, 19 nt, Homo sapiens
acaaucuugucauacuuga

SEQ ID NO: 709439 - RNA, 16 nt, Homo sapiens
acaauugacaacaguu

SEQ ID NO: 709440 - RNA, 15 nt, Homo sapiens
acaauuuaugaauug

SEQ ID NO: 709441 - RNA, 15 nt, Homo sapiens
acacagacugcgauu

SEQ ID NO: 709442 - RNA, 16 nt, Homo sapiens
acacagugagacuuca

SEQ ID NO: 709443 - RNA, 19 nt, Homo sapiens
acacauugaguuggaauca

SEQ ID NO: 709444 - RNA, 19 nt, Homo sapiens
acaccauuuuccugccuca

SEQ ID NO: 709445 - RNA, 15 nt, Homo sapiens
acaccuaugucauuu

SEQ ID NO: 709446 - RNA, 17 nt, Homo sapiens
acaccuaugucauuuca

SEQ ID NO: 709447 - RNA, 20 nt, Homo sapiens
acaccuuuuuucaacaguga

SEQ ID NO: 709448 - RNA, 17 nt, Homo sapiens
acacuugcaaccuaccu

SEQ ID NO: 709449 - RNA, 15 nt, Homo sapiens
acagaauacaagcca

SEQ ID NO: 709450 - RNA, 17 nt, Homo sapiens
acagaauacaagccacu

SEQ ID NO: 709451 - RNA, 18 nt, Homo sapiens
acagaauacaagccacua

SEQ ID NO: 709452 - RNA, 18 nt, Homo sapiens
acagaauuuuauggugca

SEQ ID NO: 709453 - RNA, 14 nt, Homo sapiens
acagcuaugaaggc

SEQ ID NO: 709454 - RNA, 20 nt, Homo sapiens
acagcuaugaaggcuguaca

SEQ ID NO: 709455 - RNA, 17 nt, Homo sapiens
acaggaacccaccaaac

SEQ ID NO: 709456 - RNA, 15 nt, Homo sapiens
acaggcgugagccac

SEQ ID NO: 709457 - RNA, 15 nt, Homo sapiens
acagugagacuucau

SEQ ID NO: 709458 - RNA, 22 nt, Homo sapiens
acaguuuucugcuuuaauuuca

SEQ ID NO: 709459 - RNA, 22 nt, Homo sapiens
acauaaaggugacccugaugaa

SEQ ID NO: 709460 - RNA, 19 nt, Homo sapiens
acauaguagaacgcuaucu

SEQ ID NO: 709461 - RNA, 18 nt, Homo sapiens
acauauauauacuauuaa

SEQ ID NO: 709462 - RNA, 14 nt, Homo sapiens
acaugcuucagugc

SEQ ID NO: 709463 - RNA, 21 nt, Homo sapiens
acauguauuuggugauuacau

SEQ ID NO: 709464 - RNA, 20 nt, Homo sapiens
acauuaaagaaggguugagc

SEQ ID NO: 709465 - RNA, 15 nt, Homo sapiens
acauuguuaccucua

SEQ ID NO: 709466 - RNA, 18 nt, Homo sapiens
acauuucuauagccaaaa

SEQ ID NO: 709467 - RNA, 19 nt, Homo sapiens
acauuuguuguucuguuaa

SEQ ID NO: 709468 - RNA, 22 nt, Homo sapiens
accaaaaguuacauguuugcac

SEQ ID NO: 709469 - RNA, 14 nt, Homo sapiens
accaagcugugacc

SEQ ID NO: 709470 - RNA, 16 nt, Homo sapiens
accacccacaaucaca

SEQ ID NO: 709471 - RNA, 12 nt, Homo sapiens
accacuccacuc

SEQ ID NO: 709472 - RNA, 18 nt, Homo sapiens
accagagcacuguauacc

SEQ ID NO: 709473 - RNA, 13 nt, Homo sapiens
accagauuugcua

SEQ ID NO: 709474 - RNA, 19 nt, Homo sapiens
accaggauagagacuggaa

SEQ ID NO: 709475 - RNA, 21 nt, Homo sapiens
accaggcagccucuggggggu

SEQ ID NO: 709476 - RNA, 16 nt, Homo sapiens
accauaacaacuucau

SEQ ID NO: 709477 - RNA, 17 nt, Homo sapiens
accauagcacaggcuaa

SEQ ID NO: 709478 - RNA, 13 nt, Homo sapiens
accauuuccucag

SEQ ID NO: 709479 - RNA, 19 nt, Homo sapiens
acccaguaacucaucuguc

SEQ ID NO: 709480 - RNA, 22 nt, Homo sapiens
acccaguaacucaucugucacc

SEQ ID NO: 709481 - RNA, 19 nt, Homo sapiens
acccagucccagaaccaca

SEQ ID NO: 709482 - RNA, 16 nt, Homo sapiens
accccccuugcccaug

SEQ ID NO: 709483 - RNA, 13 nt, Homo sapiens
accccuacaugaa

SEQ ID NO: 709484 - RNA, 18 nt, Homo sapiens
accccuccugcgcugccc

SEQ ID NO: 709485 - RNA, 13 nt, Homo sapiens
accccugcucagu

SEQ ID NO: 709486 - RNA, 17 nt, Homo sapiens
acccuagucuuuuaaac

SEQ ID NO: 709487 - RNA, 12 nt, Homo sapiens
acccuucugccu

SEQ ID NO: 709488 - RNA, 21 nt, Homo sapiens
accggccugccaggaggaccc

SEQ ID NO: 709489 - RNA, 20 nt, Homo sapiens
accguaugagggaacugugu

SEQ ID NO: 709490 - RNA, 15 nt, Homo sapiens
accuaagaaguacau

SEQ ID NO: 709491 - RNA, 11 nt, Homo sapiens
accuaauccaa

SEQ ID NO: 709492 - RNA, 14 nt, Homo sapiens
accuaaucucugua

SEQ ID NO: 709493 - RNA, 22 nt, Homo sapiens
accuacugauaaccacuccuaa

SEQ ID NO: 709494 - RNA, 21 nt, Homo sapiens
accuacuuugacuuuuugcau

SEQ ID NO: 709495 - RNA, 17 nt, Homo sapiens
accucaggcaaucugcc

SEQ ID NO: 709496 - RNA, 22 nt, Homo sapiens
accucccccugaacacugugac

SEQ ID NO: 709497 - RNA, 22 nt, Homo sapiens
accucuauauaccaaagcacau

SEQ ID NO: 709498 - RNA, 13 nt, Homo sapiens
accugaagacacc

SEQ ID NO: 709499 - RNA, 16 nt, Homo sapiens
accugccgagagucca

SEQ ID NO: 709500 - RNA, 21 nt, Homo sapiens
accuggggaguuuacuaccug

SEQ ID NO: 709501 - RNA, 18 nt, Homo sapiens
acgcagccugcagacuca

SEQ ID NO: 709502 - RNA, 22 nt, Homo sapiens
acgcagccugcagacucacugu

SEQ ID NO: 709503 - RNA, 16 nt, Homo sapiens
acgcucauuguagaaa

SEQ ID NO: 709504 - RNA, 20 nt, Homo sapiens
acuaauagaauuaauggaau

SEQ ID NO: 709505 - RNA, 14 nt, Homo sapiens
acuaaucuuauuca

SEQ ID NO: 709506 - RNA, 21 nt, Homo sapiens
acuaaucuuauucauuuucuc

SEQ ID NO: 709507 - RNA, 22 nt, Homo sapiens
acuaauggcaugagaaauacaa

SEQ ID NO: 709508 - RNA, 13 nt, Homo sapiens
acuacaugcacuu

SEQ ID NO: 709509 - RNA, 21 nt, Homo sapiens
acuacaugcacuuggcugcau

SEQ ID NO: 709510 - RNA, 11 nt, Homo sapiens
acucacugugg

SEQ ID NO: 709511 - RNA, 12 nt, Homo sapiens
acucacuguggg

SEQ ID NO: 709512 - RNA, 14 nt, Homo sapiens
acucaucugucacc

SEQ ID NO: 709513 - RNA, 17 nt, Homo sapiens
acuccugaccucaggca

SEQ ID NO: 709514 - RNA, 22 nt, Homo sapiens
acuccugguuccuaggugagca

SEQ ID NO: 709515 - RNA, 21 nt, Homo sapiens
acucuucugagcaccuacuua

SEQ ID NO: 709516 - RNA, 22 nt, Homo sapiens
acucuucugagcaccuacuuac

SEQ ID NO: 709517 - RNA, 15 nt, Homo sapiens
acugaccugccugua

SEQ ID NO: 709518 - RNA, 20 nt, Homo sapiens
acugagccuccacagcagug

SEQ ID NO: 709519 - RNA, 17 nt, Homo sapiens
acugcaaacaguguucu

SEQ ID NO: 709520 - RNA, 17 nt, Homo sapiens
acugcaugcacuucuua

SEQ ID NO: 709521 - RNA, 14 nt, Homo sapiens
acuggcagcauuga

SEQ ID NO: 709522 - RNA, 19 nt, Homo sapiens
acugggcaaugauggcaau

SEQ ID NO: 709523 - RNA, 12 nt, Homo sapiens
acugucacuguu

SEQ ID NO: 709524 - RNA, 15 nt, Homo sapiens
acugucucucaugaa

SEQ ID NO: 709525 - RNA, 17 nt, Homo sapiens
acugucuguguccuucc

SEQ ID NO: 709526 - RNA, 22 nt, Homo sapiens
acugucuguguccuuccuugaa

SEQ ID NO: 709527 - RNA, 19 nt, Homo sapiens
acuguguaagggccagaaa

SEQ ID NO: 709528 - RNA, 17 nt, Homo sapiens
acuuaaaaucuaauuca

SEQ ID NO: 709529 - RNA, 14 nt, Homo sapiens
acuuacaugcauua

SEQ ID NO: 709530 - RNA, 22 nt, Homo sapiens
acuuauaauuaugcuaccuacu

SEQ ID NO: 709531 - RNA, 22 nt, Homo sapiens
acuuauuggaacucugcuugau

SEQ ID NO: 709532 - RNA, 19 nt, Homo sapiens
acuugcucagguacuugua

SEQ ID NO: 709533 - RNA, 23 nt, Homo sapiens
acuugucccgggacaccuaggcu

SEQ ID NO: 709534 - RNA, 20 nt, Homo sapiens
acuuuauguuacuacaugca

SEQ ID NO: 709535 - RNA, 22 nt, Homo sapiens
acuuugguggccacauaagcca

SEQ ID NO: 709536 - RNA, 18 nt, Homo sapiens
acuuuugaaaacaaaaua

SEQ ID NO: 709537 - RNA, 17 nt, Homo sapiens
acuuuuuaaaacacaac

SEQ ID NO: 709538 - RNA, 13 nt, Homo sapiens
agaaaaauuaauu

SEQ ID NO: 709539 - RNA, 17 nt, Homo sapiens
agaaacacguaucccac

SEQ ID NO: 709540 - RNA, 13 nt, Homo sapiens
agaaaguuaugaa

SEQ ID NO: 709541 - RNA, 17 nt, Homo sapiens
agaaauaucuucacuug

SEQ ID NO: 709542 - RNA, 23 nt, Homo sapiens
agaaaucuggcuucuggccagga

SEQ ID NO: 709543 - RNA, 17 nt, Homo sapiens
agaaaugaggagacaca

SEQ ID NO: 709544 - RNA, 14 nt, Homo sapiens
agaaccacacuguu

SEQ ID NO: 709545 - RNA, 17 nt, Homo sapiens
agaagaagcuaccucag

SEQ ID NO: 709546 - RNA, 16 nt, Homo sapiens
agaagggacugagaga

SEQ ID NO: 709547 - RNA, 22 nt, Homo sapiens
agaauggaaagcuucagugcug

SEQ ID NO: 709548 - RNA, 15 nt, Homo sapiens
agacaaaacuagaga

SEQ ID NO: 709549 - RNA, 21 nt, Homo sapiens
agacagaaccccuacaugaaa

SEQ ID NO: 709550 - RNA, 12 nt, Homo sapiens
agaccaaaauaa

SEQ ID NO: 709551 - RNA, 20 nt, Homo sapiens
aucaguuuuuucaccuggaa

SEQ ID NO: 709552 - RNA, 15 nt, Homo sapiens
aucauggcuaucugu

SEQ ID NO: 709553 - RNA, 18 nt, Homo sapiens
aucauguuggauagucag

SEQ ID NO: 709554 - RNA, 21 nt, Homo sapiens
aucauguuggauagucagcug

SEQ ID NO: 709555 - RNA, 16 nt, Homo sapiens
auccaggcacccaaac

SEQ ID NO: 709556 - RNA, 16 nt, Homo sapiens
auccaguuugcaauua

SEQ ID NO: 709557 - RNA, 18 nt, Homo sapiens
aucccaccugacaugucc

SEQ ID NO: 709558 - RNA, 19 nt, Homo sapiens
aucccaccugacauguccu

SEQ ID NO: 709559 - RNA, 24 nt, Homo sapiens
auccuuggaaauuggaagagcaca

SEQ ID NO: 709560 - RNA, 14 nt, Homo sapiens
aucgacuugccaaa

SEQ ID NO: 709561 - RNA, 23 nt, Homo sapiens
aucgcagauucucccuugcucug

SEQ ID NO: 709562 - RNA, 13 nt, Homo sapiens
aucuccugaccuc

SEQ ID NO: 709563 - RNA, 20 nt, Homo sapiens
aucucggcucacugcaagcu

SEQ ID NO: 709564 - RNA, 21 nt, Homo sapiens
cauuugcugaauagcuacuau

SEQ ID NO: 709565 - RNA, 22 nt, Homo sapiens
cauuuuaaaagugccauuaaca

SEQ ID NO: 709566 - RNA, 17 nt, Homo sapiens
cauuuuaugucauuaaa

SEQ ID NO: 709567 - RNA, 13 nt, Homo sapiens
cauuuucacuuuu

SEQ ID NO: 709568 - RNA, 16 nt, Homo sapiens
ccaaagaaccaaagaa

SEQ ID NO: 709569 - RNA, 16 nt, Homo sapiens
ccaaagagaaugcccu

SEQ ID NO: 709570 - RNA, 21 nt, Homo sapiens
ccaaauauugugcacauuuaa

SEQ ID NO: 709571 - RNA, 18 nt, Homo sapiens
ccaacacugccagcauuu

SEQ ID NO: 709572 - RNA, 19 nt, Homo sapiens
ccaacuugguuuugcuaca

SEQ ID NO: 709573 - RNA, 10 nt, Homo sapiens
ccaagagcua

SEQ ID NO: 709574 - RNA, 12 nt, Homo sapiens
ccaagcugugac

SEQ ID NO: 709575 - RNA, 21 nt, Homo sapiens
ccaagugaccauaaaggcaug

SEQ ID NO: 709576 - RNA, 19 nt, Homo sapiens
ccaauaaaaaguucagagu

SEQ ID NO: 709577 - RNA, 19 nt, Homo sapiens
ccaauagggcugagcucuc

SEQ ID NO: 709578 - RNA, 24 nt, Homo sapiens
ccacagaauacaagccacuaccuu

SEQ ID NO: 709579 - RNA, 22 nt, Homo sapiens
ccacaggcaccagcaaaacaac

SEQ ID NO: 709580 - RNA, 20 nt, Homo sapiens
ccacccacaaucacaagaag

SEQ ID NO: 709581 - RNA, 16 nt, Homo sapiens
ccaccugacauguccu

SEQ ID NO: 709582 - RNA, 21 nt, Homo sapiens
ccagaaaacaaaacugcauuu

SEQ ID NO: 709583 - RNA, 17 nt, Homo sapiens
ccagagaaaaagggagg

SEQ ID NO: 709584 - RNA, 14 nt, Homo sapiens
ccagagucccugcc

SEQ ID NO: 709585 - RNA, 19 nt, Homo sapiens
ccagcagaagcaggguacc

SEQ ID NO: 709586 - RNA, 20 nt, Homo sapiens
ccagcagaagcaggguaccc

SEQ ID NO: 709587 - RNA, 14 nt, Homo sapiens
ccagcaguacucag

SEQ ID NO: 709588 - RNA, 18 nt, Homo sapiens
ccagcaugcugagauuac

SEQ ID NO: 709589 - RNA, 19 nt, Homo sapiens
ccagcuacaaaacaauuca

SEQ ID NO: 709590 - RNA, 13 nt, Homo sapiens
ccagcuacuugau

SEQ ID NO: 709591 - RNA, 10 nt, Homo sapiens
ccagcuguca

SEQ ID NO: 709592 - RNA, 19 nt, Homo sapiens
ccagcuuucccugccucuc

SEQ ID NO: 709593 - RNA, 16 nt, Homo sapiens
ccaggcuggucucaaa

SEQ ID NO: 709594 - RNA, 16 nt, Homo sapiens
ccaggguuaaccacug

SEQ ID NO: 709595 - RNA, 18 nt, Homo sapiens
ccagugaaaaacuauuaa

SEQ ID NO: 709596 - RNA, 20 nt, Homo sapiens
ccaucagcaaauauuauucu

SEQ ID NO: 709597 - RNA, 10 nt, Homo sapiens
ccaucucagg

SEQ ID NO: 709598 - RNA, 12 nt, Homo sapiens
ccaugacaugga

SEQ ID NO: 709599 - RNA, 12 nt, Homo sapiens
ccauuacugcau

SEQ ID NO: 709600 - RNA, 21 nt, Homo sapiens
ccauuacuuuaauacucaccu

SEQ ID NO: 709601 - RNA, 19 nt, Homo sapiens
ccauucacuucauaaucca

SEQ ID NO: 709602 - RNA, 17 nt, Homo sapiens
ccauuccagacugcuuc

SEQ ID NO: 709603 - RNA, 23 nt, Homo sapiens
cccaaauccuuagaucuggcaug

SEQ ID NO: 709604 - RNA, 20 nt, Homo sapiens
cccacugggagcacuuugua

SEQ ID NO: 709605 - RNA, 14 nt, Homo sapiens
cccacuguacuugc

SEQ ID NO: 709606 - RNA, 20 nt, Homo sapiens
cccagcacuuugggaggcca

SEQ ID NO: 709607 - RNA, 16 nt, Homo sapiens
cccaggaacugggcca

SEQ ID NO: 709608 - RNA, 18 nt, Homo sapiens
cccaggaccccauggcag

SEQ ID NO: 709609 - RNA, 23 nt, Homo sapiens
cccaugccuccagcuacaaaaca

SEQ ID NO: 709610 - RNA, 23 nt, Homo sapiens
cccaugccuggucccaagacagu

SEQ ID NO: 709611 - RNA, 21 nt, Homo sapiens
cccauuacuuuaauacucacc

SEQ ID NO: 709612 - RNA, 23 nt, Homo sapiens
cccauuacuuuaauacucaccuc

SEQ ID NO: 709613 - RNA, 13 nt, Homo sapiens
ccccauuugcaca

SEQ ID NO: 709614 - RNA, 16 nt, Homo sapiens
cccccaaccauuuccu

SEQ ID NO: 709615 - RNA, 13 nt, Homo sapiens
ccccuacaugaaa

SEQ ID NO: 709616 - RNA, 14 nt, Homo sapiens
ccccucccuggaug

SEQ ID NO: 709617 - RNA, 21 nt, Homo sapiens
ccccucccuggaugacauuaa

SEQ ID NO: 709618 - RNA, 14 nt, Homo sapiens
ccccugaaagccau

SEQ ID NO: 709619 - RNA, 22 nt, Homo sapiens
ccccugagcccaaggcacugag

SEQ ID NO: 709620 - RNA, 21 nt, Homo sapiens
ccccugccucaagaaauugcc

SEQ ID NO: 709621 - RNA, 18 nt, Homo sapiens
cccucaucuuucuuccaa

SEQ ID NO: 709622 - RNA, 15 nt, Homo sapiens
cccucccuggaugac

SEQ ID NO: 709623 - RNA, 17 nt, Homo sapiens
cccugaacacugugaca

SEQ ID NO: 709624 - RNA, 23 nt, Homo sapiens
cccugccccagcuggggaaauca

SEQ ID NO: 709625 - RNA, 14 nt, Homo sapiens
cccugccucucugc

SEQ ID NO: 709626 - RNA, 13 nt, Homo sapiens
cccugcucccaca

SEQ ID NO: 709627 - RNA, 15 nt, Homo sapiens
cccuuuggggagcag

SEQ ID NO: 709628 - RNA, 12 nt, Homo sapiens
ccgagaagaaca

SEQ ID NO: 709629 - RNA, 11 nt, Homo sapiens
ccgggacaccu

SEQ ID NO: 709630 - RNA, 17 nt, Homo sapiens
ccgguucuuaaauccau

SEQ ID NO: 709631 - RNA, 16 nt, Homo sapiens
ccgucaaaagagucuu

SEQ ID NO: 709632 - RNA, 19 nt, Homo sapiens
ccgucaaaagagucuuaau

SEQ ID NO: 709633 - RNA, 17 nt, Homo sapiens
ccuaaacaucauucauu

SEQ ID NO: 709634 - RNA, 15 nt, Homo sapiens
ccuaaaguacuggga

SEQ ID NO: 709635 - RNA, 16 nt, Homo sapiens
ccuacuuugacuuuuu

SEQ ID NO: 709636 - RNA, 19 nt, Homo sapiens
ccuacuuugacuuuuugca

SEQ ID NO: 709637 - RNA, 15 nt, Homo sapiens
ccuaggcuagggugg

SEQ ID NO: 709638 - RNA, 20 nt, Homo sapiens
ccucaaccccuccccuccau

SEQ ID NO: 709639 - RNA, 21 nt, Homo sapiens
ccucacuucagguauaccuca

SEQ ID NO: 709640 - RNA, 17 nt, Homo sapiens
ccucagggacucaggug

SEQ ID NO: 709641 - RNA, 18 nt, Homo sapiens
ccucaucccuccaucuca

SEQ ID NO: 709642 - RNA, 22 nt, Homo sapiens
ccuccaaggaggggcuguaaaa

SEQ ID NO: 709643 - RNA, 20 nt, Homo sapiens
ccucccuggaugacauuaaa

SEQ ID NO: 709644 - RNA, 15 nt, Homo sapiens
ccucgcccuccacaa

SEQ ID NO: 709645 - RNA, 20 nt, Homo sapiens
ccucucgcuccucaaccccu

SEQ ID NO: 709646 - RNA, 17 nt, Homo sapiens
ccucugggggguggcca

SEQ ID NO: 709647 - RNA, 24 nt, Homo sapiens
ccucuuugugugcgucacugugaa

SEQ ID NO: 709648 - RNA, 17 nt, Homo sapiens
ccugacccuacuucuuu

SEQ ID NO: 709649 - RNA, 22 nt, Homo sapiens
ccugacccucaucuuucuucca

SEQ ID NO: 709650 - RNA, 12 nt, Homo sapiens
ccugagugaucc

SEQ ID NO: 709651 - RNA, 21 nt, Homo sapiens
ccuggaacugucucucaugaa

SEQ ID NO: 709652 - RNA, 20 nt, Homo sapiens
ccuggacaguuuucugcuuu

SEQ ID NO: 709653 - RNA, 22 nt, Homo sapiens
ccuggacaguuuucugcuuuaa

SEQ ID NO: 709654 - RNA, 14 nt, Homo sapiens
ccuggcuauguccu

SEQ ID NO: 709655 - RNA, 16 nt, Homo sapiens
ccuggucccaagacag

SEQ ID NO: 709656 - RNA, 20 nt, Homo sapiens
ccuguaccccagcacuugug

SEQ ID NO: 709657 - RNA, 14 nt, Homo sapiens
ccugugaaauacca

SEQ ID NO: 709658 - RNA, 15 nt, Homo sapiens
ccuuagcuggcauua

SEQ ID NO: 709659 - RNA, 14 nt, Homo sapiens
ccuugaacugucua

SEQ ID NO: 709660 - RNA, 16 nt, Homo sapiens
ccuuggcagcccugau

SEQ ID NO: 709661 - RNA, 17 nt, Homo sapiens
ccuuucuucagcucuga

SEQ ID NO: 709662 - RNA, 17 nt, Homo sapiens
ccuuuggaaugcuguau

SEQ ID NO: 709663 - RNA, 16 nt, Homo sapiens
ccuuuggggacuuuuc

SEQ ID NO: 709664 - RNA, 14 nt, Homo sapiens
ccuuuggggagcag

SEQ ID NO: 709665 - RNA, 14 nt, Homo sapiens
cgaaacacacaaac

SEQ ID NO: 709666 - RNA, 23 nt, Homo sapiens
cgauucucuugccucaaccuccc

SEQ ID NO: 709667 - RNA, 16 nt, Homo sapiens
cgcccuggacugugug

SEQ ID NO: 709668 - RNA, 20 nt, Homo sapiens
cgcccuggacugugugcuca

SEQ ID NO: 709669 - RNA, 11 nt, Homo sapiens
cgcguauuuca

SEQ ID NO: 709670 - RNA, 17 nt, Homo sapiens
cggacaguuuauuuguu

SEQ ID NO: 709671 - RNA, 17 nt, Homo sapiens
cggcaucaggcuuucuu

SEQ ID NO: 709672 - RNA, 14 nt, Homo sapiens
cggcucacugcaac

SEQ ID NO: 709673 - RNA, 22 nt, Homo sapiens
cggugcuugauagaaaugccaa

SEQ ID NO: 709674 - RNA, 15 nt, Homo sapiens
cgucagcugggacac

SEQ ID NO: 709675 - RNA, 14 nt, Homo sapiens
cgugaccagugcug

SEQ ID NO: 709676 - RNA, 13 nt, Homo sapiens
cuaaaacaucuca

SEQ ID NO: 709677 - RNA, 21 nt, Homo sapiens
cuaaacacgugacacaaacac

SEQ ID NO: 709678 - RNA, 14 nt, Homo sapiens
cuaaacugagacaa

SEQ ID NO: 709679 - RNA, 16 nt, Homo sapiens
cuaaauaccucaauca

SEQ ID NO: 709680 - RNA, 18 nt, Homo sapiens
cuaaggaagauuacucag

SEQ ID NO: 709681 - RNA, 15 nt, Homo sapiens
cuaaucagcucccuu

SEQ ID NO: 709682 - RNA, 17 nt, Homo sapiens
cuaauuggcaugaaggu

SEQ ID NO: 709683 - RNA, 19 nt, Homo sapiens
cuaauuggcaugaaggugu

SEQ ID NO: 709684 - RNA, 21 nt, Homo sapiens
cuaccaaagcaccuuagcugg

SEQ ID NO: 709685 - RNA, 15 nt, Homo sapiens
cuaccaagcugugac

SEQ ID NO: 709686 - RNA, 14 nt, Homo sapiens
cuacccuguugcuu

SEQ ID NO: 709687 - RNA, 14 nt, Homo sapiens
cuaccuccaaagcu

SEQ ID NO: 709688 - RNA, 19 nt, Homo sapiens
cuaccuggucucuccuugu

SEQ ID NO: 709689 - RNA, 12 nt, Homo sapiens
cuacuccaaaau

SEQ ID NO: 709690 - RNA, 18 nt, Homo sapiens
cuacuuugauaugacugu

SEQ ID NO: 709691 - RNA, 15 nt, Homo sapiens
uggggggggugcugg

SEQ ID NO: 709692 - RNA, 16 nt, Homo sapiens
uggguaacugucaagu

SEQ ID NO: 709693 - RNA, 16 nt, Homo sapiens
uggguugaaagccaag

SEQ ID NO: 709694 - RNA, 17 nt, Homo sapiens
ugguagccucacuuuua

SEQ ID NO: 709695 - RNA, 19 nt, Homo sapiens
uggucuccucugauuauca

SEQ ID NO: 709696 - RNA, 21 nt, Homo sapiens
uggugucaguaguuuuacuga

SEQ ID NO: 709697 - RNA, 13 nt, Homo sapiens
uggugugcugcuu

SEQ ID NO: 709698 - RNA, 16 nt, Homo sapiens
ugguugaugccaaaaa

SEQ ID NO: 709699 - RNA, 17 nt, Homo sapiens
ugguuuuguaacuuguu

SEQ ID NO: 709700 - RNA, 19 nt, Homo sapiens
uguaaagcuaaaauaaaga

SEQ ID NO: 709701 - RNA, 18 nt, Homo sapiens
uguaagguggucacuguu

SEQ ID NO: 709702 - RNA, 13 nt, Homo sapiens
uguaaucccagca

SEQ ID NO: 709703 - RNA, 22 nt, Homo sapiens
uguaaucccagcaugcugagau

SEQ ID NO: 709704 - RNA, 23 nt, Homo sapiens
uguaauuuugaguacagaauuca

SEQ ID NO: 709705 - RNA, 19 nt, Homo sapiens
uguacauauuagaaaggga

SEQ ID NO: 709706 - RNA, 19 nt, Homo sapiens
uguaccaagccccuuggcc

SEQ ID NO: 709707 - RNA, 14 nt, Homo sapiens
uguacuaaagccaa

SEQ ID NO: 709708 - RNA, 20 nt, Homo sapiens
uguagaaugauuucaugcua

SEQ ID NO: 709709 - RNA, 15 nt, Homo sapiens
uguagcuuugcucuu

SEQ ID NO: 709710 - RNA, 17 nt, Homo sapiens
uguaggcauugcaugaa

SEQ ID NO: 709711 - RNA, 13 nt, Homo sapiens
uguaucuaugcau

SEQ ID NO: 709712 - RNA, 19 nt, Homo sapiens
ugucauuguuauauaauca

SEQ ID NO: 709713 - RNA, 22 nt, Homo sapiens
uguccuuucuagagcacugcca

SEQ ID NO: 709714 - RNA, 17 nt, Homo sapiens
ugucugcucaguaauuu

SEQ ID NO: 709715 - RNA, 19 nt, Homo sapiens
ugugaaauaccaaccugaa

SEQ ID NO: 709716 - RNA, 21 nt, Homo sapiens
ugugaccaaaaguuacauguu

SEQ ID NO: 709717 - RNA, 21 nt, Homo sapiens
ugugaguugcacagcuaugaa

SEQ ID NO: 709718 - RNA, 21 nt, Homo sapiens
uguggaucaaccaucgcuuua

SEQ ID NO: 709719 - RNA, 22 nt, Homo sapiens
ugugggagaccggccugccagg

SEQ ID NO: 709720 - RNA, 14 nt, Homo sapiens
ugugguuagaaaag

SEQ ID NO: 709721 - RNA, 15 nt, Homo sapiens
ugugugcgucacugu

SEQ ID NO: 709722 - RNA, 17 nt, Homo sapiens
uguugaaaauguucaga

SEQ ID NO: 709723 - RNA, 17 nt, Homo sapiens
uguugagcaucacagaa

SEQ ID NO: 709724 - RNA, 20 nt, Homo sapiens
uguugcuuuucacaaaucau

SEQ ID NO: 709725 - RNA, 17 nt, Homo sapiens
uguuuaaaaaguaauaa

SEQ ID NO: 709726 - RNA, 20 nt, Homo sapiens
uguuucaaacaaaaagucau

SEQ ID NO: 709727 - RNA, 22 nt, Homo sapiens
uguuucaaacaaaaagucauaa

SEQ ID NO: 709728 - RNA, 23 nt, Homo sapiens
uguuuccaugggucaaagccggu

SEQ ID NO: 709729 - RNA, 19 nt, Homo sapiens
uguuuguguggauacccag

SEQ ID NO: 709730 - RNA, 11 nt, Homo sapiens
uguuuuuaccu

SEQ ID NO: 709731 - RNA, 20 nt, Homo sapiens
uuaaaaagguuuacagaauu

SEQ ID NO: 709732 - RNA, 19 nt, Homo sapiens
uuaaaauagcaaaagaaga

SEQ ID NO: 709733 - RNA, 18 nt, Homo sapiens
uuaaaccguacacugugu

SEQ ID NO: 709734 - RNA, 12 nt, Homo sapiens
uuaaacugugua

SEQ ID NO: 709735 - RNA, 17 nt, Homo sapiens
uuaaaggaauaaggugu

SEQ ID NO: 709736 - RNA, 16 nt, Homo sapiens
uuaaauguguguaaaa

SEQ ID NO: 709737 - RNA, 12 nt, Homo sapiens
uuaacugaaugc

SEQ ID NO: 709738 - RNA, 23 nt, Homo sapiens
uuaauaugcuguggggcauagaa

SEQ ID NO: 709739 - RNA, 12 nt, Homo sapiens
uuacacauguau

SEQ ID NO: 709740 - RNA, 18 nt, Homo sapiens
uuacacuugguuacucaa

SEQ ID NO: 709741 - RNA, 12 nt, Homo sapiens
uuacaugauuca

SEQ ID NO: 709742 - RNA, 13 nt, Homo sapiens
uuacaugauucau

SEQ ID NO: 709743 - RNA, 12 nt, Homo sapiens
uuacaugcauua

SEQ ID NO: 709744 - RNA, 13 nt, Homo sapiens
uuacaugcauuac

SEQ ID NO: 709745 - RNA, 22 nt, Homo sapiens
uuacaugcauuacugcaugcac

SEQ ID NO: 709746 - RNA, 21 nt, Homo sapiens
uuaccaggcaccaaaagaagu

SEQ ID NO: 709747 - RNA, 20 nt, Homo sapiens
uuaccucuauauaccaaagc

SEQ ID NO: 709748 - RNA, 21 nt, Homo sapiens
uuacuauaagaacuuugagcu

SEQ ID NO: 709749 - RNA, 17 nt, Homo sapiens
uuagcaauugacuguca

SEQ ID NO: 709750 - RNA, 17 nt, Homo sapiens
uuagccauuugacuaau

SEQ ID NO: 709751 - RNA, 15 nt, Homo sapiens
uuagcugucugcuca

SEQ ID NO: 709752 - RNA, 16 nt, Homo sapiens
uuagcuucucugccaa

SEQ ID NO: 709753 - RNA, 21 nt, Homo sapiens
uuagcuucucugccaagcccu

SEQ ID NO: 709754 - RNA, 20 nt, Homo sapiens
uuaguggcucaacauugugu

SEQ ID NO: 709755 - RNA, 14 nt, Homo sapiens
uuaguguacaugaa

SEQ ID NO: 709756 - RNA, 16 nt, Homo sapiens
uuauauuacacuacac

SEQ ID NO: 709757 - RNA, 17 nt, Homo sapiens
uuauauugauaagaucu

SEQ ID NO: 709758 - RNA, 21 nt, Homo sapiens
uuaucaacuuccuaaauauua

SEQ ID NO: 709759 - RNA, 16 nt, Homo sapiens
uuaucaugcauguccu

SEQ ID NO: 709760 - RNA, 21 nt, Homo sapiens
uuaugaaaaauaagucacuua

SEQ ID NO: 709761 - RNA, 13 nt, Homo sapiens
uuaugcugugaca

SEQ ID NO: 709762 - RNA, 19 nt, Homo sapiens
uuaugucucuucugagcua

SEQ ID NO: 709763 - RNA, 14 nt, Homo sapiens
uuauuaacauugau
